United States Patent 10,706,955 (BIOINFORMATIC PROCESSES FOR DETERMINATION OF PEPTIDE BINDING) - sequence listing, part 21

SEQ ID NO: 807094 - protein, 25 aa, Mycobacterium
EGAHGLLVVTPYYSKPPQAGLVAHF

SEQ ID NO: 807095 - protein, 25 aa, Mycobacterium
EGAHGLLVVTPYYSKPPQSGLIAHF

SEQ ID NO: 807096 - protein, 25 aa, Mycobacterium
EGAHGLLVVTPYYSKPPQSGLLAHF

SEQ ID NO: 807097 - protein, 18 aa, Mycobacterium
EGAIWRLWRAGIVDIRGR

SEQ ID NO: 807098 - protein, 31 aa, Mycobacterium
EGAKGKAKEVFGAVTGRDDMKREGQAQQDKA

SEQ ID NO: 807099 - protein, 23 aa, Mycobacterium
EGAKPFDFVFHGGSGSLKSEIEE

SEQ ID NO: 807100 - protein, 22 aa, Mycobacterium
EGALIMSRVLRSISPFDTAISM

SEQ ID NO: 807101 - protein, 25 aa, Mycobacterium
EGALKLKELTYRWAEHYPAGELKHG

SEQ ID NO: 807102 - protein, 26 aa, Mycobacterium
EGALKLKELTYRWAEHYPAGELKHGP

SEQ ID NO: 807103 - protein, 17 aa, Mycobacterium
EGALLPDQLYTEAGASI

SEQ ID NO: 807104 - protein, 26 aa, Mycobacterium
EGALRRSVKFPAFLDGIDAVRRVAEH

SEQ ID NO: 807105 - protein, 24 aa, Mycobacterium
EGALVGLAWVDARLVAAAVSFDVC

SEQ ID NO: 807106 - protein, 26 aa, Mycobacterium
EGANLVHAPLWGLARVAAAEHPHLWG

SEQ ID NO: 807107 - protein, 28 aa, Mycobacterium
EGAPAMVHVDLYRLLDQSSVDLLAELDS

SEQ ID NO: 807108 - protein, 23 aa, Mycobacterium
EGAPIVLTYPSSVVGPAYMTNPG

SEQ ID NO: 807109 - protein, 25 aa, Mycobacterium
EGAPRKLELEAPFDGGAVLVQGATE

SEQ ID NO: 807110 - protein, 27 aa, Mycobacterium
EGAPRPDLILLDLNLPKYDGRQLLEQI

SEQ ID NO: 807111 - protein, 24 aa, Mycobacterium
EGAPVIPVPGSAPLVVTPPAPPGT

SEQ ID NO: 807112 - protein, 26 aa, Mycobacterium
EGAQVFFDYPPHPRTIAHTVRGFDEV

SEQ ID NO: 807113 - protein, 24 aa, Mycobacterium
EGARGLYQWGPPPPASFLHPEDLA

SEQ ID NO: 807114 - protein, 26 aa, Mycobacterium
EGARIELGLRHFLADGFGAFTTNFED

SEQ ID NO: 807115 - protein, 31 aa, Mycobacterium
EGARIRMLQLPGFGAPRPLRVPLLIAADGSR

SEQ ID NO: 807116 - protein, 24 aa, Mycobacterium
EGARRPRVAAPGRIVLLTSGTTGK

SEQ ID NO: 807117 - protein, 22 aa, Mycobacterium
EGARTWIGLAGTMTTLSALAHN

SEQ ID NO: 807118 - protein, 27 aa, Mycobacterium
EGASFDPAWWRRAAELGWTGLLVPEEL

SEQ ID NO: 807119 - protein, 25 aa, Mycobacterium
EGASTNFEWLRDEGYHQLLSRTVLV

SEQ ID NO: 807120 - protein, 20 aa, Mycobacterium
EGATRWAAVRRAITELIREG

SEQ ID NO: 807121 - protein, 25 aa, Mycobacterium
EGAVPHPIDPILLGRTVLNLLRTPV

SEQ ID NO: 807122 - protein, 24 aa, Mycobacterium
EGAVRVLELHPMFNPAAYVSAEFG

SEQ ID NO: 807123 - protein, 27 aa, Mycobacterium
EGCFWGAERGFWKLPGVYSTAVGYAGG

SEQ ID NO: 807124 - protein, 25 aa, Mycobacterium
EGCLDFVFIDHWKDIYLDDLQRLLE

SEQ ID NO: 807125 - protein, 17 aa, Mycobacterium
EGDAFGRLILLYDPEGS

SEQ ID NO: 807126 - protein, 21 aa, Mycobacterium
EGDAFIYQVKSIQLRNPDLHI

SEQ ID NO: 807127 - protein, 22 aa, Mycobacterium
EGDALYLPRGWVHAAQALDTTS

SEQ ID NO: 807128 - protein, 30 aa, Mycobacterium
EGDANLVAMPLFHVGGIGYALFGIRAGVPT

SEQ ID NO: 807129 - protein, 25 aa, Mycobacterium
EGDCPSFITVIPDPNAKRLKHIPDD

SEQ ID NO: 807130 - protein, 21 aa, Mycobacterium
EGDEVWPGILGFDDTVLPQLE

SEQ ID NO: 807131 - protein, 20 aa, Mycobacterium
EGDFFGVIVQLPGASGVVRD

SEQ ID NO: 807132 - protein, 33 aa, Mycobacterium
EGDHVILAFIPACGECPPCLKGFRSLCDRGAVL

SEQ ID NO: 807133 - protein, 22 aa, Mycobacterium
EGDIWRMPIVKDAAIRDWVKLA

SEQ ID NO: 807134 - protein, 21 aa, Mycobacterium
EGDIYLALYGSWKDPADEAKY

SEQ ID NO: 807135 - protein, 23 aa, Mycobacterium
EGDKVIVHPLITCGLCRACRSGD

SEQ ID NO: 807136 - protein, 21 aa, Mycobacterium
EGDKVVLFYSSANWDTTVFTN

SEQ ID NO: 807137 - protein, 23 aa, Mycobacterium
EGDLGSILRWFVAGTLGVGPVEN

SEQ ID NO: 807138 - protein, 17 aa, Mycobacterium
EGDNVFVALSWSKHPAP

SEQ ID NO: 807139 - protein, 22 aa, Mycobacterium
EGDNVFVALSWSKHPAPQNFEE

SEQ ID NO: 807140 - protein, 23 aa, Mycobacterium
EGDPLQAFWTQVVRLRDLLKFDF

SEQ ID NO: 807141 - protein, 17 aa, Mycobacterium
EGDPLWTDDGVQWGLEY

SEQ ID NO: 807142 - protein, 19 aa, Mycobacterium
EGDPRMFRVIRGQVAIATT

SEQ ID NO: 807143 - protein, 22 aa, Mycobacterium
EGDRWVQLPLLSPQDGYVMVDT

SEQ ID NO: 807144 - protein, 29 aa, Mycobacterium
EGDRYLQVNPYFHTFGLKAGLVTSFLRGA

SEQ ID NO: 807145 - protein, 17 aa, Mycobacterium
EGDRYRYRDVLSGLFAT

SEQ ID NO: 807146 - protein, 29 aa, Mycobacterium
EGDSIPSVFIPELLALHARGRFPIERLVT

SEQ ID NO: 807147 - protein, 20 aa, Mycobacterium
EGDVLLLLPGSGHRDERVFE

SEQ ID NO: 807148 - protein, 24 aa, Mycobacterium
EGDWQSKHHFLRDNARLLRELSEL

SEQ ID NO: 807149 - protein, 24 aa, Mycobacterium
EGDWTVRHAVAAWPALCSGLRAEA

SEQ ID NO: 807150 - protein, 23 aa, Mycobacterium
EGDYLRQHVHLGYAVTVHAAQGV

SEQ ID NO: 807151 - protein, 24 aa, Mycobacterium
EGEAVLRVAPLPCPTFDGEPTIGA

SEQ ID NO: 807152 - protein, 29 aa, Mycobacterium
EGEFIKGFASPFTLLVIADLLGVPPEDRQ

SEQ ID NO: 807153 - protein, 19 aa, Mycobacterium
EGEGFPVVRAFAGIGTAAL

SEQ ID NO: 807154 - protein, 30 aa, Mycobacterium
EGEIDDGLLWPEPWLALNPAFEPGGSVGEL

SEQ ID NO: 807155 - protein, 24 aa, Mycobacterium
EGEIDLLEFFAELTIYTSTACLIG

SEQ ID NO: 807156 - protein, 23 aa, Mycobacterium
EGEIDLLEFFAELTIYTSTSCLI

SEQ ID NO: 807157 - protein, 19 aa, Mycobacterium
EGEIIFYQSAPGQVLGFFL

SEQ ID NO: 807158 - protein, 25 aa, Mycobacterium
EGEIRLGFLHTFGPTLIAGLIAGFA

SEQ ID NO: 807159 - protein, 26 aa, Mycobacterium
EGELETPWSSLLPVGSRFAAGNGVVC

SEQ ID NO: 807160 - protein, 23 aa, Mycobacterium
EGELPRLFVVTRQAQRVRPEDEI

SEQ ID NO: 807161 - protein, 25 aa, Mycobacterium
EGELRPQLLDRFGFAVDIHASRDVE

SEQ ID NO: 807162 - protein, 20 aa, Mycobacterium
EGEREVGFRSALRGSGRPVI

SEQ ID NO: 807163 - protein, 19 aa, Mycobacterium
EGERLVPWARRILADRDSL

SEQ ID NO: 807164 - protein, 17 aa, Mycobacterium
EGERPVVFLCRSGARSI

SEQ ID NO: 807165 - protein, 24 aa, Mycobacterium
EGEVGLRAFFDRFPDARLAGDPVR

SEQ ID NO: 807166 - protein, 22 aa, Mycobacterium
EGEVLVPFVRAIVTSVSLEDGV

SEQ ID NO: 807167 - protein, 17 aa, Mycobacterium
EGEYRAVQRIGGRIWRV

SEQ ID NO: 807168 - protein, 20 aa, Mycobacterium
EGFALLPNLAPARAAIIAPS

SEQ ID NO: 807169 - protein, 25 aa, Mycobacterium
EGFALLRDDFTFWTLYTRTACDKDT

SEQ ID NO: 807170 - protein, 17 aa, Mycobacterium
EGFASRPFLASSPLAPT

SEQ ID NO: 807171 - protein, 27 aa, Mycobacterium
EGFDALRRRHLVPQPPYGQGVAAAAGG

SEQ ID NO: 807172 - protein, 25 aa, Mycobacterium
EGFEVQLMLAAVPTPVVAFAVRHMP

SEQ ID NO: 807173 - protein, 20 aa, Mycobacterium
EGFEWFVHQMCEITATNRGL

SEQ ID NO: 807174 - protein, 18 aa, Mycobacterium
EGFFLDRRDPNNLLAMLW

SEQ ID NO: 807175 - protein, 18 aa, Mycobacterium
EGFKHRIADARLLLNEAL

SEQ ID NO: 807176 - protein, 18 aa, Mycobacterium
EGFKHRIADARLLLNQAL

SEQ ID NO: 807177 - protein, 18 aa, Mycobacterium
EGFLLEHPGVAQAAVVGV

SEQ ID NO: 807178 - protein, 23 aa, Mycobacterium
EGFLPTLLEWCRRNDVVFIADEV

SEQ ID NO: 807179 - protein, 23 aa, Mycobacterium
EGFPSLSAIILNGGLKLHPRIAD

SEQ ID NO: 807180 - protein, 26 aa, Mycobacterium
EGFRAFETLLRYDRPYSGYAPIMGTP

SEQ ID NO: 807181 - protein, 24 aa, Mycobacterium
EGFVDLLKALRPSLTTPARIAKYL

SEQ ID NO: 807182 - protein, 27 aa, Mycobacterium
EGFVGLRVVPWLWNAPPTDRRYYPLFA

SEQ ID NO: 807183 - protein, 25 aa, Mycobacterium
EGGALVIVDLPRLAPAGLPVQPASP

SEQ ID NO: 807184 - protein, 21 aa, Mycobacterium
EGGARYVTFAKGAMYWSPETG

SEQ ID NO: 807185 - protein, 31 aa, Mycobacterium
EGGEGPLVGIWRRAPLQALARLHMLAAADQV

SEQ ID NO: 807186 - protein, 31 aa, Mycobacterium; identical to SEQ ID NO: 114168

SEQ ID NO: 807187 - protein, 23 aa, Mycobacterium
EGGEQVFLCPLELASFTMATAED

SEQ ID NO: 807188 - protein, 28 aa, Mycobacterium
EGGFHLCAAWLVEAYLLIGARSQAELLF

SEQ ID NO: 807189 - protein, 17 aa, Mycobacterium
EGGGRLVVELTPEEAAA

SEQ ID NO: 807190 - protein, 23 aa, Mycobacterium
EGGIRVVGFLTWPGFERQRQIGT

SEQ ID NO: 807191 - protein, 24 aa, Mycobacterium
EGGLLLAHHPLLLRGVDTVAASTP

SEQ ID NO: 807192 - protein, 28 aa, Mycobacterium
EGGLMACLAYTWKQVVTTPLFAENELAL

SEQ ID NO: 807193 - protein, 24 aa, Mycobacterium
EGGMHSLWTDILARQVFAPHVPHD

SEQ ID NO: 807194 - protein, 22 aa, Mycobacterium
EGGMLIPEALDLVYSLGFTLTG

SEQ ID NO: 807195 - protein, 22 aa, Mycobacterium
EGGNFVVPVWRSMYEGMQPGGY

SEQ ID NO: 807196 - protein, 27 aa, Mycobacterium
EGGPAPVLQWLIYPRTDFTAKTRSLSL

SEQ ID NO: 807197 - protein, 26 aa, Mycobacterium
EGGPHVMIFPNLFIAEIQVFNIQPVS

SEQ ID NO: 807198 - protein, 28 aa, Mycobacterium
EGGQMPIHMRLPKLKGFRNRFRTEYGVV

SEQ ID NO: 807199 - protein, 23 aa, Mycobacterium
EGGREILVPFVGAIVTSVSRQNA

SEQ ID NO: 807200 - protein, 28 aa, Mycobacterium
EGGRHYNPGWNLAIDLRNMLLVSECVAK

SEQ ID NO: 807201 - protein, 27 aa, Mycobacterium
EGGRIFNPGWHLAIDMRNMLLVSECVA

SEQ ID NO: 807202 - protein, 24 aa, Mycobacterium
EGGRLLEFDLSGGPPRVLLENVPS

SEQ ID NO: 807203 - protein, 34 aa, Mycobacterium
EGGSVRNWPWRRWALSWTANTYARLALGIGVHDI

SEQ ID NO: 807204 - protein, 27 aa, Mycobacterium
EGGSYIFPQLPALRVPPAEFRNILRSD

SEQ ID NO: 807205 - protein, 24 aa, Mycobacterium
EGGTFHQLPFALTPGPPIRTTALQ

SEQ ID NO: 807206 - protein, 27 aa, Mycobacterium
EGGTFLQRAIFHLPGLTAAIDELQRDF

SEQ ID NO: 807207 - protein, 27 aa, Mycobacterium
EGGTGLLDLLNRLGITPLPNTAGCRSA

SEQ ID NO: 807208 - protein, 25 aa, Mycobacterium
EGGWPPTGWFEGWANGLDVFDVEPG

SEQ ID NO: 807209 - protein, 23 aa, Mycobacterium
EGHKWAMLTAYDYSTARIFDEAG

SEQ ID NO: 807210 - protein, 24 aa, Mycobacterium
EGHKWAMLTAYDYSTARIFDEAGI

SEQ ID NO: 807211 - protein, 21 aa, Mycobacterium
EGHKWAMLTCYDYSSARVFDD

SEQ ID NO: 807212 - protein, 18 aa, Mycobacterium
EGHLGLPADFLIGSDGRV

SEQ ID NO: 807213 - protein, 24 aa, Mycobacterium
EGHQEELWRYIRTGDVATVSTDHC

SEQ ID NO: 807214 - protein, 24 aa, Mycobacterium
EGHRVLVDRLWPRGLRKDDPRIGQ

SEQ ID NO: 807215 - protein, 18 aa, Mycobacterium
EGHRWRNPVWRHADGSFA

SEQ ID NO: 807216 - protein, 20 aa, Mycobacterium
EGHWPLYEIGARLTRLITST

SEQ ID NO: 807217 - protein, 23 aa, Mycobacterium
EGIAIDMLVPYRIDSDGATINVQ

SEQ ID NO: 807218 - protein, 21 aa, Mycobacterium
EGICHRLHTASLRTVVIAPDP

SEQ ID NO: 807219 - protein, 24 aa, Mycobacterium
EGIDAFLRRFLLPALLADTHSCIA

SEQ ID NO: 807220 - protein, 18 aa, Mycobacterium
EGIEGRVPFRGPLGTVIH

SEQ ID NO: 807221 - protein, 20 aa, Mycobacterium
EGIEGRVPFRGPLNSVIHQL

SEQ ID NO: 807222 - protein, 18 aa, Mycobacterium
EGIEGRVPFRGPLSTVIH

SEQ ID NO: 807223 - protein, 29 aa, Mycobacterium
EGIGEQYELVLYWWPRADLSGVENAILAA

SEQ ID NO: 807224 - protein, 18 aa, Mycobacterium
EGILTLRMAEFGEAGPRE

SEQ ID NO: 807225 - protein, 17 aa, Mycobacterium
EGIRALADLWRSLSRQD

SEQ ID NO: 807226 - protein, 22 aa, Mycobacterium
EGISLNAWLVRAAVAAAEKRTG

SEQ ID NO: 807227 - protein, 23 aa, Mycobacterium
EGISLSTLALNCDILHPVDGDVV

SEQ ID NO: 807228 - protein, 36 aa, Mycobacterium
EGISVNVTLIFSVERYRLVMDAYLQGLEKAKEAGHD

SEQ ID NO: 807229 - protein, 32 aa, Mycobacterium
EGITAMHFVPSLLGLFLSLPGVNQWRTLERVP

SEQ ID NO: 807230 - protein, 30 aa, Mycobacterium
EGITDYDPIWPLHGIRIIPGPSSLWLDATG

SEQ ID NO: 807231 - protein, 26 aa, Mycobacterium
EGITSYKMFMAYPGVFYSDDAQIVRA

SEQ ID NO: 807232 - protein, 25 aa, Mycobacterium
EGITWLAGHLQQRWARNSGGLLLVT

SEQ ID NO: 807233 - protein, 17 aa, Mycobacterium
EGITWLASHLQQRWARN

SEQ ID NO: 807234 - protein, 25 aa, Mycobacterium
EGIVAGILTQLFEFDTLALDHRNTA

SEQ ID NO: 807235 - protein, 19 aa, Mycobacterium
EGIVRRFFAGEYEFAVARL

SEQ ID NO: 807236 - protein, 22 aa, Mycobacterium
EGIYEEMWAADVSAMVGYHGGA

SEQ ID NO: 807237 - protein, 24 aa, Mycobacterium
EGKDPVLYVVGRKALGYFSFRQRT

SEQ ID NO: 807238 - protein, 20 aa, Mycobacterium
EGKFLAVVPHDEAAAAVAAL

SEQ ID NO: 807239 - protein, 27 aa, Mycobacterium
EGKGFGYILHGLNPERMLIAAEALGIG

SEQ ID NO: 807240 - protein, 27 aa, Mycobacterium
EGKGFQYILDGLNPERMLIAAEALGIG

SEQ ID NO: 807241 - protein, 35 aa, Mycobacterium
EGKIGAIRYARSRGLPVLGLCLGLQCIVIEAARSA

SEQ ID NO: 807242 - protein, 21 aa, Mycobacterium
EGKLGAIRYARKRRVPILGLC

SEQ ID NO: 807243 - protein, 22 aa, Mycobacterium
EGKLKGILKYYDAPIVSSDIVT

SEQ ID NO: 807244 - protein, 21 aa, Mycobacterium
EGKLPPDEFLTQAIPAGRVGA

SEQ ID NO: 807245 - protein, 24 aa, Mycobacterium
EGKQLLPNLLSIEAPVIAAINGPA

SEQ ID NO: 807246 - protein, 24 aa, Mycobacterium
EGKQPVLYVVGRKALAYYTFRHWD

SEQ ID NO: 807247 - protein, 24 aa, Mycobacterium
EGKQPVLYVVGRKALAYYTFRNWD

SEQ ID NO: 807248 - protein, 23 aa, Mycobacterium
EGKSSVRTWLYRIATNTCLTALE

SEQ ID NO: 807249 - protein, 25 aa, Mycobacterium
EGKTDPYYHGIARAWQLEEEATHRA

SEQ ID NO: 807250 - protein, 20 aa, Mycobacterium
EGLAAMRPALTTTPRILHTE

SEQ ID NO: 807251 - protein, 18 aa, Mycobacterium
EGLAELVDLGIEPAIAVV

SEQ ID NO: 807252 - protein, 19 aa, Mycobacterium
EGLARFKYDFPDGSEYTLN

SEQ ID NO: 807253 - protein, 25 aa, Mycobacterium
EGLATVIPFHRAVVSDPAFIGDEDG

SEQ ID NO: 807254 - protein, 25 aa, Mycobacterium
EGLATVIPFHRAVVSDPAFIGDEHG

SEQ ID NO: 807255 - protein, 22 aa, Mycobacterium
EGLAVGPTAPLFLYAHNDQELH

SEQ ID NO: 807256 - protein, 24 aa, Mycobacterium
EGLDFLYRRGPYADAPRPDLILLD

SEQ ID NO: 807257 - protein, 24 aa, Mycobacterium
EGLDYPKVVLVTGACRFLGGYLTA

SEQ ID NO: 807258 - protein, 18 aa, Mycobacterium
EGLERIRFTSPHPAEFTD

SEQ ID NO: 807259 - protein, 32 aa, Mycobacterium; identical to SEQ ID NO: 119788

SEQ ID NO: 807260 - protein, 17 aa, Mycobacterium
EGLGEIFAAAGAQWRQA

SEQ ID NO: 807261 - protein, 20 aa, Mycobacterium
EGLGQLYIRLLTDNFEEAVA

SEQ ID NO: 807262 - protein, 22 aa, Mycobacterium
EGLGRPVRRIPMSPKALLAVGR

SEQ ID NO: 807263 - protein, 25 aa, Mycobacterium
EGLGRRVRRVRLSPGALRGIGRLAD

SEQ ID NO: 807264 - protein, 17 aa, Mycobacterium
EGLHGVAFDRPLARLKE

SEQ ID NO: 807265 - protein, 18 aa, Mycobacterium
EGLHRRQLQRIEPSLEAV

SEQ ID NO: 807266 - protein, 18 aa, Mycobacterium
EGLHVLGWRNVPTDDSSL

SEQ ID NO: 807267 - protein, 24 aa, Mycobacterium
EGLIDAIVGLWRAPVHMAAAGGPT

SEQ ID NO: 807268 - protein, 19 aa, Mycobacterium
EGLINRIDEYFDPAELAPL

SEQ ID NO: 807269 - protein, 18 aa, Mycobacterium
EGLKLWTTNGVVAELLVV

SEQ ID NO: 807270 - protein, 20 aa, Mycobacterium
EGLLAGVYLNLAPVIVDAGA

SEQ ID NO: 807271 - protein, 17 aa, Mycobacterium
EGLLGYLPPEAQDRLLD

SEQ ID NO: 807272 - protein, 17 aa, Mycobacterium
EGLLPVLRTASPTELLT

SEQ ID NO: 807273 - protein, 20 aa, Mycobacterium
EGLLPYLPPEAQDRLFDNIT

SEQ ID NO: 807274 - protein, 31 aa, Mycobacterium
EGLLRAAGLLLLWARGYVEPVLAPRSPRHIA

SEQ ID NO: 807275 - protein, 17 aa, Mycobacterium
EGLPFVGPAGRLLQRAL

SEQ ID NO: 807276 - protein, 26 aa, Mycobacterium
EGLPTGAALLVVKRGPNAGSRFLLDR

SEQ ID NO: 807277 - protein, 29 aa, Mycobacterium
EGLPWAVFSPFTPYLRSRGVPPFGPGLRP

SEQ ID NO: 807278 - protein, 22 aa, Mycobacterium
EGLQAGLRYLARQSVAIGGGTT

SEQ ID NO: 807279 - protein, 19 aa, Mycobacterium
EGLQRWCDHLVTMVRETQG

SEQ ID NO: 807280 - protein, 24 aa, Mycobacterium
EGLRAERLLAPMFDNTLPLPDLSK

SEQ ID NO: 807281 - protein, 25 aa, Mycobacterium
EGLRKLFRQFSFPGGIPSHVAAQTP

SEQ ID NO: 807282 - protein, 24 aa, Mycobacterium
EGLRSRFTRSINFPSYAPSELVEI

SEQ ID NO: 807283 - protein, 21 aa, Mycobacterium
EGLSDIPSILPAAPQGGGLTP

SEQ ID NO: 807284 - protein, 17 aa, Mycobacterium
EGLTFSEASERDPELHR

SEQ ID NO: 807285 - protein, 24 aa, Mycobacterium
EGLTTSFPMGALSKAFVAYDKPFW

SEQ ID NO: 807286 - protein, 26 aa, Mycobacterium
EGLTVPLFPNLLTQASPYAWVGMSWF

SEQ ID NO: 807287 - protein, 25 aa, Mycobacterium
EGLVAQQPRRGFVVLPVTKRDLADV

SEQ ID NO: 807288 - protein, 17 aa, Mycobacterium
EGLVLTAGALVDLGSPL

SEQ ID NO: 807289 - protein, 19 aa, Mycobacterium
EGLVYSLEPLRFAHATSSA

SEQ ID NO: 807290 - protein, 18 aa, Mycobacterium
EGLWAPHLGPELGGQGFG

SEQ ID NO: 807291 - protein, 19 aa, Mycobacterium
EGLYPVQHGYWLETMRAAA

SEQ ID NO: 807292 - protein, 22 aa, Mycobacterium
EGMAVAMIATLPPRGHFADATV

SEQ ID NO: 807293 - protein, 25 aa, Mycobacterium
EGMCSVTLWVVARWVSGEPVVMEPD

SEQ ID NO: 807294 - protein, 27 aa, Mycobacterium
EGMKDGSIDALFWSGGLPTSGITDLIV

SEQ ID NO: 807295 - protein, 19 aa, Mycobacterium
EGMMAFLEKRPPVFNQPKR

SEQ ID NO: 807296 - protein, 24 aa, Mycobacterium
EGMPKTMQPILNLAANLSCPLLGL

SEQ ID NO: 807297 - protein, 17 aa, Mycobacterium
EGMTFAEAANRDPDLHH

SEQ ID NO: 807298 - protein, 19 aa, Mycobacterium
EGMVFALETYWPTADGSSA

SEQ ID NO: 807299 - protein, 19 aa, Mycobacterium
EGMWKPGWIEFSGTALSVG

SEQ ID NO: 807300 - protein, 17 aa, Mycobacterium
EGMWRASPQFESWQAVM

SEQ ID NO: 807301 - protein, 24 aa, Mycobacterium
EGNAQNFRILTSLEPKVLDAQGNS

SEQ ID NO: 807302 - protein, 24 aa, Mycobacterium
EGNAQNFRILTSLEPKVLDSQGLS

SEQ ID NO: 807303 - protein, 17 aa, Mycobacterium
EGNAVCVGIAPDLFELD

SEQ ID NO: 807304 - protein, 26 aa, Mycobacterium
EGNDIVLVDFWASWCGPCRQFGPTFQ

SEQ ID NO: 807305 - protein, 27 aa, Mycobacterium
EGNDIVLVDFWASWCGPCRQFGPTFQA

SEQ ID NO: 807306 - protein, 24 aa, Mycobacterium
EGNFALVPLSLYFTEGKVKVEIAL

SEQ ID NO: 807307 - protein, 27 aa, Mycobacterium
EGNGFQYILDGLNPERMLIAAEALGIG

SEQ ID NO: 807308 - protein, 20 aa, Mycobacterium
EGNWVGGWTDFSGRQVTVGG

SEQ ID NO: 807309 - protein, 30 aa, Mycobacterium
EGNYLLLDQPAWRRVRRSLDQTWFVSADDS

SEQ ID NO: 807310 - protein, 17 aa, Mycobacterium
EGPARAWERGRFGAPYL

SEQ ID NO: 807311 - protein, 17 aa, Mycobacterium
EGPCPAIRIPLRGDIEV

SEQ ID NO: 807312 - protein, 32 aa, Mycobacterium
EGPELPAYPVYGLLVEFLAYTGLRAAEAAGLE

SEQ ID NO: 807313 - protein, 18 aa, Mycobacterium
EGPGLLRLTDERGRRFLV

SEQ ID NO: 807314 - protein, 18 aa, Mycobacterium
EGPLIQPVLSELGATMAS

SEQ ID NO: 807315 - protein, 29 aa, Mycobacterium
EGPLTDSYLLIWTTTPWTLPSNQAVAVGP

SEQ ID NO: 807316 - protein, 21 aa, Mycobacterium
EGPQRFTVVALDLGIKTNTPR

SEQ ID NO: 807317 - protein, 24 aa, Mycobacterium
EGPRLHANWTWAPSALDREQVTRL

SEQ ID NO: 807318 - protein, 22 aa, Mycobacterium
EGPRLLLLGGRSWKVTHIDWER

SEQ ID NO: 807319 - protein, 22 aa, Mycobacterium
EGPRTFDGLLDAILHGAATTKP

SEQ ID NO: 807320 - protein, 38 aa, Mycobacterium
EGPTQSTYYMIPTEHLPLLAPLRFIPYVGDPLAELLEP

SEQ ID NO: 807321 - protein, 23 aa, Mycobacterium
EGQAKLLPDPFIVAATQNPIEYE

SEQ ID NO: 807322 - protein, 25 aa, Mycobacterium
EGQGFIQLMTQLPQERLIVAVGAVA

SEQ ID NO: 807323 - protein, 27 aa, Mycobacterium
EGQGFKYILDGLNPERMLIAAEALGIG

SEQ ID NO: 807324 - protein, 19 aa, Mycobacterium
EGQPGELWIGGAGVALGYL

SEQ ID NO: 807325 - protein, 38 aa, Mycobacterium
EGQPGRFLLVTNFEYATPQFMFPGYNPDAPTRDQFDVE

SEQ ID NO: 807326 - protein, 21 aa, Mycobacterium
EGQRVLVDRVWPRGMRKDDPR

SEQ ID NO: 807327 - protein, 24 aa, Mycobacterium
EGQVRVIRDFLRHLPVEVDIETRE

SEQ ID NO: 807328 - protein, 17 aa, Mycobacterium
EGQWVAFPTVEQLEKAV

SEQ ID NO: 807329 - protein, 17 aa, Mycobacterium
EGRALFAANRALPWPED

SEQ ID NO: 807330 - protein, 23 aa, Mycobacterium
EGRALLDGLLARTTTPDKVYSHK

SEQ ID NO: 807331 - protein, 25 aa, Mycobacterium
EGRASLRTWLYRIATNRCLNARRSA

SEQ ID NO: 807332 - protein, 21 aa, Mycobacterium
EGRAWDPGLGNLWVYFDSEGC

SEQ ID NO: 807333 - protein, 19 aa, Mycobacterium
EGRFDYRWHDGARWTDQVS

SEQ ID NO: 807334 - protein, 27 aa, Mycobacterium
EGRGFYQLMQNLPQERLALGVGAVAAA

SEQ ID NO: 807335 - protein, 21 aa, Mycobacterium
EGRGIVLYMRGHEGRGIGLMH

SEQ ID NO: 807336 - protein, 19 aa, Mycobacterium
EGRGIVMRVPLEGGGRLVV

SEQ ID NO: 807337 - protein, 22 aa, Mycobacterium
EGRGIVMRVPLEGGGRLVVELT

SEQ ID NO: 807338 - protein, 24 aa, Mycobacterium
EGRGMGFTERPPVKPLIAAVEGYA

SEQ ID NO: 807339 - protein, 27 aa, Mycobacterium
EGRGWRWHTWHLYPLHPGGSGGTVVHT

SEQ ID NO: 807340 - protein, 35 aa, Mycobacterium
EGRINPDVKMNYLASPPLVIAYALAGSMDFDFESD

SEQ ID NO: 807341 - protein, 33 aa, Mycobacterium
EGRINPDVKMNYLASPPLVIAYALAGTMDFDFD

SEQ ID NO: 807342 - protein, 17 aa, Mycobacterium
EGRIWCAMVTPANPVAD

SEQ ID NO: 807343 - protein, 24 aa, Mycobacterium
EGRKHIVRRLLAEVGFPVQNLVRT

SEQ ID NO: 807344 - protein, 26 aa, Mycobacterium
EGRKRPVMLLTSDSAFLFHIAELETA

SEQ ID NO: 807345 - protein, 22 aa, Mycobacterium
EGRLFTRFLKMLPTNKAMIDEL

SEQ ID NO: 807346 - protein, 22 aa, Mycobacterium
EGRLHGFGFLYEAVLQLRHQAG

SEQ ID NO: 807347 - protein, 19 aa, Mycobacterium
EGRLLAGLLAPYGDEPMPT

SEQ ID NO: 807348 - protein, 20 aa, Mycobacterium
EGRLLLTNPSDMLTTGIEVE

SEQ ID NO: 807349 - protein, 17 aa, Mycobacterium
EGRLRTQRRGKGYIYPA

SEQ ID NO: 807350 - protein, 21 aa, Mycobacterium
EGRLYDIELALRLGASVEQVA

SEQ ID NO: 807351 - protein, 19 aa, Mycobacterium
EGRMYACFAAGALATGCEY

SEQ ID NO: 807352 - protein, 22 aa, Mycobacterium
EGRNFVQTMLSLAAKGVDPAVV

SEQ ID NO: 807353 - protein, 23 aa, Mycobacterium
EGRNRIVRRLLAAAGFPVEALVR

SEQ ID NO: 807354 - protein, 19 aa, Mycobacterium
EGRPAHWRATDVAPMGAAG

SEQ ID NO: 807355 - protein, 17 aa, Mycobacterium
EGRPKHYWSIYQKMIVK

SEQ ID NO: 807356 - protein, 23 aa, Mycobacterium
EGRPKHYWSIYQKMIVKGRDFDD

SEQ ID NO: 807357 - protein, 28 aa, Mycobacterium
EGRPSDPLALWTELWGDALIRHDILAFT

SEQ ID NO: 807358 - protein, 23 aa, Mycobacterium
EGRPVMVWADIGELPYLRVRLQM

SEQ ID NO: 807359 - protein, 24 aa, Mycobacterium
EGRQVFYALAVPDLLDLFAAAETV

SEQ ID NO: 807360 - protein, 25 aa, Mycobacterium
EGRSHAWIEAWTGAWWSYDPTNDTE

SEQ ID NO: 807361 - protein, 32 aa, Mycobacterium
EGRTDVKLVLQDDRNLVLYSGADSVWSSGTQT

SEQ ID NO: 807362 - protein, 18 aa, Mycobacterium
EGRTLTSYPSIRTDLRNA

SEQ ID NO: 807363 - protein, 17 aa, Mycobacterium
EGRTMIPWPDALEKADF

SEQ ID NO: 807364 - protein, 33 aa, Mycobacterium
EGRTTEIVLAPFKIPAIPLDFPALSGTVGPIQM

SEQ ID NO: 807365 - protein, 34 aa, Mycobacterium
EGSAPQHGLPIMLWAYDPLTFGGKGRAAIAIGNP

SEQ ID NO: 807366 - protein, 27 aa, Mycobacterium
EGSATVHVPLGLLPQRLDLLDDSLSVA

SEQ ID NO: 807367 - protein, 26 aa, Mycobacterium
EGSDSKSLAMFRAALRADPSLNPSDV

SEQ ID NO: 807368 - protein, 24 aa, Mycobacterium
EGSGIPNHAFYLAATKYGSHSWEA

SEQ ID NO: 807369 - protein, 26 aa, Mycobacterium
EGSGPWPGVVLFPDAGGLRPTMEEMA

SEQ ID NO: 807370 - protein, 17 aa, Mycobacterium
EGSGVFWVWPDSAGDVD

SEQ ID NO: 807371 - protein, 20 aa, Mycobacterium
EGSLRMLWVSATNPAVSLPE

SEQ ID NO: 807372 - protein, 24 aa, Mycobacterium
EGSTPLAEWAAGAAAINLLTGEVT

SEQ ID NO: 807373 - protein, 20 aa, Mycobacterium
EGSYASGIAFLPQGSKDAAT

SEQ ID NO: 807374 - protein, 21 aa, Mycobacterium
EGTALERILAPGGLADRLLAE

SEQ ID NO: 807375 - protein, 25 aa, Mycobacterium
EGTAPKGIFPWYAPGSDTFLGEFPL

SEQ ID NO: 807376 - protein, 20 aa, Mycobacterium
EGTASYYFRTRAALLRGVGD

SEQ ID NO: 807377 - protein, 18 aa, Mycobacterium
EGTDPGLVAGQWLEEHPL

SEQ ID NO: 807378 - protein, 23 aa, Mycobacterium
EGTESLFLGFGMQTYCNQRLNEL

SEQ ID NO: 807379 - protein, 26 aa, Mycobacterium
EGTFEYQALLFIPSHAQHDLFNRDAV

SEQ ID NO: 807380 - protein, 27 aa, Mycobacterium
EGTFVKFHWKPRLGVHSLIWDECQKIA

SEQ ID NO: 807381 - protein, 23 aa, Mycobacterium
EGTGPWIAPWEPGPSTESDVARR

SEQ ID NO: 807382 - protein, 24 aa, Mycobacterium
EGTHIVMIGILPTLMPEHLSGSWM

SEQ ID NO: 807383 - protein, 18 aa, Mycobacterium
EGTICTNPNHGAADEAGG

SEQ ID NO: 807384 - protein, 18 aa, Mycobacterium
EGTLIRFIHAGMDDDVAR

SEQ ID NO: 807385 - protein, 23 aa, Mycobacterium
EGTPFLDEIPLSAFFGTGVVVSI

SEQ ID NO: 807386 - protein, 23 aa, Mycobacterium
EGTPLIVQLVHFGATFRTDNDVA

SEQ ID NO: 807387 - protein, 23 aa, Mycobacterium
EGTPPFRTMAKPVIVAINGICCG

SEQ ID NO: 807388 - protein, 29 aa, Mycobacterium
EGTRPLRSWQRRALVKYLGTQPRDFLAVA

SEQ ID NO: 807389 - protein, 21 aa, Mycobacterium
EGTRPYGISKALWEVMERART

SEQ ID NO: 807390 - protein, 24 aa, Mycobacterium
EGTRRPELQPFLVELQRAAVKSAT

SEQ ID NO: 807391 - protein, 18 aa, Mycobacterium
EGTSEMHLLSIGRALTGQ

SEQ ID NO: 807392 - protein, 18 aa, Mycobacterium
EGTTSYYYRTRTALLRGV

SEQ ID NO: 807393 - protein, 19 aa, Mycobacterium
EGTVLRFTHRGLTPRDGQG

SEQ ID NO: 807394 - protein, 28 aa, Mycobacterium
EGTWPHTRDWLRRSFWDIPVEETRQMLG

SEQ ID NO: 807395 - protein, 25 aa, Mycobacterium
EGTWWKHRPIFNQEDPGELLGPKAH

SEQ ID NO: 807396 - protein, 23 aa, Mycobacterium
EGTYEEMWAADVAAMVGYHGGAS

SEQ ID NO: 807397 - protein, 25 aa, Mycobacterium
EGVAQAWRQIIFGEADIAICGGVEA

SEQ ID NO: 807398 - protein, 20 aa, Mycobacterium
EGVASQRWDLVRDGIFVGYQ

SEQ ID NO: 807399 - protein, 28 aa, Mycobacterium
EGVDFTNIYFYCVLYHALRASNRIAIER

SEQ ID NO: 807400 - protein, 24 aa, Mycobacterium
EGVDIRYYSVIYQAIDEIESALKG

SEQ ID NO: 807401 - protein, 33 aa, Mycobacterium
EGVDTLRVGILPTPAVAYLTSAYDADFGVMISA

SEQ ID NO: 807402 - protein, 18 aa, Mycobacterium
EGVDWLLAQSDKPDLVFE

SEQ ID NO: 807403 - protein, 24 aa, Mycobacterium
EGVEIRYYSVIYQAIDEIEAALKG

SEQ ID NO: 807404 - protein, 21 aa, Mycobacterium
EGVELFARRLAGLTPNGATIA

SEQ ID NO: 807405 - protein, 22 aa, Mycobacterium
EGVELVLLDNFPVWQTQIAVQR

SEQ ID NO: 807406 - protein, 27 aa, Mycobacterium
EGVGADSLLLLLFTSGTTGASKAVKCS

SEQ ID NO: 807407 - protein, 23 aa, Mycobacterium
EGVGTWLVLCCRAMQAGAKEALA

SEQ ID NO: 807408 - protein, 23 aa, Mycobacterium
EGVHLRFGFVARGGLRWSDRRED

SEQ ID NO: 807409 - protein, 26 aa, Mycobacterium
EGVHTLPMLYALRDTGPDADRLRVLL

SEQ ID NO: 807410 - protein, 26 aa, Mycobacterium
EGVHTLPMLYALREPGPAAARLAELL

SEQ ID NO: 807411 - protein, 25 aa, Mycobacterium
EGVHTLPVLYALRETGPDADRLREL

SEQ ID NO: 807412 - protein, 18 aa, Mycobacterium
EGVKGKAKEVGGAVLGRD

SEQ ID NO: 807413 - protein, 30 aa, Mycobacterium
EGVKGKAKEVIGVVTGRDDLQREGEAQQDK

SEQ ID NO: 807414 - protein, 24 aa, Mycobacterium
EGVKGKVKEVGGAALGRDDLVEEG

SEQ ID NO: 807415 - protein, 26 aa, Mycobacterium
EGVKVASFALAPKPELIARLKEAGAV

SEQ ID NO: 807416 - protein, 28 aa, Mycobacterium
EGVKVASFALAPKPELIARLKEAGAVVI

SEQ ID NO: 807417 - protein, 25 aa, Mycobacterium
EGVLAEPWWCRTVVLSAERIARRGG

SEQ ID NO: 807418 - protein, 25 aa, Mycobacterium
EGVLLIDAFGRIAAAPGLPAVPAVV

SEQ ID NO: 807419 - protein, 32 aa, Mycobacterium
EGVLVVQRMLASRFRPLALLGTDRRLSELAAD

SEQ ID NO: 807420 - protein, 26 aa, Mycobacterium
EGVNGQLFIVYGPSVTLVAAPTAEKQ

SEQ ID NO: 807421 - protein, 27 aa, Mycobacterium
EGVNGQLFIVYGPTVTLIAAPTAERQF

SEQ ID NO: 807422 - protein, 26 aa, Mycobacterium
EGVNNWDPIWPKHAIRIIPGPSSMWF

SEQ ID NO: 807423 - protein, 27 aa, Mycobacterium
EGVPPKDYFALLALLKRSLTEDEVVRA

SEQ ID NO: 807424 - protein, 23 aa, Mycobacterium
EGVQWLAEHLLARSAGRSGVTRG

SEQ ID NO: 807425 - protein, 21 aa, Mycobacterium
EGVRFAYYEPPAGATVIEIME

SEQ ID NO: 807426 - protein, 22 aa, Mycobacterium
EGVRFLVGSLLPSGAVPVAQAY

SEQ ID NO: 807427 - protein, 24 aa, Mycobacterium
EGVRKFFRNRPPKERPRVIAVDAI

SEQ ID NO: 807428 - protein, 24 aa, Mycobacterium
EGVRKFFRTRPAKDRPRVIAVDAV

SEQ ID NO: 807429 - protein, 24 aa, Mycobacterium
EGVRKFFRTRPANQRPRVIAVDAV

SEQ ID NO: 807430 - protein, 25 aa, Mycobacterium
EGVRTLPMLYALRDTGPDGARLRAL

SEQ ID NO: 807431 - protein, 19 aa, Mycobacterium
EGVTSCESVLALAASYDVE

SEQ ID NO: 807432 - protein, 17 aa, Mycobacterium
EGWAHGPQIDKGARWDP

SEQ ID NO: 807433 - protein, 19 aa, Mycobacterium
EGWARHLPRLAPCVDALAS

SEQ ID NO: 807434 - protein, 17 aa, Mycobacterium
EGWFVNQHTVWRVGDED

SEQ ID NO: 807435 - protein, 23 aa, Mycobacterium
EGWHALLTMRLDGNVKLPANATA

SEQ ID NO: 807436 - protein, 23 aa, Mycobacterium
EGWHGKAFPPEMARRALAELGEV

SEQ ID NO: 807437 - protein, 25 aa, Mycobacterium
EGWRFVNRLARRIAANPLDLIAGVK

SEQ ID NO: 807438 - protein, 21 aa, Mycobacterium
EGWTMSAMLALGYPRGKWGVA

SEQ ID NO: 807439 - protein, 22 aa, Mycobacterium
EGWYGRPFPKPLARTREYIDIM

SEQ ID NO: 807440 - protein, 23 aa, Mycobacterium
EGYAKLLGLFAADLQRQSQRGYA

SEQ ID NO: 807441 - protein, 18 aa, Mycobacterium
EGYDMFIGMLDGMKEESV

SEQ ID NO: 807442 - protein, 20 aa, Mycobacterium
EGYDMFMAMLDGMKEESVGF

SEQ ID NO: 807443 - protein, 21 aa, Mycobacterium
EGYDMFMAMLEGMKEESVGFL

SEQ ID NO: 807444 - protein, 21 aa, Mycobacterium
EGYDMFTAMLDGLKEESVGFL

SEQ ID NO: 807445 - protein, 17 aa, Mycobacterium
EGYDRLRELDWEAYRNR

SEQ ID NO: 807446 - protein, 19 aa, Mycobacterium
EGYGRYLSLFDSSGDSTRH

SEQ ID NO: 807447 - protein, 17 aa, Mycobacterium
EGYGWVFEGYRDGLLEA

SEQ ID NO: 807448 - protein, 32 aa, Mycobacterium
EGYRDESKWVPLLWRRDLDAGHWAPFSHPRAI

SEQ ID NO: 807449 - protein, 21 aa, Mycobacterium
EHAALLLARIAVNGQPLATRF

SEQ ID NO: 807450 - protein, 27 aa, Mycobacterium
EHAERFTLLRPLLFTIAYEILGSATES

SEQ ID NO: 807451 - protein, 28 aa, Mycobacterium
EHAERFTLLRPLLFTIAYEMLGSATEAD

SEQ ID NO: 807452 - protein, 28 aa, Mycobacterium
EHAERFTVLRPLLFTIAYEMLGSATEAD

SEQ ID NO: 807453 - protein, 17 aa, Mycobacterium
EHAGRLASLLRSLDIGY

SEQ ID NO: 807454 - protein, 22 aa, Mycobacterium
EHAHLRILQAIRAGDDSLARYR

SEQ ID NO: 807455 - protein, 23 aa, Mycobacterium
EHAKHLFVFQRTPNYSVPAGNKP

SEQ ID NO: 807456 - protein, 23 aa, Mycobacterium
EHALFLRQTPIFEQMLIDDGILL

SEQ ID NO: 807457 - protein, 19 aa, Mycobacterium
EHAPLLGQHNRELLAGLGL

SEQ ID NO: 807458 - protein, 21 aa, Mycobacterium
EHAPTMFLIDVATPGVKITDV

SEQ ID NO: 807459 - protein, 17 aa, Mycobacterium
EHAPVVTPQPHVPAEQP

SEQ ID NO: 807460 - protein, 22 aa, Mycobacterium
EHAQLLRFYRDLIALRHHETDL

SEQ ID NO: 807461 - protein, 27 aa, Mycobacterium
EHARLRRLYRDLIALRRTDPDLADPWL

SEQ ID NO: 807462 - protein, 25 aa, Mycobacterium
EHARRYDHVAARFAESGLITYALDH

SEQ ID NO: 807463 - protein, 31 aa, Mycobacterium
EHATDDPRPVMLWAYDPLAFNGEGKAAIAIG

SEQ ID NO: 807464 - protein, 24 aa, Mycobacterium
EHATVQFMVPAMWAALMNVDGFED

SEQ ID NO: 807465 - protein, 26 aa, Mycobacterium
EHAVWALMDYGFRVVISSRFADIFRG

SEQ ID NO: 807466 - protein, 23 aa, Mycobacterium
EHCVYKPVRGEAPLWDFPDGTLA

SEQ ID NO: 807467 - protein, 24 aa, Mycobacterium
EHDAHLHLRRALVDAALLGAEAPA

SEQ ID NO: 807468 - protein, 26 aa, Mycobacterium
EHDAHLHLRRALVIAALFGGDGPARD

SEQ ID NO: 807469 - protein, 26 aa, Mycobacterium
EHDAHLHLRRAVVTTALFGGDAPAAD

SEQ ID NO: 807470 - protein, 19 aa, Mycobacterium
EHDCGAPIPGRIFAGPGLA

SEQ ID NO: 807471 - protein, 22 aa, Mycobacterium
EHDGILSTRYHRGAFVARFDEA

SEQ ID NO: 807472 - protein, 27 aa, Mycobacterium
EHDGKPFFGSLLEFITSGPVVAAIVEG

SEQ ID NO: 807473 - protein, 18 aa, Mycobacterium
EHDGLRWYRTGDMARYWP

SEQ ID NO: 807474 - protein, 18 aa, Mycobacterium
EHDGPTVIVLPAVLQMFA

SEQ ID NO: 807475 - protein, 17 aa, Mycobacterium
EHDGWAGGPERILDLTL

SEQ ID NO: 807476 - protein, 23 aa, Mycobacterium
EHDLHLYLRRASLNRAMFGAPED

SEQ ID NO: 807477 - protein, 26 aa, Mycobacterium
EHDPGPLRRLIATLPALEVPRPDWPA

SEQ ID NO: 807478 - protein, 24 aa, Mycobacterium
EHDVPLDHFVLYSSISGLIGIVPQ

SEQ ID NO: 807479 - protein, 26 aa, Mycobacterium
EHDVRYYWDKHMSASFMVDPLGLELI

SEQ ID NO: 807480 - protein, 25 aa, Mycobacterium
EHDYDLSSLFLLASTAALFSPSIKE

SEQ ID NO: 807481 - protein, 28 aa, Mycobacterium
EHEGKPFFGSLLEFITSAPVVAAIVEGP

SEQ ID NO: 807482 - protein, 28 aa, Mycobacterium
EHEGKPFFGSLLEFITSGPVVAAVVEGP

SEQ ID NO: 807483 - protein, 31 aa, Mycobacterium
EHELKVIAQLQFPGYFLVVHDIARFCRDNNI

SEQ ID NO: 807484 - protein, 27 aa, Mycobacterium
EHELRTVMYLVGYPNLLVSLHPDYVMT

SEQ ID NO: 807485 - protein, 24 aa, Mycobacterium
EHEPFQHFIQRLYRVLLDNAAEDA

SEQ ID NO: 807486 - protein, 23 aa, Mycobacterium
EHEWRAYGYGFPSAKVRLARLDE

SEQ ID NO: 807487 - protein, 25 aa, Mycobacterium
EHEYRPFRALIRAVLRHAGGVRIDH

SEQ ID NO: 807488 - protein, 20 aa, Mycobacterium
EHFDERLGRSVLGPGVVPVL

SEQ ID NO: 807489 - protein, 18 aa, Mycobacterium
EHFFDFIVTARRAEDGTI

SEQ ID NO: 807490 - protein, 28 aa, Mycobacterium
EHFGFHRYDDFFKFAYTALPRDGVMVLH

SEQ ID NO: 807491 - protein, 26 aa, Mycobacterium
EHFGRLRYAHFFKMAYQALPADGIML

SEQ ID NO: 807492 - protein, 18 aa, Mycobacterium
EHFLRRPLNHIRGAGILS

SEQ ID NO: 807493 - protein, 24 aa, Mycobacterium
EHFNFDALNFLPDHPARSTQDTFY

SEQ ID NO: 807494 - protein, 26 aa, Mycobacterium
EHFRKVIEINLVGVFIGMQAVIPAMR

SEQ ID NO: 807495 - protein, 26 aa, Mycobacterium
EHFVDQPVEFWPTAAIRSALQSGDIA

SEQ ID NO: 807496 - protein, 24 aa, Mycobacterium
EHGAARYLFYWQGTSNDVAIQSFP

SEQ ID NO: 807497 - protein, 18 aa, Mycobacterium
EHGAPADLLGYRADPRTG

SEQ ID NO: 807498 - protein, 25 aa, Mycobacterium
EHGEIPLGIYCRASLAPYMDAERLF

SEQ ID NO: 807499 - protein, 26 aa, Mycobacterium
EHGGLDLDASLKLWERGEELAKRCEQ

SEQ ID NO: 807500 - protein, 34 aa, Mycobacterium
EHGGVLLITHYTRILRYIQPQFVHVFVGGRIVEA

SEQ ID NO: 807501 - protein, 21 aa, Mycobacterium
EHGLDRIFLVAPSSTPERLAN

SEQ ID NO: 807502 - protein, 25 aa, Mycobacterium
EHGLSLSDYLGWSAAIPASECAFSE

SEQ ID NO: 807503 - protein, 28 aa, Mycobacterium
EHGNFRARWVPQRFLKGIPYDTPIQGYG

SEQ ID NO: 807504 - protein, 33 aa, Mycobacterium
EHGPQMLSFVLKHTPLKMCWVPGYSDYYPEAPG

SEQ ID NO: 807505 - protein, 24 aa, Mycobacterium
EHGSDLFAWLQDGGHFYVCGDATR

SEQ ID NO: 807506 - protein, 24 aa, Mycobacterium
EHGTTPWRDLFSPAVALADNGFDI

SEQ ID NO: 807507 - protein, 26 aa, Mycobacterium
EHGVDALILLLNGYVGYATGASWPLL

SEQ ID NO: 807508 - protein, 27 aa, Mycobacterium
EHGVGRLKRPWLAGYLGPDAMDLNRRI

SEQ ID NO: 807509 - protein, 27 aa, Mycobacterium
EHGVGRLKRPWLAGYLGPEVMDLNRRI

SEQ ID NO: 807510 - protein, 28 aa, Mycobacterium
EHGVGRLKRPWLAGYLGPEVMELNRRIK

SEQ ID NO: 807511 - protein, 23 aa, Mycobacterium
EHGWPIHGVLAGNSGWLVDEKTD

SEQ ID NO: 807512 - protein, 25 aa, Mycobacterium
EHGYELLPAWDRAGVVFDALVAAVR

SEQ ID NO: 807513 - protein, 23 aa, Mycobacterium
EHGYELLPPWESAGVVFDALAAA

SEQ ID NO: 807514 - protein, 25 aa, Mycobacterium
EHHANIVPWQLLSRQTGAVLKVAPV

SEQ ID NO: 807515 - protein, 19 aa, Mycobacterium
EHHAWSAEPWTTLPARYGV

SEQ ID NO: 807516 - protein, 32 aa, Mycobacterium
EHHCAAALLNGPRYWLMSRIEKVGGTETPRET

SEQ ID NO: 807517 - protein, 18 aa, Mycobacterium
EHHCDFGRLLPAVRAVRE

SEQ ID NO: 807518 - protein, 20 aa, Mycobacterium
EHHEVPWLEPLPDGDDPADP

SEQ ID NO: 807519 - protein, 17 aa, Mycobacterium
EHHGQYFTVPGPFLCEP

SEQ ID NO: 807520 - protein, 18 aa, Mycobacterium
EHHIHLYVRHAWQGAAQL

SEQ ID NO: 807521 - protein, 18 aa, Mycobacterium
EHHIVLKGLGRKVSEAPL

SEQ ID NO: 807522 - protein, 26 aa, Mycobacterium
EHHLSRTGWLPSPLILAAAVAGRTRS

SEQ ID NO: 807523 - protein, 25 aa, Mycobacterium
EHHPERYFEMFIAEQQLVASSVGLH

SEQ ID NO: 807524 - protein, 19 aa, Mycobacterium
EHHQWLFDAIVDGSTRRAV

SEQ ID NO: 807525 - protein, 25 aa, Mycobacterium
EHHRLRRLMNPAFSPKLIGSLVPRF

SEQ ID NO: 807526 - protein, 17 aa, Mycobacterium
EHIALLGVESKIAHILA

SEQ ID NO: 807527 - protein, 31 aa, Mycobacterium
EHIGIANYPAYFRFLQSRLKTGGLLLNHCIT

SEQ ID NO: 807528 - protein, 17 aa, Mycobacterium
EHIKITDNALIPMKERV

SEQ ID NO: 807529 - protein, 20 aa, Mycobacterium
EHIRDLAVTGYRLAKQLGVQ

SEQ ID NO: 807530 - protein, 26 aa, Mycobacterium
EHISDTMVYLCGPAGRYVTGVALPVD

SEQ ID NO: 807531 - protein, 19 aa, Mycobacterium
EHKMQLLCVQRLHGGLTIG

SEQ ID NO: 807532 - protein, 17 aa, Mycobacterium
EHKVNLLFFTGDAMARP

SEQ ID NO: 807533 - protein, 36 aa, Mycobacterium
EHLAAEPILALSRLTATFLDRLEAHLKGWGKTLKYA

SEQ ID NO: 807534 - protein, 18 aa, Mycobacterium
EHLAGLPGPTLLAASMAT

SEQ ID NO: 807535 - protein, 19 aa, Mycobacterium
EHLAGLRLQPGYERVLEEG

SEQ ID NO: 807536 - protein, 30 aa, Mycobacterium
EHLAKGEKLLVFLPLAHVLARALTIGAFSN

SEQ ID NO: 807537 - protein, 25 aa, Mycobacterium
EHLDPQRGPLWGAVWLRGSDDADST

SEQ ID NO: 807538 - protein, 23 aa, Mycobacterium
EHLGDLRFYPGGQLQLEQFACRR

SEQ ID NO: 807539 - protein, 18 aa, Mycobacterium
EHLGLRTRLFAAPGWVVS

SEQ ID NO: 807540 - protein, 30 aa, Mycobacterium
EHLGVPAPVPGDWLLLVELAADHDQTERLA

SEQ ID NO: 807541 - protein, 25 aa, Mycobacterium
EHLHQILVNLLSNAFKFTRPSGTVR

SEQ ID NO: 807542 - protein, 29 aa, Mycobacterium
EHLIAADMTWLLSRWTCVFGTPACKGTVV

SEQ ID NO: 807543 - protein, 17 aa, Mycobacterium
EHLIDSAGYWTKTADRW

SEQ ID NO: 807544 - protein, 17 aa, Mycobacterium
EHLIDTAGYWTKTADQW

SEQ ID NO: 807545 - protein, 23 aa, Mycobacterium
EHLLALGHRRVGVIAGLAHASTG

SEQ ID NO: 807546 - protein, 19 aa, Mycobacterium
EHLLFKSTPTRTAVDIAQA

SEQ ID NO: 807547 - protein, 18 aa, Mycobacterium
EHLPAVALRTGRGETRKV

SEQ ID NO: 807548 - protein, 18 aa, Mycobacterium
EHLQLVLHKLHDAGATVT

SEQ ID NO: 807549 - protein, 33 aa, Mycobacterium
EHLQVASLDHAMWFMRAFRADEWLLYDQSSPSA

SEQ ID NO: 807550 - protein, 26 aa, Mycobacterium
EHLRSQGIRLIYDAPRRGTANSRINF

SEQ ID NO: 807551 - protein, 21 aa, Mycobacterium
EHLTARLTTLGPAATLARGYS

SEQ ID NO: 807552 - protein, 30 aa, Mycobacterium
EHLTDEAIFSFLRLLLPAGLETTYRSSGNL

SEQ ID NO: 807553 - protein, 17 aa, Mycobacterium
EHLTLPTDRPYPPIADY

SEQ ID NO: 807554 - protein, 19 aa, Mycobacterium
EHLVRLECLAAAAGDRYNA

SEQ ID NO: 807555 - protein, 25 aa, Mycobacterium
EHLVTGDLPFPLPVVGGHEGAGTVV

SEQ ID NO: 807556 - protein, 31 aa, Mycobacterium
EHMDQIFITAPPYPPSILLTGIIVNKLGQRF

SEQ ID NO: 807557 - protein, 27 aa, Mycobacterium
EHMDQIFITAPPYPPSILLTGVIVNKL

SEQ ID NO: 807558 - protein, 17 aa, Mycobacterium
EHMLILKLTSPEGAAKY

SEQ ID NO: 807559 - protein, 18 aa, Mycobacterium
EHMTAYLKQHHPTVPILI

SEQ ID NO: 807560 - protein, 20 aa, Mycobacterium
EHNGLIGYVLAELGYRVRRL

SEQ ID NO: 807561 - protein, 28 aa, Mycobacterium
EHNPMIGFRGCYRYVKEPELFALELEAL

SEQ ID NO: 807562 - protein, 17 aa, Mycobacterium
EHNPVLGRRVWVDRWDT

SEQ ID NO: 807563 - protein, 17 aa, Mycobacterium
EHNQRALLTMWADYLQG

SEQ ID NO: 807564 - protein, 17 aa, Mycobacterium
EHNVHLPRFYPDMPSRF

SEQ ID NO: 807565 - protein, 25 aa, Mycobacterium
EHPAAMVLFSPLYDLSFELALARER

SEQ ID NO: 807566 - protein, 23 aa, Mycobacterium
EHPAHLYYKRAVSNSALFGGRAV

SEQ ID NO: 807567 - protein, 17 aa, Mycobacterium
EHPALIRTDPAAIRRRI

SEQ ID NO: 807568 - protein, 17 aa, Mycobacterium
EHPFDRLARLRFRVTVN

SEQ ID NO: 807569 - protein, 22 aa, Mycobacterium
EHPFVEPPLNRQKSVSLKKLLD

SEQ ID NO: 807570 - protein, 24 aa, Mycobacterium
EHPGLLRFTVGLAQITSLLMAGEI

SEQ ID NO: 807571 - protein, 24 aa, Mycobacterium
EHPGLLRFTVGLAQITTLLMAGEV

SEQ ID NO: 807572 - protein, 28 aa, Mycobacterium
EHPGLTLIIPHLGGVLPYLAQRLIDQSG

SEQ ID NO: 807573 - protein, 22 aa, Mycobacterium
EHPHHSPPVEPYFIYTRHAHAS

SEQ ID NO: 807574 - protein, 22 aa, Mycobacterium
EHPILIERPFVVTPKGTRLARP

SEQ ID NO: 807575 - protein, 18 aa, Mycobacterium
EHPILIERPFVVTSKGTR

SEQ ID NO: 807576 - protein, 21 aa, Mycobacterium
EHPLGHRWRWELAEVGPGATK

SEQ ID NO: 807577 - protein, 21 aa, Mycobacterium
EHPLQQLIRRLWACRDQKHWS

SEQ ID NO: 807578 - protein, 20 aa, Mycobacterium
EHPLVILHNSGHKAFFNSAA

SEQ ID NO: 807579 - protein, 18 aa, Mycobacterium
EHPNVVPLLVTRPLATPL

SEQ ID NO: 807580 - protein, 18 aa, Mycobacterium
EHPPDVVILDLGLPDISG

SEQ ID NO: 807581 - protein, 23 aa, Mycobacterium
EHPSLCLLASWVSPGSPAGRRLR

SEQ ID NO: 807582 - protein, 28 aa, Mycobacterium
EHPYREPLWTQLITAYYLTDRQSDALGA

SEQ ID NO: 807583 - protein, 28 aa, Mycobacterium
EHPYREWLDRNLVPLEKLPQGDYARMPH

SEQ ID NO: 807584 - protein, 17 aa, Mycobacterium
EHQAALDKLGVAAFELL

SEQ ID NO: 807585 - protein, 22 aa, Mycobacterium
EHQAHLYFKRATTDAALLGTAE

SEQ ID NO: 807586 - protein, 27 aa, Mycobacterium
EHQAIIRDVLAAGDFWGGAGSAACQEF

SEQ ID NO: 807587 - protein, 28 aa, Mycobacterium
EHQAIVRDVLAAGDFWGGAGSSACQEFI

SEQ ID NO: 807588 - protein, 23 aa, Mycobacterium
EHQDVPFELLVERLNPVRSLTHH

SEQ ID NO: 807589 - protein, 19 aa, Mycobacterium
EHQQLLPRAGWVEHNPVEI

SEQ ID NO: 807590 - protein, 21 aa, Mycobacterium
EHQRMVFGANTYRAFAQMLAE

SEQ ID NO: 807591 - protein, 25 aa, Mycobacterium
EHRAYIEYQPALPAKIEGLTTSFPM

SEQ ID NO: 807592 - protein, 26 aa, Mycobacterium
EHREGVAIGLIFPYTRGADGAYQLEA

SEQ ID NO: 807593 - protein, 21 aa, Mycobacterium
EHRGRYLLLVQWDTLEHHTEG

SEQ ID NO: 807594 - protein, 18 aa, Mycobacterium
EHRIAIVPFGGGTSVVGG

SEQ ID NO: 807595 - protein, 21 aa, Mycobacterium
EHRIYRNVLNPYLSPAAVKRW

SEQ ID NO: 807596 - protein, 17 aa, Mycobacterium
EHRLGKRVAAAYALYLT

SEQ ID NO: 807597 - protein, 24 aa, Mycobacterium
EHRLLQPLALAPRGIWLGPKELRT

SEQ ID NO: 807598 - protein, 17 aa, Mycobacterium
EHRPLLESPDILIFAWG

SEQ ID NO: 807599 - protein, 24 aa, Mycobacterium
EHRQPWSYYRGRIGMKLRSVGRRE

SEQ ID NO: 807600 - protein, 26 aa, Mycobacterium
EHRRWLNNHVPFHANWVRLKSFWGTA

SEQ ID NO: 807601 - protein, 30 aa, Mycobacterium
EHRRYLGKHLPYYANWHRLKSYWATADNNY

SEQ ID NO: 807602 - protein, 24 aa, Mycobacterium
EHRTKVWLPVIDRVVVLGADGAAL

SEQ ID NO: 807603 - protein, 22 aa, Mycobacterium
EHRVLIMDELTRRNPDLLAELR

SEQ ID NO: 807604 - protein, 18 aa, Mycobacterium
EHRVLVLVGRIHAYEGHD

SEQ ID NO: 807605 - protein, 17 aa, Mycobacterium
EHRYLMTVIATASNPRF

SEQ ID NO: 807606 - protein, 24 aa, Mycobacterium
EHSAFTLPELLGLVGLPDMTVVVD

SEQ ID NO: 807607 - protein, 24 aa, Mycobacterium
EHSAHYYFRDFWGADSGMLAALYV

SEQ ID NO: 807608 - protein, 23 aa, Mycobacterium
EHSATPFMVLLAAFGVLVHRYTG

SEQ ID NO: 807609 - protein, 29 aa, Mycobacterium
EHSDFTSFLNLWWYLTEQRKERSGSSFRR

SEQ ID NO: 807610 - protein, 26 aa, Mycobacterium
EHSDLHLVPLSPPLPIRTVELLRRSS

SEQ ID NO: 807611 - protein, 25 aa, Mycobacterium
EHSDYRLGLPIAGRWREVLNTDATI

SEQ ID NO: 807612 - protein, 24 aa, Mycobacterium
EHSGHLPSWPEDIPVRVAHVGLGR

SEQ ID NO: 807613 - protein, 20 aa, Mycobacterium
EHSLPPLNLTVPESLAVLTG

SEQ ID NO: 807614 - protein, 23 aa, Mycobacterium
EHSSYRVGLPLTGRWREVINTDA

SEQ ID NO: 807615 - protein, 29 aa, Mycobacterium
EHTCLYHYAWVRDRLLMVSLADVASQVEI

SEQ ID NO: 807616 - protein, 24 aa, Mycobacterium
EHTDSMLSLYRRAIELRKSRKEFT

SEQ ID NO: 807617 - protein, 30 aa, Mycobacterium
EHTDYNLGLALPIALPQRVVVRYQPDDSEA

SEQ ID NO: 807618 - protein, 27 aa, Mycobacterium
EHTDYNLGWALPIALPQRAVATFVPDH

SEQ ID NO: 807619 - protein, 30 aa, Mycobacterium
EHTDYNLGWALPIALPQRTVVRFAPGGGDA

SEQ ID NO: 807620 - protein, 19 aa, Mycobacterium
EHTEVLPLYARLPTAEQQK

SEQ ID NO: 807621 - protein, 25 aa, Mycobacterium
EHTKRYRSIRPIPRPSPAVTATSLP

SEQ ID NO: 807622 - protein, 25 aa, Mycobacterium
EHTRLRKIVSRLFTPRAIAGMEAKL

SEQ ID NO: 807623 - protein, 33 aa, Mycobacterium
EHTRSNLPRWMRSTRLMRAARLAGLRAEVVPSP

SEQ ID NO: 807624 - protein, 19 aa, Mycobacterium
EHTSYRRWAGALVERARRL

SEQ ID NO: 807625 - protein, 21 aa, Mycobacterium
EHTVLGIFRNINRPTYDDAAR

SEQ ID NO: 807626 - protein, 18 aa, Mycobacterium
EHTVYRRLISSAFTPRNV

SEQ ID NO: 807627 - protein, 22 aa, Mycobacterium
EHTYAVAHQLWRDATSIDWSGH

SEQ ID NO: 807628 - protein, 25 aa, Mycobacterium
EHTYREVFPFLLRLYHRILQTRNPN

SEQ ID NO: 807629 - protein, 22 aa, Mycobacterium
EHVALRSVFTWHDAPGRSGVAR

SEQ ID NO: 807630 - protein, 20 aa, Mycobacterium
EHVALVIDGVRRGFDVANYG

SEQ ID NO: 807631 - protein, 47 aa, Mycobacterium
EHVARMGGWRLAPPLLVDQLAGLKPPAPLVLVPRRQRRKLNGQLDFL

SEQ ID NO: 807632 - protein, 21 aa, Mycobacterium
EHVAVIRRLFRQLPESVDLDT

SEQ ID NO: 807633 - protein, 28 aa, Mycobacterium
EHVETFIPRGIAGLFFFDGEQIEALADL

SEQ ID NO: 807634 - protein, 22 aa, Mycobacterium
EHWCEAFHDWTCAAVAVRDVVS

SEQ ID NO: 807635 - protein, 30 aa, Mycobacterium
EHWEQGAVFEPFLTLWRSAAIHPEARKVLH

SEQ ID NO: 807636 - protein, 26 aa, Mycobacterium
EHWSALATMILPVGGAPYVIMPKGPN

SEQ ID NO: 807637 - protein, 21 aa, Mycobacterium
EHWSIHRKPPAFSDLEPRTEM

SEQ ID NO: 807638 - protein, 17 aa, Mycobacterium
EHYGLHVGGLDIQLATV

SEQ ID NO: 807639 - protein, 24 aa, Mycobacterium
EHYGRIDVLIHNAGTVRRASLKEM

SEQ ID NO: 807640 - protein, 17 aa, Mycobacterium
EHYLKVVYEKTACLIAA

SEQ ID NO: 807641 - protein, 21 aa, Mycobacterium
EHYLRTPFVLTKASVPQMRKQ

SEQ ID NO: 807642 - protein, 25 aa, Mycobacterium
EHYPSMLTALRRAVAENAIVLRGLM

SEQ ID NO: 807643 - protein, 24 aa, Mycobacterium
EHYTAPPMPFWFTADHYDELRAIP

SEQ ID NO: 807644 - protein, 18 aa, Mycobacterium
EIAALIDHTLLKPEATTA

SEQ ID NO: 807645 - protein, 22 aa, Mycobacterium
EIAALLQIEYLLDQRWPETKIE

SEQ ID NO: 807646 - protein, 19 aa, Mycobacterium
EIADFGVVGDLFNVAPQLT

SEQ ID NO: 807647 - protein, 27 aa, Mycobacterium
EIADKFHATFDALLYNFYGPTETVVNC

SEQ ID NO: 807648 - protein, 17 aa, Mycobacterium
EIADLELEWRPADPIHA

SEQ ID NO: 807649 - protein, 27 aa, Mycobacterium
EIADVLPLTPLQQGLLFHSNLAPEGLE

SEQ ID NO: 807650 - protein, 26 aa, Mycobacterium
EIAEGWQPIFFLPEKAATVWGDALKA

SEQ ID NO: 807651 - protein, 26 aa, Mycobacterium
EIAEGWQPVFFYPAKAHGVWGAALAA

SEQ ID NO: 807652 - protein, 17 aa, Mycobacterium
EIAELAHILPRPPHSDP

SEQ ID NO: 807653 - protein, 17 aa, Mycobacterium
EIAENFRMPPALEKAWH

SEQ ID NO: 807654 - protein, 25 aa, Mycobacterium
EIAERGWPVFLVSSVARVGLQPLVF

SEQ ID NO: 807655 - protein, 25 aa, Mycobacterium
EIAERGWPVFLVSTVAREGLQPLIF

SEQ ID NO: 807656 - protein, 19 aa, Mycobacterium
EIAERRKGFEPLPPRYKTG

SEQ ID NO: 807657 - protein, 20 aa, Mycobacterium
EIAFLVEDCAPRLVITEEVL

SEQ ID NO: 807658 - protein, 18 aa, Mycobacterium
EIAGLPLLAAIKAQPQLG

SEQ ID NO: 807659 - protein, 20 aa, Mycobacterium
EIAGPVYMRLKRGEIPVLFD

SEQ ID NO: 807660 - protein, 19 aa, Mycobacterium
EIAGRLAARIGSGLLVDVV

SEQ ID NO: 807661 - protein, 21 aa, Mycobacterium
EIAGRLAARIGSGLLVDVVGI

SEQ ID NO: 807662 - protein, 23 aa, Mycobacterium
EIAHILVLNSKFEGGLTSSVRGV

SEQ ID NO: 807663 - protein, 22 aa, Mycobacterium
EIAHILVLQSKFEGGVTSKVRG

SEQ ID NO: 807664 - protein, 23 aa, Mycobacterium
EIAHRAYLRWLHTQGGHPPADVI

SEQ ID NO: 807665 - protein, 19 aa, Mycobacterium
EIALHQCRLTIWHACWMMD

SEQ ID NO: 807666 - protein, 17 aa, Mycobacterium
EIALLRDAARTATVVAT

SEQ ID NO: 807667 - protein, 17 aa, Mycobacterium
EIALLRDAPRTATVVAA

SEQ ID NO: 807668 - protein, 17 aa, Mycobacterium
EIALLRHIPRTATVTTA

SEQ ID NO: 807669 - protein, 17 aa, Mycobacterium
EIALYEHGSLVLSLDDA

SEQ ID NO: 807670 - protein, 24 aa, Mycobacterium
EIAPAHLVLGLFSDPSGLAAQLVA

SEQ ID NO: 807671 - protein, 25 aa, Mycobacterium
EIAPHAVVLAEPLRIPTTSSGKIRR

SEQ ID NO: 807672 - protein, 24 aa, Mycobacterium
EIAPIVSAWLAELGAHSPLVEELA

SEQ ID NO: 807673 - protein, 25 aa, Mycobacterium
EIAPSYVFFAADQLSSYYTGEVLAP

SEQ ID NO: 807674 - protein, 26 aa, Mycobacterium
EIAQRGWPVFLVSTVTRENLQPLIFG

SEQ ID NO: 807675 - protein, 22 aa, Mycobacterium
EIARAYVTALRDLLRALDVSDV

SEQ ID NO: 807676 - protein, 22 aa, Mycobacterium
EIARAYVTALRQLMRALDVSDV

SEQ ID NO: 807677 - protein, 19 aa, Mycobacterium
EIARFWVGLASFDEARDRY

SEQ ID NO: 807678 - protein, 19 aa, Mycobacterium
EIARPHLSLVPDAFEPQPA

SEQ ID NO: 807679 - protein, 43 aa, Mycobacterium
EIASASAPVLLILDDLHWAAKPTLLLLRHLLRFGDHARVQIVG

SEQ ID NO: 807680 - protein, 25 aa, Mycobacterium
EIAVLTLIPGGFPRAIQASQAISAL

SEQ ID NO: 807681 - protein, 21 aa, Mycobacterium
EIDARLRLLVGRRAGAVNVEN

SEQ ID NO: 807682 - protein, 22 aa, Mycobacterium
EIDEALPAPRWTRVGVHIAESG

SEQ ID NO: 807683 - protein, 17 aa, Mycobacterium
EIDEGILPALYAAAAPH

SEQ ID NO: 807684 - protein, 18 aa, Mycobacterium
EIDEHLIALPGGRYGWRV

SEQ ID NO: 807685 - protein, 24 aa, Mycobacterium
EIDERMIRFSWQSFLVDTDQFVGW

SEQ ID NO: 807686 - protein, 28 aa, Mycobacterium
EIDGIPRVFFIAWYIRDSQRHPGAPRLT

SEQ ID NO: 807687 - protein, 20 aa, Mycobacterium
EIDLLDFFAELTIYTSTSCL

SEQ ID NO: 807688 - protein, 18 aa, Mycobacterium
EIDLPDLSTLTITVDPVS

SEQ ID NO: 807689 - protein, 22 aa, Mycobacterium
EIDPGSWWFGRDHSWGIRNGPG

SEQ ID NO: 807690 - protein, 20 aa, Mycobacterium
EIDQFFARRVSLVYDAATTG

SEQ ID NO: 807691 - protein, 19 aa, Mycobacterium
EIDRVFAGKVWGAWHLSEA

SEQ ID NO: 807692 - protein, 27 aa, Mycobacterium
EIDSRTYTFIAYLGDYYAFTTLTNDPG

SEQ ID NO: 807693 - protein, 23 aa, Mycobacterium
EIDSVPEHLVIIGGSYIALEFAQ

SEQ ID NO: 807694 - protein, 32 aa, Mycobacterium
EIDVAEIYVPFSWFEPMWLENLGFAAEGEGWK

SEQ ID NO: 807695 - protein, 24 aa, Mycobacterium
EIDVSLLSTAWWAAGASVTQGMET

SEQ ID NO: 807696 - protein, 23 aa, Mycobacterium
EIDWSKVHIYWGDERFVPQDDDE

SEQ ID NO: 807697 - protein, 18 aa, Mycobacterium
EIDYRKPIPVGSTVDLAA

SEQ ID NO: 807698 - protein, 40 aa, Mycobacterium
EIDYRNTIDILQRYYNIILTDCGTGIMHSAMAGVLDLAHT

SEQ ID NO: 807699 - protein, 19 aa, Mycobacterium
EIEALGFGALWVNGGQLDR

SEQ ID NO: 807700 - protein, 23 aa, Mycobacterium
EIEALYYLHPLTGDVIRQVDSLR

SEQ ID NO: 807701 - protein, 21 aa, Mycobacterium
EIEALYYLHPLTGDVVRQVES

SEQ ID NO: 807702 - protein, 17 aa, Mycobacterium
EIEEFLLTHPDIEDVHV

SEQ ID NO: 807703 - protein, 25 aa, Mycobacterium
EIEELYYLHPLTGDIIRKVDSLRIF

SEQ ID NO: 807704 - protein, 17 aa, Mycobacterium
EIEFFMRYLTWGLRGVT

SEQ ID NO: 807705 - protein, 28 aa, Mycobacterium
EIEFTVEGGKLWLLQTRDAERSAQAAVR

SEQ ID NO: 807706 - protein, 31 aa, Mycobacterium
EIEGVFTLPEPLPGKLLFISAGSGITPIISM

SEQ ID NO: 807707 - protein, 24 aa, Mycobacterium
EIEQHVRLLLSELGVDVGAVSTVP

SEQ ID NO: 807708 - protein, 30 aa, Mycobacterium
EIEQLRFQIGRWQYRDLIREQIHPWLAERT

SEQ ID NO: 807709 - protein, 18 aa, Mycobacterium
EIERAVRSCPTQALFIKQ

SEQ ID NO: 807710 - protein, 21 aa, Mycobacterium
EIESAPDVAVRRFSEEEGICI

SEQ ID NO: 807711 - protein, 21 aa, Mycobacterium
EIEVGLRYYAAAFFQVIPQVN

SEQ ID NO: 807712 - protein, 19 aa, Mycobacterium
EIEVLLLEKDASVPGMPPR

SEQ ID NO: 807713 - protein, 18 aa, Mycobacterium
EIFAAAGAQWRQAGCSMC

SEQ ID NO: 807714 - protein, 33 aa, Mycobacterium
EIFAAYYGVQLPAPVPYRKFVAWLAAQDRGAAQ

SEQ ID NO: 807715 - protein, 24 aa, Mycobacterium
EIFDRPVVLLTMTGAKSGKKRYVP

SEQ ID NO: 807716 - protein, 18 aa, Mycobacterium
EIFGDGRIALRFPGDADQ

SEQ ID NO: 807717 - protein, 17 aa, Mycobacterium
EIFGPVLVVIPFEDEDD

SEQ ID NO: 807718 - protein, 19 aa, Mycobacterium
EIFQDYLTGIIYQQLANPV

SEQ ID NO: 807719 - protein, 17 aa, Mycobacterium
EIFTKFSIPINIARVIH

SEQ ID NO: 807720 - protein, 25 aa, Mycobacterium
EIGALIAFLLSDVCAFVTGQTIYAD

SEQ ID NO: 807721 - protein, 17 aa, Mycobacterium
EIGAPISFAQRAQVGLP

SEQ ID NO: 807722 - protein, 22 aa, Mycobacterium
EIGAQLKRRRLGYGRGARMKFE

SEQ ID NO: 807723 - protein, 32 aa, Mycobacterium
EIGDGAVPFYIPTEARPWPARRTRVAAVSSFG

SEQ ID NO: 807724 - protein, 23 aa, Mycobacterium
EIGDVAFAVANWTVLHPIDQQRK

SEQ ID NO: 807725 - protein, 23 aa, Mycobacterium
EIGEQIAMSVYTGLFCVVDAHNR

SEQ ID NO: 807726 - protein, 18 aa, Mycobacterium
EIGHYFYYRLVGGSAEYL

SEQ ID NO: 807727 - protein, 24 aa, Mycobacterium
EIGHYYFYRLIAPSDDHLARFREL

SEQ ID NO: 807728 - protein, 24 aa, Mycobacterium
EIGHYYFYRLIAPSGEYLARFNEL

SEQ ID NO: 807729 - protein, 24 aa, Mycobacterium
EIGHYYFYRLIDPSGDHRARFTEL

SEQ ID NO: 807730 - protein, 21 aa, Mycobacterium
EIGHYYFYRLVAPSAEFTAKF

SEQ ID NO: 807731 - protein, 26 aa, Mycobacterium
EIGHYYYYRLIAPYRDRLERFNELFG

SEQ ID NO: 807732 - protein, 22 aa, Mycobacterium
EIGILLRSRPAQMAAFLGVLLS

SEQ ID NO: 807733 - protein, 17 aa, Mycobacterium
EIGILLTAARQPHQREG

SEQ ID NO: 807734 - protein, 34 aa, Mycobacterium
EIGKRDIYGDTRLGLFPFRRNLSFHAVDLVLVAK

SEQ ID NO: 807735 - protein, 24 aa, Mycobacterium
EIGLLLPCNVAVRRDPENADTIIV

SEQ ID NO: 807736 - protein, 21 aa, Mycobacterium
EIGMLHQLRRAAPEVDFLAVN

SEQ ID NO: 807737 - protein, 26 aa, Mycobacterium
EIGMVFQHFNLFPHMTVIQNIVEAPV

SEQ ID NO: 807738 - protein, 23 aa, Mycobacterium
EIGNRYNLGLVRALLSGAIETGR

SEQ ID NO: 807739 - protein, 21 aa, Mycobacterium
EIGPQPDLPWRRGRQIAPELT

SEQ ID NO: 807740 - protein, 25 aa, Mycobacterium
EIGPRSTLLSLLAAADLIPDSQRIA

SEQ ID NO: 807741 - protein, 17 aa, Mycobacterium
EIGPTLRAILQTAAHDP

SEQ ID NO: 807742 - protein, 17 aa, Mycobacterium
EIGQFQLIQLKLATMEV

SEQ ID NO: 807743 - protein, 27 aa, Mycobacterium
EIGQSLRPWVPIVSLVKGLEQGSRMRM

SEQ ID NO: 807744 - protein, 25 aa, Mycobacterium
EIGRAHTPWFHWPTTAMVANAVDHF

SEQ ID NO: 807745 - protein, 26 aa, Mycobacterium
EIGRALAPVPWIDHVCAARLLARLGT

SEQ ID NO: 807746 - protein, 25 aa, Mycobacterium
EIGRALPATLIFDHPTPAAVAYHLQ

SEQ ID NO: 807747 - protein, 18 aa, Mycobacterium
EIGRRFATLSLPLAEMRE

SEQ ID NO: 807748 - protein, 26 aa, Mycobacterium
EIGRRLAPEPVLHGALAPGAIIAERG

SEQ ID NO: 807749 - protein, 26 aa, Mycobacterium
EIGRSLAPVPWIDHVCTARLLGRLGA

SEQ ID NO: 807750 - protein, 25 aa, Mycobacterium
EIGRSLAPVPWIDQVCAARLLARLG

SEQ ID NO: 807751 - protein, 23 aa, Mycobacterium
EIGSQLFISAHTVEWHLSNVYAK

SEQ ID NO: 807752 - protein, 18 aa, Mycobacterium
EIGTDWLRSYLALPNYAN

SEQ ID NO: 807753 - protein, 18 aa, Mycobacterium
EIGWAARIGRIPMGYFND

SEQ ID NO: 807754 - protein, 25 aa, Mycobacterium
EIGWLAQQGLIPLGYLGDPEKTART

SEQ ID NO: 807755 - protein, 22 aa, Mycobacterium
EIGYCLGRRWWGLGLMSEALGV

SEQ ID NO: 807756 - protein, 20 aa, Mycobacterium
EIGYGVLFFASDASSYCSGQ

SEQ ID NO: 807757 - protein, 19 aa, Mycobacterium
EIHAFYEAFSPRFEEAIDY

SEQ ID NO: 807758 - protein, 27 aa, Mycobacterium
EIHAGCVWINDHIPIISEMPHGGFGAS

SEQ ID NO: 807759 - protein, 23 aa, Mycobacterium
EIHALAQRFLAGRSVLMAQRIAQ

SEQ ID NO: 807760 - protein, 17 aa, Mycobacterium
EIHLMYVALVGGGAPLR

SEQ ID NO: 807761 - protein, 32 aa, Mycobacterium
EIHRDWNARYVWPKFVCALPSEFFAAVRAELD

SEQ ID NO: 807762 - protein, 23 aa, Mycobacterium
EIHRRFVDRIDGFRVVGVARTGA

SEQ ID NO: 807763 - protein, 18 aa, Mycobacterium
EIIFERRLSELAASYPRL

SEQ ID NO: 807764 - protein, 19 aa, Mycobacterium
EIIGGATMLRLLLVSDENL

SEQ ID NO: 807765 - protein, 24 aa, Mycobacterium
EIIGGTPRLWHLVAESADVPSLAA

SEQ ID NO: 807766 - protein, 25 aa, Mycobacterium
EIILDRKGNRHFSFGLGVHRCIGSN

SEQ ID NO: 807767 - protein, 24 aa, Mycobacterium
EIIRCLKRFLAREIWASCIHCAPL

SEQ ID NO: 807768 - protein, 18 aa, Mycobacterium
EIIVRQRGTKFHPGVGVG

SEQ ID NO: 807769 - protein, 23 aa, Mycobacterium
EIKEEFRRFATKLELHDLTVIPV

SEQ ID NO: 807770 - protein, 17 aa, Mycobacterium
EIKRAYRKLARELHPDV

SEQ ID NO: 807771 - protein, 19 aa, Mycobacterium
EIKRPRMFYFHRQASDDWD

SEQ ID NO: 807772 - protein, 23 aa, Mycobacterium
EIKRVWIAPHVRGLGLGKRILAE

SEQ ID NO: 807773 - protein, 23 aa, Mycobacterium
EIKTQVLERLADTYPGREKEIGA

SEQ ID NO: 807774 - protein, 20 aa, Mycobacterium
EILAADPTRYAVLPHMRAAC

SEQ ID NO: 807775 - protein, 26 aa, Mycobacterium
EILADRIMRLHRLALMRARAEQRQRV

SEQ ID NO: 807776 - protein, 25 aa, Mycobacterium
EILADYDTWIRERPRELARTVFIEL

SEQ ID NO: 807777 - protein, 17 aa, Mycobacterium
EILALRAAAGVLGDGWR

SEQ ID NO: 807778 - protein, 21 aa, Mycobacterium
EILAQLPPRPVLVGASLGGIT

SEQ ID NO: 807779 - protein, 24 aa, Mycobacterium
EILDDEIRWVLTKGKLPASEWIDV

SEQ ID NO: 807780 - protein, 17 aa, Mycobacterium
EILDLSGGPLRYAGWSS

SEQ ID NO: 807781 - protein, 27 aa, Mycobacterium
EILDLTLCVAVFLGLGRSLTVLGVDQS

SEQ ID NO: 807782 - protein, 26 aa, Mycobacterium
EILDRAPDPALYIRALVRFVEGAQES

SEQ ID NO: 807783 - protein, 20 aa, Mycobacterium
EILDVLFDLESLTEWSSAHK

SEQ ID NO: 807784 - protein, 20 aa, Mycobacterium
EILFDGIPLDKISTSITING

SEQ ID NO: 807785 - protein, 21 aa, Mycobacterium
EILFDQGLGDMFVVRTAGHVI

SEQ ID NO: 807786 - protein, 17 aa, Mycobacterium
EILGRIFDERSNRVTIS

SEQ ID NO: 807787 - protein, 17 aa, Mycobacterium
EILGVLRAVLFAPEDLA

SEQ ID NO: 807788 - protein, 30 aa, Mycobacterium
EILGYPPEGLPYRWPHPWLVDRKSAAQQQE

SEQ ID NO: 807789 - protein, 17 aa, Mycobacterium
EILILRVVVGLSAEETA

SEQ ID NO: 807790 - protein, 17 aa, Mycobacterium
EILIRQRGTKIHPGINV

SEQ ID NO: 807791 - protein, 17 aa, Mycobacterium
EILKVYTAQGGAGGALG

SEQ ID NO: 807792 - protein, 17 aa, Mycobacterium
EILLLDEGIGAVDAEFL

SEQ ID NO: 807793 - protein, 24 aa, Mycobacterium
EILPSLPLMVRADGLIDPAPMVQT

SEQ ID NO: 807794 - protein, 26 aa, Mycobacterium
EILQAPLVKAFLLQVSAKTLRDFGFE

SEQ ID NO: 807795 - protein, 21 aa, Mycobacterium
EILRAPLVKAFLLQVSAETLR

SEQ ID NO: 807796 - protein, 32 aa, Mycobacterium
EILREIRERLPNLRLWNFYGQTELAPLACALG

SEQ ID NO: 807797 - protein, 21 aa, Mycobacterium
EILRLLLGHPAYTSGRLTIGA

SEQ ID NO: 807798 - protein, 21 aa, Mycobacterium
EILRTNLAAVILQMAALQLGE

SEQ ID NO: 807799 - protein, 25 aa, Mycobacterium
EILTALWELIGYRISTPIPRISYAD

SEQ ID NO: 807800 - protein, 18 aa, Mycobacterium
EILTGLPPFTATTAVKMV

SEQ ID NO: 807801 - protein, 19 aa, Mycobacterium
EILTGLWTTPTGETFDYSG

SEQ ID NO: 807802 - protein, 23 aa, Mycobacterium
EILTRYLNLVSFGNGAYGIQDAA

SEQ ID NO: 807803 - protein, 22 aa, Mycobacterium
EILTRYPRLGFGDEFLACFADQ

SEQ ID NO: 807804 - protein, 20 aa, Mycobacterium
EILVLGLARGGVPVGWEVAQ

SEQ ID NO: 807805 - protein, 17 aa, Mycobacterium
EIMAVLCANLDSLEPVE

SEQ ID NO: 807806 - protein, 20 aa, Mycobacterium
EIMGLGPIEAVKRALANAGK

SEQ ID NO: 807807 - protein, 21 aa, Mycobacterium
EIMREIIGRDLRLDRSPSAKE

SEQ ID NO: 807808 - protein, 23 aa, Mycobacterium
EIMRFCQSFMTELYRHIGEYTDV

SEQ ID NO: 807809 - protein, 28 aa, Mycobacterium
EINCVPGYFAIHTLSRRWPAHNADEVVS

SEQ ID NO: 807810 - protein, 23 aa, Mycobacterium
EINEAFAPVVLAWLKEIKADPEK

SEQ ID NO: 807811 - protein, 26 aa, Mycobacterium
EINEAFASVVLSWARVHEPDMARVNV

SEQ ID NO: 807812 - protein, 22 aa, Mycobacterium
EINGKPRLMCMTRMSTFAEDEI

SEQ ID NO: 807813 - protein, 25 aa, Mycobacterium
EINGRPRLLCMTRMSTFGEDEVVTV

SEQ ID NO: 807814 - protein, 21 aa, Mycobacterium
EINGYPKLMCMTRMSTFAEDE

SEQ ID NO: 807815 - protein, 25 aa, Mycobacterium
EINGYPRLLCMTRMSTFAEDEVVTV

SEQ ID NO: 807816 - protein, 20 aa, Mycobacterium
EINLGPRRLAVTARRVIPDD

SEQ ID NO: 807817 - protein, 22 aa, Mycobacterium
EINRIRALRRPQHDQAPPARQR

SEQ ID NO: 807818 - protein, 20 aa, Mycobacterium
EINSALMLAGAGSGPTLAAA

SEQ ID NO: 807819 - protein, 24 aa, Mycobacterium
EINSARIFAGAGSGPMLQAAAAWD

SEQ ID NO: 807820 - protein, 23 aa, Mycobacterium
EINSARMFAGAGSGPMLQAATAW

SEQ ID NO: 807821 - protein, 17 aa, Mycobacterium
EINSARMYSGAGSGPLL

SEQ ID NO: 807822 - protein, 27 aa, Mycobacterium
EINSEEYLFYPSPSFDVAFIRGTTADE

SEQ ID NO: 807823 - protein, 18 aa, Mycobacterium
EINSGRMYSGPGSGPMLA

SEQ ID NO: 807824 - protein, 17 aa, Mycobacterium
EINSIRLYSGPGSAPMV

SEQ ID NO: 807825 - protein, 24 aa, Mycobacterium
EINSLRIFAGAGSAPMLEAAVAWD

SEQ ID NO: 807826 - protein, 22 aa, Mycobacterium
EINSLRLFSGAGSTSMLEAAAA

SEQ ID NO: 807827 - protein, 24 aa, Mycobacterium
EINSLRMFTGAGSAPMLQAAAAWD

SEQ ID NO: 807828 - protein, 24 aa, Mycobacterium
EINSLRMFTGAGSAPMLQAAAAWE

SEQ ID NO: 807829 - protein, 19 aa, Mycobacterium
EINSLRMYCGAGSGPMLEA

SEQ ID NO: 807830 - protein, 25 aa, Mycobacterium
EINTRGDIILFIDELHTLVGAGAAE

SEQ ID NO: 807831 - protein, 20 aa, Mycobacterium
EINYPAIAATLRDIGYTGTV

SEQ ID NO: 807832 - protein, 22 aa, Mycobacterium
EIPADRPALEAALGILRDITSG

SEQ ID NO: 807833 - protein, 17 aa, Mycobacterium
EIPARFDPIDVGMLHLG

SEQ ID NO: 807834 - protein, 29 aa, Mycobacterium
EIPDAELDAFWALLRPAGIDFMLGEWKGG

SEQ ID NO: 807835 - protein, 20 aa, Mycobacterium
EIPDALRHIWVARGGDREPS

SEQ ID NO: 807836 - protein, 32 aa, Mycobacterium
EIPDHFRIYVSQKLARLERFDRTIYLFDVELD

SEQ ID NO: 807837 - protein, 24 aa, Mycobacterium
EIPEVLILAWGHTIPMIADAVGVK

SEQ ID NO: 807838 - protein, 17 aa, Mycobacterium
EIPFKLHHPMWREHCDV

SEQ ID NO: 807839 - protein, 20 aa, Mycobacterium
EIPGIQGAFLAVINAWPDGS

SEQ ID NO: 807840 - protein, 22 aa, Mycobacterium
EIPGTIVSVLRAAAEAVTECAE

SEQ ID NO: 807841 - protein, 20 aa, Mycobacterium
EIPGTWLCKNGMEGTLIEGD

SEQ ID NO: 807842 - protein, 21 aa, Mycobacterium
EIPGTWLCRNGLEGTLIEGDL

SEQ ID NO: 807843 - protein, 21 aa, Mycobacterium
EIPGTWLCRNGLEGTLIEGDV

SEQ ID NO: 807844 - protein, 21 aa, Mycobacterium
EIPGTWLCRNGMEGTLIEGDV

SEQ ID NO: 807845 - protein, 20 aa, Mycobacterium
EIPHDGFLADFLMRTKGVIR

SEQ ID NO: 807846 - protein, 22 aa, Mycobacterium
EIPLRAMLFRVSDDEHLLVAVV

SEQ ID NO: 807847 - protein, 18 aa, Mycobacterium
EIPVAELAGLLGAASPTA

SEQ ID NO: 807848 - protein, 24 aa, Mycobacterium
EIPVFPRGMTGPRDDPYAFSFSGL

SEQ ID NO: 807849 - protein, 18 aa, Mycobacterium
EIPVIENISFLIGDGEHP

SEQ ID NO: 807850 - protein, 18 aa, Mycobacterium
EIPVPYVIAIVELAEQRG

SEQ ID NO: 807851 - protein, 27 aa, Mycobacterium
EIPVRLRDHRMVAIKRRIAQHAAALVP

SEQ ID NO: 807852 - protein, 17 aa, Mycobacterium
EIPVVVVACLRGVIPPW

SEQ ID NO: 807853 - protein, 23 aa, Mycobacterium
EIQATPWWKERIVSALSSYWVYQ

SEQ ID NO: 807854 - protein, 24 aa, Mycobacterium
EIQAYDELCFPGLAAEWAEWGDRR

SEQ ID NO: 807855 - protein, 27 aa, Mycobacterium
EIQHGSPPLALLTKLIEELSAGSSLRI

SEQ ID NO: 807856 - protein, 24 aa, Mycobacterium
EIQHYVWDPPVVKVNYALDGPIPW

SEQ ID NO: 807857 - protein, 18 aa, Mycobacterium
EIQLMNIRSRLADGAKVV

SEQ ID NO: 807858 - protein, 21 aa, Mycobacterium
EIQMRRVAGYMFGFMSQKAPK

SEQ ID NO: 807859 - protein, 21 aa, Mycobacterium
EIQPYLADVPVAIGGVTVVPG

SEQ ID NO: 807860 - protein, 17 aa, Mycobacterium
EIQRVVGSIPVKRLRQA

SEQ ID NO: 807861 - protein, 21 aa, Mycobacterium
EIRAHLLRTSGTPLSWDCFTF

SEQ ID NO: 807862 - protein, 25 aa, Mycobacterium
EIRDGLLYVFLPPTAELDDFLDLVA

SEQ ID NO: 807863 - protein, 24 aa, Mycobacterium
EIRDGRMWLPDRPGLGFTLSDQMR

SEQ ID NO: 807864 - protein, 26 aa, Mycobacterium
EIRDQSQLYGLLDRVRDLGLELVSVQ

SEQ ID NO: 807865 - protein, 24 aa, Mycobacterium
EIRGELRDFRRATAASFNGMRQDF

SEQ ID NO: 807866 - protein, 21 aa, Mycobacterium
EIRKAVRYQIKHGAALIKVCV

SEQ ID NO: 807867 - protein, 24 aa, Mycobacterium
EIRLAARPELIRLAGNGELKVTVD

SEQ ID NO: 807868 - protein, 17 aa, Mycobacterium
EIRLLSRFTGANPHVPV

SEQ ID NO: 807869 - protein, 17 aa, Mycobacterium
EIRMLRTLGADLVGMST

SEQ ID NO: 807870 - protein, 20 aa, Mycobacterium
EIRPALPHMGQLLVLGEDYD

SEQ ID NO: 807871 - protein, 25 aa, Mycobacterium
EIRRRGYRRIYLTTGPRQPEAKALY

SEQ ID NO: 807872 - protein, 22 aa, Mycobacterium
EIRSTIFQLKSPSGRDGGFRQR

SEQ ID NO: 807873 - protein, 17 aa, Mycobacterium
EIRTFMSDYPDNAVRDI

SEQ ID NO: 807874 - protein, 23 aa, Mycobacterium
EIRWALDLLRRRFAKVIWVPGNH

SEQ ID NO: 807875 - protein, 23 aa, Mycobacterium
EIRWTLDLLRRRFAKVIWVPGNH

SEQ ID NO: 807876 - protein, 27 aa, Mycobacterium
EISAGPYRFVYRKRFHKKPETELTVVA

SEQ ID NO: 807877 - protein, 21 aa, Mycobacterium
EISEWIDVQPLAWDNMYNAVD

SEQ ID NO: 807878 - protein, 21 aa, Mycobacterium
EISGGRFMFGLGAGAAPGSPW

SEQ ID NO: 807879 - protein, 20 aa, Mycobacterium
EISIEEVFFHCAKAFLRSDT

SEQ ID NO: 807880 - protein, 19 aa, Mycobacterium
EISIPIDIPINGTIGDINT

SEQ ID NO: 807881 - protein, 19 aa, Mycobacterium
EISLLIDPKALHARLDRPF

SEQ ID NO: 807882 - protein, 32 aa, Mycobacterium
EISLNWFPLDHVGGLVMFHIRDVWLRCRQVQV

SEQ ID NO: 807883 - protein, 26 aa, Mycobacterium
EISLPRWVEICSTTPARMFGMYGRKG

SEQ ID NO: 807884 - protein, 26 aa, Mycobacterium
EISSGPYRFVYRKRFHKKCETQLTVL

SEQ ID NO: 807885 - protein, 17 aa, Mycobacterium
EISTAIAALFERHALAY

SEQ ID NO: 807886 - protein, 18 aa, Mycobacterium
EISTPIPISIIVAPQTPP

SEQ ID NO: 807887 - protein, 18 aa, Mycobacterium
EISVLLQEWFRRVPEFQI

SEQ ID NO: 807888 - protein, 22 aa, Mycobacterium
EISVPWHRRAIHVFNVIITDGA

SEQ ID NO: 807889 - protein, 21 aa, Mycobacterium
EISWETAAVFPIPALTAEQVV

SEQ ID NO: 807890 - protein, 17 aa, Mycobacterium
EITALLAGLGYAGHFDF

SEQ ID NO: 807891 - protein, 17 aa, Mycobacterium
EITALTSGPWVGPSAAA

SEQ ID NO: 807892 - protein, 21 aa, Mycobacterium
EITAMFSAAPRFTVHRQLGAG

SEQ ID NO: 807893 - protein, 20 aa, Mycobacterium
EITELKYRYARTLDNKLWDE

SEQ ID NO: 807894 - protein, 25 aa, Mycobacterium
EITGLYPLGPIFPGSGLNITVMSMG

SEQ ID NO: 807895 - protein, 27 aa, Mycobacterium
EITILPQVWAMRYTLERVIRGQDTIAV

SEQ ID NO: 807896 - protein, 20 aa, Mycobacterium
EITKWLIEQKGFCAVAAEAD

SEQ ID NO: 807897 - protein, 17 aa, Mycobacterium
EITPCNLSLDRLATAVK

SEQ ID NO: 807898 - protein, 24 aa, Mycobacterium
EITPDHLLLGLFADTEGLAAKLLA

SEQ ID NO: 807899 - protein, 18 aa, Mycobacterium
EITPLTTLTLARLASEAG

SEQ ID NO: 807900 - protein, 23 aa, Mycobacterium
EITPLTTLTLARLASEAGLPDGV

SEQ ID NO: 807901 - protein, 19 aa, Mycobacterium
EITPVPFAHPLWVMFSSGT

SEQ ID NO: 807902 - protein, 27 aa, Mycobacterium
EITRSLMTTLYACRAALPAMVEQGHGV

SEQ ID NO: 807903 - protein, 22 aa, Mycobacterium
EITTALLSRPEPHRRPLQVIAE

SEQ ID NO: 807904 - protein, 18 aa, Mycobacterium
EITTFAQLLLERHDAMPY

SEQ ID NO: 807905 - protein, 24 aa, Mycobacterium
EITTHYSPMAWLSVTHRKKGTGVR

SEQ ID NO: 807906 - protein, 18 aa, Mycobacterium
EITVLESYLLRPSDKPSD

SEQ ID NO: 807907 - protein, 19 aa, Mycobacterium
EIVAAAAADMDGIGSAITA

SEQ ID NO: 807908 - protein, 21 aa, Mycobacterium
EIVARFLGVLELYRSKAVLFE

SEQ ID NO: 807909 - protein, 26 aa, Mycobacterium
EIVARLRQRFPKLQDPPSDDICYATQ

SEQ ID NO: 807910 - protein, 32 aa, Mycobacterium
EIVATAAQFWALIHGFVMLELAGFFGDEGAAI

SEQ ID NO: 807911 - protein, 19 aa, Mycobacterium
EIVDSLEKLAWMIKSENRK

SEQ ID NO: 807912 - protein, 18 aa, Mycobacterium
EIVEFTLVALLSDPARLP

SEQ ID NO: 807913 - protein, 28 aa, Mycobacterium
EIVGEVAELLWYPLWDANIRLDHSVRTV

SEQ ID NO: 807914 - protein, 20 aa, Mycobacterium
EIVHAYFPKGWQMACHVQGD

SEQ ID NO: 807915 - protein, 17 aa, Mycobacterium
EIVIKYFGPRAAERFCV

SEQ ID NO: 807916 - protein, 17 aa, Mycobacterium
EIVKDRGLWATHLGPHL

SEQ ID NO: 807917 - protein, 25 aa, Mycobacterium
EIVLDRKGNRHFSFGLGVHRCIGSN

SEQ ID NO: 807918 - protein, 19 aa, Mycobacterium
EIVLWARPRDMAPDGLFAL

SEQ ID NO: 807919 - protein, 25 aa, Mycobacterium
EIVPAAVLLNTFLNAAGAGLADVRL

SEQ ID NO: 807920 - protein, 18 aa, Mycobacterium
EIVPAFQLLTYPMLDDRS

SEQ ID NO: 807921 - protein, 20 aa, Mycobacterium
EIVPVFQPIFDLITGEVIGF

SEQ ID NO: 807922 - protein, 41 aa, Mycobacterium
EIVQLRRLLYCGEWIHSHALHIFLLHLPDFLGHPDGISLAR

SEQ ID NO: 807923 - protein, 27 aa, Mycobacterium
EIVRQLRLRDVGGIVVIDFIDMVLESN

SEQ ID NO: 807924 - protein, 24 aa, Mycobacterium
EIVSFAPVYRPPWDSFPRSEPYVV

SEQ ID NO: 807925 - protein, 22 aa, Mycobacterium
EIVTWMSVAPALRDGWEDSILQ

SEQ ID NO: 807926 - protein, 23 aa, Mycobacterium
EIVTYRQLWQARDERFGAVTGYQ

SEQ ID NO: 807927 - protein, 17 aa, Mycobacterium
EIVVIDNGRGIPDYVER

SEQ ID NO: 807928 - protein, 19 aa, Mycobacterium
EIWEGELPDWLVSTSERKS

SEQ ID NO: 807929 - protein, 25 aa, Mycobacterium
EIWGHLCCHYAIRALMYQAAEHPGD

SEQ ID NO: 807930 - protein, 17 aa, Mycobacterium
EIWPLLHDRSPITKSER

SEQ ID NO: 807931 - protein, 26 aa, Mycobacterium
EIWSSYILERYMAKNVFASLVDRKYE

SEQ ID NO: 807932 - protein, 28 aa, Mycobacterium
EIYDLLPGYLVFRALVSARPPTLKSVRT

SEQ ID NO: 807933 - protein, 26 aa, Mycobacterium
EIYGIGGSWFRLDDQLLIEWQRDFFD

SEQ ID NO: 807934 - protein, 26 aa, Mycobacterium
EIYGIGGSWFRLNDQLLIEWQRDFFD

SEQ ID NO: 807935 - protein, 20 aa, Mycobacterium
EIYMIATHTLIADGRDVDVV

SEQ ID NO: 807936 - protein, 23 aa, Mycobacterium
EIYRSQWMVLREDDIRRPDGSPG

SEQ ID NO: 807937 - protein, 18 aa, Mycobacterium
EIYTIINELASRGKAVIV

SEQ ID NO: 807938 - protein, 32 aa, Mycobacterium
EIYVPAPQRQFGYYVWPFLLDGRLVGRVDLKR

SEQ ID NO: 807939 - protein, 29 aa, Mycobacterium
EKAAELGLKPLVRLVSWGSAGVAPDLMGI

SEQ ID NO: 807940 - protein, 19 aa, Mycobacterium
EKAAVLRFLGPPYAGAPDD

SEQ ID NO: 807941 - protein, 30 aa, Mycobacterium
EKADEYGLRPLVRLVSWGLAGVAPDVMGIG

SEQ ID NO: 807942 - protein, 21 aa, Mycobacterium
EKAFAACSVLPPRDIRVTAFG

SEQ ID NO: 807943 - protein, 25 aa, Mycobacterium
EKAFAEWRRVLAPDATLIADVSLNP

SEQ ID NO: 807944 - protein, 25 aa, Mycobacterium
EKAGSFLNWEGRPRPFAPSLKTNAI

SEQ ID NO: 807945 - protein, 24 aa, Mycobacterium
EKAPAKKAPAKKATPAAAAKANPT

SEQ ID NO: 807946 - protein, 25 aa, Mycobacterium
EKAQELGLTWLVEIGAHGVAAGPDS

SEQ ID NO: 807947 - protein, 35 aa, Mycobacterium
EKAQFATYPILAVQGWAAFHDLKLRAVIGTAEQLA

SEQ ID NO: 807948 - protein, 23 aa, Mycobacterium
EKAREIPSFAPPKDLRPGDYRMA

SEQ ID NO: 807949 - protein, 27 aa, Mycobacterium
EKAREKLFPLICRYALAYHVVFIPSVE

SEQ ID NO: 807950 - protein, 19 aa, Mycobacterium
EKASQLIFRVLCESSLLIA

SEQ ID NO: 807951 - protein, 27 aa, Mycobacterium
EKAYADEPFVYLLPDGRLPKTGAVAGS

SEQ ID NO: 807952 - protein, 27 aa, Mycobacterium
EKAYDAEPFVYLLPEGQLPRTGSVIGS

SEQ ID NO: 807953 - protein, 23 aa, Mycobacterium
EKDLLRLPGLVAIAYQHETSRAG

SEQ ID NO: 807954 - protein, 26 aa, Mycobacterium
EKDPESYLLIPHVGGRRAILDWHHPE

SEQ ID NO: 807955 - protein, 25 aa, Mycobacterium
EKDPSASLWLARLLAEAGVPAGVFN

SEQ ID NO: 807956 - protein, 19 aa, Mycobacterium
EKDRRAGLMPNAKGVFSVL

SEQ ID NO: 807957 - protein, 21 aa, Mycobacterium
EKDVGFPYRSALWPGRNAEID

SEQ ID NO: 807958 - protein, 24 aa, Mycobacterium
EKDVKRQLLLDALADDLKVQVGQE

SEQ ID NO: 807959 - protein, 17 aa, Mycobacterium
EKDWEARLPTMAEQALA

SEQ ID NO: 807960 - protein, 18 aa, Mycobacterium
EKDWGDEFYLHPGQMVLA

SEQ ID NO: 807961 - protein, 31 aa, Mycobacterium
EKEAWTGLVSLILLMPGRLEAPLRDVDLNLF

SEQ ID NO: 807962 - protein, 26 aa, Mycobacterium
EKEKWTTYFLDPPQIELLRALRRSGT

SEQ ID NO: 807963 - protein, 30 aa, Mycobacterium
EKERYSMDWYYPILGGALRGPAAAARIDHR

SEQ ID NO: 807964 - protein, 31 aa, Mycobacterium
EKFDYAKGFKFSTYATWWIRQAITRGMADQS

SEQ ID NO: 807965 - protein, 36 aa, Mycobacterium; identical to SEQ ID NO: 114216

SEQ ID NO: 807966 - protein, 25 aa, Mycobacterium
EKGDRLPYNRVWLKALGAMPDDPVL

SEQ ID NO: 807967 - protein, 23 aa, Mycobacterium
EKGFLGMDFTVPDGIPAIDLRSG

SEQ ID NO: 807968 - protein, 27 aa, Mycobacterium
EKGLRRWRAVARSAARQSRRAHIPPVD

SEQ ID NO: 807969 - protein, 26 aa, Mycobacterium
EKGQVLFCGLWYDDEFVRTPEGWRMT

SEQ ID NO: 807970 - protein, 24 aa, Mycobacterium
EKGSLLRRPSYAQPALFAVETALY

SEQ ID NO: 807971 - protein, 25 aa, Mycobacterium
EKIAQAWETLLQRLGYRRYGAQGGD

SEQ ID NO: 807972 - protein, 18 aa, Mycobacterium
EKIESRYATALGAAELDA

SEQ ID NO: 807973 - protein, 21 aa, Mycobacterium
EKINEPRFPSFKGIMAAKKKE

SEQ ID NO: 807974 - protein, 35 aa, Mycobacterium
EKINERIHRLIRERGYLAFGLKLFTQTRKQFVDKR

SEQ ID NO: 807975 - protein, 27 aa, Mycobacterium
EKISSLPDLLPLLEKVAEAGKPLLIVA

SEQ ID NO: 807976 - protein, 25 aa, Mycobacterium
EKKIRLAPQYLLDDLPRLASRMDRP

SEQ ID NO: 807977 - protein, 25 aa, Mycobacterium
EKKRHEILQLELLKPKIAILDETDS

SEQ ID NO: 807978 - protein, 35 aa, Mycobacterium
EKLCDLFVYSALEADLSWFLMHRHVSTERAKAIRR

SEQ ID NO: 807979 - protein, 30 aa, Mycobacterium
EKLDDEAIIAFLRLLLPAGLETTYRSSGNL

SEQ ID NO: 807980 - protein, 18 aa, Mycobacterium
EKLDELKALWFSEAQKYN

SEQ ID NO: 807981 - protein, 23 aa, Mycobacterium
EKLELRRVAYFGGTVEAYLHKRA

SEQ ID NO: 807982 - protein, 24 aa, Mycobacterium
EKLELRRVAYFGGTVEAYLHKRAA

SEQ ID NO: 807983 - protein, 27 aa, Mycobacterium
EKLERLGLWGLMPRPVYDALIWCTFSG

SEQ ID NO: 807984 - protein, 43 aa, Mycobacterium
EKLKEALVKAIPFRRLARPDEVAAPVLFFASEAASFITGQVIS

SEQ ID NO: 807985 - protein, 39 aa, Mycobacterium
EKLKEALVKAIPFRRLARPEEVAAAVLFFASPAASFITG

SEQ ID NO: 807986 - protein, 22 aa, Mycobacterium
EKLPPYMVPTAVMVLDALPLTG

SEQ ID NO: 807987 - protein, 21 aa, Mycobacterium
EKLQELLAALPARAAGLDGDH

SEQ ID NO: 807988 - protein, 18 aa, Mycobacterium
EKLRLIVERGLIGESTLG

SEQ ID NO: 807989 - protein, 24 aa, Mycobacterium
EKLRNQLSTWVEHARRVSGRRRGR

SEQ ID NO: 807990 - protein, 21 aa, Mycobacterium
EKLRRRFARPLVQPTGLSPRP

SEQ ID NO: 807991 - protein, 18 aa, Mycobacterium
EKLRVHSLARVLGTSTRR

SEQ ID NO: 807992 - protein, 24 aa, Mycobacterium
EKLRVRVFDVHPLFARARTFVDTG

SEQ ID NO: 807993 - protein, 30 aa, Mycobacterium
EKLTDEAIYSFLRLLLPAGLETTYRSSGNL

SEQ ID NO: 807994 - protein, 22 aa, Mycobacterium
EKLVSLLDYPMFVVTTVVGDRK

SEQ ID NO: 807995 - protein, 26 aa, Mycobacterium
EKMPDGYDLGLWAKQTPLLHGADSEI

SEQ ID NO: 807996 - protein, 22 aa, Mycobacterium
EKMPRRFYCHARWHSSELNSET

SEQ ID NO: 807997 - protein, 26 aa, Mycobacterium
EKMRETLFPLICRYAEAYHVVSVPAD

SEQ ID NO: 807998 - protein, 19 aa, Mycobacterium
EKMSLFIVPGETPGIEIVR

SEQ ID NO: 807999 - protein, 24 aa, Mycobacterium
EKNRARILIGPDGRVMAAMPRLLG

SEQ ID NO: 808000 - protein, 22 aa, Mycobacterium
EKPFRHLALERAGDPREIVGAA

SEQ ID NO: 808001 - protein, 31 aa, Mycobacterium
EKPKHTRIFRLFNFSPALFSLPLAVDRASLD

SEQ ID NO: 808002 - protein, 30 aa, Mycobacterium
EKPVIVTPWRSVLLCDLPHGDADAVLRVLA

SEQ ID NO: 808003 - protein, 20 aa, Mycobacterium
EKQGEIVGFWKQIANKSDGS

SEQ ID NO: 808004 - protein, 20 aa, Mycobacterium
EKQHIFARAWIFVGHESEIA

SEQ ID NO: 808005 - protein, 24 aa, Mycobacterium
EKQIDAVALYTPILGLNAMIARHL

SEQ ID NO: 808006 - protein, 23 aa, Mycobacterium
EKQQKEFLLRQQLAAIRKELGEL

SEQ ID NO: 808007 - protein, 27 aa, Mycobacterium
EKQRHASLLPLLHNYQKPAPPLRGSMA

SEQ ID NO: 808008 - protein, 18 aa, Mycobacterium
EKRAADQAALQRATAEKS

SEQ ID NO: 808009 - protein, 25 aa, Mycobacterium
EKRERRKVLALNKLGDAALGVRRDF

SEQ ID NO: 808010 - protein, 23 aa, Mycobacterium
EKRFPQLTVLSIAPLLASTIREV

SEQ ID NO: 808011 - protein, 22 aa, Mycobacterium
EKRFRRFAALVRALNPLINRLP

SEQ ID NO: 808012 - protein, 24 aa, Mycobacterium
EKRFSMPWGRPVARMREFVQALHE

SEQ ID NO: 808013 - protein, 20 aa, Mycobacterium
EKRKALQWFQPHGVLISQGP

SEQ ID NO: 808014 - protein, 23 aa, Mycobacterium
EKRRLMVDLYKRVIDGVGQLGFP

SEQ ID NO: 808015 - protein, 22 aa, Mycobacterium
EKRSWLRARGLQTFPVVAWAER

SEQ ID NO: 808016 - protein, 27 aa, Mycobacterium
EKSDLGALAAGPIIAGSYTAGAGMGLS

SEQ ID NO: 808017 - protein, 39 aa, Mycobacterium
EKSDSGLTWLPPNPAYRCPYIARYLTVAVTYGLAITTEE

SEQ ID NO: 808018 - protein, 23 aa, Mycobacterium
EKSLDALTMPFLDPRKRVADYPT

SEQ ID NO: 808019 - protein, 25 aa, Mycobacterium
EKSRLSLFVVPIDSPGLTYQQIDTS

SEQ ID NO: 808020 - protein, 23 aa, Mycobacterium
EKSTFIEVCYLLIYGELPNTDQL

SEQ ID NO: 808021 - protein, 22 aa, Mycobacterium
EKSWRRMDPLLRQTFSDARQQL

SEQ ID NO: 808022 - protein, 23 aa, Mycobacterium
EKTGAVLIPPFDHPDIIAGQGTI

SEQ ID NO: 808023 - protein, 25 aa, Mycobacterium
EKTGHPFLQHLLAHRDATRLKVTVD

SEQ ID NO: 808024 - protein, 24 aa, Mycobacterium
EKTQKEFLLRQQLAAIRKELGELG

SEQ ID NO: 808025 - protein, 28 aa, Mycobacterium
EKTREKLFPLICRYALAYHVVFIPSVEV

SEQ ID NO: 808026 - protein, 30 aa, Mycobacterium
EKTYQVNYLAPFLLTTQLLTVLLDSRATVI

SEQ ID NO: 808027 - protein, 33 aa, Mycobacterium
EKVDDPLAMYLFDLCTLPLNLAGHCGMSVPAGL

SEQ ID NO: 808028 - protein, 33 aa, Mycobacterium
EKVDDPLAMYLFDLCTLPLNLAGHCGMSVPSGL

SEQ ID NO: 808029 - protein, 25 aa, Mycobacterium
EKVDPVKLNLTLSAAAQALTGLGDK

SEQ ID NO: 808030 - protein, 27 aa, Mycobacterium
EKVDYDRLLIATGTRARPWFNPEEAAL

SEQ ID NO: 808031 - protein, 24 aa, Mycobacterium
EKVEPLDLVWPHLQFTPLNEARRQ

SEQ ID NO: 808032 - protein, 27 aa, Mycobacterium
EKVGPDGLVVVLLPDGGRGYLSKVFND

SEQ ID NO: 808033 - protein, 25 aa, Mycobacterium
EKVGQYVKWGLNHLVFHAPGHDQRR

SEQ ID NO: 808034 - protein, 24 aa, Mycobacterium
EKVLPVPEFHPHIAKLKLADGVAT

SEQ ID NO: 808035 - protein, 23 aa, Mycobacterium
EKVMSLFDDNIEWVQPGESEISG

SEQ ID NO: 808036 - protein, 26 aa, Mycobacterium
EKVPTLRQILTIGPVPEALAGVATDL

SEQ ID NO: 808037 - protein, 19 aa, Mycobacterium
EKVWARPGLRLPPLDLAGC

SEQ ID NO: 808038 - protein, 20 aa, Mycobacterium
EKVWPYREQARPAPRGHSVP

SEQ ID NO: 808039 - protein, 17 aa, Mycobacterium
EKWAKVRGDKLAYRFLD

SEQ ID NO: 808040 - protein, 20 aa, Mycobacterium
EKWDFKRFQGLPASGIDIRI

SEQ ID NO: 808041 - protein, 18 aa, Mycobacterium
EKWTKYFLDPRQIQTMRA

SEQ ID NO: 808042 - protein, 25 aa, Mycobacterium
EKWVWAGAAVIYPEYTRALVSLSRG

SEQ ID NO: 808043 - protein, 23 aa, Mycobacterium
EKYELDLRTRIGRKPRGSYQIAI

SEQ ID NO: 808044 - protein, 31 aa, Mycobacterium
EKYGVTIYYTAPTLIRTFMKWGRAIPDAHDL

SEQ ID NO: 808045 - protein, 17 aa, Mycobacterium
EKYIPTRDLKLIVNLAG

SEQ ID NO: 808046 - protein, 24 aa, Mycobacterium
ELAAALVPLHDTPLGPLAPGVTLR

SEQ ID NO: 808047 - protein, 17 aa, Mycobacterium
ELAAGLSALTRGEEHPL

SEQ ID NO: 808048 - protein, 18 aa, Mycobacterium
ELAALATQLFWEATPSGA

SEQ ID NO: 808049 - protein, 33 aa, Mycobacterium
ELAALPREEWPTHLRRLIAEQVGLLLRRTVDPD

SEQ ID NO: 808050 - protein, 21 aa, Mycobacterium
ELAALVRRGMTPMQAIRAATV

SEQ ID NO: 808051 - protein, 19 aa, Mycobacterium
ELAARRQTHPFGPGRGRAG

SEQ ID NO: 808052 - protein, 17 aa, Mycobacterium
ELAATRLGRFAGLVAID

SEQ ID NO: 808053 - protein, 22 aa, Mycobacterium
ELAAWGLPVPTLTPQESVRDIS

SEQ ID NO: 808054 - protein, 18 aa, Mycobacterium
ELADALAYLVELPARGVG

SEQ ID NO: 808055 - protein, 24 aa, Mycobacterium
ELADIALRRPSLDDVFLSMTTDPS

SEQ ID NO: 808056 - protein, 42 aa, Mycobacterium
ELADLARHTLIWYIDALLDVAPLRILGLLPHKQRVAIQTNNI

SEQ ID NO: 808057 - protein, 24 aa, Mycobacterium
ELADLLHEILVAQVATYLGVEPSV

SEQ ID NO: 808058 - protein, 25 aa, Mycobacterium
ELADQFWGDRYGMLRDPFGHQWSMG

SEQ ID NO: 808059 - protein, 24 aa, Mycobacterium
ELADRIYEKLYAFANFGFPESHAQ

SEQ ID NO: 808060 - protein, 28 aa, Mycobacterium
ELADRLTDFRLLDVRWTVMAPDGRAAYL

SEQ ID NO: 808061 - protein, 18 aa, Mycobacterium
ELADVLDVGLRSAYVASW

SEQ ID NO: 808062 - protein, 24 aa, Mycobacterium
ELAEAALAIRAGALWVAANVDPTL

SEQ ID NO: 808063 - protein, 31 aa, Mycobacterium
ELAEGLHRALSKLFSILRRGDPNGAVAGELT

SEQ ID NO: 808064 - protein, 30 aa, Mycobacterium
ELAEGLHRALSKLFSILRRGDPNGVVAGEL

SEQ ID NO: 808065 - protein, 27 aa, Mycobacterium
ELAELRRVAPIWWNDQPIGKGGFNDGG

SEQ ID NO: 808066 - protein, 34 aa, Mycobacterium
ELAEQQAVLTGWWLRRMVAVRQPLREKLTLLWHN

SEQ ID NO: 808067 - protein, 22 aa, Mycobacterium
ELAERLGVTLLLKGNVTVIATP

SEQ ID NO: 808068 - protein, 25 aa, Mycobacterium
ELAEVHPHWIVLRTVIDVVEPIELP

SEQ ID NO: 808069 - protein, 21 aa, Mycobacterium
ELAEWFGIDAGTLRVGDRADF

SEQ ID NO: 808070 - protein, 18 aa, Mycobacterium
ELAFPNAVLALFHYPDKK

SEQ ID NO: 808071 - protein, 36 aa, Mycobacterium
ELAGAAHFVWVRDALRLGGKFPLKAGMLTSLGFGHV

SEQ ID NO: 808072 - protein, 26 aa, Mycobacterium
ELAGAEQAILLIPREPDLPADEVDTL

SEQ ID NO: 808073 - protein, 18 aa, Mycobacterium
ELAGARKALDDALTEIDE

SEQ ID NO: 808074 - protein, 18 aa, Mycobacterium
ELAGFFRDATGHARFNLG

SEQ ID NO: 808075 - protein, 17 aa, Mycobacterium
ELAGHYRFPQLRFIASV

SEQ ID NO: 808076 - protein, 18 aa, Mycobacterium
ELAGQFTALAWSLMKLTT

SEQ ID NO: 808077 - protein, 25 aa, Mycobacterium
ELAGWLGDNFLPPEVVDWPLNVVVV

SEQ ID NO: 808078 - protein, 19 aa, Mycobacterium
ELAGYALAIEQHYGRPMDI

SEQ ID NO: 808079 - protein, 31 aa, Mycobacterium; identical to SEQ ID NO: 125866

SEQ ID NO: 808080 - protein, 19 aa, Mycobacterium
ELAGYWTGAFAMAGPNTRI

SEQ ID NO: 808081 - protein, 21 aa, Mycobacterium
ELAHEFFRPLGEHLRASLAEL

SEQ ID NO: 808082 - protein, 28 aa, Mycobacterium
ELAHIPLRRFGSVSEIAPIVAFLCTEHS

SEQ ID NO: 808083 - protein, 25 aa, Mycobacterium
ELAIDLARFPALKDWSSEDLNILAN

SEQ ID NO: 808084 - protein, 25 aa, Mycobacterium
ELAIDLARFPALNTWSSEDLNILAS

SEQ ID NO: 808085 - protein, 29 aa, Mycobacterium
ELAILVPELLLIGQLIDRSGMAWCIQAFG

SEQ ID NO: 808086 - protein, 19 aa, Mycobacterium
ELAIWCDLRVVEEDAVFGV

SEQ ID NO: 808087 - protein, 29 aa, Mycobacterium
ELAKALTPLYKGLVTPALTPISDLLTQQY

SEQ ID NO: 808088 - protein, 24 aa, Mycobacterium
ELAKELRPWVPVVSLVKGLEQGTN

SEQ ID NO: 808089 - protein, 18 aa, Mycobacterium
ELAKILCNYSHRLAAAAR

SEQ ID NO: 808090 - protein, 17 aa, Mycobacterium
ELALASYPGFHVTAPPG

SEQ ID NO: 808091 - protein, 22 aa, Mycobacterium
ELALASYPGFTATAPPGDAQIY

SEQ ID NO: 808092 - protein, 19 aa, Mycobacterium
ELALASYPGFTSTAPPGDG

SEQ ID NO: 808093 - protein, 23 aa, Mycobacterium
ELALASYPGFTTTAPPGDGQVYG

SEQ ID NO: 808094 - protein, 19 aa, Mycobacterium
ELALIIHHLAVDGVSWRIL

SEQ ID NO: 808095 - protein, 25 aa, Mycobacterium
ELALRLIPGYVVTPTIKLLSDELVR

SEQ ID NO: 808096 - protein, 23 aa, Mycobacterium
ELALRVRSVLRRSPASIAAHPVD

SEQ ID NO: 808097 - protein, 22 aa, Mycobacterium
ELALRYETALAAGAPLADLCHT

SEQ ID NO: 808098 - protein, 17 aa, Mycobacterium
ELAPETGLDLFAGLGLL

SEQ ID NO: 808099 - protein, 26 aa, Mycobacterium
ELAPGSILVPFSWQQVSLHAAGAAAV

SEQ ID NO: 808100 - protein, 20 aa, Mycobacterium
ELAPIYVLLASDDASYISGA

SEQ ID NO: 808101 - protein, 22 aa, Mycobacterium
ELAPRNIMVNALAPLAATPMTE

SEQ ID NO: 808102 - protein, 26 aa, Mycobacterium
ELAQRGWPVFLVSTVTRENLQPLIFG

SEQ ID NO: 808103 - protein, 24 aa, Mycobacterium
ELARAPFEMRTPVLRISPHVDVTV

SEQ ID NO: 808104 - protein, 18 aa, Mycobacterium
ELARAVRLRSAAVAAAVA

SEQ ID NO: 808105 - protein, 25 aa, Mycobacterium
ELARDALREWLRRGGKPARLIDIAS

SEQ ID NO: 808106 - protein, 18 aa, Mycobacterium
ELARFLRLHLGIRTKQET

SEQ ID NO: 808107 - protein, 28 aa, Mycobacterium
ELARGLARRGFPLLLVARRRERLDELAN

SEQ ID NO: 808108 - protein, 25 aa, Mycobacterium
ELARLDALTKPRLGFPHNMLELAPG

SEQ ID NO: 808109 - protein, 19 aa, Mycobacterium
ELARLLAPGATVVLAARKA

SEQ ID NO: 808110 - protein, 22 aa, Mycobacterium
ELARMLIERFDGRVLLVGHRDP

SEQ ID NO: 808111 - protein, 18 aa, Mycobacterium
ELARRLAPGAPVILAARD

SEQ ID NO: 808112 - protein, 25 aa, Mycobacterium
ELARRLIPGYVVTPAIKLLSDELVR

SEQ ID NO: 808113 - protein, 17 aa, Mycobacterium
ELARRLLITPQGVQLAL

SEQ ID NO: 808114 - protein, 21 aa, Mycobacterium
ELARSWRVQWPQLPDAMEQAA

SEQ ID NO: 808115 - protein, 27 aa, Mycobacterium
ELARTLHRPALVPVPSLGPRILLGEQG

SEQ ID NO: 808116 - protein, 23 aa, Mycobacterium
ELARVLKRCSYLCDEVAVRDMAK

SEQ ID NO: 808117 - protein, 25 aa, Mycobacterium
ELASGILPIYIRTPSLLAMTAAGLD

SEQ ID NO: 808118 - protein, 25 aa, Mycobacterium
ELASGVFPIYIRTPSLLAMTAAGLD

SEQ ID NO: 808119 - protein, 25 aa, Mycobacterium
ELASGVLPLYIRTPSLLAMTAAGLD

SEQ ID NO: 808120 - protein, 25 aa, Mycobacterium
ELATLSWVYWHNTSRLHSYLGDLPP

SEQ ID NO: 808121 - protein, 25 aa, Mycobacterium
ELATLSWVYWHNTSRLHSYLNDIPP

SEQ ID NO: 808122 - protein, 31 aa, Mycobacterium
ELATPLRQPTKFLGLHFFNPVPASQLVEIVV

SEQ ID NO: 808123 - protein, 17 aa, Mycobacterium
ELATSRWWKEERHGVFV

SEQ ID NO: 808124 - protein, 23 aa, Mycobacterium
ELAVLLEELPVYLASVGAQGSWL

SEQ ID NO: 808125 - protein, 18 aa, Mycobacterium
ELAWLRRGPPARTAKPKF

SEQ ID NO: 808126 - protein, 18 aa, Mycobacterium
ELAWLRRGPPARTSKPKF

SEQ ID NO: 808127 - protein, 26 aa, Mycobacterium
ELAWRLDAAGRYGPPRRWLVVTGTNG

SEQ ID NO: 808128 - protein, 17 aa, Mycobacterium
ELAYELEEARPWVRIHA

SEQ ID NO: 808129 - protein, 18 aa, Mycobacterium
ELAYLLDRHPCIAEVFRA

SEQ ID NO: 808130 - protein, 17 aa, Mycobacterium
ELCALLRRNGAEVSSAA

SEQ ID NO: 808131 - protein, 24 aa, Mycobacterium
ELCAVFDGFYTLLVSNRDSFAVVR

SEQ ID NO: 808132 - protein, 20 aa, Mycobacterium
ELCAWVRMRPDRVVIDAVAI

SEQ ID NO: 808133 - protein, 26 aa, Mycobacterium
ELCDDAPFYTLGPLATDIAPAYDHIT

SEQ ID NO: 808134 - protein, 27 aa, Mycobacterium
ELCDKRKIPLLFLQNIAGFMVGRDYEA

SEQ ID NO: 808135 - protein, 17 aa, Mycobacterium
ELCDQFGIVFIADEVMA

SEQ ID NO: 808136 - protein, 25 aa, Mycobacterium
ELCEEAPFYTLGPLTTDIAPAYDHI

SEQ ID NO: 808137 - protein, 20 aa, Mycobacterium
ELCFVFGRLPTAPVGTLKDP

SEQ ID NO: 808138 - protein, 23 aa, Mycobacterium
ELCPAQIWQLRQSAAGYVAPTPV

SEQ ID NO: 808139 - protein, 19 aa, Mycobacterium
ELCRLDAGLVLTSIGYRGK

SEQ ID NO: 808140 - protein, 23 aa, Mycobacterium
ELCSLTFPGYKPSAAGLVGSALF

SEQ ID NO: 808141 - protein, 17 aa, Mycobacterium
ELDAAIIRITPRRIISF

SEQ ID NO: 808142 - protein, 25 aa, Mycobacterium
ELDALPPRMPIRLLVAAISAAVAAE

SEQ ID NO: 808143 - protein, 28 aa, Mycobacterium
ELDAMPARLPIRALWKAIELAAMAEHAL

SEQ ID NO: 808144 - protein, 25 aa, Mycobacterium
ELDARQWLAFGAAQWLRRSAEARTV

SEQ ID NO: 808145 - protein, 17 aa, Mycobacterium
ELDAVLIGGGPAPRRVV

SEQ ID NO: 808146 - protein, 20 aa, Mycobacterium
ELDAYVVRRLNLAFRDVDWT

SEQ ID NO: 808147 - protein, 20 aa, Mycobacterium
ELDAYVVRRLNLPFRDVDWT

SEQ ID NO: 808148 - protein, 25 aa, Mycobacterium
ELDELGFPALWIPDVGGPVFDAVGN

SEQ ID NO: 808149 - protein, 24 aa, Mycobacterium
ELDELPTHLVIVGGSYIALEFAQM

SEQ ID NO: 808150 - protein, 25 aa, Mycobacterium
ELDELRVRYAIAPLLPADAAAGAEV

SEQ ID NO: 808151 - protein, 35 aa, Mycobacterium; identical to SEQ ID NO: 114233

SEQ ID NO: 808152 - protein, 18 aa, Mycobacterium
ELDGFWVKPQWIERRYVD

SEQ ID NO: 808153 - protein, 25 aa, Mycobacterium
ELDGLPEMGLVGRQLWTQSGLKPAD

SEQ ID NO: 808154 - protein, 24 aa, Mycobacterium
ELDGQTHTVSWPRSAKLLDVLLAA

SEQ ID NO: 808155 - protein, 19 aa, Mycobacterium
ELDHLIANRPIIAAEINDR

SEQ ID NO: 808156 - protein, 18 aa, Mycobacterium
ELDIAPFQVCQFADAGDI

SEQ ID NO: 808157 - protein, 18 aa, Mycobacterium
ELDIGHRTIPNYGGFDLG

SEQ ID NO: 808158 - protein, 19 aa, Mycobacterium
ELDLALTPQGTLAEKLRAG

SEQ ID NO: 808159 - protein, 24 aa, Mycobacterium
ELDLHAPVARYWPEFGQAGKEAIT

SEQ ID NO: 808160 - protein, 18 aa, Mycobacterium
ELDMIVFATGFDAMTGSL

SEQ ID NO: 808161 - protein, 20 aa, Mycobacterium
ELDMLLTAGERISNALVAMA

SEQ ID NO: 808162 - protein, 18 aa, Mycobacterium
ELDNQLTDLLAPRDPHDA

SEQ ID NO: 808163 - protein, 22 aa, Mycobacterium
ELDPLMYDKSYYLEPDSKSSKS

SEQ ID NO: 808164 - protein, 31 aa, Mycobacterium
ELDPPGHTPYRKLVMPFFTAPAVAAMEPQLR

SEQ ID NO: 808165 - protein, 39 aa, Mycobacterium
ELDQFDFDYVFVDCPPSLGLLTINALVAAPEVLIPIQCE

SEQ ID NO: 808166 - protein, 30 aa, Mycobacterium
ELDRDDLWDRYRQAALYPYVATLITVGMGG

SEQ ID NO: 808167 - protein, 24 aa, Mycobacterium
ELDRFLVAVTFRIGRLGVPVIAEF

SEQ ID NO: 808168 - protein, 22 aa, Mycobacterium
ELDRGTWTPAPVFGMIAQRGRI

SEQ ID NO: 808169 - protein, 25 aa, Mycobacterium
ELDRLQRHYSGRPSPLYEATRLSEH

SEQ ID NO: 808170 - protein, 24 aa, Mycobacterium
ELDRLQRHYTGRPSPLYEAERLSE

SEQ ID NO: 808171 - protein, 27 aa, Mycobacterium
ELDRRGLLRRIGGAPYLHTLISTVPTA

SEQ ID NO: 808172 - protein, 18 aa, Mycobacterium
ELDRRHTALVLWAEPRGE

SEQ ID NO: 808173 - protein, 27 aa, Mycobacterium
ELDRRNLLRRIGGAPYLHTLISTVPTA

SEQ ID NO: 808174 - protein, 25 aa, Mycobacterium
ELDTFDLLRRYGVIVDWGTGELLPN

SEQ ID NO: 808175 - protein, 18 aa, Mycobacterium
ELDTIRRAMPTLRATVVV

SEQ ID NO: 808176 - protein, 22 aa, Mycobacterium
ELDVARAVRPPTPGRRLPKSLT

SEQ ID NO: 808177 - protein, 21 aa, Mycobacterium
ELDVLALYIAAVATGSIALSV

SEQ ID NO: 808178 - protein, 19 aa, Mycobacterium
ELDVVDLHRLALTCRSRGT

SEQ ID NO: 808179 - protein, 31 aa, Mycobacterium
ELDWRVGPPVGPLPYLTLRLTGVAAITVDVQ

SEQ ID NO: 808180 - protein, 18 aa, Mycobacterium
ELDWWTAPFTLEDGVPRS

SEQ ID NO: 808181 - protein, 20 aa, Mycobacterium
ELEADIVFLAMGFVGPEKPG

SEQ ID NO: 808182 - protein, 17 aa, Mycobacterium
ELEALLETVFHRGSKMH

SEQ ID NO: 808183 - protein, 18 aa, Mycobacterium
ELEALLETVFHRGSKMHD

SEQ ID NO: 808184 - protein, 19 aa, Mycobacterium
ELEAPDYFQVPKRGKVEIL

SEQ ID NO: 808185 - protein, 23 aa, Mycobacterium
ELEARVLVLRDAHPRWGPTRIVY

SEQ ID NO: 808186 - protein, 19 aa, Mycobacterium
ELEDFWRDHLDGAPPEIEL

SEQ ID NO: 808187 - protein, 17 aa, Mycobacterium
ELEDRVRHPLYGKIIRT

SEQ ID NO: 808188 - protein, 25 aa, Mycobacterium
ELEDRVRHPLYGKIIRTTKKVKAHD

SEQ ID NO: 808189 - protein, 25 aa, Mycobacterium
ELEDRVRHPLYGKIIRTTTKVKAHD

SEQ ID NO: 808190 - protein, 17 aa, Mycobacterium
ELEFGRLHLPVPDWQVL

SEQ ID NO: 808191 - protein, 21 aa, Mycobacterium
ELEGLLSAWQGALTGGVRTVL

SEQ ID NO: 808192 - protein, 18 aa, Mycobacterium
ELEHHANLIPWQELARRT

SEQ ID NO: 808193 - protein, 19 aa, Mycobacterium
ELEIAFAEIIRLAGPFGGN

SEQ ID NO: 808194 - protein, 23 aa, Mycobacterium
ELEIHALLYRYARAVDTKDWDLY

SEQ ID NO: 808195 - protein, 18 aa, Mycobacterium
ELEIMPAWGGAERLAALV

SEQ ID NO: 808196 - protein, 17 aa, Mycobacterium
ELEIPAAPLNTPGALFD

SEQ ID NO: 808197 - protein, 25 aa, Mycobacterium
ELEKRRAHVPWVTWGTTAMVARSVD

SEQ ID NO: 808198 - protein, 25 aa, Mycobacterium
ELEKRRARVPWVTWGTTAMVARSVT

SEQ ID NO: 808199 - protein, 20 aa, Mycobacterium
ELEKVWDDLPYDAKWYSDNE

SEQ ID NO: 808200 - protein, 25 aa, Mycobacterium
ELELDFHMSYDAAPLGRICLCRVHD

SEQ ID NO: 808201 - protein, 22 aa, Mycobacterium
ELELFLDLVGYLSTTSASFFLD

SEQ ID NO: 808202 - protein, 25 aa, Mycobacterium
ELELGQRFDAVLLASSLINYPGTEL

SEQ ID NO: 808203 - protein, 24 aa, Mycobacterium
ELELKAPAGVEIKWIYRGGRADLV

SEQ ID NO: 808204 - protein, 25 aa, Mycobacterium
ELELKRVFVLTFEVDFFAKHGFREI

SEQ ID NO: 808205 - protein, 35 aa, Mycobacterium
ELELPVAGQNWPWGHPHRYAFSPHPISGAAAKLWR

SEQ ID NO: 808206 - protein, 17 aa, Mycobacterium
ELELRWAGLRAHNRWLA

SEQ ID NO: 808207 - protein, 18 aa, Mycobacterium
ELELRWAGLRAHNRWLAD

SEQ ID NO: 808208 - protein, 21 aa, Mycobacterium
ELENLIRPTGFYRNKANSLIG

SEQ ID NO: 808209 - protein, 47 aa, Mycobacterium
ELEPDFQRAYKELAKQVRLPGFRPGKAPIRLLEARFGREAMLDQIVN

SEQ ID NO: 808210 - protein, 20 aa, Mycobacterium
ELEPYRLMFVEEPVLSEHVD

SEQ ID NO: 808211 - protein, 21 aa, Mycobacterium
ELERLYPRTAAELSSWGQGWL

SEQ ID NO: 808212 - protein, 18 aa, Mycobacterium
ELERLYVPWSERTGKHWL

SEQ ID NO: 808213 - protein, 17 aa, Mycobacterium
ELERRIRAGERDVVLLG

SEQ ID NO: 808214 - protein, 21 aa, Mycobacterium
ELERRLVARGIPAYRLDGDNL

SEQ ID NO: 808215 - protein, 19 aa, Mycobacterium
ELERYWAAPADTPAYKKGA

SEQ ID NO: 808216 - protein, 25 aa, Mycobacterium
ELESAAALLAGVGSNVGAAGSAAAG

SEQ ID NO: 808217 - protein, 25 aa, Mycobacterium
ELESARPDCVLLDLHLPDASGIDAL

SEQ ID NO: 808218 - protein, 23 aa, Mycobacterium
ELETLQRRQASLEEQLLEVMERR

SEQ ID NO: 808219 - protein, 22 aa, Mycobacterium
ELETLTRRQASLEDSLLDVLER

SEQ ID NO: 808220 - protein, 31 aa, Mycobacterium
ELEVVRIAAPCRLLDDWIAPGAARAMHNRGG

SEQ ID NO: 808221 - protein, 17 aa, Mycobacterium
ELEWMRRLAGEIDRPVS

SEQ ID NO: 808222 - protein, 17 aa, Mycobacterium
ELFAAGQRGPDGRGPGG

SEQ ID NO: 808223 - protein, 23 aa, Mycobacterium
ELFAAIVVLMQWGDKHLPNPDGP

SEQ ID NO: 808224 - protein, 25 aa, Mycobacterium
ELFAENIELLTQLWAGKKIDWPGSR

SEQ ID NO: 808225 - protein, 21 aa, Mycobacterium
ELFAGILAQVPFVDPLTTILD

SEQ ID NO: 808226 - protein, 32 aa, Mycobacterium
ELFDASPHNLFPLVFDMLFRGETPRINGDDYP

SEQ ID NO: 808227 - protein, 18 aa, Mycobacterium
ELFDAWFAPAVENPAIRR

SEQ ID NO: 808228 - protein, 34 aa, Mycobacterium
ELFDEGLPWCDGAFELLERLVAEGTPMALVTNTN

SEQ ID NO: 808229 - protein, 26 aa, Mycobacterium
ELFDSFSVRMREAMLALLAGSAERPH

SEQ ID NO: 808230 - protein, 19 aa, Mycobacterium
ELFDSVWGGRFVGEAALSS

SEQ ID NO: 808231 - protein, 24 aa, Mycobacterium
ELFDTLLVFQNFPSLGLADGKARA

SEQ ID NO: 808232 - protein, 21 aa, Mycobacterium
ELFDTLLVYENFPPGGLVGSD

SEQ ID NO: 808233 - protein, 19 aa, Mycobacterium
ELFDTVWGGRFVGEAALTS

SEQ ID NO: 808234 - protein, 19 aa, Mycobacterium
ELFEDNWFRSIGEQSSYAR

SEQ ID NO: 808235 - protein, 28 aa, Mycobacterium
ELFERSAGNPLLLRGFLTAGRESGTLVH

SEQ ID NO: 808236 - protein, 19 aa, Mycobacterium
ELFETGLAAMRRRGELRPD

SEQ ID NO: 808237 - protein, 17 aa, Mycobacterium
ELFGAPYAYAQPHSGID

SEQ ID NO: 808238 - protein, 17 aa, Mycobacterium
ELFGLPKFGVKILLDVL

SEQ ID NO: 808239 - protein, 25 aa, Mycobacterium
ELFHRHHRQLYRLAHLTSRDPDDAA

SEQ ID NO: 808240 - protein, 17 aa, Mycobacterium
ELFKPLATKATRPEVRG

SEQ ID NO: 808241 - protein, 20 aa, Mycobacterium
ELFNLRFQMATGQLANNRRL

SEQ ID NO: 808242 - protein, 22 aa, Mycobacterium
ELFNLRFQMATGQLNNNRRLRT

SEQ ID NO: 808243 - protein, 21 aa, Mycobacterium
ELFNLRFQMATGQLTNNRRLR

SEQ ID NO: 808244 - protein, 24 aa, Mycobacterium
ELFPEEMFADLFPSQRGRPSIPAE

SEQ ID NO: 808245 - protein, 26 aa, Mycobacterium
ELFPEEMFADLFPSRRGRPSVPAEVM

SEQ ID NO: 808246 - protein, 20 aa, Mycobacterium
ELFPFDRVIRLSMENVKHPS

SEQ ID NO: 808247 - protein, 21 aa, Mycobacterium
ELFPLLLSVMSTGVTFVRSEE

SEQ ID NO: 808248 - protein, 19 aa, Mycobacterium
ELFPRMRVPQAWYDAGIAA

SEQ ID NO: 808249 - protein, 22 aa, Mycobacterium
ELFQGEPPWNIGEPQPELAALI

SEQ ID NO: 808250 - protein, 17 aa, Mycobacterium
ELFRAVGLDYWDEVGKR

SEQ ID NO: 808251 - protein, 20 aa, Mycobacterium
ELFRESMRLILDGSVLAAAM

SEQ ID NO: 808252 - protein, 23 aa, Mycobacterium
ELFSAIYQRWYQHGLDVALEALG

SEQ ID NO: 808253 - protein, 24 aa, Mycobacterium
ELFSAVDLVPTLLGLLGIDAPADV

SEQ ID NO: 808254 - protein, 22 aa, Mycobacterium
ELFTRYAFPPNELGYCGPDGAA

SEQ ID NO: 808255 - protein, 20 aa, Mycobacterium
ELFVGPPDAPLQLVRVRIAE

SEQ ID NO: 808256 - protein, 17 aa, Mycobacterium
ELFVPQANTPWPTDGRH

SEQ ID NO: 808257 - protein, 23 aa, Mycobacterium
ELGAAIPTMIPMGRMGDPEEDIA

SEQ ID NO: 808258 - protein, 25 aa, Mycobacterium
ELGAALHPGPWLSTAVAAPQALNLL

SEQ ID NO: 808259 - protein, 25 aa, Mycobacterium
ELGAGRLTYRQLWDRAARVAGGLRA

SEQ ID NO: 808260 - protein, 26 aa, Mycobacterium
ELGAKKIAMVAPYMKPLTSQVVDYIE

SEQ ID NO: 808261 - protein, 33 aa, Mycobacterium
ELGATWSRWGQPLFPIGVLYDPFVERALEPWSF

SEQ ID NO: 808262 - protein, 24 aa, Mycobacterium
ELGCRSLALVAFGTGVGGFPVEEA

SEQ ID NO: 808263 - protein, 28 aa, Mycobacterium
ELGDAPGKGWRLIQAVVAFPDVESANNF

SEQ ID NO: 808264 - protein, 27 aa, Mycobacterium
ELGDRVAALAAAWRSGLPGGLRPGDFV

SEQ ID NO: 808265 - protein, 24 aa, Mycobacterium
ELGDSWRLSQILSLQTRAAMAAGD

SEQ ID NO: 808266 - protein, 25 aa, Mycobacterium
ELGDTGRILLRPSGTEPMIRVMVEA

SEQ ID NO: 808267 - protein, 27 aa, Mycobacterium
ELGDVADALWYPLWDANIRLDHSVRTV

SEQ ID NO: 808268 - protein, 26 aa, Mycobacterium
ELGEHLPVFRPPLDMARLFGAPTLGP

SEQ ID NO: 808269 - protein, 26 aa, Mycobacterium
ELGEHLPVFRPPLDMARLFGHPELSS

SEQ ID NO: 808270 - protein, 26 aa, Mycobacterium
ELGEHLPVFRPPLDMARLFGQPELGP

SEQ ID NO: 808271 - protein, 24 aa, Mycobacterium
ELGELITFAIRIPLEIDMVVDLRI

SEQ ID NO: 808272 - protein, 22 aa, Mycobacterium
ELGEVLARLRTPTDGRLYDIEY

SEQ ID NO: 808273 - protein, 22 aa, Mycobacterium
ELGEWLHPFEKLWRDKLSALAE

SEQ ID NO: 808274 - protein, 25 aa, Mycobacterium
ELGFRPRRLAGRVVWMAPPDAPLPA

SEQ ID NO: 808275 - protein, 23 aa, Mycobacterium
ELGFRTAFVARPLEFGPGGDADV

SEQ ID NO: 808276 - protein, 20 aa, Mycobacterium
ELGGFLEELPVDASALESKL

SEQ ID NO: 808277 - protein, 20 aa, Mycobacterium
ELGHPWTVLRATESTDYLVL

SEQ ID NO: 808278 - protein, 17 aa, Mycobacterium
ELGIAQRVTFLPPQSRT

SEQ ID NO: 808279 - protein, 25 aa, Mycobacterium
ELGIELPGVVPPVAAYVPAVHTGNH

SEQ ID NO: 808280 - protein, 33 aa, Mycobacterium
ELGIPARPVVIGPVTFLLLSKAVDGASAPIGRL

SEQ ID NO: 808281 - protein, 20 aa, Mycobacterium
ELGIRVLRYGSGPGGDHAAT

SEQ ID NO: 808282 - protein, 17 aa, Mycobacterium
ELGKRDIYRDSQLGLFP

SEQ ID NO: 808283 - protein, 26 aa, Mycobacterium
ELGKRLVPTPLLGTTLAELALLSVDA

SEQ ID NO: 808284 - protein, 24 aa, Mycobacterium
ELGLDSMMAMNLLRDAKALVRIDL

SEQ ID NO: 808285 - protein, 18 aa, Mycobacterium
ELGLDSVRFVLLMKQLGV

SEQ ID NO: 808286 - protein, 27 aa, Mycobacterium
ELGLKLPSVLLPLWDSELGTGLVSTLR

SEQ ID NO: 808287 - protein, 17 aa, Mycobacterium
ELGLKPRKAFGPIRVGA

SEQ ID NO: 808288 - protein, 17 aa, Mycobacterium
ELGLPEMGVVGRQLWGQ

SEQ ID NO: 808289 - protein, 21 aa, Mycobacterium
ELGLPVVVRPSFTMGGLGSGM

SEQ ID NO: 808290 - protein, 17 aa, Mycobacterium
ELGLRPMLPRLDTPERA

SEQ ID NO: 808291 - protein, 22 aa, Mycobacterium
ELGLSYLLPRAIGTSRAFEIML

SEQ ID NO: 808292 - protein, 32 aa, Mycobacterium
ELGLTAPMSLMRFIKFILTEIFPGGRLPQIPQ

SEQ ID NO: 808293 - protein, 35 aa, Mycobacterium
ELGLTSPMSLLRFIKFILTEIFPGGRLPRISQVDH

SEQ ID NO: 808294 - protein, 20 aa, Mycobacterium
ELGLVATLVPPALKTRNLDH

SEQ ID NO: 808295 - protein, 33 aa, Mycobacterium
ELGMMWREVYKLRQPVLLIWGREDRVNPLDGAL

SEQ ID NO: 808296 - protein, 34 aa, Mycobacterium
ELGMMWREVYKLRQPVLLIWGREDRVNPLDGALV

SEQ ID NO: 808297 - protein, 34 aa, Mycobacterium
ELGMMWREVYRLRQPVLLIWGREDRVNPLDGALV

SEQ ID NO: 808298 - protein, 20 aa, Mycobacterium
ELGMPLFHRVGRGVVLADAG

SEQ ID NO: 808299 - protein, 24 aa, Mycobacterium
ELGNFVTALVYLPRDRYTTTVRLA

SEQ ID NO: 808300 - protein, 27 aa, Mycobacterium
ELGPDEVPLNFFNPRPGTPFGDLEVLP

SEQ ID NO: 808301 - protein, 25 aa, Mycobacterium
ELGPIRPPQRLAPFSYALGAEVKHA

SEQ ID NO: 808302 - protein, 25 aa, Mycobacterium
ELGPIRPPQRLAPYSYALGAEVRHP

SEQ ID NO: 808303 - protein, 34 aa, Mycobacterium
ELGPQAARPVLFSTFLMWVLADLFTTLPEVGDLD

SEQ ID NO: 808304 - protein, 25 aa, Mycobacterium
ELGQPLPLFIKWDDAEYGLRANEHG

SEQ ID NO: 808305 - protein, 23 aa, Mycobacterium
ELGQWDDTLFIYLCGDNGASGEG

SEQ ID NO: 808306 - protein, 20 aa, Mycobacterium
ELGRADGEKWVWAGAAVIYP

SEQ ID NO: 808307 - protein, 25 aa, Mycobacterium
ELGRAEIRALFRSSKVGLIAGCMIS

SEQ ID NO: 808308 - protein, 25 aa, Mycobacterium
ELGRAEIRALFRSSKVGLIAGCMIT

SEQ ID NO: 808309 - protein, 21 aa, Mycobacterium
ELGRAIDGAWWPRADRITNEL

SEQ ID NO: 808310 - protein, 24 aa, Mycobacterium
ELGRALAPVPFVSSTVLATGLLLD

SEQ ID NO: 808311 - protein, 25 aa, Mycobacterium
ELGRALTPVPFAATILAIEAILRMG

SEQ ID NO: 808312 - protein, 32 aa, Mycobacterium
ELGRALVPSPLLGTTLAELALLAAAEPDAKTL

SEQ ID NO: 808313 - protein, 27 aa, Mycobacterium
ELGRALVPSPLLGTTLAELALLAAPEP

SEQ ID NO: 808314 - protein, 29 aa, Mycobacterium
ELGRALVPSPLLGTTLAELALLSAAEPDA

SEQ ID NO: 808315 - protein, 17 aa, Mycobacterium
ELGRAYVRWAIAHPDHY

SEQ ID NO: 808316 - protein, 30 aa, Mycobacterium
ELGRGLVPSPLLGTTLAELALLAAPEPDAE

SEQ ID NO: 808317 - protein, 20 aa, Mycobacterium
ELGRIRRILSQDRLFLVVQD

SEQ ID NO: 808318 - protein, 25 aa, Mycobacterium
ELGSHDLRLWRQLEFPGTNGQVSAL

SEQ ID NO: 808319 - protein, 35 aa, Mycobacterium
ELGSQSLRPVLFSTFLMWVLADLFTYLPEVGDLDK

SEQ ID NO: 808320 - protein, 25 aa, Mycobacterium
ELGVDVFLVVPFTPEFMKLSPERYV

SEQ ID NO: 808321 - protein, 17 aa, Mycobacterium
ELGVIPNMQPLWAQMDA

SEQ ID NO: 808322 - protein, 25 aa, Mycobacterium
ELGVLSGLSFKLYTADRTAGALNLF

SEQ ID NO: 808323 - protein, 22 aa, Mycobacterium
ELGVSHLYLSPILTAVAGSSHG

SEQ ID NO: 808324 - protein, 20 aa, Mycobacterium
ELGVSWLAEIGAHGVVAGPD

SEQ ID NO: 808325 - protein, 25 aa, Mycobacterium
ELGWALRRPPMPPTGQHWRLLSTVK

SEQ ID NO: 808326 - protein, 24 aa, Mycobacterium
ELGWERNIAALAARYRVLAPDQLG

SEQ ID NO: 808327 - protein, 27 aa, Mycobacterium
ELGYCLGRPWWRRGLMSEAMSVLIDDT

SEQ ID NO: 808328 - protein, 28 aa, Mycobacterium
ELGYDPNLWRLLCEQVGAAALVIPEEFG

SEQ ID NO: 808329 - protein, 19 aa, Mycobacterium
ELGYRLLPARFADALARAE

SEQ ID NO: 808330 - protein, 17 aa, Mycobacterium
ELGYTYRQYRHAIEAED

SEQ ID NO: 808331 - protein, 19 aa, Mycobacterium
ELHDCFYNETFLNHAKDYW

SEQ ID NO: 808332 - protein, 27 aa, Mycobacterium
ELHELRTKCYWPVPWGNDDQLTYFGYG

SEQ ID NO: 808333 - protein, 25 aa, Mycobacterium
ELHEVITDFFRYFTKLTADRRENPT

SEQ ID NO: 808334 - protein, 26 aa, Mycobacterium
ELHGSAIYRIPLFCALSNVAAAPAVG

SEQ ID NO: 808335 - protein, 27 aa, Mycobacterium
ELHKQAHLPYLVYLRHPTTGGVFASWG

SEQ ID NO: 808336 - protein, 23 aa, Mycobacterium
ELHLFTPEVVFLLQHSTRTGRRD

SEQ ID NO: 808337 - protein, 24 aa, Mycobacterium
ELHLFTPEVVFLLQHSTRTGRYEV

SEQ ID NO: 808338 - protein, 17 aa, Mycobacterium
ELHNVLITPTVPIPAFP

SEQ ID NO: 808339 - protein, 24 aa, Mycobacterium
ELHRRANRLARWFIGQGFGPEDII

SEQ ID NO: 808340 - protein, 32 aa, Mycobacterium
ELHRRGCVVQRLILLDPPQLPGSTLRSLGVEE

SEQ ID NO: 808341 - protein, 25 aa, Mycobacterium
ELHRSPAIRLAGRRAFEIAGLGTDD

SEQ ID NO: 808342 - protein, 18 aa, Mycobacterium
ELHTKGVDVLGLILGKTD

SEQ ID NO: 808343 - protein, 27 aa, Mycobacterium
ELHTMPFAALHFFPARALELGGFQEPV

SEQ ID NO: 808344 - protein, 17 aa, Mycobacterium
ELHVSGQALPWLADHVV

SEQ ID NO: 808345 - protein, 25 aa, Mycobacterium
ELHYLGARLWRNGIGAAMQSFIDTG

SEQ ID NO: 808346 - protein, 26 aa, Mycobacterium
ELIAAVTARRPGWFNARWVAVAMQNR

SEQ ID NO: 808347 - protein, 20 aa, Mycobacterium
ELIAGLGAYPAYYAHMGVIN

SEQ ID NO: 808348 - protein, 30 aa, Mycobacterium
ELIALGPDDRLCIVPPFYHCFGMVMGTLGA

SEQ ID NO: 808349 - protein, 17 aa, Mycobacterium
ELIAMLRHYEHSGTAAI

SEQ ID NO: 808350 - protein, 18 aa, Mycobacterium
ELIARIRAVLRRGADNDD

SEQ ID NO: 808351 - protein, 18 aa, Mycobacterium
ELIARIRAVLRRGGDDDS

SEQ ID NO: 808352 - protein, 18 aa, Mycobacterium
ELIARLAARPLDKSRPLW

SEQ ID NO: 808353 - protein, 19 aa, Mycobacterium
ELIARLAARPLDKSRPLWE

SEQ ID NO: 808354 - protein, 19 aa, Mycobacterium
ELICGVARHLGFGDAFDHK

SEQ ID NO: 808355 - protein, 27 aa, Mycobacterium
ELIDPTFARPLRPLAPVAQLALGEPEP

SEQ ID NO: 808356 - protein, 19 aa, Mycobacterium
ELIDRPRGMSYLVVRGRRG

SEQ ID NO: 808357 - protein, 18 aa, Mycobacterium
ELIDSAAMDLANIGTALN

SEQ ID NO: 808358 - protein, 23 aa, Mycobacterium
ELIDWRRTDPLPGRIATGAGGYG

SEQ ID NO: 808359 - protein, 19 aa, Mycobacterium
ELIFITSLTVLKASPGHIA

SEQ ID NO: 808360 - protein, 18 aa, Mycobacterium
ELIGGTSIDWRDGLRRMA

SEQ ID NO: 808361 - protein, 21 aa, Mycobacterium
ELIGILGGETRQLAFAKTPPT

SEQ ID NO: 808362 - protein, 19 aa, Mycobacterium
ELIGTGLGWRRLDVVDETG

SEQ ID NO: 808363 - protein, 31 aa, Mycobacterium
ELIMALLAPRHSAVALLPRAYRTPLHLRSCA

SEQ ID NO: 808364 - protein, 25 aa, Mycobacterium
ELIPRQITNYRWALSAFGTASAANL

SEQ ID NO: 808365 - protein, 19 aa, Mycobacterium
ELIQWLPVAALDQPIGNIG

SEQ ID NO: 808366 - protein, 20 aa, Mycobacterium
ELIREYPQLAAFEFAIRAED

SEQ ID NO: 808367 - protein, 19 aa, Mycobacterium
ELIRIALTTKLKPYTYVST

SEQ ID NO: 808368 - protein, 17 aa, Mycobacterium
ELIRYVRPPWLRRWARD

SEQ ID NO: 808369 - protein, 25 aa, Mycobacterium
ELITDIGLTTFPLTSGSKGLHLYVP

SEQ ID NO: 808370 - protein, 21 aa, Mycobacterium
ELITIAHYWKQWADPRLVVAV

SEQ ID NO: 808371 - protein, 28 aa, Mycobacterium
ELITIKRYWSEWKDPRLIIAILHNNDLN

SEQ ID NO: 808372 - protein, 17 aa, Mycobacterium
ELITMAVGSRRGPGVLA

SEQ ID NO: 808373 - protein, 22 aa, Mycobacterium
ELITPAAVMLRRCETCAGDVDE

SEQ ID NO: 808374 - protein, 21 aa, Mycobacterium
ELITVRGRRLLAHADVVIADR

SEQ ID NO: 808375 - protein, 17 aa, Mycobacterium
ELITYEALGLCAEGEGG

SEQ ID NO: 808376 - protein, 17 aa, Mycobacterium
ELIVGGATYDLAAAAAL

SEQ ID NO: 808377 - protein, 18 aa, Mycobacterium
ELIYWCIDDVARGLAWRW

SEQ ID NO: 808378 - protein, 19 aa, Mycobacterium
ELKDYYRKASKARGTWRAT

SEQ ID NO: 808379 - protein, 17 aa, Mycobacterium
ELKFFPAEQAGGAKYLR

SEQ ID NO: 808380 - protein, 17 aa, Mycobacterium
ELKGFTAIREWAKKFYP

SEQ ID NO: 808381 - protein, 25 aa, Mycobacterium
ELKKHFRPEFLNRIDDIIVFHQLTK

SEQ ID NO: 808382 - protein, 29 aa, Mycobacterium
ELKKHFRPEFLNRIDDIIVFHQLTRDEII

SEQ ID NO: 808383 - protein, 18 aa, Mycobacterium
ELKLLPQEEWAGRLRRLI

SEQ ID NO: 808384 - protein, 39 aa, Mycobacterium
ELKNHNFDYVFIDCPPSLGLLTINALVAAPEVLIPIQCE

SEQ ID NO: 808385 - protein, 31 aa, Mycobacterium
ELKNTWAEALWRFSLAPLQHACAFYTDLHPG

SEQ ID NO: 808386 - protein, 18 aa, Mycobacterium
ELKPDESRWRMAVEKVLR

SEQ ID NO: 808387 - protein, 30 aa, Mycobacterium
ELKPRNLWAEPIDMLRYSPHSWQRVTLFER

SEQ ID NO: 808388 - protein, 25 aa, Mycobacterium
ELKQALYPRLLPIARDWWAKLGRDA

SEQ ID NO: 808389 - protein, 25 aa, Mycobacterium
ELKQALYPRLLPIARDWWGKLGRDA

SEQ ID NO: 808390 - protein, 22 aa, Mycobacterium
ELKQGWLEIDSEIKELFLRGQR

SEQ ID NO: 808391 - protein, 17 aa, Mycobacterium
ELKQKIIEHLRGRGHEP

SEQ ID NO: 808392 - protein, 17 aa, Mycobacterium
ELKRAYRKLARELHPDI

SEQ ID NO: 808393 - protein, 25 aa, Mycobacterium
ELKRDVALNLIGAIGLITLPRSDEI

SEQ ID NO: 808394 - protein, 22 aa, Mycobacterium
ELKRIWTHSAYRKRGLAKALLT

SEQ ID NO: 808395 - protein, 19 aa, Mycobacterium
ELKRRRTLAALEAMEASGA

SEQ ID NO: 808396 - protein, 17 aa, Mycobacterium
ELKRVLGGLWGAQDPTD

SEQ ID NO: 808397 - protein, 35 aa, Mycobacterium
ELKSRPTRPHPLFAAFIGAAIDYKAAERLPGMDLP

SEQ ID NO: 808398 - protein, 27 aa, Mycobacterium
ELKYGAVATVWNILDPLQLVHNKDKAV

SEQ ID NO: 808399 - protein, 19 aa, Mycobacterium
ELLAAAIRLTRPGGVVLYA

SEQ ID NO: 808400 - protein, 19 aa, Mycobacterium
ELLAAIFGASTITGGTMSL

SEQ ID NO: 808401 - protein, 19 aa, Mycobacterium
ELLADWRTTRAALHDALLA

SEQ ID NO: 808402 - protein, 22 aa, Mycobacterium
ELLAGAERPLIVLGKGAAYAQA

SEQ ID NO: 808403 - protein, 17 aa, Mycobacterium
ELLAGYYHAVHALTLQY

SEQ ID NO: 808404 - protein, 17 aa, Mycobacterium
ELLAILHLDRVDENTFI

SEQ ID NO: 808405 - protein, 17 aa, Mycobacterium
ELLAPFSGRYFDVIEDV

SEQ ID NO: 808406 - protein, 21 aa, Mycobacterium
ELLARMRALLRRTKPDDTAES

SEQ ID NO: 808407 - protein, 21 aa, Mycobacterium
ELLAWALDDLATVFGLAVHPI

SEQ ID NO: 808408 - protein, 21 aa, Mycobacterium
ELLDARLVFEPLAASLAAEHI

SEQ ID NO: 808409 - protein, 17 aa, Mycobacterium
ELLDAYPLVSIEDPLSE

SEQ ID NO: 808410 - protein, 17 aa, Mycobacterium
ELLDFTVLAKVFGYPTT

SEQ ID NO: 808411 - protein, 24 aa, Mycobacterium
ELLDPGFPMLLQRNAYTVEAVYHL

SEQ ID NO: 808412 - protein, 22 aa, Mycobacterium
ELLDRELGLPLPDAGTRRALLE

SEQ ID NO: 808413 - protein, 17 aa, Mycobacterium
ELLDSWPRSNWLQYALL

SEQ ID NO: 808414 - protein, 29 aa, Mycobacterium
ELLDTMRELPDGHLWVYRLAAEEDDPAAW

SEQ ID NO: 808415 - protein, 22 aa, Mycobacterium
ELLDVALTHPVKLIANALGVPP

SEQ ID NO: 808416 - protein, 17 aa, Mycobacterium
ELLDVFVVWERQYYERA

SEQ ID NO: 808417 - protein, 21 aa, Mycobacterium
ELLEAAYRYALSHGLADMSLR

SEQ ID NO: 808418 - protein, 19 aa, Mycobacterium
ELLEAIFGARRSTAGDVVV

SEQ ID NO: 808419 - protein, 20 aa, Mycobacterium
ELLEDFEQFGYYLVHNPALA

SEQ ID NO: 808420 - protein, 24 aa, Mycobacterium
ELLEEVVNRVWFLDAVRGEVDVYN

SEQ ID NO: 808421 - protein, 21 aa, Mycobacterium
ELLEGYFDFHYRHRADLVLIV

SEQ ID NO: 808422 - protein, 30 aa, Mycobacterium
ELLEILELKAGRILFNGWPTGVEVGHAMVH

SEQ ID NO: 808423 - protein, 17 aa, Mycobacterium
ELLEPTRIYAKDCLALC

SEQ ID NO: 808424 - protein, 26 aa, Mycobacterium
ELLERFRAMEPWLEGGRVHAPFWEVH

SEQ ID NO: 808425 - protein, 22 aa, Mycobacterium
ELLEVVGLRRTDAARYPTEFSG

SEQ ID NO: 808426 - protein, 20 aa, Mycobacterium
ELLFDQLVKATGPTGLLSEE

SEQ ID NO: 808427 - protein, 24 aa, Mycobacterium
ELLGIDPLYVANEGKFIAVVAPEE

SEQ ID NO: 808428 - protein, 21 aa, Mycobacterium
ELLGIMPIDVIKAAAGLLGGS

SEQ ID NO: 808429 - protein, 27 aa, Mycobacterium
ELLGPKAHKVWKPVIAALHGIVAGGAM

SEQ ID NO: 808430 - protein, 18 aa, Mycobacterium
ELLGRDRSLLRLRAARET

SEQ ID NO: 808431 - protein, 17 aa, Mycobacterium
ELLGRLPFELTAGQRDV

SEQ ID NO: 808432 - protein, 18 aa, Mycobacterium
ELLGRLPFELTAGQREVL

SEQ ID NO: 808433 - protein, 19 aa, Mycobacterium
ELLGRTAAFADRLRAAGVE

SEQ ID NO: 808434 - protein, 17 aa, Mycobacterium
ELLGYLNAGAHATPEGA

SEQ ID NO: 808435 - protein, 31 aa, Mycobacterium
ELLHETLETPLPWPPPFWKSAADQGLTSVHL

SEQ ID NO: 808436 - protein, 20 aa, Mycobacterium
ELLIRGPIVMRGYRKQPEKT

SEQ ID NO: 808437 - protein, 19 aa, Mycobacterium
ELLITALGIIKAGAVYLPV

SEQ ID NO: 808438 - protein, 17 aa, Mycobacterium
ELLKILESRLDNVVYRA

SEQ ID NO: 808439 - protein, 25 aa, Mycobacterium
ELLLGGSIFPAMQNFLLAARAQGLG

SEQ ID NO: 808440 - protein, 20 aa, Mycobacterium
ELLLMGQMIDRSGMAWCISN

SEQ ID NO: 808441 - protein, 19 aa, Mycobacterium
ELLLSGDWKTRVARIAAGL

SEQ ID NO: 808442 - protein, 17 aa, Mycobacterium
ELLQPIRRMAHGCASSA

SEQ ID NO: 808443 - protein, 19 aa, Mycobacterium
ELLQRRITMPENTIRWAWA

SEQ ID NO: 808444 - protein, 17 aa, Mycobacterium
ELLRKLVRQVFTKAAIA

SEQ ID NO: 808445 - protein, 20 aa, Mycobacterium
ELLRLAEWVADPRATVVVGA

SEQ ID NO: 808446 - protein, 17 aa, Mycobacterium
ELLRLDNRLPGLDAAHR

SEQ ID NO: 808447 - protein, 26 aa, Mycobacterium
ELLRNGVLVDLYPLVRKSLRAGAESF

SEQ ID NO: 808448 - protein, 31 aa, Mycobacterium
ELLRRLDLHPESWWWRVTHPGLYVSIGRKTA

SEQ ID NO: 808449 - protein, 24 aa, Mycobacterium
ELLRRLLTWQGWMDAPSSRRTKAW

SEQ ID NO: 808450 - protein, 20 aa, Mycobacterium
ELLRRYLDRWYWQVKDYVSG

SEQ ID NO: 808451 - protein, 26 aa, Mycobacterium
ELLRTAVLAFLTYIDRNRASWMVLYT

SEQ ID NO: 808452 - protein, 19 aa, Mycobacterium
ELLSQLAVALLGSDEHFPP

SEQ ID NO: 808453 - protein, 23 aa, Mycobacterium
ELLTATPPSWRPDIRQPADLVEE

SEQ ID NO: 808454 - protein, 21 aa, Mycobacterium
ELLTEAWLTQAPKKLAKEFLT

SEQ ID NO: 808455 - protein, 21 aa, Mycobacterium
ELLTLDQWNAIIDVNIRGVVH

SEQ ID NO: 808456 - protein, 22 aa, Mycobacterium
ELLTRRAGLLSGGQRQQLAIAR

SEQ ID NO: 808457 - protein, 23 aa, Mycobacterium
ELLTSLVPAVHGLAAMLGPGNEV

SEQ ID NO: 808458 - protein, 17 aa, Mycobacterium
ELLVARCEALLAAGDVS

SEQ ID NO: 808459 - protein, 18 aa, Mycobacterium
ELLVEVRIPLRHNTSSAY

SEQ ID NO: 808460 - protein, 25 aa, Mycobacterium
ELLVIGIRHRNPVGKLLLGSVAQRL

SEQ ID NO: 808461 - protein, 18 aa, Mycobacterium
ELLVLMDGLERLAQAPIP

SEQ ID NO: 808462 - protein, 25 aa, Mycobacterium
ELLVRVHTVRQRPGWRRRLIDDTGS

SEQ ID NO: 808463 - protein, 18 aa, Mycobacterium
ELLVTLRAYLECRQERSA

SEQ ID NO: 808464 - protein, 22 aa, Mycobacterium
ELMAAWSSRRLAIEARTADLAK

SEQ ID NO: 808465 - protein, 22 aa, Mycobacterium
ELMAAWSSRRLAIEARTAELAK

SEQ ID NO: 808466 - protein, 34 aa, Mycobacterium
ELMDTALIVDEPFLLPAHIDLAALRVKFDGGTLP

SEQ ID NO: 808467 - protein, 17 aa, Mycobacterium
ELMFLSAYSLETIAAQV

SEQ ID NO: 808468 - protein, 20 aa, Mycobacterium
ELMLRKATWLYDNGKPCGRE

SEQ ID NO: 808469 - protein, 20 aa, Mycobacterium
ELMRRFNGAALEAMLNRLNL

SEQ ID NO: 808470 - protein, 17 aa, Mycobacterium
ELMSAPWYDERLAKLAA

SEQ ID NO: 808471 - protein, 21 aa, Mycobacterium
ELMTMALKHAILERGVAHLVV

SEQ ID NO: 808472 - protein, 30 aa, Mycobacterium
ELNAAHGRTFFLATRLLAPDQRPAVHALYG

SEQ ID NO: 808473 - protein, 19 aa, Mycobacterium
ELNAFTAREHTCYYAHVLD

SEQ ID NO: 808474 - protein, 25 aa, Mycobacterium
ELNAIPAVMAAPVGLLSTLDLPLVT

SEQ ID NO: 808475 - protein, 20 aa, Mycobacterium
ELNALRPQLLAARHTPEGYK

SEQ ID NO: 808476 - protein, 17 aa, Mycobacterium
ELNASFYRWPKDSTFKG

SEQ ID NO: 808477 - protein, 17 aa, Mycobacterium
ELNDIGQISIRLAEAIS

SEQ ID NO: 808478 - protein, 20 aa, Mycobacterium
ELNGSFYRWPSDAQFERWRD

SEQ ID NO: 808479 - protein, 24 aa, Mycobacterium
ELNHEPFLTLGIHIGARATSIVAT

SEQ ID NO: 808480 - protein, 17 aa, Mycobacterium
ELNIAITAIPLDSSGQP

SEQ ID NO: 808481 - protein, 21 aa, Mycobacterium
ELNKLWTQEPVWPCLYLHGRD

SEQ ID NO: 808482 - protein, 31 aa, Mycobacterium
ELNLYALHDSVGTPFLLLSGMEPDLRWERFV

SEQ ID NO: 808483 - protein, 34 aa, Mycobacterium
ELNLYALHDTVGTPFLLLAGLEPDLRWERFITAV

SEQ ID NO: 808484 - protein, 24 aa, Mycobacterium
ELNRFVFAMPEQLGRVYLGLTDEA

SEQ ID NO: 808485 - protein, 18 aa, Mycobacterium
ELNRPAALIAALPAILGF

SEQ ID NO: 808486 - protein, 17 aa, Mycobacterium
ELNRPGALIAALPAILG

SEQ ID NO: 808487 - protein, 22 aa, Mycobacterium
ELNRWWTEPPRLPSLYLHGRDD

SEQ ID NO: 808488 - protein, 26 aa, Mycobacterium
ELNVPRRDLRMLAARLGSDVPFALHG

SEQ ID NO: 808489 - protein, 18 aa, Mycobacterium
ELNVRWRKGQTLEPDWQI

SEQ ID NO: 808490 - protein, 26 aa, Mycobacterium
ELNVSAGALYWHFANKQQLLGAVADR

SEQ ID NO: 808491 - protein, 25 aa, Mycobacterium
ELPAAQFVHLFVPRGAITVEAVGEL

SEQ ID NO: 808492 - protein, 25 aa, Mycobacterium
ELPADLLGLCRALIDSVPEQLLRRP

SEQ ID NO: 808493 - protein, 17 aa, Mycobacterium
ELPAMRRVLHIDGSGPK

SEQ ID NO: 808494 - protein, 17 aa, Mycobacterium
ELPATALAWREGFLDGQ

SEQ ID NO: 808495 - protein, 23 aa, Mycobacterium
ELPATAQVWRRGLLDGQHVKVIA

SEQ ID NO: 808496 - protein, 18 aa, Mycobacterium
ELPATEFAGFLWVALDPG

SEQ ID NO: 808497 - protein, 28 aa, Mycobacterium
ELPATEFAGFLWVSLHPAARLDVPAHLG

SEQ ID NO: 808498 - protein, 17 aa, Mycobacterium
ELPAVIAEWDAALAQVG

SEQ ID NO: 808499 - protein, 19 aa, Mycobacterium
ELPDELFIESLRQLIAVDE

SEQ ID NO: 808500 - protein, 24 aa, Mycobacterium
ELPDRACWALQHLLTRRYISAESD

SEQ ID NO: 808501 - protein, 21 aa, Mycobacterium
ELPDRTWPDKVITRAPQWGAV

SEQ ID NO: 808502 - protein, 18 aa, Mycobacterium
ELPEAYPLKMIGMREPRS

SEQ ID NO: 808503 - protein, 19 aa, Mycobacterium
ELPEGPTLPLVPRAEQQDP

SEQ ID NO: 808504 - protein, 31 aa, Mycobacterium
ELPERLLPRVIPRLWRDWGPQGYDTGAELAD

SEQ ID NO: 808505 - protein, 37 aa, Mycobacterium; identical to SEQ ID NO: 125917

SEQ ID NO: 808506 - protein, 23 aa, Mycobacterium
ELPGDPLALIAPAGSGPGGGGLG

SEQ ID NO: 808507 - protein, 17 aa, Mycobacterium
ELPGEDVLYWVGDTGPM

SEQ ID NO: 808508 - protein, 25 aa, Mycobacterium
ELPGESPRLFVVTRNAASVVAGDVA

SEQ ID NO: 808509 - protein, 22 aa, Mycobacterium
ELPGKWGEYLLASRATTIYGGT

SEQ ID NO: 808510 - protein, 19 aa, Mycobacterium
ELPGLHPGVLGLGDHLVEA

SEQ ID NO: 808511 - protein, 26 aa, Mycobacterium
ELPGVVVRPLLPLTERRLGIAVSASA

SEQ ID NO: 808512 - protein, 22 aa, Mycobacterium
ELPIELARLHWSVADPARTARA

SEQ ID NO: 808513 - protein, 17 aa, Mycobacterium
ELPIFEDTALFARGVGE

SEQ ID NO: 808514 - protein, 22 aa, Mycobacterium
ELPIRTLSDMVWIPESEREHMA

SEQ ID NO: 808515 - protein, 18 aa, Mycobacterium
ELPKRRPVPLRLKDWHEV

SEQ ID NO: 808516 - protein, 27 aa, Mycobacterium
ELPLPALQVLLYPITDWVSETRSRTLF

SEQ ID NO: 808517 - protein, 17 aa, Mycobacterium
ELPLVTGKGLYLPPAGA

SEQ ID NO: 808518 - protein, 17 aa, Mycobacterium
ELPNMRAIVGFAAETGD

SEQ ID NO: 808519 - protein, 18 aa, Mycobacterium
ELPPLVIGMAWHPRFDAD

SEQ ID NO: 808520 - protein, 23 aa, Mycobacterium
ELPPYRGKWPEIWVAAHGPRMLR

SEQ ID NO: 808521 - protein, 24 aa, Mycobacterium
ELPQRHIGVGWASLRSLPPPAGHA

SEQ ID NO: 808522 - protein, 18 aa, Mycobacterium
ELPRDPNGKLYKRRIRER

SEQ ID NO: 808523 - protein, 20 aa, Mycobacterium
ELPRKPTGKILKKELRKPHW

SEQ ID NO: 808524 - protein, 27 aa, Mycobacterium
ELPRLPRTALIDVLLRCPPRTRSAAPL

SEQ ID NO: 808525 - protein, 21 aa, Mycobacterium
ELPRLVRRRALTYNVSLLLVL

SEQ ID NO: 808526 - protein, 24 aa, Mycobacterium
ELPRRTRISIPQRKPLLPDRAPPI

SEQ ID NO: 808527 - protein, 21 aa, Mycobacterium
ELPRTVTFKVLKRQLAAQGLE

SEQ ID NO: 808528 - protein, 18 aa, Mycobacterium
ELPRTYELLGRTPRRPRP

SEQ ID NO: 808529 - protein, 19 aa, Mycobacterium
ELPSLRKILHLDSDGPAAL

SEQ ID NO: 808530 - protein, 20 aa, Mycobacterium
ELPSRVRGISPRSPLPGADG

SEQ ID NO: 808531 - protein, 17 aa, Mycobacterium
ELPTIRAQIARMGTGLA

SEQ ID NO: 808532 - protein, 23 aa, Mycobacterium
ELPTKRYCIGLLAAAGKLGVAAE

SEQ ID NO: 808533 - protein, 18 aa, Mycobacterium
ELPTRALLISAHDEPAIV

SEQ ID NO: 808534 - protein, 21 aa, Mycobacterium
ELPTYAFDRRRFWLSRDDAPA

SEQ ID NO: 808535 - protein, 22 aa, Mycobacterium
ELPTYAFEKRRFWLSGEGVSVD

SEQ ID NO: 808536 - protein, 28 aa, Mycobacterium
ELPTYAFERRRFWLAGDGTTVDAAGLGL

SEQ ID NO: 808537 - protein, 23 aa, Mycobacterium
ELPTYGFVHRRFWLDQPDDSRTA

SEQ ID NO: 808538 - protein, 26 aa, Mycobacterium
ELPVAGQDWPWGYPHRYPHAPHPVSG

SEQ ID NO: 808539 - protein, 23 aa, Mycobacterium
ELPVDDPLPLKLRDPRPAQTAGI

SEQ ID NO: 808540 - protein, 18 aa, Mycobacterium
ELPWRQVTAKPADIEKLA

SEQ ID NO: 808541 - protein, 20 aa, Mycobacterium
ELPWVGHRSRNWEPEPLRWL

SEQ ID NO: 808542 - protein, 23 aa, Mycobacterium
ELPYDELVIATGLVPKRIGSFPD

SEQ ID NO: 808543 - protein, 18 aa, Mycobacterium
ELQAALRRGELAIREARN

SEQ ID NO: 808544 - protein, 24 aa, Mycobacterium
ELQAELELPIYFGNRNWEPYVEDT

SEQ ID NO: 808545 - protein, 19 aa, Mycobacterium
ELQALLGRPGLSPADRAQL

SEQ ID NO: 808546 - protein, 18 aa, Mycobacterium
ELQEIGFFKLLQPSQWGG

SEQ ID NO: 808547 - protein, 23 aa, Mycobacterium
ELQGILGIVTQLIAVTAHLEIDY

SEQ ID NO: 808548 - protein, 23 aa, Mycobacterium
ELQHRYIPGLLDGSRYGSLGITE

SEQ ID NO: 808549 - protein, 25 aa, Mycobacterium
ELQLERLFVLTFETEFFARHGFTEI

SEQ ID NO: 808550 - protein, 24 aa, Mycobacterium
ELQLERLFVLTFETEFFTAHGFTE

SEQ ID NO: 808551 - protein, 24 aa, Mycobacterium
ELQLKRLFVLTFETEFFGKHGFTE

SEQ ID NO: 808552 - protein, 18 aa, Mycobacterium
ELQLWVAACLYKGGVDIY

SEQ ID NO: 808553 - protein, 23 aa, Mycobacterium
ELQQRFPFDLVIFALDCGGEFIN

SEQ ID NO: 808554 - protein, 22 aa, Mycobacterium
ELQRRGCVVSRLILLDAQPVMD

SEQ ID NO: 808555 - protein, 18 aa, Mycobacterium
ELQRRLQAAGAETVALAA

SEQ ID NO: 808556 - protein, 17 aa, Mycobacterium
ELQRVVASIPVKRLRQA

SEQ ID NO: 808557 - protein, 24 aa, Mycobacterium
ELQSLRARFGTLTGVDRPVADGDF

SEQ ID NO: 808558 - protein, 20 aa, Mycobacterium
ELQTAFAVSPWAARTPIDVE

SEQ ID NO: 808559 - protein, 21 aa, Mycobacterium
ELQTLLARWSAAAAILQQGKP

SEQ ID NO: 808560 - protein, 19 aa, Mycobacterium
ELQYYRRTAFVPQPGPTTS

SEQ ID NO: 808561 - protein, 28 aa, Mycobacterium
ELRAEFDIYLLDFPGYGLSAKPPEPYVY

SEQ ID NO: 808562 - protein, 22 aa, Mycobacterium
ELRAPMEQATPLRRLGDPVDIA

SEQ ID NO: 808563 - protein, 20 aa, Mycobacterium
ELRARDFVALVAGGVHAETE

SEQ ID NO: 808564 - protein, 23 aa, Mycobacterium
ELRARDFVALVISGLHAETEVGV

SEQ ID NO: 808565 - protein, 18 aa, Mycobacterium
ELRARDFVSLVSGGIHAE

SEQ ID NO: 808566 - protein, 21 aa, Mycobacterium
ELRARLRLAITRRRHALEGTL

SEQ ID NO: 808567 - protein, 22 aa, Mycobacterium
ELRAVWLGFMQKWIDQTAALIN

SEQ ID NO: 808568 - protein, 26 aa, Mycobacterium
ELRAWLRRFSTDRPRWGWRRAAKMAR

SEQ ID NO: 808569 - protein, 21 aa, Mycobacterium
ELRAYLPGVTPAQRRKRVLAD

SEQ ID NO: 808570 - protein, 22 aa, Mycobacterium
ELRDRAFYAPAQSRYRVFIIDE

SEQ ID NO: 808571 - protein, 28 aa, Mycobacterium
ELRDVVGRYWVIDDISPARIHANVPAEF

SEQ ID NO: 808572 - protein, 28 aa, Mycobacterium
ELRDVVSKYWVIDEIRPARIHANVPDSA

SEQ ID NO: 808573 - protein, 24 aa, Mycobacterium
ELREAVPLIPLDQLLVETDAPFLT

SEQ ID NO: 808574 - protein, 34 aa, Mycobacterium
ELREFLADKVVRWWLPERWAFVDQVPRTSVGKYD

SEQ ID NO: 808575 - protein, 24 aa, Mycobacterium
ELREIYFTRGVLERAALAQAAARA

SEQ ID NO: 808576 - protein, 17 aa, Mycobacterium
ELREKKFMKIVSLAPEV

SEQ ID NO: 808577 - protein, 23 aa, Mycobacterium
ELRELTGIALRLSPLRAHATGDY

SEQ ID NO: 808578 - protein, 28 aa, Mycobacterium
ELRELVGRYWAIDEIKPARLHGNLPESF

SEQ ID NO: 808579 - protein, 17 aa, Mycobacterium
ELRELWWQEAERNRVLP

SEQ ID NO: 808580 - protein, 17 aa, Mycobacterium
ELREPHRVSRYLEDLAG

SEQ ID NO: 808581 - protein, 17 aa, Mycobacterium
ELREWVLGGRIVTAFCG

SEQ ID NO: 808582 - protein, 21 aa, Mycobacterium
ELRFHALRHTYASLCAAVGVP

SEQ ID NO: 808583 - protein, 27 aa, Mycobacterium
ELRGPDRYRWRLLAGPKTVWDSELIPE

SEQ ID NO: 808584 - protein, 28 aa, Mycobacterium
ELRHLRRGLYWRGLKTPLGMAPPQPDLL

SEQ ID NO: 808585 - protein, 17 aa, Mycobacterium
ELRIKLDRPAYVYPLFE

SEQ ID NO: 808586 - protein, 23 aa, Mycobacterium
ELRKSIVFVTHDFGEAVKLGDRI

SEQ ID NO: 808587 - protein, 20 aa, Mycobacterium
ELRLAPDTPAYFAVKAHEVV

SEQ ID NO: 808588 - protein, 28 aa, Mycobacterium
ELRLARLGYLFQDYNLLQSLTSVENVAL

SEQ ID NO: 808589 - protein, 17 aa, Mycobacterium
ELRLHNGTVWRWNRPVY

SEQ ID NO: 808590 - protein, 41 aa, Mycobacterium
ELRLLGAHAPPYNRKSRFPHRWWWVVLTEEPFPRFSVVRTT

SEQ ID NO: 808591 - protein, 19 aa, Mycobacterium
ELRLLYLASTDPATGKLFS

SEQ ID NO: 808592 - protein, 28 aa, Mycobacterium
ELRLMTERVLRRLPDLRLADDAPVPLRP

SEQ ID NO: 808593 - protein, 29 aa, Mycobacterium
ELRMKMLECLLVLHTLPDEADLNFADLAN

SEQ ID NO: 808594 - protein, 41 aa, Mycobacterium
ELRMLAAHAPPYNRRSRFPHRWWWVTLTDEAFPRLSVVRAP

SEQ ID NO: 808595 - protein, 42 aa, Mycobacterium
ELRMLAAHAPPYNRRSRFPHRWWWVVLSEEAFPRLAVVRAPR

SEQ ID NO: 808596 - protein, 20 aa, Mycobacterium
ELRMTLRALGSLRVEADLID

SEQ ID NO: 808597 - protein, 22 aa, Mycobacterium
ELRNWRLYAGSTSMLYRTINRN

SEQ ID NO: 808598 - protein, 24 aa, Mycobacterium
ELRPDYLQWVYGDPNLRTHRAHLP

SEQ ID NO: 808599 - protein, 24 aa, Mycobacterium
ELRPQHRALRQQIPEVYKGFAALS

SEQ ID NO: 808600 - protein, 20 aa, Mycobacterium
ELRPQLLDRFGLTVDVAASR

SEQ ID NO: 808601 - protein, 21 aa, Mycobacterium
ELRPQLLDRFGLTVDVQASRD

SEQ ID NO: 808602 - protein, 19 aa, Mycobacterium
ELRQLCDALLEAAKAADGW

SEQ ID NO: 808603 - protein, 17 aa, Mycobacterium
ELRQRNVPLRVITTTYL

SEQ ID NO: 808604 - protein, 25 aa, Mycobacterium
ELRRCAPIWWNEQPDGIGGFGDGGF

SEQ ID NO: 808605 - protein, 27 aa, Mycobacterium
ELRRGPLAEFWMAGPTWLEATTRALVE

SEQ ID NO: 808606 - protein, 24 aa, Mycobacterium
ELRRHIGHAPLWLPGVTGVVIRGE

SEQ ID NO: 808607 - protein, 18 aa, Mycobacterium
ELRRIATLCAAFDVDGMR

SEQ ID NO: 808608 - protein, 18 aa, Mycobacterium
ELRRLNAILRRRNKILQS

SEQ ID NO: 808609 - protein, 20 aa, Mycobacterium
ELRRQLRGDAREPVIPFAQP

SEQ ID NO: 808610 - protein, 23 aa, Mycobacterium
ELRRRLRDRLAPPAPSVLSINDT

SEQ ID NO: 808611 - protein, 26 aa, Mycobacterium
ELRRRYLDQLLAGKTLAALAITEPEV

SEQ ID NO: 808612 - protein, 25 aa, Mycobacterium
ELRRTAPIWWNEQPLGAGGFDDGGF

SEQ ID NO: 808613 - protein, 30 aa, Mycobacterium
ELRRWRLHAGSTSLLFRTLGRNKRSITLDV

SEQ ID NO: 808614 - protein, 24 aa, Mycobacterium
ELRRYRTQVPSALRGKRRLADAMP

SEQ ID NO: 808615 - protein, 31 aa, Mycobacterium
ELRSALAGLAPKLPVIPLLSTVTDTGTPRLD

SEQ ID NO: 808616 - protein, 18 aa, Mycobacterium
ELRSHIAPLQQLWTREAA

SEQ ID NO: 808617 - protein, 26 aa, Mycobacterium
ELRSKPGDWYVIHSYAGYENKVKANL

SEQ ID NO: 808618 - protein, 21 aa, Mycobacterium
ELRSLFLFEALTDEQLAVLCA

SEQ ID NO: 808619 - protein, 22 aa, Mycobacterium
ELRSLFLFEKLTDDQLQDLCAH

SEQ ID NO: 808620 - protein, 17 aa, Mycobacterium
ELRSPMEKATPMRRLGD

SEQ ID NO: 808621 - protein, 17 aa, Mycobacterium
ELRSYRIIDGVVTEEDI

SEQ ID NO: 808622 - protein, 24 aa, Mycobacterium
ELRTLFLFEHLTDAQLDTLCEAGR

SEQ ID NO: 808623 - protein, 21 aa, Mycobacterium
ELRTPWPSQALKDLLVLLAAG

SEQ ID NO: 808624 - protein, 21 aa, Mycobacterium
ELRYDYLIYAVGSTAAMPAVA

SEQ ID NO: 808625 - protein, 17 aa, Mycobacterium
ELRYPHLADWGIPTARA

SEQ ID NO: 808626 - protein, 25 aa, Mycobacterium
ELRYRGLRAPHKIKMGVSGCARECA

SEQ ID NO: 808627 - protein, 19 aa, Mycobacterium
ELRYRQMRNFWATLMVSQG

SEQ ID NO: 808628 - protein, 19 aa, Mycobacterium
ELSAALGLFPPTDEQAAVI

SEQ ID NO: 808629 - protein, 22 aa, Mycobacterium
ELSAALRRRIMVIDGAMGTAIQ

SEQ ID NO: 808630 - protein, 28 aa, Mycobacterium
ELSADNYRALFLPPFVAHGFQTLVDNTE

SEQ ID NO: 808631 - protein, 21 aa, Mycobacterium
ELSAISFLRDIGKYFSVNVML

SEQ ID NO: 808632 - protein, 26 aa, Mycobacterium
ELSALGALRLIQAFTPALEKSHGSIV

SEQ ID NO: 808633 - protein, 25 aa, Mycobacterium
ELSALGALRLIQGFTPALAESKGSI

SEQ ID NO: 808634 - protein, 23 aa, Mycobacterium
ELSDEAITLFTPLGSTEQHGPHL

SEQ ID NO: 808635 - protein, 33 aa, Mycobacterium
ELSEAQRWPSVPGRYFTVRAGSLVAWNSAGADG

SEQ ID NO: 808636 - protein, 28 aa, Mycobacterium
ELSERSAGNLLLLRGFLTAGRENGALVQ

SEQ ID NO: 808637 - protein, 32 aa, Mycobacterium
ELSGALRLIYPHDTLWRPPVLTMSALENNGVS

SEQ ID NO: 808638 - protein, 19 aa, Mycobacterium
ELSGQYLFDAFPDNPKDPQ

SEQ ID NO: 808639 - protein, 18 aa, Mycobacterium
ELSIRFLQRISAPTELVM

SEQ ID NO: 808640 - protein, 25 aa, Mycobacterium
ELSKELRPWVPVVSLVKGLEQGTNK

SEQ ID NO: 808641 - protein, 19 aa, Mycobacterium
ELSKKLAIRRFSVTTAACA

SEQ ID NO: 808642 - protein, 20 aa, Mycobacterium
ELSKLYLLPDQHGTGTAKAL

SEQ ID NO: 808643 - protein, 28 aa, Mycobacterium
ELSLGVMLRVLRFLLGAGYAPTVVDLPH

SEQ ID NO: 808644 - protein, 18 aa, Mycobacterium
ELSLREVLRVLKPGGRFV

SEQ ID NO: 808645 - protein, 20 aa, Mycobacterium
ELSMWELPRDTTGTLGAVDA

SEQ ID NO: 808646 - protein, 33 aa, Mycobacterium
ELSNVANLPIALWPGMKIGQLCILRLTSPAEHP

SEQ ID NO: 808647 - protein, 34 aa, Mycobacterium
ELSNVANLPITLWPGMKIGQLCILKLTSPSEHPY

SEQ ID NO: 808648 - protein, 33 aa, Mycobacterium
ELSNVANLPITLWPGMKIGQLCLLRLTSPAEHP

SEQ ID NO: 808649 - protein, 34 aa, Mycobacterium
ELSNVANLPITLWPGMKIGQLCLLRLTSPAENPY

SEQ ID NO: 808650 - protein, 33 aa, Mycobacterium
ELSNVANLPITLWPGMKIGQLCLLRLTSPAQHP

SEQ ID NO: 808651 - protein, 20 aa, Mycobacterium
ELSPHPLLTRAVQQTACSLD

SEQ ID NO: 808652 - protein, 26 aa, Mycobacterium
ELSPQSYLYVAAVHRLSSLGAVITHV

SEQ ID NO: 808653 - protein, 29 aa, Mycobacterium
ELSPRALAWLFFNMAVATTLRYIEADDPI

SEQ ID NO: 808654 - protein, 30 aa, Mycobacterium
ELSRAVFSKGIFPAVDPLASSSTILLPSVV

SEQ ID NO: 808655 - protein, 19 aa, Mycobacterium
ELSRQRGALREELDRFAKA

SEQ ID NO: 808656 - protein, 20 aa, Mycobacterium
ELSRRRIYHSFNPQGVNIVA

SEQ ID NO: 808657 - protein, 21 aa, Mycobacterium
ELSRRRIYHSFNPQGVNIVAA

SEQ ID NO: 808658 - protein, 19 aa, Mycobacterium
ELSRRRVFTPPDDMTRLVP

SEQ ID NO: 808659 - protein, 24 aa, Mycobacterium
ELSRRTECWLVLDIPNLYATAVAS

SEQ ID NO: 808660 - protein, 28 aa, Mycobacterium
ELSRTVFSKGIFPAVDPLASSSTILDPA

SEQ ID NO: 808661 - protein, 32 aa, Mycobacterium
ELSSAIRLIHPRETLWRPPVLTMSAMEGTGLE

SEQ ID NO: 808662 - protein, 23 aa, Mycobacterium
ELSSALWLKYNLLAERHTRGIPR

SEQ ID NO: 808663 - protein, 38 aa, Mycobacterium
ELSTGMLLRPVQPPPSDGWRLLLYKMSGGLINLGESPR

SEQ ID NO: 808664 - protein, 24 aa, Mycobacterium
ELSTSMLLRPVKSPPTEGWRRLVY

SEQ ID NO: 808665 - protein, 36 aa, Mycobacterium
ELSTSQHFVWLRESLPLKEKLPLKAGLVTSLGFGHV

SEQ ID NO: 808666 - protein, 22 aa, Mycobacterium
ELSVHFPFPIKDLVAIDDALKF

SEQ ID NO: 808667 - protein, 24 aa, Mycobacterium
ELSVRDMTVCILDRPRHAQLIHDV

SEQ ID NO: 808668 - protein, 17 aa, Mycobacterium
ELSWDRLVLTPGSISRL

SEQ ID NO: 808669 - protein, 27 aa, Mycobacterium
ELSYVFRRDSWGRGWAYAAAAALIGAA

SEQ ID NO: 808670 - protein, 19 aa, Mycobacterium
ELSYVPERAIVLGGGVIGV

SEQ ID NO: 808671 - protein, 23 aa, Mycobacterium
ELTAALQSLGLRGPRYLGGAGHW

SEQ ID NO: 808672 - protein, 17 aa, Mycobacterium
ELTAALRALGVGGPRYL

SEQ ID NO: 808673 - protein, 21 aa, Mycobacterium
ELTADWDYALVGGLTLGADPV

SEQ ID NO: 808674 - protein, 22 aa, Mycobacterium
ELTAVATPNWHYLHIHNDVIPA

SEQ ID NO: 808675 - protein, 27 aa, Mycobacterium
ELTDELLQRMLFESCLLHAGQACILHS

SEQ ID NO: 808676 - protein, 22 aa, Mycobacterium
ELTDLLWRMGIRTVGQFAALSR

SEQ ID NO: 808677 - protein, 24 aa, Mycobacterium
ELTDPLTPVLALGSAASAVLGSPV

SEQ ID NO: 808678 - protein, 26 aa, Mycobacterium
ELTELDRVLLRIALANTSRPPLLVVG

SEQ ID NO: 808679 - protein, 20 aa, Mycobacterium
ELTFHLCYGDSKFGASPFMG

SEQ ID NO: 808680 - protein, 23 aa, Mycobacterium
ELTGDLPALRRVLVINGSGPKAL

SEQ ID NO: 808681 - protein, 23 aa, Mycobacterium
ELTGFLDELPVDASALEAKLARQ

SEQ ID NO: 808682 - protein, 17 aa, Mycobacterium
ELTGIYTAPADGSVNEI

SEQ ID NO: 808683 - protein, 22 aa, Mycobacterium
ELTGKKLLRLTYHLLGATSLER

SEQ ID NO: 808684 - protein, 25 aa, Mycobacterium
ELTGMGVAWMLRPSAEGPIIVQHGG

SEQ ID NO: 808685 - protein, 22 aa, Mycobacterium
ELTGRCPAVRLLATSREPLGVP

SEQ ID NO: 808686 - protein, 26 aa, Mycobacterium
ELTILVENWVDMLLPDHGDHCVRTGL

SEQ ID NO: 808687 - protein, 17 aa, Mycobacterium
ELTITNLHRSYAVLAVQ

SEQ ID NO: 808688 - protein, 25 aa, Mycobacterium
ELTKELGLAAFVAFSSMAGIVGAPG

SEQ ID NO: 808689 - protein, 23 aa, Mycobacterium
ELTKGAMYFHFKSKHALAVAIIE

SEQ ID NO: 808690 - protein, 30 aa, Mycobacterium
ELTKTFGPTTGLWILLLAKGGGDTTVSAEP

SEQ ID NO: 808691 - protein, 26 aa, Mycobacterium
ELTKYAANCFLALKLSYANAMAELAE

SEQ ID NO: 808692 - protein, 17 aa, Mycobacterium
ELTLAQLSILVTLLDRG

SEQ ID NO: 808693 - protein, 27 aa, Mycobacterium
ELTLEDFLEQMLAIRKMGPIGNLLGML

SEQ ID NO: 808694 - protein, 17 aa, Mycobacterium
ELTLTRPELVTAAVFMG

SEQ ID NO: 808695 - protein, 18 aa, Mycobacterium
ELTMLAAALRDGSANRRT

SEQ ID NO: 808696 - protein, 18 aa, Mycobacterium
ELTMLAAALRDGTADRPT

SEQ ID NO: 808697 - protein, 25 aa, Mycobacterium
ELTPGYIIDLFSSYYPMTVASPAIA

SEQ ID NO: 808698 - protein, 24 aa, Mycobacterium
ELTPKAKALLAKRGFDPVLGARPL

SEQ ID NO: 808699 - protein, 28 aa, Mycobacterium
ELTPPALIKAILKAPVDLLWNGGIGTYI

SEQ ID NO: 808700 - protein, 23 aa, Mycobacterium
ELTQHFGRRMAAMSRGGIVLVGS

SEQ ID NO: 808701 - protein, 31 aa, Mycobacterium
ELTQVNPIWREVLLGVLGDLAVRHEQCGYQE

SEQ ID NO: 808702 - protein, 21 aa, Mycobacterium
ELTRCDIRVPRYAAVDLSGQV

SEQ ID NO: 808703 - protein, 18 aa, Mycobacterium
ELTRFYRRPHDVRATLTK

SEQ ID NO: 808704 - protein, 21 aa, Mycobacterium
ELTRRGLYGGVLGYLDFAGNA

SEQ ID NO: 808705 - protein, 18 aa, Mycobacterium
ELTSPMLEVPFSGSGLHH

SEQ ID NO: 808706 - protein, 23 aa, Mycobacterium
ELTTPSFITNWNEFWSVVTGVYS

SEQ ID NO: 808707 - protein, 26 aa, Mycobacterium
ELTTRLEFYFRRWKAPALVSEEFTGS

SEQ ID NO: 808708 - protein, 20 aa, Mycobacterium
ELTVPPWAVAGLGSQAELLT

SEQ ID NO: 808709 - protein, 20 aa, Mycobacterium
ELVAEFLRPVFAAHWDQLEP

SEQ ID NO: 808710 - protein, 18 aa, Mycobacterium
ELVALKERGFRLLALTPK

SEQ ID NO: 808711 - protein, 25 aa, Mycobacterium
ELVARLRGLLRRTAYLTPAADETLR

SEQ ID NO: 808712 - protein, 24 aa, Mycobacterium
ELVARQITNYRWALSAFGTASAAN

SEQ ID NO: 808713 - protein, 21 aa, Mycobacterium
ELVARVKALLRRRGAVATSST

SEQ ID NO: 808714 - protein, 27 aa, Mycobacterium
ELVASDLVPYRTLLTQTPVAVMVGHLQ

SEQ ID NO: 808715 - protein, 17 aa, Mycobacterium
ELVCKDFGALKVLKGIT

SEQ ID NO: 808716 - protein, 29 aa, Mycobacterium
ELVDAAATDFARIGSAINAAAQAAAIPTT

SEQ ID NO: 808717 - protein, 18 aa, Mycobacterium
ELVDARLSEAGLTWYEVS

SEQ ID NO: 808718 - protein, 17 aa, Mycobacterium
ELVDEGWRIIRVSSDMV

SEQ ID NO: 808719 - protein, 25 aa, Mycobacterium
ELVDEHLIGFPPQFSLRRIVEDAFT

SEQ ID NO: 808720 - protein, 26 aa, Mycobacterium
ELVECTEYFADTPFRVFQAPYVGAVV

SEQ ID NO: 808721 - protein, 30 aa, Mycobacterium
ELVEFNARRPFHPLRLHAAIDMLLDGVIRT

SEQ ID NO: 808722 - protein, 28 aa, Mycobacterium
ELVEHFILEEWWGRWLGRWTAEEHLHAI

SEQ ID NO: 808723 - protein, 20 aa, Mycobacterium
ELVELLIPVMRLHLRLRDTE

SEQ ID NO: 808724 - protein, 27 aa, Mycobacterium
ELVEMLLDWRRLGIDGARLRPAVNATD

SEQ ID NO: 808725 - protein, 27 aa, Mycobacterium
ELVEPLADYHALWEPKIPLGRMGRPEE

SEQ ID NO: 808726 - protein, 31 aa, Mycobacterium
ELVEVPVGFKWFVDGLIGGTIGFGGEESAGA

SEQ ID NO: 808727 - protein, 26 aa, Mycobacterium
ELVFAKTPPTVIMLAGLQGSGKTTLA

SEQ ID NO: 808728 - protein, 32 aa, Mycobacterium
ELVFDVAPPGWLAPGQWWALVRVGCAGRLVYS

SEQ ID NO: 808729 - protein, 17 aa, Mycobacterium
ELVFPNAVLALFHYPDK

SEQ ID NO: 808730 - protein, 18 aa, Mycobacterium
ELVFRRGVRHWMGVQRYD

SEQ ID NO: 808731 - protein, 25 aa, Mycobacterium
ELVGAIREKFWAQGTLGSAPWSQDV

SEQ ID NO: 808732 - protein, 21 aa, Mycobacterium
ELVGDFTFEFPTRVIARLLGL

SEQ ID NO: 808733 - protein, 20 aa, Mycobacterium
ELVGFPFFKGYGERKLDLPM

SEQ ID NO: 808734 - protein, 20 aa, Mycobacterium
ELVGHNVLPGRWSFQIVEEF

SEQ ID NO: 808735 - protein, 31 aa, Mycobacterium
ELVGIPWIELNPHPLYLPSKGLPPIGSGLAP

SEQ ID NO: 808736 - protein, 19 aa, Mycobacterium
ELVGTTLPHPFLDTELIVV

SEQ ID NO: 808737 - protein, 18 aa, Mycobacterium
ELVHLTPVASHRGTVQPL

SEQ ID NO: 808738 - protein, 26 aa, Mycobacterium
ELVHRFYTHWFALDASVRDLFPPEMS

SEQ ID NO: 808739 - protein, 27 aa, Mycobacterium
ELVIATGLVPRRIPTFPDIEGIRVLRS

SEQ ID NO: 808740 - protein, 17 aa, Mycobacterium
ELVIFLAVVAGAGVETT

SEQ ID NO: 808741 - protein, 18 aa, Mycobacterium
ELVINRPLDVPALTMMHD

SEQ ID NO: 808742 - protein, 28 aa, Mycobacterium
ELVIPPTFLCILGYAAQKWFLQHCGIAI

SEQ ID NO: 808743 - protein, 24 aa, Mycobacterium
ELVIVVPPDHKWARRSRIVTAREL

SEQ ID NO: 808744 - protein, 24 aa, Mycobacterium
ELVKSLLFSVFESGLRQGLFHGDL

SEQ ID NO: 808745 - protein, 26 aa, Mycobacterium
ELVKVTPMDFLRDTLLWAKLIDKYKG

SEQ ID NO: 808746 - protein, 18 aa, Mycobacterium
ELVLASAPLLEGKLPPDS

SEQ ID NO: 808747 - protein, 19 aa, Mycobacterium
ELVLASNRWRPPNNALVDL

SEQ ID NO: 808748 - protein, 21 aa, Mycobacterium
ELVLDRRGNRHFSFGIGVHRC

SEQ ID NO: 808749 - protein, 17 aa, Mycobacterium
ELVLGRGSFTDSFPLFG

SEQ ID NO: 808750 - protein, 24 aa, Mycobacterium
ELVLLLVVHHICWDDDSWEVFFGE

SEQ ID NO: 808751 - protein, 19 aa, Mycobacterium
ELVLLTTDEFKRFGDLRLR

SEQ ID NO: 808752 - protein, 21 aa, Mycobacterium
ELVLRGMELIPRVLAEALNAL

SEQ ID NO: 808753 - protein, 25 aa, Mycobacterium
ELVLRHHRQLRRLAYLTSNHLDDAD

SEQ ID NO: 808754 - protein, 17 aa, Mycobacterium
ELVLRKATWLYDNGKPC

SEQ ID NO: 808755 - protein, 18 aa, Mycobacterium
ELVLRKATWLYDNGKPCG

SEQ ID NO: 808756 - protein, 18 aa, Mycobacterium
ELVNDLCALGYLTRRADP

SEQ ID NO: 808757 - protein, 23 aa, Mycobacterium
ELVRRGCPFSGLLYAGLAITAKG

SEQ ID NO: 808758 - protein, 24 aa, Mycobacterium
ELVSFGLKFLGKPPSDGTVLDAGC

SEQ ID NO: 808759 - protein, 37 aa, Mycobacterium
ELVSFTFGVPPPDVIRRLGALGLLVMVTVTSAYEAGV

SEQ ID NO: 808760 - protein, 38 aa, Mycobacterium; identical to SEQ ID NO: 114272

SEQ ID NO: 808761 - protein, 28 aa, Mycobacterium
ELVSLTQILAWDLPLTRKIRERAAKQAR

SEQ ID NO: 808762 - protein, 28 aa, Mycobacterium
ELVTGLDLVRLQLLVAMGRPLPAEVSKP

SEQ ID NO: 808763 - protein, 18 aa, Mycobacterium
ELVTTFLRVTFALLDRRY

SEQ ID NO: 808764 - protein, 18 aa, Mycobacterium
ELVVLTKFDPAEVLRVIE

SEQ ID NO: 808765 - protein, 19 aa, Mycobacterium
ELWADGPVAFVFLRQFGSA

SEQ ID NO: 808766 - protein, 17 aa, Mycobacterium
ELWAWVAAYDHVALCQL

SEQ ID NO: 808767 - protein, 17 aa, Mycobacterium
ELWAWVGAYDHVALCQL

SEQ ID NO: 808768 - protein, 18 aa, Mycobacterium
ELWEFTVGDTLWAPTFVR

SEQ ID NO: 808769 - protein, 17 aa, Mycobacterium
ELWEPGPVLAQPPDPDG

SEQ ID NO: 808770 - protein, 19 aa, Mycobacterium
ELWESMLAVAKLGAVIMPT

SEQ ID NO: 808771 - protein, 23 aa, Mycobacterium
ELWGTDVLYCPYCHGWEVRDQPI

SEQ ID NO: 808772 - protein, 17 aa, Mycobacterium
ELWLVDAGPDTPAGKFG

SEQ ID NO: 808773 - protein, 17 aa, Mycobacterium
ELWLVDSGPDTPTGKFG

SEQ ID NO: 808774 - protein, 17 aa, Mycobacterium
ELWMINGLVPPPMNSAA

SEQ ID NO: 808775 - protein, 19 aa, Mycobacterium
ELWRVDFAWPHMRLAAEYE

SEQ ID NO: 808776 - protein, 18 aa, Mycobacterium
ELWSRFMQKWVDHITTVI

SEQ ID NO: 808777 - protein, 23 aa, Mycobacterium
ELWSTFMQKWIAYTAKIIEAERE

SEQ ID NO: 808778 - protein, 17 aa, Mycobacterium
ELWVLGTANTPARLVLP

SEQ ID NO: 808779 - protein, 20 aa, Mycobacterium
ELYADWPRKARAVVGNLRYV

SEQ ID NO: 808780 - protein, 17 aa, Mycobacterium
ELYAIPPLGASECSANG

SEQ ID NO: 808781 - protein, 21 aa, Mycobacterium
ELYARILAGAGVEWGLLGPRE

SEQ ID NO: 808782 - protein, 20 aa, Mycobacterium
ELYDAMMVLSTAAAKDVDPA

SEQ ID NO: 808783 - protein, 31 aa, Mycobacterium; identical to SEQ ID NO: 125959

SEQ ID NO: 808784 - protein, 19 aa, Mycobacterium
ELYFPGSPVLSVHGTFGEC

SEQ ID NO: 808785 - protein, 25 aa, Mycobacterium
ELYGKPQFWPIWEAAVDAGLPVAAH

SEQ ID NO: 808786 - protein, 25 aa, Mycobacterium
ELYGKPQFWPLWEAAVDAGLPVAAH

SEQ ID NO: 808787 - protein, 25 aa, Mycobacterium
ELYGKPQYWPLWEAASDAGLPVAVH

SEQ ID NO: 808788 - protein, 22 aa, Mycobacterium
ELYQLELKQLFAKAWTVVAHED

SEQ ID NO: 808789 - protein, 25 aa, Mycobacterium
ELYRVNLHHVLLATHAFLPAMIDRH

SEQ ID NO: 808790 - protein, 25 aa, Mycobacterium
ELYRVNLHHVLLATHAFLPAMIEQH

SEQ ID NO: 808791 - protein, 17 aa, Mycobacterium
ELYSSPANLFVAGFIGS

SEQ ID NO: 808792 - protein, 28 aa, Mycobacterium
ELYVTILGALRNGSVVSPLFSAFGPEPV

SEQ ID NO: 808793 - protein, 37 aa, Mycobacterium
EMAAKLAGFGYVVLVPDVYYRIPNWGPINLNTVFSDQ

SEQ ID NO: 808794 - protein, 19 aa, Mycobacterium
EMAATLAGFGYAVLLPDMY

SEQ ID NO: 808795 - protein, 22 aa, Mycobacterium
EMADLDLLFAEELCPADDVLSR

SEQ ID NO: 808796 - protein, 24 aa, Mycobacterium
EMAGDFGGVWYWNRFPGIQCDNDA

SEQ ID NO: 808797 - protein, 17 aa, Mycobacterium
EMALRSLAFDRAALAYL

SEQ ID NO: 808798 - protein, 23 aa, Mycobacterium
EMANGYLLLMRVGDGSHLATLAV

SEQ ID NO: 808799 - protein, 17 aa, Mycobacterium
EMAQRMRGFSRPGIELT

SEQ ID NO: 808800 - protein, 25 aa, Mycobacterium
EMARAFLTFNGFLLRRGELSPRLRE

SEQ ID NO: 808801 - protein, 22 aa, Mycobacterium
EMARMFAWRPEAVTAAAELGGQ

SEQ ID NO: 808802 - protein, 18 aa, Mycobacterium
EMASIVAFLLSDDSSMIT

SEQ ID NO: 808803 - protein, 19 aa, Mycobacterium
EMASYFPAVPMVVRAPGAV

SEQ ID NO: 808804 - protein, 24 aa, Mycobacterium
EMATPRLPAPPPQPPIRGGADLAP

SEQ ID NO: 808805 - protein, 30 aa, Mycobacterium
EMAYEGKVDWAFAELLALGTFLAEGKTIRF

SEQ ID NO: 808806 - protein, 19 aa, Mycobacterium
EMCPRIMAMTVRDGKVCAL

SEQ ID NO: 808807 - protein, 22 aa, Mycobacterium
EMDAAWALFEAYIKILTGEVDT

SEQ ID NO: 808808 - protein, 23 aa, Mycobacterium
EMDRVMESTTMPTLLLGGDPADP

SEQ ID NO: 808809 - protein, 18 aa, Mycobacterium
EMEGWFWRLTDRASGRVV

SEQ ID NO: 808810 - protein, 20 aa, Mycobacterium
EMELPRPLKALIAKTDPGVA

SEQ ID NO: 808811 - protein, 25 aa, Mycobacterium
EMEPITWPQFAALHPFAPAGDSRGL

SEQ ID NO: 808812 - protein, 23 aa, Mycobacterium
EMERLGVVAVLFLGGLDTTRGAL

SEQ ID NO: 808813 - protein, 27 aa, Mycobacterium
EMERVRLHPYLTVRILSQVGGLDAVAR

SEQ ID NO: 808814 - protein, 23 aa, Mycobacterium
EMESRFSAAWALLSAGDEGDLDE

SEQ ID NO: 808815 - protein, 30 aa, Mycobacterium
EMETLPQPPLPALVGYLRGLAMVDAVDPVV

SEQ ID NO: 808816 - protein, 19 aa, Mycobacterium
EMFAEIYDLERDPAPRPTP

SEQ ID NO: 808817 - protein, 21 aa, Mycobacterium
EMFAQIYDLERDPAPRPTPPL

SEQ ID NO: 808818 - protein, 26 aa, Mycobacterium
EMGARVWFREPYLRTVIYRTARLDER

SEQ ID NO: 808819 - protein, 25 aa, Mycobacterium
EMGFDVDTPWRKLPAKARKAILEGS

SEQ ID NO: 808820 - protein, 24 aa, Mycobacterium
EMGGDFGGVWYWNRYPGIQCDNES

SEQ ID NO: 808821 - protein, 28 aa, Mycobacterium
EMGLPTTMSLMRFFRFIVTEIYPGGRIP

SEQ ID NO: 808822 - protein, 27 aa, Mycobacterium
EMGLTNVVIMLPFVRRVAEADLVLQTM

SEQ ID NO: 808823 - protein, 22 aa, Mycobacterium
EMGMSYHLPRIVGAGVAADWML

SEQ ID NO: 808824 - protein, 24 aa, Mycobacterium
EMGRRPHLPLPSFWSGQFGVNIKS

SEQ ID NO: 808825 - protein, 18 aa, Mycobacterium
EMGVVAERLWRDSGLKPQ

SEQ ID NO: 808826 - protein, 24 aa, Mycobacterium
EMGYPTAFVERLARRIFNFQTRNY

SEQ ID NO: 808827 - protein, 17 aa, Mycobacterium
EMHGAWVRFATTGDPGW

SEQ ID NO: 808828 - protein, 34 aa, Mycobacterium
EMHLFTALGYRQYLFWTWAIYSGRLLHGRLPRID

SEQ ID NO: 808829 - protein, 32 aa, Mycobacterium
EMHLFTTLGQHRLLFLAWSVYSGRVLRGRLPA

SEQ ID NO: 808830 - protein, 35 aa, Mycobacterium
EMHLFTTLGYRQSLFWAWLIYGGRLLRGRLPRIDT

SEQ ID NO: 808831 - protein, 19 aa, Mycobacterium
EMIAVAPSMLWSMTVDLER

SEQ ID NO: 808832 - protein, 19 aa, Mycobacterium
EMIAVAPSMLWSMTVDLEW

SEQ ID NO: 808833 - protein, 30 aa, Mycobacterium
EMIHKIVVHPFLLTTFRVSGLTELVTVEAA

SEQ ID NO: 808834 - protein, 25 aa, Mycobacterium
EMKAVWRLNELLNWQVASSGDDISM

SEQ ID NO: 808835 - protein, 17 aa, Mycobacterium
EMKPKLDVVDYWSIIRA

SEQ ID NO: 808836 - protein, 26 aa, Mycobacterium
EMLAALDLIFPADLLADILAGQRGAS

SEQ ID NO: 808837 - protein, 24 aa, Mycobacterium
EMLDTLIKEKWLTANAVIGFFPAN

SEQ ID NO: 808838 - protein, 25 aa, Mycobacterium
EMLDTLIREKWLTANGVIGFFPANA

SEQ ID NO: 808839 - protein, 39 aa, Mycobacterium
EMLEQTMKVGLWSVWWGMQTAFPLLKDRGGGRIINFYSI

SEQ ID NO: 808840 - protein, 22 aa, Mycobacterium
EMLGAMMPFAPLLGHDPLPPAD

SEQ ID NO: 808841 - protein, 20 aa, Mycobacterium
EMLMPCFHQLYDELGLQQSD

SEQ ID NO: 808842 - protein, 17 aa, Mycobacterium
EMLPYSDLDLMLLHDNM

SEQ ID NO: 808843 - protein, 17 aa, Mycobacterium
EMLPYSDLDLVLLHDEN

SEQ ID NO: 808844 - protein, 24 aa, Mycobacterium
EMLQQMLFDCCSLHAGQACILHSR

SEQ ID NO: 808845 - protein, 29 aa, Mycobacterium
EMLRGLPSAEFRFVWHRPGPIVTDSGVLT

SEQ ID NO: 808846 - protein, 29 aa, Mycobacterium
EMLRYLTERLPLIVAPRWLRTCVQPIAVR

SEQ ID NO: 808847 - protein, 20 aa, Mycobacterium
EMLSSFLLDATLAGLSTCTL

SEQ ID NO: 808848 - protein, 27 aa, Mycobacterium
EMMAKGSYAMLLLATKDLDRTFGQLQA

SEQ ID NO: 808849 - protein, 18 aa, Mycobacterium
EMMDFLERTSNWMEFVWK

SEQ ID NO: 808850 - protein, 31 aa, Mycobacterium
EMMEFLENLSPWLEFVWKPGYADYYPELPGG

SEQ ID NO: 808851 - protein, 25 aa, Mycobacterium
EMMNKLLHRNYGFGAAVRIDGVVTD

SEQ ID NO: 808852 - protein, 25 aa, Mycobacterium
EMNLGQLSLLLRGKYLVDVQSVAKV

SEQ ID NO: 808853 - protein, 22 aa, Mycobacterium
EMNRVYLRCGMVPAPTDVLWDN

SEQ ID NO: 808854 - protein, 24 aa, Mycobacterium
EMPAPVPPALRAIAGRFLDEYRGQ

SEQ ID NO: 808855 - protein, 18 aa, Mycobacterium
EMPDGDYPFLLNTGRLAH

SEQ ID NO: 808856 - protein, 24 aa, Mycobacterium
EMPDGDYPFLLNTGRLPHQWHTLT

SEQ ID NO: 808857 - protein, 26 aa, Mycobacterium
EMPGVAVPLVFRLLGETGVHAPVLND

SEQ ID NO: 808858 - protein, 19 aa, Mycobacterium
EMPLLAELYRRGGVELTPE

SEQ ID NO: 808859 - protein, 20 aa, Mycobacterium
EMPLRARLFRVAEDEHLLVA

SEQ ID NO: 808860 - protein, 23 aa, Mycobacterium
EMPNPVASIYKTRDNRFIAFVLL

SEQ ID NO: 808861 - protein, 21 aa, Mycobacterium
EMPVAVPWSLPAARPVHAGDP

SEQ ID NO: 808862 - protein, 18 aa, Mycobacterium
EMQAFYDAITARAEEAIA

SEQ ID NO: 808863 - protein, 27 aa, Mycobacterium
EMQIVRPIARPAAPLKAPAGPKAARRR

SEQ ID NO: 808864 - protein, 23 aa, Mycobacterium
EMQNGYLLLMRVGDGSHLATLAA

SEQ ID NO: 808865 - protein, 20 aa, Mycobacterium
EMQPTPPPIPIYVGGLSDIA

SEQ ID NO: 808866 - protein, 24 aa, Mycobacterium
EMQWGRTIGQLPSPYTAVNPLVAP

SEQ ID NO: 808867 - protein, 17 aa, Mycobacterium
EMRAFPEELGKMGFVFN

SEQ ID NO: 808868 - protein, 17 aa, Mycobacterium
EMRAFVETCLDVHVLDG

SEQ ID NO: 808869 - protein, 26 aa, Mycobacterium
EMRELAYRLLPSRFVAALAAAGPIGE

SEQ ID NO: 808870 - protein, 36 aa, Mycobacterium
EMRERPPHLLLTNYAMLEYLLLRPLDMELFDTGSES

SEQ ID NO: 808871 - protein, 25 aa, Mycobacterium
EMRLALETAAVRRLCRTPDVVDSLF

SEQ ID NO: 808872 - protein, 17 aa, Mycobacterium
EMRLRQELVKASKPRHI

SEQ ID NO: 808873 - protein, 18 aa, Mycobacterium
EMRPYIAEMARIADTFVS

SEQ ID NO: 808874 - protein, 19 aa, Mycobacterium
EMRPYIAEVARIADTFVSC

SEQ ID NO: 808875 - protein, 19 aa, Mycobacterium
EMRQHFQAWQFSQFLHGEQ

SEQ ID NO: 808876 - protein, 19 aa, Mycobacterium
EMRQHFQAWQLSQFLHGEQ

SEQ ID NO: 808877 - protein, 19 aa, Mycobacterium
EMRQQTIQIFGLPEPGRTD

SEQ ID NO: 808878 - protein, 18 aa, Mycobacterium
EMRRLGRDPVPAAVEAAL

SEQ ID NO: 808879 - protein, 18 aa, Mycobacterium
EMRRMLALQSGRRGVVNI

SEQ ID NO: 808880 - protein, 17 aa, Mycobacterium
EMRRRVARLRTQRAHVV

SEQ ID NO: 808881 - protein, 25 aa, Mycobacterium
EMRTAINLLLDRLPNLRLDPDADDP

SEQ ID NO: 808882 - protein, 20 aa, Mycobacterium
EMRVRGLRGQLGGATLRLGD

SEQ ID NO: 808883 - protein, 26 aa, Mycobacterium
EMSARHPGNIAALARIAPPSIGAVLN

SEQ ID NO: 808884 - protein, 25 aa, Mycobacterium
EMSARHPGNIAALARVAPPAIGVVL

SEQ ID NO: 808885 - protein, 24 aa, Mycobacterium
EMSFRRLFVDLGVFARNELRVPEN

SEQ ID NO: 808886 - protein, 17 aa, Mycobacterium
EMSLMSTLLRIADRAGS

SEQ ID NO: 808887 - protein, 18 aa, Mycobacterium
EMSPVTCMLLGDDAIRKL

SEQ ID NO: 808888 - protein, 18 aa, Mycobacterium
EMSPVTCMLLGDDALRKL

SEQ ID NO: 808889 - protein, 18 aa, Mycobacterium
EMSPVTCMLMGDDAIRKM

SEQ ID NO: 808890 - protein, 34 aa, Mycobacterium
EMSQRGLPLTMRKLRFFKFIMDEIFPGGELPYVA

SEQ ID NO: 808891 - protein, 28 aa, Mycobacterium
EMSTIGDPLLDLGWMLATWPSETDDASL

SEQ ID NO: 808892 - protein, 26 aa, Mycobacterium
EMSYADHWPTRLYFCCQAPAAQGGET

SEQ ID NO: 808893 - protein, 25 aa, Mycobacterium
EMTDVLLPRRGTLIAWTTQGFPPGA

SEQ ID NO: 808894 - protein, 26 aa, Mycobacterium
EMTHANLLFEMYAFDAVLPSRYADRV

SEQ ID NO: 808895 - protein, 20 aa, Mycobacterium
EMTLERNGVHPLPAWNRHDP

SEQ ID NO: 808896 - protein, 21 aa, Mycobacterium
EMTRFVMSSPVAWRCSARPAA

SEQ ID NO: 808897 - protein, 20 aa, Mycobacterium
EMTRRLAREEALLVGGSCGM

SEQ ID NO: 808898 - protein, 26 aa, Mycobacterium
EMTRRTLAVLSTPAALAALPGLVGEM

SEQ ID NO: 808899 - protein, 28 aa, Mycobacterium
EMTYQVNYLAPFLLTTRLMDLLVESRAS

SEQ ID NO: 808900 - protein, 18 aa, Mycobacterium
EMVAWRRHIHAHPELGRQ

SEQ ID NO: 808901 - protein, 25 aa, Mycobacterium
EMVDELLRGFLDWLFNRYREIVDTE

SEQ ID NO: 808902 - protein, 17 aa, Mycobacterium
EMVELIEKMLASGAAYT

SEQ ID NO: 808903 - protein, 24 aa, Mycobacterium
EMVERLIPAYLATYRGPHGGAPGA

SEQ ID NO: 808904 - protein, 17 aa, Mycobacterium
EMVINRRRLSPAHRRVA

SEQ ID NO: 808905 - protein, 23 aa, Mycobacterium
EMVKGILQLIADLGADGMTMIVV

SEQ ID NO: 808906 - protein, 19 aa, Mycobacterium
EMVPFDHPIWVLFSSGTTG

SEQ ID NO: 808907 - protein, 17 aa, Mycobacterium
EMVPKLLRGDEQWCQGF

SEQ ID NO: 808908 - protein, 24 aa, Mycobacterium
EMVRRTMVFLTTPSARAALPGLIG

SEQ ID NO: 808909 - protein, 18 aa, Mycobacterium
EMVSERWGRLNCLVHTIG

SEQ ID NO: 808910 - protein, 23 aa, Mycobacterium
EMVSLTQPLAWDLPLNNKIRERV

SEQ ID NO: 808911 - protein, 28 aa, Mycobacterium
EMWFTEAHWPAFRRVDFLRALRDYSMRH

SEQ ID NO: 808912 - protein, 28 aa, Mycobacterium
EMWFTEAHWPAFRRVDFLRALRDYSQRH

SEQ ID NO: 808913 - protein, 38 aa, Mycobacterium
EMWGTRPYAYLGITVPKFPNLFIIYGPGTHLAHGGSLI

SEQ ID NO: 808914 - protein, 18 aa, Mycobacterium
EMWLAPTASFAASPFRWL

SEQ ID NO: 808915 - protein, 19 aa, Mycobacterium
EMYKYLVAVAKDPDHAKIR

SEQ ID NO: 808916 - protein, 22 aa, Mycobacterium
ENAATRVYERFWSHFAARDWAA

SEQ ID NO: 808917 - protein, 20 aa, Mycobacterium
ENACRFFSWDPFARTAREEA

SEQ ID NO: 808918 - protein, 26 aa, Mycobacterium
ENAGKLIVVVLPDFGERYLSTPLFAD

SEQ ID NO: 808919 - protein, 24 aa, Mycobacterium
ENAGPHFLPNLWPQRPAGMEAAWT

SEQ ID NO: 808920 - protein, 23 aa, Mycobacterium
ENAMRWYHWDPFTHIAKEQATVG

SEQ ID NO: 808921 - protein, 24 aa, Mycobacterium
ENANGLLRQYFPKGTSLSTYTPDH

SEQ ID NO: 808922 - protein, 24 aa, Mycobacterium
ENAPGLRWPDLALQAGRLTWSAVR

SEQ ID NO: 808923 - protein, 25 aa, Mycobacterium
ENARRTPILLPVQVQLILDACAIQD

SEQ ID NO: 808924 - protein, 17 aa, Mycobacterium
ENCDLIWVMHEGRNIAA

SEQ ID NO: 808925 - protein, 17 aa, Mycobacterium
ENCDYLMFTGSTATGRT

SEQ ID NO: 808926 - protein, 26 aa, Mycobacterium
ENCFFLHCSLVPFMAPSGELKTKPTQ

SEQ ID NO: 808927 - protein, 25 aa, Mycobacterium
ENDGLRQVFMGLNPERIMGAALGNG

SEQ ID NO: 808928 - protein, 19 aa, Mycobacterium
ENDLFGVDLLGNTLIALGT

SEQ ID NO: 808929 - protein, 27 aa, Mycobacterium
ENDLPPARIMTVDDLHRAAAAATDVDD

SEQ ID NO: 808930 - protein, 18 aa, Mycobacterium
ENDLRPEFRKFAQPLRWF

SEQ ID NO: 808931 - protein, 25 aa, Mycobacterium
ENDMHLYLKRAHVFRHLFGEPTDVL

SEQ ID NO: 808932 - protein, 24 aa, Mycobacterium
ENEDAMWLLADRVLDGYLAAGQGD

SEQ ID NO: 808933 - protein, 24 aa, Mycobacterium
ENEDIFIIQRGLPTWDRTLAHELG

SEQ ID NO: 808934 - protein, 19 aa, Mycobacterium
ENERWITFRSHYGFEAWYC

SEQ ID NO: 808935 - protein, 24 aa, Mycobacterium
ENFARLLSELIPPAATIAVDELTG

SEQ ID NO: 808936 - protein, 19 aa, Mycobacterium
ENFCWLMARVGPLSTPQVA

SEQ ID NO: 808937 - protein, 25 aa, Mycobacterium
ENFERSPLFLIPCIEGRLDNLPVVG

SEQ ID NO: 808938 - protein, 20 aa, Mycobacterium
ENFIGSQLVELLIAEQRFTT

SEQ ID NO: 808939 - protein, 30 aa, Mycobacterium
ENFNVAPQAIWPRVRRALAAVGLALPLMHD

SEQ ID NO: 808940 - protein, 20 aa, Mycobacterium
ENFREMLPLGGWEITYLGPT

SEQ ID NO: 808941 - protein, 22 aa, Mycobacterium
ENFRYDIERLSAFYQVSYETIG

SEQ ID NO: 808942 - protein, 23 aa, Mycobacterium
ENFSLLVSHVLVPPAIAAIMESP

SEQ ID NO: 808943 - protein, 18 aa, Mycobacterium
ENGADWVPDLFKGLKGVY

SEQ ID NO: 808944 - protein, 24 aa, Mycobacterium
ENGADWVPTLFKGLKGVYKKMPNA

SEQ ID NO: 808945 - protein, 20 aa, Mycobacterium
ENGCMKFLPGSHRTLYYDES

SEQ ID NO: 808946 - protein, 25 aa, Mycobacterium
ENGLRLLRLGIDTHLITSHCLLPLL

SEQ ID NO: 808947 - protein, 27 aa, Mycobacterium
ENGNWAWRYDAIRAFPDFAVLWDDVDA

SEQ ID NO: 808948 - protein, 22 aa, Mycobacterium
ENGRPINTLQIPAGIVQVGYDE

SEQ ID NO: 808949 - protein, 24 aa, Mycobacterium
ENGRSWSRWSFIGAGAPSALTVRD

SEQ ID NO: 808950 - protein, 25 aa, Mycobacterium
ENGRSWSRWSFIGAGAPTALTVRDG

SEQ ID NO: 808951 - protein, 25 aa, Mycobacterium
ENGRSWSRWSFIGAGAPTALTVRGG

SEQ ID NO: 808952 - protein, 24 aa, Mycobacterium
ENGSLYPAPAPRFSRSVPSAPKAP

SEQ ID NO: 808953 - protein, 24 aa, Mycobacterium
ENGSSWIFPLFNDFEDLYKKMPQN

SEQ ID NO: 808954 - protein, 27 aa, Mycobacterium
ENGSSWIFPLFRDFADLYKKMPQNFPE

SEQ ID NO: 808955 - protein, 26 aa, Mycobacterium
ENGVWAIFSTLDPRVLQFKPGLLLSR

SEQ ID NO: 808956 - protein, 21 aa, Mycobacterium
ENGWFPTKDVAYLDSEGYLFI

SEQ ID NO: 808957 - protein, 27 aa, Mycobacterium
ENHEGVYRFLLKRNRRLYGVAYTLDKV

SEQ ID NO: 808958 - protein, 27 aa, Mycobacterium
ENHEGVYRFLLRRNRRLYGVAYTLDKV

SEQ ID NO: 808959 - protein, 20 aa, Mycobacterium
ENHLALLRLTNPVTPVAPER

SEQ ID NO: 808960 - protein, 23 aa, Mycobacterium
ENIADAIVRLVAHPKPRVRVTRA

SEQ ID NO: 808961 - protein, 20 aa, Mycobacterium
ENIAFPLRLAGKLSDDEIRQ

SEQ ID NO: 808962 - protein, 20 aa, Mycobacterium
ENIGLITRFLRAGIDVCSTA

SEQ ID NO: 808963 - protein, 21 aa, Mycobacterium
ENIKKQWWRSVVTSRDDVVGL

SEQ ID NO: 808964 - protein, 19 aa, Mycobacterium
ENIKRQWWKSVVTGRDDVV

SEQ ID NO: 808965 - protein, 21 aa, Mycobacterium
ENIKRQWWRSVITSRDDVVGI

SEQ ID NO: 808966 - protein, 24 aa, Mycobacterium
ENISAFHRLFAGHPFIRVPQAVPE

SEQ ID NO: 808967 - protein, 17 aa, Mycobacterium
ENKLSCPIYTFIGSKDW

SEQ ID NO: 808968 - protein, 25 aa, Mycobacterium
ENKYRLIFEKLRLKAGDRLLDVGCG

SEQ ID NO: 808969 - protein, 24 aa, Mycobacterium
ENKYRLIFEKLRLQPGDRLLDVGC

SEQ ID NO: 808970 - protein, 23 aa, Mycobacterium
ENKYRLVFEKLRLRPGDRLLDVG

SEQ ID NO: 808971 - protein, 26 aa, Mycobacterium
ENLAFKLALVIRGLAADALIDTYEAE

SEQ ID NO: 808972 - protein, 24 aa, Mycobacterium
ENLAFPRARRRTLIALVGALADGS

SEQ ID NO: 808973 - protein, 28 aa, Mycobacterium
ENLAPGLDPVSFTVTLDGGAYQLYCPGA

SEQ ID NO: 808974 - protein, 21 aa, Mycobacterium
ENLDVTTVIFANGAYDILRLE

SEQ ID NO: 808975 - protein, 23 aa, Mycobacterium
ENLEAFLRVMVYDQKLITPELID

SEQ ID NO: 808976 - protein, 18 aa, Mycobacterium
ENLIRPTGFFRNKATSLI

SEQ ID NO: 808977 - protein, 17 aa, Mycobacterium
ENLLVMHPKLVDAAVFG

SEQ ID NO: 808978 - protein, 18 aa, Mycobacterium
ENLLVMHPKLVDAAVFGV

SEQ ID NO: 808979 - protein, 18 aa, Mycobacterium
ENLPSYIYRSVDPVVAEM

SEQ ID NO: 808980 - protein, 34 aa, Mycobacterium
ENLRNLHAFLSDTLLMTGFGFAPPVATPSWGILE

SEQ ID NO: 808981 - protein, 23 aa, Mycobacterium
ENLTWQAPRLHLVDLQYSDVRLD

SEQ ID NO: 808982 - protein, 23 aa, Mycobacterium
ENLWAVLCEQVGAAALLIPEESG

SEQ ID NO: 808983 - protein, 22 aa, Mycobacterium
ENLYGISWNPMNTMAALRRIDG

SEQ ID NO: 808984 - protein, 17 aa, Mycobacterium
ENMASGLALEWSRYGIR

SEQ ID NO: 808985 - protein, 29 aa, Mycobacterium
ENMPEPALSWLRDTFPAALVAPVAAYLVS

SEQ ID NO: 808986 - protein, 19 aa, Mycobacterium
ENMTVIDAIYRAAGLPLRK

SEQ ID NO: 808987 - protein, 35 aa, Mycobacterium
ENNLTLPHPLAHLRAFVLIPWLAVDPDARLTVAEG

SEQ ID NO: 808988 - protein, 35 aa, Mycobacterium
ENNLTLPHPLAHLRAFVMIPWLAIDPDAQLTVAEG

SEQ ID NO: 808989 - protein, 31 aa, Mycobacterium
ENNQRELLRLWADYLDMPPLRVDPATVLTDN

SEQ ID NO: 808990 - protein, 30 aa, Mycobacterium
ENNQRQLLRLWADYLDMPPLRVDPATVLSD

SEQ ID NO: 808991 - protein, 29 aa, Mycobacterium
ENNSHIHTVMWAARRSGLYYVPISTHLTA

SEQ ID NO: 808992 - protein, 26 aa, Mycobacterium
ENNTLILAALGWKGFWVGGQDLAVTV

SEQ ID NO: 808993 - protein, 24 aa, Mycobacterium
ENNVAYVEWAIKLGHPGTVVVVDN

SEQ ID NO: 808994 - protein, 17 aa, Mycobacterium
ENNVKLRPLARQIVREF

SEQ ID NO: 808995 - protein, 25 aa, Mycobacterium
ENPASLVEYVIMGQVLTAGAGQMPA

SEQ ID NO: 808996 - protein, 17 aa, Mycobacterium
ENPIEVPGFPLLTNRRS

SEQ ID NO: 808997 - protein, 35 aa, Mycobacterium
ENPIGPRPFLRLEGTAVFRWAAFEMGKVGQRALDA

SEQ ID NO: 808998 - protein, 25 aa, Mycobacterium
ENPRELYRLGLESVPFLLSVGDLLL

SEQ ID NO: 808999 - protein, 17 aa, Mycobacterium
ENPSFSVVAPLLSRSLI

SEQ ID NO: 809000 - protein, 29 aa, Mycobacterium
ENPSFSVVAPLLSRSLILQLHPLGADDIR

SEQ ID NO: 809001 - protein, 35 aa, Mycobacterium
ENPSFSVVAPLLSRSLILQLQPLTPADIEAVLRRA

SEQ ID NO: 809002 - protein, 34 aa, Mycobacterium
ENPSFSVVAPLLSRSLILQLQPLTPADVTTVIRR

SEQ ID NO: 809003 - protein, 32 aa, Mycobacterium
ENPSFSVVAPLLSRSLILQLRPLDADDIRAVV

SEQ ID NO: 809004 - protein, 33 aa, Mycobacterium
ENPSFSVVAPLLSRSLILQLRPLSADDIRTVVQ

SEQ ID NO: 809005 - protein, 33 aa, Mycobacterium
ENPTGPRPFLRLEGSAVFRWAAFEMGKVGQQAM

SEQ ID NO: 809006 - protein, 34 aa, Mycobacterium
ENPVAWVDQAPYRPFWAITKHADIMAIERANDLW

SEQ ID NO: 809007 - protein, 24 aa, Mycobacterium
ENPVGLAAALRRLLAQRFQCESMG

SEQ ID NO: 809008 - protein, 17 aa, Mycobacterium
ENQGWQLITTQLNFERA

SEQ ID NO: 809009 - protein, 25 aa, Mycobacterium
ENQPGFLGFQLLRPVQGEDRYFVVT

SEQ ID NO: 809010 - protein, 32 aa, Mycobacterium
ENQSLLRRISAIWEDRFRPVLTEVIAQGVAEG

SEQ ID NO: 809011 - protein, 21 aa, Mycobacterium
ENRAALIGYLPTGYPDVAGSV

SEQ ID NO: 809012 - protein, 21 aa, Mycobacterium
ENRALLDEHPWVTQLATTRPP

SEQ ID NO: 809013 - protein, 24 aa, Mycobacterium
ENRDALYTAYVHREARRVYQEVSD

SEQ ID NO: 809014 - protein, 25 aa, Mycobacterium
ENRDYILELLLSRTTAGLSYEQCVG

SEQ ID NO: 809015 - protein, 25 aa, Mycobacterium
ENRFGFRLVVGYALSETPYGLIVPV

SEQ ID NO: 809016 - protein, 18 aa, Mycobacterium
ENRFVGRVGLFRNQPGDI

SEQ ID NO: 809017 - protein, 17 aa, Mycobacterium
ENRLFERVAERLRSIGV

SEQ ID NO: 809018 - protein, 18 aa, Mycobacterium
ENRLHAQKALLTWLLERR

SEQ ID NO: 809019 - protein, 18 aa, Mycobacterium
ENRLHAQKALLVWLLERS

SEQ ID NO: 809020 - protein, 17 aa, Mycobacterium
ENRLRAYDVHRAIESIV

SEQ ID NO: 809021 - protein, 22 aa, Mycobacterium
ENRRGWGLPGTFLHPGERLSDA

SEQ ID NO: 809022 - protein, 24 aa, Mycobacterium
ENRSIYIYEWTGDSRWLLYMQDTG

SEQ ID NO: 809023 - protein, 17 aa, Mycobacterium
ENRTWAHFLESTTLILD

SEQ ID NO: 809024 - protein, 20 aa, Mycobacterium
ENRVMPVRILTEALGEGGDG

SEQ ID NO: 809025 - protein, 29 aa, Mycobacterium
ENRWDLVGRDTLCWPYGLHLHRDLLAVAD

SEQ ID NO: 809026 - protein, 23 aa, Mycobacterium
ENRWPVGMPPDVPDWRTLGAPKL

SEQ ID NO: 809027 - protein, 27 aa, Mycobacterium
ENSARPVWPMIVLRTPKGWTGPKVVDG

SEQ ID NO: 809028 - protein, 24 aa, Mycobacterium
ENSPNILYLVWDDTGIATWDCFGG

SEQ ID NO: 809029 - protein, 18 aa, Mycobacterium
ENTLIGHPAIYEAAVVAV

SEQ ID NO: 809030 - protein, 25 aa, Mycobacterium
ENTNGLLRDYFPKGVTLISHPPEQL

SEQ ID NO: 809031 - protein, 25 aa, Mycobacterium
ENTTRALLYVAMTRGRSANTAYLHE

SEQ ID NO: 809032 - protein, 22 aa, Mycobacterium
ENVMNPATWSGAGVVASHATAT

SEQ ID NO: 809033 - protein, 24 aa, Mycobacterium
ENVPDSLWVLLESAAFRSTTTDAD

SEQ ID NO: 809034 - protein, 18 aa, Mycobacterium
ENVPEIWRRLADVGLQTA

SEQ ID NO: 809035 - protein, 23 aa, Mycobacterium
ENVPEIWRRLDAVGLQTAEACGD

SEQ ID NO: 809036 - protein, 19 aa, Mycobacterium
ENWEVVRVSLPSAVARYVV

SEQ ID NO: 809037 - protein, 37 aa, Mycobacterium
ENWHPLGVVGVITAFNFPVAVWAWNTAVALVCGNTVV

SEQ ID NO: 809038 - protein, 25 aa, Mycobacterium
ENWPPIPLPFGTYPVDIALGCLIIE

SEQ ID NO: 809039 - protein, 20 aa, Mycobacterium
ENWRTSFEVDMMGTVGLVDA

SEQ ID NO: 809040 - protein, 19 aa, Mycobacterium
ENWRTTFEVDLMGTVGMVD

SEQ ID NO: 809041 - protein, 33 aa, Mycobacterium
ENYERYMRYLKGCQYYFIDEAIDVSLVTYLKPA

SEQ ID NO: 809042 - protein, 19 aa, Mycobacterium
ENYHRLTTPSTWLEALVKT

SEQ ID NO: 809043 - protein, 31 aa, Mycobacterium
ENYHSLTLPRTWLEAMVKAYIGDSLAADFYG

SEQ ID NO: 809044 - protein, 17 aa, Mycobacterium
ENYSGWFHHRSTTELYP

SEQ ID NO: 809045 - protein, 23 aa, Mycobacterium
ENYSWVMSPRWFDGKDHLALDTG

SEQ ID NO: 809046 - protein, 20 aa, Mycobacterium
EPAAGFLEGVRRLCDKHGAL

SEQ ID NO: 809047 - protein, 23 aa, Mycobacterium
EPAALDHALRRAAARTFDRLDVD

SEQ ID NO: 809048 - protein, 24 aa, Mycobacterium
EPAALVMISPLLQLAKECKQAHPN

SEQ ID NO: 809049 - protein, 36 aa, Mycobacterium
EPAAQVPPGWSPPQPYPGQWPQPAPAAPQPYGGQQF

SEQ ID NO: 809050 - protein, 20 aa, Mycobacterium
EPAARLRALQRLENARRRQA

SEQ ID NO: 809051 - protein, 18 aa, Mycobacterium
EPADGVLPAPRPTDTRMI

SEQ ID NO: 809052 - protein, 27 aa, Mycobacterium
EPADILALTLGLTTAWLGASPALRGLA

SEQ ID NO: 809053 - protein, 33 aa, Mycobacterium
EPADSRAAIADWLYWKHLSGLLHAALNPKLAAC

SEQ ID NO: 809054 - protein, 21 aa, Mycobacterium
EPAESLPPPYDNRLAQPYGGY

SEQ ID NO: 809055 - protein, 25 aa, Mycobacterium
EPAEYVFRHPLIHTVAYESQLKSAR

SEQ ID NO: 809056 - protein, 23 aa, Mycobacterium
EPAFAIDVEWTLLASLARLGRPD

SEQ ID NO: 809057 - protein, 26 aa, Mycobacterium
EPALDWLEPFLPWDGMEMAPLPAALE

SEQ ID NO: 809058 - protein, 22 aa, Mycobacterium
EPALEDPWGRCVWGLGTAAAHS

SEQ ID NO: 809059 - protein, 23 aa, Mycobacterium
EPALLARVLTACGIVAGYLYDAE

SEQ ID NO: 809060 - protein, 21 aa, Mycobacterium
EPALPALRRLIDSPRHDVVAV

SEQ ID NO: 809061 - protein, 26 aa, Mycobacterium
EPALPRLMRRLVIMGGAFDYKGNTTP

SEQ ID NO: 809062 - protein, 30 aa, Mycobacterium
EPALSDLELYLFFSLLFSAGAETTRNAVAG

SEQ ID NO: 809063 - protein, 25 aa, Mycobacterium
EPANQGAWPSFGLTLPEILPDHFTG

SEQ ID NO: 809064 - protein, 18 aa, Mycobacterium
EPAPLLETMLRLVEETEG

SEQ ID NO: 809065 - protein, 25 aa, Mycobacterium
EPAQLLDHFYAHSERRYWAKMAGLV

SEQ ID NO: 809066 - protein, 20 aa, Mycobacterium
EPARLAVLAALEDPAALSEA

SEQ ID NO: 809067 - protein, 20 aa, Mycobacterium
EPARLFATFEEEPFASASIA

SEQ ID NO: 809068 - protein, 20 aa, Mycobacterium
EPARLPFWRGDGVGRPVELG

SEQ ID NO: 809069 - protein, 26 aa, Mycobacterium
EPARRLRTLIGSYVILIVKYRKQVAI

SEQ ID NO: 809070 - protein, 36 aa, Mycobacterium
EPASFKDRWLLRNRPHLVLDGLRLAAALVAATRAYV

SEQ ID NO: 809071 - protein, 46 aa, Mycobacterium
EPASIALNAQALRLLQQLRPDLEIWYTLPVLPSGLTADGLNVVRKA

SEQ ID NO: 809072 - protein, 25 aa, Mycobacterium
EPASIKDRWLLRNRPHAVLDGLRLA

SEQ ID NO: 809073 - protein, 37 aa, Mycobacterium
EPASIKDRWLLRNRPHLVLDGLRLAATLVAADRAYLY

SEQ ID NO: 809074 - protein, 35 aa, Mycobacterium
EPASLKDRWLLRNRPHLILDGLRLAAAMVGADRAY

SEQ ID NO: 809075 - protein, 31 aa, Mycobacterium
EPASVKDRWLLRNRPHLVLDGLRLAARIIGA

SEQ ID NO: 809076 - protein, 20 aa, Mycobacterium
EPATVFAYPHDDHRFSRAAD

SEQ ID NO: 809077 - protein, 23 aa, Mycobacterium
EPAVTILDLLFNMGPEAPDYLRY

SEQ ID NO: 809078 - protein, 35 aa, Mycobacterium
EPAVWLRLQQVDAGHLWWIRSQLRSLLVADVRARL

SEQ ID NO: 809079 - protein, 18 aa, Mycobacterium
EPDAAFLSRYRDLTARRA

SEQ ID NO: 809080 - protein, 23 aa, Mycobacterium
EPDAALLVFFHGGGHVIGSLDSH

SEQ ID NO: 809081 - protein, 26 aa, Mycobacterium
EPDAWTLDGYLRHGGYRGLRTALGMD

SEQ ID NO: 809082 - protein, 26 aa, Mycobacterium
EPDDGFVNVIYRWARTGDLAAALAAA

SEQ ID NO: 809083 - protein, 26 aa, Mycobacterium
EPDDGFVNVIYRWARTGDLGAALAAA

SEQ ID NO: 809084 - protein, 35 aa, Mycobacterium
EPDELFSVPIASPLPHPLLLRVPVDEDVLSVITAQ

SEQ ID NO: 809085 - protein, 18 aa, Mycobacterium
EPDELITWVSIPAARYGQ

SEQ ID NO: 809086 - protein, 25 aa, Mycobacterium
EPDEQVLLLFSALELLHACALVHDD

SEQ ID NO: 809087 - protein, 24 aa, Mycobacterium
EPDEVLTGVRFPVWNGRSGFAIRE

SEQ ID NO: 809088 - protein, 20 aa, Mycobacterium
EPDFARLIVNLGHSEALFGE

SEQ ID NO: 809089 - protein, 26 aa, Mycobacterium
EPDFVIPLVEELLRYEPPAQITPRVA

SEQ ID NO: 809090 - protein, 29 aa, Mycobacterium
EPDGLIMETAFLPIFASLPKPTPEQEVQW

SEQ ID NO: 809091 - protein, 24 aa, Mycobacterium
EPDHLRIVTLPWARDLAVAIERLG

SEQ ID NO: 809092 - protein, 24 aa, Mycobacterium
EPDHLRLVTLPWSRDLAAAIERLG

SEQ ID NO: 809093 - protein, 17 aa, Mycobacterium
EPDLILGSVALTPEEHL

SEQ ID NO: 809094 - protein, 34 aa, Mycobacterium
EPDLKWERFITAVRLLAERLGVRQTIGLGTVPMA

SEQ ID NO: 809095 - protein, 28 aa, Mycobacterium
EPDLKWERFITAVRLLAERLNVRQTIGL

SEQ ID NO: 809096 - protein, 19 aa, Mycobacterium
EPDLLLLDEPFGALDALTR

SEQ ID NO: 809097 - protein, 17 aa, Mycobacterium
EPDLLLSAWDLRPFTDD

SEQ ID NO: 809098 - protein, 17 aa, Mycobacterium
EPDLPFKDLGIDSLSAL

SEQ ID NO: 809099 - protein, 28 aa, Mycobacterium
EPDLRWERFITAVRLLAEQLGVRQVIGL

SEQ ID NO: 809100 - protein, 34 aa, Mycobacterium
EPDLRWERFVTAIRLLAERLGVRRVIGLGSIPMA

SEQ ID NO: 809101 - protein, 26 aa, Mycobacterium
EPDLSNALAFIAPALATGGTVRITGW

SEQ ID NO: 809102 - protein, 25 aa, Mycobacterium
EPDMPDVDLFLRPSGEFRSSNFMMW

SEQ ID NO: 809103 - protein, 24 aa, Mycobacterium
EPDPEDLFMLIFTSGTSGDPKAVR

SEQ ID NO: 809104 - protein, 23 aa, Mycobacterium
EPDPEPPPPMRAPAAPAVEAPPA

SEQ ID NO: 809105 - protein, 19 aa, Mycobacterium
EPDPKLSLAPVAAALGEKL

SEQ ID NO: 809106 - protein, 24 aa, Mycobacterium
EPDPQLPVALSFSRSRQAALDAKR

SEQ ID NO: 809107 - protein, 38 aa, Mycobacterium
EPDQFYHRWYYSHALRLLQGPFLIYRELLKQSIQAALH

SEQ ID NO: 809108 - protein, 25 aa, Mycobacterium
EPDSEVLLLFSALELLHACALVHDD

SEQ ID NO: 809109 - protein, 26 aa, Mycobacterium
EPDTILRVLALHRFAKTPMLIGGQML

SEQ ID NO: 809110 - protein, 20 aa, Mycobacterium
EPDTRLLSETELWQLAFEVV

SEQ ID NO: 809111 - protein, 22 aa, Mycobacterium
EPDWDDMIGVNLSGVWKTVKAG

SEQ ID NO: 809112 - protein, 30 aa, Mycobacterium
EPDWLREGVRFWMRTALTHQLFTWTTVISR

SEQ ID NO: 809113 - protein, 25 aa, Mycobacterium
EPEAPGFVHVPWDAVDTWFEEGRKL

SEQ ID NO: 809114 - protein, 25 aa, Mycobacterium
EPEDISNAVLWLASDESRYVTGMQL

SEQ ID NO: 809115 - protein, 24 aa, Mycobacterium
EPEDVSAFVLFLASDESSYATAAE

SEQ ID NO: 809116 - protein, 23 aa, Mycobacterium
EPEEIAVFISWLVSAENSYITGQ

SEQ ID NO: 809117 - protein, 27 aa, Mycobacterium
EPEELTSWLLLLAGSASDFMTGEVIVI

SEQ ID NO: 809118 - protein, 26 aa, Mycobacterium
EPEHGLGPFPGALWLQVRDIAATQAE

SEQ ID NO: 809119 - protein, 17 aa, Mycobacterium
EPEHHIRMGRGWRRGTS

SEQ ID NO: 809120 - protein, 29 aa, Mycobacterium
EPEKPLQFADLVELPLVVPRSTTGLGQAL

SEQ ID NO: 809121 - protein, 17 aa, Mycobacterium
EPEKYIAAGLWRSADTL

SEQ ID NO: 809122 - protein, 18 aa, Mycobacterium
EPELGIGLVFPQPKSDTP

SEQ ID NO: 809123 - protein, 20 aa, Mycobacterium
EPELLPQLLVADALSAELLA

SEQ ID NO: 809124 - protein, 17 aa, Mycobacterium
EPELPLRFAVNLSVFVA

SEQ ID NO: 809125 - protein, 21 aa, Mycobacterium
EPELVFVMKERLSGPGVTAAQ

SEQ ID NO: 809126 - protein, 19 aa, Mycobacterium
EPELVPGLHRRAAKWFEAE

SEQ ID NO: 809127 - protein, 20 aa, Mycobacterium
EPEMLRRALLYAIERKRAEL

SEQ ID NO: 809128 - protein, 21 aa, Mycobacterium
EPEMLRRALLYAIERKRAELI

SEQ ID NO: 809129 - protein, 22 aa, Mycobacterium
EPEMLRRALLYAIERKRAELIA

SEQ ID NO: 809130 - protein, 26 aa, Mycobacterium
EPEPHIMRLFSALELLHACALVHDDL

SEQ ID NO: 809131 - protein, 21 aa, Mycobacterium
EPEPQPWVALLPGLDVTTMGW

SEQ ID NO: 809132 - protein, 41 aa, Mycobacterium
EPEQIDRIRRAHLLLAMFNALQPGVFALSGWDVCGMLTLPS

SEQ ID NO: 809133 - protein, 21 aa, Mycobacterium
EPERILFRRLAAFAGDFDLDA

SEQ ID NO: 809134 - protein, 25 aa, Mycobacterium
EPERLKSGWLNGIKHWQVDYSGKGC

SEQ ID NO: 809135 - protein, 25 aa, Mycobacterium
EPERQIIFRVPWIDDNGVVQLNRGF

SEQ ID NO: 809136 - protein, 24 aa, Mycobacterium
EPERQIIFRVPWIRDDGAVEINRG

SEQ ID NO: 809137 - protein, 24 aa, Mycobacterium
EPERQIIFRVPWVDDTGHVQINRG

SEQ ID NO: 809138 - protein, 22 aa, Mycobacterium
EPETLIIDCGADFRLTDPAAWE

SEQ ID NO: 809139 - protein, 25 aa, Mycobacterium
EPEVKLWDIAPLDVLIREAGGTFTS

SEQ ID NO: 809140 - protein, 24 aa, Mycobacterium
EPEVKLWDLAPLDVLVREAGGRFT

SEQ ID NO: 809141 - protein, 30 aa, Mycobacterium
EPEYALMRRGQTLFTYLHLAASLPCTQALL

SEQ ID NO: 809142 - protein, 28 aa, Mycobacterium
EPFLGIAVHGFPNYFFISGPDNANAAVQ

SEQ ID NO: 809143 - protein, 21 aa, Mycobacterium
EPFPGFVWEGCLNPVLGCPIQ

SEQ ID NO: 809144 - protein, 18 aa, Mycobacterium
EPFSALAFKVATHPFFGK

SEQ ID NO: 809145 - protein, 23 aa, Mycobacterium
EPFSWWTPPISHRSRILTSSTIT

SEQ ID NO: 809146 - protein, 32 aa, Mycobacterium
EPGALVAVARRLLLDPREIGPIRLLGVGFSGL

SEQ ID NO: 809147 - protein, 26 aa, Mycobacterium
EPGAYICVYPFVRSLEWYLLPDEERR

SEQ ID NO: 809148 - protein, 32 aa, Mycobacterium
EPGAYICVYPFVRSYDWYLLPDEERRKMLADH

SEQ ID NO: 809149 - protein, 26 aa, Mycobacterium
EPGDIAALVAFLLSREGEWINGQVVN

SEQ ID NO: 809150 - protein, 24 aa, Mycobacterium
EPGELDYPLPWADQPGRSHLVTAG

SEQ ID NO: 809151 - protein, 31 aa, Mycobacterium
EPGEWGHVELAWWRQVLAGLPGDISIALDHT

SEQ ID NO: 809152 - protein, 46 aa, Mycobacterium
EPGEYLVIDWAQAAPGLFLFCAVLAFSRWRFVRFATDERASTTLAL

SEQ ID NO: 809153 - protein, 21 aa, Mycobacterium
EPGFITMNLPRLLDALDGQGI

SEQ ID NO: 809154 - protein, 24 aa, Mycobacterium
EPGGAEVALVFQADRPGPVDDAAV

SEQ ID NO: 809155 - protein, 26 aa, Mycobacterium
EPGGMMRYGIPNYRLPRDVLDAEIER

SEQ ID NO: 809156 - protein, 26 aa, Mycobacterium
EPGGMMRYGIPSYRLPRDVLDAEIER

SEQ ID NO: 809157 - protein, 25 aa, Mycobacterium
EPGHLWWIRSQLRETLIADVRARLR

SEQ ID NO: 809158 - protein, 25 aa, Mycobacterium
EPGLAPLRCRLPSLPQGPNPVRTFI

SEQ ID NO: 809159 - protein, 22 aa, Mycobacterium
EPGLRKLLRDNLAAGRLHFTTD

SEQ ID NO: 809160 - protein, 19 aa, Mycobacterium
EPGLRQLHAITDRPTYGVL

SEQ ID NO: 809161 - protein, 26 aa, Mycobacterium
EPGNSLFINVNCWGRLVTGVGAALGK

SEQ ID NO: 809162 - protein, 26 aa, Mycobacterium
EPGNSLFITVNCWGRLVSGVGAALGK

SEQ ID NO: 809163 - protein, 26 aa, Mycobacterium
EPGNSLFITVNCWGRLVTGVGAALGK

SEQ ID NO: 809164 - protein, 26 aa, Mycobacterium
EPGNYICVYPFVRSYEWYLLPDEERR

SEQ ID NO: 809165 - protein, 18 aa, Mycobacterium
EPGPIPALLESPDVTIEL

SEQ ID NO: 809166 - protein, 18 aa, Mycobacterium
EPGPPKPFVRKLINTVRL

SEQ ID NO: 809167 - protein, 32 aa, Mycobacterium
EPGRAIQFNTLFLDPYLWKLQVGGKRLVQRAR

SEQ ID NO: 809168 - protein, 22 aa, Mycobacterium
EPGRFFDELLAIIGPQAGRYWS

SEQ ID NO: 809169 - protein, 29 aa, Mycobacterium
EPGRHIHDFPALWYVPAAGAVYVAAAGEV

SEQ ID NO: 809170 - protein, 23 aa, Mycobacterium
EPGRPCWLVGLLFPSADGCAGHS

SEQ ID NO: 809171 - protein, 32 aa, Mycobacterium
EPGRTYQFNALFLDPYLWKLQVGGKRLVQKAR

SEQ ID NO: 809172 - protein, 22 aa, Mycobacterium
EPGSLLARALRRTAREARIGAT

SEQ ID NO: 809173 - protein, 23 aa, Mycobacterium
EPGSLSVLWMGVATLLIDDGSSA

SEQ ID NO: 809174 - protein, 22 aa, Mycobacterium
EPGSYATGMAFLPQSSRDAAAA

SEQ ID NO: 809175 - protein, 20 aa, Mycobacterium
EPGSYGLLVGRYRDLVLDIV

SEQ ID NO: 809176 - protein, 24 aa, Mycobacterium
EPGTRLKFLQIAATITGHFAARSA

SEQ ID NO: 809177 - protein, 25 aa, Mycobacterium
EPGVAQRVTLVPLRGTREVYGLSIN

SEQ ID NO: 809178 - protein, 22 aa, Mycobacterium
EPGVFLGQRNIPVAAAGAYVPG

SEQ ID NO: 809179 - protein, 17 aa, Mycobacterium
EPGVGKSTLLLEVAHRW

SEQ ID NO: 809180 - protein, 25 aa, Mycobacterium
EPGVGKSTLLLKVVHQWAASGGRAL

SEQ ID NO: 809181 - protein, 18 aa, Mycobacterium
EPGVRLRWPDGVTTTALT

SEQ ID NO: 809182 - protein, 25 aa, Mycobacterium
EPGVRQFERLLAKALRKVTTKLAED

SEQ ID NO: 809183 - protein, 20 aa, Mycobacterium
EPGWAPFTASGLAQWGPPAT

SEQ ID NO: 809184 - protein, 23 aa, Mycobacterium
EPGWAPLTASGLAQWGPPATKDF

SEQ ID NO: 809185 - protein, 25 aa, Mycobacterium
EPGYFRGVVRHDDSCPWYAALKRDL

SEQ ID NO: 809186 - protein, 43 aa, Mycobacterium
EPHAPYQRPPLSKEFLCDTAASDDLWILPEKWCADNGVEIRTG

SEQ ID NO: 809187 - protein, 18 aa, Mycobacterium
EPHLARITCPALVINADQ

SEQ ID NO: 809188 - protein, 18 aa, Mycobacterium
EPHMYVGPALWPAAEDIA

SEQ ID NO: 809189 - protein, 23 aa, Mycobacterium
EPHRICRYLEDLAGDYHRFYDSC

SEQ ID NO: 809190 - protein, 18 aa, Mycobacterium
EPHRLLTTPLVRGGDVVA

SEQ ID NO: 809191 - protein, 19 aa, Mycobacterium
EPIAVIGLGLRLPGGDDLD

SEQ ID NO: 809192 - protein, 22 aa, Mycobacterium
EPIDGVFRWIGRIRPNEQLTAI

SEQ ID NO: 809193 - protein, 19 aa, Mycobacterium
EPIDISNAVLFFASDEARY

SEQ ID NO: 809194 - protein, 19 aa, Mycobacterium
EPIDISNAVLFFASDESRY

SEQ ID NO: 809195 - protein, 34 aa, Mycobacterium
EPIEIEYGLLRRGQILFTYLHLAASLPCTEALLR

SEQ ID NO: 809196 - protein, 25 aa, Mycobacterium
EPIEPRLSLQWWVRVETLAKAAGDA

SEQ ID NO: 809197 - protein, 20 aa, Mycobacterium
EPIFLADLIAKRGLAEVGVL

SEQ ID NO: 809198 - protein, 20 aa, Mycobacterium
EPIGDKLARLTTQLLAALDE

SEQ ID NO: 809199 - protein, 24 aa, Mycobacterium
EPILALSRLTATLLERLQAHLEGW

SEQ ID NO: 809200 - protein, 17 aa, Mycobacterium
EPILDLRMRLGEGSGAA

SEQ ID NO: 809201 - protein, 21 aa, Mycobacterium
EPINADAWFDTVRRSAPFATL

SEQ ID NO: 809202 - protein, 18 aa, Mycobacterium
EPIPGAVSLKLPLRQPHN

SEQ ID NO: 809203 - protein, 20 aa, Mycobacterium
EPIPLPVKTSYAWAAARHCG

SEQ ID NO: 809204 - protein, 18 aa, Mycobacterium
EPIPPMPIAHGLGLGFDP

SEQ ID NO: 809205 - protein, 20 aa, Mycobacterium
EPIPVHLVYSAAAYARQHAT

SEQ ID NO: 809206 - protein, 18 aa, Mycobacterium
EPIQGEGGFIVPAPGFLA

SEQ ID NO: 809207 - protein, 24 aa, Mycobacterium
EPIRPYERLLYAGLIGDRQLFARE

SEQ ID NO: 809208 - protein, 17 aa, Mycobacterium
EPIVPAHVLHRPKLGFP

SEQ ID NO: 809209 - protein, 20 aa, Mycobacterium
EPIWWDEQLPGQGGGFHDGG

SEQ ID NO: 809210 - protein, 25 aa, Mycobacterium
EPKITVWKDYWDMNSLVAFAPPNHF

SEQ ID NO: 809211 - protein, 27 aa, Mycobacterium
EPKLALPTPAGWEYTAAMNSPMIRGTV

SEQ ID NO: 809212 - protein, 30 aa, Mycobacterium
EPKQAWFPIDRSMILYYCSLVEDANPRYWE

SEQ ID NO: 809213 - protein, 28 aa, Mycobacterium
EPLDPEAYRQFLTDIGYLLPEPEDFAIT

SEQ ID NO: 809214 - protein, 23 aa, Mycobacterium
EPLDPHVIVLFGATGDLAKRKLI

SEQ ID NO: 809215 - protein, 28 aa, Mycobacterium
EPLEDFLGDFKFYLDYYTKQSAGGVEVR

SEQ ID NO: 809216 - protein, 25 aa, Mycobacterium
EPLEDFLGEFKFYLDFYTKQSSHGL

SEQ ID NO: 809217 - protein, 28 aa, Mycobacterium
EPLEDYLGDFRFYLDYYTKQSAGGLEVR

SEQ ID NO: 809218 - protein, 24 aa, Mycobacterium
EPLEIPCDLALLAIGFEGVEHMPL

SEQ ID NO: 809219 - protein, 20 aa, Mycobacterium
EPLFHVEKGWMGVGLGIHGE

SEQ ID NO: 809220 - protein, 20 aa, Mycobacterium
EPLFSLLNPHDADNLTKGII

SEQ ID NO: 809221 - protein, 22 aa, Mycobacterium
EPLGFDGIWFPEHHGTPYGMTP

SEQ ID NO: 809222 - protein, 36 aa, Mycobacterium
EPLGVVGLVTPWNFPIAIPAWKMAPALVSGNAVVIK

SEQ ID NO: 809223 - protein, 36 aa, Mycobacterium
EPLGVVGQIIPWNFPILMAVWKLAPALAAGNAVVLK

SEQ ID NO: 809224 - protein, 35 aa, Mycobacterium
EPLGVVGQIIPWNFPLLMASWKLAPALAAGNTVVL

SEQ ID NO: 809225 - protein, 35 aa, Mycobacterium
EPLGVVGQIIPWNFPLLMATWKLAPALAAGNAVVL

SEQ ID NO: 809226 - protein, 36 aa, Mycobacterium
EPLGVVGVITPWNFPMTIAAWGFAPALAAGCAVLLK

SEQ ID NO: 809227 - protein, 36 aa, Mycobacterium
EPLGVVGVITPWNFPMTIASWGFAPALAAGNAVLVK

SEQ ID NO: 809228 - protein, 25 aa, Mycobacterium
EPLIRPTLLRLGPATHVLLVLVHHI

SEQ ID NO: 809229 - protein, 22 aa, Mycobacterium
EPLLDLIASVRSVTALPVVAAG

SEQ ID NO: 809230 - protein, 20 aa, Mycobacterium
EPLLPPQRWPSRAAATLSTH

SEQ ID NO: 809231 - protein, 17 aa, Mycobacterium
EPLPALPALPVPPALPA

SEQ ID NO: 809232 - protein, 21 aa, Mycobacterium
EPLPANIPWFRSGAQRVPTTL

SEQ ID NO: 809233 - protein, 23 aa, Mycobacterium
EPLPAVVDFRTALTSPVAVHDAY

SEQ ID NO: 809234 - protein, 19 aa, Mycobacterium
EPLPPDHPLRRLPNVTLSP

SEQ ID NO: 809235 - protein, 22 aa, Mycobacterium
EPLPRDRGAFAQLLRACGRIEG

SEQ ID NO: 809236 - protein, 19 aa, Mycobacterium
EPLPTFDAIGHFPLPMIRN

SEQ ID NO: 809237 - protein, 25 aa, Mycobacterium
EPLQVEDPVFGTDWGQPVIPEHPDM

SEQ ID NO: 809238 - protein, 24 aa, Mycobacterium
EPLRIALAYAVRRATRPLRAPRWL

SEQ ID NO: 809239 - protein, 25 aa, Mycobacterium
EPLSDRACWLHMLTLYRAGRAPEAL

SEQ ID NO: 809240 - protein, 21 aa, Mycobacterium
EPLSSRPTGWRTRVRLDVGAD

SEQ ID NO: 809241 - protein, 27 aa, Mycobacterium
EPLSTLVVNAIRKTLKAVAVKAPFFGD

SEQ ID NO: 809242 - protein, 28 aa, Mycobacterium
EPMALRDRLIVEMLYATGIRVSELCGLD

SEQ ID NO: 809243 - protein, 18 aa, Mycobacterium
EPMGVVGAITPWNFPFEI

SEQ ID NO: 809244 - protein, 21 aa, Mycobacterium
EPMLGTWQSIVLVDLNRDNPQ

SEQ ID NO: 809245 - protein, 23 aa, Mycobacterium
EPMRAIPAFFEPGPRLETMNELG

SEQ ID NO: 809246 - protein, 31 aa, Mycobacterium
EPNARLLTETQLWQLAFRLVCDFDGDLDTEK

SEQ ID NO: 809247 - protein, 33 aa, Mycobacterium
EPNHLPITPGWNYLVRLYRPRAEILDGSWTFPV

SEQ ID NO: 809248 - protein, 23 aa, Mycobacterium
EPNLDLRYAVQHPGYQIPISVAI

SEQ ID NO: 809249 - protein, 24 aa, Mycobacterium
EPNPHIPFDTLPLRVGQTLVPWPE

SEQ ID NO: 809250 - protein, 20 aa, Mycobacterium
EPNRRIAWQSLPGSAIENGG

SEQ ID NO: 809251 - protein, 18 aa, Mycobacterium
EPNTIERLFGGLIAAQSL

SEQ ID NO: 809252 - protein, 23 aa, Mycobacterium
EPNWVRRFDLLDSVFMRAAAEGP

SEQ ID NO: 809253 - protein, 30 aa, Mycobacterium
EPNYVHSIDWRWLTVPLAPGPGESWLRPTV

SEQ ID NO: 809254 - protein, 20 aa, Mycobacterium
EPPAPWLPESAVGQAGLVLL

SEQ ID NO: 809255 - protein, 22 aa, Mycobacterium
EPPASTVFLLCAPSVDPEDIAV

SEQ ID NO: 809256 - protein, 17 aa, Mycobacterium
EPPAYRAGLAGGMPGGF

SEQ ID NO: 809257 - protein, 24 aa, Mycobacterium
EPPDHLIFVFATTEPEKVLPTIRS

SEQ ID NO: 809258 - protein, 27 aa, Mycobacterium
EPPERPIPGPLKWDLTLGVATDTRESL

SEQ ID NO: 809259 - protein, 17 aa, Mycobacterium
EPPGTRMRVALSALTMA

SEQ ID NO: 809260 - protein, 28 aa, Mycobacterium
EPPKPPEVILIDLLRPPGTTARGAGLQS

SEQ ID NO: 809261 - protein, 26 aa, Mycobacterium
EPPLVAPRVLAPSALVGRLRAVVCAP

SEQ ID NO: 809262 - protein, 17 aa, Mycobacterium
EPPLVTPGIGANPAPEG

SEQ ID NO: 809263 - protein, 25 aa, Mycobacterium
EPPNGPPPPARWSRRKPEAAARLEA

SEQ ID NO: 809264 - protein, 29 aa, Mycobacterium
EPPSEPQWAPQWWSEIPLPPEPEPEPEPE

SEQ ID NO: 809265 - protein, 26 aa, Mycobacterium
EPPSLPSLPMDNLPAETPPAAVPHGG

SEQ ID NO: 809266 - protein, 32 aa, Mycobacterium
EPPTDLFGDWLALARLRLLRATVPSAPELLRL

SEQ ID NO: 809267 - protein, 26 aa, Mycobacterium
EPPTGWALATPQQPLWWHSSVMADAV

SEQ ID NO: 809268 - protein, 26 aa, Mycobacterium
EPPVTYLVSYYALRGVILECSVHMET

SEQ ID NO: 809269 - protein, 20 aa, Mycobacterium
EPQFYAEFLKGVGLEGADLP

SEQ ID NO: 809270 - protein, 27 aa, Mycobacterium
EPQLRELRAWLGRRLPRYLMPNAIVAV

SEQ ID NO: 809271 - protein, 27 aa, Mycobacterium
EPQLSLAPCALLSCAIPTGYGSAANRA

SEQ ID NO: 809272 - protein, 21 aa, Mycobacterium
EPQPEWELALGRLGHALVAHP

SEQ ID NO: 809273 - protein, 25 aa, Mycobacterium
EPQQLVQYLTQQQQLPGLYVDVRRG

SEQ ID NO: 809274 - protein, 24 aa, Mycobacterium
EPQRTARGWLASGPAIVVLTLGAR

SEQ ID NO: 809275 - protein, 18 aa, Mycobacterium
EPQRWIIDSNWKLGADNF

SEQ ID NO: 809276 - protein, 18 aa, Mycobacterium
EPQWATPPEFAWDYRVFG

SEQ ID NO: 809277 - protein, 20 aa, Mycobacterium
EPRCPFAPPPDVMALAESRP

SEQ ID NO: 809278 - protein, 19 aa, Mycobacterium
EPRHAAFERFLSFGDVCTH

SEQ ID NO: 809279 - protein, 21 aa, Mycobacterium
EPRHLELPAHDYAAVLRNSGT

SEQ ID NO: 809280 - protein, 20 aa, Mycobacterium
EPRIDLPFDIGGACVLLVDG

SEQ ID NO: 809281 - protein, 24 aa, Mycobacterium
EPRITALSDLWFEAARLGGFDVAT

SEQ ID NO: 809282 - protein, 24 aa, Mycobacterium
EPRKEWVLQFSIGAAPRSSTVVAT

SEQ ID NO: 809283 - protein, 28 aa, Mycobacterium
EPRKGMAVLLAALPKLVARFPDVEILIV

SEQ ID NO: 809284 - protein, 24 aa, Mycobacterium
EPRKGVGVLLDALPRLVERFADVQ

SEQ ID NO: 809285 - protein, 18 aa, Mycobacterium
EPRLFTCGVDLPLEHPRV

SEQ ID NO: 809286 - protein, 20 aa, Mycobacterium
EPRLPFADAAFDLVTSRHPI

SEQ ID NO: 809287 - protein, 22 aa, Mycobacterium
EPRLPVPSGWPFGEDFPRTCGA

SEQ ID NO: 809288 - protein, 29 aa, Mycobacterium
EPRLRVPDEFGLCRYLAAGLAALSTVDPR

SEQ ID NO: 809289 - protein, 22 aa, Mycobacterium
EPRLSLQWFVRVESLAKAAGDA

SEQ ID NO: 809290 - protein, 18 aa, Mycobacterium
EPRRGVAIVSSPLVHIGG

SEQ ID NO: 809291 - protein, 17 aa, Mycobacterium
EPRRLRPGFTAFGQTRW

SEQ ID NO: 809292 - protein, 23 aa, Mycobacterium
EPRSLKFPSFGKSAKAWKADDTK

SEQ ID NO: 809293 - protein, 24 aa, Mycobacterium
EPRTDGFRNFFRPGDKNPLEQQLV

SEQ ID NO: 809294 - protein, 21 aa, Mycobacterium
EPRTLIWRSRWVTDDGIVECR

SEQ ID NO: 809295 - protein, 25 aa, Mycobacterium
EPRVLQIRALVLGGAMDWLQDNQAS

SEQ ID NO: 809296 - protein, 25 aa, Mycobacterium
EPRVLQIRALVLGTALDWIKSNHST

SEQ ID NO: 809297 - protein, 22 aa, Mycobacterium
EPRVLQIRALVLGTALDWLADN

SEQ ID NO: 809298 - protein, 21 aa, Mycobacterium
EPRVLQIRALVLGTAMDWLAD

SEQ ID NO: 809299 - protein, 25 aa, Mycobacterium
EPSAWLVEGLLIYLPADAQERLFES

SEQ ID NO: 809300 - protein, 17 aa, Mycobacterium
EPSDLVLRRWHGVGPMG

SEQ ID NO: 809301 - protein, 17 aa, Mycobacterium
EPSEIASAVIFLSSPDA

SEQ ID NO: 809302 - protein, 25 aa, Mycobacterium
EPSLPGQWPFVRGGDPRRDVNSGWK

SEQ ID NO: 809303 - protein, 30 aa, Mycobacterium
EPSLTDLELYLFFSLLFSAGAETTRNAVAG

SEQ ID NO: 809304 - protein, 20 aa, Mycobacterium
EPSLTIQTLLDDPLAAVVCE

SEQ ID NO: 809305 - protein, 25 aa, Mycobacterium
EPSMDGVVLHYFLHAEPTAAAAWQL

SEQ ID NO: 809306 - protein, 29 aa, Mycobacterium
EPSMYRFHRRLASFSRLIRFDHRGVGLSS

SEQ ID NO: 809307 - protein, 23 aa, Mycobacterium
EPSMYRFHRRLASFSRVIRFDHR

SEQ ID NO: 809308 - protein, 31 aa, Mycobacterium
EPSRKLTGNDWLALLLEPPASAHTPGTPEWE

SEQ ID NO: 809309 - protein, 24 aa, Mycobacterium
EPSTALLIDFRDLAIRPVPFDPEA

SEQ ID NO: 809310 - protein, 25 aa, Mycobacterium
EPSTLAYAIEGLPAWMGRLTNRWTL

SEQ ID NO: 809311 - protein, 23 aa, Mycobacterium
EPSVDSWYALLRADDEVAPDEEA

SEQ ID NO: 809312 - protein, 20 aa, Mycobacterium
EPSWPSPFGRGRPGWHVECS

SEQ ID NO: 809313 - protein, 28 aa, Mycobacterium
EPSWSYLYRTMIPVLVDAGLRAVAIDLV

SEQ ID NO: 809314 - protein, 24 aa, Mycobacterium
EPTAALFPNLSLAPAKPTGVRATA

SEQ ID NO: 809315 - protein, 24 aa, Mycobacterium
EPTAPLFCAVTLKPAKPTGKRVGG

SEQ ID NO: 809316 - protein, 28 aa, Mycobacterium
EPTAWIAEGLLIYLPAEAQDRLLDNITA

SEQ ID NO: 809317 - protein, 28 aa, Mycobacterium
EPTAWLAEGLLMYLPTEAQDRLFELIVD

SEQ ID NO: 809318 - protein, 23 aa, Mycobacterium
EPTFVGTRRYVRRQRSWFRRDHR

SEQ ID NO: 809319 - protein, 26 aa, Mycobacterium
EPTLLPREYFERVFALQREVFPSDWL

SEQ ID NO: 809320 - protein, 18 aa, Mycobacterium
EPTPLLRPAEGVPPITAS

SEQ ID NO: 809321 - protein, 24 aa, Mycobacterium
EPTPSFAIIGYAARFPGAASAEEY

SEQ ID NO: 809322 - protein, 27 aa, Mycobacterium
EPTQALTGRPLIGNGTPGAAGSGTDGT

SEQ ID NO: 809323 - protein, 29 aa, Mycobacterium
EPTRRVRLMRWGLVPPWAKAGADGAPETK

SEQ ID NO: 809324 - protein, 28 aa, Mycobacterium
EPTRRVRLMRWGLVPPWAKAGEDGAPET

SEQ ID NO: 809325 - protein, 30 aa, Mycobacterium
EPTRRVRMMRWGFVPSWAKPGPQGAPEGKG

SEQ ID NO: 809326 - protein, 36 aa, Mycobacterium
EPTSIKDRWLLRNRPHLVLDGLRLAATIVGAKRGYV

SEQ ID NO: 809327 - protein, 19 aa, Mycobacterium
EPTYILRGLTELHITFTPA

SEQ ID NO: 809328 - protein, 22 aa, Mycobacterium
EPVAGPWRLDALPLVISASDWD

SEQ ID NO: 809329 - protein, 18 aa, Mycobacterium
EPVALLDWEMASVGPREL

SEQ ID NO: 809330 - protein, 21 aa, Mycobacterium
EPVAPPPPAAPVPAAAPAAPA

SEQ ID NO: 809331 - protein, 32 aa, Mycobacterium
EPVARELVVVRPIGFEPLAWVRALAAEDPVPS

SEQ ID NO: 809332 - protein, 22 aa, Mycobacterium
EPVDADAWFDAVRRSAPFATLP

SEQ ID NO: 809333 - protein, 27 aa, Mycobacterium
EPVDPVAYKQFLTDIGYLLPEPEDFTI

SEQ ID NO: 809334 - protein, 19 aa, Mycobacterium
EPVETLYRLADGSPRRLRS

SEQ ID NO: 809335 - protein, 26 aa, Mycobacterium
EPVGAVHNFWYRDAVWRRYDEMDGFP

SEQ ID NO: 809336 - protein, 23 aa, Mycobacterium
EPVHFVQMWVVPDESGIQPGYQQ

SEQ ID NO: 809337 - protein, 18 aa, Mycobacterium
EPVLASCALPGVLPPVRI

SEQ ID NO: 809338 - protein, 18 aa, Mycobacterium
EPVLRNWQEMSASLMSVG

SEQ ID NO: 809339 - protein, 21 aa, Mycobacterium
EPVLVALPADRLALLRSELGA

SEQ ID NO: 809340 - protein, 17 aa, Mycobacterium
EPVPCEIYCHTLADPSI

SEQ ID NO: 809341 - protein, 21 aa, Mycobacterium
EPVPVLMRDGVPTLALRSTSG

SEQ ID NO: 809342 - protein, 25 aa, Mycobacterium
EPVRLRSGWLNGIKHWQVDYRGDAA

SEQ ID NO: 809343 - protein, 25 aa, Mycobacterium
EPVRPLAPYVLKAAYWMAARSGIEG

SEQ ID NO: 809344 - protein, 21 aa, Mycobacterium
EPVRRLIRELAEKMLARSGEV

SEQ ID NO: 809345 - protein, 22 aa, Mycobacterium
EPVRSLVWARGRLREFHPAEVA

SEQ ID NO: 809346 - protein, 23 aa, Mycobacterium
EPVSPYLALLYSQSQELDFDSTL

SEQ ID NO: 809347 - protein, 21 aa, Mycobacterium
EPVTDKWAAFGWDVRAVDGHD

SEQ ID NO: 809348 - protein, 25 aa, Mycobacterium
EPVTSPPPPPPPPPPPVTERDRVLR

SEQ ID NO: 809349 - protein, 27 aa, Mycobacterium
EPVVIVAPMFHAWGFSQLAFAASMACT

SEQ ID NO: 809350 - protein, 25 aa, Mycobacterium
EPVVPLTDYVLKAAYWKSARDGLDG

SEQ ID NO: 809351 - protein, 23 aa, Mycobacterium
EPVYAHVPLVLNADGARLAKRDG

SEQ ID NO: 809352 - protein, 24 aa, Mycobacterium
EPVYMGGILALRRDRVAMPGGGSA

SEQ ID NO: 809353 - protein, 18 aa, Mycobacterium
EPWALRQPIRVRVALHTG

SEQ ID NO: 809354 - protein, 33 aa, Mycobacterium
EPWPLVQDAYLRAWEYRPWRAEALYAIARQYRD

SEQ ID NO: 809355 - protein, 18 aa, Mycobacterium
EPWYAHIPGIKVVAPATI

SEQ ID NO: 809356 - protein, 20 aa, Mycobacterium
EPYDFIISSLPHSNFPAITV

SEQ ID NO: 809357 - protein, 33 aa, Mycobacterium
EPYGTTLIIGAWNFPFYLTIGPLVGAVAAGNTV

SEQ ID NO: 809358 - protein, 32 aa, Mycobacterium
EPYGTVLVIGAWNFPFALTLGPAVGAIAAGNT

SEQ ID NO: 809359 - protein, 19 aa, Mycobacterium
EPYRRLAPIAPVRPVVPAD

SEQ ID NO: 809360 - protein, 19 aa, Mycobacterium
EPYRRLVNQGYIQAFAYTD

SEQ ID NO: 809361 - protein, 21 aa, Mycobacterium
EQAAAFLERPPGDLKQIVLHL

SEQ ID NO: 809362 - protein, 33 aa, Mycobacterium
EQAATTMRLMLSLPANPLGLHAFVADFARKAEN

SEQ ID NO: 809363 - protein, 18 aa, Mycobacterium
EQAATWHALLSPEPRRPK

SEQ ID NO: 809364 - protein, 23 aa, Mycobacterium
EQAAVLVFLGSRAAGYISGQVLW

SEQ ID NO: 809365 - protein, 23 aa, Mycobacterium
EQADYNLKYLSAVALIDGGVGPE

SEQ ID NO: 809366 - protein, 21 aa, Mycobacterium
EQAELLRLLIKVADSLRARGI

SEQ ID NO: 809367 - protein, 25 aa, Mycobacterium
EQAFYAALEFWSALHGFVLLEMTGV

SEQ ID NO: 809368 - protein, 24 aa, Mycobacterium
EQAGAPDLIYIDLHLVHEVTSPQA

SEQ ID NO: 809369 - protein, 18 aa, Mycobacterium
EQAIRWINYTIESELLMN

SEQ ID NO: 809370 - protein, 26 aa, Mycobacterium
EQAKGMLMLVYRLNADAAFDVLKWRS

SEQ ID NO: 809371 - protein, 24 aa, Mycobacterium
EQAKGMLMVIYGIDESTAFVLLKW

SEQ ID NO: 809372 - protein, 24 aa, Mycobacterium
EQAKGVLMAVYRVSPEQAFRVLQW

SEQ ID NO: 809373 - protein, 25 aa, Mycobacterium
EQAKGVLMFVYRVSAEQAFRVLQWR

SEQ ID NO: 809374 - protein, 24 aa, Mycobacterium
EQAKGVLMSVYRVSAQQAFRVLQW

SEQ ID NO: 809375 - protein, 25 aa, Mycobacterium
EQAKIDAFFFTDVLGIQGEFNRSRD

SEQ ID NO: 809376 - protein, 27 aa, Mycobacterium
EQALEDLWNLLTGWVDDIPIIGDIIEI

SEQ ID NO: 809377 - protein, 21 aa, Mycobacterium
EQALGAISVLFLGGLDTTRSA

SEQ ID NO: 809378 - protein, 17 aa, Mycobacterium
EQALTQLGAWTHETIRR

SEQ ID NO: 809379 - protein, 24 aa, Mycobacterium
EQAQWLDVLHWSQLVIELADGDPT

SEQ ID NO: 809380 - protein, 28 aa, Mycobacterium
EQARARPIAPLLDALRGLGVPVDGAGLP

SEQ ID NO: 809381 - protein, 27 aa, Mycobacterium
EQARARPIAPLLDALRGLGVQIDGAGL

SEQ ID NO: 809382 - protein, 24 aa, Mycobacterium
EQARARPIAPLLDALRSTGVGIDG

SEQ ID NO: 809383 - protein, 25 aa, Mycobacterium
EQARDWLRRFELRPGFEVVLPPPAP

SEQ ID NO: 809384 - protein, 24 aa, Mycobacterium
EQARFAGAFTFQYSKRPGTPAADM

SEQ ID NO: 809385 - protein, 25 aa, Mycobacterium
EQARKHRVFKAIRFVGHLEHAELLA

SEQ ID NO: 809386 - protein, 23 aa, Mycobacterium
EQARKHRVLKATKFLGHLEHAEL

SEQ ID NO: 809387 - protein, 24 aa, Mycobacterium
EQARKHRVLKATKFVGHLGHTELL

SEQ ID NO: 809388 - protein, 26 aa, Mycobacterium
EQARSRPIAPLLDGLRTLGVDIDGDG

SEQ ID NO: 809389 - protein, 19 aa, Mycobacterium
EQCDIDHVVPWPYGPTHPS

SEQ ID NO: 809390 - protein, 21 aa, Mycobacterium
EQCLTVARRLAAVLGGDCNHH

SEQ ID NO: 809391 - protein, 28 aa, Mycobacterium
EQDAFDWVRDLLSYLPPNNATDAPRYAE

SEQ ID NO: 809392 - protein, 29 aa, Mycobacterium
EQDAFDWVRDLLSYLPPNNATDPPRYAEP

SEQ ID NO: 809393 - protein, 31 aa, Mycobacterium
EQDALDLARLMRLPVMFAQLDDQLIGVLAAD

SEQ ID NO: 809394 - protein, 27 aa, Mycobacterium
EQDHGFEFAVLPWPDYYGSVPGARNDG

SEQ ID NO: 809395 - protein, 19 aa, Mycobacterium
EQDIQIWAHQRYCDPPALT

SEQ ID NO: 809396 - protein, 28 aa, Mycobacterium
EQDKLPDVLYTSLLRRAITTANIALDKA

SEQ ID NO: 809397 - protein, 25 aa, Mycobacterium
EQDLRGLLGAFMFTGPQLDQPAGTL

SEQ ID NO: 809398 - protein, 25 aa, Mycobacterium
EQDLRGLLGAFMFTGPQLEQPAGTL

SEQ ID NO: 809399 - protein, 19 aa, Mycobacterium
EQDLRREYLAMEIAVAVVD

SEQ ID NO: 809400 - protein, 37 aa, Mycobacterium
EQDQNELLVSWLPQYHDFGLIFMALQALYLGATVVSM

SEQ ID NO: 809401 - protein, 31 aa, Mycobacterium
EQDRRFFFPAYLGPFGWLGLDLTAAAAVDWT

SEQ ID NO: 809402 - protein, 27 aa, Mycobacterium
EQDSRFFFPAYMGPFGWLGLDLTAAEV

SEQ ID NO: 809403 - protein, 32 aa, Mycobacterium
EQDVAVNLNGPFFLCRAALPHLLERGGNIVNV

SEQ ID NO: 809404 - protein, 18 aa, Mycobacterium
EQEILRDGVIPRRLITSC

SEQ ID NO: 809405 - protein, 24 aa, Mycobacterium
EQEKQIWFWLVQGHVDDPALRDLA

SEQ ID NO: 809406 - protein, 24 aa, Mycobacterium
EQELDLVLAILRARQLFGGEQVIP

SEQ ID NO: 809407 - protein, 18 aa, Mycobacterium
EQELLLAPEFFTALPQHL

SEQ ID NO: 809408 - protein, 22 aa, Mycobacterium
EQELQYWQRFYSWAAGDTLSPT

SEQ ID NO: 809409 - protein, 25 aa, Mycobacterium
EQELRGLLGAFMFTGPQLDQPAGTL

SEQ ID NO: 809410 - protein, 28 aa, Mycobacterium
EQELRRHILTLWQTALIRLSRLKIQDEI

SEQ ID NO: 809411 - protein, 26 aa, Mycobacterium
EQENLGFPVFSRGLAIRGTGKSYPGV

SEQ ID NO: 809412 - protein, 24 aa, Mycobacterium
EQEQGRIDILVNNAALIRDEMMGR

SEQ ID NO: 809413 - protein, 25 aa, Mycobacterium
EQERLRRIFAIVDVADRTRIGLTAG

SEQ ID NO: 809414 - protein, 23 aa, Mycobacterium
EQEWSYVDFGPWPGNRSPDGSER

SEQ ID NO: 809415 - protein, 27 aa, Mycobacterium
EQEYFLVDRHFFVARPDLVNAGRTVFG

SEQ ID NO: 809416 - protein, 25 aa, Mycobacterium
EQEYRPFRALIRAVLRHAGGVRIDH

SEQ ID NO: 809417 - protein, 18 aa, Mycobacterium
EQFGYDAWVLVYDIDTVH

SEQ ID NO: 809418 - protein, 20 aa, Mycobacterium
EQFMQWFLKEQVEEVAAMTT

SEQ ID NO: 809419 - protein, 20 aa, Mycobacterium
EQFMQWFLKEQVEEVATMTT

SEQ ID NO: 809420 - protein, 18 aa, Mycobacterium
EQFMQWFLQEQVEEMSLM

SEQ ID NO: 809421 - protein, 20 aa, Mycobacterium
EQFMTWRRSYDTPPPPIERG

SEQ ID NO: 809422 - protein, 27 aa, Mycobacterium
EQFRPDTPFGFGFGFDPTGRGPGLRGR

SEQ ID NO: 809423 - protein, 21 aa, Mycobacterium
EQFSCWRITLPHPDAAKFDAA

SEQ ID NO: 809424 - protein, 31 aa, Mycobacterium
EQFVPATLRGDLFWCQLFSEPGAGSDLAALR

SEQ ID NO: 809425 - protein, 19 aa, Mycobacterium
EQGGEFLDPALLEKPDRFA

SEQ ID NO: 809426 - protein, 24 aa, Mycobacterium
EQGLGIAVVPAPYVRNRAGVLALD

SEQ ID NO: 809427 - protein, 18 aa, Mycobacterium
EQGLGWKAGVEAALERLL

SEQ ID NO: 809428 - protein, 23 aa, Mycobacterium
EQGLPFIREAALAKRLGADKGMQ

SEQ ID NO: 809429 - protein, 23 aa, Mycobacterium
EQGPAYHLAVLPFTDGGSVRHDL

SEQ ID NO: 809430 - protein, 20 aa, Mycobacterium
EQGPGIAVFLVPAKAPGVEV

SEQ ID NO: 809431 - protein, 23 aa, Mycobacterium
EQGPLQRIGAVALATRTVPEPVR

SEQ ID NO: 809432 - protein, 24 aa, Mycobacterium
EQGRLRAGARHKVIPALAGETGMH

SEQ ID NO: 809433 - protein, 24 aa, Mycobacterium
EQGRSYRAMADPIALSAALELPAG

SEQ ID NO: 809434 - protein, 18 aa, Mycobacterium
EQGVLRFVTVHKVALQGA

SEQ ID NO: 809435 - protein, 26 aa, Mycobacterium
EQGVNDLFLPLRYGQVTLAEKMPRRF

SEQ ID NO: 809436 - protein, 18 aa, Mycobacterium
EQHFGRLVDYGFTAAMED

SEQ ID NO: 809437 - protein, 22 aa, Mycobacterium
EQHPIPEWIVVGAGTGGTSATI

SEQ ID NO: 809438 - protein, 23 aa, Mycobacterium
EQHRAIGPGLRRLVRLSVASPVK

SEQ ID NO: 809439 - protein, 21 aa, Mycobacterium
EQHRHWDRVLFDAGLSVITWP

SEQ ID NO: 809440 - protein, 24 aa, Mycobacterium
EQHRIPLGGTVLLVSGRASFELTQ

SEQ ID NO: 809441 - protein, 19 aa, Mycobacterium
EQHRLIVELTRAALEAAGV

SEQ ID NO: 809442 - protein, 18 aa, Mycobacterium
EQHRPLLKLWVEAYGRSL

SEQ ID NO: 809443 - protein, 21 aa, Mycobacterium
EQHRRWDKVLFDAGLSVITWP

SEQ ID NO: 809444 - protein, 25 aa, Mycobacterium
EQHSLWPTFAEIPVGWRKVYGEASR

SEQ ID NO: 809445 - protein, 19 aa, Mycobacterium
EQIAALRTIILTGGNQIRL

SEQ ID NO: 809446 - protein, 31 aa, Mycobacterium; identical to SEQ ID NO: 119893

SEQ ID NO: 809447 - protein, 17 aa, Mycobacterium
EQIAKMPPFALRQAKRA

SEQ ID NO: 809448 - protein, 23 aa, Mycobacterium
EQIAVRTRYFDELFIAAGADGVR

SEQ ID NO: 809449 - protein, 19 aa, Mycobacterium
EQICPQGHWVGFGGHGGYQ

SEQ ID NO: 809450 - protein, 20 aa, Mycobacterium
EQIFKNALTGLPIGGGKGGS

SEQ ID NO: 809451 - protein, 22 aa, Mycobacterium
EQIGHLLLRDLPEGKAKAALLR

SEQ ID NO: 809452 - protein, 23 aa, Mycobacterium
EQIGKVVVAYEPVWAIGTGRVAS

SEQ ID NO: 809453 - protein, 20 aa, Mycobacterium
EQILATHYGLQAKAASLGSQ

SEQ ID NO: 809454 - protein, 24 aa, Mycobacterium
EQIPALLGILSVGAVYLPIGVDQP

SEQ ID NO: 809455 - protein, 19 aa, Mycobacterium
EQIPVFRPDGSYIITGGLG

SEQ ID NO: 809456 - protein, 24 aa, Mycobacterium
EQIRAGQRLGALIRTARAGRAPDE

SEQ ID NO: 809457 - protein, 35 aa, Mycobacterium
EQIRDQIDVLLMAPMLITRAFLKPMREQGGGRIIQ

SEQ ID NO: 809458 - protein, 24 aa, Mycobacterium
EQIRMSLAIAGWPKARRKAREDEL

SEQ ID NO: 809459 - protein, 25 aa, Mycobacterium
EQIWDSVRYWYQSGLHPAIQVCLRH

SEQ ID NO: 809460 - protein, 22 aa, Mycobacterium
EQIYQMYRLLALAKYEERYVIP

SEQ ID NO: 809461 - protein, 36 aa, Mycobacterium
EQIYRGSQIVPWVNAVIPISKILPNLAPALGDDDAA

SEQ ID NO: 809462 - protein, 23 aa, Mycobacterium
EQKARLLPGLIDGSVTAGVGLDG

SEQ ID NO: 809463 - protein, 33 aa, Mycobacterium
EQKERFLPPTFRGEMIWCQLFSEPGAGSDLAAL

SEQ ID NO: 809464 - protein, 22 aa, Mycobacterium
EQKEVWLEPLLEGDIRSAFCMT

SEQ ID NO: 809465 - protein, 25 aa, Mycobacterium
EQKKKFLPGILAGEIHFAIGYTEPE

SEQ ID NO: 809466 - protein, 22 aa, Mycobacterium
EQKKRWLEPLLNQDMFSAYSMT

SEQ ID NO: 809467 - protein, 33 aa, Mycobacterium
EQKQRFLPPTFRGDMIWCQLFSEPGAGSDLAGL

SEQ ID NO: 809468 - protein, 34 aa, Mycobacterium
EQKQRFLPPTFRGDMIWCQLFSEPGAGSDLAGLT

SEQ ID NO: 809469 - protein, 34 aa, Mycobacterium
EQKQRFLPPTFRGEMIWCQLFSEPGAGSDLASLT

SEQ ID NO: 809470 - protein, 22 aa, Mycobacterium
EQKQRFLPRMATGETRGAFSMS

SEQ ID NO: 809471 - protein, 23 aa, Mycobacterium
EQKQRWLPGIADGSLTMAFAITE

SEQ ID NO: 809472 - protein, 23 aa, Mycobacterium
EQKQRWLPGIADGTLTMAFAITE

SEQ ID NO: 809473 - protein, 26 aa, Mycobacterium
EQKQRWLPRVISGDAVLAIAMTEPGA

SEQ ID NO: 809474 - protein, 25 aa, Mycobacterium
EQKRFPQLTVLSIAPLLASTIRAVF

SEQ ID NO: 809475 - protein, 28 aa, Mycobacterium
EQKRKFLRPLFTGEQIYCQLFSEPGAGS

SEQ ID NO: 809476 - protein, 25 aa, Mycobacterium
EQKRKWLPDLTAGRALAGFGLTEPG

SEQ ID NO: 809477 - protein, 24 aa, Mycobacterium
EQKRPGYLLIATDVARFPTEPPTA

SEQ ID NO: 809478 - protein, 19 aa, Mycobacterium
EQKRRWLPGIADGSITMAF

SEQ ID NO: 809479 - protein, 17 aa, Mycobacterium
EQKSIIFMDPPEHRHMR

SEQ ID NO: 809480 - protein, 21 aa, Mycobacterium
EQKSIIFMDPPEHRHMRSLLN

SEQ ID NO: 809481 - protein, 23 aa, Mycobacterium
EQKSYFLPRILTGEVFFCQGYSE

SEQ ID NO: 809482 - protein, 20 aa, Mycobacterium
EQLAFDERRLRQALSALDCG

SEQ ID NO: 809483 - protein, 20 aa, Mycobacterium
EQLAFDERRLRQALTALDCG

SEQ ID NO: 809484 - protein, 19 aa, Mycobacterium
EQLAHLGYRLSDVRHIIVT

SEQ ID NO: 809485 - protein, 26 aa, Mycobacterium
EQLAKALDRKVWLPSGGTLVIDRTEA

SEQ ID NO: 809486 - protein, 19 aa, Mycobacterium
EQLAQLDPATLLRAGQKTG

SEQ ID NO: 809487 - protein, 17 aa, Mycobacterium
EQLDIRRMPWRVHVFTP

SEQ ID NO: 809488 - protein, 25 aa, Mycobacterium
EQLDRRPLLLSGGQRQRVAIARALA

SEQ ID NO: 809489 - protein, 22 aa, Mycobacterium
EQLDWGTYVFDFGRNEVRNFLV

SEQ ID NO: 809490 - protein, 18 aa, Mycobacterium
EQLDYDFHLFTEEATRQD

SEQ ID NO: 809491 - protein, 20 aa, Mycobacterium
EQLEIELNWIDEHIGDHPYG

SEQ ID NO: 809492 - protein, 21 aa, Mycobacterium
EQLERRLDLAQRLLLGTADPG

SEQ ID NO: 809493 - protein, 27 aa, Mycobacterium
EQLFAVGYAACFHSALRVVARQQKADV

SEQ ID NO: 809494 - protein, 27 aa, Mycobacterium
EQLFRRHHRRLYRLARATSRTPEDAAD

SEQ ID NO: 809495 - protein, 17 aa, Mycobacterium
EQLGIAAFELVVVNLYP

SEQ ID NO: 809496 - protein, 25 aa, Mycobacterium
EQLGRWLPEMFGTPGDPKLGAFCSS

SEQ ID NO: 809497 - protein, 28 aa, Mycobacterium
EQLHEIVGAYFPFGWPMACHVQGDAGVD

SEQ ID NO: 809498 - protein, 30 aa, Mycobacterium
EQLHGELASLLRFVLELLGDYGLEDFYLEL

SEQ ID NO: 809499 - protein, 20 aa, Mycobacterium
EQLILIGEIARDFGLYTKIT

SEQ ID NO: 809500 - protein, 20 aa, Mycobacterium
EQLISPPPVTVVRLSEYPYL

SEQ ID NO: 809501 - protein, 28 aa, Mycobacterium
EQLLAELARVWKLLPFEADWFSSNELAR

SEQ ID NO: 809502 - protein, 18 aa, Mycobacterium
EQLLKGVWEFLVRRETPV

SEQ ID NO: 809503 - protein, 18 aa, Mycobacterium
EQLLRVLARQVRKATRKL

SEQ ID NO: 809504 - protein, 20 aa, Mycobacterium
EQLPSVDILVNNLGIFGAEP

SEQ ID NO: 809505 - protein, 17 aa, Mycobacterium
EQLQRLGGFSWSGAAEP

SEQ ID NO: 809506 - protein, 26 aa, Mycobacterium
EQLRALPDPLTYGLLRYLNADVDLDG

SEQ ID NO: 809507 - protein, 26 aa, Mycobacterium
EQLRALPDPLTYGLLRYLNDEVDLDG

SEQ ID NO: 809508 - protein, 31 aa, Mycobacterium
EQLRALPDPLTYGLLRYLNPDVDLSGPEPAI

SEQ ID NO: 809509 - protein, 20 aa, Mycobacterium
EQLRALPDPLTYGLLRYMNA

SEQ ID NO: 809510 - protein, 35 aa, Mycobacterium
EQLRERLLRAHRGLKLLLMAWARYEDEQPSDARRE

SEQ ID NO: 809511 - protein, 18 aa, Mycobacterium
EQLRFLAPVPLEPWEGVR

SEQ ID NO: 809512 - protein, 28 aa, Mycobacterium
EQLRGLPDGLLYGLIRYLNREVELAGAE

SEQ ID NO: 809513 - protein, 26 aa, Mycobacterium
EQLRHRRFFEFVGHPVNPAAAHSTLP

SEQ ID NO: 809514 - protein, 26 aa, Mycobacterium
EQLRHTIPELPWLSRKRIQQEWGISD

SEQ ID NO: 809515 - protein, 20 aa, Mycobacterium
EQLRHWAVADLEAVLGAGIV

SEQ ID NO: 809516 - protein, 19 aa, Mycobacterium
EQLRLWVDSLLSATDGKLS

SEQ ID NO: 809517 - protein, 21 aa, Mycobacterium
EQLRQFYKLGVSPIPPNTPNI

SEQ ID NO: 809518 - protein, 26 aa, Mycobacterium
EQLRQTIPELPWLSRKRIQQEWGVSD

SEQ ID NO: 809519 - protein, 17 aa, Mycobacterium
EQLRRFLDDQVWLENRR

SEQ ID NO: 809520 - protein, 25 aa, Mycobacterium
EQLSPLPRADAISAPLLLVHGLNDT

SEQ ID NO: 809521 - protein, 33 aa, Mycobacterium
EQLSYIWEWGGQLIFPLPTLHSSAVFKPPLGGI

SEQ ID NO: 809522 - protein, 23 aa, Mycobacterium
EQLTAIFKSRTRRQWTDFFIATD

SEQ ID NO: 809523 - protein, 27 aa, Mycobacterium
EQLTEIVDAYFPLGWPMACHVMGDAGV

SEQ ID NO: 809524 - protein, 26 aa, Mycobacterium
EQLTEIVEAYLPLGWQMACHVQGDAG

SEQ ID NO: 809525 - protein, 24 aa, Mycobacterium
EQLTPEQFGFFVVMLSVAGNETTR

SEQ ID NO: 809526 - protein, 22 aa, Mycobacterium
EQLTRPTLMGRPVLVGGMGGRG

SEQ ID NO: 809527 - protein, 24 aa, Mycobacterium
EQLVDSLATLWLITGNGATQTARA

SEQ ID NO: 809528 - protein, 18 aa, Mycobacterium
EQLVIPRSVALARIQLLD

SEQ ID NO: 809529 - protein, 17 aa, Mycobacterium
EQLVWLASSAAGTDWTS

SEQ ID NO: 809530 - protein, 22 aa, Mycobacterium
EQLWGTLLACAAATRNTQVLSE

SEQ ID NO: 809531 - protein, 20 aa, Mycobacterium
EQLYPIPRYRLEETLSRYPD

SEQ ID NO: 809532 - protein, 22 aa, Mycobacterium
EQMAVLTDFFNYFSALTNSRRE

SEQ ID NO: 809533 - protein, 18 aa, Mycobacterium
EQMGKMLRLYGTPRERII

SEQ ID NO: 809534 - protein, 29 aa, Mycobacterium
EQMGLTNVVLMLPFVRRVAEADLVLTEMA

SEQ ID NO: 809535 - protein, 26 aa, Mycobacterium
EQMLVNDGISLTKLWFSVSAAEQRTR

SEQ ID NO: 809536 - protein, 23 aa, Mycobacterium
EQMLVNDGISLTKLWFSVTRSEQ

SEQ ID NO: 809537 - protein, 24 aa, Mycobacterium
EQMLVSSWQMPGGIYAPMMHPWST

SEQ ID NO: 809538 - protein, 22 aa, Mycobacterium
EQMYGLPKTGFAANAPVIADIW

SEQ ID NO: 809539 - protein, 27 aa, Mycobacterium
EQNAPALLGLIGLWYSNFFGAQSRGVL

SEQ ID NO: 809540 - protein, 23 aa, Mycobacterium
EQNARLKRLLADAELEKDALREV

SEQ ID NO: 809541 - protein, 24 aa, Mycobacterium
EQNFEYGLKCILDHAARLIEEKPA

SEQ ID NO: 809542 - protein, 20 aa, Mycobacterium
EQNGLMGYVLAEIGFRVRRL

SEQ ID NO: 809543 - protein, 23 aa, Mycobacterium
EQNGRLKRLLADAELEKDALREV

SEQ ID NO: 809544 - protein, 18 aa, Mycobacterium
EQNLPLLRPGDRVHVSWS

SEQ ID NO: 809545 - protein, 25 aa, Mycobacterium
EQPAAPAAKAAPAVLVARPVKAAPD

SEQ ID NO: 809546 - protein, 21 aa, Mycobacterium
EQPALAVRRLVGVLAAAFSAD

SEQ ID NO: 809547 - protein, 31 aa, Mycobacterium
EQPDIRPAPPIPQPVLGRPPSAPAPTAGGPS

SEQ ID NO: 809548 - protein, 27 aa, Mycobacterium
EQPETLHAIMWLMSDRALPRSYRMMQG

SEQ ID NO: 809549 - protein, 21 aa, Mycobacterium
EQPKHKGITYFLLDMHQPGVE

SEQ ID NO: 809550 - protein, 20 aa, Mycobacterium
EQPLFLLYTSGTTGKPKGIL

SEQ ID NO: 809551 - protein, 20 aa, Mycobacterium
EQPLFLLYTSGTTGKPKGIV

SEQ ID NO: 809552 - protein, 19 aa, Mycobacterium
EQPLGILPQPNELPRGCIA

SEQ ID NO: 809553 - protein, 18 aa, Mycobacterium
EQPLWDFPDGTLAGREVA

SEQ ID NO: 809554 - protein, 32 aa, Mycobacterium
EQPPERPRRELPTPWWESGTPATPAAPATPST

SEQ ID NO: 809555 - protein, 31 aa, Mycobacterium
EQPRIVVARKWLGLQGLFGRGTVLAADDETV

SEQ ID NO: 809556 - protein, 29 aa, Mycobacterium
EQPRPVLVWLHFGAFQFGSASNPLYDGTV

SEQ ID NO: 809557 - protein, 18 aa, Mycobacterium
EQPVFRAALIRTADNLHR

SEQ ID NO: 809558 - protein, 25 aa, Mycobacterium
EQPVGLRRFLAPAELAPWMGVRDAV

SEQ ID NO: 809559 - protein, 22 aa, Mycobacterium
EQPVVLAYPAPIDLTLTIGTES

SEQ ID NO: 809560 - protein, 22 aa, Mycobacterium
EQQERMQAWLSKLKLAVGETAS

SEQ ID NO: 809561 - protein, 22 aa, Mycobacterium
EQQFHLRVPPSAPARVVVLASG

SEQ ID NO: 809562 - protein, 23 aa, Mycobacterium
EQQIYDMYRLLALAKYEERYVIP

SEQ ID NO: 809563 - protein, 27 aa, Mycobacterium
EQQKEFADLLAWMKDTLADHVKEVRLS

SEQ ID NO: 809564 - protein, 25 aa, Mycobacterium
EQQKEFADLLGWLKETLGEQVKEVR

SEQ ID NO: 809565 - protein, 18 aa, Mycobacterium
EQQLAEWTTMRKTTVVAV

SEQ ID NO: 809566 - protein, 34 aa, Mycobacterium
EQQLLAAINAPTQTLLGRPLIGNGADGAAGTGAD

SEQ ID NO: 809567 - protein, 25 aa, Mycobacterium
EQQQRFLPRILDVTELWSQGYSEPG

SEQ ID NO: 809568 - protein, 23 aa, Mycobacterium
EQQRLKVLVSIFGRETPVELNFT

SEQ ID NO: 809569 - protein, 24 aa, Mycobacterium
EQQRQLYDWLVAKGDRVLTGDSFF

SEQ ID NO: 809570 - protein, 30 aa, Mycobacterium
EQQYRAVASGHWPLIRYNPVLRATGKPPFL

SEQ ID NO: 809571 - protein, 23 aa, Mycobacterium
EQRAELRKLLRGDSREPVIPFAQ

SEQ ID NO: 809572 - protein, 25 aa, Mycobacterium
EQRDAFAWHIDLAKRSGKPLMIHNR

SEQ ID NO: 809573 - protein, 27 aa, Mycobacterium
EQRDIAVRVVDLRWLAPLPVDDMAREA

SEQ ID NO: 809574 - protein, 23 aa, Mycobacterium
EQRDRILIITINRPKAKNAVNSA

SEQ ID NO: 809575 - protein, 19 aa, Mycobacterium
EQREAFAWHIDLAKRTGKP

SEQ ID NO: 809576 - protein, 22 aa, Mycobacterium
EQRERWLPRLVSGDVVAGIGTN

SEQ ID NO: 809577 - protein, 28 aa, Mycobacterium
EQRITLRTTLPGHPLLVAVAENPDITRA

SEQ ID NO: 809578 - protein, 19 aa, Mycobacterium
EQRIYALSPQALSRPRDIR

SEQ ID NO: 809579 - protein, 19 aa, Mycobacterium
EQRIYALSPQALSRPRDMR

SEQ ID NO: 809580 - protein, 28 aa, Mycobacterium
EQRLDRLVPAPLRHIPILIGGAGERRTM

SEQ ID NO: 809581 - protein, 24 aa, Mycobacterium
EQRLLQPLALAPRGIWLGPKELRT

SEQ ID NO: 809582 - protein, 18 aa, Mycobacterium
EQRLLSRLLAIVADRRTP

SEQ ID NO: 809583 - protein, 22 aa, Mycobacterium
EQRLRALHYPKVVIGVSGGLDS

SEQ ID NO: 809584 - protein, 23 aa, Mycobacterium
EQRMELLIAVGWYRTICTLCNGL

SEQ ID NO: 809585 - protein, 26 aa, Mycobacterium
EQRNFPATSVRFFASPRSEGKKLTFR

SEQ ID NO: 809586 - protein, 24 aa, Mycobacterium
EQRPGLAALLDYARPGDGIVVVGI

SEQ ID NO: 809587 - protein, 21 aa, Mycobacterium
EQRQYLLGGRFIFAMTGSAPT

SEQ ID NO: 809588 - protein, 25 aa, Mycobacterium
EQRRDVDALLRKAAIKATPRQVTAD

SEQ ID NO: 809589 - protein, 24 aa, Mycobacterium
EQRRIRVYVNPDDYARALGKVGHN

SEQ ID NO: 809590 - protein, 40 aa, Mycobacterium
EQRRLMRIYALIRLAYRVLPDRLTYFPLAYHARKHHQVLE

SEQ ID NO: 809591 - protein, 24 aa, Mycobacterium
EQRRRADAILKRRTDRLPFLAPID

SEQ ID NO: 809592 - protein, 18 aa, Mycobacterium
EQRRRWLPGITSGELIIA

SEQ ID NO: 809593 - protein, 19 aa, Mycobacterium
EQRVREGLLEIGRKLGIPP

SEQ ID NO: 809594 - protein, 27 aa, Mycobacterium
EQRVYGLDAWRAWRALVTKFGTPAPGP

SEQ ID NO: 809595 - protein, 17 aa, Mycobacterium
EQRWPRYSPASVELGVL

SEQ ID NO: 809596 - protein, 25 aa, Mycobacterium
EQSGLALIKYWASQGWLHRITEQAG

SEQ ID NO: 809597 - protein, 18 aa, Mycobacterium
EQSGTRFILALFVDLRGK

SEQ ID NO: 809598 - protein, 21 aa, Mycobacterium
EQSHGLGLFVRSLVGLDREAA

SEQ ID NO: 809599 - protein, 31 aa, Mycobacterium
EQSKNPVLQLFIDVLIRLTARYALQSRTDTA

SEQ ID NO: 809600 - protein, 30 aa, Mycobacterium
EQSKNPVLQLFIDVLMRLTTRYALASRTDS

SEQ ID NO: 809601 - protein, 25 aa, Mycobacterium
EQSPALLEWLKAQGVPFRGGAGPSY

SEQ ID NO: 809602 - protein, 18 aa, Mycobacterium
EQSSRWGGLLDPARVIVE

SEQ ID NO: 809603 - protein, 25 aa, Mycobacterium
EQTAPGFDWSGWLSALGAGAGQVTE

SEQ ID NO: 809604 - protein, 24 aa, Mycobacterium
EQTGGDSCVLINELGACEDQQEVD

SEQ ID NO: 809605 - protein, 27 aa, Mycobacterium
EQTGSLLGFHWTKIHDASLGEVYVVGV

SEQ ID NO: 809606 - protein, 20 aa, Mycobacterium
EQTLAALSLVLNGGGLGQVQ

SEQ ID NO: 809607 - protein, 24 aa, Mycobacterium
EQTPALGIMLTLFSAAGESTASLL

SEQ ID NO: 809608 - protein, 27 aa, Mycobacterium
EQTPRSRLLALFKSPRPGTAPLRGCPF

SEQ ID NO: 809609 - protein, 17 aa, Mycobacterium
EQTPWGHFSVAGVGAPP

SEQ ID NO: 809610 - protein, 22 aa, Mycobacterium
EQTQWPGWVPVGRMGVPEDQAR

SEQ ID NO: 809611 - protein, 24 aa, Mycobacterium
EQTRALYLADSVPWVVGYSGGKDS

SEQ ID NO: 809612 - protein, 35 aa, Mycobacterium
EQTRPTLMLLDGNSLAFRAFYALPAENFKTRGGLT

SEQ ID NO: 809613 - protein, 23 aa, Mycobacterium
EQTRRHAAVLALLGVPRLVLAVN

SEQ ID NO: 809614 - protein, 18 aa, Mycobacterium
EQTRTRDWLVTRVAVRTH

SEQ ID NO: 809615 - protein, 24 aa, Mycobacterium
EQTRTRDWVVTRFAVRQQRRLGRR

SEQ ID NO: 809616 - protein, 23 aa, Mycobacterium
EQTWTSLLDGRSGIRKLDDPFVE

SEQ ID NO: 809617 - protein, 24 aa, Mycobacterium
EQVAILVALGHQLAAVPYLESVML

SEQ ID NO: 809618 - protein, 31 aa, Mycobacterium
EQVAILVALGHQLAAVPYLESVVLAAGALAR

SEQ ID NO: 809619 - protein, 34 aa, Mycobacterium; identical to SEQ ID NO: 126045

SEQ ID NO: 809620 - protein, 18 aa, Mycobacterium
EQVFPTALRQRCLIQRLR

SEQ ID NO: 809621 - protein, 21 aa, Mycobacterium
EQVFYGHVLGFKGLERRVVVL

SEQ ID NO: 809622 - protein, 23 aa, Mycobacterium
EQVGKVVIAYEPVWAIGTGRVAS

SEQ ID NO: 809623 - protein, 19 aa, Mycobacterium
EQVHRLVVPSLPVGSVLTV

SEQ ID NO: 809624 - protein, 24 aa, Mycobacterium
EQVKGMLMLIYRVDDDTAFELLRW

SEQ ID NO: 809625 - protein, 23 aa, Mycobacterium
EQVLDLLRIDLMRSLGVGINDIQ

SEQ ID NO: 809626 - protein, 20 aa, Mycobacterium
EQVLFRHPAVFDAAVIGGKD

SEQ ID NO: 809627 - protein, 25 aa, Mycobacterium
EQVLRAFGDERYWRARLADSGADEA

SEQ ID NO: 809628 - protein, 19 aa, Mycobacterium
EQVLRINLTGTFLVTREAI

SEQ ID NO: 809629 - protein, 17 aa, Mycobacterium
EQVLRVLQLPDDRLEEL

SEQ ID NO: 809630 - protein, 24 aa, Mycobacterium
EQVPALLGILSIGAVYLPIGVDQP

SEQ ID NO: 809631 - protein, 30 aa, Mycobacterium
EQVPIREPILPFWLTKASRPRFQRLWGTPY

SEQ ID NO: 809632 - protein, 22 aa, Mycobacterium
EQVQEILRRWADNLWDTGIEFG

SEQ ID NO: 809633 - protein, 21 aa, Mycobacterium
EQVRAVFETNYFGALRVAKAF

SEQ ID NO: 809634 - protein, 20 aa, Mycobacterium
EQVRCLVAAELGLVGGSLLV

SEQ ID NO: 809635 - protein, 20 aa, Mycobacterium
EQVRPWIWKTMESFPGNYMT

SEQ ID NO: 809636 - protein, 28 aa, Mycobacterium
EQVRRGDGVLYWQVPRTATLDSAIGKTM

SEQ ID NO: 809637 - protein, 18 aa, Mycobacterium
EQVRRKGLWATHLGPELG

SEQ ID NO: 809638 - protein, 31 aa, Mycobacterium
EQVRRYLTRAELLWRWPPFSATADCASVKPA

SEQ ID NO: 809639 - protein, 26 aa, Mycobacterium
EQVRRYVRVFVLPTLLADPPQPEAVF

SEQ ID NO: 809640 - protein, 24 aa, Mycobacterium
EQVWPEMLEALSEAGWHNYSLFVR

SEQ ID NO: 809641 - protein, 27 aa, Mycobacterium
EQVWRVGRLAVWAVTRLFDIEPEDLLY

SEQ ID NO: 809642 - protein, 17 aa, Mycobacterium
EQWAALESLLSSGALPP

SEQ ID NO: 809643 - protein, 17 aa, Mycobacterium
EQWGFSRTQLDEFSLRS

SEQ ID NO: 809644 - protein, 23 aa, Mycobacterium
EQWGYKRYWLAEHHFVAVASSSP

SEQ ID NO: 809645 - protein, 18 aa, Mycobacterium
EQWLTARRDLIDRRQRAR

SEQ ID NO: 809646 - protein, 30 aa, Mycobacterium
EQWNPFHNMVVIYALFPNIVLSVTIANGEL

SEQ ID NO: 809647 - protein, 22 aa, Mycobacterium
EQWSGFGDFGFSATVSSVSKPR

SEQ ID NO: 809648 - protein, 17 aa, Mycobacterium
EQWVRSRHLNAGKGKRA

SEQ ID NO: 809649 - protein, 22 aa, Mycobacterium
EQWVRSRRINAGKGKRALASEL

SEQ ID NO: 809650 - protein, 23 aa, Mycobacterium
EQYDLAVYCRGETTRWGGDTVTP

SEQ ID NO: 809651 - protein, 17 aa, Mycobacterium
EQYDWLATRLEIARKLR

SEQ ID NO: 809652 - protein, 28 aa, Mycobacterium
EQYEWHRGYLRRHAVSRRNFLRGSAAAA

SEQ ID NO: 809653 - protein, 25 aa, Mycobacterium
EQYFLLDTDLLEQAFRPILDEFDFA

SEQ ID NO: 809654 - protein, 18 aa, Mycobacterium
EQYLGLVRSPAGPPHAVV

SEQ ID NO: 809655 - protein, 18 aa, Mycobacterium
ERAAAERLAQIRESMRRD

SEQ ID NO: 809656 - protein, 23 aa, Mycobacterium
ERAAARWVLAEVPLAAFLTEEIV

SEQ ID NO: 809657 - protein, 25 aa, Mycobacterium
ERAALLDLKGASFPWRTIRGEECSA

SEQ ID NO: 809658 - protein, 22 aa, Mycobacterium
ERAAMPLIIVISAINQRLIEEG

SEQ ID NO: 809659 - protein, 23 aa, Mycobacterium
ERAAPCWVILYRTGQTLAPQPSR

SEQ ID NO: 809660 - protein, 17 aa, Mycobacterium
ERAAQALALHRMAERGR

SEQ ID NO: 809661 - protein, 30 aa, Mycobacterium
ERAAQLRREFSEWLGTHFTLDPVRASDIVL

SEQ ID NO: 809662 - protein, 26 aa, Mycobacterium
ERAARRLVHIPLGRFAEPEELAAAVA

SEQ ID NO: 809663 - protein, 18 aa, Mycobacterium
ERAAVLAAAAKLLEERKG

SEQ ID NO: 809664 - protein, 17 aa, Mycobacterium
ERAAYILREAFDYPYEQ

SEQ ID NO: 809665 - protein, 21 aa, Mycobacterium
ERADVMLGGLRFTVVHETGAA

SEQ ID NO: 809666 - protein, 22 aa, Mycobacterium
ERADVVLAGLRFTVVHETGAAG

SEQ ID NO: 809667 - protein, 24 aa, Mycobacterium
ERAEGAGRHRGQVDGAPEDGESLY

SEQ ID NO: 809668 - protein, 24 aa, Mycobacterium
ERAENMARLLLVARDRFHVYRHQQ

SEQ ID NO: 809669 - protein, 22 aa, Mycobacterium
ERAFVPVIARRLGLPDDDLTAR

SEQ ID NO: 809670 - protein, 26 aa, Mycobacterium
ERAGRYIDRFILPEKPFVLDLSEVDS

SEQ ID NO: 809671 - protein, 22 aa, Mycobacterium
ERAHHYLWRIRNALPPAGHIGV

SEQ ID NO: 809672 - protein, 25 aa, Mycobacterium
ERAHRAGLAAFRKAGGRVVSVVPDD

SEQ ID NO: 809673 - protein, 18 aa, Mycobacterium
ERAKILGKTLDAAIGKLL

SEQ ID NO: 809674 - protein, 18 aa, Mycobacterium
ERAKLLGKTLDAAIGKLL

SEQ ID NO: 809675 - protein, 24 aa, Mycobacterium
ERALAEQWLLVDRSVFEVQAVRPG

SEQ ID NO: 809676 - protein, 20 aa, Mycobacterium
ERALLLCYRQRRWYLEGSYE

SEQ ID NO: 809677 - protein, 22 aa, Mycobacterium
ERALVAPLHLDPASLRVPDGAA

SEQ ID NO: 809678 - protein, 17 aa, Mycobacterium
ERALVERFLGPSYAPRT

SEQ ID NO: 809679 - protein, 17 aa, Mycobacterium
ERAMLRLSESDDGEPQL

SEQ ID NO: 809680 - protein, 24 aa, Mycobacterium
ERAQQLERLITEPLLRLQAGDDRI

SEQ ID NO: 809681 - protein, 24 aa, Mycobacterium
ERARAGLFLAMQYPIEVTGVSMSN

SEQ ID NO: 809682 - protein, 22 aa, Mycobacterium
ERARALAYFAALTIAADDPRRR

SEQ ID NO: 809683 - protein, 33 aa, Mycobacterium
ERARPMLELVPDDAIWRPQARWVYELIRALVDS

SEQ ID NO: 809684 - protein, 25 aa, Mycobacterium
ERARQLERLITEPLLRLQAGDDRIG

SEQ ID NO: 809685 - protein, 22 aa, Mycobacterium
ERARRRWARASAHLRAVAVAAF

SEQ ID NO: 809686 - protein, 20 aa, Mycobacterium
ERARTLWVALGFAAADSDDE

SEQ ID NO: 809687 - protein, 23 aa, Mycobacterium
ERASFDPLTLAEADQRILGSNYG

SEQ ID NO: 809688 - protein, 23 aa, Mycobacterium
ERASLPEIARAGTPLVLIDRGAD

SEQ ID NO: 809689 - protein, 27 aa, Mycobacterium
ERASQQAFLFGPPPLGPDAPPLDRLVA

SEQ ID NO: 809690 - protein, 28 aa, Mycobacterium
ERAVFVERLRYLGDLPLSLDLTYLAPDI

SEQ ID NO: 809691 - protein, 28 aa, Mycobacterium
ERAVQAWRGFSRWLMRAYDVLVDEDQIA

SEQ ID NO: 809692 - protein, 19 aa, Mycobacterium
ERAVSQVWTGLWRVAPQLV

SEQ ID NO: 809693 - protein, 28 aa, Mycobacterium
ERAWGMWLTRQLIARLLGTFGPSLAGTR

SEQ ID NO: 809694 - protein, 18 aa, Mycobacterium
ERAYGAAAAHWHTYRNRL

SEQ ID NO: 809695 - protein, 18 aa, Mycobacterium
ERAYVIFGNHEFGLPPGD

SEQ ID NO: 809696 - protein, 31 aa, Mycobacterium
ERCGIAIIHQELALVPYLSIAENVFLGNEQA

SEQ ID NO: 809697 - protein, 24 aa, Mycobacterium
ERCGYRRFWIAEHHFVAVASAAPA

SEQ ID NO: 809698 - protein, 25 aa, Mycobacterium
ERDCAYYTTLIMWVGCHADSHEYAR

SEQ ID NO: 809699 - protein, 26 aa, Mycobacterium
ERDCTYYTALIMWIGCHADSHEYARW

SEQ ID NO: 809700 - protein, 24 aa, Mycobacterium
ERDDLAKALLAYFTGHLGISTTMR

SEQ ID NO: 809701 - protein, 18 aa, Mycobacterium
ERDFPATEVRFFASARSA

SEQ ID NO: 809702 - protein, 28 aa, Mycobacterium
ERDFPATSVRFFASARSQGRKLEFRGQE

SEQ ID NO: 809703 - protein, 25 aa, Mycobacterium
ERDFPATSVRFFASARSQGRKLPFR

SEQ ID NO: 809704 - protein, 19 aa, Mycobacterium
ERDGKAYRYWPTLTREQHS

SEQ ID NO: 809705 - protein, 17 aa, Mycobacterium
ERDGMLLAETRFLTLQP

SEQ ID NO: 809706 - protein, 22 aa, Mycobacterium
ERDIECPFAIQELTLPLALAGD

SEQ ID NO: 809707 - protein, 18 aa, Mycobacterium
ERDKLWRKVWQQVGRVEE

SEQ ID NO: 809708 - protein, 20 aa, Mycobacterium
ERDLFAAAYDRIPESRYLFN

SEQ ID NO: 809709 - protein, 27 aa, Mycobacterium
ERDLGDPARWFPPPGYPDSLALCIVDA

SEQ ID NO: 809710 - protein, 30 aa, Mycobacterium
ERDLRVICHGWLAFTFELCRQRIIDPTINA

SEQ ID NO: 809711 - protein, 23 aa, Mycobacterium
ERDPDVVLAWTPEGSPREDEPHD

SEQ ID NO: 809712 - protein, 22 aa, Mycobacterium
ERDPELHRQWLSDTSITPPEGE

SEQ ID NO: 809713 - protein, 34 aa, Mycobacterium
ERDPMECADLLDWPAKLRLLEGFRNRENLGWNAP

SEQ ID NO: 809714 - protein, 32 aa, Mycobacterium
ERDPMECADLLDWPAKLRLLEGFRQRENLSWS

SEQ ID NO: 809715 - protein, 33 aa, Mycobacterium
ERDPMECAEILDWPAKLRLLEGFRQRENLTWQA

SEQ ID NO: 809716 - protein, 37 aa, Mycobacterium
ERDPMECAELLDWPAKLRLLDGFRHRENLSWSAPRLH

SEQ ID NO: 809717 - protein, 18 aa, Mycobacterium
ERDRGLHVWLLMPGRDAA

SEQ ID NO: 809718 - protein, 17 aa, Mycobacterium
ERDRGVFVLAATSNPEA

SEQ ID NO: 809719 - protein, 24 aa, Mycobacterium
ERDRIEWLSAQRIPGPSVLEWATT

SEQ ID NO: 809720 - protein, 23 aa, Mycobacterium
ERDRPLLDLAWDYATEDAEGDEP

SEQ ID NO: 809721 - protein, 22 aa, Mycobacterium
ERDRPLLQLAWDYATEGDEPSG

SEQ ID NO: 809722 - protein, 30 aa, Mycobacterium
ERDSQLVDLLMLPFFTHTVTVPALRHRIED

SEQ ID NO: 809723 - protein, 24 aa, Mycobacterium
ERDTTYTPTLWIDDAAHPDTRGNL

SEQ ID NO: 809724 - protein, 25 aa, Mycobacterium
ERDVLAEYGDFLRSLVQLSGARPLR

SEQ ID NO: 809725 - protein, 18 aa, Mycobacterium
ERDVLRMRFFESMTQSQI

SEQ ID NO: 809726 - protein, 30 aa, Mycobacterium
ERDVLSAVNAPSLALTGRPLIGNGADGGPG

SEQ ID NO: 809727 - protein, 26 aa, Mycobacterium
EREALAQVTRFPLLAALTGRRSRRFP

SEQ ID NO: 809728 - protein, 23 aa, Mycobacterium
EREATIMELLWSAAEPVTVRDVL

SEQ ID NO: 809729 - protein, 24 aa, Mycobacterium
EREDLRILLAARRILDQQRTANRN

SEQ ID NO: 809730 - protein, 25 aa, Mycobacterium
EREETPWPVIAEAAKVGLYSPDFFA

SEQ ID NO: 809731 - protein, 26 aa, Mycobacterium
EREFEQVFATLFPGGEGRLLLTDPSD

SEQ ID NO: 809732 - protein, 24 aa, Mycobacterium
EREFPASSVRFFASARSEGKKLAF

SEQ ID NO: 809733 - protein, 20 aa, Mycobacterium
EREFPSFQAMLDLTVAAAPH

SEQ ID NO: 809734 - protein, 20 aa, Mycobacterium
EREFTAYGIPFLPVGDRVTG

SEQ ID NO: 809735 - protein, 23 aa, Mycobacterium
EREFTEVFTVLFPGGEGRLRLTD

SEQ ID NO: 809736 - protein, 26 aa, Mycobacterium
EREFTQVFSTLFPGGEGRLLLTNPSD

SEQ ID NO: 809737 - protein, 17 aa, Mycobacterium
EREGMQIPLLIGGATTS

SEQ ID NO: 809738 - protein, 27 aa, Mycobacterium
EREGRAAFLPPYLISGQGLAVDTTRLP

SEQ ID NO: 809739 - protein, 27 aa, Mycobacterium
EREGVNLTFLPFIARAVIDALKIHPNV

SEQ ID NO: 809740 - protein, 21 aa, Mycobacterium
EREHVGLGVPFPPLAERFERL

SEQ ID NO: 809741 - protein, 23 aa, Mycobacterium
EREKAFVELRRLLAVHETAEEEV

SEQ ID NO: 809742 - protein, 33 aa, Mycobacterium
EREKALQRREAALARREWLASERDRMAAERDRV

SEQ ID NO: 809743 - protein, 28 aa, Mycobacterium
ERELEIIAQLNFPGYFLVVHDITQFCRR

SEQ ID NO: 809744 - protein, 22 aa, Mycobacterium
ERELGLPLFMRRRDGLALTEAG

SEQ ID NO: 809745 - protein, 24 aa, Mycobacterium
ERELLWRNPALLGEDLQPVGGHIP

SEQ ID NO: 809746 - protein, 38 aa, Mycobacterium
ERELSLTTLAPHLVKPMPFLFPLTNRVWERPYVAAGIF

SEQ ID NO: 809747 - protein, 24 aa, Mycobacterium
EREPWEIAIIRRTAAGQRQLHLCV

SEQ ID NO: 809748 - protein, 26 aa, Mycobacterium
EREQTQWYFQRYITHLPAGGEIVLFD

SEQ ID NO: 809749 - protein, 22 aa, Mycobacterium
ERERGITIKAQNVRLPWVVNGE

SEQ ID NO: 809750 - protein, 25 aa, Mycobacterium
ERERTQWYFQRYVPHLPAAGEMVFF

SEQ ID NO: 809751 - protein, 25 aa, Mycobacterium
ERESEFPQRREVGRGRAGRLVAPDA

SEQ ID NO: 809752 - protein, 26 aa, Mycobacterium
ERESVFHFWRYVGLLMGIHPELVPTS

SEQ ID NO: 809753 - protein, 27 aa, Mycobacterium
EREVAELLLLGLPYRDIGRQLFISAKT

SEQ ID NO: 809754 - protein, 21 aa, Mycobacterium
EREVRFYGDIAPRLGGPIAPC

SEQ ID NO: 809755 - protein, 26 aa, Mycobacterium
EREWSYGWSLMRIGALLRRTDMSLLD

SEQ ID NO: 809756 - protein, 22 aa, Mycobacterium
EREYELDVLIFATGFDAMTGTL

SEQ ID NO: 809757 - protein, 26 aa, Mycobacterium
EREYRTRLKTYLESQLEELGQRGSAA

SEQ ID NO: 809758 - protein, 25 aa, Mycobacterium
EREYRTRLKTYLESQLEELGTRGSA

SEQ ID NO: 809759 - protein, 19 aa, Mycobacterium
ERFAGILAAVPFVDPLTTI

SEQ ID NO: 809760 - protein, 23 aa, Mycobacterium
ERFAGRWVPGLLALYTELNCERG

SEQ ID NO: 809761 - protein, 17 aa, Mycobacterium
ERFALIHDFYSACVGRR

SEQ ID NO: 809762 - protein, 18 aa, Mycobacterium
ERFDGRVLLVGHRDPDER

SEQ ID NO: 809763 - protein, 19 aa, Mycobacterium
ERFDLIRYAVDTLTRDPAA

SEQ ID NO: 809764 - protein, 24 aa, Mycobacterium
ERFDLSPHYFSPDSDARLVADLGE

SEQ ID NO: 809765 - protein, 19 aa, Mycobacterium
ERFDLVHYAVDTLTKDPNA

SEQ ID NO: 809766 - protein, 24 aa, Mycobacterium
ERFGRLLDEPLIPSTLRAELAAGT

SEQ ID NO: 809767 - protein, 26 aa, Mycobacterium
ERFGYDAWVLAYDIGTVREVVDAYPF

SEQ ID NO: 809768 - protein, 23 aa, Mycobacterium
ERFGYEAWVLVYDLDTIARIIAA

SEQ ID NO: 809769 - protein, 25 aa, Mycobacterium
ERFLRDLEKSWLLVLRGIAQPDRVD

SEQ ID NO: 809770 - protein, 26 aa, Mycobacterium
ERFNAALAPLGWAPTYMQPSYGLAEN

SEQ ID NO: 809771 - protein, 19 aa, Mycobacterium
ERFSPFSGYGYFANGLAGF

SEQ ID NO: 809772 - protein, 23 aa, Mycobacterium
ERFTLLRPLLFTIVYEILGSATE

SEQ ID NO: 809773 - protein, 24 aa, Mycobacterium
ERGAFLVRSWRPYVSGDVLAYAVD

SEQ ID NO: 809774 - protein, 22 aa, Mycobacterium
ERGATILTVCSGAFIAGAAGLL

SEQ ID NO: 809775 - protein, 24 aa, Mycobacterium
ERGDIVLIRTGWWTRFAQTGDKTE

SEQ ID NO: 809776 - protein, 17 aa, Mycobacterium
ERGFLAVRLEDIGAAAG

SEQ ID NO: 809777 - protein, 32 aa, Mycobacterium
ERGFSLGHYPQSFLFATIGGFAATRSSGQDSA

SEQ ID NO: 809778 - protein, 21 aa, Mycobacterium
ERGIAGLMLESFLVAGAQSLS

SEQ ID NO: 809779 - protein, 17 aa, Mycobacterium
ERGIIPPGTQLTPRPEQ

SEQ ID NO: 809780 - protein, 25 aa, Mycobacterium
ERGIRTDFALVHAWKGDRHGNLLYR

SEQ ID NO: 809781 - protein, 18 aa, Mycobacterium
ERGLFAVDLAADGVLPLP

SEQ ID NO: 809782 - protein, 23 aa, Mycobacterium
ERGLLDELCLTIAPFVVGGLARR

SEQ ID NO: 809783 - protein, 25 aa, Mycobacterium
ERGLPLTMEVAKFIRFIVTDIFPGG

SEQ ID NO: 809784 - protein, 35 aa, Mycobacterium
ERGLRWIDHSMFFPQRFRSPLSIAFPFVSTHNHFA

SEQ ID NO: 809785 - protein, 21 aa, Mycobacterium
ERGLTLLRRAGAEPDYPLVEL

SEQ ID NO: 809786 - protein, 18 aa, Mycobacterium
ERGLVDELGGFRTALRRA

SEQ ID NO: 809787 - protein, 24 aa, Mycobacterium
ERGMPMTFEMARFIKFIVTEIFPG

SEQ ID NO: 809788 - protein, 33 aa, Mycobacterium
ERGNFPVFRKRLRQWMMRITAYSDRLLEDLDVL

SEQ ID NO: 809789 - protein, 29 aa, Mycobacterium
ERGPAIRFLLIEMPRERWRLVLTAHHIVI

SEQ ID NO: 809790 - protein, 28 aa, Mycobacterium
ERGPEMLSFVLKHTPLKMCWVPRYSDYY

SEQ ID NO: 809791 - protein, 23 aa, Mycobacterium
ERGPGWRLAVHPFVGGGAGVSLV

SEQ ID NO: 809792 - protein, 22 aa, Mycobacterium
ERGPLLDRFLEEVVAGRNMVAV

SEQ ID NO: 809793 - protein, 23 aa, Mycobacterium
ERGQWYYQRYIAHLPAKGEIVLF

SEQ ID NO: 809794 - protein, 18 aa, Mycobacterium
ERGRALPDAGRPDDPVRL

SEQ ID NO: 809795 - protein, 27 aa, Mycobacterium
ERGRDALRALPLVGRLAYRVMHSVKAG

SEQ ID NO: 809796 - protein, 26 aa, Mycobacterium
ERGRSARAWLFTVARNMIIDDRRSAR

SEQ ID NO: 809797 - protein, 31 aa, Mycobacterium
ERGTGELLLKKIWLAALRRGLTAASLGTDIN

SEQ ID NO: 809798 - protein, 20 aa, Mycobacterium
ERGTLDLSHLDYLVLDEADE

SEQ ID NO: 809799 - protein, 17 aa, Mycobacterium
ERGVYPPCSAFETWFVS

SEQ ID NO: 809800 - protein, 22 aa, Mycobacterium
ERGWAPIVRARVAPRVRAGMQM

SEQ ID NO: 809801 - protein, 22 aa, Mycobacterium
ERGWGAWGFAPYTDLMAATDAA

SEQ ID NO: 809802 - protein, 17 aa, Mycobacterium
ERGWGPIVKARVAPRLR

SEQ ID NO: 809803 - protein, 28 aa, Mycobacterium
ERGYDETLWRLLCEQVGAAALVIPEELG

SEQ ID NO: 809804 - protein, 23 aa, Mycobacterium
ERGYGYGPAFRGLNAMWRRGDEV

SEQ ID NO: 809805 - protein, 24 aa, Mycobacterium
ERHAIIARLAAAGVTWLTIAPSGS

SEQ ID NO: 809806 - protein, 21 aa, Mycobacterium
ERHILIGVGVQRLLAHLLEHI

SEQ ID NO: 809807 - protein, 20 aa, Mycobacterium
ERHKDGLLFIAVCGHAGDGD

SEQ ID NO: 809808 - protein, 23 aa, Mycobacterium
ERHLAIHLVQPDRRHRPHLDSLI

SEQ ID NO: 809809 - protein, 23 aa, Mycobacterium
ERHLKKLWGLPGTQLGVVAWPPA

SEQ ID NO: 809810 - protein, 17 aa, Mycobacterium
ERHLLNCAVIGELVGAG

SEQ ID NO: 809811 - protein, 21 aa, Mycobacterium
ERHLPAFLRFAGREYIGVQGT

SEQ ID NO: 809812 - protein, 29 aa, Mycobacterium
ERHLRAVRPWAPHDYVPWSRGRDFAFLGG

SEQ ID NO: 809813 - protein, 20 aa, Mycobacterium
ERHPRLRVAFLEAGAGWVPF

SEQ ID NO: 809814 - protein, 31 aa, Mycobacterium
ERHQFYVLDEFTYPLKWGWLDVDDVVEVLLA

SEQ ID NO: 809815 - protein, 18 aa, Mycobacterium
ERHRAGLLAYVEYVRSNP

SEQ ID NO: 809816 - protein, 25 aa, Mycobacterium
ERHRLLLDLVCRNAAAVLGDSSSRR

SEQ ID NO: 809817 - protein, 19 aa, Mycobacterium
ERHRPHVRLGFMEEAAMSR

SEQ ID NO: 809818 - protein, 24 aa, Mycobacterium
ERHRQILLVTFKRSGEAVPSPINH

SEQ ID NO: 809819 - protein, 18 aa, Mycobacterium
ERHVFGRRTLPNMDLASV

SEQ ID NO: 809820 - protein, 24 aa, Mycobacterium
ERHWPALCRAVGRPEWRDDPRFAD

SEQ ID NO: 809821 - protein, 30 aa, Mycobacterium
ERIAALPVNQLIMIKLALNSALLQQGVVNS

SEQ ID NO: 809822 - protein, 24 aa, Mycobacterium
ERIAHEIRRFARVKAPLILDLSHL

SEQ ID NO: 809823 - protein, 17 aa, Mycobacterium
ERIARLPVDLFRYEVLM

SEQ ID NO: 809824 - protein, 20 aa, Mycobacterium
ERIDTDVLAALRSAERDPAR

SEQ ID NO: 809825 - protein, 18 aa, Mycobacterium
ERIDTDVLSALRSAERNP

SEQ ID NO: 809826 - protein, 28 aa, Mycobacterium
ERIDTSLPNWWPSILAPAVAGAGALRGS

SEQ ID NO: 809827 - protein, 27 aa, Mycobacterium
ERIDTSLPNWWPSILAPIVAGVGAWRG

SEQ ID NO: 809828 - protein, 17 aa, Mycobacterium
ERIDVRRKLVAVKDVRK

SEQ ID NO: 809829 - protein, 25 aa, Mycobacterium
ERIELLLDRDAPFLELSSLAAWGTD

SEQ ID NO: 809830 - protein, 26 aa, Mycobacterium
ERIETVLPFSWQGVSLYAAGASRVRV

SEQ ID NO: 809831 - protein, 23 aa, Mycobacterium
ERIEYLIADAKPRIVMRPQEFRV

SEQ ID NO: 809832 - protein, 19 aa, Mycobacterium
ERIFAAPYITLCIPDNAVR

SEQ ID NO: 809833 - protein, 26 aa, Mycobacterium
ERIGADPRLLVLDKPVPTAILDAPTD

SEQ ID NO: 809834 - protein, 17 aa, Mycobacterium
ERIHRALALPAGIDGVL

SEQ ID NO: 809835 - protein, 21 aa, Mycobacterium
ERIHRVAQWLSSGAPRTLDPV

SEQ ID NO: 809836 - protein, 36 aa, Mycobacterium
ERIKAPLLDAMLAPFPPVRPLLRLLAELGTSEAIRV

SEQ ID NO: 809837 - protein, 18 aa, Mycobacterium
ERILLRHNAINRVAVYAV

SEQ ID NO: 809838 - protein, 26 aa, Mycobacterium
ERILNWRQLYDLDTLPEHLVVVGSGV

SEQ ID NO: 809839 - protein, 25 aa, Mycobacterium
ERIPLHPMRVYAELAPLLDRNAIVV

SEQ ID NO: 809840 - protein, 19 aa, Mycobacterium
ERIPWFHRNADYDEIALIH

SEQ ID NO: 809841 - protein, 18 aa, Mycobacterium
ERIQAGALDFIPAKRVGT

SEQ ID NO: 809842 - protein, 23 aa, Mycobacterium
ERIQAGALDFIPAKRVGTAEEVA

SEQ ID NO: 809843 - protein, 25 aa, Mycobacterium
ERIQRRGMADNYWSMGIPGPCGPCS

SEQ ID NO: 809844 - protein, 17 aa, Mycobacterium
ERIQTWAAPYYERSGDA

SEQ ID NO: 809845 - protein, 25 aa, Mycobacterium
ERIRPHVVRTPLLAARWGDAERPLW

SEQ ID NO: 809846 - protein, 24 aa, Mycobacterium
ERIRVREWLPDDPYPRARITLWPD

SEQ ID NO: 809847 - protein, 21 aa, Mycobacterium
ERIWPGIYCLGEPTEPLLLRG

SEQ ID NO: 809848 - protein, 23 aa, Mycobacterium
ERIWQAARYWYQAGMHPAIQLCI

SEQ ID NO: 809849 - protein, 23 aa, Mycobacterium
ERIWQAARYWYQAGMHPAIQVCL

SEQ ID NO: 809850 - protein, 25 aa, Mycobacterium
ERIYRDVRLLRLYEGTSEIQKLIIG

SEQ ID NO: 809851 - protein, 25 aa, Mycobacterium
ERKALLDRLQARALPQGWDAGLPSW

SEQ ID NO: 809852 - protein, 25 aa, Mycobacterium
ERKELLDRLLAGKLPEGWDADLPHW

SEQ ID NO: 809853 - protein, 23 aa, Mycobacterium
ERKGSLRGLRLSYFGDGANNMAH

SEQ ID NO: 809854 - protein, 18 aa, Mycobacterium
ERKGYLRRDPNRPRAVDV

SEQ ID NO: 809855 - protein, 17 aa, Mycobacterium
ERKKLFEMMGTLTPEVI

SEQ ID NO: 809856 - protein, 22 aa, Mycobacterium
ERKKLVWWDAELGEWTGHDVPD

SEQ ID NO: 809857 - protein, 21 aa, Mycobacterium
ERKKVQTRLAIRRAAFELFDT

SEQ ID NO: 809858 - protein, 23 aa, Mycobacterium
ERKPPWIKVRARMGPEYTQLKGL

SEQ ID NO: 809859 - protein, 18 aa, Mycobacterium
ERKPPWIRIRARMGPEYT

SEQ ID NO: 809860 - protein, 22 aa, Mycobacterium
ERKVYQLLLDQLGDGDLVIPGK

SEQ ID NO: 809861 - protein, 18 aa, Mycobacterium
ERLAALKERGMLTDAEFE

SEQ ID NO: 809862 - protein, 26 aa, Mycobacterium
ERLAPVKPTSALWRLGAAALAAAATQ

SEQ ID NO: 809863 - protein, 25 aa, Mycobacterium
ERLARRFWRARKHGASIQLLGVLLF

SEQ ID NO: 809864 - protein, 19 aa, Mycobacterium
ERLDGLPLAIELAAARLRA

SEQ ID NO: 809865 - protein, 27 aa, Mycobacterium
ERLDLDALTAWIAGCHHAGRPVAVHCV

SEQ ID NO: 809866 - protein, 21 aa, Mycobacterium
ERLEQLLASMPLRVWRTDEIT

SEQ ID NO: 809867 - protein, 29 aa, Mycobacterium
ERLETICRQIMLYHLDRGWADHLAYLADI

SEQ ID NO: 809868 - protein, 21 aa, Mycobacterium
ERLGALAGGLGGPPPGQPPVA

SEQ ID NO: 809869 - protein, 21 aa, Mycobacterium
ERLGFTRYWVAEHHNMASVGA

SEQ ID NO: 809870 - protein, 22 aa, Mycobacterium
ERLGHRVDILPPVAGLPDMVYA

SEQ ID NO: 809871 - protein, 31 aa, Mycobacterium
ERLGIPTIATVPWTTDRLLNALLRETETAKW

SEQ ID NO: 809872 - protein, 28 aa, Mycobacterium
ERLGIPWIELNPHPLYRPSKGLPPIGSG

SEQ ID NO: 809873 - protein, 30 aa, Mycobacterium
ERLGLDYVDLYLIHWPAPAVGKYVDAFGGL

SEQ ID NO: 809874 - protein, 30 aa, Mycobacterium
ERLGLDYVDLYLIHWPVPARGEYVNSFGGL

SEQ ID NO: 809875 - protein, 17 aa, Mycobacterium
ERLGLHQVWIKDSTDQM

SEQ ID NO: 809876 - protein, 24 aa, Mycobacterium
ERLGLLTRAWAEPVYRAVYDPDGR

SEQ ID NO: 809877 - protein, 24 aa, Mycobacterium
ERLGPIVMVGYHRNGWEQTPTVAE

SEQ ID NO: 809878 - protein, 20 aa, Mycobacterium
ERLGRLTRPEQWSGFGDFGA

SEQ ID NO: 809879 - protein, 24 aa, Mycobacterium
ERLINRYPVFRSLAVKDRDGSWWW

SEQ ID NO: 809880 - protein, 24 aa, Mycobacterium
ERLITFWRVLRERPAELARLCSLT

SEQ ID NO: 809881 - protein, 17 aa, Mycobacterium
ERLKIVMRVYFEKPRTT

SEQ ID NO: 809882 - protein, 18 aa, Mycobacterium
ERLKQLNGLLILSHLEVV

SEQ ID NO: 809883 - protein, 19 aa, Mycobacterium
ERLKQLNGLLILSHLEVVN

SEQ ID NO: 809884 - protein, 17 aa, Mycobacterium
ERLLAPPDDPEPPNQTR

SEQ ID NO: 809885 - protein, 20 aa, Mycobacterium
ERLLAVLREGALDAALIALP

SEQ ID NO: 809886 - protein, 31 aa, Mycobacterium
ERLLGIPDAFAWCWAKGGYWRSHIRSVITVQ

SEQ ID NO: 809887 - protein, 17 aa, Mycobacterium
ERLLGSLSAWRAAAEDF

SEQ ID NO: 809888 - protein, 22 aa, Mycobacterium
ERLLLLLHYGIDWDTSWVAEPR

SEQ ID NO: 809889 - protein, 22 aa, Mycobacterium
ERLLLSYAAELARRRQARGLKL

SEQ ID NO: 809890 - protein, 18 aa, Mycobacterium
ERLLRIRVPDLVDYQSLG

SEQ ID NO: 809891 - protein, 21 aa, Mycobacterium
ERLLTTSRQYGVEPQQLFAYL

SEQ ID NO: 809892 - protein, 27 aa, Mycobacterium
ERLNRLLEFVVRQESRLNWAVGDLPDG

SEQ ID NO: 809893 - protein, 19 aa, Mycobacterium
ERLPAPVAYRRFVTWLSGQ

SEQ ID NO: 809894 - protein, 19 aa, Mycobacterium
ERLPHYMVPAAIAVVEVVP

SEQ ID NO: 809895 - protein, 25 aa, Mycobacterium
ERLPNLRLWNFYGQTEMAPLASALG

SEQ ID NO: 809896 - protein, 19 aa, Mycobacterium
ERLQVRLIGADRSRYLVTV

SEQ ID NO: 809897 - protein, 23 aa, Mycobacterium
ERLRDMLWSAIFPSINLASDPAR

SEQ ID NO: 809898 - protein, 25 aa, Mycobacterium
ERLREQGVRLLYDAPRRGTSNSRIN

SEQ ID NO: 809899 - protein, 20 aa, Mycobacterium
ERLRGWRFYDGFRVDGGAPA

SEQ ID NO: 809900 - protein, 22 aa, Mycobacterium
ERLRIAIMRGVLAPGAQLGEAS

SEQ ID NO: 809901 - protein, 23 aa, Mycobacterium
ERLRMADLRVTRPRVAVLEAVDA

SEQ ID NO: 809902 - protein, 20 aa, Mycobacterium
ERLRRWSVLLRGRGACATLD

SEQ ID NO: 809903 - protein, 20 aa, Mycobacterium
ERLRRWSVVLRGRGACATLD

SEQ ID NO: 809904 - protein, 21 aa, Mycobacterium
ERLRVNLRAYLRSAADDVETA

SEQ ID NO: 809905 - protein, 20 aa, Mycobacterium
ERLRWARRYTTVPTVLSVNT

SEQ ID NO: 809906 - protein, 22 aa, Mycobacterium
ERLVDEFLAGRAPLFGARVAQG

SEQ ID NO: 809907 - protein, 23 aa, Mycobacterium
ERLVELLVVMRDAQRDGTWGRLK

SEQ ID NO: 809908 - protein, 23 aa, Mycobacterium
ERLVMDRLLRLQAADDRLGDVRG

SEQ ID NO: 809909 - protein, 26 aa, Mycobacterium
ERLVRDAFALYVPRIGREPAPMSADY

SEQ ID NO: 809910 - protein, 26 aa, Mycobacterium
ERLYPRTAAELFSWGRSWLETCQNAF

SEQ ID NO: 809911 - protein, 25 aa, Mycobacterium
ERLYYRKMHPWVPAEPWAPGDLGVP

SEQ ID NO: 809912 - protein, 24 aa, Mycobacterium
ERMARLIFAPRILAQVVKCVAQFG

SEQ ID NO: 809913 - protein, 27 aa, Mycobacterium
ERMDNVSAWRFITPPSAFISTVMVDQQ

SEQ ID NO: 809914 - protein, 24 aa, Mycobacterium
ERMKGILRALLKRQLPNFDLDKHF

SEQ ID NO: 809915 - protein, 26 aa, Mycobacterium
ERMLEALDGWPVNVALLGKGNTVSAE

SEQ ID NO: 809916 - protein, 20 aa, Mycobacterium
ERMMRLVTEQAPDAILTLHR

SEQ ID NO: 809917 - protein, 20 aa, Mycobacterium
ERMQGLVRKAGVDDATAADM

SEQ ID NO: 809918 - protein, 24 aa, Mycobacterium
ERMRHGMYWSGDLAYRDADGWIYL

SEQ ID NO: 809919 - protein, 25 aa, Mycobacterium
ERMRHGMYWSGDLAYRDAEGWIYLA

SEQ ID NO: 809920 - protein, 23 aa, Mycobacterium
ERMRHGMYWSGDLGYRDTQGWIY

SEQ ID NO: 809921 - protein, 17 aa, Mycobacterium
ERMRLGALARHIAEELP

SEQ ID NO: 809922 - protein, 24 aa, Mycobacterium
ERNDGTFPAFPLPLGDQSGPYAGD

SEQ ID NO: 809923 - protein, 18 aa, Mycobacterium
ERNEWLRETLREFLVRNR

SEQ ID NO: 809924 - protein, 25 aa, Mycobacterium
ERNGERYQFLRWGQGAFDDFKVVPP

SEQ ID NO: 809925 - protein, 24 aa, Mycobacterium
ERNHAMMIIRYLIDKNVAITIPGV

SEQ ID NO: 809926 - protein, 24 aa, Mycobacterium
ERNLTWDIAAWLLSQFMHGEQGAL

SEQ ID NO: 809927 - protein, 18 aa, Mycobacterium
ERNMPPFKKLVFEALEAV

SEQ ID NO: 809928 - protein, 22 aa, Mycobacterium
ERNPRLVWCAISGYGPDGPYEK

SEQ ID NO: 809929 - protein, 22 aa, Mycobacterium
ERNQPWPYAKRQPPADPSGGVL

SEQ ID NO: 809930 - protein, 23 aa, Mycobacterium
ERNQREFWGRLLELLTDSGDDAS

SEQ ID NO: 809931 - protein, 30 aa, Mycobacterium
ERNTPVRSFLLRLGGIRALGFSPELVTAVS

SEQ ID NO: 809932 - protein, 19 aa, Mycobacterium
ERNVFTRPGPQLPLAVVHG

SEQ ID NO: 809933 - protein, 17 aa, Mycobacterium
ERNVLLTVLSRLGTGSR

SEQ ID NO: 809934 - protein, 27 aa, Mycobacterium
ERPALDPILLKVLDAVPFRLSTDDGID

SEQ ID NO: 809935 - protein, 34 aa, Mycobacterium
ERPAVIPLSFAQNRLWFIQQLQGPSPVYNMAAAL

SEQ ID NO: 809936 - protein, 18 aa, Mycobacterium
ERPFFADPLRRHDIAPIT

SEQ ID NO: 809937 - protein, 19 aa, Mycobacterium
ERPFFAEPLRRHDIAPITD

SEQ ID NO: 809938 - protein, 21 aa, Mycobacterium
ERPGVFIEFVADRAGVDAADV

SEQ ID NO: 809939 - protein, 20 aa, Mycobacterium
ERPHMYRLMFGSTSAHGIKA

SEQ ID NO: 809940 - protein, 17 aa, Mycobacterium
ERPLFFALQCMPLNRVR

SEQ ID NO: 809941 - protein, 31 aa, Mycobacterium
ERPLHPVSRLTTALALAQWIEEHRPDCEIGP

SEQ ID NO: 809942 - protein, 18 aa, Mycobacterium
ERPLTRYFPELVAAVRAE

SEQ ID NO: 809943 - protein, 22 aa, Mycobacterium
ERPLWECWIIEGLSESRWALLT

SEQ ID NO: 809944 - protein, 20 aa, Mycobacterium
ERPMTRYFPELVAAVRAELP

SEQ ID NO: 809945 - protein, 17 aa, Mycobacterium
ERPNHLSVPLTRRSRRV

SEQ ID NO: 809946 - protein, 23 aa, Mycobacterium
ERPNLARMMFLDPHTRELYADWP

SEQ ID NO: 809947 - protein, 18 aa, Mycobacterium
ERPPRKPLIAAVEGYALA

SEQ ID NO: 809948 - protein, 17 aa, Mycobacterium
ERPPSWIFNVRANPEVT

SEQ ID NO: 809949 - protein, 36 aa, Mycobacterium
ERPRELARVVLIELLAWQFASPVRWIETQDLLFIEE

SEQ ID NO: 809950 - protein, 18 aa, Mycobacterium
ERPRLSLGPLPVADHFLD

SEQ ID NO: 809951 - protein, 22 aa, Mycobacterium
ERPRRALEVYPHAASVALFRLG

SEQ ID NO: 809952 - protein, 24 aa, Mycobacterium
ERPSARLWETLASRWARSTDPSSD

SEQ ID NO: 809953 - protein, 17 aa, Mycobacterium
ERPSFFDMCSDNRMVGG

SEQ ID NO: 809954 - protein, 17 aa, Mycobacterium
ERPSRPIELWRSAGWLT

SEQ ID NO: 809955 - protein, 24 aa, Mycobacterium
ERPTPGPLKWNLTLGVATDTRESL

SEQ ID NO: 809956 - protein, 23 aa, Mycobacterium
ERPVIHLSQLLRAPVLARAGETV

SEQ ID NO: 809957 - protein, 17 aa, Mycobacterium
ERPYTTPFVADPALRSQ

SEQ ID NO: 809958 - protein, 25 aa, Mycobacterium
ERQALRDFLALVRKRRKRHPHMHVY

SEQ ID NO: 809959 - protein, 29 aa, Mycobacterium
ERQEAVLEDPFILLVSSKVSTVKDLLPLL

SEQ ID NO: 809960 - protein, 26 aa, Mycobacterium
ERQELAPMTPFERKIVHDAVAAVPGV

SEQ ID NO: 809961 - protein, 17 aa, Mycobacterium
ERQMSLLAAPAAASTPG

SEQ ID NO: 809962 - protein, 26 aa, Mycobacterium
ERQPISTISLLGPGFRRLDLLVVAVH

SEQ ID NO: 809963 - protein, 30 aa, Mycobacterium
ERQPQMMKLFVKLFGPYPLSTGYTVVVTDD

SEQ ID NO: 809964 - protein, 23 aa, Mycobacterium
ERQRQHSVLPLLQLPSTRQVEPG

SEQ ID NO: 809965 - protein, 20 aa, Mycobacterium
ERQRVLIARALAQQPHVLVL

SEQ ID NO: 809966 - protein, 19 aa, Mycobacterium
ERQSHYFHVRPADQFDAMI

SEQ ID NO: 809967 - protein, 27 aa, Mycobacterium
ERQSMLFSATMPGPIITLARTFMNQPT

SEQ ID NO: 809968 - protein, 26 aa, Mycobacterium
ERQSPQLLNCFLQLTGYVVELTGDPL

SEQ ID NO: 809969 - protein, 25 aa, Mycobacterium
ERQVDRWLGFLAAYQVRELPGLQEA

SEQ ID NO: 809970 - protein, 23 aa, Mycobacterium
ERQVLDLIFTVGCYQMLGAAVNA

SEQ ID NO: 809971 - protein, 17 aa, Mycobacterium
ERQVLVLERVVVTVLQL

SEQ ID NO: 809972 - protein, 26 aa, Mycobacterium
ERQVMIIHTLLWPDEIREPDFPVLDQ

SEQ ID NO: 809973 - protein, 21 aa, Mycobacterium
ERQWRIARLSGIRGVAPQFVD

SEQ ID NO: 809974 - protein, 24 aa, Mycobacterium
ERRADGFFYIRGRSSEMIISGGVN

SEQ ID NO: 809975 - protein, 19 aa, Mycobacterium
ERRAGWVGLPLAGVQTRLV

SEQ ID NO: 809976 - protein, 23 aa, Mycobacterium
ERRAIAQLPAVLRVAVRPPADTV

SEQ ID NO: 809977 - protein, 21 aa, Mycobacterium
ERRALLVDAAFRLFGDGGESA

SEQ ID NO: 809978 - protein, 22 aa, Mycobacterium
ERRARHVIVYRTIQMLGGTVAL

SEQ ID NO: 809979 - protein, 31 aa, Mycobacterium
ERRARLMIEMHVLGPLHLCQLAIPAMRERGR

SEQ ID NO: 809980 - protein, 35 aa, Mycobacterium
ERRARRINCPGWVEAFRWLKPILSTRLGELPVLRF

SEQ ID NO: 809981 - protein, 24 aa, Mycobacterium
ERRARWAVRVIISLLTFPGRDEAD

SEQ ID NO: 809982 - protein, 24 aa, Mycobacterium
ERRARWVVRVITSLLQFPGRDDAD

SEQ ID NO: 809983 - protein, 20 aa, Mycobacterium
ERRCRLIAMSVLASGAIPPR

SEQ ID NO: 809984 - protein, 24 aa, Mycobacterium
ERRDIAPRRILPDSAIIDAALSDP

SEQ ID NO: 809985 - protein, 17 aa, Mycobacterium
ERRDVWPGILGFEDTVI

SEQ ID NO: 809986 - protein, 23 aa, Mycobacterium
ERRDYILELLLEQTTAGLSYEQC

SEQ ID NO: 809987 - protein, 27 aa, Mycobacterium
ERREAFERRWQLGGVLFSKTFSDQMIN

SEQ ID NO: 809988 - protein, 22 aa, Mycobacterium
ERRFLENIPMRRVGQPREIAHV

SEQ ID NO: 809989 - protein, 19 aa, Mycobacterium
ERRFLTRYVEIRARLTAQF

SEQ ID NO: 809990 - protein, 22 aa, Mycobacterium
ERRGDYPLLMPQSTEQSVTGGR

SEQ ID NO: 809991 - protein, 20 aa, Mycobacterium
ERRGPICYLVHAGVGMDFGR

SEQ ID NO: 809992 - protein, 24 aa, Mycobacterium
ERRGTWVYYWVIPSALQQLSEVLR

SEQ ID NO: 809993 - protein, 19 aa, Mycobacterium
ERRGWSERAFLLRQEGLRQ

SEQ ID NO: 809994 - protein, 36 aa, Mycobacterium
ERRGYLATRWKNVLLDWVVVELMTRFPKAARRLIRH

SEQ ID NO: 809995 - protein, 32 aa, Mycobacterium
ERRHRRQPPLQRLLRALLGLDAKLSQYTRGKA

SEQ ID NO: 809996 - protein, 23 aa, Mycobacterium
ERRKFGFYVGFPDDDGPAADWVR

SEQ ID NO: 809997 - protein, 26 aa, Mycobacterium
ERRKRRLRILGYDDLLLRLSKALAAA

SEQ ID NO: 809998 - protein, 23 aa, Mycobacterium
ERRLDMAVMAWLAQPPSQLRERI

SEQ ID NO: 809999 - protein, 20 aa, Mycobacterium
ERRLDRERPLWECWIIEGLS

SEQ ID NO: 810000 - protein, 22 aa, Mycobacterium
ERRLGLILEVAAGAGLIAPGIP

SEQ ID NO: 810001 - protein, 17 aa, Mycobacterium
ERRLPDTAILPVHDVAR

SEQ ID NO: 810002 - protein, 22 aa, Mycobacterium
ERRLVLIELRLDGGMDPNEVRA

SEQ ID NO: 810003 - protein, 23 aa, Mycobacterium
ERRLYLVETAEKGILWMRLTAQG

SEQ ID NO: 810004 - protein, 33 aa, Mycobacterium
ERRNEMARIVLIELLAWQFASPVRWIETQDLLF

SEQ ID NO: 810005 - protein, 17 aa, Mycobacterium
ERRPAPEPNWYGASSGN

SEQ ID NO: 810006 - protein, 17 aa, Mycobacterium
ERRPVYVDLLPPCNAGC

SEQ ID NO: 810007 - protein, 24 aa, Mycobacterium
ERRQAAWDMFAALSGQHMNKTYQA

SEQ ID NO: 810008 - protein, 29 aa, Mycobacterium
ERRRFSMNYVFALYALPGPMTISQMGRQF

SEQ ID NO: 810009 - protein, 18 aa, Mycobacterium
ERRRLFGMIGSVTPDKIA

SEQ ID NO: 810010 - protein, 21 aa, Mycobacterium
ERRRLQLTRVLMAEPNVLLLD

SEQ ID NO: 810011 - protein, 17 aa, Mycobacterium
ERRRLVVASVRHAVSHG

SEQ ID NO: 810012 - protein, 26 aa, Mycobacterium
ERRTSWEVFARRLPAGRRYGVVAGTG

SEQ ID NO: 810013 - protein, 35 aa, Mycobacterium
ERRVAPRWWPPVMKKYVWPWLAARRQIVVNCYPAH

SEQ ID NO: 810014 - protein, 18 aa, Mycobacterium
ERRVARVIGVDRMLLRRW

SEQ ID NO: 810015 - protein, 24 aa, Mycobacterium
ERRVDAVALYTPILGLNAMIARHL

SEQ ID NO: 810016 - protein, 24 aa, Mycobacterium
ERRVRARFVLAGVTPTVLAGLLGD

SEQ ID NO: 810017 - protein, 19 aa, Mycobacterium
ERRVREGLLEIGRKLGIPP

SEQ ID NO: 810018 - protein, 18 aa, Mycobacterium
ERRVREGLLHIGRTLNIP

SEQ ID NO: 810019 - protein, 23 aa, Mycobacterium
ERRWQPFTDWPDPWVLVGALAQV

SEQ ID NO: 810020 - protein, 19 aa, Mycobacterium
ERRYAALLGAQRCPVHLVS

SEQ ID NO: 810021 - protein, 23 aa, Mycobacterium
ERSALDHLEALFAGLAAAATPDS

SEQ ID NO: 810022 - protein, 24 aa, Mycobacterium
ERSAPITGIVWRGSGRPGAEESGE

SEQ ID NO: 810023 - protein, 24 aa, Mycobacterium
ERSGPERFLSTFVLLASAAENMAA

SEQ ID NO: 810024 - protein, 22 aa, Mycobacterium
ERSLDFYGMYVLPELEGLDGFC

SEQ ID NO: 810025 - protein, 24 aa, Mycobacterium
ERSLFRRLAVFLGGFDLDAAQTVA

SEQ ID NO: 810026 - protein, 39 aa, Mycobacterium
ERSLVHLGLKHYFLVDFPQEPGALRRFLDGVLGPTDDIT

SEQ ID NO: 810027 - protein, 24 aa, Mycobacterium
ERSPDDIFLIYTGGTTGFPKGVMW

SEQ ID NO: 810028 - protein, 24 aa, Mycobacterium
ERSPLPFGRHRWVAAPGPAAPLDF

SEQ ID NO: 810029 - protein, 23 aa, Mycobacterium
ERSPTFYRFDSMEQLRVWREMDD

SEQ ID NO: 810030 - protein, 24 aa, Mycobacterium
ERSQDIWTVIITGAGRALCVGADV

SEQ ID NO: 810031 - protein, 17 aa, Mycobacterium
ERSQERLSWARRTYRRW

SEQ ID NO: 810032 - protein, 30 aa, Mycobacterium
ERSRAGAILGPFEAWLGARSLATAGLRFER

SEQ ID NO: 810033 - protein, 21 aa, Mycobacterium
ERSRILKLFEAPAFSSRALSE

SEQ ID NO: 810034 - protein, 24 aa, Mycobacterium
ERSRLMLDIANWRGRRRDELAALG

SEQ ID NO: 810035 - protein, 33 aa, Mycobacterium
ERSRLMLDIAQWRRRRRDELAALGDKVARRVLE

SEQ ID NO: 810036 - protein, 26 aa, Mycobacterium
ERSRRDLPWRRPDVGAWQILVSEFML

SEQ ID NO: 810037 - protein, 24 aa, Mycobacterium
ERSSHTWFVLHELLGHKNVKNYDG

SEQ ID NO: 810038 - protein, 26 aa, Mycobacterium
ERSSHTWFVLRELLGHRNVKNYDGSW

SEQ ID NO: 810039 - protein, 25 aa, Mycobacterium
ERSSHTWFVLTHLLGLPGVRNYDGS

SEQ ID NO: 810040 - protein, 25 aa, Mycobacterium
ERSSHTWFVLTHLLGMPGVRNYDGS

SEQ ID NO: 810041 - protein, 24 aa, Mycobacterium
ERSSLPALRDWLRRQREERVGAPE

SEQ ID NO: 810042 - protein, 30 aa, Mycobacterium
ERSYPVKDLLPLTPLQQGLLFHSDAFTSGQ

SEQ ID NO: 810043 - protein, 18 aa, Mycobacterium
ERSYYPWGVARHFDAVLG

SEQ ID NO: 810044 - protein, 23 aa, Mycobacterium
ERTAGFLAIGLAVAERAPVCVAM

SEQ ID NO: 810045 - protein, 24 aa, Mycobacterium
ERTAGYLAIGLAVAAGAPVCVAMT

SEQ ID NO: 810046 - protein, 25 aa, Mycobacterium
ERTAQIVWGARALGGPVPIPEDVNN

SEQ ID NO: 810047 - protein, 23 aa, Mycobacterium
ERTDIPWIAVGDPLPHVAGFRRS

SEQ ID NO: 810048 - protein, 32 aa, Mycobacterium
ERTDVDVWVLARRGLPLRLATLGEFMSRSAQY

SEQ ID NO: 810049 - protein, 19 aa, Mycobacterium
ERTFFRHFPTKEAVLFQDY

SEQ ID NO: 810050 - protein, 29 aa, Mycobacterium
ERTGLPFSRIRILMRLSRTPMTVKQIAAA

SEQ ID NO: 810051 - protein, 23 aa, Mycobacterium
ERTHRGSALWVRRGEVLAVHASG

SEQ ID NO: 810052 - protein, 32 aa, Mycobacterium
ERTIDINYLGPIRLLLGLLPAMRESGRGHIVN

SEQ ID NO: 810053 - protein, 18 aa, Mycobacterium
ERTIGACRGFVYAASTMG

SEQ ID NO: 810054 - protein, 22 aa, Mycobacterium
ERTLGMVETLLRRLNPTATIVR

SEQ ID NO: 810055 - protein, 18 aa, Mycobacterium
ERTLRLLIPADGVPRVDA

SEQ ID NO: 810056 - protein, 36 aa, Mycobacterium
ERTLRRLFADTLGLPWRTYLLHARMLRAMAPLAAPA

SEQ ID NO: 810057 - protein, 35 aa, Mycobacterium
ERTLVPDPWAVRILPRRWRVPAVLSRFKVVRNAMI

SEQ ID NO: 810058 - protein, 30 aa, Mycobacterium; identical to SEQ ID NO: 126089

SEQ ID NO: 810059 - protein, 28 aa, Mycobacterium
ERTMQLNYFSPLRLIRGFAPGMVERRSG

SEQ ID NO: 810060 - protein, 29 aa, Mycobacterium
ERTPLTAELLLRGWLEAGGPDVLALAQGA

SEQ ID NO: 810061 - protein, 18 aa, Mycobacterium
ERTPWYHRNVDFDEIAFF

SEQ ID NO: 810062 - protein, 18 aa, Mycobacterium
ERTPWYHRNVDYDEIAFF

SEQ ID NO: 810063 - protein, 24 aa, Mycobacterium
ERTQLWPRLTAHNPRWARYQSWTD

SEQ ID NO: 810064 - protein, 18 aa, Mycobacterium
ERTRPRSVIVNRAGNRFV

SEQ ID NO: 810065 - protein, 26 aa, Mycobacterium
ERTRRAMALLAIRNFESYLDTGELVT

SEQ ID NO: 810066 - protein, 35 aa, Mycobacterium
ERTRRFDLGRGPLIRFLLIEMPAQRWRLVVTAHHI

SEQ ID NO: 810067 - protein, 24 aa, Mycobacterium
ERTRRNFLYPRWSDFFDGIDPRRI

SEQ ID NO: 810068 - protein, 29 aa, Mycobacterium
ERTRVRTRLIELFELFDPADPEVIAGRRS

SEQ ID NO: 810069 - protein, 28 aa, Mycobacterium
ERTRVRTRLIELFELFDPADPEVVAGRR

SEQ ID NO: 810070 - protein, 24 aa, Mycobacterium
ERTRVVLLGIPTRGVILATRLAAK

SEQ ID NO: 810071 - protein, 23 aa, Mycobacterium
ERTSDVRFMVYIGRAPGGDSERA

SEQ ID NO: 810072 - protein, 25 aa, Mycobacterium
ERTVAAYLLALRRMVERFAGQGFSG

SEQ ID NO: 810073 - protein, 26 aa, Mycobacterium
ERTYAPYHQHFLIARLDLDIDGPDNT

SEQ ID NO: 810074 - protein, 24 aa, Mycobacterium
ERVAEAWHWPDAFAVIAEGLRDAW

SEQ ID NO: 810075 - protein, 18 aa, Mycobacterium
ERVAKTLPAVWDLAAPST

SEQ ID NO: 810076 - protein, 20 aa, Mycobacterium
ERVALLIPRSAGAVAAMLAV

SEQ ID NO: 810077 - protein, 23 aa, Mycobacterium
ERVAPSILLGRRDGLKRVDEFEQ

SEQ ID NO: 810078 - protein, 24 aa, Mycobacterium
ERVCDLHRRACRWYAGQRLVREAV

SEQ ID NO: 810079 - protein, 21 aa, Mycobacterium
ERVCKLAYDVMLTGKQPVAMR

SEQ ID NO: 810080 - protein, 26 aa, Mycobacterium
ERVDEFKSLFLASRAAYRQMEEDNAR

SEQ ID NO: 810081 - protein, 22 aa, Mycobacterium
ERVEAALCFPLPKFSDIRYDYS

SEQ ID NO: 810082 - protein, 24 aa, Mycobacterium
ERVEGPLLSLLLAMTGRAAGCVDL

SEQ ID NO: 810083 - protein, 27 aa, Mycobacterium
ERVEYDRLLIATGTRARPWFNPQEAAL

SEQ ID NO: 810084 - protein, 18 aa, Mycobacterium
ERVFGRIDPIAAGGEDYR

SEQ ID NO: 810085 - protein, 25 aa, Mycobacterium
ERVGELIERLLPGMPTRDFAEPAWR

SEQ ID NO: 810086 - protein, 22 aa, Mycobacterium
ERVHGRLRLGPGWVSHILQDLA

SEQ ID NO: 810087 - protein, 22 aa, Mycobacterium
ERVHGRLRLGPGWVSHLLQDLA

SEQ ID NO: 810088 - protein, 22 aa, Mycobacterium
ERVHTLTEALALARETSAAYRA

SEQ ID NO: 810089 - protein, 23 aa, Mycobacterium
ERVKRYIAKLTINPAISVGADDH

SEQ ID NO: 810090 - protein, 22 aa, Mycobacterium
ERVLASFAAVLRGGGIPNVEVI

SEQ ID NO: 810091 - protein, 18 aa, Mycobacterium
ERVLATAKRMGYPGPDPV

SEQ ID NO: 810092 - protein, 19 aa, Mycobacterium
ERVLRFGATEVLDPAVDDV

SEQ ID NO: 810093 - protein, 25 aa, Mycobacterium
ERVLRGFALSLLVPPQHYDAVAGWV

SEQ ID NO: 810094 - protein, 19 aa, Mycobacterium
ERVLRRLPDLRLASSDALP

SEQ ID NO: 810095 - protein, 32 aa, Mycobacterium
ERVLVLCPSGLDFLAGFFGCVYAGAAAVPVHP

SEQ ID NO: 810096 - protein, 24 aa, Mycobacterium
ERVMVVCRYGRYLAMAARDGEEMV

SEQ ID NO: 810097 - protein, 24 aa, Mycobacterium
ERVNPLAYFDIDGKAYIVGSSAGR

SEQ ID NO: 810098 - protein, 29 aa, Mycobacterium
ERVRAAEPLGFDLKLWKALLETGAVEMAV

SEQ ID NO: 810099 - protein, 18 aa, Mycobacterium
ERVRAMLAETVDLDLWQA

SEQ ID NO: 810100 - protein, 24 aa, Mycobacterium
ERVRELLRFVTWSGSNPGIVYVTR

SEQ ID NO: 810101 - protein, 26 aa, Mycobacterium
ERVRRWARARLDRPPGDAFLAEILAA

SEQ ID NO: 810102 - protein, 27 aa, Mycobacterium
ERVRSSLGLLAMRRLRKLLAGRMSVRA

SEQ ID NO: 810103 - protein, 32 aa, Mycobacterium
ERVSILHDLYQRWPFFRSVLSNLAQVLAKSDL

SEQ ID NO: 810104 - protein, 31 aa, Mycobacterium
ERVTRLVLMAPGGGWLPFGPTPTEGQKEMFR

SEQ ID NO: 810105 - protein, 19 aa, Mycobacterium
ERVWAWHQTITDPEHREAA

SEQ ID NO: 810106 - protein, 19 aa, Mycobacterium
ERWAKVRGDKLAYRFLDFS

SEQ ID NO: 810107 - protein, 23 aa, Mycobacterium
ERWDVIQFVRYPSLEAFIALMSS

SEQ ID NO: 810108 - protein, 34 aa, Mycobacterium
ERWGELSFRRLGPGRWILGGFFASRYALGYRVVD

SEQ ID NO: 810109 - protein, 17 aa, Mycobacterium
ERWGQEVVAVVALAQGA

SEQ ID NO: 810110 - protein, 18 aa, Mycobacterium
ERWIPVERVGLYVPGGNA

SEQ ID NO: 810111 - protein, 19 aa, Mycobacterium
ERWLSAGYCVLVIDPEGDH

SEQ ID NO: 810112 - protein, 32 aa, Mycobacterium
ERWPSYWAALFATHGYLPYDLLRGKLWHDTRC

SEQ ID NO: 810113 - protein, 27 aa, Mycobacterium
ERWREAAFQYAWLLAAADRDQYGSGQV

SEQ ID NO: 810114 - protein, 20 aa, Mycobacterium
ERWRSTAVRPVFAGPLRSMI

SEQ ID NO: 810115 - protein, 18 aa, Mycobacterium
ERWTLLILRELVGGPRRY

SEQ ID NO: 810116 - protein, 17 aa, Mycobacterium
ERWVPVERVGLYVPGGN

SEQ ID NO: 810117 - protein, 17 aa, Mycobacterium
ERWWGSWSATEDGYLGV

SEQ ID NO: 810118 - protein, 18 aa, Mycobacterium
ERYFYIGGQRIRVNLRQG

SEQ ID NO: 810119 - protein, 24 aa, Mycobacterium
ERYGMQRFCLGIHACEIPVLDLET

SEQ ID NO: 810120 - protein, 23 aa, Mycobacterium
ERYGVPAHQLLHRAGQRKLIGGQ

SEQ ID NO: 810121 - protein, 22 aa, Mycobacterium
ERYHQRCWLRQLTPYASREQEN

SEQ ID NO: 810122 - protein, 18 aa, Mycobacterium
ERYLAALMPMVWVACERE

SEQ ID NO: 810123 - protein, 18 aa, Mycobacterium
ERYLTAGLQPVDCRFCHV

SEQ ID NO: 810124 - protein, 17 aa, Mycobacterium
ERYMRYLTGCSKLFQEG

SEQ ID NO: 810125 - protein, 19 aa, Mycobacterium
ERYQELMKTAWGPVRVAIA

SEQ ID NO: 810126 - protein, 19 aa, Mycobacterium
ERYRLPFNALTQTSLADID

SEQ ID NO: 810127 - protein, 17 aa, Mycobacterium
ERYRWRHGAAVSVGLVF

SEQ ID NO: 810128 - protein, 18 aa, Mycobacterium
ERYTLDRILAEEALLLDA

SEQ ID NO: 810129 - protein, 22 aa, Mycobacterium
ERYVDLLPRRGAQVRVVTAVEM

SEQ ID NO: 810130 - protein, 26 aa, Mycobacterium
ERYWESAAGLLAPVLDLLFEAREPTV

SEQ ID NO: 810131 - protein, 23 aa, Mycobacterium
ERYWPPLMRMYPPYRKYREAADR

SEQ ID NO: 810132 - protein, 25 aa, Mycobacterium
ESAADRFGPLLAGAPVHLVTEKAAK

SEQ ID NO: 810133 - protein, 25 aa, Mycobacterium
ESAALLEFGGQPILLDVCRIAEDAG

SEQ ID NO: 810134 - protein, 21 aa, Mycobacterium
ESAALYEPMLQRETNRLRGDA

SEQ ID NO: 810135 - protein, 27 aa, Mycobacterium
ESAARALLLPRRHPGRRSPLWHQRQRA

SEQ ID NO: 810136 - protein, 27 aa, Mycobacterium
ESAEALALLFAEAGLPAGAYLNIRAAN

SEQ ID NO: 810137 - protein, 18 aa, Mycobacterium
ESAGFAAFWIPQVPGYLD

SEQ ID NO: 810138 - protein, 18 aa, Mycobacterium
ESAGLARWLLHTATEYAK

SEQ ID NO: 810139 - protein, 22 aa, Mycobacterium
ESAHQLMIAIVDGFHAHLAGTG

SEQ ID NO: 810140 - protein, 24 aa, Mycobacterium
ESAHQVAWLFGDRGIPRTWRHMNG

SEQ ID NO: 810141 - protein, 18 aa, Mycobacterium
ESAIDSWRRVVSTAVQLG

SEQ ID NO: 810142 - protein, 18 aa, Mycobacterium
ESAIELLRRNGVAGTGLA

SEQ ID NO: 810143 - protein, 27 aa, Mycobacterium
ESAIRIGLALNCEITPWGRFARKNYFY

SEQ ID NO: 810144 - protein, 17 aa, Mycobacterium
ESAIYFYGPGSINCLAT

SEQ ID NO: 810145 - protein, 21 aa, Mycobacterium
ESAKDTLLNLGWRGLRGRPRD

SEQ ID NO: 810146 - protein, 24 aa, Mycobacterium
ESAKEILLALLAQVEEADRDDLAC

SEQ ID NO: 810147 - protein, 37 aa, Mycobacterium
ESALKGAHFIELCDKRKIPLLFLQNIAGFMVGRDYEA

SEQ ID NO: 810148 - protein, 30 aa, Mycobacterium
ESALMLASRLQPLWLVRGRISEGRSWFDAA

SEQ ID NO: 810149 - protein, 21 aa, Mycobacterium
ESALRFIGAATFEALSGQPVH

SEQ ID NO: 810150 - protein, 23 aa, Mycobacterium
ESALRLIPGIRHAVAAVVGADAP

SEQ ID NO: 810151 - protein, 23 aa, Mycobacterium
ESAMDLYPMARRVLLTAYADTNA

SEQ ID NO: 810152 - protein, 29 aa, Mycobacterium
ESAMEDLALLVKLDWLFTGSGDRWTENSD

SEQ ID NO: 810153 - protein, 23 aa, Mycobacterium
ESAPAIRALLSQVLGRDGQSALI

SEQ ID NO: 810154 - protein, 29 aa, Mycobacterium
ESAPGDTRFIVLLPLQPPAADVAPELDGP

SEQ ID NO: 810155 - protein, 21 aa, Mycobacterium
ESAPVEAFGPLGAIFAADQPS

SEQ ID NO: 810156 - protein, 26 aa, Mycobacterium
ESAQALLENLFFKEKRYDLARVGRYK

SEQ ID NO: 810157 - protein, 25 aa, Mycobacterium
ESAQFLAELFGLPEPKPFGHFMVVQ

SEQ ID NO: 810158 - protein, 21 aa, Mycobacterium
ESAQRLLPRPLGRTSVEVAVA

SEQ ID NO: 810159 - protein, 25 aa, Mycobacterium
ESAQRLRYALADLPLAAPVTVVGGG

SEQ ID NO: 810160 - protein, 23 aa, Mycobacterium
ESARFCTQFIKLGIGGCDIGVSY

SEQ ID NO: 810161 - protein, 26 aa, Mycobacterium
ESARRLGVPESKWVYLHGHSDLVEQP

SEQ ID NO: 810162 - protein, 19 aa, Mycobacterium
ESASFATPFVTDPALRSQV

SEQ ID NO: 810163 - protein, 35 aa, Mycobacterium
ESATLPRPAVRLLEQWLAHSALLRSFVPPDERTTL

SEQ ID NO: 810164 - protein, 19 aa, Mycobacterium
ESAVEGFVLVGFAVGDNAG

SEQ ID NO: 810165 - protein, 26 aa, Mycobacterium
ESAVQRLLLDPLQLGHTHYFSDQIVG

SEQ ID NO: 810166 - protein, 18 aa, Mycobacterium
ESAWPLLQHAGQCGVQTR

SEQ ID NO: 810167 - protein, 23 aa, Mycobacterium
ESCEDPRFSIARLSLLDRGMVFA

SEQ ID NO: 810168 - protein, 24 aa, Mycobacterium
ESDAAPTVYAARAAYEAAGIGPED

SEQ ID NO: 810169 - protein, 23 aa, Mycobacterium
ESDAGLISLLDDPAKTAKKIRSA

SEQ ID NO: 810170 - protein, 25 aa, Mycobacterium
ESDDEKLWSALRRIPVRELRRTGLL

SEQ ID NO: 810171 - protein, 25 aa, Mycobacterium
ESDDLQWWPPDALPPGTDHALRYLV

SEQ ID NO: 810172 - protein, 21 aa, Mycobacterium
ESDGWLWITGQMPNYPDDHAK

SEQ ID NO: 810173 - protein, 23 aa, Mycobacterium
ESDLLPPELNTRGFWSLTKQDDI

SEQ ID NO: 810174 - protein, 27 aa, Mycobacterium
ESDLPPQPVPLFDSLFALVQNALDRIY

SEQ ID NO: 810175 - protein, 27 aa, Mycobacterium
ESDNLAVKGIYWARHDADPARRRIITT

SEQ ID NO: 810176 - protein, 24 aa, Mycobacterium
ESDNLAVKGIYWARRDAEPQRRRI

SEQ ID NO: 810177 - protein, 25 aa, Mycobacterium
ESDNLAVKGIYWARRDAQPGRRRIV

SEQ ID NO: 810178 - protein, 27 aa, Mycobacterium
ESDNLAVKGMYWARRDAQPARRRIVTT

SEQ ID NO: 810179 - protein, 21 aa, Mycobacterium
ESDPGRWRRWRVDGAAARAAE

SEQ ID NO: 810180 - protein, 28 aa, Mycobacterium
ESDPHGMSPLFRSFIAGILATLRELTLF

SEQ ID NO: 810181 - protein, 26 aa, Mycobacterium
ESDPRLWYYRFQTAAVGWNPGINVLL

SEQ ID NO: 810182 - protein, 23 aa, Mycobacterium
ESDPRMFRLIRGQVAIATTPGKV

SEQ ID NO: 810183 - protein, 24 aa, Mycobacterium
ESDPWTLWWMHVTGSDSAELIAAA

SEQ ID NO: 810184 - protein, 27 aa, Mycobacterium
ESDQFRALVLIDFFGNAVAQGLVDMNF

SEQ ID NO: 810185 - protein, 27 aa, Mycobacterium
ESDQPASILILFAPGAPREDYFEGFPG

SEQ ID NO: 810186 - protein, 26 aa, Mycobacterium
ESDRIGRLAFATAHPRWIAQSFSDAL

SEQ ID NO: 810187 - protein, 30 aa, Mycobacterium
ESDVLFVQCTRPWVMPYGAGDITYPATEPW

SEQ ID NO: 810188 - protein, 18 aa, Mycobacterium
ESDWYQPLSRRYESTDAG

SEQ ID NO: 810189 - protein, 30 aa, Mycobacterium
ESDYFPLRHAVFDLPPYKGRWPEIWVAAHG

SEQ ID NO: 810190 - protein, 24 aa, Mycobacterium
ESEDLHERLLRRDIPAVVLNAKND

SEQ ID NO: 810191 - protein, 23 aa, Mycobacterium
ESEDLHERLLRRGVPAVVLNAKN

SEQ ID NO: 810192 - protein, 29 aa, Mycobacterium
ESEGRGFYQLMKNLPQERLALGVGAVAAA

SEQ ID NO: 810193 - protein, 26 aa, Mycobacterium
ESEGVTGIFLVPAQWQAVCAAQQANP

SEQ ID NO: 810194 - protein, 20 aa, Mycobacterium
ESEGWLHRYGDQEISQFRGA

SEQ ID NO: 810195 - protein, 26 aa, Mycobacterium
ESELDPALRSWLAFGFEKVTEVVALA

SEQ ID NO: 810196 - protein, 23 aa, Mycobacterium
ESELMERFGVSRPTLREAFRVLE

SEQ ID NO: 810197 - protein, 23 aa, Mycobacterium
ESEQRLWCRLSVLAANFELPAAR

SEQ ID NO: 810198 - protein, 25 aa, Mycobacterium
ESERFRTLWASYDVKKHTRGLLLVN

SEQ ID NO: 810199 - protein, 24 aa, Mycobacterium
ESERLLRGFLSAALWDAGLYCRAD

SEQ ID NO: 810200 - protein, 23 aa, Mycobacterium
ESERLLRGFLSSALLEAGLYCRA

SEQ ID NO: 810201 - protein, 20 aa, Mycobacterium
ESESFRRYWPADLHMIGKDI

SEQ ID NO: 810202 - protein, 25 aa, Mycobacterium
ESESLIPFPDYLAESVFAPLNLGDT

SEQ ID NO: 810203 - protein, 39 aa, Mycobacterium
ESETLWAVLARTLPAPWRVEALVLLAFSAYARGDGPLAG

SEQ ID NO: 810204 - protein, 40 aa, Mycobacterium
ESFDGLTALAAYVCDVPMALIGFLDAERQWLKSRQGVGHS

SEQ ID NO: 810205 - protein, 29 aa, Mycobacterium
ESFGAQWAAFARAALFPALVRGLDDGVRD

SEQ ID NO: 810206 - protein, 21 aa, Mycobacterium
ESFGFKYGLPMDADMVMDVRF

SEQ ID NO: 810207 - protein, 22 aa, Mycobacterium
ESFGFKYGLPMDADMVMDVRFL

SEQ ID NO: 810208 - protein, 19 aa, Mycobacterium
ESFGFKYGLPMDADMVVDV

SEQ ID NO: 810209 - protein, 21 aa, Mycobacterium
ESFHRIVAPWCLSHHPASPPS

SEQ ID NO: 810210 - protein, 17 aa, Mycobacterium
ESFLQGFRAFFAESAAD

SEQ ID NO: 810211 - protein, 26 aa, Mycobacterium
ESFPDTYPWVPSLNPGLNFYLGQPSV

SEQ ID NO: 810212 - protein, 29 aa, Mycobacterium
ESFPGNYMTSFPSLWHVIDEDTGRIICEL

SEQ ID NO: 810213 - protein, 17 aa, Mycobacterium
ESFQSVIDLNLIATFNI

SEQ ID NO: 810214 - protein, 26 aa, Mycobacterium
ESFRDRLFTEIFPGRSTVPKTLIFAK

SEQ ID NO: 810215 - protein, 20 aa, Mycobacterium
ESFRTRDELFVTLAQGLLAE

SEQ ID NO: 810216 - protein, 18 aa, Mycobacterium
ESFRYIDCRCCGGMLKPD

SEQ ID NO: 810217 - protein, 21 aa, Mycobacterium
ESFTLVYDAIVARANGAGVTA

SEQ ID NO: 810218 - protein, 20 aa, Mycobacterium
ESFVKRYLDTVAGGSAADIA

SEQ ID NO: 810219 - protein, 32 aa, Mycobacterium
ESFWGTMKVEFYDRYLWPTKAAAKLAVGDWIE

SEQ ID NO: 810220 - protein, 25 aa, Mycobacterium
ESGAPLVLGGWLPDDVAGGRTGRPD

SEQ ID NO: 810221 - protein, 17 aa, Mycobacterium
ESGFTAVRRLKQPAAVA

SEQ ID NO: 810222 - protein, 26 aa, Mycobacterium
ESGIPDYLLDRIGLATPAQVADIELR

SEQ ID NO: 810223 - protein, 23 aa, Mycobacterium
ESGITLVAFLRQDSMNVYTRVDR

SEQ ID NO: 810224 - protein, 18 aa, Mycobacterium
ESGLAGAEWQLGLLGKID

SEQ ID NO: 810225 - protein, 28 aa, Mycobacterium
ESGLDPTMLVPLLRLLAAGEPVTVEALA

SEQ ID NO: 810226 - protein, 17 aa, Mycobacterium
ESGLFAVALPFTNLIDY

SEQ ID NO: 810227 - protein, 22 aa, Mycobacterium
ESGLHLRCRYPDTAEARTNVGA

SEQ ID NO: 810228 - protein, 24 aa, Mycobacterium
ESGLLRLPHWDTDHVWHLFTVEVT

SEQ ID NO: 810229 - protein, 22 aa, Mycobacterium
ESGLPTFRDAQTGLWSKYDPMT

SEQ ID NO: 810230 - protein, 33 aa, Mycobacterium
ESGLRRIHLAMRSQRYFRLLDALEGLVASSTDT

SEQ ID NO: 810231 - protein, 24 aa, Mycobacterium
ESGPRLQAVWTWAPSLVDAIQVQR

SEQ ID NO: 810232 - protein, 20 aa, Mycobacterium
ESGPWRLGISSAGTFENLQL

SEQ ID NO: 810233 - protein, 20 aa, Mycobacterium
ESGRLELPLPASGRTAERWQ

SEQ ID NO: 810234 - protein, 25 aa, Mycobacterium
ESGRLTLPYWMVYDSRAGDVPPVGA

SEQ ID NO: 810235 - protein, 24 aa, Mycobacterium
ESGRQVGPLAKFYSIAPTDVVIIH

SEQ ID NO: 810236 - protein, 35 aa, Mycobacterium
ESGSAFVLATGRPPRWITPIVDALGFAPISVCANG

SEQ ID NO: 810237 - protein, 22 aa, Mycobacterium
ESGSAWVFHLFEKLAKSYGQIP

SEQ ID NO: 810238 - protein, 22 aa, Mycobacterium
ESGSPLVLYAHGGGFVTGNLDT

SEQ ID NO: 810239 - protein, 19 aa, Mycobacterium
ESGSWSRLAPAERSRVLTQ

SEQ ID NO: 810240 - protein, 29 aa, Mycobacterium
ESGTIDLFPGALLWLPRRSRRQFTAGAEG

SEQ ID NO: 810241 - protein, 23 aa, Mycobacterium
ESGWTFDHFYPIFSDSSGPCLEG

SEQ ID NO: 810242 - protein, 29 aa, Mycobacterium
ESGYNLARVIAVELGFDFLPGTTVNRYCS

SEQ ID NO: 810243 - protein, 24 aa, Mycobacterium
ESHAMFVALAYAKLNGVRKEKYLA

SEQ ID NO: 810244 - protein, 17 aa, Mycobacterium
ESHFVTGLMAALTTADA

SEQ ID NO: 810245 - protein, 17 aa, Mycobacterium
ESHLQRYGLSSGRFAVL

SEQ ID NO: 810246 - protein, 19 aa, Mycobacterium
ESHLWTAIWGAGEVHRYAP

SEQ ID NO: 810247 - protein, 26 aa, Mycobacterium
ESHQYVDLVAMFRPITRWADGVPTAR

SEQ ID NO: 810248 - protein, 24 aa, Mycobacterium
ESIAAALTPFPLQAAGSVVTANLG

SEQ ID NO: 810249 - protein, 27 aa, Mycobacterium
ESIAHAFRIDVRYFIDSGYADELESDL

SEQ ID NO: 810250 - protein, 25 aa, Mycobacterium
ESIASVPVILRRGAEWFRTMGTEKS

SEQ ID NO: 810251 - protein, 24 aa, Mycobacterium
ESIKALAIILSKRLPPADLTPSQL

SEQ ID NO: 810252 - protein, 22 aa, Mycobacterium
ESILERMQWARAKLQRYERLRA

SEQ ID NO: 810253 - protein, 21 aa, Mycobacterium
ESIQLAFDLLATEGAVASVGL

SEQ ID NO: 810254 - protein, 27 aa, Mycobacterium
ESIQVIRRFYHQLPAWIDQATRERAEA

SEQ ID NO: 810255 - protein, 18 aa, Mycobacterium
ESIREDVLAIRPPRAPLT

SEQ ID NO: 810256 - protein, 31 aa, Mycobacterium
ESIRFYSETLGMPLKFRDGAHFAALDGGQVT

SEQ ID NO: 810257 - protein, 40 aa, Mycobacterium
ESISDLRAIPWVLAWSQSRVMLPGWYGTGSAFEQWIAAGP

SEQ ID NO: 810258 - protein, 21 aa, Mycobacterium
ESIWDVTLGVNLHGLRKVTAA

SEQ ID NO: 810259 - protein, 24 aa, Mycobacterium
ESKDELFLALLDREFELRGEQIAI

SEQ ID NO: 810260 - protein, 19 aa, Mycobacterium
ESKFGVRVWHRDFFDAEIV

SEQ ID NO: 810261 - protein, 38 aa, Mycobacterium
ESKLPKVFFVNWFRRGHDGHFLWPGFGENSRVLKWIVE

SEQ ID NO: 810262 - protein, 23 aa, Mycobacterium
ESKPLVRLRVPFTLSRYEIDNVE

SEQ ID NO: 810263 - protein, 17 aa, Mycobacterium
ESKTLPAMLAGVAPLVL

SEQ ID NO: 810264 - protein, 19 aa, Mycobacterium
ESKTLPGMFAGVVPLVLNT

SEQ ID NO: 810265 - protein, 24 aa, Mycobacterium
ESLADAMQIRWAPPFEMRSGFVRP

SEQ ID NO: 810266 - protein, 26 aa, Mycobacterium
ESLADPLAFLLRKEGFEATVVGDGPS

SEQ ID NO: 810267 - protein, 26 aa, Mycobacterium
ESLADPLAFLLRKEGFEATVVTDGQA

SEQ ID NO: 810268 - protein, 26 aa, Mycobacterium
ESLADPLAFLLRKEGFEATVVTDGSA

SEQ ID NO: 810269 - protein, 18 aa, Mycobacterium
ESLDARLAEEEPDVSADD

SEQ ID NO: 810270 - protein, 28 aa, Mycobacterium
ESLDRTGLWGRLFPEWDAVRDLPPRDVS

SEQ ID NO: 810271 - protein, 29 aa, Mycobacterium
ESLEDYLGDFRFYLDFYTKQGPNGLEVRG

SEQ ID NO: 810272 - protein, 17 aa, Mycobacterium
ESLELLGRDRSVRRLRA

SEQ ID NO: 810273 - protein, 23 aa, Mycobacterium
ESLEMARRLAREEGLLVGISSGA

SEQ ID NO: 810274 - protein, 18 aa, Mycobacterium
ESLEPAWNFGGRGERFEV

SEQ ID NO: 810275 - protein, 28 aa, Mycobacterium
ESLGEVEFAFFVILLAVAGNETTRNAIT

SEQ ID NO: 810276 - protein, 21 aa, Mycobacterium
ESLGHPLIDHVRGRGLLQGIV

SEQ ID NO: 810277 - protein, 22 aa, Mycobacterium
ESLGWLGDDVWFAHGVHLSASD

SEQ ID NO: 810278 - protein, 28 aa, Mycobacterium
ESLKEALWQLIWAGYVGGDTFAPVRALL

SEQ ID NO: 810279 - protein, 25 aa, Mycobacterium
ESLLDRPLADWLAGLPAAASVNTPR

SEQ ID NO: 810280 - protein, 32 aa, Mycobacterium
ESLLEQLPLAQLAPFRQLLIDPLTELDTSRGT

SEQ ID NO: 810281 - protein, 17 aa, Mycobacterium
ESLLGAIYLEHGIDVAR

SEQ ID NO: 810282 - protein, 20 aa, Mycobacterium
ESLLPVLHSGKLTMLVDHLP

SEQ ID NO: 810283 - protein, 18 aa, Mycobacterium
ESLLRGYGYRPITVAGDD

SEQ ID NO: 810284 - protein, 22 aa, Mycobacterium
ESLPEFPWDTLADAKTLAGSHP

SEQ ID NO: 810285 - protein, 21 aa, Mycobacterium
ESLPTMPPWHVQENKWRSARY

SEQ ID NO: 810286 - protein, 24 aa, Mycobacterium
ESLQIPCDLALLAIGFDGVEHMPL

SEQ ID NO: 810287 - protein, 32 aa, Mycobacterium
ESLQRLRDLGCEYVICYFPEAAYDRSSIEMFE

SEQ ID NO: 810288 - protein, 22 aa, Mycobacterium
ESLQVGGWDPARQARRGRAFAD

SEQ ID NO: 810289 - protein, 25 aa, Mycobacterium
ESLRYDLATQEIFVFTPKGDVITLP

SEQ ID NO: 810290 - protein, 24 aa, Mycobacterium
ESLTLLGALGALGAWTERVRLVTT

SEQ ID NO: 810291 - protein, 22 aa, Mycobacterium
ESLTWSQLYRRTLNVARELSHC

SEQ ID NO: 810292 - protein, 17 aa, Mycobacterium
ESLVAECRVWPSPLLPA

SEQ ID NO: 810293 - protein, 19 aa, Mycobacterium
ESLVNWDALAAMRGTIVLL

SEQ ID NO: 810294 - protein, 23 aa, Mycobacterium
ESLWRLLCEQVGAAALVIPEELG

SEQ ID NO: 810295 - protein, 22 aa, Mycobacterium
ESMAMWPGAAVSGWYFAHPQSQ

SEQ ID NO: 810296 - protein, 28 aa, Mycobacterium
ESMAVTDHRFVPAAVFTGPQLAGVGLTE

SEQ ID NO: 810297 - protein, 20 aa, Mycobacterium
ESMKLFEYLGGPQTYNHYPI

SEQ ID NO: 810298 - protein, 17 aa, Mycobacterium
ESMTFPDPVIEVAIEPK

SEQ ID NO: 810299 - protein, 20 aa, Mycobacterium
ESMTLARRLAAEEGLLVGIS

SEQ ID NO: 810300 - protein, 25 aa, Mycobacterium
ESMTRAPWVMAKPSAPWARPGEVVD

SEQ ID NO: 810301 - protein, 23 aa, Mycobacterium
ESMTSLHVALLILDTHRSANPEP

SEQ ID NO: 810302 - protein, 27 aa, Mycobacterium
ESNAPALLGLIGLWYSNFLGAQSRAVL

SEQ ID NO: 810303 - protein, 26 aa, Mycobacterium
ESNAPALLGLIGLWYSNFMGAQSRAV

SEQ ID NO: 810304 - protein, 26 aa, Mycobacterium
ESNAPVLLGLIGLWYSNFMGAQSRAV

SEQ ID NO: 810305 - protein, 25 aa, Mycobacterium
ESNPFALLVGMLLDQQVPMETAFAG

SEQ ID NO: 810306 - protein, 20 aa, Mycobacterium
ESNPIPYFEPTPTPEPEPTP

SEQ ID NO: 810307 - protein, 22 aa, Mycobacterium
ESPAPLVVYAHGGGFVTGNLET

SEQ ID NO: 810308 - protein, 18 aa, Mycobacterium
ESPEPHLSFQWPSGGRHS

SEQ ID NO: 810309 - protein, 27 aa, Mycobacterium
ESPGTTLMVLPPLMHGAAQWAVFTAMN

SEQ ID NO: 810310 - protein, 17 aa, Mycobacterium
ESPIVHGMWLSAAAQHA

SEQ ID NO: 810311 - protein, 22 aa, Mycobacterium
ESPLLAPLELLAYSAACTARLR

SEQ ID NO: 810312 - protein, 26 aa, Mycobacterium
ESPLRHVAELPPRPGRPTGWPEWAAA

SEQ ID NO: 810313 - protein, 22 aa, Mycobacterium
ESPRAFGLMEVLRWAPIGDQDG

SEQ ID NO: 810314 - protein, 25 aa, Mycobacterium
ESPRETWLRLVVVRAGYPPPQTQYA

SEQ ID NO: 810315 - protein, 27 aa, Mycobacterium
ESPRMRRDLPLLYRLCSGITGGIQIRN

SEQ ID NO: 810316 - protein, 25 aa, Mycobacterium
ESPRRAYDVRPIVTAILDSETPFDE

SEQ ID NO: 810317 - protein, 20 aa, Mycobacterium
ESPRREAVLAALGSVAPARV

SEQ ID NO: 810318 - protein, 31 aa, Mycobacterium
ESPTAVRWHLLATTWLDLPARPALIGTRGPD

SEQ ID NO: 810319 - protein, 18 aa, Mycobacterium
ESPTYWGAIIAAAQAGVR

SEQ ID NO: 810320 - protein, 24 aa, Mycobacterium
ESPWALMHFMVRLPEDVATGSIDV

SEQ ID NO: 810321 - protein, 23 aa, Mycobacterium
ESPWALMHFMVRLPSDDPGATPV

SEQ ID NO: 810322 - protein, 23 aa, Mycobacterium
ESPYFALANGKLLSRRPRAGMTT

SEQ ID NO: 810323 - protein, 21 aa, Mycobacterium
ESPYLLARKFSTLDHLTRGRI

SEQ ID NO: 810324 - protein, 21 aa, Mycobacterium
ESPYSYLMTRRIERAMMLLRR

SEQ ID NO: 810325 - protein, 26 aa, Mycobacterium
ESQAAPPLACLLYAASPQGNSLGMPW

SEQ ID NO: 810326 - protein, 21 aa, Mycobacterium
ESQALLGYQLWLATHEKVDRD

SEQ ID NO: 810327 - protein, 24 aa, Mycobacterium
ESQALLGYQLWLAVHERGERDLGA

SEQ ID NO: 810328 - protein, 24 aa, Mycobacterium
ESQHPDLFWALRGGGGNFGVATAF

SEQ ID NO: 810329 - protein, 24 aa, Mycobacterium
ESQKLTLLPRMMRAEDIWCQGMSE

SEQ ID NO: 810330 - protein, 17 aa, Mycobacterium
ESQLLQIAAALPTGRPA

SEQ ID NO: 810331 - protein, 19 aa, Mycobacterium
ESQLLSPMRDRTLTISKRL

SEQ ID NO: 810332 - protein, 27 aa, Mycobacterium
ESQLQIHLVGAFRLASTVLPGMLERRR

SEQ ID NO: 810333 - protein, 26 aa, Mycobacterium
ESQQAVRFGLFHLLQASARAERRAIA

SEQ ID NO: 810334 - protein, 26 aa, Mycobacterium
ESQQAVRFGLFHLLQASARAERRAIP

SEQ ID NO: 810335 - protein, 17 aa, Mycobacterium
ESRAQMATLPRLRPRVF

SEQ ID NO: 810336 - protein, 23 aa, Mycobacterium
ESRELLGPFPRDRGWPIDELLSL

SEQ ID NO: 810337 - protein, 24 aa, Mycobacterium
ESRELLSPFPRDRGWPVDDLLSVS

SEQ ID NO: 810338 - protein, 17 aa, Mycobacterium
ESRFRSMCEARGLPAVR

SEQ ID NO: 810339 - protein, 17 aa, Mycobacterium
ESRGLHALRARGALIRI

SEQ ID NO: 810340 - protein, 23 aa, Mycobacterium
ESRGLLHVGALEGLDNLTFVINC

SEQ ID NO: 810341 - protein, 33 aa, Mycobacterium
ESRHGLKSMLFAPELALARAWTCFARKDPVTAV

SEQ ID NO: 810342 - protein, 30 aa, Mycobacterium
ESRHGLKSMLFAPELALARAWTMVARRDTH

SEQ ID NO: 810343 - protein, 22 aa, Mycobacterium
ESRHRPGWLPIPLRSIARLTAT

SEQ ID NO: 810344 - protein, 26 aa, Mycobacterium
ESRIALERLLDFMPRYEVDLAGCKRV

SEQ ID NO: 810345 - protein, 28 aa, Mycobacterium
ESRIALERLLDFMPRYEVDWDGCKRVNM

SEQ ID NO: 810346 - protein, 24 aa, Mycobacterium
ESRLGYFAALYKRITVAVRTAVAH

SEQ ID NO: 810347 - protein, 25 aa, Mycobacterium
ESRPAWPMIVFRTPKGWTGPDYIDG

SEQ ID NO: 810348 - protein, 29 aa, Mycobacterium
ESRPPFWQDMVELGWLGLHIDERHGGSGY

SEQ ID NO: 810349 - protein, 19 aa, Mycobacterium
ESRQLPFVEINASYYPKRP

SEQ ID NO: 810350 - protein, 34 aa, Mycobacterium
ESRQLVREWLTSWSKPGLIPVALVVVNVFVENVL

SEQ ID NO: 810351 - protein, 41 aa, Mycobacterium
ESRRRVGITVLPADRWNLFDPVVIRWRLEVGDRTAQLVSLS

SEQ ID NO: 810352 - protein, 24 aa, Mycobacterium
ESRSPLVLDVSRLGRRPGSMLTHR

SEQ ID NO: 810353 - protein, 22 aa, Mycobacterium
ESRVGLINWLIQDPGNEAVARE

SEQ ID NO: 810354 - protein, 22 aa, Mycobacterium
ESRVGLINWLIQDPGNPAVAAE

SEQ ID NO: 810355 - protein, 24 aa, Mycobacterium
ESRVRLIGFFNPLDGKFHWQGTIY

SEQ ID NO: 810356 - protein, 21 aa, Mycobacterium
ESRWRMAVEKVLRGAGLRLLV

SEQ ID NO: 810357 - protein, 21 aa, Mycobacterium
ESSAVMCGWVDGAIRSGERAA

SEQ ID NO: 810358 - protein, 25 aa, Mycobacterium
ESTAASLQAQWRGAAGTAAQAAVVR

SEQ ID NO: 810359 - protein, 25 aa, Mycobacterium
ESTAAVVDWLQPFIDELRVCLHGCG

SEQ ID NO: 810360 - protein, 23 aa, Mycobacterium
ESTAGVLILLRTVGAIAFDEEQL

SEQ ID NO: 810361 - protein, 24 aa, Mycobacterium
ESTATFEWAFRWLDAHRPAGSAPV

SEQ ID NO: 810362 - protein, 28 aa, Mycobacterium
ESTDPAPLVLWVHGGPLGSWNTWHWRWN

SEQ ID NO: 810363 - protein, 17 aa, Mycobacterium
ESTGFAGLAPLLSSLAD

SEQ ID NO: 810364 - protein, 22 aa, Mycobacterium
ESTGIPYVPMSMAKGLLPDDHP

SEQ ID NO: 810365 - protein, 25 aa, Mycobacterium
ESTGQPHRFFVVATKQLSIATDFAD

SEQ ID NO: 810366 - protein, 18 aa, Mycobacterium
ESTLGLAAAMQPLAHRDP

SEQ ID NO: 810367 - protein, 25 aa, Mycobacterium
ESTLSEGLLYERRLFHSTFATEDQS

SEQ ID NO: 810368 - protein, 24 aa, Mycobacterium
ESTPRFAIIGYAARFPGAADAEEF

SEQ ID NO: 810369 - protein, 26 aa, Mycobacterium
ESTRLIHDYPHLAAFLRAVRIESNAR

SEQ ID NO: 810370 - protein, 25 aa, Mycobacterium
ESTRREWTLPTWAPVPVAELVLGRA

SEQ ID NO: 810371 - protein, 24 aa, Mycobacterium
ESTSPRFFAGLRAAGYTRVSLGMQ

SEQ ID NO: 810372 - protein, 22 aa, Mycobacterium
ESTSSYYPHRGGVLYVSSKFAV

SEQ ID NO: 810373 - protein, 31 aa, Mycobacterium
ESTSTMLDLFTWLPTTHPASFFATGSGGIGW

SEQ ID NO: 810374 - protein, 19 aa, Mycobacterium
ESTTALRALAGLPSTTSAL

SEQ ID NO: 810375 - protein, 32 aa, Mycobacterium
ESTTMSHLLLDLDLLEPLRGLLAHGLPAYGAC

SEQ ID NO: 810376 - protein, 25 aa, Mycobacterium
ESTTVGLFTYPVLQAADVLAYDSDL

SEQ ID NO: 810377 - protein, 19 aa, Mycobacterium
ESTWPEFFDAIRAAGYTRV

SEQ ID NO: 810378 - protein, 30 aa, Mycobacterium
ESVADLVPGPLQWLRPLAPAFEPTRRGPSR

SEQ ID NO: 810379 - protein, 34 aa, Mycobacterium
ESVAELIPPSLQWLRPFAPAFRPRWRDPSRDEAR

SEQ ID NO: 810380 - protein, 24 aa, Mycobacterium
ESVAQNLWPLVEAGKVRPVVGAEI

SEQ ID NO: 810381 - protein, 20 aa, Mycobacterium
ESVAQQRFSRIFLTTGRSGT

SEQ ID NO: 810382 - protein, 27 aa, Mycobacterium
ESVHQALMFRQWSPRITLFLNGAVDPS

SEQ ID NO: 810383 - protein, 23 aa, Mycobacterium
ESVKRFAAVLSNAKTIFWNGPMG

SEQ ID NO: 810384 - protein, 23 aa, Mycobacterium
ESVLLLFACCLMSRCARRRIRCL

SEQ ID NO: 810385 - protein, 17 aa, Mycobacterium
ESVLPSLSLLAHAVRTA

SEQ ID NO: 810386 - protein, 23 aa, Mycobacterium
ESVLSALLSDGWLGPASAAMAAA

SEQ ID NO: 810387 - protein, 27 aa, Mycobacterium
ESVQWLEQHLAAYPGAILAVTHDRYFL

SEQ ID NO: 810388 - protein, 25 aa, Mycobacterium
ESVQWLEQHLAAYPGAVLAVTHDRY

SEQ ID NO: 810389 - protein, 25 aa, Mycobacterium
ESVQWLEQHLASYAGAILAVTHDRY

SEQ ID NO: 810390 - protein, 22 aa, Mycobacterium
ESVRAIVRQLLPTGAATLDLVA

SEQ ID NO: 810391 - protein, 24 aa, Mycobacterium
ESVRDFARASLAYGLNAKWPVYLS

SEQ ID NO: 810392 - protein, 25 aa, Mycobacterium
ESVRKFLRTLPAAERPRMIAVDAVP

SEQ ID NO: 810393 - protein, 23 aa, Mycobacterium
ESVRPYWEAGFTDIALIQVGGDT

SEQ ID NO: 810394 - protein, 25 aa, Mycobacterium
ESVRRTLKGWVWKFDPAIFGGHLAE

SEQ ID NO: 810395 - protein, 21 aa, Mycobacterium
ESVSFPEVLALAAEALRVRAE

SEQ ID NO: 810396 - protein, 21 aa, Mycobacterium
ESVSGYLTLLYAYSQDSDTNE

SEQ ID NO: 810397 - protein, 19 aa, Mycobacterium
ESVSLLQYAVQRQLRAEGD

SEQ ID NO: 810398 - protein, 30 aa, Mycobacterium
ESVVTPFLLPDIPVVAWWPDIAPAVPAQDP

SEQ ID NO: 810399 - protein, 17 aa, Mycobacterium
ESVYGPLTASIRRLIDV

SEQ ID NO: 810400 - protein, 20 aa, Mycobacterium
ESWHNTFWDNLAASIELHSI

SEQ ID NO: 810401 - protein, 36 aa, Mycobacterium
ESWHPLGVVGVISAFNFPVAVWSWNTAIALVCGDTV

SEQ ID NO: 810402 - protein, 20 aa, Mycobacterium
ESWIDTYDEGSFRRMARDLR

SEQ ID NO: 810403 - protein, 17 aa, Mycobacterium
ESWLVQITGYDAVSLQP

SEQ ID NO: 810404 - protein, 20 aa, Mycobacterium
ESWNSLRQMSLVLALEEEFG

SEQ ID NO: 810405 - protein, 17 aa, Mycobacterium
ESWPTVVSAHPDACLMI

SEQ ID NO: 810406 - protein, 31 aa, Mycobacterium
ESWRGEPLAAYLRKMVFWSDVQIEPADLGVL

SEQ ID NO: 810407 - protein, 28 aa, Mycobacterium
ESWSAFEQFALDYLRIRKITCSITHALE

SEQ ID NO: 810408 - protein, 19 aa, Mycobacterium
ESWSRIIDVNLTGTFHCCQ

SEQ ID NO: 810409 - protein, 18 aa, Mycobacterium
ESWSRIVEVNLTGTFHCC

SEQ ID NO: 810410 - protein, 25 aa, Mycobacterium
ESYAAILDALRWLGMDWDEGPEVGG

SEQ ID NO: 810411 - protein, 24 aa, Mycobacterium
ESYAPLMAYLVRSMQSGGELAMTL

SEQ ID NO: 810412 - protein, 23 aa, Mycobacterium
ESYAPMMAYLVRSMQSGGELANM

SEQ ID NO: 810413 - protein, 23 aa, Mycobacterium
ESYDFWKTYLGRTDLRPGHFGEN

SEQ ID NO: 810414 - protein, 27 aa, Mycobacterium
ESYEIFRLNAVPGTEKLPYSLKVLAEN

SEQ ID NO: 810415 - protein, 18 aa, Mycobacterium
ESYGRFMQIRDFDCWMHE

SEQ ID NO: 810416 - protein, 19 aa, Mycobacterium
ESYGRFMRVRVFDCWMHEQ

SEQ ID NO: 810417 - protein, 21 aa, Mycobacterium
ESYGRLLALLAAPTGDIAAAE

SEQ ID NO: 810418 - protein, 21 aa, Mycobacterium
ESYQLLDQLSLLVDKSLVVAD

SEQ ID NO: 810419 - protein, 17 aa, Mycobacterium
ESYSWKQDLGAAAPMGI

SEQ ID NO: 810420 - protein, 34 aa, Mycobacterium
ESYTIKDWKGKLKFLAKKIPFAGTLAEIGTLANI

SEQ ID NO: 810421 - protein, 18 aa, Mycobacterium
ETAARFVADPFTLGARMY

SEQ ID NO: 810422 - protein, 17 aa, Mycobacterium
ETAARFVPDPFVPGARM

SEQ ID NO: 810423 - protein, 24 aa, Mycobacterium
ETADGAPFHRLCFGLAAGGVGNRF

SEQ ID NO: 810424 - protein, 24 aa, Mycobacterium
ETAFGVYRPAYVARSALTHVLVDA

SEQ ID NO: 810425 - protein, 25 aa, Mycobacterium
ETAGFNSFWFPQVPGYLDAMTTVAL

SEQ ID NO: 810426 - protein, 26 aa, Mycobacterium
ETAGMLEPLRMYAHIPRLLNAYGKLE

SEQ ID NO: 810427 - protein, 26 aa, Mycobacterium
ETAGPDALVVVLLPDGGRGYMSKIFN

SEQ ID NO: 810428 - protein, 24 aa, Mycobacterium
ETAKAMVELPSPFEGTVVALQAAE

SEQ ID NO: 810429 - protein, 19 aa, Mycobacterium
ETALDRYPGPLLTQSVSPA

SEQ ID NO: 810430 - protein, 19 aa, Mycobacterium
ETALIARWLATPGVRIVRV

SEQ ID NO: 810431 - protein, 17 aa, Mycobacterium
ETALIARWLGQAGVRIV

SEQ ID NO: 810432 - protein, 17 aa, Mycobacterium
ETALNRDFRRFEAGTHP

SEQ ID NO: 810433 - protein, 24 aa, Mycobacterium
ETAPPRGFGLDGQRPRAAGEPRID

SEQ ID NO: 810434 - protein, 27 aa, Mycobacterium
ETAPQERIFMGFPPLGELFGATHDEAL

SEQ ID NO: 810435 - protein, 31 aa, Mycobacterium
ETAQIESTVWIGAPIRDLALGADGKALVLTS

SEQ ID NO: 810436 - protein, 25 aa, Mycobacterium
ETAQPLYARYWLHNRGPAPLGGLPA

SEQ ID NO: 810437 - protein, 27 aa, Mycobacterium
ETAQQRALVVLLLQHFDRRAGLVAVRR

SEQ ID NO: 810438 - protein, 20 aa, Mycobacterium
ETARLLRATKFISTYKFMGK

SEQ ID NO: 810439 - protein, 25 aa, Mycobacterium
ETARRYVRTFVLPAILADPPAPQQV

SEQ ID NO: 810440 - protein, 26 aa, Mycobacterium
ETASRFVRLPWHDDGVQRWYRTGDLV

SEQ ID NO: 810441 - protein, 26 aa, Mycobacterium
ETASVWFTAYPLSLITRSNESFLKAM

SEQ ID NO: 810442 - protein, 21 aa, Mycobacterium
ETAVIWQVYLASPPADRMTPA

SEQ ID NO: 810443 - protein, 18 aa, Mycobacterium
ETAVSYIPAAFAEGTRIE

SEQ ID NO: 810444 - protein, 17 aa, Mycobacterium
ETAVYNVLPQWAKLAAK

SEQ ID NO: 810445 - protein, 34 aa, Mycobacterium
ETAWQAYRHPKRLHWYVPKSIRLIDVFKGLSPEF

SEQ ID NO: 810446 - protein, 25 aa, Mycobacterium
ETAWRCGQWYTARLSPMPLRPEERK

SEQ ID NO: 810447 - protein, 25 aa, Mycobacterium
ETAWRDGDWYVARLCPSPLSHDERQ

SEQ ID NO: 810448 - protein, 27 aa, Mycobacterium
ETAWREDHWYRARLNLGPLGPDDWRST

SEQ ID NO: 810449 - protein, 22 aa, Mycobacterium
ETAYDGPFWDAMSPGLVLSKIA

SEQ ID NO: 810450 - protein, 21 aa, Mycobacterium
ETAYKLTPAYRALFDDVMDYV

SEQ ID NO: 810451 - protein, 20 aa, Mycobacterium
ETCVGRLRYLGVVLYDVDRV

SEQ ID NO: 810452 - protein, 24 aa, Mycobacterium
ETCWRDYRLGVLQAPLISALGFAF

SEQ ID NO: 810453 - protein, 26 aa, Mycobacterium
ETDARTWLLLATGLLDIADAGASVQM

SEQ ID NO: 810454 - protein, 23 aa, Mycobacterium
ETDDNLWHRFKAAQDKFFAARNA

SEQ ID NO: 810455 - protein, 33 aa, Mycobacterium
ETDLTTPTQWPKFAAALLAQTPVRGAMGFRLLV

SEQ ID NO: 810456 - protein, 24 aa, Mycobacterium
ETDMALWQRMFATSVLGPVALTQA

SEQ ID NO: 810457 - protein, 27 aa, Mycobacterium
ETDPRTWLLVATGLLRLSEATATGALT

SEQ ID NO: 810458 - protein, 25 aa, Mycobacterium
ETDRGLWVQALVAAGYQVFAINPLA

SEQ ID NO: 810459 - protein, 25 aa, Mycobacterium
ETDRNLLWLVFTDPYIHELLPNWDT

SEQ ID NO: 810460 - protein, 24 aa, Mycobacterium
ETDSAHYLLPPQQAAWIPAGLEHQ

SEQ ID NO: 810461 - protein, 22 aa, Mycobacterium
ETDVKRQLLLDALADELEVQVG

SEQ ID NO: 810462 - protein, 22 aa, Mycobacterium
ETDVKRQLLLDALADQLEVQVG

SEQ ID NO: 810463 - protein, 38 aa, Mycobacterium
ETDVMVSWLPLFHDMGMIGFLTVPMYFAGELVKVTPMD

SEQ ID NO: 810464 - protein, 23 aa, Mycobacterium
ETDVVGRFAGLRPLLDGDDSATA

SEQ ID NO: 810465 - protein, 25 aa, Mycobacterium
ETEDLRLLELLPPAPADANPPDDER

SEQ ID NO: 810466 - protein, 27 aa, Mycobacterium
ETEGLPHIPVRLRARSWHRYPEPSPDD

SEQ ID NO: 810467 - protein, 30 aa, Mycobacterium
ETEGPGEALFAFLRSMVLQWGAADRGLVDA

SEQ ID NO: 810468 - protein, 17 aa, Mycobacterium
ETEILRYVAKGLTAKQI

SEQ ID NO: 810469 - protein, 22 aa, Mycobacterium
ETEILVRRALLQLPVEQRAAVV

SEQ ID NO: 810470 - protein, 23 aa, Mycobacterium
ETEKPFLMPVEDVFTITGRGTVV

SEQ ID NO: 810471 - protein, 29 aa, Mycobacterium
ETELRRHILTLWQTALIRLSRLKISDEIE

SEQ ID NO: 810472 - protein, 18 aa, Mycobacterium
ETELWQLAFDVVSGYRGE

SEQ ID NO: 810473 - protein, 36 aa, Mycobacterium
ETEPVLAEWFLRRFSLLDSLYMVPPPRIIGRAIAHN

SEQ ID NO: 810474 - protein, 23 aa, Mycobacterium
ETEPVRDFLIRNAIRLTHQRADA

SEQ ID NO: 810475 - protein, 23 aa, Mycobacterium
ETERLLRDRLAELRPGDPILGEE

SEQ ID NO: 810476 - protein, 17 aa, Mycobacterium
ETERLNRLLEFVVRQES

SEQ ID NO: 810477 - protein, 23 aa, Mycobacterium
ETESLYAWAAGQLAPHATVVELC

SEQ ID NO: 810478 - protein, 24 aa, Mycobacterium
ETEVGFDPAVWRRAADELGLQGLA

SEQ ID NO: 810479 - protein, 22 aa, Mycobacterium
ETEVHRRLLRSGLPFGTCLQAV

SEQ ID NO: 810480 - protein, 18 aa, Mycobacterium
ETEWIPPPHLDRGQPRTN

SEQ ID NO: 810481 - protein, 21 aa, Mycobacterium
ETEYLKRPLIDGPAPVPPTHP

SEQ ID NO: 810482 - protein, 19 aa, Mycobacterium
ETFAPMRILTGIEVDILDD

SEQ ID NO: 810483 - protein, 23 aa, Mycobacterium
ETFAPMVRYLLHSVQSGGEPGRA

SEQ ID NO: 810484 - protein, 26 aa, Mycobacterium
ETFAVAWTCLFRNLDLKAGQTLVLRG

SEQ ID NO: 810485 - protein, 19 aa, Mycobacterium
ETFERWLECKGSVRLTALA

SEQ ID NO: 810486 - protein, 19 aa, Mycobacterium
ETFHPRGRAGAALPASASK

SEQ ID NO: 810487 - protein, 34 aa, Mycobacterium
ETFIALKVGIDNWRWAGVPIYLRTGKKMAEGIRI

SEQ ID NO: 810488 - protein, 32 aa, Mycobacterium
ETFIALKVGIDNWRWAGVPIYLRTGKRMAEGQ

SEQ ID NO: 810489 - protein, 21 aa, Mycobacterium
ETFLRAIGAIRRFGGRSSART

SEQ ID NO: 810490 - protein, 19 aa, Mycobacterium
ETFPFPFAADTYRYTTNVE

SEQ ID NO: 810491 - protein, 33 aa, Mycobacterium
ETGATPYMVLLAAFGALIRRYTHTDDFLVATPV

SEQ ID NO: 810492 - protein, 22 aa, Mycobacterium
ETGAVFPLLAGAIAPADYPAML

SEQ ID NO: 810493 - protein, 17 aa, Mycobacterium
ETGDPKKQVRCVYVAVG

SEQ ID NO: 810494 - protein, 17 aa, Mycobacterium
ETGDPKQQVRCVYVAIG

SEQ ID NO: 810495 - protein, 18 aa, Mycobacterium
ETGEAHFAVLSKAQSFAA

SEQ ID NO: 810496 - protein, 29 aa, Mycobacterium
ETGEPLWGSWYVGRPILVTANDYGLKLYN

SEQ ID NO: 810497 - protein, 25 aa, Mycobacterium
ETGERVLLLGHFVKSFVGLKDTESA

SEQ ID NO: 810498 - protein, 20 aa, Mycobacterium
ETGGARLTFRATVQVRVPII

SEQ ID NO: 810499 - protein, 26 aa, Mycobacterium
ETGLDLFAGLGLLQSVGEPVEVGARV

SEQ ID NO: 810500 - protein, 20 aa, Mycobacterium
ETGLLAPHWPKPYGRAAGPA

SEQ ID NO: 810501 - protein, 18 aa, Mycobacterium
ETGLRYYEAAFFDVIPQV

SEQ ID NO: 810502 - protein, 29 aa, Mycobacterium
ETGMVNVVCSVGLWARYRKLAVTARALII

SEQ ID NO: 810503 - protein, 25 aa, Mycobacterium
ETGPAPMLGGLPLGQLANAGGGNGV

SEQ ID NO: 810504 - protein, 21 aa, Mycobacterium
ETGQAFRYAQLRLAPARLTHC

SEQ ID NO: 810505 - protein, 26 aa, Mycobacterium
ETGQDLLLITVLKGAVIFVTDLARAI

SEQ ID NO: 810506 - protein, 19 aa, Mycobacterium
ETGQRVVMTFLPRCGSCPA

SEQ ID NO: 810507 - protein, 24 aa, Mycobacterium
ETGRKVLLLGHFVKHFVGLGQAES

SEQ ID NO: 810508 - protein, 25 aa, Mycobacterium
ETGRLLLGRRVAGLVAALQSLDRAT

SEQ ID NO: 810509 - protein, 21 aa, Mycobacterium
ETGRRLATVRILGALALGRLQ

SEQ ID NO: 810510 - protein, 26 aa, Mycobacterium
ETGTKYRVVWQDFASGAPLTAQMIAT

SEQ ID NO: 810511 - protein, 21 aa, Mycobacterium
ETGWLLGDYILSQIEPGMVSE

SEQ ID NO: 810512 - protein, 18 aa, Mycobacterium
ETGWLLGDYILSQPQRAE

SEQ ID NO: 810513 - protein, 18 aa, Mycobacterium
ETHLLFGIPYDRIDVVVH

SEQ ID NO: 810514 - protein, 25 aa, Mycobacterium
ETHLRRHTPWGARVSIHRGEVGQPY

SEQ ID NO: 810515 - protein, 20 aa, Mycobacterium
ETHMNELIPVALRLTQEGFA

SEQ ID NO: 810516 - protein, 27 aa, Mycobacterium
ETHPAVSWVRYPYLSSHPQYDLAKRQM

SEQ ID NO: 810517 - protein, 28 aa, Mycobacterium
ETHPLWIVRRTMIDLIRPVEFSDMLRMR

SEQ ID NO: 810518 - protein, 24 aa, Mycobacterium
ETHSGHDIYLYSPALVVEAIRDVV

SEQ ID NO: 810519 - protein, 32 aa, Mycobacterium
ETHSSWVLLAGPYAYKLKKPVDLGFLDFTSIE

SEQ ID NO: 810520 - protein, 17 aa, Mycobacterium
ETHSWNRPEWTVEQLIA

SEQ ID NO: 810521 - protein, 21 aa, Mycobacterium
ETIARVVRDFSWTGPVGVTYP

SEQ ID NO: 810522 - protein, 23 aa, Mycobacterium
ETIGVIQGMRKLPAGFTPGRKIG

SEQ ID NO: 810523 - protein, 21 aa, Mycobacterium
ETILVFPTFGCGVEEALRGDI

SEQ ID NO: 810524 - protein, 27 aa, Mycobacterium
ETIPATYGFPLPPPGYLEAVKALTERH

SEQ ID NO: 810525 - protein, 31 aa, Mycobacterium
ETIRPLIEKLPPREQAVLKLRFFDEMTQTQI

SEQ ID NO: 810526 - protein, 25 aa, Mycobacterium
ETIVSLTYFTPAVNQIELHPLLNQA

SEQ ID NO: 810527 - protein, 18 aa, Mycobacterium
ETIYGLVGIPITDLARTA

SEQ ID NO: 810528 - protein, 21 aa, Mycobacterium
ETKARVLRPYAEKLITHAKKG

SEQ ID NO: 810529 - protein, 24 aa, Mycobacterium
ETKLLALLHRFGIAAPASADRSRA

SEQ ID NO: 810530 - protein, 17 aa, Mycobacterium
ETKNTRYPMIHPFCGPT

SEQ ID NO: 810531 - protein, 22 aa, Mycobacterium
ETKPEWYLRQMLGTANFRAGPA

SEQ ID NO: 810532 - protein, 25 aa, Mycobacterium
ETKQALTEAVLWPLQHPETFQRLGV

SEQ ID NO: 810533 - protein, 24 aa, Mycobacterium
ETKRKFREALDRKLAKSSGGSDHK

SEQ ID NO: 810534 - protein, 23 aa, Mycobacterium
ETKRRMIFTAHHILVDGWSLAVF

SEQ ID NO: 810535 - protein, 37 aa, Mycobacterium
ETLAGLQPAFYSEAMKALFPQINWSITPGNSSPLSDG

SEQ ID NO: 810536 - protein, 23 aa, Mycobacterium
ETLDDFIMLGLTITAMPAITAIP

SEQ ID NO: 810537 - protein, 29 aa, Mycobacterium
ETLDHFLDLMLRAPFRLARDVLPHMRPGS

SEQ ID NO: 810538 - protein, 23 aa, Mycobacterium
ETLDHSLPYIFAVALQDGSWHHE

SEQ ID NO: 810539 - protein, 23 aa, Mycobacterium
ETLEPMMRITLNAILRAVFGADG

SEQ ID NO: 810540 - protein, 28 aa, Mycobacterium
ETLFEQRGRRWPIIISGTITDASGRTLS

SEQ ID NO: 810541 - protein, 18 aa, Mycobacterium
ETLFRALSPITRAVVAAG

SEQ ID NO: 810542 - protein, 17 aa, Mycobacterium
ETLFVRRAIDLHHKQAV

SEQ ID NO: 810543 - protein, 17 aa, Mycobacterium
ETLGFHRVWYAEHHNMR

SEQ ID NO: 810544 - protein, 31 aa, Mycobacterium
ETLGRPWVVLSPFTPYLRSPGAPPFGPGATP

SEQ ID NO: 810545 - protein, 17 aa, Mycobacterium
ETLGWIALNQRANAALN

SEQ ID NO: 810546 - protein, 18 aa, Mycobacterium
ETLGWIALNQRANAALNP

SEQ ID NO: 810547 - protein, 28 aa, Mycobacterium
ETLHELYERWPFFRSVLSNMAQVLAKSD

SEQ ID NO: 810548 - protein, 24 aa, Mycobacterium
ETLHFYRDILGFSLRDSMKLPPQL

SEQ ID NO: 810549 - protein, 22 aa, Mycobacterium
ETLIDDGRLRKLTFTGSTGVGK

SEQ ID NO: 810550 - protein, 19 aa, Mycobacterium
ETLIIDCGADFRLTDAAAW

SEQ ID NO: 810551 - protein, 22 aa, Mycobacterium
ETLISDLVLGVVSPVGDQGGDI

SEQ ID NO: 810552 - protein, 18 aa, Mycobacterium
ETLKLRWQAQPAMAGQLR

SEQ ID NO: 810553 - protein, 18 aa, Mycobacterium
ETLPALNSFVLPGGSPLS

SEQ ID NO: 810554 - protein, 27 aa, Mycobacterium
ETLPAPRVSPFPAVFQDVALIVGDDVS

SEQ ID NO: 810555 - protein, 23 aa, Mycobacterium
ETLPSMMRITLNAILRTVFGAQG

SEQ ID NO: 810556 - protein, 20 aa, Mycobacterium
ETLQKWNPRLIFGSVKGFND

SEQ ID NO: 810557 - protein, 32 aa, Mycobacterium
ETLQRIKDLVIPPAWKKVWISPHPNGHIQAVG

SEQ ID NO: 810558 - protein, 20 aa, Mycobacterium
ETLQRRQASLEDSQLELMER

SEQ ID NO: 810559 - protein, 29 aa, Mycobacterium
ETLQSIPRYFYALFAIDLTNKNYAKSKLY

SEQ ID NO: 810560 - protein, 17 aa, Mycobacterium
ETLRAFERAVGQLSEIR

SEQ ID NO: 810561 - protein, 18 aa, Mycobacterium
ETLRLHRFGNKAARRRHV

SEQ ID NO: 810562 - protein, 21 aa, Mycobacterium
ETLRSLGLPAMSPTIGGHEGS

SEQ ID NO: 810563 - protein, 28 aa, Mycobacterium
ETLSEVADGLWYPLWDANIRLDHSVRTV

SEQ ID NO: 810564 - protein, 24 aa, Mycobacterium
ETLSRLFHRIAFTSPESASRAILR

SEQ ID NO: 810565 - protein, 38 aa, Mycobacterium
ETLSSYELAWQRITRNYRLLTRALVLGSAPPIARRAIV

SEQ ID NO: 810566 - protein, 25 aa, Mycobacterium
ETLSYLFIEKPPYPHPDDPLISARQ

SEQ ID NO: 810567 - protein, 27 aa, Mycobacterium
ETLVALTRLRELIDRYPLRGVKGPMGT

SEQ ID NO: 810568 - protein, 27 aa, Mycobacterium
ETMKLPKTILMYPMTLASQAAHLVMVF

SEQ ID NO: 810569 - protein, 22 aa, Mycobacterium
ETMPGIESLVSDGLPGVSAALK

SEQ ID NO: 810570 - protein, 23 aa, Mycobacterium
ETNLKLRDLAGRFLDAVASTASA

SEQ ID NO: 810571 - protein, 26 aa, Mycobacterium
ETNPQLSHVLTPFLPDWVAEPEEIAD

SEQ ID NO: 810572 - protein, 19 aa, Mycobacterium
ETNYQIGFVPQGIGADLIA

SEQ ID NO: 810573 - protein, 17 aa, Mycobacterium
ETPAEIRMLRTLGADLV

SEQ ID NO: 810574 - protein, 33 aa, Mycobacterium
ETPALIPFSGPARKVLELTFREALRLGHNYIGT

SEQ ID NO: 810575 - protein, 26 aa, Mycobacterium
ETPCAVVAFASWPQEVVLRGTLADIA

SEQ ID NO: 810576 - protein, 22 aa, Mycobacterium
ETPDWWDSLPADRPIVYATLGT

SEQ ID NO: 810577 - protein, 18 aa, Mycobacterium
ETPERFGPALAMLDGGWS

SEQ ID NO: 810578 - protein, 18 aa, Mycobacterium
ETPIALADKLKLLEAVAA

SEQ ID NO: 810579 - protein, 25 aa, Mycobacterium
ETPIRSIMAFQLFIADESLGALNVY

SEQ ID NO: 810580 - protein, 26 aa, Mycobacterium
ETPLDPIPASRFPPAALPVRAVRAAR

SEQ ID NO: 810581 - protein, 20 aa, Mycobacterium
ETPPPPPSPILTAGANDPQC

SEQ ID NO: 810582 - protein, 24 aa, Mycobacterium
ETPRGLLVAVLRASGRPIYPINPM

SEQ ID NO: 810583 - protein, 21 aa, Mycobacterium
ETPVEMIFRDMRAFRLYDGPT

SEQ ID NO: 810584 - protein, 25 aa, Mycobacterium
ETPVHGIMGFRLLVGPHKIGALNLF

SEQ ID NO: 810585 - protein, 24 aa, Mycobacterium
ETPYASVTFPWYQLGRQVHVRGPV

SEQ ID NO: 810586 - protein, 23 aa, Mycobacterium
ETQAALRRLAVLIARDTPPSDVF

SEQ ID NO: 810587 - protein, 24 aa, Mycobacterium
ETQAVLALLDSPLGQLLHAAGSGK

SEQ ID NO: 810588 - protein, 27 aa, Mycobacterium
ETQAVLALLESPLGQLLRAAATGELAS

SEQ ID NO: 810589 - protein, 31 aa, Mycobacterium
ETQAVLALLESPLGQLLYAAGSGTLAEFGEL

SEQ ID NO: 810590 - protein, 31 aa, Mycobacterium
ETQAVLALLESPLGQLLYAAGTGKLAEFGEL

SEQ ID NO: 810591 - protein, 31 aa, Mycobacterium
ETQAVLALLESPLGQLLYAAGTGKLAELGEL

SEQ ID NO: 810592 - protein, 17 aa, Mycobacterium
ETQGFMKVVVDTDTREI

SEQ ID NO: 810593 - protein, 22 aa, Mycobacterium
ETQLCPHGLKHAFGGPYAESPT

SEQ ID NO: 810594 - protein, 24 aa, Mycobacterium
ETQPNLRDLWFDDPRLDTKTWLGE

SEQ ID NO: 810595 - protein, 24 aa, Mycobacterium
ETQRAVPLGPLYRKSGSLRGFVMS

SEQ ID NO: 810596 - protein, 18 aa, Mycobacterium
ETQRLRQAFSARGGLQCG

SEQ ID NO: 810597 - protein, 30 aa, Mycobacterium
ETQTERPDYLPLFVAPQPVSFEPAVVDDED

SEQ ID NO: 810598 - protein, 23 aa, Mycobacterium
ETQWVSALPFGIAGAPVLGAIVV

SEQ ID NO: 810599 - protein, 25 aa, Mycobacterium
ETRAPSTPWPTYPLMYRVSAAHEEG

SEQ ID NO: 810600 - protein, 30 aa, Mycobacterium
ETRDALAWLRHAGYQRLLDTAVLAINRTEA

SEQ ID NO: 810601 - protein, 24 aa, Mycobacterium
ETRDALLASLKRGLSSRQAAAEPV

SEQ ID NO: 810602 - protein, 24 aa, Mycobacterium
ETRDALLGSLLRGLSARQAAAEPV

SEQ ID NO: 810603 - protein, 27 aa, Mycobacterium
ETRDAWVEFPIFDAKTRSLKKAFLGKA

SEQ ID NO: 810604 - protein, 39 aa, Mycobacterium
ETRDDRLILSPQWPKALDPIEFPFVYRGQRLHLRVSGRA

SEQ ID NO: 810605 - protein, 25 aa, Mycobacterium
ETRDLFLTLLSVSGVGPRLAMATLA

SEQ ID NO: 810606 - protein, 21 aa, Mycobacterium
ETREWWGGMWAERILHSTVAS

SEQ ID NO: 810607 - protein, 19 aa, Mycobacterium
ETRFGWPVFEISTVAREGL

SEQ ID NO: 810608 - protein, 19 aa, Mycobacterium
ETRGQWYLRQLLGSANFNA

SEQ ID NO: 810609 - protein, 28 aa, Mycobacterium
ETRGYLEYATRWRDIPKPSIAAVQGKCI

SEQ ID NO: 810610 - protein, 17 aa, Mycobacterium
ETRIEPSLTRISALLDL

SEQ ID NO: 810611 - protein, 17 aa, Mycobacterium
ETRIVVTGNYRAWRHFI

SEQ ID NO: 810612 - protein, 30 aa, Mycobacterium
ETRLSDRVLLRFGLHQALRLGKPLQLHVGF

SEQ ID NO: 810613 - protein, 18 aa, Mycobacterium
ETRLVPARGYHLELITPV

SEQ ID NO: 810614 - protein, 17 aa, Mycobacterium
ETRMAVPPWVQGALQAD

SEQ ID NO: 810615 - protein, 27 aa, Mycobacterium
ETRNAWVEFPIFDAKTRSLKKAFLGKA

SEQ ID NO: 810616 - protein, 24 aa, Mycobacterium
ETRPETVLPTVKPLNVLLAEPDPP

SEQ ID NO: 810617 - protein, 18 aa, Mycobacterium
ETRPLSATKRWRLVEILE

SEQ ID NO: 810618 - protein, 26 aa, Mycobacterium
ETRPRWKRDLAWWFGGKVLATARASA

SEQ ID NO: 810619 - protein, 29 aa, Mycobacterium
ETRRILDRLYGYEVSPVLWKKVAPKLSAG

SEQ ID NO: 810620 - protein, 32 aa, Mycobacterium
ETRRILDRLYGYEVSPVLWKKVGRNLSAGRVQ

SEQ ID NO: 810621 - protein, 17 aa, Mycobacterium
ETRRLFAGGGFGGRRFD

SEQ ID NO: 810622 - protein, 18 aa, Mycobacterium
ETRRLFAGGGFGGRRFDA

SEQ ID NO: 810623 - protein, 18 aa, Mycobacterium
ETRRLFAGGGFGGRRFDT

SEQ ID NO: 810624 - protein, 21 aa, Mycobacterium
ETRTAVFDFLKTTLSEAGYTK

SEQ ID NO: 810625 - protein, 21 aa, Mycobacterium
ETRTGDIWLFRGQSGPDRAIQ

SEQ ID NO: 810626 - protein, 26 aa, Mycobacterium
ETRTTLPGGLTWPLGLAVDADGDLYI

SEQ ID NO: 810627 - protein, 23 aa, Mycobacterium
ETRWALDLLRRRFAKVIWVPGNH

SEQ ID NO: 810628 - protein, 25 aa, Mycobacterium
ETSANTVAVPYFWSDQYDVKIQSLG

SEQ ID NO: 810629 - protein, 22 aa, Mycobacterium
ETSATMCGWIDGAIRSGERAAS

SEQ ID NO: 810630 - protein, 23 aa, Mycobacterium
ETSHDPFLPLLLAAEHTSRIELG

SEQ ID NO: 810631 - protein, 23 aa, Mycobacterium
ETSHDPFLPLLLAAEHTSRLELG

SEQ ID NO: 810632 - protein, 29 aa, Mycobacterium
ETSIYRRWKTLPRLLADALIIHIDADIPI

SEQ ID NO: 810633 - protein, 21 aa, Mycobacterium
ETSLFIDRIRVSAPMLVDGRT

SEQ ID NO: 810634 - protein, 24 aa, Mycobacterium
ETSLTDLIYAHHPRFLGVRRAYES

SEQ ID NO: 810635 - protein, 27 aa, Mycobacterium
ETSLTEGLLYERRLFHSAFATADQKEG

SEQ ID NO: 810636 - protein, 24 aa, Mycobacterium
ETSLVKFHWKPVAGVHSLVWEEAQ

SEQ ID NO: 810637 - protein, 24 aa, Mycobacterium
ETSNPARWLVVADAGLCAEMRRAA

SEQ ID NO: 810638 - protein, 17 aa, Mycobacterium
ETSPYYHGVSRPWELEE

SEQ ID NO: 810639 - protein, 26 aa, Mycobacterium
ETSRIDGFPLLRAGICAGPVVKRRGD

SEQ ID NO: 810640 - protein, 34 aa, Mycobacterium
ETSRVSRVVPIGSPIRDLGYAAGALYALTSDRAV

SEQ ID NO: 810641 - protein, 22 aa, Mycobacterium
ETSRWLNGLVGLGDRISVRRAD

SEQ ID NO: 810642 - protein, 25 aa, Mycobacterium
ETSSTTLSWLFYELDRHPEIERGVA

SEQ ID NO: 810643 - protein, 18 aa, Mycobacterium
ETSTLRSRFGFMAIHGGG

SEQ ID NO: 810644 - protein, 23 aa, Mycobacterium
ETSVLIAPNFAIGAVLCMHFAKQ

SEQ ID NO: 810645 - protein, 26 aa, Mycobacterium
ETSVPYFSLAMLPGGRRLHRRAPEGQ

SEQ ID NO: 810646 - protein, 18 aa, Mycobacterium
ETSWLLDPSLPLQDVFKG

SEQ ID NO: 810647 - protein, 17 aa, Mycobacterium
ETSYIRLDLAQELARQL

SEQ ID NO: 810648 - protein, 30 aa, Mycobacterium
ETTANAMSWFWYLMALHPDARDRMLAEVDD

SEQ ID NO: 810649 - protein, 20 aa, Mycobacterium
ETTAVDELLYWIADDLARTT

SEQ ID NO: 810650 - protein, 24 aa, Mycobacterium
ETTDPSWVSLFLVAGAVVTDHGGM

SEQ ID NO: 810651 - protein, 20 aa, Mycobacterium
ETTFAAMVPPPVIAANRSEL

SEQ ID NO: 810652 - protein, 23 aa, Mycobacterium
ETTFGHPFLVMPYCGLGCIQDRI

SEQ ID NO: 810653 - protein, 17 aa, Mycobacterium
ETTGRLIGWLAKVLAEH

SEQ ID NO: 810654 - protein, 26 aa, Mycobacterium
ETTHAMLRSLFRVGLDPRNVAVIGKC

SEQ ID NO: 810655 - protein, 27 aa, Mycobacterium
ETTHYPLTVFVLPGPQLGFRVEYDTAA

SEQ ID NO: 810656 - protein, 19 aa, Mycobacterium
ETTILRRSLPMTRTALRDF

SEQ ID NO: 810657 - protein, 23 aa, Mycobacterium
ETTIRRLVKFLVDGKPTALPGIF

SEQ ID NO: 810658 - protein, 28 aa, Mycobacterium
ETTLLTLYVTLMHFGGIIVPPGYTDPLK

SEQ ID NO: 810659 - protein, 18 aa, Mycobacterium
ETTLPRECLLLFGQEGPG

SEQ ID NO: 810660 - protein, 26 aa, Mycobacterium
ETTLSEGLLYERRLFHSAFATDDQTE

SEQ ID NO: 810661 - protein, 17 aa, Mycobacterium
ETTPFSLENGLLTGIRK

SEQ ID NO: 810662 - protein, 18 aa, Mycobacterium
ETTPFSLENGLLTGIRKL

SEQ ID NO: 810663 - protein, 40 aa, Mycobacterium
ETTPFTLENGLLTGIRKLAWPKLKAHYGDRLEQMYAELAA

SEQ ID NO: 810664 - protein, 24 aa, Mycobacterium
ETTPPGLLGLAARAYTASGLSRNL

SEQ ID NO: 810665 - protein, 30 aa, Mycobacterium
ETTPWTLENGLLTGIRKLARPQLKKHYGEL

SEQ ID NO: 810666 - protein, 17 aa, Mycobacterium
ETTRNLIALGTLALIAH

SEQ ID NO: 810667 - protein, 25 aa, Mycobacterium
ETTRTRTPPPRAPHPTPPTTSTACG

SEQ ID NO: 810668 - protein, 25 aa, Mycobacterium
ETTSLAFLVAFRPGLVSPTLSAQMA

SEQ ID NO: 810669 - protein, 25 aa, Mycobacterium
ETTTHYSPIAWRTVTHRKRDIGVRP

SEQ ID NO: 810670 - protein, 28 aa, Mycobacterium
ETTTRLLGRLAPRRQPPKTVPPLRRPEV

SEQ ID NO: 810671 - protein, 18 aa, Mycobacterium
ETTWKLLLDSQSGIRTLD

SEQ ID NO: 810672 - protein, 26 aa, Mycobacterium
ETTYSDWEVIFRNGPLRWTEVDYHNP

SEQ ID NO: 810673 - protein, 25 aa, Mycobacterium
ETVDAMLKAFGRDIGYRIAHHADLN

SEQ ID NO: 810674 - protein, 24 aa, Mycobacterium
ETVEAGQALIWLEAMKMEHTITAP

SEQ ID NO: 810675 - protein, 22 aa, Mycobacterium
ETVEAMVVHPWSRGISEAGRTV

SEQ ID NO: 810676 - protein, 24 aa, Mycobacterium
ETVGARLMLLRRLARPDDETLGAP

SEQ ID NO: 810677 - protein, 17 aa, Mycobacterium
ETVGRLFGWLGKLLGDH

SEQ ID NO: 810678 - protein, 20 aa, Mycobacterium
ETVKRVFLELGGKSAAIILD

SEQ ID NO: 810679 - protein, 18 aa, Mycobacterium
ETVLFALSQPAGCEVREL

SEQ ID NO: 810680 - protein, 30 aa, Mycobacterium
ETVLKFIMGGPALIAARLLGPRILNVPGAR

SEQ ID NO: 810681 - protein, 30 aa, Mycobacterium
ETVLRLKARLWFVHRGVEKLFEGRPPNGAV

SEQ ID NO: 810682 - protein, 21 aa, Mycobacterium
ETVLRSLLHRSRPADSVLGEE

SEQ ID NO: 810683 - protein, 24 aa, Mycobacterium
ETVPPPVITANRTLLASLVATNFL

SEQ ID NO: 810684 - protein, 32 aa, Mycobacterium
ETVQAIGHLPQGLGIIGLLIDEPKPLRLDDLS

SEQ ID NO: 810685 - protein, 17 aa, Mycobacterium
ETVQARIKWLMADKSKG

SEQ ID NO: 810686 - protein, 19 aa, Mycobacterium
ETVQARIKWLMADKSQDYD

SEQ ID NO: 810687 - protein, 30 aa, Mycobacterium
ETVQDALLQHWDWLSSMAELSIKIAKQASD

SEQ ID NO: 810688 - protein, 25 aa, Mycobacterium
ETVQSMFIGPVFGPLLKLLGADKVA

SEQ ID NO: 810689 - protein, 39 aa, Mycobacterium
ETVRQLRLRDIGGIVVIDFIDMVLESNRDLVLRRLTEAL

SEQ ID NO: 810690 - protein, 21 aa, Mycobacterium
ETVRYFAPFRPAQGSDRGSSQ

SEQ ID NO: 810691 - protein, 17 aa, Mycobacterium
ETVVPLLPAQDFKRVGE

SEQ ID NO: 810692 - protein, 22 aa, Mycobacterium
ETVWVDGPLTRAVRTGALCYLD

SEQ ID NO: 810693 - protein, 25 aa, Mycobacterium
ETWGNFRTFFRFVPDESGKFRQLDI

SEQ ID NO: 810694 - protein, 18 aa, Mycobacterium
ETWPVARILRDAQVNTIW

SEQ ID NO: 810695 - protein, 17 aa, Mycobacterium
ETWTSRFFRDQRLLSIG

SEQ ID NO: 810696 - protein, 18 aa, Mycobacterium
ETYGIDLALLQRVQRAIG

SEQ ID NO: 810697 - protein, 17 aa, Mycobacterium
ETYPGTMSYYLASAFRE

SEQ ID NO: 810698 - protein, 27 aa, Mycobacterium
ETYSLSRFPELVAAAPKGLFLTGTAVV

SEQ ID NO: 810699 - protein, 24 aa, Mycobacterium
ETYTVRYDWPVRTGLIIGRLDDDG

SEQ ID NO: 810700 - protein, 17 aa, Mycobacterium
ETYWRSRTFRLSDYRFE

SEQ ID NO: 810701 - protein, 17 aa, Mycobacterium
EVAAFYRLTDEARMAPN

SEQ ID NO: 810702 - protein, 17 aa, Mycobacterium
EVAAFYRLTDESRMAPD

SEQ ID NO: 810703 - protein, 26 aa, Mycobacterium
EVAAKRIAWMKLLNAGQTCVAPDYVL

SEQ ID NO: 810704 - protein, 18 aa, Mycobacterium
EVAAKVNALLDIAQVNLG

SEQ ID NO: 810705 - protein, 19 aa, Mycobacterium
EVAAKVNALLDIAQVNLGD

SEQ ID NO: 810706 - protein, 19 aa, Mycobacterium
EVAALLGCAVLTGGGAVLN

SEQ ID NO: 810707 - protein, 29 aa, Mycobacterium
EVAALMRVSKMTVYRLVHNGELPAVRVGR

SEQ ID NO: 810708 - protein, 33 aa, Mycobacterium
EVAALVGVARRLLLDPREIGPIRLLGVGFSGLS

SEQ ID NO: 810709 - protein, 18 aa, Mycobacterium
EVAANRALMMALLATNFL

SEQ ID NO: 810710 - protein, 17 aa, Mycobacterium
EVAANRTMLSWLVATNA

SEQ ID NO: 810711 - protein, 22 aa, Mycobacterium
EVAAVEHHLLWRVASLMDAQVP

SEQ ID NO: 810712 - protein, 32 aa, Mycobacterium
EVADASLNHPYLDTVLFILGITRGEIEAADAL

SEQ ID NO: 810713 - protein, 24 aa, Mycobacterium
EVADLLLQYPLREFVTRGEVHGVW

SEQ ID NO: 810714 - protein, 24 aa, Mycobacterium
EVADRVAVLALRRARPLQRAAAEP

SEQ ID NO: 810715 - protein, 18 aa, Mycobacterium
EVADVLPLTPLQQGLLFQ

SEQ ID NO: 810716 - protein, 24 aa, Mycobacterium
EVAEARLFPLAQFMGDVYAGALLT

SEQ ID NO: 810717 - protein, 26 aa, Mycobacterium
EVAELLLLGMPYRDIGSRLFISAKTV

SEQ ID NO: 810718 - protein, 29 aa, Mycobacterium
EVAEVWRRGSVIGSWLLDLTAIALHDSPD

SEQ ID NO: 810719 - protein, 17 aa, Mycobacterium
EVAFENLIFGTDSALNG

SEQ ID NO: 810720 - protein, 40 aa, Mycobacterium
EVAGLGNRYLFVLPFLTPAIASLWVGLVTPIPSGLARPLV

SEQ ID NO: 810721 - protein, 17 aa, Mycobacterium
EVAGPLWSLVHGIASLA

SEQ ID NO: 810722 - protein, 28 aa, Mycobacterium
EVAGVSRGWLYRHFPDKSELLGAAIVRL

SEQ ID NO: 810723 - protein, 18 aa, Mycobacterium
EVAHLRRPWAARAARTAP

SEQ ID NO: 810724 - protein, 18 aa, Mycobacterium
EVAIDALLPTVRIRRIYA

SEQ ID NO: 810725 - protein, 23 aa, Mycobacterium
EVAIFGVPLDAGATYRPGTRFGP

SEQ ID NO: 810726 - protein, 27 aa, Mycobacterium
EVAIKMALQYWRSLGLPAKHRLMTWRG

SEQ ID NO: 810727 - protein, 18 aa, Mycobacterium
EVALALGGSVNCIRHLAA

SEQ ID NO: 810728 - protein, 25 aa, Mycobacterium
EVALFLTHYLGFPLGSKLDGAVSKV

SEQ ID NO: 810729 - protein, 17 aa, Mycobacterium
EVALLERFLAACPADRP

SEQ ID NO: 810730 - protein, 21 aa, Mycobacterium
EVALMASLVRIADRAGANLFE

SEQ ID NO: 810731 - protein, 18 aa, Mycobacterium
EVALVPKSTALVVWQPRR

SEQ ID NO: 810732 - protein, 23 aa, Mycobacterium
EVANLPLHPGFAASWQRLRTATA

SEQ ID NO: 810733 - protein, 25 aa, Mycobacterium
EVAPRAELLILAVPDHELAALVAGL

SEQ ID NO: 810734 - protein, 25 aa, Mycobacterium
EVAPWLDLACKLGVLAAALSDEPPV

SEQ ID NO: 810735 - protein, 23 aa, Mycobacterium
EVAQAAVYLLLNSATTGSTLYTD

SEQ ID NO: 810736 - protein, 18 aa, Mycobacterium
EVAQAWGLLGLTVAGPDV

SEQ ID NO: 810737 - protein, 19 aa, Mycobacterium
EVAQQIAFYASVRTYEPLL

SEQ ID NO: 810738 - protein, 18 aa, Mycobacterium
EVAQQIAFYASVRTYQPL

SEQ ID NO: 810739 - protein, 22 aa, Mycobacterium
EVARAWSSYAPTLVRLPDGRVK

SEQ ID NO: 810740 - protein, 23 aa, Mycobacterium
EVARGFLTAQKARWAARSLLDAT

SEQ ID NO: 810741 - protein, 23 aa, Mycobacterium
EVARGFLTAQKARWAGRSLLDAA

SEQ ID NO: 810742 - protein, 20 aa, Mycobacterium
EVARLLALESFDILDTPPEE

SEQ ID NO: 810743 - protein, 24 aa, Mycobacterium
EVARLLRPGGVFAFSAWVRDDRDG

SEQ ID NO: 810744 - protein, 25 aa, Mycobacterium
EVARLMIESLRSGGKVIFFGNGGSA

SEQ ID NO: 810745 - protein, 18 aa, Mycobacterium
EVARSLVVYLKRAGGQSQ

SEQ ID NO: 810746 - protein, 29 aa, Mycobacterium
EVASLMRVSKMTVYRLVHNGELPAVRVGR

SEQ ID NO: 810747 - protein, 17 aa, Mycobacterium
EVASWTGAKVRSVPIRI

SEQ ID NO: 810748 - protein, 23 aa, Mycobacterium
EVASYLFHAYGTNLQFADGEFNF

SEQ ID NO: 810749 - protein, 25 aa, Mycobacterium
EVAVFLTHYLGFPLGSKLDGAVSKV

SEQ ID NO: 810750 - protein, 25 aa, Mycobacterium
EVAVKMALQFWRSGGHRAKSRLMTW

SEQ ID NO: 810751 - protein, 20 aa, Mycobacterium
EVAVRILGSEFLVHAWDYAV

SEQ ID NO: 810752 - protein, 17 aa, Mycobacterium
EVAVTALALRPGGSIPT

SEQ ID NO: 810753 - protein, 19 aa, Mycobacterium
EVAWRILQSTPVTATGLVS

SEQ ID NO: 810754 - protein, 18 aa, Mycobacterium
EVAWRILRATPMTATGLV

SEQ ID NO: 810755 - protein, 30 aa, Mycobacterium
EVAWRQPGIVFFKYLLGMPVDDVPLCVELT

SEQ ID NO: 810756 - protein, 18 aa, Mycobacterium
EVAYHLAKGWLAPAVRRS

SEQ ID NO: 810757 - protein, 19 aa, Mycobacterium
EVAYRDGVRWVKGLQRLPD

SEQ ID NO: 810758 - protein, 21 aa, Mycobacterium
EVCAWIRMRPGRTALDAAAVR

SEQ ID NO: 810759 - protein, 19 aa, Mycobacterium
EVCCGPTRFIDGPGYHLYH

SEQ ID NO: 810760 - protein, 23 aa, Mycobacterium
EVCEIDLRVGGTWRYVVRQPCES

SEQ ID NO: 810761 - protein, 26 aa, Mycobacterium
EVCLQMHLLNLSFALAVGARAGADTA

SEQ ID NO: 810762 - protein, 20 aa, Mycobacterium
EVCYYLQPATLRAVLDREVP

SEQ ID NO: 810763 - protein, 26 aa, Mycobacterium
EVDANAMRGLKFSAALPSKLATQTLG

SEQ ID NO: 810764 - protein, 18 aa, Mycobacterium
EVDAYYFAPQKNFASDGG

SEQ ID NO: 810765 - protein, 24 aa, Mycobacterium
EVDEPYVLILPTYGGGRANPDLDL

SEQ ID NO: 810766 - protein, 24 aa, Mycobacterium
EVDEPYVLILPTYGGGRATPDLNA

SEQ ID NO: 810767 - protein, 20 aa, Mycobacterium
EVDGYLFPAGTMVLVNTAAA

SEQ ID NO: 810768 - protein, 25 aa, Mycobacterium
EVDHWAALDPIARYRCYLRAQGLWS

SEQ ID NO: 810769 - protein, 25 aa, Mycobacterium
EVDIRPKLTLPDPGSLTISVDPIEI

SEQ ID NO: 810770 - protein, 22 aa, Mycobacterium
EVDKLVWLPVDAAMDQLQYPDD

SEQ ID NO: 810771 - protein, 23 aa, Mycobacterium
EVDLDYHIRPWRVSPPGGRRELD

SEQ ID NO: 810772 - protein, 23 aa, Mycobacterium
EVDLGLPVRRILTTAAAPIRAAG

SEQ ID NO: 810773 - protein, 23 aa, Mycobacterium
EVDPQLVIMLGEYPGRAMLTVER

SEQ ID NO: 810774 - protein, 24 aa, Mycobacterium
EVDQPYVLVLPTYGGGRATPDLNA

SEQ ID NO: 810775 - protein, 18 aa, Mycobacterium
EVDRDGERLTLHPTQLVL

SEQ ID NO: 810776 - protein, 25 aa, Mycobacterium
EVDRELHLLADRLGKVEITVIPIAA

SEQ ID NO: 810777 - protein, 26 aa, Mycobacterium
EVDRMWSPDIAVWRVGARRDNDKARA

SEQ ID NO: 810778 - protein, 26 aa, Mycobacterium
EVDRVGWFPVAQARVKLLKGQLGFLD

SEQ ID NO: 810779 - protein, 25 aa, Mycobacterium
EVDSARLWDLPDVPVPIGVAVSSGD

SEQ ID NO: 810780 - protein, 24 aa, Mycobacterium
EVDSARLWDVPDVPVRIAAAVSGE

SEQ ID NO: 810781 - protein, 30 aa, Mycobacterium
EVDTRRWAGVPFFLRTGKRLARRVTEVALV

SEQ ID NO: 810782 - protein, 23 aa, Mycobacterium
EVDVHRRLVRSGLPFGTCLDATY

SEQ ID NO: 810783 - protein, 17 aa, Mycobacterium
EVDVLVIGFGMGGGCAA

SEQ ID NO: 810784 - protein, 19 aa, Mycobacterium
EVDVQRRWPSVEKARMLLG

SEQ ID NO: 810785 - protein, 24 aa, Mycobacterium
EVDVRPQITLPDLGQLTVSVESIE

SEQ ID NO: 810786 - protein, 17 aa, Mycobacterium
EVDVYNMGWHKYLDARA

SEQ ID NO: 810787 - protein, 27 aa, Mycobacterium
EVDWHTPPRARKPQRWVRLTGAMAAGE

SEQ ID NO: 810788 - protein, 22 aa, Mycobacterium
EVDWLVPDFIARGQSYALVSTA

SEQ ID NO: 810789 - protein, 17 aa, Mycobacterium
EVDWTPRRATQPQLVSL

SEQ ID NO: 810790 - protein, 23 aa, Mycobacterium
EVEALQLEYNWIKEFDPRFNIRY

SEQ ID NO: 810791 - protein, 22 aa, Mycobacterium
EVEALQLEYNWIKEFDPRFNVR

SEQ ID NO: 810792 - protein, 19 aa, Mycobacterium
EVEALTRRGYAADAAMVLS

SEQ ID NO: 810793 - protein, 19 aa, Mycobacterium
EVEALTWVRAGAPPRRRCL

SEQ ID NO: 810794 - protein, 23 aa, Mycobacterium
EVEALYYLHPLTGDVIRQVDSLR

SEQ ID NO: 810795 - protein, 21 aa, Mycobacterium
EVEALYYLHPLTGDVVRQTNS

SEQ ID NO: 810796 - protein, 24 aa, Mycobacterium
EVEAPLLINLVVGGLTPRVPVTRL

SEQ ID NO: 810797 - protein, 24 aa, Mycobacterium
EVEARALLAFSLAIGTHVIAADHP

SEQ ID NO: 810798 - protein, 24 aa, Mycobacterium
EVEDPLYVLAGRDEGYVPYYAEYP

SEQ ID NO: 810799 - protein, 21 aa, Mycobacterium
EVEETWRRYPDAAGALIVSPS

SEQ ID NO: 810800 - protein, 26 aa, Mycobacterium
EVEEVFLPLARLLHLQVAARQRLFAA

SEQ ID NO: 810801 - protein, 29 aa, Mycobacterium
EVEIGLAPVLVLAWLPQLVGRRQAMRLTA

SEQ ID NO: 810802 - protein, 25 aa, Mycobacterium
EVEIVCRLARTLLGAAHPVPWESFA

SEQ ID NO: 810803 - protein, 23 aa, Mycobacterium
EVELAFLGLIPQSITATQLLYRT

SEQ ID NO: 810804 - protein, 31 aa, Mycobacterium
EVELRRQVLRLWQTALIRLFRLQISDEIEVG

SEQ ID NO: 810805 - protein, 30 aa, Mycobacterium
EVERDLRVIIFGWIAFTFEICRQRIMDPTT

SEQ ID NO: 810806 - protein, 23 aa, Mycobacterium
EVEREFRRYFMTGPVLEDWHAWA

SEQ ID NO: 810807 - protein, 20 aa, Mycobacterium
EVESLFQALTPIARKVVAAG

SEQ ID NO: 810808 - protein, 27 aa, Mycobacterium
EVEVFHYTRRWLQKMTNIELEKAAGQI

SEQ ID NO: 810809 - protein, 24 aa, Mycobacterium
EVEVRGPWIAGSYYLTADDAKFDS

SEQ ID NO: 810810 - protein, 23 aa, Mycobacterium
EVEVSMMFKIGKYLYPDSLTVPD

SEQ ID NO: 810811 - protein, 27 aa, Mycobacterium
EVEYRQLRLERVVLVGVWTDGTAADSQ

SEQ ID NO: 810812 - protein, 25 aa, Mycobacterium
EVEYRQLRLERVVLVGVWTEGTAAD

SEQ ID NO: 810813 - protein, 20 aa, Mycobacterium
EVFAGYHWYPPMGEPAAASL

SEQ ID NO: 810814 - protein, 19 aa, Mycobacterium
EVFARQVLATGRPGDVVIG

SEQ ID NO: 810815 - protein, 18 aa, Mycobacterium
EVFASRLPSYFPTTLRER

SEQ ID NO: 810816 - protein, 20 aa, Mycobacterium
EVFDLLEHAPIDVAVMTAPD

SEQ ID NO: 810817 - protein, 35 aa, Mycobacterium; identical to SEQ ID NO: 217853

SEQ ID NO: 810818 - protein, 25 aa, Mycobacterium
EVFDRPIVLLTVTGAKSGKRRYVPL

SEQ ID NO: 810819 - protein, 26 aa, Mycobacterium
EVFETLLALAGYYFAVGDLARSTGVF

SEQ ID NO: 810820 - protein, 19 aa, Mycobacterium
EVFFHCAKAFLRSDAWDPQ

SEQ ID NO: 810821 - protein, 29 aa, Mycobacterium
EVFFHCAKAFLRSDTWKPETWNPTAVPSV

SEQ ID NO: 810822 - protein, 18 aa, Mycobacterium
EVFFVIVGELLFIDENNT

SEQ ID NO: 810823 - protein, 27 aa, Mycobacterium
EVFGDEKAVWWERAVAAWPEYAEYQTK

SEQ ID NO: 810824 - protein, 17 aa, Mycobacterium
EVFGPVASVYRAADIDE

SEQ ID NO: 810825 - protein, 18 aa, Mycobacterium
EVFGPVASVYRAADIDEA

SEQ ID NO: 810826 - protein, 17 aa, Mycobacterium
EVFGPVASVYRATDIEE

SEQ ID NO: 810827 - protein, 17 aa, Mycobacterium
EVFGPVLSITPYDGGDD

SEQ ID NO: 810828 - protein, 25 aa, Mycobacterium
EVFKRNIYIHPFLEDDLKGIIDIMG

SEQ ID NO: 810829 - protein, 24 aa, Mycobacterium
EVFLDLAATWRDKLRWYTVVGNHR

SEQ ID NO: 810830 - protein, 21 aa, Mycobacterium
EVFRDHFLTCFISDKVGVALR

SEQ ID NO: 810831 - protein, 23 aa, Mycobacterium
EVFREHFLTCFIADPVGVATRHQ

SEQ ID NO: 810832 - protein, 24 aa, Mycobacterium
EVFRGVQKWRIKSNWKFVSENFLG

SEQ ID NO: 810833 - protein, 28 aa, Mycobacterium
EVFRSGRPLLTETFRRPIPAFTDVGERP

SEQ ID NO: 810834 - protein, 26 aa, Mycobacterium
EVFTPLRAIIGIFTNGGLLSGNSPLN

SEQ ID NO: 810835 - protein, 34 aa, Mycobacterium
EVFWRKAHAAAMERAITLLLRQTPMDAEQIGHLL

SEQ ID NO: 810836 - protein, 24 aa, Mycobacterium
EVGAGRWWRRLPGPRTLVHGLGAG

SEQ ID NO: 810837 - protein, 17 aa, Mycobacterium
EVGAIVPLHASALGKVL

SEQ ID NO: 810838 - protein, 29 aa, Mycobacterium
EVGCPVIEELMLSAPLPLPAAGAVCVQVV

SEQ ID NO: 810839 - protein, 39 aa, Mycobacterium
EVGDGVRWAMRHLPFYGRWYRFLVLWPGSDKGLDAAEGD

SEQ ID NO: 810840 - protein, 27 aa, Mycobacterium
EVGEIFMRPWEGMPTPYKYLGAEIKRF

SEQ ID NO: 810841 - protein, 29 aa, Mycobacterium
EVGFFKGVMQLTHPAFLILDSPDGKNHGT

SEQ ID NO: 810842 - protein, 31 aa, Mycobacterium
EVGFFRNVMQLTHPAFLLLDTPDGKNRGTVS

SEQ ID NO: 810843 - protein, 18 aa, Mycobacterium
EVGFVTEPLRRLPVRPER

SEQ ID NO: 810844 - protein, 25 aa, Mycobacterium
EVGHALYLGFLFLDEDDDAFMVALT

SEQ ID NO: 810845 - protein, 32 aa, Mycobacterium
EVGIGFCFAPLFHPSYRHTSAVRRELGVPTVF

SEQ ID NO: 810846 - protein, 22 aa, Mycobacterium
EVGKAYIVLKPGATLNADSVIE

SEQ ID NO: 810847 - protein, 24 aa, Mycobacterium
EVGKYLQRFILEDHPVVLDLSEVD

SEQ ID NO: 810848 - protein, 18 aa, Mycobacterium
EVGLFLLAADARGVEIRP

SEQ ID NO: 810849 - protein, 21 aa, Mycobacterium
EVGLGRRQVLSLWGRNDTAQR

SEQ ID NO: 810850 - protein, 21 aa, Mycobacterium
EVGLRTFFQRYPDAQLAGSGS

SEQ ID NO: 810851 - protein, 30 aa, Mycobacterium
EVGPFKKGPFRIAMAAGIPIVPIVIRNAEI

SEQ ID NO: 810852 - protein, 31 aa, Mycobacterium
EVGPFKKGPFRIAMAAGIPIVPIVIRNAEIV

SEQ ID NO: 810853 - protein, 23 aa, Mycobacterium
EVGPHDVFIDIKFAGICHSDIHT

SEQ ID NO: 810854 - protein, 29 aa, Mycobacterium
EVGPPELYAWLRYDPIPVRDDLAKALVAY

SEQ ID NO: 810855 - protein, 32 aa, Mycobacterium
EVGPRTFGPYEIPLFSFPGPGFANSTTSPSSG

SEQ ID NO: 810856 - protein, 24 aa, Mycobacterium
EVGPTLHRLIRGADGRVIVACFAS

SEQ ID NO: 810857 - protein, 20 aa, Mycobacterium
EVGPWFRWASVGVDSAAALA

SEQ ID NO: 810858 - protein, 33 aa, Mycobacterium
EVGQSYPFTPPVGLMFVLWDTDETITSWLAKDP

SEQ ID NO: 810859 - protein, 17 aa, Mycobacterium
EVGRAQFFADLGVSMIT

SEQ ID NO: 810860 - protein, 24 aa, Mycobacterium
EVGRDWAAWAPRAALRTFTLDQLG

SEQ ID NO: 810861 - protein, 17 aa, Mycobacterium
EVGRLCVFLAGGQADFV

SEQ ID NO: 810862 - protein, 25 aa, Mycobacterium
EVGSERILFTHIAVPVMTRLKQPER

SEQ ID NO: 810863 - protein, 24 aa, Mycobacterium
EVGSGRLIAGLDDAIVGLSVDESR

SEQ ID NO: 810864 - protein, 24 aa, Mycobacterium
EVGSGRLIAGLDDALVGLSVDESR

SEQ ID NO: 810865 - protein, 24 aa, Mycobacterium
EVGSGRLIAGLDEALVGLSVDESK

SEQ ID NO: 810866 - protein, 19 aa, Mycobacterium
EVGSRAWAAMYLGTPRTPE

SEQ ID NO: 810867 - protein, 24 aa, Mycobacterium
EVGSWYVSTFPRSGFVTGLTAALV

SEQ ID NO: 810868 - protein, 19 aa, Mycobacterium
EVGVLRRDPMAMRPFLGYH

SEQ ID NO: 810869 - protein, 24 aa, Mycobacterium
EVGVTLLIPGGMHTPFFDGRTEQY

SEQ ID NO: 810870 - protein, 17 aa, Mycobacterium
EVGWRQAGLAARYIAHR

SEQ ID NO: 810871 - protein, 29 aa, Mycobacterium
EVGYDIRGLPWDVWKRELLGLGTEGLRKN

SEQ ID NO: 810872 - protein, 27 aa, Mycobacterium
EVGYFKGVMQLTHPAFLILDSPDGQHH

SEQ ID NO: 810873 - protein, 26 aa, Mycobacterium
EVHAAILDLLARICDPLTGIKEVWEV

SEQ ID NO: 810874 - protein, 22 aa, Mycobacterium
EVHAELPHMPLIGSGGIRTGMD

SEQ ID NO: 810875 - protein, 28 aa, Mycobacterium
EVHDGHFPGLYLLITGTPAFFEGRQGIP

SEQ ID NO: 810876 - protein, 17 aa, Mycobacterium
EVHGRIHEIRIDEMARA

SEQ ID NO: 810877 - protein, 18 aa, Mycobacterium
EVHLAARPGMLTAAELAE

SEQ ID NO: 810878 - protein, 17 aa, Mycobacterium
EVHLFVDPLGTSRMARA

SEQ ID NO: 810879 - protein, 20 aa, Mycobacterium
EVHVPQWRFAGENPGPATRL

SEQ ID NO: 810880 - protein, 17 aa, Mycobacterium
EVIADERTLLPDAVELV

SEQ ID NO: 810881 - protein, 26 aa, Mycobacterium
EVIDFERLWTVRALLPALSLGQRIRE

SEQ ID NO: 810882 - protein, 36 aa, Mycobacterium
EVIELRPDIDWDKGKTLRWVIDHLPDQRAAPLVPIY

SEQ ID NO: 810883 - protein, 25 aa, Mycobacterium
EVIELRPDIDWDKGKTLRWVIEHLR

SEQ ID NO: 810884 - protein, 35 aa, Mycobacterium
EVIELRPDMDWDKGKTLRWVLDHLTGAESGPLTPV

SEQ ID NO: 810885 - protein, 17 aa, Mycobacterium
EVIEVVEKLLASGAAYV

SEQ ID NO: 810886 - protein, 24 aa, Mycobacterium
EVIFGWRSFELYPPQVAVAGATAV

SEQ ID NO: 810887 - protein, 18 aa, Mycobacterium
EVIGRRLDLPTASVPAED

SEQ ID NO: 810888 - protein, 17 aa, Mycobacterium
EVIGVLRAVLFAPEDLA

SEQ ID NO: 810889 - protein, 19 aa, Mycobacterium
EVILDRKGNRHFSFGIGVH

SEQ ID NO: 810890 - protein, 20 aa, Mycobacterium
EVILPSFTFVSTANAFVLRG

SEQ ID NO: 810891 - protein, 21 aa, Mycobacterium
EVIPELQRMFAARCVNMADLA

SEQ ID NO: 810892 - protein, 35 aa, Mycobacterium
EVIPPDYQLSWFDHVFFVSAWWGWQDHFREIVNVD

SEQ ID NO: 810893 - protein, 24 aa, Mycobacterium
EVIPYTNKPLFLRTIIPSSNTVST

SEQ ID NO: 810894 - protein, 22 aa, Mycobacterium
EVIRFGMYGIALSRASGCWAAM

SEQ ID NO: 810895 - protein, 29 aa, Mycobacterium
EVIRRKAGLPPATYFSGAKLQWILENVDG

SEQ ID NO: 810896 - protein, 18 aa, Mycobacterium
EVIRVRGLTFAYPKASTP

SEQ ID NO: 810897 - protein, 24 aa, Mycobacterium
EVISISYGFFTPLSGFMGRREVDE

SEQ ID NO: 810898 - protein, 17 aa, Mycobacterium
EVISLLRSSPDADELVV

SEQ ID NO: 810899 - protein, 23 aa, Mycobacterium
EVKALRRGVFHNSRRLDNGNWTW

SEQ ID NO: 810900 - protein, 25 aa, Mycobacterium
EVKAMYPLGPIFHGSGLNITAMSLQ

SEQ ID NO: 810901 - protein, 25 aa, Mycobacterium
EVKAMYPLGPIFHGSGLNVTVMSLN

SEQ ID NO: 810902 - protein, 24 aa, Mycobacterium
EVKDDSEVLLLERACAAADTALAA

SEQ ID NO: 810903 - protein, 30 aa, Mycobacterium
EVKDGYGRNFLLPRGMAIVASRGAQKQADE

SEQ ID NO: 810904 - protein, 18 aa, Mycobacterium
EVKIPLVGGKIEGFVGGK

SEQ ID NO: 810905 - protein, 23 aa, Mycobacterium
EVKPISLVVGLIEELRKRNPDLD

SEQ ID NO: 810906 - protein, 25 aa, Mycobacterium
EVKQSMIDWWGPILYEYYSSTEGNG

SEQ ID NO: 810907 - protein, 22 aa, Mycobacterium
EVKRRIMIGAYALSAGYYDAYY

SEQ ID NO: 810908 - protein, 17 aa, Mycobacterium
EVKVAHAPLLALLTELM

SEQ ID NO: 810909 - protein, 19 aa, Mycobacterium
EVKVAHAPLLALLTELMEE

SEQ ID NO: 810910 - protein, 23 aa, Mycobacterium
EVKVGIQILESLNLRPRGLEIVS

SEQ ID NO: 810911 - protein, 24 aa, Mycobacterium
EVKVGIQILESLNLRPRGLEIVSC

SEQ ID NO: 810912 - protein, 26 aa, Mycobacterium
EVLAEKPELVLLDNFPVWQTQMAVQR

SEQ ID NO: 810913 - protein, 26 aa, Mycobacterium
EVLAKHLPIAMLLVKRGLMTRNQIAE

SEQ ID NO: 810914 - protein, 20 aa, Mycobacterium
EVLAMFYPRQVRFGRTEPVA

SEQ ID NO: 810915 - protein, 18 aa, Mycobacterium
EVLAMSLDVLCSRAASEV

SEQ ID NO: 810916 - protein, 21 aa, Mycobacterium
EVLAPLFDFLSLHGRPPRTGE

SEQ ID NO: 810917 - protein, 17 aa, Mycobacterium
EVLAPVAAVLSTDEWVL

SEQ ID NO: 810918 - protein, 22 aa, Mycobacterium
EVLARAVLVAVLAAERVAGIPT

SEQ ID NO: 810919 - protein, 25 aa, Mycobacterium
EVLARFRVKRPIRVTGWPPKGTDRG

SEQ ID NO: 810920 - protein, 24 aa, Mycobacterium
EVLARFRVQRPIRVTSWPPKGTDR

SEQ ID NO: 810921 - protein, 19 aa, Mycobacterium
EVLARPGARHRPAIAATIQ

SEQ ID NO: 810922 - protein, 17 aa, Mycobacterium
EVLARYLSITTATARRR

SEQ ID NO: 810923 - protein, 31 aa, Mycobacterium
EVLESVGTRVGRIIRIITRTVGEVAQEVSGV

SEQ ID NO: 810924 - protein, 18 aa, Mycobacterium
EVLFSSQMYLHQVALGLA

SEQ ID NO: 810925 - protein, 24 aa, Mycobacterium
EVLGRPWRDMRRPTIPGVAQAKDG

SEQ ID NO: 810926 - protein, 33 aa, Mycobacterium
EVLGSPFPQSPAPGGPMPLDPAPTAPVTSRDQL

SEQ ID NO: 810927 - protein, 24 aa, Mycobacterium
EVLGVWNFFTKIANIVSPAHSWPK

SEQ ID NO: 810928 - protein, 19 aa, Mycobacterium
EVLHGLRGWLSAPVIVLSA

SEQ ID NO: 810929 - protein, 22 aa, Mycobacterium
EVLIIGRRGPLQAPFTTLELRE

SEQ ID NO: 810930 - protein, 21 aa, Mycobacterium
EVLIQLCHRLLTGTRGVAMTL

SEQ ID NO: 810931 - protein, 23 aa, Mycobacterium
EVLKATWLHGYSLTYLQPNENIN

SEQ ID NO: 810932 - protein, 18 aa, Mycobacterium
EVLKLINWELASSTDTAP

SEQ ID NO: 810933 - protein, 23 aa, Mycobacterium
EVLKLLSDGTLPKGDAIATARLA

SEQ ID NO: 810934 - protein, 21 aa, Mycobacterium
EVLLIEPFYDSYSPVLAMAGA

SEQ ID NO: 810935 - protein, 25 aa, Mycobacterium
EVLLRGMHLYSEAFGRLANSLGIKS

SEQ ID NO: 810936 - protein, 18 aa, Mycobacterium
EVLLSGLSGIRGVTGVPS

SEQ ID NO: 810937 - protein, 21 aa, Mycobacterium
EVLLWSGDLFERAATAALRLA

SEQ ID NO: 810938 - protein, 27 aa, Mycobacterium
EVLPEKPELILLDNFPVWQTQMAVQRR

SEQ ID NO: 810939 - protein, 26 aa, Mycobacterium
EVLPEKPELILLDNFPVWQTQTAVQR

SEQ ID NO: 810940 - protein, 25 aa, Mycobacterium
EVLPGLTIPGKLDKLGYKGIDTTEL

SEQ ID NO: 810941 - protein, 21 aa, Mycobacterium
EVLPLYARLPTADQQKVFAPH

SEQ ID NO: 810942 - protein, 28 aa, Mycobacterium
EVLPPYMVPAAFMLIDQLPLTVNGKLDR

SEQ ID NO: 810943 - protein, 19 aa, Mycobacterium
EVLRAWGKLGYPRRAKRLH

SEQ ID NO: 810944 - protein, 17 aa, Mycobacterium
EVLRFDLARHRIGVSLV

SEQ ID NO: 810945 - protein, 22 aa, Mycobacterium
EVLRGLPPQPVLVGASLGGFTS

SEQ ID NO: 810946 - protein, 19 aa, Mycobacterium
EVLRMKYFDQEMVAWRAAS

SEQ ID NO: 810947 - protein, 21 aa, Mycobacterium
EVLRNMLYADSPALPGLSYVV

SEQ ID NO: 810948 - protein, 25 aa, Mycobacterium
EVLRPGLLVLPVRGAARYFGSEADA

SEQ ID NO: 810949 - protein, 19 aa, Mycobacterium
EVLRPLLEELGLVAYPKTS

SEQ ID NO: 810950 - protein, 28 aa, Mycobacterium
EVLRTLREQIPGLPLLLLTAKDSVEDRI

SEQ ID NO: 810951 - protein, 36 aa, Mycobacterium
EVLRTWMSGISRKGPWTVPPRLRLVTRMCSTTLDFT

SEQ ID NO: 810952 - protein, 24 aa, Mycobacterium
EVLRTYLELVLDGLVARLASGDDP

SEQ ID NO: 810953 - protein, 22 aa, Mycobacterium
EVLRVCAALELLHTCALIHDDV

SEQ ID NO: 810954 - protein, 17 aa, Mycobacterium
EVLRVVKFWVSHGVKVF

SEQ ID NO: 810955 - protein, 24 aa, Mycobacterium
EVLRVVRHWIDHGVKFFRVDNPHT

SEQ ID NO: 810956 - protein, 31 aa, Mycobacterium
EVLSNLMHWPSVERVWMPEWLNYREATLERL

SEQ ID NO: 810957 - protein, 19 aa, Mycobacterium
EVLTGFRIHPGGAAAHFGV

SEQ ID NO: 810958 - protein, 20 aa, Mycobacterium
EVLTRVGYELANHGESLLVL

SEQ ID NO: 810959 - protein, 21 aa, Mycobacterium
EVLVIEPFYDSYSPVIAMAGC

SEQ ID NO: 810960 - protein, 18 aa, Mycobacterium
EVLVPFVSAIVLSVSLDD

SEQ ID NO: 810961 - protein, 20 aa, Mycobacterium
EVMAGLERRFSAAAGGQVPP

SEQ ID NO: 810962 - protein, 20 aa, Mycobacterium
EVMARAVGFHLNRGVLASAS

SEQ ID NO: 810963 - protein, 19 aa, Mycobacterium
EVMARRDEVLRSRGIEPNG

SEQ ID NO: 810964 - protein, 20 aa, Mycobacterium
EVMDELGIDFALMFPTLASL

SEQ ID NO: 810965 - protein, 18 aa, Mycobacterium
EVMEWFAEPFAARAQCAF

SEQ ID NO: 810966 - protein, 27 aa, Mycobacterium
EVMIGWRSFECYLPIIQVSGATTVRVP

SEQ ID NO: 810967 - protein, 35 aa, Mycobacterium
EVMMEIFARHPGFVHSFPPMPLQPNGFMTPDEVAD

SEQ ID NO: 810968 - protein, 23 aa, Mycobacterium
EVMRSLGLPTMFPTIGGHEGAGI

SEQ ID NO: 810969 - protein, 38 aa, Mycobacterium
EVMTDSLLHLFLAGGKRFRPLFTVLSAQVGPNPGADEV

SEQ ID NO: 810970 - protein, 25 aa, Mycobacterium
EVNADLLFAQTYIDQARLADTIRAV

SEQ ID NO: 810971 - protein, 27 aa, Mycobacterium
EVNALARRLLVKRYGAAVLGPYTSKRQ

SEQ ID NO: 810972 - protein, 25 aa, Mycobacterium
EVNCPVLHELTLMAPLAISESGVPV

SEQ ID NO: 810973 - protein, 20 aa, Mycobacterium
EVNEWARRALGLLVHDHFGQ

SEQ ID NO: 810974 - protein, 17 aa, Mycobacterium
EVNFWRQQLAGVPTEIA

SEQ ID NO: 810975 - protein, 23 aa, Mycobacterium
EVNGALLRRKFRPGNAAMTPLQR

SEQ ID NO: 810976 - protein, 24 aa, Mycobacterium
EVNHEPFLTLGIHIGARTTSIVAA

SEQ ID NO: 810977 - protein, 24 aa, Mycobacterium
EVNKKKIHRLWREEGLQVRVHSPR

SEQ ID NO: 810978 - protein, 21 aa, Mycobacterium
EVNLAGFYDLTQTLGGVEVCL

SEQ ID NO: 810979 - protein, 24 aa, Mycobacterium
EVNRKKIHRLWREEGLQVRVHSPR

SEQ ID NO: 810980 - protein, 24 aa, Mycobacterium
EVNSARIFAGAGTGPMLAAAAAWD

SEQ ID NO: 810981 - protein, 21 aa, Mycobacterium
EVNSARMFAGAGSGPTLTAAA

SEQ ID NO: 810982 - protein, 17 aa, Mycobacterium
EVNSARMYAGPGSGPML

SEQ ID NO: 810983 - protein, 24 aa, Mycobacterium
EVNSGLMYAGPGAGPMLAAAAGWD

SEQ ID NO: 810984 - protein, 23 aa, Mycobacterium
EVNSGLMYAGPGPGSMLTSATAW

SEQ ID NO: 810985 - protein, 25 aa, Mycobacterium
EVNSGRMYLGPGPATLLAASAAWES

SEQ ID NO: 810986 - protein, 18 aa, Mycobacterium
EVNSGRMYSGPGAGPMLA

SEQ ID NO: 810987 - protein, 25 aa, Mycobacterium
EVNSLRMYSGPGSAPLLAAVAAWDG

SEQ ID NO: 810988 - protein, 28 aa, Mycobacterium
EVNSRRWAGVPFYLRTGKRLGRRVTEIA

SEQ ID NO: 810989 - protein, 17 aa, Mycobacterium
EVNVAYGLYPAWRGRGL

SEQ ID NO: 810990 - protein, 25 aa, Mycobacterium
EVPALGLVALFERLGFEGDLALELR

SEQ ID NO: 810991 - protein, 22 aa, Mycobacterium
EVPDGEVWVHCASGYRSSIAAS

SEQ ID NO: 810992 - protein, 20 aa, Mycobacterium
EVPDGVPWWDPLADNAVDPA

SEQ ID NO: 810993 - protein, 20 aa, Mycobacterium
EVPEYLLAVLARFARNLRES

SEQ ID NO: 810994 - protein, 29 aa, Mycobacterium
EVPFFTDFARRYTDLPFLIKLEERGDMLV

SEQ ID NO: 810995 - protein, 22 aa, Mycobacterium
EVPGTIVSVLRAAAAAVEQCAG

SEQ ID NO: 810996 - protein, 19 aa, Mycobacterium
EVPGTIVSVLRAAATAVQQ

SEQ ID NO: 810997 - protein, 29 aa, Mycobacterium
EVPHGRDEIWRFTPLRRLRGLHDGSAHAT

SEQ ID NO: 810998 - protein, 27 aa, Mycobacterium
EVPHGRDEIWRFTPLRRLRGLHNGTAG

SEQ ID NO: 810999 - protein, 27 aa, Mycobacterium
EVPHGRDELWRFTPLKRLRGLHDGSAA

SEQ ID NO: 811000 - protein, 27 aa, Mycobacterium
EVPHGRDELWRFTPLKRLRGLHDGSAP

SEQ ID NO: 811001 - protein, 22 aa, Mycobacterium
EVPIQRPIFVTGLVRTGTTALH

SEQ ID NO: 811002 - protein, 18 aa, Mycobacterium
EVPIVSGSSFRGVLRRIG

SEQ ID NO: 811003 - protein, 17 aa, Mycobacterium
EVPKTSVGKFDKKELRK

SEQ ID NO: 811004 - protein, 25 aa, Mycobacterium
EVPNEPYLRLLLEEPSHALLRSVTS

SEQ ID NO: 811005 - protein, 18 aa, Mycobacterium
EVPPLDASGLRLALVAST

SEQ ID NO: 811006 - protein, 17 aa, Mycobacterium
EVPPLPGYPTEGLLQWF

SEQ ID NO: 811007 - protein, 18 aa, Mycobacterium
EVPPLPVVSWMYESEIYR

SEQ ID NO: 811008 - protein, 21 aa, Mycobacterium
EVPQEFVSYVPQPLPRAVADH

SEQ ID NO: 811009 - protein, 22 aa, Mycobacterium
EVPRDFIIEPQPFTQGNGLLTG

SEQ ID NO: 811010 - protein, 27 aa, Mycobacterium
EVPSGRDEIWRFTPLRRLRGLHDGSAR

SEQ ID NO: 811011 - protein, 43 aa, Mycobacterium
EVPSHKLLIRAGYIRPVAPGLYSWLPLGLRVLRRIERIVREEM

SEQ ID NO: 811012 - protein, 43 aa, Mycobacterium
EVPSHKLLIRAGYIRPVGPGLYSWLPLGLRVLRNIERVIREEM

SEQ ID NO: 811013 - protein, 18 aa, Mycobacterium
EVPVRIQHRSGVQWTLNT

SEQ ID NO: 811014 - protein, 29 aa, Mycobacterium
EVQALARSWRWLPPWPDSVDGIAVMKRHV

SEQ ID NO: 811015 - protein, 23 aa, Mycobacterium
EVQEFIAGFWYHYDQGHFEELAS

SEQ ID NO: 811016 - protein, 26 aa, Mycobacterium
EVQEFIARFWYHYDQGQFDVLAGFIA

SEQ ID NO: 811017 - protein, 24 aa, Mycobacterium
EVQIGKFRLVFLTGPKQGDDDGGT

SEQ ID NO: 811018 - protein, 20 aa, Mycobacterium
EVQIPPLIATLPVAVTGDTA

SEQ ID NO: 811019 - protein, 20 aa, Mycobacterium
EVQKLPLNVTWVNLTTGKSG

SEQ ID NO: 811020 - protein, 25 aa, Mycobacterium
EVQLFEQAFRRRMPVMLTGPTGCGK

SEQ ID NO: 811021 - protein, 27 aa, Mycobacterium
EVQPLGFLMYRVMAVLQPAVAAQLQQL

SEQ ID NO: 811022 - protein, 21 aa, Mycobacterium
EVQRLHYLSVPPDAARAVITM

SEQ ID NO: 811023 - protein, 20 aa, Mycobacterium
EVQTIFTHPPGYWHDHSIAI

SEQ ID NO: 811024 - protein, 18 aa, Mycobacterium
EVQTVQRSLLGQMLTSRP

SEQ ID NO: 811025 - protein, 19 aa, Mycobacterium
EVQVRMFEVVPNPAWVARP

SEQ ID NO: 811026 - protein, 40 aa, Mycobacterium
EVRAAVAMTLTSRFPIVLWLSPTDLFLMYNDAYAQILGDK

SEQ ID NO: 811027 - protein, 18 aa, Mycobacterium
EVRAMRNLLRREHAAPGR

SEQ ID NO: 811028 - protein, 21 aa, Mycobacterium
EVRAMWNLPRPPRPESNGGGS

SEQ ID NO: 811029 - protein, 27 aa, Mycobacterium
EVREYIDWQPFFNAWEMKGRFPDILNN

SEQ ID NO: 811030 - protein, 25 aa, Mycobacterium
EVRGEVFFRVADFQALNASLVEEGK

SEQ ID NO: 811031 - protein, 23 aa, Mycobacterium
EVRGLLAQHRFVTLTGAGGAGKT

SEQ ID NO: 811032 - protein, 21 aa, Mycobacterium
EVRGLVDMTAAATPKALGETQ

SEQ ID NO: 811033 - protein, 18 aa, Mycobacterium
EVRGPWITGAYYLGYDQS

SEQ ID NO: 811034 - protein, 27 aa, Mycobacterium
EVRIAAPLALLPPWDDALERSDREHHA

SEQ ID NO: 811035 - protein, 25 aa, Mycobacterium
EVRIVEFTARRPFHPVRLHAAIDLL

SEQ ID NO: 811036 - protein, 25 aa, Mycobacterium
EVRKDGLLPYLRPDGKTQVTIEYDG

SEQ ID NO: 811037 - protein, 31 aa, Mycobacterium
EVRLDPSGSGWRWLASALWGEILLSQHADTW

SEQ ID NO: 811038 - protein, 22 aa, Mycobacterium
EVRLGTLPLLDAVLAAVSVPVL

SEQ ID NO: 811039 - protein, 18 aa, Mycobacterium
EVRLLSRFTGANPHVALV

SEQ ID NO: 811040 - protein, 24 aa, Mycobacterium
EVRLRAAQHLPWHPGRCAEVLVGD

SEQ ID NO: 811041 - protein, 17 aa, Mycobacterium
EVRLVHRDILQGGPTTL

SEQ ID NO: 811042 - protein, 30 aa, Mycobacterium
EVRNFLVANALFWLDQFHIDGLRVDAVASM

SEQ ID NO: 811043 - protein, 30 aa, Mycobacterium
EVRNFLVANALYWIEQFHIDGLRVDAVASM

SEQ ID NO: 811044 - protein, 25 aa, Mycobacterium
EVRNFLVANALYWLEEYHVDGLRVD

SEQ ID NO: 811045 - protein, 23 aa, Mycobacterium
EVRPALIGHTVVRREPIGVVGAI

SEQ ID NO: 811046 - protein, 17 aa, Mycobacterium
EVRPDIMAWKHRKLIMN

SEQ ID NO: 811047 - protein, 30 aa, Mycobacterium
EVRPDRSTTLALRWLVTFSRARREKTMVER

SEQ ID NO: 811048 - protein, 31 aa, Mycobacterium
EVRPDVPALQRVLFIGTADWDTLRAAGSGVD

SEQ ID NO: 811049 - protein, 20 aa, Mycobacterium
EVRPILLWHALEECEHKAVA

SEQ ID NO: 811050 - protein, 28 aa, Mycobacterium
EVRPMLERFRAMEPWLVGGRVHAPFWEV

SEQ ID NO: 811051 - protein, 25 aa, Mycobacterium
EVRPVVLERGFFGRLSAKLGFGAKA

SEQ ID NO: 811052 - protein, 32 aa, Mycobacterium
EVRQLMLLDAPSVLGWAGFRDVAQRYSLGMTE

SEQ ID NO: 811053 - protein, 26 aa, Mycobacterium
EVRQQFSLLFTTTVLGGTLAIDHEST

SEQ ID NO: 811054 - protein, 26 aa, Mycobacterium
EVRRAIDVLRFFGSAGWRPSGETLPS

SEQ ID NO: 811055 - protein, 17 aa, Mycobacterium
EVRRALPRWIGQGQAAA

SEQ ID NO: 811056 - protein, 25 aa, Mycobacterium
EVRRAWPRAQIVFVRPRFLDDPTDD

SEQ ID NO: 811057 - protein, 27 aa, Mycobacterium
EVRRLLDRASRWFLANRQQPLAVDAEI

SEQ ID NO: 811058 - protein, 17 aa, Mycobacterium
EVRRLTGEAPAALRRRV

SEQ ID NO: 811059 - protein, 19 aa, Mycobacterium
EVRRRGCRRVVVASYLLSE

SEQ ID NO: 811060 - protein, 25 aa, Mycobacterium
EVRRRNLLPTSAFPHRMPSGYQIDS

SEQ ID NO: 811061 - protein, 20 aa, Mycobacterium
EVRRYFGAKVLRTVIPRSVK

SEQ ID NO: 811062 - protein, 25 aa, Mycobacterium
EVRRYFRDHGWSLKVPRRLKELNVR

SEQ ID NO: 811063 - protein, 17 aa, Mycobacterium
EVRRYFRDYSWGMRVPR

SEQ ID NO: 811064 - protein, 25 aa, Mycobacterium
EVRSALLSLTCPWNLTGHPALSVPA

SEQ ID NO: 811065 - protein, 17 aa, Mycobacterium
EVRSQLALTWGTETFIV

SEQ ID NO: 811066 - protein, 18 aa, Mycobacterium
EVRSQLALTWGTETFIVP

SEQ ID NO: 811067 - protein, 22 aa, Mycobacterium
EVRSQLALTWGTETFIVPVMET

SEQ ID NO: 811068 - protein, 24 aa, Mycobacterium
EVRVGIGYHIPGGLFGKAAATLFG

SEQ ID NO: 811069 - protein, 27 aa, Mycobacterium
EVSAAIAALFSFHGQSYQTLGAQAEAF

SEQ ID NO: 811070 - protein, 18 aa, Mycobacterium
EVSAAVAALFSDHAHNYQ

SEQ ID NO: 811071 - protein, 25 aa, Mycobacterium
EVSALTALQFAAHAQMYQAVSAQAA

SEQ ID NO: 811072 - protein, 40 aa, Mycobacterium
EVSAPAKKWLAARGFDPIYGARPLRRLVQQSIGDQLAKQL

SEQ ID NO: 811073 - protein, 25 aa, Mycobacterium
EVSAQLAAVFGDYARQFQALSARAE

SEQ ID NO: 811074 - protein, 17 aa, Mycobacterium
EVSDGLFLRLAVTSVDS

SEQ ID NO: 811075 - protein, 18 aa, Mycobacterium
EVSGGRPFDEACAGPWWA

SEQ ID NO: 811076 - protein, 37 aa, Mycobacterium
EVSGNRFYLDLLNSLGPMMIMLPRTRLGDAHSITDAA

SEQ ID NO: 811077 - protein, 23 aa, Mycobacterium
EVSGPLLRRKFRPGNAAMEPLRK

SEQ ID NO: 811078 - protein, 17 aa, Mycobacterium
EVSNLVVYLASDESSYS

SEQ ID NO: 811079 - protein, 28 aa, Mycobacterium
EVSRKVILKLFGPLLDAAATLGAGLDWK

SEQ ID NO: 811080 - protein, 22 aa, Mycobacterium
EVSRLAFGTWAFSSDWGQADED

SEQ ID NO: 811081 - protein, 24 aa, Mycobacterium
EVSRYVLHQWTYLDLPAGPSASPV

SEQ ID NO: 811082 - protein, 17 aa, Mycobacterium
EVSTFVVFLASDDASYA

SEQ ID NO: 811083 - protein, 22 aa, Mycobacterium
EVSTVVASLFSRYAQAYQVLGA

SEQ ID NO: 811084 - protein, 21 aa, Mycobacterium
EVSVRALIDFTIDTFGRLDIV

SEQ ID NO: 811085 - protein, 17 aa, Mycobacterium
EVSWMRQPARYRDTARR

SEQ ID NO: 811086 - protein, 19 aa, Mycobacterium
EVSWSNRKIFTPTLFDCGT

SEQ ID NO: 811087 - protein, 22 aa, Mycobacterium
EVTATTMRLLGSLPARRQPPKT

SEQ ID NO: 811088 - protein, 17 aa, Mycobacterium
EVTEIRWDPSDSRWVIA

SEQ ID NO: 811089 - protein, 23 aa, Mycobacterium
EVTGIAIFDLLSMAAKTGIASPA

SEQ ID NO: 811090 - protein, 18 aa, Mycobacterium
EVTGWLRRKRLDERRFLT

SEQ ID NO: 811091 - protein, 18 aa, Mycobacterium
EVTGWLRRKRYDERLFLE

SEQ ID NO: 811092 - protein, 25 aa, Mycobacterium
EVTHYLFKHPGVDFIWVTGGPKIVA

SEQ ID NO: 811093 - protein, 20 aa, Mycobacterium
EVTKFLVYNARKRQAGGDTA

SEQ ID NO: 811094 - protein, 17 aa, Mycobacterium
EVTLGLARPVWVDDRDF

SEQ ID NO: 811095 - protein, 18 aa, Mycobacterium
EVTLKLLPAQHPACTVVA

SEQ ID NO: 811096 - protein, 23 aa, Mycobacterium
EVTLPREWGDWATRAKMPTLRIP

SEQ ID NO: 811097 - protein, 17 aa, Mycobacterium
EVTLTEALLKRIESAAA

SEQ ID NO: 811098 - protein, 19 aa, Mycobacterium
EVTLTTHPAGFERTFRLER

SEQ ID NO: 811099 - protein, 17 aa, Mycobacterium
EVTLTTHPAGFNRTFRL

SEQ ID NO: 811100 - protein, 27 aa, Mycobacterium
EVTPDELILRRLLPMADEGLRRWEVAA

SEQ ID NO: 811101 - protein, 24 aa, Mycobacterium
EVTREVLGAGIPLFGICFGNQILG

SEQ ID NO: 811102 - protein, 20 aa, Mycobacterium
EVTRRRFLRHVSDQSDPNLL

SEQ ID NO: 811103 - protein, 23 aa, Mycobacterium
EVTRYFVPRFAATPIARGSEQAR

SEQ ID NO: 811104 - protein, 19 aa, Mycobacterium
EVTRYLLWTPHPDVGETRR

SEQ ID NO: 811105 - protein, 24 aa, Mycobacterium
EVTSAIRWVLGRKRIRSGIRLVGT

SEQ ID NO: 811106 - protein, 19 aa, Mycobacterium
EVTVRYFAAARAAAGIECE

SEQ ID NO: 811107 - protein, 20 aa, Mycobacterium
EVVALRKAGGLAAGAIAVVT

SEQ ID NO: 811108 - protein, 24 aa, Mycobacterium
EVVAPARIRAAVLAAMRAAHPYEE

SEQ ID NO: 811109 - protein, 36 aa, Mycobacterium
EVVAQQLIPFGPVMTARAPWLRRAGLLGPNSTQERI

SEQ ID NO: 811110 - protein, 30 aa, Mycobacterium
EVVASATGDFRFFAAPGDWTLRALSSAGNG

SEQ ID NO: 811111 - protein, 30 aa, Mycobacterium; identical to SEQ ID NO: 114408

SEQ ID NO: 811112 - protein, 30 aa, Mycobacterium
EVVASATGDFRFFAAPGSWTLRALSAVGNG

SEQ ID NO: 811113 - protein, 29 aa, Mycobacterium
EVVASATGDFRFFAAPGSWTVRALSKAGN

SEQ ID NO: 811114 - protein, 29 aa, Mycobacterium
EVVASATGDFRFFAAPGSWTVRALSKVGN

SEQ ID NO: 811115 - protein, 29 aa, Mycobacterium
EVVASATGDFRFFAAPGTWTVRALSSAGN

SEQ ID NO: 811116 - protein, 25 aa, Mycobacterium
EVVEALRFHLRDLAVTFRFGEEVTT

SEQ ID NO: 811117 - protein, 19 aa, Mycobacterium
EVVELYNLVVWNEQNLELA

SEQ ID NO: 811118 - protein, 30 aa, Mycobacterium
EVVFERIEDVWLPLFRPRTDAQPRPLPVDE

SEQ ID NO: 811119 - protein, 21 aa, Mycobacterium
EVVFPLAADDLPYLHPVTVVN

SEQ ID NO: 811120 - protein, 18 aa, Mycobacterium
EVVFVPSGQPWQKGRRVS

SEQ ID NO: 811121 - protein, 20 aa, Mycobacterium
EVVGPRRRQGGRGPVFELGI

SEQ ID NO: 811122 - protein, 24 aa, Mycobacterium
EVVGQDHLLAAGSPLRRLVEGSGV

SEQ ID NO: 811123 - protein, 18 aa, Mycobacterium
EVVGQDHLLKPNSPLRRL

SEQ ID NO: 811124 - protein, 27 aa, Mycobacterium
EVVGQGHLLAPGAPLRRLVEGSGVASV

SEQ ID NO: 811125 - protein, 26 aa, Mycobacterium
EVVGQSHLLQAGSPLRRLVEGSGAAS

SEQ ID NO: 811126 - protein, 27 aa, Mycobacterium
EVVHAPDLHFLIFFDQPTPADVGYRTS

SEQ ID NO: 811127 - protein, 18 aa, Mycobacterium
EVVHPRAKRKLSDGAAVV

SEQ ID NO: 811128 - protein, 17 aa, Mycobacterium
EVVIGSALAAVLVRGPD

SEQ ID NO: 811129 - protein, 19 aa, Mycobacterium
EVVLHLERAGVIPALDRSQ

SEQ ID NO: 811130 - protein, 32 aa, Mycobacterium
EVVLIPGPTALLAPAWVPWDQRVRPGDLSPGD

SEQ ID NO: 811131 - protein, 24 aa, Mycobacterium
EVVLPRLEIPHLLVELVQPTSPDG

SEQ ID NO: 811132 - protein, 19 aa, Mycobacterium
EVVLRLRALLRRTGIAGDS

SEQ ID NO: 811133 - protein, 28 aa, Mycobacterium
EVVMNPLVGGLPLDAGWASLQLLTDEVL

SEQ ID NO: 811134 - protein, 18 aa, Mycobacterium
EVVPARAPWSTVVAAGDV

SEQ ID NO: 811135 - protein, 17 aa, Mycobacterium
EVVPLYKERYVLLVSGD

SEQ ID NO: 811136 - protein, 19 aa, Mycobacterium
EVVPRRPVIRPVPVDDSGF

SEQ ID NO: 811137 - protein, 21 aa, Mycobacterium
EVVPVRIPQRKGDPIEFAEDE

SEQ ID NO: 811138 - protein, 25 aa, Mycobacterium
EVVQRALQQLGVQMTWTVSRCEQMT

SEQ ID NO: 811139 - protein, 29 aa, Mycobacterium
EVVRDRERILWFLAEIARRYDPHDEQAQQ

SEQ ID NO: 811140 - protein, 23 aa, Mycobacterium
EVVRKLWDSWEDDAVIRDVTTGR

SEQ ID NO: 811141 - protein, 28 aa, Mycobacterium
EVVRLDDIYPGWDGLSWASEHVGSALLE

SEQ ID NO: 811142 - protein, 18 aa, Mycobacterium
EVVRTEGPWRLIIAQHFA

SEQ ID NO: 811143 - protein, 26 aa, Mycobacterium
EVVSAVFYNFALARVAKALPAAWEIA

SEQ ID NO: 811144 - protein, 17 aa, Mycobacterium
EVVTDLLILRRRDPRTP

SEQ ID NO: 811145 - protein, 20 aa, Mycobacterium
EVVTPNLRKWRIFERNDFSA

SEQ ID NO: 811146 - protein, 21 aa, Mycobacterium
EVVTVFLAPPSWQDLEARLVG

SEQ ID NO: 811147 - protein, 23 aa, Mycobacterium
EVVVEGRWKGSIARIPAGQNGFG

SEQ ID NO: 811148 - protein, 21 aa, Mycobacterium
EVVVGLPRTLADRTGPSALDA

SEQ ID NO: 811149 - protein, 19 aa, Mycobacterium
EVVVLTGIHLDWCIEGNAR

SEQ ID NO: 811150 - protein, 19 aa, Mycobacterium
EVVVPLHILTPNEPPTGWA

SEQ ID NO: 811151 - protein, 20 aa, Mycobacterium
EVVYLAHHIAGERQLWVGHE

SEQ ID NO: 811152 - protein, 17 aa, Mycobacterium
EVWAAREAGLGATAYPP

SEQ ID NO: 811153 - protein, 17 aa, Mycobacterium
EVWACGYGRPKFAKAVA

SEQ ID NO: 811154 - protein, 22 aa, Mycobacterium
EVWEGFIFINLDPAAAPLSEYL

SEQ ID NO: 811155 - protein, 19 aa, Mycobacterium
EVWLRNLYIAEYQHGSWTN

SEQ ID NO: 811156 - protein, 17 aa, Mycobacterium
EVWMQPSGTLGLVGFAT

SEQ ID NO: 811157 - protein, 27 aa, Mycobacterium
EVWPGYGPAPVWNFPATLTNLSPGAVP

SEQ ID NO: 811158 - protein, 18 aa, Mycobacterium
EVWRIRISKLTTTPLPRV

SEQ ID NO: 811159 - protein, 18 aa, Mycobacterium
EVWTFNGAIIPNIGLNAV

SEQ ID NO: 811160 - protein, 19 aa, Mycobacterium
EVWVSPHDRPLTDDELRHA

SEQ ID NO: 811161 - protein, 19 aa, Mycobacterium
EVWWHTRKLKAEAAPAPSY

SEQ ID NO: 811162 - protein, 23 aa, Mycobacterium
EVYAFLGGIFGRGLEKEGLGDKL

SEQ ID NO: 811163 - protein, 17 aa, Mycobacterium
EVYFREAGNPRNPALLL

SEQ ID NO: 811164 - protein, 25 aa, Mycobacterium
EVYGKPQFWPLWEAAADANLPVAVH

SEQ ID NO: 811165 - protein, 26 aa, Mycobacterium
EVYGKPQFWPLWEAAVDAGWPVAVHF

SEQ ID NO: 811166 - protein, 26 aa, Mycobacterium
EVYIHRLRKYIGAYLAILGSADVITF

SEQ ID NO: 811167 - protein, 25 aa, Mycobacterium
EVYLNMYRNLYDLDCSHIAPANVYG

SEQ ID NO: 811168 - protein, 26 aa, Mycobacterium
EVYPHPATVVLFRLARTLKYKAKPGR

SEQ ID NO: 811169 - protein, 20 aa, Mycobacterium
EVYPRLQAAQRRAPVAIGPY

SEQ ID NO: 811170 - protein, 24 aa, Mycobacterium
EVYQACVCTQFTGVLDGDPLEFFT

SEQ ID NO: 811171 - protein, 17 aa, Mycobacterium
EVYRPRLSGPVPSEEDV

SEQ ID NO: 811172 - protein, 23 aa, Mycobacterium
EVYYRAMFSGRVTSWNLRDQHMA

SEQ ID NO: 811173 - protein, 17 aa, Mycobacterium
EWADIHGGLQRSGTPAA

SEQ ID NO: 811174 - protein, 17 aa, Mycobacterium
EWAEIHGGLHRSGTLAK

SEQ ID NO: 811175 - protein, 20 aa, Mycobacterium
EWAQLLMATVRVASWPGLLS

SEQ ID NO: 811176 - protein, 24 aa, Mycobacterium
EWAQYSYIRFARLAADPRTGVSLR

SEQ ID NO: 811177 - protein, 18 aa, Mycobacterium
EWARQEFEYLRTFEGSPT

SEQ ID NO: 811178 - protein, 20 aa, Mycobacterium
EWATIHMYSSLSAALGEEIT

SEQ ID NO: 811179 - protein, 25 aa, Mycobacterium
EWATNDARFLLYPAMKKLTLDIASM

SEQ ID NO: 811180 - protein, 18 aa, Mycobacterium
EWAVAEDGWIAIPHGEIL

SEQ ID NO: 811181 - protein, 19 aa, Mycobacterium
EWDGYTPPVPAQGLGVREF

SEQ ID NO: 811182 - protein, 17 aa, Mycobacterium
EWDIDYPTARLAPTSTV

SEQ ID NO: 811183 - protein, 17 aa, Mycobacterium
EWDLLNLLAPADDGRRA

SEQ ID NO: 811184 - protein, 19 aa, Mycobacterium
EWDPFPEFLDELRAAGAEV

SEQ ID NO: 811185 - protein, 23 aa, Mycobacterium
EWDPVLVRAFLRGPMHGAVSPPN

SEQ ID NO: 811186 - protein, 19 aa, Mycobacterium
EWDRVVATNLRGTFLATRA

SEQ ID NO: 811187 - protein, 19 aa, Mycobacterium
EWDVARKSYRPAWCTVREI

SEQ ID NO: 811188 - protein, 19 aa, Mycobacterium
EWERILAAPGCCATPVLSL

SEQ ID NO: 811189 - protein, 25 aa, Mycobacterium
EWFATAYVDGFRWVMPTNVVGMSQH

SEQ ID NO: 811190 - protein, 19 aa, Mycobacterium
EWGFAGYVRHFIDKPTIAA

SEQ ID NO: 811191 - protein, 19 aa, Mycobacterium
EWGIDGVRLRPAANALDIP

SEQ ID NO: 811192 - protein, 17 aa, Mycobacterium
EWGLDEILLPSTGPAEI

SEQ ID NO: 811193 - protein, 17 aa, Mycobacterium
EWGLEYLFGVLEAGPAG

SEQ ID NO: 811194 - protein, 18 aa, Mycobacterium
EWGPGLTNLEYAPLAEIL

SEQ ID NO: 811195 - protein, 20 aa, Mycobacterium
EWGRANYPIVPGHEIAGVIT

SEQ ID NO: 811196 - protein, 21 aa, Mycobacterium
EWGRPLRGGVALFERMSLEAF

SEQ ID NO: 811197 - protein, 23 aa, Mycobacterium
EWGRPLYGQVALFERMSLEAFQS

SEQ ID NO: 811198 - protein, 27 aa, Mycobacterium
EWHDVMEALLLGAFISEGFVSPTRAGF

SEQ ID NO: 811199 - protein, 20 aa, Mycobacterium
EWHFTIFFDQPTPGDIGYRA

SEQ ID NO: 811200 - protein, 17 aa, Mycobacterium
EWHQRHPGVRVYPVTTK

SEQ ID NO: 811201 - protein, 19 aa, Mycobacterium
EWHYFFENTCRWRDLRKIT

SEQ ID NO: 811202 - protein, 24 aa, Mycobacterium
EWIEELIERRLTWALDSLDTADFD

SEQ ID NO: 811203 - protein, 18 aa, Mycobacterium
EWILHALTHPCEPAPWSI

SEQ ID NO: 811204 - protein, 27 aa, Mycobacterium
EWKDGEALFLRCNIWREAAENVAESLV

SEQ ID NO: 811205 - protein, 33 aa, Mycobacterium
EWKRLLDRSAWAKRNPRRWSVIDAWAGLGMRLG

SEQ ID NO: 811206 - protein, 36 aa, Mycobacterium
EWKRMGIPLLMSRVRFIYFIGTEIFPGGRLPSVPMV

SEQ ID NO: 811207 - protein, 32 aa, Mycobacterium
EWKRTGYKFFPFAAWQAGAWWVLRFNFGFPEH

SEQ ID NO: 811208 - protein, 17 aa, Mycobacterium
EWLALWSEHYQLGEKLR

SEQ ID NO: 811209 - protein, 17 aa, Mycobacterium
EWLESFDGLLARSGPAR

SEQ ID NO: 811210 - protein, 17 aa, Mycobacterium
EWLHAGLLDLKTLPERG

SEQ ID NO: 811211 - protein, 17 aa, Mycobacterium
EWLLSHNGVVDRAVLPL

SEQ ID NO: 811212 - protein, 18 aa, Mycobacterium
EWLNYAALDVELLIELRG

SEQ ID NO: 811213 - protein, 20 aa, Mycobacterium
EWLQALADLCRTRDILLIVD

SEQ ID NO: 811214 - protein, 21 aa, Mycobacterium
EWMLGYVRFHRTYRGVIRAWF

SEQ ID NO: 811215 - protein, 21 aa, Mycobacterium
EWMPNFIDLLQRKLSRIGDAV

SEQ ID NO: 811216 - protein, 19 aa, Mycobacterium
EWMTRLMLGFGSDVQVLAP

SEQ ID NO: 811217 - protein, 19 aa, Mycobacterium
EWMVAFARHLEACGFESIV

SEQ ID NO: 811218 - protein, 22 aa, Mycobacterium
EWNAGLLYLRGHLEDLFLADVR

SEQ ID NO: 811219 - protein, 18 aa, Mycobacterium
EWNDLVRRGRWDAASDRL

SEQ ID NO: 811220 - protein, 18 aa, Mycobacterium
EWNDLVRRGRWRDAIERL

SEQ ID NO: 811221 - protein, 18 aa, Mycobacterium
EWNMWTRQFMRDHVAVIE

SEQ ID NO: 811222 - protein, 22 aa, Mycobacterium
EWNPALLALRAELERVFLAGVR

SEQ ID NO: 811223 - protein, 18 aa, Mycobacterium
EWNPLRWFEEDEPVYGHP

SEQ ID NO: 811224 - protein, 17 aa, Mycobacterium
EWNRYLAVNLTGTFLCI

SEQ ID NO: 811225 - protein, 18 aa, Mycobacterium
EWPAPQNLPPLWNVLEHR

SEQ ID NO: 811226 - protein, 24 aa, Mycobacterium
EWPENPRFLMCTPLSHAGAAFFTP

SEQ ID NO: 811227 - protein, 24 aa, Mycobacterium
EWPENPRFLMCTPLSHAGAAFFVP

SEQ ID NO: 811228 - protein, 18 aa, Mycobacterium
EWPETDWIRRWRPSASAP

SEQ ID NO: 811229 - protein, 18 aa, Mycobacterium
EWQLRVAAGEKLTFAQDD

SEQ ID NO: 811230 - protein, 25 aa, Mycobacterium
EWQMKAACRGVSTDIFYYAETQRGA

SEQ ID NO: 811231 - protein, 32 aa, Mycobacterium
EWQPTLGVAGLLTRLWDWLVDAAAGNFHAATA

SEQ ID NO: 811232 - protein, 19 aa, Mycobacterium
EWQRDFFDFGHVQALYLDL

SEQ ID NO: 811233 - protein, 22 aa, Mycobacterium
EWQRDFFDFGHVSALYMQLMKN

SEQ ID NO: 811234 - protein, 20 aa, Mycobacterium
EWRAVAKVSAWLLATGDTSD

SEQ ID NO: 811235 - protein, 27 aa, Mycobacterium
EWRDHGLRYLLVINGSLVNPSLRKTVT

SEQ ID NO: 811236 - protein, 18 aa, Mycobacterium
EWRRGTLPPGRIGVRKTK

SEQ ID NO: 811237 - protein, 24 aa, Mycobacterium
EWRTYQMSDHLPMWLELSIDDGQA

SEQ ID NO: 811238 - protein, 17 aa, Mycobacterium
EWRYDNDPAWVLKAKSQ

SEQ ID NO: 811239 - protein, 17 aa, Mycobacterium
EWSLLVLAQPLAEHAII

SEQ ID NO: 811240 - protein, 30 aa, Mycobacterium
EWTGRKLAELAGEPLWRVVQAHPSAAVFPG

SEQ ID NO: 811241 - protein, 21 aa, Mycobacterium
EWTNYLTPQALLDMVASRSYC

SEQ ID NO: 811242 - protein, 21 aa, Mycobacterium
EWTPDEFWPAHSTISLSVGGV

SEQ ID NO: 811243 - protein, 29 aa, Mycobacterium
EWTSSPLRPWPGFTPMIYERYSTPFFEGT

SEQ ID NO: 811244 - protein, 28 aa, Mycobacterium
EWTSSPLRPWPGFTPMIYRQYSEPFFDG

SEQ ID NO: 811245 - protein, 28 aa, Mycobacterium
EWTSSPLRPWPGFVPMIYDRYSQPFFDG

SEQ ID NO: 811246 - protein, 26 aa, Mycobacterium
EWTTSPLRPWPGFTPMIYQQYSEPFF

SEQ ID NO: 811247 - protein, 26 aa, Mycobacterium
EWTVPTRLALVRRLGSIELDLTKARF

SEQ ID NO: 811248 - protein, 29 aa, Mycobacterium
EWVDLGINFRYFFVRKTMFVKYAQAFVCL

SEQ ID NO: 811249 - protein, 21 aa, Mycobacterium
EWVPQMFGSVDDPKVAAFCSS

SEQ ID NO: 811250 - protein, 18 aa, Mycobacterium
EWWAQRFGIEPDLAEALV

SEQ ID NO: 811251 - protein, 27 aa, Mycobacterium
EWWSRARCRGLPTEMFFVPDGDRGRSR

SEQ ID NO: 811252 - protein, 17 aa, Mycobacterium
EWYDEKDIALRLGSAAT

SEQ ID NO: 811253 - protein, 17 aa, Mycobacterium
EWYDEKDITLRLGSAAT

SEQ ID NO: 811254 - protein, 34 aa, Mycobacterium
EWYRRRDLPAWLALPERLLPIRAAGIKPARVMVR

SEQ ID NO: 811255 - protein, 34 aa, Mycobacterium
EWYRTPNYRRRIVRWPRQVLAEFGLILPEDVEIR

SEQ ID NO: 811256 - protein, 25 aa, Mycobacterium
EYAKTFSGPLPLPPSKHVAVVACMD

SEQ ID NO: 811257 - protein, 22 aa, Mycobacterium
EYALANDERFGIWGGLSERERR

SEQ ID NO: 811258 - protein, 25 aa, Mycobacterium
EYARIREILGRRPTDAELAMYSVMW

SEQ ID NO: 811259 - protein, 21 aa, Mycobacterium
EYARRFNLPIHVRSSYTDRPG

SEQ ID NO: 811260 - protein, 24 aa, Mycobacterium
EYARVLSPLHRLLRDIVGQGITEG

SEQ ID NO: 811261 - protein, 24 aa, Mycobacterium
EYASPFISLPPSRVDLRPAQAGGP

SEQ ID NO: 811262 - protein, 25 aa, Mycobacterium
EYCAGGHEVFLIVPGRRAGHVQLYT

SEQ ID NO: 811263 - protein, 17 aa, Mycobacterium
EYCDDCARWAHPATGEC

SEQ ID NO: 811264 - protein, 29 aa, Mycobacterium
EYCNKQVLTFDWPDGAASVIVYLAPKGHD

SEQ ID NO: 811265 - protein, 27 aa, Mycobacterium
EYCSKQVLTFAWPAGAAAVSIYLAPKD

SEQ ID NO: 811266 - protein, 26 aa, Mycobacterium
EYDETRRLFAGGGFGRRFGDNGFGGG

SEQ ID NO: 811267 - protein, 25 aa, Mycobacterium
EYDNYRKRALRDQQLIAERTKANVV

SEQ ID NO: 811268 - protein, 17 aa, Mycobacterium
EYDRDLPVYIPVEQIRE

SEQ ID NO: 811269 - protein, 19 aa, Mycobacterium
EYDVYLWLLEEMKSVRYDD

SEQ ID NO: 811270 - protein, 19 aa, Mycobacterium
EYEIVNVGDIARLFPEGGT

SEQ ID NO: 811271 - protein, 17 aa, Mycobacterium
EYEIVNVGDLNRLFPQG

SEQ ID NO: 811272 - protein, 23 aa, Mycobacterium
EYEKARLPAEAWPPTAWFEGWAT

SEQ ID NO: 811273 - protein, 23 aa, Mycobacterium
EYEKRFGYVYLVFANGRPAEELL

SEQ ID NO: 811274 - protein, 24 aa, Mycobacterium
EYEVARLWRDSRVQRLYAGTTEIM

SEQ ID NO: 811275 - protein, 26 aa, Mycobacterium
EYFDIPLIMLHHFPMRPNGQLLPMLP

SEQ ID NO: 811276 - protein, 31 aa, Mycobacterium
EYFGIPLAGLHFFPAPALPAGMLSTLATKAA

SEQ ID NO: 811277 - protein, 19 aa, Mycobacterium
EYFPMSDYLGDGRFRTLGG

SEQ ID NO: 811278 - protein, 17 aa, Mycobacterium
EYFSLRGLALLTDTVDK

SEQ ID NO: 811279 - protein, 17 aa, Mycobacterium
EYFSLRGLALLTDTVEK

SEQ ID NO: 811280 - protein, 17 aa, Mycobacterium
EYFVWFKDEYEISESDR

SEQ ID NO: 811281 - protein, 19 aa, Mycobacterium
EYGAIKAPTLVLWTSHDPT

SEQ ID NO: 811282 - protein, 20 aa, Mycobacterium
EYGALLTDLIREPRRGRGSH

SEQ ID NO: 811283 - protein, 36 aa, Mycobacterium
EYGARGWAMNTLFDGIAPLLADLRAAGVRLAVATCK

SEQ ID NO: 811284 - protein, 23 aa, Mycobacterium
EYGKGVLLALHLGRRKDADTLAT

SEQ ID NO: 811285 - protein, 29 aa, Mycobacterium
EYGKTPTQVLLRWNLQLGNAVIFGSSNAE

SEQ ID NO: 811286 - protein, 23 aa, Mycobacterium
EYGLIRGSWLTVARLAKCGPWHR

SEQ ID NO: 811287 - protein, 25 aa, Mycobacterium
EYGLTLPIEFITYSAITNLADAVDV

SEQ ID NO: 811288 - protein, 21 aa, Mycobacterium
EYGRTVVVLTIDPAKRLAQAL

SEQ ID NO: 811289 - protein, 23 aa, Mycobacterium
EYGTALVPTLINIENFPGIAEAA

SEQ ID NO: 811290 - protein, 26 aa, Mycobacterium
EYGVTATFFIVTPNREQLAELARLVD

SEQ ID NO: 811291 - protein, 19 aa, Mycobacterium
EYHASLMEPWDGPASITFT

SEQ ID NO: 811292 - protein, 24 aa, Mycobacterium
EYHDIPLVTLHHIPMRPNGQLVTI

SEQ ID NO: 811293 - protein, 22 aa, Mycobacterium
EYHGATMQFPWSRGSELDVWVA

SEQ ID NO: 811294 - protein, 29 aa, Mycobacterium
EYHHEGLIEKLPRMLGTQAAGAAPLVNGA

SEQ ID NO: 811295 - protein, 23 aa, Mycobacterium
EYHNLPDHPAFDWYMQRITDQSA

SEQ ID NO: 811296 - protein, 21 aa, Mycobacterium
EYHTIAHMRRGPGGGLVVTRP

SEQ ID NO: 811297 - protein, 18 aa, Mycobacterium
EYHWGPDWVCWDADQTFQ

SEQ ID NO: 811298 - protein, 18 aa, Mycobacterium
EYIISWLHRFARGEINTV

SEQ ID NO: 811299 - protein, 19 aa, Mycobacterium
EYIQRFESAFKAHLGVKHA

SEQ ID NO: 811300 - protein, 20 aa, Mycobacterium
EYIRRNASKVLLLTATPYNL

SEQ ID NO: 811301 - protein, 26 aa, Mycobacterium
EYIRSPAELVLLPGAAAALAALNAAG

SEQ ID NO: 811302 - protein, 24 aa, Mycobacterium
EYKKLLVAMLQRREAWQIIDHVNS

SEQ ID NO: 811303 - protein, 24 aa, Mycobacterium
EYKKLVLAMLQRREAWQIVDVVNT

SEQ ID NO: 811304 - protein, 26 aa, Mycobacterium
EYKRQHLMVLHIIALYQRLKNNPGLT

SEQ ID NO: 811305 - protein, 19 aa, Mycobacterium
EYLAFRRYVIDPDGVIVGE

SEQ ID NO: 811306 - protein, 17 aa, Mycobacterium
EYLAYHQGAYLAVSYGL

SEQ ID NO: 811307 - protein, 18 aa, Mycobacterium
EYLEAMFELWHSDSPSYD

SEQ ID NO: 811308 - protein, 27 aa, Mycobacterium
EYLGKTAEFFGLSNWSSDRPDCGGVLL

SEQ ID NO: 811309 - protein, 20 aa, Mycobacterium
EYLIRAGHFGLVVGSTAVAQ

SEQ ID NO: 811310 - protein, 20 aa, Mycobacterium
EYLKRPLIDGPAPEPLHHPI

SEQ ID NO: 811311 - protein, 17 aa, Mycobacterium
EYLLASRATTIYGGTSE

SEQ ID NO: 811312 - protein, 17 aa, Mycobacterium
EYLLASRATTIYGGTTE

SEQ ID NO: 811313 - protein, 22 aa, Mycobacterium
EYLRAVAADTLFTAALARTELI

SEQ ID NO: 811314 - protein, 27 aa, Mycobacterium
EYLRKGMPTAWLIARLSDTALAGGARV

SEQ ID NO: 811315 - protein, 20 aa, Mycobacterium
EYLRNFVFDKPSFGKRGYNE

SEQ ID NO: 811316 - protein, 27 aa, Mycobacterium
EYLRTAAQRFGLWFSKPGNGVSHPTHM

SEQ ID NO: 811317 - protein, 18 aa, Mycobacterium
EYLSSGIFGASLTGPEPP

SEQ ID NO: 811318 - protein, 18 aa, Mycobacterium
EYLTADRALIGPGAELAD

SEQ ID NO: 811319 - protein, 18 aa, Mycobacterium
EYLVLEYASGKRGAAAGG

SEQ ID NO: 811320 - protein, 20 aa, Mycobacterium
EYLYNFWRDATNSRGLWRRT

SEQ ID NO: 811321 - protein, 24 aa, Mycobacterium
EYMADHTSWIRREPVGVIGQVAPW

SEQ ID NO: 811322 - protein, 18 aa, Mycobacterium
EYMRDYNHWATVGVLNEL

SEQ ID NO: 811323 - protein, 18 aa, Mycobacterium
EYMRDYNHWSTIGVLNEL

SEQ ID NO: 811324 - protein, 25 aa, Mycobacterium
EYPEGKRAGLWPGLRETFKSGTSEP

SEQ ID NO: 811325 - protein, 26 aa, Mycobacterium
EYPELRERHLVPRPPYGHGVAAADAG

SEQ ID NO: 811326 - protein, 30 aa, Mycobacterium
EYPQPDEFLWNRPIARLLAFGRGQHFCLGA

SEQ ID NO: 811327 - protein, 42 aa, Mycobacterium
EYPRLMVYRGPRRKGVRYFGPYSHAWAIRETLDLLTRVFPAR

SEQ ID NO: 811328 - protein, 17 aa, Mycobacterium
EYPVFPEYGDDVYYAVS

SEQ ID NO: 811329 - protein, 20 aa, Mycobacterium
EYPVSLLVLGGHRAVPALRV

SEQ ID NO: 811330 - protein, 21 aa, Mycobacterium
EYQDNLFMLSLSRGGPTMWMS

SEQ ID NO: 811331 - protein, 22 aa, Mycobacterium
EYQDNLFMLSLSRGGPTMWMSP

SEQ ID NO: 811332 - protein, 25 aa, Mycobacterium
EYQQTVPFFSLFMATLRADPPIGDV

SEQ ID NO: 811333 - protein, 24 aa, Mycobacterium
EYQRALDEWQLLTAAALVGLVEET

SEQ ID NO: 811334 - protein, 20 aa, Mycobacterium
EYQRDVWRLRRLGVSGHDGA

SEQ ID NO: 811335 - protein, 25 aa, Mycobacterium
EYQRIREILGRRPTATELAMYSVMW

SEQ ID NO: 811336 - protein, 28 aa, Mycobacterium
EYQRLGLPAPDWQVLLAVPAELAGQRAR

SEQ ID NO: 811337 - protein, 29 aa, Mycobacterium
EYQRMGLPVPDWQVLLAVPADLAAQRARS

SEQ ID NO: 811338 - protein, 30 aa, Mycobacterium
EYQTDVLPQWLVGQLLVHYQRLLADGLSRP

SEQ ID NO: 811339 - protein, 20 aa, Mycobacterium
EYRADLACRAAPLLARHGLA

SEQ ID NO: 811340 - protein, 32 aa, Mycobacterium
EYRAVQRIGGRIWRVPVTAFWQAHRDAAAVYS

SEQ ID NO: 811341 - protein, 18 aa, Mycobacterium
EYRDLIRESIRPWMAERT

SEQ ID NO: 811342 - protein, 24 aa, Mycobacterium
EYRDPQLLRLALGEKNRALLPASA

SEQ ID NO: 811343 - protein, 25 aa, Mycobacterium
EYRERLGFEVLPLSGGGKPPFEVLC

SEQ ID NO: 811344 - protein, 24 aa, Mycobacterium
EYREYFGLCLEFPTLCARAFTAHE

SEQ ID NO: 811345 - protein, 29 aa, Mycobacterium
EYRKLDEEFVWYGRIPRAKLADYVGALEG

SEQ ID NO: 811346 - protein, 25 aa, Mycobacterium
EYRPDAAPGILIPFFASHTQKVQDR

SEQ ID NO: 811347 - protein, 21 aa, Mycobacterium
EYRQQVRHWIDTSLSREPGQV

SEQ ID NO: 811348 - protein, 17 aa, Mycobacterium
EYRRIVLYALTQTSWSS

SEQ ID NO: 811349 - protein, 25 aa, Mycobacterium
EYRRLHERIIAMTLPLAQHTARRFR

SEQ ID NO: 811350 - protein, 18 aa, Mycobacterium
EYRSGIRTLPQILSESGW

SEQ ID NO: 811351 - protein, 24 aa, Mycobacterium
EYRSLPDHPAFYWYAERISEQRAV

SEQ ID NO: 811352 - protein, 25 aa, Mycobacterium
EYRSLPDHPAFYWYAERISEQRAVL

SEQ ID NO: 811353 - protein, 24 aa, Mycobacterium
EYRVARAWMDARVTKIWAGSNEIM

SEQ ID NO: 811354 - protein, 20 aa, Mycobacterium
EYRYRQFMEASECVPVLLKA

SEQ ID NO: 811355 - protein, 19 aa, Mycobacterium
EYSFLPRLGPGKGLAVIPR

SEQ ID NO: 811356 - protein, 23 aa, Mycobacterium
EYSIRALHPDDFLLDQLDLYQEA

SEQ ID NO: 811357 - protein, 22 aa, Mycobacterium
EYSLAVVGPLLAGAALGISGMA

SEQ ID NO: 811358 - protein, 26 aa, Mycobacterium
EYSRMRKGQTLFTYLHLAASKPCTDA

SEQ ID NO: 811359 - protein, 22 aa, Mycobacterium
EYTAALVRRIGAGITPPAAAHE

SEQ ID NO: 811360 - protein, 27 aa, Mycobacterium
EYTKKANLPLSPLNPPVPPTAYSPPAP

SEQ ID NO: 811361 - protein, 18 aa, Mycobacterium
EYTWLYAESWSDPQVRWL

SEQ ID NO: 811362 - protein, 25 aa, Mycobacterium
EYVDGKRTGLWPGLRDTFKSGTSAP

SEQ ID NO: 811363 - protein, 18 aa, Mycobacterium
EYVFYDGPPFANGLPHYG

SEQ ID NO: 811364 - protein, 20 aa, Mycobacterium
EYVKPYDALVSYLDELDAAL

SEQ ID NO: 811365 - protein, 34 aa, Mycobacterium
EYVKSRVAAYKYPRLVWLVDALPKGPTGKVLKRE

SEQ ID NO: 811366 - protein, 19 aa, Mycobacterium
EYVLKFDWLSMSGLTARIY

SEQ ID NO: 811367 - protein, 17 aa, Mycobacterium
EYVNAIRAIWRSWRTGE

SEQ ID NO: 811368 - protein, 26 aa, Mycobacterium
EYVRPRGIIYHRALGARFADLLPAAG

SEQ ID NO: 811369 - protein, 22 aa, Mycobacterium
EYVRSPDEVVLLPGAGRAIAAL

SEQ ID NO: 811370 - protein, 17 aa, Mycobacterium
EYWKSVYGQSLKGSFVP

SEQ ID NO: 811371 - protein, 21 aa, Mycobacterium
EYWPKLDAIYPDFVNYRTYTD

SEQ ID NO: 811372 - protein, 19 aa, Mycobacterium
EYWRRFGVVPDWAGKRVLD

SEQ ID NO: 811373 - protein, 20 aa, Mycobacterium
EYYFNDHGAQIDRFSNSLIA

SEQ ID NO: 811374 - protein, 26 aa, Mycobacterium
FAAAHVPYLAWLLRASADSAGVAAQH

SEQ ID NO: 811375 - protein, 28 aa, Mycobacterium
FAAALDALWPMLTPETLLSELYTSPERL

SEQ ID NO: 811376 - protein, 20 aa, Mycobacterium
FAAATWLRGIDIVHVPTTLL

SEQ ID NO: 811377 - protein, 28 aa, Mycobacterium
FAADDLVASLLLVHGLHPHPVHRRIADA

SEQ ID NO: 811378 - protein, 36 aa, Mycobacterium
FAADLRRWPTLFDDDALAAALFGLGAFIEKAGTGGG

SEQ ID NO: 811379 - protein, 17 aa, Mycobacterium
FAADVAGAKPWFAIGGI

SEQ ID NO: 811380 - protein, 22 aa, Mycobacterium
FAAELLAWLRNRLSHFKCPKAI

SEQ ID NO: 811381 - protein, 28 aa, Mycobacterium
FAAELRLLRGMPSVFVPSAAIPNKGDHV

SEQ ID NO: 811382 - protein, 33 aa, Mycobacterium
FAAFYQRCRLVTQRLWPTLLEPLRTREQARRHV

SEQ ID NO: 811383 - protein, 37 aa, Mycobacterium
FAAFYRRCRLVTERLWPTLLEPLRTRDQARRTVVDCG

SEQ ID NO: 811384 - protein, 19 aa, Mycobacterium
FAAGRRPLKFTAYDGSSCG

SEQ ID NO: 811385 - protein, 25 aa, Mycobacterium
FAAGRSFLLPPTWTQLDSLAGRTVA

SEQ ID NO: 811386 - protein, 30 aa, Mycobacterium
FAAIDPSMRVPWFGLPMSAASSLTARIMET

SEQ ID NO: 811387 - protein, 17 aa, Mycobacterium
FAAIRGGHPWRAARTAN

SEQ ID NO: 811388 - protein, 18 aa, Mycobacterium
FAAKPLTYGGTPAPLWLA

SEQ ID NO: 811389 - protein, 18 aa, Mycobacterium
FAAKRIAPHSLEWDAAKH

SEQ ID NO: 811390 - protein, 17 aa, Mycobacterium
FAALARGPIVVAFDGSP

SEQ ID NO: 811391 - protein, 17 aa, Mycobacterium
FAALDWVSDRLAGQRYL

SEQ ID NO: 811392 - protein, 26 aa, Mycobacterium
FAALEVKRMWPKVWQLACMVDHVAEP

SEQ ID NO: 811393 - protein, 20 aa, Mycobacterium
FAALLIYRLGRLPSDRSSIV

SEQ ID NO: 811394 - protein, 19 aa, Mycobacterium
FAALLLYRLGRLPSDRASI

SEQ ID NO: 811395 - protein, 19 aa, Mycobacterium
FAALPTDPGFVLYDVQLMR

SEQ ID NO: 811396 - protein, 18 aa, Mycobacterium
FAALSLDPPLVLFCPTKA

SEQ ID NO: 811397 - protein, 19 aa, Mycobacterium
FAALSLEPPLVLFCPTKQS

SEQ ID NO: 811398 - protein, 19 aa, Mycobacterium
FAAPRYGFKPTVVPQPPAG

SEQ ID NO: 811399 - protein, 18 aa, Mycobacterium
FAAPTTLRFEPGITAVVG

SEQ ID NO: 811400 - protein, 28 aa, Mycobacterium
FAAPVTRIWQIYADPRQLEKVWGPPSHP

SEQ ID NO: 811401 - protein, 22 aa, Mycobacterium
FAAPVWMPRAKRPSIRDVQEAI

SEQ ID NO: 811402 - protein, 20 aa, Mycobacterium
FAAPVWMPRARRDSIREVQE

SEQ ID NO: 811403 - protein, 20 aa, Mycobacterium
FAAQTLAVLRRLGLDEDTVN

SEQ ID NO: 811404 - protein, 26 aa, Mycobacterium
FAAQVLAVLAEWKIDPLDDRLNPNGS

SEQ ID NO: 811405 - protein, 27 aa, Mycobacterium
FAARGVRLRPLPTTPPPVWVGGNSKPA

SEQ ID NO: 811406 - protein, 17 aa, Mycobacterium
FAARLTSVAGRRVAIGR

SEQ ID NO: 811407 - protein, 20 aa, Mycobacterium
FAASAYGKLTGRPAACFGIA

SEQ ID NO: 811408 - protein, 32 aa, Mycobacterium
FAASYRAVGFDPPYPSWPLAPSAFEEAPSYTP

SEQ ID NO: 811409 - protein, 20 aa, Mycobacterium
FAATILAIEAILRMGDSEQR

SEQ ID NO: 811410 - protein, 23 aa, Mycobacterium
FAATLKARRRGWTAGRFSFNVAD

SEQ ID NO: 811411 - protein, 19 aa, Mycobacterium
FAATMWPVVSKAIDFVLEL

SEQ ID NO: 811412 - protein, 18 aa, Mycobacterium
FAATVPPAAVAANRAQLA

SEQ ID NO: 811413 - protein, 18 aa, Mycobacterium
FAATVPPPAIAANRAQLA

SEQ ID NO: 811414 - protein, 34 aa, Mycobacterium
FAATVPPPVIAANRALLATLIATNILGQNTPAIA

SEQ ID NO: 811415 - protein, 18 aa, Mycobacterium
FAATWGTNNRWPDGSYRD

SEQ ID NO: 811416 - protein, 17 aa, Mycobacterium
FAAVALASARELGLDEA

SEQ ID NO: 811417 - protein, 19 aa, Mycobacterium
FAAVGRLLHRHDGPIFPLI

SEQ ID NO: 811418 - protein, 19 aa, Mycobacterium
FAAVGRLLHRHTGPIFPLI

SEQ ID NO: 811419 - protein, 19 aa, Mycobacterium
FAAVGRLLQRHAGPIFPLI

SEQ ID NO: 811420 - protein, 19 aa, Mycobacterium
FAAVGRLLQRHTGPIFPLI

SEQ ID NO: 811421 - protein, 17 aa, Mycobacterium
FAAVTPNATSGGAVTAA

SEQ ID NO: 811422 - protein, 17 aa, Mycobacterium
FAAVYDLTKSRVYGMVM

SEQ ID NO: 811423 - protein, 26 aa, Mycobacterium
FACEHWGVVPDVYLLGKALGGGVVPL

SEQ ID NO: 811424 - protein, 17 aa, Mycobacterium
FACGPHHRLLTPDGWTT

SEQ ID NO: 811425 - protein, 19 aa, Mycobacterium
FACPLPADIAAVPGALRIL

SEQ ID NO: 811426 - protein, 17 aa, Mycobacterium
FACVVRFFSSMFPARRT

SEQ ID NO: 811427 - protein, 29 aa, Mycobacterium
FADAFDADFFAPWAKLAAVRTPTIAAVAG

SEQ ID NO: 811428 - protein, 22 aa, Mycobacterium
FADAFPKFMWKPSREVARAGVD

SEQ ID NO: 811429 - protein, 18 aa, Mycobacterium
FADAYIGFLSATVDGPAA

SEQ ID NO: 811430 - protein, 24 aa, Mycobacterium
FADDDPELAAWLRARRPAHGLTLL

SEQ ID NO: 811431 - protein, 24 aa, Mycobacterium
FADDTAHYLWTWTDEAAGELRSRM

SEQ ID NO: 811432 - protein, 25 aa, Mycobacterium
FADERFTRWFGRRPATAGPPAHARS

SEQ ID NO: 811433 - protein, 18 aa, Mycobacterium
FADFLRRQAPDLLPASLG

SEQ ID NO: 811434 - protein, 19 aa, Mycobacterium
FADFPRYPLNFIADLNAVM

SEQ ID NO: 811435 - protein, 35 aa, Mycobacterium
FADFYQRCRLVTERLWPTLLEPLRSREQARRHVLE

SEQ ID NO: 811436 - protein, 18 aa, Mycobacterium
FADGPTVWRNGETIRITV

SEQ ID NO: 811437 - protein, 30 aa, Mycobacterium
FADIDPATRLPWFGPPMSAVSSLTARLMET

SEQ ID NO: 811438 - protein, 18 aa, Mycobacterium
FADIRWRLDVWNASAQVA

SEQ ID NO: 811439 - protein, 33 aa, Mycobacterium
FADLTQQWLTLRYITRLLLRLGCREDAAVLYWA

SEQ ID NO: 811440 - protein, 26 aa, Mycobacterium
FADQRTFGGWLLADLVTVDGSVVPAP

SEQ ID NO: 811441 - protein, 18 aa, Mycobacterium
FADRPDLATLIAAPYFRD

SEQ ID NO: 811442 - protein, 25 aa, Mycobacterium
FADSPILVVNYRLLPKHSIGMALDD

SEQ ID NO: 811443 - protein, 19 aa, Mycobacterium
FADSPPIFADPLAARLLGV

SEQ ID NO: 811444 - protein, 24 aa, Mycobacterium
FADVGPVLIPDWLGDDDALMLTDA

SEQ ID NO: 811445 - protein, 20 aa, Mycobacterium
FADVLIAFGKFPIIDDREPQ

SEQ ID NO: 811446 - protein, 24 aa, Mycobacterium
FADWGMRLVFLRVGGVTIEIAQPL

SEQ ID NO: 811447 - protein, 18 aa, Mycobacterium
FADYDAGLHWFRAALATR

SEQ ID NO: 811448 - protein, 20 aa, Mycobacterium
FADYGFIPDLYATMADNPTV

SEQ ID NO: 811449 - protein, 22 aa, Mycobacterium
FADYMRPAVRLAALMNIDPIYV

SEQ ID NO: 811450 - protein, 32 aa, Mycobacterium
FAEAAGVPVVFLTALYGLSVLGGLRAGERVLV

SEQ ID NO: 811451 - protein, 22 aa, Mycobacterium
FAEELVMWWNFVGRNHDEIVSY

SEQ ID NO: 811452 - protein, 24 aa, Mycobacterium
FAEFGGWLMPVSYAGTVSEHHATR

SEQ ID NO: 811453 - protein, 23 aa, Mycobacterium
FAEFGGWLMPVSYAGTVSEHNAT

SEQ ID NO: 811454 - protein, 24 aa, Mycobacterium
FAEFGGWLMPVSYAGTVSEHNATR

SEQ ID NO: 811455 - protein, 26 aa, Mycobacterium
FAEGTPAGLAAWLVLCCRAMEAGAQE

SEQ ID NO: 811456 - protein, 20 aa, Mycobacterium
FAEHFELGIKDLVPMAYAEA

SEQ ID NO: 811457 - protein, 34 aa, Mycobacterium
FAEIIGFYGLSYWYPFQVTALGLGPIWMSDNEDA

SEQ ID NO: 811458 - protein, 35 aa, Mycobacterium
FAEIIGFYGLSYWYPFQVTALGLGPIWMSDNEDAK

SEQ ID NO: 811459 - protein, 33 aa, Mycobacterium
FAEIVGFYGLSYWYPFQVTALGLGPIWMSDNTD

SEQ ID NO: 811460 - protein, 26 aa, Mycobacterium
FAEIYDLERNPPPKPTPPLPIPQDLT

SEQ ID NO: 811461 - protein, 22 aa, Mycobacterium
FAELAPHPLLTRAVEKTAEGLD

SEQ ID NO: 811462 - protein, 34 aa, Mycobacterium
FAELPTATRWFRLMSAWLMLAARPDLIGKRTSDD

SEQ ID NO: 811463 - protein, 17 aa, Mycobacterium
FAELPWRGNLINRIRYF

SEQ ID NO: 811464 - protein, 19 aa, Mycobacterium
FAELSPHPLLTHPVEQTAR

SEQ ID NO: 811465 - protein, 26 aa, Mycobacterium
FAEMIETWIEMAWQDGSFGWVGIANF

SEQ ID NO: 811466 - protein, 20 aa, Mycobacterium
FAEMIVPYRDPSPDHYRRTA

SEQ ID NO: 811467 - protein, 24 aa, Mycobacterium
FAERAARIPLPEGDVLFVGAEVYT

SEQ ID NO: 811468 - protein, 30 aa, Mycobacterium; identical to SEQ ID NO: 126237

SEQ ID NO: 811469 - protein, 33 aa, Mycobacterium
FAEREGVNLTYLPFIARAVIDALKLHPNVNASY

SEQ ID NO: 811470 - protein, 21 aa, Mycobacterium
FAERGFLAVRLEDIGAVAGIS

SEQ ID NO: 811471 - protein, 33 aa, Mycobacterium
FAERKLPLTMTKLKFFKFIMDEIFPGGMLPKVD

SEQ ID NO: 811472 - protein, 17 aa, Mycobacterium
FAERQMSLLAAPAAAST

SEQ ID NO: 811473 - protein, 20 aa, Mycobacterium
FAERTDVLALLLRSTYDDGS

SEQ ID NO: 811474 - protein, 22 aa, Mycobacterium
FAETHRFAFPLLSDADGTVAAR

SEQ ID NO: 811475 - protein, 20 aa, Mycobacterium
FAETLDFRSYRYFTANGGAC

SEQ ID NO: 811476 - protein, 18 aa, Mycobacterium
FAETMWPVVTRAIDFVLG

SEQ ID NO: 811477 - protein, 31 aa, Mycobacterium
FAETSWDLRKFLWAPMFKCFGIQRIHLLSNC

SEQ ID NO: 811478 - protein, 24 aa, Mycobacterium
FAEVNLAGFYDLAQTLGGVEVCLN

SEQ ID NO: 811479 - protein, 17 aa, Mycobacterium
FAEVRLPEAAGSTSGFG

SEQ ID NO: 811480 - protein, 18 aa, Mycobacterium
FAEWQSYLSAGFAAMRDN

SEQ ID NO: 811481 - protein, 20 aa, Mycobacterium
FAEYDRDLPHYIPVEQIRTE

SEQ ID NO: 811482 - protein, 25 aa, Mycobacterium
FAFPHGGHLINLHIAAALGLGGCES

SEQ ID NO: 811483 - protein, 23 aa, Mycobacterium
FAFQMAGGLALRDAAAATKVILL

SEQ ID NO: 811484 - protein, 26 aa, Mycobacterium
FAFRSQFRTWLYSLASRKTVDAMRRR

SEQ ID NO: 811485 - protein, 19 aa, Mycobacterium
FAGCPICNLHLQSIVRRHD

SEQ ID NO: 811486 - protein, 25 aa, Mycobacterium
FAGDGGLWLAVLSPAALARVEAIAG

SEQ ID NO: 811487 - protein, 17 aa, Mycobacterium
FAGGGFGGRRFDAGGFG

SEQ ID NO: 811488 - protein, 19 aa, Mycobacterium
FAGGLGHLARLAAAAPRAV

SEQ ID NO: 811489 - protein, 19 aa, Mycobacterium
FAGGWKVNADLPTPAGFAG

SEQ ID NO: 811490 - protein, 24 aa, Mycobacterium
FAGGWPVNADLPTPAGFAAATKFV

SEQ ID NO: 811491 - protein, 26 aa, Mycobacterium
FAGHPTVGASWWLRENGRPINTLQIP

SEQ ID NO: 811492 - protein, 21 aa, Mycobacterium
FAGKKLFDVSSIAATGPLGGE

SEQ ID NO: 811493 - protein, 18 aa, Mycobacterium
FAGKPFDYWRQHLKTMKG

SEQ ID NO: 811494 - protein, 21 aa, Mycobacterium
FAGLYALHRLKRSGLQVTCFE

SEQ ID NO: 811495 - protein, 20 aa, Mycobacterium
FAGLYALQRLRSQGLSVVVF

SEQ ID NO: 811496 - protein, 18 aa, Mycobacterium
FAGMDPMLTGRENLVLFG

SEQ ID NO: 811497 - protein, 25 aa, Mycobacterium
FAGMQPRWITPRWDAERHFSHPPSP

SEQ ID NO: 811498 - protein, 20 aa, Mycobacterium
FAGMRLVIGDALHSLTDLGT

SEQ ID NO: 811499 - protein, 20 aa, Mycobacterium
FAGPNLVVGNTILLKHAPQC

SEQ ID NO: 811500 - protein, 28 aa, Mycobacterium
FAGQLYPRMPVPVSWFEARIAYRADSLA

SEQ ID NO: 811501 - protein, 32 aa, Mycobacterium
FAGQPAMMQLFIDLFGPYPLANGYTVVVTDDA

SEQ ID NO: 811502 - protein, 18 aa, Mycobacterium
FAGQTWWAAIEDIGRLRD

SEQ ID NO: 811503 - protein, 23 aa, Mycobacterium
FAGRLVPILVDLAHLIAFERDDA

SEQ ID NO: 811504 - protein, 28 aa, Mycobacterium
FAGVAKYPARVKCALLGWMACKDALAQA

SEQ ID NO: 811505 - protein, 29 aa, Mycobacterium
FAGVAKYPARVKCALLGWMACKDALAQAS

SEQ ID NO: 811506 - protein, 35 aa, Mycobacterium
FAGVAKYPARVKCALLGWMAFKAAVAEARPLDETH

SEQ ID NO: 811507 - protein, 20 aa, Mycobacterium
FAGVLREGSWNQARIDPALP

SEQ ID NO: 811508 - protein, 34 aa, Mycobacterium
FAGVSRYPARVKCALLGWMAFKDALVQAIEHHEV

SEQ ID NO: 811509 - protein, 22 aa, Mycobacterium
FAGYRGDMAFATLIVGGGGSEA

SEQ ID NO: 811510 - protein, 21 aa, Mycobacterium
FAGYYEVDPYTPVTPRAPIAE

SEQ ID NO: 811511 - protein, 25 aa, Mycobacterium
FAHIDRLVRAFGSLQGLLAASATDL

SEQ ID NO: 811512 - protein, 18 aa, Mycobacterium
FAHNLSVGQIARFPARVV

SEQ ID NO: 811513 - protein, 17 aa, Mycobacterium
FAHPVLLERFRAAELAT

SEQ ID NO: 811514 - protein, 24 aa, Mycobacterium
FAHVFSAFGVRVTLVIRGGCMLRH

SEQ ID NO: 811515 - protein, 20 aa, Mycobacterium
FAHVIAEKYPITVALHTDHC

SEQ ID NO: 811516 - protein, 22 aa, Mycobacterium
FAHVVVGRVIPLLALEGRAWDT

SEQ ID NO: 811517 - protein, 21 aa, Mycobacterium
FAHYAPPVVPLPGAQARVFLG

SEQ ID NO: 811518 - protein, 17 aa, Mycobacterium
FAIAIRTALMRAGTAYV

SEQ ID NO: 811519 - protein, 18 aa, Mycobacterium
FAIAMVKFTFPNQNLLPV

SEQ ID NO: 811520 - protein, 24 aa, Mycobacterium
FAIGAVLCMHFAKQAARFFDSAEV

SEQ ID NO: 811521 - protein, 22 aa, Mycobacterium
FAIGAVLSMHFAKQAAKYFESV

SEQ ID NO: 811522 - protein, 18 aa, Mycobacterium
FAIGFPRGVLLYAERRVI

SEQ ID NO: 811523 - protein, 17 aa, Mycobacterium
FAIGLGCDLAHADKLIY

SEQ ID NO: 811524 - protein, 20 aa, Mycobacterium
FAIQELTLPLALAGEDVIGQ

SEQ ID NO: 811525 - protein, 20 aa, Mycobacterium
FAIQELTLPLALAGSDLIGQ

SEQ ID NO: 811526 - protein, 26 aa, Mycobacterium
FAIRVAPACFFPAGDRALLARFADRW

SEQ ID NO: 811527 - protein, 25 aa, Mycobacterium
FAISNYAWGLHTVEYYTAGTAVRRT

SEQ ID NO: 811528 - protein, 25 aa, Mycobacterium
FAKAWFKLLHRDMGPVTRYLGPEVP

SEQ ID NO: 811529 - protein, 23 aa, Mycobacterium
FAKGNLFQDAWSLFAQSLTMVVE

SEQ ID NO: 811530 - protein, 20 aa, Mycobacterium
FAKRNGMDPLWRDLHTITAP

SEQ ID NO: 811531 - protein, 27 aa, Mycobacterium
FAKTSWNLRKFLWAPQFGMYGIQRIHL

SEQ ID NO: 811532 - protein, 23 aa, Mycobacterium
FALANPQRYQLIFGAAAPASISR

SEQ ID NO: 811533 - protein, 27 aa, Mycobacterium
FALDDLPVLIFFLVNAGYKTTANMLGL

SEQ ID NO: 811534 - protein, 24 aa, Mycobacterium
FALDHALVDIGVGVRWLREVAGAE

SEQ ID NO: 811535 - protein, 20 aa, Mycobacterium
FALEKERLFGRAWTFVAHES

SEQ ID NO: 811536 - protein, 23 aa, Mycobacterium
FALFEYRLRQRFWAGRVIHTIRL

SEQ ID NO: 811537 - protein, 17 aa, Mycobacterium
FALGVRLIEDSPLYARI

SEQ ID NO: 811538 - protein, 17 aa, Mycobacterium
FALILSPRGFGASAPFY

SEQ ID NO: 811539 - protein, 25 aa, Mycobacterium
FALKGRHWFAIYRWVFELDELDGAA

SEQ ID NO: 811540 - protein, 27 aa, Mycobacterium
FALLDGQDHWLLRPPPKLGEHNEEILR

SEQ ID NO: 811541 - protein, 17 aa, Mycobacterium
FALLVIADLLGVPEEDH

SEQ ID NO: 811542 - protein, 17 aa, Mycobacterium
FALPRPWAPDDEHIMMQ

SEQ ID NO: 811543 - protein, 17 aa, Mycobacterium
FALPRPWAPDDEHVMMQ

SEQ ID NO: 811544 - protein, 17 aa, Mycobacterium
FALPRPWAPDDERIMLQ

SEQ ID NO: 811545 - protein, 17 aa, Mycobacterium
FALPRPWTADDERILLQ

SEQ ID NO: 811546 - protein, 17 aa, Mycobacterium
FALQVPVGVRFAKSAGL

SEQ ID NO: 811547 - protein, 19 aa, Mycobacterium
FALSREPIDRAWYDELSAV

SEQ ID NO: 811548 - protein, 20 aa, Mycobacterium
FALTAAGIGRRPLRTSLLTA

SEQ ID NO: 811549 - protein, 20 aa, Mycobacterium
FALVPLSMYFLDGKVKVELA

SEQ ID NO: 811550 - protein, 17 aa, Mycobacterium
FAMAFDMRFAALGTTVL

SEQ ID NO: 811551 - protein, 21 aa, Mycobacterium
FAMFYDHTCTRVYGLVARVLR

SEQ ID NO: 811552 - protein, 20 aa, Mycobacterium
FAMQPISMLVSQVLGQFMGG

SEQ ID NO: 811553 - protein, 28 aa, Mycobacterium
FAMRNMKTIPTLRLLRQMLANRPKFDSK

SEQ ID NO: 811554 - protein, 18 aa, Mycobacterium
FAMTQLLYSDAVVGFLHE

SEQ ID NO: 811555 - protein, 17 aa, Mycobacterium
FAMTSEVLGGVVPGAVA

SEQ ID NO: 811556 - protein, 19 aa, Mycobacterium
FANAFSHLPLREQLVALGG

SEQ ID NO: 811557 - protein, 18 aa, Mycobacterium
FANALYEPIWNNNYVDHV

SEQ ID NO: 811558 - protein, 25 aa, Mycobacterium
FANAWNDYNFALQGDVKRFRAFDNW

SEQ ID NO: 811559 - protein, 17 aa, Mycobacterium
FANDLLPLALAGTCQNI

SEQ ID NO: 811560 - protein, 18 aa, Mycobacterium
FANDLLPMALAGTCQSIQ

SEQ ID NO: 811561 - protein, 25 aa, Mycobacterium
FANELPAQPLLRITGFGYDRAATED

SEQ ID NO: 811562 - protein, 19 aa, Mycobacterium
FANFKPGTLTALGFSYDEL

SEQ ID NO: 811563 - protein, 18 aa, Mycobacterium
FANGFATLTLETVPNPIL

SEQ ID NO: 811564 - protein, 23 aa, Mycobacterium
FANIRLRNLLLDDVSGGYTRDFT

SEQ ID NO: 811565 - protein, 18 aa, Mycobacterium
FANIRLRNQLLDDVSGGY

SEQ ID NO: 811566 - protein, 19 aa, Mycobacterium
FANIRLRNQLLEDVSGGYT

SEQ ID NO: 811567 - protein, 20 aa, Mycobacterium
FANKLPGQPLIRISGFGYNE

SEQ ID NO: 811568 - protein, 20 aa, Mycobacterium
FANQFWDPIWNAHYVDHVQI

SEQ ID NO: 811569 - protein, 25 aa, Mycobacterium
FANTDLDMLLKRHGIHQIIVVGLIA

SEQ ID NO: 811570 - protein, 17 aa, Mycobacterium
FAPAATVRPLPGGRFCL

SEQ ID NO: 811571 - protein, 19 aa, Mycobacterium
FAPAMHTEMWLHPATVDNV

SEQ ID NO: 811572 - protein, 20 aa, Mycobacterium
FAPAMHTEMWLHPATVDNVA

SEQ ID NO: 811573 - protein, 21 aa, Mycobacterium
FAPAMHTEMWLHPATVDNVAT

SEQ ID NO: 811574 - protein, 19 aa, Mycobacterium
FAPATLCEYLGLALDFGER

SEQ ID NO: 811575 - protein, 19 aa, Mycobacterium
FAPFIFRKQTAEPHEIVVR

SEQ ID NO: 811576 - protein, 25 aa, Mycobacterium
FAPFRRRRAELRSAYRSLAAAVIAE

SEQ ID NO: 811577 - protein, 18 aa, Mycobacterium
FAPGFAYLVDGDARLQVP

SEQ ID NO: 811578 - protein, 21 aa, Mycobacterium
FAPINSWPDNVSLDKARRLLW

SEQ ID NO: 811579 - protein, 17 aa, Mycobacterium
FAPLGMSDTYYLPAANA

SEQ ID NO: 811580 - protein, 33 aa, Mycobacterium
FAPLGNPFVLQLIDVFWSIFRRASDRIVLDLRR

SEQ ID NO: 811581 - protein, 19 aa, Mycobacterium
FAPLNSWPDNVLLDRARRL

SEQ ID NO: 811582 - protein, 17 aa, Mycobacterium
FAPLVDEDIVISAPAVY

SEQ ID NO: 811583 - protein, 20 aa, Mycobacterium
FAPPPPIDLPSPAELQLTTK

SEQ ID NO: 811584 - protein, 18 aa, Mycobacterium
FAPPPPRYQTGVLAKYVK

SEQ ID NO: 811585 - protein, 41 aa, Mycobacterium
FAPQFHPSYRHASVVRREIGVPTVFNLLGPLTNPARPRAGL

SEQ ID NO: 811586 - protein, 23 aa, Mycobacterium
FAPQFHPSYRQASVVRREIGVPT

SEQ ID NO: 811587 - protein, 31 aa, Mycobacterium
FAPSPEAYLALVRYLLELDLIDRVVFATLPV

SEQ ID NO: 811588 - protein, 28 aa, Mycobacterium
FAPTAEAYLGLLRFLLGLDLVDRVLFWM

SEQ ID NO: 811589 - protein, 19 aa, Mycobacterium
FAPTRLRELSKMDGAVVLS

SEQ ID NO: 811590 - protein, 17 aa, Mycobacterium
FAPVFDPVKVEVGFHTP

SEQ ID NO: 811591 - protein, 18 aa, Mycobacterium
FAPVHKARRHLLVAAGIG

SEQ ID NO: 811592 - protein, 27 aa, Mycobacterium
FAQAIPTLFPFVECQSRLLAAYAVGRY

SEQ ID NO: 811593 - protein, 22 aa, Mycobacterium
FAQALRLALIDAAPDVAQDPVV

SEQ ID NO: 811594 - protein, 26 aa, Mycobacterium
FAQAMGPMQFIPETWRLYGVDANNDG

SEQ ID NO: 811595 - protein, 27 aa, Mycobacterium
FAQDQGIALVPWSPLKNGFLSGKYRRD

SEQ ID NO: 811596 - protein, 18 aa, Mycobacterium
FAQDVRTVLPPALSIRNG

SEQ ID NO: 811597 - protein, 17 aa, Mycobacterium
FAQFCTRCILLTRTAPG

SEQ ID NO: 811598 - protein, 25 aa, Mycobacterium
FAQHRIWDRVLFDAGLSVITWPKKY

SEQ ID NO: 811599 - protein, 19 aa, Mycobacterium
FAQLEIARGIYPFGGATPR

SEQ ID NO: 811600 - protein, 17 aa, Mycobacterium
FAQLLAQVRTRSLAAFE

SEQ ID NO: 811601 - protein, 21 aa, Mycobacterium
FAQLREARPLSWHPPVEDALM

SEQ ID NO: 811602 - protein, 28 aa, Mycobacterium
FAQPALFALEIAMAALWESLGVTPDVVI

SEQ ID NO: 811603 - protein, 23 aa, Mycobacterium
FAQPALFALEVALAALLQACGVV

SEQ ID NO: 811604 - protein, 34 aa, Mycobacterium
FAQPALFALEVGLWALLEHWGIRPDFVLGHSVGE

SEQ ID NO: 811605 - protein, 35 aa, Mycobacterium
FAQPALFAVEVALFRLLESWGIHPDFVMGHSIGEL

SEQ ID NO: 811606 - protein, 31 aa, Mycobacterium
FAQPALFVLEVALAALWRSWGVTPDVVIGHS

SEQ ID NO: 811607 - protein, 25 aa, Mycobacterium
FAQQMKILFPIFTSNDAKEGAIAFA

SEQ ID NO: 811608 - protein, 21 aa, Mycobacterium
FAQQQLFDILGGRGSFAEVDV

SEQ ID NO: 811609 - protein, 23 aa, Mycobacterium
FAQRFVIGYRREALPRIQVWPVT

SEQ ID NO: 811610 - protein, 33 aa, Mycobacterium
FAQSIARLLVFSTYRLAVLDRLCGSRDPVLAAV

SEQ ID NO: 811611 - protein, 21 aa, Mycobacterium
FAQSRLWFTGQLQGPSPVYNM

SEQ ID NO: 811612 - protein, 18 aa, Mycobacterium
FAQVAERRHWRLETLAKV

SEQ ID NO: 811613 - protein, 22 aa, Mycobacterium
FAQYWAEICELPISLITDMIKH

SEQ ID NO: 811614 - protein, 20 aa, Mycobacterium
FAQYWSEICAIPLSFITETV

SEQ ID NO: 811615 - protein, 19 aa, Mycobacterium
FARDETDLRALLRSGADDD

SEQ ID NO: 811616 - protein, 23 aa, Mycobacterium
FAREHPHLLPGYVTHTFGVDDVQ

SEQ ID NO: 811617 - protein, 20 aa, Mycobacterium
FAREWIQPHRIHDPEKLAVV

SEQ ID NO: 811618 - protein, 17 aa, Mycobacterium
FARFFAGGEHGSGAGAP

SEQ ID NO: 811619 - protein, 24 aa, Mycobacterium
FARGVPIWATLIALLQDGVPVVGV

SEQ ID NO: 811620 - protein, 21 aa, Mycobacterium
FARGWHCLGLAETFLDGQPHG

SEQ ID NO: 811621 - protein, 27 aa, Mycobacterium
FARIWLGGFNWIMYQVCRKAPGFAKWF

SEQ ID NO: 811622 - protein, 19 aa, Mycobacterium
FARKAADRIIFMADGAIVE

SEQ ID NO: 811623 - protein, 32 aa, Mycobacterium
FARNVLLHRDARKRVLAMRRTFRKHRKQLAAV

SEQ ID NO: 811624 - protein, 19 aa, Mycobacterium
FARNYAWMRGALDSGRMTF

SEQ ID NO: 811625 - protein, 23 aa, Mycobacterium
FARNYTWMRAALNSGKLTFGIVY

SEQ ID NO: 811626 - protein, 18 aa, Mycobacterium
FARRASDRVVFMSDGAIV

SEQ ID NO: 811627 - protein, 18 aa, Mycobacterium
FARRIAAHIVRRRARQPF

SEQ ID NO: 811628 - protein, 24 aa, Mycobacterium
FARRNLGLVLLGTDPLRPTRRVNP

SEQ ID NO: 811629 - protein, 20 aa, Mycobacterium
FARRRPYFIPGTSVLRNNFG

SEQ ID NO: 811630 - protein, 20 aa, Mycobacterium
FARRRTGVAGLRGLGGRLGR

SEQ ID NO: 811631 - protein, 17 aa, Mycobacterium
FARRTLAPILDYDHAHR

SEQ ID NO: 811632 - protein, 21 aa, Mycobacterium
FARRTRRPALLAHSVAIRATQ

SEQ ID NO: 811633 - protein, 34 aa, Mycobacterium
FARSPYVASFRAGWAYLSLITVHIYYGTATPDDP

SEQ ID NO: 811634 - protein, 21 aa, Mycobacterium
FARVIPVRYPAHTSMIASIGA

SEQ ID NO: 811635 - protein, 18 aa, Mycobacterium
FARVRDIAALDFVSAPVG

SEQ ID NO: 811636 - protein, 17 aa, Mycobacterium
FARYIISATTPFAVEDM

SEQ ID NO: 811637 - protein, 21 aa, Mycobacterium
FASAFYGPFREAVSCSLSGDR

SEQ ID NO: 811638 - protein, 22 aa, Mycobacterium
FASAFYGPFREAVSCSLSGDRR

SEQ ID NO: 811639 - protein, 17 aa, Mycobacterium
FASATTAAIPLYRTLRA

SEQ ID NO: 811640 - protein, 25 aa, Mycobacterium
FASDGGLWLAIMSPAALARVEAIAA

SEQ ID NO: 811641 - protein, 26 aa, Mycobacterium
FASDGGLWLAIMSPAALARVESIAAS

SEQ ID NO: 811642 - protein, 25 aa, Mycobacterium
FASDGGLWLALMSPAALARVEAIAA

SEQ ID NO: 811643 - protein, 19 aa, Mycobacterium
FASGMAALTAVLRVLAQPG

SEQ ID NO: 811644 - protein, 19 aa, Mycobacterium
FASGRIAYTLGLHGPAVTV

SEQ ID NO: 811645 - protein, 18 aa, Mycobacterium
FASGWQRNDFILAREPFD

SEQ ID NO: 811646 - protein, 18 aa, Mycobacterium
FASLCSFAGIALARASEF

SEQ ID NO: 811647 - protein, 19 aa, Mycobacterium
FASNYLLNQADIGMGCALG

SEQ ID NO: 811648 - protein, 23 aa, Mycobacterium
FASPALQQPLLLGADIVLHSTTK

SEQ ID NO: 811649 - protein, 23 aa, Mycobacterium
FASPFAMLVIADLLGVPESDHEE

SEQ ID NO: 811650 - protein, 25 aa, Mycobacterium
FASSRGLTPLARIRGWASVGVEVEH

SEQ ID NO: 811651 - protein, 20 aa, Mycobacterium
FASSRLGVALGLEAIRMLEE

SEQ ID NO: 811652 - protein, 17 aa, Mycobacterium
FASTWFDAWAEQDIKKI

SEQ ID NO: 811653 - protein, 17 aa, Mycobacterium
FASVVLKFQKDLGIPDE

SEQ ID NO: 811654 - protein, 21 aa, Mycobacterium
FASVVLSWAAVHKPDFDRVNV

SEQ ID NO: 811655 - protein, 20 aa, Mycobacterium
FASVVLSWARVHEPDMAKVN

SEQ ID NO: 811656 - protein, 23 aa, Mycobacterium
FASWLADFLPRDYYQRYPRYRWD

SEQ ID NO: 811657 - protein, 24 aa, Mycobacterium
FASYARQRPALLAGWLDGHLDGVD

SEQ ID NO: 811658 - protein, 31 aa, Mycobacterium
FASYFGHRLPAPSSYRSFVSWLADQDLDAAR

SEQ ID NO: 811659 - protein, 18 aa, Mycobacterium
FASYNGLLFISLDPNAEP

SEQ ID NO: 811660 - protein, 17 aa, Mycobacterium
FATAITSLPLFDGTGWN

SEQ ID NO: 811661 - protein, 18 aa, Mycobacterium
FATALWGVRTMFGGFARF

SEQ ID NO: 811662 - protein, 21 aa, Mycobacterium
FATAVQTWWRPHAHYGALRPL

SEQ ID NO: 811663 - protein, 17 aa, Mycobacterium
FATCPITQGSLVRFLMR

SEQ ID NO: 811664 - protein, 20 aa, Mycobacterium
FATEPDFFWSPVNSLEDVVA

SEQ ID NO: 811665 - protein, 17 aa, Mycobacterium
FATFHQPGTSNSAWDPV

SEQ ID NO: 811666 - protein, 17 aa, Mycobacterium
FATGMMVATSLAAADAL

SEQ ID NO: 811667 - protein, 20 aa, Mycobacterium
FATKLELHDLTVIPVSALLG

SEQ ID NO: 811668 - protein, 24 aa, Mycobacterium
FATLPPMMRITLNAILRAVFGAEG

SEQ ID NO: 811669 - protein, 24 aa, Mycobacterium
FATLPSMMHITLNAILRAVFGADG

SEQ ID NO: 811670 - protein, 24 aa, Mycobacterium
FATLPSMMRITLNAILRAVFGAEG

SEQ ID NO: 811671 - protein, 17 aa, Mycobacterium
FATLPTQLVLVTHDLDL

SEQ ID NO: 811672 - protein, 29 aa, Mycobacterium
FATLTLETVPNPILTPGFHGLHIHSVGKC

SEQ ID NO: 811673 - protein, 29 aa, Mycobacterium
FATQQGVGFIPWFPLASGPLAAPDGPLRQ

SEQ ID NO: 811674 - protein, 30 aa, Mycobacterium
FATRTRLGLWFRNMAMRTMNFGPLATFFAG

SEQ ID NO: 811675 - protein, 25 aa, Mycobacterium
FATSDLFLERLGLTALSELPDLAPL

SEQ ID NO: 811676 - protein, 26 aa, Mycobacterium
FATSFRLTGRLFRRRPQESRILLANG

SEQ ID NO: 811677 - protein, 30 aa, Mycobacterium
FATSLDHSIWFHRPFRPDIWHRYELRAANH

SEQ ID NO: 811678 - protein, 25 aa, Mycobacterium
FATTELFLERLGLTSLTELPDIAPL

SEQ ID NO: 811679 - protein, 23 aa, Mycobacterium
FATTPRMSTYLVALIAGPYAAWQ

SEQ ID NO: 811680 - protein, 23 aa, Mycobacterium
FATTPRMSTYLVALIAGPYAVWR

SEQ ID NO: 811681 - protein, 26 aa, Mycobacterium
FATTSMNVWSNLRLVRQMLSRKPRIE

SEQ ID NO: 811682 - protein, 28 aa, Mycobacterium
FATVLAPLHRLLGDILRRGIAEGSFRAD

SEQ ID NO: 811683 - protein, 17 aa, Mycobacterium
FATYGPFLSLTDDNLRQ

SEQ ID NO: 811684 - protein, 19 aa, Mycobacterium
FAVALPFVDLIDYRLQVSY

SEQ ID NO: 811685 - protein, 19 aa, Mycobacterium
FAVALPFVNLIDYRLQVSY

SEQ ID NO: 811686 - protein, 24 aa, Mycobacterium
FAVAQQLLKLHRLGYRYHFTLYPI

SEQ ID NO: 811687 - protein, 18 aa, Mycobacterium
FAVAVRVFARTRAARIRR

SEQ ID NO: 811688 - protein, 19 aa, Mycobacterium
FAVDPMLAPMGLAGRISGL

SEQ ID NO: 811689 - protein, 17 aa, Mycobacterium
FAVDSFWRDLVSFTWNI

SEQ ID NO: 811690 - protein, 22 aa, Mycobacterium
FAVERPPEDWLFKARTGDTVVD

SEQ ID NO: 811691 - protein, 23 aa, Mycobacterium
FAVMVSLAELWKSVGVRPDAVIG

SEQ ID NO: 811692 - protein, 32 aa, Mycobacterium
FAVNVFGPVELTLALLPALRRARGQVIFINSG

SEQ ID NO: 811693 - protein, 17 aa, Mycobacterium
FAVQFHVTTSLLVGLKR

SEQ ID NO: 811694 - protein, 23 aa, Mycobacterium
FAVQSALPLMGPGGSIILIGSAA

SEQ ID NO: 811695 - protein, 25 aa, Mycobacterium
FAVRGGILDLFPPTAEHPVRVEFWG

SEQ ID NO: 811696 - protein, 24 aa, Mycobacterium
FAVRKPVIAMLHLSALPGDPGFDS

SEQ ID NO: 811697 - protein, 26 aa, Mycobacterium
FAVTVPPPMIAANRALLASLVATNLL

SEQ ID NO: 811698 - protein, 20 aa, Mycobacterium
FAVVEFVVSPLFGSPPEAGL

SEQ ID NO: 811699 - protein, 34 aa, Mycobacterium
FAVWVYETHWWAHRALWHLIFSGALDRHPDLTVI

SEQ ID NO: 811700 - protein, 35 aa, Mycobacterium; identical to SEQ ID NO: 114441

SEQ ID NO: 811701 - protein, 31 aa, Mycobacterium
FAWHARPGAIHRLFPPWQPLRIEAEAASLAD

SEQ ID NO: 811702 - protein, 17 aa, Mycobacterium
FAWHIDLAKRCGKPLMI

SEQ ID NO: 811703 - protein, 30 aa, Mycobacterium
FAWKGETLEEYWWAAEQMLTWDGEPANMIL

SEQ ID NO: 811704 - protein, 18 aa, Mycobacterium
FAWPTARIAVIGADGAAQ

SEQ ID NO: 811705 - protein, 17 aa, Mycobacterium
FAWRTRLSVSASVDARV

SEQ ID NO: 811706 - protein, 37 aa, Mycobacterium
FAWVDDMHDWCISRQLWWGHRIPIWHGPGGEIVCLGP

SEQ ID NO: 811707 - protein, 37 aa, Mycobacterium
FAWVDNMHDWCISRQLWWGHRIPIWHGPDGETVCVGP

SEQ ID NO: 811708 - protein, 24 aa, Mycobacterium
FAYAPGQYLTLRIPSDRTGSVARC

SEQ ID NO: 811709 - protein, 20 aa, Mycobacterium
FAYEWAAQRGLLTPGDDVDL

SEQ ID NO: 811710 - protein, 17 aa, Mycobacterium
FAYGSNLCVRQMARRCP

SEQ ID NO: 811711 - protein, 17 aa, Mycobacterium
FAYLNRAEMMDRFIHVF

SEQ ID NO: 811712 - protein, 20 aa, Mycobacterium
FAYRAFATALHEAGAVVVTP

SEQ ID NO: 811713 - protein, 17 aa, Mycobacterium
FAYTTDEQLRPLGDYWL

SEQ ID NO: 811714 - protein, 20 aa, Mycobacterium
FAYTVGLWHTMRLPELAIYG

SEQ ID NO: 811715 - protein, 17 aa, Mycobacterium
FCAGGDLKDFASAPSRG

SEQ ID NO: 811716 - protein, 26 aa, Mycobacterium
FCARDPFGIKPLFLATGAGGTAVASE

SEQ ID NO: 811717 - protein, 27 aa, Mycobacterium
FCARDPFGIKPLYLATAPGGTIVGSEK

SEQ ID NO: 811718 - protein, 18 aa, Mycobacterium
FCATGVTDGDLLKGVRYY

SEQ ID NO: 811719 - protein, 19 aa, Mycobacterium
FCATGVTDGDLLKGVRYYP

SEQ ID NO: 811720 - protein, 17 aa, Mycobacterium
FCATGVTNGDLLKGVQY

SEQ ID NO: 811721 - protein, 17 aa, Mycobacterium
FCDMLPADAVPPKVRRD

SEQ ID NO: 811722 - protein, 17 aa, Mycobacterium
FCDSPAAKAIWPDAERV

SEQ ID NO: 811723 - protein, 25 aa, Mycobacterium
FCEGDALLVWIPLNAANIVGGLYRQ

SEQ ID NO: 811724 - protein, 19 aa, Mycobacterium
FCERLTQLLPDPLDTVFLV

SEQ ID NO: 811725 - protein, 18 aa, Mycobacterium
FCGLDDPELGERAASAAA

SEQ ID NO: 811726 - protein, 23 aa, Mycobacterium
FCGLKVVRAEQIRRLPDAVDTVR

SEQ ID NO: 811727 - protein, 23 aa, Mycobacterium
FCHVRVTVRRLGPGHTAVQWNTE

SEQ ID NO: 811728 - protein, 18 aa, Mycobacterium
FCITTAVGLRYLADPAAT

SEQ ID NO: 811729 - protein, 18 aa, Mycobacterium
FCKAARALALLADRNHVL

SEQ ID NO: 811730 - protein, 17 aa, Mycobacterium
FCLNKTTSQLRAIVTEL

SEQ ID NO: 811731 - protein, 31 aa, Mycobacterium
FCNSYRYIQFAVANQFYLLSREAGLDFDRVH

SEQ ID NO: 811732 - protein, 17 aa, Mycobacterium
FCPADRPERFTKAAAAA

SEQ ID NO: 811733 - protein, 21 aa, Mycobacterium
FCPDQFLGAHVRRITGRTNLH

SEQ ID NO: 811734 - protein, 22 aa, Mycobacterium
FCPVGPWIVTDLKPLDPGDLEL

SEQ ID NO: 811735 - protein, 17 aa, Mycobacterium
FCRIVVIDGQHRAMALL

SEQ ID NO: 811736 - protein, 28 aa, Mycobacterium
FCRSAPWRAATRRLVLPWALQGIEPVGE

SEQ ID NO: 811737 - protein, 20 aa, Mycobacterium
FCRSWPCGGAPRRGLGRSAM

SEQ ID NO: 811738 - protein, 17 aa, Mycobacterium
FCSLCFRGGWRAIVQLR

SEQ ID NO: 811739 - protein, 19 aa, Mycobacterium
FCVGPCWPTPTKPDRAAPG

SEQ ID NO: 811740 - protein, 18 aa, Mycobacterium
FCWNCGKPVGRSTPDGRA

SEQ ID NO: 811741 - protein, 24 aa, Mycobacterium
FDAALIDVILPMASGLVDRLQAGA

SEQ ID NO: 811742 - protein, 17 aa, Mycobacterium
FDAALVADFLRRFATKN

SEQ ID NO: 811743 - protein, 25 aa, Mycobacterium
FDAAWIDLVALMKVGLRRGKIIVVR

SEQ ID NO: 811744 - protein, 31 aa, Mycobacterium
FDADPNLASLLVAPYFRSAVESAIDSWRRVV

SEQ ID NO: 811745 - protein, 23 aa, Mycobacterium
FDAEWRVILVGIVEGDLLSRVEV

SEQ ID NO: 811746 - protein, 27 aa, Mycobacterium
FDAFGPHHRLIFPLNTILALDDAPEEQ

SEQ ID NO: 811747 - protein, 30 aa, Mycobacterium
FDAFKKERWPAFWDWAYKTLPDDSRMMMHS

SEQ ID NO: 811748 - protein, 33 aa, Mycobacterium
FDAFYRRCRLVTERLWPTLMEPLRTRQQARRHV

SEQ ID NO: 811749 - protein, 17 aa, Mycobacterium
FDAGFFGIAPREALAMD

SEQ ID NO: 811750 - protein, 18 aa, Mycobacterium
FDAGFFGIAPREALAMDP

SEQ ID NO: 811751 - protein, 26 aa, Mycobacterium
FDAGLAWVHFPVGFGGLDLPHTYQAQ

SEQ ID NO: 811752 - protein, 18 aa, Mycobacterium
FDAGRLAGLADAIETRMK

SEQ ID NO: 811753 - protein, 40 aa, Mycobacterium
FDAHAQAYQALSAQALVFHDQFVQMLNAGASSYAAAEAAN

SEQ ID NO: 811754 - protein, 30 aa, Mycobacterium
FDAIGHFPLPMIRNPLWRPAATAATVREVL

SEQ ID NO: 811755 - protein, 18 aa, Mycobacterium
FDALAAPAPAPLPPAPET

SEQ ID NO: 811756 - protein, 17 aa, Mycobacterium
FDALDKPGGAAANGINA

SEQ ID NO: 811757 - protein, 35 aa, Mycobacterium
FDALFTPDRPVIFAYHGYPWLIHRLTYSRTNHAHM

SEQ ID NO: 811758 - protein, 23 aa, Mycobacterium
FDALTGFLRRLSVDRPIALVLED

SEQ ID NO: 811759 - protein, 21 aa, Mycobacterium
FDALTLLFQRSGQPGLQVLPG

SEQ ID NO: 811760 - protein, 27 aa, Mycobacterium
FDAPQLLTLPDIFPNGLANKFTFMPIG

SEQ ID NO: 811761 - protein, 21 aa, Mycobacterium
FDAPRRALPPRHFADLADTER

SEQ ID NO: 811762 - protein, 20 aa, Mycobacterium
FDAVLNLNLKGPFRLSALVG

SEQ ID NO: 811763 - protein, 28 aa, Mycobacterium
FDAVVNLNLKGPFRLSALVGERMVAAGR

SEQ ID NO: 811764 - protein, 24 aa, Mycobacterium
FDCSGLVHWSYAQAGITLGPDTYT

SEQ ID NO: 811765 - protein, 20 aa, Mycobacterium
FDCSGLVQWAYAQAGVHLDR

SEQ ID NO: 811766 - protein, 17 aa, Mycobacterium
FDCSYYQLLDATKGRPF

SEQ ID NO: 811767 - protein, 25 aa, Mycobacterium
FDCVDPDMLASWWAGVAGGEVNAVA

SEQ ID NO: 811768 - protein, 17 aa, Mycobacterium
FDCWMHELDVRDSLGLP

SEQ ID NO: 811769 - protein, 18 aa, Mycobacterium
FDDAGIPVLLIGDSAANV

SEQ ID NO: 811770 - protein, 19 aa, Mycobacterium
FDDALVLSGILAPALQRAR

SEQ ID NO: 811771 - protein, 19 aa, Mycobacterium
FDDAPIRRTNLMQKGFIQG

SEQ ID NO: 811772 - protein, 27 aa, Mycobacterium
FDDAWASYRWCAFYGFMLSIPMAVQLE

SEQ ID NO: 811773 - protein, 26 aa, Mycobacterium
FDDCGMGWYFYDFGTAVSFFEDHPSV

SEQ ID NO: 811774 - protein, 29 aa, Mycobacterium
FDDEQVFYLRARGIPEDQARRLIVRGFFA

SEQ ID NO: 811775 - protein, 17 aa, Mycobacterium
FDDFLELAAIRTKAIRQ

SEQ ID NO: 811776 - protein, 17 aa, Mycobacterium
FDDIRWRLDVWNASAQV

SEQ ID NO: 811777 - protein, 17 aa, Mycobacterium
FDDLRLEHGRLDQPIPV

SEQ ID NO: 811778 - protein, 18 aa, Mycobacterium
FDDMLLHVDGWLCEIKDV

SEQ ID NO: 811779 - protein, 22 aa, Mycobacterium
FDDPYFTAALHRYFPATLRRRL

SEQ ID NO: 811780 - protein, 22 aa, Mycobacterium
FDDSFLLCFNAHYEPIEFTLPA

SEQ ID NO: 811781 - protein, 24 aa, Mycobacterium
FDDVFKRMWELYLAYSEAGFRSGY

SEQ ID NO: 811782 - protein, 23 aa, Mycobacterium
FDDVILHTYFTPETLQRAVKTVK

SEQ ID NO: 811783 - protein, 24 aa, Mycobacterium
FDDVILHTYFTPETLQRCVSIVKT

SEQ ID NO: 811784 - protein, 24 aa, Mycobacterium
FDDVILHTYFTPETLRRCVATVKS

SEQ ID NO: 811785 - protein, 17 aa, Mycobacterium
FDDVLLLPAASDVVPAT

SEQ ID NO: 811786 - protein, 21 aa, Mycobacterium
FDDWRRFGRDAIGMHLDDALA

SEQ ID NO: 811787 - protein, 26 aa, Mycobacterium
FDDYNEIVISCPLLLTLPAVGTYPIE

SEQ ID NO: 811788 - protein, 31 aa, Mycobacterium
FDEATIVTLAIDDPLLYYSCPQHFTAYCGFD

SEQ ID NO: 811789 - protein, 17 aa, Mycobacterium
FDEAVGLQWALVARRHS

SEQ ID NO: 811790 - protein, 23 aa, Mycobacterium
FDEDPCLFVETIRLQGKRGPVPV

SEQ ID NO: 811791 - protein, 19 aa, Mycobacterium
FDEEIASVHILRPTPNPGA

SEQ ID NO: 811792 - protein, 19 aa, Mycobacterium
FDEGPWPRMGLAERGAILH

SEQ ID NO: 811793 - protein, 18 aa, Mycobacterium
FDEHLDARVIRRLNSLEP

SEQ ID NO: 811794 - protein, 20 aa, Mycobacterium
FDEITRLPEYYPTRTEAGLL

SEQ ID NO: 811795 - protein, 18 aa, Mycobacterium
FDELAGDLLRPVLGVPRH

SEQ ID NO: 811796 - protein, 24 aa, Mycobacterium
FDELRRRHLVPEPPYRQGVAAAAA

SEQ ID NO: 811797 - protein, 19 aa, Mycobacterium
FDEREDLPRIIRAGRHLAK

SEQ ID NO: 811798 - protein, 37 aa, Mycobacterium
FDETLKALEFDYVDLFLIHWPLPTLYDGDFVSTWKTL

SEQ ID NO: 811799 - protein, 27 aa, Mycobacterium
FDEVGYLYNGYIGAGLLTGVTLAKDLG

SEQ ID NO: 811800 - protein, 18 aa, Mycobacterium
FDEWFPASRLVRLGLCLS

SEQ ID NO: 811801 - protein, 17 aa, Mycobacterium
FDEWLAVIAERTGTDPE

SEQ ID NO: 811802 - protein, 24 aa, Mycobacterium
FDEWQRLYLFTRADTIYGGSNEIQ

SEQ ID NO: 811803 - protein, 20 aa, Mycobacterium
FDFERLLPGASRYTLRPGDF

SEQ ID NO: 811804 - protein, 24 aa, Mycobacterium
FDFERRVRHFARFTKLNVRLAIVA

SEQ ID NO: 811805 - protein, 19 aa, Mycobacterium
FDFGALPPEINSLRMYTGA

SEQ ID NO: 811806 - protein, 18 aa, Mycobacterium
FDFGDYRWAATLLDHAVF

SEQ ID NO: 811807 - protein, 17 aa, Mycobacterium
FDFMGFGHTPDHPAPLF

SEQ ID NO: 811808 - protein, 24 aa, Mycobacterium
FDFMPVVFAMFQWGKRHLPGGDRL

SEQ ID NO: 811809 - protein, 25 aa, Mycobacterium
FDGAAPPSAIFIGGGLTQPGLLDAC

SEQ ID NO: 811810 - protein, 19 aa, Mycobacterium
FDGDGLFDDMMWDADGDGS

SEQ ID NO: 811811 - protein, 19 aa, Mycobacterium
FDGFGVPFELTRRGALTAE

SEQ ID NO: 811812 - protein, 21 aa, Mycobacterium
FDGGLKWLGAFSAHPKWDFAT

SEQ ID NO: 811813 - protein, 17 aa, Mycobacterium
FDGGWLLPGLVDAHCHV

SEQ ID NO: 811814 - protein, 19 aa, Mycobacterium
FDGHQVWTSPLFVTRTVGT

SEQ ID NO: 811815 - protein, 25 aa, Mycobacterium
FDGKHELLLALFEDALSRSAEQIRA

SEQ ID NO: 811816 - protein, 26 aa, Mycobacterium
FDGLNSWLTGMFDRGAWRPAAVVVVG

SEQ ID NO: 811817 - protein, 19 aa, Mycobacterium
FDGLRLAGRPVRRPDLTIA

SEQ ID NO: 811818 - protein, 18 aa, Mycobacterium
FDGLRLAGRPVRRPDLTL

SEQ ID NO: 811819 - protein, 31 aa, Mycobacterium
FDGQVETYLHKRAADLPPAVGVLVEYTGDDK

SEQ ID NO: 811820 - protein, 27 aa, Mycobacterium
FDGTDSVMLVWLGQRRIPGIESGRTLK

SEQ ID NO: 811821 - protein, 27 aa, Mycobacterium
FDGTDTVVLVWLGQRRIPGIEQGRTLR

SEQ ID NO: 811822 - protein, 31 aa, Mycobacterium
FDGTVEAYLHKRAADLPPAVGVLVEYQAGDA

SEQ ID NO: 811823 - protein, 30 aa, Mycobacterium
FDGTVEAYLHRRAADLPPAVGVLVEYQGSD

SEQ ID NO: 811824 - protein, 21 aa, Mycobacterium
FDGVLAWGLMFLLSAEDQRRL

SEQ ID NO: 811825 - protein, 33 aa, Mycobacterium
FDGVTYVLERAIRTDFALVHAWKGDRHGNLVYR

SEQ ID NO: 811826 - protein, 33 aa, Mycobacterium
FDGVTYVLERGIRTDFALVHAWKGDRHGNLVYR

SEQ ID NO: 811827 - protein, 17 aa, Mycobacterium
FDGYRPWAGEIRARHTG

SEQ ID NO: 811828 - protein, 18 aa, Mycobacterium
FDHAGRLRIVGRKKDMFI

SEQ ID NO: 811829 - protein, 23 aa, Mycobacterium
FDHDLYQIHVFAVAVDPAGDVFV

SEQ ID NO: 811830 - protein, 27 aa, Mycobacterium
FDHGKWLPYYASLIEQSAPFPPPPPGY

SEQ ID NO: 811831 - protein, 18 aa, Mycobacterium
FDHGPWPLLDPHERMSKI

SEQ ID NO: 811832 - protein, 19 aa, Mycobacterium
FDHLVREYPPLFPTLEAED

SEQ ID NO: 811833 - protein, 20 aa, Mycobacterium
FDHPLMSLLPQLTATPDLSM

SEQ ID NO: 811834 - protein, 19 aa, Mycobacterium
FDHRVREARWSSQTSLWTL

SEQ ID NO: 811835 - protein, 19 aa, Mycobacterium
FDHSLRFSLGTTIYAGTSE

SEQ ID NO: 811836 - protein, 26 aa, Mycobacterium
FDHVPEQAFFLIGGLDDLAKKAESLG

SEQ ID NO: 811837 - protein, 26 aa, Mycobacterium
FDHVPEQAFFLIGGLDDLAKKAETFG

SEQ ID NO: 811838 - protein, 17 aa, Mycobacterium
FDIAVVGLSARLPGDVN

SEQ ID NO: 811839 - protein, 20 aa, Mycobacterium
FDIDIAAPMIIAGLPRTGTT

SEQ ID NO: 811840 - protein, 25 aa, Mycobacterium
FDIGAPPQYMDFRYVVHDRYHGEFF

SEQ ID NO: 811841 - protein, 18 aa, Mycobacterium
FDIGFLRAAAGRCDIAWP

SEQ ID NO: 811842 - protein, 28 aa, Mycobacterium
FDINGRRALSFLIYKNDPTACAIDVEAT

SEQ ID NO: 811843 - protein, 25 aa, Mycobacterium
FDINSKAAYFFLQQAGKRLNDNGSI

SEQ ID NO: 811844 - protein, 19 aa, Mycobacterium
FDIPLREPLVPDPEPRGAA

SEQ ID NO: 811845 - protein, 21 aa, Mycobacterium
FDIREPKPPILYRIGGKDVDV

SEQ ID NO: 811846 - protein, 23 aa, Mycobacterium
FDKLVAVLNYPMFVVTTQANGTP

SEQ ID NO: 811847 - protein, 19 aa, Mycobacterium
FDKPTLIAWSADDVFFEQE

SEQ ID NO: 811848 - protein, 32 aa, Mycobacterium
FDKVIAVHLKGTWNGLRAAAAIMRENKRGVIV

SEQ ID NO: 811849 - protein, 22 aa, Mycobacterium
FDKVRVYRDIGRHLTCRAQLAN

SEQ ID NO: 811850 - protein, 17 aa, Mycobacterium
FDKVTQGGLFPIAYTVG

SEQ ID NO: 811851 - protein, 27 aa, Mycobacterium
FDLALTREMLTAMRPLTASAPITDAVI

SEQ ID NO: 811852 - protein, 26 aa, Mycobacterium
FDLAVFALSFHHLPPAAAARVIAEGT

SEQ ID NO: 811853 - protein, 18 aa, Mycobacterium
FDLDIPVFGICYGFQAMA

SEQ ID NO: 811854 - protein, 20 aa, Mycobacterium
FDLDYHIRELRLARPGLVDQ

SEQ ID NO: 811855 - protein, 19 aa, Mycobacterium
FDLKMRFEQALLFRSAREG

SEQ ID NO: 811856 - protein, 24 aa, Mycobacterium
FDLPQLGIPSLTIPPLTLAEGTTV

SEQ ID NO: 811857 - protein, 18 aa, Mycobacterium
FDLQLHQRGMLRPLRSAE

SEQ ID NO: 811858 - protein, 37 aa, Mycobacterium
FDLRENLRRLALAPLQFAPGSAWRYSLALDVLGAVVE

SEQ ID NO: 811859 - protein, 33 aa, Mycobacterium
FDLRPAAIVRDLDLLRPIYAPTAAYGHFGRTDI

SEQ ID NO: 811860 - protein, 38 aa, Mycobacterium
FDLSTIRVLWHMAAPCPVWLKQAWIDLLGPEVIWELYA

SEQ ID NO: 811861 - protein, 26 aa, Mycobacterium
FDMAQFGWLGDAFPLSALTQIYLSGG

SEQ ID NO: 811862 - protein, 19 aa, Mycobacterium
FDMASAVPWLAAMPNWEYE

SEQ ID NO: 811863 - protein, 37 aa, Mycobacterium
FDMIFTTDRPIIFAYHGYPWLIHRLTYRRAGHDNLHV

SEQ ID NO: 811864 - protein, 28 aa, Mycobacterium
FDMRRHCTMYLTYWTAGDTRNRGREMVE

SEQ ID NO: 811865 - protein, 19 aa, Mycobacterium
FDMSLSFHHALLDGWSVVE

SEQ ID NO: 811866 - protein, 18 aa, Mycobacterium
FDNELIPIAGLATDEIIR

SEQ ID NO: 811867 - protein, 18 aa, Mycobacterium
FDNFCDILLRVADARAQV

SEQ ID NO: 811868 - protein, 18 aa, Mycobacterium
FDNGPWPRLTPHERQAVL

SEQ ID NO: 811869 - protein, 21 aa, Mycobacterium
FDNKFFDIPPDEAALMDPQQR

SEQ ID NO: 811870 - protein, 19 aa, Mycobacterium
FDNLTLPREALLGETGQAF

SEQ ID NO: 811871 - protein, 26 aa, Mycobacterium
FDNPLFNSRAVGDFLRTLLGSSPGSS

SEQ ID NO: 811872 - protein, 20 aa, Mycobacterium
FDNSPGLQRLRLLEISYGVV

SEQ ID NO: 811873 - protein, 23 aa, Mycobacterium
FDNWARQFLASHPEAVVLHAGCG

SEQ ID NO: 811874 - protein, 17 aa, Mycobacterium
FDPAAVRFVLLDLAEQV

SEQ ID NO: 811875 - protein, 20 aa, Mycobacterium
FDPALLDRVAPNAPDRAHEP

SEQ ID NO: 811876 - protein, 25 aa, Mycobacterium
FDPALLRARNLPATQTRPLTAATGL

SEQ ID NO: 811877 - protein, 29 aa, Mycobacterium
FDPEARQQFWELIRLLAADGTTIVLTTHY

SEQ ID NO: 811878 - protein, 24 aa, Mycobacterium
FDPGKFWSGDTLPLAPGYQLGDEI

SEQ ID NO: 811879 - protein, 20 aa, Mycobacterium
FDPGKFWSGDTLPLAPGYRL

SEQ ID NO: 811880 - protein, 24 aa, Mycobacterium
FDPGLLHLIAATCRGAAGAASVSV

SEQ ID NO: 811881 - protein, 24 aa, Mycobacterium
FDPGRQRLYWSSEGERRTAGPVLL

SEQ ID NO: 811882 - protein, 17 aa, Mycobacterium
FDPLPLCSKICSDGRCP

SEQ ID NO: 811883 - protein, 29 aa, Mycobacterium
FDPNAGWFSYFSTWGNQFISSGFPINMLS

SEQ ID NO: 811884 - protein, 20 aa, Mycobacterium
FDPPLPPQYLELTRHWPQGR

SEQ ID NO: 811885 - protein, 29 aa, Mycobacterium
FDPQVLEDPYPFYRRLRETAPVWPVGDSG

SEQ ID NO: 811886 - protein, 20 aa, Mycobacterium
FDPRSLLAEARIGVLATIKA

SEQ ID NO: 811887 - protein, 24 aa, Mycobacterium
FDPSTLVYWRKRIAASARPDRVFD

SEQ ID NO: 811888 - protein, 17 aa, Mycobacterium
FDPTRPTAWLAEGLLMY

SEQ ID NO: 811889 - protein, 27 aa, Mycobacterium
FDPVRKQFYWHRFFSHQPDLNYDNPAV

SEQ ID NO: 811890 - protein, 27 aa, Mycobacterium
FDPVRKQFYWHRFFSHQPDLNYENPAV

SEQ ID NO: 811891 - protein, 27 aa, Mycobacterium
FDPVRRQFYWHRFFSHQPDLNYDNPAV

SEQ ID NO: 811892 - protein, 31 aa, Mycobacterium
FDPYDVGLIADPYPMFARLRQEAPLYYNAEF

SEQ ID NO: 811893 - protein, 25 aa, Mycobacterium
FDQEGPAILMQILHQPMLDSDATPS

SEQ ID NO: 811894 - protein, 26 aa, Mycobacterium
FDQGSVLTFEYLPQGAPAANAFTIDV

SEQ ID NO: 811895 - protein, 24 aa, Mycobacterium
FDQHRDWLRLMARLSTTMAKQASG

SEQ ID NO: 811896 - protein, 19 aa, Mycobacterium
FDQITRLPEYYPTRAEAEI

SEQ ID NO: 811897 - protein, 21 aa, Mycobacterium
FDQITRLPEYYPTRAEAGILR

SEQ ID NO: 811898 - protein, 27 aa, Mycobacterium
FDQLCETLARYDVTLALAAGLQPGSVA

SEQ ID NO: 811899 - protein, 17 aa, Mycobacterium
FDQLRVLKTIGLLNLVS

SEQ ID NO: 811900 - protein, 18 aa, Mycobacterium
FDQLWTDLTFVHWPVLPN

SEQ ID NO: 811901 - protein, 25 aa, Mycobacterium
FDQNRIWCAIVQLACELTAWLQMLA

SEQ ID NO: 811902 - protein, 24 aa, Mycobacterium
FDQPILHGLCSYGMVLKAVVDSAL

SEQ ID NO: 811903 - protein, 18 aa, Mycobacterium
FDQPVPRDVLMECLELAL

SEQ ID NO: 811904 - protein, 19 aa, Mycobacterium
FDQSLPSAAPYRNFVTWLG

SEQ ID NO: 811905 - protein, 21 aa, Mycobacterium
FDQVIAVHLKGTWNGTKAAAA

SEQ ID NO: 811906 - protein, 21 aa, Mycobacterium
FDQYQLPDLGMWLIHGHTHSG

SEQ ID NO: 811907 - protein, 28 aa, Mycobacterium
FDQYVNLRPVRLLPGIAGPLAGRKPGDI

SEQ ID NO: 811908 - protein, 37 aa, Mycobacterium
FDRFPTLRIVFVEHAFSWILPLMWRMDAIYDARKSWV

SEQ ID NO: 811909 - protein, 36 aa, Mycobacterium
FDRFPTLRIVFVEHAFSWILPLMWRMDAIYEARKSW

SEQ ID NO: 811910 - protein, 37 aa, Mycobacterium
FDRFPTLRIVFVEHAFTWILPLMWRMDAIYAARKSRV

SEQ ID NO: 811911 - protein, 36 aa, Mycobacterium
FDRFPTLRIVFVEHAFTWILPLMWRMDAIYERRKSW

SEQ ID NO: 811912 - protein, 37 aa, Mycobacterium
FDRFPTLRIVLVEHAFTWILPLMWRMDALYDARKSRM

SEQ ID NO: 811913 - protein, 17 aa, Mycobacterium
FDRFYAEAARRIHLLPM

SEQ ID NO: 811914 - protein, 17 aa, Mycobacterium
FDRGALVKLAGLWFDAL

SEQ ID NO: 811915 - protein, 19 aa, Mycobacterium
FDRHGKRLALNPFGRIFYQ

SEQ ID NO: 811916 - protein, 23 aa, Mycobacterium
FDRIVGLLTERQFIHGPPTDPEV

SEQ ID NO: 811917 - protein, 17 aa, Mycobacterium
FDRLEITTCLRRGELEI

SEQ ID NO: 811918 - protein, 18 aa, Mycobacterium
FDRLEITTCLRRGELEIV

SEQ ID NO: 811919 - protein, 26 aa, Mycobacterium
FDRLVRRLSRFLPSDVRVLDISRAPA

SEQ ID NO: 811920 - protein, 31 aa, Mycobacterium
FDRMRPRERSYARWMFLSPDARKLFADWDVQ

SEQ ID NO: 811921 - protein, 25 aa, Mycobacterium
FDRPHSYTYLIVRSFPPFNHEGGTL

SEQ ID NO: 811922 - protein, 19 aa, Mycobacterium
FDRQRLVAEPAKSAGLPGT

SEQ ID NO: 811923 - protein, 31 aa, Mycobacterium
FDRQSATAMWHWFFHLQPDLPELLVAGNTEA

SEQ ID NO: 811924 - protein, 19 aa, Mycobacterium
FDRRAAWGYKLDIASGGGV

SEQ ID NO: 811925 - protein, 20 aa, Mycobacterium
FDRRAGLVAVRRDDLNRPVQ

SEQ ID NO: 811926 - protein, 24 aa, Mycobacterium
FDRRMLHNPSFNAGLPPLFNELIG

SEQ ID NO: 811927 - protein, 26 aa, Mycobacterium
FDRSPVCTHALAVYLGLPVCAALTAE

SEQ ID NO: 811928 - protein, 17 aa, Mycobacterium
FDRSRGITMYRADPDKV

SEQ ID NO: 811929 - protein, 26 aa, Mycobacterium
FDRTYIRFFTRRSLVRLFKTSGFGVR

SEQ ID NO: 811930 - protein, 18 aa, Mycobacterium
FDRVGAFGTGLVTAVSNP

SEQ ID NO: 811931 - protein, 17 aa, Mycobacterium
FDRVQTARLWGAAAISA

SEQ ID NO: 811932 - protein, 18 aa, Mycobacterium
FDRWGLMPRMLVGTTERD

SEQ ID NO: 811933 - protein, 18 aa, Mycobacterium
FDSARFAGIIRLYTARQV

SEQ ID NO: 811934 - protein, 28 aa, Mycobacterium
FDSDPFGLLPPLVRWIGKAMAAVPILRT

SEQ ID NO: 811935 - protein, 18 aa, Mycobacterium
FDSEQPLFLLYTSGTTGK

SEQ ID NO: 811936 - protein, 19 aa, Mycobacterium
FDSGLYLAHVPFDRVLELG

SEQ ID NO: 811937 - protein, 20 aa, Mycobacterium
FDSHLLWQEPYVIHSQILSA

SEQ ID NO: 811938 - protein, 17 aa, Mycobacterium
FDSIPTVMLRRMAWYWA

SEQ ID NO: 811939 - protein, 24 aa, Mycobacterium
FDSLFLMDHFYQLPMLGTPDQPML

SEQ ID NO: 811940 - protein, 23 aa, Mycobacterium
FDSMDALGLVLIDESFRSLRDML

SEQ ID NO: 811941 - protein, 31 aa, Mycobacterium
FDSMIPKLPGLHKAFYFGMGLVLQDERQGAE

SEQ ID NO: 811942 - protein, 24 aa, Mycobacterium
FDSPRFEGIIRLYTARQVAEQRGT

SEQ ID NO: 811943 - protein, 24 aa, Mycobacterium
FDSRAIGPGGLFLALPGAHVDGHD

SEQ ID NO: 811944 - protein, 23 aa, Mycobacterium
FDSRAVTAGGLFLALPGARSDGH

SEQ ID NO: 811945 - protein, 24 aa, Mycobacterium
FDSVAQLELLLPAMAGLVGTLTFD

SEQ ID NO: 811946 - protein, 20 aa, Mycobacterium
FDTAILLTRFLVGSWQYRRL

SEQ ID NO: 811947 - protein, 18 aa, Mycobacterium
FDTAVLGLTLALFRTATA

SEQ ID NO: 811948 - protein, 24 aa, Mycobacterium
FDTCPVIERALVKNPYMPTDLPAW

SEQ ID NO: 811949 - protein, 22 aa, Mycobacterium
FDTFADMELAWGPTWSTSLKSL

SEQ ID NO: 811950 - protein, 23 aa, Mycobacterium
FDTFARLYPGTTLLVDTYDTLRG

SEQ ID NO: 811951 - protein, 17 aa, Mycobacterium
FDTGPVRVLAWTTLGEL

SEQ ID NO: 811952 - protein, 18 aa, Mycobacterium
FDTHGLDVLAAPLTTPVA

SEQ ID NO: 811953 - protein, 26 aa, Mycobacterium
FDTIARLWDHIGDKGIGFCLDTCHAW

SEQ ID NO: 811954 - protein, 26 aa, Mycobacterium
FDTIGRLWDHIGDKGIGFCLDTCHAW

SEQ ID NO: 811955 - protein, 18 aa, Mycobacterium
FDTLFVYENYPIDRAALA

SEQ ID NO: 811956 - protein, 18 aa, Mycobacterium
FDTLLSYSAWAHSIGRTP

SEQ ID NO: 811957 - protein, 32 aa, Mycobacterium
FDTPLLRAALASMPPFCWMTQDGTGWALIYIA

SEQ ID NO: 811958 - protein, 19 aa, Mycobacterium
FDTQVLHRLPVSTWDVRCA

SEQ ID NO: 811959 - protein, 17 aa, Mycobacterium
FDTTNPGARQSNWARLA

SEQ ID NO: 811960 - protein, 19 aa, Mycobacterium
FDTVFHLASPASPVDYQRR

SEQ ID NO: 811961 - protein, 23 aa, Mycobacterium
FDTVLTFIMLHHTVRWEQTLAEA

SEQ ID NO: 811962 - protein, 28 aa, Mycobacterium
FDTVWQDTLARFFEHTPLAGTWELNDFG

SEQ ID NO: 811963 - protein, 17 aa, Mycobacterium
FDTVWVRQRHLQPGISS

SEQ ID NO: 811964 - protein, 23 aa, Mycobacterium
FDVADRICALYLGRVAADVPAAD

SEQ ID NO: 811965 - protein, 31 aa, Mycobacterium
FDVAFKVHVKGPFILTAALAPLMAQRGGGAI

SEQ ID NO: 811966 - protein, 25 aa, Mycobacterium
FDVAVRIWRPRWAAWGLHVVRSGGL

SEQ ID NO: 811967 - protein, 25 aa, Mycobacterium
FDVDGVIHIAGYKYAGESVKRPLHT

SEQ ID NO: 811968 - protein, 21 aa, Mycobacterium
FDVDWQLMSLAVLNEGRELPP

SEQ ID NO: 811969 - protein, 17 aa, Mycobacterium
FDVGRWLPQAGAVERID

SEQ ID NO: 811970 - protein, 18 aa, Mycobacterium
FDVHLGGPALFGPIGMIV

SEQ ID NO: 811971 - protein, 25 aa, Mycobacterium
FDVHLGGPALFGPIGMVVAGALKGD

SEQ ID NO: 811972 - protein, 18 aa, Mycobacterium
FDVIHLRGHTPGSIALAL

SEQ ID NO: 811973 - protein, 22 aa, Mycobacterium
FDVMGFGKPLDEIPMLLQPGVL

SEQ ID NO: 811974 - protein, 34 aa, Mycobacterium
FDVSQVLPAKLPRWLSLPAQLVMQALIGHVRVPG

SEQ ID NO: 811975 - protein, 17 aa, Mycobacterium
FDVSSIAATGPLGGEAA

SEQ ID NO: 811976 - protein, 17 aa, Mycobacterium
FDVWPGNDWFDKTVTDQ

SEQ ID NO: 811977 - protein, 17 aa, Mycobacterium
FDWDSQLFLCPYDVVEP

SEQ ID NO: 811978 - protein, 17 aa, Mycobacterium
FDWTYTRDDLNAFLNRL

SEQ ID NO: 811979 - protein, 17 aa, Mycobacterium
FDWVLAPYDIVASRAHT

SEQ ID NO: 811980 - protein, 17 aa, Mycobacterium
FDYGPWPRLDPDERIRK

SEQ ID NO: 811981 - protein, 20 aa, Mycobacterium
FDYVRDILSYLPSNNASEPP

SEQ ID NO: 811982 - protein, 25 aa, Mycobacterium
FEAAFAMTVPPPVIAANRVLLATLV

SEQ ID NO: 811983 - protein, 18 aa, Mycobacterium
FEAAQVCRWLLTSRLELI

SEQ ID NO: 811984 - protein, 26 aa, Mycobacterium
FEAARAAMIHPLAVAANRNALVQLVL

SEQ ID NO: 811985 - protein, 26 aa, Mycobacterium
FEAFKAERYPVFFERAYSILPDDGRM

SEQ ID NO: 811986 - protein, 19 aa, Mycobacterium
FEAFQHAISQTFVPLALCV

SEQ ID NO: 811987 - protein, 17 aa, Mycobacterium
FEAIGVPGIIDDALRRA

SEQ ID NO: 811988 - protein, 18 aa, Mycobacterium
FEALAALGGLDRAALHSQ

SEQ ID NO: 811989 - protein, 19 aa, Mycobacterium
FEALQPQTPRLTNTASLVC

SEQ ID NO: 811990 - protein, 25 aa, Mycobacterium
FEAPIQRIWQIYADPRQLEKVWGPP

SEQ ID NO: 811991 - protein, 19 aa, Mycobacterium
FEARMHSWWEHAAAQREPS

SEQ ID NO: 811992 - protein, 27 aa, Mycobacterium
FEATLAEGLLYERRLIHSAFATADQSE

SEQ ID NO: 811993 - protein, 20 aa, Mycobacterium
FEAYPQWNPEIKGCWILARY

SEQ ID NO: 811994 - protein, 21 aa, Mycobacterium
FECGGFAVHFFSRELVASLAD

SEQ ID NO: 811995 - protein, 24 aa, Mycobacterium
FEDALKRHLGFAGTVERIWAGISP

SEQ ID NO: 811996 - protein, 25 aa, Mycobacterium
FEDEFHPELQFDKPYLLAMANAGPG

SEQ ID NO: 811997 - protein, 22 aa, Mycobacterium
FEDELFITGRIKDLLVVDGSNH

SEQ ID NO: 811998 - protein, 26 aa, Mycobacterium
FEDFLATIAVTRLVMGPKVRIQAPPN

SEQ ID NO: 811999 - protein, 25 aa, Mycobacterium
FEDGGWIWFDITTDTAVTLLNAGWY

SEQ ID NO: 812000 - protein, 25 aa, Mycobacterium
FEDGPNLLGQAWPLFAQSMAMIVEH

SEQ ID NO: 812001 - protein, 23 aa, Mycobacterium
FEDPFSFNILRNPNPHVGFGGTG

SEQ ID NO: 812002 - protein, 17 aa, Mycobacterium
FEDRPITAQAPWPIGYD

SEQ ID NO: 812003 - protein, 24 aa, Mycobacterium
FEDRTDILALLLRSTYDDGTTMSR

SEQ ID NO: 812004 - protein, 18 aa, Mycobacterium
FEDRVVMVALTLAAGDLQ

SEQ ID NO: 812005 - protein, 17 aa, Mycobacterium
FEDTPVKAARYLYPRVE

SEQ ID NO: 812006 - protein, 17 aa, Mycobacterium
FEDVLMLRVFLNAPEGF

SEQ ID NO: 812007 - protein, 20 aa, Mycobacterium
FEEALTVIRLLWDSDGPVDF

SEQ ID NO: 812008 - protein, 22 aa, Mycobacterium
FEEALTVIRLLWRSDGPVDFDG

SEQ ID NO: 812009 - protein, 18 aa, Mycobacterium
FEEGLATIRALWDSNGAL

SEQ ID NO: 812010 - protein, 18 aa, Mycobacterium
FEEGLATIRALWNSNGQL

SEQ ID NO: 812011 - protein, 17 aa, Mycobacterium
FEEILEQMRSVLAALAL

SEQ ID NO: 812012 - protein, 20 aa, Mycobacterium
FEELFKPGLIFLSAATRHIV

SEQ ID NO: 812013 - protein, 17 aa, Mycobacterium
FEELRLLSRLRSRPTTL

SEQ ID NO: 812014 - protein, 17 aa, Mycobacterium
FEELRVLSLLPSQATTL

SEQ ID NO: 812015 - protein, 23 aa, Mycobacterium
FEERGRRWPMIISGTITDASGRT

SEQ ID NO: 812016 - protein, 24 aa, Mycobacterium
FEERGRRWPVIISGTITDASGRTL

SEQ ID NO: 812017 - protein, 18 aa, Mycobacterium
FEEVPGSDLFLLKNVLGN

SEQ ID NO: 812018 - protein, 21 aa, Mycobacterium
FEEWNRFLAVNLTGTFLCMQA

SEQ ID NO: 812019 - protein, 17 aa, Mycobacterium
FEFIAPKAESTLMHGRA

SEQ ID NO: 812020 - protein, 20 aa, Mycobacterium
FEFRWNDQFALSLDPDTARE

SEQ ID NO: 812021 - protein, 19 aa, Mycobacterium
FEGAHDPFLPLLLAAEHTK

SEQ ID NO: 812022 - protein, 22 aa, Mycobacterium
FEGELFITGRIKDLLIVDGSNH

SEQ ID NO: 812023 - protein, 20 aa, Mycobacterium
FEGFDPAKLDRLTLGLSRRF

SEQ ID NO: 812024 - protein, 20 aa, Mycobacterium
FEGGPLLRFMSGNLSQQIEH

SEQ ID NO: 812025 - protein, 29 aa, Mycobacterium
FEGGQMPIHMRLPKLKGFKNRFRTEYQVV

SEQ ID NO: 812026 - protein, 26 aa, Mycobacterium
FEGGWVLEQIIGDAPLLAPLELLAYC

SEQ ID NO: 812027 - protein, 26 aa, Mycobacterium
FEGGWVLEQIIGSSPLLAPLELLAYC

SEQ ID NO: 812028 - protein, 19 aa, Mycobacterium
FEGGWVLEQIVGESPLLAP

SEQ ID NO: 812029 - protein, 30 aa, Mycobacterium
FEGGWVLEQIVGPAPLLAPMELLAYCAACT

SEQ ID NO: 812030 - protein, 28 aa, Mycobacterium
FEGIAVPKFPNLLTLNGPYSYSGLSYFD

SEQ ID NO: 812031 - protein, 17 aa, Mycobacterium
FEGIMDALFTGLIAIHG

SEQ ID NO: 812032 - protein, 24 aa, Mycobacterium
FEGLHLRFGLVARGGLRWSDRHDD

SEQ ID NO: 812033 - protein, 17 aa, Mycobacterium
FEGLVESFDFAAGGGVI

SEQ ID NO: 812034 - protein, 17 aa, Mycobacterium
FEGPHNAFYLGTAEPDP

SEQ ID NO: 812035 - protein, 23 aa, Mycobacterium
FEGPLRVLLADYARADLNAVGVH

SEQ ID NO: 812036 - protein, 19 aa, Mycobacterium
FEGPPPWNIGEPQPELAAL

SEQ ID NO: 812037 - protein, 19 aa, Mycobacterium
FEGQIGQLAYTASKAAIAG

SEQ ID NO: 812038 - protein, 23 aa, Mycobacterium
FEGTIPANRLDWVDTYIGDVETE

SEQ ID NO: 812039 - protein, 19 aa, Mycobacterium
FEHGRIKTTEPKARALRPY

SEQ ID NO: 812040 - protein, 18 aa, Mycobacterium
FEHIVDNALYLHPVQATI

SEQ ID NO: 812041 - protein, 21 aa, Mycobacterium
FEHPGLDRVLQWDPRFASESV

SEQ ID NO: 812042 - protein, 17 aa, Mycobacterium
FEHRPLDFFAPMVEQVF

SEQ ID NO: 812043 - protein, 21 aa, Mycobacterium
FEHWSIHRKPPAFEDLEPRTE

SEQ ID NO: 812044 - protein, 20 aa, Mycobacterium
FEHWSIHRKPPAFEELEPRT

SEQ ID NO: 812045 - protein, 24 aa, Mycobacterium
FEIADLGIVGDLFKVSPQLTEAVK

SEQ ID NO: 812046 - protein, 25 aa, Mycobacterium
FEIADYGVIGDLFKVAPQLTEGVKA

SEQ ID NO: 812047 - protein, 24 aa, Mycobacterium
FEIADYGVVGDLFKVAPQLTDAIK

SEQ ID NO: 812048 - protein, 25 aa, Mycobacterium
FEIADYGVVGDLFKVAPQLTDAIKA

SEQ ID NO: 812049 - protein, 25 aa, Mycobacterium
FEIADYGVVGDLFKVAPQLTEAIKA

SEQ ID NO: 812050 - protein, 17 aa, Mycobacterium
FEICARLTTKHGISSSR

SEQ ID NO: 812051 - protein, 28 aa, Mycobacterium
FEIFADLELAWGPTWSGSLKSLWLGEGE

SEQ ID NO: 812052 - protein, 17 aa, Mycobacterium
FEIPELIADALAPYGIV

SEQ ID NO: 812053 - protein, 19 aa, Mycobacterium
FEISGPVPKAPLGRSNNYP

SEQ ID NO: 812054 - protein, 24 aa, Mycobacterium
FEISTPVMPLMLKGITVNGIGTGH

SEQ ID NO: 812055 - protein, 18 aa, Mycobacterium
FEITAAAGGLDTAFRASY

SEQ ID NO: 812056 - protein, 28 aa, Mycobacterium
FEKENLPPGAWPHTGWYAEWVSGQDIFD

SEQ ID NO: 812057 - protein, 28 aa, Mycobacterium
FEKMLYDNAQLLRVYAHWARRTADPSAR

SEQ ID NO: 812058 - protein, 21 aa, Mycobacterium
FEKTLRFWLERGVDGFRIDVA

SEQ ID NO: 812059 - protein, 17 aa, Mycobacterium
FEKYLRHGPVFTVKMPY

SEQ ID NO: 812060 - protein, 25 aa, Mycobacterium
FELAELRGRILQGRMLLHAVARQVD

SEQ ID NO: 812061 - protein, 29 aa, Mycobacterium
FELAPTLPLRIYWALLGWARGRTNRNGMR

SEQ ID NO: 812062 - protein, 26 aa, Mycobacterium
FELAQKATMAGIPILAAVSAPSSLAV

SEQ ID NO: 812063 - protein, 17 aa, Mycobacterium
FELARDLGPEMALKNLG

SEQ ID NO: 812064 - protein, 28 aa, Mycobacterium
FELHARAILGLACDTIMISPGAAEVTYA

SEQ ID NO: 812065 - protein, 26 aa, Mycobacterium
FELHARAILGLPVDTTLKSAGASAVI

SEQ ID NO: 812066 - protein, 26 aa, Mycobacterium
FELHARAILGLPVDTTLKSPGASAVI

SEQ ID NO: 812067 - protein, 27 aa, Mycobacterium
FELHARAILGLPVDTTLRAPGASAVIY

SEQ ID NO: 812068 - protein, 17 aa, Mycobacterium
FELHPSIAALVAGLRLR

SEQ ID NO: 812069 - protein, 17 aa, Mycobacterium
FELIEQLVRGVGGLAQR

SEQ ID NO: 812070 - protein, 17 aa, Mycobacterium
FELISLTGDPAATPVLG

SEQ ID NO: 812071 - protein, 35 aa, Mycobacterium
FELNVYIPMMARNILESFKLLTNVSKLFAERCITG

SEQ ID NO: 812072 - protein, 35 aa, Mycobacterium
FELNVYIPMMARNILESFKLLTNVSKLFAQRCITG

SEQ ID NO: 812073 - protein, 24 aa, Mycobacterium
FELNVYIPMMARNILESFTLLTNV

SEQ ID NO: 812074 - protein, 23 aa, Mycobacterium
FELNVYIPMMARNVLESFKLLTN

SEQ ID NO: 812075 - protein, 23 aa, Mycobacterium
FELNVYIPMMARNVLESFTLLAN

SEQ ID NO: 812076 - protein, 17 aa, Mycobacterium
FELPSLPVAIKVDINDE

SEQ ID NO: 812077 - protein, 27 aa, Mycobacterium
FELQFGTNHLGPFALTGLLIDHLLPVE

SEQ ID NO: 812078 - protein, 27 aa, Mycobacterium
FELRLGDAWVWDMYRPARFVKQVRVIT

SEQ ID NO: 812079 - protein, 18 aa, Mycobacterium
FELRRRNVVRPGDRLIDA

SEQ ID NO: 812080 - protein, 32 aa, Mycobacterium
FELSDNFVTYLGWLYSWGSPLTLIGDDVDQIA

SEQ ID NO: 812081 - protein, 22 aa, Mycobacterium
FELTQKAVLAGIPVLAAVSAPS

SEQ ID NO: 812082 - protein, 20 aa, Mycobacterium
FELTQKAVMAGIPVLAAVSA

SEQ ID NO: 812083 - protein, 21 aa, Mycobacterium
FELTQKAVMAGIPVLAAVSAP

SEQ ID NO: 812084 - protein, 17 aa, Mycobacterium
FELVRWLGRFKTEEAKE

SEQ ID NO: 812085 - protein, 25 aa, Mycobacterium
FELVTEFLRPIFRRHWSYVEPGVSV

SEQ ID NO: 812086 - protein, 19 aa, Mycobacterium
FEMAATVDYLFGYDATAHV

SEQ ID NO: 812087 - protein, 20 aa, Mycobacterium
FEMLGRPWRTERRPTVPGVA

SEQ ID NO: 812088 - protein, 17 aa, Mycobacterium
FEMLRYVADRFLLLPMP

SEQ ID NO: 812089 - protein, 17 aa, Mycobacterium
FEMMGTLTPEVIASDAE

SEQ ID NO: 812090 - protein, 21 aa, Mycobacterium
FEMQFGTNHLGHFALTGLLLD

SEQ ID NO: 812091 - protein, 33 aa, Mycobacterium; identical to SEQ ID NO: 114462

SEQ ID NO: 812092 - protein, 34 aa, Mycobacterium
FEMTLGTNLLGPFALTNLLLPRVRSQIINVGSDA

SEQ ID NO: 812093 - protein, 31 aa, Mycobacterium
FENEAPAWQRLLTDYFLPADKYPAINITSIK

SEQ ID NO: 812094 - protein, 19 aa, Mycobacterium
FENKIVLSIATRLLAESYM

SEQ ID NO: 812095 - protein, 18 aa, Mycobacterium
FENPDQWELFKRERPITA

SEQ ID NO: 812096 - protein, 18 aa, Mycobacterium
FENPFTFDIMRDPNPHVG

SEQ ID NO: 812097 - protein, 26 aa, Mycobacterium
FENPSPHIPWDRLPVEVVKESIPWRR

SEQ ID NO: 812098 - protein, 24 aa, Mycobacterium
FENRPNPYPYFKELRRTPVAKVAD

SEQ ID NO: 812099 - protein, 33 aa, Mycobacterium
FEPDATTLFGALLPRYLATRVYAALLEAAASES

SEQ ID NO: 812100 - protein, 32 aa, Mycobacterium
FEPDPETLFDALLPRYIATRVYAALLEAAASE

SEQ ID NO: 812101 - protein, 32 aa, Mycobacterium
FEPDPETLFDALLPRYVATRVYAALLEAAASE

SEQ ID NO: 812102 - protein, 31 aa, Mycobacterium
FEPEPRALSWTVYSVPRIPPGAYIELGEAEY

SEQ ID NO: 812103 - protein, 23 aa, Mycobacterium
FEPFLRRARPFSPFLSDRSATLP

SEQ ID NO: 812104 - protein, 17 aa, Mycobacterium
FEPKRRYWEKGEVDTAL

SEQ ID NO: 812105 - protein, 19 aa, Mycobacterium
FEPLPAGVLHVPYGDLAAI

SEQ ID NO: 812106 - protein, 17 aa, Mycobacterium
FEPVPTFTDPRPLRPGE

SEQ ID NO: 812107 - protein, 21 aa, Mycobacterium
FEQAFQRRLPVMLTGPTGCGK

SEQ ID NO: 812108 - protein, 24 aa, Mycobacterium
FEQDRLIAWTVLGQIQPPIGHVYG

SEQ ID NO: 812109 - protein, 22 aa, Mycobacterium
FEQFPNLHQLFWQGVKGAGDVK

SEQ ID NO: 812110 - protein, 19 aa, Mycobacterium
FEQGDYRWVAQVLNYVIFA

SEQ ID NO: 812111 - protein, 24 aa, Mycobacterium
FEQHLRAVLDYPLGDTSALAPTVM

SEQ ID NO: 812112 - protein, 24 aa, Mycobacterium
FEQLLIDEGILLRKYWFSVSEAEQ

SEQ ID NO: 812113 - protein, 19 aa, Mycobacterium
FEQLMRSFFVDFGTKFPTE

SEQ ID NO: 812114 - protein, 23 aa, Mycobacterium
FEQLTLRETGFWRFAPDPNDPDE

SEQ ID NO: 812115 - protein, 17 aa, Mycobacterium
FEQMLIEDGIILRKYWF

SEQ ID NO: 812116 - protein, 26 aa, Mycobacterium
FEQNEDVWLPLFRPTAEPETAALPDD

SEQ ID NO: 812117 - protein, 22 aa, Mycobacterium
FEQQLAINTYWDLIGGHNMLPG

SEQ ID NO: 812118 - protein, 19 aa, Mycobacterium
FEQVAYLLWHGELPDEQQL

SEQ ID NO: 812119 - protein, 27 aa, Mycobacterium
FEQVEDVWFPLFRPTTETERAALPDDE

SEQ ID NO: 812120 - protein, 17 aa, Mycobacterium
FEQWKPRRRTLQPVFTK

SEQ ID NO: 812121 - protein, 36 aa, Mycobacterium
FEQWLKIKDGLISSLFTPFPPVSGLMQLLRKLGTAE

SEQ ID NO: 812122 - protein, 18 aa, Mycobacterium
FEQWRTIISANLDSCFVV

SEQ ID NO: 812123 - protein, 18 aa, Mycobacterium
FERADRIGGLLRYGIPEF

SEQ ID NO: 812124 - protein, 25 aa, Mycobacterium
FERDAIPLLDQLYGGALRMTRNPAD

SEQ ID NO: 812125 - protein, 26 aa, Mycobacterium
FERDALPLLDQLYGAALRMTRNPADA

SEQ ID NO: 812126 - protein, 17 aa, Mycobacterium
FEREIVALVRRYTEGHP

SEQ ID NO: 812127 - protein, 19 aa, Mycobacterium
FERGAALGGALRWAAVLHP

SEQ ID NO: 812128 - protein, 18 aa, Mycobacterium
FERGLMSMMTGRRPAVRA

SEQ ID NO: 812129 - protein, 18 aa, Mycobacterium
FERLLSLAAIKDVDARPT

SEQ ID NO: 812130 - protein, 22 aa, Mycobacterium
FERLRRTLLVYLHYQEEHPFAP

SEQ ID NO: 812131 - protein, 17 aa, Mycobacterium
FERLVGLGIIRLEDDHA

SEQ ID NO: 812132 - protein, 21 aa, Mycobacterium
FERMPALKFVWADGAADLLTP

SEQ ID NO: 812133 - protein, 23 aa, Mycobacterium
FERQDDIWIPLFEPDSEAADAGP

SEQ ID NO: 812134 - protein, 19 aa, Mycobacterium
FERQPGFAEAFLPGGRAPK

SEQ ID NO: 812135 - protein, 22 aa, Mycobacterium
FERRGLPLTIFAVATALQRNPE

SEQ ID NO: 812136 - protein, 17 aa, Mycobacterium
FERRGRWNVPKKLTTFA

SEQ ID NO: 812137 - protein, 32 aa, Mycobacterium
FERSGPERILSTGPLLFAAIRTLGRGPVPDDR

SEQ ID NO: 812138 - protein, 24 aa, Mycobacterium
FERTALWHSTFQQCSLLGSVFVGC

SEQ ID NO: 812139 - protein, 17 aa, Mycobacterium
FERTLQWATDTELDGRR

SEQ ID NO: 812140 - protein, 28 aa, Mycobacterium
FERVRALIVERLPSMPQLRWRVTDVPLG

SEQ ID NO: 812141 - protein, 21 aa, Mycobacterium
FERYQLPYNALTQTDLHSVDL

SEQ ID NO: 812142 - protein, 21 aa, Mycobacterium
FERYRPVFVSVTYGAGGSTRD

SEQ ID NO: 812143 - protein, 28 aa, Mycobacterium
FESGWTFDHFYPIFSDPTGPCLEGWVTL

SEQ ID NO: 812144 - protein, 18 aa, Mycobacterium
FESIRWRLDVWNASAQVS

SEQ ID NO: 812145 - protein, 25 aa, Mycobacterium
FESKDELFLALLDREFELRGEQIAT

SEQ ID NO: 812146 - protein, 25 aa, Mycobacterium
FESKSAILVALFDQVIDDLIAEEKR

SEQ ID NO: 812147 - protein, 23 aa, Mycobacterium
FESLEQRGLLRRPIIPEGCSHNA

SEQ ID NO: 812148 - protein, 19 aa, Mycobacterium
FESPTFTPRMREVIILRVA

SEQ ID NO: 812149 - protein, 25 aa, Mycobacterium
FESQAMHLALEAIWLMLGEANRYFS

SEQ ID NO: 812150 - protein, 25 aa, Mycobacterium
FESQYPAFGLFGLGPVGGFDHGGHG

SEQ ID NO: 812151 - protein, 29 aa, Mycobacterium
FESSLAEGLLFERRIFHSAFGTADQSEGM

SEQ ID NO: 812152 - protein, 26 aa, Mycobacterium
FESTLAEGLLYERRLFHSTFATDDQS

SEQ ID NO: 812153 - protein, 26 aa, Mycobacterium
FESTLAEGLLYERRLFHSTFATEDQS

SEQ ID NO: 812154 - protein, 25 aa, Mycobacterium
FESYAAQLQFAAPTLPLVCNRTGAV

SEQ ID NO: 812155 - protein, 25 aa, Mycobacterium
FESYAAQVQFAAPTLPLVCNRTGAV

SEQ ID NO: 812156 - protein, 23 aa, Mycobacterium
FESYALYPPMSVRENLLYGLKAR

SEQ ID NO: 812157 - protein, 25 aa, Mycobacterium
FESYDLLMTPTLATPPPRIGEFELP

SEQ ID NO: 812158 - protein, 18 aa, Mycobacterium
FETAPFTAYLLGLSDIGE

SEQ ID NO: 812159 - protein, 24 aa, Mycobacterium
FETLEPMMRITLNTILRAVFGAKG

SEQ ID NO: 812160 - protein, 24 aa, Mycobacterium
FETMEPMMRITLNAILRAVFGADG

SEQ ID NO: 812161 - protein, 26 aa, Mycobacterium
FETPSPHIPWERLPIEVVRETVPWQR

SEQ ID NO: 812162 - protein, 24 aa, Mycobacterium
FETVPIDMTPFFAAADLLYNGALV

SEQ ID NO: 812163 - protein, 26 aa, Mycobacterium
FETVRSMIPILEQLSFDEAFGEPSEL

SEQ ID NO: 812164 - protein, 22 aa, Mycobacterium
FEVAAAARWRKVATRTVRALMD

SEQ ID NO: 812165 - protein, 17 aa, Mycobacterium
FEVAKLLAAEGARVAIL

SEQ ID NO: 812166 - protein, 17 aa, Mycobacterium
FEVEMFYQPPKTHKERL

SEQ ID NO: 812167 - protein, 19 aa, Mycobacterium
FEVIGPWEIDRGPQLFAYD

SEQ ID NO: 812168 - protein, 19 aa, Mycobacterium
FEVILGVWERRSSEVAQSV

SEQ ID NO: 812169 - protein, 29 aa, Mycobacterium
FEVNEAFAPVPLAWIAETGADPARVNPLG

SEQ ID NO: 812170 - protein, 29 aa, Mycobacterium
FEVNEAFAPVPLAWLAETGADPARMNPLG

SEQ ID NO: 812171 - protein, 29 aa, Mycobacterium
FEVNEAFAPVPLAWLAETGADPGRLNPLG

SEQ ID NO: 812172 - protein, 27 aa, Mycobacterium
FEVNEAFAPVPLAWLAETGADPRRLNP

SEQ ID NO: 812173 - protein, 25 aa, Mycobacterium
FEVSSDHYFPWLSSQGHAPYAWSVL

SEQ ID NO: 812174 - protein, 25 aa, Mycobacterium
FEVVAPARVRAAVLAALRAAHPYEE

SEQ ID NO: 812175 - protein, 19 aa, Mycobacterium
FEVVDVYRGVNTLVIQYRN

SEQ ID NO: 812176 - protein, 24 aa, Mycobacterium
FEWDPVLVRAFLRGPMHGAVSPPN

SEQ ID NO: 812177 - protein, 20 aa, Mycobacterium
FEWLIGSQRWRDSAIARGEA

SEQ ID NO: 812178 - protein, 19 aa, Mycobacterium
FEWLIGSQRWRESAAQRGD

SEQ ID NO: 812179 - protein, 17 aa, Mycobacterium
FEYLLPAVRRRRADQSG

SEQ ID NO: 812180 - protein, 33 aa, Mycobacterium
FEYPYAELDEIWKLVLLQQFHDILPGSSIAWVH

SEQ ID NO: 812181 - protein, 18 aa, Mycobacterium
FEYWRRHLKTMKGQWAPF

SEQ ID NO: 812182 - protein, 18 aa, Mycobacterium
FFAKNMLPKLTGVRAVIE

SEQ ID NO: 812183 - protein, 20 aa, Mycobacterium
FFAKNMLPLLTSTRQIIENL

SEQ ID NO: 812184 - protein, 18 aa, Mycobacterium
FFALFLDPNMVYTCAYFE

SEQ ID NO: 812185 - protein, 19 aa, Mycobacterium
FFARIWPVVASHETESIRA

SEQ ID NO: 812186 - protein, 19 aa, Mycobacterium
FFARLWTAMSSREPESLRR

SEQ ID NO: 812187 - protein, 19 aa, Mycobacterium
FFARVWPFVANHEAEAIRV

SEQ ID NO: 812188 - protein, 24 aa, Mycobacterium
FFASDLLLMNDISELAFGLGIVRE

SEQ ID NO: 812189 - protein, 18 aa, Mycobacterium
FFASVEQLTRPTLRGRPV

SEQ ID NO: 812190 - protein, 18 aa, Mycobacterium
FFAVRAGSLIAWRSNTDS

SEQ ID NO: 812191 - protein, 18 aa, Mycobacterium
FFCTQLPTDLPNDVLSQL

SEQ ID NO: 812192 - protein, 18 aa, Mycobacterium
FFCTQLPTDVPNNVLSQL

SEQ ID NO: 812193 - protein, 17 aa, Mycobacterium
FFDAPFADVSKGFHISA

SEQ ID NO: 812194 - protein, 17 aa, Mycobacterium
FFDDTMVETILAFEAAV

SEQ ID NO: 812195 - protein, 19 aa, Mycobacterium
FFDGKPLRAYRPPTRRWGS

SEQ ID NO: 812196 - protein, 29 aa, Mycobacterium
FFDIGAVVYFLRKLIWTVPDFTAEPYFQR

SEQ ID NO: 812197 - protein, 17 aa, Mycobacterium
FFDSAEIIELHHPQKAD

SEQ ID NO: 812198 - protein, 24 aa, Mycobacterium
FFDSAPCGLLLTSPDGRIIRANET

SEQ ID NO: 812199 - protein, 33 aa, Mycobacterium
FFDVGAVIYFLRKVIWFLPDFTVECYHDQLRAL

SEQ ID NO: 812200 - protein, 29 aa, Mycobacterium
FFDVGAVIYFLRKVIWTVPDFTVDAYRER

SEQ ID NO: 812201 - protein, 17 aa, Mycobacterium
FFEDGNALVGMIVEGGT

SEQ ID NO: 812202 - protein, 18 aa, Mycobacterium
FFEEFGIEDVPLVGGKNA

SEQ ID NO: 812203 - protein, 19 aa, Mycobacterium
FFEEFGIEDVPLVGGKNAS

SEQ ID NO: 812204 - protein, 19 aa, Mycobacterium
FFEEIGIADVPLVGGKNAS

SEQ ID NO: 812205 - protein, 17 aa, Mycobacterium
FFEELAAVGYGRLSVDA

SEQ ID NO: 812206 - protein, 17 aa, Mycobacterium
FFEKMVASPAFKSAMRS

SEQ ID NO: 812207 - protein, 19 aa, Mycobacterium
FFENTLYSDPTHWAGLTLD

SEQ ID NO: 812208 - protein, 17 aa, Mycobacterium
FFERGFAAVSLSDIAQA

SEQ ID NO: 812209 - protein, 23 aa, Mycobacterium
FFESIPKLLPFKPEMRDLLAGRS

SEQ ID NO: 812210 - protein, 26 aa, Mycobacterium
FFFDGELFIIGRIKDLLIVYGRNHSP

SEQ ID NO: 812211 - protein, 19 aa, Mycobacterium
FFGDIPRVPFIMPGTDELA

SEQ ID NO: 812212 - protein, 17 aa, Mycobacterium
FFGHHLWAETRIELFTQ

SEQ ID NO: 812213 - protein, 18 aa, Mycobacterium
FFGHVLQFASGPLSNVIV

SEQ ID NO: 812214 - protein, 17 aa, Mycobacterium
FFGIVLQAPGASGAVRH

SEQ ID NO: 812215 - protein, 18 aa, Mycobacterium
FFGRYFSPDEARALIAEQ

SEQ ID NO: 812216 - protein, 21 aa, Mycobacterium
FFGTSWPKEFGGQDLPPVYDV

SEQ ID NO: 812217 - protein, 20 aa, Mycobacterium
FFGYDFKEFRVDPAWVPPEE

SEQ ID NO: 812218 - protein, 19 aa, Mycobacterium
FFHDGSLYGIPMPPGLVSH

SEQ ID NO: 812219 - protein, 25 aa, Mycobacterium
FFHELGHMLIDIYQLPATGREEDVA

SEQ ID NO: 812220 - protein, 26 aa, Mycobacterium
FFIEEWAEHIGFVYPPALAADLEPYL

SEQ ID NO: 812221 - protein, 17 aa, Mycobacterium
FFLFHDKETDRPSVVYR

SEQ ID NO: 812222 - protein, 18 aa, Mycobacterium
FFLLGKLDDAHAVWEAYV

SEQ ID NO: 812223 - protein, 19 aa, Mycobacterium
FFNHPIKGFFRALDYTLPW

SEQ ID NO: 812224 - protein, 20 aa, Mycobacterium
FFNHVVTPGRRFATAPLSLA

SEQ ID NO: 812225 - protein, 18 aa, Mycobacterium
FFNSGFTNTGLFNSGNTN

SEQ ID NO: 812226 - protein, 18 aa, Mycobacterium
FFNYYRMSADKRVVFGGG

SEQ ID NO: 812227 - protein, 42 aa, Mycobacterium
FFQDGEEFWRLLFTNPVAAFEFLFGILVFDLPTHIMQIVTWL

SEQ ID NO: 812228 - protein, 17 aa, Mycobacterium
FFQLYVTALEVGVIHAL

SEQ ID NO: 812229 - protein, 17 aa, Mycobacterium
FFRLFLDPTQTYSCAYF

SEQ ID NO: 812230 - protein, 19 aa, Mycobacterium
FFRSIWTVRSPIRLMRKVW

SEQ ID NO: 812231 - protein, 19 aa, Mycobacterium
FFRSYPYHDAFLLEDARRF

SEQ ID NO: 812232 - protein, 19 aa, Mycobacterium
FFSMIFDRDGLVPGSEQIK

SEQ ID NO: 812233 - protein, 19 aa, Mycobacterium
FFTDMRVPIANRLGDKDGL

SEQ ID NO: 812234 - protein, 18 aa, Mycobacterium
FFTPVVDDPYDWGRIAAT

SEQ ID NO: 812235 - protein, 17 aa, Mycobacterium
FFVATAPAYSFVSSSLA

SEQ ID NO: 812236 - protein, 20 aa, Mycobacterium
FFVDAATHGWRFTRPGAPFR

SEQ ID NO: 812237 - protein, 21 aa, Mycobacterium
FFVLSQGIFDLLPPGGDLVAD

SEQ ID NO: 812238 - protein, 30 aa, Mycobacterium
FGADPRLLASFPYPHLLTVTARLADRTLTV

SEQ ID NO: 812239 - protein, 30 aa, Mycobacterium
FGADPTLLASFPYPHVLAMSVRLAERTLTV

SEQ ID NO: 812240 - protein, 17 aa, Mycobacterium
FGADRIMFAADYPYGDA

SEQ ID NO: 812241 - protein, 28 aa, Mycobacterium
FGAEVDRPWAVAELLLHQLMPIREGTVV

SEQ ID NO: 812242 - protein, 17 aa, Mycobacterium
FGAFAERTVVDAAALAP

SEQ ID NO: 812243 - protein, 25 aa, Mycobacterium
FGAFLQMFWRAFPDAFFEISGSPYL

SEQ ID NO: 812244 - protein, 18 aa, Mycobacterium
FGAFVPRGITLRVYGDAN

SEQ ID NO: 812245 - protein, 32 aa, Mycobacterium
FGAGLQAFARDFFLLWAPYPNSYKRFRDGTFA

SEQ ID NO: 812246 - protein, 22 aa, Mycobacterium
FGAHAFVADFRLAPEHPYPAQI

SEQ ID NO: 812247 - protein, 18 aa, Mycobacterium
FGAKLWVVPANMASYADI

SEQ ID NO: 812248 - protein, 17 aa, Mycobacterium
FGAKVAALTPRMSEWLR

SEQ ID NO: 812249 - protein, 19 aa, Mycobacterium
FGALAPRLEHELGKPVWAV

SEQ ID NO: 812250 - protein, 17 aa, Mycobacterium
FGALIRHHSAFKRIAVV

SEQ ID NO: 812251 - protein, 17 aa, Mycobacterium
FGALLADAPVTPVTERA

SEQ ID NO: 812252 - protein, 18 aa, Mycobacterium
FGALLEDLFTRPGGPELR

SEQ ID NO: 812253 - protein, 34 aa, Mycobacterium
FGALVCQVPLLDMRRYHLLLAGASWVAEYGDPDN

SEQ ID NO: 812254 - protein, 24 aa, Mycobacterium
FGAPPPDVVRQLSALGLLVSVTVT

SEQ ID NO: 812255 - protein, 18 aa, Mycobacterium
FGAPYAYAQPHSGIDANL

SEQ ID NO: 812256 - protein, 30 aa, Mycobacterium
FGARLCRLSLGWALLMRGELIQAVAQFSAV

SEQ ID NO: 812257 - protein, 25 aa, Mycobacterium
FGARLQPRLLADALIRMSAGGDLFR

SEQ ID NO: 812258 - protein, 23 aa, Mycobacterium
FGARTVHIIAGNSPLIAALSIIR

SEQ ID NO: 812259 - protein, 23 aa, Mycobacterium
FGARVDQLPEIWKRLVDGGMESG

SEQ ID NO: 812260 - protein, 38 aa, Mycobacterium
FGASRPRVPLPTYPFERERLWMSPPRSVLDKPVQAPIA

SEQ ID NO: 812261 - protein, 27 aa, Mycobacterium
FGATMNALYGPRFVLGLGRGVPLPDMP

SEQ ID NO: 812262 - protein, 21 aa, Mycobacterium
FGAVELWPVVHAVEPSRALTG

SEQ ID NO: 812263 - protein, 17 aa, Mycobacterium
FGAVFKLSSKTNGGEVS

SEQ ID NO: 812264 - protein, 19 aa, Mycobacterium
FGAVGVIAPWNGSLVVAAS

SEQ ID NO: 812265 - protein, 19 aa, Mycobacterium
FGCEPPLRELLNGATVERL

SEQ ID NO: 812266 - protein, 33 aa, Mycobacterium
FGCHRPHLLSPHHYRLSSPRWPIIVGGVRDEST

SEQ ID NO: 812267 - protein, 21 aa, Mycobacterium
FGCPHYDAILAGYQRVRSLKP

SEQ ID NO: 812268 - protein, 25 aa, Mycobacterium
FGDANLERGFFIGPTLFDHVTPDMS

SEQ ID NO: 812269 - protein, 20 aa, Mycobacterium
FGDDLPIAWRHRSERYTEKL

SEQ ID NO: 812270 - protein, 23 aa, Mycobacterium
FGDGLWYVDLAPVSHAEAVPVTV

SEQ ID NO: 812271 - protein, 24 aa, Mycobacterium
FGDGNLSGILNFGSGNTGSFNMGS

SEQ ID NO: 812272 - protein, 35 aa, Mycobacterium
FGDGPFPLNLIAAAEKFFFGYVVPTQAFTDLLNHF

SEQ ID NO: 812273 - protein, 22 aa, Mycobacterium
FGDGWAPWLTKPDELPAKLDYL

SEQ ID NO: 812274 - protein, 18 aa, Mycobacterium
FGDIEAFGFLDPPDARSI

SEQ ID NO: 812275 - protein, 20 aa, Mycobacterium
FGDLFHAVITPGPGTPLLGS

SEQ ID NO: 812276 - protein, 25 aa, Mycobacterium
FGDMPNDVPMLGWAGLGVAMGNAHP

SEQ ID NO: 812277 - protein, 23 aa, Mycobacterium
FGDMPNDVPMLLRAGLGVAMGNA

SEQ ID NO: 812278 - protein, 23 aa, Mycobacterium
FGDPQGRAIFWLHGTPGARRQVP

SEQ ID NO: 812279 - protein, 25 aa, Mycobacterium
FGDPQGRAMFWLHGTPGARRQIPVE

SEQ ID NO: 812280 - protein, 25 aa, Mycobacterium
FGDQLPFLLKVLAADEPLSLQAHPS

SEQ ID NO: 812281 - protein, 25 aa, Mycobacterium
FGDRAVLGVADPHPRHPIALAQQGD

SEQ ID NO: 812282 - protein, 24 aa, Mycobacterium
FGDRDYPIYRFESGRLWKSACSIK

SEQ ID NO: 812283 - protein, 20 aa, Mycobacterium
FGDRVTSYLPTAHIADRVMG

SEQ ID NO: 812284 - protein, 17 aa, Mycobacterium
FGDWEGMTFAEAANRDP

SEQ ID NO: 812285 - protein, 25 aa, Mycobacterium
FGDYDLLLTPTLAKAPPRIGEFNLP

SEQ ID NO: 812286 - protein, 22 aa, Mycobacterium
FGEALPVRVCPLRTDPWNVAAS

SEQ ID NO: 812287 - protein, 18 aa, Mycobacterium
FGEALRWGAEVYHSLKSV

SEQ ID NO: 812288 - protein, 23 aa, Mycobacterium
FGEANGIFIDKAVDLGVEALMGA

SEQ ID NO: 812289 - protein, 18 aa, Mycobacterium
FGEERGTRWMPAGSAVAT

SEQ ID NO: 812290 - protein, 24 aa, Mycobacterium
FGEIALLSGWRRAATVRASQPSVL

SEQ ID NO: 812291 - protein, 17 aa, Mycobacterium
FGELAPHPLLTHAVEQN

SEQ ID NO: 812292 - protein, 24 aa, Mycobacterium
FGELITQILPCTLMSPDSVARFFP

SEQ ID NO: 812293 - protein, 19 aa, Mycobacterium
FGELSQRWGGELNALVITV

SEQ ID NO: 812294 - protein, 21 aa, Mycobacterium
FGEMGVLFHMPRSATVRARTD

SEQ ID NO: 812295 - protein, 24 aa, Mycobacterium
FGEQIVMWWNFVGRDHDEIAAFRE

SEQ ID NO: 812296 - protein, 26 aa, Mycobacterium
FGEQKARIFLALLGKQYGVTPEGWQA

SEQ ID NO: 812297 - protein, 25 aa, Mycobacterium
FGEQKARIFLALLGKQYGVTPPGWR

SEQ ID NO: 812298 - protein, 29 aa, Mycobacterium
FGERPGHPVVIARGHWPAVLGAISGDRGA

SEQ ID NO: 812299 - protein, 24 aa, Mycobacterium
FGERVRRVLADLRTLEAVTARAVR

SEQ ID NO: 812300 - protein, 21 aa, Mycobacterium
FGEVAFPKPLFHGDTLYAETE

SEQ ID NO: 812301 - protein, 35 aa, Mycobacterium
FGEVGLDLAIIYLPPPLTPAILEPLAAAITASGLL

SEQ ID NO: 812302 - protein, 19 aa, Mycobacterium
FGEVLRRAGLPAPRFGMAT

SEQ ID NO: 812303 - protein, 20 aa, Mycobacterium
FGEVTLTPHMLDLLDKQARP

SEQ ID NO: 812304 - protein, 17 aa, Mycobacterium
FGFATAPLVVAGCIMMR

SEQ ID NO: 812305 - protein, 20 aa, Mycobacterium
FGFAVTYFARPMASLISRMD

SEQ ID NO: 812306 - protein, 25 aa, Mycobacterium
FGFCKGIDSFCPIGPWIVTADEIPN

SEQ ID NO: 812307 - protein, 19 aa, Mycobacterium
FGFGFVMYVGDSCARDVLA

SEQ ID NO: 812308 - protein, 17 aa, Mycobacterium
FGFIAPDGGAPDVFVHY

SEQ ID NO: 812309 - protein, 20 aa, Mycobacterium
FGFKCFLLHSGVDEFPHLDA

SEQ ID NO: 812310 - protein, 22 aa, Mycobacterium
FGFRGLIKALAGFPKPLICAVN

SEQ ID NO: 812311 - protein, 29 aa, Mycobacterium
FGFYHKHFGIPYAFGKYDQLFVPEFNAGA

SEQ ID NO: 812312 - protein, 20 aa, Mycobacterium
FGGAIALHLAARRPDLVKSL

SEQ ID NO: 812313 - protein, 22 aa, Mycobacterium
FGGDFIFGSAVWQIAHAHSAFA

SEQ ID NO: 812314 - protein, 25 aa, Mycobacterium
FGGDPGLWPLPPASGAHDLWVRAVV

SEQ ID NO: 812315 - protein, 26 aa, Mycobacterium
FGGEMLTFADLIPWVKAHGDEHPELI

SEQ ID NO: 812316 - protein, 22 aa, Mycobacterium
FGGFGGWGGQSGLIGSGGNGGA

SEQ ID NO: 812317 - protein, 17 aa, Mycobacterium
FGGGHNVCYAAKAFLCS

SEQ ID NO: 812318 - protein, 18 aa, Mycobacterium
FGGGLMTSGGAGGTGGAG

SEQ ID NO: 812319 - protein, 26 aa, Mycobacterium
FGGGSMFLLVGILAALWERHNSGKGQ

SEQ ID NO: 812320 - protein, 25 aa, Mycobacterium
FGGGSMFLLVGILSALWERQNSGKG

SEQ ID NO: 812321 - protein, 25 aa, Mycobacterium
FGGGSMFLLVGILSALYERQASGKG

SEQ ID NO: 812322 - protein, 28 aa, Mycobacterium
FGGGSMFLLVGVLAALWERERSGKGQVV

SEQ ID NO: 812323 - protein, 21 aa, Mycobacterium
FGGIGVCQLIAGLYNGRRVAM

SEQ ID NO: 812324 - protein, 17 aa, Mycobacterium
FGGKIKSLDPQTRTGIV

SEQ ID NO: 812325 - protein, 18 aa, Mycobacterium
FGGLPPVVRERFGIGWSG

SEQ ID NO: 812326 - protein, 20 aa, Mycobacterium
FGGLVPTLLEYVPELLVTAL

SEQ ID NO: 812327 - protein, 25 aa, Mycobacterium
FGGMYRTMSVLPRSTGKFLTRKLGI

SEQ ID NO: 812328 - protein, 26 aa, Mycobacterium
FGGNLQKVLVDLIELSLQGKQAHWNV

SEQ ID NO: 812329 - protein, 25 aa, Mycobacterium
FGGNPVCTAAALAVLRVLASDNLVR

SEQ ID NO: 812330 - protein, 23 aa, Mycobacterium
FGGNPVCVAAALAVLRVLDEQDL

SEQ ID NO: 812331 - protein, 25 aa, Mycobacterium
FGGPTMFSILPRIPISRSPAYNLIL

SEQ ID NO: 812332 - protein, 18 aa, Mycobacterium
FGGRGLATILVGEALQAT

SEQ ID NO: 812333 - protein, 17 aa, Mycobacterium
FGGRRFDTGGFGGFNVG

SEQ ID NO: 812334 - protein, 25 aa, Mycobacterium
FGGRRSFILVPGIDVPFHSKVLRVG

SEQ ID NO: 812335 - protein, 29 aa, Mycobacterium
FGGSLIHGLLHDWPLEKTLRYANAAGAIV

SEQ ID NO: 812336 - protein, 20 aa, Mycobacterium
FGGSWRFPATDSLASYRIEH

SEQ ID NO: 812337 - protein, 31 aa, Mycobacterium
FGGTIAHGLLTLSLLPRFTHQLYTVDNVAMA

SEQ ID NO: 812338 - protein, 25 aa, Mycobacterium
FGGTIVHGYLTLALAPAFLDEVLEI

SEQ ID NO: 812339 - protein, 17 aa, Mycobacterium
FGGTLPPYPGWPDQIDD

SEQ ID NO: 812340 - protein, 26 aa, Mycobacterium
FGGYGWGFADLLPYFMRSETATHGDP

SEQ ID NO: 812341 - protein, 18 aa, Mycobacterium
FGGYGYMREYPIARAAID

SEQ ID NO: 812342 - protein, 24 aa, Mycobacterium
FGGYMANWIAGHTDRFAAIVTHAG

SEQ ID NO: 812343 - protein, 23 aa, Mycobacterium
FGGYVALPAYLAARRGPLRRRRV

SEQ ID NO: 812344 - protein, 27 aa, Mycobacterium
FGHGFYNPEPALRWYWDQYVPALSDRQ

SEQ ID NO: 812345 - protein, 17 aa, Mycobacterium
FGHGLTYTSFGYRDLAV

SEQ ID NO: 812346 - protein, 17 aa, Mycobacterium
FGHIPNLVTMRGDRYRD

SEQ ID NO: 812347 - protein, 21 aa, Mycobacterium
FGHSHIPWDTTAKTGLRLLNP

SEQ ID NO: 812348 - protein, 29 aa, Mycobacterium
FGHTPDHPAPLFDPDRLAALWGPTVHLVA

SEQ ID NO: 812349 - protein, 24 aa, Mycobacterium
FGHTPYQFVLDRRMSRAKQLLATT

SEQ ID NO: 812350 - protein, 26 aa, Mycobacterium
FGHVSGLIALVHPQAFIAALDPADRD

SEQ ID NO: 812351 - protein, 19 aa, Mycobacterium
FGHWGEILAVAAMSRGIRG

SEQ ID NO: 812352 - protein, 37 aa, Mycobacterium
FGICFGNQILGRALGLSTYKMVFGHRGINIPVMDHAT

SEQ ID NO: 812353 - protein, 37 aa, Mycobacterium
FGICFGNQILGRALGLSTYKMVFGHRGINIPVMDHTT

SEQ ID NO: 812354 - protein, 23 aa, Mycobacterium
FGIDFPLFAFSHCRDVVAAVTNA

SEQ ID NO: 812355 - protein, 24 aa, Mycobacterium
FGIEYPIFVFTPSEKVAAAVSKAG

SEQ ID NO: 812356 - protein, 24 aa, Mycobacterium
FGIEYPIFVFTPSEKVAAAVTKAG

SEQ ID NO: 812357 - protein, 19 aa, Mycobacterium
FGIGFPAWTGGVHQYILGY

SEQ ID NO: 812358 - protein, 31 aa, Mycobacterium
FGILDIDDEFFVILRPAPSGTRLLLSDATAA

SEQ ID NO: 812359 - protein, 17 aa, Mycobacterium
FGIMHYYMTGIHTPGRT

SEQ ID NO: 812360 - protein, 23 aa, Mycobacterium
FGIRYPIFGFTPSEKVAAAISRA

SEQ ID NO: 812361 - protein, 19 aa, Mycobacterium
FGITPALARIYRATGQDVP

SEQ ID NO: 812362 - protein, 20 aa, Mycobacterium
FGITPALARLYRASGQDIPV

SEQ ID NO: 812363 - protein, 19 aa, Mycobacterium
FGKALSQSPILQRGLREFL

SEQ ID NO: 812364 - protein, 24 aa, Mycobacterium
FGKPESFITRRMGVALARDEDVDT

SEQ ID NO: 812365 - protein, 23 aa, Mycobacterium
FGKTNLLEALWYSSTLGSHRVGT

SEQ ID NO: 812366 - protein, 24 aa, Mycobacterium
FGLADKAWVLDELRELAAVLGVAR

SEQ ID NO: 812367 - protein, 27 aa, Mycobacterium
FGLAGDVLQWPGPPIYTLTAAGEQLGL

SEQ ID NO: 812368 - protein, 18 aa, Mycobacterium
FGLAPRSALGAPELIMPA

SEQ ID NO: 812369 - protein, 19 aa, Mycobacterium
FGLEVPRPLWPPHETAELP

SEQ ID NO: 812370 - protein, 17 aa, Mycobacterium
FGLFNAGNHNSGSFNVG

SEQ ID NO: 812371 - protein, 19 aa, Mycobacterium
FGLGLLVGGMRRLLEAVPS

SEQ ID NO: 812372 - protein, 27 aa, Mycobacterium
FGLGSRYFRLLPRRLVERIVPKPGTGP

SEQ ID NO: 812373 - protein, 18 aa, Mycobacterium
FGLGYRRYEWKCDSLNEP

SEQ ID NO: 812374 - protein, 17 aa, Mycobacterium
FGLIDKRSLHLSYGEFS

SEQ ID NO: 812375 - protein, 24 aa, Mycobacterium
FGLIVYQEQIMFIAQKVASYSMGK

SEQ ID NO: 812376 - protein, 31 aa, Mycobacterium
FGLLESLGNPVLWSVPLHWAGVHAGILTSSP

SEQ ID NO: 812377 - protein, 20 aa, Mycobacterium
FGLLGHLHKLARASGVTAVI

SEQ ID NO: 812378 - protein, 20 aa, Mycobacterium
FGLLGHLHKLARASGVTAVV

SEQ ID NO: 812379 - protein, 20 aa, Mycobacterium
FGLLPPIDPVDFAGAMVNGT

SEQ ID NO: 812380 - protein, 19 aa, Mycobacterium
FGLPELSLGLIPGAGGTVS

SEQ ID NO: 812381 - protein, 18 aa, Mycobacterium
FGLPTRYFAPDTDARLVS

SEQ ID NO: 812382 - protein, 20 aa, Mycobacterium
FGLRRDGLTFRKLAEEHPHG

SEQ ID NO: 812383 - protein, 17 aa, Mycobacterium
FGLSIVAPVNMPLPTKI

SEQ ID NO: 812384 - protein, 17 aa, Mycobacterium
FGLSYLFVAHDLGVVRH

SEQ ID NO: 812385 - protein, 20 aa, Mycobacterium
FGLTADDLLRTDLFKTKSGA

SEQ ID NO: 812386 - protein, 23 aa, Mycobacterium
FGLTLPSPIFMAPVGVAGICSQS

SEQ ID NO: 812387 - protein, 17 aa, Mycobacterium
FGMALRAWNQGFDIAVF

SEQ ID NO: 812388 - protein, 19 aa, Mycobacterium
FGMALRAWNQGFRVAVFQF

SEQ ID NO: 812389 - protein, 26 aa, Mycobacterium
FGMGSGVPTPFYGLAEAALTVSAGAF

SEQ ID NO: 812390 - protein, 27 aa, Mycobacterium
FGMMMETVLPWFNLGNAAVSLGLATAA

SEQ ID NO: 812391 - protein, 18 aa, Mycobacterium
FGMSMRFIKSRAAFVDKV

SEQ ID NO: 812392 - protein, 25 aa, Mycobacterium
FGNAGNFNTGFWNAGSSNTGFGSAG

SEQ ID NO: 812393 - protein, 26 aa, Mycobacterium
FGNAGWSHFYCWAVPLNYPPDPSCVS

SEQ ID NO: 812394 - protein, 29 aa, Mycobacterium
FGNEIGDLPFLYQPGMLSAAWGVGIRQLA

SEQ ID NO: 812395 - protein, 17 aa, Mycobacterium
FGNFGQANYGAAKLGLV

SEQ ID NO: 812396 - protein, 17 aa, Mycobacterium
FGNGPHLPERHPARHWR

SEQ ID NO: 812397 - protein, 18 aa, Mycobacterium
FGNLGLVNIAIWADPARG

SEQ ID NO: 812398 - protein, 25 aa, Mycobacterium
FGNLGLVNIAIWADPARGLAAGVVS

SEQ ID NO: 812399 - protein, 28 aa, Mycobacterium
FGNPLTWSDLAWLRELTDLPLIVKGICH

SEQ ID NO: 812400 - protein, 30 aa, Mycobacterium
FGNRDGILKATWLRGIERFQRRAMAADGAT

SEQ ID NO: 812401 - protein, 27 aa, Mycobacterium
FGNRDGILTAAWLRALERFQTRALAAG

SEQ ID NO: 812402 - protein, 25 aa, Mycobacterium
FGNRGPWSRRLGYGPLVRATTGVTS

SEQ ID NO: 812403 - protein, 17 aa, Mycobacterium
FGNTATVATAFIGGGNT

SEQ ID NO: 812404 - protein, 19 aa, Mycobacterium
FGPALAMLDGGWSVGEAGP

SEQ ID NO: 812405 - protein, 31 aa, Mycobacterium
FGPATVDTTLFRLPIRLALGPTHVAVVVGIA

SEQ ID NO: 812406 - protein, 25 aa, Mycobacterium
FGPDSPTWKVWTSPTALIGFQRSVV

SEQ ID NO: 812407 - protein, 19 aa, Mycobacterium
FGPERNYEHYLGCKVAAWV

SEQ ID NO: 812408 - protein, 24 aa, Mycobacterium
FGPGFGPGFGFGPGGRRGAWRRGG

SEQ ID NO: 812409 - protein, 19 aa, Mycobacterium
FGPGPGLPPTQRRALHSAR

SEQ ID NO: 812410 - protein, 24 aa, Mycobacterium
FGPGSFGPGFGFGPGSRRGGGPRG

SEQ ID NO: 812411 - protein, 18 aa, Mycobacterium
FGPHYNPWDQRLCLVPNG

SEQ ID NO: 812412 - protein, 26 aa, Mycobacterium
FGPIDVHMLQYSGAIWYPMVYDMPVR

SEQ ID NO: 812413 - protein, 17 aa, Mycobacterium
FGPIFIQTYAGTEPGYV

SEQ ID NO: 812414 - protein, 22 aa, Mycobacterium
FGPIGELWYRKSGTYRGKIQNL

SEQ ID NO: 812415 - protein, 22 aa, Mycobacterium
FGPIGELWYRKSGTYRGKVQNL

SEQ ID NO: 812416 - protein, 31 aa, Mycobacterium
FGPNLMIMNHFGFTPVWLPVDGDGRADVDGI

SEQ ID NO: 812417 - protein, 17 aa, Mycobacterium
FGPRAALPATMMARWFR

SEQ ID NO: 812418 - protein, 27 aa, Mycobacterium
FGPRALLPATTMARWFRTEQARALFGG

SEQ ID NO: 812419 - protein, 24 aa, Mycobacterium
FGPTIWAPLAMCELTHDGRPVATA

SEQ ID NO: 812420 - protein, 26 aa, Mycobacterium
FGPVGAPFLASLTRAAAAQSASLGRL

SEQ ID NO: 812421 - protein, 28 aa, Mycobacterium
FGPVTLPDITLSGPTFSLLMGGPDTVVG

SEQ ID NO: 812422 - protein, 18 aa, Mycobacterium
FGQALGYGLRPGDTLLIV

SEQ ID NO: 812423 - protein, 22 aa, Mycobacterium
FGQGQWTLRDFIDAHAINVDGA

SEQ ID NO: 812424 - protein, 22 aa, Mycobacterium
FGQIALLLPTLPTDESLRMLDD

SEQ ID NO: 812425 - protein, 27 aa, Mycobacterium
FGQLEIKTILHRLLRRYRLELARPDYR

SEQ ID NO: 812426 - protein, 19 aa, Mycobacterium
FGQLLVLERQDDLDDPGDP

SEQ ID NO: 812427 - protein, 24 aa, Mycobacterium
FGQPRLHGGQRPVGALVAGGDRIL

SEQ ID NO: 812428 - protein, 19 aa, Mycobacterium
FGQRLAAFVVPRPGSDVDA

SEQ ID NO: 812429 - protein, 17 aa, Mycobacterium
FGQRLVAFVVARPGSDI

SEQ ID NO: 812430 - protein, 28 aa, Mycobacterium
FGQRVKWNLMAWWSAKMLMAARNDIAIT

SEQ ID NO: 812431 - protein, 34 aa, Mycobacterium
FGQRVVGLELARRLAREWLGYEFDPTSKSAEKVQ

SEQ ID NO: 812432 - protein, 27 aa, Mycobacterium
FGQSGTFLWVDPVADLALLVLTDRDFG

SEQ ID NO: 812433 - protein, 20 aa, Mycobacterium
FGQVIRILVAAPGSLTGRYP

SEQ ID NO: 812434 - protein, 26 aa, Mycobacterium
FGRDGFILSNLIPALSFSWITDEQPN

SEQ ID NO: 812435 - protein, 28 aa, Mycobacterium
FGREVRLTGFWLGNWYASEPRHEIVDTL

SEQ ID NO: 812436 - protein, 17 aa, Mycobacterium
FGRFVFHHHPEYGAALE

SEQ ID NO: 812437 - protein, 41 aa, Mycobacterium
FGRITLAEDLVLYLFGTPGQRRFWFMWDDLVRGAIGAVVLV

SEQ ID NO: 812438 - protein, 20 aa, Mycobacterium
FGRKVLAKRGITSQTAQALR

SEQ ID NO: 812439 - protein, 21 aa, Mycobacterium
FGRLDILVNNAWQTIWDGTES

SEQ ID NO: 812440 - protein, 31 aa, Mycobacterium
FGRLNLPHRYIALVPQWDFLDLLADAAKEEP

SEQ ID NO: 812441 - protein, 38 aa, Mycobacterium
FGRLWATEPLSDWKLWASWRLICARAPYLTDPLVNENF

SEQ ID NO: 812442 - protein, 30 aa, Mycobacterium
FGRPVGSRPPLLKRIVLQTAARLSPRGRRL

SEQ ID NO: 812443 - protein, 26 aa, Mycobacterium
FGRQRYPRFFKMAYNVLPSDGVMLLH

SEQ ID NO: 812444 - protein, 17 aa, Mycobacterium
FGRRRLAARVDETFVIP

SEQ ID NO: 812445 - protein, 20 aa, Mycobacterium
FGRSAGVLARLLLPSPDLLD

SEQ ID NO: 812446 - protein, 29 aa, Mycobacterium
FGRTGETWWGFIRHGVVPDLVTMGKPMAN

SEQ ID NO: 812447 - protein, 18 aa, Mycobacterium
FGRYGAHMPKLNVLPIYG

SEQ ID NO: 812448 - protein, 26 aa, Mycobacterium
FGSAGLLLRAPLPDGGPAVLLQHRAV

SEQ ID NO: 812449 - protein, 24 aa, Mycobacterium
FGSAGLLLRAPRPDGTPAVLLQHR

SEQ ID NO: 812450 - protein, 23 aa, Mycobacterium
FGSAPFEDLSLDDWTRMLRVHLD

SEQ ID NO: 812451 - protein, 27 aa, Mycobacterium
FGSASILPITWAYIRMMGADGLRTASL

SEQ ID NO: 812452 - protein, 23 aa, Mycobacterium
FGSDANWGRVLAAVGIAPVTLDP

SEQ ID NO: 812453 - protein, 23 aa, Mycobacterium
FGSDFFSAWGKLGAVRTPTIAAV

SEQ ID NO: 812454 - protein, 17 aa, Mycobacterium
FGSGFMSAPLFDALLDG

SEQ ID NO: 812455 - protein, 19 aa, Mycobacterium
FGSGGFGGFGGFGSGGGSG

SEQ ID NO: 812456 - protein, 17 aa, Mycobacterium
FGSGPRLPMLPDGWESD

SEQ ID NO: 812457 - protein, 18 aa, Mycobacterium
FGSIETLRRAFVNHLGIS

SEQ ID NO: 812458 - protein, 24 aa, Mycobacterium
FGSIETLRRVFVNHLGISPKAYRE

SEQ ID NO: 812459 - protein, 19 aa, Mycobacterium
FGSIGDFLRVQPGYEVAVA

SEQ ID NO: 812460 - protein, 20 aa, Mycobacterium
FGSIVTLFRLLDGPNRYRAA

SEQ ID NO: 812461 - protein, 22 aa, Mycobacterium
FGSKLIEEFLPTVDLREVIDTS

SEQ ID NO: 812462 - protein, 18 aa, Mycobacterium
FGSLRMSDFPLIPARVET

SEQ ID NO: 812463 - protein, 17 aa, Mycobacterium
FGSLRPLLEVAAAHDRG

SEQ ID NO: 812464 - protein, 17 aa, Mycobacterium
FGSLRPLLEVATANDRG

SEQ ID NO: 812465 - protein, 18 aa, Mycobacterium
FGSMHYWDDVVADAAMHA

SEQ ID NO: 812466 - protein, 29 aa, Mycobacterium
FGSNVALILQRLLRLCERYGSHPTVVFAS

SEQ ID NO: 812467 - protein, 19 aa, Mycobacterium
FGSPAWTFNKALWEYARLP

SEQ ID NO: 812468 - protein, 18 aa, Mycobacterium
FGSRFVQALTSGAGAYTS

SEQ ID NO: 812469 - protein, 18 aa, Mycobacterium
FGSVHYWDELLTTAALAA

SEQ ID NO: 812470 - protein, 27 aa, Mycobacterium
FGSVIGTLAGQSWLGSAAAAMSAAAVP

SEQ ID NO: 812471 - protein, 17 aa, Mycobacterium
FGSWRRSISIRHAEILL

SEQ ID NO: 812472 - protein, 24 aa, Mycobacterium
FGTADSWLVWNLTGGTRGGVHVTD

SEQ ID NO: 812473 - protein, 24 aa, Mycobacterium
FGTADTWVLWNLTGGPRGGVHVTD

SEQ ID NO: 812474 - protein, 18 aa, Mycobacterium
FGTAFEGTPAGLPPLVFC

SEQ ID NO: 812475 - protein, 22 aa, Mycobacterium
FGTDLMIKILCGDGPLAMAAMA

SEQ ID NO: 812476 - protein, 18 aa, Mycobacterium
FGTDWSWVGPARDAGIPT

SEQ ID NO: 812477 - protein, 21 aa, Mycobacterium
FGTLSFAQPVAFSGGVRLTYR

SEQ ID NO: 812478 - protein, 19 aa, Mycobacterium
FGTMRFTGRGIWGEPADRA

SEQ ID NO: 812479 - protein, 30 aa, Mycobacterium
FGTNHLGHFAFTGLLLDNLLDVPGSRVVTV

SEQ ID NO: 812480 - protein, 18 aa, Mycobacterium
FGTNHLGHFALTGLLLDH

SEQ ID NO: 812481 - protein, 30 aa, Mycobacterium
FGTNHLGHFALTGLLLDRMLTVPGSRVVTV

SEQ ID NO: 812482 - protein, 19 aa, Mycobacterium
FGTNHLGHFALTGLLLERL

SEQ ID NO: 812483 - protein, 32 aa, Mycobacterium
FGTNHLGHFALTGRLLSLLRAAGSARVVTVSS

SEQ ID NO: 812484 - protein, 18 aa, Mycobacterium
FGTPAQIDRLLVPLLRGD

SEQ ID NO: 812485 - protein, 23 aa, Mycobacterium
FGTTDTWVLWNLTGGHRGGVHVT

SEQ ID NO: 812486 - protein, 24 aa, Mycobacterium
FGTVRGTQFLQPLFEFPGACAGCG

SEQ ID NO: 812487 - protein, 18 aa, Mycobacterium
FGTYGVRDWPWTDADRTL

SEQ ID NO: 812488 - protein, 24 aa, Mycobacterium
FGVDQLRYFLLREVPFGQDGSYSE

SEQ ID NO: 812489 - protein, 25 aa, Mycobacterium
FGVEPPVALLLQGATLNDVALDLIR

SEQ ID NO: 812490 - protein, 18 aa, Mycobacterium
FGVFQDPTRKYSCAYFTG

SEQ ID NO: 812491 - protein, 25 aa, Mycobacterium
FGVHGGILDPLPLLGDLVAGLRART

SEQ ID NO: 812492 - protein, 24 aa, Mycobacterium
FGVHPMTLQKWLRQADIEEGTKPG

SEQ ID NO: 812493 - protein, 19 aa, Mycobacterium
FGVHPVMLDAALHAVILTS

SEQ ID NO: 812494 - protein, 19 aa, Mycobacterium
FGVIYPPQVAIVGFGKPAQ

SEQ ID NO: 812495 - protein, 17 aa, Mycobacterium
FGVLQRPCATLTAALRA

SEQ ID NO: 812496 - protein, 34 aa, Mycobacterium
FGVPAIPHGPLGRGFILLLHKLIHQLMSELEADG

SEQ ID NO: 812497 - protein, 17 aa, Mycobacterium
FGVPVPNLTPWRASLTG

SEQ ID NO: 812498 - protein, 29 aa, Mycobacterium
FGVQDPRLRRWWPRRYRRSSVYSKLVAMD

SEQ ID NO: 812499 - protein, 31 aa, Mycobacterium
FGVTGHIIAWNYPMQLLARAVAPAIAVGNCA

SEQ ID NO: 812500 - protein, 17 aa, Mycobacterium
FGVVHVLHDVDFRVYPG

SEQ ID NO: 812501 - protein, 28 aa, Mycobacterium
FGVVNLTRAALPAMRRQRDGHIVQISSV

SEQ ID NO: 812502 - protein, 17 aa, Mycobacterium
FGVYRPATVPRSSVTQV

SEQ ID NO: 812503 - protein, 27 aa, Mycobacterium
FGWHRGMLIPGARMQVSFLKDLVTLRN

SEQ ID NO: 812504 - protein, 21 aa, Mycobacterium
FGWVGIANFPSSFAAASYLPD

SEQ ID NO: 812505 - protein, 20 aa, Mycobacterium
FGWVGIANLPSSFAAAAYLP

SEQ ID NO: 812506 - protein, 17 aa, Mycobacterium
FGYLYGTPGFQAPEIVR

SEQ ID NO: 812507 - protein, 18 aa, Mycobacterium
FGYPAAATLDRRARRGRA

SEQ ID NO: 812508 - protein, 17 aa, Mycobacterium
FGYTLREPCGRIHWAGT

SEQ ID NO: 812509 - protein, 26 aa, Mycobacterium
FGYWRESGRFILFEAPAVVLATGGIG

SEQ ID NO: 812510 - protein, 31 aa, Mycobacterium
FHAAARRQLSYFWPRVVGNTEWQLMDSKFAV

SEQ ID NO: 812511 - protein, 18 aa, Mycobacterium
FHAAIARLSGNSTLQIVS

SEQ ID NO: 812512 - protein, 26 aa, Mycobacterium
FHAALEFWSALHGFVLLEMTGLMEEI

SEQ ID NO: 812513 - protein, 19 aa, Mycobacterium
FHAALEFWSAMHGFVLLEM

SEQ ID NO: 812514 - protein, 18 aa, Mycobacterium
FHAEFVRALAAAGAAYAA

SEQ ID NO: 812515 - protein, 18 aa, Mycobacterium
FHAELVRLLNGGAASYLS

SEQ ID NO: 812516 - protein, 24 aa, Mycobacterium
FHAGINDILLIGYALAWAEFLETG

SEQ ID NO: 812517 - protein, 24 aa, Mycobacterium
FHAGVHDILLIAFAVAWQEFLADP

SEQ ID NO: 812518 - protein, 18 aa, Mycobacterium
FHALAGFRPVARTVELMR

SEQ ID NO: 812519 - protein, 30 aa, Mycobacterium
FHALSTEMLGKIMTPFLASPSTEFAEHKSS

SEQ ID NO: 812520 - protein, 31 aa, Mycobacterium
FHATHTMVPFFYGYIGYAALAGLDVACWDLM

SEQ ID NO: 812521 - protein, 21 aa, Mycobacterium
FHDLWVILRGVKTKTALFTMR

SEQ ID NO: 812522 - protein, 26 aa, Mycobacterium
FHDSLLPKFTGFSPVLWALISGESEF

SEQ ID NO: 812523 - protein, 17 aa, Mycobacterium
FHEDGAASGLRAARRLG

SEQ ID NO: 812524 - protein, 25 aa, Mycobacterium
FHESYDYFLTPSLATPPLAVGDTTT

SEQ ID NO: 812525 - protein, 26 aa, Mycobacterium
FHESYDYFLTPTLATPPLTVGATATS

SEQ ID NO: 812526 - protein, 26 aa, Mycobacterium
FHEVDRPAFLVSPLISHAAAEPLDAV

SEQ ID NO: 812527 - protein, 20 aa, Mycobacterium
FHEVLRVVKFWISHGVKVFR

SEQ ID NO: 812528 - protein, 25 aa, Mycobacterium
FHGAYDYFLTPTLATPPLEVGATAT

SEQ ID NO: 812529 - protein, 20 aa, Mycobacterium
FHGGSLYGIPMPPGLISHAP

SEQ ID NO: 812530 - protein, 29 aa, Mycobacterium
FHGVRAFLPKMMAVDEPAWVWNVASVGAV

SEQ ID NO: 812531 - protein, 17 aa, Mycobacterium
FHHINTAPLEPIVERWL

SEQ ID NO: 812532 - protein, 18 aa, Mycobacterium
FHHPCDLGRAGLPEEVAS

SEQ ID NO: 812533 - protein, 26 aa, Mycobacterium
FHHSRRVFFFGALQGRRRGLQPDLEL

SEQ ID NO: 812534 - protein, 18 aa, Mycobacterium
FHIAGIGNLLTGVLLGIP

SEQ ID NO: 812535 - protein, 24 aa, Mycobacterium
FHIDRGYPLFVENLVSLGAEIERV

SEQ ID NO: 812536 - protein, 24 aa, Mycobacterium
FHIDRGYPLFVENLVSLGAEVERV

SEQ ID NO: 812537 - protein, 27 aa, Mycobacterium
FHIEHRSLVVEIYRPRLAGPVPQAEEV

SEQ ID NO: 812538 - protein, 27 aa, Mycobacterium
FHIEHRSLVVEIYRPRLTAPVPQAEDV

SEQ ID NO: 812539 - protein, 19 aa, Mycobacterium
FHIYARISRDWPYAKVRLA

SEQ ID NO: 812540 - protein, 30 aa, Mycobacterium
FHKPESPDAPLLLIFPHAGAGASAYRTLSK

SEQ ID NO: 812541 - protein, 23 aa, Mycobacterium
FHKRADIVLSGLRKLRSALTEAA

SEQ ID NO: 812542 - protein, 20 aa, Mycobacterium
FHKRAETQLTILSPVREQLS

SEQ ID NO: 812543 - protein, 19 aa, Mycobacterium
FHLAKAALPYLGPGSSIIG

SEQ ID NO: 812544 - protein, 26 aa, Mycobacterium
FHLATLYGSIFPPVWNFQLALHTRGY

SEQ ID NO: 812545 - protein, 21 aa, Mycobacterium
FHLAYAAALATAGRFADANRI

SEQ ID NO: 812546 - protein, 34 aa, Mycobacterium
FHLGVAVAAHNPLLLRLLKGLRVALDRTSETSLT

SEQ ID NO: 812547 - protein, 18 aa, Mycobacterium
FHLLPAAIVRLRGVRRHT

SEQ ID NO: 812548 - protein, 17 aa, Mycobacterium
FHLLRRHGKDGIQRPLI

SEQ ID NO: 812549 - protein, 18 aa, Mycobacterium
FHLRDLAVTFRFGEEVTA

SEQ ID NO: 812550 - protein, 46 aa, Mycobacterium
FHLSEPCVLFAKLNPRVPRIWNVVRLPPQMALASCEFVVLSPLGVD

SEQ ID NO: 812551 - protein, 23 aa, Mycobacterium
FHMYHALTWGPLVREIVYAATGK

SEQ ID NO: 812552 - protein, 21 aa, Mycobacterium
FHNGLIVPHYDDPNLDIVIEP

SEQ ID NO: 812553 - protein, 17 aa, Mycobacterium
FHNQFVQNLFGGAQAYA

SEQ ID NO: 812554 - protein, 19 aa, Mycobacterium
FHPDTPTVPALPPRMVPLS

SEQ ID NO: 812555 - protein, 18 aa, Mycobacterium
FHQALFAPLGNPFVLQLI

SEQ ID NO: 812556 - protein, 19 aa, Mycobacterium
FHQQFVRALGMGAASYASA

SEQ ID NO: 812557 - protein, 23 aa, Mycobacterium
FHQTFDCLLTPTLATPPLRVGAT

SEQ ID NO: 812558 - protein, 19 aa, Mycobacterium
FHRAHPHVRLRLRLSQSGA

SEQ ID NO: 812559 - protein, 27 aa, Mycobacterium
FHRGQDFVYHWALGDRLPADAGLAARH

SEQ ID NO: 812560 - protein, 21 aa, Mycobacterium
FHRNFGYGLAGRRIERSRLPF

SEQ ID NO: 812561 - protein, 19 aa, Mycobacterium
FHRVMAVNVLGVMAGTRDA

SEQ ID NO: 812562 - protein, 17 aa, Mycobacterium
FHSDQLGPFAEALAGLC

SEQ ID NO: 812563 - protein, 25 aa, Mycobacterium
FHSDRLGPFCAALSELCGKDMVLPM

SEQ ID NO: 812564 - protein, 18 aa, Mycobacterium
FHSERLAPVKPTSALWRL

SEQ ID NO: 812565 - protein, 33 aa, Mycobacterium
FHSIAFDFSVWELWGPLLYGGCVVMVPYLETRT

SEQ ID NO: 812566 - protein, 21 aa, Mycobacterium
FHSKHDLLFADYTGLHWFRTA

SEQ ID NO: 812567 - protein, 21 aa, Mycobacterium
FHSYELFARKVIPYFKGQLEA

SEQ ID NO: 812568 - protein, 18 aa, Mycobacterium
FHTIIPGFVTKDGAPVLS

SEQ ID NO: 812569 - protein, 17 aa, Mycobacterium
FHTIQAVLPDMIETQWG

SEQ ID NO: 812570 - protein, 18 aa, Mycobacterium
FHTLTGRMHFYLAHDWIE

SEQ ID NO: 812571 - protein, 25 aa, Mycobacterium
FHVTTSLLVGLKRIADARGVTVPEV

SEQ ID NO: 812572 - protein, 26 aa, Mycobacterium
FHVVRPAFPLMCAAHYGRIVLTSSIG

SEQ ID NO: 812573 - protein, 17 aa, Mycobacterium
FHWEALVGDKVVVEITV

SEQ ID NO: 812574 - protein, 17 aa, Mycobacterium
FHWEALVGGQPVVRVTV

SEQ ID NO: 812575 - protein, 20 aa, Mycobacterium
FHYTRKWLQKMSAIEIDRSV

SEQ ID NO: 812576 - protein, 18 aa, Mycobacterium
FIAAFKRWTGTTPARHQR

SEQ ID NO: 812577 - protein, 18 aa, Mycobacterium
FIAAIRADPVLAATPVLM

SEQ ID NO: 812578 - protein, 18 aa, Mycobacterium
FIADPVILDLIEADPRAA

SEQ ID NO: 812579 - protein, 24 aa, Mycobacterium
FIAGAKILRQYGIGPLPGVAMMVV

SEQ ID NO: 812580 - protein, 18 aa, Mycobacterium
FIAGGIGITPILAMMESL

SEQ ID NO: 812581 - protein, 18 aa, Mycobacterium
FIAGNFFEEVPGSDLFLL

SEQ ID NO: 812582 - protein, 18 aa, Mycobacterium
FIAPFHRAGTNPSLALQR

SEQ ID NO: 812583 - protein, 18 aa, Mycobacterium
FIARFTEGLDLMKLAWSD

SEQ ID NO: 812584 - protein, 18 aa, Mycobacterium
FICVVAEGAKPIPGSIAL

SEQ ID NO: 812585 - protein, 26 aa, Mycobacterium
FIDCPPSLGLLTVNALVAANEVLIPI

SEQ ID NO: 812586 - protein, 20 aa, Mycobacterium
FIDHDGQGYRLIFENDYVTE

SEQ ID NO: 812587 - protein, 34 aa, Mycobacterium
FIDHLETFVAGFRTYARFLARWQIDTTTGGLLDG

SEQ ID NO: 812588 - protein, 17 aa, Mycobacterium
FIDMFTKMGGLMAERVT

SEQ ID NO: 812589 - protein, 17 aa, Mycobacterium
FIDPMRTARLLGSLAIT

SEQ ID NO: 812590 - protein, 32 aa, Mycobacterium
FIDRLQPQTMSYLGTWIKGALPRAGVAAQIIE

SEQ ID NO: 812591 - protein, 30 aa, Mycobacterium
FIDRLQPQTMSYLGTWIKGALPRANMAAQI

SEQ ID NO: 812592 - protein, 17 aa, Mycobacterium
FIEADAPEFELLDDLTW

SEQ ID NO: 812593 - protein, 18 aa, Mycobacterium
FIEDVARTWHLTRYAAVA

SEQ ID NO: 812594 - protein, 21 aa, Mycobacterium
FIEETLRFEAPFRGHYRHVWR

SEQ ID NO: 812595 - protein, 21 aa, Mycobacterium
FIEHDSQGYRLIFENDYVTEP

SEQ ID NO: 812596 - protein, 18 aa, Mycobacterium
FIEKYPWPEPENLGDDDW

SEQ ID NO: 812597 - protein, 18 aa, Mycobacterium
FIELIVGGTTYDLAAEAA

SEQ ID NO: 812598 - protein, 25 aa, Mycobacterium
FIENYNLNMAIPWIAAERGFIDAVI

SEQ ID NO: 812599 - protein, 19 aa, Mycobacterium
FIERKLYPNVDYYTGVIYR

SEQ ID NO: 812600 - protein, 33 aa, Mycobacterium
FIESPTAVKWQLLMSAWLDLPGRPSLVGTRGAD

SEQ ID NO: 812601 - protein, 19 aa, Mycobacterium
FIEVSYLLIYGELPTPDQL

SEQ ID NO: 812602 - protein, 19 aa, Mycobacterium
FIEVSYLLIYGELPTPQQL

SEQ ID NO: 812603 - protein, 17 aa, Mycobacterium
FIGAGIAGGLALAGCGH

SEQ ID NO: 812604 - protein, 17 aa, Mycobacterium
FIGAGIASGLALAGCGH

SEQ ID NO: 812605 - protein, 18 aa, Mycobacterium
FIGAPAMNLIEAPVADGV

SEQ ID NO: 812606 - protein, 24 aa, Mycobacterium
FIGDAVMWVSPTPVRLVQAAVDLV

SEQ ID NO: 812607 - protein, 23 aa, Mycobacterium
FIGEIVAASLRRNLKRRVEAIAT

SEQ ID NO: 812608 - protein, 30 aa, Mycobacterium
FIGEMFTTMKPYLAPPLPGAQPAPLWGTEG

SEQ ID NO: 812609 - protein, 29 aa, Mycobacterium
FIGSPAMNFFPAVLTPTGLTLPFGEVTLD

SEQ ID NO: 812610 - protein, 24 aa, Mycobacterium
FIGSPAMNLVKLPIVPDGVRVGDN

SEQ ID NO: 812611 - protein, 20 aa, Mycobacterium
FIHRGQAAGLTLQKVRQILA

SEQ ID NO: 812612 - protein, 32 aa, Mycobacterium
FIHTRPRYFAQIIGELLYWIGEDKILFASDYA

SEQ ID NO: 812613 - protein, 18 aa, Mycobacterium
FIHVHLAEVLSRIPGVSL

SEQ ID NO: 812614 - protein, 18 aa, Mycobacterium
FIKFIITEIFPGGRLPST

SEQ ID NO: 812615 - protein, 25 aa, Mycobacterium
FILEEAEVIYWGLCPDCASTEAAPR

SEQ ID NO: 812616 - protein, 18 aa, Mycobacterium
FILFGRFADAAASWRRYL

SEQ ID NO: 812617 - protein, 17 aa, Mycobacterium
FIMFASDYPHWDGEWPE

SEQ ID NO: 812618 - protein, 27 aa, Mycobacterium
FIMGDCDQLMPPYLRFVKGVVDAQDMS

SEQ ID NO: 812619 - protein, 17 aa, Mycobacterium
FIMVTYWAEPCSPSAEA

SEQ ID NO: 812620 - protein, 20 aa, Mycobacterium
FINADYTITLSRLPEGVYIG

SEQ ID NO: 812621 - protein, 18 aa, Mycobacterium
FINGFKKNFFTNPMQRVA

SEQ ID NO: 812622 - protein, 23 aa, Mycobacterium
FINPKRRLKGLRWTATDIQWTDG

SEQ ID NO: 812623 - protein, 25 aa, Mycobacterium
FIPDVGGAYLLSRAPGSLGLHAALT

SEQ ID NO: 812624 - protein, 25 aa, Mycobacterium
FIPDVGGVYLLSRAPGGLGLHAALT

SEQ ID NO: 812625 - protein, 17 aa, Mycobacterium
FIQALAASDIRYILTRH

SEQ ID NO: 812626 - protein, 19 aa, Mycobacterium
FIQIDTTNVLFIVAGAFAG

SEQ ID NO: 812627 - protein, 34 aa, Mycobacterium
FIRAFSMVMTTPLFYGWWIAGAKYLMAHDPTIDQ

SEQ ID NO: 812628 - protein, 29 aa, Mycobacterium
FIRALSDPYPNAYTYFRGERLRLISAHVS

SEQ ID NO: 812629 - protein, 25 aa, Mycobacterium
FIRDAKVIAPDKPWFSYVCPGAGHA

SEQ ID NO: 812630 - protein, 32 aa, Mycobacterium
FIRDLYEAVSQLAFLPFPFDSVIAGGPSMAYW

SEQ ID NO: 812631 - protein, 18 aa, Mycobacterium
FIRDQSLLPPQRFAGDHA

SEQ ID NO: 812632 - protein, 26 aa, Mycobacterium
FIRDTTWVSVRWYQPGGPLTAEQVGL

SEQ ID NO: 812633 - protein, 27 aa, Mycobacterium
FIRETCAPALRPFLSAAPRVTDIGPVE

SEQ ID NO: 812634 - protein, 18 aa, Mycobacterium
FIRPIFADNELIGFAQNK

SEQ ID NO: 812635 - protein, 17 aa, Mycobacterium
FIRQFVAVPLGSGATVE

SEQ ID NO: 812636 - protein, 19 aa, Mycobacterium
FIRTCDCFGIPIITLEDVP

SEQ ID NO: 812637 - protein, 27 aa, Mycobacterium
FISDWPRLADGILQLSVRDFEYPRSDL

SEQ ID NO: 812638 - protein, 26 aa, Mycobacterium
FISEGQLFIVGRIKDLLIVYGRNHAP

SEQ ID NO: 812639 - protein, 17 aa, Mycobacterium
FISGEQWLTHPGSVGVV

SEQ ID NO: 812640 - protein, 31 aa, Mycobacterium
FISGNYSNGFLWRGDYQGLITISYSSTIPEI

SEQ ID NO: 812641 - protein, 19 aa, Mycobacterium
FISGRETLLAQRIAQGCIV

SEQ ID NO: 812642 - protein, 35 aa, Mycobacterium
FISGSYSNGLFWQDDYRLLGIDLKINFGGTSGDYA

SEQ ID NO: 812643 - protein, 17 aa, Mycobacterium
FISLYRYGDVTATHRRL

SEQ ID NO: 812644 - protein, 18 aa, Mycobacterium
FISPSYYGLGVNSLEELI

SEQ ID NO: 812645 - protein, 26 aa, Mycobacterium
FISSGFPINLLGVWAQLATAQGVASV

SEQ ID NO: 812646 - protein, 26 aa, Mycobacterium
FITDGKMFIIGRIKDLLIVYGRNHSP

SEQ ID NO: 812647 - protein, 18 aa, Mycobacterium
FITGIDLAVDGGFSELAA

SEQ ID NO: 812648 - protein, 19 aa, Mycobacterium
FITGQYPIRVGLSTVGLPG

SEQ ID NO: 812649 - protein, 17 aa, Mycobacterium
FITIFRDLEGLSHSMAP

SEQ ID NO: 812650 - protein, 30 aa, Mycobacterium
FITSEFPVTLLLVGIGLENIGLFPRGVDHT

SEQ ID NO: 812651 - protein, 20 aa, Mycobacterium
FIVEYIGQTRGWFYTLHVLA

SEQ ID NO: 812652 - protein, 32 aa, Mycobacterium
FIVEYIGQTRGWFYTLHVLATALFDRPAFRTC

SEQ ID NO: 812653 - protein, 20 aa, Mycobacterium
FIVGEYIKVHPLALLHPDKV

SEQ ID NO: 812654 - protein, 17 aa, Mycobacterium
FIVGRTAVIARFAYPQR

SEQ ID NO: 812655 - protein, 20 aa, Mycobacterium
FIVLAQRHWDMLTPYHRLGG

SEQ ID NO: 812656 - protein, 18 aa, Mycobacterium
FIVLAQRHWEMLTAHHRL

SEQ ID NO: 812657 - protein, 17 aa, Mycobacterium
FIVLARTAPVDPAHRHA

SEQ ID NO: 812658 - protein, 18 aa, Mycobacterium
FIVLDHFGRAPEAMTEIA

SEQ ID NO: 812659 - protein, 18 aa, Mycobacterium
FIYSFSYDQKTTWSKFFT

SEQ ID NO: 812660 - protein, 22 aa, Mycobacterium
FKAPFEPLVPGGFRVPNTNFYR

SEQ ID NO: 812661 - protein, 33 aa, Mycobacterium
FKCCPPIREASNRELLWQGLIDGTIDCIVSDHS

SEQ ID NO: 812662 - protein, 23 aa, Mycobacterium
FKDAELLGMPWIVVVGRGWADGV

SEQ ID NO: 812663 - protein, 25 aa, Mycobacterium
FKDAELLGMPWIVVVGRGWADGVVE

SEQ ID NO: 812664 - protein, 27 aa, Mycobacterium
FKDAELLGVPWIVVIGRGWADGTIELR

SEQ ID NO: 812665 - protein, 19 aa, Mycobacterium
FKDILRLRRWCSGTSNRWC

SEQ ID NO: 812666 - protein, 17 aa, Mycobacterium
FKDRYKLQRFGRGGFVS

SEQ ID NO: 812667 - protein, 24 aa, Mycobacterium
FKDTLIMAYEWPADRQSLSWTLQS

SEQ ID NO: 812668 - protein, 18 aa, Mycobacterium
FKDVIDRWNAESVRLYHA

SEQ ID NO: 812669 - protein, 26 aa, Mycobacterium
FKDWDLRTAFTWKFLRAATAEQITAS

SEQ ID NO: 812670 - protein, 25 aa, Mycobacterium
FKEGDRLWLSWAMANRDPAVFPDPN

SEQ ID NO: 812671 - protein, 25 aa, Mycobacterium
FKEGERLWISWAMANRDPAVFHDPD

SEQ ID NO: 812672 - protein, 25 aa, Mycobacterium
FKEGERLWISWAMANRDPAVFKDPD

SEQ ID NO: 812673 - protein, 25 aa, Mycobacterium
FKEGERLWISWAMANRDPAVFPDPD

SEQ ID NO: 812674 - protein, 31 aa, Mycobacterium
FKEGTNLKAWLYRILTNTYINIYRKKQRQPA

SEQ ID NO: 812675 - protein, 19 aa, Mycobacterium
FKELRIKAASAAMPVGALS

SEQ ID NO: 812676 - protein, 30 aa, Mycobacterium
FKGLQLDIGAPPQFMDFRYALHDRWHGEFH

SEQ ID NO: 812677 - protein, 17 aa, Mycobacterium
FKIRDIPVSPDITGLLQ

SEQ ID NO: 812678 - protein, 19 aa, Mycobacterium
FKKFLDLSFEEWQKVVDVN

SEQ ID NO: 812679 - protein, 18 aa, Mycobacterium
FKKTWLYVGRVERVPKSG

SEQ ID NO: 812680 - protein, 17 aa, Mycobacterium
FKLARRTILADESVLRM

SEQ ID NO: 812681 - protein, 21 aa, Mycobacterium
FKLGEVVAVFAPGGRLQQCDQ

SEQ ID NO: 812682 - protein, 22 aa, Mycobacterium
FKLSDRYVAPPMPFALTPDEGE

SEQ ID NO: 812683 - protein, 17 aa, Mycobacterium
FKLVAYLGKVKETRAAK

SEQ ID NO: 812684 - protein, 18 aa, Mycobacterium
FKLWAALSGVVPRISVVN

SEQ ID NO: 812685 - protein, 24 aa, Mycobacterium
FKPGTLTSLGFNYDKLRGLNPGIV

SEQ ID NO: 812686 - protein, 19 aa, Mycobacterium
FKPLRLDIENGEWLVLATF

SEQ ID NO: 812687 - protein, 22 aa, Mycobacterium
FKPPLRWGMRMTGKKFLREYPY

SEQ ID NO: 812688 - protein, 26 aa, Mycobacterium
FKPPYLPFATLWNFVSELAAHPLPPA

SEQ ID NO: 812689 - protein, 19 aa, Mycobacterium
FKPRYNPWDQRMCLVLDKD

SEQ ID NO: 812690 - protein, 17 aa, Mycobacterium
FKPSPAVYRYVCDALGV

SEQ ID NO: 812691 - protein, 23 aa, Mycobacterium
FKPVPLPMFPGIEGTSEPNRLII

SEQ ID NO: 812692 - protein, 18 aa, Mycobacterium
FKQILRTHPLDLGSPEWV

SEQ ID NO: 812693 - protein, 27 aa, Mycobacterium
FKRARGQVWLMPHNPAYDPIPGNEAAV

SEQ ID NO: 812694 - protein, 21 aa, Mycobacterium
FKRHKQIDRPCLLGYIDKCSA

SEQ ID NO: 812695 - protein, 18 aa, Mycobacterium
FKRVLDINLLGVFNTVRA

SEQ ID NO: 812696 - protein, 25 aa, Mycobacterium
FKSGKPHGWIHNELRRRCGGPPVAA

SEQ ID NO: 812697 - protein, 25 aa, Mycobacterium
FKSRDPVMYMGNGKIWLDGQLQPQS

SEQ ID NO: 812698 - protein, 18 aa, Mycobacterium
FKVDMAAQYRIRLGGTWK

SEQ ID NO: 812699 - protein, 19 aa, Mycobacterium
FKVIEYARMMVGTKAIATL

SEQ ID NO: 812700 - protein, 17 aa, Mycobacterium
FKVPKRVVFYRAEDLPL

SEQ ID NO: 812701 - protein, 17 aa, Mycobacterium
FKVPRYVEFLDELPLNA

SEQ ID NO: 812702 - protein, 24 aa, Mycobacterium
FKVTAIVVVPVMLNRLLNALDELS

SEQ ID NO: 812703 - protein, 17 aa, Mycobacterium
FKYVHKTPFIPRFTRQE

SEQ ID NO: 812704 - protein, 25 aa, Mycobacterium
FLAAKAAYYLQLTGPVFTAQAACAS

SEQ ID NO: 812705 - protein, 17 aa, Mycobacterium
FLAAREAAHHRLFSHVP

SEQ ID NO: 812706 - protein, 31 aa, Mycobacterium
FLADRGLSMLRPELGLAAMQQLLIADRGRTG

SEQ ID NO: 812707 - protein, 33 aa, Mycobacterium
FLAESGFMQAIRPKLVVPLVTFLASSACTFSHR

SEQ ID NO: 812708 - protein, 20 aa, Mycobacterium
FLAFAVPTMMGEVRRYFRDH

SEQ ID NO: 812709 - protein, 19 aa, Mycobacterium
FLAGLRDYFRAHAFGNATF

SEQ ID NO: 812710 - protein, 18 aa, Mycobacterium
FLAITGAGGFLLYLQMHQ

SEQ ID NO: 812711 - protein, 25 aa, Mycobacterium
FLALFITHDGFWASFAREAGIEGFA

SEQ ID NO: 812712 - protein, 18 aa, Mycobacterium
FLALPRAELADAALNAAR

SEQ ID NO: 812713 - protein, 17 aa, Mycobacterium
FLALVDYAHKPGALREV

SEQ ID NO: 812714 - protein, 18 aa, Mycobacterium
FLANPDLIERLKLGAELN

SEQ ID NO: 812715 - protein, 17 aa, Mycobacterium
FLAPLSVKELAAEPSLC

SEQ ID NO: 812716 - protein, 18 aa, Mycobacterium
FLAPVEIAILLEEVLRRL

SEQ ID NO: 812717 - protein, 23 aa, Mycobacterium
FLARHPHDRFGLSELSRRVGVSK

SEQ ID NO: 812718 - protein, 26 aa, Mycobacterium
FLARNRLYYTWFRSDEPKGAALLEAA

SEQ ID NO: 812719 - protein, 25 aa, Mycobacterium
FLASRARVFSVLRPVPDLVREINEF

SEQ ID NO: 812720 - protein, 19 aa, Mycobacterium
FLASSRILNRRKGVRMSLL

SEQ ID NO: 812721 - protein, 19 aa, Mycobacterium
FLATRAVGRHLVAQRSGKV

SEQ ID NO: 812722 - protein, 18 aa, Mycobacterium
FLAVLPTGFGKSVCFQLP

SEQ ID NO: 812723 - protein, 27 aa, Mycobacterium
FLAVSDRYWRRYFVNFTEVMAPATQVG

SEQ ID NO: 812724 - protein, 17 aa, Mycobacterium
FLAVVDYGGFGKAAEQL

SEQ ID NO: 812725 - protein, 20 aa, Mycobacterium
FLAWEPFSRMAFRFNAASTR

SEQ ID NO: 812726 - protein, 18 aa, Mycobacterium
FLAWSDDPLPKGAQVLVV

SEQ ID NO: 812727 - protein, 18 aa, Mycobacterium
FLAYGQKTKALADGKPLH

SEQ ID NO: 812728 - protein, 17 aa, Mycobacterium
FLAYLERDGVLTGVVGC

SEQ ID NO: 812729 - protein, 20 aa, Mycobacterium
FLCEIKNVIDRSAAAGAPCG

SEQ ID NO: 812730 - protein, 21 aa, Mycobacterium
FLDAFSGTGLRRDAFCPAYGL

SEQ ID NO: 812731 - protein, 18 aa, Mycobacterium
FLDALRQALPGKAIEAGI

SEQ ID NO: 812732 - protein, 17 aa, Mycobacterium
FLDALYSADLGDPDRWQ

SEQ ID NO: 812733 - protein, 27 aa, Mycobacterium
FLDAVRPTFLVLQSAMCLGLAKTTLTQ

SEQ ID NO: 812734 - protein, 19 aa, Mycobacterium
FLDETCWLALRALAAHPEG

SEQ ID NO: 812735 - protein, 18 aa, Mycobacterium
FLDFLKTVARAYPRRKLH

SEQ ID NO: 812736 - protein, 26 aa, Mycobacterium
FLDGELFVTGRLKDLIIIRGRNYYPE

SEQ ID NO: 812737 - protein, 23 aa, Mycobacterium
FLDGFADLDFNPNPGLPVSRNVY

SEQ ID NO: 812738 - protein, 19 aa, Mycobacterium
FLDGFYRHRLDLPEALRRA

SEQ ID NO: 812739 - protein, 23 aa, Mycobacterium
FLDGLAAYRHAHGLPGLSVAWGL

SEQ ID NO: 812740 - protein, 17 aa, Mycobacterium
FLDIQTMYFSALQQAQC

SEQ ID NO: 812741 - protein, 21 aa, Mycobacterium
FLDKHGLDTLARPLADEAAHQ

SEQ ID NO: 812742 - protein, 18 aa, Mycobacterium
FLDMVTAWTRSRTTQEIV

SEQ ID NO: 812743 - protein, 27 aa, Mycobacterium
FLDNRAGTYTWIPFGGGVRRCLGATFA

SEQ ID NO: 812744 - protein, 25 aa, Mycobacterium
FLDTVSQLITLYRPHRLAVCLDLDW

SEQ ID NO: 812745 - protein, 17 aa, Mycobacterium
FLDVDCIPSPRLIARYR

SEQ ID NO: 812746 - protein, 21 aa, Mycobacterium
FLDYSTNPKIYPALHDYLRAS

SEQ ID NO: 812747 - protein, 26 aa, Mycobacterium
FLEAAMDIFPLARRVLLTAYADTHAA

SEQ ID NO: 812748 - protein, 19 aa, Mycobacterium
FLEAGVGWVPFFVDRLHEH

SEQ ID NO: 812749 - protein, 21 aa, Mycobacterium
FLEAGYRRFLERRLRETFGFE

SEQ ID NO: 812750 - protein, 19 aa, Mycobacterium
FLEGVRRLCDKHGALLVID

SEQ ID NO: 812751 - protein, 24 aa, Mycobacterium
FLEHSRIIHFRAIDEYWIGSADMM

SEQ ID NO: 812752 - protein, 24 aa, Mycobacterium
FLEHSRIIHFRGINEFWIGSADMM

SEQ ID NO: 812753 - protein, 24 aa, Mycobacterium
FLEHSRIMHFNRINEFWIGSADMM

SEQ ID NO: 812754 - protein, 21 aa, Mycobacterium
FLEKPSRWVRALAENPQAFSA

SEQ ID NO: 812755 - protein, 20 aa, Mycobacterium
FLELAPNPVALMQVGLTTMA

SEQ ID NO: 812756 - protein, 18 aa, Mycobacterium
FLELGGKSAMIVLDDAKP

SEQ ID NO: 812757 - protein, 17 aa, Mycobacterium
FLELSPLAAWGSAFKVG

SEQ ID NO: 812758 - protein, 17 aa, Mycobacterium
FLELSPLAAYGSAFTVG

SEQ ID NO: 812759 - protein, 18 aa, Mycobacterium
FLELSPLAAYGSAFTVGA

SEQ ID NO: 812760 - protein, 17 aa, Mycobacterium
FLELYKQHKGEYFGSLL

SEQ ID NO: 812761 - protein, 21 aa, Mycobacterium
FLERFVLNPRHIEVQVLADSH

SEQ ID NO: 812762 - protein, 19 aa, Mycobacterium
FLERRLREAFGFEGSPIRI

SEQ ID NO: 812763 - protein, 21 aa, Mycobacterium
FLERRLRESFGFDGTPIRINV

SEQ ID NO: 812764 - protein, 24 aa, Mycobacterium
FLERRLRETFGFEGSPIRINVRVR

SEQ ID NO: 812765 - protein, 26 aa, Mycobacterium
FLESLRYDLAVQEIFVFTPKGDVITL

SEQ ID NO: 812766 - protein, 25 aa, Mycobacterium
FLESPSRWVRALATNPHAWSSAPNF

SEQ ID NO: 812767 - protein, 23 aa, Mycobacterium
FLETFERLILRPRSLDYKVQFPG

SEQ ID NO: 812768 - protein, 19 aa, Mycobacterium
FLETNVMGTYRVLEAVRRY

SEQ ID NO: 812769 - protein, 25 aa, Mycobacterium
FLEVVFGLWERSWQIESLTPDRGDD

SEQ ID NO: 812770 - protein, 18 aa, Mycobacterium
FLFADAREYLRKGMPTAW

SEQ ID NO: 812771 - protein, 22 aa, Mycobacterium
FLFDTLDGFLDILLDAAARGVA

SEQ ID NO: 812772 - protein, 20 aa, Mycobacterium
FLFGMDSIVAISLVHKARRQ

SEQ ID NO: 812773 - protein, 19 aa, Mycobacterium
FLFRLIPPRADFAQTMTDI

SEQ ID NO: 812774 - protein, 33 aa, Mycobacterium
FLGAQYDAGLAWVHLPRGFGGLDLPRTAQERVD

SEQ ID NO: 812775 - protein, 18 aa, Mycobacterium
FLGEFLRTLPREWELPPI

SEQ ID NO: 812776 - protein, 24 aa, Mycobacterium
FLGEQFMQWFLQEQIEEVALMASL

SEQ ID NO: 812777 - protein, 17 aa, Mycobacterium
FLGGAAVRTQYAFGPTI

SEQ ID NO: 812778 - protein, 19 aa, Mycobacterium
FLGGAERWLRRIAALTRDG

SEQ ID NO: 812779 - protein, 18 aa, Mycobacterium
FLGLPPMQPRMNVTDIAD

SEQ ID NO: 812780 - protein, 17 aa, Mycobacterium
FLGLRAGYGSLIQMIWI

SEQ ID NO: 812781 - protein, 20 aa, Mycobacterium
FLGLYLASRLVELLPELDVF

SEQ ID NO: 812782 - protein, 17 aa, Mycobacterium
FLGPEIYVLGAASAPRY

SEQ ID NO: 812783 - protein, 29 aa, Mycobacterium
FLGRYLALDWLERMDLVDGKVIALVRAKS

SEQ ID NO: 812784 - protein, 29 aa, Mycobacterium
FLGTVQMCRAFLPVLRQRPEANITNMSSL

SEQ ID NO: 812785 - protein, 19 aa, Mycobacterium
FLGYPHVLAGQRLCIYLDP

SEQ ID NO: 812786 - protein, 17 aa, Mycobacterium
FLHACDVSRLPDGTFGV

SEQ ID NO: 812787 - protein, 21 aa, Mycobacterium
FLHAEPIFASVAPGVDAAPRT

SEQ ID NO: 812788 - protein, 17 aa, Mycobacterium
FLHGCDISRIPDGSYQV

SEQ ID NO: 812789 - protein, 17 aa, Mycobacterium
FLHTASHGDSLTPKYGY

SEQ ID NO: 812790 - protein, 19 aa, Mycobacterium
FLHVAGSGGLPLILVDGVT

SEQ ID NO: 812791 - protein, 17 aa, Mycobacterium
FLHYRMIDVSSIKELCR

SEQ ID NO: 812792 - protein, 18 aa, Mycobacterium
FLIAVRPDRRRNATLSTL

SEQ ID NO: 812793 - protein, 19 aa, Mycobacterium
FLIEGFGARFNDWSQTSLW

SEQ ID NO: 812794 - protein, 30 aa, Mycobacterium
FLIRPVAAVLQPVFWFGLGGLARELPVRGP

SEQ ID NO: 812795 - protein, 19 aa, Mycobacterium
FLISGRWPDSTKEWAQLLM

SEQ ID NO: 812796 - protein, 17 aa, Mycobacterium
FLKKALTGEGLPLMRCS

SEQ ID NO: 812797 - protein, 17 aa, Mycobacterium
FLKPEEVTRAVLFLVDE

SEQ ID NO: 812798 - protein, 18 aa, Mycobacterium
FLLALHLGRQKDAGELAP

SEQ ID NO: 812799 - protein, 17 aa, Mycobacterium
FLLAPWTAEQIVSELAP

SEQ ID NO: 812800 - protein, 37 aa, Mycobacterium
FLLGLDLVDRVLFWMLPLDDPLPWLVADRRAVRVTAV

SEQ ID NO: 812801 - protein, 17 aa, Mycobacterium
FLLGVQQLLGLGQFAIP

SEQ ID NO: 812802 - protein, 20 aa, Mycobacterium
FLLGYSIAHLKYFASLARSY

SEQ ID NO: 812803 - protein, 19 aa, Mycobacterium
FLLLSLLQVMFTENLVDRA

SEQ ID NO: 812804 - protein, 18 aa, Mycobacterium
FLLNELRVGELFVSSLDA

SEQ ID NO: 812805 - protein, 17 aa, Mycobacterium
FLLPLNPGKDDEGNIID

SEQ ID NO: 812806 - protein, 18 aa, Mycobacterium
FLLPLNPGKDDEGNIYDY

SEQ ID NO: 812807 - protein, 17 aa, Mycobacterium
FLLPPTWSQLDAVSSAG

SEQ ID NO: 812808 - protein, 19 aa, Mycobacterium
FLLVAITMTIASWRRARAQ

SEQ ID NO: 812809 - protein, 17 aa, Mycobacterium
FLMPLNPGKDDDGNPID

SEQ ID NO: 812810 - protein, 17 aa, Mycobacterium
FLMPVEDVFTITGRGTV

SEQ ID NO: 812811 - protein, 26 aa, Mycobacterium
FLNEGLPYRVPYPQTMPVQESGPVRG

SEQ ID NO: 812812 - protein, 38 aa, Mycobacterium
FLNRGQWLARLLMADRLLRLKSIPISLALPWGLNISDL

SEQ ID NO: 812813 - protein, 20 aa, Mycobacterium
FLNVATALFRELRILPPFTQ

SEQ ID NO: 812814 - protein, 23 aa, Mycobacterium
FLPAFTGAMPYRRARERGVKMIG

SEQ ID NO: 812815 - protein, 27 aa, Mycobacterium
FLPDRVRVLDFPTGFHYDFRTPEYAQY

SEQ ID NO: 812816 - protein, 25 aa, Mycobacterium
FLPDRVRVLDFPTNFHYDFRTPEYA

SEQ ID NO: 812817 - protein, 34 aa, Mycobacterium
FLPEAYTASWTRPVSTWWPWRGRTVHIARAPVPD

SEQ ID NO: 812818 - protein, 22 aa, Mycobacterium
FLPEITLLRYPADTPAGPNPGD

SEQ ID NO: 812819 - protein, 17 aa, Mycobacterium
FLPERLGFLFVGAAEMA

SEQ ID NO: 812820 - protein, 19 aa, Mycobacterium
FLPGATYHFVATSAAPRYL

SEQ ID NO: 812821 - protein, 17 aa, Mycobacterium
FLPGILSGEVHFAIGYS

SEQ ID NO: 812822 - protein, 25 aa, Mycobacterium
FLPGQRVPAWAAKQMGPHCFAKDQP

SEQ ID NO: 812823 - protein, 18 aa, Mycobacterium
FLPLSHHIIKNSAKVMSL

SEQ ID NO: 812824 - protein, 19 aa, Mycobacterium
FLPMHMLCLRDMGLMLGEY

SEQ ID NO: 812825 - protein, 20 aa, Mycobacterium
FLPMHMLCLRDMGLMLGEYW

SEQ ID NO: 812826 - protein, 18 aa, Mycobacterium
FLPNMYRNMANVPGLLDT

SEQ ID NO: 812827 - protein, 17 aa, Mycobacterium
FLPQVRSAVGLGGKVEH

SEQ ID NO: 812828 - protein, 17 aa, Mycobacterium
FLPTAGDSRGIVGSSHA

SEQ ID NO: 812829 - protein, 26 aa, Mycobacterium
FLPVEELIAAFLPVLFPGMEIVEHHA

SEQ ID NO: 812830 - protein, 21 aa, Mycobacterium
FLQIAQAFVSERIGLAAQAYS

SEQ ID NO: 812831 - protein, 41 aa, Mycobacterium
FLQIDDRLGHLHWLMQHNGGVFLPPWGKVEQWLLSVQHDTA

SEQ ID NO: 812832 - protein, 19 aa, Mycobacterium
FLQMFTTALEKRLTKYDLK

SEQ ID NO: 812833 - protein, 27 aa, Mycobacterium
FLQPGHPYRMWPARLRRPEPAPRLGEH

SEQ ID NO: 812834 - protein, 34 aa, Mycobacterium
FLQYYRESANWLERTYKWVPRVGIEHLRAVLVEE

SEQ ID NO: 812835 - protein, 20 aa, Mycobacterium
FLRAQPDLSAKAWPRYVRIA

SEQ ID NO: 812836 - protein, 26 aa, Mycobacterium
FLRCCTDVWRVGRFLVIDAGLSGPDR

SEQ ID NO: 812837 - protein, 18 aa, Mycobacterium
FLRDVYSEQAILADGVLS

SEQ ID NO: 812838 - protein, 26 aa, Mycobacterium
FLREVQDVWTWARPYFDDRATATAKE

SEQ ID NO: 812839 - protein, 27 aa, Mycobacterium
FLREVQDVWTWVRPYYDARAMAAAADL

SEQ ID NO: 812840 - protein, 39 aa, Mycobacterium
FLREYPYREAYLLRHAKLFRAELTMPLILLGGITNRDTM

SEQ ID NO: 812841 - protein, 23 aa, Mycobacterium
FLRMEADWEAGYLLTVRSAWQAD

SEQ ID NO: 812842 - protein, 24 aa, Mycobacterium
FLRMEADWEASYLLSLRAAWQADN

SEQ ID NO: 812843 - protein, 25 aa, Mycobacterium
FLRMEADWEASYLLSLRAAWQADNK

SEQ ID NO: 812844 - protein, 26 aa, Mycobacterium
FLRMEADWESGYLLTLRSAWQADNRI

SEQ ID NO: 812845 - protein, 23 aa, Mycobacterium
FLRMEADWESSYLLTLRSAWQAD

SEQ ID NO: 812846 - protein, 26 aa, Mycobacterium
FLRMEAEWEASYLLALRAAWQADNNI

SEQ ID NO: 812847 - protein, 19 aa, Mycobacterium
FLRMVLSVEKVLCGLPALW

SEQ ID NO: 812848 - protein, 18 aa, Mycobacterium
FLRNWRDALELPPQRHRD

SEQ ID NO: 812849 - protein, 23 aa, Mycobacterium
FLRQLQAILKVRSHYGIATSRQI

SEQ ID NO: 812850 - protein, 17 aa, Mycobacterium
FLRQRIAGYLSQRLQVE

SEQ ID NO: 812851 - protein, 18 aa, Mycobacterium
FLRSHHSWTCAGAPIRDP

SEQ ID NO: 812852 - protein, 25 aa, Mycobacterium
FLRSHHSWTCAGAPIRDPRTGQVIG

SEQ ID NO: 812853 - protein, 28 aa, Mycobacterium
FLRSREPWVWGPRMLVGLDISASATLGI

SEQ ID NO: 812854 - protein, 23 aa, Mycobacterium
FLRTETGLLAAWSWDDFLRANDD

SEQ ID NO: 812855 - protein, 23 aa, Mycobacterium
FLRVTFALLDRRYAIDLPATARD

SEQ ID NO: 812856 - protein, 27 aa, Mycobacterium
FLSAQQDLPRIGWPRYIRLSENLPTTA

SEQ ID NO: 812857 - protein, 17 aa, Mycobacterium
FLSEFRSTTGDFVKLSK

SEQ ID NO: 812858 - protein, 17 aa, Mycobacterium
FLSFLPSSTFGQPPIVN

SEQ ID NO: 812859 - protein, 17 aa, Mycobacterium
FLSGPWQSDLTAAGFDP

SEQ ID NO: 812860 - protein, 17 aa, Mycobacterium
FLSLHLARLMAAAGHDV

SEQ ID NO: 812861 - protein, 19 aa, Mycobacterium
FLSLQQAVYRLTGELAEWF

SEQ ID NO: 812862 - protein, 25 aa, Mycobacterium
FLSLQRDLYAYLHDQTLRLLNQGYT

SEQ ID NO: 812863 - protein, 26 aa, Mycobacterium
FLSLQRDLYAYLHDQTLRLLNQGYTG

SEQ ID NO: 812864 - protein, 26 aa, Mycobacterium
FLSQAYVELTFPLAAQYFTVNPMAKR

SEQ ID NO: 812865 - protein, 18 aa, Mycobacterium
FLSQFLGRVINTHPALLP

SEQ ID NO: 812866 - protein, 18 aa, Mycobacterium
FLSRYRDLTARRAARVPL

SEQ ID NO: 812867 - protein, 24 aa, Mycobacterium
FLTADRAVVLTAWTPLNRGTDPQD

SEQ ID NO: 812868 - protein, 21 aa, Mycobacterium
FLTAPDPFRAVSGFLTENENA

SEQ ID NO: 812869 - protein, 26 aa, Mycobacterium
FLTDLTDRGLACPLLVISDGARGLIA

SEQ ID NO: 812870 - protein, 20 aa, Mycobacterium
FLTDVFVPDDMLLGGPTSGW

SEQ ID NO: 812871 - protein, 19 aa, Mycobacterium
FLTGRIGFPAIVGTIADVL

SEQ ID NO: 812872 - protein, 44 aa, Mycobacterium
FLTLDSLKWVLRNRAYTPWYLVRYWRLLKFKLANPHIITRGMVF

SEQ ID NO: 812873 - protein, 19 aa, Mycobacterium
FLTPRDSLRQRCVVHRLTI

SEQ ID NO: 812874 - protein, 18 aa, Mycobacterium
FLTPRDSLRQRRVAHRLI

SEQ ID NO: 812875 - protein, 19 aa, Mycobacterium
FLTRKWAKENGYALRKELW

SEQ ID NO: 812876 - protein, 17 aa, Mycobacterium
FLTYRVMGGKPHAFRPP

SEQ ID NO: 812877 - protein, 17 aa, Mycobacterium
FLVALRRGDPDSGATAL

SEQ ID NO: 812878 - protein, 17 aa, Mycobacterium
FLVAVTFRMGRLGVPVV

SEQ ID NO: 812879 - protein, 26 aa, Mycobacterium
FLVEGRVALIAPAGWPTQRVIGGPGS

SEQ ID NO: 812880 - protein, 17 aa, Mycobacterium
FLVFMRTGGTVVSAPYL

SEQ ID NO: 812881 - protein, 29 aa, Mycobacterium
FLVGSWQYRRLFMRLPPDAPKHRARLFDA

SEQ ID NO: 812882 - protein, 17 aa, Mycobacterium
FLVHGRIVYAAGPIGIA

SEQ ID NO: 812883 - protein, 17 aa, Mycobacterium
FLVHHRSRLASEKNGQL

SEQ ID NO: 812884 - protein, 29 aa, Mycobacterium
FLVKDLHLPWQWGAAWFLDQLTDGDVASN

SEQ ID NO: 812885 - protein, 19 aa, Mycobacterium
FLVLEMSARHPGNIAALAA

SEQ ID NO: 812886 - protein, 19 aa, Mycobacterium
FLVLPHPQVLDMYRQKGAD

SEQ ID NO: 812887 - protein, 19 aa, Mycobacterium
FLVNYIRMFAKDPQQRRVQ

SEQ ID NO: 812888 - protein, 19 aa, Mycobacterium
FLVRGPLVMRGYRKEPEKT

SEQ ID NO: 812889 - protein, 18 aa, Mycobacterium
FLVSAEEFVFLEVNPRIQ

SEQ ID NO: 812890 - protein, 25 aa, Mycobacterium
FLVSDVQLLVCRIGDLPLAYRDHCP

SEQ ID NO: 812891 - protein, 20 aa, Mycobacterium
FLVTSGFWQKLPQMSLEQYP

SEQ ID NO: 812892 - protein, 20 aa, Mycobacterium
FLVVVPDRWEPLANNLFHGI

SEQ ID NO: 812893 - protein, 18 aa, Mycobacterium
FLYSLDPYLPPGAKPRWR

SEQ ID NO: 812894 - protein, 19 aa, Mycobacterium
FMAAGIAGGLALTACSQTK

SEQ ID NO: 812895 - protein, 27 aa, Mycobacterium
FMADHHAYLSLMLWLAGPGSQQFDVIH

SEQ ID NO: 812896 - protein, 27 aa, Mycobacterium
FMADHVFSRIDIPGWLARTGFQMLDPI

SEQ ID NO: 812897 - protein, 18 aa, Mycobacterium
FMAEGATRWAAVRRAITE

SEQ ID NO: 812898 - protein, 30 aa, Mycobacterium
FMAKMQLESIFRELIFRAPGLRVGEPVYLT

SEQ ID NO: 812899 - protein, 17 aa, Mycobacterium
FMALNYIYHQMNMIAEG

SEQ ID NO: 812900 - protein, 31 aa, Mycobacterium
FMDLAGFDAWLARWQALRPDADAMDRTNPIY

SEQ ID NO: 812901 - protein, 18 aa, Mycobacterium
FMDMIKQPPVTIGALYQP

SEQ ID NO: 812902 - protein, 25 aa, Mycobacterium
FMDVMVTIAMWKFRQFRPVNTAAAR

SEQ ID NO: 812903 - protein, 27 aa, Mycobacterium
FMEEYDIQLYYRRAKAWAAAFADPRRE

SEQ ID NO: 812904 - protein, 31 aa, Mycobacterium
FMEQYGFQCGFCLPGMLLAATDLLDRDPNPS

SEQ ID NO: 812905 - protein, 36 aa, Mycobacterium
FMERRLAPRWWPTAMKKFVWPWLVGRRQVVVSSYPP

SEQ ID NO: 812906 - protein, 19 aa, Mycobacterium
FMESLDPSIYWMGMHHSRL

SEQ ID NO: 812907 - protein, 18 aa, Mycobacterium
FMESLLQVPLRDGYGSTE

SEQ ID NO: 812908 - protein, 18 aa, Mycobacterium
FMEVLSQGTRFKPAKAKE

SEQ ID NO: 812909 - protein, 25 aa, Mycobacterium
FMGCYAFPNHVLPRYPGRGLGVAVP

SEQ ID NO: 812910 - protein, 17 aa, Mycobacterium
FMGLISLPTAVLSDADI

SEQ ID NO: 812911 - protein, 36 aa, Mycobacterium
FMGSSYLLNGLFFSLPWYYRSGYDVLLYTLPFHGKR

SEQ ID NO: 812912 - protein, 37 aa, Mycobacterium
FMGSSYLLNGLFFSLPWYYRSGYDVLLYTLPFHGKRA

SEQ ID NO: 812913 - protein, 25 aa, Mycobacterium
FMHLPTNLREPVFAALAAAVAPGGT

SEQ ID NO: 812914 - protein, 17 aa, Mycobacterium
FMHPGDALFVPGEPVDV

SEQ ID NO: 812915 - protein, 27 aa, Mycobacterium
FMKILGAEFLSRFPGRVVNTHPALLPA

SEQ ID NO: 812916 - protein, 24 aa, Mycobacterium
FMKNPEFAAAILPTLRGLKAIANY

SEQ ID NO: 812917 - protein, 20 aa, Mycobacterium
FMLFGLVDHGGWITKAGIER

SEQ ID NO: 812918 - protein, 24 aa, Mycobacterium
FMNEGTMKLFRPDLKNPGPDDLKV

SEQ ID NO: 812919 - protein, 20 aa, Mycobacterium
FMNHMLTPQRRFATATLALA

SEQ ID NO: 812920 - protein, 18 aa, Mycobacterium
FMPAWGEADYMMSFQALL

SEQ ID NO: 812921 - protein, 18 aa, Mycobacterium
FMPGWLEMLTEVGGDLSS

SEQ ID NO: 812922 - protein, 21 aa, Mycobacterium
FMPTAVIPRGAGPAVALPVAS

SEQ ID NO: 812923 - protein, 18 aa, Mycobacterium
FMQKVFFEIMKQFQGEYL

SEQ ID NO: 812924 - protein, 20 aa, Mycobacterium
FMQKVFFEIMKQFQGEYLGS

SEQ ID NO: 812925 - protein, 27 aa, Mycobacterium
FMQRLNSVLPLWLQYGGSPTQAAALCP

SEQ ID NO: 812926 - protein, 20 aa, Mycobacterium
FMRDQFPMAVHLLDGIAVGT

SEQ ID NO: 812927 - protein, 22 aa, Mycobacterium
FMREHALLKKLLRTEPETILPS

SEQ ID NO: 812928 - protein, 26 aa, Mycobacterium
FMRYVQNPIWNFLCDNYFRVEIDGWH

SEQ ID NO: 812929 - protein, 19 aa, Mycobacterium
FMTMRWTYSQPTERLPVVT

SEQ ID NO: 812930 - protein, 20 aa, Mycobacterium
FMVADLLAARLGSKFKGHKR

SEQ ID NO: 812931 - protein, 25 aa, Mycobacterium
FMVSHFHYDPVWWNTQAAYTSVWTE

SEQ ID NO: 812932 - protein, 18 aa, Mycobacterium
FMVVFDLLDLTPYGRQET

SEQ ID NO: 812933 - protein, 17 aa, Mycobacterium
FNAALRYFNGGLGVEIG

SEQ ID NO: 812934 - protein, 17 aa, Mycobacterium
FNAFTNASANHLSPGMW

SEQ ID NO: 812935 - protein, 19 aa, Mycobacterium
FNAIYKRWHCGELDVPLPG

SEQ ID NO: 812936 - protein, 21 aa, Mycobacterium
FNALADRLPDLAPLGNPERLR

SEQ ID NO: 812937 - protein, 17 aa, Mycobacterium
FNALAYHTEWPVGSGKY

SEQ ID NO: 812938 - protein, 18 aa, Mycobacterium
FNALLQWGPMIFALGYTA

SEQ ID NO: 812939 - protein, 23 aa, Mycobacterium
FNANGAGWNLGFGNDGSFNIGLG

SEQ ID NO: 812940 - protein, 19 aa, Mycobacterium
FNATRYALLNGAALAPLPP

SEQ ID NO: 812941 - protein, 19 aa, Mycobacterium
FNATRYALLNGAQLASLPP

SEQ ID NO: 812942 - protein, 17 aa, Mycobacterium
FNAVADHMPDLTPIAAP

SEQ ID NO: 812943 - protein, 19 aa, Mycobacterium
FNAVYRRWHGGELDVALPG

SEQ ID NO: 812944 - protein, 19 aa, Mycobacterium
FNCTGWKIGWACGTPELVA

SEQ ID NO: 812945 - protein, 20 aa, Mycobacterium
FNDIVAVLALYRPGPMGMNA

SEQ ID NO: 812946 - protein, 23 aa, Mycobacterium
FNDMIIGLRMITPAGVLDLGRVA

SEQ ID NO: 812947 - protein, 26 aa, Mycobacterium
FNDPDLLSTFLPAFRNDYRALQAYHR

SEQ ID NO: 812948 - protein, 19 aa, Mycobacterium
FNDPQWKGITDWRAELSPH

SEQ ID NO: 812949 - protein, 25 aa, Mycobacterium
FNDRLLERLIIGGPLTRRQLLEGAE

SEQ ID NO: 812950 - protein, 24 aa, Mycobacterium
FNDTERWWLDRMVSVIANSAGIRA

SEQ ID NO: 812951 - protein, 17 aa, Mycobacterium
FNDTHLTRLRLITSMLD

SEQ ID NO: 812952 - protein, 17 aa, Mycobacterium
FNDVIVFARDWGFRLED

SEQ ID NO: 812953 - protein, 17 aa, Mycobacterium
FNEAFSPYGFKPEAIKP

SEQ ID NO: 812954 - protein, 26 aa, Mycobacterium
FNEALPALNSFILPGGTPLSALLHVA

SEQ ID NO: 812955 - protein, 24 aa, Mycobacterium
FNEDQRAWLSGFLAGLHSRLAMNL

SEQ ID NO: 812956 - protein, 24 aa, Mycobacterium
FNEHMLLHPLSAPMTLRWLTDRFD

SEQ ID NO: 812957 - protein, 20 aa, Mycobacterium
FNELVMRAGLRWQQVVLLRA

SEQ ID NO: 812958 - protein, 24 aa, Mycobacterium
FNEMDYFVRMWNQAALAMDVYQAE

SEQ ID NO: 812959 - protein, 17 aa, Mycobacterium
FNESDYMRMWVQAAITM

SEQ ID NO: 812960 - protein, 22 aa, Mycobacterium
FNETIRYYTTMLKKYGVTVLLN

SEQ ID NO: 812961 - protein, 25 aa, Mycobacterium
FNEVDWYVRHLLGLAPRGALGITPG

SEQ ID NO: 812962 - protein, 18 aa, Mycobacterium
FNEVFFDGVRIPANNVLG

SEQ ID NO: 812963 - protein, 19 aa, Mycobacterium
FNEVFLTDVFVPDDMLLGG

SEQ ID NO: 812964 - protein, 18 aa, Mycobacterium
FNEWNHRCYGLWSGDGMV

SEQ ID NO: 812965 - protein, 20 aa, Mycobacterium
FNFHVGLAQLAGNALLDLFL

SEQ ID NO: 812966 - protein, 26 aa, Mycobacterium
FNGGVLNTGFFSATTHAGPNSGYFNV

SEQ ID NO: 812967 - protein, 22 aa, Mycobacterium
FNGILHPLERITAIAPNPLTGG

SEQ ID NO: 812968 - protein, 24 aa, Mycobacterium
FNGNPILCDLILIRSALSPRAAKV

SEQ ID NO: 812969 - protein, 25 aa, Mycobacterium
FNGSKIKFVAQFLATIHVTAAVEAM

SEQ ID NO: 812970 - protein, 18 aa, Mycobacterium
FNGSYWQGGVGEAQVGLS

SEQ ID NO: 812971 - protein, 20 aa, Mycobacterium
FNGTAAPVKYPAGFFGVFTG

SEQ ID NO: 812972 - protein, 24 aa, Mycobacterium
FNGTVLVEWLNVSGGIDAPAVWMM

SEQ ID NO: 812973 - protein, 22 aa, Mycobacterium
FNGVEPVYMVPPYTASEDDPVM

SEQ ID NO: 812974 - protein, 18 aa, Mycobacterium
FNIELLPCGQIAHSALSG

SEQ ID NO: 812975 - protein, 17 aa, Mycobacterium
FNIRYRDDKSYPVLAVT

SEQ ID NO: 812976 - protein, 23 aa, Mycobacterium
FNKALWEYARLPGSIHQLVILVT

SEQ ID NO: 812977 - protein, 46 aa, Mycobacterium
FNLASWAVGWVPWIGILAPQINFFYYLFEPIVQSGLFNTLDWLDGT

SEQ ID NO: 812978 - protein, 20 aa, Mycobacterium
FNLEFHVRRMRVAEPGTLRD

SEQ ID NO: 812979 - protein, 17 aa, Mycobacterium
FNLFEVFGVDKVLGADK

SEQ ID NO: 812980 - protein, 18 aa, Mycobacterium
FNLRFQMATGQLNNIRRL

SEQ ID NO: 812981 - protein, 26 aa, Mycobacterium
FNLSAEFFLWYTEQIAHLHGTYAPAS

SEQ ID NO: 812982 - protein, 17 aa, Mycobacterium
FNLVQYLGQLGVDADVW

SEQ ID NO: 812983 - protein, 19 aa, Mycobacterium
FNMNFGDLFDRVREQRVRP

SEQ ID NO: 812984 - protein, 26 aa, Mycobacterium
FNNELGHPWTVLRATPETDFLVLEMS

SEQ ID NO: 812985 - protein, 23 aa, Mycobacterium
FNNELGHPWTVLRATRGTDYLIL

SEQ ID NO: 812986 - protein, 19 aa, Mycobacterium
FNNITFDDWQRVIDVNLNG

SEQ ID NO: 812987 - protein, 23 aa, Mycobacterium
FNNLSPFMQFVGRIMRVIPDVDP

SEQ ID NO: 812988 - protein, 21 aa, Mycobacterium
FNPGMFRGLAGVGYTALRQVD

SEQ ID NO: 812989 - protein, 17 aa, Mycobacterium
FNPGPIAHRAPRIWTGG

SEQ ID NO: 812990 - protein, 34 aa, Mycobacterium
FNQASGRIKLAWFLLNAARYMPVLVYAADPHWGK

SEQ ID NO: 812991 - protein, 33 aa, Mycobacterium; identical to SEQ ID NO: 114515

SEQ ID NO: 812992 - protein, 31 aa, Mycobacterium
FNQASHRIKLAWFLLNAARYMPAQVFAADPR

SEQ ID NO: 812993 - protein, 33 aa, Mycobacterium
FNQPLKYEIVLSNTYDLWFTPWAPRSNTNGLGA

SEQ ID NO: 812994 - protein, 23 aa, Mycobacterium
FNQVALEIMPAWGGAERLVELVG

SEQ ID NO: 812995 - protein, 23 aa, Mycobacterium
FNQVALEIMPAWGGAERLVTLVG

SEQ ID NO: 812996 - protein, 23 aa, Mycobacterium
FNQVQLEIMPAWGGAERLAALVG

SEQ ID NO: 812997 - protein, 39 aa, Mycobacterium
FNRRFIGLGPGHRAVFWVPPYHDFGLISGILSALAGNFD

SEQ ID NO: 812998 - protein, 20 aa, Mycobacterium
FNRSPRAFAVAVRVFARTRA

SEQ ID NO: 812999 - protein, 17 aa, Mycobacterium
FNRYVVGGHLPIPKIPF

SEQ ID NO: 813000 - protein, 21 aa, Mycobacterium
FNSDKGFGFIAPDGGEKDVFV

SEQ ID NO: 813001 - protein, 24 aa, Mycobacterium
FNSFDWASIWPTLTQRFTVVAPDM

SEQ ID NO: 813002 - protein, 23 aa, Mycobacterium
FNSGYVNTGFFNSGSTNTGLFNA

SEQ ID NO: 813003 - protein, 20 aa, Mycobacterium
FNSWTHAKIKAASDAFDSGK

SEQ ID NO: 813004 - protein, 29 aa, Mycobacterium
FNTADADVIRYLRWFTFLSADELGELEQA

SEQ ID NO: 813005 - protein, 30 aa, Mycobacterium
FNTADADVIRYLRWFTFLTADELGELEQAT

SEQ ID NO: 813006 - protein, 25 aa, Mycobacterium
FNTFAEVWHFPPWFGRNAAAFDDFM

SEQ ID NO: 813007 - protein, 24 aa, Mycobacterium
FNTFYGEFAKPWDRRRLPMHYQAR

SEQ ID NO: 813008 - protein, 19 aa, Mycobacterium
FNTVYLDDVFVPDELVLGD

SEQ ID NO: 813009 - protein, 18 aa, Mycobacterium
FNVPTQDARWFRLCTVDG

SEQ ID NO: 813010 - protein, 27 aa, Mycobacterium
FNVTPLDQMFVLWTAVNRVSRSGEVIG

SEQ ID NO: 813011 - protein, 23 aa, Mycobacterium
FNVYLPLSLIRQVKHRAIETDMS

SEQ ID NO: 813012 - protein, 19 aa, Mycobacterium
FNYGALASGLLNRGNTISG

SEQ ID NO: 813013 - protein, 23 aa, Mycobacterium
FNYKDRIFATPVITLPIVDRALE

SEQ ID NO: 813014 - protein, 18 aa, Mycobacterium
FPAAAWAPDFDPAGKRIA

SEQ ID NO: 813015 - protein, 23 aa, Mycobacterium
FPAADRPWLTHFADTWNRQDRHV

SEQ ID NO: 813016 - protein, 32 aa, Mycobacterium
FPAALHTAPFAEPLYDVIALAQHRARPLSNAT

SEQ ID NO: 813017 - protein, 26 aa, Mycobacterium
FPAASWQVVRLPRIPARFPMYLPGPD

SEQ ID NO: 813018 - protein, 18 aa, Mycobacterium
FPADFIVEYIGQTRGWFY

SEQ ID NO: 813019 - protein, 17 aa, Mycobacterium
FPAESVRFFASARSQGR

SEQ ID NO: 813020 - protein, 18 aa, Mycobacterium
FPAFLDALRQALPGKAIE

SEQ ID NO: 813021 - protein, 18 aa, Mycobacterium
FPAFLDPLRQSLPGKAIE

SEQ ID NO: 813022 - protein, 25 aa, Mycobacterium
FPALDALFGTLYLPADRWLAQYGVD

SEQ ID NO: 813023 - protein, 18 aa, Mycobacterium
FPALLDEGICVFLPNVRG

SEQ ID NO: 813024 - protein, 18 aa, Mycobacterium
FPAMPPICRVCQMPAVFP

SEQ ID NO: 813025 - protein, 25 aa, Mycobacterium
FPAPQKYVAPIAFNVVPLAGSLVDD

SEQ ID NO: 813026 - protein, 33 aa, Mycobacterium
FPAPSLLEVRGEVFFLLADFEALNASLVEDGKA

SEQ ID NO: 813027 - protein, 22 aa, Mycobacterium
FPARLARGRGIPPLDRLQYLGE

SEQ ID NO: 813028 - protein, 18 aa, Mycobacterium
FPAVVRPVAAAYGQGQSV

SEQ ID NO: 813029 - protein, 18 aa, Mycobacterium
FPAYLDPIRQSLPGKAID

SEQ ID NO: 813030 - protein, 17 aa, Mycobacterium
FPAYLDPLRQSLPGKAI

SEQ ID NO: 813031 - protein, 17 aa, Mycobacterium
FPAYLDPLRQSLPGRAI

SEQ ID NO: 813032 - protein, 19 aa, Mycobacterium
FPCGEAMISAWLYRPAGAD

SEQ ID NO: 813033 - protein, 17 aa, Mycobacterium
FPCVVFAHGFSGTMDWI

SEQ ID NO: 813034 - protein, 33 aa, Mycobacterium
FPDASFDALTARHFIWTLLEPEKAFAEWRRVLA

SEQ ID NO: 813035 - protein, 26 aa, Mycobacterium
FPDEFRIQLAWLRQSPPDSANPAWSF

SEQ ID NO: 813036 - protein, 20 aa, Mycobacterium
FPDFASLWDDVDALSAPITL

SEQ ID NO: 813037 - protein, 21 aa, Mycobacterium
FPDIAGHYRRRFRHVLVDEYQ

SEQ ID NO: 813038 - protein, 25 aa, Mycobacterium
FPDKTVFPAVFPKLLPGVGPGGTRP

SEQ ID NO: 813039 - protein, 18 aa, Mycobacterium
FPDPDAVAIVLFTSGTTS

SEQ ID NO: 813040 - protein, 18 aa, Mycobacterium
FPDPHLSTLLALMLTYRL

SEQ ID NO: 813041 - protein, 18 aa, Mycobacterium
FPDQWQKLLDDRSKVPAA

SEQ ID NO: 813042 - protein, 29 aa, Mycobacterium
FPDRDAAMKLLYLGLRNISSQRGGFSGTG

SEQ ID NO: 813043 - protein, 17 aa, Mycobacterium
FPDTFWVNPFGMNFRHI

SEQ ID NO: 813044 - protein, 27 aa, Mycobacterium
FPDTSTWPVVFPALPPSPDGGPRRPPQ

SEQ ID NO: 813045 - protein, 24 aa, Mycobacterium
FPEAMPFLIWGYGATRDGSPGIAA

SEQ ID NO: 813046 - protein, 25 aa, Mycobacterium
FPEDTFPVFVALMTNVFDGAAVVEG

SEQ ID NO: 813047 - protein, 30 aa, Mycobacterium
FPEEAERASLLHLLLDDWVGAALVSGYATQ

SEQ ID NO: 813048 - protein, 25 aa, Mycobacterium
FPEETFPVIVALLTNVFDGAAVVQG

SEQ ID NO: 813049 - protein, 18 aa, Mycobacterium
FPEEWTGEVDGHSFYFCE

SEQ ID NO: 813050 - protein, 33 aa, Mycobacterium
FPEFSDLFTAFPSFAGLRPMFDTRLMRLEDEMA

SEQ ID NO: 813051 - protein, 27 aa, Mycobacterium
FPEFSELFAAFPSFAGLRPAFDSRLMK

SEQ ID NO: 813052 - protein, 18 aa, Mycobacterium
FPEGCFQTLLVSASAVER

SEQ ID NO: 813053 - protein, 17 aa, Mycobacterium
FPEGCFQTLLVSSGAVE

SEQ ID NO: 813054 - protein, 34 aa, Mycobacterium
FPEHHPPMQAFLGMPVIIRGAVYGSLYVTDDRPG

SEQ ID NO: 813055 - protein, 27 aa, Mycobacterium
FPEHHPPMRAFLGVPIMIRGTVFGHLY

SEQ ID NO: 813056 - protein, 23 aa, Mycobacterium
FPEIARTLALSGVDLFVVSSANM

SEQ ID NO: 813057 - protein, 18 aa, Mycobacterium
FPELAFTWRHQISALAAA

SEQ ID NO: 813058 - protein, 18 aa, Mycobacterium
FPELLRLRRWCSGTSNRW

SEQ ID NO: 813059 - protein, 21 aa, Mycobacterium
FPELNDLWRSADHLGFEGIWD

SEQ ID NO: 813060 - protein, 21 aa, Mycobacterium
FPEQTNWWPADLGVPSSTGGQ

SEQ ID NO: 813061 - protein, 18 aa, Mycobacterium
FPEVDRVGWFAVGAARTK

SEQ ID NO: 813062 - protein, 27 aa, Mycobacterium
FPFAPMRAEHLWAQPDPLPPVTGLTVA

SEQ ID NO: 813063 - protein, 24 aa, Mycobacterium
FPFGLSVIFPPNLPLPAKVVTEVL

SEQ ID NO: 813064 - protein, 17 aa, Mycobacterium
FPFSLDANAMRATTLTE

SEQ ID NO: 813065 - protein, 22 aa, Mycobacterium
FPGDWRVIRGLTQPQLAAAAGI

SEQ ID NO: 813066 - protein, 18 aa, Mycobacterium
FPGERPLTAYHPRAWQRI

SEQ ID NO: 813067 - protein, 20 aa, Mycobacterium
FPGFFAEYAIADHTLVFSTE

SEQ ID NO: 813068 - protein, 24 aa, Mycobacterium
FPGGPVSLSRWMMRPNPEFDGRTP

SEQ ID NO: 813069 - protein, 25 aa, Mycobacterium
FPGKAAILAVYYRRAADQLSGDLSS

SEQ ID NO: 813070 - protein, 23 aa, Mycobacterium
FPGMGMVERWLLKTQFPETTLAD

SEQ ID NO: 813071 - protein, 17 aa, Mycobacterium
FPGVLEEVVLLLADGYD

SEQ ID NO: 813072 - protein, 17 aa, Mycobacterium
FPGYLDPLRQSLPGKAI

SEQ ID NO: 813073 - protein, 17 aa, Mycobacterium
FPHGGHLINLHVAAGLG

SEQ ID NO: 813074 - protein, 18 aa, Mycobacterium
FPHLSVAANVVFGPFSRR

SEQ ID NO: 813075 - protein, 19 aa, Mycobacterium
FPHLVERLILVAAGGVTKD

SEQ ID NO: 813076 - protein, 19 aa, Mycobacterium
FPHLVERLILVGAGGVTKD

SEQ ID NO: 813077 - protein, 23 aa, Mycobacterium
FPKKQGMRIDFILGSPALAGRVV

SEQ ID NO: 813078 - protein, 25 aa, Mycobacterium
FPKNRGMRIDFILGSPTLAELVTHA

SEQ ID NO: 813079 - protein, 25 aa, Mycobacterium
FPLDGFKKVIGVNLIGTFNVLRLAA

SEQ ID NO: 813080 - protein, 19 aa, Mycobacterium
FPLGLGLVSQFFGRYFTPD

SEQ ID NO: 813081 - protein, 17 aa, Mycobacterium
FPLLSGGERRRVLVARA

SEQ ID NO: 813082 - protein, 43 aa, Mycobacterium
FPLPALACLLRSITLRLTIAPVQRTWPALIALLQSGRLDVDGI

SEQ ID NO: 813083 - protein, 17 aa, Mycobacterium
FPLPRPWSEDDEHQLFQ

SEQ ID NO: 813084 - protein, 17 aa, Mycobacterium
FPMAIRAYRRFVAAGDH

SEQ ID NO: 813085 - protein, 29 aa, Mycobacterium
FPMEMDRYPGRIWVIAHKPVAVAAGMGVM

SEQ ID NO: 813086 - protein, 18 aa, Mycobacterium
FPMRLIGMREARSENSWM

SEQ ID NO: 813087 - protein, 26 aa, Mycobacterium
FPMRPNGQLLPMLPARLVRSGGLLSE

SEQ ID NO: 813088 - protein, 25 aa, Mycobacterium
FPNKEALLVDLLTDVSRRLLEGGMT

SEQ ID NO: 813089 - protein, 17 aa, Mycobacterium
FPPAMVFEHMTIAELAA

SEQ ID NO: 813090 - protein, 21 aa, Mycobacterium
FPPNLGPIWRLERDGMWDELI

SEQ ID NO: 813091 - protein, 18 aa, Mycobacterium
FPPSALLEALLRGYERTG

SEQ ID NO: 813092 - protein, 20 aa, Mycobacterium
FPPVNAIPSRGWFELADVIT

SEQ ID NO: 813093 - protein, 21 aa, Mycobacterium
FPQLTVLSIAPLLANTIRAVF

SEQ ID NO: 813094 - protein, 23 aa, Mycobacterium
FPQRGFERGVGHPAVRELAEEVG

SEQ ID NO: 813095 - protein, 25 aa, Mycobacterium
FPRARTSMLAAYRAGVKIAVGTDAP

SEQ ID NO: 813096 - protein, 17 aa, Mycobacterium
FPRDAVPPLFSALNAEI

SEQ ID NO: 813097 - protein, 20 aa, Mycobacterium
FPREYGGLGLDYAYQRAFNA

SEQ ID NO: 813098 - protein, 18 aa, Mycobacterium
FPREYGGQGLPYEYQRAF

SEQ ID NO: 813099 - protein, 17 aa, Mycobacterium
FPRFLTEVARVLRPNGH

SEQ ID NO: 813100 - protein, 24 aa, Mycobacterium
FPRGSVPELFNALHAKIDFGSLAK

SEQ ID NO: 813101 - protein, 18 aa, Mycobacterium
FPRLYGVQTRFFDDFFVG

SEQ ID NO: 813102 - protein, 17 aa, Mycobacterium
FPRRRSDRFFRVAQHLL

SEQ ID NO: 813103 - protein, 17 aa, Mycobacterium
FPRYHQSVPADLAAEAL

SEQ ID NO: 813104 - protein, 17 aa, Mycobacterium
FPRYPLNILSDLNTLMS

SEQ ID NO: 813105 - protein, 25 aa, Mycobacterium
FPSEPVPFRLVPPPTRWVSDAQTVA

SEQ ID NO: 813106 - protein, 17 aa, Mycobacterium
FPSLAQGIELWPWQRDF

SEQ ID NO: 813107 - protein, 18 aa, Mycobacterium
FPSLSCIVLNGGFRLHPS

SEQ ID NO: 813108 - protein, 22 aa, Mycobacterium
FPSSLIWYERFAGLIKSLVAIK

SEQ ID NO: 813109 - protein, 39 aa, Mycobacterium
FPSSSFDFRSVIPYLAGQAWLTMDFLGFGLSDKPRPHRY

SEQ ID NO: 813110 - protein, 24 aa, Mycobacterium
FPTAQRARRLVYAPDLDGRAGPGE

SEQ ID NO: 813111 - protein, 21 aa, Mycobacterium
FPTEPPGAPLPPYGGGTSPRA

SEQ ID NO: 813112 - protein, 25 aa, Mycobacterium
FPTGQPHHFFMDRFTEAFRTELSSF

SEQ ID NO: 813113 - protein, 18 aa, Mycobacterium
FPTIGDDVFISPMAMVLG

SEQ ID NO: 813114 - protein, 17 aa, Mycobacterium
FPTLASLIEERLSDDPV

SEQ ID NO: 813115 - protein, 28 aa, Mycobacterium
FPTLHDAYRALKAWGLPVSDHTAQVTGL

SEQ ID NO: 813116 - protein, 20 aa, Mycobacterium
FPTLTYATTVAEACERADAV

SEQ ID NO: 813117 - protein, 17 aa, Mycobacterium
FPTPRPTASPPGPTASP

SEQ ID NO: 813118 - protein, 26 aa, Mycobacterium
FPTRHPYGLALWQNEIERILADWVNE

SEQ ID NO: 813119 - protein, 27 aa, Mycobacterium
FPTRHPYGLALWQNQIERILAEWVGEL

SEQ ID NO: 813120 - protein, 23 aa, Mycobacterium
FPTTARLTGRWMRGRIPVVSDFT

SEQ ID NO: 813121 - protein, 18 aa, Mycobacterium
FPVDLRRVYEDWPVVRIW

SEQ ID NO: 813122 - protein, 26 aa, Mycobacterium
FPVENWQVVRLPRIPTRFPMYLSAVK

SEQ ID NO: 813123 - protein, 20 aa, Mycobacterium
FPVPPLAMHLRTGVAMLSYA

SEQ ID NO: 813124 - protein, 26 aa, Mycobacterium
FPVTEFNVALPWTKMVVLNPGVQTES

SEQ ID NO: 813125 - protein, 17 aa, Mycobacterium
FPVTLGIRPNIPQEDLR

SEQ ID NO: 813126 - protein, 36 aa, Mycobacterium
FPVTQWTRWRRPVIGMPATPRFLGHGQLLVATHLGQ

SEQ ID NO: 813127 - protein, 22 aa, Mycobacterium
FPVTVEVVIATAWDSPFEGPTP

SEQ ID NO: 813128 - protein, 20 aa, Mycobacterium
FPVTVGWIHAIRRGQAALHR

SEQ ID NO: 813129 - protein, 18 aa, Mycobacterium
FPVVFVTGWEDGMFPHMR

SEQ ID NO: 813130 - protein, 17 aa, Mycobacterium
FPVWQTQMAVQRRDARA

SEQ ID NO: 813131 - protein, 18 aa, Mycobacterium
FPVYVTTINGAYIQFLFP

SEQ ID NO: 813132 - protein, 20 aa, Mycobacterium
FPYAWPRKPVLAENVVCTSQ

SEQ ID NO: 813133 - protein, 32 aa, Mycobacterium
FPYRYDARLAPMWLPFRWPGRQGVTLTDDGRF

SEQ ID NO: 813134 - protein, 21 aa, Mycobacterium
FPYSQFLPDYGQARAVQIDID

SEQ ID NO: 813135 - protein, 23 aa, Mycobacterium
FQAAFPLKGKPPNVYGFALSKAR

SEQ ID NO: 813136 - protein, 18 aa, Mycobacterium
FQAFEGIAVPKFPNLLTL

SEQ ID NO: 813137 - protein, 18 aa, Mycobacterium
FQAIAIRADLTRPAINHY

SEQ ID NO: 813138 - protein, 17 aa, Mycobacterium
FQAIGSSNWYRADDYPL

SEQ ID NO: 813139 - protein, 18 aa, Mycobacterium
FQALEKYSTDLTARAREG

SEQ ID NO: 813140 - protein, 25 aa, Mycobacterium
FQARCRSIHMIPFDPHLAEGADVDF

SEQ ID NO: 813141 - protein, 24 aa, Mycobacterium
FQARLTLAYALGWQGRGREAEDVL

SEQ ID NO: 813142 - protein, 18 aa, Mycobacterium
FQAVIALGDRIGTATVAA

SEQ ID NO: 813143 - protein, 20 aa, Mycobacterium
FQAVYTRAIAIHEAFVATLA

SEQ ID NO: 813144 - protein, 17 aa, Mycobacterium
FQAWAQGPAIAAHAGER

SEQ ID NO: 813145 - protein, 19 aa, Mycobacterium
FQDGWRGLLENRRIHLHND

SEQ ID NO: 813146 - protein, 36 aa, Mycobacterium
FQDLANAFVALLPQIPPLVQIFTQLIEHVGPQLPKF

SEQ ID NO: 813147 - protein, 18 aa, Mycobacterium
FQDVALPMLQLYMRGVHF

SEQ ID NO: 813148 - protein, 24 aa, Mycobacterium
FQEDALLPWRTALKNVQFPLKLRG

SEQ ID NO: 813149 - protein, 28 aa, Mycobacterium
FQELMPDVLHWLGIRTIHRLVSMSNMKY

SEQ ID NO: 813150 - protein, 21 aa, Mycobacterium
FQEPRLFPWRDVRTNVGYGLT

SEQ ID NO: 813151 - protein, 25 aa, Mycobacterium
FQESATLPWRTVRDNVAFALEVRAV

SEQ ID NO: 813152 - protein, 19 aa, Mycobacterium
FQEYTLVRDDLFTTPVPGP

SEQ ID NO: 813153 - protein, 22 aa, Mycobacterium
FQEYVIIRDDLFSTPIPGEDDQ

SEQ ID NO: 813154 - protein, 20 aa, Mycobacterium
FQFIAPTFAAYHQPGTSRDI

SEQ ID NO: 813155 - protein, 22 aa, Mycobacterium
FQFQVFLDEVRLPADALVGSED

SEQ ID NO: 813156 - protein, 21 aa, Mycobacterium
FQGLIGSIGEKIGLRGFGDVE

SEQ ID NO: 813157 - protein, 24 aa, Mycobacterium
FQGVPTMYSALLRLAATAKPEATR

SEQ ID NO: 813158 - protein, 24 aa, Mycobacterium
FQGWTAVTKHRTPWKADAPPPFDD

SEQ ID NO: 813159 - protein, 20 aa, Mycobacterium
FQHFNLFPHMTAAENVWNAP

SEQ ID NO: 813160 - protein, 26 aa, Mycobacterium
FQHIDDVWLPVFTPSADTTPTPAPVE

SEQ ID NO: 813161 - protein, 19 aa, Mycobacterium
FQHLPVPFELYSDGIDLPV

SEQ ID NO: 813162 - protein, 30 aa, Mycobacterium
FQIIESVPMYRLRRYFPPDSRPGAKTPGAP

SEQ ID NO: 813163 - protein, 23 aa, Mycobacterium
FQIRCVGTLIFGRPRPLSRSRRA

SEQ ID NO: 813164 - protein, 17 aa, Mycobacterium
FQKLFGYSEPHATKLML

SEQ ID NO: 813165 - protein, 21 aa, Mycobacterium
FQLDAFGEALLLLAAAGRLDR

SEQ ID NO: 813166 - protein, 20 aa, Mycobacterium
FQLGTLFAQQLLPDAAAAPS

SEQ ID NO: 813167 - protein, 26 aa, Mycobacterium
FQLHRHLHRIGLPPPGGRAELSQICG

SEQ ID NO: 813168 - protein, 22 aa, Mycobacterium
FQLIAAVAALLAFPAYARNAEL

SEQ ID NO: 813169 - protein, 20 aa, Mycobacterium
FQLRDDLLGVFGPPATTGKP

SEQ ID NO: 813170 - protein, 22 aa, Mycobacterium
FQLRDELAEVLRLAPEAIRVVV

SEQ ID NO: 813171 - protein, 17 aa, Mycobacterium
FQLSFSTLISAFYETAC

SEQ ID NO: 813172 - protein, 18 aa, Mycobacterium
FQLYISLINVLAASARVG

SEQ ID NO: 813173 - protein, 19 aa, Mycobacterium
FQMPPALDRAWHTHGYYGS

SEQ ID NO: 813174 - protein, 19 aa, Mycobacterium
FQMPPALERAWHTHGYYGS

SEQ ID NO: 813175 - protein, 25 aa, Mycobacterium
FQNAWVNPIMWNAFLGWVGVDQYDE

SEQ ID NO: 813176 - protein, 25 aa, Mycobacterium
FQNPSPHIPWDRLPVEVVREARPWG

SEQ ID NO: 813177 - protein, 20 aa, Mycobacterium
FQPFGGYCDGCVLRDGQIVP

SEQ ID NO: 813178 - protein, 18 aa, Mycobacterium
FQPIFDLITGEVIGFEGL

SEQ ID NO: 813179 - protein, 17 aa, Mycobacterium
FQPKYIFAAIDAGCAAV

SEQ ID NO: 813180 - protein, 18 aa, Mycobacterium
FQPKYIFAAIDAGCAAVR

SEQ ID NO: 813181 - protein, 26 aa, Mycobacterium
FQQRVWKALLTIPYGETRSYGEIAEQ

SEQ ID NO: 813182 - protein, 25 aa, Mycobacterium
FQRAPDWVLPRWGAEAPGAVGRLVS

SEQ ID NO: 813183 - protein, 28 aa, Mycobacterium
FQRCANGHPFLYPRLVCPVCHDGELAWE

SEQ ID NO: 813184 - protein, 26 aa, Mycobacterium
FQRDIVVGARLRWSASRADSCAGGGQ

SEQ ID NO: 813185 - protein, 18 aa, Mycobacterium
FQRGPLDEAIRASIAIPG

SEQ ID NO: 813186 - protein, 18 aa, Mycobacterium
FQRISGGRLLLNIVAGGD

SEQ ID NO: 813187 - protein, 18 aa, Mycobacterium
FQRNVFPIYPATKNLESW

SEQ ID NO: 813188 - protein, 26 aa, Mycobacterium
FQRRVWKALLTIPYGETRSYGWIAEQ

SEQ ID NO: 813189 - protein, 28 aa, Mycobacterium
FQRTPIWVGPKFDLEIGPLGRIILGNSR

SEQ ID NO: 813190 - protein, 19 aa, Mycobacterium
FQRTRLPDQLGPDVRMVFY

SEQ ID NO: 813191 - protein, 23 aa, Mycobacterium
FQRVYQRFTDFLRHGNFSFEYCD

SEQ ID NO: 813192 - protein, 26 aa, Mycobacterium
FQSGLSWLIILRKRDNFRAAFDGFDV

SEQ ID NO: 813193 - protein, 27 aa, Mycobacterium
FQSGLSWLIILRKRENFRRAFCGFDIE

SEQ ID NO: 813194 - protein, 26 aa, Mycobacterium
FQSGLSWLIILRKRENFRRAFSGFDI

SEQ ID NO: 813195 - protein, 24 aa, Mycobacterium
FQSRGRHFVAPSPQKRPVLWQAGS

SEQ ID NO: 813196 - protein, 17 aa, Mycobacterium
FQTLWDQAQRLQVVESG

SEQ ID NO: 813197 - protein, 28 aa, Mycobacterium
FQTVFHIHLHVLPRRNGDKLALAKAMVL

SEQ ID NO: 813198 - protein, 18 aa, Mycobacterium
FQVAAAEDLPFADQSFDL

SEQ ID NO: 813199 - protein, 20 aa, Mycobacterium
FQVIELHDCFSANELLLYEA

SEQ ID NO: 813200 - protein, 27 aa, Mycobacterium
FQVLCEAGLLPGALTRNVGLHFVCRDV

SEQ ID NO: 813201 - protein, 29 aa, Mycobacterium
FQVSFAFQNNPLPAIDFPGLGIEVLSAPT

SEQ ID NO: 813202 - protein, 27 aa, Mycobacterium
FQVVSIPTMILFKDGAPVKRIVGAKGK

SEQ ID NO: 813203 - protein, 17 aa, Mycobacterium
FQWVVFTSTNAVRAVWE

SEQ ID NO: 813204 - protein, 25 aa, Mycobacterium
FQYAKTWRTLAKLSLPNKYLRDDAD

SEQ ID NO: 813205 - protein, 21 aa, Mycobacterium
FQYCTAGHPPPLLVGGEGSRY

SEQ ID NO: 813206 - protein, 17 aa, Mycobacterium
FQYLDPKAGYANDPAWI

SEQ ID NO: 813207 - protein, 20 aa, Mycobacterium
FRAAKVLVATGRRPNTDGLN

SEQ ID NO: 813208 - protein, 18 aa, Mycobacterium
FRAASFGGLSAALTVPVP

SEQ ID NO: 813209 - protein, 27 aa, Mycobacterium
FRAENRWWQMLWSGDVWKAIVHLRSTR

SEQ ID NO: 813210 - protein, 30 aa, Mycobacterium; identical to SEQ ID NO: 114530

SEQ ID NO: 813211 - protein, 30 aa, Mycobacterium
FRAGTNLKAWLYRILTNTYINSYRKRQRQP

SEQ ID NO: 813212 - protein, 18 aa, Mycobacterium
FRALPEMAVRWQADTPPD

SEQ ID NO: 813213 - protein, 25 aa, Mycobacterium
FRASERGIISIRHVADRMPPLADAM

SEQ ID NO: 813214 - protein, 22 aa, Mycobacterium
FRATDFLAPMRVRGWGGVTLDE

SEQ ID NO: 813215 - protein, 17 aa, Mycobacterium
FRAVAEELHFGRAAQRL

SEQ ID NO: 813216 - protein, 17 aa, Mycobacterium
FRAVGEELHFGRAAERL

SEQ ID NO: 813217 - protein, 24 aa, Mycobacterium
FRCGQALSAILLECTMAGLATCTV

SEQ ID NO: 813218 - protein, 18 aa, Mycobacterium
FRCLILEFPGFGVSDDFG

SEQ ID NO: 813219 - protein, 24 aa, Mycobacterium
FRCSGAKLHITLPAALPAGSAMTV

SEQ ID NO: 813220 - protein, 26 aa, Mycobacterium
FRDAEKLTFPLLSDPDRKVLTAWGAY

SEQ ID NO: 813221 - protein, 20 aa, Mycobacterium
FRDAGYVVVLFDYRHFGASS

SEQ ID NO: 813222 - protein, 17 aa, Mycobacterium
FRDGLVTPTAGWSAGYA

SEQ ID NO: 813223 - protein, 17 aa, Mycobacterium
FRDLFAEATLRPGDDAG

SEQ ID NO: 813224 - protein, 17 aa, Mycobacterium
FRDRGVFSSGLVGVRLP

SEQ ID NO: 813225 - protein, 21 aa, Mycobacterium
FRDRLAAWLKEQKGRFPTSGD

SEQ ID NO: 813226 - protein, 27 aa, Mycobacterium
FRDSEFYVDWLRPNSIEDGLFVRLTDG

SEQ ID NO: 813227 - protein, 21 aa, Mycobacterium
FRDSPVRVLLVTLADDDHYLA

SEQ ID NO: 813228 - protein, 20 aa, Mycobacterium
FRDSYLTCWQGNDGQAIITA

SEQ ID NO: 813229 - protein, 17 aa, Mycobacterium
FRDVLPLGGWEISYLGP

SEQ ID NO: 813230 - protein, 18 aa, Mycobacterium
FRDVVERWNAESLTLHTT

SEQ ID NO: 813231 - protein, 17 aa, Mycobacterium
FRDWMTEFSRQWGSFLD

SEQ ID NO: 813232 - protein, 26 aa, Mycobacterium
FREDMAALRVLPPHDYVAATDAIAEV

SEQ ID NO: 813233 - protein, 17 aa, Mycobacterium
FREGRLMLAGDAAHLMP

SEQ ID NO: 813234 - protein, 18 aa, Mycobacterium
FREHFLTCFISDKVGVKL

SEQ ID NO: 813235 - protein, 20 aa, Mycobacterium
FREIGVDLMFAHIKESLHEF

SEQ ID NO: 813236 - protein, 21 aa, Mycobacterium
FRELGNPYLPVRWSTDNPDSI

SEQ ID NO: 813237 - protein, 28 aa, Mycobacterium
FRELVGEGKFFYILHFQEPGVADAEFDG

SEQ ID NO: 813238 - protein, 17 aa, Mycobacterium
FREPDGGGFSPPGVTCR

SEQ ID NO: 813239 - protein, 19 aa, Mycobacterium
FREPLPRVMRSLYPIGGVV

SEQ ID NO: 813240 - protein, 23 aa, Mycobacterium
FREQFRRLTGVSPLAYRNTFRAQ

SEQ ID NO: 813241 - protein, 24 aa, Mycobacterium
FREQFRRVAGVPPQSYRHTFRHHG

SEQ ID NO: 813242 - protein, 24 aa, Mycobacterium
FRERVRAFLDEHLPCGWSGPGALA

SEQ ID NO: 813243 - protein, 19 aa, Mycobacterium
FRESQLLNNLWNSGNPPWK

SEQ ID NO: 813244 - protein, 19 aa, Mycobacterium
FRGCEGDALLMLLDANGIE

SEQ ID NO: 813245 - protein, 24 aa, Mycobacterium
FRGDFYRIHDFTLKPKPVDVPGRP

SEQ ID NO: 813246 - protein, 26 aa, Mycobacterium
FRGDMTALRVLPPREYVRATESIACI

SEQ ID NO: 813247 - protein, 22 aa, Mycobacterium
FRGDPSLLAPGLRQLAELTGRP

SEQ ID NO: 813248 - protein, 27 aa, Mycobacterium
FRGDRDVVLVFFPLAFTGICQRELDEI

SEQ ID NO: 813249 - protein, 17 aa, Mycobacterium
FRGGWFHTGDLGRIDAD

SEQ ID NO: 813250 - protein, 23 aa, Mycobacterium
FRGHDYTSMLRRVAAQLPSRPEV

SEQ ID NO: 813251 - protein, 25 aa, Mycobacterium
FRGQDARVLLPPTSSVYIASRRLAR

SEQ ID NO: 813252 - protein, 21 aa, Mycobacterium
FRGREIVLTLFEKISGLRMNS

SEQ ID NO: 813253 - protein, 27 aa, Mycobacterium
FRGVNVPGFPNLFLLAGPGSGTNALAG

SEQ ID NO: 813254 - protein, 23 aa, Mycobacterium
FRGYDLALTTHLQPAYPPHFDST

SEQ ID NO: 813255 - protein, 20 aa, Mycobacterium
FRGYSLFMKGKDPRDAHFIT

SEQ ID NO: 813256 - protein, 28 aa, Mycobacterium
FRHGLQLHGAMGFTWENDLQFALKRAKA

SEQ ID NO: 813257 - protein, 25 aa, Mycobacterium
FRHQTCLELFDALQKFRLDREVRAA

SEQ ID NO: 813258 - protein, 18 aa, Mycobacterium
FRHRGVIAVFHEAALAMF

SEQ ID NO: 813259 - protein, 24 aa, Mycobacterium
FRHTFDWCVTSAFIMSQLAAPHMI

SEQ ID NO: 813260 - protein, 20 aa, Mycobacterium
FRHWMEGPALPPPGVGFAPP

SEQ ID NO: 813261 - protein, 22 aa, Mycobacterium
FRIDDYTRWRLLEGLDDIGLTL

SEQ ID NO: 813262 - protein, 18 aa, Mycobacterium
FRIGKLPSALRAEVEAEG

SEQ ID NO: 813263 - protein, 18 aa, Mycobacterium
FRKTWLQMGRIELIPKKG

SEQ ID NO: 813264 - protein, 25 aa, Mycobacterium
FRLADVAVPVRWWHGDADSIISLAD

SEQ ID NO: 813265 - protein, 17 aa, Mycobacterium
FRLAGVLHSAMVLADEI

SEQ ID NO: 813266 - protein, 24 aa, Mycobacterium
FRLDNAVLAFRFTATVIDRAGAAT

SEQ ID NO: 813267 - protein, 28 aa, Mycobacterium
FRLEDSINTYYFWMNTQQAPFNDVRVRQ

SEQ ID NO: 813268 - protein, 18 aa, Mycobacterium
FRLFRPDLENPGPDDFAP

SEQ ID NO: 813269 - protein, 21 aa, Mycobacterium
FRLIAAVAAALAFPAYARNAE

SEQ ID NO: 813270 - protein, 18 aa, Mycobacterium
FRLLSQPCAIDDYSDLRP

SEQ ID NO: 813271 - protein, 30 aa, Mycobacterium
FRLRAGLIHDWFTFPFLPDAHEDRAGVYSD

SEQ ID NO: 813272 - protein, 26 aa, Mycobacterium
FRLSKTPVPPPLPAPALRTNGAQAKW

SEQ ID NO: 813273 - protein, 22 aa, Mycobacterium
FRLTGRLFRRRPQESQILLVNG

SEQ ID NO: 813274 - protein, 24 aa, Mycobacterium
FRLVRSPIRIAGYTPEYRPAPTLD

SEQ ID NO: 813275 - protein, 20 aa, Mycobacterium
FRLWVCLHEVAHRVQFTANP

SEQ ID NO: 813276 - protein, 17 aa, Mycobacterium
FRMLSDPTRIKVLWALS

SEQ ID NO: 813277 - protein, 19 aa, Mycobacterium
FRMRSICDRIAGFPAPVVA

SEQ ID NO: 813278 - protein, 18 aa, Mycobacterium
FRNMIAQYVLGLGKPNYS

SEQ ID NO: 813279 - protein, 22 aa, Mycobacterium
FRPFQPSPFRSYYSLARNPAED

SEQ ID NO: 813280 - protein, 20 aa, Mycobacterium
FRPGTLEKWDLGYDVLRERN

SEQ ID NO: 813281 - protein, 19 aa, Mycobacterium
FRPGTLEKWDLGYDVLRQH

SEQ ID NO: 813282 - protein, 21 aa, Mycobacterium
FRPGTLEKWNLGYDVLRERNR

SEQ ID NO: 813283 - protein, 25 aa, Mycobacterium
FRPLVRRLSRFLPSDVRVIDIVRAP

SEQ ID NO: 813284 - protein, 38 aa, Mycobacterium
FRPREYWRGPVWPVLTWLFCWAFERRGWSERAFLLRQE

SEQ ID NO: 813285 - protein, 36 aa, Mycobacterium
FRPREYWRGPVWPVMTWLFAWCFARRGWAERSATLR

SEQ ID NO: 813286 - protein, 24 aa, Mycobacterium
FRPRKFVHALPHNGLHGSMGHAGP

SEQ ID NO: 813287 - protein, 19 aa, Mycobacterium
FRPRYKIWDNRLCLILDGD

SEQ ID NO: 813288 - protein, 21 aa, Mycobacterium
FRQLDPSTQIWWGAYLGTEHE

SEQ ID NO: 813289 - protein, 18 aa, Mycobacterium
FRQLLAGRDFAVNDMIAA

SEQ ID NO: 813290 - protein, 18 aa, Mycobacterium
FRQLLSGRDFAAGDMIAQ

SEQ ID NO: 813291 - protein, 18 aa, Mycobacterium
FRQLLSGRDFAVGDMIAA

SEQ ID NO: 813292 - protein, 25 aa, Mycobacterium
FRQPSHPYRMRPARLRPPQRAPRLG

SEQ ID NO: 813293 - protein, 25 aa, Mycobacterium
FRQQDAQVLLPPTTSVHIASRRLAR

SEQ ID NO: 813294 - protein, 19 aa, Mycobacterium
FRQQEARLLLPPTSSAHIA

SEQ ID NO: 813295 - protein, 17 aa, Mycobacterium
FRQVFMAGASGMTLERR

SEQ ID NO: 813296 - protein, 17 aa, Mycobacterium
FRQWQGQQSADKADWLI

SEQ ID NO: 813297 - protein, 21 aa, Mycobacterium
FRRAFSWLPAQFASQSDAPVG

SEQ ID NO: 813298 - protein, 22 aa, Mycobacterium
FRRAFSWLPAQFASQSDAPVGA

SEQ ID NO: 813299 - protein, 23 aa, Mycobacterium
FRRAFSWLPSQFASQSDAPVGAP

SEQ ID NO: 813300 - protein, 20 aa, Mycobacterium
FRRAFSWLPSQSDSPVGPRQ

SEQ ID NO: 813301 - protein, 22 aa, Mycobacterium
FRRAFSWLPTQFASQSDAPVGA

SEQ ID NO: 813302 - protein, 27 aa, Mycobacterium
FRRAGLPPLTVPLSVILLGGLRELTAL

SEQ ID NO: 813303 - protein, 18 aa, Mycobacterium
FRRFVVGKQVMLAASFLK

SEQ ID NO: 813304 - protein, 18 aa, Mycobacterium
FRRGDAVMGLFPNNAFAA

SEQ ID NO: 813305 - protein, 17 aa, Mycobacterium
FRRIDGAAIDSLLGPEM

SEQ ID NO: 813306 - protein, 19 aa, Mycobacterium
FRRLVAEAKALWRSENHRG

SEQ ID NO: 813307 - protein, 18 aa, Mycobacterium
FRRMLSKPFTFKRVEGLR

SEQ ID NO: 813308 - protein, 22 aa, Mycobacterium
FRRNDFQLPFEPAASPRGFRSG

SEQ ID NO: 813309 - protein, 20 aa, Mycobacterium
FRRNSCCLYYRLPGAGKCGD

SEQ ID NO: 813310 - protein, 20 aa, Mycobacterium
FRRNTLARFELFMEGTRRPE

SEQ ID NO: 813311 - protein, 29 aa, Mycobacterium
FRRRIGEKGWFGLNWPREYGGLGLGAVHQ

SEQ ID NO: 813312 - protein, 18 aa, Mycobacterium
FRRTWLHVGRVERLPKTG

SEQ ID NO: 813313 - protein, 24 aa, Mycobacterium
FRRVHPPHRVLIDLVALFPREAHC

SEQ ID NO: 813314 - protein, 19 aa, Mycobacterium
FRSAYGESPYSYLMTRRIE

SEQ ID NO: 813315 - protein, 26 aa, Mycobacterium
FRSDALQIIAFGRYARTVSAAELTAL

SEQ ID NO: 813316 - protein, 25 aa, Mycobacterium
FRSDALQIVAFGRYARTVTAAELTG

SEQ ID NO: 813317 - protein, 26 aa, Mycobacterium
FRSGRPMITETLRYPIQAFTDVGQRP

SEQ ID NO: 813318 - protein, 20 aa, Mycobacterium
FRSGWINGVVALPANYHGSG

SEQ ID NO: 813319 - protein, 18 aa, Mycobacterium
FRSRALPSTFATWRERRK

SEQ ID NO: 813320 - protein, 32 aa, Mycobacterium
FRSRALPSTFATWRERRRLIKVLRKRGRILQS

SEQ ID NO: 813321 - protein, 25 aa, Mycobacterium
FRSSNFMMWQSAYAEFVFQEKMYPD

SEQ ID NO: 813322 - protein, 21 aa, Mycobacterium
FRTAGLPSPLPYLTGVRDRDW

SEQ ID NO: 813323 - protein, 17 aa, Mycobacterium
FRTIFEPWERHPDMLRA

SEQ ID NO: 813324 - protein, 21 aa, Mycobacterium
FRTIVLGDDNLPYVAQKRLLR

SEQ ID NO: 813325 - protein, 18 aa, Mycobacterium
FRTPLTLILDPVSELRRA

SEQ ID NO: 813326 - protein, 17 aa, Mycobacterium
FRTTAKPVLTAVNGICC

SEQ ID NO: 813327 - protein, 23 aa, Mycobacterium
FRTYPFEEAFFSALARQFRAAMS

SEQ ID NO: 813328 - protein, 26 aa, Mycobacterium
FRVDKHSNLHLIIGKASFDAEKLTEN

SEQ ID NO: 813329 - protein, 27 aa, Mycobacterium
FRVDKQANLHFIIGKASFDETKLAENY

SEQ ID NO: 813330 - protein, 34 aa, Mycobacterium
FRVEDTVHLSILQFAKFPLWKDLDESWEALSRNP

SEQ ID NO: 813331 - protein, 33 aa, Mycobacterium
FRVHNPLDLAPVAPLPVLVAALGPVMLTLAGER

SEQ ID NO: 813332 - protein, 18 aa, Mycobacterium
FRVIVPYARGFGSTRFLS

SEQ ID NO: 813333 - protein, 17 aa, Mycobacterium
FRVLQWRSQETNTKLRA

SEQ ID NO: 813334 - protein, 19 aa, Mycobacterium
FRVSFDAAPARRLAPVSAH

SEQ ID NO: 813335 - protein, 21 aa, Mycobacterium
FRVSRGGWYGLDPVAADLFTF

SEQ ID NO: 813336 - protein, 19 aa, Mycobacterium
FRVVRTPEDWLFKAYTADD

SEQ ID NO: 813337 - protein, 21 aa, Mycobacterium
FRWIRVHLLRRWCRGYPALPH

SEQ ID NO: 813338 - protein, 25 aa, Mycobacterium
FRWQHLPVPFEVYADGISLVVFEEF

SEQ ID NO: 813339 - protein, 18 aa, Mycobacterium
FRYFAGCIRAQEGSLSEV

SEQ ID NO: 813340 - protein, 24 aa, Mycobacterium
FSAAAVWRIRRAAPMLPTVLLGET

SEQ ID NO: 813341 - protein, 27 aa, Mycobacterium
FSAAAVWRIRRAAPMLPTVLLGETSRY

SEQ ID NO: 813342 - protein, 28 aa, Mycobacterium
FSAAAVWRIRRVAPLLPTVLLGRTGRYL

SEQ ID NO: 813343 - protein, 23 aa, Mycobacterium
FSAAAVWRVRRAAPLLPTVLLGK

SEQ ID NO: 813344 - protein, 23 aa, Mycobacterium
FSAAQLLEILDAVRGLAGVGVVE

SEQ ID NO: 813345 - protein, 25 aa, Mycobacterium
FSAAWTDLVALMKVGLRGGKIVVVR

SEQ ID NO: 813346 - protein, 24 aa, Mycobacterium
FSAGAVWRIRRAAPMLPTVLLGET

SEQ ID NO: 813347 - protein, 17 aa, Mycobacterium
FSAGGPVLWPDLEAILV

SEQ ID NO: 813348 - protein, 17 aa, Mycobacterium
FSALFNTILINVTAFFR

SEQ ID NO: 813349 - protein, 17 aa, Mycobacterium
FSALLSNAKTIFWNGPM

SEQ ID NO: 813350 - protein, 31 aa, Mycobacterium
FSALQHLFNKEAPFVFLYQADTIVISNDKVR

SEQ ID NO: 813351 - protein, 19 aa, Mycobacterium
FSALRRHYVYRLSTAPWGV

SEQ ID NO: 813352 - protein, 24 aa, Mycobacterium
FSALRRHYVYRLTTAPYGPEPHET

SEQ ID NO: 813353 - protein, 17 aa, Mycobacterium
FSALTRLDHNRAISQLA

SEQ ID NO: 813354 - protein, 32 aa, Mycobacterium
FSAPQLPGLPDLFPVNFMIKPSLMAIGEAFYR

SEQ ID NO: 813355 - protein, 24 aa, Mycobacterium
FSARVQESLLADDRIRHLRGRVAH

SEQ ID NO: 813356 - protein, 32 aa, Mycobacterium
FSASRFLSDIRYFGATFFTYVGKALAYLMATP

SEQ ID NO: 813357 - protein, 17 aa, Mycobacterium
FSAVIPPNLPLPTKIVT

SEQ ID NO: 813358 - protein, 25 aa, Mycobacterium
FSDDEYLRCWLAERGAQFPVWAGHY

SEQ ID NO: 813359 - protein, 17 aa, Mycobacterium
FSDDRWELYDLSQDYSQ

SEQ ID NO: 813360 - protein, 27 aa, Mycobacterium
FSDEFRIQLAWMRQSPPDTPNPGWLYA

SEQ ID NO: 813361 - protein, 18 aa, Mycobacterium
FSDELLADLALSCALWVG

SEQ ID NO: 813362 - protein, 19 aa, Mycobacterium
FSDELLADLALSCALWVGM

SEQ ID NO: 813363 - protein, 26 aa, Mycobacterium
FSDESLLPNPYPYFDHLRSKSPVLRL

SEQ ID NO: 813364 - protein, 23 aa, Mycobacterium
FSDIAPDLIALLRGRTLVAHNVG

SEQ ID NO: 813365 - protein, 26 aa, Mycobacterium
FSDPETFKLYLTTRPFLEFHVRQRVQ

SEQ ID NO: 813366 - protein, 36 aa, Mycobacterium
FSDQLLAMAKLAQDIPLSVMFPMVTTLDELFAARRL

SEQ ID NO: 813367 - protein, 19 aa, Mycobacterium
FSDQPDYVDSWPVHCVAGS

SEQ ID NO: 813368 - protein, 18 aa, Mycobacterium
FSDRLAAGTWLREYLRGL

SEQ ID NO: 813369 - protein, 25 aa, Mycobacterium
FSDTAFRIFVLMATRRLKSDRFYTV

SEQ ID NO: 813370 - protein, 28 aa, Mycobacterium
FSDTVVARFLPYPFTAGSLVIEHPAGTI

SEQ ID NO: 813371 - protein, 29 aa, Mycobacterium
FSEADYLAVMRILQRFYNIILTDCGTGLM

SEQ ID NO: 813372 - protein, 17 aa, Mycobacterium
FSEDYLVASLAALERWV

SEQ ID NO: 813373 - protein, 19 aa, Mycobacterium
FSEELLADLALSCALWVGM

SEQ ID NO: 813374 - protein, 25 aa, Mycobacterium
FSEHHAFMSRLFLDRIDAHTADIGR

SEQ ID NO: 813375 - protein, 42 aa, Mycobacterium
FSEHYIAEYLARHGYGFLGWNTRFRGFESQFLLDHALVDIGV

SEQ ID NO: 813376 - protein, 21 aa, Mycobacterium
FSEIAFPKPLFHGDTLYAETE

SEQ ID NO: 813377 - protein, 26 aa, Mycobacterium
FSEKQPIAALARLYPNYTQVIARTDA

SEQ ID NO: 813378 - protein, 49 aa, Mycobacterium
FSELEPDFQRAYKELARQVRLPGFRPGKAPAKLLEARFGREAMLDQVVT

SEQ ID NO: 813379 - protein, 24 aa, Mycobacterium
FSELIRVPFADYNLAPLPAGVDPV

SEQ ID NO: 813380 - protein, 18 aa, Mycobacterium
FSEPEVFDFPEGIGPVEC

SEQ ID NO: 813381 - protein, 24 aa, Mycobacterium
FSEQLLPEHLHKVSLSFLVDDLVV

SEQ ID NO: 813382 - protein, 24 aa, Mycobacterium
FSESFVPPVLAAPAGPSGGRITFG

SEQ ID NO: 813383 - protein, 26 aa, Mycobacterium
FSFGDYFKREAIELAWTLLTNGVSEG

SEQ ID NO: 813384 - protein, 33 aa, Mycobacterium
FSFGDYFKREAIRLAWTLLTNPVSEGGYGFDPE

SEQ ID NO: 813385 - protein, 21 aa, Mycobacterium
FSFGDYFKRGAIELAWSLLTN

SEQ ID NO: 813386 - protein, 24 aa, Mycobacterium
FSFGDYFKRGAIELAWTLLTNPVE

SEQ ID NO: 813387 - protein, 32 aa, Mycobacterium
FSFGDYFKRRAIELAWTLLTNSVEQGGYGLDP

SEQ ID NO: 813388 - protein, 18 aa, Mycobacterium
FSFGDYYDPANTHHGLLL

SEQ ID NO: 813389 - protein, 26 aa, Mycobacterium
FSGAPESMGIWWWNARHSGPEQAVGQ

SEQ ID NO: 813390 - protein, 28 aa, Mycobacterium
FSGDTLYRRFMTPRLPTPALMHYLSEVD

SEQ ID NO: 813391 - protein, 18 aa, Mycobacterium
FSGFPSFAGIRSMFDTRL

SEQ ID NO: 813392 - protein, 19 aa, Mycobacterium
FSGHALDYQALSTQMAGFH

SEQ ID NO: 813393 - protein, 20 aa, Mycobacterium
FSGHALDYQALSTQVAAFHT

SEQ ID NO: 813394 - protein, 28 aa, Mycobacterium
FSGKKALLLGGTLYRGGVQATPPGWRTD

SEQ ID NO: 813395 - protein, 27 aa, Mycobacterium
FSGLTGQLCAVAFLLTGRETGRLAADL

SEQ ID NO: 813396 - protein, 22 aa, Mycobacterium
FSGLYMLHRLRQAGIRARVLEM

SEQ ID NO: 813397 - protein, 26 aa, Mycobacterium
FSGRILNTHPALLPAFPGAHGVADAL

SEQ ID NO: 813398 - protein, 34 aa, Mycobacterium
FSGRIYDYHREYPHYLRLLLWEGLDRNPLDGNPP

SEQ ID NO: 813399 - protein, 27 aa, Mycobacterium
FSGRQKLLAIWIIGDTPNAFYSCVDLQ

SEQ ID NO: 813400 - protein, 29 aa, Mycobacterium
FSGTCPAWVYFWLGAARIGAVSAAVNAAN

SEQ ID NO: 813401 - protein, 18 aa, Mycobacterium
FSGTLFRLEEDESWFEGM

SEQ ID NO: 813402 - protein, 25 aa, Mycobacterium
FSGVQPRWITPRWDAAHHFSHPPSP

SEQ ID NO: 813403 - protein, 29 aa, Mycobacterium
FSGYPHLEELFWFGEGVVPILRKRGLFDA

SEQ ID NO: 813404 - protein, 33 aa, Mycobacterium
FSGYPIAASLTRLLGCPVFVDHRARLQVLGDRW

SEQ ID NO: 813405 - protein, 18 aa, Mycobacterium
FSGYRFVRHAAALGRPVA

SEQ ID NO: 813406 - protein, 18 aa, Mycobacterium
FSHCLLLAEGHVVASGLL

SEQ ID NO: 813407 - protein, 18 aa, Mycobacterium
FSHCLLLAEGQVVAAGLL

SEQ ID NO: 813408 - protein, 19 aa, Mycobacterium
FSHFAFAHSLPFDIDRHGG

SEQ ID NO: 813409 - protein, 26 aa, Mycobacterium
FSHPGLDRILQWDLRYGAEVVATLAS

SEQ ID NO: 813410 - protein, 19 aa, Mycobacterium
FSHPQTVRRLLTTVYQRTA

SEQ ID NO: 813411 - protein, 24 aa, Mycobacterium
FSIVNGLCFCGIAHHLMLNNAVAE

SEQ ID NO: 813412 - protein, 20 aa, Mycobacterium
FSKIIYPPYTERAFKLARKL

SEQ ID NO: 813413 - protein, 22 aa, Mycobacterium
FSKQIISSIKWAPNETGIIPTS

SEQ ID NO: 813414 - protein, 25 aa, Mycobacterium
FSLDGNLLRWQNWSLRVGFNHREGM

SEQ ID NO: 813415 - protein, 25 aa, Mycobacterium
FSLDRKNVREHIAFGRGVHSCPGGP

SEQ ID NO: 813416 - protein, 18 aa, Mycobacterium
FSLDYRLAPEHPFPAAAD

SEQ ID NO: 813417 - protein, 19 aa, Mycobacterium
FSLGHFPQSFEYATIGGFA

SEQ ID NO: 813418 - protein, 29 aa, Mycobacterium
FSLGHFPQSFLFATIGGFAATRSSGQSSA

SEQ ID NO: 813419 - protein, 17 aa, Mycobacterium
FSLMAAAVAWDALAAEL

SEQ ID NO: 813420 - protein, 29 aa, Mycobacterium
FSLPPHELEFFFFVLAFAGSDTTKNALAI

SEQ ID NO: 813421 - protein, 17 aa, Mycobacterium
FSLQPAAMFALPICRRP

SEQ ID NO: 813422 - protein, 23 aa, Mycobacterium
FSLTERHVIFYDLPVTFDTRRAV

SEQ ID NO: 813423 - protein, 17 aa, Mycobacterium
FSLTVPRRDGGERRLYL

SEQ ID NO: 813424 - protein, 17 aa, Mycobacterium
FSLVELPVKLPRETLKK

SEQ ID NO: 813425 - protein, 17 aa, Mycobacterium
FSLVRFDGDRQRADAVY

SEQ ID NO: 813426 - protein, 20 aa, Mycobacterium
FSMALGEHLAYGPQAVRARL

SEQ ID NO: 813427 - protein, 20 aa, Mycobacterium
FSMAYYLQPDELGLAEPHLI

SEQ ID NO: 813428 - protein, 19 aa, Mycobacterium
FSMGGGEVAAYCARKGVER

SEQ ID NO: 813429 - protein, 19 aa, Mycobacterium
FSMLYAFSENFVLPISHDE

SEQ ID NO: 813430 - protein, 36 aa, Mycobacterium
FSMPAVWLRLNQVDPGHLWWIRSQLRSLLVEDVRAR

SEQ ID NO: 813431 - protein, 27 aa, Mycobacterium
FSMVMENRWLPMKRTALALNHLVCTRF

SEQ ID NO: 813432 - protein, 24 aa, Mycobacterium
FSNAAVELALAGYPGFHVTTPPKD

SEQ ID NO: 813433 - protein, 19 aa, Mycobacterium
FSPAFYEKFGYDRPVYTLG

SEQ ID NO: 813434 - protein, 17 aa, Mycobacterium
FSPAFYERFGYDRPVYT

SEQ ID NO: 813435 - protein, 26 aa, Mycobacterium
FSPDHYNGFFYKAMPPFCIGMHANGV

SEQ ID NO: 813436 - protein, 17 aa, Mycobacterium
FSPLRHWNAGPGKRIAV

SEQ ID NO: 813437 - protein, 27 aa, Mycobacterium
FSPVKSVSALWAIAPLPVAEQIEAAHD

SEQ ID NO: 813438 - protein, 19 aa, Mycobacterium
FSPWLLPTVAVGRRGKART

SEQ ID NO: 813439 - protein, 27 aa, Mycobacterium
FSRACEALYHFAWDEFCDWYVELAKTQ

SEQ ID NO: 813440 - protein, 23 aa, Mycobacterium
FSREDLLKRVWRWDFGDLSTVTV

SEQ ID NO: 813441 - protein, 20 aa, Mycobacterium
FSRFADPRFLGPLGIAHRAS

SEQ ID NO: 813442 - protein, 21 aa, Mycobacterium
FSRFLQEKIGLVYPINKHLTA

SEQ ID NO: 813443 - protein, 19 aa, Mycobacterium
FSRHFGVFREAQAGAGVVF

SEQ ID NO: 813444 - protein, 19 aa, Mycobacterium
FSRLGIRTSLRYKIPPMPF

SEQ ID NO: 813445 - protein, 20 aa, Mycobacterium
FSRLSPPWQPMRLVTEARSL

SEQ ID NO: 813446 - protein, 19 aa, Mycobacterium
FSRPWVTVTLHGAAVRPVG

SEQ ID NO: 813447 - protein, 22 aa, Mycobacterium
FSRSDVFPIRQFADGIAHTLRR

SEQ ID NO: 813448 - protein, 30 aa, Mycobacterium
FSRTEPAVFVWLGVIFYLTPDAAGSTLDYI

SEQ ID NO: 813449 - protein, 23 aa, Mycobacterium
FSRYAQAYQVLGADMAAIHDQFV

SEQ ID NO: 813450 - protein, 19 aa, Mycobacterium
FSSAILPAWARKSPQMSEV

SEQ ID NO: 813451 - protein, 17 aa, Mycobacterium
FSSFYFDTALSSSAAAL

SEQ ID NO: 813452 - protein, 17 aa, Mycobacterium
FSSKLELYLAVLNRHVD

SEQ ID NO: 813453 - protein, 24 aa, Mycobacterium
FSSLDHYMWRLTSGRARRPHPKKP

SEQ ID NO: 813454 - protein, 29 aa, Mycobacterium
FSSLPGGLNRYFTDLFTALRTRGDIELSA

SEQ ID NO: 813455 - protein, 26 aa, Mycobacterium
FSSNNRPFLPPPAPRALLAVLNGPPP

SEQ ID NO: 813456 - protein, 21 aa, Mycobacterium
FSSRYLPYQFGDGEPITVGSM

SEQ ID NO: 813457 - protein, 25 aa, Mycobacterium
FSSTLGLTMTLLDRTRLRTGCRNCV

SEQ ID NO: 813458 - protein, 25 aa, Mycobacterium
FSTAAPFDRRLLLETLDALPPGAGV

SEQ ID NO: 813459 - protein, 26 aa, Mycobacterium
FSTFNSTPALLIYTEGRLDVVLAVSI

SEQ ID NO: 813460 - protein, 23 aa, Mycobacterium
FSTFQYQLSRKRPAYMRKTLMTM

SEQ ID NO: 813461 - protein, 18 aa, Mycobacterium
FSTGRYWKVVNPSKLNEF

SEQ ID NO: 813462 - protein, 17 aa, Mycobacterium
FSTLRVGLLQELPGYKG

SEQ ID NO: 813463 - protein, 28 aa, Mycobacterium
FSTNTFPSWPLAHPYRRVAHNGEINTVA

SEQ ID NO: 813464 - protein, 24 aa, Mycobacterium
FSTPLGLLARRIAFDDPLTGERRE

SEQ ID NO: 813465 - protein, 17 aa, Mycobacterium
FSTRAESRWFASQGFTL

SEQ ID NO: 813466 - protein, 18 aa, Mycobacterium
FSTRAESRWYASQGFTLV

SEQ ID NO: 813467 - protein, 27 aa, Mycobacterium
FSTSPYIRQIFLYGSSEQPFLLAVIVP

SEQ ID NO: 813468 - protein, 24 aa, Mycobacterium
FSTVRWHNLHVIAAALLQNLALIR

SEQ ID NO: 813469 - protein, 20 aa, Mycobacterium
FSVFCNHVMIVPPIKAILES

SEQ ID NO: 813470 - protein, 18 aa, Mycobacterium
FSVFGTAFTQRLVTQMYF

SEQ ID NO: 813471 - protein, 18 aa, Mycobacterium
FSVGHAVDWNLAATVGGK

SEQ ID NO: 813472 - protein, 19 aa, Mycobacterium
FSVLHQPGVGEYLAPGLPA

SEQ ID NO: 813473 - protein, 20 aa, Mycobacterium
FSVLQAMLMIASAGKFEHLI

SEQ ID NO: 813474 - protein, 19 aa, Mycobacterium
FSVTFMREHALLKKLLRTE

SEQ ID NO: 813475 - protein, 27 aa, Mycobacterium
FSVWRKIAMATWRPRKDPIIWATAEID

SEQ ID NO: 813476 - protein, 18 aa, Mycobacterium
FSWAHIAEMTLQIYQKVC

SEQ ID NO: 813477 - protein, 20 aa, Mycobacterium
FSYGNLLLARLRDLGTASTE

SEQ ID NO: 813478 - protein, 25 aa, Mycobacterium
FTAADRAVGWWYPAASALARQDSQA

SEQ ID NO: 813479 - protein, 25 aa, Mycobacterium
FTADGLPLGVQILGKPFAEPEILTF

SEQ ID NO: 813480 - protein, 26 aa, Mycobacterium
FTAEFLGDCVLLPCTVTGGVATSALG

SEQ ID NO: 813481 - protein, 29 aa, Mycobacterium
FTAEHPFHRFLARALVLDSVLGSASELPS

SEQ ID NO: 813482 - protein, 25 aa, Mycobacterium
FTAFAAKLAERVGCRRADDGRIRVG

SEQ ID NO: 813483 - protein, 27 aa, Mycobacterium
FTAHFDRLYTRLARPYDLAVKLLPVWR

SEQ ID NO: 813484 - protein, 18 aa, Mycobacterium
FTAIRQWAKQFYPEAFVS

SEQ ID NO: 813485 - protein, 19 aa, Mycobacterium
FTALAARFLGPTLDGVRPV

SEQ ID NO: 813486 - protein, 18 aa, Mycobacterium
FTALDWVSDRLSAQRYLL

SEQ ID NO: 813487 - protein, 28 aa, Mycobacterium
FTAMAWTIVKLTTLHRTIKPELLTRPNV

SEQ ID NO: 813488 - protein, 22 aa, Mycobacterium
FTANPWLAGYMQEALGLLTREP

SEQ ID NO: 813489 - protein, 17 aa, Mycobacterium
FTAPLIPVRPDLPDVLL

SEQ ID NO: 813490 - protein, 27 aa, Mycobacterium
FTAQRKGFDPGYAARLITRFGLDDLAD

SEQ ID NO: 813491 - protein, 18 aa, Mycobacterium
FTARPCIVAIPPGGRTRE

SEQ ID NO: 813492 - protein, 29 aa, Mycobacterium
FTATCPEWVYFWLGAARIGAVSAAINAAN

SEQ ID NO: 813493 - protein, 17 aa, Mycobacterium
FTATMILQAVDRGLLSL

SEQ ID NO: 813494 - protein, 17 aa, Mycobacterium
FTATRTSIFRKADDGSS

SEQ ID NO: 813495 - protein, 17 aa, Mycobacterium
FTAVRDSIWYDPYTVTD

SEQ ID NO: 813496 - protein, 17 aa, Mycobacterium
FTAWATVFERTSDRIRA

SEQ ID NO: 813497 - protein, 19 aa, Mycobacterium
FTAYKLLIADVVGGDLKAV

SEQ ID NO: 813498 - protein, 20 aa, Mycobacterium
FTCGALSMFARYLGEVQLPQ

SEQ ID NO: 813499 - protein, 19 aa, Mycobacterium
FTCWRIKLPHLDAAKFDAA

SEQ ID NO: 813500 - protein, 20 aa, Mycobacterium
FTDDGLLFVDGRDDDMIVSG

SEQ ID NO: 813501 - protein, 17 aa, Mycobacterium
FTDLFRKGLRGLAPDGT

SEQ ID NO: 813502 - protein, 17 aa, Mycobacterium
FTDLLAQVRQRSLAAYE

SEQ ID NO: 813503 - protein, 17 aa, Mycobacterium
FTDLWVYPDAPGEFCDT

SEQ ID NO: 813504 - protein, 19 aa, Mycobacterium
FTDPALIRNFCIIAHIDHG

SEQ ID NO: 813505 - protein, 21 aa, Mycobacterium
FTDPDIYARRLPVDELAELRR

SEQ ID NO: 813506 - protein, 30 aa, Mycobacterium
FTDPSLVPDPYPYFDYLRSRNPVLRLPHHG

SEQ ID NO: 813507 - protein, 19 aa, Mycobacterium
FTDVLIKWMSRLNTWMYRR

SEQ ID NO: 813508 - protein, 29 aa, Mycobacterium
FTEAVINEAMRLYPPAWSIERDAVEADDI

SEQ ID NO: 813509 - protein, 25 aa, Mycobacterium
FTECRLRPLTLVEVDFTLAVLAGVD

SEQ ID NO: 813510 - protein, 22 aa, Mycobacterium
FTEELVMWWNFVGRNHDEIVTY

SEQ ID NO: 813511 - protein, 22 aa, Mycobacterium
FTEELVMWWNFVGRSHDDIVAY

SEQ ID NO: 813512 - protein, 19 aa, Mycobacterium
FTEGLQLMKAAWSDDPRVT

SEQ ID NO: 813513 - protein, 18 aa, Mycobacterium
FTEHVVPILVRRGLFRAE

SEQ ID NO: 813514 - protein, 20 aa, Mycobacterium
FTEIADLSHAGFPLAEVYED

SEQ ID NO: 813515 - protein, 24 aa, Mycobacterium
FTEKDFLPAIRAAGANLAHLVVVD

SEQ ID NO: 813516 - protein, 30 aa, Mycobacterium
FTEKERYSMDWYYPILGSALRGPAADARIK

SEQ ID NO: 813517 - protein, 26 aa, Mycobacterium
FTEMIETWIEMAWQDGSFGWVGIANL

SEQ ID NO: 813518 - protein, 32 aa, Mycobacterium
FTENDRYLCVNPFFHNFGYKAGILACLQTGAA

SEQ ID NO: 813519 - protein, 19 aa, Mycobacterium
FTEQYPGSSTLLLRVRREE

SEQ ID NO: 813520 - protein, 27 aa, Mycobacterium
FTERPRQRLAVLLYEIGIVGFGVDPNI

SEQ ID NO: 813521 - protein, 21 aa, Mycobacterium
FTERRSFLLPPTWSQLDAVSS

SEQ ID NO: 813522 - protein, 17 aa, Mycobacterium
FTFAPRGQLIHIDAEAR

SEQ ID NO: 813523 - protein, 27 aa, Mycobacterium
FTFGAPPPDVIRRLSALGLLVSVTVTS

SEQ ID NO: 813524 - protein, 17 aa, Mycobacterium
FTFLPEVGDLDKPKLVF

SEQ ID NO: 813525 - protein, 36 aa, Mycobacterium
FTFYTEVLGFRPRGAFRIPAPPEFGPMRVRFLGINE

SEQ ID NO: 813526 - protein, 25 aa, Mycobacterium
FTGATPQYLLGFSRRFPDATVVRLE

SEQ ID NO: 813527 - protein, 19 aa, Mycobacterium
FTGDGIMALFGAPLALEDH

SEQ ID NO: 813528 - protein, 18 aa, Mycobacterium
FTGDGVMALFGAPAALED

SEQ ID NO: 813529 - protein, 28 aa, Mycobacterium
FTGEDRLLRLRWPCPVPGALPVSEVGDA

SEQ ID NO: 813530 - protein, 26 aa, Mycobacterium
FTGEDRLLRLRWPCPVPGAMPVSEVG

SEQ ID NO: 813531 - protein, 17 aa, Mycobacterium
FTGGEPLIFKDLEKLVA

SEQ ID NO: 813532 - protein, 17 aa, Mycobacterium
FTGGLNWYRNFDRNWET

SEQ ID NO: 813533 - protein, 17 aa, Mycobacterium
FTGIPDKLAPVKTNLFV

SEQ ID NO: 813534 - protein, 17 aa, Mycobacterium
FTGKYFAVKGPSITPRP

SEQ ID NO: 813535 - protein, 17 aa, Mycobacterium
FTGLVIRWHAPVIIDGA

SEQ ID NO: 813536 - protein, 23 aa, Mycobacterium
FTGMDPMLTGRENLVLFGRLRGL

SEQ ID NO: 813537 - protein, 24 aa, Mycobacterium
FTGNEKVWPFFEKAVPAPRGHKVP

SEQ ID NO: 813538 - protein, 21 aa, Mycobacterium
FTGPGLWANLACRKRFIADKL

SEQ ID NO: 813539 - protein, 19 aa, Mycobacterium
FTGRLPQRFADRAPRVVET

SEQ ID NO: 813540 - protein, 26 aa, Mycobacterium
FTGSLALELGFFGVRAKLVEPGYGPG

SEQ ID NO: 813541 - protein, 18 aa, Mycobacterium
FTGTFATIGLSYLGFTQW

SEQ ID NO: 813542 - protein, 20 aa, Mycobacterium
FTGTGFYWHSDFETWHAEDG

SEQ ID NO: 813543 - protein, 26 aa, Mycobacterium
FTGTLTLRYRRPTALGRPLRAQAHVE

SEQ ID NO: 813544 - protein, 28 aa, Mycobacterium
FTGTRFECNLTWLELQWGRTIGQTPSPC

SEQ ID NO: 813545 - protein, 22 aa, Mycobacterium
FTGVQTFTFYPAGPDGTIQTGS

SEQ ID NO: 813546 - protein, 26 aa, Mycobacterium
FTGVQTYFFYPVNDNGGWQLGSRVFS

SEQ ID NO: 813547 - protein, 34 aa, Mycobacterium
FTHANHIHLIAHPILMPILTISGLTELVAVEPAP

SEQ ID NO: 813548 - protein, 18 aa, Mycobacterium
FTHELRMTLRALGSLRVE

SEQ ID NO: 813549 - protein, 21 aa, Mycobacterium
FTHLLGYAIVQAIKDFPNMNR

SEQ ID NO: 813550 - protein, 21 aa, Mycobacterium
FTHLLGYAIVQAVKKFPNMNR

SEQ ID NO: 813551 - protein, 21 aa, Mycobacterium
FTHPLAPYRIDGRRPAPVAGA

SEQ ID NO: 813552 - protein, 18 aa, Mycobacterium
FTHPQVNDFFTSLEGLPR

SEQ ID NO: 813553 - protein, 17 aa, Mycobacterium
FTHTCFMVTPYEGYVQV

SEQ ID NO: 813554 - protein, 22 aa, Mycobacterium
FTHWGGAFKYAASLLGLPIGAY

SEQ ID NO: 813555 - protein, 17 aa, Mycobacterium
FTIALAGLAAVLHRYTE

SEQ ID NO: 813556 - protein, 20 aa, Mycobacterium
FTIANRRLIRYLAERPDHVR

SEQ ID NO: 813557 - protein, 21 aa, Mycobacterium
FTIATVPALLRKRPDPMAGMD

SEQ ID NO: 813558 - protein, 25 aa, Mycobacterium
FTIHHIVIDGWSLPVLLREVFAGYY

SEQ ID NO: 813559 - protein, 25 aa, Mycobacterium
FTITEPLGYDATYTWSGSVVGEDGK

SEQ ID NO: 813560 - protein, 18 aa, Mycobacterium
FTITLDEALKIYAQPKRL

SEQ ID NO: 813561 - protein, 18 aa, Mycobacterium
FTIVGDLAQRRSPAGARS

SEQ ID NO: 813562 - protein, 22 aa, Mycobacterium
FTLFKGLQLDIGAPPQFMDFRY

SEQ ID NO: 813563 - protein, 25 aa, Mycobacterium
FTLGVGPSHHWIIDGQLGLPYERPA

SEQ ID NO: 813564 - protein, 18 aa, Mycobacterium
FTLGVRLIQDSPLYSRIA

SEQ ID NO: 813565 - protein, 27 aa, Mycobacterium
FTLIALSIFGSLAWKSGEAAAEGVAGA

SEQ ID NO: 813566 - protein, 17 aa, Mycobacterium
FTLLQDQLQSVLDTLSE

SEQ ID NO: 813567 - protein, 23 aa, Mycobacterium
FTLPGSFAQLVAVPRAAANLVRL

SEQ ID NO: 813568 - protein, 25 aa, Mycobacterium
FTLTEKYVVFYDLPVTLDMSMISQS

SEQ ID NO: 813569 - protein, 18 aa, Mycobacterium
FTMAPCRHPFRVDVTVAA

SEQ ID NO: 813570 - protein, 18 aa, Mycobacterium
FTMRYLDAPPRVALDLSD

SEQ ID NO: 813571 - protein, 20 aa, Mycobacterium
FTNPDKPYFPKLGKNGTKGK

SEQ ID NO: 813572 - protein, 20 aa, Mycobacterium
FTNPDKVYFPKLGKNGTKGK

SEQ ID NO: 813573 - protein, 22 aa, Mycobacterium
FTPAPVGTPGLSPTASGPATPS

SEQ ID NO: 813574 - protein, 17 aa, Mycobacterium
FTPGPRLGPGLDATLER

SEQ ID NO: 813575 - protein, 21 aa, Mycobacterium
FTPKYLRVKLGDHKPKVTATF

SEQ ID NO: 813576 - protein, 19 aa, Mycobacterium
FTPPAQIRNFCIIAHIDHG

SEQ ID NO: 813577 - protein, 20 aa, Mycobacterium
FTPPAQIRNFCIIAHIDHGK

SEQ ID NO: 813578 - protein, 18 aa, Mycobacterium
FTPPGPPRFAHELAWWVY

SEQ ID NO: 813579 - protein, 25 aa, Mycobacterium
FTPRDVELLVVIGRLIAGALHQARL

SEQ ID NO: 813580 - protein, 25 aa, Mycobacterium
FTPSVDAWLTRWDENFTAALAARGW

SEQ ID NO: 813581 - protein, 19 aa, Mycobacterium
FTPTDEPGLWLAYDRLGSQ

SEQ ID NO: 813582 - protein, 26 aa, Mycobacterium
FTPWNGATILSWRAALSPIAAGNTVV

SEQ ID NO: 813583 - protein, 29 aa, Mycobacterium
FTQAGELLTLPIPPLLREIATHLDRGSAI

SEQ ID NO: 813584 - protein, 30 aa, Mycobacterium
FTQAGELLTLPIPPLLREIATHLDRGTAIT

SEQ ID NO: 813585 - protein, 29 aa, Mycobacterium
FTQEHDLSLWLLKVQALRSAWGTPEVHRR

SEQ ID NO: 813586 - protein, 29 aa, Mycobacterium
FTQEHDLSLWLLRVQALRSAWGTPEAHRR

SEQ ID NO: 813587 - protein, 29 aa, Mycobacterium
FTQEHDLSLWLLRVQALRSAWGTPEVHRR

SEQ ID NO: 813588 - protein, 38 aa, Mycobacterium; identical to SEQ ID NO: 114555

SEQ ID NO: 813589 - protein, 23 aa, Mycobacterium
FTQMAGLAAMWRSVGVAPNATIG

SEQ ID NO: 813590 - protein, 20 aa, Mycobacterium
FTQVYLVVGVLFHQRRQPGE

SEQ ID NO: 813591 - protein, 18 aa, Mycobacterium
FTQWGVHGTPYWFECQSK

SEQ ID NO: 813592 - protein, 19 aa, Mycobacterium
FTRETLGFSVLHVVRDNPT

SEQ ID NO: 813593 - protein, 18 aa, Mycobacterium
FTRLAGGRPMCPRRSQDV

SEQ ID NO: 813594 - protein, 17 aa, Mycobacterium
FTRMWNQAAAAMDAYQA

SEQ ID NO: 813595 - protein, 17 aa, Mycobacterium
FTRMYRRIVAGSDPPDD

SEQ ID NO: 813596 - protein, 21 aa, Mycobacterium
FTRNFWFCAVEDKSSFVQHHR

SEQ ID NO: 813597 - protein, 19 aa, Mycobacterium
FTRSIQSLLLTGVAPASFY

SEQ ID NO: 813598 - protein, 17 aa, Mycobacterium
FTRTGAGLAFTPGGLRL

SEQ ID NO: 813599 - protein, 23 aa, Mycobacterium
FTRTRLRLDVMPLLEEVLGGGVA

SEQ ID NO: 813600 - protein, 29 aa, Mycobacterium
FTSDIRNLLPLFAVFKPTVVVSVPRVFEK

SEQ ID NO: 813601 - protein, 26 aa, Mycobacterium
FTSDPVFRRRYWARNHLGWRHMDDTQ

SEQ ID NO: 813602 - protein, 20 aa, Mycobacterium
FTSFNWIGFSVFRDDYPKTD

SEQ ID NO: 813603 - protein, 23 aa, Mycobacterium
FTSGFGYRWGALHGGIDIANSIG

SEQ ID NO: 813604 - protein, 17 aa, Mycobacterium
FTSLLDNGIDASSITFV

SEQ ID NO: 813605 - protein, 17 aa, Mycobacterium
FTSLPRSGTFRAARIVA

SEQ ID NO: 813606 - protein, 18 aa, Mycobacterium
FTSPVAYKPYPGKAITAA

SEQ ID NO: 813607 - protein, 19 aa, Mycobacterium
FTSPVGGGGFIGKWLKKML

SEQ ID NO: 813608 - protein, 19 aa, Mycobacterium
FTSSLLLDVDLTRANTAAA

SEQ ID NO: 813609 - protein, 17 aa, Mycobacterium
FTSYRIRALLRRQNQPA

SEQ ID NO: 813610 - protein, 19 aa, Mycobacterium
FTTAFSRRGLIAEYGISWI

SEQ ID NO: 813611 - protein, 20 aa, Mycobacterium
FTTCALLVDTIKARLPVWKH

SEQ ID NO: 813612 - protein, 19 aa, Mycobacterium
FTTDFMKLTPDRFIHELLV

SEQ ID NO: 813613 - protein, 25 aa, Mycobacterium
FTTEAIWEMPPFTGWYQGGPSIAAL

SEQ ID NO: 813614 - protein, 26 aa, Mycobacterium
FTTGEFQYCTAGHPPPLVVTAEAKSR

SEQ ID NO: 813615 - protein, 19 aa, Mycobacterium
FTTIAWRLAHVIVGVLAMR

SEQ ID NO: 813616 - protein, 22 aa, Mycobacterium
FTTKLFNATRYALLNGATKPSE

SEQ ID NO: 813617 - protein, 18 aa, Mycobacterium
FTTLVPNLGVVSAGEHAF

SEQ ID NO: 813618 - protein, 18 aa, Mycobacterium
FTTLVPNLGVVSAGENTY

SEQ ID NO: 813619 - protein, 17 aa, Mycobacterium
FTTNEFTIAPIGIGGFT

SEQ ID NO: 813620 - protein, 24 aa, Mycobacterium
FTTTAELVALLYEAIPAAARRTGG

SEQ ID NO: 813621 - protein, 21 aa, Mycobacterium
FTTTPFLAPAPLAPTGRGLPA

SEQ ID NO: 813622 - protein, 21 aa, Mycobacterium
FTTVHMALVRTPMISPTTIYD

SEQ ID NO: 813623 - protein, 23 aa, Mycobacterium
FTVDPFAALILAANIGWRDTVLL

SEQ ID NO: 813624 - protein, 25 aa, Mycobacterium
FTVESGKLWLLQTRAAERSAQAAVR

SEQ ID NO: 813625 - protein, 26 aa, Mycobacterium
FTVESGKLWLLQTRSAERSAQAAVRL

SEQ ID NO: 813626 - protein, 25 aa, Mycobacterium
FTVEVPRRTVCCGLTWISTGQLTTA

SEQ ID NO: 813627 - protein, 26 aa, Mycobacterium
FTVGDNIAIVPKLLNWDKQRIDERVD

SEQ ID NO: 813628 - protein, 18 aa, Mycobacterium
FTVGPLEHKLGIKGSPTA

SEQ ID NO: 813629 - protein, 18 aa, Mycobacterium
FTVGPRPLAAGDRDCLGV

SEQ ID NO: 813630 - protein, 17 aa, Mycobacterium
FTVLLVENILPEAPLHD

SEQ ID NO: 813631 - protein, 28 aa, Mycobacterium
FTVNHQQWLPRLPPPYVVAVVALAEDPS

SEQ ID NO: 813632 - protein, 27 aa, Mycobacterium
FTVPEPLSLRPHYIKTLRIWGDTLESN

SEQ ID NO: 813633 - protein, 24 aa, Mycobacterium
FTVPNFLDLDYWQTWHYGDSTMAG

SEQ ID NO: 813634 - protein, 20 aa, Mycobacterium
FTVPPSQANFVWLPLEDRTT

SEQ ID NO: 813635 - protein, 28 aa, Mycobacterium
FTVPVERPMPWPIYLPSVRVAATPHHGA

SEQ ID NO: 813636 - protein, 35 aa, Mycobacterium
FTVQTFDARPWWLDRLRLLTWVIVDPASPIMIRLT

SEQ ID NO: 813637 - protein, 20 aa, Mycobacterium
FTVVALDRPGYGSSAPYPEA

SEQ ID NO: 813638 - protein, 21 aa, Mycobacterium
FTVVALDRPGYGSSAPYPEAM

SEQ ID NO: 813639 - protein, 17 aa, Mycobacterium
FTVVGDLAQRRSAAGAT

SEQ ID NO: 813640 - protein, 18 aa, Mycobacterium
FTVVGTDPSSDIAVVRAQ

SEQ ID NO: 813641 - protein, 26 aa, Mycobacterium
FTWEHDLHLYWRRAISLAASIGPANR

SEQ ID NO: 813642 - protein, 26 aa, Mycobacterium
FTWEHDLHLYWRRATSLAASLGPVSR

SEQ ID NO: 813643 - protein, 26 aa, Mycobacterium
FTWEHPAHLYLKRAKSSQLLFGSPSS

SEQ ID NO: 813644 - protein, 18 aa, Mycobacterium
FTWLPDLALRSLGGAVVW

SEQ ID NO: 813645 - protein, 19 aa, Mycobacterium
FTWTNTALHRTTGWEYYVG

SEQ ID NO: 813646 - protein, 18 aa, Mycobacterium
FTYGLLYQREADLAQRCR

SEQ ID NO: 813647 - protein, 20 aa, Mycobacterium
FTYHQIADKLTFVVDLMLGK

SEQ ID NO: 813648 - protein, 20 aa, Mycobacterium
FTYHQIADRLTYVVGLILGE

SEQ ID NO: 813649 - protein, 26 aa, Mycobacterium
FVAAHQPFLDWLAQAAAVANAAATAH

SEQ ID NO: 813650 - protein, 17 aa, Mycobacterium
FVAALHAIWSAWRDGGK

SEQ ID NO: 813651 - protein, 20 aa, Mycobacterium
FVAALKPIEWRYDNDPAWVL

SEQ ID NO: 813652 - protein, 24 aa, Mycobacterium
FVAAYGPYLAWLAQASADTATAAT

SEQ ID NO: 813653 - protein, 18 aa, Mycobacterium
FVACFSMFGDDLSQWRGY

SEQ ID NO: 813654 - protein, 20 aa, Mycobacterium
FVAECARVLRRGGLLMVSTP

SEQ ID NO: 813655 - protein, 19 aa, Mycobacterium
FVALFGSADRYLARIAALC

SEQ ID NO: 813656 - protein, 17 aa, Mycobacterium
FVALGFAAATTSTLRLI

SEQ ID NO: 813657 - protein, 19 aa, Mycobacterium
FVALLLSELGHRVTGVDAS

SEQ ID NO: 813658 - protein, 17 aa, Mycobacterium
FVAPARPVRAEWLAPLL

SEQ ID NO: 813659 - protein, 17 aa, Mycobacterium
FVAPIPDTTHSAIADAV

SEQ ID NO: 813660 - protein, 28 aa, Mycobacterium
FVAQDLHQKLHRIGRIAFVWSDRHSAVT

SEQ ID NO: 813661 - protein, 19 aa, Mycobacterium
FVAQIGELITLRAELIAAP

SEQ ID NO: 813662 - protein, 18 aa, Mycobacterium
FVARRAILALARAEYRIL

SEQ ID NO: 813663 - protein, 21 aa, Mycobacterium
FVASVLSVLRRLEGHFTLVFA

SEQ ID NO: 813664 - protein, 17 aa, Mycobacterium
FVAVCGQCRWCASGIEY

SEQ ID NO: 813665 - protein, 35 aa, Mycobacterium
FVAVKAHIRNWRWAGVPFYLRTGKRMSQRFSEIVV

SEQ ID NO: 813666 - protein, 17 aa, Mycobacterium
FVAVMPAATSAAKVALI

SEQ ID NO: 813667 - protein, 19 aa, Mycobacterium
FVAVYRMHPLIPDDFVFRS

SEQ ID NO: 813668 - protein, 17 aa, Mycobacterium
FVCIFDTRAGLIVSMRL

SEQ ID NO: 813669 - protein, 19 aa, Mycobacterium
FVCLRMLSMFPGMSSAELS

SEQ ID NO: 813670 - protein, 20 aa, Mycobacterium
FVCQVVSGSALMISALVAMR

SEQ ID NO: 813671 - protein, 21 aa, Mycobacterium
FVCRDVWLRVASTSTAWTSRF

SEQ ID NO: 813672 - protein, 19 aa, Mycobacterium
FVDADPPEFTLLPDEQWST

SEQ ID NO: 813673 - protein, 20 aa, Mycobacterium
FVDGLSRRYLPKVGDVLVVP

SEQ ID NO: 813674 - protein, 26 aa, Mycobacterium
FVDGVIPELQRRGLYRGGYESQSLRA

SEQ ID NO: 813675 - protein, 19 aa, Mycobacterium
FVDLLAEAPVRRVTERAAK

SEQ ID NO: 813676 - protein, 17 aa, Mycobacterium
FVDLPVCDDLALADHVD

SEQ ID NO: 813677 - protein, 33 aa, Mycobacterium
FVDNDPLFDAMRVHGLGALRWRDFPDYRRGYSV

SEQ ID NO: 813678 - protein, 44 aa, Mycobacterium
FVDPFAMVLPIRLSGTRPPIWCPSAAFGLSWSYRGLLDHVDDRP

SEQ ID NO: 813679 - protein, 18 aa, Mycobacterium
FVDPQQLVRGILVNARGQ

SEQ ID NO: 813680 - protein, 18 aa, Mycobacterium
FVDRLHDVKPLSSAERSA

SEQ ID NO: 813681 - protein, 17 aa, Mycobacterium
FVDTAGLRRKVGQASGH

SEQ ID NO: 813682 - protein, 29 aa, Mycobacterium
FVDVPLSTLGLVALPFDIGGYYTGVHTDD

SEQ ID NO: 813683 - protein, 22 aa, Mycobacterium
FVDVWARYIGTLMSLTPTLLHG

SEQ ID NO: 813684 - protein, 19 aa, Mycobacterium
FVDWSLIDVLRGAPGAPGM

SEQ ID NO: 813685 - protein, 18 aa, Mycobacterium
FVEACKGVSVPLRLTSPA

SEQ ID NO: 813686 - protein, 20 aa, Mycobacterium
FVEAGKLGLLGFSVPEQFGG

SEQ ID NO: 813687 - protein, 21 aa, Mycobacterium
FVEAVRPYWEAGFTDVALVQV

SEQ ID NO: 813688 - protein, 26 aa, Mycobacterium
FVEDIAMKLPLLAIADLIGVPEADRE

SEQ ID NO: 813689 - protein, 21 aa, Mycobacterium
FVEELLARYGIAPSPEAGAER

SEQ ID NO: 813690 - protein, 21 aa, Mycobacterium
FVEEVLRYEPPFRGHYRHVVH

SEQ ID NO: 813691 - protein, 19 aa, Mycobacterium
FVEFAQYAEGLGFAGVLAG

SEQ ID NO: 813692 - protein, 17 aa, Mycobacterium
FVEFVRDGHFDQVAHHR

SEQ ID NO: 813693 - protein, 17 aa, Mycobacterium
FVEFVRDGQFDQVAQHR

SEQ ID NO: 813694 - protein, 39 aa, Mycobacterium
FVEKLNAAFAHRTGLAASGLPWHALRTPIADIGSTTAFV

SEQ ID NO: 813695 - protein, 17 aa, Mycobacterium
FVELFYGQPLNASSWEL

SEQ ID NO: 813696 - protein, 17 aa, Mycobacterium
FVELLPVNSFAGTRGWG

SEQ ID NO: 813697 - protein, 25 aa, Mycobacterium
FVELPTYAFDRRRFWLSGEGAAADA

SEQ ID NO: 813698 - protein, 24 aa, Mycobacterium
FVELPTYAFERRRFWLSGDAVAAD

SEQ ID NO: 813699 - protein, 27 aa, Mycobacterium
FVEMSAHPSLLYPLADLVDERTTVVVG

SEQ ID NO: 813700 - protein, 19 aa, Mycobacterium
FVEPLPPHTLTGKTVAVVG

SEQ ID NO: 813701 - protein, 17 aa, Mycobacterium
FVERLSEGIGTIAAAFW

SEQ ID NO: 813702 - protein, 18 aa, Mycobacterium
FVERVVPTELLHETLETP

SEQ ID NO: 813703 - protein, 25 aa, Mycobacterium
FVESDGELWALKELPPRIAGREYGV

SEQ ID NO: 813704 - protein, 25 aa, Mycobacterium
FVEVTFPISAHYFTVLPLAKRMESA

SEQ ID NO: 813705 - protein, 27 aa, Mycobacterium
FVEYAEFLPGALLVPAIHLVRAAHLGQ

SEQ ID NO: 813706 - protein, 23 aa, Mycobacterium
FVFDPRTPYVVFWVVDPDTGERV

SEQ ID NO: 813707 - protein, 17 aa, Mycobacterium
FVFGVGAGWNLEEMRNH

SEQ ID NO: 813708 - protein, 19 aa, Mycobacterium
FVFNLVQYLGQLGVDATVW

SEQ ID NO: 813709 - protein, 21 aa, Mycobacterium
FVFVNLFRGRVGAPMRPDAIG

SEQ ID NO: 813710 - protein, 18 aa, Mycobacterium
FVGFLEAQRAHGERPLFP

SEQ ID NO: 813711 - protein, 21 aa, Mycobacterium
FVGGILHRIFDKCPHLTTIVD

SEQ ID NO: 813712 - protein, 18 aa, Mycobacterium
FVGGLPIVLATKLLGQRV

SEQ ID NO: 813713 - protein, 25 aa, Mycobacterium
FVGGQGLLFLMPTGPHGVGHFSRAV

SEQ ID NO: 813714 - protein, 27 aa, Mycobacterium
FVGHVELFWTVPEFKSFFDQLASFCRV

SEQ ID NO: 813715 - protein, 17 aa, Mycobacterium
FVGPRFGLYGRTQPTWR

SEQ ID NO: 813716 - protein, 17 aa, Mycobacterium
FVGPRFGQWGPTGSVGR

SEQ ID NO: 813717 - protein, 18 aa, Mycobacterium
FVGQLYDVFVEHQGLLLT

SEQ ID NO: 813718 - protein, 19 aa, Mycobacterium
FVGQLYDVFVEHQGLLLTL

SEQ ID NO: 813719 - protein, 20 aa, Mycobacterium
FVGQRMLAVPRPVVDHALGA

SEQ ID NO: 813720 - protein, 18 aa, Mycobacterium
FVGRKLHPLGRRIQPGVG

SEQ ID NO: 813721 - protein, 27 aa, Mycobacterium
FVGRVRAIGLKNWIATLTLDLEKGVKL

SEQ ID NO: 813722 - protein, 17 aa, Mycobacterium
FVGTELEFMVFDDSFRQ

SEQ ID NO: 813723 - protein, 18 aa, Mycobacterium
FVGVQRAPLELAGPVLRI

SEQ ID NO: 813724 - protein, 25 aa, Mycobacterium
FVGVTAYDYMLTLAGRLRPEDLDAY

SEQ ID NO: 813725 - protein, 25 aa, Mycobacterium
FVGYQLDRAFALRLGRPRSNGCSYA

SEQ ID NO: 813726 - protein, 25 aa, Mycobacterium
FVGYQLDRVFAPRLGQPRSNGCSYA

SEQ ID NO: 813727 - protein, 20 aa, Mycobacterium
FVHAAAVRHLWTLAPGRVFL

SEQ ID NO: 813728 - protein, 23 aa, Mycobacterium
FVHAHPRWIAQAFADALGPSAAE

SEQ ID NO: 813729 - protein, 24 aa, Mycobacterium
FVHAHPRWIAQAFTDALGAAAGEL

SEQ ID NO: 813730 - protein, 26 aa, Mycobacterium
FVHGGELFIVGRIKDLLIIRGRNHYP

SEQ ID NO: 813731 - protein, 18 aa, Mycobacterium
FVHGLPLCAVSLALMRTG

SEQ ID NO: 813732 - protein, 18 aa, Mycobacterium
FVHGMGFQRDILGATPAT

SEQ ID NO: 813733 - protein, 24 aa, Mycobacterium
FVHGYLMGGQLWRQVSERLAKRGL

SEQ ID NO: 813734 - protein, 24 aa, Mycobacterium
FVHGYMMGGQLWRGVSERLADRGL

SEQ ID NO: 813735 - protein, 29 aa, Mycobacterium
FVHNRLLTPLLFDMGSFAGLARPLRNAIM

SEQ ID NO: 813736 - protein, 18 aa, Mycobacterium
FVHPGVIDAALHTISPLI

SEQ ID NO: 813737 - protein, 29 aa, Mycobacterium
FVHSRLVTALAIAILRGFPVVVLVDDAPE

SEQ ID NO: 813738 - protein, 28 aa, Mycobacterium
FVIDPLPNLLFTRDSSFWIGPRVAITSL

SEQ ID NO: 813739 - protein, 19 aa, Mycobacterium
FVIGTDIMPLLMPLETIGV

SEQ ID NO: 813740 - protein, 17 aa, Mycobacterium
FVIGVRDAGFHLISVTP

SEQ ID NO: 813741 - protein, 18 aa, Mycobacterium
FVIGYQLGCQSDVSSGLQ

SEQ ID NO: 813742 - protein, 32 aa, Mycobacterium
FVIHRTLVLINLLLFNPAGLLSFFLSNPVYAL

SEQ ID NO: 813743 - protein, 18 aa, Mycobacterium
FVIQRFMARVFNANEPPW

SEQ ID NO: 813744 - protein, 17 aa, Mycobacterium
FVKDPNGWHLFAEIAKN

SEQ ID NO: 813745 - protein, 27 aa, Mycobacterium
FVKEQVCRFTITWLAAEARKPGSYRSL

SEQ ID NO: 813746 - protein, 37 aa, Mycobacterium
FVKGKRLVLRYRPMGLIGVIGPWNYPLTNSFGDCIPA

SEQ ID NO: 813747 - protein, 24 aa, Mycobacterium
FVKRPDLWLRAISDYRITFTGGPN

SEQ ID NO: 813748 - protein, 17 aa, Mycobacterium
FVLAPGSVLTKKPPRWI

SEQ ID NO: 813749 - protein, 25 aa, Mycobacterium
FVLDHALVDIGVGVRWLREVQNIET

SEQ ID NO: 813750 - protein, 17 aa, Mycobacterium
FVLDTPIPDKGRILTAM

SEQ ID NO: 813751 - protein, 17 aa, Mycobacterium
FVLFGAFTDAPATWQRY

SEQ ID NO: 813752 - protein, 18 aa, Mycobacterium
FVLFGEFADAPAAWQRYL

SEQ ID NO: 813753 - protein, 19 aa, Mycobacterium
FVLHDAFAVPFDQIAPLVG

SEQ ID NO: 813754 - protein, 20 aa, Mycobacterium
FVLHDGFSVPFKQIADILGI

SEQ ID NO: 813755 - protein, 19 aa, Mycobacterium
FVLHRMRQSLAIQPVAIGS

SEQ ID NO: 813756 - protein, 17 aa, Mycobacterium
FVLLEMTGLMEEIDTDA

SEQ ID NO: 813757 - protein, 20 aa, Mycobacterium
FVLMPTPIWDQMFKPLVAGQ

SEQ ID NO: 813758 - protein, 22 aa, Mycobacterium
FVLNQPVMTAGRHPASDIYLDD

SEQ ID NO: 813759 - protein, 20 aa, Mycobacterium
FVLPAKRPRRVLLVSGGSGI

SEQ ID NO: 813760 - protein, 24 aa, Mycobacterium
FVLPAQRPRRILFVSGGSGITPVM

SEQ ID NO: 813761 - protein, 25 aa, Mycobacterium
FVLPDTPPERILFVSGGSGITPVLS

SEQ ID NO: 813762 - protein, 19 aa, Mycobacterium
FVLPQRRPRRILFVSGGSG

SEQ ID NO: 813763 - protein, 18 aa, Mycobacterium
FVLQPFKLRLARRALGNT

SEQ ID NO: 813764 - protein, 24 aa, Mycobacterium
FVLRIPDSLPLDKAAPLLCAGITL

SEQ ID NO: 813765 - protein, 17 aa, Mycobacterium
FVLVNNPERIPLTVHDG

SEQ ID NO: 813766 - protein, 19 aa, Mycobacterium
FVLYDGFGVPFPDIADVLG

SEQ ID NO: 813767 - protein, 17 aa, Mycobacterium
FVMAPDGSFYFLEVNTR

SEQ ID NO: 813768 - protein, 20 aa, Mycobacterium
FVMCRAEVAPILLAAIRDAW

SEQ ID NO: 813769 - protein, 27 aa, Mycobacterium
FVMPHQPRFPFFDYPYIVVLVELDEGV

SEQ ID NO: 813770 - protein, 25 aa, Mycobacterium
FVNGGFPGISWPLTPGHEIAGKVAE

SEQ ID NO: 813771 - protein, 17 aa, Mycobacterium
FVNLLDMGTEWKPSEAA

SEQ ID NO: 813772 - protein, 21 aa, Mycobacterium
FVNSRPKPLAAYLFTKAKAVR

SEQ ID NO: 813773 - protein, 17 aa, Mycobacterium
FVPAFDIPGAEELLNPR

SEQ ID NO: 813774 - protein, 19 aa, Mycobacterium
FVPAMFTRMLKLPDRVRNS

SEQ ID NO: 813775 - protein, 20 aa, Mycobacterium
FVPDLLLSTWDLRPWREDSG

SEQ ID NO: 813776 - protein, 19 aa, Mycobacterium
FVPDLLPRMDAEVAALGRS

SEQ ID NO: 813777 - protein, 26 aa, Mycobacterium
FVPDVGGMFLLSRAPGGLGLHAALTG

SEQ ID NO: 813778 - protein, 26 aa, Mycobacterium
FVPERRIGIVMLANKNFPIPARVTAA

SEQ ID NO: 813779 - protein, 25 aa, Mycobacterium
FVPGDEVDRLLWLPAAEAMRKLDYA

SEQ ID NO: 813780 - protein, 19 aa, Mycobacterium
FVPGKYGFNGLMAVLAEFP

SEQ ID NO: 813781 - protein, 20 aa, Mycobacterium
FVPHSRTFPLFTREPYRGSS

SEQ ID NO: 813782 - protein, 21 aa, Mycobacterium
FVPIINDHLRQDLSGALAWEQ

SEQ ID NO: 813783 - protein, 17 aa, Mycobacterium
FVPIMNVFPDATFIVTH

SEQ ID NO: 813784 - protein, 33 aa, Mycobacterium
FVPITEHHLDVPLFWQCWKLDSPLVQAITDAVL

SEQ ID NO: 813785 - protein, 17 aa, Mycobacterium
FVPPVPGGDAEGCFVYR

SEQ ID NO: 813786 - protein, 25 aa, Mycobacterium
FVPQNYGGYILPGSTLDKLNLFVSQ

SEQ ID NO: 813787 - protein, 22 aa, Mycobacterium
FVPRSLLLPGIRIGNRFRGGPN

SEQ ID NO: 813788 - protein, 17 aa, Mycobacterium
FVPSRRTTSRPLTLPGS

SEQ ID NO: 813789 - protein, 26 aa, Mycobacterium
FVPTHRRRTALLLQQASLFPHLTVAR

SEQ ID NO: 813790 - protein, 17 aa, Mycobacterium
FVPVMRNTKLVLLGGIT

SEQ ID NO: 813791 - protein, 17 aa, Mycobacterium
FVPVVRNTKLILLGGIT

SEQ ID NO: 813792 - protein, 18 aa, Mycobacterium
FVPYQNFDALRTLTLPFG

SEQ ID NO: 813793 - protein, 23 aa, Mycobacterium
FVQAFPNVLSPRSSLLVLGDGRT

SEQ ID NO: 813794 - protein, 19 aa, Mycobacterium
FVQAFPNVLSPRTSLLVLG

SEQ ID NO: 813795 - protein, 19 aa, Mycobacterium
FVQCRLRPITFDEVDFTLA

SEQ ID NO: 813796 - protein, 17 aa, Mycobacterium
FVQDAIWAGIRQAVILA

SEQ ID NO: 813797 - protein, 24 aa, Mycobacterium
FVQDPLRWLRCLTQYRGTNSGAPN

SEQ ID NO: 813798 - protein, 25 aa, Mycobacterium
FVQIRLGGDMALFAGLGRLLLEAED

SEQ ID NO: 813799 - protein, 24 aa, Mycobacterium
FVRDIAAPLPMAVIGDMLGVLPTE

SEQ ID NO: 813800 - protein, 25 aa, Mycobacterium
FVRDWSEMFTMWPTKQTPGSRTQLD

SEQ ID NO: 813801 - protein, 19 aa, Mycobacterium
FVREAWSVPPDYFEPLMML

SEQ ID NO: 813802 - protein, 21 aa, Mycobacterium
FVRELYGPLLEAGVPFLVTDL

SEQ ID NO: 813803 - protein, 21 aa, Mycobacterium
FVRFTGVPPRTWLAAEFRNIQ

SEQ ID NO: 813804 - protein, 22 aa, Mycobacterium
FVRGEFRALRVKVGEDTVTALL

SEQ ID NO: 813805 - protein, 17 aa, Mycobacterium
FVRGFVGAGATLMQLSL

SEQ ID NO: 813806 - protein, 18 aa, Mycobacterium
FVRKVFNRLAMAANIGET

SEQ ID NO: 813807 - protein, 30 aa, Mycobacterium
FVRLCDAFGIPLIVVVDVPGYLPGVDQEWG

SEQ ID NO: 813808 - protein, 17 aa, Mycobacterium
FVRLPAPLRGNTTWCTA

SEQ ID NO: 813809 - protein, 20 aa, Mycobacterium
FVRLTDGALPTCFLVAAPRS

SEQ ID NO: 813810 - protein, 18 aa, Mycobacterium
FVRMLLGDGTIDGVRVLS

SEQ ID NO: 813811 - protein, 18 aa, Mycobacterium
FVRNATRTFWHQCGTAKM

SEQ ID NO: 813812 - protein, 24 aa, Mycobacterium
FVRNVLARAFDRDPRRLRVLTPAV

SEQ ID NO: 813813 - protein, 25 aa, Mycobacterium
FVRPRHRMVLTTFRADGSLQSSPVT

SEQ ID NO: 813814 - protein, 23 aa, Mycobacterium
FVRPSLRNGLWHLTAWLATGVAN

SEQ ID NO: 813815 - protein, 26 aa, Mycobacterium
FVRQRELFDPALLAHARLISAAGGST

SEQ ID NO: 813816 - protein, 25 aa, Mycobacterium
FVRRPQRWIKALSAQAGRAVTAAPN

SEQ ID NO: 813817 - protein, 20 aa, Mycobacterium
FVRRRIFDGTYPAGRYIRLE

SEQ ID NO: 813818 - protein, 23 aa, Mycobacterium
FVRSEGCAMVLLKRLPDALRDGN

SEQ ID NO: 813819 - protein, 26 aa, Mycobacterium
FVRSETIPEFLAALQTPRRVLIMVKA

SEQ ID NO: 813820 - protein, 17 aa, Mycobacterium
FVRTAAALLSWLAEDFR

SEQ ID NO: 813821 - protein, 20 aa, Mycobacterium
FVRWCRQVLDLLDQVRNAAP

SEQ ID NO: 813822 - protein, 17 aa, Mycobacterium
FVRWCRQVVDLLDQIHK

SEQ ID NO: 813823 - protein, 17 aa, Mycobacterium
FVRYGELRYPHLADWGI

SEQ ID NO: 813824 - protein, 40 aa, Mycobacterium
FVSAPSSLLTFAAILPLVVIAGPVDLPIAALGTLIGFHTD

SEQ ID NO: 813825 - protein, 25 aa, Mycobacterium
FVSGEGCVMLLLKPLDDAQRDGDRI

SEQ ID NO: 813826 - protein, 18 aa, Mycobacterium
FVSNLRALVALRGAGSRA

SEQ ID NO: 813827 - protein, 18 aa, Mycobacterium
FVSPDLVTPPISALMPDL

SEQ ID NO: 813828 - protein, 26 aa, Mycobacterium
FVSQHFRALLHDLKIDLLLSRGGKPT

SEQ ID NO: 813829 - protein, 26 aa, Mycobacterium
FVSSFATLLPLRIIDTMLGVPREHEQ

SEQ ID NO: 813830 - protein, 19 aa, Mycobacterium
FVTDLARAIPLPTQFEFMA

SEQ ID NO: 813831 - protein, 29 aa, Mycobacterium
FVTEIAVNFPLYVILSLLGLPEEDFGRMH

SEQ ID NO: 813832 - protein, 24 aa, Mycobacterium
FVTESLQLPLPFLGLEARPYGSIL

SEQ ID NO: 813833 - protein, 18 aa, Mycobacterium
FVTHDISEAILLSQQVWV

SEQ ID NO: 813834 - protein, 18 aa, Mycobacterium
FVTKWDLPVKIGGHLKDP

SEQ ID NO: 813835 - protein, 18 aa, Mycobacterium
FVTKWDLPVKIGGHLKEP

SEQ ID NO: 813836 - protein, 26 aa, Mycobacterium
FVTRMDYLAPFFNETAYCLGVEKLLG

SEQ ID NO: 813837 - protein, 25 aa, Mycobacterium
FVTRMDYLSPFFNETAYCLGVEKLL

SEQ ID NO: 813838 - protein, 20 aa, Mycobacterium
FVTSGWFIGHLPLAVPVGAS

SEQ ID NO: 813839 - protein, 26 aa, Mycobacterium
FVTSHQAHFFPHKAVPKGYGPIAASK

SEQ ID NO: 813840 - protein, 19 aa, Mycobacterium
FVTSLPAYNLTLFLSQLAQ

SEQ ID NO: 813841 - protein, 18 aa, Mycobacterium
FVTTALFNTLIDAVPDCF

SEQ ID NO: 813842 - protein, 19 aa, Mycobacterium
FVTTKFFGMKANKYIHDHH

SEQ ID NO: 813843 - protein, 26 aa, Mycobacterium
FVTYDALPGIPTLPPPAAKKRSRRST

SEQ ID NO: 813844 - protein, 17 aa, Mycobacterium
FVVALLAASRADLVAVP

SEQ ID NO: 813845 - protein, 18 aa, Mycobacterium
FVVAVRTSPDRHTGLSLL

SEQ ID NO: 813846 - protein, 17 aa, Mycobacterium
FVVCNEILPRWGVETVF

SEQ ID NO: 813847 - protein, 18 aa, Mycobacterium
FVVCNEILPRWGVETVFV

SEQ ID NO: 813848 - protein, 20 aa, Mycobacterium
FVVFARTRPADEQGPGIAVF

SEQ ID NO: 813849 - protein, 19 aa, Mycobacterium
FVVFARTRPASDKSPGIAV

SEQ ID NO: 813850 - protein, 17 aa, Mycobacterium
FVVLHPVGVDTSALWSA

SEQ ID NO: 813851 - protein, 17 aa, Mycobacterium
FVVLKDGFTADDDLRLE

SEQ ID NO: 813852 - protein, 20 aa, Mycobacterium
FVVLPDVHIKRDLSVAAVQA

SEQ ID NO: 813853 - protein, 26 aa, Mycobacterium
FVVPEPLSLRPHYIKTLHIWGDNLEA

SEQ ID NO: 813854 - protein, 27 aa, Mycobacterium
FVVPEPLSLRPHYIKTLHIWGDTLESN

SEQ ID NO: 813855 - protein, 20 aa, Mycobacterium
FVVRIPDALPLDAAAPLLCA

SEQ ID NO: 813856 - protein, 17 aa, Mycobacterium
FVVSRKLDKMGWRSSDT

SEQ ID NO: 813857 - protein, 20 aa, Mycobacterium
FVYASPLEQAGWALRAPRIV

SEQ ID NO: 813858 - protein, 20 aa, Mycobacterium
FVYIGEICGYLLNQPPKPTD

SEQ ID NO: 813859 - protein, 17 aa, Mycobacterium
FVYLEELSRRRIYHSFN

SEQ ID NO: 813860 - protein, 17 aa, Mycobacterium
FVYTDVDPSLWGAAEWS

SEQ ID NO: 813861 - protein, 21 aa, Mycobacterium
FWAALWDYFDLGERAQPVLQS

SEQ ID NO: 813862 - protein, 20 aa, Mycobacterium
FWAAVWDYFDLGERPDQVLT

SEQ ID NO: 813863 - protein, 17 aa, Mycobacterium
FWAKLEGFNPGGMKDRP

SEQ ID NO: 813864 - protein, 21 aa, Mycobacterium
FWALLKYEDVRYVSGHPLTFS

SEQ ID NO: 813865 - protein, 31 aa, Mycobacterium
FWAQATRLRDLLKFDFYFADSATFRDHIAEE

SEQ ID NO: 813866 - protein, 18 aa, Mycobacterium
FWASRPRCGHDESILGAP

SEQ ID NO: 813867 - protein, 18 aa, Mycobacterium
FWAVTKHADIMAIERANE

SEQ ID NO: 813868 - protein, 29 aa, Mycobacterium
FWCAADPGWAYGLYTAIAAPMAAGISSIL

SEQ ID NO: 813869 - protein, 19 aa, Mycobacterium
FWDAAAFGLIDKRSLHLSY

SEQ ID NO: 813870 - protein, 24 aa, Mycobacterium
FWDNRATLHLAPRDFEHLDHERVL

SEQ ID NO: 813871 - protein, 26 aa, Mycobacterium
FWDSEGFVLPVLTYTAPHAVADALRW

SEQ ID NO: 813872 - protein, 27 aa, Mycobacterium
FWDTEGYVLPVLTYTAPHTVADALKWR

SEQ ID NO: 813873 - protein, 26 aa, Mycobacterium
FWFDPLCPWAWITSRWILEVEKVRDI

SEQ ID NO: 813874 - protein, 26 aa, Mycobacterium
FWFDPLCPWAWITSRWVLEAEKVRDI

SEQ ID NO: 813875 - protein, 26 aa, Mycobacterium
FWFDPLCPWCWITSRWILEVEKVRDI

SEQ ID NO: 813876 - protein, 18 aa, Mycobacterium
FWFIVDRVKDMIVTGGFN

SEQ ID NO: 813877 - protein, 18 aa, Mycobacterium
FWIAHADPPAPAPEPIVG

SEQ ID NO: 813878 - protein, 17 aa, Mycobacterium
FWKLVTLTGMDVGNDIH

SEQ ID NO: 813879 - protein, 20 aa, Mycobacterium
FWMLTNMGAFWNSMDYLYRP

SEQ ID NO: 813880 - protein, 17 aa, Mycobacterium
FWNAIRHARPIAVGLNC

SEQ ID NO: 813881 - protein, 17 aa, Mycobacterium
FWNSIRHAQPLAVGLNC

SEQ ID NO: 813882 - protein, 18 aa, Mycobacterium
FWRAYRQMADPRNGQLAL

SEQ ID NO: 813883 - protein, 17 aa, Mycobacterium
FWRDYLAGLSAPTMLSR

SEQ ID NO: 813884 - protein, 18 aa, Mycobacterium
FWSSQLPAELTWMAPLLT

SEQ ID NO: 813885 - protein, 19 aa, Mycobacterium
FWTYPEWAPRRVGADQFVV

SEQ ID NO: 813886 - protein, 19 aa, Mycobacterium
FWVKPQWIERRYVDAPPRL

SEQ ID NO: 813887 - protein, 18 aa, Mycobacterium
FWVMGPPTSADEVVSRKA

SEQ ID NO: 813888 - protein, 17 aa, Mycobacterium
FYAAERIYMTAGGVPAG

SEQ ID NO: 813889 - protein, 29 aa, Mycobacterium
FYAAVLHHWPDSAWWNWNRTFDAIETDEG

SEQ ID NO: 813890 - protein, 17 aa, Mycobacterium
FYADLAAMIADQARRAI

SEQ ID NO: 813891 - protein, 18 aa, Mycobacterium
FYAGAIGWCDRNGDGRWA

SEQ ID NO: 813892 - protein, 21 aa, Mycobacterium
FYALPQSPQLFKQLLMVAGME

SEQ ID NO: 813893 - protein, 22 aa, Mycobacterium
FYALPQSPQLFKQLLMVAGMER

SEQ ID NO: 813894 - protein, 21 aa, Mycobacterium
FYDDPVMVWLMPDQNKRTVGL

SEQ ID NO: 813895 - protein, 17 aa, Mycobacterium
FYDFSVPGDVVEVRNSG

SEQ ID NO: 813896 - protein, 18 aa, Mycobacterium
FYDKYYANPDHGRAAVAW

SEQ ID NO: 813897 - protein, 23 aa, Mycobacterium
FYDLDFITPQWSAGPIDAPDPKV

SEQ ID NO: 813898 - protein, 17 aa, Mycobacterium
FYDLVSRIGAKRARRVV

SEQ ID NO: 813899 - protein, 18 aa, Mycobacterium
FYDLVVIGGGPAGLAAAV

SEQ ID NO: 813900 - protein, 18 aa, Mycobacterium
FYDNFGSGDPVVVKNSIG

SEQ ID NO: 813901 - protein, 25 aa, Mycobacterium
FYDYATQWRTWPGYSDDERIAMEFA

SEQ ID NO: 813902 - protein, 17 aa, Mycobacterium
FYEEVLGLEVIQPSSRS

SEQ ID NO: 813903 - protein, 22 aa, Mycobacterium
FYEFHASLMEPWDGPASVCFTD

SEQ ID NO: 813904 - protein, 34 aa, Mycobacterium
FYEGKIAVASFFAKNFLPLLTSTRSIIENLDNEV

SEQ ID NO: 813905 - protein, 26 aa, Mycobacterium
FYEKIFNDFVSRGWLRFVYGGADVGG

SEQ ID NO: 813906 - protein, 19 aa, Mycobacterium
FYEWVLGPSMTYTCAVYPD

SEQ ID NO: 813907 - protein, 22 aa, Mycobacterium
FYEYHASLMEPWDGPASVCFTD

SEQ ID NO: 813908 - protein, 17 aa, Mycobacterium
FYFEFHMKQGEGFLAHM

SEQ ID NO: 813909 - protein, 17 aa, Mycobacterium
FYGADDHGIRYSAPATI

SEQ ID NO: 813910 - protein, 18 aa, Mycobacterium
FYGALGWTPLLDVEGEII

SEQ ID NO: 813911 - protein, 19 aa, Mycobacterium
FYGDLFPHAVRWRGDIYLE

SEQ ID NO: 813912 - protein, 17 aa, Mycobacterium
FYHYFSSKEALVSALAA

SEQ ID NO: 813913 - protein, 20 aa, Mycobacterium
FYLHAKSREQVPETLWPVLK

SEQ ID NO: 813914 - protein, 20 aa, Mycobacterium
FYLKHGFTRSGTKTFLVGER

SEQ ID NO: 813915 - protein, 34 aa, Mycobacterium
FYLSRLQVINWGVFDGYHSIPFSPAGTLITGSSG

SEQ ID NO: 813916 - protein, 27 aa, Mycobacterium
FYMPSNTLAPFLGFLGGAAAADHAADA

SEQ ID NO: 813917 - protein, 19 aa, Mycobacterium
FYNFTPERVAKTLPAVWDL

SEQ ID NO: 813918 - protein, 23 aa, Mycobacterium
FYNLDFITPQWSAGPIDAPDPKV

SEQ ID NO: 813919 - protein, 26 aa, Mycobacterium
FYNTRIEALLIAKLGVRFAETPAKRG

SEQ ID NO: 813920 - protein, 17 aa, Mycobacterium
FYPVPRPRDPLAAATIW

SEQ ID NO: 813921 - protein, 43 aa, Mycobacterium
FYQFLGADTGMWAQWLTLPAAAGPIVLAFNAGHRGRYVESSAP

SEQ ID NO: 813922 - protein, 18 aa, Mycobacterium
FYQKPITLEQHQQSRWII

SEQ ID NO: 813923 - protein, 18 aa, Mycobacterium
FYQLVYNERIAPATEWFG

SEQ ID NO: 813924 - protein, 17 aa, Mycobacterium
FYQRFPEDLKDKAPRIW

SEQ ID NO: 813925 - protein, 20 aa, Mycobacterium
FYRDVLGFKLRDSMRLPPQV

SEQ ID NO: 813926 - protein, 17 aa, Mycobacterium
FYRGRDCMTWLADMGVY

SEQ ID NO: 813927 - protein, 21 aa, Mycobacterium
FYRGRGFLDGQYDDLRPGLRM

SEQ ID NO: 813928 - protein, 21 aa, Mycobacterium
FYRGRGFLEGQYDDLRAGLRM

SEQ ID NO: 813929 - protein, 21 aa, Mycobacterium
FYRHRLDLPEALRRAAVAAAI

SEQ ID NO: 813930 - protein, 17 aa, Mycobacterium
FYRLVAPSAEFTAKFNE

SEQ ID NO: 813931 - protein, 24 aa, Mycobacterium
FYRSPLKYAVYLDDWILFDDTGLK

SEQ ID NO: 813932 - protein, 17 aa, Mycobacterium
FYRVVRDIIDREQPTLG

SEQ ID NO: 813933 - protein, 17 aa, Mycobacterium
FYSAADGYSFEKEKRTA

SEQ ID NO: 813934 - protein, 24 aa, Mycobacterium
FYSPALLNHCLRSYLWGSAYAVRH

SEQ ID NO: 813935 - protein, 19 aa, Mycobacterium
FYSRMYASGLRRVLAARGP

SEQ ID NO: 813936 - protein, 28 aa, Mycobacterium
FYSSYMHLHTRLTRRFNAVIVPGVTSVS

SEQ ID NO: 813937 - protein, 18 aa, Mycobacterium
FYTDMLPEQPPSLQFQQA

SEQ ID NO: 813938 - protein, 36 aa, Mycobacterium
FYTHKIMTPMFTPEPQPYPAPKIFLAAVGDAMTEMC

SEQ ID NO: 813939 - protein, 24 aa, Mycobacterium
FYTHKIMTPMFTPEPQPYSAPKVF

SEQ ID NO: 813940 - protein, 18 aa, Mycobacterium
FYTHWFGLDVSVRDLFPP

SEQ ID NO: 813941 - protein, 17 aa, Mycobacterium
FYTLALFDLDTGEYGTY

SEQ ID NO: 813942 - protein, 18 aa, Mycobacterium
FYVDLDNLKLVHPLIVAV

SEQ ID NO: 813943 - protein, 19 aa, Mycobacterium
FYVLAHPCPMCLGSLYYCS

SEQ ID NO: 813944 - protein, 18 aa, Mycobacterium
FYVNIWKLDGVSGDWALV

SEQ ID NO: 813945 - protein, 17 aa, Mycobacterium
FYVNPTSAAMRAAQSAD

SEQ ID NO: 813946 - protein, 18 aa, Mycobacterium
GAAACLLDPDRTGRFVVV

SEQ ID NO: 813947 - protein, 19 aa, Mycobacterium
GAAAIFPPGTVIADAAIGL

SEQ ID NO: 813948 - protein, 22 aa, Mycobacterium
GAAALDAFTLRVGRPVGPMLAQ

SEQ ID NO: 813949 - protein, 17 aa, Mycobacterium
GAAAPLALLARRARGAG

SEQ ID NO: 813950 - protein, 22 aa, Mycobacterium
GAAAPSTTAIAPLAGDEVSAAV

SEQ ID NO: 813951 - protein, 27 aa, Mycobacterium
GAAAQGFAWPWSICRWVTGENPKFGQL

SEQ ID NO: 813952 - protein, 23 aa, Mycobacterium
GAAARRLGLRPLARIHTTVVVGS

SEQ ID NO: 813953 - protein, 24 aa, Mycobacterium
GAAARVRATLPSGAELLFCQHHAN

SEQ ID NO: 813954 - protein, 27 aa, Mycobacterium
GAAASMLMLFAPGAPRQKYFEGFGALA

SEQ ID NO: 813955 - protein, 23 aa, Mycobacterium
GAAAYLRELAFRDFYAAVLHHWP

SEQ ID NO: 813956 - protein, 32 aa, Mycobacterium
GAACWDARRWLGRPGLDHGASADLLCFARDPR

SEQ ID NO: 813957 - protein, 28 aa, Mycobacterium
GAACWDARRWLGRPGLDHGASADLLCYG

SEQ ID NO: 813958 - protein, 28 aa, Mycobacterium
GAACWDARRWLGRPGLDHGASADLLCYS

SEQ ID NO: 813959 - protein, 26 aa, Mycobacterium
GAADAVLAAWRDSLADTAWVLSRDEA

SEQ ID NO: 813960 - protein, 26 aa, Mycobacterium
GAADAWDPFPEFLGGLRLAGAEVVPV

SEQ ID NO: 813961 - protein, 24 aa, Mycobacterium
GAADGGILLLPAAGQWLLVDAASP

SEQ ID NO: 813962 - protein, 18 aa, Mycobacterium
GAADGWDPFPEFVGGLRA

SEQ ID NO: 813963 - protein, 26 aa, Mycobacterium
GAADKLMRPGGIVDLLTAPGGLLDRV

SEQ ID NO: 813964 - protein, 30 aa, Mycobacterium
GAADLPDRWWNFLALANAIAGGLFVHVPMM

SEQ ID NO: 813965 - protein, 25 aa, Mycobacterium
GAADPPPVPLDAAILFAPVGDLVLP

SEQ ID NO: 813966 - protein, 19 aa, Mycobacterium
GAADTWDPFPEFLNGLRSA

SEQ ID NO: 813967 - protein, 32 aa, Mycobacterium
GAADWSKRPLPPAWLNYAALDVELLIELRAAI

SEQ ID NO: 813968 - protein, 24 aa, Mycobacterium
GAADYLIKPFEFDQLRAKLVAFAA

SEQ ID NO: 813969 - protein, 26 aa, Mycobacterium
GAAEALRWAMMRGEPLVVLADALAEA

SEQ ID NO: 813970 - protein, 22 aa, Mycobacterium
GAAEFIAALPRSAWAVVTSASR

SEQ ID NO: 813971 - protein, 23 aa, Mycobacterium
GAAEGFAMLPRLNPRRAAVVAPG

SEQ ID NO: 813972 - protein, 25 aa, Mycobacterium
GAAELRKAWLELHESWLVAKAGEIG

SEQ ID NO: 813973 - protein, 23 aa, Mycobacterium
GAAEPGWIPPAPAAMSPVGQPMM

SEQ ID NO: 813974 - protein, 23 aa, Mycobacterium
GAAEYVYRFAPLVGIYGGTLEVF

SEQ ID NO: 813975 - protein, 23 aa, Mycobacterium
GAAFPPATMPPVGWIAQDDGRVT

SEQ ID NO: 813976 - protein, 25 aa, Mycobacterium
GAAFPWGIPVLLLTTTGRKTGQQRL

SEQ ID NO: 813977 - protein, 18 aa, Mycobacterium
GAAFVPLEPAWPPSRIAE

SEQ ID NO: 813978 - protein, 20 aa, Mycobacterium
GAAGFEFLPGEPGQLTGERA

SEQ ID NO: 813979 - protein, 20 aa, Mycobacterium
GAAGFLAGFRRLGARHQQFA

SEQ ID NO: 813980 - protein, 26 aa, Mycobacterium
GAAGGIYLPLLGATVSAKAARQLLSH

SEQ ID NO: 813981 - protein, 19 aa, Mycobacterium
GAAGGWFRSSRRPGREWTN

SEQ ID NO: 813982 - protein, 17 aa, Mycobacterium
GAAGLFGAGAAGGAGGA

SEQ ID NO: 813983 - protein, 19 aa, Mycobacterium
GAAGLFGDGAAGGAGGAGG

SEQ ID NO: 813984 - protein, 19 aa, Mycobacterium
GAAGLFGNGAAGGAGGAGG

SEQ ID NO: 813985 - protein, 19 aa, Mycobacterium
GAAGLIGNGGMGGAGGAGA

SEQ ID NO: 813986 - protein, 21 aa, Mycobacterium
GAAGLLLRAPQADGTPAVLLQ

SEQ ID NO: 813987 - protein, 21 aa, Mycobacterium
GAAGLLLRAPQPDGTPAVLLQ

SEQ ID NO: 813988 - protein, 19 aa, Mycobacterium
GAAGLWGNGGAGGHGGSGL

SEQ ID NO: 813989 - protein, 24 aa, Mycobacterium
GAAGPLAYRLYRPASPGPHPVVVY

SEQ ID NO: 813990 - protein, 23 aa, Mycobacterium
GAAGRISHGLGLIGPSVCVDSAC

SEQ ID NO: 813991 - protein, 18 aa, Mycobacterium
GAAGSGIVIEVRGTAHAA

SEQ ID NO: 813992 - protein, 32 aa, Mycobacterium
GAAGTRLRGLVFPTPPAPIVAAGTDALSVAIN

SEQ ID NO: 813993 - protein, 19 aa, Mycobacterium
GAAGWLIGNGGSGGQGGLA

SEQ ID NO: 813994 - protein, 23 aa, Mycobacterium
GAAHAALQVLVEEPWRAQRVLDH

SEQ ID NO: 813995 - protein, 19 aa, Mycobacterium
GAAIAAAAPWLCDDDVVVV

SEQ ID NO: 813996 - protein, 26 aa, Mycobacterium
GAAIDVVLANPLLRAVTIDGDRVGAG

SEQ ID NO: 813997 - protein, 31 aa, Mycobacterium
GAAIGLMDQSWWFPAVAPLPGKAPAVMLAER

SEQ ID NO: 813998 - protein, 26 aa, Mycobacterium
GAAIKQLWLPGPDPEPHYRPSAKLAA

SEQ ID NO: 813999 - protein, 22 aa, Mycobacterium
GAAIRHSIGIWPLVIDDQTVVE

SEQ ID NO: 814000 - protein, 17 aa, Mycobacterium
GAAIRLVAAVLAGVDGS

SEQ ID NO: 814001 - protein, 19 aa, Mycobacterium
GAAIVRLNDAFWTESRTRL

SEQ ID NO: 814002 - protein, 18 aa, Mycobacterium
GAAIWHMAWSDKDDAIDW

SEQ ID NO: 814003 - protein, 18 aa, Mycobacterium
GAAKLGLVGMINTLAQEG

SEQ ID NO: 814004 - protein, 17 aa, Mycobacterium
GAAKLVSSCDLPLTGKA

SEQ ID NO: 814005 - protein, 23 aa, Mycobacterium
GAAKPVMVWLHGGAYMLGSASQA

SEQ ID NO: 814006 - protein, 22 aa, Mycobacterium
GAALADLQLAIQAALNASLGVQ

SEQ ID NO: 814007 - protein, 17 aa, Mycobacterium
GAALALASAPELPIGVR

SEQ ID NO: 814008 - protein, 34 aa, Mycobacterium
GAALATINRLPVLLLPADTFATRVSSPVLQELEL

SEQ ID NO: 814009 - protein, 37 aa, Mycobacterium; identical to SEQ ID NO: 218165

SEQ ID NO: 814010 - protein, 18 aa, Mycobacterium
GAALGAAFLARMAAGLET

SEQ ID NO: 814011 - protein, 24 aa, Mycobacterium
GAALLLDSWALLGRQDLRAAEDTL

SEQ ID NO: 814012 - protein, 25 aa, Mycobacterium
GAALLLDTWALLGRQDLRAAEEALC

SEQ ID NO: 814013 - protein, 22 aa, Mycobacterium
GAALNHCVIALAATGWLAEVHR

SEQ ID NO: 814014 - protein, 23 aa, Mycobacterium
GAALNHCVIALAAVGWHAKVARL

SEQ ID NO: 814015 - protein, 17 aa, Mycobacterium
GAALRIAFRALTLAGVH

SEQ ID NO: 814016 - protein, 21 aa, Mycobacterium
GAALRIAFRALTLAGVHDVAR

SEQ ID NO: 814017 - protein, 28 aa, Mycobacterium
GAALRVPLIAVILRRGYGLGAQAMAGGS

SEQ ID NO: 814018 - protein, 21 aa, Mycobacterium
GAALSVTLLKAVPYGVHLAGL

SEQ ID NO: 814019 - protein, 22 aa, Mycobacterium
GAALTEALASGGPALIDCVIDP

SEQ ID NO: 814020 - protein, 24 aa, Mycobacterium
GAALTRLGFRVIPSDANFVLFGEF

SEQ ID NO: 814021 - protein, 18 aa, Mycobacterium
GAALTWPAGWSVWPERVY

SEQ ID NO: 814022 - protein, 22 aa, Mycobacterium
GAAMNAIRRVFATDNLRLVGLH

SEQ ID NO: 814023 - protein, 25 aa, Mycobacterium
GAAMTGILGGLPGQGGNGGNANWFG

SEQ ID NO: 814024 - protein, 28 aa, Mycobacterium
GAAMVRFIGVDGYRWMIRCVVNGPFERI

SEQ ID NO: 814025 - protein, 28 aa, Mycobacterium
GAAPAQIGLAWLLAHAPNILLIAGTSSI

SEQ ID NO: 814026 - protein, 18 aa, Mycobacterium
GAAPCIAFVFPGQGNQWQ

SEQ ID NO: 814027 - protein, 18 aa, Mycobacterium
GAAPIRPTARRIAQRWVR

SEQ ID NO: 814028 - protein, 18 aa, Mycobacterium
GAAPLVLISAGIGITPMI

SEQ ID NO: 814029 - protein, 22 aa, Mycobacterium
GAAPPIVFQLLHQPVLDDRPTR

SEQ ID NO: 814030 - protein, 27 aa, Mycobacterium
GAAPRRWRSQLPLWGDVSFESVAPALR

SEQ ID NO: 814031 - protein, 22 aa, Mycobacterium
GAAPWRELFTPAVQLADDGFEI

SEQ ID NO: 814032 - protein, 20 aa, Mycobacterium
GAAQILNGASAATATGGAGG

SEQ ID NO: 814033 - protein, 21 aa, Mycobacterium
GAAQLLMKRFPDPNAPEAQAI

SEQ ID NO: 814034 - protein, 25 aa, Mycobacterium
GAAQRAGLELLAWGGRFVEIGKRDI

SEQ ID NO: 814035 - protein, 29 aa, Mycobacterium
GAARKAGRRFALLAPIVATHRKLVAARED

SEQ ID NO: 814036 - protein, 32 aa, Mycobacterium
GAARKVGRRFAQVSPIVACYRKLEAARGDLEA

SEQ ID NO: 814037 - protein, 19 aa, Mycobacterium
GAARLFGTGGTGGAGGVGG

SEQ ID NO: 814038 - protein, 28 aa, Mycobacterium
GAARLSAFSVLLEMLGRPPLKSATREEQ

SEQ ID NO: 814039 - protein, 21 aa, Mycobacterium
GAASFTRSFARYEPMPESAAA

SEQ ID NO: 814040 - protein, 23 aa, Mycobacterium
GAASPWPAVPWVVSGKSGQALAA

SEQ ID NO: 814041 - protein, 26 aa, Mycobacterium
GAASRLFLRYVIFGGEMLTFADLIPW

SEQ ID NO: 814042 - protein, 18 aa, Mycobacterium
GAASVLNSASIATATSGS

SEQ ID NO: 814043 - protein, 31 aa, Mycobacterium
GAATDLLDEAWWFPAIQWPDGRMQFMLNERM

SEQ ID NO: 814044 - protein, 31 aa, Mycobacterium
GAATDLLNEAWWFPAIQWPDGRMQFMLNERM

SEQ ID NO: 814045 - protein, 24 aa, Mycobacterium
GAATLPLPALSQLNTRLLRYFVKR

SEQ ID NO: 814046 - protein, 38 aa, Mycobacterium
GAAVDFSVLYPAGRLVNAPLPAWTHRRFFVDGEGQDSK

SEQ ID NO: 814047 - protein, 36 aa, Mycobacterium
GAAVELITESLRRGGRLIYLGAGTSGRIGLLDAVEC

SEQ ID NO: 814048 - protein, 19 aa, Mycobacterium
GAAVLWRASFRFIGRDTEV

SEQ ID NO: 814049 - protein, 28 aa, Mycobacterium
GAAVMPPTLLHTWFELLSPEQIVMAYGM

SEQ ID NO: 814050 - protein, 25 aa, Mycobacterium
GAAVPLGILPARVAEFLAAIEAPIA

SEQ ID NO: 814051 - protein, 25 aa, Mycobacterium
GAAVPLLVAVVGFPELLVAGGGLAV

SEQ ID NO: 814052 - protein, 27 aa, Mycobacterium
GAAVRHDLRPWPTYYRHRLKERICTNV

SEQ ID NO: 814053 - protein, 19 aa, Mycobacterium
GAAVWGLVRSAQAEHPGRI

SEQ ID NO: 814054 - protein, 23 aa, Mycobacterium
GAAYLEGFAWGLSRGYSVLVEMD

SEQ ID NO: 814055 - protein, 18 aa, Mycobacterium
GAAYLPIDPALPAARMEF

SEQ ID NO: 814056 - protein, 17 aa, Mycobacterium
GAAYPRPGLRGKFYDAR

SEQ ID NO: 814057 - protein, 21 aa, Mycobacterium
GACAGFFRHPPRVPPNRADVV

SEQ ID NO: 814058 - protein, 26 aa, Mycobacterium
GACARAGLLCLPTLSTHGYEVIARSA

SEQ ID NO: 814059 - protein, 26 aa, Mycobacterium
GACFNTWLVWAQHAPTVGRLALSWQK

SEQ ID NO: 814060 - protein, 17 aa, Mycobacterium
GACHSWLIGNPRRGADS

SEQ ID NO: 814061 - protein, 18 aa, Mycobacterium
GACRAAGVGFSFGYPVDW

SEQ ID NO: 814062 - protein, 20 aa, Mycobacterium
GACRFLGGYLTARLAQNPLI

SEQ ID NO: 814063 - protein, 22 aa, Mycobacterium
GACRFLGGYLTARLAQNPLINH

SEQ ID NO: 814064 - protein, 21 aa, Mycobacterium
GACRYCRQGHYGQCLGGGGWI

SEQ ID NO: 814065 - protein, 19 aa, Mycobacterium
GACTVACPEVFVITDDGYA

SEQ ID NO: 814066 - protein, 19 aa, Mycobacterium
GACWRPELAAMFNQGAVTD

SEQ ID NO: 814067 - protein, 27 aa, Mycobacterium
GADAFRSWRLLVSRYGSPAPGPAPDKM

SEQ ID NO: 814068 - protein, 21 aa, Mycobacterium
GADALVLPGGFPEQFTAELSA

SEQ ID NO: 814069 - protein, 26 aa, Mycobacterium
GADAMIEWRWFELEAFIYGDALTPMA

SEQ ID NO: 814070 - protein, 25 aa, Mycobacterium
GADARTPMFLLNRVSYDQDDVAIEQ

SEQ ID NO: 814071 - protein, 23 aa, Mycobacterium
GADATLIIASAYLPQHEDARAAD

SEQ ID NO: 814072 - protein, 29 aa, Mycobacterium
GADATTVGLFTYPVLMAADVLLYDTHVVP

SEQ ID NO: 814073 - protein, 24 aa, Mycobacterium
GADATVFEPFAGNGGHGGAGGGGG

SEQ ID NO: 814074 - protein, 24 aa, Mycobacterium
GADERACLVLADRGYPTAHRAAVV

SEQ ID NO: 814075 - protein, 24 aa, Mycobacterium
GADESAVLLLPVGETWLLVDAGAD

SEQ ID NO: 814076 - protein, 29 aa, Mycobacterium
GADEVSAAISFLFGAHAQAYQALSAQAAS

SEQ ID NO: 814077 - protein, 50 aa, Mycobacterium
GADEVSVAIAGLLRLHGQQYQQFGAHLSEFHARFTQMLSAGANEYSLAEA

SEQ ID NO: 814078 - protein, 53 aa, Mycobacterium
GADEVSVGIAALFTDHAQQYDVVLREFLDGLQGGFGRTLDTAAKAYASAEAAS

SEQ ID NO: 814079 - protein, 20 aa, Mycobacterium
GADFFVFSGHKIYGPTGIGV

SEQ ID NO: 814080 - protein, 26 aa, Mycobacterium
GADFIFSGFGSIPRYDNAFALSNFNS

SEQ ID NO: 814081 - protein, 27 aa, Mycobacterium
GADFKRPSPHWWFDDDTLYGPDGLALP

SEQ ID NO: 814082 - protein, 22 aa, Mycobacterium
GADFLLALAVAYEVQCRFSAQV

SEQ ID NO: 814083 - protein, 23 aa, Mycobacterium
GADFLLALAVAYEVQCRFSTQVP

SEQ ID NO: 814084 - protein, 22 aa, Mycobacterium
GADFPAGWQKLNGPQALSFVRQ

SEQ ID NO: 814085 - protein, 25 aa, Mycobacterium
GADFPAGWQKLNGTQALSFVRQRHD

SEQ ID NO: 814086 - protein, 25 aa, Mycobacterium
GADGKEWMSIWPTTASGLRDDLANL

SEQ ID NO: 814087 - protein, 25 aa, Mycobacterium
GADGLTFTGLMAIPPLGADADEAFA

SEQ ID NO: 814088 - protein, 29 aa, Mycobacterium
GADGQPHLVAMWYAVLNGEVWFETKAKSQ

SEQ ID NO: 814089 - protein, 25 aa, Mycobacterium
GADGTPGGWLLGDGGAGGSAVAGSD

SEQ ID NO: 814090 - protein, 25 aa, Mycobacterium
GADGTPGGWLLGDGGAGGSGLAGRD

SEQ ID NO: 814091 - protein, 24 aa, Mycobacterium
GADGWVQAYDPAGPVGSKIANSSA

SEQ ID NO: 814092 - protein, 31 aa, Mycobacterium
GADIALMDQAWWFPAIAPLPGKAPAVMLAER

SEQ ID NO: 814093 - protein, 21 aa, Mycobacterium
GADIHAAVETLGPIMHEVKSA

SEQ ID NO: 814094 - protein, 18 aa, Mycobacterium
GADIILVETIFDSLNAKA

SEQ ID NO: 814095 - protein, 18 aa, Mycobacterium
GADIPFLHLVADIDAHEV

SEQ ID NO: 814096 - protein, 22 aa, Mycobacterium
GADIPFLHLVYDIDPADVRMGM

SEQ ID NO: 814097 - protein, 34 aa, Mycobacterium
GADIRGYFVWSLLDNFEWAYGYAKRFGLIHVDYA

SEQ ID NO: 814098 - protein, 20 aa, Mycobacterium
GADIYTFIADVEWTPFGIHK

SEQ ID NO: 814099 - protein, 24 aa, Mycobacterium
GADKKFVSQLQWKQAHLTPTRMMS

SEQ ID NO: 814100 - protein, 22 aa, Mycobacterium
GADLAGVFYLRTAADGEMIREA

SEQ ID NO: 814101 - protein, 25 aa, Mycobacterium
GADLHRIPLLPVSMFKQAGAHVLMT

SEQ ID NO: 814102 - protein, 23 aa, Mycobacterium
GADLILSSWMYPGLAANVGEYYG

SEQ ID NO: 814103 - protein, 23 aa, Mycobacterium
GADLITYFLDAPGSLVTFFVDAP

SEQ ID NO: 814104 - protein, 29 aa, Mycobacterium
GADLIWVLPTGYPCALPKAPRGALAMAIH

SEQ ID NO: 814105 - protein, 23 aa, Mycobacterium
GADLLALTLLTPPGEIGADIAFG

SEQ ID NO: 814106 - protein, 23 aa, Mycobacterium
GADLLEYKPYLPQALHDDFDAWA

SEQ ID NO: 814107 - protein, 34 aa, Mycobacterium
GADLPDYLREATAWLQLATAALIQLRAPVVTAVQ

SEQ ID NO: 814108 - protein, 24 aa, Mycobacterium
GADLPTQSELFVHAGRIFRDLTEL

SEQ ID NO: 814109 - protein, 24 aa, Mycobacterium
GADLSRLALIPRPGLSAVEVASVL

SEQ ID NO: 814110 - protein, 20 aa, Mycobacterium
GADLVLIYLVQNMPDMSADV

SEQ ID NO: 814111 - protein, 28 aa, Mycobacterium
GADMDDILWQVPYLPIDPKDVGRTYEAV

SEQ ID NO: 814112 - protein, 25 aa, Mycobacterium
GADNARLHWPPRPEPPRTDEADALP

SEQ ID NO: 814113 - protein, 32 aa, Mycobacterium
GADPGPWDQLALAPLVCLLYAASPAATGLGMR

SEQ ID NO: 814114 - protein, 23 aa, Mycobacterium
GADPVIMLTAPIPATQKALKRSG

SEQ ID NO: 814115 - protein, 20 aa, Mycobacterium
GADPVLMLTGPIPATEKVLG

SEQ ID NO: 814116 - protein, 24 aa, Mycobacterium
GADPVMMLTAPIPATRHALKRTGL

SEQ ID NO: 814117 - protein, 26 aa, Mycobacterium
GADPWWDIAIRMLIKYKNLRLMTSAW

SEQ ID NO: 814118 - protein, 25 aa, Mycobacterium
GADRGAITPVVHCELPLADAASAHA

SEQ ID NO: 814119 - protein, 24 aa, Mycobacterium
GADRSLQWFIEDVLGLFDVDPKNH

SEQ ID NO: 814120 - protein, 36 aa, Mycobacterium
GADRTLTTVAFERLGRAWPALGWAAVQAHTAIDVLA

SEQ ID NO: 814121 - protein, 22 aa, Mycobacterium
GADRWGICDFEISNNARLGTAP

SEQ ID NO: 814122 - protein, 23 aa, Mycobacterium
GADSGMLAALYVLAALGEQDRPL

SEQ ID NO: 814123 - protein, 17 aa, Mycobacterium
GADSLLRMRLDLVECAT

SEQ ID NO: 814124 - protein, 27 aa, Mycobacterium
GADSPRETWLRLRLTDAGLPPDSTQIP

SEQ ID NO: 814125 - protein, 17 aa, Mycobacterium
GADSTTVGLFTYPVLQA

SEQ ID NO: 814126 - protein, 25 aa, Mycobacterium
GADSYWLPDHLNAFLPRAVMTPKYS

SEQ ID NO: 814127 - protein, 28 aa, Mycobacterium
GADTAVELILHLPLIVAIANTAHPLDPA

SEQ ID NO: 814128 - protein, 23 aa, Mycobacterium
GADTAVWLAATRPAPLSGTFWHD

SEQ ID NO: 814129 - protein, 31 aa, Mycobacterium
GADTGLMDQAWWFPAFAPLPGGEPTVMLAER

SEQ ID NO: 814130 - protein, 31 aa, Mycobacterium
GADTVAWLREQPWFTGRFATLGLSYLGFTQW

SEQ ID NO: 814131 - protein, 29 aa, Mycobacterium
GADTVEWLRRQPWFTGRFATIGVSYLGFT

SEQ ID NO: 814132 - protein, 22 aa, Mycobacterium
GADTVLVHPFDVAIAGGFPGTA

SEQ ID NO: 814133 - protein, 35 aa, Mycobacterium
GADTWILDQLFPADRALPLVTVLDGHPHTLAFLAN

SEQ ID NO: 814134 - protein, 21 aa, Mycobacterium
GADVLLLNTSFAGPALAEVLQ

SEQ ID NO: 814135 - protein, 25 aa, Mycobacterium
GADVNTLVILLPETPKLDGRAAAAE

SEQ ID NO: 814136 - protein, 18 aa, Mycobacterium
GADVPLLGQIPLDPELVA

SEQ ID NO: 814137 - protein, 19 aa, Mycobacterium
GADVRFVYSPLDALKVAID

SEQ ID NO: 814138 - protein, 23 aa, Mycobacterium
GADVVAIARPLLAPAIESATAVQ

SEQ ID NO: 814139 - protein, 24 aa, Mycobacterium
GADWDAAVEAWKLLRTDEGAQFDT

SEQ ID NO: 814140 - protein, 17 aa, Mycobacterium
GADWFRPKAMRDLKVRV

SEQ ID NO: 814141 - protein, 20 aa, Mycobacterium
GADWPRLVAPVFEPKKAVLF

SEQ ID NO: 814142 - protein, 17 aa, Mycobacterium
GADWPVEYGGRDDYHPL

SEQ ID NO: 814143 - protein, 24 aa, Mycobacterium
GADYPRIDLLINNAGVMYPPKSLT

SEQ ID NO: 814144 - protein, 28 aa, Mycobacterium
GADYRALPDFWVWYVPPNENAAGWGPHR

SEQ ID NO: 814145 - protein, 26 aa, Mycobacterium
GAEAFRSWRLLVTRYGTPAPGPAPDG

SEQ ID NO: 814146 - protein, 25 aa, Mycobacterium
GAEALALLRLPMVLPTVQLAGKVLG

SEQ ID NO: 814147 - protein, 31 aa, Mycobacterium
GAEALVRWRHPVWGLLLPDSFIGIAESTNLA

SEQ ID NO: 814148 - protein, 30 aa, Mycobacterium
GAEATTVGLFTYPVLMAADVLLYDTELVPV

SEQ ID NO: 814149 - protein, 24 aa, Mycobacterium
GAEAWRAWRYLINNVGIDLGGAKT

SEQ ID NO: 814150 - protein, 20 aa, Mycobacterium
GAEDLLKRLLPTGRICASTD

SEQ ID NO: 814151 - protein, 25 aa, Mycobacterium
GAEFEPLLTLWRSAAIQPQARKILH

SEQ ID NO: 814152 - protein, 24 aa, Mycobacterium
GAEFPLDDALRLLEAHLAEIDLVI

SEQ ID NO: 814153 - protein, 28 aa, Mycobacterium
GAEGLDLAIIYLPPPYDPAVLEPLAQAI

SEQ ID NO: 814154 - protein, 29 aa, Mycobacterium
GAEGLDLAIIYLPPPYDPAVLEPLAQALR

SEQ ID NO: 814155 - protein, 28 aa, Mycobacterium
GAEHITLPSIYFAHRRKVFKRDGMLLAV

SEQ ID NO: 814156 - protein, 25 aa, Mycobacterium
GAEIVLFPGRLPVPAPQLARVAAHA

SEQ ID NO: 814157 - protein, 17 aa, Mycobacterium
GAELARGLARRGFPLLL

SEQ ID NO: 814158 - protein, 29 aa, Mycobacterium
GAELDELRRLIPPWVTLGSRMATMPKPQR

SEQ ID NO: 814159 - protein, 19 aa, Mycobacterium
GAELLERLGYRDVSVLADG

SEQ ID NO: 814160 - protein, 18 aa, Mycobacterium
GAELLLELVDLHNQARAE

SEQ ID NO: 814161 - protein, 31 aa, Mycobacterium
GAELRRFVAGWLGPAILYPRLARAVDAITAP

SEQ ID NO: 814162 - protein, 17 aa, Mycobacterium
GAELTWIGPPVAAVAAM

SEQ ID NO: 814163 - protein, 26 aa, Mycobacterium
GAELVALHAWTDMGPLDFPSINWAPI

SEQ ID NO: 814164 - protein, 35 aa, Mycobacterium
GAELVKITPMDFLGDILLWPRLIHKYRGTMTAAPN

SEQ ID NO: 814165 - protein, 24 aa, Mycobacterium
GAEPALIGLALRSPDLDATVSAIR

SEQ ID NO: 814166 - protein, 18 aa, Mycobacterium
GAEPLFLQDYIAVGRTVP

SEQ ID NO: 814167 - protein, 26 aa, Mycobacterium
GAEPLPEFPTLFARWPSTLTVDGAQI

SEQ ID NO: 814168 - protein, 19 aa, Mycobacterium
GAEQIKLPSIYYAHERKVF

SEQ ID NO: 814169 - protein, 23 aa, Mycobacterium
GAEQLVWLASSRPGVDWTSGEYY

SEQ ID NO: 814170 - protein, 26 aa, Mycobacterium
GAERGGQLRWFGLDGVEHTGGPLVDF

SEQ ID NO: 814171 - protein, 24 aa, Mycobacterium
GAERILFTHIAVPVMTRLKQPERQ

SEQ ID NO: 814172 - protein, 21 aa, Mycobacterium
GAERLAALVGKSKALLLAGSG

SEQ ID NO: 814173 - protein, 23 aa, Mycobacterium
GAERLRLIGAVNYLGVVDLLTRW

SEQ ID NO: 814174 - protein, 28 aa, Mycobacterium
GAESPRETWLRLLLIDAGYPAPQTQMAV

SEQ ID NO: 814175 - protein, 33 aa, Mycobacterium
GAESPRETWLRLLLIRAGFPRPQTQIPVYDYGA

SEQ ID NO: 814176 - protein, 23 aa, Mycobacterium
GAETLSLGDYRMLPRATFCQPQV

SEQ ID NO: 814177 - protein, 24 aa, Mycobacterium
GAEVLFVYDFRSSALRETWSAADS

SEQ ID NO: 814178 - protein, 24 aa, Mycobacterium
GAEVVAIARPLLAPAVESVGAVVD

SEQ ID NO: 814179 - protein, 26 aa, Mycobacterium
GAEVVPIRVYRWHPAPPGGEFDQLVA

SEQ ID NO: 814180 - protein, 27 aa, Mycobacterium
GAEVVPIRVYRWKPTPLGGAFDQLVTE

SEQ ID NO: 814181 - protein, 27 aa, Mycobacterium
GAEVVPIRVYRWKPTPLGGEFDQLVAG

SEQ ID NO: 814182 - protein, 18 aa, Mycobacterium
GAEWYLAEHLRQGIKDVE

SEQ ID NO: 814183 - protein, 21 aa, Mycobacterium
GAEYVYRFAPLVGIYGGTLEV

SEQ ID NO: 814184 - protein, 20 aa, Mycobacterium
GAFACFGMSRREGLWAAGAA

SEQ ID NO: 814185 - protein, 24 aa, Mycobacterium
GAFDILLAAYSLAATLWQIANPPE

SEQ ID NO: 814186 - protein, 22 aa, Mycobacterium
GAFEMAATVDYLFGYDATAHVM

SEQ ID NO: 814187 - protein, 22 aa, Mycobacterium
GAFEMAATVDYLFGYDATANVM

SEQ ID NO: 814188 - protein, 22 aa, Mycobacterium
GAFEMAATVDYLFGYDATAQVM

SEQ ID NO: 814189 - protein, 18 aa, Mycobacterium
GAFGCFGMSRREGLWAAG

SEQ ID NO: 814190 - protein, 21 aa, Mycobacterium
GAFGFLLTMLGQDCGWPVPVG

SEQ ID NO: 814191 - protein, 19 aa, Mycobacterium
GAFGRFLPAWQMVGADSAS

SEQ ID NO: 814192 - protein, 34 aa, Mycobacterium
GAFHESLNMAALWKLPVLFLCENNLYAMGTALHR

SEQ ID NO: 814193 - protein, 25 aa, Mycobacterium
GAFKPPLRWGIRMTGHKFLREYPYR

SEQ ID NO: 814194 - protein, 17 aa, Mycobacterium
GAFLLCGFMMALAEHQQ

SEQ ID NO: 814195 - protein, 17 aa, Mycobacterium
GAFLLGYSIAHLKYFAS

SEQ ID NO: 814196 - protein, 25 aa, Mycobacterium
GAFLPLHLLCLRDMGLMLGEYWDLT

SEQ ID NO: 814197 - protein, 23 aa, Mycobacterium
GAFNYDPIFFPSGVSNIVGNPGF

SEQ ID NO: 814198 - protein, 20 aa, Mycobacterium
GAFRIPEMIRWPGKISAGVV

SEQ ID NO: 814199 - protein, 26 aa, Mycobacterium
GAFRSRKGLLEVPRLGPKAFEQCAGF

SEQ ID NO: 814200 - protein, 19 aa, Mycobacterium
GAFRVPVPPEFGPVRVRFL

SEQ ID NO: 814201 - protein, 23 aa, Mycobacterium
GAFRYVMMVLRHIPRPIFRKLPI

SEQ ID NO: 814202 - protein, 23 aa, Mycobacterium
GAFRYVMMVLRHIPRPVFRKLPI

SEQ ID NO: 814203 - protein, 22 aa, Mycobacterium
GAFSLPQLGIPSLTIPSLTVPA

SEQ ID NO: 814204 - protein, 25 aa, Mycobacterium
GAFSYAHVMAIMAFIKGIGSGTHFY

SEQ ID NO: 814205 - protein, 19 aa, Mycobacterium
GAFTDQIVPVFPAAATVVD

SEQ ID NO: 814206 - protein, 19 aa, Mycobacterium
GAFVNWEGRYREFEPSLRG

SEQ ID NO: 814207 - protein, 25 aa, Mycobacterium
GAFVNWEGRYRGFKPALHGTTAQAG

SEQ ID NO: 814208 - protein, 30 aa, Mycobacterium
GAFWHIDYMFMPEPFAFSMVLPLAVPGHDR

SEQ ID NO: 814209 - protein, 28 aa, Mycobacterium
GAFWHVDYMFMPKPFAFSMVLPLAVPGH

SEQ ID NO: 814210 - protein, 19 aa, Mycobacterium
GAFWSSWPGRQLWWSYYMR

SEQ ID NO: 814211 - protein, 17 aa, Mycobacterium
GAGADCGRCRRTVRAII

SEQ ID NO: 814212 - protein, 31 aa, Mycobacterium
GAGANPCLLTPPPWYPILRGTTQQALFEVAR

SEQ ID NO: 814213 - protein, 23 aa, Mycobacterium
GAGAPAMPSLGISAGSGGVGGAG

SEQ ID NO: 814214 - protein, 28 aa, Mycobacterium
GAGAQGAPAQFGSTGFAGGDGGAGGDGG

SEQ ID NO: 814215 - protein, 28 aa, Mycobacterium
GAGASYGVAAIDFVLAGDGGAGGAATTG

SEQ ID NO: 814216 - protein, 23 aa, Mycobacterium
GAGAYGYFEPYDDWLAEYTAAKF

SEQ ID NO: 814217 - protein, 25 aa, Mycobacterium
GAGCPIKVRLLVTAMRHAAMSREIA

SEQ ID NO: 814218 - protein, 28 aa, Mycobacterium
GAGDLALWLELRTPRWVSAEDRLLVTVL

SEQ ID NO: 814219 - protein, 19 aa, Mycobacterium
GAGDQLFLSTAGPGQPFAG

SEQ ID NO: 814220 - protein, 25 aa, Mycobacterium
GAGDTLLSIPVPAAGIRAYTGAIED

SEQ ID NO: 814221 - protein, 22 aa, Mycobacterium
GAGDWWPLRDERIPPDVSMSAG

SEQ ID NO: 814222 - protein, 28 aa, Mycobacterium
GAGEAILTGWRMLLDAGRLQDGEPHLAG

SEQ ID NO: 814223 - protein, 25 aa, Mycobacterium
GAGELDLVLAILRARQLFGGEQTVP

SEQ ID NO: 814224 - protein, 21 aa, Mycobacterium
GAGERALLPDALYTEAGATIG

SEQ ID NO: 814225 - protein, 25 aa, Mycobacterium
GAGFANLPVHRILLQDSGMNIIEAM

SEQ ID NO: 814226 - protein, 26 aa, Mycobacterium
GAGFTLPSLFGVGLMPSFQLGTAPGA

SEQ ID NO: 814227 - protein, 18 aa, Mycobacterium
GAGFVPDLLLSTWDLRPW

SEQ ID NO: 814228 - protein, 24 aa, Mycobacterium
GAGGAAGWWGAGGAGGQGGTGGMA

SEQ ID NO: 814229 - protein, 26 aa, Mycobacterium
GAGGAAVGLFGNGGIGGAGGGAEGLN

SEQ ID NO: 814230 - protein, 26 aa, Mycobacterium
GAGGAGGVGGLLFGAGGAGGAGGTGT

SEQ ID NO: 814231 - protein, 34 aa, Mycobacterium
GAGGAGGVGGVDRALIGWSGGAGGVGGSGGAGGL

SEQ ID NO: 814232 - protein, 23 aa, Mycobacterium
GAGGAGWDATAAGVLAATGGDGG

SEQ ID NO: 814233 - protein, 29 aa, Mycobacterium
GAGGANSQLLSLWGSAGAGGAGGIGGAGG

SEQ ID NO: 814234 - protein, 25 aa, Mycobacterium
GAGGAPGTGLIPGSTGAAGATGRAG

SEQ ID NO: 814235 - protein, 27 aa, Mycobacterium
GAGGASAIPLGPDLIGKGGAGGAGGSG

SEQ ID NO: 814236 - protein, 27 aa, Mycobacterium
GAGGAVTGSINPLGNAGAHGANGTGGV

SEQ ID NO: 814237 - protein, 25 aa, Mycobacterium
GAGGDAGLLGLNGAGGHGGGGGMGG

SEQ ID NO: 814238 - protein, 23 aa, Mycobacterium
GAGGDAWLFGSGGSGGGGGAGAI

SEQ ID NO: 814239 - protein, 28 aa, Mycobacterium
GAGGDGGLGGLGGFGGSGGTGGQGGLGG

SEQ ID NO: 814240 - protein, 28 aa, Mycobacterium
GAGGDGSFLWDSPPNTNVYIGDAGGAGG

SEQ ID NO: 814241 - protein, 25 aa, Mycobacterium
GAGGDWFDAVPLGDRLVLIVGDVVG

SEQ ID NO: 814242 - protein, 32 aa, Mycobacterium
GAGGGIAHRLGMRPSWVLDLHNGGCAAFVLAL

SEQ ID NO: 814243 - protein, 21 aa, Mycobacterium
GAGGHGGMLFGDGGAGGGGGD

SEQ ID NO: 814244 - protein, 23 aa, Mycobacterium
GAGGHGGWLYGNGGVGGVGGTGG

SEQ ID NO: 814245 - protein, 21 aa, Mycobacterium
GAGGIGGNGGFFGNGGAGGAG

SEQ ID NO: 814246 - protein, 18 aa, Mycobacterium
GAGGKAWLMGDGGSGGHG

SEQ ID NO: 814247 - protein, 18 aa, Mycobacterium
GAGGLFNAGGAGGAGGTS

SEQ ID NO: 814248 - protein, 17 aa, Mycobacterium
GAGGLGETGTTGGAGGV

SEQ ID NO: 814249 - protein, 18 aa, Mycobacterium
GAGGLLFGTGGSGGDGGL

SEQ ID NO: 814250 - protein, 19 aa, Mycobacterium
GAGGLLRLPNRIPYQVAME

SEQ ID NO: 814251 - protein, 27 aa, Mycobacterium
GAGGMSGLLLGLDGYNAPTSTSPIHVA

SEQ ID NO: 814252 - protein, 24 aa, Mycobacterium
GAGGNAGFLFGSGGIGGPGGFAVA

SEQ ID NO: 814253 - protein, 24 aa, Mycobacterium
GAGGNAGLLFSAGGVGGAGGYGSS

SEQ ID NO: 814254 - protein, 25 aa, Mycobacterium
GAGGNALGLFGHGGAGGAGGYDVTT

SEQ ID NO: 814255 - protein, 23 aa, Mycobacterium
GAGGNGGLWGAGGIGGNGGYGTT

SEQ ID NO: 814256 - protein, 24 aa, Mycobacterium
GAGGNGGWLLSNGGVGGAGGAGAD

SEQ ID NO: 814257 - protein, 24 aa, Mycobacterium
GAGGRGGLVFGGGGAGGAGGDGGT

SEQ ID NO: 814258 - protein, 25 aa, Mycobacterium
GAGGSAAFFGNGGAGGHGGAGGAGG

SEQ ID NO: 814259 - protein, 23 aa, Mycobacterium
GAGGSAGLWGAGGAGGAGGSATT

SEQ ID NO: 814260 - protein, 26 aa, Mycobacterium
GAGGSAVGWFGDGGAGGAGGPVVPTA

SEQ ID NO: 814261 - protein, 24 aa, Mycobacterium
GAGGTGAWLFGNGGSGGAGGAGGM

SEQ ID NO: 814262 - protein, 23 aa, Mycobacterium
GAGGTGGWLYGSGGSGGIGGVGG

SEQ ID NO: 814263 - protein, 26 aa, Mycobacterium
GAGGVGLLLTQWATSLAASVITTVST

SEQ ID NO: 814264 - protein, 18 aa, Mycobacterium
GAGGWIYGHGGDGGIGGA

SEQ ID NO: 814265 - protein, 18 aa, Mycobacterium
GAGGWLFGDGGTGGTGGD

SEQ ID NO: 814266 - protein, 19 aa, Mycobacterium
GAGGWLFGQGGAGGNGGTA

SEQ ID NO: 814267 - protein, 35 aa, Mycobacterium
GAGICQWFHGDATYRAVLALLLLTGSMGRNGGGWA

SEQ ID NO: 814268 - protein, 31 aa, Mycobacterium
GAGIDLMDQAWWFPAIAPLPGKAPAVMLAER

SEQ ID NO: 814269 - protein, 27 aa, Mycobacterium
GAGIGPISIPILDLPTAPGFGNATDSP

SEQ ID NO: 814270 - protein, 23 aa, Mycobacterium
GAGIRPPWSLGEPQPELATLIEQ

SEQ ID NO: 814271 - protein, 25 aa, Mycobacterium
GAGKSTLLRILAGDLQPLSGTVGVA

SEQ ID NO: 814272 - protein, 24 aa, Mycobacterium
GAGKSTLLRLLLGRQEPDEGRASL

SEQ ID NO: 814273 - protein, 25 aa, Mycobacterium
GAGKSTLLRLLLGRQQPDEGRASLG

SEQ ID NO: 814274 - protein, 26 aa, Mycobacterium
GAGKTTILEAIHLALYGPLSQARSRR

SEQ ID NO: 814275 - protein, 31 aa, Mycobacterium
GAGKTTLLEAINLALYGPLTQTAARKSGGYE

SEQ ID NO: 814276 - protein, 21 aa, Mycobacterium
GAGLACIGLLSGGIAREELQA

SEQ ID NO: 814277 - protein, 17 aa, Mycobacterium
GAGLALALVLDGCGKQV

SEQ ID NO: 814278 - protein, 30 aa, Mycobacterium
GAGLDPFEVAALWNALRKGGVPTAGPGTTM

SEQ ID NO: 814279 - protein, 26 aa, Mycobacterium
GAGLDTRAWRLSWPDAVTVYELEQPN

SEQ ID NO: 814280 - protein, 26 aa, Mycobacterium
GAGLERIMRLLSQPGLDPDAHIDLAE

SEQ ID NO: 814281 - protein, 19 aa, Mycobacterium
GAGLFPKLAEPTAPLPPPT

SEQ ID NO: 814282 - protein, 26 aa, Mycobacterium
GAGLGKDVLLLTDGRFSGGTTGLCVG

SEQ ID NO: 814283 - protein, 22 aa, Mycobacterium
GAGLGLVLLGADPLRPAGRVNP

SEQ ID NO: 814284 - protein, 23 aa, Mycobacterium
GAGLITVPLWSTVLARRALGLPW

SEQ ID NO: 814285 - protein, 25 aa, Mycobacterium
GAGLLAMPQAPIYGAAKAGLQNLTG

SEQ ID NO: 814286 - protein, 28 aa, Mycobacterium
GAGLLFNDLTVYFALTVRGRLAEGETVL

SEQ ID NO: 814287 - protein, 20 aa, Mycobacterium
GAGLNLALAADVRIAGPAAL

SEQ ID NO: 814288 - protein, 18 aa, Mycobacterium
GAGLNLALAADVRIAGPH

SEQ ID NO: 814289 - protein, 19 aa, Mycobacterium
GAGLNLALAADVRIAGPHA

SEQ ID NO: 814290 - protein, 24 aa, Mycobacterium
GAGLPLPHLLVAATAATVTRWRRS

SEQ ID NO: 814291 - protein, 18 aa, Mycobacterium
GAGLTLALAADWRISGDN

SEQ ID NO: 814292 - protein, 18 aa, Mycobacterium
GAGLTLALAADWRVSGDN

SEQ ID NO: 814293 - protein, 19 aa, Mycobacterium
GAGLTLALAADWRVSGDNV

SEQ ID NO: 814294 - protein, 19 aa, Mycobacterium
GAGLYKDLTECGVKIVWDQ

SEQ ID NO: 814295 - protein, 21 aa, Mycobacterium
GAGMAAWFGWLRRFVRGVPTG

SEQ ID NO: 814296 - protein, 19 aa, Mycobacterium
GAGMHPWGKWGNDFTEYGV

SEQ ID NO: 814297 - protein, 28 aa, Mycobacterium
GAGMLAPSLATMLVVLTTDAVADSAALD

SEQ ID NO: 814298 - protein, 34 aa, Mycobacterium
GAGNRDLLRQLLPIVLPIVLAYIGNQLGSGEGSQ

SEQ ID NO: 814299 - protein, 26 aa, Mycobacterium
GAGNWLLAVPAIHIAGLQVLVRSALA

SEQ ID NO: 814300 - protein, 32 aa, Mycobacterium
GAGNYTFPLGMETGWWATAPTLIVDGGAVNVP

SEQ ID NO: 814301 - protein, 40 aa, Mycobacterium
GAGPASRVAILLPAHWQTAAVLFGVWWIGAEAVLAGPADL

SEQ ID NO: 814302 - protein, 28 aa, Mycobacterium
GAGPGKLDQWTLLARARALDSMSYVAAA

SEQ ID NO: 814303 - protein, 29 aa, Mycobacterium
GAGPGKLDQWTLLARARALDSMSYVAAAG

SEQ ID NO: 814304 - protein, 18 aa, Mycobacterium
GAGPPVAVGLALAGKRKG

SEQ ID NO: 814305 - protein, 24 aa, Mycobacterium
GAGQAGGWLFGDGGPGAAATATSA

SEQ ID NO: 814306 - protein, 21 aa, Mycobacterium
GAGQFRRSFARYEPMPESAAA

SEQ ID NO: 814307 - protein, 18 aa, Mycobacterium
GAGQGQPIDLLFSRARRI

SEQ ID NO: 814308 - protein, 31 aa, Mycobacterium
GAGRAISLAPRLRVPDTFSLAHHLAVGAAVL

SEQ ID NO: 814309 - protein, 28 aa, Mycobacterium
GAGRAPVLYELPYGLPFSELLALHAVAP

SEQ ID NO: 814310 - protein, 26 aa, Mycobacterium
GAGRFGIRGLLPYSVAKGGLEALTRA

SEQ ID NO: 814311 - protein, 22 aa, Mycobacterium
GAGRGIGREHALLFAREGASVV

SEQ ID NO: 814312 - protein, 17 aa, Mycobacterium
GAGRISHCLGLTGPSMC

SEQ ID NO: 814313 - protein, 18 aa, Mycobacterium
GAGRLEHAATSSAAVQTA

SEQ ID NO: 814314 - protein, 37 aa, Mycobacterium; identical to SEQ ID NO: 126553

SEQ ID NO: 814315 - protein, 30 aa, Mycobacterium
GAGRSVWTLLRRRNGVLPAIEQALHTTGLT

SEQ ID NO: 814316 - protein, 22 aa, Mycobacterium
GAGRTALLLTLAGRMKPQSGEV

SEQ ID NO: 814317 - protein, 25 aa, Mycobacterium
GAGRTWHPYQVPAFLEAGYRVITFD

SEQ ID NO: 814318 - protein, 32 aa, Mycobacterium
GAGRWGKYLGVQAGPLWLIAHLSRAGWLRWSD

SEQ ID NO: 814319 - protein, 21 aa, Mycobacterium
GAGRYQLLCRTGERIRVCDWL

SEQ ID NO: 814320 - protein, 21 aa, Mycobacterium
GAGSERDIWWVHAARNRQTQP

SEQ ID NO: 814321 - protein, 23 aa, Mycobacterium
GAGSIFKIFTTAAALDMGMGINA

SEQ ID NO: 814322 - protein, 33 aa, Mycobacterium
GAGTFYTLRCYLDDRPIFLGRNGRISVFNSERA

SEQ ID NO: 814323 - protein, 26 aa, Mycobacterium
GAGTMTHAWLITGPPGSGRSVAALCF

SEQ ID NO: 814324 - protein, 25 aa, Mycobacterium
GAGTRMYRTGDLVWWDPDGQLRYVG

SEQ ID NO: 814325 - protein, 18 aa, Mycobacterium
GAGTVEFVMAPDGSFYFL

SEQ ID NO: 814326 - protein, 25 aa, Mycobacterium
GAGVPLVLALRFRGTMDHWDPAFLD

SEQ ID NO: 814327 - protein, 21 aa, Mycobacterium
GAGVSGLWLLSGMRDDGVLTT

SEQ ID NO: 814328 - protein, 30 aa, Mycobacterium
GAGVSKALFYFYFPRKEDVLFEVGVMSTRS

SEQ ID NO: 814329 - protein, 19 aa, Mycobacterium
GAGWLKVKPVHTLDLVVLA

SEQ ID NO: 814330 - protein, 18 aa, Mycobacterium
GAGWNVIKVVWGREWDVL

SEQ ID NO: 814331 - protein, 28 aa, Mycobacterium
GAGYEDLAWFCVRAWRFGAPASYGAGGL

SEQ ID NO: 814332 - protein, 23 aa, Mycobacterium
GAGYFPIDPGYPLARKQFMLEDV

SEQ ID NO: 814333 - protein, 24 aa, Mycobacterium
GAHADAYLWVKRPGESDGSCNGGP

SEQ ID NO: 814334 - protein, 38 aa, Mycobacterium
GAHARGRLTAWFKEFVLTGVPWGLRREGRKPGASVWFK

SEQ ID NO: 814335 - protein, 17 aa, Mycobacterium
GAHFCLGAPLARLEATV

SEQ ID NO: 814336 - protein, 31 aa, Mycobacterium
GAHGGSRPPFLKRLVLRTAARLSRRGRRLGL

SEQ ID NO: 814337 - protein, 21 aa, Mycobacterium
GAHGLLVVTPYYSRPAQAGLL

SEQ ID NO: 814338 - protein, 24 aa, Mycobacterium
GAHGLLVVTPYYSRPPQAGLVAHF

SEQ ID NO: 814339 - protein, 17 aa, Mycobacterium
GAHGYLIHQFLSPHSNH

SEQ ID NO: 814340 - protein, 29 aa, Mycobacterium
GAHHVETLTGFKWLARAGSPGTTLVYAYE

SEQ ID NO: 814341 - protein, 22 aa, Mycobacterium
GAHIVMIGILPTLMPRHFAQDW

SEQ ID NO: 814342 - protein, 43 aa, Mycobacterium
GAHIVRGLLTAGHRVRLLAEPGWNNPPLLHKLSEFGAITVIRG

SEQ ID NO: 814343 - protein, 25 aa, Mycobacterium
GAHKHIALVPQWDFLELVATAAEAE

SEQ ID NO: 814344 - protein, 33 aa, Mycobacterium
GAHKPTPTITARLNFQLAFGARVGQRLAEAREQ

SEQ ID NO: 814345 - protein, 17 aa, Mycobacterium
GAHKWVRHIAIVDFENT

SEQ ID NO: 814346 - protein, 26 aa, Mycobacterium
GAHLDLCMVLPLDRPILAPLPQQERQ

SEQ ID NO: 814347 - protein, 17 aa, Mycobacterium
GAHLPITLPSGRVRQYS

SEQ ID NO: 814348 - protein, 24 aa, Mycobacterium
GAHLRNMAFYNMGLRLLRHVQDAV

SEQ ID NO: 814349 - protein, 24 aa, Mycobacterium
GAHLRNMAFYNSGLRLLRHARDAE

SEQ ID NO: 814350 - protein, 24 aa, Mycobacterium
GAHLRNMAFYNSGLRLLRHVHEAE

SEQ ID NO: 814351 - protein, 29 aa, Mycobacterium
GAHLRNMAFYNSGLRLLRHVRDAGFMSVE

SEQ ID NO: 814352 - protein, 23 aa, Mycobacterium
GAHLRNMSFYNAGLRLLKRVKEA

SEQ ID NO: 814353 - protein, 25 aa, Mycobacterium
GAHPVKLPSYPWQTKRFWNDTHEAE

SEQ ID NO: 814354 - protein, 24 aa, Mycobacterium
GAHQAIVGDRLRLALDADLCGAVT

SEQ ID NO: 814355 - protein, 23 aa, Mycobacterium
GAHQALQWGLLTEVTNKGSHIRT

SEQ ID NO: 814356 - protein, 17 aa, Mycobacterium
GAHQPPGYMLPVSERMT

SEQ ID NO: 814357 - protein, 25 aa, Mycobacterium
GAHQRHRVVGVPGFRAPRADDGLLP

SEQ ID NO: 814358 - protein, 21 aa, Mycobacterium
GAHRVAVPLVPHGRGFALDAD

SEQ ID NO: 814359 - protein, 30 aa, Mycobacterium
GAHSQLALALWAVQQLFPGATLNAGKDDHG

SEQ ID NO: 814360 - protein, 24 aa, Mycobacterium
GAHTVRALIQAGHEVKLLAAPTDP

SEQ ID NO: 814361 - protein, 29 aa, Mycobacterium
GAHVGHTVGKYAESLLTLGWAEEFASVPI

SEQ ID NO: 814362 - protein, 28 aa, Mycobacterium
GAHWIADRQIVPSLLKYGTETQKRRYLP

SEQ ID NO: 814363 - protein, 24 aa, Mycobacterium
GAHYGMICDASYSTYFLTHWARDR

SEQ ID NO: 814364 - protein, 25 aa, Mycobacterium
GAHYGMICDASYSTYFLTHWARDRK

SEQ ID NO: 814365 - protein, 21 aa, Mycobacterium
GAIALGHPLGATGAKLFATML

SEQ ID NO: 814366 - protein, 18 aa, Mycobacterium
GAIAQKWAALGPLVEGLG

SEQ ID NO: 814367 - protein, 24 aa, Mycobacterium
GAIAVPLNFRLTAAEIAFLVQDCE

SEQ ID NO: 814368 - protein, 29 aa, Mycobacterium
GAIAVPLNFRLTPSEIAFLVEDCAPRLVI

SEQ ID NO: 814369 - protein, 25 aa, Mycobacterium
GAIAVPLNFRLTPTEIAFLVEDCAP

SEQ ID NO: 814370 - protein, 19 aa, Mycobacterium
GAIDAGRRLPAGDIFVFGE

SEQ ID NO: 814371 - protein, 33 aa, Mycobacterium
GAIDFLRLEARCDTFLLAYKTPGAKGFNLITSV

SEQ ID NO: 814372 - protein, 24 aa, Mycobacterium
GAIEDLLAFIRRADVPSLPQIAIA

SEQ ID NO: 814373 - protein, 20 aa, Mycobacterium
GAIEFIFRHGVPAGIYGGTM

SEQ ID NO: 814374 - protein, 23 aa, Mycobacterium
GAIELAWALLTNSVADGGYGLDP

SEQ ID NO: 814375 - protein, 27 aa, Mycobacterium
GAIELGIKWLSLYAFSTENWKRSAEEV

SEQ ID NO: 814376 - protein, 25 aa, Mycobacterium
GAIEPQFYAELLKGLGLDGADLPAQ

SEQ ID NO: 814377 - protein, 23 aa, Mycobacterium
GAIEVALVHRPRYDDWSLPKGKL

SEQ ID NO: 814378 - protein, 19 aa, Mycobacterium
GAIGLQYARYCLERGARTV

SEQ ID NO: 814379 - protein, 24 aa, Mycobacterium
GAIGMEFAYVLKNYGVDVTIVEFL

SEQ ID NO: 814380 - protein, 31 aa, Mycobacterium
GAIGVTSEHPLWLFTLRAQSWTADYGTTANY

SEQ ID NO: 814381 - protein, 17 aa, Mycobacterium
GAIGYGMPAAIGAAIAA

SEQ ID NO: 814382 - protein, 20 aa, Mycobacterium
GAIIVPFDQAGPHPLRGYGL

SEQ ID NO: 814383 - protein, 17 aa, Mycobacterium
GAILFLLSEMSSYITGQ

SEQ ID NO: 814384 - protein, 27 aa, Mycobacterium
GAILNVLSVLSWMHPPTSGAYASAKAA

SEQ ID NO: 814385 - protein, 20 aa, Mycobacterium
GAIMVHPYVASKWAVRGLTK

SEQ ID NO: 814386 - protein, 26 aa, Mycobacterium
GAINAPTEFLLARPLIGNGADGTAAN

SEQ ID NO: 814387 - protein, 25 aa, Mycobacterium
GAIPAIPLNLILLKDICVRGMEIRT

SEQ ID NO: 814388 - protein, 17 aa, Mycobacterium
GAIPVLALYGIPHRDCG

SEQ ID NO: 814389 - protein, 21 aa, Mycobacterium
GAIQGYILAGVPRLADWGGVA

SEQ ID NO: 814390 - protein, 19 aa, Mycobacterium
GAISACRYLSGTDMLAGIG

SEQ ID NO: 814391 - protein, 26 aa, Mycobacterium
GAISGRIAYVLGLGGPALTIDASCTG

SEQ ID NO: 814392 - protein, 23 aa, Mycobacterium
GAITATPIIRWLRGVESAGGPVD

SEQ ID NO: 814393 - protein, 19 aa, Mycobacterium
GAITIPINVRLAGPEIGYI

SEQ ID NO: 814394 - protein, 27 aa, Mycobacterium
GAITPALATLGFGVLPLVDLASEDQQE

SEQ ID NO: 814395 - protein, 25 aa, Mycobacterium
GAITPWNFPHQINLAKVGPALAAGN

SEQ ID NO: 814396 - protein, 20 aa, Mycobacterium
GAITRYAVRLSQPAVVPAEG

SEQ ID NO: 814397 - protein, 18 aa, Mycobacterium
GAITVPPTWQGSMPVPAV

SEQ ID NO: 814398 - protein, 25 aa, Mycobacterium
GAIVAPKPLQAGGIPLWIAGGGEKV

SEQ ID NO: 814399 - protein, 26 aa, Mycobacterium
GAIVECFTLAMRLITESRLAGTIIEN

SEQ ID NO: 814400 - protein, 20 aa, Mycobacterium
GAIVPLHASALGKVLLAFDP

SEQ ID NO: 814401 - protein, 32 aa, Mycobacterium
GAIVPWNVPQFLIMPKLIPALIAGCTVIIKPA

SEQ ID NO: 814402 - protein, 18 aa, Mycobacterium
GAIWYPMVYDMPVRAKEA

SEQ ID NO: 814403 - protein, 23 aa, Mycobacterium
GAKAFSRLFAESLWLELRETGVD

SEQ ID NO: 814404 - protein, 25 aa, Mycobacterium
GAKAWITHGGIADFYSLFARTGEGG

SEQ ID NO: 814405 - protein, 26 aa, Mycobacterium
GAKDQLRFTAPPRLDLSLLVSALPED

SEQ ID NO: 814406 - protein, 17 aa, Mycobacterium
GAKELIAFDLAGHGRRT

SEQ ID NO: 814407 - protein, 23 aa, Mycobacterium
GAKEQLAIVARLAGASLVAKEDT

SEQ ID NO: 814408 - protein, 25 aa, Mycobacterium
GAKEQLGILARFAGAALVAKEDTVP

SEQ ID NO: 814409 - protein, 20 aa, Mycobacterium
GAKGFQRAAVAWSGSANLVT

SEQ ID NO: 814410 - protein, 28 aa, Mycobacterium
GAKGKAKEVFGAVTGRDDVKREGQAQQD

SEQ ID NO: 814411 - protein, 24 aa, Mycobacterium
GAKIAFFFTRRKLTQMTGLETAGM

SEQ ID NO: 814412 - protein, 22 aa, Mycobacterium
GAKIIAINPLPEAGLIRFKDPQ

SEQ ID NO: 814413 - protein, 43 aa, Mycobacterium
GAKKAYIRYQPLGVVLAVMPWNFPLWQAVRFAAPALMAGNVGI

SEQ ID NO: 814414 - protein, 26 aa, Mycobacterium
GAKLAAVLGLPYGFASHFAPPALQDA

SEQ ID NO: 814415 - protein, 19 aa, Mycobacterium
GAKLGRLVMRSACAQFGLW

SEQ ID NO: 814416 - protein, 23 aa, Mycobacterium
GAKLLEAYAVPPLLHNQALAISV

SEQ ID NO: 814417 - protein, 36 aa, Mycobacterium
GAKLPVAEAIGYMLEILPALGYLHSIGLAYNDLKPE

SEQ ID NO: 814418 - protein, 20 aa, Mycobacterium
GAKLRSALADRLRITKAEAG

SEQ ID NO: 814419 - protein, 24 aa, Mycobacterium
GAKPALFVWGMKDFAFRQGPTLPR

SEQ ID NO: 814420 - protein, 17 aa, Mycobacterium
GAKPIVPGLMPITSLRS

SEQ ID NO: 814421 - protein, 25 aa, Mycobacterium
GAKRPLVLDIPLFVSDMSFGALSEE

SEQ ID NO: 814422 - protein, 25 aa, Mycobacterium
GAKRRIVFRFFTSPIELRGEDRVES

SEQ ID NO: 814423 - protein, 23 aa, Mycobacterium
GAKRRIVFRFRTSPIEIRGDGKV

SEQ ID NO: 814424 - protein, 30 aa, Mycobacterium
GAKTDLLDEAWWLPSVFIANGGAVAASLGS

SEQ ID NO: 814425 - protein, 30 aa, Mycobacterium
GAKTDLMDEAWWLPSVFIADGGDAARALGS

SEQ ID NO: 814426 - protein, 17 aa, Mycobacterium
GAKTLWLQLGLRHDEVV

SEQ ID NO: 814427 - protein, 37 aa, Mycobacterium
GAKTPYYMYAGDGEPLFMAGLWTTWRPKPADTDAPKD

SEQ ID NO: 814428 - protein, 28 aa, Mycobacterium
GAKTQHRFFEMLQACVTLAAFGDSSGQI

SEQ ID NO: 814429 - protein, 19 aa, Mycobacterium
GAKVLRQYGLGPLPGVAMM

SEQ ID NO: 814430 - protein, 37 aa, Mycobacterium
GAKVSGARFYFLTGYGALLQLGLLQLAVQTAVANGFT

SEQ ID NO: 814431 - protein, 38 aa, Mycobacterium
GAKVSGSRFYFLTGAGALLQLGLLQLATQVAVQNGFTL

SEQ ID NO: 814432 - protein, 40 aa, Mycobacterium
GAKVSGSRFYFLTGRGALLQLGLLQLALRLAVDNGFIPMI

SEQ ID NO: 814433 - protein, 41 aa, Mycobacterium
GAKVSGSRFYFLTGRGALLQLGLLQLALRLAVENGFIPMIP

SEQ ID NO: 814434 - protein, 21 aa, Mycobacterium
GAKYHVPLLLAPFAYSTYRGS

SEQ ID NO: 814435 - protein, 17 aa, Mycobacterium
GAKYRGEFEERLKAVLD

SEQ ID NO: 814436 - protein, 19 aa, Mycobacterium
GAKYRGEFEERLKAVLDEI

SEQ ID NO: 814437 - protein, 24 aa, Mycobacterium
GALAAGCAVLLKPSERTPLTAELL

SEQ ID NO: 814438 - protein, 20 aa, Mycobacterium
GALAAGCSVLLKPSERTPLT

SEQ ID NO: 814439 - protein, 22 aa, Mycobacterium
GALAALYRRGITGRGQVVDVAL

SEQ ID NO: 814440 - protein, 23 aa, Mycobacterium
GALAALYRRSVTGEGQIVDAALT

SEQ ID NO: 814441 - protein, 22 aa, Mycobacterium
GALAALYRRSVTGRGQVVDVAL

SEQ ID NO: 814442 - protein, 17 aa, Mycobacterium
GALAEPLASAIYGLEIA

SEQ ID NO: 814443 - protein, 26 aa, Mycobacterium
GALAERALVPVLPGVEEFPYAIRQVS

SEQ ID NO: 814444 - protein, 26 aa, Mycobacterium
GALAERALVPVLPSIEEFPYAIRQVS

SEQ ID NO: 814445 - protein, 18 aa, Mycobacterium
GALAMAAVRIALDDWLSH

SEQ ID NO: 814446 - protein, 23 aa, Mycobacterium
GALAPDFGWAPWQGEASEWPITS

SEQ ID NO: 814447 - protein, 23 aa, Mycobacterium
GALAPLAGLLSPLRAAAGAVLMR

SEQ ID NO: 814448 - protein, 31 aa, Mycobacterium
GALAQVCESFAIPWLVIRALSDLAGAGSGLD

SEQ ID NO: 814449 - protein, 22 aa, Mycobacterium
GALAVPLNVRLAGPEIGYILAD

SEQ ID NO: 814450 - protein, 17 aa, Mycobacterium
GALCERLGYAQLADVEQ

SEQ ID NO: 814451 - protein, 24 aa, Mycobacterium
GALCPRHHRGCYGCFGPSAAPQTA

SEQ ID NO: 814452 - protein, 22 aa, Mycobacterium
GALCVYLEPIALYHTKDLHEDG

SEQ ID NO: 814453 - protein, 30 aa, Mycobacterium
GALDFSYVRSAHLRPPIYLVGRSADLEDEY

SEQ ID NO: 814454 - protein, 24 aa, Mycobacterium
GALDGAILHYFLHAEPSGVAARQL

SEQ ID NO: 814455 - protein, 26 aa, Mycobacterium
GALDGIRVLELGTLIAGPFAGRLLGD

SEQ ID NO: 814456 - protein, 23 aa, Mycobacterium
GALDLTFRERWTDPAPLDMLSPI

SEQ ID NO: 814457 - protein, 20 aa, Mycobacterium
GALDMRVLVLGGGESRDLDV

SEQ ID NO: 814458 - protein, 26 aa, Mycobacterium
GALDRFAKAAPALERYRKLRDAWLTA

SEQ ID NO: 814459 - protein, 24 aa, Mycobacterium
GALDRFEQVLPRLPLPSIEETLQT

SEQ ID NO: 814460 - protein, 18 aa, Mycobacterium
GALDVPLSQVLSEVSERL

SEQ ID NO: 814461 - protein, 18 aa, Mycobacterium
GALEFIPAKRVGTAEDVA

SEQ ID NO: 814462 - protein, 27 aa, Mycobacterium
GALETVGMLFSPGYPGFLRGVVAVGGD

SEQ ID NO: 814463 - protein, 17 aa, Mycobacterium
GALFGYLAAGKKSVANT

SEQ ID NO: 814464 - protein, 18 aa, Mycobacterium
GALFIVLSGGYFADGVFL

SEQ ID NO: 814465 - protein, 30 aa, Mycobacterium
GALFLADRTVVGARQYRLGPVGLAGAHDVG

SEQ ID NO: 814466 - protein, 23 aa, Mycobacterium
GALGAVHLVGWSYGALIGLEAAL

SEQ ID NO: 814467 - protein, 23 aa, Mycobacterium
GALGCRYSMFMYPLAPEHDHREI

SEQ ID NO: 814468 - protein, 22 aa, Mycobacterium
GALGMLFDSILGLSAAVLTGNP

SEQ ID NO: 814469 - protein, 22 aa, Mycobacterium
GALGMLFDTLLGLTASVLTGSR

SEQ ID NO: 814470 - protein, 23 aa, Mycobacterium
GALHDVLPADLLAHSLRELVART

SEQ ID NO: 814471 - protein, 23 aa, Mycobacterium
GALHDVLPADLLAHSLRELVTRT

SEQ ID NO: 814472 - protein, 24 aa, Mycobacterium
GALHQVLPADLLAHSLRELAARTG

SEQ ID NO: 814473 - protein, 25 aa, Mycobacterium
GALHRTLRGELLGLPVRLTEIAPGA

SEQ ID NO: 814474 - protein, 20 aa, Mycobacterium
GALHWDDPESILAWLDAYDP

SEQ ID NO: 814475 - protein, 18 aa, Mycobacterium
GALIAFEKGRSWPRERTR

SEQ ID NO: 814476 - protein, 17 aa, Mycobacterium
GALICHGALSRNPDLRI

SEQ ID NO: 814477 - protein, 22 aa, Mycobacterium
GALIDDGRLRKLTFTGSTGVGK

SEQ ID NO: 814478 - protein, 20 aa, Mycobacterium
GALIDKPLIRRKLAEMIVDV

SEQ ID NO: 814479 - protein, 36 aa, Mycobacterium
GALKNNPALPIMTTTMLFFVRDMCSQSFCVRAVRIT

SEQ ID NO: 814480 - protein, 21 aa, Mycobacterium
GALLGFHWTKVHSESLGEVYV

SEQ ID NO: 814481 - protein, 19 aa, Mycobacterium
GALLGLAALLRADPHRDDA

SEQ ID NO: 814482 - protein, 17 aa, Mycobacterium
GALLGLGQLLCDQPERD

SEQ ID NO: 814483 - protein, 21 aa, Mycobacterium
GALLHVVSHMRRFLDDAAARP

SEQ ID NO: 814484 - protein, 20 aa, Mycobacterium
GALLIESYTLATLNLRQAAR

SEQ ID NO: 814485 - protein, 18 aa, Mycobacterium
GALLLGGRLGPGRTAAIC

SEQ ID NO: 814486 - protein, 27 aa, Mycobacterium
GALLPAGFTRILGYRSGLQGDDAQCYQ

SEQ ID NO: 814487 - protein, 22 aa, Mycobacterium
GALLQIAVGERPPLERLLNGPS

SEQ ID NO: 814488 - protein, 41 aa, Mycobacterium
GALLREELLAVPALGWVNLHFSVLPAWRGAAPVQAALAAGD

SEQ ID NO: 814489 - protein, 17 aa, Mycobacterium
GALLRRTDMSLLDQWYA

SEQ ID NO: 814490 - protein, 20 aa, Mycobacterium
GALLSISFPGALIGDAPDLC

SEQ ID NO: 814491 - protein, 19 aa, Mycobacterium
GALMLVYGVGPDQAFELLQ

SEQ ID NO: 814492 - protein, 18 aa, Mycobacterium
GALNLPLGSPVLVLERIS

SEQ ID NO: 814493 - protein, 21 aa, Mycobacterium
GALNPYLSPAAIKRWEPFIDE

SEQ ID NO: 814494 - protein, 20 aa, Mycobacterium
GALNRGFNVANLLIGTGEQA

SEQ ID NO: 814495 - protein, 25 aa, Mycobacterium
GALNWTAAPVQLPDMPPIQAGEDAM

SEQ ID NO: 814496 - protein, 29 aa, Mycobacterium
GALPDFVGLAFRLTPPEPAGKPWDILLVS

SEQ ID NO: 814497 - protein, 18 aa, Mycobacterium
GALPDIAQICSCNNVTKG

SEQ ID NO: 814498 - protein, 21 aa, Mycobacterium
GALPDWPTGTPPVLRTRETLP

SEQ ID NO: 814499 - protein, 24 aa, Mycobacterium
GALPELASALWLKGNLLAERHSRG

SEQ ID NO: 814500 - protein, 22 aa, Mycobacterium
GALPFRVVASYAIKSPPPGGRF

SEQ ID NO: 814501 - protein, 19 aa, Mycobacterium
GALPGLPKIAVHWPLIDFE

SEQ ID NO: 814502 - protein, 19 aa, Mycobacterium
GALPGLSRPAAAALVEAAG

SEQ ID NO: 814503 - protein, 19 aa, Mycobacterium
GALPPYRYSQRELTEAFVN

SEQ ID NO: 814504 - protein, 39 aa, Mycobacterium
GALQAAVPAPLYLQLQVWSRGTIALAFAAVLIGAGEFEQ

SEQ ID NO: 814505 - protein, 25 aa, Mycobacterium
GALQATSIKLRQAVDGKCGKPKQPG

SEQ ID NO: 814506 - protein, 17 aa, Mycobacterium
GALQIWQAFTEKVSKQP

SEQ ID NO: 814507 - protein, 18 aa, Mycobacterium
GALQLPLWGGLGEEDRLR

SEQ ID NO: 814508 - protein, 24 aa, Mycobacterium
GALQVATRQELVQRIGRAELSDRE

SEQ ID NO: 814509 - protein, 23 aa, Mycobacterium
GALRAYLTDQHALPEKPLVAMVP

SEQ ID NO: 814510 - protein, 31 aa, Mycobacterium
GALRDLVARRTPLFEFAIRSALAEMDLDSAE

SEQ ID NO: 814511 - protein, 31 aa, Mycobacterium
GALRDLVARRTPLFEFAIRTALAEMDLDSAE

SEQ ID NO: 814512 - protein, 18 aa, Mycobacterium
GALRIITLNRPDALNAVN

SEQ ID NO: 814513 - protein, 23 aa, Mycobacterium
GALRIVGNLIRRPAARKRVIGMR

SEQ ID NO: 814514 - protein, 25 aa, Mycobacterium
GALRPGGWMVIEDYDWTAFGFEGSG

SEQ ID NO: 814515 - protein, 17 aa, Mycobacterium
GALRRLLVDLNYDPDTH

SEQ ID NO: 814516 - protein, 25 aa, Mycobacterium
GALRRSIKFATFLDGIDAVRRVAEH

SEQ ID NO: 814517 - protein, 19 aa, Mycobacterium
GALRRSIKFPSFLAGIDAV

SEQ ID NO: 814518 - protein, 23 aa, Mycobacterium
GALRTLLLRYDGKAEPLLASVPM

SEQ ID NO: 814519 - protein, 22 aa, Mycobacterium
GALRVAKAFAPILATNGGGALV

SEQ ID NO: 814520 - protein, 21 aa, Mycobacterium
GALSFPLGKQQRPAPAVVAGD

SEQ ID NO: 814521 - protein, 17 aa, Mycobacterium
GALSIPDKYLVSVNLSP

SEQ ID NO: 814522 - protein, 24 aa, Mycobacterium
GALSLLPAALIYRAGMHVHAGELD

SEQ ID NO: 814523 - protein, 31 aa, Mycobacterium
GALSTALIYDLRLGPAWQGLGFGIGMITEAV

SEQ ID NO: 814524 - protein, 24 aa, Mycobacterium
GALTFVVSAWIKMPVASTGYVSFR

SEQ ID NO: 814525 - protein, 25 aa, Mycobacterium
GALTPALATLGFGVVPLVELASGEQ

SEQ ID NO: 814526 - protein, 17 aa, Mycobacterium
GALTRSALRWNYRRIFP

SEQ ID NO: 814527 - protein, 23 aa, Mycobacterium
GALTSERMLQILRIVMSSGTLRQ

SEQ ID NO: 814528 - protein, 21 aa, Mycobacterium
GALVALPVLQAAVGTLAQMAT

SEQ ID NO: 814529 - protein, 33 aa, Mycobacterium
GALVCSVPLLDMKRFHLLLAGASWMAEYGNPDD

SEQ ID NO: 814530 - protein, 33 aa, Mycobacterium
GALVCSVPLLDMKRFHLLLAGASWVAEYGNPDD

SEQ ID NO: 814531 - protein, 25 aa, Mycobacterium
GALVDVASILSWMPGSGGYGDSKAA

SEQ ID NO: 814532 - protein, 29 aa, Mycobacterium
GALVLSRIGRLVFGAWEPKTGAVGSLWDV

SEQ ID NO: 814533 - protein, 23 aa, Mycobacterium
GALVPATPFTFDPAALAAAEAAT

SEQ ID NO: 814534 - protein, 23 aa, Mycobacterium
GALVPDVPFSFDPTVLRAARAAT

SEQ ID NO: 814535 - protein, 22 aa, Mycobacterium
GALVRGPMTPPVPLLGTPMPDA

SEQ ID NO: 814536 - protein, 18 aa, Mycobacterium
GALVRPLTDHLSALGIPT

SEQ ID NO: 814537 - protein, 17 aa, Mycobacterium
GALVVLIARDDPLDTYL

SEQ ID NO: 814538 - protein, 21 aa, Mycobacterium
GALYVHPQYPVLTPAQVVTAV

SEQ ID NO: 814539 - protein, 20 aa, Mycobacterium
GAMALGHPLGATGAKLFATM

SEQ ID NO: 814540 - protein, 20 aa, Mycobacterium
GAMANCNWIDDDCATRGGTG

SEQ ID NO: 814541 - protein, 25 aa, Mycobacterium
GAMANRLPMMVVASLIGVPDADAAQ

SEQ ID NO: 814542 - protein, 17 aa, Mycobacterium
GAMAWRMRSICDRIAGF

SEQ ID NO: 814543 - protein, 28 aa, Mycobacterium
GAMDSWTVPLYQLVTQRQAPLPAYPVQV

SEQ ID NO: 814544 - protein, 26 aa, Mycobacterium
GAMDWYTVLACFKLGIILEGTHARAC

SEQ ID NO: 814545 - protein, 20 aa, Mycobacterium
GAMGFLMTMLAQDCGWPVPV

SEQ ID NO: 814546 - protein, 21 aa, Mycobacterium
GAMGFLMTMLAQDCGWPVPVG

SEQ ID NO: 814547 - protein, 20 aa, Mycobacterium
GAMGLPFVASYHLTPATALE

SEQ ID NO: 814548 - protein, 20 aa, Mycobacterium
GAMHAVFIRAPWVERVGDDV

SEQ ID NO: 814549 - protein, 17 aa, Mycobacterium
GAMISLLSALDARVTVW

SEQ ID NO: 814550 - protein, 20 aa, Mycobacterium
GAMLRAVWVPSTGQLALIIH

SEQ ID NO: 814551 - protein, 24 aa, Mycobacterium
GAMLTGIPNMAFTIGYTNASWTLK

SEQ ID NO: 814552 - protein, 22 aa, Mycobacterium
GAMMPMMGTYPAHAGQRRGDEN

SEQ ID NO: 814553 - protein, 19 aa, Mycobacterium
GAMMPMRTIGYLLGIPEAD

SEQ ID NO: 814554 - protein, 18 aa, Mycobacterium
GAMMRRAGYMYGSYLPRG

SEQ ID NO: 814555 - protein, 20 aa, Mycobacterium
GAMNSWQQQLGEVSSGVGNL

SEQ ID NO: 814556 - protein, 23 aa, Mycobacterium
GAMPARVLVVGRDRPGRHRLGAE

SEQ ID NO: 814557 - protein, 30 aa, Mycobacterium
GAMPGMASSLPPMLTGLLGAGVGMATQIPQ

SEQ ID NO: 814558 - protein, 19 aa, Mycobacterium
GAMPIYRFGSEEQKAKWLP

SEQ ID NO: 814559 - protein, 18 aa, Mycobacterium
GAMRTPHWHANADELTYC

SEQ ID NO: 814560 - protein, 25 aa, Mycobacterium
GAMVADAAVPRWGKPEEMAELLAFC

SEQ ID NO: 814561 - protein, 18 aa, Mycobacterium
GAMVADLVRREGVAYEPV

SEQ ID NO: 814562 - protein, 21 aa, Mycobacterium
GAMVFLNDDFPEFCDGRSSTP

SEQ ID NO: 814563 - protein, 21 aa, Mycobacterium
GAMVTHLRFIRDHQKHIKKIA

SEQ ID NO: 814564 - protein, 24 aa, Mycobacterium
GAMVYGNFVGRVGALAAALGIGIA

SEQ ID NO: 814565 - protein, 25 aa, Mycobacterium
GANAQLWRFIVLDGPEQRAAVAQAA

SEQ ID NO: 814566 - protein, 25 aa, Mycobacterium
GANAQLWRFVVLDASEQRAAVAKAA

SEQ ID NO: 814567 - protein, 27 aa, Mycobacterium
GANAQNGAFNLGFGDITFGDKTSNTAT

SEQ ID NO: 814568 - protein, 26 aa, Mycobacterium
GANAQQGAFNLGFGDITLGNKTTNTA

SEQ ID NO: 814569 - protein, 22 aa, Mycobacterium
GANAVPVMLIAADVPVTCNDGG

SEQ ID NO: 814570 - protein, 23 aa, Mycobacterium
GANFDLVMLPALDAPPEAMTSLA

SEQ ID NO: 814571 - protein, 33 aa, Mycobacterium
GANGYLGRFLCLDWLERLAPTGGTVICLARGAD

SEQ ID NO: 814572 - protein, 31 aa, Mycobacterium; identical to SEQ ID NO: 218212

SEQ ID NO: 814573 - protein, 22 aa, Mycobacterium
GANLARLTINLMFNAIADHMPN

SEQ ID NO: 814574 - protein, 23 aa, Mycobacterium
GANLARLTITLMFNAIADHMPDL

SEQ ID NO: 814575 - protein, 22 aa, Mycobacterium
GANLARMTINLIFNAIADNMPD

SEQ ID NO: 814576 - protein, 22 aa, Mycobacterium
GANLARMTISLIFNAIADHMPD

SEQ ID NO: 814577 - protein, 25 aa, Mycobacterium
GANLHGRYLLPHFLIHDIAEVAADL

SEQ ID NO: 814578 - protein, 27 aa, Mycobacterium
GANLNDALLALLPLVGVWRGEGEGRGH

SEQ ID NO: 814579 - protein, 27 aa, Mycobacterium
GANMGFSARAYWRVGGFRTLASGEDVD

SEQ ID NO: 814580 - protein, 19 aa, Mycobacterium
GANNFPASVLATVGLDRPA

SEQ ID NO: 814581 - protein, 18 aa, Mycobacterium
GANPRKVIVVPGRLVNLV

SEQ ID NO: 814582 - protein, 19 aa, Mycobacterium
GANQQLLPEDLLAGPAIRA

SEQ ID NO: 814583 - protein, 26 aa, Mycobacterium
GANRYRLACVLGERIRVLQWLDDAPY

SEQ ID NO: 814584 - protein, 32 aa, Mycobacterium
GANSVWRAIAGPTPRLNPWRTPVPGVYLCSAA

SEQ ID NO: 814585 - protein, 24 aa, Mycobacterium
GANTPVLVRMPFGGVLAQPQPITA

SEQ ID NO: 814586 - protein, 27 aa, Mycobacterium
GANYVGPMRLTLALLPGMRARGSGHIV

SEQ ID NO: 814587 - protein, 21 aa, Mycobacterium
GAPAAQLLSAPAGAVSQLGQA

SEQ ID NO: 814588 - protein, 22 aa, Mycobacterium
GAPADPYDLWPQVLLEAAHAVA

SEQ ID NO: 814589 - protein, 31 aa, Mycobacterium
GAPAHRAVIALLHRLGFAAATVFVGVDGTFH

SEQ ID NO: 814590 - protein, 22 aa, Mycobacterium
GAPAIFQPMLDYIKTLAVKPDF

SEQ ID NO: 814591 - protein, 24 aa, Mycobacterium
GAPALVHVDVYRLLEHQSADLLGE

SEQ ID NO: 814592 - protein, 25 aa, Mycobacterium
GAPALYRRWENLWDRLLSACQPGAS

SEQ ID NO: 814593 - protein, 24 aa, Mycobacterium
GAPAPVLQWLIYPRTDFTAQTRSL

SEQ ID NO: 814594 - protein, 28 aa, Mycobacterium
GAPATLHLERIWIKNLTITTGLVDTHST

SEQ ID NO: 814595 - protein, 17 aa, Mycobacterium
GAPDIKMLQPIPAGDPG

SEQ ID NO: 814596 - protein, 23 aa, Mycobacterium
GAPDRLWVADFTYCRTRAGWAYT

SEQ ID NO: 814597 - protein, 23 aa, Mycobacterium
GAPELFVNVLFHEIPVGDCFVGR

SEQ ID NO: 814598 - protein, 25 aa, Mycobacterium
GAPERLKSGWLNGIKHWQVDYTGAG

SEQ ID NO: 814599 - protein, 19 aa, Mycobacterium
GAPFGLRPEAVIPAYGMAE

SEQ ID NO: 814600 - protein, 20 aa, Mycobacterium
GAPFGLRPQAILPAYGMAEI

SEQ ID NO: 814601 - protein, 25 aa, Mycobacterium
GAPGDLCILATPPPQALAELDAAAV

SEQ ID NO: 814602 - protein, 26 aa, Mycobacterium
GAPGEYLTRPGFWHGAVGVAACWLGG

SEQ ID NO: 814603 - protein, 24 aa, Mycobacterium
GAPGQWWQQQVILGLQRGGLPPQE

SEQ ID NO: 814604 - protein, 24 aa, Mycobacterium
GAPHAHNVLAILAAQRSNGRPVKL

SEQ ID NO: 814605 - protein, 25 aa, Mycobacterium
GAPIGYALDFLAIPVADVASMSERR

SEQ ID NO: 814606 - protein, 22 aa, Mycobacterium
GAPIVTPVWFVLHEGPEGDELI

SEQ ID NO: 814607 - protein, 23 aa, Mycobacterium
GAPKNPVWYYNVKENPLVELQDG

SEQ ID NO: 814608 - protein, 25 aa, Mycobacterium
GAPKQRAVLAMLLLAQGRVVSVDRL

SEQ ID NO: 814609 - protein, 34 aa, Mycobacterium
GAPLAPGLTLVPDALVGLCWPAVFSAIGSAVTDD

SEQ ID NO: 814610 - protein, 17 aa, Mycobacterium
GAPLGLDRPWWVEDTKL

SEQ ID NO: 814611 - protein, 18 aa, Mycobacterium
GAPLIIKPSAGGGGKGMR

SEQ ID NO: 814612 - protein, 20 aa, Mycobacterium
GAPLRDWWQVCEWASRLDDD

SEQ ID NO: 814613 - protein, 24 aa, Mycobacterium
GAPLSLRPVLPGDAERFKSSGSFS

SEQ ID NO: 814614 - protein, 20 aa, Mycobacterium
GAPMALWVQGPARLDQVVQR

SEQ ID NO: 814615 - protein, 20 aa, Mycobacterium
GAPMLPMAGLLAAAALDDLD

SEQ ID NO: 814616 - protein, 21 aa, Mycobacterium
GAPMPGWLAAALAAPASPPRE

SEQ ID NO: 814617 - protein, 25 aa, Mycobacterium
GAPNPLYWRGARLVGNYPLSIALDG

SEQ ID NO: 814618 - protein, 21 aa, Mycobacterium
GAPPEIELPRDFPRPALGSFR

SEQ ID NO: 814619 - protein, 25 aa, Mycobacterium
GAPPITIGPLYAGKTIQLCAPDDTV

SEQ ID NO: 814620 - protein, 28 aa, Mycobacterium
GAPPPDIEIMGMLMLLIGGGFDTTTALT

SEQ ID NO: 814621 - protein, 25 aa, Mycobacterium
GAPPRPSLGYLVVGLGHHGSKELQQ

SEQ ID NO: 814622 - protein, 22 aa, Mycobacterium
GAPPRPSVGYLIYGIGRHANDK

SEQ ID NO: 814623 - protein, 18 aa, Mycobacterium
GAPPRPSVGYLVFGIGRH

SEQ ID NO: 814624 - protein, 24 aa, Mycobacterium
GAPPRPSVGYLVFGIGRHGSDALR

SEQ ID NO: 814625 - protein, 18 aa, Mycobacterium
GAPPRPSVGYLVYGIGEH

SEQ ID NO: 814626 - protein, 25 aa, Mycobacterium
GAPQDRVWMAFPCEGYSLGDTEADR

SEQ ID NO: 814627 - protein, 26 aa, Mycobacterium
GAPQLDPALFDLGVPVFGICYGFQAM

SEQ ID NO: 814628 - protein, 22 aa, Mycobacterium
GAPQNPVWYYNVKKNPRVELRD

SEQ ID NO: 814629 - protein, 25 aa, Mycobacterium
GAPRDYILELLLDQTTADLPYEDCV

SEQ ID NO: 814630 - protein, 18 aa, Mycobacterium
GAPRGWSSFEPVLRSAFD

SEQ ID NO: 814631 - protein, 22 aa, Mycobacterium
GAPSAAWLRKCAELNEHAVTAV

SEQ ID NO: 814632 - protein, 17 aa, Mycobacterium
GAPSFGEALRWGAEVYH

SEQ ID NO: 814633 - protein, 26 aa, Mycobacterium
GAPTAVEMLLFQRARLIGSASGKVPA

SEQ ID NO: 814634 - protein, 23 aa, Mycobacterium
GAPTRLLLLRHGQTPLSVERRYS

SEQ ID NO: 814635 - protein, 24 aa, Mycobacterium
GAPTSAIAFTKRLLNDSPDTDRSG

SEQ ID NO: 814636 - protein, 26 aa, Mycobacterium
GAPVDTPWVWVLDPVDGTFNYAAGSP

SEQ ID NO: 814637 - protein, 25 aa, Mycobacterium
GAPVLLFETGLPTRYYIDPTDVAFE

SEQ ID NO: 814638 - protein, 18 aa, Mycobacterium
GAPVLVQVPRRGYVPSLA

SEQ ID NO: 814639 - protein, 28 aa, Mycobacterium
GAPVPGAALFVLDGWLRPAATGVVGELY

SEQ ID NO: 814640 - protein, 17 aa, Mycobacterium
GAPVTLSGIARLQPGAK

SEQ ID NO: 814641 - protein, 22 aa, Mycobacterium
GAPVVASIARKLGALTIGVVTR

SEQ ID NO: 814642 - protein, 31 aa, Mycobacterium
GAPVYKVFNGIFWKHLLERGIPAGSPGRIAL

SEQ ID NO: 814643 - protein, 17 aa, Mycobacterium
GAPWFALSERNSPGSII

SEQ ID NO: 814644 - protein, 22 aa, Mycobacterium
GAPWLESLAYKIWGRAFEQFTA

SEQ ID NO: 814645 - protein, 20 aa, Mycobacterium
GAQALPLLDFPNTRMNEIRL

SEQ ID NO: 814646 - protein, 17 aa, Mycobacterium
GAQALVVHLGMSGQMLI

SEQ ID NO: 814647 - protein, 23 aa, Mycobacterium
GAQAMAARQVGSYWRSAVAEHPR

SEQ ID NO: 814648 - protein, 17 aa, Mycobacterium
GAQAYLRELAFRDFYAD

SEQ ID NO: 814649 - protein, 25 aa, Mycobacterium
GAQGRLLRLWRPPCGPGQWCTLGLF

SEQ ID NO: 814650 - protein, 38 aa, Mycobacterium
GAQGRYTFPYLLSALPDLDRLLLFGTHPDGIAAVRAYV

SEQ ID NO: 814651 - protein, 33 aa, Mycobacterium
GAQHPVIRRFWPRRLRRSSFYWKLVAYDQRYDI

SEQ ID NO: 814652 - protein, 17 aa, Mycobacterium
GAQINVPLFINTGDKLK

SEQ ID NO: 814653 - protein, 21 aa, Mycobacterium
GAQIPIEKPGVGSPFHGGGGG

SEQ ID NO: 814654 - protein, 23 aa, Mycobacterium
GAQIQVPLFINTGDKLKVDSRDG

SEQ ID NO: 814655 - protein, 19 aa, Mycobacterium
GAQLARLTALLAARQLRMP

SEQ ID NO: 814656 - protein, 18 aa, Mycobacterium
GAQLAWIPRRAGERGALE

SEQ ID NO: 814657 - protein, 22 aa, Mycobacterium
GAQLVTATLWPLPTSAGYRTFT

SEQ ID NO: 814658 - protein, 24 aa, Mycobacterium
GAQLYADVASLRHAWAALDAGADG

SEQ ID NO: 814659 - protein, 28 aa, Mycobacterium
GAQMLFDLPPRWFSLFTRLGMRTSIRYK

SEQ ID NO: 814660 - protein, 23 aa, Mycobacterium
GAQNFLILARRLLGAVTSRGNVG

SEQ ID NO: 814661 - protein, 19 aa, Mycobacterium
GAQNFMILARRLVGADTTR

SEQ ID NO: 814662 - protein, 19 aa, Mycobacterium
GAQNRFIIPPKLAIVEVKA

SEQ ID NO: 814663 - protein, 25 aa, Mycobacterium
GAQPRDWFEVSLIPTTRELTTLGSA

SEQ ID NO: 814664 - protein, 24 aa, Mycobacterium
GAQQRFNTFAAAAYMNGPSSSYLT

SEQ ID NO: 814665 - protein, 35 aa, Mycobacterium
GAQRAMIADSWQLMSNPNISFPKTPLTVGAKQGSD

SEQ ID NO: 814666 - protein, 22 aa, Mycobacterium
GAQRFAFLGFDSGPVLTLWEQS

SEQ ID NO: 814667 - protein, 22 aa, Mycobacterium
GAQSGLPIGWYSHPAQGIKQII

SEQ ID NO: 814668 - protein, 29 aa, Mycobacterium
GAQSPRESYLRLFLIDAGLPRPQTQLPVL

SEQ ID NO: 814669 - protein, 30 aa, Mycobacterium
GAQTLALHEQFVKLMSGGAAQYAAAEAANA

SEQ ID NO: 814670 - protein, 23 aa, Mycobacterium
GAQTLRAFGVTDLYDLRSPTEIA

SEQ ID NO: 814671 - protein, 26 aa, Mycobacterium
GAQVHQRIVQLLNSASGAYASAEAAN

SEQ ID NO: 814672 - protein, 23 aa, Mycobacterium
GAQVKVNLLLRRLPRLRDENVTP

SEQ ID NO: 814673 - protein, 23 aa, Mycobacterium
GAQVRTPFLLLHGTSDDVVGPEA

SEQ ID NO: 814674 - protein, 28 aa, Mycobacterium
GAQVSRGLLLLWQGGPYRDEALELLSLG

SEQ ID NO: 814675 - protein, 24 aa, Mycobacterium
GAQWSRIRLSDRAHLEPWEPSAEG

SEQ ID NO: 814676 - protein, 19 aa, Mycobacterium
GAQWSYRRDLGNTRLLVID

SEQ ID NO: 814677 - protein, 24 aa, Mycobacterium
GARAARAWTARPLVGLGRSGNPGR

SEQ ID NO: 814678 - protein, 24 aa, Mycobacterium
GARAEWAMGLWDDPTQSALRAVIA

SEQ ID NO: 814679 - protein, 29 aa, Mycobacterium
GARAHGVPTYRWPMVPALALTASMPVLGA

SEQ ID NO: 814680 - protein, 18 aa, Mycobacterium
GARAILIRPAPVPGFRGP

SEQ ID NO: 814681 - protein, 27 aa, Mycobacterium
GARALRFWEVMYPSPPPGLAGPGDERR

SEQ ID NO: 814682 - protein, 25 aa, Mycobacterium
GARARLWVDGLLAGRYSRLETAAPS

SEQ ID NO: 814683 - protein, 22 aa, Mycobacterium
GARCALAWSLETAVLAREHNNA

SEQ ID NO: 814684 - protein, 18 aa, Mycobacterium
GARCAVAPVAPKPPAVPA

SEQ ID NO: 814685 - protein, 47 aa, Mycobacterium
GARDFLVPARLQPGSFYALPQSPQLFKQLLMVAGMERYYQIARCYRD

SEQ ID NO: 814686 - protein, 26 aa, Mycobacterium
GARDFQRFLIGKLRDIRAVVLNASLD

SEQ ID NO: 814687 - protein, 24 aa, Mycobacterium
GARDFQRFLIGKLRDIREVVANAS

SEQ ID NO: 814688 - protein, 23 aa, Mycobacterium
GARDWVIEPDLSNSVPFLAAAVV

SEQ ID NO: 814689 - protein, 25 aa, Mycobacterium
GAREHALLLALARDPQVSGLVVAPG

SEQ ID NO: 814690 - protein, 25 aa, Mycobacterium
GAREHALLLALARDPQVTHLIVAPG

SEQ ID NO: 814691 - protein, 25 aa, Mycobacterium
GAREHALLLALRKDPQVTALWVAPG

SEQ ID NO: 814692 - protein, 25 aa, Mycobacterium
GAREHALLLALRKDPQVTGLAIAPG

SEQ ID NO: 814693 - protein, 25 aa, Mycobacterium
GAREHALLLALRRDPEVDALSVAPG

SEQ ID NO: 814694 - protein, 25 aa, Mycobacterium
GAREHALLLALRRDPEVEGLAVAPG

SEQ ID NO: 814695 - protein, 23 aa, Mycobacterium
GAREIPLLGYHRPLRDKLEGKGF

SEQ ID NO: 814696 - protein, 20 aa, Mycobacterium
GARFAAWPQISELIQALFAG

SEQ ID NO: 814697 - protein, 18 aa, Mycobacterium
GARFADLLPAAGADLLVS

SEQ ID NO: 814698 - protein, 30 aa, Mycobacterium
GARGDLARRMLFPSLYRLAAAGRLPADHRI

SEQ ID NO: 814699 - protein, 25 aa, Mycobacterium
GARGGVAEALFPRLLEPLRQIACDA

SEQ ID NO: 814700 - protein, 21 aa, Mycobacterium
GARGLHLFATLLSAAENATGS

SEQ ID NO: 814701 - protein, 24 aa, Mycobacterium
GARGLPFVASYHLTPATALDAVDV

SEQ ID NO: 814702 - protein, 17 aa, Mycobacterium
GARGPGLVEGLDRGDGV

SEQ ID NO: 814703 - protein, 20 aa, Mycobacterium
GARHALVVADLPFGSYEAGP

SEQ ID NO: 814704 - protein, 20 aa, Mycobacterium
GARHRPAIAATIQGLRDAAA

SEQ ID NO: 814705 - protein, 21 aa, Mycobacterium
GARIDPTLWTTAALITAKVDL

SEQ ID NO: 814706 - protein, 23 aa, Mycobacterium
GARISRFYPFGAPFDGGALFVTV

SEQ ID NO: 814707 - protein, 25 aa, Mycobacterium
GARKDTVIVLPKQKLAAVLVADNPG

SEQ ID NO: 814708 - protein, 17 aa, Mycobacterium
GARKLYADTLTQLAYGA

SEQ ID NO: 814709 - protein, 18 aa, Mycobacterium
GARKRLALWAIDTGIRAA

SEQ ID NO: 814710 - protein, 17 aa, Mycobacterium
GARLAWRDDARWAPHGG

SEQ ID NO: 814711 - protein, 26 aa, Mycobacterium
GARLDWPAVFLGWGGRRVSLPTYAFM

SEQ ID NO: 814712 - protein, 24 aa, Mycobacterium
GARLESMIPLGPPVMDVALNITCF

SEQ ID NO: 814713 - protein, 22 aa, Mycobacterium
GARLIDWEWVQINLARVHAKAE

SEQ ID NO: 814714 - protein, 21 aa, Mycobacterium
GARLLAVGLPPTLPHEFPITD

SEQ ID NO: 814715 - protein, 17 aa, Mycobacterium
GARLLFVSQAAGPPALY

SEQ ID NO: 814716 - protein, 19 aa, Mycobacterium
GARLNWLLGHGDAPQWNPD

SEQ ID NO: 814717 - protein, 22 aa, Mycobacterium
GARLPAWAWTNRAALAVLGRIA

SEQ ID NO: 814718 - protein, 23 aa, Mycobacterium
GARLRALRDRLIDGVLSGIEDVG

SEQ ID NO: 814719 - protein, 23 aa, Mycobacterium
GARLRTGLLRIWSAMRDCVARGL

SEQ ID NO: 814720 - protein, 29 aa, Mycobacterium
GARLTTQISLAGRYLVYVPGASSTGISRK

SEQ ID NO: 814721 - protein, 19 aa, Mycobacterium
GARLVFMDAARREWNPSTI

SEQ ID NO: 814722 - protein, 29 aa, Mycobacterium
GARLVLFPEATMCRFGVPLGPVAQPLDGP

SEQ ID NO: 814723 - protein, 20 aa, Mycobacterium
GARLYMFEFSPHNVNGLQWT

SEQ ID NO: 814724 - protein, 27 aa, Mycobacterium
GARMRWASWVSAPMLAGAFAVAWEWDN

SEQ ID NO: 814725 - protein, 25 aa, Mycobacterium
GARNAGLLAVRMLGSSDPALRARIA

SEQ ID NO: 814726 - protein, 23 aa, Mycobacterium
GARNAGLLAVRMLGSSDPQLRAR

SEQ ID NO: 814727 - protein, 24 aa, Mycobacterium
GARNSPRLWIVTRGAQQLSPADEV

SEQ ID NO: 814728 - protein, 34 aa, Mycobacterium
GARPLDSAALRDALLDLHDFWLTTKATEIGITAT

SEQ ID NO: 814729 - protein, 20 aa, Mycobacterium
GARPLPVYCASLRTAEPELL

SEQ ID NO: 814730 - protein, 19 aa, Mycobacterium
GARPRRLSIPGADLPGVCY

SEQ ID NO: 814731 - protein, 22 aa, Mycobacterium
GARQLLLSLMPRIEQADRDDLM

SEQ ID NO: 814732 - protein, 24 aa, Mycobacterium
GARQRLVHRLPTRPDPHAQLGNAF

SEQ ID NO: 814733 - protein, 23 aa, Mycobacterium
GARQYDYLNLAYQVGGKYYPLQL

SEQ ID NO: 814734 - protein, 17 aa, Mycobacterium
GARRGVAARVRPPRARQ

SEQ ID NO: 814735 - protein, 38 aa, Mycobacterium
GARRILLDREKSGAWWSTDGLWKEMVSTGWLGLHIDER

SEQ ID NO: 814736 - protein, 30 aa, Mycobacterium
GARRLYTSRGWLPWHGPTSVLSPTGPTPTP

SEQ ID NO: 814737 - protein, 17 aa, Mycobacterium
GARRRVVRLIDAQVVRV

SEQ ID NO: 814738 - protein, 17 aa, Mycobacterium
GARRSLVAEQPRLRWRL

SEQ ID NO: 814739 - protein, 28 aa, Mycobacterium
GARRVALVTPYYPVIEKNAVSYFEGRGF

SEQ ID NO: 814740 - protein, 32 aa, Mycobacterium
GARRVILVHWDDFFRPLSKPLRAIPYAADDLD

SEQ ID NO: 814741 - protein, 27 aa, Mycobacterium
GARRVPLPTYAFQRTRLWLDAQGGAGL

SEQ ID NO: 814742 - protein, 17 aa, Mycobacterium
GARRVVVVCDGRRLTFG

SEQ ID NO: 814743 - protein, 20 aa, Mycobacterium
GARSLLLNMVAAVTAAGGNA

SEQ ID NO: 814744 - protein, 31 aa, Mycobacterium
GARSPAFLARLLELAPFHKILYSSDGFGPAE

SEQ ID NO: 814745 - protein, 23 aa, Mycobacterium
GARSPAPVLLHGLDESCWPLLEH

SEQ ID NO: 814746 - protein, 23 aa, Mycobacterium
GARSRDDFLFTPELRQWSSRGSI

SEQ ID NO: 814747 - protein, 18 aa, Mycobacterium
GARSVAALVVWKLGSSSA

SEQ ID NO: 814748 - protein, 29 aa, Mycobacterium
GARTLTALYPGRFVLGLGVSHGPLVERGM

SEQ ID NO: 814749 - protein, 17 aa, Mycobacterium
GARTRYFDTYFGKAIEA

SEQ ID NO: 814750 - protein, 22 aa, Mycobacterium
GARVDQLPEIWKRLVDGGMESG

SEQ ID NO: 814751 - protein, 27 aa, Mycobacterium
GARVEHLMPVGPLLFDVALNVTCFSYC

SEQ ID NO: 814752 - protein, 26 aa, Mycobacterium
GARVGYGFITWSLARNPGLLDNALAQ

SEQ ID NO: 814753 - protein, 23 aa, Mycobacterium
GARVPMLPTGWEPGSLDAAHTVL

SEQ ID NO: 814754 - protein, 18 aa, Mycobacterium
GARVRRLLYGRVLITWQA

SEQ ID NO: 814755 - protein, 35 aa, Mycobacterium
GARWATRHLPYYGRWLRFVSWWPIADALDEQITID

SEQ ID NO: 814756 - protein, 18 aa, Mycobacterium
GARYGAIGVWGPEGTLTS

SEQ ID NO: 814757 - protein, 17 aa, Mycobacterium
GARYRAALAGKFLDRFG

SEQ ID NO: 814758 - protein, 26 aa, Mycobacterium
GASAAAARLLPAQSLQDLLAALPNLG

SEQ ID NO: 814759 - protein, 27 aa, Mycobacterium
GASALAARLAPWQQALGAAPGAAASVI

SEQ ID NO: 814760 - protein, 17 aa, Mycobacterium
GASARLLRSVHGGRIGF

SEQ ID NO: 814761 - protein, 26 aa, Mycobacterium
GASAVKIFPAGRFGPRYLSDLHGPYP

SEQ ID NO: 814762 - protein, 18 aa, Mycobacterium
GASDPWTGCRGWEARFGT

SEQ ID NO: 814763 - protein, 23 aa, Mycobacterium
GASHHPAWYLNLVADPHVEITVR

SEQ ID NO: 814764 - protein, 29 aa, Mycobacterium
GASKAAQLGFLRTAAMELAPKKITINAVL

SEQ ID NO: 814765 - protein, 23 aa, Mycobacterium
GASLLAMPQAAIYGAAKAGLNNL

SEQ ID NO: 814766 - protein, 29 aa, Mycobacterium
GASLTYPQLILDPLLGTILRVVIGVGEQL

SEQ ID NO: 814767 - protein, 17 aa, Mycobacterium
GASLYILTFTQDAFPED

SEQ ID NO: 814768 - protein, 18 aa, Mycobacterium
GASMVRLLTPRPDGTRLA

SEQ ID NO: 814769 - protein, 17 aa, Mycobacterium
GASNLLFRRNSVTGAVE

SEQ ID NO: 814770 - protein, 24 aa, Mycobacterium
GASNSLLRFIEDAAHFYFEFHMKQ

SEQ ID NO: 814771 - protein, 24 aa, Mycobacterium
GASNVMIGSWFAGTYESPGDLMHD

SEQ ID NO: 814772 - protein, 23 aa, Mycobacterium
GASNWYTEFARIVPLMEKDTHYE

SEQ ID NO: 814773 - protein, 23 aa, Mycobacterium
GASPRFLLDFSRRFPDATLVRLE

SEQ ID NO: 814774 - protein, 20 aa, Mycobacterium
GASPRFLLDFSRRYPDATVV

SEQ ID NO: 814775 - protein, 25 aa, Mycobacterium
GASPRYLLDFSRRFPEVTLVRLERD

SEQ ID NO: 814776 - protein, 26 aa, Mycobacterium
GASRHAFSLFIYHGIRPPPDSPTAGF

SEQ ID NO: 814777 - protein, 24 aa, Mycobacterium
GASRKRFLGSLLAGPDGAVRPPDG

SEQ ID NO: 814778 - protein, 24 aa, Mycobacterium
GASRKRFLGTLLAGPDGSPRPPDG

SEQ ID NO: 814779 - protein, 24 aa, Mycobacterium
GASSRLLYDLLGHVYDWHGFDTVG

SEQ ID NO: 814780 - protein, 24 aa, Mycobacterium
GASTMVLLPLVRSHVDIPIIAAGG

SEQ ID NO: 814781 - protein, 26 aa, Mycobacterium
GASTPPAIFRWTDRDTLLYALGVGAG

SEQ ID NO: 814782 - protein, 25 aa, Mycobacterium
GASVYPFVWNILLSARNEGFGGVLT

SEQ ID NO: 814783 - protein, 25 aa, Mycobacterium
GASVYPFVWNVLLAARNEGFGGVLT

SEQ ID NO: 814784 - protein, 20 aa, Mycobacterium
GASVYVLRHPDRYPHHLPSS

SEQ ID NO: 814785 - protein, 23 aa, Mycobacterium
GASWGNAGWIAPALTIPANSPAM

SEQ ID NO: 814786 - protein, 17 aa, Mycobacterium
GASWWLREQGTPINTLQ

SEQ ID NO: 814787 - protein, 21 aa, Mycobacterium
GASYFVLVFDRAGMPAGGPVN

SEQ ID NO: 814788 - protein, 22 aa, Mycobacterium
GASYFVLVFDRASMPEGPANAV

SEQ ID NO: 814789 - protein, 17 aa, Mycobacterium
GASYLTRTLGPASYTAL

SEQ ID NO: 814790 - protein, 30 aa, Mycobacterium
GATAAQVALAWLLAKGPDIVPIPGTKRITR

SEQ ID NO: 814791 - protein, 31 aa, Mycobacterium
GATAAQVALAWLLAKGPDIVPIPGTKRVARL

SEQ ID NO: 814792 - protein, 23 aa, Mycobacterium
GATAFMLSWSVRLLAERPGLAKQ

SEQ ID NO: 814793 - protein, 17 aa, Mycobacterium
GATALGCMPYMAQFFVT

SEQ ID NO: 814794 - protein, 26 aa, Mycobacterium
GATASLPMFTLMLARAKLIGTTIRGR

SEQ ID NO: 814795 - protein, 22 aa, Mycobacterium
GATATGFWRWMEATPDGAPIEP

SEQ ID NO: 814796 - protein, 20 aa, Mycobacterium
GATDALLALAASVGADVAIA

SEQ ID NO: 814797 - protein, 27 aa, Mycobacterium
GATDCALPMMWALRRGVKVDTFHIYTD

SEQ ID NO: 814798 - protein, 26 aa, Mycobacterium
GATFDIAHLSGLVRWATLARGLGMRA

SEQ ID NO: 814799 - protein, 21 aa, Mycobacterium
GATFVFVEQWADADALKVHST

SEQ ID NO: 814800 - protein, 18 aa, Mycobacterium
GATGARSVAALLAWKLGS

SEQ ID NO: 814801 - protein, 28 aa, Mycobacterium
GATGFLGRYLALQWLEQLELVDGTLICL

SEQ ID NO: 814802 - protein, 37 aa, Mycobacterium
GATGPLAWLANLGTAYQTFWTNLLNTIPGGANFYTAM

SEQ ID NO: 814803 - protein, 35 aa, Mycobacterium
GATGPLQGVFDLGNAPVQALTGRPLIANGANAATG

SEQ ID NO: 814804 - protein, 18 aa, Mycobacterium
GATGTPLYRLMQSGDISY

SEQ ID NO: 814805 - protein, 20 aa, Mycobacterium
GATGVRLIDFAKQRISPGLI

SEQ ID NO: 814806 - protein, 22 aa, Mycobacterium
GATGYWPAPAVANYALAGAPVI

SEQ ID NO: 814807 - protein, 18 aa, Mycobacterium
GATIGVLGLTFKAGTDDV

SEQ ID NO: 814808 - protein, 18 aa, Mycobacterium
GATILAVDTAPKVIEGDW

SEQ ID NO: 814809 - protein, 18 aa, Mycobacterium
GATILLRLDQDVPNEVRS

SEQ ID NO: 814810 - protein, 27 aa, Mycobacterium
GATIRFPRTAGWGNAMRWMLTADTFDA

SEQ ID NO: 814811 - protein, 20 aa, Mycobacterium
GATITTDRTRPLRAVGTCHG

SEQ ID NO: 814812 - protein, 17 aa, Mycobacterium
GATKPLMKWTDEEWHQV

SEQ ID NO: 814813 - protein, 24 aa, Mycobacterium
GATLIPHLTFDPLRALRAIEQHRI

SEQ ID NO: 814814 - protein, 17 aa, Mycobacterium
GATLLIEPSTFARALVA

SEQ ID NO: 814815 - protein, 23 aa, Mycobacterium
GATLLPWTLPVHRSEAVAMVGIA

SEQ ID NO: 814816 - protein, 23 aa, Mycobacterium
GATLPAYMMPSSLTVLDTLPKTE

SEQ ID NO: 814817 - protein, 22 aa, Mycobacterium
GATLRSPAGWTPPIAAAPQSEL

SEQ ID NO: 814818 - protein, 24 aa, Mycobacterium
GATLRSYLRRWVGAAVKPAQASVQ

SEQ ID NO: 814819 - protein, 23 aa, Mycobacterium
GATLWVIAPQWEPHAHHVAVEFV

SEQ ID NO: 814820 - protein, 20 aa, Mycobacterium
GATNGYGGQGGIGGTGGQGG

SEQ ID NO: 814821 - protein, 28 aa, Mycobacterium
GATPIRGSHLLLAAGRRPNTDDLGLPAA

SEQ ID NO: 814822 - protein, 24 aa, Mycobacterium
GATPLIGFAGAPFTLASYLVEGGP

SEQ ID NO: 814823 - protein, 26 aa, Mycobacterium
GATPRFPRVAGWGNAMRWMLTAEEFD

SEQ ID NO: 814824 - protein, 22 aa, Mycobacterium
GATPYMVLMAAFGALVHRYTQS

SEQ ID NO: 814825 - protein, 21 aa, Mycobacterium
GATPYSVLVAAFMAWIASRGR

SEQ ID NO: 814826 - protein, 33 aa, Mycobacterium
GATRGSFYWHFTDMKAYRAALVASWNTFLENDR

SEQ ID NO: 814827 - protein, 24 aa, Mycobacterium
GATRGWFMSWLARAHPDLVGTYRE

SEQ ID NO: 814828 - protein, 28 aa, Mycobacterium
GATSCYWDYHPSFGSGPFRNVICLSVND

SEQ ID NO: 814829 - protein, 29 aa, Mycobacterium
GATSIYNWELFFHAPFLIACKLTANQRFD

SEQ ID NO: 814830 - protein, 19 aa, Mycobacterium
GATSLFEASSGGTGGAGGA

SEQ ID NO: 814831 - protein, 24 aa, Mycobacterium
GATSPMPGLGWGGSPLSGLLRGSE

SEQ ID NO: 814832 - protein, 25 aa, Mycobacterium
GATTFDPPFFGITHREALVMHPQQR

SEQ ID NO: 814833 - protein, 19 aa, Mycobacterium
GATTFLIEPALDSGPVYGV

SEQ ID NO: 814834 - protein, 17 aa, Mycobacterium
GATTLWIGSGERPKAGA

SEQ ID NO: 814835 - protein, 21 aa, Mycobacterium
GATTTFWFGLGRTLAVGRMAI

SEQ ID NO: 814836 - protein, 24 aa, Mycobacterium
GATVERLSYWLARPHGAPPNGATA

SEQ ID NO: 814837 - protein, 22 aa, Mycobacterium
GATVLLRTLPLGVHGVGVGAAV

SEQ ID NO: 814838 - protein, 25 aa, Mycobacterium
GATVPVVAAPFRFASRPTAADDSAS

SEQ ID NO: 814839 - protein, 30 aa, Mycobacterium
GATVVLQGLHRLWPPLIDFTHRAVADIGHP

SEQ ID NO: 814840 - protein, 30 aa, Mycobacterium
GATVYPAAIAWGATFDPPLVREMAAAIGRD

SEQ ID NO: 814841 - protein, 31 aa, Mycobacterium
GATWSRWGQTLFPIGVLYDPFVERALEPWSF

SEQ ID NO: 814842 - protein, 19 aa, Mycobacterium
GATYLVLAPEHDLVDGLVA

SEQ ID NO: 814843 - protein, 19 aa, Mycobacterium
GATYMNYVGKPLAYILASP

SEQ ID NO: 814844 - protein, 19 aa, Mycobacterium
GATYMNYVGKPLAYILATP

SEQ ID NO: 814845 - protein, 19 aa, Mycobacterium
GATYVPIGFDQPAQRRAAI

SEQ ID NO: 814846 - protein, 18 aa, Mycobacterium
GATYWDPLATLGFLAART

SEQ ID NO: 814847 - protein, 19 aa, Mycobacterium
GAVAETWRGLGTEAPLVVD

SEQ ID NO: 814848 - protein, 27 aa, Mycobacterium
GAVAHLFDSLLGFTAFKLSGSKAQRTA

SEQ ID NO: 814849 - protein, 21 aa, Mycobacterium
GAVAHQSPLWRTEPEPARVRL

SEQ ID NO: 814850 - protein, 17 aa, Mycobacterium
GAVALFHSLSDPTRLAI

SEQ ID NO: 814851 - protein, 26 aa, Mycobacterium
GAVAPGFYGGMPPMGPVASVVNAPRG

SEQ ID NO: 814852 - protein, 23 aa, Mycobacterium
GAVATAALAFRVVHDHVTSVFRH

SEQ ID NO: 814853 - protein, 21 aa, Mycobacterium
GAVDIALLRPPAETSGLALIP

SEQ ID NO: 814854 - protein, 17 aa, Mycobacterium
GAVDYLEIWDAQAWHEY

SEQ ID NO: 814855 - protein, 17 aa, Mycobacterium
GAVEAFWGLDWPREISI

SEQ ID NO: 814856 - protein, 29 aa, Mycobacterium
GAVEPSLPQWFAGTWHRAAVLRYGENPHQ

SEQ ID NO: 814857 - protein, 34 aa, Mycobacterium
GAVEQKFLMDGAFLSVFGVPIQVTLDGRLPELIG

SEQ ID NO: 814858 - protein, 26 aa, Mycobacterium
GAVESRTITFLDIPAAPGFGNTTAGP

SEQ ID NO: 814859 - protein, 26 aa, Mycobacterium
GAVEVWPMFGTFEPSRREGSQWLALL

SEQ ID NO: 814860 - protein, 22 aa, Mycobacterium
GAVFAELIRAGLQALIEAEATE

SEQ ID NO: 814861 - protein, 20 aa, Mycobacterium
GAVFIHGTAVWLESAIEQLV

SEQ ID NO: 814862 - protein, 20 aa, Mycobacterium
GAVGGTGGWLLGDGGAGGNG

SEQ ID NO: 814863 - protein, 18 aa, Mycobacterium
GAVGILHRAGIDPWVIDF

SEQ ID NO: 814864 - protein, 18 aa, Mycobacterium
GAVGILHRAGLDPWVIDF

SEQ ID NO: 814865 - protein, 25 aa, Mycobacterium
GAVGMPLTIRIPFGGGIGAVEHHSE

SEQ ID NO: 814866 - protein, 26 aa, Mycobacterium
GAVGRALRWRLTGLGLRVIAHDPYSD

SEQ ID NO: 814867 - protein, 27 aa, Mycobacterium
GAVHELMRYYPVVFGTIRLAAEDVDLA

SEQ ID NO: 814868 - protein, 19 aa, Mycobacterium
GAVHYSIAPALPGPPVRRR

SEQ ID NO: 814869 - protein, 20 aa, Mycobacterium
GAVIALTYALAQSLTERRIR

SEQ ID NO: 814870 - protein, 20 aa, Mycobacterium
GAVIGFWQPGTHVGFTQWGV

SEQ ID NO: 814871 - protein, 25 aa, Mycobacterium
GAVIIDHWGIIKADIGIRDGRVCAI

SEQ ID NO: 814872 - protein, 24 aa, Mycobacterium
GAVIKPIPLRTPVPGGFTSDDFSI

SEQ ID NO: 814873 - protein, 18 aa, Mycobacterium
GAVISLDLRRFNELHFLD

SEQ ID NO: 814874 - protein, 30 aa, Mycobacterium
GAVKELVLKGILWSLRREGRKPGATSWLKN

SEQ ID NO: 814875 - protein, 17 aa, Mycobacterium
GAVKGFIKGKWDRTDPS

SEQ ID NO: 814876 - protein, 24 aa, Mycobacterium
GAVLEALLLVVDTPVTIDALASAT

SEQ ID NO: 814877 - protein, 30 aa, Mycobacterium
GAVLGGFEAWLLLRSLETAGLRFERQCQNA

SEQ ID NO: 814878 - protein, 17 aa, Mycobacterium
GAVLGRDDLADEGRAQQ

SEQ ID NO: 814879 - protein, 18 aa, Mycobacterium
GAVLLQVRRLCLEGRPDP

SEQ ID NO: 814880 - protein, 24 aa, Mycobacterium
GAVLLRGSPFALGWVAGWVSTEFP

SEQ ID NO: 814881 - protein, 20 aa, Mycobacterium
GAVLPYDYLVYAVGSTTSTP

SEQ ID NO: 814882 - protein, 17 aa, Mycobacterium
GAVLRTAAVRPGESVLV

SEQ ID NO: 814883 - protein, 20 aa, Mycobacterium
GAVLTYPRWLATDVGSEQVV

SEQ ID NO: 814884 - protein, 23 aa, Mycobacterium
GAVLVPIVHIYGMAEVAFVLDQS

SEQ ID NO: 814885 - protein, 17 aa, Mycobacterium
GAVLWRDASEHGGTTGH

SEQ ID NO: 814886 - protein, 18 aa, Mycobacterium
GAVMVRRGLALRSTLLPS

SEQ ID NO: 814887 - protein, 28 aa, Mycobacterium
GAVNAPAQALLGRPLIGNGIDGTATNPN

SEQ ID NO: 814888 - protein, 24 aa, Mycobacterium
GAVNAPTLALLGRPLIGDGAHGTV

SEQ ID NO: 814889 - protein, 31 aa, Mycobacterium
GAVNAPVQTLTGRPLIGNGTPGAAGSGAAGT

SEQ ID NO: 814890 - protein, 29 aa, Mycobacterium
GAVPAWRVERLMSTGFLPAVWRSDDVVVR

SEQ ID NO: 814891 - protein, 26 aa, Mycobacterium
GAVPDPPWHPMPFHANFDTPIYDSVR

SEQ ID NO: 814892 - protein, 18 aa, Mycobacterium
GAVPLLNLATAEQQDRYL

SEQ ID NO: 814893 - protein, 23 aa, Mycobacterium
GAVPLNLRLCTCGPLGHTLRMPS

SEQ ID NO: 814894 - protein, 22 aa, Mycobacterium
GAVPSWISAAFVLEEGFGIAEL

SEQ ID NO: 814895 - protein, 23 aa, Mycobacterium
GAVPSWISAAFVLEEGFPIAELK

SEQ ID NO: 814896 - protein, 22 aa, Mycobacterium
GAVPSWISAAFVLEEGFPIEEL

SEQ ID NO: 814897 - protein, 25 aa, Mycobacterium
GAVQAALSALNIPAPPAVSIPDMPD

SEQ ID NO: 814898 - protein, 27 aa, Mycobacterium
GAVQALGLLPERRLRSAMFTCEPFDIA

SEQ ID NO: 814899 - protein, 23 aa, Mycobacterium
GAVQKALVHKAGLSSGLQPGDVE

SEQ ID NO: 814900 - protein, 22 aa, Mycobacterium
GAVQWVEPPGGPALGLRADGWP

SEQ ID NO: 814901 - protein, 22 aa, Mycobacterium
GAVRAGFATRVLLDLTAGISAE

SEQ ID NO: 814902 - protein, 18 aa, Mycobacterium
GAVRCGIWHVPRLVAAGR

SEQ ID NO: 814903 - protein, 21 aa, Mycobacterium
GAVRFVHEFVVSGKPVAAICH

SEQ ID NO: 814904 - protein, 26 aa, Mycobacterium
GAVRPYRGTIPRLSLAGLLDIARLRW

SEQ ID NO: 814905 - protein, 18 aa, Mycobacterium
GAVRRLAPGRRYTSLVAA

SEQ ID NO: 814906 - protein, 30 aa, Mycobacterium
GAVSLKLPLRQPHNIAWSTWLLEHHCARGV

SEQ ID NO: 814907 - protein, 30 aa, Mycobacterium
GAVSPLNLPIMTSLYLLGAPSTSKLYGDRL

SEQ ID NO: 814908 - protein, 26 aa, Mycobacterium
GAVSPVLEPLIAVHREFYPKADRSVL

SEQ ID NO: 814909 - protein, 21 aa, Mycobacterium
GAVSRVRPMWVLRARGEPGYG

SEQ ID NO: 814910 - protein, 35 aa, Mycobacterium
GAVTDLIEQLIPLMPTIIGFIRDFVSAITVLVEIG

SEQ ID NO: 814911 - protein, 25 aa, Mycobacterium
GAVTPALATLGLGAVPLLNLATAEQ

SEQ ID NO: 814912 - protein, 25 aa, Mycobacterium
GAVTPWNFPHQINLAKVGPALAAGN

SEQ ID NO: 814913 - protein, 24 aa, Mycobacterium
GAVVALPVLRAAVATLASMATFEE

SEQ ID NO: 814914 - protein, 24 aa, Mycobacterium
GAVVLGDWVTFADGPVLADVQASL

SEQ ID NO: 814915 - protein, 25 aa, Mycobacterium
GAVVLLMWTGILAYLDRSGYDYVTG

SEQ ID NO: 814916 - protein, 19 aa, Mycobacterium
GAVVRYIMSRLDDPTPNTS

SEQ ID NO: 814917 - protein, 23 aa, Mycobacterium
GAVYLPVDPSYPQDRMSFVLSDS

SEQ ID NO: 814918 - protein, 19 aa, Mycobacterium
GAVYRLMRAMVSRGALREE

SEQ ID NO: 814919 - protein, 27 aa, Mycobacterium
GAWASVVPHTWLRAVPQLGAARAVRLI

SEQ ID NO: 814920 - protein, 18 aa, Mycobacterium
GAWCWEHFQDFFADAGYR

SEQ ID NO: 814921 - protein, 21 aa, Mycobacterium
GAWFPTPQFASLGLGNLGGGL

SEQ ID NO: 814922 - protein, 17 aa, Mycobacterium
GAWGSVLPAVWSFMLAA

SEQ ID NO: 814923 - protein, 19 aa, Mycobacterium
GAWHLHELTKELGLAAFVA

SEQ ID NO: 814924 - protein, 19 aa, Mycobacterium
GAWIVIPAFNEASVIGEVV

SEQ ID NO: 814925 - protein, 19 aa, Mycobacterium
GAWMRLHPRFDVETMLRHI

SEQ ID NO: 814926 - protein, 18 aa, Mycobacterium
GAWPYLRVLSRLTGIADP

SEQ ID NO: 814927 - protein, 19 aa, Mycobacterium
GAWRAAYQGFAELGIFGVA

SEQ ID NO: 814928 - protein, 29 aa, Mycobacterium
GAWRNHVMYIRYLDRYLLGGDGAWRISHR

SEQ ID NO: 814929 - protein, 25 aa, Mycobacterium
GAWSIDVCMGPWPALSLRDACQRGD

SEQ ID NO: 814930 - protein, 26 aa, Mycobacterium
GAWSIDVCMGPWPALSLRDACQRGDW

SEQ ID NO: 814931 - protein, 18 aa, Mycobacterium
GAWWVLRFNFGFPEHDMY

SEQ ID NO: 814932 - protein, 26 aa, Mycobacterium
GAYAAYYEQWAQPWEIQALLRAHAVA

SEQ ID NO: 814933 - protein, 25 aa, Mycobacterium
GAYAHRWWVRRTLADALREAAQSTP

SEQ ID NO: 814934 - protein, 26 aa, Mycobacterium
GAYAPRLWRYWAQHLDPDRARRDDPR

SEQ ID NO: 814935 - protein, 24 aa, Mycobacterium
GAYASLPYLKRTPGSLMFSTSSSS

SEQ ID NO: 814936 - protein, 19 aa, Mycobacterium
GAYDLFVAGLRETLYGNAT

SEQ ID NO: 814937 - protein, 23 aa, Mycobacterium
GAYEFDLFYLTTQPPSMQAFNAD

SEQ ID NO: 814938 - protein, 23 aa, Mycobacterium
GAYEQMWAQDAAAMYGYAASSSG

SEQ ID NO: 814939 - protein, 21 aa, Mycobacterium
GAYFPSRLVGDQLWISGTTSR

SEQ ID NO: 814940 - protein, 22 aa, Mycobacterium
GAYGALPYLKKAPGSLMFSTSS

SEQ ID NO: 814941 - protein, 24 aa, Mycobacterium
GAYGALPYLKKTPGSLMFSTSSSS

SEQ ID NO: 814942 - protein, 22 aa, Mycobacterium
GAYGILGVALSLPTVVSAHGAG

SEQ ID NO: 814943 - protein, 25 aa, Mycobacterium
GAYGRAKLAVMLWGLELDRRQRVAR

SEQ ID NO: 814944 - protein, 21 aa, Mycobacterium
GAYIITGGIGGLGLFLAGKMA

SEQ ID NO: 814945 - protein, 22 aa, Mycobacterium
GAYLIDQPLMRNVLADLAVEAE

SEQ ID NO: 814946 - protein, 18 aa, Mycobacterium
GAYRFHRIFLQHLQSGVA

SEQ ID NO: 814947 - protein, 20 aa, Mycobacterium
GAYRFHRIFLQHLQSGVAGQ

SEQ ID NO: 814948 - protein, 51 aa, Mycobacterium
GAYSAAELVNVLPLQNVEQDLLNLVNAPTQALFGRPLIGNGADGAAGTGQA

SEQ ID NO: 814949 - protein, 32 aa, Mycobacterium
GAYTQSKLANLLFTYELQRRLAPRGKTIAVAA

SEQ ID NO: 814950 - protein, 23 aa, Mycobacterium
GCAAALVGVVPMGEVADSAAFAG

SEQ ID NO: 814951 - protein, 25 aa, Mycobacterium
GCAASATEWWLGPDPDSPLRMPREQ

SEQ ID NO: 814952 - protein, 25 aa, Mycobacterium
GCAGLRYNLFFDDRALDGDLTAEFG

SEQ ID NO: 814953 - protein, 25 aa, Mycobacterium
GCAGLRYNLFFDDRSLDGDLIAEFG

SEQ ID NO: 814954 - protein, 25 aa, Mycobacterium
GCARKLLSAFKVPTAWLLLDSDDDV

SEQ ID NO: 814955 - protein, 38 aa, Mycobacterium
GCARRLLAAPAVLGLAIDGGWWVLGVHSPAAAECLRGV

SEQ ID NO: 814956 - protein, 24 aa, Mycobacterium
GCASQLEVLLHKLGYETGASGEYR

SEQ ID NO: 814957 - protein, 30 aa, Mycobacterium
GCASSAWTIGFLALHNWMLALFGEQAQAEA

SEQ ID NO: 814958 - protein, 37 aa, Mycobacterium
GCASSAWTLGFYALHNWLLSLFDLRVQQEVFASGPVL

SEQ ID NO: 814959 - protein, 30 aa, Mycobacterium
GCASSAWTLGFYALHNWMLSLFDPRAQEEV

SEQ ID NO: 814960 - protein, 28 aa, Mycobacterium
GCASSAWTLGFYTLHNWMLALFSEEAQQ

SEQ ID NO: 814961 - protein, 24 aa, Mycobacterium
GCAVIDELILAAPLVMHPGAGVKV

SEQ ID NO: 814962 - protein, 18 aa, Mycobacterium
GCCDLAFAAPDAARAIKS

SEQ ID NO: 814963 - protein, 18 aa, Mycobacterium
GCCDLAFATPDASRRIKG

SEQ ID NO: 814964 - protein, 26 aa, Mycobacterium
GCDHFRTNIAFLPDLQAYLDDLLRTR

SEQ ID NO: 814965 - protein, 38 aa, Mycobacterium
GCDKSLPGMLMAAARLDLAAVFLYAGSILPGLAKLSDG

SEQ ID NO: 814966 - protein, 38 aa, Mycobacterium
GCDKSLPGMLMAAARLDLAAVFLYAGSILPGVAKLSDG

SEQ ID NO: 814967 - protein, 38 aa, Mycobacterium
GCDKSLPGMLMAAARLDLASVFLYAGSILPGVAKLSDG

SEQ ID NO: 814968 - protein, 19 aa, Mycobacterium
GCDLAHAHRLIYSAGIDLA

SEQ ID NO: 814969 - protein, 18 aa, Mycobacterium
GCDSMLYLDGRLSGKPGT

SEQ ID NO: 814970 - protein, 23 aa, Mycobacterium
GCDVVYYCVVDARPWLRDPRPMW

SEQ ID NO: 814971 - protein, 18 aa, Mycobacterium
GCDVWLNNPLRPLEACGT

SEQ ID NO: 814972 - protein, 22 aa, Mycobacterium
GCDYAICYFPEAAYDRSGIELF

SEQ ID NO: 814973 - protein, 21 aa, Mycobacterium
GCDYWNIRWIHVDDPACRIQN

SEQ ID NO: 814974 - protein, 24 aa, Mycobacterium
GCESYPGVFQPFGGYPDGCAVTGG

SEQ ID NO: 814975 - protein, 19 aa, Mycobacterium
GCFAAFKAVYECEVPVVTA

SEQ ID NO: 814976 - protein, 24 aa, Mycobacterium
GCFDLMFFDDRLAMPGIYGGSVAE

SEQ ID NO: 814977 - protein, 17 aa, Mycobacterium
GCFPPPPGYFERVREIC

SEQ ID NO: 814978 - protein, 17 aa, Mycobacterium
GCGAAAVNPYLAFESIE

SEQ ID NO: 814979 - protein, 18 aa, Mycobacterium
GCGAAAVNPYLAFESIED

SEQ ID NO: 814980 - protein, 30 aa, Mycobacterium
GCGETPYLKLLSQLFGDRLMIANATGCSSI

SEQ ID NO: 814981 - protein, 28 aa, Mycobacterium
GCGETPYLKLLSQLFGDRLMVANATGCS

SEQ ID NO: 814982 - protein, 25 aa, Mycobacterium
GCGEYVPKLAMYPPAPIRTHSGEQI

SEQ ID NO: 814983 - protein, 26 aa, Mycobacterium
GCGGLIRPDIVWFGEALPEGPWQHAV

SEQ ID NO: 814984 - protein, 25 aa, Mycobacterium
GCGRLRDRLLFAVLYDTGMFSRARP

SEQ ID NO: 814985 - protein, 27 aa, Mycobacterium
GCGYEFRLETSCYNPVFGANREARVFI

SEQ ID NO: 814986 - protein, 18 aa, Mycobacterium
GCHALLRGDAHLVTRAAE

SEQ ID NO: 814987 - protein, 24 aa, Mycobacterium
GCHHYRFHLFALSSPVPATVETKG

SEQ ID NO: 814988 - protein, 24 aa, Mycobacterium
GCHLTWIMALQPNGVAGRAGLFLG

SEQ ID NO: 814989 - protein, 28 aa, Mycobacterium
GCHWTGFNKVWWYYAQPEYRDCLFVKVD

SEQ ID NO: 814990 - protein, 19 aa, Mycobacterium
GCIFMWYQPHGKEPQWELP

SEQ ID NO: 814991 - protein, 21 aa, Mycobacterium
GCIPTKMFVYAAGVAEQIRES

SEQ ID NO: 814992 - protein, 21 aa, Mycobacterium
GCIVRLVAIADPTGSYRIETG

SEQ ID NO: 814993 - protein, 21 aa, Mycobacterium
GCLERGVRVGCFRPPTVPAGT

SEQ ID NO: 814994 - protein, 18 aa, Mycobacterium
GCLLFCLESRTACIVARA

SEQ ID NO: 814995 - protein, 19 aa, Mycobacterium
GCLPTKMFVYAADVAKTIR

SEQ ID NO: 814996 - protein, 20 aa, Mycobacterium
GCMRGRTMYVVPFCMGPLGA

SEQ ID NO: 814997 - protein, 21 aa, Mycobacterium
GCMRGRTMYVVPFCMGPLGAE

SEQ ID NO: 814998 - protein, 28 aa, Mycobacterium
GCPADDLLPLAARLAPLRAAAGQVLMRQ

SEQ ID NO: 814999 - protein, 27 aa, Mycobacterium
GCPADQVWWEIWQQISPMLVSVLDTGV

SEQ ID NO: 815000 - protein, 17 aa, Mycobacterium
GCPFAPRCPLAIDECTA

SEQ ID NO: 815001 - protein, 17 aa, Mycobacterium
GCPFAPRCPLVIDECRS

SEQ ID NO: 815002 - protein, 17 aa, Mycobacterium
GCPLEGLRILDLGIIVA

SEQ ID NO: 815003 - protein, 18 aa, Mycobacterium
GCPLINIHHSFLPAFIGA

SEQ ID NO: 815004 - protein, 20 aa, Mycobacterium
GCPLLGTWQSIVLVDLNRDN

SEQ ID NO: 815005 - protein, 29 aa, Mycobacterium
GCPPTAWMPLWQWLLHVRPAPSSRWRRAT

SEQ ID NO: 815006 - protein, 23 aa, Mycobacterium
GCPRTKMVLGGYSQGAAVMGFVT

SEQ ID NO: 815007 - protein, 20 aa, Mycobacterium
GCPTLWRNDSLRRSWRRFHE

SEQ ID NO: 815008 - protein, 20 aa, Mycobacterium
GCQHWNEQMLRAARIGPQSR

SEQ ID NO: 815009 - protein, 27 aa, Mycobacterium
GCQVKSMYPLGPIFHGSGLNITVMSLN

SEQ ID NO: 815010 - protein, 22 aa, Mycobacterium
GCRAFTPAQWRKHPQGALLART

SEQ ID NO: 815011 - protein, 23 aa, Mycobacterium
GCRGEVPLGMLIDLLAAHHGVDA

SEQ ID NO: 815012 - protein, 28 aa, Mycobacterium
GCRGLGPIGRRLLGSVTAGLIRHARCPV

SEQ ID NO: 815013 - protein, 21 aa, Mycobacterium
GCRKRELAADLLRTVAVRDGN

SEQ ID NO: 815014 - protein, 24 aa, Mycobacterium
GCRQGDPLILAADFDRLRVFFESQ

SEQ ID NO: 815015 - protein, 24 aa, Mycobacterium
GCRRREWPAYPDMDPLGNVAGMMR

SEQ ID NO: 815016 - protein, 20 aa, Mycobacterium
GCSCGPRRWPRQVAVRAGMG

SEQ ID NO: 815017 - protein, 25 aa, Mycobacterium
GCSGDLAPLAHCALALMGEGEVRDA

SEQ ID NO: 815018 - protein, 33 aa, Mycobacterium
GCSPLDYMEELGWLGPDVWFAHGVHFDDASIAR

SEQ ID NO: 815019 - protein, 17 aa, Mycobacterium
GCSSVYHSIRCALALAA

SEQ ID NO: 815020 - protein, 26 aa, Mycobacterium
GCSTYKWETFLTSELPEWLSANRSVK

SEQ ID NO: 815021 - protein, 26 aa, Mycobacterium
GCSTYKWETFLTSELPQYLASNKGVK

SEQ ID NO: 815022 - protein, 18 aa, Mycobacterium
GCSVILDGTWRDEEETGR

SEQ ID NO: 815023 - protein, 23 aa, Mycobacterium
GCTGVFVTLVPFAVDGGTALTAV

SEQ ID NO: 815024 - protein, 23 aa, Mycobacterium
GCTIKLLAICERLTSPKGKQKVS

SEQ ID NO: 815025 - protein, 26 aa, Mycobacterium
GCTRYVALLACYLMHRARSCAGADAV

SEQ ID NO: 815026 - protein, 20 aa, Mycobacterium
GCVFQDFRLLQQKTVYENVA

SEQ ID NO: 815027 - protein, 23 aa, Mycobacterium
GCVFQDFRLLQQKTVYENVAFAL

SEQ ID NO: 815028 - protein, 24 aa, Mycobacterium
GCVFQDFRLLQQKTVYENVAFALE

SEQ ID NO: 815029 - protein, 20 aa, Mycobacterium
GCVTIRAQRSARWLDVIVHD

SEQ ID NO: 815030 - protein, 20 aa, Mycobacterium
GCVYSVFTEGYWSTAGPSAI

SEQ ID NO: 815031 - protein, 24 aa, Mycobacterium
GCWQPLTHDLWPAPELVMDSGNSI

SEQ ID NO: 815032 - protein, 22 aa, Mycobacterium
GCWRSYLTCDANLAVTLPAGLS

SEQ ID NO: 815033 - protein, 18 aa, Mycobacterium
GCWVLTNHPFLTGRPSRA

SEQ ID NO: 815034 - protein, 20 aa, Mycobacterium
GCYGIQRIHPLRNVMILAGA

SEQ ID NO: 815035 - protein, 23 aa, Mycobacterium
GCYGVHVLRRFGVPSILSATAVQ

SEQ ID NO: 815036 - protein, 19 aa, Mycobacterium
GCYPTAALLALLPALAEDL

SEQ ID NO: 815037 - protein, 19 aa, Mycobacterium
GCYPTAALLALLPAMADDL

SEQ ID NO: 815038 - protein, 22 aa, Mycobacterium
GCYPTAALLALSPAVTAGLVEP

SEQ ID NO: 815039 - protein, 20 aa, Mycobacterium
GCYRMLPPPGAIAAGGLYTA

SEQ ID NO: 815040 - protein, 23 aa, Mycobacterium
GDAAAPLLVFYHGGGWALGDLDT

SEQ ID NO: 815041 - protein, 22 aa, Mycobacterium
GDAALLARLQLLTTLVAGNPDQ

SEQ ID NO: 815042 - protein, 20 aa, Mycobacterium
GDAAMIWTLRPQLGDMVERM

SEQ ID NO: 815043 - protein, 17 aa, Mycobacterium
GDAAYPTVPYTFSRSPA

SEQ ID NO: 815044 - protein, 18 aa, Mycobacterium
GDACPVFPGLRYEEWKLE

SEQ ID NO: 815045 - protein, 28 aa, Mycobacterium
GDADFAKYPFLVRGYIGPKALLANGVRY

SEQ ID NO: 815046 - protein, 21 aa, Mycobacterium
GDAFLAWQRFSQETPDFPVGH

SEQ ID NO: 815047 - protein, 25 aa, Mycobacterium
GDAFMAGLLDALWELGLLGADRRAA

SEQ ID NO: 815048 - protein, 25 aa, Mycobacterium
GDAFMTGLIDALWSADLLGADRRHH

SEQ ID NO: 815049 - protein, 22 aa, Mycobacterium
GDAFVADCAALSEGFSAAARSA

SEQ ID NO: 815050 - protein, 18 aa, Mycobacterium
GDAGAALALPADSVVLSA

SEQ ID NO: 815051 - protein, 24 aa, Mycobacterium
GDAGAALLLERAPAGSAGIALAGF

SEQ ID NO: 815052 - protein, 26 aa, Mycobacterium
GDAGDIAYPYYLVNGRIPAAPTSFKA

SEQ ID NO: 815053 - protein, 27 aa, Mycobacterium
GDAGDVAYPYYLINGRIPAAPTTFNAK

SEQ ID NO: 815054 - protein, 23 aa, Mycobacterium
GDAGIALAILGTGLAAASVAANG

SEQ ID NO: 815055 - protein, 25 aa, Mycobacterium
GDAGLNNQIFGAKGTPNGAAGGYGG

SEQ ID NO: 815056 - protein, 25 aa, Mycobacterium
GDAHHHVLMRILIAARAHGINAIDG

SEQ ID NO: 815057 - protein, 33 aa, Mycobacterium
GDAKTISLLKFESARLWPLLDELRRVGVRLVQA

SEQ ID NO: 815058 - protein, 26 aa, Mycobacterium
GDALAEWLNSCQPQLIAAAHWEAIDN

SEQ ID NO: 815059 - protein, 17 aa, Mycobacterium
GDALLAGYLAACSDGPA

SEQ ID NO: 815060 - protein, 17 aa, Mycobacterium
GDALLDLERLYAALAQT

SEQ ID NO: 815061 - protein, 20 aa, Mycobacterium
GDALLIIDGLFFQQASVRHK

SEQ ID NO: 815062 - protein, 21 aa, Mycobacterium
GDALPFLVKVLAADEPLSLQA

SEQ ID NO: 815063 - protein, 20 aa, Mycobacterium
GDALRVVYLLVAGQPDRRVE

SEQ ID NO: 815064 - protein, 25 aa, Mycobacterium
GDALTAAWAIRLAVAPGIDVRFGIG

SEQ ID NO: 815065 - protein, 17 aa, Mycobacterium
GDALWDTGIEFGTLGVG

SEQ ID NO: 815066 - protein, 22 aa, Mycobacterium
GDAMSYRVLISDLAALYHGGAQ

SEQ ID NO: 815067 - protein, 28 aa, Mycobacterium
GDAPEPFELPFLYVPPSATDLAAAATAV

SEQ ID NO: 815068 - protein, 25 aa, Mycobacterium
GDAPRFHSGWINGIKKFDTAYCPVT

SEQ ID NO: 815069 - protein, 28 aa, Mycobacterium
GDAQRRMRFVLEIVRRTKAAVSPGFAVA

SEQ ID NO: 815070 - protein, 24 aa, Mycobacterium
GDAQVRLFRRAMTQAGIRPEDVGM

SEQ ID NO: 815071 - protein, 25 aa, Mycobacterium
GDARLIDSYVRPTLAGGKIGALAIT

SEQ ID NO: 815072 - protein, 26 aa, Mycobacterium
GDASRARLLRDALRLSFRGSGGPFRS

SEQ ID NO: 815073 - protein, 18 aa, Mycobacterium
GDATLPEPIPTTTPKQPA

SEQ ID NO: 815074 - protein, 23 aa, Mycobacterium
GDAVFFNPALFHGAGANTSTGIR

SEQ ID NO: 815075 - protein, 20 aa, Mycobacterium
GDAVFFNPALYHGAGQNRSR

SEQ ID NO: 815076 - protein, 22 aa, Mycobacterium
GDCALNRGVFGDAYGVVGSVGE

SEQ ID NO: 815077 - protein, 20 aa, Mycobacterium
GDCIAEPMWVHRYGDRGKIV

SEQ ID NO: 815078 - protein, 19 aa, Mycobacterium
GDCTMLMPALARETRHIGF

SEQ ID NO: 815079 - protein, 23 aa, Mycobacterium
GDCVAFFWFAEAADRVPGISSPG

SEQ ID NO: 815080 - protein, 29 aa, Mycobacterium
GDCVHTHHRLLGITWLPLGTTAHKQGRVA

SEQ ID NO: 815081 - protein, 25 aa, Mycobacterium
GDDARLLFVVFGVEDVVWKASLGEL

SEQ ID NO: 815082 - protein, 27 aa, Mycobacterium
GDDDNEAKWFWFEGNFGAYEENKIERL

SEQ ID NO: 815083 - protein, 27 aa, Mycobacterium
GDDDNEAKWFWFEGNFGAYEENKIQRM

SEQ ID NO: 815084 - protein, 26 aa, Mycobacterium
GDDFPLARLYAWHRAMRLFDGPDEVH

SEQ ID NO: 815085 - protein, 21 aa, Mycobacterium
GDDFVSHLFGMFAFAIVERDS

SEQ ID NO: 815086 - protein, 31 aa, Mycobacterium
GDDGQPLLLTPPPWYPILRGTTQQALFETAR

SEQ ID NO: 815087 - protein, 24 aa, Mycobacterium
GDDLLQELLWTYGPCGQEDEVRAV

SEQ ID NO: 815088 - protein, 23 aa, Mycobacterium
GDDLPRWHPGAHLDLHLPSGRIR

SEQ ID NO: 815089 - protein, 17 aa, Mycobacterium
GDDLTEFAVIIEPTRSD

SEQ ID NO: 815090 - protein, 19 aa, Mycobacterium
GDDLYILYTGGTTGLPKGV

SEQ ID NO: 815091 - protein, 18 aa, Mycobacterium
GDDPIGCIVARSLQKEPN

SEQ ID NO: 815092 - protein, 18 aa, Mycobacterium
GDDPVLLTGTRWLDQARA

SEQ ID NO: 815093 - protein, 27 aa, Mycobacterium
GDDQVLAKCFLLWAGVLGAISLEVFGQ

SEQ ID NO: 815094 - protein, 27 aa, Mycobacterium
GDDRVVAKCFLLWAGVLGAISLEVFGQ

SEQ ID NO: 815095 - protein, 18 aa, Mycobacterium
GDDRWRSLPTPEGDTFEW

SEQ ID NO: 815096 - protein, 24 aa, Mycobacterium
GDDWTPVTLLEGGTPLIAATRLSE

SEQ ID NO: 815097 - protein, 28 aa, Mycobacterium
GDDYQLMPWLLAIMRNTWISRYRAAQRR

SEQ ID NO: 815098 - protein, 19 aa, Mycobacterium
GDEAALRPFLLVASFINPH

SEQ ID NO: 815099 - protein, 17 aa, Mycobacterium
GDEARHMLMFGKAIRRI

SEQ ID NO: 815100 - protein, 27 aa, Mycobacterium
GDECHMAFHFPLMPRIFMAVRRESRIP

SEQ ID NO: 815101 - protein, 22 aa, Mycobacterium
GDEDAILARFKRFADAGVTDLS

SEQ ID NO: 815102 - protein, 23 aa, Mycobacterium
GDEDAILARLLRFADAGVTDLSV

SEQ ID NO: 815103 - protein, 23 aa, Mycobacterium
GDEDFWLKVGIDPVRIMTGTGTF

SEQ ID NO: 815104 - protein, 27 aa, Mycobacterium
GDEDNEAKWFWFEGNFGAYEENKVERL

SEQ ID NO: 815105 - protein, 25 aa, Mycobacterium
GDEFAIVHKLRRVLSGLDSHQAIDL

SEQ ID NO: 815106 - protein, 17 aa, Mycobacterium
GDEFGYFQFGGSDIILL

SEQ ID NO: 815107 - protein, 27 aa, Mycobacterium
GDEGHWQMLPRILAITVRDGKVCALWD

SEQ ID NO: 815108 - protein, 28 aa, Mycobacterium
GDEGLDLAIVYLPPPYDPAVLEPLAEKI

SEQ ID NO: 815109 - protein, 30 aa, Mycobacterium
GDEIAIPTPYWPSYLDIARLSGLTTRVLPY

SEQ ID NO: 815110 - protein, 22 aa, Mycobacterium
GDEIISAERIFLNVGGRAVVPD

SEQ ID NO: 815111 - protein, 21 aa, Mycobacterium
GDEISAAVAALFGSYAQGYQS

SEQ ID NO: 815112 - protein, 23 aa, Mycobacterium
GDEIVLRLFGKMVELAFVAVPDE

SEQ ID NO: 815113 - protein, 25 aa, Mycobacterium
GDELCVCDMAWVVGLPQGLVSHHLR

SEQ ID NO: 815114 - protein, 25 aa, Mycobacterium
GDELLARRKLLLPPFNGKNMRAYED

SEQ ID NO: 815115 - protein, 17 aa, Mycobacterium
GDELLAWLRDRLAHYKC

SEQ ID NO: 815116 - protein, 17 aa, Mycobacterium
GDELLGVEVFASALSSP

SEQ ID NO: 815117 - protein, 29 aa, Mycobacterium
GDELRTLISVPLFHATGCNSQLLAAARVG

SEQ ID NO: 815118 - protein, 26 aa, Mycobacterium
GDEMTRVIWKLIKDQLILPHLDIDLD

SEQ ID NO: 815119 - protein, 24 aa, Mycobacterium
GDEMTRVIWKLIKDRLILPHLDVK

SEQ ID NO: 815120 - protein, 27 aa, Mycobacterium
GDEPMTGAQRSYLNTLAQEAGVEAPDD

SEQ ID NO: 815121 - protein, 26 aa, Mycobacterium
GDEPVEPPQKWSASGKFGLVANEASE

SEQ ID NO: 815122 - protein, 18 aa, Mycobacterium
GDEREDPARWLTGHGWTV

SEQ ID NO: 815123 - protein, 23 aa, Mycobacterium
GDERGWLFSGRLSAQTHAWLADH

SEQ ID NO: 815124 - protein, 23 aa, Mycobacterium
GDERLDALIGFVGDLVAGITNAP

SEQ ID NO: 815125 - protein, 29 aa, Mycobacterium
GDESMSLTMALLAAAVLYAASAEAADIDC

SEQ ID NO: 815126 - protein, 25 aa, Mycobacterium
GDETGWLLGDYILSGIADPSKAVVA

SEQ ID NO: 815127 - protein, 26 aa, Mycobacterium
GDETGWLLGDYILSKQPPGDWIVAST

SEQ ID NO: 815128 - protein, 18 aa, Mycobacterium
GDETLLGSIRRLLAQRRT

SEQ ID NO: 815129 - protein, 32 aa, Mycobacterium
GDETQWDWLELPDPPALWGWGKTAHLLVGSLA

SEQ ID NO: 815130 - protein, 25 aa, Mycobacterium
GDEVLLFVDTFTNYFTPDVGIATVR

SEQ ID NO: 815131 - protein, 24 aa, Mycobacterium
GDEVLLRLFGKIVEVAFLAVPDEI

SEQ ID NO: 815132 - protein, 25 aa, Mycobacterium
GDEVLLRLFGKLVELVFLAVPDEIR

SEQ ID NO: 815133 - protein, 24 aa, Mycobacterium
GDEVLLRLFGKLVEVAFLAVPDEI

SEQ ID NO: 815134 - protein, 25 aa, Mycobacterium
GDEVMGLYFAPLTRDGRYVNSMVSD

SEQ ID NO: 815135 - protein, 17 aa, Mycobacterium
GDEWEAFLGKDEDLFVF

SEQ ID NO: 815136 - protein, 20 aa, Mycobacterium
GDEWPALLEKITAADIVVLS

SEQ ID NO: 815137 - protein, 22 aa, Mycobacterium
GDFARAYLSTGLIALGKTRLSE

SEQ ID NO: 815138 - protein, 19 aa, Mycobacterium
GDFATGYIVTPSLPAERTG

SEQ ID NO: 815139 - protein, 18 aa, Mycobacterium
GDFDLSTLRFALSGAEPV

SEQ ID NO: 815140 - protein, 26 aa, Mycobacterium
GDFELQVLGMWLMSLRHLAVGDPEPA

SEQ ID NO: 815141 - protein, 18 aa, Mycobacterium
GDFFGVVAQLPGAGGRVT

SEQ ID NO: 815142 - protein, 27 aa, Mycobacterium
GDFGGGSMFLLLGILSALWERQTSGKG

SEQ ID NO: 815143 - protein, 23 aa, Mycobacterium
GDFGLNDLLPPAPTDLEPPADQT

SEQ ID NO: 815144 - protein, 23 aa, Mycobacterium
GDFLALRAFCPQACYAGGPSNFR

SEQ ID NO: 815145 - protein, 31 aa, Mycobacterium
GDFLRAIHEMLLSDAFWDDIFRELGNPYLPV

SEQ ID NO: 815146 - protein, 31 aa, Mycobacterium
GDFLRTIHEMLLSDAFWDEIFRELGNPYLPV

SEQ ID NO: 815147 - protein, 26 aa, Mycobacterium
GDFPVRPLNLLATVNALLGYGIMHGE

SEQ ID NO: 815148 - protein, 24 aa, Mycobacterium
GDFRKLWITRINAAARLNGITYNR

SEQ ID NO: 815149 - protein, 29 aa, Mycobacterium
GDFRPELPAAWLTEALYGLIGGTAWSVRA

SEQ ID NO: 815150 - protein, 20 aa, Mycobacterium
GDFVGVMRRLAAGEGPVRVV

SEQ ID NO: 815151 - protein, 31 aa, Mycobacterium
GDFVQLVSVKLPGRIFGSFFGLPEGELRDRA

SEQ ID NO: 815152 - protein, 20 aa, Mycobacterium
GDFWLVGRRGSVARTARGMI

SEQ ID NO: 815153 - protein, 23 aa, Mycobacterium
GDGAESTDPTLAGQAGGQGGTGG

SEQ ID NO: 815154 - protein, 22 aa, Mycobacterium
GDGAGILIQLPVDLLRDVADFD

SEQ ID NO: 815155 - protein, 25 aa, Mycobacterium
GDGAGILIQLPVELLREVVDFELPA

SEQ ID NO: 815156 - protein, 21 aa, Mycobacterium
GDGFRIPELLASTGSRLREVG

SEQ ID NO: 815157 - protein, 30 aa, Mycobacterium
GDGGAGGRGGWLWSAGGDGGAGGLGGTGGA

SEQ ID NO: 815158 - protein, 18 aa, Mycobacterium
GDGGLFFSSGGAGGEGGA

SEQ ID NO: 815159 - protein, 22 aa, Mycobacterium
GDGGLHLSSFVGPGGSGGDGGA

SEQ ID NO: 815160 - protein, 22 aa, Mycobacterium
GDGGNAGALFGIGAGGHGGNAG

SEQ ID NO: 815161 - protein, 23 aa, Mycobacterium
GDGGSGGLGGHGGTGADNTTAVS

SEQ ID NO: 815162 - protein, 18 aa, Mycobacterium
GDGGTGGLGGDGGGAGQG

SEQ ID NO: 815163 - protein, 24 aa, Mycobacterium
GDGGTLGYPLPWADEPDRSHLVTP

SEQ ID NO: 815164 - protein, 20 aa, Mycobacterium
GDGGWLFGDGGSGGAGGAGG

SEQ ID NO: 815165 - protein, 20 aa, Mycobacterium
GDGGWLYGNGGAGGSGAAGQ

SEQ ID NO: 815166 - protein, 19 aa, Mycobacterium
GDGGWLYGNGGAGGSGASG

SEQ ID NO: 815167 - protein, 26 aa, Mycobacterium
GDGHVRVIRGFLAHLPAEVDLPTREA

SEQ ID NO: 815168 - protein, 25 aa, Mycobacterium
GDGIDVLWRKLAELAAPTDTAVDVV

SEQ ID NO: 815169 - protein, 24 aa, Mycobacterium
GDGKSSLLRLLTGQLKPDSGRVTR

SEQ ID NO: 815170 - protein, 35 aa, Mycobacterium
GDGLRQWEWRKDGESLWWALVGRNKRDISLSLSDP

SEQ ID NO: 815171 - protein, 18 aa, Mycobacterium
GDGNPLDYGGRLSFGDFS

SEQ ID NO: 815172 - protein, 20 aa, Mycobacterium
GDGPLPLMWGEYRPGELVRG

SEQ ID NO: 815173 - protein, 24 aa, Mycobacterium
GDGQPWFRDDLSFADPSIPRSGSA

SEQ ID NO: 815174 - protein, 26 aa, Mycobacterium
GDGQVIILTCSPQRYADVRSARHIEL

SEQ ID NO: 815175 - protein, 29 aa, Mycobacterium
GDGQVQWNMQLLSYLFDHGLDPAEAVSAP

SEQ ID NO: 815176 - protein, 28 aa, Mycobacterium
GDGRDRLTPFRPFQVNQRLLGLADPEAI

SEQ ID NO: 815177 - protein, 27 aa, Mycobacterium
GDGRNDLWRLFVYDPALNRKPSDSEIL

SEQ ID NO: 815178 - protein, 24 aa, Mycobacterium
GDGRRFWIVGLEIDRHWPALCRVV

SEQ ID NO: 815179 - protein, 25 aa, Mycobacterium
GDGRRFWIVGLQADRHWPALCRVVG

SEQ ID NO: 815180 - protein, 20 aa, Mycobacterium
GDGRRLVAFLGSTIGNFTPG

SEQ ID NO: 815181 - protein, 24 aa, Mycobacterium
GDGRVRARRDISVKIPAGVGDGMR

SEQ ID NO: 815182 - protein, 19 aa, Mycobacterium
GDGRWDVRLADADGDGAAE

SEQ ID NO: 815183 - protein, 25 aa, Mycobacterium
GDGSAWINQLYWNLADYAGSPRRII

SEQ ID NO: 815184 - protein, 33 aa, Mycobacterium
GDGSRPVIGTVMRQGYKLGDQILRHAMVGVVDT

SEQ ID NO: 815185 - protein, 26 aa, Mycobacterium
GDGTRLRFAVQVAVKIPLVGRKLEKS

SEQ ID NO: 815186 - protein, 25 aa, Mycobacterium
GDGTTVFFDYPPHPRTIAHTVRGFD

SEQ ID NO: 815187 - protein, 26 aa, Mycobacterium
GDGTTVFFDYPPHPRTIAHTVRGFDE

SEQ ID NO: 815188 - protein, 23 aa, Mycobacterium
GDGVLAVRGLGLWAGVDVDPALG

SEQ ID NO: 815189 - protein, 21 aa, Mycobacterium
GDGVLYWQVPKSQTLGSPVGK

SEQ ID NO: 815190 - protein, 20 aa, Mycobacterium
GDGVWNWYSAPQLPAEVLQA

SEQ ID NO: 815191 - protein, 17 aa, Mycobacterium
GDGWVHFDAPAGMLIPD

SEQ ID NO: 815192 - protein, 19 aa, Mycobacterium
GDGWVHFDAPAGMLIPDSV

SEQ ID NO: 815193 - protein, 25 aa, Mycobacterium
GDGYDPFIDKLLKDGEPRVNAYQLL

SEQ ID NO: 815194 - protein, 29 aa, Mycobacterium
GDGYDVVLDLVYGKPFIAALDATANGGTL

SEQ ID NO: 815195 - protein, 18 aa, Mycobacterium
GDHARIATWRREVSLRRT

SEQ ID NO: 815196 - protein, 19 aa, Mycobacterium
GDHGFFVRPAVFADALPTM

SEQ ID NO: 815197 - protein, 18 aa, Mycobacterium
GDHLIIPNDAYGGTFRLI

SEQ ID NO: 815198 - protein, 17 aa, Mycobacterium
GDHPQVFLTLTAPSFGA

SEQ ID NO: 815199 - protein, 22 aa, Mycobacterium
GDHQLAIMLGGPERDEFFAKAQ

SEQ ID NO: 815200 - protein, 26 aa, Mycobacterium
GDHRFSYDPTFLLRGLSELRIEYTAA

SEQ ID NO: 815201 - protein, 30 aa, Mycobacterium
GDHSRRLWTLLIFMLWHAIFVERSVVPQIS

SEQ ID NO: 815202 - protein, 18 aa, Mycobacterium
GDHSVALPSLRAAHAVHG

SEQ ID NO: 815203 - protein, 20 aa, Mycobacterium
GDHVCYLLEPVSVWAPECSE

SEQ ID NO: 815204 - protein, 24 aa, Mycobacterium
GDHVKLLFNIVPESAVYLADRDLA

SEQ ID NO: 815205 - protein, 25 aa, Mycobacterium
GDHYLITQPFGLSPFQIFPVRASVK

SEQ ID NO: 815206 - protein, 19 aa, Mycobacterium
GDIAAGRFAKRGVPFAALV

SEQ ID NO: 815207 - protein, 18 aa, Mycobacterium
GDIAALNVRIRLALRRCG

SEQ ID NO: 815208 - protein, 32 aa, Mycobacterium
GDIAGLPAYPAYALLVEFMAYTGLRAAEVSGL

SEQ ID NO: 815209 - protein, 24 aa, Mycobacterium
GDIAGTLSILAFTFTMVTGGNDTV

SEQ ID NO: 815210 - protein, 25 aa, Mycobacterium
GDIAGTLSILAFTFTMVTGGNDTVT

SEQ ID NO: 815211 - protein, 17 aa, Mycobacterium
GDIALAHKIIAIGIDDT

SEQ ID NO: 815212 - protein, 17 aa, Mycobacterium
GDIARLLGAINELVRRG

SEQ ID NO: 815213 - protein, 24 aa, Mycobacterium
GDIARRFAGLWRGERGQQGTEPPA

SEQ ID NO: 815214 - protein, 24 aa, Mycobacterium
GDIARSWLFERISMLPRSAAPFKT

SEQ ID NO: 815215 - protein, 23 aa, Mycobacterium
GDIDALMELLAPDVVWTADSAGK

SEQ ID NO: 815216 - protein, 25 aa, Mycobacterium
GDIDGFWAAVLHRTAERRGELPSNA

SEQ ID NO: 815217 - protein, 26 aa, Mycobacterium
GDIDGFWAAVLHRTAQRRGELPSNAV

SEQ ID NO: 815218 - protein, 26 aa, Mycobacterium
GDIDGLWAAVLHRTAERRAGVLGRHD

SEQ ID NO: 815219 - protein, 27 aa, Mycobacterium
GDIDKPKLVFFFDEAHLLFADASKAFL

SEQ ID NO: 815220 - protein, 26 aa, Mycobacterium
GDIDRGGVFAAFFGTIALLSAEDQAL

SEQ ID NO: 815221 - protein, 24 aa, Mycobacterium
GDIDYRAFQTIVFRTDLITDAEVL

SEQ ID NO: 815222 - protein, 20 aa, Mycobacterium
GDIGGTWDLFRYPGIRSDSD

SEQ ID NO: 815223 - protein, 18 aa, Mycobacterium
GDIKACWIMCTNPVATVA

SEQ ID NO: 815224 - protein, 26 aa, Mycobacterium
GDIKPEHLILIGQIAQEFGLYTKITG

SEQ ID NO: 815225 - protein, 17 aa, Mycobacterium
GDILAVSGGIGADGQSG

SEQ ID NO: 815226 - protein, 18 aa, Mycobacterium
GDILSAKVDLAPPSAPLV

SEQ ID NO: 815227 - protein, 18 aa, Mycobacterium
GDILVPPGFTRALGVPPA

SEQ ID NO: 815228 - protein, 29 aa, Mycobacterium
GDINAPPVLLIMGLGAQLLLWRTGFCQKL

SEQ ID NO: 815229 - protein, 17 aa, Mycobacterium
GDIPFYEPGLRKLLRDN

SEQ ID NO: 815230 - protein, 24 aa, Mycobacterium
GDIPTLLTGVEWLDTARAAGVDAI

SEQ ID NO: 815231 - protein, 25 aa, Mycobacterium
GDIQLYYRRVRGWAMVFGEPAVALD

SEQ ID NO: 815232 - protein, 20 aa, Mycobacterium
GDIQWNFEKFLLAADGTVVN

SEQ ID NO: 815233 - protein, 23 aa, Mycobacterium
GDIQWNFEKFLLAPDGAVVQRFR

SEQ ID NO: 815234 - protein, 24 aa, Mycobacterium
GDIQWNFEKFLLSPGGEVVRRFRP

SEQ ID NO: 815235 - protein, 24 aa, Mycobacterium
GDISGVLSILAFTFTMVTGGNDTT

SEQ ID NO: 815236 - protein, 19 aa, Mycobacterium
GDIVLPGSCTRAIDAHAGD

SEQ ID NO: 815237 - protein, 23 aa, Mycobacterium
GDIVVVHTGWWTRFLSAGDGAEP

SEQ ID NO: 815238 - protein, 20 aa, Mycobacterium
GDKALDWPDVYVFTGLTSDE

SEQ ID NO: 815239 - protein, 21 aa, Mycobacterium
GDKALDWPDVYVFTGRTPDEL

SEQ ID NO: 815240 - protein, 25 aa, Mycobacterium
GDKATYLTPAAAGPVILLFPGQGGE

SEQ ID NO: 815241 - protein, 27 aa, Mycobacterium
GDKDFWLQVGIDPIRIMTSSGTFFTLR

SEQ ID NO: 815242 - protein, 17 aa, Mycobacterium
GDKGAVGDSGFAGGTGG

SEQ ID NO: 815243 - protein, 22 aa, Mycobacterium
GDKGYWAITKHKDVKEISVRSD

SEQ ID NO: 815244 - protein, 17 aa, Mycobacterium
GDKLAALRMDSVLLQGA

SEQ ID NO: 815245 - protein, 19 aa, Mycobacterium
GDKPFLIADGQELTYIDLD

SEQ ID NO: 815246 - protein, 18 aa, Mycobacterium
GDKRGIRRFGDAFIPMDE

SEQ ID NO: 815247 - protein, 23 aa, Mycobacterium
GDKRSLPPSIPAALRVAPRMLGQ

SEQ ID NO: 815248 - protein, 33 aa, Mycobacterium
GDKVAMLLERTPLIPIAVLAIIKTGAAYVPLDP

SEQ ID NO: 815249 - protein, 21 aa, Mycobacterium
GDKVTLWWASANRDDAVFADP

SEQ ID NO: 815250 - protein, 19 aa, Mycobacterium
GDLAEPLGFDGIWFPEHHG

SEQ ID NO: 815251 - protein, 18 aa, Mycobacterium
GDLAIVRAIIALAEAFGL

SEQ ID NO: 815252 - protein, 18 aa, Mycobacterium
GDLALFAGDLLRPSTVSP

SEQ ID NO: 815253 - protein, 22 aa, Mycobacterium
GDLALPLLTTERELRHGDVLWT

SEQ ID NO: 815254 - protein, 20 aa, Mycobacterium
GDLANWMVPGKMVKGPGGAM

SEQ ID NO: 815255 - protein, 21 aa, Mycobacterium
GDLAYFLDKRKRGFDLCIYML

SEQ ID NO: 815256 - protein, 20 aa, Mycobacterium
GDLAYYLDKRKRGFDLCIYM

SEQ ID NO: 815257 - protein, 21 aa, Mycobacterium
GDLCLIWAEQMLRDSGIDPRR

SEQ ID NO: 815258 - protein, 21 aa, Mycobacterium
GDLDALLALKPDCVVYTALGE

SEQ ID NO: 815259 - protein, 23 aa, Mycobacterium
GDLDIMIIALRAPADGPIGDSAL

SEQ ID NO: 815260 - protein, 18 aa, Mycobacterium
GDLDLLAPGLRDLEGVTG

SEQ ID NO: 815261 - protein, 25 aa, Mycobacterium
GDLDPGVIGYLWRTAKLGVDEIESM

SEQ ID NO: 815262 - protein, 25 aa, Mycobacterium
GDLDRALTDLLAPRDPHDADDIVLE

SEQ ID NO: 815263 - protein, 35 aa, Mycobacterium
GDLDRRVPTWPVIEWLAMRPGSRELWLSELTPSGV

SEQ ID NO: 815264 - protein, 23 aa, Mycobacterium
GDLDVMIIALRAPADGPLGDSAL

SEQ ID NO: 815265 - protein, 42 aa, Mycobacterium
GDLELIPKLILPVNDIFITIIMGLVFQTKYLNGLASTAAGAA

SEQ ID NO: 815266 - protein, 22 aa, Mycobacterium
GDLFGLTADDLLRTELFTTKAG

SEQ ID NO: 815267 - protein, 29 aa, Mycobacterium
GDLGDLLITRWISTFAPDPAPLPIIGPPG

SEQ ID NO: 815268 - protein, 29 aa, Mycobacterium
GDLGDVLITRWISTFTPDPAPLPIIGPPG

SEQ ID NO: 815269 - protein, 26 aa, Mycobacterium
GDLGGFAGLFALRGDYREPLLASSTD

SEQ ID NO: 815270 - protein, 17 aa, Mycobacterium
GDLGGRAPVLRSGARAG

SEQ ID NO: 815271 - protein, 18 aa, Mycobacterium
GDLGLLADIGLPEAVLGV

SEQ ID NO: 815272 - protein, 18 aa, Mycobacterium
GDLGLLSDIGLPEAVLGV

SEQ ID NO: 815273 - protein, 27 aa, Mycobacterium
GDLGPGWSAWPIAPKAAAIPAGGMLDT

SEQ ID NO: 815274 - protein, 29 aa, Mycobacterium
GDLGRRWAGPAFLLNEMLVWGFTGQVICA

SEQ ID NO: 815275 - protein, 36 aa, Mycobacterium
GDLHAPPFRFFAHADAVFFMFDPLRVKTIRDQLHDL

SEQ ID NO: 815276 - protein, 29 aa, Mycobacterium
GDLHKLWRTRDRKGYHVEYGFSCMGYEIA

SEQ ID NO: 815277 - protein, 20 aa, Mycobacterium
GDLHLLRRWLDLPEARDNRE

SEQ ID NO: 815278 - protein, 27 aa, Mycobacterium
GDLIKYRGHWYPVVRVNSKTVSVRRHE

SEQ ID NO: 815279 - protein, 25 aa, Mycobacterium
GDLKLDTWRRAIATAPYLLSKSALV

SEQ ID NO: 815280 - protein, 24 aa, Mycobacterium
GDLKSDVFALYKPPAPPGMTDSPD

SEQ ID NO: 815281 - protein, 24 aa, Mycobacterium
GDLKTSVFALYNPPAPPGISDDPD

SEQ ID NO: 815282 - protein, 24 aa, Mycobacterium
GDLKTSVFALYQPPAPPSMTADPD

SEQ ID NO: 815283 - protein, 19 aa, Mycobacterium
GDLLANRVKALIATSALGM

SEQ ID NO: 815284 - protein, 19 aa, Mycobacterium
GDLLDLLNLEIRALPGVLS

SEQ ID NO: 815285 - protein, 21 aa, Mycobacterium
GDLLDVDGPLFGAALRHGVAL

SEQ ID NO: 815286 - protein, 21 aa, Mycobacterium
GDLLEYWSGRRWPSGRHRVLP

SEQ ID NO: 815287 - protein, 27 aa, Mycobacterium
GDLLFGTVDSWLLWNLTGGIDGGVHAT

SEQ ID NO: 815288 - protein, 19 aa, Mycobacterium
GDLLGPDPILLPPDSEAEQ

SEQ ID NO: 815289 - protein, 18 aa, Mycobacterium
GDLLLLELLQQLAEADSL

SEQ ID NO: 815290 - protein, 19 aa, Mycobacterium
GDLLVVLPGTHTKWVRIAA

SEQ ID NO: 815291 - protein, 23 aa, Mycobacterium
GDLMARLISLRQLSLSVARTLTD

SEQ ID NO: 815292 - protein, 24 aa, Mycobacterium
GDLPIRELITSPLLRCRRTLEPLA

SEQ ID NO: 815293 - protein, 18 aa, Mycobacterium
GDLPLPPLGEYFDELTEL

SEQ ID NO: 815294 - protein, 24 aa, Mycobacterium
GDLPSWQWESLITKPTRLVAVTAA

SEQ ID NO: 815295 - protein, 19 aa, Mycobacterium
GDLQGDYPLFMPQSTEQSV

SEQ ID NO: 815296 - protein, 20 aa, Mycobacterium
GDLRHRVAALAGALSRRGIG

SEQ ID NO: 815297 - protein, 17 aa, Mycobacterium
GDLTALFDFVEQRTGER

SEQ ID NO: 815298 - protein, 19 aa, Mycobacterium
GDLTAPWLGLDGLAPFQAL

SEQ ID NO: 815299 - protein, 35 aa, Mycobacterium
GDLTDRPVVVIGAGPIGLFALLAARHAGARVVVAD

SEQ ID NO: 815300 - protein, 28 aa, Mycobacterium
GDLTLAQLSILLTLIDQGPMRMTELAAH

SEQ ID NO: 815301 - protein, 17 aa, Mycobacterium
GDLVAMEAYRRSLLEQA

SEQ ID NO: 815302 - protein, 30 aa, Mycobacterium
GDLVDQPRFLEPYLWALDSLHRRGARATLR

SEQ ID NO: 815303 - protein, 19 aa, Mycobacterium
GDLVLVYLAAANRDPAVFS

SEQ ID NO: 815304 - protein, 24 aa, Mycobacterium
GDLVRLLTEVLIPELVAARAWQES

SEQ ID NO: 815305 - protein, 20 aa, Mycobacterium
GDLVRRQLALFSEVEPGLGG

SEQ ID NO: 815306 - protein, 25 aa, Mycobacterium
GDLVVRPRSWLLTRAAAEVAAEVAA

SEQ ID NO: 815307 - protein, 21 aa, Mycobacterium
GDLVYGLGTLITGLPGVLSRR

SEQ ID NO: 815308 - protein, 25 aa, Mycobacterium
GDLYRPHWDRWAAQELEYIARCDPR

SEQ ID NO: 815309 - protein, 24 aa, Mycobacterium
GDMEPYPIIRKLFSTFGIDTMAKE

SEQ ID NO: 815310 - protein, 25 aa, Mycobacterium
GDMEPYPIVRKLFATFGIDAMAKEA

SEQ ID NO: 815311 - protein, 30 aa, Mycobacterium
GDMKSEQFLHWVPVPKGLTFYISVPHAAGD

SEQ ID NO: 815312 - protein, 22 aa, Mycobacterium
GDMLLAELMERFTRAILHGAQA

SEQ ID NO: 815313 - protein, 17 aa, Mycobacterium
GDNARRFMGLPIANPDP

SEQ ID NO: 815314 - protein, 22 aa, Mycobacterium
GDNARRFMGLPIANPDPDAVNP

SEQ ID NO: 815315 - protein, 21 aa, Mycobacterium
GDNARRFMGLPIANPDPEAVK

SEQ ID NO: 815316 - protein, 20 aa, Mycobacterium
GDNHKCLFPTYSISKIAGEV

SEQ ID NO: 815317 - protein, 18 aa, Mycobacterium
GDNHRFLFPTYSISKIAG

SEQ ID NO: 815318 - protein, 23 aa, Mycobacterium
GDNKVLKGVSFKVARGSATTILG

SEQ ID NO: 815319 - protein, 26 aa, Mycobacterium
GDNLDPLFDVLMKHIPPPSGDPEAPL

SEQ ID NO: 815320 - protein, 23 aa, Mycobacterium
GDNPAYVSWLISQSMLADANEIS

SEQ ID NO: 815321 - protein, 28 aa, Mycobacterium
GDNPHKIAMLGLTFDDVLLLPAASDVVP

SEQ ID NO: 815322 - protein, 38 aa, Mycobacterium
GDNQSGFLHAILPTVALPALPHLSVPAISIPGINTGFG

SEQ ID NO: 815323 - protein, 24 aa, Mycobacterium
GDNVPPPAPLLPLATPSDPDARLR

SEQ ID NO: 815324 - protein, 22 aa, Mycobacterium
GDPAWLITGYATVRQLFDDERV

SEQ ID NO: 815325 - protein, 24 aa, Mycobacterium
GDPAYLPMAPNPDASIAFAAAQEL

SEQ ID NO: 815326 - protein, 22 aa, Mycobacterium
GDPEAAFAHFGRRFDDLSTEVT

SEQ ID NO: 815327 - protein, 23 aa, Mycobacterium
GDPEGYLDVDFLPLGAGKHEIAR

SEQ ID NO: 815328 - protein, 25 aa, Mycobacterium
GDPELLRRLARGRAHWPLGTLQLEA

SEQ ID NO: 815329 - protein, 17 aa, Mycobacterium
GDPFRPLNQILETDIVY

SEQ ID NO: 815330 - protein, 23 aa, Mycobacterium
GDPGLIVAVWDRRLHTGARAAGC

SEQ ID NO: 815331 - protein, 24 aa, Mycobacterium
GDPGRLFGRMLGCDLGMNPPFEMD

SEQ ID NO: 815332 - protein, 21 aa, Mycobacterium
GDPIVGLQRAVADHHQLASNF

SEQ ID NO: 815333 - protein, 25 aa, Mycobacterium
GDPKRLQRLALLDPPVDALRLTRTS

SEQ ID NO: 815334 - protein, 24 aa, Mycobacterium
GDPLADLGYLLYMTPEPGGEVAMS

SEQ ID NO: 815335 - protein, 24 aa, Mycobacterium
GDPLDALVLLPEPVFPGCIVEARP

SEQ ID NO: 815336 - protein, 19 aa, Mycobacterium
GDPLDALVLLTESVFPGCV

SEQ ID NO: 815337 - protein, 18 aa, Mycobacterium
GDPLIFDADFDRLQVFFE

SEQ ID NO: 815338 - protein, 21 aa, Mycobacterium
GDPLLVFLRTSVIGGESSTAT

SEQ ID NO: 815339 - protein, 23 aa, Mycobacterium
GDPLPFGEPAWTAGALGSVAKAV

SEQ ID NO: 815340 - protein, 20 aa, Mycobacterium
GDPMVYLEQAVLNPRHIEVQ

SEQ ID NO: 815341 - protein, 27 aa, Mycobacterium
GDPPEIPPLFVMSWIDGSSLEPLFDLD

SEQ ID NO: 815342 - protein, 18 aa, Mycobacterium
GDPPLAGALLIGGQGRVV

SEQ ID NO: 815343 - protein, 25 aa, Mycobacterium
GDPPQHWATIPFGVPLRNVRCRVVS

SEQ ID NO: 815344 - protein, 26 aa, Mycobacterium
GDPPYVAVPYLDRMDLAYAAADLAIC

SEQ ID NO: 815345 - protein, 23 aa, Mycobacterium
GDPQRVLTLVAFDQAGTGIQVHA

SEQ ID NO: 815346 - protein, 18 aa, Mycobacterium
GDPRLDLCDLYVFQSPDE

SEQ ID NO: 815347 - protein, 20 aa, Mycobacterium
GDPRLLHERGLIASLAAAWL

SEQ ID NO: 815348 - protein, 24 aa, Mycobacterium
GDPRPFIGPIRDAGAALIIQATDL

SEQ ID NO: 815349 - protein, 24 aa, Mycobacterium
GDPRPSSTTTLWVRDRARRPVDYA

SEQ ID NO: 815350 - protein, 24 aa, Mycobacterium
GDPSRPLVPRRPRPRPRGHQNLPA

SEQ ID NO: 815351 - protein, 25 aa, Mycobacterium
GDPSTLYPVLALLPIDEARIEDVWH

SEQ ID NO: 815352 - protein, 22 aa, Mycobacterium
GDPSVSLVFKGLQPTSIAEGLQ

SEQ ID NO: 815353 - protein, 25 aa, Mycobacterium
GDPTVFPGHWYSAEPSAALSEVKRS

SEQ ID NO: 815354 - protein, 25 aa, Mycobacterium
GDPTVFPGHWYSAEPSAPLSDVRGS

SEQ ID NO: 815355 - protein, 24 aa, Mycobacterium
GDPTVFPGHWYSAEPSASLSEVKR

SEQ ID NO: 815356 - protein, 25 aa, Mycobacterium
GDPTVFPGHWYSAQPSASLSDVKRS

SEQ ID NO: 815357 - protein, 24 aa, Mycobacterium
GDPVELIALFKTYGAAGSEALLGS

SEQ ID NO: 815358 - protein, 22 aa, Mycobacterium
GDPVGGWPEPLRSAALAGRAPA

SEQ ID NO: 815359 - protein, 24 aa, Mycobacterium
GDPVRTLELLWRVPAEARSGRGPK

SEQ ID NO: 815360 - protein, 18 aa, Mycobacterium
GDPVVRCRAVLLTVDHQA

SEQ ID NO: 815361 - protein, 17 aa, Mycobacterium
GDPVWIVDILRAEGVNP

SEQ ID NO: 815362 - protein, 19 aa, Mycobacterium
GDPVWLADVLRAEGVNLVE

SEQ ID NO: 815363 - protein, 27 aa, Mycobacterium
GDPYQKLVMLLGPLMAAGLWSRTGAEA

SEQ ID NO: 815364 - protein, 21 aa, Mycobacterium
GDQHYDVISAFIKSVRGSDVD

SEQ ID NO: 815365 - protein, 22 aa, Mycobacterium
GDQHYDVISAFIKSVRGSDVDA

SEQ ID NO: 815366 - protein, 17 aa, Mycobacterium
GDQILLPGLMDMEVNLL

SEQ ID NO: 815367 - protein, 17 aa, Mycobacterium
GDQLIKCGWRPGDSVVL

SEQ ID NO: 815368 - protein, 27 aa, Mycobacterium
GDQQDQWQLLYLLRTIVTGMTPQQAID

SEQ ID NO: 815369 - protein, 33 aa, Mycobacterium
GDQQRAVRTIAWLPWLVCPLSAPAGAGKTTSMR

SEQ ID NO: 815370 - protein, 26 aa, Mycobacterium
GDRAIAAAVPMVSWLATASARAKARA

SEQ ID NO: 815371 - protein, 23 aa, Mycobacterium
GDRALIMAIVNRTPDSFYDRGAT

SEQ ID NO: 815372 - protein, 24 aa, Mycobacterium
GDRAQYWAERLFSLSLHTAEEMAA

SEQ ID NO: 815373 - protein, 31 aa, Mycobacterium
GDRARHIHDFPALWYVPAAGLVYIAAAGQVL

SEQ ID NO: 815374 - protein, 32 aa, Mycobacterium
GDRAVLVYPPGLDFVRGLVGCLAAGVLPVPIY

SEQ ID NO: 815375 - protein, 29 aa, Mycobacterium
GDRAVPLCFGFHPYLHIPDVARGEWTIET

SEQ ID NO: 815376 - protein, 18 aa, Mycobacterium
GDRDVRLPFHRPVDDMNG

SEQ ID NO: 815377 - protein, 31 aa, Mycobacterium
GDREGEAIAWHLLETLKPKVPVRRMVFHEIT

SEQ ID NO: 815378 - protein, 37 aa, Mycobacterium
GDREGEAIAWHLLETLKPRIPVKRMVFHEITEPAIRA

SEQ ID NO: 815379 - protein, 32 aa, Mycobacterium
GDREGEAIAWHLLETLKPRVPVKRMVFHEITE

SEQ ID NO: 815380 - protein, 19 aa, Mycobacterium
GDREWLPEELNALQAIAAL

SEQ ID NO: 815381 - protein, 24 aa, Mycobacterium
GDRFAATMLILPEGLCYGRVDSAD

SEQ ID NO: 815382 - protein, 17 aa, Mycobacterium
GDRFALSRVLSSVSRTI

SEQ ID NO: 815383 - protein, 17 aa, Mycobacterium
GDRFLLGIGVSHAPLID

SEQ ID NO: 815384 - protein, 24 aa, Mycobacterium
GDRFTPLNLKHRIFRKAIGSHAGV

SEQ ID NO: 815385 - protein, 22 aa, Mycobacterium
GDRGPVWVFSGQGSQWAAMGAD

SEQ ID NO: 815386 - protein, 23 aa, Mycobacterium
GDRHAFGELFLRHQRQLHRLARL

SEQ ID NO: 815387 - protein, 24 aa, Mycobacterium
GDRHWPPLCRAVGHPEWLDDPRFA

SEQ ID NO: 815388 - protein, 22 aa, Mycobacterium
GDRIFIFGFSRGAFCARGLAGL

SEQ ID NO: 815389 - protein, 19 aa, Mycobacterium
GDRILWTHAVCGRCVMCAK

SEQ ID NO: 815390 - protein, 18 aa, Mycobacterium
GDRLHRYVTAFCPHCHAE

SEQ ID NO: 815391 - protein, 18 aa, Mycobacterium
GDRLVLQAVRYPELWRDN

SEQ ID NO: 815392 - protein, 31 aa, Mycobacterium
GDRPALFEAISLSYLGPLGLFPADTAAAEAI

SEQ ID NO: 815393 - protein, 21 aa, Mycobacterium
GDRPGWFRRLPHHHATVLGDR

SEQ ID NO: 815394 - protein, 24 aa, Mycobacterium
GDRPHPFVTAMIRSLRYANLSMPP

SEQ ID NO: 815395 - protein, 19 aa, Mycobacterium
GDRPLIMAIVNRTPDSFYD

SEQ ID NO: 815396 - protein, 26 aa, Mycobacterium
GDRRAAIDFATLWARPGDTVLVAGKG

SEQ ID NO: 815397 - protein, 26 aa, Mycobacterium
GDRREDLLAQLKFLTDQGVDLIVTSG

SEQ ID NO: 815398 - protein, 29 aa, Mycobacterium
GDRRLPFVYMATVIPFFEVGLDGAVLKFL

SEQ ID NO: 815399 - protein, 30 aa, Mycobacterium
GDRRRRPQLLFQPRLRLQRLRAGGEQQPLR

SEQ ID NO: 815400 - protein, 19 aa, Mycobacterium
GDRSGWSMIFEDLGRRRRP

SEQ ID NO: 815401 - protein, 40 aa, Mycobacterium
GDRTLRFGGIPQPWLRDLAKRWARWRLSTGLGLEAGGGRP

SEQ ID NO: 815402 - protein, 25 aa, Mycobacterium
GDRTVSIAWTAWRGLGMGSTSGFVA

SEQ ID NO: 815403 - protein, 28 aa, Mycobacterium
GDRVAIYLPLIPEAVIAMLACARLGIMH

SEQ ID NO: 815404 - protein, 23 aa, Mycobacterium
GDRVMVPFNIFCGSCYFCARGLY

SEQ ID NO: 815405 - protein, 31 aa, Mycobacterium
GDRVTLVLHDWGGALGFDWANRHRDRVAGIV

SEQ ID NO: 815406 - protein, 20 aa, Mycobacterium
GDRVVIPFQISCGHCFMCDM

SEQ ID NO: 815407 - protein, 20 aa, Mycobacterium
GDRVVIPFQISCGHCFMCDQ

SEQ ID NO: 815408 - protein, 22 aa, Mycobacterium
GDSAIFEYLDAKLVIHHSRDHT

SEQ ID NO: 815409 - protein, 24 aa, Mycobacterium
GDSASRDVLLTDLFTAFNQRMAGE

SEQ ID NO: 815410 - protein, 23 aa, Mycobacterium
GDSFRVHCREWFDGAIHNDDSAD

SEQ ID NO: 815411 - protein, 25 aa, Mycobacterium
GDSGSGGFFTPSPGTGGAGGDGGHG

SEQ ID NO: 815412 - protein, 28 aa, Mycobacterium
GDSGTLLIGLQRPQGILALGRHVFVVDS

SEQ ID NO: 815413 - protein, 22 aa, Mycobacterium
GDSLAAMRLIAAVNAGLNAHLG

SEQ ID NO: 815414 - protein, 26 aa, Mycobacterium
GDSLIDPLLTGWLDFDDDMRTDSPLV

SEQ ID NO: 815415 - protein, 32 aa, Mycobacterium
GDSLPDVLVLRSLTKTWALAGLRVGYALGSPE

SEQ ID NO: 815416 - protein, 23 aa, Mycobacterium
GDSMAALLEMFQYFTELTASRRA

SEQ ID NO: 815417 - protein, 24 aa, Mycobacterium
GDSPAFFQLYTPPDRKMAASLVHR

SEQ ID NO: 815418 - protein, 24 aa, Mycobacterium
GDSRGLFFEWLTDHGFTEFAGHRL

SEQ ID NO: 815419 - protein, 25 aa, Mycobacterium
GDSRGLFFEWLTERGFSAFAGHRLD

SEQ ID NO: 815420 - protein, 26 aa, Mycobacterium
GDTAVPLCFGFHPYLQLPGVPRTEWV

SEQ ID NO: 815421 - protein, 40 aa, Mycobacterium
GDTDYYLIGTDLLPLLQPLLLFVPRPILSALDAPLRVLVE

SEQ ID NO: 815422 - protein, 23 aa, Mycobacterium
GDTERAFELASVTKPLVARAVHV

SEQ ID NO: 815423 - protein, 20 aa, Mycobacterium
GDTFLVPSPIAHIGGSIYAF

SEQ ID NO: 815424 - protein, 25 aa, Mycobacterium
GDTGMTYQAWQAQWNQAMESLVRAY

SEQ ID NO: 815425 - protein, 25 aa, Mycobacterium
GDTGMTYQVWQAQWNQAMESLVRAY

SEQ ID NO: 815426 - protein, 22 aa, Mycobacterium
GDTGRILLRPSGTEPLIRVMVE

SEQ ID NO: 815427 - protein, 22 aa, Mycobacterium
GDTGVTYQAWQARWNQALDDLV

SEQ ID NO: 815428 - protein, 23 aa, Mycobacterium
GDTKFFALLQDWTTRYRHSTVIT

SEQ ID NO: 815429 - protein, 17 aa, Mycobacterium
GDTLVVHSMHRLARNLE

SEQ ID NO: 815430 - protein, 23 aa, Mycobacterium
GDTMPQRAPALTAPLLVVHGSED

SEQ ID NO: 815431 - protein, 18 aa, Mycobacterium
GDTNPNTCRPAVAAGPTG

SEQ ID NO: 815432 - protein, 24 aa, Mycobacterium
GDTPLIGFAGAPFTLASYLVEGGP

SEQ ID NO: 815433 - protein, 25 aa, Mycobacterium
GDTQALSMKYFRDQWRDYQSTLEGH

SEQ ID NO: 815434 - protein, 23 aa, Mycobacterium
GDTRYGSVGPPLPYQRVKALRLD

SEQ ID NO: 815435 - protein, 25 aa, Mycobacterium
GDTSRLSANQFFYGLRYGEEHRVKL

SEQ ID NO: 815436 - protein, 29 aa, Mycobacterium
GDTTATFEWGFRWLAANRPDPTPAVLVHG

SEQ ID NO: 815437 - protein, 24 aa, Mycobacterium
GDTTTAGHTAGWGGNGGYGGQGGG

SEQ ID NO: 815438 - protein, 35 aa, Mycobacterium; identical to SEQ ID NO: 114664

SEQ ID NO: 815439 - protein, 34 aa, Mycobacterium
GDTVRRLARLHTPLPVLAFTALPEVRSQLALTWG

SEQ ID NO: 815440 - protein, 34 aa, Mycobacterium
GDTVRRLARLHTPLPVLAFTPLPEVRSQLALTWG

SEQ ID NO: 815441 - protein, 25 aa, Mycobacterium
GDTVTAYRRLLVPVAVMTEAAARGD

SEQ ID NO: 815442 - protein, 30 aa, Mycobacterium
GDTWELLGNARWLPFVIAHGLIDELVPFAS

SEQ ID NO: 815443 - protein, 23 aa, Mycobacterium
GDTYGLIRFGSRLDTYLPAGAEP

SEQ ID NO: 815444 - protein, 25 aa, Mycobacterium
GDTYGLIRFGSRLDTYLPAGCEPLV

SEQ ID NO: 815445 - protein, 24 aa, Mycobacterium
GDVAGMLSVLAFTFTMVTGGNDTT

SEQ ID NO: 815446 - protein, 25 aa, Mycobacterium
GDVAGQLARRRLGYGRGARMKFEQD

SEQ ID NO: 815447 - protein, 25 aa, Mycobacterium
GDVAGTLSILAFTFTMVTGGNDTVT

SEQ ID NO: 815448 - protein, 26 aa, Mycobacterium
GDVDAGLFCLRPLPSLKPLERDALDQ

SEQ ID NO: 815449 - protein, 27 aa, Mycobacterium
GDVDKPKLVFFFDEAHLLFADASKAFL

SEQ ID NO: 815450 - protein, 26 aa, Mycobacterium
GDVDKPKLVFFFDEAHLLFNDASKAF

SEQ ID NO: 815451 - protein, 26 aa, Mycobacterium
GDVDPGVIFYLWREAGMPVEDIESML

SEQ ID NO: 815452 - protein, 26 aa, Mycobacterium
GDVDPSIMWYLWRTANMGVDEIESML

SEQ ID NO: 815453 - protein, 25 aa, Mycobacterium
GDVELDLVLAILRARQLFGGEHTLP

SEQ ID NO: 815454 - protein, 23 aa, Mycobacterium
GDVFGNGMLLRRGIRLVAAFDHR

SEQ ID NO: 815455 - protein, 22 aa, Mycobacterium
GDVFSAGLMLIWACDLIVGSEE

SEQ ID NO: 815456 - protein, 26 aa, Mycobacterium
GDVGDFPEVLLALFRGENTGKLVLAL

SEQ ID NO: 815457 - protein, 31 aa, Mycobacterium
GDVIITNWVTNFAPAAPPLQIIGPPGTAEVV

SEQ ID NO: 815458 - protein, 29 aa, Mycobacterium
GDVIRRKAGLPPATYFSGGKLQWILENVD

SEQ ID NO: 815459 - protein, 19 aa, Mycobacterium
GDVIVSRRNEPGIAVHDAA

SEQ ID NO: 815460 - protein, 23 aa, Mycobacterium
GDVKRFRAFDNWEGDAATACEAS

SEQ ID NO: 815461 - protein, 22 aa, Mycobacterium
GDVLDYDYLIYAIGSTDSTAAG

SEQ ID NO: 815462 - protein, 17 aa, Mycobacterium
GDVMPGHYPVRAELALV

SEQ ID NO: 815463 - protein, 22 aa, Mycobacterium
GDVNKGWLVARATLGNERVSIG

SEQ ID NO: 815464 - protein, 26 aa, Mycobacterium
GDVNRPTWVISLTDLLMVAEILSDPA

SEQ ID NO: 815465 - protein, 24 aa, Mycobacterium
GDVPAMVASPRWSPTGKQVAFVDN

SEQ ID NO: 815466 - protein, 23 aa, Mycobacterium
GDVPLIGFAGAPFTLASYLIEGG

SEQ ID NO: 815467 - protein, 24 aa, Mycobacterium
GDVPLIGFAGAPFTLASYLIEGGP

SEQ ID NO: 815468 - protein, 24 aa, Mycobacterium
GDVPLIGFAGAPFTLASYLVEGGP

SEQ ID NO: 815469 - protein, 28 aa, Mycobacterium
GDVRELLRGLPPRPVLVGASLGGFTAML

SEQ ID NO: 815470 - protein, 20 aa, Mycobacterium
GDVRGEGYFYGIELVKDKAT

SEQ ID NO: 815471 - protein, 23 aa, Mycobacterium
GDVTPYDPVLFPFDPALHDRDDL

SEQ ID NO: 815472 - protein, 26 aa, Mycobacterium
GDVTPYDPVLFPFDPALRDRDDLGRQ

SEQ ID NO: 815473 - protein, 20 aa, Mycobacterium
GDVTYPYYLINGRVAADPQS

SEQ ID NO: 815474 - protein, 20 aa, Mycobacterium
GDVVAIIGLGGLGHLGVQFA

SEQ ID NO: 815475 - protein, 20 aa, Mycobacterium
GDVVALLLPRSGRAIIAILA

SEQ ID NO: 815476 - protein, 23 aa, Mycobacterium
GDVVDVVADLPLGHGFNALTGEY

SEQ ID NO: 815477 - protein, 21 aa, Mycobacterium
GDVVLMNRYLRQALDAADQTV

SEQ ID NO: 815478 - protein, 19 aa, Mycobacterium
GDVVLPGSCTRAIDAHPGD

SEQ ID NO: 815479 - protein, 20 aa, Mycobacterium
GDVVLPIVPMFHANAWGLPY

SEQ ID NO: 815480 - protein, 26 aa, Mycobacterium
GDVVNCLSIQLMAFAYDGAWAEYTVA

SEQ ID NO: 815481 - protein, 22 aa, Mycobacterium
GDVVPIGRPLPSTAAVLVADGN

SEQ ID NO: 815482 - protein, 24 aa, Mycobacterium
GDVVVGLPMRCVFALTAMGFLPQP

SEQ ID NO: 815483 - protein, 19 aa, Mycobacterium
GDVWALLVDGKFGHGLPPA

SEQ ID NO: 815484 - protein, 21 aa, Mycobacterium
GDVWALLVDGKFGQGLPPAEP

SEQ ID NO: 815485 - protein, 23 aa, Mycobacterium
GDVWLPVHPVTRRRWPNGRVTHD

SEQ ID NO: 815486 - protein, 23 aa, Mycobacterium
GDVYAAFLEGFRAFFAESAADPL

SEQ ID NO: 815487 - protein, 20 aa, Mycobacterium
GDVYTLLKVLPHDDAYAWAQ

SEQ ID NO: 815488 - protein, 20 aa, Mycobacterium
GDVYTQVPFALTPGAPISTA

SEQ ID NO: 815489 - protein, 18 aa, Mycobacterium
GDWATWPEFRRLEAMGLT

SEQ ID NO: 815490 - protein, 23 aa, Mycobacterium
GDWFDVCSCKLPCPCSFAQAPTH

SEQ ID NO: 815491 - protein, 21 aa, Mycobacterium
GDWLGTPYLRFERQGPIAVCT

SEQ ID NO: 815492 - protein, 19 aa, Mycobacterium
GDWLRDRGVSPLQTNEILL

SEQ ID NO: 815493 - protein, 20 aa, Mycobacterium
GDWPTALRAAGLDAAAPTAW

SEQ ID NO: 815494 - protein, 18 aa, Mycobacterium
GDWQRYTYADLYVRVKRA

SEQ ID NO: 815495 - protein, 18 aa, Mycobacterium
GDWRTKHHFFRDNARLRE

SEQ ID NO: 815496 - protein, 17 aa, Mycobacterium
GDWTRFTGASIGAYIGL

SEQ ID NO: 815497 - protein, 22 aa, Mycobacterium
GDWVIIHMGFAIEKTDRAGAEQ

SEQ ID NO: 815498 - protein, 25 aa, Mycobacterium
GDWWDAAYLMMWGSNVPVTRTPDAH

SEQ ID NO: 815499 - protein, 26 aa, Mycobacterium
GDWWDAAYLMMWGSNVPVTRTPDAHW

SEQ ID NO: 815500 - protein, 26 aa, Mycobacterium
GDWWDATYLMMWGSNVPVTRTPDAHW

SEQ ID NO: 815501 - protein, 18 aa, Mycobacterium
GDYDIGIAIGLDKHPRGA

SEQ ID NO: 815502 - protein, 19 aa, Mycobacterium
GDYDIGIAIGLDKHPRGAF

SEQ ID NO: 815503 - protein, 23 aa, Mycobacterium
GDYDLSALKYLFLAGERLDPDTY

SEQ ID NO: 815504 - protein, 24 aa, Mycobacterium
GDYESWRYVAPIQRAAWSRRTFEY

SEQ ID NO: 815505 - protein, 19 aa, Mycobacterium
GDYGLYRIDAGPVKGFGAA

SEQ ID NO: 815506 - protein, 28 aa, Mycobacterium
GDYGTYFKGHLYIAGRIKDLVIIDGRNH

SEQ ID NO: 815507 - protein, 23 aa, Mycobacterium
GDYLAELTMLILARDRAKDPGRG

SEQ ID NO: 815508 - protein, 25 aa, Mycobacterium
GDYLAELTMLILGRDRAKAPERGYA

SEQ ID NO: 815509 - protein, 27 aa, Mycobacterium
GDYLAELTMLILWKSRKKNPETGYAHT

SEQ ID NO: 815510 - protein, 18 aa, Mycobacterium
GDYLATLLVVAPGADIEA

SEQ ID NO: 815511 - protein, 24 aa, Mycobacterium
GDYLEELLDLLDFDGDIDLDVEGN

SEQ ID NO: 815512 - protein, 24 aa, Mycobacterium
GDYLEELLDLLDFDGDIDLDVEGS

SEQ ID NO: 815513 - protein, 33 aa, Mycobacterium
GDYLESLRRLRGLGHLTVLPGHGPELDDMAAVS

SEQ ID NO: 815514 - protein, 19 aa, Mycobacterium
GDYLRAGAIARFAPVMRSV

SEQ ID NO: 815515 - protein, 24 aa, Mycobacterium
GDYLTGGWLVLRRGKRNIAGVQRL

SEQ ID NO: 815516 - protein, 26 aa, Mycobacterium
GDYPFAGLRILDLGIIVAGGELSRLF

SEQ ID NO: 815517 - protein, 26 aa, Mycobacterium
GDYQGLVGVPLFDIAAAPGFGNTTTS

SEQ ID NO: 815518 - protein, 22 aa, Mycobacterium
GDYRMDNVFFPTVPDQPAAVID

SEQ ID NO: 815519 - protein, 20 aa, Mycobacterium
GDYVPAVGTLTFTPGQTSKT

SEQ ID NO: 815520 - protein, 19 aa, Mycobacterium
GDYYAFTTLTNDPGSVVPA

SEQ ID NO: 815521 - protein, 26 aa, Mycobacterium
GEAAFEGFTLIVPGLGEAGAAADGAG

SEQ ID NO: 815522 - protein, 24 aa, Mycobacterium
GEAAPALGKEKFGRFLRAGERSRN

SEQ ID NO: 815523 - protein, 22 aa, Mycobacterium
GEAAPPMTHIVLLGGDFPAAAS

SEQ ID NO: 815524 - protein, 25 aa, Mycobacterium
GEAAPYARTWSFITRAYAAVNRNEL

SEQ ID NO: 815525 - protein, 17 aa, Mycobacterium
GEAARWLHRGLTSQDVV

SEQ ID NO: 815526 - protein, 24 aa, Mycobacterium
GEAAWADALAAVPASRRASARNMA

SEQ ID NO: 815527 - protein, 25 aa, Mycobacterium
GEACAQAIAWYLAMARRGQGNEEAA

SEQ ID NO: 815528 - protein, 24 aa, Mycobacterium
GEADVYNMGWQKYLDARATDEQRR

SEQ ID NO: 815529 - protein, 20 aa, Mycobacterium
GEAFAYAKYMRYADQARRDG

SEQ ID NO: 815530 - protein, 27 aa, Mycobacterium
GEAGPLAGVPFLLKDLGAALAGAPEAM

SEQ ID NO: 815531 - protein, 19 aa, Mycobacterium
GEAHRAILDTLAGGGAYFF

SEQ ID NO: 815532 - protein, 17 aa, Mycobacterium
GEAIWLGVVPQDAPTGG

SEQ ID NO: 815533 - protein, 23 aa, Mycobacterium
GEAKPTVVTNRPNRRIVIMPSED

SEQ ID NO: 815534 - protein, 26 aa, Mycobacterium
GEAKQRMLIGRQLAWRVRELESINEF

SEQ ID NO: 815535 - protein, 27 aa, Mycobacterium
GEALESFLRKMVFWSDVAIESSDLAVL

SEQ ID NO: 815536 - protein, 21 aa, Mycobacterium
GEALISGLLRAGRQAKDIVVS

SEQ ID NO: 815537 - protein, 21 aa, Mycobacterium
GEALLHCSVGQSRKAWTDLRV

SEQ ID NO: 815538 - protein, 24 aa, Mycobacterium
GEALPNISRLLPVARRAGVDVVHC

SEQ ID NO: 815539 - protein, 21 aa, Mycobacterium
GEALRLLGTYLARAVADASDS

SEQ ID NO: 815540 - protein, 24 aa, Mycobacterium
GEALRLWYDLLSRSGLPAADSGPE

SEQ ID NO: 815541 - protein, 18 aa, Mycobacterium
GEAPMRRWMRSQVDDPVI

SEQ ID NO: 815542 - protein, 25 aa, Mycobacterium
GEAPPDIELIGMLNLLIGGGFDTTT

SEQ ID NO: 815543 - protein, 28 aa, Mycobacterium
GEAPVDVLTLFSYPLHPPGKPERLRTEH

SEQ ID NO: 815544 - protein, 36 aa, Mycobacterium
GEARSIVRYLPLEELIAAFLPLLFPGMEIVEHHAFR

SEQ ID NO: 815545 - protein, 22 aa, Mycobacterium
GEASLLVLHGRVRLSTSSESAE

SEQ ID NO: 815546 - protein, 24 aa, Mycobacterium
GEASVAFQAAHARFVEAAARVNTL

SEQ ID NO: 815547 - protein, 24 aa, Mycobacterium
GEATAKVWGLYMAGSRLGFERNVV

SEQ ID NO: 815548 - protein, 18 aa, Mycobacterium
GEATVKTFKRARGQVWLM

SEQ ID NO: 815549 - protein, 25 aa, Mycobacterium
GEAVVTILAILKTGAAYLPIDPAHP

SEQ ID NO: 815550 - protein, 30 aa, Mycobacterium
GEAWQLTADRFFAPAFDLAQPRMLRAGLAP

SEQ ID NO: 815551 - protein, 25 aa, Mycobacterium
GEAWYLDEFGGWGKIKLFGAPTHEL

SEQ ID NO: 815552 - protein, 23 aa, Mycobacterium
GEAYHHVLMTILVAARAHGIDAI

SEQ ID NO: 815553 - protein, 27 aa, Mycobacterium
GEAYRGHIFWDELFVAPVVSLRRPALT

SEQ ID NO: 815554 - protein, 25 aa, Mycobacterium
GECDFVWDLAAPLPMAVIGDMLGVR

SEQ ID NO: 815555 - protein, 28 aa, Mycobacterium
GECRHNLGYWDGGQWWGAGPGAHGYVDA

SEQ ID NO: 815556 - protein, 28 aa, Mycobacterium
GECRHNLGYWDGGQWWGAGPGAHGYVGT

SEQ ID NO: 815557 - protein, 27 aa, Mycobacterium
GECRHNLGYWNGGQWWGAGPGAHGYVG

SEQ ID NO: 815558 - protein, 25 aa, Mycobacterium
GECYGLRVLFTGAQAGRRVARSTGL

SEQ ID NO: 815559 - protein, 29 aa, Mycobacterium
GEDAEVRKLFDVNYFGAVDMIKAVLPAMR

SEQ ID NO: 815560 - protein, 25 aa, Mycobacterium
GEDAIFKLFRRITPGVHPDIELNRV

SEQ ID NO: 815561 - protein, 23 aa, Mycobacterium
GEDAKFTFVGRPKPALVAGEEPA

SEQ ID NO: 815562 - protein, 20 aa, Mycobacterium
GEDALYLRPFVIATEPGLGV

SEQ ID NO: 815563 - protein, 27 aa, Mycobacterium
GEDAMSMTIAALLPTLHASMTANVTAL

SEQ ID NO: 815564 - protein, 24 aa, Mycobacterium
GEDAPFPLATMQHAYWIGRSEDQE

SEQ ID NO: 815565 - protein, 24 aa, Mycobacterium
GEDAVAAILRYCSEHRIAVVPFGG

SEQ ID NO: 815566 - protein, 18 aa, Mycobacterium
GEDAVGYGATGAAGAAGA

SEQ ID NO: 815567 - protein, 24 aa, Mycobacterium
GEDDHVWLLLLERAAPQAQRVHDV

SEQ ID NO: 815568 - protein, 20 aa, Mycobacterium
GEDFSWYLEEVPGAMARLGV

SEQ ID NO: 815569 - protein, 20 aa, Mycobacterium
GEDFSWYLEEVPGAMGRLGV

SEQ ID NO: 815570 - protein, 19 aa, Mycobacterium
GEDFWPQAYDRTVPDEIIA

SEQ ID NO: 815571 - protein, 24 aa, Mycobacterium
GEDGAFGLLRVLGAAMARLAEAES

SEQ ID NO: 815572 - protein, 24 aa, Mycobacterium
GEDGVIAWLLSGPEHTYHVALPGR

SEQ ID NO: 815573 - protein, 25 aa, Mycobacterium
GEDHAFSYVFLASDRSRGITGETVR

SEQ ID NO: 815574 - protein, 25 aa, Mycobacterium
GEDHAWSFVFLASDRARGITGETVR

SEQ ID NO: 815575 - protein, 21 aa, Mycobacterium
GEDLGAVVYFPLGTDLTDDDE

SEQ ID NO: 815576 - protein, 27 aa, Mycobacterium
GEDPLLHKKPEWLKPIGSPVGAIDLRE

SEQ ID NO: 815577 - protein, 18 aa, Mycobacterium
GEDRKWAAVGRSADFSEA

SEQ ID NO: 815578 - protein, 26 aa, Mycobacterium
GEDSSLLYPERWVRRTIRFRHNTLDP

SEQ ID NO: 815579 - protein, 17 aa, Mycobacterium
GEDTFTYGLLYQQEDEL

SEQ ID NO: 815580 - protein, 25 aa, Mycobacterium
GEDVQILRRVLLSRFGPDRVRDTPI

SEQ ID NO: 815581 - protein, 19 aa, Mycobacterium
GEEALYLRPFVIATEPGLG

SEQ ID NO: 815582 - protein, 27 aa, Mycobacterium
GEECAFDLRLIAPQLPPFDVPSGHTED

SEQ ID NO: 815583 - protein, 22 aa, Mycobacterium
GEEFGYFQFGGSDIIILFQEGV

SEQ ID NO: 815584 - protein, 33 aa, Mycobacterium
GEEGDRGLSWLPFFHDMGLITALLAPMIGHYFT

SEQ ID NO: 815585 - protein, 26 aa, Mycobacterium
GEEGQGFIYLMKNLPQERMSIAVMAA

SEQ ID NO: 815586 - protein, 25 aa, Mycobacterium
GEEHLRIIRHFFDRLPVVVDAATRE

SEQ ID NO: 815587 - protein, 25 aa, Mycobacterium
GEEHPLVHRSSLGAAPCIAFVFPGQ

SEQ ID NO: 815588 - protein, 19 aa, Mycobacterium
GEEIILFRASFAQQRMWFL

SEQ ID NO: 815589 - protein, 20 aa, Mycobacterium
GEEKWRWRLDYPMAASVLAT

SEQ ID NO: 815590 - protein, 17 aa, Mycobacterium
GEELAAGKAVTVDDARR

SEQ ID NO: 815591 - protein, 23 aa, Mycobacterium
GEELLARAVRLEAPIPGLPTEDP

SEQ ID NO: 815592 - protein, 26 aa, Mycobacterium
GEENIRFVQALAASPIRYVLTRHEQA

SEQ ID NO: 815593 - protein, 25 aa, Mycobacterium
GEENIRFVQALASSGIRYVLTRHEQ

SEQ ID NO: 815594 - protein, 23 aa, Mycobacterium
GEEQFMAWRRSYDTPPPLIEKGS

SEQ ID NO: 815595 - protein, 22 aa, Mycobacterium
GEEQFMAWRRSYDTPPPPIEKG

SEQ ID NO: 815596 - protein, 23 aa, Mycobacterium
GEEQFMAWRRSYDTPPPPIEKGS

SEQ ID NO: 815597 - protein, 23 aa, Mycobacterium
GEEQFMAWRRSYDTPPPPIERGS

SEQ ID NO: 815598 - protein, 20 aa, Mycobacterium
GEERLGRFPASPASVATLSG

SEQ ID NO: 815599 - protein, 25 aa, Mycobacterium
GEERVNLLIVPYATYSGLALMVLRR

SEQ ID NO: 815600 - protein, 30 aa, Mycobacterium
GEESALFAADLARMYIRYAERHGWKVTVLD

SEQ ID NO: 815601 - protein, 30 aa, Mycobacterium
GEESALFAADLARMYIRYAERHGWNVTVLD

SEQ ID NO: 815602 - protein, 30 aa, Mycobacterium
GEESALFAADLARMYIRYAERHGWTVTLLD

SEQ ID NO: 815603 - protein, 30 aa, Mycobacterium
GEESALFAADLARMYIRYAERHGWTVTMLG

SEQ ID NO: 815604 - protein, 30 aa, Mycobacterium; identical to SEQ ID NO: 114672

SEQ ID NO: 815605 - protein, 30 aa, Mycobacterium
GEESALFAADLARMYIRYAERHGWTVTVLG

SEQ ID NO: 815606 - protein, 30 aa, Mycobacterium
GEESALFAADLARMYIRYAERRGWTVTVLD

SEQ ID NO: 815607 - protein, 22 aa, Mycobacterium
GEETGFRSHLGRRLPTVTYPVD

SEQ ID NO: 815608 - protein, 27 aa, Mycobacterium
GEETQWDWLELPDPPASWGWGKTAHLL

SEQ ID NO: 815609 - protein, 18 aa, Mycobacterium
GEFAVHLALAAGGKCFYT

SEQ ID NO: 815610 - protein, 18 aa, Mycobacterium
GEFAVHLALASGGKCFYT

SEQ ID NO: 815611 - protein, 26 aa, Mycobacterium
GEFDEWQRLFLFSRADTIYGGSNEIQ

SEQ ID NO: 815612 - protein, 29 aa, Mycobacterium
GEFDFNLQWKPLGGFPVTAGWFSAIRRGQ

SEQ ID NO: 815613 - protein, 19 aa, Mycobacterium
GEFDLSTLRFALSGAEPVE

SEQ ID NO: 815614 - protein, 23 aa, Mycobacterium
GEFDPAFFGISPREAVAMDPQQR

SEQ ID NO: 815615 - protein, 23 aa, Mycobacterium
GEFDSMIRLFTSDAVFDRAGIVH

SEQ ID NO: 815616 - protein, 35 aa, Mycobacterium
GEFDYNLEWKPVGGFPVRFGWISAIRRGHAELHRG

SEQ ID NO: 815617 - protein, 34 aa, Mycobacterium
GEFEYNLDWKPVGGFPITLGWINAIRRGQAQLHR

SEQ ID NO: 815618 - protein, 23 aa, Mycobacterium
GEFFTALRERRILGVRGSDGRVH

SEQ ID NO: 815619 - protein, 25 aa, Mycobacterium
GEFGAFLEYAPPEAAHWLASAIEAA

SEQ ID NO: 815620 - protein, 24 aa, Mycobacterium
GEFGYARPIYTLTHDIMLVGPTAD

SEQ ID NO: 815621 - protein, 17 aa, Mycobacterium
GEFIPRPIKSSFREGLT

SEQ ID NO: 815622 - protein, 18 aa, Mycobacterium
GEFIPRPIKSSFREGLTV

SEQ ID NO: 815623 - protein, 19 aa, Mycobacterium
GEFIPRPIKSSFREGLTVL

SEQ ID NO: 815624 - protein, 17 aa, Mycobacterium
GEFLPPSVVFDYPTVYS

SEQ ID NO: 815625 - protein, 23 aa, Mycobacterium
GEFPPQPVWASEALDLINDIQPA

SEQ ID NO: 815626 - protein, 18 aa, Mycobacterium
GEFRKLWISRINAAARAN

SEQ ID NO: 815627 - protein, 24 aa, Mycobacterium
GEFRQIMVQFGLTPMARRTLQWNI

SEQ ID NO: 815628 - protein, 24 aa, Mycobacterium
GEFSEPFIQLWDPSYTYVGSNIAT

SEQ ID NO: 815629 - protein, 19 aa, Mycobacterium
GEFTARFGIKRVCEFYSAS

SEQ ID NO: 815630 - protein, 27 aa, Mycobacterium
GEFTRRDFGLIYQARPRFLDRAISSSV

SEQ ID NO: 815631 - protein, 38 aa, Mycobacterium
GEFVNFDPIYSWPKPVQKPYPPMYFGGGPAAFPRIARL

SEQ ID NO: 815632 - protein, 33 aa, Mycobacterium
GEFVSMIFSVQYRLPNYYRWLLYEADHAGAYRY

SEQ ID NO: 815633 - protein, 17 aa, Mycobacterium
GEGAFPADRVKILSTGG

SEQ ID NO: 815634 - protein, 17 aa, Mycobacterium
GEGAGIVVLKPLSRALA

SEQ ID NO: 815635 - protein, 32 aa, Mycobacterium
GEGALRDLVARRIPLFAFAIRSALAESDLEIA

SEQ ID NO: 815636 - protein, 24 aa, Mycobacterium
GEGAPWIGMAPFVSENHLFQNLGD

SEQ ID NO: 815637 - protein, 34 aa, Mycobacterium
GEGARRFGGRWNPPLLFSAIYLADSAQACMVEVE

SEQ ID NO: 815638 - protein, 18 aa, Mycobacterium
GEGFGAWRLGDDDAMLDV

SEQ ID NO: 815639 - protein, 27 aa, Mycobacterium
GEGFLSEPWWCRMLVLSAARTARRDGV

SEQ ID NO: 815640 - protein, 27 aa, Mycobacterium
GEGGFIVPAPGFLATLTAWASENGVVF

SEQ ID NO: 815641 - protein, 24 aa, Mycobacterium
GEGGLFEVVWPPTTLVDNGIGDTP

SEQ ID NO: 815642 - protein, 25 aa, Mycobacterium
GEGGRGGQWFGHGGGGGAGGAGGAD

SEQ ID NO: 815643 - protein, 23 aa, Mycobacterium
GEGKISALRWGGAPPRIVFIHGG

SEQ ID NO: 815644 - protein, 23 aa, Mycobacterium
GEGKLTQLPPLLAAPPAKTRYLT

SEQ ID NO: 815645 - protein, 31 aa, Mycobacterium
GEGKRLFAAGLWSVWKPAKGAVPLLSCTIVT

SEQ ID NO: 815646 - protein, 23 aa, Mycobacterium
GEGKRLYPLTADRAKPAVPFGGG

SEQ ID NO: 815647 - protein, 23 aa, Mycobacterium
GEGLQTGLRYLARQSVAIGGGTT

SEQ ID NO: 815648 - protein, 17 aa, Mycobacterium
GEGLVRRFVAEGAQVMI

SEQ ID NO: 815649 - protein, 26 aa, Mycobacterium
GEGLVYTLREPVGIVGAITPWNFPFN

SEQ ID NO: 815650 - protein, 27 aa, Mycobacterium
GEGLYEMTLALWDWGFELEDVRAHFDV

SEQ ID NO: 815651 - protein, 26 aa, Mycobacterium
GEGMALAMIATLPPGGHFGSADISVD

SEQ ID NO: 815652 - protein, 30 aa, Mycobacterium
GEGMRTLISVPLFHVTGCNSQLLAAARLGG

SEQ ID NO: 815653 - protein, 22 aa, Mycobacterium
GEGNPSWIPAASPASPESLPVL

SEQ ID NO: 815654 - protein, 23 aa, Mycobacterium
GEGNRPPWSIGEPQPEIAALIEA

SEQ ID NO: 815655 - protein, 25 aa, Mycobacterium
GEGPRYRKLGNRVYYLASDLKAWLD

SEQ ID NO: 815656 - protein, 25 aa, Mycobacterium
GEGPYVQLWPHRHGTDAMFAAALRR

SEQ ID NO: 815657 - protein, 24 aa, Mycobacterium
GEGRLTELPPLLAAPPVKTRYVTT

SEQ ID NO: 815658 - protein, 46 aa, Mycobacterium
GEGTAVIKRFPIGVLLGIMPWNFPYYQVARFACPNLLVGNTIVLKH

SEQ ID NO: 815659 - protein, 30 aa, Mycobacterium
GEGTRFTAQLLPRPIGLIIGLQLSANPFVL

SEQ ID NO: 815660 - protein, 28 aa, Mycobacterium
GEGVFVKFHWKPLLGVHSLLWDECQQIA

SEQ ID NO: 815661 - protein, 25 aa, Mycobacterium
GEGVLPILERKRLWHRPHGSSPHSA

SEQ ID NO: 815662 - protein, 24 aa, Mycobacterium
GEGVLRFFRYIAERTDIALGMFNS

SEQ ID NO: 815663 - protein, 24 aa, Mycobacterium
GEGVLRFFRYIASRTDIALGMFNS

SEQ ID NO: 815664 - protein, 25 aa, Mycobacterium
GEGVQIGLLGASPLSHHPLAGGSGP

SEQ ID NO: 815665 - protein, 26 aa, Mycobacterium
GEGWQPDIWRGFAEELGILGATLPEE

SEQ ID NO: 815666 - protein, 23 aa, Mycobacterium
GEHALVHRFYRDLIALRHDDPDM

SEQ ID NO: 815667 - protein, 29 aa, Mycobacterium
GEHFDAIRNIEAPLIFPVLPDGHAEHIRY

SEQ ID NO: 815668 - protein, 26 aa, Mycobacterium
GEHGVGRLKRPWLAGQLGPEAMELNR

SEQ ID NO: 815669 - protein, 27 aa, Mycobacterium
GEHGVGRLKRPWLANQIGPDAMELNHR

SEQ ID NO: 815670 - protein, 26 aa, Mycobacterium
GEHGYELLPPWDSAAVVFDALAGAVA

SEQ ID NO: 815671 - protein, 25 aa, Mycobacterium
GEHGYELLPPWESAGVVFDALAAAV

SEQ ID NO: 815672 - protein, 24 aa, Mycobacterium
GEHGYELLPPWETAGVVFDALVDA

SEQ ID NO: 815673 - protein, 26 aa, Mycobacterium
GEHLFDPLIDWHASKELDWLYPAQGH

SEQ ID NO: 815674 - protein, 24 aa, Mycobacterium
GEHPERGWLGQYAALVGPVQRGAV

SEQ ID NO: 815675 - protein, 18 aa, Mycobacterium
GEHQLTVLADLLVHRLRA

SEQ ID NO: 815676 - protein, 19 aa, Mycobacterium
GEHRLGFEQFPGHAGELAA

SEQ ID NO: 815677 - protein, 24 aa, Mycobacterium
GEHTILLTRLGYDVLGIDFSPQAI

SEQ ID NO: 815678 - protein, 24 aa, Mycobacterium
GEHVFDFFLRNKRAEWARYRSNVT

SEQ ID NO: 815679 - protein, 20 aa, Mycobacterium
GEHVLLTDQLAQGTPILLCD

SEQ ID NO: 815680 - protein, 19 aa, Mycobacterium
GEHVVPIPRLLDVQDYLDY

SEQ ID NO: 815681 - protein, 24 aa, Mycobacterium
GEIARRVFATCRRLGIGTVAVYTD

SEQ ID NO: 815682 - protein, 26 aa, Mycobacterium
GEIAVRVIRTLRRLGIRSVAVYSDAD

SEQ ID NO: 815683 - protein, 19 aa, Mycobacterium
GEIEGDYPLFMPQSTEQSV

SEQ ID NO: 815684 - protein, 26 aa, Mycobacterium
GEIEQLRFQIGRWAYRDLIREQIGPW

SEQ ID NO: 815685 - protein, 21 aa, Mycobacterium
GEIHYPAIAKALRDSGYRGTV

SEQ ID NO: 815686 - protein, 21 aa, Mycobacterium
GEIIVKHYVNLGIAAATERGL

SEQ ID NO: 815687 - protein, 18 aa, Mycobacterium
GEIKACWIICSNPVATVA

SEQ ID NO: 815688 - protein, 24 aa, Mycobacterium
GEIKVPVIFFSPEGPVVKHLFGLL

SEQ ID NO: 815689 - protein, 19 aa, Mycobacterium
GEILDLAAGPLRYAGWSSC

SEQ ID NO: 815690 - protein, 32 aa, Mycobacterium
GEILQRMRPLVHRLGVIDPLLEDHRVHLPVWS

SEQ ID NO: 815691 - protein, 26 aa, Mycobacterium
GEILRLLLAHPAYTAGRLRIGVLTAG

SEQ ID NO: 815692 - protein, 23 aa, Mycobacterium
GEILRYINWVADKLDLRPGITFD

SEQ ID NO: 815693 - protein, 17 aa, Mycobacterium
GEILVLGPQSHRFTRAG

SEQ ID NO: 815694 - protein, 18 aa, Mycobacterium
GEILWWSQRDGWGHLYLY

SEQ ID NO: 815695 - protein, 24 aa, Mycobacterium
GEIMRFCQSFMTELYRHLGEYTDV

SEQ ID NO: 815696 - protein, 25 aa, Mycobacterium
GEINRFVFAMPEQLGRVYLGLTDED

SEQ ID NO: 815697 - protein, 18 aa, Mycobacterium
GEIPGWDTAGIVAQAAAD

SEQ ID NO: 815698 - protein, 23 aa, Mycobacterium
GEIPPFAPFLVTPIAEEYRTDVA

SEQ ID NO: 815699 - protein, 27 aa, Mycobacterium
GEIPRIPLNLVLLKGVQVLGFQFQDVP

SEQ ID NO: 815700 - protein, 29 aa, Mycobacterium
GEIPWSLFSPFTPYLRSRGVPPFGPGLRP

SEQ ID NO: 815701 - protein, 25 aa, Mycobacterium
GEIQDLRPLITPVDAEFRVGTMGLG

SEQ ID NO: 815702 - protein, 26 aa, Mycobacterium
GEIRVPRMLGVFSIGRAINPRTLRSQ

SEQ ID NO: 815703 - protein, 24 aa, Mycobacterium
GEIRVPRMLGVFSVGRVINARTLR

SEQ ID NO: 815704 - protein, 17 aa, Mycobacterium
GEIRYLDAVLHNSKGEP

SEQ ID NO: 815705 - protein, 20 aa, Mycobacterium
GEISPRKVIKPVAGQFAAAG

SEQ ID NO: 815706 - protein, 27 aa, Mycobacterium
GEIYEDLSWFCIRAWRFGAAESLGAGG

SEQ ID NO: 815707 - protein, 19 aa, Mycobacterium
GEIYKIPEPFLVLATQNPV

SEQ ID NO: 815708 - protein, 18 aa, Mycobacterium
GEIYMRPAPGARPTYRYI

SEQ ID NO: 815709 - protein, 28 aa, Mycobacterium
GEKAPLEHLLIERAYLLGVTAPEMTVLV

SEQ ID NO: 815710 - protein, 28 aa, Mycobacterium
GEKAPLEHLLVERAYLLGVTAPEMTVLV

SEQ ID NO: 815711 - protein, 28 aa, Mycobacterium
GEKAPLEQLLIERAYLLGVTGPEMTVLV

SEQ ID NO: 815712 - protein, 29 aa, Mycobacterium
GEKERERLFPLIRRYALAYHVVFIPSHEV

SEQ ID NO: 815713 - protein, 27 aa, Mycobacterium
GEKHEWFHTLTWPVRDLPQGGTDVPWL

SEQ ID NO: 815714 - protein, 27 aa, Mycobacterium
GEKKRHEILQLELLKPKIAILDETDSG

SEQ ID NO: 815715 - protein, 26 aa, Mycobacterium
GEKKRHEILQLGLLKPKIAVLDETDS

SEQ ID NO: 815716 - protein, 25 aa, Mycobacterium
GEKLDLRIDPPYRTKSRTIFSHFTG

SEQ ID NO: 815717 - protein, 22 aa, Mycobacterium
GEKLGLSHQALFDVAANASGQC

SEQ ID NO: 815718 - protein, 22 aa, Mycobacterium
GEKPRFISGPLPPPPAGDVILA

SEQ ID NO: 815719 - protein, 23 aa, Mycobacterium
GEKPTRIEVILIAAYRDGRIHRI

SEQ ID NO: 815720 - protein, 22 aa, Mycobacterium
GEKPVLEWIGGTALRPVRAALP

SEQ ID NO: 815721 - protein, 27 aa, Mycobacterium
GEKRFDLAAREFLLFPTVAHSHAERVR

SEQ ID NO: 815722 - protein, 28 aa, Mycobacterium
GEKRFELAASEFLLFPTVAHSHAERVRP

SEQ ID NO: 815723 - protein, 29 aa, Mycobacterium
GEKRRVALCKLLLSKPDLLLLDEPTNHLD

SEQ ID NO: 815724 - protein, 26 aa, Mycobacterium
GEKRSWLRARGLKLFPLVGWAERGGY

SEQ ID NO: 815725 - protein, 23 aa, Mycobacterium
GEKRTLPLVARYAQHWNFPDGTP

SEQ ID NO: 815726 - protein, 26 aa, Mycobacterium
GELAALMDVLRVPALFFTSVPVCRVE

SEQ ID NO: 815727 - protein, 19 aa, Mycobacterium
GELAEVRKLLMNPQIREAA

SEQ ID NO: 815728 - protein, 19 aa, Mycobacterium
GELAFPLAADDLPYLHPVT

SEQ ID NO: 815729 - protein, 20 aa, Mycobacterium
GELALKPGWPSMFRGYLHAE

SEQ ID NO: 815730 - protein, 19 aa, Mycobacterium
GELALKPGWPSMFRGYLNA

SEQ ID NO: 815731 - protein, 24 aa, Mycobacterium
GELAMTPTFLRVFGLRATKARAVQ

SEQ ID NO: 815732 - protein, 26 aa, Mycobacterium
GELAPHPLLVYPAEQTARSLDIPMVA

SEQ ID NO: 815733 - protein, 22 aa, Mycobacterium
GELARLCHAALESLRAGITDSW

SEQ ID NO: 815734 - protein, 30 aa, Mycobacterium
GELARLNAIYLLWRLKESPHWPAIRDALAA

SEQ ID NO: 815735 - protein, 17 aa, Mycobacterium
GELCRRIADKGPEMKVA

SEQ ID NO: 815736 - protein, 21 aa, Mycobacterium
GELFATGLIWCDGAQEMLGQL

SEQ ID NO: 815737 - protein, 23 aa, Mycobacterium
GELFGSGQMQLPFVLQSAEVMKT

SEQ ID NO: 815738 - protein, 26 aa, Mycobacterium
GELHGQPLNRDRPLWDAWVVQGLADG

SEQ ID NO: 815739 - protein, 18 aa, Mycobacterium
GELHIDRQLARGGPYLMA

SEQ ID NO: 815740 - protein, 24 aa, Mycobacterium
GELIDDPYPYYEALRRQCPVTREG

SEQ ID NO: 815741 - protein, 22 aa, Mycobacterium
GELIDLYDFPKNDKIYLRANMI

SEQ ID NO: 815742 - protein, 27 aa, Mycobacterium
GELINMIPFPSFFADDFTILDGLLAFY

SEQ ID NO: 815743 - protein, 34 aa, Mycobacterium
GELIPRGLPLPAHTAWLLFPGDRDALRVSGSFQI

SEQ ID NO: 815744 - protein, 19 aa, Mycobacterium
GELKLFLDPSRVVRSTDRS

SEQ ID NO: 815745 - protein, 34 aa, Mycobacterium
GELLAVRGLVIGARPVLRYLAPIAIRGELVWIDL

SEQ ID NO: 815746 - protein, 26 aa, Mycobacterium
GELLGRPTAWLFGPESHGLPSEIASA

SEQ ID NO: 815747 - protein, 17 aa, Mycobacterium
GELLKPFTARYFEVILG

SEQ ID NO: 815748 - protein, 19 aa, Mycobacterium
GELLNIPLTAHFLGGAVIG

SEQ ID NO: 815749 - protein, 24 aa, Mycobacterium
GELLRARGLRRMASRIQVLAVLEP

SEQ ID NO: 815750 - protein, 25 aa, Mycobacterium
GELLRLPGAFSPLVAKLIQEIGFEG

SEQ ID NO: 815751 - protein, 22 aa, Mycobacterium
GELMTDVFALYDPPAPPGMSGD

SEQ ID NO: 815752 - protein, 20 aa, Mycobacterium
GELNAFTAREQTCYYAHVLD

SEQ ID NO: 815753 - protein, 26 aa, Mycobacterium
GELNRFVFAMPEQLGRIYLGLTDEDA

SEQ ID NO: 815754 - protein, 25 aa, Mycobacterium
GELNRFVFAMPEQLGRVYLGLTDEA

SEQ ID NO: 815755 - protein, 24 aa, Mycobacterium
GELPGQLLFDAFPDNPHDPQSTGT

SEQ ID NO: 815756 - protein, 17 aa, Mycobacterium
GELPNWWDEFVANGFHA

SEQ ID NO: 815757 - protein, 22 aa, Mycobacterium
GELPPWWEEFTAHGFHAVHLSE

SEQ ID NO: 815758 - protein, 22 aa, Mycobacterium
GELPRLFVVTRQAQIVRSDDEA

SEQ ID NO: 815759 - protein, 26 aa, Mycobacterium
GELPSWQWEGLIDKPTRLVAIASASS

SEQ ID NO: 815760 - protein, 20 aa, Mycobacterium
GELPTWQWESLVSRPTRIVA

SEQ ID NO: 815761 - protein, 25 aa, Mycobacterium
GELPYNTLSFLWRELAGFSRDDWAL

SEQ ID NO: 815762 - protein, 24 aa, Mycobacterium
GELQRRRGLPAPVAYGRPALGAGE

SEQ ID NO: 815763 - protein, 30 aa, Mycobacterium
GELRAYWELPAMMAQFLRTGPGAVSPALHL

SEQ ID NO: 815764 - protein, 38 aa, Mycobacterium
GELRGNMFVLRLDAIGFWQRLHHTFAAVLRARAAAAGN

SEQ ID NO: 815765 - protein, 23 aa, Mycobacterium
GELRPLYRPGLFHMYHALTWGPL

SEQ ID NO: 815766 - protein, 17 aa, Mycobacterium
GELRPLYRPGLIHMYHA

SEQ ID NO: 815767 - protein, 22 aa, Mycobacterium
GELRPQLLDRFGLTVDVTASRD

SEQ ID NO: 815768 - protein, 26 aa, Mycobacterium
GELRRIVRPGGRIGLLVFLAHGDIAD

SEQ ID NO: 815769 - protein, 21 aa, Mycobacterium
GELSGRMDELFLAALRELAAP

SEQ ID NO: 815770 - protein, 23 aa, Mycobacterium
GELSRVMLALEVVLAASAAGTTM

SEQ ID NO: 815771 - protein, 23 aa, Mycobacterium
GELSRVMLALEVVLAASTAGTTM

SEQ ID NO: 815772 - protein, 23 aa, Mycobacterium
GELSRVMLALEVVLSASAAGTTM

SEQ ID NO: 815773 - protein, 22 aa, Mycobacterium
GELSRVMLALEVVLSASTEGTT

SEQ ID NO: 815774 - protein, 25 aa, Mycobacterium
GELSVHYPFPNYQLATLDDALTYGS

SEQ ID NO: 815775 - protein, 22 aa, Mycobacterium
GELTLDKFLDESLLKAAKDVQP

SEQ ID NO: 815776 - protein, 34 aa, Mycobacterium
GELTLEDFLEQMLAIRRMGPIGNLLGMLPGAGQM

SEQ ID NO: 815777 - protein, 21 aa, Mycobacterium
GELTWCQLFSEPGAGSDLAAL

SEQ ID NO: 815778 - protein, 17 aa, Mycobacterium
GELVCLLDAARLGERGG

SEQ ID NO: 815779 - protein, 26 aa, Mycobacterium
GELVEFYLEHLPAHLLGGVLVGHSVG

SEQ ID NO: 815780 - protein, 18 aa, Mycobacterium
GELVELLYDAIPAPARRT

SEQ ID NO: 815781 - protein, 24 aa, Mycobacterium
GELVPKVPFSFDPTVLRAARAASG

SEQ ID NO: 815782 - protein, 25 aa, Mycobacterium
GELVRGRWGLLEPPAPWLPESAVGQ

SEQ ID NO: 815783 - protein, 25 aa, Mycobacterium
GELVVRLRVPLRGVAPGQTLVLYRP

SEQ ID NO: 815784 - protein, 21 aa, Mycobacterium
GELWQRPDIALALAQRYSAAY

SEQ ID NO: 815785 - protein, 19 aa, Mycobacterium
GELYGLLMEHGILARTAHA

SEQ ID NO: 815786 - protein, 26 aa, Mycobacterium
GEMDEWQRLFLFSRADTIYGGSNEIQ

SEQ ID NO: 815787 - protein, 24 aa, Mycobacterium
GEMDVYNMGWQKYLDARATDEQRR

SEQ ID NO: 815788 - protein, 26 aa, Mycobacterium
GEMEPYPIIRKMFATFGIDALAKEGL

SEQ ID NO: 815789 - protein, 17 aa, Mycobacterium
GEMGGTWRDNTYPGAAC

SEQ ID NO: 815790 - protein, 20 aa, Mycobacterium
GEMRKYLGYFDTERARLAQS

SEQ ID NO: 815791 - protein, 20 aa, Mycobacterium
GEMRYTRTLTIQACWEAGKQ

SEQ ID NO: 815792 - protein, 19 aa, Mycobacterium
GEMVFFDRSWYNRAGVERV

SEQ ID NO: 815793 - protein, 18 aa, Mycobacterium
GEMYFHNKYFRLDNYRYG

SEQ ID NO: 815794 - protein, 24 aa, Mycobacterium
GENDALLRFACSWIAAEDGTPRTP

SEQ ID NO: 815795 - protein, 17 aa, Mycobacterium
GENERAWRQLTADNPFA

SEQ ID NO: 815796 - protein, 24 aa, Mycobacterium
GENGRIAVVYLNAEGFYAGVKVGV

SEQ ID NO: 815797 - protein, 26 aa, Mycobacterium
GENHLMLTVFFDLGWPCRPIDYGAIR

SEQ ID NO: 815798 - protein, 17 aa, Mycobacterium
GENLQDHLQLRTIYRVR

SEQ ID NO: 815799 - protein, 26 aa, Mycobacterium
GENLQPENLLNWARIAYNADTAVTMP

SEQ ID NO: 815800 - protein, 27 aa, Mycobacterium
GENPRDVLVVFFPLAFTGVCEGELGAI

SEQ ID NO: 815801 - protein, 25 aa, Mycobacterium
GENRRWLAAWLAERGFEVRYDRIGN

SEQ ID NO: 815802 - protein, 26 aa, Mycobacterium
GENVLLIALHYRVGGSVWGVGDTIIN

SEQ ID NO: 815803 - protein, 23 aa, Mycobacterium
GEPAALQAFTLRVGRPVGPMLAQ

SEQ ID NO: 815804 - protein, 26 aa, Mycobacterium
GEPALYDLSAHYLWIGDRTRQLDHAH

SEQ ID NO: 815805 - protein, 35 aa, Mycobacterium
GEPARAFYGPQFALTFPILTHYGVGLWVPEVGGAV

SEQ ID NO: 815806 - protein, 34 aa, Mycobacterium
GEPARAFYGPQFALTFPVLTHHGVGLWVPEVGGA

SEQ ID NO: 815807 - protein, 20 aa, Mycobacterium
GEPDPKFSLAPVGAALGEKL

SEQ ID NO: 815808 - protein, 24 aa, Mycobacterium
GEPDRPLLMLLHGSGGHAEAYVRN

SEQ ID NO: 815809 - protein, 17 aa, Mycobacterium
GEPDWVNTIFLSTRFRA

SEQ ID NO: 815810 - protein, 20 aa, Mycobacterium
GEPDYMVQFTIAGSAAPYHT

SEQ ID NO: 815811 - protein, 55 aa, Mycobacterium
GEPFPKFRVPGRLVWFAMTIWQFLHFKFGLPKPLLEPLAVERLYLDNYFSIAKAQ

SEQ ID NO: 815812 - protein, 22 aa, Mycobacterium
GEPGARMYRTGDLVFWGADGQL

SEQ ID NO: 815813 - protein, 18 aa, Mycobacterium
GEPGLLLSRVNRLQPFDG

SEQ ID NO: 815814 - protein, 22 aa, Mycobacterium
GEPIDCLSAEALHLALLLAELL

SEQ ID NO: 815815 - protein, 27 aa, Mycobacterium
GEPLPRWQIGLYWRRDGQPLWSDPELL

SEQ ID NO: 815816 - protein, 24 aa, Mycobacterium
GEPLQRDWFRRAMEPQLVATGVMT

SEQ ID NO: 815817 - protein, 27 aa, Mycobacterium
GEPLYTRRGWIRWKGPTSVLAPSGMTP

SEQ ID NO: 815818 - protein, 24 aa, Mycobacterium
GEPPPFAPWDTPDGTPPPGAPGLS

SEQ ID NO: 815819 - protein, 18 aa, Mycobacterium
GEPRLRLLGFERVELEPG

SEQ ID NO: 815820 - protein, 24 aa, Mycobacterium
GEPRRSWAVLGEMAELGPDAISEH

SEQ ID NO: 815821 - protein, 32 aa, Mycobacterium
GEPSSGFSTMLWGGQPLPTINPAYGSKTISLC

SEQ ID NO: 815822 - protein, 18 aa, Mycobacterium
GEPSWPSPFGPGRPGWHV

SEQ ID NO: 815823 - protein, 28 aa, Mycobacterium
GEPTGFVPGFWGAVLAGLIVVPSPLPDT

SEQ ID NO: 815824 - protein, 23 aa, Mycobacterium
GEPTWSYLYRSMITPLTDAGNRV

SEQ ID NO: 815825 - protein, 23 aa, Mycobacterium
GEPTWSYLYRTMIQPLADAGNRV

SEQ ID NO: 815826 - protein, 25 aa, Mycobacterium
GEPVAGLTWLPFIGERYTAVAGGPL

SEQ ID NO: 815827 - protein, 27 aa, Mycobacterium
GEPVIRHQLLVYPVTTTDLTKGMDPEY

SEQ ID NO: 815828 - protein, 22 aa, Mycobacterium
GEPVLLLHPFMLSQSVWETVAE

SEQ ID NO: 815829 - protein, 25 aa, Mycobacterium
GEPVRGFFSYQIANGGWDSLWYKTT

SEQ ID NO: 815830 - protein, 36 aa, Mycobacterium
GEPVVLLHGWPQTWYAWRKVIPLLAGEFEVIVPDLR

SEQ ID NO: 815831 - protein, 18 aa, Mycobacterium
GEPWTPESPSLLVAAPGV

SEQ ID NO: 815832 - protein, 17 aa, Mycobacterium
GEPWTVSKIYYNHGFMR

SEQ ID NO: 815833 - protein, 23 aa, Mycobacterium
GEPYQLFVEEFEVPWTAVDLTDL

SEQ ID NO: 815834 - protein, 24 aa, Mycobacterium
GEQAVDLLVPTAAKPGKRIIGERA

SEQ ID NO: 815835 - protein, 20 aa, Mycobacterium
GEQFMQWFLKEQVEEVALMD

SEQ ID NO: 815836 - protein, 22 aa, Mycobacterium
GEQFMQWFLKEQVEEVALMDTL

SEQ ID NO: 815837 - protein, 25 aa, Mycobacterium
GEQGELWFRSPQLMKGYHNKPEATA

SEQ ID NO: 815838 - protein, 19 aa, Mycobacterium
GEQIATLERLALASPVREV

SEQ ID NO: 815839 - protein, 25 aa, Mycobacterium
GEQKAKIFLALLGKQYGVDAKGWRA

SEQ ID NO: 815840 - protein, 23 aa, Mycobacterium
GEQLDWGTYVFDFGRAEVRNFLV

SEQ ID NO: 815841 - protein, 25 aa, Mycobacterium
GEQLRLVIAGRWLSPRNPLTGQFPA

SEQ ID NO: 815842 - protein, 22 aa, Mycobacterium
GEQLSQYKFQPPAAANPAPAGT

SEQ ID NO: 815843 - protein, 21 aa, Mycobacterium
GEQMKMFLTRLGFGSKMVVTG

SEQ ID NO: 815844 - protein, 27 aa, Mycobacterium
GEQNLVLFGRLYGLRKSRARQRAQELL

SEQ ID NO: 815845 - protein, 20 aa, Mycobacterium
GEQSWPGSGPAPVKPFPAPL

SEQ ID NO: 815846 - protein, 26 aa, Mycobacterium
GEQVATIAWLGYEPPGTDISVAEAGF

SEQ ID NO: 815847 - protein, 21 aa, Mycobacterium
GEQWLSVCGFRRAENAEPAEP

SEQ ID NO: 815848 - protein, 21 aa, Mycobacterium
GERADWWWYDPFQPQPPPTNN

SEQ ID NO: 815849 - protein, 17 aa, Mycobacterium
GERAHRVAYAALKHSYE

SEQ ID NO: 815850 - protein, 20 aa, Mycobacterium
GERAPRFRLHPAPQATFALT

SEQ ID NO: 815851 - protein, 21 aa, Mycobacterium
GERAQWWWYDPFQPQPPPTNN

SEQ ID NO: 815852 - protein, 26 aa, Mycobacterium
GERARRYPLHLLANQPASRLHSQLDG

SEQ ID NO: 815853 - protein, 29 aa, Mycobacterium
GERFHLVEQFRYPIGLRRWEFPQGTAPDR

SEQ ID NO: 815854 - protein, 35 aa, Mycobacterium
GERFRATLAAVLLADPAPQLLLLDEPTNNLDFASY

SEQ ID NO: 815855 - protein, 19 aa, Mycobacterium
GERGAHIVMIGILPTVMPE

SEQ ID NO: 815856 - protein, 17 aa, Mycobacterium
GERIIDIRLSGGRPVLG

SEQ ID NO: 815857 - protein, 31 aa, Mycobacterium
GERILTWRQLYDLDALPQHLIVVGSGVTGAE

SEQ ID NO: 815858 - protein, 24 aa, Mycobacterium
GERILTWRQLYDLDELPEHLIVVG

SEQ ID NO: 815859 - protein, 32 aa, Mycobacterium
GERILTWRQLYDLEALPEHLIVVGSGVTGAEF

SEQ ID NO: 815860 - protein, 31 aa, Mycobacterium
GERILTWRQLYDLEALPQHLIVVGSGVTGAE

SEQ ID NO: 815861 - protein, 32 aa, Mycobacterium
GERILTWRQLYNLEALPEHLIVVGSGVTGAEF

SEQ ID NO: 815862 - protein, 24 aa, Mycobacterium
GERIVGMGFDRDVLLRAGIERAQA

SEQ ID NO: 815863 - protein, 18 aa, Mycobacterium
GERLPAAPSYRSFVSWLD

SEQ ID NO: 815864 - protein, 18 aa, Mycobacterium
GERLPAAPSYRSFVTWLT

SEQ ID NO: 815865 - protein, 17 aa, Mycobacterium
GERLPEYMVPAAVMVID

SEQ ID NO: 815866 - protein, 24 aa, Mycobacterium
GERLRDMLWAAIFPSIDLKTDSSR

SEQ ID NO: 815867 - protein, 25 aa, Mycobacterium
GERLRDMLWSAIFPSINLASDPARE

SEQ ID NO: 815868 - protein, 19 aa, Mycobacterium
GERLRLIHKFGAGVNTIAL

SEQ ID NO: 815869 - protein, 17 aa, Mycobacterium
GERLVDAVALMDKLRTS

SEQ ID NO: 815870 - protein, 17 aa, Mycobacterium
GERMVAVTYSKLAGRHL

SEQ ID NO: 815871 - protein, 24 aa, Mycobacterium
GERPPHFVTMLRKPVIAAINGPCV

SEQ ID NO: 815872 - protein, 24 aa, Mycobacterium
GERPPHFVTTLRKPVIAAINGACV

SEQ ID NO: 815873 - protein, 24 aa, Mycobacterium
GERPPHFVTTLRKPVIAAINGPCA

SEQ ID NO: 815874 - protein, 22 aa, Mycobacterium
GERPRRIVNRTLIQLDPDDRDE

SEQ ID NO: 815875 - protein, 18 aa, Mycobacterium
GERQPLPRLPIVEHALPD

SEQ ID NO: 815876 - protein, 25 aa, Mycobacterium
GERQRPLHHPVDELAPETGLDLFAG

SEQ ID NO: 815877 - protein, 23 aa, Mycobacterium
GERRIAVVFSAYPTKHARIGNAV

SEQ ID NO: 815878 - protein, 22 aa, Mycobacterium
GERRPGWVGLPLAGVQTRLLDD

SEQ ID NO: 815879 - protein, 30 aa, Mycobacterium; identical to SEQ ID NO: 114693

SEQ ID NO: 815880 - protein, 28 aa, Mycobacterium
GERRTLEIPIRRTDLAFWEIRSGQWGVE

SEQ ID NO: 815881 - protein, 20 aa, Mycobacterium
GERSAIVMPLIADGAVLGVI

SEQ ID NO: 815882 - protein, 25 aa, Mycobacterium
GERSAIVMPLIVDDAVLGVIAVARR

SEQ ID NO: 815883 - protein, 26 aa, Mycobacterium
GERSLARVSLPLLRSWLAEQSASGAA

SEQ ID NO: 815884 - protein, 27 aa, Mycobacterium
GERSRLMLDIARWRRRRRDELAALGEK

SEQ ID NO: 815885 - protein, 28 aa, Mycobacterium
GERSSHTWFVLTYLLGKPGVRNYDGSWT

SEQ ID NO: 815886 - protein, 29 aa, Mycobacterium
GERSSHTWFVLYELLGHRNVKNYDGSWTE

SEQ ID NO: 815887 - protein, 24 aa, Mycobacterium
GERTDNLWRPSPGSVYPTLQLLVD

SEQ ID NO: 815888 - protein, 19 aa, Mycobacterium
GERTLLAGDFVRGFVGLDS

SEQ ID NO: 815889 - protein, 25 aa, Mycobacterium
GERVLAAQWRALPDILTDADITALQ

SEQ ID NO: 815890 - protein, 35 aa, Mycobacterium
GERVLFQTTNHVWAVLGWYGVLKAGLVPVATLAQH

SEQ ID NO: 815891 - protein, 23 aa, Mycobacterium
GERYEELLRRRRLDELSAELEWT

SEQ ID NO: 815892 - protein, 24 aa, Mycobacterium
GESALAFQGAHARYMEAASKVNAL

SEQ ID NO: 815893 - protein, 26 aa, Mycobacterium
GESDPVVLLAIAFVVRALRGGSVCVD

SEQ ID NO: 815894 - protein, 21 aa, Mycobacterium
GESEGFWMGSLRADRNGLPML

SEQ ID NO: 815895 - protein, 26 aa, Mycobacterium
GESIEFPLRGLIQGWQDGIPGMKVGG

SEQ ID NO: 815896 - protein, 17 aa, Mycobacterium
GESIEFPLSALIKGWQD

SEQ ID NO: 815897 - protein, 25 aa, Mycobacterium
GESKLLIRDGLLRDYRPTEDTLAVM

SEQ ID NO: 815898 - protein, 19 aa, Mycobacterium
GESLDWPSNLWMGVSVENA

SEQ ID NO: 815899 - protein, 32 aa, Mycobacterium
GESLNLPRPAVWLLEQWLTHSAVLRSRVAPAH

SEQ ID NO: 815900 - protein, 18 aa, Mycobacterium
GESWFINIHAEWHVGDEL

SEQ ID NO: 815901 - protein, 24 aa, Mycobacterium
GESWSFAVALRLAAYELLRADGSE

SEQ ID NO: 815902 - protein, 24 aa, Mycobacterium
GESWSMAVALRLAAYELLRVEGSD

SEQ ID NO: 815903 - protein, 23 aa, Mycobacterium
GESYQDLLRRRGWAGLDSQQTWT

SEQ ID NO: 815904 - protein, 24 aa, Mycobacterium
GETASIFLPSVPNLLQLASELEAQ

SEQ ID NO: 815905 - protein, 23 aa, Mycobacterium
GETASIFLPSVPTLLELASLLEE

SEQ ID NO: 815906 - protein, 23 aa, Mycobacterium
GETCPQYLYLSLEDNLGAPGFDG

SEQ ID NO: 815907 - protein, 26 aa, Mycobacterium
GETELDLVLAILRARQLFAGAQALPG

SEQ ID NO: 815908 - protein, 20 aa, Mycobacterium
GETEWIPPPHLDRGQPRTNS

SEQ ID NO: 815909 - protein, 22 aa, Mycobacterium
GETILLVHGWPDSHHLWDGVAP

SEQ ID NO: 815910 - protein, 20 aa, Mycobacterium
GETKILRRWPQPLSGYEIHH

SEQ ID NO: 815911 - protein, 23 aa, Mycobacterium
GETKLATLPLLDSVLDAVSVPVL

SEQ ID NO: 815912 - protein, 22 aa, Mycobacterium
GETLTTLIWRTDPGKAVFRTEA

SEQ ID NO: 815913 - protein, 23 aa, Mycobacterium
GETMPQRAPALTAPLLVVHGSED

SEQ ID NO: 815914 - protein, 26 aa, Mycobacterium
GETRDLFLTLLSVSGVGPRLAMATLS

SEQ ID NO: 815915 - protein, 25 aa, Mycobacterium
GETWLPRYGGLISSEWEFAKGLQIL

SEQ ID NO: 815916 - protein, 24 aa, Mycobacterium
GEVDVRIWIHPAHRKHGFGTAALR

SEQ ID NO: 815917 - protein, 23 aa, Mycobacterium
GEVDVRIWIHPEHRKKGYGTAAL

SEQ ID NO: 815918 - protein, 24 aa, Mycobacterium
GEVDVYNMGWQKYLDARSLDEQRR

SEQ ID NO: 815919 - protein, 19 aa, Mycobacterium
GEVEGDYPLFMPQSTEQSV

SEQ ID NO: 815920 - protein, 21 aa, Mycobacterium
GEVFSAMPMALTPGPPVMTKA

SEQ ID NO: 815921 - protein, 19 aa, Mycobacterium
GEVGLWKLGLSPAQMFEHG

SEQ ID NO: 815922 - protein, 20 aa, Mycobacterium
GEVIARIIPATAGPLDALIT

SEQ ID NO: 815923 - protein, 22 aa, Mycobacterium
GEVIGESVLRRGKLRSATVTTT

SEQ ID NO: 815924 - protein, 30 aa, Mycobacterium
GEVIRRKAGLPPATYFSGGKLQWILDNVDG

SEQ ID NO: 815925 - protein, 18 aa, Mycobacterium
GEVLGVIRDLAVQGWTLV

SEQ ID NO: 815926 - protein, 20 aa, Mycobacterium
GEVLLRADVLGHRLIDVANV

SEQ ID NO: 815927 - protein, 17 aa, Mycobacterium
GEVLRHWATARSALEAW

SEQ ID NO: 815928 - protein, 23 aa, Mycobacterium
GEVLWTAMPLFHLSAAPSVLAPM

SEQ ID NO: 815929 - protein, 24 aa, Mycobacterium
GEVLWTAMPLFHLSAAPSVLAPML

SEQ ID NO: 815930 - protein, 27 aa, Mycobacterium
GEVNADLWRRYMAILIEGMRRRDDQER

SEQ ID NO: 815931 - protein, 25 aa, Mycobacterium
GEVNVRIWIHPDFRKRGYGTAALRK

SEQ ID NO: 815932 - protein, 23 aa, Mycobacterium
GEVNVRIWIHPEHRKKGYGTAAL

SEQ ID NO: 815933 - protein, 24 aa, Mycobacterium
GEVPLIGFAGAPFTLASYLIEGGP

SEQ ID NO: 815934 - protein, 31 aa, Mycobacterium; identical to SEQ ID NO: 665122

SEQ ID NO: 815935 - protein, 24 aa, Mycobacterium
GEVRVPAEALWRAQTQRAVENFPI

SEQ ID NO: 815936 - protein, 30 aa, Mycobacterium
GEVSSAFAVQWRALALVATTADLVGIARGA

SEQ ID NO: 815937 - protein, 28 aa, Mycobacterium
GEVTLMSPLTFLQRPALWFDVMDRVRAT

SEQ ID NO: 815938 - protein, 24 aa, Mycobacterium
GEVTRLATHALRFLNRAQFADGTF

SEQ ID NO: 815939 - protein, 21 aa, Mycobacterium
GEVTSNYFTFAPRGQLIHIDA

SEQ ID NO: 815940 - protein, 27 aa, Mycobacterium
GEVVDTSLGWRFTNPRFAQMDAGIAAD

SEQ ID NO: 815941 - protein, 21 aa, Mycobacterium
GEVWDAERAWNFLTSHSAMAE

SEQ ID NO: 815942 - protein, 22 aa, Mycobacterium
GEVWLRNLYIPEYRHGSWTNHE

SEQ ID NO: 815943 - protein, 29 aa, Mycobacterium
GEVYEDLAWFCIRAWRFGATESHAAGGLG

SEQ ID NO: 815944 - protein, 23 aa, Mycobacterium
GEWASIQMYPSLSAALGEEITPQ

SEQ ID NO: 815945 - protein, 34 aa, Mycobacterium
GEWHALPARLLAEVLRLRGWRVDFLGAQVPTPHL

SEQ ID NO: 815946 - protein, 18 aa, Mycobacterium
GEWILFQNQVNRSRMGAA

SEQ ID NO: 815947 - protein, 18 aa, Mycobacterium
GEWLVIHEGWRSELPEQL

SEQ ID NO: 815948 - protein, 17 aa, Mycobacterium
GEWLVSRSGLRYRMHSY

SEQ ID NO: 815949 - protein, 28 aa, Mycobacterium
GEWMMGWRRRLIVLLAGGKPSAAQMIQA

SEQ ID NO: 815950 - protein, 34 aa, Mycobacterium
GEWQMLSDLSFADYLMWVRRDDGVLVCVAQIRPN

SEQ ID NO: 815951 - protein, 18 aa, Mycobacterium
GEWQPLYTFTTEPRPRID

SEQ ID NO: 815952 - protein, 18 aa, Mycobacterium
GEWRIELDLRPSGRFVRT

SEQ ID NO: 815953 - protein, 21 aa, Mycobacterium
GEWSQRSATLAALTPPSPGQP

SEQ ID NO: 815954 - protein, 27 aa, Mycobacterium
GEWTVPTRLALVRRLGSVELDLTKARF

SEQ ID NO: 815955 - protein, 18 aa, Mycobacterium
GEWVRYDQLERKETRLRP

SEQ ID NO: 815956 - protein, 25 aa, Mycobacterium
GEYAEPLLAVLQPFTDRIAVIGQVG

SEQ ID NO: 815957 - protein, 26 aa, Mycobacterium
GEYDVLIGINLLREGLDLPEVSLVAI

SEQ ID NO: 815958 - protein, 31 aa, Mycobacterium
GEYFDFMADIALPLPIAIIGEWLGLDDSSAA

SEQ ID NO: 815959 - protein, 43 aa, Mycobacterium
GEYFDYLGFDIFYRVEGSGPPLLLIHGYPFNSFDWASIWPTLT

SEQ ID NO: 815960 - protein, 18 aa, Mycobacterium
GEYFLRHLLGTDSNVQAA

SEQ ID NO: 815961 - protein, 17 aa, Mycobacterium
GEYGAGKVIIWDSGTYD

SEQ ID NO: 815962 - protein, 17 aa, Mycobacterium
GEYIPRPIKSSFREGLT

SEQ ID NO: 815963 - protein, 26 aa, Mycobacterium
GEYKKLLLAMLQRRDAWQIVDMVNKI

SEQ ID NO: 815964 - protein, 23 aa, Mycobacterium
GEYLKERGYFRSWGIGRHIQGSQ

SEQ ID NO: 815965 - protein, 19 aa, Mycobacterium
GEYLLMDTTPLDVYAMDPH

SEQ ID NO: 815966 - protein, 43 aa, Mycobacterium
GEYLVIDWAQVAPGLFLFCAVLAFSRWRFVRFATDERASTTLA

SEQ ID NO: 815967 - protein, 18 aa, Mycobacterium
GEYPAVALALDAVMEVLS

SEQ ID NO: 815968 - protein, 27 aa, Mycobacterium
GEYPFAGLRILDLGIIVAGGELSRLFG

SEQ ID NO: 815969 - protein, 24 aa, Mycobacterium
GEYQDYLKRYLRWVPQQSDADAWK

SEQ ID NO: 815970 - protein, 17 aa, Mycobacterium
GEYQMKVPAPFVPGLEV

SEQ ID NO: 815971 - protein, 19 aa, Mycobacterium
GFAAFWIPQVPGYLDAMTA

SEQ ID NO: 815972 - protein, 19 aa, Mycobacterium
GFAAGPAPRRVAGRRRSWS

SEQ ID NO: 815973 - protein, 19 aa, Mycobacterium
GFAASLYRRGTPYIRIPTT

SEQ ID NO: 815974 - protein, 18 aa, Mycobacterium
GFAAVLYKGGPTGYRLVL

SEQ ID NO: 815975 - protein, 19 aa, Mycobacterium
GFACLFISHDLAVVELVAS

SEQ ID NO: 815976 - protein, 24 aa, Mycobacterium
GFADFPRYPLNFISDLNAVMGIVY

SEQ ID NO: 815977 - protein, 22 aa, Mycobacterium
GFADIAENLLAVLRQRVSGDLL

SEQ ID NO: 815978 - protein, 25 aa, Mycobacterium
GFADYFSRYDALLAPVLPVPAHEHR

SEQ ID NO: 815979 - protein, 26 aa, Mycobacterium
GFAEPAHHWLLTLLVGGARARPRSPR

SEQ ID NO: 815980 - protein, 22 aa, Mycobacterium
GFAEWLSITYGGQGVGVSCLCP

SEQ ID NO: 815981 - protein, 22 aa, Mycobacterium
GFAFLDRYGLQFSVSRGYLSAG

SEQ ID NO: 815982 - protein, 22 aa, Mycobacterium
GFAGDLLVLTLARIVSQIDTIH

SEQ ID NO: 815983 - protein, 24 aa, Mycobacterium
GFAGDLLVLTLARIVSRIDAIHIY

SEQ ID NO: 815984 - protein, 24 aa, Mycobacterium
GFAGSESGVFWDFTKLLDGMGEDN

SEQ ID NO: 815985 - protein, 18 aa, Mycobacterium
GFAGVDPAWEWNPALLAL

SEQ ID NO: 815986 - protein, 20 aa, Mycobacterium
GFAGVDPSWEWNPALLALRG

SEQ ID NO: 815987 - protein, 24 aa, Mycobacterium
GFAIERPPEDWLFKARTGDTLVDV

SEQ ID NO: 815988 - protein, 17 aa, Mycobacterium
GFALAWAEFLGNAGAPI

SEQ ID NO: 815989 - protein, 18 aa, Mycobacterium
GFALLSDDFTYWSIITRS

SEQ ID NO: 815990 - protein, 19 aa, Mycobacterium
GFALPQFGSAAFAAGGELA

SEQ ID NO: 815991 - protein, 24 aa, Mycobacterium
GFANDLIPFALAGTCQRIEQVRCM

SEQ ID NO: 815992 - protein, 19 aa, Mycobacterium
GFANDLLPLALAGTCQQIE

SEQ ID NO: 815993 - protein, 26 aa, Mycobacterium
GFANSGNINTGFWNAGNWNTGAGNGG

SEQ ID NO: 815994 - protein, 17 aa, Mycobacterium
GFAPLPGQAAYGAAKAF

SEQ ID NO: 815995 - protein, 27 aa, Mycobacterium
GFAQAMGPMQFIPETWRLYGVDANNDG

SEQ ID NO: 815996 - protein, 18 aa, Mycobacterium
GFASFMRAHGLTSALFHK

SEQ ID NO: 815997 - protein, 19 aa, Mycobacterium
GFATDLLQRAYRAGAGAAG

SEQ ID NO: 815998 - protein, 19 aa, Mycobacterium
GFAVEIWSWHDKDLAALAA

SEQ ID NO: 815999 - protein, 17 aa, Mycobacterium
GFCADLELRTRRIDVDY

SEQ ID NO: 816000 - protein, 32 aa, Mycobacterium
GFCAQAAVRRTPLLLDGMAVTAAALVAERLAP

SEQ ID NO: 816001 - protein, 31 aa, Mycobacterium
GFCFGEGPRWFEGLVWFSDMLGEAVHTVTLD

SEQ ID NO: 816002 - protein, 18 aa, Mycobacterium
GFCQLLVDQLSAALASVV

SEQ ID NO: 816003 - protein, 23 aa, Mycobacterium
GFCTPGFVMSLTALLRDNPDPSD

SEQ ID NO: 816004 - protein, 24 aa, Mycobacterium
GFCTPGMMITARALLRQNPDPTEE

SEQ ID NO: 816005 - protein, 45 aa, Mycobacterium
GFDAFRQTIARRLHLLEPLRYRLIDIPWRLHHPMWLQDCPVDLDY

SEQ ID NO: 816006 - protein, 18 aa, Mycobacterium
GFDALTAAPLLCAGVTVF

SEQ ID NO: 816007 - protein, 19 aa, Mycobacterium
GFDARFSALRRHYTYRLST

SEQ ID NO: 816008 - protein, 19 aa, Mycobacterium
GFDDIRWRLDVWNASAQVT

SEQ ID NO: 816009 - protein, 25 aa, Mycobacterium
GFDELRRRHLVPDPPYGQGVAAAVA

SEQ ID NO: 816010 - protein, 19 aa, Mycobacterium
GFDFFAHPELPGPPVSERD

SEQ ID NO: 816011 - protein, 17 aa, Mycobacterium
GFDFLDPDVSVKGLPVA

SEQ ID NO: 816012 - protein, 18 aa, Mycobacterium
GFDGFARLSSSSALALVY

SEQ ID NO: 816013 - protein, 17 aa, Mycobacterium
GFDGLYPGPLVELTTIN

SEQ ID NO: 816014 - protein, 24 aa, Mycobacterium
GFDGVEHMPLLDKLGLSLNRRGTL

SEQ ID NO: 816015 - protein, 20 aa, Mycobacterium
GFDIGFLKAAARQCGIDWPQ

SEQ ID NO: 816016 - protein, 17 aa, Mycobacterium
GFDIGFLRAAAERTQLT

SEQ ID NO: 816017 - protein, 27 aa, Mycobacterium
GFDIRRPPEEWLFKAAFSVDGPVLIDV

SEQ ID NO: 816018 - protein, 25 aa, Mycobacterium
GFDIWGTDLGIMWDGGEWNGQRFVH

SEQ ID NO: 816019 - protein, 17 aa, Mycobacterium
GFDPAQPTAWLAEGLLP

SEQ ID NO: 816020 - protein, 21 aa, Mycobacterium
GFDPFDVIAPFEVLAAGAEMV

SEQ ID NO: 816021 - protein, 33 aa, Mycobacterium
GFDPSARTAWLAEGLLMYLPAEAQDRLFTQIGE

SEQ ID NO: 816022 - protein, 33 aa, Mycobacterium
GFDPTARTAWLAEGLLMYLPADAQDRLFIQIGE

SEQ ID NO: 816023 - protein, 34 aa, Mycobacterium
GFDPTRPTAWSAEGLLPFLPPEAQDRLLDAITSL

SEQ ID NO: 816024 - protein, 24 aa, Mycobacterium
GFDRDLWRRLADQGVLGMLVDSEY

SEQ ID NO: 816025 - protein, 19 aa, Mycobacterium
GFDRIFAVTMNHSVWFHRP

SEQ ID NO: 816026 - protein, 19 aa, Mycobacterium
GFDRLEITTCLRRGEIEMV

SEQ ID NO: 816027 - protein, 22 aa, Mycobacterium
GFDRNVLIMWGTEDRYVPFAQT

SEQ ID NO: 816028 - protein, 17 aa, Mycobacterium
GFDRVLVDVPCTGLGAL

SEQ ID NO: 816029 - protein, 25 aa, Mycobacterium
GFDTAAIELILPTYGERLGLKGRIA

SEQ ID NO: 816030 - protein, 20 aa, Mycobacterium
GFDVLRILAPSVARDDAFRS

SEQ ID NO: 816031 - protein, 19 aa, Mycobacterium
GFDVVYLPPIHPIGEVNRK

SEQ ID NO: 816032 - protein, 29 aa, Mycobacterium
GFDYTITIPEIGLGLNVDVPLNIPLRGTI

SEQ ID NO: 816033 - protein, 26 aa, Mycobacterium
GFEDGPNLLGQAWPLFAQSMAMVVEG

SEQ ID NO: 816034 - protein, 25 aa, Mycobacterium
GFEERMEAARWLRGYLRELISQRRR

SEQ ID NO: 816035 - protein, 17 aa, Mycobacterium
GFEFVAMARALLAEPDL

SEQ ID NO: 816036 - protein, 17 aa, Mycobacterium
GFEFVAMGRALLAEPDL

SEQ ID NO: 816037 - protein, 32 aa, Mycobacterium
GFEGSWRVNSLGPFLGIQAALPHLKAAEGAAI

SEQ ID NO: 816038 - protein, 19 aa, Mycobacterium
GFEHPYPFARRLSTLDHLT

SEQ ID NO: 816039 - protein, 19 aa, Mycobacterium
GFEIILRGKDPQAGLIVCP

SEQ ID NO: 816040 - protein, 24 aa, Mycobacterium
GFELAVRCLTFPVPVIMAATGPAI

SEQ ID NO: 816041 - protein, 18 aa, Mycobacterium
GFELIFKRQIIAHARDRD

SEQ ID NO: 816042 - protein, 18 aa, Mycobacterium
GFELQFGTNHLGHFAFTG

SEQ ID NO: 816043 - protein, 18 aa, Mycobacterium
GFELQFGTNHLGHFALTG

SEQ ID NO: 816044 - protein, 21 aa, Mycobacterium
GFEMQFGTNHLGHFALTGLLL

SEQ ID NO: 816045 - protein, 22 aa, Mycobacterium
GFEPDLLVFKELRIFGSLGVDY

SEQ ID NO: 816046 - protein, 19 aa, Mycobacterium
GFEPDLLVFKELRVLGSLG

SEQ ID NO: 816047 - protein, 17 aa, Mycobacterium
GFEPNRASAWIAEGLFG

SEQ ID NO: 816048 - protein, 19 aa, Mycobacterium
GFERFYGFLGGDTSQYEPA

SEQ ID NO: 816049 - protein, 20 aa, Mycobacterium
GFERFYGFLGGETNQWYPDL

SEQ ID NO: 816050 - protein, 20 aa, Mycobacterium
GFERFYGFMGGETDQWYPDL

SEQ ID NO: 816051 - protein, 23 aa, Mycobacterium
GFERFYGFMGGETDQWYPDLMYD

SEQ ID NO: 816052 - protein, 26 aa, Mycobacterium
GFESAWRVNCLGAFLGMRAALGALSA

SEQ ID NO: 816053 - protein, 20 aa, Mycobacterium
GFFDREIVPVTLPDGTVVSK

SEQ ID NO: 816054 - protein, 21 aa, Mycobacterium
GFFRGSWLALIRLLKCGPWHR

SEQ ID NO: 816055 - protein, 26 aa, Mycobacterium
GFGAVKAQIFLALLGKQYGVTPKGWR

SEQ ID NO: 816056 - protein, 30 aa, Mycobacterium
GFGDWFQDFPHPDDFFRPLINGKSILPTNG

SEQ ID NO: 816057 - protein, 25 aa, Mycobacterium
GFGEHAVLPVLRRDQPERRAVGAAV

SEQ ID NO: 816058 - protein, 30 aa, Mycobacterium
GFGFYHKHFGLPYAFGKYDQLFVPEFNAGA

SEQ ID NO: 816059 - protein, 17 aa, Mycobacterium
GFGGDALTLAYTRSRFT

SEQ ID NO: 816060 - protein, 20 aa, Mycobacterium
GFGGLGLRLRSNDTLYCCLP

SEQ ID NO: 816061 - protein, 21 aa, Mycobacterium
GFGGMVSVRLAGGRQAALDLC

SEQ ID NO: 816062 - protein, 19 aa, Mycobacterium
GFGGTLRPLRAEDLAARVI

SEQ ID NO: 816063 - protein, 23 aa, Mycobacterium
GFGGYVALPAYLAARRRVPVVVH

SEQ ID NO: 816064 - protein, 26 aa, Mycobacterium
GFGHIGRTSWKLLRAFGADAVAVTGT

SEQ ID NO: 816065 - protein, 31 aa, Mycobacterium
GFGKEAPVFVMERVMDLIARRLRLDPAEVRR

SEQ ID NO: 816066 - protein, 24 aa, Mycobacterium
GFGKTNIIEALWYSATLGSHRVGT

SEQ ID NO: 816067 - protein, 17 aa, Mycobacterium
GFGLARPVWLDDVDFDI

SEQ ID NO: 816068 - protein, 20 aa, Mycobacterium
GFGLGLHRCLGAHFARIQIA

SEQ ID NO: 816069 - protein, 28 aa, Mycobacterium
GFGLGTRVPLPKFIAQRVLPKPGTGPSE

SEQ ID NO: 816070 - protein, 22 aa, Mycobacterium
GFGLGWWLQRCRQDHRAGTLPA

SEQ ID NO: 816071 - protein, 20 aa, Mycobacterium
GFGLPEPTTLPYIPEGKICH

SEQ ID NO: 816072 - protein, 17 aa, Mycobacterium
GFGMHRCLGAFLAPVEI

SEQ ID NO: 816073 - protein, 24 aa, Mycobacterium
GFGNGGSLNFGFGNAGLGNVGVGN

SEQ ID NO: 816074 - protein, 26 aa, Mycobacterium
GFGNTGFYNVGFFNTGDNNSGFGNIN

SEQ ID NO: 816075 - protein, 26 aa, Mycobacterium
GFGNTGVPGIIFGPALSGGNSGLFNN

SEQ ID NO: 816076 - protein, 26 aa, Mycobacterium
GFGPFTPGFRIVPFGDAAALERAIDG

SEQ ID NO: 816077 - protein, 25 aa, Mycobacterium
GFGPGFGPGFGFGPGGRRGGWRRGG

SEQ ID NO: 816078 - protein, 26 aa, Mycobacterium
GFGSLHMPDFPLLPVRVETWEGLVFV

SEQ ID NO: 816079 - protein, 35 aa, Mycobacterium
GFGTDRAMIAACPLTFPWNVLGWPSINVPAGFTSE

SEQ ID NO: 816080 - protein, 30 aa, Mycobacterium
GFGTGGAGGTGGWLIGHSGTNGIGGTGGAG

SEQ ID NO: 816081 - protein, 24 aa, Mycobacterium
GFGVPPMPFFDPRATAHPLATVLQ

SEQ ID NO: 816082 - protein, 19 aa, Mycobacterium
GFGVRAFTALIYPHKPHMA

SEQ ID NO: 816083 - protein, 18 aa, Mycobacterium
GFHAAWCWERTAAALRAL

SEQ ID NO: 816084 - protein, 24 aa, Mycobacterium
GFHDQLVRLMRAGAAAYASVEATA

SEQ ID NO: 816085 - protein, 21 aa, Mycobacterium
GFHGFLLRTAGKWTLKHPLRP

SEQ ID NO: 816086 - protein, 19 aa, Mycobacterium
GFHKRHPQVRLRPLQFPRV

SEQ ID NO: 816087 - protein, 20 aa, Mycobacterium
GFHLNRGVLAAARRVPEPTV

SEQ ID NO: 816088 - protein, 18 aa, Mycobacterium
GFHPEGTIGLWRALAEVV

SEQ ID NO: 816089 - protein, 31 aa, Mycobacterium
GFHQGQNLFWDKLSGAMFRLAGALGATQAPK

SEQ ID NO: 816090 - protein, 19 aa, Mycobacterium
GFHQRFVQALGAAGGSYAA

SEQ ID NO: 816091 - protein, 19 aa, Mycobacterium
GFHVYARIAPQWSFSQVRL

SEQ ID NO: 816092 - protein, 18 aa, Mycobacterium
GFIFNRIWAAIKREALMV

SEQ ID NO: 816093 - protein, 17 aa, Mycobacterium
GFIFRVVPDRQSARVVA

SEQ ID NO: 816094 - protein, 31 aa, Mycobacterium
GFIGSPAMNFFPATLTPIGLTLPFGEVMLTP

SEQ ID NO: 816095 - protein, 17 aa, Mycobacterium
GFIGSPAMNFLPATLTP

SEQ ID NO: 816096 - protein, 24 aa, Mycobacterium
GFIGSPAMNLFTLPVIDSAVSLGD

SEQ ID NO: 816097 - protein, 27 aa, Mycobacterium
GFIHSGELFIVGRMKDLLIIRGRNHYP

SEQ ID NO: 816098 - protein, 18 aa, Mycobacterium
GFIINRVWAAVKREALAV

SEQ ID NO: 816099 - protein, 17 aa, Mycobacterium
GFILAPDGTVRLAVYSS

SEQ ID NO: 816100 - protein, 19 aa, Mycobacterium
GFIQLFAVVTAGLSDRIDR

SEQ ID NO: 816101 - protein, 18 aa, Mycobacterium
GFIRQFVAVPLGSGATVE

SEQ ID NO: 816102 - protein, 17 aa, Mycobacterium
GFITGPLSPASLFTIPG

SEQ ID NO: 816103 - protein, 19 aa, Mycobacterium
GFITWSLARNPELLDLILA

SEQ ID NO: 816104 - protein, 24 aa, Mycobacterium
GFIVLAQRHWDMLTKQHRLWGRYF

SEQ ID NO: 816105 - protein, 18 aa, Mycobacterium
GFIYGSGGAGGPGGVGGS

SEQ ID NO: 816106 - protein, 30 aa, Mycobacterium
GFKADVLASALPWLKQLHGKIVVVKYGGNA

SEQ ID NO: 816107 - protein, 29 aa, Mycobacterium
GFKKFHNITFEDWRRVIDVNLNGVFHTVQ

SEQ ID NO: 816108 - protein, 33 aa, Mycobacterium
GFKPPYMAFQTFWRFIDELSGPGLPPVIDRSLM

SEQ ID NO: 816109 - protein, 20 aa, Mycobacterium
GFLDDLHYIARGREFIGGTR

SEQ ID NO: 816110 - protein, 25 aa, Mycobacterium
GFLGPRVYELLYDEPFPAGIQTAEN

SEQ ID NO: 816111 - protein, 25 aa, Mycobacterium
GFLGRYLVLEWLEQLEQVEGKLICL

SEQ ID NO: 816112 - protein, 27 aa, Mycobacterium
GFLHDGELYVCGRVKDLLIVAGRNIHP

SEQ ID NO: 816113 - protein, 18 aa, Mycobacterium
GFLLFVDEAHAIGTVGKT

SEQ ID NO: 816114 - protein, 17 aa, Mycobacterium
GFLLQDRAKFHSSFGAD

SEQ ID NO: 816115 - protein, 20 aa, Mycobacterium
GFLMMAHTIAPEKLAAQARI

SEQ ID NO: 816116 - protein, 19 aa, Mycobacterium
GFLNATRWWNAKHPNAYAQ

SEQ ID NO: 816117 - protein, 20 aa, Mycobacterium
GFLPAGYRQALAPASTWWSW

SEQ ID NO: 816118 - protein, 20 aa, Mycobacterium
GFLPAPGPVTKFVAPTGPGV

SEQ ID NO: 816119 - protein, 20 aa, Mycobacterium
GFLPASLVEMRRVRDLQPYI

SEQ ID NO: 816120 - protein, 26 aa, Mycobacterium
GFLRAIRPELVVPLVTFLASRECTVT

SEQ ID NO: 816121 - protein, 25 aa, Mycobacterium
GFLSEPWWCRMVVLSADRVARRGGV

SEQ ID NO: 816122 - protein, 25 aa, Mycobacterium
GFLTEPWWCRMVVLSAERIARRGGV

SEQ ID NO: 816123 - protein, 17 aa, Mycobacterium
GFLTHKELGLVPLRGLV

SEQ ID NO: 816124 - protein, 19 aa, Mycobacterium
GFLTPRSSPRQRCVAHRLT

SEQ ID NO: 816125 - protein, 30 aa, Mycobacterium
GFLVNAAAPDVLRLAPPLIITDEQIGEFVT

SEQ ID NO: 816126 - protein, 23 aa, Mycobacterium
GFMGLGMIYTAMPVTNAVPAVVA

SEQ ID NO: 816127 - protein, 17 aa, Mycobacterium
GFMTHKELGLIPLRGVI

SEQ ID NO: 816128 - protein, 26 aa, Mycobacterium
GFNAPAIAAAEFQYEEMWAQDVAAMV

SEQ ID NO: 816129 - protein, 33 aa, Mycobacterium
GFNDIGLLVNFPVSQFLKFGPHAAAGGLGEFPK

SEQ ID NO: 816130 - protein, 22 aa, Mycobacterium
GFNDIVAVLALYRPGPMGMNAH

SEQ ID NO: 816131 - protein, 26 aa, Mycobacterium
GFNIARVVAVALGYDFLPGTTVNRYC

SEQ ID NO: 816132 - protein, 27 aa, Mycobacterium
GFNIGRVVAVALGYDFLPGTTVNRYCS

SEQ ID NO: 816133 - protein, 18 aa, Mycobacterium
GFPAWSVMGEANASLMTC

SEQ ID NO: 816134 - protein, 17 aa, Mycobacterium
GFPEFPLPLGNPQESSR

SEQ ID NO: 816135 - protein, 24 aa, Mycobacterium
GFPFGLSVIFPPNLPLPSKIVTQV

SEQ ID NO: 816136 - protein, 25 aa, Mycobacterium
GFPIAKIAAKLAIGYSLDEIVNDIT

SEQ ID NO: 816137 - protein, 27 aa, Mycobacterium
GFPIAKIAAKLAIGYTLDEILNDITKE

SEQ ID NO: 816138 - protein, 33 aa, Mycobacterium
GFPKASVMTHHRWLRALAVFGGLGLRLKSSDTL

SEQ ID NO: 816139 - protein, 32 aa, Mycobacterium
GFPKASVMTHHRWLRALAVFGGMGLRLKSSDT

SEQ ID NO: 816140 - protein, 28 aa, Mycobacterium
GFPKASVMTHLRWLKALAAFGGIGLRLK

SEQ ID NO: 816141 - protein, 29 aa, Mycobacterium
GFPKASVMTHLRWLKALAAFGGIGLRLKA

SEQ ID NO: 816142 - protein, 35 aa, Mycobacterium
GFPNAPMRSVHLWALPQPLPAPPSLTLATEAWEPH

SEQ ID NO: 816143 - protein, 17 aa, Mycobacterium
GFPNHFNIFGPYGYNGS

SEQ ID NO: 816144 - protein, 26 aa, Mycobacterium
GFPQNWWEWHHLIGPLAADGYRVLCP

SEQ ID NO: 816145 - protein, 19 aa, Mycobacterium
GFPQNWWEWRELIGPLAAD

SEQ ID NO: 816146 - protein, 18 aa, Mycobacterium
GFPRALLQELLSAYGPCG

SEQ ID NO: 816147 - protein, 17 aa, Mycobacterium
GFPTVRGLAPYLDGNVG

SEQ ID NO: 816148 - protein, 21 aa, Mycobacterium
GFQGPPPWNIGEPQPELAALH

SEQ ID NO: 816149 - protein, 17 aa, Mycobacterium
GFQKLACEYFAHGAYEQ

SEQ ID NO: 816150 - protein, 17 aa, Mycobacterium
GFQLVIVATVQNATTIE

SEQ ID NO: 816151 - protein, 17 aa, Mycobacterium
GFQTAVYGPIRAAGQAW

SEQ ID NO: 816152 - protein, 17 aa, Mycobacterium
GFRAAGIAAGIKASGKL

SEQ ID NO: 816153 - protein, 21 aa, Mycobacterium
GFRALLFVNDELRKARVHCSV

SEQ ID NO: 816154 - protein, 17 aa, Mycobacterium
GFRDPALYAHLWKIVQH

SEQ ID NO: 816155 - protein, 38 aa, Mycobacterium
GFREILEPTLPLSRLVFSTPTQYYKVGVAWLTYLDGGQ

SEQ ID NO: 816156 - protein, 18 aa, Mycobacterium
GFRFDLAATLAREFYDVD

SEQ ID NO: 816157 - protein, 18 aa, Mycobacterium
GFRFDLASTLAREFYDVD

SEQ ID NO: 816158 - protein, 18 aa, Mycobacterium
GFRFDLASTLAREFYEVD

SEQ ID NO: 816159 - protein, 17 aa, Mycobacterium
GFRGCLTLELVNLGKMP

SEQ ID NO: 816160 - protein, 24 aa, Mycobacterium
GFRHTDVLWPLKILGRNGIDLRER

SEQ ID NO: 816161 - protein, 19 aa, Mycobacterium
GFRINAVLPGPVETPILVD

SEQ ID NO: 816162 - protein, 23 aa, Mycobacterium
GFRLGITTDWKSRWYADKQYADY

SEQ ID NO: 816163 - protein, 27 aa, Mycobacterium
GFRLGITTDWKSRWYADKQYADYIKED

SEQ ID NO: 816164 - protein, 26 aa, Mycobacterium
GFRLGITTDWKSRWYADKQYAEYVKE

SEQ ID NO: 816165 - protein, 23 aa, Mycobacterium
GFRLGITTDWKSRWYADKQYSDY

SEQ ID NO: 816166 - protein, 28 aa, Mycobacterium
GFRLGITTEWKSRWYADKQYKDYVKEDV

SEQ ID NO: 816167 - protein, 17 aa, Mycobacterium
GFRLNRVVDTVSPLSII

SEQ ID NO: 816168 - protein, 20 aa, Mycobacterium
GFRMGLLGAGALSNHPLAGG

SEQ ID NO: 816169 - protein, 17 aa, Mycobacterium
GFRNAMTFVLTGLNIEA

SEQ ID NO: 816170 - protein, 22 aa, Mycobacterium
GFRPAPLFEVLAKRMGVSADDR

SEQ ID NO: 816171 - protein, 18 aa, Mycobacterium
GFRRPILHGLCTYGVAGR

SEQ ID NO: 816172 - protein, 24 aa, Mycobacterium
GFRRRSCCLFYRLPDGSLCGDCVL

SEQ ID NO: 816173 - protein, 21 aa, Mycobacterium
GFRRVPVLAIKRKNAINEPLF

SEQ ID NO: 816174 - protein, 24 aa, Mycobacterium
GFRRVPVMAIKRRNAINEPLFTSP

SEQ ID NO: 816175 - protein, 34 aa, Mycobacterium
GFRSFREGTNLKAWLYRILTNTYINSYRKKQRQP

SEQ ID NO: 816176 - protein, 26 aa, Mycobacterium
GFRVRRLAGRVVWMQPPDAPLGAQTH

SEQ ID NO: 816177 - protein, 27 aa, Mycobacterium
GFRVRRLAGRVVWMRPPDAPLPAQTHT

SEQ ID NO: 816178 - protein, 23 aa, Mycobacterium
GFRWWTRARALELGLTGFASNRP

SEQ ID NO: 816179 - protein, 17 aa, Mycobacterium
GFRWWTRCRALELGLTG

SEQ ID NO: 816180 - protein, 19 aa, Mycobacterium
GFSAFFRSDHYLAMSGDGL

SEQ ID NO: 816181 - protein, 18 aa, Mycobacterium
GFSCYPKKTPWLEDINWL

SEQ ID NO: 816182 - protein, 17 aa, Mycobacterium
GFSFGFPVDARIWDAVD

SEQ ID NO: 816183 - protein, 27 aa, Mycobacterium
GFSFHDLRHYLASLLIARGCDVKTVQA

SEQ ID NO: 816184 - protein, 27 aa, Mycobacterium
GFSGVTGAIFGVLFVALGRANAKVAIE

SEQ ID NO: 816185 - protein, 24 aa, Mycobacterium
GFSLNCNNSLDAYLPIVACGITDA

SEQ ID NO: 816186 - protein, 21 aa, Mycobacterium
GFSLTVPRRQGGERRLYLLET

SEQ ID NO: 816187 - protein, 19 aa, Mycobacterium
GFSTELLLRAYRHAGVAAF

SEQ ID NO: 816188 - protein, 20 aa, Mycobacterium
GFSVVLLPDPVPTPVVAFAV

SEQ ID NO: 816189 - protein, 18 aa, Mycobacterium
GFSWDHTTDALLASYRRA

SEQ ID NO: 816190 - protein, 21 aa, Mycobacterium
GFSWPCVMVFISDWAAPKSLT

SEQ ID NO: 816191 - protein, 23 aa, Mycobacterium
GFTALNFLYHLMNMIAEGVFERM

SEQ ID NO: 816192 - protein, 23 aa, Mycobacterium
GFTANVLLRLCKDAELRAKFTAD

SEQ ID NO: 816193 - protein, 18 aa, Mycobacterium
GFTDAYRDLAFPGGIREI

SEQ ID NO: 816194 - protein, 26 aa, Mycobacterium
GFTEFVPLPFVHQNSPLYLAGAARPG

SEQ ID NO: 816195 - protein, 27 aa, Mycobacterium
GFTEFVPLPFVHQNSPLYLAGAARPGP

SEQ ID NO: 816196 - protein, 27 aa, Mycobacterium
GFTEFVPLPFVHQSAPLYLAGAARPGP

SEQ ID NO: 816197 - protein, 27 aa, Mycobacterium
GFTEFVPLPFVHQSSPLYLAGGARPGP

SEQ ID NO: 816198 - protein, 27 aa, Mycobacterium
GFTEFVPLPFVHQSSPLYLAGGSRPGP

SEQ ID NO: 816199 - protein, 24 aa, Mycobacterium
GFTLLEQRPDSWDPACIPLHHLVT

SEQ ID NO: 816200 - protein, 20 aa, Mycobacterium
GFTQSYSYFTWRTSKWELTE

SEQ ID NO: 816201 - protein, 33 aa, Mycobacterium
GFTRFDQITLAEWNRFLAVNLTGTFLSLQAGLA

SEQ ID NO: 816202 - protein, 17 aa, Mycobacterium
GFTTPGKPALLRPASAE

SEQ ID NO: 816203 - protein, 26 aa, Mycobacterium
GFTWEHDAHLYLRRARTLAALMADGV

SEQ ID NO: 816204 - protein, 27 aa, Mycobacterium
GFTWEHDVHLYWRRAISLAGSIGPANR

SEQ ID NO: 816205 - protein, 26 aa, Mycobacterium
GFTWEHPCHLYVRRARSGLQLFGDSG

SEQ ID NO: 816206 - protein, 18 aa, Mycobacterium
GFTYWPDGPLKAPKRVLP

SEQ ID NO: 816207 - protein, 20 aa, Mycobacterium
GFVAVIHRWASTGDLASALA

SEQ ID NO: 816208 - protein, 19 aa, Mycobacterium
GFVAYSPLGRGFLTGTVRS

SEQ ID NO: 816209 - protein, 24 aa, Mycobacterium
GFVCSIRAWAYQIADLATDYRVIA

SEQ ID NO: 816210 - protein, 24 aa, Mycobacterium
GFVCSIRVWAYQIADLATDYRVIA

SEQ ID NO: 816211 - protein, 20 aa, Mycobacterium
GFVDLPVLPGERLRAVVSGR

SEQ ID NO: 816212 - protein, 21 aa, Mycobacterium
GFVDLPVLPGERLRAVVSGRN

SEQ ID NO: 816213 - protein, 25 aa, Mycobacterium
GFVDVNIPPGLWGGYATHLHLPFDS

SEQ ID NO: 816214 - protein, 26 aa, Mycobacterium
GFVLNPAERIPPRTALELFFGTAQDP

SEQ ID NO: 816215 - protein, 20 aa, Mycobacterium
GFVLRPGMVLVLEPVVWEDG

SEQ ID NO: 816216 - protein, 28 aa, Mycobacterium
GFVNQLQMALFAWIKRNPAGNRPLGGLL

SEQ ID NO: 816217 - protein, 22 aa, Mycobacterium
GFVNSRPKPLSAYLFTKSREIR

SEQ ID NO: 816218 - protein, 19 aa, Mycobacterium
GFVPKFALSVPAIQNLLAT

SEQ ID NO: 816219 - protein, 24 aa, Mycobacterium
GFVPSRDATVVRRLLAAGATIAGK

SEQ ID NO: 816220 - protein, 17 aa, Mycobacterium
GFVQWVKDHCGETEIVE

SEQ ID NO: 816221 - protein, 17 aa, Mycobacterium
GFVRLRLDIAYDGTDFA

SEQ ID NO: 816222 - protein, 18 aa, Mycobacterium
GFVRLRLTSAGHLAPLIV

SEQ ID NO: 816223 - protein, 32 aa, Mycobacterium
GFVRSRPDLALPDLELIFAPAPFYDEGLRVQP

SEQ ID NO: 816224 - protein, 19 aa, Mycobacterium
GFVSQPIAHLNGRSISLSM

SEQ ID NO: 816225 - protein, 18 aa, Mycobacterium
GFVYPDFAAPTPGRAPTD

SEQ ID NO: 816226 - protein, 20 aa, Mycobacterium
GFWASLGWEPFYDSRPGPAG

SEQ ID NO: 816227 - protein, 19 aa, Mycobacterium
GFWERLGYHRYGDPWREQR

SEQ ID NO: 816228 - protein, 21 aa, Mycobacterium
GFWRGYFATRSAPLGRADARV

SEQ ID NO: 816229 - protein, 21 aa, Mycobacterium
GFYAALEFWSAMHGFVLLEMT

SEQ ID NO: 816230 - protein, 19 aa, Mycobacterium
GFYCFAAEITSPMAEIPFS

SEQ ID NO: 816231 - protein, 20 aa, Mycobacterium
GFYLQPTIFAGNNAMRIFQE

SEQ ID NO: 816232 - protein, 17 aa, Mycobacterium
GFYPIPRPRAALGAATI

SEQ ID NO: 816233 - protein, 20 aa, Mycobacterium
GFYRQLYRDNARFGAKLWVL

SEQ ID NO: 816234 - protein, 24 aa, Mycobacterium
GFYSFLNVFKLFGPGNQAPLSFPI

SEQ ID NO: 816235 - protein, 25 aa, Mycobacterium
GFYSQFAPGIPEWNLRGTISTGDDG

SEQ ID NO: 816236 - protein, 26 aa, Mycobacterium
GFYTSGQLFLEAYYTQGAIAHGAIGT

SEQ ID NO: 816237 - protein, 24 aa, Mycobacterium
GFYVDLDNIRLVHPLIVSVETLSR

SEQ ID NO: 816238 - protein, 17 aa, Mycobacterium
GFYYEKFGLATTRPTAS

SEQ ID NO: 816239 - protein, 20 aa, Mycobacterium
GGAAAARRAAPAPGAAAAGS

SEQ ID NO: 816240 - protein, 18 aa, Mycobacterium
GGAAAMAGGFIYLGGGTA

SEQ ID NO: 816241 - protein, 18 aa, Mycobacterium
GGAAAMAGGFIYLGGGTP

SEQ ID NO: 816242 - protein, 23 aa, Mycobacterium
GGAADFFESGAPWRDGSTPVNVS

SEQ ID NO: 816243 - protein, 18 aa, Mycobacterium
GGAAFSKHLPIERAFRDA

SEQ ID NO: 816244 - protein, 21 aa, Mycobacterium
GGAAGLFFGAGGAGGHGGSAI

SEQ ID NO: 816245 - protein, 18 aa, Mycobacterium
GGAAGLFGAGGRGGDGGV

SEQ ID NO: 816246 - protein, 19 aa, Mycobacterium
GGAAGLWGTGGTGGAGARS

SEQ ID NO: 816247 - protein, 18 aa, Mycobacterium
GGAAGLWGTGGTGGAGGR

SEQ ID NO: 816248 - protein, 19 aa, Mycobacterium
GGAAGMWGTGGSGGAGAAG

SEQ ID NO: 816249 - protein, 30 aa, Mycobacterium
GGAAGNVPAGFMAPSLNGIGGDGGDAFLIG

SEQ ID NO: 816250 - protein, 25 aa, Mycobacterium
GGAAGPALFGIGVDGTAGVGGAGGN

SEQ ID NO: 816251 - protein, 25 aa, Mycobacterium
GGAAGPPMVLPAAAPMPTAESAPVP

SEQ ID NO: 816252 - protein, 18 aa, Mycobacterium
GGAAGVALAGSGHDGAQG

SEQ ID NO: 816253 - protein, 23 aa, Mycobacterium
GGAAIPPMFDLRSPVLRRAEAIT

SEQ ID NO: 816254 - protein, 30 aa, Mycobacterium
GGAALLWSHPGAPAFWYQPSRNGAPPVTGL

SEQ ID NO: 816255 - protein, 25 aa, Mycobacterium
GGAAVTPGLGIGDEPAGGTGGTGGH

SEQ ID NO: 816256 - protein, 22 aa, Mycobacterium
GGAAYTSNILMNATGGNGGQGG

SEQ ID NO: 816257 - protein, 25 aa, Mycobacterium
GGADHDFGFFWITAVTVDGQIAVAN

SEQ ID NO: 816258 - protein, 20 aa, Mycobacterium
GGADIIIIETIFDSLNAKAA

SEQ ID NO: 816259 - protein, 26 aa, Mycobacterium
GGADRLVQLVRRPGAGVDDLPPEVCL

SEQ ID NO: 816260 - protein, 31 aa, Mycobacterium; identical to SEQ ID NO: 218374

SEQ ID NO: 816261 - protein, 25 aa, Mycobacterium
GGAERLAELVGKSRALLLAGTGTAL

SEQ ID NO: 816262 - protein, 26 aa, Mycobacterium
GGAERLVELVGYSRALLLAGTGRILA

SEQ ID NO: 816263 - protein, 23 aa, Mycobacterium
GGAEYVYRFAPLVGIYGGTLEVF

SEQ ID NO: 816264 - protein, 18 aa, Mycobacterium
GGAFHRTVPITLEHVQAV

SEQ ID NO: 816265 - protein, 30 aa, Mycobacterium
GGAFLNVLSAAIWIPVPTAYAASKAAAWSA

SEQ ID NO: 816266 - protein, 26 aa, Mycobacterium
GGAFTRVFRPWTHPAAPETAGLGTDL

SEQ ID NO: 816267 - protein, 22 aa, Mycobacterium
GGAGAWLIGSAGDGGAGGAGNI

SEQ ID NO: 816268 - protein, 20 aa, Mycobacterium
GGAGFLFGTGGTGGAGGAGI

SEQ ID NO: 816269 - protein, 25 aa, Mycobacterium
GGAGFSYPYLIGGGPSIGFGSGMST

SEQ ID NO: 816270 - protein, 25 aa, Mycobacterium
GGAGGAAGLFGRGGAGGAGGAGTAA

SEQ ID NO: 816271 - protein, 26 aa, Mycobacterium
GGAGGAAGLLFGPGGSGGAGGATFSG

SEQ ID NO: 816272 - protein, 24 aa, Mycobacterium
GGAGGAAGLWGSGGTGGAGGAGAA

SEQ ID NO: 816273 - protein, 25 aa, Mycobacterium
GGAGGAAGWLYGAGGSGGAGGAGTA

SEQ ID NO: 816274 - protein, 24 aa, Mycobacterium
GGAGGAARWFGDGGTGGTGSQAGT

SEQ ID NO: 816275 - protein, 23 aa, Mycobacterium
GGAGGAAWLVGAGGAGGVGGFGD

SEQ ID NO: 816276 - protein, 25 aa, Mycobacterium
GGAGGAGGLLWGQGGIGGTGGSGID

SEQ ID NO: 816277 - protein, 24 aa, Mycobacterium
GGAGGAGGLWGGGGIGGTGGFGAL

SEQ ID NO: 816278 - protein, 26 aa, Mycobacterium
GGAGGAGGWLFGPGGVGGAGGSSSSA

SEQ ID NO: 816279 - protein, 22 aa, Mycobacterium
GGAGGAGGWLLGDGGGGGGGGS

SEQ ID NO: 816280 - protein, 25 aa, Mycobacterium
GGAGGAGGWLLGTGGAGGAGGYTTS

SEQ ID NO: 816281 - protein, 22 aa, Mycobacterium
GGAGGALAGFLGAGGGDGGAGG

SEQ ID NO: 816282 - protein, 25 aa, Mycobacterium
GGAGGASLLFGNGGAGGLGGGGATA

SEQ ID NO: 816283 - protein, 24 aa, Mycobacterium
GGAGGFPLIVRMLRTAFGEKRVKR

SEQ ID NO: 816284 - protein, 25 aa, Mycobacterium
GGAGGGGLWFGNGGAGGIGGFDAHG

SEQ ID NO: 816285 - protein, 26 aa, Mycobacterium
GGAGGGGPVLFGHGGAGGLGGQGGTG

SEQ ID NO: 816286 - protein, 21 aa, Mycobacterium
GGAGGLFGNGGIGGTGGLASV

SEQ ID NO: 816287 - protein, 24 aa, Mycobacterium
GGAGGLGGMLFGTGGSGGAGGVAQ

SEQ ID NO: 816288 - protein, 19 aa, Mycobacterium
GGAGGLLAGMVGAGGGAGG

SEQ ID NO: 816289 - protein, 24 aa, Mycobacterium
GGAGGLLGAAGLGGAGGAGVNGDG

SEQ ID NO: 816290 - protein, 21 aa, Mycobacterium
GGAGGLLGGGGLGGAGGASTS

SEQ ID NO: 816291 - protein, 20 aa, Mycobacterium
GGAGGLLRGMGGAGGTGGTG

SEQ ID NO: 816292 - protein, 19 aa, Mycobacterium
GGAGGLLYGNGGRGGDSTL

SEQ ID NO: 816293 - protein, 26 aa, Mycobacterium
GGAGGNAGVLFGPGGIGGSGGQGMAS

SEQ ID NO: 816294 - protein, 26 aa, Mycobacterium
GGAGGNAPLLGWGGNGGVGGNAPQGT

SEQ ID NO: 816295 - protein, 28 aa, Mycobacterium
GGAGGNGFLGAPAFSSNPGGNGGNGGAG

SEQ ID NO: 816296 - protein, 26 aa, Mycobacterium
GGAGGNGGWLFGQGGAGGIGGSGAAG

SEQ ID NO: 816297 - protein, 30 aa, Mycobacterium
GGAGGNGSSITALWGIYGGGAGGEGGSATG

SEQ ID NO: 816298 - protein, 25 aa, Mycobacterium
GGAGGPGLFGFNGGAGGAGGAGGLL

SEQ ID NO: 816299 - protein, 25 aa, Mycobacterium
GGAGGRGGLLFGVGGAGGAGGDGLD

SEQ ID NO: 816300 - protein, 25 aa, Mycobacterium
GGAGGRGGWLIGNGGAGGAGGAGGA

SEQ ID NO: 816301 - protein, 23 aa, Mycobacterium
GGAGGSAFLFGSGGHGGSGGTAY

SEQ ID NO: 816302 - protein, 26 aa, Mycobacterium
GGAGGSAGLWGAGGAGGAGGAGATPG

SEQ ID NO: 816303 - protein, 26 aa, Mycobacterium
GGAGGSAPLLGWGGNGGAGGDSTQGA

SEQ ID NO: 816304 - protein, 21 aa, Mycobacterium
GGAGGWLLGNGGAGGAGGASA

SEQ ID NO: 816305 - protein, 17 aa, Mycobacterium
GGAGIPGFYTRTAYGTN

SEQ ID NO: 816306 - protein, 24 aa, Mycobacterium
GGAGPLVGVWQKAPLQALARLHML

SEQ ID NO: 816307 - protein, 28 aa, Mycobacterium
GGAGPVTIPVFHLSPTPGFGNSGGAPSS

SEQ ID NO: 816308 - protein, 25 aa, Mycobacterium
GGAGQAGGWLFGDGGPGAAATATSA

SEQ ID NO: 816309 - protein, 25 aa, Mycobacterium
GGAGRGLFYGLGGAGGMGGSATAVT

SEQ ID NO: 816310 - protein, 36 aa, Mycobacterium
GGAGRRELLQRLLPLVLPIVLAYLGNQLRPGGALQG

SEQ ID NO: 816311 - protein, 25 aa, Mycobacterium
GGAGVFVLDVWLRPVPPGTVGELYV

SEQ ID NO: 816312 - protein, 23 aa, Mycobacterium
GGAGVVLVTDRWLRAHPGVTPQA

SEQ ID NO: 816313 - protein, 25 aa, Mycobacterium
GGAHIVMIGILPTLMPEHLATGWMS

SEQ ID NO: 816314 - protein, 30 aa, Mycobacterium
GGAIIRQPVPPFKWWRGLRARQLLEDYFNE

SEQ ID NO: 816315 - protein, 30 aa, Mycobacterium
GGAIIRQPVPPFKWWRGLRARTLLEEYFAD

SEQ ID NO: 816316 - protein, 33 aa, Mycobacterium
GGAITTYMIPAPTLPMLLPLKDIGVPQPIVDTL

SEQ ID NO: 816317 - protein, 26 aa, Mycobacterium
GGAKEQLGILARFAGAALVAKEDTVP

SEQ ID NO: 816318 - protein, 21 aa, Mycobacterium
GGAKLRPLFSQLAEHGLALEN

SEQ ID NO: 816319 - protein, 19 aa, Mycobacterium
GGAKPWFAIGGIDEARLPE

SEQ ID NO: 816320 - protein, 25 aa, Mycobacterium
GGALAITVPRWLPERICWALSDEYH

SEQ ID NO: 816321 - protein, 25 aa, Mycobacterium
GGALGLLFDTVLGLTASVLTGSTRQ

SEQ ID NO: 816322 - protein, 28 aa, Mycobacterium
GGALLYAQVWIAQVGRIPLLLLDSDIPE

SEQ ID NO: 816323 - protein, 22 aa, Mycobacterium
GGALRRYLLDKGELPESSLVTV

SEQ ID NO: 816324 - protein, 29 aa, Mycobacterium
GGALTFTHLFSEPLIAVMPAHHPLTKKSS

SEQ ID NO: 816325 - protein, 22 aa, Mycobacterium
GGALTRRFWHDEYLLNSYIGRY

SEQ ID NO: 816326 - protein, 31 aa, Mycobacterium
GGALVLVAPHDPIPLLRQLDHRISGRLEIRY

SEQ ID NO: 816327 - protein, 22 aa, Mycobacterium
GGAPLGWIDAEGARRHRDGAPL

SEQ ID NO: 816328 - protein, 25 aa, Mycobacterium
GGARALEWAVMHPDAVRAALVLAVG

SEQ ID NO: 816329 - protein, 25 aa, Mycobacterium
GGARALEWAVTYPDSVRSALVLAVG

SEQ ID NO: 816330 - protein, 25 aa, Mycobacterium
GGARALEWLVTHPDDVRAGLVLAVG

SEQ ID NO: 816331 - protein, 27 aa, Mycobacterium
GGARHRDRYRWASWSGRLGIDGTAVEQ

SEQ ID NO: 816332 - protein, 25 aa, Mycobacterium
GGARPIGISKALWEVLDRARAHLEA

SEQ ID NO: 816333 - protein, 24 aa, Mycobacterium
GGARRPMLIAPDSAASYIGSVERE

SEQ ID NO: 816334 - protein, 27 aa, Mycobacterium
GGASVYPLIWNILLAARSEGYGGTITT

SEQ ID NO: 816335 - protein, 19 aa, Mycobacterium
GGASWPLYPLKAHHTYVNI

SEQ ID NO: 816336 - protein, 23 aa, Mycobacterium
GGASYLMRTFRPASYTGLDLNSD

SEQ ID NO: 816337 - protein, 17 aa, Mycobacterium
GGATIRQLWGLGESMIP

SEQ ID NO: 816338 - protein, 23 aa, Mycobacterium
GGATLLALLQTPDALASPSWVDS

SEQ ID NO: 816339 - protein, 24 aa, Mycobacterium
GGATMLRMLLRPDEKLDDTWVDQT

SEQ ID NO: 816340 - protein, 23 aa, Mycobacterium
GGATVIFQWTYSQAKPRDVIWNQ

SEQ ID NO: 816341 - protein, 23 aa, Mycobacterium
GGATVIFQWTYSQVKPRDVIWNQ

SEQ ID NO: 816342 - protein, 24 aa, Mycobacterium
GGATVLLRTLPLMVDGASAGAAVL

SEQ ID NO: 816343 - protein, 19 aa, Mycobacterium
GGAVIGAFLGSRRDTPVWV

SEQ ID NO: 816344 - protein, 23 aa, Mycobacterium
GGAWFPTPQFANLGLGNLGGGAG

SEQ ID NO: 816345 - protein, 23 aa, Mycobacterium
GGAWFPTPQFAQLGLGNLGNIGG

SEQ ID NO: 816346 - protein, 17 aa, Mycobacterium
GGAWLAVAVADDSQWRG

SEQ ID NO: 816347 - protein, 24 aa, Mycobacterium
GGAWLREGPLIRFARARGFRVVVT

SEQ ID NO: 816348 - protein, 23 aa, Mycobacterium
GGAWRILDLPAPLRLRDEVTWVD

SEQ ID NO: 816349 - protein, 19 aa, Mycobacterium
GGAYRLIDFVLSNLVNARF

SEQ ID NO: 816350 - protein, 26 aa, Mycobacterium
GGCAGLRYNLFFDDRTLDGDLTVDFS

SEQ ID NO: 816351 - protein, 26 aa, Mycobacterium
GGCAGLRYQLFFDDRTLDGDLTVDFD

SEQ ID NO: 816352 - protein, 27 aa, Mycobacterium
GGCDPLVVPAVLIPPTSSSAALGDQDL

SEQ ID NO: 816353 - protein, 20 aa, Mycobacterium
GGCEVAMMCDLIIAADTAKF

SEQ ID NO: 816354 - protein, 25 aa, Mycobacterium
GGCKSWVELPLRAPLGPPVHDPGSL

SEQ ID NO: 816355 - protein, 32 aa, Mycobacterium
GGCLGLLFDTIFGTGSLLLTDLRKLRTAYLNI

SEQ ID NO: 816356 - protein, 20 aa, Mycobacterium
GGCPLLLMLVSSAISGELIS

SEQ ID NO: 816357 - protein, 19 aa, Mycobacterium
GGCYLLPRRIGMQKAKEMA

SEQ ID NO: 816358 - protein, 22 aa, Mycobacterium
GGDAFLYGFGGAGGPGGAGGPG

SEQ ID NO: 816359 - protein, 26 aa, Mycobacterium
GGDAGGMFGVRGLFGTGGAGGTGGFG

SEQ ID NO: 816360 - protein, 22 aa, Mycobacterium
GGDAGLFGVGGIGGTGGTGFSG

SEQ ID NO: 816361 - protein, 20 aa, Mycobacterium
GGDAGLLFGSGGAGGTGGTG

SEQ ID NO: 816362 - protein, 23 aa, Mycobacterium
GGDAGPGALGGFGGDAQLWGNGG

SEQ ID NO: 816363 - protein, 17 aa, Mycobacterium
GGDALTLAYTRSRFTIA

SEQ ID NO: 816364 - protein, 27 aa, Mycobacterium
GGDAQAWYRILLYGPMHNPVIDVGVDN

SEQ ID NO: 816365 - protein, 24 aa, Mycobacterium
GGDARFLSVLSIRQLATEPSLSGP

SEQ ID NO: 816366 - protein, 18 aa, Mycobacterium
GGDDTLFALAPGAVEFGA

SEQ ID NO: 816367 - protein, 25 aa, Mycobacterium
GGDDWPHLFLPFREGAAQESGLPAD

SEQ ID NO: 816368 - protein, 24 aa, Mycobacterium
GGDEDFWLEVGIDPIQMITNSGTF

SEQ ID NO: 816369 - protein, 22 aa, Mycobacterium
GGDEWLIARWGCLRAANLYWGC

SEQ ID NO: 816370 - protein, 27 aa, Mycobacterium
GGDEWWIDVTLPMLESVRRKLRGLLRF

SEQ ID NO: 816371 - protein, 24 aa, Mycobacterium
GGDFAAWRTFLHPEQRKYVESDFS

SEQ ID NO: 816372 - protein, 27 aa, Mycobacterium
GGDFTLPAPRPRRILFVSGGSGITPVM

SEQ ID NO: 816373 - protein, 27 aa, Mycobacterium
GGDGGAGGFIIGTYGGNGGGAAGAGGG

SEQ ID NO: 816374 - protein, 27 aa, Mycobacterium
GGDGGAGGGLLFGLGGSGGAGGVATDA

SEQ ID NO: 816375 - protein, 31 aa, Mycobacterium; identical to SEQ ID NO: 665677

SEQ ID NO: 816376 - protein, 23 aa, Mycobacterium
GGDGGFFFGNGGKGGAAGSIPAG

SEQ ID NO: 816377 - protein, 20 aa, Mycobacterium
GGDGGFGGLIGSGGAGGVAG

SEQ ID NO: 816378 - protein, 24 aa, Mycobacterium
GGDGGLGGLVYGNGGGGGAGGVGG

SEQ ID NO: 816379 - protein, 19 aa, Mycobacterium
GGDGGLLWGNGGAGGTGTA

SEQ ID NO: 816380 - protein, 20 aa, Mycobacterium
GGDGGLLWGNGGNGGSGATG

SEQ ID NO: 816381 - protein, 24 aa, Mycobacterium
GGDGGNAVGLFGNGGPGGTGGVSG

SEQ ID NO: 816382 - protein, 26 aa, Mycobacterium
GGDGGRGGWLLGIGGSGGFGGFGQGP

SEQ ID NO: 816383 - protein, 23 aa, Mycobacterium
GGDGGVAGLIGTGGNGGAGGIGA

SEQ ID NO: 816384 - protein, 25 aa, Mycobacterium
GGDGIDGPADRPGGRGGQGGHGGDG

SEQ ID NO: 816385 - protein, 24 aa, Mycobacterium
GGDGLHTALGRQGNGGAGGHGGSG

SEQ ID NO: 816386 - protein, 17 aa, Mycobacterium
GGDGRCTLVPYAKRTPK

SEQ ID NO: 816387 - protein, 25 aa, Mycobacterium
GGDGRPVVLIHGWPLHSDSWAHQVD

SEQ ID NO: 816388 - protein, 25 aa, Mycobacterium
GGDGTWVIRFFMPAKWTLDTLPTPD

SEQ ID NO: 816389 - protein, 29 aa, Mycobacterium
GGDGYGRFWVYRGGARMMVRANRYALAAS

SEQ ID NO: 816390 - protein, 25 aa, Mycobacterium
GGDHTIALPLLRAAAAKHGPVALVH

SEQ ID NO: 816391 - protein, 17 aa, Mycobacterium
GGDIRLSRAGQPVFHHL

SEQ ID NO: 816392 - protein, 19 aa, Mycobacterium
GGDKPLEFLPAAAELNPYL

SEQ ID NO: 816393 - protein, 18 aa, Mycobacterium
GGDLRDLVLLTEAVMEAG

SEQ ID NO: 816394 - protein, 23 aa, Mycobacterium
GGDPAYIQPWTGTHADIINNVHN

SEQ ID NO: 816395 - protein, 25 aa, Mycobacterium
GGDPDTFPGLAGLGDLIVTCTSQRS

SEQ ID NO: 816396 - protein, 19 aa, Mycobacterium
GGDPFGPTGLALPPHVLAA

SEQ ID NO: 816397 - protein, 19 aa, Mycobacterium
GGDPGSFGVGGTGGVAGGQ

SEQ ID NO: 816398 - protein, 17 aa, Mycobacterium
GGDPLHALRATCELLAT

SEQ ID NO: 816399 - protein, 28 aa, Mycobacterium
GGDQDFRTFDFLGIRNWTAGKPIIVVMP

SEQ ID NO: 816400 - protein, 25 aa, Mycobacterium
GGDRRRLFLLRNSPWPSGKKTTEEI

SEQ ID NO: 816401 - protein, 23 aa, Mycobacterium
GGDSGFGWSGQVGSAGSGPNGVI

SEQ ID NO: 816402 - protein, 25 aa, Mycobacterium
GGDSGLLSGLFGTGGGHGGLGGAGV

SEQ ID NO: 816403 - protein, 24 aa, Mycobacterium
GGDVTIRSYAYLRISTTGAHSSYA

SEQ ID NO: 816404 - protein, 19 aa, Mycobacterium
GGDWYDAFELRDGRLIVLI

SEQ ID NO: 816405 - protein, 18 aa, Mycobacterium
GGDWYDAFELRDGRLIVV

SEQ ID NO: 816406 - protein, 31 aa, Mycobacterium
GGDYDHLLVGSSLPWLLPRTLHDLESWDEHL

SEQ ID NO: 816407 - protein, 21 aa, Mycobacterium
GGDYLNWESRSWRLSATGDYQ

SEQ ID NO: 816408 - protein, 21 aa, Mycobacterium
GGEAAMIWRLRPELGGMVERM

SEQ ID NO: 816409 - protein, 27 aa, Mycobacterium
GGECLHNLGYWDGGEWWGAGPGAHGFL

SEQ ID NO: 816410 - protein, 23 aa, Mycobacterium
GGEDFSWYLEEIPGAMARLGVWP

SEQ ID NO: 816411 - protein, 24 aa, Mycobacterium
GGEDFSWYLEEIPGAMARLGVWSG

SEQ ID NO: 816412 - protein, 24 aa, Mycobacterium
GGEEGILLAVRRALDAGTLRIGEA

SEQ ID NO: 816413 - protein, 22 aa, Mycobacterium
GGEESLYLRPFIIATEAGLGVR

SEQ ID NO: 816414 - protein, 23 aa, Mycobacterium
GGEGSGRLFGLGGAGGAGGTGIT

SEQ ID NO: 816415 - protein, 27 aa, Mycobacterium
GGEGTLVGVWRRAPLQAIARLHSLAAA

SEQ ID NO: 816416 - protein, 23 aa, Mycobacterium
GGEGVLRFFQYVAARTNIALGMF

SEQ ID NO: 816417 - protein, 24 aa, Mycobacterium
GGEHRIEYRFTRTGLLFAGEDQVR

SEQ ID NO: 816418 - protein, 23 aa, Mycobacterium
GGELEFIIRLLPDGAMSNYLRDH

SEQ ID NO: 816419 - protein, 18 aa, Mycobacterium
GGELFIVGRIKDVVIIRG

SEQ ID NO: 816420 - protein, 25 aa, Mycobacterium
GGELKVRFFASARSQGRKLAFRGQE

SEQ ID NO: 816421 - protein, 21 aa, Mycobacterium
GGELRYIVFNLKTMPGVTDAQ

SEQ ID NO: 816422 - protein, 23 aa, Mycobacterium
GGELSRVMLALEVVLAASVEGTT

SEQ ID NO: 816423 - protein, 20 aa, Mycobacterium
GGEMIVLAKFDPGEVLRVIE

SEQ ID NO: 816424 - protein, 21 aa, Mycobacterium
GGEMIVLPKFDPGEVLRVIEE

SEQ ID NO: 816425 - protein, 18 aa, Mycobacterium
GGEPARLARLERRIADFL

SEQ ID NO: 816426 - protein, 18 aa, Mycobacterium
GGEPLLRRGLESTVAQVA

SEQ ID NO: 816427 - protein, 17 aa, Mycobacterium
GGEPTLLPREYFERVFA

SEQ ID NO: 816428 - protein, 21 aa, Mycobacterium
GGEQLYRLYITGDTMLVEDLH

SEQ ID NO: 816429 - protein, 33 aa, Mycobacterium
GGERRMLRLIRRYGPIMTMPILSLGDVAIVSDP

SEQ ID NO: 816430 - protein, 28 aa, Mycobacterium
GGERRRLQFLRLLLDEPNVLLLDEPTND

SEQ ID NO: 816431 - protein, 25 aa, Mycobacterium
GGERRRLQLMLTLLSEPNVLLLDEP

SEQ ID NO: 816432 - protein, 23 aa, Mycobacterium
GGETFLASLSLALGLVELAARSG

SEQ ID NO: 816433 - protein, 24 aa, Mycobacterium
GGETIWVDGPLTRAVRTGAICYLD

SEQ ID NO: 816434 - protein, 33 aa, Mycobacterium
GGETLDRSFRLLRRGGRLVTLSAPPPAGRADEY

SEQ ID NO: 816435 - protein, 23 aa, Mycobacterium
GGEVGLRKWLLDNAIDAVVDATH

SEQ ID NO: 816436 - protein, 28 aa, Mycobacterium
GGEVIRLGLARLLLRRPDVLLLDEPTNN

SEQ ID NO: 816437 - protein, 39 aa, Mycobacterium
GGEVLLMDYLVHQRRLFPLIARSYALQYAQNELVARCHE

SEQ ID NO: 816438 - protein, 23 aa, Mycobacterium
GGEVLRHWAAARTALDAWRAAER

SEQ ID NO: 816439 - protein, 24 aa, Mycobacterium
GGEVSIVEHPFAVGLLTAAHMHTR

SEQ ID NO: 816440 - protein, 21 aa, Mycobacterium
GGEVWRLSPAALGTFLAQLPE

SEQ ID NO: 816441 - protein, 20 aa, Mycobacterium
GGEYFLRHLLGTDSNASALP

SEQ ID NO: 816442 - protein, 20 aa, Mycobacterium
GGFAHRTLFEGLDLTVARGD

SEQ ID NO: 816443 - protein, 18 aa, Mycobacterium
GGFALWVDEQRRLHHTYS

SEQ ID NO: 816444 - protein, 17 aa, Mycobacterium
GGFAPDLPGTKAALDLI

SEQ ID NO: 816445 - protein, 18 aa, Mycobacterium
GGFARRHGVPLVERPHFT

SEQ ID NO: 816446 - protein, 45 aa, Mycobacterium
GGFARYSVDPYWVVPHFEKMLYDNALLLRVYAHLARRTGSVLARR

SEQ ID NO: 816447 - protein, 17 aa, Mycobacterium
GGFAWQVALRMSGALAK

SEQ ID NO: 816448 - protein, 24 aa, Mycobacterium
GGFDALFLADILGVYDIYGGSRDA

SEQ ID NO: 816449 - protein, 26 aa, Mycobacterium
GGFDCSGLVMWAFQQAGISLPHSSQA

SEQ ID NO: 816450 - protein, 27 aa, Mycobacterium
GGFDCSGLVMWAFQQAGISLPHSSQAM

SEQ ID NO: 816451 - protein, 17 aa, Mycobacterium
GGFFPSSREYSVRYGLS

SEQ ID NO: 816452 - protein, 17 aa, Mycobacterium
GGFFRPGYNGCGVVAMF

SEQ ID NO: 816453 - protein, 23 aa, Mycobacterium
GGFFSFGIMHYYLTGMHTPGRTG

SEQ ID NO: 816454 - protein, 23 aa, Mycobacterium
GGFFSFGIMHYYLTGMHTPGRTK

SEQ ID NO: 816455 - protein, 17 aa, Mycobacterium
GGFGLLPAGYRTITQLE

SEQ ID NO: 816456 - protein, 20 aa, Mycobacterium
GGFGLVGACDIVVAGPACTF

SEQ ID NO: 816457 - protein, 17 aa, Mycobacterium
GGFGRRFGDNGFGGGGF

SEQ ID NO: 816458 - protein, 39 aa, Mycobacterium
GGFGTRFLAQPTWRHGVMKLIFMEVPLRAVPGLRIRADA

SEQ ID NO: 816459 - protein, 18 aa, Mycobacterium
GGFGWQIALRLPGTSGRA

SEQ ID NO: 816460 - protein, 24 aa, Mycobacterium
GGFGYDPVFIPDGYQRTAAQLSPE

SEQ ID NO: 816461 - protein, 20 aa, Mycobacterium
GGFIGKWLKKMLSSARKTGS

SEQ ID NO: 816462 - protein, 27 aa, Mycobacterium
GGFIGRFKRQTPVPLGYRDHALDAPWS

SEQ ID NO: 816463 - protein, 17 aa, Mycobacterium
GGFIVGRTAVIARFAYP

SEQ ID NO: 816464 - protein, 17 aa, Mycobacterium
GGFPPNLGPIWRLERDG

SEQ ID NO: 816465 - protein, 24 aa, Mycobacterium
GGFRFSMFTIPPRGSAATADLENL

SEQ ID NO: 816466 - protein, 18 aa, Mycobacterium
GGFRQVIDPLAHELALDF

SEQ ID NO: 816467 - protein, 20 aa, Mycobacterium
GGFRTPYVWQALIRDQGTPR

SEQ ID NO: 816468 - protein, 27 aa, Mycobacterium
GGFRYSDINFILLGALIEKVTGEALDA

SEQ ID NO: 816469 - protein, 17 aa, Mycobacterium
GGFTLAERKRLAALAFQ

SEQ ID NO: 816470 - protein, 17 aa, Mycobacterium
GGFTLIALSIFGSLAWK

SEQ ID NO: 816471 - protein, 20 aa, Mycobacterium
GGFTLLFLAAFDVGDTVVMT

SEQ ID NO: 816472 - protein, 24 aa, Mycobacterium
GGFVELITAWHAGLLDVIQGEIVE

SEQ ID NO: 816473 - protein, 20 aa, Mycobacterium
GGFVGSFDRPSPRLLGYRDH

SEQ ID NO: 816474 - protein, 17 aa, Mycobacterium
GGFVLDVRYAPTRLREL

SEQ ID NO: 816475 - protein, 20 aa, Mycobacterium
GGGAALPYKRRLFGQIVAAA

SEQ ID NO: 816476 - protein, 25 aa, Mycobacterium
GGGAGGLLYGDGGLGGAGGAGGEAL

SEQ ID NO: 816477 - protein, 29 aa, Mycobacterium
GGGANTGINGIALAPAGPGGTGGGGGSGG

SEQ ID NO: 816478 - protein, 25 aa, Mycobacterium
GGGARDDFLRLLPASLLASADMAHA

SEQ ID NO: 816479 - protein, 23 aa, Mycobacterium
GGGAYFFRQLIGDIPDEAAIKAA

SEQ ID NO: 816480 - protein, 46 aa, Mycobacterium
GGGAYLPTTVYLPSTVRLAVSDPALPLGWADVWMGCQFPSKIVADY

SEQ ID NO: 816481 - protein, 18 aa, Mycobacterium
GGGCELALACDIVIAGES

SEQ ID NO: 816482 - protein, 23 aa, Mycobacterium
GGGDLCDWWSGGTASLFGDPRAL

SEQ ID NO: 816483 - protein, 25 aa, Mycobacterium
GGGEDFSWYLEEIPGAMGRLGVWSG

SEQ ID NO: 816484 - protein, 25 aa, Mycobacterium
GGGFLLYLQLHESTDIRVVLRDYSE

SEQ ID NO: 816485 - protein, 19 aa, Mycobacterium
GGGFLLYLQMHATPTDLRA

SEQ ID NO: 816486 - protein, 25 aa, Mycobacterium
GGGGGIAHRLGMKPNWVIDLHNGGC

SEQ ID NO: 816487 - protein, 32 aa, Mycobacterium
GGGGGLTLAVDFLGFGLFHGGAGGDGGAATGA

SEQ ID NO: 816488 - protein, 20 aa, Mycobacterium
GGGGHSLVGPGGDGGLGGTG

SEQ ID NO: 816489 - protein, 23 aa, Mycobacterium
GGGGLLLPLGVRSLRIYGPTRNA

SEQ ID NO: 816490 - protein, 22 aa, Mycobacterium
GGGGPIHLLPDDEWDRVVDVNL

SEQ ID NO: 816491 - protein, 32 aa, Mycobacterium
GGGGQLVVVWQKAPLQALARLHTLAAAGLVDD

SEQ ID NO: 816492 - protein, 24 aa, Mycobacterium
GGGGVWFPCNPVLVRAAPPGSFDD

SEQ ID NO: 816493 - protein, 18 aa, Mycobacterium
GGGGWILGHLIDGTQAEY

SEQ ID NO: 816494 - protein, 29 aa, Mycobacterium
GGGHGGAGGAAGWFGHAGVGGDGGTGGAG

SEQ ID NO: 816495 - protein, 21 aa, Mycobacterium
GGGHLTRQLLYVALTRGRVEN

SEQ ID NO: 816496 - protein, 25 aa, Mycobacterium
GGGIPLIAHFTLLGDTKATTIDIPG

SEQ ID NO: 816497 - protein, 21 aa, Mycobacterium
GGGKALLLKAGVFDDVAAAVM

SEQ ID NO: 816498 - protein, 24 aa, Mycobacterium
GGGLASCHPGMRGMFLMVEAVRQL

SEQ ID NO: 816499 - protein, 27 aa, Mycobacterium
GGGLFSSIPFLNQYWHPYRLGGNASGT

SEQ ID NO: 816500 - protein, 18 aa, Mycobacterium
GGGLGISYLAADDPPPMG

SEQ ID NO: 816501 - protein, 26 aa, Mycobacterium
GGGLLLATGRLPRLASAALALTVVPG

SEQ ID NO: 816502 - protein, 25 aa, Mycobacterium
GGGLPAATLLSRALLWQGHPAQADN

SEQ ID NO: 816503 - protein, 19 aa, Mycobacterium
GGGLPFKIRDIPVSPDITG

SEQ ID NO: 816504 - protein, 23 aa, Mycobacterium
GGGLVLLKPLHAALADGNRIRAV

SEQ ID NO: 816505 - protein, 25 aa, Mycobacterium
GGGLWVSRGIYRLPGRDLLEYRYHV

SEQ ID NO: 816506 - protein, 27 aa, Mycobacterium
GGGNGALWHGLLDPLPPGTFTLIDPNP

SEQ ID NO: 816507 - protein, 25 aa, Mycobacterium
GGGNGGRAFLLGDGGTGGDALSAGT

SEQ ID NO: 816508 - protein, 37 aa, Mycobacterium
GGGNIDIRLLGEGATFFLPVFAEGALFYVGDPHMAMG

SEQ ID NO: 816509 - protein, 18 aa, Mycobacterium
GGGPAPRPVLDAAAAAGI

SEQ ID NO: 816510 - protein, 17 aa, Mycobacterium
GGGPLLGPSDFSPLRRL

SEQ ID NO: 816511 - protein, 20 aa, Mycobacterium
GGGPQLRLYDTADRQVRPVT

SEQ ID NO: 816512 - protein, 18 aa, Mycobacterium
GGGPYRTSLHRLAHDFGV

SEQ ID NO: 816513 - protein, 18 aa, Mycobacterium
GGGQNRFSWKKTGQILAN

SEQ ID NO: 816514 - protein, 26 aa, Mycobacterium
GGGRGLGRAYALMLASRGAKVVVNDV

SEQ ID NO: 816515 - protein, 20 aa, Mycobacterium
GGGRLTYRQLWDRAARVAGG

SEQ ID NO: 816516 - protein, 26 aa, Mycobacterium
GGGRPRVRLAYRLTPNRVLGEQRATG

SEQ ID NO: 816517 - protein, 22 aa, Mycobacterium
GGGSIPGGPTITGGPGGGSGSI

SEQ ID NO: 816518 - protein, 26 aa, Mycobacterium
GGGSLLPIPELIRLAADAHHYLYVYD

SEQ ID NO: 816519 - protein, 34 aa, Mycobacterium; identical to SEQ ID NO: 114723

SEQ ID NO: 816520 - protein, 32 aa, Mycobacterium
GGGSLWLDPQLTSPYAWYQYFVNTSDADVIRY

SEQ ID NO: 816521 - protein, 23 aa, Mycobacterium
GGGSSINLMVWARGHRGDWDHFA

SEQ ID NO: 816522 - protein, 21 aa, Mycobacterium
GGGTGGWLYGDGGAGGAGGSG

SEQ ID NO: 816523 - protein, 29 aa, Mycobacterium
GGGTGTGTPPPFGTGAPGGSGGTGGHGGD

SEQ ID NO: 816524 - protein, 25 aa, Mycobacterium
GGGTPFFPTLPSWISLRLLENRTFP

SEQ ID NO: 816525 - protein, 23 aa, Mycobacterium
GGGTPGRMSGFFNTASGGTGQSG

SEQ ID NO: 816526 - protein, 23 aa, Mycobacterium
GGGTWRVTLRLPENLRTTVEAAA

SEQ ID NO: 816527 - protein, 25 aa, Mycobacterium
GGGVREDLLRLLPASLLASADMAHA

SEQ ID NO: 816528 - protein, 25 aa, Mycobacterium
GGGVVPWIHRHVLRFDLGPPSSPDH

SEQ ID NO: 816529 - protein, 33 aa, Mycobacterium
GGGWRMYTRAKYAPYVERLLLDGARTKLTRAAL

SEQ ID NO: 816530 - protein, 18 aa, Mycobacterium
GGGYFFRQFGSDATRAAL

SEQ ID NO: 816531 - protein, 17 aa, Mycobacterium
GGGYPVHKPVTAGWNGY

SEQ ID NO: 816532 - protein, 26 aa, Mycobacterium
GGGYWSFPHGHLCLWTWAANPQDRPL

SEQ ID NO: 816533 - protein, 24 aa, Mycobacterium
GGHAVVLHPGPMLRGMEIASSVAD

SEQ ID NO: 816534 - protein, 28 aa, Mycobacterium
GGHAVVMTYWNPVLRYGIDAFARDLASA

SEQ ID NO: 816535 - protein, 17 aa, Mycobacterium
GGHFFEADPLALRLRVF

SEQ ID NO: 816536 - protein, 24 aa, Mycobacterium
GGHFLYTDFRLPFGIDAWETALAD

SEQ ID NO: 816537 - protein, 25 aa, Mycobacterium
GGHFYGAGLINWWDPRGTRKTLEEL

SEQ ID NO: 816538 - protein, 21 aa, Mycobacterium
GGHGGLLIGTGGNGGAGGIGG

SEQ ID NO: 816539 - protein, 20 aa, Mycobacterium
GGHGGTYFGSGGAGGHGGYD

SEQ ID NO: 816540 - protein, 28 aa, Mycobacterium
GGHGLEPRPWILDTLPIVLSAAEWEVLE

SEQ ID NO: 816541 - protein, 22 aa, Mycobacterium
GGHGMWGITLGPVTGRLLAEQI

SEQ ID NO: 816542 - protein, 21 aa, Mycobacterium
GGHGPFGEKIPAGGSGGDGGT

SEQ ID NO: 816543 - protein, 23 aa, Mycobacterium
GGHGQRFRLFIGVGVQDSEFAIA

SEQ ID NO: 816544 - protein, 23 aa, Mycobacterium
GGHGSALFGAAGANGNGGAGGAG

SEQ ID NO: 816545 - protein, 24 aa, Mycobacterium
GGHLDPTMFAAFAPHALELSVEEG

SEQ ID NO: 816546 - protein, 23 aa, Mycobacterium
GGHLDPTMFAAFAPHVLDLTVEE

SEQ ID NO: 816547 - protein, 23 aa, Mycobacterium
GGHLDPTMFAAFAPHVLELTIEE

SEQ ID NO: 816548 - protein, 24 aa, Mycobacterium
GGHLTALRRTRVGRFTLEQARSLD

SEQ ID NO: 816549 - protein, 23 aa, Mycobacterium
GGHLTSLRRTRVGRFGLDQACSL

SEQ ID NO: 816550 - protein, 19 aa, Mycobacterium
GGHLVTALTLKSALVRAIQ

SEQ ID NO: 816551 - protein, 17 aa, Mycobacterium
GGHLWKLVRSFDDPGTW

SEQ ID NO: 816552 - protein, 18 aa, Mycobacterium
GGHNVCYAAKAFLCSEIA

SEQ ID NO: 816553 - protein, 38 aa, Mycobacterium
GGHRLYGLLRQLFFVIPPERIHTLVFGFLRGVTAVAWA

SEQ ID NO: 816554 - protein, 19 aa, Mycobacterium
GGHRMLANWLAVCGLVRND

SEQ ID NO: 816555 - protein, 21 aa, Mycobacterium
GGHRMLANWLGFCGAAPDETL

SEQ ID NO: 816556 - protein, 33 aa, Mycobacterium
GGHSAGIGPLRWLPATPTLLANDPAWENCLTGR

SEQ ID NO: 816557 - protein, 28 aa, Mycobacterium
GGHSDVPGWWHTIQAYVQGEMWPNGHQD

SEQ ID NO: 816558 - protein, 19 aa, Mycobacterium
GGHTEHFLTMLPGLTVIGL

SEQ ID NO: 816559 - protein, 21 aa, Mycobacterium
GGHVLFIADGRLHYVYNFLGE

SEQ ID NO: 816560 - protein, 23 aa, Mycobacterium
GGHWAMLPRITAMTVRDGKVCAL

SEQ ID NO: 816561 - protein, 24 aa, Mycobacterium
GGIAEGLIHVDGDAGLNGVAGTSG

SEQ ID NO: 816562 - protein, 26 aa, Mycobacterium
GGIAVPLNFRLTAAEIAFLVGDCEAR

SEQ ID NO: 816563 - protein, 32 aa, Mycobacterium
GGICHWFHGDAIYRAVLALLMLTGSMGRNGGG

SEQ ID NO: 816564 - protein, 22 aa, Mycobacterium
GGIDVLLSARRVGPDGFAYGVD

SEQ ID NO: 816565 - protein, 23 aa, Mycobacterium
GGIDVLLSARRVGPTGFAYGVDM

SEQ ID NO: 816566 - protein, 18 aa, Mycobacterium
GGIDYLVNNAAIYGGMKL

SEQ ID NO: 816567 - protein, 26 aa, Mycobacterium
GGIEIPSILAIIAYYAPKAAEFLAPE

SEQ ID NO: 816568 - protein, 27 aa, Mycobacterium
GGIEPLTVTVFHLSPTPGFGNSGGAPS

SEQ ID NO: 816569 - protein, 20 aa, Mycobacterium
GGIFGLTRGLAVEGAPLGIK

SEQ ID NO: 816570 - protein, 18 aa, Mycobacterium
GGIFRDCAVHDFDALRWI

SEQ ID NO: 816571 - protein, 25 aa, Mycobacterium
GGIGFTWEYPLHYELRRVFTNSHLI

SEQ ID NO: 816572 - protein, 26 aa, Mycobacterium
GGIGGFAGLFALKGGYREPVLAASTD

SEQ ID NO: 816573 - protein, 25 aa, Mycobacterium
GGIGGHGGWLFGNAGAGGPGGSGGA

SEQ ID NO: 816574 - protein, 27 aa, Mycobacterium
GGIGITPILPMLALARSLGVDWSMVYT

SEQ ID NO: 816575 - protein, 29 aa, Mycobacterium
GGIGMTWEYPAHLYLKRAKSDQLAFGTGY

SEQ ID NO: 816576 - protein, 28 aa, Mycobacterium
GGIGMTWEYPAHLYLKRAKSDQLALGTA

SEQ ID NO: 816577 - protein, 29 aa, Mycobacterium
GGIGMTWEYPAHLYLKRAKSDQLVFGTAY

SEQ ID NO: 816578 - protein, 26 aa, Mycobacterium
GGIGSQGGILFSHAGADGSTGAPGAG

SEQ ID NO: 816579 - protein, 28 aa, Mycobacterium
GGIHEKRFEVAAGDFLLFPTVAHSHAER

SEQ ID NO: 816580 - protein, 31 aa, Mycobacterium
GGIHEKRFTLADSRFLFFPTAVHGHAERVRP

SEQ ID NO: 816581 - protein, 18 aa, Mycobacterium
GGIKTNWVIALPPGQTGL

SEQ ID NO: 816582 - protein, 31 aa, Mycobacterium
GGILARFPGFYIPFLDVPFTGATPPNSPYPT

SEQ ID NO: 816583 - protein, 26 aa, Mycobacterium
GGILPLLFDHLFGMTVIMAGRTISRT

SEQ ID NO: 816584 - protein, 18 aa, Mycobacterium
GGIPAILGELWRGGHLHE

SEQ ID NO: 816585 - protein, 23 aa, Mycobacterium
GGIPIGAALFTADGVLLGRGRNR

SEQ ID NO: 816586 - protein, 33 aa, Mycobacterium
GGIPTKEVILYFSPAGLVVVAPLPDGIHRIVAT

SEQ ID NO: 816587 - protein, 23 aa, Mycobacterium
GGIPWRLPEDLAHFKRLTMGHTV

SEQ ID NO: 816588 - protein, 22 aa, Mycobacterium
GGIRAIRAFTAIQGLPAPEVFH

SEQ ID NO: 816589 - protein, 22 aa, Mycobacterium
GGIRAIRAFTAIQGLPSPEVYH

SEQ ID NO: 816590 - protein, 21 aa, Mycobacterium
GGISGLLLGADGFNAPASSSP

SEQ ID NO: 816591 - protein, 24 aa, Mycobacterium
GGISGPEALWQFLCDRKSSIGRVP

SEQ ID NO: 816592 - protein, 19 aa, Mycobacterium
GGISHRLVRIDEPILRVPQ

SEQ ID NO: 816593 - protein, 19 aa, Mycobacterium
GGITEREWRMCWPSVGAHT

SEQ ID NO: 816594 - protein, 17 aa, Mycobacterium
GGITERFPLMVSSLSSA

SEQ ID NO: 816595 - protein, 17 aa, Mycobacterium
GGITIAAWSARYRHMVR

SEQ ID NO: 816596 - protein, 18 aa, Mycobacterium
GGITLEPHLFEFGSLIQA

SEQ ID NO: 816597 - protein, 26 aa, Mycobacterium
GGITSDRLYPLRLQAELAELLPGCDA

SEQ ID NO: 816598 - protein, 24 aa, Mycobacterium
GGIVFRVQQELGVPVKLVGLGEGP

SEQ ID NO: 816599 - protein, 21 aa, Mycobacterium
GGIVGMTLPIARDLSVVGIRV

SEQ ID NO: 816600 - protein, 21 aa, Mycobacterium
GGKAGFFYGNGGNGGFGGNGA

SEQ ID NO: 816601 - protein, 21 aa, Mycobacterium
GGKALKFYASVRMDVRRIETL

SEQ ID NO: 816602 - protein, 20 aa, Mycobacterium
GGKALLLRAGVFDDIAAAVM

SEQ ID NO: 816603 - protein, 19 aa, Mycobacterium
GGKAMIVVLKPSTGEILAI

SEQ ID NO: 816604 - protein, 23 aa, Mycobacterium
GGKAWALDLLDVAALESLQLETD

SEQ ID NO: 816605 - protein, 26 aa, Mycobacterium
GGKEDLLLATIVRILDAFRDQLAPVI

SEQ ID NO: 816606 - protein, 25 aa, Mycobacterium
GGKEELLLATIVRILDAFRDQLAPV

SEQ ID NO: 816607 - protein, 27 aa, Mycobacterium
GGKELPVVGFIWQVLGRIGVGRKDAIV

SEQ ID NO: 816608 - protein, 26 aa, Mycobacterium
GGKLIGDGGLGGDGGIGLAGTGGNGG

SEQ ID NO: 816609 - protein, 24 aa, Mycobacterium
GGKLMWNQTPLLLNRARQLPNRSG

SEQ ID NO: 816610 - protein, 18 aa, Mycobacterium
GGKLVIVCTRPERQWRIA

SEQ ID NO: 816611 - protein, 25 aa, Mycobacterium
GGKPVDGPGWFYPPTVVTDITKDMA

SEQ ID NO: 816612 - protein, 23 aa, Mycobacterium
GGKPVVLNIFPSVDTPVCATSVR

SEQ ID NO: 816613 - protein, 25 aa, Mycobacterium
GGKPYGVDLLLPPKYVGAEQGGIDT

SEQ ID NO: 816614 - protein, 17 aa, Mycobacterium
GGKQSRAHGAAGGGRRE

SEQ ID NO: 816615 - protein, 22 aa, Mycobacterium
GGKRFCKPCRIAYQRRYRAGKA

SEQ ID NO: 816616 - protein, 23 aa, Mycobacterium
GGKRFRPLFTVLAAQTGPDPDND

SEQ ID NO: 816617 - protein, 23 aa, Mycobacterium
GGKRLDPGYFYAPTLLTDVDPDS

SEQ ID NO: 816618 - protein, 23 aa, Mycobacterium
GGKRLDPGYFYAPTLLTNVDPDS

SEQ ID NO: 816619 - protein, 24 aa, Mycobacterium
GGKRLDPGYFYAPTLLTNVDPDSE

SEQ ID NO: 816620 - protein, 21 aa, Mycobacterium
GGKSFVFFRTPQPDATDPDSG

SEQ ID NO: 816621 - protein, 21 aa, Mycobacterium
GGKSGLFGGTGGTGGTGGNAT

SEQ ID NO: 816622 - protein, 32 aa, Mycobacterium; identical to SEQ ID NO: 114730

SEQ ID NO: 816623 - protein, 32 aa, Mycobacterium
GGKVTAWRYIRASVPAVWAYTRREPMLTLELP

SEQ ID NO: 816624 - protein, 24 aa, Mycobacterium
GGLADCVLALGFEKMQPGSLGGGA

SEQ ID NO: 816625 - protein, 25 aa, Mycobacterium
GGLALGIFLRRAGFDDFTIFDREDG

SEQ ID NO: 816626 - protein, 20 aa, Mycobacterium
GGLAMKWRWRAKIGKDWKGR

SEQ ID NO: 816627 - protein, 19 aa, Mycobacterium
GGLCAWYSIIHTPADRLAG

SEQ ID NO: 816628 - protein, 21 aa, Mycobacterium
GGLDDWLGLRALGHGVEVTGY

SEQ ID NO: 816629 - protein, 18 aa, Mycobacterium
GGLDEEFIRFGATADWQA

SEQ ID NO: 816630 - protein, 24 aa, Mycobacterium
GGLDPVLKIPRLQDAYFKRFPEYP

SEQ ID NO: 816631 - protein, 24 aa, Mycobacterium
GGLDTAFRADFGHGPLVAGICAEY

SEQ ID NO: 816632 - protein, 24 aa, Mycobacterium
GGLDTRAYRLDWPAGVTVFEIDYP

SEQ ID NO: 816633 - protein, 28 aa, Mycobacterium
GGLDVDWYDWLIERVRLWPDVKRRNDQL

SEQ ID NO: 816634 - protein, 25 aa, Mycobacterium
GGLFNGILARYLALVATTLPGETPE

SEQ ID NO: 816635 - protein, 27 aa, Mycobacterium
GGLFNGILARYLALVVTLLPQNSPQDA

SEQ ID NO: 816636 - protein, 31 aa, Mycobacterium
GGLGAWAGPPPLWWAQRFGIQPDLAEALVCA

SEQ ID NO: 816637 - protein, 28 aa, Mycobacterium
GGLGGDGGDARWLGRGGVGGVGGAGEGS

SEQ ID NO: 816638 - protein, 26 aa, Mycobacterium
GGLGGFAGLFALRGDYREPLLAASTD

SEQ ID NO: 816639 - protein, 26 aa, Mycobacterium
GGLGGFAGLFALRGGYREPVLAASTD

SEQ ID NO: 816640 - protein, 26 aa, Mycobacterium
GGLGLVVARWLVAQGAGLVVLNGRSV

SEQ ID NO: 816641 - protein, 22 aa, Mycobacterium
GGLGRFWMSAGQAHVAGVGMDW

SEQ ID NO: 816642 - protein, 22 aa, Mycobacterium
GGLGRQYALLLAARGARVVVND

SEQ ID NO: 816643 - protein, 25 aa, Mycobacterium
GGLGTDGYGGWGGEGGWGGDAGTTR

SEQ ID NO: 816644 - protein, 21 aa, Mycobacterium
GGLGTFSWPGAYGTWWQADPG

SEQ ID NO: 816645 - protein, 17 aa, Mycobacterium
GGLGYLLAPGADAYRLK

SEQ ID NO: 816646 - protein, 21 aa, Mycobacterium
GGLHAAALFDVDGELLCVRED

SEQ ID NO: 816647 - protein, 23 aa, Mycobacterium
GGLHSWCLAAERPELVTALVVED

SEQ ID NO: 816648 - protein, 25 aa, Mycobacterium
GGLIILATHLLAPPDLWAAVVLVDI

SEQ ID NO: 816649 - protein, 22 aa, Mycobacterium
GGLKLAIWAAIPLLTPYVREIC

SEQ ID NO: 816650 - protein, 32 aa, Mycobacterium
GGLLADRALHPTQWVRLWFSDGGKLHQRGYTL

SEQ ID NO: 816651 - protein, 25 aa, Mycobacterium
GGLLARFPDLSIPSLGLTFYGGTPS

SEQ ID NO: 816652 - protein, 17 aa, Mycobacterium
GGLLEWIRLRRLGRRER

SEQ ID NO: 816653 - protein, 17 aa, Mycobacterium
GGLLGGLVGAGGGDGGA

SEQ ID NO: 816654 - protein, 32 aa, Mycobacterium
GGLLINSPAFIETMLAAAKLGAIFVPMNVRLA

SEQ ID NO: 816655 - protein, 29 aa, Mycobacterium
GGLLLATGKLPRVASAALAFTVLPANLGA

SEQ ID NO: 816656 - protein, 20 aa, Mycobacterium
GGLLLDLVEHRLLFFGEELM

SEQ ID NO: 816657 - protein, 17 aa, Mycobacterium
GGLLLRDLDLPDFRDYA

SEQ ID NO: 816658 - protein, 19 aa, Mycobacterium
GGLLRLDPAVRPTMYRCAT

SEQ ID NO: 816659 - protein, 22 aa, Mycobacterium
GGLNWDSMPLKLFAGGNAKFWD

SEQ ID NO: 816660 - protein, 28 aa, Mycobacterium
GGLPDDLKFALVEPLRLLFKDEVRAVGR

SEQ ID NO: 816661 - protein, 28 aa, Mycobacterium
GGLPGVAHQLLLLNAALGGPALVDASWL

SEQ ID NO: 816662 - protein, 17 aa, Mycobacterium
GGLPLQRLVNGESMAAV

SEQ ID NO: 816663 - protein, 17 aa, Mycobacterium
GGLPRLPRTALVDVLLR

SEQ ID NO: 816664 - protein, 32 aa, Mycobacterium
GGLPSYPHPRLMPDFWQFPTVSMGLGPMNAIM

SEQ ID NO: 816665 - protein, 17 aa, Mycobacterium
GGLPTNERLEFLGDAVL

SEQ ID NO: 816666 - protein, 20 aa, Mycobacterium
GGLQFKPATWARYGGVGNPA

SEQ ID NO: 816667 - protein, 19 aa, Mycobacterium
GGLQPPDRLRQLVGVGHVE

SEQ ID NO: 816668 - protein, 21 aa, Mycobacterium
GGLRLRRRSPLAAAARRVLAL

SEQ ID NO: 816669 - protein, 19 aa, Mycobacterium
GGLRLSRRSPLAAAAQSVL

SEQ ID NO: 816670 - protein, 17 aa, Mycobacterium
GGLRPFVGALTLDLPTA

SEQ ID NO: 816671 - protein, 19 aa, Mycobacterium
GGLRPGRRSALAAAARQVL

SEQ ID NO: 816672 - protein, 18 aa, Mycobacterium
GGLRPQTRHLLFSVSKSL

SEQ ID NO: 816673 - protein, 27 aa, Mycobacterium
GGLRQRAMIAMALVAGPRLLIADEPTT

SEQ ID NO: 816674 - protein, 27 aa, Mycobacterium
GGLRVDTVLNRILHSGLPYPPGVAIHE

SEQ ID NO: 816675 - protein, 27 aa, Mycobacterium
GGLSLAQLSLLDPLLATESLPVSELAS

SEQ ID NO: 816676 - protein, 20 aa, Mycobacterium
GGLSLPIAIPQHVDCTLTPR

SEQ ID NO: 816677 - protein, 27 aa, Mycobacterium
GGLSVPQSWMFPPAVRQVAAMFPGTTP

SEQ ID NO: 816678 - protein, 21 aa, Mycobacterium
GGLSWIYRNLGAYLDCPIIGI

SEQ ID NO: 816679 - protein, 23 aa, Mycobacterium
GGLTFAGMMAIPPLGADPGEAFA

SEQ ID NO: 816680 - protein, 47 aa, Mycobacterium
GGLTSNPGWLQWLIDWYMPISQLIYNTVGLPYFAIGIGNSLITSWRA

SEQ ID NO: 816681 - protein, 20 aa, Mycobacterium
GGLTYSGHPLACAAAVATIN

SEQ ID NO: 816682 - protein, 21 aa, Mycobacterium
GGLVPRYWCVAAAGRYTIRAV

SEQ ID NO: 816683 - protein, 21 aa, Mycobacterium
GGLYLEPWDGILIDTLKMVAQ

SEQ ID NO: 816684 - protein, 26 aa, Mycobacterium
GGMAKGAGMLAPSLATMLCVLTTDAA

SEQ ID NO: 816685 - protein, 24 aa, Mycobacterium
GGMDTAFRATYGHGPLVIGVCAEY

SEQ ID NO: 816686 - protein, 32 aa, Mycobacterium
GGMEHAVLHLLYSRFWHKVLYDLGHVSSREPY

SEQ ID NO: 816687 - protein, 28 aa, Mycobacterium
GGMELGAMTPMFVGFRAREIILSLFESI

SEQ ID NO: 816688 - protein, 22 aa, Mycobacterium
GGMELGAMTPMFVGFRGREIVL

SEQ ID NO: 816689 - protein, 24 aa, Mycobacterium
GGMELGAMTPMFVGFRGREIVLTL

SEQ ID NO: 816690 - protein, 22 aa, Mycobacterium
GGMFAQLCADLPWTQRLSEVWR

SEQ ID NO: 816691 - protein, 21 aa, Mycobacterium
GGMFDKGFWVAPTILTGVHND

SEQ ID NO: 816692 - protein, 26 aa, Mycobacterium
GGMFDQLCIELPWTQRLSQVWRMHDP

SEQ ID NO: 816693 - protein, 26 aa, Mycobacterium
GGMGAYAPLPWLPDSVTTQIVDEIVK

SEQ ID NO: 816694 - protein, 25 aa, Mycobacterium
GGMGGDYFALCLALEELGKVDQSVA

SEQ ID NO: 816695 - protein, 31 aa, Mycobacterium
GGMGGTGGHGSFLFGAAGASCNGGAGGAGGN

SEQ ID NO: 816696 - protein, 25 aa, Mycobacterium
GGMGGTGGWLWGNGGAGGGGGVGTT

SEQ ID NO: 816697 - protein, 24 aa, Mycobacterium
GGMGLLLTQWATYRGVRVITTVSS

SEQ ID NO: 816698 - protein, 27 aa, Mycobacterium
GGMGPFTVRLHAVLPPIAAAGTCLSLR

SEQ ID NO: 816699 - protein, 26 aa, Mycobacterium
GGMGRVIARRQGIGKALLLADHNEQA

SEQ ID NO: 816700 - protein, 23 aa, Mycobacterium
GGMHALIWHRGAIIAHGAVVQRR

SEQ ID NO: 816701 - protein, 19 aa, Mycobacterium
GGMLAYAWAATHRDTVTRL

SEQ ID NO: 816702 - protein, 17 aa, Mycobacterium
GGMLKHVDFLASDLPGS

SEQ ID NO: 816703 - protein, 18 aa, Mycobacterium
GGMLKPDIVYFGESVPKE

SEQ ID NO: 816704 - protein, 27 aa, Mycobacterium
GGMPMPRALMWALHEHLLGANPAVWMY

SEQ ID NO: 816705 - protein, 25 aa, Mycobacterium
GGMPMRWGTGYMLGSKRFGPFGRNS

SEQ ID NO: 816706 - protein, 24 aa, Mycobacterium
GGMSLGEFWATEGPLSYLGMAVAG

SEQ ID NO: 816707 - protein, 28 aa, Mycobacterium
GGMVINHLLYHAVIPKLPFGGVGASGMG

SEQ ID NO: 816708 - protein, 27 aa, Mycobacterium
GGMVKGAGMLAPSLATMLCVLTTDAVA

SEQ ID NO: 816709 - protein, 24 aa, Mycobacterium
GGMVRTVSWLYLGQTMVIHQRFDP

SEQ ID NO: 816710 - protein, 27 aa, Mycobacterium
GGMVVNHLIFHFATHKLPFGGVGPSGL

SEQ ID NO: 816711 - protein, 19 aa, Mycobacterium
GGMWFPCNPVLLRAGTDDT

SEQ ID NO: 816712 - protein, 17 aa, Mycobacterium
GGMWRFLGRDMAAVSGT

SEQ ID NO: 816713 - protein, 22 aa, Mycobacterium
GGNAALLIGTGGNGGAGVPPAS

SEQ ID NO: 816714 - protein, 21 aa, Mycobacterium
GGNAGLFGGGGTGGAGGGSGS

SEQ ID NO: 816715 - protein, 21 aa, Mycobacterium
GGNAGLLIGVGGAGGEGGIGG

SEQ ID NO: 816716 - protein, 18 aa, Mycobacterium
GGNAGWLGSGGSGGAGGG

SEQ ID NO: 816717 - protein, 27 aa, Mycobacterium
GGNALVLRQRLLLRGIPAEIVEITLAD

SEQ ID NO: 816718 - protein, 20 aa, Mycobacterium
GGNANWFGSGGAGGQGGTGL

SEQ ID NO: 816719 - protein, 27 aa, Mycobacterium
GGNAPRPWMIDRALRHLLTDITGNTHR

SEQ ID NO: 816720 - protein, 21 aa, Mycobacterium
GGNATDLMFANGGNGGNGGTG

SEQ ID NO: 816721 - protein, 23 aa, Mycobacterium
GGNFGQWSGLRKALRGNAVGMAA

SEQ ID NO: 816722 - protein, 26 aa, Mycobacterium
GGNGGAAGLALAATGHDGGHGTGGAG

SEQ ID NO: 816723 - protein, 25 aa, Mycobacterium
GGNGGAAGLLWGTAGAGGAGGSANS

SEQ ID NO: 816724 - protein, 25 aa, Mycobacterium
GGNGGAGGILWGNGGAGATGAAGQT

SEQ ID NO: 816725 - protein, 27 aa, Mycobacterium
GGNGGAGGSAGLWGRGGNGGAGGTGVA

SEQ ID NO: 816726 - protein, 26 aa, Mycobacterium
GGNGGAGGWLFGDGGIGGTGGAGATG

SEQ ID NO: 816727 - protein, 27 aa, Mycobacterium
GGNGGDGGWLFGSGGNGAAGAAGQAGG

SEQ ID NO: 816728 - protein, 30 aa, Mycobacterium
GGNGGFGGTGGLFEAAGSGGAGGVGGDGSQ

SEQ ID NO: 816729 - protein, 19 aa, Mycobacterium
GGNGGFLFGSGGTGGFGGV

SEQ ID NO: 816730 - protein, 22 aa, Mycobacterium
GGNGGIGGIGLTPGADGIGGTS

SEQ ID NO: 816731 - protein, 21 aa, Mycobacterium
GGNGGLLFGNGGHGGAVAFGG

SEQ ID NO: 816732 - protein, 26 aa, Mycobacterium
GGNGGLSIIFDGGVGGAGGAAGLFGG

SEQ ID NO: 816733 - protein, 29 aa, Mycobacterium
GGNGGNAGAFALFGNGGNGGNGGVGVVGA

SEQ ID NO: 816734 - protein, 25 aa, Mycobacterium
GGNGGNAIGLFGQGGTGGTGGFGIG

SEQ ID NO: 816735 - protein, 27 aa, Mycobacterium
GGNGGNGGRGGLFGKGGNAGNGADGGT

SEQ ID NO: 816736 - protein, 17 aa, Mycobacterium
GGNGGVGGLLYGNGGRG

SEQ ID NO: 816737 - protein, 22 aa, Mycobacterium
GGNGGWLYGLGGQGGMGGNGSS

SEQ ID NO: 816738 - protein, 22 aa, Mycobacterium
GGNHAFYLSIPPNAFPVVCEQL

SEQ ID NO: 816739 - protein, 23 aa, Mycobacterium
GGNHAFYLSIPPNAFPVVCEQLR

SEQ ID NO: 816740 - protein, 25 aa, Mycobacterium
GGNIDPLLLTHVITHGLRAAGRYLT

SEQ ID NO: 816741 - protein, 17 aa, Mycobacterium
GGNLLQRPRCLYFRDVS

SEQ ID NO: 816742 - protein, 18 aa, Mycobacterium
GGNLTLTLAHRAKREGWI

SEQ ID NO: 816743 - protein, 19 aa, Mycobacterium
GGNNLLFRRNSVSGAVEVV

SEQ ID NO: 816744 - protein, 32 aa, Mycobacterium
GGNNMFSALTGPALRWNPWATPIPRTYLCSSA

SEQ ID NO: 816745 - protein, 25 aa, Mycobacterium
GGNPDTFPGLAGLGDLIVTCTSQRS

SEQ ID NO: 816746 - protein, 26 aa, Mycobacterium
GGNPYQLSWWINRFTEIFQTIARDLE

SEQ ID NO: 816747 - protein, 28 aa, Mycobacterium
GGNQIRLVESLLYRGDVTPLLTAIAQAR

SEQ ID NO: 816748 - protein, 21 aa, Mycobacterium
GGNRTVPTVKFADGSTLTNPS

SEQ ID NO: 816749 - protein, 24 aa, Mycobacterium
GGNSAWRAIAGPTPRLNPWRTPIP

SEQ ID NO: 816750 - protein, 25 aa, Mycobacterium
GGNSHQHIVRLWWTDPSSGDTGDNS

SEQ ID NO: 816751 - protein, 17 aa, Mycobacterium
GGNVAFATIPILREDGW

SEQ ID NO: 816752 - protein, 32 aa, Mycobacterium
GGNVGIVNNGAFTPALYGFGGNGGNGVNGGTG

SEQ ID NO: 816753 - protein, 25 aa, Mycobacterium
GGNVWFKRIGGGAGLPLLVVHGGPG

SEQ ID NO: 816754 - protein, 18 aa, Mycobacterium
GGNYIRYQGMVDGVPRVE

SEQ ID NO: 816755 - protein, 20 aa, Mycobacterium
GGPAALRRTPVQAAAGLAVK

SEQ ID NO: 816756 - protein, 19 aa, Mycobacterium
GGPADVFKRHFYTCFISDK

SEQ ID NO: 816757 - protein, 25 aa, Mycobacterium
GGPAGLILGNLYRGGAGGMGGAGGW

SEQ ID NO: 816758 - protein, 25 aa, Mycobacterium
GGPAHLRLRRLVARAFIPKAAERLR

SEQ ID NO: 816759 - protein, 20 aa, Mycobacterium
GGPAIFAQVLLYPGLDRDMG

SEQ ID NO: 816760 - protein, 19 aa, Mycobacterium
GGPALFGPIGMIVAAALRS

SEQ ID NO: 816761 - protein, 18 aa, Mycobacterium
GGPALLAFTGRRLFAVIV

SEQ ID NO: 816762 - protein, 23 aa, Mycobacterium
GGPALRAQLLLYPVIAADFDTES

SEQ ID NO: 816763 - protein, 17 aa, Mycobacterium
GGPALRLPSLEIPVLSL

SEQ ID NO: 816764 - protein, 18 aa, Mycobacterium
GGPARAWIQFRKGALPGE

SEQ ID NO: 816765 - protein, 28 aa, Mycobacterium
GGPATIVPMFLLYDYSFLPHGATSKAEG

SEQ ID NO: 816766 - protein, 28 aa, Mycobacterium
GGPATIVPMFLLYDYSFLPQGAGTKAEG

SEQ ID NO: 816767 - protein, 28 aa, Mycobacterium
GGPATIVPMFLLYDYSFLPSGATTKAEG

SEQ ID NO: 816768 - protein, 23 aa, Mycobacterium
GGPCLRLLGFERIELEPGASRRL

SEQ ID NO: 816769 - protein, 23 aa, Mycobacterium
GGPDTLLLLQHPAVYTAGRRTEP

SEQ ID NO: 816770 - protein, 25 aa, Mycobacterium
GGPDYALYLYRNKGPLIYLDSPIMP

SEQ ID NO: 816771 - protein, 33 aa, Mycobacterium
GGPELALALVLPSWTLLGMLDRALALTVSHVGL

SEQ ID NO: 816772 - protein, 20 aa, Mycobacterium
GGPFFIEFRTYRFRAHSMFD

SEQ ID NO: 816773 - protein, 34 aa, Mycobacterium
GGPFGQPVLLAFTQRRLFAVVTLTVREGLVLKIE

SEQ ID NO: 816774 - protein, 17 aa, Mycobacterium
GGPFPPLPFTPEGDDIS

SEQ ID NO: 816775 - protein, 20 aa, Mycobacterium
GGPFPPLPFTPEGDDITEQI

SEQ ID NO: 816776 - protein, 19 aa, Mycobacterium
GGPFWARRDDGAWSVPKGE

SEQ ID NO: 816777 - protein, 17 aa, Mycobacterium
GGPGAGPLLGRRCGACR

SEQ ID NO: 816778 - protein, 17 aa, Mycobacterium
GGPGMQEMLYPTSYLKG

SEQ ID NO: 816779 - protein, 24 aa, Mycobacterium
GGPGRGFGGFGFGFDPGAGFGFGP

SEQ ID NO: 816780 - protein, 22 aa, Mycobacterium
GGPIDGMFALAGELVPRSAVQL

SEQ ID NO: 816781 - protein, 30 aa, Mycobacterium
GGPIRLVASGMIRLIRPVASPALEIYARLS

SEQ ID NO: 816782 - protein, 28 aa, Mycobacterium
GGPLAHLAFFVLDRWLRPVPAGVVGELF

SEQ ID NO: 816783 - protein, 26 aa, Mycobacterium
GGPLAHPFQPLLAPRLREFALREGLA

SEQ ID NO: 816784 - protein, 24 aa, Mycobacterium
GGPLARLEVNLALEILLRRVESPT

SEQ ID NO: 816785 - protein, 24 aa, Mycobacterium
GGPLATMGLYPPGSTFKIVTAGAA

SEQ ID NO: 816786 - protein, 23 aa, Mycobacterium
GGPLPERVAAIIDTLYEGLTSTH

SEQ ID NO: 816787 - protein, 23 aa, Mycobacterium
GGPLSHPFQPLLNPRLREFALRE

SEQ ID NO: 816788 - protein, 26 aa, Mycobacterium
GGPLTWPLHISLMLAKEYALTGTRIP

SEQ ID NO: 816789 - protein, 31 aa, Mycobacterium
GGPNDYIYIIVQPQVWAPLAELIGHPELADH

SEQ ID NO: 816790 - protein, 21 aa, Mycobacterium
GGPNFLGWQHPPTSTTVTAPA

SEQ ID NO: 816791 - protein, 33 aa, Mycobacterium
GGPPGFVRVGSPTRLWWPDFPGNNMFNSYGNLA

SEQ ID NO: 816792 - protein, 21 aa, Mycobacterium
GGPPHLLGGRLPTPTANALRE

SEQ ID NO: 816793 - protein, 24 aa, Mycobacterium
GGPPLPPGYYPLDGPPPPGYEYNS

SEQ ID NO: 816794 - protein, 23 aa, Mycobacterium
GGPPPMPASLRAFEMAVAADRKM

SEQ ID NO: 816795 - protein, 21 aa, Mycobacterium
GGPSWVQSGYGSTLGGNATGT

SEQ ID NO: 816796 - protein, 25 aa, Mycobacterium
GGPVAFIMMLRYPAKVTGFFGLNTS

SEQ ID NO: 816797 - protein, 26 aa, Mycobacterium
GGPVAFIMMLRYPAKVTGFFGMNTAA

SEQ ID NO: 816798 - protein, 21 aa, Mycobacterium
GGPVLRLRWWEVLRCIASVRS

SEQ ID NO: 816799 - protein, 17 aa, Mycobacterium
GGQACEEAIELFHAAPG

SEQ ID NO: 816800 - protein, 18 aa, Mycobacterium
GGQAFWSFGGLFLVDSPE

SEQ ID NO: 816801 - protein, 19 aa, Mycobacterium
GGQAGLFGAQGQQGAGGAG

SEQ ID NO: 816802 - protein, 19 aa, Mycobacterium
GGQALLLHFRRQRWYVEGV

SEQ ID NO: 816803 - protein, 24 aa, Mycobacterium
GGQATIPIVYAVSRALVEKGGVPY

SEQ ID NO: 816804 - protein, 27 aa, Mycobacterium
GGQEPALPSAFFFEIARLADGGGEPAA

SEQ ID NO: 816805 - protein, 31 aa, Mycobacterium
GGQETTLLSLYITLMHFGGIIVPPGYTDACK

SEQ ID NO: 816806 - protein, 25 aa, Mycobacterium
GGQFEGFPLLLLTSEGARSGAQRVN

SEQ ID NO: 816807 - protein, 25 aa, Mycobacterium
GGQFREWLGLLDPDIRYVVPVRTTR

SEQ ID NO: 816808 - protein, 25 aa, Mycobacterium
GGQGADALGPAFTSGATGGTGGDGG

SEQ ID NO: 816809 - protein, 23 aa, Mycobacterium
GGQGAVLIGAGFGGAGGDGGSAT

SEQ ID NO: 816810 - protein, 26 aa, Mycobacterium
GGQGGHAGLLWSSGGAGGAGAFSVSG

SEQ ID NO: 816811 - protein, 27 aa, Mycobacterium
GGQKQCVAIARAVFFGARVLILDEPTA

SEQ ID NO: 816812 - protein, 23 aa, Mycobacterium
GGQKWLRAGWGTGFTKLSDRMLE

SEQ ID NO: 816813 - protein, 23 aa, Mycobacterium
GGQLAIKAALALGSPYTAMLFMG

SEQ ID NO: 816814 - protein, 23 aa, Mycobacterium
GGQLATYLAAWQAGASAVDGAAA

SEQ ID NO: 816815 - protein, 19 aa, Mycobacterium
GGQLATYLAAWSAGADAVD

SEQ ID NO: 816816 - protein, 25 aa, Mycobacterium
GGQLLEWLERCIFPAEARLADTALA

SEQ ID NO: 816817 - protein, 33 aa, Mycobacterium
GGQLLVYGVDPLILRQAYPVPRAPYGLAGSRAL

SEQ ID NO: 816818 - protein, 32 aa, Mycobacterium
GGQLLVYGVDPLILRQAYPVSQAPYGLAGSRA

SEQ ID NO: 816819 - protein, 23 aa, Mycobacterium
GGQMIFDLPPSAFAFLVGRGVRA

SEQ ID NO: 816820 - protein, 17 aa, Mycobacterium
GGQPPEMRPPHDGPPHP

SEQ ID NO: 816821 - protein, 17 aa, Mycobacterium
GGQPQLVGGQPAQPFAV

SEQ ID NO: 816822 - protein, 17 aa, Mycobacterium
GGQQFSCAFGAARDGEH

SEQ ID NO: 816823 - protein, 25 aa, Mycobacterium
GGQQGTWDRLWPKLGMQARDEDSQP

SEQ ID NO: 816824 - protein, 19 aa, Mycobacterium
GGQRLLFSATLDAAVDTLV

SEQ ID NO: 816825 - protein, 20 aa, Mycobacterium
GGQRLLFSATLDNGVDKLVN

SEQ ID NO: 816826 - protein, 21 aa, Mycobacterium
GGQRLLFSATLDNGVDKLVTR

SEQ ID NO: 816827 - protein, 24 aa, Mycobacterium
GGQRRRLLLARAALSPARIVLLDE

SEQ ID NO: 816828 - protein, 27 aa, Mycobacterium
GGQRRRLQLMLVLLSEPNVLVLDEPTN

SEQ ID NO: 816829 - protein, 25 aa, Mycobacterium
GGQRRRVELARILFAASEGGAGTSG

SEQ ID NO: 816830 - protein, 26 aa, Mycobacterium
GGQRRRVELARILFAASETGSGSATT

SEQ ID NO: 816831 - protein, 18 aa, Mycobacterium
GGQTVLYGPSTGGSGGAG

SEQ ID NO: 816832 - protein, 19 aa, Mycobacterium
GGRAGLLIGNAGAGGAGGE

SEQ ID NO: 816833 - protein, 31 aa, Mycobacterium
GGRAHLLDIWRRPDLAPGRRAPVLIQVPGGA

SEQ ID NO: 816834 - protein, 17 aa, Mycobacterium
GGRALRIWGRSAASIDG

SEQ ID NO: 816835 - protein, 24 aa, Mycobacterium
GGRALVGRFLAALDKLPNADCWCE

SEQ ID NO: 816836 - protein, 23 aa, Mycobacterium
GGRAVFLACSALRESMLEAVRRG

SEQ ID NO: 816837 - protein, 27 aa, Mycobacterium
GGRAVVMTYWNPVLRKGVDAFARDLAN

SEQ ID NO: 816838 - protein, 28 aa, Mycobacterium
GGRAVVMTYWNPVLRYGVDAFARDLASA

SEQ ID NO: 816839 - protein, 29 aa, Mycobacterium
GGRDDRLHWWAGPWPVDERWWDPDLGKGR

SEQ ID NO: 816840 - protein, 26 aa, Mycobacterium
GGRDGLIHSVAVNPLFLVLSGGGPDV

SEQ ID NO: 816841 - protein, 20 aa, Mycobacterium
GGRFAFYIKVHHTVTDGVAG

SEQ ID NO: 816842 - protein, 17 aa, Mycobacterium
GGRFVLQAILGHPLKKW

SEQ ID NO: 816843 - protein, 19 aa, Mycobacterium
GGRFWAGVMAYEPSPEAGA

SEQ ID NO: 816844 - protein, 23 aa, Mycobacterium
GGRGALNLFSRKANSFTLADQAV

SEQ ID NO: 816845 - protein, 27 aa, Mycobacterium
GGRGARPWLAGVALDWVLDGAVRAGAA

SEQ ID NO: 816846 - protein, 24 aa, Mycobacterium
GGRGGAGGFYGNGGAGGAGGNSAP

SEQ ID NO: 816847 - protein, 20 aa, Mycobacterium
GGRGGLFYGAGGAGGDGGNG

SEQ ID NO: 816848 - protein, 25 aa, Mycobacterium
GGRGGNAGLFGSGGIGGSGAAGAAG

SEQ ID NO: 816849 - protein, 22 aa, Mycobacterium
GGRGGYLIGSGGNGGAGAGGGD

SEQ ID NO: 816850 - protein, 22 aa, Mycobacterium
GGRGLLVLLDALRTTITGQAPA

SEQ ID NO: 816851 - protein, 30 aa, Mycobacterium
GGRGVHVFLRIKPQWDFIEVRRAGIALARE

SEQ ID NO: 816852 - protein, 33 aa, Mycobacterium
GGRGVHVFLRIKTDWDFIAVRRAGIALAREVER

SEQ ID NO: 816853 - protein, 24 aa, Mycobacterium
GGRHAFLAACWLPFDAAVDCYGAF

SEQ ID NO: 816854 - protein, 30 aa, Mycobacterium
GGRHDGEWFELIWPLWRSGRSAITRFPGMA

SEQ ID NO: 816855 - protein, 17 aa, Mycobacterium
GGRHQDLYFAGARISRF

SEQ ID NO: 816856 - protein, 20 aa, Mycobacterium
GGRIDLQLRDGRVDLTGRAV

SEQ ID NO: 816857 - protein, 30 aa, Mycobacterium
GGRIINIGSVLGLLPAPYAALYSASKHAVE

SEQ ID NO: 816858 - protein, 17 aa, Mycobacterium
GGRISIDCRLAVASVMM

SEQ ID NO: 816859 - protein, 24 aa, Mycobacterium
GGRKFSILPLSARTPAALAQLADK

SEQ ID NO: 816860 - protein, 25 aa, Mycobacterium
GGRLGSGKQWLSWIGLDDLIDIYHR

SEQ ID NO: 816861 - protein, 22 aa, Mycobacterium
GGRLGYLVATPALVDAMLLVRL

SEQ ID NO: 816862 - protein, 22 aa, Mycobacterium
GGRLLDVAFDAVGLKATFEQGL

SEQ ID NO: 816863 - protein, 20 aa, Mycobacterium
GGRLPALLEANPDAPLYADP

SEQ ID NO: 816864 - protein, 24 aa, Mycobacterium
GGRLPSAVWAPYGLAGVLEREAFI

SEQ ID NO: 816865 - protein, 23 aa, Mycobacterium
GGRLPSTLWAQYGLAGILEHEAF

SEQ ID NO: 816866 - protein, 26 aa, Mycobacterium
GGRLQQELIRLGRYPLLVVDEVGYIP

SEQ ID NO: 816867 - protein, 24 aa, Mycobacterium
GGRMMVTFGVGWLKGEFDALGVPF

SEQ ID NO: 816868 - protein, 23 aa, Mycobacterium
GGRPAGALLFTCNGRGRRMFGVA

SEQ ID NO: 816869 - protein, 22 aa, Mycobacterium
GGRPLPVFCASLRTAEPELLEL

SEQ ID NO: 816870 - protein, 18 aa, Mycobacterium
GGRPMLPLDAERPADAAP

SEQ ID NO: 816871 - protein, 20 aa, Mycobacterium
GGRPPYYIYRRALDSGQFQE

SEQ ID NO: 816872 - protein, 29 aa, Mycobacterium
GGRPRRLPVPGPRPELVHYLRTLDDARRL

SEQ ID NO: 816873 - protein, 17 aa, Mycobacterium
GGRPVKLALTRQQMFSL

SEQ ID NO: 816874 - protein, 18 aa, Mycobacterium
GGRPYPAQLVGYDRGRDV

SEQ ID NO: 816875 - protein, 25 aa, Mycobacterium
GGRPYSQTFLERYDGRIPNQGLGAE

SEQ ID NO: 816876 - protein, 25 aa, Mycobacterium
GGRPYTEGPLAEGYFIAPTVLELDG

SEQ ID NO: 816877 - protein, 24 aa, Mycobacterium
GGRQKFHYLNTAPLGQIAKRWRID

SEQ ID NO: 816878 - protein, 18 aa, Mycobacterium
GGRRAIPRGGVFGRRQGA

SEQ ID NO: 816879 - protein, 24 aa, Mycobacterium
GGRRELQVAFGKKLRYFALRPEQA

SEQ ID NO: 816880 - protein, 24 aa, Mycobacterium
GGRRPLVWLGAPAPGGLALPPASP

SEQ ID NO: 816881 - protein, 19 aa, Mycobacterium
GGRRQLHIPAHLAYGDRGA

SEQ ID NO: 816882 - protein, 20 aa, Mycobacterium
GGRRRGFVVVRWLDNPQAPT

SEQ ID NO: 816883 - protein, 29 aa, Mycobacterium
GGRRYRHPLCLSVHFPAGTLLDETGCVIR

SEQ ID NO: 816884 - protein, 24 aa, Mycobacterium
GGRTLMHLAFDRHGLEHHPDAELC

SEQ ID NO: 816885 - protein, 29 aa, Mycobacterium
GGRTTVSVLPLNIFDSLLLSGFSAELWLQ

SEQ ID NO: 816886 - protein, 19 aa, Mycobacterium
GGRVLLVWDAPNLDMGLGS

SEQ ID NO: 816887 - protein, 22 aa, Mycobacterium
GGRVVVAFQPHLYSRTATFAHE

SEQ ID NO: 816888 - protein, 20 aa, Mycobacterium
GGRWRARSAALLAAVTVGGA

SEQ ID NO: 816889 - protein, 17 aa, Mycobacterium
GGRWRLIAPDLPGFGYS

SEQ ID NO: 816890 - protein, 17 aa, Mycobacterium
GGRYAVQSYLEYQGRKL

SEQ ID NO: 816891 - protein, 24 aa, Mycobacterium
GGRYEDYYFPVQAAQVRNLLGKIL

SEQ ID NO: 816892 - protein, 26 aa, Mycobacterium
GGRYGFAGMLIQLARRRGVSAFIGDG

SEQ ID NO: 816893 - protein, 23 aa, Mycobacterium
GGSAGLIGNGGIGGQGGAGGIGG

SEQ ID NO: 816894 - protein, 17 aa, Mycobacterium
GGSAGLWGAGGQGGDGA

SEQ ID NO: 816895 - protein, 19 aa, Mycobacterium
GGSAGLWGAGGTGGAGGSS

SEQ ID NO: 816896 - protein, 19 aa, Mycobacterium
GGSALLFGSGGAGGQGGTG

SEQ ID NO: 816897 - protein, 17 aa, Mycobacterium
GGSAQFIVGYQGPAGIG

SEQ ID NO: 816898 - protein, 26 aa, Mycobacterium
GGSAVRLPRQIPYTVACDILLTGRHI

SEQ ID NO: 816899 - protein, 27 aa, Mycobacterium
GGSAVRLPRQIPYTVACDLLLTGRHIT

SEQ ID NO: 816900 - protein, 26 aa, Mycobacterium
GGSAVRLVRQIPYTVACDILLTGRHI

SEQ ID NO: 816901 - protein, 25 aa, Mycobacterium
GGSAVRLVRQIPYTVACDLLMTGRH

SEQ ID NO: 816902 - protein, 25 aa, Mycobacterium
GGSDRLLRLRWPCPITGAMPVSEVG

SEQ ID NO: 816903 - protein, 27 aa, Mycobacterium
GGSDRPLPVMFFIHGGAYFLGSSATPI

SEQ ID NO: 816904 - protein, 25 aa, Mycobacterium
GGSEVLDWLVTRNALARSAYQLGVV

SEQ ID NO: 816905 - protein, 27 aa, Mycobacterium
GGSGADGTLFSSLAGTGGTGGNGGTGG

SEQ ID NO: 816906 - protein, 26 aa, Mycobacterium
GGSGANGGLLYGNGGAGGVGGTGGTG

SEQ ID NO: 816907 - protein, 23 aa, Mycobacterium
GGSGGAARFFGDGGAAGTGGVGG

SEQ ID NO: 816908 - protein, 24 aa, Mycobacterium
GGSGGAGGLLFGNGGDGGAGGDGG

SEQ ID NO: 816909 - protein, 27 aa, Mycobacterium
GGSGGAGGWAGLIGAGGAGGVGGTGVA

SEQ ID NO: 816910 - protein, 32 aa, Mycobacterium
GGSGGANGLLGGGWGPFGGASGGAGGAGGAGG

SEQ ID NO: 816911 - protein, 25 aa, Mycobacterium
GGSGGHSGLLIGDGGSGGSGGNGGN

SEQ ID NO: 816912 - protein, 24 aa, Mycobacterium
GGSGGLLDPILFGGTGGLLGPLVG

SEQ ID NO: 816913 - protein, 21 aa, Mycobacterium
GGSGGLLWGNGGAGGAGGLSI

SEQ ID NO: 816914 - protein, 27 aa, Mycobacterium
GGSGGLSCFFLPRILPDGTRNRMFLQR

SEQ ID NO: 816915 - protein, 24 aa, Mycobacterium
GGSGGNAGLFGNGGNAGGGGSGGS

SEQ ID NO: 816916 - protein, 32 aa, Mycobacterium
GGSGPNAFDCSGLVMWSFQQAGISLPHSSQAL

SEQ ID NO: 816917 - protein, 29 aa, Mycobacterium
GGSHSWFAGYRGDLAFAALIVGGGSSEYA

SEQ ID NO: 816918 - protein, 20 aa, Mycobacterium
GGSIFPAVQNFLLAARAQGL

SEQ ID NO: 816919 - protein, 22 aa, Mycobacterium
GGSIINISSIWGSAAVAGAHAY

SEQ ID NO: 816920 - protein, 21 aa, Mycobacterium
GGSIPFIAEFARAFPAAKILV

SEQ ID NO: 816921 - protein, 25 aa, Mycobacterium
GGSITARWAVLYELGGNVLCYVLLD

SEQ ID NO: 816922 - protein, 24 aa, Mycobacterium
GGSIYAFECPLLLGTTAVLLDRWD

SEQ ID NO: 816923 - protein, 24 aa, Mycobacterium
GGSIYAFECPLLLGTTAVLMQRWN

SEQ ID NO: 816924 - protein, 23 aa, Mycobacterium
GGSKVGLPLVRRALELLPDVGFV

SEQ ID NO: 816925 - protein, 24 aa, Mycobacterium
GGSKVGLPLVRRALELLPDVGFVN

SEQ ID NO: 816926 - protein, 32 aa, Mycobacterium; identical to SEQ ID NO: 146767

SEQ ID NO: 816927 - protein, 26 aa, Mycobacterium
GGSKVPLPLVRKALSLLPDVGFVNAY

SEQ ID NO: 816928 - protein, 25 aa, Mycobacterium
GGSLAITVPRWLPEKICWLLSDEYH

SEQ ID NO: 816929 - protein, 27 aa, Mycobacterium
GGSLGMLFDTVLGLTAVLLTGSRRQRT

SEQ ID NO: 816930 - protein, 26 aa, Mycobacterium
GGSLHEPLLTVAWPNAHLGPMGLEGA

SEQ ID NO: 816931 - protein, 26 aa, Mycobacterium
GGSLVTGWATLHGYPLGILANARGVL

SEQ ID NO: 816932 - protein, 29 aa, Mycobacterium
GGSMLYIQSLLDDWSFPATDPAVRARWEQ

SEQ ID NO: 816933 - protein, 29 aa, Mycobacterium
GGSMLYIQSLLDDWSFPATDPAVRARWER

SEQ ID NO: 816934 - protein, 29 aa, Mycobacterium
GGSMLYIQSLLDEWSFPATDPAVRAKYEA

SEQ ID NO: 816935 - protein, 18 aa, Mycobacterium
GGSMRRLNFLVTGVPFCG

SEQ ID NO: 816936 - protein, 23 aa, Mycobacterium
GGSPLPENLGIGPGIPGGRGGDG

SEQ ID NO: 816937 - protein, 24 aa, Mycobacterium
GGSPLSVRIGYRGPNARLAAVGGA

SEQ ID NO: 816938 - protein, 24 aa, Mycobacterium
GGSPPAELAWVEPILAATTTLQVA

SEQ ID NO: 816939 - protein, 23 aa, Mycobacterium
GGSPPAELVWVEPILEATTTLQV

SEQ ID NO: 816940 - protein, 23 aa, Mycobacterium
GGSPTLMPLVSPVGQPGALALEG

SEQ ID NO: 816941 - protein, 32 aa, Mycobacterium
GGSPWPSWRTHPLLFPFLHGHSGGILRLEVPA

SEQ ID NO: 816942 - protein, 25 aa, Mycobacterium
GGSRLPMPDLIRLAANAIHYLAVFD

SEQ ID NO: 816943 - protein, 24 aa, Mycobacterium
GGSRVGLPLVRRALELLPDVGFVN

SEQ ID NO: 816944 - protein, 26 aa, Mycobacterium
GGSSPGATGGWGGQGGLGGVGTAGVG

SEQ ID NO: 816945 - protein, 28 aa, Mycobacterium
GGSSRITLWAMAWLARAHFVSGDWDAAL

SEQ ID NO: 816946 - protein, 23 aa, Mycobacterium
GGSSSMNAMMWVRGFKADYDEWA

SEQ ID NO: 816947 - protein, 27 aa, Mycobacterium
GGSTLFGRWELPAFMQIVAGLAEAMRD

SEQ ID NO: 816948 - protein, 32 aa, Mycobacterium
GGSTVRLPRQIPYAFAMELLLTADLVDAERAL

SEQ ID NO: 816949 - protein, 18 aa, Mycobacterium
GGSVLPPPVTPPPAQPAS

SEQ ID NO: 816950 - protein, 28 aa, Mycobacterium
GGSVLQVGPLMPSLVRKLADDYDARRLP

SEQ ID NO: 816951 - protein, 24 aa, Mycobacterium
GGSVPPPPLTPPPTVPAGESMGPA

SEQ ID NO: 816952 - protein, 31 aa, Mycobacterium
GGSVRFIGVDGYRWMIRCVLQGPAETFDALA

SEQ ID NO: 816953 - protein, 25 aa, Mycobacterium
GGSVTRIWLGPKRLVPPMVMVTSPQ

SEQ ID NO: 816954 - protein, 21 aa, Mycobacterium
GGSWFRYAGNGQWNWQRDFFD

SEQ ID NO: 816955 - protein, 22 aa, Mycobacterium
GGSWLLPKTVGLQQAKRLVLLA

SEQ ID NO: 816956 - protein, 17 aa, Mycobacterium
GGSYIALEFAQMYRRFG

SEQ ID NO: 816957 - protein, 28 aa, Mycobacterium
GGTAFSPLPRIFYTAAVSDLFINPVDPA

SEQ ID NO: 816958 - protein, 29 aa, Mycobacterium
GGTAGAAGPLTNAGLAGGFGTGGTGGTGG

SEQ ID NO: 816959 - protein, 24 aa, Mycobacterium
GGTAIIITFERIDPFAFGGLAVAG

SEQ ID NO: 816960 - protein, 17 aa, Mycobacterium
GGTAPRTPLLSNLLGIS

SEQ ID NO: 816961 - protein, 18 aa, Mycobacterium
GGTDHEKLFTRDGWMRMG

SEQ ID NO: 816962 - protein, 26 aa, Mycobacterium
GGTEDLAAMMGLGEPAAQLGGQLAEG

SEQ ID NO: 816963 - protein, 21 aa, Mycobacterium
GGTEFGGLIPGLQSASAQLAD

SEQ ID NO: 816964 - protein, 20 aa, Mycobacterium
GGTFGAQWLVDNRPDLFSGV

SEQ ID NO: 816965 - protein, 24 aa, Mycobacterium
GGTFLQRAIFHLPGLTAAIDELQR

SEQ ID NO: 816966 - protein, 24 aa, Mycobacterium
GGTFVISWEFDLANGRWTHSGATQ

SEQ ID NO: 816967 - protein, 29 aa, Mycobacterium
GGTGAWDPAFTQHYYRPVGFDDGGVLPPG

SEQ ID NO: 816968 - protein, 26 aa, Mycobacterium
GGTGGAALGWFGNGGAGGDGGAGGAS

SEQ ID NO: 816969 - protein, 26 aa, Mycobacterium
GGTGGAGGIGLNLGNPGTPGSQGATG

SEQ ID NO: 816970 - protein, 23 aa, Mycobacterium
GGTGGLFGAGGLGGTGGASGMDT

SEQ ID NO: 816971 - protein, 20 aa, Mycobacterium
GGTGGNSYYAGNAGPGGQGG

SEQ ID NO: 816972 - protein, 25 aa, Mycobacterium
GGTGGTGGLLWGNGGIGGQGGTAMA

SEQ ID NO: 816973 - protein, 22 aa, Mycobacterium
GGTGIGLLRRVGERGDEIDWSK

SEQ ID NO: 816974 - protein, 26 aa, Mycobacterium
GGTGLLDLLDRLGITPLPNTAGCRGA

SEQ ID NO: 816975 - protein, 25 aa, Mycobacterium
GGTGLLDLLNRLGITPLPNTAGCRS

SEQ ID NO: 816976 - protein, 19 aa, Mycobacterium
GGTGLVRDGGVGGAGGAGG

SEQ ID NO: 816977 - protein, 26 aa, Mycobacterium
GGTGQGGISFLAPGGQTGGDGSTGGT

SEQ ID NO: 816978 - protein, 29 aa, Mycobacterium
GGTHLGHFVTPLIERTWPAVMRVARRLYD

SEQ ID NO: 816979 - protein, 30 aa, Mycobacterium
GGTIAHGLLTLSLLPHFTHQLYRVDNITMA

SEQ ID NO: 816980 - protein, 30 aa, Mycobacterium
GGTIAHGLLTLSLLPRFMHELYSVEGVKMA

SEQ ID NO: 816981 - protein, 17 aa, Mycobacterium
GGTILWMADERAIADHV

SEQ ID NO: 816982 - protein, 17 aa, Mycobacterium
GGTITTYLIPSPTLPML

SEQ ID NO: 816983 - protein, 22 aa, Mycobacterium
GGTLRTYLRLLSAETAFQRAST

SEQ ID NO: 816984 - protein, 29 aa, Mycobacterium
GGTNPITDSLFLIGYQLGCQSDVSSGLQI

SEQ ID NO: 816985 - protein, 23 aa, Mycobacterium
GGTPREPRIIRRKSYSMAPCTVD

SEQ ID NO: 816986 - protein, 22 aa, Mycobacterium
GGTPRTVFPLTFAELVRITGGQ

SEQ ID NO: 816987 - protein, 21 aa, Mycobacterium
GGTPTAFDRVLATRFGVNAAD

SEQ ID NO: 816988 - protein, 26 aa, Mycobacterium
GGTPTIITGPILIPTAATPSLTGGTP

SEQ ID NO: 816989 - protein, 26 aa, Mycobacterium
GGTQSLHKLLMKRRRLRAERLVFLGV

SEQ ID NO: 816990 - protein, 20 aa, Mycobacterium
GGTRLAEGLKQAAALMEGHE

SEQ ID NO: 816991 - protein, 20 aa, Mycobacterium
GGTRLFRDRGVFSSGLVGVR

SEQ ID NO: 816992 - protein, 24 aa, Mycobacterium
GGTRPYGIAKALWEVLERARTHLD

SEQ ID NO: 816993 - protein, 23 aa, Mycobacterium
GGTSRFGGLGGNGGVGGKAGLIG

SEQ ID NO: 816994 - protein, 25 aa, Mycobacterium
GGTTAIGLIAIQLAKALGASMVAAT

SEQ ID NO: 816995 - protein, 27 aa, Mycobacterium
GGTTGPWEPWLYSWPEVFTSAGEFTAR

SEQ ID NO: 816996 - protein, 28 aa, Mycobacterium
GGTVETYLHRRAADLPPAVGVLVEYTGA

SEQ ID NO: 816997 - protein, 20 aa, Mycobacterium
GGTVFCCRFGLGLHGGREED

SEQ ID NO: 816998 - protein, 25 aa, Mycobacterium
GGTVLRLPDIRALLTRHLAGRPTRA

SEQ ID NO: 816999 - protein, 27 aa, Mycobacterium
GGTVVNWPWRRLVLSRSANVYARLVLG

SEQ ID NO: 817000 - protein, 18 aa, Mycobacterium
GGTYLLSRAPGQLGLHAA

SEQ ID NO: 817001 - protein, 24 aa, Mycobacterium
GGVAAPLLVFYHGGGWVIGDLDTH

SEQ ID NO: 817002 - protein, 24 aa, Mycobacterium
GGVATVRWSAVPPGIFDAAEDTVE

SEQ ID NO: 817003 - protein, 23 aa, Mycobacterium
GGVCAMILDHVLGAAVHQPGRPA

SEQ ID NO: 817004 - protein, 31 aa, Mycobacterium
GGVDTWKMDIHPWWVAFTQGAGVTTLAFDHP

SEQ ID NO: 817005 - protein, 22 aa, Mycobacterium
GGVEFPVIYEGPPGLVHGGFLG

SEQ ID NO: 817006 - protein, 32 aa, Mycobacterium
GGVEHAVLHLLYSRFWHKVLYDLGHVSSREPY

SEQ ID NO: 817007 - protein, 34 aa, Mycobacterium
GGVEHAVLHLLYSRFWHKVLYDLGYVSSREPYRR

SEQ ID NO: 817008 - protein, 23 aa, Mycobacterium
GGVELADLPYPAAAIGALKTAFV

SEQ ID NO: 817009 - protein, 20 aa, Mycobacterium
GGVFASLFTCGIAVPHMIAS

SEQ ID NO: 817010 - protein, 23 aa, Mycobacterium
GGVFQNVLLLRACRERLQRKGFE

SEQ ID NO: 817011 - protein, 27 aa, Mycobacterium
GGVFRIVEQLPRKVALELIYTGEPISS

SEQ ID NO: 817012 - protein, 23 aa, Mycobacterium
GGVFRIVEQLPRKVALELVLTGE

SEQ ID NO: 817013 - protein, 20 aa, Mycobacterium
GGVGALGTGWSIFNHATADA

SEQ ID NO: 817014 - protein, 19 aa, Mycobacterium
GGVGGFGDIGGKGGSGGTG

SEQ ID NO: 817015 - protein, 21 aa, Mycobacterium
GGVGPLTRAFLLTNVIERAER

SEQ ID NO: 817016 - protein, 24 aa, Mycobacterium
GGVGPWVGDLPDDLRYDPELLRDG

SEQ ID NO: 817017 - protein, 27 aa, Mycobacterium
GGVGTPRALILAELLERIAASADRLAV

SEQ ID NO: 817018 - protein, 23 aa, Mycobacterium
GGVHLCLTIELWNQWKAAVDKAI

SEQ ID NO: 817019 - protein, 24 aa, Mycobacterium
GGVHPFDLGFVNGFVRRVGGRVEA

SEQ ID NO: 817020 - protein, 28 aa, Mycobacterium
GGVIDFEVETFMDGVTLQAKGGRGGNGG

SEQ ID NO: 817021 - protein, 24 aa, Mycobacterium
GGVINTISGQYLIGNGINGTADNP

SEQ ID NO: 817022 - protein, 30 aa, Mycobacterium
GGVLERFNGLYLPIVDVLFNGATPPDSPYP

SEQ ID NO: 817023 - protein, 18 aa, Mycobacterium
GGVLLRPFARLIASTGDS

SEQ ID NO: 817024 - protein, 24 aa, Mycobacterium
GGVLPPELLFSHPGYLRAANGIEI

SEQ ID NO: 817025 - protein, 25 aa, Mycobacterium
GGVLTYVEYLYLRQIRRTLSRGTQR

SEQ ID NO: 817026 - protein, 25 aa, Mycobacterium
GGVLYRYWVDTDRAARFLLVVLTQT

SEQ ID NO: 817027 - protein, 23 aa, Mycobacterium
GGVMPRFPLPLGESGPHPERVEV

SEQ ID NO: 817028 - protein, 24 aa, Mycobacterium
GGVNPDAWLLALGTELELAAARLD

SEQ ID NO: 817029 - protein, 25 aa, Mycobacterium
GGVPKTLIQHLIRWVISSGEFNDEV

SEQ ID NO: 817030 - protein, 25 aa, Mycobacterium
GGVPKTLIQHLIRWVISSGQFESDV

SEQ ID NO: 817031 - protein, 25 aa, Mycobacterium
GGVPKTLIQHLIRWVISSNQFDDVV

SEQ ID NO: 817032 - protein, 26 aa, Mycobacterium
GGVPKTLIQHLIRWVISSQQFESKVS

SEQ ID NO: 817033 - protein, 18 aa, Mycobacterium
GGVPTFDAVREKIETRYG

SEQ ID NO: 817034 - protein, 25 aa, Mycobacterium
GGVPVVMKALLDAGLLRGDCLTVTG

SEQ ID NO: 817035 - protein, 24 aa, Mycobacterium
GGVPVVMKTLLDAGLLHGDCLTVT

SEQ ID NO: 817036 - protein, 19 aa, Mycobacterium
GGVQALRIWGAGATGSRLV

SEQ ID NO: 817037 - protein, 27 aa, Mycobacterium
GGVQVRIPGLPPVTIGPHTPAVIDPEW

SEQ ID NO: 817038 - protein, 18 aa, Mycobacterium
GGVRAIRAFTAIAGLAAP

SEQ ID NO: 817039 - protein, 29 aa, Mycobacterium
GGVRDWGRAFAWMGMPDEYFASSGNAPIA

SEQ ID NO: 817040 - protein, 33 aa, Mycobacterium
GGVRIDHIIGLFRLWWIPKGALPLEGTYVRYDH

SEQ ID NO: 817041 - protein, 22 aa, Mycobacterium
GGVRSFGPLRASLGLDPSALQE

SEQ ID NO: 817042 - protein, 21 aa, Mycobacterium
GGVSRVWRFDRMATVCDPGSG

SEQ ID NO: 817043 - protein, 20 aa, Mycobacterium
GGVTLPLTYRFEPGAVDDGV

SEQ ID NO: 817044 - protein, 32 aa, Mycobacterium
GGVVNEEVAPWLDLVRKLGVLAASLSDGPPVS

SEQ ID NO: 817045 - protein, 31 aa, Mycobacterium
GGVVNEEVAPWLDLVRKLGVLAATLSDGPPV

SEQ ID NO: 817046 - protein, 25 aa, Mycobacterium
GGVVPDALTVLVRLLAGLHDDDGNV

SEQ ID NO: 817047 - protein, 27 aa, Mycobacterium
GGVVRFIGVDGYRWMVRCVVNGVPETV

SEQ ID NO: 817048 - protein, 22 aa, Mycobacterium
GGWAGIAWPTEYGGKGLTLLQQ

SEQ ID NO: 817049 - protein, 22 aa, Mycobacterium
GGWARFARFHLGRNGAVHGGAL

SEQ ID NO: 817050 - protein, 20 aa, Mycobacterium
GGWFMQRTVFHRSGLAAARD

SEQ ID NO: 817051 - protein, 18 aa, Mycobacterium
GGWITSWIVGPFKGIPGS

SEQ ID NO: 817052 - protein, 20 aa, Mycobacterium
GGWLAGLHPAELLGSIQRSV

SEQ ID NO: 817053 - protein, 17 aa, Mycobacterium
GGWLLGDGGAGGSGAPG

SEQ ID NO: 817054 - protein, 17 aa, Mycobacterium
GGWLLGNGGNGGSGAAG

SEQ ID NO: 817055 - protein, 31 aa, Mycobacterium
GGWNLFMTLGYLPPQLREKLGFGWTAAQQRR

SEQ ID NO: 817056 - protein, 18 aa, Mycobacterium
GGWVRYANFDYAASAPAL

SEQ ID NO: 817057 - protein, 17 aa, Mycobacterium
GGYAEMLVVHQSGLARI

SEQ ID NO: 817058 - protein, 25 aa, Mycobacterium
GGYAINRTAWLKPLAGKLTTSLEAY

SEQ ID NO: 817059 - protein, 26 aa, Mycobacterium
GGYAPNRTGWLLPFASQLVSSSEARR

SEQ ID NO: 817060 - protein, 26 aa, Mycobacterium
GGYCGYLMYNLTTNGFRPATFAAIVD

SEQ ID NO: 817061 - protein, 23 aa, Mycobacterium
GGYFPIDPGYPRARKQFMLDDVR

SEQ ID NO: 817062 - protein, 19 aa, Mycobacterium
GGYFRVDLTAATPAPARVD

SEQ ID NO: 817063 - protein, 28 aa, Mycobacterium
GGYGAALLLDAWALLGRQDLRAAEDTLR

SEQ ID NO: 817064 - protein, 25 aa, Mycobacterium
GGYGDTGFGTAGYAGGTGGTGGTGG

SEQ ID NO: 817065 - protein, 21 aa, Mycobacterium
GGYGGALFGSGGSGGGGGAGS

SEQ ID NO: 817066 - protein, 22 aa, Mycobacterium
GGYGGNAGLWGNGGAGGHGGFG

SEQ ID NO: 817067 - protein, 24 aa, Mycobacterium
GGYGGTGFDAAGAMGGIGGTGGTG

SEQ ID NO: 817068 - protein, 17 aa, Mycobacterium
GGYGYLREYGLEKIVRD

SEQ ID NO: 817069 - protein, 19 aa, Mycobacterium
GGYGYMREYPVARAYLDAR

SEQ ID NO: 817070 - protein, 20 aa, Mycobacterium
GGYGYMREYPVARAYLDSRV

SEQ ID NO: 817071 - protein, 23 aa, Mycobacterium
GGYHLWVSLPPQSDSRQFAAEAL

SEQ ID NO: 817072 - protein, 25 aa, Mycobacterium
GGYIGPITIPSITIVGPPINATVGP

SEQ ID NO: 817073 - protein, 26 aa, Mycobacterium
GGYNVANCLLAVALLDAVDVSPEQAA

SEQ ID NO: 817074 - protein, 28 aa, Mycobacterium
GGYRDTEIVRWLFTPDPSLTITRDGSRD

SEQ ID NO: 817075 - protein, 19 aa, Mycobacterium
GGYRKKYLRAMSRLLALTA

SEQ ID NO: 817076 - protein, 17 aa, Mycobacterium
GGYSEMLYVRESALVRV

SEQ ID NO: 817077 - protein, 17 aa, Mycobacterium
GGYTFDRLREALSLRVK

SEQ ID NO: 817078 - protein, 19 aa, Mycobacterium
GGYTYGGRIAALADAAREN

SEQ ID NO: 817079 - protein, 18 aa, Mycobacterium
GGYVLPGSRLDRTGGIGL

SEQ ID NO: 817080 - protein, 25 aa, Mycobacterium
GGYWSFPHGHLCLWTWAANPQDRPL

SEQ ID NO: 817081 - protein, 23 aa, Mycobacterium
GGYYFSTHFSYNALPRPAVYTVG

SEQ ID NO: 817082 - protein, 27 aa, Mycobacterium
GHAASPRFDPAIWPLTAHPDEEGRLCV

SEQ ID NO: 817083 - protein, 23 aa, Mycobacterium
GHADPLLHWVAEPQAVHVDAGQV

SEQ ID NO: 817084 - protein, 26 aa, Mycobacterium
GHAERFLRELPGLRLIGLDRDPSALD

SEQ ID NO: 817085 - protein, 30 aa, Mycobacterium
GHAFWDTEGFVLPVLTYTAPRAAADALRWR

SEQ ID NO: 817086 - protein, 29 aa, Mycobacterium
GHAFWDTEGFVLPVLTYTKPQAAADALRW

SEQ ID NO: 817087 - protein, 25 aa, Mycobacterium
GHAGATNFGFFDSGNYNAGSFNAGN

SEQ ID NO: 817088 - protein, 36 aa, Mycobacterium
GHAHSVVIPFLLPDIPVVVWWPDIAPAVPAQDPLGK

SEQ ID NO: 817089 - protein, 34 aa, Mycobacterium
GHAKTPYFLQLEDPAKIALMRRIKQSFDPAGILN

SEQ ID NO: 817090 - protein, 25 aa, Mycobacterium
GHALGGGCELAMMCDLLIAADTAKF

SEQ ID NO: 817091 - protein, 28 aa, Mycobacterium
GHALKASIAWRTLRARLLSRRGDDDEAR

SEQ ID NO: 817092 - protein, 20 aa, Mycobacterium
GHASPLLYAAFKAVGVITDT

SEQ ID NO: 817093 - protein, 25 aa, Mycobacterium
GHAVKTFYRDAFAKHQKLFDELGVN

SEQ ID NO: 817094 - protein, 27 aa, Mycobacterium
GHAVVMSYWNPVLRYGVDAFARELAAA

SEQ ID NO: 817095 - protein, 37 aa, Mycobacterium
GHAVYRTMLLHLMRLAGNLGWMPIGGWALRAIVAALM

SEQ ID NO: 817096 - protein, 43 aa, Mycobacterium
GHAYAGELLFLYNGIRPRHVMPVHGTWRMLRANSKLAARTGVP

SEQ ID NO: 817097 - protein, 32 aa, Mycobacterium
GHAYAGELLFLYNGVRPRNVMPVHGTWRMLRA

SEQ ID NO: 817098 - protein, 43 aa, Mycobacterium
GHAYAGELLFLYNGVRPRNVMPVHGTWRMLRANAALAARTGVP

SEQ ID NO: 817099 - protein, 18 aa, Mycobacterium
GHCHLPVISLRRHYPVRF

SEQ ID NO: 817100 - protein, 26 aa, Mycobacterium
GHCYGVGLINWWDPRGARRTLTELKS

SEQ ID NO: 817101 - protein, 23 aa, Mycobacterium
GHDDQAHVDLLWSLSRAPDPDAA

SEQ ID NO: 817102 - protein, 23 aa, Mycobacterium
GHDELVLVKQIPMYSTCEHHLVS

SEQ ID NO: 817103 - protein, 23 aa, Mycobacterium
GHDFTYRFSVPDPGTYWAHPHVG

SEQ ID NO: 817104 - protein, 25 aa, Mycobacterium
GHDGMGWLAQRGYVPLGYKGDAAKT

SEQ ID NO: 817105 - protein, 25 aa, Mycobacterium
GHDGMGWLAQRGYVPLGYKGDATKT

SEQ ID NO: 817106 - protein, 24 aa, Mycobacterium
GHDIAATIRPLGCVIGLRSDDGTP

SEQ ID NO: 817107 - protein, 30 aa, Mycobacterium
GHDLTLTLTEFRLLSFLVLHAGQAFTRTRL

SEQ ID NO: 817108 - protein, 23 aa, Mycobacterium
GHDLYNGVSGIALFLAAHAAVTG

SEQ ID NO: 817109 - protein, 20 aa, Mycobacterium
GHDPAFVPAFDIPGAEELLN

SEQ ID NO: 817110 - protein, 23 aa, Mycobacterium
GHDQLFDTLFVYENYPIDKTAAQ

SEQ ID NO: 817111 - protein, 18 aa, Mycobacterium
GHDQRRFLELFKRDLEPR

SEQ ID NO: 817112 - protein, 18 aa, Mycobacterium
GHDQRRFLELFQRDLEPR

SEQ ID NO: 817113 - protein, 30 aa, Mycobacterium
GHDRHGLYYLEMPPALFAPIVENLAKADLL

SEQ ID NO: 817114 - protein, 25 aa, Mycobacterium
GHDRLFDTLFVYENYPIDANALLSV

SEQ ID NO: 817115 - protein, 25 aa, Mycobacterium
GHDRLRLALVLCAVRPDIGGVLIRG

SEQ ID NO: 817116 - protein, 25 aa, Mycobacterium
GHDRLRLALVLSAVRPDIGGVLIRG

SEQ ID NO: 817117 - protein, 34 aa, Mycobacterium
GHDYAVISLSDRLKPWEIISERLAAAAAADLVLA

SEQ ID NO: 817118 - protein, 30 aa, Mycobacterium
GHEALRGCTWLPFFHDMGLITVMVPSMLGK

SEQ ID NO: 817119 - protein, 24 aa, Mycobacterium
GHEDQDVWRYFASVAFPSEAMVRN

SEQ ID NO: 817120 - protein, 25 aa, Mycobacterium
GHEGMGWLAQRGYVPLGYKGDAAKT

SEQ ID NO: 817121 - protein, 19 aa, Mycobacterium
GHEGSLAHGPFPLADERYL

SEQ ID NO: 817122 - protein, 18 aa, Mycobacterium
GHEIACHGLRWKSYQEID

SEQ ID NO: 817123 - protein, 24 aa, Mycobacterium
GHEKLFDTLFAYENYPLETSAMAV

SEQ ID NO: 817124 - protein, 20 aa, Mycobacterium
GHELLKRSVIVLNDIHDCAS

SEQ ID NO: 817125 - protein, 18 aa, Mycobacterium
GHELRVYADLYVTFTGVV

SEQ ID NO: 817126 - protein, 22 aa, Mycobacterium
GHELYLVGGPVRDALLGRFDPD

SEQ ID NO: 817127 - protein, 17 aa, Mycobacterium
GHEPTMSALALGLGRAG

SEQ ID NO: 817128 - protein, 26 aa, Mycobacterium
GHERTMLWLGYANLLGELATDFTPAG

SEQ ID NO: 817129 - protein, 24 aa, Mycobacterium
GHERTMMWLGFADRLDNLIADLHP

SEQ ID NO: 817130 - protein, 24 aa, Mycobacterium
GHERTMMWLGFADRLDNLLADFRP

SEQ ID NO: 817131 - protein, 23 aa, Mycobacterium
GHERTMMWLGFADRLENMIDDFQ

SEQ ID NO: 817132 - protein, 25 aa, Mycobacterium
GHEVGWSMLPLARNALRRIGNDTDV

SEQ ID NO: 817133 - protein, 26 aa, Mycobacterium
GHEVGWSMLPVARSVLRRIGDDTDIV

SEQ ID NO: 817134 - protein, 26 aa, Mycobacterium
GHEVGWSMLPVARSVLRRIGDTTDVV

SEQ ID NO: 817135 - protein, 26 aa, Mycobacterium
GHEVGWSMLPVARTALRRIGNDADVV

SEQ ID NO: 817136 - protein, 25 aa, Mycobacterium
GHEWDLVVIAGLQDGLWPNTIPRGG

SEQ ID NO: 817137 - protein, 24 aa, Mycobacterium
GHFALTAHVLPLLRAAQGARVVSL

SEQ ID NO: 817138 - protein, 22 aa, Mycobacterium
GHFALTAHVLPLLRATPAARVV

SEQ ID NO: 817139 - protein, 25 aa, Mycobacterium
GHFALTGHLLPLLRAGRARVTSHTS

SEQ ID NO: 817140 - protein, 18 aa, Mycobacterium
GHFALTNLLLPKISDRVV

SEQ ID NO: 817141 - protein, 18 aa, Mycobacterium
GHFFDRSGLLLATVVQEG

SEQ ID NO: 817142 - protein, 26 aa, Mycobacterium
GHFGQSGTFLWVDPGASVALIVLTDR

SEQ ID NO: 817143 - protein, 19 aa, Mycobacterium
GHFNAVELILCFNQLAYSA

SEQ ID NO: 817144 - protein, 27 aa, Mycobacterium
GHFNDFVIVALIRSALYRAAVNHGDGP

SEQ ID NO: 817145 - protein, 17 aa, Mycobacterium
GHFSSPYAGITRSGSYG

SEQ ID NO: 817146 - protein, 27 aa, Mycobacterium
GHFVPNLTIGLPVVESLLAVSRIPMDC

SEQ ID NO: 817147 - protein, 26 aa, Mycobacterium
GHFVPNLTLGLPVVESLLAASDIPMD

SEQ ID NO: 817148 - protein, 18 aa, Mycobacterium
GHGAAIAAALRERLDPTR

SEQ ID NO: 817149 - protein, 20 aa, Mycobacterium
GHGALPVARTALAAGAAALG

SEQ ID NO: 817150 - protein, 30 aa, Mycobacterium
GHGAQGFFDAQAQMLSGLQGLIETVGQHGT

SEQ ID NO: 817151 - protein, 24 aa, Mycobacterium
GHGDLLVTVKVAVPPNLEGEAAEA

SEQ ID NO: 817152 - protein, 27 aa, Mycobacterium
GHGDPVEIMRLCAALWLDACADPEIQR

SEQ ID NO: 817153 - protein, 43 aa, Mycobacterium
GHGFAVGLLSVPHAWIAALPDAAAVDIGWIGAPIRLVTACALP

SEQ ID NO: 817154 - protein, 20 aa, Mycobacterium
GHGGLLFGNGGGGGDAGLNN

SEQ ID NO: 817155 - protein, 24 aa, Mycobacterium
GHGGTGGAAGLWGVGGHGGDGAHG

SEQ ID NO: 817156 - protein, 29 aa, Mycobacterium
GHGILTWHVPMLFRTPPGYNLLVRGPANY

SEQ ID NO: 817157 - protein, 19 aa, Mycobacterium
GHGKRWESLFTRHLSDIPA

SEQ ID NO: 817158 - protein, 21 aa, Mycobacterium
GHGLSWEMLPDAALAQPAVWE

SEQ ID NO: 817159 - protein, 22 aa, Mycobacterium
GHGMRVRILTYGGIIQSIEVPD

SEQ ID NO: 817160 - protein, 34 aa, Mycobacterium
GHGQAYQRLANQLMAFHDQFAQALTAGASAYTGA

SEQ ID NO: 817161 - protein, 27 aa, Mycobacterium
GHGQREAYMSFLIVATEALEAAASDVA

SEQ ID NO: 817162 - protein, 32 aa, Mycobacterium
GHGQVVDLSIYEPLFWILGAQTSAYDQLGTLP

SEQ ID NO: 817163 - protein, 20 aa, Mycobacterium
GHGRPALGTLPLLTQVLDAV

SEQ ID NO: 817164 - protein, 17 aa, Mycobacterium
GHGTLVRALRNDGLDPT

SEQ ID NO: 817165 - protein, 22 aa, Mycobacterium
GHGYLFSSFLSPATNLRDDEYG

SEQ ID NO: 817166 - protein, 22 aa, Mycobacterium
GHGYLLSSFFSPNLNRRTDRFG

SEQ ID NO: 817167 - protein, 17 aa, Mycobacterium
GHHAIALTLPGLDDGDD

SEQ ID NO: 817168 - protein, 25 aa, Mycobacterium
GHHCALPLHRKFGVAATARASFAVY

SEQ ID NO: 817169 - protein, 26 aa, Mycobacterium
GHHCAQPILRRLGLEQTVRPSFAFYN

SEQ ID NO: 817170 - protein, 27 aa, Mycobacterium
GHHCAQPILRRYGLEATVRPSFAFYNT

SEQ ID NO: 817171 - protein, 25 aa, Mycobacterium
GHHDGGLVSTYLYERARRGMVVGLA

SEQ ID NO: 817172 - protein, 23 aa, Mycobacterium
GHHGRNWLFFGDQHRSANFYYRD

SEQ ID NO: 817173 - protein, 31 aa, Mycobacterium
GHHHLTSVYIEDGLLRLGAETVEHRLNEALQ

SEQ ID NO: 817174 - protein, 36 aa, Mycobacterium
GHHLINRVKTWLQFPQWFYMNNPPNVFEPPRITPGG

SEQ ID NO: 817175 - protein, 18 aa, Mycobacterium
GHHQLFLHACDVSRLPDG

SEQ ID NO: 817176 - protein, 20 aa, Mycobacterium
GHHQLFLHGCDISRIPDGSY

SEQ ID NO: 817177 - protein, 24 aa, Mycobacterium
GHHRGRVVAVDLQRLVVEIDRIVV

SEQ ID NO: 817178 - protein, 24 aa, Mycobacterium
GHIAWLQKGWPELFDRLAMALPRL

SEQ ID NO: 817179 - protein, 28 aa, Mycobacterium
GHICPISMTYAVVPALRYNPELAAVYEP

SEQ ID NO: 817180 - protein, 21 aa, Mycobacterium
GHIFHGALQWPFAEDDEPLST

SEQ ID NO: 817181 - protein, 18 aa, Mycobacterium
GHIGTVASALFGDNNGVK

SEQ ID NO: 817182 - protein, 23 aa, Mycobacterium
GHIPVMLDRCYELLAPALTADST

SEQ ID NO: 817183 - protein, 20 aa, Mycobacterium
GHKDGFFIGASLFDHVTPEM

SEQ ID NO: 817184 - protein, 19 aa, Mycobacterium
GHKWAMLTAYDYSTARVFD

SEQ ID NO: 817185 - protein, 20 aa, Mycobacterium
GHKWSMLTAYDYSTARVFND

SEQ ID NO: 817186 - protein, 17 aa, Mycobacterium
GHLARAFGAHAFVADFR

SEQ ID NO: 817187 - protein, 26 aa, Mycobacterium
GHLASLLYGVPHVLTAHSLEPLRPWK

SEQ ID NO: 817188 - protein, 28 aa, Mycobacterium
GHLDEISAWRFIVPPAAFLGSLLVDTKG

SEQ ID NO: 817189 - protein, 20 aa, Mycobacterium
GHLDIGHRTIPNYGGFDLGV

SEQ ID NO: 817190 - protein, 25 aa, Mycobacterium
GHLDPTMFAAFMPGALELTVEEGIA

SEQ ID NO: 817191 - protein, 27 aa, Mycobacterium
GHLDPTMFAAFMPGVLELTIEEGIANG

SEQ ID NO: 817192 - protein, 26 aa, Mycobacterium
GHLDPTMFAAFMPGVLELTVEEGIAN

SEQ ID NO: 817193 - protein, 22 aa, Mycobacterium
GHLDPTVFQRLAPGIMPLSVAE

SEQ ID NO: 817194 - protein, 28 aa, Mycobacterium
GHLEQLGRALALLPQGRAAARVPARQQQ

SEQ ID NO: 817195 - protein, 19 aa, Mycobacterium
GHLEWYADGMFPPMQIDAE

SEQ ID NO: 817196 - protein, 43 aa, Mycobacterium
GHLGIYVTEVRWWGARPLWFALWSGVFERFPGLRWGVTECGAF

SEQ ID NO: 817197 - protein, 45 aa, Mycobacterium
GHLGIYVTEVRWWGARPLWFALWSGVFERFPRLRWGVTECGAFWA

SEQ ID NO: 817198 - protein, 18 aa, Mycobacterium
GHLGLPADFLIAPDGRVL

SEQ ID NO: 817199 - protein, 17 aa, Mycobacterium
GHLGWRVPSSLSVIEPP

SEQ ID NO: 817200 - protein, 19 aa, Mycobacterium
GHLIAMGPNIRFLSGDYWD

SEQ ID NO: 817201 - protein, 31 aa, Mycobacterium
GHLKKDRLFDLIERMRLPTVFFAEGGGGRPG

SEQ ID NO: 817202 - protein, 17 aa, Mycobacterium
GHLLAIAPTVRVQTKTG

SEQ ID NO: 817203 - protein, 21 aa, Mycobacterium
GHLPPVLRVYEACGRVLAGTV

SEQ ID NO: 817204 - protein, 18 aa, Mycobacterium
GHLPRFAAFRRDGARVLD

SEQ ID NO: 817205 - protein, 22 aa, Mycobacterium
GHLSALLYGVPHVLTAHSLEPM

SEQ ID NO: 817206 - protein, 22 aa, Mycobacterium
GHLTHGMRINFSGKLYNVAAYE

SEQ ID NO: 817207 - protein, 21 aa, Mycobacterium
GHMLDLEMLLMLRGKERTRAQ

SEQ ID NO: 817208 - protein, 20 aa, Mycobacterium
GHMYFHRRIWQQILSVLTEA

SEQ ID NO: 817209 - protein, 34 aa, Mycobacterium
GHNGLTAAVLLAKAGLRTVCLDPKLYAGGMASTV

SEQ ID NO: 817210 - protein, 19 aa, Mycobacterium
GHNLVAITRPLISDPFEAQ

SEQ ID NO: 817211 - protein, 19 aa, Mycobacterium
GHNPIAIVVPCHRVIGANG

SEQ ID NO: 817212 - protein, 22 aa, Mycobacterium
GHNRWHPDIPPVVTVKRGDTFR

SEQ ID NO: 817213 - protein, 28 aa, Mycobacterium
GHNYIGTEHILLGLIREGEGVAAQVLVK

SEQ ID NO: 817214 - protein, 18 aa, Mycobacterium
GHNYLASSFLSPLINRRI

SEQ ID NO: 817215 - protein, 32 aa, Mycobacterium
GHPAAAPDLGRWQPPAVLPQHLGDLLLKESDV

SEQ ID NO: 817216 - protein, 17 aa, Mycobacterium
GHPAGVFSWSPPAALVT

SEQ ID NO: 817217 - protein, 24 aa, Mycobacterium
GHPCQGLYHRAAGTRPTVAMIATH

SEQ ID NO: 817218 - protein, 24 aa, Mycobacterium
GHPDHYGGILPLLDAFDRTLPVAT

SEQ ID NO: 817219 - protein, 22 aa, Mycobacterium
GHPDWLDAFDDDWLEFSVSADK

SEQ ID NO: 817220 - protein, 22 aa, Mycobacterium
GHPGENPWFGRLPRLDPADVVR

SEQ ID NO: 817221 - protein, 20 aa, Mycobacterium
GHPGGPRPYLPLATLVVRGK

SEQ ID NO: 817222 - protein, 23 aa, Mycobacterium
GHPGIVAPPAMIQVWTMGGLGQG

SEQ ID NO: 817223 - protein, 26 aa, Mycobacterium
GHPHALQLIMDSLRYWVIEMHVDGFR

SEQ ID NO: 817224 - protein, 26 aa, Mycobacterium
GHPHALQLIMDSLRYWVLEMHVDGFR

SEQ ID NO: 817225 - protein, 20 aa, Mycobacterium
GHPHRVDIAELPWSHTETTT

SEQ ID NO: 817226 - protein, 20 aa, Mycobacterium
GHPQRFIIKANWKSAAEQFA

SEQ ID NO: 817227 - protein, 22 aa, Mycobacterium
GHPRFLVPHIVASAPKVVIQEW

SEQ ID NO: 817228 - protein, 29 aa, Mycobacterium
GHPRLFDTLFVYENYPINDLTALCPDQLT

SEQ ID NO: 817229 - protein, 21 aa, Mycobacterium
GHPRRAVIDRAWRAIGPGVEV

SEQ ID NO: 817230 - protein, 21 aa, Mycobacterium
GHPRRSVIDAAWRAIGPGVEV

SEQ ID NO: 817231 - protein, 26 aa, Mycobacterium
GHPSAPLVVIGPLYCPIHETTPGPGS

SEQ ID NO: 817232 - protein, 23 aa, Mycobacterium
GHPTAGWWDGVAGPGAPIDTDHW

SEQ ID NO: 817233 - protein, 18 aa, Mycobacterium
GHPTVGAAWYLRDIGRPI

SEQ ID NO: 817234 - protein, 17 aa, Mycobacterium
GHPVAWIHATALRTEPL

SEQ ID NO: 817235 - protein, 22 aa, Mycobacterium
GHPVAWIHATALRTEPLAYAGR

SEQ ID NO: 817236 - protein, 26 aa, Mycobacterium
GHPVSAATWYLLRDDGLLVNMDVARK

SEQ ID NO: 817237 - protein, 21 aa, Mycobacterium
GHPVVIARRHWPELLRVVHGD

SEQ ID NO: 817238 - protein, 17 aa, Mycobacterium
GHQGAAEILRPISRKYD

SEQ ID NO: 817239 - protein, 20 aa, Mycobacterium
GHQLALDLGFSLTDVTMIAT

SEQ ID NO: 817240 - protein, 19 aa, Mycobacterium
GHQLAVLFEGAVALATTLN

SEQ ID NO: 817241 - protein, 21 aa, Mycobacterium
GHRAFLEIGPHPALSANIREL

SEQ ID NO: 817242 - protein, 17 aa, Mycobacterium
GHRAGWADRVRLAHALG

SEQ ID NO: 817243 - protein, 19 aa, Mycobacterium
GHRATLLQGPRFVGTGPQV

SEQ ID NO: 817244 - protein, 23 aa, Mycobacterium
GHRAVSAVLYPGLPSHPGHEVAA

SEQ ID NO: 817245 - protein, 24 aa, Mycobacterium
GHREIGLLTMRLGRDRRQGLVDAD

SEQ ID NO: 817246 - protein, 17 aa, Mycobacterium
GHRHLIDRLLANDQLPS

SEQ ID NO: 817247 - protein, 20 aa, Mycobacterium
GHRIALLACDFRFLGGSIGI

SEQ ID NO: 817248 - protein, 19 aa, Mycobacterium
GHRLAFNAAFAELGLDISW

SEQ ID NO: 817249 - protein, 18 aa, Mycobacterium
GHRLMETWHPLGVVGVIT

SEQ ID NO: 817250 - protein, 37 aa, Mycobacterium
GHRLRDHSWGPRSWQAPWFCRWMHGCSNGFGFMVANF

SEQ ID NO: 817251 - protein, 22 aa, Mycobacterium
GHRLRMIGVTWGDEASAQAALL

SEQ ID NO: 817252 - protein, 26 aa, Mycobacterium
GHRLTIAMTRWHATVSWAGSEPATVE

SEQ ID NO: 817253 - protein, 23 aa, Mycobacterium
GHRLTIVMDAWTISVDGPDDQPS

SEQ ID NO: 817254 - protein, 24 aa, Mycobacterium
GHRMLANWLTYCGAPLDEPLVRSL

SEQ ID NO: 817255 - protein, 22 aa, Mycobacterium
GHRMLANWLTYCGWARNDTLVR

SEQ ID NO: 817256 - protein, 26 aa, Mycobacterium
GHRQYNPAWNLAIDLRNMLLVSECVA

SEQ ID NO: 817257 - protein, 19 aa, Mycobacterium
GHRRFGLAELYRQPGDSPH

SEQ ID NO: 817258 - protein, 17 aa, Mycobacterium
GHRRLKIIDLSEAGAQP

SEQ ID NO: 817259 - protein, 32 aa, Mycobacterium
GHRSRNWEPEPLRWLGVRGLYIAYKLADRHEA

SEQ ID NO: 817260 - protein, 18 aa, Mycobacterium
GHRVLDDSFILCFNAHFE

SEQ ID NO: 817261 - protein, 24 aa, Mycobacterium
GHRWGLASFNPARRARYRAAVDLA

SEQ ID NO: 817262 - protein, 29 aa, Mycobacterium
GHSERFLTDFPALRLIGLDRDPNALAIAG

SEQ ID NO: 817263 - protein, 18 aa, Mycobacterium
GHSGGCELVLRMATSPRA

SEQ ID NO: 817264 - protein, 23 aa, Mycobacterium
GHSLFEYWRNGYRTFHGFTSCGF

SEQ ID NO: 817265 - protein, 21 aa, Mycobacterium
GHSNLLFRRNSVTGAVEVVAR

SEQ ID NO: 817266 - protein, 27 aa, Mycobacterium
GHSSLTLYIQLYLGGFGLELSDIEALR

SEQ ID NO: 817267 - protein, 18 aa, Mycobacterium
GHSWHAMQHVPVDELAAL

SEQ ID NO: 817268 - protein, 27 aa, Mycobacterium
GHTAAMVSAALWPVHAWRSDYMTDEDF

SEQ ID NO: 817269 - protein, 25 aa, Mycobacterium
GHTAFLIFTRRLAPGVVAPAPLGRK

SEQ ID NO: 817270 - protein, 24 aa, Mycobacterium
GHTAFLVFTRRLAPGVVAPAPLGR

SEQ ID NO: 817271 - protein, 34 aa, Mycobacterium
GHTAPAVLGPIGSITLLPLYFELDGSFPNHEANP

SEQ ID NO: 817272 - protein, 33 aa, Mycobacterium
GHTARLFRRSPWVGWSELFRVLVRLLGAGHTVD

SEQ ID NO: 817273 - protein, 22 aa, Mycobacterium
GHTDAVLWDIDRPNPALLTQGM

SEQ ID NO: 817274 - protein, 24 aa, Mycobacterium
GHTGPIATTLLLPSVLDAVADTGM

SEQ ID NO: 817275 - protein, 25 aa, Mycobacterium
GHTGPIATTLLLPSVLDAVADTGMP

SEQ ID NO: 817276 - protein, 18 aa, Mycobacterium
GHTITVNGDLVFTPGPEG

SEQ ID NO: 817277 - protein, 22 aa, Mycobacterium
GHTLREHLGLSPTPGWAGNPAG

SEQ ID NO: 817278 - protein, 19 aa, Mycobacterium
GHTPGSIALALDGPATGGV

SEQ ID NO: 817279 - protein, 20 aa, Mycobacterium
GHTPGSIALALDGPATGGVT

SEQ ID NO: 817280 - protein, 23 aa, Mycobacterium
GHTRLWAPAYQPRRAKKYRELTW

SEQ ID NO: 817281 - protein, 24 aa, Mycobacterium
GHTRRAIVRLLLESGSITAGEIGD

SEQ ID NO: 817282 - protein, 21 aa, Mycobacterium
GHTTLRYAMRALESESLRDLE

SEQ ID NO: 817283 - protein, 26 aa, Mycobacterium
GHTVDAYLYLVRLDGTPAVAAEIEEM

SEQ ID NO: 817284 - protein, 22 aa, Mycobacterium
GHVALPPPLTTGGPPIWIGGNG

SEQ ID NO: 817285 - protein, 28 aa, Mycobacterium
GHVDADLWRRYTSILLEGMRHHPGQEPV

SEQ ID NO: 817286 - protein, 25 aa, Mycobacterium
GHVDHQRLGWRQAPVGPALADALGL

SEQ ID NO: 817287 - protein, 24 aa, Mycobacterium
GHVDIVAAIPTPGRLLLHTQRAEA

SEQ ID NO: 817288 - protein, 32 aa, Mycobacterium
GHVDPHWHPMDLLVLLFGVGLAWAQSPHPDAV

SEQ ID NO: 817289 - protein, 17 aa, Mycobacterium
GHVFGLTGPIMHVDTAC

SEQ ID NO: 817290 - protein, 23 aa, Mycobacterium
GHVGAVWRGTWHGGLEFTKKCCA

SEQ ID NO: 817291 - protein, 26 aa, Mycobacterium
GHVIFMDLPVVFDLDIALKGTGDMPY

SEQ ID NO: 817292 - protein, 20 aa, Mycobacterium
GHVNHTIWWKNLSPHGGDKP

SEQ ID NO: 817293 - protein, 25 aa, Mycobacterium
GHVNNVVYYAWFDTAVNGWLMEAAG

SEQ ID NO: 817294 - protein, 23 aa, Mycobacterium
GHVNPRHQLQYSLTVREVVMTGI

SEQ ID NO: 817295 - protein, 23 aa, Mycobacterium
GHVRLPLREVMWGADPELLQSTE

SEQ ID NO: 817296 - protein, 25 aa, Mycobacterium
GHVSGLIALVHPQAFIASLDAAQRA

SEQ ID NO: 817297 - protein, 17 aa, Mycobacterium
GHVSGLIALVHPQAFLA

SEQ ID NO: 817298 - protein, 22 aa, Mycobacterium
GHVSWLDIFAIGSVLPGSFVAR

SEQ ID NO: 817299 - protein, 18 aa, Mycobacterium
GHVVRRNIITFRRGELST

SEQ ID NO: 817300 - protein, 18 aa, Mycobacterium
GHVYLCEFAHRWVDDLTI

SEQ ID NO: 817301 - protein, 17 aa, Mycobacterium
GHWEGDLLIGLQRSAIG

SEQ ID NO: 817302 - protein, 32 aa, Mycobacterium
GHWIPDAPARPIALLGTLLAWHTSHNSLSDRP

SEQ ID NO: 817303 - protein, 21 aa, Mycobacterium
GHWLEPLTTLTYLAARTERIR

SEQ ID NO: 817304 - protein, 24 aa, Mycobacterium
GHYDFRLEIGGVLVSWAIPSGPST

SEQ ID NO: 817305 - protein, 33 aa, Mycobacterium
GHYDIVHSHYWLSGQVGWLARDRWAVPLVHTAH

SEQ ID NO: 817306 - protein, 32 aa, Mycobacterium
GHYGMCGRAYDPRFLFAWPSAKSAVMGGAQLA

SEQ ID NO: 817307 - protein, 32 aa, Mycobacterium
GHYGMCGRAYDPRFLFAWPSAKSAVMGGAQLS

SEQ ID NO: 817308 - protein, 32 aa, Mycobacterium
GHYGMCGRAYDPRFLFAWPSAKSAVMGGTQLA

SEQ ID NO: 817309 - protein, 26 aa, Mycobacterium
GHYGPLFIRMAWHAAGTYRVSDGRGG

SEQ ID NO: 817310 - protein, 21 aa, Mycobacterium
GHYLALRHFPMTSFSPGYRSV

SEQ ID NO: 817311 - protein, 19 aa, Mycobacterium
GHYRFPQLRFIASVGEPLN

SEQ ID NO: 817312 - protein, 24 aa, Mycobacterium
GHYSFLNVFKLFGPGNQAPLSFPI

SEQ ID NO: 817313 - protein, 21 aa, Mycobacterium
GHYSVMFEPALLDLADGRLAE

SEQ ID NO: 817314 - protein, 25 aa, Mycobacterium
GHYVGYVHLQRLLREPPAELVGGIV

SEQ ID NO: 817315 - protein, 17 aa, Mycobacterium
GHYVPGSLPSYDELLRL

SEQ ID NO: 817316 - protein, 23 aa, Mycobacterium
GIAELSPKLTTWLRGHDLEIVTK

SEQ ID NO: 817317 - protein, 23 aa, Mycobacterium
GIAEWIFPTILDRGSDLQRDRFG

SEQ ID NO: 817318 - protein, 20 aa, Mycobacterium
GIAFGWDRIVALLAGLDSIR

SEQ ID NO: 817319 - protein, 27 aa, Mycobacterium
GIAGLIKTVLMLQRGQLLPSGAFEVPN

SEQ ID NO: 817320 - protein, 17 aa, Mycobacterium
GIAHAWRQIAYGDADIA

SEQ ID NO: 817321 - protein, 19 aa, Mycobacterium
GIALAEELVALLGAPEETP

SEQ ID NO: 817322 - protein, 21 aa, Mycobacterium
GIALLSRYPVASWQVLRLPRI

SEQ ID NO: 817323 - protein, 21 aa, Mycobacterium
GIALRRCPLLDAARRYPTIVC

SEQ ID NO: 817324 - protein, 17 aa, Mycobacterium
GIAMHAWIRQHGDLSHA

SEQ ID NO: 817325 - protein, 18 aa, Mycobacterium
GIANAVFDGYRPWAGEIR

SEQ ID NO: 817326 - protein, 38 aa, Mycobacterium
GIAPGDRVLLQLPNGRRFAVALFGLLRAGAVPVMCLPG

SEQ ID NO: 817327 - protein, 18 aa, Mycobacterium
GIAPGWLAGRLRAPLNRV

SEQ ID NO: 817328 - protein, 27 aa, Mycobacterium
GIAPPAQHQLLKPFTARYFEAISGVWA

SEQ ID NO: 817329 - protein, 18 aa, Mycobacterium
GIAPSNIYPTADGSWVVI

SEQ ID NO: 817330 - protein, 26 aa, Mycobacterium
GIARRTLFRYYPSKSALPWGDFDAHL

SEQ ID NO: 817331 - protein, 17 aa, Mycobacterium
GIASLFNGALFRAATCE

SEQ ID NO: 817332 - protein, 21 aa, Mycobacterium
GIASLFNGALFRAATLESVGV

SEQ ID NO: 817333 - protein, 26 aa, Mycobacterium
GIASRHDLKWHSRLRDRVLAAITEFV

SEQ ID NO: 817334 - protein, 25 aa, Mycobacterium
GIASTVFMPVTVALPKLAATKAYGA

SEQ ID NO: 817335 - protein, 20 aa, Mycobacterium
GIATALLHRGASVLLTDVLG

SEQ ID NO: 817336 - protein, 18 aa, Mycobacterium
GIATGYEIQMALVRGICL

SEQ ID NO: 817337 - protein, 17 aa, Mycobacterium
GIAVLMVGGGLVSRCEV

SEQ ID NO: 817338 - protein, 18 aa, Mycobacterium
GIAVRKLWVSAGPVPSAV

SEQ ID NO: 817339 - protein, 28 aa, Mycobacterium
GIAYLAGLARWRQRVLIRVTPDVDVHGH

SEQ ID NO: 817340 - protein, 20 aa, Mycobacterium
GIAYLHVLVEPSAPAFAAVR

SEQ ID NO: 817341 - protein, 18 aa, Mycobacterium
GICQRLHTASLKTVVIGA

SEQ ID NO: 817342 - protein, 32 aa, Mycobacterium
GICQWFHGDAIYRAVLALLMLTGSMGRNGGGW

SEQ ID NO: 817343 - protein, 20 aa, Mycobacterium
GICRQAGLSARYFYESFPDK

SEQ ID NO: 817344 - protein, 17 aa, Mycobacterium
GIDAFTRACAIEWGPDG

SEQ ID NO: 817345 - protein, 24 aa, Mycobacterium
GIDAPGRRLLLGSGFELDYDYLIY

SEQ ID NO: 817346 - protein, 25 aa, Mycobacterium
GIDARGFLLGAAVAIRLGVGVLAVR

SEQ ID NO: 817347 - protein, 25 aa, Mycobacterium
GIDDPAFDGLPFFEAKRAAKEILLD

SEQ ID NO: 817348 - protein, 27 aa, Mycobacterium
GIDEFDADFFGFPPLAAQVLDPQHRLF

SEQ ID NO: 817349 - protein, 20 aa, Mycobacterium
GIDERYFDFLVTPRRREDGS

SEQ ID NO: 817350 - protein, 26 aa, Mycobacterium
GIDESTAFVLLKWRSQENNVKLRPLA

SEQ ID NO: 817351 - protein, 27 aa, Mycobacterium
GIDFTNIYFYTVLYHALRASNRIAIER

SEQ ID NO: 817352 - protein, 26 aa, Mycobacterium
GIDFTNIYFYTVLYHALRASNRISIE

SEQ ID NO: 817353 - protein, 28 aa, Mycobacterium
GIDGAQRPWAALGAQLLLVETLRATGKI

SEQ ID NO: 817354 - protein, 23 aa, Mycobacterium
GIDHVDIFYSHRIDPVTPLEETI

SEQ ID NO: 817355 - protein, 26 aa, Mycobacterium
GIDLDLPRDSLIVFTGLSGSGKSSLA

SEQ ID NO: 817356 - protein, 19 aa, Mycobacterium
GIDLILPFEDRVSIVATMC

SEQ ID NO: 817357 - protein, 17 aa, Mycobacterium
GIDLILREAGVAKASLY

SEQ ID NO: 817358 - protein, 21 aa, Mycobacterium
GIDLLALRALMGHVSPETTAR

SEQ ID NO: 817359 - protein, 17 aa, Mycobacterium
GIDLQLALYTCYELHYR

SEQ ID NO: 817360 - protein, 18 aa, Mycobacterium
GIDLVIFEEFGAGAAALH

SEQ ID NO: 817361 - protein, 18 aa, Mycobacterium
GIDMSKSPSFMWLEVDDV

SEQ ID NO: 817362 - protein, 23 aa, Mycobacterium
GIDPFVTAYPLRMVYEGSVRGTG

SEQ ID NO: 817363 - protein, 20 aa, Mycobacterium
GIDPGFANDLLPMALAGTCQ

SEQ ID NO: 817364 - protein, 23 aa, Mycobacterium
GIDPPRGVLLYGPPGCGKTFVVR

SEQ ID NO: 817365 - protein, 19 aa, Mycobacterium
GIDPVRIMTGTGTFYTLRC

SEQ ID NO: 817366 - protein, 23 aa, Mycobacterium
GIDQCVMYPTLASLIEERTTDDV

SEQ ID NO: 817367 - protein, 27 aa, Mycobacterium
GIDQPEQNAWWWDVLRHGRSSAYASYF

SEQ ID NO: 817368 - protein, 26 aa, Mycobacterium
GIDQPQQNAWWWDVLRHGRSSDYATY

SEQ ID NO: 817369 - protein, 27 aa, Mycobacterium
GIDQPRQNPWWWDVLRNGRSSPYATFF

SEQ ID NO: 817370 - protein, 17 aa, Mycobacterium
GIDRRDWPLFRSVFTDD

SEQ ID NO: 817371 - protein, 21 aa, Mycobacterium
GIDSVLALYSSLDGALSGIAG

SEQ ID NO: 817372 - protein, 18 aa, Mycobacterium
GIDTVDILRFLAGDWHCC

SEQ ID NO: 817373 - protein, 19 aa, Mycobacterium
GIDVFRTAYRRWLAADEGD

SEQ ID NO: 817374 - protein, 18 aa, Mycobacterium
GIDVGGAARRLGRFQAPA

SEQ ID NO: 817375 - protein, 21 aa, Mycobacterium
GIDVLAGLRGWLTAPVIVLSA

SEQ ID NO: 817376 - protein, 27 aa, Mycobacterium
GIDVTRWVFAPRPPADGTPPVLLFVGR

SEQ ID NO: 817377 - protein, 20 aa, Mycobacterium
GIEAIRLLHAAQGPPALALT

SEQ ID NO: 817378 - protein, 17 aa, Mycobacterium
GIEDRPALSPGSAVLVV

SEQ ID NO: 817379 - protein, 17 aa, Mycobacterium
GIEFLATPDSYYEDPEL

SEQ ID NO: 817380 - protein, 24 aa, Mycobacterium
GIEFMPVVWALFEWGRRHLPGRNR

SEQ ID NO: 817381 - protein, 20 aa, Mycobacterium
GIEGIRAFTQARAFVRHPVP

SEQ ID NO: 817382 - protein, 24 aa, Mycobacterium
GIEGLDELFVGPTAIAFIEGEPVD

SEQ ID NO: 817383 - protein, 25 aa, Mycobacterium
GIEIALPFERPLYQPPTEVAVESHV

SEQ ID NO: 817384 - protein, 25 aa, Mycobacterium
GIEKNLEYRYWTQGVTFVTRMDYLA

SEQ ID NO: 817385 - protein, 25 aa, Mycobacterium
GIEKNLEYRYWTQGVTFVTRMDYLS

SEQ ID NO: 817386 - protein, 23 aa, Mycobacterium
GIELCRDLLSDLPELRCLMLTSF

SEQ ID NO: 817387 - protein, 19 aa, Mycobacterium
GIELDPDWLFDIQVKRIHE

SEQ ID NO: 817388 - protein, 26 aa, Mycobacterium
GIELFDATFFGYPPAEAAMIDPQHRL

SEQ ID NO: 817389 - protein, 18 aa, Mycobacterium
GIELPRRVFAHGFLHNRG

SEQ ID NO: 817390 - protein, 26 aa, Mycobacterium
GIELRYLLTLYVYRFGVTTVAELVQM

SEQ ID NO: 817391 - protein, 20 aa, Mycobacterium
GIELVECTEYFKDTTFRVFQ

SEQ ID NO: 817392 - protein, 17 aa, Mycobacterium
GIENLDFNEVFFTDVRV

SEQ ID NO: 817393 - protein, 34 aa, Mycobacterium
GIEPGDRVAIWSPNTWHWVVASLAIHHAGGVLVP

SEQ ID NO: 817394 - protein, 24 aa, Mycobacterium
GIEPMFAIAYIRAVIGRRLLEVNP

SEQ ID NO: 817395 - protein, 25 aa, Mycobacterium
GIEQFGYLWDTPVPNWRRVVDVNIS

SEQ ID NO: 817396 - protein, 30 aa, Mycobacterium
GIERAKGMLMLIYGLSDSAAFELLRWLSQE

SEQ ID NO: 817397 - protein, 20 aa, Mycobacterium
GIERFYVWFADFAAPQTISE

SEQ ID NO: 817398 - protein, 24 aa, Mycobacterium
GIERTFAGYLNLAGKRPAAEEFSG

SEQ ID NO: 817399 - protein, 22 aa, Mycobacterium
GIERTLAGSLLLAGVRPADIPL

SEQ ID NO: 817400 - protein, 17 aa, Mycobacterium
GIERVKATLPRLGELAI

SEQ ID NO: 817401 - protein, 23 aa, Mycobacterium
GIERVRATLPRLGELAIGGTAVG

SEQ ID NO: 817402 - protein, 24 aa, Mycobacterium
GIESHVWHLARALIRQGHAVTLCA

SEQ ID NO: 817403 - protein, 25 aa, Mycobacterium
GIEVMRRHGLPVPPAFCITTEVGLR

SEQ ID NO: 817404 - protein, 17 aa, Mycobacterium
GIEYGHPVIVIGGKPHE

SEQ ID NO: 817405 - protein, 46 aa, Mycobacterium
GIFDGLQQITPAGLLYLIGPMAWTLGYPIVPMLTPGSLDFNGVVFN

SEQ ID NO: 817406 - protein, 21 aa, Mycobacterium
GIFDSMRTLAPPTARGWEVVA

SEQ ID NO: 817407 - protein, 46 aa, Mycobacterium
GIFEDFPQISPAGLLYLAGPMAWTFGLPIVPMLNPGSIDFNGVVFG

SEQ ID NO: 817408 - protein, 18 aa, Mycobacterium
GIFENMWFCAVRTSDLEK

SEQ ID NO: 817409 - protein, 20 aa, Mycobacterium
GIFNSIWGDFPAAVSWQRTS

SEQ ID NO: 817410 - protein, 19 aa, Mycobacterium
GIFRAAMVGLPPPPDLPPG

SEQ ID NO: 817411 - protein, 18 aa, Mycobacterium
GIFRNMCASIFAVGSEDL

SEQ ID NO: 817412 - protein, 31 aa, Mycobacterium
GIFSETAFDQAYLATLLGFPLVESADLVVRE

SEQ ID NO: 817413 - protein, 17 aa, Mycobacterium
GIFVIIDPDAHYGEGAS

SEQ ID NO: 817414 - protein, 18 aa, Mycobacterium
GIGAGYARRFARDGYDLV

SEQ ID NO: 817415 - protein, 19 aa, Mycobacterium
GIGAGYARRYANDGYDLVL

SEQ ID NO: 817416 - protein, 24 aa, Mycobacterium
GIGAIPNDAWLSSSGLLIDDGVVC

SEQ ID NO: 817417 - protein, 21 aa, Mycobacterium
GIGAIRGTAGTGGYGGLLLGQ

SEQ ID NO: 817418 - protein, 26 aa, Mycobacterium
GIGALLLRRDVACVPLLHGGGQERDV

SEQ ID NO: 817419 - protein, 23 aa, Mycobacterium
GIGAMWARHIREGLSRLAESTLT

SEQ ID NO: 817420 - protein, 40 aa, Mycobacterium
GIGASVGLACDLIYAADTAFFLLAFANIGLMPDGGSSALV

SEQ ID NO: 817421 - protein, 24 aa, Mycobacterium
GIGAWAGPPPQWWAGRFGIEPGLA

SEQ ID NO: 817422 - protein, 27 aa, Mycobacterium
GIGCSSRFPYYLDTYGMHSIHGRAPAI

SEQ ID NO: 817423 - protein, 24 aa, Mycobacterium
GIGDLFGGLFGQRAQPRASRPRRG

SEQ ID NO: 817424 - protein, 30 aa, Mycobacterium
GIGDPLLVLRINFLGMRQFTESLLDRMPAG

SEQ ID NO: 817425 - protein, 26 aa, Mycobacterium
GIGDPLLVVRINFLGTRQFTEALVDR

SEQ ID NO: 817426 - protein, 30 aa, Mycobacterium
GIGDPLLVVTINFLGLRQLTEALLPMMGPG

SEQ ID NO: 817427 - protein, 29 aa, Mycobacterium
GIGEGFLTEPWWCRTLVLAAARTARRHGV

SEQ ID NO: 817428 - protein, 25 aa, Mycobacterium
GIGEGFLTEPWWCRTLVLTAERTAR

SEQ ID NO: 817429 - protein, 24 aa, Mycobacterium
GIGFELAMLLADDGYDLIVAADDE

SEQ ID NO: 817430 - protein, 23 aa, Mycobacterium
GIGFSPDKMLLGRVFAYADAHRY

SEQ ID NO: 817431 - protein, 25 aa, Mycobacterium
GIGFVFQHYAAFKHLSVRDNVAFGL

SEQ ID NO: 817432 - protein, 25 aa, Mycobacterium
GIGFVFQHYAAFKHLTVRDNVAFGL

SEQ ID NO: 817433 - protein, 23 aa, Mycobacterium
GIGGAALGLFGAGGAGGTGGEGG

SEQ ID NO: 817434 - protein, 32 aa, Mycobacterium
GIGGDALAEILLPFGVPRFFQTDPSQFMPQLP

SEQ ID NO: 817435 - protein, 18 aa, Mycobacterium
GIGGGWYEHEWRAYGYGF

SEQ ID NO: 817436 - protein, 27 aa, Mycobacterium
GIGGTSGLLLGLDGFNAPTSTSPIHTL

SEQ ID NO: 817437 - protein, 20 aa, Mycobacterium
GIGGTWWANRYPGVRTDSEY

SEQ ID NO: 817438 - protein, 25 aa, Mycobacterium
GIGGYDFEFFRRAALPRLHALAPLR

SEQ ID NO: 817439 - protein, 31 aa, Mycobacterium
GIGIDTTYPLHRYFLWAKHNELTLGPATVQL

SEQ ID NO: 817440 - protein, 24 aa, Mycobacterium
GIGISYFESKLPAGTPVVRAMPNA

SEQ ID NO: 817441 - protein, 19 aa, Mycobacterium
GIGLLRYLGSQGPQIDWSK

SEQ ID NO: 817442 - protein, 19 aa, Mycobacterium
GIGLSTFPLTSGSKGLHLY

SEQ ID NO: 817443 - protein, 19 aa, Mycobacterium
GIGMLRFDALGLGDSDGDW

SEQ ID NO: 817444 - protein, 18 aa, Mycobacterium
GIGMLRFDALGLGDSEGG

SEQ ID NO: 817445 - protein, 26 aa, Mycobacterium
GIGMLTVFEELFWGDAGIALSILGTG

SEQ ID NO: 817446 - protein, 27 aa, Mycobacterium
GIGMTWEYPAHLYLKRAKSDQLALGTA

SEQ ID NO: 817447 - protein, 17 aa, Mycobacterium
GIGPHQVWWLSELTADP

SEQ ID NO: 817448 - protein, 26 aa, Mycobacterium
GIGPITATLFHLSPVPGFGNSTGSPS

SEQ ID NO: 817449 - protein, 22 aa, Mycobacterium
GIGPPITDGFYYDFDVPEPFTP

SEQ ID NO: 817450 - protein, 28 aa, Mycobacterium
GIGPVAPTPIMHWLHSVPGPVERFNQTV

SEQ ID NO: 817451 - protein, 27 aa, Mycobacterium
GIGPVVATPIMRWLQTIDGPIDEFNQT

SEQ ID NO: 817452 - protein, 27 aa, Mycobacterium
GIGPVVATPIMRWLQTVDGPIDDFNQT

SEQ ID NO: 817453 - protein, 25 aa, Mycobacterium
GIGREMHMDPFLPNEGAPGRGPTLV

SEQ ID NO: 817454 - protein, 23 aa, Mycobacterium
GIGREMHVIVGQGKLSEILESRP

SEQ ID NO: 817455 - protein, 24 aa, Mycobacterium
GIGREMHVIVGQGKLSEILESRPE

SEQ ID NO: 817456 - protein, 35 aa, Mycobacterium
GIGRLRAISRNLLRRYRFYRVPPRSAPNSLAPTQH

SEQ ID NO: 817457 - protein, 18 aa, Mycobacterium
GIGRPRLKTSLLAAADMK

SEQ ID NO: 817458 - protein, 23 aa, Mycobacterium
GIGRRLLDELLAFADGGVVFLEV

SEQ ID NO: 817459 - protein, 23 aa, Mycobacterium
GIGRRLLDELLVFADGGAVFLEV

SEQ ID NO: 817460 - protein, 19 aa, Mycobacterium
GIGRWLHTLGYRGHITTKS

SEQ ID NO: 817461 - protein, 19 aa, Mycobacterium
GIGSGYARRYARDGYDLVL

SEQ ID NO: 817462 - protein, 20 aa, Mycobacterium
GIGSLLMGIPTAGGLHFAGR

SEQ ID NO: 817463 - protein, 17 aa, Mycobacterium
GIGTADLFHDEDLAYAE

SEQ ID NO: 817464 - protein, 20 aa, Mycobacterium
GIGTFSWPGAYGTWWQADPG

SEQ ID NO: 817465 - protein, 24 aa, Mycobacterium
GIGVLHVPGFRRSAPDSPQRVAGT

SEQ ID NO: 817466 - protein, 32 aa, Mycobacterium
GIGVLYGRRDVLAAMPPFLTGGSMIETVTMEE

SEQ ID NO: 817467 - protein, 32 aa, Mycobacterium
GIGVLYGRRELLAAMPPFLTGGSMIETVTMEA

SEQ ID NO: 817468 - protein, 25 aa, Mycobacterium
GIGVSGLMETFLPSGSPLGNIGNSW

SEQ ID NO: 817469 - protein, 21 aa, Mycobacterium
GIGYLHLPALGGRRGRQSVDP

SEQ ID NO: 817470 - protein, 17 aa, Mycobacterium
GIHFCLGAPLARLETAT

SEQ ID NO: 817471 - protein, 23 aa, Mycobacterium
GIHHKPVVLLDPAGHYRGLLDWL

SEQ ID NO: 817472 - protein, 17 aa, Mycobacterium
GIHIAGGRTWELDPRDW

SEQ ID NO: 817473 - protein, 18 aa, Mycobacterium
GIHLLPATDVLAELAIKA

SEQ ID NO: 817474 - protein, 19 aa, Mycobacterium
GIHNSLTRLLIKPSHLAGG

SEQ ID NO: 817475 - protein, 17 aa, Mycobacterium
GIHPLVLTPDGTGVWLG

SEQ ID NO: 817476 - protein, 22 aa, Mycobacterium
GIHQAMEFLPWGNRQALGDLGE

SEQ ID NO: 817477 - protein, 18 aa, Mycobacterium
GIHQATLNAWLRAADADE

SEQ ID NO: 817478 - protein, 19 aa, Mycobacterium
GIHRLIESWPTVVSAHPDA

SEQ ID NO: 817479 - protein, 31 aa, Mycobacterium
GIHTYDFVMQQWEILKPLMSPGGLVLFDDIT

SEQ ID NO: 817480 - protein, 26 aa, Mycobacterium
GIHTYLKRATLNRSLFGSPAAQRRRL

SEQ ID NO: 817481 - protein, 25 aa, Mycobacterium
GIIAHGLCTMAFTSWAALTELADSR

SEQ ID NO: 817482 - protein, 26 aa, Mycobacterium
GIIAHGLCTMAFTSWAVLTEVGGSDV

SEQ ID NO: 817483 - protein, 30 aa, Mycobacterium
GIIALDAQYYGHFWVTNALNRTYYGATVSS

SEQ ID NO: 817484 - protein, 19 aa, Mycobacterium
GIIANWWRQGMQGGAKAHY

SEQ ID NO: 817485 - protein, 19 aa, Mycobacterium
GIIARRLRKDIYDLYGYSA

SEQ ID NO: 817486 - protein, 18 aa, Mycobacterium
GIIAYPVTPFLPDDTVDI

SEQ ID NO: 817487 - protein, 24 aa, Mycobacterium
GIIAYQGLHELTVPEWNRVVATNQ

SEQ ID NO: 817488 - protein, 18 aa, Mycobacterium
GIIDDILRRCPAGTRVVV

SEQ ID NO: 817489 - protein, 17 aa, Mycobacterium
GIIGRRPVIGRSTHDAA

SEQ ID NO: 817490 - protein, 19 aa, Mycobacterium
GIISAPSVILATGGLGQLY

SEQ ID NO: 817491 - protein, 20 aa, Mycobacterium
GIISAPSVILATGGLGQLYS

SEQ ID NO: 817492 - protein, 17 aa, Mycobacterium
GIITLLELGPQAARPVL

SEQ ID NO: 817493 - protein, 18 aa, Mycobacterium
GIIYRLYEIYPQGHRLAG

SEQ ID NO: 817494 - protein, 18 aa, Mycobacterium
GIKIIRKAIHRSRGRFGF

SEQ ID NO: 817495 - protein, 25 aa, Mycobacterium
GIKKLSVRVGIVPPGKNSAPTVGNP

SEQ ID NO: 817496 - protein, 17 aa, Mycobacterium
GIKPVSVWLSHEYVRAA

SEQ ID NO: 817497 - protein, 32 aa, Mycobacterium
GIKRPDYSITGWVILTLIQHGTAWQIERFVEK

SEQ ID NO: 817498 - protein, 24 aa, Mycobacterium
GIKVLDLSTLLPGPLATLMLAEAG

SEQ ID NO: 817499 - protein, 33 aa, Mycobacterium
GIKVPPFGSYAGRLYQYWRRNLDPERYRRDDPA

SEQ ID NO: 817500 - protein, 18 aa, Mycobacterium
GIKVSLLDAALETQLREL

SEQ ID NO: 817501 - protein, 23 aa, Mycobacterium
GILAAVKRLYLLGKNDRPTGTFT

SEQ ID NO: 817502 - protein, 17 aa, Mycobacterium
GILAPAGDEVSAAVATL

SEQ ID NO: 817503 - protein, 27 aa, Mycobacterium
GILDRLPRPYMLIAMDLQGGMSEPDKQ

SEQ ID NO: 817504 - protein, 18 aa, Mycobacterium
GILELIAELGADGMTMVV

SEQ ID NO: 817505 - protein, 23 aa, Mycobacterium
GILGVGPYPRPGGVDADLINAGK

SEQ ID NO: 817506 - protein, 22 aa, Mycobacterium
GILKPDIVYFGENVPKDLVAEA

SEQ ID NO: 817507 - protein, 19 aa, Mycobacterium
GILMVFCTARVYDGFGPEV

SEQ ID NO: 817508 - protein, 21 aa, Mycobacterium
GILPGSLYHHFESKEAILIEL

SEQ ID NO: 817509 - protein, 21 aa, Mycobacterium
GILRVLAPLFRLGLGGRVGDG

SEQ ID NO: 817510 - protein, 27 aa, Mycobacterium
GILSGVYLTLISPIGRFLLAEAIREAH

SEQ ID NO: 817511 - protein, 24 aa, Mycobacterium
GIMAALRNALRAQLFVGAAPAEAL

SEQ ID NO: 817512 - protein, 20 aa, Mycobacterium
GIMSDALKDSIVGKAPEPGQ

SEQ ID NO: 817513 - protein, 19 aa, Mycobacterium
GINASDLNWQQAALLAGMV

SEQ ID NO: 817514 - protein, 18 aa, Mycobacterium
GINCLTGQHWLDACAMLG

SEQ ID NO: 817515 - protein, 17 aa, Mycobacterium
GINCLTGQHWLDVCAMA

SEQ ID NO: 817516 - protein, 34 aa, Mycobacterium
GINGAAAHLIHPGDLVILIAYGMLDDAAARTYEP

SEQ ID NO: 817517 - protein, 25 aa, Mycobacterium
GINGYGIHPVLLDAVLQAAAVAVDS

SEQ ID NO: 817518 - protein, 25 aa, Mycobacterium
GINHLGHFALTCLLGDRIRDRVVLV

SEQ ID NO: 817519 - protein, 21 aa, Mycobacterium
GINLLRPVRPLRELTAIVGEL

SEQ ID NO: 817520 - protein, 24 aa, Mycobacterium
GINPLSILGGLWNTSTAITAATAR

SEQ ID NO: 817521 - protein, 25 aa, Mycobacterium
GINRTVFDRIAALPLPTIAAVEGNA

SEQ ID NO: 817522 - protein, 20 aa, Mycobacterium
GINWGPWAEVGRAQFFADLG

SEQ ID NO: 817523 - protein, 25 aa, Mycobacterium
GIPAERVRGALMGGYFAGLLDRRVL

SEQ ID NO: 817524 - protein, 18 aa, Mycobacterium
GIPAQFLVDILSDLRTDR

SEQ ID NO: 817525 - protein, 25 aa, Mycobacterium
GIPAVAFWAAVPHYVSQPPNPKATV

SEQ ID NO: 817526 - protein, 27 aa, Mycobacterium
GIPAVTFWAAIPHYVSQPPNPKATVAL

SEQ ID NO: 817527 - protein, 27 aa, Mycobacterium
GIPAVTFWAAVPHYVSHPPNPKATVAL

SEQ ID NO: 817528 - protein, 28 aa, Mycobacterium
GIPAVTFWAAVPHYVSHPPNPKATVALL

SEQ ID NO: 817529 - protein, 28 aa, Mycobacterium
GIPEDIINRIFTPFFTTKPFGEGTGLGL

SEQ ID NO: 817530 - protein, 19 aa, Mycobacterium
GIPEGPRMLLREYLARGDF

SEQ ID NO: 817531 - protein, 18 aa, Mycobacterium
GIPFFASTVAPAPVVVLV

SEQ ID NO: 817532 - protein, 19 aa, Mycobacterium
GIPILRLHDTIYRKTNGRI

SEQ ID NO: 817533 - protein, 23 aa, Mycobacterium
GIPISIDMIRFVKFIVTEIFPGG

SEQ ID NO: 817534 - protein, 17 aa, Mycobacterium
GIPLSRIREALSTLPND

SEQ ID NO: 817535 - protein, 20 aa, Mycobacterium
GIPLVHATPMPYDNYFGGIT

SEQ ID NO: 817536 - protein, 26 aa, Mycobacterium
GIPMPRALQWALIEHILGANPAAYMY

SEQ ID NO: 817537 - protein, 29 aa, Mycobacterium
GIPNLAPFSFFTVVSSQPPMVLLSVEYQP

SEQ ID NO: 817538 - protein, 17 aa, Mycobacterium
GIPPGDIAPPDAAIPGG

SEQ ID NO: 817539 - protein, 21 aa, Mycobacterium
GIPRAIRPPSDVLRLGYNFKD

SEQ ID NO: 817540 - protein, 30 aa, Mycobacterium
GIPRLQFSHTDLLVRAFGSLQGLLAASASD

SEQ ID NO: 817541 - protein, 19 aa, Mycobacterium
GIPSEIFDVLDLKPTFISD

SEQ ID NO: 817542 - protein, 17 aa, Mycobacterium
GIPSRYVSGYLHPKKNA

SEQ ID NO: 817543 - protein, 26 aa, Mycobacterium
GIPTPDGWRMLSGDETGWLLGDYILS

SEQ ID NO: 817544 - protein, 20 aa, Mycobacterium
GIPTPGFSSALSYYDALRTE

SEQ ID NO: 817545 - protein, 24 aa, Mycobacterium
GIPVASIYQYFPGKAAILAVYYRR

SEQ ID NO: 817546 - protein, 17 aa, Mycobacterium
GIPVDIGPGATVAHMCC

SEQ ID NO: 817547 - protein, 26 aa, Mycobacterium
GIPVEEFAVLRKTAPVWWNQQGESIF

SEQ ID NO: 817548 - protein, 32 aa, Mycobacterium
GIPVIDSIAATLWWALELTGSDARIPAAGLLL

SEQ ID NO: 817549 - protein, 27 aa, Mycobacterium
GIPVLDRGFFFARAEPMRSYCMAFDVP

SEQ ID NO: 817550 - protein, 18 aa, Mycobacterium
GIPYPEWNMWTRQFMRDH

SEQ ID NO: 817551 - protein, 42 aa, Mycobacterium
GIPYVAIANAYWSPYSRRRFPLPEVFWSRLFGVRLVKRAYRL

SEQ ID NO: 817552 - protein, 39 aa, Mycobacterium
GIQDLLRELAVLKKTYRIDIPLLAIVPCAVPSSGTVYRQ

SEQ ID NO: 817553 - protein, 21 aa, Mycobacterium
GIQHARWTVIPIVVTDVRVHP

SEQ ID NO: 817554 - protein, 30 aa, Mycobacterium
GIQRAAIAATPYLLHEVLDAAGISIGDIDH

SEQ ID NO: 817555 - protein, 19 aa, Mycobacterium
GIQRPLIVFTPKSMLRNKA

SEQ ID NO: 817556 - protein, 24 aa, Mycobacterium
GIQTNWVIALPPGQTRLLRPVIAL

SEQ ID NO: 817557 - protein, 19 aa, Mycobacterium
GIQWYRVKLDAEYVAAAGA

SEQ ID NO: 817558 - protein, 19 aa, Mycobacterium
GIRAALRATPAPIVGYSPI

SEQ ID NO: 817559 - protein, 18 aa, Mycobacterium
GIRALNSLFGTENLRRVE

SEQ ID NO: 817560 - protein, 24 aa, Mycobacterium
GIRAVTIPFLPVSDRSLHPEPGPT

SEQ ID NO: 817561 - protein, 23 aa, Mycobacterium
GIRCDLHLWDGQIHDFPLAADVL

SEQ ID NO: 817562 - protein, 17 aa, Mycobacterium
GIRDALRAKGHEAELVI

SEQ ID NO: 817563 - protein, 26 aa, Mycobacterium
GIRDGVLFVPFHYGYWDAGGDRGHHR

SEQ ID NO: 817564 - protein, 26 aa, Mycobacterium
GIRDGVLFVPFHYGYWDAGTNGHHRA

SEQ ID NO: 817565 - protein, 24 aa, Mycobacterium
GIREIGFTRFWSRNVRRTRQAYDL

SEQ ID NO: 817566 - protein, 18 aa, Mycobacterium
GIREPHWHPSAWEINVIT

SEQ ID NO: 817567 - protein, 17 aa, Mycobacterium
GIRFVSFSSVNGFFGGS

SEQ ID NO: 817568 - protein, 37 aa, Mycobacterium
GIRGDYMNQFIVFDFTIPRLKSGILLGTRWGEPGASM

SEQ ID NO: 817569 - protein, 36 aa, Mycobacterium
GIRGLHLAYDLLEGWDLLVLVDALPCRVRPGTLRVF

SEQ ID NO: 817570 - protein, 19 aa, Mycobacterium
GIRGLLRINDGSHRLLRYR

SEQ ID NO: 817571 - protein, 29 aa, Mycobacterium
GIRGMHLAYDLLDSWDTLVLVDAVPSRGN

SEQ ID NO: 817572 - protein, 31 aa, Mycobacterium
GIRIPLAEHDVLACWLLEAGGLAADRAPRTV

SEQ ID NO: 817573 - protein, 24 aa, Mycobacterium
GIRLIVAGYGRLPTYPGMVAHQYT

SEQ ID NO: 817574 - protein, 17 aa, Mycobacterium
GIRLVYETPRRGTADSR

SEQ ID NO: 817575 - protein, 25 aa, Mycobacterium
GIRNWDYRYCWLRDASMTASALVAL

SEQ ID NO: 817576 - protein, 22 aa, Mycobacterium
GIRRFGDAFIPMDEALAHAAVD

SEQ ID NO: 817577 - protein, 23 aa, Mycobacterium
GIRSAEVLAIVKKAGFADAMHVQ

SEQ ID NO: 817578 - protein, 20 aa, Mycobacterium
GIRSDAAGRPMPWGNVAIGV

SEQ ID NO: 817579 - protein, 19 aa, Mycobacterium
GIRSLLHQALGIDGTPLDE

SEQ ID NO: 817580 - protein, 21 aa, Mycobacterium
GIRTPCLIRWPGKVVPRESNE

SEQ ID NO: 817581 - protein, 17 aa, Mycobacterium
GIRVLRYGSAPGLDATL

SEQ ID NO: 817582 - protein, 17 aa, Mycobacterium
GIRVLRYGSTGDNLAGT

SEQ ID NO: 817583 - protein, 26 aa, Mycobacterium
GIRVNSVLPGYIWGGTLESYFSHQAG

SEQ ID NO: 817584 - protein, 25 aa, Mycobacterium
GIRVNSVLPGYIWGGTLKSYFEHQA

SEQ ID NO: 817585 - protein, 17 aa, Mycobacterium
GISACLTDLIRFGSLFL

SEQ ID NO: 817586 - protein, 55 aa, Mycobacterium
GISDVRAFFHTNAVPLYFISPTPFNLLGIDRWIRNFFYLTYFDSFEGEHSRVFVP

SEQ ID NO: 817587 - protein, 26 aa, Mycobacterium
GISEKFPLLFSVFSTGVTFVRAEEFS

SEQ ID NO: 817588 - protein, 24 aa, Mycobacterium
GISEKFPLMLSAMSTGVTFVRAEE

SEQ ID NO: 817589 - protein, 26 aa, Mycobacterium
GISEPEALWRFLWKGHCAIGEVPAER

SEQ ID NO: 817590 - protein, 30 aa, Mycobacterium
GISGMHLAYDLLDDWDTLVLVDAVPSRGNP

SEQ ID NO: 817591 - protein, 27 aa, Mycobacterium
GISGMKAWRAVLPADIEMLPVGGVDEN

SEQ ID NO: 817592 - protein, 18 aa, Mycobacterium
GISGPSYRRRAVLAGIEL

SEQ ID NO: 817593 - protein, 26 aa, Mycobacterium
GISISTYFRYAPTKEGLLVDPVRDAA

SEQ ID NO: 817594 - protein, 25 aa, Mycobacterium
GISLDSRLRVVTRREFAGMISVTIE

SEQ ID NO: 817595 - protein, 17 aa, Mycobacterium
GISLLYAFDADCRAAGV

SEQ ID NO: 817596 - protein, 17 aa, Mycobacterium
GISLPMSLTLPGTANRG

SEQ ID NO: 817597 - protein, 24 aa, Mycobacterium
GISNEPPWLTDLTGAIGLTGHAWN

SEQ ID NO: 817598 - protein, 27 aa, Mycobacterium
GISNLANFMRTLPPFVRPNLANNWYRY

SEQ ID NO: 817599 - protein, 33 aa, Mycobacterium
GISRASFYIYFDDKGHLLRRLAGQVFDDLATGA

SEQ ID NO: 817600 - protein, 27 aa, Mycobacterium
GISRKAAKWIPLLKNRVPVVAAELQNT

SEQ ID NO: 817601 - protein, 27 aa, Mycobacterium
GISRKAEKWLPLLENRTPVVAAALLNT

SEQ ID NO: 817602 - protein, 26 aa, Mycobacterium
GISRPKLYRFFTDKEALFAAVAMRVQ

SEQ ID NO: 817603 - protein, 20 aa, Mycobacterium
GISSPLRKLLDDDLTDFHRV

SEQ ID NO: 817604 - protein, 28 aa, Mycobacterium
GISVARLHGYLLAAYAPSDIRDRWLPGL

SEQ ID NO: 817605 - protein, 18 aa, Mycobacterium
GISVPGAPITPLLVQVNG

SEQ ID NO: 817606 - protein, 19 aa, Mycobacterium
GISWPYQTLANHLTNPLIG

SEQ ID NO: 817607 - protein, 17 aa, Mycobacterium
GISYVIVQMRHAEAFGA

SEQ ID NO: 817608 - protein, 19 aa, Mycobacterium
GITAFPLVGIYHASKWALE

SEQ ID NO: 817609 - protein, 26 aa, Mycobacterium
GITCAIRAWAYQIADLAGDYRVIAFD

SEQ ID NO: 817610 - protein, 28 aa, Mycobacterium
GITCAIRAWAYQIVDLAGDYRVIAFDHR

SEQ ID NO: 817611 - protein, 23 aa, Mycobacterium
GITDITPYWRPASWAAGVVVIDA

SEQ ID NO: 817612 - protein, 25 aa, Mycobacterium
GITGIITMPWMFYTGPDAGLDAKID

SEQ ID NO: 817613 - protein, 25 aa, Mycobacterium
GITGIITMPWMFYTGPDASLDDKID

SEQ ID NO: 817614 - protein, 23 aa, Mycobacterium
GITHPQYLVMLTLWDHAKSGADD

SEQ ID NO: 817615 - protein, 18 aa, Mycobacterium
GITHRDITFPERGVVVVG

SEQ ID NO: 817616 - protein, 17 aa, Mycobacterium
GITILREVGLGYQPIGG

SEQ ID NO: 817617 - protein, 24 aa, Mycobacterium
GITIQPIYGAFDIPGARLARDGVP

SEQ ID NO: 817618 - protein, 24 aa, Mycobacterium
GITIRRYYFPFAGSKRIPYRDVKD

SEQ ID NO: 817619 - protein, 28 aa, Mycobacterium
GITLANRPMPLFELLVLCMLASKPIDAT

SEQ ID NO: 817620 - protein, 26 aa, Mycobacterium
GITLFIVPTDSPGFSWKPLHTMPGVS

SEQ ID NO: 817621 - protein, 19 aa, Mycobacterium
GITMHHFNLVAGHLSDALA

SEQ ID NO: 817622 - protein, 27 aa, Mycobacterium
GITNHNPIWPGHGIRILPGPSSLWLDA

SEQ ID NO: 817623 - protein, 19 aa, Mycobacterium
GITPFTEPPVPLVLQEMTL

SEQ ID NO: 817624 - protein, 22 aa, Mycobacterium
GITPGWYLRTLSEVAVPLWQVV

SEQ ID NO: 817625 - protein, 23 aa, Mycobacterium
GITPLIEEIPAPTPRRGLDSIFE

SEQ ID NO: 817626 - protein, 17 aa, Mycobacterium
GITPRLAIPDRLLPQPT

SEQ ID NO: 817627 - protein, 22 aa, Mycobacterium
GITPVLAMLRTLVAQHHLHIHG

SEQ ID NO: 817628 - protein, 20 aa, Mycobacterium
GITPVLSMLRTLRAQAFTGE

SEQ ID NO: 817629 - protein, 19 aa, Mycobacterium
GITPVMSMLRTLRARRHAG

SEQ ID NO: 817630 - protein, 25 aa, Mycobacterium
GITRGALYFYFASKNDVLAALVQRT

SEQ ID NO: 817631 - protein, 25 aa, Mycobacterium
GITRGALYFYFGSKQEVITALFARC

SEQ ID NO: 817632 - protein, 19 aa, Mycobacterium
GITRLPRPATPLSDAALMT

SEQ ID NO: 817633 - protein, 26 aa, Mycobacterium
GITSDRLYPLRLQQELADLLPGCGGL

SEQ ID NO: 817634 - protein, 27 aa, Mycobacterium
GITSDRLYPLRLQQELAELLPGCAGLR

SEQ ID NO: 817635 - protein, 18 aa, Mycobacterium
GITTLGIPAQLLVHRCPR

SEQ ID NO: 817636 - protein, 26 aa, Mycobacterium
GITVAEMPNLFFLLGPNTGLGHNSVV

SEQ ID NO: 817637 - protein, 23 aa, Mycobacterium
GITWTSELLTVTAADPIGPVSVQ

SEQ ID NO: 817638 - protein, 17 aa, Mycobacterium
GIVALVQRFPQSTRFLF

SEQ ID NO: 817639 - protein, 31 aa, Mycobacterium
GIVGAITPWNFPFNIPSRKLGPALAAGNPVL

SEQ ID NO: 817640 - protein, 23 aa, Mycobacterium
GIVHFDGPFLYRSTFHADTEEQE

SEQ ID NO: 817641 - protein, 18 aa, Mycobacterium
GIVLFGSGAGLAGGANMV

SEQ ID NO: 817642 - protein, 23 aa, Mycobacterium
GIVPAPLLAELIARGATIRFVHA

SEQ ID NO: 817643 - protein, 22 aa, Mycobacterium
GIVPAPLLAELIARGATVRLVT

SEQ ID NO: 817644 - protein, 19 aa, Mycobacterium
GIVPAVLHYAAHYTRAGTA

SEQ ID NO: 817645 - protein, 18 aa, Mycobacterium
GIVQNSIDIGTYALDRTK

SEQ ID NO: 817646 - protein, 18 aa, Mycobacterium
GIVSLLEFSGQSLRPVIF

SEQ ID NO: 817647 - protein, 20 aa, Mycobacterium
GIVSSFRHALQAVGAPVPDG

SEQ ID NO: 817648 - protein, 20 aa, Mycobacterium
GIVTGPPWNLRACSVVDGVE

SEQ ID NO: 817649 - protein, 18 aa, Mycobacterium
GIVTTLDLPLITGKGLYL

SEQ ID NO: 817650 - protein, 19 aa, Mycobacterium
GIVTVLWADQAPGLQILGS

SEQ ID NO: 817651 - protein, 19 aa, Mycobacterium
GIVTYNDLPLILPRGVVPT

SEQ ID NO: 817652 - protein, 23 aa, Mycobacterium
GIVTYSDLALTLPRGMVPTDRNS

SEQ ID NO: 817653 - protein, 25 aa, Mycobacterium
GIVVIDFIDMVLESNRDLVLRRLTE

SEQ ID NO: 817654 - protein, 17 aa, Mycobacterium
GIVWVNDHHRLDPCSPW

SEQ ID NO: 817655 - protein, 26 aa, Mycobacterium
GIVYDNLVRPIANSFVYNLVDPILND

SEQ ID NO: 817656 - protein, 17 aa, Mycobacterium
GIVYLPPPHDPAVLEPL

SEQ ID NO: 817657 - protein, 23 aa, Mycobacterium
GIVYPAAGLPQLALSRGATVVEI

SEQ ID NO: 817658 - protein, 25 aa, Mycobacterium
GIWALEDVVRLAPGLNLRGYGHYTE

SEQ ID NO: 817659 - protein, 22 aa, Mycobacterium
GIWMRPEAVPGFRRLTDAIHAE

SEQ ID NO: 817660 - protein, 17 aa, Mycobacterium
GIWPWASTATGEPDVVL

SEQ ID NO: 817661 - protein, 24 aa, Mycobacterium
GIYAGVFVPERRKSKGWSAAMNQL

SEQ ID NO: 817662 - protein, 24 aa, Mycobacterium
GIYNTSILNLMAQAFVSGLGNTGH

SEQ ID NO: 817663 - protein, 31 aa, Mycobacterium
GIYPDGRFSYQLTIYIFRYGEGTAMAIMHPD

SEQ ID NO: 817664 - protein, 31 aa, Mycobacterium
GIYPDGRFSYQLTIYIFRYGQGTEMAIMHPD

SEQ ID NO: 817665 - protein, 20 aa, Mycobacterium
GIYPFGGATIRFPRTAGWGN

SEQ ID NO: 817666 - protein, 23 aa, Mycobacterium
GIYTADIMDFWRPNYRSTALVDG

SEQ ID NO: 817667 - protein, 21 aa, Mycobacterium
GKAALFKTFGGLDSIPLVLDT

SEQ ID NO: 817668 - protein, 21 aa, Mycobacterium
GKAALYRRWANKHDLVHAALQ

SEQ ID NO: 817669 - protein, 28 aa, Mycobacterium
GKAEAWFYDPPWTLPMRRRNEVAVPIDP

SEQ ID NO: 817670 - protein, 24 aa, Mycobacterium
GKAFQGLVAVWRRESELFAEVVAP

SEQ ID NO: 817671 - protein, 19 aa, Mycobacterium
GKAGWLSVYVPSAEVLHHK

SEQ ID NO: 817672 - protein, 25 aa, Mycobacterium
GKAIDLFPIKVLGKTPTWSQELTYE

SEQ ID NO: 817673 - protein, 24 aa, Mycobacterium
GKAITLRLLSLAEHRVFIEAARDF

SEQ ID NO: 817674 - protein, 18 aa, Mycobacterium
GKAIVDELLRRGAAKVYA

SEQ ID NO: 817675 - protein, 25 aa, Mycobacterium
GKAKAALLRRRFTIGLSNCPNSKVL

SEQ ID NO: 817676 - protein, 29 aa, Mycobacterium
GKAKAQPLWRVLVALSIRHVGPTAARALA

SEQ ID NO: 817677 - protein, 21 aa, Mycobacterium
GKAKEVGGAVLGRDDLADEGR

SEQ ID NO: 817678 - protein, 27 aa, Mycobacterium
GKALALYHSKRLACPAQRIMLFAKDRG

SEQ ID NO: 817679 - protein, 24 aa, Mycobacterium
GKALALYHTKRLASPGQRIVLYAK

SEQ ID NO: 817680 - protein, 21 aa, Mycobacterium
GKALDFFADAVTRTAPARAAY

SEQ ID NO: 817681 - protein, 19 aa, Mycobacterium
GKALEPWVRALHGCDNPVC

SEQ ID NO: 817682 - protein, 21 aa, Mycobacterium
GKAPFVVFSDADLDAAVQGAV

SEQ ID NO: 817683 - protein, 26 aa, Mycobacterium
GKAPYTPAFFDEFARRFALATRGFDS

SEQ ID NO: 817684 - protein, 22 aa, Mycobacterium
GKARLRIALAAPTGKAAARLHE

SEQ ID NO: 817685 - protein, 23 aa, Mycobacterium
GKAVVLNIFPSIDTPVCAASVRT

SEQ ID NO: 817686 - protein, 23 aa, Mycobacterium
GKAVVLNIFPSIDTPVCATSVRT

SEQ ID NO: 817687 - protein, 34 aa, Mycobacterium
GKAWAAKAGGTSGVLWGALLTALGARLGDTGRPD

SEQ ID NO: 817688 - protein, 17 aa, Mycobacterium
GKAWLFAPSGLADGPLP

SEQ ID NO: 817689 - protein, 22 aa, Mycobacterium
GKCEIVFDYNFPFTLDAITDLL

SEQ ID NO: 817690 - protein, 18 aa, Mycobacterium
GKCPPPAGFYGTVASVSG

SEQ ID NO: 817691 - protein, 24 aa, Mycobacterium
GKDAVLRHFAVTLGGDVARLTGRV

SEQ ID NO: 817692 - protein, 17 aa, Mycobacterium
GKDCAYLELYWGAKDLI

SEQ ID NO: 817693 - protein, 22 aa, Mycobacterium
GKDEFFKVWRYLNGSFELDTDL

SEQ ID NO: 817694 - protein, 22 aa, Mycobacterium
GKDELFFTLFDASSEQLLTQLR

SEQ ID NO: 817695 - protein, 17 aa, Mycobacterium
GKDFEHWSIHRKPPPFS

SEQ ID NO: 817696 - protein, 27 aa, Mycobacterium
GKDGGTMPITLWIVDTSAQAPASSTAE

SEQ ID NO: 817697 - protein, 19 aa, Mycobacterium
GKDGLPELFPWTPQTHREL

SEQ ID NO: 817698 - protein, 25 aa, Mycobacterium
GKDLAVLGFIWEVLGRIGIGRKDAV

SEQ ID NO: 817699 - protein, 24 aa, Mycobacterium
GKDMGPCFILEYKKDRHARVALAA

SEQ ID NO: 817700 - protein, 22 aa, Mycobacterium
GKDMRDIYIGSITAPYVLKGRS

SEQ ID NO: 817701 - protein, 25 aa, Mycobacterium
GKDNSGLVILLTFGTGIGSAVIHNG

SEQ ID NO: 817702 - protein, 25 aa, Mycobacterium
GKDNSGVIVLLTFGTGIGSAVIHNG

SEQ ID NO: 817703 - protein, 24 aa, Mycobacterium
GKDRDYILDLLLRHTTAGVPYEQC

SEQ ID NO: 817704 - protein, 29 aa, Mycobacterium
GKDSTAVLQLVWLSLAGLPPEKLTKPVHV

SEQ ID NO: 817705 - protein, 23 aa, Mycobacterium
GKDTWRFVVDFPFDDQGHSVRDD

SEQ ID NO: 817706 - protein, 28 aa, Mycobacterium
GKDVLPDDLPFVTGSIGLLGTRPSYELM

SEQ ID NO: 817707 - protein, 21 aa, Mycobacterium
GKDVLPDDLPWVTGSIGLLGT

SEQ ID NO: 817708 - protein, 25 aa, Mycobacterium
GKDWTPIQHQIWLDEMQLASVPEPL

SEQ ID NO: 817709 - protein, 25 aa, Mycobacterium
GKEDWYRWQWRVHVGLWAAASASKL

SEQ ID NO: 817710 - protein, 54 aa, Mycobacterium
GKEGDRGLSWLPFFHDMGLITALLSPVLGHNFTFMTPAAFVRRPGRWIREMARK

SEQ ID NO: 817711 - protein, 31 aa, Mycobacterium
GKEGRGFYHLMTNLPSERLSIAISAIAGARA

SEQ ID NO: 817712 - protein, 32 aa, Mycobacterium
GKEGRGFYHLMTNLPSERLSIAISAIAGARAV

SEQ ID NO: 817713 - protein, 23 aa, Mycobacterium
GKEIAGRLAARIGSGLLVDVIEV

SEQ ID NO: 817714 - protein, 24 aa, Mycobacterium
GKELPVVGFIWEVLGRIGIGRKDA

SEQ ID NO: 817715 - protein, 31 aa, Mycobacterium
GKEPLVAALLRSFFHPLVRLRNKVPGYAVSL

SEQ ID NO: 817716 - protein, 26 aa, Mycobacterium
GKEVDLRFVFGYTPLEFRDTLHMLAD

SEQ ID NO: 817717 - protein, 21 aa, Mycobacterium
GKFRDTVRDYWRGQPATLGEF

SEQ ID NO: 817718 - protein, 31 aa, Mycobacterium
GKGEFIKGFASPFTLLVIADLLGIPAEDRNA

SEQ ID NO: 817719 - protein, 26 aa, Mycobacterium
GKGLTLLQQLIWYEEYAARGFPGIDA

SEQ ID NO: 817720 - protein, 27 aa, Mycobacterium
GKGNAMGPDFWRELPLIFTELDADPEV

SEQ ID NO: 817721 - protein, 23 aa, Mycobacterium
GKGSMIIGCDTLPILPTDPGDRN

SEQ ID NO: 817722 - protein, 26 aa, Mycobacterium
GKGSNAPIGFSFGGAGGKGGTGGTGG

SEQ ID NO: 817723 - protein, 24 aa, Mycobacterium
GKGSPEWWVVNVKPGRVLFELSYP

SEQ ID NO: 817724 - protein, 27 aa, Mycobacterium
GKGSTSWLALLLEPADRAYVPGSPEWE

SEQ ID NO: 817725 - protein, 30 aa, Mycobacterium
GKGTLFRRFGSRTGLLLALLDHEEHIEQQA

SEQ ID NO: 817726 - protein, 37 aa, Mycobacterium
GKGTRVGILFPNCAQWLIAWLAAARIGALTVPLSTFA

SEQ ID NO: 817727 - protein, 28 aa, Mycobacterium
GKGVRAHVLFPGGFLNTGIWESWRHRPE

SEQ ID NO: 817728 - protein, 27 aa, Mycobacterium
GKHAVSAFSLWFPLSEEISGYGALKTE

SEQ ID NO: 817729 - protein, 25 aa, Mycobacterium
GKHFGQMIAIKKFLQGREIIVQAPV

SEQ ID NO: 817730 - protein, 25 aa, Mycobacterium
GKHLLESWIPLLALAAHDPVRDWSA

SEQ ID NO: 817731 - protein, 18 aa, Mycobacterium
GKIAEMLRWCQEAGIEMA

SEQ ID NO: 817732 - protein, 23 aa, Mycobacterium
GKIDDLPPLLAAPPVKTRYLDTE

SEQ ID NO: 817733 - protein, 18 aa, Mycobacterium
GKIDVLVNNAFRVPSMKP

SEQ ID NO: 817734 - protein, 25 aa, Mycobacterium
GKITLWRDYFDLFDMFKATVRGLAA

SEQ ID NO: 817735 - protein, 21 aa, Mycobacterium
GKIVGQRYGFRPMVVARHVVG

SEQ ID NO: 817736 - protein, 17 aa, Mycobacterium
GKIWRRGSRNWFGESAA

SEQ ID NO: 817737 - protein, 19 aa, Mycobacterium
GKIYVRFPDAVSMREYLGE

SEQ ID NO: 817738 - protein, 24 aa, Mycobacterium
GKIYVRFPEAVSMRQYLGAPHGPL

SEQ ID NO: 817739 - protein, 23 aa, Mycobacterium
GKIYVRFPEAVSMRQYLGPAHGA

SEQ ID NO: 817740 - protein, 24 aa, Mycobacterium
GKIYVRFPEAVSMRQYLGVPHGPI

SEQ ID NO: 817741 - protein, 17 aa, Mycobacterium
GKKIKRLSLLSGGEKSL

SEQ ID NO: 817742 - protein, 24 aa, Mycobacterium
GKKRKMSFPAAIRSNFRSLPVVDV

SEQ ID NO: 817743 - protein, 20 aa, Mycobacterium
GKLAARLRGQGHTPLLVACD

SEQ ID NO: 817744 - protein, 21 aa, Mycobacterium
GKLEDLLTIPLADSSLTWSPE

SEQ ID NO: 817745 - protein, 28 aa, Mycobacterium
GKLEPLGIINDSPGFKGFFRPTEDADDL

SEQ ID NO: 817746 - protein, 22 aa, Mycobacterium
GKLEVYSPNSPLGGALIDAKVG

SEQ ID NO: 817747 - protein, 33 aa, Mycobacterium
GKLFSPGKIRRFLTIARLLAPVAVPLVYRASIA

SEQ ID NO: 817748 - protein, 19 aa, Mycobacterium
GKLIEELWEHTVGDKLWAP

SEQ ID NO: 817749 - protein, 25 aa, Mycobacterium
GKLRPALFVVPTDTPGFTYTAIDME

SEQ ID NO: 817750 - protein, 18 aa, Mycobacterium
GKLSVPPSWAVATPDIRA

SEQ ID NO: 817751 - protein, 31 aa, Mycobacterium
GKLVARIVPVGDFRVAPIPARSVEPAATDAG

SEQ ID NO: 817752 - protein, 25 aa, Mycobacterium
GKLVPRKFVAFSPDGNGRMIEMIGE

SEQ ID NO: 817753 - protein, 20 aa, Mycobacterium
GKMFVQLWHVGRMAHPEISG

SEQ ID NO: 817754 - protein, 21 aa, Mycobacterium
GKMGFVFNFITYGGHQIDGVA

SEQ ID NO: 817755 - protein, 21 aa, Mycobacterium
GKMGFVFNFITYGGHQVDGVA

SEQ ID NO: 817756 - protein, 23 aa, Mycobacterium
GKMGLSHLAILRTHPDLDVVGVC

SEQ ID NO: 817757 - protein, 23 aa, Mycobacterium
GKNDILAAIFRRASDRVSAETAE

SEQ ID NO: 817758 - protein, 24 aa, Mycobacterium
GKNESLLPVAPLTTALSSREYIVG

SEQ ID NO: 817759 - protein, 25 aa, Mycobacterium
GKNFSYGLDLPAMGASLPALDAGAK

SEQ ID NO: 817760 - protein, 23 aa, Mycobacterium
GKNLSWADLIVYAGNVALEDMGF

SEQ ID NO: 817761 - protein, 18 aa, Mycobacterium
GKNTLLVCDTWDIADALN

SEQ ID NO: 817762 - protein, 26 aa, Mycobacterium
GKNVVTPLGWFYPTEKEAAPLEVAAQ

SEQ ID NO: 817763 - protein, 18 aa, Mycobacterium
GKNVVTPVGWLYPSERSG

SEQ ID NO: 817764 - protein, 18 aa, Mycobacterium
GKPALVKLQCPCPCPCRL

SEQ ID NO: 817765 - protein, 22 aa, Mycobacterium
GKPAYIAGDLAYFLDKRKRGFD

SEQ ID NO: 817766 - protein, 24 aa, Mycobacterium
GKPEFVENFFLFIAEEVRELMAEL

SEQ ID NO: 817767 - protein, 25 aa, Mycobacterium
GKPELDLVLAILRARQLFGGEHAIP

SEQ ID NO: 817768 - protein, 18 aa, Mycobacterium
GKPESFVNRRMGVALAFA

SEQ ID NO: 817769 - protein, 27 aa, Mycobacterium
GKPKPHLATSFWFAFGPQADARAQVHR

SEQ ID NO: 817770 - protein, 22 aa, Mycobacterium
GKPKVLVDGWLDIAVDALRAGG

SEQ ID NO: 817771 - protein, 32 aa, Mycobacterium
GKPLILDEAWGAHLPFHEDLPSWAMDAGADVC

SEQ ID NO: 817772 - protein, 24 aa, Mycobacterium
GKPLSLQDMLLPAGPAGPGRGGVP

SEQ ID NO: 817773 - protein, 30 aa, Mycobacterium
GKPPLGQPPIPPWASPPPPPSLQATRDAYN

SEQ ID NO: 817774 - protein, 21 aa, Mycobacterium
GKPQIIPFQLVDAASGHVLAQ

SEQ ID NO: 817775 - protein, 26 aa, Mycobacterium
GKPSATYLWEDKGVVPLLKIDKGLAE

SEQ ID NO: 817776 - protein, 27 aa, Mycobacterium
GKPVTAMYLLAAFATLAGPDSGFHYVK

SEQ ID NO: 817777 - protein, 26 aa, Mycobacterium
GKQADTLMLFYLLSADELYELFDRLG

SEQ ID NO: 817778 - protein, 25 aa, Mycobacterium
GKQAMAEMWLMYYELIQQRRDDPGD

SEQ ID NO: 817779 - protein, 21 aa, Mycobacterium
GKQLRLAQQYFFVSCSLQDML

SEQ ID NO: 817780 - protein, 34 aa, Mycobacterium
GKQLVNRVKTWLQFPKWFYDNLPVNTMTEPRLTP

SEQ ID NO: 817781 - protein, 24 aa, Mycobacterium
GKQTFAFFRQNLVSDYTYPESVAD

SEQ ID NO: 817782 - protein, 24 aa, Mycobacterium
GKRAAELLKPCTLELGGKSAAIML

SEQ ID NO: 817783 - protein, 28 aa, Mycobacterium
GKRDGVLRWWAGPWPVDERWWDPQNRGT

SEQ ID NO: 817784 - protein, 25 aa, Mycobacterium
GKREVLPGVGLYLDGGFGVGKTHLL

SEQ ID NO: 817785 - protein, 23 aa, Mycobacterium
GKRFRPLFTVLSAQIGPNPDAHE

SEQ ID NO: 817786 - protein, 21 aa, Mycobacterium
GKRFRPLFTVLSAQVGPDPEA

SEQ ID NO: 817787 - protein, 21 aa, Mycobacterium
GKRGALLLALGSPGGSVIIQF

SEQ ID NO: 817788 - protein, 30 aa, Mycobacterium
GKRHHHELGWFARTALRMLDDLRLEYGRLD

SEQ ID NO: 817789 - protein, 25 aa, Mycobacterium
GKRIERGLGLTALLRSTLTTERGRA

SEQ ID NO: 817790 - protein, 36 aa, Mycobacterium
GKRNPIAEWLDKLGLFGKRSYEKFVPAQVFALPNDQ

SEQ ID NO: 817791 - protein, 24 aa, Mycobacterium
GKRPAPTPLFAKPGSYYGDITALG

SEQ ID NO: 817792 - protein, 24 aa, Mycobacterium
GKRPDLVRPILPYDGCRLLTKVRH

SEQ ID NO: 817793 - protein, 22 aa, Mycobacterium
GKRPILALEISIEEVFFHCAKA

SEQ ID NO: 817794 - protein, 28 aa, Mycobacterium
GKRRAFADQPYWGRPVPGWGSERPRLLI

SEQ ID NO: 817795 - protein, 18 aa, Mycobacterium
GKRRVPAAALAQLPLLLL

SEQ ID NO: 817796 - protein, 29 aa, Mycobacterium
GKRRWEAFTDWPDPWVMIGAVALVTSRLH

SEQ ID NO: 817797 - protein, 20 aa, Mycobacterium
GKRYGIVGKVFNLFSKLRGG

SEQ ID NO: 817798 - protein, 22 aa, Mycobacterium
GKRYGLLGKTFNFFSKLRGGME

SEQ ID NO: 817799 - protein, 22 aa, Mycobacterium
GKSFVYFRTPRPDATDPDTGER

SEQ ID NO: 817800 - protein, 23 aa, Mycobacterium
GKSHFMAVLYALLGNHPAVRTSK

SEQ ID NO: 817801 - protein, 22 aa, Mycobacterium
GKSHFMAVLYALLGQNPTARAR

SEQ ID NO: 817802 - protein, 20 aa, Mycobacterium
GKSIILLSEGRLLNLGNATG

SEQ ID NO: 817803 - protein, 23 aa, Mycobacterium
GKSLAYLLPAIGRASRPGQPVVI

SEQ ID NO: 817804 - protein, 18 aa, Mycobacterium
GKSLYLRDPIFAEWIDKV

SEQ ID NO: 817805 - protein, 22 aa, Mycobacterium
GKSLYMAVLVKQLEVLCERLGV

SEQ ID NO: 817806 - protein, 20 aa, Mycobacterium
GKSMSPFLVRPTGNPADDPH

SEQ ID NO: 817807 - protein, 25 aa, Mycobacterium
GKSNYTRFDALVPGGLYALDSAGPK

SEQ ID NO: 817808 - protein, 27 aa, Mycobacterium
GKSSLLDAISLGFLPFNRRNFNASGDN

SEQ ID NO: 817809 - protein, 17 aa, Mycobacterium
GKSSLRTWLHRIATNTC

SEQ ID NO: 817810 - protein, 18 aa, Mycobacterium
GKSSLRTWLHRIATNTCL

SEQ ID NO: 817811 - protein, 27 aa, Mycobacterium
GKSTFIAFTLAPLLPRSVFVNADEIAK

SEQ ID NO: 817812 - protein, 24 aa, Mycobacterium
GKSTFIELTLAPLVPRSVYVNADE

SEQ ID NO: 817813 - protein, 24 aa, Mycobacterium
GKSTIAAALALALAAHGRRVLLVE

SEQ ID NO: 817814 - protein, 25 aa, Mycobacterium
GKSTLLKSIFRLVEPMSGEISLLGE

SEQ ID NO: 817815 - protein, 22 aa, Mycobacterium
GKSTLLQTLILSAAASHTPRQI

SEQ ID NO: 817816 - protein, 23 aa, Mycobacterium
GKSTLLRLIAGELSPTAGAVTVD

SEQ ID NO: 817817 - protein, 23 aa, Mycobacterium
GKSTLLRLLLGRCQPDDGRASLG

SEQ ID NO: 817818 - protein, 21 aa, Mycobacterium
GKSTLLRLLSGIYEPTRGSAT

SEQ ID NO: 817819 - protein, 21 aa, Mycobacterium
GKSTLLRLLSGIYEPTRGSSY

SEQ ID NO: 817820 - protein, 21 aa, Mycobacterium
GKSTLLRLLSGIYEPTRGVAE

SEQ ID NO: 817821 - protein, 23 aa, Mycobacterium
GKSVFLKSLIGLLRPEQGAIYID

SEQ ID NO: 817822 - protein, 24 aa, Mycobacterium
GKSVFLKSLIGLLRPERGSIVIDG

SEQ ID NO: 817823 - protein, 18 aa, Mycobacterium
GKSVVWSQTWRNLHSGEP

SEQ ID NO: 817824 - protein, 22 aa, Mycobacterium
GKTAAFAIPILSKIDVTSTATQ

SEQ ID NO: 817825 - protein, 24 aa, Mycobacterium
GKTALLRYVLGKASGQLIAQASGI

SEQ ID NO: 817826 - protein, 17 aa, Mycobacterium
GKTFNFFSKLRGGMEKN

SEQ ID NO: 817827 - protein, 23 aa, Mycobacterium
GKTGVDYWAGLEPNGFAGLSLRE

SEQ ID NO: 817828 - protein, 18 aa, Mycobacterium
GKTILFITHGIDEALYLG

SEQ ID NO: 817829 - protein, 23 aa, Mycobacterium
GKTKRIIASGLPIGPPPGVTPKP

SEQ ID NO: 817830 - protein, 22 aa, Mycobacterium
GKTLLPGFIDPHSHYINALTVA

SEQ ID NO: 817831 - protein, 25 aa, Mycobacterium
GKTLTCVLPAYLNALAGKGTHVVTV

SEQ ID NO: 817832 - protein, 21 aa, Mycobacterium
GKTMLAQRLPGLLPPLRHEEA

SEQ ID NO: 817833 - protein, 22 aa, Mycobacterium
GKTMLAQRLPGLLPPLSRGESL

SEQ ID NO: 817834 - protein, 21 aa, Mycobacterium
GKTMLAQRLPGLLPPLTESES

SEQ ID NO: 817835 - protein, 19 aa, Mycobacterium
GKTMVVTGLHLLGGARADA

SEQ ID NO: 817836 - protein, 21 aa, Mycobacterium
GKTMVVTGLHLLGGARADATK

SEQ ID NO: 817837 - protein, 22 aa, Mycobacterium
GKTNLIEALWYSSTLGSHRVGT

SEQ ID NO: 817838 - protein, 27 aa, Mycobacterium
GKTPAQVLLRWNLQLGNAVVFRSANAE

SEQ ID NO: 817839 - protein, 27 aa, Mycobacterium
GKTPAQVLLRWNLQLGNAVVFRSSQPE

SEQ ID NO: 817840 - protein, 25 aa, Mycobacterium
GKTRGFPLGPGYLIDGRPVILTAPK

SEQ ID NO: 817841 - protein, 23 aa, Mycobacterium
GKTRLSPLAYLTIDGRMIIVGSY

SEQ ID NO: 817842 - protein, 23 aa, Mycobacterium
GKTRLVEHMGLLLGRPVVTISCH

SEQ ID NO: 817843 - protein, 25 aa, Mycobacterium
GKTRSLALTFRRPTPILTHLRFDIT

SEQ ID NO: 817844 - protein, 24 aa, Mycobacterium
GKTSLLRLLLGQVPLTRGSMTVTS

SEQ ID NO: 817845 - protein, 24 aa, Mycobacterium
GKTTALLVMGLLLTPDGGTVQICG

SEQ ID NO: 817846 - protein, 23 aa, Mycobacterium
GKTTLLNHLLRHPGTRIGVVVND

SEQ ID NO: 817847 - protein, 25 aa, Mycobacterium
GKTTLLQVILGLLGPASGSVRVFGR

SEQ ID NO: 817848 - protein, 20 aa, Mycobacterium
GKTTLLRILAGFEDPDLGTV

SEQ ID NO: 817849 - protein, 17 aa, Mycobacterium
GKTTLLRLLAGTEAPDT

SEQ ID NO: 817850 - protein, 21 aa, Mycobacterium
GKTTLLRLLAGVETPDTGALE

SEQ ID NO: 817851 - protein, 24 aa, Mycobacterium
GKTTTLRMIAGFESPTEGAIRLEG

SEQ ID NO: 817852 - protein, 20 aa, Mycobacterium
GKTVFVFPGQGAQYAGMGAG

SEQ ID NO: 817853 - protein, 19 aa, Mycobacterium
GKTVLRLEYSAHPSAQQVL

SEQ ID NO: 817854 - protein, 23 aa, Mycobacterium
GKTYPVLYLLHGGGDQDFRTFDF

SEQ ID NO: 817855 - protein, 25 aa, Mycobacterium
GKVDYPALKSLALKLLGLDKSERSA

SEQ ID NO: 817856 - protein, 35 aa, Mycobacterium
GKVGAIRYARKRGLPLLGLCLGLQCIVIEAARSVG

SEQ ID NO: 817857 - protein, 20 aa, Mycobacterium
GKVGKVMRPYLSITGTARIV

SEQ ID NO: 817858 - protein, 23 aa, Mycobacterium
GKVISIPGLQYKAIGTAGRLMPR

SEQ ID NO: 817859 - protein, 42 aa, Mycobacterium
GKVKGNVPFRVVTGHGAFVVPFFRKAAFLTLAMCESEVAEKC

SEQ ID NO: 817860 - protein, 26 aa, Mycobacterium
GKVKWSVPLGFLAQTPPTVTPDGLIV

SEQ ID NO: 817861 - protein, 21 aa, Mycobacterium
GKVLVAYPDRNKVLVEGVNRI

SEQ ID NO: 817862 - protein, 20 aa, Mycobacterium
GKVQGILVEDWRGAAAKSLQ

SEQ ID NO: 817863 - protein, 29 aa, Mycobacterium
GKVRDRLLPAMRDWLAHSPLGFVATTDAD

SEQ ID NO: 817864 - protein, 23 aa, Mycobacterium
GKVRRVRLLPGDPPATRQAVEAI

SEQ ID NO: 817865 - protein, 23 aa, Mycobacterium
GKVRRVRLLPSDPPATRQAVDAI

SEQ ID NO: 817866 - protein, 25 aa, Mycobacterium
GKVTAWRYIRAAVPAVLRYRNREPV

SEQ ID NO: 817867 - protein, 18 aa, Mycobacterium
GKVTLLEALPRKILNFAP

SEQ ID NO: 817868 - protein, 21 aa, Mycobacterium
GKVTLLRYIVSEDVGPMINPS

SEQ ID NO: 817869 - protein, 23 aa, Mycobacterium
GKWALNRDIAAARLSWERATRIS

SEQ ID NO: 817870 - protein, 20 aa, Mycobacterium
GKWIHPPLERSRYTGGPVHF

SEQ ID NO: 817871 - protein, 23 aa, Mycobacterium
GKWNLDLGALLPALSVRNSHGRN

SEQ ID NO: 817872 - protein, 17 aa, Mycobacterium
GKWRLATVNVDVVPRVA

SEQ ID NO: 817873 - protein, 23 aa, Mycobacterium
GKWTAALIGSWWSTPSTELHAGA

SEQ ID NO: 817874 - protein, 23 aa, Mycobacterium
GKWVDLEMLLLADARERTAEEYS

SEQ ID NO: 817875 - protein, 26 aa, Mycobacterium
GKYDPNKYLMLLEFPEDREPRAAIAV

SEQ ID NO: 817876 - protein, 38 aa, Mycobacterium
GKYGYSYKVLGIKFNYPFKYSFDIPAITIPSIQIGGSS

SEQ ID NO: 817877 - protein, 17 aa, Mycobacterium
GKYNVHTTTLYFPLVRT

SEQ ID NO: 817878 - protein, 22 aa, Mycobacterium
GKYPLLAVRTMSRIICAVEENS

SEQ ID NO: 817879 - protein, 21 aa, Mycobacterium
GKYQVLFLDPDFREDIRLAIV

SEQ ID NO: 817880 - protein, 22 aa, Mycobacterium
GKYRGPLHGIPLGVKDLYDTAG

SEQ ID NO: 817881 - protein, 23 aa, Mycobacterium
GKYSWVMSPRWFDGKDHLALDTG

SEQ ID NO: 817882 - protein, 24 aa, Mycobacterium
GLAAELPEWLMLARGIESDVDDMT

SEQ ID NO: 817883 - protein, 17 aa, Mycobacterium
GLAAFRRAGGRIVESVS

SEQ ID NO: 817884 - protein, 34 aa, Mycobacterium; identical to SEQ ID NO: 120303

SEQ ID NO: 817885 - protein, 20 aa, Mycobacterium
GLAAHRRAHGLPGISLAWGL

SEQ ID NO: 817886 - protein, 18 aa, Mycobacterium
GLAAHRRAHGLPGLSVAW

SEQ ID NO: 817887 - protein, 20 aa, Mycobacterium
GLAAKPWVKTTMAPGSQVVS

SEQ ID NO: 817888 - protein, 17 aa, Mycobacterium
GLAALGCAPILVYPASK

SEQ ID NO: 817889 - protein, 19 aa, Mycobacterium
GLAALLDYARPGDTITVVG

SEQ ID NO: 817890 - protein, 17 aa, Mycobacterium
GLAALWIAKATGARIYA

SEQ ID NO: 817891 - protein, 21 aa, Mycobacterium
GLAAMRRRGELRPDADPRHLA

SEQ ID NO: 817892 - protein, 19 aa, Mycobacterium
GLAARYFYESFTDKDEFVG

SEQ ID NO: 817893 - protein, 32 aa, Mycobacterium
GLAAYRGPWQFESFAREILLDIAARKMNIDPV

SEQ ID NO: 817894 - protein, 28 aa, Mycobacterium
GLAAYRGPWQYETLAREILLDIAARKMG

SEQ ID NO: 817895 - protein, 26 aa, Mycobacterium
GLAAYRGPWQYETLAREVLLDIAARK

SEQ ID NO: 817896 - protein, 24 aa, Mycobacterium
GLADALHWLSTHVPIYALNILLAT

SEQ ID NO: 817897 - protein, 28 aa, Mycobacterium
GLADIEWTVQLLQLRFAHKIPALHTTST

SEQ ID NO: 817898 - protein, 25 aa, Mycobacterium
GLADLSIHPLAVLAPDQLSGTVCLG

SEQ ID NO: 817899 - protein, 25 aa, Mycobacterium
GLADNGYIPIPDGFKSRLSTAVNAI

SEQ ID NO: 817900 - protein, 27 aa, Mycobacterium
GLADNLVRFVASLAAAPLLGPLSAISA

SEQ ID NO: 817901 - protein, 25 aa, Mycobacterium
GLADRLRRSLGRMPWTTAQKRLPRP

SEQ ID NO: 817902 - protein, 27 aa, Mycobacterium
GLAEEPFIMFPRHLGPGLYDIIHSACA

SEQ ID NO: 817903 - protein, 19 aa, Mycobacterium
GLAEGIPEMLRFTTTWIAE

SEQ ID NO: 817904 - protein, 17 aa, Mycobacterium
GLAEIQLPDLQPGSSIM

SEQ ID NO: 817905 - protein, 18 aa, Mycobacterium
GLAEIRLPDLQPGSSIMP

SEQ ID NO: 817906 - protein, 23 aa, Mycobacterium
GLAERDGGRWRLVRAGRARPAAE

SEQ ID NO: 817907 - protein, 20 aa, Mycobacterium
GLAEYFVHRTGHGIGLCVHE

SEQ ID NO: 817908 - protein, 21 aa, Mycobacterium
GLAFRCVTPFDAWTMTYEGKA

SEQ ID NO: 817909 - protein, 30 aa, Mycobacterium
GLAGHLAALLYGIPHVLTAHSLEPMRPWKT

SEQ ID NO: 817910 - protein, 18 aa, Mycobacterium
GLAGHLASLLYGVPHVLT

SEQ ID NO: 817911 - protein, 23 aa, Mycobacterium
GLAGLPVLPRQRVLVISTGSELV

SEQ ID NO: 817912 - protein, 17 aa, Mycobacterium
GLAGLVITPGYDLRYLI

SEQ ID NO: 817913 - protein, 18 aa, Mycobacterium
GLAGLVITPGYDLRYLVG

SEQ ID NO: 817914 - protein, 40 aa, Mycobacterium
GLAGQAWQGAASRAMVAAAAPYSGWLSTAAARAAAASAQA

SEQ ID NO: 817915 - protein, 20 aa, Mycobacterium
GLAGQVWQGAAAAAMAAAAA

SEQ ID NO: 817916 - protein, 19 aa, Mycobacterium
GLAHPIRPLVRLPSSYLED

SEQ ID NO: 817917 - protein, 17 aa, Mycobacterium
GLAIAKRAAADGANIAL

SEQ ID NO: 817918 - protein, 20 aa, Mycobacterium
GLAIARWGIAYAVGPNYNKP

SEQ ID NO: 817919 - protein, 19 aa, Mycobacterium
GLAIWMATLSGGDAWQRAD

SEQ ID NO: 817920 - protein, 24 aa, Mycobacterium
GLAKPGRLVGPDPSLLAAAYAGLA

SEQ ID NO: 817921 - protein, 22 aa, Mycobacterium
GLAKRPALFVASYFGELTDALP

SEQ ID NO: 817922 - protein, 31 aa, Mycobacterium
GLALDFLTGPWPVGFVRLRRLRGISLHGTDI

SEQ ID NO: 817923 - protein, 19 aa, Mycobacterium
GLALDFMTSSYSTGTALAN

SEQ ID NO: 817924 - protein, 19 aa, Mycobacterium
GLALLRHVNDLVNTGWPVL

SEQ ID NO: 817925 - protein, 26 aa, Mycobacterium
GLALSRTIIFDYPTPMALARHLDEQL

SEQ ID NO: 817926 - protein, 17 aa, Mycobacterium
GLALVAQQRGYKCVFVC

SEQ ID NO: 817927 - protein, 18 aa, Mycobacterium
GLALVRITYRRSSDTGPA

SEQ ID NO: 817928 - protein, 23 aa, Mycobacterium
GLAMRSIWHVAPYVREGRLVHVL

SEQ ID NO: 817929 - protein, 22 aa, Mycobacterium
GLANIALLRRPAALDEPTWLAR

SEQ ID NO: 817930 - protein, 22 aa, Mycobacterium
GLANIALLRRPAGLDEETWLTR

SEQ ID NO: 817931 - protein, 18 aa, Mycobacterium
GLANIRSFRIRFTGQVWP

SEQ ID NO: 817932 - protein, 25 aa, Mycobacterium
GLANRQFHFLTFETSTLARTRRIVT

SEQ ID NO: 817933 - protein, 21 aa, Mycobacterium
GLANTGLFNSGSFNTGIGNVG

SEQ ID NO: 817934 - protein, 17 aa, Mycobacterium
GLAPADLAERHPQVIPV

SEQ ID NO: 817935 - protein, 22 aa, Mycobacterium
GLAPGRLQLPAMLVLVAPDCYG

SEQ ID NO: 817936 - protein, 21 aa, Mycobacterium
GLAPLRALILDLSRFADNPRV

SEQ ID NO: 817937 - protein, 20 aa, Mycobacterium
GLAPLRALILDMGRFVENPR

SEQ ID NO: 817938 - protein, 19 aa, Mycobacterium
GLAPMVISQIFKIIAEINA

SEQ ID NO: 817939 - protein, 26 aa, Mycobacterium
GLAPREYPVPFDVGWFRIDRIKETAY

SEQ ID NO: 817940 - protein, 19 aa, Mycobacterium
GLAPRRQPPKTVPPLRRPE

SEQ ID NO: 817941 - protein, 20 aa, Mycobacterium
GLAPYILEYIDNVTMAALVH

SEQ ID NO: 817942 - protein, 17 aa, Mycobacterium
GLAPYPLDPLTVAEIES

SEQ ID NO: 817943 - protein, 24 aa, Mycobacterium
GLAQFGINLPPLPTGLLTGTGAAA

SEQ ID NO: 817944 - protein, 20 aa, Mycobacterium
GLAQRYFYESFADKDEYAAA

SEQ ID NO: 817945 - protein, 21 aa, Mycobacterium
GLARDLAFIAFSGIGGELVAK

SEQ ID NO: 817946 - protein, 20 aa, Mycobacterium
GLARDLAFIAFSSAGGELVA

SEQ ID NO: 817947 - protein, 22 aa, Mycobacterium
GLARFCTLRSWLSQWSYDDARG

SEQ ID NO: 817948 - protein, 29 aa, Mycobacterium
GLARLHDYLLAWPQHHAALLAVEICSLSW

SEQ ID NO: 817949 - protein, 28 aa, Mycobacterium
GLARLIANRFRRALPPALAATARHASRR

SEQ ID NO: 817950 - protein, 20 aa, Mycobacterium
GLARLIANRFRRAVPPVPAP

SEQ ID NO: 817951 - protein, 17 aa, Mycobacterium
GLARWLLHTATEYAKVR

SEQ ID NO: 817952 - protein, 19 aa, Mycobacterium
GLASKPWVKTSMAPGSQVV

SEQ ID NO: 817953 - protein, 24 aa, Mycobacterium
GLASRLPRMLGTQAAGAAPLVLGE

SEQ ID NO: 817954 - protein, 24 aa, Mycobacterium
GLASTDQLYFASGLLDCPGAMFTA

SEQ ID NO: 817955 - protein, 24 aa, Mycobacterium
GLASTDQLYFASGLLECPGAMFTA

SEQ ID NO: 817956 - protein, 21 aa, Mycobacterium
GLASWYMYLNQLPRLPERLML

SEQ ID NO: 817957 - protein, 24 aa, Mycobacterium
GLASYLQVLFPRGDAGRRLLATEV

SEQ ID NO: 817958 - protein, 24 aa, Mycobacterium
GLATEVFEIGDIARRAARAGAPES

SEQ ID NO: 817959 - protein, 22 aa, Mycobacterium
GLATTVAWFRIACDDTAGDDPD

SEQ ID NO: 817960 - protein, 23 aa, Mycobacterium
GLATVIPFHRAVTADPAFIGDGE

SEQ ID NO: 817961 - protein, 24 aa, Mycobacterium
GLATVIPFHRAVVADPAFIGDQDG

SEQ ID NO: 817962 - protein, 24 aa, Mycobacterium
GLATVIPFHRAVVSDPAFIGDGEG

SEQ ID NO: 817963 - protein, 24 aa, Mycobacterium
GLATVIPFHRAVVSDPAFIGDGEK

SEQ ID NO: 817964 - protein, 24 aa, Mycobacterium
GLATVIPFHRAVVSDPAFIGDGES

SEQ ID NO: 817965 - protein, 34 aa, Mycobacterium
GLAVHRRARGLPAISLGWGLWNQASAMTGGLASV

SEQ ID NO: 817966 - protein, 26 aa, Mycobacterium
GLAVQPISPAFLYARDRRELDALSPA

SEQ ID NO: 817967 - protein, 23 aa, Mycobacterium
GLAWRTKRLIVFDVDSTLVQGEV

SEQ ID NO: 817968 - protein, 24 aa, Mycobacterium
GLAWRTKRLIVFDVDSTLVQGEVI

SEQ ID NO: 817969 - protein, 17 aa, Mycobacterium
GLAYIPENVELPHKVYM

SEQ ID NO: 817970 - protein, 20 aa, Mycobacterium
GLAYMFSVLGPLSDAYRKLP

SEQ ID NO: 817971 - protein, 18 aa, Mycobacterium
GLCFRDLALRTMNFAPMT

SEQ ID NO: 817972 - protein, 21 aa, Mycobacterium
GLCGLIFPTHLGGTGDTNVAY

SEQ ID NO: 817973 - protein, 23 aa, Mycobacterium
GLCRHVLCFRTVWESTHTALARR

SEQ ID NO: 817974 - protein, 24 aa, Mycobacterium
GLDAALCVAAALFGRLHSGHGESI

SEQ ID NO: 817975 - protein, 24 aa, Mycobacterium
GLDAAVIYLPVPLDPRVLNPLANA

SEQ ID NO: 817976 - protein, 22 aa, Mycobacterium
GLDAGWHLKLPAGPDARTEIHF

SEQ ID NO: 817977 - protein, 35 aa, Mycobacterium
GLDARAWRLDWPRDAVLFELDLPRVLAFKAETLDK

SEQ ID NO: 817978 - protein, 23 aa, Mycobacterium
GLDARGFLLGAAVATRLGTGVLA

SEQ ID NO: 817979 - protein, 26 aa, Mycobacterium
GLDARPYRLWFPPGTTVYEIDQPRVI

SEQ ID NO: 817980 - protein, 30 aa, Mycobacterium
GLDAWTYAGPKYIWALELAPIVAGTELTPF

SEQ ID NO: 817981 - protein, 27 aa, Mycobacterium
GLDCSGLTQWAYREAGLDIPRLAQEQD

SEQ ID NO: 817982 - protein, 28 aa, Mycobacterium
GLDDLGIAGLLLRINDPAALSTFARRTL

SEQ ID NO: 817983 - protein, 17 aa, Mycobacterium
GLDDRRMGIDEATLREI

SEQ ID NO: 817984 - protein, 18 aa, Mycobacterium
GLDEALIKLADPVRRLDA

SEQ ID NO: 817985 - protein, 24 aa, Mycobacterium
GLDELLVAVFDWIIEDSIATAGSA

SEQ ID NO: 817986 - protein, 17 aa, Mycobacterium
GLDFLAGSGLRALLVLD

SEQ ID NO: 817987 - protein, 23 aa, Mycobacterium
GLDFLYQRGVYEGAPRPDLILLD

SEQ ID NO: 817988 - protein, 23 aa, Mycobacterium
GLDFLYRRGAHELAPRPDLVLLD

SEQ ID NO: 817989 - protein, 26 aa, Mycobacterium
GLDFMPVVFSLFQWGKRHLPGGDRLQ

SEQ ID NO: 817990 - protein, 25 aa, Mycobacterium
GLDGLRNALWNIVDLKKQASTMVDG

SEQ ID NO: 817991 - protein, 27 aa, Mycobacterium
GLDGYGWHPHAWRYAFAHNATGGGQLS

SEQ ID NO: 817992 - protein, 18 aa, Mycobacterium
GLDHALPILTTPHAAKRL

SEQ ID NO: 817993 - protein, 23 aa, Mycobacterium
GLDIENYWFRRHEVVYQRLAERC

SEQ ID NO: 817994 - protein, 23 aa, Mycobacterium
GLDIENYWFRRHEVVYQRLAGRC

SEQ ID NO: 817995 - protein, 20 aa, Mycobacterium
GLDILLTGLATRLDMPGGMP

SEQ ID NO: 817996 - protein, 19 aa, Mycobacterium
GLDIVCPNAGIFPSGRIAD

SEQ ID NO: 817997 - protein, 19 aa, Mycobacterium
GLDKRRPDFGIGGFHEVDL

SEQ ID NO: 817998 - protein, 17 aa, Mycobacterium
GLDKVFQVLRAPHTEEP

SEQ ID NO: 817999 - protein, 17 aa, Mycobacterium
GLDLDDDTRRRAALNPL

SEQ ID NO: 818000 - protein, 22 aa, Mycobacterium
GLDLDLLQRLQRAMGLPAVEDP

SEQ ID NO: 818001 - protein, 24 aa, Mycobacterium
GLDLEKHGLQWLWPEVDCAHPLDD

SEQ ID NO: 818002 - protein, 18 aa, Mycobacterium
GLDLIAIDKGAPVELDLR

SEQ ID NO: 818003 - protein, 31 aa, Mycobacterium
GLDLIDRVVFWMLPVDDLLPWLLVDRRAAKV

SEQ ID NO: 818004 - protein, 27 aa, Mycobacterium
GLDLLRGNPLFAMDLVAAALAVSAARA

SEQ ID NO: 818005 - protein, 17 aa, Mycobacterium
GLDLMTMSIFTGAQLVE

SEQ ID NO: 818006 - protein, 28 aa, Mycobacterium
GLDLPAFSFGLWQKFGTDYPFETQREII

SEQ ID NO: 818007 - protein, 37 aa, Mycobacterium
GLDLQLALYVCYELHYRGFSGVDPRWEWDIGLLNLRR

SEQ ID NO: 818008 - protein, 20 aa, Mycobacterium
GLDLRAGIAAQMRGLGVRAI

SEQ ID NO: 818009 - protein, 26 aa, Mycobacterium
GLDPAELPARIRPPLTEFTDSTLCGL

SEQ ID NO: 818010 - protein, 18 aa, Mycobacterium
GLDPIVATLFNPLGAGIK

SEQ ID NO: 818011 - protein, 19 aa, Mycobacterium
GLDPIVTINSYSSLFSPAV

SEQ ID NO: 818012 - protein, 17 aa, Mycobacterium
GLDPVLRVDLWQQFNDL

SEQ ID NO: 818013 - protein, 23 aa, Mycobacterium
GLDPVLRVELWDQFTTLARRGTT

SEQ ID NO: 818014 - protein, 17 aa, Mycobacterium
GLDPVRLSHVLTAGMTF

SEQ ID NO: 818015 - protein, 19 aa, Mycobacterium
GLDPVSFTVTLDGGSYQLY

SEQ ID NO: 818016 - protein, 17 aa, Mycobacterium
GLDPWLRHTFEDARHQL

SEQ ID NO: 818017 - protein, 24 aa, Mycobacterium
GLDQPHGLFFAGPTLYVAESDQID

SEQ ID NO: 818018 - protein, 17 aa, Mycobacterium
GLDRASLWSASFASRVG

SEQ ID NO: 818019 - protein, 23 aa, Mycobacterium
GLDRFPDLVAAAPKGLFLTATAV

SEQ ID NO: 818020 - protein, 25 aa, Mycobacterium
GLDRLFDTLFVYENYPIDADALLGA

SEQ ID NO: 818021 - protein, 21 aa, Mycobacterium
GLDRRTWQRLAQAVDLIVDSA

SEQ ID NO: 818022 - protein, 25 aa, Mycobacterium
GLDRVKPFRPFQVNEQLLAAADSEA

SEQ ID NO: 818023 - protein, 26 aa, Mycobacterium
GLDRVRPFRPFQVNADLLELADPAAV

SEQ ID NO: 818024 - protein, 25 aa, Mycobacterium
GLDRVRPFRPFQVNADLLGRADSEA

SEQ ID NO: 818025 - protein, 30 aa, Mycobacterium
GLDRWRLRHRILQRPAHFQRLLRKSEYWTN

SEQ ID NO: 818026 - protein, 18 aa, Mycobacterium
GLDSLVYADIPRPLPKSG

SEQ ID NO: 818027 - protein, 23 aa, Mycobacterium
GLDSRAFRLDWPAGTTVFEIDQP

SEQ ID NO: 818028 - protein, 17 aa, Mycobacterium
GLDSRAYRLDWAPGTTV

SEQ ID NO: 818029 - protein, 22 aa, Mycobacterium
GLDSRAYRLDWPAATTIFELDQ

SEQ ID NO: 818030 - protein, 22 aa, Mycobacterium
GLDSRAYRLDWPAGTTVYEIDQ

SEQ ID NO: 818031 - protein, 23 aa, Mycobacterium
GLDSRAYRLDWPAGTTVYEIDQP

SEQ ID NO: 818032 - protein, 24 aa, Mycobacterium
GLDSVRFVLLMKRLGVDRESELPS

SEQ ID NO: 818033 - protein, 26 aa, Mycobacterium
GLDVDTDLRWRIVIALATAGAIDADG

SEQ ID NO: 818034 - protein, 27 aa, Mycobacterium
GLDVDWRGWYRGRIAAWTNGLSSLEGP

SEQ ID NO: 818035 - protein, 18 aa, Mycobacterium
GLDVGSPFHHAKSGILYV

SEQ ID NO: 818036 - protein, 24 aa, Mycobacterium
GLDVLFGLWEGQPFSYEGKHYQVT

SEQ ID NO: 818037 - protein, 25 aa, Mycobacterium
GLDVLVHAAGLWQAGIPGYIGVEEI

SEQ ID NO: 818038 - protein, 20 aa, Mycobacterium
GLDVPAMGGSFTPLLSGDAL

SEQ ID NO: 818039 - protein, 22 aa, Mycobacterium
GLDVPTFRVLAGLSGRVPLVAI

SEQ ID NO: 818040 - protein, 26 aa, Mycobacterium
GLDVTIVRPFNIFGVRQKTGRFGALI

SEQ ID NO: 818041 - protein, 20 aa, Mycobacterium
GLDWTIVRPSGLFDLPEPTD

SEQ ID NO: 818042 - protein, 24 aa, Mycobacterium
GLEAALCVAAALFGRLHSGGGEAV

SEQ ID NO: 818043 - protein, 19 aa, Mycobacterium
GLEAGLRYLSRQTVAIGGG

SEQ ID NO: 818044 - protein, 27 aa, Mycobacterium
GLEAMMILSVLNFKYFRKLNSVANWLS

SEQ ID NO: 818045 - protein, 18 aa, Mycobacterium
GLEELLTEAWLTQAPKKL

SEQ ID NO: 818046 - protein, 19 aa, Mycobacterium
GLEERIKLLIATKCKGEKA

SEQ ID NO: 818047 - protein, 21 aa, Mycobacterium
GLEGLSIRRLADALGVNGASL

SEQ ID NO: 818048 - protein, 24 aa, Mycobacterium
GLEHVRELLPDRSPFHAWSNFEFV

SEQ ID NO: 818049 - protein, 24 aa, Mycobacterium
GLEIDTDLRWRIVTALASAGEIDA

SEQ ID NO: 818050 - protein, 24 aa, Mycobacterium
GLEIDTDLRWRIVTALATAGDIDA

SEQ ID NO: 818051 - protein, 18 aa, Mycobacterium
GLEIPLLIGGATTSRAHT

SEQ ID NO: 818052 - protein, 20 aa, Mycobacterium
GLELAAALRRGVTTLSARRD

SEQ ID NO: 818053 - protein, 19 aa, Mycobacterium
GLELALYCDILIASEQARF

SEQ ID NO: 818054 - protein, 18 aa, Mycobacterium
GLELIETHLLFGIDYDRI

SEQ ID NO: 818055 - protein, 18 aa, Mycobacterium
GLELIETHLLFGVDYDDI

SEQ ID NO: 818056 - protein, 20 aa, Mycobacterium
GLELLTRVWADEFGRSGVRV

SEQ ID NO: 818057 - protein, 35 aa, Mycobacterium
GLELMEDAWWGPTVPLVGAPWFALSERNSPGSIIV

SEQ ID NO: 818058 - protein, 26 aa, Mycobacterium
GLELRPRKLREAAALWDRLTQGAGID

SEQ ID NO: 818059 - protein, 24 aa, Mycobacterium
GLELRPRKLREAGALWERLTQAAG

SEQ ID NO: 818060 - protein, 31 aa, Mycobacterium
GLELTVVNPLVDATWRFMTLDHDGKIRMDCS

SEQ ID NO: 818061 - protein, 19 aa, Mycobacterium
GLELVGLMGIPPLDWDPDE

SEQ ID NO: 818062 - protein, 24 aa, Mycobacterium
GLEMPKVPSFMWLEVDDVVSQSLA

SEQ ID NO: 818063 - protein, 29 aa, Mycobacterium
GLEMVRKRPLPFPPEPLASIGIQATRWSL

SEQ ID NO: 818064 - protein, 26 aa, Mycobacterium
GLENPMLGFGLALLAGLVGLSRVVTG

SEQ ID NO: 818065 - protein, 26 aa, Mycobacterium
GLENPPLGFALALLAGLVGLSRVATG

SEQ ID NO: 818066 - protein, 25 aa, Mycobacterium
GLEPYPPFYFDGAIPFRTLHAVTEE

SEQ ID NO: 818067 - protein, 28 aa, Mycobacterium
GLEQEYELIVYWWPTPDKASVAGAILAA

SEQ ID NO: 818068 - protein, 26 aa, Mycobacterium
GLEQRLRALDFPKIVIGISGGLDSTH

SEQ ID NO: 818069 - protein, 27 aa, Mycobacterium
GLEQRLRALHYPKVVLGLSGGLDSTHA

SEQ ID NO: 818070 - protein, 18 aa, Mycobacterium
GLERKRMLLDLEKSRMAP

SEQ ID NO: 818071 - protein, 24 aa, Mycobacterium
GLERYRLPFNALTQTSLHDIDMSV

SEQ ID NO: 818072 - protein, 23 aa, Mycobacterium
GLETSRMLLWRAASALDCDAADK

SEQ ID NO: 818073 - protein, 20 aa, Mycobacterium
GLETSRNLLWRAASALDANH

SEQ ID NO: 818074 - protein, 26 aa, Mycobacterium
GLETWPGLASVPPTPFPAAITNLGGS

SEQ ID NO: 818075 - protein, 24 aa, Mycobacterium
GLEVDTDLRWRIVTALATAGVIDS

SEQ ID NO: 818076 - protein, 30 aa, Mycobacterium
GLEVLRQLRDLYPGLPLLLLTAKDSLEDRI

SEQ ID NO: 818077 - protein, 20 aa, Mycobacterium
GLEVPRDALLRLLVDMQYNR

SEQ ID NO: 818078 - protein, 20 aa, Mycobacterium
GLEWDAVFLVGLADGTLPIS

SEQ ID NO: 818079 - protein, 17 aa, Mycobacterium
GLEWDAVYLVGLADGTL

SEQ ID NO: 818080 - protein, 17 aa, Mycobacterium
GLEWLAEIGAHGVVAGP

SEQ ID NO: 818081 - protein, 23 aa, Mycobacterium
GLEWVSLRPTMFVSNLVGMWSTQ

SEQ ID NO: 818082 - protein, 17 aa, Mycobacterium
GLFAVNGILFNHESPRR

SEQ ID NO: 818083 - protein, 20 aa, Mycobacterium
GLFEFYTETLGFKSRGAFRV

SEQ ID NO: 818084 - protein, 17 aa, Mycobacterium
GLFFTPTVDFLDDPPPL

SEQ ID NO: 818085 - protein, 19 aa, Mycobacterium
GLFIGRAAWQLPGYVRILE

SEQ ID NO: 818086 - protein, 20 aa, Mycobacterium
GLFLDQRPLAVPGTAVTVTL

SEQ ID NO: 818087 - protein, 22 aa, Mycobacterium
GLFPMDVPVFATGFYEKFGYDR

SEQ ID NO: 818088 - protein, 17 aa, Mycobacterium
GLFQEKPGFARAGGVDP

SEQ ID NO: 818089 - protein, 19 aa, Mycobacterium
GLFRMLTPRRFGGYAVAPR

SEQ ID NO: 818090 - protein, 21 aa, Mycobacterium
GLFSGHYREDRFWSNEVLDEA

SEQ ID NO: 818091 - protein, 20 aa, Mycobacterium
GLFTPNYYEQLSIPVGIIDS

SEQ ID NO: 818092 - protein, 19 aa, Mycobacterium
GLFTQPLLPDLVEEEPFTG

SEQ ID NO: 818093 - protein, 19 aa, Mycobacterium
GLFVGQLIALAIDGVQSGA

SEQ ID NO: 818094 - protein, 40 aa, Mycobacterium
GLGAAGGAGGSAWLLGTGGTGGAGGWAAAGATGGIGGQGG

SEQ ID NO: 818095 - protein, 20 aa, Mycobacterium
GLGAALTLLGLHHLESRLTG

SEQ ID NO: 818096 - protein, 25 aa, Mycobacterium
GLGAAYLAGFAWGLNREYTVLVEMD

SEQ ID NO: 818097 - protein, 24 aa, Mycobacterium
GLGADLLAVVARLNRLATQRIQMP

SEQ ID NO: 818098 - protein, 20 aa, Mycobacterium
GLGAFMNWPGPTFTDSGGFQ

SEQ ID NO: 818099 - protein, 23 aa, Mycobacterium
GLGAGFARRYALEGYDLVFVARD

SEQ ID NO: 818100 - protein, 25 aa, Mycobacterium
GLGAIHLHLLMSEFEYWGVPGPDLT

SEQ ID NO: 818101 - protein, 40 aa, Mycobacterium
GLGARLFGLLMRLPPQVFGALFSHEWFVDPALPTGTLRRD

SEQ ID NO: 818102 - protein, 18 aa, Mycobacterium
GLGAWLAALPQGLSTVLT

SEQ ID NO: 818103 - protein, 24 aa, Mycobacterium
GLGDAMNLGWKLAATIGGEAPEHL

SEQ ID NO: 818104 - protein, 25 aa, Mycobacterium
GLGDLPLPAPGIGSGGYRLTALFSN

SEQ ID NO: 818105 - protein, 23 aa, Mycobacterium
GLGDQWFEGPPPIHQGKLFAGHS

SEQ ID NO: 818106 - protein, 24 aa, Mycobacterium
GLGEGYFINQHIIWRVGDEDVAEM

SEQ ID NO: 818107 - protein, 26 aa, Mycobacterium
GLGENLTPGPTWPPGAPDPAAPADPL

SEQ ID NO: 818108 - protein, 20 aa, Mycobacterium
GLGEWVVPTLLQHGSKEQVD

SEQ ID NO: 818109 - protein, 22 aa, Mycobacterium
GLGFEYFYGFLAGEASQYEPNL

SEQ ID NO: 818110 - protein, 19 aa, Mycobacterium
GLGFMSFRAGSGPDDEKQA

SEQ ID NO: 818111 - protein, 24 aa, Mycobacterium
GLGGCTRVWRFDRMATVCDPGSGR

SEQ ID NO: 818112 - protein, 26 aa, Mycobacterium
GLGGDPWRVLQRAGELLRRGGECLAE

SEQ ID NO: 818113 - protein, 25 aa, Mycobacterium
GLGGLGLVVARWLVDSGAGRVVLNG

SEQ ID NO: 818114 - protein, 17 aa, Mycobacterium
GLGGLYLEDCRVGEPAP

SEQ ID NO: 818115 - protein, 19 aa, Mycobacterium
GLGGPALVLPLRATDTVAG

SEQ ID NO: 818116 - protein, 23 aa, Mycobacterium
GLGGRGGFLFGDGGLGGQGGDGG

SEQ ID NO: 818117 - protein, 20 aa, Mycobacterium
GLGGVYPEIFLPLHGEHQAH

SEQ ID NO: 818118 - protein, 17 aa, Mycobacterium
GLGHWLDTGGRQRGFIV

SEQ ID NO: 818119 - protein, 17 aa, Mycobacterium
GLGKPRYEWTPDAVRRA

SEQ ID NO: 818120 - protein, 19 aa, Mycobacterium
GLGLALLAGLVGMSRVATG

SEQ ID NO: 818121 - protein, 25 aa, Mycobacterium
GLGLDFLRHIERCAVLVHVVDCATA

SEQ ID NO: 818122 - protein, 25 aa, Mycobacterium
GLGLDFLRHIERCAVLVHVVDCATL

SEQ ID NO: 818123 - protein, 25 aa, Mycobacterium
GLGLDFLRHIERCAVLVHVVDCATN

SEQ ID NO: 818124 - protein, 25 aa, Mycobacterium
GLGLDFLRHLERCAVLVHVVDCATM

SEQ ID NO: 818125 - protein, 18 aa, Mycobacterium
GLGLDLAWRIVVEKHKGN

SEQ ID NO: 818126 - protein, 25 aa, Mycobacterium
GLGLEFLRHIERCAVLVHVVDCATL

SEQ ID NO: 818127 - protein, 32 aa, Mycobacterium
GLGLETRGVFWLPPYHDFGLISVILSTLTGNS

SEQ ID NO: 818128 - protein, 18 aa, Mycobacterium
GLGLFLAEKMATPGSGAG

SEQ ID NO: 818129 - protein, 19 aa, Mycobacterium
GLGLGFDPPVVSAALLAAG

SEQ ID NO: 818130 - protein, 20 aa, Mycobacterium
GLGLRAALTAWFGQPRAASA

SEQ ID NO: 818131 - protein, 17 aa, Mycobacterium
GLGLTLFTALTGHAAFE

SEQ ID NO: 818132 - protein, 17 aa, Mycobacterium
GLGMGLPGARRLMDRLI

SEQ ID NO: 818133 - protein, 37 aa, Mycobacterium
GLGMLTAFEEMFWGDAGIALSIMGTGLAAAALAANGT

SEQ ID NO: 818134 - protein, 17 aa, Mycobacterium
GLGPIWMSANSDAKRKA

SEQ ID NO: 818135 - protein, 17 aa, Mycobacterium
GLGPLRRVRPDVVVDTQ

SEQ ID NO: 818136 - protein, 24 aa, Mycobacterium
GLGPVFEFRFLGARYVVAASADAV

SEQ ID NO: 818137 - protein, 17 aa, Mycobacterium
GLGQRTVLPGHGPELTD

SEQ ID NO: 818138 - protein, 26 aa, Mycobacterium
GLGRGTVWCTLLTIDPRRGLVGHHRK

SEQ ID NO: 818139 - protein, 18 aa, Mycobacterium
GLGRPGRLVGPDPGLLVS

SEQ ID NO: 818140 - protein, 18 aa, Mycobacterium
GLGRRELLPHSDLDLLLV

SEQ ID NO: 818141 - protein, 34 aa, Mycobacterium
GLGRTLIEVPVGFKWFVNGLIDGTIGFGGEESAG

SEQ ID NO: 818142 - protein, 25 aa, Mycobacterium
GLGRTLTMIGLRSLAQRLGDRDLGR

SEQ ID NO: 818143 - protein, 33 aa, Mycobacterium
GLGRTLVEVPVGFKWFVGGLLDGTIGFGGEESA

SEQ ID NO: 818144 - protein, 27 aa, Mycobacterium
GLGSDDRIFLISPLASVTGVLQALFIG

SEQ ID NO: 818145 - protein, 17 aa, Mycobacterium
GLGSKVTVIARGPRLLR

SEQ ID NO: 818146 - protein, 18 aa, Mycobacterium
GLGSLARIAHIAGTAPIS

SEQ ID NO: 818147 - protein, 25 aa, Mycobacterium
GLGSVAALLWHCPKSRRGRLFALRE

SEQ ID NO: 818148 - protein, 25 aa, Mycobacterium
GLGSVYRLRLALPQLDPGSLTLGRA

SEQ ID NO: 818149 - protein, 23 aa, Mycobacterium
GLGSVYRMRLALPQLDASALTLG

SEQ ID NO: 818150 - protein, 18 aa, Mycobacterium
GLGTAGNLRHHLRRGLGM

SEQ ID NO: 818151 - protein, 20 aa, Mycobacterium
GLGTMLRLDPETIYAAIGQA

SEQ ID NO: 818152 - protein, 23 aa, Mycobacterium
GLGVFWAVELVKDQKTREPLAPY

SEQ ID NO: 818153 - protein, 21 aa, Mycobacterium
GLGVLVCFAGRVLQPLGLNKV

SEQ ID NO: 818154 - protein, 23 aa, Mycobacterium
GLGVVTLGDLLPEPAHHEEPVVD

SEQ ID NO: 818155 - protein, 17 aa, Mycobacterium
GLGWVYLAVDHNVNDRP

SEQ ID NO: 818156 - protein, 27 aa, Mycobacterium
GLGYYGSRWRLAFGYPAARFDALSEDI

SEQ ID NO: 818157 - protein, 23 aa, Mycobacterium
GLHAAAGCWRGLAAALGGAEQGL

SEQ ID NO: 818158 - protein, 20 aa, Mycobacterium
GLHAAFPYLKGTPGAVVVNL

SEQ ID NO: 818159 - protein, 22 aa, Mycobacterium
GLHAHHLWHWEDGGPTELANLV

SEQ ID NO: 818160 - protein, 28 aa, Mycobacterium
GLHAPSWCDPVWLDFPGIAFGRPDEAGA

SEQ ID NO: 818161 - protein, 32 aa, Mycobacterium
GLHAYRGPWQYETLSREILLDIAARKIGIDPV

SEQ ID NO: 818162 - protein, 32 aa, Mycobacterium
GLHAYRGPWQYETLTREMLLDCAARKIGMDPV

SEQ ID NO: 818163 - protein, 29 aa, Mycobacterium
GLHDKIEGLRLPLLILHSPTDNTVGIENA

SEQ ID NO: 818164 - protein, 19 aa, Mycobacterium
GLHDPFFDQGDLGHHPGIG

SEQ ID NO: 818165 - protein, 26 aa, Mycobacterium
GLHFESILIRGLMNYAFWVPNGSPEY

SEQ ID NO: 818166 - protein, 18 aa, Mycobacterium
GLHFHPPQSLWLDSDRSD

SEQ ID NO: 818167 - protein, 24 aa, Mycobacterium
GLHFICRDVWLRVASTSTAWTSRF

SEQ ID NO: 818168 - protein, 22 aa, Mycobacterium
GLHFVCRDVWLQVASTSTAWTS

SEQ ID NO: 818169 - protein, 23 aa, Mycobacterium
GLHGLATVEFLFAGGEFVFLEVN

SEQ ID NO: 818170 - protein, 19 aa, Mycobacterium
GLHKLVVECLRLSADCLIC

SEQ ID NO: 818171 - protein, 21 aa, Mycobacterium
GLHPRIALMLDIESGGNPPGD

SEQ ID NO: 818172 - protein, 22 aa, Mycobacterium
GLHPTNLGRLVLGKQAALPCTP

SEQ ID NO: 818173 - protein, 30 aa, Mycobacterium
GLHQGIALQVPPYAYAHPDDLLRDAKSDAA

SEQ ID NO: 818174 - protein, 26 aa, Mycobacterium
GLHQGLGLQVPPYAYAHPDDLLATAR

SEQ ID NO: 818175 - protein, 24 aa, Mycobacterium
GLHQLYPLLAHVVLFGGGYATQTH

SEQ ID NO: 818176 - protein, 28 aa, Mycobacterium
GLHQRRLVVLPFLTPRIASLWVGTVTPI

SEQ ID NO: 818177 - protein, 24 aa, Mycobacterium
GLHRKHEIFLGTRGALGRGPEPAD

SEQ ID NO: 818178 - protein, 17 aa, Mycobacterium
GLHRLPIGEFPHVRDLA

SEQ ID NO: 818179 - protein, 17 aa, Mycobacterium
GLHTCWVAEAWGSDAPS

SEQ ID NO: 818180 - protein, 39 aa, Mycobacterium
GLHWDRILFCAKEATYKAWFPLTKRWLGFEDAHIVFDLD

SEQ ID NO: 818181 - protein, 38 aa, Mycobacterium
GLHWDRILFCAKEATYKVWFPLTNRWLGFEDAHITFEA

SEQ ID NO: 818182 - protein, 21 aa, Mycobacterium
GLHYTWFRADDPDGQRLLNAA

SEQ ID NO: 818183 - protein, 19 aa, Mycobacterium
GLIAAGRAWARFERGEVVY

SEQ ID NO: 818184 - protein, 25 aa, Mycobacterium
GLIAAHLQWHLERKLRTLPLVERGS

SEQ ID NO: 818185 - protein, 31 aa, Mycobacterium
GLIAALTAALLQLPVAHWPALGGMGNASWTQ

SEQ ID NO: 818186 - protein, 26 aa, Mycobacterium
GLIAAYRDRLPIGENWQPVTLREGGT

SEQ ID NO: 818187 - protein, 20 aa, Mycobacterium
GLIADLYARMHPETVGALVM

SEQ ID NO: 818188 - protein, 17 aa, Mycobacterium
GLIALLCKTDPNTKPRH

SEQ ID NO: 818189 - protein, 18 aa, Mycobacterium
GLIDAIVGLWLAPVTGED

SEQ ID NO: 818190 - protein, 24 aa, Mycobacterium
GLIDDFMVMVRPLSAATALAEAMG

SEQ ID NO: 818191 - protein, 23 aa, Mycobacterium
GLIDDFMVMVRPLSGAKALSEAM

SEQ ID NO: 818192 - protein, 23 aa, Mycobacterium
GLIDDFMVMVRPLSGAQALAEAM

SEQ ID NO: 818193 - protein, 24 aa, Mycobacterium
GLIDDFMVMVRPLSGATALSEAMG

SEQ ID NO: 818194 - protein, 19 aa, Mycobacterium
GLIDELGTLTWRQLDERSS

SEQ ID NO: 818195 - protein, 20 aa, Mycobacterium
GLIDFHLDFALGEPDLIRIQ

SEQ ID NO: 818196 - protein, 24 aa, Mycobacterium
GLIDRFNLRGERLGLVAGGAVLKH

SEQ ID NO: 818197 - protein, 18 aa, Mycobacterium
GLIESWTPIPGRFPSYLV

SEQ ID NO: 818198 - protein, 17 aa, Mycobacterium
GLIFAAHSSVAWNSARR

SEQ ID NO: 818199 - protein, 30 aa, Mycobacterium
GLIGMQLTLTELWRSYGIQPDLVIGHSMGE

SEQ ID NO: 818200 - protein, 31 aa, Mycobacterium
GLIGMQLTLTELWRSYGIQPDLVIGHSMGEV

SEQ ID NO: 818201 - protein, 22 aa, Mycobacterium
GLIGPAALKYLLFSGELVDVEQ

SEQ ID NO: 818202 - protein, 28 aa, Mycobacterium
GLIGRTQFAAMKPTAFFITTARGPVHDE

SEQ ID NO: 818203 - protein, 24 aa, Mycobacterium
GLIIGMLMYVPLLKRIYGEMAEMG

SEQ ID NO: 818204 - protein, 18 aa, Mycobacterium
GLIKAILCLEHKAIPATL

SEQ ID NO: 818205 - protein, 34 aa, Mycobacterium
GLIKAILSMQHGVLPPLLHFNRLPDELAGIETGL

SEQ ID NO: 818206 - protein, 27 aa, Mycobacterium
GLIKVVLALRHQAIPPSLNFAEPNPHI

SEQ ID NO: 818207 - protein, 18 aa, Mycobacterium
GLILTQWATHLGARVIST

SEQ ID NO: 818208 - protein, 20 aa, Mycobacterium
GLINAIGYPIAADAALLGLA

SEQ ID NO: 818209 - protein, 32 aa, Mycobacterium
GLINMEFIQFHPTGMVWPLSVKGILVTEGVRG

SEQ ID NO: 818210 - protein, 18 aa, Mycobacterium
GLIPPELIRELAASAKQL

SEQ ID NO: 818211 - protein, 19 aa, Mycobacterium
GLIPYLTVTDARAAIDWYV

SEQ ID NO: 818212 - protein, 21 aa, Mycobacterium
GLIQKAWASPLGSKLYDRAQL

SEQ ID NO: 818213 - protein, 27 aa, Mycobacterium
GLIRDDLRLLPPWRGSSSFPGKIPVSA

SEQ ID NO: 818214 - protein, 20 aa, Mycobacterium
GLIRFEARQGFRILLPDPRE

SEQ ID NO: 818215 - protein, 25 aa, Mycobacterium
GLIRPDVVWFGEALPDDAWERSVEA

SEQ ID NO: 818216 - protein, 19 aa, Mycobacterium
GLITLNRPKAINSLNQRMV

SEQ ID NO: 818217 - protein, 19 aa, Mycobacterium
GLITNMRGYWNLDMMTFGK

SEQ ID NO: 818218 - protein, 19 aa, Mycobacterium
GLITNMRGYWNLDVMEFGQ

SEQ ID NO: 818219 - protein, 20 aa, Mycobacterium
GLIVDFVRERGLTAIVKGLR

SEQ ID NO: 818220 - protein, 20 aa, Mycobacterium
GLIWEIAHNPGWRIDADGSV

SEQ ID NO: 818221 - protein, 30 aa, Mycobacterium
GLKGLKGLYEFFTPLLRNLGHSGRVVVIGT

SEQ ID NO: 818222 - protein, 19 aa, Mycobacterium
GLKIFPLVGWAERGGYDAQ

SEQ ID NO: 818223 - protein, 24 aa, Mycobacterium
GLKKPANWLLAARCLRGLLTMSSQ

SEQ ID NO: 818224 - protein, 19 aa, Mycobacterium
GLKLDFFINTSSIAAVWGG

SEQ ID NO: 818225 - protein, 20 aa, Mycobacterium
GLKLVVVDYLQLMTSGKKHE

SEQ ID NO: 818226 - protein, 24 aa, Mycobacterium
GLKMLDDMFPLMKTLYNSEPTAPT

SEQ ID NO: 818227 - protein, 27 aa, Mycobacterium
GLKPDGTMRLILHTRVLAGLAVAQMFP

SEQ ID NO: 818228 - protein, 25 aa, Mycobacterium
GLKPMRWGTGYMLGGKRFGPFGRNT

SEQ ID NO: 818229 - protein, 29 aa, Mycobacterium
GLKPSRGRLPLDPQLRRLPIRIVANGVLT

SEQ ID NO: 818230 - protein, 24 aa, Mycobacterium
GLKPSRGRLPLNSQLRRLPLVIVA

SEQ ID NO: 818231 - protein, 25 aa, Mycobacterium
GLKPTPLTWPVGIAGDFKGVLDRRG

SEQ ID NO: 818232 - protein, 27 aa, Mycobacterium
GLKPVHRRVLYAMFDSGFRPDRGHAKS

SEQ ID NO: 818233 - protein, 24 aa, Mycobacterium
GLKRERQLLVDFLCAATGGPMYYR

SEQ ID NO: 818234 - protein, 24 aa, Mycobacterium
GLKRIRIEILPITIGLPFGLTMFF

SEQ ID NO: 818235 - protein, 28 aa, Mycobacterium
GLKTKSIAWHWELMFTRPLTGYDIAAQQ

SEQ ID NO: 818236 - protein, 21 aa, Mycobacterium
GLLAHLPGLPQIRASVAELQS

SEQ ID NO: 818237 - protein, 23 aa, Mycobacterium
GLLAMPQAPVYAAAKAGLNNLTG

SEQ ID NO: 818238 - protein, 27 aa, Mycobacterium
GLLAQGSWTLRSLAAILWAESTDLPDD

SEQ ID NO: 818239 - protein, 17 aa, Mycobacterium
GLLATQLAKARGATVVA

SEQ ID NO: 818240 - protein, 19 aa, Mycobacterium
GLLAYRRVSEALADQTWYL

SEQ ID NO: 818241 - protein, 18 aa, Mycobacterium
GLLDAMGWLAANVPIYAV

SEQ ID NO: 818242 - protein, 21 aa, Mycobacterium
GLLDEFPPYDDVFDPVNRVLL

SEQ ID NO: 818243 - protein, 20 aa, Mycobacterium
GLLDFLTIDDTLMPQPGRRE

SEQ ID NO: 818244 - protein, 18 aa, Mycobacterium
GLLDPWIRIADLDGRYLG

SEQ ID NO: 818245 - protein, 19 aa, Mycobacterium
GLLDRIGVVRDAAGARFEQ

SEQ ID NO: 818246 - protein, 35 aa, Mycobacterium
GLLDRLDYLQWLGIDCIWLPPFYDSPLRDGGYDIR

SEQ ID NO: 818247 - protein, 28 aa, Mycobacterium
GLLDTAMVLGEPFMLPAHIDFAALRVKF

SEQ ID NO: 818248 - protein, 26 aa, Mycobacterium
GLLEQSRRHAFLASLLGIQHVVLAVN

SEQ ID NO: 818249 - protein, 36 aa, Mycobacterium
GLLEQSRRHAFLASLLGIRHIVLAVNKMDLIGWDQA

SEQ ID NO: 818250 - protein, 38 aa, Mycobacterium
GLLEQSRRHAFLASLLGIRHIVLAVNKMDLIGWDQERF

SEQ ID NO: 818251 - protein, 37 aa, Mycobacterium
GLLEQSRRHAFLASLLGIRHLVLAVNKMDLIGWDKAK

SEQ ID NO: 818252 - protein, 17 aa, Mycobacterium
GLLESKSLGRELWAHYV

SEQ ID NO: 818253 - protein, 18 aa, Mycobacterium
GLLGIGASGLAALLAACG

SEQ ID NO: 818254 - protein, 17 aa, Mycobacterium
GLLGKTRLFGQFSERIS

SEQ ID NO: 818255 - protein, 26 aa, Mycobacterium
GLLGRRIERSPLPFGRPRWVAYHEAP

SEQ ID NO: 818256 - protein, 22 aa, Mycobacterium
GLLGSELGLIPSLLTVRQSIAD

SEQ ID NO: 818257 - protein, 21 aa, Mycobacterium
GLLGVAWPVEYGGGGLTALEQ

SEQ ID NO: 818258 - protein, 18 aa, Mycobacterium
GLLGVSPLSNHPLAGGSG

SEQ ID NO: 818259 - protein, 28 aa, Mycobacterium
GLLHDGELYVCGRLKDLLILAGRNIHPQ

SEQ ID NO: 818260 - protein, 18 aa, Mycobacterium
GLLHGGVLAQRLTAWVGL

SEQ ID NO: 818261 - protein, 17 aa, Mycobacterium
GLLIAEVNISYKAQLRL

SEQ ID NO: 818262 - protein, 17 aa, Mycobacterium
GLLIGNAGAGGAGGEGT

SEQ ID NO: 818263 - protein, 18 aa, Mycobacterium
GLLKAAVVPRPVAWTSTV

SEQ ID NO: 818264 - protein, 19 aa, Mycobacterium
GLLKFRGGVRPPVPLDEVE

SEQ ID NO: 818265 - protein, 22 aa, Mycobacterium
GLLKIWDQRNYRFWADLTDALQ

SEQ ID NO: 818266 - protein, 18 aa, Mycobacterium
GLLKPLQHRAYSISSSAL

SEQ ID NO: 818267 - protein, 18 aa, Mycobacterium
GLLLLDPAIGLDGAWMRE

SEQ ID NO: 818268 - protein, 17 aa, Mycobacterium
GLLLLTDGLFEGHAGRG

SEQ ID NO: 818269 - protein, 27 aa, Mycobacterium
GLLLPAISLGLWYNFGDNRPFDVQRAV

SEQ ID NO: 818270 - protein, 19 aa, Mycobacterium
GLLLQLLDPANRADPYRLC

SEQ ID NO: 818271 - protein, 25 aa, Mycobacterium
GLLLRLRFELDHHINLRPARLYPGV

SEQ ID NO: 818272 - protein, 25 aa, Mycobacterium
GLLLRLRFELDHHINLRPGRLYPGV

SEQ ID NO: 818273 - protein, 18 aa, Mycobacterium
GLLLVTHDRWFLDEVATT

SEQ ID NO: 818274 - protein, 22 aa, Mycobacterium
GLLMAPTYAVPRLLARNGLSLQ

SEQ ID NO: 818275 - protein, 26 aa, Mycobacterium
GLLMAPTYAVPRLLARNGLTLQDFDF

SEQ ID NO: 818276 - protein, 22 aa, Mycobacterium
GLLMGDALLVRRPELFEGIHFA

SEQ ID NO: 818277 - protein, 24 aa, Mycobacterium
GLLMGVMLTRYPDLFGALVCSVPL

SEQ ID NO: 818278 - protein, 29 aa, Mycobacterium
GLLNAVHFELLWLLNKRDYYGHITDEDAK

SEQ ID NO: 818279 - protein, 19 aa, Mycobacterium
GLLNPNSGIRPRRGRGRIV

SEQ ID NO: 818280 - protein, 19 aa, Mycobacterium
GLLNRYSQFALAGAAAGAV

SEQ ID NO: 818281 - protein, 17 aa, Mycobacterium
GLLPAFAERFRCLVLEF

SEQ ID NO: 818282 - protein, 24 aa, Mycobacterium
GLLPQEQGLLFPPASKDDLPTVLR

SEQ ID NO: 818283 - protein, 24 aa, Mycobacterium
GLLPRDRAIITEFLSPLLAGQDPF

SEQ ID NO: 818284 - protein, 26 aa, Mycobacterium
GLLPVCADLLAMTRKQRAVLGPMHEG

SEQ ID NO: 818285 - protein, 20 aa, Mycobacterium
GLLQADLLVVNKIDLAALVG

SEQ ID NO: 818286 - protein, 19 aa, Mycobacterium
GLLQCAWVYNRGLDFDGLR

SEQ ID NO: 818287 - protein, 17 aa, Mycobacterium
GLLQLIDSRNWRDDADL

SEQ ID NO: 818288 - protein, 17 aa, Mycobacterium
GLLRERLEAYRAAPSGL

SEQ ID NO: 818289 - protein, 28 aa, Mycobacterium
GLLRPRLNPVAWMSGAWRATLTAGSAAE

SEQ ID NO: 818290 - protein, 19 aa, Mycobacterium
GLLRQYFPKGTDLSVHSAD

SEQ ID NO: 818291 - protein, 17 aa, Mycobacterium
GLLRRLRADGIDAPALF

SEQ ID NO: 818292 - protein, 18 aa, Mycobacterium
GLLRRLRADGIDAPALFL

SEQ ID NO: 818293 - protein, 21 aa, Mycobacterium
GLLRSLVDRPIEWSKVHLFWG

SEQ ID NO: 818294 - protein, 18 aa, Mycobacterium
GLLRTGPDVWIPLGNPSY

SEQ ID NO: 818295 - protein, 22 aa, Mycobacterium
GLLRTRLFAHTTAVLTSATLCL

SEQ ID NO: 818296 - protein, 17 aa, Mycobacterium
GLLRVCGGADLAAMAGF

SEQ ID NO: 818297 - protein, 28 aa, Mycobacterium
GLLSDARKLLRPKLKDHYGERLEALYAE

SEQ ID NO: 818298 - protein, 19 aa, Mycobacterium
GLLSFFLSNPVYALSLVTP

SEQ ID NO: 818299 - protein, 22 aa, Mycobacterium
GLLSTVPLAVLALGGEALGKPA

SEQ ID NO: 818300 - protein, 22 aa, Mycobacterium
GLLTARENINMIGSLRGIRRKE

SEQ ID NO: 818301 - protein, 18 aa, Mycobacterium
GLLTPKNLNGDYYTLGPD

SEQ ID NO: 818302 - protein, 17 aa, Mycobacterium
GLLTWRGVAKVMSEAPA

SEQ ID NO: 818303 - protein, 24 aa, Mycobacterium
GLLVDVVALPQPPAHRQRQRSVHP

SEQ ID NO: 818304 - protein, 17 aa, Mycobacterium
GLLVFLAHGDIADEVLE

SEQ ID NO: 818305 - protein, 18 aa, Mycobacterium
GLLVLTTFLDEDLVVRAV

SEQ ID NO: 818306 - protein, 20 aa, Mycobacterium
GLLYERLFDIADALQVRVGA

SEQ ID NO: 818307 - protein, 17 aa, Mycobacterium
GLLYHRYEIDDDGLISA

SEQ ID NO: 818308 - protein, 24 aa, Mycobacterium
GLMACLAYTWKQVVDTPLFAENEL

SEQ ID NO: 818309 - protein, 22 aa, Mycobacterium
GLMAPHWPAPWGVDADPLKQLI

SEQ ID NO: 818310 - protein, 27 aa, Mycobacterium
GLMAVYWDRYILPRRAQARRLLERARE

SEQ ID NO: 818311 - protein, 21 aa, Mycobacterium
GLMGPYLMHPIHWAVVDRWFD

SEQ ID NO: 818312 - protein, 25 aa, Mycobacterium
GLMGPYLMHPIHWAVVDRWFDPETT

SEQ ID NO: 818313 - protein, 17 aa, Mycobacterium
GLMIGLGPGISAELVLL

SEQ ID NO: 818314 - protein, 27 aa, Mycobacterium
GLMKQKWPERLVLVDEFPLTGLGKVAK

SEQ ID NO: 818315 - protein, 17 aa, Mycobacterium
GLMLAMGPGFCSELVLL

SEQ ID NO: 818316 - protein, 25 aa, Mycobacterium
GLMLATLAHRVGWPIPIGGSQVIAD

SEQ ID NO: 818317 - protein, 18 aa, Mycobacterium
GLMNALSPHFEGKILNLC

SEQ ID NO: 818318 - protein, 20 aa, Mycobacterium
GLMNAVNRFDPDKGPSFIGF

SEQ ID NO: 818319 - protein, 23 aa, Mycobacterium
GLMRRHIKPYQKPHPPIGVTGFS

SEQ ID NO: 818320 - protein, 17 aa, Mycobacterium
GLMRTFAVELGQHFIRV

SEQ ID NO: 818321 - protein, 27 aa, Mycobacterium
GLNANGAGWNFGFGNSGSFNLGFGNTG

SEQ ID NO: 818322 - protein, 18 aa, Mycobacterium
GLNDGNFFELDWALQRHN

SEQ ID NO: 818323 - protein, 25 aa, Mycobacterium
GLNDNRWAILLKIHPCMADGISAAQ

SEQ ID NO: 818324 - protein, 29 aa, Mycobacterium
GLNGISYYAINQWLLAAQQPPSLAAMIPW

SEQ ID NO: 818325 - protein, 22 aa, Mycobacterium
GLNGLLLPEDYPEGGLIELTRD

SEQ ID NO: 818326 - protein, 24 aa, Mycobacterium
GLNHDVLLIAVGALASMALAVAKR

SEQ ID NO: 818327 - protein, 27 aa, Mycobacterium
GLNHHGAALLKALVERLKDRHTLAPPI

SEQ ID NO: 818328 - protein, 21 aa, Mycobacterium
GLNIGIMPYALGKCGLNQITE

SEQ ID NO: 818329 - protein, 17 aa, Mycobacterium
GLNIIYAHLNRIIRQRD

SEQ ID NO: 818330 - protein, 19 aa, Mycobacterium
GLNKTLGGPLGPWAGLGAD

SEQ ID NO: 818331 - protein, 17 aa, Mycobacterium
GLNLKWGHLDTDNTSLF

SEQ ID NO: 818332 - protein, 19 aa, Mycobacterium
GLNLRRAAELTALSSDDML

SEQ ID NO: 818333 - protein, 19 aa, Mycobacterium
GLNLRSPLLASASPLSQTL

SEQ ID NO: 818334 - protein, 24 aa, Mycobacterium
GLNLSIRDGWWDEWYDGENGWEIP

SEQ ID NO: 818335 - protein, 22 aa, Mycobacterium
GLNMLRLWDDRGTLEPWIAPLS

SEQ ID NO: 818336 - protein, 32 aa, Mycobacterium
GLNMLRLWDDRGTLEPWITPLAKALGDGTIAP

SEQ ID NO: 818337 - protein, 17 aa, Mycobacterium
GLNNAIALPRVWEYNLP

SEQ ID NO: 818338 - protein, 24 aa, Mycobacterium
GLNNRRGFRLLAEAALLAARTHGH

SEQ ID NO: 818339 - protein, 24 aa, Mycobacterium
GLNNRRGFYLLAEQKLRGSHHLGH

SEQ ID NO: 818340 - protein, 28 aa, Mycobacterium
GLNPNLVLLRISAFGRRGPWRQRSATPL

SEQ ID NO: 818341 - protein, 25 aa, Mycobacterium
GLNYLYRRGEFHDAPRPDLILLDLN

SEQ ID NO: 818342 - protein, 22 aa, Mycobacterium
GLPADLFQVLPGRGSVVGERFV

SEQ ID NO: 818343 - protein, 19 aa, Mycobacterium
GLPAFLQKKGRKVRFMAKK

SEQ ID NO: 818344 - protein, 21 aa, Mycobacterium
GLPALWLRRLCANMLCKLGVF

SEQ ID NO: 818345 - protein, 27 aa, Mycobacterium
GLPAQPAEPLPWLLSGAKTLSYAINMS

SEQ ID NO: 818346 - protein, 25 aa, Mycobacterium
GLPASAINWGLWKSLADAQTGFEAQ

SEQ ID NO: 818347 - protein, 22 aa, Mycobacterium
GLPATTVNWGQWADVGLASSLR

SEQ ID NO: 818348 - protein, 17 aa, Mycobacterium
GLPAVAYLHPRLVNAEA

SEQ ID NO: 818349 - protein, 23 aa, Mycobacterium
GLPDDGWVLDELRELAGILGIAR

SEQ ID NO: 818350 - protein, 27 aa, Mycobacterium
GLPDDLKFALVEPLRLLFKDEVRAVGR

SEQ ID NO: 818351 - protein, 23 aa, Mycobacterium
GLPDEGWVLDELRELAGILGMAR

SEQ ID NO: 818352 - protein, 17 aa, Mycobacterium
GLPDELFDAWFAPAVEN

SEQ ID NO: 818353 - protein, 24 aa, Mycobacterium
GLPDGEPVEWWIADGVLSAEPIAG

SEQ ID NO: 818354 - protein, 25 aa, Mycobacterium
GLPDPLSYGLLRYLNPEVALPHSDS

SEQ ID NO: 818355 - protein, 17 aa, Mycobacterium
GLPEAADDHRRVRAVIA

SEQ ID NO: 818356 - protein, 20 aa, Mycobacterium
GLPEDDLPWFRKRAVELISY

SEQ ID NO: 818357 - protein, 28 aa, Mycobacterium
GLPEEIVARQPFPGPGLGIRIVGEVTGQ

SEQ ID NO: 818358 - protein, 19 aa, Mycobacterium
GLPEFTIPSLTIPSQALGN

SEQ ID NO: 818359 - protein, 26 aa, Mycobacterium
GLPEHSWLRRFVGLGGASRTTQRNTR

SEQ ID NO: 818360 - protein, 20 aa, Mycobacterium
GLPELTSTKWIVWGDGHTRP

SEQ ID NO: 818361 - protein, 22 aa, Mycobacterium
GLPEMGLVGQQLWQQSGLKPTD

SEQ ID NO: 818362 - protein, 21 aa, Mycobacterium
GLPEMGVVARQLWRDSGLKPQ

SEQ ID NO: 818363 - protein, 20 aa, Mycobacterium
GLPEMGVVGQQLWAQSGLKP

SEQ ID NO: 818364 - protein, 20 aa, Mycobacterium
GLPEMGVVGRQLWGQSGLKP

SEQ ID NO: 818365 - protein, 18 aa, Mycobacterium
GLPESDFPRMLKLTQEMF

SEQ ID NO: 818366 - protein, 20 aa, Mycobacterium
GLPFEIRTTAPSDFVTSAGR

SEQ ID NO: 818367 - protein, 18 aa, Mycobacterium
GLPFTICRPFNAYGPGEL

SEQ ID NO: 818368 - protein, 17 aa, Mycobacterium
GLPFVANYHVTPWSTVE

SEQ ID NO: 818369 - protein, 20 aa, Mycobacterium
GLPGIPLAIARPDLEVVLLE

SEQ ID NO: 818370 - protein, 18 aa, Mycobacterium
GLPGIPLALARPDVHVVL

SEQ ID NO: 818371 - protein, 19 aa, Mycobacterium
GLPGLPLAIARPDLQVVLL

SEQ ID NO: 818372 - protein, 26 aa, Mycobacterium
GLPHALKFLLMLRGGARQTKSQGTAV

SEQ ID NO: 818373 - protein, 20 aa, Mycobacterium
GLPHVRLHDARHSCATLMHL

SEQ ID NO: 818374 - protein, 18 aa, Mycobacterium
GLPIRAIVRSPLLRCERT

SEQ ID NO: 818375 - protein, 23 aa, Mycobacterium
GLPIVDLLTGMFAAVGVAAALAG

SEQ ID NO: 818376 - protein, 18 aa, Mycobacterium
GLPIVIDGAIVGGIAAGG

SEQ ID NO: 818377 - protein, 31 aa, Mycobacterium
GLPKASVMTHYRWLRALAGFGGLGLRLRSND

SEQ ID NO: 818378 - protein, 27 aa, Mycobacterium
GLPKASVMTHYRWLRGMSGIGDMALRL

SEQ ID NO: 818379 - protein, 28 aa, Mycobacterium
GLPLATMHYFPMRPNGQLAPNLPAPLVR

SEQ ID NO: 818380 - protein, 20 aa, Mycobacterium
GLPLFGPFWDRDAQLPTRAA

SEQ ID NO: 818381 - protein, 20 aa, Mycobacterium
GLPLLLLHDKVYKATDGRIG

SEQ ID NO: 818382 - protein, 17 aa, Mycobacterium
GLPLQRLVNGEGMASLA

SEQ ID NO: 818383 - protein, 24 aa, Mycobacterium
GLPLQSMLCEPVIRRIDVLASQGH

SEQ ID NO: 818384 - protein, 24 aa, Mycobacterium
GLPNERAMNFLGEPRVVIGPLYET

SEQ ID NO: 818385 - protein, 28 aa, Mycobacterium
GLPNMRTVLHCLPPKDWTEPGFMGLGMI

SEQ ID NO: 818386 - protein, 24 aa, Mycobacterium
GLPPEDLDFFRRLSLDLISIPTDI

SEQ ID NO: 818387 - protein, 32 aa, Mycobacterium
GLPPERIQRRGMADNYWSMGIPGPCGPSSEIY

SEQ ID NO: 818388 - protein, 17 aa, Mycobacterium
GLPPLSGGMVGFLAYDI

SEQ ID NO: 818389 - protein, 18 aa, Mycobacterium
GLPPNRVTLIWNAATDNP

SEQ ID NO: 818390 - protein, 22 aa, Mycobacterium
GLPQGDPLPPLPSDSFALVPIE

SEQ ID NO: 818391 - protein, 22 aa, Mycobacterium
GLPQWYGDQGMFLTTHYFGTKI

SEQ ID NO: 818392 - protein, 19 aa, Mycobacterium
GLPRLLRAVPVLGGRLREL

SEQ ID NO: 818393 - protein, 20 aa, Mycobacterium
GLPSLSVPAAFTADGLPLGV

SEQ ID NO: 818394 - protein, 25 aa, Mycobacterium
GLPTAKVWGLYMAGSRLGFETNVVQ

SEQ ID NO: 818395 - protein, 32 aa, Mycobacterium
GLPTQPLQGSNWIALLLEPPERAVAPGTPEWE

SEQ ID NO: 818396 - protein, 21 aa, Mycobacterium
GLPTVFVYDGHPGGAGFAARG

SEQ ID NO: 818397 - protein, 26 aa, Mycobacterium
GLPVDKLRFPVFSWQRITLQEMLHMR

SEQ ID NO: 818398 - protein, 19 aa, Mycobacterium
GLPVGGWTAACDGGFIARD

SEQ ID NO: 818399 - protein, 34 aa, Mycobacterium
GLPVGPPPGVVPKPLKGMPPFSGPQGPFAGIAAG

SEQ ID NO: 818400 - protein, 17 aa, Mycobacterium
GLPVIELTLRTPAALDA

SEQ ID NO: 818401 - protein, 21 aa, Mycobacterium
GLPVVPMIGLLAAAAFDFLDE

SEQ ID NO: 818402 - protein, 17 aa, Mycobacterium
GLPVWIGGHLKEPIDNH

SEQ ID NO: 818403 - protein, 35 aa, Mycobacterium
GLPYDAYTNPGQPIWWLARALEFFQDGEEFWRLLF

SEQ ID NO: 818404 - protein, 19 aa, Mycobacterium
GLPYVQTHPWWPDAGDDPE

SEQ ID NO: 818405 - protein, 22 aa, Mycobacterium
GLQCGFCTPGFLVSAVELLRDP

SEQ ID NO: 818406 - protein, 18 aa, Mycobacterium
GLQDGVLRGPVGLFGVDV

SEQ ID NO: 818407 - protein, 18 aa, Mycobacterium
GLQFTRLAGGRPMCPRRS

SEQ ID NO: 818408 - protein, 23 aa, Mycobacterium
GLQGIVVPERWGGAGAGVVELAV

SEQ ID NO: 818409 - protein, 27 aa, Mycobacterium
GLQIVGRFLALLELFRARAVAFEQSEP

SEQ ID NO: 818410 - protein, 18 aa, Mycobacterium
GLQLALAMRRGSEIGSAG

SEQ ID NO: 818411 - protein, 19 aa, Mycobacterium
GLQLDVILVAHSWGGYPAT

SEQ ID NO: 818412 - protein, 24 aa, Mycobacterium
GLQLHGAMGFTWENDLQFALKRAK

SEQ ID NO: 818413 - protein, 25 aa, Mycobacterium
GLQLHGAMGFTWENDLQFALKRAKA

SEQ ID NO: 818414 - protein, 23 aa, Mycobacterium
GLQLLVAGRNRPGGVAPLVGTPG

SEQ ID NO: 818415 - protein, 18 aa, Mycobacterium
GLQPLLDELALIDAAPDA

SEQ ID NO: 818416 - protein, 32 aa, Mycobacterium
GLQVCRYLPGRAIVVLMLMHYLDGDLGRYHEF

SEQ ID NO: 818417 - protein, 17 aa, Mycobacterium
GLQVGILGLGRIGSAIA

SEQ ID NO: 818418 - protein, 31 aa, Mycobacterium
GLQVKTIWAARAISVLFPQITTIGGFRQDPL

SEQ ID NO: 818419 - protein, 20 aa, Mycobacterium
GLQVWAPSVIPPIGVELSDA

SEQ ID NO: 818420 - protein, 23 aa, Mycobacterium
GLQYLAGCIAGCLHLAFDYERDH

SEQ ID NO: 818421 - protein, 26 aa, Mycobacterium
GLRAARPTLILWVGADQPVWAAAVKR

SEQ ID NO: 818422 - protein, 23 aa, Mycobacterium
GLRAAVEARRRVPRSPILVLSQY

SEQ ID NO: 818423 - protein, 19 aa, Mycobacterium
GLRADRILHASSAGTGILP

SEQ ID NO: 818424 - protein, 23 aa, Mycobacterium
GLRALFTTWITAPQPDLDVLVPA

SEQ ID NO: 818425 - protein, 23 aa, Mycobacterium
GLRALFTTWITCPQPDLDLLVPA

SEQ ID NO: 818426 - protein, 17 aa, Mycobacterium
GLRALYLYAAAHQDDAV

SEQ ID NO: 818427 - protein, 26 aa, Mycobacterium
GLRDHNMQWDFWTLRPETAHQVTWLM

SEQ ID NO: 818428 - protein, 17 aa, Mycobacterium
GLRELAPTLPRSSTATI

SEQ ID NO: 818429 - protein, 20 aa, Mycobacterium
GLRELLLRYDGRADRPIMAT

SEQ ID NO: 818430 - protein, 36 aa, Mycobacterium
GLRFGVSPPPWLDPGQWWALVRVGCAGRLLYSPAVR

SEQ ID NO: 818431 - protein, 17 aa, Mycobacterium
GLRFRQCQMSDNDAIDA

SEQ ID NO: 818432 - protein, 20 aa, Mycobacterium
GLRGLLRVIGAEYPHLHTTH

SEQ ID NO: 818433 - protein, 21 aa, Mycobacterium
GLRGLLRVIGAEYPHLHTTHV

SEQ ID NO: 818434 - protein, 23 aa, Mycobacterium
GLRGNVIRRLSMSELLMSDRARV

SEQ ID NO: 818435 - protein, 19 aa, Mycobacterium
GLRGRFVKCVHSVGAPLAP

SEQ ID NO: 818436 - protein, 20 aa, Mycobacterium
GLRHCPFLELAENRSSVVCP

SEQ ID NO: 818437 - protein, 21 aa, Mycobacterium
GLRHCPFLELAENRTAVVCPV

SEQ ID NO: 818438 - protein, 20 aa, Mycobacterium
GLRHCPFLEVAESRSAIVCP

SEQ ID NO: 818439 - protein, 24 aa, Mycobacterium
GLRHDQKGWRLLLGGRTTSVCDGD

SEQ ID NO: 818440 - protein, 32 aa, Mycobacterium
GLRIGYVVAPLARRPALIRSLRATSWGASSIA

SEQ ID NO: 818441 - protein, 26 aa, Mycobacterium
GLRITPVRIWHEGRFLGDVAKLLVAN

SEQ ID NO: 818442 - protein, 33 aa, Mycobacterium
GLRKNALFPFVDFIRALSEEQVFFPPTGRALFD

SEQ ID NO: 818443 - protein, 17 aa, Mycobacterium
GLRLAGRKVVVVGAGSV

SEQ ID NO: 818444 - protein, 19 aa, Mycobacterium
GLRLGVEAALRSLARIAPT

SEQ ID NO: 818445 - protein, 18 aa, Mycobacterium
GLRLPLNSISWQPPRPSF

SEQ ID NO: 818446 - protein, 18 aa, Mycobacterium
GLRLPLNSISWQPPRTSF

SEQ ID NO: 818447 - protein, 18 aa, Mycobacterium
GLRLRRRSTLAAAARRVL

SEQ ID NO: 818448 - protein, 19 aa, Mycobacterium
GLRNATVGKLLGFRVVTSN

SEQ ID NO: 818449 - protein, 26 aa, Mycobacterium
GLRNSVMFGPPGRLYTYRSHGIHVCA

SEQ ID NO: 818450 - protein, 19 aa, Mycobacterium
GLRPAVYYFGRRIEDDPIE

SEQ ID NO: 818451 - protein, 18 aa, Mycobacterium
GLRPAWITDLHNVFGSAA

SEQ ID NO: 818452 - protein, 17 aa, Mycobacterium
GLRPEDLNIDLGPLGPL

SEQ ID NO: 818453 - protein, 25 aa, Mycobacterium
GLRPRDVVALMRWAAPALRPATLTE

SEQ ID NO: 818454 - protein, 23 aa, Mycobacterium
GLRPRSYLVDYWTETVRAVGARR

SEQ ID NO: 818455 - protein, 25 aa, Mycobacterium
GLRQRILLVTNDFPPRPGGIQSYLQ

SEQ ID NO: 818456 - protein, 27 aa, Mycobacterium
GLRRGLRPDLELLYVGALFHDIGLTDR

SEQ ID NO: 818457 - protein, 18 aa, Mycobacterium
GLRRLPRLGRDYAATFRY

SEQ ID NO: 818458 - protein, 17 aa, Mycobacterium
GLRRNFRWDPLDSVYFA

SEQ ID NO: 818459 - protein, 17 aa, Mycobacterium
GLRRRLPSMLGADQRRM

SEQ ID NO: 818460 - protein, 19 aa, Mycobacterium
GLRRRVRLASVLRRCTVLD

SEQ ID NO: 818461 - protein, 23 aa, Mycobacterium
GLRRRYIPIVGPPGSLAAVTAAG

SEQ ID NO: 818462 - protein, 24 aa, Mycobacterium
GLRRSELLGLRWVDFDEKASMLAI

SEQ ID NO: 818463 - protein, 27 aa, Mycobacterium
GLRSDIGMIFQQFNLFRSRTVAGNIAY

SEQ ID NO: 818464 - protein, 21 aa, Mycobacterium
GLRSRILLQVHDELLFEVSEG

SEQ ID NO: 818465 - protein, 20 aa, Mycobacterium
GLRSRMLLQVHDELLFEVAE

SEQ ID NO: 818466 - protein, 27 aa, Mycobacterium
GLRTARQLLLDIIDIGLPVGCEFLEPT

SEQ ID NO: 818467 - protein, 25 aa, Mycobacterium
GLRTAYFAFGRLYFDESLPLDAELA

SEQ ID NO: 818468 - protein, 17 aa, Mycobacterium
GLRTGTDFEYELQMAQM

SEQ ID NO: 818469 - protein, 17 aa, Mycobacterium
GLRTLIHMDDPLHRDIR

SEQ ID NO: 818470 - protein, 20 aa, Mycobacterium
GLRTRLFAAPGWNVSPGTVT

SEQ ID NO: 818471 - protein, 21 aa, Mycobacterium
GLRTRLFAAPGWTASAGAIEM

SEQ ID NO: 818472 - protein, 24 aa, Mycobacterium
GLRTVLGFLELSLGRHAAAVDVLS

SEQ ID NO: 818473 - protein, 19 aa, Mycobacterium
GLRVPKILDYGAMAGLAYA

SEQ ID NO: 818474 - protein, 17 aa, Mycobacterium
GLRVPKILDYGAMAGLR

SEQ ID NO: 818475 - protein, 30 aa, Mycobacterium
GLRYATNVRRILYLASFQLQPGQSLLSPND

SEQ ID NO: 818476 - protein, 24 aa, Mycobacterium
GLSARYFYESFPDKDEFIGGVFDW

SEQ ID NO: 818477 - protein, 18 aa, Mycobacterium
GLSATWLQMELGLITPED

SEQ ID NO: 818478 - protein, 30 aa, Mycobacterium
GLSAVDLSVDQLLGSGWKGGAGSAYSEQWD

SEQ ID NO: 818479 - protein, 29 aa, Mycobacterium
GLSDPAGYLVWLRELTGPDAWIVIEKILA

SEQ ID NO: 818480 - protein, 34 aa, Mycobacterium
GLSDRRQAMLPAHAVVLHPGPMLRGMEIASSVAD

SEQ ID NO: 818481 - protein, 34 aa, Mycobacterium; identical to SEQ ID NO: 114836

SEQ ID NO: 818482 - protein, 26 aa, Mycobacterium
GLSFDPAWWRRAAELGWTGLLVPEEL

SEQ ID NO: 818483 - protein, 23 aa, Mycobacterium
GLSFDPQWWQRAAELGWTALLVP

SEQ ID NO: 818484 - protein, 17 aa, Mycobacterium
GLSFLLASSLGGMSVWL

SEQ ID NO: 818485 - protein, 27 aa, Mycobacterium
GLSFPHGPFSVGFARFFEIWVDVEAHR

SEQ ID NO: 818486 - protein, 26 aa, Mycobacterium
GLSFVGLPWMHTWGSGRFLGIDRDAR

SEQ ID NO: 818487 - protein, 22 aa, Mycobacterium
GLSFYDFPMRPKPYKDAYRARL

SEQ ID NO: 818488 - protein, 17 aa, Mycobacterium
GLSGANSAGARGGAGGA

SEQ ID NO: 818489 - protein, 31 aa, Mycobacterium
GLSIGTLYQYFPDKLALLRAVAERHVRDADR

SEQ ID NO: 818490 - protein, 20 aa, Mycobacterium
GLSKIARLVDLYSKRPQVQE

SEQ ID NO: 818491 - protein, 18 aa, Mycobacterium
GLSLFDHWRDGYKTLHGM

SEQ ID NO: 818492 - protein, 18 aa, Mycobacterium
GLSLLRHVKDLVNTGWPV

SEQ ID NO: 818493 - protein, 25 aa, Mycobacterium
GLSLTPTLVFDYPTPRDVASYLEYQ

SEQ ID NO: 818494 - protein, 20 aa, Mycobacterium
GLSMAQYAVLRALADHPTAS

SEQ ID NO: 818495 - protein, 18 aa, Mycobacterium
GLSRALGYSSRQLNRVLL

SEQ ID NO: 818496 - protein, 25 aa, Mycobacterium
GLSRPNIERALIAAGKDLGSLAPAD

SEQ ID NO: 818497 - protein, 22 aa, Mycobacterium
GLSRPSLDDVFLMLTGHRTDDT

SEQ ID NO: 818498 - protein, 24 aa, Mycobacterium
GLSRQMAIILLGGLRELTALIVED

SEQ ID NO: 818499 - protein, 25 aa, Mycobacterium
GLSRTPVHEAFLRLAAEDLLELLPR

SEQ ID NO: 818500 - protein, 37 aa, Mycobacterium
GLSSCFLEPLESTGIFLIYAALYQLAKHFPDRRFDPV

SEQ ID NO: 818501 - protein, 18 aa, Mycobacterium
GLSSRLFQEIRESRGLAY

SEQ ID NO: 818502 - protein, 18 aa, Mycobacterium
GLSSRLFQEIRETRGLAY

SEQ ID NO: 818503 - protein, 24 aa, Mycobacterium
GLSTKLVEPLIAGLPDTLTREVSE

SEQ ID NO: 818504 - protein, 18 aa, Mycobacterium
GLSVLRYAIRTEIRLITS

SEQ ID NO: 818505 - protein, 20 aa, Mycobacterium
GLSVPASWAALPAAGSAAAP

SEQ ID NO: 818506 - protein, 22 aa, Mycobacterium
GLSVPPAWNLPPAVRQVAAMFP

SEQ ID NO: 818507 - protein, 22 aa, Mycobacterium
GLSWLTILRKRENFRRAFHGFD

SEQ ID NO: 818508 - protein, 28 aa, Mycobacterium
GLSYADLLAAIRFVAPYSGYPAAADALA

SEQ ID NO: 818509 - protein, 23 aa, Mycobacterium
GLTAARFVANPYAAEPGARFYRS

SEQ ID NO: 818510 - protein, 27 aa, Mycobacterium
GLTAGVRNLYLLGSSPLDELRTQFGNA

SEQ ID NO: 818511 - protein, 24 aa, Mycobacterium
GLTAMPGWGLYCAGKFALNGMSEA

SEQ ID NO: 818512 - protein, 26 aa, Mycobacterium
GLTARVLQRWSVAPVRPAVTVVQALP

SEQ ID NO: 818513 - protein, 25 aa, Mycobacterium
GLTASRFIACPFGAPGTRMYRTGDL

SEQ ID NO: 818514 - protein, 25 aa, Mycobacterium
GLTASRFIACPFGGPGARMYRTGDL

SEQ ID NO: 818515 - protein, 26 aa, Mycobacterium
GLTASRFLACPFGGPGSRMYRTGDLV

SEQ ID NO: 818516 - protein, 34 aa, Mycobacterium
GLTATHTWWRIDWNTLLDASVPIALFALDTDPAR

SEQ ID NO: 818517 - protein, 22 aa, Mycobacterium
GLTAVRWRDEVDPQRVCYVELP

SEQ ID NO: 818518 - protein, 26 aa, Mycobacterium
GLTDQLPLVNVLLGGIALGLADGPTE

SEQ ID NO: 818519 - protein, 27 aa, Mycobacterium
GLTDRLRRSFGRMPWTTTQKRLPRPYS

SEQ ID NO: 818520 - protein, 24 aa, Mycobacterium
GLTEAIIIKWLVSVGDTVVIDQPV

SEQ ID NO: 818521 - protein, 25 aa, Mycobacterium
GLTEFKLATFLLSQLALTPDDRIDM

SEQ ID NO: 818522 - protein, 24 aa, Mycobacterium
GLTEKVMGWLRPLIKGYHRAEVHG

SEQ ID NO: 818523 - protein, 20 aa, Mycobacterium
GLTEMRWRLSIFGDGPDRER

SEQ ID NO: 818524 - protein, 26 aa, Mycobacterium
GLTEVGLLKYLIGQLLLSEPARVETL

SEQ ID NO: 818525 - protein, 17 aa, Mycobacterium
GLTFPLLSDPDRKVLTA

SEQ ID NO: 818526 - protein, 21 aa, Mycobacterium
GLTFQGWLRNSPYYPHDGLFA

SEQ ID NO: 818527 - protein, 21 aa, Mycobacterium
GLTGGSWQGPAAAAMAAAAAP

SEQ ID NO: 818528 - protein, 24 aa, Mycobacterium
GLTGGVFVNRILLDGLREELTSRG

SEQ ID NO: 818529 - protein, 22 aa, Mycobacterium
GLTGSRFVACPFGGAGTRMYRT

SEQ ID NO: 818530 - protein, 28 aa, Mycobacterium
GLTGVQRVFFGWAQVWRTKSRDAEAIRR

SEQ ID NO: 818531 - protein, 28 aa, Mycobacterium
GLTGVQRVFFGWAQVWRTKSREAEAIRR

SEQ ID NO: 818532 - protein, 18 aa, Mycobacterium
GLTLDPDQPLHLAFTRIQ

SEQ ID NO: 818533 - protein, 17 aa, Mycobacterium
GLTLMVPATAWETRPAQ

SEQ ID NO: 818534 - protein, 24 aa, Mycobacterium
GLTLNPLSWASALARSAFGAVTAA

SEQ ID NO: 818535 - protein, 21 aa, Mycobacterium
GLTLRIPRPRLCTDNGAMIAS

SEQ ID NO: 818536 - protein, 26 aa, Mycobacterium
GLTLSRTLIFDYPTPTAVARHLGERL

SEQ ID NO: 818537 - protein, 18 aa, Mycobacterium
GLTNGVAAALLLSSRILG

SEQ ID NO: 818538 - protein, 24 aa, Mycobacterium
GLTNLELHLLPIEDLHTLGRDFDL

SEQ ID NO: 818539 - protein, 25 aa, Mycobacterium
GLTPEGDRLVLWARRILADRDALEH

SEQ ID NO: 818540 - protein, 20 aa, Mycobacterium
GLTPTPVRRPLFSSRPAGVP

SEQ ID NO: 818541 - protein, 23 aa, Mycobacterium
GLTQLRALYRDMVVVRRIDNEST

SEQ ID NO: 818542 - protein, 19 aa, Mycobacterium
GLTRFVFTSSIGTIGLRAG

SEQ ID NO: 818543 - protein, 17 aa, Mycobacterium
GLTRIDPVLREAATALG

SEQ ID NO: 818544 - protein, 18 aa, Mycobacterium
GLTRPVIVAPMAGGPSTP

SEQ ID NO: 818545 - protein, 18 aa, Mycobacterium
GLTRWLTGMFDRDGWQPG

SEQ ID NO: 818546 - protein, 20 aa, Mycobacterium
GLTRYFATKAGMTDLIKLVP

SEQ ID NO: 818547 - protein, 34 aa, Mycobacterium
GLTSLQPQQGFSGTYPYWGFQKATSEDLDRLMNY

SEQ ID NO: 818548 - protein, 19 aa, Mycobacterium
GLTSPRPDHYDPMAAWAAG

SEQ ID NO: 818549 - protein, 26 aa, Mycobacterium
GLTTEGFPNLFLIAGPNSPSVLSNMA

SEQ ID NO: 818550 - protein, 33 aa, Mycobacterium
GLTTNLRRRGDRWYWHWDPQFISGTAAFPPFEV

SEQ ID NO: 818551 - protein, 33 aa, Mycobacterium
GLTTNLRRRGDRWYWHWDPQFISGTAAFPPIEV

SEQ ID NO: 818552 - protein, 33 aa, Mycobacterium
GLTTNLRRRGDRWYWHWDPRFISGTAAFPPIEV

SEQ ID NO: 818553 - protein, 20 aa, Mycobacterium
GLTVDTDLRWRIVNALAASG

SEQ ID NO: 818554 - protein, 19 aa, Mycobacterium
GLTVRRKAGRLANLEAALA

SEQ ID NO: 818555 - protein, 26 aa, Mycobacterium
GLTVSWLARDVPSLGWRSYRLADGAG

SEQ ID NO: 818556 - protein, 20 aa, Mycobacterium
GLTYGLLRYLNPDADVAGPD

SEQ ID NO: 818557 - protein, 21 aa, Mycobacterium
GLTYGLLRYLNPEVGLAGSEP

SEQ ID NO: 818558 - protein, 27 aa, Mycobacterium
GLVAFSLHYPWSQKLPVHSLDGATVLP

SEQ ID NO: 818559 - protein, 20 aa, Mycobacterium
GLVALIGDLAYKAKKPVRTD

SEQ ID NO: 818560 - protein, 20 aa, Mycobacterium
GLVANLFAFDALRAARLEPL

SEQ ID NO: 818561 - protein, 20 aa, Mycobacterium
GLVCALLLTTRGAALTLGQL

SEQ ID NO: 818562 - protein, 24 aa, Mycobacterium
GLVDAALPHLLKSDAGSIVTISSV

SEQ ID NO: 818563 - protein, 20 aa, Mycobacterium
GLVDAPLLAAELWERGRLVR

SEQ ID NO: 818564 - protein, 28 aa, Mycobacterium
GLVDAPLPTWTHRRLWLSGGGQESPTHG

SEQ ID NO: 818565 - protein, 20 aa, Mycobacterium
GLVDIAVWADPARALSVGVV

SEQ ID NO: 818566 - protein, 28 aa, Mycobacterium
GLVDRALIAAFAGGLTPILCLTKTDLAP

SEQ ID NO: 818567 - protein, 28 aa, Mycobacterium
GLVDRALIAAYTGGLTPILCLTKTDLAP

SEQ ID NO: 818568 - protein, 19 aa, Mycobacterium
GLVETYWYGMDPVVEQVRS

SEQ ID NO: 818569 - protein, 21 aa, Mycobacterium
GLVFPTRRWVHPIGPRNRSLS

SEQ ID NO: 818570 - protein, 18 aa, Mycobacterium
GLVFRRPPEYQILPGYDL

SEQ ID NO: 818571 - protein, 30 aa, Mycobacterium
GLVFVFSGMGTQWWAMGRDLLNAGGIFAAE

SEQ ID NO: 818572 - protein, 28 aa, Mycobacterium
GLVGGLAVPPSWAVATPAIRTVAAVLSG

SEQ ID NO: 818573 - protein, 24 aa, Mycobacterium
GLVGGSWQGPAAAAMTAAAAPYSA

SEQ ID NO: 818574 - protein, 25 aa, Mycobacterium
GLVGKFNWAMLLHGSQSIRLHAPLP

SEQ ID NO: 818575 - protein, 20 aa, Mycobacterium
GLVGLHAWSDIDVSEWPGID

SEQ ID NO: 818576 - protein, 18 aa, Mycobacterium
GLVGVFKGPLHDGIVVPG

SEQ ID NO: 818577 - protein, 25 aa, Mycobacterium
GLVHAGMLVLPYGIGDAAIGIATVP

SEQ ID NO: 818578 - protein, 28 aa, Mycobacterium
GLVHGLRAQFPLLDRGRDALRYLHETLG

SEQ ID NO: 818579 - protein, 27 aa, Mycobacterium
GLVITLDTWIFGWRPRDLTISNFPFLR

SEQ ID NO: 818580 - protein, 29 aa, Mycobacterium
GLVKEIKINWVWVPPWGPDKITDDGREQL

SEQ ID NO: 818581 - protein, 18 aa, Mycobacterium
GLVKHRLPVGINLPEKQY

SEQ ID NO: 818582 - protein, 37 aa, Mycobacterium; identical to SEQ ID NO: 126997

SEQ ID NO: 818583 - protein, 17 aa, Mycobacterium
GLVLIPAAADKIEIPMI

SEQ ID NO: 818584 - protein, 17 aa, Mycobacterium
GLVLLKPLPAALDDGDR

SEQ ID NO: 818585 - protein, 17 aa, Mycobacterium
GLVLRRSIDPDRSLPDY

SEQ ID NO: 818586 - protein, 21 aa, Mycobacterium
GLVLVSDAWLRDNPAARPLGR

SEQ ID NO: 818587 - protein, 20 aa, Mycobacterium
GLVNAFGYPVAADVALLTLA

SEQ ID NO: 818588 - protein, 20 aa, Mycobacterium
GLVNHLRRPPGTWTVSSELA

SEQ ID NO: 818589 - protein, 26 aa, Mycobacterium
GLVNRGFGPLLLPRLAANLFEIEPRC

SEQ ID NO: 818590 - protein, 17 aa, Mycobacterium
GLVPDLAGFWRPYLEAA

SEQ ID NO: 818591 - protein, 18 aa, Mycobacterium
GLVPKRIGSFPDLQGIRV

SEQ ID NO: 818592 - protein, 17 aa, Mycobacterium
GLVPPPEKRGRVGIYSD

SEQ ID NO: 818593 - protein, 26 aa, Mycobacterium
GLVQGLLLMRRMVFVGYSLSDEDFHE

SEQ ID NO: 818594 - protein, 18 aa, Mycobacterium
GLVQLILSNFFGQNAPSI

SEQ ID NO: 818595 - protein, 25 aa, Mycobacterium
GLVQRQDGLWRIVRATAGHAASTPR

SEQ ID NO: 818596 - protein, 20 aa, Mycobacterium
GLVRDFYRFGEIGAVPAFGA

SEQ ID NO: 818597 - protein, 27 aa, Mycobacterium
GLVRPSLNIAEWILPSVLAAAPKDLQE

SEQ ID NO: 818598 - protein, 18 aa, Mycobacterium
GLVRWMADLNTKTVPDHP

SEQ ID NO: 818599 - protein, 35 aa, Mycobacterium
GLVSGLGWYITKHSLGLWSATPPPTGWQTPDMADA

SEQ ID NO: 818600 - protein, 19 aa, Mycobacterium
GLVSQFFGRYFSPDEARAL

SEQ ID NO: 818601 - protein, 26 aa, Mycobacterium
GLVTLPIVHIGGLWSLLQSLVAARPI

SEQ ID NO: 818602 - protein, 19 aa, Mycobacterium
GLVVADVLPWMITAGDFSY

SEQ ID NO: 818603 - protein, 22 aa, Mycobacterium
GLVVALLCRGHVLLEGVPGVAK

SEQ ID NO: 818604 - protein, 18 aa, Mycobacterium
GLVVMGLARHGVGNFDFA

SEQ ID NO: 818605 - protein, 17 aa, Mycobacterium
GLVVPFSRFMAIAPEDS

SEQ ID NO: 818606 - protein, 19 aa, Mycobacterium
GLVYTMPGGARDLIRAFWP

SEQ ID NO: 818607 - protein, 21 aa, Mycobacterium
GLWCSPGLSNAYLLTTGDGRV

SEQ ID NO: 818608 - protein, 22 aa, Mycobacterium
GLWLSRQIIARIMGTFGPSLAG

SEQ ID NO: 818609 - protein, 19 aa, Mycobacterium
GLWMLTNMGVFFNSMDYLY

SEQ ID NO: 818610 - protein, 18 aa, Mycobacterium
GLWREVAGLPADRIQRRG

SEQ ID NO: 818611 - protein, 20 aa, Mycobacterium
GLWRKFLFDRKRKSAGLPPH

SEQ ID NO: 818612 - protein, 28 aa, Mycobacterium
GLWRQQEDIYNPLRFVQATLKWCRKAQE

SEQ ID NO: 818613 - protein, 26 aa, Mycobacterium
GLWSTADDYLRFVRLLLGDGTIDGVR

SEQ ID NO: 818614 - protein, 21 aa, Mycobacterium
GLWTRGLELLRWLVERETGNG

SEQ ID NO: 818615 - protein, 22 aa, Mycobacterium
GLYAAALSGLAARGSASGRARR

SEQ ID NO: 818616 - protein, 18 aa, Mycobacterium
GLYDTDAPQFLLSLIDES

SEQ ID NO: 818617 - protein, 18 aa, Mycobacterium
GLYEPLLARLRASANVVP

SEQ ID NO: 818618 - protein, 28 aa, Mycobacterium
GLYGDYFSFYLCDLLLKVNGKGGQPVYI

SEQ ID NO: 818619 - protein, 26 aa, Mycobacterium
GLYGQRLRHLLVLAERRLELAHGGPH

SEQ ID NO: 818620 - protein, 25 aa, Mycobacterium
GLYLRFRATGPDDFHLAYAAALATT

SEQ ID NO: 818621 - protein, 23 aa, Mycobacterium
GLYPVQHGYWLETLRRAVTSNPT

SEQ ID NO: 818622 - protein, 18 aa, Mycobacterium
GLYRTPFHPYSDALLSAV

SEQ ID NO: 818623 - protein, 19 aa, Mycobacterium
GLYRWEARFLQESDQAISN

SEQ ID NO: 818624 - protein, 18 aa, Mycobacterium
GLYVGPADLALSLGVDVV

SEQ ID NO: 818625 - protein, 19 aa, Mycobacterium
GMAAPWWAAPYLTVCATAL

SEQ ID NO: 818626 - protein, 19 aa, Mycobacterium
GMADLPFGFSAGDDPDRDK

SEQ ID NO: 818627 - protein, 17 aa, Mycobacterium
GMAFARERDGRISQRFF

SEQ ID NO: 818628 - protein, 17 aa, Mycobacterium
GMAGLFGAGGAGGEGGG

SEQ ID NO: 818629 - protein, 19 aa, Mycobacterium
GMAGVLYRGGPTGYRLALV

SEQ ID NO: 818630 - protein, 25 aa, Mycobacterium
GMAKGAGMLAPSLATMLCVITTDAA

SEQ ID NO: 818631 - protein, 25 aa, Mycobacterium
GMAKGAGMLAPSLATMLCVLTTDAA

SEQ ID NO: 818632 - protein, 25 aa, Mycobacterium
GMAKGAGMLAPSLATMLCVLTTDAV

SEQ ID NO: 818633 - protein, 25 aa, Mycobacterium
GMAKLAFTGLLPMSASEALALGMGR

SEQ ID NO: 818634 - protein, 20 aa, Mycobacterium
GMALARSFFTPLGAELHTAL

SEQ ID NO: 818635 - protein, 25 aa, Mycobacterium
GMAMPDFPNFFMLYGPNTNVGSNSV

SEQ ID NO: 818636 - protein, 25 aa, Mycobacterium
GMAPVTAIPLALRRSGLTVDDVDLF

SEQ ID NO: 818637 - protein, 17 aa, Mycobacterium
GMAPWLTCFPGFGMLTV

SEQ ID NO: 818638 - protein, 23 aa, Mycobacterium
GMARHVLCFRTLWEATFNQLMKE

SEQ ID NO: 818639 - protein, 32 aa, Mycobacterium
GMASGKPCLLTPPPWYPILRGTTQQALFHVAR

SEQ ID NO: 818640 - protein, 21 aa, Mycobacterium
GMATAAYFTYRSKCAAIARIS

SEQ ID NO: 818641 - protein, 19 aa, Mycobacterium
GMATLGPLAVQIIGQLSSL

SEQ ID NO: 818642 - protein, 20 aa, Mycobacterium
GMATVKWELEDLSFAILHPK

SEQ ID NO: 818643 - protein, 32 aa, Mycobacterium
GMAVVISDFLGPINWMRPLRAIAARHEVLAIE

SEQ ID NO: 818644 - protein, 21 aa, Mycobacterium
GMCLTLCPEVFRLTDDGYAEA

SEQ ID NO: 818645 - protein, 36 aa, Mycobacterium
GMDASLLRELNLLTTKPFLYVFNADEAVLTDCTRVA

SEQ ID NO: 818646 - protein, 18 aa, Mycobacterium
GMDLGIMHDLAVGVDPDG

SEQ ID NO: 818647 - protein, 17 aa, Mycobacterium
GMDLVVLGLGGRRVPHT

SEQ ID NO: 818648 - protein, 33 aa, Mycobacterium
GMDPLWRDLHTITAPTLLLWGRDDRTITLEGAQ

SEQ ID NO: 818649 - protein, 22 aa, Mycobacterium
GMDPQQRLILEIAWETLESASI

SEQ ID NO: 818650 - protein, 17 aa, Mycobacterium
GMDRFGLDVILPFEDRV

SEQ ID NO: 818651 - protein, 24 aa, Mycobacterium
GMDSRAFRLPWRAGTTVYEIDQPE

SEQ ID NO: 818652 - protein, 24 aa, Mycobacterium
GMDTALARYLAGPVVPTMLGRDAR

SEQ ID NO: 818653 - protein, 27 aa, Mycobacterium
GMDVLALPGLLRSAIAGHWAMTPALSR

SEQ ID NO: 818654 - protein, 20 aa, Mycobacterium
GMEFGYVLKNYGVDVTIVEF

SEQ ID NO: 818655 - protein, 19 aa, Mycobacterium
GMEGYGWVFDNYRNGYLEA

SEQ ID NO: 818656 - protein, 29 aa, Mycobacterium
GMELGAMTAMFIGFRAREIILNVFESITG

SEQ ID NO: 818657 - protein, 24 aa, Mycobacterium
GMESILGAVYLEHGLETARAVVLT

SEQ ID NO: 818658 - protein, 23 aa, Mycobacterium
GMESLLGAIYLHHGMEVAREAIL

SEQ ID NO: 818659 - protein, 24 aa, Mycobacterium
GMESRLYWPELGEVTPDELILRQL

SEQ ID NO: 818660 - protein, 25 aa, Mycobacterium
GMETTWLLDPSIPLPEVFKQYAETL

SEQ ID NO: 818661 - protein, 19 aa, Mycobacterium
GMFAIRAVLAGTLSPTWGV

SEQ ID NO: 818662 - protein, 23 aa, Mycobacterium
GMFAQLCTDLPWTQTLSEVWRMQ

SEQ ID NO: 818663 - protein, 25 aa, Mycobacterium
GMFDNHLLRRIFQAKLDEVRRGQQC

SEQ ID NO: 818664 - protein, 25 aa, Mycobacterium
GMFDQLCTELPWAQRLSQVWRMRDP

SEQ ID NO: 818665 - protein, 17 aa, Mycobacterium
GMFISLMFAGHHTSSGT

SEQ ID NO: 818666 - protein, 19 aa, Mycobacterium
GMFISMMFAGHHTSSGTAS

SEQ ID NO: 818667 - protein, 22 aa, Mycobacterium
GMFLQNLMLALTARGLGTCVQV

SEQ ID NO: 818668 - protein, 25 aa, Mycobacterium
GMFSRSHVFPIRQFADGIAHTLRRC

SEQ ID NO: 818669 - protein, 21 aa, Mycobacterium
GMGAGLYRHHPVFTTAIDEIC

SEQ ID NO: 818670 - protein, 18 aa, Mycobacterium
GMGAIKPRPVALGAEIVV

SEQ ID NO: 818671 - protein, 24 aa, Mycobacterium
GMGAYAPLPWLPDEVYRDIVANIV

SEQ ID NO: 818672 - protein, 25 aa, Mycobacterium
GMGAYAPLPWLPDEVYREIVGQIVE

SEQ ID NO: 818673 - protein, 22 aa, Mycobacterium
GMGAYAPVPWLPDEVYRDIVGN

SEQ ID NO: 818674 - protein, 25 aa, Mycobacterium
GMGDPLSMLGPAMAGLGSIPGALGG

SEQ ID NO: 818675 - protein, 17 aa, Mycobacterium
GMGFDRDVLVRAGIEEA

SEQ ID NO: 818676 - protein, 24 aa, Mycobacterium
GMGGDYFALCLALEELGRVDQSVA

SEQ ID NO: 818677 - protein, 25 aa, Mycobacterium
GMGGDYFALCLTLEELARADQSVAI

SEQ ID NO: 818678 - protein, 24 aa, Mycobacterium
GMGHDLPQPVWRPILETLTENFSR

SEQ ID NO: 818679 - protein, 19 aa, Mycobacterium
GMGINPFFDAPYEDVAKGI

SEQ ID NO: 818680 - protein, 18 aa, Mycobacterium
GMGINPFFDAPYEDVSKG

SEQ ID NO: 818681 - protein, 27 aa, Mycobacterium
GMGIVALDQPIVDRGILTVALARMQAM

SEQ ID NO: 818682 - protein, 25 aa, Mycobacterium
GMGKALALDTPLPTPTGWTTMAEVK

SEQ ID NO: 818683 - protein, 24 aa, Mycobacterium
GMGKTFAFGVPLLQRVSSGTGVRP

SEQ ID NO: 818684 - protein, 21 aa, Mycobacterium
GMGMHPAVLDAVLHALGLAIE

SEQ ID NO: 818685 - protein, 24 aa, Mycobacterium
GMGMLFHEDGIWTVTAFGVAKAEP

SEQ ID NO: 818686 - protein, 26 aa, Mycobacterium
GMGMRSRFFDEFFLEAAASGITQAVI

SEQ ID NO: 818687 - protein, 17 aa, Mycobacterium
GMGQLFYESVPAFRAEV

SEQ ID NO: 818688 - protein, 25 aa, Mycobacterium
GMGQQLHAQFPIFAAAFDAVAGELD

SEQ ID NO: 818689 - protein, 25 aa, Mycobacterium
GMGRALIGPLRIGLQRKGVPVQLNT

SEQ ID NO: 818690 - protein, 25 aa, Mycobacterium
GMGRDLYGRFPAFAKAFDTVADALD

SEQ ID NO: 818691 - protein, 19 aa, Mycobacterium
GMGTVRFQIGLDGKLKALG

SEQ ID NO: 818692 - protein, 18 aa, Mycobacterium
GMGVNPFFDAPFADVSKG

SEQ ID NO: 818693 - protein, 19 aa, Mycobacterium
GMHALIWHHGAIIAHAAVV

SEQ ID NO: 818694 - protein, 18 aa, Mycobacterium
GMHHWLANWRLRAAEAAS

SEQ ID NO: 818695 - protein, 34 aa, Mycobacterium
GMHRKPIVILDPWGHYDGLLAWLNGLVNTGYVAQ

SEQ ID NO: 818696 - protein, 18 aa, Mycobacterium
GMIALGMLAALDPPSLPA

SEQ ID NO: 818697 - protein, 19 aa, Mycobacterium
GMIANRVSYGFALHGPSMT

SEQ ID NO: 818698 - protein, 17 aa, Mycobacterium
GMIAYKTGTALAASDSL

SEQ ID NO: 818699 - protein, 24 aa, Mycobacterium
GMIDAPLLAAELWERGRLVRSLGD

SEQ ID NO: 818700 - protein, 24 aa, Mycobacterium
GMIDTHIELIRTGVPGLRDVIVDE

SEQ ID NO: 818701 - protein, 17 aa, Mycobacterium
GMIERRRGDLIFVGSDV

SEQ ID NO: 818702 - protein, 18 aa, Mycobacterium
GMIFLSLNAQAPPLEDYL

SEQ ID NO: 818703 - protein, 20 aa, Mycobacterium
GMIGALLAAGLPTGQAAAAA

SEQ ID NO: 818704 - protein, 19 aa, Mycobacterium
GMIGVSYLAISQWKSAALR

SEQ ID NO: 818705 - protein, 37 aa, Mycobacterium
GMIICPVGPDMSFLRPWQATTPLVFVDRMPGRLVADS

SEQ ID NO: 818706 - protein, 26 aa, Mycobacterium
GMILIDGAIRRPAVLDYKLVDVPDLG

SEQ ID NO: 818707 - protein, 19 aa, Mycobacterium
GMILTINAWNRIAVTTRNA

SEQ ID NO: 818708 - protein, 22 aa, Mycobacterium
GMINMALYHDLCQKPVIMDALT

SEQ ID NO: 818709 - protein, 17 aa, Mycobacterium
GMIVGEIALLRDIPRTA

SEQ ID NO: 818710 - protein, 18 aa, Mycobacterium
GMIWRYPDYFIVGREQLR

SEQ ID NO: 818711 - protein, 24 aa, Mycobacterium
GMKAKFVSTPLTPAAPIVSRLVAR

SEQ ID NO: 818712 - protein, 19 aa, Mycobacterium
GMKANKYLHDHNISRATLA

SEQ ID NO: 818713 - protein, 17 aa, Mycobacterium
GMKANRYLHDHGISHRT

SEQ ID NO: 818714 - protein, 18 aa, Mycobacterium
GMKANRYLHDHNISRRTL

SEQ ID NO: 818715 - protein, 24 aa, Mycobacterium
GMKRFNTIWTGPQTLPLPAEIENP

SEQ ID NO: 818716 - protein, 24 aa, Mycobacterium
GMKRFNTIWTSPQTLPLPAELENP

SEQ ID NO: 818717 - protein, 18 aa, Mycobacterium
GMLAPSLATMLVVITTDA

SEQ ID NO: 818718 - protein, 18 aa, Mycobacterium
GMLARPEPLRDFVSRVHA

SEQ ID NO: 818719 - protein, 25 aa, Mycobacterium
GMLFRKQLVMFGPREVLLTSEEPVV

SEQ ID NO: 818720 - protein, 19 aa, Mycobacterium
GMLLAVHRYLQPRADEPVF

SEQ ID NO: 818721 - protein, 19 aa, Mycobacterium
GMLLGRLVDHAFGRTLTRQ

SEQ ID NO: 818722 - protein, 26 aa, Mycobacterium
GMLMERFDIDAIAAFGLLAKLSQDTN

SEQ ID NO: 818723 - protein, 19 aa, Mycobacterium
GMLMLLHDITEEQAFDLLR

SEQ ID NO: 818724 - protein, 27 aa, Mycobacterium
GMLNRVRWTLVHYKPPQALTLNGDGRG

SEQ ID NO: 818725 - protein, 18 aa, Mycobacterium
GMLPAFRHTVEELFAAGL

SEQ ID NO: 818726 - protein, 19 aa, Mycobacterium
GMLPAFRHTVEELFTAGLV

SEQ ID NO: 818727 - protein, 19 aa, Mycobacterium
GMLREWFAIQPRDSTVELL

SEQ ID NO: 818728 - protein, 18 aa, Mycobacterium
GMLTGVMVLNTWIRQGLV

SEQ ID NO: 818729 - protein, 20 aa, Mycobacterium
GMLTTPQLKAFYLDLQDDRM

SEQ ID NO: 818730 - protein, 27 aa, Mycobacterium
GMLTTPQLKAFYLDLQDNRLTSALGIV

SEQ ID NO: 818731 - protein, 18 aa, Mycobacterium
GMLTTPQLRAFYLDLQDE

SEQ ID NO: 818732 - protein, 27 aa, Mycobacterium
GMLVDDRWVWLPTVLDGRVFTHRLSAH

SEQ ID NO: 818733 - protein, 17 aa, Mycobacterium
GMLVLRILAGQLAEAEA

SEQ ID NO: 818734 - protein, 17 aa, Mycobacterium
GMLVPVGDVPALANAIG

SEQ ID NO: 818735 - protein, 26 aa, Mycobacterium
GMMAALISFWMTPDSVYLSPAPLYHT

SEQ ID NO: 818736 - protein, 26 aa, Mycobacterium
GMMLGVPTVLYPLGAFDPGQLLDVLE

SEQ ID NO: 818737 - protein, 19 aa, Mycobacterium
GMMLSGLPNMAYTVGYTNA

SEQ ID NO: 818738 - protein, 22 aa, Mycobacterium
GMNGHWLDRITAALAAQPPQLG

SEQ ID NO: 818739 - protein, 20 aa, Mycobacterium
GMNLAVVLRTTWAVAQVLKE

SEQ ID NO: 818740 - protein, 22 aa, Mycobacterium
GMNLFAIQELLGHAWTGTTARY

SEQ ID NO: 818741 - protein, 17 aa, Mycobacterium
GMNQGLQFPLADSLARL

SEQ ID NO: 818742 - protein, 18 aa, Mycobacterium
GMPAGMVELADCAEPARP

SEQ ID NO: 818743 - protein, 18 aa, Mycobacterium
GMPALARVLSWASVGVDP

SEQ ID NO: 818744 - protein, 18 aa, Mycobacterium
GMPATRFLGPALGSLHMF

SEQ ID NO: 818745 - protein, 17 aa, Mycobacterium
GMPDHVRPVAWLCVGPV

SEQ ID NO: 818746 - protein, 24 aa, Mycobacterium
GMPESSVRTAFYYVRARATVAPGD

SEQ ID NO: 818747 - protein, 18 aa, Mycobacterium
GMPFSPMGNHGLGRAVPQ

SEQ ID NO: 818748 - protein, 17 aa, Mycobacterium
GMPGLAAATRNSAGFGA

SEQ ID NO: 818749 - protein, 26 aa, Mycobacterium
GMPGMAGLPPGFPDLSNMPKGLDELP

SEQ ID NO: 818750 - protein, 20 aa, Mycobacterium
GMPGVEYYAHPWEFGARKAK

SEQ ID NO: 818751 - protein, 23 aa, Mycobacterium
GMPGVEYYAHPWEFGPRKAKELL

SEQ ID NO: 818752 - protein, 23 aa, Mycobacterium
GMPKAVLWRQHDIFMNSMGGRTF

SEQ ID NO: 818753 - protein, 23 aa, Mycobacterium
GMPKAVLWRQHDIYMNAMGGRAF

SEQ ID NO: 818754 - protein, 22 aa, Mycobacterium
GMPKGVLWRQHDIFMASFGGRS

SEQ ID NO: 818755 - protein, 17 aa, Mycobacterium
GMPLQYMVSGMAVAATH

SEQ ID NO: 818756 - protein, 27 aa, Mycobacterium
GMPMAPGMFAISWLDQLRLPVRIDSVG

SEQ ID NO: 818757 - protein, 26 aa, Mycobacterium
GMPNRIRWTIVRYKPPEGMTLNGDGV

SEQ ID NO: 818758 - protein, 29 aa, Mycobacterium
GMPNVRAMNFLGQPPVVIGPTYAAKTIKV

SEQ ID NO: 818759 - protein, 38 aa, Mycobacterium
GMPRVLKWLSQFIPLAAGPLPIPFFFGVLAGEEPIDHT

SEQ ID NO: 818760 - protein, 19 aa, Mycobacterium
GMPSAIEGLHRRQLQRIEP

SEQ ID NO: 818761 - protein, 17 aa, Mycobacterium
GMPVWEIAQLLGVGRST

SEQ ID NO: 818762 - protein, 25 aa, Mycobacterium
GMQLALTELWRSYGVTPDAVIGHSM

SEQ ID NO: 818763 - protein, 17 aa, Mycobacterium
GMQLRVDAGGYLKWYDY

SEQ ID NO: 818764 - protein, 19 aa, Mycobacterium
GMQLSLFSRDVIAMSTAIA

SEQ ID NO: 818765 - protein, 23 aa, Mycobacterium
GMQMRLTFARALINDPELLFLDE

SEQ ID NO: 818766 - protein, 17 aa, Mycobacterium
GMQPEGNWLTRAPSLRR

SEQ ID NO: 818767 - protein, 23 aa, Mycobacterium
GMQQPHCYLLTYGQGRRTSAADE

SEQ ID NO: 818768 - protein, 20 aa, Mycobacterium
GMRAYRQSKIACGLFGLELS

SEQ ID NO: 818769 - protein, 24 aa, Mycobacterium
GMRDDLLRIYPTLDPDVVHVIRNG

SEQ ID NO: 818770 - protein, 24 aa, Mycobacterium
GMRDDVLRLYPGLDPGMVHVVRNG

SEQ ID NO: 818771 - protein, 30 aa, Mycobacterium
GMRDIRKHIAWYLHGFPAGSDVRRALALVK

SEQ ID NO: 818772 - protein, 22 aa, Mycobacterium
GMREMLLARDWSQITLSDVAKA

SEQ ID NO: 818773 - protein, 23 aa, Mycobacterium
GMRHQLPMPSILDTKGRIVDTGT

SEQ ID NO: 818774 - protein, 19 aa, Mycobacterium
GMRLLGLAHRAALDILGRV

SEQ ID NO: 818775 - protein, 18 aa, Mycobacterium
GMRLVGMPLEYRNPDRQL

SEQ ID NO: 818776 - protein, 17 aa, Mycobacterium
GMRLVGMPLEYRSPDRQ

SEQ ID NO: 818777 - protein, 27 aa, Mycobacterium
GMRQRVMIAMAIALNPALIIADEPTTA

SEQ ID NO: 818778 - protein, 23 aa, Mycobacterium
GMRQRVMIAMALALEPEVLIADE

SEQ ID NO: 818779 - protein, 21 aa, Mycobacterium
GMRRFLPSSPTSLYVYARETV

SEQ ID NO: 818780 - protein, 26 aa, Mycobacterium
GMRRRLDLAVSLLASPPVLFLDEPTT

SEQ ID NO: 818781 - protein, 25 aa, Mycobacterium
GMRRRRQFHSLGRRLLDFTDEVFGR

SEQ ID NO: 818782 - protein, 20 aa, Mycobacterium
GMRRVGDIAALPEAIEAASR

SEQ ID NO: 818783 - protein, 18 aa, Mycobacterium
GMRVTRPRIAVLRSVYAH

SEQ ID NO: 818784 - protein, 20 aa, Mycobacterium
GMRYDMPALPGLAELWGDSV

SEQ ID NO: 818785 - protein, 17 aa, Mycobacterium
GMSIKRVLINPGAMRTP

SEQ ID NO: 818786 - protein, 19 aa, Mycobacterium
GMSKLSGWLTPEARATWEA

SEQ ID NO: 818787 - protein, 17 aa, Mycobacterium
GMSMGDLTKYAYVRYSE

SEQ ID NO: 818788 - protein, 26 aa, Mycobacterium
GMSMLSNLKGLFPAAAAAGAQIATSV

SEQ ID NO: 818789 - protein, 24 aa, Mycobacterium
GMSQPWDFVLVRSPETLRAFRDHV

SEQ ID NO: 818790 - protein, 20 aa, Mycobacterium
GMSQRLGIAAALLGDPPVLL

SEQ ID NO: 818791 - protein, 25 aa, Mycobacterium
GMSSQWRLSRDPWRLGFPMAEMSAD

SEQ ID NO: 818792 - protein, 25 aa, Mycobacterium
GMSVPGYPNFFMLYGPNTNVGSNSV

SEQ ID NO: 818793 - protein, 25 aa, Mycobacterium
GMTAAYLVQQWLGEATSGVLITLSR

SEQ ID NO: 818794 - protein, 19 aa, Mycobacterium
GMTARLPQLVGAAMARRLS

SEQ ID NO: 818795 - protein, 17 aa, Mycobacterium
GMTASPLAPYSPPGAGA

SEQ ID NO: 818796 - protein, 18 aa, Mycobacterium
GMTAWDLYGGAGVFAAVL

SEQ ID NO: 818797 - protein, 25 aa, Mycobacterium
GMTDEMLAWQTRRFLDLADGDATDH

SEQ ID NO: 818798 - protein, 25 aa, Mycobacterium
GMTETSPLATMAWPPPGTPEDQHWA

SEQ ID NO: 818799 - protein, 27 aa, Mycobacterium
GMTETSPLATMAWPPPGTPPDRHWAIR

SEQ ID NO: 818800 - protein, 20 aa, Mycobacterium
GMTETSPMATMAWPPPGTPE

SEQ ID NO: 818801 - protein, 27 aa, Mycobacterium
GMTETSPMATMAWPPPGTPPDRHWAIR

SEQ ID NO: 818802 - protein, 21 aa, Mycobacterium
GMTILNYDPGSRGALSYLDAS

SEQ ID NO: 818803 - protein, 19 aa, Mycobacterium
GMTLGSYRWLRPHGRRTAQ

SEQ ID NO: 818804 - protein, 23 aa, Mycobacterium
GMTLGSYRWLRPSGRRSAKEIAA

SEQ ID NO: 818805 - protein, 23 aa, Mycobacterium
GMTLSGKTLGLLGLGRVGKRMTE

SEQ ID NO: 818806 - protein, 17 aa, Mycobacterium
GMTNGVAAALALTSRIL

SEQ ID NO: 818807 - protein, 18 aa, Mycobacterium
GMTPPLPASPLGSGGGSG

SEQ ID NO: 818808 - protein, 17 aa, Mycobacterium
GMTQLLYSDAIVGMLTE

SEQ ID NO: 818809 - protein, 20 aa, Mycobacterium
GMTRMDALEALFPAVTASGI

SEQ ID NO: 818810 - protein, 24 aa, Mycobacterium
GMTVPGFPNFFMLYGPNTNVGSNS

SEQ ID NO: 818811 - protein, 18 aa, Mycobacterium
GMTWGPIDSPVIIEDAWR

SEQ ID NO: 818812 - protein, 23 aa, Mycobacterium
GMTWTQRLVSLLVFDGPELPGPL

SEQ ID NO: 818813 - protein, 26 aa, Mycobacterium
GMTYVALVPFFLTSTKLGTALPLPYF

SEQ ID NO: 818814 - protein, 25 aa, Mycobacterium
GMVAKTLLAGVPLVAVPGGGDQWEI

SEQ ID NO: 818815 - protein, 23 aa, Mycobacterium
GMVDGLADMRWAPGSAVHVVLDG

SEQ ID NO: 818816 - protein, 20 aa, Mycobacterium
GMVDQALALLPRARVGFAGV

SEQ ID NO: 818817 - protein, 24 aa, Mycobacterium
GMVFQDNALLPWRTVRSNIELALR

SEQ ID NO: 818818 - protein, 33 aa, Mycobacterium
GMVFQHFNLFPHMTVLENVTLAPLLTKKMDKAA

SEQ ID NO: 818819 - protein, 24 aa, Mycobacterium
GMVFQHFNLFPHRTALANIIEAPI

SEQ ID NO: 818820 - protein, 23 aa, Mycobacterium
GMVFQHFNLFPHRTALGNVVEAP

SEQ ID NO: 818821 - protein, 25 aa, Mycobacterium
GMVGHAWLRAAQRFLDMQRDAVDGA

SEQ ID NO: 818822 - protein, 18 aa, Mycobacterium
GMVGHRFVEALRARDTEG

SEQ ID NO: 818823 - protein, 20 aa, Mycobacterium
GMVGLIKLLLSGQHGHIPPT

SEQ ID NO: 818824 - protein, 19 aa, Mycobacterium
GMVLRYITAAKDQGFGVIF

SEQ ID NO: 818825 - protein, 24 aa, Mycobacterium
GMVRAKPPIPAINGLFGKPTVVNN

SEQ ID NO: 818826 - protein, 30 aa, Mycobacterium
GMVRCVRTALPLLRKAQWARIVNFSAHSTQ

SEQ ID NO: 818827 - protein, 19 aa, Mycobacterium
GMVRELWPTPPGQPTEPGV

SEQ ID NO: 818828 - protein, 22 aa, Mycobacterium
GMVRQWQTLFYQERYSQTDLAT

SEQ ID NO: 818829 - protein, 25 aa, Mycobacterium
GMVSQLWAMLLARQGFQVIVQDTRG

SEQ ID NO: 818830 - protein, 21 aa, Mycobacterium
GMVSRQIPALAAVPATRFAMA

SEQ ID NO: 818831 - protein, 20 aa, Mycobacterium
GMVWKYPDPFLIGREQIRQY

SEQ ID NO: 818832 - protein, 22 aa, Mycobacterium
GMWEIFEWGAVSEADLAVFDEL

SEQ ID NO: 818833 - protein, 17 aa, Mycobacterium
GMWPSEWIPAKREAAQA

SEQ ID NO: 818834 - protein, 17 aa, Mycobacterium
GMWTAFAALLNGQTVIL

SEQ ID NO: 818835 - protein, 18 aa, Mycobacterium
GMWVSWLHEFDDGQLGGG

SEQ ID NO: 818836 - protein, 25 aa, Mycobacterium
GMYNRIKWTVVRYKPPEGMTLNGDG

SEQ ID NO: 818837 - protein, 24 aa, Mycobacterium
GMYPASMLMGPLMQLGSSANTAGL

SEQ ID NO: 818838 - protein, 17 aa, Mycobacterium
GMYPISAVLLGERAARW

SEQ ID NO: 818839 - protein, 33 aa, Mycobacterium
GNADWVRINGFGTPWWADDIAILAGSSVGGVML

SEQ ID NO: 818840 - protein, 17 aa, Mycobacterium
GNAFLLGAGGAGGVGGT

SEQ ID NO: 818841 - protein, 20 aa, Mycobacterium
GNAGLFSGIAGNGGDGGQGG

SEQ ID NO: 818842 - protein, 18 aa, Mycobacterium
GNAGLLFGDGGVGGTGGT

SEQ ID NO: 818843 - protein, 24 aa, Mycobacterium
GNAGPFLSWSALPGGRPPDIAADT

SEQ ID NO: 818844 - protein, 21 aa, Mycobacterium
GNAGRLAWLAGGYPEEVPGAT

SEQ ID NO: 818845 - protein, 30 aa, Mycobacterium
GNAGWIAPGLALPLNSPAVLRYGLRSLLDS

SEQ ID NO: 818846 - protein, 26 aa, Mycobacterium
GNAHPGQLLLLRQYDPHLRHIVRPKT

SEQ ID NO: 818847 - protein, 26 aa, Mycobacterium
GNAHVRRLLIEAAWHHRTVHPASTIA

SEQ ID NO: 818848 - protein, 23 aa, Mycobacterium
GNALDVLQRLIAPASLTGVRVFF

SEQ ID NO: 818849 - protein, 20 aa, Mycobacterium
GNALFWQEYRADPAEFWFRV

SEQ ID NO: 818850 - protein, 35 aa, Mycobacterium
GNALPVAQAIAYMLEILPALGFLHSVGLTYNDLKP

SEQ ID NO: 818851 - protein, 28 aa, Mycobacterium
GNALRMDKPLQRYWRDAHAGVAHAIHVP

SEQ ID NO: 818852 - protein, 27 aa, Mycobacterium
GNAPDSTFNLGFADIGIFNAGAANTGN

SEQ ID NO: 818853 - protein, 18 aa, Mycobacterium
GNAPFRVVTGHGSFVVPF

SEQ ID NO: 818854 - protein, 18 aa, Mycobacterium
GNAPLPVRSLPQPNIVAG

SEQ ID NO: 818855 - protein, 23 aa, Mycobacterium
GNAPYLAALQRLAASPGGSSCRP

SEQ ID NO: 818856 - protein, 26 aa, Mycobacterium
GNAQLRAEFGDRLPVILLDGREHSYW

SEQ ID NO: 818857 - protein, 17 aa, Mycobacterium
GNAQNFRILTSLEPKVL

SEQ ID NO: 818858 - protein, 23 aa, Mycobacterium
GNARPDIGPLFYEPTVLADVTPE

SEQ ID NO: 818859 - protein, 25 aa, Mycobacterium
GNATRARIVLFRKPIERRAKDTLEL

SEQ ID NO: 818860 - protein, 25 aa, Mycobacterium
GNATRARIVLFRKPIERRAKDTVEL

SEQ ID NO: 818861 - protein, 30 aa, Mycobacterium
GNATRDFTLGLAGLPPTFQTAFQAVLAGDF

SEQ ID NO: 818862 - protein, 23 aa, Mycobacterium
GNAVVLRQRLLMRGIPAEIVEIT

SEQ ID NO: 818863 - protein, 18 aa, Mycobacterium
GNAWLWSACGSCEQCRTG

SEQ ID NO: 818864 - protein, 23 aa, Mycobacterium
GNAYGRWFTPAVPLDVPGVPRGY

SEQ ID NO: 818865 - protein, 24 aa, Mycobacterium
GNAYLEGFTPFWDILFAHAKDREA

SEQ ID NO: 818866 - protein, 17 aa, Mycobacterium
GNCDIKTLALSAGVDRT

SEQ ID NO: 818867 - protein, 31 aa, Mycobacterium
GNCVPLTYPFALTFPALMSLVTGFDFPFAAM

SEQ ID NO: 818868 - protein, 31 aa, Mycobacterium
GNDATTVGLFTYPVLMAADILLYQTNVVPVG

SEQ ID NO: 818869 - protein, 23 aa, Mycobacterium
GNDLAVLPPKRREVEILMTGTDP

SEQ ID NO: 818870 - protein, 19 aa, Mycobacterium
GNDLIAIPEGTDVDMDLRV

SEQ ID NO: 818871 - protein, 24 aa, Mycobacterium
GNDLINRWYYNPDYFKIMSSCANS

SEQ ID NO: 818872 - protein, 23 aa, Mycobacterium
GNDLPVLGVCRGMQLINVHAGGS

SEQ ID NO: 818873 - protein, 25 aa, Mycobacterium
GNDLQPAALSLYPDLRRTLRAGVEA

SEQ ID NO: 818874 - protein, 27 aa, Mycobacterium
GNDLVVDTFSFYKPTRPGSYPIVLATY

SEQ ID NO: 818875 - protein, 24 aa, Mycobacterium
GNDNALQLLGWTEATATPQVEIAL

SEQ ID NO: 818876 - protein, 25 aa, Mycobacterium
GNDNVLVYIWAPLCPPCAVLTPTYE

SEQ ID NO: 818877 - protein, 23 aa, Mycobacterium
GNDPLAVRSALDDALRRARAGGN

SEQ ID NO: 818878 - protein, 32 aa, Mycobacterium
GNDPQRLAGIAQWLMQFTPDIEQLIFSGPGVS

SEQ ID NO: 818879 - protein, 22 aa, Mycobacterium
GNDPSMWQLFADHQTYIHSFSP

SEQ ID NO: 818880 - protein, 23 aa, Mycobacterium
GNDQPVQRFWRDAHAGRVHAAND

SEQ ID NO: 818881 - protein, 27 aa, Mycobacterium
GNDSRAYPRLLREAWAKVTRRSMMPPR

SEQ ID NO: 818882 - protein, 25 aa, Mycobacterium
GNDSVLVYVWAPLCAPCDVFAPTYE

SEQ ID NO: 818883 - protein, 21 aa, Mycobacterium
GNDVFLRDIWPSAAEIEETIA

SEQ ID NO: 818884 - protein, 21 aa, Mycobacterium
GNDYWVWRGLTAVRPGIAIIE

SEQ ID NO: 818885 - protein, 21 aa, Mycobacterium
GNEAAFHFRLTITAGEHRMVI

SEQ ID NO: 818886 - protein, 23 aa, Mycobacterium
GNEIELPFATVPLRDEWRGSVEE

SEQ ID NO: 818887 - protein, 17 aa, Mycobacterium
GNELLRRLKGLPGFGEQ

SEQ ID NO: 818888 - protein, 30 aa, Mycobacterium
GNELRSLLREYFPGFLHAFADRPGGITAPE

SEQ ID NO: 818889 - protein, 26 aa, Mycobacterium
GNEPARTWFTAMKPIAESFGPVALPP

SEQ ID NO: 818890 - protein, 25 aa, Mycobacterium
GNEPARTWFTAMKPIANNFGEVHLP

SEQ ID NO: 818891 - protein, 23 aa, Mycobacterium
GNEPGYLPGFGMLPAHMVREVAK

SEQ ID NO: 818892 - protein, 18 aa, Mycobacterium
GNEPLLAALQRELRRRTG

SEQ ID NO: 818893 - protein, 25 aa, Mycobacterium
GNERRTNWLNAFYFGGDHGVEGSVA

SEQ ID NO: 818894 - protein, 24 aa, Mycobacterium
GNERRTNWLNNFYFGGEHGVEGSI

SEQ ID NO: 818895 - protein, 19 aa, Mycobacterium
GNEVLLQDLSRLPDSIVAI

SEQ ID NO: 818896 - protein, 26 aa, Mycobacterium
GNEYDLSSLFLLASTAALFSPSIKEK

SEQ ID NO: 818897 - protein, 22 aa, Mycobacterium
GNEYFLAHLLGTTSNLQAAPAP

SEQ ID NO: 818898 - protein, 20 aa, Mycobacterium
GNFFELDWALQRHGDFLAGF

SEQ ID NO: 818899 - protein, 20 aa, Mycobacterium
GNFFELDWALQRHNDFLSRF

SEQ ID NO: 818900 - protein, 19 aa, Mycobacterium
GNFGDTLSGFWNVGSEGSG

SEQ ID NO: 818901 - protein, 22 aa, Mycobacterium
GNFPQYPLNLLADLNAVIGIVD

SEQ ID NO: 818902 - protein, 20 aa, Mycobacterium
GNFYFSITTPDLTLPPLEIP

SEQ ID NO: 818903 - protein, 31 aa, Mycobacterium
GNGAEGAIGAQFVPASSLPTPSGGAGGDGGN

SEQ ID NO: 818904 - protein, 26 aa, Mycobacterium
GNGAEPIEILWNGATLGLRTPSTTVI

SEQ ID NO: 818905 - protein, 22 aa, Mycobacterium
GNGALAGFFNTGIANTGIANSG

SEQ ID NO: 818906 - protein, 29 aa, Mycobacterium
GNGAPNLVFQLLWYPSCVGDLALPSFSEN

SEQ ID NO: 818907 - protein, 24 aa, Mycobacterium
GNGDLLVTVKVAVPPNLEGAAQEA

SEQ ID NO: 818908 - protein, 19 aa, Mycobacterium
GNGFLPRLINTWAAKRARA

SEQ ID NO: 818909 - protein, 26 aa, Mycobacterium
GNGFRGMPMPWGLVTWQTADHPETLV

SEQ ID NO: 818910 - protein, 22 aa, Mycobacterium
GNGGAAGLFGNGAAGGAGGAGG

SEQ ID NO: 818911 - protein, 22 aa, Mycobacterium
GNGGAASLLFGNGGSGGDGGVG

SEQ ID NO: 818912 - protein, 23 aa, Mycobacterium
GNGGAGADSGWSASSPNGGDGGV

SEQ ID NO: 818913 - protein, 26 aa, Mycobacterium
GNGGAGGAAGWWGRGGIGGQGGTGGE

SEQ ID NO: 818914 - protein, 29 aa, Mycobacterium
GNGGAGGATGWFGSTGMTGAGGAGGHGGN

SEQ ID NO: 818915 - protein, 23 aa, Mycobacterium
GNGGAGLGILGEAGGNGGGGGAG

SEQ ID NO: 818916 - protein, 24 aa, Mycobacterium
GNGGLGGAGAIGPAGADGSTGGQG

SEQ ID NO: 818917 - protein, 20 aa, Mycobacterium
GNGGLLFGNGGTGGVGGTGG

SEQ ID NO: 818918 - protein, 20 aa, Mycobacterium
GNGGLLMGTGGDGGSGGSGG

SEQ ID NO: 818919 - protein, 29 aa, Mycobacterium
GNGGNAGALGVIPGVQGEYGGAANGINGG

SEQ ID NO: 818920 - protein, 17 aa, Mycobacterium
GNGGNAGLVGNGGNGGA

SEQ ID NO: 818921 - protein, 26 aa, Mycobacterium
GNGGPANLSRLNPFALQPAPGNNNVG

SEQ ID NO: 818922 - protein, 18 aa, Mycobacterium
GNGGSFNTGFWNSGDTNT

SEQ ID NO: 818923 - protein, 28 aa, Mycobacterium
GNGGSGGLGGNAWLLGSGGTGGTGGAGV

SEQ ID NO: 818924 - protein, 23 aa, Mycobacterium
GNGGWHFAVVRYGQLAGAGTARR

SEQ ID NO: 818925 - protein, 21 aa, Mycobacterium
GNGGWLIGSGGDGAAGGVAGQ

SEQ ID NO: 818926 - protein, 19 aa, Mycobacterium
GNGGWLYGDGGAGGQGGAA

SEQ ID NO: 818927 - protein, 26 aa, Mycobacterium
GNGIALLRYLGASGPRIDWSKIHLFW

SEQ ID NO: 818928 - protein, 17 aa, Mycobacterium
GNGPGVHGLWPQALALG

SEQ ID NO: 818929 - protein, 21 aa, Mycobacterium
GNGRVEIWEGRGGNGGNGAIG

SEQ ID NO: 818930 - protein, 22 aa, Mycobacterium
GNGYAGGLQFTPSTWRANGGSG

SEQ ID NO: 818931 - protein, 24 aa, Mycobacterium
GNGYIETWPVARLLRDAQVNTIWE

SEQ ID NO: 818932 - protein, 26 aa, Mycobacterium
GNHDSPALFRLFNQLLGEGSRIRFID

SEQ ID NO: 818933 - protein, 25 aa, Mycobacterium
GNHNVGMFNAGFANVGWANAGIGNT

SEQ ID NO: 818934 - protein, 23 aa, Mycobacterium
GNIFHGGLQWPFAEDDDPLETAA

SEQ ID NO: 818935 - protein, 18 aa, Mycobacterium
GNIGLYQALRARGVHIRL

SEQ ID NO: 818936 - protein, 32 aa, Mycobacterium
GNIGTGPWAPRLAWLTPPIDDPAFLDSSAWEK

SEQ ID NO: 818937 - protein, 19 aa, Mycobacterium
GNIHPLWTYAHVPNGYTGD

SEQ ID NO: 818938 - protein, 18 aa, Mycobacterium
GNIKACWIICTNPVASVA

SEQ ID NO: 818939 - protein, 29 aa, Mycobacterium
GNINSSLISMFLDFYRPLVEAGMVYVTLP

SEQ ID NO: 818940 - protein, 30 aa, Mycobacterium
GNINSSLISMFLDFYRPLVEAGMVYVTMPP

SEQ ID NO: 818941 - protein, 29 aa, Mycobacterium
GNIPFALSAWTIRFLTRLPQKSVTALATN

SEQ ID NO: 818942 - protein, 33 aa, Mycobacterium
GNISTDLLYKLLRSEWLEPRWMIGIDPESEGLA

SEQ ID NO: 818943 - protein, 25 aa, Mycobacterium
GNKGWGWDEILPIFKGFEDHEFGPS

SEQ ID NO: 818944 - protein, 24 aa, Mycobacterium
GNKLQWQNWSLRVGFNYREGMTLH

SEQ ID NO: 818945 - protein, 28 aa, Mycobacterium
GNKRTGWAACWLLLGLNGHRLSSQLDVD

SEQ ID NO: 818946 - protein, 29 aa, Mycobacterium
GNLAAAMQGLVALPLLAGYDIGAPDPEGA

SEQ ID NO: 818947 - protein, 31 aa, Mycobacterium
GNLAAAMQGLVALPLLVGYDIDAPDPEGAGR

SEQ ID NO: 818948 - protein, 19 aa, Mycobacterium
GNLAPPPETLRSLGLPAMS

SEQ ID NO: 818949 - protein, 25 aa, Mycobacterium
GNLKPALFVVPTDTPGLTYTKIPME

SEQ ID NO: 818950 - protein, 25 aa, Mycobacterium
GNLKRLTLELGGKSPLIMFDDANLD

SEQ ID NO: 818951 - protein, 24 aa, Mycobacterium
GNLKRTHLELGGKAPVIVFDDADL

SEQ ID NO: 818952 - protein, 18 aa, Mycobacterium
GNLLTGVLLGIPTVIYPL

SEQ ID NO: 818953 - protein, 17 aa, Mycobacterium
GNLNLGWGNAGNLNLGS

SEQ ID NO: 818954 - protein, 18 aa, Mycobacterium
GNLPGAAALLRRASERLA

SEQ ID NO: 818955 - protein, 25 aa, Mycobacterium
GNLPPPLVGFVLLGLSVVRPNLPNS

SEQ ID NO: 818956 - protein, 18 aa, Mycobacterium
GNLPPVQTPYAVGLGYEP

SEQ ID NO: 818957 - protein, 18 aa, Mycobacterium
GNLRLLLGELDLILPAGE

SEQ ID NO: 818958 - protein, 25 aa, Mycobacterium
GNLTLVPLSLYFLDGKVKVELALAR

SEQ ID NO: 818959 - protein, 28 aa, Mycobacterium
GNLWQMLNAFWTNPFNALLQWGPMIFAL

SEQ ID NO: 818960 - protein, 27 aa, Mycobacterium
GNMGTVPPLPGFNAALRRITAAHGALL

SEQ ID NO: 818961 - protein, 28 aa, Mycobacterium
GNMGTVPPLPGFNAALRRITAEHGALLI

SEQ ID NO: 818962 - protein, 17 aa, Mycobacterium
GNMLSAFVAITPLDPSQ

SEQ ID NO: 818963 - protein, 23 aa, Mycobacterium
GNNGTMPKFPLPLGDLSVPCTGD

SEQ ID NO: 818964 - protein, 25 aa, Mycobacterium
GNNQPGLVVLLTFGTGIGSAVINNG

SEQ ID NO: 818965 - protein, 26 aa, Mycobacterium
GNNVPLTYPFALTFPTMMSLVTGFDF

SEQ ID NO: 818966 - protein, 25 aa, Mycobacterium
GNPAFRFVNVYRVVTNLGVFDFGGP

SEQ ID NO: 818967 - protein, 20 aa, Mycobacterium
GNPALFAEALLHNARHIEVQ

SEQ ID NO: 818968 - protein, 20 aa, Mycobacterium
GNPDLAFKTSFLPNDGVGLA

SEQ ID NO: 818969 - protein, 21 aa, Mycobacterium
GNPDLAFKTSFLPNDGVGLAR

SEQ ID NO: 818970 - protein, 23 aa, Mycobacterium
GNPELPAYGAMKRALNSLTESAA

SEQ ID NO: 818971 - protein, 23 aa, Mycobacterium
GNPETFPGLAGLGDLIVTCTSSS

SEQ ID NO: 818972 - protein, 20 aa, Mycobacterium
GNPFVLTQLLGRPPATIDDV

SEQ ID NO: 818973 - protein, 18 aa, Mycobacterium
GNPGPGGKPGPNGADGIV

SEQ ID NO: 818974 - protein, 24 aa, Mycobacterium
GNPGQWYLHLFDAEQPDLNWDNPE

SEQ ID NO: 818975 - protein, 21 aa, Mycobacterium
GNPLALLEILRDLGPADLAGG

SEQ ID NO: 818976 - protein, 18 aa, Mycobacterium
GNPLLALVASDIPPLSWF

SEQ ID NO: 818977 - protein, 30 aa, Mycobacterium
GNPLTWADLPWLRSLTKLPLILKGICHPDD

SEQ ID NO: 818978 - protein, 29 aa, Mycobacterium
GNPLTWDDLPWLRSLTKLPLIVKGVCHPD

SEQ ID NO: 818979 - protein, 25 aa, Mycobacterium
GNPPDRPWNLPAAVNSLFGAAYYHN

SEQ ID NO: 818980 - protein, 26 aa, Mycobacterium
GNPPDRPWNLPAWVNSLFGAAYYHNT

SEQ ID NO: 818981 - protein, 22 aa, Mycobacterium
GNPTSSYLWRNVIPHLSDVGRC

SEQ ID NO: 818982 - protein, 32 aa, Mycobacterium; identical to SEQ ID NO: 127031

SEQ ID NO: 818983 - protein, 24 aa, Mycobacterium
GNPVILPTVWDAWSARLAVGAGFA

SEQ ID NO: 818984 - protein, 17 aa, Mycobacterium
GNPVVLPTVWDAWSARL

SEQ ID NO: 818985 - protein, 22 aa, Mycobacterium
GNQILGRALGLSTYKMVFGHRG

SEQ ID NO: 818986 - protein, 33 aa, Mycobacterium
GNQILGRALGLSTYKMVFGHRGINIPVIDHATG

SEQ ID NO: 818987 - protein, 20 aa, Mycobacterium
GNQMRSYVLHPYQMVKDLRT

SEQ ID NO: 818988 - protein, 24 aa, Mycobacterium
GNQRHNLIKALRSLFRHAKKNALV

SEQ ID NO: 818989 - protein, 26 aa, Mycobacterium
GNRDGVLTAAWLRALERFQARALAAD

SEQ ID NO: 818990 - protein, 25 aa, Mycobacterium
GNREHHSFVLRSGAIRFVINGAVDP

SEQ ID NO: 818991 - protein, 23 aa, Mycobacterium
GNRGGPFAGVPFLIKDLAQDYAG

SEQ ID NO: 818992 - protein, 17 aa, Mycobacterium
GNRHFSFGIGVHRCIGS

SEQ ID NO: 818993 - protein, 31 aa, Mycobacterium
GNRLTDIGDIAPLAVFLADEGHWINGQTLFT

SEQ ID NO: 818994 - protein, 17 aa, Mycobacterium
GNRMEIIYVIPDYYEKY

SEQ ID NO: 818995 - protein, 27 aa, Mycobacterium
GNRPKIGWRRYEAQAVLSRLLNAPVSV

SEQ ID NO: 818996 - protein, 22 aa, Mycobacterium
GNRPTLNSAFPRVFNKPHCDLV

SEQ ID NO: 818997 - protein, 23 aa, Mycobacterium
GNRQPLPIEGFPAWLHPQLRAAQ

SEQ ID NO: 818998 - protein, 23 aa, Mycobacterium
GNRRLAHLAGGLRPLERIEVRMA

SEQ ID NO: 818999 - protein, 17 aa, Mycobacterium
GNRTFYIQAVHDKRVVS

SEQ ID NO: 819000 - protein, 19 aa, Mycobacterium
GNRYGMPKILAANGRWLEL

SEQ ID NO: 819001 - protein, 22 aa, Mycobacterium
GNRYIDLVCSWGPMLLGHAHPA

SEQ ID NO: 819002 - protein, 22 aa, Mycobacterium
GNSGFTGNLGVPGSNGLPGTIV

SEQ ID NO: 819003 - protein, 26 aa, Mycobacterium
GNSGVTSTGFWNSGSYDTGFGNAGSG

SEQ ID NO: 819004 - protein, 24 aa, Mycobacterium
GNSLITSWRALGWIGPAASEISET

SEQ ID NO: 819005 - protein, 25 aa, Mycobacterium
GNSTRARIVLFRKPIERRAKDTDEL

SEQ ID NO: 819006 - protein, 25 aa, Mycobacterium
GNSTRARIVLFRKPIERRVKGSDEL

SEQ ID NO: 819007 - protein, 26 aa, Mycobacterium
GNSVPRFHITWGTGPALVEIFARQLR

SEQ ID NO: 819008 - protein, 25 aa, Mycobacterium
GNSVPRFHITWGTGPALVEIFARRL

SEQ ID NO: 819009 - protein, 25 aa, Mycobacterium
GNSVPRFHITWGTGPGLVEIFARRV

SEQ ID NO: 819010 - protein, 22 aa, Mycobacterium
GNSWPMARLTLALSPATLPKMG

SEQ ID NO: 819011 - protein, 24 aa, Mycobacterium
GNTALLLAQLRDVPEQRRGAAFVS

SEQ ID NO: 819012 - protein, 25 aa, Mycobacterium
GNTDTGFWNAGSFDTGFGNGGSLNF

SEQ ID NO: 819013 - protein, 26 aa, Mycobacterium
GNTEYYMVLGQHLPLTDPLRQIPYVG

SEQ ID NO: 819014 - protein, 24 aa, Mycobacterium
GNTFEQLPFALTPGPPVPTTVLRK

SEQ ID NO: 819015 - protein, 20 aa, Mycobacterium
GNTFRRLNGTLLAGLPALVV

SEQ ID NO: 819016 - protein, 18 aa, Mycobacterium
GNTLILKVPDQAPLSSLL

SEQ ID NO: 819017 - protein, 18 aa, Mycobacterium
GNTLVLKPAPDTPWAAAV

SEQ ID NO: 819018 - protein, 19 aa, Mycobacterium
GNTLVLKPAPDTPWAAAVL

SEQ ID NO: 819019 - protein, 25 aa, Mycobacterium
GNTLVLKPSPLTPLAGLALARIIDE

SEQ ID NO: 819020 - protein, 23 aa, Mycobacterium
GNTPVLWVSEPFSTPGTGFWAKL

SEQ ID NO: 819021 - protein, 25 aa, Mycobacterium
GNTTRARIVLFRKPIELRAKKSGDL

SEQ ID NO: 819022 - protein, 29 aa, Mycobacterium
GNTVCMAGLWSVWKPNNAAAPLLSATIIT

SEQ ID NO: 819023 - protein, 25 aa, Mycobacterium
GNVASLLKLAPLGKKLYPSYIERLK

SEQ ID NO: 819024 - protein, 23 aa, Mycobacterium
GNVEYFLRLRAQADRPLAGDALV

SEQ ID NO: 819025 - protein, 22 aa, Mycobacterium
GNVFPGLARSLAVLAASPAVEG

SEQ ID NO: 819026 - protein, 20 aa, Mycobacterium
GNVGDYYVSGGTGGMGGDGG

SEQ ID NO: 819027 - protein, 20 aa, Mycobacterium
GNVIALHRLPGARLTGVDIA

SEQ ID NO: 819028 - protein, 17 aa, Mycobacterium
GNVIRFLPPLTIEEADI

SEQ ID NO: 819029 - protein, 17 aa, Mycobacterium
GNVKRWRDGQMALRWCA

SEQ ID NO: 819030 - protein, 19 aa, Mycobacterium
GNVLSRRQLLEIVRDGPWV

SEQ ID NO: 819031 - protein, 24 aa, Mycobacterium
GNVLVGPLDWAVELDERWVIVGPN

SEQ ID NO: 819032 - protein, 21 aa, Mycobacterium
GNVMTFLAPSTRVRVLSRLRA

SEQ ID NO: 819033 - protein, 23 aa, Mycobacterium
GNVRAGGAWRLPGVRNGPANQLN

SEQ ID NO: 819034 - protein, 23 aa, Mycobacterium
GNVTQVLPGIHPIVGVEAGGAMV

SEQ ID NO: 819035 - protein, 20 aa, Mycobacterium
GNVVRFLPPLTIDEPDIAAA

SEQ ID NO: 819036 - protein, 24 aa, Mycobacterium
GNVWFKRVGGGPGLPLLVVHGGPG

SEQ ID NO: 819037 - protein, 19 aa, Mycobacterium
GNVYCNELCFVSGHLPTAP

SEQ ID NO: 819038 - protein, 26 aa, Mycobacterium
GNVYSNELCFLAGLLPTTAVGRLGDP

SEQ ID NO: 819039 - protein, 22 aa, Mycobacterium
GNWTDGLLFALGGPIYAGTNEI

SEQ ID NO: 819040 - protein, 22 aa, Mycobacterium
GNWTEGLLFALGGPIYAGTNEI

SEQ ID NO: 819041 - protein, 21 aa, Mycobacterium
GNWTGIPVFKLTEAETTRLLR

SEQ ID NO: 819042 - protein, 30 aa, Mycobacterium
GNYAFFTEVPDLTYAGFPLAEVSADGTSVI

SEQ ID NO: 819043 - protein, 27 aa, Mycobacterium
GNYNNGFLWRGDYQGLVQLSYKVTIPE

SEQ ID NO: 819044 - protein, 21 aa, Mycobacterium
GNYQVLFLDPDFREDIRLAIV

SEQ ID NO: 819045 - protein, 19 aa, Mycobacterium
GNYRYAYAATGKPGWFLFD

SEQ ID NO: 819046 - protein, 26 aa, Mycobacterium
GNYSNGMFWRGDYQGLVGAHYEIFIP

SEQ ID NO: 819047 - protein, 25 aa, Mycobacterium
GPAAADPIIFLKPNTAIVGPNVPIR

SEQ ID NO: 819048 - protein, 17 aa, Mycobacterium
GPAAAVMRVLPQSVWRR

SEQ ID NO: 819049 - protein, 18 aa, Mycobacterium
GPAADWLAPHGWQPFVGA

SEQ ID NO: 819050 - protein, 32 aa, Mycobacterium
GPAAMAMAAAVAPYANWLSAAAARAAGAAAQA

SEQ ID NO: 819051 - protein, 25 aa, Mycobacterium
GPAARYRRWLAALRGGARLVIGTRS

SEQ ID NO: 819052 - protein, 26 aa, Mycobacterium
GPAARYRRWLAALRGQARLVIGTRSA

SEQ ID NO: 819053 - protein, 26 aa, Mycobacterium
GPAARYRRWLAALRGTARLVIGTRSA

SEQ ID NO: 819054 - protein, 23 aa, Mycobacterium
GPAAVFSALIPDAHHFNGRGGRV

SEQ ID NO: 819055 - protein, 26 aa, Mycobacterium
GPAAVGALLLRRDVACVPLAHGGGQE

SEQ ID NO: 819056 - protein, 32 aa, Mycobacterium
GPAAWRYVAEWLAVPVVWIPPATETTARVYAR

SEQ ID NO: 819057 - protein, 25 aa, Mycobacterium
GPADIPLLVADLAYVRGMVHRQLRE

SEQ ID NO: 819058 - protein, 29 aa, Mycobacterium
GPAELHFLGAALWRTGIHRVLREFVLDDD

SEQ ID NO: 819059 - protein, 18 aa, Mycobacterium
GPAELHYLGARLWRNGIG

SEQ ID NO: 819060 - protein, 21 aa, Mycobacterium
GPAFLAGCAVVLKPAAETPLS

SEQ ID NO: 819061 - protein, 25 aa, Mycobacterium
GPAFLLNEMLVWGFTGQVISAMLDV

SEQ ID NO: 819062 - protein, 26 aa, Mycobacterium
GPAFQGTIKSAVAFGALLSKGIGDTI

SEQ ID NO: 819063 - protein, 20 aa, Mycobacterium
GPAFWSEMPELFAALDADPE

SEQ ID NO: 819064 - protein, 25 aa, Mycobacterium
GPAGFGLRIKRAVTASLLLDGPASA

SEQ ID NO: 819065 - protein, 28 aa, Mycobacterium
GPAGHFGLFFIGAADQLFLSTAGVGQPF

SEQ ID NO: 819066 - protein, 24 aa, Mycobacterium
GPAGTFFSRPGVALAASATLRVTV

SEQ ID NO: 819067 - protein, 17 aa, Mycobacterium
GPAIALALNGFGHVVAD

SEQ ID NO: 819068 - protein, 27 aa, Mycobacterium
GPAIDLGDLAYTLARRRGFRAARSAVL

SEQ ID NO: 819069 - protein, 21 aa, Mycobacterium
GPAIYTFLYGREVSVYTIDSL

SEQ ID NO: 819070 - protein, 24 aa, Mycobacterium
GPAKFSTYPMTFLNQALSASKAVT

SEQ ID NO: 819071 - protein, 25 aa, Mycobacterium
GPAKSPLPPMPIGGPAPTPPEPPPA

SEQ ID NO: 819072 - protein, 28 aa, Mycobacterium
GPALHTTVMPFILRGIALLGMDSCRCRS

SEQ ID NO: 819073 - protein, 23 aa, Mycobacterium
GPALLLGARGKRLDPRQARTVVH

SEQ ID NO: 819074 - protein, 20 aa, Mycobacterium
GPALLLGARGRRLDARQART

SEQ ID NO: 819075 - protein, 23 aa, Mycobacterium
GPALLLGARGRRLDPRQARTVVH

SEQ ID NO: 819076 - protein, 24 aa, Mycobacterium
GPALNLFRHHDVGPLGGNAFAPFD

SEQ ID NO: 819077 - protein, 26 aa, Mycobacterium
GPALSAFNAWILLKGLETLAIRVQHS

SEQ ID NO: 819078 - protein, 23 aa, Mycobacterium
GPALVLLPGWSLTAQIFRHQLAG

SEQ ID NO: 819079 - protein, 19 aa, Mycobacterium
GPAMAVYPMTKAAVLCLTE

SEQ ID NO: 819080 - protein, 25 aa, Mycobacterium
GPAPDRFLVGLAVLGLIATASEDRP

SEQ ID NO: 819081 - protein, 21 aa, Mycobacterium
GPAPEVLRRLATGSPAAVIPP

SEQ ID NO: 819082 - protein, 17 aa, Mycobacterium
GPAPLAPPVMPSSAAPA

SEQ ID NO: 819083 - protein, 38 aa, Mycobacterium
GPAPQAPPMLPPLAPHPPIPPPPSPPPGKPPLGQPPIP

SEQ ID NO: 819084 - protein, 23 aa, Mycobacterium
GPAPVLQWLIYPRTDFTAQTRSL

SEQ ID NO: 819085 - protein, 19 aa, Mycobacterium
GPAPWKSLLGMTGPTTLPI

SEQ ID NO: 819086 - protein, 19 aa, Mycobacterium
GPARLQIHLSWAPTDEEAL

SEQ ID NO: 819087 - protein, 33 aa, Mycobacterium
GPARSRAQLALGGRRILHPQCLHTHRNPLVMLV

SEQ ID NO: 819088 - protein, 20 aa, Mycobacterium
GPASFPPPFADPPVPAAPVD

SEQ ID NO: 819089 - protein, 31 aa, Mycobacterium
GPASLSMVAAARPYIAWLSGASALAEQAGMQ

SEQ ID NO: 819090 - protein, 25 aa, Mycobacterium
GPATAPLFADLTFSAGPGRTGLVGS

SEQ ID NO: 819091 - protein, 24 aa, Mycobacterium
GPATGLLLAITRRVTAEQAGLEMF

SEQ ID NO: 819092 - protein, 27 aa, Mycobacterium
GPATIVPMFLLYDYSFLPEGASSKAEG

SEQ ID NO: 819093 - protein, 23 aa, Mycobacterium
GPATVTDIKWWFGNTLGSARQAL

SEQ ID NO: 819094 - protein, 26 aa, Mycobacterium
GPAVFLLHGWPQTWQEWLPILEDLAR

SEQ ID NO: 819095 - protein, 34 aa, Mycobacterium
GPAVGRYLHLHPVVAMLALHDQPQQPWWGGPMTA

SEQ ID NO: 819096 - protein, 24 aa, Mycobacterium
GPAVQAGPLPAYGSDLRQSGSVPP

SEQ ID NO: 819097 - protein, 24 aa, Mycobacterium
GPAVRAVLTVTFGGLKPVHALGEC

SEQ ID NO: 819098 - protein, 20 aa, Mycobacterium
GPAVVVLRPEQLRVGTDGSG

SEQ ID NO: 819099 - protein, 18 aa, Mycobacterium
GPAYTTFAYASWGAAHAA

SEQ ID NO: 819100 - protein, 17 aa, Mycobacterium
GPCDPAIIAALSETLRA

SEQ ID NO: 819101 - protein, 17 aa, Mycobacterium
GPCITAMVTGRVSVSGS

SEQ ID NO: 819102 - protein, 19 aa, Mycobacterium
GPCIVLPGSFRRFAERRRV

SEQ ID NO: 819103 - protein, 21 aa, Mycobacterium
GPCTWVSLWSNTTGSGIWYGN

SEQ ID NO: 819104 - protein, 30 aa, Mycobacterium
GPDAPAHPVPWRLDGLPLLLDPADWNVLEV

SEQ ID NO: 819105 - protein, 26 aa, Mycobacterium
GPDAPPLTRLIAFGRARLAFLERHLD

SEQ ID NO: 819106 - protein, 19 aa, Mycobacterium
GPDAWLLHADAWGATLTRT

SEQ ID NO: 819107 - protein, 17 aa, Mycobacterium
GPDDLAALFPSGLIAQE

SEQ ID NO: 819108 - protein, 31 aa, Mycobacterium
GPDDMAPICQLFHTLPIPWVEAEDISNAVLF

SEQ ID NO: 819109 - protein, 34 aa, Mycobacterium
GPDDMAPICQLFHTLPIPWVEPIDISNAVLFFAS

SEQ ID NO: 819110 - protein, 35 aa, Mycobacterium
GPDDMAPICQLFHTLPIPWVEPIDISNAVLFFASD

SEQ ID NO: 819111 - protein, 24 aa, Mycobacterium
GPDDPAWSLQCDIARQVLALDGVP

SEQ ID NO: 819112 - protein, 23 aa, Mycobacterium
GPDEALLDIYRKLRPGEPPTKES

SEQ ID NO: 819113 - protein, 17 aa, Mycobacterium
GPDFPFEFDAWISHPDG

SEQ ID NO: 819114 - protein, 21 aa, Mycobacterium
GPDFPPFAVIWGDSNLGLSPR

SEQ ID NO: 819115 - protein, 25 aa, Mycobacterium
GPDGDRIFRWQLAAAVRPTLFVFTS

SEQ ID NO: 819116 - protein, 19 aa, Mycobacterium
GPDGHWLEPLTTLAYIAGF

SEQ ID NO: 819117 - protein, 20 aa, Mycobacterium
GPDGLTLPMTLNLPGTVNRG

SEQ ID NO: 819118 - protein, 28 aa, Mycobacterium
GPDGMAVIRPIVALAARWLRDGGKCAVE

SEQ ID NO: 819119 - protein, 23 aa, Mycobacterium
GPDGTPLPFDRSLITPYVLRHSY

SEQ ID NO: 819120 - protein, 26 aa, Mycobacterium
GPDGTRDLMLVSPIILYDHPQIAAQS

SEQ ID NO: 819121 - protein, 25 aa, Mycobacterium
GPDHITGGWWEGIIGPGAAIDTDHW

SEQ ID NO: 819122 - protein, 20 aa, Mycobacterium
GPDIALFDRITARLLDAGAV

SEQ ID NO: 819123 - protein, 20 aa, Mycobacterium
GPDISGMLEPLFGAEGLRGV

SEQ ID NO: 819124 - protein, 17 aa, Mycobacterium
GPDLTQLGLIPADGIML

SEQ ID NO: 819125 - protein, 25 aa, Mycobacterium
GPDLTRLDLPAADGIMLLAAHISRH

SEQ ID NO: 819126 - protein, 25 aa, Mycobacterium
GPDNAKPPPALFRLSVNMDRDDGQL

SEQ ID NO: 819127 - protein, 24 aa, Mycobacterium
GPDNRMISWPYPKLMNSNNMVDQG

SEQ ID NO: 819128 - protein, 17 aa, Mycobacterium
GPDNRWISSPYTKLMNS

SEQ ID NO: 819129 - protein, 20 aa, Mycobacterium
GPDPALIRVLVDRLVESGCH

SEQ ID NO: 819130 - protein, 19 aa, Mycobacterium
GPDPKLSLAPVAAALGEQL

SEQ ID NO: 819131 - protein, 25 aa, Mycobacterium
GPDRAWLICDDPNHTWLRGSWEHQE

SEQ ID NO: 819132 - protein, 20 aa, Mycobacterium
GPDREWRAWRAIIDKTLVLV

SEQ ID NO: 819133 - protein, 26 aa, Mycobacterium
GPDRPIELRLLEIEPALKALEGVVME

SEQ ID NO: 819134 - protein, 26 aa, Mycobacterium
GPDSLYNAWTQLPFVDAIYGHNREAI

SEQ ID NO: 819135 - protein, 23 aa, Mycobacterium
GPDTLLLLEHRPVYTAGRRTEPH

SEQ ID NO: 819136 - protein, 25 aa, Mycobacterium
GPDTYGRFMRIRVFDCWMHEQDIRV

SEQ ID NO: 819137 - protein, 26 aa, Mycobacterium
GPDVGWVLRLLSAPGAELVLPIIAPT

SEQ ID NO: 819138 - protein, 22 aa, Mycobacterium
GPDVPPPPPVRAYSVNWDAIAQ

SEQ ID NO: 819139 - protein, 25 aa, Mycobacterium
GPDVSYWRRQLFRDGLGWRYVGVLH

SEQ ID NO: 819140 - protein, 29 aa, Mycobacterium
GPDYGHALSGRWPADLLSAATIPSSHDWG

SEQ ID NO: 819141 - protein, 28 aa, Mycobacterium
GPECPTELLCLPLLRARYGLTFKEFRVT

SEQ ID NO: 819142 - protein, 17 aa, Mycobacterium
GPEFMRWPTDVRLRAAM

SEQ ID NO: 819143 - protein, 21 aa, Mycobacterium
GPEGKDLAILLLRLGRGRLGH

SEQ ID NO: 819144 - protein, 21 aa, Mycobacterium
GPEGKDLAMLLLRLGRGRLGY

SEQ ID NO: 819145 - protein, 18 aa, Mycobacterium
GPEHAWLRESGRADYRPI

SEQ ID NO: 819146 - protein, 24 aa, Mycobacterium
GPEHTYHVPLPEPGEPKRAILDSY

SEQ ID NO: 819147 - protein, 22 aa, Mycobacterium
GPELERVLARCSFLHDGVAVRD

SEQ ID NO: 819148 - protein, 30 aa, Mycobacterium
GPELISRWAAYWPPGATEAAFRWASSRDGQ

SEQ ID NO: 819149 - protein, 32 aa, Mycobacterium
GPEMLSFVLEHTPLKMCWVPGYSDYYPEAPGG

SEQ ID NO: 819150 - protein, 25 aa, Mycobacterium
GPEMLSFVLEHTPLKMCWVPRYSDY

SEQ ID NO: 819151 - protein, 20 aa, Mycobacterium
GPEMTVLVGGLRALGANHGS

SEQ ID NO: 819152 - protein, 25 aa, Mycobacterium
GPEPHLVLPATPWHHTRHWIDVRPA

SEQ ID NO: 819153 - protein, 20 aa, Mycobacterium
GPEPIALRIKAARVSAVVVD

SEQ ID NO: 819154 - protein, 24 aa, Mycobacterium
GPERVEKLLARHPRLVLIIAHMGM

SEQ ID NO: 819155 - protein, 17 aa, Mycobacterium
GPETLIIDCGADFRLTD

SEQ ID NO: 819156 - protein, 18 aa, Mycobacterium
GPFAEWLVCDLRSADEIE

SEQ ID NO: 819157 - protein, 18 aa, Mycobacterium
GPFAIVQAALPYLRRSGN

SEQ ID NO: 819158 - protein, 43 aa, Mycobacterium; identical to SEQ ID NO: 114874

SEQ ID NO: 819159 - protein, 37 aa, Mycobacterium
GPFALQDFSLFHVLRYGFRPSKIAFLAWHAWSDSQRG

SEQ ID NO: 819160 - protein, 23 aa, Mycobacterium
GPFDGILAAYLIRNVADRDGVLQ

SEQ ID NO: 819161 - protein, 25 aa, Mycobacterium
GPFNGWLHFPQFGSPAWTFNKALWE

SEQ ID NO: 819162 - protein, 18 aa, Mycobacterium
GPFPPLPFEPEGDDISPQ

SEQ ID NO: 819163 - protein, 18 aa, Mycobacterium
GPFRREVLQLAGGGGDDL

SEQ ID NO: 819164 - protein, 22 aa, Mycobacterium
GPFTYLRPGTVLGDDGKLGAFV

SEQ ID NO: 819165 - protein, 22 aa, Mycobacterium
GPFYDGAVFHRVINGFMIQGGD

SEQ ID NO: 819166 - protein, 22 aa, Mycobacterium
GPFYDGAVFHRVIQGFMIQGGD

SEQ ID NO: 819167 - protein, 24 aa, Mycobacterium
GPFYDGVIFHRVIEGFMIQGGDPT

SEQ ID NO: 819168 - protein, 26 aa, Mycobacterium
GPGAHLLLAHHPLLLRGVDTVAASTP

SEQ ID NO: 819169 - protein, 25 aa, Mycobacterium
GPGAPGMPMPAPGLVAPPTMPNMGG

SEQ ID NO: 819170 - protein, 23 aa, Mycobacterium
GPGAPPLERLLAYGRHRLKFVDT

SEQ ID NO: 819171 - protein, 26 aa, Mycobacterium
GPGDRPAWSMIFEDLGHRRRPAPETA

SEQ ID NO: 819172 - protein, 23 aa, Mycobacterium
GPGDRWIIEQIAATAPKVKLVVI

SEQ ID NO: 819173 - protein, 24 aa, Mycobacterium
GPGDRWIYEQIRAVAPRTTLIAIV

SEQ ID NO: 819174 - protein, 27 aa, Mycobacterium
GPGDVPLLDTYLSVANYLLIPTRADQA

SEQ ID NO: 819175 - protein, 25 aa, Mycobacterium
GPGDYFGEMGVLFHLPRSATVRART

SEQ ID NO: 819176 - protein, 27 aa, Mycobacterium
GPGENIPAWLVFDQRYRDRYIFAGLQP

SEQ ID NO: 819177 - protein, 26 aa, Mycobacterium
GPGENLPAWLVFDQEYRNRYIFAGLQ

SEQ ID NO: 819178 - protein, 17 aa, Mycobacterium
GPGFYAFGDLLKQWRDK

SEQ ID NO: 819179 - protein, 24 aa, Mycobacterium
GPGGGEMIAIRRGQQAAQHGNTQR

SEQ ID NO: 819180 - protein, 26 aa, Mycobacterium
GPGGSIPIRIYWPPISPDATDPLPVV

SEQ ID NO: 819181 - protein, 26 aa, Mycobacterium
GPGHPTPGWWDGVAGPGAPIDTDRWC

SEQ ID NO: 819182 - protein, 27 aa, Mycobacterium
GPGKADPGLLRWFEDPKIGGIELKGFS

SEQ ID NO: 819183 - protein, 29 aa, Mycobacterium
GPGLNLGLQDTFNLGWKLAAELNGWAPDG

SEQ ID NO: 819184 - protein, 36 aa, Mycobacterium
GPGLYPCPPFARLAGQDKWLLRPPPLLGEHNEDVLS

SEQ ID NO: 819185 - protein, 28 aa, Mycobacterium
GPGNRAPLSFPIPGWNICVDFPIKAGLN

SEQ ID NO: 819186 - protein, 23 aa, Mycobacterium
GPGPARPPQTFALFNTTGVDARQ

SEQ ID NO: 819187 - protein, 19 aa, Mycobacterium
GPGPTLLYGYGGFETSNTP

SEQ ID NO: 819188 - protein, 23 aa, Mycobacterium
GPGQFVALLFPRSTEAIVAILAV

SEQ ID NO: 819189 - protein, 24 aa, Mycobacterium
GPGQPPILIPLITGQYNNVVSVGL

SEQ ID NO: 819190 - protein, 35 aa, Mycobacterium
GPGRIHDWFDFSARYWGVLFRVYSRLRMADRHKVM

SEQ ID NO: 819191 - protein, 17 aa, Mycobacterium
GPGRLVARLIQRGVPAL

SEQ ID NO: 819192 - protein, 18 aa, Mycobacterium
GPGRRDICIYARESHVVV

SEQ ID NO: 819193 - protein, 19 aa, Mycobacterium
GPGRRDICIYARESHVVVA

SEQ ID NO: 819194 - protein, 21 aa, Mycobacterium
GPGRSLPQYGFRPTVVARPPA

SEQ ID NO: 819195 - protein, 27 aa, Mycobacterium
GPGTKGLSLFFVPKFIPNFETGEPGER

SEQ ID NO: 819196 - protein, 28 aa, Mycobacterium
GPGTKGLSLFFVPKFLFDFETGELGERN

SEQ ID NO: 819197 - protein, 31 aa, Mycobacterium
GPGTKGLSLFYVPKFLFDPETFELGPRNGVF

SEQ ID NO: 819198 - protein, 25 aa, Mycobacterium
GPGTLGLPILTILQSLVSGFEALSD

SEQ ID NO: 819199 - protein, 23 aa, Mycobacterium
GPGVHGLWPQALALGYRVAVRPS

SEQ ID NO: 819200 - protein, 26 aa, Mycobacterium
GPGVLFNDFLPAVARMRALDPVTSEL

SEQ ID NO: 819201 - protein, 22 aa, Mycobacterium
GPGVRALLLYPMNALANDQMKR

SEQ ID NO: 819202 - protein, 18 aa, Mycobacterium
GPGWSGDPAADPSGALAG

SEQ ID NO: 819203 - protein, 21 aa, Mycobacterium
GPGYGAFLRVLVDKTPKLTAV

SEQ ID NO: 819204 - protein, 20 aa, Mycobacterium
GPGYLVKRVQQALRRRCDTE

SEQ ID NO: 819205 - protein, 23 aa, Mycobacterium
GPGYPMVSPPDSPSSMKSPRVCT

SEQ ID NO: 819206 - protein, 25 aa, Mycobacterium
GPHAKLVMSFLAMDDPEHLRLRALV

SEQ ID NO: 819207 - protein, 25 aa, Mycobacterium
GPHAMFDPRFQKLGIHPGGGATWML

SEQ ID NO: 819208 - protein, 17 aa, Mycobacterium
GPHEWLEPIPDALTFRT

SEQ ID NO: 819209 - protein, 17 aa, Mycobacterium
GPHFCIGAPLARLEAAV

SEQ ID NO: 819210 - protein, 20 aa, Mycobacterium
GPHGSFFLREAERPILLLAG

SEQ ID NO: 819211 - protein, 24 aa, Mycobacterium
GPHGVGAFLAWGDPSLYDSTLRIL

SEQ ID NO: 819212 - protein, 19 aa, Mycobacterium
GPHKVLRGDLAFAGQPGVL

SEQ ID NO: 819213 - protein, 20 aa, Mycobacterium
GPHLMMVFPASAGDLTKGIG

SEQ ID NO: 819214 - protein, 20 aa, Mycobacterium
GPHLQANWTWARSALDEKQI

SEQ ID NO: 819215 - protein, 23 aa, Mycobacterium
GPHRPPLPNLAEAFLALVEASWD

SEQ ID NO: 819216 - protein, 19 aa, Mycobacterium
GPHRVLRGDLAFAGLPGVV

SEQ ID NO: 819217 - protein, 18 aa, Mycobacterium
GPHRVLRGDLAYAGLPGV

SEQ ID NO: 819218 - protein, 19 aa, Mycobacterium
GPHVAVFLPELELARAWER

SEQ ID NO: 819219 - protein, 27 aa, Mycobacterium
GPHVVLNPEFIPKPEFIHSRGPVAVVV

SEQ ID NO: 819220 - protein, 25 aa, Mycobacterium
GPIAKAYIRLPFNQGPDAWLAELAK

SEQ ID NO: 819221 - protein, 26 aa, Mycobacterium
GPIAKAYMRLPFNQGPDAWLAELAKL

SEQ ID NO: 819222 - protein, 20 aa, Mycobacterium
GPIAKKLDPALVAPVVAYLC

SEQ ID NO: 819223 - protein, 21 aa, Mycobacterium
GPIEALPIAAFSMMRAMSTRN

SEQ ID NO: 819224 - protein, 21 aa, Mycobacterium
GPIFPLIEDLFGLGIVEVQQE

SEQ ID NO: 819225 - protein, 35 aa, Mycobacterium
GPIFRHSGVIFLRRKLDDPLYKYVLRQYVGYLVEK

SEQ ID NO: 819226 - protein, 18 aa, Mycobacterium
GPIHIGGTRWAAVGDALG

SEQ ID NO: 819227 - protein, 23 aa, Mycobacterium
GPIITEWLAQRRFSPVESEVVAD

SEQ ID NO: 819228 - protein, 24 aa, Mycobacterium
GPIKAIPKALELAGRKLEDVALFE

SEQ ID NO: 819229 - protein, 24 aa, Mycobacterium
GPIPQQVHFLDWRPRSRAAVRAWH

SEQ ID NO: 819230 - protein, 18 aa, Mycobacterium
GPIRLVDVFGGRSQLIVY

SEQ ID NO: 819231 - protein, 25 aa, Mycobacterium
GPISRAYMRLPFGKGSDTWLAELAA

SEQ ID NO: 819232 - protein, 32 aa, Mycobacterium
GPITQDLPLDQYWFWNLRNTVRFDKAIAAAVT

SEQ ID NO: 819233 - protein, 22 aa, Mycobacterium
GPIVHVHLGLYGAFTEWERPDD

SEQ ID NO: 819234 - protein, 25 aa, Mycobacterium
GPKAELTWFIPGSGAVWGPAKDIAA

SEQ ID NO: 819235 - protein, 22 aa, Mycobacterium
GPKIRLGRFADGPTYWADGDTV

SEQ ID NO: 819236 - protein, 28 aa, Mycobacterium
GPKKQLGITFILIDFTSPGIDVKPLVMS

SEQ ID NO: 819237 - protein, 23 aa, Mycobacterium
GPKLGRLAALLRDKRIPFEMCPS

SEQ ID NO: 819238 - protein, 28 aa, Mycobacterium
GPKPAGVPFLWRWQDVHAKLLKSCDVMP

SEQ ID NO: 819239 - protein, 18 aa, Mycobacterium
GPKQNEVLIKVAAAGLCH

SEQ ID NO: 819240 - protein, 25 aa, Mycobacterium
GPKRTLPLVVRYADIWHTFLSVEGF

SEQ ID NO: 819241 - protein, 21 aa, Mycobacterium
GPKTFAFDVLNGAVGFLNACQ

SEQ ID NO: 819242 - protein, 20 aa, Mycobacterium
GPLAAFVHALGSVGFDVAVL

SEQ ID NO: 819243 - protein, 19 aa, Mycobacterium
GPLAGLPPLSGGMVGFFAY

SEQ ID NO: 819244 - protein, 21 aa, Mycobacterium
GPLAHPFQPLLNPRLREFALR

SEQ ID NO: 819245 - protein, 22 aa, Mycobacterium
GPLAHPFQPLLTPRLREFALRE

SEQ ID NO: 819246 - protein, 23 aa, Mycobacterium
GPLALCYRVFMLPDTKQTMIAYY

SEQ ID NO: 819247 - protein, 17 aa, Mycobacterium
GPLALVEDLGRPGLSHI

SEQ ID NO: 819248 - protein, 32 aa, Mycobacterium
GPLASWNAWHWRWNPWLMAAGGYAVLLPDPAL

SEQ ID NO: 819249 - protein, 17 aa, Mycobacterium
GPLGPWAGLGADPAHEA

SEQ ID NO: 819250 - protein, 30 aa, Mycobacterium
GPLGSWNTWHWRWNPWLLTAHGYAVLMPDP

SEQ ID NO: 819251 - protein, 20 aa, Mycobacterium
GPLLDRQAAIRARLGQLGIP

SEQ ID NO: 819252 - protein, 21 aa, Mycobacterium
GPLLDRVPIPLTYSSQFVRVD

SEQ ID NO: 819253 - protein, 38 aa, Mycobacterium
GPLMAGVYSAPFPTAYRYGWSEAEATRFALQELDYLFA

SEQ ID NO: 819254 - protein, 35 aa, Mycobacterium
GPLMRRSGVIFLRRKLDDPLYKFVLRQFVGYIVEK

SEQ ID NO: 819255 - protein, 21 aa, Mycobacterium
GPLNAPFYRKLGLPTVVTVHG

SEQ ID NO: 819256 - protein, 17 aa, Mycobacterium
GPLNAWLKEVVAATPPP

SEQ ID NO: 819257 - protein, 17 aa, Mycobacterium
GPLPAYGADLRPPVVAP

SEQ ID NO: 819258 - protein, 19 aa, Mycobacterium
GPLPLQIICDMMGIPPRDH

SEQ ID NO: 819259 - protein, 19 aa, Mycobacterium
GPLPVRPNTLLAGGDSLDI

SEQ ID NO: 819260 - protein, 25 aa, Mycobacterium
GPLPYNRMNGILAPGLFGLGIAFPE

SEQ ID NO: 819261 - protein, 22 aa, Mycobacterium
GPLRAFYQRIKARRGFQTAIVA

SEQ ID NO: 819262 - protein, 17 aa, Mycobacterium
GPLRRFDVELTVPSLVR

SEQ ID NO: 819263 - protein, 36 aa, Mycobacterium
GPLSGDPYRMASQLGMPPWRVQKAQKQARHWSRDTV

SEQ ID NO: 819264 - protein, 37 aa, Mycobacterium
GPLSGDPYRMASQLGMPPWRVQKAQKQARRWSRDKVA

SEQ ID NO: 819265 - protein, 23 aa, Mycobacterium
GPLTLLDLFDGRSQLIVQHFMFG

SEQ ID NO: 819266 - protein, 23 aa, Mycobacterium
GPLTNLALALRAEPALPSLLRRL

SEQ ID NO: 819267 - protein, 21 aa, Mycobacterium
GPLTVRLPHRPMRYDAELRDR

SEQ ID NO: 819268 - protein, 25 aa, Mycobacterium
GPLTWPLHISLMLAKEYALTGQRIA

SEQ ID NO: 819269 - protein, 20 aa, Mycobacterium
GPLVLRMAWHFAGTYRIGDG

SEQ ID NO: 819270 - protein, 17 aa, Mycobacterium
GPLVLWASQTGTAEEFA

SEQ ID NO: 819271 - protein, 17 aa, Mycobacterium
GPLVRRLGRMLTEDVRV

SEQ ID NO: 819272 - protein, 21 aa, Mycobacterium
GPLYAAIGVLAALHAAGRDGK

SEQ ID NO: 819273 - protein, 19 aa, Mycobacterium
GPMGPTRMVLSKPVIAAIS

SEQ ID NO: 819274 - protein, 24 aa, Mycobacterium
GPMGPTRMVLSKPVIAAVSGYAVA

SEQ ID NO: 819275 - protein, 19 aa, Mycobacterium
GPMLAAAAAWDRLASELDT

SEQ ID NO: 819276 - protein, 26 aa, Mycobacterium
GPMPRWYRPVGALYDQFLGAAETNPV

SEQ ID NO: 819277 - protein, 19 aa, Mycobacterium
GPMRAVVKAVPILKPVVPD

SEQ ID NO: 819278 - protein, 19 aa, Mycobacterium
GPMRTYRIGAILLDLQDPT

SEQ ID NO: 819279 - protein, 28 aa, Mycobacterium
GPMRWTCVEPLRKWRLDVAPNGSGIEWE

SEQ ID NO: 819280 - protein, 25 aa, Mycobacterium
GPMTDLLLGLIRRGTTQDLINYRTN

SEQ ID NO: 819281 - protein, 20 aa, Mycobacterium
GPMTGLLGRAIVVIGADGNV

SEQ ID NO: 819282 - protein, 24 aa, Mycobacterium
GPMVDDLLRLVLRHSFETEAINVA

SEQ ID NO: 819283 - protein, 17 aa, Mycobacterium
GPMVRALREWRKELGDR

SEQ ID NO: 819284 - protein, 24 aa, Mycobacterium
GPNARRLHYLSVPPKAARAVITML

SEQ ID NO: 819285 - protein, 35 aa, Mycobacterium
GPNLLLIHGYPFNSWDWSLIWPTLTQRFTVIAPDM

SEQ ID NO: 819286 - protein, 23 aa, Mycobacterium
GPNNMFPFATPTNAALPVGMNQG

SEQ ID NO: 819287 - protein, 19 aa, Mycobacterium
GPNPLTPEFSISGAPIATL

SEQ ID NO: 819288 - protein, 24 aa, Mycobacterium
GPNVLRAFTFPFDDVRVLIVGQDP

SEQ ID NO: 819289 - protein, 25 aa, Mycobacterium
GPNVLRAFTFPFDQVRILIVGQDPY

SEQ ID NO: 819290 - protein, 24 aa, Mycobacterium
GPNVLRAFTFPFDQVRVLIVGQDP

SEQ ID NO: 819291 - protein, 24 aa, Mycobacterium
GPNVLRAFTYPFDQVRVLIVGQDP

SEQ ID NO: 819292 - protein, 25 aa, Mycobacterium
GPPASHHLRWLASANCLLEIGEDVT

SEQ ID NO: 819293 - protein, 23 aa, Mycobacterium
GPPASHHLRWLASANCLLELDED

SEQ ID NO: 819294 - protein, 17 aa, Mycobacterium
GPPDWQPRQGMFVQMAA

SEQ ID NO: 819295 - protein, 21 aa, Mycobacterium
GPPEELLLFAVGRAARVEFDG

SEQ ID NO: 819296 - protein, 26 aa, Mycobacterium
GPPELYAWLHYDPIPTRDDLAKALLA

SEQ ID NO: 819297 - protein, 26 aa, Mycobacterium
GPPELYAWLHYDPVPTRDDLAKALIA

SEQ ID NO: 819298 - protein, 26 aa, Mycobacterium
GPPELYAWLHYEPIPDRDDLAKALIA

SEQ ID NO: 819299 - protein, 24 aa, Mycobacterium
GPPGLPRFTVVAFDLGIKTNTPRN

SEQ ID NO: 819300 - protein, 23 aa, Mycobacterium
GPPICAQVLLYPGLDRDMAAPSV

SEQ ID NO: 819301 - protein, 23 aa, Mycobacterium
GPPIGALVFRDPALIDSFGSVSL

SEQ ID NO: 819302 - protein, 17 aa, Mycobacterium
GPPPGVEPKPLKGMPPF

SEQ ID NO: 819303 - protein, 23 aa, Mycobacterium
GPPPPPAIRLASTALPATSAAAA

SEQ ID NO: 819304 - protein, 18 aa, Mycobacterium
GPPPTHKIWATQSGFTFP

SEQ ID NO: 819305 - protein, 18 aa, Mycobacterium
GPPPTHKVWAAESGFLFP

SEQ ID NO: 819306 - protein, 31 aa, Mycobacterium
GPPRFAHELAWWVYTCWREGLRRIDPAKIVW

SEQ ID NO: 819307 - protein, 25 aa, Mycobacterium
GPPSDLPLCALLAGWVRGQVRPAAT

SEQ ID NO: 819308 - protein, 23 aa, Mycobacterium
GPPTLPPFMLADGVASLNAAYAV

SEQ ID NO: 819309 - protein, 24 aa, Mycobacterium
GPPVSGFFGVVQMASPAAAQEFFA

SEQ ID NO: 819310 - protein, 19 aa, Mycobacterium
GPPVVLLHGWPGTRRDHRH

SEQ ID NO: 819311 - protein, 23 aa, Mycobacterium
GPQDMFFLYSESPSTMMHVGALM

SEQ ID NO: 819312 - protein, 26 aa, Mycobacterium
GPQFGPLRRVRAVLAAATRCHRAGQD

SEQ ID NO: 819313 - protein, 20 aa, Mycobacterium
GPQILVQILHQPMLDSDATQ

SEQ ID NO: 819314 - protein, 27 aa, Mycobacterium
GPQLALAANSPFFFGKSLWAETRIELF

SEQ ID NO: 819315 - protein, 22 aa, Mycobacterium
GPQLHATWTWAPSALDREQVAR

SEQ ID NO: 819316 - protein, 20 aa, Mycobacterium
GPQLPLYMLGCEVKAMYPLG

SEQ ID NO: 819317 - protein, 27 aa, Mycobacterium
GPQPADQLRRWLDSLLSATAGKLRGPT

SEQ ID NO: 819318 - protein, 36 aa, Mycobacterium; identical to SEQ ID NO: 114884

SEQ ID NO: 819319 - protein, 25 aa, Mycobacterium
GPQRVAPTLQPLRPLLSLRSQHPAP

SEQ ID NO: 819320 - protein, 25 aa, Mycobacterium
GPQSWKQFLHPPRQRLWAGTRDGFG

SEQ ID NO: 819321 - protein, 26 aa, Mycobacterium
GPQSWKQFLHPPRRRLWSGTRDGFSE

SEQ ID NO: 819322 - protein, 24 aa, Mycobacterium
GPQTRRFLMDLTGIGGDRPPFSCD

SEQ ID NO: 819323 - protein, 23 aa, Mycobacterium
GPQTRRFLVDLTGVDGADRPPFS

SEQ ID NO: 819324 - protein, 25 aa, Mycobacterium
GPQVAALAKFFSVPPANVIVMHDEL

SEQ ID NO: 819325 - protein, 24 aa, Mycobacterium
GPQVVARLVDPLLGGVYAGSAATT

SEQ ID NO: 819326 - protein, 21 aa, Mycobacterium
GPQYVVALLAVLKSGAVCVPL

SEQ ID NO: 819327 - protein, 25 aa, Mycobacterium
GPRALGRAAAFIHHLPVDQSFTLEA

SEQ ID NO: 819328 - protein, 25 aa, Mycobacterium
GPRATFLLMQAVHPLMVREGGGSIV

SEQ ID NO: 819329 - protein, 25 aa, Mycobacterium
GPRATFLLMQAVYPVMVEAGGGSIV

SEQ ID NO: 819330 - protein, 17 aa, Mycobacterium
GPRAWHRDFFDAEIVAC

SEQ ID NO: 819331 - protein, 25 aa, Mycobacterium
GPRDLVAPYRSGLLLPVAEFEDRLS

SEQ ID NO: 819332 - protein, 23 aa, Mycobacterium
GPRDQLYFLGCRLDAMYPLGPII

SEQ ID NO: 819333 - protein, 24 aa, Mycobacterium
GPREHLHGWFHLADVPADVVAADC

SEQ ID NO: 819334 - protein, 24 aa, Mycobacterium
GPRGDCCWMCLPRWDSPAVFGSLL

SEQ ID NO: 819335 - protein, 23 aa, Mycobacterium
GPRGDCCWMCSPRWDSPAVFSSL

SEQ ID NO: 819336 - protein, 25 aa, Mycobacterium
GPRGLTMLLVPLDTPGIEIQAVHTM

SEQ ID NO: 819337 - protein, 21 aa, Mycobacterium
GPRHFGFVIGGSLPAALGADW

SEQ ID NO: 819338 - protein, 19 aa, Mycobacterium
GPRHGLTGEPLPPALPATA

SEQ ID NO: 819339 - protein, 30 aa, Mycobacterium
GPRHPLKVLGKRVVAIFPVPPLAMHLRTGV

SEQ ID NO: 819340 - protein, 19 aa, Mycobacterium
GPRHTTGWIRIGDDGHTVY

SEQ ID NO: 819341 - protein, 19 aa, Mycobacterium
GPRIALMLSLVPSAEPMSG

SEQ ID NO: 819342 - protein, 25 aa, Mycobacterium
GPRIDWSKIHLFWGDERYVSEEDDE

SEQ ID NO: 819343 - protein, 18 aa, Mycobacterium
GPRILNVPGARRLATLPV

SEQ ID NO: 819344 - protein, 17 aa, Mycobacterium
GPRLKDVAGLSLTKLFV

SEQ ID NO: 819345 - protein, 19 aa, Mycobacterium
GPRLYSRQVAYAANLVAKA

SEQ ID NO: 819346 - protein, 36 aa, Mycobacterium
GPRPRWVPMLDGLDLVLRWYLDDVRGRFPDSPVLLC

SEQ ID NO: 819347 - protein, 24 aa, Mycobacterium
GPRQPSLLIAAIAELKEVAAERSS

SEQ ID NO: 819348 - protein, 26 aa, Mycobacterium
GPRRHGKWLVLPTDGPALLIHSGMTG

SEQ ID NO: 819349 - protein, 26 aa, Mycobacterium
GPRRVLDPAIYREAALRLDRHFAISV

SEQ ID NO: 819350 - protein, 30 aa, Mycobacterium
GPRSDLWGHVLRRQPLPLSLLATHPIDISR

SEQ ID NO: 819351 - protein, 18 aa, Mycobacterium
GPRVGEVLIKYTAAGLCH

SEQ ID NO: 819352 - protein, 28 aa, Mycobacterium
GPRVQLPATPWHHAHHWIHIAKPDTVAH

SEQ ID NO: 819353 - protein, 19 aa, Mycobacterium
GPRVTLSPYRTGVPGTYIC

SEQ ID NO: 819354 - protein, 29 aa, Mycobacterium
GPSAFPTIIDMWLPLSWSLNMVNRSMGHD

SEQ ID NO: 819355 - protein, 26 aa, Mycobacterium
GPSARYRRWLAALRGHARVVIGTRSA

SEQ ID NO: 819356 - protein, 27 aa, Mycobacterium
GPSDKNRFIGIPAAFPKLFRSEVDWDY

SEQ ID NO: 819357 - protein, 30 aa, Mycobacterium
GPSGFDTIIEMWLPLAWSLNMVNRSMGHLD

SEQ ID NO: 819358 - protein, 29 aa, Mycobacterium
GPSGFDTLIDLWLPLSWALNQVNRSMGKE

SEQ ID NO: 819359 - protein, 20 aa, Mycobacterium
GPSGFRWPHAITGTGDLLLV

SEQ ID NO: 819360 - protein, 29 aa, Mycobacterium
GPSGIALSPYRFPTGWFIVAFSSELGAGE

SEQ ID NO: 819361 - protein, 21 aa, Mycobacterium
GPSGRRLLGAGAPWFESWLEH

SEQ ID NO: 819362 - protein, 30 aa, Mycobacterium
GPSISAPGWFLPTIITPTVSPIPPFNQNPV

SEQ ID NO: 819363 - protein, 28 aa, Mycobacterium
GPSLSLVLIDRIPFPRPDDPLLSARQRA

SEQ ID NO: 819364 - protein, 27 aa, Mycobacterium
GPSLSLVLIDRIPFPRPDDPLRAARQR

SEQ ID NO: 819365 - protein, 22 aa, Mycobacterium
GPSMFLGVTLFPPDIRKSFSDL

SEQ ID NO: 819366 - protein, 25 aa, Mycobacterium
GPSMFRRWCRLVGRPELFDDPRFAD

SEQ ID NO: 819367 - protein, 21 aa, Mycobacterium
GPSQWLLRMLATQTERTMLVP

SEQ ID NO: 819368 - protein, 34 aa, Mycobacterium
GPSSFLGFTIPQFNYPAPALWYFPTQANGSVNAT

SEQ ID NO: 819369 - protein, 31 aa, Mycobacterium
GPSSFLGITIPQFNYPAPAHWYFPTQADGSV

SEQ ID NO: 819370 - protein, 22 aa, Mycobacterium
GPSSLWGITFTVADIDVTAAFF

SEQ ID NO: 819371 - protein, 25 aa, Mycobacterium
GPSSQMWPPHPYAPDLEPGIPYNIA

SEQ ID NO: 819372 - protein, 25 aa, Mycobacterium
GPSVQLWPHRHGTDAMFAAALRVDA

SEQ ID NO: 819373 - protein, 17 aa, Mycobacterium
GPSVRIYPLLKELTLDI

SEQ ID NO: 819374 - protein, 23 aa, Mycobacterium
GPSVRIYPLLKNLTLDIATDVFM

SEQ ID NO: 819375 - protein, 25 aa, Mycobacterium
GPTALLAPEWVPWEHRVRPGDLSPG

SEQ ID NO: 819376 - protein, 26 aa, Mycobacterium
GPTFIECVTFRFRGHYFGDRMPYIPE

SEQ ID NO: 819377 - protein, 25 aa, Mycobacterium
GPTFIECVTFRFRGHYFGDRTPYIP

SEQ ID NO: 819378 - protein, 17 aa, Mycobacterium
GPTFTLRVAGMGTLVYL

SEQ ID NO: 819379 - protein, 34 aa, Mycobacterium
GPTGIGVLYGRRALLNALPPFLTGGSMIETVTME

SEQ ID NO: 819380 - protein, 32 aa, Mycobacterium
GPTGIGVLYGRRGLLDAMPPFITGGSMIETVT

SEQ ID NO: 819381 - protein, 22 aa, Mycobacterium
GPTIAVLYYRAQQLAGNTGYVE

SEQ ID NO: 819382 - protein, 21 aa, Mycobacterium
GPTIPLIDRGFEWLRENWPEE

SEQ ID NO: 819383 - protein, 20 aa, Mycobacterium
GPTLHYQVRAHWRTVAQEYE

SEQ ID NO: 819384 - protein, 24 aa, Mycobacterium
GPTLIGEFARTLTMTDLVIGWTEN

SEQ ID NO: 819385 - protein, 24 aa, Mycobacterium
GPTPPQRVLDIAAAARERGADRLS

SEQ ID NO: 819386 - protein, 28 aa, Mycobacterium
GPTPRLNPWRTPIPKVYLCSAATPPGGG

SEQ ID NO: 819387 - protein, 22 aa, Mycobacterium
GPTRIRTVLGILKAYTTRVGSG

SEQ ID NO: 819388 - protein, 23 aa, Mycobacterium
GPTRIRTVLGILKAYTTRVGSGP

SEQ ID NO: 819389 - protein, 24 aa, Mycobacterium
GPTSHTAIIARQLGIPCVVAVAGL

SEQ ID NO: 819390 - protein, 23 aa, Mycobacterium
GPTSHTAIIARQLGIPCVVAVSG

SEQ ID NO: 819391 - protein, 24 aa, Mycobacterium
GPTSPAIAPGEHALAAKAAGASIA

SEQ ID NO: 819392 - protein, 22 aa, Mycobacterium
GPTSRVLRLPGHDADWVPVHVT

SEQ ID NO: 819393 - protein, 32 aa, Mycobacterium
GPTSTNYYMIPSPHLPLLDPVRAIPVIGTPIA

SEQ ID NO: 819394 - protein, 26 aa, Mycobacterium
GPVAALLARHPHLRLIIAHLGMPEYT

SEQ ID NO: 819395 - protein, 26 aa, Mycobacterium
GPVAATPIMRWLRDVAGPVDQFNQAM

SEQ ID NO: 819396 - protein, 20 aa, Mycobacterium
GPVADALVELGLPGLAVNVR

SEQ ID NO: 819397 - protein, 17 aa, Mycobacterium
GPVAESLLALGLPGLSV

SEQ ID NO: 819398 - protein, 18 aa, Mycobacterium
GPVATRFMRDRFGHFDFS

SEQ ID NO: 819399 - protein, 21 aa, Mycobacterium
GPVATTLLLPSVLDAVKGTGI

SEQ ID NO: 819400 - protein, 21 aa, Mycobacterium
GPVATTLLLPSVLDAVRGTGI

SEQ ID NO: 819401 - protein, 17 aa, Mycobacterium
GPVAVMYLDLDRLKPIN

SEQ ID NO: 819402 - protein, 23 aa, Mycobacterium
GPVCSALRQGAVETLIIGDIGDA

SEQ ID NO: 819403 - protein, 26 aa, Mycobacterium
GPVDGLPTIFVYDGYPGGAGFAARGF

SEQ ID NO: 819404 - protein, 29 aa, Mycobacterium
GPVDLRHLSLWWTWTPGASWRHPAGPHSS

SEQ ID NO: 819405 - protein, 33 aa, Mycobacterium
GPVELFDDLVRLFPPLFPMLEAQDPDAALQAGD

SEQ ID NO: 819406 - protein, 20 aa, Mycobacterium
GPVFLQYPWEVIPEELIKPI

SEQ ID NO: 819407 - protein, 26 aa, Mycobacterium
GPVFLSIPLDDWDKPALGPAAVRSVS

SEQ ID NO: 819408 - protein, 22 aa, Mycobacterium
GPVFVNRDGGWMSLANLRRSMR

SEQ ID NO: 819409 - protein, 35 aa, Mycobacterium
GPVGFVLLDGWKELYLPVIRLLEPSLSAGALIVAD

SEQ ID NO: 819410 - protein, 22 aa, Mycobacterium
GPVHFDIPLREPLVPDPEPHGG

SEQ ID NO: 819411 - protein, 20 aa, Mycobacterium
GPVHYYDIPLRGPIFRIDRM

SEQ ID NO: 819412 - protein, 19 aa, Mycobacterium
GPVICAQVLMYPGLDRDMA

SEQ ID NO: 819413 - protein, 19 aa, Mycobacterium
GPVLAIRRAADAEEAFTLA

SEQ ID NO: 819414 - protein, 26 aa, Mycobacterium
GPVLATPIIHWLQGVPGPVDQFNQTI

SEQ ID NO: 819415 - protein, 18 aa, Mycobacterium
GPVLCILGYHDIDHAVEL

SEQ ID NO: 819416 - protein, 18 aa, Mycobacterium
GPVLVRRGGHQAASLLGL

SEQ ID NO: 819417 - protein, 26 aa, Mycobacterium
GPVNTPLLQELFAKDPERAARRLVHV

SEQ ID NO: 819418 - protein, 18 aa, Mycobacterium
GPVNTRIVRRSNALLDWA

SEQ ID NO: 819419 - protein, 17 aa, Mycobacterium
GPVPATMFVVAATEGWM

SEQ ID NO: 819420 - protein, 17 aa, Mycobacterium
GPVPDWFCQSRDLEELG

SEQ ID NO: 819421 - protein, 23 aa, Mycobacterium
GPVPKLIKLIPQAKNLFPEYRLM

SEQ ID NO: 819422 - protein, 23 aa, Mycobacterium
GPVPKLIKLIPQAKNLFPEYRSM

SEQ ID NO: 819423 - protein, 20 aa, Mycobacterium
GPVPWKPMVSLSGPRSLPIE

SEQ ID NO: 819424 - protein, 25 aa, Mycobacterium
GPVQRVEMWGGVPVWLVTRYQEARN

SEQ ID NO: 819425 - protein, 18 aa, Mycobacterium
GPVRDGLKGLQLAFREAS

SEQ ID NO: 819426 - protein, 18 aa, Mycobacterium
GPVRLVDVFDGRAQLIVY

SEQ ID NO: 819427 - protein, 20 aa, Mycobacterium
GPVSRYLGPWVPAEQEIWQD

SEQ ID NO: 819428 - protein, 29 aa, Mycobacterium
GPVSVSFTPVLIPMPRGILATCTAPTTAS

SEQ ID NO: 819429 - protein, 25 aa, Mycobacterium
GPVSVTLPRRILVSRVDVIILHTER

SEQ ID NO: 819430 - protein, 24 aa, Mycobacterium
GPVTAAIIICAYSHRGRIRSEAAF

SEQ ID NO: 819431 - protein, 31 aa, Mycobacterium
GPVTRIVLGPRWLVPPALLVTSPQGAHDVLS

SEQ ID NO: 819432 - protein, 18 aa, Mycobacterium
GPVVAFLASRRNSYMTGA

SEQ ID NO: 819433 - protein, 25 aa, Mycobacterium
GPVVSPTFVLARVHRARQADRPAMV

SEQ ID NO: 819434 - protein, 22 aa, Mycobacterium
GPVWLFLAVPDGKTVKNRLHVD

SEQ ID NO: 819435 - protein, 17 aa, Mycobacterium
GPVWVFSGQGSQWASMG

SEQ ID NO: 819436 - protein, 18 aa, Mycobacterium
GPVWVFSGQGSQWKAMGA

SEQ ID NO: 819437 - protein, 18 aa, Mycobacterium
GPWGAARVFAPQKGPTRP

SEQ ID NO: 819438 - protein, 17 aa, Mycobacterium
GPWGFWVNRWTAEENRH

SEQ ID NO: 819439 - protein, 17 aa, Mycobacterium
GPWMITDGVEPEALAAQ

SEQ ID NO: 819440 - protein, 19 aa, Mycobacterium
GPWPVVGTGWGASVVVGTG

SEQ ID NO: 819441 - protein, 20 aa, Mycobacterium
GPYGFVLGSYLWMIEATSAH

SEQ ID NO: 819442 - protein, 25 aa, Mycobacterium
GPYKGGLRFHPSVSLSIIKFLGFEQ

SEQ ID NO: 819443 - protein, 20 aa, Mycobacterium
GPYLIHFDANGKELERLSPF

SEQ ID NO: 819444 - protein, 18 aa, Mycobacterium
GPYTPGFRSVPFGDADAL

SEQ ID NO: 819445 - protein, 27 aa, Mycobacterium
GQAAELFGWLGPYPDAVVGSSAAIVLA

SEQ ID NO: 819446 - protein, 26 aa, Mycobacterium
GQAARAGLLCLPTLSTHGYEVIARRA

SEQ ID NO: 819447 - protein, 25 aa, Mycobacterium
GQAARLGRWVLTRSFTDYASLGRDD

SEQ ID NO: 819448 - protein, 26 aa, Mycobacterium
GQACILHSRLLLPDSLHDDVVDRLAA

SEQ ID NO: 819449 - protein, 25 aa, Mycobacterium
GQACILHSRLLLPDSLHDDVVDRLV

SEQ ID NO: 819450 - protein, 25 aa, Mycobacterium
GQACILHSRLLLPEAMHDEIVDRLV

SEQ ID NO: 819451 - protein, 26 aa, Mycobacterium
GQAELDGHHFFWTVHARNKKAVTLDL

SEQ ID NO: 819452 - protein, 26 aa, Mycobacterium
GQAELDGHHFFWTVHARNKKAVTLNL

SEQ ID NO: 819453 - protein, 17 aa, Mycobacterium
GQAFWSFGGLFFVDSPE

SEQ ID NO: 819454 - protein, 18 aa, Mycobacterium
GQAFYIHNRVRTIDSAAA

SEQ ID NO: 819455 - protein, 23 aa, Mycobacterium
GQAGGAGGLLYGNGGSGAAGAAG

SEQ ID NO: 819456 - protein, 25 aa, Mycobacterium
GQAGGDGGLLIGNGGAGGSGAAGQA

SEQ ID NO: 819457 - protein, 28 aa, Mycobacterium
GQAGIALSTYRFPTGWFIVAFGSDLAAG

SEQ ID NO: 819458 - protein, 28 aa, Mycobacterium
GQAGIALSTYRFPTGWFIVAFGSDLAPG

SEQ ID NO: 819459 - protein, 28 aa, Mycobacterium
GQAGQRWVLKSPAHLGYLSLLHAHFPDL

SEQ ID NO: 819460 - protein, 28 aa, Mycobacterium
GQAGTAGKGGLFGGSGSAGKAGATGAAG

SEQ ID NO: 819461 - protein, 25 aa, Mycobacterium
GQAGTFIWVDPAVDLGLVVLTDRPF

SEQ ID NO: 819462 - protein, 24 aa, Mycobacterium
GQAIDGFFVMHFAPAGQRSDNTSA

SEQ ID NO: 819463 - protein, 19 aa, Mycobacterium
GQAIVAVVVPRPGAEPDPE

SEQ ID NO: 819464 - protein, 22 aa, Mycobacterium
GQAQRIALARALAAEPRVLLLD

SEQ ID NO: 819465 - protein, 22 aa, Mycobacterium
GQARLIALLGRPLPAQVAQLLL

SEQ ID NO: 819466 - protein, 24 aa, Mycobacterium
GQARLIVDIMRQICTGLGYVHDRG

SEQ ID NO: 819467 - protein, 21 aa, Mycobacterium
GQARVLLMAALATGSDLVAVI

SEQ ID NO: 819468 - protein, 19 aa, Mycobacterium
GQARWYRNRWVRTAHVCAA

SEQ ID NO: 819469 - protein, 22 aa, Mycobacterium
GQATIPIVHAVSRVAPVVYAEI

SEQ ID NO: 819470 - protein, 25 aa, Mycobacterium
GQATIPIVYAVSRVVEVPYAEIVAS

SEQ ID NO: 819471 - protein, 22 aa, Mycobacterium
GQAVGFGGWYSPIALHVVGDTL

SEQ ID NO: 819472 - protein, 29 aa, Mycobacterium
GQAYEDLAWFCIRAWRFGAPASLGAGGLG

SEQ ID NO: 819473 - protein, 23 aa, Mycobacterium
GQCEWIPPQLLDRGQHRTNTYHH

SEQ ID NO: 819474 - protein, 25 aa, Mycobacterium
GQCQQVWCPVCALAALISGEQHPLL

SEQ ID NO: 819475 - protein, 25 aa, Mycobacterium
GQDFIARGWGAWGEAPYTDLMAATD

SEQ ID NO: 819476 - protein, 24 aa, Mycobacterium
GQDFVVDVTVWIDLASAAATDDLT

SEQ ID NO: 819477 - protein, 23 aa, Mycobacterium
GQDGRPVIFLCRSGNRSIGAAQA

SEQ ID NO: 819478 - protein, 23 aa, Mycobacterium
GQDHLLKPNSPLRRLIEGSGAAS

SEQ ID NO: 819479 - protein, 22 aa, Mycobacterium
GQDIGPTLRAAWTGAVLGQANA

SEQ ID NO: 819480 - protein, 23 aa, Mycobacterium
GQDKLALLLEFANDLPALPPELE

SEQ ID NO: 819481 - protein, 26 aa, Mycobacterium
GQDKLFDTLFAYENYPIDAAALSGDH

SEQ ID NO: 819482 - protein, 27 aa, Mycobacterium
GQDPGDPWAWHEVAALPRHAMRRRRRV

SEQ ID NO: 819483 - protein, 28 aa, Mycobacterium
GQDPRYILWAAWHRSGLQNRWLAAIDRG

SEQ ID NO: 819484 - protein, 28 aa, Mycobacterium
GQDPRYTLWAAWHRSGLQSRWLTASERG

SEQ ID NO: 819485 - protein, 24 aa, Mycobacterium
GQDRGPSGPLWLGSIKSNMGHTQA

SEQ ID NO: 819486 - protein, 24 aa, Mycobacterium
GQDRLVERILVGLLAKGHVLLEGV

SEQ ID NO: 819487 - protein, 21 aa, Mycobacterium
GQDVANPSGLLLGAVMMLVHV

SEQ ID NO: 819488 - protein, 23 aa, Mycobacterium
GQDWGGLIGLRLAAEHPERFARI

SEQ ID NO: 819489 - protein, 28 aa, Mycobacterium
GQEGTFLLCTFWLAQALAASGQLDRARE

SEQ ID NO: 819490 - protein, 31 aa, Mycobacterium
GQERGLRPGTLPVALIAGLGLAAELALKEND

SEQ ID NO: 819491 - protein, 22 aa, Mycobacterium
GQERPFPLDLVPRVISAAEWSR

SEQ ID NO: 819492 - protein, 22 aa, Mycobacterium
GQERPFPLDLVPRVISAAEWTR

SEQ ID NO: 819493 - protein, 25 aa, Mycobacterium
GQEVLTALIDQLLVDPKLTAQITRA

SEQ ID NO: 819494 - protein, 30 aa, Mycobacterium
GQEVRAAIGGLLPYLDRLKLTDAPLERNPT

SEQ ID NO: 819495 - protein, 19 aa, Mycobacterium
GQEWPLQDTVRPWDSLNDD

SEQ ID NO: 819496 - protein, 19 aa, Mycobacterium
GQEYICQFLISGVGALHIP

SEQ ID NO: 819497 - protein, 23 aa, Mycobacterium
GQFAGPRGWFRDINHHDGVIAFL

SEQ ID NO: 819498 - protein, 33 aa, Mycobacterium
GQFAPALIQPALALAIANLGWAAGFAGLAGIQP

SEQ ID NO: 819499 - protein, 23 aa, Mycobacterium
GQFDYNLQWKPVGGFPITFGWLH

SEQ ID NO: 819500 - protein, 19 aa, Mycobacterium
GQFEGANLLLLHTTGAKSG

SEQ ID NO: 819501 - protein, 18 aa, Mycobacterium
GQFPPGVVIPLHPGARVF

SEQ ID NO: 819502 - protein, 19 aa, Mycobacterium
GQFSDEFLRWLAGVRFTGE

SEQ ID NO: 819503 - protein, 20 aa, Mycobacterium
GQFVALFGSADRYLARIAAL

SEQ ID NO: 819504 - protein, 36 aa, Mycobacterium
GQFYRHTLMTPTFNPGPIPFGPPPIYVGALGPRLTR

SEQ ID NO: 819505 - protein, 24 aa, Mycobacterium
GQGAVELDAWWESLRGIQATFPLS

SEQ ID NO: 819506 - protein, 24 aa, Mycobacterium
GQGDGPDLIYIDLHLVHEVTSPQA

SEQ ID NO: 819507 - protein, 23 aa, Mycobacterium
GQGDWIVPLVRHVDPVALREHHV

SEQ ID NO: 819508 - protein, 26 aa, Mycobacterium
GQGEGALAFVLQPLSAALAAGRRPRA

SEQ ID NO: 819509 - protein, 27 aa, Mycobacterium
GQGGAGGRAGLLAGLGGAGGDGGLGGN

SEQ ID NO: 819510 - protein, 20 aa, Mycobacterium
GQGGIFLGNGANGGAAGNVP

SEQ ID NO: 819511 - protein, 24 aa, Mycobacterium
GQGGNARLFGTGGVGGHGGTGAGS

SEQ ID NO: 819512 - protein, 23 aa, Mycobacterium
GQGGWPMTCFLTPDGRPFFCGTY

SEQ ID NO: 819513 - protein, 24 aa, Mycobacterium
GQGGWPMTCFLTPDGRPFFCGTYY

SEQ ID NO: 819514 - protein, 24 aa, Mycobacterium
GQGGWPMTCFLTPDGRPFYTGTYY

SEQ ID NO: 819515 - protein, 19 aa, Mycobacterium
GQGGYGGWLAGSGGAGGTA

SEQ ID NO: 819516 - protein, 24 aa, Mycobacterium
GQGKTRLLRALVGLLDEWTPVIAG

SEQ ID NO: 819517 - protein, 25 aa, Mycobacterium
GQGKTRLLRALVGLLDEWTPVIAGA

SEQ ID NO: 819518 - protein, 22 aa, Mycobacterium
GQGKVLVTPFGMALAAATVANG

SEQ ID NO: 819519 - protein, 25 aa, Mycobacterium
GQGLDIAVLVHPVPRSVLGELAATV

SEQ ID NO: 819520 - protein, 17 aa, Mycobacterium
GQGLMKNAYVGRTFIQP

SEQ ID NO: 819521 - protein, 25 aa, Mycobacterium
GQGMQSVMSTLMQIPSMVANAGGQM

SEQ ID NO: 819522 - protein, 26 aa, Mycobacterium
GQGMTFTQDWFRFERLMVAARCVGAA

SEQ ID NO: 819523 - protein, 25 aa, Mycobacterium
GQGRRDICIYAREPHVLVSKAPAEL

SEQ ID NO: 819524 - protein, 25 aa, Mycobacterium
GQGRSFLHRFVVTEELLAAGVPVAA

SEQ ID NO: 819525 - protein, 28 aa, Mycobacterium
GQGTFVKFHWKPRLGVHSLVWEECQKVA

SEQ ID NO: 819526 - protein, 21 aa, Mycobacterium
GQGVGFGGWYAPVALHVDSAS

SEQ ID NO: 819527 - protein, 17 aa, Mycobacterium
GQGWAYVNSNYFLLGMI

SEQ ID NO: 819528 - protein, 17 aa, Mycobacterium
GQGYFDTLTPPVLRRHI

SEQ ID NO: 819529 - protein, 17 aa, Mycobacterium
GQHAPAIAATEAHYERM

SEQ ID NO: 819530 - protein, 21 aa, Mycobacterium
GQHGFLDRLMADPAVAGLSEG

SEQ ID NO: 819531 - protein, 24 aa, Mycobacterium
GQHHLHERVMAQAPRRVHPLDQHL

SEQ ID NO: 819532 - protein, 26 aa, Mycobacterium
GQHNWALLHALPELVATGFPVLLGAS

SEQ ID NO: 819533 - protein, 25 aa, Mycobacterium
GQHQMWAAQFISYEKPRTWLNSGGL

SEQ ID NO: 819534 - protein, 20 aa, Mycobacterium
GQHRCFPVLAGPPGARDTLL

SEQ ID NO: 819535 - protein, 19 aa, Mycobacterium
GQIAAQLFISARTAGHHLE

SEQ ID NO: 819536 - protein, 18 aa, Mycobacterium
GQIAAWRDYFDMSTVAAA

SEQ ID NO: 819537 - protein, 24 aa, Mycobacterium
GQIDLRAFQTIVFRTDLIVDPQVM

SEQ ID NO: 819538 - protein, 21 aa, Mycobacterium
GQIDPALKLRPSRGTHLVFDA

SEQ ID NO: 819539 - protein, 20 aa, Mycobacterium
GQIFAINMFLEQAGGHYVMH

SEQ ID NO: 819540 - protein, 17 aa, Mycobacterium
GQIFLAAGGFIGRFKRQ

SEQ ID NO: 819541 - protein, 23 aa, Mycobacterium
GQIHDWVLLTLDGPRYLAQINQE

SEQ ID NO: 819542 - protein, 19 aa, Mycobacterium
GQILLPGFVDLHTHLREPG

SEQ ID NO: 819543 - protein, 26 aa, Mycobacterium
GQIPAIETPIATQLPLIKAEATTTAS

SEQ ID NO: 819544 - protein, 24 aa, Mycobacterium
GQIPHSHFTFLEALRLQGTESQRA

SEQ ID NO: 819545 - protein, 30 aa, Mycobacterium
GQITDSMPVLPASEWPWAPSDIDPLTFTWA

SEQ ID NO: 819546 - protein, 23 aa, Mycobacterium
GQITLQTIWSAPDSALAAPLVLD

SEQ ID NO: 819547 - protein, 23 aa, Mycobacterium
GQIVACVRRRHLATRADEHSKGG

SEQ ID NO: 819548 - protein, 26 aa, Mycobacterium
GQKDTVLPFAWQGLSLHAAGASRVRV

SEQ ID NO: 819549 - protein, 26 aa, Mycobacterium
GQKEKLAYTILAASLAYQFGLEWGAE

SEQ ID NO: 819550 - protein, 26 aa, Mycobacterium
GQKEKLAYTILAASLAYQFGLEWGAQ

SEQ ID NO: 819551 - protein, 23 aa, Mycobacterium
GQKGVDASLLLPPVRGAVPADDP

SEQ ID NO: 819552 - protein, 25 aa, Mycobacterium
GQKIFTTFAHLADYCFLLTRSQRGS

SEQ ID NO: 819553 - protein, 25 aa, Mycobacterium
GQKIWSSRAVFGERAFGLFRSDPAA

SEQ ID NO: 819554 - protein, 25 aa, Mycobacterium
GQKIWSSRAVFGERGFGLFRSDPEA

SEQ ID NO: 819555 - protein, 26 aa, Mycobacterium
GQKKVDFYLRLRAIGIFPDDAPHTIR

SEQ ID NO: 819556 - protein, 19 aa, Mycobacterium
GQKLLTFQLYDQQANVPLG

SEQ ID NO: 819557 - protein, 22 aa, Mycobacterium
GQKTFISNGLLSKLVLTAVKTD

SEQ ID NO: 819558 - protein, 28 aa, Mycobacterium
GQKVWTSLAHRAKWGLLLARTDPNMPKH

SEQ ID NO: 819559 - protein, 17 aa, Mycobacterium
GQKWFVTVGDVADFLIV

SEQ ID NO: 819560 - protein, 22 aa, Mycobacterium
GQLAAARWYGKVFKSINDVEPI

SEQ ID NO: 819561 - protein, 23 aa, Mycobacterium
GQLAAVRELWLSRDELARARDVA

SEQ ID NO: 819562 - protein, 24 aa, Mycobacterium
GQLADWICFMLSDSADFLCGSVVF

SEQ ID NO: 819563 - protein, 22 aa, Mycobacterium
GQLAIKAALALGSPYTAMLFMG

SEQ ID NO: 819564 - protein, 25 aa, Mycobacterium
GQLDKAGLPYLGHVRRVAAYVDPAN

SEQ ID NO: 819565 - protein, 30 aa, Mycobacterium
GQLDQVLFPLLHGTLWYVGIAPLAPMCLYG

SEQ ID NO: 819566 - protein, 25 aa, Mycobacterium
GQLEIKTILHRLLRRYRLELPRPDY

SEQ ID NO: 819567 - protein, 24 aa, Mycobacterium
GQLEIMVVLNEIGRRLAPEPVLHG

SEQ ID NO: 819568 - protein, 25 aa, Mycobacterium
GQLEVRGPVRLEVVQFLAGEGMSTR

SEQ ID NO: 819569 - protein, 23 aa, Mycobacterium
GQLFLEEYYTQCVIAHGAIGTNH

SEQ ID NO: 819570 - protein, 23 aa, Mycobacterium
GQLGFNYTLNIPTLPVDLDIYAN

SEQ ID NO: 819571 - protein, 20 aa, Mycobacterium
GQLGLQYLPPGAAMTTADLF

SEQ ID NO: 819572 - protein, 31 aa, Mycobacterium
GQLKPLGHAGQRLLPVGELLGDAAAAVGQLA

SEQ ID NO: 819573 - protein, 22 aa, Mycobacterium
GQLKVLPSFGVIPASPMLFDML

SEQ ID NO: 819574 - protein, 25 aa, Mycobacterium
GQLLRRVRSRLARLAGAGLTIPAAG

SEQ ID NO: 819575 - protein, 18 aa, Mycobacterium
GQLLRRVRSRLARLAGVG

SEQ ID NO: 819576 - protein, 19 aa, Mycobacterium
GQLLRRVRTRLARLAGAGL

SEQ ID NO: 819577 - protein, 30 aa, Mycobacterium
GQLLVYGVDPLILRQAYPVPQDPYGLAGSN

SEQ ID NO: 819578 - protein, 19 aa, Mycobacterium
GQLPKMRAIVGFAAETGDA

SEQ ID NO: 819579 - protein, 25 aa, Mycobacterium
GQLQYWVDRFTPAPAIVGFPVTAQS

SEQ ID NO: 819580 - protein, 26 aa, Mycobacterium
GQLRVLHTFGLSIAALEERMRMALSC

SEQ ID NO: 819581 - protein, 27 aa, Mycobacterium
GQLSHLELVYLAQALFAAGIDSTWVMI

SEQ ID NO: 819582 - protein, 30 aa, Mycobacterium
GQLSPELVKGMAWGLAPYTAAIGGGDPAIF

SEQ ID NO: 819583 - protein, 23 aa, Mycobacterium
GQLSVPVHIPLFAEPLTAAELAR

SEQ ID NO: 819584 - protein, 18 aa, Mycobacterium
GQLTDMLRRHDINLLVDV

SEQ ID NO: 819585 - protein, 20 aa, Mycobacterium
GQLVIIGMQGGVKGELNIGK

SEQ ID NO: 819586 - protein, 22 aa, Mycobacterium
GQLVLIVHHLAVDGVSWRVLLE

SEQ ID NO: 819587 - protein, 20 aa, Mycobacterium
GQLVSLALSNLFGQNTPAIA

SEQ ID NO: 819588 - protein, 21 aa, Mycobacterium
GQLVVIIHHLAVDGVSWRILL

SEQ ID NO: 819589 - protein, 31 aa, Mycobacterium
GQMHLSLALNRLPKVAALFLAGGISARLMSV

SEQ ID NO: 819590 - protein, 27 aa, Mycobacterium
GQMIGFAVCRYILRLSPVIEMTHQDIV

SEQ ID NO: 819591 - protein, 25 aa, Mycobacterium
GQMRSLPDYYFYYGGLADKLQGDVI

SEQ ID NO: 819592 - protein, 19 aa, Mycobacterium
GQNADYFVRLMAGLGDALG

SEQ ID NO: 819593 - protein, 25 aa, Mycobacterium
GQNALGLFDAVRRSKLTFISSRVEN

SEQ ID NO: 819594 - protein, 25 aa, Mycobacterium
GQNARLAARLTGWRIDIRGDSPAHP

SEQ ID NO: 819595 - protein, 25 aa, Mycobacterium
GQNARLAARLTGWRIDIRGDSPEQS

SEQ ID NO: 819596 - protein, 24 aa, Mycobacterium
GQNARLAARLTGWRIDIRGDSPGG

SEQ ID NO: 819597 - protein, 25 aa, Mycobacterium
GQNARLAARLTGWRIDIRGDTPGGS

SEQ ID NO: 819598 - protein, 25 aa, Mycobacterium
GQNARLAARLTGWRIDIRSDAAPVG

SEQ ID NO: 819599 - protein, 24 aa, Mycobacterium
GQNARLAARLTGWRIDIRSDADPE

SEQ ID NO: 819600 - protein, 25 aa, Mycobacterium
GQNARLAARLTGWRIDIRSDDADKN

SEQ ID NO: 819601 - protein, 24 aa, Mycobacterium
GQNGAAGGLLWGNGGAGGAGTATH

SEQ ID NO: 819602 - protein, 26 aa, Mycobacterium
GQNGGDGGWLIGNGGNGGSGAPGGNG

SEQ ID NO: 819603 - protein, 36 aa, Mycobacterium
GQNHSWMTWQAGISVLVWHPALNVYSGYAHLSSTVI

SEQ ID NO: 819604 - protein, 24 aa, Mycobacterium
GQNRVVAKLFQAGVLGLVEQIHRR

SEQ ID NO: 819605 - protein, 26 aa, Mycobacterium
GQNTKILNNLLFSANLGSAVSTLELG

SEQ ID NO: 819606 - protein, 29 aa, Mycobacterium
GQPALRDLGWFRFLTGRLDGPDGAPLLVS

SEQ ID NO: 819607 - protein, 18 aa, Mycobacterium
GQPARLPFWRGDDAGRPA

SEQ ID NO: 819608 - protein, 28 aa, Mycobacterium
GQPDDLVGMLLFLLSDQAKWVTGQIFNV

SEQ ID NO: 819609 - protein, 28 aa, Mycobacterium
GQPEDLVGMCLFLLSDQARWITGQIFNV

SEQ ID NO: 819610 - protein, 22 aa, Mycobacterium
GQPFGLYVHVPFCVTRCGYCDF

SEQ ID NO: 819611 - protein, 18 aa, Mycobacterium
GQPFRSPTALPVTFSPAA

SEQ ID NO: 819612 - protein, 38 aa, Mycobacterium
GQPGAFLSFPVTQWTRWRQPVIGMPTTPRFLGSGELLV

SEQ ID NO: 819613 - protein, 24 aa, Mycobacterium
GQPGDALWFDCNLMHGSGSNISPY

SEQ ID NO: 819614 - protein, 23 aa, Mycobacterium
GQPGKYLAIFGDSFSGNKVGEGE

SEQ ID NO: 819615 - protein, 24 aa, Mycobacterium
GQPGQWYLHLFDTEQPDLNWEHPD

SEQ ID NO: 819616 - protein, 19 aa, Mycobacterium
GQPIPALLTTNACALALLL

SEQ ID NO: 819617 - protein, 22 aa, Mycobacterium
GQPLRVRAAMKPISTVPKALAT

SEQ ID NO: 819618 - protein, 18 aa, Mycobacterium
GQPLVWLEAMKMEHTVAA

SEQ ID NO: 819619 - protein, 34 aa, Mycobacterium
GQPPPNPLHPLALPLLRPKQVIMLGRPTLHRPVS

SEQ ID NO: 819620 - protein, 39 aa, Mycobacterium
GQPQFSLAGLAYLLGPVAWLLGLRIVPMLAPGSADANGF

SEQ ID NO: 819621 - protein, 23 aa, Mycobacterium
GQPRKVPRRLLKAARLGLVDLDR

SEQ ID NO: 819622 - protein, 18 aa, Mycobacterium
GQPRNTDWLTAHPGLAVL

SEQ ID NO: 819623 - protein, 32 aa, Mycobacterium
GQPSWVHLYLHGHLGWPAAVSYRIVALTRPDA

SEQ ID NO: 819624 - protein, 20 aa, Mycobacterium
GQPVAVSGLVALPWSQDGRS

SEQ ID NO: 819625 - protein, 21 aa, Mycobacterium
GQPVPLRRMLPALESMDLEVI

SEQ ID NO: 819626 - protein, 33 aa, Mycobacterium
GQPVVPYLHFEGLRTLALPLRIHLESAGFGIDR

SEQ ID NO: 819627 - protein, 23 aa, Mycobacterium
GQQHVGVFVGLRLEEGVLGDHQF

SEQ ID NO: 819628 - protein, 17 aa, Mycobacterium
GQQLWAQSGLKPSDIQT

SEQ ID NO: 819629 - protein, 19 aa, Mycobacterium
GQQLWRYKHAVPFDVSLCC

SEQ ID NO: 819630 - protein, 18 aa, Mycobacterium
GQQWLKTTGLNTLRPDFD

SEQ ID NO: 819631 - protein, 28 aa, Mycobacterium
GQRAKNMFALGLLSWMYGRELEASEAFI

SEQ ID NO: 819632 - protein, 28 aa, Mycobacterium
GQRAKNMFALGLLSWMYGRELEHSEAFI

SEQ ID NO: 819633 - protein, 29 aa, Mycobacterium
GQRAKNMFALGLLSWMYGRPIRTSENFIR

SEQ ID NO: 819634 - protein, 18 aa, Mycobacterium
GQRFAFVMDTRLCDAVYA

SEQ ID NO: 819635 - protein, 22 aa, Mycobacterium
GQRFIVDITMWIDLVDAARSDD

SEQ ID NO: 819636 - protein, 24 aa, Mycobacterium
GQRIRAAGMVRRLARRIDYECELN

SEQ ID NO: 819637 - protein, 20 aa, Mycobacterium
GQRIVLYTKDRGCSAPGCDV

SEQ ID NO: 819638 - protein, 20 aa, Mycobacterium
GQRLAAFVVLAPDAHLDRGA

SEQ ID NO: 819639 - protein, 28 aa, Mycobacterium
GQRLANFWHGDFPWRPEPGYGRTSPVGS

SEQ ID NO: 819640 - protein, 17 aa, Mycobacterium
GQRLLRTLPADGGRFEL

SEQ ID NO: 819641 - protein, 19 aa, Mycobacterium
GQRLVVFGDAFHTPAQLSH

SEQ ID NO: 819642 - protein, 19 aa, Mycobacterium
GQRNLFMHGAVPEVARAWT

SEQ ID NO: 819643 - protein, 22 aa, Mycobacterium
GQRPACEVVLDALRRMEYRGYD

SEQ ID NO: 819644 - protein, 28 aa, Mycobacterium
GQRPGMGRLFYDAFPSFRAEVERCADLF

SEQ ID NO: 819645 - protein, 26 aa, Mycobacterium
GQRPGMGRLFYQTVPAFRAEVNRCAE

SEQ ID NO: 819646 - protein, 25 aa, Mycobacterium
GQRPQLLIPPGHWQRAWPLGDEPTL

SEQ ID NO: 819647 - protein, 25 aa, Mycobacterium
GQRRPTLELLLLLAEAHQVPLDELV

SEQ ID NO: 819648 - protein, 17 aa, Mycobacterium
GQRRQLPRLVSSIGQRV

SEQ ID NO: 819649 - protein, 25 aa, Mycobacterium
GQRRRPILGKRWPYAAISGDTVTRC

SEQ ID NO: 819650 - protein, 22 aa, Mycobacterium
GQRRRTQCDGGQPARPGALQQP

SEQ ID NO: 819651 - protein, 26 aa, Mycobacterium
GQRRRVELARILFAASDSGAGSGTTL

SEQ ID NO: 819652 - protein, 25 aa, Mycobacterium
GQRRRVELARILFAASDTGAGSSTT

SEQ ID NO: 819653 - protein, 25 aa, Mycobacterium
GQRRRVELARILFAASDTGAGSSTV

SEQ ID NO: 819654 - protein, 22 aa, Mycobacterium
GQRRRVELARILFAASEGGGGD

SEQ ID NO: 819655 - protein, 19 aa, Mycobacterium
GQRRRVGLAAALVRDLDLL

SEQ ID NO: 819656 - protein, 28 aa, Mycobacterium
GQRRYNPGWNLAIDLRNMLLVSECVAKA

SEQ ID NO: 819657 - protein, 22 aa, Mycobacterium
GQRSFSLDDLSLRYLRRELRAE

SEQ ID NO: 819658 - protein, 22 aa, Mycobacterium
GQRSGFFMVPERNFAMTLLTNS

SEQ ID NO: 819659 - protein, 21 aa, Mycobacterium
GQRTSAINRLLWRVHELDPSR

SEQ ID NO: 819660 - protein, 31 aa, Mycobacterium
GQRVALMFQEPALFPWLTSAANVELALRARS

SEQ ID NO: 819661 - protein, 23 aa, Mycobacterium
GQRVLVDRVWPRGIRKDDPRVGI

SEQ ID NO: 819662 - protein, 20 aa, Mycobacterium
GQRVVLFYRSANFDEEVFDD

SEQ ID NO: 819663 - protein, 17 aa, Mycobacterium
GQRVVLNPWLSCGPRGI

SEQ ID NO: 819664 - protein, 19 aa, Mycobacterium
GQRWQQLAGLLPGITFAAP

SEQ ID NO: 819665 - protein, 22 aa, Mycobacterium
GQSGPTVIWVPGWMVSNVDTID

SEQ ID NO: 819666 - protein, 24 aa, Mycobacterium
GQSKHLVYQYLPSRYGMNPDDLRK

SEQ ID NO: 819667 - protein, 18 aa, Mycobacterium
GQSLMALMNLRLARPGVI

SEQ ID NO: 819668 - protein, 39 aa, Mycobacterium
GQSRLIVTHRPVGPCLLITPWNFPLAMGTRKIGPALAAG

SEQ ID NO: 819669 - protein, 19 aa, Mycobacterium
GQSVPLFVGSGANGHIVLV

SEQ ID NO: 819670 - protein, 25 aa, Mycobacterium
GQTDNLAHMVFLDPAGRDFYVDWDE

SEQ ID NO: 819671 - protein, 23 aa, Mycobacterium
GQTELDYWRDALAGLPDEISVAT

SEQ ID NO: 819672 - protein, 24 aa, Mycobacterium
GQTFAPECWLTWSGVAAAGSTFRL

SEQ ID NO: 819673 - protein, 23 aa, Mycobacterium
GQTFDWAPAMTLSPGLAAAHQAI

SEQ ID NO: 819674 - protein, 22 aa, Mycobacterium
GQTFVLPETFVPKNAARIYDLQ

SEQ ID NO: 819675 - protein, 24 aa, Mycobacterium
GQTHKLPMPFIVLATDNPIEYEGT

SEQ ID NO: 819676 - protein, 29 aa, Mycobacterium
GQTHPVFDFLFTYYSLKPRRLRVWHPGYG

SEQ ID NO: 819677 - protein, 20 aa, Mycobacterium
GQTHRLVVDALPVGSVLAVG

SEQ ID NO: 819678 - protein, 24 aa, Mycobacterium
GQTLIDLNVRWRKGQTLDPDWKIE

SEQ ID NO: 819679 - protein, 23 aa, Mycobacterium
GQTLLRTVLAPMFASRAMTVHSW

SEQ ID NO: 819680 - protein, 37 aa, Mycobacterium
GQTLMVDGGLDLKWSHLGADNTSLFLRDESFRAAIRR

SEQ ID NO: 819681 - protein, 27 aa, Mycobacterium
GQTLTTLMPLHYQNHNWWLRARTPSDI

SEQ ID NO: 819682 - protein, 21 aa, Mycobacterium
GQTPLARWCASGPVGLPAPEA

SEQ ID NO: 819683 - protein, 25 aa, Mycobacterium
GQTQFAAPVWLPRAQRPTIRQVQEA

SEQ ID NO: 819684 - protein, 23 aa, Mycobacterium
GQTSPYPFFEYMRRTDPVWHGAL

SEQ ID NO: 819685 - protein, 28 aa, Mycobacterium
GQTTKLLNNLLFTAHLGTAATALSLAGA

SEQ ID NO: 819686 - protein, 19 aa, Mycobacterium
GQTVIAYEPVWAIGTGRVA

SEQ ID NO: 819687 - protein, 20 aa, Mycobacterium
GQTVILYDKPTLDAAAVLET

SEQ ID NO: 819688 - protein, 20 aa, Mycobacterium
GQTVPAIARALFLAPSTVKT

SEQ ID NO: 819689 - protein, 24 aa, Mycobacterium
GQVFDWAPALTLSAGLAAAHQAIL

SEQ ID NO: 819690 - protein, 21 aa, Mycobacterium
GQVFKDYVAWPAITSLSPGAT

SEQ ID NO: 819691 - protein, 25 aa, Mycobacterium
GQVIDFTLTLWDGDRSRLHLDVDML

SEQ ID NO: 819692 - protein, 18 aa, Mycobacterium
GQVLLPGFVDLHTHLREP

SEQ ID NO: 819693 - protein, 20 aa, Mycobacterium
GQVLLPGLVDLHTHLREPGR

SEQ ID NO: 819694 - protein, 24 aa, Mycobacterium
GQVRVALRAIATNFRDVMITLGMF

SEQ ID NO: 819695 - protein, 22 aa, Mycobacterium
GQVTEAFWNAIRHAKPIAVGLN

SEQ ID NO: 819696 - protein, 23 aa, Mycobacterium
GQVTEAFWNAIRHAKPIAVGLNC

SEQ ID NO: 819697 - protein, 22 aa, Mycobacterium
GQVTEAFWNAIRHAKPLAVGLN

SEQ ID NO: 819698 - protein, 23 aa, Mycobacterium
GQVWSNFGVTQQPAWAFISANGE

SEQ ID NO: 819699 - protein, 30 aa, Mycobacterium
GQWDPFHHMVVIYALFPNVVLSVTIANGEL

SEQ ID NO: 819700 - protein, 19 aa, Mycobacterium
GQWLLSHNGIVDRAVLPAA

SEQ ID NO: 819701 - protein, 20 aa, Mycobacterium
GQWLLSHNGLVDRGVLPLTG

SEQ ID NO: 819702 - protein, 19 aa, Mycobacterium
GQWRLSPKAMRRLGETALR

SEQ ID NO: 819703 - protein, 20 aa, Mycobacterium
GQWRLSPKAMRRLGETALRD

SEQ ID NO: 819704 - protein, 17 aa, Mycobacterium
GQWRSGTAHLLPDDDPL

SEQ ID NO: 819705 - protein, 20 aa, Mycobacterium
GQWWQQQVVLGLQRSGFPPQ

SEQ ID NO: 819706 - protein, 21 aa, Mycobacterium
GQYAFARLLGEPTLPHPTVRS

SEQ ID NO: 819707 - protein, 23 aa, Mycobacterium
GQYEAPLGITLRELLDYAGGIRA

SEQ ID NO: 819708 - protein, 21 aa, Mycobacterium
GQYEAPLGITLRELLDYAGGV

SEQ ID NO: 819709 - protein, 22 aa, Mycobacterium
GQYEAPLGITLRELLDYAGGVR

SEQ ID NO: 819710 - protein, 27 aa, Mycobacterium
GQYIGIGLLMDGRWRWRSYSLTSTPAA

SEQ ID NO: 819711 - protein, 20 aa, Mycobacterium
GQYIGIGLLVDGRWRWRSYS

SEQ ID NO: 819712 - protein, 24 aa, Mycobacterium
GQYSALNVFKLFGPGNKAPLSFPM

SEQ ID NO: 819713 - protein, 18 aa, Mycobacterium
GQYVAALESLPLGPNVAA

SEQ ID NO: 819714 - protein, 30 aa, Mycobacterium
GQYYANPRNAFWPITGELFGFDAAAPYETR

SEQ ID NO: 819715 - protein, 22 aa, Mycobacterium
GQYYNFLRLGRAGYAQVMRCLS

SEQ ID NO: 819716 - protein, 29 aa, Mycobacterium
GRAAAFDMALLDLFWTSVGGFGHALMVAR

SEQ ID NO: 819717 - protein, 25 aa, Mycobacterium
GRAARPRYRADGRMWATALRTLERI

SEQ ID NO: 819718 - protein, 38 aa, Mycobacterium
GRAAVLAPRLSVPDEFGLCRYLAAGLAVLRTVDPKLRI

SEQ ID NO: 819719 - protein, 24 aa, Mycobacterium
GRADLPYLITGLGVYPNLGVTDAF

SEQ ID NO: 819720 - protein, 24 aa, Mycobacterium
GRADLVMRMWERLESAWGPARDVR

SEQ ID NO: 819721 - protein, 18 aa, Mycobacterium
GRAFSFISAIDSIGAVPP

SEQ ID NO: 819722 - protein, 22 aa, Mycobacterium
GRAFSGWRPGDLMRSAWEQQPP

SEQ ID NO: 819723 - protein, 35 aa, Mycobacterium
GRAGLDLMLFHAWYLYRNLDLNVVLPVLPLHGPRA

SEQ ID NO: 819724 - protein, 27 aa, Mycobacterium
GRAGTGGFGGNGGLGSAFGPGGTGGNG

SEQ ID NO: 819725 - protein, 24 aa, Mycobacterium
GRAHPGALTLHNYPRHLQILERPD

SEQ ID NO: 819726 - protein, 20 aa, Mycobacterium
GRAIRLIMLTVGGGIPGELD

SEQ ID NO: 819727 - protein, 18 aa, Mycobacterium
GRAIVRQPKAFLMDEPLS

SEQ ID NO: 819728 - protein, 17 aa, Mycobacterium
GRALADIGGEGLCLSLS

SEQ ID NO: 819729 - protein, 19 aa, Mycobacterium
GRALFPSSVPARSAGLRAI

SEQ ID NO: 819730 - protein, 26 aa, Mycobacterium
GRALRGWQRRALVKYLAGQPRDFLAV

SEQ ID NO: 819731 - protein, 21 aa, Mycobacterium
GRALVAMLEGMVAGVPITSEE

SEQ ID NO: 819732 - protein, 20 aa, Mycobacterium
GRALVVLNPANPPVVMRNTV

SEQ ID NO: 819733 - protein, 42 aa, Mycobacterium
GRAMLPIPAQHWTLETLGPALLKFAPGLAAAYLPGYLSGVEW

SEQ ID NO: 819734 - protein, 24 aa, Mycobacterium
GRAPDGFADYLRELARTPVPAELG

SEQ ID NO: 819735 - protein, 32 aa, Mycobacterium
GRAPYVAIGTARWDFRRYLLGTADLHLGYAVC

SEQ ID NO: 819736 - protein, 21 aa, Mycobacterium
GRARAFALGQLRSLAERNGYP

SEQ ID NO: 819737 - protein, 24 aa, Mycobacterium
GRARAMLYGAYRTGAPFGGRAADL

SEQ ID NO: 819738 - protein, 33 aa, Mycobacterium
GRAREMTTLLRRILEVPLPVIAAIDGHVRAGGL

SEQ ID NO: 819739 - protein, 22 aa, Mycobacterium
GRARHRWYLRLLFARPTSRKVR

SEQ ID NO: 819740 - protein, 23 aa, Mycobacterium
GRARLLDLVPGRSAAALSSWLSE

SEQ ID NO: 819741 - protein, 20 aa, Mycobacterium
GRARLRVLLADHQAALPAGR

SEQ ID NO: 819742 - protein, 25 aa, Mycobacterium
GRASYGGIGARRPAAAVASVASGST

SEQ ID NO: 819743 - protein, 23 aa, Mycobacterium
GRATAWRLTGLGLRVIAHDPYCA

SEQ ID NO: 819744 - protein, 22 aa, Mycobacterium
GRATELMAVARLLVSADSLGAA

SEQ ID NO: 819745 - protein, 24 aa, Mycobacterium
GRATLALPGGLRWVAVHQADGYDP

SEQ ID NO: 819746 - protein, 18 aa, Mycobacterium
GRATLPLVDGRRGPLTES

SEQ ID NO: 819747 - protein, 25 aa, Mycobacterium
GRATLYRRFPTKAALVDAVVLAEAR

SEQ ID NO: 819748 - protein, 23 aa, Mycobacterium
GRATNPMWYLNLKANPKVTFQTR

SEQ ID NO: 819749 - protein, 23 aa, Mycobacterium
GRATQWRLSGLGLRVIAHDPYNP

SEQ ID NO: 819750 - protein, 29 aa, Mycobacterium
GRAVAPVPFLSSAVLATVALLRAGDAETV

SEQ ID NO: 819751 - protein, 26 aa, Mycobacterium
GRAVAPVPFLSSAVLATVALSLSGET

SEQ ID NO: 819752 - protein, 18 aa, Mycobacterium
GRAVFTPGLAGLVLGEYR

SEQ ID NO: 819753 - protein, 25 aa, Mycobacterium
GRAVLPDDLPYVTGPIGLLGSTASQ

SEQ ID NO: 819754 - protein, 21 aa, Mycobacterium
GRAVPAELLEAIPSALRAAGD

SEQ ID NO: 819755 - protein, 23 aa, Mycobacterium
GRAVVSHFSWSLSPTVLGDDFDE

SEQ ID NO: 819756 - protein, 25 aa, Mycobacterium
GRAYDPRFMFSWVNAKLAVMGAQQL

SEQ ID NO: 819757 - protein, 31 aa, Mycobacterium
GRAYQALAAHVSAFHDQFVQNLAASAGSYAS

SEQ ID NO: 819758 - protein, 26 aa, Mycobacterium
GRCAGYPCHVLGFALPQFGSAAFAAG

SEQ ID NO: 819759 - protein, 26 aa, Mycobacterium
GRCFAEFDWAAHPLGPPADWSPEIRT

SEQ ID NO: 819760 - protein, 18 aa, Mycobacterium
GRCFPSYALRRGAKALGA

SEQ ID NO: 819761 - protein, 27 aa, Mycobacterium
GRCISGGLLLCWPCDLILASDDALFSD

SEQ ID NO: 819762 - protein, 18 aa, Mycobacterium
GRCPTCQAGLRNLCDLGA

SEQ ID NO: 819763 - protein, 17 aa, Mycobacterium
GRCQMSFVFAAPEALVA

SEQ ID NO: 819764 - protein, 26 aa, Mycobacterium
GRCRHTIRAILGARRGGAAAEPTPHR

SEQ ID NO: 819765 - protein, 22 aa, Mycobacterium
GRCRRTVQAILRSSSPERTPNP

SEQ ID NO: 819766 - protein, 18 aa, Mycobacterium
GRDAGRRRPPILTEAEFL

SEQ ID NO: 819767 - protein, 18 aa, Mycobacterium
GRDAGRRRPPVLSEAEFL

SEQ ID NO: 819768 - protein, 23 aa, Mycobacterium
GRDAKFMWPHMFNAVADEYDRRY

SEQ ID NO: 819769 - protein, 23 aa, Mycobacterium
GRDALDRLLVLGTLLEGHADHVM

SEQ ID NO: 819770 - protein, 28 aa, Mycobacterium
GRDAVNDDAPWFWSDQYEHNLQLLGEAT

SEQ ID NO: 819771 - protein, 25 aa, Mycobacterium
GRDCTAIRWGLWQAAGVVAADEIAR

SEQ ID NO: 819772 - protein, 25 aa, Mycobacterium
GRDCTAIRWGLWQGAGVVVGNEITR

SEQ ID NO: 819773 - protein, 25 aa, Mycobacterium
GRDERGQRVLDDSFLLCFNAHHEPI

SEQ ID NO: 819774 - protein, 25 aa, Mycobacterium
GRDERLCWWAGPWPVDERWWDDRPV

SEQ ID NO: 819775 - protein, 26 aa, Mycobacterium
GRDERLDWWAGPWPVDERWWDDRRVA

SEQ ID NO: 819776 - protein, 24 aa, Mycobacterium
GRDGCRIPLPWNESEPTYGFADGP

SEQ ID NO: 819777 - protein, 18 aa, Mycobacterium
GRDGHRSPRLPLDRLTEL

SEQ ID NO: 819778 - protein, 17 aa, Mycobacterium
GRDGLLMAPTYAVPRLL

SEQ ID NO: 819779 - protein, 25 aa, Mycobacterium
GRDGVFPLAAFRKVVDINLVGTFNV

SEQ ID NO: 819780 - protein, 20 aa, Mycobacterium
GRDHTPDAPLWLGSIKSNMG

SEQ ID NO: 819781 - protein, 18 aa, Mycobacterium
GRDIGTVVFPDARVKIFL

SEQ ID NO: 819782 - protein, 23 aa, Mycobacterium
GRDKCRVPIPWSGDAPPFGFSSS

SEQ ID NO: 819783 - protein, 31 aa, Mycobacterium
GRDLAHWDFYMALAYFKLAIIAAGIDYRRRE

SEQ ID NO: 819784 - protein, 22 aa, Mycobacterium
GRDLERFIRDAAVSYWHQSGTA

SEQ ID NO: 819785 - protein, 40 aa, Mycobacterium
GRDNPHILTLSPPILLESKWLRPTPYMMAKFGMTLCALGI

SEQ ID NO: 819786 - protein, 34 aa, Mycobacterium
GRDPAALQYWHVLGLWKLAIIAEGVMRRAMDEPQ

SEQ ID NO: 819787 - protein, 29 aa, Mycobacterium
GRDPGAVWSGWYRWGLRRRTRRVDHPGAC

SEQ ID NO: 819788 - protein, 28 aa, Mycobacterium
GRDPGEIQLLPVTKFFPASDVEELYRLG

SEQ ID NO: 819789 - protein, 24 aa, Mycobacterium
GRDPRSIGPILTRGHGSLRDDFAV

SEQ ID NO: 819790 - protein, 25 aa, Mycobacterium
GRDPYYLCELKIDGVALSLVYRDGR

SEQ ID NO: 819791 - protein, 23 aa, Mycobacterium
GRDRCRVPMPWSGTTPPFGFSSC

SEQ ID NO: 819792 - protein, 18 aa, Mycobacterium
GRDRWQYLPFGGGGRSCL

SEQ ID NO: 819793 - protein, 21 aa, Mycobacterium
GRDTIAMFRNAYHGHFDSTLV

SEQ ID NO: 819794 - protein, 23 aa, Mycobacterium
GRDVALIVAVKRLAAAKTRLAPV

SEQ ID NO: 819795 - protein, 25 aa, Mycobacterium
GRDVAVIQLLGAAGLPAAPIGDANI

SEQ ID NO: 819796 - protein, 22 aa, Mycobacterium
GRDVMIAMLLGGEEFGFATAPL

SEQ ID NO: 819797 - protein, 25 aa, Mycobacterium
GRDVTPLQWVIFEEEYFKAGAPARI

SEQ ID NO: 819798 - protein, 23 aa, Mycobacterium
GRDWQRLCQKWDLASAPLDRQIE

SEQ ID NO: 819799 - protein, 26 aa, Mycobacterium
GRDYLEKMLQLKVAIPPLSAPEAETY

SEQ ID NO: 819800 - protein, 19 aa, Mycobacterium
GRDYRVLSVALLEVTFCGF

SEQ ID NO: 819801 - protein, 23 aa, Mycobacterium
GREAFICGPGPFMTAAEDALRAA

SEQ ID NO: 819802 - protein, 23 aa, Mycobacterium
GREAPGLPLVRAAAGFGGAKPWF

SEQ ID NO: 819803 - protein, 26 aa, Mycobacterium
GREAYLQAFFAVLANPVLGALAPYVL

SEQ ID NO: 819804 - protein, 25 aa, Mycobacterium
GREDGGLQRFLASAAAAFVAGVNVD

SEQ ID NO: 819805 - protein, 21 aa, Mycobacterium
GREDWAVHVALWQAGELVAGA

SEQ ID NO: 819806 - protein, 26 aa, Mycobacterium
GREGVPTFLLPANPVSALVVFEVMVR

SEQ ID NO: 819807 - protein, 27 aa, Mycobacterium
GREGVRLARVLPLPVAMRLILMGKHEK

SEQ ID NO: 819808 - protein, 26 aa, Mycobacterium
GREHLLDVWRRPDLAPGGRAPVLIQV

SEQ ID NO: 819809 - protein, 39 aa, Mycobacterium
GREIRRLGVLGADFRPLVFDGLFLQLPIGSVDALRCAYA

SEQ ID NO: 819810 - protein, 19 aa, Mycobacterium
GREIVFAPFVFGVNEPSDS

SEQ ID NO: 819811 - protein, 20 aa, Mycobacterium
GREKLFATFLTPAADGAGNT

SEQ ID NO: 819812 - protein, 21 aa, Mycobacterium
GREMHVIVGQGRLSQILESRP

SEQ ID NO: 819813 - protein, 26 aa, Mycobacterium
GRENLRSFATWDCAVAGLLDLDPAPT

SEQ ID NO: 819814 - protein, 23 aa, Mycobacterium
GRENPHILTLSPPVQLDKKWLKP

SEQ ID NO: 819815 - protein, 23 aa, Mycobacterium
GRENPHILTLSPPVRLEPEWLKP

SEQ ID NO: 819816 - protein, 28 aa, Mycobacterium
GREPGLYFRPMLIPISIHLCEDPERGWA

SEQ ID NO: 819817 - protein, 19 aa, Mycobacterium
GREPVSGVHFAFVSNSSPW

SEQ ID NO: 819818 - protein, 17 aa, Mycobacterium
GREPYFVGKPNPMMFRS

SEQ ID NO: 819819 - protein, 32 aa, Mycobacterium
GREQSRPELGFRLLQRLGADVADYGFVETSAK

SEQ ID NO: 819820 - protein, 25 aa, Mycobacterium
GREQVRAWIWQTMTTFPGSHMVAFP

SEQ ID NO: 819821 - protein, 23 aa, Mycobacterium
GRERIFASLLTPSAYGAPDCRWD

SEQ ID NO: 819822 - protein, 21 aa, Mycobacterium
GRERLLIEYWMRRTTVGVVDP

SEQ ID NO: 819823 - protein, 17 aa, Mycobacterium
GREVAHLRAFRAYAGHC

SEQ ID NO: 819824 - protein, 27 aa, Mycobacterium
GREVSSNVVVPYFWSDQYDVKIQCLGE

SEQ ID NO: 819825 - protein, 19 aa, Mycobacterium
GREWGLEYLFGVLEAGPAG

SEQ ID NO: 819826 - protein, 24 aa, Mycobacterium
GRFAFQWTEFPWGCEHYEWTGRMM

SEQ ID NO: 819827 - protein, 18 aa, Mycobacterium
GRFARKNYFYPDQPKNYQ

SEQ ID NO: 819828 - protein, 17 aa, Mycobacterium
GRFASLSSGLRALSAPE

SEQ ID NO: 819829 - protein, 20 aa, Mycobacterium
GRFDDVMLLLGDQLPEGSVY

SEQ ID NO: 819830 - protein, 26 aa, Mycobacterium
GRFDEWLTIFGGWRSAVPDIIEVGTR

SEQ ID NO: 819831 - protein, 18 aa, Mycobacterium
GRFELALKQPGMLRPLGA

SEQ ID NO: 819832 - protein, 24 aa, Mycobacterium
GRFGAPYLRDSLLSAGALCETLET

SEQ ID NO: 819833 - protein, 23 aa, Mycobacterium
GRFLDGIAERVLVIGTGGLSHSP

SEQ ID NO: 819834 - protein, 18 aa, Mycobacterium
GRFLTAMRLAQDLAVSTD

SEQ ID NO: 819835 - protein, 27 aa, Mycobacterium
GRFNDMILGLRMITPVGVLDLGRVAAS

SEQ ID NO: 819836 - protein, 18 aa, Mycobacterium
GRFPDVKAWLAEVLPNFP

SEQ ID NO: 819837 - protein, 27 aa, Mycobacterium
GRFQNRRALLDVPRLGPKAFEQCAGFL

SEQ ID NO: 819838 - protein, 21 aa, Mycobacterium
GRFQRFVDATLWPRLFGNCHT

SEQ ID NO: 819839 - protein, 20 aa, Mycobacterium
GRFQWVVFTSTNAVRAVWEK

SEQ ID NO: 819840 - protein, 20 aa, Mycobacterium
GRFTLLLEDLSSIAAPGDMI

SEQ ID NO: 819841 - protein, 25 aa, Mycobacterium
GRFVGFADFLIRDGERYRIADTKLA

SEQ ID NO: 819842 - protein, 31 aa, Mycobacterium
GRFVSTYGWRAYALPALVALTAVVVYQTVTG

SEQ ID NO: 819843 - protein, 29 aa, Mycobacterium
GRGADLRALSLPVLRSWLATAAGAGAART

SEQ ID NO: 819844 - protein, 18 aa, Mycobacterium
GRGALGMCELAVAGTVVA

SEQ ID NO: 819845 - protein, 29 aa, Mycobacterium
GRGDDILPVARLLVLPESGWTTAQTIFVN

SEQ ID NO: 819846 - protein, 32 aa, Mycobacterium
GRGDIIRRKAGLPPATYFSGGKLQWILENVEG

SEQ ID NO: 819847 - protein, 26 aa, Mycobacterium
GRGDIVLIRTGWWARFLMTGNKTERY

SEQ ID NO: 819848 - protein, 33 aa, Mycobacterium
GRGDRVGIWAPNRWEWVLVQYATAEIGAVLVTI

SEQ ID NO: 819849 - protein, 26 aa, Mycobacterium
GRGEFRPRVSFLSPGKKILHDDRLDL

SEQ ID NO: 819850 - protein, 26 aa, Mycobacterium
GRGERTVCIYLPDGSLGFGFERPHVS

SEQ ID NO: 819851 - protein, 29 aa, Mycobacterium
GRGESGWYNTYFFNQPALEDALEALVARV

SEQ ID NO: 819852 - protein, 18 aa, Mycobacterium
GRGFAAYGTAKAALSHYT

SEQ ID NO: 819853 - protein, 29 aa, Mycobacterium
GRGFLFEKVFPAFWQFKPTKQIRGAYTLL

SEQ ID NO: 819854 - protein, 18 aa, Mycobacterium
GRGGFAGLLLGSVSTSVA

SEQ ID NO: 819855 - protein, 18 aa, Mycobacterium
GRGGFPGMLLGSVSSAVA

SEQ ID NO: 819856 - protein, 23 aa, Mycobacterium
GRGGKPTFWISGALAGPNREVHL

SEQ ID NO: 819857 - protein, 19 aa, Mycobacterium
GRGGLLIGSGGNGGTGGTG

SEQ ID NO: 819858 - protein, 23 aa, Mycobacterium
GRGGNAGLLFSSAGAGGFGGYGT

SEQ ID NO: 819859 - protein, 21 aa, Mycobacterium
GRGGPQFLPFGAATAGGDTIG

SEQ ID NO: 819860 - protein, 20 aa, Mycobacterium
GRGGWSNVLLVVPAATDSDD

SEQ ID NO: 819861 - protein, 18 aa, Mycobacterium
GRGHVVGKLPWGPEIRRI

SEQ ID NO: 819862 - protein, 21 aa, Mycobacterium
GRGIGFTEKPPRKPLIAAVEG

SEQ ID NO: 819863 - protein, 21 aa, Mycobacterium
GRGIGLLHKLQAYQLQDAGDD

SEQ ID NO: 819864 - protein, 18 aa, Mycobacterium
GRGILLHADPVDAAPATG

SEQ ID NO: 819865 - protein, 18 aa, Mycobacterium
GRGILLHADPVDSAPTTG

SEQ ID NO: 819866 - protein, 20 aa, Mycobacterium
GRGIVLYMRGHEGRGIGLMH

SEQ ID NO: 819867 - protein, 25 aa, Mycobacterium
GRGKARFEKWYRYTIDQKQYVATEP

SEQ ID NO: 819868 - protein, 20 aa, Mycobacterium
GRGLDLDRVAALLGLTDAER

SEQ ID NO: 819869 - protein, 23 aa, Mycobacterium
GRGLFWAVELVRNKETREPLVPF

SEQ ID NO: 819870 - protein, 24 aa, Mycobacterium
GRGLHGQFPAFARAFDAAVDELDQ

SEQ ID NO: 819871 - protein, 22 aa, Mycobacterium
GRGLLSLLVVPTDVPGLTKSLI

SEQ ID NO: 819872 - protein, 23 aa, Mycobacterium
GRGLLSLLVVPTDVPGLTKSLIP

SEQ ID NO: 819873 - protein, 21 aa, Mycobacterium
GRGLLVLLDALRTTVTGQAPA

SEQ ID NO: 819874 - protein, 17 aa, Mycobacterium
GRGLPPAEPFPLPIHTG

SEQ ID NO: 819875 - protein, 26 aa, Mycobacterium
GRGLTPIIDPRWVGSLESRAVALAQR

SEQ ID NO: 819876 - protein, 26 aa, Mycobacterium
GRGPAMRFLLLETGQQRWRFVITAHH

SEQ ID NO: 819877 - protein, 22 aa, Mycobacterium
GRGPFRWVALSGDPKDIHATDE

SEQ ID NO: 819878 - protein, 24 aa, Mycobacterium
GRGPPRGFLRRRRVAVTEQGPRRE

SEQ ID NO: 819879 - protein, 21 aa, Mycobacterium
GRGPSTWYFDAGELDVWEVWA

SEQ ID NO: 819880 - protein, 24 aa, Mycobacterium
GRGPVATVLIQRGTLRVGDSIVAG

SEQ ID NO: 819881 - protein, 26 aa, Mycobacterium
GRGRHPSLCLLASWVSPASPAGRRLS

SEQ ID NO: 819882 - protein, 24 aa, Mycobacterium
GRGRPAKRFRLTAAGRAKLNHAYD

SEQ ID NO: 819883 - protein, 24 aa, Mycobacterium
GRGSLYKAFGDKHSMFLRGLEQYC

SEQ ID NO: 819884 - protein, 32 aa, Mycobacterium
GRGSPWAVPLSWLLPPRIALQILMTGDPITAE

SEQ ID NO: 819885 - protein, 38 aa, Mycobacterium
GRGSRVEFWAFDLLYLDGRSLLRARYRDRRKLLEMLAA

SEQ ID NO: 819886 - protein, 27 aa, Mycobacterium
GRGSTWSRQLPWLTRLGAVYTYDAPWH

SEQ ID NO: 819887 - protein, 26 aa, Mycobacterium
GRGSTWSRQLPWLTRLGSVYTYDAPW

SEQ ID NO: 819888 - protein, 24 aa, Mycobacterium
GRGTRLPVWLEQWGYDRPREDLLD

SEQ ID NO: 819889 - protein, 24 aa, Mycobacterium
GRGTRLPVWLTQWGYQRPPEETVD

SEQ ID NO: 819890 - protein, 27 aa, Mycobacterium
GRGTTWTRQLPWLTRLGTVYSYDAPWH

SEQ ID NO: 819891 - protein, 41 aa, Mycobacterium
GRGVPLLFMHGLLLSRKAYLRMLSRIAGMGFLVVAVDAAGH

SEQ ID NO: 819892 - protein, 18 aa, Mycobacterium
GRGVTVGRPMGLLLTRRS

SEQ ID NO: 819893 - protein, 17 aa, Mycobacterium
GRGWLTRDDKHAWEKMR

SEQ ID NO: 819894 - protein, 26 aa, Mycobacterium
GRGYGYGPAFRGLRAVWRRGAEVFAE

SEQ ID NO: 819895 - protein, 17 aa, Mycobacterium
GRHADILVLLDRHPEGL

SEQ ID NO: 819896 - protein, 24 aa, Mycobacterium
GRHAPGWSRRLLPPVMGTMLEIGS

SEQ ID NO: 819897 - protein, 24 aa, Mycobacterium
GRHAQWPMVLASLPHLADPGRIDA

SEQ ID NO: 819898 - protein, 20 aa, Mycobacterium
GRHAYLAACSLPFDAAVDCY

SEQ ID NO: 819899 - protein, 24 aa, Mycobacterium
GRHEEWFYLTQGMALQKEFLDHFL

SEQ ID NO: 819900 - protein, 24 aa, Mycobacterium
GRHERLWEILGAHPRSFVTADGEV

SEQ ID NO: 819901 - protein, 24 aa, Mycobacterium
GRHGFVGLIDALSGFPKPLVCAVN

SEQ ID NO: 819902 - protein, 19 aa, Mycobacterium
GRHGFVYRFQPGEQPLGEA

SEQ ID NO: 819903 - protein, 25 aa, Mycobacterium
GRHHKTHLFGEIDRAYFTPGSHAVT

SEQ ID NO: 819904 - protein, 25 aa, Mycobacterium
GRHIRRVPLSGGLFRALGRIADAVG

SEQ ID NO: 819905 - protein, 28 aa, Mycobacterium
GRHLDLPPVYLMMFRVLGSLSGILAQLD

SEQ ID NO: 819906 - protein, 17 aa, Mycobacterium
GRHLLGVSYARTGTVPD

SEQ ID NO: 819907 - protein, 19 aa, Mycobacterium
GRHPLPSGVALQAAARRWG

SEQ ID NO: 819908 - protein, 27 aa, Mycobacterium
GRHPTSTAIFVYFLGPDNLTYEYSFGV

SEQ ID NO: 819909 - protein, 20 aa, Mycobacterium
GRHQLNRYPDGLEKCIGCEL

SEQ ID NO: 819910 - protein, 17 aa, Mycobacterium
GRHRFGYTLGVDGGYLT

SEQ ID NO: 819911 - protein, 23 aa, Mycobacterium
GRHRFPIVLTESVEQFLTAVGEE

SEQ ID NO: 819912 - protein, 18 aa, Mycobacterium
GRHRVIQAVVAFPDAAAA

SEQ ID NO: 819913 - protein, 20 aa, Mycobacterium
GRHVWEFVPRGKTDLAALVK

SEQ ID NO: 819914 - protein, 18 aa, Mycobacterium
GRIAGRLGVLPPNTSLLQ

SEQ ID NO: 819915 - protein, 20 aa, Mycobacterium
GRIAKLAGLLPGRDPYHPNE

SEQ ID NO: 819916 - protein, 19 aa, Mycobacterium
GRIALHVFFDVEDVDIAVA

SEQ ID NO: 819917 - protein, 25 aa, Mycobacterium
GRIDPHLRMLTPVDDYPLIDGAGRR

SEQ ID NO: 819918 - protein, 21 aa, Mycobacterium
GRIDPTLLYDIAAATPESGQL

SEQ ID NO: 819919 - protein, 25 aa, Mycobacterium
GRIDRRGRMLWSLPKGHIELGETAE

SEQ ID NO: 819920 - protein, 24 aa, Mycobacterium
GRIDRRGRMLWSLPKGHIEMGETA

SEQ ID NO: 819921 - protein, 18 aa, Mycobacterium
GRIDYQAAWDLQRELAEE

SEQ ID NO: 819922 - protein, 24 aa, Mycobacterium
GRIERELPEWLAADVAILGEPSGG

SEQ ID NO: 819923 - protein, 24 aa, Mycobacterium
GRIERELPEWLSADVAILGEPTSG

SEQ ID NO: 819924 - protein, 23 aa, Mycobacterium
GRIGQLFAQRLAAFGTHIVAYDP

SEQ ID NO: 819925 - protein, 20 aa, Mycobacterium
GRIIPTFIAQALRGEPITVF

SEQ ID NO: 819926 - protein, 24 aa, Mycobacterium
GRIKTVVSMLLLRGFAKQVGADGN

SEQ ID NO: 819927 - protein, 19 aa, Mycobacterium
GRILVEDPAIGAAPGMPVC

SEQ ID NO: 819928 - protein, 24 aa, Mycobacterium
GRIPADDPPFTAAGWVLDLTPEER

SEQ ID NO: 819929 - protein, 18 aa, Mycobacterium
GRIQFVRQEPLFTSSVKY

SEQ ID NO: 819930 - protein, 24 aa, Mycobacterium
GRIQMGIGAGWYEHEWRAYGYGFP

SEQ ID NO: 819931 - protein, 24 aa, Mycobacterium
GRIQMGIGGGWYEHEWRAYGYGFP

SEQ ID NO: 819932 - protein, 23 aa, Mycobacterium
GRITDFRAFYWNVAEYVEVTSEA

SEQ ID NO: 819933 - protein, 22 aa, Mycobacterium
GRITIMFCSFTRNSRILRLFGT

SEQ ID NO: 819934 - protein, 18 aa, Mycobacterium
GRITKLAESALYQSAFGY

SEQ ID NO: 819935 - protein, 40 aa, Mycobacterium
GRITLAEDLVLYLFGTPGQRRFWFMWDDLVRGAIGAIILV

SEQ ID NO: 819936 - protein, 41 aa, Mycobacterium; identical to SEQ ID NO: 218760

SEQ ID NO: 819937 - protein, 24 aa, Mycobacterium
GRIVLMFCSFDKRCRIIRLHGRAR

SEQ ID NO: 819938 - protein, 20 aa, Mycobacterium
GRIVSIPRRVNGELYGSFLS

SEQ ID NO: 819939 - protein, 30 aa, Mycobacterium
GRKGRIQQILLPTLLDWLSDTPDPDAGLLA

SEQ ID NO: 819940 - protein, 23 aa, Mycobacterium
GRKHLWLDVVALAQNLRPQSSLA

SEQ ID NO: 819941 - protein, 18 aa, Mycobacterium
GRKIGEFQAVAFKLADMK

SEQ ID NO: 819942 - protein, 19 aa, Mycobacterium
GRKIGEFQAVAFKLADMKS

SEQ ID NO: 819943 - protein, 18 aa, Mycobacterium
GRKIGEFQGVAFKLADMK

SEQ ID NO: 819944 - protein, 18 aa, Mycobacterium
GRKMVYLPNFDAQEWVRL

SEQ ID NO: 819945 - protein, 21 aa, Mycobacterium
GRKMVYLRHFDAEKWVRLVAD

SEQ ID NO: 819946 - protein, 17 aa, Mycobacterium
GRKPARFDDFALPAAAG

SEQ ID NO: 819947 - protein, 19 aa, Mycobacterium
GRKSGRHFSLPLSAHVIDN

SEQ ID NO: 819948 - protein, 19 aa, Mycobacterium
GRKTGRQFSLPLSAHVIDN

SEQ ID NO: 819949 - protein, 31 aa, Mycobacterium
GRKTRIFCPRWVGLFRWLKPVLSTSVGERPI

SEQ ID NO: 819950 - protein, 17 aa, Mycobacterium
GRKTVIDTLVLATGFDL

SEQ ID NO: 819951 - protein, 25 aa, Mycobacterium
GRKVAKLMEWVAMVGCPIIGINDSA

SEQ ID NO: 819952 - protein, 26 aa, Mycobacterium
GRKVAPGVRMLIVPGSMRVRAQAEKE

SEQ ID NO: 819953 - protein, 29 aa, Mycobacterium
GRKVSEIELLPITKFFPATDVAILARLGC

SEQ ID NO: 819954 - protein, 20 aa, Mycobacterium
GRKVVQFIPNSFSDAVRLFT

SEQ ID NO: 819955 - protein, 22 aa, Mycobacterium
GRKWLITGARGAKTWIIMANLE

SEQ ID NO: 819956 - protein, 19 aa, Mycobacterium
GRLAALPRRDLGASAAELV

SEQ ID NO: 819957 - protein, 26 aa, Mycobacterium
GRLAAPLLPLITEVIWRGVTGERSVH

SEQ ID NO: 819958 - protein, 24 aa, Mycobacterium
GRLAGRPVVLAKPRVYMNESGRQV

SEQ ID NO: 819959 - protein, 25 aa, Mycobacterium
GRLAHYRILRHRPAINAGLEFIGSA

SEQ ID NO: 819960 - protein, 25 aa, Mycobacterium
GRLARMMRLLGLDVWWSSVADDPAL

SEQ ID NO: 819961 - protein, 23 aa, Mycobacterium
GRLARYVVPLPGRPAPLHPNEAG

SEQ ID NO: 819962 - protein, 21 aa, Mycobacterium
GRLARYWQLLPNVGAHAFDDD

SEQ ID NO: 819963 - protein, 18 aa, Mycobacterium
GRLDILVNNAAIIRDEMM

SEQ ID NO: 819964 - protein, 18 aa, Mycobacterium
GRLDITVWNPGLAERVVH

SEQ ID NO: 819965 - protein, 24 aa, Mycobacterium
GRLDKLEIYPNLWAGVGLVRGGAG

SEQ ID NO: 819966 - protein, 22 aa, Mycobacterium
GRLDVLVNNAGFLRDRMLANMS

SEQ ID NO: 819967 - protein, 23 aa, Mycobacterium
GRLEADLVNVPLFVAADYAVNGV

SEQ ID NO: 819968 - protein, 24 aa, Mycobacterium
GRLFAAGLDIGWPAALAGSGGRRV

SEQ ID NO: 819969 - protein, 19 aa, Mycobacterium
GRLFARHSQPYAWPGRVIG

SEQ ID NO: 819970 - protein, 19 aa, Mycobacterium
GRLFRPDSEPLLPNWKHLP

SEQ ID NO: 819971 - protein, 19 aa, Mycobacterium
GRLFTRFLKLLPTNEAKIE

SEQ ID NO: 819972 - protein, 19 aa, Mycobacterium
GRLGLPASGYLYGTYENPT

SEQ ID NO: 819973 - protein, 28 aa, Mycobacterium
GRLGRPDELTGLYLYLASEASSYMTGSD

SEQ ID NO: 819974 - protein, 27 aa, Mycobacterium
GRLGRPGSGLLPALRQRRVVTGLFDGG

SEQ ID NO: 819975 - protein, 28 aa, Mycobacterium
GRLGWNWARFAFNGWKALSWMDANVWRH

SEQ ID NO: 819976 - protein, 21 aa, Mycobacterium
GRLHLPVPDWQVLLNVPTELA

SEQ ID NO: 819977 - protein, 39 aa, Mycobacterium
GRLHQQLIKVLPLWLRLERFAVWLIFEVLAVTLVDAKPL

SEQ ID NO: 819978 - protein, 21 aa, Mycobacterium
GRLHTPKRYSRRLRRVMYMSA

SEQ ID NO: 819979 - protein, 18 aa, Mycobacterium
GRLHTWYERAHVEHPADG

SEQ ID NO: 819980 - protein, 21 aa, Mycobacterium
GRLHTWYRHAPRMSNFEFKAA

SEQ ID NO: 819981 - protein, 21 aa, Mycobacterium
GRLHYAIALRERLPRVAEVFA

SEQ ID NO: 819982 - protein, 18 aa, Mycobacterium
GRLIAEKTDFPPGVVNVV

SEQ ID NO: 819983 - protein, 26 aa, Mycobacterium
GRLIVGWHHRSWPRLARQCGRWGAIA

SEQ ID NO: 819984 - protein, 20 aa, Mycobacterium
GRLKHRETIFDGIESCVDAL

SEQ ID NO: 819985 - protein, 21 aa, Mycobacterium
GRLLEALAEFRFGPAELESVS

SEQ ID NO: 819986 - protein, 28 aa, Mycobacterium
GRLLQRHAGPIFPLIEDLFGVSVAQLHQ

SEQ ID NO: 819987 - protein, 23 aa, Mycobacterium
GRLLRAHLPADDPLAPYAARLTT

SEQ ID NO: 819988 - protein, 17 aa, Mycobacterium
GRLLRRPTDKTKPVQIV

SEQ ID NO: 819989 - protein, 18 aa, Mycobacterium
GRLLTFQLYDQQANVPLG

SEQ ID NO: 819990 - protein, 19 aa, Mycobacterium
GRLPAEWTAGALLYQCCTA

SEQ ID NO: 819991 - protein, 22 aa, Mycobacterium
GRLPGRAFLGYCTAKGALAHYT

SEQ ID NO: 819992 - protein, 18 aa, Mycobacterium
GRLPLDAVLRRMPVGVVV

SEQ ID NO: 819993 - protein, 23 aa, Mycobacterium
GRLQPGKMLLIDTAAGRIVPDDE

SEQ ID NO: 819994 - protein, 18 aa, Mycobacterium
GRLRPDVVLVTRSPLPDD

SEQ ID NO: 819995 - protein, 21 aa, Mycobacterium
GRLRPEIWQAWRHANNASGTL

SEQ ID NO: 819996 - protein, 24 aa, Mycobacterium
GRLRRPLLGLPMAHPGAVDVVYDT

SEQ ID NO: 819997 - protein, 23 aa, Mycobacterium
GRLRRRLPITAETADIITAWQQR

SEQ ID NO: 819998 - protein, 18 aa, Mycobacterium
GRLSAKLGFGAKALPFML

SEQ ID NO: 819999 - protein, 23 aa, Mycobacterium
GRLSLADVLQLGVALAAGLESAH

SEQ ID NO: 820000 - protein, 22 aa, Mycobacterium
GRLSLLVVPTDAPGLTKTLIPV

SEQ ID NO: 820001 - protein, 36 aa, Mycobacterium
GRLSLSAQPWLADHAVLGVMLFPGTGFLELVIRAGD

SEQ ID NO: 820002 - protein, 19 aa, Mycobacterium
GRLSQLWFEALAGICAHVK

SEQ ID NO: 820003 - protein, 18 aa, Mycobacterium
GRLTALDVFMGRPVVACM

SEQ ID NO: 820004 - protein, 17 aa, Mycobacterium
GRLTGVTALSPVAPIDE

SEQ ID NO: 820005 - protein, 18 aa, Mycobacterium
GRLTLVEGAGGLLVEIGR

SEQ ID NO: 820006 - protein, 18 aa, Mycobacterium
GRLTLVEGAGGLLVELAD

SEQ ID NO: 820007 - protein, 17 aa, Mycobacterium
GRLTLVSRLGNNKVRDL

SEQ ID NO: 820008 - protein, 21 aa, Mycobacterium
GRLTPPMVALLKVVAPIVREG

SEQ ID NO: 820009 - protein, 19 aa, Mycobacterium
GRLTTPEAWLSTWSGLSAN

SEQ ID NO: 820010 - protein, 20 aa, Mycobacterium
GRLTVLHWLESVQGLPTRAQ

SEQ ID NO: 820011 - protein, 24 aa, Mycobacterium
GRLTYLPMTRYLGDNRIRTLDGAE

SEQ ID NO: 820012 - protein, 24 aa, Mycobacterium
GRLVFHEIFLDPDRLGISELRSLV

SEQ ID NO: 820013 - protein, 19 aa, Mycobacterium
GRLVIIGMQGGTKAEINLG

SEQ ID NO: 820014 - protein, 20 aa, Mycobacterium
GRLVIIGMQGGVKAELNIGK

SEQ ID NO: 820015 - protein, 19 aa, Mycobacterium
GRLVMRSACAQFGLWRSHG

SEQ ID NO: 820016 - protein, 23 aa, Mycobacterium
GRLWATIIQHRFGGSGALAGHPI

SEQ ID NO: 820017 - protein, 24 aa, Mycobacterium
GRLWATIIQHRFGGSGALAGHPIG

SEQ ID NO: 820018 - protein, 24 aa, Mycobacterium
GRLWATILQHRFGGSGALAGHPIG

SEQ ID NO: 820019 - protein, 25 aa, Mycobacterium
GRLYTHDAAMLDRRLLQMAHDVCED

SEQ ID NO: 820020 - protein, 18 aa, Mycobacterium
GRMASICTGSFILAQAGL

SEQ ID NO: 820021 - protein, 18 aa, Mycobacterium
GRMDGTLAYFLIVATADS

SEQ ID NO: 820022 - protein, 24 aa, Mycobacterium
GRMEGLLVDLWDALRGLPEVFRAL

SEQ ID NO: 820023 - protein, 22 aa, Mycobacterium
GRMISPLSLPPPVPMSGRFIYA

SEQ ID NO: 820024 - protein, 17 aa, Mycobacterium
GRMMELTNKLRLGTASF

SEQ ID NO: 820025 - protein, 17 aa, Mycobacterium
GRMSIDQFAPQISFFFY

SEQ ID NO: 820026 - protein, 17 aa, Mycobacterium
GRMTIDEFAPQISFFFY

SEQ ID NO: 820027 - protein, 18 aa, Mycobacterium
GRMYACFAAGALATGCEY

SEQ ID NO: 820028 - protein, 24 aa, Mycobacterium
GRNEAPDLIYIDLHLVHEVTSPQA

SEQ ID NO: 820029 - protein, 21 aa, Mycobacterium
GRNFLLPPTWTQLDALAGHTV

SEQ ID NO: 820030 - protein, 18 aa, Mycobacterium
GRNISAVCDAPVVMASFA

SEQ ID NO: 820031 - protein, 18 aa, Mycobacterium
GRNLARRAAWFLDNEPDE

SEQ ID NO: 820032 - protein, 18 aa, Mycobacterium
GRNLARRAAWFMDNEPDE

SEQ ID NO: 820033 - protein, 18 aa, Mycobacterium
GRNLVRRAAWFLDNEPGE

SEQ ID NO: 820034 - protein, 18 aa, Mycobacterium
GRNMTMVLAPHRGAKTRA

SEQ ID NO: 820035 - protein, 23 aa, Mycobacterium
GRNMTMVLAPHRGAKTRARARHG

SEQ ID NO: 820036 - protein, 24 aa, Mycobacterium
GRNNTGVIVLLTFGTGIGSAVIHN

SEQ ID NO: 820037 - protein, 25 aa, Mycobacterium
GRNPDEIKVMYLVIPTLGETTEEAV

SEQ ID NO: 820038 - protein, 19 aa, Mycobacterium
GRNPMVAVLFAMQSPPPVD

SEQ ID NO: 820039 - protein, 23 aa, Mycobacterium
GRNQLRVGMFPAVDPDDVSALTE

SEQ ID NO: 820040 - protein, 25 aa, Mycobacterium
GRNQSGLVVLLTFGTGIGSAVIHNG

SEQ ID NO: 820041 - protein, 25 aa, Mycobacterium
GRNQTGLVILLTFGTGIGSAVIHNG

SEQ ID NO: 820042 - protein, 20 aa, Mycobacterium
GRNRIVRRLLAAAGFPVEAL

SEQ ID NO: 820043 - protein, 18 aa, Mycobacterium
GRNRIVRRLLGAAGFPVE

SEQ ID NO: 820044 - protein, 18 aa, Mycobacterium
GRNVATLIDLLAPPPQPE

SEQ ID NO: 820045 - protein, 28 aa, Mycobacterium
GRNVGEIELLPITKFFPATDVVTLSRLG

SEQ ID NO: 820046 - protein, 20 aa, Mycobacterium
GRNYIGATGTPLYRLMQSGD

SEQ ID NO: 820047 - protein, 19 aa, Mycobacterium
GRPAALYRFTDSRLRVTDE

SEQ ID NO: 820048 - protein, 20 aa, Mycobacterium
GRPAAQLMFNVDAGVVFSAA

SEQ ID NO: 820049 - protein, 29 aa, Mycobacterium
GRPAAWIAEGLLPYLPPAAQDLLFERIDT

SEQ ID NO: 820050 - protein, 33 aa, Mycobacterium
GRPADPPFEGMWWLYLPIAFDDFAVVLIIQEEP

SEQ ID NO: 820051 - protein, 33 aa, Mycobacterium
GRPADPPFEGMWWLYVPLAFDDFATVLIIQEDP

SEQ ID NO: 820052 - protein, 30 aa, Mycobacterium
GRPADPPFEGMWWLYVPMAFDEFSIVLIIQ

SEQ ID NO: 820053 - protein, 19 aa, Mycobacterium
GRPAFVARSVLVTGGNRGI

SEQ ID NO: 820054 - protein, 22 aa, Mycobacterium
GRPAFWVAHSFGGVALARAAAE

SEQ ID NO: 820055 - protein, 19 aa, Mycobacterium
GRPAKRYRLTAGGRAKLDH

SEQ ID NO: 820056 - protein, 19 aa, Mycobacterium
GRPALPFGHWVAEHRDVFT

SEQ ID NO: 820057 - protein, 25 aa, Mycobacterium
GRPANSLLAVLPSKIRSVGEYAYLR

SEQ ID NO: 820058 - protein, 25 aa, Mycobacterium
GRPAQGLLELAWSPISPAHGALDGG

SEQ ID NO: 820059 - protein, 19 aa, Mycobacterium
GRPCRGRRGPTGRGRRRDA

SEQ ID NO: 820060 - protein, 24 aa, Mycobacterium
GRPDAPIFPLAEAVDRITAAAHTT

SEQ ID NO: 820061 - protein, 33 aa, Mycobacterium
GRPDDPPFEGMWWLYIPMAFDDFGIVIIIQEDP

SEQ ID NO: 820062 - protein, 19 aa, Mycobacterium
GRPEGRPWTYTPPVTFDQP

SEQ ID NO: 820063 - protein, 20 aa, Mycobacterium
GRPELSLLRAAGAAGFTAIA

SEQ ID NO: 820064 - protein, 43 aa, Mycobacterium
GRPETYFTDDGLGTWRFHVERSGSISWFGLDGMEHPGGTADID

SEQ ID NO: 820065 - protein, 22 aa, Mycobacterium
GRPETYKQAFYARDLAGTVVLV

SEQ ID NO: 820066 - protein, 29 aa, Mycobacterium
GRPEVDLGYFLFFDRVYSAGIGLPRLEGF

SEQ ID NO: 820067 - protein, 31 aa, Mycobacterium
GRPFDEACAGPWWALAANHPGLPIPPACLAA

SEQ ID NO: 820068 - protein, 23 aa, Mycobacterium
GRPFGIYVHVPFCATRCGYCDFN

SEQ ID NO: 820069 - protein, 19 aa, Mycobacterium
GRPFLVMPYHQNDSLEALV

SEQ ID NO: 820070 - protein, 26 aa, Mycobacterium
GRPFSRLPSWELIKTALNAPGKNATA

SEQ ID NO: 820071 - protein, 21 aa, Mycobacterium
GRPGCGLLQMNGQPTAENTRE

SEQ ID NO: 820072 - protein, 21 aa, Mycobacterium
GRPHFGAPLTGPENSGRELFT

SEQ ID NO: 820073 - protein, 25 aa, Mycobacterium
GRPHPRSFGTFPRVLGRYVREQPTI

SEQ ID NO: 820074 - protein, 18 aa, Mycobacterium
GRPIGSFQAVKHACADML

SEQ ID NO: 820075 - protein, 23 aa, Mycobacterium
GRPKLAVIVSKFDALRALRDVEG

SEQ ID NO: 820076 - protein, 29 aa, Mycobacterium
GRPLAWHSLGEALLNGRWIKLDATIDAPT

SEQ ID NO: 820077 - protein, 21 aa, Mycobacterium
GRPLGKLVAYVLEPGSVGKPS

SEQ ID NO: 820078 - protein, 22 aa, Mycobacterium
GRPLIAPSILSADFARLADEAA

SEQ ID NO: 820079 - protein, 23 aa, Mycobacterium
GRPLIQVGFMRRFDDEYVRLKAL

SEQ ID NO: 820080 - protein, 19 aa, Mycobacterium
GRPLPVYCASLRTAEPELL

SEQ ID NO: 820081 - protein, 21 aa, Mycobacterium
GRPLSILEWLRSGGSVEPVLE

SEQ ID NO: 820082 - protein, 23 aa, Mycobacterium
GRPLTTAHRDLLRMFADGVGLSY

SEQ ID NO: 820083 - protein, 22 aa, Mycobacterium
GRPNILHHMAFGRGVHTCPGAP

SEQ ID NO: 820084 - protein, 18 aa, Mycobacterium
GRPPDADLFRRAAALSAI

SEQ ID NO: 820085 - protein, 19 aa, Mycobacterium
GRPPHLVPVVADSGAAAVF

SEQ ID NO: 820086 - protein, 26 aa, Mycobacterium
GRPPTWDRWWEWGPVFLCSNNNKRGV

SEQ ID NO: 820087 - protein, 25 aa, Mycobacterium
GRPPYYIYCRAIDSGKFREVSATGS

SEQ ID NO: 820088 - protein, 22 aa, Mycobacterium
GRPRGHLRKFGLSRMRVRELAH

SEQ ID NO: 820089 - protein, 22 aa, Mycobacterium
GRPRGHLRKFGLSRVRVREMAH

SEQ ID NO: 820090 - protein, 25 aa, Mycobacterium
GRPRRAFRRITGAALEALLPEQPQQ

SEQ ID NO: 820091 - protein, 23 aa, Mycobacterium
GRPSTFGWIPFGGGTRRCVGAAF

SEQ ID NO: 820092 - protein, 32 aa, Mycobacterium
GRPVEQLLPIPPIALQLRTVISMLSYVDELAI

SEQ ID NO: 820093 - protein, 26 aa, Mycobacterium
GRPVFDPYIPMLANAKLQVNELAFGA

SEQ ID NO: 820094 - protein, 18 aa, Mycobacterium
GRQHGVLRGPVGLFGVDV

SEQ ID NO: 820095 - protein, 30 aa, Mycobacterium
GRQIQFNSLFLDPYLWKLQVGSKRLVQKAR

SEQ ID NO: 820096 - protein, 23 aa, Mycobacterium
GRQLAKDYVAFPALTSLSPGATY

SEQ ID NO: 820097 - protein, 25 aa, Mycobacterium
GRQLAQRLKHLYGRGVVVLGLPRGG

SEQ ID NO: 820098 - protein, 20 aa, Mycobacterium
GRQLEEGCFDLMFFDDRLAM

SEQ ID NO: 820099 - protein, 22 aa, Mycobacterium
GRQLIVRRYFADGCSAFPKRLQ

SEQ ID NO: 820100 - protein, 17 aa, Mycobacterium
GRQPAVFFDFDGTLSDI

SEQ ID NO: 820101 - protein, 31 aa, Mycobacterium
GRQPQMMKLFTKLFGPYPLATGYTVVVTDDD

SEQ ID NO: 820102 - protein, 23 aa, Mycobacterium
GRQSMLFSATMPDPIITLARTFM

SEQ ID NO: 820103 - protein, 23 aa, Mycobacterium
GRQVLWGLSYSMTAWRHGEEAMD

SEQ ID NO: 820104 - protein, 19 aa, Mycobacterium
GRQWAVDNWRWSLQAERLA

SEQ ID NO: 820105 - protein, 27 aa, Mycobacterium
GRRALDIYFQLANYRNNWKRLGFSDEE

SEQ ID NO: 820106 - protein, 21 aa, Mycobacterium
GRRALGWWLVGTGRGMLSLAR

SEQ ID NO: 820107 - protein, 24 aa, Mycobacterium
GRRAVGWWLVGTGRAMLALACRHA

SEQ ID NO: 820108 - protein, 22 aa, Mycobacterium
GRRCTAVRWGLWPGAGIIDADE

SEQ ID NO: 820109 - protein, 24 aa, Mycobacterium
GRRDGDILFLQGMMFVIGSTDEEA

SEQ ID NO: 820110 - protein, 24 aa, Mycobacterium
GRREPIPLPIKTSYAWGAARHCGD

SEQ ID NO: 820111 - protein, 18 aa, Mycobacterium
GRREPLPLPLKTSYAWAQ

SEQ ID NO: 820112 - protein, 18 aa, Mycobacterium
GRRFSFTALVIVGDGKGM

SEQ ID NO: 820113 - protein, 18 aa, Mycobacterium
GRRFSFTALVIVGDGNGM

SEQ ID NO: 820114 - protein, 25 aa, Mycobacterium
GRRGKYLWLTLGDGSAVVVHLGMSG

SEQ ID NO: 820115 - protein, 24 aa, Mycobacterium
GRRGPAGGLPITYSRKVFIPVTRL

SEQ ID NO: 820116 - protein, 24 aa, Mycobacterium
GRRGPGGGLPITYSRKVFIPVTHL

SEQ ID NO: 820117 - protein, 26 aa, Mycobacterium
GRRGQPRLRPPFPAVAGLYGCPTVIN

SEQ ID NO: 820118 - protein, 31 aa, Mycobacterium
GRRGRIQSILLPTLLDWLADTPDPDAGLLAY

SEQ ID NO: 820119 - protein, 25 aa, Mycobacterium
GRRGRLLGLRGGRRAGPRTGTCPGS

SEQ ID NO: 820120 - protein, 23 aa, Mycobacterium
GRRHHLCWPHGQTLVETLLEAGI

SEQ ID NO: 820121 - protein, 25 aa, Mycobacterium
GRRHKAPVLFLTKTDARAWLAQRHS

SEQ ID NO: 820122 - protein, 19 aa, Mycobacterium
GRRHLCGRPRHRSGRRAHL

SEQ ID NO: 820123 - protein, 31 aa, Mycobacterium
GRRIIRDRLRHLRPFFLSPLATPNLGHPMGT

SEQ ID NO: 820124 - protein, 18 aa, Mycobacterium
GRRIVAPEALLPATSPQM

SEQ ID NO: 820125 - protein, 24 aa, Mycobacterium
GRRKAFYVTSLPVPIPGIRAFAED

SEQ ID NO: 820126 - protein, 29 aa, Mycobacterium
GRRKARVRGWRPFGMIPFNSSAKKCLELA

SEQ ID NO: 820127 - protein, 28 aa, Mycobacterium
GRRKLLGRRVVLPGVGLYLDGGFGVGKT

SEQ ID NO: 820128 - protein, 17 aa, Mycobacterium
GRRKSPPTAGWRRWLYL

SEQ ID NO: 820129 - protein, 26 aa, Mycobacterium
GRRLASRWRADPDAPPWARMYTSGSW

SEQ ID NO: 820130 - protein, 22 aa, Mycobacterium
GRRLFKDFLALHFSTTRPPSQE

SEQ ID NO: 820131 - protein, 30 aa, Mycobacterium
GRRLLDPAIYREAALRLDRHFTISIIDCGS

SEQ ID NO: 820132 - protein, 30 aa, Mycobacterium
GRRLTDLEFNLFFLLLINAGGDTTRNLVAA

SEQ ID NO: 820133 - protein, 20 aa, Mycobacterium
GRRLYELMSAYWPTADKAPD

SEQ ID NO: 820134 - protein, 25 aa, Mycobacterium
GRRNDYVVGWIKRGPTGVIGSNKKD

SEQ ID NO: 820135 - protein, 17 aa, Mycobacterium
GRRNQPTPPPLVALETH

SEQ ID NO: 820136 - protein, 18 aa, Mycobacterium
GRRPAAFTDLPPLNGDNL

SEQ ID NO: 820137 - protein, 25 aa, Mycobacterium
GRRPGIDALFRSVALDYGPRAIGVL

SEQ ID NO: 820138 - protein, 21 aa, Mycobacterium
GRRQQLWLVTITDDQNRTVAR

SEQ ID NO: 820139 - protein, 21 aa, Mycobacterium
GRRQQLWLVTITDGDGRTVAR

SEQ ID NO: 820140 - protein, 32 aa, Mycobacterium
GRRRARAPDRRRLRLALRARGRDPRGAGRGAG

SEQ ID NO: 820141 - protein, 18 aa, Mycobacterium
GRRRASLPEPILHTAPER

SEQ ID NO: 820142 - protein, 17 aa, Mycobacterium
GRRRAVTALATGLLIGL

SEQ ID NO: 820143 - protein, 26 aa, Mycobacterium
GRRREQVLPAWVPVPTTEFAIGRAVR

SEQ ID NO: 820144 - protein, 17 aa, Mycobacterium
GRRRFVVIPARHPGVDH

SEQ ID NO: 820145 - protein, 21 aa, Mycobacterium
GRRRLDYPALAALCDIFYPRV

SEQ ID NO: 820146 - protein, 28 aa, Mycobacterium
GRRRLRIDDYQPGLAALLEAYRGRDFVV

SEQ ID NO: 820147 - protein, 33 aa, Mycobacterium
GRRRLRPADYQPPLGPLLTTYRGRELVVKCAPG

SEQ ID NO: 820148 - protein, 25 aa, Mycobacterium
GRRRPVAGLRWPWHARLGTAAVCWR

SEQ ID NO: 820149 - protein, 25 aa, Mycobacterium
GRRRPVPGLHWPWVARIGTVVMSWR

SEQ ID NO: 820150 - protein, 26 aa, Mycobacterium
GRRRPVPGLHWPWVARIGTVVMSWRL

SEQ ID NO: 820151 - protein, 17 aa, Mycobacterium
GRRRQLRRLLGERVLRI

SEQ ID NO: 820152 - protein, 29 aa, Mycobacterium
GRRRRLRLPQHWPWNHLIDTGWANPAPPE

SEQ ID NO: 820153 - protein, 22 aa, Mycobacterium
GRRSFILVPGIDVPFHSRVLRV

SEQ ID NO: 820154 - protein, 20 aa, Mycobacterium
GRRSFLVRHRFAAPTQILLV

SEQ ID NO: 820155 - protein, 17 aa, Mycobacterium
GRRSLLWRWAGDMRIAF

SEQ ID NO: 820156 - protein, 28 aa, Mycobacterium
GRRSRDLLLDAYLLRAMGIAGWAPALTE

SEQ ID NO: 820157 - protein, 31 aa, Mycobacterium
GRRTVWVPWALRPMFFAMRLLPQFVWRRMPR

SEQ ID NO: 820158 - protein, 18 aa, Mycobacterium
GRRVIFMVTGVLPSEDEI

SEQ ID NO: 820159 - protein, 17 aa, Mycobacterium
GRRVTEIALVFKRAPHL

SEQ ID NO: 820160 - protein, 23 aa, Mycobacterium
GRRVTEIALVFKRAPHLPFDATM

SEQ ID NO: 820161 - protein, 21 aa, Mycobacterium
GRRWPTWPWSDFGLKLQPATD

SEQ ID NO: 820162 - protein, 18 aa, Mycobacterium
GRRWSVVLTNPPFGRKSS

SEQ ID NO: 820163 - protein, 18 aa, Mycobacterium
GRRYIYRARCKVSVDGVE

SEQ ID NO: 820164 - protein, 22 aa, Mycobacterium
GRRYRRQRWCRRADLRRRRGRW

SEQ ID NO: 820165 - protein, 28 aa, Mycobacterium
GRSAEYLFRLALPMGIYGGTLDVFRNMI

SEQ ID NO: 820166 - protein, 22 aa, Mycobacterium
GRSEAILFALRASLAAAGDDSL

SEQ ID NO: 820167 - protein, 26 aa, Mycobacterium
GRSELLSTVWRFAFEDPLTGIANRRA

SEQ ID NO: 820168 - protein, 24 aa, Mycobacterium
GRSFSDFPTILQSISERLGKLPGD

SEQ ID NO: 820169 - protein, 25 aa, Mycobacterium
GRSFSDFPTILRSISGRLGPLPEDT

SEQ ID NO: 820170 - protein, 32 aa, Mycobacterium
GRSGAIPAIIAEYLGLPQLTHLRKLTVEGGVV

SEQ ID NO: 820171 - protein, 33 aa, Mycobacterium
GRSGEPFPYPVTVGYMYIMKLHHLVDDKIHARS

SEQ ID NO: 820172 - protein, 27 aa, Mycobacterium
GRSHAWIQAWTGGWWHYDPTNDTEISE

SEQ ID NO: 820173 - protein, 18 aa, Mycobacterium
GRSIGVPGIVRLLDVVHR

SEQ ID NO: 820174 - protein, 25 aa, Mycobacterium
GRSKIEIIRLLKRAVAREVFRLLSQ

SEQ ID NO: 820175 - protein, 26 aa, Mycobacterium
GRSLILAKLWMRGYRRMLLVRINSGP

SEQ ID NO: 820176 - protein, 23 aa, Mycobacterium
GRSLVGPLDWAVELDERWVIIGP

SEQ ID NO: 820177 - protein, 23 aa, Mycobacterium
GRSLVVFQPHLYSRTKEFAELFG

SEQ ID NO: 820178 - protein, 24 aa, Mycobacterium
GRSPLLERTFDWLDANWPHEAAAR

SEQ ID NO: 820179 - protein, 32 aa, Mycobacterium
GRSPVVARGWRTPLRFLFIDGGHTEEAAQRDF

SEQ ID NO: 820180 - protein, 33 aa, Mycobacterium
GRSPWPAWRAHPLLFPFLHGRPGGLLRLQVPVA

SEQ ID NO: 820181 - protein, 18 aa, Mycobacterium
GRSQWAPIIFGCQAPDTG

SEQ ID NO: 820182 - protein, 28 aa, Mycobacterium
GRSRERGYAYFLYPPNKPLTETAYDRLA

SEQ ID NO: 820183 - protein, 25 aa, Mycobacterium
GRSRRFYQELLGFGFWWEADVPDAG

SEQ ID NO: 820184 - protein, 24 aa, Mycobacterium
GRSSRQWLRHIYETWSRTLDFDVP

SEQ ID NO: 820185 - protein, 27 aa, Mycobacterium
GRSTLWHHWNELDPAERHRLLLDLVCR

SEQ ID NO: 820186 - protein, 18 aa, Mycobacterium
GRSVARMEAALSAPSIFG

SEQ ID NO: 820187 - protein, 22 aa, Mycobacterium
GRSWHLHQVPAFRAAGYRTITF

SEQ ID NO: 820188 - protein, 20 aa, Mycobacterium
GRSWWEQELLTMRQANAAAA

SEQ ID NO: 820189 - protein, 24 aa, Mycobacterium
GRSYSDFPTILQSISERLGKLPGE

SEQ ID NO: 820190 - protein, 24 aa, Mycobacterium
GRSYSDFPTILQSISGRLGTLPGD

SEQ ID NO: 820191 - protein, 24 aa, Mycobacterium
GRTALLLTLAGRMRPTSGRLSVLG

SEQ ID NO: 820192 - protein, 21 aa, Mycobacterium
GRTDAVLWDLERPDPALLTQG

SEQ ID NO: 820193 - protein, 24 aa, Mycobacterium
GRTDKLEIYPNLWAGVGLVRGGAG

SEQ ID NO: 820194 - protein, 25 aa, Mycobacterium
GRTDRRGRMLWSLPKGHIELGETAE

SEQ ID NO: 820195 - protein, 24 aa, Mycobacterium
GRTELAMSVFGRSYGRYVSGKVFK

SEQ ID NO: 820196 - protein, 21 aa, Mycobacterium
GRTFAAAPNFAFELAAERGLP

SEQ ID NO: 820197 - protein, 27 aa, Mycobacterium
GRTFDVPACFIWRVEQGLITHARDYLG

SEQ ID NO: 820198 - protein, 45 aa, Mycobacterium
GRTGEFLEWFLGNVPITPIWVCPLRLRHPSGWPLYPIQPDRTYVN

SEQ ID NO: 820199 - protein, 24 aa, Mycobacterium
GRTGVFWIREMLPIGELREILSAA

SEQ ID NO: 820200 - protein, 21 aa, Mycobacterium
GRTILRLGIAFLKEARKHSHA

SEQ ID NO: 820201 - protein, 21 aa, Mycobacterium
GRTKVPWREGFRRMTAARHPE

SEQ ID NO: 820202 - protein, 20 aa, Mycobacterium
GRTKVTFRLAYEAPGGLLGL

SEQ ID NO: 820203 - protein, 27 aa, Mycobacterium
GRTKYEELFVVWGEVSRLLRDRGYTIV

SEQ ID NO: 820204 - protein, 21 aa, Mycobacterium
GRTLEMTLADNGIDPLPVWNR

SEQ ID NO: 820205 - protein, 32 aa, Mycobacterium
GRTLGDSWYRIPAFYFACPATVLGPYDDAPTA

SEQ ID NO: 820206 - protein, 18 aa, Mycobacterium
GRTLITESRLGLVQAAAG

SEQ ID NO: 820207 - protein, 19 aa, Mycobacterium
GRTLLLGSPSLLRQEKVRV

SEQ ID NO: 820208 - protein, 17 aa, Mycobacterium
GRTLTSYPSIRTDLRNA

SEQ ID NO: 820209 - protein, 21 aa, Mycobacterium
GRTLTYLTYGDPGGLPVIFSH

SEQ ID NO: 820210 - protein, 32 aa, Mycobacterium
GRTPDLPGMGSLLLPPWTLTRYAPDGVEMRGS

SEQ ID NO: 820211 - protein, 32 aa, Mycobacterium
GRTPDLPGMGSLLLPPWTLTRYAPDGVEMTGH

SEQ ID NO: 820212 - protein, 26 aa, Mycobacterium
GRTPSAVVYLIKLGGPLDARKVISEH

SEQ ID NO: 820213 - protein, 26 aa, Mycobacterium
GRTRDLGYPLPLSRRRLRALGQDVRQ

SEQ ID NO: 820214 - protein, 17 aa, Mycobacterium
GRTRLIDNIAIDIGASA

SEQ ID NO: 820215 - protein, 23 aa, Mycobacterium
GRTSFDLIPAMSLTCAVSSVKPV

SEQ ID NO: 820216 - protein, 27 aa, Mycobacterium
GRTTLRLLPRFDTTTYGELWSRTTSVA

SEQ ID NO: 820217 - protein, 18 aa, Mycobacterium
GRTVGVLANNPLRLGGCL

SEQ ID NO: 820218 - protein, 27 aa, Mycobacterium
GRTVPGGWWPPLMLEPGWVSDNHSRFD

SEQ ID NO: 820219 - protein, 27 aa, Mycobacterium
GRTVSPVDFWQYPTVDSLAKFLTGGEV

SEQ ID NO: 820220 - protein, 28 aa, Mycobacterium
GRTVTRLLPRFDTLTYAQVWSRVQAVAA

SEQ ID NO: 820221 - protein, 20 aa, Mycobacterium
GRTWHPHQVPAFLAAGYRCI

SEQ ID NO: 820222 - protein, 21 aa, Mycobacterium
GRTWQPHQVPAFLAAGYRCIT

SEQ ID NO: 820223 - protein, 19 aa, Mycobacterium
GRVAFAWRAMDAFYEEEER

SEQ ID NO: 820224 - protein, 20 aa, Mycobacterium
GRVDFGLGAGWFSEEHEAYA

SEQ ID NO: 820225 - protein, 26 aa, Mycobacterium
GRVDPDGTVWLITASGERTIGSWQAG

SEQ ID NO: 820226 - protein, 27 aa, Mycobacterium
GRVDPDGTVWLITGSGERVIGAWQAGD

SEQ ID NO: 820227 - protein, 25 aa, Mycobacterium
GRVDRRGRMLWSLPKGHIEMGETAE

SEQ ID NO: 820228 - protein, 25 aa, Mycobacterium
GRVDWAVHVALWQAGQLVAGAVALP

SEQ ID NO: 820229 - protein, 24 aa, Mycobacterium
GRVELGLGAGWFEAEHKAYAIPFP

SEQ ID NO: 820230 - protein, 20 aa, Mycobacterium
GRVFEWVMASYAAVAALGAL

SEQ ID NO: 820231 - protein, 26 aa, Mycobacterium
GRVFNPGWHLAIDMRNMLLVSECVAK

SEQ ID NO: 820232 - protein, 34 aa, Mycobacterium
GRVFRFPAWAFDRVLMPVIVRWGIYRGVRAGGSR

SEQ ID NO: 820233 - protein, 24 aa, Mycobacterium
GRVGAKLGIVPRTIDAMVAAGAQV

SEQ ID NO: 820234 - protein, 25 aa, Mycobacterium
GRVGAQIGIVPRTLEAMLAAGAHVE

SEQ ID NO: 820235 - protein, 23 aa, Mycobacterium
GRVHGVWLWTGSTAPHTVPPAEG

SEQ ID NO: 820236 - protein, 17 aa, Mycobacterium
GRVHGWARFARFHLGRN

SEQ ID NO: 820237 - protein, 17 aa, Mycobacterium
GRVIFVRDALPGERVRV

SEQ ID NO: 820238 - protein, 25 aa, Mycobacterium
GRVIGQWTVFPRVSAVHLYRIPAEE

SEQ ID NO: 820239 - protein, 23 aa, Mycobacterium
GRVKAWKGIRYAAAPVGDLRFRA

SEQ ID NO: 820240 - protein, 32 aa, Mycobacterium
GRVLADTWYRIPAFYFACPATVLGPYDDAPTA

SEQ ID NO: 820241 - protein, 33 aa, Mycobacterium
GRVLAGMLAPRKLRSIVVLALPRGGIPVGREIA

SEQ ID NO: 820242 - protein, 19 aa, Mycobacterium
GRVLLTRRALGKKTWPGVW

SEQ ID NO: 820243 - protein, 21 aa, Mycobacterium
GRVMALLRDEGARTKSVVVVR

SEQ ID NO: 820244 - protein, 25 aa, Mycobacterium
GRVMEPTVLPSRFPNLLANGSGGIA

SEQ ID NO: 820245 - protein, 19 aa, Mycobacterium
GRVMWTYEQVAYSAILKHV

SEQ ID NO: 820246 - protein, 17 aa, Mycobacterium
GRVQLRLQRPIMFDPYR

SEQ ID NO: 820247 - protein, 30 aa, Mycobacterium
GRVRLVEFAARRPFHPSRLHAAVDLLLEGV

SEQ ID NO: 820248 - protein, 32 aa, Mycobacterium
GRVRRCGMVSPTVFWPIPRVYSGLVRIDRYET

SEQ ID NO: 820249 - protein, 23 aa, Mycobacterium
GRVRVHSLLSWVAAALTKKPDFV

SEQ ID NO: 820250 - protein, 19 aa, Mycobacterium
GRVTWPPIAGGAHALPFVV

SEQ ID NO: 820251 - protein, 18 aa, Mycobacterium
GRVVALDAGLPITVPGMQ

SEQ ID NO: 820252 - protein, 20 aa, Mycobacterium
GRVVAPHRLTDPKAGPLIAV

SEQ ID NO: 820253 - protein, 24 aa, Mycobacterium
GRVVHIHLGLYGAFTEWPVPAELA

SEQ ID NO: 820254 - protein, 31 aa, Mycobacterium
GRVVLAGHPAHLLLQLGRPVDHHAVAALIGH

SEQ ID NO: 820255 - protein, 25 aa, Mycobacterium
GRVVLLTFDHAVAFDLLRSDDFQVS

SEQ ID NO: 820256 - protein, 26 aa, Mycobacterium
GRWAEVHGYPLMPIDGILVGTAAMAT

SEQ ID NO: 820257 - protein, 27 aa, Mycobacterium
GRWAQSYGFPLMPIDGILVGTAAMATL

SEQ ID NO: 820258 - protein, 22 aa, Mycobacterium
GRWEKPFLAIFGARDPILGQAD

SEQ ID NO: 820259 - protein, 19 aa, Mycobacterium
GRWGGVISGDRVSVSFGKC

SEQ ID NO: 820260 - protein, 28 aa, Mycobacterium
GRWNVPKKLTTFTLWGTGVLDLRYADFT

SEQ ID NO: 820261 - protein, 18 aa, Mycobacterium
GRYAIHELALTPDDVPEE

SEQ ID NO: 820262 - protein, 19 aa, Mycobacterium
GRYDGVLVLVPNPDGFQDI

SEQ ID NO: 820263 - protein, 19 aa, Mycobacterium
GRYFSVPGPFLCEPSPQRT

SEQ ID NO: 820264 - protein, 31 aa, Mycobacterium
GRYHSIWLPDHMVSFWPDSIWTPEFTDLAVA

SEQ ID NO: 820265 - protein, 25 aa, Mycobacterium
GRYIACAALEEKFWQRLVTLVGLDK

SEQ ID NO: 820266 - protein, 24 aa, Mycobacterium
GRYIPNLVPRPFTLDRDFIQEIRD

SEQ ID NO: 820267 - protein, 26 aa, Mycobacterium
GRYKAWQETAFQYAWLLAAADRHRDR

SEQ ID NO: 820268 - protein, 17 aa, Mycobacterium
GRYLALEWLERMDLVDG

SEQ ID NO: 820269 - protein, 29 aa, Mycobacterium
GRYLALEWLERMDLVDGKVICLVRARSDD

SEQ ID NO: 820270 - protein, 24 aa, Mycobacterium
GRYLALEWLERMDLVDGRVIALVR

SEQ ID NO: 820271 - protein, 22 aa, Mycobacterium
GRYLPALAGTPIDRAELRNLGT

SEQ ID NO: 820272 - protein, 19 aa, Mycobacterium
GRYLRLRRQFDGIVTNLIA

SEQ ID NO: 820273 - protein, 31 aa, Mycobacterium
GRYPEKRSALLPLLHLVQAQDSYLTPAGLEF

SEQ ID NO: 820274 - protein, 20 aa, Mycobacterium
GRYRLIVARACPWANRAIIV

SEQ ID NO: 820275 - protein, 21 aa, Mycobacterium
GRYRLIVARACPWANRAIIVR

SEQ ID NO: 820276 - protein, 20 aa, Mycobacterium
GRYRLIVARACPWANRTIIV

SEQ ID NO: 820277 - protein, 32 aa, Mycobacterium
GRYRLKCVMAERIRVLEWLPDDPYPRAVMQEW

SEQ ID NO: 820278 - protein, 22 aa, Mycobacterium
GRYRTRLRPGVLEAGISIPTTG

SEQ ID NO: 820279 - protein, 18 aa, Mycobacterium
GRYSAFTRMPLGGGDDPE

SEQ ID NO: 820280 - protein, 19 aa, Mycobacterium
GSAAARILRHSPVPTMIVP

SEQ ID NO: 820281 - protein, 24 aa, Mycobacterium
GSAAELLLAMVRRVPVADTGIEVF

SEQ ID NO: 820282 - protein, 22 aa, Mycobacterium
GSAAEVLAWTAALRSEPIAGLV

SEQ ID NO: 820283 - protein, 28 aa, Mycobacterium
GSAALFSWGLNYLVALGLRPPPPQRYPL

SEQ ID NO: 820284 - protein, 23 aa, Mycobacterium
GSAALPVPVFDGLAALTGHQPIE

SEQ ID NO: 820285 - protein, 18 aa, Mycobacterium
GSAARKFGFYDADREAAA

SEQ ID NO: 820286 - protein, 29 aa, Mycobacterium
GSADKMRAGMLALLSYARAGDVVVVAALE

SEQ ID NO: 820287 - protein, 18 aa, Mycobacterium
GSADLRRWLPLDVGRPLR

SEQ ID NO: 820288 - protein, 19 aa, Mycobacterium
GSADYKRHLARELTIRTMR

SEQ ID NO: 820289 - protein, 25 aa, Mycobacterium
GSAEYKRHLASELTIRTLRTATQRV

SEQ ID NO: 820290 - protein, 26 aa, Mycobacterium
GSAFKGPIWLIDGYAGPGWYQSDDNT

SEQ ID NO: 820291 - protein, 27 aa, Mycobacterium
GSAFVDAWLLRACAKLGIRLVHSAPGR

SEQ ID NO: 820292 - protein, 26 aa, Mycobacterium
GSAGILPITWAYIALMGPDGLATATK

SEQ ID NO: 820293 - protein, 21 aa, Mycobacterium
GSAGLFFGTGGAGGDGGATLI

SEQ ID NO: 820294 - protein, 21 aa, Mycobacterium
GSAGLLFSGAGAGGAGGVGLS

SEQ ID NO: 820295 - protein, 24 aa, Mycobacterium
GSAKNPMWYLNLKANPKVGVQIKK

SEQ ID NO: 820296 - protein, 24 aa, Mycobacterium
GSAKWWANRVDALPFHLVQAHDDP

SEQ ID NO: 820297 - protein, 21 aa, Mycobacterium
GSALCPVAVIQSPAGAAGAPK

SEQ ID NO: 820298 - protein, 24 aa, Mycobacterium
GSALLFPNLCVPTGGLPPIVGTAG

SEQ ID NO: 820299 - protein, 18 aa, Mycobacterium
GSALLPRILKRTDSTAIC

SEQ ID NO: 820300 - protein, 26 aa, Mycobacterium
GSALVPSWTAFAVIGLLEQHFGRLVD

SEQ ID NO: 820301 - protein, 23 aa, Mycobacterium
GSALVPSWVAFAVTGLLEQHFGH

SEQ ID NO: 820302 - protein, 17 aa, Mycobacterium
GSALWPNWTPAPLTRRV

SEQ ID NO: 820303 - protein, 24 aa, Mycobacterium
GSAMKLHFLFTHFDQVEGVNLPTF

SEQ ID NO: 820304 - protein, 24 aa, Mycobacterium
GSANVGVWVSSAQQWAWLVHTLTV

SEQ ID NO: 820305 - protein, 17 aa, Mycobacterium
GSAPANWAGLLDAATSA

SEQ ID NO: 820306 - protein, 26 aa, Mycobacterium
GSAPDGPGFWFPPTVLTPSRDDRTVS

SEQ ID NO: 820307 - protein, 19 aa, Mycobacterium
GSAPFEDLSHDDWARMLRV

SEQ ID NO: 820308 - protein, 31 aa, Mycobacterium
GSAPFIAMTVFARGLLNRLFTRVYLPGEHVA

SEQ ID NO: 820309 - protein, 19 aa, Mycobacterium
GSAPLLAAVAAWDGLAAEL

SEQ ID NO: 820310 - protein, 24 aa, Mycobacterium
GSAPMLQAAAAWDGLAEELGTAAQ

SEQ ID NO: 820311 - protein, 27 aa, Mycobacterium
GSAPQGPGFWFPPTVLTPARDDRTVVE

SEQ ID NO: 820312 - protein, 23 aa, Mycobacterium
GSAPSSMPLSGVGGYAPVASQAC

SEQ ID NO: 820313 - protein, 18 aa, Mycobacterium
GSAQLLPEAVAGRGLVYA

SEQ ID NO: 820314 - protein, 25 aa, Mycobacterium
GSARKLAMEFARFLGLPPMQPRMNV

SEQ ID NO: 820315 - protein, 25 aa, Mycobacterium
GSARPPILDLVLPSAAGEATGDSEL

SEQ ID NO: 820316 - protein, 27 aa, Mycobacterium
GSASMMAAAWAWNLLAAELDSAANDYD

SEQ ID NO: 820317 - protein, 17 aa, Mycobacterium
GSASMMAAAWAWNMLAA

SEQ ID NO: 820318 - protein, 18 aa, Mycobacterium
GSATLFDRVGAFGTGLVT

SEQ ID NO: 820319 - protein, 22 aa, Mycobacterium
GSATLYQAFSSPVSLSLTSLTP

SEQ ID NO: 820320 - protein, 26 aa, Mycobacterium
GSAVDSPWVWVLDPVDGTFNYAAGSP

SEQ ID NO: 820321 - protein, 25 aa, Mycobacterium
GSAVLMEMMWSFRANGMWSDERGTN

SEQ ID NO: 820322 - protein, 21 aa, Mycobacterium
GSAVQRVPFARALRAAQRHDY

SEQ ID NO: 820323 - protein, 26 aa, Mycobacterium
GSAVTMFIPAFLRYDLREVNGEWRIG

SEQ ID NO: 820324 - protein, 17 aa, Mycobacterium
GSAWELWHRGAGEVHLG

SEQ ID NO: 820325 - protein, 22 aa, Mycobacterium
GSAWIKPLFDDLQSTYGKMPQN

SEQ ID NO: 820326 - protein, 19 aa, Mycobacterium
GSCLLLRRNAFDAIGGFDE

SEQ ID NO: 820327 - protein, 35 aa, Mycobacterium
GSCSPRWLHADPWNFWVLRPWSFSVTHADHFVNSI

SEQ ID NO: 820328 - protein, 19 aa, Mycobacterium
GSCVFFLGTLWHGGGANQS

SEQ ID NO: 820329 - protein, 24 aa, Mycobacterium
GSDAFTPLAWWGRETERLRLGTSV

SEQ ID NO: 820330 - protein, 26 aa, Mycobacterium
GSDAFYIAIGGIPPRQGRMPLGHEPA

SEQ ID NO: 820331 - protein, 25 aa, Mycobacterium
GSDAFYITIGGLPPRQGHTPLGHEP

SEQ ID NO: 820332 - protein, 23 aa, Mycobacterium
GSDAPVTVFDPWMSVRAAVNHRT

SEQ ID NO: 820333 - protein, 23 aa, Mycobacterium
GSDAWDRLFSGPRPAELHPFREI

SEQ ID NO: 820334 - protein, 24 aa, Mycobacterium
GSDAWDRLFSGPRPAELHPFVELD

SEQ ID NO: 820335 - protein, 24 aa, Mycobacterium
GSDAWDRLFSGPRPAELHPFVELK

SEQ ID NO: 820336 - protein, 25 aa, Mycobacterium
GSDAWDRLFSGPRPAKLHPFVALHG

SEQ ID NO: 820337 - protein, 22 aa, Mycobacterium
GSDDLWWAIDGGFLSITDTKVS

SEQ ID NO: 820338 - protein, 27 aa, Mycobacterium
GSDDNPASWFWFEGNFQAYEENKVERL

SEQ ID NO: 820339 - protein, 20 aa, Mycobacterium
GSDEMIKFRVASNARRRRED

SEQ ID NO: 820340 - protein, 22 aa, Mycobacterium
GSDFELARGFLLTEGVIAHRDD

SEQ ID NO: 820341 - protein, 19 aa, Mycobacterium
GSDFPRVAALLRSGKDFST

SEQ ID NO: 820342 - protein, 18 aa, Mycobacterium
GSDFVFVNLFRGRVGAPM

SEQ ID NO: 820343 - protein, 23 aa, Mycobacterium
GSDGLPIGLQLMGRPGADATVLG

SEQ ID NO: 820344 - protein, 17 aa, Mycobacterium
GSDGQWRLSPKAMRQLG

SEQ ID NO: 820345 - protein, 25 aa, Mycobacterium
GSDGRRWRLDFAWPGLRVAAEYDGV

SEQ ID NO: 820346 - protein, 24 aa, Mycobacterium
GSDGYIPFENGFLSEILRAQGYNT

SEQ ID NO: 820347 - protein, 24 aa, Mycobacterium
GSDIDLTKLFYNGERRSATEHLGA

SEQ ID NO: 820348 - protein, 25 aa, Mycobacterium
GSDLAGLFRGATGPVSFNVGLANDG

SEQ ID NO: 820349 - protein, 17 aa, Mycobacterium
GSDLIMIETIFDSLNAK

SEQ ID NO: 820350 - protein, 17 aa, Mycobacterium
GSDPHLYRTRARYELTM

SEQ ID NO: 820351 - protein, 27 aa, Mycobacterium
GSDPLSSLAPMLPALGGLGGAAGNPLD

SEQ ID NO: 820352 - protein, 23 aa, Mycobacterium
GSDPLYMLTGVIPATEKALARSG

SEQ ID NO: 820353 - protein, 26 aa, Mycobacterium
GSDPLYMLTGVIPATEKVLSKAGLTL

SEQ ID NO: 820354 - protein, 27 aa, Mycobacterium
GSDPRDWFEVSLIPTTRELTTLGQAPI

SEQ ID NO: 820355 - protein, 24 aa, Mycobacterium
GSDRLDVELALLVCHWYGGSVLQS

SEQ ID NO: 820356 - protein, 21 aa, Mycobacterium
GSDRLRLEAYRRLAAAADDDA

SEQ ID NO: 820357 - protein, 26 aa, Mycobacterium
GSDRRFPYSWNPRYPARIGVMPRDGG

SEQ ID NO: 820358 - protein, 23 aa, Mycobacterium
GSDSLVVIPIPRTSGLARRAAPA

SEQ ID NO: 820359 - protein, 24 aa, Mycobacterium
GSDVSRIRRFAHPVLLERFRAAEL

SEQ ID NO: 820360 - protein, 17 aa, Mycobacterium
GSDYELALLLRDIFTAA

SEQ ID NO: 820361 - protein, 20 aa, Mycobacterium
GSDYLVARRVLPDGSAHVFH

SEQ ID NO: 820362 - protein, 25 aa, Mycobacterium
GSEAPWRLKQNYFIDLRTIRYGKVD

SEQ ID NO: 820363 - protein, 31 aa, Mycobacterium
GSEARVWTFLGPRPAGWWIRRRANEVAVHRA

SEQ ID NO: 820364 - protein, 24 aa, Mycobacterium
GSEAWDRLFSGSRPARLWPFREVR

SEQ ID NO: 820365 - protein, 26 aa, Mycobacterium
GSEDGYLPSPFLLASALAARTQRLAL

SEQ ID NO: 820366 - protein, 23 aa, Mycobacterium
GSEDGYLPSPFLLASAVAARTQR

SEQ ID NO: 820367 - protein, 30 aa, Mycobacterium
GSEDLPARVFLTYFTRKSAFKRFGFHPEGT

SEQ ID NO: 820368 - protein, 18 aa, Mycobacterium
GSEDVLGILLSAIDSRRA

SEQ ID NO: 820369 - protein, 18 aa, Mycobacterium
GSEFIMVTYWAEPCSPSA

SEQ ID NO: 820370 - protein, 23 aa, Mycobacterium
GSEFLVHAWDYAVATGQEFEPMD

SEQ ID NO: 820371 - protein, 23 aa, Mycobacterium
GSEGYFINQFLAPYTNDRTDEFG

SEQ ID NO: 820372 - protein, 19 aa, Mycobacterium
GSEGYLINQFLAPRTNRRT

SEQ ID NO: 820373 - protein, 30 aa, Mycobacterium
GSELAGFFRDATGHAPFNLGLGNIGFGNVG

SEQ ID NO: 820374 - protein, 24 aa, Mycobacterium
GSELVARIAGLDDPAPAGLSALAE

SEQ ID NO: 820375 - protein, 23 aa, Mycobacterium
GSENVLGILLSAIDSRQAVQFRH

SEQ ID NO: 820376 - protein, 24 aa, Mycobacterium
GSEPGFISLNLPTALLAGAGTVDS

SEQ ID NO: 820377 - protein, 44 aa, Mycobacterium
GSEPGKRFWRTGAVSFWVLPPEINSLRMFIGAGSAPMLQAATAW

SEQ ID NO: 820378 - protein, 17 aa, Mycobacterium
GSERARFTPYQKLVILD

SEQ ID NO: 820379 - protein, 22 aa, Mycobacterium
GSERIVPAPVTFVDIAGLVKGA

SEQ ID NO: 820380 - protein, 26 aa, Mycobacterium
GSERLRIWVMRRTTIAFIYTTFFETL

SEQ ID NO: 820381 - protein, 23 aa, Mycobacterium
GSERPWLLIVGLAPAAHGANRTG

SEQ ID NO: 820382 - protein, 34 aa, Mycobacterium
GSEVLIMDYLVHQRRLFPLIAKSYALQFAQNELV

SEQ ID NO: 820383 - protein, 17 aa, Mycobacterium
GSEVWTFNGAIIPNIGL

SEQ ID NO: 820384 - protein, 23 aa, Mycobacterium
GSEYVHAFLRPGQQLRIKGPRNN

SEQ ID NO: 820385 - protein, 19 aa, Mycobacterium
GSFDAQAVLWSWTIDLQTG

SEQ ID NO: 820386 - protein, 25 aa, Mycobacterium
GSFGDKHRLFLRALDGYCEATLHDV

SEQ ID NO: 820387 - protein, 18 aa, Mycobacterium
GSFGLIPDVAHDIDVFRN

SEQ ID NO: 820388 - protein, 24 aa, Mycobacterium
GSFHAPEFTIAWPTGEIGGMGLEG

SEQ ID NO: 820389 - protein, 18 aa, Mycobacterium
GSFLFQYAKTWRTLAKLS

SEQ ID NO: 820390 - protein, 26 aa, Mycobacterium
GSFNNELGHPWTVLRAGRDTDYLILE

SEQ ID NO: 820391 - protein, 22 aa, Mycobacterium
GSFPFFVGPAGAIAKSAFDKLI

SEQ ID NO: 820392 - protein, 18 aa, Mycobacterium
GSFPLQYAKTWRTLAKLS

SEQ ID NO: 820393 - protein, 18 aa, Mycobacterium
GSFPQTVQIRKARAALVA

SEQ ID NO: 820394 - protein, 24 aa, Mycobacterium
GSFRAPQFTIAWPTGEIGGMGLEG

SEQ ID NO: 820395 - protein, 21 aa, Mycobacterium
GSFRAPQFTVAWPTGEIGGMG

SEQ ID NO: 820396 - protein, 18 aa, Mycobacterium
GSFRWASARAHRLAARLV

SEQ ID NO: 820397 - protein, 23 aa, Mycobacterium
GSFRWATARAHRLAARLVELGVD

SEQ ID NO: 820398 - protein, 20 aa, Mycobacterium
GSFTEWSLPPLLPVGQVRMR

SEQ ID NO: 820399 - protein, 24 aa, Mycobacterium
GSFTQFELLLIAALLAQGWAVSIP

SEQ ID NO: 820400 - protein, 19 aa, Mycobacterium
GSFTTRGWISLRGKTVVII

SEQ ID NO: 820401 - protein, 26 aa, Mycobacterium
GSGAALALPVLRAAVATLSSMATFTQ

SEQ ID NO: 820402 - protein, 25 aa, Mycobacterium
GSGAALGLFGGTGGNGGLLFGNGGT

SEQ ID NO: 820403 - protein, 27 aa, Mycobacterium
GSGADALWFVPLLAQDALDKLELGLGR

SEQ ID NO: 820404 - protein, 28 aa, Mycobacterium
GSGAGVPVLPATWPLQVVGSTSGSGVSP

SEQ ID NO: 820405 - protein, 23 aa, Mycobacterium
GSGAIGWYFGNPGAFSYSHVLWL

SEQ ID NO: 820406 - protein, 35 aa, Mycobacterium
GSGAPAGWGWVAPYIGMIWPNGDPAKLRAAAAAWT

SEQ ID NO: 820407 - protein, 33 aa, Mycobacterium
GSGAPAGWSWVAPYIGMIWPTGDSAKLRAAAAA

SEQ ID NO: 820408 - protein, 31 aa, Mycobacterium
GSGARSIAGMRPWDDPWGRPFLDRRRTETRS

SEQ ID NO: 820409 - protein, 30 aa, Mycobacterium
GSGASAFNGFLNLAIGLTDGVMASAGPGNF

SEQ ID NO: 820410 - protein, 24 aa, Mycobacterium
GSGATLGPGLMGPGAVQAAAEPAV

SEQ ID NO: 820411 - protein, 35 aa, Mycobacterium
GSGDFPGEPWQVPKFYWAVMADSAFEAGWRALDRG

SEQ ID NO: 820412 - protein, 35 aa, Mycobacterium
GSGDLDVDWLADGWLPLLHKWFDLAVASGIPEPNA

SEQ ID NO: 820413 - protein, 25 aa, Mycobacterium
GSGDLLVTVKVAVPPNLEGAAKEAL

SEQ ID NO: 820414 - protein, 24 aa, Mycobacterium
GSGDLLVTVKVAVPPNLEGVAEEA

SEQ ID NO: 820415 - protein, 24 aa, Mycobacterium
GSGDTFLFTQYLSKQDPDGWGKSP

SEQ ID NO: 820416 - protein, 24 aa, Mycobacterium
GSGDVLMVAWMDDDALDRTLKTRE

SEQ ID NO: 820417 - protein, 24 aa, Mycobacterium
GSGELLDVVWSPISLPGNGVGQGV

SEQ ID NO: 820418 - protein, 21 aa, Mycobacterium
GSGFTYWPDGPLKAPKRVLPP

SEQ ID NO: 820419 - protein, 25 aa, Mycobacterium
GSGFTYWPHGPLKAPQRILPPINNR

SEQ ID NO: 820420 - protein, 17 aa, Mycobacterium
GSGFYRTDSREATKKSK

SEQ ID NO: 820421 - protein, 24 aa, Mycobacterium
GSGGAGGLLFSPGGAGGDGGAGFS

SEQ ID NO: 820422 - protein, 26 aa, Mycobacterium
GSGGAGTYISPSGRLTVEEFAGGVGG

SEQ ID NO: 820423 - protein, 22 aa, Mycobacterium
GSGGLFGAGGLGGAGGFGGSAG

SEQ ID NO: 820424 - protein, 19 aa, Mycobacterium
GSGGLLMGIGGAGGAGGVG

SEQ ID NO: 820425 - protein, 24 aa, Mycobacterium
GSGGNAAWLFGDGGAGGSGGSSDT

SEQ ID NO: 820426 - protein, 24 aa, Mycobacterium
GSGGSGGFLPGGAGVAGLIGDGGA

SEQ ID NO: 820427 - protein, 19 aa, Mycobacterium
GSGGWFHRADYPKMAMSDA

SEQ ID NO: 820428 - protein, 25 aa, Mycobacterium
GSGGYGPLVGGWGGDGGAGGDGGGA

SEQ ID NO: 820429 - protein, 30 aa, Mycobacterium
GSGGYSLTAVFSNALNLPMNAKVKLAGADV

SEQ ID NO: 820430 - protein, 24 aa, Mycobacterium
GSGHFLLGGFQRLLDRWHKQFPAL

SEQ ID NO: 820431 - protein, 21 aa, Mycobacterium
GSGIILTADGLILTNNHVVAA

SEQ ID NO: 820432 - protein, 26 aa, Mycobacterium
GSGITPVFSLLRTALVSGTRGARLFY

SEQ ID NO: 820433 - protein, 24 aa, Mycobacterium
GSGKRTYELLPDGRLHVIAGGPHG

SEQ ID NO: 820434 - protein, 24 aa, Mycobacterium
GSGKSTLFNLLTGAIKPGGGSIEL

SEQ ID NO: 820435 - protein, 19 aa, Mycobacterium
GSGKSTLLRLCNRLEVPTS

SEQ ID NO: 820436 - protein, 20 aa, Mycobacterium
GSGKSTLLRLCNRLEVPTSG

SEQ ID NO: 820437 - protein, 28 aa, Mycobacterium
GSGKSTMLQVILGLLPVASGSVRVLDGR

SEQ ID NO: 820438 - protein, 24 aa, Mycobacterium
GSGKTLAFSIPLVSRLDAGDRRPG

SEQ ID NO: 820439 - protein, 23 aa, Mycobacterium
GSGKTLAFSLPMVSRLAGRPRRP

SEQ ID NO: 820440 - protein, 18 aa, Mycobacterium
GSGKWLLVSISDTADMLA

SEQ ID NO: 820441 - protein, 28 aa, Mycobacterium
GSGLGLRLELGGRALFGPVGSAAARAVK

SEQ ID NO: 820442 - protein, 21 aa, Mycobacterium
GSGLGQWNFGPGRDSFVEVGQ

SEQ ID NO: 820443 - protein, 24 aa, Mycobacterium
GSGNFGDHNVGFGNAGLAGAGGNG

SEQ ID NO: 820444 - protein, 19 aa, Mycobacterium
GSGPEHIGWGPAAWNYRAQ

SEQ ID NO: 820445 - protein, 25 aa, Mycobacterium
GSGPLLAAAAAWDALAGELGSAVAS

SEQ ID NO: 820446 - protein, 33 aa, Mycobacterium
GSGPRPGRLLPAFVELLIATGCRPNEVLATRWC

SEQ ID NO: 820447 - protein, 31 aa, Mycobacterium
GSGPRSIAGMRPYDLPWGRPLLGVRRDTTHR

SEQ ID NO: 820448 - protein, 20 aa, Mycobacterium
GSGPTTLRLFGRVGGDGGDG

SEQ ID NO: 820449 - protein, 23 aa, Mycobacterium
GSGRWPGRPLGSVSSGLLRYAHC

SEQ ID NO: 820450 - protein, 24 aa, Mycobacterium
GSGRWVPEFLSLPIAIENSLKNQT

SEQ ID NO: 820451 - protein, 18 aa, Mycobacterium
GSGSSRDWAAKGTLLLGV

SEQ ID NO: 820452 - protein, 25 aa, Mycobacterium
GSGTGFLLPALGRPNLTLHARTRVA

SEQ ID NO: 820453 - protein, 34 aa, Mycobacterium
GSGVRSIAGMRPYDPPWGRPLLGVRRALTHAACA

SEQ ID NO: 820454 - protein, 22 aa, Mycobacterium
GSHAPPWPGLGAYGVSKAALER

SEQ ID NO: 820455 - protein, 23 aa, Mycobacterium
GSHAQYVRVPFADANCFAIPGDI

SEQ ID NO: 820456 - protein, 23 aa, Mycobacterium
GSHAQYVRVPFADANCFVIPGDI

SEQ ID NO: 820457 - protein, 21 aa, Mycobacterium
GSHGWGYDGVLWYSVHEPYGG

SEQ ID NO: 820458 - protein, 21 aa, Mycobacterium
GSHILLFVRESKTNALGTSPY

SEQ ID NO: 820459 - protein, 19 aa, Mycobacterium
GSHMVAFPSLWSVIDEATG

SEQ ID NO: 820460 - protein, 18 aa, Mycobacterium
GSHMVAFPSLWSVIDEST

SEQ ID NO: 820461 - protein, 20 aa, Mycobacterium
GSHNWGIGNIGINNIGLGNV

SEQ ID NO: 820462 - protein, 30 aa, Mycobacterium
GSHRATIASTAWLPKLGLPQGFGARPMVRH

SEQ ID NO: 820463 - protein, 22 aa, Mycobacterium
GSHRPADLLDLAKLAWGQRGIT

SEQ ID NO: 820464 - protein, 18 aa, Mycobacterium
GSHSLYWTQKRIIGGDDP

SEQ ID NO: 820465 - protein, 21 aa, Mycobacterium
GSHTARLLLAKNPAGWQEALS

SEQ ID NO: 820466 - protein, 22 aa, Mycobacterium
GSHVFLVVHRLDNLRRSGRIRT

SEQ ID NO: 820467 - protein, 23 aa, Mycobacterium
GSIDRPDAWWRGLRLRVESSPQP

SEQ ID NO: 820468 - protein, 25 aa, Mycobacterium
GSIEPQFFAILVQGLGLDPESVPFQ

SEQ ID NO: 820469 - protein, 25 aa, Mycobacterium
GSIERFFGVLTEHYAGAFPAWLAPV

SEQ ID NO: 820470 - protein, 25 aa, Mycobacterium
GSIERFFGVLTEHYAGAFPAWLSPV

SEQ ID NO: 820471 - protein, 19 aa, Mycobacterium
GSIFCVPVVVAPDALAAVD

SEQ ID NO: 820472 - protein, 38 aa, Mycobacterium
GSIIDPRILLGSLMYIPLLTRMMANLTAWGLSEEKLYN

SEQ ID NO: 820473 - protein, 26 aa, Mycobacterium
GSILDSLFIMGYQLGCQSDVSSGLQL

SEQ ID NO: 820474 - protein, 21 aa, Mycobacterium
GSILLGLYRDDGELQMVGGAA

SEQ ID NO: 820475 - protein, 25 aa, Mycobacterium
GSINADLTFTVANLPRPGQTVLASS

SEQ ID NO: 820476 - protein, 26 aa, Mycobacterium
GSIPVKRLRQAGVLELLLALADESNG

SEQ ID NO: 820477 - protein, 22 aa, Mycobacterium
GSITFDNVAIPKTHVLGAGRGN

SEQ ID NO: 820478 - protein, 32 aa, Mycobacterium
GSIVFNGKPLRRLRRHQITRRGIARTFQNIRL

SEQ ID NO: 820479 - protein, 20 aa, Mycobacterium
GSIVIAYEPVWAIGTGRVAS

SEQ ID NO: 820480 - protein, 26 aa, Mycobacterium
GSIYAGVPIAFTRPVWRVDLFGSTES

SEQ ID NO: 820481 - protein, 28 aa, Mycobacterium
GSIYSGGYWLVPLLKSLGGALGALKESK

SEQ ID NO: 820482 - protein, 22 aa, Mycobacterium
GSIYTFECPLLLGTTAVLMDRW

SEQ ID NO: 820483 - protein, 23 aa, Mycobacterium
GSKATVTDLRWLRERGLAAGIAA

SEQ ID NO: 820484 - protein, 25 aa, Mycobacterium
GSKAWITHGGIADFYNLFARTGEGS

SEQ ID NO: 820485 - protein, 25 aa, Mycobacterium
GSKEELLWEILRSYIDEMLTEAVHI

SEQ ID NO: 820486 - protein, 24 aa, Mycobacterium
GSKERLIEALLDRYLDQIEKRRFA

SEQ ID NO: 820487 - protein, 25 aa, Mycobacterium
GSKGLHLYVPLAQPASSSGAVAVAK

SEQ ID NO: 820488 - protein, 22 aa, Mycobacterium
GSKGLHLYVPLEDPISSRGASV

SEQ ID NO: 820489 - protein, 23 aa, Mycobacterium
GSKLARVLGTPPPPNGAQPSEDP

SEQ ID NO: 820490 - protein, 32 aa, Mycobacterium
GSKLDITKWTFLNTDLAVHVFRVPDGDWIGIR

SEQ ID NO: 820491 - protein, 33 aa, Mycobacterium
GSKPGIGQVILPAAFFAMWATRRMHEVGTTVET

SEQ ID NO: 820492 - protein, 23 aa, Mycobacterium
GSKRLCLDSNYYATFNLPQVRLV

SEQ ID NO: 820493 - protein, 23 aa, Mycobacterium
GSKTVRIKPWRSGNRKINAALYW

SEQ ID NO: 820494 - protein, 29 aa, Mycobacterium
GSKVHEAPAYRWPLVPALALVAAMPALGA

SEQ ID NO: 820495 - protein, 24 aa, Mycobacterium
GSLARLPMILNDGHLRELALTGRD

SEQ ID NO: 820496 - protein, 23 aa, Mycobacterium
GSLARLPYILSDGHLRELALTGK

SEQ ID NO: 820497 - protein, 25 aa, Mycobacterium
GSLARQYFLTLRTIHKLAFPDRFLR

SEQ ID NO: 820498 - protein, 18 aa, Mycobacterium
GSLCQLIAVDKPWVPAAG

SEQ ID NO: 820499 - protein, 22 aa, Mycobacterium
GSLDLNYRREVALGLPGLAEQV

SEQ ID NO: 820500 - protein, 31 aa, Mycobacterium
GSLDTVGMLFSPGYPGFLRGVIAGGAGEFIV

SEQ ID NO: 820501 - protein, 24 aa, Mycobacterium
GSLEHSLAVARRLRAGFIGVNGGA

SEQ ID NO: 820502 - protein, 22 aa, Mycobacterium
GSLGIRVTAIAPSLFATGITSR

SEQ ID NO: 820503 - protein, 26 aa, Mycobacterium
GSLGTRGRMLSLFRDHLGRIDRPRWV

SEQ ID NO: 820504 - protein, 31 aa, Mycobacterium
GSLLLHSYAGPVIWLEKFRMQLRNTTIPLWQ

SEQ ID NO: 820505 - protein, 17 aa, Mycobacterium
GSLLPMPDPIRMASHAH

SEQ ID NO: 820506 - protein, 21 aa, Mycobacterium
GSLLQYRPNLIIVTNIEADHL

SEQ ID NO: 820507 - protein, 28 aa, Mycobacterium
GSLLSARWLRPPSGPGVLLLAAHVLAMD

SEQ ID NO: 820508 - protein, 21 aa, Mycobacterium
GSLLSSMSMAGMAGAAFGAGA

SEQ ID NO: 820509 - protein, 21 aa, Mycobacterium
GSLMVMPGSHRTFYPCVGATP

SEQ ID NO: 820510 - protein, 20 aa, Mycobacterium
GSLPEWLRRWDVRGGQACEE

SEQ ID NO: 820511 - protein, 32 aa, Mycobacterium
GSLQTAGMLFSPGYPGFLRGLAAGGPGEFVVT

SEQ ID NO: 820512 - protein, 23 aa, Mycobacterium
GSLRLDLSQFRELESFAAFASDL

SEQ ID NO: 820513 - protein, 23 aa, Mycobacterium
GSLRLELSQYRELESFAAFASDL

SEQ ID NO: 820514 - protein, 24 aa, Mycobacterium
GSLRPHPSFIPYAASKAGLNAMTE

SEQ ID NO: 820515 - protein, 27 aa, Mycobacterium
GSLRQKNPAITARRRLRMICHGLGRAE

SEQ ID NO: 820516 - protein, 17 aa, Mycobacterium
GSLSALMRGYTADAVLI

SEQ ID NO: 820517 - protein, 22 aa, Mycobacterium
GSLSWDLSWKDAAAPLWTFPRV

SEQ ID NO: 820518 - protein, 27 aa, Mycobacterium
GSLTQAWDALLPARVFAFTAGASVTFS

SEQ ID NO: 820519 - protein, 32 aa, Mycobacterium
GSLTTYIMIPVQDLPMLAPVRAIPFVGEPLAD

SEQ ID NO: 820520 - protein, 24 aa, Mycobacterium
GSLVAFGWFSWRSAIGTAGFDTTG

SEQ ID NO: 820521 - protein, 17 aa, Mycobacterium
GSLYQYFANKDAILHAV

SEQ ID NO: 820522 - protein, 17 aa, Mycobacterium
GSMDPFAALAPASGAKA

SEQ ID NO: 820523 - protein, 26 aa, Mycobacterium
GSMDPYNWFYEMVLERYPGAFEPMDA

SEQ ID NO: 820524 - protein, 17 aa, Mycobacterium
GSMFACEDFGYVPDIIT

SEQ ID NO: 820525 - protein, 21 aa, Mycobacterium
GSMLNLLRWTSARTIKETFVP

SEQ ID NO: 820526 - protein, 24 aa, Mycobacterium
GSMLYVQSLLDEWSFPATDPQVRA

SEQ ID NO: 820527 - protein, 23 aa, Mycobacterium
GSMPIFALYGIPHRDCGSYASGG

SEQ ID NO: 820528 - protein, 25 aa, Mycobacterium
GSMTVLAVNTLYRGPATPGSAAALA

SEQ ID NO: 820529 - protein, 17 aa, Mycobacterium
GSNAEFVVTLLAASRAD

SEQ ID NO: 820530 - protein, 23 aa, Mycobacterium
GSNARIFLQPNKSFRVPSDDEAP

SEQ ID NO: 820531 - protein, 20 aa, Mycobacterium
GSNFLLYPNTVTAVTALEPE

SEQ ID NO: 820532 - protein, 23 aa, Mycobacterium
GSNGAIFGLPSWNLTLEIVEAVD

SEQ ID NO: 820533 - protein, 36 aa, Mycobacterium
GSNHAIDLLLSSWPGKRTLACLPGEYGPNLSAMAAN

SEQ ID NO: 820534 - protein, 28 aa, Mycobacterium
GSNKPFPIASVVKLFIADDLLLQESEGK

SEQ ID NO: 820535 - protein, 26 aa, Mycobacterium
GSNLAGLAFPFLREKIHGRSDPKVIA

SEQ ID NO: 820536 - protein, 26 aa, Mycobacterium
GSNLAGLSFPFLREKIHGRSNPRIVA

SEQ ID NO: 820537 - protein, 20 aa, Mycobacterium
GSNLSGFFLAGDSADRIFNV

SEQ ID NO: 820538 - protein, 31 aa, Mycobacterium
GSNRWPAVHRLDAAHLFRLALENAPTGSRLH

SEQ ID NO: 820539 - protein, 25 aa, Mycobacterium
GSNTQTVLPFTGLNTPLAVAVDSAG

SEQ ID NO: 820540 - protein, 33 aa, Mycobacterium
GSPADFYTAVAVPLPMMVLCELLGVPYADRDEF

SEQ ID NO: 820541 - protein, 19 aa, Mycobacterium
GSPAIAYTCKRCRGNSIRA

SEQ ID NO: 820542 - protein, 18 aa, Mycobacterium
GSPAPVLSLSFFGDYPRN

SEQ ID NO: 820543 - protein, 26 aa, Mycobacterium
GSPDRLRSGWLNGIKHWQVDYSGRGC

SEQ ID NO: 820544 - protein, 22 aa, Mycobacterium
GSPEDIGWAMVYLASDESRYMT

SEQ ID NO: 820545 - protein, 28 aa, Mycobacterium
GSPEHAALFGLPRCEPVYPTPAGLVGAV

SEQ ID NO: 820546 - protein, 25 aa, Mycobacterium
GSPELGLAHIYLPDGLTVPLINYTV

SEQ ID NO: 820547 - protein, 27 aa, Mycobacterium
GSPELPTTVMPFILRGATLAGIDSVLL

SEQ ID NO: 820548 - protein, 20 aa, Mycobacterium
GSPEWTCMPTPPDTPWPAPM

SEQ ID NO: 820549 - protein, 27 aa, Mycobacterium
GSPHAHNVILLRAKGIPVIVGAGPGVL

SEQ ID NO: 820550 - protein, 33 aa, Mycobacterium
GSPIDRYRYGLIPVALTEWLGYAWVCLSDTPPP

SEQ ID NO: 820551 - protein, 22 aa, Mycobacterium
GSPKILERCTLPLTGVGCVNRI

SEQ ID NO: 820552 - protein, 27 aa, Mycobacterium
GSPLARLAARLFPWRYDRQLLAGIPPE

SEQ ID NO: 820553 - protein, 27 aa, Mycobacterium
GSPLLAGDFVRWCRQALDLLDQVRNAA

SEQ ID NO: 820554 - protein, 25 aa, Mycobacterium
GSPLNLQRWLLPRSIKETFNAPTEY

SEQ ID NO: 820555 - protein, 26 aa, Mycobacterium
GSPLRELAGWPALLRGKLSVTLDLHD

SEQ ID NO: 820556 - protein, 28 aa, Mycobacterium
GSPQGARTIALWEPALLPDLAGENGAPV

SEQ ID NO: 820557 - protein, 26 aa, Mycobacterium
GSPQGIPYRVPFPQSLPSQETTPARG

SEQ ID NO: 820558 - protein, 29 aa, Mycobacterium
GSPQHVGWFRFYFADERWEWSPQVAQMHG

SEQ ID NO: 820559 - protein, 27 aa, Mycobacterium
GSPRKLAMEFARFLGLPTLNQRMNVTD

SEQ ID NO: 820560 - protein, 35 aa, Mycobacterium
GSPRRIIGYANAYDFWNMWRVRPPGLRVIAAGYGS

SEQ ID NO: 820561 - protein, 33 aa, Mycobacterium
GSPTMNFFPATLTSIGLTLPFGEVTLAPEVQQL

SEQ ID NO: 820562 - protein, 26 aa, Mycobacterium
GSPTRFGCVAAQLRNFLDSLGGLWAE

SEQ ID NO: 820563 - protein, 34 aa, Mycobacterium
GSPTRPMSWDRVVDKFWWLAGPFCERALGDEIIA

SEQ ID NO: 820564 - protein, 25 aa, Mycobacterium
GSPVEGDWLLLVELAADHDQTDRLA

SEQ ID NO: 820565 - protein, 19 aa, Mycobacterium
GSPVPIYLAGAEVTGFFGF

SEQ ID NO: 820566 - protein, 26 aa, Mycobacterium
GSPVVQLLRLRLLDGSPAMLERAAFV

SEQ ID NO: 820567 - protein, 30 aa, Mycobacterium
GSPVVWDFRKRLVAGFYAMRQKLAERSAAH

SEQ ID NO: 820568 - protein, 26 aa, Mycobacterium
GSQAGTQGVVWLAGMEATAEPEATTA

SEQ ID NO: 820569 - protein, 20 aa, Mycobacterium
GSQFFITVGPTPHLNRRHTI

SEQ ID NO: 820570 - protein, 24 aa, Mycobacterium
GSQGIRLHAPLPAAGKLSVVSEVA

SEQ ID NO: 820571 - protein, 24 aa, Mycobacterium
GSQGQLVPTIKISPAGTAGGTAVV

SEQ ID NO: 820572 - protein, 21 aa, Mycobacterium
GSQIIARLLIQTGRPLTGLRE

SEQ ID NO: 820573 - protein, 26 aa, Mycobacterium
GSQLDGVNLYRPYLQLVVSAVVPAGD

SEQ ID NO: 820574 - protein, 25 aa, Mycobacterium
GSQLRAALQVNVKIPLVGGKLEKSI

SEQ ID NO: 820575 - protein, 17 aa, Mycobacterium
GSQMLRLCLVEHGEAYV

SEQ ID NO: 820576 - protein, 25 aa, Mycobacterium
GSQSIRLHAPLPPAGKLSVVSEVAD

SEQ ID NO: 820577 - protein, 23 aa, Mycobacterium
GSQVLLIEPFYDSYSPVVAMAGA

SEQ ID NO: 820578 - protein, 24 aa, Mycobacterium
GSQYLGWVREPIRWNHAATAGPGV

SEQ ID NO: 820579 - protein, 29 aa, Mycobacterium
GSRAIGAVPQFEWPLIAAAVARGWAVSIS

SEQ ID NO: 820580 - protein, 22 aa, Mycobacterium
GSRATHIVVWATLDKSKGRAAI

SEQ ID NO: 820581 - protein, 23 aa, Mycobacterium
GSRATHIVVWATLDKSKGRAAIK

SEQ ID NO: 820582 - protein, 22 aa, Mycobacterium
GSRATHIVVWATLDKTKGRPAI

SEQ ID NO: 820583 - protein, 17 aa, Mycobacterium
GSRAWAAMYLGTPTTPE

SEQ ID NO: 820584 - protein, 22 aa, Mycobacterium
GSRDELLAEILWSLAERTLALA

SEQ ID NO: 820585 - protein, 25 aa, Mycobacterium
GSRDFLLHPVMMDIALQTLGATRMA

SEQ ID NO: 820586 - protein, 25 aa, Mycobacterium
GSRDKILTAAWQRALERFQEPFLDQ

SEQ ID NO: 820587 - protein, 24 aa, Mycobacterium
GSRFALTQPVMSAGRHPDSDIYLD

SEQ ID NO: 820588 - protein, 18 aa, Mycobacterium
GSRFLLDQPTTSAGRHPD

SEQ ID NO: 820589 - protein, 24 aa, Mycobacterium
GSRFLVFMQRYTPAVLFISTADQG

SEQ ID NO: 820590 - protein, 25 aa, Mycobacterium
GSRFTLTHFGLFGFAVMSCATLREL

SEQ ID NO: 820591 - protein, 17 aa, Mycobacterium
GSRFVACPSGPPGQRMY

SEQ ID NO: 820592 - protein, 24 aa, Mycobacterium
GSRGWAMNTLFDGIEPLLADLEAA

SEQ ID NO: 820593 - protein, 24 aa, Mycobacterium
GSRIDPVLARSWLLVNGAHGERFQ

SEQ ID NO: 820594 - protein, 23 aa, Mycobacterium
GSRIDPVLARSWLLVNGTHADRF

SEQ ID NO: 820595 - protein, 26 aa, Mycobacterium
GSRIDPVLARSWLLVNGTHPDRFQSA

SEQ ID NO: 820596 - protein, 27 aa, Mycobacterium
GSRIRVLIAGSWFPRYARHLGTDEPTL

SEQ ID NO: 820597 - protein, 26 aa, Mycobacterium
GSRIRVLIAGSWFPRYARNLGTDEPI

SEQ ID NO: 820598 - protein, 23 aa, Mycobacterium
GSRLDCDMLVIAAGIRPNVGLAQ

SEQ ID NO: 820599 - protein, 24 aa, Mycobacterium
GSRLHYLMRLPQPGGDLLFRTSDT

SEQ ID NO: 820600 - protein, 26 aa, Mycobacterium
GSRLQGHPTPVLPWVDVASGSLGQGI

SEQ ID NO: 820601 - protein, 17 aa, Mycobacterium
GSRLVELPGGDALYWVG

SEQ ID NO: 820602 - protein, 17 aa, Mycobacterium
GSRLVELPGSDSLYWVG

SEQ ID NO: 820603 - protein, 26 aa, Mycobacterium
GSRPLRGWQRRAIVKYLAAEPRDFLA

SEQ ID NO: 820604 - protein, 22 aa, Mycobacterium
GSRPPMLDHLLPSAAAQAPGDS

SEQ ID NO: 820605 - protein, 26 aa, Mycobacterium
GSRPQALLLPLGPLAENNIRATFASN

SEQ ID NO: 820606 - protein, 30 aa, Mycobacterium; identical to SEQ ID NO: 114968

SEQ ID NO: 820607 - protein, 17 aa, Mycobacterium
GSRRLDPRLVWQRPAEH

SEQ ID NO: 820608 - protein, 26 aa, Mycobacterium
GSRSGLLTRAWLRAVHRLQTVLTELV

SEQ ID NO: 820609 - protein, 24 aa, Mycobacterium
GSRSRFLRLFPTVVKGTHVELDEV

SEQ ID NO: 820610 - protein, 17 aa, Mycobacterium
GSRTRFGDVLPFLVKVL

SEQ ID NO: 820611 - protein, 36 aa, Mycobacterium
GSRVAVLLPAHWQTAAVLFGIWWIGAEVVLSGEADI

SEQ ID NO: 820612 - protein, 24 aa, Mycobacterium
GSRVELYHHLLDQLVADEARIVGA

SEQ ID NO: 820613 - protein, 17 aa, Mycobacterium
GSRVHLFVRNALAASFD

SEQ ID NO: 820614 - protein, 19 aa, Mycobacterium
GSRVLYVSPLKALAVDVER

SEQ ID NO: 820615 - protein, 22 aa, Mycobacterium
GSRYTQRLIFVPRGVLGRMYRR

SEQ ID NO: 820616 - protein, 25 aa, Mycobacterium
GSRYTVLGPLGLSTLLLTTTGRKSG

SEQ ID NO: 820617 - protein, 20 aa, Mycobacterium
GSRYWDPLATLGYVSARTSR

SEQ ID NO: 820618 - protein, 25 aa, Mycobacterium
GSSAAPLQTVGWTAAAPQTGAGTVV

SEQ ID NO: 820619 - protein, 24 aa, Mycobacterium
GSSALLRLGSAGGPIGLALAGVAT

SEQ ID NO: 820620 - protein, 24 aa, Mycobacterium
GSSDPLIVTWPRGIAARGEVRSQY

SEQ ID NO: 820621 - protein, 26 aa, Mycobacterium
GSSEPPFLPSLDKFVEFVGEGHFDQI

SEQ ID NO: 820622 - protein, 24 aa, Mycobacterium
GSSFPYTQFLPPFGGARGVQIDID

SEQ ID NO: 820623 - protein, 26 aa, Mycobacterium
GSSGTQWILRRPPFGRLQAGAHDVMR

SEQ ID NO: 820624 - protein, 28 aa, Mycobacterium
GSSGVWELFWPDFPTNGLYKFRVHGADG

SEQ ID NO: 820625 - protein, 17 aa, Mycobacterium
GSSILDELTWRGLIAQT

SEQ ID NO: 820626 - protein, 23 aa, Mycobacterium
GSSIRHSIGIWPLVIDDATIVEE

SEQ ID NO: 820627 - protein, 24 aa, Mycobacterium
GSSKHFPFDWRPDGAVPTVSDELA

SEQ ID NO: 820628 - protein, 30 aa, Mycobacterium
GSSLEDWKDWLRWRVIHGRAFLLTDELIAE

SEQ ID NO: 820629 - protein, 22 aa, Mycobacterium
GSSLQVFVLRPCIVAGPEAHAL

SEQ ID NO: 820630 - protein, 23 aa, Mycobacterium
GSSLRGRMALERAAQALALHRMI

SEQ ID NO: 820631 - protein, 26 aa, Mycobacterium
GSSNMQFWAISRLLAPATIATLPRWM

SEQ ID NO: 820632 - protein, 28 aa, Mycobacterium
GSSPDVNYAVRFGFWGAEEEGLLGSTNY

SEQ ID NO: 820633 - protein, 19 aa, Mycobacterium
GSSQFVSGLLLSGAAFSAG

SEQ ID NO: 820634 - protein, 22 aa, Mycobacterium
GSSQFVSGLLLSGAGFENGLTI

SEQ ID NO: 820635 - protein, 27 aa, Mycobacterium
GSSSFYLPRLIGVRRTQELMLTNRALS

SEQ ID NO: 820636 - protein, 32 aa, Mycobacterium
GSSSMAMLQAVQPYLIWLRETAQQAQQMAASA

SEQ ID NO: 820637 - protein, 27 aa, Mycobacterium
GSSSPLVNVYGWMQTRGPRRAVLENAS

SEQ ID NO: 820638 - protein, 23 aa, Mycobacterium
GSSVFKPMYLFRGDVPVREFAQV

SEQ ID NO: 820639 - protein, 29 aa, Mycobacterium
GSSVLIQMMWAMRGLGMWSDARGTNMLDG

SEQ ID NO: 820640 - protein, 27 aa, Mycobacterium
GSSVLSMMMWSFRGMGMWSDERGVNML

SEQ ID NO: 820641 - protein, 29 aa, Mycobacterium
GSSVLVQMMWAMRGIGIWSDVRGTNMLDG

SEQ ID NO: 820642 - protein, 26 aa, Mycobacterium
GSTAAMTVLTGLIPAGAEEVSAQAVM

SEQ ID NO: 820643 - protein, 17 aa, Mycobacterium
GSTAARLFYAYADTLLA

SEQ ID NO: 820644 - protein, 24 aa, Mycobacterium
GSTAARLFYAYADTLLALGRRDEA

SEQ ID NO: 820645 - protein, 27 aa, Mycobacterium
GSTAARLFYAYAETLLALGRRDEALRW

SEQ ID NO: 820646 - protein, 23 aa, Mycobacterium
GSTANWIFVLARTDPVAPKHQGL

SEQ ID NO: 820647 - protein, 34 aa, Mycobacterium
GSTDALRRLALGHWLRRWWPASIREGIAELDPAL

SEQ ID NO: 820648 - protein, 27 aa, Mycobacterium
GSTDVPTLFNLLPGYLAMPHAGQESLA

SEQ ID NO: 820649 - protein, 27 aa, Mycobacterium
GSTDVPTLFNLLPGYLAMPHAGQETLA

SEQ ID NO: 820650 - protein, 26 aa, Mycobacterium
GSTGLGLYPCPPFALLDGQDHWLLRP

SEQ ID NO: 820651 - protein, 22 aa, Mycobacterium
GSTHRPYLTHHPRPGWAEQDPR

SEQ ID NO: 820652 - protein, 18 aa, Mycobacterium
GSTIFPFRRVFVVAVVGG

SEQ ID NO: 820653 - protein, 27 aa, Mycobacterium
GSTLGLRLELGGRPLFGPVGAAAARAV

SEQ ID NO: 820654 - protein, 27 aa, Mycobacterium
GSTLGLRLELGGRPLFGPVGSAAARAV

SEQ ID NO: 820655 - protein, 22 aa, Mycobacterium
GSTLVVPPTPWSAQGMFDVLRD

SEQ ID NO: 820656 - protein, 17 aa, Mycobacterium
GSTMWAVRPPDLDGADC

SEQ ID NO: 820657 - protein, 27 aa, Mycobacterium
GSTNAVLHLLAIAWEAQVELTLADFTR

SEQ ID NO: 820658 - protein, 24 aa, Mycobacterium
GSTNTGWWNAGSVNDGLFNAGNAN

SEQ ID NO: 820659 - protein, 17 aa, Mycobacterium
GSTPAVMGSPYPGAGQM

SEQ ID NO: 820660 - protein, 24 aa, Mycobacterium
GSTRGWFMDWLAEAYPDLVGEYRR

SEQ ID NO: 820661 - protein, 23 aa, Mycobacterium
GSTRGWFMSWLGRSHPELVAPYR

SEQ ID NO: 820662 - protein, 27 aa, Mycobacterium
GSTRITLWSHAWLARTQFSLGEWDAAL

SEQ ID NO: 820663 - protein, 21 aa, Mycobacterium
GSTRLLDNVPIEIGPTGPTDP

SEQ ID NO: 820664 - protein, 34 aa, Mycobacterium
GSTTLLVTDLAGGWIPPHVRLTANVTLLEPTARR

SEQ ID NO: 820665 - protein, 35 aa, Mycobacterium
GSTTPLRRLALGHWLRRWWPASQRDGIAGLDRALL

SEQ ID NO: 820666 - protein, 20 aa, Mycobacterium
GSTVLLLFAAGNRDPAQFKH

SEQ ID NO: 820667 - protein, 27 aa, Mycobacterium
GSTVRLPRQMPYPLAMELLLTADMVDA

SEQ ID NO: 820668 - protein, 26 aa, Mycobacterium
GSVALTPIMRWFNSVASLVAGLHQTV

SEQ ID NO: 820669 - protein, 19 aa, Mycobacterium
GSVEHFNWLEALGFEFERT

SEQ ID NO: 820670 - protein, 29 aa, Mycobacterium
GSVEHFNWLEALGFQFERSFYPEKAVIQP

SEQ ID NO: 820671 - protein, 17 aa, Mycobacterium
GSVFVQCRLRPITFDEV

SEQ ID NO: 820672 - protein, 21 aa, Mycobacterium
GSVHPSLWRQCGLNIRQGLYH

SEQ ID NO: 820673 - protein, 25 aa, Mycobacterium
GSVIAGLKLESWLGPAAASMATAAA

SEQ ID NO: 820674 - protein, 23 aa, Mycobacterium
GSVILLVVPMFHANAWGSPYTAA

SEQ ID NO: 820675 - protein, 20 aa, Mycobacterium
GSVIPGHPFTFDSTALIAAR

SEQ ID NO: 820676 - protein, 23 aa, Mycobacterium
GSVKRFATLLSNAKTIFWNGPMG

SEQ ID NO: 820677 - protein, 20 aa, Mycobacterium
GSVLLGIKSSFNVGGGNLGD

SEQ ID NO: 820678 - protein, 21 aa, Mycobacterium
GSVLNLLRWTSARTIKETFVP

SEQ ID NO: 820679 - protein, 21 aa, Mycobacterium
GSVLPLLYGAPAMSAELVDYA

SEQ ID NO: 820680 - protein, 17 aa, Mycobacterium
GSVLYHRYDGHYGLITP

SEQ ID NO: 820681 - protein, 24 aa, Mycobacterium
GSVMLRMPLHPVAIELLREVGPMA

SEQ ID NO: 820682 - protein, 18 aa, Mycobacterium
GSVNADLTFTVDALPRPG

SEQ ID NO: 820683 - protein, 23 aa, Mycobacterium
GSVQLYLQETLTFLSYTAEASVA

SEQ ID NO: 820684 - protein, 31 aa, Mycobacterium; identical to SEQ ID NO: 218858

SEQ ID NO: 820685 - protein, 31 aa, Mycobacterium
GSVRFLMSVGDLVIAWLLQRQAAVAVAALDA

SEQ ID NO: 820686 - protein, 25 aa, Mycobacterium
GSVRFLMSVGDLVIGWLLQQQAAVA

SEQ ID NO: 820687 - protein, 30 aa, Mycobacterium
GSVRFLMSVGDLVIGWLLQRQAAVAVAALD

SEQ ID NO: 820688 - protein, 34 aa, Mycobacterium
GSVRYLLAVGDLIIGWRLLVQAGVAHAALADSPS

SEQ ID NO: 820689 - protein, 34 aa, Mycobacterium
GSVRYLLAVGDLLIGWRLLVQAGVAHAALAEASG

SEQ ID NO: 820690 - protein, 39 aa, Mycobacterium
GSVSKYFSMTGWRLGWMLVPRRFLRAVDRLSSNFTICPP

SEQ ID NO: 820691 - protein, 20 aa, Mycobacterium
GSVSSGLLRYAHCPVAIVHD

SEQ ID NO: 820692 - protein, 18 aa, Mycobacterium
GSVSVLRHAAWAVDELEP

SEQ ID NO: 820693 - protein, 28 aa, Mycobacterium
GSVTNRPPLLKRLVLQTAARLSRRGRRL

SEQ ID NO: 820694 - protein, 29 aa, Mycobacterium
GSVVHRLRALYRDHLLVLAALDLAATVED

SEQ ID NO: 820695 - protein, 26 aa, Mycobacterium
GSVVSALILEPWMGSAAAAMTAAATP

SEQ ID NO: 820696 - protein, 21 aa, Mycobacterium
GSVVTLFRLLAEPDRYRAGII

SEQ ID NO: 820697 - protein, 17 aa, Mycobacterium
GSVWHQRVPERYPEVIV

SEQ ID NO: 820698 - protein, 17 aa, Mycobacterium
GSVWTSLFALPAVRQET

SEQ ID NO: 820699 - protein, 28 aa, Mycobacterium
GSVWYYKFRLPERDPSTGRYPWITKGGF

SEQ ID NO: 820700 - protein, 23 aa, Mycobacterium
GSVYPTLQLLDDEGLIAASASDG

SEQ ID NO: 820701 - protein, 23 aa, Mycobacterium
GSVYPTLQLLDDEGLITAGASDG

SEQ ID NO: 820702 - protein, 23 aa, Mycobacterium
GSVYPTLQLLDDEGLITASESAG

SEQ ID NO: 820703 - protein, 23 aa, Mycobacterium
GSVYPTLQLLVDEGLISGTEAEG

SEQ ID NO: 820704 - protein, 24 aa, Mycobacterium
GSVYPTLQLLVDEGLIVSTEAEGS

SEQ ID NO: 820705 - protein, 18 aa, Mycobacterium
GSWAGMLAAPAAAGWTPA

SEQ ID NO: 820706 - protein, 22 aa, Mycobacterium
GSWKPPQPASFPHRGRGIALMR

SEQ ID NO: 820707 - protein, 22 aa, Mycobacterium
GSWPYGLPELPGGRDALHGTKR

SEQ ID NO: 820708 - protein, 18 aa, Mycobacterium
GSWRAYADHRMAMAGAIV

SEQ ID NO: 820709 - protein, 20 aa, Mycobacterium
GSWVPTFPNARYLVPAADYR

SEQ ID NO: 820710 - protein, 23 aa, Mycobacterium
GSYDTVMWQKVQAKTLFIEQMRR

SEQ ID NO: 820711 - protein, 25 aa, Mycobacterium
GSYEQMWAADVAAMLGYHGGASAAA

SEQ ID NO: 820712 - protein, 21 aa, Mycobacterium
GSYFPDWLLERRKRAERALTT

SEQ ID NO: 820713 - protein, 20 aa, Mycobacterium
GSYFPEWLLERRKRAERALT

SEQ ID NO: 820714 - protein, 17 aa, Mycobacterium
GSYLRYGAYPYAIAVRE

SEQ ID NO: 820715 - protein, 19 aa, Mycobacterium
GSYLWMIEATSAHLSRAIA

SEQ ID NO: 820716 - protein, 22 aa, Mycobacterium
GSYPNRDLLLRNIVRASTAAPH

SEQ ID NO: 820717 - protein, 20 aa, Mycobacterium
GSYQAIAHLLAESLALIEGS

SEQ ID NO: 820718 - protein, 25 aa, Mycobacterium
GSYTGEFLVDLLPRPVRNGKAPAKA

SEQ ID NO: 820719 - protein, 17 aa, Mycobacterium
GSYVFPVQDHCPRCSSA

SEQ ID NO: 820720 - protein, 26 aa, Mycobacterium
GTAAVCWRLRRRYGLPVHDIAPMRVA

SEQ ID NO: 820721 - protein, 23 aa, Mycobacterium
GTADAMLHVLARDMRHLEEALER

SEQ ID NO: 820722 - protein, 26 aa, Mycobacterium
GTADPIPMLTLFDKQIQLRMGQANVK

SEQ ID NO: 820723 - protein, 32 aa, Mycobacterium
GTAEEKLVKICRLIMLYHLDRAWADHLAFLSD

SEQ ID NO: 820724 - protein, 24 aa, Mycobacterium
GTAEIGWAARMGRIPLGYFNDPEA

SEQ ID NO: 820725 - protein, 21 aa, Mycobacterium
GTAELIRLALTTKLKPYTYVS

SEQ ID NO: 820726 - protein, 30 aa, Mycobacterium
GTAESGFPMLPPLMPPPISAGSGWRKRKQQ

SEQ ID NO: 820727 - protein, 20 aa, Mycobacterium
GTAEVPRRSLSPAQVHAILR

SEQ ID NO: 820728 - protein, 30 aa, Mycobacterium
GTAEYKRHLASELTIRTLRTATERVRNIPE

SEQ ID NO: 820729 - protein, 24 aa, Mycobacterium
GTAFAPRPVIYRAMDFRTNEFRGL

SEQ ID NO: 820730 - protein, 18 aa, Mycobacterium
GTAGFLTGFRRAGARRKT

SEQ ID NO: 820731 - protein, 23 aa, Mycobacterium
GTAGFMTGFRRSGARHQALVSTF

SEQ ID NO: 820732 - protein, 33 aa, Mycobacterium
GTAGPLAWDLSWTDTGAPLWTFPRAAWDRELLP

SEQ ID NO: 820733 - protein, 21 aa, Mycobacterium
GTAHRIMTGAPLPFGADTVVP

SEQ ID NO: 820734 - protein, 19 aa, Mycobacterium
GTAKAWLGIRYARAPIGEL

SEQ ID NO: 820735 - protein, 27 aa, Mycobacterium
GTALLCPFDPLIFFRPRVERLFEFHYR

SEQ ID NO: 820736 - protein, 29 aa, Mycobacterium
GTALLCPFDPLIFFRPRVERLFGGFHYRI

SEQ ID NO: 820737 - protein, 20 aa, Mycobacterium
GTALLFPRPTKNIDGQIPLA

SEQ ID NO: 820738 - protein, 28 aa, Mycobacterium
GTALLPGVKILPIVALAEAIRAGAAIKQ

SEQ ID NO: 820739 - protein, 19 aa, Mycobacterium
GTALRLLERKIAQQPPKKH

SEQ ID NO: 820740 - protein, 22 aa, Mycobacterium
GTANSGVPLILLLSLLSFVPLL

SEQ ID NO: 820741 - protein, 24 aa, Mycobacterium
GTAPIERILLRHPGIVEVAVYPIP

SEQ ID NO: 820742 - protein, 21 aa, Mycobacterium
GTAPIERILMRFPGVAEAAVY

SEQ ID NO: 820743 - protein, 21 aa, Mycobacterium
GTAPIERVLLRYPGVVEVAVY

SEQ ID NO: 820744 - protein, 20 aa, Mycobacterium
GTAQLPQMLIFRPAPGLGRA

SEQ ID NO: 820745 - protein, 23 aa, Mycobacterium
GTAQLQQMLIFRPAPGMGRAETP

SEQ ID NO: 820746 - protein, 24 aa, Mycobacterium
GTAQRPIVTAPIGKATLGALSARL

SEQ ID NO: 820747 - protein, 22 aa, Mycobacterium
GTARILTAYGFPALATTSAGLA

SEQ ID NO: 820748 - protein, 24 aa, Mycobacterium
GTASPFDLILADPPYDVSCAEIEA

SEQ ID NO: 820749 - protein, 25 aa, Mycobacterium
GTASWTLIELLRHPEFYAKVQAELD

SEQ ID NO: 820750 - protein, 23 aa, Mycobacterium
GTASWVLIELLRHPDIQSQVIDE

SEQ ID NO: 820751 - protein, 24 aa, Mycobacterium
GTATFPFAPPGWPSPKGRDEVRTY

SEQ ID NO: 820752 - protein, 20 aa, Mycobacterium
GTATIGAQGLAGQTGQTGHT

SEQ ID NO: 820753 - protein, 19 aa, Mycobacterium
GTAVAKQPGRPTGATGLTS

SEQ ID NO: 820754 - protein, 19 aa, Mycobacterium
GTAVALTWALQNPEATVAV

SEQ ID NO: 820755 - protein, 24 aa, Mycobacterium
GTAVAWAREQFGDELLWGIEDCRN

SEQ ID NO: 820756 - protein, 20 aa, Mycobacterium
GTAVEEFIRWATPVMTFRRT

SEQ ID NO: 820757 - protein, 19 aa, Mycobacterium
GTAVRPAAALMLNARKNER

SEQ ID NO: 820758 - protein, 24 aa, Mycobacterium
GTAVTSIPILLSAKGLEPIVYSNT

SEQ ID NO: 820759 - protein, 20 aa, Mycobacterium
GTAVVLPLERELFTFAKEVA

SEQ ID NO: 820760 - protein, 23 aa, Mycobacterium
GTAWAFQQLGVIPDVVAFGKKTQ

SEQ ID NO: 820761 - protein, 23 aa, Mycobacterium
GTAWQVFPNFQIGQGLTSALCYG

SEQ ID NO: 820762 - protein, 23 aa, Mycobacterium
GTAWQVFPNFQIGQGLTSALCYS

SEQ ID NO: 820763 - protein, 25 aa, Mycobacterium
GTCRLPVTLPQIFGLMQAAQQGPAQ

SEQ ID NO: 820764 - protein, 25 aa, Mycobacterium
GTCVPCRKGLFIHCVNGQVPSLSYP

SEQ ID NO: 820765 - protein, 18 aa, Mycobacterium
GTCVVFGGLGLNGSTGLN

SEQ ID NO: 820766 - protein, 23 aa, Mycobacterium
GTDAAPYFRIFNPSAQAEKFDPA

SEQ ID NO: 820767 - protein, 24 aa, Mycobacterium
GTDAWSWDAPFSYTARRYAETHDA

SEQ ID NO: 820768 - protein, 28 aa, Mycobacterium
GTDDAGAAALWFALDTDLPVIVDADGLT

SEQ ID NO: 820769 - protein, 22 aa, Mycobacterium
GTDEWHFLIFFDQPFPADIGYR

SEQ ID NO: 820770 - protein, 25 aa, Mycobacterium
GTDFARPDPDWWFDDDRIYGPSGIS

SEQ ID NO: 820771 - protein, 21 aa, Mycobacterium
GTDFVAVMRRLAAGDGPIDVV

SEQ ID NO: 820772 - protein, 23 aa, Mycobacterium
GTDGRWRIARRVAPDRMISTVDP

SEQ ID NO: 820773 - protein, 25 aa, Mycobacterium
GTDINHAPFFLSINPEILSVDIDIK

SEQ ID NO: 820774 - protein, 24 aa, Mycobacterium
GTDIVLGGNVDYLLDRRLRQRGLD

SEQ ID NO: 820775 - protein, 21 aa, Mycobacterium
GTDLAGWYRNGPDATTFSFGI

SEQ ID NO: 820776 - protein, 28 aa, Mycobacterium
GTDPIALLRRFPLERVAYVHIAGGRFEG

SEQ ID NO: 820777 - protein, 24 aa, Mycobacterium
GTDPKTIVWITAGFRPEHRAALDW

SEQ ID NO: 820778 - protein, 24 aa, Mycobacterium
GTDPRKIFDLLEHAPIGVAVVTNA

SEQ ID NO: 820779 - protein, 24 aa, Mycobacterium
GTDRCGPWIIERAIRDVRGGIEGL

SEQ ID NO: 820780 - protein, 24 aa, Mycobacterium
GTDRIDLYYQHRLDRATPIEDTVG

SEQ ID NO: 820781 - protein, 21 aa, Mycobacterium
GTDRLLQLPKPIGLHATYLVR

SEQ ID NO: 820782 - protein, 28 aa, Mycobacterium
GTDRRGKYLWLLLDSDAALVVHLGMSGQ

SEQ ID NO: 820783 - protein, 24 aa, Mycobacterium
GTDSLEETALWLELTHTGDTPVVI

SEQ ID NO: 820784 - protein, 31 aa, Mycobacterium
GTDTKLRPAWTADLHHFLGTRIAEAVITDPA

SEQ ID NO: 820785 - protein, 27 aa, Mycobacterium
GTDTLIGRLLPLPRTIGDLGPDAMSSL

SEQ ID NO: 820786 - protein, 36 aa, Mycobacterium
GTDTPIAVLSRRPRMLYDYFHQLFAQVTNPPLDAIR

SEQ ID NO: 820787 - protein, 36 aa, Mycobacterium
GTDTPIAVLSRRPRMLYDYFQQLFAQVTNPPLDAIR

SEQ ID NO: 820788 - protein, 25 aa, Mycobacterium
GTDVLAPGFLYHYSLDATTAGADLI

SEQ ID NO: 820789 - protein, 24 aa, Mycobacterium
GTDVPALRFIAYGGSRAIAADVRF

SEQ ID NO: 820790 - protein, 24 aa, Mycobacterium
GTDWQLGLLIKIEGSIRRDVLERA

SEQ ID NO: 820791 - protein, 28 aa, Mycobacterium
GTDYVDLYLIHWPVPELDEYVASFKALQ

SEQ ID NO: 820792 - protein, 22 aa, Mycobacterium
GTEFMPVVWAMFEWGRKHLDDT

SEQ ID NO: 820793 - protein, 29 aa, Mycobacterium
GTEFQRRVWRALLTIPYGETRSYGEIAER

SEQ ID NO: 820794 - protein, 24 aa, Mycobacterium
GTEGWIDILPRFHHPREIVLHRKG

SEQ ID NO: 820795 - protein, 19 aa, Mycobacterium
GTEKNFKWIARSADGWITT

SEQ ID NO: 820796 - protein, 24 aa, Mycobacterium
GTEKPPYEIVDPQPLMVLPDADKG

SEQ ID NO: 820797 - protein, 23 aa, Mycobacterium
GTELLAALGLHRVWERADAVMAS

SEQ ID NO: 820798 - protein, 21 aa, Mycobacterium
GTELLDVFGLVPMVIDVHDER

SEQ ID NO: 820799 - protein, 24 aa, Mycobacterium
GTELRALPLVDFGIGVAAGAVFAG

SEQ ID NO: 820800 - protein, 30 aa, Mycobacterium
GTELVRDVARWLVVYLKRAGGQSQFSVLVE

SEQ ID NO: 820801 - protein, 24 aa, Mycobacterium
GTENLRRIEPLLQTLRAVATDVDA

SEQ ID NO: 820802 - protein, 23 aa, Mycobacterium
GTEPGAIWFRTGDLGVYIDGELY

SEQ ID NO: 820803 - protein, 24 aa, Mycobacterium
GTEPLLIERIDAEYARYFTPTGRP

SEQ ID NO: 820804 - protein, 25 aa, Mycobacterium
GTEPPGWEWLWELESQGPGETLVRH

SEQ ID NO: 820805 - protein, 18 aa, Mycobacterium
GTEQLALTKALDVHPIRR

SEQ ID NO: 820806 - protein, 26 aa, Mycobacterium
GTEQLSYMFGLIDLLPWGRQEQWQDS

SEQ ID NO: 820807 - protein, 24 aa, Mycobacterium
GTERILFTHIAVPVMTRLRQPERQ

SEQ ID NO: 820808 - protein, 23 aa, Mycobacterium
GTERLYTDAGFWAHPDYCEAYGK

SEQ ID NO: 820809 - protein, 25 aa, Mycobacterium
GTERTRVWGMRIATVILFTELVIQT

SEQ ID NO: 820810 - protein, 28 aa, Mycobacterium
GTESPLRLTLIRTGPAEHVLLLVAHHIA

SEQ ID NO: 820811 - protein, 21 aa, Mycobacterium
GTETVGRLFGWLGKLLGEHPD

SEQ ID NO: 820812 - protein, 23 aa, Mycobacterium
GTEVRILFDPAIAPDSTLDIGEV

SEQ ID NO: 820813 - protein, 20 aa, Mycobacterium
GTEVTLRFDDGEVVTMHVIA

SEQ ID NO: 820814 - protein, 20 aa, Mycobacterium
GTEWLAVSGYRRIDDETAPF

SEQ ID NO: 820815 - protein, 21 aa, Mycobacterium
GTEYLSLDIAVALVDGLDAAI

SEQ ID NO: 820816 - protein, 24 aa, Mycobacterium
GTFDAYMFGIVERKARGFEQLYRV

SEQ ID NO: 820817 - protein, 25 aa, Mycobacterium
GTFEDPIIFLKPNTAIIGPYTPIQL

SEQ ID NO: 820818 - protein, 30 aa, Mycobacterium
GTFHGIQLWVNLPARDKFLTPAYQAIEGAQ

SEQ ID NO: 820819 - protein, 24 aa, Mycobacterium
GTFMQRTIFHLPGLTAARDGLERE

SEQ ID NO: 820820 - protein, 25 aa, Mycobacterium
GTFMTPVIDFKGTPLPFDDSDYAYD

SEQ ID NO: 820821 - protein, 18 aa, Mycobacterium
GTFPPNGFGLVDMIGNVW

SEQ ID NO: 820822 - protein, 24 aa, Mycobacterium
GTFRGHAFHTSRWDYAYTGEGLQD

SEQ ID NO: 820823 - protein, 19 aa, Mycobacterium
GTFTFAELLAHELSVERAS

SEQ ID NO: 820824 - protein, 24 aa, Mycobacterium
GTFTPRTWVALATEYFLAGHSRVM

SEQ ID NO: 820825 - protein, 23 aa, Mycobacterium
GTFTVLLVENILPDAPLHDRMLS

SEQ ID NO: 820826 - protein, 17 aa, Mycobacterium
GTFYYHFSDKQAMFTAL

SEQ ID NO: 820827 - protein, 18 aa, Mycobacterium
GTGAAAVWLARRGLRVWA

SEQ ID NO: 820828 - protein, 29 aa, Mycobacterium
GTGAAGGAGGLLWGNGGNGGSGAAGQAGG

SEQ ID NO: 820829 - protein, 35 aa, Mycobacterium
GTGADGGRYAFGANWSLDLPVGGAGGAGGWANSID

SEQ ID NO: 820830 - protein, 18 aa, Mycobacterium
GTGAEMWLKLNPQAYRDL

SEQ ID NO: 820831 - protein, 23 aa, Mycobacterium
GTGAFMAFMAARSAGRRAYAQRM

SEQ ID NO: 820832 - protein, 26 aa, Mycobacterium
GTGAPVLMWPSLLMTGDLWAGQAAVF

SEQ ID NO: 820833 - protein, 23 aa, Mycobacterium
GTGDQLMFRKLFESVIKGHVKVL

SEQ ID NO: 820834 - protein, 24 aa, Mycobacterium
GTGDVLMVAWMDDDALARTLETRE

SEQ ID NO: 820835 - protein, 29 aa, Mycobacterium
GTGEFRYCTAGHPPPLLVTSEATSRYLEP

SEQ ID NO: 820836 - protein, 20 aa, Mycobacterium
GTGFFLTWVTTYVDQHGEVL

SEQ ID NO: 820837 - protein, 20 aa, Mycobacterium
GTGFFLTWVTTYVDQHSEVL

SEQ ID NO: 820838 - protein, 21 aa, Mycobacterium
GTGGAAGLWGTGGTGGAGGSG

SEQ ID NO: 820839 - protein, 24 aa, Mycobacterium
GTGGAAGSGGMFGQMGDAGDGGDA

SEQ ID NO: 820840 - protein, 22 aa, Mycobacterium
GTGGAARLFGSGGSGGTGGVGG

SEQ ID NO: 820841 - protein, 24 aa, Mycobacterium
GTGGAGGHGGLWGNGGDGGTGGQG

SEQ ID NO: 820842 - protein, 25 aa, Mycobacterium
GTGGAGGLLFGPGGVGGAGGASFLT

SEQ ID NO: 820843 - protein, 23 aa, Mycobacterium
GTGGAGGWFYGTGGGGGAGGVSA

SEQ ID NO: 820844 - protein, 24 aa, Mycobacterium
GTGGAGGWLTGAGGTGGAGGTGTS

SEQ ID NO: 820845 - protein, 31 aa, Mycobacterium
GTGGAGVVSGLSAFPGGIGGAGGAGGQGGQA

SEQ ID NO: 820846 - protein, 21 aa, Mycobacterium
GTGGALLGSAGAGGALGAAGL

SEQ ID NO: 820847 - protein, 24 aa, Mycobacterium
GTGGATLPVLIFAAARAGVAFTPI

SEQ ID NO: 820848 - protein, 25 aa, Mycobacterium
GTGGDGGFLLGQGAAGGAGGNGGAG

SEQ ID NO: 820849 - protein, 19 aa, Mycobacterium
GTGGFGGGLMTSGGAGGTG

SEQ ID NO: 820850 - protein, 19 aa, Mycobacterium
GTGGLLFGNGGNGGMGGTA

SEQ ID NO: 820851 - protein, 23 aa, Mycobacterium
GTGGLLIGLDGFNAAASTSPLHN

SEQ ID NO: 820852 - protein, 21 aa, Mycobacterium
GTGGMLAVGLPFSELEPLLGD

SEQ ID NO: 820853 - protein, 23 aa, Mycobacterium
GTGGNGGWLYGSGGAGGAGGNAL

SEQ ID NO: 820854 - protein, 29 aa, Mycobacterium
GTGGPAGLGVFVGVPTFGDGGGGGAGGAG

SEQ ID NO: 820855 - protein, 25 aa, Mycobacterium
GTGGWSGHGGAGGRGGWLIGNGGTG

SEQ ID NO: 820856 - protein, 23 aa, Mycobacterium
GTGHSMFYRYFTNKRDILEHVVQ

SEQ ID NO: 820857 - protein, 21 aa, Mycobacterium
GTGIPLFCIHPASGLSWPYHA

SEQ ID NO: 820858 - protein, 25 aa, Mycobacterium
GTGIPPLYAEHWEPLWAACADAGLV

SEQ ID NO: 820859 - protein, 26 aa, Mycobacterium
GTGITFDVVYWKPLPDNNDAPGYPPL

SEQ ID NO: 820860 - protein, 24 aa, Mycobacterium
GTGKSLAYLVPAIVHALDDDSPVV

SEQ ID NO: 820861 - protein, 25 aa, Mycobacterium
GTGKTAAFAIPILSKIDLTSKDTQA

SEQ ID NO: 820862 - protein, 23 aa, Mycobacterium
GTGKTAAFAIPILSKIDTSRRDT

SEQ ID NO: 820863 - protein, 23 aa, Mycobacterium
GTGKVLMVAWMDDDALARTLQTR

SEQ ID NO: 820864 - protein, 23 aa, Mycobacterium
GTGLGGLTNSFPGSSGTGGDPGG

SEQ ID NO: 820865 - protein, 29 aa, Mycobacterium
GTGLPPLYAEHWEPFWAACAEAGLVVNHH

SEQ ID NO: 820866 - protein, 25 aa, Mycobacterium
GTGMGIDRLLMSLTGLSIRETVLFP

SEQ ID NO: 820867 - protein, 26 aa, Mycobacterium
GTGMGIDRLLMTLTGLSIRETVLFPI

SEQ ID NO: 820868 - protein, 24 aa, Mycobacterium
GTGPARVILLGGLPFGEELVMWWN

SEQ ID NO: 820869 - protein, 25 aa, Mycobacterium
GTGPGDWFEVSLIPTTRELTTLGRA

SEQ ID NO: 820870 - protein, 28 aa, Mycobacterium
GTGPVVATPIIRWLHGLGGNVGEFNQTV

SEQ ID NO: 820871 - protein, 27 aa, Mycobacterium
GTGQAGGAGGILWGNGGNGGSGGVGQA

SEQ ID NO: 820872 - protein, 24 aa, Mycobacterium
GTGRPLTGLLVADLSSMWAGPLCG

SEQ ID NO: 820873 - protein, 23 aa, Mycobacterium
GTGSGISFSGSTTLTAGSGNGGN

SEQ ID NO: 820874 - protein, 18 aa, Mycobacterium
GTGSPIPDPNRAGPATLV

SEQ ID NO: 820875 - protein, 18 aa, Mycobacterium
GTGSPMYEPFDDGVLDVV

SEQ ID NO: 820876 - protein, 25 aa, Mycobacterium
GTGTDSTDPTLAGQAGGQGGTGETG

SEQ ID NO: 820877 - protein, 24 aa, Mycobacterium
GTGTDSTDPTLAGQAGGQGGTGGT

SEQ ID NO: 820878 - protein, 18 aa, Mycobacterium
GTGTLELRLQYGVGRPER

SEQ ID NO: 820879 - protein, 38 aa, Mycobacterium
GTGTLIAAFPRYHPRWAWWMTSVPMLREFLVSNLVLVL

SEQ ID NO: 820880 - protein, 20 aa, Mycobacterium
GTGWAYRQFGVQPDVVAFGK

SEQ ID NO: 820881 - protein, 24 aa, Mycobacterium
GTGWLHGWRLTFGGADIAWEGALA

SEQ ID NO: 820882 - protein, 23 aa, Mycobacterium
GTGWLNGWRLTFGGEDLGWDGAL

SEQ ID NO: 820883 - protein, 23 aa, Mycobacterium
GTGWPSFWQPLPHAVSERPDNSL

SEQ ID NO: 820884 - protein, 24 aa, Mycobacterium
GTGWQIAAGGLVRFAARPLQLANV

SEQ ID NO: 820885 - protein, 32 aa, Mycobacterium
GTGYQDTFWVNMIALLMGTAHRIDTVRGKASW

SEQ ID NO: 820886 - protein, 23 aa, Mycobacterium
GTHAIRGFYSAIAGLERVCELVS

SEQ ID NO: 820887 - protein, 24 aa, Mycobacterium
GTHCDLLIIVTKTDPAAGAAGVSL

SEQ ID NO: 820888 - protein, 18 aa, Mycobacterium
GTHDALILRNHGLLTVGA

SEQ ID NO: 820889 - protein, 18 aa, Mycobacterium
GTHLIARAKLRDLPVRAL

SEQ ID NO: 820890 - protein, 23 aa, Mycobacterium
GTHPHDPLPYLLTDPRQAQVTAS

SEQ ID NO: 820891 - protein, 18 aa, Mycobacterium
GTHPVLGSVMRRGYKVGD

SEQ ID NO: 820892 - protein, 17 aa, Mycobacterium
GTHQLAVLAPGADPTGP

SEQ ID NO: 820893 - protein, 20 aa, Mycobacterium
GTHRVFGWVAFEFGTYRFNL

SEQ ID NO: 820894 - protein, 25 aa, Mycobacterium
GTHSSGIGVLRWLPAVPEALAEDPQ

SEQ ID NO: 820895 - protein, 26 aa, Mycobacterium
GTHTLLTLHPRFGRWLQLGGHCEDTD

SEQ ID NO: 820896 - protein, 20 aa, Mycobacterium
GTHVGFTQWGVHGTPYWFEC

SEQ ID NO: 820897 - protein, 18 aa, Mycobacterium
GTHWKLNPVFDECGFDYY

SEQ ID NO: 820898 - protein, 24 aa, Mycobacterium
GTIAALEMAFFGALVHAGSGEFTY

SEQ ID NO: 820899 - protein, 18 aa, Mycobacterium
GTIAAQFARDENIKRVAV

SEQ ID NO: 820900 - protein, 24 aa, Mycobacterium
GTIDAPIGRHRGHDWKFAVVEDGR

SEQ ID NO: 820901 - protein, 24 aa, Mycobacterium
GTIDAPIGRHRGHDWKFAVVEGGR

SEQ ID NO: 820902 - protein, 24 aa, Mycobacterium
GTIDLGIYCRASLSEFMDADRLFT

SEQ ID NO: 820903 - protein, 22 aa, Mycobacterium
GTIDRLVSIAPLGRAAAPAEIA

SEQ ID NO: 820904 - protein, 28 aa, Mycobacterium
GTIEYLVDAVFNYPTFSEAYKVAALDVM

SEQ ID NO: 820905 - protein, 19 aa, Mycobacterium
GTIFGTDRPQWRGASGADM

SEQ ID NO: 820906 - protein, 21 aa, Mycobacterium
GTIGLIVDRLLPGGVLHVATD

SEQ ID NO: 820907 - protein, 19 aa, Mycobacterium
GTIGPAMTFGYLAALDIAA

SEQ ID NO: 820908 - protein, 23 aa, Mycobacterium
GTIHTLPIRVAAPAAELLGSLLR

SEQ ID NO: 820909 - protein, 18 aa, Mycobacterium
GTINIVVAVPVRLSGAAL

SEQ ID NO: 820910 - protein, 21 aa, Mycobacterium
GTIRAVVCAPLRVVLPARGTD

SEQ ID NO: 820911 - protein, 17 aa, Mycobacterium
GTIRGLAELLCSKLAPA

SEQ ID NO: 820912 - protein, 33 aa, Mycobacterium
GTIVLLMAVERIELFVDALLKGGRPAKTPVLVV

SEQ ID NO: 820913 - protein, 17 aa, Mycobacterium
GTIVLLMAVERIEQFAR

SEQ ID NO: 820914 - protein, 18 aa, Mycobacterium
GTIWTRPELSMRDRRLLL

SEQ ID NO: 820915 - protein, 21 aa, Mycobacterium
GTIYPYRFDALVDAVLRSGLA

SEQ ID NO: 820916 - protein, 26 aa, Mycobacterium
GTKAGFDLAMLQAVRSAVTVPVIASG

SEQ ID NO: 820917 - protein, 26 aa, Mycobacterium
GTKAGFDLKMLRAVRGAVTVPVIASG

SEQ ID NO: 820918 - protein, 25 aa, Mycobacterium
GTKAGFDLKMLSAVRAAVSVPVIAS

SEQ ID NO: 820919 - protein, 25 aa, Mycobacterium
GTKGKLLEYYLAVADPMVTLLRDRP

SEQ ID NO: 820920 - protein, 22 aa, Mycobacterium
GTKGLSLFFVPKFHFDHETGEI

SEQ ID NO: 820921 - protein, 23 aa, Mycobacterium
GTKGLSLFFVPKFHFDHETGEPG

SEQ ID NO: 820922 - protein, 24 aa, Mycobacterium
GTKGLSLFIVPKFHFDPQTGDLGE

SEQ ID NO: 820923 - protein, 26 aa, Mycobacterium
GTKGLSLFYVPNYLFDPDTFELGSRN

SEQ ID NO: 820924 - protein, 29 aa, Mycobacterium
GTKGPVPWWWRPSGALFDQFLGAAETDPV

SEQ ID NO: 820925 - protein, 25 aa, Mycobacterium
GTKGRLIDYYLAVGGGPMLTALRDR

SEQ ID NO: 820926 - protein, 17 aa, Mycobacterium
GTKQALFHEAVHWDIPV

SEQ ID NO: 820927 - protein, 25 aa, Mycobacterium
GTKRRLVEYYLAVGRGPMLATLRDR

SEQ ID NO: 820928 - protein, 30 aa, Mycobacterium
GTKSAQRALQLIYRVWPDLRVKPHLDKSVA

SEQ ID NO: 820929 - protein, 23 aa, Mycobacterium
GTLERFIRVPYTLPDAQLVEAIE

SEQ ID NO: 820930 - protein, 25 aa, Mycobacterium
GTLEVKAILHRMLRSLTWTVPENYH

SEQ ID NO: 820931 - protein, 17 aa, Mycobacterium
GTLFLGHAEMLLSHGDR

SEQ ID NO: 820932 - protein, 27 aa, Mycobacterium
GTLFTVQAMLPLLNRGASIVLTGSTAA

SEQ ID NO: 820933 - protein, 24 aa, Mycobacterium
GTLGTAVRVLLPGDRQLLGDAVDI

SEQ ID NO: 820934 - protein, 29 aa, Mycobacterium
GTLIATAHRLLLDPVDIGPIRLVGIGFSG

SEQ ID NO: 820935 - protein, 20 aa, Mycobacterium
GTLLRLDPAVRPTMYRCATV

SEQ ID NO: 820936 - protein, 24 aa, Mycobacterium
GTLPPAAGTLIRLFHAETVMCEMD

SEQ ID NO: 820937 - protein, 25 aa, Mycobacterium
GTLPPGQLGWRRAIALRDQCALLAA

SEQ ID NO: 820938 - protein, 17 aa, Mycobacterium
GTLQGYFAERDPGRSFS

SEQ ID NO: 820939 - protein, 22 aa, Mycobacterium
GTLRELLGERGPMPPYAVAAVL

SEQ ID NO: 820940 - protein, 23 aa, Mycobacterium
GTLRKLLLRYDGQADHPLLASVP

SEQ ID NO: 820941 - protein, 22 aa, Mycobacterium
GTLRLLNPRRWSERTMIALVMQ

SEQ ID NO: 820942 - protein, 26 aa, Mycobacterium
GTLRTAGMLFTPGYPGFLRGVTAGCP

SEQ ID NO: 820943 - protein, 23 aa, Mycobacterium
GTLRVAILHRPGPELKRLTPRNN

SEQ ID NO: 820944 - protein, 32 aa, Mycobacterium
GTLSEKIDPYLRPLYDALYDMMDAELIPKLMS

SEQ ID NO: 820945 - protein, 31 aa, Mycobacterium
GTLSEKIDPYLRPLYDALYDMMDPELIAKLM

SEQ ID NO: 820946 - protein, 18 aa, Mycobacterium
GTLSLWQGVDVPGPSLSL

SEQ ID NO: 820947 - protein, 20 aa, Mycobacterium
GTLTAAHWLSEEGVPVVGVP

SEQ ID NO: 820948 - protein, 18 aa, Mycobacterium
GTLTFIDIIGRDGITLRG

SEQ ID NO: 820949 - protein, 26 aa, Mycobacterium
GTLTIRYVRPTWLGALRAEAWIDREE

SEQ ID NO: 820950 - protein, 22 aa, Mycobacterium
GTLTLRYRRGTVLGRPLRAEGR

SEQ ID NO: 820951 - protein, 31 aa, Mycobacterium
GTLTTGRWGLLEPPQPWLPAAALAEAALVLV

SEQ ID NO: 820952 - protein, 25 aa, Mycobacterium
GTLTYQMMFELRDFGFTTSIGIGGD

SEQ ID NO: 820953 - protein, 21 aa, Mycobacterium
GTLVIPIGICDSAIGVATVPL

SEQ ID NO: 820954 - protein, 20 aa, Mycobacterium
GTLVRALRNDGLDPTRDVEV

SEQ ID NO: 820955 - protein, 25 aa, Mycobacterium
GTLVRTPLIGGLLDKPADPAVAPVA

SEQ ID NO: 820956 - protein, 18 aa, Mycobacterium
GTLYSWAVCEPTTGELLA

SEQ ID NO: 820957 - protein, 19 aa, Mycobacterium
GTMPNMLLTTSTKDLKDAF

SEQ ID NO: 820958 - protein, 18 aa, Mycobacterium
GTMRLGAYPAVLESGSIV

SEQ ID NO: 820959 - protein, 24 aa, Mycobacterium
GTNDDLRYLAAWSAARTGVEAYVE

SEQ ID NO: 820960 - protein, 24 aa, Mycobacterium
GTNGWRFRHELLREVAAELAPPSV

SEQ ID NO: 820961 - protein, 31 aa, Mycobacterium
GTNHFGHFELTRLLIPQLTAAGAARVVILSS

SEQ ID NO: 820962 - protein, 29 aa, Mycobacterium
GTNHLGHFEFTRLLFPALVAADGARVVNL

SEQ ID NO: 820963 - protein, 17 aa, Mycobacterium
GTNHLGHYALTGLLLER

SEQ ID NO: 820964 - protein, 25 aa, Mycobacterium
GTNLAGWLYRIMRNTHLSAYRRRLC

SEQ ID NO: 820965 - protein, 25 aa, Mycobacterium
GTNLRAWLLHIMTNTYISGLRRARR

SEQ ID NO: 820966 - protein, 27 aa, Mycobacterium
GTNMQAWLFRIMRNTWISNFRAQQRNP

SEQ ID NO: 820967 - protein, 27 aa, Mycobacterium
GTNPEQLFAAGWSACFLSAMGVTAPKH

SEQ ID NO: 820968 - protein, 20 aa, Mycobacterium
GTNPRRPLDPLYQSFCQLLA

SEQ ID NO: 820969 - protein, 31 aa, Mycobacterium
GTNTILKAAGFRWFRTLGVWGIAGSRDRQPN

SEQ ID NO: 820970 - protein, 17 aa, Mycobacterium
GTNTWVLCGPGSDELVI

SEQ ID NO: 820971 - protein, 21 aa, Mycobacterium
GTNVTLLPGWLTSLRRSAYRN

SEQ ID NO: 820972 - protein, 20 aa, Mycobacterium
GTNVWGAFGLLAEMVAEGRS

SEQ ID NO: 820973 - protein, 20 aa, Mycobacterium
GTNYFVERLWSASQRYELPG

SEQ ID NO: 820974 - protein, 24 aa, Mycobacterium
GTPADLAELLWSFAPSPRSRPADA

SEQ ID NO: 820975 - protein, 28 aa, Mycobacterium
GTPADLSKLLWSFAPEPRPRPADASEIP

SEQ ID NO: 820976 - protein, 26 aa, Mycobacterium
GTPAFSVYAATKAAIRSFGRTWAAEL

SEQ ID NO: 820977 - protein, 24 aa, Mycobacterium
GTPALAHRLVPTAATPTLTGVRPL

SEQ ID NO: 820978 - protein, 33 aa, Mycobacterium
GTPANPLVYLAQAWDWIFPLGPDANYEPDRSQS

SEQ ID NO: 820979 - protein, 18 aa, Mycobacterium
GTPATSCPFAEQVRLAYG

SEQ ID NO: 820980 - protein, 26 aa, Mycobacterium
GTPDGLTAWLLLSCEGLHAGAREALS

SEQ ID NO: 820981 - protein, 18 aa, Mycobacterium
GTPDSWVIWNLTGGVRSG

SEQ ID NO: 820982 - protein, 19 aa, Mycobacterium
GTPDVPWGAPADDAVLAAI

SEQ ID NO: 820983 - protein, 27 aa, Mycobacterium
GTPEAITAWIVFCCQALTAGAAEATSI

SEQ ID NO: 820984 - protein, 24 aa, Mycobacterium
GTPEPALPALRRLLDSPRHEVIAV

SEQ ID NO: 820985 - protein, 17 aa, Mycobacterium
GTPGGAGGLLYGNGGRG

SEQ ID NO: 820986 - protein, 25 aa, Mycobacterium
GTPGQWYLHLFDPAQPDLNWNNPEV

SEQ ID NO: 820987 - protein, 24 aa, Mycobacterium
GTPGQWYLHLFDTEQPDLNWDNPD

SEQ ID NO: 820988 - protein, 23 aa, Mycobacterium
GTPIEPYLEILREFDTLLVMSVE

SEQ ID NO: 820989 - protein, 26 aa, Mycobacterium
GTPIGGIVPGLLTYAPQQFANAIGAA

SEQ ID NO: 820990 - protein, 24 aa, Mycobacterium
GTPLEPYLEILREFDTLLVMSVEP

SEQ ID NO: 820991 - protein, 18 aa, Mycobacterium
GTPLGPWLRTGDLGVMSE

SEQ ID NO: 820992 - protein, 27 aa, Mycobacterium
GTPLPLQWGRYVPGKLVAAPYGLREPE

SEQ ID NO: 820993 - protein, 21 aa, Mycobacterium
GTPLSPGTFLATITGAGRPPV

SEQ ID NO: 820994 - protein, 29 aa, Mycobacterium
GTPLVIHQPSYSLLNRWIEGGLTDELRKA

SEQ ID NO: 820995 - protein, 19 aa, Mycobacterium
GTPNDWHRTHLISRAIGGA

SEQ ID NO: 820996 - protein, 33 aa, Mycobacterium
GTPNLFTPHRYGMVPRIKIPLPTGAIASVRVGP

SEQ ID NO: 820997 - protein, 26 aa, Mycobacterium
GTPPDELSWAWVQTEMLRLHVRRRLS

SEQ ID NO: 820998 - protein, 36 aa, Mycobacterium
GTPPPTWEDIAWLRQLWGGPFMLKGVMRVDDAKRAV

SEQ ID NO: 820999 - protein, 17 aa, Mycobacterium
GTPTAYDRVLATRFGVN

SEQ ID NO: 821000 - protein, 19 aa, Mycobacterium
GTPTAYDRVLATRFGVNAA

SEQ ID NO: 821001 - protein, 30 aa, Mycobacterium
GTPTFTGRQWPLADVRLLAPILASKVVAMG

SEQ ID NO: 821002 - protein, 30 aa, Mycobacterium
GTPTFTGRQWPLADVRLLAPILASKVVCMG

SEQ ID NO: 821003 - protein, 30 aa, Mycobacterium
GTPTFTGRSWPLADVRLLAPILASKVVCVG

SEQ ID NO: 821004 - protein, 18 aa, Mycobacterium
GTPTMQLLHDPKGSAGQR

SEQ ID NO: 821005 - protein, 34 aa, Mycobacterium
GTPVFAWKGETLEEYWWAAEQMLTWPNEPANMIL

SEQ ID NO: 821006 - protein, 22 aa, Mycobacterium
GTPVGFLLMLPDVNEIAGRSGR

SEQ ID NO: 821007 - protein, 17 aa, Mycobacterium
GTPVLRKGRRRFTMPRP

SEQ ID NO: 821008 - protein, 24 aa, Mycobacterium
GTPVPLWLAAFAESPLPTLDLTEC

SEQ ID NO: 821009 - protein, 20 aa, Mycobacterium
GTPVVAMPLLRRGNEVHGIG

SEQ ID NO: 821010 - protein, 17 aa, Mycobacterium
GTPWAYQQLGVAPDVVA

SEQ ID NO: 821011 - protein, 36 aa, Mycobacterium
GTPYSRMWGAYLSGMWLYRLSFAKVKWHSLTGRPLT

SEQ ID NO: 821012 - protein, 36 aa, Mycobacterium
GTPYSRMWGAYLTGMWLYRLSLAKVKWHALTGRPLT

SEQ ID NO: 821013 - protein, 35 aa, Mycobacterium
GTPYSRMWGAYLTGMWLYRLSLAKVKWHSLTGRPL

SEQ ID NO: 821014 - protein, 23 aa, Mycobacterium
GTQAAIWFLTNGVELDTAARNVP

SEQ ID NO: 821015 - protein, 23 aa, Mycobacterium
GTQAQRPAWLAAAATVITGVGDR

SEQ ID NO: 821016 - protein, 27 aa, Mycobacterium
GTQGSARFWWFGVIPAWTHHLTIKRLE

SEQ ID NO: 821017 - protein, 17 aa, Mycobacterium
GTQIQAHIERRFSMPWS

SEQ ID NO: 821018 - protein, 23 aa, Mycobacterium
GTQLAASLRREGWDGEIVLVGDE

SEQ ID NO: 821019 - protein, 19 aa, Mycobacterium
GTQMRSYVLQPYQMVKDLR

SEQ ID NO: 821020 - protein, 17 aa, Mycobacterium
GTQNVIELALKKGARLV

SEQ ID NO: 821021 - protein, 21 aa, Mycobacterium
GTQQVTLLSAKPFAAHAREAV

SEQ ID NO: 821022 - protein, 17 aa, Mycobacterium
GTQRLLHKFKDSGSLPN

SEQ ID NO: 821023 - protein, 23 aa, Mycobacterium
GTQRQMLFAGVPLTAVTRLCITH

SEQ ID NO: 821024 - protein, 31 aa, Mycobacterium
GTQSNLQALLLARDLFARKAGWDIAGLGLPP

SEQ ID NO: 821025 - protein, 22 aa, Mycobacterium
GTQTLYFLVSQWVTDPTRAYRT

SEQ ID NO: 821026 - protein, 22 aa, Mycobacterium
GTQVPLYILGSSLFGAKLAAVL

SEQ ID NO: 821027 - protein, 17 aa, Mycobacterium
GTQVRAAISLGLAPDLT

SEQ ID NO: 821028 - protein, 26 aa, Mycobacterium
GTQYRCRMFRMTVQDVFFIRGRGIVA

SEQ ID NO: 821029 - protein, 19 aa, Mycobacterium
GTRARPWFNPEEAALRGLF

SEQ ID NO: 821030 - protein, 20 aa, Mycobacterium
GTRARPWFNPQEAALEGLFT

SEQ ID NO: 821031 - protein, 18 aa, Mycobacterium
GTRCYLALLTDADGSPLF

SEQ ID NO: 821032 - protein, 25 aa, Mycobacterium
GTRDPMVVCWPSRIPREGGIRSQFT

SEQ ID NO: 821033 - protein, 18 aa, Mycobacterium
GTRDWVARVLGNLARDND

SEQ ID NO: 821034 - protein, 22 aa, Mycobacterium
GTREIGYLFGQYKRITNRYESG

SEQ ID NO: 821035 - protein, 22 aa, Mycobacterium
GTRFILALFVDLRGKPCAKLVP

SEQ ID NO: 821036 - protein, 18 aa, Mycobacterium
GTRFPGFPDASITGSYAG

SEQ ID NO: 821037 - protein, 24 aa, Mycobacterium
GTRGPLLERLGLPEPSTALDATDT

SEQ ID NO: 821038 - protein, 19 aa, Mycobacterium
GTRGWYRGVPQAYPGTVLF

SEQ ID NO: 821039 - protein, 21 aa, Mycobacterium
GTRIKARVPVALAGRLQEFSA

SEQ ID NO: 821040 - protein, 24 aa, Mycobacterium
GTRIRARVPGALAATLREFAASPA

SEQ ID NO: 821041 - protein, 19 aa, Mycobacterium
GTRKALLESLLKSVPAGAL

SEQ ID NO: 821042 - protein, 21 aa, Mycobacterium
GTRKSPRLWIVTRGAQQVDPT

SEQ ID NO: 821043 - protein, 24 aa, Mycobacterium
GTRLKPEILAVTLAGRELGPKSIA

SEQ ID NO: 821044 - protein, 29 aa, Mycobacterium
GTRLRDRILLRFGLHQALRLGKPLQFHVG

SEQ ID NO: 821045 - protein, 29 aa, Mycobacterium
GTRLTDRVLLRFGLHRALRIGKPLQVHVG

SEQ ID NO: 821046 - protein, 21 aa, Mycobacterium
GTRLYPITMGISKQLLPVYDK

SEQ ID NO: 821047 - protein, 29 aa, Mycobacterium
GTRMKLARNMLTFIGFTAACEAMRLAEAS

SEQ ID NO: 821048 - protein, 19 aa, Mycobacterium
GTRMRSDIPKVLHTLAGRS

SEQ ID NO: 821049 - protein, 26 aa, Mycobacterium
GTRNATFIDPSGHRWMLSGPVGVRVP

SEQ ID NO: 821050 - protein, 22 aa, Mycobacterium
GTRNPMIVTWPQRINDGGGLRS

SEQ ID NO: 821051 - protein, 23 aa, Mycobacterium
GTRPDGPGWYYPPTVITDITKNM

SEQ ID NO: 821052 - protein, 27 aa, Mycobacterium
GTRPLATHDLLVLAPYNAQVALIRQRL

SEQ ID NO: 821053 - protein, 23 aa, Mycobacterium
GTRPPILDPFDPVTVWGYDECDL

SEQ ID NO: 821054 - protein, 22 aa, Mycobacterium
GTRPSYELMRDCDTLLIVGTNF

SEQ ID NO: 821055 - protein, 28 aa, Mycobacterium
GTRPTLPTVWPGTPYPLGATYDGAGTNF

SEQ ID NO: 821056 - protein, 27 aa, Mycobacterium
GTRQLAHEPFGWRPTTLLVTIRRYGCA

SEQ ID NO: 821057 - protein, 29 aa, Mycobacterium
GTRRAIHFQEWWVRYRADVPTHSFAFIGA

SEQ ID NO: 821058 - protein, 24 aa, Mycobacterium
GTRRALLEALLKHVPAGDLDLDEI

SEQ ID NO: 821059 - protein, 27 aa, Mycobacterium
GTRRIFDITIDYLKTRIQFGRAIGSFQ

SEQ ID NO: 821060 - protein, 23 aa, Mycobacterium
GTRRLYTWIELRDRALRLAASIR

SEQ ID NO: 821061 - protein, 24 aa, Mycobacterium
GTRSLVEVLLLHRHLDRADVIAGI

SEQ ID NO: 821062 - protein, 18 aa, Mycobacterium
GTRVAALGRVHLRNVVAP

SEQ ID NO: 821063 - protein, 43 aa, Mycobacterium
GTRVARTLLIIDLPRPPAPLHLLRLATMLPLAPLVPFVHDGVI

SEQ ID NO: 821064 - protein, 44 aa, Mycobacterium
GTRVGRTLLIIDLLRLPAPLLAPAYLFAAAVGWVRPVAHDGAIS

SEQ ID NO: 821065 - protein, 19 aa, Mycobacterium
GTRVVFPYFFCCHTCRNCL

SEQ ID NO: 821066 - protein, 19 aa, Mycobacterium
GTRYWDPLATFGYLAAHTR

SEQ ID NO: 821067 - protein, 25 aa, Mycobacterium
GTSAAPLQTVGWTAAAPQAGTGTVI

SEQ ID NO: 821068 - protein, 24 aa, Mycobacterium
GTSANPTWLLKLKAPRGPQGDNAT

SEQ ID NO: 821069 - protein, 18 aa, Mycobacterium
GTSDGRILRVRGRGVPKR

SEQ ID NO: 821070 - protein, 25 aa, Mycobacterium
GTSGAVFGTFFRALYGGLGSEPWST

SEQ ID NO: 821071 - protein, 22 aa, Mycobacterium
GTSIPYFLVRPTGSDGPGPTLL

SEQ ID NO: 821072 - protein, 42 aa, Mycobacterium
GTSKFDLVGWLPAYLHWYGLAMRRPMLRWTGGGLAAIAAAQL

SEQ ID NO: 821073 - protein, 40 aa, Mycobacterium
GTSKFDLVGWLPSYLHWYGLAMRGPVLRGTTGSLAALGAM

SEQ ID NO: 821074 - protein, 26 aa, Mycobacterium
GTSKPVLYRRWPDRRALLRDTLMAVA

SEQ ID NO: 821075 - protein, 26 aa, Mycobacterium
GTSKSQLFHYFPGGKDQLMLAVAEHE

SEQ ID NO: 821076 - protein, 24 aa, Mycobacterium
GTSKTSFDPHRRKDHPTMPKPTRI

SEQ ID NO: 821077 - protein, 18 aa, Mycobacterium
GTSLKPLQPAPFAVKYRY

SEQ ID NO: 821078 - protein, 18 aa, Mycobacterium
GTSLLSDWPRRSAQFTKI

SEQ ID NO: 821079 - protein, 18 aa, Mycobacterium
GTSMVWLVTPRHADDWLR

SEQ ID NO: 821080 - protein, 22 aa, Mycobacterium
GTSQLVALYDTASGLPVIPDGT

SEQ ID NO: 821081 - protein, 25 aa, Mycobacterium
GTSQLYQQLIFRPVPGFGTAETPVA

SEQ ID NO: 821082 - protein, 23 aa, Mycobacterium
GTSQQFLIEGLAARLKVAQRSGS

SEQ ID NO: 821083 - protein, 27 aa, Mycobacterium
GTSSVLVRFLGLWDATAIPGTHGEPGL

SEQ ID NO: 821084 - protein, 25 aa, Mycobacterium
GTSSWTLIELLRHPEYYAQVQQELD

SEQ ID NO: 821085 - protein, 18 aa, Mycobacterium
GTSTVYRGLDTRLDRPVA

SEQ ID NO: 821086 - protein, 24 aa, Mycobacterium
GTSVRMPLALSIPPGIPLEPGLYE

SEQ ID NO: 821087 - protein, 30 aa, Mycobacterium
GTSYIPGLQERTFPYLFSPAANEAVEQSDL

SEQ ID NO: 821088 - protein, 19 aa, Mycobacterium
GTSYWYVHTDQWRYDGYRA

SEQ ID NO: 821089 - protein, 26 aa, Mycobacterium
GTTAAMTVLTGLIPAGAEEVSAQAVL

SEQ ID NO: 821090 - protein, 17 aa, Mycobacterium
GTTALLIDVVPKPPERM

SEQ ID NO: 821091 - protein, 23 aa, Mycobacterium
GTTDIEYKFGFAGNPWGELEGIA

SEQ ID NO: 821092 - protein, 27 aa, Mycobacterium
GTTEELILQYDLWKAKGLRAVPPTAIQ

SEQ ID NO: 821093 - protein, 17 aa, Mycobacterium
GTTIFPFRRLFIVAEVG

SEQ ID NO: 821094 - protein, 22 aa, Mycobacterium
GTTIGEFAFPAGPGYLNSSATP

SEQ ID NO: 821095 - protein, 22 aa, Mycobacterium
GTTIVALKYPGGVLIAGDRRST

SEQ ID NO: 821096 - protein, 26 aa, Mycobacterium
GTTLLEYPVLMWHWARVADPAVPWDR

SEQ ID NO: 821097 - protein, 28 aa, Mycobacterium
GTTMTTADLFIRYLRPIRQGSAFAVPRM

SEQ ID NO: 821098 - protein, 28 aa, Mycobacterium
GTTPIYALPSYFMAAGTPLYAMSSILGM

SEQ ID NO: 821099 - protein, 22 aa, Mycobacterium
GTTPVYLPFTELNFPHGVAVDH

SEQ ID NO: 821100 - protein, 26 aa, Mycobacterium
GTTQHRFLYFPSENHWILSPQHAKLW

SEQ ID NO: 821101 - protein, 17 aa, Mycobacterium
GTTRAFFDVEFATTGWT

SEQ ID NO: 821102 - protein, 26 aa, Mycobacterium
GTTTPQLLRAFAAKGVALLPQYGGTE

SEQ ID NO: 821103 - protein, 17 aa, Mycobacterium
GTTVATACQPGRPVASI

SEQ ID NO: 821104 - protein, 25 aa, Mycobacterium
GTTVAYPVAYPMGLLPTPQNDSGLV

SEQ ID NO: 821105 - protein, 20 aa, Mycobacterium
GTTVYRLTVGPVPVDGFWSV

SEQ ID NO: 821106 - protein, 21 aa, Mycobacterium
GTVAGGINGISGDGGSGGAGG

SEQ ID NO: 821107 - protein, 23 aa, Mycobacterium
GTVARAFLRQALGVEVLSHVVSI

SEQ ID NO: 821108 - protein, 27 aa, Mycobacterium
GTVDDMVGMCLFLLSDKASWITGQVFN

SEQ ID NO: 821109 - protein, 31 aa, Mycobacterium
GTVDGPAVSCPLLVWVKTRDPKAYAGPDSAA

SEQ ID NO: 821110 - protein, 23 aa, Mycobacterium
GTVDIAVFPPIPVDDWTLDTLPD

SEQ ID NO: 821111 - protein, 23 aa, Mycobacterium
GTVDRLTFDPAGFGFPRADLDDL

SEQ ID NO: 821112 - protein, 36 aa, Mycobacterium
GTVEPWVRDYLFLRGLLGTSILWFELDRDGNGDPLP

SEQ ID NO: 821113 - protein, 36 aa, Mycobacterium
GTVEPWVRDYLLLRGLLGTSILWFELDRDGNGGPLP

SEQ ID NO: 821114 - protein, 27 aa, Mycobacterium
GTVETYLHRRSADLPPAVGVLVEYQGG

SEQ ID NO: 821115 - protein, 29 aa, Mycobacterium
GTVGLSYLGFTQWALLHDPPPELAAAVIT

SEQ ID NO: 821116 - protein, 26 aa, Mycobacterium
GTVGPIQMPPIRVTGPFISITVGSPE

SEQ ID NO: 821117 - protein, 25 aa, Mycobacterium
GTVHGGFLAALLDAATGLAVHSALD

SEQ ID NO: 821118 - protein, 20 aa, Mycobacterium
GTVHWLEPPAGPALGLNLGN

SEQ ID NO: 821119 - protein, 30 aa, Mycobacterium
GTVIRYPAIYGPRNLVPWEWSVMRRIRDGR

SEQ ID NO: 821120 - protein, 17 aa, Mycobacterium
GTVKAAAPPGATLLLLE

SEQ ID NO: 821121 - protein, 20 aa, Mycobacterium
GTVKIRIEGLKKSFGDLVVL

SEQ ID NO: 821122 - protein, 24 aa, Mycobacterium
GTVKKLFGRAIGNTRLRTEGRADQ

SEQ ID NO: 821123 - protein, 24 aa, Mycobacterium
GTVKPALVLVLGVGVAGLQALATA

SEQ ID NO: 821124 - protein, 32 aa, Mycobacterium
GTVLALRLQHLVPEWLWLLGRRVVNADRTVGP

SEQ ID NO: 821125 - protein, 17 aa, Mycobacterium
GTVLGPAATPLSRVSRG

SEQ ID NO: 821126 - protein, 21 aa, Mycobacterium
GTVLMVAWMNDEALALTLSTR

SEQ ID NO: 821127 - protein, 25 aa, Mycobacterium
GTVLSAGLMLAWCCDLIVAADDTVF

SEQ ID NO: 821128 - protein, 28 aa, Mycobacterium
GTVLTEPGYWPWPDVLANALVIDGALDE

SEQ ID NO: 821129 - protein, 26 aa, Mycobacterium
GTVLTPQWFADGARFWYRIGTRYVAV

SEQ ID NO: 821130 - protein, 24 aa, Mycobacterium
GTVMLRMPLHPVAIELLREVGPLA

SEQ ID NO: 821131 - protein, 24 aa, Mycobacterium
GTVMLRMPLHPVAIELLREVGPMA

SEQ ID NO: 821132 - protein, 18 aa, Mycobacterium
GTVMLTTGLLYGEPDKRG

SEQ ID NO: 821133 - protein, 20 aa, Mycobacterium
GTVPGFPNLFITSAPNYSPG

SEQ ID NO: 821134 - protein, 22 aa, Mycobacterium
GTVPIVPAAVIFDLPVGAWKNR

SEQ ID NO: 821135 - protein, 17 aa, Mycobacterium
GTVPLPFAGGSWVIWSR

SEQ ID NO: 821136 - protein, 23 aa, Mycobacterium
GTVPQRLWAKPAITVIGIDTTSV

SEQ ID NO: 821137 - protein, 23 aa, Mycobacterium
GTVRGTQFLQPLFEFSGACAGCG

SEQ ID NO: 821138 - protein, 33 aa, Mycobacterium
GTVRLACFVTLTPFVLPRLLPDLGTRHPDLEVE

SEQ ID NO: 821139 - protein, 25 aa, Mycobacterium
GTVRMIEAYHRLTKLREYSAVDFMG

SEQ ID NO: 821140 - protein, 20 aa, Mycobacterium
GTVRPYIGAQFPLSETAAAL

SEQ ID NO: 821141 - protein, 17 aa, Mycobacterium
GTVRQFDAILGTGSLLR

SEQ ID NO: 821142 - protein, 26 aa, Mycobacterium
GTVSPALATLGLGLVPLLDLASEAQQ

SEQ ID NO: 821143 - protein, 19 aa, Mycobacterium
GTVTAVGPPASHHLRWLAV

SEQ ID NO: 821144 - protein, 25 aa, Mycobacterium
GTVVRSWLQQLLAKALKEDPDLSEI

SEQ ID NO: 821145 - protein, 26 aa, Mycobacterium
GTVVRSWLQSLLAKALKEDPGFAEIS

SEQ ID NO: 821146 - protein, 21 aa, Mycobacterium
GTVWESAYAALYLLADESRFM

SEQ ID NO: 821147 - protein, 24 aa, Mycobacterium
GTVWINNWHQIDPALPFGGYKQSG

SEQ ID NO: 821148 - protein, 17 aa, Mycobacterium
GTVYIVQAALDALTASG

SEQ ID NO: 821149 - protein, 29 aa, Mycobacterium
GTVYLQHGFGAFGLLYQPLAIELAQQTNS

SEQ ID NO: 821150 - protein, 19 aa, Mycobacterium
GTWDLFRYPGIRADTDMYT

SEQ ID NO: 821151 - protein, 17 aa, Mycobacterium
GTWFAIDNFGVVPDLIT

SEQ ID NO: 821152 - protein, 23 aa, Mycobacterium
GTWGELFNIPLTAHFLGGAAIGD

SEQ ID NO: 821153 - protein, 26 aa, Mycobacterium
GTWHGRAPRLWLVTEGGLVVHDEPGR

SEQ ID NO: 821154 - protein, 21 aa, Mycobacterium
GTWHLPRLIGARRAAAAYLRN

SEQ ID NO: 821155 - protein, 19 aa, Mycobacterium
GTWIDRGGAWIGPGQDRIY

SEQ ID NO: 821156 - protein, 19 aa, Mycobacterium
GTWLAGRALAILPGPIRGA

SEQ ID NO: 821157 - protein, 23 aa, Mycobacterium
GTWLIAGFDELAAKVPGCIPLDR

SEQ ID NO: 821158 - protein, 23 aa, Mycobacterium
GTWLIAGFDELAAKVPGCIPLNR

SEQ ID NO: 821159 - protein, 21 aa, Mycobacterium
GTWLIGGFDELAVSVPGCIPA

SEQ ID NO: 821160 - protein, 23 aa, Mycobacterium
GTWLLSHNGLVDRAILPATRDAE

SEQ ID NO: 821161 - protein, 27 aa, Mycobacterium
GTWPHTREWLRRSFWDIPIDETRQILG

SEQ ID NO: 821162 - protein, 20 aa, Mycobacterium
GTWRAAWREHAHSQQSLHQA

SEQ ID NO: 821163 - protein, 19 aa, Mycobacterium
GTWRSYADHRMATAGAIVG

SEQ ID NO: 821164 - protein, 19 aa, Mycobacterium
GTWVARYPGAQWSVRGRDA

SEQ ID NO: 821165 - protein, 26 aa, Mycobacterium
GTYGNVLRFLPPLSMPDELLQEALAV

SEQ ID NO: 821166 - protein, 39 aa, Mycobacterium
GTYHKLDEFLPQFLKGCIQLGAWPLLETTWEMAPVDFTS

SEQ ID NO: 821167 - protein, 25 aa, Mycobacterium
GTYQYLDMHMAIASALSMFDNVLAP

SEQ ID NO: 821168 - protein, 17 aa, Mycobacterium
GTYRKVHQPVGESLTYL

SEQ ID NO: 821169 - protein, 17 aa, Mycobacterium
GVAAASLGLFTEAERRL

SEQ ID NO: 821170 - protein, 20 aa, Mycobacterium
GVAACWLGGARAVAAALYAR

SEQ ID NO: 821171 - protein, 19 aa, Mycobacterium
GVAAQRFVPNPFGAGRLYR

SEQ ID NO: 821172 - protein, 18 aa, Mycobacterium
GVAARLPEFSKPALIAWS

SEQ ID NO: 821173 - protein, 26 aa, Mycobacterium
GVACYPARFQLVLAANLCPCAPADPQ

SEQ ID NO: 821174 - protein, 26 aa, Mycobacterium
GVACYPARFQLVLAANLCPCAPADPR

SEQ ID NO: 821175 - protein, 25 aa, Mycobacterium
GVACYPARFQLVLAANPCPCAPPNP

SEQ ID NO: 821176 - protein, 17 aa, Mycobacterium
GVADFRRSLDRVMPRDK

SEQ ID NO: 821177 - protein, 18 aa, Mycobacterium
GVAEFRRSLDRVMPRDKD

SEQ ID NO: 821178 - protein, 22 aa, Mycobacterium
GVAELHYRFTLDGTSISRLVIE

SEQ ID NO: 821179 - protein, 26 aa, Mycobacterium
GVAEPLWIPTPVDPRLRRACALIADN

SEQ ID NO: 821180 - protein, 25 aa, Mycobacterium
GVAEWTQWWGDLPVFDDTAPEILEY

SEQ ID NO: 821181 - protein, 23 aa, Mycobacterium
GVAFDVLRRWLSARAYDVLFVRN

SEQ ID NO: 821182 - protein, 24 aa, Mycobacterium
GVAFDVLRRWLTAKGFDVAFIRNV

SEQ ID NO: 821183 - protein, 25 aa, Mycobacterium
GVAGAILVALLRYLTEASKQSMVLA

SEQ ID NO: 821184 - protein, 24 aa, Mycobacterium
GVAGAPGGWLLGDGGAGGSAAATP

SEQ ID NO: 821185 - protein, 26 aa, Mycobacterium
GVAGARRMLLLGYLLGNQHAPIDVDE

SEQ ID NO: 821186 - protein, 25 aa, Mycobacterium
GVAGIPFPPAFTLEGLQAAAAATRR

SEQ ID NO: 821187 - protein, 34 aa, Mycobacterium
GVAGKPLRGQWSLTKHRWLLTHDPAARAAVRRFD

SEQ ID NO: 821188 - protein, 26 aa, Mycobacterium
GVAGPVTFSFIDIPAAPGFGNTTATP

SEQ ID NO: 821189 - protein, 18 aa, Mycobacterium
GVAGQAGQPGPSATWPIF

SEQ ID NO: 821190 - protein, 26 aa, Mycobacterium
GVAGRYFRFYGHAIDSYYGQTIPLTT

SEQ ID NO: 821191 - protein, 26 aa, Mycobacterium
GVAHLVRVLQIKRLTGLGLSLKQIAE

SEQ ID NO: 821192 - protein, 18 aa, Mycobacterium
GVAIPHLNVTWLIESLDA

SEQ ID NO: 821193 - protein, 25 aa, Mycobacterium
GVAKAHFELWCFAVSSINGCPDCVA

SEQ ID NO: 821194 - protein, 42 aa, Mycobacterium
GVAKNRYLIYTSPDIRALYAFKRLAWWPYSVAMRQVNAIFTR

SEQ ID NO: 821195 - protein, 24 aa, Mycobacterium
GVAKTLLVRALAAALRLEFKRVQF

SEQ ID NO: 821196 - protein, 32 aa, Mycobacterium
GVAKYAEVPGSALWFMHQLANGWSGVKDFLGA

SEQ ID NO: 821197 - protein, 20 aa, Mycobacterium
GVALHHCVVALASMGWRAKV

SEQ ID NO: 821198 - protein, 19 aa, Mycobacterium
GVALHLPTVWRREDPWGEA

SEQ ID NO: 821199 - protein, 28 aa, Mycobacterium
GVALLEYPVWMWHWASPADAAVPWERAH

SEQ ID NO: 821200 - protein, 42 aa, Mycobacterium
GVALLSRYPAVSWQVARLPRIPFPFPLYLREPRKVVVVHEEP

SEQ ID NO: 821201 - protein, 18 aa, Mycobacterium
GVALMLAVCGRTVALDRL

SEQ ID NO: 821202 - protein, 20 aa, Mycobacterium
GVALPGPLRRWSEGLALLIT

SEQ ID NO: 821203 - protein, 20 aa, Mycobacterium
GVAMTLARIDFPAGGLCWTG

SEQ ID NO: 821204 - protein, 25 aa, Mycobacterium
GVAMTLARIDLPTGKLVWTGVGNVS

SEQ ID NO: 821205 - protein, 23 aa, Mycobacterium
GVANSWQSLSKIGPKTAKVIAQA

SEQ ID NO: 821206 - protein, 20 aa, Mycobacterium
GVAPIPRQPSSSCDPNYSGA

SEQ ID NO: 821207 - protein, 19 aa, Mycobacterium
GVAPLLRDRFRLVAIDNRG

SEQ ID NO: 821208 - protein, 24 aa, Mycobacterium
GVAPNTIYWYFPDKDEVLIAVLEA

SEQ ID NO: 821209 - protein, 25 aa, Mycobacterium
GVARGTFYFHFPTKEHVLVELERAE

SEQ ID NO: 821210 - protein, 20 aa, Mycobacterium
GVARISFGPFLQAALTGRAN

SEQ ID NO: 821211 - protein, 24 aa, Mycobacterium
GVARLIALDWGTTALRAWLLGDNG

SEQ ID NO: 821212 - protein, 19 aa, Mycobacterium
GVARPYVYGLALDGTNGVK

SEQ ID NO: 821213 - protein, 25 aa, Mycobacterium
GVARTVRMFGIQKAFMEILSQGTRF

SEQ ID NO: 821214 - protein, 24 aa, Mycobacterium
GVATPGMMGVPIPIPATGGNQTGS

SEQ ID NO: 821215 - protein, 25 aa, Mycobacterium
GVATSIWPHGRWRLAFRGEANHAGT

SEQ ID NO: 821216 - protein, 26 aa, Mycobacterium
GVAVDWAAVFAAHRPRRVDLPTYAFQ

SEQ ID NO: 821217 - protein, 28 aa, Mycobacterium
GVAVGLARRWPLGRAVRFGIAAASAKLQ

SEQ ID NO: 821218 - protein, 24 aa, Mycobacterium
GVAVWISGPQYQAWKHTQLVIDVV

SEQ ID NO: 821219 - protein, 18 aa, Mycobacterium
GVAYLTAWHSLCEVGRLS

SEQ ID NO: 821220 - protein, 17 aa, Mycobacterium
GVCLTVVELLPDGQFTA

SEQ ID NO: 821221 - protein, 25 aa, Mycobacterium
GVCQATLFRWKRQALIDAGVIEGTP

SEQ ID NO: 821222 - protein, 25 aa, Mycobacterium
GVCQDFAHLSLIMLRGMGIPARYVS

SEQ ID NO: 821223 - protein, 26 aa, Mycobacterium
GVCQDFAHLTLMVLRGMGIPSRYVSG

SEQ ID NO: 821224 - protein, 25 aa, Mycobacterium
GVCQDFVHLSLMVLRAMGIPAHYVS

SEQ ID NO: 821225 - protein, 23 aa, Mycobacterium
GVDAIQVFDSWAGALSLADYRAY

SEQ ID NO: 821226 - protein, 17 aa, Mycobacterium
GVDAIQVFDSWAGTLSL

SEQ ID NO: 821227 - protein, 18 aa, Mycobacterium
GVDAIWLNPVTVSPMADH

SEQ ID NO: 821228 - protein, 24 aa, Mycobacterium
GVDALHIYRVLFGYLYGHILTELQ

SEQ ID NO: 821229 - protein, 32 aa, Mycobacterium
GVDALRVGVLPTPAVAYLTGAYDADFGVMISA

SEQ ID NO: 821230 - protein, 19 aa, Mycobacterium
GVDALWLNPVMVSPMADHG

SEQ ID NO: 821231 - protein, 19 aa, Mycobacterium
GVDDALLTALLKAGVITTG

SEQ ID NO: 821232 - protein, 24 aa, Mycobacterium
GVDDAMALVYLLASPEADVVGIAS

SEQ ID NO: 821233 - protein, 24 aa, Mycobacterium
GVDDFGMGLLLKGRQVKKVIASYV

SEQ ID NO: 821234 - protein, 22 aa, Mycobacterium
GVDDRLSRLLGRPVRLIAQRPE

SEQ ID NO: 821235 - protein, 22 aa, Mycobacterium
GVDDVLMFRVYLTKREDFAAMN

SEQ ID NO: 821236 - protein, 25 aa, Mycobacterium
GVDELRAFDLLRRLSQESQVKLIDI

SEQ ID NO: 821237 - protein, 27 aa, Mycobacterium
GVDFTNIYFYAVLYHALRASNRIAVER

SEQ ID NO: 821238 - protein, 18 aa, Mycobacterium
GVDGAGCCDLAFAAPDAA

SEQ ID NO: 821239 - protein, 20 aa, Mycobacterium
GVDGFGERAQFDAAGLEVAG

SEQ ID NO: 821240 - protein, 17 aa, Mycobacterium
GVDGHRWGGLPLRSADR

SEQ ID NO: 821241 - protein, 29 aa, Mycobacterium
GVDGLLIMPEFANIRLVFDTTNPGARQSN

SEQ ID NO: 821242 - protein, 19 aa, Mycobacterium
GVDGQWLYTLGDVNHRALL

SEQ ID NO: 821243 - protein, 28 aa, Mycobacterium
GVDIAIALLTPLMGQEFLDKYRLRDPVN

SEQ ID NO: 821244 - protein, 29 aa, Mycobacterium
GVDINPFAVAIARFRLLVAALHAAGDSSI

SEQ ID NO: 821245 - protein, 22 aa, Mycobacterium
GVDKLDAALRFIVDYQYSYSGV

SEQ ID NO: 821246 - protein, 23 aa, Mycobacterium
GVDLGAWVYTCRDRYWDGLLSAA

SEQ ID NO: 821247 - protein, 20 aa, Mycobacterium
GVDLLPTLLDLLGIDMPADV

SEQ ID NO: 821248 - protein, 26 aa, Mycobacterium
GVDLPAGSRLLLLWGAANRDPSHFDA

SEQ ID NO: 821249 - protein, 24 aa, Mycobacterium
GVDLSHTLGWFTTKYPVAVSVGAL

SEQ ID NO: 821250 - protein, 25 aa, Mycobacterium
GVDRERVIPDILLSGKMLGGGVMPV

SEQ ID NO: 821251 - protein, 26 aa, Mycobacterium
GVDRKTDDALWKRYSTARETFNRRRG

SEQ ID NO: 821252 - protein, 27 aa, Mycobacterium
GVDRPQQNMWWWDVLRHGRNSEYAGYF

SEQ ID NO: 821253 - protein, 32 aa, Mycobacterium
GVDRPRGALLQLYLHAIAAGILRSLRTDAVAL

SEQ ID NO: 821254 - protein, 24 aa, Mycobacterium
GVDRTRTLSFYRTLSSTVSIVSAM

SEQ ID NO: 821255 - protein, 17 aa, Mycobacterium
GVDRYVMVSALAADDRS

SEQ ID NO: 821256 - protein, 25 aa, Mycobacterium
GVDSIMTVALRRTLEKRTGLALPPT

SEQ ID NO: 821257 - protein, 24 aa, Mycobacterium
GVDSPLLGYSYYGEVLLDWITERL

SEQ ID NO: 821258 - protein, 17 aa, Mycobacterium
GVDSWLAGWDEEFSGRL

SEQ ID NO: 821259 - protein, 19 aa, Mycobacterium
GVDTLLRRNSSPVNLVLDM

SEQ ID NO: 821260 - protein, 25 aa, Mycobacterium
GVDTLVAAWRLLLAEGIEGRCRIVG

SEQ ID NO: 821261 - protein, 36 aa, Mycobacterium
GVDTSLLRELNLLTTKPFLYVFNADESVLTDAARVA

SEQ ID NO: 821262 - protein, 32 aa, Mycobacterium
GVDTTGVPPAGWGWLPLLTGLAVAHTLRESYG

SEQ ID NO: 821263 - protein, 28 aa, Mycobacterium
GVDTVGARLLLLRRLAHPEDTRLGPPLR

SEQ ID NO: 821264 - protein, 31 aa, Mycobacterium
GVDVFEAALSAPLFWIATNAGLDGAVVVSKV

SEQ ID NO: 821265 - protein, 33 aa, Mycobacterium
GVDVLRVGVLPTPAVAYLTGAYGAAFGVMISAS

SEQ ID NO: 821266 - protein, 26 aa, Mycobacterium
GVDVVFNWDHFFPLYGDPDGAHFECW

SEQ ID NO: 821267 - protein, 19 aa, Mycobacterium
GVDWKGTLTGLAGYASGDL

SEQ ID NO: 821268 - protein, 32 aa, Mycobacterium
GVDYMTVHAGVLLRYIPLTVNRVTGIVSRGGS

SEQ ID NO: 821269 - protein, 29 aa, Mycobacterium
GVDYMTVHAGVLLRYVPLTAKRVTGIVSR

SEQ ID NO: 821270 - protein, 18 aa, Mycobacterium
GVEAALRSLARIAPTQRH

SEQ ID NO: 821271 - protein, 24 aa, Mycobacterium
GVEAIAAQHRLLISVIAHAGDGNT

SEQ ID NO: 821272 - protein, 20 aa, Mycobacterium
GVEALLRWRVGGVEIPAGEI

SEQ ID NO: 821273 - protein, 17 aa, Mycobacterium
GVEAPTPGLRQALRQTA

SEQ ID NO: 821274 - protein, 27 aa, Mycobacterium
GVEARAVLPEWFLGSGLTAAAYRGAQL

SEQ ID NO: 821275 - protein, 20 aa, Mycobacterium
GVEDFFWYAAQGGYGIQMAP

SEQ ID NO: 821276 - protein, 24 aa, Mycobacterium
GVEGLTYVWTPDQLRRVLGEDDGR

SEQ ID NO: 821277 - protein, 25 aa, Mycobacterium
GVEGQWLYALGDVNRRALLTHQGKY

SEQ ID NO: 821278 - protein, 34 aa, Mycobacterium
GVEHGQRLAIWSPNSWHWPIACLGGQYAGAAVVP

SEQ ID NO: 821279 - protein, 22 aa, Mycobacterium
GVEHTWLGFVDSGLPQGDPPPP

SEQ ID NO: 821280 - protein, 20 aa, Mycobacterium
GVEIAEMFQMPPALDRAWHT

SEQ ID NO: 821281 - protein, 21 aa, Mycobacterium
GVEIAEMFQMPPALEQAWHTR

SEQ ID NO: 821282 - protein, 21 aa, Mycobacterium
GVEIAEMFQMPPALERAWHTH

SEQ ID NO: 821283 - protein, 21 aa, Mycobacterium
GVEIAEMFRMPPALERAWHTH

SEQ ID NO: 821284 - protein, 17 aa, Mycobacterium
GVEIHAANGYLLDQFLT

SEQ ID NO: 821285 - protein, 21 aa, Mycobacterium
GVEIRPLYAWSGYRTNEVAFR

SEQ ID NO: 821286 - protein, 24 aa, Mycobacterium
GVEIRYYSVIYQAIDEIEAALRGM

SEQ ID NO: 821287 - protein, 24 aa, Mycobacterium
GVEIRYYSVIYQAIDEIEKALRGM

SEQ ID NO: 821288 - protein, 20 aa, Mycobacterium
GVELIAIQRGAPLALDLRVE

SEQ ID NO: 821289 - protein, 34 aa, Mycobacterium
GVEPGDRIAIWSPNTWHWVVASLATHYAGGVVVP

SEQ ID NO: 821290 - protein, 34 aa, Mycobacterium
GVEPGDRVAIWSPNTWHWVVACLAIHHAGAAMVP

SEQ ID NO: 821291 - protein, 26 aa, Mycobacterium
GVEPNMRWRTFCAELLNIADKLNVQT

SEQ ID NO: 821292 - protein, 18 aa, Mycobacterium
GVEPPVALILQGASLHDL

SEQ ID NO: 821293 - protein, 18 aa, Mycobacterium
GVEPPVTLILQGASLHDL

SEQ ID NO: 821294 - protein, 20 aa, Mycobacterium
GVEPWTMKPDVCWQLPIRRS

SEQ ID NO: 821295 - protein, 20 aa, Mycobacterium
GVEQAAFWGLGRVIGHQELG

SEQ ID NO: 821296 - protein, 23 aa, Mycobacterium
GVEQFGYLWDTPVANWNRVMDIN

SEQ ID NO: 821297 - protein, 25 aa, Mycobacterium
GVEQVWFRDGWVDRFGLDLPRDAHG

SEQ ID NO: 821298 - protein, 25 aa, Mycobacterium
GVEQVWLRDGWVDRFGLDLPQGDMG

SEQ ID NO: 821299 - protein, 26 aa, Mycobacterium
GVEQVWTRDGWIDRFDLGLPPDDIGY

SEQ ID NO: 821300 - protein, 21 aa, Mycobacterium
GVERLDAALRFIVDYQYSYSG

SEQ ID NO: 821301 - protein, 28 aa, Mycobacterium
GVERPIVQAPMGWIARSQLASAVCNAGG

SEQ ID NO: 821302 - protein, 25 aa, Mycobacterium
GVERRWVYLHYFKDGQPSINWLDPS

SEQ ID NO: 821303 - protein, 22 aa, Mycobacterium
GVESMSRWDVTVGSPTIDGRNP

SEQ ID NO: 821304 - protein, 20 aa, Mycobacterium
GVETTLLLNDADAKAMGLKA

SEQ ID NO: 821305 - protein, 24 aa, Mycobacterium
GVETTWFVHPLQISSPITEIPDHL

SEQ ID NO: 821306 - protein, 17 aa, Mycobacterium
GVEVHLLPFPDLGEQDA

SEQ ID NO: 821307 - protein, 20 aa, Mycobacterium
GVEVLLLGDLLTEALDKSGA

SEQ ID NO: 821308 - protein, 24 aa, Mycobacterium
GVEVLLLSDLLTEALTHSGAARMQ

SEQ ID NO: 821309 - protein, 28 aa, Mycobacterium
GVFAFSSWVRSVSNPLFDPVLAVLGPPA

SEQ ID NO: 821310 - protein, 21 aa, Mycobacterium
GVFCRRWGVPLIDGGTVRLPR

SEQ ID NO: 821311 - protein, 17 aa, Mycobacterium
GVFDSFVERLAPGGALV

SEQ ID NO: 821312 - protein, 22 aa, Mycobacterium
GVFEGPPPWNIGEPQPELAALI

SEQ ID NO: 821313 - protein, 17 aa, Mycobacterium
GVFGFKCFLLHSGVDEF

SEQ ID NO: 821314 - protein, 24 aa, Mycobacterium
GVFHTLRAAIPVMRQQRFGRIVAT

SEQ ID NO: 821315 - protein, 23 aa, Mycobacterium
GVFKEWNPHDYIPWSDGKNYKAL

SEQ ID NO: 821316 - protein, 33 aa, Mycobacterium
GVFLPLHLLCLRDMGMMFGEYWDLTALAEDCAA

SEQ ID NO: 821317 - protein, 31 aa, Mycobacterium
GVFSTAHDVGIFAQALLDRLAGRPSEFPLAQ

SEQ ID NO: 821318 - protein, 22 aa, Mycobacterium
GVFVPAHRLVKVSDIYAGTAPG

SEQ ID NO: 821319 - protein, 25 aa, Mycobacterium
GVGALLLRRDTACVPLLHGGGQERD

SEQ ID NO: 821320 - protein, 21 aa, Mycobacterium
GVGALLLRRDTACVPQLHGGG

SEQ ID NO: 821321 - protein, 26 aa, Mycobacterium
GVGALLLRREIACVPLLHGGGHERDI

SEQ ID NO: 821322 - protein, 26 aa, Mycobacterium
GVGASSLFLLLFTSGTTGASKAVKCS

SEQ ID NO: 821323 - protein, 26 aa, Mycobacterium
GVGDILLIAFGLAFAEFLGAGAAVPI

SEQ ID NO: 821324 - protein, 26 aa, Mycobacterium
GVGDILLIAFGLAFAEFLGTGAAPIG

SEQ ID NO: 821325 - protein, 41 aa, Mycobacterium
GVGDQPLLRGFPTAPMRAVHLWATPEPLPPAPGSALVVAYE

SEQ ID NO: 821326 - protein, 27 aa, Mycobacterium
GVGEEEFVRFQKAWFAELHSAGYAVPH

SEQ ID NO: 821327 - protein, 26 aa, Mycobacterium
GVGERTLYRRFPTKADLVLAALEQSI

SEQ ID NO: 821328 - protein, 29 aa, Mycobacterium
GVGEVPPDRWGLVPLLAGVAIVDAVAEVS

SEQ ID NO: 821329 - protein, 26 aa, Mycobacterium
GVGFFDAGVPRRWRSASPLWGDTSFV

SEQ ID NO: 821330 - protein, 29 aa, Mycobacterium
GVGFFDGGVPRRWRSAAPLWGDASFASVA

SEQ ID NO: 821331 - protein, 17 aa, Mycobacterium
GVGFMRAALREATAYVR

SEQ ID NO: 821332 - protein, 22 aa, Mycobacterium
GVGFRPFVHVLATELGLAGFVG

SEQ ID NO: 821333 - protein, 18 aa, Mycobacterium
GVGFRPFVYTTAAAMGLT

SEQ ID NO: 821334 - protein, 19 aa, Mycobacterium
GVGFSFGFPVDARVWDAVD

SEQ ID NO: 821335 - protein, 29 aa, Mycobacterium
GVGGAGGANNAWLGGAAGSGGTGGSGGTG

SEQ ID NO: 821336 - protein, 18 aa, Mycobacterium
GVGGAGGWLSGNAGAGGA

SEQ ID NO: 821337 - protein, 24 aa, Mycobacterium
GVGGLFEILRRWIDGQLNLSTEVL

SEQ ID NO: 821338 - protein, 23 aa, Mycobacterium
GVGGLMLFGVPQEKDKDATGSAG

SEQ ID NO: 821339 - protein, 23 aa, Mycobacterium
GVGGLMLFGVPRDQDKDAVGSAG

SEQ ID NO: 821340 - protein, 20 aa, Mycobacterium
GVGGLMLFGVPRDTSKDPVG

SEQ ID NO: 821341 - protein, 25 aa, Mycobacterium
GVGGRGGVLFGDGGIGGAGGGGGIG

SEQ ID NO: 821342 - protein, 28 aa, Mycobacterium
GVGGTGGDAGWLVGAGGSGGSGGIGATG

SEQ ID NO: 821343 - protein, 18 aa, Mycobacterium
GVGGTGGWLSGSGGVGGA

SEQ ID NO: 821344 - protein, 23 aa, Mycobacterium
GVGGTGGWLYGNGGAGGIGGTGG

SEQ ID NO: 821345 - protein, 28 aa, Mycobacterium
GVGGTSGLLLGLDGFNAPASTSPLHTFQ

SEQ ID NO: 821346 - protein, 22 aa, Mycobacterium
GVGGTWHWNTYPGIAVDIPSYS

SEQ ID NO: 821347 - protein, 22 aa, Mycobacterium
GVGGTWYWNTYPGIAVDIPSFS

SEQ ID NO: 821348 - protein, 19 aa, Mycobacterium
GVGGYFDALSWRPQDTEGQ

SEQ ID NO: 821349 - protein, 35 aa, Mycobacterium
GVGHHMRVYVPFGEQWYGYFVRRIAERPANMTFFL

SEQ ID NO: 821350 - protein, 22 aa, Mycobacterium
GVGIHPFGRFEGKTAMQMGVDA

SEQ ID NO: 821351 - protein, 26 aa, Mycobacterium
GVGILAAFEEMFWGDAGIAISIMGTG

SEQ ID NO: 821352 - protein, 22 aa, Mycobacterium
GVGIRLFRPPASTTLPGPALVW

SEQ ID NO: 821353 - protein, 24 aa, Mycobacterium
GVGKKTLYRRWPSKAPLVAEAVLE

SEQ ID NO: 821354 - protein, 24 aa, Mycobacterium
GVGKLLRPKLKERYADRLEQLYAE

SEQ ID NO: 821355 - protein, 25 aa, Mycobacterium
GVGKQTIYRWWPSRHALVADVILED

SEQ ID NO: 821356 - protein, 25 aa, Mycobacterium
GVGKQTIYRWWPSRHALVADVLLED

SEQ ID NO: 821357 - protein, 19 aa, Mycobacterium
GVGLALVAQHRGYKCVFVC

SEQ ID NO: 821358 - protein, 21 aa, Mycobacterium
GVGLALVAQQRGYKCVFVCPD

SEQ ID NO: 821359 - protein, 25 aa, Mycobacterium
GVGLGLPQLLALNALGAPVNAGLAA

SEQ ID NO: 821360 - protein, 21 aa, Mycobacterium
GVGLHPFGRFDKPAVQMGAEA

SEQ ID NO: 821361 - protein, 21 aa, Mycobacterium
GVGLHPFGRFDKTAMEMGAEA

SEQ ID NO: 821362 - protein, 20 aa, Mycobacterium
GVGLILTQWATSLGTRVITT

SEQ ID NO: 821363 - protein, 19 aa, Mycobacterium
GVGLRYLLQHGYVADFHIL

SEQ ID NO: 821364 - protein, 29 aa, Mycobacterium
GVGLTVCYDIRFPALYTELARRGAQLIAV

SEQ ID NO: 821365 - protein, 26 aa, Mycobacterium
GVGLTVVPRLALIDLPAGVRTVAISE

SEQ ID NO: 821366 - protein, 25 aa, Mycobacterium
GVGLVAVHTWMNSADFYVDVSVIDV

SEQ ID NO: 821367 - protein, 17 aa, Mycobacterium
GVGLYLDGGFGVGKTHL

SEQ ID NO: 821368 - protein, 17 aa, Mycobacterium
GVGMHRCLGSHYAKLMF

SEQ ID NO: 821369 - protein, 33 aa, Mycobacterium
GVGNMITGLLLGLPTVIHPLGAFDPGALLDVLE

SEQ ID NO: 821370 - protein, 27 aa, Mycobacterium
GVGNPPLIVTINFLGLRHLTEALIPKM

SEQ ID NO: 821371 - protein, 23 aa, Mycobacterium
GVGPEHALLKDVGRARYLPITDS

SEQ ID NO: 821372 - protein, 26 aa, Mycobacterium
GVGPESLFLLLFTSGTTGASKAVKCS

SEQ ID NO: 821373 - protein, 24 aa, Mycobacterium
GVGPINIPIINIPATPGFGNSTDA

SEQ ID NO: 821374 - protein, 19 aa, Mycobacterium
GVGPLTRAFLLTNVVELAE

SEQ ID NO: 821375 - protein, 18 aa, Mycobacterium
GVGPRLELLAELVNGRTQ

SEQ ID NO: 821376 - protein, 29 aa, Mycobacterium
GVGPVVATPIMRWLYSLDGPIDEFNQTVV

SEQ ID NO: 821377 - protein, 20 aa, Mycobacterium
GVGPWELERGLPLPEDPRYD

SEQ ID NO: 821378 - protein, 17 aa, Mycobacterium
GVGPWSGPPPDDPRYDP

SEQ ID NO: 821379 - protein, 19 aa, Mycobacterium
GVGPYPPIFVGRFTNMMRI

SEQ ID NO: 821380 - protein, 26 aa, Mycobacterium
GVGQGRLYFGIGLPELTLPPLDVPGI

SEQ ID NO: 821381 - protein, 24 aa, Mycobacterium
GVGRGTFYLYFDTKRDVLDAVIDS

SEQ ID NO: 821382 - protein, 21 aa, Mycobacterium
GVGRLDLGSVLIPVPETGQIQ

SEQ ID NO: 821383 - protein, 20 aa, Mycobacterium
GVGRLKKPWLGDQVGPEVLE

SEQ ID NO: 821384 - protein, 23 aa, Mycobacterium
GVGRLKRDWLPKQLGDDVMWVTR

SEQ ID NO: 821385 - protein, 23 aa, Mycobacterium
GVGRSAFYFYFENKAAAVAALLE

SEQ ID NO: 821386 - protein, 22 aa, Mycobacterium
GVGSKGWYVAPTVLAGVAPQAD

SEQ ID NO: 821387 - protein, 18 aa, Mycobacterium
GVGSPFHGGGGGGGGGGG

SEQ ID NO: 821388 - protein, 21 aa, Mycobacterium
GVGSWPGILARPAAEVVVGEL

SEQ ID NO: 821389 - protein, 25 aa, Mycobacterium
GVGTAYYEAKLPAGSPVIRVMPNAP

SEQ ID NO: 821390 - protein, 19 aa, Mycobacterium
GVGTLDLFHDEDLAYAGRL

SEQ ID NO: 821391 - protein, 23 aa, Mycobacterium
GVGTLVMTHYVPAIIAGQEDQWR

SEQ ID NO: 821392 - protein, 23 aa, Mycobacterium
GVGTLYRRTLGKETLLAAAVIDL

SEQ ID NO: 821393 - protein, 24 aa, Mycobacterium
GVGTMLMPLLYGGILLVFEVCGQC

SEQ ID NO: 821394 - protein, 18 aa, Mycobacterium
GVGTVFAFERGQPVLAID

SEQ ID NO: 821395 - protein, 24 aa, Mycobacterium
GVGTVLDVLAPPPAAPVVVFGAGA

SEQ ID NO: 821396 - protein, 23 aa, Mycobacterium
GVGTVPWRLPAVEAALRGRPPDA

SEQ ID NO: 821397 - protein, 26 aa, Mycobacterium
GVGTVPWRLPAVERALAGRPATADAI

SEQ ID NO: 821398 - protein, 24 aa, Mycobacterium
GVGTVTCIVSFDPKAGWSHRFVPV

SEQ ID NO: 821399 - protein, 28 aa, Mycobacterium
GVGVGLAVGLFAPALLASAAVGAAAGAL

SEQ ID NO: 821400 - protein, 19 aa, Mycobacterium
GVGVGWQRAEYDAAGLPFA

SEQ ID NO: 821401 - protein, 18 aa, Mycobacterium
GVGVLPRAPVRHPGTVEI

SEQ ID NO: 821402 - protein, 31 aa, Mycobacterium
GVGVLYARRQLLSELPPFLTGGSMIETVTME

SEQ ID NO: 821403 - protein, 27 aa, Mycobacterium
GVGVRVLSAPPFAFPLRGGDDADRYAA

SEQ ID NO: 821404 - protein, 22 aa, Mycobacterium
GVGWDSGLLGLAGYLAAPNDRI

SEQ ID NO: 821405 - protein, 29 aa, Mycobacterium
GVGYMAVTPPLPRWTARQPVLSPGSGPEP

SEQ ID NO: 821406 - protein, 23 aa, Mycobacterium
GVHAPTWAAPQWLRLGRELIGGE

SEQ ID NO: 821407 - protein, 33 aa, Mycobacterium
GVHASMSISLLRHGRLWGLIACHHYAGPHLPPF

SEQ ID NO: 821408 - protein, 33 aa, Mycobacterium
GVHASMSISLLRQGRLWGLIACHHYAGPHLPPF

SEQ ID NO: 821409 - protein, 25 aa, Mycobacterium
GVHCVYKPVRGEQPLWDFPDGTLAG

SEQ ID NO: 821410 - protein, 34 aa, Mycobacterium
GVHELEAVGLPGPPRRILGPFAGVGALGVPPHRV

SEQ ID NO: 821411 - protein, 17 aa, Mycobacterium
GVHFFTRQKAITTRWLD

SEQ ID NO: 821412 - protein, 25 aa, Mycobacterium
GVHGFDLMFAAPKSVSLLRSLTDDV

SEQ ID NO: 821413 - protein, 25 aa, Mycobacterium
GVHGLEPGPWRLDTLPLVVSAQDWE

SEQ ID NO: 821414 - protein, 25 aa, Mycobacterium
GVHIPLGFLGSWMNFRHTAPERFDA

SEQ ID NO: 821415 - protein, 20 aa, Mycobacterium
GVHIVYDVWTPDAAPKAVVV

SEQ ID NO: 821416 - protein, 24 aa, Mycobacterium
GVHPMTLWKWMRQADIDEGAKPGK

SEQ ID NO: 821417 - protein, 21 aa, Mycobacterium
GVHPVDLGAAAWRGLFERNDV

SEQ ID NO: 821418 - protein, 27 aa, Mycobacterium
GVHPVDLGAFAWRGLLDRVDVDPAAVD

SEQ ID NO: 821419 - protein, 18 aa, Mycobacterium
GVHQAMEYLPWANRLQEG

SEQ ID NO: 821420 - protein, 25 aa, Mycobacterium
GVHRLGIVTPYPDYMNARIGESYRA

SEQ ID NO: 821421 - protein, 24 aa, Mycobacterium
GVHRSTVYYYFPSKDALLAASFMR

SEQ ID NO: 821422 - protein, 42 aa, Mycobacterium
GVHRWRSIPYARPPVGPLRYRAPRPVQPWPGVRYCHGFGACA

SEQ ID NO: 821423 - protein, 22 aa, Mycobacterium
GVHRWRSIPYARPPVGSLRLRA

SEQ ID NO: 821424 - protein, 26 aa, Mycobacterium
GVHSTALYYPLVATPMIAPTKAYEGV

SEQ ID NO: 821425 - protein, 24 aa, Mycobacterium
GVHSTFFRLLHIGDTYNPVPTTSL

SEQ ID NO: 821426 - protein, 31 aa, Mycobacterium
GVHTARALLNFPISGMPISRHPDLVVALASV

SEQ ID NO: 821427 - protein, 24 aa, Mycobacterium
GVHTLPLLHVGGCSVLLPSFDPRQ

SEQ ID NO: 821428 - protein, 25 aa, Mycobacterium
GVHTLPMVYALREPGPDAARLRELL

SEQ ID NO: 821429 - protein, 18 aa, Mycobacterium
GVHTNPWLRNGNALTYVP

SEQ ID NO: 821430 - protein, 25 aa, Mycobacterium
GVHTYLKRAALNRSLFGSPREHRTM

SEQ ID NO: 821431 - protein, 18 aa, Mycobacterium
GVHVDPAAFFDRLVERVG

SEQ ID NO: 821432 - protein, 24 aa, Mycobacterium
GVHVFPDGCALLLAGRDTGVRLGA

SEQ ID NO: 821433 - protein, 21 aa, Mycobacterium
GVHVTLLAPGPVRTVEPDPAE

SEQ ID NO: 821434 - protein, 35 aa, Mycobacterium
GVIAGRWQLIAFAAPLLGVLCSISWQRPVPTVRVH

SEQ ID NO: 821435 - protein, 25 aa, Mycobacterium
GVIDGVVPLALLRETLDRTLRVVAD

SEQ ID NO: 821436 - protein, 24 aa, Mycobacterium
GVIDKLPRMLGTQAAGAAPLVHGA

SEQ ID NO: 821437 - protein, 24 aa, Mycobacterium
GVIDKLPRMLGTQAAGAAPLVLGK

SEQ ID NO: 821438 - protein, 18 aa, Mycobacterium
GVIDLRKTLRKSMSTGGV

SEQ ID NO: 821439 - protein, 17 aa, Mycobacterium
GVIDLTCRARQADPLLF

SEQ ID NO: 821440 - protein, 23 aa, Mycobacterium
GVIDPYHRVYGYPTLFVVDGAAI

SEQ ID NO: 821441 - protein, 27 aa, Mycobacterium
GVIDPYHRVYGYPTMFVVDGAAISANL

SEQ ID NO: 821442 - protein, 29 aa, Mycobacterium
GVIDVHAHWLPRELFDLPPGAPYGPLHDR

SEQ ID NO: 821443 - protein, 32 aa, Mycobacterium
GVIDVRHELAPATRLKLLQIAAIIVEYFASGP

SEQ ID NO: 821444 - protein, 18 aa, Mycobacterium
GVIGFFPANAVGPGFEDI

SEQ ID NO: 821445 - protein, 18 aa, Mycobacterium
GVIGFTRNLAHEVALRGV

SEQ ID NO: 821446 - protein, 26 aa, Mycobacterium
GVIGKILPAEDMPFLPDGTPVDIILN

SEQ ID NO: 821447 - protein, 29 aa, Mycobacterium
GVIGKILPQEDMPFLPDGTPVDIILNTHG

SEQ ID NO: 821448 - protein, 19 aa, Mycobacterium
GVIGPMFRSAVRSAEVRRR

SEQ ID NO: 821449 - protein, 22 aa, Mycobacterium
GVIGRWLQKLLSSSRKSGGDGA

SEQ ID NO: 821450 - protein, 18 aa, Mycobacterium
GVIHGIKAFVPLLLEQGE

SEQ ID NO: 821451 - protein, 26 aa, Mycobacterium
GVIKDPFGHLWSLGQPVKIVNPEDLK

SEQ ID NO: 821452 - protein, 20 aa, Mycobacterium
GVIKVVREIVSGLGLKEAKD

SEQ ID NO: 821453 - protein, 17 aa, Mycobacterium
GVILECSVHMETTGDRE

SEQ ID NO: 821454 - protein, 23 aa, Mycobacterium
GVIMVRMPGFGLQGPWRDYVGWA

SEQ ID NO: 821455 - protein, 21 aa, Mycobacterium
GVINHFIPNPTFDPIIEPGCL

SEQ ID NO: 821456 - protein, 27 aa, Mycobacterium
GVIRKRYNLFANIRPARALSKSVRAVC

SEQ ID NO: 821457 - protein, 20 aa, Mycobacterium
GVIRRYQLPFGMNRAAAVAV

SEQ ID NO: 821458 - protein, 25 aa, Mycobacterium
GVIRTRGRLWLANRPDQVMWLESAG

SEQ ID NO: 821459 - protein, 25 aa, Mycobacterium
GVISGRISYLLGLAGPALTIDSSCS

SEQ ID NO: 821460 - protein, 19 aa, Mycobacterium
GVISLEDGHRHTSGDGIGG

SEQ ID NO: 821461 - protein, 25 aa, Mycobacterium
GVISVRGNWPLVPTMDVVVPHTRSM

SEQ ID NO: 821462 - protein, 24 aa, Mycobacterium
GVITGLDLRLHAIPPHRVTAICGF

SEQ ID NO: 821463 - protein, 17 aa, Mycobacterium
GVITRHDLLGFVSSGRG

SEQ ID NO: 821464 - protein, 21 aa, Mycobacterium
GVIVRIWRIPGTRSNVGIWSA

SEQ ID NO: 821465 - protein, 19 aa, Mycobacterium
GVKALLLDTFSNGLEQQME

SEQ ID NO: 821466 - protein, 31 aa, Mycobacterium
GVKAQVLAEALPWLKQLHGKIVVIKYGGNAM

SEQ ID NO: 821467 - protein, 29 aa, Mycobacterium
GVKESFRRYGTDDLVWWNSGRGALTGLDV

SEQ ID NO: 821468 - protein, 24 aa, Mycobacterium
GVKFSVVMPTFVNTELIAGTSGAK

SEQ ID NO: 821469 - protein, 26 aa, Mycobacterium
GVKGFFEKTFAPLGLKRIQGEVLANL

SEQ ID NO: 821470 - protein, 17 aa, Mycobacterium
GVKGKVKEVAGAVAGRD

SEQ ID NO: 821471 - protein, 25 aa, Mycobacterium
GVKGRVLPMCPIALQIEADVSGLES

SEQ ID NO: 821472 - protein, 23 aa, Mycobacterium
GVKGRVLPMCPVGLSIEADVVGL

SEQ ID NO: 821473 - protein, 17 aa, Mycobacterium
GVKLLNLRSTLLTLAGG

SEQ ID NO: 821474 - protein, 28 aa, Mycobacterium
GVKNYPAYFGFLKSKLRTGGLLLNHCIT

SEQ ID NO: 821475 - protein, 34 aa, Mycobacterium
GVKPAARVGIWSPNTWHWVVACLAIHHVGAAMVP

SEQ ID NO: 821476 - protein, 33 aa, Mycobacterium
GVKPALVHYYFPTMDDLYLTVFRRGAAAYLERQ

SEQ ID NO: 821477 - protein, 18 aa, Mycobacterium
GVKPIIGIEAYIAPASRF

SEQ ID NO: 821478 - protein, 30 aa, Mycobacterium
GVKQALVYYYFPTMDDLFVEVLRVGGESSL

SEQ ID NO: 821479 - protein, 24 aa, Mycobacterium
GVKQRFVDLLPQLTILDAGGSSES

SEQ ID NO: 821480 - protein, 19 aa, Mycobacterium
GVKVIELGGIGPGPHAAMM

SEQ ID NO: 821481 - protein, 20 aa, Mycobacterium
GVKVIPWIPTAVRRGLVRGR

SEQ ID NO: 821482 - protein, 20 aa, Mycobacterium
GVKYQWPQGTYLAWLDCRGL

SEQ ID NO: 821483 - protein, 18 aa, Mycobacterium
GVLAKYVKLVSSAAIGAV

SEQ ID NO: 821484 - protein, 25 aa, Mycobacterium
GVLARFPDLTLPSLGFTFYGATPDN

SEQ ID NO: 821485 - protein, 23 aa, Mycobacterium
GVLASLLLNRLSLAPGEALYLPA

SEQ ID NO: 821486 - protein, 23 aa, Mycobacterium
GVLASLLLNRLTLEPGEGIYLPA

SEQ ID NO: 821487 - protein, 30 aa, Mycobacterium
GVLDIDALTLAFRALLRSYPVLATQIVSAG

SEQ ID NO: 821488 - protein, 23 aa, Mycobacterium
GVLDLLKRLDIVPLPNTAGCRGA

SEQ ID NO: 821489 - protein, 17 aa, Mycobacterium
GVLEAWTGAGLAVIIDA

SEQ ID NO: 821490 - protein, 21 aa, Mycobacterium
GVLERAATAEALLLGRLGDLD

SEQ ID NO: 821491 - protein, 21 aa, Mycobacterium
GVLERGLLLNTRFALDHHINL

SEQ ID NO: 821492 - protein, 28 aa, Mycobacterium
GVLERGMLLKLRFALDHHVNLRPGRLYP

SEQ ID NO: 821493 - protein, 25 aa, Mycobacterium
GVLEVLELHPLLNPAGYVRAETADR

SEQ ID NO: 821494 - protein, 18 aa, Mycobacterium
GVLGLPFASGHYLALRQF

SEQ ID NO: 821495 - protein, 17 aa, Mycobacterium
GVLGRMYRRTVWPLRVA

SEQ ID NO: 821496 - protein, 22 aa, Mycobacterium
GVLGWGRLWELTDEQWDTVIGV

SEQ ID NO: 821497 - protein, 22 aa, Mycobacterium
GVLGWGRLWELTDEQWDTVVGV

SEQ ID NO: 821498 - protein, 17 aa, Mycobacterium
GVLGWPRRKLSKAVLSL

SEQ ID NO: 821499 - protein, 30 aa, Mycobacterium
GVLHAAMISLETCPPMGHPHHHHLHLPHLP

SEQ ID NO: 821500 - protein, 21 aa, Mycobacterium
GVLHGDYLGLLPGPGSEPGES

SEQ ID NO: 821501 - protein, 27 aa, Mycobacterium
GVLHRQRRPLRGPAPPPRQIGLADIPG

SEQ ID NO: 821502 - protein, 21 aa, Mycobacterium
GVLILAVHHLAADPISWRVIM

SEQ ID NO: 821503 - protein, 18 aa, Mycobacterium
GVLKLQIPVAEKAKPRKI

SEQ ID NO: 821504 - protein, 18 aa, Mycobacterium
GVLLARPRGPVDPTAVVK

SEQ ID NO: 821505 - protein, 20 aa, Mycobacterium
GVLLCTVTRRSTLPRDLTER

SEQ ID NO: 821506 - protein, 25 aa, Mycobacterium
GVLLDAVYDPWPTPLAAAVSAAGGR

SEQ ID NO: 821507 - protein, 27 aa, Mycobacterium
GVLLDNVPDFVFWLGGAALAGATIVGI

SEQ ID NO: 821508 - protein, 27 aa, Mycobacterium
GVLLDNVPDFVFWLGGAALAGATVVGI

SEQ ID NO: 821509 - protein, 25 aa, Mycobacterium
GVLMAAYGISARRAFDILVWRSQET

SEQ ID NO: 821510 - protein, 17 aa, Mycobacterium
GVLMAMGPGFCSELVLL

SEQ ID NO: 821511 - protein, 24 aa, Mycobacterium
GVLPAAADLVSLLTATQFATHAQM

SEQ ID NO: 821512 - protein, 18 aa, Mycobacterium
GVLPAADPAIWDHPVDHP

SEQ ID NO: 821513 - protein, 25 aa, Mycobacterium
GVLPILERMGLWRHPNRQSHPAGAT

SEQ ID NO: 821514 - protein, 18 aa, Mycobacterium
GVLPLVDLASEDQQERFL

SEQ ID NO: 821515 - protein, 18 aa, Mycobacterium
GVLPPEKGFVYLDDVPAA

SEQ ID NO: 821516 - protein, 21 aa, Mycobacterium
GVLQYRVLRAFKKAGLNSQRA

SEQ ID NO: 821517 - protein, 19 aa, Mycobacterium
GVLRFVVLDGLGRPGRLVG

SEQ ID NO: 821518 - protein, 39 aa, Mycobacterium
GVLRNEAIIVVPRWWKALWYLERLSPALSMRTAAVALKR

SEQ ID NO: 821519 - protein, 18 aa, Mycobacterium
GVLRQTRRHARIAKLLGI

SEQ ID NO: 821520 - protein, 25 aa, Mycobacterium
GVLRRLYSLLRPGGELRYLEHVASA

SEQ ID NO: 821521 - protein, 18 aa, Mycobacterium
GVLRRSRAAARPRGLRPP

SEQ ID NO: 821522 - protein, 19 aa, Mycobacterium
GVLSFRMYYRGHNLHLRVS

SEQ ID NO: 821523 - protein, 22 aa, Mycobacterium
GVLTGKLVIRDLLGRLGVGSDT

SEQ ID NO: 821524 - protein, 18 aa, Mycobacterium
GVLVAMNTLWELGVPRRD

SEQ ID NO: 821525 - protein, 17 aa, Mycobacterium
GVLVASDECYLGLGWDA

SEQ ID NO: 821526 - protein, 19 aa, Mycobacterium
GVLVATNFFGINTIPIALN

SEQ ID NO: 821527 - protein, 17 aa, Mycobacterium
GVLVCVAQCRPNTAPTV

SEQ ID NO: 821528 - protein, 20 aa, Mycobacterium
GVLVDVVLFALGRSDAVPSA

SEQ ID NO: 821529 - protein, 19 aa, Mycobacterium
GVLVGSWHTIEGLVFSMPA

SEQ ID NO: 821530 - protein, 18 aa, Mycobacterium
GVLVGSWHTIEGLVYTMP

SEQ ID NO: 821531 - protein, 29 aa, Mycobacterium
GVLVQAHGRWRLRGNLRPSPDLYELIASR

SEQ ID NO: 821532 - protein, 17 aa, Mycobacterium
GVLVYGVMYYANVKIVP

SEQ ID NO: 821533 - protein, 27 aa, Mycobacterium
GVLYGRGELLSAMPPFLTGGSMIENVA

SEQ ID NO: 821534 - protein, 17 aa, Mycobacterium
GVLYLFVRGMCGPDTPM

SEQ ID NO: 821535 - protein, 18 aa, Mycobacterium
GVLYRPEGGAPPFPCVVF

SEQ ID NO: 821536 - protein, 18 aa, Mycobacterium
GVMADSAILTVGLLAGSM

SEQ ID NO: 821537 - protein, 23 aa, Mycobacterium
GVMELALHEAWVGRRISELESAT

SEQ ID NO: 821538 - protein, 20 aa, Mycobacterium
GVMELLLINHPLDCPVCDKG

SEQ ID NO: 821539 - protein, 17 aa, Mycobacterium
GVMFTPFGRTRDGFEMQ

SEQ ID NO: 821540 - protein, 20 aa, Mycobacterium
GVMGNLRFLGQAKVVGPGGD

SEQ ID NO: 821541 - protein, 24 aa, Mycobacterium
GVMHTHRALLYQAADTNLVTEANR

SEQ ID NO: 821542 - protein, 28 aa, Mycobacterium
GVMLAYSPVHHLLFDRLGPVVLVMTSAN

SEQ ID NO: 821543 - protein, 18 aa, Mycobacterium
GVMLLHTITMLTPQQIVE

SEQ ID NO: 821544 - protein, 28 aa, Mycobacterium
GVMYVTGWDGWFWALDAKTGQQLWRYKH

SEQ ID NO: 821545 - protein, 17 aa, Mycobacterium
GVNACLTDLVRFGSLFL

SEQ ID NO: 821546 - protein, 18 aa, Mycobacterium
GVNCLWPETYIATAAVTN

SEQ ID NO: 821547 - protein, 27 aa, Mycobacterium
GVNDLFLPLRYGQVTLKEKMPRRFYCR

SEQ ID NO: 821548 - protein, 25 aa, Mycobacterium
GVNFMPMSHLAGRLTLMGTLSGGGT

SEQ ID NO: 821549 - protein, 23 aa, Mycobacterium
GVNFRDVLVALGMYPGGGELGVD

SEQ ID NO: 821550 - protein, 27 aa, Mycobacterium
GVNFRDVLVALGMYPGGGRLGAEGAGL

SEQ ID NO: 821551 - protein, 20 aa, Mycobacterium
GVNHRLSGWLFSRAATVNAN

SEQ ID NO: 821552 - protein, 25 aa, Mycobacterium
GVNLDLSLRFFSELTGVSDLRHGQF

SEQ ID NO: 821553 - protein, 23 aa, Mycobacterium
GVNLGGLICWENWMPQARHALYA

SEQ ID NO: 821554 - protein, 23 aa, Mycobacterium
GVNLTGTFLVAKAALARMIEQPR

SEQ ID NO: 821555 - protein, 25 aa, Mycobacterium
GVNPVDWKMRSSGPLRLAARLIGPK

SEQ ID NO: 821556 - protein, 25 aa, Mycobacterium
GVNRYGVLNPGWGGDGGNGGAGGTA

SEQ ID NO: 821557 - protein, 28 aa, Mycobacterium
GVNSLEELIFWQIWSSLALKPERPWLEL

SEQ ID NO: 821558 - protein, 24 aa, Mycobacterium
GVNVDAVMRTLLMRGLIAEAGTDD

SEQ ID NO: 821559 - protein, 21 aa, Mycobacterium
GVNVNGVLWGIQAAAAKFVEL

SEQ ID NO: 821560 - protein, 18 aa, Mycobacterium
GVNVSVIMPPFTNTELIA

SEQ ID NO: 821561 - protein, 28 aa, Mycobacterium
GVNVWSAMNFLLGYTPWGAFPGHTPQDI

SEQ ID NO: 821562 - protein, 24 aa, Mycobacterium
GVPAPIPQFEVMYLLAGCDAAAAD

SEQ ID NO: 821563 - protein, 17 aa, Mycobacterium
GVPAVERLAYFAEAATA

SEQ ID NO: 821564 - protein, 17 aa, Mycobacterium
GVPCIGLLSGGISRAEL

SEQ ID NO: 821565 - protein, 26 aa, Mycobacterium
GVPDDHLVAFLLGVGYPADRPLRPIR

SEQ ID NO: 821566 - protein, 27 aa, Mycobacterium
GVPDDRLVAFLLGVGYPADRPLAPVRT

SEQ ID NO: 821567 - protein, 19 aa, Mycobacterium
GVPEEKWVYLRGHADLQEQ

SEQ ID NO: 821568 - protein, 27 aa, Mycobacterium
GVPEGSVLVPFAWQGVTLHAAGASAVR

SEQ ID NO: 821569 - protein, 25 aa, Mycobacterium
GVPERGVIFGVSWNPEAVIEHASQF

SEQ ID NO: 821570 - protein, 21 aa, Mycobacterium
GVPEVWPFAPAEHRAMLANPD

SEQ ID NO: 821571 - protein, 18 aa, Mycobacterium
GVPFFDHMLTSLGSHASF

SEQ ID NO: 821572 - protein, 28 aa, Mycobacterium
GVPFSAPYSFDTPFGPVALTLNGTASPL

SEQ ID NO: 821573 - protein, 20 aa, Mycobacterium
GVPFYDHMLTALGSHASFDL

SEQ ID NO: 821574 - protein, 20 aa, Mycobacterium
GVPFYDHMLTALGTHASFDL

SEQ ID NO: 821575 - protein, 26 aa, Mycobacterium
GVPGATSVCWWLLDGKPGFQLELFEF

SEQ ID NO: 821576 - protein, 18 aa, Mycobacterium
GVPGIIDDILLRARPGTR

SEQ ID NO: 821577 - protein, 26 aa, Mycobacterium
GVPGNRGLALFISGDNLRKGAALNTI

SEQ ID NO: 821578 - protein, 18 aa, Mycobacterium
GVPGQWRLYSLVRDHAIV

SEQ ID NO: 821579 - protein, 17 aa, Mycobacterium
GVPHVLLADALAEAVHT

SEQ ID NO: 821580 - protein, 18 aa, Mycobacterium
GVPHYADCPVPTDSPLGG

SEQ ID NO: 821581 - protein, 25 aa, Mycobacterium
GVPIHRALVHRLMQSGAARGATALR

SEQ ID NO: 821582 - protein, 21 aa, Mycobacterium
GVPIPIAWPDRLVAADYGLEA

SEQ ID NO: 821583 - protein, 20 aa, Mycobacterium
GVPISAIFFGGRRASTVPLI

SEQ ID NO: 821584 - protein, 21 aa, Mycobacterium
GVPISAILFGGRRKTTVPLVT

SEQ ID NO: 821585 - protein, 32 aa, Mycobacterium
GVPKATLYYYFAGKEDILAFLLEDLLKDISEA

SEQ ID NO: 821586 - protein, 18 aa, Mycobacterium
GVPKSPEWAAPISGLDAA

SEQ ID NO: 821587 - protein, 24 aa, Mycobacterium
GVPKTLIQHLMRWVISSGQFDEHV

SEQ ID NO: 821588 - protein, 29 aa, Mycobacterium
GVPLAHLALFVLDKWLRPVPTGVVGELYV

SEQ ID NO: 821589 - protein, 17 aa, Mycobacterium
GVPLGTSPAPPGYTATP

SEQ ID NO: 821590 - protein, 18 aa, Mycobacterium
GVPLKDRRAERRALLVEA

SEQ ID NO: 821591 - protein, 32 aa, Mycobacterium
GVPLPAVMTAYRIGFRFIWEQTLAAARASGMP

SEQ ID NO: 821592 - protein, 17 aa, Mycobacterium
GVPLSVPFPGVHDDRVT

SEQ ID NO: 821593 - protein, 18 aa, Mycobacterium
GVPLTDRRAERRALLVDA

SEQ ID NO: 821594 - protein, 17 aa, Mycobacterium
GVPMAYIEISPAGPTGP

SEQ ID NO: 821595 - protein, 23 aa, Mycobacterium
GVPPFYVMDVWQAAAERQRTHGD

SEQ ID NO: 821596 - protein, 19 aa, Mycobacterium
GVPPLTMKPDVCWQLPIRR

SEQ ID NO: 821597 - protein, 18 aa, Mycobacterium
GVPPPDYVPLLALLGRRL

SEQ ID NO: 821598 - protein, 30 aa, Mycobacterium; identical to SEQ ID NO: 24002

SEQ ID NO: 821599 - protein, 24 aa, Mycobacterium
GVPRAPQLRSAVGVWVTILDRTRL

SEQ ID NO: 821600 - protein, 25 aa, Mycobacterium
GVPRAPVGMFAPHSPAGPLAAPTAT

SEQ ID NO: 821601 - protein, 23 aa, Mycobacterium
GVPRPRLAPAKLADSLVGVGTFS

SEQ ID NO: 821602 - protein, 18 aa, Mycobacterium
GVPRRDLHHLAAQLGSDV

SEQ ID NO: 821603 - protein, 17 aa, Mycobacterium
GVPRVDAVIFLLRSLNA

SEQ ID NO: 821604 - protein, 24 aa, Mycobacterium
GVPRVDAVVFLLRTLNAPDIALLK

SEQ ID NO: 821605 - protein, 23 aa, Mycobacterium
GVPSDRWVFPWSSATCNDVYFPV

SEQ ID NO: 821606 - protein, 27 aa, Mycobacterium
GVPTPTGWRMLSGDETGWLLGDYVLSH

SEQ ID NO: 821607 - protein, 34 aa, Mycobacterium
GVPVFAWKGETLEEYWWAAEQMLTWPDEPANMIL

SEQ ID NO: 821608 - protein, 34 aa, Mycobacterium; identical to SEQ ID NO: 218957

SEQ ID NO: 821609 - protein, 17 aa, Mycobacterium
GVPVLLAPATNVATALT

SEQ ID NO: 821610 - protein, 20 aa, Mycobacterium
GVPVPLARLDGMDSLLSIVQ

SEQ ID NO: 821611 - protein, 29 aa, Mycobacterium
GVPVPRAALFVLDGWLRPVPAGVAGELYV

SEQ ID NO: 821612 - protein, 23 aa, Mycobacterium
GVPVVMKALLDAGLLHGDCLTVT

SEQ ID NO: 821613 - protein, 18 aa, Mycobacterium
GVPYVINPRMVRGLDYYT

SEQ ID NO: 821614 - protein, 23 aa, Mycobacterium
GVQEGLWPNMIPRGGVLGTQHLV

SEQ ID NO: 821615 - protein, 26 aa, Mycobacterium
GVQGFELVVVNLYPFAATVASGASED

SEQ ID NO: 821616 - protein, 24 aa, Mycobacterium
GVQGITDLITTPGLINVDFADVKS

SEQ ID NO: 821617 - protein, 18 aa, Mycobacterium
GVQGWLGAHRVGDVVVLP

SEQ ID NO: 821618 - protein, 20 aa, Mycobacterium
GVQMVAFTQAYRAAGVAPPK

SEQ ID NO: 821619 - protein, 34 aa, Mycobacterium
GVQPGDRVAIWSPNTWHWVVACLAIHHAGAAMVP

SEQ ID NO: 821620 - protein, 18 aa, Mycobacterium
GVQPLMPGQVLRLGVAAG

SEQ ID NO: 821621 - protein, 18 aa, Mycobacterium
GVQPRWITPRWDAQRHIS

SEQ ID NO: 821622 - protein, 28 aa, Mycobacterium
GVQQKRIVVVGHFFGRQVWAGEEHRATV

SEQ ID NO: 821623 - protein, 25 aa, Mycobacterium
GVQRFDYFRLLDRIVHQQADISELQ

SEQ ID NO: 821624 - protein, 37 aa, Mycobacterium
GVQRGDRVLAVLPFFHIYGLVVLLNVQLKLGAELVIL

SEQ ID NO: 821625 - protein, 23 aa, Mycobacterium
GVQRRRALPKLAAQFVKAWAPEV

SEQ ID NO: 821626 - protein, 25 aa, Mycobacterium
GVQRVFFGWAQVWCTKAREAEAIRR

SEQ ID NO: 821627 - protein, 25 aa, Mycobacterium
GVQRVFYGWAQVWRTKAREAEAIRR

SEQ ID NO: 821628 - protein, 20 aa, Mycobacterium
GVQTNIEFLRFLLADERVRA

SEQ ID NO: 821629 - protein, 19 aa, Mycobacterium
GVRAAPGYAAYAAAKAGVI

SEQ ID NO: 821630 - protein, 21 aa, Mycobacterium
GVRAAPGYAAYAAAKAGVINY

SEQ ID NO: 821631 - protein, 24 aa, Mycobacterium
GVRADALRWHPNGLALDVMIPDPG

SEQ ID NO: 821632 - protein, 18 aa, Mycobacterium
GVRALSLEPQPLPRLSIV

SEQ ID NO: 821633 - protein, 17 aa, Mycobacterium
GVRASALAAYLLGRNDP

SEQ ID NO: 821634 - protein, 27 aa, Mycobacterium
GVRAVVEPAFWLGQPRTGPSSFIDYFD

SEQ ID NO: 821635 - protein, 24 aa, Mycobacterium
GVRCDLHLWDGQIHDFPLAADILP

SEQ ID NO: 821636 - protein, 17 aa, Mycobacterium
GVRCVVQFFPSHDVYSW

SEQ ID NO: 821637 - protein, 19 aa, Mycobacterium
GVRDAANLCWKLAAVLNGN

SEQ ID NO: 821638 - protein, 18 aa, Mycobacterium
GVRELLLTHIPPWTSRED

SEQ ID NO: 821639 - protein, 18 aa, Mycobacterium
GVRFGLLSAWRGPAGQDL

SEQ ID NO: 821640 - protein, 17 aa, Mycobacterium
GVRFGSITPGQEPIDRL

SEQ ID NO: 821641 - protein, 19 aa, Mycobacterium
GVRFTGIVHPGLMGTAPSA

SEQ ID NO: 821642 - protein, 34 aa, Mycobacterium
GVRGLFACRQALRPRYLLMLAEILRFHRAASRLL

SEQ ID NO: 821643 - protein, 31 aa, Mycobacterium
GVRGWEALRSLGCRISWAQTLAPAQRVAEAG

SEQ ID NO: 821644 - protein, 19 aa, Mycobacterium
GVRHGLTLGGPIAIEIGNT

SEQ ID NO: 821645 - protein, 17 aa, Mycobacterium
GVRIAPPPPTTDADEGA

SEQ ID NO: 821646 - protein, 31 aa, Mycobacterium
GVRIDHIIGLFRLWWIPAGAAPTHGTYVRYD

SEQ ID NO: 821647 - protein, 29 aa, Mycobacterium
GVRIDHIIGLFRLWWIPEGAAPTEGTYVR

SEQ ID NO: 821648 - protein, 32 aa, Mycobacterium
GVRIDHIIGLFRLWWIPQGLPPTDGTYVRYDH

SEQ ID NO: 821649 - protein, 31 aa, Mycobacterium
GVRIDHIIGLFRLWWIPRGAPPTEGTYVRYD

SEQ ID NO: 821650 - protein, 31 aa, Mycobacterium
GVRIDHIIGMFRLWWIPKGAAPTDGTYVRYD

SEQ ID NO: 821651 - protein, 29 aa, Mycobacterium
GVRIEQGPFLRSTLPIAGFAVLEADDLDA

SEQ ID NO: 821652 - protein, 18 aa, Mycobacterium
GVRIIEISSFVAVPLAGM

SEQ ID NO: 821653 - protein, 30 aa, Mycobacterium
GVRIPLAEHDLLACWLLEASGMPTDDAVRT

SEQ ID NO: 821654 - protein, 22 aa, Mycobacterium
GVRIRVPVHVMFDGSVPYTGSL

SEQ ID NO: 821655 - protein, 19 aa, Mycobacterium
GVRISLGDGFLVLPGADVR

SEQ ID NO: 821656 - protein, 17 aa, Mycobacterium
GVRIVVELKRDAVAKVV

SEQ ID NO: 821657 - protein, 25 aa, Mycobacterium
GVRKLAGFWGHCWQSAVFGSGRAFG

SEQ ID NO: 821658 - protein, 26 aa, Mycobacterium
GVRKTIGMVFQRPNPFPTMSIRDNVV

SEQ ID NO: 821659 - protein, 18 aa, Mycobacterium
GVRLCDYGIRGLHLAYDL

SEQ ID NO: 821660 - protein, 19 aa, Mycobacterium
GVRLELRLVDRAEPQGSIY

SEQ ID NO: 821661 - protein, 24 aa, Mycobacterium
GVRLGRLASILRDKRIPLELCPSS

SEQ ID NO: 821662 - protein, 19 aa, Mycobacterium
GVRLPFGEVTLTPHMLDLL

SEQ ID NO: 821663 - protein, 19 aa, Mycobacterium
GVRLYDTMPLPQWPARLNG

SEQ ID NO: 821664 - protein, 23 aa, Mycobacterium
GVRMIEYLVPGMRQRGWGRIIQI

SEQ ID NO: 821665 - protein, 20 aa, Mycobacterium
GVRMLIVPGSMRVRAQAEAE

SEQ ID NO: 821666 - protein, 26 aa, Mycobacterium
GVRNPTAPPLVIHKEPDGFARSDFYL

SEQ ID NO: 821667 - protein, 27 aa, Mycobacterium
GVRNYPAYFGFLKSKLRTGGLLLNHCI

SEQ ID NO: 821668 - protein, 27 aa, Mycobacterium
GVRNYPAYFGLLKSKLRTGGLLLNHCI

SEQ ID NO: 821669 - protein, 27 aa, Mycobacterium
GVRPAKQYRYLLIASPAGAYFKGGINP

SEQ ID NO: 821670 - protein, 26 aa, Mycobacterium
GVRPARHRFLTRNRLVAALGGAAVVV

SEQ ID NO: 821671 - protein, 25 aa, Mycobacterium
GVRPARHRFLTRNRLVAALSGATVV

SEQ ID NO: 821672 - protein, 25 aa, Mycobacterium
GVRPARHRFLTRNRLVAAVSGAAVV

SEQ ID NO: 821673 - protein, 21 aa, Mycobacterium
GVRPMTCPSLPAGFDFTDPDI

SEQ ID NO: 821674 - protein, 17 aa, Mycobacterium
GVRPRVWFGERWIDSIL

SEQ ID NO: 821675 - protein, 27 aa, Mycobacterium
GVRPSRQYRYLLIASPAGAYFKGGINP

SEQ ID NO: 821676 - protein, 17 aa, Mycobacterium
GVRPTPAIEPPVEQVEP

SEQ ID NO: 821677 - protein, 26 aa, Mycobacterium
GVRQALVYYYFPTMDDLFVEVLRAGA

SEQ ID NO: 821678 - protein, 17 aa, Mycobacterium
GVRQFEISGPVPKAPLG

SEQ ID NO: 821679 - protein, 25 aa, Mycobacterium
GVRQFLMDHFSSVGLVLFDERVFPG

SEQ ID NO: 821680 - protein, 30 aa, Mycobacterium
GVRQVLRPLWNAYSFLALYAPKVGTWRTDS

SEQ ID NO: 821681 - protein, 30 aa, Mycobacterium
GVRRDFVKKLLARKTPPKGAGLFVADCLAR

SEQ ID NO: 821682 - protein, 28 aa, Mycobacterium
GVRSALVYYYFDTLDDLYIAVLRNGADV

SEQ ID NO: 821683 - protein, 29 aa, Mycobacterium
GVRSIRAALPLLRAADWARVVTLSAHSIQ

SEQ ID NO: 821684 - protein, 27 aa, Mycobacterium
GVRSRLMLDIASWRRRRREELAALGDK

SEQ ID NO: 821685 - protein, 28 aa, Mycobacterium
GVRSRLMLDIASWRRRRREELAALGDKV

SEQ ID NO: 821686 - protein, 23 aa, Mycobacterium
GVRTLPMLYALRQTGSDGARLRT

SEQ ID NO: 821687 - protein, 26 aa, Mycobacterium
GVRTTLELIMTGPLAWLAGRTAGSRV

SEQ ID NO: 821688 - protein, 19 aa, Mycobacterium
GVRTVPVWPGELSAPYLGV

SEQ ID NO: 821689 - protein, 28 aa, Mycobacterium
GVRVILDDSLVYLALNKPRGMHSTMSDD

SEQ ID NO: 821690 - protein, 21 aa, Mycobacterium
GVRVLDFATLAAAPLAATYLG

SEQ ID NO: 821691 - protein, 24 aa, Mycobacterium
GVRVPHGFAITAEAYRHMLDSAGA

SEQ ID NO: 821692 - protein, 22 aa, Mycobacterium
GVRVPLPRDLMRDNYILKATPA

SEQ ID NO: 821693 - protein, 17 aa, Mycobacterium
GVRWLREVAGAETVVLL

SEQ ID NO: 821694 - protein, 20 aa, Mycobacterium
GVRYSGLGALALTPARKADL

SEQ ID NO: 821695 - protein, 27 aa, Mycobacterium
GVSAEAALGLLRRHKIEKLPIVDGHGK

SEQ ID NO: 821696 - protein, 22 aa, Mycobacterium
GVSAGIDLGLWLAGRIAGEEKA

SEQ ID NO: 821697 - protein, 23 aa, Mycobacterium
GVSAGLDLAFWLAGQIGGENRAK

SEQ ID NO: 821698 - protein, 23 aa, Mycobacterium
GVSAGLDLALWLAGQIGGENRAK

SEQ ID NO: 821699 - protein, 19 aa, Mycobacterium
GVSAGLDLGLWLAGQIGGE

SEQ ID NO: 821700 - protein, 24 aa, Mycobacterium
GVSALFDRPDWQQGFSAPDDGGAQ

SEQ ID NO: 821701 - protein, 25 aa, Mycobacterium
GVSAPDYQALWRWSVEDPGAFWAAV

SEQ ID NO: 821702 - protein, 24 aa, Mycobacterium
GVSDDTVRRWIDSGALPASKDDAG

SEQ ID NO: 821703 - protein, 18 aa, Mycobacterium
GVSDDTVRRWIDSGTLES

SEQ ID NO: 821704 - protein, 24 aa, Mycobacterium
GVSDRLPRMLGTQAAGAAPLVTGA

SEQ ID NO: 821705 - protein, 28 aa, Mycobacterium
GVSDSMPALHLLPLAAALDVLPVLATDV

SEQ ID NO: 821706 - protein, 18 aa, Mycobacterium
GVSFLADEVGRFIRAALA

SEQ ID NO: 821707 - protein, 20 aa, Mycobacterium
GVSFRYWTESIPNIDGELLG

SEQ ID NO: 821708 - protein, 26 aa, Mycobacterium
GVSIGSLYQYFPNKHALLNALAQRHV

SEQ ID NO: 821709 - protein, 25 aa, Mycobacterium
GVSIPSFPNFLSLAGPYASSGLSFF

SEQ ID NO: 821710 - protein, 25 aa, Mycobacterium
GVSISTYFRYAPTKEGLLVDPVREA

SEQ ID NO: 821711 - protein, 20 aa, Mycobacterium
GVSIVVVRILGGYRAWQSGV

SEQ ID NO: 821712 - protein, 35 aa, Mycobacterium
GVSKQLLPVYDKPLVYYPLSTLIMAGIRDILVITT

SEQ ID NO: 821713 - protein, 33 aa, Mycobacterium
GVSKQLLPVYDKPLVYYPLSTLIMAGVRDILVI

SEQ ID NO: 821714 - protein, 34 aa, Mycobacterium
GVSKQLMPVYDKPLIYYPLSTLMMAGIRDILIIT

SEQ ID NO: 821715 - protein, 25 aa, Mycobacterium
GVSMDTFVDWLIDAGYKIARIDDYD

SEQ ID NO: 821716 - protein, 18 aa, Mycobacterium
GVSNPYLSQIERGLRRPS

SEQ ID NO: 821717 - protein, 22 aa, Mycobacterium
GVSNPYLSQVERGLRKPSAEVL

SEQ ID NO: 821718 - protein, 23 aa, Mycobacterium
GVSNYSLARWKKADAALGRPVVS

SEQ ID NO: 821719 - protein, 23 aa, Mycobacterium
GVSNYSLARWRKADAALGRPVIS

SEQ ID NO: 821720 - protein, 23 aa, Mycobacterium
GVSNYSLARWRKADAALGRPVVS

SEQ ID NO: 821721 - protein, 23 aa, Mycobacterium
GVSPATLYNWRRTYGGMDTDAAK

SEQ ID NO: 821722 - protein, 19 aa, Mycobacterium
GVSPIFPGAPGQAGNTGFF

SEQ ID NO: 821723 - protein, 19 aa, Mycobacterium
GVSQMQVSRILAGTLRCLR

SEQ ID NO: 821724 - protein, 24 aa, Mycobacterium
GVSRAELIRQLLGTALNNSDDNLE

SEQ ID NO: 821725 - protein, 26 aa, Mycobacterium
GVSRALLYRYFPDKRAFYTAVMQAEY

SEQ ID NO: 821726 - protein, 28 aa, Mycobacterium
GVSRALMYHYFPDKRAFFAAVVKDEADR

SEQ ID NO: 821727 - protein, 27 aa, Mycobacterium
GVSRALMYHYFPDKRAFFAAVVRAESE

SEQ ID NO: 821728 - protein, 26 aa, Mycobacterium
GVSRGWLYRHFPDKVSLLGAAIVRLN

SEQ ID NO: 821729 - protein, 19 aa, Mycobacterium
GVSRPTLYRKCGDKEDIVA

SEQ ID NO: 821730 - protein, 26 aa, Mycobacterium
GVSRPTLYRWFADKQALLEAFGVHER

SEQ ID NO: 821731 - protein, 26 aa, Mycobacterium
GVSRPTLYRWFASKEELLSAFSAYER

SEQ ID NO: 821732 - protein, 26 aa, Mycobacterium
GVSRPTLYRWFASKEELLSAFSSYER

SEQ ID NO: 821733 - protein, 27 aa, Mycobacterium
GVSRPTLYRWFSSKQDLLDAFVVWERR

SEQ ID NO: 821734 - protein, 25 aa, Mycobacterium
GVSRSWLYRHFPDKPTLVGAAIIRL

SEQ ID NO: 821735 - protein, 20 aa, Mycobacterium
GVSRYFFELASRLPADTVSE

SEQ ID NO: 821736 - protein, 23 aa, Mycobacterium
GVSSALVIYYFGTRDRLLVDALR

SEQ ID NO: 821737 - protein, 28 aa, Mycobacterium
GVSSCATCDGFFFRDQDIAVIGGGDSAM

SEQ ID NO: 821738 - protein, 24 aa, Mycobacterium
GVSSNYRFDLAPRTWEFIRDLRSG

SEQ ID NO: 821739 - protein, 19 aa, Mycobacterium
GVSSPRPLIAFAGGSGITP

SEQ ID NO: 821740 - protein, 23 aa, Mycobacterium
GVSSPRVLSDLFWIGRYGERAEN

SEQ ID NO: 821741 - protein, 17 aa, Mycobacterium
GVSTELHIFPRACHGFD

SEQ ID NO: 821742 - protein, 28 aa, Mycobacterium
GVSTGIIPRVRFRFKDFQIVEDMVAHGH

SEQ ID NO: 821743 - protein, 27 aa, Mycobacterium
GVSVADIEFIQFHPTMLHTPDAAGCRP

SEQ ID NO: 821744 - protein, 33 aa, Mycobacterium
GVSVLPTLQSFLPPPLDALPNPFEDLDILVAAA

SEQ ID NO: 821745 - protein, 24 aa, Mycobacterium
GVSVPAARRYLPGSLILETTWQTH

SEQ ID NO: 821746 - protein, 27 aa, Mycobacterium
GVSVPKFPNMFSITGPYGFVLGSYLWM

SEQ ID NO: 821747 - protein, 26 aa, Mycobacterium
GVSYGHTWLAPRDTTLALIPAGYADG

SEQ ID NO: 821748 - protein, 25 aa, Mycobacterium
GVSYTLPRIIGAGPAFDLILTARAV

SEQ ID NO: 821749 - protein, 18 aa, Mycobacterium
GVTAALQHNIGLGGAAVV

SEQ ID NO: 821750 - protein, 27 aa, Mycobacterium
GVTADAALGLLRRNKIEKLPIVDGEGR

SEQ ID NO: 821751 - protein, 26 aa, Mycobacterium
GVTAGSVYYHFGTKNKLFEAVCDDVY

SEQ ID NO: 821752 - protein, 20 aa, Mycobacterium
GVTATLFEALSRHGVELLNV

SEQ ID NO: 821753 - protein, 20 aa, Mycobacterium
GVTDLLVHIVARNAEDLYRI

SEQ ID NO: 821754 - protein, 24 aa, Mycobacterium
GVTDVIVGFRWPYVKGPDTEPLEQ

SEQ ID NO: 821755 - protein, 30 aa, Mycobacterium
GVTEAPRSWQLKLDLRRDGDRIKMSKVEFL

SEQ ID NO: 821756 - protein, 24 aa, Mycobacterium
GVTEKRMFGGLAFLVHGHMTVAAK

SEQ ID NO: 821757 - protein, 30 aa, Mycobacterium
GVTGAQVGLAWLLGHTPNTLLIPGTRSVAH

SEQ ID NO: 821758 - protein, 25 aa, Mycobacterium
GVTGQFWSVYVPPQQFTGPSAVSAT

SEQ ID NO: 821759 - protein, 30 aa, Mycobacterium
GVTGRQVFGTLPWHADLWLDSEDALDLTGR

SEQ ID NO: 821760 - protein, 26 aa, Mycobacterium
GVTGWAGYVAGVIWALRGAGHPVPGG

SEQ ID NO: 821761 - protein, 33 aa, Mycobacterium; identical to SEQ ID NO: 127376

SEQ ID NO: 821762 - protein, 23 aa, Mycobacterium
GVTHLFTGDSLFPGGPGRTTNPE

SEQ ID NO: 821763 - protein, 23 aa, Mycobacterium
GVTHYRFSLAWPRLQPDGKGPIN

SEQ ID NO: 821764 - protein, 24 aa, Mycobacterium
GVTIAYFEAKLPAGTPVVRAMPNT

SEQ ID NO: 821765 - protein, 26 aa, Mycobacterium
GVTIYYTAPTLIRTFMKWGREVPDAH

SEQ ID NO: 821766 - protein, 19 aa, Mycobacterium
GVTKRILITVTGALSEDDA

SEQ ID NO: 821767 - protein, 17 aa, Mycobacterium
GVTLAGPVPLIYTAAPS

SEQ ID NO: 821768 - protein, 20 aa, Mycobacterium
GVTLMHEHVFIMTTEVAQNY

SEQ ID NO: 821769 - protein, 20 aa, Mycobacterium
GVTLMHEHVFIMTTEVMLNH

SEQ ID NO: 821770 - protein, 20 aa, Mycobacterium
GVTLMHEHVFIMTTEVVQNY

SEQ ID NO: 821771 - protein, 25 aa, Mycobacterium
GVTLRALPRIPDPVKRLLLGRRTIT

SEQ ID NO: 821772 - protein, 23 aa, Mycobacterium
GVTLRQIGLRDRLCELDFEFPLA

SEQ ID NO: 821773 - protein, 24 aa, Mycobacterium
GVTMSLERRLRLLELARDWGSMIL

SEQ ID NO: 821774 - protein, 25 aa, Mycobacterium
GVTNWIETLGHRRAYLQFRWQRADR

SEQ ID NO: 821775 - protein, 35 aa, Mycobacterium
GVTPEKLTWIMPRDAWLIDRATLQPGPTFIKQFRD

SEQ ID NO: 821776 - protein, 30 aa, Mycobacterium
GVTPFDPNAGWFHYFSTWGDQIIAGGLPIN

SEQ ID NO: 821777 - protein, 26 aa, Mycobacterium
GVTPKPLRGMPPFSGPQGPFAAITAG

SEQ ID NO: 821778 - protein, 22 aa, Mycobacterium
GVTPRLYLVTANAQPAAGTELT

SEQ ID NO: 821779 - protein, 22 aa, Mycobacterium
GVTPRRFLALSNPGLRALIDDT

SEQ ID NO: 821780 - protein, 23 aa, Mycobacterium
GVTRELEWPAMRISHCRPPDSDR

SEQ ID NO: 821781 - protein, 23 aa, Mycobacterium
GVTRELEWPAMRISHCRPPGSDR

SEQ ID NO: 821782 - protein, 24 aa, Mycobacterium
GVTRELVWPSMRISHCRPPGADRD

SEQ ID NO: 821783 - protein, 22 aa, Mycobacterium
GVTRFMPVYPTEKGAIKAVGRL

SEQ ID NO: 821784 - protein, 24 aa, Mycobacterium
GVTRSAFYFYFENKAAAVAALLEP

SEQ ID NO: 821785 - protein, 22 aa, Mycobacterium
GVTRVTRMLGIQNGFVTVLAQG

SEQ ID NO: 821786 - protein, 25 aa, Mycobacterium
GVTRVTYLPFHRLTRVLPGGEYDYD

SEQ ID NO: 821787 - protein, 20 aa, Mycobacterium
GVTSALFEALSRHGVELLNV

SEQ ID NO: 821788 - protein, 21 aa, Mycobacterium
GVTSALFEVLAKHGVELLNVE

SEQ ID NO: 821789 - protein, 25 aa, Mycobacterium
GVTTSYFESKLPAGTPVIRAMPNAA

SEQ ID NO: 821790 - protein, 24 aa, Mycobacterium
GVTVALLCPGPVRTEFLKNAGMDE

SEQ ID NO: 821791 - protein, 23 aa, Mycobacterium
GVTVALLCPGPVRTEFVKSAGMD

SEQ ID NO: 821792 - protein, 22 aa, Mycobacterium
GVTVIDPRWVLPVADGIGDLAV

SEQ ID NO: 821793 - protein, 20 aa, Mycobacterium
GVTVIDPRWVLPVSDGIVEL

SEQ ID NO: 821794 - protein, 23 aa, Mycobacterium
GVTVIDPRWVLPVSDNLLDLAAR

SEQ ID NO: 821795 - protein, 28 aa, Mycobacterium
GVTVMEGFHYLFHPVTQRALALAGDGTL

SEQ ID NO: 821796 - protein, 25 aa, Mycobacterium
GVTVNSLVQLAWALTLSSLTDRDDI

SEQ ID NO: 821797 - protein, 18 aa, Mycobacterium
GVTVNSLVQVAWALVLGA

SEQ ID NO: 821798 - protein, 31 aa, Mycobacterium
GVTVSDLEFIQFHPTMLFDGSSGGRRPLITE

SEQ ID NO: 821799 - protein, 28 aa, Mycobacterium
GVTVTHRPLTEYFNWFRAEYRVGGSDRV

SEQ ID NO: 821800 - protein, 20 aa, Mycobacterium
GVTVTRLPASPASVASLLAG

SEQ ID NO: 821801 - protein, 27 aa, Mycobacterium
GVTVVDPRWVLPVPAAINTLAAAHKLV

SEQ ID NO: 821802 - protein, 24 aa, Mycobacterium
GVTVVDPRWVLPVPDAVLELAVAH

SEQ ID NO: 821803 - protein, 26 aa, Mycobacterium
GVTVVDPRWVLPVPPHVVELAGQHRL

SEQ ID NO: 821804 - protein, 19 aa, Mycobacterium
GVTVVSYTWAMLRDVVDDP

SEQ ID NO: 821805 - protein, 26 aa, Mycobacterium
GVTVVSYTWAMLRDVVDNPEFALHGN

SEQ ID NO: 821806 - protein, 25 aa, Mycobacterium
GVTWGVIQYHFGDRNGLLMAVVDDG

SEQ ID NO: 821807 - protein, 22 aa, Mycobacterium
GVTWGVIQYHFGDRNGLLTAVV

SEQ ID NO: 821808 - protein, 33 aa, Mycobacterium
GVTYSWETVRRLALMRTAAPDFRLFWDNAYAVH

SEQ ID NO: 821809 - protein, 30 aa, Mycobacterium
GVVAAIAPFNFPLNLVVHKVAPALAVGCPV

SEQ ID NO: 821810 - protein, 32 aa, Mycobacterium
GVVAAIAPWNFPLMLETWKVAPALAWGNTVVL

SEQ ID NO: 821811 - protein, 19 aa, Mycobacterium
GVVADPFGHHWSLGQPVRE

SEQ ID NO: 821812 - protein, 18 aa, Mycobacterium
GVVAELLVIMARVPKSEG

SEQ ID NO: 821813 - protein, 28 aa, Mycobacterium
GVVAKIDWSRFLPLYQQAGRRAFLSELE

SEQ ID NO: 821814 - protein, 25 aa, Mycobacterium
GVVAPITFLAVAGRRVQHKIFTEMD

SEQ ID NO: 821815 - protein, 24 aa, Mycobacterium
GVVAQINWLFDLILHAEDIAQSVD

SEQ ID NO: 821816 - protein, 25 aa, Mycobacterium
GVVARIDWARFLPLYQQAGKRSFLE

SEQ ID NO: 821817 - protein, 18 aa, Mycobacterium
GVVARYFYENFTDLDQLS

SEQ ID NO: 821818 - protein, 32 aa, Mycobacterium
GVVATITPWNYPLQMAVWKVIPALAAGCSVVI

SEQ ID NO: 821819 - protein, 34 aa, Mycobacterium
GVVATITPWNYPLQMAVWKVLPALAAGCTVVIKP

SEQ ID NO: 821820 - protein, 25 aa, Mycobacterium
GVVAVLTPWNDPVAVAAGLLGAALV

SEQ ID NO: 821821 - protein, 24 aa, Mycobacterium
GVVEYFHKLGVPLRETYGMSETAG

SEQ ID NO: 821822 - protein, 20 aa, Mycobacterium
GVVFEFVERPLKYFSPAVER

SEQ ID NO: 821823 - protein, 19 aa, Mycobacterium
GVVFKPWGHLIHIERVMLG

SEQ ID NO: 821824 - protein, 24 aa, Mycobacterium
GVVFNAHYLTWFDEACTAFLDHLG

SEQ ID NO: 821825 - protein, 24 aa, Mycobacterium
GVVFNGHYLTWFDEACTGLLDDLG

SEQ ID NO: 821826 - protein, 25 aa, Mycobacterium
GVVFQQPLLMPWLTVADNVAFARRF

SEQ ID NO: 821827 - protein, 27 aa, Mycobacterium
GVVFQQPRLFPWRTVGGNIDLALKYAK

SEQ ID NO: 821828 - protein, 27 aa, Mycobacterium
GVVFQQPRLFPWRTVGGNIELALKYAK

SEQ ID NO: 821829 - protein, 32 aa, Mycobacterium
GVVGAITPWNFPLLLTLWKVGPAIAAGNSVVV

SEQ ID NO: 821830 - protein, 33 aa, Mycobacterium; identical to SEQ ID NO: 120489

SEQ ID NO: 821831 - protein, 33 aa, Mycobacterium
GVVGAIVPWNSPLLMLAWKLSPALAGGNTIILK

SEQ ID NO: 821832 - protein, 25 aa, Mycobacterium
GVVGDPPRWIPAARPLREVWVPGAD

SEQ ID NO: 821833 - protein, 34 aa, Mycobacterium
GVVGEEVAPWLELVRKLGLLVGALADAPPVSLQV

SEQ ID NO: 821834 - protein, 24 aa, Mycobacterium
GVVGELGFFFKEPWGSSTHSLAAQ

SEQ ID NO: 821835 - protein, 29 aa, Mycobacterium
GVVGLPALVGLFGGKADVGRFGSFVGAGC

SEQ ID NO: 821836 - protein, 32 aa, Mycobacterium
GVVGVIGPWNFPLNLVVLPAVAAFAAGNRVMI

SEQ ID NO: 821837 - protein, 30 aa, Mycobacterium
GVVGVIGPWNFPVNLVVLPASAAFAAGNRV

SEQ ID NO: 821838 - protein, 18 aa, Mycobacterium
GVVGVLKGPLRDGVIVPG

SEQ ID NO: 821839 - protein, 24 aa, Mycobacterium
GVVHFHGPFLYRSVFNSANEEQET

SEQ ID NO: 821840 - protein, 20 aa, Mycobacterium
GVVHGLKWLLDYMPNGEVDL

SEQ ID NO: 821841 - protein, 18 aa, Mycobacterium
GVVIPLHPGARVFILTEQ

SEQ ID NO: 821842 - protein, 20 aa, Mycobacterium
GVVIPPPFDLRTLLASGRVQ

SEQ ID NO: 821843 - protein, 25 aa, Mycobacterium
GVVLGNTWFWPADTLTMKMFSRVMS

SEQ ID NO: 821844 - protein, 26 aa, Mycobacterium
GVVLIPEIPGIHPGVLALGNHLVDNG

SEQ ID NO: 821845 - protein, 26 aa, Mycobacterium
GVVLIPEIPGIHPGVLGLGNHLVDNG

SEQ ID NO: 821846 - protein, 26 aa, Mycobacterium
GVVLIPEMPGIHPGVLALGNHLVDNG

SEQ ID NO: 821847 - protein, 24 aa, Mycobacterium
GVVMHAGKLLALWEGGRPTRIHPD

SEQ ID NO: 821848 - protein, 24 aa, Mycobacterium
GVVNAPTNLLLGRPLIGEGANGAP

SEQ ID NO: 821849 - protein, 24 aa, Mycobacterium
GVVNFHVQLVQWLKNRLLLTDLLT

SEQ ID NO: 821850 - protein, 19 aa, Mycobacterium
GVVNGTKAFLPHLIASGDG

SEQ ID NO: 821851 - protein, 20 aa, Mycobacterium
GVVNGTKAFLPHLIASGDGH

SEQ ID NO: 821852 - protein, 24 aa, Mycobacterium
GVVNWIETVGHRRGFLKFRWQRTN

SEQ ID NO: 821853 - protein, 25 aa, Mycobacterium
GVVPAAADLVSLLTASQFAAHAQLY

SEQ ID NO: 821854 - protein, 19 aa, Mycobacterium
GVVPDALSVLVRLLASLHD

SEQ ID NO: 821855 - protein, 20 aa, Mycobacterium
GVVPDALSVLVRLLASLHDD

SEQ ID NO: 821856 - protein, 21 aa, Mycobacterium
GVVPDALSVLVRLLASLHDDE

SEQ ID NO: 821857 - protein, 19 aa, Mycobacterium
GVVPIYTRTPSLLAMTAAG

SEQ ID NO: 821858 - protein, 33 aa, Mycobacterium
GVVQSRFQFVLARLEVLLGPLHVAPGAARQQRD

SEQ ID NO: 821859 - protein, 24 aa, Mycobacterium
GVVRFIGVDGYRWMVRCVVNGPHE

SEQ ID NO: 821860 - protein, 24 aa, Mycobacterium
GVVRGTFYFHFPTKEHVLAELERN

SEQ ID NO: 821861 - protein, 25 aa, Mycobacterium
GVVRGTFYFHFPTKEHVLIEVERNE

SEQ ID NO: 821862 - protein, 26 aa, Mycobacterium
GVVRGTFYFHFPTKEQVLVELERNEE

SEQ ID NO: 821863 - protein, 17 aa, Mycobacterium
GVVRRIVLDRNAGLSFG

SEQ ID NO: 821864 - protein, 29 aa, Mycobacterium
GVVSEEVAPWLEVVRKLGVLIGAVSEQLP

SEQ ID NO: 821865 - protein, 19 aa, Mycobacterium
GVVTEKGRWYLVGHDRDRD

SEQ ID NO: 821866 - protein, 19 aa, Mycobacterium
GVVTEKGRWYLVGHDRDRG

SEQ ID NO: 821867 - protein, 25 aa, Mycobacterium
GVVTYPARFQLVLAANPCPCAPANP

SEQ ID NO: 821868 - protein, 23 aa, Mycobacterium
GVVVLGLPRGGVPVAFEVAKALQ

SEQ ID NO: 821869 - protein, 23 aa, Mycobacterium
GVVWTRFGVTQQPAWAFVSANGD

SEQ ID NO: 821870 - protein, 20 aa, Mycobacterium
GVVYGRWTSSVLGSLAFSAN

SEQ ID NO: 821871 - protein, 20 aa, Mycobacterium
GVVYTTFHYPVTGANVVTTD

SEQ ID NO: 821872 - protein, 29 aa, Mycobacterium
GVWDVRASFLPQIYFAGVNLAGGIAVLLP

SEQ ID NO: 821873 - protein, 19 aa, Mycobacterium
GVWGSYADHRMATAGALVG

SEQ ID NO: 821874 - protein, 27 aa, Mycobacterium
GVWMAPPELLYSYAEPFWKAGYQLHAH

SEQ ID NO: 821875 - protein, 18 aa, Mycobacterium
GVWQLRGEMTLSPQLTTL

SEQ ID NO: 821876 - protein, 18 aa, Mycobacterium
GVWVCRRDQQALDRALEA

SEQ ID NO: 821877 - protein, 30 aa, Mycobacterium
GVYADYLISGLPFIFLPKESQNLVADVHAE

SEQ ID NO: 821878 - protein, 20 aa, Mycobacterium
GVYAFDIEPLHAALSRLRSN

SEQ ID NO: 821879 - protein, 19 aa, Mycobacterium
GVYCRLLTDVFPDWATRHE

SEQ ID NO: 821880 - protein, 19 aa, Mycobacterium
GVYEEMWAADVAAMAGYHG

SEQ ID NO: 821881 - protein, 19 aa, Mycobacterium
GVYEQMWAADVAAMAGYHG

SEQ ID NO: 821882 - protein, 23 aa, Mycobacterium
GVYFNSALMRSYGWDTNPPADPV

SEQ ID NO: 821883 - protein, 18 aa, Mycobacterium
GVYFPGQWGARIEDIVIV

SEQ ID NO: 821884 - protein, 25 aa, Mycobacterium
GVYGVPTMFIAMLADPGFAHRDLST

SEQ ID NO: 821885 - protein, 17 aa, Mycobacterium
GVYLPAGVLSTETVLAG

SEQ ID NO: 821886 - protein, 26 aa, Mycobacterium
GVYNASYDIWLNPTPITTGVNQQEVM

SEQ ID NO: 821887 - protein, 24 aa, Mycobacterium
GVYTYWDYTQLRFPKKQGMRIDFI

SEQ ID NO: 821888 - protein, 37 aa, Mycobacterium
GVYTYWDYTQLRFPKRQGMRIDFILGSPAFAQRVGHA

SEQ ID NO: 821889 - protein, 25 aa, Mycobacterium
GVYTYWDYTQLSFPKKRGMRIDFVL

SEQ ID NO: 821890 - protein, 34 aa, Mycobacterium
GVYTYWDYTRLRFPKRQGMRIDFILGSPALASRV

SEQ ID NO: 821891 - protein, 21 aa, Mycobacterium
GWAAGLYLAALSLAGRAQAAA

SEQ ID NO: 821892 - protein, 24 aa, Mycobacterium
GWACGVTVVLPPPGTVAAVDCRGG

SEQ ID NO: 821893 - protein, 17 aa, Mycobacterium
GWAPKRSPDAPATLRDF

SEQ ID NO: 821894 - protein, 29 aa, Mycobacterium
GWAPTVQLTAFLRGLPADGWLRIIATCTE

SEQ ID NO: 821895 - protein, 28 aa, Mycobacterium
GWAPTVQLTAILRALPTDGWLRIVATCV

SEQ ID NO: 821896 - protein, 20 aa, Mycobacterium
GWARFARFHLGRNGAVHGGS

SEQ ID NO: 821897 - protein, 30 aa, Mycobacterium
GWARPEFRGVVRVFAFAFTRYRVGGGAACV

SEQ ID NO: 821898 - protein, 35 aa, Mycobacterium
GWATDRAMVAACPLTFPWNVLGWPSINVPAGFTSE

SEQ ID NO: 821899 - protein, 18 aa, Mycobacterium
GWAVTRLHACSFGGRGAC

SEQ ID NO: 821900 - protein, 21 aa, Mycobacterium
GWAWALDSPFQWMKQVASHFG

SEQ ID NO: 821901 - protein, 24 aa, Mycobacterium
GWCGHCQLGPLLLCRDGPVVSYDV

SEQ ID NO: 821902 - protein, 23 aa, Mycobacterium
GWCPYYVSIATAAQWLRARELPD

SEQ ID NO: 821903 - protein, 35 aa, Mycobacterium
GWDDAPPRRLIFRTDLPRPPRCLPRYLPVDSDRKL

SEQ ID NO: 821904 - protein, 19 aa, Mycobacterium
GWDGCLYPYRFNISDFEPI

SEQ ID NO: 821905 - protein, 25 aa, Mycobacterium
GWDGPGFFGPLSQPLPMSLARHQHW

SEQ ID NO: 821906 - protein, 25 aa, Mycobacterium
GWDGPGFFGPLSQPLPMSLRQHDRW

SEQ ID NO: 821907 - protein, 36 aa, Mycobacterium
GWDKPSFAKELFLGRFPLELIHPFPTPTEADETRTR

SEQ ID NO: 821908 - protein, 34 aa, Mycobacterium
GWDLWQRRHAILRNFPIIGHLRFLLEAVGPELRQ

SEQ ID NO: 821909 - protein, 24 aa, Mycobacterium
GWEAMPEFLAAYPPHRVAEITGLR

SEQ ID NO: 821910 - protein, 17 aa, Mycobacterium
GWEDGMFPHMRALDDPR

SEQ ID NO: 821911 - protein, 18 aa, Mycobacterium
GWEELFQLARFVGVSRPG

SEQ ID NO: 821912 - protein, 22 aa, Mycobacterium
GWEKYYGDFWRAYRQMADPRNG

SEQ ID NO: 821913 - protein, 18 aa, Mycobacterium
GWELTRVRLYTDGSRRVL

SEQ ID NO: 821914 - protein, 19 aa, Mycobacterium
GWELTRVRLYTDGSRRVLL

SEQ ID NO: 821915 - protein, 17 aa, Mycobacterium
GWELVRHAGPLPTHPDE

SEQ ID NO: 821916 - protein, 26 aa, Mycobacterium
GWENDLDLMLEFLATPDFAAAEAWCQ

SEQ ID NO: 821917 - protein, 24 aa, Mycobacterium
GWERPYIAAGIFLYDRLGGAKSVP

SEQ ID NO: 821918 - protein, 20 aa, Mycobacterium
GWERTILDEFLRYTSPVNAM

SEQ ID NO: 821919 - protein, 29 aa, Mycobacterium
GWESGAWMLDFIGSWEWTIPGGASEIQRT

SEQ ID NO: 821920 - protein, 31 aa, Mycobacterium
GWESNPERVWGWYLWRHYLVATVEPNEGHRA

SEQ ID NO: 821921 - protein, 22 aa, Mycobacterium
GWEVLYNTYVPLLTYKHAKGEE

SEQ ID NO: 821922 - protein, 19 aa, Mycobacterium
GWFMNFTSDLWTGPFEQAG

SEQ ID NO: 821923 - protein, 18 aa, Mycobacterium
GWFQLADKQVVLLSGAEA

SEQ ID NO: 821924 - protein, 19 aa, Mycobacterium
GWGHRTVGLGLRQKLDRAA

SEQ ID NO: 821925 - protein, 28 aa, Mycobacterium
GWGKSAVYFIAAKLLRNAGLGPTVIVSP

SEQ ID NO: 821926 - protein, 17 aa, Mycobacterium
GWGLWDQASDMTGGMDA

SEQ ID NO: 821927 - protein, 17 aa, Mycobacterium
GWGLWDQASNMTGGLAA

SEQ ID NO: 821928 - protein, 18 aa, Mycobacterium
GWHCLGPVKNFSDGKPHS

SEQ ID NO: 821929 - protein, 25 aa, Mycobacterium
GWHDARVIPYGPIELDPSAIVLHYA

SEQ ID NO: 821930 - protein, 25 aa, Mycobacterium
GWHDARVIPYGPIELDPSALVLHYA

SEQ ID NO: 821931 - protein, 17 aa, Mycobacterium
GWHICLDTLSLAVAGTP

SEQ ID NO: 821932 - protein, 19 aa, Mycobacterium
GWHPGMPYGRQAWDQYRLE

SEQ ID NO: 821933 - protein, 18 aa, Mycobacterium
GWHPVIGPFFNRGLMMLD

SEQ ID NO: 821934 - protein, 18 aa, Mycobacterium
GWIALNAGLASGAHMTLI

SEQ ID NO: 821935 - protein, 27 aa, Mycobacterium
GWKGDYFPFVFNIRDWNVIMSDSLHLP

SEQ ID NO: 821936 - protein, 23 aa, Mycobacterium
GWKRLTALRRELSALRARLGMPL

SEQ ID NO: 821937 - protein, 19 aa, Mycobacterium
GWLAEPLATMAGYHLGWWD

SEQ ID NO: 821938 - protein, 19 aa, Mycobacterium
GWLAPYPGQPVPIGRARTY

SEQ ID NO: 821939 - protein, 21 aa, Mycobacterium
GWLARRDLIPLGYLGDAEKTA

SEQ ID NO: 821940 - protein, 20 aa, Mycobacterium
GWLEGYLLTGRHGLFNCYEA

SEQ ID NO: 821941 - protein, 18 aa, Mycobacterium
GWLFCPADRPERFTKAAA

SEQ ID NO: 821942 - protein, 20 aa, Mycobacterium
GWLHKGYPEGVPPKDYFALL

SEQ ID NO: 821943 - protein, 17 aa, Mycobacterium
GWLIGNGGSGAAGQNGE

SEQ ID NO: 821944 - protein, 23 aa, Mycobacterium
GWLKDKFGLSWQVVSRELIDLIF

SEQ ID NO: 821945 - protein, 25 aa, Mycobacterium
GWLLNGQKIWSSRAPFAEMGFGLFR

SEQ ID NO: 821946 - protein, 18 aa, Mycobacterium
GWLTALRAELQMAAAHLG

SEQ ID NO: 821947 - protein, 18 aa, Mycobacterium
GWNIVPYTIIRHGPAGPG

SEQ ID NO: 821948 - protein, 33 aa, Mycobacterium
GWNKPSFAKELFLGRFPLELINPFPRPSDAEEA

SEQ ID NO: 821949 - protein, 22 aa, Mycobacterium
GWNPGINVLLPDDYRTSGKTYP

SEQ ID NO: 821950 - protein, 19 aa, Mycobacterium
GWNTDDHVELLWSLSRAPD

SEQ ID NO: 821951 - protein, 18 aa, Mycobacterium
GWPPGMRLIVRRERPHPG

SEQ ID NO: 821952 - protein, 18 aa, Mycobacterium
GWPQMVLAPLGPEQAERF

SEQ ID NO: 821953 - protein, 20 aa, Mycobacterium
GWPSMFRGYLHAEDRYRKCF

SEQ ID NO: 821954 - protein, 21 aa, Mycobacterium
GWPSMFRGYLHAEDRYRKCFS

SEQ ID NO: 821955 - protein, 18 aa, Mycobacterium
GWPVDELLSLSNLDGWGR

SEQ ID NO: 821956 - protein, 17 aa, Mycobacterium
GWQPPRFSPPEGTLAPQ

SEQ ID NO: 821957 - protein, 28 aa, Mycobacterium
GWQRKALVKYLTTKPRDYLLVATPGAGK

SEQ ID NO: 821958 - protein, 35 aa, Mycobacterium
GWQSFRVPCLPSDRLINLLIYIKGYLDGTLTFRRS

SEQ ID NO: 821959 - protein, 23 aa, Mycobacterium
GWQSFRVPCLPSDRLLNLLIYIK

SEQ ID NO: 821960 - protein, 35 aa, Mycobacterium
GWQSFRVPCLPSDRLLNLLIYIKSYLDGTLTFRRS

SEQ ID NO: 821961 - protein, 29 aa, Mycobacterium
GWRAHPDRVWAWYLWRHHMMSAVGPNNAH

SEQ ID NO: 821962 - protein, 32 aa, Mycobacterium
GWRDNPQRVWGWYLWRHYLVADVQPNAGHRAI

SEQ ID NO: 821963 - protein, 27 aa, Mycobacterium
GWREMRSLYELQLPYSGWFVDVTGAES

SEQ ID NO: 821964 - protein, 29 aa, Mycobacterium
GWRGHKSERWYLEQLYAAVGIQGSSAAQQ

SEQ ID NO: 821965 - protein, 29 aa, Mycobacterium
GWRHDALCRGMPWDFFYSPDDERGARRRE

SEQ ID NO: 821966 - protein, 19 aa, Mycobacterium
GWRLAQWGSALEVGRGSEN

SEQ ID NO: 821967 - protein, 17 aa, Mycobacterium
GWRLTFGGEDIGWEGAL

SEQ ID NO: 821968 - protein, 18 aa, Mycobacterium
GWRLVAKELIMALLAPRH

SEQ ID NO: 821969 - protein, 26 aa, Mycobacterium
GWRLYTRARFAPYVEKLLLDGARTKL

SEQ ID NO: 821970 - protein, 24 aa, Mycobacterium
GWRQRLVRPAAVRLASRAWMPVGR

SEQ ID NO: 821971 - protein, 19 aa, Mycobacterium
GWRSVARSLARLPATEIKR

SEQ ID NO: 821972 - protein, 18 aa, Mycobacterium
GWRSYRLADGAGGGWSPV

SEQ ID NO: 821973 - protein, 33 aa, Mycobacterium
GWRVPPGFTRFRWDLDSMFGPQARWGDWRQAPG

SEQ ID NO: 821974 - protein, 18 aa, Mycobacterium
GWSAAIAALGSPTAVLAQ

SEQ ID NO: 821975 - protein, 19 aa, Mycobacterium
GWSAGRFSFNVAEGRCATC

SEQ ID NO: 821976 - protein, 18 aa, Mycobacterium
GWSAGRIINLDIGGGSLE

SEQ ID NO: 821977 - protein, 19 aa, Mycobacterium
GWSAPAYLRAGRSLPRRDR

SEQ ID NO: 821978 - protein, 26 aa, Mycobacterium
GWSAQSRFLLNVPLFHRESVHPDIDR

SEQ ID NO: 821979 - protein, 26 aa, Mycobacterium
GWSAQTRFLLNVPLFQRESVHSDVNR

SEQ ID NO: 821980 - protein, 19 aa, Mycobacterium
GWSAVRWRNLTGGIVALHA

SEQ ID NO: 821981 - protein, 18 aa, Mycobacterium
GWSDNYGGFWTLTRYDDV

SEQ ID NO: 821982 - protein, 19 aa, Mycobacterium
GWSFTGWYDTTEAQALLDF

SEQ ID NO: 821983 - protein, 17 aa, Mycobacterium
GWSIGQQLTFGPGGSTV

SEQ ID NO: 821984 - protein, 21 aa, Mycobacterium
GWSLPILLQEVFASYYGERLP

SEQ ID NO: 821985 - protein, 23 aa, Mycobacterium
GWSLRRTPLPPTGQHWRLLSTIK

SEQ ID NO: 821986 - protein, 18 aa, Mycobacterium
GWSPKWTLEDGLHALLEW

SEQ ID NO: 821987 - protein, 25 aa, Mycobacterium
GWSPMHVVGLTYPLSNLLLGVSNAL

SEQ ID NO: 821988 - protein, 27 aa, Mycobacterium
GWSPRCRGRLWWWRPGCVAVRPTPRRG

SEQ ID NO: 821989 - protein, 17 aa, Mycobacterium
GWSPYYPQFDRSSLDVA

SEQ ID NO: 821990 - protein, 25 aa, Mycobacterium
GWSYNHWINVLYPPGTPSARRLARY

SEQ ID NO: 821991 - protein, 22 aa, Mycobacterium
GWTFSGTISWVSGWGLNTVLTV

SEQ ID NO: 821992 - protein, 19 aa, Mycobacterium
GWTFTFEGYDPPNEKLREA

SEQ ID NO: 821993 - protein, 23 aa, Mycobacterium
GWTITPDWRIDVGDTWIGRDPIE

SEQ ID NO: 821994 - protein, 23 aa, Mycobacterium
GWTMSAMVAFGYPLGRWDIAANR

SEQ ID NO: 821995 - protein, 17 aa, Mycobacterium
GWTPLPSHDDGTLAWVR

SEQ ID NO: 821996 - protein, 28 aa, Mycobacterium
GWTPTVQLTTYLRRRPAPGWMRVMASST

SEQ ID NO: 821997 - protein, 30 aa, Mycobacterium
GWVDVTVASAYKWLLAPRGTAWMSLSDSVA

SEQ ID NO: 821998 - protein, 19 aa, Mycobacterium
GWVGIANLPSSFAAAAYLP

SEQ ID NO: 821999 - protein, 19 aa, Mycobacterium
GWVNGRRLTFHGSGGKVTG

SEQ ID NO: 822000 - protein, 18 aa, Mycobacterium
GWVWRDSRADRWERGFAA

SEQ ID NO: 822001 - protein, 17 aa, Mycobacterium
GWYDVDFPQIVDLRRRL

SEQ ID NO: 822002 - protein, 20 aa, Mycobacterium
GWYFAHPQSQYFVVGRLAQD

SEQ ID NO: 822003 - protein, 23 aa, Mycobacterium
GWYFSHPQSQYFVIGRLAQDQVA

SEQ ID NO: 822004 - protein, 22 aa, Mycobacterium
GWYSALFGMQHETSYPARLGFD

SEQ ID NO: 822005 - protein, 17 aa, Mycobacterium
GWYSFDIAGVHVIALVN

SEQ ID NO: 822006 - protein, 19 aa, Mycobacterium
GYACSWLIGDIKTGEIACH

SEQ ID NO: 822007 - protein, 17 aa, Mycobacterium
GYAFYKLADVRPGETVL

SEQ ID NO: 822008 - protein, 18 aa, Mycobacterium
GYAGVYSSFLRHAEAAAA

SEQ ID NO: 822009 - protein, 18 aa, Mycobacterium
GYAHIGVIDALRARDYEI

SEQ ID NO: 822010 - protein, 17 aa, Mycobacterium
GYALPGYTWTAMGPANA

SEQ ID NO: 822011 - protein, 20 aa, Mycobacterium
GYAPLPVDLKVAGPAVLAVG

SEQ ID NO: 822012 - protein, 18 aa, Mycobacterium
GYAPLPVELGYDGPAVLA

SEQ ID NO: 822013 - protein, 20 aa, Mycobacterium
GYAPMIGGLGYVLAPGAAAY

SEQ ID NO: 822014 - protein, 25 aa, Mycobacterium
GYAPNRTGWLLPFASELVSTAQARR

SEQ ID NO: 822015 - protein, 25 aa, Mycobacterium
GYAPNRTGWLYPFASELVTPAEARR

SEQ ID NO: 822016 - protein, 30 aa, Mycobacterium
GYARALRPHLILHTGDLFDAFRPGYAEMAR

SEQ ID NO: 822017 - protein, 27 aa, Mycobacterium
GYASMRTLVWRRWPTTGLAAPVQSATE

SEQ ID NO: 822018 - protein, 26 aa, Mycobacterium
GYAVCELLYRHGFAGATVLLGVDGTA

SEQ ID NO: 822019 - protein, 24 aa, Mycobacterium
GYAVLLPDVYYREGAWAAFDMATA

SEQ ID NO: 822020 - protein, 25 aa, Mycobacterium
GYAVPSYPKQWWGREYPHKLASVIE

SEQ ID NO: 822021 - protein, 21 aa, Mycobacterium
GYAVVPWSAVDSWFEEGRELV

SEQ ID NO: 822022 - protein, 19 aa, Mycobacterium
GYCFQIEMTWRSVNSGFVV

SEQ ID NO: 822023 - protein, 19 aa, Mycobacterium
GYCFQIEMTWRTVNSGFVV

SEQ ID NO: 822024 - protein, 24 aa, Mycobacterium
GYDEALWRLLCEQVGAAVLVVPEE

SEQ ID NO: 822025 - protein, 26 aa, Mycobacterium
GYDESLWRLLCEQVGAAALVVPEELG

SEQ ID NO: 822026 - protein, 25 aa, Mycobacterium
GYDGVMGRLWLSRGGTYVLANIRGG

SEQ ID NO: 822027 - protein, 25 aa, Mycobacterium
GYDQPRWWSPRGWAHRQEAGLVAPQ

SEQ ID NO: 822028 - protein, 25 aa, Mycobacterium
GYDRPVYTLSHDILFMGATGSFFRR

SEQ ID NO: 822029 - protein, 23 aa, Mycobacterium
GYEGQIGQLPYAAAKGGVLGMTL

SEQ ID NO: 822030 - protein, 17 aa, Mycobacterium
GYELLPSWDDAGAVFDA

SEQ ID NO: 822031 - protein, 33 aa, Mycobacterium
GYEMIDFLIRKGVRLIRCAGWSDYYPNHNGGNA

SEQ ID NO: 822032 - protein, 24 aa, Mycobacterium
GYEPRPEYIAARDFTPLTPKSPST

SEQ ID NO: 822033 - protein, 23 aa, Mycobacterium
GYESVLDIYRRIEDWHGPAVSAR

SEQ ID NO: 822034 - protein, 23 aa, Mycobacterium
GYESVLDVYRRIEDWHGRCDGDR

SEQ ID NO: 822035 - protein, 24 aa, Mycobacterium
GYFHVELMSIRRSATALKYLAASE

SEQ ID NO: 822036 - protein, 23 aa, Mycobacterium
GYFHVELMSIRRSATKLKYLAAS

SEQ ID NO: 822037 - protein, 19 aa, Mycobacterium
GYFMAKRIIKLINAVAEAV

SEQ ID NO: 822038 - protein, 18 aa, Mycobacterium
GYFQFGGSDIILLFQDGV

SEQ ID NO: 822039 - protein, 17 aa, Mycobacterium
GYFQGKVEGWQAPDPRL

SEQ ID NO: 822040 - protein, 19 aa, Mycobacterium
GYFRRSMHLLPKSGSRAPW

SEQ ID NO: 822041 - protein, 20 aa, Mycobacterium
GYFYFVYRVDLQTDDGAAQQ

SEQ ID NO: 822042 - protein, 17 aa, Mycobacterium
GYGALPDDARRAKAAQL

SEQ ID NO: 822043 - protein, 25 aa, Mycobacterium
GYGAPTYPTEWYGRAYPNKLAKVIA

SEQ ID NO: 822044 - protein, 21 aa, Mycobacterium
GYGARFAGVAFPGETLTVNVW

SEQ ID NO: 822045 - protein, 23 aa, Mycobacterium
GYGEIAWQTLFTQQLYAVVSTDH

SEQ ID NO: 822046 - protein, 25 aa, Mycobacterium
GYGENTLFLYIWGDNGSSGEGQNGT

SEQ ID NO: 822047 - protein, 24 aa, Mycobacterium
GYGLPMALTLIRPDLDQWTPGEHN

SEQ ID NO: 822048 - protein, 18 aa, Mycobacterium
GYGLPPLESIPGLAEEIF

SEQ ID NO: 822049 - protein, 17 aa, Mycobacterium
GYGLRLFVYDCADDRGK

SEQ ID NO: 822050 - protein, 18 aa, Mycobacterium
GYGLRPGDALLIIDGLFF

SEQ ID NO: 822051 - protein, 19 aa, Mycobacterium
GYGLRPGDTLLIVDGLFFQ

SEQ ID NO: 822052 - protein, 19 aa, Mycobacterium
GYGMPAAIGAAIAAPGRPV

SEQ ID NO: 822053 - protein, 23 aa, Mycobacterium
GYGPLVRAAVGFTNLWTYPGEPD

SEQ ID NO: 822054 - protein, 22 aa, Mycobacterium
GYGRATALKFLAEGWNVVATMR

SEQ ID NO: 822055 - protein, 18 aa, Mycobacterium
GYGRFCVQTGRLPEAGPW

SEQ ID NO: 822056 - protein, 25 aa, Mycobacterium
GYGRLVREVLLPGSSPRPYGGYFDE

SEQ ID NO: 822057 - protein, 24 aa, Mycobacterium
GYGRLVRPVALPGGSPRPYGGYFD

SEQ ID NO: 822058 - protein, 26 aa, Mycobacterium
GYGRLVRPVALPGSTPRPYGGYFDAV

SEQ ID NO: 822059 - protein, 33 aa, Mycobacterium
GYGRRQTLERLKYLPLAPFRVSYAYTNYGVTAA

SEQ ID NO: 822060 - protein, 20 aa, Mycobacterium
GYGTVFFINEILKASDDTFE

SEQ ID NO: 822061 - protein, 24 aa, Mycobacterium
GYGYGPAFQGLRAVWRRGAETFAE

SEQ ID NO: 822062 - protein, 18 aa, Mycobacterium
GYGYMREYPVARAYLDAR

SEQ ID NO: 822063 - protein, 24 aa, Mycobacterium
GYGYTAFMHDPLAAAVALDPQLIS

SEQ ID NO: 822064 - protein, 44 aa, Mycobacterium
GYHAFESLLRYDRPYSGYAPIIGTPWLTSFAQRSRFAEAFGSMG

SEQ ID NO: 822065 - protein, 25 aa, Mycobacterium
GYHDDVALLLYRQPEPLDLDFPADV

SEQ ID NO: 822066 - protein, 33 aa, Mycobacterium
GYHEDWDFDALWTALKTLYPVSLKPEELIASGE

SEQ ID NO: 822067 - protein, 18 aa, Mycobacterium
GYHESPVPGLLRGFGHVG

SEQ ID NO: 822068 - protein, 20 aa, Mycobacterium
GYHFLAVLTLSGHRGLERPM

SEQ ID NO: 822069 - protein, 25 aa, Mycobacterium
GYHNRERKPFWWSHFDRLNNPVDEW

SEQ ID NO: 822070 - protein, 20 aa, Mycobacterium
GYIAALIYNDKHWNAFIEAV

SEQ ID NO: 822071 - protein, 17 aa, Mycobacterium
GYIAYPPRPDGQPTFNE

SEQ ID NO: 822072 - protein, 26 aa, Mycobacterium
GYIDVKGLRLTLTQAAWKVAEDLPAE

SEQ ID NO: 822073 - protein, 25 aa, Mycobacterium
GYIDVKGLRLTLTQAAWKVSEDVPA

SEQ ID NO: 822074 - protein, 26 aa, Mycobacterium
GYIDVKGLRLTLTQAAWRLSEDLPAD

SEQ ID NO: 822075 - protein, 25 aa, Mycobacterium
GYIDVKGLRLTLTQAAWRVSEDIPA

SEQ ID NO: 822076 - protein, 25 aa, Mycobacterium
GYIDVKGLRLTLTQAAWRVSEDLPA

SEQ ID NO: 822077 - protein, 21 aa, Mycobacterium
GYIELFYGRPLNQASWELVTD

SEQ ID NO: 822078 - protein, 18 aa, Mycobacterium
GYIGLGNQGAPMAKRLVD

SEQ ID NO: 822079 - protein, 32 aa, Mycobacterium
GYIPKDADWALFSRLMPILPTTVESSGTGMAD

SEQ ID NO: 822080 - protein, 37 aa, Mycobacterium
GYIPLLMAAALPRPARRLPLLGAWIAELLDRNSRDQA

SEQ ID NO: 822081 - protein, 25 aa, Mycobacterium
GYIPPNLHFSRWNPAIDASSTRLFV

SEQ ID NO: 822082 - protein, 26 aa, Mycobacterium
GYIRDYPVERLWRELRVDRIWEGTSE

SEQ ID NO: 822083 - protein, 37 aa, Mycobacterium
GYKCSIRTPWWRTPSLWAPDLFLLRQIHRAPRLTVNG

SEQ ID NO: 822084 - protein, 21 aa, Mycobacterium
GYKGISIPRMLEAEGFRGGML

SEQ ID NO: 822085 - protein, 25 aa, Mycobacterium
GYKVPRSIWIVDSVKRNPAGKADYR

SEQ ID NO: 822086 - protein, 19 aa, Mycobacterium
GYLAALIYNDKHWAAFVDA

SEQ ID NO: 822087 - protein, 26 aa, Mycobacterium
GYLAGMLVHDLDFLTSLLGRPVSVCA

SEQ ID NO: 822088 - protein, 17 aa, Mycobacterium
GYLANRNVLPKYGFPVD

SEQ ID NO: 822089 - protein, 22 aa, Mycobacterium
GYLGLFVTHDGFWKAFAAEAGI

SEQ ID NO: 822090 - protein, 18 aa, Mycobacterium
GYLHGLAALGCAPILVYP

SEQ ID NO: 822091 - protein, 26 aa, Mycobacterium
GYLKREYESLWSAVRFDDPARPAAVR

SEQ ID NO: 822092 - protein, 19 aa, Mycobacterium
GYLLHGTLDLHGRSRDRVL

SEQ ID NO: 822093 - protein, 38 aa, Mycobacterium
GYLLSQPGLRKLLLQEWLRFGWYFLITRRDPKGLAEWI

SEQ ID NO: 822094 - protein, 20 aa, Mycobacterium
GYLLYRVGTVLRPEVAAVLS

SEQ ID NO: 822095 - protein, 21 aa, Mycobacterium
GYLVNGQWPLASGSYEHQWMM

SEQ ID NO: 822096 - protein, 20 aa, Mycobacterium
GYMAIPALWGGSGVFKGFGK

SEQ ID NO: 822097 - protein, 27 aa, Mycobacterium
GYMASRTAFFDEFFLAATGAGIRQAVI

SEQ ID NO: 822098 - protein, 18 aa, Mycobacterium
GYMLEYPVARAYLDTRAQ

SEQ ID NO: 822099 - protein, 22 aa, Mycobacterium
GYMMEYPIAQMYAAARVQKIYG

SEQ ID NO: 822100 - protein, 33 aa, Mycobacterium
GYNGALDIDLVFSPFFNALPIRRLGIHERAEMI

SEQ ID NO: 822101 - protein, 20 aa, Mycobacterium
GYNTGFWNAGDINTGMWNSG

SEQ ID NO: 822102 - protein, 19 aa, Mycobacterium
GYPAVLADQLLILANGAMV

SEQ ID NO: 822103 - protein, 18 aa, Mycobacterium
GYPFARQRHWVEPKHMVW

SEQ ID NO: 822104 - protein, 17 aa, Mycobacterium
GYPHLEEAYWFGEGVLP

SEQ ID NO: 822105 - protein, 19 aa, Mycobacterium
GYPKVMADFTIRHGRQFGF

SEQ ID NO: 822106 - protein, 32 aa, Mycobacterium
GYPLDSFPGAPPFIRGPYPTMYVNQPWTIRQY

SEQ ID NO: 822107 - protein, 21 aa, Mycobacterium
GYPREWRRRKPPSWLRQVLPD

SEQ ID NO: 822108 - protein, 33 aa, Mycobacterium
GYPREWRRRKPYRWLRQILPDPKYAPGYLNEFG

SEQ ID NO: 822109 - protein, 21 aa, Mycobacterium
GYPREWRRRKPYSWLRQVLPD

SEQ ID NO: 822110 - protein, 29 aa, Mycobacterium
GYPSFHDLEYWRPLWQALVDTETVMNVHI

SEQ ID NO: 822111 - protein, 37 aa, Mycobacterium
GYPSLLTSPVAFLARPARWLHLLASTPHTFSAAPNFA

SEQ ID NO: 822112 - protein, 17 aa, Mycobacterium
GYPVHKPVTAGWNGYGD

SEQ ID NO: 822113 - protein, 17 aa, Mycobacterium
GYPVTSLYYDTPDLRFY

SEQ ID NO: 822114 - protein, 18 aa, Mycobacterium
GYPYLVMPFCSRGSVQEV

SEQ ID NO: 822115 - protein, 25 aa, Mycobacterium
GYQAVRTHFFDSYFADAVGAGIRQV

SEQ ID NO: 822116 - protein, 20 aa, Mycobacterium
GYQFDLLAPVFEDTAITAQA

SEQ ID NO: 822117 - protein, 27 aa, Mycobacterium
GYQGAVPRLPAPPLPRVRMVPRRNAPT

SEQ ID NO: 822118 - protein, 21 aa, Mycobacterium
GYQLVDIPFKFHHPMWREHCE

SEQ ID NO: 822119 - protein, 18 aa, Mycobacterium
GYQPFPGQAGYAATKAFV

SEQ ID NO: 822120 - protein, 24 aa, Mycobacterium
GYQSLSFHDALFARRTFGLRPAPE

SEQ ID NO: 822121 - protein, 17 aa, Mycobacterium
GYQSQWVNTGNPIHDLS

SEQ ID NO: 822122 - protein, 17 aa, Mycobacterium
GYQVFAINPLAVARYRD

SEQ ID NO: 822123 - protein, 25 aa, Mycobacterium
GYQVVTFGFILGELVRRVTGRTLGQ

SEQ ID NO: 822124 - protein, 20 aa, Mycobacterium
GYRAVLPRPVTALLGHLRPD

SEQ ID NO: 822125 - protein, 18 aa, Mycobacterium
GYRDVYGISYVIVQMRHA

SEQ ID NO: 822126 - protein, 22 aa, Mycobacterium
GYRGKLWTFRQYSGFGTAEESN

SEQ ID NO: 822127 - protein, 25 aa, Mycobacterium
GYRIAPGRSSALRRAVSLLGEDLDA

SEQ ID NO: 822128 - protein, 17 aa, Mycobacterium
GYRIELGEIRAALTGLR

SEQ ID NO: 822129 - protein, 26 aa, Mycobacterium
GYRLPSMLLPLWDSDLGTGFIATLRS

SEQ ID NO: 822130 - protein, 23 aa, Mycobacterium
GYRNPVEPDPFSEPGWFRTDDLG

SEQ ID NO: 822131 - protein, 25 aa, Mycobacterium
GYRQAALAHLTLLLIDLARLADDVV

SEQ ID NO: 822132 - protein, 21 aa, Mycobacterium
GYRQLQTWWGATAAAIEACEC

SEQ ID NO: 822133 - protein, 21 aa, Mycobacterium
GYRRRMLIIVISDEPDADRRL

SEQ ID NO: 822134 - protein, 32 aa, Mycobacterium
GYRSIRYGFVPRRFRLMLTASGVNRFAGPDAA

SEQ ID NO: 822135 - protein, 20 aa, Mycobacterium
GYRSLRDIVLPLAQLTVITG

SEQ ID NO: 822136 - protein, 25 aa, Mycobacterium
GYRSLREVILPLGRLSVITGANGSG

SEQ ID NO: 822137 - protein, 25 aa, Mycobacterium
GYRSLREVILPLGRLSVVTGANGAG

SEQ ID NO: 822138 - protein, 20 aa, Mycobacterium
GYRVFTIMGRIPELYITMLG

SEQ ID NO: 822139 - protein, 22 aa, Mycobacterium
GYSEQLLLEKWGRDSKILDIFE

SEQ ID NO: 822140 - protein, 20 aa, Mycobacterium
GYSEYLLRLRVVYAALEDAM

SEQ ID NO: 822141 - protein, 24 aa, Mycobacterium
GYSFGFVDLLGVRRDWRGRKLAQA

SEQ ID NO: 822142 - protein, 31 aa, Mycobacterium
GYSFTVPVQRPILAPIYLPDIRVACTPYKGA

SEQ ID NO: 822143 - protein, 26 aa, Mycobacterium
GYSGVLGRLWLARGGTYVLANIRGGG

SEQ ID NO: 822144 - protein, 25 aa, Mycobacterium
GYSGVMGRLWLARGGTYVLANIRGG

SEQ ID NO: 822145 - protein, 19 aa, Mycobacterium
GYSIVIAPGLAFGAAADAV

SEQ ID NO: 822146 - protein, 25 aa, Mycobacterium
GYSLDVWHRYHAILVGVVCGGGKLR

SEQ ID NO: 822147 - protein, 24 aa, Mycobacterium
GYSPEQAYLLLGSAPIEGRLSGVV

SEQ ID NO: 822148 - protein, 21 aa, Mycobacterium
GYSPMIGGLGYVLAPGPAAYT

SEQ ID NO: 822149 - protein, 26 aa, Mycobacterium
GYSRIPGYLIARLAIDTSLRGQGFGE

SEQ ID NO: 822150 - protein, 24 aa, Mycobacterium
GYSTRLKILLEPVKPFVALQHIRF

SEQ ID NO: 822151 - protein, 18 aa, Mycobacterium
GYSVRLRIQLEPVKPFVA

SEQ ID NO: 822152 - protein, 22 aa, Mycobacterium
GYTAIPALWGGSGVFKGFGKRD

SEQ ID NO: 822153 - protein, 19 aa, Mycobacterium
GYTALLVAGWRALDTVGPQ

SEQ ID NO: 822154 - protein, 24 aa, Mycobacterium
GYTFPVDDWARVHRFLTLGTDGGT

SEQ ID NO: 822155 - protein, 17 aa, Mycobacterium
GYTIILHTVLIPEELAV

SEQ ID NO: 822156 - protein, 17 aa, Mycobacterium
GYTPIRVHLVNTGATVT

SEQ ID NO: 822157 - protein, 24 aa, Mycobacterium
GYTQSYTYFTWRTAKWELTEFGQS

SEQ ID NO: 822158 - protein, 25 aa, Mycobacterium
GYTSTSFELMAHLFIPPGGAQGVIM

SEQ ID NO: 822159 - protein, 21 aa, Mycobacterium
GYTTTVLLALGYPDAANTYNN

SEQ ID NO: 822160 - protein, 18 aa, Mycobacterium
GYTYGGRIAALADAAREN

SEQ ID NO: 822161 - protein, 22 aa, Mycobacterium
GYVDASYWRDMGTPEDFVRGSA

SEQ ID NO: 822162 - protein, 22 aa, Mycobacterium
GYVDATYWRDMGTPEDFVRGSA

SEQ ID NO: 822163 - protein, 22 aa, Mycobacterium
GYVELFYGRPLTQSSWELVTDA

SEQ ID NO: 822164 - protein, 24 aa, Mycobacterium
GYVELPPERLNKASLAPFAIEQWA

SEQ ID NO: 822165 - protein, 23 aa, Mycobacterium
GYVELPPERLNKATPAPFTLEQW

SEQ ID NO: 822166 - protein, 24 aa, Mycobacterium
GYVELPPERLSTASPAPFTLEQWA

SEQ ID NO: 822167 - protein, 22 aa, Mycobacterium
GYVENWPVARLLRDAQVNTIWE

SEQ ID NO: 822168 - protein, 27 aa, Mycobacterium
GYVEVLPTPFLPAGVFDLWGLTADDPR

SEQ ID NO: 822169 - protein, 20 aa, Mycobacterium
GYVFLAAPLPREWPALTKAM

SEQ ID NO: 822170 - protein, 20 aa, Mycobacterium
GYVLAEIGFRVRRLAGRVVW

SEQ ID NO: 822171 - protein, 30 aa, Mycobacterium
GYVLAELGYRVRRLAGRVVWLAPPDAPTPA

SEQ ID NO: 822172 - protein, 26 aa, Mycobacterium
GYVPGIPRLGVPPLRMSDAGLGVTNP

SEQ ID NO: 822173 - protein, 36 aa, Mycobacterium
GYVPLLTVAAWPRLVRRLPVLGPWVRNLLDADAREK

SEQ ID NO: 822174 - protein, 20 aa, Mycobacterium
GYVPRALYVANLIFGALTSL

SEQ ID NO: 822175 - protein, 20 aa, Mycobacterium
GYVRAVVVPDRPAPKLAQSG

SEQ ID NO: 822176 - protein, 21 aa, Mycobacterium
GYVTVIIDLTPVLDGTGRARL

SEQ ID NO: 822177 - protein, 24 aa, Mycobacterium
GYVTVLGFFRENAIGLACKALDVA

SEQ ID NO: 822178 - protein, 18 aa, Mycobacterium
GYVWHAYLPNISPGQRYG

SEQ ID NO: 822179 - protein, 20 aa, Mycobacterium
GYVWHCYLPTISPGQRYGFR

SEQ ID NO: 822180 - protein, 30 aa, Mycobacterium
GYVWINGSARHYWGLPFGGWKSSGVGSEES

SEQ ID NO: 822181 - protein, 20 aa, Mycobacterium
GYWSEHLRDAPPAIDLPRDF

SEQ ID NO: 822182 - protein, 34 aa, Mycobacterium; identical to SEQ ID NO: 115049

SEQ ID NO: 822183 - protein, 34 aa, Mycobacterium
GYYDTLTPPVLLRNVLENPAWYTAYTPYQPEISQ

SEQ ID NO: 822184 - protein, 22 aa, Mycobacterium
GYYFESPSGRWRCAILPHVQAG

SEQ ID NO: 822185 - protein, 27 aa, Mycobacterium
GYYNLVHSHYWLSGQAGWLARDRWGVP

SEQ ID NO: 822186 - protein, 18 aa, Mycobacterium
GYYPGDLIDFQFAGDTIE

SEQ ID NO: 822187 - protein, 24 aa, Mycobacterium
GYYQIRGGIPYAIVKSLAAAPFAD

SEQ ID NO: 822188 - protein, 26 aa, Mycobacterium
HAAAAPLVTAVLPPAADAVSLQTATG

SEQ ID NO: 822189 - protein, 22 aa, Mycobacterium
HAAAFYRNSLIHAFLETSIVEL

SEQ ID NO: 822190 - protein, 30 aa, Mycobacterium
HAAAGGVGLLFLQWANLLGVNVIGTVSNEE

SEQ ID NO: 822191 - protein, 19 aa, Mycobacterium
HAAALFTLDGTVLAVREDI

SEQ ID NO: 822192 - protein, 25 aa, Mycobacterium
HAAALPAITAVVPPAADPVSIQTAA

SEQ ID NO: 822193 - protein, 21 aa, Mycobacterium
HAAALWRYALRLTGDRARSED

SEQ ID NO: 822194 - protein, 18 aa, Mycobacterium
HAAAPPARVPRPGFCAIC

SEQ ID NO: 822195 - protein, 30 aa, Mycobacterium
HAAARRQLQYFWPRLVGDTGWELLDSKFSV

SEQ ID NO: 822196 - protein, 20 aa, Mycobacterium
HAAATLLRLTQRTATACGLA

SEQ ID NO: 822197 - protein, 29 aa, Mycobacterium
HAAAVNFPDVLFIAGKYQVKIPPPFIPGN

SEQ ID NO: 822198 - protein, 26 aa, Mycobacterium
HAAAVPLITVVAPPAADPVSVQSAVE

SEQ ID NO: 822199 - protein, 28 aa, Mycobacterium
HAACGHHPFIDLPYRPGHEAVGVVETLG

SEQ ID NO: 822200 - protein, 22 aa, Mycobacterium
HAADCLVVSVGYRLAPEHPCPA

SEQ ID NO: 822201 - protein, 19 aa, Mycobacterium
HAAELRHAWLDLHESWLMA

SEQ ID NO: 822202 - protein, 22 aa, Mycobacterium
HAAEWRTWPGYSEQERLAAEFA

SEQ ID NO: 822203 - protein, 19 aa, Mycobacterium
HAAFGTVMALFQRERAKAP

SEQ ID NO: 822204 - protein, 29 aa, Mycobacterium
HAAFKAALDLLWPVLTPETVLAELYSSHE

SEQ ID NO: 822205 - protein, 34 aa, Mycobacterium
HAAGLRQLRYFWPQLVGDTRWELIDSKFTLVAQA

SEQ ID NO: 822206 - protein, 20 aa, Mycobacterium
HAAGLWTAFSGFLSGFPVVL

SEQ ID NO: 822207 - protein, 36 aa, Mycobacterium
HAAGVIVLTCGMFGNVIRLLPPLTISDELLSEGLDI

SEQ ID NO: 822208 - protein, 17 aa, Mycobacterium
HAAIVNHVLWMRAHYAV

SEQ ID NO: 822209 - protein, 17 aa, Mycobacterium
HAAKLRFMTGGRTTAPI

SEQ ID NO: 822210 - protein, 17 aa, Mycobacterium
HAALAEALQTAAALLAS

SEQ ID NO: 822211 - protein, 20 aa, Mycobacterium
HAALEFWSALHGFVLLEMTG

SEQ ID NO: 822212 - protein, 28 aa, Mycobacterium
HAALIRRANARLVVFPELSLTGYQLKVA

SEQ ID NO: 822213 - protein, 17 aa, Mycobacterium
HAALRQVLGPNAVQAGS

SEQ ID NO: 822214 - protein, 27 aa, Mycobacterium
HAALYGKYLTEIIWQLPAGLASPSTMT

SEQ ID NO: 822215 - protein, 22 aa, Mycobacterium
HAAMFGDSFADYGFIPDLYATM

SEQ ID NO: 822216 - protein, 17 aa, Mycobacterium
HAAMTLLRREQPVTKVI

SEQ ID NO: 822217 - protein, 19 aa, Mycobacterium
HAAMYQMVSAKAAAIHEHF

SEQ ID NO: 822218 - protein, 22 aa, Mycobacterium
HAANGYLLDQFLTTYTNHRTDE

SEQ ID NO: 822219 - protein, 24 aa, Mycobacterium
HAAPRGVMIAVPLSPDAVAEYLTP

SEQ ID NO: 822220 - protein, 25 aa, Mycobacterium
HAAQPLSVFFFDILHHDGTDLLDAP

SEQ ID NO: 822221 - protein, 22 aa, Mycobacterium
HAARHPLLHTLGRDLRELQRAL

SEQ ID NO: 822222 - protein, 23 aa, Mycobacterium
HAARLWSPVLACALAHGVLPDLS

SEQ ID NO: 822223 - protein, 17 aa, Mycobacterium
HAARPQVVPRRPVIRPV

SEQ ID NO: 822224 - protein, 20 aa, Mycobacterium
HAARPTILLWHGMQTDARAA

SEQ ID NO: 822225 - protein, 26 aa, Mycobacterium
HAARRALPVSFAGRSWWVAIEDIGRL

SEQ ID NO: 822226 - protein, 24 aa, Mycobacterium
HAARVPVLQILEARLRELQSGAEP

SEQ ID NO: 822227 - protein, 24 aa, Mycobacterium
HAASAFALFFPIEGDVDYGQAKVE

SEQ ID NO: 822228 - protein, 25 aa, Mycobacterium
HAASAFALWFPIEGGADYGDAKVEM

SEQ ID NO: 822229 - protein, 25 aa, Mycobacterium
HAASAFAMWFPIEGGADYGQAKVDM

SEQ ID NO: 822230 - protein, 24 aa, Mycobacterium
HAASVPVLVHPAPRSVLGGLAATV

SEQ ID NO: 822231 - protein, 32 aa, Mycobacterium
HAATYLAFDLIHRLWLDLGHDVQYVQNVTDVD

SEQ ID NO: 822232 - protein, 30 aa, Mycobacterium
HAATYLAFDLIYRQWLDLGHDVHYVQNVTD

SEQ ID NO: 822233 - protein, 29 aa, Mycobacterium
HAATYLTFDLIYRQWLDAGLDVHYVQNVT

SEQ ID NO: 822234 - protein, 29 aa, Mycobacterium
HAATYLTFDLVHRLWLDAGHTVQYVQNVT

SEQ ID NO: 822235 - protein, 25 aa, Mycobacterium
HAATYLTFDLVNRVWRDSGHDVHYV

SEQ ID NO: 822236 - protein, 29 aa, Mycobacterium
HAATYLTFDLVYRQWLDLGHDVHYVQNVT

SEQ ID NO: 822237 - protein, 21 aa, Mycobacterium
HAAVEPLVLMLAPLAPHLAEE

SEQ ID NO: 822238 - protein, 36 aa, Mycobacterium
HAAVLAPRLGVPDEFGLCRYLAAGLAVVHAVDPRPS

SEQ ID NO: 822239 - protein, 23 aa, Mycobacterium
HAAWSHDHPSLDDPALATSIAQQ

SEQ ID NO: 822240 - protein, 22 aa, Mycobacterium
HAAYDLQLYSGGRFRLGLGSQV

SEQ ID NO: 822241 - protein, 23 aa, Mycobacterium
HAAYIDYPASLLTWSEFDCAATN

SEQ ID NO: 822242 - protein, 24 aa, Mycobacterium
HACEYWRAQFKAGNPIDAHVVNTV

SEQ ID NO: 822243 - protein, 29 aa, Mycobacterium
HACTTQLAHFKAPKAFLFVERIERLGNGK

SEQ ID NO: 822244 - protein, 25 aa, Mycobacterium
HADDPRLFRLAVFDVLINNADRKGG

SEQ ID NO: 822245 - protein, 18 aa, Mycobacterium
HADDSLLRRMAVFDTLVN

SEQ ID NO: 822246 - protein, 25 aa, Mycobacterium
HADEERIVWLADPLIAPDLSEVSED

SEQ ID NO: 822247 - protein, 26 aa, Mycobacterium
HADEERIVWLAEPLVASADLPDGYDD

SEQ ID NO: 822248 - protein, 24 aa, Mycobacterium
HADEIYAWVRSRPVDEIRELATAF

SEQ ID NO: 822249 - protein, 27 aa, Mycobacterium
HADFFVRNLIAILAEERLAFGVTRPKA

SEQ ID NO: 822250 - protein, 18 aa, Mycobacterium
HADGNGLFPVLPDAADPY

SEQ ID NO: 822251 - protein, 18 aa, Mycobacterium
HADHFWTWSIDMLGHGYT

SEQ ID NO: 822252 - protein, 25 aa, Mycobacterium
HADHLDKFLGELTELALILGVGAHS

SEQ ID NO: 822253 - protein, 17 aa, Mycobacterium
HADILVLLDRHPEGLSA

SEQ ID NO: 822254 - protein, 26 aa, Mycobacterium
HADKPFFGSLLEFITSGPLVAAIVEG

SEQ ID NO: 822255 - protein, 25 aa, Mycobacterium
HADLEGALTVIRPLSRSASEEVSVG

SEQ ID NO: 822256 - protein, 17 aa, Mycobacterium
HADLLVVQRGEKVTVEV

SEQ ID NO: 822257 - protein, 17 aa, Mycobacterium
HADLQGIRQPLTDFRNR

SEQ ID NO: 822258 - protein, 34 aa, Mycobacterium
HADRGSWYINRVHRLLARVLTLSVPTAAAVVGHA

SEQ ID NO: 822259 - protein, 29 aa, Mycobacterium
HADSVVLPFLLPDTPVVAWWPASAPETPA

SEQ ID NO: 822260 - protein, 18 aa, Mycobacterium
HADTFIGPLITPAAVELV

SEQ ID NO: 822261 - protein, 17 aa, Mycobacterium
HADVWNHLVRFAFCKRD

SEQ ID NO: 822262 - protein, 24 aa, Mycobacterium
HAEAIKKFRILPVDFTEATGEMTP

SEQ ID NO: 822263 - protein, 23 aa, Mycobacterium
HAEDIRWHAERLVQADIYLGQRL

SEQ ID NO: 822264 - protein, 22 aa, Mycobacterium
HAEFVALMFLSEASDRTLGLSE

SEQ ID NO: 822265 - protein, 26 aa, Mycobacterium
HAEGMKLFQQIWHGGPTQLTRDSSAP

SEQ ID NO: 822266 - protein, 23 aa, Mycobacterium
HAEGWSHYLDRLVAAALQGDAGP

SEQ ID NO: 822267 - protein, 21 aa, Mycobacterium
HAEILALRAAALVHGDGWRLE

SEQ ID NO: 822268 - protein, 21 aa, Mycobacterium
HAEILALRRAGDLAAGGTVVV

SEQ ID NO: 822269 - protein, 29 aa, Mycobacterium
HAEKPFFGSLLEFITSGPLVAAVLEGPRA

SEQ ID NO: 822270 - protein, 19 aa, Mycobacterium
HAELITAVELPPPPVGAVS

SEQ ID NO: 822271 - protein, 25 aa, Mycobacterium
HAEPLAEYALFGLLAGAKTLPRLLR

SEQ ID NO: 822272 - protein, 20 aa, Mycobacterium
HAEQPRVPIWVGGRSRRSLR

SEQ ID NO: 822273 - protein, 26 aa, Mycobacterium
HAERFTQLRPLLFTIAYEILGSATES

SEQ ID NO: 822274 - protein, 40 aa, Mycobacterium
HAERHWRELAKPLHLHRILLQRSWIPIFCSRFGEAVEMIA

SEQ ID NO: 822275 - protein, 41 aa, Mycobacterium
HAERHWRELGRPLPLHRILLQRSWIAIFWSRFAEAVELIAE

SEQ ID NO: 822276 - protein, 24 aa, Mycobacterium
HAERLAVPADLLLPIPRDVSWEQA

SEQ ID NO: 822277 - protein, 23 aa, Mycobacterium
HAESVFGIFPTPKSMRAYATDIR

SEQ ID NO: 822278 - protein, 29 aa, Mycobacterium
HAETITDRILLLDGLPNYQRLFSLRVGQT

SEQ ID NO: 822279 - protein, 31 aa, Mycobacterium
HAETTVNLLFEPIMPMKPIVLPGVGETTAAA

SEQ ID NO: 822280 - protein, 20 aa, Mycobacterium
HAEVLALRRAGDLAAGGTAV

SEQ ID NO: 822281 - protein, 31 aa, Mycobacterium
HAEVPLELRIRAAWLWSGRRAVIGGAAAAAL

SEQ ID NO: 822282 - protein, 22 aa, Mycobacterium
HAEVVALRRAGGLAAGAIAVVT

SEQ ID NO: 822283 - protein, 17 aa, Mycobacterium
HAFAGSLLRDHGLLLPI

SEQ ID NO: 822284 - protein, 26 aa, Mycobacterium
HAFAGTLLREFGLMLPVEPDTRLLGE

SEQ ID NO: 822285 - protein, 17 aa, Mycobacterium
HAFALLQDDVMDQSPQR

SEQ ID NO: 822286 - protein, 30 aa, Mycobacterium
HAFGAQWAAFARSALFPALVRALDDGIHDP

SEQ ID NO: 822287 - protein, 19 aa, Mycobacterium
HAFGARWAGFARSSVFSAL

SEQ ID NO: 822288 - protein, 18 aa, Mycobacterium
HAFMVERVESGFGSLDEV

SEQ ID NO: 822289 - protein, 23 aa, Mycobacterium
HAFPALALCLKFAAAGDDPVLLT

SEQ ID NO: 822290 - protein, 19 aa, Mycobacterium
HAFPASRWRRYDKLDRFPA

SEQ ID NO: 822291 - protein, 19 aa, Mycobacterium
HAFTQFPEQWELYKKTRPE

SEQ ID NO: 822292 - protein, 28 aa, Mycobacterium
HAFWDTEGFVLPVLTYTAPHAVADALRW

SEQ ID NO: 822293 - protein, 19 aa, Mycobacterium
HAFYLQYKNVKADYVKAFW

SEQ ID NO: 822294 - protein, 21 aa, Mycobacterium
HAGAAYFLPTLIKGGEMHVLP

SEQ ID NO: 822295 - protein, 21 aa, Mycobacterium
HAGFELKQRIIEHLRASGHEP

SEQ ID NO: 822296 - protein, 18 aa, Mycobacterium
HAGFVAVYALIRQAAEKA

SEQ ID NO: 822297 - protein, 27 aa, Mycobacterium
HAGGPGWSFRRPGPAFRFSKTPVARPG

SEQ ID NO: 822298 - protein, 25 aa, Mycobacterium
HAGIRNRLLWMQAAYQLTPADRVLH

SEQ ID NO: 822299 - protein, 26 aa, Mycobacterium
HAGKGRAILNYRPLHHIRRPQRDIIT

SEQ ID NO: 822300 - protein, 19 aa, Mycobacterium
HAGLLDYPAGHRGPVGLVI

SEQ ID NO: 822301 - protein, 20 aa, Mycobacterium
HAGLRREHLSLAAGRITGIV

SEQ ID NO: 822302 - protein, 18 aa, Mycobacterium
HAGLSYLLVPLDQPGVQI

SEQ ID NO: 822303 - protein, 18 aa, Mycobacterium
HAGLSYLLVPLDQPGVQV

SEQ ID NO: 822304 - protein, 25 aa, Mycobacterium
HAGVPYLEFAYIPDEIHALFDHIKQ

SEQ ID NO: 822305 - protein, 23 aa, Mycobacterium
HAGVQDILLIAFALAWSEFSSGG

SEQ ID NO: 822306 - protein, 29 aa, Mycobacterium
HAGVQDILLIAFGLAWARFVGTGAPIGID

SEQ ID NO: 822307 - protein, 26 aa, Mycobacterium
HAGVQDILLIAFGLAWNEFLDSNTTS

SEQ ID NO: 822308 - protein, 29 aa, Mycobacterium
HAGVQDILLIAFGLAWNEFLGVSGAPIAF

SEQ ID NO: 822309 - protein, 27 aa, Mycobacterium
HAGVQDILLIAFGLAWSEYLGSEQGSI

SEQ ID NO: 822310 - protein, 32 aa, Mycobacterium
HAGVQDILLIAFGLAWTQFMGTGAPIAIDVEG

SEQ ID NO: 822311 - protein, 35 aa, Mycobacterium
HAGVRVRQSRWGRAPMLHRLPCGLQQQPMLRVHQH

SEQ ID NO: 822312 - protein, 17 aa, Mycobacterium
HAGWAWAGSTPYKGMKL

SEQ ID NO: 822313 - protein, 18 aa, Mycobacterium
HAGYPLVVKPVTGSLRDG

SEQ ID NO: 822314 - protein, 19 aa, Mycobacterium
HAHAWALRMSPDGNVWGAT

SEQ ID NO: 822315 - protein, 28 aa, Mycobacterium
HAHDTVEVFIPMKGKWIIIWGDEGEHQL

SEQ ID NO: 822316 - protein, 20 aa, Mycobacterium
HAHDWLVAHPAVALAQFFDV

SEQ ID NO: 822317 - protein, 31 aa, Mycobacterium
HAHEDHIGAIPFLLKLRPDIPVVGSKFTIAL

SEQ ID NO: 822318 - protein, 30 aa, Mycobacterium
HAHEDHIGAIPFLLKLRPDIPVVGSRFTLA

SEQ ID NO: 822319 - protein, 34 aa, Mycobacterium
HAHEDHIGAIPFLLRLRPDIPIVGSKFTLALVAA

SEQ ID NO: 822320 - protein, 31 aa, Mycobacterium
HAHEDHIGGIPFLLKLRPDIPVVGSKFTLAL

SEQ ID NO: 822321 - protein, 30 aa, Mycobacterium
HAHEDHIGGIPFLLKLRPDIPVVGSRFTLA

SEQ ID NO: 822322 - protein, 18 aa, Mycobacterium
HAHELRQTVLALLADHNL

SEQ ID NO: 822323 - protein, 27 aa, Mycobacterium
HAHHAHALHSPFWWLKCAVGVSNADHP

SEQ ID NO: 822324 - protein, 18 aa, Mycobacterium
HAHHYLAIFDKGKALALY

SEQ ID NO: 822325 - protein, 23 aa, Mycobacterium
HAHLRHLNPFPANLGDVLRRYPM

SEQ ID NO: 822326 - protein, 20 aa, Mycobacterium
HAHLRHLNPFPQNLGEVLRK

SEQ ID NO: 822327 - protein, 21 aa, Mycobacterium
HAHLRYLNPFPANLGEVLRRY

SEQ ID NO: 822328 - protein, 33 aa, Mycobacterium
HAHNYQALGRQAAAFHDQFVAALSAGGGGYGAA

SEQ ID NO: 822329 - protein, 25 aa, Mycobacterium
HAHSTLNPLAAYQKRFTLEQIMNDV

SEQ ID NO: 822330 - protein, 19 aa, Mycobacterium
HAIADWALISRTEAARRIK

SEQ ID NO: 822331 - protein, 18 aa, Mycobacterium
HAIALLLAAARQIPAADA

SEQ ID NO: 822332 - protein, 17 aa, Mycobacterium
HAIAMGAFLLTSGDHRV

SEQ ID NO: 822333 - protein, 30 aa, Mycobacterium
HAIATGCVDFVLPPDRLAAAVLALTTAPGG

SEQ ID NO: 822334 - protein, 27 aa, Mycobacterium
HAIATMLRNHGAQYQALSAQGAQVHQR

SEQ ID NO: 822335 - protein, 22 aa, Mycobacterium
HAIGIGFTLALQADIRVAAEEA

SEQ ID NO: 822336 - protein, 19 aa, Mycobacterium
HAIGRFLGGPERWQRRITA

SEQ ID NO: 822337 - protein, 17 aa, Mycobacterium
HAILIEPLATPVHTVRR

SEQ ID NO: 822338 - protein, 33 aa, Mycobacterium
HAIRAWAVRQPASWALLYGSPVPGYHAPRDRTV

SEQ ID NO: 822339 - protein, 22 aa, Mycobacterium
HAIWWQVYPLGFVGAFPANQPP

SEQ ID NO: 822340 - protein, 22 aa, Mycobacterium
HAIWWQVYPLGSVGAFPASEPP

SEQ ID NO: 822341 - protein, 25 aa, Mycobacterium
HAKDIDLALMRPPVDDPALTAVSLR

SEQ ID NO: 822342 - protein, 25 aa, Mycobacterium
HAKDVFFYEPIILPEKSSREVQLTV

SEQ ID NO: 822343 - protein, 28 aa, Mycobacterium
HAKFGKLPFERLFGPAIAYGRNGFLVSP

SEQ ID NO: 822344 - protein, 21 aa, Mycobacterium
HAKGKLDARARIGHLLDPGTF

SEQ ID NO: 822345 - protein, 22 aa, Mycobacterium
HAKKFRLRRPPVSMQQFLADPR

SEQ ID NO: 822346 - protein, 18 aa, Mycobacterium
HAKKMGLFGYAIPQEWGG

SEQ ID NO: 822347 - protein, 20 aa, Mycobacterium
HAKPDRIPQLADALIRNPDV

SEQ ID NO: 822348 - protein, 23 aa, Mycobacterium
HAKPGYIGYAWTAMEPVNAIPAI

SEQ ID NO: 822349 - protein, 25 aa, Mycobacterium
HAKTLVDGFGIPEPLRYAEMLHPEN

SEQ ID NO: 822350 - protein, 20 aa, Mycobacterium
HALALLLAAARQIPAADASL

SEQ ID NO: 822351 - protein, 18 aa, Mycobacterium
HALARIMLHGRIAQIQTS

SEQ ID NO: 822352 - protein, 23 aa, Mycobacterium
HALARRAALAVACDSLGIAAAML

SEQ ID NO: 822353 - protein, 22 aa, Mycobacterium
HALDPFVALAFAAAATTDVKLL

SEQ ID NO: 822354 - protein, 17 aa, Mycobacterium
HALDYQALSAQMAGVHQ

SEQ ID NO: 822355 - protein, 17 aa, Mycobacterium
HALEFATGQARFVDDIR

SEQ ID NO: 822356 - protein, 18 aa, Mycobacterium
HALGLIKRLHQGLDDTSP

SEQ ID NO: 822357 - protein, 24 aa, Mycobacterium
HALKASIAWRTLRAHLLARGNDHD

SEQ ID NO: 822358 - protein, 23 aa, Mycobacterium
HALLEYATPRLAAIPGVRIVGTA

SEQ ID NO: 822359 - protein, 19 aa, Mycobacterium
HALLKPFTDRYFEAIPGVW

SEQ ID NO: 822360 - protein, 17 aa, Mycobacterium
HALLPDSARRAYDVHPL

SEQ ID NO: 822361 - protein, 21 aa, Mycobacterium
HALLRAAVPHLLKSDNASVIN

SEQ ID NO: 822362 - protein, 27 aa, Mycobacterium
HALNPETFYWAHATFFMLVVKVAEYFC

SEQ ID NO: 822363 - protein, 23 aa, Mycobacterium
HALNPTTFWWAHATFQVMVEQTI

SEQ ID NO: 822364 - protein, 19 aa, Mycobacterium
HALQEFYAAYRAGAPNLTG

SEQ ID NO: 822365 - protein, 18 aa, Mycobacterium
HALQLGVPVLPDAEFMLG

SEQ ID NO: 822366 - protein, 17 aa, Mycobacterium
HALQRDTFRRSMESQLV

SEQ ID NO: 822367 - protein, 20 aa, Mycobacterium
HALRATCELLATGTLPGLPP

SEQ ID NO: 822368 - protein, 26 aa, Mycobacterium
HALRDGAIPLQFLFSGTVFAKSERGF

SEQ ID NO: 822369 - protein, 27 aa, Mycobacterium
HALRDGALPLQFLFSGTIFVKSDRGFF

SEQ ID NO: 822370 - protein, 17 aa, Mycobacterium
HALRLRLGDTKFFALLQ

SEQ ID NO: 822371 - protein, 23 aa, Mycobacterium
HALRREAFRLFDENGYAATTVEQ

SEQ ID NO: 822372 - protein, 22 aa, Mycobacterium
HALRRNINITILLFNNRIYGLT

SEQ ID NO: 822373 - protein, 18 aa, Mycobacterium
HALSIGWLMGRLAKAVTG

SEQ ID NO: 822374 - protein, 19 aa, Mycobacterium
HALVACFAGPAPAGWRIIG

SEQ ID NO: 822375 - protein, 20 aa, Mycobacterium
HALVEWKGNPGLSLLRHMIA

SEQ ID NO: 822376 - protein, 19 aa, Mycobacterium
HALVGMFPGVVPTGWVPIG

SEQ ID NO: 822377 - protein, 19 aa, Mycobacterium
HALVRTRWAHDLVATRSVV

SEQ ID NO: 822378 - protein, 17 aa, Mycobacterium
HALWAWSVEDVEEFWAA

SEQ ID NO: 822379 - protein, 23 aa, Mycobacterium
HAMALLLAAARQIPAADASLREH

SEQ ID NO: 822380 - protein, 25 aa, Mycobacterium
HAMCELEAPDYFRVPKRGKVEILDP

SEQ ID NO: 822381 - protein, 24 aa, Mycobacterium
HAMCELEAPDYFRVPKRGTVEILN

SEQ ID NO: 822382 - protein, 20 aa, Mycobacterium
HAMEERLPFFADMEASQRAS

SEQ ID NO: 822383 - protein, 26 aa, Mycobacterium
HAMHRKILLPHLSAKRVRIIEEFAAQ

SEQ ID NO: 822384 - protein, 20 aa, Mycobacterium
HAMLSALRSVARYFGEQVDP

SEQ ID NO: 822385 - protein, 17 aa, Mycobacterium
HAMRTIGLSRKALDMMC

SEQ ID NO: 822386 - protein, 17 aa, Mycobacterium
HAMTERIRTLPKATIAV

SEQ ID NO: 822387 - protein, 19 aa, Mycobacterium
HAMVWGVGLCLGYGGTSDP

SEQ ID NO: 822388 - protein, 23 aa, Mycobacterium
HANHYLAIFDDGKALALYHTKRL

SEQ ID NO: 822389 - protein, 24 aa, Mycobacterium
HANHYLALFDHGKALALYHSKRLA

SEQ ID NO: 822390 - protein, 22 aa, Mycobacterium
HANIVPWQLISQQTGAVLKVAP

SEQ ID NO: 822391 - protein, 19 aa, Mycobacterium
HANLLFEGFAIEEVFGIQF

SEQ ID NO: 822392 - protein, 17 aa, Mycobacterium
HANLPPEVSGMPAFDAR

SEQ ID NO: 822393 - protein, 21 aa, Mycobacterium
HANLSVLWLPSQGAGSCIDRS

SEQ ID NO: 822394 - protein, 28 aa, Mycobacterium
HANLVPWQELVLRTGATLKWYGVTAEGR

SEQ ID NO: 822395 - protein, 18 aa, Mycobacterium
HANMFGLWLCPLGTDLPD

SEQ ID NO: 822396 - protein, 24 aa, Mycobacterium
HAPDLTTWLTQWDIRGTAPSPEAI

SEQ ID NO: 822397 - protein, 36 aa, Mycobacterium
HAPEAPWVRPPLRSLRWMETFLETLFSYGFDDDAAV

SEQ ID NO: 822398 - protein, 34 aa, Mycobacterium
HAPEVRAWKNDPFKPFLVARTRPVAFQKAVVMKY

SEQ ID NO: 822399 - protein, 20 aa, Mycobacterium
HAPEYFPLDDWGYASLHGDG

SEQ ID NO: 822400 - protein, 23 aa, Mycobacterium
HAPFSLAWMTAVGERTQRLQLGT

SEQ ID NO: 822401 - protein, 23 aa, Mycobacterium
HAPFSLAWMTAVGERTTRLQLGT

SEQ ID NO: 822402 - protein, 25 aa, Mycobacterium
HAPGRWEDSPLYFKEVSLVGSNAFG

SEQ ID NO: 822403 - protein, 19 aa, Mycobacterium
HAPGYFSLDDWGYASLIGD

SEQ ID NO: 822404 - protein, 17 aa, Mycobacterium
HAPKWMRLSGPKMAERI

SEQ ID NO: 822405 - protein, 24 aa, Mycobacterium
HAPLIAPLELLSYAAAVTTRLRLG

SEQ ID NO: 822406 - protein, 17 aa, Mycobacterium
HAPLPDQLFIQANPAKI

SEQ ID NO: 822407 - protein, 18 aa, Mycobacterium
HAPLVALLTELMEAAAEA

SEQ ID NO: 822408 - protein, 18 aa, Mycobacterium
HAPMLRPDQLRRAADLGV

SEQ ID NO: 822409 - protein, 25 aa, Mycobacterium
HAPNTLLKDLLFRTQQRHPEHQITA

SEQ ID NO: 822410 - protein, 17 aa, Mycobacterium
HAPPGIPVDIGPGATVA

SEQ ID NO: 822411 - protein, 33 aa, Mycobacterium
HAPPWAHRFTPASWAAMLAAPAAAGWTPRDLNQ

SEQ ID NO: 822412 - protein, 18 aa, Mycobacterium
HAPPWAPLPVQYIDYTLW

SEQ ID NO: 822413 - protein, 34 aa, Mycobacterium
HAPPYNRRSKAPKRWWWVALTDEPFPRLSAVRDP

SEQ ID NO: 822414 - protein, 25 aa, Mycobacterium
HAPTGAVLLQVRWLCLEGSGDRVDD

SEQ ID NO: 822415 - protein, 31 aa, Mycobacterium
HAPVSWVEVPNYRPFWAITKHADIMDIERDN

SEQ ID NO: 822416 - protein, 23 aa, Mycobacterium
HAQDKLRTVLWGWAGKPVEPELL

SEQ ID NO: 822417 - protein, 22 aa, Mycobacterium
HAQFVPTMFVRMLKLPAKVRDR

SEQ ID NO: 822418 - protein, 27 aa, Mycobacterium
HAQGMAYVRFAIATPLMYRLATVTQPE

SEQ ID NO: 822419 - protein, 17 aa, Mycobacterium
HAQLAMYQLAVAEGLVD

SEQ ID NO: 822420 - protein, 17 aa, Mycobacterium
HAQLDRLTLVSRAFHSD

SEQ ID NO: 822421 - protein, 17 aa, Mycobacterium
HAQLLLSARRMRIPARG

SEQ ID NO: 822422 - protein, 21 aa, Mycobacterium
HAQLPARVQSLLARRAAGVAR

SEQ ID NO: 822423 - protein, 17 aa, Mycobacterium
HAQQAWRDLPVGTVKIN

SEQ ID NO: 822424 - protein, 25 aa, Mycobacterium
HAQRPGDPTLRRLLPDFYKPGETDP

SEQ ID NO: 822425 - protein, 20 aa, Mycobacterium
HAQRRGTWRAAWHEHTRTQQ

SEQ ID NO: 822426 - protein, 28 aa, Mycobacterium
HARAVLAALPENYRRILELRFLQCCSIK

SEQ ID NO: 822427 - protein, 39 aa, Mycobacterium
HARAYQALSVQAGQFHQWFTQTLSGAGLSYASAEAANVS

SEQ ID NO: 822428 - protein, 17 aa, Mycobacterium
HARCPLAWTDTYGGHWV

SEQ ID NO: 822429 - protein, 29 aa, Mycobacterium
HARDAVVVHPTWWTPNRVTRLRDIATTCG

SEQ ID NO: 822430 - protein, 18 aa, Mycobacterium
HAREKLRRKGCDLLVVNA

SEQ ID NO: 822431 - protein, 18 aa, Mycobacterium
HARELFGAPYAYAQPHSG

SEQ ID NO: 822432 - protein, 20 aa, Mycobacterium
HARELFGAPYAYAQPHSGID

SEQ ID NO: 822433 - protein, 17 aa, Mycobacterium
HARELFGAPYAYVQPHS

SEQ ID NO: 822434 - protein, 33 aa, Mycobacterium
HARFSKIFDVNLWAPLLWTSLAVKGWMGEHGGV

SEQ ID NO: 822435 - protein, 32 aa, Mycobacterium
HARFTKIFDVNLWAPLLWTSLAVKSWMGEHGG

SEQ ID NO: 822436 - protein, 33 aa, Mycobacterium
HARFTKIFDVNLWAPLLWTSLVVKSWMGEHGGA

SEQ ID NO: 822437 - protein, 34 aa, Mycobacterium
HARFTKIFDVNLWAPLMWTSLVVKAWMGEHGGVV

SEQ ID NO: 822438 - protein, 26 aa, Mycobacterium
HARGQGLARMSLLGTFSPYAVVHQDS

SEQ ID NO: 822439 - protein, 28 aa, Mycobacterium
HARGVRLQCPLLLLWGAEGALASADVLG

SEQ ID NO: 822440 - protein, 17 aa, Mycobacterium
HARHYLAVFDKGKALAL

SEQ ID NO: 822441 - protein, 17 aa, Mycobacterium
HARKVPGAVVVVSIFVN

SEQ ID NO: 822442 - protein, 26 aa, Mycobacterium
HARLAPRPPAWIHGTGWRTETGHFAG

SEQ ID NO: 822443 - protein, 18 aa, Mycobacterium
HARLGTAAVCWRLRRRYG

SEQ ID NO: 822444 - protein, 20 aa, Mycobacterium
HARLLGFYRDLITLRRSESD

SEQ ID NO: 822445 - protein, 19 aa, Mycobacterium
HARLRKKIAGTPERPRLVV

SEQ ID NO: 822446 - protein, 29 aa, Mycobacterium
HARLVNAMPFLFRGPMLWIAALVGEEIFD

SEQ ID NO: 822447 - protein, 29 aa, Mycobacterium
HARMNGVDHLWLHPVLVGRDRWHEIQTPG

SEQ ID NO: 822448 - protein, 18 aa, Mycobacterium
HARQKLRRKSCDLLVVNA

SEQ ID NO: 822449 - protein, 24 aa, Mycobacterium
HARRDVHMYPYSARRTRILGRLVG

SEQ ID NO: 822450 - protein, 17 aa, Mycobacterium
HARRLRDAFPHAALIEI

SEQ ID NO: 822451 - protein, 27 aa, Mycobacterium
HARRRFDWGVPLGVEVPLLASAVARTN

SEQ ID NO: 822452 - protein, 17 aa, Mycobacterium
HARRYDHVAQRFGEAGL

SEQ ID NO: 822453 - protein, 18 aa, Mycobacterium
HARSYQALTAQAATFLEE

SEQ ID NO: 822454 - protein, 29 aa, Mycobacterium
HARTAWSAEGLLVYLPPEAQDRLFDNIVA

SEQ ID NO: 822455 - protein, 23 aa, Mycobacterium
HARTKAMMLADPDSWHALMEKLT

SEQ ID NO: 822456 - protein, 25 aa, Mycobacterium
HARTLRRLRAVLTAARRSDASGADP

SEQ ID NO: 822457 - protein, 31 aa, Mycobacterium
HARVGILPTWGLTTLLPLSVGRGLARRMSLT

SEQ ID NO: 822458 - protein, 26 aa, Mycobacterium
HASHRKLLLPHLSAKRIRVIEQFAEV

SEQ ID NO: 822459 - protein, 25 aa, Mycobacterium
HASKAHLLQIARRLDIRGRSTMNKG

SEQ ID NO: 822460 - protein, 23 aa, Mycobacterium
HASPLLVSVFLDKDFTFTVSTEA

SEQ ID NO: 822461 - protein, 19 aa, Mycobacterium
HASWLNQVEIYFSILQRKA

SEQ ID NO: 822462 - protein, 17 aa, Mycobacterium
HATALWRYALRLTGDPA

SEQ ID NO: 822463 - protein, 28 aa, Mycobacterium
HATELFAVFGLFKRWPALAGKKDRRHAL

SEQ ID NO: 822464 - protein, 28 aa, Mycobacterium
HATGYLVLDQPWPAMLRGIWGDPERFKE

SEQ ID NO: 822465 - protein, 40 aa, Mycobacterium
HATIAGLRYIVYGAAPMPLPLLHRALSTWPDTRFVQVYGQ

SEQ ID NO: 822466 - protein, 28 aa, Mycobacterium
HATIPPNLHFSQWNPGIDAAPTRFFVPT

SEQ ID NO: 822467 - protein, 18 aa, Mycobacterium
HATLTCDPAAPLLAEVVK

SEQ ID NO: 822468 - protein, 17 aa, Mycobacterium
HATLVDHLIPPMARAET

SEQ ID NO: 822469 - protein, 18 aa, Mycobacterium
HATLVDHLIPPMARAETY

SEQ ID NO: 822470 - protein, 28 aa, Mycobacterium
HATPSQLALAWLLKRSPVMLPIPGTSRV

SEQ ID NO: 822471 - protein, 28 aa, Mycobacterium
HATTATVTWFLPYFQEVVSGPTVGGIVS

SEQ ID NO: 822472 - protein, 29 aa, Mycobacterium
HAVADMLAAVFWGLGFHARMLTADIGVDG

SEQ ID NO: 822473 - protein, 29 aa, Mycobacterium
HAVAEAFVDGQWRVVDATLLAPRQSLVRI

SEQ ID NO: 822474 - protein, 28 aa, Mycobacterium
HAVAEAFVEGQWRVVDATLLAPRQTLVR

SEQ ID NO: 822475 - protein, 17 aa, Mycobacterium
HAVAFVKFSTSLGQVIC

SEQ ID NO: 822476 - protein, 17 aa, Mycobacterium
HAVALIAERARVLGEAV

SEQ ID NO: 822477 - protein, 19 aa, Mycobacterium
HAVALLWSMRHIYDIAPGE

SEQ ID NO: 822478 - protein, 18 aa, Mycobacterium
HAVALQIAALKARYLSRD

SEQ ID NO: 822479 - protein, 21 aa, Mycobacterium
HAVCRRHGALLLVDEAHGLGV

SEQ ID NO: 822480 - protein, 29 aa, Mycobacterium
HAVDPALPVLGLAGSVFFGAAEELGLRTV

SEQ ID NO: 822481 - protein, 31 aa, Mycobacterium
HAVEILTRMYGLARPIAVEAYGLFIFRDCIE

SEQ ID NO: 822482 - protein, 18 aa, Mycobacterium
HAVFIRAPWVERVGPGVE

SEQ ID NO: 822483 - protein, 24 aa, Mycobacterium
HAVHRKLLVRHLAARRIRSLERFV

SEQ ID NO: 822484 - protein, 17 aa, Mycobacterium
HAVIDFSLGLQSISRRR

SEQ ID NO: 822485 - protein, 25 aa, Mycobacterium
HAVKLWEHWDRCALHWFPGSHVLHV

SEQ ID NO: 822486 - protein, 19 aa, Mycobacterium
HAVKPFVDTVIRDEWLPAM

SEQ ID NO: 822487 - protein, 26 aa, Mycobacterium
HAVNAPTQTLLGRPLIGNGADATTPG

SEQ ID NO: 822488 - protein, 26 aa, Mycobacterium
HAVNLLRLKAFFSRQWQQMPAAHFMT

SEQ ID NO: 822489 - protein, 22 aa, Mycobacterium
HAVPASVRRALVARLDRFGIAH

SEQ ID NO: 822490 - protein, 31 aa, Mycobacterium
HAVPLFGFTGCHGLMLLSIRAGVTQIVLPRF

SEQ ID NO: 822491 - protein, 26 aa, Mycobacterium
HAVQAPWPLLRTFAAGPALSREAALL

SEQ ID NO: 822492 - protein, 39 aa, Mycobacterium
HAVTHAFNRWLLDDWTFNYQDRIFPVPAISLNDPALGVQ

SEQ ID NO: 822493 - protein, 25 aa, Mycobacterium
HAVTLWEHWDHCALHWFPGSHIMHV

SEQ ID NO: 822494 - protein, 29 aa, Mycobacterium
HAVTYNAFFAAAAAPPILIGDPARQHGPI

SEQ ID NO: 822495 - protein, 25 aa, Mycobacterium
HAVWALMDYGFRVVLSSRFGDIFRG

SEQ ID NO: 822496 - protein, 20 aa, Mycobacterium
HAVWDIRALLGWIRAENPGA

SEQ ID NO: 822497 - protein, 19 aa, Mycobacterium
HAWGLKYDALVGGRAGGAG

SEQ ID NO: 822498 - protein, 25 aa, Mycobacterium
HAWIQAWTGAWWNYDPTHDTEITEQ

SEQ ID NO: 822499 - protein, 17 aa, Mycobacterium
HAWMTLPAAERIAEIRD

SEQ ID NO: 822500 - protein, 24 aa, Mycobacterium
HAWSDVAVFPILGMDWHQYEQQGH

SEQ ID NO: 822501 - protein, 24 aa, Mycobacterium
HAWSFAFDAAWQPLVALLDGHGVH

SEQ ID NO: 822502 - protein, 24 aa, Mycobacterium
HAWSFGFDAAWQPLVALLDGHGVH

SEQ ID NO: 822503 - protein, 24 aa, Mycobacterium
HAWSFTFDAAWQPLVALLDGHANH

SEQ ID NO: 822504 - protein, 25 aa, Mycobacterium
HAYAGELLFLYNGVRPRNVMPVHGT

SEQ ID NO: 822505 - protein, 29 aa, Mycobacterium
HAYAGELLFLYNGVRPRNVMPVHGTWRHL

SEQ ID NO: 822506 - protein, 30 aa, Mycobacterium
HAYAGELLYLYNAVRPRNVMPVHGTWRHLR

SEQ ID NO: 822507 - protein, 23 aa, Mycobacterium
HAYARVWLAELKDRRIRVNVLTP

SEQ ID NO: 822508 - protein, 21 aa, Mycobacterium
HAYRATAILELCGEDDPAVDE

SEQ ID NO: 822509 - protein, 43 aa, Mycobacterium
HAYSGELLFLYNGVRPRHVMPVHGTWRMLRANAKLAAGTGVPE

SEQ ID NO: 822510 - protein, 29 aa, Mycobacterium
HAYSTKPLSGLIFPGWDTAAESPPPPAQA

SEQ ID NO: 822511 - protein, 36 aa, Mycobacterium
HAYTLKEPFGVVGLIFPWNGPIFNASAKLAPALAAG

SEQ ID NO: 822512 - protein, 19 aa, Mycobacterium
HAYVKLRRDGTDVETWPQL

SEQ ID NO: 822513 - protein, 35 aa, Mycobacterium
HCDPYVEGKPWPYAPRVILKNLIQQAADAGFEPWV

SEQ ID NO: 822514 - protein, 23 aa, Mycobacterium
HCFDLTVEIPLRASLFRVTDDEH

SEQ ID NO: 822515 - protein, 19 aa, Mycobacterium
HCFELDRELPLRVAVLHTA

SEQ ID NO: 822516 - protein, 22 aa, Mycobacterium
HCGERWFIFNAGMGLDGEVVAA

SEQ ID NO: 822517 - protein, 22 aa, Mycobacterium
HCGSAILQPSISMGISCLGATA

SEQ ID NO: 822518 - protein, 18 aa, Mycobacterium
HCGVWPGSHAREFDDLDA

SEQ ID NO: 822519 - protein, 22 aa, Mycobacterium
HCGWPSFFDPADSDAVILRPDD

SEQ ID NO: 822520 - protein, 22 aa, Mycobacterium
HCGWPSFFDPADSDAVILRTDD

SEQ ID NO: 822521 - protein, 25 aa, Mycobacterium
HCIDLPLLFGDEAAWRNAPMLSPPG

SEQ ID NO: 822522 - protein, 24 aa, Mycobacterium
HCLGAGLELPLGCTFRLAAAEGAS

SEQ ID NO: 822523 - protein, 18 aa, Mycobacterium
HCLGAPLARMEMAIAFPA

SEQ ID NO: 822524 - protein, 20 aa, Mycobacterium
HCLLDLLWRNRRGELPMSVV

SEQ ID NO: 822525 - protein, 25 aa, Mycobacterium
HCPSSPVLPGIVWYSAETQPEGWVR

SEQ ID NO: 822526 - protein, 23 aa, Mycobacterium
HCRQCLAARLRWQRGAGLGEIYS

SEQ ID NO: 822527 - protein, 25 aa, Mycobacterium
HCRTCGADFTLGDLILLCPCGSADV

SEQ ID NO: 822528 - protein, 25 aa, Mycobacterium
HCRTCHRLFELHDPILLCPCGSADV

SEQ ID NO: 822529 - protein, 19 aa, Mycobacterium
HCSAFHPLGVGSPFWNEID

SEQ ID NO: 822530 - protein, 19 aa, Mycobacterium
HCSAFHPLGVGSPFWQEID

SEQ ID NO: 822531 - protein, 25 aa, Mycobacterium
HCSAFHPLGVGSPLWREIDLQRHGL

SEQ ID NO: 822532 - protein, 19 aa, Mycobacterium
HCSDRVWRLTHGNVLFMRQ

SEQ ID NO: 822533 - protein, 17 aa, Mycobacterium
HCVNGQVPSLSYPGGYA

SEQ ID NO: 822534 - protein, 19 aa, Mycobacterium
HCWFERNGWGFRVYPALDC

SEQ ID NO: 822535 - protein, 36 aa, Mycobacterium
HCYGIAWRLAVLGLRRGEILALRWDAVDFDAGTLAI

SEQ ID NO: 822536 - protein, 18 aa, Mycobacterium
HCYLAYLDVVLAVAEQDP

SEQ ID NO: 822537 - protein, 17 aa, Mycobacterium
HDAARALTPPTLITRVV

SEQ ID NO: 822538 - protein, 43 aa, Mycobacterium
HDADFVIEPLPNLLFTRDSSIWIGPRFVIPSLAMRARVREASL

SEQ ID NO: 822539 - protein, 17 aa, Mycobacterium
HDADWLLTFVRTDPDAP

SEQ ID NO: 822540 - protein, 22 aa, Mycobacterium
HDAEQYFVLAVPHPAGGPPHLL

SEQ ID NO: 822541 - protein, 17 aa, Mycobacterium
HDAFFCVVDLHAITLPQ

SEQ ID NO: 822542 - protein, 32 aa, Mycobacterium
HDAGDPLHPKPVYLFAYDPTAFGGKGRAAIAI

SEQ ID NO: 822543 - protein, 25 aa, Mycobacterium
HDAHLYLRRAHAIGRFLGGAERWLR

SEQ ID NO: 822544 - protein, 21 aa, Mycobacterium
HDAIAALPKIRRAHPGTVLAV

SEQ ID NO: 822545 - protein, 25 aa, Mycobacterium
HDAIGRFAVRLDVSRLLVVGSGRAM

SEQ ID NO: 822546 - protein, 27 aa, Mycobacterium
HDALPAPLTFICIFGYQAQSAFFDHAD

SEQ ID NO: 822547 - protein, 27 aa, Mycobacterium
HDAPITLMHVIAPVVVSWPAGPYMATV

SEQ ID NO: 822548 - protein, 24 aa, Mycobacterium
HDASMAWQAILHERGWAAPAWPVA

SEQ ID NO: 822549 - protein, 17 aa, Mycobacterium
HDATLYYTVLGASLDED

SEQ ID NO: 822550 - protein, 24 aa, Mycobacterium
HDATPEFAWGLLIATVRNLAEEHR

SEQ ID NO: 822551 - protein, 17 aa, Mycobacterium
HDAVLIHPFDHPDVIAG

SEQ ID NO: 822552 - protein, 26 aa, Mycobacterium
HDDAPPRLFLSRYAKATAPKPAPPLP

SEQ ID NO: 822553 - protein, 25 aa, Mycobacterium
HDDDQLVLDLLLNEKILLTQGTGFN

SEQ ID NO: 822554 - protein, 26 aa, Mycobacterium
HDDEQLVLDLLLQEKILLTQGTGFNW

SEQ ID NO: 822555 - protein, 27 aa, Mycobacterium
HDDFAARHPWFSYRRLGGETHFPGIEL

SEQ ID NO: 822556 - protein, 17 aa, Mycobacterium
HDDLFDFFYEALPGYEQ

SEQ ID NO: 822557 - protein, 17 aa, Mycobacterium
HDDLYPFVLPPAVLEKM

SEQ ID NO: 822558 - protein, 25 aa, Mycobacterium
HDDPGEALSPKWQKMWKPVVCAVQG

SEQ ID NO: 822559 - protein, 26 aa, Mycobacterium
HDDPWWSRAVFYQIYPRSFGDSDGDG

SEQ ID NO: 822560 - protein, 17 aa, Mycobacterium
HDDQAHVDLLWSLSRAA

SEQ ID NO: 822561 - protein, 23 aa, Mycobacterium
HDDQAHVDLLWSLSRAPDADAAL

SEQ ID NO: 822562 - protein, 22 aa, Mycobacterium
HDDVAFRYLAANTAPDFRSIAR

SEQ ID NO: 822563 - protein, 17 aa, Mycobacterium
HDDVLIIRVTPGCYFPA

SEQ ID NO: 822564 - protein, 26 aa, Mycobacterium
HDDVPFPAPVSLVAGGIWLWGDVAGW

SEQ ID NO: 822565 - protein, 18 aa, Mycobacterium
HDEAIRDWLRAVHPNTRF

SEQ ID NO: 822566 - protein, 26 aa, Mycobacterium
HDEFRPLKALAARMACPYANPGRFVS

SEQ ID NO: 822567 - protein, 25 aa, Mycobacterium
HDEIIRQYAPLLHLALRSTTATARR

SEQ ID NO: 822568 - protein, 24 aa, Mycobacterium
HDEIYPGPDGILRSTNRAGGLEGG

SEQ ID NO: 822569 - protein, 26 aa, Mycobacterium
HDELERLILTLPPGPRQREGGPSAWL

SEQ ID NO: 822570 - protein, 20 aa, Mycobacterium
HDELGLRWPGSVAPFAVHVV

SEQ ID NO: 822571 - protein, 19 aa, Mycobacterium
HDELGSIPGVTGVDVDLSS

SEQ ID NO: 822572 - protein, 23 aa, Mycobacterium
HDELLRFEKTLTAIWRAIQTAGR

SEQ ID NO: 822573 - protein, 28 aa, Mycobacterium
HDELRDAGAFRLLTPRELGGWAAPLPTA

SEQ ID NO: 822574 - protein, 29 aa, Mycobacterium
HDELRRRGENIGLTTVYRTLQSMAAAGMV

SEQ ID NO: 822575 - protein, 30 aa, Mycobacterium
HDELRRRGENIGLTTVYRTLQSMAAAGVVD

SEQ ID NO: 822576 - protein, 29 aa, Mycobacterium
HDELRRRGENIGLTTVYRTLQSMASAGTV

SEQ ID NO: 822577 - protein, 25 aa, Mycobacterium
HDELVLIKEIPLYSTCEHHLVSFHG

SEQ ID NO: 822578 - protein, 22 aa, Mycobacterium
HDELVLVKQIPMYSTCEHHLVS

SEQ ID NO: 822579 - protein, 22 aa, Mycobacterium
HDELVLVKSIPMYSTCEHHLVS

SEQ ID NO: 822580 - protein, 31 aa, Mycobacterium
HDEQIDGPLPRRLLVLALTLSGEQPIVAART

SEQ ID NO: 822581 - protein, 29 aa, Mycobacterium
HDETAGLWTLLKVPTLIACGDHDLLTPDE

SEQ ID NO: 822582 - protein, 25 aa, Mycobacterium
HDETAGLWTLLRVPTLIACGDHDLL

SEQ ID NO: 822583 - protein, 17 aa, Mycobacterium
HDEVLTKPPQRPAYVAK

SEQ ID NO: 822584 - protein, 17 aa, Mycobacterium
HDFGTGAAALPAAYQAA

SEQ ID NO: 822585 - protein, 35 aa, Mycobacterium
HDFQRTIDINYLGPIWLLLGLLPAMREAGRGHIVN

SEQ ID NO: 822586 - protein, 35 aa, Mycobacterium
HDFQRTIDINYLGPIWLLLGLLPAMRESGRGHVVN

SEQ ID NO: 822587 - protein, 17 aa, Mycobacterium
HDFTYYLRGLVPDEKIA

SEQ ID NO: 822588 - protein, 22 aa, Mycobacterium
HDGELFITGRVKDLVIIDGRNH

SEQ ID NO: 822589 - protein, 22 aa, Mycobacterium
HDGFAMLGPYSATKFAVRALTQ

SEQ ID NO: 822590 - protein, 25 aa, Mycobacterium
HDGGLVSTYLCDHARRGMVVGLAGV

SEQ ID NO: 822591 - protein, 25 aa, Mycobacterium
HDGHPRHQLLLQRLGLGRTGAEHLA

SEQ ID NO: 822592 - protein, 21 aa, Mycobacterium
HDGLKAVLRRTLESGQLGSHN

SEQ ID NO: 822593 - protein, 17 aa, Mycobacterium
HDGLRWYKTGDLARYWP

SEQ ID NO: 822594 - protein, 18 aa, Mycobacterium
HDGPMGRYPVLFLDPDFN

SEQ ID NO: 822595 - protein, 24 aa, Mycobacterium
HDGRWKFSRRTIVADWAYQNDPSR

SEQ ID NO: 822596 - protein, 17 aa, Mycobacterium
HDGSHLTFPSLAQGIEL

SEQ ID NO: 822597 - protein, 24 aa, Mycobacterium
HDGVPLYLELPVTVELLVAHTEPG

SEQ ID NO: 822598 - protein, 19 aa, Mycobacterium
HDHKVNLLFFTGDAMARPL

SEQ ID NO: 822599 - protein, 20 aa, Mycobacterium
HDHKVNLLFFTGDAMARPLL

SEQ ID NO: 822600 - protein, 24 aa, Mycobacterium
HDHLPVWIYVLGRMYTNPLVGRYS

SEQ ID NO: 822601 - protein, 33 aa, Mycobacterium
HDHPHAVRILARAWLYIIWHCWQDNTTYDPAHH

SEQ ID NO: 822602 - protein, 24 aa, Mycobacterium
HDHVIQRLFAVGLALQAAVPRARV

SEQ ID NO: 822603 - protein, 24 aa, Mycobacterium
HDHVIQRLFAVGLSLQGTIPRARS

SEQ ID NO: 822604 - protein, 17 aa, Mycobacterium
HDIARLHSSSFVRGFTT

SEQ ID NO: 822605 - protein, 26 aa, Mycobacterium
HDICSAVHPLALASPFFAAFDLRARG

SEQ ID NO: 822606 - protein, 25 aa, Mycobacterium
HDICSAVHPLALASPFFSAYDLTAH

SEQ ID NO: 822607 - protein, 22 aa, Mycobacterium
HDIDVFRNWSEASSDDRAGAVL

SEQ ID NO: 822608 - protein, 25 aa, Mycobacterium
HDIETVWFGAAAPLALLGPLARRAG

SEQ ID NO: 822609 - protein, 20 aa, Mycobacterium
HDIGAIIEWISSVMTLLPGD

SEQ ID NO: 822610 - protein, 25 aa, Mycobacterium
HDIGVMVYGPLAHGLLTGTMKPDTS

SEQ ID NO: 822611 - protein, 18 aa, Mycobacterium
HDIGYAPSVRRTGFHPLD

SEQ ID NO: 822612 - protein, 20 aa, Mycobacterium
HDIHRRLLSRVFTPRRMLAV

SEQ ID NO: 822613 - protein, 21 aa, Mycobacterium
HDILAFERQWWKYAGSKEDAI

SEQ ID NO: 822614 - protein, 18 aa, Mycobacterium
HDILLPGGALDRPGLAAK

SEQ ID NO: 822615 - protein, 22 aa, Mycobacterium
HDIPRLVELYSAGLLKLDELVT

SEQ ID NO: 822616 - protein, 26 aa, Mycobacterium
HDIQPWVTLYHWDLPQTLEDAGGWPA

SEQ ID NO: 822617 - protein, 19 aa, Mycobacterium
HDIRHYWDKHMCASFMVDP

SEQ ID NO: 822618 - protein, 17 aa, Mycobacterium
HDIVDRPVLCKTFVHPA

SEQ ID NO: 822619 - protein, 19 aa, Mycobacterium
HDIYGFDVPVGVILGPATD

SEQ ID NO: 822620 - protein, 18 aa, Mycobacterium
HDKKLWHRLCAELELPAL

SEQ ID NO: 822621 - protein, 17 aa, Mycobacterium
HDKLSWDAWRNEDNRWT

SEQ ID NO: 822622 - protein, 26 aa, Mycobacterium
HDLARGLFQAGPWHRAAPLRLFGHSM

SEQ ID NO: 822623 - protein, 34 aa, Mycobacterium
HDLGRRSIALRLLRSRFFTDYGAYWPGAAVHESG

SEQ ID NO: 822624 - protein, 23 aa, Mycobacterium
HDLIPLMTNLRRVARRLIIEEDT

SEQ ID NO: 822625 - protein, 23 aa, Mycobacterium
HDLKDWFTFLGGRGLDWQSVSLE

SEQ ID NO: 822626 - protein, 22 aa, Mycobacterium
HDLKDWFVFLDARSLNWREVRL

SEQ ID NO: 822627 - protein, 21 aa, Mycobacterium
HDLKFHDMLLLDDATPVWVSA

SEQ ID NO: 822628 - protein, 21 aa, Mycobacterium
HDLLDVCTLADRVLILEAGRI

SEQ ID NO: 822629 - protein, 18 aa, Mycobacterium
HDLNNMGVRFRWAGQKTR

SEQ ID NO: 822630 - protein, 22 aa, Mycobacterium
HDLPEPLWDGLISVLMSNFARA

SEQ ID NO: 822631 - protein, 18 aa, Mycobacterium
HDLRHVVHPVRTACAAGA

SEQ ID NO: 822632 - protein, 26 aa, Mycobacterium
HDLSDRLWSARLLADAPREIVAVHAA

SEQ ID NO: 822633 - protein, 23 aa, Mycobacterium
HDLSSLRYIMWCATPVTQSVAEA

SEQ ID NO: 822634 - protein, 26 aa, Mycobacterium
HDLVEFLLRVLLSFFVAPNVPSRSDD

SEQ ID NO: 822635 - protein, 18 aa, Mycobacterium
HDLYRNRLLPTLLDKHGV

SEQ ID NO: 822636 - protein, 36 aa, Mycobacterium
HDMALTRRYAIFVVSPLRINPWALVGHQSYWDSIFF

SEQ ID NO: 822637 - protein, 36 aa, Mycobacterium
HDMFDAALLLGVCDKIVPGMLIGALSFGHLPAIFVP

SEQ ID NO: 822638 - protein, 20 aa, Mycobacterium
HDMNPFPLNALGCLIRSITL

SEQ ID NO: 822639 - protein, 21 aa, Mycobacterium
HDMNPFPLNALGCLIRSITLR

SEQ ID NO: 822640 - protein, 27 aa, Mycobacterium
HDNDIVLVDFWASWCGPCRQFGPVFEA

SEQ ID NO: 822641 - protein, 24 aa, Mycobacterium
HDNKRLRVRFMTDRLVFESQMDKE

SEQ ID NO: 822642 - protein, 18 aa, Mycobacterium
HDNLIAPLTFLAVAGRRV

SEQ ID NO: 822643 - protein, 19 aa, Mycobacterium
HDNMDFGFIANAAAIEDPT

SEQ ID NO: 822644 - protein, 24 aa, Mycobacterium
HDPAARIGVFRHVIRPLLQHAETA

SEQ ID NO: 822645 - protein, 24 aa, Mycobacterium
HDPAIIAAYHADPLVHHGRVPAGI

SEQ ID NO: 822646 - protein, 17 aa, Mycobacterium
HDPALLKRYVTTIVKGM

SEQ ID NO: 822647 - protein, 29 aa, Mycobacterium
HDPDLPPSHHYLAAYRWLSASRDEGGFGA

SEQ ID NO: 822648 - protein, 20 aa, Mycobacterium
HDPEREPVFSEYLELDLSTV

SEQ ID NO: 822649 - protein, 25 aa, Mycobacterium
HDPHARLFLHYGDLTDGTRLVTLLS

SEQ ID NO: 822650 - protein, 24 aa, Mycobacterium
HDPHGRRHASPSWLSMVHGEGAAL

SEQ ID NO: 822651 - protein, 19 aa, Mycobacterium
HDPHHLILGDRYGTRHPVP

SEQ ID NO: 822652 - protein, 19 aa, Mycobacterium
HDPPASWKNQVRGLLRAIS

SEQ ID NO: 822653 - protein, 21 aa, Mycobacterium
HDPREDGLLPDVYIAMGQTAE

SEQ ID NO: 822654 - protein, 17 aa, Mycobacterium
HDPSDTTWLGRDRFVLS

SEQ ID NO: 822655 - protein, 19 aa, Mycobacterium
HDPTPPGPADHGREGGMAT

SEQ ID NO: 822656 - protein, 35 aa, Mycobacterium
HDPTQWPLNLGSERDWCFVSQPSAHLKGRSVLLSM

SEQ ID NO: 822657 - protein, 25 aa, Mycobacterium
HDPWSPDAMVWPLLAVIDDCLAEPW

SEQ ID NO: 822658 - protein, 24 aa, Mycobacterium
HDPYEAVIAAAQWVRSELDYVPGT

SEQ ID NO: 822659 - protein, 22 aa, Mycobacterium
HDQLFDTVFVYENYPIDTAALL

SEQ ID NO: 822660 - protein, 20 aa, Mycobacterium
HDQLPDWPTIPRGKLTLKGF

SEQ ID NO: 822661 - protein, 20 aa, Mycobacterium
HDQLWRVAALRDAGVPVALS

SEQ ID NO: 822662 - protein, 23 aa, Mycobacterium
HDQMRLALLLCAVRPEIGGVLIR

SEQ ID NO: 822663 - protein, 22 aa, Mycobacterium
HDQQLLYIPGRIVHHAAATYRG

SEQ ID NO: 822664 - protein, 18 aa, Mycobacterium
HDQTLRLLNQGYTGIEIA

SEQ ID NO: 822665 - protein, 18 aa, Mycobacterium
HDQTLRLLNQGYTGVEIA

SEQ ID NO: 822666 - protein, 18 aa, Mycobacterium
HDRAGWLALMSDDVVIED

SEQ ID NO: 822667 - protein, 25 aa, Mycobacterium
HDREWPTAIGWYLPDQEPPWGALEE

SEQ ID NO: 822668 - protein, 18 aa, Mycobacterium
HDRFACVDGKWRFSYRDL

SEQ ID NO: 822669 - protein, 18 aa, Mycobacterium
HDRFSMHSFGAVFAEVAV

SEQ ID NO: 822670 - protein, 24 aa, Mycobacterium
HDRFTLDRILAEEAALLQLVDAQD

SEQ ID NO: 822671 - protein, 43 aa, Mycobacterium
HDRGQIYVVPQLDAKILWQLKRALPGQFTRALGLVERVASWND

SEQ ID NO: 822672 - protein, 22 aa, Mycobacterium
HDRGRLLARERIELLLDRDAPF

SEQ ID NO: 822673 - protein, 33 aa, Mycobacterium
HDRHRPSRQPAPLFHVHKLFFLCHERGRVPADL

SEQ ID NO: 822674 - protein, 24 aa, Mycobacterium
HDRKRWWTGLPEPAALALADACTP

SEQ ID NO: 822675 - protein, 30 aa, Mycobacterium
HDRKVGLLLQDPLLFPHMSVGANVAFGPHH

SEQ ID NO: 822676 - protein, 21 aa, Mycobacterium
HDRLGIYWPVTDRGAPIYIHS

SEQ ID NO: 822677 - protein, 30 aa, Mycobacterium
HDRLTIHDYLWRWDTDWFWCSRAFGAQHPV

SEQ ID NO: 822678 - protein, 23 aa, Mycobacterium
HDRPTFALPNRDYHLAHGPLAAL

SEQ ID NO: 822679 - protein, 37 aa, Mycobacterium
HDRQHYKLIGWRHNVCGYRRFFSITSLAGIRQEDRAV

SEQ ID NO: 822680 - protein, 23 aa, Mycobacterium
HDRRVKLLAAVWGAVLITAMDDL

SEQ ID NO: 822681 - protein, 24 aa, Mycobacterium
HDRSYRLYEPAKMPASAPLVVVLH

SEQ ID NO: 822682 - protein, 24 aa, Mycobacterium
HDRYHGEFFLNHCGSLLNLEPMGA

SEQ ID NO: 822683 - protein, 24 aa, Mycobacterium
HDRYLIERVCDSTWALFGDGKLTN

SEQ ID NO: 822684 - protein, 21 aa, Mycobacterium
HDSRLPVLLGIDGSPASEVAT

SEQ ID NO: 822685 - protein, 29 aa, Mycobacterium
HDSYLVDWSGIPYLRFLASNVGRGQPLAH

SEQ ID NO: 822686 - protein, 29 aa, Mycobacterium
HDSYLVDWSGLPYLRFLAANVGRGQPLVH

SEQ ID NO: 822687 - protein, 18 aa, Mycobacterium
HDTFLAAEYAHPGDNIPP

SEQ ID NO: 822688 - protein, 23 aa, Mycobacterium
HDTFRSWFERTDDGEFIRHSISD

SEQ ID NO: 822689 - protein, 19 aa, Mycobacterium
HDTGRVRRPRIFRRSTMQA

SEQ ID NO: 822690 - protein, 20 aa, Mycobacterium
HDTLFTADGWMRMGDLCEID

SEQ ID NO: 822691 - protein, 18 aa, Mycobacterium
HDTMGEVRVPKDALWRAQ

SEQ ID NO: 822692 - protein, 26 aa, Mycobacterium
HDTVSAIAWIGYDPPQVPGFDDIGKS

SEQ ID NO: 822693 - protein, 24 aa, Mycobacterium
HDTWAQYLRWVADRAGLEVVGGEV

SEQ ID NO: 822694 - protein, 18 aa, Mycobacterium
HDTYRSWFEYLDADHIVR

SEQ ID NO: 822695 - protein, 17 aa, Mycobacterium
HDVALSHSAAVLSEIAL

SEQ ID NO: 822696 - protein, 23 aa, Mycobacterium
HDVARLLATVEAQLPPLAGIVHA

SEQ ID NO: 822697 - protein, 20 aa, Mycobacterium
HDVAVVLGSGWRPAADALGP

SEQ ID NO: 822698 - protein, 22 aa, Mycobacterium
HDVDRLSAFFDLVQQDPIVSQV

SEQ ID NO: 822699 - protein, 25 aa, Mycobacterium
HDVEFFNEFYALDIALTETPAGPVA

SEQ ID NO: 822700 - protein, 25 aa, Mycobacterium
HDVEFFNEFYALDIALTETPNGPVA

SEQ ID NO: 822701 - protein, 22 aa, Mycobacterium
HDVEFFNEFYALDITMTETPSG

SEQ ID NO: 822702 - protein, 25 aa, Mycobacterium
HDVEFFNEFYALDLALTETPSGPVA

SEQ ID NO: 822703 - protein, 21 aa, Mycobacterium
HDVFRRNIWVSPFWEGCVADV

SEQ ID NO: 822704 - protein, 31 aa, Mycobacterium
HDVGLAILGPLRELDEVAYLRFASVYRSFSS

SEQ ID NO: 822705 - protein, 18 aa, Mycobacterium
HDVHHRLSPIEAARLGRD

SEQ ID NO: 822706 - protein, 18 aa, Mycobacterium
HDVHLYVRRAWQGAALLG

SEQ ID NO: 822707 - protein, 22 aa, Mycobacterium
HDVIVLGLARGGIPVAWEVAAA

SEQ ID NO: 822708 - protein, 20 aa, Mycobacterium
HDVLLLRPLGLKPDRPREDP

SEQ ID NO: 822709 - protein, 19 aa, Mycobacterium
HDVLLPLVDVLVTNGGYGA

SEQ ID NO: 822710 - protein, 17 aa, Mycobacterium
HDVLRQRDYWAEQVSGA

SEQ ID NO: 822711 - protein, 24 aa, Mycobacterium
HDVRGFPWPRLLTGDLNLTPAAVR

SEQ ID NO: 822712 - protein, 24 aa, Mycobacterium
HDVRYYWDTHMSASFMVDPLGLQL

SEQ ID NO: 822713 - protein, 26 aa, Mycobacterium
HDVSELLPELTLAQKWDLTATELARN

SEQ ID NO: 822714 - protein, 27 aa, Mycobacterium
HDVSRSWLYFGLIRLGIGRLQEANTCW

SEQ ID NO: 822715 - protein, 32 aa, Mycobacterium; identical to SEQ ID NO: 674405

SEQ ID NO: 822716 - protein, 18 aa, Mycobacterium
HDWAWNTVGICSYCVHCC

SEQ ID NO: 822717 - protein, 21 aa, Mycobacterium
HDWDHNPRWKGITRTYTPADV

SEQ ID NO: 822718 - protein, 17 aa, Mycobacterium
HDWFDEQAFLGLARMRG

SEQ ID NO: 822719 - protein, 17 aa, Mycobacterium
HDWFQSRDGYEGCSFIN

SEQ ID NO: 822720 - protein, 17 aa, Mycobacterium
HDWQEMIDVNLSGVWKS

SEQ ID NO: 822721 - protein, 23 aa, Mycobacterium
HDWRVGKKLLAWERPLRPSEREA

SEQ ID NO: 822722 - protein, 21 aa, Mycobacterium
HDYAVISLSDRLKPWDVIVER

SEQ ID NO: 822723 - protein, 18 aa, Mycobacterium
HDYDLHRWLASNGMVLTW

SEQ ID NO: 822724 - protein, 24 aa, Mycobacterium
HDYDLSSLFLLASTAALFSPSIKE

SEQ ID NO: 822725 - protein, 18 aa, Mycobacterium
HDYGAFLRSLVSTSGLRP

SEQ ID NO: 822726 - protein, 27 aa, Mycobacterium
HDYPNSVYAQPWFQTANFGAALPDKFE

SEQ ID NO: 822727 - protein, 27 aa, Mycobacterium
HDYPVQFDVWWFKLPYEDTTEFSLLPR

SEQ ID NO: 822728 - protein, 28 aa, Mycobacterium
HDYQRTMALNYFAAVQLSLGLLPGMIER

SEQ ID NO: 822729 - protein, 27 aa, Mycobacterium
HDYSIDTALTLFRRLLERERGAYWTFL

SEQ ID NO: 822730 - protein, 23 aa, Mycobacterium
HEAAATRPLVGDVLLAIGASSVR

SEQ ID NO: 822731 - protein, 25 aa, Mycobacterium
HEAAAVGIAYLTAWHGLCEVGRLSA

SEQ ID NO: 822732 - protein, 26 aa, Mycobacterium
HEAALFRLMRSPLMPITPHAITSMFT

SEQ ID NO: 822733 - protein, 31 aa, Mycobacterium
HEAANMAALWDLPLVFVCQNNLYAEMTPTSD

SEQ ID NO: 822734 - protein, 31 aa, Mycobacterium
HEAANMAALWDLPLVFVCQNNRYAEMTPTSA

SEQ ID NO: 822735 - protein, 26 aa, Mycobacterium
HEAAQPLYARYWLHNRGPAPLGGLPA

SEQ ID NO: 822736 - protein, 25 aa, Mycobacterium
HEALLARTENFWERAWFTKSINELR

SEQ ID NO: 822737 - protein, 19 aa, Mycobacterium
HEALNFAAVFTTPCVFLVQ

SEQ ID NO: 822738 - protein, 29 aa, Mycobacterium
HEALNLAGVFRVPCLFYVQNNQWAISTPV

SEQ ID NO: 822739 - protein, 17 aa, Mycobacterium
HEAPKTAWLFTGQGSQY

SEQ ID NO: 822740 - protein, 29 aa, Mycobacterium
HEARRYLDYTLRWRNVPKPSIAAVQGRCI

SEQ ID NO: 822741 - protein, 23 aa, Mycobacterium
HEASMFAWGKPPMLPTTVAGVEH

SEQ ID NO: 822742 - protein, 29 aa, Mycobacterium
HEATADLDLDWWLTFSSVASLLGAPGQGS

SEQ ID NO: 822743 - protein, 21 aa, Mycobacterium
HEATRDLGLSAFVLCSSIAAT

SEQ ID NO: 822744 - protein, 23 aa, Mycobacterium
HEATRHLGLSMFVLCSSIAATVG

SEQ ID NO: 822745 - protein, 25 aa, Mycobacterium
HECLEYALAHDERFGIWGGLSERER

SEQ ID NO: 822746 - protein, 25 aa, Mycobacterium
HEDAFPLLITHGWPGSIVEFHKVIE

SEQ ID NO: 822747 - protein, 25 aa, Mycobacterium
HEDLAWTYHYPLPAVGQIAGLIAFY

SEQ ID NO: 822748 - protein, 24 aa, Mycobacterium
HEDNKRAYAGPRMFIRLAELEMHP

SEQ ID NO: 822749 - protein, 26 aa, Mycobacterium
HEDPGEALSPKWQKMWKPVVCAVQGM

SEQ ID NO: 822750 - protein, 27 aa, Mycobacterium
HEDPGEFLSPKWRKMWKPVVCAVQGMC

SEQ ID NO: 822751 - protein, 27 aa, Mycobacterium
HEDPGELLSPKWQKMWKPVVCAVHGMC

SEQ ID NO: 822752 - protein, 26 aa, Mycobacterium
HEDPGELLSPKWQKMWKPVVCAVQGM

SEQ ID NO: 822753 - protein, 26 aa, Mycobacterium
HEDSTYRGFWDPDGSLHWGVFEDDDT

SEQ ID NO: 822754 - protein, 26 aa, Mycobacterium
HEEDTYRFYFCSTACLRQFARRVGEV

SEQ ID NO: 822755 - protein, 25 aa, Mycobacterium
HEEDTYRFYFCSTACLRRFADRVGD

SEQ ID NO: 822756 - protein, 32 aa, Mycobacterium
HEEERNYYALERLWRDCPTIPVDLDALPAEYS

SEQ ID NO: 822757 - protein, 18 aa, Mycobacterium
HEELGLNVMLPVLPMHGP

SEQ ID NO: 822758 - protein, 24 aa, Mycobacterium
HEELRAFVQRRLNLMKAPPATPAL

SEQ ID NO: 822759 - protein, 20 aa, Mycobacterium
HEERRGTWRAAWREHAHSQQ

SEQ ID NO: 822760 - protein, 24 aa, Mycobacterium
HEEVICELLAWAGVHPDYRSLPED

SEQ ID NO: 822761 - protein, 19 aa, Mycobacterium
HEFGLSPPPPEQIGAFARL

SEQ ID NO: 822762 - protein, 19 aa, Mycobacterium
HEFLFQESDSHWMNSYAMF

SEQ ID NO: 822763 - protein, 17 aa, Mycobacterium
HEFLIKKSRMPSQTPPS

SEQ ID NO: 822764 - protein, 30 aa, Mycobacterium
HEFNLKNLYVYFWRWGTWKVFDANADQPNG

SEQ ID NO: 822765 - protein, 17 aa, Mycobacterium
HEFPVVVLPWEVAFSAV

SEQ ID NO: 822766 - protein, 22 aa, Mycobacterium
HEFRTPLTLLLGPLDDARSDAG

SEQ ID NO: 822767 - protein, 18 aa, Mycobacterium
HEGALLLFHQRMFDWLDD

SEQ ID NO: 822768 - protein, 18 aa, Mycobacterium
HEGFFDFAQSNPGMPAVV

SEQ ID NO: 822769 - protein, 24 aa, Mycobacterium
HEGIGWLAQRGYVPLGYKGDAAKT

SEQ ID NO: 822770 - protein, 27 aa, Mycobacterium
HEGKPFFASLLEFITSGPVVAAVLEGP

SEQ ID NO: 822771 - protein, 27 aa, Mycobacterium
HEGKPFFESLLAFITSGPVVAAIVEGP

SEQ ID NO: 822772 - protein, 26 aa, Mycobacterium
HEGPKYYKWVRQWLDDLELKESFYTK

SEQ ID NO: 822773 - protein, 25 aa, Mycobacterium
HEGPVYHRPVARPEWQDALNADTSA

SEQ ID NO: 822774 - protein, 20 aa, Mycobacterium
HEGVDWLLAQSDKPDLVFEA

SEQ ID NO: 822775 - protein, 20 aa, Mycobacterium
HEGVDWLLARSEKPDLVFEA

SEQ ID NO: 822776 - protein, 19 aa, Mycobacterium
HEHCDLVAPIIWADDDQGW

SEQ ID NO: 822777 - protein, 20 aa, Mycobacterium
HEHDYVVVPLVNATMHVVAP

SEQ ID NO: 822778 - protein, 18 aa, Mycobacterium
HEHFSYLSLTTVAHIFAQ

SEQ ID NO: 822779 - protein, 19 aa, Mycobacterium
HEIARWTAAMIASGERLDF

SEQ ID NO: 822780 - protein, 19 aa, Mycobacterium
HEIPNAAVRQRFLGLGFTA

SEQ ID NO: 822781 - protein, 22 aa, Mycobacterium
HEIRTWVAAFAALAAHGEYQTG

SEQ ID NO: 822782 - protein, 19 aa, Mycobacterium
HEITRWPGPKLRREINHRA

SEQ ID NO: 822783 - protein, 19 aa, Mycobacterium
HEIVVVPYAMSSAERRQEL

SEQ ID NO: 822784 - protein, 24 aa, Mycobacterium
HEIYKLGVVPIPTNRPMIRADQSD

SEQ ID NO: 822785 - protein, 30 aa, Mycobacterium
HEKLKALSLLNYFHHVGFRKSPTDGSAKPS

SEQ ID NO: 822786 - protein, 18 aa, Mycobacterium
HELALQDWLGTAAFDRPE

SEQ ID NO: 822787 - protein, 17 aa, Mycobacterium
HELALQDWLGTAGFDRP

SEQ ID NO: 822788 - protein, 24 aa, Mycobacterium
HELAPRPDLVLLDLNLPKYDGRQL

SEQ ID NO: 822789 - protein, 36 aa, Mycobacterium
HELAYMDWPAFPALIPDPRGWTLPADAPRIPLNFAI

SEQ ID NO: 822790 - protein, 19 aa, Mycobacterium
HELFRESFKTFLDRHAEPY

SEQ ID NO: 822791 - protein, 17 aa, Mycobacterium
HELGFLGVLLSRHQDVE

SEQ ID NO: 822792 - protein, 29 aa, Mycobacterium
HELKVIARLQFPGYFLVVHDIARFCRENN

SEQ ID NO: 822793 - protein, 22 aa, Mycobacterium
HELLLVVPRFCPNCSRRLAPTE

SEQ ID NO: 822794 - protein, 23 aa, Mycobacterium
HELLRLAMTAHRKTFHLVSSTFI

SEQ ID NO: 822795 - protein, 18 aa, Mycobacterium
HELQWHGTQMHRLGAGSD

SEQ ID NO: 822796 - protein, 26 aa, Mycobacterium
HELRAFCARLLGIAAQRVRVIARDTG

SEQ ID NO: 822797 - protein, 20 aa, Mycobacterium
HELRRIAALCAAFDVDGMRA

SEQ ID NO: 822798 - protein, 26 aa, Mycobacterium
HELSARLRRTLPLMARLTLAKVPGRV

SEQ ID NO: 822799 - protein, 18 aa, Mycobacterium
HEMLRHCKPLGAWGNGSA

SEQ ID NO: 822800 - protein, 22 aa, Mycobacterium
HEMTQQFQAVPFQDPFAPQQDI

SEQ ID NO: 822801 - protein, 23 aa, Mycobacterium
HENAMRWYSFDPFTHISREQATV

SEQ ID NO: 822802 - protein, 19 aa, Mycobacterium
HEPAAWDGWLLYSHESTQV

SEQ ID NO: 822803 - protein, 28 aa, Mycobacterium
HEPDAPESLPLLVFPHAGAGASAYREFS

SEQ ID NO: 822804 - protein, 24 aa, Mycobacterium
HEPGAYWVPHRLGGTAPTRAEAAR

SEQ ID NO: 822805 - protein, 37 aa, Mycobacterium
HEPLGVCVAIVPWNFPLLLGIWKIGPALAAGNSVVIK

SEQ ID NO: 822806 - protein, 36 aa, Mycobacterium
HEPLGVVGQIIPWNFPILMATWKLAPALAAGNAVVL

SEQ ID NO: 822807 - protein, 37 aa, Mycobacterium
HEPLGVVGQIIPWNFPLLMAVWKLAPALAAGNCVVLK

SEQ ID NO: 822808 - protein, 18 aa, Mycobacterium
HEPMPFFARHVDGDLLCF

SEQ ID NO: 822809 - protein, 21 aa, Mycobacterium
HEPRLPYASLKAAVATFTRGI

SEQ ID NO: 822810 - protein, 17 aa, Mycobacterium
HEPRLWPEYHENYYGAF

SEQ ID NO: 822811 - protein, 20 aa, Mycobacterium
HEQERLLLSYAAELARRRRG

SEQ ID NO: 822812 - protein, 29 aa, Mycobacterium
HEQFNAALDALWPILTPEDVLAQLYTSHE

SEQ ID NO: 822813 - protein, 20 aa, Mycobacterium
HEQIFHWTNVILGFGDPDLT

SEQ ID NO: 822814 - protein, 24 aa, Mycobacterium
HEQLGPLSAALRERIWPTPRCGRP

SEQ ID NO: 822815 - protein, 22 aa, Mycobacterium
HEQVIALLAISALGAVYVPVGV

SEQ ID NO: 822816 - protein, 30 aa, Mycobacterium
HERAGIEMGTIPEFMWLQVDDVVNACLHDI

SEQ ID NO: 822817 - protein, 23 aa, Mycobacterium
HERERALLRLLEGPRFCGHPDLA

SEQ ID NO: 822818 - protein, 25 aa, Mycobacterium
HERETYDFFGIIFDDHPALTRIQMP

SEQ ID NO: 822819 - protein, 17 aa, Mycobacterium
HERFAVRISNNGEFIHC

SEQ ID NO: 822820 - protein, 25 aa, Mycobacterium
HERFGLLHVYPLMPIPEGRAARAVI

SEQ ID NO: 822821 - protein, 21 aa, Mycobacterium
HERGLPFSGVVWRSTAPNGKE

SEQ ID NO: 822822 - protein, 19 aa, Mycobacterium
HERIDDLALLMTLEMGKPL

SEQ ID NO: 822823 - protein, 17 aa, Mycobacterium
HERLLRRGVPAVVLNAK

SEQ ID NO: 822824 - protein, 18 aa, Mycobacterium
HERLLRRGVPAVVLNAKN

SEQ ID NO: 822825 - protein, 20 aa, Mycobacterium
HERLRLIEIELDQCWDLLRQ

SEQ ID NO: 822826 - protein, 25 aa, Mycobacterium
HERQHYRLVGWRRGLCGYRRFFSIT

SEQ ID NO: 822827 - protein, 24 aa, Mycobacterium
HERQMIWIMNWVEIKRGLASLQGS

SEQ ID NO: 822828 - protein, 24 aa, Mycobacterium
HERQMIWIMNWVEIKRGLDSVRGT

SEQ ID NO: 822829 - protein, 24 aa, Mycobacterium
HERQMIWIMNWVEIKRGLQVARNT

SEQ ID NO: 822830 - protein, 26 aa, Mycobacterium
HERQVDRWLAFLDAYKVRELPGLDEA

SEQ ID NO: 822831 - protein, 26 aa, Mycobacterium
HERQVDRWLHFLAAYQVRELPGLDAA

SEQ ID NO: 822832 - protein, 25 aa, Mycobacterium
HERQVDRWLTFLDAYRVRELPGLDE

SEQ ID NO: 822833 - protein, 23 aa, Mycobacterium
HERTMMWLGFADRIANCIADFVP

SEQ ID NO: 822834 - protein, 21 aa, Mycobacterium
HERTMMWLGFADRLDNMIDDF

SEQ ID NO: 822835 - protein, 29 aa, Mycobacterium
HERVALVSPQPIFLALREVREWAQNTKDD

SEQ ID NO: 822836 - protein, 17 aa, Mycobacterium
HERVALVSSAPIFLCLR

SEQ ID NO: 822837 - protein, 17 aa, Mycobacterium
HERVMLWTGYVDLLHEL

SEQ ID NO: 822838 - protein, 20 aa, Mycobacterium
HERWPVCRITLTGSTTIRDF

SEQ ID NO: 822839 - protein, 17 aa, Mycobacterium
HESIRELQYYRRTAFVP

SEQ ID NO: 822840 - protein, 28 aa, Mycobacterium
HESLVNLPNWLPLTFRIDGGDWFDVDAV

SEQ ID NO: 822841 - protein, 27 aa, Mycobacterium
HESSGIPNYAFYLAATKHGSYSWQGVG

SEQ ID NO: 822842 - protein, 27 aa, Mycobacterium
HESTSFSLALLLATERLKVIAAVHPGL

SEQ ID NO: 822843 - protein, 30 aa, Mycobacterium
HESTSFSLALLLATERLKVIAAVHPGLWQP

SEQ ID NO: 822844 - protein, 27 aa, Mycobacterium
HESYPALDPQGLPLRLLIGRQGEPVLI

SEQ ID NO: 822845 - protein, 17 aa, Mycobacterium
HETAYRDMLGALDQARA

SEQ ID NO: 822846 - protein, 27 aa, Mycobacterium
HETGHLDGFLYLDRLIGRHARSAKRAV

SEQ ID NO: 822847 - protein, 27 aa, Mycobacterium
HETGHLDGFLYLDRLVGRYARAAKKAV

SEQ ID NO: 822848 - protein, 24 aa, Mycobacterium
HETGRLVTLLEAVPYRGPSPTPLR

SEQ ID NO: 822849 - protein, 18 aa, Mycobacterium
HETKVTVLFPDNPVARES

SEQ ID NO: 822850 - protein, 18 aa, Mycobacterium
HETLTFANVIIATGSSVR

SEQ ID NO: 822851 - protein, 18 aa, Mycobacterium
HETREWILRNSPVPVGTV

SEQ ID NO: 822852 - protein, 25 aa, Mycobacterium
HETRPWGWQVFGHHLAVNCFVVDGR

SEQ ID NO: 822853 - protein, 17 aa, Mycobacterium
HETWHPFKPVGKARRRV

SEQ ID NO: 822854 - protein, 17 aa, Mycobacterium
HEVATMLVITFATGSER

SEQ ID NO: 822855 - protein, 18 aa, Mycobacterium
HEVGFFYLTGHGVSPQLV

SEQ ID NO: 822856 - protein, 19 aa, Mycobacterium
HEVGGRVWAWTLPDGGYGW

SEQ ID NO: 822857 - protein, 24 aa, Mycobacterium
HEVGWSMLPVARSALRQIGESTDV

SEQ ID NO: 822858 - protein, 25 aa, Mycobacterium
HEVGWSMLPVARSVLRRIGDSADVV

SEQ ID NO: 822859 - protein, 25 aa, Mycobacterium
HEVGWSMLPVARSVLRRIGDTTDIV

SEQ ID NO: 822860 - protein, 26 aa, Mycobacterium
HEVKPLSLVVGLIEELRKRHPDLDEN

SEQ ID NO: 822861 - protein, 19 aa, Mycobacterium
HEVLMLMAEGLSNAGIARR

SEQ ID NO: 822862 - protein, 18 aa, Mycobacterium
HEVLRRIESALSQTGASL

SEQ ID NO: 822863 - protein, 20 aa, Mycobacterium
HEVNLKILLAGRIRGTERNT

SEQ ID NO: 822864 - protein, 22 aa, Mycobacterium
HEVPLNFLNPRPGTPFGDLEVL

SEQ ID NO: 822865 - protein, 26 aa, Mycobacterium
HEVRVMLEQYWPNVPHVLIEPGVRTG

SEQ ID NO: 822866 - protein, 27 aa, Mycobacterium
HEVRVMLEQYWPSVPHVLIEPGVRTGI

SEQ ID NO: 822867 - protein, 26 aa, Mycobacterium
HEVTHYLFKHPQVDFIWVTGGPKIVA

SEQ ID NO: 822868 - protein, 23 aa, Mycobacterium
HEVWAFMTHLYPPYITYQQSTSR

SEQ ID NO: 822869 - protein, 17 aa, Mycobacterium
HEWGLEYLFGVLEAGKK

SEQ ID NO: 822870 - protein, 28 aa, Mycobacterium
HEYPVNFDVWWFKLPRDGAADHSFLPRI

SEQ ID NO: 822871 - protein, 18 aa, Mycobacterium
HFAAFEEPELFVEDLRAF

SEQ ID NO: 822872 - protein, 20 aa, Mycobacterium
HFAAPRYGFKPTMVVHPPAG

SEQ ID NO: 822873 - protein, 25 aa, Mycobacterium
HFADALRPIEWRYTNDPAWIMRDKG

SEQ ID NO: 822874 - protein, 17 aa, Mycobacterium
HFAFVSNSSPWTYANSR

SEQ ID NO: 822875 - protein, 18 aa, Mycobacterium
HFAGIFGVDLPRGLREQA

SEQ ID NO: 822876 - protein, 17 aa, Mycobacterium
HFAPYEQPELYAEELRN

SEQ ID NO: 822877 - protein, 24 aa, Mycobacterium
HFARLVHRWRWTTDKDPVKIEHSV

SEQ ID NO: 822878 - protein, 18 aa, Mycobacterium
HFATFWDRRRQPNVAMFH

SEQ ID NO: 822879 - protein, 18 aa, Mycobacterium
HFATMKHAAAYWRAKSKA

SEQ ID NO: 822880 - protein, 18 aa, Mycobacterium
HFAVLSKAQSFAAVEPAK

SEQ ID NO: 822881 - protein, 17 aa, Mycobacterium
HFDARFSALRRHYEYRL

SEQ ID NO: 822882 - protein, 22 aa, Mycobacterium
HFDDRQPLMWMPRELHPPSRWI

SEQ ID NO: 822883 - protein, 26 aa, Mycobacterium
HFDEHLTLHGLRLVFERNREAQRGRL

SEQ ID NO: 822884 - protein, 25 aa, Mycobacterium
HFDNQSMHLALEAIWLMLGHANKYF

SEQ ID NO: 822885 - protein, 33 aa, Mycobacterium
HFDPELLTDLALSCAMWLGMGRMLRTLDIGQSC

SEQ ID NO: 822886 - protein, 17 aa, Mycobacterium
HFDPLYEAAARNGLPVA

SEQ ID NO: 822887 - protein, 23 aa, Mycobacterium
HFDPMCPFAYQTSVWIRDVRAQL

SEQ ID NO: 822888 - protein, 22 aa, Mycobacterium
HFDRQIAWLRQMADLCSTMASQ

SEQ ID NO: 822889 - protein, 24 aa, Mycobacterium
HFDRWARQFLAVHPEAVVLHLGCG

SEQ ID NO: 822890 - protein, 22 aa, Mycobacterium
HFDSMLVKLTCRGRDFATAAAR

SEQ ID NO: 822891 - protein, 21 aa, Mycobacterium
HFDSMLVKLTCRGRDFSAAAS

SEQ ID NO: 822892 - protein, 21 aa, Mycobacterium
HFDSMLVKLTCRGRDFSTAVN

SEQ ID NO: 822893 - protein, 20 aa, Mycobacterium
HFDVPAMHLALEAIWSVLGA

SEQ ID NO: 822894 - protein, 21 aa, Mycobacterium
HFDVRGFATLPAGPQGHPVLL

SEQ ID NO: 822895 - protein, 23 aa, Mycobacterium
HFDVRGFATLPRPPQRHPVLVQD

SEQ ID NO: 822896 - protein, 19 aa, Mycobacterium
HFDWAALPFHYVPGEPFST

SEQ ID NO: 822897 - protein, 27 aa, Mycobacterium
HFEDLSDMWVWPPSTPGDEGWVPTMIT

SEQ ID NO: 822898 - protein, 27 aa, Mycobacterium
HFEDRFGVVLFFRGAWCPYCVAQLRAF

SEQ ID NO: 822899 - protein, 20 aa, Mycobacterium
HFEGPPPWNIGEPQPELAAL

SEQ ID NO: 822900 - protein, 30 aa, Mycobacterium
HFEKMLYDNALLLRAYAHWARRTGDELARR

SEQ ID NO: 822901 - protein, 30 aa, Mycobacterium; identical to SEQ ID NO: 219078

SEQ ID NO: 822902 - protein, 18 aa, Mycobacterium
HFENLIDISRIEELRNIE

SEQ ID NO: 822903 - protein, 28 aa, Mycobacterium
HFENPSPHIPWDALPVRVIDEPVPWQTN

SEQ ID NO: 822904 - protein, 25 aa, Mycobacterium
HFENSTWLPDLLGKAFCTSYAATRR

SEQ ID NO: 822905 - protein, 23 aa, Mycobacterium
HFERFVVTEELLIAGAPVAAHWI

SEQ ID NO: 822906 - protein, 21 aa, Mycobacterium
HFGFERYDDFFKMCFDVLPED

SEQ ID NO: 822907 - protein, 43 aa, Mycobacterium
HFGIRSGHVLHWWFPVYDPAFAQLSPGWILLREVIDAAAEIGI

SEQ ID NO: 822908 - protein, 19 aa, Mycobacterium
HFGRLDIVLANAGIAPLAF

SEQ ID NO: 822909 - protein, 34 aa, Mycobacterium
HFGRPAIDMLTWQMALCRPLWRCYGKILECDLRA

SEQ ID NO: 822910 - protein, 20 aa, Mycobacterium
HFGRTDIELPWEQLNKVDEL

SEQ ID NO: 822911 - protein, 19 aa, Mycobacterium
HFGRTDVELPWEQLNKVDD

SEQ ID NO: 822912 - protein, 24 aa, Mycobacterium
HFGSAERWCVGLSGGPDSLALTAV

SEQ ID NO: 822913 - protein, 18 aa, Mycobacterium
HFGSKRQLLAATLQHLAD

SEQ ID NO: 822914 - protein, 22 aa, Mycobacterium
HFGTAIWLAKTYGTPVYCHADE

SEQ ID NO: 822915 - protein, 25 aa, Mycobacterium
HFHPARVEGLVFEVYRWHKSCIEDI

SEQ ID NO: 822916 - protein, 20 aa, Mycobacterium
HFIRTPEEFAWRADDVLDLV

SEQ ID NO: 822917 - protein, 26 aa, Mycobacterium
HFKDDFLDYWAFLAFASVRGGRRTAG

SEQ ID NO: 822918 - protein, 26 aa, Mycobacterium
HFKSVAYELLWFLRGDSNIGWLHQHG

SEQ ID NO: 822919 - protein, 27 aa, Mycobacterium
HFLDSTAGLPFLVRAVSEAARDPLQAA

SEQ ID NO: 822920 - protein, 17 aa, Mycobacterium
HFLPRIVRGECFFGIGM

SEQ ID NO: 822921 - protein, 19 aa, Mycobacterium
HFLRTGEEFGWRAAELFDV

SEQ ID NO: 822922 - protein, 18 aa, Mycobacterium
HFMPAKLLQSQFQTLEPL

SEQ ID NO: 822923 - protein, 29 aa, Mycobacterium
HFNDAIVRPLLRFFFKSWFRVEVSGVENI

SEQ ID NO: 822924 - protein, 18 aa, Mycobacterium
HFNENIMTLMLKLMRLTQ

SEQ ID NO: 822925 - protein, 26 aa, Mycobacterium
HFNEVFLDDVFVPDAMLLGAPNDGWN

SEQ ID NO: 822926 - protein, 19 aa, Mycobacterium
HFNEVFLNDVFIPDEMLLG

SEQ ID NO: 822927 - protein, 25 aa, Mycobacterium
HFNEVFLSDVFVPDELLLGGPTDGW

SEQ ID NO: 822928 - protein, 19 aa, Mycobacterium
HFNGGFVQFAFACPGSAEV

SEQ ID NO: 822929 - protein, 21 aa, Mycobacterium
HFNWLEALGFEFERTYYPGKV

SEQ ID NO: 822930 - protein, 18 aa, Mycobacterium
HFNWVRSWYDFAVPDIGR

SEQ ID NO: 822931 - protein, 22 aa, Mycobacterium
HFPSRIDFFREALRVLKPGGRM

SEQ ID NO: 822932 - protein, 29 aa, Mycobacterium
HFQAAGGMAFLVRSLLDAGLLRDDVATVA

SEQ ID NO: 822933 - protein, 18 aa, Mycobacterium
HFQAWQFSQFLHGEQGAM

SEQ ID NO: 822934 - protein, 17 aa, Mycobacterium
HFQEWWVRHRAQVPTDS

SEQ ID NO: 822935 - protein, 25 aa, Mycobacterium
HFQRMRLGEHWGSKVRMVFYDQRGH

SEQ ID NO: 822936 - protein, 22 aa, Mycobacterium
HFRDLAHAWAAFRDDAGAWVAV

SEQ ID NO: 822937 - protein, 21 aa, Mycobacterium
HFRDLAHAWAAFRDDANAWVA

SEQ ID NO: 822938 - protein, 17 aa, Mycobacterium
HFRKVMSAPTGPLEWLL

SEQ ID NO: 822939 - protein, 25 aa, Mycobacterium
HFRQALQFVLWEMASYRTEGLVNFL

SEQ ID NO: 822940 - protein, 24 aa, Mycobacterium
HFRRAGIVPPRDLVFAFVADEEHG

SEQ ID NO: 822941 - protein, 17 aa, Mycobacterium
HFRYFAGVLRAQEGSIS

SEQ ID NO: 822942 - protein, 17 aa, Mycobacterium
HFSPWLMSQGHAPNAWT

SEQ ID NO: 822943 - protein, 27 aa, Mycobacterium
HFSSKKDILAALVRLALERPLAVADEL

SEQ ID NO: 822944 - protein, 19 aa, Mycobacterium
HFSSKLELYLAVLKRHVDN

SEQ ID NO: 822945 - protein, 25 aa, Mycobacterium
HFSSKLELYLAVLQRHVDNLVSGVR

SEQ ID NO: 822946 - protein, 28 aa, Mycobacterium
HFSYGLDLPAMAGTFMPLMAEKALAKPR

SEQ ID NO: 822947 - protein, 21 aa, Mycobacterium
HFTAHWPTSRDVWLPDGTPPA

SEQ ID NO: 822948 - protein, 28 aa, Mycobacterium
HFTDALVRPLLRFFSRSWFRVEVSGIEN

SEQ ID NO: 822949 - protein, 29 aa, Mycobacterium
HFTFYASIAHLCVDPMIVGVLFTEIHMMY

SEQ ID NO: 822950 - protein, 22 aa, Mycobacterium
HFTLTDLELAFFLQLQGGEITA

SEQ ID NO: 822951 - protein, 19 aa, Mycobacterium
HFTRLPDDLAKIDTKLFVP

SEQ ID NO: 822952 - protein, 22 aa, Mycobacterium
HFVCRDAWLRVASTSTAWTSRF

SEQ ID NO: 822953 - protein, 26 aa, Mycobacterium
HFVGGYADYFLLPAKAVVYTVPDSVS

SEQ ID NO: 822954 - protein, 18 aa, Mycobacterium
HFVGPASARLFVASALAQ

SEQ ID NO: 822955 - protein, 17 aa, Mycobacterium
HFVGVPDLSSLGRDVVY

SEQ ID NO: 822956 - protein, 25 aa, Mycobacterium
HFVNALQPIEWRYTNDPAWVMREKG

SEQ ID NO: 822957 - protein, 23 aa, Mycobacterium
HFVNRWKAIAFSTAQYQLARKFP

SEQ ID NO: 822958 - protein, 26 aa, Mycobacterium
HFVPNLTIGLPVVESLLAATTIPMDC

SEQ ID NO: 822959 - protein, 17 aa, Mycobacterium
HFVWVRETLRLGEKFPL

SEQ ID NO: 822960 - protein, 21 aa, Mycobacterium
HFYGAGLINWWDPDGARRTLE

SEQ ID NO: 822961 - protein, 23 aa, Mycobacterium
HFYGAGLINWWDPEGTRRTLAEL

SEQ ID NO: 822962 - protein, 19 aa, Mycobacterium
HFYGAGLINWWDPQGARKT

SEQ ID NO: 822963 - protein, 25 aa, Mycobacterium
HGAAGLLLRAPGPNGAPAVLLQHRA

SEQ ID NO: 822964 - protein, 22 aa, Mycobacterium
HGAAQWAAFISLCGGRPFVMPQ

SEQ ID NO: 822965 - protein, 21 aa, Mycobacterium
HGADRIIDYIDYTVTPLPVAG

SEQ ID NO: 822966 - protein, 18 aa, Mycobacterium
HGADVAVFQFVKSAKWRV

SEQ ID NO: 822967 - protein, 29 aa, Mycobacterium
HGAEPNMRWRTFCNRLLAIADRLDVSTVV

SEQ ID NO: 822968 - protein, 26 aa, Mycobacterium
HGAHGYLLDQFLWERTNVRADGYGGS

SEQ ID NO: 822969 - protein, 21 aa, Mycobacterium
HGAISTAQWYGARLADVLGAA

SEQ ID NO: 822970 - protein, 20 aa, Mycobacterium
HGALIHHPFHRPECTEDDCF

SEQ ID NO: 822971 - protein, 25 aa, Mycobacterium
HGALRGMLAFLAVNTTYRGPATPGS

SEQ ID NO: 822972 - protein, 25 aa, Mycobacterium
HGALRSAWIGYWVASSRTGGGIATA

SEQ ID NO: 822973 - protein, 24 aa, Mycobacterium
HGANKTWKSLTGLGPKTATVAAEA

SEQ ID NO: 822974 - protein, 27 aa, Mycobacterium
HGANLHDALLALLPLVGVWRGEGEGRG

SEQ ID NO: 822975 - protein, 17 aa, Mycobacterium
HGAPAWPYFEDVKIERL

SEQ ID NO: 822976 - protein, 18 aa, Mycobacterium
HGAQFLAAGALGVAQREA

SEQ ID NO: 822977 - protein, 35 aa, Mycobacterium
HGARTAAIVDPFGHRWMLTGPITGAPVPIRHGDVG

SEQ ID NO: 822978 - protein, 23 aa, Mycobacterium
HGASGFFEAQAQMLSGLQGLIDT

SEQ ID NO: 822979 - protein, 25 aa, Mycobacterium
HGASIQLLGVLLFDVNPRATKRNEE

SEQ ID NO: 822980 - protein, 23 aa, Mycobacterium
HGATIVMPAPGFDPGRTLEAIER

SEQ ID NO: 822981 - protein, 24 aa, Mycobacterium
HGATYMNYVGKPLAYILATAERDD

SEQ ID NO: 822982 - protein, 19 aa, Mycobacterium
HGAVAMHYVTGRYALDLHP

SEQ ID NO: 822983 - protein, 20 aa, Mycobacterium
HGAVVMHYVTGLYALDLHPD

SEQ ID NO: 822984 - protein, 26 aa, Mycobacterium
HGAWCWEHFLDFFADAGYRAVAVSLR

SEQ ID NO: 822985 - protein, 32 aa, Mycobacterium
HGAWHAAWCWDDHFLDFFAGRGYRALALSFRG

SEQ ID NO: 822986 - protein, 27 aa, Mycobacterium
HGCDTRRYKLWHPRAHLHAAWKDGSDA

SEQ ID NO: 822987 - protein, 26 aa, Mycobacterium
HGCDTRRYKLWHPRAHLSAAWKDGDD

SEQ ID NO: 822988 - protein, 24 aa, Mycobacterium
HGCEPWEELAVKLMLKWPNLYYST

SEQ ID NO: 822989 - protein, 21 aa, Mycobacterium
HGCRAFIEMSPHPVLTHAITE

SEQ ID NO: 822990 - protein, 25 aa, Mycobacterium
HGCRRRQWPAYPDMDPLGNVAGMMR

SEQ ID NO: 822991 - protein, 24 aa, Mycobacterium
HGDATLLWPPPEPGGYSLIVDGRA

SEQ ID NO: 822992 - protein, 25 aa, Mycobacterium
HGDCLFTLVWHVSEGHWGDVDLSGL

SEQ ID NO: 822993 - protein, 24 aa, Mycobacterium
HGDDLRLLLVVLGVEHVVRDATLL

SEQ ID NO: 822994 - protein, 24 aa, Mycobacterium
HGDDPEFRLCDYFDLIGGTSTGSI

SEQ ID NO: 822995 - protein, 23 aa, Mycobacterium
HGDDPRFCTVIFGVITAAPDGFD

SEQ ID NO: 822996 - protein, 19 aa, Mycobacterium
HGDFAFGQALFSYDLKAYR

SEQ ID NO: 822997 - protein, 26 aa, Mycobacterium
HGDFKPHFFHHATFRQFLASIGSDDA

SEQ ID NO: 822998 - protein, 27 aa, Mycobacterium
HGDGAVLPWIFVGYPIVQESAVDELWD

SEQ ID NO: 822999 - protein, 17 aa, Mycobacterium
HGDGWCPFPAPAPLAQT

SEQ ID NO: 823000 - protein, 24 aa, Mycobacterium
HGDIPLGIYCRASLAQYMDAERLF

SEQ ID NO: 823001 - protein, 20 aa, Mycobacterium
HGDKQIIHLHRFPAEVDAHY

SEQ ID NO: 823002 - protein, 27 aa, Mycobacterium
HGDLHLGQVLRTPKGWLLIDFEGEPGQ

SEQ ID NO: 823003 - protein, 28 aa, Mycobacterium
HGDLLADDIFWVDGKPALLDCLEFDDKL

SEQ ID NO: 823004 - protein, 23 aa, Mycobacterium
HGDLLVTVKVAVPPNLEGEAAEA

SEQ ID NO: 823005 - protein, 26 aa, Mycobacterium
HGDPDAWRPVFAGLAELGLFGVAVPE

SEQ ID NO: 823006 - protein, 26 aa, Mycobacterium
HGDSRGMFFEWLTDSGFTAFCGHRFD

SEQ ID NO: 823007 - protein, 24 aa, Mycobacterium
HGDTRHRFPLASVTKLLVARAAQI

SEQ ID NO: 823008 - protein, 21 aa, Mycobacterium
HGDWPVKPSPPFIPGHEGYGT

SEQ ID NO: 823009 - protein, 17 aa, Mycobacterium
HGDYRLDNLLFDPDRTR

SEQ ID NO: 823010 - protein, 18 aa, Mycobacterium
HGDYRLDNLLYDPERTRV

SEQ ID NO: 823011 - protein, 51 aa, Mycobacterium
HGEAYRGHIFWDELFIFPVLNLRLPAVTRSLLLYRYRRLLEAQRAAKLAGY

SEQ ID NO: 823012 - protein, 40 aa, Mycobacterium
HGEAYRGHIFWDELFIFPVLNLRVPTVTRSLLRYRHRRLV

SEQ ID NO: 823013 - protein, 33 aa, Mycobacterium
HGEAYRGHVFWDELFVFPVLNMRLPKVTRSLLL

SEQ ID NO: 823014 - protein, 17 aa, Mycobacterium
HGEDVAGVDPLWLRRRV

SEQ ID NO: 823015 - protein, 26 aa, Mycobacterium
HGEEPMIFYRDPMRLMTHLGEKHGVE

SEQ ID NO: 823016 - protein, 23 aa, Mycobacterium
HGEFDYNLQWKPVGGFPITVGWL

SEQ ID NO: 823017 - protein, 29 aa, Mycobacterium
HGEFIKGFAGPFTLLVIADLLGVPEEDRD

SEQ ID NO: 823018 - protein, 29 aa, Mycobacterium
HGEFVDFDPIYSWPKPVQQPYPPLYLGCG

SEQ ID NO: 823019 - protein, 30 aa, Mycobacterium
HGEGGFVVPAPGFLGALQKWCTDNGAVFVA

SEQ ID NO: 823020 - protein, 18 aa, Mycobacterium
HGEHFWTWSIDMLGHGYT

SEQ ID NO: 823021 - protein, 21 aa, Mycobacterium
HGEIPLGIFCRGSLARHMDAE

SEQ ID NO: 823022 - protein, 19 aa, Mycobacterium
HGEITFSMIYAFSENFVLP

SEQ ID NO: 823023 - protein, 18 aa, Mycobacterium
HGELAGGMRFAYLSAADA

SEQ ID NO: 823024 - protein, 25 aa, Mycobacterium
HGELGGRWALLLPRGVPAVGAAAVR

SEQ ID NO: 823025 - protein, 19 aa, Mycobacterium
HGELLTLAPFGTADGVVAR

SEQ ID NO: 823026 - protein, 17 aa, Mycobacterium
HGELLTLRPFGTADGVV

SEQ ID NO: 823027 - protein, 22 aa, Mycobacterium
HGEPFLSAWTPVAQPQTIMVPA

SEQ ID NO: 823028 - protein, 31 aa, Mycobacterium
HGEPTWSYLYRTMIPPLAAGGYRVLAPDLIG

SEQ ID NO: 823029 - protein, 27 aa, Mycobacterium
HGEPTWSYLYRTMIPPLAKAGNRVLAP

SEQ ID NO: 823030 - protein, 22 aa, Mycobacterium
HGEREFPSFQAMLDLTIAAAPH

SEQ ID NO: 823031 - protein, 25 aa, Mycobacterium
HGESRRRGVVPQGHRALTGAAVLRC

SEQ ID NO: 823032 - protein, 28 aa, Mycobacterium
HGESWSFALALRLAAFDLLRADGTDPVL

SEQ ID NO: 823033 - protein, 26 aa, Mycobacterium
HGESWSFALALRLAAYELLRADESDP

SEQ ID NO: 823034 - protein, 26 aa, Mycobacterium
HGESWSMALALRLGAYELLCSDGVEP

SEQ ID NO: 823035 - protein, 26 aa, Mycobacterium
HGESWSMALSLRLAAYELLRADGSDP

SEQ ID NO: 823036 - protein, 20 aa, Mycobacterium
HGEVRLLGIDRYGIQLRVEG

SEQ ID NO: 823037 - protein, 20 aa, Mycobacterium
HGFDHRRGLILQRGLHLFHR

SEQ ID NO: 823038 - protein, 25 aa, Mycobacterium
HGFDLDMAALMYFDGRTDAGTYLGA

SEQ ID NO: 823039 - protein, 23 aa, Mycobacterium
HGFDVDLSDLWYGGDRNAADEYL

SEQ ID NO: 823040 - protein, 19 aa, Mycobacterium
HGFEVRFLPTLDDGRLALD

SEQ ID NO: 823041 - protein, 19 aa, Mycobacterium
HGFEVRLLPTLDDGRLALD

SEQ ID NO: 823042 - protein, 20 aa, Mycobacterium
HGFFGLDEIFPAATAAMTFA

SEQ ID NO: 823043 - protein, 29 aa, Mycobacterium
HGFGLPKISLNPLSWAGGMVRGALGAATV

SEQ ID NO: 823044 - protein, 22 aa, Mycobacterium
HGFGWTGPLGVTYPGVVTHGVA

SEQ ID NO: 823045 - protein, 19 aa, Mycobacterium
HGFIGINFPEEFGGGGAGM

SEQ ID NO: 823046 - protein, 22 aa, Mycobacterium
HGFMVVDDLVGAPPLAFRIPDG

SEQ ID NO: 823047 - protein, 23 aa, Mycobacterium
HGFQRIHRSYLVSLKQVTGLRTA

SEQ ID NO: 823048 - protein, 21 aa, Mycobacterium
HGFRIRLTNFEGPFDLLLQLI

SEQ ID NO: 823049 - protein, 17 aa, Mycobacterium
HGFSLGHFPQSFLFATI

SEQ ID NO: 823050 - protein, 25 aa, Mycobacterium
HGFSLGHFPQSFQFATIGGFAATRS

SEQ ID NO: 823051 - protein, 19 aa, Mycobacterium
HGFTVLDRNWRCRHGELDI

SEQ ID NO: 823052 - protein, 33 aa, Mycobacterium
HGGAGFDGLPGEPPDIPPIGGLGGKGGSGGLGP

SEQ ID NO: 823053 - protein, 28 aa, Mycobacterium
HGGAGGAARLWGTGGHGGSGGAGGVGAL

SEQ ID NO: 823054 - protein, 29 aa, Mycobacterium
HGGAGRTWHPYQVPAFLAAGYRVITFDNR

SEQ ID NO: 823055 - protein, 25 aa, Mycobacterium
HGGALSLMFDSLLGFTAAKLTHSRH

SEQ ID NO: 823056 - protein, 20 aa, Mycobacterium
HGGDALLFGNGGNGANGGNT

SEQ ID NO: 823057 - protein, 26 aa, Mycobacterium
HGGEPTLLPRTYFERVFALQRDVFPR

SEQ ID NO: 823058 - protein, 25 aa, Mycobacterium
HGGGAFLALLPRIERFWENSSAVTY

SEQ ID NO: 823059 - protein, 17 aa, Mycobacterium
HGGIAFGWDRINALLSG

SEQ ID NO: 823060 - protein, 20 aa, Mycobacterium
HGGLGWIYLAVDRNVNDRPV

SEQ ID NO: 823061 - protein, 17 aa, Mycobacterium
HGGLGWVYLAVDHNVND

SEQ ID NO: 823062 - protein, 25 aa, Mycobacterium
HGGMGGDYFALSLALEELGKVDQSV

SEQ ID NO: 823063 - protein, 27 aa, Mycobacterium
HGGPALKFQLLWYPSTMWDATLPSFAE

SEQ ID NO: 823064 - protein, 30 aa, Mycobacterium
HGGPARLLVPHLYFWKSAKWVRSIELCDSE

SEQ ID NO: 823065 - protein, 17 aa, Mycobacterium
HGGPGITFIPGYNAARR

SEQ ID NO: 823066 - protein, 29 aa, Mycobacterium
HGGSWRGYEVSVYYLPNGTLFAMCENAQT

SEQ ID NO: 823067 - protein, 20 aa, Mycobacterium
HGGVLPLLFDNLFGMVSHAA

SEQ ID NO: 823068 - protein, 19 aa, Mycobacterium
HGGYGYLREYGLEKIVRDL

SEQ ID NO: 823069 - protein, 22 aa, Mycobacterium
HGGYVMYLQGGRLHFCYNFLGE

SEQ ID NO: 823070 - protein, 17 aa, Mycobacterium
HGHFTFVAVLVPEQAGI

SEQ ID NO: 823071 - protein, 29 aa, Mycobacterium
HGIDFLTSWLDPFTEFRFPRIGTAVFDGV

SEQ ID NO: 823072 - protein, 27 aa, Mycobacterium
HGIDVMRRHALPVPPAFCITTEVGVRY

SEQ ID NO: 823073 - protein, 19 aa, Mycobacterium
HGILKTERLLSFHIDYASV

SEQ ID NO: 823074 - protein, 21 aa, Mycobacterium
HGIPTFTYNYFGSTYTTVAAT

SEQ ID NO: 823075 - protein, 17 aa, Mycobacterium
HGIVYPSKWGTTLGDNY

SEQ ID NO: 823076 - protein, 22 aa, Mycobacterium
HGKDPRYWIDVTKIIHVGEGEK

SEQ ID NO: 823077 - protein, 17 aa, Mycobacterium
HGKLLSLLAGISGARRV

SEQ ID NO: 823078 - protein, 22 aa, Mycobacterium
HGKSLLPQLRRVAESGLLGIVV

SEQ ID NO: 823079 - protein, 18 aa, Mycobacterium
HGLARHGEWLAPGGFDFG

SEQ ID NO: 823080 - protein, 17 aa, Mycobacterium
HGLARMVTGYVALYRAL

SEQ ID NO: 823081 - protein, 17 aa, Mycobacterium
HGLDESAWPLLQHAGQC

SEQ ID NO: 823082 - protein, 20 aa, Mycobacterium
HGLDIDVAELVWLGERRPAA

SEQ ID NO: 823083 - protein, 30 aa, Mycobacterium
HGLFDLRALDWIIPLIRAKRMRVIAKVLGP

SEQ ID NO: 823084 - protein, 25 aa, Mycobacterium
HGLGADLLAVVARLNRLATQRIQMP

SEQ ID NO: 823085 - protein, 23 aa, Mycobacterium
HGLGLGFDPPVVSPALRATADGE

SEQ ID NO: 823086 - protein, 21 aa, Mycobacterium
HGLGLGFDPPVVSPSLRASAD

SEQ ID NO: 823087 - protein, 20 aa, Mycobacterium
HGLHAFRWVAADGSARFVRY

SEQ ID NO: 823088 - protein, 20 aa, Mycobacterium
HGLIRNSFGPQRVAWISGRD

SEQ ID NO: 823089 - protein, 30 aa, Mycobacterium
HGLKALTDFPSQKAWLLADFDTRIGTAVEE

SEQ ID NO: 823090 - protein, 22 aa, Mycobacterium
HGLLDPVAKMLRLPFGTPEFID

SEQ ID NO: 823091 - protein, 21 aa, Mycobacterium
HGLLFTEYAPGVRPARHRFLT

SEQ ID NO: 823092 - protein, 20 aa, Mycobacterium
HGLLITEYPPGVRPARYRFL

SEQ ID NO: 823093 - protein, 19 aa, Mycobacterium
HGLMLLRHVDDLVKTGWPV

SEQ ID NO: 823094 - protein, 24 aa, Mycobacterium
HGLPAIGINWGPWAQVGRAQFLAD

SEQ ID NO: 823095 - protein, 26 aa, Mycobacterium
HGLPATSLAWGYWQTPGIAAHLDTVS

SEQ ID NO: 823096 - protein, 26 aa, Mycobacterium
HGLRRGPDLSGMLEPLFGADGLRGVV

SEQ ID NO: 823097 - protein, 19 aa, Mycobacterium
HGLRRLLKDHLQFPRLQDA

SEQ ID NO: 823098 - protein, 26 aa, Mycobacterium
HGLRYGDWKVLLKTQDRWFNGIQQKL

SEQ ID NO: 823099 - protein, 24 aa, Mycobacterium
HGLSIMPRWLRAVGGKTIDMPAAP

SEQ ID NO: 823100 - protein, 20 aa, Mycobacterium
HGLSKLIVLLDRNDSQVDGP

SEQ ID NO: 823101 - protein, 20 aa, Mycobacterium
HGLSLLRHVKELVNTGWPVL

SEQ ID NO: 823102 - protein, 25 aa, Mycobacterium
HGLSNSMLFRLLRPAIARPVMEVVA

SEQ ID NO: 823103 - protein, 18 aa, Mycobacterium
HGLSYTRFDYRDLVLTGG

SEQ ID NO: 823104 - protein, 18 aa, Mycobacterium
HGLTLRHFPQSFGFSSLG

SEQ ID NO: 823105 - protein, 30 aa, Mycobacterium
HGLVGYLSNLLPLRLQLDAQLHVATALPVV

SEQ ID NO: 823106 - protein, 18 aa, Mycobacterium
HGLWAPHLGPELGGQGFV

SEQ ID NO: 823107 - protein, 24 aa, Mycobacterium
HGMAGYYCARTLLRREFGIAEMPK

SEQ ID NO: 823108 - protein, 28 aa, Mycobacterium
HGMALPGRHQLFLLGCDISRTATGDFRV

SEQ ID NO: 823109 - protein, 18 aa, Mycobacterium
HGMSVDLGRLGLPHEVAA

SEQ ID NO: 823110 - protein, 17 aa, Mycobacterium
HGNERFARYLRADELHL

SEQ ID NO: 823111 - protein, 28 aa, Mycobacterium
HGNFRRFTHTVLLRLPPRIDRSTVEMML

SEQ ID NO: 823112 - protein, 25 aa, Mycobacterium
HGNKISWADLIIFAGNVALESMGFK

SEQ ID NO: 823113 - protein, 25 aa, Mycobacterium
HGNLGFCNFYEGKEPRRLNYGCYDA

SEQ ID NO: 823114 - protein, 27 aa, Mycobacterium
HGNLRLGSFRFWFVGQRWEWSDEVARM

SEQ ID NO: 823115 - protein, 25 aa, Mycobacterium
HGNSVPRFHIAWGTGTGVVEPFVDS

SEQ ID NO: 823116 - protein, 27 aa, Mycobacterium
HGNSVPRFHITWGTGPALVEIFARQLR

SEQ ID NO: 823117 - protein, 25 aa, Mycobacterium
HGPEEVWDRFIRVLTERIEAGDSDI

SEQ ID NO: 823118 - protein, 19 aa, Mycobacterium
HGPELYSRQVHYLAQLVAA

SEQ ID NO: 823119 - protein, 24 aa, Mycobacterium
HGPFDYHLTRKLCRLAQERGIPFA

SEQ ID NO: 823120 - protein, 22 aa, Mycobacterium
HGPGLPVKVSLNPLNWVTGIVR

SEQ ID NO: 823121 - protein, 22 aa, Mycobacterium
HGPGQLVGYPIIGLAQPLDVVN

SEQ ID NO: 823122 - protein, 20 aa, Mycobacterium
HGPGRMLVAAKLGSTRLLDN

SEQ ID NO: 823123 - protein, 20 aa, Mycobacterium
HGPISDMDLSGDGRRLLVTN

SEQ ID NO: 823124 - protein, 17 aa, Mycobacterium
HGPLDRTHPTRRPILIE

SEQ ID NO: 823125 - protein, 17 aa, Mycobacterium
HGPMEDLWQDADSGRLL

SEQ ID NO: 823126 - protein, 27 aa, Mycobacterium
HGPMGHFGLFFIGAGEELFLSTAGAGQ

SEQ ID NO: 823127 - protein, 23 aa, Mycobacterium
HGPQIDKGARWDPAELGPVVADL

SEQ ID NO: 823128 - protein, 19 aa, Mycobacterium
HGPQIFGTGLLGGAQSDLL

SEQ ID NO: 823129 - protein, 17 aa, Mycobacterium
HGPQLRAIDERHGGSII

SEQ ID NO: 823130 - protein, 19 aa, Mycobacterium
HGPQRWRIKANWKIGAENF

SEQ ID NO: 823131 - protein, 21 aa, Mycobacterium
HGPSYQHPPAYDLAGRRGDHV

SEQ ID NO: 823132 - protein, 19 aa, Mycobacterium
HGPTGLGYALLPESTRTLT

SEQ ID NO: 823133 - protein, 20 aa, Mycobacterium
HGPVFVIGLPRTGTTALSQL

SEQ ID NO: 823134 - protein, 27 aa, Mycobacterium
HGPVGHFGLFFLGAGDQLFLSTAGPGQ

SEQ ID NO: 823135 - protein, 27 aa, Mycobacterium
HGPVGHFSLFFLGAGDQLFLSTAGPGQ

SEQ ID NO: 823136 - protein, 19 aa, Mycobacterium
HGPYPLQDSFFARGFGTGV

SEQ ID NO: 823137 - protein, 21 aa, Mycobacterium
HGQCWELLADRLPEATIAAPD

SEQ ID NO: 823138 - protein, 24 aa, Mycobacterium
HGQFVPVMFARMLKLPEDVRKSYD

SEQ ID NO: 823139 - protein, 17 aa, Mycobacterium
HGQFWGERLRHPTLAWL

SEQ ID NO: 823140 - protein, 27 aa, Mycobacterium
HGQIPPNLHFSQWNPAIDAASTRLFVP

SEQ ID NO: 823141 - protein, 23 aa, Mycobacterium
HGQLMTLYPSLTSEQAWSMLGVT

SEQ ID NO: 823142 - protein, 20 aa, Mycobacterium
HGQLPFPLPGILGHEGSGTV

SEQ ID NO: 823143 - protein, 25 aa, Mycobacterium
HGQLQRLIGLWEGKGSESANDFLKT

SEQ ID NO: 823144 - protein, 23 aa, Mycobacterium
HGQLVGRAVDLVQLFPAASYGKN

SEQ ID NO: 823145 - protein, 28 aa, Mycobacterium
HGQQILGRFLHDFAGIGARWTPANIANA

SEQ ID NO: 823146 - protein, 23 aa, Mycobacterium
HGQRRRARFFSPNTHVPVMIIAV

SEQ ID NO: 823147 - protein, 27 aa, Mycobacterium
HGQVPRRWRSQAPLWGDVSFESVAPAL

SEQ ID NO: 823148 - protein, 18 aa, Mycobacterium
HGQVVIDAILGLRAQHGL

SEQ ID NO: 823149 - protein, 20 aa, Mycobacterium
HGQYFTVPGPFLCEPSAQRT

SEQ ID NO: 823150 - protein, 17 aa, Mycobacterium
HGRCDGDRRGVGGPVFV

SEQ ID NO: 823151 - protein, 22 aa, Mycobacterium
HGRGGFAGMLLGSVSTAVAHAA

SEQ ID NO: 823152 - protein, 17 aa, Mycobacterium
HGRGGFTGMLLGSVSSA

SEQ ID NO: 823153 - protein, 18 aa, Mycobacterium
HGRGPLSDLLVQALRCSG

SEQ ID NO: 823154 - protein, 20 aa, Mycobacterium
HGRHYGLRLSADPHTRALTG

SEQ ID NO: 823155 - protein, 23 aa, Mycobacterium
HGRIPDPLPCEIYCHSLADPSIL

SEQ ID NO: 823156 - protein, 25 aa, Mycobacterium
HGRLWATILQHRFGGTGALAGHPIG

SEQ ID NO: 823157 - protein, 26 aa, Mycobacterium
HGRNTVLWCGYTWQYWLATRSVKPEE

SEQ ID NO: 823158 - protein, 28 aa, Mycobacterium
HGRRGLLYERLFDIAAALEVTVGALLHE

SEQ ID NO: 823159 - protein, 27 aa, Mycobacterium
HGRRSATPRWRWFVAKADVGRHALFSG

SEQ ID NO: 823160 - protein, 23 aa, Mycobacterium
HGRSFLERFVVTEELLAAGAPVA

SEQ ID NO: 823161 - protein, 23 aa, Mycobacterium
HGRSFLERFVVTEELLAAGAPVG

SEQ ID NO: 823162 - protein, 17 aa, Mycobacterium
HGRSGFLLAPWTAEQIV

SEQ ID NO: 823163 - protein, 24 aa, Mycobacterium
HGRSVILDGTWRDVGRRQRAHLLA

SEQ ID NO: 823164 - protein, 23 aa, Mycobacterium
HGRTFLERFVVTEELLAAGAPVA

SEQ ID NO: 823165 - protein, 17 aa, Mycobacterium
HGRTGLKVPWAHAILPK

SEQ ID NO: 823166 - protein, 17 aa, Mycobacterium
HGRTGLKVPWAHAVLPK

SEQ ID NO: 823167 - protein, 26 aa, Mycobacterium
HGRVELELIAWRLYTTTRTVHRVAAR

SEQ ID NO: 823168 - protein, 27 aa, Mycobacterium
HGRVHKPMAKVLLRELEPYRLMFVEEP

SEQ ID NO: 823169 - protein, 17 aa, Mycobacterium
HGSARLLVAARLGTTRL

SEQ ID NO: 823170 - protein, 25 aa, Mycobacterium
HGSEPFVSRLDFAPSLGNALYSVEL

SEQ ID NO: 823171 - protein, 36 aa, Mycobacterium
HGSPNELLKPLPLAPYTPRWLARKMAALALGSSDLP

SEQ ID NO: 823172 - protein, 24 aa, Mycobacterium
HGSQRIRVFSPLPAAGALSVVSEV

SEQ ID NO: 823173 - protein, 26 aa, Mycobacterium
HGSTPPPWTLRAALPAALLSAADSMW

SEQ ID NO: 823174 - protein, 22 aa, Mycobacterium
HGTDIRWWHRGDRDERGCLKLS

SEQ ID NO: 823175 - protein, 20 aa, Mycobacterium
HGTGVKLLIARPGFVVGRMT

SEQ ID NO: 823176 - protein, 24 aa, Mycobacterium
HGTILALHHPPIPSVLDLAVTVEL

SEQ ID NO: 823177 - protein, 25 aa, Mycobacterium
HGTILALHHPPIPSVLDLAVTVELR

SEQ ID NO: 823178 - protein, 26 aa, Mycobacterium
HGTKSALFAPELMLARAWTKAAARDK

SEQ ID NO: 823179 - protein, 20 aa, Mycobacterium
HGTLAVRYRAGVADWTFVDS

SEQ ID NO: 823180 - protein, 25 aa, Mycobacterium
HGTLQPPLMPAVPVVDLLGAERAVS

SEQ ID NO: 823181 - protein, 23 aa, Mycobacterium
HGTNLWAGTAYRAAQAGPAADIV

SEQ ID NO: 823182 - protein, 17 aa, Mycobacterium
HGTPADLYHRPGTLTSA

SEQ ID NO: 823183 - protein, 18 aa, Mycobacterium
HGTPLTPMRKTLAADLPA

SEQ ID NO: 823184 - protein, 20 aa, Mycobacterium
HGTPPICFGFGSIPVESPAE

SEQ ID NO: 823185 - protein, 17 aa, Mycobacterium
HGTPPRVGVAFAAGPSS

SEQ ID NO: 823186 - protein, 26 aa, Mycobacterium
HGTRNRALGLLYRWVEQAFGGREHEL

SEQ ID NO: 823187 - protein, 27 aa, Mycobacterium
HGTTIVALTYRGGVLIAGDRRATQGNY

SEQ ID NO: 823188 - protein, 18 aa, Mycobacterium
HGTTVRILFDPAVVPDSA

SEQ ID NO: 823189 - protein, 25 aa, Mycobacterium
HGTVMLRMPLHPVAIELLRQVGPMA

SEQ ID NO: 823190 - protein, 29 aa, Mycobacterium
HGTWKVRWRSGRRWAPSFRFPEGNKMAVE

SEQ ID NO: 823191 - protein, 17 aa, Mycobacterium
HGTWRRPGPQAAADRRR

SEQ ID NO: 823192 - protein, 27 aa, Mycobacterium
HGVAAMLIAKPYLPWGDTHEFADRVLR

SEQ ID NO: 823193 - protein, 20 aa, Mycobacterium
HGVALMPRYASRSPRVARVV

SEQ ID NO: 823194 - protein, 25 aa, Mycobacterium
HGVDALILLMNGYVGYATGASWPLL

SEQ ID NO: 823195 - protein, 26 aa, Mycobacterium
HGVEPNMRWRTFCAELLAIADKLNVQ

SEQ ID NO: 823196 - protein, 26 aa, Mycobacterium
HGVEPNMRWRTFCAELLAIVDKLNVD

SEQ ID NO: 823197 - protein, 21 aa, Mycobacterium
HGVHVFGTLLATAGRQREPGR

SEQ ID NO: 823198 - protein, 19 aa, Mycobacterium
HGVIGPERLLSGFGTIGIL

SEQ ID NO: 823199 - protein, 23 aa, Mycobacterium
HGVITFYHDFRSEPAGRTTVRVC

SEQ ID NO: 823200 - protein, 22 aa, Mycobacterium
HGVNAPNPRPWVRPGAGRAAPP

SEQ ID NO: 823201 - protein, 24 aa, Mycobacterium
HGVNVSLPVFVARAFGGIIEDVDG

SEQ ID NO: 823202 - protein, 24 aa, Mycobacterium
HGVPAGALVLLRRSSESTFSDGEE

SEQ ID NO: 823203 - protein, 20 aa, Mycobacterium
HGVPNGCVLELDLRSMPPET

SEQ ID NO: 823204 - protein, 22 aa, Mycobacterium
HGVPTRALLTDMNTPLGATVGN

SEQ ID NO: 823205 - protein, 24 aa, Mycobacterium
HGVRAFLPKMMATDDQAWVWNIAS

SEQ ID NO: 823206 - protein, 17 aa, Mycobacterium
HGVRPLSLGRLDRGWVV

SEQ ID NO: 823207 - protein, 18 aa, Mycobacterium
HGVRVLVIRPGQVRTRMS

SEQ ID NO: 823208 - protein, 25 aa, Mycobacterium
HGVSAGALVLLRRTDRPVYSADEEM

SEQ ID NO: 823209 - protein, 19 aa, Mycobacterium
HGVTYWPLTRQGPAGGLHA

SEQ ID NO: 823210 - protein, 25 aa, Mycobacterium
HGVVGLMRVYANLLAGQMIRVNSIH

SEQ ID NO: 823211 - protein, 28 aa, Mycobacterium
HGVVGLMRVYANLLATQYIRVNSIHPSG

SEQ ID NO: 823212 - protein, 24 aa, Mycobacterium
HGVVTFGRYFLGGGGAVHGGAISL

SEQ ID NO: 823213 - protein, 21 aa, Mycobacterium
HGVVVPLLLADAYHARVDIPQ

SEQ ID NO: 823214 - protein, 17 aa, Mycobacterium
HGVWLERGEVILSGSFT

SEQ ID NO: 823215 - protein, 17 aa, Mycobacterium
HGWGFHEDGAASGLRAA

SEQ ID NO: 823216 - protein, 20 aa, Mycobacterium
HGWGLQTLLVWNQSFEIAPN

SEQ ID NO: 823217 - protein, 26 aa, Mycobacterium
HGWIDLPEWPLADWPTRRDRELFLQP

SEQ ID NO: 823218 - protein, 17 aa, Mycobacterium
HGWQLQGPLRADRELRD

SEQ ID NO: 823219 - protein, 21 aa, Mycobacterium
HGWQWEAFPLALEVSLHETWD

SEQ ID NO: 823220 - protein, 26 aa, Mycobacterium
HGWRDYGARVGIWRMIESLDRHGIRP

SEQ ID NO: 823221 - protein, 19 aa, Mycobacterium
HGWRHIIRVASFGLINPRP

SEQ ID NO: 823222 - protein, 17 aa, Mycobacterium
HGWTFRNDGALLKVKDP

SEQ ID NO: 823223 - protein, 18 aa, Mycobacterium
HGWVPPGLMLPEGVQLLE

SEQ ID NO: 823224 - protein, 22 aa, Mycobacterium
HGYLIQQSLTPWNNSREDQWGP

SEQ ID NO: 823225 - protein, 22 aa, Mycobacterium
HGYMMGGQLWRQVAERLAGRGL

SEQ ID NO: 823226 - protein, 20 aa, Mycobacterium
HGYPIREHINRLVDGEIIWA

SEQ ID NO: 823227 - protein, 19 aa, Mycobacterium
HGYRPGRGPVRRWIGHGFQ

SEQ ID NO: 823228 - protein, 19 aa, Mycobacterium
HGYVRIRQAARVGDWATAA

SEQ ID NO: 823229 - protein, 17 aa, Mycobacterium
HGYVRYNHVRVPADHVL

SEQ ID NO: 823230 - protein, 21 aa, Mycobacterium
HGYVVLLPDVYYREGDWTPFA

SEQ ID NO: 823231 - protein, 29 aa, Mycobacterium
HHAAEGCQLDWWLGFSSVASLLGSPGQAA

SEQ ID NO: 823232 - protein, 20 aa, Mycobacterium
HHAMRTIALARSAFDMMCER

SEQ ID NO: 823233 - protein, 24 aa, Mycobacterium
HHANIVPWQLIAQKTGAVIKVAPV

SEQ ID NO: 823234 - protein, 26 aa, Mycobacterium
HHANLIPWQELARRTGATLRWYSVTD

SEQ ID NO: 823235 - protein, 34 aa, Mycobacterium
HHAWSARPWTTRPAIPWPWRPAPLHPNEDGMTAV

SEQ ID NO: 823236 - protein, 18 aa, Mycobacterium
HHAYPELHGNILCIGFGG

SEQ ID NO: 823237 - protein, 22 aa, Mycobacterium
HHCAQPILRRMGLEATVRPSFA

SEQ ID NO: 823238 - protein, 17 aa, Mycobacterium
HHCDFAKLLPAVRAVRE

SEQ ID NO: 823239 - protein, 17 aa, Mycobacterium
HHDDGFYPVPRPRDPLA

SEQ ID NO: 823240 - protein, 19 aa, Mycobacterium
HHDDLVLQFAIRSFANYSA

SEQ ID NO: 823241 - protein, 24 aa, Mycobacterium
HHDELGLRWPPAIAPFDVHLVIAN

SEQ ID NO: 823242 - protein, 27 aa, Mycobacterium
HHDLAEATDWMLLAAIDALIDGNRTAA

SEQ ID NO: 823243 - protein, 24 aa, Mycobacterium
HHDRPRRVRKPGEPLRIGVGGPVG

SEQ ID NO: 823244 - protein, 25 aa, Mycobacterium
HHDSRGVFLELFKGPALAEAIGHPF

SEQ ID NO: 823245 - protein, 27 aa, Mycobacterium
HHEGLPIHRALVYRLMQSQTARGATAL

SEQ ID NO: 823246 - protein, 19 aa, Mycobacterium
HHEMTFSMLYAFSENFVLP

SEQ ID NO: 823247 - protein, 21 aa, Mycobacterium
HHFLGAPYWVGRGFGLNLSVV

SEQ ID NO: 823248 - protein, 19 aa, Mycobacterium
HHGDLRSELTRRLTEVHGV

SEQ ID NO: 823249 - protein, 18 aa, Mycobacterium
HHGLLSSSFITPFLAMMG

SEQ ID NO: 823250 - protein, 18 aa, Mycobacterium
HHGQWPFHVDPNDVRFIY

SEQ ID NO: 823251 - protein, 22 aa, Mycobacterium
HHGRYFDVAGPIGAARSAQGQP

SEQ ID NO: 823252 - protein, 18 aa, Mycobacterium
HHGTPVLAPIVYTSAIGL

SEQ ID NO: 823253 - protein, 23 aa, Mycobacterium
HHGVAHLVLISRRGPAAPGATEL

SEQ ID NO: 823254 - protein, 30 aa, Mycobacterium
HHGVTGPVPWWWRPSGALFDQFLGAAETNP

SEQ ID NO: 823255 - protein, 31 aa, Mycobacterium
HHGWEYRSGVRTLPQLLGEHGWHSALFGMQH

SEQ ID NO: 823256 - protein, 22 aa, Mycobacterium
HHHELGWFARQALRMFDDMRLE

SEQ ID NO: 823257 - protein, 26 aa, Mycobacterium
HHIATQNLPIRAGWVHLPCLPMVAAL

SEQ ID NO: 823258 - protein, 25 aa, Mycobacterium
HHINLRPARLYPGVNSPLAGNPDID

SEQ ID NO: 823259 - protein, 25 aa, Mycobacterium
HHINLRPGRLYPGVKSPLALEPGNP

SEQ ID NO: 823260 - protein, 24 aa, Mycobacterium
HHINLRPGRLYPGVNSPLAGNPDI

SEQ ID NO: 823261 - protein, 25 aa, Mycobacterium
HHIRRRRPGYFDGLLPGPSAVDALL

SEQ ID NO: 823262 - protein, 22 aa, Mycobacterium
HHITLRRRTGGTDAGWHLKLPA

SEQ ID NO: 823263 - protein, 38 aa, Mycobacterium
HHKSTYMFLADRHAGWLRAPLRWALRASLAVRSRLMVR

SEQ ID NO: 823264 - protein, 17 aa, Mycobacterium
HHLGKLDARIPIIVLTG

SEQ ID NO: 823265 - protein, 22 aa, Mycobacterium
HHLGRLHRGLVPAPVALMEMIL

SEQ ID NO: 823266 - protein, 20 aa, Mycobacterium
HHLIADGGILGHRRTRAGDA

SEQ ID NO: 823267 - protein, 19 aa, Mycobacterium
HHLWDGVAPLLRDRFRLVA

SEQ ID NO: 823268 - protein, 20 aa, Mycobacterium
HHMYYLNVMAGSGPDRAWLI

SEQ ID NO: 823269 - protein, 23 aa, Mycobacterium
HHNVINMAVLCGWLQGAAQGRVA

SEQ ID NO: 823270 - protein, 25 aa, Mycobacterium
HHPDIDIRWRTVTFALVTHAAGGIT

SEQ ID NO: 823271 - protein, 22 aa, Mycobacterium
HHPGRYAALTRMPFLDAVNRPT

SEQ ID NO: 823272 - protein, 34 aa, Mycobacterium
HHPKGVVGVISPWNYPMALSISDSIPALLAGNAV

SEQ ID NO: 823273 - protein, 17 aa, Mycobacterium
HHPLVQVMLAWQGNDAT

SEQ ID NO: 823274 - protein, 24 aa, Mycobacterium
HHPVAGIYPITLDKSKNASAAYLK

SEQ ID NO: 823275 - protein, 18 aa, Mycobacterium
HHPVVLAKRLATLDRLSR

SEQ ID NO: 823276 - protein, 37 aa, Mycobacterium
HHQSTYIFLADRHGGWWRAPLRWTLRGSLAVRSRLMV

SEQ ID NO: 823277 - protein, 19 aa, Mycobacterium
HHRASALIGTLMRDLTSDW

SEQ ID NO: 823278 - protein, 17 aa, Mycobacterium
HHRMLDPGGWSTRKNTR

SEQ ID NO: 823279 - protein, 24 aa, Mycobacterium
HHRPSGRRLLIQGSAGFVAGALDG

SEQ ID NO: 823280 - protein, 26 aa, Mycobacterium
HHRTGRPHGWIHNELRRRCGGPPIAA

SEQ ID NO: 823281 - protein, 26 aa, Mycobacterium
HHRTGRPHGWIHNELRRRCGGPPVAA

SEQ ID NO: 823282 - protein, 18 aa, Mycobacterium
HHRVVLRQQIFGYTYEEL

SEQ ID NO: 823283 - protein, 17 aa, Mycobacterium
HHRWLNDTSITPPGGES

SEQ ID NO: 823284 - protein, 30 aa, Mycobacterium
HHSGPHYRFERLQPYFNPGPIAHRAPRIWT

SEQ ID NO: 823285 - protein, 27 aa, Mycobacterium
HHSRRVYLFGVLQGQRRGVKPDLELLY

SEQ ID NO: 823286 - protein, 27 aa, Mycobacterium
HHTHPVRFVWVRDLTTRRALLDALKQA

SEQ ID NO: 823287 - protein, 18 aa, Mycobacterium
HHVEWTNYLTPQALIDLV

SEQ ID NO: 823288 - protein, 17 aa, Mycobacterium
HHVFWNMSDRGIPRSYR

SEQ ID NO: 823289 - protein, 18 aa, Mycobacterium
HHVFWTVHARNKRAITLD

SEQ ID NO: 823290 - protein, 17 aa, Mycobacterium
HHVFWTVHARNKRAVTL

SEQ ID NO: 823291 - protein, 27 aa, Mycobacterium
HHVGGAEYLRWLADNDYPLAPVEEVVT

SEQ ID NO: 823292 - protein, 26 aa, Mycobacterium
HHVGSAEYLRWLADNDYPLAAVEEII

SEQ ID NO: 823293 - protein, 18 aa, Mycobacterium
HHVKAVVKILGLVDKEIL

SEQ ID NO: 823294 - protein, 18 aa, Mycobacterium
HHVKTTIKILGLVDKEIL

SEQ ID NO: 823295 - protein, 21 aa, Mycobacterium
HHVLVATNFFGQNTPLIMLNE

SEQ ID NO: 823296 - protein, 19 aa, Mycobacterium
HHVRAAKILGLAQDTADRL

SEQ ID NO: 823297 - protein, 23 aa, Mycobacterium
HHVSYALIRLPDGRLGIFTDRDL

SEQ ID NO: 823298 - protein, 18 aa, Mycobacterium
HHVVATKDFHIDPGAHFS

SEQ ID NO: 823299 - protein, 17 aa, Mycobacterium
HHWGATGIKPRGPSDFL

SEQ ID NO: 823300 - protein, 18 aa, Mycobacterium
HHYAWTRDRLTVAILRDV

SEQ ID NO: 823301 - protein, 19 aa, Mycobacterium
HHYLWRIRNALPSGGQLGV

SEQ ID NO: 823302 - protein, 25 aa, Mycobacterium
HHYVAYLRQVLTNLSGHRLDVHRVS

SEQ ID NO: 823303 - protein, 18 aa, Mycobacterium
HIAAFTFFTSGAREIPLL

SEQ ID NO: 823304 - protein, 19 aa, Mycobacterium
HIAASWFAVVDQPGQPREA

SEQ ID NO: 823305 - protein, 27 aa, Mycobacterium
HIAGVDTFFVATTPRYSFVSSSLAKEV

SEQ ID NO: 823306 - protein, 27 aa, Mycobacterium
HIAKNGLPIRAGWIHLPCLPSVAALEH

SEQ ID NO: 823307 - protein, 18 aa, Mycobacterium
HIAPLQQLWTREAAAAYQ

SEQ ID NO: 823308 - protein, 25 aa, Mycobacterium
HIASLPLDRRRPLWEMWVVEGVAGT

SEQ ID NO: 823309 - protein, 20 aa, Mycobacterium
HIATIFVGGLKHLPIRYSLT

SEQ ID NO: 823310 - protein, 21 aa, Mycobacterium
HIAVSAGLPWHDVEQHIADLV

SEQ ID NO: 823311 - protein, 20 aa, Mycobacterium
HICPISMTYAVVPALRFNPE

SEQ ID NO: 823312 - protein, 17 aa, Mycobacterium
HIDAVPRALMRRCLLSG

SEQ ID NO: 823313 - protein, 23 aa, Mycobacterium
HIDDLPDFPLTTADPLIVGRRNP

SEQ ID NO: 823314 - protein, 29 aa, Mycobacterium
HIDEWCAAHPGRFIPCGILPLFDVAEAAK

SEQ ID NO: 823315 - protein, 25 aa, Mycobacterium
HIDGLQAAAYFRPVSARQVGGDFYD

SEQ ID NO: 823316 - protein, 18 aa, Mycobacterium
HIDHLGTAIWFAREHHTP

SEQ ID NO: 823317 - protein, 27 aa, Mycobacterium
HIDILIANAGVLSWGRLWEMSDQQWED

SEQ ID NO: 823318 - protein, 17 aa, Mycobacterium
HIDPHTIVFVPPHSIPK

SEQ ID NO: 823319 - protein, 34 aa, Mycobacterium
HIDSVHAAILDLLSRICDPLTGIKEVWEFLTDED

SEQ ID NO: 823320 - protein, 22 aa, Mycobacterium
HIDTMVLYPSLGLCAPTLEDPE

SEQ ID NO: 823321 - protein, 20 aa, Mycobacterium
HIDVVYYLVHGIGQPGFRDS

SEQ ID NO: 823322 - protein, 21 aa, Mycobacterium
HIEGLYEQMWAQDVAAMAGYH

SEQ ID NO: 823323 - protein, 25 aa, Mycobacterium
HIEHILADWVGELAVPIYRGCEVTG

SEQ ID NO: 823324 - protein, 25 aa, Mycobacterium
HIEHRSLVVEIYRPRLNGPVPHAED

SEQ ID NO: 823325 - protein, 18 aa, Mycobacterium
HIEKRFSMSWSHPARRMR

SEQ ID NO: 823326 - protein, 19 aa, Mycobacterium
HIELPIFEDTALFARGVGE

SEQ ID NO: 823327 - protein, 18 aa, Mycobacterium
HIEMLTTKQQLLLDDVEN

SEQ ID NO: 823328 - protein, 27 aa, Mycobacterium
HIENRSLVVEVYRPRLAGPVPQADEVV

SEQ ID NO: 823329 - protein, 25 aa, Mycobacterium
HIEQQAFMFGPPPLGPDAPPLTRLI

SEQ ID NO: 823330 - protein, 20 aa, Mycobacterium
HIFECNLYFVPPKNTRQRLA

SEQ ID NO: 823331 - protein, 19 aa, Mycobacterium
HIFPINFVVQNRTVLFRTA

SEQ ID NO: 823332 - protein, 17 aa, Mycobacterium
HIGALLLAGDIAQAGME

SEQ ID NO: 823333 - protein, 18 aa, Mycobacterium
HIGIQVLKALSPAELIVV

SEQ ID NO: 823334 - protein, 23 aa, Mycobacterium
HIGKIVCQMPNPLAPRPDRTYLI

SEQ ID NO: 823335 - protein, 22 aa, Mycobacterium
HIGKLPELPLRVGDTWEEAGPE

SEQ ID NO: 823336 - protein, 27 aa, Mycobacterium
HIGKVILTMPTLLPDALAAGTVLITGG

SEQ ID NO: 823337 - protein, 17 aa, Mycobacterium
HIGLPRSEHRRCAEMVN

SEQ ID NO: 823338 - protein, 17 aa, Mycobacterium
HIGLSPFDQSRCAERVN

SEQ ID NO: 823339 - protein, 24 aa, Mycobacterium
HIGPPTLLGVGVRAAPRDAPGVLI

SEQ ID NO: 823340 - protein, 26 aa, Mycobacterium
HIGVDIAPVRKPISPLRSLLPALRDS

SEQ ID NO: 823341 - protein, 29 aa, Mycobacterium
HIGYVLQKDLLFPWRTVLENVVLGLEVRG

SEQ ID NO: 823342 - protein, 18 aa, Mycobacterium
HIHALIRLDPRDSDDCGG

SEQ ID NO: 823343 - protein, 17 aa, Mycobacterium
HIHLHVVPRRNGDKLSF

SEQ ID NO: 823344 - protein, 25 aa, Mycobacterium
HIIEGMLALTGYYAWHKICVEHGIL

SEQ ID NO: 823345 - protein, 22 aa, Mycobacterium
HIKFAYWVPNVSGGLVTSDIEQ

SEQ ID NO: 823346 - protein, 27 aa, Mycobacterium
HIKLEFEQTFMFYLPRICEHCLNPSCV

SEQ ID NO: 823347 - protein, 18 aa, Mycobacterium
HILAPWPRELNTPRWLLP

SEQ ID NO: 823348 - protein, 27 aa, Mycobacterium
HILEVQRLIRFMPKVVIALVNGWAAGG

SEQ ID NO: 823349 - protein, 17 aa, Mycobacterium
HILLAQHVGSSPLQDRR

SEQ ID NO: 823350 - protein, 18 aa, Mycobacterium
HILLTRTPAITGRYEFLT

SEQ ID NO: 823351 - protein, 19 aa, Mycobacterium
HILRDTIAKPPPGGSPGLM

SEQ ID NO: 823352 - protein, 19 aa, Mycobacterium
HIPALISLTGSVRAGHEIT

SEQ ID NO: 823353 - protein, 31 aa, Mycobacterium
HIPLTADMGLGMFLVRFAGHCRRSSWQRAVR

SEQ ID NO: 823354 - protein, 18 aa, Mycobacterium
HIPSLYKVYPTTDWHERE

SEQ ID NO: 823355 - protein, 19 aa, Mycobacterium
HIPVLLDRCVELLAPALTR

SEQ ID NO: 823356 - protein, 27 aa, Mycobacterium
HIQRGEPGYFDGLLPAADELLEQMRAE

SEQ ID NO: 823357 - protein, 25 aa, Mycobacterium
HIRAADVLVPQWISRGRGYFVSVAS

SEQ ID NO: 823358 - protein, 18 aa, Mycobacterium
HIRELRLARPGLVDQLAE

SEQ ID NO: 823359 - protein, 18 aa, Mycobacterium
HIREQLAWCYGRVEIMRC

SEQ ID NO: 823360 - protein, 18 aa, Mycobacterium
HIRGLLERRLIALGISDA

SEQ ID NO: 823361 - protein, 18 aa, Mycobacterium
HIRHLMPSAWSPTHVPRS

SEQ ID NO: 823362 - protein, 25 aa, Mycobacterium
HIRKYLWGEHFWSPSYFAGSCGGAP

SEQ ID NO: 823363 - protein, 19 aa, Mycobacterium
HIRPYTWPYPEISTAAMIS

SEQ ID NO: 823364 - protein, 31 aa, Mycobacterium
HIRVAGWPNQQFALLFVDWLNADADVREQYS

SEQ ID NO: 823365 - protein, 23 aa, Mycobacterium
HISDAYGCRLERLPQVSYAAFGH

SEQ ID NO: 823366 - protein, 18 aa, Mycobacterium
HISRTLTNAVLRQAGTAP

SEQ ID NO: 823367 - protein, 37 aa, Mycobacterium
HISSRLRPILNFRPKYDSWLTQAPWQFNADLHLIDWL

SEQ ID NO: 823368 - protein, 17 aa, Mycobacterium
HITADEVILTCLELGAV

SEQ ID NO: 823369 - protein, 17 aa, Mycobacterium
HITADQLYPGLTRAEAW

SEQ ID NO: 823370 - protein, 29 aa, Mycobacterium
HITAVLPGRPPLPTYFLPNNRGKKSVTVD

SEQ ID NO: 823371 - protein, 25 aa, Mycobacterium
HITELNRRGLLDDVSFQGALDAAPP

SEQ ID NO: 823372 - protein, 25 aa, Mycobacterium
HITIRLDYSLVELPEKLPKKTLKAL

SEQ ID NO: 823373 - protein, 23 aa, Mycobacterium
HITPADFLNDPLLWAELITKHRG

SEQ ID NO: 823374 - protein, 36 aa, Mycobacterium
HITRPEDWPIMPVDTVNFWLKPVGFFDRNPSLDVAP

SEQ ID NO: 823375 - protein, 20 aa, Mycobacterium
HIVAAKYPINVALHTDHCPK

SEQ ID NO: 823376 - protein, 25 aa, Mycobacterium
HIVGPPFIVARFMRYLELEAISLTL

SEQ ID NO: 823377 - protein, 19 aa, Mycobacterium
HIVRRRARQPFASTADLVA

SEQ ID NO: 823378 - protein, 17 aa, Mycobacterium
HIVTLYHRLKQNPELRI

SEQ ID NO: 823379 - protein, 17 aa, Mycobacterium
HIVVVLANPLYDGHGSL

SEQ ID NO: 823380 - protein, 18 aa, Mycobacterium
HIVWDWNGTLLDDNPAML

SEQ ID NO: 823381 - protein, 20 aa, Mycobacterium
HIWEGEYLNPFPIVQGHEAA

SEQ ID NO: 823382 - protein, 20 aa, Mycobacterium
HIWHPYSPIGDGALAPVVAV

SEQ ID NO: 823383 - protein, 17 aa, Mycobacterium
HIYAVIGLKDTTTGDTL

SEQ ID NO: 823384 - protein, 17 aa, Mycobacterium
HIYEFCMDLLGPEGILY

SEQ ID NO: 823385 - protein, 17 aa, Mycobacterium
HIYGDDPRWRPTLRRVM

SEQ ID NO: 823386 - protein, 24 aa, Mycobacterium
HIYHALTWGPLMREIIWATTGKEI

SEQ ID NO: 823387 - protein, 22 aa, Mycobacterium
HKAALLVLRGLALNDLHSASRQ

SEQ ID NO: 823388 - protein, 17 aa, Mycobacterium
HKAFAEHGWFHTDDFGE

SEQ ID NO: 823389 - protein, 17 aa, Mycobacterium
HKAFQLMIDGGLTGKLV

SEQ ID NO: 823390 - protein, 23 aa, Mycobacterium
HKAKLRADFLRPAKAEDLLDDRE

SEQ ID NO: 823391 - protein, 23 aa, Mycobacterium
HKDGVMAIIGVSPFLGADGDVEL

SEQ ID NO: 823392 - protein, 18 aa, Mycobacterium
HKDLRRAVIFGRNDLVKD

SEQ ID NO: 823393 - protein, 23 aa, Mycobacterium
HKDRLVLDFYRCAMLPLSENGGD

SEQ ID NO: 823394 - protein, 17 aa, Mycobacterium
HKFGGPAAVGALLLRRD

SEQ ID NO: 823395 - protein, 21 aa, Mycobacterium
HKFGGPMGVGALLLRREIACV

SEQ ID NO: 823396 - protein, 40 aa, Mycobacterium
HKFLREYPYRDAYLLRDARLFRAELSMPLILLGGITNRET

SEQ ID NO: 823397 - protein, 21 aa, Mycobacterium
HKGISVLLIPTDLDGVVCRPF

SEQ ID NO: 823398 - protein, 24 aa, Mycobacterium
HKGQLLALHLGRLKDRVGLRPEQV

SEQ ID NO: 823399 - protein, 34 aa, Mycobacterium
HKHHSWRYHLAVRRWAIDLPALYAEVRKTRPVQP

SEQ ID NO: 823400 - protein, 24 aa, Mycobacterium
HKHLRLSARRMGLPDGGRGLVLLD

SEQ ID NO: 823401 - protein, 17 aa, Mycobacterium
HKIHLYDAFGFAESRTV

SEQ ID NO: 823402 - protein, 23 aa, Mycobacterium
HKITLRRRTGGTDAAWHLKLPAG

SEQ ID NO: 823403 - protein, 19 aa, Mycobacterium
HKIWATQSGFTFPVLSDFW

SEQ ID NO: 823404 - protein, 20 aa, Mycobacterium
HKIWSIESGFTFPVLSDFWP

SEQ ID NO: 823405 - protein, 21 aa, Mycobacterium
HKKAWKAMFDDYLRARAQSTG

SEQ ID NO: 823406 - protein, 18 aa, Mycobacterium
HKLAVLVVSVIPLAEPAR

SEQ ID NO: 823407 - protein, 19 aa, Mycobacterium
HKLEAQRVFGRCWQFLAHE

SEQ ID NO: 823408 - protein, 31 aa, Mycobacterium
HKLSQWLTYSLIEPFVWAGVEVLDIDALTGL

SEQ ID NO: 823409 - protein, 17 aa, Mycobacterium
HKNLTMFLVPLDSEGIE

SEQ ID NO: 823410 - protein, 23 aa, Mycobacterium
HKPQAPIPLPFADIAVVTRRSRR

SEQ ID NO: 823411 - protein, 18 aa, Mycobacterium
HKPRYHVGAVMRSRWDLA

SEQ ID NO: 823412 - protein, 22 aa, Mycobacterium
HKPWPGLIAAYRDRLPVADDWA

SEQ ID NO: 823413 - protein, 24 aa, Mycobacterium
HKQLALYLFDAYSQAIAPGASIRS

SEQ ID NO: 823414 - protein, 19 aa, Mycobacterium
HKRILTDILARASAINLAR

SEQ ID NO: 823415 - protein, 23 aa, Mycobacterium
HKRNPVLATMIRSAALQVPSLSV

SEQ ID NO: 823416 - protein, 25 aa, Mycobacterium
HKRNPVLSILIRRAAVAAPHLAATL

SEQ ID NO: 823417 - protein, 28 aa, Mycobacterium
HKRNPVLSVLIRRAALAAPALGATLHAA

SEQ ID NO: 823418 - protein, 26 aa, Mycobacterium
HKSFGGVPVLKGISLQLEPGTVTALA

SEQ ID NO: 823419 - protein, 26 aa, Mycobacterium
HKSIEQLLVVLPALFAAIITSAGGVP

SEQ ID NO: 823420 - protein, 24 aa, Mycobacterium
HKTNVLTFAGKLWSRIVAEVGRDY

SEQ ID NO: 823421 - protein, 29 aa, Mycobacterium
HKTNVLTFAGSLWWRTVQEIAKKYPDVEV

SEQ ID NO: 823422 - protein, 25 aa, Mycobacterium
HKTVHHYLMRFLGGELSDNDLEVTE

SEQ ID NO: 823423 - protein, 25 aa, Mycobacterium
HKVKKRTFHYPGGLVDFVKHINRTK

SEQ ID NO: 823424 - protein, 25 aa, Mycobacterium
HKVKNRVFHYPDGLVDFVKHINRTK

SEQ ID NO: 823425 - protein, 26 aa, Mycobacterium
HKVKSRTFHYPGGLVDFVKHINRTKS

SEQ ID NO: 823426 - protein, 22 aa, Mycobacterium
HKVMPIITSLLHQYPHLLALSA

SEQ ID NO: 823427 - protein, 20 aa, Mycobacterium
HKWVRHIAIVDFENTQRRRP

SEQ ID NO: 823428 - protein, 22 aa, Mycobacterium
HKYGLSPRIRFAVKVTEAWFDE

SEQ ID NO: 823429 - protein, 31 aa, Mycobacterium; identical to SEQ ID NO: 127580

SEQ ID NO: 823430 - protein, 30 aa, Mycobacterium
HLAAELMGRFAFDRPGLAAISLPDATAAMT

SEQ ID NO: 823431 - protein, 17 aa, Mycobacterium
HLAAFLATKEAGYITGQ

SEQ ID NO: 823432 - protein, 18 aa, Mycobacterium
HLAAHFPGVNNTTVWSDP

SEQ ID NO: 823433 - protein, 17 aa, Mycobacterium
HLAANLANLFRTKRFRT

SEQ ID NO: 823434 - protein, 20 aa, Mycobacterium
HLAAYRALGLDDWTYERIEC

SEQ ID NO: 823435 - protein, 25 aa, Mycobacterium
HLADLTRYLLAIRRRLDGLARGAQA

SEQ ID NO: 823436 - protein, 18 aa, Mycobacterium
HLAFIIMGSRDESARVNL

SEQ ID NO: 823437 - protein, 17 aa, Mycobacterium
HLAIGLAAARDGASRDG

SEQ ID NO: 823438 - protein, 18 aa, Mycobacterium
HLAKLRLQPAYEQVLEKG

SEQ ID NO: 823439 - protein, 19 aa, Mycobacterium
HLALRALELSPAGLTTITD

SEQ ID NO: 823440 - protein, 27 aa, Mycobacterium
HLAMRRTLWLVGVEDLPFIQSAASDRV

SEQ ID NO: 823441 - protein, 24 aa, Mycobacterium
HLAMRRTLWVVRHEDLAAIQAAAS

SEQ ID NO: 823442 - protein, 17 aa, Mycobacterium
HLAQTADRLGYHRFWVA

SEQ ID NO: 823443 - protein, 17 aa, Mycobacterium
HLARDPLDPLFDVDSVI

SEQ ID NO: 823444 - protein, 20 aa, Mycobacterium
HLARIRAVNPALNALVEADD

SEQ ID NO: 823445 - protein, 26 aa, Mycobacterium
HLARQLKAMQFLRGGRRWLLKSPQHL

SEQ ID NO: 823446 - protein, 27 aa, Mycobacterium
HLARQLKAMQFLRGGRRWLLKSPQHLE

SEQ ID NO: 823447 - protein, 22 aa, Mycobacterium
HLATLRLQPAYEQALERGRDAV

SEQ ID NO: 823448 - protein, 22 aa, Mycobacterium
HLATLRLQPVYEQALERGRDAL

SEQ ID NO: 823449 - protein, 18 aa, Mycobacterium
HLATRLSGLFRTRRFRVY

SEQ ID NO: 823450 - protein, 25 aa, Mycobacterium
HLATRLSGLFRTRRFRVYTTDDVIG

SEQ ID NO: 823451 - protein, 27 aa, Mycobacterium
HLAVDAVSWRILLEDFNIAWAQHHGGQ

SEQ ID NO: 823452 - protein, 27 aa, Mycobacterium
HLAVDGVSWRILLEDLNIAWAQHHGGQ

SEQ ID NO: 823453 - protein, 27 aa, Mycobacterium
HLAVDGVSWRILLEDLNIAWAQHHSGQ

SEQ ID NO: 823454 - protein, 27 aa, Mycobacterium
HLAVDVVSWHILLGDLAAAWRSLNGGA

SEQ ID NO: 823455 - protein, 17 aa, Mycobacterium
HLAYLRYGRGRHPAGLN

SEQ ID NO: 823456 - protein, 26 aa, Mycobacterium
HLCATLGPRFTPPKLLRAKVAEGNLG

SEQ ID NO: 823457 - protein, 23 aa, Mycobacterium
HLCERLLSFASPLHLYAEEIEPR

SEQ ID NO: 823458 - protein, 24 aa, Mycobacterium
HLCERLLSFASPLHLYAEEIEPRT

SEQ ID NO: 823459 - protein, 18 aa, Mycobacterium
HLCLARTGHLLLDLARRN

SEQ ID NO: 823460 - protein, 18 aa, Mycobacterium
HLDAAWAAEQPGFRGERL

SEQ ID NO: 823461 - protein, 28 aa, Mycobacterium
HLDADSVGWLRDFLRAHTGGLIIISHNV

SEQ ID NO: 823462 - protein, 24 aa, Mycobacterium
HLDAEGFLFYHGRTDDMFKVSGAT

SEQ ID NO: 823463 - protein, 25 aa, Mycobacterium
HLDAEMIRRALDTLAPRRARVLFIE

SEQ ID NO: 823464 - protein, 19 aa, Mycobacterium
HLDALTAHLHKHVPWGAHL

SEQ ID NO: 823465 - protein, 24 aa, Mycobacterium
HLDAPLVWCVAALLGQHPLSAEQA

SEQ ID NO: 823466 - protein, 23 aa, Mycobacterium
HLDATDRWSIGLSGGPDSLALTA

SEQ ID NO: 823467 - protein, 27 aa, Mycobacterium
HLDATFARLLIMEILMGYKALVQGGAP

SEQ ID NO: 823468 - protein, 20 aa, Mycobacterium
HLDCVYGKTEAWYVLQTRGD

SEQ ID NO: 823469 - protein, 28 aa, Mycobacterium
HLDEILTRLLEVWPVPVRRIALIGHSMG

SEQ ID NO: 823470 - protein, 28 aa, Mycobacterium
HLDKGFDGRLLIKDLSFTLPRNGIVGVI

SEQ ID NO: 823471 - protein, 17 aa, Mycobacterium
HLDLFNRDHGPPYSPEF

SEQ ID NO: 823472 - protein, 25 aa, Mycobacterium
HLDPQAALLVRLLAERAGFCVIAGD

SEQ ID NO: 823473 - protein, 17 aa, Mycobacterium
HLDQDIVFGMRAFEFLE

SEQ ID NO: 823474 - protein, 20 aa, Mycobacterium
HLDTILAQTALNLTWDAARE

SEQ ID NO: 823475 - protein, 22 aa, Mycobacterium
HLDTTPLEYLRRIRLERAHREL

SEQ ID NO: 823476 - protein, 28 aa, Mycobacterium
HLDVGVTSIYWYFRRKDDLLDAMTELAL

SEQ ID NO: 823477 - protein, 27 aa, Mycobacterium
HLDVRHTFDVLALPATLGVTAVIALHD

SEQ ID NO: 823478 - protein, 17 aa, Mycobacterium
HLEAALALDVRVLVLGG

SEQ ID NO: 823479 - protein, 24 aa, Mycobacterium
HLEALGPAMRRALTTAGIVRPDVV

SEQ ID NO: 823480 - protein, 20 aa, Mycobacterium
HLEALGPTMRRALAAAGVGK

SEQ ID NO: 823481 - protein, 22 aa, Mycobacterium
HLEHQRHLQPASGHWGHLQARQ

SEQ ID NO: 823482 - protein, 29 aa, Mycobacterium
HLEIGRAHAPWFHWGTTAVVARLVQQFGA

SEQ ID NO: 823483 - protein, 18 aa, Mycobacterium
HLEILIATSAARHRTTRD

SEQ ID NO: 823484 - protein, 24 aa, Mycobacterium
HLELAGLMALPPREADPDQAFRRL

SEQ ID NO: 823485 - protein, 18 aa, Mycobacterium
HLELGESLGLIDMARGAK

SEQ ID NO: 823486 - protein, 22 aa, Mycobacterium
HLETLPYQFGAPELLGARNVAL

SEQ ID NO: 823487 - protein, 19 aa, Mycobacterium
HLEVFKDYVRNLASWLQSA

SEQ ID NO: 823488 - protein, 20 aa, Mycobacterium
HLEVRFDGHAALLSDLNSTN

SEQ ID NO: 823489 - protein, 24 aa, Mycobacterium
HLEWFSQKQVDWIHRLRSELPNIE

SEQ ID NO: 823490 - protein, 21 aa, Mycobacterium
HLFEAYAMTNLLLCSAVDHGT

SEQ ID NO: 823491 - protein, 19 aa, Mycobacterium
HLFEVRGALESLACSLFAR

SEQ ID NO: 823492 - protein, 20 aa, Mycobacterium
HLFTLLMDHHWQDGVSCAVD

SEQ ID NO: 823493 - protein, 25 aa, Mycobacterium
HLGAKPIFVDIVPESWCIDPELAEA

SEQ ID NO: 823494 - protein, 18 aa, Mycobacterium
HLGARSAAFIARLLEMAP

SEQ ID NO: 823495 - protein, 25 aa, Mycobacterium
HLGDLARYLIAIRRRLDRLPHAVAA

SEQ ID NO: 823496 - protein, 25 aa, Mycobacterium
HLGEPYGPGFYAFGDLLSAWRDQGD

SEQ ID NO: 823497 - protein, 21 aa, Mycobacterium
HLGGPALFGPIGMVVAAALKS

SEQ ID NO: 823498 - protein, 21 aa, Mycobacterium
HLGGPALFGPIGMVVAAALRS

SEQ ID NO: 823499 - protein, 17 aa, Mycobacterium
HLGGVKELLLRLQEKRE

SEQ ID NO: 823500 - protein, 28 aa, Mycobacterium
HLGHFALTGLLLERLLPVPGSRVVTVSS

SEQ ID NO: 823501 - protein, 18 aa, Mycobacterium
HLGHNCVLAFLDVDGLKK

SEQ ID NO: 823502 - protein, 40 aa, Mycobacterium
HLGIYVTEVRWWGVRPLWFALWSGVFERFPGLRWGATECG

SEQ ID NO: 823503 - protein, 44 aa, Mycobacterium
HLGIYVTEVRWWGVRPLWFALWSGVFERFPRLRWGATECGAFWA

SEQ ID NO: 823504 - protein, 18 aa, Mycobacterium
HLGKRLVAYLTPIGGHVV

SEQ ID NO: 823505 - protein, 24 aa, Mycobacterium
HLGLVNIAVWADPQRRLAAAVISS

SEQ ID NO: 823506 - protein, 19 aa, Mycobacterium
HLGPRRALTGEPLRPALPY

SEQ ID NO: 823507 - protein, 27 aa, Mycobacterium
HLGPSGNYLPKFGPYLSSASNPWGEGI

SEQ ID NO: 823508 - protein, 27 aa, Mycobacterium
HLGPSGNYLPKFGPYLSSGSNPWGESI

SEQ ID NO: 823509 - protein, 17 aa, Mycobacterium
HLGQYWDTSWVANTYVT

SEQ ID NO: 823510 - protein, 17 aa, Mycobacterium
HLGYLSLLHAHFPDLHV

SEQ ID NO: 823511 - protein, 18 aa, Mycobacterium
HLGYRVIAVDLVPERLGR

SEQ ID NO: 823512 - protein, 30 aa, Mycobacterium
HLHNLLAAPPTFRTMPYWESNEPFPMPNEV

SEQ ID NO: 823513 - protein, 30 aa, Mycobacterium
HLHQATVGQPLDWFCSFSSAAAMLGSPGQG

SEQ ID NO: 823514 - protein, 28 aa, Mycobacterium
HLHQGIALQVPPYNYAHPDDLLAAALDT

SEQ ID NO: 823515 - protein, 27 aa, Mycobacterium
HLHQGIALQVPPYSYAHPDDLLATALG

SEQ ID NO: 823516 - protein, 28 aa, Mycobacterium
HLIAADMTWLLSRWTCVFGTPACQGTVE

SEQ ID NO: 823517 - protein, 24 aa, Mycobacterium
HLIDAARTFIFDTGLAPAAVGAAR

SEQ ID NO: 823518 - protein, 18 aa, Mycobacterium
HLIDGLISAIRVISAGIS

SEQ ID NO: 823519 - protein, 31 aa, Mycobacterium
HLIEIPSVSTLFQPLLSTIPLQVFAAGVARA

SEQ ID NO: 823520 - protein, 30 aa, Mycobacterium
HLIEIPSVSTLLQPLLSTIPLQVFAASVAQ

SEQ ID NO: 823521 - protein, 22 aa, Mycobacterium
HLIGLRRRHPWLHEARTTALSV

SEQ ID NO: 823522 - protein, 18 aa, Mycobacterium
HLIHEQFVKALGLSANSY

SEQ ID NO: 823523 - protein, 31 aa, Mycobacterium
HLINDLFARDWALRRFAGISNLPAAPQRLGP

SEQ ID NO: 823524 - protein, 29 aa, Mycobacterium
HLIPADLVDQLWPLPSDPRGILPKLTAVG

SEQ ID NO: 823525 - protein, 23 aa, Mycobacterium
HLIRGRFVLAGVTPAVLAKLLGD

SEQ ID NO: 823526 - protein, 27 aa, Mycobacterium
HLISPGNLVIIMSFVHLDEAERADHRA

SEQ ID NO: 823527 - protein, 21 aa, Mycobacterium
HLKALDWARRRFGSDLVWGIE

SEQ ID NO: 823528 - protein, 20 aa, Mycobacterium
HLKALGWARREFGGDLIWGV

SEQ ID NO: 823529 - protein, 33 aa, Mycobacterium
HLKAQGWGRIINISGLGYWQTHSIVRSIRNVSV

SEQ ID NO: 823530 - protein, 27 aa, Mycobacterium
HLKEGDPHAWLIPRISGQAKASFVAIE

SEQ ID NO: 823531 - protein, 24 aa, Mycobacterium
HLKEPLDPLMSRLEMRRMSYVQRM

SEQ ID NO: 823532 - protein, 24 aa, Mycobacterium
HLKGHFATMRHAAAYWRAKSKAGD

SEQ ID NO: 823533 - protein, 33 aa, Mycobacterium
HLKGHFATMRHAASYWRGLSKAGKTVDARIINT

SEQ ID NO: 823534 - protein, 25 aa, Mycobacterium
HLKGTWNGTRLAAAIMRENKRGAIV

SEQ ID NO: 823535 - protein, 17 aa, Mycobacterium
HLKLIVLGHSMGGGVVF

SEQ ID NO: 823536 - protein, 17 aa, Mycobacterium
HLLGDEFTLRDLRLIHE

SEQ ID NO: 823537 - protein, 20 aa, Mycobacterium
HLLMALLTQNDGIAAPLLEA

SEQ ID NO: 823538 - protein, 17 aa, Mycobacterium
HLLPKSREGYKYGDATL

SEQ ID NO: 823539 - protein, 20 aa, Mycobacterium
HLLSRVVGDLPPLELPEVER

SEQ ID NO: 823540 - protein, 17 aa, Mycobacterium
HLLTHRDVTRLKVTVDG

SEQ ID NO: 823541 - protein, 20 aa, Mycobacterium
HLLVGALKRHKSKPVLFLGD

SEQ ID NO: 823542 - protein, 32 aa, Mycobacterium; identical to SEQ ID NO: 127594

SEQ ID NO: 823543 - protein, 25 aa, Mycobacterium
HLMIPFVRTRWELEECLALVDASPL

SEQ ID NO: 823544 - protein, 18 aa, Mycobacterium
HLMPVWQGQGYNSGIRDA

SEQ ID NO: 823545 - protein, 32 aa, Mycobacterium
HLMVASLDHAMWFMRPFRADEWLLYDQSSPSA

SEQ ID NO: 823546 - protein, 32 aa, Mycobacterium
HLMVASLDHAMWFMRPFRADEWLLYDQTSPSA

SEQ ID NO: 823547 - protein, 23 aa, Mycobacterium
HLMWHRVAPALAEDFFIVAPDLR

SEQ ID NO: 823548 - protein, 19 aa, Mycobacterium
HLNAFLMGVGHHEAAWRHP

SEQ ID NO: 823549 - protein, 28 aa, Mycobacterium
HLNESLLLPLLRPLFNRWFRVDVTGVEN

SEQ ID NO: 823550 - protein, 18 aa, Mycobacterium
HLNGGDLVWQVGTGYFGC

SEQ ID NO: 823551 - protein, 17 aa, Mycobacterium
HLNIGVLVVLSQGQWRI

SEQ ID NO: 823552 - protein, 24 aa, Mycobacterium
HLNLLHIITAYYRLKQRPDLEIMP

SEQ ID NO: 823553 - protein, 18 aa, Mycobacterium
HLNVTWLIESLDAGLPKG

SEQ ID NO: 823554 - protein, 18 aa, Mycobacterium
HLPAIKTFGQRFGALARA

SEQ ID NO: 823555 - protein, 24 aa, Mycobacterium
HLPCLPMVAALDRNLGVPSMSVET

SEQ ID NO: 823556 - protein, 24 aa, Mycobacterium
HLPDIIGQVLDRHAQRRGTWRAAW

SEQ ID NO: 823557 - protein, 25 aa, Mycobacterium
HLPEGLGVIGLLIDEPKPLRLEDIS

SEQ ID NO: 823558 - protein, 23 aa, Mycobacterium
HLPGDWTIATGCVAGIHVRWKGI

SEQ ID NO: 823559 - protein, 17 aa, Mycobacterium
HLPHYRTWLDDQDFTPA

SEQ ID NO: 823560 - protein, 17 aa, Mycobacterium
HLPQVNVLPIYGGSSYT

SEQ ID NO: 823561 - protein, 33 aa, Mycobacterium
HLPQWARRWQRLLFDNGWLLPGQPPEFGGRNAT

SEQ ID NO: 823562 - protein, 19 aa, Mycobacterium
HLPRPAGPTMTRKARRTDR

SEQ ID NO: 823563 - protein, 19 aa, Mycobacterium
HLPRRRRYSPVLQPVRQQP

SEQ ID NO: 823564 - protein, 19 aa, Mycobacterium
HLPSWLVNAGPIYVMARID

SEQ ID NO: 823565 - protein, 23 aa, Mycobacterium
HLQADIIAGQLFAKGPYAGIFDS

SEQ ID NO: 823566 - protein, 17 aa, Mycobacterium
HLQRYGFLGVEPGQPVP

SEQ ID NO: 823567 - protein, 32 aa, Mycobacterium; identical to SEQ ID NO: 115138

SEQ ID NO: 823568 - protein, 32 aa, Mycobacterium
HLQVASLDHAMWFMRSFRADEWLLYDQSSPSA

SEQ ID NO: 823569 - protein, 21 aa, Mycobacterium
HLQWHLERQLKTLPLVERTYH

SEQ ID NO: 823570 - protein, 17 aa, Mycobacterium
HLRAGPPELLILAGPEG

SEQ ID NO: 823571 - protein, 17 aa, Mycobacterium
HLRALGRQNPIDEFHRL

SEQ ID NO: 823572 - protein, 33 aa, Mycobacterium
HLRASALDWTVLGPGRLTLDPPTGRITLGRGKG

SEQ ID NO: 823573 - protein, 18 aa, Mycobacterium
HLRAVSEDGPWRILGSSP

SEQ ID NO: 823574 - protein, 29 aa, Mycobacterium
HLRDDLLRSLHQLTGWLSGPAAPAVAAVL

SEQ ID NO: 823575 - protein, 22 aa, Mycobacterium
HLRDVYVSFTIRLYRVRTEHRP

SEQ ID NO: 823576 - protein, 19 aa, Mycobacterium
HLREKFLRATVAVSGANFA

SEQ ID NO: 823577 - protein, 29 aa, Mycobacterium
HLREPYVLYGHSMGGLLAYLMARRLVRNS

SEQ ID NO: 823578 - protein, 17 aa, Mycobacterium
HLRFLLEAVGPELRQYI

SEQ ID NO: 823579 - protein, 18 aa, Mycobacterium
HLRGLHKPLLPEGIAQPE

SEQ ID NO: 823580 - protein, 17 aa, Mycobacterium
HLRGQPLEHELTGRGAR

SEQ ID NO: 823581 - protein, 20 aa, Mycobacterium
HLRHPILEPLSGTLPEPEIW

SEQ ID NO: 823582 - protein, 19 aa, Mycobacterium
HLRIAMTPTFTAYFIGPLV

SEQ ID NO: 823583 - protein, 17 aa, Mycobacterium
HLRKWGIPSRRIVELDW

SEQ ID NO: 823584 - protein, 19 aa, Mycobacterium
HLRLLCKRAANPRPNGPRT

SEQ ID NO: 823585 - protein, 26 aa, Mycobacterium
HLRLPFRQFRYRLGFESLGRGVSDSI

SEQ ID NO: 823586 - protein, 19 aa, Mycobacterium
HLRLRALVSKGFTPRRIRE

SEQ ID NO: 823587 - protein, 21 aa, Mycobacterium
HLRNMAFYNFALRMLKRTQDA

SEQ ID NO: 823588 - protein, 25 aa, Mycobacterium
HLRNRLVVAALHWDNNIRGLLGSMI

SEQ ID NO: 823589 - protein, 23 aa, Mycobacterium
HLRPNHTFRLPGADVPIIMVGPG

SEQ ID NO: 823590 - protein, 18 aa, Mycobacterium
HLRQDLSGALAWEQGVTP

SEQ ID NO: 823591 - protein, 21 aa, Mycobacterium
HLRQLGFEDTHPAWIVRRTMI

SEQ ID NO: 823592 - protein, 29 aa, Mycobacterium
HLRRITPPQTGPFFLMDIDSFWTPVGGSI

SEQ ID NO: 823593 - protein, 17 aa, Mycobacterium
HLRRPWAARAARTAPAG

SEQ ID NO: 823594 - protein, 24 aa, Mycobacterium
HLRTGGYMIDFWGVGYQVAMRMGI

SEQ ID NO: 823595 - protein, 19 aa, Mycobacterium
HLSAALRRDDLSYHAELDW

SEQ ID NO: 823596 - protein, 17 aa, Mycobacterium
HLSALRAIPRLAVVRPA

SEQ ID NO: 823597 - protein, 18 aa, Mycobacterium
HLSARLTTLGPAATLARG

SEQ ID NO: 823598 - protein, 17 aa, Mycobacterium
HLSDFAYRNPACGAALL

SEQ ID NO: 823599 - protein, 23 aa, Mycobacterium
HLSDRLRLAALALGSLDSKAEQP

SEQ ID NO: 823600 - protein, 19 aa, Mycobacterium
HLSFGLGLHFCLGSALARL

SEQ ID NO: 823601 - protein, 17 aa, Mycobacterium
HLSIADGLIYTITRIGL

SEQ ID NO: 823602 - protein, 24 aa, Mycobacterium
HLSNGLAEILKIALIKSGALFDVL

SEQ ID NO: 823603 - protein, 25 aa, Mycobacterium
HLSREFRRAYGESPYSYLMTRRIER

SEQ ID NO: 823604 - protein, 24 aa, Mycobacterium
HLSRQWWSYLADHALLRPDTFIHS

SEQ ID NO: 823605 - protein, 17 aa, Mycobacterium
HLSYHDLLAGISGDQRA

SEQ ID NO: 823606 - protein, 25 aa, Mycobacterium
HLTADQLYPGLTRAEAWPVLCQHLA

SEQ ID NO: 823607 - protein, 26 aa, Mycobacterium
HLTDWAQLLEGCGFDRVLVSEHIAFG

SEQ ID NO: 823608 - protein, 24 aa, Mycobacterium
HLTGPLARFSLNAAALSPIAAEAA

SEQ ID NO: 823609 - protein, 19 aa, Mycobacterium
HLTLVRHARKVPGAVVVVS

SEQ ID NO: 823610 - protein, 25 aa, Mycobacterium
HLTPRAVQYLFRRQLDTTPTEYMRR

SEQ ID NO: 823611 - protein, 23 aa, Mycobacterium
HLTPTEWGMLEMLVRNRGKLVGR

SEQ ID NO: 823612 - protein, 19 aa, Mycobacterium
HLTPTEWSMLAVLVRNRGK

SEQ ID NO: 823613 - protein, 18 aa, Mycobacterium
HLTRLRLITSMLDRGYNI

SEQ ID NO: 823614 - protein, 25 aa, Mycobacterium
HLTTELPLMVIWGDQDRIIPVDHGF

SEQ ID NO: 823615 - protein, 17 aa, Mycobacterium
HLTVFQRTPIWVGPKFD

SEQ ID NO: 823616 - protein, 28 aa, Mycobacterium
HLTYEQILELRTLTWINPPGAPAPVQLA

SEQ ID NO: 823617 - protein, 23 aa, Mycobacterium
HLVAAAHRFSPEVQLILCAGEPD

SEQ ID NO: 823618 - protein, 17 aa, Mycobacterium
HLVAARAKRIPLQHLVG

SEQ ID NO: 823619 - protein, 24 aa, Mycobacterium
HLVAEIYLDLIHEAPYFTDVNDTQ

SEQ ID NO: 823620 - protein, 22 aa, Mycobacterium
HLVAEVFWRRLSAAPPAVHESP

SEQ ID NO: 823621 - protein, 21 aa, Mycobacterium
HLVAEVFWRRLTSSPRCEYGA

SEQ ID NO: 823622 - protein, 21 aa, Mycobacterium
HLVARAINWRAELKGPLVPVD

SEQ ID NO: 823623 - protein, 26 aa, Mycobacterium
HLVAREFPPLTRLPQPAAKTPAQVDH

SEQ ID NO: 823624 - protein, 26 aa, Mycobacterium
HLVDAAHYWSRTADLWEDVFLQMRNQ

SEQ ID NO: 823625 - protein, 24 aa, Mycobacterium
HLVDPAWRRDLPQLLDQLETAGVE

SEQ ID NO: 823626 - protein, 33 aa, Mycobacterium
HLVDSTVYLMAHPCPMCLGSLYYCSPKEVIFLI

SEQ ID NO: 823627 - protein, 17 aa, Mycobacterium
HLVGFVEALRAAGISVG

SEQ ID NO: 823628 - protein, 19 aa, Mycobacterium
HLVGPRAFHRLRLDRNRNL

SEQ ID NO: 823629 - protein, 23 aa, Mycobacterium
HLVGTTLPHPFVDRQLLIVADEH

SEQ ID NO: 823630 - protein, 18 aa, Mycobacterium
HLVHLQFRRFAGCPICNL

SEQ ID NO: 823631 - protein, 25 aa, Mycobacterium
HLVHPGDLVILIAYGTMEEAEARSY

SEQ ID NO: 823632 - protein, 27 aa, Mycobacterium
HLVKAMPQLVPLLPSMNRASRALIRTG

SEQ ID NO: 823633 - protein, 20 aa, Mycobacterium
HLVKSFYRRPLSVGDASGAA

SEQ ID NO: 823634 - protein, 18 aa, Mycobacterium
HLVNLVWNGLTHLEADPQ

SEQ ID NO: 823635 - protein, 27 aa, Mycobacterium
HLVPSMLSTLLLLPQVQQWRQLRHVPV

SEQ ID NO: 823636 - protein, 21 aa, Mycobacterium
HLVSAPLHKLFERHVRQNPDA

SEQ ID NO: 823637 - protein, 19 aa, Mycobacterium
HLVSELYGRRFGGPRWSTS

SEQ ID NO: 823638 - protein, 25 aa, Mycobacterium
HLVTGDIPMAGFPVLGGHEGAGIVT

SEQ ID NO: 823639 - protein, 24 aa, Mycobacterium
HLVVPTPRLFGIPAIADTLDTIAA

SEQ ID NO: 823640 - protein, 30 aa, Mycobacterium
HLVVSYRIEALPRIQLWPLSADGDYGEVED

SEQ ID NO: 823641 - protein, 28 aa, Mycobacterium
HLVVSYRREALPRLALWRVNSDGTYAEP

SEQ ID NO: 823642 - protein, 17 aa, Mycobacterium
HLWPGARPKDWPLQVIP

SEQ ID NO: 823643 - protein, 20 aa, Mycobacterium
HLYAIPRGVNRWAVSLAYLT

SEQ ID NO: 823644 - protein, 27 aa, Mycobacterium
HLYGGYNVIRAAWPHFRENGFGRVVVA

SEQ ID NO: 823645 - protein, 26 aa, Mycobacterium
HLYGGYNVIRAAWPHFREQSFGRVVV

SEQ ID NO: 823646 - protein, 27 aa, Mycobacterium
HLYGGYNVIRAAWPHFREQSFGRVVVA

SEQ ID NO: 823647 - protein, 26 aa, Mycobacterium
HLYGGYNVIRAAWPHFREQSYGRVVV

SEQ ID NO: 823648 - protein, 19 aa, Mycobacterium
HLYGPSGIRYYKGPSSPPE

SEQ ID NO: 823649 - protein, 24 aa, Mycobacterium
HLYPDSLHAMGWDIGTKGFEIVLS

SEQ ID NO: 823650 - protein, 20 aa, Mycobacterium
HLYSFSFDLNAHWSRLWSGQ

SEQ ID NO: 823651 - protein, 21 aa, Mycobacterium
HLYVNRMFVSHIAGYPHDTGR

SEQ ID NO: 823652 - protein, 26 aa, Mycobacterium
HMAGATPFLVGLLAAAQRAGTRLPDL

SEQ ID NO: 823653 - protein, 17 aa, Mycobacterium
HMASLAGAWTALVGGFG

SEQ ID NO: 823654 - protein, 18 aa, Mycobacterium
HMCDTMQRLLDSLDPDEA

SEQ ID NO: 823655 - protein, 22 aa, Mycobacterium
HMCPISMTYAVVPALRHNPELA

SEQ ID NO: 823656 - protein, 19 aa, Mycobacterium
HMEMPAMPLIKFIDGYETV

SEQ ID NO: 823657 - protein, 19 aa, Mycobacterium
HMHVLAPSGVFVPKQLDND

SEQ ID NO: 823658 - protein, 17 aa, Mycobacterium
HMIIMPDADLDQAVDAL

SEQ ID NO: 823659 - protein, 26 aa, Mycobacterium
HMITQYAWGSIWTRPGLDFRSRSMIT

SEQ ID NO: 823660 - protein, 19 aa, Mycobacterium
HMLIEFMQNLPRAELFASS

SEQ ID NO: 823661 - protein, 19 aa, Mycobacterium
HMNEGHAGFLGAERIRELI

SEQ ID NO: 823662 - protein, 19 aa, Mycobacterium
HMNEGHAGFLGAERIRELV

SEQ ID NO: 823663 - protein, 34 aa, Mycobacterium
HMPAWARRWQRLLFDNGWLLPGQPPEFGGRNATV

SEQ ID NO: 823664 - protein, 25 aa, Mycobacterium
HMPSLPATWTVFDPEKGWVVCEIDN

SEQ ID NO: 823665 - protein, 18 aa, Mycobacterium
HMQIGALNRYLRMVAAVT

SEQ ID NO: 823666 - protein, 18 aa, Mycobacterium
HMRGYQAVRTHFFDSYFA

SEQ ID NO: 823667 - protein, 20 aa, Mycobacterium
HMRSLLNKAFTPRAIQNQHQ

SEQ ID NO: 823668 - protein, 17 aa, Mycobacterium
HMSAFMAQAGRLVIRGD

SEQ ID NO: 823669 - protein, 17 aa, Mycobacterium
HMSPPLPMIGAGELVSA

SEQ ID NO: 823670 - protein, 30 aa, Mycobacterium
HMTVMSPAAFIRRPLRWLREMAVKGEDRGG

SEQ ID NO: 823671 - protein, 21 aa, Mycobacterium
HMTVYRRWSNKTDLVLAVLMR

SEQ ID NO: 823672 - protein, 24 aa, Mycobacterium
HMTYVLCEVLAWRGIWLSEERRRI

SEQ ID NO: 823673 - protein, 26 aa, Mycobacterium
HMVAASRHAHWLNPEPRHLWGSGDSA

SEQ ID NO: 823674 - protein, 24 aa, Mycobacterium
HMVADALPTLRYPPTRLASATSLR

SEQ ID NO: 823675 - protein, 25 aa, Mycobacterium
HMVEGMLALTGYFGWHKICVERGIL

SEQ ID NO: 823676 - protein, 27 aa, Mycobacterium
HMVNAMVPMYPALPLSTGVAVWQEEQG

SEQ ID NO: 823677 - protein, 17 aa, Mycobacterium
HMVPAATESYLSAAAAH

SEQ ID NO: 823678 - protein, 24 aa, Mycobacterium
HMVRLLRHVYNVSGIPRLTSDADT

SEQ ID NO: 823679 - protein, 24 aa, Mycobacterium
HMYHALTWGPLVREIVLGATGKGI

SEQ ID NO: 823680 - protein, 22 aa, Mycobacterium
HMYHALTWGPLVREIVYAATGK

SEQ ID NO: 823681 - protein, 23 aa, Mycobacterium
HNAEIRRYLPTAHQLRSIPDVEQ

SEQ ID NO: 823682 - protein, 25 aa, Mycobacterium
HNAGFDIGFLRAAARQCDITWPRPK

SEQ ID NO: 823683 - protein, 23 aa, Mycobacterium
HNAHMYYVLLAPGTDRAGVLAAL

SEQ ID NO: 823684 - protein, 17 aa, Mycobacterium
HNAIALNSSYPSPGSAA

SEQ ID NO: 823685 - protein, 25 aa, Mycobacterium
HNAWPEFVPFLDYPVELRKIVYTTN

SEQ ID NO: 823686 - protein, 24 aa, Mycobacterium
HNAWVEFPIFDAKSRSLKKAFLGK

SEQ ID NO: 823687 - protein, 25 aa, Mycobacterium
HNAWVEFPIFDAKSRSLKKAFLGKA

SEQ ID NO: 823688 - protein, 17 aa, Mycobacterium
HNCQYVFLITNTDPDAP

SEQ ID NO: 823689 - protein, 21 aa, Mycobacterium
HNCVLAFLDVDGLKKVNDELG

SEQ ID NO: 823690 - protein, 17 aa, Mycobacterium
HNDFLSRFAPLTFIGNH

SEQ ID NO: 823691 - protein, 27 aa, Mycobacterium
HNDPKPPPPLPPLPPGGDPTLPFTGTP

SEQ ID NO: 823692 - protein, 17 aa, Mycobacterium
HNELLPAAKRLAATIAG

SEQ ID NO: 823693 - protein, 23 aa, Mycobacterium
HNFFRGAPLPVYAEETCAAIDAL

SEQ ID NO: 823694 - protein, 25 aa, Mycobacterium
HNFHRKIVELNVLAPLLVSQQANAL

SEQ ID NO: 823695 - protein, 21 aa, Mycobacterium
HNFLGAPYWVGRGFGLNLSVV

SEQ ID NO: 823696 - protein, 19 aa, Mycobacterium
HNFVAFRGRELAPEGRLVA

SEQ ID NO: 823697 - protein, 26 aa, Mycobacterium
HNGGCVSFVLMLKLVQQMMVSSSARS

SEQ ID NO: 823698 - protein, 32 aa, Mycobacterium
HNGLAAAVLLQKAGLRTVCLDSKLYAGGMAST

SEQ ID NO: 823699 - protein, 25 aa, Mycobacterium
HNGLTAAALLQQAGLRTVCLDFKLY

SEQ ID NO: 823700 - protein, 26 aa, Mycobacterium
HNGLTAAVLLQRAGLRTLCLDAKLYA

SEQ ID NO: 823701 - protein, 24 aa, Mycobacterium
HNGLTAAVLLQRAGLRTVCLEAKR

SEQ ID NO: 823702 - protein, 24 aa, Mycobacterium
HNGVEWLTFYSVGRTDFCTPDQIG

SEQ ID NO: 823703 - protein, 26 aa, Mycobacterium
HNHIYKPFIESLPSSDPRRADFHVET

SEQ ID NO: 823704 - protein, 19 aa, Mycobacterium
HNIPVDRRPLWIERIEQAE

SEQ ID NO: 823705 - protein, 24 aa, Mycobacterium
HNLETVPRVFRRIRPAFSYERSLS

SEQ ID NO: 823706 - protein, 18 aa, Mycobacterium
HNLIVTARRESLLNELAA

SEQ ID NO: 823707 - protein, 21 aa, Mycobacterium
HNLNRLLPEVLAQGYDAVYVL

SEQ ID NO: 823708 - protein, 18 aa, Mycobacterium
HNLTDWMFGIEHVRFVND

SEQ ID NO: 823709 - protein, 20 aa, Mycobacterium
HNMLAAAPTFRTMPYWESVE

SEQ ID NO: 823710 - protein, 25 aa, Mycobacterium
HNNFGVPYAFGKYDQLFVPEFNAGA

SEQ ID NO: 823711 - protein, 29 aa, Mycobacterium
HNNTPVRSFLLRLGGIRALGYSPELVTAV

SEQ ID NO: 823712 - protein, 24 aa, Mycobacterium
HNPAKVLYGRLPGYHLSERGRAQA

SEQ ID NO: 823713 - protein, 24 aa, Mycobacterium
HNPDQWELVLADPGLVPGAIEEML

SEQ ID NO: 823714 - protein, 26 aa, Mycobacterium
HNPDSYKLRYLGDYLLNGATPPTGSF

SEQ ID NO: 823715 - protein, 18 aa, Mycobacterium
HNPFIKDGQIKFPDGSSI

SEQ ID NO: 823716 - protein, 18 aa, Mycobacterium
HNPIGIIVPCHRVIGANG

SEQ ID NO: 823717 - protein, 20 aa, Mycobacterium
HNPTVYRLLLRSGPPIVERF

SEQ ID NO: 823718 - protein, 22 aa, Mycobacterium
HNPVIYKPRVIGDFLVNGNRPV

SEQ ID NO: 823719 - protein, 20 aa, Mycobacterium
HNQDMWVTLAAAAAVTERVR

SEQ ID NO: 823720 - protein, 20 aa, Mycobacterium
HNQITFWPLTAQGPAGGLHA

SEQ ID NO: 823721 - protein, 25 aa, Mycobacterium
HNRGLPIITFGHSMGALVAFEFVRL

SEQ ID NO: 823722 - protein, 26 aa, Mycobacterium
HNRLPLTMALDQISFAFLWPQIVKAV

SEQ ID NO: 823723 - protein, 20 aa, Mycobacterium
HNRPEWIAVAGLAREYEEVM

SEQ ID NO: 823724 - protein, 23 aa, Mycobacterium
HNRRMPYTIGLLGSVPRLDATQG

SEQ ID NO: 823725 - protein, 20 aa, Mycobacterium
HNRRRIDGSPYRYAASAVEL

SEQ ID NO: 823726 - protein, 29 aa, Mycobacterium
HNRSIPFENLDPLLGIPVADLSAEALSAK

SEQ ID NO: 823727 - protein, 18 aa, Mycobacterium
HNRTYTGYTPILGTPWIA

SEQ ID NO: 823728 - protein, 24 aa, Mycobacterium
HNRVALDRMLIDQLPVIVEKAARG

SEQ ID NO: 823729 - protein, 17 aa, Mycobacterium
HNRVRTIDSAAAKIRQL

SEQ ID NO: 823730 - protein, 20 aa, Mycobacterium
HNSQPWRWRVDAASLHLYAD

SEQ ID NO: 823731 - protein, 23 aa, Mycobacterium
HNSQTIFEPITLLTAMAAVTEHI

SEQ ID NO: 823732 - protein, 32 aa, Mycobacterium
HNTDGSRPVMLWAYDPEAFNGWGKAAIAIGNP

SEQ ID NO: 823733 - protein, 36 aa, Mycobacterium
HNTFHLRHPLMEPLPGTLPEPEIWARLMRALGVVDD

SEQ ID NO: 823734 - protein, 18 aa, Mycobacterium
HNTGFTTATLALLMRHHL

SEQ ID NO: 823735 - protein, 17 aa, Mycobacterium
HNTGLADDRLRVLLADS

SEQ ID NO: 823736 - protein, 18 aa, Mycobacterium
HNTPVRSFMLQLGGIRAL

SEQ ID NO: 823737 - protein, 23 aa, Mycobacterium
HNTQPWRWQVGATTLHLYADTSL

SEQ ID NO: 823738 - protein, 18 aa, Mycobacterium
HNVAFSKPPIGKRGYNED

SEQ ID NO: 823739 - protein, 25 aa, Mycobacterium
HNVETVPRIFRRIRPAFSYRRSLDV

SEQ ID NO: 823740 - protein, 17 aa, Mycobacterium
HNVGFDYSFLAAEAELV

SEQ ID NO: 823741 - protein, 18 aa, Mycobacterium
HNVKLLREHAGTARLMTV

SEQ ID NO: 823742 - protein, 23 aa, Mycobacterium
HNVQRRGFQLLYTRAILVKPPSN

SEQ ID NO: 823743 - protein, 26 aa, Mycobacterium
HPADELPYVGPLLPKLENILVATGFD

SEQ ID NO: 823744 - protein, 18 aa, Mycobacterium
HPAGFPFIAAGLATAAVG

SEQ ID NO: 823745 - protein, 17 aa, Mycobacterium
HPALLPSFPGAHAVPEA

SEQ ID NO: 823746 - protein, 20 aa, Mycobacterium
HPALSLLRTGAAAGFTVVAL

SEQ ID NO: 823747 - protein, 24 aa, Mycobacterium
HPAMMLRSMFPYRAAQHSIIVLVM

SEQ ID NO: 823748 - protein, 19 aa, Mycobacterium
HPAPITLPPQRIKACCAEA

SEQ ID NO: 823749 - protein, 32 aa, Mycobacterium
HPASVGFPPNHPPMRTFLGVPVRTRDKVFGNL

SEQ ID NO: 823750 - protein, 24 aa, Mycobacterium
HPAWDAVCFRLGLLSTLEARAVLN

SEQ ID NO: 823751 - protein, 17 aa, Mycobacterium
HPAWKALTSAHAHDFEP

SEQ ID NO: 823752 - protein, 19 aa, Mycobacterium
HPCPMCLGSLYYCSPDEVV

SEQ ID NO: 823753 - protein, 24 aa, Mycobacterium
HPCQGIYYRGVGRKPKVAMIATHY

SEQ ID NO: 823754 - protein, 23 aa, Mycobacterium
HPCQGLYHRAAGTKPKVAFIATH

SEQ ID NO: 823755 - protein, 23 aa, Mycobacterium
HPCQGLYHRGVGRKPKVAMIAAH

SEQ ID NO: 823756 - protein, 24 aa, Mycobacterium
HPCQGLYHRGVGRKPKVAMIATHY

SEQ ID NO: 823757 - protein, 27 aa, Mycobacterium
HPCTAFDKWRWIPLLNGNGDDPHVVDM

SEQ ID NO: 823758 - protein, 24 aa, Mycobacterium
HPDADIYLSLPGLGVALGARVLGE

SEQ ID NO: 823759 - protein, 27 aa, Mycobacterium
HPDADIYLSLPGLGVILGARVLGEFGD

SEQ ID NO: 823760 - protein, 23 aa, Mycobacterium
HPDAVDFHRWLQWQLDEQLAAAQ

SEQ ID NO: 823761 - protein, 18 aa, Mycobacterium
HPDAVRAALVLAVGARAT

SEQ ID NO: 823762 - protein, 18 aa, Mycobacterium
HPDCKVIIFMGLTDPNAH

SEQ ID NO: 823763 - protein, 34 aa, Mycobacterium
HPDFSTRLLAFALLGLFTGHPYPRACSGFAASDR

SEQ ID NO: 823764 - protein, 38 aa, Mycobacterium
HPDFVHFFFDIGKGDRIAFFYYFGVERFSPDGDAYATH

SEQ ID NO: 823765 - protein, 25 aa, Mycobacterium
HPDGRSAFALWFTGGIFVDQDGKRF

SEQ ID NO: 823766 - protein, 24 aa, Mycobacterium
HPDGRSAFALWFTGGIFVNQDGDR

SEQ ID NO: 823767 - protein, 25 aa, Mycobacterium
HPDGRSAFALWFTGGIFVNQDGDRF

SEQ ID NO: 823768 - protein, 23 aa, Mycobacterium
HPDGVLWGHGWDESGWPDQTPPD

SEQ ID NO: 823769 - protein, 18 aa, Mycobacterium
HPDLLISVDTWRAEVAAK

SEQ ID NO: 823770 - protein, 18 aa, Mycobacterium
HPDLPALTYVEVATGPMV

SEQ ID NO: 823771 - protein, 25 aa, Mycobacterium
HPDNDHFILSKGHASPLLYAAFKAV

SEQ ID NO: 823772 - protein, 20 aa, Mycobacterium
HPDPVLPSLSLLPHPVRTAP

SEQ ID NO: 823773 - protein, 18 aa, Mycobacterium
HPDVLRELLAAFIHALMG

SEQ ID NO: 823774 - protein, 26 aa, Mycobacterium
HPDVVMDNLKFLIGKGIHAVVGTTGF

SEQ ID NO: 823775 - protein, 28 aa, Mycobacterium
HPDWDSSATDRIAFLFPGQGAQHIGMAR

SEQ ID NO: 823776 - protein, 17 aa, Mycobacterium
HPDYFLVVVDHSGADIT

SEQ ID NO: 823777 - protein, 28 aa, Mycobacterium
HPEELQEAFAKAWYKLLHRDMGPISRYL

SEQ ID NO: 823778 - protein, 24 aa, Mycobacterium
HPEFAIARWAARHLTPDRRARATV

SEQ ID NO: 823779 - protein, 28 aa, Mycobacterium
HPEFRTVPMVWYIPPLSPVVDAIGRDGH

SEQ ID NO: 823780 - protein, 22 aa, Mycobacterium
HPEGGEYRWAHAGIVPVLPADI

SEQ ID NO: 823781 - protein, 24 aa, Mycobacterium
HPEGILVVWIELAEHRSFTLEDQT

SEQ ID NO: 823782 - protein, 28 aa, Mycobacterium
HPEGVVRGFGWRVDMFGPDGPSRADLDR

SEQ ID NO: 823783 - protein, 17 aa, Mycobacterium
HPELLVTGHFAPVAGAE

SEQ ID NO: 823784 - protein, 22 aa, Mycobacterium
HPENQPFLRYLRDEVKLSGAQV

SEQ ID NO: 823785 - protein, 19 aa, Mycobacterium
HPEPQILLNYLGRTDLVPS

SEQ ID NO: 823786 - protein, 24 aa, Mycobacterium
HPERFLTVHFSNPAPFIPGVELVA

SEQ ID NO: 823787 - protein, 17 aa, Mycobacterium
HPESFARIFATAGRPLG

SEQ ID NO: 823788 - protein, 23 aa, Mycobacterium
HPEVHYPLRVLVCHRCWLVQTED

SEQ ID NO: 823789 - protein, 22 aa, Mycobacterium
HPEVQESVFRLATALDARSDQT

SEQ ID NO: 823790 - protein, 19 aa, Mycobacterium
HPEVVSWSDYFEKRKRRSV

SEQ ID NO: 823791 - protein, 28 aa, Mycobacterium
HPEYRTVPMVWYIPPLSPVVDAVSRDGH

SEQ ID NO: 823792 - protein, 21 aa, Mycobacterium
HPFFARIWPVIAAHEAQAVRD

SEQ ID NO: 823793 - protein, 18 aa, Mycobacterium
HPFLLSGTGPFTKMGLDN

SEQ ID NO: 823794 - protein, 20 aa, Mycobacterium
HPFLQHLLAHRDVTRLKVTV

SEQ ID NO: 823795 - protein, 24 aa, Mycobacterium
HPGDAFAYDIFSQAGGLIRSAGVL

SEQ ID NO: 823796 - protein, 24 aa, Mycobacterium
HPGGITERFPLMLSSLSAAVTHIR

SEQ ID NO: 823797 - protein, 25 aa, Mycobacterium
HPGHDLLALVPYRQIVERGFVAPDD

SEQ ID NO: 823798 - protein, 18 aa, Mycobacterium
HPGIGCFVVRNGRFLMGR

SEQ ID NO: 823799 - protein, 28 aa, Mycobacterium
HPGIVAPPAMIQVWTMFGLGGERPKDDP

SEQ ID NO: 823800 - protein, 27 aa, Mycobacterium
HPGIVAPPAMIQVWTMFGLGGERPTDD

SEQ ID NO: 823801 - protein, 26 aa, Mycobacterium
HPGIVAPPAMIQVWTMGGLGAGRSDD

SEQ ID NO: 823802 - protein, 26 aa, Mycobacterium
HPGIVAPPAMIQVWTMMGLGGVRADD

SEQ ID NO: 823803 - protein, 27 aa, Mycobacterium
HPGIVAPPAMIQVWTMYGLGGQRPKDD

SEQ ID NO: 823804 - protein, 19 aa, Mycobacterium
HPGLRVGWFEGGIAWVPPA

SEQ ID NO: 823805 - protein, 20 aa, Mycobacterium
HPGNWYFRSSGGPLAAGLLD

SEQ ID NO: 823806 - protein, 25 aa, Mycobacterium
HPGPTRTSMGWSLPAEKIGPALEDW

SEQ ID NO: 823807 - protein, 20 aa, Mycobacterium
HPGQMIIVAARPGVGKALAL

SEQ ID NO: 823808 - protein, 23 aa, Mycobacterium
HPGQPLWGHGWDESAWPQHIAPS

SEQ ID NO: 823809 - protein, 17 aa, Mycobacterium
HPGQPVWGHGWDETSWP

SEQ ID NO: 823810 - protein, 22 aa, Mycobacterium
HPGQRIVGLSKLARLVHGYAAR

SEQ ID NO: 823811 - protein, 21 aa, Mycobacterium
HPGRRRPGALLPHHRQHRAAG

SEQ ID NO: 823812 - protein, 23 aa, Mycobacterium
HPGTYVAGWIKRGPTGFIGTNKS

SEQ ID NO: 823813 - protein, 21 aa, Mycobacterium
HPGWHALRKIAERITTPLLPD

SEQ ID NO: 823814 - protein, 24 aa, Mycobacterium
HPGYAADLLVLTLARIVGKTDHIH

SEQ ID NO: 823815 - protein, 25 aa, Mycobacterium
HPHALQLIMDSLRYWVTEMHVDGFR

SEQ ID NO: 823816 - protein, 19 aa, Mycobacterium
HPHEAFVGLAALLHGATTQ

SEQ ID NO: 823817 - protein, 26 aa, Mycobacterium
HPHEALFGLLAILHGVSSRELRLLQV

SEQ ID NO: 823818 - protein, 17 aa, Mycobacterium
HPHGQIYGYPYLTPRTE

SEQ ID NO: 823819 - protein, 24 aa, Mycobacterium
HPHNGAFLPAIRFSEGVQAHLNAD

SEQ ID NO: 823820 - protein, 22 aa, Mycobacterium
HPHRDMEIITWVLHGSLVHQDS

SEQ ID NO: 823821 - protein, 26 aa, Mycobacterium
HPHSLQLLMDSLRYWVTEMHVDGFRF

SEQ ID NO: 823822 - protein, 19 aa, Mycobacterium
HPHVYEARWPVRMADVDSG

SEQ ID NO: 823823 - protein, 27 aa, Mycobacterium
HPIASPTYRMALLRWLSVCDIRDEHGQ

SEQ ID NO: 823824 - protein, 20 aa, Mycobacterium
HPIDPSLLPAYLGVGPNNMF

SEQ ID NO: 823825 - protein, 23 aa, Mycobacterium
HPIEPGRPCSLLGLLFADADGCA

SEQ ID NO: 823826 - protein, 28 aa, Mycobacterium
HPIEPGRPCWLVGLLFPGADGCAGHSDG

SEQ ID NO: 823827 - protein, 25 aa, Mycobacterium
HPIERVGNFGVWLQRFEAGLRALPN

SEQ ID NO: 823828 - protein, 20 aa, Mycobacterium
HPILYLRMADRLKAGARLIV

SEQ ID NO: 823829 - protein, 18 aa, Mycobacterium
HPIPLLIGGHSEAALRRA

SEQ ID NO: 823830 - protein, 23 aa, Mycobacterium
HPITVWWSEIARVLRPGGTYLAQ

SEQ ID NO: 823831 - protein, 24 aa, Mycobacterium
HPIVHYLHRPIPRDELIAFFVAAD

SEQ ID NO: 823832 - protein, 17 aa, Mycobacterium
HPKKLLRPKVPIAVVVG

SEQ ID NO: 823833 - protein, 25 aa, Mycobacterium
HPKPRLEVNLNRLGGWPTIKGTRVP

SEQ ID NO: 823834 - protein, 19 aa, Mycobacterium
HPKTLQRRLAHEGTTFAVL

SEQ ID NO: 823835 - protein, 22 aa, Mycobacterium
HPKWQERPLLVAVLRKGHSATR

SEQ ID NO: 823836 - protein, 31 aa, Mycobacterium
HPLAAQWLIRVFLGLWAWPLKDPAAERALVE

SEQ ID NO: 823837 - protein, 17 aa, Mycobacterium
HPLAHPDIPAPDGIIVG

SEQ ID NO: 823838 - protein, 26 aa, Mycobacterium
HPLALASPFFMEFDLPARGVQLAVPE

SEQ ID NO: 823839 - protein, 21 aa, Mycobacterium
HPLAPDHPPANKILGPGAGLV

SEQ ID NO: 823840 - protein, 20 aa, Mycobacterium
HPLATLDKMFIPPSGFHVVP

SEQ ID NO: 823841 - protein, 19 aa, Mycobacterium
HPLFERALSRYVGARDAVF

SEQ ID NO: 823842 - protein, 19 aa, Mycobacterium
HPLFGITNLPYGVFSPPDG

SEQ ID NO: 823843 - protein, 25 aa, Mycobacterium
HPLGHRWRWEFVALSPTSTRVTETF

SEQ ID NO: 823844 - protein, 17 aa, Mycobacterium
HPLLGSHVLLPEEPERH

SEQ ID NO: 823845 - protein, 17 aa, Mycobacterium
HPLLVERPEPKRAGVLI

SEQ ID NO: 823846 - protein, 22 aa, Mycobacterium
HPLMLRSYFQARSGPGGKRLIQ

SEQ ID NO: 823847 - protein, 20 aa, Mycobacterium
HPLPESLVGDAARFLLEGMP

SEQ ID NO: 823848 - protein, 20 aa, Mycobacterium
HPLPTPLQFALVVLQRRTQP

SEQ ID NO: 823849 - protein, 17 aa, Mycobacterium
HPLQIATSGLMGFALRP

SEQ ID NO: 823850 - protein, 17 aa, Mycobacterium
HPLRDDFWRSVVPDLPA

SEQ ID NO: 823851 - protein, 18 aa, Mycobacterium
HPLRDLPRPERVMQLCHS

SEQ ID NO: 823852 - protein, 21 aa, Mycobacterium
HPLRPDIPIMLGAEGPKNVAL

SEQ ID NO: 823853 - protein, 19 aa, Mycobacterium
HPLRSDIPVMLGAEGPKNV

SEQ ID NO: 823854 - protein, 31 aa, Mycobacterium
HPLSYGQRSLWFLYQLAPDNPAYTLTYAGRV

SEQ ID NO: 823855 - protein, 20 aa, Mycobacterium
HPMHLHGHTYQIIKADGSLG

SEQ ID NO: 823856 - protein, 28 aa, Mycobacterium
HPMPNQGFRRPMWWRLLDGDRPVVHVTQ

SEQ ID NO: 823857 - protein, 23 aa, Mycobacterium
HPMQAQFPDLPFYADADPAQAVA

SEQ ID NO: 823858 - protein, 18 aa, Mycobacterium
HPMVHYLHRPVPRDELIA

SEQ ID NO: 823859 - protein, 17 aa, Mycobacterium
HPMVLRPGDDHYRPIGW

SEQ ID NO: 823860 - protein, 19 aa, Mycobacterium
HPMVLRPGEAHYRPIDWDD

SEQ ID NO: 823861 - protein, 17 aa, Mycobacterium
HPNGAHSYYVPAQLFPT

SEQ ID NO: 823862 - protein, 23 aa, Mycobacterium
HPNLRAAFWDRGLPKPVQIVPTH

SEQ ID NO: 823863 - protein, 23 aa, Mycobacterium
HPNLRASFFSRGIPRPVQIVPSR

SEQ ID NO: 823864 - protein, 19 aa, Mycobacterium
HPNRRTLLAAALETLGERP

SEQ ID NO: 823865 - protein, 17 aa, Mycobacterium
HPPFRWQRRYAEGFSEQ

SEQ ID NO: 823866 - protein, 25 aa, Mycobacterium
HPPINLLDMPLLTEIDRLLGEVASD

SEQ ID NO: 823867 - protein, 19 aa, Mycobacterium
HPPIWFGANAPKALARAVR

SEQ ID NO: 823868 - protein, 21 aa, Mycobacterium
HPPQQFLYQPAVDKVLREGVD

SEQ ID NO: 823869 - protein, 20 aa, Mycobacterium
HPPVWTPLPVHYADYTLWHH

SEQ ID NO: 823870 - protein, 21 aa, Mycobacterium
HPQIAARPFGMMIGFQGHHAF

SEQ ID NO: 823871 - protein, 22 aa, Mycobacterium
HPQIAARPFGMMIGFRGHHAFG

SEQ ID NO: 823872 - protein, 20 aa, Mycobacterium
HPQIPTTPWHHTHHWIDNAA

SEQ ID NO: 823873 - protein, 20 aa, Mycobacterium
HPQIPTTPWHHTHHWIDTPA

SEQ ID NO: 823874 - protein, 31 aa, Mycobacterium
HPQLSLSLDDACLLMFPRRDLTAGEAEATAN

SEQ ID NO: 823875 - protein, 17 aa, Mycobacterium
HPQLWSRSAHMLRIGLS

SEQ ID NO: 823876 - protein, 27 aa, Mycobacterium
HPQREDLVDLLWRMGIRTIGAFAELAR

SEQ ID NO: 823877 - protein, 18 aa, Mycobacterium
HPRGVLRSLKVGIRATWG

SEQ ID NO: 823878 - protein, 18 aa, Mycobacterium
HPRGVLVIWIELAENRPF

SEQ ID NO: 823879 - protein, 17 aa, Mycobacterium
HPRHEYTRRLLAAVPQP

SEQ ID NO: 823880 - protein, 17 aa, Mycobacterium
HPRIEWEIIMVEASRPL

SEQ ID NO: 823881 - protein, 19 aa, Mycobacterium
HPRILAELARRLIRDDVKW

SEQ ID NO: 823882 - protein, 18 aa, Mycobacterium
HPRLRFLEQTPALAGYEH

SEQ ID NO: 823883 - protein, 22 aa, Mycobacterium
HPRLRQIMLDAIRTLRDSGTTF

SEQ ID NO: 823884 - protein, 19 aa, Mycobacterium
HPRPEYVLLHISDTHLVGD

SEQ ID NO: 823885 - protein, 31 aa, Mycobacterium
HPRPQGAFVRFLFQPYVWPEDSETAMNAGAD

SEQ ID NO: 823886 - protein, 18 aa, Mycobacterium
HPRPVNPPPIWIGGNTAA

SEQ ID NO: 823887 - protein, 18 aa, Mycobacterium
HPRQAGLRRLPRLGRDYA

SEQ ID NO: 823888 - protein, 24 aa, Mycobacterium
HPRSLKVCTLLRKPDAKGAHVDIA

SEQ ID NO: 823889 - protein, 22 aa, Mycobacterium
HPRSLRVCTLLRKPDAKGANVD

SEQ ID NO: 823890 - protein, 18 aa, Mycobacterium
HPRTPRWIYEAISAIDVA

SEQ ID NO: 823891 - protein, 22 aa, Mycobacterium
HPRVHAGLLADTRKPEHLAALK

SEQ ID NO: 823892 - protein, 29 aa, Mycobacterium
HPSALDALRTRLFPLATLVTPNLDEVRLL

SEQ ID NO: 823893 - protein, 24 aa, Mycobacterium
HPSFRPTRVVSLAGPLDMVYAAEH

SEQ ID NO: 823894 - protein, 20 aa, Mycobacterium
HPSGHILVRSCRGGYMHSVA

SEQ ID NO: 823895 - protein, 26 aa, Mycobacterium
HPSRRTYYLVGLRQFCRYAVRRRVML

SEQ ID NO: 823896 - protein, 24 aa, Mycobacterium
HPSRWALLYGSPVPGYHAPPERTV

SEQ ID NO: 823897 - protein, 21 aa, Mycobacterium
HPTGGWWDGVAGPGAPIDTDR

SEQ ID NO: 823898 - protein, 20 aa, Mycobacterium
HPTLRLTTNLRIGIEGREAR

SEQ ID NO: 823899 - protein, 25 aa, Mycobacterium
HPTNLGRLVLSVPAPLPCTARGIVH

SEQ ID NO: 823900 - protein, 28 aa, Mycobacterium
HPTNVNTPLFMNEPTMKLFRPDLENPGP

SEQ ID NO: 823901 - protein, 23 aa, Mycobacterium
HPTSRFRDLILSRAVDIAIGPAS

SEQ ID NO: 823902 - protein, 24 aa, Mycobacterium
HPTTDVLWPQHDPLFPLEWADRLE

SEQ ID NO: 823903 - protein, 18 aa, Mycobacterium
HPTTLRLLDELGLWERFA

SEQ ID NO: 823904 - protein, 23 aa, Mycobacterium
HPVAGIYPVTLDKSKNASAAYLR

SEQ ID NO: 823905 - protein, 18 aa, Mycobacterium
HPVAHFLAEAGLSEPGAA

SEQ ID NO: 823906 - protein, 17 aa, Mycobacterium
HPVARMGYGAMQLFETS

SEQ ID NO: 823907 - protein, 18 aa, Mycobacterium
HPVDLVVALEGLGKWAVP

SEQ ID NO: 823908 - protein, 21 aa, Mycobacterium
HPVELGGVFEIGENDPAPTQL

SEQ ID NO: 823909 - protein, 19 aa, Mycobacterium
HPVERWYRNLRAIGVAEGV

SEQ ID NO: 823910 - protein, 18 aa, Mycobacterium
HPVFRRRRFFEGKPIRSG

SEQ ID NO: 823911 - protein, 23 aa, Mycobacterium
HPVFRRRRFFSGKPLGRRGQDGL

SEQ ID NO: 823912 - protein, 18 aa, Mycobacterium
HPVFRRRRFFSGKPVGRR

SEQ ID NO: 823913 - protein, 21 aa, Mycobacterium
HPVGDRVWAWTLPDGGYGWSN

SEQ ID NO: 823914 - protein, 20 aa, Mycobacterium
HPVGFQWVMEAKANGAEVIH

SEQ ID NO: 823915 - protein, 26 aa, Mycobacterium
HPVGHRWRWEFEALSPTLTRVTETFD

SEQ ID NO: 823916 - protein, 21 aa, Mycobacterium
HPVHRYFLAAKRGEFASGSAT

SEQ ID NO: 823917 - protein, 17 aa, Mycobacterium
HPVIKLDDGTYLVPDSW

SEQ ID NO: 823918 - protein, 22 aa, Mycobacterium
HPVLLESYLDGPEVSLFCVIDG

SEQ ID NO: 823919 - protein, 18 aa, Mycobacterium
HPVPLDPVSWNALQRSLD

SEQ ID NO: 823920 - protein, 23 aa, Mycobacterium
HPVRLFIGSGMPTGLWGRVVDTF

SEQ ID NO: 823921 - protein, 20 aa, Mycobacterium
HPVRTPLNQLLADNGLPLQR

SEQ ID NO: 823922 - protein, 18 aa, Mycobacterium
HPVTDPEQLFAVGYAACF

SEQ ID NO: 823923 - protein, 19 aa, Mycobacterium
HPVVERPEALRWLANQSCI

SEQ ID NO: 823924 - protein, 19 aa, Mycobacterium
HPVVHYLHRPVPRNELIAF

SEQ ID NO: 823925 - protein, 21 aa, Mycobacterium
HPVVHYLHRPVPRNELIAYFV

SEQ ID NO: 823926 - protein, 21 aa, Mycobacterium
HPWEDARVVPLPLDLTDPQSI

SEQ ID NO: 823927 - protein, 21 aa, Mycobacterium
HPWLPGFEPPYVIAVVALDEC

SEQ ID NO: 823928 - protein, 23 aa, Mycobacterium
HPYAPVGIVPLFETIDDLQRGSS

SEQ ID NO: 823929 - protein, 20 aa, Mycobacterium
HPYIAMVPQWDLLDMLAEVG

SEQ ID NO: 823930 - protein, 26 aa, Mycobacterium
HPYQEWLDAGLFQLDELPPGDYVRMP

SEQ ID NO: 823931 - protein, 20 aa, Mycobacterium
HPYRRQIFSGVRLAWDVPKE

SEQ ID NO: 823932 - protein, 28 aa, Mycobacterium
HQAEEIVDGWWWTDGELAQRLADPDWLF

SEQ ID NO: 823933 - protein, 17 aa, Mycobacterium
HQAFLRHQPLQQQSVEN

SEQ ID NO: 823934 - protein, 27 aa, Mycobacterium
HQAGGWLVRVVLSLILWPAEDAEIERQ

SEQ ID NO: 823935 - protein, 18 aa, Mycobacterium
HQAKFHLDRLTAEGLLEC

SEQ ID NO: 823936 - protein, 18 aa, Mycobacterium
HQALRTYAGLDFLTDLRV

SEQ ID NO: 823937 - protein, 23 aa, Mycobacterium
HQARRLVGAPAVVLPPRGAVYGV

SEQ ID NO: 823938 - protein, 22 aa, Mycobacterium
HQARWPVRCLTLHKFRCPQSFD

SEQ ID NO: 823939 - protein, 22 aa, Mycobacterium
HQAYWDAMFAALTQFVAQHGHA

SEQ ID NO: 823940 - protein, 22 aa, Mycobacterium
HQDAFPLLITHGWPGSVVEFHK

SEQ ID NO: 823941 - protein, 24 aa, Mycobacterium
HQDERNFYALDRLWKDCPQVPVDL

SEQ ID NO: 823942 - protein, 26 aa, Mycobacterium
HQDPDNFGNIPPARYTQKNGTPGPDE

SEQ ID NO: 823943 - protein, 24 aa, Mycobacterium
HQDTTPMYREWADKIRNYADSISD

SEQ ID NO: 823944 - protein, 17 aa, Mycobacterium
HQDVPFLGPTPGGAWIA

SEQ ID NO: 823945 - protein, 17 aa, Mycobacterium
HQEIAAVLLSPELADGL

SEQ ID NO: 823946 - protein, 23 aa, Mycobacterium
HQERGHCLAQLGAALQDYADAYF

SEQ ID NO: 823947 - protein, 20 aa, Mycobacterium
HQFAYWRAELADAPKHIALP

SEQ ID NO: 823948 - protein, 23 aa, Mycobacterium
HQFLVDEAYLLDAQRYEAWLDTL

SEQ ID NO: 823949 - protein, 19 aa, Mycobacterium
HQFRYYIRDAPIITDAEFD

SEQ ID NO: 823950 - protein, 17 aa, Mycobacterium
HQGAAELVRPISRKYDL

SEQ ID NO: 823951 - protein, 17 aa, Mycobacterium
HQGAAEMLRPISRKYDL

SEQ ID NO: 823952 - protein, 17 aa, Mycobacterium
HQGFASKLFSLLDDPKP

SEQ ID NO: 823953 - protein, 24 aa, Mycobacterium
HQGLHMWLAEFPQPRPPRDTWESN

SEQ ID NO: 823954 - protein, 23 aa, Mycobacterium
HQGLHMWLAEFPQPRPPRETWET

SEQ ID NO: 823955 - protein, 23 aa, Mycobacterium
HQGLTYFMFDLKAEGITVRPIPQ

SEQ ID NO: 823956 - protein, 24 aa, Mycobacterium
HQGRIIAADLRRLLVGEAPLHVLN

SEQ ID NO: 823957 - protein, 19 aa, Mycobacterium
HQHLLMSEFEYWGVPGPDL

SEQ ID NO: 823958 - protein, 27 aa, Mycobacterium
HQILSGLPLFPYMKIHVTPLAVHPSDV

SEQ ID NO: 823959 - protein, 21 aa, Mycobacterium
HQKFGRWLELIGEPPKSIYEI

SEQ ID NO: 823960 - protein, 32 aa, Mycobacterium
HQKVRLGGSPWFAVSPLMHAAGLWTAFSGFLS

SEQ ID NO: 823961 - protein, 18 aa, Mycobacterium
HQLDELIADAGFSIVGTG

SEQ ID NO: 823962 - protein, 23 aa, Mycobacterium
HQLFRPYPHLDPADLAPVVPVTI

SEQ ID NO: 823963 - protein, 17 aa, Mycobacterium
HQLLGALGFCDESDISV

SEQ ID NO: 823964 - protein, 21 aa, Mycobacterium
HQLPTFLRVVGDLRELLEVLH

SEQ ID NO: 823965 - protein, 25 aa, Mycobacterium
HQLRAHLMIVFPGAVGLFAEIDSPI

SEQ ID NO: 823966 - protein, 23 aa, Mycobacterium
HQMWAAQFIKYENPKTWLNSGGL

SEQ ID NO: 823967 - protein, 27 aa, Mycobacterium
HQNAPALLGLIGLWYSNFFGAQSRAVL

SEQ ID NO: 823968 - protein, 30 aa, Mycobacterium
HQNKPDFPPTLLGSLLLDAGVTPWITLSCR

SEQ ID NO: 823969 - protein, 30 aa, Mycobacterium
HQNRPDFPPTLMSRLLLEAGVTPWITLSCR

SEQ ID NO: 823970 - protein, 24 aa, Mycobacterium
HQNSRWIIEPVLRLLDCCQESDGG

SEQ ID NO: 823971 - protein, 25 aa, Mycobacterium
HQNVTQLLKKLPADLPKAGVWSQWH

SEQ ID NO: 823972 - protein, 22 aa, Mycobacterium
HQPIEHLAALRAIPQLSVVRPG

SEQ ID NO: 823973 - protein, 29 aa, Mycobacterium
HQPMASGLPPLPPAPLTPPAAAAEQPPAD

SEQ ID NO: 823974 - protein, 17 aa, Mycobacterium
HQPPALLMLHPPSETTP

SEQ ID NO: 823975 - protein, 19 aa, Mycobacterium
HQPQRQWDLAKATLAALVA

SEQ ID NO: 823976 - protein, 24 aa, Mycobacterium
HQPRAFLQTRLYEGLNSLPLLIPD

SEQ ID NO: 823977 - protein, 35 aa, Mycobacterium
HQPVGPALLITPWNFPMLMIARKAGAALAAGCPVI

SEQ ID NO: 823978 - protein, 22 aa, Mycobacterium
HQPWPGLIAAYRDRLPVGDDWT

SEQ ID NO: 823979 - protein, 24 aa, Mycobacterium
HQPWPGLIEAYRDRLPIGDDWTTV

SEQ ID NO: 823980 - protein, 23 aa, Mycobacterium
HQPWPGLIEAYRDRLPVGDDWTP

SEQ ID NO: 823981 - protein, 23 aa, Mycobacterium
HQPWPGVIAAYRDRLPVGDDWTP

SEQ ID NO: 823982 - protein, 23 aa, Mycobacterium
HQQECLILWPFRGRLFGGVAPDG

SEQ ID NO: 823983 - protein, 18 aa, Mycobacterium
HQQHCPLFGGTPPPYPGW

SEQ ID NO: 823984 - protein, 22 aa, Mycobacterium
HQQLLMTVFKTLAKKHGMECLF

SEQ ID NO: 823985 - protein, 17 aa, Mycobacterium
HQQQSMILVPMDTPGVT

SEQ ID NO: 823986 - protein, 17 aa, Mycobacterium
HQQSYLDALADAGVEPS

SEQ ID NO: 823987 - protein, 37 aa, Mycobacterium
HQRAIFFPRGIPGRLSWLVLRHLYAAALRALARDVTA

SEQ ID NO: 823988 - protein, 24 aa, Mycobacterium
HQRALDEWRLLTAAALVGLVEETM

SEQ ID NO: 823989 - protein, 27 aa, Mycobacterium
HQRAVAAWLWSHRRGVLAGLTAAAWHG

SEQ ID NO: 823990 - protein, 25 aa, Mycobacterium
HQREPLIFSIGAWLGVPTFVVLRDV

SEQ ID NO: 823991 - protein, 34 aa, Mycobacterium
HQRFTQRLGRMLELIHRHYLSPNLAVSCPDATLA

SEQ ID NO: 823992 - protein, 23 aa, Mycobacterium
HQRPSRVLLAGHLDTVPVAGNLP

SEQ ID NO: 823993 - protein, 27 aa, Mycobacterium
HQRQPIRHPIRLPLRVFRRRRARISRL

SEQ ID NO: 823994 - protein, 23 aa, Mycobacterium
HQRRLLMPAFHRDAVARQATQMA

SEQ ID NO: 823995 - protein, 24 aa, Mycobacterium
HQRYGWQWNIVPLLKIPGVTNVHR

SEQ ID NO: 823996 - protein, 18 aa, Mycobacterium
HQSFFGVLMAIVSSMLVG

SEQ ID NO: 823997 - protein, 25 aa, Mycobacterium
HQSRELVIGLFFESAQRAYDRADPA

SEQ ID NO: 823998 - protein, 21 aa, Mycobacterium
HQSRHYSLYLALQLKARYEGM

SEQ ID NO: 823999 - protein, 17 aa, Mycobacterium
HQSWIRELRDTETEARE

SEQ ID NO: 824000 - protein, 24 aa, Mycobacterium
HQTARTTLRLLFEMIKGEDRLAEL

SEQ ID NO: 824001 - protein, 17 aa, Mycobacterium
HQTFYSCGDSRYLLELI

SEQ ID NO: 824002 - protein, 20 aa, Mycobacterium
HQVARLLRDARFLRIGEGPS

SEQ ID NO: 824003 - protein, 17 aa, Mycobacterium
HQVDFNRRLLGLGLDAR

SEQ ID NO: 824004 - protein, 20 aa, Mycobacterium
HQVIGYLRRLLNGEVIDFVE

SEQ ID NO: 824005 - protein, 22 aa, Mycobacterium
HQVKFHLDRLTAEGLLETDYAR

SEQ ID NO: 824006 - protein, 17 aa, Mycobacterium
HQVLPAAPWRHRRHWIS

SEQ ID NO: 824007 - protein, 28 aa, Mycobacterium
HQVTEAQAWPVLRRHLALLAIEGHDPIA

SEQ ID NO: 824008 - protein, 18 aa, Mycobacterium
HQWIAAHLSWNGGANDGW

SEQ ID NO: 824009 - protein, 29 aa, Mycobacterium
HQYVDLVSMFAPITRWAAGVPTARAIPEM

SEQ ID NO: 824010 - protein, 22 aa, Mycobacterium
HRAAMWGATWQTPALVAEYGLS

SEQ ID NO: 824011 - protein, 22 aa, Mycobacterium
HRAAWRAARLLVLDAFTTAEAA

SEQ ID NO: 824012 - protein, 18 aa, Mycobacterium
HRAHQAMYVDKLLEMGLA

SEQ ID NO: 824013 - protein, 24 aa, Mycobacterium
HRAIGNPWLCAQGIKLIDNDLFRD

SEQ ID NO: 824014 - protein, 22 aa, Mycobacterium
HRAILGPRRGLGTSFLPGAPRP

SEQ ID NO: 824015 - protein, 20 aa, Mycobacterium
HRALGPLFTRLAAVSGGAMP

SEQ ID NO: 824016 - protein, 30 aa, Mycobacterium
HRALIDLNNWTLLKWLDEPCTFYDWRSSET

SEQ ID NO: 824017 - protein, 24 aa, Mycobacterium
HRALLDNSALLPSVLAASMVPDIG

SEQ ID NO: 824018 - protein, 19 aa, Mycobacterium
HRALRRQACPCRPRRAATS

SEQ ID NO: 824019 - protein, 17 aa, Mycobacterium
HRAMALLAIDRTLRSMW

SEQ ID NO: 824020 - protein, 18 aa, Mycobacterium
HRAMIEAFLEWRAQTRGA

SEQ ID NO: 824021 - protein, 41 aa, Mycobacterium
HRAMTGWQRLHFRFGLPAPLLEPLAVERLYLDNYFSVDKAR

SEQ ID NO: 824022 - protein, 17 aa, Mycobacterium
HRANTAIAEQLRATAQR

SEQ ID NO: 824023 - protein, 18 aa, Mycobacterium
HRAPQYVHRGFFSTVSHP

SEQ ID NO: 824024 - protein, 28 aa, Mycobacterium
HRAPYGVDFLHNTWRFGIDRVLAGVALS

SEQ ID NO: 824025 - protein, 27 aa, Mycobacterium
HRARAMAMLMLALPGAVFLYNGEELGL

SEQ ID NO: 824026 - protein, 18 aa, Mycobacterium
HRARRPAHWRTVETADVA

SEQ ID NO: 824027 - protein, 23 aa, Mycobacterium
HRASFVQIHFALDALPEFAPPYE

SEQ ID NO: 824028 - protein, 24 aa, Mycobacterium
HRASFVQIHFALDGLPEFAAPYEF

SEQ ID NO: 824029 - protein, 24 aa, Mycobacterium
HRASFVQIHFALDGLPEFAPPYEF

SEQ ID NO: 824030 - protein, 29 aa, Mycobacterium
HRATPSQLALAWLLKRSPAMLPIPGTSSV

SEQ ID NO: 824031 - protein, 26 aa, Mycobacterium
HRAVGEMWLGLLRVPGAFESIMRLVG

SEQ ID NO: 824032 - protein, 20 aa, Mycobacterium
HRCLAIVDIYPGPNGPIEIH

SEQ ID NO: 824033 - protein, 25 aa, Mycobacterium
HRDARKRVLTMRRTFRRHRKQLAAV

SEQ ID NO: 824034 - protein, 25 aa, Mycobacterium
HRDDFQIILVDTPGLHRPRTLLGKR

SEQ ID NO: 824035 - protein, 17 aa, Mycobacterium
HRDFFDAEIVSCPDKSV

SEQ ID NO: 824036 - protein, 26 aa, Mycobacterium
HRDHRGPLLPILHAVQERLGCVPAEA

SEQ ID NO: 824037 - protein, 17 aa, Mycobacterium
HRDIEVITDMWGRPRVR

SEQ ID NO: 824038 - protein, 24 aa, Mycobacterium
HRDLGRVDVFMRGTHKIRVVWQGS

SEQ ID NO: 824039 - protein, 18 aa, Mycobacterium
HRDMEIVTWVLRGSLVHQ

SEQ ID NO: 824040 - protein, 30 aa, Mycobacterium
HRDQKLVFHRPILAGDKLWFDSYLDSVTES

SEQ ID NO: 824041 - protein, 17 aa, Mycobacterium
HRDRIGALWSRFSAVAA

SEQ ID NO: 824042 - protein, 24 aa, Mycobacterium
HRDRRRMMLPPFQREAVAHQAQLM

SEQ ID NO: 824043 - protein, 31 aa, Mycobacterium
HRDWNARYTWPRFVCALPREFFAAVRAELDA

SEQ ID NO: 824044 - protein, 23 aa, Mycobacterium
HREAYQRIFARLGVRYVIVSAVS

SEQ ID NO: 824045 - protein, 25 aa, Mycobacterium
HREAYQRIFARLQVRYVIVSAVSGA

SEQ ID NO: 824046 - protein, 33 aa, Mycobacterium; identical to SEQ ID NO: 219178

SEQ ID NO: 824047 - protein, 18 aa, Mycobacterium
HREFLFADAREYLRKGMP

SEQ ID NO: 824048 - protein, 20 aa, Mycobacterium
HREFLRAWRAGTDELRAWFD

SEQ ID NO: 824049 - protein, 25 aa, Mycobacterium
HREGAVLHPVGWPAADFQGPICGPG

SEQ ID NO: 824050 - protein, 24 aa, Mycobacterium
HREGHERYTIDLVLAEERQLLNMV

SEQ ID NO: 824051 - protein, 26 aa, Mycobacterium
HREHLLERYFPHASHQVLLLSTDTEI

SEQ ID NO: 824052 - protein, 20 aa, Mycobacterium
HREITGFAGLPRLLDLLAGN

SEQ ID NO: 824053 - protein, 24 aa, Mycobacterium
HRENFQIVLVDTPGLHRPRTLLGQ

SEQ ID NO: 824054 - protein, 30 aa, Mycobacterium
HREPATWTYTSWGTFYRALLADFGTEHYHY

SEQ ID NO: 824055 - protein, 25 aa, Mycobacterium
HREQQGRIIARLLPEVRDLRRMGSC

SEQ ID NO: 824056 - protein, 20 aa, Mycobacterium
HREQYGFPHWVVYDEAHLLG

SEQ ID NO: 824057 - protein, 22 aa, Mycobacterium
HRESRWQAPRPLLDIGLTDVEA

SEQ ID NO: 824058 - protein, 24 aa, Mycobacterium
HREVLAHWPEVIASPTPASAGRVQ

SEQ ID NO: 824059 - protein, 21 aa, Mycobacterium
HRFARVHAYGPLRPTMRHLPT

SEQ ID NO: 824060 - protein, 26 aa, Mycobacterium
HRFDELKMLILMDPPEHELLRKLVRQ

SEQ ID NO: 824061 - protein, 17 aa, Mycobacterium
HRFGERIGALALAIRSG

SEQ ID NO: 824062 - protein, 40 aa, Mycobacterium
HRFILTFHHVVIDGWSLPILLREIFAIYFGQALAPAPSYR

SEQ ID NO: 824063 - protein, 17 aa, Mycobacterium
HRFLPVEELIAAFLPVL

SEQ ID NO: 824064 - protein, 20 aa, Mycobacterium
HRFRYCAPQPRRYTIVGPGK

SEQ ID NO: 824065 - protein, 20 aa, Mycobacterium
HRFTVYPFEDHIAWVLQDKF

SEQ ID NO: 824066 - protein, 17 aa, Mycobacterium
HRFVLTIHHIVIDGWSL

SEQ ID NO: 824067 - protein, 24 aa, Mycobacterium
HRGDGVIYWQVPKGATLDSTIGRT

SEQ ID NO: 824068 - protein, 23 aa, Mycobacterium
HRGEPVLAPIVYTSALNLGELFA

SEQ ID NO: 824069 - protein, 35 aa, Mycobacterium
HRGGNPGFLRLLSPKLLRWPDYLGNSMFMTLGNLH

SEQ ID NO: 824070 - protein, 20 aa, Mycobacterium
HRGKHPAVAWGTWAVNPTPQ

SEQ ID NO: 824071 - protein, 27 aa, Mycobacterium
HRGPLNFYSLYRAHDLHFVVYSAMFEG

SEQ ID NO: 824072 - protein, 21 aa, Mycobacterium
HRGRHLPVRIQPRQPGQPQRP

SEQ ID NO: 824073 - protein, 24 aa, Mycobacterium
HRGRLIERYFPHAAHQVVLLSTDT

SEQ ID NO: 824074 - protein, 26 aa, Mycobacterium
HRGRPFFELLARIGARTPRRVVDLGC

SEQ ID NO: 824075 - protein, 17 aa, Mycobacterium
HRGRRQLRALLADVAKE

SEQ ID NO: 824076 - protein, 17 aa, Mycobacterium
HRGRRQLRGLLADVAKE

SEQ ID NO: 824077 - protein, 26 aa, Mycobacterium
HRGRRQQLWLITLTDEDGRTVARGQV

SEQ ID NO: 824078 - protein, 26 aa, Mycobacterium
HRGVPGGRRFRRAVLRGRGPAAEGGR

SEQ ID NO: 824079 - protein, 19 aa, Mycobacterium
HRGWASVWALHDNPQINRV

SEQ ID NO: 824080 - protein, 18 aa, Mycobacterium
HRGWLFKHTGDGVCAAFA

SEQ ID NO: 824081 - protein, 25 aa, Mycobacterium
HRHAHWLLPAVHWLERDDLLAFTSN

SEQ ID NO: 824082 - protein, 24 aa, Mycobacterium
HRHHFCRSVIRWLQVGYPNGVPGP

SEQ ID NO: 824083 - protein, 27 aa, Mycobacterium
HRHHVNRWFYDCPPAFHRTLGDMYVSD

SEQ ID NO: 824084 - protein, 23 aa, Mycobacterium
HRHLLRYMNWIPAEYVDAMAPTT

SEQ ID NO: 824085 - protein, 18 aa, Mycobacterium
HRHRADPFNLIELGFTGK

SEQ ID NO: 824086 - protein, 18 aa, Mycobacterium
HRHRLLVFVVSDEPEITD

SEQ ID NO: 824087 - protein, 23 aa, Mycobacterium
HRHSGAIELTGAWPGLRCDIDTA

SEQ ID NO: 824088 - protein, 32 aa, Mycobacterium
HRHYAYLKKVLRALTFLRGPRTWVLKSPQHCE

SEQ ID NO: 824089 - protein, 20 aa, Mycobacterium
HRIAFLPDYDMSMARLLYWG

SEQ ID NO: 824090 - protein, 38 aa, Mycobacterium
HRIAFLPNYDMSMARLLYWGCDVWLNNPLRPLEACGTS

SEQ ID NO: 824091 - protein, 28 aa, Mycobacterium
HRIGELLPVVKGLGLRRAWAATIDYTPD

SEQ ID NO: 824092 - protein, 31 aa, Mycobacterium
HRIKRRFRQLLPPPIREIPLLLGGSGERKTL

SEQ ID NO: 824093 - protein, 25 aa, Mycobacterium
HRILDEALICHLGYIRDGEPVVLPT

SEQ ID NO: 824094 - protein, 17 aa, Mycobacterium
HRIPRVHRWGRGVDITG

SEQ ID NO: 824095 - protein, 28 aa, Mycobacterium
HRIQESHAMLGYRLWSVAQELMAAARAG

SEQ ID NO: 824096 - protein, 38 aa, Mycobacterium
HRITFLPDYDMSMARYLYFGCDVWLNNPLRPLEACGTS

SEQ ID NO: 824097 - protein, 17 aa, Mycobacterium
HRIVVNACLDRLRRAKS

SEQ ID NO: 824098 - protein, 20 aa, Mycobacterium
HRLAERLLVDVIGLPWEEVH

SEQ ID NO: 824099 - protein, 23 aa, Mycobacterium
HRLAFLVALGDVVDHRDVFGLLG

SEQ ID NO: 824100 - protein, 17 aa, Mycobacterium
HRLAVVERLPRTANGKL

SEQ ID NO: 824101 - protein, 32 aa, Mycobacterium
HRLDLTVVNPLVDATWRFMTLDHDGKIRMDCS

SEQ ID NO: 824102 - protein, 26 aa, Mycobacterium
HRLDRLTAGVLLFTVRREVRGAYQTL

SEQ ID NO: 824103 - protein, 28 aa, Mycobacterium
HRLEEAGISWRLLPPIPAHGPVDPAALA

SEQ ID NO: 824104 - protein, 17 aa, Mycobacterium
HRLGQHRDGLFGHIDRG

SEQ ID NO: 824105 - protein, 21 aa, Mycobacterium
HRLMLRPWRLDDDVAACAIYG

SEQ ID NO: 824106 - protein, 18 aa, Mycobacterium
HRLPLAIMRLRRIRRRTA

SEQ ID NO: 824107 - protein, 20 aa, Mycobacterium
HRLQAVLRPHRPGFGNVERP

SEQ ID NO: 824108 - protein, 20 aa, Mycobacterium
HRLQLLFFTDPATGRGNLLY

SEQ ID NO: 824109 - protein, 32 aa, Mycobacterium
HRLRCTQKFLTRPKLPLMEQLRVAVPAVQLMS

SEQ ID NO: 824110 - protein, 18 aa, Mycobacterium
HRLRIIHELSSQSPVPAL

SEQ ID NO: 824111 - protein, 18 aa, Mycobacterium
HRLRIVGIDLRDPAQVVA

SEQ ID NO: 824112 - protein, 24 aa, Mycobacterium
HRLSYMGQMSTVLGRRLWETAGNP

SEQ ID NO: 824113 - protein, 19 aa, Mycobacterium
HRLTARTVWAVVGPLHRAV

SEQ ID NO: 824114 - protein, 26 aa, Mycobacterium
HRLVSRARDMLWLNRFRWNRCTTGDT

SEQ ID NO: 824115 - protein, 17 aa, Mycobacterium
HRLWANEGLPGQTSQIL

SEQ ID NO: 824116 - protein, 17 aa, Mycobacterium
HRLYPPQDPRLTGRSDE

SEQ ID NO: 824117 - protein, 17 aa, Mycobacterium
HRLYRDLIALRHSDPDL

SEQ ID NO: 824118 - protein, 33 aa, Mycobacterium
HRMEPGYCEVTAPKWYFVYNHIKTFHAIAACNL

SEQ ID NO: 824119 - protein, 17 aa, Mycobacterium
HRMLLHHFGSRDNLLVA

SEQ ID NO: 824120 - protein, 32 aa, Mycobacterium
HRMVMQTTPGWIASMTDFWLTGAGLAISETTI

SEQ ID NO: 824121 - protein, 21 aa, Mycobacterium
HRNEITEIIPLDGFDGFDELE

SEQ ID NO: 824122 - protein, 23 aa, Mycobacterium
HRNGAVLMMMWSAILDYADRYGY

SEQ ID NO: 824123 - protein, 18 aa, Mycobacterium
HRNGGMLAAGQYLREFVA

SEQ ID NO: 824124 - protein, 20 aa, Mycobacterium
HRNHNGYLLRWDEERLLFDP

SEQ ID NO: 824125 - protein, 19 aa, Mycobacterium
HRNLHRWVMAEVPSVVHWL

SEQ ID NO: 824126 - protein, 23 aa, Mycobacterium
HRPDCVLLDLNLPDAAGIDALHH

SEQ ID NO: 824127 - protein, 24 aa, Mycobacterium
HRPDRGQLKRLFANSWGTQVNRIE

SEQ ID NO: 824128 - protein, 24 aa, Mycobacterium
HRPEGLLYAVLVGAPVAAGRLKAV

SEQ ID NO: 824129 - protein, 21 aa, Mycobacterium
HRPEILLSFGFVPKMESEVGL

SEQ ID NO: 824130 - protein, 22 aa, Mycobacterium
HRPEILLSFGFVPKMESRVGLI

SEQ ID NO: 824131 - protein, 24 aa, Mycobacterium
HRPELLLSFGFIPKVESRVGLINW

SEQ ID NO: 824132 - protein, 23 aa, Mycobacterium
HRPEVLLSFGFVPKLESKIGLID

SEQ ID NO: 824133 - protein, 26 aa, Mycobacterium
HRPFTPSAIRKLLIDALAASGLTDAT

SEQ ID NO: 824134 - protein, 17 aa, Mycobacterium
HRPFWTYAHVPAGSSVD

SEQ ID NO: 824135 - protein, 20 aa, Mycobacterium
HRPKALRQLAVSSGIQVGFS

SEQ ID NO: 824136 - protein, 26 aa, Mycobacterium
HRPLEGFVYAITPFNFTAIAGNLPTA

SEQ ID NO: 824137 - protein, 20 aa, Mycobacterium
HRPLFKIGNLMLVRRRPFDP

SEQ ID NO: 824138 - protein, 17 aa, Mycobacterium
HRPLLAEPLPAPPADDV

SEQ ID NO: 824139 - protein, 25 aa, Mycobacterium
HRPLRDRCPADLFAALIASQNPPVL

SEQ ID NO: 824140 - protein, 18 aa, Mycobacterium
HRPPVSLPAIGFRLSRGV

SEQ ID NO: 824141 - protein, 21 aa, Mycobacterium
HRPQRLAAVDYPIVERRPPAP

SEQ ID NO: 824142 - protein, 29 aa, Mycobacterium
HRPRGLRELLWEPARLYPPDVLGSGLSAG

SEQ ID NO: 824143 - protein, 19 aa, Mycobacterium
HRPRRRADLLRLRRRRRTS

SEQ ID NO: 824144 - protein, 24 aa, Mycobacterium
HRPVIMAGTNVWWGHGERALLRLA

SEQ ID NO: 824145 - protein, 28 aa, Mycobacterium
HRPVPLWQHILVGKRLFDLFAYDADAEQ

SEQ ID NO: 824146 - protein, 34 aa, Mycobacterium
HRPVPLWQHVLVGKRLFDLFDYQADKPAVSSRQA

SEQ ID NO: 824147 - protein, 27 aa, Mycobacterium
HRPVPLWQHVLVGKRLFDLFDYRHSDA

SEQ ID NO: 824148 - protein, 26 aa, Mycobacterium
HRPVPLWQHVLVGKRLFDLFDYRSTE

SEQ ID NO: 824149 - protein, 28 aa, Mycobacterium
HRPVPLWQHVMVGRRLLDLFDYRGSGPS

SEQ ID NO: 824150 - protein, 18 aa, Mycobacterium
HRQFDWNTDFEALVARIV

SEQ ID NO: 824151 - protein, 24 aa, Mycobacterium
HRQHARVWELLWEQCAIGLTDGPD

SEQ ID NO: 824152 - protein, 24 aa, Mycobacterium
HRQQSMMVVPIDAPGLTVRRNLPV

SEQ ID NO: 824153 - protein, 27 aa, Mycobacterium
HRQTPLRARHFVRWLTIWNDTVDAMYR

SEQ ID NO: 824154 - protein, 28 aa, Mycobacterium
HRQYALTVPFMELLFRLAHGSAGTRPAG

SEQ ID NO: 824155 - protein, 25 aa, Mycobacterium
HRQYDPLMSPLVWDLAHIGQQEELW

SEQ ID NO: 824156 - protein, 25 aa, Mycobacterium
HRQYNPLMSPLVWDLAHIGQQEELW

SEQ ID NO: 824157 - protein, 22 aa, Mycobacterium
HRRAARMAVLNTPRLRDLAPDL

SEQ ID NO: 824158 - protein, 18 aa, Mycobacterium
HRRAFRHVVPAFGVALSA

SEQ ID NO: 824159 - protein, 18 aa, Mycobacterium
HRRCEDVRYLGSWPRGTT

SEQ ID NO: 824160 - protein, 29 aa, Mycobacterium
HRRCRSVHHRLLGGATLRSPFVGVRPAPG

SEQ ID NO: 824161 - protein, 39 aa, Mycobacterium
HRRDLAPLANLELFSVAPLLTARNYRELGRNAARHAKGM

SEQ ID NO: 824162 - protein, 18 aa, Mycobacterium
HRRGFLQFRWQRVSRQLT

SEQ ID NO: 824163 - protein, 26 aa, Mycobacterium
HRRHVNRWFYDCPPAFHRSLGDMYVS

SEQ ID NO: 824164 - protein, 30 aa, Mycobacterium
HRRIDVDFNGWWMCMIPRAVAEELGQPLPL

SEQ ID NO: 824165 - protein, 17 aa, Mycobacterium
HRRKLLAPKFHGKAMVQ

SEQ ID NO: 824166 - protein, 24 aa, Mycobacterium
HRRLDRWVSRYRDVHVQPAAARHG

SEQ ID NO: 824167 - protein, 23 aa, Mycobacterium
HRRLLAVAEGLLPVLRTASPTEL

SEQ ID NO: 824168 - protein, 26 aa, Mycobacterium
HRRLTSWLSSLTGLPVFCIDYRLAPK

SEQ ID NO: 824169 - protein, 17 aa, Mycobacterium
HRRLVRSGLPFGTCLDT

SEQ ID NO: 824170 - protein, 17 aa, Mycobacterium
HRRMVLPEPPAHRMERS

SEQ ID NO: 824171 - protein, 28 aa, Mycobacterium
HRRPYGVEFLHNTWRFGIDRVLAGVAMS

SEQ ID NO: 824172 - protein, 23 aa, Mycobacterium
HRRQRVGGFGGHRGQDPLQAADQ

SEQ ID NO: 824173 - protein, 24 aa, Mycobacterium
HRRRDLAAGTLLWHRDRLDEAQRR

SEQ ID NO: 824174 - protein, 19 aa, Mycobacterium
HRRRPLWVGVAIGGTVDGA

SEQ ID NO: 824175 - protein, 23 aa, Mycobacterium
HRRTGIVKVLRYAVSHEGGREIN

SEQ ID NO: 824176 - protein, 32 aa, Mycobacterium; identical to SEQ ID NO: 115173

SEQ ID NO: 824177 - protein, 22 aa, Mycobacterium
HRRVVHPLLATLGRDLRELQRG

SEQ ID NO: 824178 - protein, 24 aa, Mycobacterium
HRRYGWQWNIVPLLKVPGVTNVHR

SEQ ID NO: 824179 - protein, 25 aa, Mycobacterium
HRSETAMMRFLRKLSDRDLALDRTM

SEQ ID NO: 824180 - protein, 24 aa, Mycobacterium
HRSGPPPIWIGANGPRMLHLVGEY

SEQ ID NO: 824181 - protein, 18 aa, Mycobacterium
HRSGSYVLPMPEGKDVKK

SEQ ID NO: 824182 - protein, 25 aa, Mycobacterium
HRSPVGWPEQLWPALTTAGFATELR

SEQ ID NO: 824183 - protein, 39 aa, Mycobacterium
HRTALTVVLKVLRFLGTLPILEPLLPLPGAAQHVASVAA

SEQ ID NO: 824184 - protein, 26 aa, Mycobacterium
HRTGKPHGWIHSELRRRCGGPPIAAA

SEQ ID NO: 824185 - protein, 23 aa, Mycobacterium
HRTIAYRLLATLSQFRYVAKGED

SEQ ID NO: 824186 - protein, 31 aa, Mycobacterium; identical to SEQ ID NO: 676260

SEQ ID NO: 824187 - protein, 26 aa, Mycobacterium
HRTTALDVLLLGGRPIREPVFHYGPF

SEQ ID NO: 824188 - protein, 21 aa, Mycobacterium
HRTTHWPPQLAPIGGIRFARR

SEQ ID NO: 824189 - protein, 27 aa, Mycobacterium
HRVADVLPLTPLQQGLLFHTGTAQGAQ

SEQ ID NO: 824190 - protein, 19 aa, Mycobacterium
HRVAQTDPWALRLAKRAVN

SEQ ID NO: 824191 - protein, 17 aa, Mycobacterium
HRVARWLAEGAPATLDP

SEQ ID NO: 824192 - protein, 20 aa, Mycobacterium
HRVAYLLYTQRKRMERHGVL

SEQ ID NO: 824193 - protein, 19 aa, Mycobacterium
HRVCRYLEDLAGDYHRFYD

SEQ ID NO: 824194 - protein, 24 aa, Mycobacterium
HRVELVVGLHRHARRGTGDLPRRG

SEQ ID NO: 824195 - protein, 23 aa, Mycobacterium
HRVEPLFAAPFFAVVPYEWDRYV

SEQ ID NO: 824196 - protein, 17 aa, Mycobacterium
HRVGFFYLTGHGVAPEL

SEQ ID NO: 824197 - protein, 21 aa, Mycobacterium
HRVLAELAPTVALAAALCPDG

SEQ ID NO: 824198 - protein, 18 aa, Mycobacterium
HRVMAVNVLGVMAGTRDA

SEQ ID NO: 824199 - protein, 27 aa, Mycobacterium
HRVMYTGPFVPEKWYRVLTEEQATVVT

SEQ ID NO: 824200 - protein, 21 aa, Mycobacterium
HRVRLEVGDPPRVLLDGVDWS

SEQ ID NO: 824201 - protein, 22 aa, Mycobacterium
HRVRRRGGLVLSFRPMPGTYAE

SEQ ID NO: 824202 - protein, 22 aa, Mycobacterium
HRVRVIVGNGLRPELWGEFTAR

SEQ ID NO: 824203 - protein, 33 aa, Mycobacterium
HRVTGHDLLFDTLFLYENYPIDTSVPLGFHELA

SEQ ID NO: 824204 - protein, 28 aa, Mycobacterium
HRVTRNYRWLTRGLVLGSTPYPARRAIV

SEQ ID NO: 824205 - protein, 31 aa, Mycobacterium
HRVTVLHFMPGWLEMLIEVGHGRLSSVRVIP

SEQ ID NO: 824206 - protein, 17 aa, Mycobacterium
HRWPPGWEVLELNPAQV

SEQ ID NO: 824207 - protein, 19 aa, Mycobacterium
HRYARHSMVLVPMDTPGIT

SEQ ID NO: 824208 - protein, 26 aa, Mycobacterium
HRYDPELLYISSLFHDIALTRQFRDQ

SEQ ID NO: 824209 - protein, 18 aa, Mycobacterium
HRYDTAAELLLLNEIWQL

SEQ ID NO: 824210 - protein, 40 aa, Mycobacterium
HRYHAGLRRSLVAMRSKRYFRLLDALDAIAAAYPADTAAA

SEQ ID NO: 824211 - protein, 31 aa, Mycobacterium
HRYHLPVSGLVKETFLISGQVFMQVSIDGHE

SEQ ID NO: 824212 - protein, 20 aa, Mycobacterium
HRYHPDIPTPYVIALVELSE

SEQ ID NO: 824213 - protein, 26 aa, Mycobacterium
HSAFYATALAYLLNRLETKRLVIAGQ

SEQ ID NO: 824214 - protein, 26 aa, Mycobacterium
HSAGGLVVSLWLDRLRARGATASAGV

SEQ ID NO: 824215 - protein, 17 aa, Mycobacterium
HSAHMGTICEIAYGFPG

SEQ ID NO: 824216 - protein, 21 aa, Mycobacterium
HSAHMGTICEIAYGLPGYDSV

SEQ ID NO: 824217 - protein, 21 aa, Mycobacterium
HSAHWAYRPVSLDAPRGDAEQ

SEQ ID NO: 824218 - protein, 18 aa, Mycobacterium
HSAIVPYPTDKFGDRVRA

SEQ ID NO: 824219 - protein, 23 aa, Mycobacterium
HSALLQMFERATAGFGWSRPSRS

SEQ ID NO: 824220 - protein, 24 aa, Mycobacterium
HSASPFMVLLTAFSALVRRYAGAS

SEQ ID NO: 824221 - protein, 25 aa, Mycobacterium
HSASPFYRVCDVHRLQLAAADDDYR

SEQ ID NO: 824222 - protein, 33 aa, Mycobacterium
HSASVVLPFLLPDTPVVAWWPAVAPAVPSEDPL

SEQ ID NO: 824223 - protein, 31 aa, Mycobacterium
HSAVERAFFGDPAFPYFRRAIGVLDKATIDN

SEQ ID NO: 824224 - protein, 23 aa, Mycobacterium
HSAVLLLFGAANRDPLRYRDPDT

SEQ ID NO: 824225 - protein, 26 aa, Mycobacterium
HSAYRKMVMPFFTNKVVALNHDAIRE

SEQ ID NO: 824226 - protein, 26 aa, Mycobacterium
HSCAPDLPWKVLQDSSFSAVSVDSST

SEQ ID NO: 824227 - protein, 21 aa, Mycobacterium
HSDFATYRDLIGRTLAGLAVN

SEQ ID NO: 824228 - protein, 28 aa, Mycobacterium
HSDHHLLTGDFPIPCFPVLGGHEGAGII

SEQ ID NO: 824229 - protein, 24 aa, Mycobacterium
HSDKLWGFTGHRLCLDLSSAPAPS

SEQ ID NO: 824230 - protein, 23 aa, Mycobacterium
HSDKTSQWIALPDGFSAASQLGW

SEQ ID NO: 824231 - protein, 23 aa, Mycobacterium
HSDLRNFQRWLADAELTDWLSSA

SEQ ID NO: 824232 - protein, 18 aa, Mycobacterium
HSDPWFARDMAGFPKPIL

SEQ ID NO: 824233 - protein, 23 aa, Mycobacterium
HSDTVDFHRWLQWQIDEQLAAAQ

SEQ ID NO: 824234 - protein, 22 aa, Mycobacterium
HSDVIIMAYTAKYASAFFGPFR

SEQ ID NO: 824235 - protein, 21 aa, Mycobacterium
HSDYGIKQYSMLIGAMKVADD

SEQ ID NO: 824236 - protein, 25 aa, Mycobacterium
HSERFLTDFPGLRLIGLDRDPDALR

SEQ ID NO: 824237 - protein, 29 aa, Mycobacterium
HSEVDTLRRVELLRQLRLGEYDVLIGINL

SEQ ID NO: 824238 - protein, 26 aa, Mycobacterium
HSEVDTLRRVELLRQLRLGEYDVLVG

SEQ ID NO: 824239 - protein, 28 aa, Mycobacterium
HSEWTRACAYDFLIPGRGVAVLLADGSQ

SEQ ID NO: 824240 - protein, 25 aa, Mycobacterium
HSFALRWYCIATFVAWRRTGMLTAQ

SEQ ID NO: 824241 - protein, 23 aa, Mycobacterium
HSFANILPAQPLLRVTGFGYDEA

SEQ ID NO: 824242 - protein, 20 aa, Mycobacterium
HSFIIWDQDPIYDDFLKVCE

SEQ ID NO: 824243 - protein, 24 aa, Mycobacterium
HSFSLARYAGVLLGMSGMPVTYSP

SEQ ID NO: 824244 - protein, 19 aa, Mycobacterium
HSFVVALPHPVRGEVVGAA

SEQ ID NO: 824245 - protein, 26 aa, Mycobacterium
HSGDSHLRIDWAYDTRNFDRYTVEEL

SEQ ID NO: 824246 - protein, 26 aa, Mycobacterium
HSGGRRIWQLADHDTLLVGWRVTPDA

SEQ ID NO: 824247 - protein, 20 aa, Mycobacterium
HSGKWRGFLAPCQDQPHLVA

SEQ ID NO: 824248 - protein, 25 aa, Mycobacterium
HSGNRALALLYRWVEHAFGGREHEL

SEQ ID NO: 824249 - protein, 24 aa, Mycobacterium
HSGSLVRYLEPFAHTVGVMQNHDA

SEQ ID NO: 824250 - protein, 27 aa, Mycobacterium
HSGTKNIVFVLTLDKPATSPVSVAYAT

SEQ ID NO: 824251 - protein, 25 aa, Mycobacterium
HSGYPARELLPHRLVRAALTRAARS

SEQ ID NO: 824252 - protein, 19 aa, Mycobacterium
HSGYWDPFFAACERNQVGI

SEQ ID NO: 824253 - protein, 21 aa, Mycobacterium
HSHAFMVVHRLDNLRRSGRIG

SEQ ID NO: 824254 - protein, 20 aa, Mycobacterium
HSHALDLRRPPWEMHFIEGL

SEQ ID NO: 824255 - protein, 17 aa, Mycobacterium
HSHGKYDLFRSAVLALG

SEQ ID NO: 824256 - protein, 24 aa, Mycobacterium
HSHNDFEDFYILSGQHQVLIDGDD

SEQ ID NO: 824257 - protein, 24 aa, Mycobacterium
HSHRRTRRRWDPNIQRKTYYLPSE

SEQ ID NO: 824258 - protein, 27 aa, Mycobacterium
HSHYWLSGQVGWLARDRWAVPLVHTAH

SEQ ID NO: 824259 - protein, 27 aa, Mycobacterium
HSIAPAYTGRLFTAPVPALRMPDESMD

SEQ ID NO: 824260 - protein, 19 aa, Mycobacterium
HSIGRFLGGAERWLRRVAA

SEQ ID NO: 824261 - protein, 17 aa, Mycobacterium
HSINLPNLLENILPTRP

SEQ ID NO: 824262 - protein, 24 aa, Mycobacterium
HSKLWFAIAAGLLATKRPAAQRGA

SEQ ID NO: 824263 - protein, 25 aa, Mycobacterium
HSLAFDFAVWEIFGSLLYGGRLVMV

SEQ ID NO: 824264 - protein, 30 aa, Mycobacterium
HSLAFDFSVWEIFGSLLYGGRLVIVPDNVV

SEQ ID NO: 824265 - protein, 26 aa, Mycobacterium
HSLAFDFSVWEVFGSLLYGGRLVMVP

SEQ ID NO: 824266 - protein, 19 aa, Mycobacterium
HSLEHDVVFAELGFCAAAM

SEQ ID NO: 824267 - protein, 32 aa, Mycobacterium
HSLIRLGHARLTRFLIRYSRGAWREAQATLVI

SEQ ID NO: 824268 - protein, 30 aa, Mycobacterium
HSLLHAGAIDLRIGGPLRLFPKASEPGALH

SEQ ID NO: 824269 - protein, 23 aa, Mycobacterium
HSLLPLLHAYRHPQHPHNGAFLP

SEQ ID NO: 824270 - protein, 27 aa, Mycobacterium
HSLPRSPGVYLFRGPSAEVLYVGTAVD

SEQ ID NO: 824271 - protein, 24 aa, Mycobacterium
HSLRKVLHLFYYSNGGWLHEMNVS

SEQ ID NO: 824272 - protein, 28 aa, Mycobacterium
HSLRTDGVPFRLITRTPRPDRVRLLVIA

SEQ ID NO: 824273 - protein, 19 aa, Mycobacterium
HSLTMLRGILDVCKSLGIH

SEQ ID NO: 824274 - protein, 17 aa, Mycobacterium
HSLWPSFADVPAGWRVV

SEQ ID NO: 824275 - protein, 18 aa, Mycobacterium
HSLWPTFADTPSGWRVVF

SEQ ID NO: 824276 - protein, 27 aa, Mycobacterium
HSMLSELLRAGWLLRDPVRKTYHLGPA

SEQ ID NO: 824277 - protein, 20 aa, Mycobacterium
HSMSWDRLVLTPGSVTRLFD

SEQ ID NO: 824278 - protein, 18 aa, Mycobacterium
HSPALRETGYWRFVTDPA

SEQ ID NO: 824279 - protein, 18 aa, Mycobacterium
HSPDLPWGGEWHGYEGFK

SEQ ID NO: 824280 - protein, 23 aa, Mycobacterium
HSPGGWFWRYDLQPDGDATAVTL

SEQ ID NO: 824281 - protein, 21 aa, Mycobacterium
HSPLLVACDLQRPGAVNQLQI

SEQ ID NO: 824282 - protein, 34 aa, Mycobacterium
HSPMLRLLCTAWAERGWLAIRFDMPFRRNRPSGP

SEQ ID NO: 824283 - protein, 19 aa, Mycobacterium
HSPNVLPFPDDWHGTGDNP

SEQ ID NO: 824284 - protein, 17 aa, Mycobacterium
HSPRLLAAIKQAARVVP

SEQ ID NO: 824285 - protein, 21 aa, Mycobacterium
HSPTKIDFRLVRKTTTLGGMH

SEQ ID NO: 824286 - protein, 26 aa, Mycobacterium
HSQAGSFVPDLLRRFRAHAPHVQFSL

SEQ ID NO: 824287 - protein, 17 aa, Mycobacterium
HSQLLQVPPVRRTLEVP

SEQ ID NO: 824288 - protein, 17 aa, Mycobacterium
HSRCYAAYPEMFDIDDD

SEQ ID NO: 824289 - protein, 25 aa, Mycobacterium
HSREYYLDIFKRLGVRPRIRHFVSG

SEQ ID NO: 824290 - protein, 17 aa, Mycobacterium
HSRFLNGIAPTAQLPAS

SEQ ID NO: 824291 - protein, 23 aa, Mycobacterium
HSRGPFPGALWLQVRDIEATQAE

SEQ ID NO: 824292 - protein, 20 aa, Mycobacterium
HSRGPFPGALWLQVRDLDAA

SEQ ID NO: 824293 - protein, 19 aa, Mycobacterium
HSRGPFPGALWLQVRDLEA

SEQ ID NO: 824294 - protein, 26 aa, Mycobacterium
HSRHGVLRLGYAWAAVGRHTARLQRD

SEQ ID NO: 824295 - protein, 19 aa, Mycobacterium
HSRLRPPWVTDIDVVFGTS

SEQ ID NO: 824296 - protein, 19 aa, Mycobacterium
HSRRIPDFVKLAEALGCVG

SEQ ID NO: 824297 - protein, 25 aa, Mycobacterium
HSRTSQLIFPVSNLIAYLSDTVELY

SEQ ID NO: 824298 - protein, 17 aa, Mycobacterium
HSRWFVIPERPAGTEEF

SEQ ID NO: 824299 - protein, 17 aa, Mycobacterium
HSSLHWAAAQRGLARRG

SEQ ID NO: 824300 - protein, 21 aa, Mycobacterium
HSSLLPLLHNYRQPERPVRGS

SEQ ID NO: 824301 - protein, 29 aa, Mycobacterium
HSSPIVVGALPFDLSRPAALMRPQSVRFT

SEQ ID NO: 824302 - protein, 28 aa, Mycobacterium
HSSRMWTTIPEILARYSPLGYSAGDIVT

SEQ ID NO: 824303 - protein, 24 aa, Mycobacterium
HSSRRRVVRFTPPGRIAAGYRSGA

SEQ ID NO: 824304 - protein, 22 aa, Mycobacterium
HSSSPGVLFYSPATDADFAAID

SEQ ID NO: 824305 - protein, 26 aa, Mycobacterium
HSSTPIVLPTLLLPPERSSMLLDLPA

SEQ ID NO: 824306 - protein, 24 aa, Mycobacterium
HSTACILCECNCGIVVQLDDRRLA

SEQ ID NO: 824307 - protein, 25 aa, Mycobacterium
HSTAPPPTEIYGGAGGPGGGGSLDS

SEQ ID NO: 824308 - protein, 17 aa, Mycobacterium
HSTASRRQWPGGGPLLG

SEQ ID NO: 824309 - protein, 27 aa, Mycobacterium
HSTEPIPLLPNAIWVYEYGEPRRMGQV

SEQ ID NO: 824310 - protein, 27 aa, Mycobacterium
HSTFFRERWPRLLRSLYPIGGVVFDGD

SEQ ID NO: 824311 - protein, 27 aa, Mycobacterium
HSTFFRERWPRLLRSLYPIGGVVFDGE

SEQ ID NO: 824312 - protein, 28 aa, Mycobacterium
HSTFFRERWPRLLRSLYPIGGVVFDGER

SEQ ID NO: 824313 - protein, 28 aa, Mycobacterium
HSTPVPYLQAYWMYGARGGPSALTGARD

SEQ ID NO: 824314 - protein, 25 aa, Mycobacterium
HSTRASFLRQLGWHTRARGADGLAW

SEQ ID NO: 824315 - protein, 26 aa, Mycobacterium
HSTRNRALGLLYRWVEHAFGGREHEL

SEQ ID NO: 824316 - protein, 22 aa, Mycobacterium
HSTTLTYWRRRLVASDRPNRIF

SEQ ID NO: 824317 - protein, 24 aa, Mycobacterium
HSTTLYYPLVDTPMIKPTRAFDGL

SEQ ID NO: 824318 - protein, 32 aa, Mycobacterium
HSTTTLALTTPLTFRAVPLLKDMTRNAGWGRS

SEQ ID NO: 824319 - protein, 17 aa, Mycobacterium
HSVALLEVLRAMLDDIN

SEQ ID NO: 824320 - protein, 21 aa, Mycobacterium
HSVARLVGAPPGYVGYDAGGQ

SEQ ID NO: 824321 - protein, 19 aa, Mycobacterium
HSVFAVFEPSFIHGMWETG

SEQ ID NO: 824322 - protein, 20 aa, Mycobacterium
HSVILDGTWRDPGTREAAQR

SEQ ID NO: 824323 - protein, 21 aa, Mycobacterium
HSVLPLLDAYREPATPLRGAP

SEQ ID NO: 824324 - protein, 21 aa, Mycobacterium
HSVMYIFAVALQDGSWHHVRS

SEQ ID NO: 824325 - protein, 17 aa, Mycobacterium
HSVPIVFCETRPLAEEW

SEQ ID NO: 824326 - protein, 17 aa, Mycobacterium
HSVTAIVEFPPAGTLTG

SEQ ID NO: 824327 - protein, 30 aa, Mycobacterium
HSVTSPLGAWLLLALVAPVARGAVREQLEE

SEQ ID NO: 824328 - protein, 26 aa, Mycobacterium
HSVTVGRIAYLLGLKGPAVAVDTACS

SEQ ID NO: 824329 - protein, 25 aa, Mycobacterium
HSVVVAADWPLLAAAYRTRGSLRIV

SEQ ID NO: 824330 - protein, 26 aa, Mycobacterium
HSVVVEADWPLLAAAYRTRGSLHIVD

SEQ ID NO: 824331 - protein, 24 aa, Mycobacterium
HSWEAVGTVWYQALTSPKATKNMT

SEQ ID NO: 824332 - protein, 28 aa, Mycobacterium
HSWGVRDWWSMDWIWSALHLDDGTHLHG

SEQ ID NO: 824333 - protein, 17 aa, Mycobacterium
HSYAPGIATILYDFGPE

SEQ ID NO: 824334 - protein, 30 aa, Mycobacterium
HSYDPILVSYLSRAAARWPDRTWCITPREE

SEQ ID NO: 824335 - protein, 19 aa, Mycobacterium
HSYLSSAATLRGLVDVGAH

SEQ ID NO: 824336 - protein, 22 aa, Mycobacterium
HSYLVRRRWATPSQLLLVHCGR

SEQ ID NO: 824337 - protein, 24 aa, Mycobacterium
HSYYVPAQLFPTADGYLALFITHD

SEQ ID NO: 824338 - protein, 25 aa, Mycobacterium
HTAALLRQHLVGRTLTRCDVRVPRY

SEQ ID NO: 824339 - protein, 22 aa, Mycobacterium
HTAARLRQYLAGKTLTRCDIRV

SEQ ID NO: 824340 - protein, 24 aa, Mycobacterium
HTAEQVFIPLTVGGGVRTVADVDA

SEQ ID NO: 824341 - protein, 24 aa, Mycobacterium
HTAEQVFIPLTVGGGVRTVADVDL

SEQ ID NO: 824342 - protein, 18 aa, Mycobacterium
HTAEYFELLTLAYLARLM

SEQ ID NO: 824343 - protein, 20 aa, Mycobacterium
HTAEYFIRMMAGLGEALGFD

SEQ ID NO: 824344 - protein, 25 aa, Mycobacterium
HTAFDCVWEYPDGALPLRNNGSEVV

SEQ ID NO: 824345 - protein, 24 aa, Mycobacterium
HTAFRAVVDRYFTPSRLADVEPAL

SEQ ID NO: 824346 - protein, 24 aa, Mycobacterium
HTAGDWFIRVFAQRIRICAPNSTI

SEQ ID NO: 824347 - protein, 17 aa, Mycobacterium
HTALRLHKPVIRYDLPA

SEQ ID NO: 824348 - protein, 24 aa, Mycobacterium
HTALTLEALAAHGLSCAGLVIGAW

SEQ ID NO: 824349 - protein, 17 aa, Mycobacterium
HTALVLWAEPRGEIQGV

SEQ ID NO: 824350 - protein, 21 aa, Mycobacterium
HTALVSLRRFVQAHPVMATPY

SEQ ID NO: 824351 - protein, 26 aa, Mycobacterium
HTARVRGPLDEDVDAAWLLDTPTAYV

SEQ ID NO: 824352 - protein, 23 aa, Mycobacterium
HTATDYRRFLDPAALQGARLGVA

SEQ ID NO: 824353 - protein, 18 aa, Mycobacterium
HTDDPVYRWAGRGAPAYH

SEQ ID NO: 824354 - protein, 18 aa, Mycobacterium
HTDEPVFRWVGRGGPVFL

SEQ ID NO: 824355 - protein, 26 aa, Mycobacterium
HTDGVMLWFIQDESGLHLRCRYPDTA

SEQ ID NO: 824356 - protein, 24 aa, Mycobacterium
HTDGYPVLPTPVDALLIGMGERYD

SEQ ID NO: 824357 - protein, 20 aa, Mycobacterium
HTDISVAARFRKVPMVFGHE

SEQ ID NO: 824358 - protein, 19 aa, Mycobacterium
HTDLLTQIRAAANKPVIRP

SEQ ID NO: 824359 - protein, 24 aa, Mycobacterium
HTDLVARTVIYYVLGFTADEQSRL

SEQ ID NO: 824360 - protein, 17 aa, Mycobacterium
HTDVRGGLLFVWHDHEG

SEQ ID NO: 824361 - protein, 20 aa, Mycobacterium
HTDVTFVDRIPKASLLRAVT

SEQ ID NO: 824362 - protein, 20 aa, Mycobacterium
HTEATHHVFWNMSDRGIPRS

SEQ ID NO: 824363 - protein, 25 aa, Mycobacterium
HTEDSWLRHLALEGAARRYGPRAGA

SEQ ID NO: 824364 - protein, 26 aa, Mycobacterium
HTEDSWLRHLAMAGAARRYGPPERAP

SEQ ID NO: 824365 - protein, 28 aa, Mycobacterium
HTEELRVLRLHLLHLLQTVSYNSADLDV

SEQ ID NO: 824366 - protein, 24 aa, Mycobacterium
HTEEVMLGLRLRQGLPLAHLDAGE

SEQ ID NO: 824367 - protein, 18 aa, Mycobacterium
HTEKATLFGLLDATERTG

SEQ ID NO: 824368 - protein, 25 aa, Mycobacterium
HTEKVTLFDLLDVTKRTGIELTESM

SEQ ID NO: 824369 - protein, 17 aa, Mycobacterium
HTEWVYAPPDDPGWRSV

SEQ ID NO: 824370 - protein, 18 aa, Mycobacterium
HTEWVYTPPDDPGWRTVL

SEQ ID NO: 824371 - protein, 27 aa, Mycobacterium
HTEYKGHRWTWELFDAHWWDGITNGHD

SEQ ID NO: 824372 - protein, 20 aa, Mycobacterium
HTFADLRLFPNLVNELRGVP

SEQ ID NO: 824373 - protein, 21 aa, Mycobacterium
HTFAYEFKSWRHKNAIADAPL

SEQ ID NO: 824374 - protein, 18 aa, Mycobacterium
HTFGGWKRSGFGDLNQHG

SEQ ID NO: 824375 - protein, 27 aa, Mycobacterium
HTFRDHYLDLDLDLSDVVFLATANVIE

SEQ ID NO: 824376 - protein, 35 aa, Mycobacterium
HTFREGSNLTAWLYRILHNTWINLYRKRQRRPNEV

SEQ ID NO: 824377 - protein, 23 aa, Mycobacterium
HTGAKLAAALRAGPPPPPDQAQD

SEQ ID NO: 824378 - protein, 24 aa, Mycobacterium
HTGDGWVLIAGDAAWHRLQIEKVR

SEQ ID NO: 824379 - protein, 21 aa, Mycobacterium
HTGEPFVPFDPATDYRRYVDG

SEQ ID NO: 824380 - protein, 17 aa, Mycobacterium
HTGGFNRNTWGVAMIGN

SEQ ID NO: 824381 - protein, 18 aa, Mycobacterium
HTGGPAALPPLPHSAPRR

SEQ ID NO: 824382 - protein, 22 aa, Mycobacterium
HTGKLVLDVPRTGRSRVMVPPA

SEQ ID NO: 824383 - protein, 17 aa, Mycobacterium
HTGPVATTLLLPSVLDA

SEQ ID NO: 824384 - protein, 23 aa, Mycobacterium
HTGPVPTTLLLPSVLDAVQGTGI

SEQ ID NO: 824385 - protein, 20 aa, Mycobacterium
HTGQEFLFVHAGTVELDYGD

SEQ ID NO: 824386 - protein, 30 aa, Mycobacterium
HTGQWPLGPGGPSLVWFGRITPEKAPHLAI

SEQ ID NO: 824387 - protein, 19 aa, Mycobacterium
HTGRELILSCGAVLDHLRV

SEQ ID NO: 824388 - protein, 25 aa, Mycobacterium
HTGRMWRVGFSGFAPGFAYLVGGDE

SEQ ID NO: 824389 - protein, 24 aa, Mycobacterium
HTGRRRAARFLAEGPNLVEAALRR

SEQ ID NO: 824390 - protein, 24 aa, Mycobacterium
HTGRYRPEWSHVVDFPLTAGPDAV

SEQ ID NO: 824391 - protein, 24 aa, Mycobacterium
HTGSLGMLMQLKSAGPVGAPPMAY

SEQ ID NO: 824392 - protein, 18 aa, Mycobacterium
HTGTPLTPAIVWQDRRAE

SEQ ID NO: 824393 - protein, 20 aa, Mycobacterium
HTGWGVFELLLGGDGYRRYP

SEQ ID NO: 824394 - protein, 23 aa, Mycobacterium
HTGWLIVRDALVMGPWHDIERRS

SEQ ID NO: 824395 - protein, 24 aa, Mycobacterium
HTGWLIVRDALVMGPWHDIERRSR

SEQ ID NO: 824396 - protein, 25 aa, Mycobacterium
HTGWLIVRDALVMGPWHDLDRRSRT

SEQ ID NO: 824397 - protein, 18 aa, Mycobacterium
HTGYVWGGVFTVMLAGTA

SEQ ID NO: 824398 - protein, 21 aa, Mycobacterium
HTHEHVHQRGLEGLEGLEEVH

SEQ ID NO: 824399 - protein, 18 aa, Mycobacterium
HTHELRQTVLALLADHDL

SEQ ID NO: 824400 - protein, 24 aa, Mycobacterium
HTHGGQLCLPFYGALVTNCELDRS

SEQ ID NO: 824401 - protein, 26 aa, Mycobacterium
HTHHAHALHSPFWWLKCAVGVSNTDH

SEQ ID NO: 824402 - protein, 27 aa, Mycobacterium
HTHHAHALHSPFWWLKCAVGVSNTDHR

SEQ ID NO: 824403 - protein, 26 aa, Mycobacterium
HTHHSHALHSPFWWLKCAVGTEKNDH

SEQ ID NO: 824404 - protein, 17 aa, Mycobacterium
HTHLPWLAHHGRWPVGE

SEQ ID NO: 824405 - protein, 19 aa, Mycobacterium
HTHRHVHQAGLEDVHSHAH

SEQ ID NO: 824406 - protein, 35 aa, Mycobacterium
HTHRSLANIFSVRLPWQWLGRPAGRRRFRGDRPVL

SEQ ID NO: 824407 - protein, 22 aa, Mycobacterium
HTIARVGPLSGDPYRLAGELGM

SEQ ID NO: 824408 - protein, 17 aa, Mycobacterium
HTIGTLAVWDSTPRRWT

SEQ ID NO: 824409 - protein, 17 aa, Mycobacterium
HTKAWKAMFDAYLSERA

SEQ ID NO: 824410 - protein, 18 aa, Mycobacterium
HTKPPNFWAWLIAQAKGI

SEQ ID NO: 824411 - protein, 21 aa, Mycobacterium
HTLAVYPPDLLIEIPRSICRG

SEQ ID NO: 824412 - protein, 18 aa, Mycobacterium
HTLDLVVLAVEWGSGRRS

SEQ ID NO: 824413 - protein, 23 aa, Mycobacterium
HTLKALTDFPDEKAWLLHDFDNR

SEQ ID NO: 824414 - protein, 20 aa, Mycobacterium
HTLTLGCLVLALTIKGQCNE

SEQ ID NO: 824415 - protein, 35 aa, Mycobacterium
HTLVVGHPFVDIWQAVKPERIGLHAWPTVPRDIEW

SEQ ID NO: 824416 - protein, 23 aa, Mycobacterium
HTMLAELFRRRVFTPHGGIGPDQ

SEQ ID NO: 824417 - protein, 18 aa, Mycobacterium
HTMPGISTFYTFYDDVRV

SEQ ID NO: 824418 - protein, 21 aa, Mycobacterium
HTMRWDRLVLTPGSVTRLFDV

SEQ ID NO: 824419 - protein, 27 aa, Mycobacterium
HTNAHRWIRIWRTRVGPMTLDDAEITA

SEQ ID NO: 824420 - protein, 24 aa, Mycobacterium
HTNERIFDILGAELPKHGFVTAVA

SEQ ID NO: 824421 - protein, 19 aa, Mycobacterium
HTNSLLRKAGIEVITIVGA

SEQ ID NO: 824422 - protein, 25 aa, Mycobacterium
HTPEEMLLHRLAMATVDVLSTAFSR

SEQ ID NO: 824423 - protein, 18 aa, Mycobacterium
HTPLWPDVTHMHEVLGRT

SEQ ID NO: 824424 - protein, 17 aa, Mycobacterium
HTPLWPDVTRMHEVLGR

SEQ ID NO: 824425 - protein, 18 aa, Mycobacterium
HTPNIHLMIPFVRTRWEL

SEQ ID NO: 824426 - protein, 26 aa, Mycobacterium
HTPRDLRIAAANQLALWAAGQECDDF

SEQ ID NO: 824427 - protein, 24 aa, Mycobacterium
HTQNRWHYFHLKAVAHGLLTADDV

SEQ ID NO: 824428 - protein, 17 aa, Mycobacterium
HTQRTFLWQHCTAMVPG

SEQ ID NO: 824429 - protein, 22 aa, Mycobacterium
HTQVFRLWLDAVGVSEDLHGYL

SEQ ID NO: 824430 - protein, 29 aa, Mycobacterium
HTQVPTFLQAVLIMHDFRVEIGMPGAAGL

SEQ ID NO: 824431 - protein, 19 aa, Mycobacterium
HTRAPIPSLLAVSAVHHHL

SEQ ID NO: 824432 - protein, 18 aa, Mycobacterium
HTREWLQRSFWDIPVEET

SEQ ID NO: 824433 - protein, 38 aa, Mycobacterium
HTRLDPSTGYLWTLPMFHCNGWCFTWAVGAAGGTHICL

SEQ ID NO: 824434 - protein, 22 aa, Mycobacterium
HTRLRKLVSRLFTPRSVAALEE

SEQ ID NO: 824435 - protein, 18 aa, Mycobacterium
HTRLRRLVSKAFAPRVVS

SEQ ID NO: 824436 - protein, 22 aa, Mycobacterium
HTRLRVGLPMAPNTVFIAFGEV

SEQ ID NO: 824437 - protein, 17 aa, Mycobacterium
HTRQLIRLALAIGQFMT

SEQ ID NO: 824438 - protein, 20 aa, Mycobacterium
HTRRAIVRLLVESGTITAGE

SEQ ID NO: 824439 - protein, 31 aa, Mycobacterium
HTRRAYLGDLRLLFAFLADRGSALETLSLPL

SEQ ID NO: 824440 - protein, 18 aa, Mycobacterium
HTRRGILTALVTRQLTDI

SEQ ID NO: 824441 - protein, 23 aa, Mycobacterium
HTRRIPDFVKLAEALGCVGLRCE

SEQ ID NO: 824442 - protein, 20 aa, Mycobacterium
HTRRLVALGRPLAGLEMRIV

SEQ ID NO: 824443 - protein, 24 aa, Mycobacterium
HTRSLPLPAWVADAMWSRASLCGS

SEQ ID NO: 824444 - protein, 18 aa, Mycobacterium
HTSALRPLRASLAELTPR

SEQ ID NO: 824445 - protein, 28 aa, Mycobacterium
HTSAVRRELGVPTVFNLLGPLTNPARPR

SEQ ID NO: 824446 - protein, 21 aa, Mycobacterium
HTSLFFLGNSVYLPTGFAPAR

SEQ ID NO: 824447 - protein, 23 aa, Mycobacterium
HTSYFDFTFAGLPAYLQKQGRKV

SEQ ID NO: 824448 - protein, 19 aa, Mycobacterium
HTTDALLASYRRAIGDFTA

SEQ ID NO: 824449 - protein, 27 aa, Mycobacterium
HTTFGREDYWLARLKASNAPTTLDSLV

SEQ ID NO: 824450 - protein, 20 aa, Mycobacterium
HTTFPYVLCDATFCKVHIGA

SEQ ID NO: 824451 - protein, 27 aa, Mycobacterium
HTTRDLPFPFTLTARAENFLYGRPDLT

SEQ ID NO: 824452 - protein, 17 aa, Mycobacterium
HTTVNGDSLLLMRSMPG

SEQ ID NO: 824453 - protein, 25 aa, Mycobacterium
HTTVNTVLQAAYAQLLCWLTGQHDV

SEQ ID NO: 824454 - protein, 24 aa, Mycobacterium
HTTVPPFPDGCELAVFGEGCFWGA

SEQ ID NO: 824455 - protein, 18 aa, Mycobacterium
HTTVVWNLIRRQQQFRSA

SEQ ID NO: 824456 - protein, 24 aa, Mycobacterium
HTTYLRDLATLPGPLPHLTVTVLR

SEQ ID NO: 824457 - protein, 19 aa, Mycobacterium
HTVALLFNRSAEAIVAILA

SEQ ID NO: 824458 - protein, 18 aa, Mycobacterium
HTVDLFTRLAIRAEAALG

SEQ ID NO: 824459 - protein, 18 aa, Mycobacterium
HTVEWHLRKVFAKRGITS

SEQ ID NO: 824460 - protein, 24 aa, Mycobacterium
HTVEWHLRKVFVKLGIGSRRQLRT

SEQ ID NO: 824461 - protein, 28 aa, Mycobacterium
HTVHDAVRWKPYSIGRRLLTGDVADAWS

SEQ ID NO: 824462 - protein, 20 aa, Mycobacterium
HTVIRAFRPHAVKVTAVIGG

SEQ ID NO: 824463 - protein, 19 aa, Mycobacterium
HTVLGIFRDVSRPTYDDAA

SEQ ID NO: 824464 - protein, 25 aa, Mycobacterium
HTVPIRRSRGFAPLPMTVRVPGRRD

SEQ ID NO: 824465 - protein, 17 aa, Mycobacterium
HTVPNQILRFFDAKRRV

SEQ ID NO: 824466 - protein, 18 aa, Mycobacterium
HTVPNQILRFYDANRRLL

SEQ ID NO: 824467 - protein, 24 aa, Mycobacterium
HTVQKALPLLNDGASVILTGSTTA

SEQ ID NO: 824468 - protein, 24 aa, Mycobacterium
HTVRSAEMWLYHRGSPLLLEVGAE

SEQ ID NO: 824469 - protein, 18 aa, Mycobacterium
HTVTWADLRYRVAALAGS

SEQ ID NO: 824470 - protein, 17 aa, Mycobacterium
HTWDTVILGLGEPALAV

SEQ ID NO: 824471 - protein, 19 aa, Mycobacterium
HTWGPLTQKKLAAAIDVWV

SEQ ID NO: 824472 - protein, 17 aa, Mycobacterium
HTWKRSSFSGTEIFGKT

SEQ ID NO: 824473 - protein, 17 aa, Mycobacterium
HTYGQRCWLRQLHPYAT

SEQ ID NO: 824474 - protein, 20 aa, Mycobacterium
HVAARMRVLAAPDLEVIALL

SEQ ID NO: 824475 - protein, 18 aa, Mycobacterium
HVAAVLAGLREPAGPWGP

SEQ ID NO: 824476 - protein, 23 aa, Mycobacterium
HVAAVLTGLREPAGPWGAGRRVE

SEQ ID NO: 824477 - protein, 24 aa, Mycobacterium
HVADQVGNLLYRKTARNFGPVMAT

SEQ ID NO: 824478 - protein, 27 aa, Mycobacterium
HVAELAALWNLEPLQIPHYAPPTHAMQ

SEQ ID NO: 824479 - protein, 17 aa, Mycobacterium
HVAFRDGVTTRLGDDIA

SEQ ID NO: 824480 - protein, 31 aa, Mycobacterium
HVAGHEQLFDTLFLYESYPIDTSAFMGVQEL

SEQ ID NO: 824481 - protein, 27 aa, Mycobacterium
HVAGVDTFFVATAPRYSFVSSSLAKEV

SEQ ID NO: 824482 - protein, 18 aa, Mycobacterium
HVAHALVILLTVGGVPSV

SEQ ID NO: 824483 - protein, 21 aa, Mycobacterium
HVAISFLPACGNCRWCASGYT

SEQ ID NO: 824484 - protein, 18 aa, Mycobacterium
HVALPGRGEPKRAILDSY

SEQ ID NO: 824485 - protein, 19 aa, Mycobacterium
HVALRILHDDTAVTGVLVL

SEQ ID NO: 824486 - protein, 18 aa, Mycobacterium
HVAQRFGAAGLLVYALDH

SEQ ID NO: 824487 - protein, 25 aa, Mycobacterium
HVARAQLRAIFGELLRQLPGIQAGE

SEQ ID NO: 824488 - protein, 18 aa, Mycobacterium
HVARPVPERSVIARAAEI

SEQ ID NO: 824489 - protein, 26 aa, Mycobacterium
HVAVLGRGVTVGRPLGLLLTRRSENA

SEQ ID NO: 824490 - protein, 35 aa, Mycobacterium
HVAVPRSLGVTLWAQRLMPLGLAEALGRALGSGRV

SEQ ID NO: 824491 - protein, 22 aa, Mycobacterium
HVAYQLSFHEGSRYPLDRGAAG

SEQ ID NO: 824492 - protein, 17 aa, Mycobacterium
HVCATAARRLLDAGYTE

SEQ ID NO: 824493 - protein, 22 aa, Mycobacterium
HVCEYLLRQFGAHLLVVGTSEL

SEQ ID NO: 824494 - protein, 17 aa, Mycobacterium
HVCRHRDGPRPWLVWVH

SEQ ID NO: 824495 - protein, 28 aa, Mycobacterium
HVDATFLGLMLIEIHLMYAALVSGGAPI

SEQ ID NO: 824496 - protein, 19 aa, Mycobacterium
HVDGAPLPSFTPGSHIVVE

SEQ ID NO: 824497 - protein, 23 aa, Mycobacterium
HVDGGDFVIIINAEKIALSGNKL

SEQ ID NO: 824498 - protein, 26 aa, Mycobacterium
HVDGLPITLDLPLDSEVRPIVVPDIP

SEQ ID NO: 824499 - protein, 22 aa, Mycobacterium
HVDHPRLGWQRAPVGPVLADAL

SEQ ID NO: 824500 - protein, 23 aa, Mycobacterium
HVDHPRLGWRQAPVGPVLGDALG

SEQ ID NO: 824501 - protein, 18 aa, Mycobacterium
HVDIPLQAYFRINTENMG

SEQ ID NO: 824502 - protein, 18 aa, Mycobacterium
HVDIPWSADLAELCRTYL

SEQ ID NO: 824503 - protein, 27 aa, Mycobacterium
HVDLGPIALALLKRGLPAETELATGPE

SEQ ID NO: 824504 - protein, 26 aa, Mycobacterium
HVDLSRTVGWFTTKYPVALAVGELDW

SEQ ID NO: 824505 - protein, 24 aa, Mycobacterium
HVDLSRTVGWFTTKYPVALQVGGL

SEQ ID NO: 824506 - protein, 24 aa, Mycobacterium
HVDLSRTVGWFTTKYPVALTIDGL

SEQ ID NO: 824507 - protein, 25 aa, Mycobacterium
HVDMWSMLVIARDLLSMLADARIGR

SEQ ID NO: 824508 - protein, 24 aa, Mycobacterium
HVDMWSMLVIARDLLSMLADARTG

SEQ ID NO: 824509 - protein, 18 aa, Mycobacterium
HVDVLWKTVDDFTIQVQR

SEQ ID NO: 824510 - protein, 19 aa, Mycobacterium
HVDWPDQMPDLRPIAGAAL

SEQ ID NO: 824511 - protein, 45 aa, Mycobacterium
HVDWSRVYPAATFALVPLPAHPFRRRRLWITRPPKPLDRNGAINE

SEQ ID NO: 824512 - protein, 19 aa, Mycobacterium
HVEDKLRTVLWGWAGKPID

SEQ ID NO: 824513 - protein, 18 aa, Mycobacterium
HVEHALVVLLTTGGTPSV

SEQ ID NO: 824514 - protein, 19 aa, Mycobacterium
HVEHYYFANAYPAPTRGVP

SEQ ID NO: 824515 - protein, 17 aa, Mycobacterium
HVEIIAKFHKKLPSWVD

SEQ ID NO: 824516 - protein, 30 aa, Mycobacterium
HVERDLRVIIYGWLAFTFEICRQRIMDPGT

SEQ ID NO: 824517 - protein, 23 aa, Mycobacterium
HVERPRRVRQPGEPLRVGVGGPV

SEQ ID NO: 824518 - protein, 21 aa, Mycobacterium
HVERYFSDFLSGVESRRPVLP

SEQ ID NO: 824519 - protein, 25 aa, Mycobacterium
HVETLTGFKWLARADAERPGTLVYA

SEQ ID NO: 824520 - protein, 25 aa, Mycobacterium
HVETLTGFKWLARADAEVPGGTLVY

SEQ ID NO: 824521 - protein, 25 aa, Mycobacterium
HVETLTGFKWLARADARVPDGTLVY

SEQ ID NO: 824522 - protein, 22 aa, Mycobacterium
HVEWMRALAFDVLDLRNVTLVG

SEQ ID NO: 824523 - protein, 23 aa, Mycobacterium
HVEWMRALAFDVLDLRNVTLVGQ

SEQ ID NO: 824524 - protein, 24 aa, Mycobacterium
HVEWMRSLVFDALDLRKVTLVGQD

SEQ ID NO: 824525 - protein, 20 aa, Mycobacterium
HVFDELGIQLTWFDYEGYRD

SEQ ID NO: 824526 - protein, 18 aa, Mycobacterium
HVFESLAFNARIALHVRT

SEQ ID NO: 824527 - protein, 21 aa, Mycobacterium
HVGAMLLFKKPFGRDPVDEIV

SEQ ID NO: 824528 - protein, 20 aa, Mycobacterium
HVGAVMRSRWDLASPAARVR

SEQ ID NO: 824529 - protein, 31 aa, Mycobacterium
HVGEAEFLPLLRRLGRFLPTDVRVVDIVRAP

SEQ ID NO: 824530 - protein, 22 aa, Mycobacterium
HVGGIMIGSWTDLSMLTDGSLG

SEQ ID NO: 824531 - protein, 28 aa, Mycobacterium
HVGKIVVQIPNPLQPRPDRSYLITGGLG

SEQ ID NO: 824532 - protein, 19 aa, Mycobacterium
HVGKPFLAYGQKTKALADG

SEQ ID NO: 824533 - protein, 26 aa, Mycobacterium
HVGLIRTALFNWAYARHTGGDFVFRI

SEQ ID NO: 824534 - protein, 18 aa, Mycobacterium
HVGLPLALVLADEGYNVD

SEQ ID NO: 824535 - protein, 18 aa, Mycobacterium
HVGPFRVPGVPAYIDPES

SEQ ID NO: 824536 - protein, 24 aa, Mycobacterium
HVGRRRAARFLAEGPNLVEAALRR

SEQ ID NO: 824537 - protein, 19 aa, Mycobacterium
HVGRRRAGRFLAEGANLVE

SEQ ID NO: 824538 - protein, 18 aa, Mycobacterium
HVGRRRAGRFLAEGPNLV

SEQ ID NO: 824539 - protein, 24 aa, Mycobacterium
HVGRRRANRFLAEGPNLVEAASAR

SEQ ID NO: 824540 - protein, 17 aa, Mycobacterium
HVGVLLGNTPQMLTALA

SEQ ID NO: 824541 - protein, 18 aa, Mycobacterium
HVGWLAGAIDRDICDPYS

SEQ ID NO: 824542 - protein, 21 aa, Mycobacterium
HVHIPTGPGYQVRFARRIQTE

SEQ ID NO: 824543 - protein, 27 aa, Mycobacterium
HVHLLMARHMFTLWAPKRAGVTDGVTA

SEQ ID NO: 824544 - protein, 19 aa, Mycobacterium
HVHLLVHYPPKVAISRLVN

SEQ ID NO: 824545 - protein, 19 aa, Mycobacterium
HVHRPTTAWLFTGQGSQYP

SEQ ID NO: 824546 - protein, 27 aa, Mycobacterium
HVIAGLNFPFFPRFCGQMFAHLGDRDL

SEQ ID NO: 824547 - protein, 21 aa, Mycobacterium
HVIAIGPSAPYEGPPPGPGDL

SEQ ID NO: 824548 - protein, 26 aa, Mycobacterium
HVIATRGDRLFLGRTRFFGPEQGPDT

SEQ ID NO: 824549 - protein, 18 aa, Mycobacterium
HVIGAIGLITLGRSDELG

SEQ ID NO: 824550 - protein, 19 aa, Mycobacterium
HVILLIRACAVRRAGGLPL

SEQ ID NO: 824551 - protein, 23 aa, Mycobacterium
HVIQRLFAVGLAMQSTHRRSVDP

SEQ ID NO: 824552 - protein, 27 aa, Mycobacterium
HVIRRLSQIMPLLRERLQRLTTGPDSD

SEQ ID NO: 824553 - protein, 19 aa, Mycobacterium
HVITALDGLGWRLVLATGR

SEQ ID NO: 824554 - protein, 18 aa, Mycobacterium
HVIYRTELYTRATAERFA

SEQ ID NO: 824555 - protein, 25 aa, Mycobacterium
HVKAQLARWLAPRGLVFNEDKTRIV

SEQ ID NO: 824556 - protein, 17 aa, Mycobacterium
HVKELVNTGWPVLMALS

SEQ ID NO: 824557 - protein, 29 aa, Mycobacterium
HVKNNIEGQLLPAFKKAWSAGGGAYDTLI

SEQ ID NO: 824558 - protein, 24 aa, Mycobacterium
HVLAGIIYIRDPLMTQLDAALTGN

SEQ ID NO: 824559 - protein, 19 aa, Mycobacterium
HVLAGQRLCIYLDPSREWQ

SEQ ID NO: 824560 - protein, 17 aa, Mycobacterium
HVLALANWDPSAEPSVE

SEQ ID NO: 824561 - protein, 19 aa, Mycobacterium
HVLAPDMLGFGGSAKVVDF

SEQ ID NO: 824562 - protein, 24 aa, Mycobacterium
HVLDRPIVLFTTTGAKSGKKRYVP

SEQ ID NO: 824563 - protein, 19 aa, Mycobacterium
HVLDRYILAKLAQLRDDLT

SEQ ID NO: 824564 - protein, 19 aa, Mycobacterium
HVLFIADGHLHYVYNFLGE

SEQ ID NO: 824565 - protein, 21 aa, Mycobacterium
HVLHALAWLVPGEIAVFGLDE

SEQ ID NO: 824566 - protein, 17 aa, Mycobacterium
HVLIVFDDLSKQADAYR

SEQ ID NO: 824567 - protein, 18 aa, Mycobacterium
HVLIVFDDLSKQAEAYRA

SEQ ID NO: 824568 - protein, 18 aa, Mycobacterium
HVLLPGLVDLHTHLREPG

SEQ ID NO: 824569 - protein, 18 aa, Mycobacterium
HVLLQRDVHYIVRDDAVH

SEQ ID NO: 824570 - protein, 20 aa, Mycobacterium
HVLLWLLDDNPRLGDRIAGS

SEQ ID NO: 824571 - protein, 17 aa, Mycobacterium
HVLPASATFDQIADFKP

SEQ ID NO: 824572 - protein, 17 aa, Mycobacterium
HVLPRRDGDKLSVAKGL

SEQ ID NO: 824573 - protein, 17 aa, Mycobacterium
HVLRDVSLRIGRGEIVA

SEQ ID NO: 824574 - protein, 23 aa, Mycobacterium
HVLRLGLHRLPIDQFGHLRELAP

SEQ ID NO: 824575 - protein, 18 aa, Mycobacterium
HVLRRQLAKASDLGFTCY

SEQ ID NO: 824576 - protein, 17 aa, Mycobacterium
HVLTGHALSRVSPPAIG

SEQ ID NO: 824577 - protein, 24 aa, Mycobacterium
HVLTPDAFVAEVISLLRSSPDADE

SEQ ID NO: 824578 - protein, 27 aa, Mycobacterium
HVLTRVLPWCTRGSVKFLWSEQRGAFQ

SEQ ID NO: 824579 - protein, 18 aa, Mycobacterium
HVLVIGSGPILIGQAAEF

SEQ ID NO: 824580 - protein, 17 aa, Mycobacterium
HVLVIGSGPIVIGQAAE

SEQ ID NO: 824581 - protein, 22 aa, Mycobacterium
HVLWWQVYPLGFVGVHPADTAP

SEQ ID NO: 824582 - protein, 19 aa, Mycobacterium
HVMEDRLPFFTDLEASQRA

SEQ ID NO: 824583 - protein, 20 aa, Mycobacterium
HVMIVPPIKAILESPDLRLS

SEQ ID NO: 824584 - protein, 20 aa, Mycobacterium
HVMRLGLHRLPIGEFPHVRD

SEQ ID NO: 824585 - protein, 17 aa, Mycobacterium
HVMRRMFYTAAKIDAKT

SEQ ID NO: 824586 - protein, 17 aa, Mycobacterium
HVMRTIFEPWESHPLML

SEQ ID NO: 824587 - protein, 18 aa, Mycobacterium
HVMYVWVDALTNYLTGVG

SEQ ID NO: 824588 - protein, 17 aa, Mycobacterium
HVNGTAITGLFAAGNAM

SEQ ID NO: 824589 - protein, 25 aa, Mycobacterium
HVNLRPGRLYPGVTGPLVGNPPIDF

SEQ ID NO: 824590 - protein, 25 aa, Mycobacterium
HVNNVAMFRLIEEARIRFLADKLMG

SEQ ID NO: 824591 - protein, 25 aa, Mycobacterium
HVNPAYQGLRHIPGRGPYPLTDSFY

SEQ ID NO: 824592 - protein, 18 aa, Mycobacterium
HVPAIPFKYRSVDKWHRC

SEQ ID NO: 824593 - protein, 21 aa, Mycobacterium
HVPFINPTDRLGYDVDPALLG

SEQ ID NO: 824594 - protein, 26 aa, Mycobacterium
HVPGDPVFLPTVWDAWSAKLAADAGF

SEQ ID NO: 824595 - protein, 23 aa, Mycobacterium
HVPGGWFWRYDLAPNGHRTDVTL

SEQ ID NO: 824596 - protein, 18 aa, Mycobacterium
HVPGLATFIRSRSGGRWI

SEQ ID NO: 824597 - protein, 40 aa, Mycobacterium
HVPHHPIRLAAFGPRALLPATVLARWFRTERVRALYGGQA

SEQ ID NO: 824598 - protein, 23 aa, Mycobacterium
HVPIATVVRLPDAAPAPIGRVLD

SEQ ID NO: 824599 - protein, 17 aa, Mycobacterium
HVPKALHEAKLAIHDLQ

SEQ ID NO: 824600 - protein, 19 aa, Mycobacterium
HVPLKSTLLAAHLAVNGRL

SEQ ID NO: 824601 - protein, 17 aa, Mycobacterium
HVPLTPGEYTQLTGRAG

SEQ ID NO: 824602 - protein, 25 aa, Mycobacterium
HVPPGSHWPTFVQGLAFILVRKRLM

SEQ ID NO: 824603 - protein, 22 aa, Mycobacterium
HVPRHMFIPFGMGKHKCIGDSF

SEQ ID NO: 824604 - protein, 20 aa, Mycobacterium
HVPVLLWSDPGTGKSSVVRA

SEQ ID NO: 824605 - protein, 17 aa, Mycobacterium
HVQAVLPGPVRSNIFES

SEQ ID NO: 824606 - protein, 29 aa, Mycobacterium
HVQAVRRQYGLPWISAMPTNLYGPNDNYS

SEQ ID NO: 824607 - protein, 19 aa, Mycobacterium
HVQDKLRTVLWGWAGKPID

SEQ ID NO: 824608 - protein, 18 aa, Mycobacterium
HVQDLLDYALRSGESFSS

SEQ ID NO: 824609 - protein, 19 aa, Mycobacterium
HVQKAIAEIPFRPSPRAII

SEQ ID NO: 824610 - protein, 25 aa, Mycobacterium
HVRAARIRARRRRFRRRRRPARAHA

SEQ ID NO: 824611 - protein, 26 aa, Mycobacterium
HVRAGDPVPLYFYPVDLRDCVTPPVA

SEQ ID NO: 824612 - protein, 24 aa, Mycobacterium
HVREFLIEFIAEELELPTADVNDF

SEQ ID NO: 824613 - protein, 24 aa, Mycobacterium
HVRGFPLGPGYLLEGRPVILTAPR

SEQ ID NO: 824614 - protein, 25 aa, Mycobacterium
HVRGFPLGPGYLLEGRPVILTVPRR

SEQ ID NO: 824615 - protein, 17 aa, Mycobacterium
HVRGGFDGLNSWLTGMF

SEQ ID NO: 824616 - protein, 25 aa, Mycobacterium
HVRGRGLLLGIVLAGPHAKAAEVAA

SEQ ID NO: 824617 - protein, 24 aa, Mycobacterium
HVRGTSWPAALRKAGTALSEFGIE

SEQ ID NO: 824618 - protein, 20 aa, Mycobacterium
HVRICILSKRQWHGMFALMG

SEQ ID NO: 824619 - protein, 20 aa, Mycobacterium
HVRNLIRRFVESGVPGYHIE

SEQ ID NO: 824620 - protein, 23 aa, Mycobacterium
HVRPALLFVLDRMRDAAAFVCTD

SEQ ID NO: 824621 - protein, 18 aa, Mycobacterium
HVRPRVVLLGGGEQGREL

SEQ ID NO: 824622 - protein, 25 aa, Mycobacterium
HVRRLLTDAYLRLVAMRLVCTRACD

SEQ ID NO: 824623 - protein, 24 aa, Mycobacterium
HVRRLLVEAAWHHKPRYHVGAVMR

SEQ ID NO: 824624 - protein, 20 aa, Mycobacterium
HVRRSALPRPARVRELLTVT

SEQ ID NO: 824625 - protein, 21 aa, Mycobacterium
HVRSRIQFGRPLADFQAVRFA

SEQ ID NO: 824626 - protein, 17 aa, Mycobacterium
HVRVRGSLTIFDYPAKS

SEQ ID NO: 824627 - protein, 19 aa, Mycobacterium
HVRYRDFVADPVATIGGFY

SEQ ID NO: 824628 - protein, 19 aa, Mycobacterium
HVSGAPIPGLFAAGRCTAG

SEQ ID NO: 824629 - protein, 18 aa, Mycobacterium
HVSGLLDLPGLPVHLHRT

SEQ ID NO: 824630 - protein, 23 aa, Mycobacterium
HVSGMEMTLMEKTIKGCLFGSSN

SEQ ID NO: 824631 - protein, 17 aa, Mycobacterium
HVSPPIIVKYATDLQLL

SEQ ID NO: 824632 - protein, 24 aa, Mycobacterium
HVSSREPYRRLLNQGYIQAHAYTD

SEQ ID NO: 824633 - protein, 37 aa, Mycobacterium
HVSTYTFLADRYPKWWQAPLRWAFRTALGARASLVVR

SEQ ID NO: 824634 - protein, 21 aa, Mycobacterium
HVSVPVRYLPNFSAAAEQVAA

SEQ ID NO: 824635 - protein, 18 aa, Mycobacterium
HVTALIADKFRDGVFYVD

SEQ ID NO: 824636 - protein, 17 aa, Mycobacterium
HVTAWYGLHELARISAG

SEQ ID NO: 824637 - protein, 23 aa, Mycobacterium
HVTDMFPTLLRWVGCDIPDDRII

SEQ ID NO: 824638 - protein, 18 aa, Mycobacterium
HVTELVAQLRRLCAVDVH

SEQ ID NO: 824639 - protein, 17 aa, Mycobacterium
HVTGCNSQLLAATRLGG

SEQ ID NO: 824640 - protein, 24 aa, Mycobacterium
HVTGPLARYALNSSLLTPIAAQAA

SEQ ID NO: 824641 - protein, 19 aa, Mycobacterium
HVTTPHRMLCITSHSVVEV

SEQ ID NO: 824642 - protein, 27 aa, Mycobacterium
HVTVANYEYLVYWRFYQDGNIECEIRA

SEQ ID NO: 824643 - protein, 18 aa, Mycobacterium
HVVAAFDTELFGHWWYEG

SEQ ID NO: 824644 - protein, 19 aa, Mycobacterium
HVVAAKYPINVALHTDHCP

SEQ ID NO: 824645 - protein, 28 aa, Mycobacterium
HVVAANRFALLTLIATNFFGQNAAAIAA

SEQ ID NO: 824646 - protein, 18 aa, Mycobacterium
HVVALCGEVFPVTKSPKP

SEQ ID NO: 824647 - protein, 27 aa, Mycobacterium
HVVALTREVLGAGIPLFGICFGNQILG

SEQ ID NO: 824648 - protein, 18 aa, Mycobacterium
HVVCFFDISLFEKFGLPA

SEQ ID NO: 824649 - protein, 24 aa, Mycobacterium
HVVDLATWKVTEATTLGGAPTQLV

SEQ ID NO: 824650 - protein, 27 aa, Mycobacterium
HVVDVLICATGFRLWDKGSVPPFPVHG

SEQ ID NO: 824651 - protein, 21 aa, Mycobacterium
HVVHLASPALLGYGGVKAARW

SEQ ID NO: 824652 - protein, 24 aa, Mycobacterium
HVVHLASPALLGYGGVRAARWLGV

SEQ ID NO: 824653 - protein, 17 aa, Mycobacterium
HVVHPVRAACAAGVRAV

SEQ ID NO: 824654 - protein, 19 aa, Mycobacterium
HVVHPVRTACAAGAHTIVL

SEQ ID NO: 824655 - protein, 21 aa, Mycobacterium
HVVHPVRTACAAGARTIILTN

SEQ ID NO: 824656 - protein, 20 aa, Mycobacterium
HVVHPVRTACAAGARTVVLT

SEQ ID NO: 824657 - protein, 32 aa, Mycobacterium
HVVIIGRGVTVGRPLGLLLTRRSENATVTLCH

SEQ ID NO: 824658 - protein, 20 aa, Mycobacterium
HVVNLPLTSPFRSSFETKTG

SEQ ID NO: 824659 - protein, 31 aa, Mycobacterium
HVVPVVYNRALHLFWLVITDKPQKVRRQPAA

SEQ ID NO: 824660 - protein, 22 aa, Mycobacterium
HVVRLAGRWLRPGGLLAVEHDD

SEQ ID NO: 824661 - protein, 20 aa, Mycobacterium
HVVTINDYLARRDAEWMAPL

SEQ ID NO: 824662 - protein, 19 aa, Mycobacterium
HVVTINDYLARRDAEWMGP

SEQ ID NO: 824663 - protein, 20 aa, Mycobacterium
HVVVKILTPLEQYAIDAAFT

SEQ ID NO: 824664 - protein, 21 aa, Mycobacterium
HVVVLGLPRGGVPVAFEVARA

SEQ ID NO: 824665 - protein, 17 aa, Mycobacterium
HVVYVWVDALTNYLTGV

SEQ ID NO: 824666 - protein, 17 aa, Mycobacterium
HVWGLGRHYAGSNFFWY

SEQ ID NO: 824667 - protein, 18 aa, Mycobacterium
HVWKLQNEFRIPASQFTQ

SEQ ID NO: 824668 - protein, 22 aa, Mycobacterium
HVWQAYLKTKPGCNRYWVVPGA

SEQ ID NO: 824669 - protein, 17 aa, Mycobacterium
HVYPITTQAGIARFLAD

SEQ ID NO: 824670 - protein, 17 aa, Mycobacterium
HVYRACMKFGVPDRAAL

SEQ ID NO: 824671 - protein, 17 aa, Mycobacterium
HVYRLMFGSTSAHGINA

SEQ ID NO: 824672 - protein, 17 aa, Mycobacterium
HVYTRLDRPLTASLGLM

SEQ ID NO: 824673 - protein, 18 aa, Mycobacterium
HVYTRLDRPLTASLGLMI

SEQ ID NO: 824674 - protein, 19 aa, Mycobacterium
HVYVTPRALQYMFRQRLDC

SEQ ID NO: 824675 - protein, 18 aa, Mycobacterium
HWAFQHVEDFMPTALISR

SEQ ID NO: 824676 - protein, 21 aa, Mycobacterium
HWAMAPSPAVARLLRICDPDG

SEQ ID NO: 824677 - protein, 26 aa, Mycobacterium
HWAPTFPNATYLIPRADFEFWNPENR

SEQ ID NO: 824678 - protein, 25 aa, Mycobacterium
HWARTWAPGFDFHRDAQHGRRLSDV

SEQ ID NO: 824679 - protein, 25 aa, Mycobacterium
HWEVVRIGIPPAVARYVVEKGSITV

SEQ ID NO: 824680 - protein, 20 aa, Mycobacterium
HWFEHVPGKPQIRASLKLDG

SEQ ID NO: 824681 - protein, 19 aa, Mycobacterium
HWGGAFKFAASVLGLPIGA

SEQ ID NO: 824682 - protein, 21 aa, Mycobacterium
HWGHTVVHCPYCHGWEVRDEP

SEQ ID NO: 824683 - protein, 33 aa, Mycobacterium; identical to SEQ ID NO: 127740

SEQ ID NO: 824684 - protein, 26 aa, Mycobacterium
HWIADRQIVPSLLKYGTELQKSHFLP

SEQ ID NO: 824685 - protein, 26 aa, Mycobacterium
HWIADRQIVPSLLKYGTERQKQEFLP

SEQ ID NO: 824686 - protein, 17 aa, Mycobacterium
HWLANWQLRALEASTTR

SEQ ID NO: 824687 - protein, 29 aa, Mycobacterium
HWLEGTGLIVMGLARHGVGNFDFALGATV

SEQ ID NO: 824688 - protein, 17 aa, Mycobacterium
HWLIRLTERGGQGAWSL

SEQ ID NO: 824689 - protein, 18 aa, Mycobacterium
HWLLLLGADRVDAIEHHL

SEQ ID NO: 824690 - protein, 17 aa, Mycobacterium
HWNAPIAAPTRAAIRTV

SEQ ID NO: 824691 - protein, 24 aa, Mycobacterium
HWNDPEFGIVWPLPVTVISEQDAS

SEQ ID NO: 824692 - protein, 24 aa, Mycobacterium
HWNRQIERWLAERTGQSIWSQPYA

SEQ ID NO: 824693 - protein, 18 aa, Mycobacterium
HWPGLGEVPTRELVLTTL

SEQ ID NO: 824694 - protein, 17 aa, Mycobacterium
HWPQRRPTATIYQLTDR

SEQ ID NO: 824695 - protein, 18 aa, Mycobacterium
HWPRQWAHAYVDFAAGEK

SEQ ID NO: 824696 - protein, 20 aa, Mycobacterium
HWRASQLTRAIATCAGLALA

SEQ ID NO: 824697 - protein, 24 aa, Mycobacterium
HWRDVPVRWDLLPEQRLLSAEVRS

SEQ ID NO: 824698 - protein, 19 aa, Mycobacterium
HWRHTGRLARIFPEVSVEP

SEQ ID NO: 824699 - protein, 17 aa, Mycobacterium
HWRLRRSGNATIVELTS

SEQ ID NO: 824700 - protein, 18 aa, Mycobacterium
HWRPLYLGGAATLAPDRP

SEQ ID NO: 824701 - protein, 17 aa, Mycobacterium
HWSQRRPAATIYQLTDR

SEQ ID NO: 824702 - protein, 17 aa, Mycobacterium
HWSVPPSRRFLPEDRTV

SEQ ID NO: 824703 - protein, 24 aa, Mycobacterium
HWTDRGLPLGVQLVGRLGADGDLL

SEQ ID NO: 824704 - protein, 18 aa, Mycobacterium
HWTLPHLVGGAVAADLLL

SEQ ID NO: 824705 - protein, 23 aa, Mycobacterium
HWTRAQIMTAPIAAPEPLHEGWN

SEQ ID NO: 824706 - protein, 23 aa, Mycobacterium
HWVPDSPHKPIGLLGAMLAAHGD

SEQ ID NO: 824707 - protein, 36 aa, Mycobacterium
HWVQTPYRYFPIEPHWLFPGIQWLPYEARVQISMRW

SEQ ID NO: 824708 - protein, 35 aa, Mycobacterium
HWVQTPYRYFPIEPHWLFPGMQWLPYEARVQISLH

SEQ ID NO: 824709 - protein, 18 aa, Mycobacterium
HWYTPDQLEWHTPEDIAV

SEQ ID NO: 824710 - protein, 19 aa, Mycobacterium
HYAAYEKSALLRLAGRYGV

SEQ ID NO: 824711 - protein, 23 aa, Mycobacterium
HYAGAFPAWLAPVQAVGIPVADE

SEQ ID NO: 824712 - protein, 25 aa, Mycobacterium
HYAGAFPAWLAPVQVVGIPVADAHT

SEQ ID NO: 824713 - protein, 25 aa, Mycobacterium
HYAGAFPAWLAPVQVVGIPVADDHV

SEQ ID NO: 824714 - protein, 24 aa, Mycobacterium
HYAGAFPAWLSPVQAVGIPIADAH

SEQ ID NO: 824715 - protein, 25 aa, Mycobacterium
HYAGAFPVWLAPVQVVGIPVADAHA

SEQ ID NO: 824716 - protein, 24 aa, Mycobacterium
HYAKLMFDVMITQVLKRLPDFELA

SEQ ID NO: 824717 - protein, 36 aa, Mycobacterium
HYARRPWARPLSHWSMGWLPLSARLAAKAPRLVNRL

SEQ ID NO: 824718 - protein, 23 aa, Mycobacterium
HYATVELRRPGGPGVIQGRDIMR

SEQ ID NO: 824719 - protein, 25 aa, Mycobacterium
HYDERLQRNVLGPGIVPVLSESPGR

SEQ ID NO: 824720 - protein, 25 aa, Mycobacterium
HYDIPFVSLHHFPMRPNGKLVPALP

SEQ ID NO: 824721 - protein, 31 aa, Mycobacterium
HYDIVHSHYWLSGQVGWLARDRWAVPLVHTA

SEQ ID NO: 824722 - protein, 24 aa, Mycobacterium
HYDNSPLVCRPLTFVRAAPSENGY

SEQ ID NO: 824723 - protein, 26 aa, Mycobacterium
HYDQHLTLQGLRLVFERNRDTQRGRL

SEQ ID NO: 824724 - protein, 22 aa, Mycobacterium
HYEDAVIPIPLISAAAGYEIDE

SEQ ID NO: 824725 - protein, 20 aa, Mycobacterium
HYELAPMLWNRWDELTGYVR

SEQ ID NO: 824726 - protein, 17 aa, Mycobacterium
HYEPFGIVALEAAAAGT

SEQ ID NO: 824727 - protein, 18 aa, Mycobacterium
HYEPFGLVALEAAAAGTP

SEQ ID NO: 824728 - protein, 20 aa, Mycobacterium
HYEPVGVVGAITPWNVPFYL

SEQ ID NO: 824729 - protein, 26 aa, Mycobacterium
HYEQHLTLHGLRLVFERNRDAQRGRL

SEQ ID NO: 824730 - protein, 17 aa, Mycobacterium
HYFADKGALIRAVIRRQ

SEQ ID NO: 824731 - protein, 21 aa, Mycobacterium
HYFASWFERYARSFSGTIAGG

SEQ ID NO: 824732 - protein, 18 aa, Mycobacterium
HYFFQFDQRYMFAGYGGG

SEQ ID NO: 824733 - protein, 25 aa, Mycobacterium
HYFGDRTPYIPAEQLEAALAADPVP

SEQ ID NO: 824734 - protein, 20 aa, Mycobacterium
HYGFIGYANTMFVTGEGDVV

SEQ ID NO: 824735 - protein, 24 aa, Mycobacterium
HYGGLFIRMSWHAAGTYRIQDGRG

SEQ ID NO: 824736 - protein, 24 aa, Mycobacterium
HYGGLFIRMSWHSAGTYRIHDGRG

SEQ ID NO: 824737 - protein, 31 aa, Mycobacterium
HYGMCGRAYDPRFLFAWPSAKSAVMGGAQLA

SEQ ID NO: 824738 - protein, 31 aa, Mycobacterium; identical to SEQ ID NO: 219240

SEQ ID NO: 824739 - protein, 31 aa, Mycobacterium
HYGMCGRAYDPRFLFAWPSAKSAVMGGTQLA

SEQ ID NO: 824740 - protein, 30 aa, Mycobacterium
HYGMCGRAYDPRFLFAWPTSKSAVMGGAQL

SEQ ID NO: 824741 - protein, 22 aa, Mycobacterium
HYGMICDASFPTYMLTHWVRDR

SEQ ID NO: 824742 - protein, 18 aa, Mycobacterium
HYGRVDILIHNAGNVRRG

SEQ ID NO: 824743 - protein, 18 aa, Mycobacterium
HYKAAIPADVLGCLPRRS

SEQ ID NO: 824744 - protein, 18 aa, Mycobacterium
HYLRTPFVLTQAAVPHMR

SEQ ID NO: 824745 - protein, 18 aa, Mycobacterium
HYLVAHVLGYHEQALRYA

SEQ ID NO: 824746 - protein, 32 aa, Mycobacterium
HYMGFGRPLDEVPMLLQPGILGIAWGTAIRQL

SEQ ID NO: 824747 - protein, 25 aa, Mycobacterium
HYNVANCLLALAILDAVGVSPEQAA

SEQ ID NO: 824748 - protein, 27 aa, Mycobacterium
HYNVNLLVGTLKYTLWRLQERVVGRGP

SEQ ID NO: 824749 - protein, 19 aa, Mycobacterium
HYPNLADTFVRLVNQLEAH

SEQ ID NO: 824750 - protein, 19 aa, Mycobacterium
HYPQALALIQMTRGANPSA

SEQ ID NO: 824751 - protein, 22 aa, Mycobacterium
HYPRVVLVTGASRFLGGYLAAR

SEQ ID NO: 824752 - protein, 24 aa, Mycobacterium
HYPSGYTCHFIRPGWKLPHRAASS

SEQ ID NO: 824753 - protein, 23 aa, Mycobacterium
HYQHTLMTPMFTPTPHPHGDPKI

SEQ ID NO: 824754 - protein, 19 aa, Mycobacterium
HYQIVMGERRWRAAQEAGL

SEQ ID NO: 824755 - protein, 17 aa, Mycobacterium
HYQRWRSALGTNPEFDS

SEQ ID NO: 824756 - protein, 20 aa, Mycobacterium
HYRAVLPNVYLSRRAQVSLE

SEQ ID NO: 824757 - protein, 24 aa, Mycobacterium
HYRLDLACLLGCGFITGWGSSVYA

SEQ ID NO: 824758 - protein, 17 aa, Mycobacterium
HYRLVGWRNGVCGYRRF

SEQ ID NO: 824759 - protein, 19 aa, Mycobacterium
HYRRLMSPEPWIERFERCW

SEQ ID NO: 824760 - protein, 24 aa, Mycobacterium
HYRSLFNVCMHPFLSGRPGRMLAL

SEQ ID NO: 824761 - protein, 21 aa, Mycobacterium
HYRSLLRRAARLNDGLAHGGY

SEQ ID NO: 824762 - protein, 28 aa, Mycobacterium
HYRSLMVSSIKTMLGHMLAAAGAQQLIS

SEQ ID NO: 824763 - protein, 17 aa, Mycobacterium
HYRTWLDDQDFTPAYGY

SEQ ID NO: 824764 - protein, 17 aa, Mycobacterium
HYRVGWPTKPLADAKAS

SEQ ID NO: 824765 - protein, 17 aa, Mycobacterium
HYRWFALFMKHAGSQAD

SEQ ID NO: 824766 - protein, 20 aa, Mycobacterium
HYRYAGMTWGPIDSPVIIED

SEQ ID NO: 824767 - protein, 18 aa, Mycobacterium
HYSDIGFIILGTLVEKIT

SEQ ID NO: 824768 - protein, 19 aa, Mycobacterium
HYSPYAWRSVTYRKRDIGV

SEQ ID NO: 824769 - protein, 18 aa, Mycobacterium
HYSVNYSNAFWNGSQMTY

SEQ ID NO: 824770 - protein, 25 aa, Mycobacterium
HYTRAYMHHLFKAKEILASTLATIH

SEQ ID NO: 824771 - protein, 22 aa, Mycobacterium
HYTRKWLQRMTVSQFDRSVAQI

SEQ ID NO: 824772 - protein, 19 aa, Mycobacterium
HYVAHQLDVIVRRTTYRLR

SEQ ID NO: 824773 - protein, 19 aa, Mycobacterium
HYVAYLRKVCTALQGHRLQ

SEQ ID NO: 824774 - protein, 18 aa, Mycobacterium
HYVHIRYDLLQPHGPLRA

SEQ ID NO: 824775 - protein, 24 aa, Mycobacterium
HYVNDFALALARFSIRMNAVHPTN

SEQ ID NO: 824776 - protein, 30 aa, Mycobacterium
HYVQTPGSLDPFAALLPAGSAPPPTAAAVL

SEQ ID NO: 824777 - protein, 20 aa, Mycobacterium
HYVYNFLGERQQLLSSVGPI

SEQ ID NO: 824778 - protein, 17 aa, Mycobacterium
HYWGRFGAAGLLLRAPQ

SEQ ID NO: 824779 - protein, 19 aa, Mycobacterium
HYWQEWEDPRLIVAILHNN

SEQ ID NO: 824780 - protein, 25 aa, Mycobacterium
HYYNVPIVLHFRGAVRRDALQRALA

SEQ ID NO: 824781 - protein, 27 aa, Mycobacterium
IAAAFHRIEAAYPGRFLLGVGAGHPEA

SEQ ID NO: 824782 - protein, 18 aa, Mycobacterium
IAAALLAAGWKVYVTGRT

SEQ ID NO: 824783 - protein, 26 aa, Mycobacterium
IAAALLQNLALIRYLIGQVVAGPRQR

SEQ ID NO: 824784 - protein, 19 aa, Mycobacterium
IAAALRLEVRRRAGLPITV

SEQ ID NO: 824785 - protein, 18 aa, Mycobacterium
IAAALWGTGGSVWFHKNV

SEQ ID NO: 824786 - protein, 17 aa, Mycobacterium
IAAARPCVVRDPGLYRM

SEQ ID NO: 824787 - protein, 25 aa, Mycobacterium
IAAAVDVTLLGRFYERFADHAVQIA

SEQ ID NO: 824788 - protein, 28 aa, Mycobacterium
IAAAVIDWFTVDWHRAIVDKWREAGVRM

SEQ ID NO: 824789 - protein, 24 aa, Mycobacterium
IAAAWETLMLRLGYGRYGAQGGDW

SEQ ID NO: 824790 - protein, 29 aa, Mycobacterium
IAACKSGGLLPFANFNRIHVVPPCNVSAD

SEQ ID NO: 824791 - protein, 24 aa, Mycobacterium
IAADFWSIDVILDELCKLYAAQRG

SEQ ID NO: 824792 - protein, 26 aa, Mycobacterium
IAADGSVLDTWFPAPELTADGPSGTS

SEQ ID NO: 824793 - protein, 30 aa, Mycobacterium
IAADIGYPVLVRPSYVLGGRGMEIVYDEET

SEQ ID NO: 824794 - protein, 24 aa, Mycobacterium
IAADPAIPQLLRVNGFTIGMQTCY

SEQ ID NO: 824795 - protein, 32 aa, Mycobacterium
IAADTGLLTFLSFFLAYAYYGAAKSIAGDFAS

SEQ ID NO: 824796 - protein, 28 aa, Mycobacterium
IAAEAYPFDHLPPLLTDADIVVSCTGAV

SEQ ID NO: 824797 - protein, 20 aa, Mycobacterium
IAAELFKPLPSMVVAHYLGV

SEQ ID NO: 824798 - protein, 24 aa, Mycobacterium
IAAEPRVEFLRRAIDIAADLGATC

SEQ ID NO: 824799 - protein, 24 aa, Mycobacterium
IAAERMIPRNLMRAVTKRIGGGRG

SEQ ID NO: 824800 - protein, 25 aa, Mycobacterium
IAAFAGLYRDHPFIRIPDVVAEASG

SEQ ID NO: 824801 - protein, 19 aa, Mycobacterium
IAAFLWAQFEDAERITRSR

SEQ ID NO: 824802 - protein, 26 aa, Mycobacterium
IAAFPHHGFWQPMDTFRESQLLNNLW

SEQ ID NO: 824803 - protein, 24 aa, Mycobacterium
IAAGEKVVMFYASGNWDTTVFDRP

SEQ ID NO: 824804 - protein, 26 aa, Mycobacterium
IAAGHSFVIFLREGFPVNVLNPVKAV

SEQ ID NO: 824805 - protein, 17 aa, Mycobacterium
IAAGIFLYDRLGGAKSV

SEQ ID NO: 824806 - protein, 25 aa, Mycobacterium
IAAGMVPLGLTKRPTDLATKQAAAS

SEQ ID NO: 824807 - protein, 24 aa, Mycobacterium
IAAGPDDALWFTAMTSGEVCRIST

SEQ ID NO: 824808 - protein, 18 aa, Mycobacterium
IAAGQTVTFGFQASPGGG

SEQ ID NO: 824809 - protein, 17 aa, Mycobacterium
IAAGRAWARFEHGEVVF

SEQ ID NO: 824810 - protein, 17 aa, Mycobacterium
IAAHLIRLLAARGDTAV

SEQ ID NO: 824811 - protein, 24 aa, Mycobacterium
IAAHNPTFLGTATPFFVGFLEAQR

SEQ ID NO: 824812 - protein, 26 aa, Mycobacterium
IAAHRPPYVPWIPDLPGRDDFGGESF

SEQ ID NO: 824813 - protein, 17 aa, Mycobacterium
IAAIAFSPRPVPTVSVA

SEQ ID NO: 824814 - protein, 18 aa, Mycobacterium
IAAIIYASALLQVVARHA

SEQ ID NO: 824815 - protein, 17 aa, Mycobacterium
IAAILTDAGVPAGVVNL

SEQ ID NO: 824816 - protein, 19 aa, Mycobacterium
IAAIRRVRREIPAAAAVIE

SEQ ID NO: 824817 - protein, 22 aa, Mycobacterium
IAAIWRRFFGYDRIGVNDRFLE

SEQ ID NO: 824818 - protein, 29 aa, Mycobacterium
IAAKIAFFFTKRKLARMAGLATADMLEPL

SEQ ID NO: 824819 - protein, 20 aa, Mycobacterium
IAAKLFGFPTVIAHGMFSAA

SEQ ID NO: 824820 - protein, 25 aa, Mycobacterium
IAALAVIGMCNWVAWWFHEDDAASA

SEQ ID NO: 824821 - protein, 18 aa, Mycobacterium
IAALLTEHQWKIGVVAQS

SEQ ID NO: 824822 - protein, 20 aa, Mycobacterium
IAALPPPEDPEFTERAAPIL

SEQ ID NO: 824823 - protein, 17 aa, Mycobacterium
IAALQAGNTVLLVQPPR

SEQ ID NO: 824824 - protein, 17 aa, Mycobacterium
IAALQRRLGTTTVYVTH

SEQ ID NO: 824825 - protein, 17 aa, Mycobacterium
IAALRNQITALKTGHRA

SEQ ID NO: 824826 - protein, 29 aa, Mycobacterium
IAALSAALLRLPVSNWPALGGMGNASWVQ

SEQ ID NO: 824827 - protein, 26 aa, Mycobacterium
IAANFRDVMIALGLYPDPDAIMGIEA

SEQ ID NO: 824828 - protein, 25 aa, Mycobacterium
IAANFRDVMIALGLYPDPEAVMGVE

SEQ ID NO: 824829 - protein, 26 aa, Mycobacterium
IAANPKIFFQIYWLGGRDAIAERVER

SEQ ID NO: 824830 - protein, 26 aa, Mycobacterium
IAANPKIFFQVYWLGGRDAIAERVER

SEQ ID NO: 824831 - protein, 19 aa, Mycobacterium
IAANRAHLAALIATNLLGQ

SEQ ID NO: 824832 - protein, 18 aa, Mycobacterium
IAANRELLATLIATNFFG

SEQ ID NO: 824833 - protein, 19 aa, Mycobacterium
IAANRVLLATLVATNFFGQ

SEQ ID NO: 824834 - protein, 26 aa, Mycobacterium
IAAPLDFLGVNYYFRETVRFGTGAPS

SEQ ID NO: 824835 - protein, 25 aa, Mycobacterium
IAAPLNELRTKCGLPLDLAQVVNGG

SEQ ID NO: 824836 - protein, 18 aa, Mycobacterium
IAAPPGIVTVDRLPRLRY

SEQ ID NO: 824837 - protein, 24 aa, Mycobacterium
IAAQDVWMLASITLAARVHTLDGV

SEQ ID NO: 824838 - protein, 24 aa, Mycobacterium
IAAQLISRPYLPWGDVEQFADRVL

SEQ ID NO: 824839 - protein, 18 aa, Mycobacterium
IAAQMRGLGVRAIDVDPR

SEQ ID NO: 824840 - protein, 17 aa, Mycobacterium
IAARFTSPVFPGETLTT

SEQ ID NO: 824841 - protein, 18 aa, Mycobacterium
IAARIAMRVLTYRPGRLA

SEQ ID NO: 824842 - protein, 20 aa, Mycobacterium
IAARLLLSGELLPAGHRHLT

SEQ ID NO: 824843 - protein, 21 aa, Mycobacterium
IAARSLLRDNAYKALRTAIVD

SEQ ID NO: 824844 - protein, 24 aa, Mycobacterium
IAARYPGVRWIGGTVKMGFAEAFN

SEQ ID NO: 824845 - protein, 17 aa, Mycobacterium
IAASMLALFADDVARHA

SEQ ID NO: 824846 - protein, 24 aa, Mycobacterium
IAASRKPFVLLTSNATRELSEALK

SEQ ID NO: 824847 - protein, 28 aa, Mycobacterium
IAATAIGPLLPFTPKIRTGYNLPISHVR

SEQ ID NO: 824848 - protein, 36 aa, Mycobacterium
IAATERGLLLTTLWYIREVDPTTLLLTGLTRDGVYL

SEQ ID NO: 824849 - protein, 35 aa, Mycobacterium
IAATERGLLLTTLWYIRVVDPTVLLLTGLTRDGVY

SEQ ID NO: 824850 - protein, 18 aa, Mycobacterium
IAATGFKVDEPWSSAGMG

SEQ ID NO: 824851 - protein, 27 aa, Mycobacterium
IAATPDAGLPLYAGWRTMALADDAAAR

SEQ ID NO: 824852 - protein, 25 aa, Mycobacterium
IAAVADTWRRLGLTVPLVVDPVCAS

SEQ ID NO: 824853 - protein, 19 aa, Mycobacterium
IAAVIYDSTRNPDPPLRLT

SEQ ID NO: 824854 - protein, 22 aa, Mycobacterium
IAAYEHALLQYATPRLADVPGV

SEQ ID NO: 824855 - protein, 19 aa, Mycobacterium
IAAYVYRPPAGVGATACVV

SEQ ID NO: 824856 - protein, 24 aa, Mycobacterium
IACALDLQRSPLGPIRLRIGVHTG

SEQ ID NO: 824857 - protein, 27 aa, Mycobacterium
IACDVESYIYLPLLEELGYVPTEKYAK

SEQ ID NO: 824858 - protein, 25 aa, Mycobacterium
IACDVGSHYIYMARHVRVYQPRRLL

SEQ ID NO: 824859 - protein, 18 aa, Mycobacterium
IACFPVKIHAASAGWTRA

SEQ ID NO: 824860 - protein, 20 aa, Mycobacterium
IACIIELVEKMLASGAAYVV

SEQ ID NO: 824861 - protein, 21 aa, Mycobacterium
IACYVPLEEWDLRAAALGGNS

SEQ ID NO: 824862 - protein, 25 aa, Mycobacterium
IADACGFAVPYYELVDERPVLDAHL

SEQ ID NO: 824863 - protein, 25 aa, Mycobacterium
IADACGFAVPYYELVDERPVLDAYH

SEQ ID NO: 824864 - protein, 24 aa, Mycobacterium
IADAILDGVFPPGSALPPERELAE

SEQ ID NO: 824865 - protein, 18 aa, Mycobacterium
IADAILDGVFPPGSTLPP

SEQ ID NO: 824866 - protein, 18 aa, Mycobacterium
IADALRGMAFAHPELRID

SEQ ID NO: 824867 - protein, 24 aa, Mycobacterium
IADDRRAVLTAQDRLRFAAGNFYV

SEQ ID NO: 824868 - protein, 36 aa, Mycobacterium
IADGFLNGQYVLPTPLTLTVPFVVPLVGVVPQTITL

SEQ ID NO: 824869 - protein, 18 aa, Mycobacterium
IADGKLEMLFIDQQFRGR

SEQ ID NO: 824870 - protein, 24 aa, Mycobacterium
IADGPMAGLFARAIVVIGGDGNVA

SEQ ID NO: 824871 - protein, 25 aa, Mycobacterium
IADGPMAGLLARAIVVIGADGNVAY

SEQ ID NO: 824872 - protein, 23 aa, Mycobacterium
IADHLGFIATLLHHRHAGEDDHV

SEQ ID NO: 824873 - protein, 18 aa, Mycobacterium
IADHRRATPFASGELSPA

SEQ ID NO: 824874 - protein, 21 aa, Mycobacterium
IADITGLPLLASMKAEPRVAE

SEQ ID NO: 824875 - protein, 24 aa, Mycobacterium
IADLAHRVLQHRLILGFEAASAGV

SEQ ID NO: 824876 - protein, 24 aa, Mycobacterium
IADLESREVLLAKLAGAMKGNLSK

SEQ ID NO: 824877 - protein, 24 aa, Mycobacterium
IADLETREVLLAKLAGAMKGNLAK

SEQ ID NO: 824878 - protein, 19 aa, Mycobacterium
IADLMERRLDRDHPLWECW

SEQ ID NO: 824879 - protein, 21 aa, Mycobacterium
IADLRALRRTLGTTRDVPHTV

SEQ ID NO: 824880 - protein, 25 aa, Mycobacterium
IADMMRLKHFPSPVSAFVSAISSPS

SEQ ID NO: 824881 - protein, 24 aa, Mycobacterium
IADMTYLQWLQRYVELAIGEGNST

SEQ ID NO: 824882 - protein, 18 aa, Mycobacterium
IADPAGIGRWLKLALGAA

SEQ ID NO: 824883 - protein, 19 aa, Mycobacterium
IADPKARYFRVLTSWVGGG

SEQ ID NO: 824884 - protein, 21 aa, Mycobacterium
IADPLDYRLVESYWLGGGVGA

SEQ ID NO: 824885 - protein, 17 aa, Mycobacterium
IADPRGWIAQPVMQLST

SEQ ID NO: 824886 - protein, 20 aa, Mycobacterium
IADPYPYYEALRQRCPVTRE

SEQ ID NO: 824887 - protein, 37 aa, Mycobacterium
IADQLLKDLTPSDPKFFYLKRKVLDSAPFPEPAEIRG

SEQ ID NO: 824888 - protein, 26 aa, Mycobacterium
IADQPLRYHRLHLAAWRGSTAETIAM

SEQ ID NO: 824889 - protein, 17 aa, Mycobacterium
IADRLLRRAVARLPLRL

SEQ ID NO: 824890 - protein, 27 aa, Mycobacterium
IADSGWLKLCFRYYSDWDLQTTSPDAR

SEQ ID NO: 824891 - protein, 30 aa, Mycobacterium
IADSWMQIEAFRLLTLQTAWKIDRHNDYQA

SEQ ID NO: 824892 - protein, 29 aa, Mycobacterium
IADSYAQLLQFRLMVLYTAWEIDKYNDYK

SEQ ID NO: 824893 - protein, 30 aa, Mycobacterium
IADSYAQLLQFRLMVLYTAWEIDKYNDYKK

SEQ ID NO: 824894 - protein, 29 aa, Mycobacterium
IADSYTELMPFRLAVLHAAWLIDTAGEHA

SEQ ID NO: 824895 - protein, 29 aa, Mycobacterium
IADSYTELMPFRLAVLHAAWLIDTAGERA

SEQ ID NO: 824896 - protein, 29 aa, Mycobacterium
IADSYTELMPFRLAVLHAAWMIDTAGEHA

SEQ ID NO: 824897 - protein, 35 aa, Mycobacterium
IADVKLLARLLGLPYFPVTPLFPAAGPLGVVPLPS

SEQ ID NO: 824898 - protein, 25 aa, Mycobacterium
IADVLALYVGLPEHVREFNQLPIAA

SEQ ID NO: 824899 - protein, 18 aa, Mycobacterium
IADWLLGGSAKLSALTGG

SEQ ID NO: 824900 - protein, 25 aa, Mycobacterium
IADWTRLPAGTLALLRDALAVHRAF

SEQ ID NO: 824901 - protein, 18 aa, Mycobacterium
IADYSPWPDYPPKPKPTD

SEQ ID NO: 824902 - protein, 21 aa, Mycobacterium
IAEAFRFAERLGLDVAVTVPG

SEQ ID NO: 824903 - protein, 36 aa, Mycobacterium
IAEALQIRAAGLDAPLLAWLHAPGADYAAALHADVE

SEQ ID NO: 824904 - protein, 17 aa, Mycobacterium
IAEALQLAAYLTGSSRY

SEQ ID NO: 824905 - protein, 23 aa, Mycobacterium
IAEALVGLLRSNSRLSVRVLHRD

SEQ ID NO: 824906 - protein, 29 aa, Mycobacterium
IAECKKLGLLPFANYNRIHVVPPCTITAD

SEQ ID NO: 824907 - protein, 17 aa, Mycobacterium
IAEDGELKLFLDPSRVV

SEQ ID NO: 824908 - protein, 21 aa, Mycobacterium
IAEELVRIIGVLRGMQLKKLP

SEQ ID NO: 824909 - protein, 27 aa, Mycobacterium
IAEEVEKMVWAIRWGADNIMDLSTGKD

SEQ ID NO: 824910 - protein, 17 aa, Mycobacterium
IAEGLFGYLAPGAQDQL

SEQ ID NO: 824911 - protein, 19 aa, Mycobacterium
IAEGLFGYLPPEAQDRLLD

SEQ ID NO: 824912 - protein, 17 aa, Mycobacterium
IAEGLFGYLPSEAQDRL

SEQ ID NO: 824913 - protein, 25 aa, Mycobacterium
IAEGRVRPIIGARLPIQRAGEAHQQ

SEQ ID NO: 824914 - protein, 20 aa, Mycobacterium
IAEGWILSLSGTVSFKNARA

SEQ ID NO: 824915 - protein, 25 aa, Mycobacterium
IAEGWQPIFFLPEKANDVWGAALAE

SEQ ID NO: 824916 - protein, 25 aa, Mycobacterium
IAEGWQPIFYLPEKAQDVWGEALAT

SEQ ID NO: 824917 - protein, 25 aa, Mycobacterium
IAEGWQPIFYLPEKAQQVWGEALAT

SEQ ID NO: 824918 - protein, 24 aa, Mycobacterium
IAEGWQPVFFLPDQAASVWGDALA

SEQ ID NO: 824919 - protein, 24 aa, Mycobacterium
IAEGWQPVFFYPEKADEVWGDALR

SEQ ID NO: 824920 - protein, 24 aa, Mycobacterium
IAEGWQPVFYFPEKADDVWGDALR

SEQ ID NO: 824921 - protein, 28 aa, Mycobacterium
IAEHPIVVWAPPRHSFYTDLLVSHCRRS

SEQ ID NO: 824922 - protein, 27 aa, Mycobacterium
IAEIERLHRELARQPHPLLGAATWSVG

SEQ ID NO: 824923 - protein, 24 aa, Mycobacterium
IAELAIRFRDKGVVGFDIAGAEAG

SEQ ID NO: 824924 - protein, 26 aa, Mycobacterium
IAELDPRRRAILGMRFYDCLTQREIA

SEQ ID NO: 824925 - protein, 17 aa, Mycobacterium
IAELFMSVLAAVIPGRW

SEQ ID NO: 824926 - protein, 35 aa, Mycobacterium
IAELLADRLHLLPPLRWRLATVPLDLGHPWWVEGE

SEQ ID NO: 824927 - protein, 17 aa, Mycobacterium
IAELLRHGDFGLGTFNR

SEQ ID NO: 824928 - protein, 18 aa, Mycobacterium
IAELPEHVVIVGSGFVAA

SEQ ID NO: 824929 - protein, 19 aa, Mycobacterium
IAELTSLQWSGPASAAMLA

SEQ ID NO: 824930 - protein, 18 aa, Mycobacterium
IAELVRVLKVGGTLAISV

SEQ ID NO: 824931 - protein, 21 aa, Mycobacterium
IAELYATDPEFAAAAPLPAVV

SEQ ID NO: 824932 - protein, 17 aa, Mycobacterium
IAENAFFADPHVSIGLV

SEQ ID NO: 824933 - protein, 18 aa, Mycobacterium
IAEPIGVLEAWTGAGLAV

SEQ ID NO: 824934 - protein, 18 aa, Mycobacterium
IAEPLPRSLVWSAAWEMT

SEQ ID NO: 824935 - protein, 24 aa, Mycobacterium
IAEQLDLFPALKELLNRRAGLLSG

SEQ ID NO: 824936 - protein, 23 aa, Mycobacterium
IAERAKWVTFPIAALQGWAESHH

SEQ ID NO: 824937 - protein, 18 aa, Mycobacterium
IAERPIDPALYPGADPAD

SEQ ID NO: 824938 - protein, 17 aa, Mycobacterium
IAERRGEPWFDPAGFFL

SEQ ID NO: 824939 - protein, 25 aa, Mycobacterium
IAERVPQEWLLPYVHQRYDDPVLSA

SEQ ID NO: 824940 - protein, 26 aa, Mycobacterium
IAESRAYFDLAWAHAGGLPRPPMVVT

SEQ ID NO: 824941 - protein, 25 aa, Mycobacterium
IAESTWHRWLAQYGGMKANDAKRLK

SEQ ID NO: 824942 - protein, 24 aa, Mycobacterium
IAESTWHRWLAQYGGMKASDAKRL

SEQ ID NO: 824943 - protein, 23 aa, Mycobacterium
IAETGFIKLWSRSLRDTRLKYDL

SEQ ID NO: 824944 - protein, 24 aa, Mycobacterium
IAETIDWGRTLLALGLDTIDDAVV

SEQ ID NO: 824945 - protein, 24 aa, Mycobacterium
IAETIDWGRTLLALGLDTIDDSVV

SEQ ID NO: 824946 - protein, 17 aa, Mycobacterium
IAEVEALYRALTPDQRA

SEQ ID NO: 824947 - protein, 21 aa, Mycobacterium
IAEWLVRQGVPFRSAHEAAGA

SEQ ID NO: 824948 - protein, 26 aa, Mycobacterium
IAEYGISWILPRIVGWGAAQDLLLSG

SEQ ID NO: 824949 - protein, 31 aa, Mycobacterium
IAFETSWLDPFTEFRFPRIGTAVFDGIEIEL

SEQ ID NO: 824950 - protein, 27 aa, Mycobacterium
IAFETSWLDPFTEFRFPRIGTAVFDGV

SEQ ID NO: 824951 - protein, 24 aa, Mycobacterium
IAFGEFGALMDMASCRSDPFAIDF

SEQ ID NO: 824952 - protein, 19 aa, Mycobacterium
IAFGWDRVTALLAGTSSIR

SEQ ID NO: 824953 - protein, 17 aa, Mycobacterium
IAFPFPDEPFANGLGEV

SEQ ID NO: 824954 - protein, 19 aa, Mycobacterium
IAFPIAHIGGMVYLATALF

SEQ ID NO: 824955 - protein, 22 aa, Mycobacterium
IAFRLMFNTLRETYEPVLPALA

SEQ ID NO: 824956 - protein, 22 aa, Mycobacterium
IAFVTKWIPYGGPPPGESLAEF

SEQ ID NO: 824957 - protein, 24 aa, Mycobacterium
IAFVWSDRHSAVTAAALLGPGDVA

SEQ ID NO: 824958 - protein, 24 aa, Mycobacterium
IAFYDALFGWLGYSSFSSLNMEYQ

SEQ ID NO: 824959 - protein, 22 aa, Mycobacterium
IAGADTLPFEDYRMMPRATFCQ

SEQ ID NO: 824960 - protein, 17 aa, Mycobacterium
IAGARRIFAVDPYEWKR

SEQ ID NO: 824961 - protein, 26 aa, Mycobacterium
IAGAVFGKLPFLMNGIKLEVVGVDDA

SEQ ID NO: 824962 - protein, 26 aa, Mycobacterium
IAGAVFGKLPFLMTGIHLEAVGVDDA

SEQ ID NO: 824963 - protein, 19 aa, Mycobacterium
IAGFQPVPYMAVYSATKAF

SEQ ID NO: 824964 - protein, 29 aa, Mycobacterium
IAGGDLVRAPLWVISVTVLGDLGGRAPVL

SEQ ID NO: 824965 - protein, 24 aa, Mycobacterium
IAGGLPINLLSYIAQLTAAQALQG

SEQ ID NO: 824966 - protein, 20 aa, Mycobacterium
IAGIVLIGLLTRPGELEPGV

SEQ ID NO: 824967 - protein, 23 aa, Mycobacterium
IAGLIVTRYILCLEPACSMTHDE

SEQ ID NO: 824968 - protein, 17 aa, Mycobacterium
IAGLPRTGTTHLHNMLA

SEQ ID NO: 824969 - protein, 18 aa, Mycobacterium
IAGMPILGLARLLGPRAL

SEQ ID NO: 824970 - protein, 30 aa, Mycobacterium
IAGMRPHDPPWHRPLLGIRRTVTHAACEEL

SEQ ID NO: 824971 - protein, 28 aa, Mycobacterium
IAGMRPYDPPWCRPLLGVRRDVTQAACR

SEQ ID NO: 824972 - protein, 25 aa, Mycobacterium
IAGNRIQLLTLIASNLFGQNTPAIA

SEQ ID NO: 824973 - protein, 27 aa, Mycobacterium
IAGPHALFDPRFQKLGIHPGGGATWML

SEQ ID NO: 824974 - protein, 17 aa, Mycobacterium
IAGPLPPSVPYDSPTPE

SEQ ID NO: 824975 - protein, 25 aa, Mycobacterium
IAGQLRYWQHALAGLPERLALPTDR

SEQ ID NO: 824976 - protein, 17 aa, Mycobacterium
IAGRPAAVLLHLGPGLG

SEQ ID NO: 824977 - protein, 18 aa, Mycobacterium
IAGRQRVTAGTTLTAGSA

SEQ ID NO: 824978 - protein, 19 aa, Mycobacterium
IAGRTFGSRLIMGTGGAAN

SEQ ID NO: 824979 - protein, 24 aa, Mycobacterium
IAGSHLLLAVGRRPNTDDLGLDAA

SEQ ID NO: 824980 - protein, 24 aa, Mycobacterium
IAGSHLLLAVGRRPNTDDLGLEAA

SEQ ID NO: 824981 - protein, 24 aa, Mycobacterium
IAGSRFIELPGSDSLYWVGDTAAL

SEQ ID NO: 824982 - protein, 22 aa, Mycobacterium
IAGTPPEAFSLGYLGSCLGLGR

SEQ ID NO: 824983 - protein, 25 aa, Mycobacterium
IAGTVYPIPEPFLVIATQNPVDQEG

SEQ ID NO: 824984 - protein, 25 aa, Mycobacterium
IAGTVYPIPQPFLVIATQNPVDQEG

SEQ ID NO: 824985 - protein, 18 aa, Mycobacterium
IAGVPLTELAREYGTPLF

SEQ ID NO: 824986 - protein, 25 aa, Mycobacterium
IAGWRHRVLLIDAKYVGVWELPVLG

SEQ ID NO: 824987 - protein, 18 aa, Mycobacterium
IAGYPEVTLAIYASPRQT

SEQ ID NO: 824988 - protein, 22 aa, Mycobacterium
IAHALERPLDLDRPPWECWVIE

SEQ ID NO: 824989 - protein, 18 aa, Mycobacterium
IAHELGHMVLGHRGLPIA

SEQ ID NO: 824990 - protein, 25 aa, Mycobacterium
IAHGFMTLSLLPRLQHDMYTVKGIK

SEQ ID NO: 824991 - protein, 25 aa, Mycobacterium
IAHGFMTLSLLPRLQHEMYTVKGIK

SEQ ID NO: 824992 - protein, 22 aa, Mycobacterium
IAHGMLTMGLGGGYLTEWIGDP

SEQ ID NO: 824993 - protein, 19 aa, Mycobacterium
IAHILTRYPQMEYGSISGN

SEQ ID NO: 824994 - protein, 17 aa, Mycobacterium
IAHLLAENLALIEGSVS

SEQ ID NO: 824995 - protein, 24 aa, Mycobacterium
IAHLSDLDLWLRMLLRSAACFVPQ

SEQ ID NO: 824996 - protein, 17 aa, Mycobacterium
IAHRYTAKPIFVRAVEV

SEQ ID NO: 824997 - protein, 20 aa, Mycobacterium
IAHSHQPLRWGPPEAPDRYV

SEQ ID NO: 824998 - protein, 25 aa, Mycobacterium
IAIAANSPVLAGKFTGWHSTRQLVW

SEQ ID NO: 824999 - protein, 23 aa, Mycobacterium
IAIAELIRVLKVGGTLAVSVPRW

SEQ ID NO: 825000 - protein, 20 aa, Mycobacterium
IAIDPQHRMLLETAWEAMEH

SEQ ID NO: 825001 - protein, 27 aa, Mycobacterium
IAIELDGLRLITWRGAARAEQGLPFIR

SEQ ID NO: 825002 - protein, 26 aa, Mycobacterium
IAIELDGLRLITWRGASRAEQGLSFA

SEQ ID NO: 825003 - protein, 24 aa, Mycobacterium
IAIGALPLVLNPQAGVRTAVVAAD

SEQ ID NO: 825004 - protein, 20 aa, Mycobacterium
IAIGHPIGMSGARIALHAAL

SEQ ID NO: 825005 - protein, 18 aa, Mycobacterium
IAILLEEVLRRLPDYRID

SEQ ID NO: 825006 - protein, 17 aa, Mycobacterium
IAINPLPEAGLIRFKDP

SEQ ID NO: 825007 - protein, 20 aa, Mycobacterium
IAIPVNFRMTPPEVAFLVEN

SEQ ID NO: 825008 - protein, 23 aa, Mycobacterium
IAIRPIYGAFDIPGARLARAGVP

SEQ ID NO: 825009 - protein, 17 aa, Mycobacterium
IAISHYIVPSDDADQFL

SEQ ID NO: 825010 - protein, 18 aa, Mycobacterium
IAIVVDGIARDPGRAHIL

SEQ ID NO: 825011 - protein, 26 aa, Mycobacterium
IAKATLYYYFAGKEEILAFLLEDALQ

SEQ ID NO: 825012 - protein, 24 aa, Mycobacterium
IAKATLYYYFAGKEEILAFLLEDV

SEQ ID NO: 825013 - protein, 26 aa, Mycobacterium
IAKDKALSPILLVRGDARSGARLEIA

SEQ ID NO: 825014 - protein, 19 aa, Mycobacterium
IAKFHKKLPSWVDVDTRAA

SEQ ID NO: 825015 - protein, 26 aa, Mycobacterium
IAKFKIPRYLRLVDEFPMTVTGKVRK

SEQ ID NO: 825016 - protein, 22 aa, Mycobacterium
IAKFLHKRGPGIQQFACRVRNL

SEQ ID NO: 825017 - protein, 28 aa, Mycobacterium
IAKLADPQILLPKFFRQYGAKVQGGGIL

SEQ ID NO: 825018 - protein, 29 aa, Mycobacterium
IAKQLKDELSTCPPILVLTGRPDDSWLAS

SEQ ID NO: 825019 - protein, 28 aa, Mycobacterium
IAKQLKDELTTCPPILVLTGRPDDAWLA

SEQ ID NO: 825020 - protein, 20 aa, Mycobacterium
IAKRIWRRPRPDRSIIPLIR

SEQ ID NO: 825021 - protein, 22 aa, Mycobacterium
IAKRLDLLAGDAIYQGAPNLVV

SEQ ID NO: 825022 - protein, 20 aa, Mycobacterium
IAKRWRAMISEYAAAGRLGD

SEQ ID NO: 825023 - protein, 28 aa, Mycobacterium
IAKSLAAAPFADLLWMETKTADLDDARQ

SEQ ID NO: 825024 - protein, 17 aa, Mycobacterium
IAKVWGLYMAASRVAFE

SEQ ID NO: 825025 - protein, 18 aa, Mycobacterium
IALAVLASVRRPVSAAET

SEQ ID NO: 825026 - protein, 20 aa, Mycobacterium
IALCEVQAYQYAALRARAEL

SEQ ID NO: 825027 - protein, 22 aa, Mycobacterium
IALDCLNIYRQVSAPVWSSARL

SEQ ID NO: 825028 - protein, 24 aa, Mycobacterium
IALDQSLLSHAAIRRIRRLYQDFD

SEQ ID NO: 825029 - protein, 19 aa, Mycobacterium
IALEFAQMYRRFGAEVTVV

SEQ ID NO: 825030 - protein, 24 aa, Mycobacterium
IALEKLLDFMPRYEVDWANCNRVH

SEQ ID NO: 825031 - protein, 17 aa, Mycobacterium
IALELWAAVHGVAALLI

SEQ ID NO: 825032 - protein, 24 aa, Mycobacterium
IALERLLDFMPRYEVKWDGLQRVH

SEQ ID NO: 825033 - protein, 19 aa, Mycobacterium
IALGAVDYSWYTQKLDIEV

SEQ ID NO: 825034 - protein, 32 aa, Mycobacterium
IALGGPFLKLTPADWDRLLSVNLMGVVHGCRV

SEQ ID NO: 825035 - protein, 17 aa, Mycobacterium
IALGHPLGATGAKLFTT

SEQ ID NO: 825036 - protein, 19 aa, Mycobacterium
IALGRWWSEVLEWPHTIDG

SEQ ID NO: 825037 - protein, 20 aa, Mycobacterium
IALGSWQGPAAAAMAAAAAP

SEQ ID NO: 825038 - protein, 18 aa, Mycobacterium
IALHAALELARRGSGYAV

SEQ ID NO: 825039 - protein, 17 aa, Mycobacterium
IALLHQVVTAQLAAGRQ

SEQ ID NO: 825040 - protein, 20 aa, Mycobacterium
IALLSHNCWQYAVLAFATAR

SEQ ID NO: 825041 - protein, 18 aa, Mycobacterium
IALMSLVGHPRPVNPRRE

SEQ ID NO: 825042 - protein, 24 aa, Mycobacterium
IALNGVINRSFNVGNLLLGTVEQT

SEQ ID NO: 825043 - protein, 22 aa, Mycobacterium
IALNYYAPLRLIRGLAPGMRER

SEQ ID NO: 825044 - protein, 18 aa, Mycobacterium
IALNYYAPLRLIRGVAPQ

SEQ ID NO: 825045 - protein, 19 aa, Mycobacterium
IALPETLARYVVQKGSITV

SEQ ID NO: 825046 - protein, 17 aa, Mycobacterium
IALPFGLSAGMLPAIGF

SEQ ID NO: 825047 - protein, 28 aa, Mycobacterium
IALPGGRYGWRVSLPAMMSYWSELARDA

SEQ ID NO: 825048 - protein, 23 aa, Mycobacterium
IALQEDVALVGLSILSGAHVALT

SEQ ID NO: 825049 - protein, 21 aa, Mycobacterium
IALQIPSANDPTLAPPGKHAV

SEQ ID NO: 825050 - protein, 20 aa, Mycobacterium
IALRRPSLDEVFLALTGDHP

SEQ ID NO: 825051 - protein, 24 aa, Mycobacterium
IALRTCLQHPRIARPAVIISAEAI

SEQ ID NO: 825052 - protein, 18 aa, Mycobacterium
IALTDPLMTAIEKAAAVV

SEQ ID NO: 825053 - protein, 18 aa, Mycobacterium
IALTLPFSADAIPKVVHG

SEQ ID NO: 825054 - protein, 25 aa, Mycobacterium
IALTRIGAVLVPLSTLLAAGELAAQ

SEQ ID NO: 825055 - protein, 18 aa, Mycobacterium
IALVKQLMEANWVKRVLF

SEQ ID NO: 825056 - protein, 17 aa, Mycobacterium
IALYEHQVFTEGVIWGI

SEQ ID NO: 825057 - protein, 26 aa, Mycobacterium
IAMGHGGMLYSLPSRELIADSVEYMI

SEQ ID NO: 825058 - protein, 26 aa, Mycobacterium
IAMGHSGMLYSLPSRDLIADSVEYMV

SEQ ID NO: 825059 - protein, 28 aa, Mycobacterium
IAMKSGWTWRTPLLGRFGSGYVYSSQFA

SEQ ID NO: 825060 - protein, 17 aa, Mycobacterium
IAMLDEDGYLFIGGRSD

SEQ ID NO: 825061 - protein, 22 aa, Mycobacterium
IAMLDGAHVLYLAVFEGRQRFP

SEQ ID NO: 825062 - protein, 19 aa, Mycobacterium
IAMLRLACEAADAALTDLV

SEQ ID NO: 825063 - protein, 17 aa, Mycobacterium
IAMLSASGVRRVYGLPG

SEQ ID NO: 825064 - protein, 21 aa, Mycobacterium
IAMNFGLDGPWGQWVNRWTAE

SEQ ID NO: 825065 - protein, 22 aa, Mycobacterium
IAMNFSMDGPWGFWVNRWTAEE

SEQ ID NO: 825066 - protein, 22 aa, Mycobacterium
IAMNFTMDGPWGQWVNRWTAEE

SEQ ID NO: 825067 - protein, 18 aa, Mycobacterium
IAMPALRLDAAFAHLNLG

SEQ ID NO: 825068 - protein, 19 aa, Mycobacterium
IAMPALRLDAAFAHLNLGD

SEQ ID NO: 825069 - protein, 29 aa, Mycobacterium
IAMRVLTYRPGRLAAKVRCPILFCVCQTD

SEQ ID NO: 825070 - protein, 18 aa, Mycobacterium
IAMVFQNYALYPHMSVYR

SEQ ID NO: 825071 - protein, 20 aa, Mycobacterium
IANDLLFERFLSPARDGPPD

SEQ ID NO: 825072 - protein, 27 aa, Mycobacterium
IANESEAQQWRWSPAHLVVTCGARGAR

SEQ ID NO: 825073 - protein, 20 aa, Mycobacterium
IANGLARWTAAGADTLVLQP

SEQ ID NO: 825074 - protein, 24 aa, Mycobacterium
IANPDRLGYLRQFIRRRTTLTARK

SEQ ID NO: 825075 - protein, 18 aa, Mycobacterium
IANPEYLVDINDLALELG

SEQ ID NO: 825076 - protein, 21 aa, Mycobacterium
IANPTLLARIPTDELRALMVG

SEQ ID NO: 825077 - protein, 24 aa, Mycobacterium
IANRVSYFFDLRGPSVTIDTACSS

SEQ ID NO: 825078 - protein, 32 aa, Mycobacterium
IANSFLPSVLEPWTGLWPPSLAGLRGDAFDAA

SEQ ID NO: 825079 - protein, 25 aa, Mycobacterium
IANTPQAYWIVPGGSAATVGKYVGD

SEQ ID NO: 825080 - protein, 26 aa, Mycobacterium
IANTPQAYWIVPGSSASTVGKYVGDA

SEQ ID NO: 825081 - protein, 17 aa, Mycobacterium
IAPDETTFEFLKGRPHA

SEQ ID NO: 825082 - protein, 24 aa, Mycobacterium
IAPDRLRAAWVDMPEVVSAATVTG

SEQ ID NO: 825083 - protein, 21 aa, Mycobacterium
IAPDWLHLVARYYEAYGSFEW

SEQ ID NO: 825084 - protein, 20 aa, Mycobacterium
IAPDYVLVEAPIRDKLVDSI

SEQ ID NO: 825085 - protein, 23 aa, Mycobacterium
IAPELTGLWTAGFMMAPTNTRIV

SEQ ID NO: 825086 - protein, 29 aa, Mycobacterium
IAPERLTWIMPRDSWLLDRATMQPGSLFA

SEQ ID NO: 825087 - protein, 30 aa, Mycobacterium
IAPFALAEAAGWAAGPWAAAKTLSPMASGE

SEQ ID NO: 825088 - protein, 23 aa, Mycobacterium
IAPGDWVLVCNADGTPFGWMDDA

SEQ ID NO: 825089 - protein, 24 aa, Mycobacterium
IAPGPFVIDIRDLDFIGSCAYAVL

SEQ ID NO: 825090 - protein, 22 aa, Mycobacterium
IAPHWPRPWGVEATQLQLLIID

SEQ ID NO: 825091 - protein, 33 aa, Mycobacterium
IAPILTVRSLDAALARYRTLGFAARAYEGPDRY

SEQ ID NO: 825092 - protein, 20 aa, Mycobacterium
IAPITLIPNWACRAFLFTQV

SEQ ID NO: 825093 - protein, 24 aa, Mycobacterium
IAPPPQEALPRWRRIMEGLRHSKT

SEQ ID NO: 825094 - protein, 27 aa, Mycobacterium
IAPQLRTFARRHPAVTIRLLEGSKEEI

SEQ ID NO: 825095 - protein, 18 aa, Mycobacterium
IAPQPLFDTVEAYRRMVD

SEQ ID NO: 825096 - protein, 20 aa, Mycobacterium
IAPRVVFMEASDDMLVRRYE

SEQ ID NO: 825097 - protein, 19 aa, Mycobacterium
IAPSRYAGRRVLITGGGSG

SEQ ID NO: 825098 - protein, 31 aa, Mycobacterium
IAPVQLVRIGRLYLIGIPGEPTVVAGLRLRR

SEQ ID NO: 825099 - protein, 20 aa, Mycobacterium
IAQAWRNIVFGEADVAICGG

SEQ ID NO: 825100 - protein, 22 aa, Mycobacterium
IAQEEVFGPVLTVLRCRDDDDA

SEQ ID NO: 825101 - protein, 22 aa, Mycobacterium
IAQGGMQWVGRAELVAAVANAG

SEQ ID NO: 825102 - protein, 19 aa, Mycobacterium
IAQGWMNRARRLLTGAPTG

SEQ ID NO: 825103 - protein, 21 aa, Mycobacterium
IAQGWYRRMRVVLAELRKIGV

SEQ ID NO: 825104 - protein, 20 aa, Mycobacterium
IAQINLMAALGRIGPCSPAR

SEQ ID NO: 825105 - protein, 27 aa, Mycobacterium
IAQLAHVIPIMRARLLKLLSGPNAAVK

SEQ ID NO: 825106 - protein, 20 aa, Mycobacterium
IAQLDARYLAGEAAPYAAAW

SEQ ID NO: 825107 - protein, 20 aa, Mycobacterium
IAQLFDVPPLPYEEVKIATA

SEQ ID NO: 825108 - protein, 24 aa, Mycobacterium
IAQLRDIAPRRILPDSAIIDAAIA

SEQ ID NO: 825109 - protein, 18 aa, Mycobacterium
IAQMIWTACGLDPEDFAL

SEQ ID NO: 825110 - protein, 17 aa, Mycobacterium
IAQQLTFGPGGSTAGAG

SEQ ID NO: 825111 - protein, 38 aa, Mycobacterium
IAQQMLEAASLLMYGRELNWVQQWWSGVFETADGYVTV

SEQ ID NO: 825112 - protein, 26 aa, Mycobacterium
IAQRGVPWILMHWRSKDFIHTPATRN

SEQ ID NO: 825113 - protein, 28 aa, Mycobacterium
IAQTVARWLVLYLRRPGGQTQFAAPVWM

SEQ ID NO: 825114 - protein, 24 aa, Mycobacterium
IARAAEIIASARKPLIIAGGGVHY

SEQ ID NO: 825115 - protein, 17 aa, Mycobacterium
IARAAGIILTWNDIADL

SEQ ID NO: 825116 - protein, 22 aa, Mycobacterium
IARAFVNRPLVLLADEPTGNLD

SEQ ID NO: 825117 - protein, 33 aa, Mycobacterium
IARAHDQFRWFAGGWAVNADLPTPAGFAAATQF

SEQ ID NO: 825118 - protein, 20 aa, Mycobacterium
IARALAMQPKLMLFDEPTSA

SEQ ID NO: 825119 - protein, 19 aa, Mycobacterium
IARANKILELARAYGIEPS

SEQ ID NO: 825120 - protein, 19 aa, Mycobacterium
IARATKILELARAYDIESS

SEQ ID NO: 825121 - protein, 26 aa, Mycobacterium
IARATPWWEPGTAQGYHMATFGFILG

SEQ ID NO: 825122 - protein, 18 aa, Mycobacterium
IARDGMLPLNTYGGQLSA

SEQ ID NO: 825123 - protein, 26 aa, Mycobacterium
IARELDRYLPFLATTKVLIAAVRAGM

SEQ ID NO: 825124 - protein, 26 aa, Mycobacterium
IARELDRYLPFLATTRVLIAAVRAGM

SEQ ID NO: 825125 - protein, 28 aa, Mycobacterium
IARELGIGIVPYSPLGRGWLTGRVQSRD

SEQ ID NO: 825126 - protein, 20 aa, Mycobacterium
IARFAPRRLVGPRTLPLMRA

SEQ ID NO: 825127 - protein, 17 aa, Mycobacterium
IARHLQGMWVSWLHEFD

SEQ ID NO: 825128 - protein, 18 aa, Mycobacterium
IARIQRFAHPVLLERSRA

SEQ ID NO: 825129 - protein, 17 aa, Mycobacterium
IARLAPGTPLRDGLERI

SEQ ID NO: 825130 - protein, 22 aa, Mycobacterium
IARLARFFSIDPASLRMDLIVE

SEQ ID NO: 825131 - protein, 25 aa, Mycobacterium
IARLARMLVLGPLGESVGRIRDVVI

SEQ ID NO: 825132 - protein, 17 aa, Mycobacterium
IARLGVPALLMSDAGLG

SEQ ID NO: 825133 - protein, 21 aa, Mycobacterium
IARLIAFGEIRGVRPGGLIDV

SEQ ID NO: 825134 - protein, 25 aa, Mycobacterium
IARLSRMLVLGPLGESFGRIRDVVI

SEQ ID NO: 825135 - protein, 17 aa, Mycobacterium
IARLTGLEILRKTRDDE

SEQ ID NO: 825136 - protein, 19 aa, Mycobacterium
IARLVDLYAKRPQVQERLT

SEQ ID NO: 825137 - protein, 18 aa, Mycobacterium
IARLVPITDDPWADMVAA

SEQ ID NO: 825138 - protein, 20 aa, Mycobacterium
IARNALLGAGFPESVPGVTI

SEQ ID NO: 825139 - protein, 21 aa, Mycobacterium
IARNALLGAGFPETVPGVTID

SEQ ID NO: 825140 - protein, 21 aa, Mycobacterium
IARNAYPHLKLIVLGHSMGGG

SEQ ID NO: 825141 - protein, 23 aa, Mycobacterium
IARPDLQVVLLEPMLRRVEFLQE

SEQ ID NO: 825142 - protein, 17 aa, Mycobacterium
IARPGHFAGVLTVVLKL

SEQ ID NO: 825143 - protein, 24 aa, Mycobacterium
IARPPDVLITTPESLFLMLTSAAR

SEQ ID NO: 825144 - protein, 25 aa, Mycobacterium
IARQAIDFFGGPPRHQLRACLAPRC

SEQ ID NO: 825145 - protein, 24 aa, Mycobacterium
IARRELLSGVLRRGLRAAALFVAD

SEQ ID NO: 825146 - protein, 22 aa, Mycobacterium
IARRFAHLTYRGEAELDDRFGN

SEQ ID NO: 825147 - protein, 26 aa, Mycobacterium
IARRLQEMAFLNKGLILTLTDQRDPE

SEQ ID NO: 825148 - protein, 20 aa, Mycobacterium
IARRTDPILFRLSKGRINMG

SEQ ID NO: 825149 - protein, 25 aa, Mycobacterium
IARSDLFTAFVPFAARWPVEVHIYP

SEQ ID NO: 825150 - protein, 17 aa, Mycobacterium
IARSREVWLMVSGAGKA

SEQ ID NO: 825151 - protein, 21 aa, Mycobacterium
IARTSLLAAGWPETVPGVTVD

SEQ ID NO: 825152 - protein, 31 aa, Mycobacterium
IARVLPELAGLLRTPLFTLERVRVCKRDGQF

SEQ ID NO: 825153 - protein, 17 aa, Mycobacterium
IARVLPMLSVPHLDREF

SEQ ID NO: 825154 - protein, 17 aa, Mycobacterium
IARVQIPPAAAGAVQEL

SEQ ID NO: 825155 - protein, 19 aa, Mycobacterium
IARWLATPGVRIVRVTGTE

SEQ ID NO: 825156 - protein, 20 aa, Mycobacterium
IARWLGQAGVRIVRADAGYC

SEQ ID NO: 825157 - protein, 20 aa, Mycobacterium
IARWPVGRPFAAAPKMAQIT

SEQ ID NO: 825158 - protein, 17 aa, Mycobacterium
IARYARCERLLAAAPTV

SEQ ID NO: 825159 - protein, 19 aa, Mycobacterium
IARYKIPKAFIRSPEIVRS

SEQ ID NO: 825160 - protein, 22 aa, Mycobacterium
IARYKLPKAVVFRPAIERSPAG

SEQ ID NO: 825161 - protein, 31 aa, Mycobacterium
IARYPDARSALLPLLHLVQAQDGYLTPAGIG

SEQ ID NO: 825162 - protein, 26 aa, Mycobacterium
IASAHEWLRVLKRLQPRLYSISSSPK

SEQ ID NO: 825163 - protein, 23 aa, Mycobacterium
IASDRLRLEAYRRLAAAASDGEI

SEQ ID NO: 825164 - protein, 24 aa, Mycobacterium
IASELILPIALAVQNGIPVSELAQ

SEQ ID NO: 825165 - protein, 24 aa, Mycobacterium
IASGPTPGFGMWVKIRAADGTVTL

SEQ ID NO: 825166 - protein, 22 aa, Mycobacterium
IASIFAWTRGLAHRGKLDNTPE

SEQ ID NO: 825167 - protein, 26 aa, Mycobacterium
IASKGYLGHHVPGMAPNLLLTSVGAK

SEQ ID NO: 825168 - protein, 43 aa, Mycobacterium
IASLFSGHALDYQSLGARMTAFHDQFVAALTAGGGLYSSAEAA

SEQ ID NO: 825169 - protein, 44 aa, Mycobacterium
IASLFSGHALDYQSLGARMTAFHDQFVAALTAGGGLYSSAEAAA

SEQ ID NO: 825170 - protein, 18 aa, Mycobacterium
IASLLPGAAMPGPSAAWL

SEQ ID NO: 825171 - protein, 20 aa, Mycobacterium
IASLMERRLDRERPLWECWI

SEQ ID NO: 825172 - protein, 17 aa, Mycobacterium
IASLYAAFVERYGDRIT

SEQ ID NO: 825173 - protein, 18 aa, Mycobacterium
IASMFLYLDEHPDERARL

SEQ ID NO: 825174 - protein, 21 aa, Mycobacterium
IASNTLWPRTLVATAAVQNLL

SEQ ID NO: 825175 - protein, 28 aa, Mycobacterium
IASQPIAARLLWIVGKLTEMSRLVTTVH

SEQ ID NO: 825176 - protein, 22 aa, Mycobacterium
IASRWPGLLPEVQRLLPDVHPE

SEQ ID NO: 825177 - protein, 35 aa, Mycobacterium
IASTERGLLLTTLWYIREVDPTTLLLTGLTRDGVY

SEQ ID NO: 825178 - protein, 30 aa, Mycobacterium
IASTGFLLPSNMVTPFLGMLGTAAVADAAE

SEQ ID NO: 825179 - protein, 19 aa, Mycobacterium
IASTGLRTELRRAQRLGFD

SEQ ID NO: 825180 - protein, 27 aa, Mycobacterium
IASVDCALGPLWNPVRLAEDIALVDNM

SEQ ID NO: 825181 - protein, 26 aa, Mycobacterium
IASVLSIATKYPWLQAVPAYGVAIGP

SEQ ID NO: 825182 - protein, 27 aa, Mycobacterium
IASVRGFPFWSVYAASKAVLHAYARVW

SEQ ID NO: 825183 - protein, 19 aa, Mycobacterium
IASWARLWEIEADQWRDVI

SEQ ID NO: 825184 - protein, 25 aa, Mycobacterium
IATDHLMRFPGRFSEQLLPEHLHKV

SEQ ID NO: 825185 - protein, 20 aa, Mycobacterium
IATDNLMRFPGRFSEHLLAE

SEQ ID NO: 825186 - protein, 26 aa, Mycobacterium
IATDPDRVPPLALPPLVDGTLGGTAS

SEQ ID NO: 825187 - protein, 25 aa, Mycobacterium
IATEAPPWVGPLDVMVVAGDDPGDP

SEQ ID NO: 825188 - protein, 24 aa, Mycobacterium
IATEDLVYLLRDSGVDVDVDLQAA

SEQ ID NO: 825189 - protein, 28 aa, Mycobacterium
IATFALQTFTIPLELPPLVIGMAWHPRF

SEQ ID NO: 825190 - protein, 18 aa, Mycobacterium
IATGLAKHLAVEWADRGI

SEQ ID NO: 825191 - protein, 22 aa, Mycobacterium
IATGLTLSPTLIFDHPTPAALA

SEQ ID NO: 825192 - protein, 26 aa, Mycobacterium
IATGLVPRRIPTFPDLAGVHVLRTAD

SEQ ID NO: 825193 - protein, 19 aa, Mycobacterium
IATIALYHLHDIIHHAHDV

SEQ ID NO: 825194 - protein, 31 aa, Mycobacterium
IATIITRGLAEITRLGLALGASHTTLAGLAG

SEQ ID NO: 825195 - protein, 23 aa, Mycobacterium
IATKRIAPIVILTAFSQRDLVEK

SEQ ID NO: 825196 - protein, 17 aa, Mycobacterium
IATLERYKIRLDEVSRQ

SEQ ID NO: 825197 - protein, 21 aa, Mycobacterium
IATLLLSRPPTNALTRQMNRE

SEQ ID NO: 825198 - protein, 23 aa, Mycobacterium
IATPGDWRREPLSGIPAAAHTVV

SEQ ID NO: 825199 - protein, 32 aa, Mycobacterium
IATPPSHILGLLNILTALRTGASVRLHPRFDV

SEQ ID NO: 825200 - protein, 19 aa, Mycobacterium
IATPQLRAHLDAWLARFAA

SEQ ID NO: 825201 - protein, 19 aa, Mycobacterium
IATPRTWRFHLAATTVEIT

SEQ ID NO: 825202 - protein, 21 aa, Mycobacterium
IATPYLIQPFTQGADIVVHSA

SEQ ID NO: 825203 - protein, 24 aa, Mycobacterium
IATVMERRLDRERPLWDCFMIEGL

SEQ ID NO: 825204 - protein, 19 aa, Mycobacterium
IATVNALFAEPFTIARQIA

SEQ ID NO: 825205 - protein, 34 aa, Mycobacterium
IATVYQNLAVVPLMPVWRNFFLGQELRKKRFPFS

SEQ ID NO: 825206 - protein, 17 aa, Mycobacterium
IATWRREVSLRRTRERR

SEQ ID NO: 825207 - protein, 17 aa, Mycobacterium
IATWTGIPIGYVAVYVV

SEQ ID NO: 825208 - protein, 22 aa, Mycobacterium
IAVARAVGIGELKFFSKIHYGG

SEQ ID NO: 825209 - protein, 23 aa, Mycobacterium
IAVAYNVWNFYQVTGDLAYMIDY

SEQ ID NO: 825210 - protein, 23 aa, Mycobacterium
IAVAYNVWQFYQVTGDLAFMIDY

SEQ ID NO: 825211 - protein, 26 aa, Mycobacterium
IAVEAYGLFIFRDALAAMGIATAPIG

SEQ ID NO: 825212 - protein, 18 aa, Mycobacterium
IAVFLVPAKAPGVEVGAK

SEQ ID NO: 825213 - protein, 25 aa, Mycobacterium
IAVGLRLYRSAFFKVVPQVNAEVRG

SEQ ID NO: 825214 - protein, 28 aa, Mycobacterium
IAVGTLYRYFPAKTHLLVAALTREFRRL

SEQ ID NO: 825215 - protein, 26 aa, Mycobacterium
IAVHLRGHFLLTRNAATYWRSKAKDA

SEQ ID NO: 825216 - protein, 28 aa, Mycobacterium
IAVHLRGHFLLTRNAATYWRSKAKEADG

SEQ ID NO: 825217 - protein, 25 aa, Mycobacterium
IAVHSPLAVWMTKETMWQTVDAPSL

SEQ ID NO: 825218 - protein, 24 aa, Mycobacterium
IAVIDIIFGAFLSQAISASAQLGI

SEQ ID NO: 825219 - protein, 23 aa, Mycobacterium
IAVIVERHRDAHACFKALCAAGV

SEQ ID NO: 825220 - protein, 18 aa, Mycobacterium
IAVKLIQPVAMDEGLRFA

SEQ ID NO: 825221 - protein, 22 aa, Mycobacterium
IAVKSNLPGLNAKGACIGPMGQ

SEQ ID NO: 825222 - protein, 28 aa, Mycobacterium
IAVLDPLTALGCMPLAIHPAMTFAGGDE

SEQ ID NO: 825223 - protein, 17 aa, Mycobacterium
IAVLLPDDLVLPTGVLG

SEQ ID NO: 825224 - protein, 31 aa, Mycobacterium
IAVLSARPRMLFDYFQQLFAQVTNPPLDAIR

SEQ ID NO: 825225 - protein, 30 aa, Mycobacterium
IAVLSNRSRMLFDYFQQLFAQVTNPPLDAI

SEQ ID NO: 825226 - protein, 32 aa, Mycobacterium
IAVLSSRPRMLYDYFQQLFAQVTNPPLDAIRE

SEQ ID NO: 825227 - protein, 18 aa, Mycobacterium
IAVLYYRAQQLAGNTAYV

SEQ ID NO: 825228 - protein, 22 aa, Mycobacterium
IAVPVNFRMTPSEIAFLVSDCA

SEQ ID NO: 825229 - protein, 26 aa, Mycobacterium
IAVRTRFFDDFFLDAARRGVRQSVIL

SEQ ID NO: 825230 - protein, 23 aa, Mycobacterium
IAVRTRFFDDFFLNAARDGVRQS

SEQ ID NO: 825231 - protein, 25 aa, Mycobacterium
IAVTQAFLPLLRRAAGRIVVIASIG

SEQ ID NO: 825232 - protein, 18 aa, Mycobacterium
IAVWKLGATPQPVSWRLP

SEQ ID NO: 825233 - protein, 23 aa, Mycobacterium
IAWEHNIGVLGGRFRVLAPDLLG

SEQ ID NO: 825234 - protein, 19 aa, Mycobacterium
IAWMLAGPEHTYQVPLPEP

SEQ ID NO: 825235 - protein, 20 aa, Mycobacterium
IAWSLLRHPVKSREFPAKNE

SEQ ID NO: 825236 - protein, 20 aa, Mycobacterium
IAWTLFRHPVKSREFPAKAE

SEQ ID NO: 825237 - protein, 17 aa, Mycobacterium
IAYIIPKGSDAQLRAQG

SEQ ID NO: 825238 - protein, 17 aa, Mycobacterium
IAYIIPKGTDARLRSEG

SEQ ID NO: 825239 - protein, 22 aa, Mycobacterium
IAYILVLHTRFPNGFTATVRGV

SEQ ID NO: 825240 - protein, 30 aa, Mycobacterium
IAYPETYLSGYPFWPSRTQGALFDHPDQKR

SEQ ID NO: 825241 - protein, 24 aa, Mycobacterium
IAYQYPTPIICTLLGAPREDWQLF

SEQ ID NO: 825242 - protein, 20 aa, Mycobacterium
IAYRLHPPVLRALGLKRKLV

SEQ ID NO: 825243 - protein, 25 aa, Mycobacterium
IAYVPGDVTLWPTLTGGETIDLLAR

SEQ ID NO: 825244 - protein, 17 aa, Mycobacterium
IAYYRHIDYVLSAVESG

SEQ ID NO: 825245 - protein, 24 aa, Mycobacterium
ICAPFTHQQLILADAINLPGATKI

SEQ ID NO: 825246 - protein, 17 aa, Mycobacterium
ICAQSGLAARYFYESFT

SEQ ID NO: 825247 - protein, 17 aa, Mycobacterium
ICARIAQAPALRGLLGP

SEQ ID NO: 825248 - protein, 25 aa, Mycobacterium
ICAVSPALWLSLGAAAPGAFDGPDD

SEQ ID NO: 825249 - protein, 24 aa, Mycobacterium
ICDADLRLTLIEVVLALSGLDSSF

SEQ ID NO: 825250 - protein, 23 aa, Mycobacterium
ICDALEVPLSSVLIDAGERMAGL

SEQ ID NO: 825251 - protein, 17 aa, Mycobacterium
ICDQIVVEIPQLQRFTS

SEQ ID NO: 825252 - protein, 18 aa, Mycobacterium
ICDRLGLLPMYAVNQDKH

SEQ ID NO: 825253 - protein, 17 aa, Mycobacterium
ICFPSFPGFAARLFATD

SEQ ID NO: 825254 - protein, 19 aa, Mycobacterium
ICFPSFPGFAGRRFATDDP

SEQ ID NO: 825255 - protein, 32 aa, Mycobacterium
ICGKHSAIAALPWFWSDQYDLKLQIAGLNAGY

SEQ ID NO: 825256 - protein, 25 aa, Mycobacterium
ICGPETLRSLYFLGARVTGGSPHAI

SEQ ID NO: 825257 - protein, 20 aa, Mycobacterium
ICIPTGWVWTPPPLYDDSGT

SEQ ID NO: 825258 - protein, 18 aa, Mycobacterium
ICLLLYTSGTASAPKGVQ

SEQ ID NO: 825259 - protein, 21 aa, Mycobacterium
ICLPYLADLTTPEQKKRWLPG

SEQ ID NO: 825260 - protein, 18 aa, Mycobacterium
ICLTVRGKHRCDGRRHLI

SEQ ID NO: 825261 - protein, 22 aa, Mycobacterium
ICNDLLIFMLAGHDTTATALTY

SEQ ID NO: 825262 - protein, 19 aa, Mycobacterium
ICNRLLWQADVLGFGAGDV

SEQ ID NO: 825263 - protein, 20 aa, Mycobacterium
ICPFIVQGLVSVPVGTALSP

SEQ ID NO: 825264 - protein, 18 aa, Mycobacterium
ICPGAINTGFYTAARHLG

SEQ ID NO: 825265 - protein, 18 aa, Mycobacterium
ICPVCHFELPGGWRQGQA

SEQ ID NO: 825266 - protein, 24 aa, Mycobacterium
ICQDLHTRAMRRAAWETYMAENDP

SEQ ID NO: 825267 - protein, 24 aa, Mycobacterium
ICQLRDHWLIDPGDTFLVPSPIAH

SEQ ID NO: 825268 - protein, 20 aa, Mycobacterium
ICRELRVFGCQTPGALADSF

SEQ ID NO: 825269 - protein, 21 aa, Mycobacterium
ICRFASWWVVLERHGDLIRLY

SEQ ID NO: 825270 - protein, 26 aa, Mycobacterium
ICSETLELLLRPTGYSDDITLLAAQR

SEQ ID NO: 825271 - protein, 24 aa, Mycobacterium
ICSETLELLLRSTGYSDDVTLLAA

SEQ ID NO: 825272 - protein, 21 aa, Mycobacterium
ICSGGLRWASHLSYVPGLTNK

SEQ ID NO: 825273 - protein, 22 aa, Mycobacterium
ICTAGVGVVPAGRRLSRADVRP

SEQ ID NO: 825274 - protein, 21 aa, Mycobacterium
ICTALDVPLSRVLSEAGQELA

SEQ ID NO: 825275 - protein, 19 aa, Mycobacterium
ICTHYFAHRAWLDDGQLLR

SEQ ID NO: 825276 - protein, 33 aa, Mycobacterium
ICTLRERMALPRALLERLPNLKLITIVGRSLPN

SEQ ID NO: 825277 - protein, 22 aa, Mycobacterium
ICTQFLETFKEFPPRHPPASFT

SEQ ID NO: 825278 - protein, 18 aa, Mycobacterium
ICVATRVILALRVVPRSA

SEQ ID NO: 825279 - protein, 24 aa, Mycobacterium
ICVHDPLIMRRALEYATGLGVLIA

SEQ ID NO: 825280 - protein, 34 aa, Mycobacterium
IDAAEIYVPFSWFEPMWLENLGFMPEGEGWKLTE

SEQ ID NO: 825281 - protein, 26 aa, Mycobacterium
IDAAGLLRIWKSLIVLYPDGTPRTKH

SEQ ID NO: 825282 - protein, 29 aa, Mycobacterium
IDAANDAALLLELIERYAPTLSLIVTSHQ

SEQ ID NO: 825283 - protein, 18 aa, Mycobacterium
IDAARWPFAVRKPRTGPP

SEQ ID NO: 825284 - protein, 19 aa, Mycobacterium
IDAAYFVVERLRRLEERWN

SEQ ID NO: 825285 - protein, 25 aa, Mycobacterium
IDADGFVWIVGRADQAIIRGGFKVL

SEQ ID NO: 825286 - protein, 18 aa, Mycobacterium
IDAFLETSLVELALAYAA

SEQ ID NO: 825287 - protein, 24 aa, Mycobacterium
IDAGGAFGLLTRLSQQTNTRVEQI

SEQ ID NO: 825288 - protein, 19 aa, Mycobacterium
IDAIPYPLGTKSDLDETAR

SEQ ID NO: 825289 - protein, 18 aa, Mycobacterium
IDAISTLVTREKPRRLVV

SEQ ID NO: 825290 - protein, 28 aa, Mycobacterium
IDAITSEFYRRLFTNHPELLRNLFNRGN

SEQ ID NO: 825291 - protein, 29 aa, Mycobacterium
IDALCDPPESFQLYGIVAHVLTYSAHRRG

SEQ ID NO: 825292 - protein, 17 aa, Mycobacterium
IDALHHLGKLDARIPII

SEQ ID NO: 825293 - protein, 19 aa, Mycobacterium
IDALRKRFPKLAEPPTEDI

SEQ ID NO: 825294 - protein, 25 aa, Mycobacterium
IDAMAVGLAAWRLGAGRSRPGARVQ

SEQ ID NO: 825295 - protein, 25 aa, Mycobacterium
IDAMAVGLAAWRLGAGRSRPGDRVQ

SEQ ID NO: 825296 - protein, 25 aa, Mycobacterium
IDAMAVGLAVWRLGAGRSVPGEQVQ

SEQ ID NO: 825297 - protein, 26 aa, Mycobacterium
IDAMGVAMAAWRLGAGRAQPGEPVQL

SEQ ID NO: 825298 - protein, 25 aa, Mycobacterium
IDAPAHIRPIAWLCVGPVREFAERP

SEQ ID NO: 825299 - protein, 33 aa, Mycobacterium
IDAPCELIDFWRFNVAFARQILAQQPISSPGVW

SEQ ID NO: 825300 - protein, 18 aa, Mycobacterium
IDAPMHWPGLGEVPTREL

SEQ ID NO: 825301 - protein, 22 aa, Mycobacterium
IDARGRRPLWTYAHVPSGSPVD

SEQ ID NO: 825302 - protein, 32 aa, Mycobacterium
IDASEVAKLWPWADLEPFAAFGWEARGGYGDA

SEQ ID NO: 825303 - protein, 24 aa, Mycobacterium
IDCGPGDRLLISSDGLFAAADEAL

SEQ ID NO: 825304 - protein, 25 aa, Mycobacterium
IDCPLINIHHSFLPAFTGAMPYRRA

SEQ ID NO: 825305 - protein, 24 aa, Mycobacterium
IDCPPSLGLLTINALVAAPEVMIP

SEQ ID NO: 825306 - protein, 22 aa, Mycobacterium
IDCPPSLGVLTLNGLTAADEVI

SEQ ID NO: 825307 - protein, 23 aa, Mycobacterium
IDCPPSLGVLTLNGLTAADEVIV

SEQ ID NO: 825308 - protein, 23 aa, Mycobacterium
IDCPPSLGVLTLNGLTAADEVVV

SEQ ID NO: 825309 - protein, 22 aa, Mycobacterium
IDCPPSLGVLTLNGLTAADSVM

SEQ ID NO: 825310 - protein, 23 aa, Mycobacterium
IDCPPSLGVLTLNGLTAAHDVIV

SEQ ID NO: 825311 - protein, 18 aa, Mycobacterium
IDCRLAVASVMMAQGEPP

SEQ ID NO: 825312 - protein, 24 aa, Mycobacterium
IDDALALIYLLASTDADLVGIAST

SEQ ID NO: 825313 - protein, 24 aa, Mycobacterium
IDDDVAIELIWCNIRPPRGLVARD

SEQ ID NO: 825314 - protein, 19 aa, Mycobacterium
IDDEHLLFVASDRISAYDY

SEQ ID NO: 825315 - protein, 33 aa, Mycobacterium
IDDELWDVLPGYLMFRFIVPSRPPTRRTVQALV

SEQ ID NO: 825316 - protein, 19 aa, Mycobacterium
IDDFVLQPAPVGAVPLWIG

SEQ ID NO: 825317 - protein, 23 aa, Mycobacterium
IDDGFFDYLAFTRGLDGAEIRKL

SEQ ID NO: 825318 - protein, 33 aa, Mycobacterium
IDDHDTIFAWWIRRHLNPPPPLSEWVEAIAREE

SEQ ID NO: 825319 - protein, 17 aa, Mycobacterium
IDDLIAYYVADDEIFLV

SEQ ID NO: 825320 - protein, 18 aa, Mycobacterium
IDDMVAACLKWEGGYVWA

SEQ ID NO: 825321 - protein, 23 aa, Mycobacterium
IDDMVAACLKWEGGYVWACKNYD

SEQ ID NO: 825322 - protein, 26 aa, Mycobacterium
IDDNLFLRDLVLALQWVRDNIAVFGG

SEQ ID NO: 825323 - protein, 26 aa, Mycobacterium
IDDNLYLRDLVMALRWVRDNIASFGG

SEQ ID NO: 825324 - protein, 24 aa, Mycobacterium
IDDPDPVVFLEPKRLYFSRADVEL

SEQ ID NO: 825325 - protein, 17 aa, Mycobacterium
IDDTITQTFDLPGSGTL

SEQ ID NO: 825326 - protein, 24 aa, Mycobacterium
IDDVAAALMRKLGNRVPGVLAGQS

SEQ ID NO: 825327 - protein, 17 aa, Mycobacterium
IDDVCIAVQRWGELSPT

SEQ ID NO: 825328 - protein, 26 aa, Mycobacterium
IDDVSQLVYLHLRFHGYGDAKWTDSA

SEQ ID NO: 825329 - protein, 32 aa, Mycobacterium
IDEAIARQLPLRLVYVIPRREKHREPATSSEW

SEQ ID NO: 825330 - protein, 30 aa, Mycobacterium
IDEAINFAFPHYFLLPQYSSASSYRIRPLG

SEQ ID NO: 825331 - protein, 26 aa, Mycobacterium
IDEAVREYLYPIAANRIRGLTLPGPL

SEQ ID NO: 825332 - protein, 22 aa, Mycobacterium
IDEDVLAQRFLGGAGVSDWIVD

SEQ ID NO: 825333 - protein, 26 aa, Mycobacterium
IDEEYRRYFTLTGKPTGEWAAATKRL

SEQ ID NO: 825334 - protein, 26 aa, Mycobacterium
IDEFDADFFGFPPLAAQVLDPQHRLF

SEQ ID NO: 825335 - protein, 29 aa, Mycobacterium
IDEFPDLRRVHLVPAPPYGQGPAAARAGA

SEQ ID NO: 825336 - protein, 24 aa, Mycobacterium
IDEGFVAAVYRWATTGDLAASLEA

SEQ ID NO: 825337 - protein, 26 aa, Mycobacterium
IDEKHALVLDLRKLEFLGTEGFLALK

SEQ ID NO: 825338 - protein, 21 aa, Mycobacterium
IDEKYVGIRPAPGYPACPEHT

SEQ ID NO: 825339 - protein, 21 aa, Mycobacterium
IDELIPLARAVVKGAPHALVI

SEQ ID NO: 825340 - protein, 24 aa, Mycobacterium
IDELRVRFPNLDETLISDLVLGVV

SEQ ID NO: 825341 - protein, 26 aa, Mycobacterium
IDEPDQPWALKYRLAGHRSLSVGDVV

SEQ ID NO: 825342 - protein, 19 aa, Mycobacterium
IDEPVLVTDILPNGPELAE

SEQ ID NO: 825343 - protein, 26 aa, Mycobacterium
IDEQSPIVGIWHSGGARLAEGVKALH

SEQ ID NO: 825344 - protein, 25 aa, Mycobacterium
IDEQSPIVGIWHSGGARLAEGVRAL

SEQ ID NO: 825345 - protein, 24 aa, Mycobacterium
IDERPFDVQLLGALRMLDGDVIEM

SEQ ID NO: 825346 - protein, 24 aa, Mycobacterium
IDERTVICVLTHDPKFDVPVLEVA

SEQ ID NO: 825347 - protein, 29 aa, Mycobacterium
IDESEQWRAIRGFLHDLRAGRRHVNAELL

SEQ ID NO: 825348 - protein, 25 aa, Mycobacterium
IDETPLGAWWRDMKLARVGGGTDEV

SEQ ID NO: 825349 - protein, 21 aa, Mycobacterium
IDEVPDVSGLGRLFRRQHDDT

SEQ ID NO: 825350 - protein, 28 aa, Mycobacterium
IDFDDCGFGWYFYDFGTAVSFIEHDPRL

SEQ ID NO: 825351 - protein, 27 aa, Mycobacterium
IDFEDRPLTAQAPWPIGYADVEPYLQR

SEQ ID NO: 825352 - protein, 25 aa, Mycobacterium
IDFGPVWSYPKPYQRPRPKLLAATT

SEQ ID NO: 825353 - protein, 20 aa, Mycobacterium
IDFPSRIGVWWASDTWSMRD

SEQ ID NO: 825354 - protein, 20 aa, Mycobacterium
IDFRLMAAVVYRTELIEDPE

SEQ ID NO: 825355 - protein, 19 aa, Mycobacterium
IDFVLSNLVNARYLRICVL

SEQ ID NO: 825356 - protein, 19 aa, Mycobacterium
IDGADLWKLPRKRAAQRVA

SEQ ID NO: 825357 - protein, 20 aa, Mycobacterium
IDGAFCRYVTIDDDMAHAVP

SEQ ID NO: 825358 - protein, 31 aa, Mycobacterium
IDGEPIISVPGFTIPALHLDGTALSGTIGPI

SEQ ID NO: 825359 - protein, 17 aa, Mycobacterium
IDGESVLPLMPLAVPET

SEQ ID NO: 825360 - protein, 18 aa, Mycobacterium
IDGETVVPLLPAQDFKRV

SEQ ID NO: 825361 - protein, 25 aa, Mycobacterium
IDGGNGGYGGWGFNGGNGGNGGDGG

SEQ ID NO: 825362 - protein, 25 aa, Mycobacterium
IDGGTIRLPRLIGHSRAMDLILTGR

SEQ ID NO: 825363 - protein, 23 aa, Mycobacterium
IDGLLAMPNFADIKVVFDATSAG

SEQ ID NO: 825364 - protein, 35 aa, Mycobacterium
IDGLRRDYRWAEADRHLWIADERGTWHLREAEENK

SEQ ID NO: 825365 - protein, 22 aa, Mycobacterium
IDGLWAAVLQRTAERRGEQPWR

SEQ ID NO: 825366 - protein, 32 aa, Mycobacterium
IDGMLVIADLLHLVDFPLALGIRPNIPYEEQR

SEQ ID NO: 825367 - protein, 25 aa, Mycobacterium
IDGNLFLRDVVLALQWVHDNIGTFG

SEQ ID NO: 825368 - protein, 17 aa, Mycobacterium
IDGPGYHLYHLPGASGD

SEQ ID NO: 825369 - protein, 17 aa, Mycobacterium
IDGQLWQIVEFQHVKPG

SEQ ID NO: 825370 - protein, 17 aa, Mycobacterium
IDGQLWSIVEFQHVKPG

SEQ ID NO: 825371 - protein, 22 aa, Mycobacterium
IDGQLYVDMRLIDGKDLAGMLS

SEQ ID NO: 825372 - protein, 17 aa, Mycobacterium
IDGQWIPAASGRTFARH

SEQ ID NO: 825373 - protein, 27 aa, Mycobacterium
IDGRDYVLEYPIFGDVALIGAHVADQV

SEQ ID NO: 825374 - protein, 23 aa, Mycobacterium
IDGRLRDWFAAQSLMPTVESLAA

SEQ ID NO: 825375 - protein, 21 aa, Mycobacterium
IDGRMIGMRYPYEVNLVADAK

SEQ ID NO: 825376 - protein, 17 aa, Mycobacterium
IDGRWVDPVRPNPFEVE

SEQ ID NO: 825377 - protein, 26 aa, Mycobacterium
IDGTNLTYLGLIPQIQKSFLSKDVEA

SEQ ID NO: 825378 - protein, 25 aa, Mycobacterium
IDGVAINIPTWQLGYRPGDITAIGE

SEQ ID NO: 825379 - protein, 25 aa, Mycobacterium
IDGVPWSRMAVIVRSVPRSGAALCR

SEQ ID NO: 825380 - protein, 20 aa, Mycobacterium
IDGWRRVVVTATQLGIPIPG

SEQ ID NO: 825381 - protein, 22 aa, Mycobacterium
IDGYVWHAYLPTISPGQRYGFR

SEQ ID NO: 825382 - protein, 20 aa, Mycobacterium
IDHAPYFLSINTEILSVDLD

SEQ ID NO: 825383 - protein, 34 aa, Mycobacterium
IDHFQNVFPRAIWDRELTWLAARRPTPHEFFDYQ

SEQ ID NO: 825384 - protein, 17 aa, Mycobacterium
IDHGVLPASIAWIDPEF

SEQ ID NO: 825385 - protein, 18 aa, Mycobacterium
IDHLTGLWQRGIAALAAG

SEQ ID NO: 825386 - protein, 19 aa, Mycobacterium
IDHVLPWSLVGIDGLANLV

SEQ ID NO: 825387 - protein, 18 aa, Mycobacterium
IDHVTGLFIGRAAWQLPG

SEQ ID NO: 825388 - protein, 21 aa, Mycobacterium
IDHVVPWPYGPTHPSNLNCKC

SEQ ID NO: 825389 - protein, 20 aa, Mycobacterium
IDHWWQTETGWAIAANPAGL

SEQ ID NO: 825390 - protein, 18 aa, Mycobacterium
IDIAHVVTAYYAIEPDPA

SEQ ID NO: 825391 - protein, 26 aa, Mycobacterium
IDILAANFVLHPDWFDVVVASNLFGD

SEQ ID NO: 825392 - protein, 22 aa, Mycobacterium
IDILALREKYRLEREKRLRKEG

SEQ ID NO: 825393 - protein, 18 aa, Mycobacterium
IDILVRLTGARYQDLFVL

SEQ ID NO: 825394 - protein, 20 aa, Mycobacterium
IDIQWGILIKRRVSAHENAV

SEQ ID NO: 825395 - protein, 23 aa, Mycobacterium
IDIRAAFLRPVWADTLVATARPA

SEQ ID NO: 825396 - protein, 21 aa, Mycobacterium
IDITWAAINGLVLALGAISLR

SEQ ID NO: 825397 - protein, 24 aa, Mycobacterium
IDKAADVGGTWYWNRYPGIACDVE

SEQ ID NO: 825398 - protein, 30 aa, Mycobacterium
IDKADLRGRFRWWGLYTQRKQGYDGTWTGD

SEQ ID NO: 825399 - protein, 33 aa, Mycobacterium
IDKAFKQLAQQIRLPGFRPGKAPRKLLEARVGR

SEQ ID NO: 825400 - protein, 18 aa, Mycobacterium
IDKFARCSWHSGPDGMPI

SEQ ID NO: 825401 - protein, 17 aa, Mycobacterium
IDKGEFVFLIGPSGSGK

SEQ ID NO: 825402 - protein, 28 aa, Mycobacterium
IDKIDGPYYFFGVLSALAALPRFTPMML

SEQ ID NO: 825403 - protein, 22 aa, Mycobacterium
IDKPKFMVFGEISLRATAKAAE

SEQ ID NO: 825404 - protein, 23 aa, Mycobacterium
IDKYWRAANYLSVGQIYLLDNPL

SEQ ID NO: 825405 - protein, 17 aa, Mycobacterium
IDLDPVPGVPWSQILDV

SEQ ID NO: 825406 - protein, 30 aa, Mycobacterium
IDLFGARVEQLPLIWKRLIDAGMESGHAYG

SEQ ID NO: 825407 - protein, 30 aa, Mycobacterium
IDLITVGNRIIWFFKPAPLPDKMVNHVAAI

SEQ ID NO: 825408 - protein, 20 aa, Mycobacterium
IDLLARMRGGIDKRRRAELI

SEQ ID NO: 825409 - protein, 20 aa, Mycobacterium
IDLLARMRGGVDEKLRADLI

SEQ ID NO: 825410 - protein, 18 aa, Mycobacterium
IDLLSGEGLYRAFKGVDV

SEQ ID NO: 825411 - protein, 22 aa, Mycobacterium
IDLNINGTMYLLKHAGREMVRG

SEQ ID NO: 825412 - protein, 20 aa, Mycobacterium
IDLNMRYLRRIGFVGTPTYH

SEQ ID NO: 825413 - protein, 17 aa, Mycobacterium
IDLPCRDVGLPQDFFDH

SEQ ID NO: 825414 - protein, 25 aa, Mycobacterium
IDLPGLGHPLLPPWTVTGSGVDGVT

SEQ ID NO: 825415 - protein, 22 aa, Mycobacterium
IDLPPTLIYDYPTCAALAAQLA

SEQ ID NO: 825416 - protein, 26 aa, Mycobacterium
IDLPSASYLHLFVARGRLGLESFGDV

SEQ ID NO: 825417 - protein, 18 aa, Mycobacterium
IDLPTVVLESLVGIRRAG

SEQ ID NO: 825418 - protein, 18 aa, Mycobacterium
IDLTPAAVGPYVVPPVNL

SEQ ID NO: 825419 - protein, 19 aa, Mycobacterium
IDLVPIPTGSMVQGLAALA

SEQ ID NO: 825420 - protein, 19 aa, Mycobacterium
IDLVRHLQWIHPRIGHRTV

SEQ ID NO: 825421 - protein, 25 aa, Mycobacterium
IDLYKRMFKPGLDDLIFVGLAQAVP

SEQ ID NO: 825422 - protein, 26 aa, Mycobacterium
IDMDRMLRLRPEIFRELRRECTEMLT

SEQ ID NO: 825423 - protein, 25 aa, Mycobacterium
IDMGVYPFVVPFRPQSGSLATDVDG

SEQ ID NO: 825424 - protein, 17 aa, Mycobacterium
IDMPIIERVGSYPSPTV

SEQ ID NO: 825425 - protein, 17 aa, Mycobacterium
IDMPKIAALTALTKAAL

SEQ ID NO: 825426 - protein, 17 aa, Mycobacterium
IDMQRYNFQFTGQRFYR

SEQ ID NO: 825427 - protein, 18 aa, Mycobacterium
IDMQRYNFQFTGQRFYRI

SEQ ID NO: 825428 - protein, 32 aa, Mycobacterium
IDMTSPAPATPWLATTVRLAWRAKLMISASVD

SEQ ID NO: 825429 - protein, 17 aa, Mycobacterium
IDNFGVVPDLITFAKGV

SEQ ID NO: 825430 - protein, 21 aa, Mycobacterium
IDNGKLHRFVNIYVNDEDVRF

SEQ ID NO: 825431 - protein, 26 aa, Mycobacterium
IDNVVDMAHFFYIHGGLPTGFKNVFE

SEQ ID NO: 825432 - protein, 25 aa, Mycobacterium
IDNVVDMAHFFYIHGSLPTQFKNIF

SEQ ID NO: 825433 - protein, 30 aa, Mycobacterium
IDNVVDMAHFFYIHGSLPTYFKNIFEGHVA

SEQ ID NO: 825434 - protein, 29 aa, Mycobacterium
IDNVVDMAHFFYIHGSLPTYFKNIFEGQV

SEQ ID NO: 825435 - protein, 24 aa, Mycobacterium
IDPAVPAWTWGRRQDVGFIRRRVA

SEQ ID NO: 825436 - protein, 20 aa, Mycobacterium
IDPDGDWRGPIRIRIVRDCA

SEQ ID NO: 825437 - protein, 20 aa, Mycobacterium
IDPFTTAYPVRMVHEGSVRG

SEQ ID NO: 825438 - protein, 24 aa, Mycobacterium
IDPGFANDLFPMTLLGVGGRVDSV

SEQ ID NO: 825439 - protein, 25 aa, Mycobacterium
IDPGYRYVLIYGHRRRVAALEADRQ

SEQ ID NO: 825440 - protein, 26 aa, Mycobacterium
IDPHPELLRAWDLPATADGLAAFCDI

SEQ ID NO: 825441 - protein, 20 aa, Mycobacterium
IDPIGRPIFYGRLTEMTDTD

SEQ ID NO: 825442 - protein, 18 aa, Mycobacterium
IDPIVPQLGKDGGTMPIT

SEQ ID NO: 825443 - protein, 20 aa, Mycobacterium
IDPLARLLEQTLLGYDQLGL

SEQ ID NO: 825444 - protein, 18 aa, Mycobacterium
IDPLDDRLNPNGSGISLG

SEQ ID NO: 825445 - protein, 27 aa, Mycobacterium
IDPPERPIPGPLKWDLTMGVATDTRES

SEQ ID NO: 825446 - protein, 17 aa, Mycobacterium
IDPQGFWARLGHSVAFF

SEQ ID NO: 825447 - protein, 17 aa, Mycobacterium
IDPQHRVLLETSWQAVE

SEQ ID NO: 825448 - protein, 23 aa, Mycobacterium
IDPQLLVAVVTAAGAPVICETSD

SEQ ID NO: 825449 - protein, 25 aa, Mycobacterium
IDPRIRADGYWPQLAAHLAQAATSR

SEQ ID NO: 825450 - protein, 27 aa, Mycobacterium
IDPRRLQLAWPRYDAMRTELAVGQFAD

SEQ ID NO: 825451 - protein, 18 aa, Mycobacterium
IDPSLKLRPSRGTHLVFD

SEQ ID NO: 825452 - protein, 33 aa, Mycobacterium
IDPSTFELKLKTPYSALLPVLSQAFFGIQSPEA

SEQ ID NO: 825453 - protein, 27 aa, Mycobacterium
IDPTGTIRAIIYYPLSLGRNFDELLRV

SEQ ID NO: 825454 - protein, 18 aa, Mycobacterium
IDPVRRPIPVVPGAHYSC

SEQ ID NO: 825455 - protein, 18 aa, Mycobacterium
IDPYQRVWNYPTLSVMDG

SEQ ID NO: 825456 - protein, 41 aa, Mycobacterium
IDQAYQFIQYWVDYGVDLAQWGAGFVPVIGGLVSAQIGIVY

SEQ ID NO: 825457 - protein, 17 aa, Mycobacterium
IDQGLPQFVGFAVIRPA

SEQ ID NO: 825458 - protein, 20 aa, Mycobacterium
IDQLAGEGLLYECYCSRKDI

SEQ ID NO: 825459 - protein, 21 aa, Mycobacterium
IDQLLEAPTAWLFGPEAHGLS

SEQ ID NO: 825460 - protein, 19 aa, Mycobacterium
IDQLMLDRGFEGDIGLLHI

SEQ ID NO: 825461 - protein, 22 aa, Mycobacterium
IDQLPALPPLPADLRQRLDAAL

SEQ ID NO: 825462 - protein, 23 aa, Mycobacterium
IDQLPPLPPLPADLRTRLDAALA

SEQ ID NO: 825463 - protein, 23 aa, Mycobacterium
IDQLPPLPPLPTDLRARLDAALA

SEQ ID NO: 825464 - protein, 21 aa, Mycobacterium
IDQLPPLPPLSDELRQRLDSA

SEQ ID NO: 825465 - protein, 20 aa, Mycobacterium
IDQLPSLPPLPGDLRARLDA

SEQ ID NO: 825466 - protein, 19 aa, Mycobacterium
IDQPLVLQYKRHTLDAHDV

SEQ ID NO: 825467 - protein, 17 aa, Mycobacterium
IDQPVYRVAAKLRLMAD

SEQ ID NO: 825468 - protein, 34 aa, Mycobacterium
IDQRFAYVDGIQRIPRALARLEVPIIAAVNGAAV

SEQ ID NO: 825469 - protein, 24 aa, Mycobacterium
IDRAHDQFRWFAGGWAVNADLPTT

SEQ ID NO: 825470 - protein, 27 aa, Mycobacterium
IDRERVRHYPTIPLVNGYLAMPATFTP

SEQ ID NO: 825471 - protein, 24 aa, Mycobacterium
IDREYIPLLLEQGGFQPPQPVLPR

SEQ ID NO: 825472 - protein, 30 aa, Mycobacterium
IDRGQLLDTLAALLIGRKPRLPAKTVCAEC

SEQ ID NO: 825473 - protein, 30 aa, Mycobacterium
IDRGQLLDTLAALLVGRKPRLPAKTVCTEC

SEQ ID NO: 825474 - protein, 20 aa, Mycobacterium
IDRIGRRPGARWAADLLAAA

SEQ ID NO: 825475 - protein, 19 aa, Mycobacterium
IDRIGRRPGARWAADLLSA

SEQ ID NO: 825476 - protein, 17 aa, Mycobacterium
IDRIILEAFVAGIDSCQ

SEQ ID NO: 825477 - protein, 25 aa, Mycobacterium
IDRILGDPITLLGYAPETAIAEKGV

SEQ ID NO: 825478 - protein, 24 aa, Mycobacterium
IDRIPFPHKGTMVIVSPIFHSTGW

SEQ ID NO: 825479 - protein, 23 aa, Mycobacterium
IDRKTDWFTLRDAALHIRPYTWP

SEQ ID NO: 825480 - protein, 24 aa, Mycobacterium
IDRLKELGPLAPLHNPPAVLGIEV

SEQ ID NO: 825481 - protein, 19 aa, Mycobacterium
IDRLKVAIQLLFESSRPDP

SEQ ID NO: 825482 - protein, 19 aa, Mycobacterium
IDRLRWKPYLKAGSREDAL

SEQ ID NO: 825483 - protein, 17 aa, Mycobacterium
IDRLVEIFTAEAIWEMP

SEQ ID NO: 825484 - protein, 32 aa, Mycobacterium
IDRLVELFTAEAIWEMPPYAGWYRGAADIVTL

SEQ ID NO: 825485 - protein, 17 aa, Mycobacterium
IDRPLKLTSPEATGLLV

SEQ ID NO: 825486 - protein, 17 aa, Mycobacterium
IDRPRFMVFGEIALRAH

SEQ ID NO: 825487 - protein, 17 aa, Mycobacterium
IDRPRGMEYLLVRGRRG

SEQ ID NO: 825488 - protein, 23 aa, Mycobacterium
IDRPRRVRQPGEPLRIGIGGPVG

SEQ ID NO: 825489 - protein, 24 aa, Mycobacterium
IDRPTVVRVLGAIEIPVVAQALAR

SEQ ID NO: 825490 - protein, 21 aa, Mycobacterium
IDRSTAFLGPRVKPLIITNEP

SEQ ID NO: 825491 - protein, 28 aa, Mycobacterium
IDRTKGMLMLIYGIDEDAAFTMLKTLSQ

SEQ ID NO: 825492 - protein, 26 aa, Mycobacterium
IDRTKGMLMLVYGVDEMAAFNLLKSL

SEQ ID NO: 825493 - protein, 25 aa, Mycobacterium
IDRTRALEPLEVTSLWIAGETPETY

SEQ ID NO: 825494 - protein, 27 aa, Mycobacterium
IDRTSFVPGVLLAVRKIRENPGLTIGI

SEQ ID NO: 825495 - protein, 22 aa, Mycobacterium
IDRTWLRAKGWHVKKLDFMVGQ

SEQ ID NO: 825496 - protein, 23 aa, Mycobacterium
IDRVALWNLVATVDAFLSAGFSP

SEQ ID NO: 825497 - protein, 22 aa, Mycobacterium
IDRVAVITLNRPKALNALNSQV

SEQ ID NO: 825498 - protein, 20 aa, Mycobacterium
IDRVLPQYFAQCAIAASVRT

SEQ ID NO: 825499 - protein, 25 aa, Mycobacterium
IDRVPMVPIFINGVAGPFGPLNRIR

SEQ ID NO: 825500 - protein, 24 aa, Mycobacterium
IDRVQFGLRWNKFGILAVTATASG

SEQ ID NO: 825501 - protein, 19 aa, Mycobacterium
IDRVTLIDQHAHGCWLAPG

SEQ ID NO: 825502 - protein, 22 aa, Mycobacterium
IDRWLWAVRLTKTRPDAAAACR

SEQ ID NO: 825503 - protein, 20 aa, Mycobacterium
IDRWRQFAFGVLGFAEGKGP

SEQ ID NO: 825504 - protein, 24 aa, Mycobacterium
IDSDWPARVAAIEEGLRSGLEPAR

SEQ ID NO: 825505 - protein, 23 aa, Mycobacterium
IDSEEFYFVYRTRRFEPSRTGRT

SEQ ID NO: 825506 - protein, 25 aa, Mycobacterium
IDSGLTLSWLLRNLATRHPRSLKVC

SEQ ID NO: 825507 - protein, 17 aa, Mycobacterium
IDSLDILGPDDLNFLWL

SEQ ID NO: 825508 - protein, 25 aa, Mycobacterium
IDSNLYLRDLVLALQWVHDNIGAFG

SEQ ID NO: 825509 - protein, 27 aa, Mycobacterium
IDSNLYLRDLVLALQWVRENIAAFGGD

SEQ ID NO: 825510 - protein, 25 aa, Mycobacterium
IDSPFPWQYDGPRYAWLREVRDLVD

SEQ ID NO: 825511 - protein, 29 aa, Mycobacterium
IDSPHYTYKLKWLAALHNTAQGWLADDPS

SEQ ID NO: 825512 - protein, 24 aa, Mycobacterium
IDSSDEWIYSRTGIKTRRFAAPEE

SEQ ID NO: 825513 - protein, 25 aa, Mycobacterium
IDSSDEWIYSRTGIKTRRFAARDES

SEQ ID NO: 825514 - protein, 24 aa, Mycobacterium
IDSSDEWIYTRTGIKTRRFAAAEE

SEQ ID NO: 825515 - protein, 22 aa, Mycobacterium
IDSTLFHSMPVGLRAGYQRSIV

SEQ ID NO: 825516 - protein, 18 aa, Mycobacterium
IDSTWRWATTITNAWHRI

SEQ ID NO: 825517 - protein, 18 aa, Mycobacterium
IDSWRRVVVKATELGIPI

SEQ ID NO: 825518 - protein, 18 aa, Mycobacterium
IDSWRRVVVTATQLGIPV

SEQ ID NO: 825519 - protein, 25 aa, Mycobacterium
IDTANMFGFWDWVGGRYSVDSAIGL

SEQ ID NO: 825520 - protein, 17 aa, Mycobacterium
IDTARCPVYLFAGEYDY

SEQ ID NO: 825521 - protein, 22 aa, Mycobacterium
IDTARSFIFDTGLAPAAVGAAS

SEQ ID NO: 825522 - protein, 37 aa, Mycobacterium
IDTDAMTRSIRYPLRKVHLALVLWFPDDATDGNEFER

SEQ ID NO: 825523 - protein, 26 aa, Mycobacterium
IDTGAPGPHWFVIDPTGEKGYASNKE

SEQ ID NO: 825524 - protein, 31 aa, Mycobacterium
IDTLGPLLATLPVWLLDGAAAAMRRVWFGEL

SEQ ID NO: 825525 - protein, 17 aa, Mycobacterium
IDTPKLLMLSGIGPTAH

SEQ ID NO: 825526 - protein, 21 aa, Mycobacterium
IDTRRYSLEDAPQAWREQQSG

SEQ ID NO: 825527 - protein, 24 aa, Mycobacterium
IDTTPSMFTQLRAAGLLSTVPLAV

SEQ ID NO: 825528 - protein, 19 aa, Mycobacterium
IDTVLAWRERLGRLVFGAA

SEQ ID NO: 825529 - protein, 17 aa, Mycobacterium
IDTYVRPTLRGEKIGAL

SEQ ID NO: 825530 - protein, 24 aa, Mycobacterium
IDVAAVLYQSFRPAPAGADWPAEA

SEQ ID NO: 825531 - protein, 32 aa, Mycobacterium
IDVAEVYVPFSWFEPMWLENLGFAPEGEGWKL

SEQ ID NO: 825532 - protein, 31 aa, Mycobacterium; identical to SEQ ID NO: 678302

SEQ ID NO: 825533 - protein, 19 aa, Mycobacterium
IDVAQLRFLTPDVALIHAN

SEQ ID NO: 825534 - protein, 19 aa, Mycobacterium
IDVARDRLAARATVSFAVL

SEQ ID NO: 825535 - protein, 28 aa, Mycobacterium
IDVEAIRWTTWHAAWLIAEGRPAAREAA

SEQ ID NO: 825536 - protein, 32 aa, Mycobacterium
IDVGFVVVGPHPYFPRLRLELDKGLGWKAEVE

SEQ ID NO: 825537 - protein, 17 aa, Mycobacterium
IDVGSPFQHEKSAILYL

SEQ ID NO: 825538 - protein, 18 aa, Mycobacterium
IDVHALLFVERDSQKGIV

SEQ ID NO: 825539 - protein, 20 aa, Mycobacterium
IDVIRFWLGLGIDGFRLDAV

SEQ ID NO: 825540 - protein, 19 aa, Mycobacterium
IDVLRSRLGGVRKLQVSGP

SEQ ID NO: 825541 - protein, 28 aa, Mycobacterium
IDVPDVVNLVFFKLVRSKTKFWQMIGRG

SEQ ID NO: 825542 - protein, 30 aa, Mycobacterium
IDVPQQPDMIYQFLPIRWGTIGMAGVEFSE

SEQ ID NO: 825543 - protein, 24 aa, Mycobacterium
IDVRQLGTIDYRDAWRLQRELADT

SEQ ID NO: 825544 - protein, 25 aa, Mycobacterium
IDVTIVRPFNIFGIRQKTGRFGALI

SEQ ID NO: 825545 - protein, 26 aa, Mycobacterium
IDVTLRAARYLPWHPGRCAEVLVGES

SEQ ID NO: 825546 - protein, 24 aa, Mycobacterium
IDVTRCGGITDWLRAAAVAAANNV

SEQ ID NO: 825547 - protein, 19 aa, Mycobacterium
IDVTRCGGITDWVRAAAVA

SEQ ID NO: 825548 - protein, 25 aa, Mycobacterium
IDVVRFAGGWIFDRSMAGWDVTVLV

SEQ ID NO: 825549 - protein, 22 aa, Mycobacterium
IDVVYYLVHAIGQPGFRDADKS

SEQ ID NO: 825550 - protein, 18 aa, Mycobacterium
IDVVYYLVHGIGQPDFRE

SEQ ID NO: 825551 - protein, 25 aa, Mycobacterium
IDVWGVRTLGQLKKWLGGTGALHNR

SEQ ID NO: 825552 - protein, 17 aa, Mycobacterium
IDVYAGKFPVEGVIGAA

SEQ ID NO: 825553 - protein, 20 aa, Mycobacterium
IDVYRMLRVTNPSPYMYLLH

SEQ ID NO: 825554 - protein, 31 aa, Mycobacterium
IDWENQGLRLAKTLTPWPAAGGQRIAAASAF

SEQ ID NO: 825555 - protein, 19 aa, Mycobacterium
IDWIDYMDAPTGPRPFLRL

SEQ ID NO: 825556 - protein, 17 aa, Mycobacterium
IDWLEITGALASETANQ

SEQ ID NO: 825557 - protein, 18 aa, Mycobacterium
IDWPAVLADRLTTTSPDV

SEQ ID NO: 825558 - protein, 25 aa, Mycobacterium
IDWPQPAVLCTVRLARRVLSRDEAP

SEQ ID NO: 825559 - protein, 21 aa, Mycobacterium
IDWQAYFHLRNRLVVAALHWD

SEQ ID NO: 825560 - protein, 21 aa, Mycobacterium
IDWVIKRKLFQRYQDRYNMEL

SEQ ID NO: 825561 - protein, 22 aa, Mycobacterium
IDWVIKRKLFQRYQDRYNMELS

SEQ ID NO: 825562 - protein, 18 aa, Mycobacterium
IDWYARRDLPALISAPDR

SEQ ID NO: 825563 - protein, 19 aa, Mycobacterium
IDYAITIPDTAIPLNLDVP

SEQ ID NO: 825564 - protein, 24 aa, Mycobacterium
IDYATIDLALMLLGAVSVPLPTNA

SEQ ID NO: 825565 - protein, 26 aa, Mycobacterium
IDYEITLLTVRTAGIGGATRLYFCEP

SEQ ID NO: 825566 - protein, 22 aa, Mycobacterium
IDYFCCGPCWPTPTKPGRTASG

SEQ ID NO: 825567 - protein, 19 aa, Mycobacterium
IDYLDHCWGTEAFAPGGPT

SEQ ID NO: 825568 - protein, 18 aa, Mycobacterium
IDYLHFSVEWEHRFDHAD

SEQ ID NO: 825569 - protein, 28 aa, Mycobacterium
IDYRKFLDRSLIGRVPLIGGGLSLLVSD

SEQ ID NO: 825570 - protein, 18 aa, Mycobacterium
IDYRSSVRWRDAVRVTAE

SEQ ID NO: 825571 - protein, 26 aa, Mycobacterium
IDYTPDHLPILGPLIGDDGPIDGTVV

SEQ ID NO: 825572 - protein, 19 aa, Mycobacterium
IEAACPGRFLLGIGVGHRE

SEQ ID NO: 825573 - protein, 27 aa, Mycobacterium
IEAALPSRPVQVIGFTSVPGAGDNFLV

SEQ ID NO: 825574 - protein, 18 aa, Mycobacterium
IEAALRRSQRRPTGNWYV

SEQ ID NO: 825575 - protein, 26 aa, Mycobacterium
IEADYEQWVAVRPPPLFGTEPDARVL

SEQ ID NO: 825576 - protein, 19 aa, Mycobacterium
IEAEGLPYRSVLGLADLGL

SEQ ID NO: 825577 - protein, 17 aa, Mycobacterium
IEAFGFLDPPDARSIRD

SEQ ID NO: 825578 - protein, 17 aa, Mycobacterium
IEAFLGAMQAGLIAVPL

SEQ ID NO: 825579 - protein, 30 aa, Mycobacterium
IEAFQAFAPQIAAFALALPAGAAAGLVGLV

SEQ ID NO: 825580 - protein, 17 aa, Mycobacterium
IEAFRRRSQMDESVSFP

SEQ ID NO: 825581 - protein, 34 aa, Mycobacterium
IEAGGKDNWFWIKVPVGYLFTIANPRTDWCFNTE

SEQ ID NO: 825582 - protein, 18 aa, Mycobacterium
IEAGKLGLLGFSVPEHLG

SEQ ID NO: 825583 - protein, 21 aa, Mycobacterium
IEAGLTERLAVNRRLAPVRNT

SEQ ID NO: 825584 - protein, 24 aa, Mycobacterium
IEAGRALVLAFNKWDLVDEDRRYL

SEQ ID NO: 825585 - protein, 22 aa, Mycobacterium
IEAGRAWARFEDGRVIFKAEIG

SEQ ID NO: 825586 - protein, 29 aa, Mycobacterium
IEAGRVGFSHPLLPHIIYSQARPGERRRI

SEQ ID NO: 825587 - protein, 18 aa, Mycobacterium
IEAIKVLWTQEPAEYHGR

SEQ ID NO: 825588 - protein, 23 aa, Mycobacterium
IEAIVWGGVILPAGAPNVAREIA

SEQ ID NO: 825589 - protein, 33 aa, Mycobacterium
IEAKAYGIVFPDWKPVDFKVWPAENGFVQRYRW

SEQ ID NO: 825590 - protein, 18 aa, Mycobacterium
IEALKRWPQYVQASSDGR

SEQ ID NO: 825591 - protein, 18 aa, Mycobacterium
IEALLRRLRATLDDGSGV

SEQ ID NO: 825592 - protein, 17 aa, Mycobacterium
IEALNWHRFSVRGRPSK

SEQ ID NO: 825593 - protein, 24 aa, Mycobacterium
IEALSGITELPWTLSIFGDGPDRE

SEQ ID NO: 825594 - protein, 25 aa, Mycobacterium
IEALSGLAEMPWRLSIFGDGPDRER

SEQ ID NO: 825595 - protein, 40 aa, Mycobacterium
IEAMLHSDYPLQALLYTVVLHRFLRWRQPGYDPARHLGGV

SEQ ID NO: 825596 - protein, 21 aa, Mycobacterium
IEAMMTRLRQNIPAALSGFPI

SEQ ID NO: 825597 - protein, 20 aa, Mycobacterium
IEAPLNDAWMRDIGPTFVHA

SEQ ID NO: 825598 - protein, 24 aa, Mycobacterium
IEAPSVPARFRLLEQFMLAQARSS

SEQ ID NO: 825599 - protein, 20 aa, Mycobacterium
IEAPVRYSDRLYGATPGTMI

SEQ ID NO: 825600 - protein, 26 aa, Mycobacterium
IEAQIYALIVMIWTSAAANDAHTAVA

SEQ ID NO: 825601 - protein, 20 aa, Mycobacterium
IEAQLRFMADQDLDLIITSG

SEQ ID NO: 825602 - protein, 20 aa, Mycobacterium
IEAQYLATKLAKGFLRTVHI

SEQ ID NO: 825603 - protein, 24 aa, Mycobacterium
IEARWDDFVVPGLGIRCVDHRPWV

SEQ ID NO: 825604 - protein, 25 aa, Mycobacterium
IEARYLQRILTLGDDARLLLTLAAA

SEQ ID NO: 825605 - protein, 18 aa, Mycobacterium
IEAYLNFVADRLDLRRDI

SEQ ID NO: 825606 - protein, 24 aa, Mycobacterium
IEDAGQMRFVRLAAPNVGALLEAS

SEQ ID NO: 825607 - protein, 26 aa, Mycobacterium
IEDATRFYLEAYHDLGHGYQAHMHDP

SEQ ID NO: 825608 - protein, 17 aa, Mycobacterium
IEDDLPVIVVMPSPKNS

SEQ ID NO: 825609 - protein, 18 aa, Mycobacterium
IEDDPELLALFTAATDAS

SEQ ID NO: 825610 - protein, 22 aa, Mycobacterium
IEDFPYWEPCHNAILSNGILGF

SEQ ID NO: 825611 - protein, 27 aa, Mycobacterium
IEDHLRYSLGRPAALLEPKHYYRALAL

SEQ ID NO: 825612 - protein, 28 aa, Mycobacterium
IEDHVVQQIWMPYHWGYSGLVDGDVVND

SEQ ID NO: 825613 - protein, 26 aa, Mycobacterium
IEDIEQWYISRFLAMRSTAFADPESH

SEQ ID NO: 825614 - protein, 25 aa, Mycobacterium
IEDIEQWYISRFLAMRSTSFANPSS

SEQ ID NO: 825615 - protein, 25 aa, Mycobacterium
IEDIEQWYISRFLTMRSTAFADPAS

SEQ ID NO: 825616 - protein, 25 aa, Mycobacterium
IEDIEQWYVSRFLSLRGTAFADPES

SEQ ID NO: 825617 - protein, 17 aa, Mycobacterium
IEDILLQDALLDAVQDA

SEQ ID NO: 825618 - protein, 24 aa, Mycobacterium
IEDIPEVWRRLDTVGLTSIEACGD

SEQ ID NO: 825619 - protein, 17 aa, Mycobacterium
IEDLIRHEMAESAPLLQ

SEQ ID NO: 825620 - protein, 18 aa, Mycobacterium
IEDLLKTYPLRDLVTRGE

SEQ ID NO: 825621 - protein, 17 aa, Mycobacterium
IEDLLSAPAIKLLIRRA

SEQ ID NO: 825622 - protein, 17 aa, Mycobacterium
IEDLPRFPFTPADPLIV

SEQ ID NO: 825623 - protein, 17 aa, Mycobacterium
IEDLTFALDLGVDLVAL

SEQ ID NO: 825624 - protein, 18 aa, Mycobacterium
IEDLVGRTPVMLRRADGT

SEQ ID NO: 825625 - protein, 25 aa, Mycobacterium
IEDNYIKHFPYIPTTSRDLLQQYVD

SEQ ID NO: 825626 - protein, 21 aa, Mycobacterium
IEDSLAPRYVDLRPFAVNDGN

SEQ ID NO: 825627 - protein, 26 aa, Mycobacterium
IEDSLLRVEIYRAFRTELVPDDSDVV

SEQ ID NO: 825628 - protein, 18 aa, Mycobacterium
IEDTLAIYALLATHPISA

SEQ ID NO: 825629 - protein, 27 aa, Mycobacterium
IEDVRHILPFVLVNRLAQDRDAPFFEV

SEQ ID NO: 825630 - protein, 19 aa, Mycobacterium
IEEAVAVGDLVRLMEFRKG

SEQ ID NO: 825631 - protein, 19 aa, Mycobacterium
IEEIALGALPGLPKIAVHW

SEQ ID NO: 825632 - protein, 22 aa, Mycobacterium
IEEIRAVFETNYFGALRVAKAF

SEQ ID NO: 825633 - protein, 17 aa, Mycobacterium
IEEIVDTIWLPLLERRS

SEQ ID NO: 825634 - protein, 21 aa, Mycobacterium
IEELLRWLSIVSTALPRITTT

SEQ ID NO: 825635 - protein, 18 aa, Mycobacterium
IEEMLRWTAPVKNMCRML

SEQ ID NO: 825636 - protein, 20 aa, Mycobacterium
IEEPILAGLIDRIARDEARH

SEQ ID NO: 825637 - protein, 25 aa, Mycobacterium
IEEQSPIVGIWHSGGARLAEGVKAL

SEQ ID NO: 825638 - protein, 25 aa, Mycobacterium
IEEQSPIVGIWHSGGARLAEGVRAL

SEQ ID NO: 825639 - protein, 27 aa, Mycobacterium
IEERLGAKPLVIQLPIGAENDFIGIID

SEQ ID NO: 825640 - protein, 19 aa, Mycobacterium
IEETLRFEPPSPVQARYVA

SEQ ID NO: 825641 - protein, 24 aa, Mycobacterium
IEETLSALIFDNLFGRFPGLNVLV

SEQ ID NO: 825642 - protein, 17 aa, Mycobacterium
IEEVALMASLVRIADRA

SEQ ID NO: 825643 - protein, 22 aa, Mycobacterium
IEEWSILPDFASVNWHEPGSPE

SEQ ID NO: 825644 - protein, 25 aa, Mycobacterium
IEEYAPLMAYLVRSLQAGGELGKML

SEQ ID NO: 825645 - protein, 17 aa, Mycobacterium
IEFALGGATGQLRRIGR

SEQ ID NO: 825646 - protein, 18 aa, Mycobacterium
IEFCLLATQYDALAATIT

SEQ ID NO: 825647 - protein, 20 aa, Mycobacterium
IEFFAEHHVQLPLRTGDAVF

SEQ ID NO: 825648 - protein, 18 aa, Mycobacterium
IEFLFGLPSPEIDPLFAQ

SEQ ID NO: 825649 - protein, 19 aa, Mycobacterium
IEFLLSEDAGFITAAVYNV

SEQ ID NO: 825650 - protein, 17 aa, Mycobacterium
IEFLVHAWDYATAVGHD

SEQ ID NO: 825651 - protein, 18 aa, Mycobacterium
IEGDKVDFRFKIDDHLLP

SEQ ID NO: 825652 - protein, 24 aa, Mycobacterium
IEGDLLLVTVLKGAVMFVSDLARA

SEQ ID NO: 825653 - protein, 20 aa, Mycobacterium
IEGFLLNHPAVAQAAVIGIP

SEQ ID NO: 825654 - protein, 21 aa, Mycobacterium
IEGFLMHHPAVAQAAVIGVPD

SEQ ID NO: 825655 - protein, 21 aa, Mycobacterium
IEGIFYARYNDDFLIAHPDLA

SEQ ID NO: 825656 - protein, 26 aa, Mycobacterium
IEGISWLAGHLKGRWARNTGGLLLVT

SEQ ID NO: 825657 - protein, 19 aa, Mycobacterium
IEGLLTRREAFRRLALLGV

SEQ ID NO: 825658 - protein, 17 aa, Mycobacterium
IEGLRRTVALFGARLQP

SEQ ID NO: 825659 - protein, 28 aa, Mycobacterium
IEGQFTLPEPLPAKMLFISAGSGITPII

SEQ ID NO: 825660 - protein, 20 aa, Mycobacterium
IEGSLAPRYVDLRPFAVNDG

SEQ ID NO: 825661 - protein, 22 aa, Mycobacterium
IEGSLRRLGVDHVDLYYQHRVD

SEQ ID NO: 825662 - protein, 23 aa, Mycobacterium
IEGSPLFHVLSGNLGYQVEHHLF

SEQ ID NO: 825663 - protein, 18 aa, Mycobacterium
IEGTFAWNQSLFGYTFGD

SEQ ID NO: 825664 - protein, 31 aa, Mycobacterium
IEGVFTLPEPLPPKLLFISAGSGITPVISML

SEQ ID NO: 825665 - protein, 17 aa, Mycobacterium
IEGWVHRKRPGSAAAQA

SEQ ID NO: 825666 - protein, 24 aa, Mycobacterium
IEGYWAPGEQMIMGKWAQGRGYGL

SEQ ID NO: 825667 - protein, 26 aa, Mycobacterium
IEHAADLEKFQWFVRAHLENAGGKLT

SEQ ID NO: 825668 - protein, 28 aa, Mycobacterium
IEHELKVIAQLSFPGYFLVVHDITQFCR

SEQ ID NO: 825669 - protein, 31 aa, Mycobacterium
IEHELRIIEQLRFPGYFLVVHDITQFCRDNN

SEQ ID NO: 825670 - protein, 31 aa, Mycobacterium
IEHELRVIEQLNFPGYFLVVHDITRFCRENA

SEQ ID NO: 825671 - protein, 18 aa, Mycobacterium
IEHHLFPDLPSNRYAEIA

SEQ ID NO: 825672 - protein, 20 aa, Mycobacterium
IEHHLFPDLPSNRYYEISLR

SEQ ID NO: 825673 - protein, 26 aa, Mycobacterium
IEHVTFGVLPPLDWVDPVNGALNVPG

SEQ ID NO: 825674 - protein, 20 aa, Mycobacterium
IEIGYIPGKMPWLVGENLRK

SEQ ID NO: 825675 - protein, 18 aa, Mycobacterium
IEILPVTGLPEFRPGDDL

SEQ ID NO: 825676 - protein, 29 aa, Mycobacterium
IEILTAARALDLRAPLTPAPATAAVVKAL

SEQ ID NO: 825677 - protein, 20 aa, Mycobacterium
IEIMFGVWAAECVYVPINYK

SEQ ID NO: 825678 - protein, 20 aa, Mycobacterium
IEIMVVLAEAGRRLAPEPIL

SEQ ID NO: 825679 - protein, 22 aa, Mycobacterium
IEIPERWRVVFGAASRADCVEY

SEQ ID NO: 825680 - protein, 20 aa, Mycobacterium
IEIPGLPPITIPLLAPPPPP

SEQ ID NO: 825681 - protein, 18 aa, Mycobacterium
IEIRAMRQLSPAAPRTPV

SEQ ID NO: 825682 - protein, 19 aa, Mycobacterium
IEISSFVAVPLAGMTLAQL

SEQ ID NO: 825683 - protein, 24 aa, Mycobacterium
IEITAPGVAVARIIPGPNAAQLRD

SEQ ID NO: 825684 - protein, 25 aa, Mycobacterium
IEIVRYYADLLKTYPLTEDLGNIES

SEQ ID NO: 825685 - protein, 19 aa, Mycobacterium
IEKAFFEELAAVGYGRLSV

SEQ ID NO: 825686 - protein, 36 aa, Mycobacterium
IEKDAMMEIFSKYPTFLHSFAPMPFKPVARDGKPGL

SEQ ID NO: 825687 - protein, 17 aa, Mycobacterium
IEKLGYGTVWVGASPAA

SEQ ID NO: 825688 - protein, 28 aa, Mycobacterium
IEKLQRLRLPWWHVWRAADAVGAATPKH

SEQ ID NO: 825689 - protein, 30 aa, Mycobacterium
IEKLRGTLPELPWLRLGRIQQEWGVSDEVM

SEQ ID NO: 825690 - protein, 29 aa, Mycobacterium
IEKTDLRLRFKWMGLYTQREQGYDGSWTG

SEQ ID NO: 825691 - protein, 17 aa, Mycobacterium
IELAIKSAKARLEKLVA

SEQ ID NO: 825692 - protein, 19 aa, Mycobacterium
IELALEALYLAKRIDKVSG

SEQ ID NO: 825693 - protein, 18 aa, Mycobacterium
IELALRLRGAPRAGRRAA

SEQ ID NO: 825694 - protein, 32 aa, Mycobacterium
IELCRELLSLMPDLRCLMLTSFTSDEAMLDAI

SEQ ID NO: 825695 - protein, 18 aa, Mycobacterium
IELDGLRLVTLRGASRAE

SEQ ID NO: 825696 - protein, 25 aa, Mycobacterium
IELEVAWPRLFERIPDLRLATSVDE

SEQ ID NO: 825697 - protein, 21 aa, Mycobacterium
IELGTAVIPLGLENPLRLAED

SEQ ID NO: 825698 - protein, 26 aa, Mycobacterium
IELHGLGHPLLPPWTVTESGPNGVAM

SEQ ID NO: 825699 - protein, 19 aa, Mycobacterium
IELIGGATMLRMLLRPEEE

SEQ ID NO: 825700 - protein, 17 aa, Mycobacterium
IELLEALLACRAAVVLS

SEQ ID NO: 825701 - protein, 17 aa, Mycobacterium
IELLPPTGRPHILLDTN

SEQ ID NO: 825702 - protein, 19 aa, Mycobacterium
IELLTRRIEGAGGSYQSVL

SEQ ID NO: 825703 - protein, 22 aa, Mycobacterium
IELMLQLLLDGHDTLRSILTET

SEQ ID NO: 825704 - protein, 17 aa, Mycobacterium
IELPAELFDAPANIALL

SEQ ID NO: 825705 - protein, 18 aa, Mycobacterium
IELPIFEDTALFARGVGE

SEQ ID NO: 825706 - protein, 27 aa, Mycobacterium
IELQALLDEWIIAVWQNRPHDGLRDPV

SEQ ID NO: 825707 - protein, 17 aa, Mycobacterium
IELQRRAAALAAGFDHV

SEQ ID NO: 825708 - protein, 18 aa, Mycobacterium
IELQWPVQVAGGTPIPIY

SEQ ID NO: 825709 - protein, 26 aa, Mycobacterium
IELRDMPPGHRLIAGALATEGKLNDR

SEQ ID NO: 825710 - protein, 27 aa, Mycobacterium
IELTDNILWLLKQAFYFSLTSVNEAVS

SEQ ID NO: 825711 - protein, 21 aa, Mycobacterium
IEMGIPWLTTYAFSTENWRRP

SEQ ID NO: 825712 - protein, 19 aa, Mycobacterium
IEMGKLLETINVDAAWKSP

SEQ ID NO: 825713 - protein, 17 aa, Mycobacterium
IEMLEQMGWIVVRVVAE

SEQ ID NO: 825714 - protein, 17 aa, Mycobacterium
IEMTISPLTPMAPTVEE

SEQ ID NO: 825715 - protein, 19 aa, Mycobacterium
IEMWLRADRPQRVRVDALD

SEQ ID NO: 825716 - protein, 19 aa, Mycobacterium
IENELRDWLSADVAILGEP

SEQ ID NO: 825717 - protein, 27 aa, Mycobacterium
IENENKRFFTMLGTLIRGRVSVAATSG

SEQ ID NO: 825718 - protein, 25 aa, Mycobacterium
IENGEWLVLATFEPGATVPLHYHTG

SEQ ID NO: 825719 - protein, 23 aa, Mycobacterium
IENGSYFVHRLIKRLKKAANTQP

SEQ ID NO: 825720 - protein, 18 aa, Mycobacterium
IENLGSSGFLNDGALQSG

SEQ ID NO: 825721 - protein, 23 aa, Mycobacterium
IENLVFMGFAQAVPTLFPFVESQ

SEQ ID NO: 825722 - protein, 27 aa, Mycobacterium
IENPNRRFFTMLGTLVRGRITVGGSAG

SEQ ID NO: 825723 - protein, 19 aa, Mycobacterium
IENTDLPAWQRVQDINLKS

SEQ ID NO: 825724 - protein, 27 aa, Mycobacterium
IENTNRRFFTMLGTLVRGRITVGGSAG

SEQ ID NO: 825725 - protein, 24 aa, Mycobacterium
IENVLAAWPVRPDARILLCSSVSG

SEQ ID NO: 825726 - protein, 25 aa, Mycobacterium
IEPGAFRTDFLSPRSVRFAATEIDA

SEQ ID NO: 825727 - protein, 25 aa, Mycobacterium
IEPGPYLHSALPIAGFAVLEADDLD

SEQ ID NO: 825728 - protein, 25 aa, Mycobacterium
IEPHQTRLLLRKSLKLLRDKQKHDR

SEQ ID NO: 825729 - protein, 26 aa, Mycobacterium
IEPIDISYPYLWRNLTEVVGTVLEAL

SEQ ID NO: 825730 - protein, 18 aa, Mycobacterium
IEPLLRRSEFLRETVTEL

SEQ ID NO: 825731 - protein, 30 aa, Mycobacterium
IEPLPPQRAGLLVRAMYRVAKRRFGEVPEP

SEQ ID NO: 825732 - protein, 19 aa, Mycobacterium
IEPLVLMVAPLAPHLAEEL

SEQ ID NO: 825733 - protein, 25 aa, Mycobacterium
IEPPQFMPDQYGGTWRYIGKDATVS

SEQ ID NO: 825734 - protein, 18 aa, Mycobacterium
IEPQFYAAMLAGLGLDAA

SEQ ID NO: 825735 - protein, 18 aa, Mycobacterium
IEPQFYAAMLAGLGLDGA

SEQ ID NO: 825736 - protein, 25 aa, Mycobacterium
IEPQSYVLPEEPLLVAPSVAELQAA

SEQ ID NO: 825737 - protein, 29 aa, Mycobacterium
IEPSLTRISALLDLLGSPQLSYPSIHIAG

SEQ ID NO: 825738 - protein, 17 aa, Mycobacterium
IEPVDDGPRRAHRGQID

SEQ ID NO: 825739 - protein, 18 aa, Mycobacterium
IEPVPRSFPRYGATVNSV

SEQ ID NO: 825740 - protein, 29 aa, Mycobacterium
IEQAFPALRPLRFLQQSALLESLFTTMLV

SEQ ID NO: 825741 - protein, 17 aa, Mycobacterium
IEQCGVTLHVPVHNVPI

SEQ ID NO: 825742 - protein, 17 aa, Mycobacterium
IEQFGRLDIVVANAGVL

SEQ ID NO: 825743 - protein, 24 aa, Mycobacterium
IEQHGVTVLHFMPGWLEMLTEVGG

SEQ ID NO: 825744 - protein, 36 aa, Mycobacterium
IEQIQLGLIGMQLALTALWRHYGVTPDLVIGHSMGE

SEQ ID NO: 825745 - protein, 35 aa, Mycobacterium
IEQIQLGLIGMQLALTALWRSYGVQPDLVIGHSMG

SEQ ID NO: 825746 - protein, 18 aa, Mycobacterium
IEQLDLAPVRIVAVSMGS

SEQ ID NO: 825747 - protein, 24 aa, Mycobacterium
IEQLKRIAEAFRRNSQAFVDLEHH

SEQ ID NO: 825748 - protein, 17 aa, Mycobacterium
IEQRRFAAAYGYRGRIV

SEQ ID NO: 825749 - protein, 20 aa, Mycobacterium
IEQSAPFPPPPPGYDCPVSC

SEQ ID NO: 825750 - protein, 27 aa, Mycobacterium
IEQVKGMLMLIYGIDENAAFDLLKWLS

SEQ ID NO: 825751 - protein, 24 aa, Mycobacterium
IEQYDITGYWRLDSEAWDARFAEV

SEQ ID NO: 825752 - protein, 23 aa, Mycobacterium
IERAKLFLHRSGGPRLTDEEALA

SEQ ID NO: 825753 - protein, 17 aa, Mycobacterium
IERALGRYLVGRAADDG

SEQ ID NO: 825754 - protein, 19 aa, Mycobacterium
IERAPFYLFNVSIKTNMLN

SEQ ID NO: 825755 - protein, 26 aa, Mycobacterium
IERARRETTLLRRLAAFITVAMEADE

SEQ ID NO: 825756 - protein, 25 aa, Mycobacterium
IERATKIMGLLTLTTKSYAATIRFG

SEQ ID NO: 825757 - protein, 27 aa, Mycobacterium
IERDAAMGPGLRRLLRLSVPSPVKAIE

SEQ ID NO: 825758 - protein, 25 aa, Mycobacterium
IERDNTLFTNWPRPVLATVAGDELQ

SEQ ID NO: 825759 - protein, 23 aa, Mycobacterium
IERDPALWRRLDELGLVRLTGAE

SEQ ID NO: 825760 - protein, 22 aa, Mycobacterium
IERHYRDCRILGIGGGTNEIMN

SEQ ID NO: 825761 - protein, 17 aa, Mycobacterium
IERKPPWIKTRAKMGPE

SEQ ID NO: 825762 - protein, 18 aa, Mycobacterium
IERKPPWIRTRARMGPEY

SEQ ID NO: 825763 - protein, 18 aa, Mycobacterium
IERLAYFAEAATAQLDCA

SEQ ID NO: 825764 - protein, 26 aa, Mycobacterium
IERLCGSQLFFEAWASLGSSPRNRFK

SEQ ID NO: 825765 - protein, 25 aa, Mycobacterium
IERLEELVPIYSELLSLLADNGAQW

SEQ ID NO: 825766 - protein, 17 aa, Mycobacterium
IERMRTLMESTLARHTG

SEQ ID NO: 825767 - protein, 20 aa, Mycobacterium
IERPFIVVGMPRSGTTHLVN

SEQ ID NO: 825768 - protein, 22 aa, Mycobacterium
IERPHMYRLMFGSTSAHGINAP

SEQ ID NO: 825769 - protein, 23 aa, Mycobacterium
IERPHMYRLMFGSTSAHGINAPT

SEQ ID NO: 825770 - protein, 17 aa, Mycobacterium
IERPVGRDVILDAVLDG

SEQ ID NO: 825771 - protein, 23 aa, Mycobacterium
IERQLVHRFIGPAFGHESGLDAN

SEQ ID NO: 825772 - protein, 18 aa, Mycobacterium
IERRPVPPGVLIVADGAN

SEQ ID NO: 825773 - protein, 23 aa, Mycobacterium
IERRQILELYGARIIFSPAEGGS

SEQ ID NO: 825774 - protein, 23 aa, Mycobacterium
IERRQLLELYGAQIIFSPAEGGS

SEQ ID NO: 825775 - protein, 33 aa, Mycobacterium
IERRRQITGGKRSFILVPGIDVPFHSSVLRVGV

SEQ ID NO: 825776 - protein, 18 aa, Mycobacterium
IERRWQQTWADRGTFHVP

SEQ ID NO: 825777 - protein, 18 aa, Mycobacterium
IERRYVDAPPRLALDQPE

SEQ ID NO: 825778 - protein, 28 aa, Mycobacterium
IERTYLQEWHYFFNNTSRWRDLRKITIA

SEQ ID NO: 825779 - protein, 21 aa, Mycobacterium
IERVKYRYLRALDTKNWDEFA

SEQ ID NO: 825780 - protein, 25 aa, Mycobacterium
IESESIVLPSLYYAHQRNVVERDGM

SEQ ID NO: 825781 - protein, 18 aa, Mycobacterium
IESGLFATALPFVNLIDY

SEQ ID NO: 825782 - protein, 18 aa, Mycobacterium
IESGLFAVALPFVDLIDY

SEQ ID NO: 825783 - protein, 25 aa, Mycobacterium
IESGLHTRPLTWISGPSATSDIELD

SEQ ID NO: 825784 - protein, 24 aa, Mycobacterium
IESGRALVLAFNKWDLVDEDRRDL

SEQ ID NO: 825785 - protein, 17 aa, Mycobacterium
IESIAQAGLTVNFPYLL

SEQ ID NO: 825786 - protein, 18 aa, Mycobacterium
IESIAQAGLTVNFPYLLD

SEQ ID NO: 825787 - protein, 24 aa, Mycobacterium
IESIWKPYIRTLTASPQTLLHGDP

SEQ ID NO: 825788 - protein, 20 aa, Mycobacterium
IESLTQLIAVDNVWVPPAGG

SEQ ID NO: 825789 - protein, 27 aa, Mycobacterium
IESNLYLRDLVLALQWVRENIAAFGGD

SEQ ID NO: 825790 - protein, 25 aa, Mycobacterium
IESSDEWIFSRTGIKTRRFAARDES

SEQ ID NO: 825791 - protein, 25 aa, Mycobacterium
IESSDEWIYTRTGIKTRRFAADEET

SEQ ID NO: 825792 - protein, 18 aa, Mycobacterium
IESTWKGLLAGESGIRIL

SEQ ID NO: 825793 - protein, 18 aa, Mycobacterium
IESTWKGLLAGESGIRVL

SEQ ID NO: 825794 - protein, 29 aa, Mycobacterium
IESVAYTRPELLGLYPLSLSTRTQVLKGR

SEQ ID NO: 825795 - protein, 25 aa, Mycobacterium
IETEVQMQLLRDIGIRYGQGYFLGR

SEQ ID NO: 825796 - protein, 24 aa, Mycobacterium
IETGIQGFLAFNPGLYAQQFVAGT

SEQ ID NO: 825797 - protein, 23 aa, Mycobacterium
IETIFMFPTFGCGVEEALKADIE

SEQ ID NO: 825798 - protein, 18 aa, Mycobacterium
IETKGYVAALAAADAMVK

SEQ ID NO: 825799 - protein, 28 aa, Mycobacterium
IETLFEERGRRWPVIISGTITDASGRTL

SEQ ID NO: 825800 - protein, 32 aa, Mycobacterium
IETRRAFENLPRLLFAAMRRPRVGVMIARGDL

SEQ ID NO: 825801 - protein, 26 aa, Mycobacterium
IETTETMLPFCWRGVSLHAGGAGRVR

SEQ ID NO: 825802 - protein, 18 aa, Mycobacterium
IEVALTDAGASLADVIRT

SEQ ID NO: 825803 - protein, 18 aa, Mycobacterium
IEVDGWRVGMGICRDTGI

SEQ ID NO: 825804 - protein, 19 aa, Mycobacterium
IEVDPQVLIRAGESMLSLG

SEQ ID NO: 825805 - protein, 25 aa, Mycobacterium
IEVFHTGWLFDHFYPIASPSQRDHN

SEQ ID NO: 825806 - protein, 32 aa, Mycobacterium
IEVHSAWGSSPWFFEDALARGLRLGASAASDE

SEQ ID NO: 825807 - protein, 19 aa, Mycobacterium
IEVIEFAVGIPHLLKGEFT

SEQ ID NO: 825808 - protein, 24 aa, Mycobacterium
IEVIPDVLRHRLVLTYDALADEIT

SEQ ID NO: 825809 - protein, 23 aa, Mycobacterium
IEVIPDVLRHRLVMSYDALADEV

SEQ ID NO: 825810 - protein, 20 aa, Mycobacterium
IEVITDMWGRPRVRLSGAVA

SEQ ID NO: 825811 - protein, 21 aa, Mycobacterium
IEVLAGLRGWFSAPVIVLSAR

SEQ ID NO: 825812 - protein, 18 aa, Mycobacterium
IEVLGYEAAVALLQAGVI

SEQ ID NO: 825813 - protein, 18 aa, Mycobacterium
IEVRDWVHKFAADVIRPA

SEQ ID NO: 825814 - protein, 18 aa, Mycobacterium
IEVRRVLGLLGARDQEAL

SEQ ID NO: 825815 - protein, 22 aa, Mycobacterium
IEVSMRLTRRFALSSRTDSATE

SEQ ID NO: 825816 - protein, 26 aa, Mycobacterium
IEVVGRFLALLELYRSRAVAFDQSEP

SEQ ID NO: 825817 - protein, 18 aa, Mycobacterium
IEVVKPATFLFAAGQETV

SEQ ID NO: 825818 - protein, 24 aa, Mycobacterium
IEVVPDVLRHRLVLTYDALADEIS

SEQ ID NO: 825819 - protein, 23 aa, Mycobacterium
IEVWAHQIADLAGDYRVIAYDHR

SEQ ID NO: 825820 - protein, 23 aa, Mycobacterium
IEWQRDFFDFGHVAKMFATLIES

SEQ ID NO: 825821 - protein, 17 aa, Mycobacterium
IEWSVSYSQKPFPDPCE

SEQ ID NO: 825822 - protein, 31 aa, Mycobacterium
IEYLADLGITCLWLMPFYPTARKDDGYDITD

SEQ ID NO: 825823 - protein, 27 aa, Mycobacterium
IEYLVANPVPVVSFTFGVPTAPDAHRL

SEQ ID NO: 825824 - protein, 26 aa, Mycobacterium
IEYTEQLTYLLFLKMAHERATRKLNP

SEQ ID NO: 825825 - protein, 27 aa, Mycobacterium
IEYTEQLTYLLFLKMAHERATRKLNPQ

SEQ ID NO: 825826 - protein, 17 aa, Mycobacterium
IEYWAGHQWEPHKTPKT

SEQ ID NO: 825827 - protein, 25 aa, Mycobacterium
IEYYKSSVLPQLEGLDGFCSASLLI

SEQ ID NO: 825828 - protein, 18 aa, Mycobacterium
IFAAILRSDPELLLTYIV

SEQ ID NO: 825829 - protein, 17 aa, Mycobacterium
IFADALRELSAKYPDRL

SEQ ID NO: 825830 - protein, 31 aa, Mycobacterium
IFANHAGYVHSFPPMPLQPKGFMTPDEVSDV

SEQ ID NO: 825831 - protein, 26 aa, Mycobacterium
IFAPDPRQYLQPQPPPPAPQQPIDVR

SEQ ID NO: 825832 - protein, 20 aa, Mycobacterium
IFATGYNITFPFFDPEFLSA

SEQ ID NO: 825833 - protein, 18 aa, Mycobacterium
IFATVLSLEICPERPEVS

SEQ ID NO: 825834 - protein, 19 aa, Mycobacterium
IFATVLSLRIPPTGSTVTA

SEQ ID NO: 825835 - protein, 40 aa, Mycobacterium
IFAYPGVHAIWLHRINHWLWLRGARLIARITAEITRILTG

SEQ ID NO: 825836 - protein, 17 aa, Mycobacterium
IFCLPNGPVLLDCLEFD

SEQ ID NO: 825837 - protein, 19 aa, Mycobacterium
IFDLQLHQRGMLRPLRSAE

SEQ ID NO: 825838 - protein, 18 aa, Mycobacterium
IFDQGLGDMFVVRTAGHV

SEQ ID NO: 825839 - protein, 19 aa, Mycobacterium
IFDQGLGDMFVVRTAGHVI

SEQ ID NO: 825840 - protein, 17 aa, Mycobacterium
IFDRKGFIGTSAQTLLV

SEQ ID NO: 825841 - protein, 17 aa, Mycobacterium
IFDVLDLKPTFISDETQ

SEQ ID NO: 825842 - protein, 24 aa, Mycobacterium
IFEDRARITPLWVKGHRGEPLNEG

SEQ ID NO: 825843 - protein, 25 aa, Mycobacterium
IFEIADLGIVGDLFKVTPQLTEAVK

SEQ ID NO: 825844 - protein, 18 aa, Mycobacterium
IFEPAALQDLEGLFARLA

SEQ ID NO: 825845 - protein, 26 aa, Mycobacterium
IFEQSARGAFYLLTQPEYVGSAMAER

SEQ ID NO: 825846 - protein, 29 aa, Mycobacterium
IFEVRAMDRLGLLALLTSALERADADIAW

SEQ ID NO: 825847 - protein, 18 aa, Mycobacterium
IFFPKGSRILFSTPTRAL

SEQ ID NO: 825848 - protein, 17 aa, Mycobacterium
IFGDALRELTAKYPDRL

SEQ ID NO: 825849 - protein, 29 aa, Mycobacterium
IFGGMKLDFLITVDWDYYKKFMSVNLDGA

SEQ ID NO: 825850 - protein, 26 aa, Mycobacterium
IFGKDAMLKVFRRVTPGINPDIELNR

SEQ ID NO: 825851 - protein, 33 aa, Mycobacterium
IFGMRELGGLYDWLARRYVADSGVPMLLVDYRT

SEQ ID NO: 825852 - protein, 20 aa, Mycobacterium
IFGSIAQLVKVRPGYQGAIA

SEQ ID NO: 825853 - protein, 19 aa, Mycobacterium
IFGSLGKAAMLGPLAVPAS

SEQ ID NO: 825854 - protein, 24 aa, Mycobacterium
IFGSMTGMRYGFAEDFRIIDRISG

SEQ ID NO: 825855 - protein, 25 aa, Mycobacterium
IFHGVQLWVNLPKKDKFAQPRYQAI

SEQ ID NO: 825856 - protein, 17 aa, Mycobacterium
IFHWTNVILGFGDPDLT

SEQ ID NO: 825857 - protein, 21 aa, Mycobacterium
IFIRRNIGANPLYKYVLREYV

SEQ ID NO: 825858 - protein, 18 aa, Mycobacterium
IFKLHPWEWVLDDEFGQH

SEQ ID NO: 825859 - protein, 17 aa, Mycobacterium
IFKRSMQWPYAPSVPNA

SEQ ID NO: 825860 - protein, 18 aa, Mycobacterium
IFLAIAQTGSLGAAAREL

SEQ ID NO: 825861 - protein, 19 aa, Mycobacterium
IFLVNTPQCLMAEGLADLA

SEQ ID NO: 825862 - protein, 17 aa, Mycobacterium
IFLVPAQWQAVCAEQQA

SEQ ID NO: 825863 - protein, 18 aa, Mycobacterium
IFMGPILQLMGRPKVEGL

SEQ ID NO: 825864 - protein, 26 aa, Mycobacterium
IFNEPFKSFWLTPKQHMEALAERDWK

SEQ ID NO: 825865 - protein, 18 aa, Mycobacterium
IFQNFELEFSDRLNILVG

SEQ ID NO: 825866 - protein, 17 aa, Mycobacterium
IFRALQDAGFDDWTLAQ

SEQ ID NO: 825867 - protein, 22 aa, Mycobacterium
IFRELGNPYLPVRWSTDNPDSI

SEQ ID NO: 825868 - protein, 19 aa, Mycobacterium
IFRSLQQLAALPGDPTVFP

SEQ ID NO: 825869 - protein, 17 aa, Mycobacterium
IFSFPYDVDAVTKIAAL

SEQ ID NO: 825870 - protein, 17 aa, Mycobacterium
IFSKYLTEALPLHAEDL

SEQ ID NO: 825871 - protein, 28 aa, Mycobacterium
IFSPDHYNGFFYRAMPPFCIGMYASAVG

SEQ ID NO: 825872 - protein, 18 aa, Mycobacterium
IFSWRYRDPGVLLGERLG

SEQ ID NO: 825873 - protein, 38 aa, Mycobacterium
IFTDGELYRQELRRVFAPSWLFLAHADQFHRPGDFFTT

SEQ ID NO: 825874 - protein, 24 aa, Mycobacterium
IFTSNFGYRWGVLHAGIDLANSIG

SEQ ID NO: 825875 - protein, 19 aa, Mycobacterium
IFTTPIITLPIVDKAIEEL

SEQ ID NO: 825876 - protein, 18 aa, Mycobacterium
IFVEFSRWRGLSADGRCK

SEQ ID NO: 825877 - protein, 18 aa, Mycobacterium
IFVLGAPSAKPLEEEFGI

SEQ ID NO: 825878 - protein, 17 aa, Mycobacterium
IFVLPTFVRGGTNVMLP

SEQ ID NO: 825879 - protein, 18 aa, Mycobacterium
IFVPSVPNLLQLASELEA

SEQ ID NO: 825880 - protein, 19 aa, Mycobacterium
IFYERFPDDLKDYAPRIWY

SEQ ID NO: 825881 - protein, 18 aa, Mycobacterium
IFYQRFPEDLKDKAPRIW

SEQ ID NO: 825882 - protein, 23 aa, Mycobacterium
IGAALRPWRLARVVPATALTLAQ

SEQ ID NO: 825883 - protein, 21 aa, Mycobacterium
IGAALVAEALRRGARRVYVGT

SEQ ID NO: 825884 - protein, 19 aa, Mycobacterium
IGAAYYLRTMQPAKTFAIV

SEQ ID NO: 825885 - protein, 18 aa, Mycobacterium
IGADFYFSVRTMEERLGA

SEQ ID NO: 825886 - protein, 18 aa, Mycobacterium
IGADIARAFAAAGARLVL

SEQ ID NO: 825887 - protein, 25 aa, Mycobacterium
IGAEMIAERWGFDRTALDEFSLASH

SEQ ID NO: 825888 - protein, 25 aa, Mycobacterium
IGAEVPLLGQVPLDPALVSAGDAGV

SEQ ID NO: 825889 - protein, 21 aa, Mycobacterium
IGAFLGSRRDTPVWVNALENE

SEQ ID NO: 825890 - protein, 17 aa, Mycobacterium
IGAFPMAQRRRLFDELQ

SEQ ID NO: 825891 - protein, 19 aa, Mycobacterium
IGAGFIGLEVAAAARKRGK

SEQ ID NO: 825892 - protein, 20 aa, Mycobacterium
IGAGLALGLVLDKCGKRVEV

SEQ ID NO: 825893 - protein, 24 aa, Mycobacterium
IGAGPIGLFAIQWAKLHGADQVVA

SEQ ID NO: 825894 - protein, 17 aa, Mycobacterium
IGAGYARRYAQDGYDLI

SEQ ID NO: 825895 - protein, 19 aa, Mycobacterium
IGAHLGTAFHTCRAAAAVM

SEQ ID NO: 825896 - protein, 24 aa, Mycobacterium
IGAHTLLLNTSFAGPALADVVSRE

SEQ ID NO: 825897 - protein, 22 aa, Mycobacterium
IGAIAAWRELGLSVPDDVGIAG

SEQ ID NO: 825898 - protein, 17 aa, Mycobacterium
IGAIPTAVPASPFVTDE

SEQ ID NO: 825899 - protein, 31 aa, Mycobacterium
IGAISYARKRGLPVLGLCLGLQCIVIEAARS

SEQ ID NO: 825900 - protein, 20 aa, Mycobacterium
IGAIVFRDPVLLNSFHSISA

SEQ ID NO: 825901 - protein, 19 aa, Mycobacterium
IGAKSWPVVLATRLGISVK

SEQ ID NO: 825902 - protein, 18 aa, Mycobacterium
IGALLADGRIDWRTAQLT

SEQ ID NO: 825903 - protein, 17 aa, Mycobacterium
IGALLASGLPPGEAAAA

SEQ ID NO: 825904 - protein, 17 aa, Mycobacterium
IGALLMDQKIIAGVGNV

SEQ ID NO: 825905 - protein, 17 aa, Mycobacterium
IGALLMDQTVMAGVGNV

SEQ ID NO: 825906 - protein, 18 aa, Mycobacterium
IGALLRAKFAHPLRFDVP

SEQ ID NO: 825907 - protein, 19 aa, Mycobacterium
IGALTVPLSTFAPGAELAR

SEQ ID NO: 825908 - protein, 24 aa, Mycobacterium
IGAMLDYFCYVWLVEGGERGRSAV

SEQ ID NO: 825909 - protein, 17 aa, Mycobacterium
IGAPIRLVTACALPGSH

SEQ ID NO: 825910 - protein, 23 aa, Mycobacterium
IGAPSFAEALRWGAEVYHSLKSV

SEQ ID NO: 825911 - protein, 26 aa, Mycobacterium
IGAQEILLPALLPRGPYETTNRWTEY

SEQ ID NO: 825912 - protein, 20 aa, Mycobacterium
IGAQILVDLGIRSMRLLTNN

SEQ ID NO: 825913 - protein, 27 aa, Mycobacterium
IGARADLLAAVRLPSGYFGGVGTDVVA

SEQ ID NO: 825914 - protein, 23 aa, Mycobacterium
IGARLHWPGLGDVPATALVLDTL

SEQ ID NO: 825915 - protein, 23 aa, Mycobacterium
IGARTLWFQLDLVDLDAANKATE

SEQ ID NO: 825916 - protein, 25 aa, Mycobacterium
IGASLLQDWTQFAAPAVFGIAMRLY

SEQ ID NO: 825917 - protein, 30 aa, Mycobacterium
IGASQYKDVILGLLFLKYLSDADTEQRIAI

SEQ ID NO: 825918 - protein, 21 aa, Mycobacterium
IGATGYRRGLDALVGHLGVLT

SEQ ID NO: 825919 - protein, 25 aa, Mycobacterium
IGATILGFADLVFMADTARLKCPFT

SEQ ID NO: 825920 - protein, 24 aa, Mycobacterium
IGATLLQDWSQFAAPAVFGAAMRV

SEQ ID NO: 825921 - protein, 24 aa, Mycobacterium
IGATLLQDWSQFAAPAVFGVAMRV

SEQ ID NO: 825922 - protein, 38 aa, Mycobacterium
IGATVGPALLLPLRAPDAVPGVLIVLRSVGAQPFRSDE

SEQ ID NO: 825923 - protein, 20 aa, Mycobacterium
IGAVCELAPINKLINGNPVL

SEQ ID NO: 825924 - protein, 17 aa, Mycobacterium
IGAVLSMHFAQQAAKHF

SEQ ID NO: 825925 - protein, 18 aa, Mycobacterium
IGCALVGAQLPWSRLATD

SEQ ID NO: 825926 - protein, 18 aa, Mycobacterium
IGCFRAGGGLPYSEFPRF

SEQ ID NO: 825927 - protein, 19 aa, Mycobacterium
IGCGAAAINPYLAFESIED

SEQ ID NO: 825928 - protein, 24 aa, Mycobacterium
IGCPLINIHHSFLPAFTGAAPYKR

SEQ ID NO: 825929 - protein, 25 aa, Mycobacterium
IGCSSRFPYYLETYGFHSIHGRAPT

SEQ ID NO: 825930 - protein, 26 aa, Mycobacterium
IGCSSRFPYYLETYGFHSIHGRAPTI

SEQ ID NO: 825931 - protein, 25 aa, Mycobacterium
IGCVFQDFRLLQQKTVFENVAFALE

SEQ ID NO: 825932 - protein, 26 aa, Mycobacterium
IGCVFQDFRLLQQKTVFENVAFALEV

SEQ ID NO: 825933 - protein, 26 aa, Mycobacterium
IGDALGLLRLPMAMPMLRLGGAVARA

SEQ ID NO: 825934 - protein, 21 aa, Mycobacterium
IGDAVMFVCPEPLPMLDVVVK

SEQ ID NO: 825935 - protein, 29 aa, Mycobacterium
IGDCMSHWTLLRLVGLATAADLLLTGRTV

SEQ ID NO: 825936 - protein, 22 aa, Mycobacterium
IGDELAVARALYDLANQLFAAT

SEQ ID NO: 825937 - protein, 17 aa, Mycobacterium
IGDFAVGDPFRPLNQIL

SEQ ID NO: 825938 - protein, 24 aa, Mycobacterium
IGDKNFFALLQDWTTRHRHGTAFT

SEQ ID NO: 825939 - protein, 27 aa, Mycobacterium
IGDKWSLLVIGTLRDGPMRFGALEAAV

SEQ ID NO: 825940 - protein, 27 aa, Mycobacterium
IGDLAALWQVWQPQKKDYRVRGIDPTR

SEQ ID NO: 825941 - protein, 27 aa, Mycobacterium
IGDLDPALYHWFIGDGMVHGIRIRDGR

SEQ ID NO: 825942 - protein, 17 aa, Mycobacterium
IGDLFGGLFGRGAQQPR

SEQ ID NO: 825943 - protein, 26 aa, Mycobacterium
IGDLNPMLYQIARGAPLPAFRDVTLG

SEQ ID NO: 825944 - protein, 24 aa, Mycobacterium
IGDPAAMTPLYNASTLWGTSVTGS

SEQ ID NO: 825945 - protein, 18 aa, Mycobacterium
IGDPWYRLRKVPAVVRHL

SEQ ID NO: 825946 - protein, 18 aa, Mycobacterium
IGDRHLTELFADDPARGT

SEQ ID NO: 825947 - protein, 17 aa, Mycobacterium
IGDRLPMDKVSAGVREI

SEQ ID NO: 825948 - protein, 24 aa, Mycobacterium
IGDRVAVGWFGFYCGSCYRCRRGD

SEQ ID NO: 825949 - protein, 24 aa, Mycobacterium
IGEAFLLAEKLGLSAQSLFDVITG

SEQ ID NO: 825950 - protein, 25 aa, Mycobacterium
IGEALRLWYELLTESALPADDNGDS

SEQ ID NO: 825951 - protein, 25 aa, Mycobacterium
IGEATNLLFLRGMIGKPGAGVCPVR

SEQ ID NO: 825952 - protein, 24 aa, Mycobacterium
IGEAYQLLRDGLGLSAPQIAEVFT

SEQ ID NO: 825953 - protein, 24 aa, Mycobacterium
IGEFAQLFRRARALEYEKFGAGTG

SEQ ID NO: 825954 - protein, 25 aa, Mycobacterium
IGEGNLHLNVLRLPPDREPALYPEL

SEQ ID NO: 825955 - protein, 24 aa, Mycobacterium
IGEIRGLGVFWAIELVANPESREP

SEQ ID NO: 825956 - protein, 21 aa, Mycobacterium
IGEIWLHGKNLGLGYWGKEAE

SEQ ID NO: 825957 - protein, 23 aa, Mycobacterium
IGELRDGALLPGLAAGALGIHDQ

SEQ ID NO: 825958 - protein, 19 aa, Mycobacterium
IGELWARFNAVAVDNPHAW

SEQ ID NO: 825959 - protein, 20 aa, Mycobacterium
IGERGLTLIGFAVCNIDRDG

SEQ ID NO: 825960 - protein, 21 aa, Mycobacterium
IGERYVGIRPAPGYPACPEHT

SEQ ID NO: 825961 - protein, 21 aa, Mycobacterium
IGEVLLAHVLIVKGEFGAAAA

SEQ ID NO: 825962 - protein, 28 aa, Mycobacterium
IGEYEAYLKRFLRWVPHESDADAWKNEK

SEQ ID NO: 825963 - protein, 17 aa, Mycobacterium
IGEYPAATLAGVFDLDT

SEQ ID NO: 825964 - protein, 23 aa, Mycobacterium
IGFDVVLKPLPQDQYFAAFSDKN

SEQ ID NO: 825965 - protein, 21 aa, Mycobacterium
IGFGGYVALPAYLAARGIPGL

SEQ ID NO: 825966 - protein, 22 aa, Mycobacterium
IGFIAGYLRPSGSLMIWQVGVD

SEQ ID NO: 825967 - protein, 19 aa, Mycobacterium
IGFLENLLGDLAQWAYALL

SEQ ID NO: 825968 - protein, 18 aa, Mycobacterium
IGFPTVRGLAPYLDGNVG

SEQ ID NO: 825969 - protein, 20 aa, Mycobacterium
IGFRQLFAGNLVKQPAYRNV

SEQ ID NO: 825970 - protein, 20 aa, Mycobacterium
IGFRTDFLTITRGTGIANAV

SEQ ID NO: 825971 - protein, 30 aa, Mycobacterium
IGFTAEYDLSLWILKVRALTSAWGTSEWHR

SEQ ID NO: 825972 - protein, 17 aa, Mycobacterium
IGGAIASGPAGGSERNW

SEQ ID NO: 825973 - protein, 27 aa, Mycobacterium
IGGAKAWLGTALALKPILRIDDGKLVL

SEQ ID NO: 825974 - protein, 27 aa, Mycobacterium
IGGAKAWLGTALALKPLLRIDDGKLVL

SEQ ID NO: 825975 - protein, 28 aa, Mycobacterium
IGGAKAWLGTALALKPLLRIDDGKLVLA

SEQ ID NO: 825976 - protein, 27 aa, Mycobacterium
IGGAKAWLGTALALKPLLRVEDGKLVL

SEQ ID NO: 825977 - protein, 25 aa, Mycobacterium
IGGALGGFRYGLPIKRWLLDHEAAA

SEQ ID NO: 825978 - protein, 26 aa, Mycobacterium
IGGATMLRVLLYPDQMLDEAWVDQTT

SEQ ID NO: 825979 - protein, 18 aa, Mycobacterium
IGGAVGLQLLLDAADRLT

SEQ ID NO: 825980 - protein, 24 aa, Mycobacterium
IGGDKPWFAIGGIDAPRLPEVIAA

SEQ ID NO: 825981 - protein, 18 aa, Mycobacterium
IGGEIWSTGVLADSLCFV

SEQ ID NO: 825982 - protein, 17 aa, Mycobacterium
IGGFPVTVGWIHAIRRG

SEQ ID NO: 825983 - protein, 22 aa, Mycobacterium
IGGGDPAIFGSTPGFDNALDTD

SEQ ID NO: 825984 - protein, 23 aa, Mycobacterium
IGGGGILNIPITGAITGLTVQPF

SEQ ID NO: 825985 - protein, 23 aa, Mycobacterium
IGGGGILNIPITGAITGLTVQSF

SEQ ID NO: 825986 - protein, 18 aa, Mycobacterium
IGGGSGHYPAFCGTVGPG

SEQ ID NO: 825987 - protein, 24 aa, Mycobacterium
IGGGWDLPRYRGALAAGPEDPERR

SEQ ID NO: 825988 - protein, 27 aa, Mycobacterium
IGGHKGGLPLLPDIFGSVGMTGINGQY

SEQ ID NO: 825989 - protein, 17 aa, Mycobacterium
IGGIGASGSFGAPSGQG

SEQ ID NO: 825990 - protein, 18 aa, Mycobacterium
IGGKARFGKPHGWNCSEA

SEQ ID NO: 825991 - protein, 22 aa, Mycobacterium
IGGKTFPLPSPFLVMATQNPIE

SEQ ID NO: 825992 - protein, 19 aa, Mycobacterium
IGGLAVPAAWASAAPAPPI

SEQ ID NO: 825993 - protein, 25 aa, Mycobacterium
IGGLGRLRLPRYGALTYPRHMRAEA

SEQ ID NO: 825994 - protein, 30 aa, Mycobacterium
IGGLLHIRHEFNFPVRLFEIGASAGLNLRA

SEQ ID NO: 825995 - protein, 23 aa, Mycobacterium
IGGLTRLARRPVSYARVRLTRRH

SEQ ID NO: 825996 - protein, 24 aa, Mycobacterium
IGGLTTALLLRDSGFHVDVFERTP

SEQ ID NO: 825997 - protein, 32 aa, Mycobacterium
IGGNGSVGPIYLPLIDIPASPGYFNSTVLPSS

SEQ ID NO: 825998 - protein, 22 aa, Mycobacterium
IGGPFPPLPFVPEGDDIGEQIE

SEQ ID NO: 825999 - protein, 26 aa, Mycobacterium
IGGPGGSGGFGGLIGSGGPGGAGGDG

SEQ ID NO: 826000 - protein, 25 aa, Mycobacterium
IGGPTVFNHFPWGWTHAGNTPFRRW

SEQ ID NO: 826001 - protein, 26 aa, Mycobacterium
IGGQEILFPALLPRAPYEATNRWTEY

SEQ ID NO: 826002 - protein, 26 aa, Mycobacterium
IGGQEILLPALLPRAPYETTNRWTEY

SEQ ID NO: 826003 - protein, 27 aa, Mycobacterium
IGGQGGAGGWLYGNGGIGGQGGAGALG

SEQ ID NO: 826004 - protein, 17 aa, Mycobacterium
IGGQLFADAFAATSLKG

SEQ ID NO: 826005 - protein, 21 aa, Mycobacterium
IGGQTFPLPSPFLVMATQNPI

SEQ ID NO: 826006 - protein, 21 aa, Mycobacterium
IGGRWQLERLVGESLLADLEL

SEQ ID NO: 826007 - protein, 27 aa, Mycobacterium
IGGTGGGLFGLLGHSGSTGAAGAAGNG

SEQ ID NO: 826008 - protein, 21 aa, Mycobacterium
IGGTPLVRLNAVVPAGIGTVA

SEQ ID NO: 826009 - protein, 25 aa, Mycobacterium
IGGTSGLVLGLDGFNAPASTSPLHT

SEQ ID NO: 826010 - protein, 26 aa, Mycobacterium
IGGVPVMMKALLDAGLLRGDCLTVTG

SEQ ID NO: 826011 - protein, 25 aa, Mycobacterium
IGGVPVVMRALLDAGLLNGECLTVT

SEQ ID NO: 826012 - protein, 25 aa, Mycobacterium
IGGVYRVLQCIAQARPFVLLDRFEL

SEQ ID NO: 826013 - protein, 22 aa, Mycobacterium
IGHALRAWPTPLGVAINSADPI

SEQ ID NO: 826014 - protein, 26 aa, Mycobacterium
IGHDNAGRLIGFTSAHCGGPGATVAA

SEQ ID NO: 826015 - protein, 30 aa, Mycobacterium
IGHDWGAPVAWTFAWLYPQRCAGVVGISVP

SEQ ID NO: 826016 - protein, 29 aa, Mycobacterium
IGHELKVIAQLKFPGYFLVVHDITQFCRR

SEQ ID NO: 826017 - protein, 30 aa, Mycobacterium
IGHGALAERALIPVLPGVEDFPYAIRQVSE

SEQ ID NO: 826018 - protein, 29 aa, Mycobacterium
IGHGALAERALIPVLPSIEEFPYAIRQVS

SEQ ID NO: 826019 - protein, 30 aa, Mycobacterium
IGHGALAERALLPVLPGVEEFPYAIRQVSE

SEQ ID NO: 826020 - protein, 37 aa, Mycobacterium
IGHLASKHRFIAAQFVALFGDGLWLRNAEHANAMARR

SEQ ID NO: 826021 - protein, 19 aa, Mycobacterium
IGHLRRKLGDDAASPRYIA

SEQ ID NO: 826022 - protein, 23 aa, Mycobacterium
IGHLSARLATLGPAATLARGYAV

SEQ ID NO: 826023 - protein, 21 aa, Mycobacterium
IGHLSARLTTLGPAATLARGY

SEQ ID NO: 826024 - protein, 25 aa, Mycobacterium
IGHNLAGLLRGTAGQVPVNVGFANN

SEQ ID NO: 826025 - protein, 23 aa, Mycobacterium
IGHPGPAAWYDRLPRHDPSDIVR

SEQ ID NO: 826026 - protein, 26 aa, Mycobacterium
IGHTDAVLWDLQRPDPALLMQGMWVQ

SEQ ID NO: 826027 - protein, 27 aa, Mycobacterium
IGHTLPRLLLPLWDSELGKGFIATLRS

SEQ ID NO: 826028 - protein, 22 aa, Mycobacterium
IGHTTVLPFTAPYTRFNGRLGA

SEQ ID NO: 826029 - protein, 18 aa, Mycobacterium
IGHVDRPVQRRLRIGLCM

SEQ ID NO: 826030 - protein, 19 aa, Mycobacterium
IGHVLLPVAVSRSRELGQY

SEQ ID NO: 826031 - protein, 19 aa, Mycobacterium
IGHWTCPVPTFLEPLDQAR

SEQ ID NO: 826032 - protein, 17 aa, Mycobacterium
IGIAIGLDKHPRGAFTD

SEQ ID NO: 826033 - protein, 18 aa, Mycobacterium
IGIAIGLDKHPRGAFTDD

SEQ ID NO: 826034 - protein, 17 aa, Mycobacterium
IGIAYLCCITGMMPLRQ

SEQ ID NO: 826035 - protein, 20 aa, Mycobacterium
IGIDLREDWPSALRQRGFDA

SEQ ID NO: 826036 - protein, 25 aa, Mycobacterium
IGIERATKILGLLTATDKSYAATIR

SEQ ID NO: 826037 - protein, 26 aa, Mycobacterium
IGIERATKILGLLTATDKSYTATLRL

SEQ ID NO: 826038 - protein, 27 aa, Mycobacterium
IGIFGLAIPEPYGFGAVSMPCYVQVAE

SEQ ID NO: 826039 - protein, 20 aa, Mycobacterium
IGIGLTIALQADLRIVADDA

SEQ ID NO: 826040 - protein, 17 aa, Mycobacterium
IGIGYVNSYRRWQDVNA

SEQ ID NO: 826041 - protein, 18 aa, Mycobacterium
IGIHAGTPQRIGSDWLGV

SEQ ID NO: 826042 - protein, 17 aa, Mycobacterium
IGILAVLKTGAAYLPVD

SEQ ID NO: 826043 - protein, 23 aa, Mycobacterium
IGINLTGTFLVAKAALARMIDQP

SEQ ID NO: 826044 - protein, 20 aa, Mycobacterium
IGITPILPMIRQAQDWGADW

SEQ ID NO: 826045 - protein, 18 aa, Mycobacterium
IGIVLITARDGLPDRLRG

SEQ ID NO: 826046 - protein, 19 aa, Mycobacterium
IGIVRYYADLLRGYQFSED

SEQ ID NO: 826047 - protein, 21 aa, Mycobacterium
IGKALLSQLPPDQVRNMLPAD

SEQ ID NO: 826048 - protein, 30 aa, Mycobacterium
IGKDCRPLYYLEMPPSLFAPIVENLAKADL

SEQ ID NO: 826049 - protein, 31 aa, Mycobacterium
IGKDIIRFHAVYWPAFLMSAGIELPKKVFAH

SEQ ID NO: 826050 - protein, 32 aa, Mycobacterium
IGKDIIRFHAVYWPAFLMSAGIELPRRVFAHG

SEQ ID NO: 826051 - protein, 31 aa, Mycobacterium
IGKDIIRFHTVYWPAFLMSAGIALPQRVFAH

SEQ ID NO: 826052 - protein, 43 aa, Mycobacterium
IGKDIIRFHTVYWPAFLMSAGIDLPRRVFAHGFLLNRGEKMSK

SEQ ID NO: 826053 - protein, 43 aa, Mycobacterium; identical to SEQ ID NO: 115307

SEQ ID NO: 826054 - protein, 44 aa, Mycobacterium
IGKDIIRFHTVYWPAFLMSAGLPLPKRIFAHGWLLNRGEKMSKS

SEQ ID NO: 826055 - protein, 23 aa, Mycobacterium
IGKFNWAMLLHGSQGIRLHAPLP

SEQ ID NO: 826056 - protein, 24 aa, Mycobacterium
IGKGLLLSHTLTKPLIAAVNGACL

SEQ ID NO: 826057 - protein, 22 aa, Mycobacterium
IGKIVVQIPNPLQPQPDRSYLI

SEQ ID NO: 826058 - protein, 20 aa, Mycobacterium
IGKPAALLRAARASLCADAT

SEQ ID NO: 826059 - protein, 28 aa, Mycobacterium
IGKPGRAFLRKFLPGHWAYLQTLMSDLT

SEQ ID NO: 826060 - protein, 20 aa, Mycobacterium
IGKPHKLPLRADATRVALQH

SEQ ID NO: 826061 - protein, 19 aa, Mycobacterium
IGKPLLADPAPPGASQLPA

SEQ ID NO: 826062 - protein, 39 aa, Mycobacterium
IGKRDIYGDTRLGLFPFRRNLTFYALDLGLMSFSHPDRL

SEQ ID NO: 826063 - protein, 18 aa, Mycobacterium
IGKRGGWLAGLHPAELLG

SEQ ID NO: 826064 - protein, 28 aa, Mycobacterium
IGKRIERGLALTALLRATLTTVRTPGAE

SEQ ID NO: 826065 - protein, 28 aa, Mycobacterium
IGKRIERGLWLTALLRATLTAVRRTAAE

SEQ ID NO: 826066 - protein, 18 aa, Mycobacterium
IGKRNGWLSGLHATELLG

SEQ ID NO: 826067 - protein, 24 aa, Mycobacterium
IGKTAAMPTLSPALFTAISVTPVR

SEQ ID NO: 826068 - protein, 18 aa, Mycobacterium
IGKTTLWLSLLQTARMRG

SEQ ID NO: 826069 - protein, 17 aa, Mycobacterium
IGKVVLTMPSALADGLA

SEQ ID NO: 826070 - protein, 17 aa, Mycobacterium
IGKWAMGEYPYHDLYML

SEQ ID NO: 826071 - protein, 18 aa, Mycobacterium
IGLAFRALTREPGLLPRL

SEQ ID NO: 826072 - protein, 31 aa, Mycobacterium
IGLANYFAGALLLPYVLFLDAAQSVRYDIDQ

SEQ ID NO: 826073 - protein, 31 aa, Mycobacterium
IGLANYYAGALLLPYRMFLAAAEELRYDIDR

SEQ ID NO: 826074 - protein, 22 aa, Mycobacterium
IGLARTVWAIQGLKFTVTGVEN

SEQ ID NO: 826075 - protein, 19 aa, Mycobacterium
IGLDEYIDWLIEAGYSIER

SEQ ID NO: 826076 - protein, 17 aa, Mycobacterium
IGLDHRFVDGYQAATMA

SEQ ID NO: 826077 - protein, 17 aa, Mycobacterium
IGLFSCRGLDTVGPFGY

SEQ ID NO: 826078 - protein, 20 aa, Mycobacterium
IGLGGLGHLGVQFAAAMGFD

SEQ ID NO: 826079 - protein, 18 aa, Mycobacterium
IGLGNRYRRDDGVGIVAA

SEQ ID NO: 826080 - protein, 18 aa, Mycobacterium
IGLHARPAAIISEAAVEA

SEQ ID NO: 826081 - protein, 22 aa, Mycobacterium
IGLHVIVTCQMSMAHRATMDKF

SEQ ID NO: 826082 - protein, 18 aa, Mycobacterium
IGLIYRGQTWTWRAHLAA

SEQ ID NO: 826083 - protein, 27 aa, Mycobacterium
IGLLAKFMPNFLFAPNSELPVIGRRDD

SEQ ID NO: 826084 - protein, 17 aa, Mycobacterium
IGLLGSVPRLDATQGTR

SEQ ID NO: 826085 - protein, 18 aa, Mycobacterium
IGLLIAEVKVTYKGQLRL

SEQ ID NO: 826086 - protein, 19 aa, Mycobacterium
IGLLNVQYALKDDVLYVLE

SEQ ID NO: 826087 - protein, 21 aa, Mycobacterium
IGLLVDGRWRWRSYSLTSSPV

SEQ ID NO: 826088 - protein, 18 aa, Mycobacterium
IGLMIAMGPAFCSELVLL

SEQ ID NO: 826089 - protein, 19 aa, Mycobacterium
IGLPEVTLGLLPGGGGVAR

SEQ ID NO: 826090 - protein, 17 aa, Mycobacterium
IGLPGQANYSASKAGLV

SEQ ID NO: 826091 - protein, 22 aa, Mycobacterium
IGLPTGFYDDGGLVAGWEAHSG

SEQ ID NO: 826092 - protein, 23 aa, Mycobacterium
IGLRDVLAALQWIRDNIAGFGGD

SEQ ID NO: 826093 - protein, 23 aa, Mycobacterium
IGLRSKFFDEFFINATNSGCKQA

SEQ ID NO: 826094 - protein, 18 aa, Mycobacterium
IGLSCRFPGAADPEAFWH

SEQ ID NO: 826095 - protein, 34 aa, Mycobacterium
IGLTDGPDALRILRLHLVHLLQTLSPHTAELDAG

SEQ ID NO: 826096 - protein, 18 aa, Mycobacterium
IGLTFRSPNKLPVTFTPA

SEQ ID NO: 826097 - protein, 19 aa, Mycobacterium
IGLVSLLRDRALPVVAPWI

SEQ ID NO: 826098 - protein, 27 aa, Mycobacterium
IGLVTNVLLAPLYPAALLAKQLASVAC

SEQ ID NO: 826099 - protein, 31 aa, Mycobacterium
IGLVVELLTRRRIFVPILRVTAIEPGAVTLA

SEQ ID NO: 826100 - protein, 20 aa, Mycobacterium
IGLYHAKRLATPGQRIVLYA

SEQ ID NO: 826101 - protein, 17 aa, Mycobacterium
IGLYRSVGFEQIGVRRR

SEQ ID NO: 826102 - protein, 27 aa, Mycobacterium
IGMDFRPGLPIRLMPRQQAQRSYSHRD

SEQ ID NO: 826103 - protein, 22 aa, Mycobacterium
IGMEFGYVLRNYGVDVTVVEFL

SEQ ID NO: 826104 - protein, 21 aa, Mycobacterium
IGMGLILLRAPAGGEPPEQIF

SEQ ID NO: 826105 - protein, 27 aa, Mycobacterium
IGMHPQITANLLFIRFEFRTGDASGHN

SEQ ID NO: 826106 - protein, 18 aa, Mycobacterium
IGMLRREWDKIGTSVPFA

SEQ ID NO: 826107 - protein, 25 aa, Mycobacterium
IGMLVSCNAYYLYMLSDIFSEQWLG

SEQ ID NO: 826108 - protein, 36 aa, Mycobacterium
IGMPATRFLGPALGSLHLFFHRLGPVQARRLLLTGD

SEQ ID NO: 826109 - protein, 18 aa, Mycobacterium
IGMPVLPPTMVLVQQLRS

SEQ ID NO: 826110 - protein, 17 aa, Mycobacterium
IGMPVRATYIDFPAGDS

SEQ ID NO: 826111 - protein, 25 aa, Mycobacterium
IGMSWRTYLLHARMLRAMALLADQD

SEQ ID NO: 826112 - protein, 33 aa, Mycobacterium
IGMTIPYAALEIMKLRLTPSAYQQAAGLAKTFF

SEQ ID NO: 826113 - protein, 18 aa, Mycobacterium
IGMTKEQRLALGPMHHGR

SEQ ID NO: 826114 - protein, 44 aa, Mycobacterium
IGMVFQHFNLFPHRTVLDNVALAPRKLRRLPVDRARDLALTQLD

SEQ ID NO: 826115 - protein, 26 aa, Mycobacterium
IGMVFQQFQLFPHKSVLDNVTLGPRK

SEQ ID NO: 826116 - protein, 24 aa, Mycobacterium
IGMVIPYAALEIMKLRLTRSAYQQ

SEQ ID NO: 826117 - protein, 20 aa, Mycobacterium
IGMVLGSYRWLNPSGRRSAQ

SEQ ID NO: 826118 - protein, 18 aa, Mycobacterium
IGNAPTALFRLLELVDDG

SEQ ID NO: 826119 - protein, 27 aa, Mycobacterium
IGNCLRIQLMAFAYDGAWAEYTVAQAV

SEQ ID NO: 826120 - protein, 24 aa, Mycobacterium
IGNEGYFPPAFTIGDYRARTAGLG

SEQ ID NO: 826121 - protein, 26 aa, Mycobacterium
IGNLEFAGFIVWLAVAAPDMPGGPPQ

SEQ ID NO: 826122 - protein, 18 aa, Mycobacterium
IGNLLKDIGAALTAVGLP

SEQ ID NO: 826123 - protein, 35 aa, Mycobacterium
IGNPALVVTINFLGLRHFTEALIPRMPAGSAVASV

SEQ ID NO: 826124 - protein, 25 aa, Mycobacterium
IGNRDTYFPLLRDGTVGLVPEYVGS

SEQ ID NO: 826125 - protein, 25 aa, Mycobacterium
IGNSCRLDLPTPSRVFDALRAHAPT

SEQ ID NO: 826126 - protein, 26 aa, Mycobacterium
IGNSYTASLYLALAALLDQADDLSDQ

SEQ ID NO: 826127 - protein, 32 aa, Mycobacterium
IGNTAADLGPLRWLPAIPDVLAADPTWATCLQ

SEQ ID NO: 826128 - protein, 25 aa, Mycobacterium
IGNTEWPKWEAVMAADPLDPAAAAE

SEQ ID NO: 826129 - protein, 20 aa, Mycobacterium
IGNTLAPRYVDLRPFAVNDG

SEQ ID NO: 826130 - protein, 30 aa, Mycobacterium
IGNVTHGALRSAWIGYWVPRSATGGGVATA

SEQ ID NO: 826131 - protein, 22 aa, Mycobacterium
IGNVVLGFPTLAGYLNNTGSAK

SEQ ID NO: 826132 - protein, 24 aa, Mycobacterium
IGPADIPLLVADLAYVRGMVHRQL

SEQ ID NO: 826133 - protein, 27 aa, Mycobacterium
IGPADIPLLVADLAYVRGMVYRQLHDD

SEQ ID NO: 826134 - protein, 22 aa, Mycobacterium
IGPALINQHFLLTGSPPNRREL

SEQ ID NO: 826135 - protein, 24 aa, Mycobacterium
IGPAVWPAIITPAERDRVLARMAA

SEQ ID NO: 826136 - protein, 29 aa, Mycobacterium
IGPDGQPHLTAMWYAVVDGEIWLETKAKS

SEQ ID NO: 826137 - protein, 21 aa, Mycobacterium
IGPEFLRPGPGWGGSCLPKDT

SEQ ID NO: 826138 - protein, 18 aa, Mycobacterium
IGPFFPLATLTFDRELCA

SEQ ID NO: 826139 - protein, 25 aa, Mycobacterium
IGPGDKWIYEQIKLVAPRTTLIAIV

SEQ ID NO: 826140 - protein, 19 aa, Mycobacterium
IGPGDRWILEQIRSVAPGT

SEQ ID NO: 826141 - protein, 25 aa, Mycobacterium
IGPGDRWIYQQIRAVAPRTTLIGIV

SEQ ID NO: 826142 - protein, 21 aa, Mycobacterium
IGPHDVFTTASLLTGGSYDVT

SEQ ID NO: 826143 - protein, 19 aa, Mycobacterium
IGPKLLSFGSGAHFCLGAH

SEQ ID NO: 826144 - protein, 29 aa, Mycobacterium
IGPLPVGKGLLSLSLLDTPALRMDDLTNH

SEQ ID NO: 826145 - protein, 28 aa, Mycobacterium
IGPNGQPHLTAMWYAVVDGEIWLETKAK

SEQ ID NO: 826146 - protein, 23 aa, Mycobacterium
IGPPITDGFYYDFGIDHAFTPED

SEQ ID NO: 826147 - protein, 27 aa, Mycobacterium
IGPQGDVAWLCAPRWDSDAVFSNLIGG

SEQ ID NO: 826148 - protein, 17 aa, Mycobacterium
IGPRFTMFGPTVTTWRS

SEQ ID NO: 826149 - protein, 29 aa, Mycobacterium
IGPRLFARRKVLRALLGAGYRKPGRLPDS

SEQ ID NO: 826150 - protein, 24 aa, Mycobacterium
IGPRRRMRWEDVADWDFVCTQLAA

SEQ ID NO: 826151 - protein, 23 aa, Mycobacterium
IGPRTRMRWEQVADWDYVCEQLA

SEQ ID NO: 826152 - protein, 24 aa, Mycobacterium
IGPSDHVAWLDDRKWAYVRLEGRA

SEQ ID NO: 826153 - protein, 17 aa, Mycobacterium
IGPSLRAILLTAAHEDA

SEQ ID NO: 826154 - protein, 26 aa, Mycobacterium
IGPVVATPIMRWLHSVDGPVEQFNQT

SEQ ID NO: 826155 - protein, 24 aa, Mycobacterium
IGPVVATPIMRWLQNMDGPVEQFN

SEQ ID NO: 826156 - protein, 24 aa, Mycobacterium
IGPVVATPIMRWLQQVDGPTDQFN

SEQ ID NO: 826157 - protein, 17 aa, Mycobacterium
IGPYEMLRGLPSAEFRF

SEQ ID NO: 826158 - protein, 19 aa, Mycobacterium
IGPYLIRQLAQMGAKTVVA

SEQ ID NO: 826159 - protein, 19 aa, Mycobacterium
IGQAWLAQSVKRWAAEQLP

SEQ ID NO: 826160 - protein, 19 aa, Mycobacterium
IGQFELFLIAAAVAEGWAV

SEQ ID NO: 826161 - protein, 25 aa, Mycobacterium
IGQGSIGLLFSYVAKALGAARVTGV

SEQ ID NO: 826162 - protein, 17 aa, Mycobacterium
IGQILETHLGWIAKTGW

SEQ ID NO: 826163 - protein, 20 aa, Mycobacterium
IGQLELFLITAAVAEGWAVS

SEQ ID NO: 826164 - protein, 19 aa, Mycobacterium
IGQLLPCNVVVRTDPAESD

SEQ ID NO: 826165 - protein, 17 aa, Mycobacterium
IGQLQKIVLAYAQGKGV

SEQ ID NO: 826166 - protein, 18 aa, Mycobacterium
IGQRVFGLADWARNGSLA

SEQ ID NO: 826167 - protein, 18 aa, Mycobacterium
IGQSLVLEIGGEPFRVRE

SEQ ID NO: 826168 - protein, 27 aa, Mycobacterium
IGQTRGWFYTLHVLATALFDKPAFKTC

SEQ ID NO: 826169 - protein, 25 aa, Mycobacterium
IGQTRGWFYTLHVLATALFDRPSFK

SEQ ID NO: 826170 - protein, 21 aa, Mycobacterium
IGQWSAPHLEFLVAVARSCVG

SEQ ID NO: 826171 - protein, 17 aa, Mycobacterium
IGRAYYPAPYLTNDNLE

SEQ ID NO: 826172 - protein, 29 aa, Mycobacterium
IGRDHLYGLAWNPMTLIDVLKKIDGADTA

SEQ ID NO: 826173 - protein, 24 aa, Mycobacterium
IGRDIVAHLNWRKLGPGPSRPADE

SEQ ID NO: 826174 - protein, 32 aa, Mycobacterium
IGRDVVRRALSEPLRWIAFNAGFEGGDVVDVV

SEQ ID NO: 826175 - protein, 23 aa, Mycobacterium
IGRFSVLAAGWPESIPGTTVNRA

SEQ ID NO: 826176 - protein, 25 aa, Mycobacterium
IGRGCLGRPWLFAELSAAFNNRPIP

SEQ ID NO: 826177 - protein, 26 aa, Mycobacterium
IGRGCLGRPWLFAELSAAFTDSPAPT

SEQ ID NO: 826178 - protein, 27 aa, Mycobacterium
IGRGCLGRPWLFAELSAAFTGATPATP

SEQ ID NO: 826179 - protein, 25 aa, Mycobacterium
IGRGCLGRPWLFAELSAAFTGNPGP

SEQ ID NO: 826180 - protein, 26 aa, Mycobacterium
IGRGCLGRPWLFAELSAAFTGRPAPT

SEQ ID NO: 826181 - protein, 25 aa, Mycobacterium
IGRGCLGRPWLFAELSAVFNGQTIP

SEQ ID NO: 826182 - protein, 25 aa, Mycobacterium
IGRHDGGLVSTYLFDHARRGMVVGL

SEQ ID NO: 826183 - protein, 26 aa, Mycobacterium
IGRIDGWGHCTVGLGLQQKLDRPAQG

SEQ ID NO: 826184 - protein, 26 aa, Mycobacterium
IGRLEELMPIYSELLSLLADSGAQWV

SEQ ID NO: 826185 - protein, 17 aa, Mycobacterium
IGRLLFSAKLSNEVVVR

SEQ ID NO: 826186 - protein, 25 aa, Mycobacterium
IGRLLRAHGLRRMPSRIQVLAVLEP

SEQ ID NO: 826187 - protein, 28 aa, Mycobacterium
IGRLPSFEELFAHRALPAVALSGPSLQT

SEQ ID NO: 826188 - protein, 23 aa, Mycobacterium
IGRLTDLGILRYTPTRRPVTAAN

SEQ ID NO: 826189 - protein, 22 aa, Mycobacterium
IGRLVLDFYRCAMLPLSSDDVQ

SEQ ID NO: 826190 - protein, 22 aa, Mycobacterium
IGRPDLPDWYFTAEDIADTLNP

SEQ ID NO: 826191 - protein, 28 aa, Mycobacterium
IGRPEELTGLYLYLASEASSYMTGSDIV

SEQ ID NO: 826192 - protein, 28 aa, Mycobacterium
IGRPEELTGLYLYLASEASSYMTGSDLV

SEQ ID NO: 826193 - protein, 17 aa, Mycobacterium
IGRPRPLSRHRRADDLY

SEQ ID NO: 826194 - protein, 23 aa, Mycobacterium
IGRRCAWLLLDASGPLTLTLACD

SEQ ID NO: 826195 - protein, 24 aa, Mycobacterium
IGRRFLNAGLGFGGGCLPKDIRAF

SEQ ID NO: 826196 - protein, 18 aa, Mycobacterium
IGRRGWRLISGGGTIAMM

SEQ ID NO: 826197 - protein, 19 aa, Mycobacterium
IGRRLAPEPVLHAALGPGA

SEQ ID NO: 826198 - protein, 32 aa, Mycobacterium
IGRRPLDLFMTNANIYLPLANLTAFQVALLDD

SEQ ID NO: 826199 - protein, 31 aa, Mycobacterium
IGRRVLDLGSCFGFFPLRLSRNGFDATATDL

SEQ ID NO: 826200 - protein, 25 aa, Mycobacterium
IGRSPLLERTFDWLEANWPAETAAA

SEQ ID NO: 826201 - protein, 34 aa, Mycobacterium
IGRSRPVISNMIRLLRLPIAVQRRVAAGVLSAGH

SEQ ID NO: 826202 - protein, 22 aa, Mycobacterium
IGRTALLAAGWPETVPGVTVDR

SEQ ID NO: 826203 - protein, 40 aa, Mycobacterium
IGRVGPLSGDPYRLAAQLGMPPWRVQKAQKQARRWSRDKV

SEQ ID NO: 826204 - protein, 37 aa, Mycobacterium
IGRVGPLSGDPYRLASQLGMPPWRVQKAQKQARYWSR

SEQ ID NO: 826205 - protein, 18 aa, Mycobacterium
IGRVRPGSDSLLRMRLDL

SEQ ID NO: 826206 - protein, 24 aa, Mycobacterium
IGRYAVLAAGWPESIPGTTVNRAC

SEQ ID NO: 826207 - protein, 31 aa, Mycobacterium
IGRYPDKRSALLPLLHLVQAEDSYLTPAGLE

SEQ ID NO: 826208 - protein, 30 aa, Mycobacterium
IGRYPDKRSALLPLLHLVQGEDSYLTPAGL

SEQ ID NO: 826209 - protein, 30 aa, Mycobacterium
IGRYPDQRSALLPLLHLVQGEDSYLTPAGL

SEQ ID NO: 826210 - protein, 30 aa, Mycobacterium
IGSALPRTALFVLDPWLRPVPTGVAGELYV

SEQ ID NO: 826211 - protein, 19 aa, Mycobacterium
IGSALYEDLQIGPDGRVLT

SEQ ID NO: 826212 - protein, 24 aa, Mycobacterium
IGSAPRVRRPIRRGGIGVLTVSGN

SEQ ID NO: 826213 - protein, 19 aa, Mycobacterium
IGSATWITFGPDPALAKDK

SEQ ID NO: 826214 - protein, 19 aa, Mycobacterium
IGSDRLRLEAYRRLAAASS

SEQ ID NO: 826215 - protein, 24 aa, Mycobacterium
IGSDRLRLEAYRRLAAATSDSGVA

SEQ ID NO: 826216 - protein, 25 aa, Mycobacterium
IGSDRLRLEGYRRLAAAPDDAAVDA

SEQ ID NO: 826217 - protein, 31 aa, Mycobacterium
IGSDTSLFVRPFLKYQIITVVAPNSPLAVGI

SEQ ID NO: 826218 - protein, 24 aa, Mycobacterium
IGSFTPIFVMSRITGWTAHIMEQT

SEQ ID NO: 826219 - protein, 30 aa, Mycobacterium
IGSGRRPLYYLEMPPALFAPIVENLAAADL

SEQ ID NO: 826220 - protein, 24 aa, Mycobacterium
IGSITAPYVLKGRSSVPGLPLIHQ

SEQ ID NO: 826221 - protein, 27 aa, Mycobacterium
IGSKELIAWLPTLLGLGPRDVVVVPEL

SEQ ID NO: 826222 - protein, 27 aa, Mycobacterium
IGSKELIAWLPTLLGLGSADMIVVPEL

SEQ ID NO: 826223 - protein, 35 aa, Mycobacterium
IGSKLDITKWTFLNTDLAVHVFRIPAGDWIGIRAE

SEQ ID NO: 826224 - protein, 18 aa, Mycobacterium
IGSLLYMFGSMTPVIPNV

SEQ ID NO: 826225 - protein, 25 aa, Mycobacterium
IGSLQYNKFLIAELVTKLEAAQVYV

SEQ ID NO: 826226 - protein, 34 aa, Mycobacterium
IGSPAMNFLPATLTPIGLTLPFGEVMLTPEVREV

SEQ ID NO: 826227 - protein, 25 aa, Mycobacterium
IGSPGPGYGLPWSVQTWLPGVVATG

SEQ ID NO: 826228 - protein, 17 aa, Mycobacterium
IGSPPRFLDIAMFIAMD

SEQ ID NO: 826229 - protein, 23 aa, Mycobacterium
IGSPVPGAALFVLDRWLRPVPEG

SEQ ID NO: 826230 - protein, 32 aa, Mycobacterium
IGSQGALFDTPILVPPQAAMLGTGAIVKRPRI

SEQ ID NO: 826231 - protein, 23 aa, Mycobacterium
IGSQLLTGALSPEKARNLYDVDG

SEQ ID NO: 826232 - protein, 23 aa, Mycobacterium
IGSRFDCDLLASLGIDASVEELL

SEQ ID NO: 826233 - protein, 21 aa, Mycobacterium
IGSRPDGWWKDRHGAMVALVD

SEQ ID NO: 826234 - protein, 21 aa, Mycobacterium
IGSRPDGWWKDRHGAMVALVH

SEQ ID NO: 826235 - protein, 21 aa, Mycobacterium
IGSRWLAHYTATSGYLDALAY

SEQ ID NO: 826236 - protein, 22 aa, Mycobacterium
IGSRWLAHYTATSGYLDALAYA

SEQ ID NO: 826237 - protein, 19 aa, Mycobacterium
IGSSVLRLAPALGAARTIA

SEQ ID NO: 826238 - protein, 20 aa, Mycobacterium
IGSVWPLIAEGRVRPIIGAR

SEQ ID NO: 826239 - protein, 17 aa, Mycobacterium
IGTAPAYKLVPGAAIPS

SEQ ID NO: 826240 - protein, 24 aa, Mycobacterium
IGTDLMIKVIRRSRILSMGAMVGI

SEQ ID NO: 826241 - protein, 19 aa, Mycobacterium
IGTGEFMCVYWPSRGQEAI

SEQ ID NO: 826242 - protein, 20 aa, Mycobacterium
IGTGEFMCVYWPSRGQEAIA

SEQ ID NO: 826243 - protein, 21 aa, Mycobacterium
IGTHRLLQTGVRWKDLGLVIV

SEQ ID NO: 826244 - protein, 17 aa, Mycobacterium
IGTHRLLQTGVTWKDLG

SEQ ID NO: 826245 - protein, 19 aa, Mycobacterium
IGTLRVTRALLPKLIESGD

SEQ ID NO: 826246 - protein, 19 aa, Mycobacterium
IGTPHLHRLLSATTAAHCK

SEQ ID NO: 826247 - protein, 30 aa, Mycobacterium
IGTPIPGAALFVLDSWLRPVPPGTVGELYV

SEQ ID NO: 826248 - protein, 30 aa, Mycobacterium
IGTPLPSLGFFVLDGWLRPVPVGVVGELYV

SEQ ID NO: 826249 - protein, 37 aa, Mycobacterium
IGTPYSRMWGAYLSGMWLYRLSFAKAKWHSLTGRPLS

SEQ ID NO: 826250 - protein, 24 aa, Mycobacterium
IGTRAIHGFYSAIAGLTRECELVS

SEQ ID NO: 826251 - protein, 18 aa, Mycobacterium
IGTRIFDTLLASGIARWQ

SEQ ID NO: 826252 - protein, 23 aa, Mycobacterium
IGTRYVMLALRTLVDPNDPADLA

SEQ ID NO: 826253 - protein, 21 aa, Mycobacterium
IGTVVFPDARVKIFLTASAET

SEQ ID NO: 826254 - protein, 27 aa, Mycobacterium
IGVANYPSYFRFLKSKLRPGGLLLNHC

SEQ ID NO: 826255 - protein, 34 aa, Mycobacterium
IGVCAGIVPWNFPLLLAVWKLGPALAAGNTIVLK

SEQ ID NO: 826256 - protein, 31 aa, Mycobacterium
IGVELARGLAGRGFPLMLVARRRERLEELAD

SEQ ID NO: 826257 - protein, 25 aa, Mycobacterium
IGVELIAIEEGAPLELDLRLESVSE

SEQ ID NO: 826258 - protein, 17 aa, Mycobacterium
IGVFRRGSDGRYALTPV

SEQ ID NO: 826259 - protein, 34 aa, Mycobacterium
IGVGDRVGIWAPNRWEWVLVQYATAEIGAILVTV

SEQ ID NO: 826260 - protein, 28 aa, Mycobacterium
IGVHGFPNFFMSLGPQTPYSNLVVPIQL

SEQ ID NO: 826261 - protein, 28 aa, Mycobacterium
IGVHNYPAYFNFLKSKLRTGGLLLNHCI

SEQ ID NO: 826262 - protein, 18 aa, Mycobacterium
IGVIPMPPAEAIALGMQR

SEQ ID NO: 826263 - protein, 18 aa, Mycobacterium
IGVIYLPATERQSHYFHV

SEQ ID NO: 826264 - protein, 23 aa, Mycobacterium
IGVNRPIDVPLVGDLRGVVPQLV

SEQ ID NO: 826265 - protein, 27 aa, Mycobacterium
IGVNYIDTYFRSGQYPRQLPFILGQET

SEQ ID NO: 826266 - protein, 29 aa, Mycobacterium
IGVPLAHLGFFVLDGWLRPVPEGVVGELY

SEQ ID NO: 826267 - protein, 30 aa, Mycobacterium
IGVPLEHLAFFVLDGWLRKVPVGVVGELYV

SEQ ID NO: 826268 - protein, 29 aa, Mycobacterium
IGVPLEHLSFFVLDGWLRQVPVGVVGELY

SEQ ID NO: 826269 - protein, 27 aa, Mycobacterium
IGVPLSTYLYTTSMMHCMTVSLALEGV

SEQ ID NO: 826270 - protein, 29 aa, Mycobacterium
IGVPLTHLAFFVLDGWMRQVPAGVVGELY

SEQ ID NO: 826271 - protein, 29 aa, Mycobacterium
IGVPVPDAALFVLDRWMRPVPPGVVGELY

SEQ ID NO: 826272 - protein, 27 aa, Mycobacterium
IGVSGGAAFLLCRRASRLTSHAAQWAL

SEQ ID NO: 826273 - protein, 21 aa, Mycobacterium
IGVSQMQVSRILANTLRCLRD

SEQ ID NO: 826274 - protein, 20 aa, Mycobacterium
IGVTELRRQFGRILGEVTQG

SEQ ID NO: 826275 - protein, 33 aa, Mycobacterium
IGVVGAITPWNYPQALAVMKIAPALAAGCSVVL

SEQ ID NO: 826276 - protein, 25 aa, Mycobacterium
IGWCGHCQLGPLLLCRDGPVVGYDV

SEQ ID NO: 826277 - protein, 23 aa, Mycobacterium
IGWDLQAYSRGRFILGLGTQIQP

SEQ ID NO: 826278 - protein, 19 aa, Mycobacterium
IGWQLNQPIRIALAGTLKA

SEQ ID NO: 826279 - protein, 25 aa, Mycobacterium
IGWRDTVLLRALARFLKQAGLGMSH

SEQ ID NO: 826280 - protein, 23 aa, Mycobacterium
IGYIETWPVARLLRDAQVNTIWE

SEQ ID NO: 826281 - protein, 17 aa, Mycobacterium
IGYSPIIAGKPLRGMAD

SEQ ID NO: 826282 - protein, 18 aa, Mycobacterium
IGYVNSYRRWQDVNAAQV

SEQ ID NO: 826283 - protein, 24 aa, Mycobacterium
IHAALSVLQHWLAQDQLASLVVVT

SEQ ID NO: 826284 - protein, 17 aa, Mycobacterium
IHAAPQDVFRVLADPAR

SEQ ID NO: 826285 - protein, 24 aa, Mycobacterium
IHACLAPRHLPIEAIQRFVLRALG

SEQ ID NO: 826286 - protein, 41 aa, Mycobacterium
IHAEFRRVHVGAIRLVIQVLPRLDGFGVVLGGGGLLEGDIG

SEQ ID NO: 826287 - protein, 19 aa, Mycobacterium
IHAFLETSLVELALAYAAR

SEQ ID NO: 826288 - protein, 25 aa, Mycobacterium
IHAGNVAVPLFAPSLAGHTERLAAV

SEQ ID NO: 826289 - protein, 23 aa, Mycobacterium
IHALRRNINITILLFNNRIYGLT

SEQ ID NO: 826290 - protein, 17 aa, Mycobacterium
IHALWAADNAGPDERHL

SEQ ID NO: 826291 - protein, 27 aa, Mycobacterium
IHANGKPVFPMTLLGTFSPYMVVHKSS

SEQ ID NO: 826292 - protein, 19 aa, Mycobacterium
IHAPTWRERFRYRPTQWAH

SEQ ID NO: 826293 - protein, 19 aa, Mycobacterium
IHAQDKLLMRRRLSELGAP

SEQ ID NO: 826294 - protein, 45 aa, Mycobacterium
IHAVTIPVFDAGFLGIPIDAGPVTIPAIVITGPTLTGIIGGPTSA

SEQ ID NO: 826295 - protein, 24 aa, Mycobacterium
IHDALVDPKPFWEKPIELADVLDV

SEQ ID NO: 826296 - protein, 22 aa, Mycobacterium
IHDDGFYTGITPFGRTPGGYRL

SEQ ID NO: 826297 - protein, 18 aa, Mycobacterium
IHDFYGFPRELFDVEYPA

SEQ ID NO: 826298 - protein, 18 aa, Mycobacterium
IHDPISTQFLWPKTDDPR

SEQ ID NO: 826299 - protein, 17 aa, Mycobacterium
IHDRLLAVTLRSGGLDG

SEQ ID NO: 826300 - protein, 17 aa, Mycobacterium
IHEAFVNTLSMSSGSYA

SEQ ID NO: 826301 - protein, 19 aa, Mycobacterium
IHELRYPETAFAHAAIDAG

SEQ ID NO: 826302 - protein, 19 aa, Mycobacterium
IHELSSQSPVPALVELSRK

SEQ ID NO: 826303 - protein, 17 aa, Mycobacterium
IHESDMMLLPDPATARI

SEQ ID NO: 826304 - protein, 21 aa, Mycobacterium
IHEVALALWAQAPGSLDPQFA

SEQ ID NO: 826305 - protein, 18 aa, Mycobacterium
IHEVALALWGQAPGSLDP

SEQ ID NO: 826306 - protein, 25 aa, Mycobacterium
IHEVLGFASWTAYLADALGGQLEVR

SEQ ID NO: 826307 - protein, 18 aa, Mycobacterium
IHFQQWWVQHRAQVPTHS

SEQ ID NO: 826308 - protein, 25 aa, Mycobacterium
IHFRGHDWALLPRDLTGDGATTVVA

SEQ ID NO: 826309 - protein, 24 aa, Mycobacterium
IHGANGYLLDAFLKDYMNTRIDDY

SEQ ID NO: 826310 - protein, 21 aa, Mycobacterium
IHGEGVAFTVGLYSQDQRGRN

SEQ ID NO: 826311 - protein, 41 aa, Mycobacterium
IHGFFGSPYLLNGAFFALPWFFRNGYDVLLYTLPFHGRRAE

SEQ ID NO: 826312 - protein, 27 aa, Mycobacterium
IHGGAFIFPPSFLHWINYSVMAHQTGA

SEQ ID NO: 826313 - protein, 19 aa, Mycobacterium
IHGIIAYPVTPFSGDGIDT

SEQ ID NO: 826314 - protein, 18 aa, Mycobacterium
IHGIIAYPVTPFTAEGDV

SEQ ID NO: 826315 - protein, 17 aa, Mycobacterium
IHGRLDLSGPLLTAWEL

SEQ ID NO: 826316 - protein, 35 aa, Mycobacterium
IHGRPAIVEFLKAKWATELDYRLIKEVWAYGDDRI

SEQ ID NO: 826317 - protein, 20 aa, Mycobacterium
IHGVLMATNFFGINTIPIAA

SEQ ID NO: 826318 - protein, 30 aa, Mycobacterium
IHGVNLSLGCDWIPRYYAAGQSPLCRELDL

SEQ ID NO: 826319 - protein, 28 aa, Mycobacterium
IHGVNLSLGYPFDAEWYACGQSPLCVEV

SEQ ID NO: 826320 - protein, 18 aa, Mycobacterium
IHGYKRAFRIAGSGPAIL

SEQ ID NO: 826321 - protein, 23 aa, Mycobacterium
IHHAIPIIRAFSHFALLANVAED

SEQ ID NO: 826322 - protein, 29 aa, Mycobacterium
IHHDDVLQPILRFWRVFERADIGPEGEQA

SEQ ID NO: 826323 - protein, 23 aa, Mycobacterium
IHHIHHDPRWWPDPEKFDPQRFF

SEQ ID NO: 826324 - protein, 19 aa, Mycobacterium
IHHLQVDGRIPYAELARRV

SEQ ID NO: 826325 - protein, 17 aa, Mycobacterium
IHIERVMLGKRRVWISA

SEQ ID NO: 826326 - protein, 19 aa, Mycobacterium
IHIGLPRYEQHRCADMVNE

SEQ ID NO: 826327 - protein, 23 aa, Mycobacterium
IHKLAAVLDRLAAYRARIVDIDG

SEQ ID NO: 826328 - protein, 17 aa, Mycobacterium
IHLIGANRLATAVLPGM

SEQ ID NO: 826329 - protein, 17 aa, Mycobacterium
IHLLINNAGVMTPPERR

SEQ ID NO: 826330 - protein, 20 aa, Mycobacterium
IHLNMPIAMPTRTALTNPTA

SEQ ID NO: 826331 - protein, 20 aa, Mycobacterium
IHLNMPIAWPTADEPTDDER

SEQ ID NO: 826332 - protein, 17 aa, Mycobacterium
IHLVTLLEALPVQETLE

SEQ ID NO: 826333 - protein, 18 aa, Mycobacterium
IHNSLTRLLIKPSHLAGG

SEQ ID NO: 826334 - protein, 23 aa, Mycobacterium
IHNTQPWRWQVTSRSLELFSEPD

SEQ ID NO: 826335 - protein, 19 aa, Mycobacterium
IHPAIYRTVLAAVGPDRIA

SEQ ID NO: 826336 - protein, 17 aa, Mycobacterium
IHPGFIRTPMTEHFPDD

SEQ ID NO: 826337 - protein, 26 aa, Mycobacterium
IHPLHHDLGPWSPWGRYLRLRRQFDG

SEQ ID NO: 826338 - protein, 17 aa, Mycobacterium
IHPVAVAANRNVFVQLV

SEQ ID NO: 826339 - protein, 19 aa, Mycobacterium
IHPVWVVTGSRLHSIVGTE

SEQ ID NO: 826340 - protein, 18 aa, Mycobacterium
IHQAAMANTPLLLQEVLD

SEQ ID NO: 826341 - protein, 17 aa, Mycobacterium
IHQMLLADDFWDEIFRE

SEQ ID NO: 826342 - protein, 22 aa, Mycobacterium
IHQTREWILRNSPVPVGTVPIY

SEQ ID NO: 826343 - protein, 20 aa, Mycobacterium
IHRELVYSSPALALIKMSDD

SEQ ID NO: 826344 - protein, 19 aa, Mycobacterium
IHRGQAAGLTLQKVRQILA

SEQ ID NO: 826345 - protein, 20 aa, Mycobacterium
IHRGRRQQLWLITITDEAGK

SEQ ID NO: 826346 - protein, 27 aa, Mycobacterium
IHRHIHAAGFLHRPPRHHEFRGPAHRH

SEQ ID NO: 826347 - protein, 17 aa, Mycobacterium
IHRQIDAGHGSDGFPRI

SEQ ID NO: 826348 - protein, 21 aa, Mycobacterium
IHRRAARMAVLNRARIGELSP

SEQ ID NO: 826349 - protein, 28 aa, Mycobacterium
IHRSNLIGMGVIPLQFPAGESAASLKLD

SEQ ID NO: 826350 - protein, 28 aa, Mycobacterium
IHRVADVLPLTPLQEGLLFHATTMRGSD

SEQ ID NO: 826351 - protein, 30 aa, Mycobacterium
IHSATFPAIHFDTFGLLPQSNGTFGPVTLP

SEQ ID NO: 826352 - protein, 17 aa, Mycobacterium
IHSMRAKAIARLGFGYE

SEQ ID NO: 826353 - protein, 27 aa, Mycobacterium
IHTAALLGAAFPLKQAWHVNVLGTSRV

SEQ ID NO: 826354 - protein, 22 aa, Mycobacterium
IHTAHRKLLSRMFTPRKINALE

SEQ ID NO: 826355 - protein, 30 aa, Mycobacterium
IHTAVQYRLPITFLLFDNHAHAMCVTREQL

SEQ ID NO: 826356 - protein, 23 aa, Mycobacterium
IHTLRRNVNLTILLFNNRIYGLT

SEQ ID NO: 826357 - protein, 17 aa, Mycobacterium
IHVIIHSLNLWLDEVWG

SEQ ID NO: 826358 - protein, 28 aa, Mycobacterium
IHYARARGLPVLGLCLGLQCIVIEAARS

SEQ ID NO: 826359 - protein, 18 aa, Mycobacterium
IHYYMPVRITTAAGAGFD

SEQ ID NO: 826360 - protein, 18 aa, Mycobacterium
IIAAFPWEPEIEGVHSYV

SEQ ID NO: 826361 - protein, 18 aa, Mycobacterium
IIAASKWVHSELDYMPGT

SEQ ID NO: 826362 - protein, 19 aa, Mycobacterium
IIADPAWPGLVSAVNAADP

SEQ ID NO: 826363 - protein, 21 aa, Mycobacterium
IIAEDAGLGFRRSRSVVIVHI

SEQ ID NO: 826364 - protein, 32 aa, Mycobacterium
IIAEEAYQLGLYPVLTRLVAKKKLKDVWIEPS

SEQ ID NO: 826365 - protein, 28 aa, Mycobacterium
IIAELASMMPMRVIGMLLGIPESEQVSV

SEQ ID NO: 826366 - protein, 26 aa, Mycobacterium
IIAERAAHLYVFQRTPNYSVPAGNRP

SEQ ID NO: 826367 - protein, 17 aa, Mycobacterium
IIAGLIFSGVQPRWITP

SEQ ID NO: 826368 - protein, 17 aa, Mycobacterium
IIAGYRLSPQDATVAVM

SEQ ID NO: 826369 - protein, 22 aa, Mycobacterium
IIAHCETLVAFLQSIQRWFLTV

SEQ ID NO: 826370 - protein, 17 aa, Mycobacterium
IIAIAMTEPGAGSDLAG

SEQ ID NO: 826371 - protein, 26 aa, Mycobacterium
IIALPEFFTTGIAFDPALRDAALPPE

SEQ ID NO: 826372 - protein, 29 aa, Mycobacterium
IIANLASMMPMRVIGMLLGIPEGDQISVR

SEQ ID NO: 826373 - protein, 19 aa, Mycobacterium
IIANRLDPWHGNWFHPYSF

SEQ ID NO: 826374 - protein, 24 aa, Mycobacterium
IIANRLSYFLDLRGPSVAVDTACS

SEQ ID NO: 826375 - protein, 25 aa, Mycobacterium
IIANRLSYFLDVNGPSLVIDTACSS

SEQ ID NO: 826376 - protein, 31 aa, Mycobacterium
IIARYPQTRSALLPLLHLVQAQDGCLTPAGI

SEQ ID NO: 826377 - protein, 26 aa, Mycobacterium
IIAVNPLPEAGLLRFKDPQKVHGVVG

SEQ ID NO: 826378 - protein, 18 aa, Mycobacterium
IICASLVRQFEFAQNVWI

SEQ ID NO: 826379 - protein, 18 aa, Mycobacterium
IIDAFATRPWLTQLHVHS

SEQ ID NO: 826380 - protein, 17 aa, Mycobacterium
IIDAVGLELPLSPVCRP

SEQ ID NO: 826381 - protein, 17 aa, Mycobacterium
IIDAVLGIRKADIGIRD

SEQ ID NO: 826382 - protein, 17 aa, Mycobacterium
IIDRANARNHISFGFGV

SEQ ID NO: 826383 - protein, 24 aa, Mycobacterium
IIDRMESELLALVATRPPQNAISG

SEQ ID NO: 826384 - protein, 18 aa, Mycobacterium
IIDRRNNVLKLSQGEFVA

SEQ ID NO: 826385 - protein, 26 aa, Mycobacterium
IIDSALDGVLFLDEAYALVATGAKND

SEQ ID NO: 826386 - protein, 27 aa, Mycobacterium
IIDSGLTLSWLLRNLATRGPKSLRVCT

SEQ ID NO: 826387 - protein, 25 aa, Mycobacterium
IIDSGLTLSWLMRNLASRGPRSLNV

SEQ ID NO: 826388 - protein, 28 aa, Mycobacterium
IIDTTLQRIIGFWYQALRQRALRGDEDE

SEQ ID NO: 826389 - protein, 26 aa, Mycobacterium
IIDTVATTWRRLGLTVPLVVDPVAAS

SEQ ID NO: 826390 - protein, 19 aa, Mycobacterium
IIEAAAPYLDWIDGVAARS

SEQ ID NO: 826391 - protein, 18 aa, Mycobacterium
IIEALFHREFLRFGEMLE

SEQ ID NO: 826392 - protein, 19 aa, Mycobacterium
IIEDLKTKAKERGLWNLFL

SEQ ID NO: 826393 - protein, 33 aa, Mycobacterium
IIEDLTSRLWNLTPGLRFIEGLRRTVALFGARL

SEQ ID NO: 826394 - protein, 32 aa, Mycobacterium
IIEELKIKAKERGLWNLFLPAESGLTNLEYAP

SEQ ID NO: 826395 - protein, 24 aa, Mycobacterium
IIEEMLRFPLPVIAAVNGPAVGLG

SEQ ID NO: 826396 - protein, 24 aa, Mycobacterium
IIEFKVMIRPLQAINAIHEKMRAA

SEQ ID NO: 826397 - protein, 19 aa, Mycobacterium
IIEINRENWMLVTTTRDLV

SEQ ID NO: 826398 - protein, 31 aa, Mycobacterium
IIEKYGVTIYYIAPTLVRTFMKWGREIPFAH

SEQ ID NO: 826399 - protein, 24 aa, Mycobacterium
IIELMFAIWAAECVVVPINYKLHP

SEQ ID NO: 826400 - protein, 20 aa, Mycobacterium
IIELRARLQLPMPLQIVVAR

SEQ ID NO: 826401 - protein, 19 aa, Mycobacterium
IIEWISSVMTLLPGDLILT

SEQ ID NO: 826402 - protein, 18 aa, Mycobacterium
IIEWRALTVALLDEIAPL

SEQ ID NO: 826403 - protein, 17 aa, Mycobacterium
IIGAVLDRNGLRPSRIW

SEQ ID NO: 826404 - protein, 18 aa, Mycobacterium
IIGELLPDISVPYGVNVL

SEQ ID NO: 826405 - protein, 23 aa, Mycobacterium
IIGEPVNVFNWLNPPSGNEQSIV

SEQ ID NO: 826406 - protein, 24 aa, Mycobacterium
IIGFGGYVALPAYLAARGIPRGLG

SEQ ID NO: 826407 - protein, 30 aa, Mycobacterium
IIGFPSEGLPYRWPHPWLVDTKTAAEQIGL

SEQ ID NO: 826408 - protein, 18 aa, Mycobacterium
IIGLFTGALDALGIPWRR

SEQ ID NO: 826409 - protein, 23 aa, Mycobacterium
IIGPATHALLADYTTPMPPTSNS

SEQ ID NO: 826410 - protein, 24 aa, Mycobacterium
IIGPDHRYLMAISSLDPTSAGAAR

SEQ ID NO: 826411 - protein, 18 aa, Mycobacterium
IIGSPLVTAWTVGGMARA

SEQ ID NO: 826412 - protein, 30 aa, Mycobacterium
IIGYPPEGLPYRWPHPWLLDKKSAAQQQQR

SEQ ID NO: 826413 - protein, 25 aa, Mycobacterium
IIGYRALLRADLPPGGRLGIYGFGG

SEQ ID NO: 826414 - protein, 26 aa, Mycobacterium
IIGYRSLLRADLPPGGRLGLYGFGGS

SEQ ID NO: 826415 - protein, 26 aa, Mycobacterium
IIGYRSLLRAELPPGGRLGLYGFGGS

SEQ ID NO: 826416 - protein, 27 aa, Mycobacterium
IIGYRSLLRAELPPGGRLGLYGFGGSA

SEQ ID NO: 826417 - protein, 17 aa, Mycobacterium
IIHLHRFPAEVDAHYSV

SEQ ID NO: 826418 - protein, 17 aa, Mycobacterium
IIHLQLLGRRDGGTGVD

SEQ ID NO: 826419 - protein, 19 aa, Mycobacterium
IIHRRWYAGRTRELASAQP

SEQ ID NO: 826420 - protein, 17 aa, Mycobacterium
IIHYTQGLAYQLAAKGV

SEQ ID NO: 826421 - protein, 23 aa, Mycobacterium
IIIPSYLMVTVQITGYAADPEAD

SEQ ID NO: 826422 - protein, 18 aa, Mycobacterium
IIITATGLNLKFFSGVIP

SEQ ID NO: 826423 - protein, 26 aa, Mycobacterium
IIKDFGAIMPMRVISALLGIPEEDQE

SEQ ID NO: 826424 - protein, 21 aa, Mycobacterium
IIKGIGRRDFVRAVAAMGAGV

SEQ ID NO: 826425 - protein, 18 aa, Mycobacterium
IIKLALTTKIKPITYLST

SEQ ID NO: 826426 - protein, 18 aa, Mycobacterium
IIKVVDLAWLEFEKPDLV

SEQ ID NO: 826427 - protein, 17 aa, Mycobacterium
IILLFQDGVEPQINTDT

SEQ ID NO: 826428 - protein, 18 aa, Mycobacterium
IIMANLEANDHLPEGPTL

SEQ ID NO: 826429 - protein, 19 aa, Mycobacterium
IIMMSQALRRSGRIRLPVP

SEQ ID NO: 826430 - protein, 18 aa, Mycobacterium
IINTTWSAEGWVAVAGRV

SEQ ID NO: 826431 - protein, 19 aa, Mycobacterium
IINYGPLKTFDLTKWQHIL

SEQ ID NO: 826432 - protein, 18 aa, Mycobacterium
IIPGPSSLWLDAAGNRLP

SEQ ID NO: 826433 - protein, 19 aa, Mycobacterium
IIQPLIQAMAFGLPAQDMA

SEQ ID NO: 826434 - protein, 18 aa, Mycobacterium
IIQPLIQAMSFGLTAPEM

SEQ ID NO: 826435 - protein, 17 aa, Mycobacterium
IIQQEFPRTAILVLSAH

SEQ ID NO: 826436 - protein, 25 aa, Mycobacterium
IIRDMLGLPYERPAAYTRDYLQVLG

SEQ ID NO: 826437 - protein, 17 aa, Mycobacterium
IIRLDHPGVLVIEGGPG

SEQ ID NO: 826438 - protein, 30 aa, Mycobacterium
IIRNSEFVIARMYRKFLSDGRASIRLVAFT

SEQ ID NO: 826439 - protein, 21 aa, Mycobacterium
IIRRLLDVKPRFGHRATLEHY

SEQ ID NO: 826440 - protein, 19 aa, Mycobacterium
IISEPTDLVAVRTALQDAG

SEQ ID NO: 826441 - protein, 20 aa, Mycobacterium
IISFNAPIGPTLHYQVRAHW

SEQ ID NO: 826442 - protein, 17 aa, Mycobacterium
IISFQKVRDDLVRRQTD

SEQ ID NO: 826443 - protein, 29 aa, Mycobacterium
IITDSSLIPLLAPVLPLVDSVHTVIVVGD

SEQ ID NO: 826444 - protein, 30 aa, Mycobacterium
IITEAWMRLQDRPRWQLTASVAFDEWAAAV

SEQ ID NO: 826445 - protein, 25 aa, Mycobacterium
IITEAWMRLQDRPRWQLTASVEFDD

SEQ ID NO: 826446 - protein, 19 aa, Mycobacterium
IITGGLGGLGLFFASKMAA

SEQ ID NO: 826447 - protein, 19 aa, Mycobacterium
IITGGLGGLGLFLAEKMAD

SEQ ID NO: 826448 - protein, 19 aa, Mycobacterium
IITGGLGGLGLFLAEKMAT

SEQ ID NO: 826449 - protein, 18 aa, Mycobacterium
IITMFYENSTRTRVSFEV

SEQ ID NO: 826450 - protein, 19 aa, Mycobacterium
IITPLGPVLALHVGAGAVA

SEQ ID NO: 826451 - protein, 19 aa, Mycobacterium
IITQFVPNSPLCQHLGITL

SEQ ID NO: 826452 - protein, 27 aa, Mycobacterium
IIVQRERDRMAFRSAGYWDLGAELDAG

SEQ ID NO: 826453 - protein, 24 aa, Mycobacterium
IIVQRERERMAFRSAGYWDVTAEL

SEQ ID NO: 826454 - protein, 19 aa, Mycobacterium
IIVVAAAPRRNPALRSLFQ

SEQ ID NO: 826455 - protein, 18 aa, Mycobacterium
IIVYRRLEFSLDEIASLL

SEQ ID NO: 826456 - protein, 20 aa, Mycobacterium
IIYVIPDYYEKYPKPCMAGW

SEQ ID NO: 826457 - protein, 25 aa, Mycobacterium
IKAAADLGPRRGLTGEPIAPVLAGA

SEQ ID NO: 826458 - protein, 20 aa, Mycobacterium
IKAAPRRLKLAVAEAAGTIA

SEQ ID NO: 826459 - protein, 25 aa, Mycobacterium
IKAARRLVAMLARRGYGQSMAYDVV

SEQ ID NO: 826460 - protein, 24 aa, Mycobacterium
IKAGDKVVLWYYSGNRDEDVFDDP

SEQ ID NO: 826461 - protein, 22 aa, Mycobacterium
IKANPYAIRAMGPVASLVNKLG

SEQ ID NO: 826462 - protein, 34 aa, Mycobacterium
IKAVLTLQHGAIAPNLHFQKWNPSINATGTRLFV

SEQ ID NO: 826463 - protein, 27 aa, Mycobacterium
IKDAQTPTLLFPFAAPRVAGDLSEAGS

SEQ ID NO: 826464 - protein, 26 aa, Mycobacterium
IKDAQTPTLLFPFAAPRVVGDLSEAG

SEQ ID NO: 826465 - protein, 17 aa, Mycobacterium
IKDGILGLVTRPEQRFV

SEQ ID NO: 826466 - protein, 22 aa, Mycobacterium
IKDLLGREMLDQRFAGMKEALQ

SEQ ID NO: 826467 - protein, 17 aa, Mycobacterium
IKEAFDPAGLLNPGVML

SEQ ID NO: 826468 - protein, 26 aa, Mycobacterium
IKEAGWWRLMLAEEIGGMAAPPPLAW

SEQ ID NO: 826469 - protein, 20 aa, Mycobacterium
IKEIPLFTGPGTLGLPILTI

SEQ ID NO: 826470 - protein, 27 aa, Mycobacterium
IKELCRRWYPRIYFGQPDKGLAHRALA

SEQ ID NO: 826471 - protein, 20 aa, Mycobacterium
IKERGITLIGFSVSNFDPCG

SEQ ID NO: 826472 - protein, 21 aa, Mycobacterium
IKERLPVWKHQFFGDGSEEWV

SEQ ID NO: 826473 - protein, 18 aa, Mycobacterium
IKERSLIRHLGVLEVPRL

SEQ ID NO: 826474 - protein, 23 aa, Mycobacterium
IKESIRELRYYRRAAFVPDPGPS

SEQ ID NO: 826475 - protein, 18 aa, Mycobacterium
IKESLRLVAPVPLVMRKT

SEQ ID NO: 826476 - protein, 24 aa, Mycobacterium
IKESMRLVAPVPLVMRKTVEDTAI

SEQ ID NO: 826477 - protein, 24 aa, Mycobacterium
IKESMRLVAPVPLVMRKTVQDTAI

SEQ ID NO: 826478 - protein, 18 aa, Mycobacterium
IKFKIRFLRVNQRHHSVA

SEQ ID NO: 826479 - protein, 21 aa, Mycobacterium
IKGAIRKLTITSEAYPVLCGS

SEQ ID NO: 826480 - protein, 24 aa, Mycobacterium
IKGELNIAKLLGKRARVIGTTLRA

SEQ ID NO: 826481 - protein, 17 aa, Mycobacterium
IKGSPLHTPYTASKAGV

SEQ ID NO: 826482 - protein, 18 aa, Mycobacterium
IKGTPLHTPYTAAKHGIV

SEQ ID NO: 826483 - protein, 17 aa, Mycobacterium
IKHRLASVIFSLEMSKS

SEQ ID NO: 826484 - protein, 25 aa, Mycobacterium
IKHVELEFITNWWTTGEQRRESDAM

SEQ ID NO: 826485 - protein, 25 aa, Mycobacterium
IKIDGQWHEVSWDAAFRRCTELLAP

SEQ ID NO: 826486 - protein, 28 aa, Mycobacterium
IKIPAALDPLGILPDSVRILPDGTLPNV

SEQ ID NO: 826487 - protein, 17 aa, Mycobacterium
IKKIEVHYRPRAVVGII

SEQ ID NO: 826488 - protein, 27 aa, Mycobacterium
IKLDRPAYVYPIFEQALRIANGESIED

SEQ ID NO: 826489 - protein, 26 aa, Mycobacterium
IKLDRPAYVYPLFEQALRIANGESMA

SEQ ID NO: 826490 - protein, 19 aa, Mycobacterium
IKLGPSFKFQFTPLKKTGG

SEQ ID NO: 826491 - protein, 18 aa, Mycobacterium
IKLMGIDSVLALYSSLDD

SEQ ID NO: 826492 - protein, 35 aa, Mycobacterium
IKLPDNLMVFVAPNRPILGLEFFSSAPFRHGDHVA

SEQ ID NO: 826493 - protein, 33 aa, Mycobacterium; identical to SEQ ID NO: 115340

SEQ ID NO: 826494 - protein, 26 aa, Mycobacterium
IKMIQAMRHGVLPKTLHVNAPTPQVD

SEQ ID NO: 826495 - protein, 17 aa, Mycobacterium
IKMVLAMRHATLPATLH

SEQ ID NO: 826496 - protein, 18 aa, Mycobacterium
IKNALNYYTLIGATKANA

SEQ ID NO: 826497 - protein, 24 aa, Mycobacterium
IKNQVHAILARNLAPTPPVSDLFG

SEQ ID NO: 826498 - protein, 25 aa, Mycobacterium
IKPGNNLPLRNIPAGTLIHAVELRP

SEQ ID NO: 826499 - protein, 22 aa, Mycobacterium
IKPGNNLPLRNIPTGTTVHAVE

SEQ ID NO: 826500 - protein, 17 aa, Mycobacterium
IKPGWGFNFDYQPGQYI

SEQ ID NO: 826501 - protein, 17 aa, Mycobacterium
IKPLPPRLCQALWMGPC

SEQ ID NO: 826502 - protein, 17 aa, Mycobacterium
IKQGWRTVPASLKWHDT

SEQ ID NO: 826503 - protein, 23 aa, Mycobacterium
IKQHLLYEFLTERSRTCLLYSEP

SEQ ID NO: 826504 - protein, 31 aa, Mycobacterium
IKQNELTLMGWLPLRFTWLDLTEYPQRVIAE

SEQ ID NO: 826505 - protein, 22 aa, Mycobacterium
IKQRFLPPTASLDIWWCQGFSE

SEQ ID NO: 826506 - protein, 18 aa, Mycobacterium
IKQRWDDFVVDGLGIRCV

SEQ ID NO: 826507 - protein, 20 aa, Mycobacterium
IKQVKYRYLRALDTKHWDDF

SEQ ID NO: 826508 - protein, 17 aa, Mycobacterium
IKRALGDGRYRVMQKAI

SEQ ID NO: 826509 - protein, 21 aa, Mycobacterium
IKRFVIVGTPWEPGGDELTPT

SEQ ID NO: 826510 - protein, 31 aa, Mycobacterium
IKRPDYSITGWVILTLIQHGTAWQIERFVEK

SEQ ID NO: 826511 - protein, 24 aa, Mycobacterium
IKSIGLRLGVPWYAYDTVTFAGEV

SEQ ID NO: 826512 - protein, 26 aa, Mycobacterium
IKSIGLRLGVPWYAYDTVTFRGEVTA

SEQ ID NO: 826513 - protein, 18 aa, Mycobacterium
IKSLFAETLAASGKEREK

SEQ ID NO: 826514 - protein, 23 aa, Mycobacterium
IKTFRARIRMAAKRRELGLKTPG

SEQ ID NO: 826515 - protein, 19 aa, Mycobacterium
IKTFVMFAAEHPDLIRIMD

SEQ ID NO: 826516 - protein, 21 aa, Mycobacterium
IKTNMLNPCPMLTLGGLVVDE

SEQ ID NO: 826517 - protein, 18 aa, Mycobacterium
IKVDFEALYHGDVLVEGE

SEQ ID NO: 826518 - protein, 18 aa, Mycobacterium
IKVHPLALLHPDKVDDAE

SEQ ID NO: 826519 - protein, 18 aa, Mycobacterium
IKVHPLALLHPDKVDDPE

SEQ ID NO: 826520 - protein, 24 aa, Mycobacterium
IKVKGFRNVIHWRVTRYDEPKEIE

SEQ ID NO: 826521 - protein, 18 aa, Mycobacterium
IKVLRKRGRILQSAPDVA

SEQ ID NO: 826522 - protein, 17 aa, Mycobacterium
IKVPLAIAALRHDRSRA

SEQ ID NO: 826523 - protein, 27 aa, Mycobacterium
IKVRVIRRWGPARIGYLLSIHPSTVHR

SEQ ID NO: 826524 - protein, 25 aa, Mycobacterium
IKVRVLRRWGPARIGYMLGVHPSTV

SEQ ID NO: 826525 - protein, 20 aa, Mycobacterium
IKVTIPDRPGGLSRLLAVVS

SEQ ID NO: 826526 - protein, 17 aa, Mycobacterium
IKVTVLEPGGMRTDWAG

SEQ ID NO: 826527 - protein, 23 aa, Mycobacterium
IKVVPEPLRYRLVRMIRAAADER

SEQ ID NO: 826528 - protein, 19 aa, Mycobacterium
IKWMSKLNTWAYKATGGRL

SEQ ID NO: 826529 - protein, 18 aa, Mycobacterium
IKYKNLRLMTSAWSPKRL

SEQ ID NO: 826530 - protein, 18 aa, Mycobacterium
ILAAARQLVASAAPVIAQ

SEQ ID NO: 826531 - protein, 27 aa, Mycobacterium
ILAAKRTSDLIPLCHQLALTGVDVDFT

SEQ ID NO: 826532 - protein, 17 aa, Mycobacterium
ILAARGVPAASLHPALD

SEQ ID NO: 826533 - protein, 17 aa, Mycobacterium
ILAARPLSSLMAVKHTI

SEQ ID NO: 826534 - protein, 21 aa, Mycobacterium
ILAAVKRLYLLGKNDRPTGTF

SEQ ID NO: 826535 - protein, 17 aa, Mycobacterium
ILACCVLGLAGCANTVD

SEQ ID NO: 826536 - protein, 17 aa, Mycobacterium
ILADVLGTPLIPVIGHP

SEQ ID NO: 826537 - protein, 22 aa, Mycobacterium
ILADYDTWLAERRIEMARTVLI

SEQ ID NO: 826538 - protein, 18 aa, Mycobacterium
ILAEFNHPLVIQAETMDA

SEQ ID NO: 826539 - protein, 18 aa, Mycobacterium
ILAEHPNYLPSIAPMPLS

SEQ ID NO: 826540 - protein, 17 aa, Mycobacterium
ILAFTFHHIAFDGWSMA

SEQ ID NO: 826541 - protein, 24 aa, Mycobacterium
ILAGDYLFATASRLVSLLGPEAVR

SEQ ID NO: 826542 - protein, 25 aa, Mycobacterium
ILAGEKVVMFYPSGNWDTDAFDHPE

SEQ ID NO: 826543 - protein, 19 aa, Mycobacterium
ILAGFCDVALVVGADTTPK

SEQ ID NO: 826544 - protein, 17 aa, Mycobacterium
ILAGIIHIIIDRQWHDP

SEQ ID NO: 826545 - protein, 19 aa, Mycobacterium
ILAGQLRMARTLLDSSEQA

SEQ ID NO: 826546 - protein, 19 aa, Mycobacterium
ILAGVPRLADWGGVAANLR

SEQ ID NO: 826547 - protein, 24 aa, Mycobacterium
ILAGYQQLRPMRPGWRGRIGLHQL

SEQ ID NO: 826548 - protein, 38 aa, Mycobacterium
ILAHLRNIVRDLFPSLRFALTFSYARFLRRGRKAPGFF

SEQ ID NO: 826549 - protein, 20 aa, Mycobacterium
ILAHPHRIAVGPLSRPRRSA

SEQ ID NO: 826550 - protein, 17 aa, Mycobacterium
ILAIVPMFHANAWGLIY

SEQ ID NO: 826551 - protein, 17 aa, Mycobacterium
ILAKDFAKPEIVADAVL

SEQ ID NO: 826552 - protein, 18 aa, Mycobacterium
ILAKKFRPGLPMLAMPER

SEQ ID NO: 826553 - protein, 20 aa, Mycobacterium
ILALAFSGKRFAYEGEIFTV

SEQ ID NO: 826554 - protein, 19 aa, Mycobacterium
ILALPVVDGIFIGPSDLSL

SEQ ID NO: 826555 - protein, 17 aa, Mycobacterium
ILALRFANGLIEPAWNR

SEQ ID NO: 826556 - protein, 22 aa, Mycobacterium
ILAMEALVRWQHPTRGLLSPES

SEQ ID NO: 826557 - protein, 24 aa, Mycobacterium
ILAPEWRIVLLERSDALATESSGP

SEQ ID NO: 826558 - protein, 22 aa, Mycobacterium
ILAPQGIDYVAGFYAAIKAGTI

SEQ ID NO: 826559 - protein, 25 aa, Mycobacterium
ILAPQGIDYVAGFYAAIKAGTIAVP

SEQ ID NO: 826560 - protein, 40 aa, Mycobacterium
ILAPQGLEYIVAFLGALQAGLIAVPLPVPQFGIHDERISA

SEQ ID NO: 826561 - protein, 30 aa, Mycobacterium
ILAPQGLEYVIAFLGALQAGFIAVPLSTPQ

SEQ ID NO: 826562 - protein, 18 aa, Mycobacterium
ILARFRAVPAQDVTLPFI

SEQ ID NO: 826563 - protein, 29 aa, Mycobacterium
ILARLDTRRPARFFGLIKAGAGQAGRDWK

SEQ ID NO: 826564 - protein, 18 aa, Mycobacterium
ILARRGMVPLFVGNKPIA

SEQ ID NO: 826565 - protein, 17 aa, Mycobacterium
ILAVIAKIGTGGGQGHV

SEQ ID NO: 826566 - protein, 20 aa, Mycobacterium
ILAVIRQIFAPQIVGLTLTE

SEQ ID NO: 826567 - protein, 18 aa, Mycobacterium
ILAVLAMLQLVDAGYQCA

SEQ ID NO: 826568 - protein, 17 aa, Mycobacterium
ILAVLKTGAAYLPIDPA

SEQ ID NO: 826569 - protein, 17 aa, Mycobacterium
ILAVQGWAQHHELQLRA

SEQ ID NO: 826570 - protein, 19 aa, Mycobacterium
ILAVRRLLARLPEHAGIGV

SEQ ID NO: 826571 - protein, 18 aa, Mycobacterium
ILDAIDPAMRAAAAMASG

SEQ ID NO: 826572 - protein, 24 aa, Mycobacterium
ILDALMVFFDLWVSAGMTPRVDPL

SEQ ID NO: 826573 - protein, 17 aa, Mycobacterium
ILDAVLGRLAPKARVVL

SEQ ID NO: 826574 - protein, 18 aa, Mycobacterium
ILDDADLDWAIDASIFGS

SEQ ID NO: 826575 - protein, 25 aa, Mycobacterium
ILDDGNPPFYRWFPDAELNTCANAL

SEQ ID NO: 826576 - protein, 25 aa, Mycobacterium
ILDDSNPPFYRWFPDAELNTCANAL

SEQ ID NO: 826577 - protein, 24 aa, Mycobacterium
ILDEALVCHLGYLSAGRPVVLPTT

SEQ ID NO: 826578 - protein, 27 aa, Mycobacterium
ILDEGYSPPERPYAPGAFGPSETLDQL

SEQ ID NO: 826579 - protein, 18 aa, Mycobacterium
ILDGAFPPGSALPPEREL

SEQ ID NO: 826580 - protein, 36 aa, Mycobacterium
ILDGAMHHGLPQRWIEFLRRWDPMHWPQQTRSATSP

SEQ ID NO: 826581 - protein, 22 aa, Mycobacterium
ILDGGVPMLLIRGQMSDLVSQE

SEQ ID NO: 826582 - protein, 17 aa, Mycobacterium
ILDGVRLPKGSTAELRS

SEQ ID NO: 826583 - protein, 28 aa, Mycobacterium
ILDIQKEGPFFLLGWSFGGVVAHAIAAE

SEQ ID NO: 826584 - protein, 26 aa, Mycobacterium
ILDLTLCVAVFLGLGRSLTVLGVDQS

SEQ ID NO: 826585 - protein, 17 aa, Mycobacterium
ILDLVLPSAVGEITGDS

SEQ ID NO: 826586 - protein, 18 aa, Mycobacterium
ILDPFGLENMRYKWRKWL

SEQ ID NO: 826587 - protein, 19 aa, Mycobacterium
ILDPGRPFFEFLTDLLDVW

SEQ ID NO: 826588 - protein, 17 aa, Mycobacterium
ILDPLGFRWTNYGVAPE

SEQ ID NO: 826589 - protein, 17 aa, Mycobacterium
ILDPSLPLTVTEWDEWG

SEQ ID NO: 826590 - protein, 18 aa, Mycobacterium
ILDPSLPLTVTEWDEWGN

SEQ ID NO: 826591 - protein, 18 aa, Mycobacterium
ILDQLDTINLTRGLLDAA

SEQ ID NO: 826592 - protein, 18 aa, Mycobacterium
ILDRALGDRLGRLAFGGA

SEQ ID NO: 826593 - protein, 26 aa, Mycobacterium
ILDRHPELKIGWFEGGIAWVPTALQD

SEQ ID NO: 826594 - protein, 19 aa, Mycobacterium
ILDRHPGLRVGWFEGGIAW

SEQ ID NO: 826595 - protein, 24 aa, Mycobacterium
ILDRHPGLRVGWFEGGIAWVPTAL

SEQ ID NO: 826596 - protein, 25 aa, Mycobacterium
ILDRHPSLKIGWFEGGIAWVPTALQ

SEQ ID NO: 826597 - protein, 25 aa, Mycobacterium
ILDRIPPWIVSHPYNDLLGDGLPEC

SEQ ID NO: 826598 - protein, 22 aa, Mycobacterium
ILDRPIVLFTTVGAQSGKKRYV

SEQ ID NO: 826599 - protein, 24 aa, Mycobacterium
ILDSALFHIFDDADRQTYVASLHA

SEQ ID NO: 826600 - protein, 19 aa, Mycobacterium
ILDSLDLLRRGGTACLAGW

SEQ ID NO: 826601 - protein, 17 aa, Mycobacterium
ILDVERVRWVGGYGRMD

SEQ ID NO: 826602 - protein, 22 aa, Mycobacterium
ILDVIADFEAMPGWSSPHQSAE

SEQ ID NO: 826603 - protein, 24 aa, Mycobacterium
ILDVLDNYAFVRTSGYLAGPNDVY

SEQ ID NO: 826604 - protein, 21 aa, Mycobacterium
ILDVMMPGMDGFGVLRRLRAD

SEQ ID NO: 826605 - protein, 19 aa, Mycobacterium
ILEAHRLLMAPDPYADRPG

SEQ ID NO: 826606 - protein, 17 aa, Mycobacterium
ILEAITYALYNATTWEQ

SEQ ID NO: 826607 - protein, 24 aa, Mycobacterium
ILEAVAVCRPAGVPVIADGGLQYS

SEQ ID NO: 826608 - protein, 17 aa, Mycobacterium
ILEIPMPPLRDAAHRSG

SEQ ID NO: 826609 - protein, 25 aa, Mycobacterium
ILELDTLPEHLVIVGGSYIALEFAQ

SEQ ID NO: 826610 - protein, 26 aa, Mycobacterium
ILELDTLPQHLVIVGGSYIALEFAQM

SEQ ID NO: 826611 - protein, 26 aa, Mycobacterium
ILELDTLPSHLVILGGSYIALEFAQM

SEQ ID NO: 826612 - protein, 17 aa, Mycobacterium
ILELYKLGQLNLDDMVT

SEQ ID NO: 826613 - protein, 25 aa, Mycobacterium
ILENPGLLRFLPQLSERLRGEEPLL

SEQ ID NO: 826614 - protein, 33 aa, Mycobacterium
ILEPFGLENMRYKWRKWLYFDCNWKVAMEAFNE

SEQ ID NO: 826615 - protein, 17 aa, Mycobacterium
ILEPLKFRWTNYGVRPE

SEQ ID NO: 826616 - protein, 23 aa, Mycobacterium
ILEQAVGLFIDRGFHSVKLEDIA

SEQ ID NO: 826617 - protein, 17 aa, Mycobacterium
ILEQRGVVFFRGLQISD

SEQ ID NO: 826618 - protein, 35 aa, Mycobacterium
ILERLHVVALPMRVRFRGITVRELALIDGPAGWGE

SEQ ID NO: 826619 - protein, 42 aa, Mycobacterium
ILERSLVHLGLKHYFLVDFPQEPGALRRFLGEVLGPNDDITL

SEQ ID NO: 826620 - protein, 18 aa, Mycobacterium
ILESLESLGPIFAELRGA

SEQ ID NO: 826621 - protein, 34 aa, Mycobacterium
ILESPGLLRFLPELARRLLGEEPLLPTAAVYWGG

SEQ ID NO: 826622 - protein, 25 aa, Mycobacterium
ILESPGLMRFLPGLAERLLGEEPML

SEQ ID NO: 826623 - protein, 24 aa, Mycobacterium
ILEVAMYGFVPSAGAVLAEWGADV

SEQ ID NO: 826624 - protein, 26 aa, Mycobacterium
ILEVDAPALVIPERIRFLRATGGDSE

SEQ ID NO: 826625 - protein, 18 aa, Mycobacterium
ILEVPRPDLDRMSTNGLH

SEQ ID NO: 826626 - protein, 17 aa, Mycobacterium
ILEVSRSGLRRAGDAAG

SEQ ID NO: 826627 - protein, 17 aa, Mycobacterium
ILEYHWGPDWVVYDARG

SEQ ID NO: 826628 - protein, 17 aa, Mycobacterium
ILEYIDNVTMAALVHTQ

SEQ ID NO: 826629 - protein, 18 aa, Mycobacterium
ILEYIDNVTMAALVHTQN

SEQ ID NO: 826630 - protein, 18 aa, Mycobacterium
ILFDIYRQAAEGTLAAVH

SEQ ID NO: 826631 - protein, 18 aa, Mycobacterium
ILFKPRWSAFYRTELEQH

SEQ ID NO: 826632 - protein, 20 aa, Mycobacterium
ILFLHSMFGKAVAAWISRRI

SEQ ID NO: 826633 - protein, 27 aa, Mycobacterium
ILFLRAEFLAERFLRVLSAPAVRRGCG

SEQ ID NO: 826634 - protein, 18 aa, Mycobacterium
ILFLRMMERVKSGAKLIV

SEQ ID NO: 826635 - protein, 20 aa, Mycobacterium
ILFRASFAQQRMWFLSRLEP

SEQ ID NO: 826636 - protein, 17 aa, Mycobacterium
ILFRPCAQKAPSFAIRG

SEQ ID NO: 826637 - protein, 17 aa, Mycobacterium
ILFSHVCQKSGLDPFRR

SEQ ID NO: 826638 - protein, 17 aa, Mycobacterium
ILFTQELSRRLDGTGVT

SEQ ID NO: 826639 - protein, 20 aa, Mycobacterium
ILGAAAWTGHEGRDAKFMWP

SEQ ID NO: 826640 - protein, 18 aa, Mycobacterium
ILGACNPTLAHRALGIHR

SEQ ID NO: 826641 - protein, 17 aa, Mycobacterium
ILGAILFEDTMDRQIEG

SEQ ID NO: 826642 - protein, 25 aa, Mycobacterium
ILGDAHLLAAHRLELPWGFAVPERS

SEQ ID NO: 826643 - protein, 19 aa, Mycobacterium
ILGFGRPPEYQAFAAQPGM

SEQ ID NO: 826644 - protein, 17 aa, Mycobacterium
ILGFVVPTDTPGFVGRE

SEQ ID NO: 826645 - protein, 18 aa, Mycobacterium
ILGGVLQVGSIRAAGEFG

SEQ ID NO: 826646 - protein, 18 aa, Mycobacterium
ILGGWQTDFARNLTKEGR

SEQ ID NO: 826647 - protein, 17 aa, Mycobacterium
ILGHAPQLDPESFVAPN

SEQ ID NO: 826648 - protein, 18 aa, Mycobacterium
ILGIFVDGKRVPVVAHGS

SEQ ID NO: 826649 - protein, 19 aa, Mycobacterium
ILGIRMTKFGKHPDLDTVD

SEQ ID NO: 826650 - protein, 17 aa, Mycobacterium
ILGLARLLGPRALRLPL

SEQ ID NO: 826651 - protein, 18 aa, Mycobacterium
ILGLDIKGHIVKKILVAE

SEQ ID NO: 826652 - protein, 20 aa, Mycobacterium
ILGLDIKGHVVKKLLVAEAS

SEQ ID NO: 826653 - protein, 23 aa, Mycobacterium
ILGLFNSTWGQYPAAVSWPSVSG

SEQ ID NO: 826654 - protein, 18 aa, Mycobacterium
ILGLLRLYRDTRCGDVLA

SEQ ID NO: 826655 - protein, 30 aa, Mycobacterium
ILGLPANPVWWTWLGNDYLPLVRDYLPPEH

SEQ ID NO: 826656 - protein, 20 aa, Mycobacterium
ILGQRLLYTVPDARGLVYNE

SEQ ID NO: 826657 - protein, 30 aa, Mycobacterium
ILGTARLLSFPIDYASVTRLLFSRTGQATV

SEQ ID NO: 826658 - protein, 28 aa, Mycobacterium
ILGTARLLSFPVDYASVTRLLFSRSGQA

SEQ ID NO: 826659 - protein, 28 aa, Mycobacterium
ILGTEALIRWQHPTLGLLMPDSFIQVVE

SEQ ID NO: 826660 - protein, 28 aa, Mycobacterium
ILGVLTPIFAGFPVVLADPLSFVKRPDL

SEQ ID NO: 826661 - protein, 34 aa, Mycobacterium
ILGVVAQGWFLQQGYLMRPIISTLVFGRDPRPYD

SEQ ID NO: 826662 - protein, 17 aa, Mycobacterium
ILHLLAAAREAELDYTL

SEQ ID NO: 826663 - protein, 21 aa, Mycobacterium
ILHPFFSPQTLAALLPSLQAQ

SEQ ID NO: 826664 - protein, 24 aa, Mycobacterium
ILHYAREDLKRQWLPKMASGELIG

SEQ ID NO: 826665 - protein, 17 aa, Mycobacterium
ILIDFTIANRRLIRYLA

SEQ ID NO: 826666 - protein, 17 aa, Mycobacterium
ILINCHYPIDANSFVLQ

SEQ ID NO: 826667 - protein, 19 aa, Mycobacterium
ILIPLGELINMIPFPSFFA

SEQ ID NO: 826668 - protein, 33 aa, Mycobacterium
ILIPLGELINMIPFPSFLADDFTILDGLLAFYA

SEQ ID NO: 826669 - protein, 18 aa, Mycobacterium
ILITTPESLYLMLTSAAR

SEQ ID NO: 826670 - protein, 21 aa, Mycobacterium
ILKAILDRTPWRAEEPVVIVA

SEQ ID NO: 826671 - protein, 30 aa, Mycobacterium
ILKEYASRGTWIWPPEPSLRLIADTIEFCA

SEQ ID NO: 826672 - protein, 29 aa, Mycobacterium
ILKEYASRGTWIWPPGPSLRLIADTIEFC

SEQ ID NO: 826673 - protein, 18 aa, Mycobacterium
ILKFMPNYMFNPAEYPPI

SEQ ID NO: 826674 - protein, 18 aa, Mycobacterium
ILKGWFDRVLTNEFAYGD

SEQ ID NO: 826675 - protein, 17 aa, Mycobacterium
ILKGWIDRVFVKGFAYG

SEQ ID NO: 826676 - protein, 20 aa, Mycobacterium
ILKHVGVLMQTIYLAATAMG

SEQ ID NO: 826677 - protein, 17 aa, Mycobacterium
ILKIAPVQHIPKFMLQL

SEQ ID NO: 826678 - protein, 18 aa, Mycobacterium
ILKKLMGRNPAFQSALDP

SEQ ID NO: 826679 - protein, 21 aa, Mycobacterium
ILKLLGSVTLQRVWDLAAVAA

SEQ ID NO: 826680 - protein, 21 aa, Mycobacterium
ILKLLGSVTLQRVWDLSAAAA

SEQ ID NO: 826681 - protein, 17 aa, Mycobacterium
ILKPNFLLDLDAQLRAS

SEQ ID NO: 826682 - protein, 18 aa, Mycobacterium
ILKPVVPDPGIPLQLVHH

SEQ ID NO: 826683 - protein, 24 aa, Mycobacterium
ILKTKPPLCIDVEAADFYVDTLDR

SEQ ID NO: 826684 - protein, 20 aa, Mycobacterium
ILLAAPLGRMISPLSLPPPV

SEQ ID NO: 826685 - protein, 20 aa, Mycobacterium
ILLDVPGNPTMRVLRTGLAA

SEQ ID NO: 826686 - protein, 17 aa, Mycobacterium
ILLGREPRRWGRIDYRT

SEQ ID NO: 826687 - protein, 19 aa, Mycobacterium
ILLGSFIERGLLDELCLTI

SEQ ID NO: 826688 - protein, 17 aa, Mycobacterium
ILLGSGVLQVGVRSPVM

SEQ ID NO: 826689 - protein, 18 aa, Mycobacterium
ILLLLHGDARITNNALAQ

SEQ ID NO: 826690 - protein, 20 aa, Mycobacterium
ILLNYLGRTDLVPSGAIVAD

SEQ ID NO: 826691 - protein, 18 aa, Mycobacterium
ILLQEIFASYFGERLPAP

SEQ ID NO: 826692 - protein, 18 aa, Mycobacterium
ILLRIFDDGDFLDVAAQA

SEQ ID NO: 826693 - protein, 18 aa, Mycobacterium
ILLRIFDDGDFLDVAAQH

SEQ ID NO: 826694 - protein, 20 aa, Mycobacterium
ILLRVALGIIVFPTDRLDTS

SEQ ID NO: 826695 - protein, 19 aa, Mycobacterium
ILLRVAVGIIMFPTDRLDT

SEQ ID NO: 826696 - protein, 19 aa, Mycobacterium
ILLRVAVGIIMFPTERLDT

SEQ ID NO: 826697 - protein, 17 aa, Mycobacterium
ILLSALAEASSSRAGLG

SEQ ID NO: 826698 - protein, 20 aa, Mycobacterium
ILLSGLAVRLTIPGAAPADT

SEQ ID NO: 826699 - protein, 17 aa, Mycobacterium
ILLVPMTIESFDNGVLT

SEQ ID NO: 826700 - protein, 31 aa, Mycobacterium; identical to SEQ ID NO: 127950

SEQ ID NO: 826701 - protein, 18 aa, Mycobacterium
ILNAYRLVASSEGVFVEP

SEQ ID NO: 826702 - protein, 20 aa, Mycobacterium
ILNDFPLFWDTGLLEHNIHL

SEQ ID NO: 826703 - protein, 30 aa, Mycobacterium
ILNNALYMDRYPLVSAISRPLIVKHLVAAA

SEQ ID NO: 826704 - protein, 30 aa, Mycobacterium
ILNNALYMDRYPLVSAISRPLIVKHLVEAA

SEQ ID NO: 826705 - protein, 18 aa, Mycobacterium
ILNTGRLQHQWHTMTKTG

SEQ ID NO: 826706 - protein, 20 aa, Mycobacterium
ILNTIRQFETTNGALRFPEL

SEQ ID NO: 826707 - protein, 18 aa, Mycobacterium
ILPAINTGFGNTGAWNVG

SEQ ID NO: 826708 - protein, 18 aa, Mycobacterium
ILPGMQQLIRHIGDDERR

SEQ ID NO: 826709 - protein, 25 aa, Mycobacterium
ILPGNPRVLSIAQFWHRAAANELIS

SEQ ID NO: 826710 - protein, 25 aa, Mycobacterium
ILPGQSLLVYEMTPALFAAVAANEA

SEQ ID NO: 826711 - protein, 17 aa, Mycobacterium
ILPGSLYHHFESKEAIL

SEQ ID NO: 826712 - protein, 20 aa, Mycobacterium
ILPGSLYHHFESKEAILIEL

SEQ ID NO: 826713 - protein, 18 aa, Mycobacterium
ILPHEQVRWLNEAGFGTL

SEQ ID NO: 826714 - protein, 18 aa, Mycobacterium
ILPHHIPLVAQLVDDAAV

SEQ ID NO: 826715 - protein, 20 aa, Mycobacterium
ILPLATVTTPNLFEARTLSG

SEQ ID NO: 826716 - protein, 18 aa, Mycobacterium
ILPMIRQAQDWGADWTLY

SEQ ID NO: 826717 - protein, 20 aa, Mycobacterium
ILPNRATFDHLLLTAHQRMS

SEQ ID NO: 826718 - protein, 17 aa, Mycobacterium
ILPTIRELGIGLVAYSP

SEQ ID NO: 826719 - protein, 17 aa, Mycobacterium
ILPVHPLLGAHVHLHEE

SEQ ID NO: 826720 - protein, 19 aa, Mycobacterium
ILQAPLVKSFLLQVSAEVL

SEQ ID NO: 826721 - protein, 29 aa, Mycobacterium
ILQLGHSCIELYTGVRPKGLWSLTFDEEL

SEQ ID NO: 826722 - protein, 24 aa, Mycobacterium
ILQPMPCMPIRFWDDPDGSRYKAA

SEQ ID NO: 826723 - protein, 17 aa, Mycobacterium
ILQWHWKTDVFPDDDQW

SEQ ID NO: 826724 - protein, 18 aa, Mycobacterium
ILRACAVLDLADALDQEL

SEQ ID NO: 826725 - protein, 18 aa, Mycobacterium
ILRALRINFSVRGYDVVT

SEQ ID NO: 826726 - protein, 18 aa, Mycobacterium
ILRALRINLSVRGYEVRT

SEQ ID NO: 826727 - protein, 18 aa, Mycobacterium
ILRAMRINLSARGYEVVT

SEQ ID NO: 826728 - protein, 17 aa, Mycobacterium
ILRAVTLPRYGGTTLWT

SEQ ID NO: 826729 - protein, 18 aa, Mycobacterium
ILRAVVAEGSIGGAAAAL

SEQ ID NO: 826730 - protein, 17 aa, Mycobacterium
ILRDTIAKPPPGGSPGL

SEQ ID NO: 826731 - protein, 18 aa, Mycobacterium
ILRELWDLHVEFGMQQPH

SEQ ID NO: 826732 - protein, 18 aa, Mycobacterium
ILRFDPAGPLRFAALQSV

SEQ ID NO: 826733 - protein, 21 aa, Mycobacterium
ILRGGVPMLLVRGQMSDLVSQ

SEQ ID NO: 826734 - protein, 18 aa, Mycobacterium
ILRGRRFGAHQALQWGLL

SEQ ID NO: 826735 - protein, 17 aa, Mycobacterium
ILRLDPHGSLRFAALQG

SEQ ID NO: 826736 - protein, 17 aa, Mycobacterium
ILRLLLGHPARTAGRLT

SEQ ID NO: 826737 - protein, 18 aa, Mycobacterium
ILRLLLGHPAYADGRLAI

SEQ ID NO: 826738 - protein, 19 aa, Mycobacterium
ILRLLLGHPAYADGRLTIG

SEQ ID NO: 826739 - protein, 26 aa, Mycobacterium
ILRLPEGPSGWRLIPGGAGTLDDVQV

SEQ ID NO: 826740 - protein, 32 aa, Mycobacterium
ILRLSPEAIVRPRWLWKFGKTLRPPDLRVPNQ

SEQ ID NO: 826741 - protein, 25 aa, Mycobacterium
ILRNARCRILITEPRFVRVLRAAVN

SEQ ID NO: 826742 - protein, 32 aa, Mycobacterium
ILRNHARWAVLLRGLRFLVVDECHYYRGVFGS

SEQ ID NO: 826743 - protein, 25 aa, Mycobacterium
ILRNHARWAVLLRGLRFVVVDECHY

SEQ ID NO: 826744 - protein, 27 aa, Mycobacterium
ILRNHARWAVLLRNLRYLIVDECHYYR

SEQ ID NO: 826745 - protein, 18 aa, Mycobacterium
ILRPSFRNWDHPYRRQIF

SEQ ID NO: 826746 - protein, 18 aa, Mycobacterium
ILRSFPPLIHQGGTLTFT

SEQ ID NO: 826747 - protein, 29 aa, Mycobacterium
ILRTEKSVLFVIPWGNHWIIGTTDTEWNL

SEQ ID NO: 826748 - protein, 18 aa, Mycobacterium
ILRTTFDLSAYSVPLQLV

SEQ ID NO: 826749 - protein, 17 aa, Mycobacterium
ILRVYPALDPSGVHVVR

SEQ ID NO: 826750 - protein, 29 aa, Mycobacterium
ILRYVADRFPVMPLPSWLSNPMDPISIRD

SEQ ID NO: 826751 - protein, 26 aa, Mycobacterium
ILSATRYEWVILDYAILSVGAVTVPI

SEQ ID NO: 826752 - protein, 22 aa, Mycobacterium
ILSFTHSLALEYSKQGLRAVNI

SEQ ID NO: 826753 - protein, 29 aa, Mycobacterium
ILSGVYLTLISPVGRFLLAEAIRVKHTQT

SEQ ID NO: 826754 - protein, 19 aa, Mycobacterium
ILSIAWGTAIRQLAAGLGI

SEQ ID NO: 826755 - protein, 23 aa, Mycobacterium
ILSLAQTRLRSRPDLDRLAEAVV

SEQ ID NO: 826756 - protein, 27 aa, Mycobacterium
ILSMRIPKPWFVLMPTPVWDQMFKPMI

SEQ ID NO: 826757 - protein, 28 aa, Mycobacterium
ILSNALYMDRYPLVSAISRPLIAKHLVA

SEQ ID NO: 826758 - protein, 30 aa, Mycobacterium
ILSNALYMDRYPLVSAISRPLIVKHLVAAA

SEQ ID NO: 826759 - protein, 17 aa, Mycobacterium
ILSQILLGLAEVITSAA

SEQ ID NO: 826760 - protein, 19 aa, Mycobacterium
ILSQILRGVADVTAVAAAE

SEQ ID NO: 826761 - protein, 29 aa, Mycobacterium
ILSRQRPEIDWFPWLAQQLRGASPGAARG

SEQ ID NO: 826762 - protein, 20 aa, Mycobacterium
ILSVVIDSLVRRSLELVLAQ

SEQ ID NO: 826763 - protein, 22 aa, Mycobacterium
ILTCRLIDRPLRPSFVDGLRNE

SEQ ID NO: 826764 - protein, 22 aa, Mycobacterium
ILTCRLIDRPLRPSFVSGLRNE

SEQ ID NO: 826765 - protein, 29 aa, Mycobacterium
ILTDKLGTFPLFQYWGPTANITSSRWLVD

SEQ ID NO: 826766 - protein, 27 aa, Mycobacterium
ILTDRQIELSPPFRGGPALKDGDTIGL

SEQ ID NO: 826767 - protein, 18 aa, Mycobacterium
ILTFLAAREAAHHRLFSH

SEQ ID NO: 826768 - protein, 18 aa, Mycobacterium
ILTNPKHPYTRQLLAATP

SEQ ID NO: 826769 - protein, 17 aa, Mycobacterium
ILTPLGFRWTNYGVAPE

SEQ ID NO: 826770 - protein, 25 aa, Mycobacterium
ILTRLLVTLSPIWPSDNRIGEVPVG

SEQ ID NO: 826771 - protein, 20 aa, Mycobacterium
ILTSFVPPIPDRVDVVWLEH

SEQ ID NO: 826772 - protein, 33 aa, Mycobacterium
ILTSPIVLVDFWAPWCGPCRAFAPTFERSAQNH

SEQ ID NO: 826773 - protein, 19 aa, Mycobacterium
ILTTRFAVGAYDAIRRTRE

SEQ ID NO: 826774 - protein, 18 aa, Mycobacterium
ILVALALSPQGRSAPQLA

SEQ ID NO: 826775 - protein, 19 aa, Mycobacterium
ILVAVTRWTVRLEETGWGN

SEQ ID NO: 826776 - protein, 17 aa, Mycobacterium
ILVGRYIMAIEPLASLT

SEQ ID NO: 826777 - protein, 17 aa, Mycobacterium
ILVLPPGTAQPGAAAAD

SEQ ID NO: 826778 - protein, 18 aa, Mycobacterium
ILVNAIAPGLFPSRMTKE

SEQ ID NO: 826779 - protein, 17 aa, Mycobacterium
ILVNNVGHWLRHPGNFV

SEQ ID NO: 826780 - protein, 17 aa, Mycobacterium
ILVQPEDRPALKKAGFL

SEQ ID NO: 826781 - protein, 19 aa, Mycobacterium
ILVRGGADVLLLCCPIPLG

SEQ ID NO: 826782 - protein, 17 aa, Mycobacterium
ILVRSCRGGYMHSVALS

SEQ ID NO: 826783 - protein, 22 aa, Mycobacterium
ILVSSDDFAYLVDFGIASASAD

SEQ ID NO: 826784 - protein, 17 aa, Mycobacterium
ILWELQDGPKRFNALHR

SEQ ID NO: 826785 - protein, 18 aa, Mycobacterium
ILWHIMKLYSHHGIRDFV

SEQ ID NO: 826786 - protein, 19 aa, Mycobacterium
ILWSEFFQRETELAMEILE

SEQ ID NO: 826787 - protein, 26 aa, Mycobacterium
ILYDAPEVVIPILVPDGAHSYPDAAR

SEQ ID NO: 826788 - protein, 17 aa, Mycobacterium
ILYMHDLADIGAGSPHD

SEQ ID NO: 826789 - protein, 22 aa, Mycobacterium
ILYRTMLPGVLQFSLHTPTNVS

SEQ ID NO: 826790 - protein, 19 aa, Mycobacterium
ILYSADHMGREAVIGCGAM

SEQ ID NO: 826791 - protein, 17 aa, Mycobacterium
ILYTMRSATALGGRGIR

SEQ ID NO: 826792 - protein, 39 aa, Mycobacterium
IMAADLIVLGPGSWFTSVIPHVLVPGLFAALQATSARRA

SEQ ID NO: 826793 - protein, 20 aa, Mycobacterium
IMADTNWIATAAPIVHLGAK

SEQ ID NO: 826794 - protein, 18 aa, Mycobacterium
IMAFRDGVLVYSQAGALP

SEQ ID NO: 826795 - protein, 19 aa, Mycobacterium
IMAGTNVWWGHAEAALLRL

SEQ ID NO: 826796 - protein, 22 aa, Mycobacterium
IMAGTNVWWGRGEAALLRLAEE

SEQ ID NO: 826797 - protein, 20 aa, Mycobacterium
IMALFGAPLALEDHALRACL

SEQ ID NO: 826798 - protein, 32 aa, Mycobacterium
IMANISLLSPSFTTGFPLTLALDALGAPIVTG

SEQ ID NO: 826799 - protein, 25 aa, Mycobacterium
IMAPQGLDYVVAFLGALQAGRVAVP

SEQ ID NO: 826800 - protein, 18 aa, Mycobacterium
IMAWANAAGIRLSIRSGG

SEQ ID NO: 826801 - protein, 32 aa, Mycobacterium
IMDLFINPFDGLIDIVWAIVRTFQGIAHLEAH

SEQ ID NO: 826802 - protein, 24 aa, Mycobacterium
IMDRLAPLGPVYQAGTLSGNPVAV

SEQ ID NO: 826803 - protein, 18 aa, Mycobacterium
IMDVEPQVAFFGDNIPLL

SEQ ID NO: 826804 - protein, 17 aa, Mycobacterium
IMEHFVYGRVRTASRLA

SEQ ID NO: 826805 - protein, 23 aa, Mycobacterium
IMERYRVDAVRAFELLRKLSQDS

SEQ ID NO: 826806 - protein, 22 aa, Mycobacterium
IMEYLDWDRLGKTFYLLDTFAG

SEQ ID NO: 826807 - protein, 17 aa, Mycobacterium
IMFERLIPNLEYIGLMS

SEQ ID NO: 826808 - protein, 18 aa, Mycobacterium
IMFWPESAYGPTNQCIGL

SEQ ID NO: 826809 - protein, 38 aa, Mycobacterium
IMGAGICQWFHGDTTYRAVLAMLLLTGSMGRNGGGWAH

SEQ ID NO: 826810 - protein, 24 aa, Mycobacterium
IMGGPRYEQLFTATGEFRFGDERH

SEQ ID NO: 826811 - protein, 25 aa, Mycobacterium
IMGPLLSIPGHPITLARFGVPTVLP

SEQ ID NO: 826812 - protein, 26 aa, Mycobacterium
IMGRPMALNLAWSGTPLVVWNRTLER

SEQ ID NO: 826813 - protein, 26 aa, Mycobacterium
IMGSEGYLLNQFLAPRTNKRTDSWGG

SEQ ID NO: 826814 - protein, 18 aa, Mycobacterium
IMHDVNILEIAAADAAYQ

SEQ ID NO: 826815 - protein, 19 aa, Mycobacterium
IMIPARWAGYPPYHDRRYD

SEQ ID NO: 826816 - protein, 23 aa, Mycobacterium
IMKADHGLVLPRRLQIEFSQVIQ

SEQ ID NO: 826817 - protein, 25 aa, Mycobacterium
IMKLSEWLGWPLFKKLEDPQRRELG

SEQ ID NO: 826818 - protein, 19 aa, Mycobacterium
IMKPIFVMLGEHGQLWRTM

SEQ ID NO: 826819 - protein, 20 aa, Mycobacterium
IMLEKSLSWLTTRNAQRSID

SEQ ID NO: 826820 - protein, 19 aa, Mycobacterium
IMLNMDPPRHSRLRHIISR

SEQ ID NO: 826821 - protein, 18 aa, Mycobacterium
IMLNSCITVLPLQHPIVL

SEQ ID NO: 826822 - protein, 19 aa, Mycobacterium
IMPLLMPLETIGVPRPILL

SEQ ID NO: 826823 - protein, 23 aa, Mycobacterium
IMPPPDVTLISLIDRNIANVGDA

SEQ ID NO: 826824 - protein, 25 aa, Mycobacterium
IMPPQMLHMILPRKDYEIVEDSWDV

SEQ ID NO: 826825 - protein, 19 aa, Mycobacterium
IMQRLLPVYRAEPDAYDLT

SEQ ID NO: 826826 - protein, 18 aa, Mycobacterium
IMQTGMTFTIEPMINLGT

SEQ ID NO: 826827 - protein, 25 aa, Mycobacterium
IMRAGRGPRRYVCGGQLLTFDEMID

SEQ ID NO: 826828 - protein, 23 aa, Mycobacterium
IMRGAVTGLLPRPKSKASIGTVF

SEQ ID NO: 826829 - protein, 27 aa, Mycobacterium
IMRIPELPTDLVIIGGGFVSAEFAHVF

SEQ ID NO: 826830 - protein, 27 aa, Mycobacterium
IMRYRGYRSLTWALNGLLPGAEAAISK

SEQ ID NO: 826831 - protein, 17 aa, Mycobacterium
IMSEHGLYGLPRHGRRK

SEQ ID NO: 826832 - protein, 19 aa, Mycobacterium
IMSMLRTLVRRSAAAGLPL

SEQ ID NO: 826833 - protein, 17 aa, Mycobacterium
IMTGTGTFYTLRCYLDD

SEQ ID NO: 826834 - protein, 21 aa, Mycobacterium
IMTLAGRWRRQGIAVDFATLA

SEQ ID NO: 826835 - protein, 33 aa, Mycobacterium
IMTPPSHILGLLNIAMVLDTGAWMRLHPRFDVE

SEQ ID NO: 826836 - protein, 20 aa, Mycobacterium
IMTTLLYHMRDKGIRYGLQT

SEQ ID NO: 826837 - protein, 18 aa, Mycobacterium
IMVQAWDRVDNDPDIRCC

SEQ ID NO: 826838 - protein, 20 aa, Mycobacterium
IMVQAWDRVDNDPDIRCCIL

SEQ ID NO: 826839 - protein, 28 aa, Mycobacterium
IMVSYPVEQGLKKVYYWAARSLGGEFTA

SEQ ID NO: 826840 - protein, 18 aa, Mycobacterium
IMVTKKTFGIRYSGPAFL

SEQ ID NO: 826841 - protein, 18 aa, Mycobacterium
IMWDNAYAVHTLTRDFAQ

SEQ ID NO: 826842 - protein, 25 aa, Mycobacterium
INAAAKLPFIEVYIATPLAECEKRD

SEQ ID NO: 826843 - protein, 21 aa, Mycobacterium
INAALLEHKVIFFSGQDHLDD

SEQ ID NO: 826844 - protein, 29 aa, Mycobacterium
INAASGRTFFLATRLLAPDQRPPVHALYG

SEQ ID NO: 826845 - protein, 29 aa, Mycobacterium
INAFNFPVWGMLEKLAPAFLAGVPSIVKP

SEQ ID NO: 826846 - protein, 25 aa, Mycobacterium
INAGTYIFRRAIIDRIPRGREVSVE

SEQ ID NO: 826847 - protein, 22 aa, Mycobacterium
INAHTAAPWRVGFNGFSPGFAY

SEQ ID NO: 826848 - protein, 17 aa, Mycobacterium
INALRRRIREDRAIMVA

SEQ ID NO: 826849 - protein, 31 aa, Mycobacterium
INALYAPQRWKYLTSGLLGLQRGTDAGDLLL

SEQ ID NO: 826850 - protein, 30 aa, Mycobacterium
INALYTPTHWKYLTSGLLGLARGTDAGDLL

SEQ ID NO: 826851 - protein, 34 aa, Mycobacterium
INATRIPMTWFQVDQMPLWAKVPVVLVVHAKAGG

SEQ ID NO: 826852 - protein, 18 aa, Mycobacterium
INAWTGVGYLTPAATWGA

SEQ ID NO: 826853 - protein, 18 aa, Mycobacterium
INDAAVLAKKPYVWGSIY

SEQ ID NO: 826854 - protein, 23 aa, Mycobacterium
INDAHQINCRLPFGGYKQSGVGR

SEQ ID NO: 826855 - protein, 25 aa, Mycobacterium
INDANFEKFFGYPGKAKRNLPGAPS

SEQ ID NO: 826856 - protein, 17 aa, Mycobacterium
INDPKPIRLEDISRHAD

SEQ ID NO: 826857 - protein, 17 aa, Mycobacterium
INDRWAQLQLPRVPGME

SEQ ID NO: 826858 - protein, 24 aa, Mycobacterium
INEAFAPVVLAWIKDLKADPEKVN

SEQ ID NO: 826859 - protein, 20 aa, Mycobacterium
INEAFAPVVLAWLAELEADP

SEQ ID NO: 826860 - protein, 22 aa, Mycobacterium
INEAFAPVVLAWLKEIKADPEK

SEQ ID NO: 826861 - protein, 22 aa, Mycobacterium
INEAFAPVVLAWLKEVKADPEK

SEQ ID NO: 826862 - protein, 17 aa, Mycobacterium
INEILASKKLPPEKLAE

SEQ ID NO: 826863 - protein, 21 aa, Mycobacterium
INFTNICYTGCRFCAFAQRKG

SEQ ID NO: 826864 - protein, 20 aa, Mycobacterium
INGAAAHLVHPGDLVILIAY

SEQ ID NO: 826865 - protein, 31 aa, Mycobacterium
INGAAAHLVHPGDLVILIAYGTMEEAEARAY

SEQ ID NO: 826866 - protein, 17 aa, Mycobacterium
INGAIAATGFKVDEPWS

SEQ ID NO: 826867 - protein, 27 aa, Mycobacterium
INGAKTWISNARRSGLIALLCKTDPQA

SEQ ID NO: 826868 - protein, 26 aa, Mycobacterium
INGAKTWITNARRSGLIALLCKTDPA

SEQ ID NO: 826869 - protein, 31 aa, Mycobacterium
INGATYLFTNDYEWDLLLSKTGWSEADVMAQ

SEQ ID NO: 826870 - protein, 20 aa, Mycobacterium
INGDLTVALSRLPRDEWIGV

SEQ ID NO: 826871 - protein, 19 aa, Mycobacterium
INGFKMLRSLSESDFRDVL

SEQ ID NO: 826872 - protein, 23 aa, Mycobacterium
INGGPEFRFTEAVSFMVDCKDQD

SEQ ID NO: 826873 - protein, 32 aa, Mycobacterium
INGQKMWTSLIAYADWVWLAVRTNPEAKKHRG

SEQ ID NO: 826874 - protein, 20 aa, Mycobacterium
INGQKRFITNAPTAGLFVVF

SEQ ID NO: 826875 - protein, 22 aa, Mycobacterium
INGRICINFTYSSILPAMKTLG

SEQ ID NO: 826876 - protein, 21 aa, Mycobacterium
INGRPRLMCMTRMSTFAEDEV

SEQ ID NO: 826877 - protein, 21 aa, Mycobacterium
INGRPRLMCMTRMSTFGEDEV

SEQ ID NO: 826878 - protein, 23 aa, Mycobacterium
INGTIGPVCPVFLALSVSDAAED

SEQ ID NO: 826879 - protein, 17 aa, Mycobacterium
INGTISFGGQAGTPLAV

SEQ ID NO: 826880 - protein, 17 aa, Mycobacterium
INHAELHMRRGEWAEAA

SEQ ID NO: 826881 - protein, 26 aa, Mycobacterium
INHAGEIFWVKYHFITDQGIDFLTQE

SEQ ID NO: 826882 - protein, 26 aa, Mycobacterium
INHDIGFIGVPFFHIAGVGSIVSGMM

SEQ ID NO: 826883 - protein, 29 aa, Mycobacterium
INHHDGVIAFLRRTRRALPGDPDFGDPLS

SEQ ID NO: 826884 - protein, 19 aa, Mycobacterium
INHSIWWKNLSPNGGDKPT

SEQ ID NO: 826885 - protein, 22 aa, Mycobacterium
INHVLPAWDVSCGLYAALSVVA

SEQ ID NO: 826886 - protein, 18 aa, Mycobacterium
INIFNVPRSTGVSPLPLA

SEQ ID NO: 826887 - protein, 17 aa, Mycobacterium
INIFQYPSDILKSLVAQ

SEQ ID NO: 826888 - protein, 17 aa, Mycobacterium
INIGHLYVAKTMDMCVP

SEQ ID NO: 826889 - protein, 31 aa, Mycobacterium
INIGLLGKFMPNYLFAPDAALPLISRRDDAA

SEQ ID NO: 826890 - protein, 27 aa, Mycobacterium
INIMPQVWAMRYTLERAMRGQDTIAAT

SEQ ID NO: 826891 - protein, 19 aa, Mycobacterium
INIQFVLAYGPDEFAESLR

SEQ ID NO: 826892 - protein, 18 aa, Mycobacterium
INIVLQTCFFAIAGVLPV

SEQ ID NO: 826893 - protein, 20 aa, Mycobacterium
INLGASLAEYGRRVLLVDLD

SEQ ID NO: 826894 - protein, 19 aa, Mycobacterium
INLIFNAVADHMPDLTPIG

SEQ ID NO: 826895 - protein, 17 aa, Mycobacterium
INLILYYQQMIAERRAT

SEQ ID NO: 826896 - protein, 27 aa, Mycobacterium
INLKSVYLSCRAALRHMVPAGKGSIIN

SEQ ID NO: 826897 - protein, 17 aa, Mycobacterium
INLLSYLAQNTSAQALQ

SEQ ID NO: 826898 - protein, 19 aa, Mycobacterium
INLNFMPMSHVMGRGSLVT

SEQ ID NO: 826899 - protein, 39 aa, Mycobacterium
INLSRKGVRFIPLHGPLPYRPLALAWRTANQSPSVRCFL

SEQ ID NO: 826900 - protein, 24 aa, Mycobacterium
INLTGVWHTVKAGVPHILSGGRGG

SEQ ID NO: 826901 - protein, 25 aa, Mycobacterium
INLVGSFNVLRLAAERIAKTEPVGP

SEQ ID NO: 826902 - protein, 22 aa, Mycobacterium
INLVGTFDCIRLAATAMSRLDL

SEQ ID NO: 826903 - protein, 25 aa, Mycobacterium
INLVGTFNVLRLGAERIAKTEPIGE

SEQ ID NO: 826904 - protein, 17 aa, Mycobacterium
INLYARLRSITAQVVVL

SEQ ID NO: 826905 - protein, 17 aa, Mycobacterium
INMPVLDGVSVVTALRA

SEQ ID NO: 826906 - protein, 18 aa, Mycobacterium
INNAVRFAFWGAEETGLE

SEQ ID NO: 826907 - protein, 20 aa, Mycobacterium
INNLAYGFPFDDVNSQSSVL

SEQ ID NO: 826908 - protein, 25 aa, Mycobacterium
INPEAWRWYRMAFGKDKTPIVDTWW

SEQ ID NO: 826909 - protein, 21 aa, Mycobacterium
INPELWIALRDALHAAGRDHG

SEQ ID NO: 826910 - protein, 23 aa, Mycobacterium
INPFDFFIEEWAETWPAEGLTYP

SEQ ID NO: 826911 - protein, 28 aa, Mycobacterium
INPHDVVLFPAWVRFSPLKPSHLDPPHV

SEQ ID NO: 826912 - protein, 17 aa, Mycobacterium
INPPPYDEYRQVIVDAG

SEQ ID NO: 826913 - protein, 26 aa, Mycobacterium
INPSDLLLLKGKYLVHPELPAGVGAE

SEQ ID NO: 826914 - protein, 17 aa, Mycobacterium
INPYFDWANDRPPDHHY

SEQ ID NO: 826915 - protein, 24 aa, Mycobacterium
INQQRTVLEGRLEQLRTFEREYRT

SEQ ID NO: 826916 - protein, 25 aa, Mycobacterium
INRADLLQAAGKYPPPPGASEVIGL

SEQ ID NO: 826917 - protein, 27 aa, Mycobacterium
INRDTWNNLALKWFRGINSVLGVQRTG

SEQ ID NO: 826918 - protein, 23 aa, Mycobacterium
INRGAAVFTFALGDRKTYEFMDN

SEQ ID NO: 826919 - protein, 22 aa, Mycobacterium
INRLMDYRYPPGAVRRLDDALL

SEQ ID NO: 826920 - protein, 27 aa, Mycobacterium
INRLRQTLLEYFPPLERAFDYSKSKAA

SEQ ID NO: 826921 - protein, 18 aa, Mycobacterium
INRRLRRALEHRDQTCAV

SEQ ID NO: 826922 - protein, 24 aa, Mycobacterium
INRRNRMFWPTTCTIVEVIPETKL

SEQ ID NO: 826923 - protein, 25 aa, Mycobacterium
INRSLIYQLFGDPAGLFVALIDREA

SEQ ID NO: 826924 - protein, 18 aa, Mycobacterium
INSALMYSGPGSGPMLAA

SEQ ID NO: 826925 - protein, 17 aa, Mycobacterium
INSGFGWHEARIPTIVT

SEQ ID NO: 826926 - protein, 29 aa, Mycobacterium
INTADADVVRYLRWFTFLSAEEIGELETA

SEQ ID NO: 826927 - protein, 17 aa, Mycobacterium
INVDFADVKSVMSGAGS

SEQ ID NO: 826928 - protein, 22 aa, Mycobacterium
INVEGGMLAWAGAGRPMVTDDG

SEQ ID NO: 826929 - protein, 27 aa, Mycobacterium
INVGEDGEWPLFLDVWVEHVVEEVATA

SEQ ID NO: 826930 - protein, 24 aa, Mycobacterium
INVNWPPLQRPPDLNWSGWERKRQ

SEQ ID NO: 826931 - protein, 28 aa, Mycobacterium
INVPIPVPMAYYSFGGWKASLFGDSHAH

SEQ ID NO: 826932 - protein, 28 aa, Mycobacterium
INVPIPVPMAYYSFGGWKASLFGDTHAH

SEQ ID NO: 826933 - protein, 28 aa, Mycobacterium
INVPIPVPMAYYSFGGWKSSLFGDTHAH

SEQ ID NO: 826934 - protein, 25 aa, Mycobacterium
INVPRHPLRLAAFGPRAALPATVMA

SEQ ID NO: 826935 - protein, 25 aa, Mycobacterium
INVVGTSMVWLVTPRQADDWLRGPL

SEQ ID NO: 826936 - protein, 19 aa, Mycobacterium
INWGPWAEVGRAQFFADLG

SEQ ID NO: 826937 - protein, 20 aa, Mycobacterium
IPAAEFFTGLWETAMEPDEV

SEQ ID NO: 826938 - protein, 19 aa, Mycobacterium
IPAARRYLAQLTAGENPWN

SEQ ID NO: 826939 - protein, 23 aa, Mycobacterium
IPAASMLPFRFTVNGYRGCSHAC

SEQ ID NO: 826940 - protein, 25 aa, Mycobacterium
IPAATAGAWVAASNARRDAASGSAG

SEQ ID NO: 826941 - protein, 17 aa, Mycobacterium
IPAAVDAALLGRFYERF

SEQ ID NO: 826942 - protein, 24 aa, Mycobacterium
IPAAWTHLVGIKPQRGRISTWPLP

SEQ ID NO: 826943 - protein, 25 aa, Mycobacterium
IPAAWTHLVGIKPQRGRISTWPQPE

SEQ ID NO: 826944 - protein, 31 aa, Mycobacterium
IPADANWSLFTRLMPILPTTETSSGAGMADP

SEQ ID NO: 826945 - protein, 21 aa, Mycobacterium
IPADRPALEAALAILRDITAG

SEQ ID NO: 826946 - protein, 26 aa, Mycobacterium
IPAEARARLLYERSLGMLDSTVGNAL

SEQ ID NO: 826947 - protein, 25 aa, Mycobacterium
IPAESLQQLLRFLRTVPSSVNVQAS

SEQ ID NO: 826948 - protein, 17 aa, Mycobacterium
IPAFFEPGPRLEKMNEL

SEQ ID NO: 826949 - protein, 24 aa, Mycobacterium
IPAFKAPFEPLTPGGFRAPNTNFY

SEQ ID NO: 826950 - protein, 19 aa, Mycobacterium
IPAFKLTRSSAAYWRGDQK

SEQ ID NO: 826951 - protein, 25 aa, Mycobacterium
IPAGKPVFLLLGSANRDPDAWTKPE

SEQ ID NO: 826952 - protein, 19 aa, Mycobacterium
IPAGRRALLLYGSANRDER

SEQ ID NO: 826953 - protein, 20 aa, Mycobacterium
IPAGWAARQVYIDLRDGDLG

SEQ ID NO: 826954 - protein, 21 aa, Mycobacterium
IPAHANPRGLIRMKFALACYG

SEQ ID NO: 826955 - protein, 19 aa, Mycobacterium
IPAIRRPADPRRQLTVVGA

SEQ ID NO: 826956 - protein, 27 aa, Mycobacterium
IPAIVEMLVAVMWGMGFYAGYVGRSEE

SEQ ID NO: 826957 - protein, 28 aa, Mycobacterium
IPALIAGCTVIIKPAPETPLDALWLAEM

SEQ ID NO: 826958 - protein, 17 aa, Mycobacterium
IPALKAFGAIPVADERI

SEQ ID NO: 826959 - protein, 19 aa, Mycobacterium
IPALNYQRHLFQERQIRSV

SEQ ID NO: 826960 - protein, 21 aa, Mycobacterium
IPALYAEHWEPLWAACAQAGL

SEQ ID NO: 826961 - protein, 17 aa, Mycobacterium
IPAPLAAATAEAGRRLR

SEQ ID NO: 826962 - protein, 21 aa, Mycobacterium
IPASLLPYAQISDGPAAAPTT

SEQ ID NO: 826963 - protein, 27 aa, Mycobacterium
IPATRGLFRRVILHSAPLGLAYQAVAD

SEQ ID NO: 826964 - protein, 27 aa, Mycobacterium
IPAVNKLGTMGLILRGSDELKKQVLPQ

SEQ ID NO: 826965 - protein, 27 aa, Mycobacterium
IPAVNKLGTMGLILRGSDELKQKVLPS

SEQ ID NO: 826966 - protein, 27 aa, Mycobacterium
IPAVNKLGTMGLILRGSEDLKKQVLPS

SEQ ID NO: 826967 - protein, 23 aa, Mycobacterium
IPCDLHLWDGQIHDFPLAADILP

SEQ ID NO: 826968 - protein, 21 aa, Mycobacterium
IPDAAALCHALAAGGIRTVEL

SEQ ID NO: 826969 - protein, 20 aa, Mycobacterium
IPDAASPRVIWGLAPGASGS

SEQ ID NO: 826970 - protein, 32 aa, Mycobacterium
IPDDAKPTLLKRYLDRWYWEVKGHMADLTPKS

SEQ ID NO: 826971 - protein, 27 aa, Mycobacterium
IPDDIIDRIFTPFFTTKPFGEGTGLGL

SEQ ID NO: 826972 - protein, 17 aa, Mycobacterium
IPDFVKLAEALGCVGLR

SEQ ID NO: 826973 - protein, 19 aa, Mycobacterium
IPDFVKLAEALGCVGLRCE

SEQ ID NO: 826974 - protein, 23 aa, Mycobacterium
IPDGDVLLLLPGSGHRDERVFDK

SEQ ID NO: 826975 - protein, 23 aa, Mycobacterium
IPDGLLGTLYRNGSGRWTLGSTQ

SEQ ID NO: 826976 - protein, 19 aa, Mycobacterium
IPDHYRLYVSQKLARLERF

SEQ ID NO: 826977 - protein, 25 aa, Mycobacterium
IPDKAGWRMLSGDETGWLLGDYILS

SEQ ID NO: 826978 - protein, 25 aa, Mycobacterium
IPDKFFRAVLAEQGSFELPAEGSYA

SEQ ID NO: 826979 - protein, 31 aa, Mycobacterium
IPDKGRVLTAMSVFFFGLVDSPNHLAGPPDD

SEQ ID NO: 826980 - protein, 32 aa, Mycobacterium
IPDMPHTTPPRLVLDGFLASGQPLSGLEPELY

SEQ ID NO: 826981 - protein, 24 aa, Mycobacterium
IPDPEQTFLGLVSQIPGVIVTDPA

SEQ ID NO: 826982 - protein, 19 aa, Mycobacterium
IPDPQWIPIVGDRGWIIIT

SEQ ID NO: 826983 - protein, 31 aa, Mycobacterium
IPDTAIPLNLDVPVYLDIPITGTLGVFTVDG

SEQ ID NO: 826984 - protein, 18 aa, Mycobacterium
IPDVDALYFTMLNSNKRS

SEQ ID NO: 826985 - protein, 25 aa, Mycobacterium
IPDVDGVSIALLQPGPAGPQIQMCA

SEQ ID NO: 826986 - protein, 26 aa, Mycobacterium
IPDVGGAYLLSRAPGALGLHAALTGA

SEQ ID NO: 826987 - protein, 17 aa, Mycobacterium
IPDVLRSVASRFLDEYR

SEQ ID NO: 826988 - protein, 17 aa, Mycobacterium
IPDWARPAATSYPAAPN

SEQ ID NO: 826989 - protein, 23 aa, Mycobacterium
IPEAIAELSIFRIALHQPSVAMA

SEQ ID NO: 826990 - protein, 18 aa, Mycobacterium
IPEFNRDALVSTLQDLYG

SEQ ID NO: 826991 - protein, 24 aa, Mycobacterium
IPEGRRVMFLYGSGNRDERHFGDD

SEQ ID NO: 826992 - protein, 28 aa, Mycobacterium
IPELGRPSWLTAYGLCEQPKLAAPLYSV

SEQ ID NO: 826993 - protein, 18 aa, Mycobacterium
IPELLMRAPEVIQMYADG

SEQ ID NO: 826994 - protein, 18 aa, Mycobacterium
IPEMVRKAFKLAESERPA

SEQ ID NO: 826995 - protein, 17 aa, Mycobacterium
IPEPFLVLATQNPVDQE

SEQ ID NO: 826996 - protein, 17 aa, Mycobacterium
IPERAGHGWFTSLALAE

SEQ ID NO: 826997 - protein, 34 aa, Mycobacterium
IPEVAEVWRRGSVIGSWLLDLTAIALHESPELKE

SEQ ID NO: 826998 - protein, 21 aa, Mycobacterium
IPEYTGNLLQYFDPETPATTP

SEQ ID NO: 826999 - protein, 21 aa, Mycobacterium
IPFAIPYTKPLKFASGEVHTA

SEQ ID NO: 827000 - protein, 17 aa, Mycobacterium
IPFGGTVAVIGLGAVGL

SEQ ID NO: 827001 - protein, 17 aa, Mycobacterium
IPFPSLGERFDRLEEQL

SEQ ID NO: 827002 - protein, 28 aa, Mycobacterium
IPFSGPARKALELTFRQALRLGHNYIGT

SEQ ID NO: 827003 - protein, 21 aa, Mycobacterium
IPFSIPYTKPLRFASGEVHAA

SEQ ID NO: 827004 - protein, 19 aa, Mycobacterium
IPGALRWTWDTMKPLYANG

SEQ ID NO: 827005 - protein, 19 aa, Mycobacterium
IPGCMLWAELDAGWCHSHH

SEQ ID NO: 827006 - protein, 25 aa, Mycobacterium
IPGDGGTWFLPRAVGWARAAEMTLT

SEQ ID NO: 827007 - protein, 25 aa, Mycobacterium
IPGDGLDFGLLRYLRDDTAARLAGF

SEQ ID NO: 827008 - protein, 28 aa, Mycobacterium
IPGDRIPYAPPFGVALAAWDDEEERRAW

SEQ ID NO: 827009 - protein, 30 aa, Mycobacterium
IPGDRLTVAMDFARWAPPVRGALRARGVRL

SEQ ID NO: 827010 - protein, 25 aa, Mycobacterium
IPGDVCFFGFEPWEIGNPAYGYEPG

SEQ ID NO: 827011 - protein, 19 aa, Mycobacterium
IPGFHTLMIAPQGGPALTV

SEQ ID NO: 827012 - protein, 17 aa, Mycobacterium
IPGFIEESLRMDSPVKS

SEQ ID NO: 827013 - protein, 27 aa, Mycobacterium
IPGHQRAGGGVPRPVCAGFDRIRGLVC

SEQ ID NO: 827014 - protein, 20 aa, Mycobacterium
IPGINAYFADFLLDTTRAAI

SEQ ID NO: 827015 - protein, 23 aa, Mycobacterium
IPGKPRVFMPFIGGFGVYGAICA

SEQ ID NO: 827016 - protein, 17 aa, Mycobacterium
IPGLFAAGRCTAGLAAW

SEQ ID NO: 827017 - protein, 24 aa, Mycobacterium
IPGLIDAHWHAMFATIPAAVAQLS

SEQ ID NO: 827018 - protein, 27 aa, Mycobacterium
IPGLISKPTLFNVVPRGKTPPVSLEML

SEQ ID NO: 827019 - protein, 17 aa, Mycobacterium
IPGLLDLGVGPESDSYE

SEQ ID NO: 827020 - protein, 25 aa, Mycobacterium
IPGLLRLHPNLVVLRTFSKAYGLAG

SEQ ID NO: 827021 - protein, 33 aa, Mycobacterium
IPGLQYKAIIAAERMIPRTLMRAVTKRVGGGRG

SEQ ID NO: 827022 - protein, 25 aa, Mycobacterium
IPGLRALARLGLYWAQEALAFGMTK

SEQ ID NO: 827023 - protein, 26 aa, Mycobacterium
IPGPARSRAYDRAWWFTRFVADTYGT

SEQ ID NO: 827024 - protein, 27 aa, Mycobacterium
IPGPRKLPALIWRILSAPLNAYARLVI

SEQ ID NO: 827025 - protein, 23 aa, Mycobacterium
IPGQGFVDLPLPTTIPGASVLNG

SEQ ID NO: 827026 - protein, 17 aa, Mycobacterium
IPGQPPSLLNPPTGCRF

SEQ ID NO: 827027 - protein, 20 aa, Mycobacterium
IPGYERTLIGRALDFWNEEL

SEQ ID NO: 827028 - protein, 24 aa, Mycobacterium
IPGYPNFFTVFGPYGYVGSSYFAL

SEQ ID NO: 827029 - protein, 29 aa, Mycobacterium
IPHENLYGFAWNPMTLVGILKNIKGADTF

SEQ ID NO: 827030 - protein, 26 aa, Mycobacterium
IPHENLYGLAWNPMTLIGVLQNIKGT

SEQ ID NO: 827031 - protein, 18 aa, Mycobacterium
IPHGAVLPTQPRLKRGSR

SEQ ID NO: 827032 - protein, 18 aa, Mycobacterium
IPHGLLFERFLNPERPSA

SEQ ID NO: 827033 - protein, 20 aa, Mycobacterium
IPHGLLFERFLNPERTSMPD

SEQ ID NO: 827034 - protein, 26 aa, Mycobacterium
IPHKTVLSLEFARLAGYYLAEGHACL

SEQ ID NO: 827035 - protein, 18 aa, Mycobacterium
IPHMPIDVAALGADFFVF

SEQ ID NO: 827036 - protein, 22 aa, Mycobacterium
IPHVVRLAGRWLRPGGRFAVEH

SEQ ID NO: 827037 - protein, 21 aa, Mycobacterium
IPHWYVNPSETEECTAIWVST

SEQ ID NO: 827038 - protein, 18 aa, Mycobacterium
IPIDEATWAPAQIALAWA

SEQ ID NO: 827039 - protein, 18 aa, Mycobacterium
IPILVAAGHRVICPDLVG

SEQ ID NO: 827040 - protein, 18 aa, Mycobacterium
IPIMLGAEGPRNVALAAE

SEQ ID NO: 827041 - protein, 18 aa, Mycobacterium
IPIPGPGFINLANELYVR

SEQ ID NO: 827042 - protein, 19 aa, Mycobacterium
IPIPQDLALLLSASVQKYP

SEQ ID NO: 827043 - protein, 28 aa, Mycobacterium
IPIVMSDLKFMRFIAKEIFPGGSVPGEE

SEQ ID NO: 827044 - protein, 20 aa, Mycobacterium
IPIYDEDFVLALPPGHPLAG

SEQ ID NO: 827045 - protein, 17 aa, Mycobacterium
IPKDQPAGLYWYHPHFH

SEQ ID NO: 827046 - protein, 25 aa, Mycobacterium
IPKETLAFFLGIGVPIAEVWGMSEL

SEQ ID NO: 827047 - protein, 28 aa, Mycobacterium
IPKETLGFFCGIGIPITEIWGMSELSCV

SEQ ID NO: 827048 - protein, 35 aa, Mycobacterium
IPKLENVLKETLRLHPPLIILMRVAKGEFEVGGFP

SEQ ID NO: 827049 - protein, 19 aa, Mycobacterium
IPLAADHFRYFAAALRAQE

SEQ ID NO: 827050 - protein, 19 aa, Mycobacterium
IPLAALHYFPHRANSQILP

SEQ ID NO: 827051 - protein, 26 aa, Mycobacterium
IPLAEHDLLACWLLQANRMPVDGAVR

SEQ ID NO: 827052 - protein, 24 aa, Mycobacterium
IPLATLHLFPLRSNGQFVPFLPAR

SEQ ID NO: 827053 - protein, 20 aa, Mycobacterium
IPLEAPWEAKRAAKWDRMTL

SEQ ID NO: 827054 - protein, 18 aa, Mycobacterium
IPLGNDLIHAPTGAVLLQ

SEQ ID NO: 827055 - protein, 20 aa, Mycobacterium
IPLGPRMFHGKPIPPPLRTA

SEQ ID NO: 827056 - protein, 25 aa, Mycobacterium
IPLGTLQYVFPSKQGLLKAVIEDVV

SEQ ID NO: 827057 - protein, 20 aa, Mycobacterium
IPLLMVPPVINKFYIMDIAP

SEQ ID NO: 827058 - protein, 19 aa, Mycobacterium
IPLNLVLLKGITVRGMEIR

SEQ ID NO: 827059 - protein, 18 aa, Mycobacterium
IPLRVPPAELLPERTPHV

SEQ ID NO: 827060 - protein, 30 aa, Mycobacterium
IPLSFAQNRLWFIDQFQGPSPVYNIAVALR

SEQ ID NO: 827061 - protein, 23 aa, Mycobacterium
IPMATLHYIPMRPNGELIPRLPG

SEQ ID NO: 827062 - protein, 18 aa, Mycobacterium
IPMETAFAGPKKLADRIG

SEQ ID NO: 827063 - protein, 17 aa, Mycobacterium
IPMLHTYQELAAQAGWP

SEQ ID NO: 827064 - protein, 17 aa, Mycobacterium
IPNACCSVFLPTEIFDF

SEQ ID NO: 827065 - protein, 21 aa, Mycobacterium
IPNLALTRRYTPGLSDEEILA

SEQ ID NO: 827066 - protein, 17 aa, Mycobacterium
IPPFHVMDVWLAAAERQ

SEQ ID NO: 827067 - protein, 19 aa, Mycobacterium
IPPFYVMDVWLAAAERQRT

SEQ ID NO: 827068 - protein, 26 aa, Mycobacterium
IPPGSGWRKFIYAISFRQINLGESPR

SEQ ID NO: 827069 - protein, 24 aa, Mycobacterium
IPPYWAMMHKIKCPTLLTWGRDDR

SEQ ID NO: 827070 - protein, 23 aa, Mycobacterium
IPQAIEEILRWEPPALQMARYVT

SEQ ID NO: 827071 - protein, 25 aa, Mycobacterium
IPQEMLGRRWIPDLEAAAAGIATTI

SEQ ID NO: 827072 - protein, 24 aa, Mycobacterium
IPQGRYHLFRNVGPSMFLGVTLFP

SEQ ID NO: 827073 - protein, 17 aa, Mycobacterium
IPQQVVLPPERARLGFG

SEQ ID NO: 827074 - protein, 18 aa, Mycobacterium
IPQRGVSAAVLLVGVRPS

SEQ ID NO: 827075 - protein, 25 aa, Mycobacterium
IPQTWLLEFGIVDLNRGFNLLSEPE

SEQ ID NO: 827076 - protein, 17 aa, Mycobacterium
IPQVLAEAFHIASSGRP

SEQ ID NO: 827077 - protein, 18 aa, Mycobacterium
IPRDLHRRARAAVRIVQR

SEQ ID NO: 827078 - protein, 25 aa, Mycobacterium
IPRDLNKIALPWPITVRATAASVAP

SEQ ID NO: 827079 - protein, 25 aa, Mycobacterium
IPREEPWNRPLFAAPHRLNGNGELT

SEQ ID NO: 827080 - protein, 24 aa, Mycobacterium
IPRFLQGLGFSLSRQWTVAQVVRR

SEQ ID NO: 827081 - protein, 18 aa, Mycobacterium
IPRGGVFGRRQGAGVELA

SEQ ID NO: 827082 - protein, 19 aa, Mycobacterium
IPRHITVVERIGFTDAGKL

SEQ ID NO: 827083 - protein, 17 aa, Mycobacterium
IPRLAFATPSRRAVFHP

SEQ ID NO: 827084 - protein, 17 aa, Mycobacterium
IPRLIIALWDSELGANM

SEQ ID NO: 827085 - protein, 17 aa, Mycobacterium
IPRPVWTRLVSDLLTVG

SEQ ID NO: 827086 - protein, 17 aa, Mycobacterium
IPRVIAEAFHIARSGRP

SEQ ID NO: 827087 - protein, 24 aa, Mycobacterium
IPSAAPPWLAPLVDQPGAVKNAYR

SEQ ID NO: 827088 - protein, 25 aa, Mycobacterium
IPSDMRTFFDLWLDNDGYDCCDLLD

SEQ ID NO: 827089 - protein, 17 aa, Mycobacterium
IPSFIEESLRLESPVKS

SEQ ID NO: 827090 - protein, 22 aa, Mycobacterium
IPSFIYSFSFAQTGKWSRLFAP

SEQ ID NO: 827091 - protein, 25 aa, Mycobacterium
IPSGDTRAFLGSRIGVRRGAVVNAD

SEQ ID NO: 827092 - protein, 17 aa, Mycobacterium
IPSIALSLAPTASLTIT

SEQ ID NO: 827093 - protein, 17 aa, Mycobacterium
IPSPLEWGCFTFGIIQS

SEQ ID NO: 827094 - protein, 25 aa, Mycobacterium
IPSRTPRLRLKPKAPRIGFVDGAWW

SEQ ID NO: 827095 - protein, 26 aa, Mycobacterium
IPSYKSCFLAMLRRFYELGVKELNGH

SEQ ID NO: 827096 - protein, 25 aa, Mycobacterium
IPTDSGWRMLSGDETGWLLGDYILS

SEQ ID NO: 827097 - protein, 23 aa, Mycobacterium
IPTECEFFSLRGLALLTDTVEKV

SEQ ID NO: 827098 - protein, 18 aa, Mycobacterium
IPTGQFPLALDDADAFMG

SEQ ID NO: 827099 - protein, 24 aa, Mycobacterium
IPTGYLGPPPVPTSSPPTTPAGAP

SEQ ID NO: 827100 - protein, 21 aa, Mycobacterium
IPTHYPLETFIAVNPLAGLES

SEQ ID NO: 827101 - protein, 29 aa, Mycobacterium
IPTIKVNRLLLRNASLIGVAWGEFLRTHA

SEQ ID NO: 827102 - protein, 25 aa, Mycobacterium
IPTLPVDLDIYANFQTPISLDVGGT

SEQ ID NO: 827103 - protein, 19 aa, Mycobacterium
IPTLRPLQHRDYSIASSPL

SEQ ID NO: 827104 - protein, 19 aa, Mycobacterium
IPTPGFSSALAYYDALRTE

SEQ ID NO: 827105 - protein, 17 aa, Mycobacterium
IPTPIPRISYADAMRRF

SEQ ID NO: 827106 - protein, 22 aa, Mycobacterium
IPTRAMVRLLGLPDGDHVRFRR

SEQ ID NO: 827107 - protein, 21 aa, Mycobacterium
IPTVPMRVPETPALPPTRVPE

SEQ ID NO: 827108 - protein, 22 aa, Mycobacterium
IPTYRTIFYEELPDCLNALSVD

SEQ ID NO: 827109 - protein, 21 aa, Mycobacterium
IPVASIYQYFPSKAAMLAVSY

SEQ ID NO: 827110 - protein, 26 aa, Mycobacterium
IPVDDCYAALLWLARQPWVDPDRIAV

SEQ ID NO: 827111 - protein, 28 aa, Mycobacterium
IPVDGMEALLPLLHPIEPTTLTRHLPEG

SEQ ID NO: 827112 - protein, 18 aa, Mycobacterium
IPVDSIYSPVLKVTYKVD

SEQ ID NO: 827113 - protein, 24 aa, Mycobacterium
IPVEVHEFLLALGIPICEGYGMTE

SEQ ID NO: 827114 - protein, 21 aa, Mycobacterium
IPVEWTEGRDLWWHETVDKAD

SEQ ID NO: 827115 - protein, 22 aa, Mycobacterium
IPVIADIHFQPKYIFAAIDAGC

SEQ ID NO: 827116 - protein, 26 aa, Mycobacterium
IPVIADIHFQPKYIFAAIDAGCAAVR

SEQ ID NO: 827117 - protein, 18 aa, Mycobacterium
IPVIEPIGKLLKNDALSR

SEQ ID NO: 827118 - protein, 17 aa, Mycobacterium
IPVLAAAGHRVICPDLV

SEQ ID NO: 827119 - protein, 23 aa, Mycobacterium
IPVLALYGIPHRDCGSFAAGGFG

SEQ ID NO: 827120 - protein, 25 aa, Mycobacterium
IPVLLDAVYDPWPTPLAAAVAAAGG

SEQ ID NO: 827121 - protein, 20 aa, Mycobacterium
IPVMCLPGHRFAELDHFVGV

SEQ ID NO: 827122 - protein, 28 aa, Mycobacterium
IPVNPSDFVLWQKTLTGSLNGGCNPRND

SEQ ID NO: 827123 - protein, 19 aa, Mycobacterium
IPVPGFASALSYYDALRTE

SEQ ID NO: 827124 - protein, 19 aa, Mycobacterium
IPVRGMIPEILPRIDAEVA

SEQ ID NO: 827125 - protein, 20 aa, Mycobacterium
IPVRMHARSWHRYAEPPPDA

SEQ ID NO: 827126 - protein, 21 aa, Mycobacterium
IPVTTALLRPTWWEGDGPPVA

SEQ ID NO: 827127 - protein, 19 aa, Mycobacterium
IPVVAFRLKGDPGYTEFDI

SEQ ID NO: 827128 - protein, 18 aa, Mycobacterium
IPVVGSAFTLALVEAKCR

SEQ ID NO: 827129 - protein, 18 aa, Mycobacterium
IPVVSFRLKGKRPYTEFD

SEQ ID NO: 827130 - protein, 25 aa, Mycobacterium
IPVVSGHPSLWRMDALYAKTRGHSP

SEQ ID NO: 827131 - protein, 20 aa, Mycobacterium
IPWRVPEDLSHFKRITMGHT

SEQ ID NO: 827132 - protein, 25 aa, Mycobacterium
IPYAALEIMKLRLTPSGYQQAAGLA

SEQ ID NO: 827133 - protein, 29 aa, Mycobacterium
IPYARAPIGPLRFRAPRPPQPWSGVRHCH

SEQ ID NO: 827134 - protein, 26 aa, Mycobacterium
IPYEDTTLPGYLYLVDDRPRPTVIFN

SEQ ID NO: 827135 - protein, 24 aa, Mycobacterium
IPYPSQVFLTLFGLPLEDRDKLVA

SEQ ID NO: 827136 - protein, 25 aa, Mycobacterium
IPYQRFRGWEIAGRTAGLVGLGAVG

SEQ ID NO: 827137 - protein, 22 aa, Mycobacterium
IQADIYDEFLALAAIRTKAVRQ

SEQ ID NO: 827138 - protein, 19 aa, Mycobacterium
IQAEGLPYRSVLGLADLGL

SEQ ID NO: 827139 - protein, 26 aa, Mycobacterium
IQAHIERRFSMPWSAPAERMSEYVNA

SEQ ID NO: 827140 - protein, 21 aa, Mycobacterium
IQAIGQLPVDFGASGLSAMSV

SEQ ID NO: 827141 - protein, 32 aa, Mycobacterium
IQALAGVPVLLDAIYHPWPTPLAAAVTDAGGR

SEQ ID NO: 827142 - protein, 21 aa, Mycobacterium
IQALDALYPRLSPGGFCIVDD

SEQ ID NO: 827143 - protein, 23 aa, Mycobacterium
IQALDALYPRLSPGGFCIVDDYH

SEQ ID NO: 827144 - protein, 22 aa, Mycobacterium
IQALDFFFRKIVRDRGQALQFL

SEQ ID NO: 827145 - protein, 26 aa, Mycobacterium
IQALERLETLLALIEGWVQTVVTDAL

SEQ ID NO: 827146 - protein, 23 aa, Mycobacterium
IQAQDFFFRKIVRDKGVALAHVS

SEQ ID NO: 827147 - protein, 18 aa, Mycobacterium
IQAYDELFFPGLAAEWEK

SEQ ID NO: 827148 - protein, 22 aa, Mycobacterium
IQAYDQIVLPGPPGRWVQADGR

SEQ ID NO: 827149 - protein, 19 aa, Mycobacterium
IQCEVWEGFIFVNLDPHNT

SEQ ID NO: 827150 - protein, 21 aa, Mycobacterium
IQDATDFNPSWGWAAGAMVST

SEQ ID NO: 827151 - protein, 26 aa, Mycobacterium
IQDIATFACHIYYRGVGWTFVPTTLL

SEQ ID NO: 827152 - protein, 23 aa, Mycobacterium
IQDPYPLYRRMLDTAPVHPIADS

SEQ ID NO: 827153 - protein, 25 aa, Mycobacterium
IQDYQLQLVPKMLRMLRPDVTIGFF

SEQ ID NO: 827154 - protein, 17 aa, Mycobacterium
IQEFCSTTYGVTFPLLA

SEQ ID NO: 827155 - protein, 24 aa, Mycobacterium
IQEIRAQSKLLITIGACATAGGVQ

SEQ ID NO: 827156 - protein, 17 aa, Mycobacterium
IQELGWTIIPIVVSDVR

SEQ ID NO: 827157 - protein, 26 aa, Mycobacterium
IQERDMLLLLREVLEVAPAYLSAAVT

SEQ ID NO: 827158 - protein, 18 aa, Mycobacterium
IQEWCGYLGSLVGKEPVF

SEQ ID NO: 827159 - protein, 19 aa, Mycobacterium
IQEYLLGVTAKYGLRRYIE

SEQ ID NO: 827160 - protein, 26 aa, Mycobacterium
IQFADRITHIWTNTKMYLVAVHLEGP

SEQ ID NO: 827161 - protein, 22 aa, Mycobacterium
IQFGDRVTSFLPTAHIADRMTG

SEQ ID NO: 827162 - protein, 18 aa, Mycobacterium
IQGAFSHFAFAHSLPFDI

SEQ ID NO: 827163 - protein, 21 aa, Mycobacterium
IQGLDALYPRLSPGGFCIIDD

SEQ ID NO: 827164 - protein, 24 aa, Mycobacterium
IQGLVSAVRLLRSEGRDVAWWACA

SEQ ID NO: 827165 - protein, 28 aa, Mycobacterium
IQGPEDLPALFLDFLENLPVIGTVVEIV

SEQ ID NO: 827166 - protein, 17 aa, Mycobacterium
IQGPRFSTRAESRWFAG

SEQ ID NO: 827167 - protein, 20 aa, Mycobacterium
IQGVKSHALVLSRLRAGQAP

SEQ ID NO: 827168 - protein, 19 aa, Mycobacterium
IQGVWVHPEWRGLGLGTAG

SEQ ID NO: 827169 - protein, 26 aa, Mycobacterium
IQHGSPPLALLTKLIEELSAGSGLRI

SEQ ID NO: 827170 - protein, 17 aa, Mycobacterium
IQHRPTTALPAPAPHHI

SEQ ID NO: 827171 - protein, 19 aa, Mycobacterium
IQIAASHPPAFPPGAQFDY

SEQ ID NO: 827172 - protein, 17 aa, Mycobacterium
IQIDTTNVLFIVAGAFA

SEQ ID NO: 827173 - protein, 26 aa, Mycobacterium
IQIMPQVWAMRYTLERVVRGKDTIAA

SEQ ID NO: 827174 - protein, 22 aa, Mycobacterium
IQLARLTWRIQGLRITVTGVEN

SEQ ID NO: 827175 - protein, 26 aa, Mycobacterium
IQLDRSVLHVLLDRPRKRNALDLTMI

SEQ ID NO: 827176 - protein, 21 aa, Mycobacterium
IQLHQATARMDRGRLGALIAE

SEQ ID NO: 827177 - protein, 18 aa, Mycobacterium
IQLPPVPHQPPQLGEPPV

SEQ ID NO: 827178 - protein, 18 aa, Mycobacterium
IQLSYADGDIWDWAVDWD

SEQ ID NO: 827179 - protein, 17 aa, Mycobacterium
IQLYHRTAAQVDLHGKR

SEQ ID NO: 827180 - protein, 22 aa, Mycobacterium
IQNKTYYLPSEGRRIRLRVSAK

SEQ ID NO: 827181 - protein, 28 aa, Mycobacterium
IQPAMSGSVLQLLQPLQAVTSLFSLGSS

SEQ ID NO: 827182 - protein, 18 aa, Mycobacterium
IQPGFYRMRTEIPAANAV

SEQ ID NO: 827183 - protein, 17 aa, Mycobacterium
IQPGKRPRSSMAPTFVF

SEQ ID NO: 827184 - protein, 26 aa, Mycobacterium
IQPHETRLLLRKSLRLLRDKQNGPKV

SEQ ID NO: 827185 - protein, 23 aa, Mycobacterium
IQPKLTFSWRIMPQNLSDAGISW

SEQ ID NO: 827186 - protein, 17 aa, Mycobacterium
IQPLIQAMSFGLTAAEM

SEQ ID NO: 827187 - protein, 19 aa, Mycobacterium
IQPLKAPDIVLRAVAKLPG

SEQ ID NO: 827188 - protein, 17 aa, Mycobacterium
IQPVLVGVQLALTALWR

SEQ ID NO: 827189 - protein, 18 aa, Mycobacterium
IQPYLADVPVAVGGVTVV

SEQ ID NO: 827190 - protein, 23 aa, Mycobacterium
IQQWNQIIAVNLTGTFLVVREAL

SEQ ID NO: 827191 - protein, 37 aa, Mycobacterium
IQRGQGRWYPGEPLPRWQIALYWRTDGRPLWTDDTLL

SEQ ID NO: 827192 - protein, 20 aa, Mycobacterium
IQRILTKLGLPEAADDHRRV

SEQ ID NO: 827193 - protein, 18 aa, Mycobacterium
IQRIVLLEALAVLGWERW

SEQ ID NO: 827194 - protein, 19 aa, Mycobacterium
IQRLAACAHALRSPLVSEH

SEQ ID NO: 827195 - protein, 18 aa, Mycobacterium
IQRLTPLGYFEHRGRRFV

SEQ ID NO: 827196 - protein, 20 aa, Mycobacterium
IQRMWAGWLPPFATIEHVGR

SEQ ID NO: 827197 - protein, 31 aa, Mycobacterium
IQRPLPDELPAAALWWRLAAELTPAATVDAP

SEQ ID NO: 827198 - protein, 25 aa, Mycobacterium
IQRRAELLVYIALSRFTGRPRFAQL

SEQ ID NO: 827199 - protein, 31 aa, Mycobacterium
IQRTLMPLTGQLLKFALYRTADDEFHLFGLC

SEQ ID NO: 827200 - protein, 27 aa, Mycobacterium
IQRVAGRLAAAGWPLAGIEVSQVIPED

SEQ ID NO: 827201 - protein, 22 aa, Mycobacterium
IQRVAGVLAAAGWPLAGIDLSE

SEQ ID NO: 827202 - protein, 17 aa, Mycobacterium
IQRYGGVSRYFFELASR

SEQ ID NO: 827203 - protein, 19 aa, Mycobacterium
IQSEILFTFTGLEPRVLSF

SEQ ID NO: 827204 - protein, 30 aa, Mycobacterium
IQSNALYMDRYPLVSAISRPLIVKHLVAAA

SEQ ID NO: 827205 - protein, 31 aa, Mycobacterium
IQSNALYMDRYPLVSAISRPLIVKHLVKAAR

SEQ ID NO: 827206 - protein, 31 aa, Mycobacterium
IQSNALYMDRYPLVSALSRPLIVKHLVDAAR

SEQ ID NO: 827207 - protein, 19 aa, Mycobacterium
IQSQRLVRHPLLAAAAHSG

SEQ ID NO: 827208 - protein, 23 aa, Mycobacterium
IQSRQDILTGERDKLLGRIAAAD

SEQ ID NO: 827209 - protein, 19 aa, Mycobacterium
IQSWRRLAGLPQPKRAARH

SEQ ID NO: 827210 - protein, 33 aa, Mycobacterium; identical to SEQ ID NO: 120731

SEQ ID NO: 827211 - protein, 17 aa, Mycobacterium
IQTGWALARALGAIEGT

SEQ ID NO: 827212 - protein, 17 aa, Mycobacterium
IQTRELIILLTEEDNVG

SEQ ID NO: 827213 - protein, 24 aa, Mycobacterium
IQTTPSQLVLWADNYRTGKVGGQK

SEQ ID NO: 827214 - protein, 18 aa, Mycobacterium
IQVFDSWAGTLSLADYRA

SEQ ID NO: 827215 - protein, 26 aa, Mycobacterium
IQVHLKGHFAVLRHAAEYWKGQAKAG

SEQ ID NO: 827216 - protein, 29 aa, Mycobacterium
IQVHLYGGYYVTRAAWPHMREQKFGRVVM

SEQ ID NO: 827217 - protein, 26 aa, Mycobacterium
IQVMRDMLAAPDQFDWLATRLEIARK

SEQ ID NO: 827218 - protein, 25 aa, Mycobacterium
IQVMRDMLAAPEQFDWLATRLEIAR

SEQ ID NO: 827219 - protein, 26 aa, Mycobacterium
IQVYQRWFESFANISWPAARELGKPY

SEQ ID NO: 827220 - protein, 17 aa, Mycobacterium
IRAAFDATRRGGAVTLV

SEQ ID NO: 827221 - protein, 18 aa, Mycobacterium
IRACALTFLSDFGPVPAA

SEQ ID NO: 827222 - protein, 29 aa, Mycobacterium
IRADLVADDLPRLVAMLFSVLSTMDANSD

SEQ ID NO: 827223 - protein, 20 aa, Mycobacterium
IRADRFWVMGPPTSADEVVS

SEQ ID NO: 827224 - protein, 25 aa, Mycobacterium
IRAEADLARFPADVARVVVRLIHTC

SEQ ID NO: 827225 - protein, 18 aa, Mycobacterium
IRAEHESKLWIRKMEMAI

SEQ ID NO: 827226 - protein, 38 aa, Mycobacterium
IRAELADRLPPYMVPTAIVVLPALPLTSSNKLDTRALP

SEQ ID NO: 827227 - protein, 18 aa, Mycobacterium
IRAFNALFPGRMFGGGAL

SEQ ID NO: 827228 - protein, 25 aa, Mycobacterium
IRAGEKVVMFYPSGNWDTEAFDHPE

SEQ ID NO: 827229 - protein, 24 aa, Mycobacterium
IRAGERVVMLYPSANFDEEVFENP

SEQ ID NO: 827230 - protein, 29 aa, Mycobacterium
IRAGGLNWSSLPLKLFAGGNAKFWDPADI

SEQ ID NO: 827231 - protein, 19 aa, Mycobacterium
IRAGMVDEFNFFVVPKVVG

SEQ ID NO: 827232 - protein, 24 aa, Mycobacterium
IRAGRQLWCQLFSEPGAGSDLASL

SEQ ID NO: 827233 - protein, 20 aa, Mycobacterium
IRALADLWRSLSRQDVFPTR

SEQ ID NO: 827234 - protein, 26 aa, Mycobacterium
IRALNPLINRLPVKALYTPWAARAWA

SEQ ID NO: 827235 - protein, 21 aa, Mycobacterium
IRALTVAALAPRPGERLWDVG

SEQ ID NO: 827236 - protein, 26 aa, Mycobacterium
IRANHAFIYVRGEVLPVLRRLQNAVA

SEQ ID NO: 827237 - protein, 21 aa, Mycobacterium
IRANIAAVQLLRALQDAQRPA

SEQ ID NO: 827238 - protein, 24 aa, Mycobacterium
IRANIRALLQMAVVLTYGASMPVV

SEQ ID NO: 827239 - protein, 24 aa, Mycobacterium
IRAPRIGQRLQKLGMKRIRLSTER

SEQ ID NO: 827240 - protein, 17 aa, Mycobacterium
IRARAPLRISFAGGGTD

SEQ ID NO: 827241 - protein, 19 aa, Mycobacterium
IRARFPALTARQVMQRIES

SEQ ID NO: 827242 - protein, 21 aa, Mycobacterium
IRARHRDYYTSMAALLDTPGR

SEQ ID NO: 827243 - protein, 17 aa, Mycobacterium
IRARRAVILGSGGFEHN

SEQ ID NO: 827244 - protein, 24 aa, Mycobacterium
IRASGLPYALFRLGGVISPDTHTT

SEQ ID NO: 827245 - protein, 26 aa, Mycobacterium
IRASQNLVPRVFWLTYQGGRDEMLPF

SEQ ID NO: 827246 - protein, 24 aa, Mycobacterium
IRATHIEPLLYTLVSGRLAMPDAI

SEQ ID NO: 827247 - protein, 24 aa, Mycobacterium
IRATVIKRYGLFGRMVSAFNSRRV

SEQ ID NO: 827248 - protein, 20 aa, Mycobacterium
IRAVIGRRLLEVNPCFDRLA

SEQ ID NO: 827249 - protein, 20 aa, Mycobacterium
IRAVLDWMTDYPHRYEFMRS

SEQ ID NO: 827250 - protein, 21 aa, Mycobacterium
IRAVTLAALAPRPGERLWDVG

SEQ ID NO: 827251 - protein, 18 aa, Mycobacterium
IRAWIDTWNDNPKPYVWT

SEQ ID NO: 827252 - protein, 22 aa, Mycobacterium
IRAYRERGLLDPPRRVGRSAYY

SEQ ID NO: 827253 - protein, 25 aa, Mycobacterium
IRDEAVHGYYIGYKFQRGLAAADEA

SEQ ID NO: 827254 - protein, 20 aa, Mycobacterium
IRDEEKVVWLSQTTLSVDET

SEQ ID NO: 827255 - protein, 18 aa, Mycobacterium
IRDELLHKVIDVCNPGDF

SEQ ID NO: 827256 - protein, 24 aa, Mycobacterium
IRDGLLYVFLPPVDELEHFIDLIA

SEQ ID NO: 827257 - protein, 18 aa, Mycobacterium
IRDIALRLVSGIADAHGV

SEQ ID NO: 827258 - protein, 21 aa, Mycobacterium
IRDIAWFIEELRVSLWAQQLG

SEQ ID NO: 827259 - protein, 18 aa, Mycobacterium
IRDKPAWLDRAWTRIAEE

SEQ ID NO: 827260 - protein, 29 aa, Mycobacterium
IRDPDYPAALYANFFPRYLRGISDDADAQ

SEQ ID NO: 827261 - protein, 19 aa, Mycobacterium
IRDRVLQAAKLLDLEAYLD

SEQ ID NO: 827262 - protein, 27 aa, Mycobacterium
IRDTRKTLPGLRLLQKYAVRVGGGVNH

SEQ ID NO: 827263 - protein, 18 aa, Mycobacterium
IRDWVKLAVTRARLSGMP

SEQ ID NO: 827264 - protein, 19 aa, Mycobacterium
IRDWWVAQFAQPRQQRVVG

SEQ ID NO: 827265 - protein, 18 aa, Mycobacterium
IREAAKFWVGLKAAKRQR

SEQ ID NO: 827266 - protein, 24 aa, Mycobacterium
IREAAKLIAQARKPVLYVGGGVIR

SEQ ID NO: 827267 - protein, 19 aa, Mycobacterium
IREADVASALWHPNIVRVN

SEQ ID NO: 827268 - protein, 23 aa, Mycobacterium
IREDAGWVIGQWTAPPGVTAVHV

SEQ ID NO: 827269 - protein, 23 aa, Mycobacterium
IREEWLPLFDQYQVDLVVCGHEH

SEQ ID NO: 827270 - protein, 19 aa, Mycobacterium
IREFGLMQPIVVRAVPVDG

SEQ ID NO: 827271 - protein, 30 aa, Mycobacterium
IREFVEATGIPFLPMSMAKGLLPDSHPQSA

SEQ ID NO: 827272 - protein, 18 aa, Mycobacterium
IREGAVAAWPGAWQGQNL

SEQ ID NO: 827273 - protein, 19 aa, Mycobacterium
IREGAVAAWPGAWQGQNLR

SEQ ID NO: 827274 - protein, 19 aa, Mycobacterium
IREHSAWWPVAATPEELAA

SEQ ID NO: 827275 - protein, 27 aa, Mycobacterium
IREKAGLPPATYFAGGKIQWILENVPG

SEQ ID NO: 827276 - protein, 30 aa, Mycobacterium
IREKILAADILVLSSPIWLGHPASVTQRVL

SEQ ID NO: 827277 - protein, 27 aa, Mycobacterium
IRELGIGLVAYSPLGRGFLTGAIGSRD

SEQ ID NO: 827278 - protein, 19 aa, Mycobacterium
IRELLARLGYRFTPKQIPE

SEQ ID NO: 827279 - protein, 19 aa, Mycobacterium
IRELLLKSHEPGAAIPTLH

SEQ ID NO: 827280 - protein, 19 aa, Mycobacterium
IRELRIIPQIISGFDAEGL

SEQ ID NO: 827281 - protein, 37 aa, Mycobacterium
IREPIGVCVLIAPWNYPLLQMSWKVAPALAAGCTMVA

SEQ ID NO: 827282 - protein, 17 aa, Mycobacterium
IREPLVGLGLPRTGSTA

SEQ ID NO: 827283 - protein, 26 aa, Mycobacterium
IREQVGAQNFFLFGLTVQDVQRVLAA

SEQ ID NO: 827284 - protein, 21 aa, Mycobacterium
IRERFGGRLRFFVSAAAALDR

SEQ ID NO: 827285 - protein, 23 aa, Mycobacterium
IRERHRRLWHLVADAIEIADTAT

SEQ ID NO: 827286 - protein, 19 aa, Mycobacterium
IRERPARRPAWRPAASIRS

SEQ ID NO: 827287 - protein, 23 aa, Mycobacterium
IRERQLLIVLDNCEHLLDASSKL

SEQ ID NO: 827288 - protein, 18 aa, Mycobacterium
IRERSTTVAMHLLRRALG

SEQ ID NO: 827289 - protein, 18 aa, Mycobacterium
IRERYELVRTWMLAAETS

SEQ ID NO: 827290 - protein, 22 aa, Mycobacterium
IRESGNFILFEAPAVVLATGGI

SEQ ID NO: 827291 - protein, 23 aa, Mycobacterium
IRESVPDWLVWTHGCPGGESVAQ

SEQ ID NO: 827292 - protein, 21 aa, Mycobacterium
IRETLDLLTRVFPARTCSAGV

SEQ ID NO: 827293 - protein, 17 aa, Mycobacterium
IREVGAPAPSPTARSWT

SEQ ID NO: 827294 - protein, 20 aa, Mycobacterium
IREVLLRDGLQLETPIALAD

SEQ ID NO: 827295 - protein, 17 aa, Mycobacterium
IRFDSRLLGSVGSAPHI

SEQ ID NO: 827296 - protein, 18 aa, Mycobacterium
IRFRCHDDSWESLHCATQ

SEQ ID NO: 827297 - protein, 29 aa, Mycobacterium
IRFYSETLGMPLKFRDGAHFAALDAGPVT

SEQ ID NO: 827298 - protein, 24 aa, Mycobacterium
IRGALFPARKYWPTQRSLLDGART

SEQ ID NO: 827299 - protein, 18 aa, Mycobacterium
IRGAVMLGVYYNEYQSAS

SEQ ID NO: 827300 - protein, 36 aa, Mycobacterium
IRGDRIVLSPLWPEYLGALGFPIHYRGNHLHLRVSG

SEQ ID NO: 827301 - protein, 19 aa, Mycobacterium
IRGEECSAYWPAGTAAFHV

SEQ ID NO: 827302 - protein, 20 aa, Mycobacterium
IRGEECSAYWPAGTAAWHIN

SEQ ID NO: 827303 - protein, 19 aa, Mycobacterium
IRGGHLDVAVLGAMQVSAA

SEQ ID NO: 827304 - protein, 28 aa, Mycobacterium
IRGGPHLKFQLLWYPGTTSDLSLPSVVE

SEQ ID NO: 827305 - protein, 18 aa, Mycobacterium
IRGIVVDTAWFKGNYPPE

SEQ ID NO: 827306 - protein, 18 aa, Mycobacterium
IRGKVRTWTDLEPALIGR

SEQ ID NO: 827307 - protein, 25 aa, Mycobacterium
IRGLPEVFRALIACIMLVLERDSSA

SEQ ID NO: 827308 - protein, 27 aa, Mycobacterium
IRGLVKKYSDFIAWPIRMEVERRQPPT

SEQ ID NO: 827309 - protein, 27 aa, Mycobacterium
IRGMHLAYDLLEGWDTLVLVDAVPSRG

SEQ ID NO: 827310 - protein, 25 aa, Mycobacterium
IRGNIRALLQMAVVLTYGASLPVVK

SEQ ID NO: 827311 - protein, 18 aa, Mycobacterium
IRGRLHPVPADMIGATLD

SEQ ID NO: 827312 - protein, 18 aa, Mycobacterium
IRGSWLTVARLAKCGPWH

SEQ ID NO: 827313 - protein, 39 aa, Mycobacterium
IRGTQECLPTLLTPGQRLLVFLPLAHVLARALTLSAFAS

SEQ ID NO: 827314 - protein, 19 aa, Mycobacterium
IRGVNLERAVLAATLAQIE

SEQ ID NO: 827315 - protein, 20 aa, Mycobacterium
IRGVVKAANPIDILGSLFGR

SEQ ID NO: 827316 - protein, 19 aa, Mycobacterium
IRHDAGWISNPLPVDFLSK

SEQ ID NO: 827317 - protein, 28 aa, Mycobacterium
IRHEAAKPGSYFWFKGGKRAAQLPAEQQ

SEQ ID NO: 827318 - protein, 18 aa, Mycobacterium
IRHGNLAELPLPDASVDV

SEQ ID NO: 827319 - protein, 25 aa, Mycobacterium
IRHLEMLATFLKWRSDTRGELTEVG

SEQ ID NO: 827320 - protein, 17 aa, Mycobacterium
IRIAGARALELAGLGID

SEQ ID NO: 827321 - protein, 20 aa, Mycobacterium
IRIAWRAWLQMRVRIVDEYN

SEQ ID NO: 827322 - protein, 28 aa, Mycobacterium
IRIDDKPMPLFQLLVLCMLASKPIDATI

SEQ ID NO: 827323 - protein, 18 aa, Mycobacterium
IRIDLSTLRILGDGLAWA

SEQ ID NO: 827324 - protein, 23 aa, Mycobacterium
IRIGAWFLENGHRALLALTGGRY

SEQ ID NO: 827325 - protein, 27 aa, Mycobacterium
IRIGGDMALFAGLGKLLLEAEDKAPGT

SEQ ID NO: 827326 - protein, 20 aa, Mycobacterium
IRIGGDMALFAGLGRLLLEA

SEQ ID NO: 827327 - protein, 20 aa, Mycobacterium
IRIGIRMSYWAATARKDLDV

SEQ ID NO: 827328 - protein, 28 aa, Mycobacterium
IRIGRRIMARLNWRKLGPGPTQPPTPPL

SEQ ID NO: 827329 - protein, 23 aa, Mycobacterium
IRIGRRIVARLNWRKQGPAPAEV

SEQ ID NO: 827330 - protein, 30 aa, Mycobacterium
IRINAICPGFIETPLFDSVMGLPGMEGPRD

SEQ ID NO: 827331 - protein, 20 aa, Mycobacterium
IRIPLGLAHRPDPANVAWVL

SEQ ID NO: 827332 - protein, 18 aa, Mycobacterium
IRIPVHMVEVINKLGRIQ

SEQ ID NO: 827333 - protein, 19 aa, Mycobacterium
IRKALLTHKVIFFRSQHHL

SEQ ID NO: 827334 - protein, 22 aa, Mycobacterium
IRKALPLWAARLTGIPTVVHAH

SEQ ID NO: 827335 - protein, 18 aa, Mycobacterium
IRKAVRYQIKHGAQLIKV

SEQ ID NO: 827336 - protein, 23 aa, Mycobacterium
IRKELANVLALRELNRLNNARAK

SEQ ID NO: 827337 - protein, 25 aa, Mycobacterium
IRKGEWVALFFGSANRDPAVFPDPG

SEQ ID NO: 827338 - protein, 20 aa, Mycobacterium
IRKIRAAFGVLDQFREHDLT

SEQ ID NO: 827339 - protein, 26 aa, Mycobacterium
IRKTRITLEWLRNNGYHKLLATAVLA

SEQ ID NO: 827340 - protein, 17 aa, Mycobacterium
IRLAGLVAHQEVLFGTL

SEQ ID NO: 827341 - protein, 18 aa, Mycobacterium
IRLAYDFVNIQAANLVKD

SEQ ID NO: 827342 - protein, 18 aa, Mycobacterium
IRLDLAQELARQLGAPAV

SEQ ID NO: 827343 - protein, 26 aa, Mycobacterium
IRLDRPAYVYPLFEQALRIANGESVD

SEQ ID NO: 827344 - protein, 17 aa, Mycobacterium
IRLFHAETVFVDVDTAM

SEQ ID NO: 827345 - protein, 22 aa, Mycobacterium
IRLGLLAGHYRGDRYWSQQVLD

SEQ ID NO: 827346 - protein, 17 aa, Mycobacterium
IRLGPWVIPEHHAVLTS

SEQ ID NO: 827347 - protein, 29 aa, Mycobacterium
IRLGRRPHPTPLDPWTWTALQRCISHRDT

SEQ ID NO: 827348 - protein, 17 aa, Mycobacterium
IRLGVGVLAVRKAGKLP

SEQ ID NO: 827349 - protein, 19 aa, Mycobacterium
IRLIFQRAREKASDGTPVI

SEQ ID NO: 827350 - protein, 19 aa, Mycobacterium
IRLIFQRAREKASEGTPVI

SEQ ID NO: 827351 - protein, 17 aa, Mycobacterium
IRLLGEQSTLYLPVFAE

SEQ ID NO: 827352 - protein, 18 aa, Mycobacterium
IRLLNPRQWSERTVIALV

SEQ ID NO: 827353 - protein, 20 aa, Mycobacterium
IRLLPGMLTGPVRLAEVARV

SEQ ID NO: 827354 - protein, 17 aa, Mycobacterium
IRLPRHAGSLPVAIAVS

SEQ ID NO: 827355 - protein, 20 aa, Mycobacterium
IRLQNRLGAHDLLNEYIRHI

SEQ ID NO: 827356 - protein, 17 aa, Mycobacterium
IRLRRLGFHLSRVQQQL

SEQ ID NO: 827357 - protein, 25 aa, Mycobacterium
IRLRTFVRVPYRARIPMTRAALMHR

SEQ ID NO: 827358 - protein, 21 aa, Mycobacterium
IRLVIEWLDRYAEALPLTVIG

SEQ ID NO: 827359 - protein, 24 aa, Mycobacterium
IRLVPDLSTLRRVPWEPTAALVIC

SEQ ID NO: 827360 - protein, 23 aa, Mycobacterium
IRLYKRMFIPGIENLVFMGFAQA

SEQ ID NO: 827361 - protein, 18 aa, Mycobacterium
IRLYKRMFKPGIDDLVFI

SEQ ID NO: 827362 - protein, 17 aa, Mycobacterium
IRMAVLFHLLVGSSDSP

SEQ ID NO: 827363 - protein, 17 aa, Mycobacterium
IRMLLDAKVPAEDLASL

SEQ ID NO: 827364 - protein, 17 aa, Mycobacterium
IRMMAGLGEALGFDVDT

SEQ ID NO: 827365 - protein, 25 aa, Mycobacterium
IRNGIERLKIDLAELAPAGVRSSAT

SEQ ID NO: 827366 - protein, 18 aa, Mycobacterium
IRNLLWEGTGPDTAALAP

SEQ ID NO: 827367 - protein, 20 aa, Mycobacterium
IRNRLTLGVLVAAAPDVAAG

SEQ ID NO: 827368 - protein, 22 aa, Mycobacterium
IRNRVGLPGIWYAGSHGFDLMA

SEQ ID NO: 827369 - protein, 20 aa, Mycobacterium
IRNSALLDEHEIVFVPGVNE

SEQ ID NO: 827370 - protein, 36 aa, Mycobacterium
IRNVPLTLMHVIAPVVPAVAPWPAIPIPQDYFERQD

SEQ ID NO: 827371 - protein, 18 aa, Mycobacterium
IRNVQLLGVPHGLSPARV

SEQ ID NO: 827372 - protein, 24 aa, Mycobacterium
IRPAGQRDVALPQPQRLARLVDGH

SEQ ID NO: 827373 - protein, 18 aa, Mycobacterium
IRPEHLLVGVLQSAGRDL

SEQ ID NO: 827374 - protein, 18 aa, Mycobacterium
IRPELRPVHNTYYARWHE

SEQ ID NO: 827375 - protein, 26 aa, Mycobacterium
IRPSLRPAQRWMLSAGVLSVIGSIVD

SEQ ID NO: 827376 - protein, 27 aa, Mycobacterium
IRPSYEWPGHKPGQYVRLGLVIDGRYH

SEQ ID NO: 827377 - protein, 19 aa, Mycobacterium
IRPVDFRGRFYRVGGPLDG

SEQ ID NO: 827378 - protein, 17 aa, Mycobacterium
IRPYTWPYPEISTAAMI

SEQ ID NO: 827379 - protein, 26 aa, Mycobacterium
IRQADLDYWRPLMADLPEPLELPGPN

SEQ ID NO: 827380 - protein, 20 aa, Mycobacterium
IRQKIEVVVLTGIHLDWCIE

SEQ ID NO: 827381 - protein, 18 aa, Mycobacterium
IRQLLPNRRVVVASPDYL

SEQ ID NO: 827382 - protein, 17 aa, Mycobacterium
IRQPTPQEWHILGERLT

SEQ ID NO: 827383 - protein, 29 aa, Mycobacterium
IRQRAVEPLPPPAPGRLPPLTPGEMATPR

SEQ ID NO: 827384 - protein, 22 aa, Mycobacterium
IRQRYQRLWDLVATAAGRADEA

SEQ ID NO: 827385 - protein, 31 aa, Mycobacterium
IRQSYFEDPAYVPLLLRAYELWAGLAADSGR

SEQ ID NO: 827386 - protein, 30 aa, Mycobacterium
IRQSYFEDPGYVPLLLRSYELWERLAIDAQ

SEQ ID NO: 827387 - protein, 24 aa, Mycobacterium
IRQTLGMTFVNLIWRNLASIPGAL

SEQ ID NO: 827388 - protein, 20 aa, Mycobacterium
IRQTVIDRGLIGDKLSIEEL

SEQ ID NO: 827389 - protein, 21 aa, Mycobacterium
IRQTVIDRGLIGDKLSIEELD

SEQ ID NO: 827390 - protein, 22 aa, Mycobacterium
IRQTVIDRGLIGDKLSLEELDR

SEQ ID NO: 827391 - protein, 18 aa, Mycobacterium
IRQVPPADRRVLVLGASG

SEQ ID NO: 827392 - protein, 26 aa, Mycobacterium
IRRAPARWPVPWPNSNAIRTSTPATS

SEQ ID NO: 827393 - protein, 24 aa, Mycobacterium
IRRDLKVLAGRRLLKRVHGGAVPL

SEQ ID NO: 827394 - protein, 19 aa, Mycobacterium
IRRDRLLEVMNSEIWPLLQ

SEQ ID NO: 827395 - protein, 27 aa, Mycobacterium
IRREAAKPGSYFWLKGGKRPAQSPTGE

SEQ ID NO: 827396 - protein, 18 aa, Mycobacterium
IRREDFYLCAGRLVPYKR

SEQ ID NO: 827397 - protein, 21 aa, Mycobacterium
IRREMDRLFANNGPSAVLGPT

SEQ ID NO: 827398 - protein, 20 aa, Mycobacterium
IRRFGDAFIPMDESLAHAAV

SEQ ID NO: 827399 - protein, 17 aa, Mycobacterium
IRRHCAIAAFADIDELE

SEQ ID NO: 827400 - protein, 22 aa, Mycobacterium
IRRIEMLEQLGWIVIRVVAEDR

SEQ ID NO: 827401 - protein, 20 aa, Mycobacterium
IRRKEILERLGWTVIRVLAG

SEQ ID NO: 827402 - protein, 26 aa, Mycobacterium
IRRLTTIDVLIIDDFALRPLGATETS

SEQ ID NO: 827403 - protein, 20 aa, Mycobacterium
IRRLWPDFRAVERAYFEATQ

SEQ ID NO: 827404 - protein, 19 aa, Mycobacterium
IRRPVRFSDSVACARAQGA

SEQ ID NO: 827405 - protein, 22 aa, Mycobacterium
IRRQFHRGRLLAMGPRCLMTSM

SEQ ID NO: 827406 - protein, 21 aa, Mycobacterium
IRRRETLERLGWIVIRVVVND

SEQ ID NO: 827407 - protein, 23 aa, Mycobacterium
IRRRTIFITQHRITELMRLHAEG

SEQ ID NO: 827408 - protein, 24 aa, Mycobacterium
IRRVARLVHALPPAPTGPTTLARD

SEQ ID NO: 827409 - protein, 20 aa, Mycobacterium
IRRVTRARLGTRRIRRSCRP

SEQ ID NO: 827410 - protein, 18 aa, Mycobacterium
IRRYGQLEERFVALGGYG

SEQ ID NO: 827411 - protein, 27 aa, Mycobacterium
IRRYQATYMNYVGKPLAYILATPERDD

SEQ ID NO: 827412 - protein, 28 aa, Mycobacterium
IRSFEPGEDWFWDYAENAYIDGPELAPP

SEQ ID NO: 827413 - protein, 18 aa, Mycobacterium
IRSFGTYTPTLFLTARDS

SEQ ID NO: 827414 - protein, 21 aa, Mycobacterium
IRSGFRFDAMVDRLALADPRS

SEQ ID NO: 827415 - protein, 25 aa, Mycobacterium
IRSGLYHKVILSRRVEVPFAMDFPS

SEQ ID NO: 827416 - protein, 25 aa, Mycobacterium
IRSGTAHLVVWPTDSTLGGADDRRH

SEQ ID NO: 827417 - protein, 24 aa, Mycobacterium
IRSGTAHVVVWPTGSASGVEDRRH

SEQ ID NO: 827418 - protein, 21 aa, Mycobacterium
IRSHYPVLARALLSGASGQLR

SEQ ID NO: 827419 - protein, 24 aa, Mycobacterium
IRSIGLRLGVPWYAYDTITFTGEV

SEQ ID NO: 827420 - protein, 19 aa, Mycobacterium
IRSILSYELFVDHGSMAAL

SEQ ID NO: 827421 - protein, 17 aa, Mycobacterium
IRSLLREAPDSFGLADG

SEQ ID NO: 827422 - protein, 18 aa, Mycobacterium
IRSSLIHWAAANVSNPGA

SEQ ID NO: 827423 - protein, 24 aa, Mycobacterium
IRSSNLEWVILRLGGVISVDPEAM

SEQ ID NO: 827424 - protein, 37 aa, Mycobacterium
IRSTAELTIVSWLPFYHDMGLVLGVCAPILGGHPAKL

SEQ ID NO: 827425 - protein, 20 aa, Mycobacterium
IRSVLAVPVLVDGRARAMLY

SEQ ID NO: 827426 - protein, 25 aa, Mycobacterium
IRTARGLLLDIIDVGLPVGCEFLEP

SEQ ID NO: 827427 - protein, 24 aa, Mycobacterium
IRTDEPDRRFTPGASLRAKRSRDG

SEQ ID NO: 827428 - protein, 18 aa, Mycobacterium
IRTDPAAIRRRIGYVFPG

SEQ ID NO: 827429 - protein, 25 aa, Mycobacterium
IRTPGRGWQHRWALSVLHTALGGGL

SEQ ID NO: 827430 - protein, 25 aa, Mycobacterium
IRTQIRVYLLVEDLQRQFAAYLGTP

SEQ ID NO: 827431 - protein, 23 aa, Mycobacterium
IRTRPQVMDVYFLAGGDDFILHV

SEQ ID NO: 827432 - protein, 23 aa, Mycobacterium
IRTSGMLMVAPYVARMTPQLLSI

SEQ ID NO: 827433 - protein, 20 aa, Mycobacterium
IRTVCRPDRWLELRYVAAGS

SEQ ID NO: 827434 - protein, 26 aa, Mycobacterium
IRTVERLPWLTVIPAYLVGVGVRPER

SEQ ID NO: 827435 - protein, 23 aa, Mycobacterium
IRTVNPKIVYARGSALGPRGPES

SEQ ID NO: 827436 - protein, 20 aa, Mycobacterium
IRVAATLAAAGWPLAGIDVS

SEQ ID NO: 827437 - protein, 17 aa, Mycobacterium
IRVARSLVGPYITSLDM

SEQ ID NO: 827438 - protein, 19 aa, Mycobacterium
IRVEEPYVLILPTYGGGHA

SEQ ID NO: 827439 - protein, 19 aa, Mycobacterium
IRVIEVGTLISGPFAGRLL

SEQ ID NO: 827440 - protein, 21 aa, Mycobacterium
IRVLDMTTFWAGPCATHFLAM

SEQ ID NO: 827441 - protein, 24 aa, Mycobacterium
IRVLDMTTFWAGPCCTHFLAMLGA

SEQ ID NO: 827442 - protein, 17 aa, Mycobacterium
IRVLGRDGVFPLAAFRK

SEQ ID NO: 827443 - protein, 30 aa, Mycobacterium
IRVLSRDGVFPLAAFRKIVDINLVGSFNVL

SEQ ID NO: 827444 - protein, 19 aa, Mycobacterium
IRVNSVAPGYIWGDTLKGY

SEQ ID NO: 827445 - protein, 23 aa, Mycobacterium
IRVNSVAPGYIWGDTLQGYFEHQ

SEQ ID NO: 827446 - protein, 20 aa, Mycobacterium
IRVNTVIPGPIRTPGLEGLA

SEQ ID NO: 827447 - protein, 25 aa, Mycobacterium
IRVPARQYREWFSRLAPGLAEQVVE

SEQ ID NO: 827448 - protein, 17 aa, Mycobacterium
IRVRAVQNPFALPKSMV

SEQ ID NO: 827449 - protein, 27 aa, Mycobacterium
IRVWESQLDPDLLWLGDHVIDDLVVLP

SEQ ID NO: 827450 - protein, 30 aa, Mycobacterium; identical to SEQ ID NO: 128040

SEQ ID NO: 827451 - protein, 17 aa, Mycobacterium
IRWLAEHGVSIAGSTAL

SEQ ID NO: 827452 - protein, 22 aa, Mycobacterium
IRWSLDLLRRRFAKVIWVPGNH

SEQ ID NO: 827453 - protein, 19 aa, Mycobacterium
IRYANWREQPLPFGFASRS

SEQ ID NO: 827454 - protein, 27 aa, Mycobacterium
IRYSALDPELWIWIAASAINATMEAFP

SEQ ID NO: 827455 - protein, 24 aa, Mycobacterium
IRYTTDLTDEVWYYLRGEEYSAQI

SEQ ID NO: 827456 - protein, 25 aa, Mycobacterium
IRYVRPPWLRRWARDGYAWAQPRFS

SEQ ID NO: 827457 - protein, 18 aa, Mycobacterium
ISAAFTRFRCGPGAFKVD

SEQ ID NO: 827458 - protein, 21 aa, Mycobacterium
ISAAIQERLVRADYGAVLAAR

SEQ ID NO: 827459 - protein, 23 aa, Mycobacterium
ISAALMLIWACDLIVASDDAKFS

SEQ ID NO: 827460 - protein, 18 aa, Mycobacterium
ISAALPDYMIPAAYVVLD

SEQ ID NO: 827461 - protein, 24 aa, Mycobacterium
ISADSSLFYPIPGLTLGGLVVDED

SEQ ID NO: 827462 - protein, 30 aa, Mycobacterium
ISAEALGGGWFWPAAAAHPSLPRGSLLQVV

SEQ ID NO: 827463 - protein, 24 aa, Mycobacterium
ISAGLMLIWACDLIVAADNAKFSD

SEQ ID NO: 827464 - protein, 17 aa, Mycobacterium
ISAGRAWARFEHGQVVF

SEQ ID NO: 827465 - protein, 25 aa, Mycobacterium
ISAKADLIGAIRLPSKAFTRVAGTE

SEQ ID NO: 827466 - protein, 24 aa, Mycobacterium
ISALERRLELRSILLDTGAGPGGM

SEQ ID NO: 827467 - protein, 25 aa, Mycobacterium
ISALGRRVLLCQGDIADPAVPELLA

SEQ ID NO: 827468 - protein, 26 aa, Mycobacterium
ISALNKPVRMRIALDVRAGFGAEPMG

SEQ ID NO: 827469 - protein, 20 aa, Mycobacterium
ISARFCLMATGPLSAALTPD

SEQ ID NO: 827470 - protein, 27 aa, Mycobacterium
ISARPAITLCWIREAPALGAVARPLHR

SEQ ID NO: 827471 - protein, 31 aa, Mycobacterium
ISARTRLLGPAYRLFYERPVHLVRGRGSHMF

SEQ ID NO: 827472 - protein, 24 aa, Mycobacterium
ISASLGIQWYRVTFDAEYLTPFEA

SEQ ID NO: 827473 - protein, 26 aa, Mycobacterium
ISATSSWLGTALALKPVLQIDEEGKL

SEQ ID NO: 827474 - protein, 25 aa, Mycobacterium
ISAVCDAPVVMASFAGATGGGFTKT

SEQ ID NO: 827475 - protein, 24 aa, Mycobacterium
ISAVYDEPFWRADGLCGQSAAPTS

SEQ ID NO: 827476 - protein, 21 aa, Mycobacterium
ISCAMWVGMGRMLRTLDIGQS

SEQ ID NO: 827477 - protein, 25 aa, Mycobacterium
ISDADVENWRWMWEANVMGTLHVTR

SEQ ID NO: 827478 - protein, 17 aa, Mycobacterium
ISDALELLPLPVVAEEI

SEQ ID NO: 827479 - protein, 17 aa, Mycobacterium
ISDAPLFIDDSPNLTMM

SEQ ID NO: 827480 - protein, 46 aa, Mycobacterium
ISDDGRVALGWRLKLLVAAYPVLAMKWGMRRLALQTAIQTVLAEFD

SEQ ID NO: 827481 - protein, 25 aa, Mycobacterium
ISDDLPALVRSLVALTASTVSGDSS

SEQ ID NO: 827482 - protein, 28 aa, Mycobacterium
ISDERLQRIFTFQSLYAGVAPRDALAVY

SEQ ID NO: 827483 - protein, 17 aa, Mycobacterium
ISDFQAVQFMLADMAMK

SEQ ID NO: 827484 - protein, 25 aa, Mycobacterium
ISDGELFIMGRIKDLLIVDGRNHYP

SEQ ID NO: 827485 - protein, 23 aa, Mycobacterium
ISDGWDIMDFVSQLQNLAGGNVA

SEQ ID NO: 827486 - protein, 18 aa, Mycobacterium
ISDIWLANLVAFSGHRAT

SEQ ID NO: 827487 - protein, 21 aa, Mycobacterium
ISDPHLMYRFHHFEARRSPCG

SEQ ID NO: 827488 - protein, 17 aa, Mycobacterium
ISDPWSLHVLAQELCML

SEQ ID NO: 827489 - protein, 22 aa, Mycobacterium
ISDRGLPVTVYDLRDLDAATAE

SEQ ID NO: 827490 - protein, 28 aa, Mycobacterium
ISDVLPLTPLQQGLLFQAGFAEATGDST

SEQ ID NO: 827491 - protein, 23 aa, Mycobacterium
ISDYRLLVNPTGKFVLGGPMGDA

SEQ ID NO: 827492 - protein, 25 aa, Mycobacterium
ISEEVWNQYRIASTVYYVNLSANRP

SEQ ID NO: 827493 - protein, 23 aa, Mycobacterium
ISEHPDWIGNRDGVPVAVRSEVN

SEQ ID NO: 827494 - protein, 25 aa, Mycobacterium
ISEINAFLSGFGIPPFVVPTDGQPG

SEQ ID NO: 827495 - protein, 18 aa, Mycobacterium
ISEKFGIPQISTGDLFRS

SEQ ID NO: 827496 - protein, 24 aa, Mycobacterium
ISELPSMLLGLASPISSALNAGGL

SEQ ID NO: 827497 - protein, 17 aa, Mycobacterium
ISELRWPGDPDPDTGID

SEQ ID NO: 827498 - protein, 19 aa, Mycobacterium
ISELVRLRGAAQHNCRLCK

SEQ ID NO: 827499 - protein, 29 aa, Mycobacterium
ISEVEYRKLRLERVVLVGVWTDGSAADAD

SEQ ID NO: 827500 - protein, 27 aa, Mycobacterium
ISEVEYRQLRLERVVLVGVWTEGSAAD

SEQ ID NO: 827501 - protein, 21 aa, Mycobacterium
ISEVPGVLQALTSPLASAASS

SEQ ID NO: 827502 - protein, 20 aa, Mycobacterium
ISEVVLVPGPTALLAPQWVP

SEQ ID NO: 827503 - protein, 17 aa, Mycobacterium
ISFAQRAQVGLPAFMMR

SEQ ID NO: 827504 - protein, 18 aa, Mycobacterium
ISFDEAFKLVKINPLVSW

SEQ ID NO: 827505 - protein, 17 aa, Mycobacterium
ISFFGGLPKTDPTITCD

SEQ ID NO: 827506 - protein, 27 aa, Mycobacterium
ISFTDPLRADWLWRVVGEQAHVAVVEG

SEQ ID NO: 827507 - protein, 25 aa, Mycobacterium
ISFTHLLGYALVQAIKKFPNMNRHY

SEQ ID NO: 827508 - protein, 22 aa, Mycobacterium
ISFTHLLGYALVQATKQFPNMN

SEQ ID NO: 827509 - protein, 24 aa, Mycobacterium
ISFTHLLGYALVQAVKKFPNMNRH

SEQ ID NO: 827510 - protein, 23 aa, Mycobacterium
ISFTHLLGYALVQAVKQFPNMNR

SEQ ID NO: 827511 - protein, 17 aa, Mycobacterium
ISGAAGAMPALAVGAAC

SEQ ID NO: 827512 - protein, 19 aa, Mycobacterium
ISGAFLAKLGCTFVIVGHS

SEQ ID NO: 827513 - protein, 41 aa, Mycobacterium
ISGAFSMLTYNIAGLPFPLSSAILPRFLYTKQIGQRLNSYY

SEQ ID NO: 827514 - protein, 23 aa, Mycobacterium
ISGDLRVDFGWLGTVVQAYLRRT

SEQ ID NO: 827515 - protein, 25 aa, Mycobacterium
ISGDPTWNGVPLPSAGDLGQFGPNP

SEQ ID NO: 827516 - protein, 27 aa, Mycobacterium
ISGGKRSFILVPGIDVPFHSSVLRVGV

SEQ ID NO: 827517 - protein, 17 aa, Mycobacterium
ISGIDVLAGLRGWLTAP

SEQ ID NO: 827518 - protein, 25 aa, Mycobacterium
ISGKAELPCLKPEPWMIQASCATAD

SEQ ID NO: 827519 - protein, 20 aa, Mycobacterium
ISGLFHGPRLQEMDARHGGS

SEQ ID NO: 827520 - protein, 17 aa, Mycobacterium
ISGLIGNGGAGGAGGNG

SEQ ID NO: 827521 - protein, 24 aa, Mycobacterium
ISGLVIALLCRGHVLLEGVPGVAK

SEQ ID NO: 827522 - protein, 43 aa, Mycobacterium
ISGNYDNGILWRSDYRAQGGFSYAIGLVPITTSLNLSVPIDIP

SEQ ID NO: 827523 - protein, 44 aa, Mycobacterium
ISGNYSNGLLWRGDYQGLLGFTYESTVPAIPWNIGVHSDIDIPI

SEQ ID NO: 827524 - protein, 30 aa, Mycobacterium
ISGNYSNGLLWRGDYQGLWGIDYAITIPDT

SEQ ID NO: 827525 - protein, 29 aa, Mycobacterium
ISGPADGASNWYLEFARLAPLMEKDTHYE

SEQ ID NO: 827526 - protein, 20 aa, Mycobacterium
ISGPWRHFDVHANGIRFHVV

SEQ ID NO: 827527 - protein, 24 aa, Mycobacterium
ISGQKRFITNAPVADLFVVFARTR

SEQ ID NO: 827528 - protein, 25 aa, Mycobacterium
ISGQKRFITNAPVAGLFVVFARTRP

SEQ ID NO: 827529 - protein, 25 aa, Mycobacterium
ISHGALALFVRAAGDAYGWCAQDRI

SEQ ID NO: 827530 - protein, 30 aa, Mycobacterium
ISHGRANGIFLPHVLRYNASLPSKFMPAPG

SEQ ID NO: 827531 - protein, 30 aa, Mycobacterium
ISHGRANGIFLPHVLRYNASLPTKFMPAPG

SEQ ID NO: 827532 - protein, 22 aa, Mycobacterium
ISHHTILFGAAWEQTFTDIIRD

SEQ ID NO: 827533 - protein, 27 aa, Mycobacterium
ISHVEAPYLGDVIVLWSLALKQDNTAD

SEQ ID NO: 827534 - protein, 20 aa, Mycobacterium
ISHWFDTLPTPRAPLPGDQD

SEQ ID NO: 827535 - protein, 18 aa, Mycobacterium
ISIAFREAPRTMFPPGSG

SEQ ID NO: 827536 - protein, 21 aa, Mycobacterium
ISIGSLYQYFPNKDAILVELM

SEQ ID NO: 827537 - protein, 26 aa, Mycobacterium
ISIGTDALTLLLLEYGRSAAGWARRL

SEQ ID NO: 827538 - protein, 25 aa, Mycobacterium
ISIPGLPNYFQVFGHYGWTGGTWHS

SEQ ID NO: 827539 - protein, 18 aa, Mycobacterium
ISIQKLLFEGFLAANPQE

SEQ ID NO: 827540 - protein, 19 aa, Mycobacterium
ISISAISFSIASPAVDLRF

SEQ ID NO: 827541 - protein, 22 aa, Mycobacterium
ISISTYFRYAPTKEDLLIAPLR

SEQ ID NO: 827542 - protein, 21 aa, Mycobacterium
ISISTYFRYAPTKEDLLVAPV

SEQ ID NO: 827543 - protein, 18 aa, Mycobacterium
ISIVHRAGVQFPAPAMLY

SEQ ID NO: 827544 - protein, 31 aa, Mycobacterium
ISIVHRAGVQFPAPTLLYGYGAYESCEDPRF

SEQ ID NO: 827545 - protein, 20 aa, Mycobacterium
ISKDAFLMRMTEDRFTDVID

SEQ ID NO: 827546 - protein, 32 aa, Mycobacterium
ISKNVPLGRLAKPADIGWAAAFLASDAASYIS

SEQ ID NO: 827547 - protein, 21 aa, Mycobacterium
ISKVLLAPARHDPISERDSQL

SEQ ID NO: 827548 - protein, 27 aa, Mycobacterium
ISLAGLMHYFPTRDVILTEIQRGADAT

SEQ ID NO: 827549 - protein, 18 aa, Mycobacterium
ISLDPTNRMWINDTPSYL

SEQ ID NO: 827550 - protein, 21 aa, Mycobacterium
ISLDQFVFYSSAGTMLGLLGQ

SEQ ID NO: 827551 - protein, 27 aa, Mycobacterium
ISLDRPAYVYPLFEQALRVARGESIDD

SEQ ID NO: 827552 - protein, 17 aa, Mycobacterium
ISLDSRLRVVARRDFAG

SEQ ID NO: 827553 - protein, 24 aa, Mycobacterium
ISLEAVADLLLFDADNPRSLLYQV

SEQ ID NO: 827554 - protein, 17 aa, Mycobacterium
ISLENYTTHTVPTLDID

SEQ ID NO: 827555 - protein, 25 aa, Mycobacterium
ISLGTMRTPMTEPLWADPANSPQTK

SEQ ID NO: 827556 - protein, 17 aa, Mycobacterium
ISLGWGLWDQASDMTGG

SEQ ID NO: 827557 - protein, 23 aa, Mycobacterium
ISLHREWLLIELRTEWQHLGHTY

SEQ ID NO: 827558 - protein, 17 aa, Mycobacterium
ISLITRFLRAGIDVCST

SEQ ID NO: 827559 - protein, 18 aa, Mycobacterium
ISLITRFLRAGIDVCSTA

SEQ ID NO: 827560 - protein, 20 aa, Mycobacterium
ISLNGVLHAIGRHGERPVPP

SEQ ID NO: 827561 - protein, 19 aa, Mycobacterium
ISLPLVAVVAACGAAVPQL

SEQ ID NO: 827562 - protein, 20 aa, Mycobacterium
ISLRGGGLVAPAIHDVADKK

SEQ ID NO: 827563 - protein, 20 aa, Mycobacterium
ISLRGGGLVAPAIHDVPDKK

SEQ ID NO: 827564 - protein, 24 aa, Mycobacterium
ISLVGSSALLLAILHARDANTESA

SEQ ID NO: 827565 - protein, 21 aa, Mycobacterium
ISLVQSLPRDVAISSIPGVDS

SEQ ID NO: 827566 - protein, 31 aa, Mycobacterium
ISNAGTALLLERFLRHFAGYADKPHGTSSPV

SEQ ID NO: 827567 - protein, 18 aa, Mycobacterium
ISNLINYPDTQLLRSMLA

SEQ ID NO: 827568 - protein, 21 aa, Mycobacterium
ISPDLMDILGSAAALPFGTDG

SEQ ID NO: 827569 - protein, 20 aa, Mycobacterium
ISPDLMDILGTASALPVGTD

SEQ ID NO: 827570 - protein, 21 aa, Mycobacterium
ISPDLWTLHWSLMSTPERVAN

SEQ ID NO: 827571 - protein, 26 aa, Mycobacterium
ISPENKAYFIAAAFPSACGKTNLAML

SEQ ID NO: 827572 - protein, 17 aa, Mycobacterium
ISPGHVYPLFEEAIRIA

SEQ ID NO: 827573 - protein, 17 aa, Mycobacterium
ISPLLMNVALHGLEEAA

SEQ ID NO: 827574 - protein, 20 aa, Mycobacterium
ISPLQARCGWAIGWKRRRSS

SEQ ID NO: 827575 - protein, 30 aa, Mycobacterium
ISQANAAALAPITGLLPAGTDEVSAGIAAL

SEQ ID NO: 827576 - protein, 25 aa, Mycobacterium
ISQAWRDWAAAPDGWLGIPNGEILC

SEQ ID NO: 827577 - protein, 24 aa, Mycobacterium
ISQDPYAYWDFLREQSPVYREPHY

SEQ ID NO: 827578 - protein, 27 aa, Mycobacterium
ISQELDDLWWQDRLGGPFPLSVLKTES

SEQ ID NO: 827579 - protein, 19 aa, Mycobacterium
ISQEMILNFLGEHALKLPR

SEQ ID NO: 827580 - protein, 18 aa, Mycobacterium
ISQFARLGLLNHAAPAEF

SEQ ID NO: 827581 - protein, 19 aa, Mycobacterium
ISQGNPLYLRHLVDAALGT

SEQ ID NO: 827582 - protein, 23 aa, Mycobacterium
ISQLSRLWFEALAGICAHVQAGG

SEQ ID NO: 827583 - protein, 20 aa, Mycobacterium
ISQMMHTLPVPWVDAADISN

SEQ ID NO: 827584 - protein, 23 aa, Mycobacterium
ISQNGMFLLGPTLFAHGSKDQLD

SEQ ID NO: 827585 - protein, 26 aa, Mycobacterium
ISQQTTAFHDRFMQTVNAAAASYTTT

SEQ ID NO: 827586 - protein, 25 aa, Mycobacterium
ISQVTLRVVPLFTLHRDDELRPLAD

SEQ ID NO: 827587 - protein, 34 aa, Mycobacterium
ISRAGGRFTVYPRALLSLLASRLGLGALRDVRPD

SEQ ID NO: 827588 - protein, 24 aa, Mycobacterium
ISRAHAVLYIHLLGSIQLAHHLRD

SEQ ID NO: 827589 - protein, 30 aa, Mycobacterium
ISRASFYIYFEDKGHLLRRLASQVFGDLAD

SEQ ID NO: 827590 - protein, 22 aa, Mycobacterium
ISRELQALLARPGWDAGDKSAL

SEQ ID NO: 827591 - protein, 25 aa, Mycobacterium
ISRIELPCDAAYLDALLTSRDSDPA

SEQ ID NO: 827592 - protein, 26 aa, Mycobacterium
ISRKADKWLPLLENRTPVVAAALLNT

SEQ ID NO: 827593 - protein, 29 aa, Mycobacterium
ISRNPYAAFFVFWLGWPTSEVPGLYLTAS

SEQ ID NO: 827594 - protein, 18 aa, Mycobacterium
ISRPALGLRLVDPDLRTL

SEQ ID NO: 827595 - protein, 30 aa, Mycobacterium
ISSAAKMFNCTGWKIGWACGPAQLIAGMRA

SEQ ID NO: 827596 - protein, 30 aa, Mycobacterium
ISSAAKMFNCTGWKIGWACGPAQLISGVRA

SEQ ID NO: 827597 - protein, 26 aa, Mycobacterium
ISSAAKMFNCTGWKIGWACGPQELIA

SEQ ID NO: 827598 - protein, 30 aa, Mycobacterium
ISSGALPPQLLFAHPGYVRAAHGMALPGRH

SEQ ID NO: 827599 - protein, 18 aa, Mycobacterium
ISSGFPINMLSYLAQNTS

SEQ ID NO: 827600 - protein, 18 aa, Mycobacterium
ISSGQALILIPREGYFQA

SEQ ID NO: 827601 - protein, 26 aa, Mycobacterium
ISSHLQGWTLARLPAVDRAILRVAVW

SEQ ID NO: 827602 - protein, 21 aa, Mycobacterium
ISSHLQGWTLDRLPAVDRAIL

SEQ ID NO: 827603 - protein, 17 aa, Mycobacterium
ISSILLRGGFSAESTWR

SEQ ID NO: 827604 - protein, 48 aa, Mycobacterium
ISSPGWAKHAWSCFFAPWIAEATIFVYNYRRFDAPALLNQLRRAKVNT

SEQ ID NO: 827605 - protein, 28 aa, Mycobacterium
ISSPLVAWLTDAMTLPAGAPLPAGVLIH

SEQ ID NO: 827606 - protein, 32 aa, Mycobacterium; identical to SEQ ID NO: 681698

SEQ ID NO: 827607 - protein, 23 aa, Mycobacterium
ISTAELIQLLAAGGPVTLLDVRW

SEQ ID NO: 827608 - protein, 28 aa, Mycobacterium
ISTAFLYDHFTPFVFTQLEELGFCGRGE

SEQ ID NO: 827609 - protein, 50 aa, Mycobacterium
ISTAVAELFGAYARGYQIIGAQAAMFHAEFVRALDIGAGAYWATEVANAS

SEQ ID NO: 827610 - protein, 31 aa, Mycobacterium
ISTDLLYKLLRSDWLEPRWMVGIDPQSEGLA

SEQ ID NO: 827611 - protein, 30 aa, Mycobacterium
ISTDLLYKLLRSEWLEPRWMIGIDPESEGL

SEQ ID NO: 827612 - protein, 26 aa, Mycobacterium
ISTELPLERWFRDLRVKRLGEGATEV

SEQ ID NO: 827613 - protein, 25 aa, Mycobacterium
ISTEYLFRRDEDGDFWLVGRRGSVA

SEQ ID NO: 827614 - protein, 25 aa, Mycobacterium
ISTFWDKVIAPTTSIEFFFRDTFQC

SEQ ID NO: 827615 - protein, 21 aa, Mycobacterium
ISTIMGLVIGARHLGDLTVAV

SEQ ID NO: 827616 - protein, 23 aa, Mycobacterium
ISTIPMVYPPAAPKHWRTALDSA

SEQ ID NO: 827617 - protein, 18 aa, Mycobacterium
ISTIQRVFRFIKAGEVSD

SEQ ID NO: 827618 - protein, 24 aa, Mycobacterium
ISTKAGWDMWPGPYGQLGSRAYVL

SEQ ID NO: 827619 - protein, 25 aa, Mycobacterium
ISTLAIEDLIATLKLDYTIVIVTHN

SEQ ID NO: 827620 - protein, 19 aa, Mycobacterium
ISTLPLGWSNPWDASADDR

SEQ ID NO: 827621 - protein, 18 aa, Mycobacterium
ISVERWVEITSTTPARMF

SEQ ID NO: 827622 - protein, 27 aa, Mycobacterium
ISVGCNNSCTFCIVPSLRGKEADRRPG

SEQ ID NO: 827623 - protein, 22 aa, Mycobacterium
ISVGCNNTCTFCIVPSLRGKEV

SEQ ID NO: 827624 - protein, 24 aa, Mycobacterium
ISVGQRGPLPPPVALRYAVGPNSW

SEQ ID NO: 827625 - protein, 20 aa, Mycobacterium
ISVKLIQPVAMDEGLRFAIR

SEQ ID NO: 827626 - protein, 17 aa, Mycobacterium
ISWAYRNLSPYLDCPIV

SEQ ID NO: 827627 - protein, 18 aa, Mycobacterium
ISWKLYRNKTLGPVLNQY

SEQ ID NO: 827628 - protein, 31 aa, Mycobacterium
ISYAAELARRRRSRGLLLNHPEAIAIITDHL

SEQ ID NO: 827629 - protein, 17 aa, Mycobacterium
ISYLEKVGVIPALARCG

SEQ ID NO: 827630 - protein, 23 aa, Mycobacterium
ISYPVGHMTTMAWLGVRPGDVHL

SEQ ID NO: 827631 - protein, 21 aa, Mycobacterium
ISYPVLWRNLTELVGNILEAL

SEQ ID NO: 827632 - protein, 19 aa, Mycobacterium
ITAALRRAGRQRGLTTLAA

SEQ ID NO: 827633 - protein, 19 aa, Mycobacterium
ITAALTMLLGVIPGIEDPE

SEQ ID NO: 827634 - protein, 26 aa, Mycobacterium
ITAANAAAAIPTSAIAAAAADEISAA

SEQ ID NO: 827635 - protein, 26 aa, Mycobacterium
ITAARRKHWVTLIQADPGMADVLAAI

SEQ ID NO: 827636 - protein, 25 aa, Mycobacterium
ITACRYDFLIPNRGVGVLLPEGEQA

SEQ ID NO: 827637 - protein, 19 aa, Mycobacterium
ITADELRAWRAEHPGAVVV

SEQ ID NO: 827638 - protein, 26 aa, Mycobacterium
ITADGPLRVFALLRDGRPVLLNFGSA

SEQ ID NO: 827639 - protein, 25 aa, Mycobacterium
ITADIVLPHYFGFGTGYGLDPDWRH

SEQ ID NO: 827640 - protein, 18 aa, Mycobacterium
ITADLALTKGWCLRELGE

SEQ ID NO: 827641 - protein, 21 aa, Mycobacterium
ITAEEWLAHWPSGASLVDAAP

SEQ ID NO: 827642 - protein, 19 aa, Mycobacterium
ITAELLPRMDAEAAALGRS

SEQ ID NO: 827643 - protein, 23 aa, Mycobacterium
ITAEVTPHHLLLDDGRLAGYDGV

SEQ ID NO: 827644 - protein, 18 aa, Mycobacterium
ITAFYVNIWKLDGVSGDW

SEQ ID NO: 827645 - protein, 17 aa, Mycobacterium
ITAGMNPHRLRSEAAFA

SEQ ID NO: 827646 - protein, 23 aa, Mycobacterium
ITAHPKPLTTPHPPIWVGGNTSA

SEQ ID NO: 827647 - protein, 17 aa, Mycobacterium
ITAIMRHGCGVHGLREV

SEQ ID NO: 827648 - protein, 22 aa, Mycobacterium
ITALARPVIRWFVWDLTRSELV

SEQ ID NO: 827649 - protein, 18 aa, Mycobacterium
ITALLSPLAIEHTLQYRR

SEQ ID NO: 827650 - protein, 21 aa, Mycobacterium
ITANLDGKIKYKIPGVGKVNV

SEQ ID NO: 827651 - protein, 23 aa, Mycobacterium
ITAPRGWELVRYNGPLPSNPEDD

SEQ ID NO: 827652 - protein, 18 aa, Mycobacterium
ITARASGAGYRWANPSRL

SEQ ID NO: 827653 - protein, 23 aa, Mycobacterium
ITARFVVINGCRRLAAAHKYGRT

SEQ ID NO: 827654 - protein, 18 aa, Mycobacterium
ITASTFLVDGGISSAYVT

SEQ ID NO: 827655 - protein, 29 aa, Mycobacterium
ITASTSDLLLALWHRVPLSRLAVDGDAAH

SEQ ID NO: 827656 - protein, 19 aa, Mycobacterium
ITATLLNNLATHDKTFGIE

SEQ ID NO: 827657 - protein, 18 aa, Mycobacterium
ITAVELPPPPVGAVSDYR

SEQ ID NO: 827658 - protein, 45 aa, Mycobacterium
ITAVPTFIDGPLWPRLMLGVRGMLRATWLVLRKRADVLHVHLAHG

SEQ ID NO: 827659 - protein, 17 aa, Mycobacterium
ITAWREIGSVHDEVFGA

SEQ ID NO: 827660 - protein, 20 aa, Mycobacterium
ITAYRNAFRPSARLARPYVV

SEQ ID NO: 827661 - protein, 25 aa, Mycobacterium
ITDADWMFRVLATAWDRVDQLAAWG

SEQ ID NO: 827662 - protein, 39 aa, Mycobacterium
ITDADWRKDLDINFLAAVRLNAALLPAMYTRGAGSIVNV

SEQ ID NO: 827663 - protein, 22 aa, Mycobacterium
ITDELPLLQARTVRVAGHLLEI

SEQ ID NO: 827664 - protein, 18 aa, Mycobacterium
ITDFAAQVPVLRVSVNVG

SEQ ID NO: 827665 - protein, 27 aa, Mycobacterium
ITDFADDRWMLAIGADGYARAGGINEL

SEQ ID NO: 827666 - protein, 29 aa, Mycobacterium
ITDGPLQGQWYLHLFAPGQPDLNWENPEV

SEQ ID NO: 827667 - protein, 24 aa, Mycobacterium
ITDGPMAGLLARAIVVIGADGKVS

SEQ ID NO: 827668 - protein, 24 aa, Mycobacterium
ITDIRSFHRYVVGGHLPIPKVPFA

SEQ ID NO: 827669 - protein, 23 aa, Mycobacterium
ITDIRTAIRELSVRADLARKEGR

SEQ ID NO: 827670 - protein, 23 aa, Mycobacterium
ITDITPYWRPPAWAAGVVVVDAL

SEQ ID NO: 827671 - protein, 25 aa, Mycobacterium
ITDMPERVVWLPLNSPGSAVYRQLG

SEQ ID NO: 827672 - protein, 21 aa, Mycobacterium
ITDPLDYRLVESYWLGGGVGA

SEQ ID NO: 827673 - protein, 25 aa, Mycobacterium
ITDPRLRRVFTFQSLYAGVAPQDAL

SEQ ID NO: 827674 - protein, 17 aa, Mycobacterium
ITDRLREMIKVRGFQVA

SEQ ID NO: 827675 - protein, 25 aa, Mycobacterium
ITDRTRLVWIETPTNPLLSIADIAA

SEQ ID NO: 827676 - protein, 27 aa, Mycobacterium
ITDVPARFYGLTQRGRIAPGWHADLVL

SEQ ID NO: 827677 - protein, 19 aa, Mycobacterium
ITDVWMTLARCAERTTRIG

SEQ ID NO: 827678 - protein, 19 aa, Mycobacterium
ITEAVYFVERLVDCLAYEL

SEQ ID NO: 827679 - protein, 24 aa, Mycobacterium
ITEDGAFVCYPGVEWCGTAGAGGD

SEQ ID NO: 827680 - protein, 22 aa, Mycobacterium
ITEDHYVPRVIYTPGRHTFDRA

SEQ ID NO: 827681 - protein, 23 aa, Mycobacterium
ITEGDKIILFYSSANWDTTVFTN

SEQ ID NO: 827682 - protein, 22 aa, Mycobacterium
ITEGLVMTLDQPYPAAIARLSQ

SEQ ID NO: 827683 - protein, 18 aa, Mycobacterium
ITEHRVTFLTTVPTIMQR

SEQ ID NO: 827684 - protein, 24 aa, Mycobacterium
ITEHSVALLAVIRALLDDTGPGGD

SEQ ID NO: 827685 - protein, 18 aa, Mycobacterium
ITEIFPGGRLPSTGMMVE

SEQ ID NO: 827686 - protein, 25 aa, Mycobacterium
ITEQPLEFGLLRKPGQAFLGILPFE

SEQ ID NO: 827687 - protein, 18 aa, Mycobacterium
ITESFQYPIEGFTDVGER

SEQ ID NO: 827688 - protein, 17 aa, Mycobacterium
ITEVDAYYFAPQKNFAS

SEQ ID NO: 827689 - protein, 32 aa, Mycobacterium
ITFDIQVPLAIDLLIDLKLDKSRFKVAGNIAL

SEQ ID NO: 827690 - protein, 29 aa, Mycobacterium
ITFRTGTIDILIELPRQSILDIAVASAAV

SEQ ID NO: 827691 - protein, 21 aa, Mycobacterium
ITFTTFIPTMLHRTLAILEDG

SEQ ID NO: 827692 - protein, 33 aa, Mycobacterium
ITGAGRPPVLYELPHGLPFTELLALHGVPADQV

SEQ ID NO: 827693 - protein, 36 aa, Mycobacterium
ITGAGRPPVLYELPHGLPFTELLALHGVSPEAVRGA

SEQ ID NO: 827694 - protein, 27 aa, Mycobacterium
ITGAVIIDYWGIIKADIGIRDGRVVAI

SEQ ID NO: 827695 - protein, 32 aa, Mycobacterium
ITGDDRYLCINPFFHNFGYKAGILACLQTGAT

SEQ ID NO: 827696 - protein, 26 aa, Mycobacterium
ITGDPRFIRGFKPMGLFLNEVQGFMS

SEQ ID NO: 827697 - protein, 17 aa, Mycobacterium
ITGDWQKFKGLPGAEGT

SEQ ID NO: 827698 - protein, 18 aa, Mycobacterium
ITGDWQKFKGLPGAEGTL

SEQ ID NO: 827699 - protein, 22 aa, Mycobacterium
ITGETLFNEVFFDDVFVPDRDV

SEQ ID NO: 827700 - protein, 25 aa, Mycobacterium
ITGGKRSFILVPGIDVPFHSRVLRV

SEQ ID NO: 827701 - protein, 25 aa, Mycobacterium
ITGGLGGLGLFFASKLAAAGCGRIV

SEQ ID NO: 827702 - protein, 18 aa, Mycobacterium
ITGGLGGLGLFLAERMAA

SEQ ID NO: 827703 - protein, 18 aa, Mycobacterium
ITGGYLTLAATLCTAKIA

SEQ ID NO: 827704 - protein, 20 aa, Mycobacterium
ITGHLLGAARRRAFRIWLDG

SEQ ID NO: 827705 - protein, 23 aa, Mycobacterium
ITGIITMPWMFYAGPDATLDDKI

SEQ ID NO: 827706 - protein, 24 aa, Mycobacterium
ITGIITMPWMFYSGPDAPLDQKID

SEQ ID NO: 827707 - protein, 19 aa, Mycobacterium
ITGLLQSGVLAPGSHLALI

SEQ ID NO: 827708 - protein, 17 aa, Mycobacterium
ITGLPEMGVVARQLWRD

SEQ ID NO: 827709 - protein, 18 aa, Mycobacterium
ITGLVRSGVLPEGYHLAL

SEQ ID NO: 827710 - protein, 32 aa, Mycobacterium
ITGNSIVLVDFWASWCGPCRAFGPVYERSSEA

SEQ ID NO: 827711 - protein, 19 aa, Mycobacterium
ITGPILRSTGLPHDLRKSE

SEQ ID NO: 827712 - protein, 25 aa, Mycobacterium
ITGPITGFPGWSHYGASKAAQLGFL

SEQ ID NO: 827713 - protein, 21 aa, Mycobacterium
ITGPITGYPGWSHYGATKAAQ

SEQ ID NO: 827714 - protein, 20 aa, Mycobacterium
ITGPLFIGRDTHALSEPAWA

SEQ ID NO: 827715 - protein, 22 aa, Mycobacterium
ITGPLFIGRDTHALSEPAWVSA

SEQ ID NO: 827716 - protein, 36 aa, Mycobacterium
ITGPLSPASLFTIPGVPYLLGIQSYLTPQAGANLTR

SEQ ID NO: 827717 - protein, 23 aa, Mycobacterium
ITGPRLVLRRPVLDDAGALFQRV

SEQ ID NO: 827718 - protein, 18 aa, Mycobacterium
ITGPTAPSWRKGPRHIAG

SEQ ID NO: 827719 - protein, 24 aa, Mycobacterium
ITGQTLLVDGGLNLKWGHLDTDNT

SEQ ID NO: 827720 - protein, 18 aa, Mycobacterium
ITGRLKELIIRGGENIAP

SEQ ID NO: 827721 - protein, 30 aa, Mycobacterium
ITGRPAISLPLHWTADGLPLGVQFVAPLAG

SEQ ID NO: 827722 - protein, 29 aa, Mycobacterium
ITGRPAVTLPLHWTADGLPLGVQFVAPLE

SEQ ID NO: 827723 - protein, 21 aa, Mycobacterium
ITGRQRFPGWPFRISPGPAHQ

SEQ ID NO: 827724 - protein, 18 aa, Mycobacterium
ITGSTFLVDGGISSAYVT

SEQ ID NO: 827725 - protein, 29 aa, Mycobacterium
ITGTGGLGPISIPIVDVPAAPGFGNSTTS

SEQ ID NO: 827726 - protein, 19 aa, Mycobacterium
ITGYALGAGFTLALAADWR

SEQ ID NO: 827727 - protein, 22 aa, Mycobacterium
ITHASALMSHLAARPLREILAG

SEQ ID NO: 827728 - protein, 23 aa, Mycobacterium
ITHPLRADIPIMLGAEGPKNVAL

SEQ ID NO: 827729 - protein, 17 aa, Mycobacterium
ITHSQWVPTMFVRMLKL

SEQ ID NO: 827730 - protein, 22 aa, Mycobacterium
ITIAAWSARYRHMVRRRADAVA

SEQ ID NO: 827731 - protein, 21 aa, Mycobacterium
ITIADLIEWRRKHEKHIARIA

SEQ ID NO: 827732 - protein, 23 aa, Mycobacterium
ITIADMPVILLTTLGAKSGKLRK

SEQ ID NO: 827733 - protein, 23 aa, Mycobacterium
ITIEMAVAPIALALSAHPRLEDH

SEQ ID NO: 827734 - protein, 27 aa, Mycobacterium
ITIISPVDYMLYTPLLPDVAGGVVDAR

SEQ ID NO: 827735 - protein, 33 aa, Mycobacterium
ITIQLSNGIPPPPPPPVNIPLPGGPPEIGQTVV

SEQ ID NO: 827736 - protein, 30 aa, Mycobacterium
ITIRPIYGAYDIPGAWLARGGVPVYERAVL

SEQ ID NO: 827737 - protein, 26 aa, Mycobacterium
ITISDLKFMKFIGEEIFPGGQLPAVE

SEQ ID NO: 827738 - protein, 32 aa, Mycobacterium
ITISYSSTIPEIPWHYDVTAPIEIPISGNVNE

SEQ ID NO: 827739 - protein, 26 aa, Mycobacterium
ITITTPLLEWIAAQISALRGDWETAH

SEQ ID NO: 827740 - protein, 22 aa, Mycobacterium
ITKEINVQFVLAYDPEEFATSL

SEQ ID NO: 827741 - protein, 17 aa, Mycobacterium
ITKFRDGLTQWMEPTMS

SEQ ID NO: 827742 - protein, 18 aa, Mycobacterium
ITKHADVMEIERANDLFL

SEQ ID NO: 827743 - protein, 24 aa, Mycobacterium
ITKLENTFRWNWRLGDVAIWDNRA

SEQ ID NO: 827744 - protein, 22 aa, Mycobacterium
ITKNRYLIYTSADIRALYAFKR

SEQ ID NO: 827745 - protein, 24 aa, Mycobacterium
ITKPPDILITTPESLFLMLTSAAR

SEQ ID NO: 827746 - protein, 20 aa, Mycobacterium
ITKRRGGLPVSPPSGVSTQI

SEQ ID NO: 827747 - protein, 25 aa, Mycobacterium
ITLDDMPMMTLYAATKRGLNGFTGA

SEQ ID NO: 827748 - protein, 17 aa, Mycobacterium
ITLGMFTHEALLGGEGA

SEQ ID NO: 827749 - protein, 23 aa, Mycobacterium
ITLGYDIDKPWRKLTKRQRDWVL

SEQ ID NO: 827750 - protein, 17 aa, Mycobacterium
ITLIGFSVSNFDPCGAA

SEQ ID NO: 827751 - protein, 32 aa, Mycobacterium
ITLINEPVFNAPFSNFWLTPRQHRDALRKKGW

SEQ ID NO: 827752 - protein, 17 aa, Mycobacterium
ITLLVDYGHTMASLTGA

SEQ ID NO: 827753 - protein, 31 aa, Mycobacterium
ITLMDPMAFVRRPYRWIKQLGIEAAYGRTLA

SEQ ID NO: 827754 - protein, 24 aa, Mycobacterium
ITLMSPVSFVRRPGRWIKELAAEG

SEQ ID NO: 827755 - protein, 40 aa, Mycobacterium
ITLNEFTIDSLPLEVFLPFAPFYILYDFGPVTVDATTYDP

SEQ ID NO: 827756 - protein, 17 aa, Mycobacterium
ITLPPQRIKACCAEAYS

SEQ ID NO: 827757 - protein, 17 aa, Mycobacterium
ITLRRITMLSGSTEFCE

SEQ ID NO: 827758 - protein, 27 aa, Mycobacterium
ITLSDKPMPLFQLLVLCMLASKPIDAT

SEQ ID NO: 827759 - protein, 26 aa, Mycobacterium
ITLTPGAAQLIWRNWRRRARVLPHPH

SEQ ID NO: 827760 - protein, 18 aa, Mycobacterium
ITLVTFERLVFDGILQEV

SEQ ID NO: 827761 - protein, 19 aa, Mycobacterium
ITMDRVREVIGFPARFIAD

SEQ ID NO: 827762 - protein, 31 aa, Mycobacterium
ITMEDINFGFTVAIGPLPVLTGTIDSVTLAP

SEQ ID NO: 827763 - protein, 18 aa, Mycobacterium
ITMGTPEHHVPPLLSVNP

SEQ ID NO: 827764 - protein, 20 aa, Mycobacterium
ITMLPGPPTLYHSLLGAQGG

SEQ ID NO: 827765 - protein, 19 aa, Mycobacterium
ITMLPGPPTLYHSLLSARG

SEQ ID NO: 827766 - protein, 25 aa, Mycobacterium
ITMRGLTTAYLLRRIHPLRAGDTVL

SEQ ID NO: 827767 - protein, 22 aa, Mycobacterium
ITMSDLRFLHFLGKEIFPGGQM

SEQ ID NO: 827768 - protein, 17 aa, Mycobacterium
ITMSQAIRRAGRLALPV

SEQ ID NO: 827769 - protein, 24 aa, Mycobacterium
ITMTKLRFMKFIMDEIFPGGDLPS

SEQ ID NO: 827770 - protein, 28 aa, Mycobacterium
ITNAPTAGLFVVFARTRPADADGAGIAV

SEQ ID NO: 827771 - protein, 22 aa, Mycobacterium
ITNCVMTLLRNPGSWDLLRQNP

SEQ ID NO: 827772 - protein, 19 aa, Mycobacterium
ITNHRWALSAFGTASAAAL

SEQ ID NO: 827773 - protein, 18 aa, Mycobacterium
ITNLKLDPFERFHKARGF

SEQ ID NO: 827774 - protein, 28 aa, Mycobacterium
ITNRGLFVHSAPWAVPSLGLENVSHGCI

SEQ ID NO: 827775 - protein, 25 aa, Mycobacterium
ITNRGLFVHSAPWAVQSLGLENVSH

SEQ ID NO: 827776 - protein, 18 aa, Mycobacterium
ITNSYRAVLLARGEHPGR

SEQ ID NO: 827777 - protein, 17 aa, Mycobacterium
ITPAHCEALLTALVRQA

SEQ ID NO: 827778 - protein, 23 aa, Mycobacterium
ITPALATLGLGVMPLLDLASDEQ

SEQ ID NO: 827779 - protein, 20 aa, Mycobacterium
ITPEALRRAWIDIPEVVSAA

SEQ ID NO: 827780 - protein, 27 aa, Mycobacterium
ITPELRGRLVFAWRATGPMSPAARALV

SEQ ID NO: 827781 - protein, 26 aa, Mycobacterium
ITPGMVMAALRLDIPTVFVSGGPMEG

SEQ ID NO: 827782 - protein, 22 aa, Mycobacterium
ITPGYDLRYLIGSRADTFERLT

SEQ ID NO: 827783 - protein, 22 aa, Mycobacterium
ITPGYDLRYLVGSRAQTFERLT

SEQ ID NO: 827784 - protein, 18 aa, Mycobacterium
ITPLWDAWTDGKPAISPY

SEQ ID NO: 827785 - protein, 26 aa, Mycobacterium
ITPMEIAYPVLWRNLTELVGTILEAL

SEQ ID NO: 827786 - protein, 30 aa, Mycobacterium
ITPTGTVGDLLPILGIPGQMAQNFTNLLPA

SEQ ID NO: 827787 - protein, 26 aa, Mycobacterium
ITPTTKLIWLETPTNPLLSIADIAAV

SEQ ID NO: 827788 - protein, 25 aa, Mycobacterium
ITPVMAMLRTLVAQGHRGEIAFVHY

SEQ ID NO: 827789 - protein, 18 aa, Mycobacterium
ITPVVIWGGGRLELSPSP

SEQ ID NO: 827790 - protein, 17 aa, Mycobacterium
ITQDLLDRTRKPFQSVI

SEQ ID NO: 827791 - protein, 17 aa, Mycobacterium
ITQPQPARWHLSDGGKN

SEQ ID NO: 827792 - protein, 18 aa, Mycobacterium
ITQRMPNPRRTGPAPWQA

SEQ ID NO: 827793 - protein, 28 aa, Mycobacterium
ITQTLSAYLLMQLLEAAGLPPGVINLVT

SEQ ID NO: 827794 - protein, 25 aa, Mycobacterium
ITRARTHLALSWALARSPGGRQGRK

SEQ ID NO: 827795 - protein, 25 aa, Mycobacterium
ITRARTHLALTWALARSPGGRQGRK

SEQ ID NO: 827796 - protein, 25 aa, Mycobacterium
ITRARVHLALSWALARAPGGRQSRK

SEQ ID NO: 827797 - protein, 23 aa, Mycobacterium
ITRARVHLNLSWALSRAAGGRKS

SEQ ID NO: 827798 - protein, 17 aa, Mycobacterium
ITRFGRLDIVVANAGIA

SEQ ID NO: 827799 - protein, 33 aa, Mycobacterium
ITRHEARWHPQRHLLTRALGIGPHIGPDVFGID

SEQ ID NO: 827800 - protein, 26 aa, Mycobacterium
ITRLHQYNVFPNMTFLANADHLTIMC

SEQ ID NO: 827801 - protein, 24 aa, Mycobacterium
ITRLHQYNVFPNMTLLANADHLTV

SEQ ID NO: 827802 - protein, 22 aa, Mycobacterium
ITRPALYYYVKSKEDLLSRLVT

SEQ ID NO: 827803 - protein, 25 aa, Mycobacterium
ITRPEVHWWMLDFAGPGLKKMMNKK

SEQ ID NO: 827804 - protein, 21 aa, Mycobacterium
ITRPPDVLITTPESLFLMLTS

SEQ ID NO: 827805 - protein, 26 aa, Mycobacterium
ITRSGFDYTWFVLNAKIIEKEFALSG

SEQ ID NO: 827806 - protein, 31 aa, Mycobacterium
ITRTFMDSHPFVWLPILSRVLGTAELVPHAV

SEQ ID NO: 827807 - protein, 17 aa, Mycobacterium
ITRWVELALVEGSRFYM

SEQ ID NO: 827808 - protein, 23 aa, Mycobacterium
ITRWVELPLVEGSRFWMLAGSIA

SEQ ID NO: 827809 - protein, 19 aa, Mycobacterium
ITRWVELPLVEGTRFYMHT

SEQ ID NO: 827810 - protein, 22 aa, Mycobacterium
ITSALTRYFGADRPRLVVEPGR

SEQ ID NO: 827811 - protein, 17 aa, Mycobacterium
ITSATPRYDVTLTKAWG

SEQ ID NO: 827812 - protein, 32 aa, Mycobacterium; identical to SEQ ID NO: 120768

SEQ ID NO: 827813 - protein, 25 aa, Mycobacterium
ITSDRLYPLRLQQELADLLPGCAGL

SEQ ID NO: 827814 - protein, 25 aa, Mycobacterium
ITSKIAFDQTYLAPIASAITRLTDV

SEQ ID NO: 827815 - protein, 30 aa, Mycobacterium
ITSMHFVPSLLGLFLSLPGVNQWRTLRRVP

SEQ ID NO: 827816 - protein, 30 aa, Mycobacterium; identical to SEQ ID NO: 128088

SEQ ID NO: 827817 - protein, 20 aa, Mycobacterium
ITSQHRLGIVYPSPPSTFQG

SEQ ID NO: 827818 - protein, 18 aa, Mycobacterium
ITSRRMLLDMPESDWQTM

SEQ ID NO: 827819 - protein, 29 aa, Mycobacterium
ITSRSPEDIPAFNKALIDALAQQPQAQAQ

SEQ ID NO: 827820 - protein, 23 aa, Mycobacterium
ITSRVTRLLSVSALACASLLGTP

SEQ ID NO: 827821 - protein, 19 aa, Mycobacterium
ITSSITGPITGFPGWSHYG

SEQ ID NO: 827822 - protein, 28 aa, Mycobacterium
ITSTPLLVFDAWEHAFYLQYRNVKADYV

SEQ ID NO: 827823 - protein, 20 aa, Mycobacterium
ITSVPHIYAIGDVTGKLMLA

SEQ ID NO: 827824 - protein, 22 aa, Mycobacterium
ITSVTRLIPRGLVRKYNSVVGR

SEQ ID NO: 827825 - protein, 24 aa, Mycobacterium
ITTEFYRRMFAAHPELLRNLFNRG

SEQ ID NO: 827826 - protein, 20 aa, Mycobacterium
ITTLAAHKGFPGTSVYGATK

SEQ ID NO: 827827 - protein, 19 aa, Mycobacterium
ITTMRQAFLARRERLKKDI

SEQ ID NO: 827828 - protein, 24 aa, Mycobacterium
ITTPAYISGVLNTGSNLAGFLLGP

SEQ ID NO: 827829 - protein, 22 aa, Mycobacterium
ITTPDGWVLALGAKDEKHVPVA

SEQ ID NO: 827830 - protein, 25 aa, Mycobacterium
ITTPLLPDDYLSLANPLWSARELRG

SEQ ID NO: 827831 - protein, 33 aa, Mycobacterium
ITTRHNIPIPTGTFPWFQVDSVIPFATLSSIFD

SEQ ID NO: 827832 - protein, 26 aa, Mycobacterium
ITVEPFAPLPEFWVSRARKKILHAAL

SEQ ID NO: 827833 - protein, 18 aa, Mycobacterium
ITVGIARTKFLAKVASRQ

SEQ ID NO: 827834 - protein, 24 aa, Mycobacterium
ITVGLCRGWPLAESVRLGIAAGAA

SEQ ID NO: 827835 - protein, 31 aa, Mycobacterium
ITVKDAVDVLWFFFGYTGFFTLLDDNGWSPD

SEQ ID NO: 827836 - protein, 35 aa, Mycobacterium
ITVLLTSVLGHSFTFMTPAAFVRRPGRWIRELARK

SEQ ID NO: 827837 - protein, 19 aa, Mycobacterium
ITVLPLQHPIVLAKALATA

SEQ ID NO: 827838 - protein, 17 aa, Mycobacterium
ITVMSLGRRLGVGIISC

SEQ ID NO: 827839 - protein, 26 aa, Mycobacterium
ITVNYPLYVIMSLLGIPEADFPLMLK

SEQ ID NO: 827840 - protein, 19 aa, Mycobacterium
ITVPAYFNDAQRQATKEAG

SEQ ID NO: 827841 - protein, 20 aa, Mycobacterium
ITVPDPPRMADFAYVLAAVD

SEQ ID NO: 827842 - protein, 26 aa, Mycobacterium
ITVPENTIRWSWAPGDVAIWDNRATQ

SEQ ID NO: 827843 - protein, 21 aa, Mycobacterium
ITVPPVRFIKTIGDAVMFVCP

SEQ ID NO: 827844 - protein, 18 aa, Mycobacterium
ITVQRQVMYWLDPVGGTA

SEQ ID NO: 827845 - protein, 20 aa, Mycobacterium
ITVRKVLTESPWKCWRLLTL

SEQ ID NO: 827846 - protein, 26 aa, Mycobacterium
ITVRTRFFDDFFLQATGSGIRQAVIL

SEQ ID NO: 827847 - protein, 25 aa, Mycobacterium
ITVVARLIGFRDIDPMQLLEAAFDS

SEQ ID NO: 827848 - protein, 23 aa, Mycobacterium
ITVVTFERLVFDGVLQEVVLFCG

SEQ ID NO: 827849 - protein, 34 aa, Mycobacterium
ITWEHDAHLYFKRAHGSALLLGTPRQLLPNLETA

SEQ ID NO: 827850 - protein, 24 aa, Mycobacterium
ITWEHDIQLYFKRAHGSAQLLGPP

SEQ ID NO: 827851 - protein, 25 aa, Mycobacterium
ITWEHDMHLYFKRAHGSAHLLDTPQ

SEQ ID NO: 827852 - protein, 25 aa, Mycobacterium
ITWEHDMHLYFKRAHGSAHLLGTPQ

SEQ ID NO: 827853 - protein, 26 aa, Mycobacterium
ITWEHDMHLYFKRAHGSTHLLASPPE

SEQ ID NO: 827854 - protein, 25 aa, Mycobacterium
ITWEHDMHLYFKRAHGSTHLLDSPR

SEQ ID NO: 827855 - protein, 24 aa, Mycobacterium
ITWGAQLSGLYYTPVNTHFIPDEV

SEQ ID NO: 827856 - protein, 26 aa, Mycobacterium
ITYGTNWELGFDYLRDNMALRLEDCV

SEQ ID NO: 827857 - protein, 17 aa, Mycobacterium
ITYTEDTKIWLAGVAPQ

SEQ ID NO: 827858 - protein, 25 aa, Mycobacterium
IVAAALNGWFTPRPDLVLSGINHGA

SEQ ID NO: 827859 - protein, 26 aa, Mycobacterium
IVAANRIQLATLIATNFFGQNTPAIA

SEQ ID NO: 827860 - protein, 18 aa, Mycobacterium
IVAARGILADLRWVNSPI

SEQ ID NO: 827861 - protein, 18 aa, Mycobacterium
IVADFRPGPDCRLGVLVD

SEQ ID NO: 827862 - protein, 25 aa, Mycobacterium
IVADLFQALNDIGFSIAAQGCTYWN

SEQ ID NO: 827863 - protein, 18 aa, Mycobacterium
IVADPYPVYARLRDEAPL

SEQ ID NO: 827864 - protein, 17 aa, Mycobacterium
IVADRVVAWLKDRYARR

SEQ ID NO: 827865 - protein, 18 aa, Mycobacterium
IVAEALTNPFYPELVEPL

SEQ ID NO: 827866 - protein, 18 aa, Mycobacterium
IVAEKSLLRRLVEAGTRV

SEQ ID NO: 827867 - protein, 20 aa, Mycobacterium
IVAELFKPLPSMVVAHYLGV

SEQ ID NO: 827868 - protein, 25 aa, Mycobacterium
IVAELFKPLPSMVVAHYLGVPEADR

SEQ ID NO: 827869 - protein, 18 aa, Mycobacterium
IVAFLTRKWQRELDYTLR

SEQ ID NO: 827870 - protein, 18 aa, Mycobacterium
IVAFMRYIDANRASWIVM

SEQ ID NO: 827871 - protein, 32 aa, Mycobacterium
IVAFVGRIQPLKAPDILLRAAAKLPGVRVLIA

SEQ ID NO: 827872 - protein, 28 aa, Mycobacterium
IVAGGHSLLPMMKLRIANPEYLVDINDL

SEQ ID NO: 827873 - protein, 30 aa, Mycobacterium
IVAHFFVCSTHDWILFFTTQGRVYRAKAYE

SEQ ID NO: 827874 - protein, 18 aa, Mycobacterium
IVAINPLPEAGLIRFKDP

SEQ ID NO: 827875 - protein, 19 aa, Mycobacterium
IVAKFVGGLPIVLATKLLG

SEQ ID NO: 827876 - protein, 34 aa, Mycobacterium
IVAKKLDWDLELIARIGWTCRDVWWAAIQDPRAW

SEQ ID NO: 827877 - protein, 21 aa, Mycobacterium
IVALDFKPVPEKLAKWAELGV

SEQ ID NO: 827878 - protein, 22 aa, Mycobacterium
IVALDFKPVPEKLARWAELGVT

SEQ ID NO: 827879 - protein, 19 aa, Mycobacterium
IVALGELYEYFTKLIAARR

SEQ ID NO: 827880 - protein, 17 aa, Mycobacterium
IVALKYPGGVVIAGDRR

SEQ ID NO: 827881 - protein, 21 aa, Mycobacterium
IVALLAVLKTGAAYLPIDPAV

SEQ ID NO: 827882 - protein, 35 aa, Mycobacterium
IVALLRACRSARDRLIVLLMARGGLRRGEVCGLRR

SEQ ID NO: 827883 - protein, 17 aa, Mycobacterium
IVALPLATPGVAVGDHF

SEQ ID NO: 827884 - protein, 20 aa, Mycobacterium
IVALRYRQMRNFWATLMVSQ

SEQ ID NO: 827885 - protein, 19 aa, Mycobacterium
IVAPGVYDGISAHLAKRTG

SEQ ID NO: 827886 - protein, 25 aa, Mycobacterium
IVAPQGLEYIMAFLGALHAGFIAVP

SEQ ID NO: 827887 - protein, 18 aa, Mycobacterium
IVAPVKRMPYPEASRVLL

SEQ ID NO: 827888 - protein, 23 aa, Mycobacterium
IVAQREGLAVRPLSPVFLHARNA

SEQ ID NO: 827889 - protein, 33 aa, Mycobacterium
IVARLTVFQRTPIWCFPKFDVPLSRTARAMMRL

SEQ ID NO: 827890 - protein, 18 aa, Mycobacterium
IVASVLEVLVKKGDAIAE

SEQ ID NO: 827891 - protein, 18 aa, Mycobacterium
IVATAYFPENNPHSADVL

SEQ ID NO: 827892 - protein, 18 aa, Mycobacterium
IVATYLHGCCLARNPQLA

SEQ ID NO: 827893 - protein, 26 aa, Mycobacterium
IVAVASGRWPAVRFAVRHTVVQGPNA

SEQ ID NO: 827894 - protein, 28 aa, Mycobacterium
IVAVEPRRRFAYRWHPFAIDPEVDYEGE

SEQ ID NO: 827895 - protein, 22 aa, Mycobacterium
IVAVIEQYFAPALIGLTLTERE

SEQ ID NO: 827896 - protein, 17 aa, Mycobacterium
IVAVLRKVASAPPTGLR

SEQ ID NO: 827897 - protein, 22 aa, Mycobacterium
IVCEETAAGGCPLLLMLVSSAI

SEQ ID NO: 827898 - protein, 21 aa, Mycobacterium
IVCPWHGWQWRGDGSNALIPY

SEQ ID NO: 827899 - protein, 20 aa, Mycobacterium
IVCPWHGWQWRGDGTNALIP

SEQ ID NO: 827900 - protein, 19 aa, Mycobacterium
IVDAFLAAKWSEAPRHQRR

SEQ ID NO: 827901 - protein, 20 aa, Mycobacterium
IVDAPTCPVALAFPEGPQSE

SEQ ID NO: 827902 - protein, 23 aa, Mycobacterium
IVDASMPAMIRLGGKMYGADGRT

SEQ ID NO: 827903 - protein, 22 aa, Mycobacterium
IVDCAIALGFEKMQPGSLGGGA

SEQ ID NO: 827904 - protein, 43 aa, Mycobacterium
IVDDDLAAHILPRGLRWFVRATAWAPLRHWLIRLTERGGQGAW

SEQ ID NO: 827905 - protein, 29 aa, Mycobacterium
IVDEAWGAHLPFHENLPTWAMDAGADVCV

SEQ ID NO: 827906 - protein, 29 aa, Mycobacterium
IVDEAWGAHLPFHENLPTWAMNAGADVCV

SEQ ID NO: 827907 - protein, 22 aa, Mycobacterium
IVDFARIWRDMPKVVFSRTLES

SEQ ID NO: 827908 - protein, 25 aa, Mycobacterium
IVDGDPLAFKITTPLDLVLAEAVLA

SEQ ID NO: 827909 - protein, 24 aa, Mycobacterium
IVDIQLAQLAKRLEQRRLTLEVSL

SEQ ID NO: 827910 - protein, 17 aa, Mycobacterium
IVDLLTAPGGLLDRVSA

SEQ ID NO: 827911 - protein, 19 aa, Mycobacterium
IVDLSKVGFLASAGMTVLV

SEQ ID NO: 827912 - protein, 18 aa, Mycobacterium
IVDNLGAWRRIGVQRVYT

SEQ ID NO: 827913 - protein, 27 aa, Mycobacterium
IVDNTIATPYLIQPFKHGADIVVHSAT

SEQ ID NO: 827914 - protein, 27 aa, Mycobacterium
IVDNTIATPYLIQPLKHGADIVVHSAT

SEQ ID NO: 827915 - protein, 27 aa, Mycobacterium
IVDNTIATPYLIRPFTQGADIVVHSAT

SEQ ID NO: 827916 - protein, 19 aa, Mycobacterium
IVDRALWVEAGKQGFLGTD

SEQ ID NO: 827917 - protein, 19 aa, Mycobacterium
IVDRFTVLAPSPPVPTMST

SEQ ID NO: 827918 - protein, 18 aa, Mycobacterium
IVDTFFSSDGIYPDTSVL

SEQ ID NO: 827919 - protein, 25 aa, Mycobacterium
IVDTLDYLARLIAEGVLHAPVEATY

SEQ ID NO: 827920 - protein, 19 aa, Mycobacterium
IVDTWWQTETGAIMISPLP

SEQ ID NO: 827921 - protein, 47 aa, Mycobacterium
IVDTYDRFLPYTSRSPWPQAPLLVQLYLHFKIVWPAFGKQFVIRARK

SEQ ID NO: 827922 - protein, 27 aa, Mycobacterium
IVDVALRIWRPRWARWTAHVVRSGGLI

SEQ ID NO: 827923 - protein, 17 aa, Mycobacterium
IVDWLDYAVELGASGVA

SEQ ID NO: 827924 - protein, 18 aa, Mycobacterium
IVDWQFVHGLTPSALAMP

SEQ ID NO: 827925 - protein, 19 aa, Mycobacterium
IVEALKFHLRDLAVTFRFG

SEQ ID NO: 827926 - protein, 23 aa, Mycobacterium
IVEGMLALTGYYAWHKICVERGI

SEQ ID NO: 827927 - protein, 25 aa, Mycobacterium
IVEKLRQRFPKLQDPPSDDICYATQ

SEQ ID NO: 827928 - protein, 27 aa, Mycobacterium
IVELMFAIWAAECVFVPLNFKLHPREM

SEQ ID NO: 827929 - protein, 32 aa, Mycobacterium
IVELSDLELFLLRITLALLSNRPILVVGDLEQ

SEQ ID NO: 827930 - protein, 17 aa, Mycobacterium
IVEPAPRIPFTAGGKID

SEQ ID NO: 827931 - protein, 29 aa, Mycobacterium
IVEQKLYERGIRSYLLDGDNVRYGLNAGP

SEQ ID NO: 827932 - protein, 17 aa, Mycobacterium
IVERFGFSEIMMGTLEK

SEQ ID NO: 827933 - protein, 47 aa, Mycobacterium
IVERRPVGVVGLITAWNAPVHIAMRVLAPALALGNAVVLKPAPETPF

SEQ ID NO: 827934 - protein, 22 aa, Mycobacterium
IVETLIRLRPTFGAVNLEDISA

SEQ ID NO: 827935 - protein, 29 aa, Mycobacterium
IVETPTVRGLLDLLVWAGIEPVGVPMDEE

SEQ ID NO: 827936 - protein, 19 aa, Mycobacterium
IVEYIGQTRGWFYTLHVLA

SEQ ID NO: 827937 - protein, 32 aa, Mycobacterium
IVEYIGQTRGWFYVMHVLATALFDRPAFRTCV

SEQ ID NO: 827938 - protein, 26 aa, Mycobacterium
IVEYNGKFPPPVKFQIAYDPGHVWQS

SEQ ID NO: 827939 - protein, 18 aa, Mycobacterium
IVFARDWGFRLEDVSVPV

SEQ ID NO: 827940 - protein, 18 aa, Mycobacterium
IVFARDWGFRLEEVTVPV

SEQ ID NO: 827941 - protein, 19 aa, Mycobacterium
IVFGDWPAHTGARPAVTLP

SEQ ID NO: 827942 - protein, 17 aa, Mycobacterium
IVFIGPPASAIATMGDK

SEQ ID NO: 827943 - protein, 18 aa, Mycobacterium
IVFLPDYDMSMARKLYHG

SEQ ID NO: 827944 - protein, 19 aa, Mycobacterium
IVFTIRIPLEIDMVIDLRI

SEQ ID NO: 827945 - protein, 21 aa, Mycobacterium
IVFVHGEVISSKRGELSVLAD

SEQ ID NO: 827946 - protein, 30 aa, Mycobacterium
IVGAGYTGLWTAYYLKKADPSLRIAILEAR

SEQ ID NO: 827947 - protein, 29 aa, Mycobacterium
IVGAGYTGLWTAYYLKRADPSLRVVVLDA

SEQ ID NO: 827948 - protein, 17 aa, Mycobacterium
IVGAPVDALVHLAEEEQ

SEQ ID NO: 827949 - protein, 17 aa, Mycobacterium
IVGAPVDALVKLAEDEK

SEQ ID NO: 827950 - protein, 35 aa, Mycobacterium
IVGAVTFNHGKWLPYYASLIERSAAFPPPPPGYDR

SEQ ID NO: 827951 - protein, 30 aa, Mycobacterium
IVGDLNFMLIGAAFYRDTYRRTDAGWKISG

SEQ ID NO: 827952 - protein, 28 aa, Mycobacterium
IVGDSAGLGLIWIADWADDTVHVSSHHA

SEQ ID NO: 827953 - protein, 19 aa, Mycobacterium
IVGEAPRVLILGNMPSVMS

SEQ ID NO: 827954 - protein, 26 aa, Mycobacterium
IVGERHPHFLTTLRKPVIAAINGACV

SEQ ID NO: 827955 - protein, 19 aa, Mycobacterium
IVGGGPYLETLRKLARDCE

SEQ ID NO: 827956 - protein, 17 aa, Mycobacterium
IVGGGPYRTSLHRLAHD

SEQ ID NO: 827957 - protein, 27 aa, Mycobacterium
IVGGMGGLGFVVARWLAEQGAGLIVLN

SEQ ID NO: 827958 - protein, 17 aa, Mycobacterium
IVGGPGLRRLRTAVVEQ

SEQ ID NO: 827959 - protein, 18 aa, Mycobacterium
IVGHGITCIAAIHALELM

SEQ ID NO: 827960 - protein, 25 aa, Mycobacterium
IVGIMRVYANFLAQYSIRVNSVHPA

SEQ ID NO: 827961 - protein, 18 aa, Mycobacterium
IVGKLSVPPSWTGAAPLA

SEQ ID NO: 827962 - protein, 27 aa, Mycobacterium
IVGLKPTYGLVPYTGAFPIERTIDHLG

SEQ ID NO: 827963 - protein, 18 aa, Mycobacterium
IVGLYALSAGLIPETGCV

SEQ ID NO: 827964 - protein, 20 aa, Mycobacterium
IVGMLGLSGIPFTNVFNACA

SEQ ID NO: 827965 - protein, 21 aa, Mycobacterium
IVGNSRMRRLASMNTVKSLAK

SEQ ID NO: 827966 - protein, 19 aa, Mycobacterium
IVGPSASWVFDYFPMRPTG

SEQ ID NO: 827967 - protein, 28 aa, Mycobacterium
IVGQEWLDRYGLRDPLNRGLKYGVKQVF

SEQ ID NO: 827968 - protein, 22 aa, Mycobacterium
IVGQLQRRLRQKRLARTTLTEA

SEQ ID NO: 827969 - protein, 29 aa, Mycobacterium
IVGSGPVFLQYPWQVLPDELVKPLEDAAR

SEQ ID NO: 827970 - protein, 19 aa, Mycobacterium
IVGSKFTLALIAEKCREHR

SEQ ID NO: 827971 - protein, 27 aa, Mycobacterium
IVGVPVVTTWAALTIPVGEPTGLPAAS

SEQ ID NO: 827972 - protein, 18 aa, Mycobacterium
IVGVVENMSWLVLPDGTR

SEQ ID NO: 827973 - protein, 19 aa, Mycobacterium
IVGWTLLGHPIDDAAMVEL

SEQ ID NO: 827974 - protein, 18 aa, Mycobacterium
IVGYLNLSPARDADSAMA

SEQ ID NO: 827975 - protein, 21 aa, Mycobacterium
IVHAALAPGAIIAELGNDAQL

SEQ ID NO: 827976 - protein, 33 aa, Mycobacterium
IVHEQQADCFAGVYLFWVADGKSPRFTLSTADG

SEQ ID NO: 827977 - protein, 17 aa, Mycobacterium
IVHFGVGGFHRAHQAMY

SEQ ID NO: 827978 - protein, 27 aa, Mycobacterium
IVHFTQFILAEIFPGGWLPTIPTVEEH

SEQ ID NO: 827979 - protein, 18 aa, Mycobacterium
IVHLMPPLYHGRGSGAYR

SEQ ID NO: 827980 - protein, 27 aa, Mycobacterium
IVHNETFAPILYVLTYDDLDEAIALNN

SEQ ID NO: 827981 - protein, 18 aa, Mycobacterium
IVHPGLMGTAPSAGLLAK

SEQ ID NO: 827982 - protein, 17 aa, Mycobacterium
IVHRADIEFPAPAVIYG

SEQ ID NO: 827983 - protein, 21 aa, Mycobacterium
IVHVLRMMLAEADLIMAVDGY

SEQ ID NO: 827984 - protein, 26 aa, Mycobacterium
IVHVSSFTALFHPDLETLTADLPVVG

SEQ ID NO: 827985 - protein, 18 aa, Mycobacterium
IVHWHDLGRYLGAYGHRD

SEQ ID NO: 827986 - protein, 26 aa, Mycobacterium
IVIDGWSLPVFAAEMIALYGAGGDPD

SEQ ID NO: 827987 - protein, 17 aa, Mycobacterium
IVIDYYGATTPITQLAS

SEQ ID NO: 827988 - protein, 21 aa, Mycobacterium
IVIFAPLPVLTVTVEDRSGEA

SEQ ID NO: 827989 - protein, 28 aa, Mycobacterium
IVILAAGLDSRAWRLAWPAGCVVYEIDQ

SEQ ID NO: 827990 - protein, 17 aa, Mycobacterium
IVILASGLDSRAYRLDW

SEQ ID NO: 827991 - protein, 17 aa, Mycobacterium
IVIVATDAPLLPHQCAR

SEQ ID NO: 827992 - protein, 26 aa, Mycobacterium
IVIVDMSLAPLLARSLPAISSVHTVI

SEQ ID NO: 827993 - protein, 31 aa, Mycobacterium
IVIYDNGTQMPLMWTQLIPATLEGKALHNVE

SEQ ID NO: 827994 - protein, 18 aa, Mycobacterium
IVKAYFRARAAPGGQRLV

SEQ ID NO: 827995 - protein, 18 aa, Mycobacterium
IVKDSLVHEVDITRYLFG

SEQ ID NO: 827996 - protein, 25 aa, Mycobacterium
IVKVNIGTALNIAYSSAMRTGLAAD

SEQ ID NO: 827997 - protein, 32 aa, Mycobacterium
IVLAARMIALPEWLRRDLGPWSPWGKIQAARS

SEQ ID NO: 827998 - protein, 18 aa, Mycobacterium
IVLAGRRLEPLKNTATEI

SEQ ID NO: 827999 - protein, 18 aa, Mycobacterium
IVLARDALRRLLLKGDGP

SEQ ID NO: 828000 - protein, 29 aa, Mycobacterium
IVLASDQAFFLLAFTKIGLMPDGGASALV

SEQ ID NO: 828001 - protein, 19 aa, Mycobacterium
IVLCDVRMQGVSGLDLCQT

SEQ ID NO: 828002 - protein, 24 aa, Mycobacterium
IVLDDSQVYLALNKPRGVHSTMSD

SEQ ID NO: 828003 - protein, 18 aa, Mycobacterium
IVLDRKGNRHFSFGLGVH

SEQ ID NO: 828004 - protein, 25 aa, Mycobacterium
IVLDRKGNRHFSFGLGVHRCAGSNV

SEQ ID NO: 828005 - protein, 29 aa, Mycobacterium
IVLDRQNRPLRWLPLEELAKPQALAQVTR

SEQ ID NO: 828006 - protein, 18 aa, Mycobacterium
IVLDVPDDKLDELRAGLD

SEQ ID NO: 828007 - protein, 18 aa, Mycobacterium
IVLDVPRGSAARFGYQAG

SEQ ID NO: 828008 - protein, 25 aa, Mycobacterium
IVLHPQQRVAMRVAWKALENSGINP

SEQ ID NO: 828009 - protein, 27 aa, Mycobacterium
IVLLMAVERIELFAEALLAGGRPADTP

SEQ ID NO: 828010 - protein, 17 aa, Mycobacterium
IVLPGSCTRAIDAPAGS

SEQ ID NO: 828011 - protein, 19 aa, Mycobacterium
IVLPNLLRHPVERVINFYR

SEQ ID NO: 828012 - protein, 17 aa, Mycobacterium
IVLQLRDPGPITGIARS

SEQ ID NO: 828013 - protein, 18 aa, Mycobacterium
IVLQRYPGSKYDSATTRS

SEQ ID NO: 828014 - protein, 18 aa, Mycobacterium
IVLQVPKPLQPQQDRSYL

SEQ ID NO: 828015 - protein, 24 aa, Mycobacterium
IVLRDLRWISLYRVNARMVDRFRV

SEQ ID NO: 828016 - protein, 38 aa, Mycobacterium
IVLSCGTFGNVLRFLPPLAISDDLLLEGLDILELILRD

SEQ ID NO: 828017 - protein, 17 aa, Mycobacterium
IVLVPAISPLEEHRELA

SEQ ID NO: 828018 - protein, 21 aa, Mycobacterium
IVLVTPLLEWTAGQIAALRGD

SEQ ID NO: 828019 - protein, 22 aa, Mycobacterium
IVMLHLAIKAFAPGRLPFPVMH

SEQ ID NO: 828020 - protein, 25 aa, Mycobacterium
IVMLHLAIKAFRPGRLPFPVMHVDT

SEQ ID NO: 828021 - protein, 19 aa, Mycobacterium
IVMLNLSPAAVLELYGDVM

SEQ ID NO: 828022 - protein, 18 aa, Mycobacterium
IVMPIFVMMREHGQLWHT

SEQ ID NO: 828023 - protein, 21 aa, Mycobacterium
IVMVKPALGYLDVVSAAASIS

SEQ ID NO: 828024 - protein, 17 aa, Mycobacterium
IVMVRMPGFGLDGPWRD

SEQ ID NO: 828025 - protein, 21 aa, Mycobacterium
IVMVSFPIEVWKQPRVLDSGA

SEQ ID NO: 828026 - protein, 17 aa, Mycobacterium
IVMYVNSEPWLTRAKAR

SEQ ID NO: 828027 - protein, 17 aa, Mycobacterium
IVNAIPAVIAAPPGIRT

SEQ ID NO: 828028 - protein, 18 aa, Mycobacterium
IVNCLAAHHKFGKAAIVV

SEQ ID NO: 828029 - protein, 18 aa, Mycobacterium
IVNGLRFGDAAPVTAPVA

SEQ ID NO: 828030 - protein, 30 aa, Mycobacterium
IVNHFFVCSTHDWILFFTTQGRVYRAKAYD

SEQ ID NO: 828031 - protein, 18 aa, Mycobacterium
IVNIWSAAAGPVAESFHR

SEQ ID NO: 828032 - protein, 18 aa, Mycobacterium
IVNIWTAAPGPVAESFHR

SEQ ID NO: 828033 - protein, 18 aa, Mycobacterium
IVNLARWGGLSAGVTSAS

SEQ ID NO: 828034 - protein, 32 aa, Mycobacterium
IVNNLSVNALAPLPLIPAYSISKAAAFSLTQS

SEQ ID NO: 828035 - protein, 43 aa, Mycobacterium
IVNSPLVHVGGVFRILLCLAEARPFVLLPKFELHSWAEAVREH

SEQ ID NO: 828036 - protein, 34 aa, Mycobacterium
IVPAVLTLAILGIPLEKWNLYSEPVHAAVYTPEH

SEQ ID NO: 828037 - protein, 27 aa, Mycobacterium
IVPAVLTLGLFGVPLKHWEIYCEPAHA

SEQ ID NO: 828038 - protein, 26 aa, Mycobacterium
IVPCPLFATVALGVAPILIAASQEQK

SEQ ID NO: 828039 - protein, 25 aa, Mycobacterium
IVPGAVIFDLPVGDWALRPTAEFGY

SEQ ID NO: 828040 - protein, 17 aa, Mycobacterium
IVPGISAITWRELNREF

SEQ ID NO: 828041 - protein, 27 aa, Mycobacterium
IVPMFHANAWGLIYAALMSGADLVLPD

SEQ ID NO: 828042 - protein, 19 aa, Mycobacterium
IVPMGRPLRQVTKLTRRPV

SEQ ID NO: 828043 - protein, 20 aa, Mycobacterium
IVPMIVWGAHRIWPKDHPRN

SEQ ID NO: 828044 - protein, 17 aa, Mycobacterium
IVPTCWMVAEYIDKHPE

SEQ ID NO: 828045 - protein, 18 aa, Mycobacterium
IVPVFTRHDFDGPVSFVD

SEQ ID NO: 828046 - protein, 19 aa, Mycobacterium
IVPVLLDRSTELVVALLGV

SEQ ID NO: 828047 - protein, 19 aa, Mycobacterium
IVQEAWIRWAGQEAPIENL

SEQ ID NO: 828048 - protein, 19 aa, Mycobacterium
IVQEFWTNKQDRIVKSLLG

SEQ ID NO: 828049 - protein, 26 aa, Mycobacterium
IVQFVVKTLVAMLDWGLDPQQAVSAV

SEQ ID NO: 828050 - protein, 18 aa, Mycobacterium
IVQKRAIQIARENARPVI

SEQ ID NO: 828051 - protein, 24 aa, Mycobacterium
IVQRERERMAFHSASYWDVTAELD

SEQ ID NO: 828052 - protein, 35 aa, Mycobacterium
IVQSFLNIDVPLQALGRLPLLSVGGYRRIELRSGD

SEQ ID NO: 828053 - protein, 31 aa, Mycobacterium
IVQVARWGVKDRLRGLRTARISLAAQRFAAA

SEQ ID NO: 828054 - protein, 25 aa, Mycobacterium
IVRDLRAEFGWLGVALQAYLRRTPG

SEQ ID NO: 828055 - protein, 24 aa, Mycobacterium
IVREAVAMPIDWGTMTLAEGVNDI

SEQ ID NO: 828056 - protein, 25 aa, Mycobacterium
IVREPGHWYSTGADFKRPSPQWWFD

SEQ ID NO: 828057 - protein, 17 aa, Mycobacterium
IVRFLRDRVAPRVFGLP

SEQ ID NO: 828058 - protein, 18 aa, Mycobacterium
IVRGTLGELAEWAAEGVL

SEQ ID NO: 828059 - protein, 35 aa, Mycobacterium
IVRMAIGAVALILLGIRRYGFARPPLLGSTSRTLA

SEQ ID NO: 828060 - protein, 18 aa, Mycobacterium
IVRPLARFLRALHRIDAG

SEQ ID NO: 828061 - protein, 20 aa, Mycobacterium
IVRRLLGLEDALSIGFCGPT

SEQ ID NO: 828062 - protein, 19 aa, Mycobacterium
IVRRLLGLEDVLPIGFCGP

SEQ ID NO: 828063 - protein, 19 aa, Mycobacterium
IVRRLLGLESVLSIGFCGP

SEQ ID NO: 828064 - protein, 24 aa, Mycobacterium
IVRRSNALLDYAYGRRFAYAEQMS

SEQ ID NO: 828065 - protein, 17 aa, Mycobacterium
IVRRWWIREDVMAGTEN

SEQ ID NO: 828066 - protein, 18 aa, Mycobacterium
IVRSFPPFNHEGGTLTFT

SEQ ID NO: 828067 - protein, 23 aa, Mycobacterium
IVRSNPRLQLALAWANIVLHRVP

SEQ ID NO: 828068 - protein, 27 aa, Mycobacterium
IVSDSAALGVIWIADWADDMVNVSAHH

SEQ ID NO: 828069 - protein, 20 aa, Mycobacterium
IVSLRAGGKVIFFGNGGSAQ

SEQ ID NO: 828070 - protein, 18 aa, Mycobacterium
IVSLWLDRLRRRNPDAHA

SEQ ID NO: 828071 - protein, 24 aa, Mycobacterium
IVSNINFFMNVPVDPDGSLGIVDG

SEQ ID NO: 828072 - protein, 18 aa, Mycobacterium
IVSPLSYRKPALARKVNV

SEQ ID NO: 828073 - protein, 17 aa, Mycobacterium
IVSVGRLVPRKGFETLI

SEQ ID NO: 828074 - protein, 25 aa, Mycobacterium
IVSVRVLPPVPVLNRDIRSMQRAAA

SEQ ID NO: 828075 - protein, 26 aa, Mycobacterium
IVTAAPLPGLGFREPLPAAAADHVAA

SEQ ID NO: 828076 - protein, 24 aa, Mycobacterium
IVTALAEFFQVSPAYFYDADYAES

SEQ ID NO: 828077 - protein, 19 aa, Mycobacterium
IVTEIRRLLGAAWTDAAST

SEQ ID NO: 828078 - protein, 24 aa, Mycobacterium
IVTETLRLYPPGWIISRVATADVY

SEQ ID NO: 828079 - protein, 19 aa, Mycobacterium
IVTGLRLMARMAQTGRSLA

SEQ ID NO: 828080 - protein, 18 aa, Mycobacterium
IVTGLRLMSRMAQTGKSL

SEQ ID NO: 828081 - protein, 19 aa, Mycobacterium
IVTGLRLMTRMVQTGSSLA

SEQ ID NO: 828082 - protein, 25 aa, Mycobacterium
IVTIPRLRQVVRRQPLDLSAPEWVE

SEQ ID NO: 828083 - protein, 18 aa, Mycobacterium
IVTLDTWIPGWRPRDLST

SEQ ID NO: 828084 - protein, 26 aa, Mycobacterium
IVTLVTSLLGAYTPFYAAYAGTKAPV

SEQ ID NO: 828085 - protein, 26 aa, Mycobacterium
IVTQWPYTELDYARRTWRLRRRDWIH

SEQ ID NO: 828086 - protein, 24 aa, Mycobacterium
IVTRLMARFPDVDPAAVIAANRKQ

SEQ ID NO: 828087 - protein, 26 aa, Mycobacterium
IVTSTIVVHYLREAPWPSVIDTAIGI

SEQ ID NO: 828088 - protein, 20 aa, Mycobacterium
IVTSVFPEWTDTRAWILNRP

SEQ ID NO: 828089 - protein, 18 aa, Mycobacterium
IVTTAAQFWALVHGFVML

SEQ ID NO: 828090 - protein, 17 aa, Mycobacterium
IVTTLDLPLITGKGLYR

SEQ ID NO: 828091 - protein, 27 aa, Mycobacterium
IVTTNVLGPIRLIAAFIEHLQVRPEAT

SEQ ID NO: 828092 - protein, 18 aa, Mycobacterium
IVTYPGGSLLDMLRPRAS

SEQ ID NO: 828093 - protein, 28 aa, Mycobacterium
IVVALANLRVIRLAYDEPDFARLIVNLG

SEQ ID NO: 828094 - protein, 19 aa, Mycobacterium
IVVAVTRWTVRLTETGWGN

SEQ ID NO: 828095 - protein, 21 aa, Mycobacterium
IVVFDGMKLLDLAGPAEVFAE

SEQ ID NO: 828096 - protein, 35 aa, Mycobacterium
IVVGPMWPEPLGRLAFTFRYRGHRLRLTVLGRSST

SEQ ID NO: 828097 - protein, 18 aa, Mycobacterium
IVVLKPLSRALADADPVY

SEQ ID NO: 828098 - protein, 17 aa, Mycobacterium
IVVPCHRVIAANGILTG

SEQ ID NO: 828099 - protein, 17 aa, Mycobacterium
IVVQPLFQNPTGASLTP

SEQ ID NO: 828100 - protein, 18 aa, Mycobacterium
IVVRQIRSITWCRRRTVQ

SEQ ID NO: 828101 - protein, 22 aa, Mycobacterium
IVVRRLCRPPPFADSGSVGRLA

SEQ ID NO: 828102 - protein, 26 aa, Mycobacterium
IVVSGNYRAWRHFIAMRASEHADVEI

SEQ ID NO: 828103 - protein, 19 aa, Mycobacterium
IVVVPTVPSIPLPFGMWIG

SEQ ID NO: 828104 - protein, 20 aa, Mycobacterium
IVVVTMNFRLGVLGSLYAPD

SEQ ID NO: 828105 - protein, 17 aa, Mycobacterium
IVVWELIDALRRDGVTV

SEQ ID NO: 828106 - protein, 17 aa, Mycobacterium
IVWADAVIFGSPTRFGS

SEQ ID NO: 828107 - protein, 21 aa, Mycobacterium
IVYVHGNVISSRRGELSVLAD

SEQ ID NO: 828108 - protein, 31 aa, Mycobacterium
IWALAEHPPAGTGLLLAPFDPAQHVKRVLWQ

SEQ ID NO: 828109 - protein, 17 aa, Mycobacterium
IWARFGVVAQPAFAFVG

SEQ ID NO: 828110 - protein, 20 aa, Mycobacterium
IWEFPTKFGEICRPDWIPEG

SEQ ID NO: 828111 - protein, 27 aa, Mycobacterium
IWEGEDGVIAWLLGGPEKLYEVPLPGP

SEQ ID NO: 828112 - protein, 27 aa, Mycobacterium
IWEGEDGVISWLLGGPEREYHVPLPAP

SEQ ID NO: 828113 - protein, 21 aa, Mycobacterium
IWENGGFFVLSQGIFDLLPPG

SEQ ID NO: 828114 - protein, 25 aa, Mycobacterium
IWEPGDEFLPFKPTAFRSLAMGHRP

SEQ ID NO: 828115 - protein, 29 aa, Mycobacterium
IWGATGYPQMLLRLGWAPNSAAALPPTPR

SEQ ID NO: 828116 - protein, 32 aa, Mycobacterium
IWGDVELAWRLDAAGRYGPPRRWLVVTGTNGK

SEQ ID NO: 828117 - protein, 17 aa, Mycobacterium
IWGFPKIMADFTVREQG

SEQ ID NO: 828118 - protein, 18 aa, Mycobacterium
IWHAFVDRNTYPGKAEVL

SEQ ID NO: 828119 - protein, 19 aa, Mycobacterium
IWHVLRPLSGADLQRAPRL

SEQ ID NO: 828120 - protein, 20 aa, Mycobacterium
IWHVPRLVAAGRAPWKAGVG

SEQ ID NO: 828121 - protein, 19 aa, Mycobacterium
IWIGPRVVIPSLALRARVR

SEQ ID NO: 828122 - protein, 20 aa, Mycobacterium
IWIGPRVVIPTLALRARARE

SEQ ID NO: 828123 - protein, 20 aa, Mycobacterium
IWIGPRVVIPTLALRARVRE

SEQ ID NO: 828124 - protein, 18 aa, Mycobacterium
IWKREWLVDALRIFEGCR

SEQ ID NO: 828125 - protein, 18 aa, Mycobacterium
IWMGSLLTDRVRAIIANN

SEQ ID NO: 828126 - protein, 19 aa, Mycobacterium
IWMRPEAVPGFRRLTHAIH

SEQ ID NO: 828127 - protein, 17 aa, Mycobacterium
IWQRIHASAYRDMGPTI

SEQ ID NO: 828128 - protein, 36 aa, Mycobacterium
IWQRTLDINLLGYVRTIRAVLPHLLEQGSGSIVNTS

SEQ ID NO: 828129 - protein, 20 aa, Mycobacterium
IWRDYLAMVSKLHTAMHRQL

SEQ ID NO: 828130 - protein, 17 aa, Mycobacterium
IWRLCSELDLTIVQHGG

SEQ ID NO: 828131 - protein, 18 aa, Mycobacterium
IWRRIRAENLPVALSDRL

SEQ ID NO: 828132 - protein, 28 aa, Mycobacterium
IWSQLSQWPPLQQLLRLLPGCKAPSSSG

SEQ ID NO: 828133 - protein, 18 aa, Mycobacterium
IWSYIGAEQIKLPSIYYA

SEQ ID NO: 828134 - protein, 18 aa, Mycobacterium
IWTIQNAILPPGAAASYS

SEQ ID NO: 828135 - protein, 24 aa, Mycobacterium
IWTSVGHLANWIFALCRTDMDAPK

SEQ ID NO: 828136 - protein, 18 aa, Mycobacterium
IWTTLGHHTLLAHLAVDH

SEQ ID NO: 828137 - protein, 17 aa, Mycobacterium
IWVFPKPDKEVTSAIRW

SEQ ID NO: 828138 - protein, 26 aa, Mycobacterium
IWVVTPNGRFTIAAYAAPKTGGLWRE

SEQ ID NO: 828139 - protein, 20 aa, Mycobacterium
IWWQIYPLGFVGAHPADPPP

SEQ ID NO: 828140 - protein, 20 aa, Mycobacterium
IWWRFREAIQTAPKLDIGWF

SEQ ID NO: 828141 - protein, 18 aa, Mycobacterium
IWYRIRINLQHVPEGERP

SEQ ID NO: 828142 - protein, 18 aa, Mycobacterium
IYADPRQLEKVWGPPSCP

SEQ ID NO: 828143 - protein, 20 aa, Mycobacterium
IYAGFSPLYYSPFGDHGRTG

SEQ ID NO: 828144 - protein, 18 aa, Mycobacterium
IYAHHPRFLGVRRAYESR

SEQ ID NO: 828145 - protein, 20 aa, Mycobacterium
IYAHSDLLERIRAHTPLHLA

SEQ ID NO: 828146 - protein, 25 aa, Mycobacterium
IYAPDSHSWWDVPVSQVSALESTRA

SEQ ID NO: 828147 - protein, 30 aa, Mycobacterium
IYASAIAPQRWLTAIAGISRTLCATGGGLL

SEQ ID NO: 828148 - protein, 17 aa, Mycobacterium
IYASIKGFGPGKYANFK

SEQ ID NO: 828149 - protein, 19 aa, Mycobacterium
IYCLGEPTEPLLLRGLDLS

SEQ ID NO: 828150 - protein, 18 aa, Mycobacterium
IYDKFPTLTPEQAAGVIT

SEQ ID NO: 828151 - protein, 24 aa, Mycobacterium
IYDPPMRTMIALGARYPTTAIPST

SEQ ID NO: 828152 - protein, 18 aa, Mycobacterium
IYDRFLELAAIRTKAVRQ

SEQ ID NO: 828153 - protein, 23 aa, Mycobacterium
IYDTMTLAPCDIATYAMGMAASM

SEQ ID NO: 828154 - protein, 21 aa, Mycobacterium
IYDVNFKGVWLALAAEIAAIR

SEQ ID NO: 828155 - protein, 18 aa, Mycobacterium
IYEEDFVLALPPGHPLAG

SEQ ID NO: 828156 - protein, 24 aa, Mycobacterium
IYEKDRLLAPLLQDMLAPPHPRAE

SEQ ID NO: 828157 - protein, 27 aa, Mycobacterium
IYEKDRLLAPLLQDMLAPPHPRAPGAT

SEQ ID NO: 828158 - protein, 20 aa, Mycobacterium
IYELEALLEMVFHRGSKMHD

SEQ ID NO: 828159 - protein, 19 aa, Mycobacterium
IYEPPRFFEAFLRGRAHTE

SEQ ID NO: 828160 - protein, 35 aa, Mycobacterium
IYERAAWTGSVARPPQWWRLHELFDAADPVKPYVV

SEQ ID NO: 828161 - protein, 24 aa, Mycobacterium
IYERFYKYLTGCADLFRDGYTDVV

SEQ ID NO: 828162 - protein, 18 aa, Mycobacterium
IYFKGLGGIAPPLPMAFA

SEQ ID NO: 828163 - protein, 17 aa, Mycobacterium
IYFSGDTLYRRFMTPRL

SEQ ID NO: 828164 - protein, 30 aa, Mycobacterium
IYGGMKLDLLLTVPWDYYRKFMSVNHDGAL

SEQ ID NO: 828165 - protein, 21 aa, Mycobacterium
IYGIGGSWFRLNDDLLIEWQR

SEQ ID NO: 828166 - protein, 17 aa, Mycobacterium
IYGPTRNARYCYTRLTK

SEQ ID NO: 828167 - protein, 21 aa, Mycobacterium
IYHDGWRAVCPWPGTSFAEST

SEQ ID NO: 828168 - protein, 23 aa, Mycobacterium
IYHYAPYEKTALLRLAGRYGVGE

SEQ ID NO: 828169 - protein, 18 aa, Mycobacterium
IYIVEFTPRELWGARAEP

SEQ ID NO: 828170 - protein, 25 aa, Mycobacterium
IYLNLANYLNSWKRLGFCERDIARP

SEQ ID NO: 828171 - protein, 20 aa, Mycobacterium
IYLVDKLLSDGFRPTLFIVE

SEQ ID NO: 828172 - protein, 19 aa, Mycobacterium
IYMHYLTGCSDLFRDHYTD

SEQ ID NO: 828173 - protein, 28 aa, Mycobacterium
IYNDKELFALEKEKLFGRAWTFVGHESE

SEQ ID NO: 828174 - protein, 27 aa, Mycobacterium
IYNDKHWNAFIAAVRPPWASELYSTLE

SEQ ID NO: 828175 - protein, 26 aa, Mycobacterium
IYNDLRVVDNVRYFASLYGFGRQAAD

SEQ ID NO: 828176 - protein, 26 aa, Mycobacterium
IYNGGIYMSCTFPDRALDEVFADGAP

SEQ ID NO: 828177 - protein, 20 aa, Mycobacterium
IYPGWDGLAWAVEHIREALL

SEQ ID NO: 828178 - protein, 21 aa, Mycobacterium
IYPLVWNILLAARAEGYGGAL

SEQ ID NO: 828179 - protein, 18 aa, Mycobacterium
IYQLLHEDGRMPFTTLAE

SEQ ID NO: 828180 - protein, 27 aa, Mycobacterium
IYQRYMGWFDGNPAHLWEHPPVENARR

SEQ ID NO: 828181 - protein, 19 aa, Mycobacterium
IYRECIGSFVWTKPKTSAG

SEQ ID NO: 828182 - protein, 19 aa, Mycobacterium
IYREPLSLRPFDYLPRPLR

SEQ ID NO: 828183 - protein, 25 aa, Mycobacterium
IYRHITQTVGPERLSLITDAMAATG

SEQ ID NO: 828184 - protein, 18 aa, Mycobacterium
IYRNPWLTIREDEIRRPD

SEQ ID NO: 828185 - protein, 19 aa, Mycobacterium
IYRQPGFVAAMRDIVALQD

SEQ ID NO: 828186 - protein, 25 aa, Mycobacterium
IYRRIDDAFLDPLQFRADSVLGVAG

SEQ ID NO: 828187 - protein, 19 aa, Mycobacterium
IYRVPLPIHPLVLANHPDL

SEQ ID NO: 828188 - protein, 25 aa, Mycobacterium
IYSDAIALSRLGWAALAVGTSHAVL

SEQ ID NO: 828189 - protein, 18 aa, Mycobacterium
IYTLLPAFAPADPGKENT

SEQ ID NO: 828190 - protein, 37 aa, Mycobacterium
IYTLTDEAPLLATYAFLPILRAFAEPAGIKIKSSDIS

SEQ ID NO: 828191 - protein, 33 aa, Mycobacterium
IYTLTDEAPLLATYAFLPIVRAFAEPAGIQIKT

SEQ ID NO: 828192 - protein, 34 aa, Mycobacterium
IYTLTDEAPLLATYAFLPVVRKFAEAAGIDVKTS

SEQ ID NO: 828193 - protein, 34 aa, Mycobacterium
IYTLTDEAPLLATYAFLPVVRTFASAAGIDVKST

SEQ ID NO: 828194 - protein, 36 aa, Mycobacterium
IYTLTDEAPLLATYSFLPIIRAFAGPAGIDVQTSDI

SEQ ID NO: 828195 - protein, 19 aa, Mycobacterium
IYTWHLAIAMRPRLWVFNS

SEQ ID NO: 828196 - protein, 24 aa, Mycobacterium
IYVEPRYFLYGGFGQHKTSPRTVA

SEQ ID NO: 828197 - protein, 18 aa, Mycobacterium
IYVGPKPDWRYNGFWRAL

SEQ ID NO: 828198 - protein, 18 aa, Mycobacterium
IYVRGEVLPVLRRLQAAV

SEQ ID NO: 828199 - protein, 19 aa, Mycobacterium
IYYGSFHAVAEVSLSILPR

SEQ ID NO: 828200 - protein, 29 aa, Mycobacterium
KAAAADRPWWEWAATYERAFSAAYDALDV

SEQ ID NO: 828201 - protein, 28 aa, Mycobacterium
KAAAAERPWWEWAATYERAFTAAYDALD

SEQ ID NO: 828202 - protein, 29 aa, Mycobacterium
KAAAAGRPWWEWAATYERAFSAAYDALDV

SEQ ID NO: 828203 - protein, 29 aa, Mycobacterium
KAAAAGRPWWEWAATYERAFTAAYDALDV

SEQ ID NO: 828204 - protein, 22 aa, Mycobacterium
KAAAALAKKWLGLRYTMNVIAL

SEQ ID NO: 828205 - protein, 32 aa, Mycobacterium
KAAADLGYSGLPAPLTFVCVFGYTAQTAFFKH

SEQ ID NO: 828206 - protein, 30 aa, Mycobacterium
KAAAESAGLPLFRYIGGPNAHILPVPMMNI

SEQ ID NO: 828207 - protein, 27 aa, Mycobacterium
KAAAETGFPILVKAAFGGGGRGMRIVA

SEQ ID NO: 828208 - protein, 26 aa, Mycobacterium
KAAALPIYVHAPYLINLASANNKVRI

SEQ ID NO: 828209 - protein, 24 aa, Mycobacterium
KAAALQLAVYRRAWASLREIDPAR

SEQ ID NO: 828210 - protein, 17 aa, Mycobacterium
KAAAQLLRRVRSRLARL

SEQ ID NO: 828211 - protein, 28 aa, Mycobacterium
KAADAGRPWWEWAATYERAFTAAYDALG

SEQ ID NO: 828212 - protein, 24 aa, Mycobacterium
KAADRPWRMWLPGHREVSAYRRSP

SEQ ID NO: 828213 - protein, 20 aa, Mycobacterium
KAAEIAINSPLLEQSMEGAQ

SEQ ID NO: 828214 - protein, 28 aa, Mycobacterium
KAAELGLVPLVRIVSWGVAGVAPKIMGI

SEQ ID NO: 828215 - protein, 28 aa, Mycobacterium
KAAEYGLTPLVRLVSWGVAGVAPHIMGI

SEQ ID NO: 828216 - protein, 20 aa, Mycobacterium
KAAFLQRYSGPRRALAVAAI

SEQ ID NO: 828217 - protein, 22 aa, Mycobacterium
KAAGIIYQATLRHELHAERGFE

SEQ ID NO: 828218 - protein, 17 aa, Mycobacterium
KAAGIRSLLAYQWAHPG

SEQ ID NO: 828219 - protein, 22 aa, Mycobacterium
KAAGLFNAPASQVARLAAALQE

SEQ ID NO: 828220 - protein, 23 aa, Mycobacterium
KAAGLFNAPASQVARLAAALQEK

SEQ ID NO: 828221 - protein, 34 aa, Mycobacterium
KAAGLSRLLEAKPVLWRLIATITRQWIDTTRELI

SEQ ID NO: 828222 - protein, 23 aa, Mycobacterium
KAAITAVRAWRRAKPGKAKKAGG

SEQ ID NO: 828223 - protein, 30 aa, Mycobacterium
KAALITDALVYWKPALLIDDIPDTGSLEGD

SEQ ID NO: 828224 - protein, 19 aa, Mycobacterium
KAALQVLTALRPEVADQVG

SEQ ID NO: 828225 - protein, 19 aa, Mycobacterium
KAALWSMTNSLRAELEKQG

SEQ ID NO: 828226 - protein, 23 aa, Mycobacterium
KAANFPYRYPWRDVERQLQRMAG

SEQ ID NO: 828227 - protein, 29 aa, Mycobacterium
KAAPSLLNLLPVKQKWGISVGALLRHFHD

SEQ ID NO: 828228 - protein, 23 aa, Mycobacterium
KAAPVLWSQQVLSTGALRAVILN

SEQ ID NO: 828229 - protein, 21 aa, Mycobacterium
KAAPVLWTQQALTTGQLRAVI

SEQ ID NO: 828230 - protein, 25 aa, Mycobacterium
KAAPVLWTQQVLTTGQLRAVILNSG

SEQ ID NO: 828231 - protein, 26 aa, Mycobacterium
KAAPVLWTQQVLTTGRLRAVILNSGG

SEQ ID NO: 828232 - protein, 20 aa, Mycobacterium
KAAQKFWKLVTLTGMDVGND

SEQ ID NO: 828233 - protein, 29 aa, Mycobacterium
KAARAAADAEWRPKYQASELKSLASQVLK

SEQ ID NO: 828234 - protein, 34 aa, Mycobacterium; identical to SEQ ID NO: 115470

SEQ ID NO: 828235 - protein, 34 aa, Mycobacterium
KAARFIRFCDSFNIPLVFVVDTPGFLPGAEEEKR

SEQ ID NO: 828236 - protein, 34 aa, Mycobacterium
KAARFIRFCDSFQIPLVFVVDTPGFLPGAEEEKR

SEQ ID NO: 828237 - protein, 25 aa, Mycobacterium
KAARVIVPDFQLSLAIGKEGQNARL

SEQ ID NO: 828238 - protein, 22 aa, Mycobacterium
KAASMPIYVHAPYLINVASANN

SEQ ID NO: 828239 - protein, 24 aa, Mycobacterium
KAATGLLVIDPYNDFISPGGKVWD

SEQ ID NO: 828240 - protein, 19 aa, Mycobacterium
KAAVRFIAGYAAAESQRAG

SEQ ID NO: 828241 - protein, 26 aa, Mycobacterium
KAAVRSFARTWTLELAPRAIRVNVIS

SEQ ID NO: 828242 - protein, 19 aa, Mycobacterium
KAAYELWLRDHGGSVVNIS

SEQ ID NO: 828243 - protein, 17 aa, Mycobacterium
KACALDPTGMSAVLGGD

SEQ ID NO: 828244 - protein, 17 aa, Mycobacterium
KACFPEHLAKGEKLLVF

SEQ ID NO: 828245 - protein, 24 aa, Mycobacterium
KACPWLGDHKVFGQAIMPAAGFAE

SEQ ID NO: 828246 - protein, 20 aa, Mycobacterium
KADARFIAAARQLVPELIAE

SEQ ID NO: 828247 - protein, 38 aa, Mycobacterium
KADGVYHLFGLLAKLAVLPKLTPILLPDTARTNIVPVD

SEQ ID NO: 828248 - protein, 29 aa, Mycobacterium
KADLPAFDELLRRLPWPLNLTTSVNKCAA

SEQ ID NO: 828249 - protein, 21 aa, Mycobacterium
KADLRQTYPFGMFAVPQSQIS

SEQ ID NO: 828250 - protein, 17 aa, Mycobacterium
KADLRTLETFGRPVVAA

SEQ ID NO: 828251 - protein, 17 aa, Mycobacterium
KADLVIGAVLVPGAKAP

SEQ ID NO: 828252 - protein, 24 aa, Mycobacterium
KADLVSEFICRLLNYMDDNGFDRV

SEQ ID NO: 828253 - protein, 29 aa, Mycobacterium
KADPSLRIAILEARFAGFGASGRNGGWLS

SEQ ID NO: 828254 - protein, 24 aa, Mycobacterium
KADQQHFLVAYPDGLHRAWNAGTC

SEQ ID NO: 828255 - protein, 19 aa, Mycobacterium
KADSHDICFIPSGDTKAFL

SEQ ID NO: 828256 - protein, 28 aa, Mycobacterium
KADSIVIGGGMCFTFLAAQGYSVGTSLL

SEQ ID NO: 828257 - protein, 29 aa, Mycobacterium
KADSIVIGGGMCFTFLAAQGYSVGTSLLE

SEQ ID NO: 828258 - protein, 29 aa, Mycobacterium
KADSLVIGGGMCFTFLAAQGLPVGKSLVQ

SEQ ID NO: 828259 - protein, 32 aa, Mycobacterium
KADVLAFTAFPRTHWQKIWSNNPIVICSAAVS

SEQ ID NO: 828260 - protein, 20 aa, Mycobacterium
KADYWAVFDLPADVEPGIAA

SEQ ID NO: 828261 - protein, 24 aa, Mycobacterium
KAEELGLTWLAEIGAHGVVAGPDS

SEQ ID NO: 828262 - protein, 30 aa, Mycobacterium
KAEGTFEYQALLFIPKHAPFDLFNRDASFG

SEQ ID NO: 828263 - protein, 18 aa, Mycobacterium
KAELLGVDPALIDAHGAV

SEQ ID NO: 828264 - protein, 17 aa, Mycobacterium
KAELNLGKLLTKRARII

SEQ ID NO: 828265 - protein, 26 aa, Mycobacterium
KAELWPDLNLGLPFTYHQGYQSSPVP

SEQ ID NO: 828266 - protein, 17 aa, Mycobacterium
KAEMEQVAVIRYLIRHT

SEQ ID NO: 828267 - protein, 25 aa, Mycobacterium
KAEPRPCWGHPMYNPIWAAATKHDI

SEQ ID NO: 828268 - protein, 19 aa, Mycobacterium
KAESSWASRVSLAHALIGW

SEQ ID NO: 828269 - protein, 24 aa, Mycobacterium
KAETLKCAKGFRYYARNAERLLAD

SEQ ID NO: 828270 - protein, 22 aa, Mycobacterium
KAEVHRLIRTLADEGLAIIMVS

SEQ ID NO: 828271 - protein, 22 aa, Mycobacterium
KAFAARWRQLLVAAGLIAVSWP

SEQ ID NO: 828272 - protein, 18 aa, Mycobacterium
KAFESWRWSTPSERQRAL

SEQ ID NO: 828273 - protein, 20 aa, Mycobacterium
KAFLSAHELQWHGTQMHRLG

SEQ ID NO: 828274 - protein, 24 aa, Mycobacterium
KAFNTIFGVVLGQGRPLDVFLAGD

SEQ ID NO: 828275 - protein, 25 aa, Mycobacterium
KAFNTVFGVVLAKGRPLDVFVAGDD

SEQ ID NO: 828276 - protein, 25 aa, Mycobacterium
KAFSRLFAESLWLELRDHGVDVLEL

SEQ ID NO: 828277 - protein, 17 aa, Mycobacterium
KAFVLSYTHSLRGELRG

SEQ ID NO: 828278 - protein, 21 aa, Mycobacterium
KAFYSALFGWTLQEAGPEYGG

SEQ ID NO: 828279 - protein, 26 aa, Mycobacterium
KAGAFVNWEGRFRPFDAALRNTQDAT

SEQ ID NO: 828280 - protein, 22 aa, Mycobacterium
KAGAFVNWEGRYRPFEPALRWS

SEQ ID NO: 828281 - protein, 34 aa, Mycobacterium
KAGATWMLAFGLPRYPRALLDSIRYARSLGLRVA

SEQ ID NO: 828282 - protein, 19 aa, Mycobacterium
KAGDELYCDVWIDSIRKAH

SEQ ID NO: 828283 - protein, 20 aa, Mycobacterium
KAGIAALTLVAAEELERYGV

SEQ ID NO: 828284 - protein, 21 aa, Mycobacterium
KAGIDPELVDDVIWGCVMQAG

SEQ ID NO: 828285 - protein, 28 aa, Mycobacterium
KAGIDRKALRVILGNPLIAITMLRHDVK

SEQ ID NO: 828286 - protein, 27 aa, Mycobacterium
KAGITCAVLIPQGKIAMGKLAQAVIHG

SEQ ID NO: 828287 - protein, 23 aa, Mycobacterium
KAGLEWLYRLASEPRRLARRYLL

SEQ ID NO: 828288 - protein, 17 aa, Mycobacterium
KAGLKLVVVDYLQLMTS

SEQ ID NO: 828289 - protein, 23 aa, Mycobacterium
KAGLPIAFMDCFRVTALRTAANT

SEQ ID NO: 828290 - protein, 24 aa, Mycobacterium
KAGMKAVFAILDSGANLVAFARMD

SEQ ID NO: 828291 - protein, 20 aa, Mycobacterium
KAGNALVFPVSASSADALRS

SEQ ID NO: 828292 - protein, 31 aa, Mycobacterium
KAGRLLFDPLRAALADYLGLDFLAGLRVVPA

SEQ ID NO: 828293 - protein, 31 aa, Mycobacterium
KAGRYNLCPEIKFYATPPIDGAFCRYVTIDD

SEQ ID NO: 828294 - protein, 24 aa, Mycobacterium
KAGSLLFDPLHQALRTYAGLDFLT

SEQ ID NO: 828295 - protein, 23 aa, Mycobacterium
KAGSPLNLLRWTSARTIKETFVP

SEQ ID NO: 828296 - protein, 17 aa, Mycobacterium
KAGTIAVPLFAPELPGH

SEQ ID NO: 828297 - protein, 25 aa, Mycobacterium
KAGVSNPYLSQIERGLRKPSADVLN

SEQ ID NO: 828298 - protein, 23 aa, Mycobacterium
KAHAPLTNRDWWPDQIDVSMLHP

SEQ ID NO: 828299 - protein, 20 aa, Mycobacterium
KAHAPLTNRDWWPDQVDVSS

SEQ ID NO: 828300 - protein, 21 aa, Mycobacterium
KAHFTPTWETGPAGPFDRWPT

SEQ ID NO: 828301 - protein, 29 aa, Mycobacterium
KAHMLEGVPNLFWCVGYTNASWTLRADMT

SEQ ID NO: 828302 - protein, 18 aa, Mycobacterium
KAHRVGGLLLLTGDQQQP

SEQ ID NO: 828303 - protein, 25 aa, Mycobacterium
KAHTALVSLRRFVQLHPVMATPYVI

SEQ ID NO: 828304 - protein, 17 aa, Mycobacterium
KAHYAERLEALYAELAD

SEQ ID NO: 828305 - protein, 17 aa, Mycobacterium
KAHYGERLEQLYTDLAE

SEQ ID NO: 828306 - protein, 17 aa, Mycobacterium
KAIGLLAPGGALFLGDV

SEQ ID NO: 828307 - protein, 21 aa, Mycobacterium
KAIHALTQLDWGRTARAVRIN

SEQ ID NO: 828308 - protein, 30 aa, Mycobacterium
KAIIVLNPAEPPMIMRDTIFCAIPEGADHD

SEQ ID NO: 828309 - protein, 17 aa, Mycobacterium
KAILALQHGVIPRNLHF

SEQ ID NO: 828310 - protein, 20 aa, Mycobacterium
KAILANLATALFEHGRIKTT

SEQ ID NO: 828311 - protein, 20 aa, Mycobacterium
KAILLAHHGQLIAGISIEEA

SEQ ID NO: 828312 - protein, 17 aa, Mycobacterium
KAIMMASLGIFVHSGQG

SEQ ID NO: 828313 - protein, 29 aa, Mycobacterium
KAINVATLPFPGFPTDLQPMAIGLAAIAD

SEQ ID NO: 828314 - protein, 17 aa, Mycobacterium
KAIRFPLVIDGSLPPKI

SEQ ID NO: 828315 - protein, 21 aa, Mycobacterium
KAIRIGFVARTILEPGPDGRE

SEQ ID NO: 828316 - protein, 24 aa, Mycobacterium
KAISLRPVLARFAAAGFGCEVASP

SEQ ID NO: 828317 - protein, 23 aa, Mycobacterium
KAITKRVTVWPQGADIQDRVNNR

SEQ ID NO: 828318 - protein, 32 aa, Mycobacterium
KAITSAHWHVRRWPHVPILLVCDEPARRAAIT

SEQ ID NO: 828319 - protein, 18 aa, Mycobacterium
KAIVAELLDRGAAKIYAT

SEQ ID NO: 828320 - protein, 18 aa, Mycobacterium
KAIVLGEHLVVHGAAALA

SEQ ID NO: 828321 - protein, 33 aa, Mycobacterium
KAIYQRYMGWFDGNPGRLWPYPPEAIAPRYVEA

SEQ ID NO: 828322 - protein, 25 aa, Mycobacterium
KAKALLAKRGFDPVLGARPLRRTIQ

SEQ ID NO: 828323 - protein, 17 aa, Mycobacterium
KAKELAGAVTGNDSLTA

SEQ ID NO: 828324 - protein, 18 aa, Mycobacterium
KAKEVAGIVTDNDGLREE

SEQ ID NO: 828325 - protein, 18 aa, Mycobacterium
KAKEVVGAVTGNDSLTAE

SEQ ID NO: 828326 - protein, 17 aa, Mycobacterium
KAKGFSCYPKKTPWLED

SEQ ID NO: 828327 - protein, 26 aa, Mycobacterium
KAKGLGTNLSLPPKLLPSRESGRGSG

SEQ ID NO: 828328 - protein, 26 aa, Mycobacterium
KAKGLGTNLSLPPKLLPSRETGRGSG

SEQ ID NO: 828329 - protein, 27 aa, Mycobacterium
KAKKLRVRLPLLKLTVAVPDPKRLEPY

SEQ ID NO: 828330 - protein, 23 aa, Mycobacterium
KAKLAAFGMKWGYKAQLDKLDKL

SEQ ID NO: 828331 - protein, 25 aa, Mycobacterium
KAKQQGLWNLFLPAESGLTNLEYAP

SEQ ID NO: 828332 - protein, 39 aa, Mycobacterium
KAKQWGIDSFLFFPNFMLLIWAPGWYLTYHYWPTTVDKH

SEQ ID NO: 828333 - protein, 17 aa, Mycobacterium
KALAAFGGIGLRLKASD

SEQ ID NO: 828334 - protein, 23 aa, Mycobacterium
KALALYHSKRLAAPGQRIVLYAR

SEQ ID NO: 828335 - protein, 23 aa, Mycobacterium
KALALYHTKRLASPGQRIVLYAK

SEQ ID NO: 828336 - protein, 20 aa, Mycobacterium
KALAYYTFRNWDIAQSWTGF

SEQ ID NO: 828337 - protein, 25 aa, Mycobacterium
KALEEAGFFTLLQPQQWGGLQCDPT

SEQ ID NO: 828338 - protein, 20 aa, Mycobacterium
KALFEEGISTSRMGLDPARG

SEQ ID NO: 828339 - protein, 25 aa, Mycobacterium
KALGLAELTRLGLPVPPGFVIADAS

SEQ ID NO: 828340 - protein, 28 aa, Mycobacterium
KALHRRCADVRYLGSWPTGQTYAGQPPP

SEQ ID NO: 828341 - protein, 22 aa, Mycobacterium
KALIQWRSPSWFASMQQGGSHR

SEQ ID NO: 828342 - protein, 17 aa, Mycobacterium
KALLAKRGFDPVLGARP

SEQ ID NO: 828343 - protein, 20 aa, Mycobacterium
KALLANLATALFEHGRIKTT

SEQ ID NO: 828344 - protein, 17 aa, Mycobacterium
KALLANLATSLFEHGRI

SEQ ID NO: 828345 - protein, 20 aa, Mycobacterium
KALLARIGDAFLAFPDGFTP

SEQ ID NO: 828346 - protein, 32 aa, Mycobacterium
KALLDAPDFIRLGLMLALERRPTEPRARTMFL

SEQ ID NO: 828347 - protein, 17 aa, Mycobacterium
KALLDRLTAEELPDGWD

SEQ ID NO: 828348 - protein, 20 aa, Mycobacterium
KALLRRLVEAGTRVVQYGYA

SEQ ID NO: 828349 - protein, 18 aa, Mycobacterium
KALLSRIGDAFLALPEGF

SEQ ID NO: 828350 - protein, 28 aa, Mycobacterium
KALMPDKPFFMYFAPGATHAPHHVPKVW

SEQ ID NO: 828351 - protein, 18 aa, Mycobacterium
KALPAPIDHFLVQADLTV

SEQ ID NO: 828352 - protein, 19 aa, Mycobacterium
KALQQTLFHMGKAVLESYP

SEQ ID NO: 828353 - protein, 37 aa, Mycobacterium
KALQSDYVDLFLIHWPLPTLYGGDFVSTWKVFEEFAR

SEQ ID NO: 828354 - protein, 18 aa, Mycobacterium
KALRERVFRIYNEHIADL

SEQ ID NO: 828355 - protein, 19 aa, Mycobacterium
KALRESTPVFRAPQAVVLS

SEQ ID NO: 828356 - protein, 17 aa, Mycobacterium
KALRFYTEVLGFVVKHD

SEQ ID NO: 828357 - protein, 23 aa, Mycobacterium
KALRQFRKVMRFIAVDSGQSIEE

SEQ ID NO: 828358 - protein, 20 aa, Mycobacterium
KALRRGVFHNSRRLDNGNWT

SEQ ID NO: 828359 - protein, 17 aa, Mycobacterium
KALSKDVRLLILDEPTA

SEQ ID NO: 828360 - protein, 19 aa, Mycobacterium
KALSLPSVRGLIVGRTLLY

SEQ ID NO: 828361 - protein, 19 aa, Mycobacterium
KALTLARTVGRVNPTAWVF

SEQ ID NO: 828362 - protein, 20 aa, Mycobacterium
KALVARLYAQRYLADRSPLR

SEQ ID NO: 828363 - protein, 27 aa, Mycobacterium
KALYDEHAAVLWRYALRLTGDASQAED

SEQ ID NO: 828364 - protein, 18 aa, Mycobacterium
KALYPGCYLDISPSTAIP

SEQ ID NO: 828365 - protein, 28 aa, Mycobacterium
KAMAAIDEFAMPVAPWMFGAAGREHMRQ

SEQ ID NO: 828366 - protein, 19 aa, Mycobacterium
KAMGAIAMFGERYPDEVRV

SEQ ID NO: 828367 - protein, 27 aa, Mycobacterium
KAMVKGLPPLLLRPVMDAIAFVTESLQ

SEQ ID NO: 828368 - protein, 26 aa, Mycobacterium
KANFSVYPLEWVPVPEGRLVLQTLRS

SEQ ID NO: 828369 - protein, 21 aa, Mycobacterium
KANLIWTPQPAMPGQLRAVTN

SEQ ID NO: 828370 - protein, 22 aa, Mycobacterium
KANLKLVVVDYLQLMTSGKKHE

SEQ ID NO: 828371 - protein, 19 aa, Mycobacterium
KANLNWTPQPAMPGQLRAV

SEQ ID NO: 828372 - protein, 17 aa, Mycobacterium
KANPRLVVARMPAFGLT

SEQ ID NO: 828373 - protein, 24 aa, Mycobacterium
KANRLIPLMLQTQVPIVAVVRGWA

SEQ ID NO: 828374 - protein, 23 aa, Mycobacterium
KANRRHLLEHKPSTRTRRLEGRT

SEQ ID NO: 828375 - protein, 25 aa, Mycobacterium
KANRRHLLEHKPTSRTRRLDGRAVV

SEQ ID NO: 828376 - protein, 17 aa, Mycobacterium
KANRRHLLEHKSSTRTR

SEQ ID NO: 828377 - protein, 30 aa, Mycobacterium
KANSLITPVYLPMDPLSALAFLTELRHKHG

SEQ ID NO: 828378 - protein, 31 aa, Mycobacterium
KAPESVLLMAAKLRNLFVASGKLQVGRLWVE

SEQ ID NO: 828379 - protein, 26 aa, Mycobacterium
KAPFFGDRRKAFLDDLAIVTGGQVVN

SEQ ID NO: 828380 - protein, 26 aa, Mycobacterium
KAPFFGDRRKAFLDDLAVVTGGQVVN

SEQ ID NO: 828381 - protein, 27 aa, Mycobacterium
KAPFFGDRRKAFLEDLAIVTGGQVINP

SEQ ID NO: 828382 - protein, 25 aa, Mycobacterium
KAPFFGDRRKAFLEDLAIVTNAQVV

SEQ ID NO: 828383 - protein, 26 aa, Mycobacterium
KAPFFGDRRKAFLEDLAVVTGGQVVN

SEQ ID NO: 828384 - protein, 26 aa, Mycobacterium
KAPGVPMLFPPWLERLQLKYVNPVMT

SEQ ID NO: 828385 - protein, 17 aa, Mycobacterium
KAPLDVCLVRKLGAPQW

SEQ ID NO: 828386 - protein, 19 aa, Mycobacterium
KAPLERDGGFRHRIQAVVA

SEQ ID NO: 828387 - protein, 23 aa, Mycobacterium
KAPTAMHLQFLRGGVAGDPTDYA

SEQ ID NO: 828388 - protein, 20 aa, Mycobacterium
KAPWDFSPQTLQRFAPGSYD

SEQ ID NO: 828389 - protein, 24 aa, Mycobacterium
KAQAAQYAFILNKLTHAADGDQQR

SEQ ID NO: 828390 - protein, 24 aa, Mycobacterium
KAQAYRLHTFGTVTRLANGGELGA

SEQ ID NO: 828391 - protein, 23 aa, Mycobacterium
KAQEALNFFLESSSLFGRRRGVR

SEQ ID NO: 828392 - protein, 29 aa, Mycobacterium
KAQHLQIPSERWVFPYAGADAHDTYAIGE

SEQ ID NO: 828393 - protein, 27 aa, Mycobacterium
KAQKLRVRLPLLKLTVAVQDPGRLEPY

SEQ ID NO: 828394 - protein, 29 aa, Mycobacterium
KAQLLYDDLKPLLQFIVAGGLPTTVKAGL

SEQ ID NO: 828395 - protein, 24 aa, Mycobacterium
KAQQGVMELLLINHPLDCPVCDKG

SEQ ID NO: 828396 - protein, 24 aa, Mycobacterium
KAQRGVMELLLINHPLDCPICDKG

SEQ ID NO: 828397 - protein, 24 aa, Mycobacterium
KAQRLAEKLWKLRILDDERSASDV

SEQ ID NO: 828398 - protein, 26 aa, Mycobacterium
KAQRTAFLHVDYRRIALIGAQLQVEA

SEQ ID NO: 828399 - protein, 25 aa, Mycobacterium
KAQYTKLMRSYTRLADLVAARDGAE

SEQ ID NO: 828400 - protein, 25 aa, Mycobacterium
KARAAGLWNLFLPDPELGGGLSNSE

SEQ ID NO: 828401 - protein, 20 aa, Mycobacterium
KARAVAGWAYAAHSVDNARL

SEQ ID NO: 828402 - protein, 22 aa, Mycobacterium
KARFTGTISLRYVRGTPLGPLR

SEQ ID NO: 828403 - protein, 25 aa, Mycobacterium
KARIDAARLLVWRAGWMARNNHNFD

SEQ ID NO: 828404 - protein, 25 aa, Mycobacterium
KARIDAARLLVYRAGWMARNGKAFE

SEQ ID NO: 828405 - protein, 32 aa, Mycobacterium
KARIEFKLRDWLFARQRYWGEPFPIVYDSDGR

SEQ ID NO: 828406 - protein, 17 aa, Mycobacterium
KARLKFLVKDWGVEKFR

SEQ ID NO: 828407 - protein, 17 aa, Mycobacterium
KARLKLLDDLEPLRIGD

SEQ ID NO: 828408 - protein, 22 aa, Mycobacterium
KARLRLFEYTTLNSAPIELEVS

SEQ ID NO: 828409 - protein, 20 aa, Mycobacterium
KARLSWAGSTLVGVGVARLD

SEQ ID NO: 828410 - protein, 25 aa, Mycobacterium
KARNPLMQGMPGMPAGFPDLSHMPE

SEQ ID NO: 828411 - protein, 22 aa, Mycobacterium
KARPDIGPLFYEPTVLTDVTPE

SEQ ID NO: 828412 - protein, 19 aa, Mycobacterium
KARQRLAHRLPSRPDPQAL

SEQ ID NO: 828413 - protein, 19 aa, Mycobacterium
KARRLAEKLWNLRILAEER

SEQ ID NO: 828414 - protein, 20 aa, Mycobacterium
KARRLRQVASRAALRVAVDS

SEQ ID NO: 828415 - protein, 24 aa, Mycobacterium
KARRLVRHAHWPEDWHPMRHDASP

SEQ ID NO: 828416 - protein, 24 aa, Mycobacterium
KARTARDVWWVDVLLTQLESKLNL

SEQ ID NO: 828417 - protein, 20 aa, Mycobacterium
KARYLMPTRDLIVNDVEAAV

SEQ ID NO: 828418 - protein, 21 aa, Mycobacterium
KASAGFFPLDPGYPAARKQLM

SEQ ID NO: 828419 - protein, 26 aa, Mycobacterium
KASAPRLPSFALWLQEHEIGGLAVGF

SEQ ID NO: 828420 - protein, 19 aa, Mycobacterium
KASDFTYAIQRLFKADSGG

SEQ ID NO: 828421 - protein, 40 aa, Mycobacterium
KASKTPFFMYGVDGEPLFMAGLWTTWRPPGAPKDHAPLVS

SEQ ID NO: 828422 - protein, 18 aa, Mycobacterium
KASLMTRLMPGASAIVVL

SEQ ID NO: 828423 - protein, 18 aa, Mycobacterium
KASLMTRLMPGASVIIVL

SEQ ID NO: 828424 - protein, 25 aa, Mycobacterium
KASTIPLYIHAPYLINVASANNRVR

SEQ ID NO: 828425 - protein, 24 aa, Mycobacterium
KASTIPLYVHAPYLINVASANNRV

SEQ ID NO: 828426 - protein, 21 aa, Mycobacterium
KASTKFTRLTGRSPILLAGMT

SEQ ID NO: 828427 - protein, 21 aa, Mycobacterium
KASVEVPVPFAGTIVELHGDP

SEQ ID NO: 828428 - protein, 26 aa, Mycobacterium
KATAPKPAPPLPSLPGRKSKPTIAVV

SEQ ID NO: 828429 - protein, 25 aa, Mycobacterium
KATAWIAEGLFGYLAPEAQDRLLDA

SEQ ID NO: 828430 - protein, 21 aa, Mycobacterium
KATAWPGCPPRLLRVAGGHAD

SEQ ID NO: 828431 - protein, 20 aa, Mycobacterium
KATEFILLANQTDTPLIFLQ

SEQ ID NO: 828432 - protein, 26 aa, Mycobacterium
KATELGIPIPGFSSALSYYDGLRTER

SEQ ID NO: 828433 - protein, 31 aa, Mycobacterium
KATETWRYPAFFHGLLSRGVYPPASAFETWF

SEQ ID NO: 828434 - protein, 25 aa, Mycobacterium
KATGLVVVPVMFDRIMDLPAEVRRR

SEQ ID NO: 828435 - protein, 17 aa, Mycobacterium
KATHGHVWKLQNEFRIP

SEQ ID NO: 828436 - protein, 24 aa, Mycobacterium
KATKLPRFIQKRLDGIALLITTGF

SEQ ID NO: 828437 - protein, 19 aa, Mycobacterium
KATLAFAFSHRSYLDGMLL

SEQ ID NO: 828438 - protein, 20 aa, Mycobacterium
KATLRRLYRHPGSGQLVAME

SEQ ID NO: 828439 - protein, 19 aa, Mycobacterium
KATLWLDSERLHLFDPHSG

SEQ ID NO: 828440 - protein, 25 aa, Mycobacterium
KATMPIPPLVVLPSTSGTGADVSQF

SEQ ID NO: 828441 - protein, 20 aa, Mycobacterium
KATPTTPPFKATYDAQVRLA

SEQ ID NO: 828442 - protein, 21 aa, Mycobacterium
KATVYRLLQHLVSQGFVVAEP

SEQ ID NO: 828443 - protein, 25 aa, Mycobacterium
KATWSTDLMLLLMTAGVPQERYFTF

SEQ ID NO: 828444 - protein, 18 aa, Mycobacterium
KATYRSTAVRPEGDDYLV

SEQ ID NO: 828445 - protein, 25 aa, Mycobacterium
KAVADKMMSVLTGLGLKSFGAEGED

SEQ ID NO: 828446 - protein, 26 aa, Mycobacterium
KAVASKLRRMEFAIAVAKTLANQTAE

SEQ ID NO: 828447 - protein, 26 aa, Mycobacterium
KAVATSWHYLFTVAATVASAWRFGPG

SEQ ID NO: 828448 - protein, 26 aa, Mycobacterium
KAVATTWHYLFTVAATVASAWELRAG

SEQ ID NO: 828449 - protein, 22 aa, Mycobacterium
KAVDIALEWLTRGDLNIAQGWM

SEQ ID NO: 828450 - protein, 28 aa, Mycobacterium
KAVDVAAVLYQLYRPLPAGPNWPDHACW

SEQ ID NO: 828451 - protein, 24 aa, Mycobacterium
KAVGPDFIICYRLSMADYVPDGQT

SEQ ID NO: 828452 - protein, 24 aa, Mycobacterium
KAVHGFIVLDGTPPPEILRRGREQ

SEQ ID NO: 828453 - protein, 28 aa, Mycobacterium
KAVHPLVWRLVAPVFNPLAAFLTTGGLP

SEQ ID NO: 828454 - protein, 27 aa, Mycobacterium
KAVHVSAIKFPNLELGLPAIDINIGTG

SEQ ID NO: 828455 - protein, 22 aa, Mycobacterium
KAVIVGLYEGMWRASPQFESWQ

SEQ ID NO: 828456 - protein, 24 aa, Mycobacterium
KAVLEPLAILTDRGFEVTLVPPTR

SEQ ID NO: 828457 - protein, 17 aa, Mycobacterium
KAVLLKLVTRMIRARVF

SEQ ID NO: 828458 - protein, 17 aa, Mycobacterium
KAVLPAAKFTERTLAEV

SEQ ID NO: 828459 - protein, 19 aa, Mycobacterium
KAVLPANDVLISTIMGLVI

SEQ ID NO: 828460 - protein, 24 aa, Mycobacterium
KAVNFEAPLPLGPAPSEGPKPKPP

SEQ ID NO: 828461 - protein, 29 aa, Mycobacterium
KAVNGVDLTLFQGDLRFLIGPNGAGKTTV

SEQ ID NO: 828462 - protein, 20 aa, Mycobacterium
KAVRAVRLFGKAAPSLMYAA

SEQ ID NO: 828463 - protein, 23 aa, Mycobacterium
KAVRTPFLSRGLSLGARVIDAIP

SEQ ID NO: 828464 - protein, 19 aa, Mycobacterium
KAVVLLHEMLRHCKPLGAW

SEQ ID NO: 828465 - protein, 18 aa, Mycobacterium
KAVVLNIFPSVDTPVCAA

SEQ ID NO: 828466 - protein, 21 aa, Mycobacterium
KAVWPEIWTAIGPMLAGVVAT

SEQ ID NO: 828467 - protein, 19 aa, Mycobacterium
KAWGSRFPVITVRDQVAAD

SEQ ID NO: 828468 - protein, 20 aa, Mycobacterium
KAWLAEVLPNFPAYYHMLGN

SEQ ID NO: 828469 - protein, 17 aa, Mycobacterium
KAWLAQVLPAFPMYAHM

SEQ ID NO: 828470 - protein, 19 aa, Mycobacterium
KAWLMGDGGSGGHGGNGGA

SEQ ID NO: 828471 - protein, 20 aa, Mycobacterium
KAWRAGRFWWDCTQSADPGA

SEQ ID NO: 828472 - protein, 18 aa, Mycobacterium
KAWSSSRFSKRPALPEGI

SEQ ID NO: 828473 - protein, 20 aa, Mycobacterium
KAWVHALLCGPGRPTVAVDA

SEQ ID NO: 828474 - protein, 28 aa, Mycobacterium
KAYAAAWQVPFYAVNHLGGHLAADVFDH

SEQ ID NO: 828475 - protein, 24 aa, Mycobacterium
KAYAAYSTPFWRANGFSGQALSDN

SEQ ID NO: 828476 - protein, 26 aa, Mycobacterium
KAYAEGLRALYLYTATFQDAAVAEVV

SEQ ID NO: 828477 - protein, 26 aa, Mycobacterium
KAYDAEPFIYLMPDGQLPRTGAVIGS

SEQ ID NO: 828478 - protein, 17 aa, Mycobacterium
KAYFTPAVLTGVTPGMR

SEQ ID NO: 828479 - protein, 19 aa, Mycobacterium
KAYYVAAAFPSACGKTNLA

SEQ ID NO: 828480 - protein, 24 aa, Mycobacterium
KCAELAVRRRAFARALRIAGSPDT

SEQ ID NO: 828481 - protein, 18 aa, Mycobacterium
KCAKGFRYYAENTEALLA

SEQ ID NO: 828482 - protein, 24 aa, Mycobacterium
KCATMRMWLQASKAATYYAAMAVA

SEQ ID NO: 828483 - protein, 33 aa, Mycobacterium
KCEATPYVVMLAAFAALIHRYTHATDFLIAAPV

SEQ ID NO: 828484 - protein, 24 aa, Mycobacterium
KCELVHAALVFALPPVPELRSGRS

SEQ ID NO: 828485 - protein, 19 aa, Mycobacterium
KCETQLTVLAPRREQLTGD

SEQ ID NO: 828486 - protein, 19 aa, Mycobacterium
KCEYEWLHHVEMGREAGLS

SEQ ID NO: 828487 - protein, 23 aa, Mycobacterium
KCGLLQTGRWRPGLSNGGAENAG

SEQ ID NO: 828488 - protein, 18 aa, Mycobacterium
KCGPWHQGGWDPIPERCA

SEQ ID NO: 828489 - protein, 18 aa, Mycobacterium
KCGPWHQGGWDPIPERQG

SEQ ID NO: 828490 - protein, 34 aa, Mycobacterium
KCHLGREQLPLDDRARWLYAKAIQHALVSGWNDL

SEQ ID NO: 828491 - protein, 30 aa, Mycobacterium
KCLCRKHHLLKTFWTGWRDEQRPDGTVVWT

SEQ ID NO: 828492 - protein, 29 aa, Mycobacterium
KCLCRQHHLVKTFWGWRDKQLPDGTVIWT

SEQ ID NO: 828493 - protein, 28 aa, Mycobacterium
KCLRSTFMYLGWLCGAAPSRAALSAAAS

SEQ ID NO: 828494 - protein, 27 aa, Mycobacterium
KCLRSTFMYLGWLCGAGPNNAALSAAA

SEQ ID NO: 828495 - protein, 28 aa, Mycobacterium
KCLRSTFVYLGWLCGAPADPAALRAAAS

SEQ ID NO: 828496 - protein, 22 aa, Mycobacterium
KCNQLFCPVCALAALVEGEHHP

SEQ ID NO: 828497 - protein, 22 aa, Mycobacterium
KCQGHTLCSMIAPDSFELSDID

SEQ ID NO: 828498 - protein, 22 aa, Mycobacterium
KCQQVWCPLCALAALVNGEQHP

SEQ ID NO: 828499 - protein, 21 aa, Mycobacterium
KCQQVWCPVCALAAVATGDQH

SEQ ID NO: 828500 - protein, 24 aa, Mycobacterium
KCRIDAARLLVWRAGWMARNNQSF

SEQ ID NO: 828501 - protein, 24 aa, Mycobacterium
KCRTTAIFGFIACAVVRGGSWRRK

SEQ ID NO: 828502 - protein, 20 aa, Mycobacterium
KCRWLVEELGFDAAIDYQAG

SEQ ID NO: 828503 - protein, 36 aa, Mycobacterium
KCSGKLRKLFNSVGIVFKGSGFYRTDSRSGSVDAAT

SEQ ID NO: 828504 - protein, 32 aa, Mycobacterium
KCSGRLRKLFNSVGVVFKGSGFYRTDSRETDK

SEQ ID NO: 828505 - protein, 19 aa, Mycobacterium
KDAAAPLWTFPRVAWEREL

SEQ ID NO: 828506 - protein, 26 aa, Mycobacterium
KDAEVWDRLTGNFWLPEKVPVSNDIP

SEQ ID NO: 828507 - protein, 17 aa, Mycobacterium
KDAFLLIRRGDTQTAVH

SEQ ID NO: 828508 - protein, 22 aa, Mycobacterium
KDAFTFNVATAHALTVAAVPLM

SEQ ID NO: 828509 - protein, 32 aa, Mycobacterium
KDAGFVVVAPHTYFPRLRLELDKGLGWKAEVE

SEQ ID NO: 828510 - protein, 26 aa, Mycobacterium
KDAGQYFDYLGFDIFYRVDGVAPGTG

SEQ ID NO: 828511 - protein, 28 aa, Mycobacterium
KDAIRQVFVRLLDDLPDAAWNLKTQIFE

SEQ ID NO: 828512 - protein, 24 aa, Mycobacterium
KDALVQLAMLLAGSRRMVFGTCIA

SEQ ID NO: 828513 - protein, 22 aa, Mycobacterium
KDARFDGWFVTAVLTTRIYCRP

SEQ ID NO: 828514 - protein, 28 aa, Mycobacterium
KDARYLDALFPVWRYHPFFTDSDEPVDA

SEQ ID NO: 828515 - protein, 23 aa, Mycobacterium
KDDLDFFIVYSSISGVLGSPGQA

SEQ ID NO: 828516 - protein, 20 aa, Mycobacterium
KDDLILAVMERGVAIVASYL

SEQ ID NO: 828517 - protein, 21 aa, Mycobacterium
KDDPLGPVMKLFDDAGYIGVV

SEQ ID NO: 828518 - protein, 26 aa, Mycobacterium
KDDPRNLFWTTGPASQADGILAMTMI

SEQ ID NO: 828519 - protein, 20 aa, Mycobacterium
KDDPYVMYAIGDAAAEIEAS

SEQ ID NO: 828520 - protein, 32 aa, Mycobacterium
KDDVFSEEFLLQRPLLTAIRRTDPTVLLIDET

SEQ ID NO: 828521 - protein, 32 aa, Mycobacterium
KDDVFSEEFLLQRPLLTAIRRTEPTVLLIDET

SEQ ID NO: 828522 - protein, 29 aa, Mycobacterium
KDDWFWIKVPVGYLYTIANPRTDWCYTTE

SEQ ID NO: 828523 - protein, 24 aa, Mycobacterium
KDEIIHSVAVTPLFLTLSGGGPDV

SEQ ID NO: 828524 - protein, 22 aa, Mycobacterium
KDELLRVRAFYLDIAQWAVDDP

SEQ ID NO: 828525 - protein, 20 aa, Mycobacterium
KDELPSTLRRSNAKAQRTFA

SEQ ID NO: 828526 - protein, 21 aa, Mycobacterium
KDFDLIMIPGAEHSLYGWLHY

SEQ ID NO: 828527 - protein, 19 aa, Mycobacterium
KDFLALHFSTRRPPSEEWS

SEQ ID NO: 828528 - protein, 19 aa, Mycobacterium
KDFPVLLYQIQNKYRDEAR

SEQ ID NO: 828529 - protein, 19 aa, Mycobacterium
KDFRLMWDNAYAVHTLTDE

SEQ ID NO: 828530 - protein, 21 aa, Mycobacterium
KDFSDRRFVPPGSLGLSTGGY

SEQ ID NO: 828531 - protein, 17 aa, Mycobacterium
KDFWERVGIDPIRIMMT

SEQ ID NO: 828532 - protein, 18 aa, Mycobacterium
KDGAAWLARNHSDAGLFG

SEQ ID NO: 828533 - protein, 24 aa, Mycobacterium
KDGHAPEWRVLADAGWTGLEVPDT

SEQ ID NO: 828534 - protein, 20 aa, Mycobacterium
KDGKLLGIIPRQGYLQIPQF

SEQ ID NO: 828535 - protein, 34 aa, Mycobacterium
KDGKQKLFLLGRGEMQFFPVFRSRESLIAFFEKM

SEQ ID NO: 828536 - protein, 26 aa, Mycobacterium
KDGPRIAVRLAWWRDHRPRGLDELVD

SEQ ID NO: 828537 - protein, 22 aa, Mycobacterium
KDGQFREYLINELTKRADFRCA

SEQ ID NO: 828538 - protein, 23 aa, Mycobacterium
KDGREFIAQFLVSGAGGLHIPLI

SEQ ID NO: 828539 - protein, 26 aa, Mycobacterium
KDGRIKFVLFRHEQAAGFAAAAYGRL

SEQ ID NO: 828540 - protein, 23 aa, Mycobacterium
KDGRLMLCLHGYPDSAWTWRHLG

SEQ ID NO: 828541 - protein, 18 aa, Mycobacterium
KDGTPIPYFVVRPAGPAS

SEQ ID NO: 828542 - protein, 25 aa, Mycobacterium
KDGVLQSRIVPWFGPGAVITTPRHH

SEQ ID NO: 828543 - protein, 29 aa, Mycobacterium
KDGYDVVVDLIYGDPFLAALDATTVGATL

SEQ ID NO: 828544 - protein, 23 aa, Mycobacterium
KDHFDFFPLTVDVEERMYAAGRI

SEQ ID NO: 828545 - protein, 27 aa, Mycobacterium
KDIADLEFALRLGVDLIALSFVRSPSD

SEQ ID NO: 828546 - protein, 25 aa, Mycobacterium
KDIDDLTFALNLGVDMVALSFVRSP

SEQ ID NO: 828547 - protein, 22 aa, Mycobacterium
KDIEALLRRFYGRVMVDHVLAA

SEQ ID NO: 828548 - protein, 25 aa, Mycobacterium
KDIEDLTFALNLGIDMVALSFVRSP

SEQ ID NO: 828549 - protein, 21 aa, Mycobacterium
KDIGRLLLRCADRPGLIAAVS

SEQ ID NO: 828550 - protein, 31 aa, Mycobacterium
KDILQGQCTFSWPPKIDLPGYKPTTKPHNRQ

SEQ ID NO: 828551 - protein, 25 aa, Mycobacterium
KDIRGQFYCSISVPLDLYSCGVYDG

SEQ ID NO: 828552 - protein, 19 aa, Mycobacterium
KDKAAMFRFGCVCGGASLY

SEQ ID NO: 828553 - protein, 18 aa, Mycobacterium
KDKFYGLPATNLADRCGL

SEQ ID NO: 828554 - protein, 26 aa, Mycobacterium
KDKLDTYVRPLLAISAERVARGENPL

SEQ ID NO: 828555 - protein, 25 aa, Mycobacterium
KDKLDTYVRPLLAISQERVNAGQAP

SEQ ID NO: 828556 - protein, 17 aa, Mycobacterium
KDKLILPHLDINLEYYD

SEQ ID NO: 828557 - protein, 24 aa, Mycobacterium
KDKNYNLIWYTEKCLDNALRLETY

SEQ ID NO: 828558 - protein, 17 aa, Mycobacterium
KDKPAWLDRAWQRIIEE

SEQ ID NO: 828559 - protein, 17 aa, Mycobacterium
KDKPAWLDRAWRRITEE

SEQ ID NO: 828560 - protein, 26 aa, Mycobacterium
KDKVVIVPGLQYKALTTGGRMAPRNL

SEQ ID NO: 828561 - protein, 20 aa, Mycobacterium
KDKYGLAWQVTPSEYYDMVT

SEQ ID NO: 828562 - protein, 24 aa, Mycobacterium
KDLGRVLEWLLNRDVPDSEIGSAL

SEQ ID NO: 828563 - protein, 17 aa, Mycobacterium
KDLLIVYGRNHSPDDIE

SEQ ID NO: 828564 - protein, 17 aa, Mycobacterium
KDLRRAVIFGRNDLVKD

SEQ ID NO: 828565 - protein, 18 aa, Mycobacterium
KDLRRNFVPAPDTARAIL

SEQ ID NO: 828566 - protein, 24 aa, Mycobacterium
KDLTLHFVQIWRSIAPPGAAMTRG

SEQ ID NO: 828567 - protein, 26 aa, Mycobacterium
KDLVVSHILHLLLTGKLRTGDRVDRN

SEQ ID NO: 828568 - protein, 21 aa, Mycobacterium
KDMADLDLLFAEELCPADDVL

SEQ ID NO: 828569 - protein, 20 aa, Mycobacterium
KDMRRKGLTINPQTVAKHAR

SEQ ID NO: 828570 - protein, 29 aa, Mycobacterium
KDPARVVANFIPLPWLGTNGFQEACWAWR

SEQ ID NO: 828571 - protein, 24 aa, Mycobacterium
KDPDGTLLWTQKRSIFARGEGGFG

SEQ ID NO: 828572 - protein, 20 aa, Mycobacterium
KDPMIVLEDADVDLAAHAAV

SEQ ID NO: 828573 - protein, 24 aa, Mycobacterium
KDQDGNDLPWSILKHLHAGDSDDG

SEQ ID NO: 828574 - protein, 20 aa, Mycobacterium
KDQEGVRWMYSFLSADKRKT

SEQ ID NO: 828575 - protein, 19 aa, Mycobacterium
KDQKFDAQLSVRVLHRDLG

SEQ ID NO: 828576 - protein, 28 aa, Mycobacterium
KDQRAWSVRWVILHVINELARHAGHADI

SEQ ID NO: 828577 - protein, 23 aa, Mycobacterium
KDQSGVVVLLTFGTGIGSAVLHN

SEQ ID NO: 828578 - protein, 26 aa, Mycobacterium
KDQVVAHLLNLILTGKLRSGDRVDRN

SEQ ID NO: 828579 - protein, 36 aa, Mycobacterium
KDRAGQLTALLRDILELPLPVIIAVNGHVRAGGFGL

SEQ ID NO: 828580 - protein, 25 aa, Mycobacterium
KDRDAVLRRAPWVDVVFGTHNIGSL

SEQ ID NO: 828581 - protein, 17 aa, Mycobacterium
KDRDGSWWWELADDFDF

SEQ ID NO: 828582 - protein, 22 aa, Mycobacterium
KDRDIAMVFQSYALYPHMTVRQ

SEQ ID NO: 828583 - protein, 25 aa, Mycobacterium
KDRDVVLRRAPWVDVVFGTHNIGSL

SEQ ID NO: 828584 - protein, 32 aa, Mycobacterium
KDREGMLAKAPWVDVVFGTHNIGSLPALLERA

SEQ ID NO: 828585 - protein, 36 aa, Mycobacterium
KDRERDLLLASIRQPILGDYRIAVLSIKGGVGKTTT

SEQ ID NO: 828586 - protein, 28 aa, Mycobacterium
KDRFGLSWQIVPARLYELLTDPDPAVAT

SEQ ID NO: 828587 - protein, 20 aa, Mycobacterium
KDRGFFIEPTVVAGLTNAAR

SEQ ID NO: 828588 - protein, 23 aa, Mycobacterium
KDRGLWNLFLPAESGLTNLEYAP

SEQ ID NO: 828589 - protein, 18 aa, Mycobacterium
KDRHGAMVALVDRLDRWA

SEQ ID NO: 828590 - protein, 20 aa, Mycobacterium
KDRIIEYLAVRARRAQRGLQ

SEQ ID NO: 828591 - protein, 27 aa, Mycobacterium
KDRLFDLIERMKLPTVFFAEGGGGRPG

SEQ ID NO: 828592 - protein, 28 aa, Mycobacterium
KDRLFELIERMALPTVFFAEGGGGRPVD

SEQ ID NO: 828593 - protein, 28 aa, Mycobacterium
KDRLFGTWHYWWQAHLLDCLIDAQQRDP

SEQ ID NO: 828594 - protein, 28 aa, Mycobacterium
KDRLFGTWHYWWQAHLLDCLLDAQLRDP

SEQ ID NO: 828595 - protein, 24 aa, Mycobacterium
KDRLGAKPLVIQLPIGAENDFEGI

SEQ ID NO: 828596 - protein, 24 aa, Mycobacterium
KDRLILPHLDVKLLYYDLGIEHRD

SEQ ID NO: 828597 - protein, 28 aa, Mycobacterium
KDRRATSHWLTIPALKAFGAIPVADKRI

SEQ ID NO: 828598 - protein, 28 aa, Mycobacterium
KDRRATSHWLTLPALKAFGAIPVADERI

SEQ ID NO: 828599 - protein, 24 aa, Mycobacterium
KDRSVQLWQNIFGDGFKAPATTTA

SEQ ID NO: 828600 - protein, 17 aa, Mycobacterium
KDRWDIEEFFDPDPSTP

SEQ ID NO: 828601 - protein, 25 aa, Mycobacterium
KDSGLEPFALRFAEAGFDVFAFDYR

SEQ ID NO: 828602 - protein, 24 aa, Mycobacterium
KDSVQAFWDLYFEAAGDSFNAVQE

SEQ ID NO: 828603 - protein, 20 aa, Mycobacterium
KDTEFFWNGLRDNKLLIQRC

SEQ ID NO: 828604 - protein, 26 aa, Mycobacterium
KDTESAALFRLFQDRITRLENTVRWS

SEQ ID NO: 828605 - protein, 27 aa, Mycobacterium
KDTHAMEWYYPVLGGALRGDAALARIE

SEQ ID NO: 828606 - protein, 24 aa, Mycobacterium
KDTLQALIPLLERKPDRSWREHIE

SEQ ID NO: 828607 - protein, 26 aa, Mycobacterium
KDTMGPFALNAGRPVAIASAAEPGEA

SEQ ID NO: 828608 - protein, 21 aa, Mycobacterium
KDTVIVLPKQKVQAVLVADNP

SEQ ID NO: 828609 - protein, 19 aa, Mycobacterium
KDVAVLRTFLSERGKIRSR

SEQ ID NO: 828610 - protein, 32 aa, Mycobacterium
KDVDKKRPFYFGALTWYMDRLLELVHDDLDAY

SEQ ID NO: 828611 - protein, 22 aa, Mycobacterium
KDVDLGWYQLPKGSLGGNYIKY

SEQ ID NO: 828612 - protein, 19 aa, Mycobacterium
KDVDLMFRLVEGCDQMVAS

SEQ ID NO: 828613 - protein, 18 aa, Mycobacterium
KDVEAGAVSFRFGDRTQI

SEQ ID NO: 828614 - protein, 22 aa, Mycobacterium
KDVELELGWGRLIFGQTFADAH

SEQ ID NO: 828615 - protein, 22 aa, Mycobacterium
KDVELELGWGRLIFGQTFADSQ

SEQ ID NO: 828616 - protein, 30 aa, Mycobacterium
KDVESVDRWLRPHLPAWPPVTSNMTVVESF

SEQ ID NO: 828617 - protein, 25 aa, Mycobacterium
KDVKKALYRVLRQKSMREKIRIENR

SEQ ID NO: 828618 - protein, 24 aa, Mycobacterium
KDVLGDYGVFLRSLVNTADLRPLR

SEQ ID NO: 828619 - protein, 27 aa, Mycobacterium
KDVLPDDLPFVTGSIGLLGTRPSYEMM

SEQ ID NO: 828620 - protein, 29 aa, Mycobacterium
KDVLQGQCTFAWPPQFELPGYKPNTKPHN

SEQ ID NO: 828621 - protein, 31 aa, Mycobacterium
KDVLQGQCTFSWPPRIDLPGYKPTVKPHNRQ

SEQ ID NO: 828622 - protein, 17 aa, Mycobacterium
KDVLSDELPWVTGSIGL

SEQ ID NO: 828623 - protein, 18 aa, Mycobacterium
KDVLSDELPWVTGSIGLL

SEQ ID NO: 828624 - protein, 39 aa, Mycobacterium
KDVMVSWLPCFHDMGMVGFLTIPMFFGAELVKVTPMDFL

SEQ ID NO: 828625 - protein, 29 aa, Mycobacterium
KDVRRFLSTYASAAWLWTGRTGIIAGEAA

SEQ ID NO: 828626 - protein, 17 aa, Mycobacterium
KDWILDGTKMWITNGNL

SEQ ID NO: 828627 - protein, 29 aa, Mycobacterium
KDYEGKWRIIFFWPKDFTFVCPTEIAAFG

SEQ ID NO: 828628 - protein, 22 aa, Mycobacterium
KDYIGWPLVSAGAFGLAQLALR

SEQ ID NO: 828629 - protein, 24 aa, Mycobacterium
KDYLIFPALSLRRWRRTLTANAAA

SEQ ID NO: 828630 - protein, 22 aa, Mycobacterium
KDYREWFATLPAELADAVVEHW

SEQ ID NO: 828631 - protein, 18 aa, Mycobacterium
KDYTPYEGLFPPSHIPAL

SEQ ID NO: 828632 - protein, 22 aa, Mycobacterium
KDYVFFPALGRRRWRRTLGANV

SEQ ID NO: 828633 - protein, 18 aa, Mycobacterium
KEAGAVEFGIKRGRKTVN

SEQ ID NO: 828634 - protein, 18 aa, Mycobacterium
KEAIAMPAIRRPVDRKRQ

SEQ ID NO: 828635 - protein, 23 aa, Mycobacterium
KEALRLLAPVPLVMRKTVRDVAI

SEQ ID NO: 828636 - protein, 17 aa, Mycobacterium
KEALSRGVPLRLIYAVH

SEQ ID NO: 828637 - protein, 24 aa, Mycobacterium
KEAMLVELLVGISTRLLDGAREVV

SEQ ID NO: 828638 - protein, 21 aa, Mycobacterium
KEASYPPVQYIPLADVDGSVL

SEQ ID NO: 828639 - protein, 20 aa, Mycobacterium
KECHGLQCGFCTPGFVTSIT

SEQ ID NO: 828640 - protein, 18 aa, Mycobacterium
KEDALFLQDPIGNLWQML

SEQ ID NO: 828641 - protein, 17 aa, Mycobacterium
KEDLFLAVSDRYWRRYF

SEQ ID NO: 828642 - protein, 17 aa, Mycobacterium
KEDVAIRKLLATGLERA

SEQ ID NO: 828643 - protein, 27 aa, Mycobacterium
KEDVYPFVLPPPVLEKMRFIHTVIDEI

SEQ ID NO: 828644 - protein, 22 aa, Mycobacterium
KEEFNETIRYFSTMLAKHGVDV

SEQ ID NO: 828645 - protein, 17 aa, Mycobacterium
KEEILAFLLEDALQHVA

SEQ ID NO: 828646 - protein, 17 aa, Mycobacterium
KEEIVPIDTPHGLFSVD

SEQ ID NO: 828647 - protein, 18 aa, Mycobacterium
KEEIVPIETPHGLFAVDE

SEQ ID NO: 828648 - protein, 21 aa, Mycobacterium
KEELFDTVWGGRFVGEAALTS

SEQ ID NO: 828649 - protein, 26 aa, Mycobacterium
KEFMVRNTYIYPPKESMRIISDIFAY

SEQ ID NO: 828650 - protein, 26 aa, Mycobacterium
KEFMVRNTYIYPPKPSMRIISDIFGY

SEQ ID NO: 828651 - protein, 27 aa, Mycobacterium
KEFMVRNTYIYPPKPSMRIISDIFGYT

SEQ ID NO: 828652 - protein, 22 aa, Mycobacterium
KEFTKKLLAAEGLPIGKYAVIR

SEQ ID NO: 828653 - protein, 28 aa, Mycobacterium
KEGAIAIKLPLPPGTLPTLWNAEDRYRV

SEQ ID NO: 828654 - protein, 26 aa, Mycobacterium
KEGDPHAWAIPRLMGVAKAAFVAVEF

SEQ ID NO: 828655 - protein, 25 aa, Mycobacterium
KEGDPHAWAIPRLTGQAKAAFVAVE

SEQ ID NO: 828656 - protein, 25 aa, Mycobacterium
KEGDPHAWAIPRLTGQAKASFVAVE

SEQ ID NO: 828657 - protein, 24 aa, Mycobacterium
KEGDPQAWVIPRLSGQAKASFVAI

SEQ ID NO: 828658 - protein, 53 aa, Mycobacterium
KEGDRGLSWLPFFHDMGLITALLSPVLGHNFTFMTPAAFVRRPGRWIREMARK

SEQ ID NO: 828659 - protein, 24 aa, Mycobacterium
KEGERLWISWAMANRDPQVFPDPD

SEQ ID NO: 828660 - protein, 24 aa, Mycobacterium
KEGERLWLSWAMANRDPGLFDHPD

SEQ ID NO: 828661 - protein, 23 aa, Mycobacterium
KEGGRIPPKAAIKSYPVIERFEH

SEQ ID NO: 828662 - protein, 26 aa, Mycobacterium
KEGLGAGLGLAPHWGRGWLTSATSGD

SEQ ID NO: 828663 - protein, 24 aa, Mycobacterium
KEGQLRVFPDPTLATRFLVKRVGR

SEQ ID NO: 828664 - protein, 30 aa, Mycobacterium; identical to SEQ ID NO: 128178

SEQ ID NO: 828665 - protein, 27 aa, Mycobacterium
KEGRKPGSYFWFKGRNRARQLAEAAKD

SEQ ID NO: 828666 - protein, 24 aa, Mycobacterium
KEGSNAVPLFVFHPAGGSTVVYEP

SEQ ID NO: 828667 - protein, 25 aa, Mycobacterium
KEGTAPVFLISLKAGGFGLNLTEAD

SEQ ID NO: 828668 - protein, 27 aa, Mycobacterium
KEGVTGQWLIFFNNPSRPGGGLFALAT

SEQ ID NO: 828669 - protein, 20 aa, Mycobacterium
KEHPEWFTVLPDGTIAYAEN

SEQ ID NO: 828670 - protein, 27 aa, Mycobacterium
KEHQAYGIPFPPLRERFDRLGEQLAIV

SEQ ID NO: 828671 - protein, 21 aa, Mycobacterium
KEINVQFVLAYTPEEFADSLR

SEQ ID NO: 828672 - protein, 28 aa, Mycobacterium
KEIQSRLGFLLDVGLDYLSLSRAAGTLS

SEQ ID NO: 828673 - protein, 18 aa, Mycobacterium
KEIRDIVAYLRVLTNPGD

SEQ ID NO: 828674 - protein, 20 aa, Mycobacterium
KELAEHLMLVDLGRNDLGRV

SEQ ID NO: 828675 - protein, 32 aa, Mycobacterium
KELAQQVRLPGFRPGKAPAKLLEARVGRAAVL

SEQ ID NO: 828676 - protein, 38 aa, Mycobacterium
KELCRKVVIELLAWQFASPVRWIETQDLLFIEEAAGGL

SEQ ID NO: 828677 - protein, 27 aa, Mycobacterium
KELCRRWYPRIYFGQPTKGLAHRALAD

SEQ ID NO: 828678 - protein, 27 aa, Mycobacterium
KELCRRWYPRIYFGQPVKGLAHRALAD

SEQ ID NO: 828679 - protein, 27 aa, Mycobacterium
KELERFSPFDGTLPRELSLRSPNHGIE

SEQ ID NO: 828680 - protein, 17 aa, Mycobacterium
KELFAKHNVPTTPGRVT

SEQ ID NO: 828681 - protein, 18 aa, Mycobacterium
KELFAKHNVPTTPGRVTT

SEQ ID NO: 828682 - protein, 25 aa, Mycobacterium
KELGSHLIPKPAWNLLIDCVSAPRA

SEQ ID NO: 828683 - protein, 18 aa, Mycobacterium
KELLAIPDDYAVAAVLPL

SEQ ID NO: 828684 - protein, 23 aa, Mycobacterium
KELLPERLVVVDELPRSSGGKIA

SEQ ID NO: 828685 - protein, 17 aa, Mycobacterium
KELLRRNAVAPLGDVLE

SEQ ID NO: 828686 - protein, 23 aa, Mycobacterium
KELPEHWTAVPYGAPFPNNACRV

SEQ ID NO: 828687 - protein, 22 aa, Mycobacterium
KELQARLRQAREKNFSLLRRRG

SEQ ID NO: 828688 - protein, 36 aa, Mycobacterium
KELRPLIGVALQEVALDLWMSPVEQIRMSLAIAGWP

SEQ ID NO: 828689 - protein, 20 aa, Mycobacterium
KELSEHLMLVDLGRNDLGRV

SEQ ID NO: 828690 - protein, 29 aa, Mycobacterium
KELTLRGLAKRVLVLCPAPLREQWREEMN

SEQ ID NO: 828691 - protein, 29 aa, Mycobacterium
KELVVVRPVGFSPLTWVRALTAEEPVPAA

SEQ ID NO: 828692 - protein, 25 aa, Mycobacterium
KEMWDAFAEEYLAPVRPLERIKQRV

SEQ ID NO: 828693 - protein, 23 aa, Mycobacterium
KEMWDAFAQEYLAPVRPLERVKQ

SEQ ID NO: 828694 - protein, 29 aa, Mycobacterium
KEMWDAFSEEYLAPITPLERMRQKVDAAE

SEQ ID NO: 828695 - protein, 33 aa, Mycobacterium
KENHNLLGPTLLPSWLTYLPPGTTPQVFRSQAR

SEQ ID NO: 828696 - protein, 17 aa, Mycobacterium
KENPKFPALQQAGVRYR

SEQ ID NO: 828697 - protein, 17 aa, Mycobacterium
KENWQRAKMVAAGLPDF

SEQ ID NO: 828698 - protein, 28 aa, Mycobacterium
KENYAAYLGWAVRLARPGALIVADNVIR

SEQ ID NO: 828699 - protein, 20 aa, Mycobacterium
KEPHYGPPPLLLRMVEAGQL

SEQ ID NO: 828700 - protein, 20 aa, Mycobacterium
KEPLYRLYELRLRQGLAATS

SEQ ID NO: 828701 - protein, 18 aa, Mycobacterium
KEPQWWAWDKSHSIARLC

SEQ ID NO: 828702 - protein, 25 aa, Mycobacterium
KEPRITALSGLWFEAARQVGFDIAA

SEQ ID NO: 828703 - protein, 26 aa, Mycobacterium
KEQAYMQQIGLVPPYFVVAFDNKVTI

SEQ ID NO: 828704 - protein, 21 aa, Mycobacterium
KEQLGWIALNGRRNAALNPRA

SEQ ID NO: 828705 - protein, 27 aa, Mycobacterium
KEQLVADLLPQVFRWARAVDPSQPLTS

SEQ ID NO: 828706 - protein, 20 aa, Mycobacterium
KEQRLALGPMHHGRADVIGG

SEQ ID NO: 828707 - protein, 20 aa, Mycobacterium
KERAEHLMLVDLGRNDLGRV

SEQ ID NO: 828708 - protein, 24 aa, Mycobacterium
KERARIMFMIGTLTPDRVTRDSGA

SEQ ID NO: 828709 - protein, 23 aa, Mycobacterium
KERFRQLVDLVCLHAAIVTGHSN

SEQ ID NO: 828710 - protein, 18 aa, Mycobacterium
KERGLPFGLDPREQSEVG

SEQ ID NO: 828711 - protein, 26 aa, Mycobacterium
KERGWRVIPAVSMTLALAARYASRGH

SEQ ID NO: 828712 - protein, 21 aa, Mycobacterium
KERIQVFKGVVLRRSGGGVSA

SEQ ID NO: 828713 - protein, 30 aa, Mycobacterium
KERSTAEWLALLRQLEIPAAPLNTPGALFD

SEQ ID NO: 828714 - protein, 22 aa, Mycobacterium
KERYYGRKRWNIASRFLSQVRM

SEQ ID NO: 828715 - protein, 17 aa, Mycobacterium
KESFAEAVSWVAKNLPT

SEQ ID NO: 828716 - protein, 19 aa, Mycobacterium
KESIWRDKEFRALPRTAQA

SEQ ID NO: 828717 - protein, 18 aa, Mycobacterium
KESLIAGGPLVLKAAKPG

SEQ ID NO: 828718 - protein, 29 aa, Mycobacterium
KESPDESKLLLWLPSFAPERTLKRMVARM

SEQ ID NO: 828719 - protein, 20 aa, Mycobacterium
KESPHWPAIRDALAALSDYL

SEQ ID NO: 828720 - protein, 18 aa, Mycobacterium
KESPLPDALFRIVNPANI

SEQ ID NO: 828721 - protein, 32 aa, Mycobacterium
KETAYGAITKILPIPAEAATPFGIMSDALKDS

SEQ ID NO: 828722 - protein, 21 aa, Mycobacterium
KETLAVFDVGISPTARMGSLP

SEQ ID NO: 828723 - protein, 21 aa, Mycobacterium
KETLGFFAGVGIPIAEIWGMS

SEQ ID NO: 828724 - protein, 20 aa, Mycobacterium
KETQLTVLFPNNPIARESVT

SEQ ID NO: 828725 - protein, 22 aa, Mycobacterium
KETQLTVLFPNNPVARESVTRY

SEQ ID NO: 828726 - protein, 20 aa, Mycobacterium
KETWNGHFPFGWGVSAHPKV

SEQ ID NO: 828727 - protein, 17 aa, Mycobacterium
KEVIRGKRLIVVDDSIV

SEQ ID NO: 828728 - protein, 26 aa, Mycobacterium
KEVQNFLRLAQPPAATSRFLDLGTDS

SEQ ID NO: 828729 - protein, 24 aa, Mycobacterium
KEWAQLLMAAVRVASLPGLLSTTT

SEQ ID NO: 828730 - protein, 26 aa, Mycobacterium
KEWAQLLMVAVRIASLPGLLSTTTVF

SEQ ID NO: 828731 - protein, 25 aa, Mycobacterium
KEWPAELRFPYLGLAKTFIADNVLH

SEQ ID NO: 828732 - protein, 26 aa, Mycobacterium
KFAAEHPWLLGAYLTHTFGVEQVQDA

SEQ ID NO: 828733 - protein, 25 aa, Mycobacterium
KFADMKLWLEACRATTWAAVDDVAG

SEQ ID NO: 828734 - protein, 19 aa, Mycobacterium
KFAILGMLAVAVFAPENKG

SEQ ID NO: 828735 - protein, 17 aa, Mycobacterium
KFALFQTRDEQFYLFGL

SEQ ID NO: 828736 - protein, 21 aa, Mycobacterium
KFATAFTRRGLIAEYGISWIL

SEQ ID NO: 828737 - protein, 26 aa, Mycobacterium
KFAVRGLVCRLAYELAPHIRVNGVAP

SEQ ID NO: 828738 - protein, 19 aa, Mycobacterium
KFDQLLLTAARRAVSSDDD

SEQ ID NO: 828739 - protein, 24 aa, Mycobacterium
KFDRVLELSVRLPEWRAQIAKDLG

SEQ ID NO: 828740 - protein, 20 aa, Mycobacterium
KFDVLRLPPRNAPAAALTAL

SEQ ID NO: 828741 - protein, 30 aa, Mycobacterium; identical to SEQ ID NO: 219646

SEQ ID NO: 828742 - protein, 24 aa, Mycobacterium
KFEKGRSWPRRSTLEKLEKVLDWP

SEQ ID NO: 828743 - protein, 18 aa, Mycobacterium
KFFAAVEGWPEASAHDHR

SEQ ID NO: 828744 - protein, 17 aa, Mycobacterium
KFFWVQEEPANQGAWPT

SEQ ID NO: 828745 - protein, 19 aa, Mycobacterium
KFGALVFDATGITTPVELK

SEQ ID NO: 828746 - protein, 23 aa, Mycobacterium
KFGGWSWRYDLESLAPARTRITL

SEQ ID NO: 828747 - protein, 21 aa, Mycobacterium
KFGQRLAAFVVLNPGAAATPE

SEQ ID NO: 828748 - protein, 20 aa, Mycobacterium
KFGVVGFTRALAAELAGEVG

SEQ ID NO: 828749 - protein, 25 aa, Mycobacterium
KFGYQRPLYTLAHYGVFITPFRASL

SEQ ID NO: 828750 - protein, 27 aa, Mycobacterium
KFHQRILNTHPALLPAFPGAHGVADAL

SEQ ID NO: 828751 - protein, 19 aa, Mycobacterium
KFIGDAVMWVATTPHLLAR

SEQ ID NO: 828752 - protein, 19 aa, Mycobacterium
KFIGLGRGYRLLQLFDGAG

SEQ ID NO: 828753 - protein, 21 aa, Mycobacterium
KFKFHRPIVAGDRLYFDTYLD

SEQ ID NO: 828754 - protein, 19 aa, Mycobacterium
KFLAYYERDGVLVGVVGGG

SEQ ID NO: 828755 - protein, 40 aa, Mycobacterium
KFLREYPYRDAYLLRDARLFRSELSMPLILLGGITNRETM

SEQ ID NO: 828756 - protein, 39 aa, Mycobacterium
KFLSPARIRRTLTVSRLLAPILAPVMYRAAIAARGLLDQ

SEQ ID NO: 828757 - protein, 19 aa, Mycobacterium
KFLVKDWGVEKFREVLEEE

SEQ ID NO: 828758 - protein, 18 aa, Mycobacterium
KFLVKDWGVEKFREVLET

SEQ ID NO: 828759 - protein, 19 aa, Mycobacterium
KFLVLELSARRPGNIAELA

SEQ ID NO: 828760 - protein, 18 aa, Mycobacterium
KFMAIWRASKPVIAQIHG

SEQ ID NO: 828761 - protein, 28 aa, Mycobacterium
KFNSLMERFMSPTLLPAIERFCADKTRA

SEQ ID NO: 828762 - protein, 21 aa, Mycobacterium
KFPHLRVTPPAAPAIDLPDHF

SEQ ID NO: 828763 - protein, 20 aa, Mycobacterium
KFPVLLGGAALTRSYVENDL

SEQ ID NO: 828764 - protein, 26 aa, Mycobacterium
KFRDAEKLTFPLLSDPEKKVLEAWGA

SEQ ID NO: 828765 - protein, 21 aa, Mycobacterium
KFRDELTMPIILLGGITNRET

SEQ ID NO: 828766 - protein, 17 aa, Mycobacterium
KFRDGLTQWMEPTMSAA

SEQ ID NO: 828767 - protein, 36 aa, Mycobacterium
KFRGPGWLVPIISRFRWLTVLPAYFIGIGVRPEHAP

SEQ ID NO: 828768 - protein, 27 aa, Mycobacterium
KFRNHMRDMLFLFKGDRSTSPFCTWVN

SEQ ID NO: 828769 - protein, 22 aa, Mycobacterium
KFRQSVLDRWAADDFAMQPNHV

SEQ ID NO: 828770 - protein, 24 aa, Mycobacterium
KFRRATQLLIYHSAYFAPELIPVN

SEQ ID NO: 828771 - protein, 18 aa, Mycobacterium
KFRTGGYVIDFWGVGYQV

SEQ ID NO: 828772 - protein, 21 aa, Mycobacterium
KFSTYATWWIRQAITRGMADQ

SEQ ID NO: 828773 - protein, 26 aa, Mycobacterium
KFTAALIGPWWSAPSTELRAGAQHWS

SEQ ID NO: 828774 - protein, 18 aa, Mycobacterium
KFTAKVGYPVKWKDYSKL

SEQ ID NO: 828775 - protein, 24 aa, Mycobacterium
KFTDRPVWIRGVGLGLDSVMHQHK

SEQ ID NO: 828776 - protein, 26 aa, Mycobacterium
KFTRMMRRAYDKWWAAELEAQQQIED

SEQ ID NO: 828777 - protein, 23 aa, Mycobacterium
KFTTVHMALVRTPMISPTTLYDK

SEQ ID NO: 828778 - protein, 26 aa, Mycobacterium
KFTTVHMALVRTPMISPTTLYDKFPA

SEQ ID NO: 828779 - protein, 17 aa, Mycobacterium
KFTYNYFGSKYTTVAAA

SEQ ID NO: 828780 - protein, 21 aa, Mycobacterium
KFVADFGIRRFYDVGRHGISH

SEQ ID NO: 828781 - protein, 31 aa, Mycobacterium
KFVAPYFPVDPALVQGLFTPAQFYIDTGIKT

SEQ ID NO: 828782 - protein, 17 aa, Mycobacterium
KFVLPGSSDNKIGKPQN

SEQ ID NO: 828783 - protein, 38 aa, Mycobacterium
KFVLTRPCVLFSKLNPRIPRIWNVISLPVEMALTSTEF

SEQ ID NO: 828784 - protein, 21 aa, Mycobacterium
KFVPDLLPRMDAEVAALGRSM

SEQ ID NO: 828785 - protein, 26 aa, Mycobacterium
KFVRAFRNRLWPGASLRWITANGHSA

SEQ ID NO: 828786 - protein, 37 aa, Mycobacterium
KFVVPGPCVLFAKLNPRIPRIWNVVGLPPEMALASSE

SEQ ID NO: 828787 - protein, 17 aa, Mycobacterium
KFWLGKVNLTMAMAKGT

SEQ ID NO: 828788 - protein, 25 aa, Mycobacterium
KFWTVMHGFVMLELAGFWGEDGAAV

SEQ ID NO: 828789 - protein, 19 aa, Mycobacterium
KFYDQLVKVSGWQDMSVAQ

SEQ ID NO: 828790 - protein, 22 aa, Mycobacterium
KGACIFLNRPGFAGGIGCALHS

SEQ ID NO: 828791 - protein, 17 aa, Mycobacterium
KGAFQFIAPTFAAYHQP

SEQ ID NO: 828792 - protein, 26 aa, Mycobacterium
KGAGLGKDVLLLTDGRFSGGTTGFCV

SEQ ID NO: 828793 - protein, 27 aa, Mycobacterium
KGAGLGKDVLLLTDGRFSGGTTGLCVG

SEQ ID NO: 828794 - protein, 28 aa, Mycobacterium
KGAGLGKGVLLLTDGRFSGGTTGLCVGH

SEQ ID NO: 828795 - protein, 24 aa, Mycobacterium
KGAIEIALIHRPRYDDWSLPKGKV

SEQ ID NO: 828796 - protein, 20 aa, Mycobacterium
KGAIRKLTISSEAYPVLCGS

SEQ ID NO: 828797 - protein, 20 aa, Mycobacterium
KGAIRKLTVASELYPVLCGS

SEQ ID NO: 828798 - protein, 22 aa, Mycobacterium
KGAIRQIDFLTRATAHSPDALA

SEQ ID NO: 828799 - protein, 24 aa, Mycobacterium
KGANPWIMISAFHLKIDGCVGQSF

SEQ ID NO: 828800 - protein, 25 aa, Mycobacterium
KGANRTFLVPAVLAKVLDAGEDAVK

SEQ ID NO: 828801 - protein, 25 aa, Mycobacterium
KGANTAPPLAWSAPLGAALVVDDPD

SEQ ID NO: 828802 - protein, 22 aa, Mycobacterium
KGAPGFLGLYGNPGTPGSFSTV

SEQ ID NO: 828803 - protein, 31 aa, Mycobacterium
KGARALLREFVRLWEHLLTDGGFAAGCPVVA

SEQ ID NO: 828804 - protein, 21 aa, Mycobacterium
KGAVIALTYSLAQSLAQRRIR

SEQ ID NO: 828805 - protein, 27 aa, Mycobacterium
KGDASDLVGILLYLASDESKFMTGQTV

SEQ ID NO: 828806 - protein, 32 aa, Mycobacterium
KGDKLLTELGWVLRRAPLPPTGQHWRLLSTVK

SEQ ID NO: 828807 - protein, 30 aa, Mycobacterium
KGDLDHYLALGFLRGLLAILADAGHPGLLL

SEQ ID NO: 828808 - protein, 24 aa, Mycobacterium
KGDLDIMIIALRAPADGPIGDSGL

SEQ ID NO: 828809 - protein, 21 aa, Mycobacterium
KGDRHGNLVYRRAAANFNPDC

SEQ ID NO: 828810 - protein, 21 aa, Mycobacterium
KGDRHGNLVYRYAAANFNPEC

SEQ ID NO: 828811 - protein, 20 aa, Mycobacterium
KGDTAGNLVYRKTARNFNPM

SEQ ID NO: 828812 - protein, 23 aa, Mycobacterium
KGDVVVLLESMKMEIPVLAEVDG

SEQ ID NO: 828813 - protein, 22 aa, Mycobacterium
KGEFGQFLARLAEKSTTATPHK

SEQ ID NO: 828814 - protein, 20 aa, Mycobacterium
KGEFGTYFIGYSRTAAVTER

SEQ ID NO: 828815 - protein, 21 aa, Mycobacterium
KGEFGTYYIGYSRTPSVTERM

SEQ ID NO: 828816 - protein, 21 aa, Mycobacterium
KGEFRKLWIARINAAARANDI

SEQ ID NO: 828817 - protein, 24 aa, Mycobacterium
KGELDIMIIALRAPADGPIGDSAL

SEQ ID NO: 828818 - protein, 24 aa, Mycobacterium
KGELYAMMLDMRRTFDELVIQHAG

SEQ ID NO: 828819 - protein, 22 aa, Mycobacterium
KGESPGRWVGSGLASLSSTRAR

SEQ ID NO: 828820 - protein, 24 aa, Mycobacterium
KGEVKDVLLLDVTPLSLGIETKGG

SEQ ID NO: 828821 - protein, 22 aa, Mycobacterium
KGEYGTYFIGYSRTPVVTERLL

SEQ ID NO: 828822 - protein, 19 aa, Mycobacterium
KGFCEKLINQGLRVIRFDN

SEQ ID NO: 828823 - protein, 17 aa, Mycobacterium
KGFCWIASRPSVAAIWS

SEQ ID NO: 828824 - protein, 17 aa, Mycobacterium
KGFEPLPPRYKTGVLAK

SEQ ID NO: 828825 - protein, 17 aa, Mycobacterium
KGFGFIAPDGGAPDVFV

SEQ ID NO: 828826 - protein, 20 aa, Mycobacterium
KGFHAIERDLWQGGAITPAT

SEQ ID NO: 828827 - protein, 19 aa, Mycobacterium
KGFHAIERDLWQGGTITAG

SEQ ID NO: 828828 - protein, 19 aa, Mycobacterium
KGFIKGKWDRTDPSYLRPL

SEQ ID NO: 828829 - protein, 18 aa, Mycobacterium
KGFKSFAAPTTLRFEPGI

SEQ ID NO: 828830 - protein, 17 aa, Mycobacterium
KGFKSFASPTTLRLEPG

SEQ ID NO: 828831 - protein, 17 aa, Mycobacterium
KGFRDFPIPMEGLYPGG

SEQ ID NO: 828832 - protein, 20 aa, Mycobacterium
KGFTAIREWAKKFYPDGLGG

SEQ ID NO: 828833 - protein, 24 aa, Mycobacterium
KGGAAGSIPAGFMAPSENGIGGTG

SEQ ID NO: 828834 - protein, 33 aa, Mycobacterium
KGGAGAFGGAGSSPGFLSPAGNGGAGGDAGTAA

SEQ ID NO: 828835 - protein, 25 aa, Mycobacterium
KGGALQSRIVPWFGPGAVITTPRHQ

SEQ ID NO: 828836 - protein, 27 aa, Mycobacterium
KGGAPEHPVWYFNLKANPEVTLQDGEK

SEQ ID NO: 828837 - protein, 22 aa, Mycobacterium
KGGELIVLTKFDPAEVLRVIEE

SEQ ID NO: 828838 - protein, 24 aa, Mycobacterium
KGGEMHVLPKFDPADVLKTIEEKR

SEQ ID NO: 828839 - protein, 22 aa, Mycobacterium
KGGEYFLRHLLGTDANIQAQPP

SEQ ID NO: 828840 - protein, 18 aa, Mycobacterium
KGGLLGGPVGRLVARVLR

SEQ ID NO: 828841 - protein, 17 aa, Mycobacterium
KGGLVRITWAEATELIA

SEQ ID NO: 828842 - protein, 24 aa, Mycobacterium
KGHEYTTMFGWPEPFADGTDKKDR

SEQ ID NO: 828843 - protein, 26 aa, Mycobacterium
KGHPEGLMSFRWFLSDDLPERPVAEV

SEQ ID NO: 828844 - protein, 17 aa, Mycobacterium
KGHPLFAHVTLQRSERS

SEQ ID NO: 828845 - protein, 25 aa, Mycobacterium
KGIAVALDWSVLHRSEWDQTLSDGA

SEQ ID NO: 828846 - protein, 20 aa, Mycobacterium
KGIDIMRTVRSFDPCLPCGV

SEQ ID NO: 828847 - protein, 29 aa, Mycobacterium
KGIDKAYWERVWLNRWRKSGYQAFDMLKV

SEQ ID NO: 828848 - protein, 17 aa, Mycobacterium
KGIDLALSGKLIGNAST

SEQ ID NO: 828849 - protein, 21 aa, Mycobacterium
KGIEVARRLLPDIPHIAVFDT

SEQ ID NO: 828850 - protein, 21 aa, Mycobacterium
KGIGSLFSWTQNPGGPEAELA

SEQ ID NO: 828851 - protein, 17 aa, Mycobacterium
KGILWMRLTAQGRAGHG

SEQ ID NO: 828852 - protein, 26 aa, Mycobacterium
KGIPGPRWMPKPIWNVVSAPLNAYTR

SEQ ID NO: 828853 - protein, 21 aa, Mycobacterium
KGIRIASICSGAFTLAAAGIL

SEQ ID NO: 828854 - protein, 22 aa, Mycobacterium
KGIRRFGDAFIPMDECLAHAAV

SEQ ID NO: 828855 - protein, 25 aa, Mycobacterium
KGKALALYHTKRLASPGQRIVLYAK

SEQ ID NO: 828856 - protein, 27 aa, Mycobacterium
KGKAVLVKLIWRMFRARVFGDRMAAIG

SEQ ID NO: 828857 - protein, 17 aa, Mycobacterium
KGKLVEYYLSVASGPML

SEQ ID NO: 828858 - protein, 22 aa, Mycobacterium
KGKNFYHALATKYGYGPQADRI

SEQ ID NO: 828859 - protein, 22 aa, Mycobacterium
KGKNFYHMLATRYGYGAEADRI

SEQ ID NO: 828860 - protein, 24 aa, Mycobacterium
KGKRYALPHARILMHQPLGGITGG

SEQ ID NO: 828861 - protein, 35 aa, Mycobacterium
KGKTLRWVIDHLREADARPLVPIYLGDDITDEDAF

SEQ ID NO: 828862 - protein, 21 aa, Mycobacterium
KGKVLKVYPERNRVLVEGVNA

SEQ ID NO: 828863 - protein, 19 aa, Mycobacterium
KGLAAFIGIRDRTCRTPYC

SEQ ID NO: 828864 - protein, 25 aa, Mycobacterium
KGLDRGHLSFHLHGQKLRGGYALTR

SEQ ID NO: 828865 - protein, 28 aa, Mycobacterium
KGLEFPLVFVTGWEDGMFPHMRALGDPL

SEQ ID NO: 828866 - protein, 21 aa, Mycobacterium
KGLELIETHLLFGIPYDRIDV

SEQ ID NO: 828867 - protein, 20 aa, Mycobacterium
KGLELIETHLLFGIPYDRIE

SEQ ID NO: 828868 - protein, 20 aa, Mycobacterium
KGLELIETHLLFGIPYERIE

SEQ ID NO: 828869 - protein, 26 aa, Mycobacterium
KGLELIETHLLFGVPYRQIGVVVHPQ

SEQ ID NO: 828870 - protein, 21 aa, Mycobacterium
KGLEWQIVAVPHLVGRVFPST

SEQ ID NO: 828871 - protein, 22 aa, Mycobacterium
KGLFDFSWQLQQLPPELPRGFK

SEQ ID NO: 828872 - protein, 20 aa, Mycobacterium
KGLGILLDRGYPIVCGVPTQ

SEQ ID NO: 828873 - protein, 17 aa, Mycobacterium
KGLIAPWDTIDQKGASR

SEQ ID NO: 828874 - protein, 17 aa, Mycobacterium
KGLKAHFASTPLTPAAP

SEQ ID NO: 828875 - protein, 23 aa, Mycobacterium
KGLKKPPEIPQPPSIKPPEVKAP

SEQ ID NO: 828876 - protein, 19 aa, Mycobacterium
KGLMFSGVPNFAITFGYTN

SEQ ID NO: 828877 - protein, 17 aa, Mycobacterium
KGLPLGVQFVAPLGGES

SEQ ID NO: 828878 - protein, 19 aa, Mycobacterium
KGLPLLDIKDLRSVIQYLT

SEQ ID NO: 828879 - protein, 33 aa, Mycobacterium
KGLRVRIVRAYAKALWALSFGVLAWRHNNLTYV

SEQ ID NO: 828880 - protein, 19 aa, Mycobacterium
KGLTFYISVPHAAGDYVPV

SEQ ID NO: 828881 - protein, 18 aa, Mycobacterium
KGLWATHLGPELGGQGYG

SEQ ID NO: 828882 - protein, 25 aa, Mycobacterium
KGMMLDGIPNFAFTVGYQAATYTLK

SEQ ID NO: 828883 - protein, 21 aa, Mycobacterium
KGMMLSGIPNMAYTVGYTNAS

SEQ ID NO: 828884 - protein, 18 aa, Mycobacterium
KGMPAVIPVPVDPVAVVA

SEQ ID NO: 828885 - protein, 26 aa, Mycobacterium
KGMSPLPAVPLYPLASQLADKIIGVM

SEQ ID NO: 828886 - protein, 24 aa, Mycobacterium
KGNTRRLASLGPLLQGIEARIVDA

SEQ ID NO: 828887 - protein, 25 aa, Mycobacterium
KGNTRRLASLGPLLQGIEARIVDED

SEQ ID NO: 828888 - protein, 27 aa, Mycobacterium
KGPIGKILRLIPLTKPLFGSYREKIAE

SEQ ID NO: 828889 - protein, 29 aa, Mycobacterium
KGPIVDVLTLFSYPLHPPGKPDRLRIEHL

SEQ ID NO: 828890 - protein, 35 aa, Mycobacterium
KGPKAYRMTAIPGFPNFFTVLGPNSPTGSIWLQHT

SEQ ID NO: 828891 - protein, 22 aa, Mycobacterium
KGPQYAAMFGWPEPYADGADKK

SEQ ID NO: 828892 - protein, 28 aa, Mycobacterium
KGPTRPPSPHWRPVSRHGRWNWTRPPVG

SEQ ID NO: 828893 - protein, 25 aa, Mycobacterium
KGPVPKILKLIPVAKKLFPRYEELL

SEQ ID NO: 828894 - protein, 24 aa, Mycobacterium
KGPYLEATPPYAPGKPLRDLIAEG

SEQ ID NO: 828895 - protein, 25 aa, Mycobacterium
KGQKTPTVSTLLLLDALMGWQPGSA

SEQ ID NO: 828896 - protein, 23 aa, Mycobacterium
KGQRSGFFMVPDRDFAMTVLTNS

SEQ ID NO: 828897 - protein, 34 aa, Mycobacterium
KGQRVPAIWISDRRPKLGWCWDRNPHTWLGTASC

SEQ ID NO: 828898 - protein, 17 aa, Mycobacterium
KGRAKVLARYAVWLGDH

SEQ ID NO: 828899 - protein, 25 aa, Mycobacterium
KGREEVRAWIWKTMTSFPGNHMTAF

SEQ ID NO: 828900 - protein, 40 aa, Mycobacterium
KGRENPHILTLSPPVLLDKKWLKPTAYMMAKFGMTLCALG

SEQ ID NO: 828901 - protein, 41 aa, Mycobacterium
KGRENPHILTLSPPVLLGREWLKPTAYMMAKFGMTLCALGI

SEQ ID NO: 828902 - protein, 32 aa, Mycobacterium
KGRGRRGMRRYWRGWGRRRRWGRHHGHALGGA

SEQ ID NO: 828903 - protein, 22 aa, Mycobacterium
KGRKYLIAAARIAYVEIGVADA

SEQ ID NO: 828904 - protein, 27 aa, Mycobacterium
KGRLTLPAKFRDALAGGLMVTKSQDHS

SEQ ID NO: 828905 - protein, 26 aa, Mycobacterium
KGRLTLPAKFRDSLAGGLMVTKSQDH

SEQ ID NO: 828906 - protein, 23 aa, Mycobacterium
KGRNFYHSLATRYGFGAAADRIQ

SEQ ID NO: 828907 - protein, 24 aa, Mycobacterium
KGRPVMVWADIGELPYLRVRLHMS

SEQ ID NO: 828908 - protein, 24 aa, Mycobacterium
KGRRRELMRPGTYTELFFLDEAVA

SEQ ID NO: 828909 - protein, 19 aa, Mycobacterium
KGRWAFTYATAGDRLTTPL

SEQ ID NO: 828910 - protein, 27 aa, Mycobacterium
KGSALVPSWVAFAVIGLLEQHFSRLVD

SEQ ID NO: 828911 - protein, 24 aa, Mycobacterium
KGSALVPSWVAFAVTGLLEQHFGR

SEQ ID NO: 828912 - protein, 26 aa, Mycobacterium
KGSALVPSWVAFAVVGLLEQHFGRLV

SEQ ID NO: 828913 - protein, 18 aa, Mycobacterium
KGSFFDMGFGPRNGASDS

SEQ ID NO: 828914 - protein, 22 aa, Mycobacterium
KGSGLLRGIPLSGTGRGAGGKI

SEQ ID NO: 828915 - protein, 18 aa, Mycobacterium
KGSGRWVPDFLSLPIAVE

SEQ ID NO: 828916 - protein, 24 aa, Mycobacterium
KGSRVFYPVFVPGGKLSVGDLHFS

SEQ ID NO: 828917 - protein, 19 aa, Mycobacterium
KGSTYVWIERGIRFERPQQ

SEQ ID NO: 828918 - protein, 20 aa, Mycobacterium
KGTADGRILRVRGRGVPKRS

SEQ ID NO: 828919 - protein, 20 aa, Mycobacterium
KGTLRDTSAFDLAHHVVTEA

SEQ ID NO: 828920 - protein, 23 aa, Mycobacterium
KGTLVVWSHLDRCMWRTAKTIIR

SEQ ID NO: 828921 - protein, 17 aa, Mycobacterium
KGTPLHVPYTASKHGIV

SEQ ID NO: 828922 - protein, 36 aa, Mycobacterium
KGTPVFAWKGETLEEYWWAAEQMLTWPGEPANMILD

SEQ ID NO: 828923 - protein, 23 aa, Mycobacterium
KGTRVFYPVFVPGANLSFGDLHF

SEQ ID NO: 828924 - protein, 27 aa, Mycobacterium
KGTVVRSWLLDLLAKALKEDPGFDAIS

SEQ ID NO: 828925 - protein, 27 aa, Mycobacterium
KGVCQDFVHLTLMLLRGMGIPAHYVSG

SEQ ID NO: 828926 - protein, 22 aa, Mycobacterium
KGVLMERFNIDAGGAFGLLTRL

SEQ ID NO: 828927 - protein, 19 aa, Mycobacterium
KGVPGRWRLCALVREHLTG

SEQ ID NO: 828928 - protein, 17 aa, Mycobacterium
KGVPVPHRPVAEYFVWF

SEQ ID NO: 828929 - protein, 21 aa, Mycobacterium
KGVQALLVLAAQRVPDLLSGG

SEQ ID NO: 828930 - protein, 18 aa, Mycobacterium
KGVQYYPGGCTTQSIVMR

SEQ ID NO: 828931 - protein, 21 aa, Mycobacterium
KGVSFTIRRGTTLGLVGESGS

SEQ ID NO: 828932 - protein, 21 aa, Mycobacterium
KGVVHPVAYLAGFQAYLEYSL

SEQ ID NO: 828933 - protein, 22 aa, Mycobacterium
KGVVLQWTWVPPRPADELETSF

SEQ ID NO: 828934 - protein, 21 aa, Mycobacterium
KGWSYEKWVKQVTRVLVAIEN

SEQ ID NO: 828935 - protein, 19 aa, Mycobacterium
KGWTLKEGERWLSSNLAYN

SEQ ID NO: 828936 - protein, 17 aa, Mycobacterium
KGWTMVPGSYRAAGEAP

SEQ ID NO: 828937 - protein, 23 aa, Mycobacterium
KGYDGRTLIKDLSFTLPRNGIVG

SEQ ID NO: 828938 - protein, 29 aa, Mycobacterium
KGYEPLLDVAFAHDIRLIASALGPPPADL

SEQ ID NO: 828939 - protein, 29 aa, Mycobacterium
KGYEPLLDVAFSHDIRLIASALGPPPSDL

SEQ ID NO: 828940 - protein, 21 aa, Mycobacterium
KGYFPVPALTHLEGPYLDMVR

SEQ ID NO: 828941 - protein, 22 aa, Mycobacterium
KGYFPVPALTHLEGPYLDMVRD

SEQ ID NO: 828942 - protein, 26 aa, Mycobacterium
KHACLGLMRELAFELAPKVRVNGVAC

SEQ ID NO: 828943 - protein, 18 aa, Mycobacterium
KHAELMFLSAYSLETIAA

SEQ ID NO: 828944 - protein, 18 aa, Mycobacterium
KHAIAHYLDLAGAGRVDL

SEQ ID NO: 828945 - protein, 24 aa, Mycobacterium
KHDMMKWFGPIIHEYYGGTEGFAG

SEQ ID NO: 828946 - protein, 27 aa, Mycobacterium
KHDVEFFNEFYVLDLALTHTPSGPVAT

SEQ ID NO: 828947 - protein, 27 aa, Mycobacterium
KHEAALFRLMRSPLMPITPRAITSMFT

SEQ ID NO: 828948 - protein, 27 aa, Mycobacterium
KHEAALFRLMRSPLMPITPSAITSMFN

SEQ ID NO: 828949 - protein, 17 aa, Mycobacterium
KHELIPGTDGFYRMMTR

SEQ ID NO: 828950 - protein, 19 aa, Mycobacterium
KHFDHVLGSSFFGRAKIYC

SEQ ID NO: 828951 - protein, 22 aa, Mycobacterium
KHGEEGPFAKWLEKWDPDDDVL

SEQ ID NO: 828952 - protein, 22 aa, Mycobacterium
KHGERFLLGIGVSHAPLIDSKE

SEQ ID NO: 828953 - protein, 21 aa, Mycobacterium
KHGLPVYAVAPFATRALVKMS

SEQ ID NO: 828954 - protein, 20 aa, Mycobacterium
KHGSTFLARNLSVTAAAVSR

SEQ ID NO: 828955 - protein, 21 aa, Mycobacterium
KHGVVGLMRSLANELAPHHVR

SEQ ID NO: 828956 - protein, 30 aa, Mycobacterium
KHHIPHLDRFWEKFYFRPGNLGYPVFDTAV

SEQ ID NO: 828957 - protein, 20 aa, Mycobacterium
KHKGITWVICDMSTPGIDVR

SEQ ID NO: 828958 - protein, 25 aa, Mycobacterium
KHKGLSFFVIPMKQPGIEVRPLVQI

SEQ ID NO: 828959 - protein, 24 aa, Mycobacterium
KHKSLTMFLVPLDSAGIEIQGIRT

SEQ ID NO: 828960 - protein, 21 aa, Mycobacterium
KHKVPRRLLKAARLGLVDLDR

SEQ ID NO: 828961 - protein, 29 aa, Mycobacterium
KHLDVGVTSIYWYFRKKGELLDAMTDRAT

SEQ ID NO: 828962 - protein, 18 aa, Mycobacterium
KHLFGLLSVLRDGGYHEP

SEQ ID NO: 828963 - protein, 24 aa, Mycobacterium
KHLLRFLDWILDNEDRLVGIMQEE

SEQ ID NO: 828964 - protein, 19 aa, Mycobacterium
KHMDELFITAAAYPPEILL

SEQ ID NO: 828965 - protein, 20 aa, Mycobacterium
KHNTPRAVLLSYAEFEALAA

SEQ ID NO: 828966 - protein, 27 aa, Mycobacterium
KHPERLLNMHFLMPPLANSVELMSCGT

SEQ ID NO: 828967 - protein, 27 aa, Mycobacterium
KHPGEEIIYVLKGTLIYDIDGQGSKTV

SEQ ID NO: 828968 - protein, 22 aa, Mycobacterium
KHPMIFARYAALPTGGSFVLVN

SEQ ID NO: 828969 - protein, 28 aa, Mycobacterium
KHPSLEWIPDPLWKLNLAVMQRFLTFMT

SEQ ID NO: 828970 - protein, 20 aa, Mycobacterium
KHPSPKHPAPITLPPQRIKA

SEQ ID NO: 828971 - protein, 21 aa, Mycobacterium
KHPYLHHQQPAWYAAIEGFTR

SEQ ID NO: 828972 - protein, 24 aa, Mycobacterium
KHQEALRDWLATQPGLVAELARDE

SEQ ID NO: 828973 - protein, 20 aa, Mycobacterium
KHQHACVENFLLEGAKWGLG

SEQ ID NO: 828974 - protein, 28 aa, Mycobacterium
KHQVLQRAWVHLMPSRKEGWGLAVTEAA

SEQ ID NO: 828975 - protein, 28 aa, Mycobacterium
KHRYGGTVPWTMSPWAVANLGVGLLSIE

SEQ ID NO: 828976 - protein, 18 aa, Mycobacterium
KHSIGIWPLVINDATLVE

SEQ ID NO: 828977 - protein, 21 aa, Mycobacterium
KHSISDFLSNRYALNTSRRAA

SEQ ID NO: 828978 - protein, 27 aa, Mycobacterium
KHSVGVWSATPPPTGWRLIDTADEQTP

SEQ ID NO: 828979 - protein, 23 aa, Mycobacterium
KHTQAFRLWLDAVGVRDDLHSFL

SEQ ID NO: 828980 - protein, 24 aa, Mycobacterium
KHTQVFRMWLDAVGITEDLQGYLD

SEQ ID NO: 828981 - protein, 23 aa, Mycobacterium
KHTQVFRMWLDAVGVTDDLHSLI

SEQ ID NO: 828982 - protein, 38 aa, Mycobacterium
KHTRYDVYFEKASPNPLLLAWIFSQMQERHLPKDFHLT

SEQ ID NO: 828983 - protein, 26 aa, Mycobacterium
KHVAKLSELLGFLWPGRYRTFSQADA

SEQ ID NO: 828984 - protein, 25 aa, Mycobacterium
KHVKGMLTGPVTILAWSFVRDDQPL

SEQ ID NO: 828985 - protein, 21 aa, Mycobacterium
KHVLTSWIGLVALAAQLPGRE

SEQ ID NO: 828986 - protein, 20 aa, Mycobacterium
KHVPPWCYVSIRDIADPTTE

SEQ ID NO: 828987 - protein, 23 aa, Mycobacterium
KHVQVFRMWLDAVGITEDLHYFL

SEQ ID NO: 828988 - protein, 23 aa, Mycobacterium
KHVQVFRMWLDAVGVTEDLHQYL

SEQ ID NO: 828989 - protein, 18 aa, Mycobacterium
KHWQQLCHLIGRPDLLDD

SEQ ID NO: 828990 - protein, 18 aa, Mycobacterium
KHYLMPLLRGELAAPPVN

SEQ ID NO: 828991 - protein, 31 aa, Mycobacterium
KIAAEYHPPAAPPWVWVAASALLDGQSGAGT

SEQ ID NO: 828992 - protein, 23 aa, Mycobacterium
KIAAVARYLRALGYETQITASPV

SEQ ID NO: 828993 - protein, 18 aa, Mycobacterium
KIAAVILASGGSLSVITV

SEQ ID NO: 828994 - protein, 21 aa, Mycobacterium
KIADYPFTTLAPNLGVVSAGE

SEQ ID NO: 828995 - protein, 25 aa, Mycobacterium
KIADYPFTTLVPNLGVVAAGGHSFI

SEQ ID NO: 828996 - protein, 24 aa, Mycobacterium
KIADYPFTTLVPNLGVVTTGENSF

SEQ ID NO: 828997 - protein, 26 aa, Mycobacterium
KIAEANLLARFRGWSAFIGLQVEYSL

SEQ ID NO: 828998 - protein, 23 aa, Mycobacterium
KIAEAWETLMLRLGYERYGAQGG

SEQ ID NO: 828999 - protein, 23 aa, Mycobacterium
KIAEWFEARWTDRFSLPITGEII

SEQ ID NO: 829000 - protein, 25 aa, Mycobacterium
KIAGKQILRKGLAPLITTISTECAA

SEQ ID NO: 829001 - protein, 21 aa, Mycobacterium
KIALDRGLGGPILPASAYLMK

SEQ ID NO: 829002 - protein, 21 aa, Mycobacterium
KIALILERLLADRGDSVVGLI

SEQ ID NO: 829003 - protein, 24 aa, Mycobacterium
KIAPPPVPVPAYKLGEIPRWGTPF

SEQ ID NO: 829004 - protein, 17 aa, Mycobacterium
KIARIAELLRRAGREDV

SEQ ID NO: 829005 - protein, 19 aa, Mycobacterium
KIARNLGVLILLDASGSAT

SEQ ID NO: 829006 - protein, 20 aa, Mycobacterium
KIARRFAHLTYRGETELDNR

SEQ ID NO: 829007 - protein, 18 aa, Mycobacterium
KIASLLTVGWPKGRHHPV

SEQ ID NO: 829008 - protein, 23 aa, Mycobacterium
KIATGLTLSPTLIFDHPTPAALA

SEQ ID NO: 829009 - protein, 22 aa, Mycobacterium
KIAVASRVPGLNAKGACIGPMG

SEQ ID NO: 829010 - protein, 24 aa, Mycobacterium
KIDCPTIAVLYYRAQHLAGNTAYV

SEQ ID NO: 829011 - protein, 21 aa, Mycobacterium
KIDKRLLPTAPAYGGLHSELR

SEQ ID NO: 829012 - protein, 26 aa, Mycobacterium
KIDLQDFILTNKTLAGTIFGSCNPKA

SEQ ID NO: 829013 - protein, 17 aa, Mycobacterium
KIDLSLGKLGLQPGMKL

SEQ ID NO: 829014 - protein, 31 aa, Mycobacterium
KIDSDAHPLYYLEMPPALFAPIVENLAKADL

SEQ ID NO: 829015 - protein, 17 aa, Mycobacterium
KIEILQAIPRVPYGVVS

SEQ ID NO: 829016 - protein, 27 aa, Mycobacterium
KIETEILWGRPLTKLLEESRTAVMVCV

SEQ ID NO: 829017 - protein, 26 aa, Mycobacterium
KIEVLLDLRPAVVSFTFGLPSAEERR

SEQ ID NO: 829018 - protein, 22 aa, Mycobacterium
KIEVVRELLRLGVPALEIGSMA

SEQ ID NO: 829019 - protein, 18 aa, Mycobacterium
KIFDGANLALLVGARPRG

SEQ ID NO: 829020 - protein, 31 aa, Mycobacterium
KIFSGLIRTWDDPILLGLNPGVALPNAPIAP

SEQ ID NO: 829021 - protein, 18 aa, Mycobacterium
KIGDAVVGMLPLDRPGAA

SEQ ID NO: 829022 - protein, 26 aa, Mycobacterium
KIGHLPYLLTLPGHGFYWFQLSASEE

SEQ ID NO: 829023 - protein, 19 aa, Mycobacterium
KIGWTVKRLAPQAYTRAAG

SEQ ID NO: 829024 - protein, 26 aa, Mycobacterium
KIGYPPTRVWGVPAAGLWAHRLGDAR

SEQ ID NO: 829025 - protein, 26 aa, Mycobacterium
KIGYPPTRVWGVPAAGLWAHRLGDQR

SEQ ID NO: 829026 - protein, 25 aa, Mycobacterium
KIGYPPTRVWGVPATGLWAHKLGDQ

SEQ ID NO: 829027 - protein, 22 aa, Mycobacterium
KIIEEGLRRGLSPEAIQIALAT

SEQ ID NO: 829028 - protein, 19 aa, Mycobacterium
KIIEHTNLPFVIVFSREAG

SEQ ID NO: 829029 - protein, 17 aa, Mycobacterium
KIIGRHFIRAFEGAVRD

SEQ ID NO: 829030 - protein, 20 aa, Mycobacterium
KIIGRQFIRAFEGAVRDILS

SEQ ID NO: 829031 - protein, 21 aa, Mycobacterium
KIIGRQFIRAFEGAVRDVLDG

SEQ ID NO: 829032 - protein, 21 aa, Mycobacterium
KIIGRQFIRAFESAVRDVLDG

SEQ ID NO: 829033 - protein, 22 aa, Mycobacterium
KIKARQWTLADFDWDKPGADTI

SEQ ID NO: 829034 - protein, 21 aa, Mycobacterium
KIKNMWGLLTVKGEFTNFGGY

SEQ ID NO: 829035 - protein, 18 aa, Mycobacterium
KILGLLSASSKSYAATIR

SEQ ID NO: 829036 - protein, 17 aa, Mycobacterium
KILLAQHVGSSPLQDRR

SEQ ID NO: 829037 - protein, 20 aa, Mycobacterium
KILLLRTVLEAVGDRARIVA

SEQ ID NO: 829038 - protein, 19 aa, Mycobacterium
KILLNAKTRRPSVCNAAET

SEQ ID NO: 829039 - protein, 23 aa, Mycobacterium
KILNDHGLMVPNWPVEWGGKDWT

SEQ ID NO: 829040 - protein, 40 aa, Mycobacterium
KILSPARIRRALTVSRLLAPILTPIIYRAAISARALVDQR

SEQ ID NO: 829041 - protein, 18 aa, Mycobacterium
KILSPQYSDYQVLQGGQG

SEQ ID NO: 829042 - protein, 25 aa, Mycobacterium
KILTFRGYLTPHIIGQSPVALKYPP

SEQ ID NO: 829043 - protein, 19 aa, Mycobacterium
KIMLMFESANFDESVFGDP

SEQ ID NO: 829044 - protein, 23 aa, Mycobacterium
KINALRLLSEFLGRRPDGGLVAS

SEQ ID NO: 829045 - protein, 18 aa, Mycobacterium
KIPAFLEETLRLESPVKS

SEQ ID NO: 829046 - protein, 26 aa, Mycobacterium
KIPGVDRLMLPVFKKIIDELLKGGIA

SEQ ID NO: 829047 - protein, 33 aa, Mycobacterium
KIPGVGKVNVKLYWDLKISPITFSDITISGPTL

SEQ ID NO: 829048 - protein, 26 aa, Mycobacterium
KIPPAMDVLIQERPRFTTALQKLGTF

SEQ ID NO: 829049 - protein, 26 aa, Mycobacterium
KIQLPTFIPRIVFGAYPGLPGGENGV

SEQ ID NO: 829050 - protein, 28 aa, Mycobacterium
KIQRQLCKQLLLTDQLPILGDRVSTATI

SEQ ID NO: 829051 - protein, 27 aa, Mycobacterium
KIQVVPQVWAMRYTLERLIRGKDTIAA

SEQ ID NO: 829052 - protein, 29 aa, Mycobacterium
KIRAFPMGPGFLIDGKPVILTAPKRQAAP

SEQ ID NO: 829053 - protein, 26 aa, Mycobacterium
KIRDKDIVHVLFAEIGPFYSDRNGGY

SEQ ID NO: 829054 - protein, 17 aa, Mycobacterium
KIRILTNKIVLAVDGET

SEQ ID NO: 829055 - protein, 17 aa, Mycobacterium
KIRLGRFATGSTYWADG

SEQ ID NO: 829056 - protein, 21 aa, Mycobacterium
KIRLGRFKDGPTYWATGETVR

SEQ ID NO: 829057 - protein, 25 aa, Mycobacterium
KIRVNAIALGAFMTTGLQSSFDLMP

SEQ ID NO: 829058 - protein, 17 aa, Mycobacterium
KISDLLRQAAQAYERGD

SEQ ID NO: 829059 - protein, 20 aa, Mycobacterium
KISMIKSIYPGQTATLTGRV

SEQ ID NO: 829060 - protein, 26 aa, Mycobacterium
KISSLPDLLPLLEKVAESGKPLMIIA

SEQ ID NO: 829061 - protein, 26 aa, Mycobacterium
KISSLPDLLPLLEKVAESGKPLVIIA

SEQ ID NO: 829062 - protein, 19 aa, Mycobacterium
KITFDKIDQRLTVLGIDNT

SEQ ID NO: 829063 - protein, 20 aa, Mycobacterium
KITLPLVPVVAACGAAVPQA

SEQ ID NO: 829064 - protein, 21 aa, Mycobacterium
KITPMDFMRDVLLWGRLIDKY

SEQ ID NO: 829065 - protein, 40 aa, Mycobacterium
KITTNPPVEGAFYWLNNREVRWRPEHFWKSGTAIDVAVNT

SEQ ID NO: 829066 - protein, 38 aa, Mycobacterium
KITTNPPVEGAFYWLNNREVRWRPESFWDSGTSVDVKV

SEQ ID NO: 829067 - protein, 24 aa, Mycobacterium
KITTWNDPILVGLNPGVALPDTRI

SEQ ID NO: 829068 - protein, 23 aa, Mycobacterium
KITVWKDYWDFNSLVAFAPPQHF

SEQ ID NO: 829069 - protein, 27 aa, Mycobacterium
KIVEGRLNGFFKDAVLLEQPSVSDSKK

SEQ ID NO: 829070 - protein, 28 aa, Mycobacterium
KIVEGRLNGFFKDAVLLEQPSVSDSKKS

SEQ ID NO: 829071 - protein, 28 aa, Mycobacterium
KIVEGRLNGFFKDAVLLEQPSVSDSKKT

SEQ ID NO: 829072 - protein, 29 aa, Mycobacterium
KIVGDFGSLPVWFPFVTASELDPPGGRRE

SEQ ID NO: 829073 - protein, 19 aa, Mycobacterium
KIVLHHVSGPRYLLTVTLE

SEQ ID NO: 829074 - protein, 20 aa, Mycobacterium
KIVLQMPNPLQPQADRTYLI

SEQ ID NO: 829075 - protein, 19 aa, Mycobacterium
KIVRALMTGYLLHLLAGDK

SEQ ID NO: 829076 - protein, 18 aa, Mycobacterium
KIVRSITAPLSPVQARRF

SEQ ID NO: 829077 - protein, 19 aa, Mycobacterium
KIWEALIIVYPNGTPRTKH

SEQ ID NO: 829078 - protein, 17 aa, Mycobacterium
KIWSGAATFLFTRTTVG

SEQ ID NO: 829079 - protein, 20 aa, Mycobacterium
KIYVLPAYHGGGVSTALMDR

SEQ ID NO: 829080 - protein, 26 aa, Mycobacterium
KKAGAGQYVFLLYSTLQQVGDSPGVR

SEQ ID NO: 829081 - protein, 30 aa, Mycobacterium
KKALDVFPRAKAMLPKAIAAGVRIACGTDA

SEQ ID NO: 829082 - protein, 17 aa, Mycobacterium
KKALNGYAAWVTGLRRV

SEQ ID NO: 829083 - protein, 24 aa, Mycobacterium
KKDADGYFWFVGRKDDVIKSAGHL

SEQ ID NO: 829084 - protein, 17 aa, Mycobacterium
KKDNFTAYKLLIADVVG

SEQ ID NO: 829085 - protein, 20 aa, Mycobacterium
KKDWNPHDYIPWSDGKNYYA

SEQ ID NO: 829086 - protein, 17 aa, Mycobacterium
KKGPFPLDAFEKVIKIN

SEQ ID NO: 829087 - protein, 23 aa, Mycobacterium
KKGPFRIAMSVNIPIVPIVIRNA

SEQ ID NO: 829088 - protein, 24 aa, Mycobacterium
KKLIPTGRFAYPDEIAAAAVFLAS

SEQ ID NO: 829089 - protein, 17 aa, Mycobacterium
KKLLDKAAALTLTEDEA

SEQ ID NO: 829090 - protein, 22 aa, Mycobacterium
KKLLEEWLALWSDHYQLGEKLR

SEQ ID NO: 829091 - protein, 25 aa, Mycobacterium
KKLLEEWLALWSEHNKLPERLHVQL

SEQ ID NO: 829092 - protein, 25 aa, Mycobacterium
KKLMTDIFALAMELGGAISGEHGLG

SEQ ID NO: 829093 - protein, 23 aa, Mycobacterium
KKLRQRLRKAAIATFIKHGYDGA

SEQ ID NO: 829094 - protein, 45 aa, Mycobacterium
KKPKDDGLAWVPYGPKDPAFPTPGWDVYVYFLKHDCDSLKNVQNP

SEQ ID NO: 829095 - protein, 22 aa, Mycobacterium
KKPLYWRGARLAGNYPLSIALD

SEQ ID NO: 829096 - protein, 17 aa, Mycobacterium
KKQVRCVYVAVGQKGTT

SEQ ID NO: 829097 - protein, 26 aa, Mycobacterium
KKRDDLQAVIALLKGADLDVALQFVN

SEQ ID NO: 829098 - protein, 19 aa, Mycobacterium
KKRGFRFVGPTTAYALMQA

SEQ ID NO: 829099 - protein, 26 aa, Mycobacterium
KKRPDFSKLTPLYPNQRLRLETTTDR

SEQ ID NO: 829100 - protein, 28 aa, Mycobacterium
KKRQRRLTGIDEIVLSLTAKGLTTGEVA

SEQ ID NO: 829101 - protein, 17 aa, Mycobacterium
KKRTLPEWSERFATLAG

SEQ ID NO: 829102 - protein, 20 aa, Mycobacterium
KKSFGVHPLLAFLDRPEIAG

SEQ ID NO: 829103 - protein, 23 aa, Mycobacterium
KKSFRAWYDGEWFRVGMAEEIGG

SEQ ID NO: 829104 - protein, 25 aa, Mycobacterium
KKSRRTVPLPPWLAERMADYLATDH

SEQ ID NO: 829105 - protein, 32 aa, Mycobacterium
KKSSVSIIALAALPFIDFPPGYGLRHETDRGF

SEQ ID NO: 829106 - protein, 29 aa, Mycobacterium
KKTIEFYLTAVFNVMRLTAAAIARTEPLE

SEQ ID NO: 829107 - protein, 19 aa, Mycobacterium
KKVAFAHRLVDAGFTQLEV

SEQ ID NO: 829108 - protein, 34 aa, Mycobacterium
KKVLAQLPRAQALALSLLLLSPAALNTLPGLSTV

SEQ ID NO: 829109 - protein, 35 aa, Mycobacterium
KKVLSQLPRAQAMALSLLLLSPAALNTLPGLTKMT

SEQ ID NO: 829110 - protein, 18 aa, Mycobacterium
KKVRLELGSNAPLIVDRE

SEQ ID NO: 829111 - protein, 25 aa, Mycobacterium
KKVSVPLVPGETLLESARRAGLDPP

SEQ ID NO: 829112 - protein, 31 aa, Mycobacterium
KKWADWSISYFYWSPSFSQVYSELRKLEKIG

SEQ ID NO: 829113 - protein, 17 aa, Mycobacterium
KLAAALRGAAPTTVISS

SEQ ID NO: 829114 - protein, 31 aa, Mycobacterium
KLAADELGLPTAPFWFVGSLGELEAVAAHAG

SEQ ID NO: 829115 - protein, 22 aa, Mycobacterium
KLAARPFDLFRDSPVRVLLVTL

SEQ ID NO: 829116 - protein, 20 aa, Mycobacterium
KLADVLLRTCRHLKILATSR

SEQ ID NO: 829117 - protein, 28 aa, Mycobacterium
KLAELIQSPKWLELVEPYGFTEAERPDP

SEQ ID NO: 829118 - protein, 25 aa, Mycobacterium
KLAELQRLWLIEATKYNVVPLDDRG

SEQ ID NO: 829119 - protein, 26 aa, Mycobacterium
KLAEQRLPVIASDRVYFVGQPVAAVI

SEQ ID NO: 829120 - protein, 20 aa, Mycobacterium
KLAETLADFAYAYLVTVGDD

SEQ ID NO: 829121 - protein, 21 aa, Mycobacterium
KLAFSPLRLGPLTLKNRFIKA

SEQ ID NO: 829122 - protein, 18 aa, Mycobacterium
KLAFVRICTHYFAHRAWL

SEQ ID NO: 829123 - protein, 25 aa, Mycobacterium
KLAGFKIPQYWYSVTELPLNSAGKV

SEQ ID NO: 829124 - protein, 30 aa, Mycobacterium
KLAKESGSPIFLYLGGDFPQGLDKAADPSY

SEQ ID NO: 829125 - protein, 18 aa, Mycobacterium
KLALERLAAGLGVPHPDL

SEQ ID NO: 829126 - protein, 28 aa, Mycobacterium
KLALPTAPLRMALAPPLRLTIYGGLPPQ

SEQ ID NO: 829127 - protein, 29 aa, Mycobacterium
KLANLMFTYELQRRLAARGAPTIAVAAHP

SEQ ID NO: 829128 - protein, 17 aa, Mycobacterium
KLAPVLDRLASYQARSV

SEQ ID NO: 829129 - protein, 24 aa, Mycobacterium
KLARAMVNLHRRYRLATTQLAAAT

SEQ ID NO: 829130 - protein, 21 aa, Mycobacterium
KLARPQLKKHYGELLEQIYTD

SEQ ID NO: 829131 - protein, 29 aa, Mycobacterium
KLARSPQVTALLQLAAYADALAGCGVPVA

SEQ ID NO: 829132 - protein, 23 aa, Mycobacterium
KLASGDIPFYEPGLRKVLNDNLS

SEQ ID NO: 829133 - protein, 20 aa, Mycobacterium
KLATNLMRWTGISPDQVART

SEQ ID NO: 829134 - protein, 18 aa, Mycobacterium
KLATQYRPDQLAKLADLL

SEQ ID NO: 829135 - protein, 23 aa, Mycobacterium
KLAVDFRQKFKKDVVIDMLCYRR

SEQ ID NO: 829136 - protein, 18 aa, Mycobacterium
KLAVLVVSAIPLAEPVRV

SEQ ID NO: 829137 - protein, 18 aa, Mycobacterium
KLAYGESPYSYLMTRRIE

SEQ ID NO: 829138 - protein, 17 aa, Mycobacterium
KLCIHPRQVESVNKRFT

SEQ ID NO: 829139 - protein, 29 aa, Mycobacterium
KLCMIHGADPWWDVAIRLLIKYANLRIMT

SEQ ID NO: 829140 - protein, 35 aa, Mycobacterium
KLDAAALLHRLSLKVPARHFVLFSSISGLIGSRWL

SEQ ID NO: 829141 - protein, 35 aa, Mycobacterium
KLDAAALLHRLSLKVPVRHFVLFSSISGLIGSRWL

SEQ ID NO: 829142 - protein, 25 aa, Mycobacterium
KLDAQLIDELPLPRPKYEIFVYSPR

SEQ ID NO: 829143 - protein, 27 aa, Mycobacterium
KLDDQRLAFYRTLYRDHARYGAVLWVV

SEQ ID NO: 829144 - protein, 27 aa, Mycobacterium
KLDEALQIILPMLKGERPTFSGKYYRT

SEQ ID NO: 829145 - protein, 23 aa, Mycobacterium
KLDGRWLITESTLTRLREDIFNV

SEQ ID NO: 829146 - protein, 23 aa, Mycobacterium
KLDIRKWTFLNTDLVVHVHRIPE

SEQ ID NO: 829147 - protein, 28 aa, Mycobacterium
KLDITRWTFLNTDLAVHVFRVPEGEWIG

SEQ ID NO: 829148 - protein, 19 aa, Mycobacterium
KLDLAWMVQSWPTGADSGA

SEQ ID NO: 829149 - protein, 25 aa, Mycobacterium
KLDLNDPPPCAVGFLPPPLMRTPAD

SEQ ID NO: 829150 - protein, 23 aa, Mycobacterium
KLDLPMGRVPRMDTYRGFVFGSF

SEQ ID NO: 829151 - protein, 22 aa, Mycobacterium
KLDLVRYYLSVADGALRGVAGR

SEQ ID NO: 829152 - protein, 21 aa, Mycobacterium
KLDLVRYYLSVADGALRGVSG

SEQ ID NO: 829153 - protein, 26 aa, Mycobacterium
KLDRSKPLWELWFIEGLEGGRVAVVT

SEQ ID NO: 829154 - protein, 17 aa, Mycobacterium
KLDSLVPLGPPVMDVAL

SEQ ID NO: 829155 - protein, 20 aa, Mycobacterium
KLDVLDFWSIIRPELPSISG

SEQ ID NO: 829156 - protein, 18 aa, Mycobacterium
KLDWIPTVKSRDLARLMV

SEQ ID NO: 829157 - protein, 19 aa, Mycobacterium
KLEFLGTEGFLALKTVWSY

SEQ ID NO: 829158 - protein, 18 aa, Mycobacterium
KLEGDAAFFWAPGGDAKV

SEQ ID NO: 829159 - protein, 29 aa, Mycobacterium
KLEGTVAVNLALILKFMPAYLHDAQDLPV

SEQ ID NO: 829160 - protein, 19 aa, Mycobacterium
KLEKTFPVSLGKKGYETPN

SEQ ID NO: 829161 - protein, 19 aa, Mycobacterium
KLELPAIRIPLKDRIRVEE

SEQ ID NO: 829162 - protein, 22 aa, Mycobacterium
KLELRRVAIFGGTVETYLHRRA

SEQ ID NO: 829163 - protein, 20 aa, Mycobacterium
KLELYLAVLNRHVDKLVAGV

SEQ ID NO: 829164 - protein, 25 aa, Mycobacterium
KLESQILGLTYYPVTYFEMLGRPWR

SEQ ID NO: 829165 - protein, 21 aa, Mycobacterium
KLETKFTRLTGRSPILLAGMT

SEQ ID NO: 829166 - protein, 20 aa, Mycobacterium
KLEVYSPSSPLGGALIDAKV

SEQ ID NO: 829167 - protein, 17 aa, Mycobacterium
KLFALEFSALLDGLSIQ

SEQ ID NO: 829168 - protein, 21 aa, Mycobacterium
KLFCEAGVIALTAFISPYRRD

SEQ ID NO: 829169 - protein, 17 aa, Mycobacterium
KLFIETKHPVRYGSLVE

SEQ ID NO: 829170 - protein, 17 aa, Mycobacterium
KLFNATRFALMNGAAPA

SEQ ID NO: 829171 - protein, 25 aa, Mycobacterium
KLFVLLAVRCSEAPWWSRDLWDLRI

SEQ ID NO: 829172 - protein, 17 aa, Mycobacterium
KLFVPLETTPWTTNGDH

SEQ ID NO: 829173 - protein, 18 aa, Mycobacterium
KLGARRFVTLRGMGYRLE

SEQ ID NO: 829174 - protein, 19 aa, Mycobacterium
KLGAVLDRLARYQARSVDI

SEQ ID NO: 829175 - protein, 35 aa, Mycobacterium
KLGDLITFVIHIPLSIDLLLDLRLDKQRFKVAGDI

SEQ ID NO: 829176 - protein, 36 aa, Mycobacterium
KLGDLITFVIHIPLSIDLLLDLRLDKQRFSVTGDIA

SEQ ID NO: 829177 - protein, 23 aa, Mycobacterium
KLGESVLFPHRLGKPEELASMVI

SEQ ID NO: 829178 - protein, 18 aa, Mycobacterium
KLGFGAKALPFMLGAKEP

SEQ ID NO: 829179 - protein, 26 aa, Mycobacterium
KLGFTQSYSYFTWRTAKWELTEFGNE

SEQ ID NO: 829180 - protein, 25 aa, Mycobacterium
KLGKHDDFTFVWPGAANKELIDREL

SEQ ID NO: 829181 - protein, 23 aa, Mycobacterium
KLGLPEVALGLIPGWGGTQRLSA

SEQ ID NO: 829182 - protein, 19 aa, Mycobacterium
KLGLRPLARIHTTTVVGSD

SEQ ID NO: 829183 - protein, 17 aa, Mycobacterium
KLGLSPQAAVLGAFESD

SEQ ID NO: 829184 - protein, 29 aa, Mycobacterium
KLGQLGVTASQWQDLRAQLAAGATPPAPG

SEQ ID NO: 829185 - protein, 25 aa, Mycobacterium
KLGRHEDFVLVWPSKTNRAIIDEAF

SEQ ID NO: 829186 - protein, 34 aa, Mycobacterium
KLGRKKDEWSVYLSPSHWAVLELGGGASKDDDDT

SEQ ID NO: 829187 - protein, 18 aa, Mycobacterium
KLGTLFERAARRHPDNTL

SEQ ID NO: 829188 - protein, 20 aa, Mycobacterium
KLGVPIFLHPTIPPQPVIDA

SEQ ID NO: 829189 - protein, 17 aa, Mycobacterium
KLGVPPLTMKPDVCWQL

SEQ ID NO: 829190 - protein, 20 aa, Mycobacterium
KLHALGPQWALVKGGHLRSS

SEQ ID NO: 829191 - protein, 24 aa, Mycobacterium
KLHDMGADLLRRPVSEIMTTLVAT

SEQ ID NO: 829192 - protein, 18 aa, Mycobacterium
KLHGFDDTALRQLAEMTL

SEQ ID NO: 829193 - protein, 18 aa, Mycobacterium
KLHRPGNPVILPTVWDAW

SEQ ID NO: 829194 - protein, 24 aa, Mycobacterium
KLIDYYVETFGFVLAARYGEGRDV

SEQ ID NO: 829195 - protein, 30 aa, Mycobacterium
KLIEVPVGFKWFVDGLIEGGIGFGGEESAG

SEQ ID NO: 829196 - protein, 19 aa, Mycobacterium
KLIGALDVFGLTVAGRRCL

SEQ ID NO: 829197 - protein, 20 aa, Mycobacterium
KLIGAWLTELDLLGDLADPK

SEQ ID NO: 829198 - protein, 20 aa, Mycobacterium
KLIPGLAYLDQSELAPDIQI

SEQ ID NO: 829199 - protein, 21 aa, Mycobacterium
KLIQSWPIYRQLTGADPLGRG

SEQ ID NO: 829200 - protein, 20 aa, Mycobacterium
KLIQSWPVYRQLTGSDPLGR

SEQ ID NO: 829201 - protein, 17 aa, Mycobacterium
KLIVATAYFPENNPHSA

SEQ ID NO: 829202 - protein, 17 aa, Mycobacterium
KLIVDLMYEGGIARMNY

SEQ ID NO: 829203 - protein, 19 aa, Mycobacterium
KLKAPLLDYLASDGIVHSL

SEQ ID NO: 829204 - protein, 21 aa, Mycobacterium
KLKLDELITTRYRLEDINQGY

SEQ ID NO: 829205 - protein, 23 aa, Mycobacterium
KLKLEETFMFYLPRICEHCLNPS

SEQ ID NO: 829206 - protein, 24 aa, Mycobacterium
KLKLQGGSPIALNWAIDSVRKGGT

SEQ ID NO: 829207 - protein, 17 aa, Mycobacterium
KLKQMDVQTTYPGHGRT

SEQ ID NO: 829208 - protein, 17 aa, Mycobacterium
KLKRKPIMTKYAREIEE

SEQ ID NO: 829209 - protein, 18 aa, Mycobacterium
KLLAARIADRQIALAGDG

SEQ ID NO: 829210 - protein, 18 aa, Mycobacterium
KLLATEGLLALAWPKEHG

SEQ ID NO: 829211 - protein, 19 aa, Mycobacterium
KLLDLEQFLDRKPAKLSGG

SEQ ID NO: 829212 - protein, 17 aa, Mycobacterium
KLLEHGGHIAFTASFAG

SEQ ID NO: 829213 - protein, 20 aa, Mycobacterium
KLLEMLAAGSRLIVPDLLPG

SEQ ID NO: 829214 - protein, 27 aa, Mycobacterium
KLLEPRNIPYRVFINDWDPRDGEHWLK

SEQ ID NO: 829215 - protein, 26 aa, Mycobacterium
KLLERFRAMEPWLDGSRVYAPFWEVH

SEQ ID NO: 829216 - protein, 23 aa, Mycobacterium
KLLETYSVPPLLHNQTLAIGVTS

SEQ ID NO: 829217 - protein, 33 aa, Mycobacterium
KLLGHRVVRVVPIPPIALGLRTGVAILSYADDL

SEQ ID NO: 829218 - protein, 26 aa, Mycobacterium
KLLGPIPFPHHPIYTIPSERFLGNLV

SEQ ID NO: 829219 - protein, 17 aa, Mycobacterium
KLLLDDPSLLPNAVDEA

SEQ ID NO: 829220 - protein, 18 aa, Mycobacterium
KLLLDPYGKAFHGDFAFG

SEQ ID NO: 829221 - protein, 18 aa, Mycobacterium
KLLMRRRLSELGAPVPRF

SEQ ID NO: 829222 - protein, 20 aa, Mycobacterium
KLLMTWVEQSVGHAALAVAG

SEQ ID NO: 829223 - protein, 23 aa, Mycobacterium
KLLPDLPHIAVFDTAFFHDLPAP

SEQ ID NO: 829224 - protein, 18 aa, Mycobacterium
KLLPHVDVCLGQHVMPFP

SEQ ID NO: 829225 - protein, 18 aa, Mycobacterium
KLLQPWGIVHGGVYCSIV

SEQ ID NO: 829226 - protein, 19 aa, Mycobacterium
KLLSECVTSPRAVLFVTPS

SEQ ID NO: 829227 - protein, 36 aa, Mycobacterium
KLLSPTRVRRLLTVTRLLAPVLVPVVYRAAIAARGA

SEQ ID NO: 829228 - protein, 24 aa, Mycobacterium
KLLTDIFALAMELGGAISGEHGLG

SEQ ID NO: 829229 - protein, 21 aa, Mycobacterium
KLLYTHRNTLLRRLERAEQLL

SEQ ID NO: 829230 - protein, 21 aa, Mycobacterium
KLMAFCLAGALSFNLAAPESS

SEQ ID NO: 829231 - protein, 22 aa, Mycobacterium
KLMAFCLAGALSFNLASPGSAD

SEQ ID NO: 829232 - protein, 17 aa, Mycobacterium
KLMFRGMDMMRHRSAFD

SEQ ID NO: 829233 - protein, 32 aa, Mycobacterium
KLMGRRVLEMLPIPPIALNLRTGVAMVSYGDN

SEQ ID NO: 829234 - protein, 19 aa, Mycobacterium
KLMKGAGLIRLLQTKQYQG

SEQ ID NO: 829235 - protein, 20 aa, Mycobacterium
KLMKGAGLIRLLQTKQYQGF

SEQ ID NO: 829236 - protein, 32 aa, Mycobacterium
KLMRHTGPALSPFNAWTLLKGLETMALRVQHQ

SEQ ID NO: 829237 - protein, 21 aa, Mycobacterium
KLMRRLLIANVRRQLPKDFDV

SEQ ID NO: 829238 - protein, 24 aa, Mycobacterium
KLNERWRELGLNLNWPDLIYDGER

SEQ ID NO: 829239 - protein, 18 aa, Mycobacterium
KLNGILVRPHDIRVGRNA

SEQ ID NO: 829240 - protein, 17 aa, Mycobacterium
KLNLTLSAAAQSLAGLG

SEQ ID NO: 829241 - protein, 28 aa, Mycobacterium
KLNPITDPLLPVFTKVLQPFIEIGAVRI

SEQ ID NO: 829242 - protein, 27 aa, Mycobacterium
KLNRDQLNEFFLLLAIAGNETTRNTLS

SEQ ID NO: 829243 - protein, 31 aa, Mycobacterium
KLNRRHSRIKLPKLGWVKFRASRSLDGETIR

SEQ ID NO: 829244 - protein, 29 aa, Mycobacterium
KLNTELAFPCVWIAPWTRADGLVPLRHSL

SEQ ID NO: 829245 - protein, 18 aa, Mycobacterium
KLNVLPIYGGSSYAVQLA

SEQ ID NO: 829246 - protein, 20 aa, Mycobacterium
KLPAIRQQIWTLIRAAKMDH

SEQ ID NO: 829247 - protein, 28 aa, Mycobacterium
KLPDGTPFPTLYYLTHPVLTAAASRLET

SEQ ID NO: 829248 - protein, 29 aa, Mycobacterium
KLPDGTPFPTLYYLTHPVLTAAASRLETT

SEQ ID NO: 829249 - protein, 20 aa, Mycobacterium
KLPDLVVCRPELAEAVLAVT

SEQ ID NO: 829250 - protein, 18 aa, Mycobacterium
KLPFLIAVNDFDGAPRHP

SEQ ID NO: 829251 - protein, 25 aa, Mycobacterium
KLPGEPLLVPIMSKGRRLARHVSDL

SEQ ID NO: 829252 - protein, 19 aa, Mycobacterium
KLPGPWQLMVTQPARYMSP

SEQ ID NO: 829253 - protein, 20 aa, Mycobacterium
KLPIPKPMVKKLANQVLEHL

SEQ ID NO: 829254 - protein, 22 aa, Mycobacterium
KLPIRDVIRMAGHANHYLAVFD

SEQ ID NO: 829255 - protein, 24 aa, Mycobacterium
KLPKVFFVNWFRRGDEGQFLWPGF

SEQ ID NO: 829256 - protein, 20 aa, Mycobacterium
KLPPDFKVVIIGAGIAGMAA

SEQ ID NO: 829257 - protein, 19 aa, Mycobacterium
KLPPYKRPRYIELVTEFPL

SEQ ID NO: 829258 - protein, 24 aa, Mycobacterium
KLPQTILMYPMTVASQIAQLVMKM

SEQ ID NO: 829259 - protein, 26 aa, Mycobacterium
KLPQVFFVNWFRRGEDHRFLWPGFGE

SEQ ID NO: 829260 - protein, 18 aa, Mycobacterium
KLQLAVLAARLRAAGARV

SEQ ID NO: 829261 - protein, 22 aa, Mycobacterium
KLQLPRDAVLVTILRGPRVIVP

SEQ ID NO: 829262 - protein, 27 aa, Mycobacterium
KLQQDPAIDTILTLGAPFALTAVQSAK

SEQ ID NO: 829263 - protein, 29 aa, Mycobacterium
KLQQVDPAHLWWIRSQLRAALIADVRARV

SEQ ID NO: 829264 - protein, 25 aa, Mycobacterium
KLQQVGTPWMARQGGAVLAADVNGL

SEQ ID NO: 829265 - protein, 22 aa, Mycobacterium
KLQSWTIFATVRQVLDVLDPVP

SEQ ID NO: 829266 - protein, 18 aa, Mycobacterium
KLQTFLTAGPKEARAWVI

SEQ ID NO: 829267 - protein, 20 aa, Mycobacterium
KLRAAAAAWRNAGAQFAVAE

SEQ ID NO: 829268 - protein, 24 aa, Mycobacterium
KLRAAHLREPINDSWIAATAVAHQ

SEQ ID NO: 829269 - protein, 18 aa, Mycobacterium
KLRAGFSAPLHDSVRARL

SEQ ID NO: 829270 - protein, 20 aa, Mycobacterium
KLREAYQHVWFVVARSCDID

SEQ ID NO: 829271 - protein, 17 aa, Mycobacterium
KLREEGVELVFAPNAEA

SEQ ID NO: 829272 - protein, 25 aa, Mycobacterium
KLREPLEVPGLLDVQIDSFEWLIGA

SEQ ID NO: 829273 - protein, 25 aa, Mycobacterium
KLREPLEVPGLLDVQIDSFEWLIGS

SEQ ID NO: 829274 - protein, 21 aa, Mycobacterium
KLRHYLPIYERVLTNAGKMLE

SEQ ID NO: 829275 - protein, 17 aa, Mycobacterium
KLRNGPAVALRKTKQAI

SEQ ID NO: 829276 - protein, 20 aa, Mycobacterium
KLRPDILAQGQRVAAAKLGL

SEQ ID NO: 829277 - protein, 26 aa, Mycobacterium
KLRPNIAEWFESATLPRDLARQFGEL

SEQ ID NO: 829278 - protein, 28 aa, Mycobacterium
KLRPNLQSRQRWVISVAALSVIGSITDH

SEQ ID NO: 829279 - protein, 23 aa, Mycobacterium
KLRPSRGTHLVFRAASFGGLSAA

SEQ ID NO: 829280 - protein, 19 aa, Mycobacterium
KLRQAYFWIVNQAIISPHY

SEQ ID NO: 829281 - protein, 34 aa, Mycobacterium
KLRQKRLMTLIHLWLVHRFKADGVIYVTPTEDNL

SEQ ID NO: 829282 - protein, 18 aa, Mycobacterium
KLRRAAGLLNLDDLADSA

SEQ ID NO: 829283 - protein, 17 aa, Mycobacterium
KLRRRAVRIVRDAAGVD

SEQ ID NO: 829284 - protein, 24 aa, Mycobacterium
KLRRRRLRFMIKAEMQEVKAVNYV

SEQ ID NO: 829285 - protein, 18 aa, Mycobacterium
KLRRSDMSILTRSATLPY

SEQ ID NO: 829286 - protein, 22 aa, Mycobacterium
KLRTATLRMLLAAIQKEEVSGK

SEQ ID NO: 829287 - protein, 19 aa, Mycobacterium
KLRYSVFSWQRVTLLERTH

SEQ ID NO: 829288 - protein, 25 aa, Mycobacterium
KLSAPRVIWVMVPAGTITTGVIEEL

SEQ ID NO: 829289 - protein, 19 aa, Mycobacterium
KLSARAAARYYLTGAKFGA

SEQ ID NO: 829290 - protein, 18 aa, Mycobacterium
KLSDYAQRRFGVGIAVRA

SEQ ID NO: 829291 - protein, 29 aa, Mycobacterium
KLSEEAIYSFLRLLLPAGLETTYRSSGNL

SEQ ID NO: 829292 - protein, 30 aa, Mycobacterium
KLSELLSSGPVVLFFYPAAMTPGCTKEACH

SEQ ID NO: 829293 - protein, 36 aa, Mycobacterium
KLSGELYLRAYTEMYGFAPICLALSNVYGPRQRPHG

SEQ ID NO: 829294 - protein, 27 aa, Mycobacterium
KLSHGVYKMPPNHFDLAWSADKVGAMR

SEQ ID NO: 829295 - protein, 21 aa, Mycobacterium
KLSLRFVGWAEVAKAGSDLVE

SEQ ID NO: 829296 - protein, 17 aa, Mycobacterium
KLSPRAAARYYLTGETF

SEQ ID NO: 829297 - protein, 22 aa, Mycobacterium
KLSRRGLRWALEAIVCRHLSVA

SEQ ID NO: 829298 - protein, 24 aa, Mycobacterium
KLSSGDIPFYEPGLRKILQSNIAS

SEQ ID NO: 829299 - protein, 30 aa, Mycobacterium
KLSTLLSDGPVVLFFYPAAMTPGCTKEACH

SEQ ID NO: 829300 - protein, 26 aa, Mycobacterium
KLSTYFHEQVFPVLTPLAVDPAHPFP

SEQ ID NO: 829301 - protein, 28 aa, Mycobacterium
KLSTYFHEQVFPVLTPLAVDPAHPFPFV

SEQ ID NO: 829302 - protein, 27 aa, Mycobacterium
KLSVPPSWTGAAPLASPLGSALGGTPM

SEQ ID NO: 829303 - protein, 30 aa, Mycobacterium
KLTAAIHRDFSVLWAAFRELAEDDDAAVLA

SEQ ID NO: 829304 - protein, 21 aa, Mycobacterium
KLTAGPLVREAGDWCLQVHGG

SEQ ID NO: 829305 - protein, 24 aa, Mycobacterium
KLTAPRVVWVMVPAGTITTGVIEE

SEQ ID NO: 829306 - protein, 24 aa, Mycobacterium
KLTGIPPDLAIYRLKPRKELPAFG

SEQ ID NO: 829307 - protein, 25 aa, Mycobacterium
KLTGIPPDLAIYRLTTRKDLATIGD

SEQ ID NO: 829308 - protein, 33 aa, Mycobacterium
KLTGRLTRVSTLPRPLRPLRNAGIRLAAGVPAV

SEQ ID NO: 829309 - protein, 17 aa, Mycobacterium
KLTHIDMGPIQRYLGPL

SEQ ID NO: 829310 - protein, 18 aa, Mycobacterium
KLTKQELVIFLAVVAGAG

SEQ ID NO: 829311 - protein, 23 aa, Mycobacterium
KLTKWSMPLLRPGGRMLAIKGER

SEQ ID NO: 829312 - protein, 21 aa, Mycobacterium
KLTLGDLPTRTFEIGRAVVGI

SEQ ID NO: 829313 - protein, 21 aa, Mycobacterium
KLTLPLVAVVAACGAAVPQAS

SEQ ID NO: 829314 - protein, 22 aa, Mycobacterium
KLTLQSLVAFPTAKDAEAFFED

SEQ ID NO: 829315 - protein, 19 aa, Mycobacterium
KLTPDRYIHELLVEHLHVV

SEQ ID NO: 829316 - protein, 18 aa, Mycobacterium
KLTPERYIHELLVEHLHV

SEQ ID NO: 829317 - protein, 22 aa, Mycobacterium
KLTPEYVAPVVAYLMTEELEDT

SEQ ID NO: 829318 - protein, 29 aa, Mycobacterium
KLVAQMTRPVRWDLCTAAMKDLGVTALVE

SEQ ID NO: 829319 - protein, 31 aa, Mycobacterium
KLVEVPVGFKWFVDGLIGGTIGFGGEESAGA

SEQ ID NO: 829320 - protein, 31 aa, Mycobacterium
KLVEVPVGFKWFVDGLVGGSIGFGGEESAGA

SEQ ID NO: 829321 - protein, 17 aa, Mycobacterium
KLVEYYLSVASGPMLAL

SEQ ID NO: 829322 - protein, 17 aa, Mycobacterium
KLVFLPNFNVKNAHLVY

SEQ ID NO: 829323 - protein, 19 aa, Mycobacterium
KLVHPLIVFVETLSRTETP

SEQ ID NO: 829324 - protein, 19 aa, Mycobacterium
KLVIDPGLGFAKTGHHNWA

SEQ ID NO: 829325 - protein, 19 aa, Mycobacterium
KLVNLPVEWSVRGVDRAAD

SEQ ID NO: 829326 - protein, 28 aa, Mycobacterium
KLVNNALFAGQVGLLAESIRLGARLGVP

SEQ ID NO: 829327 - protein, 21 aa, Mycobacterium
KLVNQMTSPVRWDLCTEYFKT

SEQ ID NO: 829328 - protein, 18 aa, Mycobacterium
KLVPYAKRTPRLARTRAW

SEQ ID NO: 829329 - protein, 18 aa, Mycobacterium
KLVPYAKRTPRLARTRSW

SEQ ID NO: 829330 - protein, 19 aa, Mycobacterium
KLVQRFLDNPVLHSVNEAA

SEQ ID NO: 829331 - protein, 26 aa, Mycobacterium
KLVRSFYSRWFAIDPTVGDLFPADMS

SEQ ID NO: 829332 - protein, 27 aa, Mycobacterium
KLVSKRGWRRWVHSITRINVGLSPDEK

SEQ ID NO: 829333 - protein, 19 aa, Mycobacterium
KLVTGVGAALRKGAPVIVV

SEQ ID NO: 829334 - protein, 20 aa, Mycobacterium
KLWHRLCAELELPALHAPPE

SEQ ID NO: 829335 - protein, 21 aa, Mycobacterium
KLWRSKPVGLLRRVLNNPRVH

SEQ ID NO: 829336 - protein, 19 aa, Mycobacterium
KLYALRDITATVESLPLIA

SEQ ID NO: 829337 - protein, 19 aa, Mycobacterium
KLYALRDITGTVESLPLIA

SEQ ID NO: 829338 - protein, 29 aa, Mycobacterium
KLYDAVFNLNLKGPFRLSALIGERMVADG

SEQ ID NO: 829339 - protein, 26 aa, Mycobacterium
KLYDQSAHYLWIGERTRQLDGAHVAF

SEQ ID NO: 829340 - protein, 31 aa, Mycobacterium
KLYDSTFDVPIIFRAPFVHALAMSWTGRLEQ

SEQ ID NO: 829341 - protein, 20 aa, Mycobacterium
KLYMTNVFGPVALTKAVLPG

SEQ ID NO: 829342 - protein, 24 aa, Mycobacterium
KLYPVIDGLLEAWHAAGDRAIPYT

SEQ ID NO: 829343 - protein, 19 aa, Mycobacterium
KLYSDFYSGLFASNFQPQE

SEQ ID NO: 829344 - protein, 22 aa, Mycobacterium
KMADFHLRVRPGADAWCVAALA

SEQ ID NO: 829345 - protein, 22 aa, Mycobacterium
KMADFHLRVRPGTDAWCMAALA

SEQ ID NO: 829346 - protein, 24 aa, Mycobacterium
KMADTAWFVIREQNLRFNWLKDVD

SEQ ID NO: 829347 - protein, 19 aa, Mycobacterium
KMCPAPTAPIPILVGGHAD

SEQ ID NO: 829348 - protein, 20 aa, Mycobacterium
KMDGSWRIMPAGRPGPTWNH

SEQ ID NO: 829349 - protein, 19 aa, Mycobacterium
KMDSHWRNKLLVCKTVGGG

SEQ ID NO: 829350 - protein, 20 aa, Mycobacterium
KMFEIAIRALGAGYQSVFPK

SEQ ID NO: 829351 - protein, 19 aa, Mycobacterium
KMFSLLFKSLRRQRQLLSR

SEQ ID NO: 829352 - protein, 19 aa, Mycobacterium
KMGFVFNFITYGGHQVDGV

SEQ ID NO: 829353 - protein, 24 aa, Mycobacterium
KMGHRLTIAMTRWQATVNWVADEP

SEQ ID NO: 829354 - protein, 17 aa, Mycobacterium
KMGLPVLAVVAFAQSFG

SEQ ID NO: 829355 - protein, 19 aa, Mycobacterium
KMGLYYSGGYDWTFDPTVI

SEQ ID NO: 829356 - protein, 19 aa, Mycobacterium
KMGMMSSPTGELFFDNVRI

SEQ ID NO: 829357 - protein, 18 aa, Mycobacterium
KMGPPQIRKLLLDTPDPL

SEQ ID NO: 829358 - protein, 17 aa, Mycobacterium
KMHVLAPSGTFVPKNLD

SEQ ID NO: 829359 - protein, 18 aa, Mycobacterium
KMLFSREMLEGVTADNVF

SEQ ID NO: 829360 - protein, 18 aa, Mycobacterium
KMLQNAQAGLPHGSARPF

SEQ ID NO: 829361 - protein, 19 aa, Mycobacterium
KMLSFYMKTPGGFDMEFGC

SEQ ID NO: 829362 - protein, 19 aa, Mycobacterium
KMLSLLWQSLRRQRELSKR

SEQ ID NO: 829363 - protein, 25 aa, Mycobacterium
KMNGQLEKARWFGKTFASPTDVQPL

SEQ ID NO: 829364 - protein, 36 aa, Mycobacterium
KMNLNHFEAIALVQKIAFALPDKYFDKVDVTVIPPF

SEQ ID NO: 829365 - protein, 36 aa, Mycobacterium
KMNLNHFEAIALVQKIAFSLPDKYFDKVDVTVIPPF

SEQ ID NO: 829366 - protein, 36 aa, Mycobacterium
KMNLNHFEAIALVQKIAFSLPDKYFDRVDVTVIPPF

SEQ ID NO: 829367 - protein, 35 aa, Mycobacterium
KMNLNHFEAIALVQKIAFSLPDKYYDKVDVTVIPP

SEQ ID NO: 829368 - protein, 35 aa, Mycobacterium
KMNLNHFEAIALVQKVAFALPDKYYDKVDVTVIPP

SEQ ID NO: 829369 - protein, 28 aa, Mycobacterium
KMPGGMYRNQVWFPYPGSNVALCVGMCG

SEQ ID NO: 829370 - protein, 24 aa, Mycobacterium
KMPGYTIPGFRRNAVTIATGGVYD

SEQ ID NO: 829371 - protein, 19 aa, Mycobacterium
KMPKGLRAKLLGALDYIEA

SEQ ID NO: 829372 - protein, 26 aa, Mycobacterium
KMPKVFFVNWFRRGDDGGFLWPGFGE

SEQ ID NO: 829373 - protein, 21 aa, Mycobacterium
KMPLVPLIDGWETVPEMEAAL

SEQ ID NO: 829374 - protein, 21 aa, Mycobacterium
KMPRRFYCRARWHESPLDSET

SEQ ID NO: 829375 - protein, 26 aa, Mycobacterium
KMPRRFYCRATWHEAPLDSETQVFDL

SEQ ID NO: 829376 - protein, 29 aa, Mycobacterium
KMPSQRGWRHWLYVMTRINLGLSPDEIYE

SEQ ID NO: 829377 - protein, 17 aa, Mycobacterium
KMPWGTMHPTTISAPIV

SEQ ID NO: 829378 - protein, 22 aa, Mycobacterium
KMRALQTWYEGHAHYVDGLAEQ

SEQ ID NO: 829379 - protein, 26 aa, Mycobacterium
KMRLSMYVLNAAFYKPALLSRDAEAL

SEQ ID NO: 829380 - protein, 25 aa, Mycobacterium
KMSGNAPIYAILREAKERAKAAGAE

SEQ ID NO: 829381 - protein, 23 aa, Mycobacterium
KMSKFEVVTAMAFAAFADAPVDV

SEQ ID NO: 829382 - protein, 18 aa, Mycobacterium
KMSPAPTQPIPILVGGHA

SEQ ID NO: 829383 - protein, 30 aa, Mycobacterium
KMSPEVITKPRWFLQWAKTMRPPELRVPNQ

SEQ ID NO: 829384 - protein, 24 aa, Mycobacterium
KMSQYPILCAFGAGEPFGASDPWT

SEQ ID NO: 829385 - protein, 25 aa, Mycobacterium
KMTAPRVVWVMVPAGTITTGVIDEL

SEQ ID NO: 829386 - protein, 41 aa, Mycobacterium
KMTFENWDAVLKVHLYGGYNVLRAAWPHFREQSYGRIVVAT

SEQ ID NO: 829387 - protein, 18 aa, Mycobacterium
KMTPAPTKPVPILIGGHA

SEQ ID NO: 829388 - protein, 27 aa, Mycobacterium
KMVGQKFAREIFFLGRPYTAEQMHHMG

SEQ ID NO: 829389 - protein, 20 aa, Mycobacterium
KMVRKRMRALKYSKQMIDDV

SEQ ID NO: 829390 - protein, 17 aa, Mycobacterium
KMVTIAPELPGAISAIE

SEQ ID NO: 829391 - protein, 17 aa, Mycobacterium
KMVVFNNGALSFVELEM

SEQ ID NO: 829392 - protein, 18 aa, Mycobacterium
KNARLWRGLLRCTATADA

SEQ ID NO: 829393 - protein, 18 aa, Mycobacterium
KNARQHLSFGRGIHSCPG

SEQ ID NO: 829394 - protein, 19 aa, Mycobacterium
KNARQHLSFGRGIHSCPGA

SEQ ID NO: 829395 - protein, 45 aa, Mycobacterium
KNAYVGRTFIQPSQTIRQLGIRLKLNPLREVIRGKRLIVVDDSIV

SEQ ID NO: 829396 - protein, 40 aa, Mycobacterium
KNAYVGRTFIQPSQTIRQLGIRLKLNPLREVIRGKRLVVV

SEQ ID NO: 829397 - protein, 25 aa, Mycobacterium
KNDGVCMVTFLPAFVSPAVARWHAE

SEQ ID NO: 829398 - protein, 32 aa, Mycobacterium
KNDHWLHHRTAALNLRRLLTMGLTHTGTTWAL

SEQ ID NO: 829399 - protein, 31 aa, Mycobacterium
KNDHWLHHRVAALNLRRLITIGLIRNGTTWA

SEQ ID NO: 829400 - protein, 26 aa, Mycobacterium
KNDLRDGEPILPLAPSRLAVIGPFAE

SEQ ID NO: 829401 - protein, 17 aa, Mycobacterium
KNDMFQRVLRQDGVEVF

SEQ ID NO: 829402 - protein, 27 aa, Mycobacterium
KNDRLDSRLLARLPLLHPDGLREHTGD

SEQ ID NO: 829403 - protein, 24 aa, Mycobacterium
KNEAALFRYMKSPLMPVAPESVRA

SEQ ID NO: 829404 - protein, 25 aa, Mycobacterium
KNEDPDILFLSEAFTRPARLYGLAK

SEQ ID NO: 829405 - protein, 27 aa, Mycobacterium
KNEFGWIWSHCRHYLFDPWFDVEDEVT

SEQ ID NO: 829406 - protein, 20 aa, Mycobacterium
KNEIGFSQVLYDDHIGKVSL

SEQ ID NO: 829407 - protein, 32 aa, Mycobacterium
KNEPDWMLQTRLKALRIFDRKPMPTWGSNLGG

SEQ ID NO: 829408 - protein, 29 aa, Mycobacterium
KNEPEWMLDIRLKALRTFDKKPMPNWGSN

SEQ ID NO: 829409 - protein, 29 aa, Mycobacterium
KNEPEWMLDIRLKALRTFDKKPMPTWGSD

SEQ ID NO: 829410 - protein, 34 aa, Mycobacterium
KNEPEWMLQNRLKALRIFERKPMPRWGSNLEGID

SEQ ID NO: 829411 - protein, 33 aa, Mycobacterium
KNEPEWMLQTRLKALRIFERKPMPNWGSNLAGI

SEQ ID NO: 829412 - protein, 28 aa, Mycobacterium
KNEQYKLVWKNRLGFARLAIQHGYPIVP

SEQ ID NO: 829413 - protein, 24 aa, Mycobacterium
KNFGTPYAFGKYDQLFVPEFNAGA

SEQ ID NO: 829414 - protein, 23 aa, Mycobacterium
KNGADYVLFWTNDPIDKQRKAVT

SEQ ID NO: 829415 - protein, 28 aa, Mycobacterium
KNGTDLMSLFLPVSPFVELLDIRAEKLT

SEQ ID NO: 829416 - protein, 21 aa, Mycobacterium
KNHLIAEIYLNLMQQVDYFTD

SEQ ID NO: 829417 - protein, 20 aa, Mycobacterium
KNHLPTMTFMKDKIADPADG

SEQ ID NO: 829418 - protein, 26 aa, Mycobacterium
KNIDPDVLFLAEAFTRPARLFGLAKL

SEQ ID NO: 829419 - protein, 21 aa, Mycobacterium
KNKLKYYERIGACKANAAGIE

SEQ ID NO: 829420 - protein, 23 aa, Mycobacterium
KNLALRHPLAALGFMYSLRSTAY

SEQ ID NO: 829421 - protein, 21 aa, Mycobacterium
KNLIHWRGWTHAYRGTIPKLS

SEQ ID NO: 829422 - protein, 20 aa, Mycobacterium
KNLLAGQFVALFGSADRYLA

SEQ ID NO: 829423 - protein, 21 aa, Mycobacterium
KNLNGDYYTLGPDGKKAFFDK

SEQ ID NO: 829424 - protein, 22 aa, Mycobacterium
KNLSYFQIDMDRFMAWDPDACL

SEQ ID NO: 829425 - protein, 19 aa, Mycobacterium
KNLYRPKVPIFIAVGEPIA

SEQ ID NO: 829426 - protein, 20 aa, Mycobacterium
KNMMENFPVGDPWTPGVMQG

SEQ ID NO: 829427 - protein, 26 aa, Mycobacterium
KNNPVRSVLIRRAALTAGPLGSILHT

SEQ ID NO: 829428 - protein, 28 aa, Mycobacterium
KNNVLTFAGSLWWRTVQEIGEEYPDVEL

SEQ ID NO: 829429 - protein, 22 aa, Mycobacterium
KNPAPLKATLAARRRAGRELSR

SEQ ID NO: 829430 - protein, 20 aa, Mycobacterium
KNPFPAEVPVNRLLSRAGSD

SEQ ID NO: 829431 - protein, 25 aa, Mycobacterium
KNPGAFAGLVLLTPSPRYLDDADYR

SEQ ID NO: 829432 - protein, 34 aa, Mycobacterium
KNPGRVLGLHFFNPVPVLPLVELISTLVTTPEAA

SEQ ID NO: 829433 - protein, 22 aa, Mycobacterium
KNPKLYDLFMDIATEELSHLEM

SEQ ID NO: 829434 - protein, 20 aa, Mycobacterium
KNPLFLDEQLTRAEFQKITQ

SEQ ID NO: 829435 - protein, 22 aa, Mycobacterium
KNPLFLDEQLTRAEFQRITQDL

SEQ ID NO: 829436 - protein, 24 aa, Mycobacterium
KNPMRTFGGLLMAQSFVASSRTLL

SEQ ID NO: 829437 - protein, 21 aa, Mycobacterium
KNPMRTFGGLLVAQSFVASTR

SEQ ID NO: 829438 - protein, 31 aa, Mycobacterium
KNPRRVLGLHFFNPVPVLPLVELVSTLVTDE

SEQ ID NO: 829439 - protein, 17 aa, Mycobacterium
KNPRWDKRFLGKHLITA

SEQ ID NO: 829440 - protein, 28 aa, Mycobacterium
KNPSRVLGLHFFNPVPVLPLVEVINTLV

SEQ ID NO: 829441 - protein, 19 aa, Mycobacterium
KNPTRWLAERLNRGELRGV

SEQ ID NO: 829442 - protein, 24 aa, Mycobacterium
KNQDPACPAGTFVAPDAIRNPDGS

SEQ ID NO: 829443 - protein, 25 aa, Mycobacterium
KNRQPWDFVIVTDRAQLRELSTVWQ

SEQ ID NO: 829444 - protein, 20 aa, Mycobacterium
KNRVRHVPVLDGKKLIGIVS

SEQ ID NO: 829445 - protein, 20 aa, Mycobacterium
KNRYIGIPAAFSKLFRSEVD

SEQ ID NO: 829446 - protein, 21 aa, Mycobacterium
KNSFGLRLAVLGPLENADLVG

SEQ ID NO: 829447 - protein, 28 aa, Mycobacterium
KNTARRGVLGWLLPLVSRFPTLSMAISR

SEQ ID NO: 829448 - protein, 28 aa, Mycobacterium
KNTFHGLLLLRHLSDLVNTGWPVLMALS

SEQ ID NO: 829449 - protein, 26 aa, Mycobacterium
KNTVLWGGYTWQYWRATRSVKTDEYQ

SEQ ID NO: 829450 - protein, 28 aa, Mycobacterium
KNTWHGLLLLRHVADLVKTGWPVLMALS

SEQ ID NO: 829451 - protein, 21 aa, Mycobacterium
KNVAMAPRKLRRLPADEARDL

SEQ ID NO: 829452 - protein, 18 aa, Mycobacterium
KNVCEWDMMGALLGRPVD

SEQ ID NO: 829453 - protein, 21 aa, Mycobacterium
KNVEDFLTYADRRSLGPSAME

SEQ ID NO: 829454 - protein, 19 aa, Mycobacterium
KNVREHIAFGRGIHTCAGA

SEQ ID NO: 829455 - protein, 18 aa, Mycobacterium
KNVREHMAFARGVHSCPG

SEQ ID NO: 829456 - protein, 24 aa, Mycobacterium
KNWPKRMGRIPEQLLSGVPAHVDG

SEQ ID NO: 829457 - protein, 23 aa, Mycobacterium
KNYDKLLPTMEKVGFIQKGQTVS

SEQ ID NO: 829458 - protein, 19 aa, Mycobacterium
KNYDLLLPTMEKAGFIQKG

SEQ ID NO: 829459 - protein, 18 aa, Mycobacterium
KNYFYPDMPKNYQISQYD

SEQ ID NO: 829460 - protein, 19 aa, Mycobacterium
KNYFYPDMPKNYQISQYDE

SEQ ID NO: 829461 - protein, 23 aa, Mycobacterium
KPAAFDVLFWNADTTRMAAALHR

SEQ ID NO: 829462 - protein, 21 aa, Mycobacterium
KPAAKWFLALIARERGEEDAA

SEQ ID NO: 829463 - protein, 22 aa, Mycobacterium
KPAGALYAFPRLDPEVYDIADD

SEQ ID NO: 829464 - protein, 23 aa, Mycobacterium
KPAGVPFLWRWQDVHAKLLKSCD

SEQ ID NO: 829465 - protein, 25 aa, Mycobacterium
KPAIDPILQKVLDAVPFRLSTEDGI

SEQ ID NO: 829466 - protein, 25 aa, Mycobacterium
KPAIDPILQKVLDAVPFRLSTEDGV

SEQ ID NO: 829467 - protein, 17 aa, Mycobacterium
KPAIYRRWRGKAHLVHE

SEQ ID NO: 829468 - protein, 20 aa, Mycobacterium
KPANWWLAARCVRGFLSMSS

SEQ ID NO: 829469 - protein, 22 aa, Mycobacterium
KPAPQDPSMLASGPVGGPDGNP

SEQ ID NO: 829470 - protein, 28 aa, Mycobacterium
KPAQETPLTMLLLAKLMADAGLPKGVLS

SEQ ID NO: 829471 - protein, 28 aa, Mycobacterium
KPAQETPLTMLLLAKLMDEAGLPKGVLS

SEQ ID NO: 829472 - protein, 32 aa, Mycobacterium
KPAQRLLRLVATELPWTTTIGAPPTSAVINRG

SEQ ID NO: 829473 - protein, 26 aa, Mycobacterium
KPARIPVWFMRQAGRSLPEYRALRAQ

SEQ ID NO: 829474 - protein, 25 aa, Mycobacterium
KPASTVPLLAMRLAQAFDAAGLPPG

SEQ ID NO: 829475 - protein, 22 aa, Mycobacterium
KPATLIKVIRYPSDGTTSQGVG

SEQ ID NO: 829476 - protein, 19 aa, Mycobacterium
KPATVLVLGVGVAGLQALA

SEQ ID NO: 829477 - protein, 25 aa, Mycobacterium
KPAYHALTFGWLMSGLARAVTGKDM

SEQ ID NO: 829478 - protein, 20 aa, Mycobacterium
KPAYIAGDLAYYLDKRQRGF

SEQ ID NO: 829479 - protein, 32 aa, Mycobacterium
KPDARRFRRFLTHTVWPSIRDTGSYTTAPALP

SEQ ID NO: 829480 - protein, 20 aa, Mycobacterium
KPDATRIVAWHSGERAGPTV

SEQ ID NO: 829481 - protein, 20 aa, Mycobacterium
KPDCVVYNPMWFDVDELVRI

SEQ ID NO: 829482 - protein, 19 aa, Mycobacterium
KPDGALYAFPRLDPEVYDI

SEQ ID NO: 829483 - protein, 21 aa, Mycobacterium
KPDLDAIRPLITGGPAHVPPA

SEQ ID NO: 829484 - protein, 19 aa, Mycobacterium
KPDLGRYGSFGRGVTPAQA

SEQ ID NO: 829485 - protein, 21 aa, Mycobacterium
KPDPKLSLAPVGAALGELLGQ

SEQ ID NO: 829486 - protein, 23 aa, Mycobacterium
KPDPNTPWNATRLGRLIVERTDM

SEQ ID NO: 829487 - protein, 29 aa, Mycobacterium
KPDSSQLVRILIRQLLPTGAIGLGDIALH

SEQ ID NO: 829488 - protein, 25 aa, Mycobacterium
KPDWRYNGFWRALFGFPGVAKAIRH

SEQ ID NO: 829489 - protein, 22 aa, Mycobacterium
KPDYALVMPFDGHRFRLVEQFR

SEQ ID NO: 829490 - protein, 22 aa, Mycobacterium
KPEFIENFFMFIAEEVREYMAQ

SEQ ID NO: 829491 - protein, 17 aa, Mycobacterium
KPEFIHSRGPVAVVVAF

SEQ ID NO: 829492 - protein, 23 aa, Mycobacterium
KPEFINRLDDVIIFDGLNPEELV

SEQ ID NO: 829493 - protein, 26 aa, Mycobacterium
KPEFVENFFRFIAEDIRKYLAELGFR

SEQ ID NO: 829494 - protein, 23 aa, Mycobacterium
KPEGALYAFPRLDPEVYDITDDE

SEQ ID NO: 829495 - protein, 21 aa, Mycobacterium
KPEGMVPIRVKMTIKGDQLSY

SEQ ID NO: 829496 - protein, 19 aa, Mycobacterium
KPEILASNRFRAGLAKIPG

SEQ ID NO: 829497 - protein, 21 aa, Mycobacterium
KPELAHGIPLQSSPPNHSSTG

SEQ ID NO: 829498 - protein, 30 aa, Mycobacterium
KPELLEELKGLWFYYAGVYKGLPLDDRTAL

SEQ ID NO: 829499 - protein, 34 aa, Mycobacterium
KPELNSDELIYLAGFFTGLPDRPTGVPVLPGCAP

SEQ ID NO: 829500 - protein, 24 aa, Mycobacterium
KPERLRSGWLNGIKHWQVDYHSTA

SEQ ID NO: 829501 - protein, 19 aa, Mycobacterium
KPERPWLELNSRDPQLLSF

SEQ ID NO: 829502 - protein, 20 aa, Mycobacterium
KPEVAPLHPYTAAVARGVSE

SEQ ID NO: 829503 - protein, 22 aa, Mycobacterium
KPEWTDRWPELVAAFTAATRAE

SEQ ID NO: 829504 - protein, 22 aa, Mycobacterium
KPFDYWRQHLKTMKGQWAPFQS

SEQ ID NO: 829505 - protein, 20 aa, Mycobacterium
KPFEYLPDALRRGAARLSAA

SEQ ID NO: 829506 - protein, 21 aa, Mycobacterium
KPFRRVPKPPPSPTPRATTRR

SEQ ID NO: 829507 - protein, 29 aa, Mycobacterium
KPFSPRELVARIRAMLRRPRVLQSATATA

SEQ ID NO: 829508 - protein, 19 aa, Mycobacterium
KPFVALRHLRFHSLPNLIA

SEQ ID NO: 829509 - protein, 31 aa, Mycobacterium
KPGDALFFGHGLNIHFDLIKPPADVTIAMVA

SEQ ID NO: 829510 - protein, 32 aa, Mycobacterium
KPGDALFFGHGLNIHFNLIKPPADVTVAMVAP

SEQ ID NO: 829511 - protein, 32 aa, Mycobacterium
KPGDALFFGHGLNVHFGLIKPPADVTVAMVAP

SEQ ID NO: 829512 - protein, 19 aa, Mycobacterium
KPGDLALLIGYGAGLSYAA

SEQ ID NO: 829513 - protein, 25 aa, Mycobacterium
KPGEPSWPTPWGRGRPGWHLECSAM

SEQ ID NO: 829514 - protein, 21 aa, Mycobacterium
KPGERIALLALASGLEIGVVL

SEQ ID NO: 829515 - protein, 23 aa, Mycobacterium
KPGGRFFALVFATEAFPPNAEFG

SEQ ID NO: 829516 - protein, 23 aa, Mycobacterium
KPGLVIVVPVIKKQFKGANPWVM

SEQ ID NO: 829517 - protein, 20 aa, Mycobacterium
KPGNNLPLRNIPAGTVIHAV

SEQ ID NO: 829518 - protein, 34 aa, Mycobacterium
KPGQAFLGILPFEEGWCRLAFSTGLDRLGVEPTL

SEQ ID NO: 829519 - protein, 33 aa, Mycobacterium
KPGQGHPILYVAQMWDWIYPLGEDPDYEPDPST

SEQ ID NO: 829520 - protein, 25 aa, Mycobacterium
KPGRQAWYFDPASSEFRRLTPAART

SEQ ID NO: 829521 - protein, 18 aa, Mycobacterium
KPGSAMRALPGISASIVD

SEQ ID NO: 829522 - protein, 20 aa, Mycobacterium
KPGYSIVLPPPNVTGSLHMG

SEQ ID NO: 829523 - protein, 21 aa, Mycobacterium
KPGYSIVLPPPNVTGSLHMGH

SEQ ID NO: 829524 - protein, 17 aa, Mycobacterium
KPHADVAETRRVITTLF

SEQ ID NO: 829525 - protein, 22 aa, Mycobacterium
KPHAFRPPFGTLVVQDFCAITD

SEQ ID NO: 829526 - protein, 27 aa, Mycobacterium
KPHITRRFDMPWSSPAARMRDMVLAVR

SEQ ID NO: 829527 - protein, 22 aa, Mycobacterium
KPHLGTSFWFAFGSPDQARAQV

SEQ ID NO: 829528 - protein, 33 aa, Mycobacterium
KPHPRGELLLKTDGMFLGYYKRPEVTAGVFDAD

SEQ ID NO: 829529 - protein, 24 aa, Mycobacterium
KPHRVPVWMMRQAGRSLPEYRELR

SEQ ID NO: 829530 - protein, 22 aa, Mycobacterium
KPHSVNIFGTKLVVFADSKGEL

SEQ ID NO: 829531 - protein, 20 aa, Mycobacterium
KPHVRLWAKLEDRNPTGSIK

SEQ ID NO: 829532 - protein, 24 aa, Mycobacterium
KPIAPPLVTLPKLAQGIAFVASRR

SEQ ID NO: 829533 - protein, 26 aa, Mycobacterium
KPIIRHGGNPLLRWMVDNFAVAMDPA

SEQ ID NO: 829534 - protein, 21 aa, Mycobacterium
KPILLQEIFAAYYGVQLPAPV

SEQ ID NO: 829535 - protein, 21 aa, Mycobacterium
KPILLQEIFASYYGVRLPAAP

SEQ ID NO: 829536 - protein, 20 aa, Mycobacterium
KPILLQEIFVSYFGQRLPAP

SEQ ID NO: 829537 - protein, 17 aa, Mycobacterium
KPITHPLRADIPIMLGA

SEQ ID NO: 829538 - protein, 19 aa, Mycobacterium
KPITRPYAQSLTAAGLVIV

SEQ ID NO: 829539 - protein, 21 aa, Mycobacterium
KPIVPGLMPITSLRSVRRQVE

SEQ ID NO: 829540 - protein, 21 aa, Mycobacterium
KPKAIYTIPTFQNPSGVTMSL

SEQ ID NO: 829541 - protein, 23 aa, Mycobacterium
KPKFVLMPTPIWDQMFKPLVAGQ

SEQ ID NO: 829542 - protein, 23 aa, Mycobacterium
KPKLDVLDYWELVQRELPDVRGL

SEQ ID NO: 829543 - protein, 28 aa, Mycobacterium
KPKPSDKVLIFGAGPIGLGAVLAFKSAG

SEQ ID NO: 829544 - protein, 25 aa, Mycobacterium
KPKTHVSVPPPLRFTAQAAQMLPPK

SEQ ID NO: 829545 - protein, 29 aa, Mycobacterium
KPKVLSRYLAKWYWQVKGYVGGLTPQSGD

SEQ ID NO: 829546 - protein, 22 aa, Mycobacterium
KPLAHNPLEFLYGTFADYVRDR

SEQ ID NO: 829547 - protein, 26 aa, Mycobacterium
KPLDEIPMLLQPGVLSLAWGSVVRQL

SEQ ID NO: 829548 - protein, 17 aa, Mycobacterium
KPLGRQAEMARRAQTIQ

SEQ ID NO: 829549 - protein, 27 aa, Mycobacterium
KPLKPIVHPLRSDIPIFLGAEGPKNVA

SEQ ID NO: 829550 - protein, 33 aa, Mycobacterium
KPLKYPVMFRSVDVVLLNKIDLVPYLDADVEAY

SEQ ID NO: 829551 - protein, 17 aa, Mycobacterium
KPLLLLGALDIGGVGYV

SEQ ID NO: 829552 - protein, 17 aa, Mycobacterium
KPLMKWTDEEWHQVLDL

SEQ ID NO: 829553 - protein, 32 aa, Mycobacterium
KPLPLSPVQANLWYLQQLVPTMAAYNIPEAVR

SEQ ID NO: 829554 - protein, 24 aa, Mycobacterium
KPLPVAFEFMPYSQVKNLAQAIGL

SEQ ID NO: 829555 - protein, 21 aa, Mycobacterium
KPLTRLDDAGLGFVVEHVQFL

SEQ ID NO: 829556 - protein, 20 aa, Mycobacterium
KPLTVIRPSLRPAQRWMLSA

SEQ ID NO: 829557 - protein, 17 aa, Mycobacterium
KPMAFVRAILRSDITDL

SEQ ID NO: 829558 - protein, 19 aa, Mycobacterium
KPMAFVRAMLRTDVKDLTV

SEQ ID NO: 829559 - protein, 26 aa, Mycobacterium
KPMDEIPMLLQPGILSIAWGTAIRQL

SEQ ID NO: 829560 - protein, 27 aa, Mycobacterium
KPMISVAIYEKPLETPLLNLVMNESRI

SEQ ID NO: 829561 - protein, 23 aa, Mycobacterium
KPMNKFMMAVQRLGIPTGPAMVL

SEQ ID NO: 829562 - protein, 25 aa, Mycobacterium
KPMQLINYLLRRRGMLTSNVGEAYG

SEQ ID NO: 829563 - protein, 19 aa, Mycobacterium
KPMVIPMAYARDGEFLLMH

SEQ ID NO: 829564 - protein, 24 aa, Mycobacterium
KPNARYDALAYLLRHFGPGDAVVP

SEQ ID NO: 829565 - protein, 17 aa, Mycobacterium
KPNIGWVVHYDLPDSLD

SEQ ID NO: 829566 - protein, 17 aa, Mycobacterium
KPNLGRFGSFGRGVTPA

SEQ ID NO: 829567 - protein, 26 aa, Mycobacterium
KPNPAPSTLLLALLSGFERRGRWNVP

SEQ ID NO: 829568 - protein, 20 aa, Mycobacterium
KPNRMMRPARMFGLRAEVEP

SEQ ID NO: 829569 - protein, 18 aa, Mycobacterium
KPNWVIDLHNGGCAAFVL

SEQ ID NO: 829570 - protein, 21 aa, Mycobacterium
KPPAEWAPGEPPPAALSHLDD

SEQ ID NO: 829571 - protein, 19 aa, Mycobacterium
KPPFVSRSVLVTGGNRGIG

SEQ ID NO: 829572 - protein, 21 aa, Mycobacterium
KPPHPSWLPKQRRGTTPQMIG

SEQ ID NO: 829573 - protein, 19 aa, Mycobacterium
KPPMRWGVRMMGKKFLREY

SEQ ID NO: 829574 - protein, 22 aa, Mycobacterium
KPPNFWAWLIAEVKNEDPDILF

SEQ ID NO: 829575 - protein, 28 aa, Mycobacterium
KPPPSEGWRRLLYELSGHRINLGEGARA

SEQ ID NO: 829576 - protein, 18 aa, Mycobacterium
KPPRKPLIAAVEGYALAG

SEQ ID NO: 829577 - protein, 17 aa, Mycobacterium
KPQENAPAPPLARMFET

SEQ ID NO: 829578 - protein, 23 aa, Mycobacterium
KPQGALYAFPRLDPEVYDIADDE

SEQ ID NO: 829579 - protein, 23 aa, Mycobacterium
KPQLVHYYFRTMEELFLELFRRR

SEQ ID NO: 829580 - protein, 22 aa, Mycobacterium
KPQLVHYYFRTMEELFLEVFRR

SEQ ID NO: 829581 - protein, 19 aa, Mycobacterium
KPQPTLMRDALSRGSFEAP

SEQ ID NO: 829582 - protein, 26 aa, Mycobacterium
KPQRGRISTWPWPETFNGITVNGVLA

SEQ ID NO: 829583 - protein, 18 aa, Mycobacterium
KPQTALVAISPIAAIDAL

SEQ ID NO: 829584 - protein, 23 aa, Mycobacterium
KPRAEGRFYLPDGRRLGFAEFGD

SEQ ID NO: 829585 - protein, 18 aa, Mycobacterium
KPRDWLHHKGVSPAAQRG

SEQ ID NO: 829586 - protein, 18 aa, Mycobacterium
KPRFDPRAVLETAEREKV

SEQ ID NO: 829587 - protein, 19 aa, Mycobacterium
KPRGRELFCDLVEKSDIVV

SEQ ID NO: 829588 - protein, 20 aa, Mycobacterium
KPRGRRKTRIGYVVSDKMQK

SEQ ID NO: 829589 - protein, 34 aa, Mycobacterium
KPRQPYVYSLYDDARLLVHAIRRVWKLTEFRMLT

SEQ ID NO: 829590 - protein, 27 aa, Mycobacterium
KPRTDPSALAWLFYTSGTTGRSKGAML

SEQ ID NO: 829591 - protein, 22 aa, Mycobacterium
KPRTTIGWKGLINDPGMDGTFD

SEQ ID NO: 829592 - protein, 20 aa, Mycobacterium
KPRVLVGPDAKILDVIVRLT

SEQ ID NO: 829593 - protein, 29 aa, Mycobacterium
KPSAWIAEGLLIYLPASAQEQLFTGIDGL

SEQ ID NO: 829594 - protein, 22 aa, Mycobacterium
KPSFIALRTIIGYPAPNKMNTG

SEQ ID NO: 829595 - protein, 23 aa, Mycobacterium
KPSFRQRFVTLAMRYLPAEREAE

SEQ ID NO: 829596 - protein, 20 aa, Mycobacterium
KPSLAALWARKAELILEHSE

SEQ ID NO: 829597 - protein, 21 aa, Mycobacterium
KPSLAGLVGSALFADGAAAVV

SEQ ID NO: 829598 - protein, 25 aa, Mycobacterium
KPSNRLPYAWNPAYPARIGVMPREG

SEQ ID NO: 829599 - protein, 24 aa, Mycobacterium
KPSPFAASLLFGYVGAFMYEGDVP

SEQ ID NO: 829600 - protein, 23 aa, Mycobacterium
KPSPFAWVPFGGGTRRCAGAAFA

SEQ ID NO: 829601 - protein, 25 aa, Mycobacterium
KPSPPPMTVPWLIGVARHKLADHYR

SEQ ID NO: 829602 - protein, 18 aa, Mycobacterium
KPSRAAALAYKLADRLVF

SEQ ID NO: 829603 - protein, 25 aa, Mycobacterium
KPSRVPVWFMRQAGRSLPEYRALRQ

SEQ ID NO: 829604 - protein, 26 aa, Mycobacterium
KPSRVPVWFMRQAGRSLPEYRALRRQ

SEQ ID NO: 829605 - protein, 22 aa, Mycobacterium
KPSTDTIPYQPVGTLWEATASD

SEQ ID NO: 829606 - protein, 26 aa, Mycobacterium
KPSTTYLWETKGVVPILKIDKGLADA

SEQ ID NO: 829607 - protein, 26 aa, Mycobacterium
KPSTTYLWETKGVVPILKIDKGLAEA

SEQ ID NO: 829608 - protein, 17 aa, Mycobacterium
KPSWQIRTLQDLALPLE

SEQ ID NO: 829609 - protein, 22 aa, Mycobacterium
KPTALLLRYRAGDWNALHRDLY

SEQ ID NO: 829610 - protein, 17 aa, Mycobacterium
KPTFRAALIRVAEDQYR

SEQ ID NO: 829611 - protein, 17 aa, Mycobacterium
KPTGWFQVAWSDEIAVG

SEQ ID NO: 829612 - protein, 27 aa, Mycobacterium
KPTISVGAWLQYLLDNFGTVAEAVEAM

SEQ ID NO: 829613 - protein, 20 aa, Mycobacterium
KPTIYRRWSTKEDLIAAAME

SEQ ID NO: 829614 - protein, 25 aa, Mycobacterium
KPTQKPHPPVWVACTRPATVQMAAQ

SEQ ID NO: 829615 - protein, 17 aa, Mycobacterium
KPTTAAWIVNRLALRDT

SEQ ID NO: 829616 - protein, 23 aa, Mycobacterium
KPTTMLLGLWYDDEFVRTAEGWR

SEQ ID NO: 829617 - protein, 19 aa, Mycobacterium
KPTVYRRWGTKEELIAAAM

SEQ ID NO: 829618 - protein, 29 aa, Mycobacterium
KPVAAICHGPWTLVEARVLAGRTVTSFPS

SEQ ID NO: 829619 - protein, 34 aa, Mycobacterium
KPVAALAYQFAQSPTVLFLGRHVGYPVALEGALK

SEQ ID NO: 829620 - protein, 22 aa, Mycobacterium
KPVADLAYRFAQSSTVLFLGRH

SEQ ID NO: 829621 - protein, 24 aa, Mycobacterium
KPVADLAYRFAQSSTVLFLGRHVG

SEQ ID NO: 829622 - protein, 29 aa, Mycobacterium
KPVADLVPHPRTDIAFGGLAGRLHYDADH

SEQ ID NO: 829623 - protein, 21 aa, Mycobacterium
KPVDAPPTALERILSQHTGTG

SEQ ID NO: 829624 - protein, 24 aa, Mycobacterium
KPVDFGSFLIPRTDYRIDDVWNVV

SEQ ID NO: 829625 - protein, 20 aa, Mycobacterium
KPVEFGVLPKDALGGGLGLA

SEQ ID NO: 829626 - protein, 26 aa, Mycobacterium
KPVGGFPITFGWLHAVRRGQARLHRG

SEQ ID NO: 829627 - protein, 20 aa, Mycobacterium
KPVGTVCFTVLLDDGRTLTR

SEQ ID NO: 829628 - protein, 24 aa, Mycobacterium
KPVKKILAGVLVMTGIGGAGLLST

SEQ ID NO: 829629 - protein, 19 aa, Mycobacterium
KPVLYQHFSSKLELYLAVL

SEQ ID NO: 829630 - protein, 25 aa, Mycobacterium
KPVLYQHFSSKLELYLAVLARHVEN

SEQ ID NO: 829631 - protein, 20 aa, Mycobacterium
KPVLYQHFSSKLELYLAVLN

SEQ ID NO: 829632 - protein, 20 aa, Mycobacterium
KPVLYQHFSSKLELYLAVLQ

SEQ ID NO: 829633 - protein, 31 aa, Mycobacterium
KPVLYQHFSSKVELYLAVLQRHVDNLVSGVR

SEQ ID NO: 829634 - protein, 25 aa, Mycobacterium
KPVLYQHFTSKLELYLAVLARHVEN

SEQ ID NO: 829635 - protein, 20 aa, Mycobacterium
KPVNLVVGLIDELRVRFPNL

SEQ ID NO: 829636 - protein, 28 aa, Mycobacterium
KPVNVARFPTFDWPRIDAPYIRPDADMD

SEQ ID NO: 829637 - protein, 21 aa, Mycobacterium
KPVPFVAEAMRKLGKHDDFTF

SEQ ID NO: 829638 - protein, 24 aa, Mycobacterium
KPVPGAQAYLLDDGLRPVPVGVVG

SEQ ID NO: 829639 - protein, 28 aa, Mycobacterium
KPVPQRGWRRWVYAVTRINFGLSPDEKY

SEQ ID NO: 829640 - protein, 24 aa, Mycobacterium
KPVPVRRLPGYLMRFRRGSRMMTT

SEQ ID NO: 829641 - protein, 35 aa, Mycobacterium
KPVQIVSSLLPPAVKWKAFFKRQLGNPKYLHDGDV

SEQ ID NO: 829642 - protein, 26 aa, Mycobacterium
KPVQRPHPPIWFGGLAPKALARAVRH

SEQ ID NO: 829643 - protein, 17 aa, Mycobacterium
KPVSGEAPLWDFPDGTL

SEQ ID NO: 829644 - protein, 29 aa, Mycobacterium
KPVTVARFPKFDWPRIEAPYIRPRADMDA

SEQ ID NO: 829645 - protein, 22 aa, Mycobacterium
KPVVDRLLSTLPDALAVLKDER

SEQ ID NO: 829646 - protein, 26 aa, Mycobacterium
KPVVDTGFWSFPRSCNPTGALISSVR

SEQ ID NO: 829647 - protein, 27 aa, Mycobacterium
KPWDARSLWTWMSPDDGARLLEACLAT

SEQ ID NO: 829648 - protein, 21 aa, Mycobacterium
KPWQRLEKTLLLGELSLDGRV

SEQ ID NO: 829649 - protein, 20 aa, Mycobacterium
KPWSGFNYYLGDYKSTVAVN

SEQ ID NO: 829650 - protein, 22 aa, Mycobacterium
KPWWSTAVFYQVYPRSFADSSG

SEQ ID NO: 829651 - protein, 21 aa, Mycobacterium
KPYLERVWTNRWTQQGLQAFN

SEQ ID NO: 829652 - protein, 27 aa, Mycobacterium
KQAKERGLWNLFLPSVSGLSNLEYAPL

SEQ ID NO: 829653 - protein, 21 aa, Mycobacterium
KQALRLLGSVALARAARGEDD

SEQ ID NO: 829654 - protein, 23 aa, Mycobacterium
KQALTESVLWPLQHPDTFARLGV

SEQ ID NO: 829655 - protein, 26 aa, Mycobacterium
KQARLWRNLLKCRARIDDNGSVQVRL

SEQ ID NO: 829656 - protein, 17 aa, Mycobacterium
KQAWGGCAYCGATGGPF

SEQ ID NO: 829657 - protein, 19 aa, Mycobacterium
KQCPLLYRFRAIDRLPEAP

SEQ ID NO: 829658 - protein, 23 aa, Mycobacterium
KQCPLLYRFRAIDRLPEAPSAAQ

SEQ ID NO: 829659 - protein, 23 aa, Mycobacterium
KQCPLLYRFRAIDRLPEAPSPAQ

SEQ ID NO: 829660 - protein, 24 aa, Mycobacterium
KQDALPGYGWVFPLGGGRINIGIG

SEQ ID NO: 829661 - protein, 22 aa, Mycobacterium
KQDPAAMEVLLAEAVRADAAVA

SEQ ID NO: 829662 - protein, 28 aa, Mycobacterium
KQELIDNPRGIPYLLVTGRRGGSAMAAA

SEQ ID NO: 829663 - protein, 32 aa, Mycobacterium
KQEMLTEDLVTLAVLRLGRPVRYEFTRVDEFV

SEQ ID NO: 829664 - protein, 23 aa, Mycobacterium
KQEQTFSIVPMGQTCLLTVDMDV

SEQ ID NO: 829665 - protein, 21 aa, Mycobacterium
KQFAGILATQPYRFAGAIELS

SEQ ID NO: 829666 - protein, 17 aa, Mycobacterium
KQFIAHNRMMTGGFAIS

SEQ ID NO: 829667 - protein, 20 aa, Mycobacterium
KQFIAMPWHIYGDDPRWRPT

SEQ ID NO: 829668 - protein, 22 aa, Mycobacterium
KQGPVALKLLTKPPARFCNESP

SEQ ID NO: 829669 - protein, 24 aa, Mycobacterium
KQGRVPFLADYVASKFGVLGLTQA

SEQ ID NO: 829670 - protein, 18 aa, Mycobacterium
KQGSPLRRLVDGSGAASV

SEQ ID NO: 829671 - protein, 27 aa, Mycobacterium
KQGSPNLFMNILTTNGLCVRFLTDWAG

SEQ ID NO: 829672 - protein, 18 aa, Mycobacterium
KQGWKTEIWILVSPTMIN

SEQ ID NO: 829673 - protein, 17 aa, Mycobacterium
KQHAAWVRKRGLPWGLD

SEQ ID NO: 829674 - protein, 39 aa, Mycobacterium
KQHPDRFLSGWQIVALQPYGGAWLNSWLDRDLGVSGRLS

SEQ ID NO: 829675 - protein, 21 aa, Mycobacterium
KQIEWLSALYVPDASDRSDPR

SEQ ID NO: 829676 - protein, 21 aa, Mycobacterium
KQILDLLLDINKELGTSILLV

SEQ ID NO: 829677 - protein, 25 aa, Mycobacterium
KQKADLRLVVVDYLQLMSSGKKVES

SEQ ID NO: 829678 - protein, 25 aa, Mycobacterium
KQKDYIGEIVLLERFFAADPSHQGT

SEQ ID NO: 829679 - protein, 25 aa, Mycobacterium
KQKTDLRMVVVDYLQLMTSGKRVES

SEQ ID NO: 829680 - protein, 17 aa, Mycobacterium
KQKWLPRMATGEELGCF

SEQ ID NO: 829681 - protein, 27 aa, Mycobacterium
KQLAGDGFDLVLIARKPGPLEDTARQC

SEQ ID NO: 829682 - protein, 28 aa, Mycobacterium
KQLAGHGLNLMLIARRPGPLADTADSCR

SEQ ID NO: 829683 - protein, 21 aa, Mycobacterium
KQLHLIVVRSDGQHFAHVHPV

SEQ ID NO: 829684 - protein, 23 aa, Mycobacterium
KQLIHTHLIPRLPTEDQQGVISM

SEQ ID NO: 829685 - protein, 19 aa, Mycobacterium
KQLMEIPIPQRAGFVTEFL

SEQ ID NO: 829686 - protein, 27 aa, Mycobacterium
KQLMRQLDRGFPFLPSGSQIVLDSVSR

SEQ ID NO: 829687 - protein, 19 aa, Mycobacterium
KQLNKLINVIKIVEQEEDN

SEQ ID NO: 829688 - protein, 17 aa, Mycobacterium
KQLVAYVGLENFLAGLR

SEQ ID NO: 829689 - protein, 21 aa, Mycobacterium
KQLVPLAVSAFLTSRKRQAAA

SEQ ID NO: 829690 - protein, 22 aa, Mycobacterium
KQLYAPLAKAALSLGVQFYPHT

SEQ ID NO: 829691 - protein, 20 aa, Mycobacterium
KQMGLVMKAATAIAAGKADG

SEQ ID NO: 829692 - protein, 24 aa, Mycobacterium
KQPDAWYFDIPAIARIAAEPLRLT

SEQ ID NO: 829693 - protein, 21 aa, Mycobacterium
KQPFMDFTPGYVLRALDELPK

SEQ ID NO: 829694 - protein, 26 aa, Mycobacterium
KQPPGNLWRWELSPVNAELTTVTHTY

SEQ ID NO: 829695 - protein, 18 aa, Mycobacterium
KQQGITFVLIDMTSPGIQ

SEQ ID NO: 829696 - protein, 24 aa, Mycobacterium
KQQKEFLLRRQLEAIRKELGELGP

SEQ ID NO: 829697 - protein, 25 aa, Mycobacterium
KQREEAFLELRRLLAVHETAEEEIV

SEQ ID NO: 829698 - protein, 21 aa, Mycobacterium
KQRFLPPTASLDIWWCQGFSE

SEQ ID NO: 829699 - protein, 18 aa, Mycobacterium
KQRGITFVLIDMATPGIE

SEQ ID NO: 829700 - protein, 21 aa, Mycobacterium
KQRIGIARALALRPKIIALDE

SEQ ID NO: 829701 - protein, 25 aa, Mycobacterium
KQRIGIARALALRPKILALDEPVSA

SEQ ID NO: 829702 - protein, 27 aa, Mycobacterium
KQRLTELGPQRFAAWLRESRGVAVTDT

SEQ ID NO: 829703 - protein, 33 aa, Mycobacterium
KQRQRWRDLLLTLEQRLLLTQKYPGMLADDLSD

SEQ ID NO: 829704 - protein, 17 aa, Mycobacterium
KQRSVLAALLLAQGRVV

SEQ ID NO: 829705 - protein, 24 aa, Mycobacterium
KQRTGLPHLTWKYASSVDGRSAAA

SEQ ID NO: 829706 - protein, 19 aa, Mycobacterium
KQRVGIARALALGPSNLLS

SEQ ID NO: 829707 - protein, 21 aa, Mycobacterium
KQRWLPELASGKSLAAFGLTE

SEQ ID NO: 829708 - protein, 18 aa, Mycobacterium
KQSFDPAGILNPGILFPA

SEQ ID NO: 829709 - protein, 22 aa, Mycobacterium
KQSLAYWDRTLTGMPARLELPT

SEQ ID NO: 829710 - protein, 18 aa, Mycobacterium
KQTASLLTHAFVRLPLHL

SEQ ID NO: 829711 - protein, 21 aa, Mycobacterium
KQTFGFFRQNLVSEYTYPESV

SEQ ID NO: 829712 - protein, 25 aa, Mycobacterium
KQTLAPLLDFLSMHARSPRSGELEE

SEQ ID NO: 829713 - protein, 20 aa, Mycobacterium
KQVFFVESLPKNPSGKLLKR

SEQ ID NO: 829714 - protein, 29 aa, Mycobacterium
KQVNRKVLPGYILVRMDLTDDSWAAVRNT

SEQ ID NO: 829715 - protein, 20 aa, Mycobacterium
KQVPFFVDYSRRYTDLPFLI

SEQ ID NO: 829716 - protein, 26 aa, Mycobacterium
KQVVGDRWCLLPHASDFIDPLFSSGL

SEQ ID NO: 829717 - protein, 21 aa, Mycobacterium
KQVYRLVKGRRLNQLSFAYDV

SEQ ID NO: 829718 - protein, 23 aa, Mycobacterium
KQWAMVHRSIFRLAFPGGKPRPK

SEQ ID NO: 829719 - protein, 23 aa, Mycobacterium
KQYGVTPKGWRAAAGQFGKAGTH

SEQ ID NO: 829720 - protein, 17 aa, Mycobacterium
KQYLRLFEMDGVELEFT

SEQ ID NO: 829721 - protein, 23 aa, Mycobacterium
KQYSMLIGAMKVADDVRVTFTAT

SEQ ID NO: 829722 - protein, 17 aa, Mycobacterium
KQYTAYLPSRPHLEWQL

SEQ ID NO: 829723 - protein, 33 aa, Mycobacterium
KRADLVKAVFMPIPVRIIAALLGLPESDVGEFH

SEQ ID NO: 829724 - protein, 27 aa, Mycobacterium
KRAGGQIWLMPHNPAFDPIPGNDATVL

SEQ ID NO: 829725 - protein, 22 aa, Mycobacterium
KRAGIVPPRDLVFAFVADEEHG

SEQ ID NO: 829726 - protein, 21 aa, Mycobacterium
KRAHDFLLAALTAERPEDAVL

SEQ ID NO: 829727 - protein, 21 aa, Mycobacterium
KRAKEMWYLNGKFTAAKAEAM

SEQ ID NO: 829728 - protein, 24 aa, Mycobacterium
KRAKVATLLLPGVGTVRHLKDARR

SEQ ID NO: 829729 - protein, 24 aa, Mycobacterium
KRANRLAHFWYAAGLREGDTVAAL

SEQ ID NO: 829730 - protein, 25 aa, Mycobacterium
KRAVKSHNWGVPGLSWMPGEGPDPF

SEQ ID NO: 829731 - protein, 26 aa, Mycobacterium
KRAYHALTFGWLLAGLARSVTGKDMR

SEQ ID NO: 829732 - protein, 18 aa, Mycobacterium
KRAYRLERPLFFALQCMP

SEQ ID NO: 829733 - protein, 17 aa, Mycobacterium
KRCFIGLKLNQIRAADL

SEQ ID NO: 829734 - protein, 18 aa, Mycobacterium
KRCVWLCDSFAGVPPPDV

SEQ ID NO: 829735 - protein, 17 aa, Mycobacterium
KRCYAEVLPAARPGALF

SEQ ID NO: 829736 - protein, 25 aa, Mycobacterium
KRDALQLILLTILARGHVLIEDLPG

SEQ ID NO: 829737 - protein, 25 aa, Mycobacterium
KRDDLQAIIALLKGSDLDIALQFVN

SEQ ID NO: 829738 - protein, 19 aa, Mycobacterium
KRDIYDDTRLALFTLRRNL

SEQ ID NO: 829739 - protein, 19 aa, Mycobacterium
KRDRIRYHGGDFIELIVGG

SEQ ID NO: 829740 - protein, 25 aa, Mycobacterium
KRDVMVIHTLLWPDEIRDPDFPILD

SEQ ID NO: 829741 - protein, 19 aa, Mycobacterium
KREALALFGGRRVTQAIGA

SEQ ID NO: 829742 - protein, 24 aa, Mycobacterium
KREDKPFWWGHFDRVNNPVEEWAD

SEQ ID NO: 829743 - protein, 19 aa, Mycobacterium
KREIRLLSRFTGANPHVSV

SEQ ID NO: 829744 - protein, 18 aa, Mycobacterium
KRELAAAAPASDRPRRER

SEQ ID NO: 829745 - protein, 25 aa, Mycobacterium
KRERRKVLALNKLGDAAMLVRREFV

SEQ ID NO: 829746 - protein, 19 aa, Mycobacterium
KREVLPGVGIYLDGGFGVG

SEQ ID NO: 829747 - protein, 17 aa, Mycobacterium
KRFCWNCGKPVGRSSKG

SEQ ID NO: 829748 - protein, 27 aa, Mycobacterium
KRFDDQLNALVIRRLNSLKPGAYSRLG

SEQ ID NO: 829749 - protein, 27 aa, Mycobacterium
KRFEVAAQEFLLFPTVAHSHTERVRPE

SEQ ID NO: 829750 - protein, 19 aa, Mycobacterium
KRFFDGFPPNAHPMPVLSS

SEQ ID NO: 829751 - protein, 20 aa, Mycobacterium
KRFGRIIYIGSVSGSWGIGN

SEQ ID NO: 829752 - protein, 21 aa, Mycobacterium
KRFGRLIFMGSVAGQIGLPGQ

SEQ ID NO: 829753 - protein, 36 aa, Mycobacterium
KRFHHTLGYGLLGRRIERSPLPFARHRWVCDRGPAE

SEQ ID NO: 829754 - protein, 19 aa, Mycobacterium
KRFIRTAQNDDWSIVWAAG

SEQ ID NO: 829755 - protein, 17 aa, Mycobacterium
KRFPGYPKGITVPAIVD

SEQ ID NO: 829756 - protein, 23 aa, Mycobacterium
KRFPQLTVLSIAPLLANTIRAVF

SEQ ID NO: 829757 - protein, 19 aa, Mycobacterium
KRFRRLDRFTTVSIYAVFA

SEQ ID NO: 829758 - protein, 20 aa, Mycobacterium
KRGAFLDCDPWQFDPEFFGI

SEQ ID NO: 829759 - protein, 22 aa, Mycobacterium
KRGARCILIRPAPVPGFRGPRS

SEQ ID NO: 829760 - protein, 18 aa, Mycobacterium
KRGDLLFWGPGGSQHEAI

SEQ ID NO: 829761 - protein, 18 aa, Mycobacterium
KRGFLAELDREVPSHLAG

SEQ ID NO: 829762 - protein, 26 aa, Mycobacterium
KRGGKVWINIFPDRPLTKKPAETRMG

SEQ ID NO: 829763 - protein, 26 aa, Mycobacterium
KRGKAIIILNPADPPMIMRDTIFCAI

SEQ ID NO: 829764 - protein, 22 aa, Mycobacterium
KRGLEVHVFYVGLDSADTCIER

SEQ ID NO: 829765 - protein, 23 aa, Mycobacterium
KRGQEGPFAKWLEHWHPDHDPFA

SEQ ID NO: 829766 - protein, 25 aa, Mycobacterium
KRGRAPDRLLLGLAVLTLVGEASRA

SEQ ID NO: 829767 - protein, 23 aa, Mycobacterium
KRGSCFAPFHWNDAHGPGLTINA

SEQ ID NO: 829768 - protein, 18 aa, Mycobacterium
KRGTQLRRWLPAGSPRCV

SEQ ID NO: 829769 - protein, 27 aa, Mycobacterium
KRHAGLSYLLVPLDQPGVEIRPINQLT

SEQ ID NO: 829770 - protein, 27 aa, Mycobacterium
KRHAGLSYLLVPLQQPGVEIRPIIQLT

SEQ ID NO: 829771 - protein, 23 aa, Mycobacterium
KRHALPHARILMHQPLGGVTGSA

SEQ ID NO: 829772 - protein, 29 aa, Mycobacterium
KRHHFSSFFVDYFITPLVAAVWSCAAGDA

SEQ ID NO: 829773 - protein, 29 aa, Mycobacterium
KRHHHELGWFARQSLRLFDDLRLEHGRLD

SEQ ID NO: 829774 - protein, 20 aa, Mycobacterium
KRHKQIDRPCLLGYIEKCSA

SEQ ID NO: 829775 - protein, 21 aa, Mycobacterium
KRHKQIERPCLLGYIDKCSAP

SEQ ID NO: 829776 - protein, 18 aa, Mycobacterium
KRHLVLFVGAGASAGAGL

SEQ ID NO: 829777 - protein, 25 aa, Mycobacterium
KRHNAMFAELRRWRLDQLPRIPNLD

SEQ ID NO: 829778 - protein, 26 aa, Mycobacterium
KRHNFLGAPFWVGRGFGLNLSVVTDP

SEQ ID NO: 829779 - protein, 19 aa, Mycobacterium
KRHQITRLGIARTFQNIRL

SEQ ID NO: 829780 - protein, 25 aa, Mycobacterium
KRIERGLWLTALLADTLTAVRGVAA

SEQ ID NO: 829781 - protein, 25 aa, Mycobacterium
KRIERGLWLTALLADTLTTVRGVVA

SEQ ID NO: 829782 - protein, 18 aa, Mycobacterium
KRIGCGFTSYRIRALLRR

SEQ ID NO: 829783 - protein, 21 aa, Mycobacterium
KRILELNPTHPLVVGLREAHE

SEQ ID NO: 829784 - protein, 18 aa, Mycobacterium
KRIPATVTTIPFYDSDKT

SEQ ID NO: 829785 - protein, 18 aa, Mycobacterium
KRIRLRVPLVSSAMDTVT

SEQ ID NO: 829786 - protein, 17 aa, Mycobacterium
KRIVERNQIWPVMAAKY

SEQ ID NO: 829787 - protein, 22 aa, Mycobacterium
KRKFREALDRKNSKAGSAADHK

SEQ ID NO: 829788 - protein, 17 aa, Mycobacterium
KRKLAAVWLSTDGNTSL

SEQ ID NO: 829789 - protein, 37 aa, Mycobacterium
KRKVASTLLESFLFYSGFYLPMYWSSRAKLTNTADMI

SEQ ID NO: 829790 - protein, 24 aa, Mycobacterium
KRKYDITMALLPYPRYRHAFEPGC

SEQ ID NO: 829791 - protein, 17 aa, Mycobacterium
KRLAAPGQRIVLYARDR

SEQ ID NO: 829792 - protein, 21 aa, Mycobacterium
KRLADALTDYPFAYLITVDDD

SEQ ID NO: 829793 - protein, 25 aa, Mycobacterium
KRLALNPFGRIFYQHARRAQLELDS

SEQ ID NO: 829794 - protein, 17 aa, Mycobacterium
KRLASPGQRIVLYAKDR

SEQ ID NO: 829795 - protein, 24 aa, Mycobacterium
KRLDAELHLVRSRGWSFVEGEYED

SEQ ID NO: 829796 - protein, 24 aa, Mycobacterium
KRLDTGSPWLLHNNPRGKYFDGDG

SEQ ID NO: 829797 - protein, 23 aa, Mycobacterium
KRLEFGLLGPLEMSIDGALVPTG

SEQ ID NO: 829798 - protein, 22 aa, Mycobacterium
KRLEFGLLGPLEMTIDGELVPL

SEQ ID NO: 829799 - protein, 25 aa, Mycobacterium
KRLGGYNWFGAVEPLSDAGPTGWRT

SEQ ID NO: 829800 - protein, 24 aa, Mycobacterium
KRLGLERQWLHARSLAFAHPADGR

SEQ ID NO: 829801 - protein, 29 aa, Mycobacterium
KRLGTVSPAVFWPIPRVYSGLVRIDRHAD

SEQ ID NO: 829802 - protein, 18 aa, Mycobacterium
KRLLAAVPVPDPEQQRIR

SEQ ID NO: 829803 - protein, 24 aa, Mycobacterium
KRLLAPRFVMPTNGTFTSGFGYRW

SEQ ID NO: 829804 - protein, 20 aa, Mycobacterium
KRLPVPLYPGFDTLGTLEYI

SEQ ID NO: 829805 - protein, 23 aa, Mycobacterium
KRLQVRWMTPVEYARLMGAGTYN

SEQ ID NO: 829806 - protein, 21 aa, Mycobacterium
KRLRLLQQHFFVSCSLQRVLH

SEQ ID NO: 829807 - protein, 18 aa, Mycobacterium
KRLTSCGRPTLFARTALL

SEQ ID NO: 829808 - protein, 23 aa, Mycobacterium
KRLTSCGRPTMFARTALLDPEGN

SEQ ID NO: 829809 - protein, 21 aa, Mycobacterium
KRLVDFAAGLAFALRGSFDKV

SEQ ID NO: 829810 - protein, 21 aa, Mycobacterium
KRLVPYTAAVMNRHGWRAEHC

SEQ ID NO: 829811 - protein, 23 aa, Mycobacterium
KRLVQEGAYVFITGRDRTRAEKA

SEQ ID NO: 829812 - protein, 30 aa, Mycobacterium
KRMAELQAMPGFRLNMDLAALGRAGHIMYR

SEQ ID NO: 829813 - protein, 24 aa, Mycobacterium
KRMEFYYFTETSLHGLRYGDWKVL

SEQ ID NO: 829814 - protein, 19 aa, Mycobacterium
KRMGAAVRAAQAIAPTHPH

SEQ ID NO: 829815 - protein, 20 aa, Mycobacterium
KRMVKAARSPILAAGQHVIT

SEQ ID NO: 829816 - protein, 21 aa, Mycobacterium
KRNQWLVVDNIPGGAPIPQEV

SEQ ID NO: 829817 - protein, 17 aa, Mycobacterium
KRNYGPTLAAYRFNEDR

SEQ ID NO: 829818 - protein, 24 aa, Mycobacterium
KRPAFNPTMRLAEDPVFQYRLGQL

SEQ ID NO: 829819 - protein, 23 aa, Mycobacterium
KRPAIAGPLLRPFFEAYQIVADA

SEQ ID NO: 829820 - protein, 25 aa, Mycobacterium
KRPDLGPIFMNALPVLMTEAVDVSN

SEQ ID NO: 829821 - protein, 25 aa, Mycobacterium
KRPEVAWWMLDFAFPGLKTRINKNV

SEQ ID NO: 829822 - protein, 17 aa, Mycobacterium
KRPLMADAMLRVFFEAY

SEQ ID NO: 829823 - protein, 25 aa, Mycobacterium
KRPLPAEWLNYAALDVELLIELRAA

SEQ ID NO: 829824 - protein, 21 aa, Mycobacterium
KRPLPLNMFAGIVGSAGTGKS

SEQ ID NO: 829825 - protein, 17 aa, Mycobacterium
KRPLSDALVHHLGTGDA

SEQ ID NO: 829826 - protein, 21 aa, Mycobacterium
KRPRYIELVTEFPLTDTQKIA

SEQ ID NO: 829827 - protein, 25 aa, Mycobacterium
KRPVGSRTLYYRIAKRRRDRCGAHT

SEQ ID NO: 829828 - protein, 19 aa, Mycobacterium
KRPWHVRHNYLLDAIDHRF

SEQ ID NO: 829829 - protein, 28 aa, Mycobacterium
KRQEDFIGIHFFSPVDKMPLVEIIKGEK

SEQ ID NO: 829830 - protein, 28 aa, Mycobacterium
KRQEDFIGIHFFSPVDKMPLVEIIRGEK

SEQ ID NO: 829831 - protein, 17 aa, Mycobacterium
KRQFRRAVLDRDAGTVI

SEQ ID NO: 829832 - protein, 23 aa, Mycobacterium
KRQHQFDRLSRRLAGHDHGVHRR

SEQ ID NO: 829833 - protein, 19 aa, Mycobacterium
KRQLDLSLFGPLRNPELVK

SEQ ID NO: 829834 - protein, 20 aa, Mycobacterium
KRQRRRDGRDAGRRRPPILS

SEQ ID NO: 829835 - protein, 21 aa, Mycobacterium
KRQRRRDGRDAGRRRPPILSE

SEQ ID NO: 829836 - protein, 20 aa, Mycobacterium
KRQRRRDGRDAGRRRPPVLT

SEQ ID NO: 829837 - protein, 25 aa, Mycobacterium
KRRCLHYHLGFPTPQREREIVGVRA

SEQ ID NO: 829838 - protein, 17 aa, Mycobacterium
KRRDRALLSKDATIREI

SEQ ID NO: 829839 - protein, 28 aa, Mycobacterium
KRREVVEPFLLCWKDIVGTLTSLAEGAD

SEQ ID NO: 829840 - protein, 19 aa, Mycobacterium
KRRGFRFVGPTTAYALMQA

SEQ ID NO: 829841 - protein, 31 aa, Mycobacterium
KRRLLQPATIALIADRLIPGGVLHAATDHPG

SEQ ID NO: 829842 - protein, 25 aa, Mycobacterium
KRRVPILGLCLGLQCMVIEAARSAG

SEQ ID NO: 829843 - protein, 19 aa, Mycobacterium
KRSIAVISILRQGDQTRVG

SEQ ID NO: 829844 - protein, 28 aa, Mycobacterium
KRSLATALPQLLPMLRGFNLITQLSESK

SEQ ID NO: 829845 - protein, 26 aa, Mycobacterium
KRSLNHWYRMFGPTFETSLGLEFLGF

SEQ ID NO: 829846 - protein, 23 aa, Mycobacterium
KRSLNHWYRMMGPTFETSVGLEF

SEQ ID NO: 829847 - protein, 29 aa, Mycobacterium
KRSNVVRFLAPLLAAIVTSAGCGALPTEV

SEQ ID NO: 829848 - protein, 22 aa, Mycobacterium
KRSPAAAPLPAPRRIEVGPDGY

SEQ ID NO: 829849 - protein, 18 aa, Mycobacterium
KRSPAYGMAKRREHRASQ

SEQ ID NO: 829850 - protein, 21 aa, Mycobacterium
KRSVPAALLPAMHLGLRMLAQ

SEQ ID NO: 829851 - protein, 19 aa, Mycobacterium
KRTAWLAEGILYALDADAA

SEQ ID NO: 829852 - protein, 25 aa, Mycobacterium
KRTGRAPLVLWAVGPVRLDDAVERA

SEQ ID NO: 829853 - protein, 27 aa, Mycobacterium
KRTKGQVWLMPHNPAFDPIPGNDAAIL

SEQ ID NO: 829854 - protein, 19 aa, Mycobacterium
KRTLLALERKRASANAALT

SEQ ID NO: 829855 - protein, 18 aa, Mycobacterium
KRTPITIYDQIGGYQAIE

SEQ ID NO: 829856 - protein, 22 aa, Mycobacterium
KRTQVSIERPPGQSSSPPGGDN

SEQ ID NO: 829857 - protein, 24 aa, Mycobacterium
KRTRLAFLELAAELAEGFPTAGAL

SEQ ID NO: 829858 - protein, 23 aa, Mycobacterium
KRTRLWPGLRETFKSGSADIPLQ

SEQ ID NO: 829859 - protein, 29 aa, Mycobacterium
KRTSGQVWLMPHNPLFEPIPGNDAAILGK

SEQ ID NO: 829860 - protein, 28 aa, Mycobacterium
KRTVGYKRAIWWAQYGAARLKYRLRTRA

SEQ ID NO: 829861 - protein, 25 aa, Mycobacterium
KRVAPQAYFLNFTNPAGIITEALQT

SEQ ID NO: 829862 - protein, 25 aa, Mycobacterium
KRVCRDCGFFLPLAGALGAMFGVCG

SEQ ID NO: 829863 - protein, 24 aa, Mycobacterium
KRVCRDCGFFLPLAGSLGAMFGVC

SEQ ID NO: 829864 - protein, 20 aa, Mycobacterium
KRVEVIDYYPDGRPHHVKAV

SEQ ID NO: 829865 - protein, 25 aa, Mycobacterium
KRVGWSHNVGPWIVFMQNVDAIVGP

SEQ ID NO: 829866 - protein, 21 aa, Mycobacterium
KRVLKLLQWGEPERPWRLKCP

SEQ ID NO: 829867 - protein, 17 aa, Mycobacterium
KRVLMMRSTFRKHRDRM

SEQ ID NO: 829868 - protein, 22 aa, Mycobacterium
KRVLRGLKALGRGVLRADLAVL

SEQ ID NO: 829869 - protein, 18 aa, Mycobacterium
KRVTALFDRVASHDRFRF

SEQ ID NO: 829870 - protein, 23 aa, Mycobacterium
KRVTFAAFPWRWVGGDGCIVRLV

SEQ ID NO: 829871 - protein, 21 aa, Mycobacterium
KRVTRLFDRVARHRRFRFYLN

SEQ ID NO: 829872 - protein, 24 aa, Mycobacterium
KRVYAVLNLYPYNPGHLMVVPYRR

SEQ ID NO: 829873 - protein, 19 aa, Mycobacterium
KRWHAIAEIIGRSWDDVLG

SEQ ID NO: 829874 - protein, 18 aa, Mycobacterium
KRWVDDIMPLLTDDDPLG

SEQ ID NO: 829875 - protein, 19 aa, Mycobacterium
KRWVDDIMPLLTDDDPLGV

SEQ ID NO: 829876 - protein, 20 aa, Mycobacterium
KRWVTECLRAAYPLGAGHGP

SEQ ID NO: 829877 - protein, 25 aa, Mycobacterium
KRWYDRVLRRFYRSIHLICGHQFDF

SEQ ID NO: 829878 - protein, 17 aa, Mycobacterium
KRYGVPVLSVHAPCLLI

SEQ ID NO: 829879 - protein, 28 aa, Mycobacterium
KRYTGRGMPLLDLIQEGNLGLIRAMEKF

SEQ ID NO: 829880 - protein, 25 aa, Mycobacterium
KSAASIALSWRLPVVFVVENIRDGS

SEQ ID NO: 829881 - protein, 26 aa, Mycobacterium
KSAEFLAELLGLPSPVTFGPFLVVAL

SEQ ID NO: 829882 - protein, 26 aa, Mycobacterium
KSALVAAVYLRFLRDLPLHTDVNETT

SEQ ID NO: 829883 - protein, 19 aa, Mycobacterium
KSAMIRYFESREAVLLELL

SEQ ID NO: 829884 - protein, 36 aa, Mycobacterium
KSANPHVLTISPPLNMNPRWLGAHPAYTLSKYGMTL

SEQ ID NO: 829885 - protein, 29 aa, Mycobacterium
KSAPFAFSAWAVRLLSRLPQRAVVALATN

SEQ ID NO: 829886 - protein, 24 aa, Mycobacterium
KSAPMIARIPLGRFAVPHEVSDAV

SEQ ID NO: 829887 - protein, 26 aa, Mycobacterium
KSARPQRLPLSHSQLAAWFQYRIEGA

SEQ ID NO: 829888 - protein, 25 aa, Mycobacterium
KSAYHALTFGWLMSGLARAVTGKSM

SEQ ID NO: 829889 - protein, 23 aa, Mycobacterium
KSDIPLLATMYQSGQLLLDEMIT

SEQ ID NO: 829890 - protein, 18 aa, Mycobacterium
KSDKVFIYLISHENVEAQ

SEQ ID NO: 829891 - protein, 22 aa, Mycobacterium
KSDLRFASTFTWNTLPLPAVPT

SEQ ID NO: 829892 - protein, 25 aa, Mycobacterium
KSDRAKHLVLFDFSLAKASAATISA

SEQ ID NO: 829893 - protein, 21 aa, Mycobacterium
KSDSVFAFLAAHRSQLFPGEM

SEQ ID NO: 829894 - protein, 26 aa, Mycobacterium
KSDVLAGLFAVWDSLDALLDGLPEAD

SEQ ID NO: 829895 - protein, 25 aa, Mycobacterium
KSEALIAGLRRLLDGSPGVMFVTDT

SEQ ID NO: 829896 - protein, 20 aa, Mycobacterium
KSELPSTLRRSDAKAQRTFA

SEQ ID NO: 829897 - protein, 29 aa, Mycobacterium
KSEPEWMLDIRLKALRTFDKKPMPNWGSD

SEQ ID NO: 829898 - protein, 32 aa, Mycobacterium
KSEPEWMLQARLKALRIFERKPMPTWGSNLEG

SEQ ID NO: 829899 - protein, 20 aa, Mycobacterium
KSERVTAAAVRRARSGRPSG

SEQ ID NO: 829900 - protein, 21 aa, Mycobacterium
KSFAVTMWPVVRKAIDFVIDL

SEQ ID NO: 829901 - protein, 22 aa, Mycobacterium
KSFDEFLAVYAPTSGPLRLGQW

SEQ ID NO: 829902 - protein, 17 aa, Mycobacterium
KSFGVVHVLHDVDFRVY

SEQ ID NO: 829903 - protein, 21 aa, Mycobacterium
KSFVWPHQTLAAAAARVTGRP

SEQ ID NO: 829904 - protein, 20 aa, Mycobacterium
KSFYEGKIAAASFFAKNMLP

SEQ ID NO: 829905 - protein, 20 aa, Mycobacterium
KSFYQTVFGFDVLREHTDGD

SEQ ID NO: 829906 - protein, 21 aa, Mycobacterium
KSGAAYLPIDPGLPAERIGFM

SEQ ID NO: 829907 - protein, 21 aa, Mycobacterium
KSGALLFDPIREALKNYAGLD

SEQ ID NO: 829908 - protein, 24 aa, Mycobacterium
KSGFLPEERAWVSGLLASGWVDAV

SEQ ID NO: 829909 - protein, 33 aa, Mycobacterium
KSGLNRAILSKGWHQFALVLSSAARYTGTNVVK

SEQ ID NO: 829910 - protein, 41 aa, Mycobacterium
KSGQNPHILTLSPPVLLGKEWLKPTAYMMAKFGMTLCALGI

SEQ ID NO: 829911 - protein, 28 aa, Mycobacterium
KSGQPVPRLIWFYFDGADLTVYSMPKAA

SEQ ID NO: 829912 - protein, 28 aa, Mycobacterium
KSGRDSMFQAILPLRGKIINVEKARIDR

SEQ ID NO: 829913 - protein, 29 aa, Mycobacterium
KSGRPRLAPLVYLRIDGKMFIVGSFAGAD

SEQ ID NO: 829914 - protein, 22 aa, Mycobacterium
KSHGWGVPGLTWMPGEDPDPFG

SEQ ID NO: 829915 - protein, 20 aa, Mycobacterium
KSHIGRIFVKLDLRDRAAAI

SEQ ID NO: 829916 - protein, 20 aa, Mycobacterium
KSHPLYGKIIRTTTKVKAHD

SEQ ID NO: 829917 - protein, 18 aa, Mycobacterium
KSHTALLSARRVLTTYPV

SEQ ID NO: 829918 - protein, 30 aa, Mycobacterium
KSIHIKDALTPTLLFPFAAPRVGGDLSEAG

SEQ ID NO: 829919 - protein, 17 aa, Mycobacterium
KSIIFMDPPEHRHMRSL

SEQ ID NO: 829920 - protein, 27 aa, Mycobacterium
KSILELLSHLRDEYALSIILITHEMEV

SEQ ID NO: 829921 - protein, 18 aa, Mycobacterium
KSIPFYRDYYRDEADPPA

SEQ ID NO: 829922 - protein, 23 aa, Mycobacterium
KSISLRLGVPWYAYDTTVFTGEV

SEQ ID NO: 829923 - protein, 22 aa, Mycobacterium
KSISNAPYPAALDAAIMGASDP

SEQ ID NO: 829924 - protein, 34 aa, Mycobacterium
KSIVYGGGPMYVESLRKAIAAFGPIFAQIYGQGE

SEQ ID NO: 829925 - protein, 17 aa, Mycobacterium
KSKAFYSALFGWTLQEA

SEQ ID NO: 829926 - protein, 24 aa, Mycobacterium
KSKDTLIGEVYLRLLHDADTFVDV

SEQ ID NO: 829927 - protein, 22 aa, Mycobacterium
KSKKPLVTLGNKFSPTTTAGDK

SEQ ID NO: 829928 - protein, 28 aa, Mycobacterium
KSLAAGQPIPLLWMHKADDPRNYVGDVI

SEQ ID NO: 829929 - protein, 30 aa, Mycobacterium
KSLAGHDIAWPKVHLFWGDERYVPENDDER

SEQ ID NO: 829930 - protein, 28 aa, Mycobacterium
KSLAPGLRLAWMVLPADIVPDVLDAKGI

SEQ ID NO: 829931 - protein, 33 aa, Mycobacterium
KSLDIHPIRRTIQHADLLVVRRGEKVVVEVRVV

SEQ ID NO: 829932 - protein, 31 aa, Mycobacterium
KSLEAQLDQCWDLLRQRRALRAGGGDPDSAT

SEQ ID NO: 829933 - protein, 20 aa, Mycobacterium
KSLIDLRGEPPIWTGAAMAD

SEQ ID NO: 829934 - protein, 17 aa, Mycobacterium
KSLLIVDRLSGRSRFSM

SEQ ID NO: 829935 - protein, 19 aa, Mycobacterium
KSLMAVARKDVVLSAGWDE

SEQ ID NO: 829936 - protein, 25 aa, Mycobacterium
KSLNQRTILRLLDPSITAAGVLRAE

SEQ ID NO: 829937 - protein, 25 aa, Mycobacterium
KSLPGLLVVLRDGGYRTNEILRWLF

SEQ ID NO: 829938 - protein, 21 aa, Mycobacterium
KSLPPKWFYDAVGSDLFDQIT

SEQ ID NO: 829939 - protein, 19 aa, Mycobacterium
KSLPPKWFYDEAGSDLFDE

SEQ ID NO: 829940 - protein, 22 aa, Mycobacterium
KSLPPKWFYDSVGSDLFDQITR

SEQ ID NO: 829941 - protein, 17 aa, Mycobacterium
KSLRMFAVLPTIVASDM

SEQ ID NO: 829942 - protein, 24 aa, Mycobacterium
KSLSIPVLLIRGKLSDVVSPEGVR

SEQ ID NO: 829943 - protein, 25 aa, Mycobacterium
KSLTQRTILRLLDPSITAAGVLRAE

SEQ ID NO: 829944 - protein, 27 aa, Mycobacterium
KSLVDKGYFAPAWPVEFGGQSRNAWDD

SEQ ID NO: 829945 - protein, 23 aa, Mycobacterium
KSMGDRRWALFKSEVALSARANP

SEQ ID NO: 829946 - protein, 36 aa, Mycobacterium
KSMPVPMLTFRLWRPLSHDTMEVWSWFLVEKDADEE

SEQ ID NO: 829947 - protein, 24 aa, Mycobacterium
KSNGIIHSMPYWDSIFNEIAAEYP

SEQ ID NO: 829948 - protein, 23 aa, Mycobacterium
KSNLYRALRLLADSARNGAVAAL

SEQ ID NO: 829949 - protein, 22 aa, Mycobacterium
KSPAVFYRYFSDKEDLLAALAE

SEQ ID NO: 829950 - protein, 33 aa, Mycobacterium
KSPDLKLTPMTLVARMVLLALRSHPSLNSAWDE

SEQ ID NO: 829951 - protein, 17 aa, Mycobacterium
KSPEWAAPISGLDAAEL

SEQ ID NO: 829952 - protein, 18 aa, Mycobacterium
KSPFGERPVRFWFRRQAQ

SEQ ID NO: 829953 - protein, 24 aa, Mycobacterium
KSPIFSTDLLTPPLERATADTPEE

SEQ ID NO: 829954 - protein, 30 aa, Mycobacterium
KSPLVARAWRAPLQFLFIDGGHSEDAANQD

SEQ ID NO: 829955 - protein, 26 aa, Mycobacterium
KSPQAIRMLKFAFNLIDDGLVGQQVF

SEQ ID NO: 829956 - protein, 24 aa, Mycobacterium
KSPVLLFETGLPTRYYIDPTDVVF

SEQ ID NO: 829957 - protein, 25 aa, Mycobacterium
KSPYFGDRRKAFLQDLAAVTGAEVV

SEQ ID NO: 829958 - protein, 17 aa, Mycobacterium
KSQAKRLRMVLMGMFSM

SEQ ID NO: 829959 - protein, 30 aa, Mycobacterium
KSQGLFLEQSILRNAGIAALRPLRVNPMKA

SEQ ID NO: 829960 - protein, 24 aa, Mycobacterium
KSQMAAGLMRRLAGEEIDVYSAGT

SEQ ID NO: 829961 - protein, 21 aa, Mycobacterium
KSQPWILAYEDANVDVGLAAG

SEQ ID NO: 829962 - protein, 17 aa, Mycobacterium
KSRHYSTTMGALRGARA

SEQ ID NO: 829963 - protein, 24 aa, Mycobacterium
KSRIDAARLLVWRAGWMARNNQQF

SEQ ID NO: 829964 - protein, 24 aa, Mycobacterium
KSRIDAARLLVWRAGWMARNNQSF

SEQ ID NO: 829965 - protein, 25 aa, Mycobacterium
KSRIDAARLLVWRAGWMARNNQSFD

SEQ ID NO: 829966 - protein, 18 aa, Mycobacterium
KSRILSDLGWRRCPRRKP

SEQ ID NO: 829967 - protein, 24 aa, Mycobacterium
KSRMALMAHLLKRGYRHLGEVLHE

SEQ ID NO: 829968 - protein, 27 aa, Mycobacterium
KSRNVNPIYNWPLPRLAVNIVGSDHGG

SEQ ID NO: 829969 - protein, 30 aa, Mycobacterium
KSRRERVVPLDFLVVQLFDVYEFERMRVTG

SEQ ID NO: 829970 - protein, 26 aa, Mycobacterium
KSRRQRVVPLDFLVVQAFDVYEFERM

SEQ ID NO: 829971 - protein, 23 aa, Mycobacterium
KSRSTLLVQLPRLEGYGEIPRVK

SEQ ID NO: 829972 - protein, 17 aa, Mycobacterium
KSRYLTTQYQRSAPERP

SEQ ID NO: 829973 - protein, 24 aa, Mycobacterium
KSSLDHFGPVRLTSPRVVLASNRV

SEQ ID NO: 829974 - protein, 26 aa, Mycobacterium
KSSLLDAISLGFLPFNRRNFNASGDN

SEQ ID NO: 829975 - protein, 21 aa, Mycobacterium
KSSLRTAIRGLREAIAEGDKE

SEQ ID NO: 829976 - protein, 19 aa, Mycobacterium
KSSRPPTAVITMVCEHAGQ

SEQ ID NO: 829977 - protein, 21 aa, Mycobacterium
KSTFMRLLLAEENPSSGDIRV

SEQ ID NO: 829978 - protein, 25 aa, Mycobacterium
KSTFVELTLAPLLTGSAFVNADEIA

SEQ ID NO: 829979 - protein, 24 aa, Mycobacterium
KSTGLPWVLSARSAPALANQVQRL

SEQ ID NO: 829980 - protein, 23 aa, Mycobacterium
KSTIAAALALTLAAGGRKVLLVE

SEQ ID NO: 829981 - protein, 26 aa, Mycobacterium
KSTIALGILHRLAATVPKVGVFRPIT

SEQ ID NO: 829982 - protein, 22 aa, Mycobacterium
KSTLAHMVLGLLAPSSGTVVFD

SEQ ID NO: 829983 - protein, 24 aa, Mycobacterium
KSTLARLFNGLVLPDTGSVRVHGI

SEQ ID NO: 829984 - protein, 23 aa, Mycobacterium
KSTLARMVLGLLPPTAGTVVFDG

SEQ ID NO: 829985 - protein, 21 aa, Mycobacterium
KSTLFNIITGLVPPTAGSVLV

SEQ ID NO: 829986 - protein, 25 aa, Mycobacterium
KSTLGLDFLRSCSIKHRLASVIFSL

SEQ ID NO: 829987 - protein, 24 aa, Mycobacterium
KSTLGLDFLRSCSIKHRMASVIFS

SEQ ID NO: 829988 - protein, 25 aa, Mycobacterium
KSTLLALVAGLLRPDQGRVSVGGTV

SEQ ID NO: 829989 - protein, 26 aa, Mycobacterium
KSTLLDRWWHASYVNDPMGFSIELLF

SEQ ID NO: 829990 - protein, 17 aa, Mycobacterium
KSTLLLEVAHRWAQSGQ

SEQ ID NO: 829991 - protein, 20 aa, Mycobacterium
KSTLLRLLSGIYEPTRGLAK

SEQ ID NO: 829992 - protein, 20 aa, Mycobacterium
KSTLLRLLSGIYEPTRGWAK

SEQ ID NO: 829993 - protein, 17 aa, Mycobacterium
KSTLLVCDTWDIADALN

SEQ ID NO: 829994 - protein, 25 aa, Mycobacterium
KSTVDAPLVWRKRLLRKAIDFGGPL

SEQ ID NO: 829995 - protein, 19 aa, Mycobacterium
KSVALTRNVLLPVGTDYTP

SEQ ID NO: 829996 - protein, 37 aa, Mycobacterium
KSVDGAVDFLLLDGWKDLYLPVIELLEPRLSMGALVI

SEQ ID NO: 829997 - protein, 27 aa, Mycobacterium
KSVEEALDILRWAPQAASEPVAKVIAS

SEQ ID NO: 829998 - protein, 25 aa, Mycobacterium
KSVEVYPVEYPASLAFATAADGVID

SEQ ID NO: 829999 - protein, 20 aa, Mycobacterium
KSVFLKSLIGLLRPEHGSIV

SEQ ID NO: 830000 - protein, 18 aa, Mycobacterium
KSVHRILRNFKMPGFTVP

SEQ ID NO: 830001 - protein, 27 aa, Mycobacterium
KSVNDAIDILRWAPQAASEPVAKVIAS

SEQ ID NO: 830002 - protein, 24 aa, Mycobacterium
KSVQVTLNGYQWLTGIRIENGLLK

SEQ ID NO: 830003 - protein, 25 aa, Mycobacterium
KSVRTSLISFYDWAIDADLVSMNPA

SEQ ID NO: 830004 - protein, 21 aa, Mycobacterium
KSVSDLFAPITAKVIAANGDL

SEQ ID NO: 830005 - protein, 20 aa, Mycobacterium
KSVSTLWAIAPRAVATVVEE

SEQ ID NO: 830006 - protein, 28 aa, Mycobacterium
KSVTHLAAWLLRGLRRLGVTVPDAPPKN

SEQ ID NO: 830007 - protein, 18 aa, Mycobacterium
KSVWFQRGPLDEAIRASI

SEQ ID NO: 830008 - protein, 17 aa, Mycobacterium
KSWAAFIATRRNHHAAA

SEQ ID NO: 830009 - protein, 22 aa, Mycobacterium
KSWHVSPALASALWLKCNVLAE

SEQ ID NO: 830010 - protein, 17 aa, Mycobacterium
KSWLPAMAEGSFKMAFA

SEQ ID NO: 830011 - protein, 21 aa, Mycobacterium
KSWVEDLLDMHLLEGYGSTEA

SEQ ID NO: 830012 - protein, 23 aa, Mycobacterium
KTAAEWVELLQQGGLMACLAYTW

SEQ ID NO: 830013 - protein, 20 aa, Mycobacterium
KTAAFAIPILSKIDVTSTAT

SEQ ID NO: 830014 - protein, 23 aa, Mycobacterium
KTAAQWVELLHEGGLMACLAYTW

SEQ ID NO: 830015 - protein, 23 aa, Mycobacterium
KTADEWVRLLQDGGLMACHAYTW

SEQ ID NO: 830016 - protein, 19 aa, Mycobacterium
KTAGVDESIWTFSGPAVVV

SEQ ID NO: 830017 - protein, 29 aa, Mycobacterium
KTAKLHWVELYTGPITWQLRDRAAILSMI

SEQ ID NO: 830018 - protein, 24 aa, Mycobacterium
KTAKTFPVIDGVRYAIPGDRARHR

SEQ ID NO: 830019 - protein, 18 aa, Mycobacterium
KTALLSRDRIGQAKGIIM

SEQ ID NO: 830020 - protein, 26 aa, Mycobacterium
KTALWELIWAGWVTGDTFAPVRAVLG

SEQ ID NO: 830021 - protein, 32 aa, Mycobacterium
KTAPRLPDGTPFPTLYYLTHPELTAAASRFET

SEQ ID NO: 830022 - protein, 26 aa, Mycobacterium
KTASQVLLRWNLQLGNAVVFRSAKEE

SEQ ID NO: 830023 - protein, 20 aa, Mycobacterium
KTAVLTRRIAYLIAARGVAV

SEQ ID NO: 830024 - protein, 20 aa, Mycobacterium
KTAVLTRRIAYLIAARGVGV

SEQ ID NO: 830025 - protein, 21 aa, Mycobacterium
KTAVLTRRIAYLIAARGVGVG

SEQ ID NO: 830026 - protein, 31 aa, Mycobacterium
KTAVLTRRIAYLLAARDVGVGQVLAITFTNK

SEQ ID NO: 830027 - protein, 28 aa, Mycobacterium
KTAVLTRRIAYLLAARDVSPGQILAITF

SEQ ID NO: 830028 - protein, 19 aa, Mycobacterium
KTCAPWLDAEWRLVSHDVR

SEQ ID NO: 830029 - protein, 20 aa, Mycobacterium
KTDGYFWGDNAPRDPRIRNL

SEQ ID NO: 830030 - protein, 31 aa, Mycobacterium
KTDVFSEEFLLTRPLLTAIKRTDPTVLLIDE

SEQ ID NO: 830031 - protein, 17 aa, Mycobacterium
KTEHLWLKDVPGHCLQQ

SEQ ID NO: 830032 - protein, 20 aa, Mycobacterium
KTEIWILVSPTMINKGVRGR

SEQ ID NO: 830033 - protein, 20 aa, Mycobacterium
KTESPTLGGFIRLLADLPED

SEQ ID NO: 830034 - protein, 24 aa, Mycobacterium
KTFQRFAENLVFNGAPRLARHVQN

SEQ ID NO: 830035 - protein, 24 aa, Mycobacterium
KTFTSAAVIARLVNRHHWRIGVVA

SEQ ID NO: 830036 - protein, 17 aa, Mycobacterium
KTFYLLDTFAGIDPRFV

SEQ ID NO: 830037 - protein, 17 aa, Mycobacterium
KTFYLLDTFAGLDPRYV

SEQ ID NO: 830038 - protein, 22 aa, Mycobacterium
KTGAAYLPIDPALPAARMEFML

SEQ ID NO: 830039 - protein, 21 aa, Mycobacterium
KTGAAYVPLDPSWPPQRAELV

SEQ ID NO: 830040 - protein, 27 aa, Mycobacterium
KTGARPRVLLLPLGPLAEHNIRATFAS

SEQ ID NO: 830041 - protein, 24 aa, Mycobacterium
KTGDPELLSLLRRRIKPLVKRRTK

SEQ ID NO: 830042 - protein, 24 aa, Mycobacterium
KTGDVLLRYNFPAAGLTDDALRTL

SEQ ID NO: 830043 - protein, 25 aa, Mycobacterium
KTGDVMLRYNFPGGGLTDDALRTLI

SEQ ID NO: 830044 - protein, 31 aa, Mycobacterium
KTGGAQTFFMPLWMLAVALGKWLPSPSDVVR

SEQ ID NO: 830045 - protein, 22 aa, Mycobacterium
KTGGPVLLTLSRPPARLCNESP

SEQ ID NO: 830046 - protein, 17 aa, Mycobacterium
KTGHPFLQHLLAHRDVT

SEQ ID NO: 830047 - protein, 39 aa, Mycobacterium
KTGLPPYRMPWYQRVMANLLPLALKGPVLWVAALIGEEI

SEQ ID NO: 830048 - protein, 22 aa, Mycobacterium
KTGLTGYACLTGKTRLTGKTRL

SEQ ID NO: 830049 - protein, 26 aa, Mycobacterium
KTGMDVCLWLLRNGVTPEKLTWIMPR

SEQ ID NO: 830050 - protein, 23 aa, Mycobacterium
KTGQWYLHHFYKHQPDLNIANPQ

SEQ ID NO: 830051 - protein, 20 aa, Mycobacterium
KTGVLAKYVKLVGSAAIGAV

SEQ ID NO: 830052 - protein, 25 aa, Mycobacterium
KTHALELLVIVSFVRGLSVRDVEAT

SEQ ID NO: 830053 - protein, 29 aa, Mycobacterium
KTHGASGLAFCTILYGLSLIDDVTDTPFS

SEQ ID NO: 830054 - protein, 18 aa, Mycobacterium
KTHPGLLHPIEPPSLLSI

SEQ ID NO: 830055 - protein, 17 aa, Mycobacterium
KTHPLTVRLGERPTLMF

SEQ ID NO: 830056 - protein, 20 aa, Mycobacterium
KTHQGAAELMRPIARKYDLK

SEQ ID NO: 830057 - protein, 20 aa, Mycobacterium
KTHQGTAELIRPIARKYDLK

SEQ ID NO: 830058 - protein, 21 aa, Mycobacterium
KTHVSVPPPLRFTAQAAQMLP

SEQ ID NO: 830059 - protein, 30 aa, Mycobacterium
KTIAEVVDRFGWTGPLGVTYPGVVTHGIVQ

SEQ ID NO: 830060 - protein, 28 aa, Mycobacterium
KTIFWNGPMGVFEFPAFAAGTRGVAEAI

SEQ ID NO: 830061 - protein, 28 aa, Mycobacterium
KTKAKERGLWNLFLPAESGLTNLEYAPL

SEQ ID NO: 830062 - protein, 20 aa, Mycobacterium
KTKVFAAAAAGAPVPARPTA

SEQ ID NO: 830063 - protein, 27 aa, Mycobacterium
KTLASRQPCHWLNPGPYTAGQPLVQGM

SEQ ID NO: 830064 - protein, 32 aa, Mycobacterium
KTLDLGYMESVIWAFRQLWDKGLAYEGYRVLP

SEQ ID NO: 830065 - protein, 34 aa, Mycobacterium; identical to SEQ ID NO: 120885

SEQ ID NO: 830066 - protein, 24 aa, Mycobacterium
KTLDLTFMESVIWAFKQLWDKGLA

SEQ ID NO: 830067 - protein, 34 aa, Mycobacterium
KTLEDFFVLGHIMTALPPIHAIPAVVAAAPGIAT

SEQ ID NO: 830068 - protein, 21 aa, Mycobacterium
KTLGVPLFQEQLMQLAVDVAG

SEQ ID NO: 830069 - protein, 21 aa, Mycobacterium
KTLHSVKVIPGRGAWLEFDVD

SEQ ID NO: 830070 - protein, 21 aa, Mycobacterium
KTLHSVKVIPSRGAWLEFDVD

SEQ ID NO: 830071 - protein, 27 aa, Mycobacterium
KTLIRNNALKLLRARRFPQARFVSSDI

SEQ ID NO: 830072 - protein, 21 aa, Mycobacterium
KTLKAVAVKAPFFGDRRKAFL

SEQ ID NO: 830073 - protein, 29 aa, Mycobacterium
KTLNLNFFVHDPFTLEPYSRDPRNIARKA

SEQ ID NO: 830074 - protein, 28 aa, Mycobacterium
KTLNLNFFVHDPFTLEPYSRDPRNVARK

SEQ ID NO: 830075 - protein, 19 aa, Mycobacterium
KTLPASGMAILRALARRPG

SEQ ID NO: 830076 - protein, 19 aa, Mycobacterium
KTLPAVWDLAAPSTVLAVR

SEQ ID NO: 830077 - protein, 19 aa, Mycobacterium
KTLQLIAEQLSAAGVPVLM

SEQ ID NO: 830078 - protein, 22 aa, Mycobacterium
KTLQTSLFFLGNSGYLPTGFAP

SEQ ID NO: 830079 - protein, 20 aa, Mycobacterium
KTLRHWETPLHGYEIHHGQV

SEQ ID NO: 830080 - protein, 23 aa, Mycobacterium
KTLTAVLPSYLNALSGKGVHVVT

SEQ ID NO: 830081 - protein, 26 aa, Mycobacterium
KTLTSVLPAYLNALTGKGVHIVTVNE

SEQ ID NO: 830082 - protein, 20 aa, Mycobacterium
KTLVELFGLARELNIEAEGI

SEQ ID NO: 830083 - protein, 27 aa, Mycobacterium
KTLVKFELLADPNVPLPGFVLKRAVKG

SEQ ID NO: 830084 - protein, 18 aa, Mycobacterium
KTLWAHRITVESGEFVEG

SEQ ID NO: 830085 - protein, 17 aa, Mycobacterium
KTLWLQLGLRHDEVVRD

SEQ ID NO: 830086 - protein, 24 aa, Mycobacterium
KTLYLARWLHPGQRAFQLATQIAL

SEQ ID NO: 830087 - protein, 22 aa, Mycobacterium
KTLYLARWLHPGQRAFQLATQV

SEQ ID NO: 830088 - protein, 24 aa, Mycobacterium
KTMPTLVTAIMTKSLRAGKVFLDW

SEQ ID NO: 830089 - protein, 17 aa, Mycobacterium
KTMVVTGLHLLGGARAD

SEQ ID NO: 830090 - protein, 29 aa, Mycobacterium
KTNGWIGHRALWIPSLLLHTVGAKTGKRR

SEQ ID NO: 830091 - protein, 20 aa, Mycobacterium
KTNWVIALPPGQTGLLRPVI

SEQ ID NO: 830092 - protein, 26 aa, Mycobacterium
KTPAQLILRWHIELGHVVIPKTCSPQ

SEQ ID NO: 830093 - protein, 26 aa, Mycobacterium
KTPAQVLIRWHIQLGNIVIPKSVNPE

SEQ ID NO: 830094 - protein, 26 aa, Mycobacterium
KTPARRVRYPMWLAAKMSTLANSRAA

SEQ ID NO: 830095 - protein, 23 aa, Mycobacterium
KTPASFIAFDLLALGDTDLTGRP

SEQ ID NO: 830096 - protein, 34 aa, Mycobacterium
KTPAVQRWLINHPRFILHFTPTSSSWLNLVERWF

SEQ ID NO: 830097 - protein, 21 aa, Mycobacterium
KTPMTDWVPDDIFQTALGRAA

SEQ ID NO: 830098 - protein, 26 aa, Mycobacterium
KTPPGHLWRWELTPISGTRTLVTHTY

SEQ ID NO: 830099 - protein, 19 aa, Mycobacterium
KTQAFLKKLIDDATADAAD

SEQ ID NO: 830100 - protein, 21 aa, Mycobacterium
KTQIGGSWYPWAKGVVPHGGE

SEQ ID NO: 830101 - protein, 21 aa, Mycobacterium
KTQLDLIGWSLGGTLSLLTAA

SEQ ID NO: 830102 - protein, 25 aa, Mycobacterium
KTQRRRWNVKPWPWPGDSREDKAKR

SEQ ID NO: 830103 - protein, 18 aa, Mycobacterium
KTQSNGLVLFLHGGGFVL

SEQ ID NO: 830104 - protein, 21 aa, Mycobacterium
KTQTFFPWDSWDHPNPDPAMP

SEQ ID NO: 830105 - protein, 21 aa, Mycobacterium
KTQTYFPWETWDHPATTVPKV

SEQ ID NO: 830106 - protein, 27 aa, Mycobacterium
KTRDNRFIAFVLLQADRFWADFCTRLG

SEQ ID NO: 830107 - protein, 23 aa, Mycobacterium
KTRFVEHMGSLLQRPVVTISCHD

SEQ ID NO: 830108 - protein, 35 aa, Mycobacterium
KTRGFPLGPGYLLDGRPVILTAPRRPAPVTPKRTA

SEQ ID NO: 830109 - protein, 18 aa, Mycobacterium
KTRGWMHTFFADHSKTPV

SEQ ID NO: 830110 - protein, 29 aa, Mycobacterium
KTRLLLDALRDRGALRRFVPFDVDAGILS

SEQ ID NO: 830111 - protein, 21 aa, Mycobacterium
KTRLLRGLTGMLDEWTPVIAG

SEQ ID NO: 830112 - protein, 23 aa, Mycobacterium
KTRNIALDSGWHTWRCQWDETGM

SEQ ID NO: 830113 - protein, 24 aa, Mycobacterium
KTRPEAIYRTLTALYGQMAEGVLP

SEQ ID NO: 830114 - protein, 24 aa, Mycobacterium
KTRQAVLAVADWLRDESWPAPDRE

SEQ ID NO: 830115 - protein, 23 aa, Mycobacterium
KTRQILLVTFKRSGEAMPSPINH

SEQ ID NO: 830116 - protein, 25 aa, Mycobacterium
KTRSGILRFVVLDGLAKPGRLEGPD

SEQ ID NO: 830117 - protein, 25 aa, Mycobacterium
KTSAAYMLGLLLQSESVAVADLGMA

SEQ ID NO: 830118 - protein, 26 aa, Mycobacterium
KTSAAYMLGLLLQSESVELADLGMAL

SEQ ID NO: 830119 - protein, 23 aa, Mycobacterium
KTSLLKVLLGQLSLSAGVALVGG

SEQ ID NO: 830120 - protein, 17 aa, Mycobacterium
KTSMGWSLPAELIGPAL

SEQ ID NO: 830121 - protein, 20 aa, Mycobacterium
KTSRPVPLTLNVRPPARLCN

SEQ ID NO: 830122 - protein, 23 aa, Mycobacterium
KTSTHLFQPLLYQVATGILSEGD

SEQ ID NO: 830123 - protein, 30 aa, Mycobacterium
KTSVCRIIDALLMALHRRTGRTTSPHLQSA

SEQ ID NO: 830124 - protein, 21 aa, Mycobacterium
KTTCFNAITGVYRPSSGSVTF

SEQ ID NO: 830125 - protein, 21 aa, Mycobacterium
KTTCFNAITGVYRPTSGSVTF

SEQ ID NO: 830126 - protein, 27 aa, Mycobacterium
KTTDGMIRIMVFYGEVLALAYTGQFDL

SEQ ID NO: 830127 - protein, 23 aa, Mycobacterium
KTTILRLLMTLERVTDGVIWVDG

SEQ ID NO: 830128 - protein, 22 aa, Mycobacterium
KTTLADWNRTLAVNLTGTFLMT

SEQ ID NO: 830129 - protein, 18 aa, Mycobacterium
KTTLLRLVAGFENPDAGT

SEQ ID NO: 830130 - protein, 25 aa, Mycobacterium
KTTTTERILYYTGINYKIGEVHDGA

SEQ ID NO: 830131 - protein, 21 aa, Mycobacterium
KTTTTYLVEAGLRAAGKRVGL

SEQ ID NO: 830132 - protein, 21 aa, Mycobacterium
KTTYAKARLFWERSESTVEGF

SEQ ID NO: 830133 - protein, 22 aa, Mycobacterium
KTTYPVWMMNAIGDITFHHGVT

SEQ ID NO: 830134 - protein, 33 aa, Mycobacterium
KTVANRAKLNWWESRALYGWTVLVPRTKDQAGE

SEQ ID NO: 830135 - protein, 24 aa, Mycobacterium
KTVDPITDLFPLRGAIVGANRVAE

SEQ ID NO: 830136 - protein, 24 aa, Mycobacterium
KTVDVMLRYNFPGAGLTDNALRTL

SEQ ID NO: 830137 - protein, 20 aa, Mycobacterium
KTVFMVLRDPAADMSLSVTC

SEQ ID NO: 830138 - protein, 20 aa, Mycobacterium
KTVFMVLRDPAADMSLTVTC

SEQ ID NO: 830139 - protein, 18 aa, Mycobacterium
KTVFVFPGQGGQYPGMAA

SEQ ID NO: 830140 - protein, 17 aa, Mycobacterium
KTVFVFPGQGSQWLGMG

SEQ ID NO: 830141 - protein, 28 aa, Mycobacterium
KTVFWNGPMGVFEFPAFAAGTRGVAEAI

SEQ ID NO: 830142 - protein, 22 aa, Mycobacterium
KTVHHYLMRFSGGELSDEDLEV

SEQ ID NO: 830143 - protein, 20 aa, Mycobacterium
KTVIDTLVLATGFNLWESTF

SEQ ID NO: 830144 - protein, 20 aa, Mycobacterium
KTVLALHHEMLPPTAGVRTL

SEQ ID NO: 830145 - protein, 23 aa, Mycobacterium
KTVPNWLWNSTAAAKKAFLQALF

SEQ ID NO: 830146 - protein, 25 aa, Mycobacterium
KTVPPQWLPGPRELRAWTLAAGTPE

SEQ ID NO: 830147 - protein, 24 aa, Mycobacterium
KTVPPRWLPGPRELRAWTLAAGHP

SEQ ID NO: 830148 - protein, 17 aa, Mycobacterium
KTVRGHLDGIIRMVESD

SEQ ID NO: 830149 - protein, 29 aa, Mycobacterium
KTVVALHRVAYLLYTYRKQMERHGVLVVG

SEQ ID NO: 830150 - protein, 20 aa, Mycobacterium
KTVVHRLLRRYRLELARPGY

SEQ ID NO: 830151 - protein, 17 aa, Mycobacterium
KTWEFQALMKARAAVGD

SEQ ID NO: 830152 - protein, 33 aa, Mycobacterium
KTYRFNPFDLTKVWPHRDYPLIDVGKLTLDRNV

SEQ ID NO: 830153 - protein, 27 aa, Mycobacterium
KTYVAVEAIFGLRSLWDRIRHADVPVA

SEQ ID NO: 830154 - protein, 18 aa, Mycobacterium
KTYYLPSEGRRITLRVST

SEQ ID NO: 830155 - protein, 27 aa, Mycobacterium
KVAADIVPLIQTWLPALTSSMSRVAGI

SEQ ID NO: 830156 - protein, 25 aa, Mycobacterium
KVADVMLRYNFPAAGLTDDALRTLI

SEQ ID NO: 830157 - protein, 26 aa, Mycobacterium
KVAELTRLWWQEAERNRVLPLLGGLA

SEQ ID NO: 830158 - protein, 23 aa, Mycobacterium
KVAEQMRIMAAFGAAADSFRKEH

SEQ ID NO: 830159 - protein, 27 aa, Mycobacterium
KVAFKSFLLSDVPNFAYMFGYTNSSWT

SEQ ID NO: 830160 - protein, 19 aa, Mycobacterium
KVAFPGRMLAERFGLAPSD

SEQ ID NO: 830161 - protein, 37 aa, Mycobacterium
KVAGHWWLHTATAHLDLDWWLSFSSAASMLGSPGQGA

SEQ ID NO: 830162 - protein, 18 aa, Mycobacterium
KVAHAPLVALLTELMEAA

SEQ ID NO: 830163 - protein, 24 aa, Mycobacterium
KVAIARDYLLPRQRDRAALSDDEV

SEQ ID NO: 830164 - protein, 26 aa, Mycobacterium
KVALITDALVYWRPDLLSDDAPDTGA

SEQ ID NO: 830165 - protein, 25 aa, Mycobacterium
KVALNTGFDRDIVDALLASLGWDGD

SEQ ID NO: 830166 - protein, 18 aa, Mycobacterium
KVALPLHPEYRTMPMVWY

SEQ ID NO: 830167 - protein, 36 aa, Mycobacterium
KVANAGPPWFAVSPLMHAAGLWTAFSGLLSGQTVVL

SEQ ID NO: 830168 - protein, 20 aa, Mycobacterium
KVARELKYSSPQTDFQRLQQ

SEQ ID NO: 830169 - protein, 25 aa, Mycobacterium
KVARIKFPTPAACGRIPLVAKGLSK

SEQ ID NO: 830170 - protein, 24 aa, Mycobacterium
KVARIKFPTPAACGRVPLVAKGLT

SEQ ID NO: 830171 - protein, 24 aa, Mycobacterium
KVARIKFPTPAACGRVPLVVKGLS

SEQ ID NO: 830172 - protein, 17 aa, Mycobacterium
KVARLLGLGYPGGRVLD

SEQ ID NO: 830173 - protein, 23 aa, Mycobacterium
KVARLMEWCAMIGCPIIGIQDSG

SEQ ID NO: 830174 - protein, 20 aa, Mycobacterium
KVARLMEWCAMVGCPIVGIQ

SEQ ID NO: 830175 - protein, 19 aa, Mycobacterium
KVARLMEWCSMVGCPIIGI

SEQ ID NO: 830176 - protein, 19 aa, Mycobacterium
KVARRFAHLTYRGEIELDS

SEQ ID NO: 830177 - protein, 23 aa, Mycobacterium
KVARSLVVYLKRAGGQSQFSVMV

SEQ ID NO: 830178 - protein, 26 aa, Mycobacterium
KVASGRKLPWFGPPMSAASMATARLM

SEQ ID NO: 830179 - protein, 18 aa, Mycobacterium
KVASGVRMLIVPGSMRVR

SEQ ID NO: 830180 - protein, 17 aa, Mycobacterium
KVATKVFLLSPADVDVT

SEQ ID NO: 830181 - protein, 27 aa, Mycobacterium
KVAVITFRQHEAGLLLPPTSSAHIAGR

SEQ ID NO: 830182 - protein, 20 aa, Mycobacterium
KVAVLPLDSDWVRVAKRFPA

SEQ ID NO: 830183 - protein, 26 aa, Mycobacterium
KVAYPIARWINIGQLIFSYQASRKFP

SEQ ID NO: 830184 - protein, 18 aa, Mycobacterium
KVCEIRRGNGVFGPLPGP

SEQ ID NO: 830185 - protein, 29 aa, Mycobacterium
KVCGSTAWTFCIYGIHNWLAGLFPEQLQD

SEQ ID NO: 830186 - protein, 20 aa, Mycobacterium
KVDDALWKRYSAARDTFNRR

SEQ ID NO: 830187 - protein, 33 aa, Mycobacterium
KVDDPLSMYLFDLCTLPLNLAGHCGMSVPSGLS

SEQ ID NO: 830188 - protein, 23 aa, Mycobacterium
KVDGQWREVSWDAAFRRCTELLT

SEQ ID NO: 830189 - protein, 23 aa, Mycobacterium
KVDIAAVNPWMLRMAGEVADGVH

SEQ ID NO: 830190 - protein, 18 aa, Mycobacterium
KVDISAVNPWMLRMAGEV

SEQ ID NO: 830191 - protein, 20 aa, Mycobacterium
KVDPVKLNLTLSAAAQSLAG

SEQ ID NO: 830192 - protein, 19 aa, Mycobacterium
KVDRAAFLQARQARRAAAA

SEQ ID NO: 830193 - protein, 24 aa, Mycobacterium
KVDSFGVRLRQGDIVLPGSCTRAI

SEQ ID NO: 830194 - protein, 25 aa, Mycobacterium
KVDTRISVVGLNNTITYKDGEPKVD

SEQ ID NO: 830195 - protein, 18 aa, Mycobacterium
KVDWAFGELLALGSLVAE

SEQ ID NO: 830196 - protein, 19 aa, Mycobacterium
KVEALLQMAAYVETLTAAG

SEQ ID NO: 830197 - protein, 22 aa, Mycobacterium
KVEALWVGPVWRPATVIAQRGG

SEQ ID NO: 830198 - protein, 24 aa, Mycobacterium
KVEGFGVRLRKGDLVLPGSCTRAI

SEQ ID NO: 830199 - protein, 33 aa, Mycobacterium
KVESLRTEWWQSCLLPVNWKLATAAFMEGYHVP

SEQ ID NO: 830200 - protein, 25 aa, Mycobacterium
KVESQYLAQLYAAIGIRASDAAQQL

SEQ ID NO: 830201 - protein, 24 aa, Mycobacterium
KVESQYLAQLYATIGIRASDAAQQ

SEQ ID NO: 830202 - protein, 22 aa, Mycobacterium
KVEVLARRLLTAMCAAVLTITL

SEQ ID NO: 830203 - protein, 20 aa, Mycobacterium
KVEVLERLAEPYAGREKEIG

SEQ ID NO: 830204 - protein, 21 aa, Mycobacterium
KVFGQPIMPAAGFAEIALAAG

SEQ ID NO: 830205 - protein, 21 aa, Mycobacterium
KVFIPVTHLCRDKCHYCTFVT

SEQ ID NO: 830206 - protein, 25 aa, Mycobacterium
KVFPDARLIWAHRDPYRATGSLCNL

SEQ ID NO: 830207 - protein, 21 aa, Mycobacterium
KVFSLELFLCASPEFIRELPE

SEQ ID NO: 830208 - protein, 21 aa, Mycobacterium
KVFTRGIITWGIRDARRLAAW

SEQ ID NO: 830209 - protein, 22 aa, Mycobacterium
KVGARPVLYTLGKLDVPAELKA

SEQ ID NO: 830210 - protein, 19 aa, Mycobacterium
KVGLGSVRYLLAVGDLLIG

SEQ ID NO: 830211 - protein, 57 aa, Mycobacterium
KVGPFALQDFSLFHVLRFGFRPSKIAFLAWHAWHDSELGTWPPGFPHDKRPSYSLSE

SEQ ID NO: 830212 - protein, 18 aa, Mycobacterium
KVGPLGPDWIRTTDIASI

SEQ ID NO: 830213 - protein, 47 aa, Mycobacterium
KVGPYALQDFSLFQVLRFGFRPSKVAFLAWHAWHDVGAGDWPPGFPE

SEQ ID NO: 830214 - protein, 23 aa, Mycobacterium
KVGQYVKWGLNHLVFHAPGHDQR

SEQ ID NO: 830215 - protein, 23 aa, Mycobacterium
KVGQYVTWGLNHLVFHAPGHDQL

SEQ ID NO: 830216 - protein, 30 aa, Mycobacterium
KVHDAATYRWPMVPALALLAAMPALGSAER

SEQ ID NO: 830217 - protein, 28 aa, Mycobacterium
KVHDGYEWMYVLAGNLRLLLGELDLILP

SEQ ID NO: 830218 - protein, 23 aa, Mycobacterium
KVHDTIFYCVANMPGAVPRTSTF

SEQ ID NO: 830219 - protein, 17 aa, Mycobacterium
KVHKLRHYLPIYQHALA

SEQ ID NO: 830220 - protein, 27 aa, Mycobacterium
KVHPVLRLPEPPSVWRLAAGDAGTLED

SEQ ID NO: 830221 - protein, 18 aa, Mycobacterium
KVHYIDFVGTYFSVKGPS

SEQ ID NO: 830222 - protein, 19 aa, Mycobacterium
KVIAAVHPGLWQPGVLAKL

SEQ ID NO: 830223 - protein, 21 aa, Mycobacterium
KVIAYARKFLDDSVPLAAGSY

SEQ ID NO: 830224 - protein, 25 aa, Mycobacterium
KVIAYARNFLDQAVPLESGSWADAT

SEQ ID NO: 830225 - protein, 24 aa, Mycobacterium
KVIAYARRFLDGAAPLASGSWTDI

SEQ ID NO: 830226 - protein, 25 aa, Mycobacterium
KVIDRTALILDIFAQHATSREGKAQ

SEQ ID NO: 830227 - protein, 18 aa, Mycobacterium
KVIELAPAPNLPAELRDR

SEQ ID NO: 830228 - protein, 18 aa, Mycobacterium
KVIELAPAPNLPGELRDK

SEQ ID NO: 830229 - protein, 19 aa, Mycobacterium
KVIGVNLKGPFRLSASIAT

SEQ ID NO: 830230 - protein, 18 aa, Mycobacterium
KVIKINLIGTFNVVRLGA

SEQ ID NO: 830231 - protein, 20 aa, Mycobacterium
KVILDDVTLSFYPGAKIGVV

SEQ ID NO: 830232 - protein, 19 aa, Mycobacterium
KVILSLENELLPQHLHFQN

SEQ ID NO: 830233 - protein, 25 aa, Mycobacterium
KVIPDLIEWWAQRDGVRPDKSRNRK

SEQ ID NO: 830234 - protein, 19 aa, Mycobacterium
KVIPDLIEWWCERDGVRPD

SEQ ID NO: 830235 - protein, 18 aa, Mycobacterium
KVIPGLIEWWCERAKVRP

SEQ ID NO: 830236 - protein, 28 aa, Mycobacterium
KVIQVNLIGTFNVLRLAAERMAKQEPIN

SEQ ID NO: 830237 - protein, 19 aa, Mycobacterium
KVKEVAGAVAGRDDLMREG

SEQ ID NO: 830238 - protein, 18 aa, Mycobacterium
KVKIGMPVRATYIDFPAG

SEQ ID NO: 830239 - protein, 26 aa, Mycobacterium
KVKLDRYLFTSFGYPTDYGYIEDTLG

SEQ ID NO: 830240 - protein, 17 aa, Mycobacterium
KVKLVNNALFAGQVGLL

SEQ ID NO: 830241 - protein, 23 aa, Mycobacterium
KVKSGVRLIVTPASQQVYLDAVA

SEQ ID NO: 830242 - protein, 17 aa, Mycobacterium
KVKSPFGTPGMPGMPGM

SEQ ID NO: 830243 - protein, 26 aa, Mycobacterium
KVKWSAPLGFLAQTPPAVTPAGLIVS

SEQ ID NO: 830244 - protein, 19 aa, Mycobacterium
KVLAKLRNGPAVALRKTKQ

SEQ ID NO: 830245 - protein, 26 aa, Mycobacterium
KVLDALVRLTGAGYQQLFGPVMGRMM

SEQ ID NO: 830246 - protein, 26 aa, Mycobacterium
KVLGADILVLGTPTWLGHMSSVAQRV

SEQ ID NO: 830247 - protein, 19 aa, Mycobacterium
KVLHVTALVERTAQIVWGA

SEQ ID NO: 830248 - protein, 27 aa, Mycobacterium
KVLITIENAIWPDLFIAGGGISRKADK

SEQ ID NO: 830249 - protein, 17 aa, Mycobacterium
KVLRARPRLARRYLMLE

SEQ ID NO: 830250 - protein, 34 aa, Mycobacterium
KVLRGRLHKLDPFRFQLVDIPFKFHHPMWRENCD

SEQ ID NO: 830251 - protein, 22 aa, Mycobacterium
KVLRQLQGSEFVQRGLQLGLEA

SEQ ID NO: 830252 - protein, 25 aa, Mycobacterium
KVLRRFAAILDERHNFLKKLVMAES

SEQ ID NO: 830253 - protein, 20 aa, Mycobacterium
KVLRSTGLCLLVPDQHHRQV

SEQ ID NO: 830254 - protein, 18 aa, Mycobacterium
KVLTREAGVPLLRQDGRG

SEQ ID NO: 830255 - protein, 26 aa, Mycobacterium
KVMATPSTLATLRRGTEARLITAMIV

SEQ ID NO: 830256 - protein, 17 aa, Mycobacterium
KVMPIISSLLNQYPHLL

SEQ ID NO: 830257 - protein, 20 aa, Mycobacterium
KVMPIISSLLNYYPHLLALS

SEQ ID NO: 830258 - protein, 29 aa, Mycobacterium
KVNAALVTTLLIHGFGCRTIVFSGVAGGL

SEQ ID NO: 830259 - protein, 18 aa, Mycobacterium
KVNALLPVGFTRMVENMP

SEQ ID NO: 830260 - protein, 21 aa, Mycobacterium
KVNRLLLNNIDVVGVGWGAWT

SEQ ID NO: 830261 - protein, 22 aa, Mycobacterium
KVNTEHILLVDAFVARDAERAV

SEQ ID NO: 830262 - protein, 19 aa, Mycobacterium
KVPADFLVVEPFERNVTGK

SEQ ID NO: 830263 - protein, 18 aa, Mycobacterium
KVPGAVVVVSIFVNPLQF

SEQ ID NO: 830264 - protein, 21 aa, Mycobacterium
KVPGPIWKVLSAPLNAYARLV

SEQ ID NO: 830265 - protein, 17 aa, Mycobacterium
KVPGWRDMLTRMGVVEG

SEQ ID NO: 830266 - protein, 19 aa, Mycobacterium
KVPHVLRILDAPQLSARMA

SEQ ID NO: 830267 - protein, 17 aa, Mycobacterium
KVPIVVLVGEPIEPTLG

SEQ ID NO: 830268 - protein, 26 aa, Mycobacterium
KVPLRIVHVMQWPPGSATWSEIPAPT

SEQ ID NO: 830269 - protein, 19 aa, Mycobacterium
KVPRERWAQRRDQLLARVG

SEQ ID NO: 830270 - protein, 24 aa, Mycobacterium
KVPTPRQLWAFYRAIRAFAKSRPD

SEQ ID NO: 830271 - protein, 17 aa, Mycobacterium
KVPVRWWHGDSDHIVPF

SEQ ID NO: 830272 - protein, 34 aa, Mycobacterium
KVQHAGPPWFAVSPLMHAAGMWTAFAALLNGQTV

SEQ ID NO: 830273 - protein, 20 aa, Mycobacterium
KVQTWDIYACVRQALAVLDP

SEQ ID NO: 830274 - protein, 32 aa, Mycobacterium
KVQVRKLKNLGLTLSLPVGYRLSPRGAEYLAR

SEQ ID NO: 830275 - protein, 26 aa, Mycobacterium
KVRAPADLLAGYYRAVHKLSLEYVAS

SEQ ID NO: 830276 - protein, 23 aa, Mycobacterium
KVRAPDGFQLPHPPRDTREFHTS

SEQ ID NO: 830277 - protein, 18 aa, Mycobacterium
KVRAQLRDEIRRVQLEVG

SEQ ID NO: 830278 - protein, 18 aa, Mycobacterium
KVRCPILFCVCQTDSVAP

SEQ ID NO: 830279 - protein, 18 aa, Mycobacterium
KVRDLLPRIIEKVQATGH

SEQ ID NO: 830280 - protein, 17 aa, Mycobacterium
KVRGDKLAYRFLDFSTE

SEQ ID NO: 830281 - protein, 19 aa, Mycobacterium
KVRNPLGAAGLPGGFPDLS

SEQ ID NO: 830282 - protein, 23 aa, Mycobacterium
KVRPGVDVLFLDTGYHFAETIGT

SEQ ID NO: 830283 - protein, 18 aa, Mycobacterium
KVRPGVDVLFLDTGYHFV

SEQ ID NO: 830284 - protein, 24 aa, Mycobacterium
KVRPGVPVIFLDTGYHFAETIGTR

SEQ ID NO: 830285 - protein, 24 aa, Mycobacterium
KVRPGVPVVFLDTGYHFAETIGTR

SEQ ID NO: 830286 - protein, 24 aa, Mycobacterium
KVRPGVPVVFLDTGYHFVETIGTR

SEQ ID NO: 830287 - protein, 19 aa, Mycobacterium
KVRPLLPCDDPFYQAPAGY

SEQ ID NO: 830288 - protein, 17 aa, Mycobacterium
KVRRIRRLAAIWLAAQD

SEQ ID NO: 830289 - protein, 20 aa, Mycobacterium
KVRRVRLLPDHPPATRQAVD

SEQ ID NO: 830290 - protein, 25 aa, Mycobacterium
KVRYDKERIALPVRLALATGRLDIR

SEQ ID NO: 830291 - protein, 23 aa, Mycobacterium
KVSAMRVLQAKLLERKRLEERAE

SEQ ID NO: 830292 - protein, 23 aa, Mycobacterium
KVSCAGLVLGSWPAHPGLVESSN

SEQ ID NO: 830293 - protein, 25 aa, Mycobacterium
KVSDNQLFYLMSRGLTEDEAMAMVV

SEQ ID NO: 830294 - protein, 24 aa, Mycobacterium
KVSEDQLFYLMSRGLTEDEAMAMV

SEQ ID NO: 830295 - protein, 24 aa, Mycobacterium
KVSEDQMFYLMSRGLTEDEAMAMV

SEQ ID NO: 830296 - protein, 25 aa, Mycobacterium
KVSEHLKWIQLDEFAPLKSPQHVAA

SEQ ID NO: 830297 - protein, 25 aa, Mycobacterium
KVSENQLFYLMSRGLTEDEAMAMVV

SEQ ID NO: 830298 - protein, 29 aa, Mycobacterium
KVSGGGQPWFAVSPLMHAAGMWTAFSALC

SEQ ID NO: 830299 - protein, 21 aa, Mycobacterium
KVSGQPLLFKGEAFRLTDVAA

SEQ ID NO: 830300 - protein, 25 aa, Mycobacterium
KVSGTAPIYAILRDAKDRAQAAGAQ

SEQ ID NO: 830301 - protein, 17 aa, Mycobacterium
KVSGTLKQGIDSEHAKK

SEQ ID NO: 830302 - protein, 28 aa, Mycobacterium
KVSIPEEVAWRLGWIDDEQLARHARSLT

SEQ ID NO: 830303 - protein, 17 aa, Mycobacterium
KVSPATRVLVLSASDER

SEQ ID NO: 830304 - protein, 23 aa, Mycobacterium
KVSPWELLDIRERHWRPRAATVS

SEQ ID NO: 830305 - protein, 17 aa, Mycobacterium
KVSQLKPVFRPNGTVTA

SEQ ID NO: 830306 - protein, 23 aa, Mycobacterium
KVSRATFYFYFASKFSVVSGLLE

SEQ ID NO: 830307 - protein, 23 aa, Mycobacterium
KVSTLPLGVPQPRMVRIFREFAP

SEQ ID NO: 830308 - protein, 18 aa, Mycobacterium
KVTFGDYFITFDPPKHTA

SEQ ID NO: 830309 - protein, 20 aa, Mycobacterium
KVTKMMFDWAIGVGIKVSQA

SEQ ID NO: 830310 - protein, 30 aa, Mycobacterium
KVTKRGGGAALPFKRRLFGQIVAAAVRGVE

SEQ ID NO: 830311 - protein, 29 aa, Mycobacterium
KVTKRGGGAALPFKRRLFGRIVAAAVRAA

SEQ ID NO: 830312 - protein, 17 aa, Mycobacterium
KVTLAKMVPLDQIDHLV

SEQ ID NO: 830313 - protein, 22 aa, Mycobacterium
KVTLLRYIVSEDVGPMINPAIV

SEQ ID NO: 830314 - protein, 21 aa, Mycobacterium
KVTPMDFMRDTLLWAKLIDKY

SEQ ID NO: 830315 - protein, 23 aa, Mycobacterium
KVTPMDFMRDTLLWAKLIDKYGG

SEQ ID NO: 830316 - protein, 26 aa, Mycobacterium
KVTQGGLFPIAYTVGTDFRLAKRQPL

SEQ ID NO: 830317 - protein, 23 aa, Mycobacterium
KVTREYYFNDHGAQIDRFVRSLI

SEQ ID NO: 830318 - protein, 25 aa, Mycobacterium
KVTRRLVGMLARRGYNQSMAYDVVS

SEQ ID NO: 830319 - protein, 25 aa, Mycobacterium
KVTRRLVGMLARRGYSQNLACEVVI

SEQ ID NO: 830320 - protein, 17 aa, Mycobacterium
KVTVIARGPRLLRAQDE

SEQ ID NO: 830321 - protein, 34 aa, Mycobacterium
KVVDVAAAKWWRKPLVRRWYGFAEMQKKVARQIP

SEQ ID NO: 830322 - protein, 19 aa, Mycobacterium
KVVEFPPAPEVIKYPEEKS

SEQ ID NO: 830323 - protein, 28 aa, Mycobacterium
KVVEVNLIGTFNVIRLSAERIAKTEPIG

SEQ ID NO: 830324 - protein, 28 aa, Mycobacterium
KVVGQLMHTLPIGWVEPEDIANAVLFLA

SEQ ID NO: 830325 - protein, 24 aa, Mycobacterium
KVVGTKVPLLGQVPLDPAVREGGD

SEQ ID NO: 830326 - protein, 24 aa, Mycobacterium
KVVIQEWIEGIPLSHIIREGTQEQ

SEQ ID NO: 830327 - protein, 24 aa, Mycobacterium
KVVKGGRRFSFTALVIVGDGHGLV

SEQ ID NO: 830328 - protein, 24 aa, Mycobacterium
KVVKGGRRFSFTALVIVGDGKGMV

SEQ ID NO: 830329 - protein, 23 aa, Mycobacterium
KVVKGGRRFSFTALVIVGDGNGM

SEQ ID NO: 830330 - protein, 24 aa, Mycobacterium
KVVNAPTQMLLGRSLIADGANATV

SEQ ID NO: 830331 - protein, 20 aa, Mycobacterium
KVVPLTNALKGYSAWVTGIR

SEQ ID NO: 830332 - protein, 30 aa, Mycobacterium
KVVPPQVLGYRELCAPAKGLRPRVSRRFRR

SEQ ID NO: 830333 - protein, 26 aa, Mycobacterium
KVVQWVPDRYWPAHSTIALTVGQATS

SEQ ID NO: 830334 - protein, 17 aa, Mycobacterium
KVVRRFLKLPADTKTVL

SEQ ID NO: 830335 - protein, 25 aa, Mycobacterium
KVVSWYDNEWGYSNRLIDLVALVGK

SEQ ID NO: 830336 - protein, 24 aa, Mycobacterium
KVVSWYDNEWGYSNRLVDLVALVG

SEQ ID NO: 830337 - protein, 25 aa, Mycobacterium
KVVVFRPLYAVGGQDLGYLPGSESE

SEQ ID NO: 830338 - protein, 17 aa, Mycobacterium
KVVVLGGGSWGTTVASI

SEQ ID NO: 830339 - protein, 31 aa, Mycobacterium
KVVVPEMNLGQLALLLRGRFLVDVQSVTKVE

SEQ ID NO: 830340 - protein, 31 aa, Mycobacterium
KVVVPEMNLGQLALLLRGRYLVDVQSVTKVE

SEQ ID NO: 830341 - protein, 17 aa, Mycobacterium
KVVYEKTACLIAAAGRF

SEQ ID NO: 830342 - protein, 22 aa, Mycobacterium
KVWEPHLKLLTKILTSCARAGL

SEQ ID NO: 830343 - protein, 18 aa, Mycobacterium
KVWGLYMAASRVAFEHNN

SEQ ID NO: 830344 - protein, 17 aa, Mycobacterium
KVWGLYMAASRVAFERN

SEQ ID NO: 830345 - protein, 27 aa, Mycobacterium
KVWTSGAHLAHAFIALARTAPVDPANR

SEQ ID NO: 830346 - protein, 17 aa, Mycobacterium
KVWYLRILADERSAADV

SEQ ID NO: 830347 - protein, 18 aa, Mycobacterium
KVYAPFESGLPGPTGRVY

SEQ ID NO: 830348 - protein, 22 aa, Mycobacterium
KWAASISGYWRRGRTEETFRQW

SEQ ID NO: 830349 - protein, 19 aa, Mycobacterium
KWDFATGDMFNFGLAMFPT

SEQ ID NO: 830350 - protein, 23 aa, Mycobacterium
KWEHTAAIKWPPPVTFSQLRELV

SEQ ID NO: 830351 - protein, 18 aa, Mycobacterium
KWELEDLSFAILHPKKYD

SEQ ID NO: 830352 - protein, 19 aa, Mycobacterium
KWELEDLSFAILHPKKYDE

SEQ ID NO: 830353 - protein, 26 aa, Mycobacterium
KWEPKRFRFRLLAVAGRIIRTGRRRR

SEQ ID NO: 830354 - protein, 30 aa, Mycobacterium
KWEPQHLIQPLRNLLLAAVFEWGIGLHDYY

SEQ ID NO: 830355 - protein, 25 aa, Mycobacterium
KWGGPIFEWARIPEVLRLAFREMHN

SEQ ID NO: 830356 - protein, 21 aa, Mycobacterium
KWGLGYDVLSARNPGIILVRV

SEQ ID NO: 830357 - protein, 36 aa, Mycobacterium
KWHRQRVIEPFDVDAYRQFITDIGYLLPEPEDFTIT

SEQ ID NO: 830358 - protein, 28 aa, Mycobacterium
KWLATSLELPWRRPIASLNYLLSSHVWR

SEQ ID NO: 830359 - protein, 17 aa, Mycobacterium
KWLFDKLLGPRPHWSER

SEQ ID NO: 830360 - protein, 28 aa, Mycobacterium
KWLKVTNHIPWRRPIASLNYLLSSHVWR

SEQ ID NO: 830361 - protein, 24 aa, Mycobacterium
KWLTANAVIGFFPANAVGSGIEDI

SEQ ID NO: 830362 - protein, 29 aa, Mycobacterium
KWNYLRRNYKVLLCYGDPAWFSATLGAWS

SEQ ID NO: 830363 - protein, 19 aa, Mycobacterium
KWRAHPADVLPLWVAEMDV

SEQ ID NO: 830364 - protein, 24 aa, Mycobacterium
KWREIFGADNYFLELMDHGLSIER

SEQ ID NO: 830365 - protein, 20 aa, Mycobacterium
KWRKWLEFDCNWKVALEAFN

SEQ ID NO: 830366 - protein, 19 aa, Mycobacterium
KWSLYPMGGSAVRLPRQIP

SEQ ID NO: 830367 - protein, 29 aa, Mycobacterium
KWTAALIGPWWPASATILRAAAQHWIAWM

SEQ ID NO: 830368 - protein, 18 aa, Mycobacterium
KWTAQFEHTLLVTDTGAE

SEQ ID NO: 830369 - protein, 20 aa, Mycobacterium
KWTILQPSMYAQVVLAMFGP

SEQ ID NO: 830370 - protein, 17 aa, Mycobacterium
KWVDIEMLVVAGARERT

SEQ ID NO: 830371 - protein, 19 aa, Mycobacterium
KWVRMPGVHFGPETCTYRG

SEQ ID NO: 830372 - protein, 24 aa, Mycobacterium
KYAASLLGLPIGAYPHSRPPQAEL

SEQ ID NO: 830373 - protein, 25 aa, Mycobacterium
KYAETFSGPLPLPPSKHVAVVACMD

SEQ ID NO: 830374 - protein, 23 aa, Mycobacterium
KYAQRLMDWLHPDGEFSDAERAR

SEQ ID NO: 830375 - protein, 25 aa, Mycobacterium
KYCIDILTQISAINSALRSVALNLL

SEQ ID NO: 830376 - protein, 20 aa, Mycobacterium
KYCIDVLTQISAVNSALQSV

SEQ ID NO: 830377 - protein, 23 aa, Mycobacterium
KYDHSWFILNQKIIKKEFALSGS

SEQ ID NO: 830378 - protein, 30 aa, Mycobacterium
KYDITGTALATLLILKSKYAKKHETSAEVL

SEQ ID NO: 830379 - protein, 26 aa, Mycobacterium
KYDLKRPLLDPALGAALYAAKHIGHP

SEQ ID NO: 830380 - protein, 23 aa, Mycobacterium
KYEAVDILRKWEVPCAPVMSMKE

SEQ ID NO: 830381 - protein, 17 aa, Mycobacterium
KYFAALQRLVRPGGKVA

SEQ ID NO: 830382 - protein, 17 aa, Mycobacterium
KYFDDYFRRAAGAGVRQ

SEQ ID NO: 830383 - protein, 20 aa, Mycobacterium
KYFDKVDVTVIPPFTDIRSV

SEQ ID NO: 830384 - protein, 24 aa, Mycobacterium
KYFDKVDVTVIPPFTDLRSVQTLV

SEQ ID NO: 830385 - protein, 19 aa, Mycobacterium
KYFDQELIAWRAESGQLTV

SEQ ID NO: 830386 - protein, 24 aa, Mycobacterium
KYFDRVDVTVIPPFTDLRSVQTLV

SEQ ID NO: 830387 - protein, 17 aa, Mycobacterium
KYFPRPEGERRIMRHKS

SEQ ID NO: 830388 - protein, 29 aa, Mycobacterium
KYGGRDAPLLHWVVFEEEYFRAGAPGRAS

SEQ ID NO: 830389 - protein, 32 aa, Mycobacterium
KYGLAPDDVIPFLKTLPAYTALRVRGLMTIAV

SEQ ID NO: 830390 - protein, 30 aa, Mycobacterium
KYGMASLQLYLLSSGFPFLPLSHHIIKNSA

SEQ ID NO: 830391 - protein, 20 aa, Mycobacterium
KYGNKLSWADLIVFAGNHAM

SEQ ID NO: 830392 - protein, 18 aa, Mycobacterium
KYGPQEWPRGMRVIARRE

SEQ ID NO: 830393 - protein, 26 aa, Mycobacterium
KYGRRHSDLLILPAATFVLGDTDAEA

SEQ ID NO: 830394 - protein, 30 aa, Mycobacterium
KYGVTIYYTAPTLIRTFMKWGREIPDAHDL

SEQ ID NO: 830395 - protein, 25 aa, Mycobacterium
KYHDLQWTWREYLAEAAARAAGLIA

SEQ ID NO: 830396 - protein, 21 aa, Mycobacterium
KYHGLQWTWRQYLAESAARAA

SEQ ID NO: 830397 - protein, 18 aa, Mycobacterium
KYIFGGILDRHPGLRVGW

SEQ ID NO: 830398 - protein, 21 aa, Mycobacterium
KYISHFPSTRTIWSYGSGYGG

SEQ ID NO: 830399 - protein, 22 aa, Mycobacterium
KYKALMAQRVPLYRRVSTIRVD

SEQ ID NO: 830400 - protein, 24 aa, Mycobacterium
KYKGACIFLNRPGFPTGIGCALHS

SEQ ID NO: 830401 - protein, 25 aa, Mycobacterium
KYKGACIFLNRPGWPKGIGCALHSK

SEQ ID NO: 830402 - protein, 24 aa, Mycobacterium
KYKRALMELLPQATIIEGYGSSET

SEQ ID NO: 830403 - protein, 19 aa, Mycobacterium
KYLRATSRLLALTAAAQEK

SEQ ID NO: 830404 - protein, 26 aa, Mycobacterium
KYLRMPHDRLVVRQLTFGYTYEELNL

SEQ ID NO: 830405 - protein, 17 aa, Mycobacterium
KYLTGCAKAFRTGYIDV

SEQ ID NO: 830406 - protein, 22 aa, Mycobacterium
KYLVRVVVSLMYWPGEDDDAER

SEQ ID NO: 830407 - protein, 17 aa, Mycobacterium
KYLWLTLEGSSGAQALV

SEQ ID NO: 830408 - protein, 18 aa, Mycobacterium
KYMASALDGYAAAAAAVQ

SEQ ID NO: 830409 - protein, 22 aa, Mycobacterium
KYPDLRTFMIPRSDLEVIDTWF

SEQ ID NO: 830410 - protein, 22 aa, Mycobacterium
KYPDRLTVVHWLESLQGLPSAT

SEQ ID NO: 830411 - protein, 22 aa, Mycobacterium
KYPDTNWRWEYSPESYTGTELS

SEQ ID NO: 830412 - protein, 22 aa, Mycobacterium
KYPGTQWRFEYSPESYTGTELE

SEQ ID NO: 830413 - protein, 23 aa, Mycobacterium
KYPGTQWRFEYSPESYTGTELEY

SEQ ID NO: 830414 - protein, 23 aa, Mycobacterium
KYPIPALLEVRGEVFFRLEDFEA

SEQ ID NO: 830415 - protein, 28 aa, Mycobacterium
KYPYEDWAAQWLALRPAADVGERRGDPD

SEQ ID NO: 830416 - protein, 19 aa, Mycobacterium
KYQFGDIDGFWAAVLHRTA

SEQ ID NO: 830417 - protein, 18 aa, Mycobacterium
KYRDTVRDYWRGEPATLD

SEQ ID NO: 830418 - protein, 19 aa, Mycobacterium
KYRMSGFWDTALDSILRNL

SEQ ID NO: 830419 - protein, 25 aa, Mycobacterium
KYRNSYVFAAELFPRMAIPQSWYDA

SEQ ID NO: 830420 - protein, 35 aa, Mycobacterium
KYSDQLVDWLVGAGYTHCFFVAGGNIMHLLNSVRT

SEQ ID NO: 830421 - protein, 25 aa, Mycobacterium
KYSQGGLFPIAYTKGTDFKKAKRLP

SEQ ID NO: 830422 - protein, 20 aa, Mycobacterium
KYSWAKSPRYAVPGLGNVPL

SEQ ID NO: 830423 - protein, 20 aa, Mycobacterium
KYVEYNLIPSLFTEHAFYFG

SEQ ID NO: 830424 - protein, 18 aa, Mycobacterium
KYVGAYLAVLGHTDVISF

SEQ ID NO: 830425 - protein, 17 aa, Mycobacterium
KYVHLGNHTLHGTRPPR

SEQ ID NO: 830426 - protein, 20 aa, Mycobacterium
KYVRSRSLLAAKAFGKQALD

SEQ ID NO: 830427 - protein, 19 aa, Mycobacterium
KYVSTWNAAFLPSEDLQEA

SEQ ID NO: 830428 - protein, 19 aa, Mycobacterium
KYVVIYDLPVTFDSAQVMP

SEQ ID NO: 830429 - protein, 18 aa, Mycobacterium
KYWVPTRTEALLAALRSF

SEQ ID NO: 830430 - protein, 25 aa, Mycobacterium
KYYDKVDVTVIPPFTDLRSVQTLVD

SEQ ID NO: 830431 - protein, 22 aa, Mycobacterium
KYYDKVDVTVLPPFTDLRSVQT

SEQ ID NO: 830432 - protein, 24 aa, Mycobacterium
KYYDKVDVTVLPPFTDLRSVQTLV

SEQ ID NO: 830433 - protein, 21 aa, Mycobacterium
KYYEGFSNATLWPLYHDLIVK

SEQ ID NO: 830434 - protein, 27 aa, Mycobacterium
KYYETTVRLYILPFIDGRTQLGKLTPA

SEQ ID NO: 830435 - protein, 20 aa, Mycobacterium
KYYSTGGLYASYFSAQALTE

SEQ ID NO: 830436 - protein, 29 aa, Mycobacterium
LAAAADEVSLAIAGLFSAHAKQYQAFSVQ

SEQ ID NO: 830437 - protein, 32 aa, Mycobacterium
LAAAAKWQDIFGKDNFFLELMDHGLSIERRVR

SEQ ID NO: 830438 - protein, 27 aa, Mycobacterium
LAAADDVLLFKYIIKNTAWANGKTVTF

SEQ ID NO: 830439 - protein, 33 aa, Mycobacterium
LAAAELLVIQFPLWWYGPPAILKGWFDRVLTNE

SEQ ID NO: 830440 - protein, 19 aa, Mycobacterium
LAAAFRQLIPAAPTPPQEG

SEQ ID NO: 830441 - protein, 20 aa, Mycobacterium
LAAAIPRRRTDRRYYSSWPV

SEQ ID NO: 830442 - protein, 19 aa, Mycobacterium
LAAALAWDGLSTELSSAAA

SEQ ID NO: 830443 - protein, 18 aa, Mycobacterium
LAAALRNRLPQVAALFAE

SEQ ID NO: 830444 - protein, 24 aa, Mycobacterium
LAAALVPMHDTPLGPLAGGLTLRQ

SEQ ID NO: 830445 - protein, 23 aa, Mycobacterium
LAAALVPMHDTPLGPLAGGRTLR

SEQ ID NO: 830446 - protein, 24 aa, Mycobacterium
LAAALVPMHDTPLGPLAPGLTLRQ

SEQ ID NO: 830447 - protein, 29 aa, Mycobacterium
LAAAMPPGFPYAVMIVIHMSRGAPSLLAQ

SEQ ID NO: 830448 - protein, 18 aa, Mycobacterium
LAAANAALAPLITAVVPP

SEQ ID NO: 830449 - protein, 23 aa, Mycobacterium
LAAARDLVWLYNDPGMHYALVEV

SEQ ID NO: 830450 - protein, 17 aa, Mycobacterium
LAAARFRRPGLEPPAAP

SEQ ID NO: 830451 - protein, 17 aa, Mycobacterium
LAAARKLRIVPAGDGVS

SEQ ID NO: 830452 - protein, 23 aa, Mycobacterium
LAAATAWTGLAAELRSAAAAFLA

SEQ ID NO: 830453 - protein, 22 aa, Mycobacterium
LAAAVRGKLPFYIRGYEAEAVG

SEQ ID NO: 830454 - protein, 25 aa, Mycobacterium
LAAAVVPLAMWGARHQMADADVCHE

SEQ ID NO: 830455 - protein, 24 aa, Mycobacterium
LAAAYLPGYLSGVEWWGQSFSEPE

SEQ ID NO: 830456 - protein, 25 aa, Mycobacterium
LAAAYLQGFVWGMQRNYSVLVEMDA

SEQ ID NO: 830457 - protein, 23 aa, Mycobacterium
LAADAGVPVLLAAAADAASALGD

SEQ ID NO: 830458 - protein, 23 aa, Mycobacterium
LAADGSVLDTWFPAPELTESDSS

SEQ ID NO: 830459 - protein, 23 aa, Mycobacterium
LAADPLFCDLLANLHLHLEHEVE

SEQ ID NO: 830460 - protein, 29 aa, Mycobacterium
LAADQLGLPTAPFWFVGSLGELEAVAAHV

SEQ ID NO: 830461 - protein, 41 aa, Mycobacterium
LAADVERLWLALSRLLPPPWRAEALVLLGFSAYVRGDGPLA

SEQ ID NO: 830462 - protein, 34 aa, Mycobacterium
LAAEGFQVVLLPEPLPTPIVAFAVRHSGAVAGIQ

SEQ ID NO: 830463 - protein, 25 aa, Mycobacterium
LAAEHPEWVLLYQYGNPANSDSHYR

SEQ ID NO: 830464 - protein, 22 aa, Mycobacterium
LAAELTRSWAVQWPGLPHAMEE

SEQ ID NO: 830465 - protein, 20 aa, Mycobacterium
LAAEMVPRLLRGEEQWCQGF

SEQ ID NO: 830466 - protein, 23 aa, Mycobacterium
LAAEWLTETLLRHLTKRFVTGSD

SEQ ID NO: 830467 - protein, 18 aa, Mycobacterium
LAAFITPIPIRVRDGTLL

SEQ ID NO: 830468 - protein, 23 aa, Mycobacterium
LAAFPVAAAQVRQWLRAHLPGVE

SEQ ID NO: 830469 - protein, 17 aa, Mycobacterium
LAAFTKAGGRVVQNVSA

SEQ ID NO: 830470 - protein, 26 aa, Mycobacterium
LAAGACAGFFRHPPRVPPTRPGAIVA

SEQ ID NO: 830471 - protein, 25 aa, Mycobacterium
LAAGHLTLVPALRDALAGVGRPDIM

SEQ ID NO: 830472 - protein, 24 aa, Mycobacterium
LAAGHLTLVPALRDALKEVGRPDI

SEQ ID NO: 830473 - protein, 25 aa, Mycobacterium
LAAGHLTLVPALRQALAEVGRPDIM

SEQ ID NO: 830474 - protein, 17 aa, Mycobacterium
LAAGKRLGRLLRAARAD

SEQ ID NO: 830475 - protein, 26 aa, Mycobacterium
LAAGLDARAWRLGWPDGTTVYELDQP

SEQ ID NO: 830476 - protein, 27 aa, Mycobacterium
LAAGLDARAWRLPWPGGTVVYELDQPK

SEQ ID NO: 830477 - protein, 26 aa, Mycobacterium
LAAGLDARAYRLPWSAGTVVYEVDQP

SEQ ID NO: 830478 - protein, 26 aa, Mycobacterium
LAAGLDARAYRLSWPAGTVVFEVDQP

SEQ ID NO: 830479 - protein, 30 aa, Mycobacterium
LAAGLDTLLRLLHPVIPFITEALWQALTGQ

SEQ ID NO: 830480 - protein, 23 aa, Mycobacterium
LAAGNTLVLKPAPDTPWCAAVLG

SEQ ID NO: 830481 - protein, 20 aa, Mycobacterium
LAAGPFAAMLDRARDAIVGK

SEQ ID NO: 830482 - protein, 27 aa, Mycobacterium
LAAGRVDAFLLPTLSLRGMAQVNKSFE

SEQ ID NO: 830483 - protein, 44 aa, Mycobacterium
LAAGSLGFLYDTGLYLRFRATDPDGFHLAYAAALALAGESAQFA

SEQ ID NO: 830484 - protein, 18 aa, Mycobacterium
LAAGWLTEAFYSLVSGAG

SEQ ID NO: 830485 - protein, 26 aa, Mycobacterium
LAAGYWPDRAVLRSNWRRAAEWRPSM

SEQ ID NO: 830486 - protein, 22 aa, Mycobacterium
LAAHAEHFWTWAIDMLGHGYTD

SEQ ID NO: 830487 - protein, 26 aa, Mycobacterium
LAAHGMPMLVWVISPAICGSILAHHG

SEQ ID NO: 830488 - protein, 18 aa, Mycobacterium
LAAHGWVVEPVRNTLDLQ

SEQ ID NO: 830489 - protein, 24 aa, Mycobacterium
LAAHHPWTHLLTDTLTRLNALPTP

SEQ ID NO: 830490 - protein, 17 aa, Mycobacterium
LAAHPEIVQGRTAPTVL

SEQ ID NO: 830491 - protein, 23 aa, Mycobacterium
LAAHPESWKLLRGKAKLPTHEEL

SEQ ID NO: 830492 - protein, 19 aa, Mycobacterium
LAAHRSQLFPGEMFADLFP

SEQ ID NO: 830493 - protein, 18 aa, Mycobacterium
LAAHYRLGQHRPAGQSRV

SEQ ID NO: 830494 - protein, 20 aa, Mycobacterium
LAAIADLRSGAYRTALVVGV

SEQ ID NO: 830495 - protein, 24 aa, Mycobacterium
LAAIGPKLPELWGGSADLAGSNNT

SEQ ID NO: 830496 - protein, 29 aa, Mycobacterium
LAAINGPTQAIFGRPLIGDGAAGTATDPN

SEQ ID NO: 830497 - protein, 30 aa, Mycobacterium
LAAINTPAQALTGRPLIGNGTPGATGSGAD

SEQ ID NO: 830498 - protein, 24 aa, Mycobacterium
LAAKRRSWAVLGEMAELGADAIAE

SEQ ID NO: 830499 - protein, 30 aa, Mycobacterium
LAAKRTSDLVPLCHPLAITGVDIDFTVGGD

SEQ ID NO: 830500 - protein, 17 aa, Mycobacterium
LAAKRWTALNFPTNTVI

SEQ ID NO: 830501 - protein, 23 aa, Mycobacterium
LAALAEPAVRRRLAEGAAAKEAG

SEQ ID NO: 830502 - protein, 17 aa, Mycobacterium
LAALAKLAKAVAAELVA

SEQ ID NO: 830503 - protein, 17 aa, Mycobacterium
LAALDKRVLVLGSGGLS

SEQ ID NO: 830504 - protein, 26 aa, Mycobacterium
LAALDRLLMPNYLLSALQAINIQPGE

SEQ ID NO: 830505 - protein, 25 aa, Mycobacterium
LAALDVAAPVSFDPALFPDGVNVEV

SEQ ID NO: 830506 - protein, 19 aa, Mycobacterium
LAALDVFMGRRAVACLGTA

SEQ ID NO: 830507 - protein, 17 aa, Mycobacterium
LAALGLLDGRRATTHWA

SEQ ID NO: 830508 - protein, 17 aa, Mycobacterium
LAALGLLNGRRATTHWA

SEQ ID NO: 830509 - protein, 21 aa, Mycobacterium
LAALGNPTWYARFAAQVMTDP

SEQ ID NO: 830510 - protein, 28 aa, Mycobacterium
LAALIAQLGRFWRIDRGDTFLVPSPIAH

SEQ ID NO: 830511 - protein, 19 aa, Mycobacterium
LAALIARHRVDLIAIGNGT

SEQ ID NO: 830512 - protein, 26 aa, Mycobacterium
LAALISPLRLRGLSAMLARIKRRLRE

SEQ ID NO: 830513 - protein, 18 aa, Mycobacterium
LAALKVLHPEIEGFSITA

SEQ ID NO: 830514 - protein, 18 aa, Mycobacterium
LAALLARCPAVTRGRLSV

SEQ ID NO: 830515 - protein, 24 aa, Mycobacterium
LAALLLNRIMLAPGEAIFVSAGSL

SEQ ID NO: 830516 - protein, 17 aa, Mycobacterium
LAALLLNRISLSPGEAI

SEQ ID NO: 830517 - protein, 18 aa, Mycobacterium
LAALLRADPHRDDALAAD

SEQ ID NO: 830518 - protein, 22 aa, Mycobacterium
LAALPDAVLGARIRLLRDRIHQ

SEQ ID NO: 830519 - protein, 28 aa, Mycobacterium
LAALPDGALMRRAAYGLAAVIADELSRR

SEQ ID NO: 830520 - protein, 27 aa, Mycobacterium
LAALPERVLGRAVPLKVGARHSGYDLD

SEQ ID NO: 830521 - protein, 20 aa, Mycobacterium
LAALPILGAANRIPASYATC

SEQ ID NO: 830522 - protein, 28 aa, Mycobacterium
LAALPKPKRYPRFGPWGRLDKWRRQYDI

SEQ ID NO: 830523 - protein, 18 aa, Mycobacterium
LAALPQPFTVSDARRALG

SEQ ID NO: 830524 - protein, 21 aa, Mycobacterium
LAALQRLVTDRSLLVTNGTAF

SEQ ID NO: 830525 - protein, 17 aa, Mycobacterium
LAALRDWLRTQRSERGG

SEQ ID NO: 830526 - protein, 21 aa, Mycobacterium
LAALRFGELCLVAGLPPGLVN

SEQ ID NO: 830527 - protein, 25 aa, Mycobacterium
LAALRPYVWGDCVVAFDAPLVVNNP

SEQ ID NO: 830528 - protein, 18 aa, Mycobacterium
LAALRRAVPATKGNTRRL

SEQ ID NO: 830529 - protein, 18 aa, Mycobacterium
LAALRRNGAQRPVLETVS

SEQ ID NO: 830530 - protein, 20 aa, Mycobacterium
LAALRVKFDSGTLPPMFVDL

SEQ ID NO: 830531 - protein, 19 aa, Mycobacterium
LAALSPRMDELFKSALGEL

SEQ ID NO: 830532 - protein, 23 aa, Mycobacterium
LAALVMRAADGPGFVRSRARLEL

SEQ ID NO: 830533 - protein, 23 aa, Mycobacterium
LAAMCPAITTSNFRELFYPGGSF

SEQ ID NO: 830534 - protein, 17 aa, Mycobacterium
LAAMLDYARTDDIVVVT

SEQ ID NO: 830535 - protein, 19 aa, Mycobacterium
LAAMLTIRPTLAIGSRVPH

SEQ ID NO: 830536 - protein, 20 aa, Mycobacterium
LAANPAAIMLSFGDPHKFAG

SEQ ID NO: 830537 - protein, 18 aa, Mycobacterium
LAANWIWERGQEEDLAPL

SEQ ID NO: 830538 - protein, 17 aa, Mycobacterium
LAAPAAIRLKPGERHWT

SEQ ID NO: 830539 - protein, 21 aa, Mycobacterium
LAAPIRRVQGLVGPGWSGDPA

SEQ ID NO: 830540 - protein, 26 aa, Mycobacterium
LAAPLFGEQFIIDRAWTQVDVIELDP

SEQ ID NO: 830541 - protein, 23 aa, Mycobacterium
LAAPLHDLRTLVGPGWVATDPPV

SEQ ID NO: 830542 - protein, 17 aa, Mycobacterium
LAAPLLPSATEIVWRGL

SEQ ID NO: 830543 - protein, 19 aa, Mycobacterium
LAAPMQTLPQVLINVRVAD

SEQ ID NO: 830544 - protein, 27 aa, Mycobacterium
LAAPPRPFRDYLGWLGGWDSQSGEQFW

SEQ ID NO: 830545 - protein, 24 aa, Mycobacterium
LAAPPTFRTMPYWESVEPFPLPGE

SEQ ID NO: 830546 - protein, 26 aa, Mycobacterium
LAAPQGLLHKVVLARALQLTAETALD

SEQ ID NO: 830547 - protein, 39 aa, Mycobacterium
LAAQAWQGPASTAMVAAAAPYASWLSAAATQAVAAAGQA

SEQ ID NO: 830548 - protein, 27 aa, Mycobacterium
LAAQGFSVLLLPGPVPTPVVAFAVRHT

SEQ ID NO: 830549 - protein, 23 aa, Mycobacterium
LAAQPPLHWQDGSAVTVVVAAEN

SEQ ID NO: 830550 - protein, 35 aa, Mycobacterium
LAAQRADRPLPWQLPARLLLARAYAALGRAVDGER

SEQ ID NO: 830551 - protein, 20 aa, Mycobacterium
LAAQRFAAAVWTAIRERPAR

SEQ ID NO: 830552 - protein, 19 aa, Mycobacterium
LAARAQGLGAAITLWHGSC

SEQ ID NO: 830553 - protein, 23 aa, Mycobacterium
LAARDIHQALGGNAVLRGVDLDV

SEQ ID NO: 830554 - protein, 22 aa, Mycobacterium
LAARDWWTLVDIDSAPGFCDES

SEQ ID NO: 830555 - protein, 18 aa, Mycobacterium
LAARELVIREKARDLARR

SEQ ID NO: 830556 - protein, 21 aa, Mycobacterium
LAARFARPLAFGTAGLRGPVR

SEQ ID NO: 830557 - protein, 23 aa, Mycobacterium
LAARFARPLTFGTAGLRGPVRGG

SEQ ID NO: 830558 - protein, 22 aa, Mycobacterium
LAARGHNLIITARRGEILNDLA

SEQ ID NO: 830559 - protein, 25 aa, Mycobacterium
LAARGLRCIAPTWPLGAHPEPLRRG

SEQ ID NO: 830560 - protein, 27 aa, Mycobacterium
LAARIEAMPWQWAGQELPTFSSAPTDH

SEQ ID NO: 830561 - protein, 27 aa, Mycobacterium
LAARIEAMPWQWVGQELPAFSSAPTDH

SEQ ID NO: 830562 - protein, 29 aa, Mycobacterium
LAARITTPLLPDDYLHLANPLWSARELRG

SEQ ID NO: 830563 - protein, 22 aa, Mycobacterium
LAARLALRRRLVPTRDVRNRGK

SEQ ID NO: 830564 - protein, 21 aa, Mycobacterium
LAARLKARWAPEGLVQRSQGR

SEQ ID NO: 830565 - protein, 22 aa, Mycobacterium
LAARLPLAHSLSWQGRGRDADD

SEQ ID NO: 830566 - protein, 17 aa, Mycobacterium
LAARLRLAMKERDIALW

SEQ ID NO: 830567 - protein, 22 aa, Mycobacterium
LAARLTVGYALAWQGRGREADG

SEQ ID NO: 830568 - protein, 18 aa, Mycobacterium
LAARSISDLVAWSGGLYD

SEQ ID NO: 830569 - protein, 18 aa, Mycobacterium
LAARVGIDVFRTAYRRWL

SEQ ID NO: 830570 - protein, 23 aa, Mycobacterium
LAARVLERWSTVPARPAVTVVQA

SEQ ID NO: 830571 - protein, 23 aa, Mycobacterium
LAARYRVLAPDQLGFGQSAKVID

SEQ ID NO: 830572 - protein, 21 aa, Mycobacterium
LAARYVSGYLATNPPPGQPRL

SEQ ID NO: 830573 - protein, 18 aa, Mycobacterium
LAASSRRSAWWAGALTLG

SEQ ID NO: 830574 - protein, 19 aa, Mycobacterium
LAASVRPWQSILCSDIAHS

SEQ ID NO: 830575 - protein, 23 aa, Mycobacterium
LAATAYPTVMLPKAESAAQVAAL

SEQ ID NO: 830576 - protein, 24 aa, Mycobacterium
LAATDRFRLAVRELNWTSGSGETS

SEQ ID NO: 830577 - protein, 25 aa, Mycobacterium
LAATDRFRLAVRELTWAASSPDIEA

SEQ ID NO: 830578 - protein, 25 aa, Mycobacterium
LAATDRFRLAVRELTWNALSPDIEA

SEQ ID NO: 830579 - protein, 27 aa, Mycobacterium
LAATDRFRLAVRELTWSAASPDIEAAV

SEQ ID NO: 830580 - protein, 25 aa, Mycobacterium
LAATDRFRLAVRELTWSAGAAGVEA

SEQ ID NO: 830581 - protein, 25 aa, Mycobacterium
LAATDRFRLAVRELTWTALSPDIEA

SEQ ID NO: 830582 - protein, 18 aa, Mycobacterium
LAATLDYVRDRTAFGSPI

SEQ ID NO: 830583 - protein, 27 aa, Mycobacterium
LAATPYAAVTFPWYQLGRQVHVRGPVS

SEQ ID NO: 830584 - protein, 28 aa, Mycobacterium
LAATRLDRFIGLVVIDRGHPRVADLTGA

SEQ ID NO: 830585 - protein, 32 aa, Mycobacterium
LAATRRALTVHPLLGTLPLAFTAPQGLADRLR

SEQ ID NO: 830586 - protein, 27 aa, Mycobacterium
LAATWTHLRSHPVPFGELVWQHARSVL

SEQ ID NO: 830587 - protein, 28 aa, Mycobacterium
LAAVCALEPFWEALRKVYAPFESGLPGP

SEQ ID NO: 830588 - protein, 23 aa, Mycobacterium
LAAVCALEPYWEAVRKVYAPFES

SEQ ID NO: 830589 - protein, 22 aa, Mycobacterium
LAAVFSGHALDYQALSAQMAGV

SEQ ID NO: 830590 - protein, 27 aa, Mycobacterium
LAAVLIRPKFRRWISVADAIAFVESLG

SEQ ID NO: 830591 - protein, 18 aa, Mycobacterium
LAAVLPGLALEHAEWVAA

SEQ ID NO: 830592 - protein, 17 aa, Mycobacterium
LAAVPTTDLLAAGADEV

SEQ ID NO: 830593 - protein, 23 aa, Mycobacterium
LAAVPYLESVVLAAGALAAFGSE

SEQ ID NO: 830594 - protein, 25 aa, Mycobacterium
LAAVRAFVGPQFRGPGKPFGQEQPC

SEQ ID NO: 830595 - protein, 19 aa, Mycobacterium
LAAVRVRGLIALYGAASGQ

SEQ ID NO: 830596 - protein, 18 aa, Mycobacterium
LAAVTRPLLRSSFLAILA

SEQ ID NO: 830597 - protein, 34 aa, Mycobacterium
LAAVVPLPVIAANRALLMLLSATNVLGVNAPAIA

SEQ ID NO: 830598 - protein, 26 aa, Mycobacterium
LAAVWSRAPLQALARLHVLAATGMAD

SEQ ID NO: 830599 - protein, 20 aa, Mycobacterium
LAAWLPTVFDASGPVKVSNV

SEQ ID NO: 830600 - protein, 28 aa, Mycobacterium
LAAWSMVHGFSLLWLNDAIDTDRDPIAT

SEQ ID NO: 830601 - protein, 21 aa, Mycobacterium
LAAYLESLRRLRGLGARTVLP

SEQ ID NO: 830602 - protein, 17 aa, Mycobacterium
LAAYPHHDLAEATDWML

SEQ ID NO: 830603 - protein, 19 aa, Mycobacterium
LAAYRALGLHDWTYERIEC

SEQ ID NO: 830604 - protein, 17 aa, Mycobacterium
LAAYYSIGSGDPKEARA

SEQ ID NO: 830605 - protein, 17 aa, Mycobacterium
LACAAAGRPAPVDGVTT

SEQ ID NO: 830606 - protein, 25 aa, Mycobacterium
LACALDELILFRGRRVMTTILQHAI

SEQ ID NO: 830607 - protein, 19 aa, Mycobacterium
LACELLTAHIQRTTNALLS

SEQ ID NO: 830608 - protein, 20 aa, Mycobacterium
LACGPHHRLLDNGWTTRKRA

SEQ ID NO: 830609 - protein, 25 aa, Mycobacterium
LACGPLIGTVYLSIPALVAASAGPV

SEQ ID NO: 830610 - protein, 21 aa, Mycobacterium
LACIVAAAAGFHWLGLETLHC

SEQ ID NO: 830611 - protein, 18 aa, Mycobacterium
LACLRGCGLVVAAPEGRR

SEQ ID NO: 830612 - protein, 22 aa, Mycobacterium
LACVGGFVPVVLFSDDHDPADG

SEQ ID NO: 830613 - protein, 21 aa, Mycobacterium
LACVGGPVTIGIWLDANWGKR

SEQ ID NO: 830614 - protein, 28 aa, Mycobacterium
LACVLFAEPAPQLLLLDEPTNNLDLVSV

SEQ ID NO: 830615 - protein, 27 aa, Mycobacterium
LADAGLIAPHWPAPWGVDAGPLKQLII

SEQ ID NO: 830616 - protein, 25 aa, Mycobacterium
LADAGWTMVIVTHQIQFAKQVSDQV

SEQ ID NO: 830617 - protein, 24 aa, Mycobacterium
LADAIGRPVVWTTSALLGQHPIPA

SEQ ID NO: 830618 - protein, 34 aa, Mycobacterium
LADAQTLRRMVFDSDWRHLFVSLRSRSISVEIAV

SEQ ID NO: 830619 - protein, 22 aa, Mycobacterium
LADAWLGVIARHGTLRTAFTLG

SEQ ID NO: 830620 - protein, 22 aa, Mycobacterium
LADCALALGFEKMNPGSLGAMY

SEQ ID NO: 830621 - protein, 30 aa, Mycobacterium
LADDFWDEIFRELGIPYLPVRWRSDNPDSI

SEQ ID NO: 830622 - protein, 19 aa, Mycobacterium
LADDIGAFLAYAAAPPKVD

SEQ ID NO: 830623 - protein, 24 aa, Mycobacterium
LADDPLFCDLLANLHLHLEHEVDA

SEQ ID NO: 830624 - protein, 23 aa, Mycobacterium
LADDRLRVLLADSARSILSTDRR

SEQ ID NO: 830625 - protein, 21 aa, Mycobacterium
LADDVVAPLPLPVFDNSAMDG

SEQ ID NO: 830626 - protein, 17 aa, Mycobacterium
LADDYTGPGAGLDGSDV

SEQ ID NO: 830627 - protein, 17 aa, Mycobacterium
LADEAWVAVRALAPRKG

SEQ ID NO: 830628 - protein, 21 aa, Mycobacterium
LADEDLRLQLLGHARKRLGAT

SEQ ID NO: 830629 - protein, 17 aa, Mycobacterium
LADEFPEIGLKAPAPNA

SEQ ID NO: 830630 - protein, 24 aa, Mycobacterium
LADEYSVAFDRWLACGAADLEDRV

SEQ ID NO: 830631 - protein, 28 aa, Mycobacterium
LADFDLHTILRLPTGIFYAQGVKANVLF

SEQ ID NO: 830632 - protein, 17 aa, Mycobacterium
LADFHRVMAVNVLGVMA

SEQ ID NO: 830633 - protein, 17 aa, Mycobacterium
LADGLARLLAVPAPDPF

SEQ ID NO: 830634 - protein, 19 aa, Mycobacterium
LADGLFQQRLHDCGADLVS

SEQ ID NO: 830635 - protein, 28 aa, Mycobacterium
LADGLPHRPGIYLFRGPSGEVLYVGTAV

SEQ ID NO: 830636 - protein, 25 aa, Mycobacterium
LADGRDLLFFTLPGHRPAPVEDRRP

SEQ ID NO: 830637 - protein, 25 aa, Mycobacterium
LADGREQLYFSLPGHTPAPVGDRRP

SEQ ID NO: 830638 - protein, 26 aa, Mycobacterium
LADHEWFREQFAALDYLQAQTPNDET

SEQ ID NO: 830639 - protein, 26 aa, Mycobacterium
LADHGFDNLLLAYPTTDRAALPQLGE

SEQ ID NO: 830640 - protein, 19 aa, Mycobacterium
LADHQWLAIAQAFAGPPGG

SEQ ID NO: 830641 - protein, 23 aa, Mycobacterium
LADIALRRPSLDDVFLSMTTDPS

SEQ ID NO: 830642 - protein, 26 aa, Mycobacterium
LADIEWTVQLLQLRYAHKVPALHNTS

SEQ ID NO: 830643 - protein, 17 aa, Mycobacterium
LADILCPLSLGAQLVIP

SEQ ID NO: 830644 - protein, 25 aa, Mycobacterium
LADILRPNIAVGRYGQPRDIASLVS

SEQ ID NO: 830645 - protein, 22 aa, Mycobacterium
LADIPVLLGSYPITPASDILHE

SEQ ID NO: 830646 - protein, 18 aa, Mycobacterium
LADKPDATRIVAWHSGER

SEQ ID NO: 830647 - protein, 30 aa, Mycobacterium
LADLDYHLTTLFPPVRPRGFLEVRYLDSVP

SEQ ID NO: 830648 - protein, 19 aa, Mycobacterium
LADLELGFAAAAKFGATAG

SEQ ID NO: 830649 - protein, 19 aa, Mycobacterium
LADLELGFAAARRFSEFSG

SEQ ID NO: 830650 - protein, 17 aa, Mycobacterium
LADLFGGLIGSAAEGLP

SEQ ID NO: 830651 - protein, 19 aa, Mycobacterium
LADLHNVTYIARIDGVAPG

SEQ ID NO: 830652 - protein, 32 aa, Mycobacterium
LADLLGGVHRQRLRRRLGPAGLDPGDLLLQVG

SEQ ID NO: 830653 - protein, 31 aa, Mycobacterium
LADLPTALRRRAVRGWLLAAGARDLTDKHLR

SEQ ID NO: 830654 - protein, 17 aa, Mycobacterium
LADLRGGAVWDAAAIRK

SEQ ID NO: 830655 - protein, 18 aa, Mycobacterium
LADLRNPEHEAALAELGV

SEQ ID NO: 830656 - protein, 19 aa, Mycobacterium
LADLRTDTFKRLRARYVIA

SEQ ID NO: 830657 - protein, 24 aa, Mycobacterium
LADNKLDGLPGRTAAVVGAGSMGS

SEQ ID NO: 830658 - protein, 25 aa, Mycobacterium
LADNQRILYLALDRPEQIVRSMLRQ

SEQ ID NO: 830659 - protein, 18 aa, Mycobacterium
LADPDWVAVRALVPRRDV

SEQ ID NO: 830660 - protein, 17 aa, Mycobacterium
LADPEVPVFALTTGPRW

SEQ ID NO: 830661 - protein, 18 aa, Mycobacterium
LADPKVPVYALTTGPRWP

SEQ ID NO: 830662 - protein, 36 aa, Mycobacterium; identical to SEQ ID NO: 120913

SEQ ID NO: 830663 - protein, 23 aa, Mycobacterium
LADPMSLLEAWSGAGLAVLIDAA

SEQ ID NO: 830664 - protein, 17 aa, Mycobacterium
LADPPVLHLYDDRLLYL

SEQ ID NO: 830665 - protein, 23 aa, Mycobacterium
LADPRRAILTAADDGRIIGYAML

SEQ ID NO: 830666 - protein, 36 aa, Mycobacterium
LADPTICELLTARGYLLVSFEDVLGRPLAQAPAPVV

SEQ ID NO: 830667 - protein, 21 aa, Mycobacterium
LADQLGFKLVAYLGKVKETRA

SEQ ID NO: 830668 - protein, 20 aa, Mycobacterium
LADRFDCHTVIFTGVAGGLD

SEQ ID NO: 830669 - protein, 24 aa, Mycobacterium
LADRGFDISPRLAAALLDAAPQLR

SEQ ID NO: 830670 - protein, 20 aa, Mycobacterium
LADRLPAYMVPAAVVVLPAI

SEQ ID NO: 830671 - protein, 20 aa, Mycobacterium
LADRYQLLDAALTEAGLDWY

SEQ ID NO: 830672 - protein, 25 aa, Mycobacterium
LADSAAELPTPWPREVLDDLLVVLL

SEQ ID NO: 830673 - protein, 21 aa, Mycobacterium
LADSWRMAAKALRPLPVAHKE

SEQ ID NO: 830674 - protein, 17 aa, Mycobacterium
LADTDAAVILKLGRSYP

SEQ ID NO: 830675 - protein, 19 aa, Mycobacterium
LADTGLGWDATRLASQAAL

SEQ ID NO: 830676 - protein, 27 aa, Mycobacterium
LADTILRYALMALLIPSVEPLETADDI

SEQ ID NO: 830677 - protein, 25 aa, Mycobacterium
LADVEPLAPQLPYYSATSFDPRERP

SEQ ID NO: 830678 - protein, 20 aa, Mycobacterium
LADVGLAPRLRLVPIRRERD

SEQ ID NO: 830679 - protein, 26 aa, Mycobacterium
LADVLLRSLSKAPFRWSRPVMDRFDA

SEQ ID NO: 830680 - protein, 18 aa, Mycobacterium
LADVLRPDVLLTRLVRRD

SEQ ID NO: 830681 - protein, 29 aa, Mycobacterium
LADVYWGDLDILLLDLPPGTGDIAISVAQ

SEQ ID NO: 830682 - protein, 28 aa, Mycobacterium
LADVYWGDLDVLLLDLPPGTGDVAISIA

SEQ ID NO: 830683 - protein, 28 aa, Mycobacterium
LADVYWGDLDVLLLDLPPGTGDVAISVA

SEQ ID NO: 830684 - protein, 17 aa, Mycobacterium
LADWQKTLGVNLWGVIH

SEQ ID NO: 830685 - protein, 20 aa, Mycobacterium
LADYDTWRRERPRELARVVL

SEQ ID NO: 830686 - protein, 18 aa, Mycobacterium
LADYLEVSQLIRVLARRS

SEQ ID NO: 830687 - protein, 29 aa, Mycobacterium
LADYMAARGIGFLGWNTRFRGFESNFALD

SEQ ID NO: 830688 - protein, 25 aa, Mycobacterium
LADYRTCRGMWRIGQRALAVAVHRR

SEQ ID NO: 830689 - protein, 24 aa, Mycobacterium
LAEAAADLFLLPSGDDLVLVQAGD

SEQ ID NO: 830690 - protein, 32 aa, Mycobacterium
LAEAAPVLWAEMPTLPLCRQQRTLLMSKKMYA

SEQ ID NO: 830691 - protein, 24 aa, Mycobacterium
LAEADLYGPRWAMVRAFNAANDLD

SEQ ID NO: 830692 - protein, 24 aa, Mycobacterium
LAEAGLDWRQIQLVAGADTIRNGY

SEQ ID NO: 830693 - protein, 26 aa, Mycobacterium
LAEAGWALPHLPKPWGRASSPVEQII

SEQ ID NO: 830694 - protein, 26 aa, Mycobacterium
LAEAGWPVRVWTDLLPRQTTSAVAGA

SEQ ID NO: 830695 - protein, 25 aa, Mycobacterium
LAEAIKIIRELFTGELIDFRGEYFE

SEQ ID NO: 830696 - protein, 18 aa, Mycobacterium
LAEAIKLARMAKGLSWTK

SEQ ID NO: 830697 - protein, 26 aa, Mycobacterium
LAEAIRLGERLGVPESTLLSALGHGS

SEQ ID NO: 830698 - protein, 26 aa, Mycobacterium
LAEAKVPWILMHWRSVDADHPHRVPG

SEQ ID NO: 830699 - protein, 23 aa, Mycobacterium
LAEALRILAARLPNPRISGEAPW

SEQ ID NO: 830700 - protein, 19 aa, Mycobacterium
LAEALRLARRRVIVAVPFE

SEQ ID NO: 830701 - protein, 17 aa, Mycobacterium
LAEALRLRRPDVTWLLV

SEQ ID NO: 830702 - protein, 40 aa, Mycobacterium
LAEAMLHSDYPLQALLYCVVLHRFLRWRQPGYSARRHIAG

SEQ ID NO: 830703 - protein, 24 aa, Mycobacterium
LAEATLFVTGWRGPTVKTLTLDQR

SEQ ID NO: 830704 - protein, 25 aa, Mycobacterium
LAEAWEYVWPVSRWQRYLRAQLDGS

SEQ ID NO: 830705 - protein, 18 aa, Mycobacterium
LAECNWLVPVNNPRLLCA

SEQ ID NO: 830706 - protein, 19 aa, Mycobacterium
LAEDGVIWVLTPKTGKPGH

SEQ ID NO: 830707 - protein, 24 aa, Mycobacterium
LAEDLGLRLLAPTVAVSLAPLAEL

SEQ ID NO: 830708 - protein, 24 aa, Mycobacterium
LAEDLLRLLDKWFPGEQVHGVGPS

SEQ ID NO: 830709 - protein, 23 aa, Mycobacterium
LAEDPLFCDLLANLHLHLEHEVD

SEQ ID NO: 830710 - protein, 27 aa, Mycobacterium
LAEDVARLIRRRIFDGTYPAGKYIRLD

SEQ ID NO: 830711 - protein, 26 aa, Mycobacterium
LAEDVTATYKLPYDIPLIGAQCDEAN

SEQ ID NO: 830712 - protein, 20 aa, Mycobacterium
LAEEAFAGMKLLAISTTEEQ

SEQ ID NO: 830713 - protein, 31 aa, Mycobacterium
LAEEAGWDAIFGWEPVWGVDAWVALTAAAMR

SEQ ID NO: 830714 - protein, 29 aa, Mycobacterium
LAEEISQLLYWTQVLMISRGLSLDDVYRK

SEQ ID NO: 830715 - protein, 21 aa, Mycobacterium
LAEELVRIIGVLRGMQLKKLP

SEQ ID NO: 830716 - protein, 24 aa, Mycobacterium
LAEENYWFRRHEVVYQRLAHRCAG

SEQ ID NO: 830717 - protein, 20 aa, Mycobacterium
LAEENYWFRRHEVVYRRLVE

SEQ ID NO: 830718 - protein, 25 aa, Mycobacterium
LAEERRLLLLAVGRAARRVLITAVE

SEQ ID NO: 830719 - protein, 24 aa, Mycobacterium
LAEEVLVIAALARQNGLAAQHSYM

SEQ ID NO: 830720 - protein, 18 aa, Mycobacterium
LAEFAIPGGPGYLNTSAT

SEQ ID NO: 830721 - protein, 22 aa, Mycobacterium
LAEFEEMLNGTLRSVGRGRHQL

SEQ ID NO: 830722 - protein, 23 aa, Mycobacterium
LAEFEEMLNGTLRSVGRGRHQLR

SEQ ID NO: 830723 - protein, 26 aa, Mycobacterium
LAEFEKEFFPIYPASAKMQSWDIYRC

SEQ ID NO: 830724 - protein, 25 aa, Mycobacterium
LAEFKAMFQMKFYGVALFRSRGVLP

SEQ ID NO: 830725 - protein, 21 aa, Mycobacterium
LAEFNVEGLATVIPFHRAVTA

SEQ ID NO: 830726 - protein, 20 aa, Mycobacterium
LAEFQVEGLATVIPFHRAVV

SEQ ID NO: 830727 - protein, 26 aa, Mycobacterium
LAEFRAARRMGSKSALLPLIADCERG

SEQ ID NO: 830728 - protein, 20 aa, Mycobacterium
LAEGAFRGLQAGATAATSIT

SEQ ID NO: 830729 - protein, 24 aa, Mycobacterium
LAEGGIGWIPYLIERAEHVAADYQ

SEQ ID NO: 830730 - protein, 30 aa, Mycobacterium
LAEGLHRALSKLFAMLRRGDPSGAAAGELT

SEQ ID NO: 830731 - protein, 30 aa, Mycobacterium
LAEGLHRALSKLFSILRRGDPSGTAAAGEL

SEQ ID NO: 830732 - protein, 21 aa, Mycobacterium
LAEGLLLTMDQPYPIAMAKLG

SEQ ID NO: 830733 - protein, 23 aa, Mycobacterium
LAEGRYIGLGFSAYIEPTGAATG

SEQ ID NO: 830734 - protein, 26 aa, Mycobacterium
LAEGVPCLHFMTLNFARATSEVLENL

SEQ ID NO: 830735 - protein, 25 aa, Mycobacterium
LAEGYRYLLGFVHSAVERAFFGDPA

SEQ ID NO: 830736 - protein, 18 aa, Mycobacterium
LAEHHPHLLPLADRTLEP

SEQ ID NO: 830737 - protein, 25 aa, Mycobacterium
LAEHHPHLLPLAQRILEPTELEVLR

SEQ ID NO: 830738 - protein, 30 aa, Mycobacterium
LAEHKPFQLFMDRLYRVLLSDAGLDGRIEA

SEQ ID NO: 830739 - protein, 23 aa, Mycobacterium
LAEHLAALRLQPGYERVLEEGRK

SEQ ID NO: 830740 - protein, 18 aa, Mycobacterium
LAEHLPAYMVPATVLAVD

SEQ ID NO: 830741 - protein, 26 aa, Mycobacterium
LAEHNLLPDVLYTSLLRRAISTAHLA

SEQ ID NO: 830742 - protein, 18 aa, Mycobacterium
LAEHPERLPLTYTIQARK

SEQ ID NO: 830743 - protein, 31 aa, Mycobacterium
LAEHRHELFPDSFIADLFRSSTGRPSLPADL

SEQ ID NO: 830744 - protein, 25 aa, Mycobacterium
LAEHSPYRIFLVNPTISELDGKTVY

SEQ ID NO: 830745 - protein, 17 aa, Mycobacterium
LAEIALDWVLDGAVAAG

SEQ ID NO: 830746 - protein, 33 aa, Mycobacterium
LAEIARTVLPPLLVPRAFVPVAALPVTPAGALD

SEQ ID NO: 830747 - protein, 22 aa, Mycobacterium
LAEITGWSLEIAPEALNCAAPD

SEQ ID NO: 830748 - protein, 17 aa, Mycobacterium
LAEIYPVPPLLRNQVLS

SEQ ID NO: 830749 - protein, 28 aa, Mycobacterium
LAEKLGAPLHILHALPTLGRNLTESAGA

SEQ ID NO: 830750 - protein, 18 aa, Mycobacterium
LAEKVWYLRILADERSAA

SEQ ID NO: 830751 - protein, 18 aa, Mycobacterium
LAELAWPNVVVTTGIAEP

SEQ ID NO: 830752 - protein, 17 aa, Mycobacterium
LAELAWSTFIGAHWQVR

SEQ ID NO: 830753 - protein, 27 aa, Mycobacterium
LAELCTLTWTVYSLPGAPILDHYELGD

SEQ ID NO: 830754 - protein, 25 aa, Mycobacterium
LAELDQHLLRPLRDVIWGSDESLLN

SEQ ID NO: 830755 - protein, 25 aa, Mycobacterium
LAELDRAWRHLPFEAEWHSANELAR

SEQ ID NO: 830756 - protein, 24 aa, Mycobacterium
LAELEIRKRRRGVLGYDDLLTRLA

SEQ ID NO: 830757 - protein, 26 aa, Mycobacterium
LAELERAWQHLPFAAQWHSDNELARH

SEQ ID NO: 830758 - protein, 21 aa, Mycobacterium
LAELEVIARRLSEAHDVLLRA

SEQ ID NO: 830759 - protein, 18 aa, Mycobacterium
LAELFSVPDGYEVILGNG

SEQ ID NO: 830760 - protein, 26 aa, Mycobacterium
LAELGEWLHPFEKFWRARLARLAEVA

SEQ ID NO: 830761 - protein, 17 aa, Mycobacterium
LAELGFRPRRLAGRVVW

SEQ ID NO: 830762 - protein, 19 aa, Mycobacterium
LAELGIFGVAIPEEHGGAG

SEQ ID NO: 830763 - protein, 20 aa, Mycobacterium
LAELGVTWRSPREAIIATFA

SEQ ID NO: 830764 - protein, 18 aa, Mycobacterium
LAELGWVCLAIDYRVAPH

SEQ ID NO: 830765 - protein, 17 aa, Mycobacterium
LAELIRRAIAVKAEVVA

SEQ ID NO: 830766 - protein, 31 aa, Mycobacterium
LAELKHVAVIKPLPLRVPVPGGFTSDDFIID

SEQ ID NO: 830767 - protein, 18 aa, Mycobacterium
LAELLGQTWSGATALMVA

SEQ ID NO: 830768 - protein, 17 aa, Mycobacterium
LAELLGYLNAGAHATPE

SEQ ID NO: 830769 - protein, 18 aa, Mycobacterium
LAELLKPENKRALADWSW

SEQ ID NO: 830770 - protein, 18 aa, Mycobacterium
LAELLLSRGVGVEAGLFH

SEQ ID NO: 830771 - protein, 26 aa, Mycobacterium
LAELLNHLLSLGYSKELLPERLIVVD

SEQ ID NO: 830772 - protein, 29 aa, Mycobacterium
LAELPQLQVLALSALHMAPLTLAGIPGFL

SEQ ID NO: 830773 - protein, 23 aa, Mycobacterium
LAELPQRLAAFDGALLPGGADVD

SEQ ID NO: 830774 - protein, 26 aa, Mycobacterium
LAELRAARRMGSKSALLALMADCERG

SEQ ID NO: 830775 - protein, 30 aa, Mycobacterium
LAELRAARRMGSRSPLLALIADCERGVGRP

SEQ ID NO: 830776 - protein, 29 aa, Mycobacterium
LAELREYIDWQPFFNAWEMKGRFPDILNN

SEQ ID NO: 830777 - protein, 30 aa, Mycobacterium
LAELREYIDWQPFFNAWEMKGRFPDILNNP

SEQ ID NO: 830778 - protein, 18 aa, Mycobacterium
LAELRHFMRTSVTVRTLA

SEQ ID NO: 830779 - protein, 25 aa, Mycobacterium
LAELRKLNFGSWHPSWRADSSGDDT

SEQ ID NO: 830780 - protein, 30 aa, Mycobacterium
LAELRWAGIGAAWYWTVARPDINALSDRQD

SEQ ID NO: 830781 - protein, 19 aa, Mycobacterium
LAELTERCLRWPQAAAVCD

SEQ ID NO: 830782 - protein, 24 aa, Mycobacterium
LAELTLPTPPPPIVATGLDSASAA

SEQ ID NO: 830783 - protein, 19 aa, Mycobacterium
LAELWRSVGVVPDAVIGHS

SEQ ID NO: 830784 - protein, 26 aa, Mycobacterium
LAEMATDIYALRGLLADAAHKWDSGK

SEQ ID NO: 830785 - protein, 21 aa, Mycobacterium
LAEMLTYVPEVFRAAGLRVVG

SEQ ID NO: 830786 - protein, 29 aa, Mycobacterium
LAEMQLRILWEELLPRFEKIEVIGEPEYV

SEQ ID NO: 830787 - protein, 25 aa, Mycobacterium
LAEMQLRILWEELLPRFENIEVVGE

SEQ ID NO: 830788 - protein, 17 aa, Mycobacterium
LAEPIRDVVWLDAAGRP

SEQ ID NO: 830789 - protein, 17 aa, Mycobacterium
LAEPLPAPPADDVALDD

SEQ ID NO: 830790 - protein, 30 aa, Mycobacterium
LAEPTILGLGLPFFAQSMYMIADGLGVTID

SEQ ID NO: 830791 - protein, 23 aa, Mycobacterium
LAEQAWQGPAAAAMTAAAAPYAG

SEQ ID NO: 830792 - protein, 29 aa, Mycobacterium
LAEQDLLPDVLYTSLLRRAITTAHLALDS

SEQ ID NO: 830793 - protein, 20 aa, Mycobacterium
LAEQFECTFCWTNRAGDPVA

SEQ ID NO: 830794 - protein, 19 aa, Mycobacterium
LAEQIATMPPFALRQAKRA

SEQ ID NO: 830795 - protein, 28 aa, Mycobacterium
LAEQNLLPDVLYTSLLRRAITTAHLALD

SEQ ID NO: 830796 - protein, 26 aa, Mycobacterium
LAEQRRWLAPWYSSVPLQSGPAELAE

SEQ ID NO: 830797 - protein, 19 aa, Mycobacterium
LAERALPIELPRISKRRND

SEQ ID NO: 830798 - protein, 24 aa, Mycobacterium
LAERAQFIDAPAPWREQLAERKAR

SEQ ID NO: 830799 - protein, 20 aa, Mycobacterium
LAERAVVYRDLVMAGRSHNV

SEQ ID NO: 830800 - protein, 24 aa, Mycobacterium
LAERFAHTLTFGTAGLRGPLRAGP

SEQ ID NO: 830801 - protein, 40 aa, Mycobacterium
LAERIERDRLLAGPILGAFEAWLVLRSLGSAGLRFERQCQ

SEQ ID NO: 830802 - protein, 29 aa, Mycobacterium
LAERLGIKRLLRSAILPVSFGFPFGLSAV

SEQ ID NO: 830803 - protein, 20 aa, Mycobacterium
LAERLPAYMIPTAVVTLDAL

SEQ ID NO: 830804 - protein, 17 aa, Mycobacterium
LAERLPAYMVPAAIVEV

SEQ ID NO: 830805 - protein, 24 aa, Mycobacterium
LAERLPSYMVPAAVLVVDALPLTV

SEQ ID NO: 830806 - protein, 24 aa, Mycobacterium
LAERLPSYMVPAAVVVLDALPLTV

SEQ ID NO: 830807 - protein, 19 aa, Mycobacterium
LAERMELLRRAAARGDEPG

SEQ ID NO: 830808 - protein, 23 aa, Mycobacterium
LAERPLVRLFHLGGTAGLPSYFE

SEQ ID NO: 830809 - protein, 25 aa, Mycobacterium
LAERRAAALALDPTLLAELLGRVEL

SEQ ID NO: 830810 - protein, 20 aa, Mycobacterium
LAERTGLTKSYLSKIERRQS

SEQ ID NO: 830811 - protein, 25 aa, Mycobacterium
LAERVIAPLARAALENALQRGQSAL

SEQ ID NO: 830812 - protein, 25 aa, Mycobacterium
LAERYGMSRFCRGVHGCDIAVLDLE

SEQ ID NO: 830813 - protein, 28 aa, Mycobacterium
LAESFLPNRFRLLVRCARVAAVRRAVIA

SEQ ID NO: 830814 - protein, 23 aa, Mycobacterium
LAESIRAWPDQRALARRIEAAGW

SEQ ID NO: 830815 - protein, 30 aa, Mycobacterium
LAESLRLHYYVPIHLVQRYLPGMRDRRFGR

SEQ ID NO: 830816 - protein, 31 aa, Mycobacterium
LAESPLSTVYYWMFGGWLRKRRNIRDMTKTL

SEQ ID NO: 830817 - protein, 31 aa, Mycobacterium
LAETAPILWGDMPTLPLYRQQRTLLMSKKMY

SEQ ID NO: 830818 - protein, 21 aa, Mycobacterium
LAETAPIWWPGSPESAAPITD

SEQ ID NO: 830819 - protein, 26 aa, Mycobacterium
LAETERLKFLVAFRPGLMPPTLAAQQ

SEQ ID NO: 830820 - protein, 22 aa, Mycobacterium
LAETLTYLLYMATGQAPMIPLD

SEQ ID NO: 830821 - protein, 22 aa, Mycobacterium
LAETPVRLISMARPLLSDPEWV

SEQ ID NO: 830822 - protein, 26 aa, Mycobacterium
LAETTIGIPYLEGWVPRVMADGRTAS

SEQ ID NO: 830823 - protein, 24 aa, Mycobacterium
LAEVHPHWIVLRTVIDVIEPIELP

SEQ ID NO: 830824 - protein, 24 aa, Mycobacterium
LAEVTSSLIAMPRAQRAALGPMHE

SEQ ID NO: 830825 - protein, 18 aa, Mycobacterium
LAEWSERFATLAGPWAPV

SEQ ID NO: 830826 - protein, 24 aa, Mycobacterium
LAEWSERFVTLAGPWAPVQDTLQA

SEQ ID NO: 830827 - protein, 31 aa, Mycobacterium
LAEWTEIFDAEPDFFWSPINSLEDIVADEQF

SEQ ID NO: 830828 - protein, 24 aa, Mycobacterium
LAEWTEVFAAHPDLFWSPINSMED

SEQ ID NO: 830829 - protein, 19 aa, Mycobacterium
LAEYRRFPELPGTLVALKA

SEQ ID NO: 830830 - protein, 27 aa, Mycobacterium
LAEYSIDLFTLLPLGELWVAAARMRQV

SEQ ID NO: 830831 - protein, 30 aa, Mycobacterium
LAEYVAFPEDWFVRAPWSLGDAEAATLPCS

SEQ ID NO: 830832 - protein, 21 aa, Mycobacterium
LAEYVGAAAGLLFSSGYTANL

SEQ ID NO: 830833 - protein, 21 aa, Mycobacterium
LAEYVGASSGLLFSSGYTANL

SEQ ID NO: 830834 - protein, 29 aa, Mycobacterium
LAFAGIHQLCLPLLPRLGHLPVPQRDALE

SEQ ID NO: 830835 - protein, 18 aa, Mycobacterium
LAFAKLFAEAGFPPGVIN

SEQ ID NO: 830836 - protein, 24 aa, Mycobacterium
LAFAKTPPTVVMLAGLQGAGKTTL

SEQ ID NO: 830837 - protein, 19 aa, Mycobacterium
LAFAKTPPTVVMLAGLQGS

SEQ ID NO: 830838 - protein, 25 aa, Mycobacterium
LAFARNPPTVIMLAGLQGSGKTTLA

SEQ ID NO: 830839 - protein, 18 aa, Mycobacterium
LAFARPDHILFGSDFPYA

SEQ ID NO: 830840 - protein, 26 aa, Mycobacterium
LAFARVPAALLRWGVSQFDADMRPDQ

SEQ ID NO: 830841 - protein, 18 aa, Mycobacterium
LAFDFSVWEIFGALLHGG

SEQ ID NO: 830842 - protein, 17 aa, Mycobacterium
LAFGRVKDDLRRSQTER

SEQ ID NO: 830843 - protein, 19 aa, Mycobacterium
LAFGTIYAEAQRRYFESVA

SEQ ID NO: 830844 - protein, 20 aa, Mycobacterium
LAFGTIYAEAQRRYFESVAP

SEQ ID NO: 830845 - protein, 18 aa, Mycobacterium
LAFGTQMEMMLLHAVTNW

SEQ ID NO: 830846 - protein, 26 aa, Mycobacterium
LAFIHGMEMTWLLDPSIPLTEVFKEY

SEQ ID NO: 830847 - protein, 18 aa, Mycobacterium
LAFINADYTLTLSRLPRG

SEQ ID NO: 830848 - protein, 17 aa, Mycobacterium
LAFLASAGWNRPADRPT

SEQ ID NO: 830849 - protein, 17 aa, Mycobacterium
LAFLAVNSTYRGPFTPG

SEQ ID NO: 830850 - protein, 17 aa, Mycobacterium
LAFMADGGYRRQELWTE

SEQ ID NO: 830851 - protein, 24 aa, Mycobacterium
LAFNARIALHVRTLYGRDPHHITE

SEQ ID NO: 830852 - protein, 24 aa, Mycobacterium
LAFTGRRLFAVIVLTIRGSRIAKL

SEQ ID NO: 830853 - protein, 28 aa, Mycobacterium
LAFVAALQVLPPRQIAVLVLRDVLGFRT

SEQ ID NO: 830854 - protein, 23 aa, Mycobacterium
LAFVRFRIDGKDWPAGPLPSLRM

SEQ ID NO: 830855 - protein, 19 aa, Mycobacterium
LAGAEQAILLVPLEPDVPA

SEQ ID NO: 830856 - protein, 17 aa, Mycobacterium
LAGAFAVAWEWDNNRLV

SEQ ID NO: 830857 - protein, 35 aa, Mycobacterium; identical to SEQ ID NO: 219859

SEQ ID NO: 830858 - protein, 17 aa, Mycobacterium
LAGALSLHDALLVTYHR

SEQ ID NO: 830859 - protein, 35 aa, Mycobacterium
LAGATHLILAGTRKPVWFFAYPGKPSELAPEDAQV

SEQ ID NO: 830860 - protein, 17 aa, Mycobacterium
LAGAVLGGFEAWLLLRS

SEQ ID NO: 830861 - protein, 31 aa, Mycobacterium
LAGAVPQRAGWFRFYFEGHRWVWSDQVQRMH

SEQ ID NO: 830862 - protein, 19 aa, Mycobacterium
LAGDYLFATASRLVSRLGP

SEQ ID NO: 830863 - protein, 19 aa, Mycobacterium
LAGEAILFTRAHATAPLCS

SEQ ID NO: 830864 - protein, 24 aa, Mycobacterium
LAGELWAIPDGQTWVFPILQFETG

SEQ ID NO: 830865 - protein, 24 aa, Mycobacterium
LAGELYIVGLATYCASKHAVVAFT

SEQ ID NO: 830866 - protein, 25 aa, Mycobacterium
LAGETGCRLLLPEGADPFVALFSES

SEQ ID NO: 830867 - protein, 19 aa, Mycobacterium
LAGFCDVALVIGADTTPKG

SEQ ID NO: 830868 - protein, 18 aa, Mycobacterium
LAGFCDVALVVGADTTPK

SEQ ID NO: 830869 - protein, 17 aa, Mycobacterium
LAGFRRLGARHQQFARA

SEQ ID NO: 830870 - protein, 27 aa, Mycobacterium
LAGFTVNHRFSLPGMPAPYVIAQVAIA

SEQ ID NO: 830871 - protein, 25 aa, Mycobacterium
LAGGAGPFALLYRPESGAPDTVDVV

SEQ ID NO: 830872 - protein, 18 aa, Mycobacterium
LAGGCFWGMQDLIRKQPG

SEQ ID NO: 830873 - protein, 20 aa, Mycobacterium
LAGGFAHRTLFEGLDVTVAP

SEQ ID NO: 830874 - protein, 20 aa, Mycobacterium
LAGGRFVYQRRLGAGSTAVG

SEQ ID NO: 830875 - protein, 22 aa, Mycobacterium
LAGGRIVVFPTASSVPDEVGAE

SEQ ID NO: 830876 - protein, 23 aa, Mycobacterium
LAGGTWLMSQPQPGLRRLVDLTG

SEQ ID NO: 830877 - protein, 18 aa, Mycobacterium
LAGHPIGNLILAGLNEVL

SEQ ID NO: 830878 - protein, 20 aa, Mycobacterium
LAGHPIGNLILAGLSEVLAD

SEQ ID NO: 830879 - protein, 19 aa, Mycobacterium
LAGHPIGNLILAGLTDMLA

SEQ ID NO: 830880 - protein, 18 aa, Mycobacterium
LAGHPIGNLMLAGLSEVL

SEQ ID NO: 830881 - protein, 18 aa, Mycobacterium
LAGIARDMQEVCPDAWLL

SEQ ID NO: 830882 - protein, 20 aa, Mycobacterium
LAGIFVGNPTPLPAALGVFP

SEQ ID NO: 830883 - protein, 24 aa, Mycobacterium
LAGIGRWLHTLGYRGHITTKSRHY

SEQ ID NO: 830884 - protein, 17 aa, Mycobacterium
LAGIITIVARFPRTVHL

SEQ ID NO: 830885 - protein, 22 aa, Mycobacterium
LAGIRVLELGNFIAAPTAGRIL

SEQ ID NO: 830886 - protein, 25 aa, Mycobacterium
LAGKYVPFPVLAQAVLRMLGDVHRV

SEQ ID NO: 830887 - protein, 18 aa, Mycobacterium
LAGLASVTPPMRLRPKIL

SEQ ID NO: 830888 - protein, 20 aa, Mycobacterium
LAGLATAPIMTSLNSAFTSL

SEQ ID NO: 830889 - protein, 29 aa, Mycobacterium
LAGLCGALRRYHEAFGVPISTLPMAVPVN

SEQ ID NO: 830890 - protein, 28 aa, Mycobacterium
LAGLCGALRRYHEALGMPISTLPMAVPV

SEQ ID NO: 830891 - protein, 29 aa, Mycobacterium
LAGLCGALRRYHEALGVPISTLPMAVPVN

SEQ ID NO: 830892 - protein, 21 aa, Mycobacterium
LAGLFGGRRQLIVYRAFYGPD

SEQ ID NO: 830893 - protein, 17 aa, Mycobacterium
LAGLFHRGAGLQILVRE

SEQ ID NO: 830894 - protein, 28 aa, Mycobacterium
LAGLGYAGHFDFGGARRPIAEFDPAQHQ

SEQ ID NO: 830895 - protein, 37 aa, Mycobacterium
LAGLIIDAPGFPGWDSFGAMVTHFRFVRDHHKHVKKV

SEQ ID NO: 830896 - protein, 24 aa, Mycobacterium
LAGLPEHLPLPTDRPYPPIADYRG

SEQ ID NO: 830897 - protein, 17 aa, Mycobacterium
LAGLPFSGPVGGVRVAL

SEQ ID NO: 830898 - protein, 18 aa, Mycobacterium
LAGLPFSGPVGGVRVALI

SEQ ID NO: 830899 - protein, 26 aa, Mycobacterium
LAGLPGAVRRRVIRAWLLTNGGTDLT

SEQ ID NO: 830900 - protein, 18 aa, Mycobacterium
LAGLPNPRLARDLAVGLV

SEQ ID NO: 830901 - protein, 17 aa, Mycobacterium
LAGLPPALITTAGFDPL

SEQ ID NO: 830902 - protein, 18 aa, Mycobacterium
LAGLRDYFRDHAFGNATF

SEQ ID NO: 830903 - protein, 17 aa, Mycobacterium
LAGLTPAPCRHVRPPRI

SEQ ID NO: 830904 - protein, 17 aa, Mycobacterium
LAGMGKRVLSWRGGERM

SEQ ID NO: 830905 - protein, 18 aa, Mycobacterium
LAGMPYDAFRTLRREAPV

SEQ ID NO: 830906 - protein, 18 aa, Mycobacterium
LAGMSWLTGVPVEVETCH

SEQ ID NO: 830907 - protein, 31 aa, Mycobacterium
LAGMTPTDFFRAPLARLPGVDAALDAYMGTP

SEQ ID NO: 830908 - protein, 22 aa, Mycobacterium
LAGMVINPILPSLRDHELRFIL

SEQ ID NO: 830909 - protein, 30 aa, Mycobacterium
LAGNALLDLFLRIIVELFQRHWSSTEHQQP

SEQ ID NO: 830910 - protein, 29 aa, Mycobacterium
LAGNRSPLPELLPSLRRGGVAAVSPVGVL

SEQ ID NO: 830911 - protein, 30 aa, Mycobacterium
LAGNTLLDLFLRIIVELFRRHWTSTGQEPP

SEQ ID NO: 830912 - protein, 20 aa, Mycobacterium
LAGPRPVRINSWSQLTADVT

SEQ ID NO: 830913 - protein, 24 aa, Mycobacterium
LAGPWTEGLLFALGGPIYAGTNEI

SEQ ID NO: 830914 - protein, 17 aa, Mycobacterium
LAGQAWADAAGGTSGAL

SEQ ID NO: 830915 - protein, 22 aa, Mycobacterium
LAGQAWQGPAAQAMAAAAAPYA

SEQ ID NO: 830916 - protein, 24 aa, Mycobacterium
LAGQFRRISYAWIPRARNAHADRL

SEQ ID NO: 830917 - protein, 26 aa, Mycobacterium
LAGQGFDNLLLAYPTTDRTGLRELGE

SEQ ID NO: 830918 - protein, 25 aa, Mycobacterium
LAGQGKLFGYRYQGFWKPADTFKER

SEQ ID NO: 830919 - protein, 24 aa, Mycobacterium
LAGQPFLLTAGFFETHRPYPHERY

SEQ ID NO: 830920 - protein, 19 aa, Mycobacterium
LAGQRRLVSAIAGGAPMYE

SEQ ID NO: 830921 - protein, 18 aa, Mycobacterium
LAGRARFTPQLTLAYRDA

SEQ ID NO: 830922 - protein, 21 aa, Mycobacterium
LAGRATTLLALARLAGQPAVV

SEQ ID NO: 830923 - protein, 20 aa, Mycobacterium
LAGRFHFTLTFNSYTPDEIV

SEQ ID NO: 830924 - protein, 24 aa, Mycobacterium
LAGRHLRKHPNAQPVVLVVTDGEP

SEQ ID NO: 830925 - protein, 26 aa, Mycobacterium
LAGRLGIPQPEKLRRYKKGQPALAGP

SEQ ID NO: 830926 - protein, 19 aa, Mycobacterium
LAGRRRLAAAIAGGTPMYE

SEQ ID NO: 830927 - protein, 19 aa, Mycobacterium
LAGSALLRRFQSEGFTNLV

SEQ ID NO: 830928 - protein, 24 aa, Mycobacterium
LAGSTIFILALPCPMCLGALYYCS

SEQ ID NO: 830929 - protein, 21 aa, Mycobacterium
LAGTVLRFVPPVAALSRSSVT

SEQ ID NO: 830930 - protein, 21 aa, Mycobacterium
LAGVGRWLHTLGYRGHIISKS

SEQ ID NO: 830931 - protein, 25 aa, Mycobacterium
LAGVRPYLTLGTRISALLNSEYRTV

SEQ ID NO: 830932 - protein, 31 aa, Mycobacterium
LAGVTSRGLLRAPLLDRPLPTLLVCGSHTTG

SEQ ID NO: 830933 - protein, 18 aa, Mycobacterium
LAGVWKTVKAGVPHLLAG

SEQ ID NO: 830934 - protein, 17 aa, Mycobacterium
LAGVWKTVKAGVPHLLS

SEQ ID NO: 830935 - protein, 17 aa, Mycobacterium
LAGWVARRRDHGGVIFI

SEQ ID NO: 830936 - protein, 17 aa, Mycobacterium
LAGWWAEQFGGTTQELL

SEQ ID NO: 830937 - protein, 35 aa, Mycobacterium
LAGYHREMVEHFSLEIIPWADFIGRWTAEENLHAI

SEQ ID NO: 830938 - protein, 17 aa, Mycobacterium
LAGYHRVEVRTVLAPAW

SEQ ID NO: 830939 - protein, 22 aa, Mycobacterium
LAGYMHRELLGASPPDAPVAAP

SEQ ID NO: 830940 - protein, 23 aa, Mycobacterium
LAGYPLVNLKVTLLDGAFHEVDS

SEQ ID NO: 830941 - protein, 25 aa, Mycobacterium
LAGYPVHIAKMFGLIYGGDHTDTAA

SEQ ID NO: 830942 - protein, 18 aa, Mycobacterium
LAGYRKAALPDGSAVAIV

SEQ ID NO: 830943 - protein, 22 aa, Mycobacterium
LAGYRRAGKPLWRARLVATVQP

SEQ ID NO: 830944 - protein, 24 aa, Mycobacterium
LAGYVRKGSLWPATFGLACCAIEM

SEQ ID NO: 830945 - protein, 27 aa, Mycobacterium
LAHAGAALPPLLSQLAARPARRVLDPT

SEQ ID NO: 830946 - protein, 20 aa, Mycobacterium
LAHAMAVMCGASLIFQYDVT

SEQ ID NO: 830947 - protein, 27 aa, Mycobacterium
LAHAPMVNHWWQVTLYVTPRGLTTSAI

SEQ ID NO: 830948 - protein, 26 aa, Mycobacterium
LAHAQAVQFGFVLVAAAFAAGESGGE

SEQ ID NO: 830949 - protein, 25 aa, Mycobacterium
LAHAVAFLLDDLASYVTGAVLTVDG

SEQ ID NO: 830950 - protein, 25 aa, Mycobacterium
LAHDMLCLTFNGLSKAYRVAGYRAG

SEQ ID NO: 830951 - protein, 24 aa, Mycobacterium
LAHDPRVLSIAQFWHRAAQHERIV

SEQ ID NO: 830952 - protein, 21 aa, Mycobacterium
LAHFDPKFERVDFVDKILHNS

SEQ ID NO: 830953 - protein, 34 aa, Mycobacterium
LAHGQPELIRRILRPLFTGEELWCQLFSEPGAGS

SEQ ID NO: 830954 - protein, 21 aa, Mycobacterium
LAHGWIPSGISLPAGVRLLEP

SEQ ID NO: 830955 - protein, 17 aa, Mycobacterium
LAHHAVEPPPSGLAAQR

SEQ ID NO: 830956 - protein, 28 aa, Mycobacterium
LAHHSATLPPLLSQLATRPARRVLEHTD

SEQ ID NO: 830957 - protein, 18 aa, Mycobacterium
LAHLDALRVPYVINPRMV

SEQ ID NO: 830958 - protein, 19 aa, Mycobacterium
LAHLPTYANWLAQQDWTRP

SEQ ID NO: 830959 - protein, 24 aa, Mycobacterium
LAHLRNRPVLADPLKALTARHDEI

SEQ ID NO: 830960 - protein, 27 aa, Mycobacterium
LAHNALQLAVYRLAWARLHGCPTSAVR

SEQ ID NO: 830961 - protein, 18 aa, Mycobacterium
LAHNLVVSAPPLGWLRKF

SEQ ID NO: 830962 - protein, 20 aa, Mycobacterium
LAHNPLEFLYGAFADYVRDR

SEQ ID NO: 830963 - protein, 27 aa, Mycobacterium
LAHPHGQIYAYPFITAKTARVLSNVDT

SEQ ID NO: 830964 - protein, 20 aa, Mycobacterium
LAHPLLPPWMVTESGPDGVR

SEQ ID NO: 830965 - protein, 23 aa, Mycobacterium
LAHPYLTPPSHTRWARELLGPDA

SEQ ID NO: 830966 - protein, 21 aa, Mycobacterium
LAHRLRQAGLVTALYSPAGHS

SEQ ID NO: 830967 - protein, 18 aa, Mycobacterium
LAHRPVLRALATALEREN

SEQ ID NO: 830968 - protein, 18 aa, Mycobacterium
LAHRYELVDARLSEAGLT

SEQ ID NO: 830969 - protein, 18 aa, Mycobacterium
LAHSAGYVELFYGRPRNQ

SEQ ID NO: 830970 - protein, 18 aa, Mycobacterium
LAHSAGYVELFYGRPRTQ

SEQ ID NO: 830971 - protein, 20 aa, Mycobacterium
LAHSIGLLDSKLLITEAEFE

SEQ ID NO: 830972 - protein, 24 aa, Mycobacterium
LAHTGAREFVFVGAPLPVVGATGA

SEQ ID NO: 830973 - protein, 21 aa, Mycobacterium
LAHTRLRAHADLDRLAESVVD

SEQ ID NO: 830974 - protein, 20 aa, Mycobacterium
LAHVAIVACKYTELAPAALA

SEQ ID NO: 830975 - protein, 20 aa, Mycobacterium
LAHVGVRVNAIAPGLIRSAM

SEQ ID NO: 830976 - protein, 22 aa, Mycobacterium
LAHVPTYSRWLAQQDWAKPYQR

SEQ ID NO: 830977 - protein, 19 aa, Mycobacterium
LAHYTRLSALDLAPRIRVN

SEQ ID NO: 830978 - protein, 31 aa, Mycobacterium
LAIAAGHCFVIFLREGFPVSVLNPVKAVPEV

SEQ ID NO: 830979 - protein, 25 aa, Mycobacterium
LAIAAGVNLLLAPAVFHGFDQAGVL

SEQ ID NO: 830980 - protein, 17 aa, Mycobacterium
LAIAMRPRLWVFNSVGR

SEQ ID NO: 830981 - protein, 26 aa, Mycobacterium
LAICERYLRNAPARIVLACLPDDPGR

SEQ ID NO: 830982 - protein, 27 aa, Mycobacterium
LAICQRYLRNAPARIVLACLPDDPGRD

SEQ ID NO: 830983 - protein, 23 aa, Mycobacterium
LAIDGVSWRILLDDLNSVWEQHR

SEQ ID NO: 830984 - protein, 35 aa, Mycobacterium
LAIDIEAAFLEYLDMFYNLGLAGRAMRRIGAIEFA

SEQ ID NO: 830985 - protein, 20 aa, Mycobacterium
LAIDWLDRWADDMPLSLLGT

SEQ ID NO: 830986 - protein, 17 aa, Mycobacterium
LAIERVELRLLGPEYKS

SEQ ID NO: 830987 - protein, 18 aa, Mycobacterium
LAIGHYFKRLTALQFEFG

SEQ ID NO: 830988 - protein, 24 aa, Mycobacterium
LAIGHYFKRLTALQYEYGSTAAHV

SEQ ID NO: 830989 - protein, 31 aa, Mycobacterium
LAIGNAPTALFRLLELLDEGAPTPAAVLGGP

SEQ ID NO: 830990 - protein, 30 aa, Mycobacterium
LAIGSRVPHLPWPFGALNFAARMLRPSPGT

SEQ ID NO: 830991 - protein, 19 aa, Mycobacterium
LAILTARHLNCWVLGTVRK

SEQ ID NO: 830992 - protein, 19 aa, Mycobacterium
LAIMSAATTRWVWVRDVDV

SEQ ID NO: 830993 - protein, 25 aa, Mycobacterium
LAINRVLHGILPCPDYPAALRESAP

SEQ ID NO: 830994 - protein, 21 aa, Mycobacterium
LAIRLHDSVGATLFSLRVALM

SEQ ID NO: 830995 - protein, 24 aa, Mycobacterium
LAIRRRHEVALSAKPRRDFGPDGR

SEQ ID NO: 830996 - protein, 17 aa, Mycobacterium
LAIVASTWHSQICDALL

SEQ ID NO: 830997 - protein, 21 aa, Mycobacterium
LAIVDAFLTTPWSEAERHQRR

SEQ ID NO: 830998 - protein, 24 aa, Mycobacterium
LAIVDAFVTTPWSKAERHQRRIDI

SEQ ID NO: 830999 - protein, 28 aa, Mycobacterium
LAIVFQDALTALNPLYTVGTQLAEPFRI

SEQ ID NO: 831000 - protein, 29 aa, Mycobacterium
LAIVGGRWKFLIVWQLAVQGAQRYGQLRA

SEQ ID NO: 831001 - protein, 17 aa, Mycobacterium
LAKAFEGVPAVAGIDLD

SEQ ID NO: 831002 - protein, 27 aa, Mycobacterium
LAKASFLAGLIFRTALRKKYEDKAASE

SEQ ID NO: 831003 - protein, 19 aa, Mycobacterium
LAKATLPIMNPGGSIVGMD

SEQ ID NO: 831004 - protein, 23 aa, Mycobacterium
LAKDGIAMMRFDALGLGDSDGDW

SEQ ID NO: 831005 - protein, 22 aa, Mycobacterium
LAKFRDAEALTFPLLSDPDRKA

SEQ ID NO: 831006 - protein, 17 aa, Mycobacterium
LAKGFPKPMGWGVRLTG

SEQ ID NO: 831007 - protein, 32 aa, Mycobacterium
LAKGSLAHVPGLYRLLRIPPEAVDYFAHPTFY

SEQ ID NO: 831008 - protein, 25 aa, Mycobacterium
LAKHRKLLGDWLAAQPGLVAELARD

SEQ ID NO: 831009 - protein, 26 aa, Mycobacterium
LAKHRRLLGEWLATQPGLVAELARDE

SEQ ID NO: 831010 - protein, 18 aa, Mycobacterium
LAKKPYVWGSIYQFEGQI

SEQ ID NO: 831011 - protein, 19 aa, Mycobacterium
LAKKYTWAHRLVAVVSDGS

SEQ ID NO: 831012 - protein, 17 aa, Mycobacterium
LAKLGFTQSYSYFTWRT

SEQ ID NO: 831013 - protein, 22 aa, Mycobacterium
LAKLGFTQSYSYFTWRTAKQEL

SEQ ID NO: 831014 - protein, 21 aa, Mycobacterium
LAKLRAAFTASPWAARTPIAV

SEQ ID NO: 831015 - protein, 17 aa, Mycobacterium
LAKLRDRSWRDVRPGGG

SEQ ID NO: 831016 - protein, 18 aa, Mycobacterium
LAKLRWLDRATGRVVRRM

SEQ ID NO: 831017 - protein, 21 aa, Mycobacterium
LAKLVNTLLDFSRIEAGRMRA

SEQ ID NO: 831018 - protein, 22 aa, Mycobacterium
LAKMTINLIFNAIADAMPDLKP

SEQ ID NO: 831019 - protein, 23 aa, Mycobacterium
LAKPGRLAGPDPSLLAAAYAGLS

SEQ ID NO: 831020 - protein, 17 aa, Mycobacterium
LAKPWGLAATPVQQVII

SEQ ID NO: 831021 - protein, 27 aa, Mycobacterium
LAKQANFMAQLQLWARRGHPTLADIVE

SEQ ID NO: 831022 - protein, 26 aa, Mycobacterium
LAKQAQYIAQLQVWAIRSHPSSADIA

SEQ ID NO: 831023 - protein, 25 aa, Mycobacterium
LAKRDSEWMGRVHRFLGLDVGVILS

SEQ ID NO: 831024 - protein, 17 aa, Mycobacterium
LAKRIGAIVASAIEYEI

SEQ ID NO: 831025 - protein, 24 aa, Mycobacterium
LAKRKLLPGMAYLDQSELAPHIQV

SEQ ID NO: 831026 - protein, 20 aa, Mycobacterium
LAKRQWQGMFTWMGEPEEFA

SEQ ID NO: 831027 - protein, 25 aa, Mycobacterium
LAKVTCPLLDLPIVSPYLGRRYTEC

SEQ ID NO: 831028 - protein, 24 aa, Mycobacterium
LAKYVERLLPAPRTANAGSAPATE

SEQ ID NO: 831029 - protein, 20 aa, Mycobacterium
LALAAAYPRNKECLWRLVAL

SEQ ID NO: 831030 - protein, 19 aa, Mycobacterium
LALAAGVNLLLSPAGTRGL

SEQ ID NO: 831031 - protein, 20 aa, Mycobacterium
LALAAPTFQQLIARASDRPD

SEQ ID NO: 831032 - protein, 17 aa, Mycobacterium
LALACDVVIAAAGTMIG

SEQ ID NO: 831033 - protein, 30 aa, Mycobacterium
LALAEISEVLFPPASWMFGAAGREHMQQYG

SEQ ID NO: 831034 - protein, 25 aa, Mycobacterium
LALAICHCWRAPMLARMAKAEAVAE

SEQ ID NO: 831035 - protein, 19 aa, Mycobacterium
LALCLAADIRICSAAATFG

SEQ ID NO: 831036 - protein, 20 aa, Mycobacterium
LALCLAADIRICSAAATFGN

SEQ ID NO: 831037 - protein, 18 aa, Mycobacterium
LALCQATRQVIANGLGIL

SEQ ID NO: 831038 - protein, 19 aa, Mycobacterium
LALCRATRQVIANGLAILG

SEQ ID NO: 831039 - protein, 17 aa, Mycobacterium
LALCTLTADLALRIADH

SEQ ID NO: 831040 - protein, 17 aa, Mycobacterium
LALDFADLPASPCLASR

SEQ ID NO: 831041 - protein, 23 aa, Mycobacterium
LALDLRDRLRRWTGQSVPAARLL

SEQ ID NO: 831042 - protein, 18 aa, Mycobacterium
LALDRSFADWGMRLVFLR

SEQ ID NO: 831043 - protein, 19 aa, Mycobacterium
LALEDLKYFRDAMRIPIDD

SEQ ID NO: 831044 - protein, 27 aa, Mycobacterium
LALEDQLLDRARYLKALAVAAELPDVE

SEQ ID NO: 831045 - protein, 22 aa, Mycobacterium
LALEETFMFYLPRICEHCLNPS

SEQ ID NO: 831046 - protein, 24 aa, Mycobacterium
LALEGQLLDRSRYVKALAVAAKHQ

SEQ ID NO: 831047 - protein, 22 aa, Mycobacterium
LALESLILMTLGLADLLSGGSE

SEQ ID NO: 831048 - protein, 19 aa, Mycobacterium
LALFRSWRLHEDLGLNVVM

SEQ ID NO: 831049 - protein, 19 aa, Mycobacterium
LALFVVLDTLPPEQRLAFV

SEQ ID NO: 831050 - protein, 23 aa, Mycobacterium
LALGWAHRLVGLQGGRKVLDRPA

SEQ ID NO: 831051 - protein, 17 aa, Mycobacterium
LALHQPGNPVVLPTVWD

SEQ ID NO: 831052 - protein, 18 aa, Mycobacterium
LALHYLRDWQVPLASFAR

SEQ ID NO: 831053 - protein, 17 aa, Mycobacterium
LALIALSAKMRIDQIEE

SEQ ID NO: 831054 - protein, 17 aa, Mycobacterium
LALKPDCVVYNPMWIDV

SEQ ID NO: 831055 - protein, 27 aa, Mycobacterium
LALLEVRDLLFARLLQYRAFKHVAEMF

SEQ ID NO: 831056 - protein, 29 aa, Mycobacterium
LALLEVRDLLFARLLQYRAFKHVAQMFAE

SEQ ID NO: 831057 - protein, 23 aa, Mycobacterium
LALLGFRGRPPVHRNAGAGPSAD

SEQ ID NO: 831058 - protein, 26 aa, Mycobacterium
LALLGVPRLVLAVNKIDLVPDSARIF

SEQ ID NO: 831059 - protein, 17 aa, Mycobacterium
LALLMRHHLVLMSRFDP

SEQ ID NO: 831060 - protein, 19 aa, Mycobacterium
LALLNAGVPLKAPVAGIAM

SEQ ID NO: 831061 - protein, 23 aa, Mycobacterium
LALLREAVHVFGFHLCGLDLRQN

SEQ ID NO: 831062 - protein, 19 aa, Mycobacterium
LALLRLACEAADAALTDLV

SEQ ID NO: 831063 - protein, 21 aa, Mycobacterium
LALMMLTMDPPRHTALRALVS

SEQ ID NO: 831064 - protein, 17 aa, Mycobacterium
LALMRTLMDDVTIQAGT

SEQ ID NO: 831065 - protein, 19 aa, Mycobacterium
LALPALLRERGITGRDAAF

SEQ ID NO: 831066 - protein, 18 aa, Mycobacterium
LALPVEGWMRPWPEADGG

SEQ ID NO: 831067 - protein, 17 aa, Mycobacterium
LALPVIKADYRAFDAYC

SEQ ID NO: 831068 - protein, 18 aa, Mycobacterium
LALPVPSLVISQLLGVPY

SEQ ID NO: 831069 - protein, 17 aa, Mycobacterium
LALQLRRERPGTRVVMI

SEQ ID NO: 831070 - protein, 34 aa, Mycobacterium
LALRADGITAPVLAWLHPPGIDFGPALVADVEIA

SEQ ID NO: 831071 - protein, 18 aa, Mycobacterium
LALRALGPVLSPLARARG

SEQ ID NO: 831072 - protein, 18 aa, Mycobacterium
LALRARLMLECANVRELA

SEQ ID NO: 831073 - protein, 18 aa, Mycobacterium
LALRDQIAALRWVRDNIA

SEQ ID NO: 831074 - protein, 21 aa, Mycobacterium
LALRGWMWTQLPHDPELRKKL

SEQ ID NO: 831075 - protein, 18 aa, Mycobacterium
LALRLAAELGAVGVLAVE

SEQ ID NO: 831076 - protein, 28 aa, Mycobacterium
LALRQGKFLASRLLPWARSGHLAAPRAG

SEQ ID NO: 831077 - protein, 17 aa, Mycobacterium
LALRRFQRAGHRPIVLA

SEQ ID NO: 831078 - protein, 24 aa, Mycobacterium
LALRRHLLRLWLTTDSAATHEILR

SEQ ID NO: 831079 - protein, 33 aa, Mycobacterium
LALSAFNIGGLFFGLIPGYLSAASPPFNIVISN

SEQ ID NO: 831080 - protein, 29 aa, Mycobacterium
LALSGFVEILPTPFLPAGIFDQWGLDADD

SEQ ID NO: 831081 - protein, 25 aa, Mycobacterium
LALSPTLIFDYPNSAALAGYMHREL

SEQ ID NO: 831082 - protein, 19 aa, Mycobacterium
LALTCSLKKSPKPSSSELI

SEQ ID NO: 831083 - protein, 26 aa, Mycobacterium
LALTLGCTLILRRKFKPENVLADVEK

SEQ ID NO: 831084 - protein, 25 aa, Mycobacterium
LALTQLQLEPIVDLQMRLGEGTGAA

SEQ ID NO: 831085 - protein, 18 aa, Mycobacterium
LALVAAFDHRHVFIDPAP

SEQ ID NO: 831086 - protein, 18 aa, Mycobacterium
LALVIRQGRNWAVRQIPL

SEQ ID NO: 831087 - protein, 17 aa, Mycobacterium
LALVIRSVLQRFRRTRS

SEQ ID NO: 831088 - protein, 32 aa, Mycobacterium
LALVKPDLLRHRWWRRLRRRIVEADQLLYAEI

SEQ ID NO: 831089 - protein, 17 aa, Mycobacterium
LALWCDLRVAEEDAVFG

SEQ ID NO: 831090 - protein, 19 aa, Mycobacterium
LALWMQLHDSAFPAGRMVH

SEQ ID NO: 831091 - protein, 18 aa, Mycobacterium
LALYIERGGKSLLSFVID

SEQ ID NO: 831092 - protein, 20 aa, Mycobacterium
LALYRDWELIDVLAATVANA

SEQ ID NO: 831093 - protein, 17 aa, Mycobacterium
LAMAQFKAAALRPPSLK

SEQ ID NO: 831094 - protein, 19 aa, Mycobacterium
LAMAVQWARERHQFGRPIG

SEQ ID NO: 831095 - protein, 18 aa, Mycobacterium
LAMCSGALRYYLLEQNAL

SEQ ID NO: 831096 - protein, 20 aa, Mycobacterium
LAMDLEFLGRKDLGEYFLDR

SEQ ID NO: 831097 - protein, 19 aa, Mycobacterium
LAMDLEFLGRNDLGEYFLE

SEQ ID NO: 831098 - protein, 19 aa, Mycobacterium
LAMDLLPYERSTCFWQRIA

SEQ ID NO: 831099 - protein, 24 aa, Mycobacterium
LAMDPQQRLILEVSWEALEHAGID

SEQ ID NO: 831100 - protein, 18 aa, Mycobacterium
LAMFAIAHFGSEEHKQRW

SEQ ID NO: 831101 - protein, 28 aa, Mycobacterium
LAMFPHLEVVIAYRLLFGIYSGIVPDGI

SEQ ID NO: 831102 - protein, 17 aa, Mycobacterium
LAMIGRLDLLDDDPAWA

SEQ ID NO: 831103 - protein, 20 aa, Mycobacterium
LAMLADRYEIGTVVPGAGSG

SEQ ID NO: 831104 - protein, 21 aa, Mycobacterium
LAMLALFGCPHYDAILAGYQR

SEQ ID NO: 831105 - protein, 23 aa, Mycobacterium
LAMTHAWALEFAKAGIRFNCVQP

SEQ ID NO: 831106 - protein, 29 aa, Mycobacterium
LAMVAELSKLRLLPFRLSFDGGDAEDHAL

SEQ ID NO: 831107 - protein, 19 aa, Mycobacterium
LANAAYWGHRNPDQLAPVY

SEQ ID NO: 831108 - protein, 19 aa, Mycobacterium
LANALRSWPVLRFEVTEDP

SEQ ID NO: 831109 - protein, 17 aa, Mycobacterium
LANAVYWGHRNPDQLAT

SEQ ID NO: 831110 - protein, 21 aa, Mycobacterium
LANDLILRRLRVERPGDAVLS

SEQ ID NO: 831111 - protein, 28 aa, Mycobacterium
LANEFGAQLFRRPGLRIGHHHQPPAVQQ

SEQ ID NO: 831112 - protein, 19 aa, Mycobacterium
LANERFFGSYRRQLSLGEG

SEQ ID NO: 831113 - protein, 21 aa, Mycobacterium
LANIALLRRPAGLDQASWLTR

SEQ ID NO: 831114 - protein, 17 aa, Mycobacterium
LANIRSFRIRFTGQVWP

SEQ ID NO: 831115 - protein, 33 aa, Mycobacterium
LANLDKAKAAPLWRVLVALSIRHVGPTAARALA

SEQ ID NO: 831116 - protein, 17 aa, Mycobacterium
LANLGDYNVGFGNAGSL

SEQ ID NO: 831117 - protein, 26 aa, Mycobacterium
LANLGYRGFWMGYFAARSAPLGQVAP

SEQ ID NO: 831118 - protein, 17 aa, Mycobacterium
LANLLGAYRDRHDVIVL

SEQ ID NO: 831119 - protein, 19 aa, Mycobacterium
LANLMFTSELQRRLVASGS

SEQ ID NO: 831120 - protein, 18 aa, Mycobacterium
LANNHILDFGYQGLTDTV

SEQ ID NO: 831121 - protein, 23 aa, Mycobacterium
LANNPISALLQLGADLANGYTAT

SEQ ID NO: 831122 - protein, 25 aa, Mycobacterium
LANPAQVVPQDLLGAINAPVLALTG

SEQ ID NO: 831123 - protein, 24 aa, Mycobacterium
LANPDEIGWTAAFLASPLSSYVTG

SEQ ID NO: 831124 - protein, 20 aa, Mycobacterium
LANQIWRTNVLGAYHVAQSA

SEQ ID NO: 831125 - protein, 24 aa, Mycobacterium
LANQSCITLHMWQSRRARLDHPDR

SEQ ID NO: 831126 - protein, 20 aa, Mycobacterium
LANRAAHLPGLGAAALAAAG

SEQ ID NO: 831127 - protein, 20 aa, Mycobacterium
LANRRVALYVLPRTLDDVPA

SEQ ID NO: 831128 - protein, 25 aa, Mycobacterium
LANRSSGGLYRWERRYLRGDDQAEL

SEQ ID NO: 831129 - protein, 24 aa, Mycobacterium
LANSFALLAPGLKRIRKRIAQYHD

SEQ ID NO: 831130 - protein, 24 aa, Mycobacterium
LANSTTDWLFSGKLQKYPDLKIVL

SEQ ID NO: 831131 - protein, 25 aa, Mycobacterium
LANTELLASFLRLVSTTLGNVIQTD

SEQ ID NO: 831132 - protein, 25 aa, Mycobacterium
LANTSVPIHPPLAARWSPRAFDAAA

SEQ ID NO: 831133 - protein, 27 aa, Mycobacterium
LANYFAGAFLLPYKQFHHAAESSRYDV

SEQ ID NO: 831134 - protein, 25 aa, Mycobacterium
LANYRGHWLVARTIEHIGGWANRPL

SEQ ID NO: 831135 - protein, 17 aa, Mycobacterium
LAPAALWSDEVFNRVVA

SEQ ID NO: 831136 - protein, 39 aa, Mycobacterium
LAPAAQPPPSFAPGLPSLGAMPGGLPLPGVPGGDAMDPA

SEQ ID NO: 831137 - protein, 26 aa, Mycobacterium
LAPAGRDLLYLLAPTPNLSSTAIDWE

SEQ ID NO: 831138 - protein, 26 aa, Mycobacterium
LAPALRLGWMVLPPEQMDAAVAATGG

SEQ ID NO: 831139 - protein, 19 aa, Mycobacterium
LAPALTREGATLVDATLGA

SEQ ID NO: 831140 - protein, 24 aa, Mycobacterium
LAPAMVAFFTAALSRDPARRPDTA

SEQ ID NO: 831141 - protein, 19 aa, Mycobacterium
LAPARTALRTWLTRTQLDP

SEQ ID NO: 831142 - protein, 27 aa, Mycobacterium
LAPAVRAIGLLDVFTPRTPRIASLLGE

SEQ ID NO: 831143 - protein, 18 aa, Mycobacterium
LAPDLTMTEGLQKLAFGE

SEQ ID NO: 831144 - protein, 23 aa, Mycobacterium
LAPDPPRKWWQPGTGELCIGFTE

SEQ ID NO: 831145 - protein, 20 aa, Mycobacterium
LAPDQRPPVHALYGFARHAD

SEQ ID NO: 831146 - protein, 18 aa, Mycobacterium
LAPDRSTVRFRTRTMWGL

SEQ ID NO: 831147 - protein, 40 aa, Mycobacterium
LAPEIMAESKRWAFYPWRKTVVSILGPRSFRALRLDRNRN

SEQ ID NO: 831148 - protein, 27 aa, Mycobacterium
LAPEPILHAALAPGALIAELGTDAQKE

SEQ ID NO: 831149 - protein, 28 aa, Mycobacterium
LAPGRYLDVPLYWQHWKFESSTLSAITS

SEQ ID NO: 831150 - protein, 18 aa, Mycobacterium
LAPHLIGPQFHPGVQRTE

SEQ ID NO: 831151 - protein, 20 aa, Mycobacterium
LAPHTWPTYVPGTDPMLSRD

SEQ ID NO: 831152 - protein, 25 aa, Mycobacterium
LAPHYQQMLWQLPAGEQRLVVELAR

SEQ ID NO: 831153 - protein, 19 aa, Mycobacterium
LAPINLVLSNVPGPSFPLY

SEQ ID NO: 831154 - protein, 26 aa, Mycobacterium
LAPKDLEKIIYFAAYVITAVDDELRH

SEQ ID NO: 831155 - protein, 25 aa, Mycobacterium
LAPKDLEKIIYFAAYVITAVDDEMR

SEQ ID NO: 831156 - protein, 25 aa, Mycobacterium
LAPKDLEKIIYFAAYVITAVDEEMR

SEQ ID NO: 831157 - protein, 19 aa, Mycobacterium
LAPKDLEKIIYFAAYVITS

SEQ ID NO: 831158 - protein, 24 aa, Mycobacterium
LAPKDLEKIIYFAAYVITSVDEEM

SEQ ID NO: 831159 - protein, 26 aa, Mycobacterium
LAPKNPLPYRRLLTLVRALDTGQLQV

SEQ ID NO: 831160 - protein, 17 aa, Mycobacterium
LAPLPVDDMAREAAATG

SEQ ID NO: 831161 - protein, 19 aa, Mycobacterium
LAPLQPGMAAPPHPVAPGS

SEQ ID NO: 831162 - protein, 19 aa, Mycobacterium
LAPLRLPSPVTTAPRVLRL

SEQ ID NO: 831163 - protein, 18 aa, Mycobacterium
LAPLTFATIFAKLVQLDF

SEQ ID NO: 831164 - protein, 24 aa, Mycobacterium
LAPLTTLRIGPVARRMLTCTSTEQ

SEQ ID NO: 831165 - protein, 25 aa, Mycobacterium
LAPLTTLRLGPVAATLIRCESTRQV

SEQ ID NO: 831166 - protein, 31 aa, Mycobacterium
LAPMSWDRNYVHSLDWRWLTEPMTPGPGECW

SEQ ID NO: 831167 - protein, 26 aa, Mycobacterium
LAPNENALIFSTRYADWIDAHVQKKY

SEQ ID NO: 831168 - protein, 19 aa, Mycobacterium
LAPNVWPQNTVRGDDGAVS

SEQ ID NO: 831169 - protein, 17 aa, Mycobacterium
LAPPEHRSGRRRGHLRV

SEQ ID NO: 831170 - protein, 26 aa, Mycobacterium
LAPPGRDLLYLLAPAPNLTAGRVDWG

SEQ ID NO: 831171 - protein, 18 aa, Mycobacterium
LAPPGWLGLPDGLTLRVA

SEQ ID NO: 831172 - protein, 38 aa, Mycobacterium
LAPPPGPLALPPMPDPLAPPPFPDPLAPPPLVPVAAGP

SEQ ID NO: 831173 - protein, 17 aa, Mycobacterium
LAPPVMPSSAAPASAGP

SEQ ID NO: 831174 - protein, 33 aa, Mycobacterium
LAPQALGFTYDSGLYLRFRASTPDDFALAYTVC

SEQ ID NO: 831175 - protein, 28 aa, Mycobacterium
LAPQGLDYVIGFFAAIKAGTIAVPLFAP

SEQ ID NO: 831176 - protein, 17 aa, Mycobacterium
LAPQRLTEGLVGNGTIG

SEQ ID NO: 831177 - protein, 26 aa, Mycobacterium
LAPQSLDYVMGFYAAIKAGTIAVPLF

SEQ ID NO: 831178 - protein, 20 aa, Mycobacterium
LAPRGVTVNAILPGNILTEG

SEQ ID NO: 831179 - protein, 20 aa, Mycobacterium
LAPRLRPCSGLTKPFPTKLT

SEQ ID NO: 831180 - protein, 20 aa, Mycobacterium
LAPRNPLPYWQQLKALKTLH

SEQ ID NO: 831181 - protein, 27 aa, Mycobacterium
LAPRNPLYGSFPALYAPSPPARCTLHW

SEQ ID NO: 831182 - protein, 17 aa, Mycobacterium
LAPRPDRTYLITGGLGA

SEQ ID NO: 831183 - protein, 20 aa, Mycobacterium
LAPRQLVLPMFVADGLTEPK

SEQ ID NO: 831184 - protein, 17 aa, Mycobacterium
LAPRRARVLFIENVGNL

SEQ ID NO: 831185 - protein, 18 aa, Mycobacterium
LAPRVSYKLNLRGPSISL

SEQ ID NO: 831186 - protein, 21 aa, Mycobacterium
LAPSLGFARYIISATTPFAVE

SEQ ID NO: 831187 - protein, 17 aa, Mycobacterium
LAPSLRRALHHVRGVKS

SEQ ID NO: 831188 - protein, 23 aa, Mycobacterium
LAPSLTTVPDALVGPCWPAVFSA

SEQ ID NO: 831189 - protein, 25 aa, Mycobacterium
LAPSVRFNPILLKPGGDRTSQLVVR

SEQ ID NO: 831190 - protein, 27 aa, Mycobacterium
LAPTGRDLFYLLAPAPNLAAGAVDWPT

SEQ ID NO: 831191 - protein, 26 aa, Mycobacterium
LAPTMITVIAWRTALVTPAALPAIDT

SEQ ID NO: 831192 - protein, 25 aa, Mycobacterium
LAPTRTALRRWLSGAKVEQGRVMEV

SEQ ID NO: 831193 - protein, 27 aa, Mycobacterium
LAPTVSTPFLIDLYPHTPTGITIAYAA

SEQ ID NO: 831194 - protein, 17 aa, Mycobacterium
LAPVFSARTRENVVLAM

SEQ ID NO: 831195 - protein, 27 aa, Mycobacterium
LAPVHVDTWGGWIWINMDPGAEPLRDY

SEQ ID NO: 831196 - protein, 19 aa, Mycobacterium
LAPVKVAVLPLSRNADLSP

SEQ ID NO: 831197 - protein, 20 aa, Mycobacterium
LAPVLGAIPSGWRNLRSGYQ

SEQ ID NO: 831198 - protein, 23 aa, Mycobacterium
LAPVRFFNPIAMRFAKRATRDDI

SEQ ID NO: 831199 - protein, 26 aa, Mycobacterium
LAPYAGRLLSRPLGEQPLRGYLTGSV

SEQ ID NO: 831200 - protein, 24 aa, Mycobacterium
LAPYVPERLAWIVKTHPEFQQYYY

SEQ ID NO: 831201 - protein, 27 aa, Mycobacterium
LAQAAIPLLPPMMDDLMRLELRHSVET

SEQ ID NO: 831202 - protein, 24 aa, Mycobacterium
LAQAIRVLMGCPFVNGLRARRRRA

SEQ ID NO: 831203 - protein, 27 aa, Mycobacterium
LAQALVNRPLLLILDEPTVGLDPIARD

SEQ ID NO: 831204 - protein, 19 aa, Mycobacterium
LAQAMHRRAHRCRVMAFVD

SEQ ID NO: 831205 - protein, 24 aa, Mycobacterium
LAQASRGWFMPPADAHDIPPESQL

SEQ ID NO: 831206 - protein, 28 aa, Mycobacterium
LAQATTPTYLRYAIYPNIVVIRQDNGSG

SEQ ID NO: 831207 - protein, 25 aa, Mycobacterium
LAQAVTSFPIKMPGLGRVGMVSAGM

SEQ ID NO: 831208 - protein, 18 aa, Mycobacterium
LAQCNWLVPVNHANGLCT

SEQ ID NO: 831209 - protein, 24 aa, Mycobacterium
LAQEWTYRFLAAAHDWALTEHAAL

SEQ ID NO: 831210 - protein, 20 aa, Mycobacterium
LAQFGSRPVDYVESLGWLGS

SEQ ID NO: 831211 - protein, 21 aa, Mycobacterium
LAQFTFVPAAGAILADWGADV

SEQ ID NO: 831212 - protein, 34 aa, Mycobacterium
LAQGIPARPVIIGPITFLLLSKAVDGGGAPIERL

SEQ ID NO: 831213 - protein, 34 aa, Mycobacterium; identical to SEQ ID NO: 120943

SEQ ID NO: 831214 - protein, 17 aa, Mycobacterium
LAQLGAELNRRIVAAHQ

SEQ ID NO: 831215 - protein, 18 aa, Mycobacterium
LAQLLATNRFGQNTAAIA

SEQ ID NO: 831216 - protein, 17 aa, Mycobacterium
LAQLLHETAHRQRYGLP

SEQ ID NO: 831217 - protein, 20 aa, Mycobacterium
LAQLMGQITRFALESVYPTV

SEQ ID NO: 831218 - protein, 19 aa, Mycobacterium
LAQLPLQVRTWIAEAAAVL

SEQ ID NO: 831219 - protein, 21 aa, Mycobacterium
LAQLRHRLLTLAHDADLVLDL

SEQ ID NO: 831220 - protein, 22 aa, Mycobacterium
LAQLRYFVKAATYLSMTKAADE

SEQ ID NO: 831221 - protein, 25 aa, Mycobacterium
LAQLSILVTLLDQGPIRMTDLAAHE

SEQ ID NO: 831222 - protein, 25 aa, Mycobacterium
LAQLSILVTLLDRGPIRMTDLAAHE

SEQ ID NO: 831223 - protein, 22 aa, Mycobacterium
LAQNICFLYHLLGGGTGDWDVP

SEQ ID NO: 831224 - protein, 25 aa, Mycobacterium
LAQQPRRGFIVLPVTRRDIDDVAGV

SEQ ID NO: 831225 - protein, 19 aa, Mycobacterium
LAQQRVIRAALGSAGLTAA

SEQ ID NO: 831226 - protein, 20 aa, Mycobacterium
LAQRAHSLLKSGYGSYLLNL

SEQ ID NO: 831227 - protein, 28 aa, Mycobacterium
LAQRGVPVNALVRAYRLGHKEMLERIID

SEQ ID NO: 831228 - protein, 20 aa, Mycobacterium
LAQRLPGYMVPAAVVGLDAL

SEQ ID NO: 831229 - protein, 24 aa, Mycobacterium
LAQRRDVTLLWPPREPGGYSLIVD

SEQ ID NO: 831230 - protein, 24 aa, Mycobacterium
LAQSSVRGLLRVAGRTYRVQRATR

SEQ ID NO: 831231 - protein, 29 aa, Mycobacterium
LAQVCESFGIPWLVIRALSDLAGSDSGLD

SEQ ID NO: 831232 - protein, 22 aa, Mycobacterium
LAQVLPAFPMYAHMLGNVSITF

SEQ ID NO: 831233 - protein, 21 aa, Mycobacterium
LAQYGIPSLLLDRWESVYPQP

SEQ ID NO: 831234 - protein, 24 aa, Mycobacterium
LARAAMQPFPSLPLVRARLDPNYG

SEQ ID NO: 831235 - protein, 17 aa, Mycobacterium
LARAFRAYTLDGIADRI

SEQ ID NO: 831236 - protein, 25 aa, Mycobacterium
LARAFYDDPVMTWLLPHDKSRLAHL

SEQ ID NO: 831237 - protein, 22 aa, Mycobacterium
LARAIAAQAPLTPWVARELAPG

SEQ ID NO: 831238 - protein, 18 aa, Mycobacterium
LARAIRFGHKVIEAAWST

SEQ ID NO: 831239 - protein, 21 aa, Mycobacterium
LARALASLPVQPARMVRGLPP

SEQ ID NO: 831240 - protein, 17 aa, Mycobacterium
LARAMVNLHRRYRITTT

SEQ ID NO: 831241 - protein, 27 aa, Mycobacterium
LARASPVRVFYYVFDLLHLDGKSTVDA

SEQ ID NO: 831242 - protein, 22 aa, Mycobacterium
LARAWERVWPASRWQRYLRAQL

SEQ ID NO: 831243 - protein, 24 aa, Mycobacterium
LARCTDVLVWGTAPQAQETYRHRL

SEQ ID NO: 831244 - protein, 23 aa, Mycobacterium
LARDDHGFILTGPDLRNVCGWTL

SEQ ID NO: 831245 - protein, 19 aa, Mycobacterium
LARDLAFIAFSAAGGELVA

SEQ ID NO: 831246 - protein, 21 aa, Mycobacterium
LARDLAFVGFSTIGGELIPRQ

SEQ ID NO: 831247 - protein, 26 aa, Mycobacterium
LAREFTFAFPVQVIARIMGLPRHDYP

SEQ ID NO: 831248 - protein, 19 aa, Mycobacterium
LAREGGLQSALWAGPEELK

SEQ ID NO: 831249 - protein, 24 aa, Mycobacterium
LARELPVFGICRGVQLLNVALGGT

SEQ ID NO: 831250 - protein, 18 aa, Mycobacterium
LAREPRRGPRLPVQNIRS

SEQ ID NO: 831251 - protein, 20 aa, Mycobacterium
LARERLLAEVLRSASRDDLV

SEQ ID NO: 831252 - protein, 25 aa, Mycobacterium
LAREVVYDRLLFEPTFSADDYRKAL

SEQ ID NO: 831253 - protein, 17 aa, Mycobacterium
LARFDVDGVIHIAGYKY

SEQ ID NO: 831254 - protein, 21 aa, Mycobacterium
LARFTADLPFALDDFQRRACA

SEQ ID NO: 831255 - protein, 24 aa, Mycobacterium
LARGAKLVLVRPAPVPGLVKPRSL

SEQ ID NO: 831256 - protein, 17 aa, Mycobacterium
LARGERLPLLGVPIAIK

SEQ ID NO: 831257 - protein, 17 aa, Mycobacterium
LARGGIPVAWEVAAALH

SEQ ID NO: 831258 - protein, 18 aa, Mycobacterium
LARGGIPVAWEVAAALHA

SEQ ID NO: 831259 - protein, 27 aa, Mycobacterium
LARGLARRGFPLLLVARRRERLDELAT

SEQ ID NO: 831260 - protein, 27 aa, Mycobacterium
LARGLARRGFPLMLVARRRERLEELAD

SEQ ID NO: 831261 - protein, 17 aa, Mycobacterium
LARGLWRGALHGVPIGV

SEQ ID NO: 831262 - protein, 38 aa, Mycobacterium
LARGPAALFLSFGDPAPYAPRIRAAGVPLICQVHNIRQ

SEQ ID NO: 831263 - protein, 22 aa, Mycobacterium
LARGSGLLPRMEPFVGELVGRG

SEQ ID NO: 831264 - protein, 25 aa, Mycobacterium
LARIDPRLRMLTPVEDYPLIDGAGR

SEQ ID NO: 831265 - protein, 36 aa, Mycobacterium
LARKKVMPAIYDLANRGLLPPSFSLVGFARRDWETQ

SEQ ID NO: 831266 - protein, 35 aa, Mycobacterium; identical to SEQ ID NO: 115689

SEQ ID NO: 831267 - protein, 36 aa, Mycobacterium
LARKKVMPAIYDLANRGLLPPTFALVGFARRDWDTE

SEQ ID NO: 831268 - protein, 36 aa, Mycobacterium
LARKKVMPAIYDLANRGLLPPTFALVGFARRDWDTQ

SEQ ID NO: 831269 - protein, 23 aa, Mycobacterium
LARKNNRHFSFGLGIHRCIGSNV

SEQ ID NO: 831270 - protein, 19 aa, Mycobacterium
LARKPWVKTTMAPGSQVVT

SEQ ID NO: 831271 - protein, 24 aa, Mycobacterium
LARLAQYLPLLSEVEQKILGCFRR

SEQ ID NO: 831272 - protein, 18 aa, Mycobacterium
LARLCDVHTIVVVLQNGV

SEQ ID NO: 831273 - protein, 26 aa, Mycobacterium
LARLDEWLHPFEKFWRARLAGLAETA

SEQ ID NO: 831274 - protein, 20 aa, Mycobacterium
LARLDGMDSLLSIVQMPAGV

SEQ ID NO: 831275 - protein, 24 aa, Mycobacterium
LARLEAHIVLRMLLERTTWIDAAE

SEQ ID NO: 831276 - protein, 19 aa, Mycobacterium
LARLERWSQVLRGRGACAT

SEQ ID NO: 831277 - protein, 32 aa, Mycobacterium
LARLFARPPVGKPLPAWPLTTDQAILTALGND

SEQ ID NO: 831278 - protein, 18 aa, Mycobacterium
LARLHMLAAADLAADGGL

SEQ ID NO: 831279 - protein, 19 aa, Mycobacterium
LARLLAGERSIEVLAGAWA

SEQ ID NO: 831280 - protein, 19 aa, Mycobacterium
LARLLAVPAPDPFAEELVL

SEQ ID NO: 831281 - protein, 20 aa, Mycobacterium
LARLPLRSLAFDVPPEYVFR

SEQ ID NO: 831282 - protein, 20 aa, Mycobacterium
LARLQRISALVDAGINLAGI

SEQ ID NO: 831283 - protein, 32 aa, Mycobacterium
LARLSSNTWFPGYAAFAHWLEALLPEITPAER

SEQ ID NO: 831284 - protein, 17 aa, Mycobacterium
LARLWATALAGLVDIGY

SEQ ID NO: 831285 - protein, 28 aa, Mycobacterium
LARMEFIINEYIRVHPLALLHPDRVSDP

SEQ ID NO: 831286 - protein, 17 aa, Mycobacterium
LARMLVAGEDPRFVARR

SEQ ID NO: 831287 - protein, 18 aa, Mycobacterium
LARMNRLMTKLALARPRR

SEQ ID NO: 831288 - protein, 18 aa, Mycobacterium
LARMTIDLMFNAIADGIP

SEQ ID NO: 831289 - protein, 18 aa, Mycobacterium
LARMTIDLMFNAIADHMP

SEQ ID NO: 831290 - protein, 17 aa, Mycobacterium
LARMTINLMFNAIADHM

SEQ ID NO: 831291 - protein, 26 aa, Mycobacterium
LARMVTGYVALYRALIAEATPPPRPP

SEQ ID NO: 831292 - protein, 24 aa, Mycobacterium
LARNAAELGLIPDTDHLELLSHEK

SEQ ID NO: 831293 - protein, 21 aa, Mycobacterium
LARNLLHFVAFTAAGEAQRLA

SEQ ID NO: 831294 - protein, 19 aa, Mycobacterium
LARNPELADLLLARAMNVP

SEQ ID NO: 831295 - protein, 22 aa, Mycobacterium
LARPDVDVVLLEPLLRRSEFLS

SEQ ID NO: 831296 - protein, 32 aa, Mycobacterium
LARQGLTRKRVLALALRLLDRGYFRAGGEQYA

SEQ ID NO: 831297 - protein, 31 aa, Mycobacterium
LARQKPHLNLRRPDPALLKQLFGTIWGTPVD

SEQ ID NO: 831298 - protein, 30 aa, Mycobacterium
LARQLFRSWYIMYFQLPVAPEHSASWVLPL

SEQ ID NO: 831299 - protein, 24 aa, Mycobacterium
LARQQLAALFRELLHRLPDIEVCG

SEQ ID NO: 831300 - protein, 23 aa, Mycobacterium
LARRAKRLIVFDVDSTLIQGEVI

SEQ ID NO: 831301 - protein, 31 aa, Mycobacterium
LARRDAEWMGPLLKALGLTVGWITADSTADE

SEQ ID NO: 831302 - protein, 19 aa, Mycobacterium
LARREAVDRVMVVRDKTRS

SEQ ID NO: 831303 - protein, 17 aa, Mycobacterium
LARRFAHLTYRGEEELD

SEQ ID NO: 831304 - protein, 23 aa, Mycobacterium
LARRIECSPLPFGRHRWVSSNGP

SEQ ID NO: 831305 - protein, 17 aa, Mycobacterium
LARRPRPRPLTRATAEL

SEQ ID NO: 831306 - protein, 19 aa, Mycobacterium
LARRPTALLAVTGASNVTG

SEQ ID NO: 831307 - protein, 17 aa, Mycobacterium
LARRRIYRSFNPQGVGI

SEQ ID NO: 831308 - protein, 32 aa, Mycobacterium
LARSGLTRKRVLALALRLLDRGYFRAGGEQYA

SEQ ID NO: 831309 - protein, 17 aa, Mycobacterium
LARSIGHVLRRGTVAVA

SEQ ID NO: 831310 - protein, 19 aa, Mycobacterium
LARSIPWGAAFDQPHDEPS

SEQ ID NO: 831311 - protein, 34 aa, Mycobacterium
LARSLNASYLDTGAMYRIVTLNALRAGVDLDDAA

SEQ ID NO: 831312 - protein, 26 aa, Mycobacterium
LARSVRDLFLGLSIMNGPDLADPYTA

SEQ ID NO: 831313 - protein, 18 aa, Mycobacterium
LARTIRRLATAPGDFYTG

SEQ ID NO: 831314 - protein, 21 aa, Mycobacterium
LARTPTDVWLDLRGADSWRIP

SEQ ID NO: 831315 - protein, 19 aa, Mycobacterium
LARTQAWTTLQQDGMLFVW

SEQ ID NO: 831316 - protein, 19 aa, Mycobacterium
LARTRAWHTDVRGGLLFVW

SEQ ID NO: 831317 - protein, 20 aa, Mycobacterium
LARTRAWHTTEVNGQLLVWH

SEQ ID NO: 831318 - protein, 28 aa, Mycobacterium
LARTRIRPHFFPFTEPSAEVDVWFASKK

SEQ ID NO: 831319 - protein, 18 aa, Mycobacterium
LARTRSWITDVKSGLLFV

SEQ ID NO: 831320 - protein, 23 aa, Mycobacterium
LARTRSWPTLEVNGQLLVWHDPE

SEQ ID NO: 831321 - protein, 22 aa, Mycobacterium
LARTRWRPMYLAAAGMLTAERP

SEQ ID NO: 831322 - protein, 19 aa, Mycobacterium
LARVDWISLDPTNRMWIND

SEQ ID NO: 831323 - protein, 17 aa, Mycobacterium
LARVFDRLVQGQFHGGN

SEQ ID NO: 831324 - protein, 23 aa, Mycobacterium
LARVPNWEVDLGRAQRLRSGPIR

SEQ ID NO: 831325 - protein, 24 aa, Mycobacterium
LARVSRSASYWHPSHPLQAHWMYD

SEQ ID NO: 831326 - protein, 22 aa, Mycobacterium
LARVSVELLLRAIDGAEPEQHV

SEQ ID NO: 831327 - protein, 17 aa, Mycobacterium
LARWTRLYPDVRAEPVI

SEQ ID NO: 831328 - protein, 22 aa, Mycobacterium
LARYAGWAMRSYLRFAQLASDP

SEQ ID NO: 831329 - protein, 20 aa, Mycobacterium
LARYEIPTALILTDAIPRTP

SEQ ID NO: 831330 - protein, 25 aa, Mycobacterium
LARYKAPKEFLFVDRVRRLGNGKAD

SEQ ID NO: 831331 - protein, 25 aa, Mycobacterium
LARYKVPRRLVLVADLPVLASGKVD

SEQ ID NO: 831332 - protein, 20 aa, Mycobacterium
LARYVLGFALQLPGATDGGG

SEQ ID NO: 831333 - protein, 25 aa, Mycobacterium
LASADPISWLLQLGADLATAYTKAM

SEQ ID NO: 831334 - protein, 19 aa, Mycobacterium
LASAFGEVWMQPSGTLGLV

SEQ ID NO: 831335 - protein, 22 aa, Mycobacterium
LASAIWLKYNLLAERQTRGVLR

SEQ ID NO: 831336 - protein, 19 aa, Mycobacterium
LASALWLKCNVLAERNSRG

SEQ ID NO: 831337 - protein, 21 aa, Mycobacterium
LASATRPWHEIFCSDVAHVLV

SEQ ID NO: 831338 - protein, 28 aa, Mycobacterium
LASDELGLPTVPFWFAGSVEELTAVAEH

SEQ ID NO: 831339 - protein, 24 aa, Mycobacterium
LASDGSVLDTWFPAPELTESGTSA

SEQ ID NO: 831340 - protein, 18 aa, Mycobacterium
LASDIFCLPNGPVLLDCL

SEQ ID NO: 831341 - protein, 25 aa, Mycobacterium
LASDIPPLSWVLGNSPPPLLNLLLG

SEQ ID NO: 831342 - protein, 25 aa, Mycobacterium
LASDPLMSRLGMMGGPAMGALGSLP

SEQ ID NO: 831343 - protein, 27 aa, Mycobacterium
LASESAFFMLAFTKIGLMPDGGASALI

SEQ ID NO: 831344 - protein, 17 aa, Mycobacterium
LASFYFRADVRGLDRIP

SEQ ID NO: 831345 - protein, 25 aa, Mycobacterium
LASGKMPRLTAAALALSVVPGSLGS

SEQ ID NO: 831346 - protein, 26 aa, Mycobacterium
LASGLDARAYRLAWPAGTVVYEVDMP

SEQ ID NO: 831347 - protein, 27 aa, Mycobacterium
LASGLDARAYRLPWPADMTVFEIDQPQ

SEQ ID NO: 831348 - protein, 26 aa, Mycobacterium
LASGLDTRAYRLAWPAGTIVYEIDQP

SEQ ID NO: 831349 - protein, 26 aa, Mycobacterium
LASGLDTRAYRLGWPGGMTVFEIDQP

SEQ ID NO: 831350 - protein, 22 aa, Mycobacterium
LASGLLVLICGDVIRPGVPWML

SEQ ID NO: 831351 - protein, 25 aa, Mycobacterium
LASKPSAFAWIPFGGGTRRCVGAAF

SEQ ID NO: 831352 - protein, 20 aa, Mycobacterium
LASLAAMSTGPWLRRRKGAE

SEQ ID NO: 831353 - protein, 18 aa, Mycobacterium
LASLDKWDAYTEAKEAMF

SEQ ID NO: 831354 - protein, 24 aa, Mycobacterium
LASLFSRPARGRPVAAWSLAADEA

SEQ ID NO: 831355 - protein, 19 aa, Mycobacterium
LASLGVFEDAFRRGDKAAR

SEQ ID NO: 831356 - protein, 17 aa, Mycobacterium
LASLLDLPAPTGAVGWI

SEQ ID NO: 831357 - protein, 19 aa, Mycobacterium
LASLLERELLWHEPSREQA

SEQ ID NO: 831358 - protein, 19 aa, Mycobacterium
LASLLTHHIAVPHMAAQGD

SEQ ID NO: 831359 - protein, 26 aa, Mycobacterium
LASLPDGALMRRAAYGLAAEIIGELA

SEQ ID NO: 831360 - protein, 26 aa, Mycobacterium
LASLPDGVLMRRAAFGLATEIGRELT

SEQ ID NO: 831361 - protein, 19 aa, Mycobacterium
LASLRLTWAPTSDDLWRPQ

SEQ ID NO: 831362 - protein, 18 aa, Mycobacterium
LASLVTLAPDDLLRAVRV

SEQ ID NO: 831363 - protein, 24 aa, Mycobacterium
LASMAIRVVTIAPGLFKTPMLASL

SEQ ID NO: 831364 - protein, 19 aa, Mycobacterium
LASMCFPTFTGFSARHLNM

SEQ ID NO: 831365 - protein, 20 aa, Mycobacterium
LASNRMRAAGIPLPDVLISA

SEQ ID NO: 831366 - protein, 20 aa, Mycobacterium
LASPYAFIGLNFFNTMEYQM

SEQ ID NO: 831367 - protein, 18 aa, Mycobacterium
LASQLILPSALKAMSASA

SEQ ID NO: 831368 - protein, 19 aa, Mycobacterium
LASRARKAPGFALLGEPGQ

SEQ ID NO: 831369 - protein, 20 aa, Mycobacterium
LASRCHPETLRQMRWANAML

SEQ ID NO: 831370 - protein, 24 aa, Mycobacterium
LASRHLDLAARWLRAQGKGFYTIG

SEQ ID NO: 831371 - protein, 24 aa, Mycobacterium
LASRHLRRHPNAQPVVLVVTDGEP

SEQ ID NO: 831372 - protein, 24 aa, Mycobacterium
LASRLVDVTVWLATQPGTAALPVG

SEQ ID NO: 831373 - protein, 25 aa, Mycobacterium
LASRSITPATLRQALLGKVMTVGDT

SEQ ID NO: 831374 - protein, 17 aa, Mycobacterium
LASRTLVTTIPFVVYEQ

SEQ ID NO: 831375 - protein, 18 aa, Mycobacterium
LASRVAGRAKDAFPEVDF

SEQ ID NO: 831376 - protein, 34 aa, Mycobacterium
LASSAHFVWVRETLRLGGKFPLKAGLVTSLGFGH

SEQ ID NO: 831377 - protein, 25 aa, Mycobacterium
LASSAVLHYHRVYLLGGSAAVDELP

SEQ ID NO: 831378 - protein, 26 aa, Mycobacterium
LASSIDGLLLETYERQRRSGGAGAGF

SEQ ID NO: 831379 - protein, 18 aa, Mycobacterium
LASSYYQLPGLGPDAPEQ

SEQ ID NO: 831380 - protein, 24 aa, Mycobacterium
LASTPAVTLADRLGRKRLSEPWQQ

SEQ ID NO: 831381 - protein, 17 aa, Mycobacterium
LASVFRSAIERAGLVFD

SEQ ID NO: 831382 - protein, 26 aa, Mycobacterium
LASVTGGNPFFLIEALRHVDESGGRW

SEQ ID NO: 831383 - protein, 22 aa, Mycobacterium
LASVTPPMRLRPKILPNGTQDS

SEQ ID NO: 831384 - protein, 44 aa, Mycobacterium
LASWFGTQIDRFIGWPRLPKMAGIAVLYTLRRALQSDNLFDSGR

SEQ ID NO: 831385 - protein, 17 aa, Mycobacterium
LASWLPQHHDMGLISAY

SEQ ID NO: 831386 - protein, 19 aa, Mycobacterium
LASYRRAIGDFTAGRRRRV

SEQ ID NO: 831387 - protein, 20 aa, Mycobacterium
LATAARLRWLARANPDAWAR

SEQ ID NO: 831388 - protein, 28 aa, Mycobacterium
LATADILDDLLLLGALEDKVVFSSFNRG

SEQ ID NO: 831389 - protein, 28 aa, Mycobacterium
LATADTWRNPWPMYRALRDRDPVHHVVP

SEQ ID NO: 831390 - protein, 23 aa, Mycobacterium
LATDGQLVIIGMQGGIKGELNIA

SEQ ID NO: 831391 - protein, 36 aa, Mycobacterium
LATDRAIIAACPLTWPWNLLGWPSINVPAGFTVDGL

SEQ ID NO: 831392 - protein, 36 aa, Mycobacterium
LATDRAIIAACPYTWPWNLLGWPAINVPAGFTVEGL

SEQ ID NO: 831393 - protein, 17 aa, Mycobacterium
LATEEMIRWVTPVKQFM

SEQ ID NO: 831394 - protein, 17 aa, Mycobacterium
LATFGPHHESTLTALLA

SEQ ID NO: 831395 - protein, 17 aa, Mycobacterium
LATGIVNIWSAPAAAVA

SEQ ID NO: 831396 - protein, 28 aa, Mycobacterium
LATGLQPMRWGTGYMLGSKRFGPFGRGA

SEQ ID NO: 831397 - protein, 19 aa, Mycobacterium
LATGPCGRLGLPASGYLYG

SEQ ID NO: 831398 - protein, 26 aa, Mycobacterium
LATHHDLHLWLPHPSDTLWQALSTRK

SEQ ID NO: 831399 - protein, 18 aa, Mycobacterium
LATILHHFATFWDRRRQP

SEQ ID NO: 831400 - protein, 22 aa, Mycobacterium
LATIQLPVVCTVRGWAVGLGCN

SEQ ID NO: 831401 - protein, 18 aa, Mycobacterium
LATIYKRYPTRDALILAA

SEQ ID NO: 831402 - protein, 19 aa, Mycobacterium
LATLAWVYWHNTSRLHSYL

SEQ ID NO: 831403 - protein, 18 aa, Mycobacterium
LATLDKRVLVLGSGGLSH

SEQ ID NO: 831404 - protein, 19 aa, Mycobacterium
LATLGLGVVPLLALASEAQ

SEQ ID NO: 831405 - protein, 17 aa, Mycobacterium
LATLHRCLDLGVTFIDT

SEQ ID NO: 831406 - protein, 17 aa, Mycobacterium
LATLPPAPLVVIKDPRI

SEQ ID NO: 831407 - protein, 24 aa, Mycobacterium
LATLRFWPRRVTPAIVSFLVETFG

SEQ ID NO: 831408 - protein, 17 aa, Mycobacterium
LATLRRARDGQAMARPF

SEQ ID NO: 831409 - protein, 24 aa, Mycobacterium
LATLRSFLRRRISTTGLVTASVAA

SEQ ID NO: 831410 - protein, 21 aa, Mycobacterium
LATLSMLPRLAGPTVDVRWDA

SEQ ID NO: 831411 - protein, 24 aa, Mycobacterium
LATLSQLHAPFWGSRRLANGGDLS

SEQ ID NO: 831412 - protein, 18 aa, Mycobacterium
LATLVATNFFGQNTAAIA

SEQ ID NO: 831413 - protein, 31 aa, Mycobacterium; identical to SEQ ID NO: 115698

SEQ ID NO: 831414 - protein, 27 aa, Mycobacterium
LATMHPSRYLTLIDGVSAVFLTGVHPI

SEQ ID NO: 831415 - protein, 24 aa, Mycobacterium
LATMHPSRYLTLIEGVSQVFVTGV

SEQ ID NO: 831416 - protein, 25 aa, Mycobacterium
LATMHPSRYLTLIEGVTAVFLTGVH

SEQ ID NO: 831417 - protein, 17 aa, Mycobacterium
LATMLRAVLARPLGPTT

SEQ ID NO: 831418 - protein, 17 aa, Mycobacterium
LATMSQFAPLAAGCFDP

SEQ ID NO: 831419 - protein, 17 aa, Mycobacterium
LATPNITQSGVTPGINT

SEQ ID NO: 831420 - protein, 17 aa, Mycobacterium
LATQFRPDQLARLAGRL

SEQ ID NO: 831421 - protein, 21 aa, Mycobacterium
LATQIALLTQADLITGIIAGD

SEQ ID NO: 831422 - protein, 27 aa, Mycobacterium
LATQSLSPITLRQALLGKVMTVGDAVS

SEQ ID NO: 831423 - protein, 25 aa, Mycobacterium
LATRRSIFIPMLRVATIEPEAITLN

SEQ ID NO: 831424 - protein, 18 aa, Mycobacterium
LATSGLTYAFRLVEETDA

SEQ ID NO: 831425 - protein, 28 aa, Mycobacterium
LATTGYRLARQLGVRLPPRRAFGSFGQS

SEQ ID NO: 831426 - protein, 17 aa, Mycobacterium
LATTRWLVAILENHQQP

SEQ ID NO: 831427 - protein, 26 aa, Mycobacterium
LATVFRAPCVFFIQNNQWAISVPVSR

SEQ ID NO: 831428 - protein, 19 aa, Mycobacterium
LATVGIAGRQRVTAGTTLT

SEQ ID NO: 831429 - protein, 21 aa, Mycobacterium
LATVIAWHRYVADLIGQAKSE

SEQ ID NO: 831430 - protein, 29 aa, Mycobacterium
LATVLARNVFHWVFAFADGGLATPQVFKE

SEQ ID NO: 831431 - protein, 18 aa, Mycobacterium
LATVRPLASYIAARNWCV

SEQ ID NO: 831432 - protein, 19 aa, Mycobacterium
LATWVAIPGHTATPTGSVS

SEQ ID NO: 831433 - protein, 19 aa, Mycobacterium
LATYGFHRRALAVAGPRIL

SEQ ID NO: 831434 - protein, 17 aa, Mycobacterium
LATYRIAVGKRHKVAPG

SEQ ID NO: 831435 - protein, 24 aa, Mycobacterium
LAVAAQFMHVLPVGWVEPRDISNA

SEQ ID NO: 831436 - protein, 21 aa, Mycobacterium
LAVAIPFIHTRPRYFAQIIGE

SEQ ID NO: 831437 - protein, 33 aa, Mycobacterium
LAVALAIASAYFDIAMPMKAIAIGEVGLAGDLR

SEQ ID NO: 831438 - protein, 24 aa, Mycobacterium
LAVALDAPVLLHPADDMLWRDIHP

SEQ ID NO: 831439 - protein, 25 aa, Mycobacterium
LAVALLAVLKTGAAFVPLEPAWPPS

SEQ ID NO: 831440 - protein, 28 aa, Mycobacterium
LAVAQMALQPFLDYAFGFRRGQNAGQPP

SEQ ID NO: 831441 - protein, 19 aa, Mycobacterium
LAVATDWLRAHKPLDYIPG

SEQ ID NO: 831442 - protein, 26 aa, Mycobacterium
LAVDAVSWRILLEDLNIAWAQHRSGQ

SEQ ID NO: 831443 - protein, 27 aa, Mycobacterium
LAVDDLQLPEMLLLLATDLAAVDHHEG

SEQ ID NO: 831444 - protein, 20 aa, Mycobacterium
LAVDFRQRFNKDVIIDMLCY

SEQ ID NO: 831445 - protein, 18 aa, Mycobacterium
LAVDFYRCDGPRAVVLLL

SEQ ID NO: 831446 - protein, 26 aa, Mycobacterium
LAVDGVSWRILLEDFNIAWAQHHNGQ

SEQ ID NO: 831447 - protein, 26 aa, Mycobacterium
LAVDGVSWRILLEDFNIAWAQHHSGQ

SEQ ID NO: 831448 - protein, 25 aa, Mycobacterium
LAVDGVSWRILLEDINIAWAQHHGG

SEQ ID NO: 831449 - protein, 25 aa, Mycobacterium
LAVDGVSWRILLEDINIAWAQHRSG

SEQ ID NO: 831450 - protein, 26 aa, Mycobacterium
LAVDGVSWRILLEDLNIAWAQHHGGR

SEQ ID NO: 831451 - protein, 26 aa, Mycobacterium
LAVDGVSWRILLEDLNIAWAQHHSGQ

SEQ ID NO: 831452 - protein, 26 aa, Mycobacterium
LAVDGVSWRILLEDLNIAWAQHRAGQ

SEQ ID NO: 831453 - protein, 26 aa, Mycobacterium
LAVDGVSWRILLEDLNIAWAQHRGGQ

SEQ ID NO: 831454 - protein, 26 aa, Mycobacterium
LAVDGVSWRILLEDLNIAWAQQQSGR

SEQ ID NO: 831455 - protein, 25 aa, Mycobacterium
LAVDGVSWRILLEDLNVAWAQRRSG

SEQ ID NO: 831456 - protein, 26 aa, Mycobacterium
LAVDGVSWRVLLEDLNIAWGQHHHGQ

SEQ ID NO: 831457 - protein, 18 aa, Mycobacterium
LAVDHDLPDFAEPLLAQL

SEQ ID NO: 831458 - protein, 18 aa, Mycobacterium
LAVDNGFIPMIPPVLVRP

SEQ ID NO: 831459 - protein, 24 aa, Mycobacterium
LAVDPAHPFPFVSGLSLNLAVMVR

SEQ ID NO: 831460 - protein, 25 aa, Mycobacterium
LAVDPAHPFPFVSGLSLNLAVMVRQ

SEQ ID NO: 831461 - protein, 22 aa, Mycobacterium
LAVDPQVLLLDEPFGALDAKVR

SEQ ID NO: 831462 - protein, 25 aa, Mycobacterium
LAVDVVSWHIMLGDLAAAWRSLQAG

SEQ ID NO: 831463 - protein, 24 aa, Mycobacterium
LAVFVNELFALYRAGGAIDALAAP

SEQ ID NO: 831464 - protein, 18 aa, Mycobacterium
LAVGADYAFDARDEDLAD

SEQ ID NO: 831465 - protein, 24 aa, Mycobacterium
LAVGDRVVVPFPIACGACSACRRD

SEQ ID NO: 831466 - protein, 26 aa, Mycobacterium
LAVGEDALITLLDPSDRLGGILRTER

SEQ ID NO: 831467 - protein, 18 aa, Mycobacterium
LAVGFWEGADDLRANWQE

SEQ ID NO: 831468 - protein, 18 aa, Mycobacterium
LAVGFWRNTDELRENWNE

SEQ ID NO: 831469 - protein, 17 aa, Mycobacterium
LAVGIYATSASTPLFFA

SEQ ID NO: 831470 - protein, 18 aa, Mycobacterium
LAVGQYYANPRNAFWPIT

SEQ ID NO: 831471 - protein, 33 aa, Mycobacterium
LAVGTIERLHRLRLPWWHVWRVAEAAGAATPKH

SEQ ID NO: 831472 - protein, 19 aa, Mycobacterium
LAVIGKLQARRLTAEVLLD

SEQ ID NO: 831473 - protein, 19 aa, Mycobacterium
LAVKACFAAFRSGTLDHHG

SEQ ID NO: 831474 - protein, 18 aa, Mycobacterium
LAVKACFAAFRTGTLDHH

SEQ ID NO: 831475 - protein, 20 aa, Mycobacterium
LAVKACFGAFRTGTLDHHGD

SEQ ID NO: 831476 - protein, 25 aa, Mycobacterium
LAVKRELFQRLASLAPHAVLATNTS

SEQ ID NO: 831477 - protein, 21 aa, Mycobacterium
LAVKTLLKMLKQCVSPYPGSC

SEQ ID NO: 831478 - protein, 26 aa, Mycobacterium
LAVLDRILMPNYLLSALQAINILPGE

SEQ ID NO: 831479 - protein, 26 aa, Mycobacterium
LAVLDRLLMPNYLLSALQAINIQPGE

SEQ ID NO: 831480 - protein, 26 aa, Mycobacterium
LAVLDRLLMPNYLLSALQVINIQPGE

SEQ ID NO: 831481 - protein, 17 aa, Mycobacterium
LAVLGYYEWREGLLRGL

SEQ ID NO: 831482 - protein, 18 aa, Mycobacterium
LAVLIERAAKLQLAAMAA

SEQ ID NO: 831483 - protein, 21 aa, Mycobacterium
LAVLLAGWCGLRKGEVFALRR

SEQ ID NO: 831484 - protein, 17 aa, Mycobacterium
LAVLLSKLTGSADVPVG

SEQ ID NO: 831485 - protein, 18 aa, Mycobacterium
LAVLPPDTSLRSQLLSRL

SEQ ID NO: 831486 - protein, 21 aa, Mycobacterium
LAVLQALLDRHGMLRLRVDDA

SEQ ID NO: 831487 - protein, 17 aa, Mycobacterium
LAVLRAQAELEVEVPQE

SEQ ID NO: 831488 - protein, 17 aa, Mycobacterium
LAVLRDLSRHRGTQVLA

SEQ ID NO: 831489 - protein, 17 aa, Mycobacterium
LAVLRRAVPTAAGRTRR

SEQ ID NO: 831490 - protein, 18 aa, Mycobacterium
LAVLSPREKEVLGLMAEG

SEQ ID NO: 831491 - protein, 21 aa, Mycobacterium
LAVLYQISRPVALIGASMGGL

SEQ ID NO: 831492 - protein, 20 aa, Mycobacterium
LAVMFGVLPPLPTTTRFAFQ

SEQ ID NO: 831493 - protein, 29 aa, Mycobacterium
LAVMWGMDLINFLGVKWGLTSPATAARVR

SEQ ID NO: 831494 - protein, 19 aa, Mycobacterium
LAVMYGELPPLPTTTRFAF

SEQ ID NO: 831495 - protein, 18 aa, Mycobacterium
LAVNLLGTYDVIQAFLPM

SEQ ID NO: 831496 - protein, 24 aa, Mycobacterium
LAVNRLLRRNVGVLGVAWGEYLNR

SEQ ID NO: 831497 - protein, 19 aa, Mycobacterium
LAVNTIYRGPATPGSAAAL

SEQ ID NO: 831498 - protein, 25 aa, Mycobacterium
LAVPELPALLPRGTVAMLSGARSLL

SEQ ID NO: 831499 - protein, 32 aa, Mycobacterium
LAVPGPKRQAVLNRLLFPGPTKEFEEHRETYG

SEQ ID NO: 831500 - protein, 17 aa, Mycobacterium
LAVPIDEIARRAGVGAG

SEQ ID NO: 831501 - protein, 17 aa, Mycobacterium
LAVPLNVRLAGPEIGYI

SEQ ID NO: 831502 - protein, 28 aa, Mycobacterium
LAVPTPDHFIPFLYFAGIASASTDSVDT

SEQ ID NO: 831503 - protein, 21 aa, Mycobacterium
LAVQIGTRLGLWPSDVELLSK

SEQ ID NO: 831504 - protein, 18 aa, Mycobacterium
LAVQLRTLAPSGGRVTEL

SEQ ID NO: 831505 - protein, 24 aa, Mycobacterium
LAVQPLAPVFLYARNDDELRGLSP

SEQ ID NO: 831506 - protein, 18 aa, Mycobacterium
LAVQWHPEKSLDDLRLFA

SEQ ID NO: 831507 - protein, 42 aa, Mycobacterium
LAVRAVAYPVIALWARFPALPWPYRVVDLAAAVLRPVRGVRR

SEQ ID NO: 831508 - protein, 23 aa, Mycobacterium
LAVRGTRLAIHKTLDLPLHDGEI

SEQ ID NO: 831509 - protein, 21 aa, Mycobacterium
LAVRGTRLAIHKTLDLPLLEG

SEQ ID NO: 831510 - protein, 22 aa, Mycobacterium
LAVRGTRLAILKGIDLPLPEAE

SEQ ID NO: 831511 - protein, 17 aa, Mycobacterium
LAVRLDVSRLVVVGSGR

SEQ ID NO: 831512 - protein, 17 aa, Mycobacterium
LAVRLRLVIADATGEWA

SEQ ID NO: 831513 - protein, 25 aa, Mycobacterium
LAVSDRYWRRYFDNFAEVMASAASV

SEQ ID NO: 831514 - protein, 30 aa, Mycobacterium
LAVSNGFTLIIPPVLVRPEVMSGTGFLGAH

SEQ ID NO: 831515 - protein, 26 aa, Mycobacterium
LAVSVQLQRYLQLMLPAVTAAYLEER

SEQ ID NO: 831516 - protein, 20 aa, Mycobacterium
LAVTAGLPFLVRAVATSAAE

SEQ ID NO: 831517 - protein, 26 aa, Mycobacterium
LAVVAQFLPLLGEVEQKIIGCFRAGG

SEQ ID NO: 831518 - protein, 27 aa, Mycobacterium
LAVVDARLLVRVPSGWSLAEAAGVPVA

SEQ ID NO: 831519 - protein, 17 aa, Mycobacterium
LAVVDYAHKPGALRAVL

SEQ ID NO: 831520 - protein, 17 aa, Mycobacterium
LAVWLVEDPRQVPGIAT

SEQ ID NO: 831521 - protein, 35 aa, Mycobacterium
LAVWVYESHWWAHRALWHLIFSGVLDRYPDLTVVL

SEQ ID NO: 831522 - protein, 18 aa, Mycobacterium
LAWAVERIIRHPDAHSRL

SEQ ID NO: 831523 - protein, 17 aa, Mycobacterium
LAWDLPLDSRIRAQVAK

SEQ ID NO: 831524 - protein, 19 aa, Mycobacterium
LAWEILDPVLDYWAAHGKP

SEQ ID NO: 831525 - protein, 18 aa, Mycobacterium
LAWISAMPTNLYGPGDNF

SEQ ID NO: 831526 - protein, 17 aa, Mycobacterium
LAWVFERLTRQPEVLSA

SEQ ID NO: 831527 - protein, 19 aa, Mycobacterium
LAYAAYEEIFLGGERFAAL

SEQ ID NO: 831528 - protein, 26 aa, Mycobacterium
LAYAVPTIMGEVRRYFRDCSWAVKVP

SEQ ID NO: 831529 - protein, 21 aa, Mycobacterium
LAYGTVWLGLTELARMSAGDK

SEQ ID NO: 831530 - protein, 17 aa, Mycobacterium
LAYLHVVIDPGAVELRA

SEQ ID NO: 831531 - protein, 18 aa, Mycobacterium
LAYMQAVVPYISGTPSQL

SEQ ID NO: 831532 - protein, 18 aa, Mycobacterium
LAYPWLNEIPIEVALDPA

SEQ ID NO: 831533 - protein, 19 aa, Mycobacterium
LAYSWRHQIPALAAAGYHV

SEQ ID NO: 831534 - protein, 20 aa, Mycobacterium
LAYSWRHQIPALAAAGYHVL

SEQ ID NO: 831535 - protein, 20 aa, Mycobacterium
LAYTTIMTVLQRLAKKNLVS

SEQ ID NO: 831536 - protein, 23 aa, Mycobacterium
LAYVADGILGAAISFGGHVWDHA

SEQ ID NO: 831537 - protein, 23 aa, Mycobacterium
LAYVADGVLGGSISFGGHVWDHA

SEQ ID NO: 831538 - protein, 23 aa, Mycobacterium
LAYVLMCGMTFDELPLGGGVAQP

SEQ ID NO: 831539 - protein, 19 aa, Mycobacterium
LAYWREVMANPPEPLELPG

SEQ ID NO: 831540 - protein, 19 aa, Mycobacterium
LCAGALRRWLADRGELPEQ

SEQ ID NO: 831541 - protein, 22 aa, Mycobacterium
LCAPNNRFIAPTTFPGIHTLEA

SEQ ID NO: 831542 - protein, 32 aa, Mycobacterium
LCAPVIATLYPVRRMVFVGGLLPVPGHSFVEH

SEQ ID NO: 831543 - protein, 19 aa, Mycobacterium
LCAQILLLAAEDPTKDISL

SEQ ID NO: 831544 - protein, 17 aa, Mycobacterium
LCARALDALLPPGGRLL

SEQ ID NO: 831545 - protein, 17 aa, Mycobacterium
LCCSLSVGAAERGLHTA

SEQ ID NO: 831546 - protein, 24 aa, Mycobacterium
LCDEWARRGFLAVRYNLPYRRRRP

SEQ ID NO: 831547 - protein, 26 aa, Mycobacterium
LCDKRKTPLLFLQNIAGFMVGRDYEA

SEQ ID NO: 831548 - protein, 26 aa, Mycobacterium
LCDKRKTPLLFLQNISGFMVGRDYEA

SEQ ID NO: 831549 - protein, 17 aa, Mycobacterium
LCDYFAPILASRRAEPK

SEQ ID NO: 831550 - protein, 17 aa, Mycobacterium
LCEHLLSAGFDVAACRD

SEQ ID NO: 831551 - protein, 19 aa, Mycobacterium
LCEHTLICLPTGSGVRSIL

SEQ ID NO: 831552 - protein, 17 aa, Mycobacterium
LCEIIGRPDLLDDERFI

SEQ ID NO: 831553 - protein, 25 aa, Mycobacterium
LCEILARYDVTFSLGDGLRPGSIAD

SEQ ID NO: 831554 - protein, 20 aa, Mycobacterium
LCEKYDLPYFTGSLARQYAS

SEQ ID NO: 831555 - protein, 17 aa, Mycobacterium
LCELERTGQRYGLQTIC

SEQ ID NO: 831556 - protein, 18 aa, Mycobacterium
LCELKIDGVALSLVYRDG

SEQ ID NO: 831557 - protein, 19 aa, Mycobacterium
LCELTFDALTTPELLRVVE

SEQ ID NO: 831558 - protein, 25 aa, Mycobacterium
LCEQGQWWGLVTYPIRYGATTKNVT

SEQ ID NO: 831559 - protein, 22 aa, Mycobacterium
LCERLLSYASPLHLYAEEIEPR

SEQ ID NO: 831560 - protein, 18 aa, Mycobacterium
LCERLQDIPMSAPVVVVG

SEQ ID NO: 831561 - protein, 18 aa, Mycobacterium
LCEVLGWRGIWLSEERRR

SEQ ID NO: 831562 - protein, 22 aa, Mycobacterium
LCFAGANLIPLRGAPADLSAFA

SEQ ID NO: 831563 - protein, 20 aa, Mycobacterium
LCFAGANLIPLRGGLIDLNA

SEQ ID NO: 831564 - protein, 26 aa, Mycobacterium
LCFDPTQRLLWCTNTYHTGYYHANAG

SEQ ID NO: 831565 - protein, 19 aa, Mycobacterium
LCFGLAAGGVGNRFYDMYY

SEQ ID NO: 831566 - protein, 18 aa, Mycobacterium
LCGFMMALAEHQQGHAHC

SEQ ID NO: 831567 - protein, 19 aa, Mycobacterium
LCGPVTYLPPPGTRGYPLP

SEQ ID NO: 831568 - protein, 19 aa, Mycobacterium
LCGTTLIVWTTIPEARQVP

SEQ ID NO: 831569 - protein, 21 aa, Mycobacterium
LCGTVDQPPPLRAHEFYEIQR

SEQ ID NO: 831570 - protein, 19 aa, Mycobacterium
LCGVWVKATPAFNRELCAR

SEQ ID NO: 831571 - protein, 17 aa, Mycobacterium
LCHGLLHGWSLEKTLRY

SEQ ID NO: 831572 - protein, 27 aa, Mycobacterium
LCIDAPVSAVWPWLLQMGQDRGGWYGG

SEQ ID NO: 831573 - protein, 18 aa, Mycobacterium
LCIDTWHVHRSGTDYRKL

SEQ ID NO: 831574 - protein, 17 aa, Mycobacterium
LCILGYHDIDHAVELAN

SEQ ID NO: 831575 - protein, 39 aa, Mycobacterium
LCLHDPVWYDHLPYLPFPPNWPVFAPKDKIGDWLEFYTK

SEQ ID NO: 831576 - protein, 17 aa, Mycobacterium
LCLHRRFGRWVQLGGHC

SEQ ID NO: 831577 - protein, 25 aa, Mycobacterium
LCLPVCVFMYRFVRPVTTGGRARRF

SEQ ID NO: 831578 - protein, 27 aa, Mycobacterium
LCLRDMGLMLGEYWDLGPLAADCAADG

SEQ ID NO: 831579 - protein, 18 aa, Mycobacterium
LCLVPNLVADHCYELGMP

SEQ ID NO: 831580 - protein, 17 aa, Mycobacterium
LCLVWAEQMLRESGVDA

SEQ ID NO: 831581 - protein, 29 aa, Mycobacterium
LCMIHGADPWWDIAIRLLIKYANLRLMTS

SEQ ID NO: 831582 - protein, 29 aa, Mycobacterium
LCMIHGADPWWDVAIRLLLKYANLRLMTS

SEQ ID NO: 831583 - protein, 30 aa, Mycobacterium
LCMIHGADPWWDVAIRLLLKYANLRLMTSA

SEQ ID NO: 831584 - protein, 29 aa, Mycobacterium
LCMIHGADPWWDVAIRLLLKYSNLRLMTS

SEQ ID NO: 831585 - protein, 26 aa, Mycobacterium
LCNLRCTYCMPAEGLDWMPRDQKLTP

SEQ ID NO: 831586 - protein, 19 aa, Mycobacterium
LCNTHFYMPPQFNALDLMS

SEQ ID NO: 831587 - protein, 18 aa, Mycobacterium
LCPDHGEILDWLHRLRGP

SEQ ID NO: 831588 - protein, 21 aa, Mycobacterium
LCPLPTDRGWPIRDLLTGSCR

SEQ ID NO: 831589 - protein, 25 aa, Mycobacterium
LCPQNLDYLISFFGALYSGRIAVPL

SEQ ID NO: 831590 - protein, 24 aa, Mycobacterium
LCPQNLDYLVAFFGALYAGRIAVP

SEQ ID NO: 831591 - protein, 25 aa, Mycobacterium
LCPQNLDYLVAFFGTLYSGRIAVPL

SEQ ID NO: 831592 - protein, 20 aa, Mycobacterium
LCQELWAGANAAQLKARALA

SEQ ID NO: 831593 - protein, 19 aa, Mycobacterium
LCQEPMMFVCRPDHRLAQR

SEQ ID NO: 831594 - protein, 17 aa, Mycobacterium
LCQLLDQPAVLGQHARV

SEQ ID NO: 831595 - protein, 20 aa, Mycobacterium
LCQQLLRNHYEGWLSQVALA

SEQ ID NO: 831596 - protein, 33 aa, Mycobacterium
LCQRYPIADVLPLTPLQQGLLFHTGTAHGSDDL

SEQ ID NO: 831597 - protein, 26 aa, Mycobacterium
LCRDTCHYCTFVTVPGKLRAHGAGMY

SEQ ID NO: 831598 - protein, 23 aa, Mycobacterium
LCRDTCHYCTFVTVPGKLRAQGA

SEQ ID NO: 831599 - protein, 23 aa, Mycobacterium
LCRDTCHYCTFVTVPGKLRAQGM

SEQ ID NO: 831600 - protein, 28 aa, Mycobacterium
LCREHHLLKTFWPGWSNVQFPDGTIVWR

SEQ ID NO: 831601 - protein, 24 aa, Mycobacterium
LCRERVSAFWAAHPELVAGRMALT

SEQ ID NO: 831602 - protein, 23 aa, Mycobacterium
LCRHVLCFRTVWESTYAALRLHG

SEQ ID NO: 831603 - protein, 28 aa, Mycobacterium
LCRIDPGDLKWFLRALPAVIEDYQRRHG

SEQ ID NO: 831604 - protein, 41 aa, Mycobacterium
LCRKHHLLKTFWDWRDLQLPDGTVIWLLPDGHTYVTTPGSA

SEQ ID NO: 831605 - protein, 17 aa, Mycobacterium
LCRRIADKGPEMKVAPD

SEQ ID NO: 831606 - protein, 19 aa, Mycobacterium
LCRRRIYHSFNPQGVNIVA

SEQ ID NO: 831607 - protein, 26 aa, Mycobacterium
LCRSAGYWAVPYPLAERLAAPTDLDV

SEQ ID NO: 831608 - protein, 25 aa, Mycobacterium
LCRSHLGVSPRWLLRRARVIDAHQL

SEQ ID NO: 831609 - protein, 27 aa, Mycobacterium
LCRTHHLVKTFWGWQEKQLPDGTVIFT

SEQ ID NO: 831610 - protein, 24 aa, Mycobacterium
LCRYRRYRVYWSPRRTSPAGNPAG

SEQ ID NO: 831611 - protein, 17 aa, Mycobacterium
LCSLTRPALAPTIGSLV

SEQ ID NO: 831612 - protein, 30 aa, Mycobacterium
LCSLTYPGYKPSLPGLVGSALFADGAGAVV

SEQ ID NO: 831613 - protein, 17 aa, Mycobacterium
LCSVMGKSGLFSDYLIK

SEQ ID NO: 831614 - protein, 17 aa, Mycobacterium
LCTACFDGQYPIELPEE

SEQ ID NO: 831615 - protein, 28 aa, Mycobacterium
LCTDWMGDDAWLWKLDCEFRLFNYVGDV

SEQ ID NO: 831616 - protein, 27 aa, Mycobacterium
LCTGVAFPAFPALLAATERGAVPDLFL

SEQ ID NO: 831617 - protein, 18 aa, Mycobacterium
LCVDPRRAHLRKLVNAFV

SEQ ID NO: 831618 - protein, 17 aa, Mycobacterium
LCVLADPRWDHIQDIGD

SEQ ID NO: 831619 - protein, 17 aa, Mycobacterium
LCVPSWLRQWEDKTSYV

SEQ ID NO: 831620 - protein, 18 aa, Mycobacterium
LCVPTMAVALVESAARRD

SEQ ID NO: 831621 - protein, 18 aa, Mycobacterium
LCWALERLTRHPAVLAKA

SEQ ID NO: 831622 - protein, 24 aa, Mycobacterium
LCYAGPNMIPLRGSLDDLKAFSDK

SEQ ID NO: 831623 - protein, 18 aa, Mycobacterium
LDAAAGRFADLGALALAA

SEQ ID NO: 831624 - protein, 22 aa, Mycobacterium
LDAAARLLRLLDRPDDAPVLAP

SEQ ID NO: 831625 - protein, 26 aa, Mycobacterium
LDAAARWRGPIPGRDRVRIIVAGAPP

SEQ ID NO: 831626 - protein, 28 aa, Mycobacterium
LDAADALAAVPWLPVQLGGAVGTHAATT

SEQ ID NO: 831627 - protein, 24 aa, Mycobacterium
LDAADRLWIPVRRSWRLNERHYGA

SEQ ID NO: 831628 - protein, 24 aa, Mycobacterium
LDAADRLWIPVRRTWRLNERHYGA

SEQ ID NO: 831629 - protein, 27 aa, Mycobacterium
LDAAHPGLLRFTLGLGQTLALIMNADV

SEQ ID NO: 831630 - protein, 17 aa, Mycobacterium
LDAAIAWYHDHLGMVVM

SEQ ID NO: 831631 - protein, 25 aa, Mycobacterium
LDAAIEWYHDHLGLILVHEEVNDDQ

SEQ ID NO: 831632 - protein, 24 aa, Mycobacterium
LDAAPQLRLDPEASAYFLNQDGTP

SEQ ID NO: 831633 - protein, 23 aa, Mycobacterium
LDAARLTYRQLWDRASRVAGGLR

SEQ ID NO: 831634 - protein, 19 aa, Mycobacterium
LDAAYAVPDRFWAQVLPRV

SEQ ID NO: 831635 - protein, 30 aa, Mycobacterium
LDACIHLRDRLLWALLWDTGIRIGEALGLR

SEQ ID NO: 831636 - protein, 25 aa, Mycobacterium
LDADAVIYAPLLPNPEEVAALLRSG

SEQ ID NO: 831637 - protein, 26 aa, Mycobacterium
LDADDYIELLPVQWRTINSYGVRINH

SEQ ID NO: 831638 - protein, 26 aa, Mycobacterium
LDADEFLKVMLRWLNAFVSKPGQTIP

SEQ ID NO: 831639 - protein, 25 aa, Mycobacterium
LDADEFMTAWWRLVRRLTLGERARD

SEQ ID NO: 831640 - protein, 20 aa, Mycobacterium
LDADLPFKDLGIDSLSALEL

SEQ ID NO: 831641 - protein, 23 aa, Mycobacterium
LDADTRFYFVHSYAAQQWSGRED

SEQ ID NO: 831642 - protein, 26 aa, Mycobacterium
LDADYDEWVVLRSPPLFGTEADARVL

SEQ ID NO: 831643 - protein, 26 aa, Mycobacterium
LDAEAPPLFSLWTPENGRTGYEPGVA

SEQ ID NO: 831644 - protein, 20 aa, Mycobacterium
LDAEFPKFRQLLPAEHTAVA

SEQ ID NO: 831645 - protein, 21 aa, Mycobacterium
LDAEFPKFRQLLPAEHTAVAT

SEQ ID NO: 831646 - protein, 19 aa, Mycobacterium
LDAESLSPFVTWGTNPGQG

SEQ ID NO: 831647 - protein, 30 aa, Mycobacterium
LDAESVLWLEQHLATYPGAILAVTHDRYFL

SEQ ID NO: 831648 - protein, 20 aa, Mycobacterium
LDAEWVLLALADGALQEALP

SEQ ID NO: 831649 - protein, 18 aa, Mycobacterium
LDAFAELTLLELSEFVKA

SEQ ID NO: 831650 - protein, 28 aa, Mycobacterium
LDAFDLQRPVRLLGVRLELAMPSATAAR

SEQ ID NO: 831651 - protein, 22 aa, Mycobacterium
LDAFEDGGWIWFDITTDSDVTL

SEQ ID NO: 831652 - protein, 18 aa, Mycobacterium
LDAFIVRKLGAPGHDEFA

SEQ ID NO: 831653 - protein, 17 aa, Mycobacterium
LDAFLHYRMIDVSSIKE

SEQ ID NO: 831654 - protein, 17 aa, Mycobacterium
LDAFLLHNLPHSVARRS

SEQ ID NO: 831655 - protein, 17 aa, Mycobacterium
LDAFRRVLRDGEVGCLV

SEQ ID NO: 831656 - protein, 25 aa, Mycobacterium
LDAFRSVIELNLIATFNLNRLQAWH

SEQ ID NO: 831657 - protein, 24 aa, Mycobacterium
LDAGEWFRSFPAAQASSLFAGLAD

SEQ ID NO: 831658 - protein, 18 aa, Mycobacterium
LDAGKPFGLRPSAILPAY

SEQ ID NO: 831659 - protein, 17 aa, Mycobacterium
LDAGLLRERADLAVSGA

SEQ ID NO: 831660 - protein, 18 aa, Mycobacterium
LDAGVLIRDVGIPGYLRV

SEQ ID NO: 831661 - protein, 24 aa, Mycobacterium
LDAHLLERIARFKRPKRYEFIDAL

SEQ ID NO: 831662 - protein, 25 aa, Mycobacterium
LDAHLLERIARFKRPKRYEFVDELP

SEQ ID NO: 831663 - protein, 22 aa, Mycobacterium
LDAHLTVPILFDAPTVRGLARH

SEQ ID NO: 831664 - protein, 25 aa, Mycobacterium
LDAHREFWTHFFRNFWRVQELIEKR

SEQ ID NO: 831665 - protein, 18 aa, Mycobacterium
LDAIAVAPGVYPAPQSQS

SEQ ID NO: 831666 - protein, 23 aa, Mycobacterium
LDAIGLYIAVIASGSIALSITNT

SEQ ID NO: 831667 - protein, 17 aa, Mycobacterium
LDAIGRPVVLIGASMGG

SEQ ID NO: 831668 - protein, 23 aa, Mycobacterium
LDAIKAVASLDLGLPLVAGNVVS

SEQ ID NO: 831669 - protein, 19 aa, Mycobacterium
LDAILARRPIRLHPDRPNN

SEQ ID NO: 831670 - protein, 18 aa, Mycobacterium
LDAKLARQAQLRTLTRKY

SEQ ID NO: 831671 - protein, 32 aa, Mycobacterium
LDAKLVWHLKRHIPNPYRWGAGLIGRLMPTAV

SEQ ID NO: 831672 - protein, 17 aa, Mycobacterium
LDALADYREKNRYGFTP

SEQ ID NO: 831673 - protein, 17 aa, Mycobacterium
LDALAFQRRADGLTATS

SEQ ID NO: 831674 - protein, 19 aa, Mycobacterium
LDALALDTLALLEDRWRDV

SEQ ID NO: 831675 - protein, 20 aa, Mycobacterium
LDALALDTLALLEDRWRDVV

SEQ ID NO: 831676 - protein, 27 aa, Mycobacterium
LDALARAGFHTLKLQTFLTAGPKEARA

SEQ ID NO: 831677 - protein, 27 aa, Mycobacterium
LDALARAGFHTLKLQTFLTAGPKESRA

SEQ ID NO: 831678 - protein, 21 aa, Mycobacterium
LDALGIGYEIVPGVPAFAAVA

SEQ ID NO: 831679 - protein, 26 aa, Mycobacterium
LDALGYRGFWMGYFAARSAPLGMVPR

SEQ ID NO: 831680 - protein, 21 aa, Mycobacterium
LDALLAFADRLAKFTARAEQI

SEQ ID NO: 831681 - protein, 18 aa, Mycobacterium
LDALLPPGGRLLDLGVGS

SEQ ID NO: 831682 - protein, 22 aa, Mycobacterium
LDALLTALGSGPYILVGHSYGG

SEQ ID NO: 831683 - protein, 19 aa, Mycobacterium
LDALMPMVWTACERADFVV

SEQ ID NO: 831684 - protein, 31 aa, Mycobacterium
LDALRELHHVMLWAAFRYSTKPQAVPMKVLF

SEQ ID NO: 831685 - protein, 28 aa, Mycobacterium
LDALRHPRWWFDLLTTEPLAFASLDRWS

SEQ ID NO: 831686 - protein, 19 aa, Mycobacterium
LDALSRRRDAELERGVCLV

SEQ ID NO: 831687 - protein, 17 aa, Mycobacterium
LDALTAHLQSHAPWGAH

SEQ ID NO: 831688 - protein, 24 aa, Mycobacterium
LDALTDRFIPGRTAELRASTRKEL

SEQ ID NO: 831689 - protein, 28 aa, Mycobacterium
LDALVSLVLDWRRPVKLFIETKHPVRYG

SEQ ID NO: 831690 - protein, 24 aa, Mycobacterium
LDAMHGLLLVKKWSSITMADVASA

SEQ ID NO: 831691 - protein, 26 aa, Mycobacterium
LDAMIGHKSARYLRFGWAAARLDDLM

SEQ ID NO: 831692 - protein, 20 aa, Mycobacterium
LDAPFIAELVERRLSFIGLT

SEQ ID NO: 831693 - protein, 32 aa, Mycobacterium
LDAPKRLGSFMDSRLWRMLLAPGRGIGRLVTG

SEQ ID NO: 831694 - protein, 20 aa, Mycobacterium
LDAPMVNRALPGLDLARLDL

SEQ ID NO: 831695 - protein, 27 aa, Mycobacterium
LDAPPKSFWRLDIAPASRIVLHFRSGR

SEQ ID NO: 831696 - protein, 17 aa, Mycobacterium
LDAPPVRNVIAGSEILL

SEQ ID NO: 831697 - protein, 19 aa, Mycobacterium
LDAPVLLHPGDEMLWRMTH

SEQ ID NO: 831698 - protein, 25 aa, Mycobacterium
LDAQLIDELPLPRPKYEIFVYSPRV

SEQ ID NO: 831699 - protein, 20 aa, Mycobacterium
LDAQLWTRLDDLGLVRLTGS

SEQ ID NO: 831700 - protein, 20 aa, Mycobacterium
LDAQRRWQKILGPQRLGELR

SEQ ID NO: 831701 - protein, 23 aa, Mycobacterium
LDARARIEYLLDPGTFRELGTLV

SEQ ID NO: 831702 - protein, 21 aa, Mycobacterium
LDARDTELLRELKARRSRDVP

SEQ ID NO: 831703 - protein, 17 aa, Mycobacterium
LDARFGSVYRRRGHPAL

SEQ ID NO: 831704 - protein, 24 aa, Mycobacterium
LDARPMFNRIRDAIEAHLTIVFAA

SEQ ID NO: 831705 - protein, 25 aa, Mycobacterium
LDARQWFQSFPAVAGSSLFARLQDS

SEQ ID NO: 831706 - protein, 24 aa, Mycobacterium
LDARRRELLGSRDRLRATLDALVG

SEQ ID NO: 831707 - protein, 22 aa, Mycobacterium
LDARVILRRLVAADPAAYGYLV

SEQ ID NO: 831708 - protein, 22 aa, Mycobacterium
LDARVILRRLVAADPASYGYLV

SEQ ID NO: 831709 - protein, 22 aa, Mycobacterium
LDARVVLRRLMAADPTSYGYLV

SEQ ID NO: 831710 - protein, 19 aa, Mycobacterium
LDARYLAGEAAPYARTWSF

SEQ ID NO: 831711 - protein, 26 aa, Mycobacterium
LDASAFLGRLALIRIYKGRIKKGQQV

SEQ ID NO: 831712 - protein, 26 aa, Mycobacterium
LDASAFLGRLALIRIYNGRIRKGQQV

SEQ ID NO: 831713 - protein, 24 aa, Mycobacterium
LDASDAFYFKPDGAQFLCSPADET

SEQ ID NO: 831714 - protein, 26 aa, Mycobacterium
LDASLLLVVLTRFLPPDDPRVRNTVL

SEQ ID NO: 831715 - protein, 26 aa, Mycobacterium
LDASTFLGRLALIRIYNGRIRKGQQV

SEQ ID NO: 831716 - protein, 22 aa, Mycobacterium
LDASTWVVFLTDHGPAFPRAKS

SEQ ID NO: 831717 - protein, 23 aa, Mycobacterium
LDASTWVVFLTDHGPAFPRAKST

SEQ ID NO: 831718 - protein, 22 aa, Mycobacterium
LDATLKLLCPVDNLATFRLIEN

SEQ ID NO: 831719 - protein, 24 aa, Mycobacterium
LDATTWVVFFTDHGPAFPRAKSTL

SEQ ID NO: 831720 - protein, 19 aa, Mycobacterium
LDAVLRPLTARHDVLWPMI

SEQ ID NO: 831721 - protein, 27 aa, Mycobacterium
LDAVNGPTQFLLGRPLIGNGADGTATS

SEQ ID NO: 831722 - protein, 29 aa, Mycobacterium
LDAVNTPTQALFGRPLIGNGANGTATSPN

SEQ ID NO: 831723 - protein, 20 aa, Mycobacterium
LDAVQWLADHEGAAVTWLPV

SEQ ID NO: 831724 - protein, 17 aa, Mycobacterium
LDAVRATWLALEPSHFA

SEQ ID NO: 831725 - protein, 25 aa, Mycobacterium
LDAVRFAGGWIYDRVMAGWDVTVLV

SEQ ID NO: 831726 - protein, 23 aa, Mycobacterium
LDAVTKYPWRRTEERRKFGFYVG

SEQ ID NO: 831727 - protein, 18 aa, Mycobacterium
LDAVTLLSYRQTLDLRGA

SEQ ID NO: 831728 - protein, 21 aa, Mycobacterium
LDAWRAAERGFYALATVAGVN

SEQ ID NO: 831729 - protein, 26 aa, Mycobacterium
LDAYFEDDVHLWDWAAGALIASEAGA

SEQ ID NO: 831730 - protein, 25 aa, Mycobacterium
LDAYYEHGLQLWDRAAGALIAAEAG

SEQ ID NO: 831731 - protein, 18 aa, Mycobacterium
LDCDLAAITLQIGDTDLP

SEQ ID NO: 831732 - protein, 24 aa, Mycobacterium
LDCDPWQFDPEFFGISPREATSMD

SEQ ID NO: 831733 - protein, 18 aa, Mycobacterium
LDCFFVYLARHPEHRRQL

SEQ ID NO: 831734 - protein, 21 aa, Mycobacterium
LDCSGLTQWAYGQSGVDIPRL

SEQ ID NO: 831735 - protein, 26 aa, Mycobacterium
LDCSGLTQWAYREAGLNIPRLAQEQD

SEQ ID NO: 831736 - protein, 25 aa, Mycobacterium
LDCTPHDLWPKQYPAATARAVTTAS

SEQ ID NO: 831737 - protein, 17 aa, Mycobacterium
LDDAGRLRIVGRKKDMF

SEQ ID NO: 831738 - protein, 39 aa, Mycobacterium
LDDDLVLYLFGTPGQRRFWFMWDDLIRGAIGAIILVDVR

SEQ ID NO: 831739 - protein, 26 aa, Mycobacterium
LDDDPAVRVIVLTGAPPAFCSGAQIS

SEQ ID NO: 831740 - protein, 23 aa, Mycobacterium
LDDEDVLLTTLPLSHLNAQAYSV

SEQ ID NO: 831741 - protein, 33 aa, Mycobacterium
LDDETLIRYIDRFLMFYIRTADRLQRTAPWVEA

SEQ ID NO: 831742 - protein, 22 aa, Mycobacterium
LDDEYLTKWDLPVKIGGHLKDP

SEQ ID NO: 831743 - protein, 29 aa, Mycobacterium
LDDFDLHTMLRLPTGIFYAQGVKANVLFF

SEQ ID NO: 831744 - protein, 17 aa, Mycobacterium
LDDFKRSFDVAVGAQWT

SEQ ID NO: 831745 - protein, 18 aa, Mycobacterium
LDDFWSSLEPATIEGMLG

SEQ ID NO: 831746 - protein, 23 aa, Mycobacterium
LDDGMIYWDVRPSNKFPTVEVRV

SEQ ID NO: 831747 - protein, 24 aa, Mycobacterium
LDDGPFIHPLVEVLDEGRPAGVVV

SEQ ID NO: 831748 - protein, 34 aa, Mycobacterium
LDDHGVPLLQALHRRLRGYAIAPLVVATQARVAL

SEQ ID NO: 831749 - protein, 29 aa, Mycobacterium
LDDHPGLRIGWFEGGIAWVPWALQDAEHL

SEQ ID NO: 831750 - protein, 23 aa, Mycobacterium
LDDHTIAYYPPAFSAAARDQLQA

SEQ ID NO: 831751 - protein, 23 aa, Mycobacterium
LDDIEGYDFVLMDCPPALGELTT

SEQ ID NO: 831752 - protein, 26 aa, Mycobacterium
LDDIEVPVNVLWFPDLFGPDKDPHKA

SEQ ID NO: 831753 - protein, 19 aa, Mycobacterium
LDDILASRMIFDPLTKLQC

SEQ ID NO: 831754 - protein, 25 aa, Mycobacterium
LDDIRRYLSFFPSSAWSYPSSTPPG

SEQ ID NO: 831755 - protein, 31 aa, Mycobacterium
LDDLAERVGWRWRLIWYKAVAELLTGDYDSA

SEQ ID NO: 831756 - protein, 31 aa, Mycobacterium
LDDLAERVGWRWRLVWFRAVSELLTADYDSA

SEQ ID NO: 831757 - protein, 26 aa, Mycobacterium
LDDLAKRLIVLVEPIEAIVDRIDYIV

SEQ ID NO: 831758 - protein, 25 aa, Mycobacterium
LDDLAKRLIVLVEPVEAIVARIDEM

SEQ ID NO: 831759 - protein, 34 aa, Mycobacterium
LDDLDFDYVFIDCPPSLGLLTINALVAAPEVMIP

SEQ ID NO: 831760 - protein, 17 aa, Mycobacterium
LDDLPDDVLNLLHLVYS

SEQ ID NO: 831761 - protein, 23 aa, Mycobacterium
LDDMTPLKHEHLEFGYGALDLGA

SEQ ID NO: 831762 - protein, 24 aa, Mycobacterium
LDDNRVLYEWDYAKQLLHVQMLRD

SEQ ID NO: 831763 - protein, 24 aa, Mycobacterium
LDDPERFLLDLEKSWLIILGGILQ

SEQ ID NO: 831764 - protein, 24 aa, Mycobacterium
LDDPLVAAMYDPALERIPALDADL

SEQ ID NO: 831765 - protein, 28 aa, Mycobacterium
LDDPTRVIGRLRRPLLTPEPHERNGYVP

SEQ ID NO: 831766 - protein, 25 aa, Mycobacterium
LDDQDRYPWLRRVGEWLAAHRDGGV

SEQ ID NO: 831767 - protein, 29 aa, Mycobacterium
LDDQFWGDRYGVVADPFGHHWSLGQPVRE

SEQ ID NO: 831768 - protein, 20 aa, Mycobacterium
LDDRHDLPRIIRAGRHLARP

SEQ ID NO: 831769 - protein, 31 aa, Mycobacterium; identical to SEQ ID NO: 128568

SEQ ID NO: 831770 - protein, 31 aa, Mycobacterium
LDDVAAFDLYSCFPFPVFNICDGTGLATDDP

SEQ ID NO: 831771 - protein, 34 aa, Mycobacterium
LDDVLRRAVRLLAQLTRQVAIVQYPTLSTSSVRH

SEQ ID NO: 831772 - protein, 29 aa, Mycobacterium
LDDVLRRAVRLLAQLTRQVAVVQYPTLST

SEQ ID NO: 831773 - protein, 28 aa, Mycobacterium
LDDVLRRAVRLLAQLTRQVAVVQYPTLT

SEQ ID NO: 831774 - protein, 26 aa, Mycobacterium
LDDVLRRAVRLLAQMTRQVAVVQYPT

SEQ ID NO: 831775 - protein, 25 aa, Mycobacterium
LDDVNLQRLIGLFEQLREKSQLIVI

SEQ ID NO: 831776 - protein, 25 aa, Mycobacterium
LDDVNLRRLISLFEQLREKSQLIVI

SEQ ID NO: 831777 - protein, 27 aa, Mycobacterium
LDDVNLRRLISLFEQLRERSQLIVITH

SEQ ID NO: 831778 - protein, 17 aa, Mycobacterium
LDDVRLPADLILGGREK

SEQ ID NO: 831779 - protein, 17 aa, Mycobacterium
LDEAGRLRIVGRKKDMF

SEQ ID NO: 831780 - protein, 20 aa, Mycobacterium
LDEAITFYTRLFDVEPAKVK

SEQ ID NO: 831781 - protein, 23 aa, Mycobacterium
LDEALVCHLGYLSAGRPVVLPTT

SEQ ID NO: 831782 - protein, 25 aa, Mycobacterium
LDEAQIFNRYLAVKVPYHTHYMETI

SEQ ID NO: 831783 - protein, 27 aa, Mycobacterium
LDEASLMAWALPRAANQFWMRSEPERA

SEQ ID NO: 831784 - protein, 23 aa, Mycobacterium
LDEATLRWVVTTAVGDVLSARFC

SEQ ID NO: 831785 - protein, 22 aa, Mycobacterium
LDEDPYLPPYYHPGSDAPEIRY

SEQ ID NO: 831786 - protein, 24 aa, Mycobacterium
LDEFAGLRYVLIITSTYGEGEMPD

SEQ ID NO: 831787 - protein, 18 aa, Mycobacterium
LDEFLRYTSPVNAMGRIV

SEQ ID NO: 831788 - protein, 17 aa, Mycobacterium
LDEFPLRDLLTRGTQYG

SEQ ID NO: 831789 - protein, 25 aa, Mycobacterium
LDEGRRTYYFVWHAQRRPSAALSAF

SEQ ID NO: 831790 - protein, 18 aa, Mycobacterium
LDEIYSLLDLRNATCHQT

SEQ ID NO: 831791 - protein, 18 aa, Mycobacterium
LDEKMIYWDVRPSQNFPT

SEQ ID NO: 831792 - protein, 26 aa, Mycobacterium
LDELAKLPRWRLDLDDESIRFDTTTL

SEQ ID NO: 831793 - protein, 24 aa, Mycobacterium
LDELAPLVRAGLGDPQLPLACVLE

SEQ ID NO: 831794 - protein, 22 aa, Mycobacterium
LDELARLDDMYGKKLREAADDL

SEQ ID NO: 831795 - protein, 17 aa, Mycobacterium
LDELARRYGVHEVAAVP

SEQ ID NO: 831796 - protein, 23 aa, Mycobacterium
LDELDKVWGKLPFDAQWHSDNER

SEQ ID NO: 831797 - protein, 17 aa, Mycobacterium
LDELGLVGYPKTSGGRG

SEQ ID NO: 831798 - protein, 19 aa, Mycobacterium
LDELGRLYVCGRAKDMIVL

SEQ ID NO: 831799 - protein, 17 aa, Mycobacterium
LDELLNRWPEWGIDYET

SEQ ID NO: 831800 - protein, 24 aa, Mycobacterium
LDELNLAAPLVLPAGGSVAVQVVV

SEQ ID NO: 831801 - protein, 24 aa, Mycobacterium
LDELRAHIAPLQQLWTSEAAAAYQ

SEQ ID NO: 831802 - protein, 17 aa, Mycobacterium
LDELRRAILDGGVPPGT

SEQ ID NO: 831803 - protein, 25 aa, Mycobacterium
LDELRRIIPPWTTLGSRLASMPKPK

SEQ ID NO: 831804 - protein, 27 aa, Mycobacterium
LDELRRIIPPWVTLGSRLAVLPTPHRT

SEQ ID NO: 831805 - protein, 28 aa, Mycobacterium
LDELRRIIPPWVTLGSRLAVLPTPKRNY

SEQ ID NO: 831806 - protein, 27 aa, Mycobacterium
LDELRRLIPPWVTLGSRLAALPKPKRY

SEQ ID NO: 831807 - protein, 29 aa, Mycobacterium
LDELRRLIPPWVTLGSRLAAMPKPKRNYG

SEQ ID NO: 831808 - protein, 24 aa, Mycobacterium
LDELRRVWESLGVSRLSLIDAQLR

SEQ ID NO: 831809 - protein, 17 aa, Mycobacterium
LDELVGFCADLELRTRR

SEQ ID NO: 831810 - protein, 20 aa, Mycobacterium
LDELVRMALDWNRPVKLFIE

SEQ ID NO: 831811 - protein, 22 aa, Mycobacterium
LDENAWRTMLDVNLTGVWHTCR

SEQ ID NO: 831812 - protein, 17 aa, Mycobacterium
LDENGWFPTKDVAYLDS

SEQ ID NO: 831813 - protein, 27 aa, Mycobacterium
LDENLISDLILGVVSPVGDQGGDIART

SEQ ID NO: 831814 - protein, 26 aa, Mycobacterium
LDEPIGIVRFYADLLRGYEFSDDLGE

SEQ ID NO: 831815 - protein, 26 aa, Mycobacterium
LDEPYAGFDWDTYLKFWDLVARRRDD

SEQ ID NO: 831816 - protein, 17 aa, Mycobacterium
LDEQVSVVLSYLGGLIL

SEQ ID NO: 831817 - protein, 25 aa, Mycobacterium
LDEQYFLLDTDLLENAFRPILDEVD

SEQ ID NO: 831818 - protein, 22 aa, Mycobacterium
LDERGLLYLMDRKKDVIISGGE

SEQ ID NO: 831819 - protein, 17 aa, Mycobacterium
LDERTWQRLADTVDLIV

SEQ ID NO: 831820 - protein, 18 aa, Mycobacterium
LDERVADFAPLPAPDDVL

SEQ ID NO: 831821 - protein, 28 aa, Mycobacterium
LDESKKLLRGMPVVGPLAYALMHSLKVG

SEQ ID NO: 831822 - protein, 17 aa, Mycobacterium
LDESTYFSRDKFSFYHA

SEQ ID NO: 831823 - protein, 19 aa, Mycobacterium
LDETLYLHGSTGSGPLLAA

SEQ ID NO: 831824 - protein, 25 aa, Mycobacterium
LDETPMLLQPGVLSLAWGSVVRQLA

SEQ ID NO: 831825 - protein, 29 aa, Mycobacterium
LDEVDGYVWHAYLPNIIPGQRYGFRVYGP

SEQ ID NO: 831826 - protein, 24 aa, Mycobacterium
LDEVDPFRLRLLDGLATSITERGY

SEQ ID NO: 831827 - protein, 18 aa, Mycobacterium
LDEVIDRILPIMNDVAAV

SEQ ID NO: 831828 - protein, 24 aa, Mycobacterium
LDEVIRWLTGFDETTLRRRLTDGA

SEQ ID NO: 831829 - protein, 19 aa, Mycobacterium
LDEVPGCFVALGALPPGAD

SEQ ID NO: 831830 - protein, 18 aa, Mycobacterium
LDEVPRTPAFYFDAITQL

SEQ ID NO: 831831 - protein, 26 aa, Mycobacterium
LDEVSGWDSVYLLKLITALEQQTGRA

SEQ ID NO: 831832 - protein, 23 aa, Mycobacterium
LDEVTVPVRWWHGDHDHIVPFAH

SEQ ID NO: 831833 - protein, 26 aa, Mycobacterium
LDEVVTLYEQLLVRLAEAGVAWVQID

SEQ ID NO: 831834 - protein, 28 aa, Mycobacterium
LDEWAQIFAGEPDFFWSPVNTLEDVVAD

SEQ ID NO: 831835 - protein, 24 aa, Mycobacterium
LDEWNRYLAVNLTGTFLSIRAALS

SEQ ID NO: 831836 - protein, 26 aa, Mycobacterium
LDEWPTRLRRLISDQVSLILRRNIDP

SEQ ID NO: 831837 - protein, 26 aa, Mycobacterium
LDEWPTRLRRLISEQVSLILRRTIDP

SEQ ID NO: 831838 - protein, 18 aa, Mycobacterium
LDEWRVLSAAALVGLVEE

SEQ ID NO: 831839 - protein, 17 aa, Mycobacterium
LDEYVDWLIDAGHRIQR

SEQ ID NO: 831840 - protein, 35 aa, Mycobacterium
LDFAALTAVGDIFFPRVFLRRGQFLPAGTVTLTIY

SEQ ID NO: 831841 - protein, 29 aa, Mycobacterium
LDFADALAALWQWGLDIDWRPLYAEHDRV

SEQ ID NO: 831842 - protein, 22 aa, Mycobacterium
LDFANIPPTRFKRKEHWLPAHF

SEQ ID NO: 831843 - protein, 24 aa, Mycobacterium
LDFARLLGTPIGHPAASALAAKHM

SEQ ID NO: 831844 - protein, 19 aa, Mycobacterium
LDFDAAIATPDQMAKVGRI

SEQ ID NO: 831845 - protein, 34 aa, Mycobacterium
LDFDDLPRHRVAPPPLPAALLDLTSLRTQYQQAL

SEQ ID NO: 831846 - protein, 29 aa, Mycobacterium
LDFDPVPFDHPLWVLYSSGTTGLPKGIVQ

SEQ ID NO: 831847 - protein, 17 aa, Mycobacterium
LDFFAGAGALNYGHNNP

SEQ ID NO: 831848 - protein, 19 aa, Mycobacterium
LDFFFRKIVRDHGKALQFV

SEQ ID NO: 831849 - protein, 17 aa, Mycobacterium
LDFFVDGVARTSPARAA

SEQ ID NO: 831850 - protein, 24 aa, Mycobacterium
LDFGDLTYILPALGALFGFGDGPF

SEQ ID NO: 831851 - protein, 22 aa, Mycobacterium
LDFHAAIIGLLDSPRVDRFFAA

SEQ ID NO: 831852 - protein, 19 aa, Mycobacterium
LDFIGPYESLRWLPDTEVR

SEQ ID NO: 831853 - protein, 21 aa, Mycobacterium
LDFSDLRRDGKPLALVDKHST

SEQ ID NO: 831854 - protein, 29 aa, Mycobacterium
LDFTAVHPVWLRELAKRWCRWRMSCGVGL

SEQ ID NO: 831855 - protein, 27 aa, Mycobacterium
LDFTGLDDWTIWWGANLGAAGERLVAG

SEQ ID NO: 831856 - protein, 18 aa, Mycobacterium
LDFVFAEVWQRPGLTRRE

SEQ ID NO: 831857 - protein, 27 aa, Mycobacterium
LDFVGSIVEPAFAYPFAKQANSIRVRA

SEQ ID NO: 831858 - protein, 19 aa, Mycobacterium
LDFVLVVGHLFSLVVYGQL

SEQ ID NO: 831859 - protein, 21 aa, Mycobacterium
LDGADGAVLLRRLLREGVVVP

SEQ ID NO: 831860 - protein, 22 aa, Mycobacterium
LDGAEFTVFAPTDDAFAKIDPA

SEQ ID NO: 831861 - protein, 18 aa, Mycobacterium
LDGAWWPRTASISQELPE

SEQ ID NO: 831862 - protein, 23 aa, Mycobacterium
LDGAYLGQFALPANLAMSAQRTG

SEQ ID NO: 831863 - protein, 18 aa, Mycobacterium
LDGCSNRRILATASALRD

SEQ ID NO: 831864 - protein, 24 aa, Mycobacterium
LDGDRLPVDLAANAASLGADVIRV

SEQ ID NO: 831865 - protein, 19 aa, Mycobacterium
LDGELRLRTPRGRAPGANL

SEQ ID NO: 831866 - protein, 34 aa, Mycobacterium
LDGETHTVSWPRNAKLLDVLLAAGLDAPFSCREG

SEQ ID NO: 831867 - protein, 18 aa, Mycobacterium
LDGFFGQSSLAGYALTTQ

SEQ ID NO: 831868 - protein, 28 aa, Mycobacterium
LDGFRGAQVPIIWLNWGTRSDRANLPPN

SEQ ID NO: 831869 - protein, 18 aa, Mycobacterium
LDGFRKVVEVNLIGTFNV

SEQ ID NO: 831870 - protein, 24 aa, Mycobacterium
LDGGPMRDLLRRMQPTEFNDIVAV

SEQ ID NO: 831871 - protein, 25 aa, Mycobacterium
LDGGRWQDEWLYARAYTIAGGSSEI

SEQ ID NO: 831872 - protein, 18 aa, Mycobacterium
LDGIVANALTPSKWTPTI

SEQ ID NO: 831873 - protein, 30 aa, Mycobacterium
LDGKHLLESWIPLLALFAHAGAHDWSAVCI

SEQ ID NO: 831874 - protein, 29 aa, Mycobacterium
LDGKHLLESWIPLLALFAHDPGRDWSAIC

SEQ ID NO: 831875 - protein, 21 aa, Mycobacterium
LDGLAAAPGWVRREAAIDGIE

SEQ ID NO: 831876 - protein, 18 aa, Mycobacterium
LDGLAWRLREQGIAGTSV

SEQ ID NO: 831877 - protein, 20 aa, Mycobacterium
LDGLDEFWKDTPWRQPRQLQ

SEQ ID NO: 831878 - protein, 19 aa, Mycobacterium
LDGLDRLEAFVRDLRGGVV

SEQ ID NO: 831879 - protein, 23 aa, Mycobacterium
LDGLGHWWMVEDPQRGAAALTEF

SEQ ID NO: 831880 - protein, 19 aa, Mycobacterium
LDGLGWRLVLATGRGELGG

SEQ ID NO: 831881 - protein, 26 aa, Mycobacterium
LDGLGYRGFWMGYFAARSAPLGMVPH

SEQ ID NO: 831882 - protein, 24 aa, Mycobacterium
LDGLLLPEVILANRLSPALTFGGA

SEQ ID NO: 831883 - protein, 19 aa, Mycobacterium
LDGLPLAGVRIIDLTAFWA

SEQ ID NO: 831884 - protein, 25 aa, Mycobacterium
LDGLRKLFRQFSFPGGIPSHTAPET

SEQ ID NO: 831885 - protein, 20 aa, Mycobacterium
LDGLSRWVHSPAFGALCAEA

SEQ ID NO: 831886 - protein, 20 aa, Mycobacterium
LDGMDLVVLGLGGHRVTRTR

SEQ ID NO: 831887 - protein, 19 aa, Mycobacterium
LDGMRHYRSLFNVCMHPFL

SEQ ID NO: 831888 - protein, 19 aa, Mycobacterium
LDGMSRISGYLTPEARATL

SEQ ID NO: 831889 - protein, 20 aa, Mycobacterium
LDGNAIMKLLDIPAGPQVGE

SEQ ID NO: 831890 - protein, 29 aa, Mycobacterium
LDGNPVPKPVAVPVLWLGAAERVSAIVEM

SEQ ID NO: 831891 - protein, 23 aa, Mycobacterium
LDGNQIMTLLDIPAGPQVGEAWR

SEQ ID NO: 831892 - protein, 26 aa, Mycobacterium
LDGNTEHLFFIFSAALCTIAEHVVPA

SEQ ID NO: 831893 - protein, 25 aa, Mycobacterium
LDGPARMRVALDVRAGFGTAPMSGL

SEQ ID NO: 831894 - protein, 28 aa, Mycobacterium
LDGPGSVLLVLPTLRLIKLTSVVENGVE

SEQ ID NO: 831895 - protein, 20 aa, Mycobacterium
LDGPPIRYFLPGADEWRTAE

SEQ ID NO: 831896 - protein, 17 aa, Mycobacterium
LDGPQRYGDLSAALSPI

SEQ ID NO: 831897 - protein, 17 aa, Mycobacterium
LDGPTELTIPPGTQPGS

SEQ ID NO: 831898 - protein, 18 aa, Mycobacterium
LDGPTLLAPALGAATIGD

SEQ ID NO: 831899 - protein, 20 aa, Mycobacterium
LDGQKTWITDGHWADMGLAL

SEQ ID NO: 831900 - protein, 26 aa, Mycobacterium
LDGQRIRGLLAQRIDLMPPLRWRVRE

SEQ ID NO: 831901 - protein, 31 aa, Mycobacterium
LDGRDMAEMFAWLRPTDLVWRYWVNNYVQGR

SEQ ID NO: 831902 - protein, 18 aa, Mycobacterium
LDGRFIPAGPSGSPLRGL

SEQ ID NO: 831903 - protein, 29 aa, Mycobacterium
LDGRLLADGGILDPLPIAPIAAVNADLTI

SEQ ID NO: 831904 - protein, 21 aa, Mycobacterium
LDGRPMLRHRMELGAGSLADD

SEQ ID NO: 831905 - protein, 28 aa, Mycobacterium
LDGSIARVALTPAVTRWTESELAAAITE

SEQ ID NO: 831906 - protein, 22 aa, Mycobacterium
LDGSPLIYNRPDPYLPDLLMCR

SEQ ID NO: 831907 - protein, 17 aa, Mycobacterium
LDGVFPPGSTLPPERDL

SEQ ID NO: 831908 - protein, 20 aa, Mycobacterium
LDGVIPVRIDITDPASVQAA

SEQ ID NO: 831909 - protein, 21 aa, Mycobacterium
LDGVIRTRGRLWLASNPDRAM

SEQ ID NO: 831910 - protein, 24 aa, Mycobacterium
LDGVIRTRGRLWLATQGEQAMWLE

SEQ ID NO: 831911 - protein, 17 aa, Mycobacterium
LDGVRLPDSARLPGATS

SEQ ID NO: 831912 - protein, 18 aa, Mycobacterium
LDGVTLRDWAHTAVSELI

SEQ ID NO: 831913 - protein, 17 aa, Mycobacterium
LDGWSVPILLNETFACY

SEQ ID NO: 831914 - protein, 21 aa, Mycobacterium
LDGYGLHIIERVPLPVRANKE

SEQ ID NO: 831915 - protein, 22 aa, Mycobacterium
LDGYGLHIIERVPLPVRANSEN

SEQ ID NO: 831916 - protein, 18 aa, Mycobacterium
LDGYPRPGKTVLFLGRYD

SEQ ID NO: 831917 - protein, 28 aa, Mycobacterium
LDGYPRPGKTVLFLGRYDEPRKGMAVLL

SEQ ID NO: 831918 - protein, 18 aa, Mycobacterium
LDHAGITELFALLAYGEV

SEQ ID NO: 831919 - protein, 26 aa, Mycobacterium
LDHAPLPEEPLRWLDDIFIGYLVERR

SEQ ID NO: 831920 - protein, 35 aa, Mycobacterium
LDHARSWYRPDPAAQWQLLITDLSGLPATARILEE

SEQ ID NO: 831921 - protein, 18 aa, Mycobacterium
LDHDLPIITTPHAAKRLH

SEQ ID NO: 831922 - protein, 34 aa, Mycobacterium
LDHEWSWLVINQWRPGGPAWFTALHQAAWHGAPA

SEQ ID NO: 831923 - protein, 17 aa, Mycobacterium
LDHLGRNVATLIDLLAP

SEQ ID NO: 831924 - protein, 21 aa, Mycobacterium
LDHLKFAVLALGDSSYELFCN

SEQ ID NO: 831925 - protein, 26 aa, Mycobacterium
LDHLQRLTAELGTALLLITHDLALAA

SEQ ID NO: 831926 - protein, 23 aa, Mycobacterium
LDHLRHLGRIPATMRYTAQGLAR

SEQ ID NO: 831927 - protein, 25 aa, Mycobacterium
LDHPKRFFRPPPPLTDVTMRQVKKG

SEQ ID NO: 831928 - protein, 23 aa, Mycobacterium
LDHQIWQCPVVLLADVRSVGVQG

SEQ ID NO: 831929 - protein, 18 aa, Mycobacterium
LDHTWASVTWQQVGERVS

SEQ ID NO: 831930 - protein, 24 aa, Mycobacterium
LDHYLEILYRKPGALPGATALVQA

SEQ ID NO: 831931 - protein, 25 aa, Mycobacterium
LDIARKYPDFPIVLEAVRECLQDVY

SEQ ID NO: 831932 - protein, 24 aa, Mycobacterium
LDIAVVYAFLQQSLPPTLPDELLA

SEQ ID NO: 831933 - protein, 20 aa, Mycobacterium
LDICDQFGISISEVALRNES

SEQ ID NO: 831934 - protein, 38 aa, Mycobacterium
LDIDKFAPRLSFFWGIGMNFFMEVAKLRAGRLLWSDLV

SEQ ID NO: 831935 - protein, 17 aa, Mycobacterium
LDIEGTEQLALTKALDV

SEQ ID NO: 831936 - protein, 21 aa, Mycobacterium
LDIEMLGYEAGAALLSARVIG

SEQ ID NO: 831937 - protein, 22 aa, Mycobacterium
LDIENYWFRRHEVVYERLAPRC

SEQ ID NO: 831938 - protein, 17 aa, Mycobacterium
LDIFADSGALSVYAACL

SEQ ID NO: 831939 - protein, 22 aa, Mycobacterium
LDIFETMSRWRPTLSGERSAYV

SEQ ID NO: 831940 - protein, 32 aa, Mycobacterium
LDIFSKVIGINLIGSFNLIRLAATAISQEEPV

SEQ ID NO: 831941 - protein, 25 aa, Mycobacterium
LDIGAPPQFMDFRYTVHDRWHGEFH

SEQ ID NO: 831942 - protein, 26 aa, Mycobacterium
LDIGAPPQFMDFRYVVHDRWHGEFYL

SEQ ID NO: 831943 - protein, 32 aa, Mycobacterium
LDIGFMESVIWVFKQLWDKGLAYEGNRVLPYC

SEQ ID NO: 831944 - protein, 18 aa, Mycobacterium
LDIGHRTVPNYGGFDLGV

SEQ ID NO: 831945 - protein, 21 aa, Mycobacterium
LDIHAHHLLLDGGAIGVIEAD

SEQ ID NO: 831946 - protein, 18 aa, Mycobacterium
LDIKGHIVKKILVAEASD

SEQ ID NO: 831947 - protein, 18 aa, Mycobacterium
LDILPLTAPVINLAETIG

SEQ ID NO: 831948 - protein, 17 aa, Mycobacterium
LDILSMRIPKPWFVLMP

SEQ ID NO: 831949 - protein, 22 aa, Mycobacterium
LDIMSRGLYRAVRTPLVIGASD

SEQ ID NO: 831950 - protein, 25 aa, Mycobacterium
LDISEQLARRRLGYGRGARMAFERD

SEQ ID NO: 831951 - protein, 29 aa, Mycobacterium
LDISPLQARCGWAIGWKKDAFFGRDALLA

SEQ ID NO: 831952 - protein, 29 aa, Mycobacterium
LDISPLQARCGWAVGWKKDAFWGRDALLA

SEQ ID NO: 831953 - protein, 36 aa, Mycobacterium
LDISWDAIFTAEVFGRFKPDPSVYRGALRYLGVEPY

SEQ ID NO: 831954 - protein, 18 aa, Mycobacterium
LDITLYRDDLMQKPPRPL

SEQ ID NO: 831955 - protein, 21 aa, Mycobacterium
LDIVGLLRVIADMSDVLPPLS

SEQ ID NO: 831956 - protein, 19 aa, Mycobacterium
LDIVVANAGVLSWGRLWEL

SEQ ID NO: 831957 - protein, 17 aa, Mycobacterium
LDIWLSQEAGFAGTQWQ

SEQ ID NO: 831958 - protein, 30 aa, Mycobacterium
LDKAKTVALWRVLVALSIRHVGPTAARALA

SEQ ID NO: 831959 - protein, 17 aa, Mycobacterium
LDKAMLDWGTRELHEEM

SEQ ID NO: 831960 - protein, 23 aa, Mycobacterium
LDKLGLPSKPSGWRKNTMACTGI

SEQ ID NO: 831961 - protein, 26 aa, Mycobacterium
LDKLGVAAFELLVVNLYPFSQTVESG

SEQ ID NO: 831962 - protein, 18 aa, Mycobacterium
LDKLLDVALAACDKLFAA

SEQ ID NO: 831963 - protein, 22 aa, Mycobacterium
LDKLLDVALAACDKLFAAQREA

SEQ ID NO: 831964 - protein, 21 aa, Mycobacterium
LDKLVAEGVVLAPPPQALVHA

SEQ ID NO: 831965 - protein, 26 aa, Mycobacterium
LDKSRPLWEMYLIEGLEKGRVALYTK

SEQ ID NO: 831966 - protein, 17 aa, Mycobacterium
LDKTLGVPLFQEQLMQL

SEQ ID NO: 831967 - protein, 25 aa, Mycobacterium
LDKTRPLWEMYLAEGLAKNRVAIYT

SEQ ID NO: 831968 - protein, 26 aa, Mycobacterium
LDKVPALNPHQIDDLILGCGLPGGES

SEQ ID NO: 831969 - protein, 18 aa, Mycobacterium
LDKWVIYVPNENAEAVQA

SEQ ID NO: 831970 - protein, 20 aa, Mycobacterium
LDLAFPHQQFVPLDGKRREA

SEQ ID NO: 831971 - protein, 21 aa, Mycobacterium
LDLAGLMAIPPLDSDPDEAFD

SEQ ID NO: 831972 - protein, 18 aa, Mycobacterium
LDLALISVPNRFPPQLEM

SEQ ID NO: 831973 - protein, 25 aa, Mycobacterium
LDLATRLPGFLMDAPVILRGVATGF

SEQ ID NO: 831974 - protein, 18 aa, Mycobacterium
LDLDFFISTSSIASVWGG

SEQ ID NO: 831975 - protein, 19 aa, Mycobacterium
LDLDLNWLSSDPFYRDSLE

SEQ ID NO: 831976 - protein, 21 aa, Mycobacterium
LDLDLRLVRYFTVVAEQRHFG

SEQ ID NO: 831977 - protein, 19 aa, Mycobacterium
LDLDRHGLSWLLPDIDCVH

SEQ ID NO: 831978 - protein, 19 aa, Mycobacterium
LDLDSACRQGFPRRDLDAA

SEQ ID NO: 831979 - protein, 20 aa, Mycobacterium
LDLFRSPAAAQSFVIDPDGA

SEQ ID NO: 831980 - protein, 21 aa, Mycobacterium
LDLFRSPASAAAFIADPDGSL

SEQ ID NO: 831981 - protein, 25 aa, Mycobacterium
LDLGLRNYWGYNTFGFFAPHNQYAA

SEQ ID NO: 831982 - protein, 26 aa, Mycobacterium
LDLGLRNYWGYNTFGFFAPHNQYAAT

SEQ ID NO: 831983 - protein, 25 aa, Mycobacterium
LDLGLRNYWGYNTFGFFAPHNQYAS

SEQ ID NO: 831984 - protein, 34 aa, Mycobacterium
LDLGLRNYWGYNTVGFFAPHFQYAATRNAGGAVA

SEQ ID NO: 831985 - protein, 27 aa, Mycobacterium
LDLGPADIFAFPVTITLSYRASSVPAS

SEQ ID NO: 831986 - protein, 17 aa, Mycobacterium
LDLKRPANWLLAARCAR

SEQ ID NO: 831987 - protein, 17 aa, Mycobacterium
LDLLAAAETLLAATGNA

SEQ ID NO: 831988 - protein, 22 aa, Mycobacterium
LDLLGFDFLVDGLVVALTEPRL

SEQ ID NO: 831989 - protein, 21 aa, Mycobacterium
LDLLHRFRLWGSADLRRWLPL

SEQ ID NO: 831990 - protein, 29 aa, Mycobacterium
LDLLKDEVGFTQLLYDDHIGKLSLIGAGM

SEQ ID NO: 831991 - protein, 18 aa, Mycobacterium
LDLLRRNLTRYGSDELVP

SEQ ID NO: 831992 - protein, 22 aa, Mycobacterium
LDLLYRMADFCRPDWMVMVDAD

SEQ ID NO: 831993 - protein, 45 aa, Mycobacterium
LDLNLRLRPRRYRELLQKLLHQLVAGQLRMLPVTAFSLDHAVDAF

SEQ ID NO: 831994 - protein, 26 aa, Mycobacterium
LDLNVRPVFLTLKYAGRAMVRNGGGS

SEQ ID NO: 831995 - protein, 19 aa, Mycobacterium
LDLPAVAPLAGVHAELRVA

SEQ ID NO: 831996 - protein, 26 aa, Mycobacterium
LDLQLAGPHRDALLRRLHAAAAGGEI

SEQ ID NO: 831997 - protein, 20 aa, Mycobacterium
LDLQRRLWSVSEELTDVVFP

SEQ ID NO: 831998 - protein, 20 aa, Mycobacterium
LDLRAAAAFKVTAARLGEEV

SEQ ID NO: 831999 - protein, 18 aa, Mycobacterium
LDLRIARLTGRVAVIRVG

SEQ ID NO: 832000 - protein, 24 aa, Mycobacterium
LDLRKLRYFVAVAEELNFGRAAQR

SEQ ID NO: 832001 - protein, 26 aa, Mycobacterium
LDLRNRALLELLYSTGARISEAVGLD

SEQ ID NO: 832002 - protein, 27 aa, Mycobacterium
LDLRPISAPFYPKDYVPYCFDPTALIT

SEQ ID NO: 832003 - protein, 30 aa, Mycobacterium
LDLRRLVDRAGRWLLNYRPQPLAVGAEINR

SEQ ID NO: 832004 - protein, 19 aa, Mycobacterium
LDLSGFSALATQVDMAALA

SEQ ID NO: 832005 - protein, 26 aa, Mycobacterium
LDLSRTVGWFTAKYPASLTPAELRWA

SEQ ID NO: 832006 - protein, 25 aa, Mycobacterium
LDLSSLWQIYSVDRPGLKDPPFVPA

SEQ ID NO: 832007 - protein, 18 aa, Mycobacterium
LDLSYPTLGPQVCQFIEE

SEQ ID NO: 832008 - protein, 18 aa, Mycobacterium
LDLSYRMHPAVCAAVSAL

SEQ ID NO: 832009 - protein, 17 aa, Mycobacterium
LDLTGCMALGITGPILR

SEQ ID NO: 832010 - protein, 20 aa, Mycobacterium
LDLVGCWVHSADKSGHDVGE

SEQ ID NO: 832011 - protein, 17 aa, Mycobacterium
LDLVLGHGLHRVDQAAL

SEQ ID NO: 832012 - protein, 27 aa, Mycobacterium
LDLVNAPTQTLFNRPLIGNGANGAPGT

SEQ ID NO: 832013 - protein, 25 aa, Mycobacterium
LDLVRAFSRYFNVDPSYFTVDSPAR

SEQ ID NO: 832014 - protein, 19 aa, Mycobacterium
LDLVRRGVPVIPHGVALSL

SEQ ID NO: 832015 - protein, 22 aa, Mycobacterium
LDLVYSLGFTLTGLLPCFIDAR

SEQ ID NO: 832016 - protein, 17 aa, Mycobacterium
LDLYHENIRYFPPLLPE

SEQ ID NO: 832017 - protein, 18 aa, Mycobacterium
LDMALRNHPHRVDYSSIA

SEQ ID NO: 832018 - protein, 19 aa, Mycobacterium
LDMARLFGESRLGAGPGAD

SEQ ID NO: 832019 - protein, 17 aa, Mycobacterium
LDMDAFFASVEQLTRPT

SEQ ID NO: 832020 - protein, 31 aa, Mycobacterium
LDMLAEIPDIAIPLVFRLLGESGAHAPVLND

SEQ ID NO: 832021 - protein, 18 aa, Mycobacterium
LDMLAPWEVLDSVSRLVS

SEQ ID NO: 832022 - protein, 18 aa, Mycobacterium
LDMLAPWEVLDSVSRLVV

SEQ ID NO: 832023 - protein, 33 aa, Mycobacterium
LDMLAPWEVLGAVSRLLIPGGVLMIYVATVTQL

SEQ ID NO: 832024 - protein, 28 aa, Mycobacterium
LDMLVRAAPTLTLHLSWPAPAALKDRED

SEQ ID NO: 832025 - protein, 17 aa, Mycobacterium
LDMLVSDALTVTLHLSW

SEQ ID NO: 832026 - protein, 18 aa, Mycobacterium
LDMNAAIGQLGRLITTEP

SEQ ID NO: 832027 - protein, 19 aa, Mycobacterium
LDMTVWIMRRPEDDIAAEL

SEQ ID NO: 832028 - protein, 17 aa, Mycobacterium
LDMVRRRSRIRMEALPE

SEQ ID NO: 832029 - protein, 33 aa, Mycobacterium
LDMVSYPIEAGVKKVYYWAARSTGGDFTPGNEV

SEQ ID NO: 832030 - protein, 22 aa, Mycobacterium
LDMWCHLDPVWGPAREVRACQP

SEQ ID NO: 832031 - protein, 26 aa, Mycobacterium
LDNACHELVFRLGFRRAVLSTVDTRG

SEQ ID NO: 832032 - protein, 23 aa, Mycobacterium
LDNAGRLFIVGREDDMIISGGEN

SEQ ID NO: 832033 - protein, 25 aa, Mycobacterium
LDNDEFRLYELIWQRTVASQMADAR

SEQ ID NO: 832034 - protein, 25 aa, Mycobacterium
LDNFALPDGTLWSIPIVFDMSADDI

SEQ ID NO: 832035 - protein, 22 aa, Mycobacterium
LDNFLRDDFLRNFWMQMIRNPV

SEQ ID NO: 832036 - protein, 31 aa, Mycobacterium
LDNGTLPRLSSFSIAGWLRGKSRTQAVSEVM

SEQ ID NO: 832037 - protein, 32 aa, Mycobacterium
LDNGVRLFDVLRGTHFTLLTFGAQAPVIADVC

SEQ ID NO: 832038 - protein, 17 aa, Mycobacterium
LDNGWWRMGDVGYRTRW

SEQ ID NO: 832039 - protein, 17 aa, Mycobacterium
LDNLDGPGLPVLRQRLL

SEQ ID NO: 832040 - protein, 28 aa, Mycobacterium
LDNLGRPTSFIWYGPRWAQAATAPSRLH

SEQ ID NO: 832041 - protein, 22 aa, Mycobacterium
LDNLSALGEAYIGLAPRTSGGP

SEQ ID NO: 832042 - protein, 24 aa, Mycobacterium
LDNPPAWYDPDLWERGRQLWNNSS

SEQ ID NO: 832043 - protein, 23 aa, Mycobacterium
LDNQIWQCPVVLLADVRSVGVQG

SEQ ID NO: 832044 - protein, 27 aa, Mycobacterium
LDNRGSQFYLALYWAAELAAQTEDVEL

SEQ ID NO: 832045 - protein, 25 aa, Mycobacterium
LDNRHREWISTLPVLRTRDGVEVDK

SEQ ID NO: 832046 - protein, 23 aa, Mycobacterium
LDNTLVFYIWGDNGASMEGTITG

SEQ ID NO: 832047 - protein, 21 aa, Mycobacterium
LDNVFATPLLQQGIPMGADVV

SEQ ID NO: 832048 - protein, 26 aa, Mycobacterium
LDNVFATPLLQRGIPLGVDVVVYSGT

SEQ ID NO: 832049 - protein, 21 aa, Mycobacterium
LDNVMMYWVTGTAASSARLYW

SEQ ID NO: 832050 - protein, 23 aa, Mycobacterium
LDNYHRMTTPSTWLEALVKTYIG

SEQ ID NO: 832051 - protein, 27 aa, Mycobacterium
LDPAIVRALVRHPRLARRYLAVEGHRA

SEQ ID NO: 832052 - protein, 22 aa, Mycobacterium
LDPAKYFIIVPNMLGNGLSTSP

SEQ ID NO: 832053 - protein, 24 aa, Mycobacterium
LDPALVDDVILGEGLYGGGVIARH

SEQ ID NO: 832054 - protein, 20 aa, Mycobacterium
LDPAQYRNRYPRELSGGQQQ

SEQ ID NO: 832055 - protein, 21 aa, Mycobacterium
LDPDLLLGEMSFVPGPAAGSE

SEQ ID NO: 832056 - protein, 18 aa, Mycobacterium
LDPDLSFKDLGIDSLSAL

SEQ ID NO: 832057 - protein, 21 aa, Mycobacterium
LDPDVVILDIGLPGIDGLEVC

SEQ ID NO: 832058 - protein, 27 aa, Mycobacterium
LDPEMTSPYAWYQYFVNTADADVLGYL

SEQ ID NO: 832059 - protein, 17 aa, Mycobacterium
LDPFFAACADHSALVFV

SEQ ID NO: 832060 - protein, 23 aa, Mycobacterium
LDPFRREIFMIGRNTQVTRYEKV

SEQ ID NO: 832061 - protein, 29 aa, Mycobacterium
LDPGARVIFIERLRYLGDLPLSLDKTYLT

SEQ ID NO: 832062 - protein, 20 aa, Mycobacterium
LDPGEWFPTGDLGYLTDDGL

SEQ ID NO: 832063 - protein, 21 aa, Mycobacterium
LDPHLLMWDIRRTVPIDAWPR

SEQ ID NO: 832064 - protein, 17 aa, Mycobacterium
LDPIRQSLPGKAIDAGI

SEQ ID NO: 832065 - protein, 17 aa, Mycobacterium
LDPLPAGGGTPTRWVYY

SEQ ID NO: 832066 - protein, 18 aa, Mycobacterium
LDPMIKGERPTFSGSWYQ

SEQ ID NO: 832067 - protein, 30 aa, Mycobacterium
LDPNRAMRLEALPGWTWGPRSRRTSATPRT

SEQ ID NO: 832068 - protein, 30 aa, Mycobacterium
LDPQAYREFLTEIGYLLPAPEDFTITTSGV

SEQ ID NO: 832069 - protein, 30 aa, Mycobacterium
LDPQDPLLSPLFFEDAVFAALPPSTIYVGE

SEQ ID NO: 832070 - protein, 19 aa, Mycobacterium
LDPQGLPLRLLTDATGDPA

SEQ ID NO: 832071 - protein, 27 aa, Mycobacterium
LDPQNDVEFFFLRPKDIAIYVGSGELD

SEQ ID NO: 832072 - protein, 29 aa, Mycobacterium
LDPQRPTILAIHGWPDNHHLWDPVAELLG

SEQ ID NO: 832073 - protein, 25 aa, Mycobacterium
LDPQRVVAVLLAFGSPHAHNVILLR

SEQ ID NO: 832074 - protein, 22 aa, Mycobacterium
LDPRLPISDLLAEPLQANGFNK

SEQ ID NO: 832075 - protein, 23 aa, Mycobacterium
LDPRLPVFDVLAEPLIANGFDKS

SEQ ID NO: 832076 - protein, 23 aa, Mycobacterium
LDPRLPVFELLAEPLRANGFDKG

SEQ ID NO: 832077 - protein, 20 aa, Mycobacterium
LDPRLPVSDLLAEPLQANGF

SEQ ID NO: 832078 - protein, 17 aa, Mycobacterium
LDPRRFEVIAIGITPQG

SEQ ID NO: 832079 - protein, 25 aa, Mycobacterium
LDPSGRPFPPLAAEATPPVVPPDPE

SEQ ID NO: 832080 - protein, 20 aa, Mycobacterium
LDPTLQLMLSGLRAVGIDGL

SEQ ID NO: 832081 - protein, 18 aa, Mycobacterium
LDPVAQVGFCRLLGEVDH

SEQ ID NO: 832082 - protein, 18 aa, Mycobacterium
LDPVLRVDLWQQFAELAR

SEQ ID NO: 832083 - protein, 23 aa, Mycobacterium
LDPVLVGESLIGPLYAHGAAGAD

SEQ ID NO: 832084 - protein, 26 aa, Mycobacterium
LDPVTNYDVMFVPQGIGADLIATIEG

SEQ ID NO: 832085 - protein, 21 aa, Mycobacterium
LDPWHGAWFHPYSFTRLEVLT

SEQ ID NO: 832086 - protein, 32 aa, Mycobacterium
LDQFDINVHGLFWTLNAALPALRQSEPGLFLH

SEQ ID NO: 832087 - protein, 38 aa, Mycobacterium
LDQFHDVLIALSYSIPWVLRTVLLARAGFDPATLREAY

SEQ ID NO: 832088 - protein, 25 aa, Mycobacterium
LDQHLEGHVLVLERLEAAGAHPGEQ

SEQ ID NO: 832089 - protein, 20 aa, Mycobacterium
LDQISAYVRRLVIPEKSIVL

SEQ ID NO: 832090 - protein, 17 aa, Mycobacterium
LDQLEADVKRWVTLAAE

SEQ ID NO: 832091 - protein, 17 aa, Mycobacterium
LDQLIANRPIIAAEIND

SEQ ID NO: 832092 - protein, 19 aa, Mycobacterium
LDQLLALGTLLEGHAEHVM

SEQ ID NO: 832093 - protein, 17 aa, Mycobacterium
LDQMLAFSINRQVRGRP

SEQ ID NO: 832094 - protein, 21 aa, Mycobacterium
LDQPVQRFWRDAHAGRVHAAN

SEQ ID NO: 832095 - protein, 28 aa, Mycobacterium
LDQRFDRDLWRKLIDAGILSSASASSLG

SEQ ID NO: 832096 - protein, 18 aa, Mycobacterium
LDQRLDAVRVEHVGAELH

SEQ ID NO: 832097 - protein, 20 aa, Mycobacterium
LDQRWSSYGVYWPVPNSIPV

SEQ ID NO: 832098 - protein, 24 aa, Mycobacterium
LDQYLRTVILKRMGLERPGQDRAL

SEQ ID NO: 832099 - protein, 24 aa, Mycobacterium
LDQYMRTVILKRLGLERPTQDRAL

SEQ ID NO: 832100 - protein, 24 aa, Mycobacterium
LDRAFPGLTLALPDVLATRIGRLV

SEQ ID NO: 832101 - protein, 17 aa, Mycobacterium
LDRAFPGLTLALPDVLG

SEQ ID NO: 832102 - protein, 18 aa, Mycobacterium
LDRAGVIAHTLWVTPNRA

SEQ ID NO: 832103 - protein, 23 aa, Mycobacterium
LDRAPNCHVAFGLGPHRCIGSHL

SEQ ID NO: 832104 - protein, 26 aa, Mycobacterium
LDRASQLALTLRLISGLTAAEIARAL

SEQ ID NO: 832105 - protein, 25 aa, Mycobacterium
LDRDRPMWELWVIEGLTDDRWAMLT

SEQ ID NO: 832106 - protein, 24 aa, Mycobacterium
LDRDVQSLFGVWRGSAADAYRSGW

SEQ ID NO: 832107 - protein, 25 aa, Mycobacterium
LDRDYFNMVLAAYDAIVGGPRYVYE

SEQ ID NO: 832108 - protein, 24 aa, Mycobacterium
LDREELWLRYRQAAAYAYVATTIV

SEQ ID NO: 832109 - protein, 20 aa, Mycobacterium
LDREILGIAEAIRASGLSAG

SEQ ID NO: 832110 - protein, 20 aa, Mycobacterium
LDRELLGISEALRSSGLSAG

SEQ ID NO: 832111 - protein, 25 aa, Mycobacterium
LDRERPLWEIWIIEGLSDNRWAMLT

SEQ ID NO: 832112 - protein, 37 aa, Mycobacterium
LDRFRELLFNPETLPDLLRFTGPFNFSGSPTITLPGG

SEQ ID NO: 832113 - protein, 31 aa, Mycobacterium
LDRGALPVKLSYAGPFFRYERPQAGRYRQLQ

SEQ ID NO: 832114 - protein, 17 aa, Mycobacterium
LDRGGFFAKLTANRSYC

SEQ ID NO: 832115 - protein, 27 aa, Mycobacterium
LDRGGLLHWARPIAPLILNASSRGGQG

SEQ ID NO: 832116 - protein, 26 aa, Mycobacterium
LDRGHFLLDYVLDDLLRFGGWHIVIQ

SEQ ID NO: 832117 - protein, 17 aa, Mycobacterium
LDRGVRVGCFRPPTVPA

SEQ ID NO: 832118 - protein, 18 aa, Mycobacterium
LDRGWDLGRLYDPDPDRL

SEQ ID NO: 832119 - protein, 23 aa, Mycobacterium
LDRGWYVRPTLFAAADNSMRIAR

SEQ ID NO: 832120 - protein, 28 aa, Mycobacterium
LDRHTQPLIRLPLGSEALALRLIPGVPD

SEQ ID NO: 832121 - protein, 17 aa, Mycobacterium
LDRIAAATRPAVIVGAG

SEQ ID NO: 832122 - protein, 21 aa, Mycobacterium
LDRIFLVAPSSTPERLERTIG

SEQ ID NO: 832123 - protein, 26 aa, Mycobacterium
LDRKGPGRPPLMFRAVRQMDRGGTRH

SEQ ID NO: 832124 - protein, 19 aa, Mycobacterium
LDRLCELSFEVLTIPERLR

SEQ ID NO: 832125 - protein, 26 aa, Mycobacterium
LDRLDEIWTTFTKLAPKQLIVDELLY

SEQ ID NO: 832126 - protein, 25 aa, Mycobacterium
LDRLDEIWTTFTKLAPKQLIVDEVL

SEQ ID NO: 832127 - protein, 25 aa, Mycobacterium
LDRLEDIWSTFTKLAPKQLIVDENL

SEQ ID NO: 832128 - protein, 25 aa, Mycobacterium
LDRLEEIWTTFTKLAPKQLIVDENL

SEQ ID NO: 832129 - protein, 17 aa, Mycobacterium
LDRLGWNTDAHVELLWA

SEQ ID NO: 832130 - protein, 24 aa, Mycobacterium
LDRLHVVALPMRVRFRGITTREVA

SEQ ID NO: 832131 - protein, 25 aa, Mycobacterium
LDRLHVVALPMRVRFRGITTREVAL

SEQ ID NO: 832132 - protein, 23 aa, Mycobacterium
LDRLKELVLKPVEGSGGYGIVFG

SEQ ID NO: 832133 - protein, 17 aa, Mycobacterium
LDRLLDFMPRYEVLFDE

SEQ ID NO: 832134 - protein, 17 aa, Mycobacterium
LDRLQTHYVGRPSPLYE

SEQ ID NO: 832135 - protein, 25 aa, Mycobacterium
LDRPAFVYPMFEQALRIAAGETPDE

SEQ ID NO: 832136 - protein, 24 aa, Mycobacterium
LDRPKLVFVFDEAHLLFADASKAF

SEQ ID NO: 832137 - protein, 21 aa, Mycobacterium
LDRPWRRPGALRYALSRICGI

SEQ ID NO: 832138 - protein, 21 aa, Mycobacterium
LDRQMRVWARTLLDGYPAEQL

SEQ ID NO: 832139 - protein, 25 aa, Mycobacterium
LDRQSQLALTLRLVSGLTVAEIARA

SEQ ID NO: 832140 - protein, 25 aa, Mycobacterium
LDRQSQLALTLRLVSGLTVGEIARA

SEQ ID NO: 832141 - protein, 25 aa, Mycobacterium
LDRQSQLALTLRLVSGLTVTEIARA

SEQ ID NO: 832142 - protein, 27 aa, Mycobacterium
LDRRAARRLYRLPLAIARLARSGRITQ

SEQ ID NO: 832143 - protein, 22 aa, Mycobacterium
LDRRDGAAWLQENHSGAGLFGS

SEQ ID NO: 832144 - protein, 25 aa, Mycobacterium
LDRRGLLRRVGGAPYLHTLISTVPT

SEQ ID NO: 832145 - protein, 25 aa, Mycobacterium
LDRRGMLRRIGGAPYLHTLISTVPT

SEQ ID NO: 832146 - protein, 19 aa, Mycobacterium
LDRRQLIGFCLLVTQYDGL

SEQ ID NO: 832147 - protein, 20 aa, Mycobacterium
LDRRSAALAIALLAEGISKG

SEQ ID NO: 832148 - protein, 17 aa, Mycobacterium
LDRRTRIGLVARDRVRA

SEQ ID NO: 832149 - protein, 21 aa, Mycobacterium
LDRRVRVLERLWLHALWGGQS

SEQ ID NO: 832150 - protein, 24 aa, Mycobacterium
LDRSRPELWAARRPGQVFVVEQHS

SEQ ID NO: 832151 - protein, 24 aa, Mycobacterium
LDRSRPLWEFHFAEGLAGGRFALV

SEQ ID NO: 832152 - protein, 25 aa, Mycobacterium
LDRSRPLWEMYFIEGLANDRIAVVG

SEQ ID NO: 832153 - protein, 25 aa, Mycobacterium
LDRSRPLWEMYLIEGLADGRIAVLG

SEQ ID NO: 832154 - protein, 19 aa, Mycobacterium
LDRSYAMTRFATEHPLIRL

SEQ ID NO: 832155 - protein, 23 aa, Mycobacterium
LDRTGLWGRLLPEWGSIRDLPPR

SEQ ID NO: 832156 - protein, 23 aa, Mycobacterium
LDRTLMFPTLASLLEERLRDDPV

SEQ ID NO: 832157 - protein, 27 aa, Mycobacterium
LDRTSFVPGVLLAVRKISGLQGLTVGI

SEQ ID NO: 832158 - protein, 24 aa, Mycobacterium
LDRTSFVPGVLLAVRRVQERPGLT

SEQ ID NO: 832159 - protein, 18 aa, Mycobacterium
LDRVDVPVLLVGGWQDIF

SEQ ID NO: 832160 - protein, 20 aa, Mycobacterium
LDRWSAVMMNNYGTPPLALA

SEQ ID NO: 832161 - protein, 19 aa, Mycobacterium
LDRYFDYAEGRLGWRTLDF

SEQ ID NO: 832162 - protein, 20 aa, Mycobacterium
LDRYHLPYNALTQTSLGDID

SEQ ID NO: 832163 - protein, 22 aa, Mycobacterium
LDRYLGLWYEIGRLPLRWEHPE

SEQ ID NO: 832164 - protein, 19 aa, Mycobacterium
LDRYLYTPMGYPTDYGFFE

SEQ ID NO: 832165 - protein, 27 aa, Mycobacterium
LDRYPSRRSALLPLLHLVQSEDGYVTT

SEQ ID NO: 832166 - protein, 23 aa, Mycobacterium
LDRYRRLGFDARAYDGPDRYGFV

SEQ ID NO: 832167 - protein, 24 aa, Mycobacterium
LDSADRLWIPVRRSWRLNERHYGA

SEQ ID NO: 832168 - protein, 24 aa, Mycobacterium
LDSDGILNLRFIPGSMVVVGAGVI

SEQ ID NO: 832169 - protein, 22 aa, Mycobacterium
LDSDGWVHLYTVRSSVLVSVGV

SEQ ID NO: 832170 - protein, 26 aa, Mycobacterium
LDSDYVFVNLWSGPIGYPLTYASVYD

SEQ ID NO: 832171 - protein, 33 aa, Mycobacterium
LDSESQLALPQWLADLLPAPLPRGTVAVLSGAR

SEQ ID NO: 832172 - protein, 33 aa, Mycobacterium
LDSETLIRYIDRYLMFYIRTADRLQRTAPWQEA

SEQ ID NO: 832173 - protein, 34 aa, Mycobacterium
LDSEVRPIVVPDIPISRIPIVLSLGSDSTSLNTA

SEQ ID NO: 832174 - protein, 17 aa, Mycobacterium
LDSGEYFDYLGFDIFYR

SEQ ID NO: 832175 - protein, 27 aa, Mycobacterium
LDSIITTHGLSWGFDRIFAVTMNHSVW

SEQ ID NO: 832176 - protein, 24 aa, Mycobacterium
LDSIITTHGLSWGYDRIFAATINH

SEQ ID NO: 832177 - protein, 20 aa, Mycobacterium
LDSLDLLHRGGRACLAGWLG

SEQ ID NO: 832178 - protein, 24 aa, Mycobacterium
LDSMNIPLTAHFIGGCPIGDSPET

SEQ ID NO: 832179 - protein, 23 aa, Mycobacterium
LDSPARVAEFTAWLARQLTDAHV

SEQ ID NO: 832180 - protein, 27 aa, Mycobacterium
LDSPTYDGIAIRPLYTALDELPEPSLP

SEQ ID NO: 832181 - protein, 34 aa, Mycobacterium
LDSQTWLDVYRNFWTSFFRGFWKIQEMRGMWREM

SEQ ID NO: 832182 - protein, 22 aa, Mycobacterium
LDSRAYRLRWPIGTTVYEIDQP

SEQ ID NO: 832183 - protein, 23 aa, Mycobacterium
LDSRLRVVARRDFAGMISVAVEN

SEQ ID NO: 832184 - protein, 25 aa, Mycobacterium
LDSRQLFDPALIASAQRIAAAGGCP

SEQ ID NO: 832185 - protein, 21 aa, Mycobacterium
LDSRRLLLRPPKLDDAGPIYK

SEQ ID NO: 832186 - protein, 28 aa, Mycobacterium
LDSRTLIKTYPLAFGVTALAVSPDGKRV

SEQ ID NO: 832187 - protein, 25 aa, Mycobacterium
LDSVITTHGLSWGFDRIFAASANHS

SEQ ID NO: 832188 - protein, 27 aa, Mycobacterium
LDSVPDALWPAVVFTLVALLDDPTAAD

SEQ ID NO: 832189 - protein, 18 aa, Mycobacterium
LDSVVFAVPLVVADHDAP

SEQ ID NO: 832190 - protein, 26 aa, Mycobacterium
LDSVYITRLLVRDNVIFGAYGFDLRD

SEQ ID NO: 832191 - protein, 20 aa, Mycobacterium
LDSWPRSNWLQYALLDNHLG

SEQ ID NO: 832192 - protein, 37 aa, Mycobacterium
LDSWRNYQWHQLARAFLMFVTQRWPDVLLTAAEDLPP

SEQ ID NO: 832193 - protein, 38 aa, Mycobacterium
LDSWTNYQWHQLARTFLMYRTQRWPDVLLAAAEELPPQ

SEQ ID NO: 832194 - protein, 28 aa, Mycobacterium
LDTAELDAEYWYRNIRQTVQFDQAVRSA

SEQ ID NO: 832195 - protein, 25 aa, Mycobacterium
LDTAHPYVLGIPQPVTDRILVEHAV

SEQ ID NO: 832196 - protein, 20 aa, Mycobacterium
LDTAMRVFWRSGYAHTSTED

SEQ ID NO: 832197 - protein, 20 aa, Mycobacterium
LDTDCRVYRVAGLRVADASA

SEQ ID NO: 832198 - protein, 26 aa, Mycobacterium
LDTDEFRLYELIWQRTVASQMADARG

SEQ ID NO: 832199 - protein, 18 aa, Mycobacterium
LDTDFLFNLETITGYNNL

SEQ ID NO: 832200 - protein, 25 aa, Mycobacterium
LDTDGLTVWVYRGADWLVPDPHGPH

SEQ ID NO: 832201 - protein, 20 aa, Mycobacterium
LDTDHCPFFSQPRQLAEFIS

SEQ ID NO: 832202 - protein, 26 aa, Mycobacterium
LDTDLRIALLHYAPIPETLGGEPLEI

SEQ ID NO: 832203 - protein, 33 aa, Mycobacterium
LDTEPWRAAPLLEYLRKMVFWSEVTPSDADLAV

SEQ ID NO: 832204 - protein, 24 aa, Mycobacterium
LDTGPNFLGWTRVSAPTATTVTSA

SEQ ID NO: 832205 - protein, 19 aa, Mycobacterium
LDTIARIIAAFPWEPEIEG

SEQ ID NO: 832206 - protein, 23 aa, Mycobacterium
LDTKDWAAWRTIFADDFVSDTSE

SEQ ID NO: 832207 - protein, 19 aa, Mycobacterium
LDTKDWESWRTLFSDDFRS

SEQ ID NO: 832208 - protein, 35 aa, Mycobacterium
LDTKTWLDVYRNFWTFFFHTFWKVREIRTMWRQMW

SEQ ID NO: 832209 - protein, 19 aa, Mycobacterium
LDTLALLEVRWREAVATLD

SEQ ID NO: 832210 - protein, 25 aa, Mycobacterium
LDTLLSAQWRNGMIPHIVFANGVDG

SEQ ID NO: 832211 - protein, 19 aa, Mycobacterium
LDTLPPAERLAFVLQDVFA

SEQ ID NO: 832212 - protein, 37 aa, Mycobacterium
LDTRVINGRQWLLFGPFAGWSPKFLKQGKVTDLPLSV

SEQ ID NO: 832213 - protein, 24 aa, Mycobacterium
LDTSSTRLLFNPTGKFVVGGPMGD

SEQ ID NO: 832214 - protein, 17 aa, Mycobacterium
LDTTEVGPFKKGPFRIA

SEQ ID NO: 832215 - protein, 18 aa, Mycobacterium
LDTTLYRDDLMTKPPRAL

SEQ ID NO: 832216 - protein, 29 aa, Mycobacterium
LDTVGHYDGLLAWLRGLVGTGYVAQDAMD

SEQ ID NO: 832217 - protein, 20 aa, Mycobacterium
LDTWLQANPIKPSIADPSGS

SEQ ID NO: 832218 - protein, 24 aa, Mycobacterium
LDTYHRLLNLVIDGYRREGKRYMT

SEQ ID NO: 832219 - protein, 21 aa, Mycobacterium
LDVADPLPPERYRLVNQGAGE

SEQ ID NO: 832220 - protein, 24 aa, Mycobacterium
LDVAERILLNSKTRRPSVCNAAET

SEQ ID NO: 832221 - protein, 18 aa, Mycobacterium
LDVALGIGGLPRGRVVEI

SEQ ID NO: 832222 - protein, 17 aa, Mycobacterium
LDVALWDLKARRAGLPL

SEQ ID NO: 832223 - protein, 21 aa, Mycobacterium
LDVARAVRPPTPGRRLPKSLT

SEQ ID NO: 832224 - protein, 18 aa, Mycobacterium
LDVCGRALFPSSVPARSA

SEQ ID NO: 832225 - protein, 26 aa, Mycobacterium
LDVDEEFFIIIRPAPSGTHLLISDAT

SEQ ID NO: 832226 - protein, 26 aa, Mycobacterium
LDVDNRLTLLDALREKLGATAPKKGC

SEQ ID NO: 832227 - protein, 31 aa, Mycobacterium
LDVDVEFSPFFNALPIRRLGLHEQAASVTLP

SEQ ID NO: 832228 - protein, 20 aa, Mycobacterium
LDVDWKLHGFDDTALRQLAE

SEQ ID NO: 832229 - protein, 26 aa, Mycobacterium
LDVEALLKGLYLYRPAPEKRAKSAQI

SEQ ID NO: 832230 - protein, 23 aa, Mycobacterium
LDVEGGVYPMRRTDDGWWHTAIE

SEQ ID NO: 832231 - protein, 22 aa, Mycobacterium
LDVENYWFRRHEVVYQRLAPRC

SEQ ID NO: 832232 - protein, 22 aa, Mycobacterium
LDVFALGSLTYLLVAGHDPATS

SEQ ID NO: 832233 - protein, 19 aa, Mycobacterium
LDVFAPNGFAFHFPGWSIQ

SEQ ID NO: 832234 - protein, 20 aa, Mycobacterium
LDVFGIELTPEPILLGCVLS

SEQ ID NO: 832235 - protein, 24 aa, Mycobacterium
LDVHAYIEEKIFYPQLLKRGTEDA

SEQ ID NO: 832236 - protein, 25 aa, Mycobacterium
LDVHLLTRIARFKRPKRYEFVDELP

SEQ ID NO: 832237 - protein, 35 aa, Mycobacterium
LDVINQWYHRPDYLAIMRDCGFTRMGVWSENSLDR

SEQ ID NO: 832238 - protein, 18 aa, Mycobacterium
LDVLANIAGFHKMRHTAS

SEQ ID NO: 832239 - protein, 24 aa, Mycobacterium
LDVLGERWTLLILRELVGGSRRYG

SEQ ID NO: 832240 - protein, 20 aa, Mycobacterium
LDVLGYDRLIGHRGFELIAD

SEQ ID NO: 832241 - protein, 29 aa, Mycobacterium
LDVLHDLYQRWPFFRSVLSNMAQVLAKSD

SEQ ID NO: 832242 - protein, 26 aa, Mycobacterium
LDVLPNPPALPWNWLSEPDLDYYAAE

SEQ ID NO: 832243 - protein, 18 aa, Mycobacterium
LDVLQSWLARDGAGVLVV

SEQ ID NO: 832244 - protein, 29 aa, Mycobacterium
LDVLRKLREQIPGLPLLLLTAKDSVEDRI

SEQ ID NO: 832245 - protein, 24 aa, Mycobacterium
LDVLTDVLVSKLPPGPAFYPDGEL

SEQ ID NO: 832246 - protein, 18 aa, Mycobacterium
LDVNGLFEFYTETLGFKS

SEQ ID NO: 832247 - protein, 18 aa, Mycobacterium
LDVPAMGGSFTPLLAGDA

SEQ ID NO: 832248 - protein, 22 aa, Mycobacterium
LDVPAVLLRPDGHIAWVGDEQG

SEQ ID NO: 832249 - protein, 17 aa, Mycobacterium
LDVPLSRVLTDAGESMA

SEQ ID NO: 832250 - protein, 24 aa, Mycobacterium
LDVPTFRMLAALSGRVPLISIVSG

SEQ ID NO: 832251 - protein, 19 aa, Mycobacterium
LDVPVACLPGLRGRYRPAG

SEQ ID NO: 832252 - protein, 19 aa, Mycobacterium
LDVQASHVAWIIAWALEHG

SEQ ID NO: 832253 - protein, 26 aa, Mycobacterium
LDVQLNRLRRWYAGGVLLIGDAAHAM

SEQ ID NO: 832254 - protein, 21 aa, Mycobacterium
LDVQLRLMALPDTAPAERYQA

SEQ ID NO: 832255 - protein, 25 aa, Mycobacterium
LDVRKAAVLSLTRWAAEPDARDALG

SEQ ID NO: 832256 - protein, 24 aa, Mycobacterium
LDVRRRPRNILTFSHGAHFCLGAA

SEQ ID NO: 832257 - protein, 23 aa, Mycobacterium
LDVSAFVMFSSIAGLAGASGQAN

SEQ ID NO: 832258 - protein, 19 aa, Mycobacterium
LDVTPLITHRYPIDHAAEA

SEQ ID NO: 832259 - protein, 26 aa, Mycobacterium
LDVVHDRGPWKLIIAQHFASADELMA

SEQ ID NO: 832260 - protein, 21 aa, Mycobacterium
LDVVPPGDLRMALAALASDSP

SEQ ID NO: 832261 - protein, 28 aa, Mycobacterium
LDVVSRVGGWLFDMRMAGWNVGVAFAVA

SEQ ID NO: 832262 - protein, 18 aa, Mycobacterium
LDVVVANAGVLGWGRLWE

SEQ ID NO: 832263 - protein, 19 aa, Mycobacterium
LDVWRRKNLPAHPAPVLIF

SEQ ID NO: 832264 - protein, 19 aa, Mycobacterium
LDVWRYIARENVQLASLYY

SEQ ID NO: 832265 - protein, 24 aa, Mycobacterium
LDVYFNLANYRNNWKRLGFGEDEV

SEQ ID NO: 832266 - protein, 17 aa, Mycobacterium
LDVYYRQCSLRVTCTDL

SEQ ID NO: 832267 - protein, 30 aa, Mycobacterium
LDWAEPLRHPTFYKAVYRPSVLRANRAATA

SEQ ID NO: 832268 - protein, 28 aa, Mycobacterium
LDWDDELLSFFSIPRAMLPAIEPSSPLQ

SEQ ID NO: 832269 - protein, 23 aa, Mycobacterium
LDWEATLAYRRELWSYGLGVADA

SEQ ID NO: 832270 - protein, 19 aa, Mycobacterium
LDWMRLTHSDLRNFQRWLD

SEQ ID NO: 832271 - protein, 22 aa, Mycobacterium
LDWWTSSFVLAEGMPPSALASD

SEQ ID NO: 832272 - protein, 19 aa, Mycobacterium
LDWYAEGMFPPMHLDAEIG

SEQ ID NO: 832273 - protein, 18 aa, Mycobacterium
LDYANRANPYPLYAQLRQ

SEQ ID NO: 832274 - protein, 19 aa, Mycobacterium
LDYDYLVYAVGSTGAVPDG

SEQ ID NO: 832275 - protein, 20 aa, Mycobacterium
LDYERAMLRLSEGENGEPQL

SEQ ID NO: 832276 - protein, 17 aa, Mycobacterium
LDYFWTAVNAGRSRQHT

SEQ ID NO: 832277 - protein, 18 aa, Mycobacterium
LDYHIRPWQLRPPGGRRE

SEQ ID NO: 832278 - protein, 20 aa, Mycobacterium
LDYHLRRSALPSPGRPRELL

SEQ ID NO: 832279 - protein, 24 aa, Mycobacterium
LDYHLTTLFPPVRPRRWLEIRYLD

SEQ ID NO: 832280 - protein, 30 aa, Mycobacterium
LDYIKWLGVDCLWLPPFYDSPLRDGGYDIR

SEQ ID NO: 832281 - protein, 20 aa, Mycobacterium
LDYLVAHFGALYAGAISVPL

SEQ ID NO: 832282 - protein, 36 aa, Mycobacterium
LDYLYRRDPFQDAPRPDLILLDLNLPKYDGRQLLEK

SEQ ID NO: 832283 - protein, 17 aa, Mycobacterium
LDYPFNPVSLALGAEAT

SEQ ID NO: 832284 - protein, 22 aa, Mycobacterium
LDYSISFDTPAWVPGRLLAAVL

SEQ ID NO: 832285 - protein, 23 aa, Mycobacterium
LDYTLMFPTLASLVEERLKDDPE

SEQ ID NO: 832286 - protein, 19 aa, Mycobacterium
LDYVSDGRFILGLGASGPQ

SEQ ID NO: 832287 - protein, 30 aa, Mycobacterium
LEAAARWREIFGPENFFLELMDHGLDIERR

SEQ ID NO: 832288 - protein, 22 aa, Mycobacterium
LEAAFYRNSLIHAFLETSLVEL

SEQ ID NO: 832289 - protein, 27 aa, Mycobacterium
LEAAIEGLLLGAYRFTEFRSAKTAPTD

SEQ ID NO: 832290 - protein, 29 aa, Mycobacterium
LEACWGDVAMMLSVPYQGLGNAAISAVAT

SEQ ID NO: 832291 - protein, 26 aa, Mycobacterium
LEADATAMLMLPLFNYADGNCDAIRE

SEQ ID NO: 832292 - protein, 30 aa, Mycobacterium
LEADELINFSLLPWPDYFGAAPKARADGMR

SEQ ID NO: 832293 - protein, 25 aa, Mycobacterium
LEADPLGPFGFSGWVGPEPHGAALA

SEQ ID NO: 832294 - protein, 27 aa, Mycobacterium
LEADSFSGWFLTVLGAARVAFAQFTQE

SEQ ID NO: 832295 - protein, 19 aa, Mycobacterium
LEAERVTGIFLVPAQWQAV

SEQ ID NO: 832296 - protein, 33 aa, Mycobacterium
LEAFLKRHRFSPFFIDYFITPLVAAVWSCASAD

SEQ ID NO: 832297 - protein, 26 aa, Mycobacterium
LEAGLRNLYLLPSSPLQELRNQLPRA

SEQ ID NO: 832298 - protein, 18 aa, Mycobacterium
LEAGRRWSRTRILAALAL

SEQ ID NO: 832299 - protein, 26 aa, Mycobacterium
LEAGVPIIPLIVWGAQRIWTKDHPRA

SEQ ID NO: 832300 - protein, 26 aa, Mycobacterium
LEAHGFDRRFAFPHGGHLINLHVAAG

SEQ ID NO: 832301 - protein, 27 aa, Mycobacterium
LEAHLISPWGTWEWMAPAAAGAVLPAC

SEQ ID NO: 832302 - protein, 30 aa, Mycobacterium
LEAHPAVSWVRYPFLPSHPQYNLAKRQMSG

SEQ ID NO: 832303 - protein, 30 aa, Mycobacterium
LEAHPAVSWVRYPYLPSHPQYDLARRQMSG

SEQ ID NO: 832304 - protein, 28 aa, Mycobacterium
LEAIDGFRFLAVRELAKQRLALRDELDS

SEQ ID NO: 832305 - protein, 18 aa, Mycobacterium
LEAKPDVSVLIAPNFAIG

SEQ ID NO: 832306 - protein, 19 aa, Mycobacterium
LEAKYFMMRVRCDGGAISA

SEQ ID NO: 832307 - protein, 20 aa, Mycobacterium
LEALAPVRAVLPAGAGAASP

SEQ ID NO: 832308 - protein, 24 aa, Mycobacterium
LEALGPAMRRALATAGLDKPDIVA

SEQ ID NO: 832309 - protein, 19 aa, Mycobacterium
LEALLACRAAVVLSGYPSA

SEQ ID NO: 832310 - protein, 18 aa, Mycobacterium
LEALLAWEQGAGYLPVLV

SEQ ID NO: 832311 - protein, 21 aa, Mycobacterium
LEALLLVVDTPVTVDTLAGVT

SEQ ID NO: 832312 - protein, 17 aa, Mycobacterium
LEALLRGYERTGDAPVL

SEQ ID NO: 832313 - protein, 18 aa, Mycobacterium
LEALMRIADVLRNKGAAV

SEQ ID NO: 832314 - protein, 17 aa, Mycobacterium
LEALPQFTFDDEACRSL

SEQ ID NO: 832315 - protein, 18 aa, Mycobacterium
LEALRRFLPDDGAVKSMF

SEQ ID NO: 832316 - protein, 17 aa, Mycobacterium
LEALRWRGSDIGNLPGP

SEQ ID NO: 832317 - protein, 20 aa, Mycobacterium
LEALVKTYIGDALAADFYLE

SEQ ID NO: 832318 - protein, 27 aa, Mycobacterium
LEAMRAIGVPVYLLPGNHDPLDASSVY

SEQ ID NO: 832319 - protein, 20 aa, Mycobacterium
LEAMWTCDDFYFDSIAQVSL

SEQ ID NO: 832320 - protein, 19 aa, Mycobacterium
LEANWPAETAAAEPVLLWG

SEQ ID NO: 832321 - protein, 19 aa, Mycobacterium
LEAPAVLGPARDGGWWVLG

SEQ ID NO: 832322 - protein, 20 aa, Mycobacterium
LEAPGPQEWHWDKDAAVRRL

SEQ ID NO: 832323 - protein, 26 aa, Mycobacterium
LEAQVPIVPVIVWGAHRIWPKDHPKK

SEQ ID NO: 832324 - protein, 19 aa, Mycobacterium
LEARIVLAMLLERTTWIEA

SEQ ID NO: 832325 - protein, 20 aa, Mycobacterium
LEARVMFEVLLGAFPTIELT

SEQ ID NO: 832326 - protein, 19 aa, Mycobacterium
LEARWWRRDVGGVMVRFVV

SEQ ID NO: 832327 - protein, 18 aa, Mycobacterium
LEASTQWRDKFKQQIESL

SEQ ID NO: 832328 - protein, 25 aa, Mycobacterium
LEATARYTAPPTAPIHWANATHACT

SEQ ID NO: 832329 - protein, 21 aa, Mycobacterium
LEATVLRDGYEWFQYYDRSVP

SEQ ID NO: 832330 - protein, 17 aa, Mycobacterium
LEAVAMSSPVIYCDPAL

SEQ ID NO: 832331 - protein, 21 aa, Mycobacterium
LEAVVADDLWPLPTYQEMLYI

SEQ ID NO: 832332 - protein, 21 aa, Mycobacterium
LEAVYRMRLELPQVDSAALTL

SEQ ID NO: 832333 - protein, 22 aa, Mycobacterium
LEAYNALPLRRAVHAVFECCCC

SEQ ID NO: 832334 - protein, 25 aa, Mycobacterium
LECQIAVGTLMRRLPRLKLTERTQL

SEQ ID NO: 832335 - protein, 18 aa, Mycobacterium
LECVFFMRDVRSAQYFEQ

SEQ ID NO: 832336 - protein, 28 aa, Mycobacterium
LECWLPERGIDYRWEPLLGGRRHVAAGE

SEQ ID NO: 832337 - protein, 19 aa, Mycobacterium
LEDAEGAIWRLWRAGIVDI

SEQ ID NO: 832338 - protein, 23 aa, Mycobacterium
LEDAFCEPKPLQFPHPPIVMAST

SEQ ID NO: 832339 - protein, 19 aa, Mycobacterium
LEDCGHYVRWIFDHPDRAN

SEQ ID NO: 832340 - protein, 20 aa, Mycobacterium
LEDCGYYVRWLFDNTDRSNG

SEQ ID NO: 832341 - protein, 24 aa, Mycobacterium
LEDEAGWLVLRFKHTDADDGWLKA

SEQ ID NO: 832342 - protein, 23 aa, Mycobacterium
LEDFATLWRHGGSAPLRGLLDAG

SEQ ID NO: 832343 - protein, 17 aa, Mycobacterium
LEDFLTANKLALPPDRE

SEQ ID NO: 832344 - protein, 24 aa, Mycobacterium
LEDGEPWRRLLGPLAADCDGVVGL

SEQ ID NO: 832345 - protein, 17 aa, Mycobacterium
LEDGIVVEHFVTSAASA

SEQ ID NO: 832346 - protein, 26 aa, Mycobacterium
LEDGNALFFGHGLNIHFGLIKAPENV

SEQ ID NO: 832347 - protein, 33 aa, Mycobacterium
LEDGNALFFGHGLNIHFGLIKPPANVTIGMVAP

SEQ ID NO: 832348 - protein, 23 aa, Mycobacterium
LEDHNIPMAWEYAPTFVEAGLDI

SEQ ID NO: 832349 - protein, 25 aa, Mycobacterium
LEDIDRTMASLRQSWHGEASDAQAH

SEQ ID NO: 832350 - protein, 31 aa, Mycobacterium
LEDLAARVGWRWRLVWFKAVSEMLSADYDSA

SEQ ID NO: 832351 - protein, 31 aa, Mycobacterium
LEDLAERVGWQWRLVWYKAVADLLTGDYDSA

SEQ ID NO: 832352 - protein, 18 aa, Mycobacterium
LEDLGWLEKLARAHHEVV

SEQ ID NO: 832353 - protein, 17 aa, Mycobacterium
LEDLGWYVADNLPPELI

SEQ ID NO: 832354 - protein, 20 aa, Mycobacterium
LEDLGWYVADNLPPQLITRM

SEQ ID NO: 832355 - protein, 21 aa, Mycobacterium
LEDLGWYVADNLPPQLITRMV

SEQ ID NO: 832356 - protein, 19 aa, Mycobacterium
LEDLHWAQLPTLAMLEHVL

SEQ ID NO: 832357 - protein, 17 aa, Mycobacterium
LEDMPRGFAVGALLNMM

SEQ ID NO: 832358 - protein, 24 aa, Mycobacterium
LEDNALQLLGWTEATATPQVEIAL

SEQ ID NO: 832359 - protein, 27 aa, Mycobacterium
LEDPHYQYKLRWLSALRDTAAGWLADA

SEQ ID NO: 832360 - protein, 26 aa, Mycobacterium
LEDPQLIARNLFRDMTHPLIARPLPA

SEQ ID NO: 832361 - protein, 24 aa, Mycobacterium
LEDQFWGDRFGVIKDPFGHLWSLG

SEQ ID NO: 832362 - protein, 18 aa, Mycobacterium
LEDRGFGYEGLFDEYTVA

SEQ ID NO: 832363 - protein, 20 aa, Mycobacterium
LEDRPFPLLSGGERRRVLVA

SEQ ID NO: 832364 - protein, 22 aa, Mycobacterium
LEDSDVVLWYTLGAHHVVRPED

SEQ ID NO: 832365 - protein, 20 aa, Mycobacterium
LEDSGFFNYGALASGLLNRG

SEQ ID NO: 832366 - protein, 24 aa, Mycobacterium
LEDSNMLIFAWGATVPMIAHAAGI

SEQ ID NO: 832367 - protein, 24 aa, Mycobacterium
LEDTEVFFFLVGELLFLDADNKIL

SEQ ID NO: 832368 - protein, 26 aa, Mycobacterium
LEDTNRGWLPHRLPRPARARCDDPQL

SEQ ID NO: 832369 - protein, 23 aa, Mycobacterium
LEDVSVPVRWWHGDHDHIIPFSH

SEQ ID NO: 832370 - protein, 25 aa, Mycobacterium
LEDWKAWARWRVIHARAGLLTDDLV

SEQ ID NO: 832371 - protein, 30 aa, Mycobacterium
LEDWKCWARWRLIRARAPWLTSDLVAEDFE

SEQ ID NO: 832372 - protein, 27 aa, Mycobacterium
LEDYFDVLWTHRVVLGIIVRDLAALGQ

SEQ ID NO: 832373 - protein, 22 aa, Mycobacterium
LEDYGLTPWPKTSGSRGFHVYA

SEQ ID NO: 832374 - protein, 26 aa, Mycobacterium
LEEALQIILPMIKGERPTFSGKWYQV

SEQ ID NO: 832375 - protein, 19 aa, Mycobacterium
LEEAQPWLRRAGARADARG

SEQ ID NO: 832376 - protein, 23 aa, Mycobacterium
LEEAYRRAFDTYGIRMQQLAASG

SEQ ID NO: 832377 - protein, 19 aa, Mycobacterium
LEEAYWFGEGVLPLLERRG

SEQ ID NO: 832378 - protein, 20 aa, Mycobacterium
LEEFKGIIRWIQTQGQYSAL

SEQ ID NO: 832379 - protein, 31 aa, Mycobacterium
LEEFVLSGGKRLRPIFAYRGWQAVTTEDPDP

SEQ ID NO: 832380 - protein, 18 aa, Mycobacterium
LEEGRRLVHYPPNPYHRV

SEQ ID NO: 832381 - protein, 19 aa, Mycobacterium
LEEHWPAEPAAREPVLLWG

SEQ ID NO: 832382 - protein, 33 aa, Mycobacterium
LEEHYHTRLLAYVLDMFGLPFQVIAPPLLVRQF

SEQ ID NO: 832383 - protein, 23 aa, Mycobacterium
LEEILKRWPDWTVDMGNAVRAPT

SEQ ID NO: 832384 - protein, 18 aa, Mycobacterium
LEEKGILVLKVADLLAAD

SEQ ID NO: 832385 - protein, 23 aa, Mycobacterium
LEEKLCCAAVFVTRARRAIASAT

SEQ ID NO: 832386 - protein, 17 aa, Mycobacterium
LEELDEFLTERLARYKH

SEQ ID NO: 832387 - protein, 28 aa, Mycobacterium
LEELGEQLPVYRPPLDMARLFGESRLGA

SEQ ID NO: 832388 - protein, 29 aa, Mycobacterium
LEELGLTYPQYLVLLVLWEEEPCTVGHLG

SEQ ID NO: 832389 - protein, 20 aa, Mycobacterium
LEELIRPTGFYRNKANSLIK

SEQ ID NO: 832390 - protein, 20 aa, Mycobacterium
LEELIRPTGFYRNKATSLIG

SEQ ID NO: 832391 - protein, 18 aa, Mycobacterium
LEELKSLGLKTFLMPLNP

SEQ ID NO: 832392 - protein, 28 aa, Mycobacterium
LEELTRREVPFVLVNRSVADYPAATCDN

SEQ ID NO: 832393 - protein, 24 aa, Mycobacterium
LEENDGYFISREQLALLGSLYDPD

SEQ ID NO: 832394 - protein, 19 aa, Mycobacterium
LEEPILAGLIDRIARDERR

SEQ ID NO: 832395 - protein, 20 aa, Mycobacterium
LEEQLEILTGLWTTPTGDTY

SEQ ID NO: 832396 - protein, 19 aa, Mycobacterium
LEEQLLRHPGIGSAAAVPL

SEQ ID NO: 832397 - protein, 17 aa, Mycobacterium
LEEQVVVLRLLAAQQEA

SEQ ID NO: 832398 - protein, 25 aa, Mycobacterium
LEETALWLALTCAVPVPVVLTGAQR

SEQ ID NO: 832399 - protein, 22 aa, Mycobacterium
LEETGLLPHLNPGVMSWSELSR

SEQ ID NO: 832400 - protein, 19 aa, Mycobacterium
LEETLRYEAPFRGHYRHVR

SEQ ID NO: 832401 - protein, 18 aa, Mycobacterium
LEETMTFLCYTAEASVAL

SEQ ID NO: 832402 - protein, 38 aa, Mycobacterium
LEEVAVLVALGRQLAAVPYLESVVLGAGALARFGDDGL

SEQ ID NO: 832403 - protein, 23 aa, Mycobacterium
LEEVTVPVRWWHGDHDHIIPFSH

SEQ ID NO: 832404 - protein, 20 aa, Mycobacterium
LEEWTLRRRLRASQTFEPAG

SEQ ID NO: 832405 - protein, 17 aa, Mycobacterium
LEFGSMFAGPYGATLLA

SEQ ID NO: 832406 - protein, 20 aa, Mycobacterium
LEFHVRQRVQRLGNVKFLDG

SEQ ID NO: 832407 - protein, 17 aa, Mycobacterium
LEFLHAFALMQDDVMDE

SEQ ID NO: 832408 - protein, 17 aa, Mycobacterium
LEFLPAAAELNPYLGVR

SEQ ID NO: 832409 - protein, 19 aa, Mycobacterium
LEFMESFIVLVQALCNTDA

SEQ ID NO: 832410 - protein, 18 aa, Mycobacterium
LEFQLTDLGARWVGPIRT

SEQ ID NO: 832411 - protein, 33 aa, Mycobacterium
LEFRPKVIIAGWSAYPRILDFAAFASIADEVDA

SEQ ID NO: 832412 - protein, 33 aa, Mycobacterium
LEFRPKVIIAGWSAYPRILDFAAFRAIADEVDA

SEQ ID NO: 832413 - protein, 25 aa, Mycobacterium
LEFRPKVIIAGWSAYPRVLDFAAFR

SEQ ID NO: 832414 - protein, 33 aa, Mycobacterium
LEFRPQVIIAGWSAYPRILDFAAFASIADEVDA

SEQ ID NO: 832415 - protein, 20 aa, Mycobacterium
LEFTFDVIPGITAIQALTAR

SEQ ID NO: 832416 - protein, 19 aa, Mycobacterium
LEFVRTFFANDLDVAATAK

SEQ ID NO: 832417 - protein, 17 aa, Mycobacterium
LEFYHGPGVQHLALATN

SEQ ID NO: 832418 - protein, 22 aa, Mycobacterium
LEFYTKVMEVPYWSSTTCLSAS

SEQ ID NO: 832419 - protein, 22 aa, Mycobacterium
LEFYTRVMEVPYWSKTTCLSAT

SEQ ID NO: 832420 - protein, 25 aa, Mycobacterium
LEGDWVPQRLAILEFPDVDAARAWL

SEQ ID NO: 832421 - protein, 24 aa, Mycobacterium
LEGETRTRLLERAGRRVRLTPTGL

SEQ ID NO: 832422 - protein, 18 aa, Mycobacterium
LEGFIMDHLREHPDLTML

SEQ ID NO: 832423 - protein, 19 aa, Mycobacterium
LEGGASFRRLLGPLVERSD

SEQ ID NO: 832424 - protein, 25 aa, Mycobacterium
LEGIGWPVVEVTLPALDRMVDVFAK

SEQ ID NO: 832425 - protein, 26 aa, Mycobacterium
LEGIYQAMEYLPWANKVQLGDDVVDA

SEQ ID NO: 832426 - protein, 19 aa, Mycobacterium
LEGLEYLAGSIAASLHLVY

SEQ ID NO: 832427 - protein, 18 aa, Mycobacterium
LEGLFARYREIAAANLNP

SEQ ID NO: 832428 - protein, 29 aa, Mycobacterium
LEGLGFLYSYLQRVFVFTRTMQMLDPQRP

SEQ ID NO: 832429 - protein, 31 aa, Mycobacterium
LEGLVVDTDLRWRIVIALARSGEIDADGPET

SEQ ID NO: 832430 - protein, 18 aa, Mycobacterium
LEGRRAVYGLTLNPPGRL

SEQ ID NO: 832431 - protein, 23 aa, Mycobacterium
LEGRSVTPPLPAAGYRLPSEVSD

SEQ ID NO: 832432 - protein, 26 aa, Mycobacterium
LEGTGVRVIDLTPAALGPYCVPVVNL

SEQ ID NO: 832433 - protein, 24 aa, Mycobacterium
LEGVAAEFIAVRLPYGVQADEEDA

SEQ ID NO: 832434 - protein, 23 aa, Mycobacterium
LEGVPLTFRGKVNRLAIMVRGNL

SEQ ID NO: 832435 - protein, 18 aa, Mycobacterium
LEGWRRFIEADAPEFELL

SEQ ID NO: 832436 - protein, 19 aa, Mycobacterium
LEGYFDFHYRHRQDLMLVV

SEQ ID NO: 832437 - protein, 33 aa, Mycobacterium
LEHELGKPVWAVGTVIYWHALRAMGIDDQYEGF

SEQ ID NO: 832438 - protein, 19 aa, Mycobacterium
LEHEQILPRPGWVEHNPVE

SEQ ID NO: 832439 - protein, 24 aa, Mycobacterium
LEHLGLRTRLFAAPGWVVSPGVVK

SEQ ID NO: 832440 - protein, 20 aa, Mycobacterium
LEHLLDFMPRYEVDFDGLQR

SEQ ID NO: 832441 - protein, 17 aa, Mycobacterium
LEHLLPSGSLTAARVFF

SEQ ID NO: 832442 - protein, 17 aa, Mycobacterium
LEHLPAATPRRPLGDVL

SEQ ID NO: 832443 - protein, 24 aa, Mycobacterium
LEHRFSHPLTFGTAGLRGPLRGGP

SEQ ID NO: 832444 - protein, 24 aa, Mycobacterium
LEHTWSSGILDRPLVRYTVSTDEG

SEQ ID NO: 832445 - protein, 18 aa, Mycobacterium
LEHWITDRGFRGLSLRPF

SEQ ID NO: 832446 - protein, 18 aa, Mycobacterium
LEHYAILLDSALADPDTE

SEQ ID NO: 832447 - protein, 21 aa, Mycobacterium
LEIAHISPALLRFVQQRTADR

SEQ ID NO: 832448 - protein, 27 aa, Mycobacterium
LEIARAHTPWYHWGTTSVVARLVRQFG

SEQ ID NO: 832449 - protein, 20 aa, Mycobacterium
LEIAVPRLTFTEPINTIAGA

SEQ ID NO: 832450 - protein, 20 aa, Mycobacterium
LEIAWKGAKAVYLSFDIDVI

SEQ ID NO: 832451 - protein, 23 aa, Mycobacterium
LEIDVLLAEWLRRVPDYAIQTHA

SEQ ID NO: 832452 - protein, 17 aa, Mycobacterium
LEIELDWIDEHIGDHPY

SEQ ID NO: 832453 - protein, 19 aa, Mycobacterium
LEIGPGYGATLRALAARTA

SEQ ID NO: 832454 - protein, 26 aa, Mycobacterium
LEIGRAHTPWFHWGTTAMAAHTVEKF

SEQ ID NO: 832455 - protein, 24 aa, Mycobacterium
LEIPGYRVLTDLTAIPPELRGLHP

SEQ ID NO: 832456 - protein, 19 aa, Mycobacterium
LEIPPLLVELVQPMSPDGS

SEQ ID NO: 832457 - protein, 18 aa, Mycobacterium
LEIRALPGVLSTETLVYL

SEQ ID NO: 832458 - protein, 25 aa, Mycobacterium
LEIVLPVLGVNAIRVPSAKPGSRAS

SEQ ID NO: 832459 - protein, 24 aa, Mycobacterium
LEKAIAWYSMIARVVVDAKLAVND

SEQ ID NO: 832460 - protein, 22 aa, Mycobacterium
LEKDFRARLLTQKPLRCTDFGK

SEQ ID NO: 832461 - protein, 22 aa, Mycobacterium
LEKERLFGRAWMFMAHESEIPH

SEQ ID NO: 832462 - protein, 19 aa, Mycobacterium
LEKIIYFAAYVITSVDNEM

SEQ ID NO: 832463 - protein, 17 aa, Mycobacterium
LEKLWLPGVDRLLDCVE

SEQ ID NO: 832464 - protein, 17 aa, Mycobacterium
LEKPLLDVVFDVDSPDS

SEQ ID NO: 832465 - protein, 19 aa, Mycobacterium
LEKQWLGCSVDRWLENKTW

SEQ ID NO: 832466 - protein, 28 aa, Mycobacterium
LEKRPQPKPIFRYLGMLPAVGSVAGYIG

SEQ ID NO: 832467 - protein, 19 aa, Mycobacterium
LEKTMPVSLGKPGYETPNG

SEQ ID NO: 832468 - protein, 21 aa, Mycobacterium
LEKVLTVRPDFVFASEPYGAD

SEQ ID NO: 832469 - protein, 17 aa, Mycobacterium
LEKVWLPGPDRLLDCVE

SEQ ID NO: 832470 - protein, 23 aa, Mycobacterium
LEKYPDAGLRWPRSTIFKVLDDL

SEQ ID NO: 832471 - protein, 17 aa, Mycobacterium
LELAGFAPLPHSATPDP

SEQ ID NO: 832472 - protein, 17 aa, Mycobacterium
LELAGLMAIPPLGSDPD

SEQ ID NO: 832473 - protein, 18 aa, Mycobacterium
LELAIVLAEFGYGAVPGP

SEQ ID NO: 832474 - protein, 18 aa, Mycobacterium
LELALGVSLGVLRLLMGA

SEQ ID NO: 832475 - protein, 21 aa, Mycobacterium
LELARPLISLGTRGLLLGIKH

SEQ ID NO: 832476 - protein, 39 aa, Mycobacterium
LELDAFGAQMWALHQFLVGLRRRHPWLHRASTTALRLEN

SEQ ID NO: 832477 - protein, 22 aa, Mycobacterium
LELDAILHRIVAAAIGMTGARY

SEQ ID NO: 832478 - protein, 18 aa, Mycobacterium
LELDILVNSLSPRSKLMR

SEQ ID NO: 832479 - protein, 19 aa, Mycobacterium
LELDLDAVPLVAALPAPRV

SEQ ID NO: 832480 - protein, 26 aa, Mycobacterium
LELDLPTLAICRGLQVLNVALGGTLV

SEQ ID NO: 832481 - protein, 28 aa, Mycobacterium
LELDPDFALARWGVAYAIGPNYNKGWEA

SEQ ID NO: 832482 - protein, 27 aa, Mycobacterium
LELDRVDQWLFVGRQLPAPANHILGGH

SEQ ID NO: 832483 - protein, 28 aa, Mycobacterium
LELGHRDIGLLTMRLGRDWPHGDPRPAL

SEQ ID NO: 832484 - protein, 19 aa, Mycobacterium
LELGTTMILPAAVRYQTEL

SEQ ID NO: 832485 - protein, 25 aa, Mycobacterium
LELGYQVGFPWSLGVGINFSYTTPN

SEQ ID NO: 832486 - protein, 35 aa, Mycobacterium
LELHRSVTQRLFLISLQLSAVLPLARMPAVAERIG

SEQ ID NO: 832487 - protein, 17 aa, Mycobacterium
LELIGLMGVPPRDWDQE

SEQ ID NO: 832488 - protein, 28 aa, Mycobacterium
LELIKTHLPDVALLDYRMPRMDGAQVAA

SEQ ID NO: 832489 - protein, 24 aa, Mycobacterium
LELILPGVVYGFLTRFAQGEINVT

SEQ ID NO: 832490 - protein, 19 aa, Mycobacterium
LELKKRYLEPLLDNRIVSC

SEQ ID NO: 832491 - protein, 18 aa, Mycobacterium
LELLAELVNGRTQAPAPV

SEQ ID NO: 832492 - protein, 18 aa, Mycobacterium
LELLGRDRSVRRLRAARA

SEQ ID NO: 832493 - protein, 19 aa, Mycobacterium
LELLHAFALLQDDVMDQSP

SEQ ID NO: 832494 - protein, 17 aa, Mycobacterium
LELLHTCALIHDDVIDS

SEQ ID NO: 832495 - protein, 17 aa, Mycobacterium
LELLLRELDVHPGDVIE

SEQ ID NO: 832496 - protein, 18 aa, Mycobacterium
LELLRWLVERETGNGHLS

SEQ ID NO: 832497 - protein, 18 aa, Mycobacterium
LELMLVCAHPAIAANCRT

SEQ ID NO: 832498 - protein, 18 aa, Mycobacterium
LELPDPPDSWGWGKTAHL

SEQ ID NO: 832499 - protein, 18 aa, Mycobacterium
LELPTDRPYPLVADFRGA

SEQ ID NO: 832500 - protein, 18 aa, Mycobacterium
LELPVHALDRTRDSLRDN

SEQ ID NO: 832501 - protein, 20 aa, Mycobacterium
LELRALDHGVDVIGLWGEAA

SEQ ID NO: 832502 - protein, 21 aa, Mycobacterium
LELSLMTERVLRRLPDLRLAS

SEQ ID NO: 832503 - protein, 21 aa, Mycobacterium
LELSRPMWMSYLIDGLEDGRF

SEQ ID NO: 832504 - protein, 25 aa, Mycobacterium
LELSSLPFVLGFKQPAQGFRNLGRG

SEQ ID NO: 832505 - protein, 22 aa, Mycobacterium
LELTARCHPETLRQMRWANAML

SEQ ID NO: 832506 - protein, 20 aa, Mycobacterium
LELVDCTEFFKDTTFRVFQA

SEQ ID NO: 832507 - protein, 19 aa, Mycobacterium
LELVECAEFFKDTTFRVFQ

SEQ ID NO: 832508 - protein, 19 aa, Mycobacterium
LELVHMIAELLVALSGRPA

SEQ ID NO: 832509 - protein, 17 aa, Mycobacterium
LELVLGVTRTPAMARAG

SEQ ID NO: 832510 - protein, 18 aa, Mycobacterium
LELWNRIVGVNLTGTFLV

SEQ ID NO: 832511 - protein, 17 aa, Mycobacterium
LEMADRHVLFKYGVKQL

SEQ ID NO: 832512 - protein, 18 aa, Mycobacterium
LEMALGCDFLIASERAVF

SEQ ID NO: 832513 - protein, 38 aa, Mycobacterium
LEMGIRSVSWLPLYHDMGLIMIMFPALCGNHITLMDPM

SEQ ID NO: 832514 - protein, 17 aa, Mycobacterium
LEMGLASEWGICGVGLL

SEQ ID NO: 832515 - protein, 17 aa, Mycobacterium
LEMLFAPINMRALYTGE

SEQ ID NO: 832516 - protein, 18 aa, Mycobacterium
LEMLFIDQQFRGRGAGSA

SEQ ID NO: 832517 - protein, 26 aa, Mycobacterium
LEMVADLRMLFIVSGKLKEGRRWLDR

SEQ ID NO: 832518 - protein, 25 aa, Mycobacterium
LENARQFVPLMRNTKLILLGGITDR

SEQ ID NO: 832519 - protein, 18 aa, Mycobacterium
LENGYQLRIIEQMPLDAG

SEQ ID NO: 832520 - protein, 19 aa, Mycobacterium
LENLAVLRTLVAAIGTFED

SEQ ID NO: 832521 - protein, 19 aa, Mycobacterium
LENLIRPTGFFRNKANALI

SEQ ID NO: 832522 - protein, 19 aa, Mycobacterium
LENLIRPTGFFRNKASSLI

SEQ ID NO: 832523 - protein, 25 aa, Mycobacterium
LENRIVDLLMDFYPAAIAAFADPLQ

SEQ ID NO: 832524 - protein, 26 aa, Mycobacterium
LENYHRLTMPSTWLEALVKTYVADAL

SEQ ID NO: 832525 - protein, 22 aa, Mycobacterium
LENYHRLTTPSTWLEALVKTYV

SEQ ID NO: 832526 - protein, 26 aa, Mycobacterium
LEPATRGLLTPYPAWMTSNENTRTQQ

SEQ ID NO: 832527 - protein, 24 aa, Mycobacterium
LEPDGLTHRGGEVRWWMPDGDVFE

SEQ ID NO: 832528 - protein, 29 aa, Mycobacterium
LEPEDIANAVYWLVSDAARYVTGITLPVD

SEQ ID NO: 832529 - protein, 20 aa, Mycobacterium
LEPGDLLLAPLVAGICGTDW

SEQ ID NO: 832530 - protein, 17 aa, Mycobacterium
LEPGRPLGKLVAYVLEP

SEQ ID NO: 832531 - protein, 33 aa, Mycobacterium
LEPGRTYQFNALFLDPYLWKLQVGGKRLVQKAR

SEQ ID NO: 832532 - protein, 20 aa, Mycobacterium
LEPHLFEFGSLIQALNSERV

SEQ ID NO: 832533 - protein, 21 aa, Mycobacterium
LEPIGLMRRVGLGDTLRMALM

SEQ ID NO: 832534 - protein, 18 aa, Mycobacterium
LEPLFPQRDPAQQRYPAW

SEQ ID NO: 832535 - protein, 18 aa, Mycobacterium
LEPLGLSRRPRDLATKQA

SEQ ID NO: 832536 - protein, 19 aa, Mycobacterium
LEPLLARWREHGFDLDLGD

SEQ ID NO: 832537 - protein, 18 aa, Mycobacterium
LEPLLRKRRGSWIGWAGV

SEQ ID NO: 832538 - protein, 19 aa, Mycobacterium
LEPLRAIPVIGNPLANLIQ

SEQ ID NO: 832539 - protein, 20 aa, Mycobacterium
LEPLRAIPVIGNPLANLIQP

SEQ ID NO: 832540 - protein, 19 aa, Mycobacterium
LEPLRPWKAEQLGGGYRVS

SEQ ID NO: 832541 - protein, 19 aa, Mycobacterium
LEPLRPWKSEQLGGGYRIS

SEQ ID NO: 832542 - protein, 22 aa, Mycobacterium
LEPLTAQGCIPLAIHPAMTFTG

SEQ ID NO: 832543 - protein, 17 aa, Mycobacterium
LEPLTRQKLEVLSTCPR

SEQ ID NO: 832544 - protein, 17 aa, Mycobacterium
LEPLTVLTAIAATTDRI

SEQ ID NO: 832545 - protein, 17 aa, Mycobacterium
LEPLYMGAQLRAGDVTT

SEQ ID NO: 832546 - protein, 19 aa, Mycobacterium
LEPMRPWKAEQLGGGYRIS

SEQ ID NO: 832547 - protein, 25 aa, Mycobacterium
LEPQQLLQMLQQNNQLPAMFADVRR

SEQ ID NO: 832548 - protein, 18 aa, Mycobacterium
LEPRLRDPLAAAAVLDVC

SEQ ID NO: 832549 - protein, 25 aa, Mycobacterium
LEPSVRFNPILLKPGSDRTSQLVIR

SEQ ID NO: 832550 - protein, 17 aa, Mycobacterium
LEPVRAHRAWLRSTLAG

SEQ ID NO: 832551 - protein, 19 aa, Mycobacterium
LEPYAWCEPGFLARGLESG

SEQ ID NO: 832552 - protein, 19 aa, Mycobacterium
LEQAAHAAALWFTPTNNAQ

SEQ ID NO: 832553 - protein, 17 aa, Mycobacterium
LEQAGWFGKTFSSARDV

SEQ ID NO: 832554 - protein, 17 aa, Mycobacterium
LEQAISAVPPDIALFLD

SEQ ID NO: 832555 - protein, 39 aa, Mycobacterium
LEQALGPIRSIPARALIRFAAHAPTWRETGRASMLQAID

SEQ ID NO: 832556 - protein, 24 aa, Mycobacterium
LEQAPEIGGYWRRSTFSSVAGDEL

SEQ ID NO: 832557 - protein, 32 aa, Mycobacterium
LEQDLLGVLNAPTQALLGRPLIGDGADGTAPG

SEQ ID NO: 832558 - protein, 18 aa, Mycobacterium
LEQFVPIMNVFPDATFIV

SEQ ID NO: 832559 - protein, 21 aa, Mycobacterium
LEQKGFLRRDPNRPRAVDVRG

SEQ ID NO: 832560 - protein, 30 aa, Mycobacterium
LEQLEIRKRRRGILGFDDLLTRLADALNAT

SEQ ID NO: 832561 - protein, 25 aa, Mycobacterium
LEQLSALAIMLTLFSAAGESTASLL

SEQ ID NO: 832562 - protein, 24 aa, Mycobacterium
LEQPLGGSLYELLQVRYGLTPATT

SEQ ID NO: 832563 - protein, 41 aa, Mycobacterium
LEQQLIEWSLDRLVTFFSSRRLRRVRLLKRVAPADTLLKES

SEQ ID NO: 832564 - protein, 25 aa, Mycobacterium
LEQRERLGLPVFVKPARGGSSIGVS

SEQ ID NO: 832565 - protein, 34 aa, Mycobacterium
LEQVAQRGLFLQPVDGEPGWFHYHQMFAEFLRRR

SEQ ID NO: 832566 - protein, 26 aa, Mycobacterium
LEQVTPVLRRLEYLRFSALSGRESIE

SEQ ID NO: 832567 - protein, 25 aa, Mycobacterium
LERAARLMVEAVRRHHPGSLKRVVF

SEQ ID NO: 832568 - protein, 22 aa, Mycobacterium
LERALVEDFGFDAALGRPGQPD

SEQ ID NO: 832569 - protein, 25 aa, Mycobacterium
LERAVARGSFFPVIPVCSSTGVGTL

SEQ ID NO: 832570 - protein, 25 aa, Mycobacterium
LERAVARGSFFPVIPVCSTTGVGTY

SEQ ID NO: 832571 - protein, 25 aa, Mycobacterium
LERDEWEFALLSGALARGIPVLGVC

SEQ ID NO: 832572 - protein, 24 aa, Mycobacterium
LERDPVIVQGFRTWAGSINAAAAH

SEQ ID NO: 832573 - protein, 25 aa, Mycobacterium
LERDRPLWLMWVVEGLAEGKVALVM

SEQ ID NO: 832574 - protein, 28 aa, Mycobacterium
LERDRVLALALQLLDRGYFRAGGEQSAE

SEQ ID NO: 832575 - protein, 24 aa, Mycobacterium
LERERCLLFVACTRAREELLVTWH

SEQ ID NO: 832576 - protein, 20 aa, Mycobacterium
LERFDRTIYLFDVELDHEKN

SEQ ID NO: 832577 - protein, 24 aa, Mycobacterium
LERFGARPVDYVESLGWLGDDVWF

SEQ ID NO: 832578 - protein, 22 aa, Mycobacterium
LERGWRVLLICGPGQMDTARTE

SEQ ID NO: 832579 - protein, 26 aa, Mycobacterium
LERHEDGFFYIKGRSSEMIISGGVNI

SEQ ID NO: 832580 - protein, 24 aa, Mycobacterium
LERHGNVAEIIWAAPKLNLFTPHV

SEQ ID NO: 832581 - protein, 17 aa, Mycobacterium
LERIAGAGLRYNQFHTT

SEQ ID NO: 832582 - protein, 17 aa, Mycobacterium
LERIRWRLDVWNASAQV

SEQ ID NO: 832583 - protein, 19 aa, Mycobacterium
LERKGYLRRDPNRPRAVDV

SEQ ID NO: 832584 - protein, 23 aa, Mycobacterium
LERLCGFLLDAGVDGLFVCGSSG

SEQ ID NO: 832585 - protein, 23 aa, Mycobacterium
LERLGVDAIWLNPVTVSPMADHG

SEQ ID NO: 832586 - protein, 17 aa, Mycobacterium
LERLQVAVQLLYEASRP

SEQ ID NO: 832587 - protein, 25 aa, Mycobacterium
LERLSINLRWSWHKPTQDLFATIDP

SEQ ID NO: 832588 - protein, 25 aa, Mycobacterium
LERLSPFDGTLPKELSLRSPNRGME

SEQ ID NO: 832589 - protein, 17 aa, Mycobacterium
LERMDPVLSGWTGARDP

SEQ ID NO: 832590 - protein, 20 aa, Mycobacterium
LERMRSAPTVFIDAAHNPGG

SEQ ID NO: 832591 - protein, 34 aa, Mycobacterium
LERMTVLDLILKEALRLLAPVPLVMRKTVRDVAI

SEQ ID NO: 832592 - protein, 18 aa, Mycobacterium
LERNVLLNVLDRKWREHL

SEQ ID NO: 832593 - protein, 21 aa, Mycobacterium
LERNVLLTVLSRLGAGSRVVL

SEQ ID NO: 832594 - protein, 22 aa, Mycobacterium
LERNVLLTVLSRLGAGSRVVLT

SEQ ID NO: 832595 - protein, 19 aa, Mycobacterium
LERPQILRVISGQLPGRTS

SEQ ID NO: 832596 - protein, 28 aa, Mycobacterium
LERPRFDALGRWLLARTAAVAARAPGGP

SEQ ID NO: 832597 - protein, 25 aa, Mycobacterium
LERPRFDALGRWLLARTTQVSATAP

SEQ ID NO: 832598 - protein, 24 aa, Mycobacterium
LERPRFDALGRWLLGRTAEVSAGR

SEQ ID NO: 832599 - protein, 20 aa, Mycobacterium
LERPYGGFLAVYGEGHRPDA

SEQ ID NO: 832600 - protein, 25 aa, Mycobacterium
LERRISAAWLWSGRAATIAGAAAAA

SEQ ID NO: 832601 - protein, 18 aa, Mycobacterium
LERRLGVVLFKDFLALHF

SEQ ID NO: 832602 - protein, 27 aa, Mycobacterium
LERRNGVWKIALRRCTIEWMISGDSSV

SEQ ID NO: 832603 - protein, 17 aa, Mycobacterium
LERRTQVAVLATKLARE

SEQ ID NO: 832604 - protein, 40 aa, Mycobacterium
LERSLVHLGLKHYFLVDFPQEPGALRRFLDEVLGPDDDIT

SEQ ID NO: 832605 - protein, 18 aa, Mycobacterium
LERSVWAAMYSTAPARAS

SEQ ID NO: 832606 - protein, 19 aa, Mycobacterium
LERSWTWSQWNDRVRRLAG

SEQ ID NO: 832607 - protein, 26 aa, Mycobacterium
LERTSNWMEFVWKPGYADYYPELPGG

SEQ ID NO: 832608 - protein, 25 aa, Mycobacterium
LERTSQLALTLRLVSGLTVAEIARA

SEQ ID NO: 832609 - protein, 26 aa, Mycobacterium
LERYTGLYIPFMDVSFDGATPPNSPY

SEQ ID NO: 832610 - protein, 23 aa, Mycobacterium
LESAFPRAVFTGALYGPELAAAY

SEQ ID NO: 832611 - protein, 24 aa, Mycobacterium
LESAPIGLPLALLAGLVGLSRVAT

SEQ ID NO: 832612 - protein, 18 aa, Mycobacterium
LESARRAGMGPPFSCEAG

SEQ ID NO: 832613 - protein, 17 aa, Mycobacterium
LESATNILLIGPGVIEG

SEQ ID NO: 832614 - protein, 26 aa, Mycobacterium
LESDATNMLMLPLFNYADGNCDAIRE

SEQ ID NO: 832615 - protein, 26 aa, Mycobacterium
LESDATSMLMLPLFNYADGNCDAIRE

SEQ ID NO: 832616 - protein, 24 aa, Mycobacterium
LESDRIFVWSSWTAARLQARRGNS

SEQ ID NO: 832617 - protein, 18 aa, Mycobacterium
LESGPARIQAMLGALLEL

SEQ ID NO: 832618 - protein, 17 aa, Mycobacterium
LESLRARFGTLTGVDRP

SEQ ID NO: 832619 - protein, 21 aa, Mycobacterium
LESLRLWHDGGFLDGLPSHVV

SEQ ID NO: 832620 - protein, 25 aa, Mycobacterium
LESLRLWRDGGFLDGLPAGVVTARE

SEQ ID NO: 832621 - protein, 27 aa, Mycobacterium
LESNAPVLLGLIGLWYSNFMGAQSRAV

SEQ ID NO: 832622 - protein, 26 aa, Mycobacterium
LESNASAMLMLPLFNYADGNCDAIRE

SEQ ID NO: 832623 - protein, 31 aa, Mycobacterium
LESNPFALLVGMLLDQQIPMETAFAGPKKLA

SEQ ID NO: 832624 - protein, 25 aa, Mycobacterium
LESPPLGFGLSLLAGLVGLSRVATG

SEQ ID NO: 832625 - protein, 29 aa, Mycobacterium
LESQIRVQSAWWPVQVPAAQLAAALVPMH

SEQ ID NO: 832626 - protein, 19 aa, Mycobacterium
LESRPLVRNGRRIELDSAV

SEQ ID NO: 832627 - protein, 25 aa, Mycobacterium
LESRRKPRMAAYVKQLYGIYDRYIA

SEQ ID NO: 832628 - protein, 18 aa, Mycobacterium
LESTVRFILSAKSAYVDG

SEQ ID NO: 832629 - protein, 33 aa, Mycobacterium
LESVPFLLSVGDLLLAWLLLQQAEIALNALDGT

SEQ ID NO: 832630 - protein, 21 aa, Mycobacterium
LESVVADDLWPLPTYQEMLYI

SEQ ID NO: 832631 - protein, 17 aa, Mycobacterium
LESVVLAAGALARFGSE

SEQ ID NO: 832632 - protein, 23 aa, Mycobacterium
LESVYRLRLALPQLDPGSLSLGR

SEQ ID NO: 832633 - protein, 19 aa, Mycobacterium
LESWDIYRCIDQVLTQLDP

SEQ ID NO: 832634 - protein, 20 aa, Mycobacterium
LETAFTWREYGTAALRAAAK

SEQ ID NO: 832635 - protein, 29 aa, Mycobacterium
LETAGERPHYMPLFVAPQPIEAEERANAD

SEQ ID NO: 832636 - protein, 24 aa, Mycobacterium
LETDLIGRNVLYGRWTFQVVEEFD

SEQ ID NO: 832637 - protein, 17 aa, Mycobacterium
LETFIAVNPLAGLESMP

SEQ ID NO: 832638 - protein, 28 aa, Mycobacterium
LETGRRLSRLRILTALVLGRLTRSPLYH

SEQ ID NO: 832639 - protein, 32 aa, Mycobacterium
LETKEHLGGFWIINAPDLDAALKWAAEGSAAC

SEQ ID NO: 832640 - protein, 26 aa, Mycobacterium
LETLGHGGAYFFRQLTDGTVEGTAGQ

SEQ ID NO: 832641 - protein, 28 aa, Mycobacterium
LETLGHRSVYDPAPLRALRLQQVLREII

SEQ ID NO: 832642 - protein, 34 aa, Mycobacterium
LETLIDVVNPLIRVLRVALYPTKIVLDFADDRIA

SEQ ID NO: 832643 - protein, 18 aa, Mycobacterium
LETLILSILNHDSAVASA

SEQ ID NO: 832644 - protein, 19 aa, Mycobacterium
LETLLTRIADIAEPLPRTL

SEQ ID NO: 832645 - protein, 21 aa, Mycobacterium
LETLNWYLDTLGMIVSDFLYF

SEQ ID NO: 832646 - protein, 19 aa, Mycobacterium
LETLVDFVYLIAVRDISQD

SEQ ID NO: 832647 - protein, 25 aa, Mycobacterium
LETPEMLTQWLWDNGFEVREATRRD

SEQ ID NO: 832648 - protein, 24 aa, Mycobacterium
LETPVPVPPAPWFPKDVDAWNVRW

SEQ ID NO: 832649 - protein, 26 aa, Mycobacterium
LETPWTALQLAYFTGYAMWTYTAEPF

SEQ ID NO: 832650 - protein, 19 aa, Mycobacterium
LETSGFPAVVRPVAAAYGQ

SEQ ID NO: 832651 - protein, 23 aa, Mycobacterium
LETSPYDAGLGRTVRLEKYFVGR

SEQ ID NO: 832652 - protein, 19 aa, Mycobacterium
LETTAEWVPQLWKDMDTTL

SEQ ID NO: 832653 - protein, 26 aa, Mycobacterium
LETTPVIVGTLWTNTMFKPRNGLVKV

SEQ ID NO: 832654 - protein, 38 aa, Mycobacterium
LETWHPLGVVGVITAFNFPVAVWAWNAALALVCGDPVV

SEQ ID NO: 832655 - protein, 18 aa, Mycobacterium
LETYLVRGRPDLARRGRG

SEQ ID NO: 832656 - protein, 30 aa, Mycobacterium
LEVAQLYDGFTFLTIAWLEALGICADGGAG

SEQ ID NO: 832657 - protein, 30 aa, Mycobacterium
LEVAQLYDGFTFLTLAWLEALGICADGEAG

SEQ ID NO: 832658 - protein, 25 aa, Mycobacterium
LEVEGRGRIWVDDKFRTKVEHIYAV

SEQ ID NO: 832659 - protein, 19 aa, Mycobacterium
LEVFLPTGHSLRLPSWSVH

SEQ ID NO: 832660 - protein, 19 aa, Mycobacterium
LEVFLRYLDTKLEKIYTVN

SEQ ID NO: 832661 - protein, 19 aa, Mycobacterium
LEVFRPGDRRAARAALGLP

SEQ ID NO: 832662 - protein, 23 aa, Mycobacterium
LEVHVPQWRFVAEWTSKGEILTP

SEQ ID NO: 832663 - protein, 18 aa, Mycobacterium
LEVIDLRSLVPLDFDTVA

SEQ ID NO: 832664 - protein, 17 aa, Mycobacterium
LEVIPEHIPFEVAALNE

SEQ ID NO: 832665 - protein, 33 aa, Mycobacterium
LEVLGKPENVWWSDLYWVFEIITDVIGGRSKIY

SEQ ID NO: 832666 - protein, 27 aa, Mycobacterium
LEVLHRLRKENPALPVLLLTAKDAVED

SEQ ID NO: 832667 - protein, 19 aa, Mycobacterium
LEVLQHWLARDRSATLVIA

SEQ ID NO: 832668 - protein, 18 aa, Mycobacterium
LEVLRSWLSRDGAGQLVI

SEQ ID NO: 832669 - protein, 17 aa, Mycobacterium
LEVLRVGAPEFTASAAD

SEQ ID NO: 832670 - protein, 18 aa, Mycobacterium
LEVLVKKGDAIAEGDTIV

SEQ ID NO: 832671 - protein, 18 aa, Mycobacterium
LEVMERREELMAERSEEL

SEQ ID NO: 832672 - protein, 17 aa, Mycobacterium
LEVMNSEIWPLLQDGEP

SEQ ID NO: 832673 - protein, 18 aa, Mycobacterium
LEVPEFRTSPRPLPMVVE

SEQ ID NO: 832674 - protein, 26 aa, Mycobacterium
LEVPHLHIHVFPTRSLRDFGFANVDR

SEQ ID NO: 832675 - protein, 19 aa, Mycobacterium
LEVPTDAVRQRFLGLGFSA

SEQ ID NO: 832676 - protein, 38 aa, Mycobacterium
LEVRLRLLRDRIHQGWILNALWLIDTGVTAAALPRSQA

SEQ ID NO: 832677 - protein, 24 aa, Mycobacterium
LEVSPATLYNWRRSYGGMDTDAAK

SEQ ID NO: 832678 - protein, 24 aa, Mycobacterium
LEVSQRLFPTLRERGLISNDKSGT

SEQ ID NO: 832679 - protein, 30 aa, Mycobacterium
LEVSTHILPQQALLYRLCGDRNPLHSDPAF

SEQ ID NO: 832680 - protein, 21 aa, Mycobacterium
LEVVALLSRGKLLYGVVDDEN

SEQ ID NO: 832681 - protein, 20 aa, Mycobacterium
LEVVALLSRGKLLYGVVDNE

SEQ ID NO: 832682 - protein, 18 aa, Mycobacterium
LEVVFPGCEFLPLNDERR

SEQ ID NO: 832683 - protein, 17 aa, Mycobacterium
LEVVGLGDLARARPHEI

SEQ ID NO: 832684 - protein, 19 aa, Mycobacterium
LEVWAPAVMPPIGVELSHE

SEQ ID NO: 832685 - protein, 27 aa, Mycobacterium
LEVWKSWARWRVIRARAAWLTDEVVAA

SEQ ID NO: 832686 - protein, 27 aa, Mycobacterium
LEVWKSWARWRVIRARASWLTDELVAA

SEQ ID NO: 832687 - protein, 19 aa, Mycobacterium
LEVYSPNSPLGGALIDAKV

SEQ ID NO: 832688 - protein, 19 aa, Mycobacterium
LEVYSPNSPLGGALLDAKV

SEQ ID NO: 832689 - protein, 25 aa, Mycobacterium
LEVYVLRPCIVAGPKATALADAMPW

SEQ ID NO: 832690 - protein, 34 aa, Mycobacterium
LEWADLFVLQFPLWWYSVPAILKGWIDRVFVKGF

SEQ ID NO: 832691 - protein, 19 aa, Mycobacterium
LEWALRHGARFIVMVPGPV

SEQ ID NO: 832692 - protein, 24 aa, Mycobacterium
LEWDYYDMKNIPWSQLRVLAPTAT

SEQ ID NO: 832693 - protein, 20 aa, Mycobacterium
LEWEEKPYEWISGRHFRQSR

SEQ ID NO: 832694 - protein, 18 aa, Mycobacterium
LEWGCFTFGIIQSENHFT

SEQ ID NO: 832695 - protein, 29 aa, Mycobacterium
LEWGHYGIRVIDMWPLYVNTAMTKDVKTG

SEQ ID NO: 832696 - protein, 18 aa, Mycobacterium
LEWIVGHPDRVRSALLLA

SEQ ID NO: 832697 - protein, 34 aa, Mycobacterium
LEWLCGQRPISMLYLIPTLHNPLGYILGASARQR

SEQ ID NO: 832698 - protein, 18 aa, Mycobacterium
LEWMVGHPGRVRAGLLLA

SEQ ID NO: 832699 - protein, 18 aa, Mycobacterium
LEWRQIQLVAGADTIRNG

SEQ ID NO: 832700 - protein, 17 aa, Mycobacterium
LEWVGPHVDLSAVDESE

SEQ ID NO: 832701 - protein, 20 aa, Mycobacterium
LEYGKGFLLALHLGRQKDAG

SEQ ID NO: 832702 - protein, 24 aa, Mycobacterium
LEYHLTTLFPPVRPRRWLEIRYLD

SEQ ID NO: 832703 - protein, 19 aa, Mycobacterium
LEYHWGPDWMCWDADQTFQ

SEQ ID NO: 832704 - protein, 20 aa, Mycobacterium
LEYLLVINGSLVNPSLRKAV

SEQ ID NO: 832705 - protein, 18 aa, Mycobacterium
LEYLVAEGYFATDGPFLH

SEQ ID NO: 832706 - protein, 23 aa, Mycobacterium
LEYQGRKLLARFDAGTYVLLTDA

SEQ ID NO: 832707 - protein, 17 aa, Mycobacterium
LFAAFSMVTHAGQGCAL

SEQ ID NO: 832708 - protein, 19 aa, Mycobacterium
LFAALQQTPARKALILNLA

SEQ ID NO: 832709 - protein, 25 aa, Mycobacterium
LFAAWAVYLLVGYEQAILPRDISSL

SEQ ID NO: 832710 - protein, 26 aa, Mycobacterium
LFADAYRVPPWWDPEKAERGRQRARQ

SEQ ID NO: 832711 - protein, 19 aa, Mycobacterium
LFADVVFGQPFCKELKARQ

SEQ ID NO: 832712 - protein, 23 aa, Mycobacterium
LFADWAVYLLVGYEQATLPPDPA

SEQ ID NO: 832713 - protein, 24 aa, Mycobacterium
LFADYATNPPLYPTLHEYLRTSGV

SEQ ID NO: 832714 - protein, 20 aa, Mycobacterium
LFADYTGLHWFRAALDARPA

SEQ ID NO: 832715 - protein, 22 aa, Mycobacterium
LFADYTGLHWFRAALDARPVDE

SEQ ID NO: 832716 - protein, 19 aa, Mycobacterium
LFADYTGLHWFRTALDARP

SEQ ID NO: 832717 - protein, 22 aa, Mycobacterium
LFADYTGLNWFRAALDARPAGE

SEQ ID NO: 832718 - protein, 27 aa, Mycobacterium
LFAEHLLTHYGVRRLLLTSRRGPSGVG

SEQ ID NO: 832719 - protein, 17 aa, Mycobacterium
LFAERGFLAVRLEDIGA

SEQ ID NO: 832720 - protein, 20 aa, Mycobacterium
LFAERGFLAVRLEDIGAAAG

SEQ ID NO: 832721 - protein, 18 aa, Mycobacterium
LFAGGGFGGRRFDAGGFG

SEQ ID NO: 832722 - protein, 23 aa, Mycobacterium
LFAGRRQLIVYRAFFEPGVDGWP

SEQ ID NO: 832723 - protein, 18 aa, Mycobacterium
LFALLAETGMRMGEALTL

SEQ ID NO: 832724 - protein, 17 aa, Mycobacterium
LFALLEQAAARHGERGA

SEQ ID NO: 832725 - protein, 24 aa, Mycobacterium
LFAPAMHTEMWLHPATQQNVATLR

SEQ ID NO: 832726 - protein, 19 aa, Mycobacterium
LFAQLPFYDVVDTDDSVVV

SEQ ID NO: 832727 - protein, 17 aa, Mycobacterium
LFARPMVTSPAATVAVE

SEQ ID NO: 832728 - protein, 18 aa, Mycobacterium
LFARPQQLPPTDDQGRHL

SEQ ID NO: 832729 - protein, 17 aa, Mycobacterium
LFASLRRQRRLASRFDE

SEQ ID NO: 832730 - protein, 17 aa, Mycobacterium
LFATLAETGMRLGEALS

SEQ ID NO: 832731 - protein, 17 aa, Mycobacterium
LFAVDLAADGVLPLPSG

SEQ ID NO: 832732 - protein, 31 aa, Mycobacterium
LFAVEVAMLQLLRHWGIRPDFVLGHSVGEIA

SEQ ID NO: 832733 - protein, 20 aa, Mycobacterium
LFAVKACFAAFRSGTLEHHG

SEQ ID NO: 832734 - protein, 18 aa, Mycobacterium
LFCEAGVIALTAFISPYV

SEQ ID NO: 832735 - protein, 23 aa, Mycobacterium
LFCPDQFLGAHVRRVTGRKNMHV

SEQ ID NO: 832736 - protein, 22 aa, Mycobacterium
LFCPDQFLGAHVRRVTGRQNLH

SEQ ID NO: 832737 - protein, 19 aa, Mycobacterium
LFCSFVMALADHQQGNHLA

SEQ ID NO: 832738 - protein, 18 aa, Mycobacterium
LFCYIDRGLGPAQWADLG

SEQ ID NO: 832739 - protein, 26 aa, Mycobacterium
LFDAAAGWLGSRAGLLAEPLEALLSA

SEQ ID NO: 832740 - protein, 17 aa, Mycobacterium
LFDAGHDTFLEISPHPI

SEQ ID NO: 832741 - protein, 17 aa, Mycobacterium
LFDARWLDAVVPDRPVV

SEQ ID NO: 832742 - protein, 20 aa, Mycobacterium
LFDATIAVNLRAPALLASAV

SEQ ID NO: 832743 - protein, 23 aa, Mycobacterium
LFDAVLNLNLKGPFRLSALVGER

SEQ ID NO: 832744 - protein, 19 aa, Mycobacterium
LFDDLRLEHGRLDEPIPVG

SEQ ID NO: 832745 - protein, 20 aa, Mycobacterium
LFDGMFALVQHSLGRLYSLG

SEQ ID NO: 832746 - protein, 19 aa, Mycobacterium
LFDGVMNPELYLADAIGAR

SEQ ID NO: 832747 - protein, 20 aa, Mycobacterium
LFDLDPIFQSVLDPAARRLL

SEQ ID NO: 832748 - protein, 17 aa, Mycobacterium
LFDLHEVVFVPTGQPWQ

SEQ ID NO: 832749 - protein, 29 aa, Mycobacterium
LFDPRLKRSIPFLPNTIGLITGRASAAER

SEQ ID NO: 832750 - protein, 18 aa, Mycobacterium
LFDPSSPIRLVLGDLRVG

SEQ ID NO: 832751 - protein, 20 aa, Mycobacterium
LFDQITRLPEYYPTRAEAQI

SEQ ID NO: 832752 - protein, 18 aa, Mycobacterium
LFDQLGLGRVPLVGNSLG

SEQ ID NO: 832753 - protein, 18 aa, Mycobacterium
LFDTGHFWPFEAPRATVD

SEQ ID NO: 832754 - protein, 20 aa, Mycobacterium
LFDTLPTFRRTLDAAGLDDH

SEQ ID NO: 832755 - protein, 18 aa, Mycobacterium
LFDVPRPPVPVGALDHAP

SEQ ID NO: 832756 - protein, 17 aa, Mycobacterium
LFDYWRDDYKTLHGMTS

SEQ ID NO: 832757 - protein, 25 aa, Mycobacterium
LFEALRIEPYLRYSAVRSPAHAAAL

SEQ ID NO: 832758 - protein, 25 aa, Mycobacterium
LFEAPTIHLLAPRLGADGAGRTPLV

SEQ ID NO: 832759 - protein, 28 aa, Mycobacterium
LFEDVDLLVAPVLPLANLTLDRFRELLF

SEQ ID NO: 832760 - protein, 17 aa, Mycobacterium
LFEEGISTSRMSLDPAR

SEQ ID NO: 832761 - protein, 18 aa, Mycobacterium
LFEHIDMIEAFRLGDPAP

SEQ ID NO: 832762 - protein, 17 aa, Mycobacterium
LFELAAQCLVPGGRLVF

SEQ ID NO: 832763 - protein, 19 aa, Mycobacterium
LFELDPIFQSILDPAARQR

SEQ ID NO: 832764 - protein, 18 aa, Mycobacterium
LFELVAEFLRPVFAAHWD

SEQ ID NO: 832765 - protein, 37 aa, Mycobacterium
LFEPGRPRMHQYMLDLAGLFDAGVLRPLPVTAFDVRR

SEQ ID NO: 832766 - protein, 24 aa, Mycobacterium
LFERDKHYIVRNGEVFIVDEFTGR

SEQ ID NO: 832767 - protein, 40 aa, Mycobacterium
LFERELSLTTLAPHLVKPLPFLFPLTKRGWERPYIAAGIF

SEQ ID NO: 832768 - protein, 19 aa, Mycobacterium
LFERLVAAAYQHGKALRSA

SEQ ID NO: 832769 - protein, 17 aa, Mycobacterium
LFEVFGVDKVLGADKFS

SEQ ID NO: 832770 - protein, 19 aa, Mycobacterium
LFEVVWTPMTVAATDAAPA

SEQ ID NO: 832771 - protein, 32 aa, Mycobacterium
LFFANDTEWVTWWLAVSRIGALAVPLSTLYRP

SEQ ID NO: 832772 - protein, 17 aa, Mycobacterium
LFGAAYYHNTASLASLS

SEQ ID NO: 832773 - protein, 20 aa, Mycobacterium
LFGAIRPDDVAAHFGRGTLV

SEQ ID NO: 832774 - protein, 26 aa, Mycobacterium
LFGAPATALLIDFRDLSLQAVQFDPD

SEQ ID NO: 832775 - protein, 17 aa, Mycobacterium
LFGDGKLTNLPGGIEEY

SEQ ID NO: 832776 - protein, 26 aa, Mycobacterium
LFGEVIYALYATIAREALFASQARFG

SEQ ID NO: 832777 - protein, 32 aa, Mycobacterium; identical to SEQ ID NO: 128695

SEQ ID NO: 832778 - protein, 21 aa, Mycobacterium
LFGGPFLSSVGMAASVLLALD

SEQ ID NO: 832779 - protein, 18 aa, Mycobacterium
LFGHDIGFFNAGNHNVGM

SEQ ID NO: 832780 - protein, 24 aa, Mycobacterium
LFGKFVLCQLDDLWRQFDSKYLAT

SEQ ID NO: 832781 - protein, 26 aa, Mycobacterium
LFGKPESFVKRRMGVALAFDDDVQTA

SEQ ID NO: 832782 - protein, 17 aa, Mycobacterium
LFGLDLAKRDIAKGHQA

SEQ ID NO: 832783 - protein, 18 aa, Mycobacterium
LFGLMIPEEYGGLGESLL

SEQ ID NO: 832784 - protein, 30 aa, Mycobacterium
LFGNTAAANFLLIGAAYQAGALRIPAAAIE

SEQ ID NO: 832785 - protein, 25 aa, Mycobacterium
LFGQGFYNPKPALQWYWDCYVPSHD

SEQ ID NO: 832786 - protein, 23 aa, Mycobacterium
LFGQQIRYDLGCGFPLLTTKKVH

SEQ ID NO: 832787 - protein, 17 aa, Mycobacterium
LFGRPMVTSPNATIAIE

SEQ ID NO: 832788 - protein, 19 aa, Mycobacterium
LFGRRAPIPSAEPRRRGFL

SEQ ID NO: 832789 - protein, 29 aa, Mycobacterium
LFGSERIVPAPVTFVDIAGLVKGASEGAG

SEQ ID NO: 832790 - protein, 20 aa, Mycobacterium
LFGTLSLWQGVDVPGPSLSL

SEQ ID NO: 832791 - protein, 21 aa, Mycobacterium
LFGTNGWHPGEPWIADTTLGR

SEQ ID NO: 832792 - protein, 18 aa, Mycobacterium
LFGTVDHGAWITKAGIDR

SEQ ID NO: 832793 - protein, 20 aa, Mycobacterium
LFGTWEPVVSAVPLLNMIAM

SEQ ID NO: 832794 - protein, 25 aa, Mycobacterium
LFGVAIAIEALRRGAARTQVRALLR

SEQ ID NO: 832795 - protein, 20 aa, Mycobacterium
LFHARAKLQRKGCDLLVVNA

SEQ ID NO: 832796 - protein, 18 aa, Mycobacterium
LFHDEFVRVLSAGADAYA

SEQ ID NO: 832797 - protein, 20 aa, Mycobacterium
LFHECAGLRLAFLKRDGEVL

SEQ ID NO: 832798 - protein, 26 aa, Mycobacterium
LFHGVQLWVNLPKKDKFAPPRYQAIE

SEQ ID NO: 832799 - protein, 18 aa, Mycobacterium
LFHHYAGGPVVHVHLGLY

SEQ ID NO: 832800 - protein, 17 aa, Mycobacterium
LFHVNAVLVSTLTPLLA

SEQ ID NO: 832801 - protein, 18 aa, Mycobacterium
LFIADVDALLPAGNEMRP

SEQ ID NO: 832802 - protein, 26 aa, Mycobacterium
LFIGSGMPAGLWRRVTEKFDPAHVVE

SEQ ID NO: 832803 - protein, 17 aa, Mycobacterium
LFISSHTVEWHLRKVFA

SEQ ID NO: 832804 - protein, 19 aa, Mycobacterium
LFIVGRIKDVVIIRGRNHY

SEQ ID NO: 832805 - protein, 19 aa, Mycobacterium
LFLDYFNASPAFGFAAAPH

SEQ ID NO: 832806 - protein, 26 aa, Mycobacterium
LFLHVHAFARYYRYPFRPATIGSYRS

SEQ ID NO: 832807 - protein, 17 aa, Mycobacterium
LFLVIDDAQWLDPSSVD

SEQ ID NO: 832808 - protein, 17 aa, Mycobacterium
LFMQLGDGPEWICYFPH

SEQ ID NO: 832809 - protein, 26 aa, Mycobacterium
LFMREGHPFLWSLSDPRPDGLVVVEY

SEQ ID NO: 832810 - protein, 27 aa, Mycobacterium
LFNAMPPLHHRDPGPALALLRDPRVTV

SEQ ID NO: 832811 - protein, 22 aa, Mycobacterium
LFNAMPPLHHREPGPALALLRH

SEQ ID NO: 832812 - protein, 19 aa, Mycobacterium
LFNDLTVQFALRTRGRLAA

SEQ ID NO: 832813 - protein, 21 aa, Mycobacterium
LFNRDAVFGIQLYVKRVFIMG

SEQ ID NO: 832814 - protein, 19 aa, Mycobacterium
LFPAAEAVIVYLSTPPFGS

SEQ ID NO: 832815 - protein, 32 aa, Mycobacterium
LFPEGFTPSLDLFLTPTFRGYLANYGAVLYPE

SEQ ID NO: 832816 - protein, 24 aa, Mycobacterium
LFPLEWADRLEHYFVDVRLHTAEH

SEQ ID NO: 832817 - protein, 32 aa, Mycobacterium
LFPNAHAWIAHIWQPPFAGKRLRRRLRAAART

SEQ ID NO: 832818 - protein, 18 aa, Mycobacterium
LFPRCAEAIMAMLAVLKT

SEQ ID NO: 832819 - protein, 19 aa, Mycobacterium
LFPRMAIPQSWYDAGIAHR

SEQ ID NO: 832820 - protein, 20 aa, Mycobacterium
LFPTLNYAVSVAEACERADA

SEQ ID NO: 832821 - protein, 25 aa, Mycobacterium
LFPTLPSMMRITLNAILRAVFGADG

SEQ ID NO: 832822 - protein, 17 aa, Mycobacterium
LFPVLSDFWPHGAVSQA

SEQ ID NO: 832823 - protein, 37 aa, Mycobacterium
LFQEFAGLPVRRVWRPTTFYTMLLQQLTDHRTMHDGV

SEQ ID NO: 832824 - protein, 17 aa, Mycobacterium
LFQEIRETRGLAYSVYS

SEQ ID NO: 832825 - protein, 21 aa, Mycobacterium
LFQELPLRRWAVRQHADTSIT

SEQ ID NO: 832826 - protein, 24 aa, Mycobacterium
LFQELQPLIIPLENHPWNWAAHEA

SEQ ID NO: 832827 - protein, 17 aa, Mycobacterium
LFQMAWAAILSAFTDRT

SEQ ID NO: 832828 - protein, 19 aa, Mycobacterium
LFQMMQPLMSGRPDQLGLP

SEQ ID NO: 832829 - protein, 31 aa, Mycobacterium
LFQSVQYQLSRRFPRFMRRTLMTMAQRRLPE

SEQ ID NO: 832830 - protein, 18 aa, Mycobacterium
LFRDVVLALGQQLVDATA

SEQ ID NO: 832831 - protein, 23 aa, Mycobacterium
LFREMITLPVLSKDFREAVLDAC

SEQ ID NO: 832832 - protein, 18 aa, Mycobacterium
LFRESLRLIIDPNMLLGA

SEQ ID NO: 832833 - protein, 19 aa, Mycobacterium
LFRFGFDIVAPAGLELLAD

SEQ ID NO: 832834 - protein, 17 aa, Mycobacterium
LFRFTFASQDSLPEAFQ

SEQ ID NO: 832835 - protein, 24 aa, Mycobacterium
LFRIAEAWPRRPGARMLVCSSVSG

SEQ ID NO: 832836 - protein, 17 aa, Mycobacterium
LFRKRPATLPGGLSAAW

SEQ ID NO: 832837 - protein, 27 aa, Mycobacterium
LFRLVNPVMGLLLRSPFAGAARKQFMV

SEQ ID NO: 832838 - protein, 21 aa, Mycobacterium
LFRPSPYAVRCCEQSIEILRT

SEQ ID NO: 832839 - protein, 22 aa, Mycobacterium
LFRPSPYAVRCCERSLEILRAA

SEQ ID NO: 832840 - protein, 20 aa, Mycobacterium
LFRRRGLETDILLATGTNLL

SEQ ID NO: 832841 - protein, 21 aa, Mycobacterium
LFRRVELFARERWDELAALDG

SEQ ID NO: 832842 - protein, 22 aa, Mycobacterium
LFRRVELFARERWDELGGLDDD

SEQ ID NO: 832843 - protein, 25 aa, Mycobacterium
LFRSRGVLPSRLRLIYLADGQVLDY

SEQ ID NO: 832844 - protein, 25 aa, Mycobacterium
LFRSRGVLPTRLRLIYLADSQVLDY

SEQ ID NO: 832845 - protein, 17 aa, Mycobacterium
LFRVGVSVWERYTGPYS

SEQ ID NO: 832846 - protein, 18 aa, Mycobacterium
LFRVIRRLRDSGTAILFV

SEQ ID NO: 832847 - protein, 25 aa, Mycobacterium
LFSAFGMYPVGYYDLREAASPIPVV

SEQ ID NO: 832848 - protein, 17 aa, Mycobacterium
LFSDAGGGGFGGFGLAG

SEQ ID NO: 832849 - protein, 23 aa, Mycobacterium
LFSLPCYHMFGYIEGLLSAMFVG

SEQ ID NO: 832850 - protein, 24 aa, Mycobacterium
LFSPRVITYRASRGFLGTPAMAVV

SEQ ID NO: 832851 - protein, 24 aa, Mycobacterium
LFSRPGVHYLSGFFGPLERALRDM

SEQ ID NO: 832852 - protein, 18 aa, Mycobacterium
LFSSISGVLGSRWLAHYA

SEQ ID NO: 832853 - protein, 18 aa, Mycobacterium
LFSTFYRVREMRSMWREM

SEQ ID NO: 832854 - protein, 30 aa, Mycobacterium
LFTATCPEWIYFWLGAARIGAVSAAVNAAN

SEQ ID NO: 832855 - protein, 26 aa, Mycobacterium
LFTEEAIWEMPPFDSWYQGPQAIGDL

SEQ ID NO: 832856 - protein, 25 aa, Mycobacterium
LFTEFVCWTAEILVARAVPAESLYP

SEQ ID NO: 832857 - protein, 36 aa, Mycobacterium
LFTEWLGIWVPRCLDAALALQPIWSAPADKAVTFAS

SEQ ID NO: 832858 - protein, 24 aa, Mycobacterium
LFTHLRPLLFTIAYEMLGSATEAD

SEQ ID NO: 832859 - protein, 17 aa, Mycobacterium
LFTKPASVEQIWWHWNY

SEQ ID NO: 832860 - protein, 17 aa, Mycobacterium
LFTPATKTQHYLTAAAV

SEQ ID NO: 832861 - protein, 19 aa, Mycobacterium
LFTPRFLTRLGVQAVVWDM

SEQ ID NO: 832862 - protein, 21 aa, Mycobacterium
LFTQLAAEWPPVRGVIHAAGV

SEQ ID NO: 832863 - protein, 20 aa, Mycobacterium
LFTRTDVPPLILTSTRALDD

SEQ ID NO: 832864 - protein, 19 aa, Mycobacterium
LFTRTGAGLAFTPGGLRLA

SEQ ID NO: 832865 - protein, 19 aa, Mycobacterium
LFTRVLKMMPLSESALEGM

SEQ ID NO: 832866 - protein, 33 aa, Mycobacterium
LFVAGFIGSPAMNFFPATRTDVGVRLPFGEVTL

SEQ ID NO: 832867 - protein, 19 aa, Mycobacterium
LFVAGLRETLYGNATALAT

SEQ ID NO: 832868 - protein, 18 aa, Mycobacterium
LFVASYFGELTDALPALA

SEQ ID NO: 832869 - protein, 24 aa, Mycobacterium
LFVGTFSFGPLIEHLPYGLQADNV

SEQ ID NO: 832870 - protein, 19 aa, Mycobacterium
LFVPCHRVFRIGGALGGFR

SEQ ID NO: 832871 - protein, 19 aa, Mycobacterium
LFVSQAAGPPALYRPAEDL

SEQ ID NO: 832872 - protein, 17 aa, Mycobacterium
LFVTNQPNRVFLRNWRE

SEQ ID NO: 832873 - protein, 21 aa, Mycobacterium
LFVVFARTRPADDKGPGIAVF

SEQ ID NO: 832874 - protein, 20 aa, Mycobacterium
LFVVRKLIELTAVDAAGTAG

SEQ ID NO: 832875 - protein, 24 aa, Mycobacterium
LFWDAAAFGLIREKSLHLTFGEFS

SEQ ID NO: 832876 - protein, 17 aa, Mycobacterium
LFWQRKYRVLQRLGESR

SEQ ID NO: 832877 - protein, 18 aa, Mycobacterium
LFYVAALLHDISLTEPFD

SEQ ID NO: 832878 - protein, 19 aa, Mycobacterium
LGAAFASELLARGADRVYV

SEQ ID NO: 832879 - protein, 29 aa, Mycobacterium
LGAALACGPLFGTVYLAIPALVAASGGQE

SEQ ID NO: 832880 - protein, 20 aa, Mycobacterium
LGAALDRHSHFRQRLQSALQ

SEQ ID NO: 832881 - protein, 29 aa, Mycobacterium
LGAALQGFVALPLLAGYDLDDPNPEGAGR

SEQ ID NO: 832882 - protein, 26 aa, Mycobacterium
LGAALQGFVALPLLVGYDLDDPHPEG

SEQ ID NO: 832883 - protein, 22 aa, Mycobacterium
LGAALRIAWRALTLAGVDGVDL

SEQ ID NO: 832884 - protein, 20 aa, Mycobacterium
LGAALYLKNFTRRGLYQRVG

SEQ ID NO: 832885 - protein, 26 aa, Mycobacterium
LGAARRRAFRIWLDGRRAVSVRLAPG

SEQ ID NO: 832886 - protein, 18 aa, Mycobacterium
LGAATVRLVLVGGGPGAG

SEQ ID NO: 832887 - protein, 24 aa, Mycobacterium
LGAAYLEGFAWGLSREYSVLVEMD

SEQ ID NO: 832888 - protein, 27 aa, Mycobacterium
LGACHCLELPFLFGSPEAWADAAMLGN

SEQ ID NO: 832889 - protein, 28 aa, Mycobacterium
LGAEDFVVLLVVHHICWDDNSWEVFFAE

SEQ ID NO: 832890 - protein, 20 aa, Mycobacterium
LGAERIHRALDLPGGIEGAV

SEQ ID NO: 832891 - protein, 24 aa, Mycobacterium
LGAFIEETLRFESPFRGHYRHVVR

SEQ ID NO: 832892 - protein, 17 aa, Mycobacterium
LGAFLDAIRRHEWDHDL

SEQ ID NO: 832893 - protein, 23 aa, Mycobacterium
LGAFLEEVLRYEPPFRGHYRHVV

SEQ ID NO: 832894 - protein, 20 aa, Mycobacterium
LGAFMNWPGPTFTDSGGFQV

SEQ ID NO: 832895 - protein, 17 aa, Mycobacterium
LGAFRHFLRPALLQNET

SEQ ID NO: 832896 - protein, 25 aa, Mycobacterium
LGAGAHRLYRRWIHELWSGRRVAEQ

SEQ ID NO: 832897 - protein, 25 aa, Mycobacterium
LGAGAYFIHFRWDSGDPDQLAETEA

SEQ ID NO: 832898 - protein, 20 aa, Mycobacterium
LGAGFTLALAADWRVSGDNV

SEQ ID NO: 832899 - protein, 31 aa, Mycobacterium
LGAGGLNWESVPLRLFAGGIAKLWDPANIDF

SEQ ID NO: 832900 - protein, 19 aa, Mycobacterium
LGAGMHPWGKWGTDFTEYG

SEQ ID NO: 832901 - protein, 23 aa, Mycobacterium
LGAGNIGNFNFGFGNNGTGNFGF

SEQ ID NO: 832902 - protein, 24 aa, Mycobacterium
LGAGPTGLLLAQLIAAGGASSVTV

SEQ ID NO: 832903 - protein, 21 aa, Mycobacterium
LGAHVATFREVSRFAAAHEMF

SEQ ID NO: 832904 - protein, 17 aa, Mycobacterium
LGAHVRLMEEPPRHVWH

SEQ ID NO: 832905 - protein, 17 aa, Mycobacterium
LGAHVRRVTGRKNLHVW

SEQ ID NO: 832906 - protein, 18 aa, Mycobacterium
LGAIPHLPEGLRGLEETR

SEQ ID NO: 832907 - protein, 22 aa, Mycobacterium
LGAKFADVLPPRSARLLICVDD

SEQ ID NO: 832908 - protein, 26 aa, Mycobacterium
LGAKPALFVWGMKDFAFRPGPCLPRM

SEQ ID NO: 832909 - protein, 24 aa, Mycobacterium
LGALAAFLGLSPRDPSASPPIARS

SEQ ID NO: 832910 - protein, 29 aa, Mycobacterium
LGALDLKLRHVMQFELKRIQREIGITFIY

SEQ ID NO: 832911 - protein, 22 aa, Mycobacterium
LGALEPLFERTLQWATDTELDG

SEQ ID NO: 832912 - protein, 23 aa, Mycobacterium
LGALHLDLRYVNGKSWLMFGPFA

SEQ ID NO: 832913 - protein, 18 aa, Mycobacterium
LGALLDTVPFPDAGPELE

SEQ ID NO: 832914 - protein, 20 aa, Mycobacterium
LGALLQLRRPALLVGRTDPT

SEQ ID NO: 832915 - protein, 22 aa, Mycobacterium
LGALPLAFLQNQAQYCSVICPF

SEQ ID NO: 832916 - protein, 18 aa, Mycobacterium
LGALPVPRAFGGPGGNIL

SEQ ID NO: 832917 - protein, 25 aa, Mycobacterium
LGALRIVFNALTHPAARKRVLGMRR

SEQ ID NO: 832918 - protein, 17 aa, Mycobacterium
LGALTALRLPPAGRVRE

SEQ ID NO: 832919 - protein, 17 aa, Mycobacterium
LGALTKAPFYAAKMVPG

SEQ ID NO: 832920 - protein, 23 aa, Mycobacterium
LGAMPIYRFGTEEQKRKWLPDLT

SEQ ID NO: 832921 - protein, 21 aa, Mycobacterium
LGAMQAGLIAVPLSVPAAGSH

SEQ ID NO: 832922 - protein, 21 aa, Mycobacterium
LGAMRYFGMASPEYVERHLPD

SEQ ID NO: 832923 - protein, 19 aa, Mycobacterium
LGAMVHPGLVAANRNQLVS

SEQ ID NO: 832924 - protein, 28 aa, Mycobacterium
LGAPEGLRLWVMMETPRSFLRAEEIASA

SEQ ID NO: 832925 - protein, 18 aa, Mycobacterium
LGAPEMRPYIAEMARIAD

SEQ ID NO: 832926 - protein, 23 aa, Mycobacterium
LGAPLDLRTLGLQPRDFDFVAEQ

SEQ ID NO: 832927 - protein, 18 aa, Mycobacterium
LGAPLPLGAPLPIAPVVP

SEQ ID NO: 832928 - protein, 18 aa, Mycobacterium
LGAPLTSAIQRAVTDRYL

SEQ ID NO: 832929 - protein, 21 aa, Mycobacterium
LGAPTLLYLAAAGVGTIGIVE

SEQ ID NO: 832930 - protein, 22 aa, Mycobacterium
LGAQITIFRLGSDRGLARFIDQ

SEQ ID NO: 832931 - protein, 28 aa, Mycobacterium
LGAQPRDWFEVSLIPTTRELTTLGQAPV

SEQ ID NO: 832932 - protein, 24 aa, Mycobacterium
LGAQVTIFRLGSDPGLARFIDQVA

SEQ ID NO: 832933 - protein, 25 aa, Mycobacterium
LGAQVTIFRLGSDPGLARFIDQVAR

SEQ ID NO: 832934 - protein, 23 aa, Mycobacterium
LGARFTDFAGWQMPVRYGSELTE

SEQ ID NO: 832935 - protein, 17 aa, Mycobacterium
LGARLTIEKAVGAPGPV

SEQ ID NO: 832936 - protein, 28 aa, Mycobacterium
LGARPVGIQPLRRTAFMASAPRPNATGS

SEQ ID NO: 832937 - protein, 20 aa, Mycobacterium
LGARRFHASGELLPESVLGE

SEQ ID NO: 832938 - protein, 32 aa, Mycobacterium
LGARSPAFLGRLLELAPFSKILYSSDGFGPAE

SEQ ID NO: 832939 - protein, 20 aa, Mycobacterium
LGASGVWTGSIWLTAAEYDL

SEQ ID NO: 832940 - protein, 27 aa, Mycobacterium
LGASNPLSLLSGLWTAPGAITSGIVRV

SEQ ID NO: 832941 - protein, 25 aa, Mycobacterium
LGASRKRFLGTLLAGPDGSPRPPGG

SEQ ID NO: 832942 - protein, 24 aa, Mycobacterium
LGASWVRVNSIRPGLIRTDLVAAI

SEQ ID NO: 832943 - protein, 23 aa, Mycobacterium
LGATEILPWRQAAGRVSAEMICP

SEQ ID NO: 832944 - protein, 24 aa, Mycobacterium
LGATLLQDWSQFAAPAVFGTAMRV

SEQ ID NO: 832945 - protein, 24 aa, Mycobacterium
LGATNGWQSLPGIGPKTAKVIAQA

SEQ ID NO: 832946 - protein, 25 aa, Mycobacterium
LGAVAGIHLEGPWLSRARCGAHDPT

SEQ ID NO: 832947 - protein, 25 aa, Mycobacterium
LGAVAQFEFLLIAAALAEGWAVSVP

SEQ ID NO: 832948 - protein, 25 aa, Mycobacterium
LGAVDFLVKPVGRQVFYAKVKALLE

SEQ ID NO: 832949 - protein, 19 aa, Mycobacterium
LGAVRRYHDKLMTLGATAP

SEQ ID NO: 832950 - protein, 17 aa, Mycobacterium
LGAYILAGELAAAGDDY

SEQ ID NO: 832951 - protein, 18 aa, Mycobacterium
LGCDLAHADKLIYSVGVD

SEQ ID NO: 832952 - protein, 17 aa, Mycobacterium
LGCDLGVNPPFEMDNRS

SEQ ID NO: 832953 - protein, 18 aa, Mycobacterium
LGCDMGLNPPFEMDNRSK

SEQ ID NO: 832954 - protein, 23 aa, Mycobacterium
LGCELRHAHRLVYSEGLDLSGDI

SEQ ID NO: 832955 - protein, 24 aa, Mycobacterium
LGCELRHAHRLVYSEGLDLSGEIS

SEQ ID NO: 832956 - protein, 23 aa, Mycobacterium
LGCELRHAHRLVYSEGLDLSGNV

SEQ ID NO: 832957 - protein, 25 aa, Mycobacterium
LGCELRHAHRLVYSQGLDLSSEGAT

SEQ ID NO: 832958 - protein, 20 aa, Mycobacterium
LGCRSLALVAFGTGVGGFPL

SEQ ID NO: 832959 - protein, 20 aa, Mycobacterium
LGCRSLGLVAFGTGVGGFPL

SEQ ID NO: 832960 - protein, 20 aa, Mycobacterium
LGCRTLGLVAFGTGVGGFPL

SEQ ID NO: 832961 - protein, 27 aa, Mycobacterium
LGCVPGTVPVLVHPAPRGVLGEAAALV

SEQ ID NO: 832962 - protein, 23 aa, Mycobacterium
LGDAALADAPWLHRDAPLNQVMI

SEQ ID NO: 832963 - protein, 17 aa, Mycobacterium
LGDAALAEAPWLNRDSP

SEQ ID NO: 832964 - protein, 40 aa, Mycobacterium
LGDDAGIASLYDLALLAGMYAMFAGFFHGAAMVAAQGVSA

SEQ ID NO: 832965 - protein, 25 aa, Mycobacterium
LGDDDLLLVTVLKGAVMFVTDLARS

SEQ ID NO: 832966 - protein, 25 aa, Mycobacterium
LGDDLRRNLLKLRRSKSNVQRLKLL

SEQ ID NO: 832967 - protein, 23 aa, Mycobacterium
LGDEHVRIIRRFFDVLPDAVDAD

SEQ ID NO: 832968 - protein, 26 aa, Mycobacterium
LGDESIAIVLFLDIGLERCQQMFADL

SEQ ID NO: 832969 - protein, 30 aa, Mycobacterium
LGDGPEWICYFPHPHRVVCGGISILDRWDT

SEQ ID NO: 832970 - protein, 27 aa, Mycobacterium
LGDGPYVQLWPHRHGTDAMFAAALRRE

SEQ ID NO: 832971 - protein, 26 aa, Mycobacterium
LGDGPYVQLWPHRHGTDAMFAGALQR

SEQ ID NO: 832972 - protein, 22 aa, Mycobacterium
LGDGWVHFDAPAGMLIPDSVAT

SEQ ID NO: 832973 - protein, 17 aa, Mycobacterium
LGDGWVHFDTQAGMLIP

SEQ ID NO: 832974 - protein, 22 aa, Mycobacterium
LGDGWWSQKLVEYAHRLGISDA

SEQ ID NO: 832975 - protein, 24 aa, Mycobacterium
LGDLPKGWAPVIGLWESDSDEEFG

SEQ ID NO: 832976 - protein, 22 aa, Mycobacterium
LGDLRRSRLDNTRAREVLGWQP

SEQ ID NO: 832977 - protein, 20 aa, Mycobacterium
LGDLTSWTSWQRWRDAVVDR

SEQ ID NO: 832978 - protein, 19 aa, Mycobacterium
LGDMQLELIQPVRGQNIYS

SEQ ID NO: 832979 - protein, 25 aa, Mycobacterium
LGDNLRRTLLKLRRAKSNVQRLKLV

SEQ ID NO: 832980 - protein, 22 aa, Mycobacterium
LGDPALPHLFFVDGGALAVENA

SEQ ID NO: 832981 - protein, 29 aa, Mycobacterium
LGDPARDLGPMLVFLAGPGSGFITGQLLA

SEQ ID NO: 832982 - protein, 22 aa, Mycobacterium
LGDPFRLRLLDGLAASITERGY

SEQ ID NO: 832983 - protein, 24 aa, Mycobacterium
LGDPPGGWPEPFRTRALQGRGPAR

SEQ ID NO: 832984 - protein, 29 aa, Mycobacterium
LGDPTRDLGPMLVFLAGPGSGFITGQLLA

SEQ ID NO: 832985 - protein, 23 aa, Mycobacterium
LGDPVRLRLFSLIASHAGGEACV

SEQ ID NO: 832986 - protein, 24 aa, Mycobacterium
LGDQPFWARRLRDLGLSADTVPQR

SEQ ID NO: 832987 - protein, 24 aa, Mycobacterium
LGDQPLIYPFLVNDPGEGTQAKRR

SEQ ID NO: 832988 - protein, 19 aa, Mycobacterium
LGDRALPNRAVPGDGAIPI

SEQ ID NO: 832989 - protein, 23 aa, Mycobacterium
LGDRLNLPDGWRYRARTLDQTVR

SEQ ID NO: 832990 - protein, 19 aa, Mycobacterium
LGDRPVVVCLSRLVPRKGQ

SEQ ID NO: 832991 - protein, 34 aa, Mycobacterium
LGDSITFVIHIPLSIDLLLDLRLDKQRFVVSGDI

SEQ ID NO: 832992 - protein, 36 aa, Mycobacterium
LGDSITFVIHIPLSIDLLVDLWLDKQRFVVSGDIAL

SEQ ID NO: 832993 - protein, 23 aa, Mycobacterium
LGDTGRILLRPSGTEPMIRVMVE

SEQ ID NO: 832994 - protein, 18 aa, Mycobacterium
LGDVAAHQRAAEKERDAA

SEQ ID NO: 832995 - protein, 26 aa, Mycobacterium
LGDVDNIFFESGIEPFFQIAAQTIAA

SEQ ID NO: 832996 - protein, 26 aa, Mycobacterium
LGDVFDPLPAMGLWQTVLLVDGNVGL

SEQ ID NO: 832997 - protein, 17 aa, Mycobacterium
LGDVLARLTAYRARSVD

SEQ ID NO: 832998 - protein, 17 aa, Mycobacterium
LGDVRSLKQKRSLIRPV

SEQ ID NO: 832999 - protein, 18 aa, Mycobacterium
LGDWLVMHEGWRSELPDE

SEQ ID NO: 833000 - protein, 19 aa, Mycobacterium
LGDWPIPLPRELAGSGREV

SEQ ID NO: 833001 - protein, 21 aa, Mycobacterium
LGDWRIVLHCPYGLRVNGPLA

SEQ ID NO: 833002 - protein, 18 aa, Mycobacterium
LGDYEWILAFEAPELHRI

SEQ ID NO: 833003 - protein, 23 aa, Mycobacterium
LGDYEWILAFEAPELHRIVDLMR

SEQ ID NO: 833004 - protein, 28 aa, Mycobacterium
LGDYPFAGLRILDLGIIVAGGELSRLFG

SEQ ID NO: 833005 - protein, 25 aa, Mycobacterium
LGEALYVDTLLPPRVRTIAILRICA

SEQ ID NO: 833006 - protein, 23 aa, Mycobacterium
LGEARVRLSALRALIAATADEIE

SEQ ID NO: 833007 - protein, 25 aa, Mycobacterium
LGEDGWVIDRFLGGNAPLVLTEVER

SEQ ID NO: 833008 - protein, 27 aa, Mycobacterium
LGEDRDYILELLLAGTTAGLPYEDCVG

SEQ ID NO: 833009 - protein, 22 aa, Mycobacterium
LGEEGKNLAMLLLRLGRGRLGH

SEQ ID NO: 833010 - protein, 28 aa, Mycobacterium
LGEEGMGFIYLMQNLPQERISIAIMAAA

SEQ ID NO: 833011 - protein, 24 aa, Mycobacterium
LGEELLEPTLIYAKDCLALAAETH

SEQ ID NO: 833012 - protein, 25 aa, Mycobacterium
LGEELLEPTLIYAKDCLALAAETQV

SEQ ID NO: 833013 - protein, 18 aa, Mycobacterium
LGEELLGPTLIAYGTPEQ

SEQ ID NO: 833014 - protein, 19 aa, Mycobacterium
LGEELLGPTLIAYGTPEQQ

SEQ ID NO: 833015 - protein, 31 aa, Mycobacterium
LGEETGQPPWLQWYAGRPLLVTANDYGLRVY

SEQ ID NO: 833016 - protein, 18 aa, Mycobacterium
LGEFAPLHPLGRVGTPTD

SEQ ID NO: 833017 - protein, 24 aa, Mycobacterium
LGEFDALWRHGASPVFRELLDSQT

SEQ ID NO: 833018 - protein, 23 aa, Mycobacterium
LGEFVSWLRLPPAGRAGAVVLLP

SEQ ID NO: 833019 - protein, 24 aa, Mycobacterium
LGEGEYLIIPAERHNLAALEDSVV

SEQ ID NO: 833020 - protein, 17 aa, Mycobacterium
LGEGFARRYAVDGYDLV

SEQ ID NO: 833021 - protein, 20 aa, Mycobacterium
LGEGFGIWQLGDDDAMLGIV

SEQ ID NO: 833022 - protein, 20 aa, Mycobacterium
LGEGFGVWRLGDDDAMLRIV

SEQ ID NO: 833023 - protein, 18 aa, Mycobacterium
LGEGYFINQLITWTTEEG

SEQ ID NO: 833024 - protein, 17 aa, Mycobacterium
LGEIFAAAGAQWRQAGC

SEQ ID NO: 833025 - protein, 27 aa, Mycobacterium
LGEIHATWRINELLNWQVAAAGEDINV

SEQ ID NO: 833026 - protein, 27 aa, Mycobacterium
LGEIHATWRINELLNWQVAAAGENINV

SEQ ID NO: 833027 - protein, 24 aa, Mycobacterium
LGEIPRWGTPFAEQLALWEQAVNQ

SEQ ID NO: 833028 - protein, 17 aa, Mycobacterium
LGEKFDAVLLVSNLINY

SEQ ID NO: 833029 - protein, 26 aa, Mycobacterium
LGELDAMLLLIALANSVRPALLVVGG

SEQ ID NO: 833030 - protein, 24 aa, Mycobacterium
LGELDAWYTERGLPTLLCLPDRLI

SEQ ID NO: 833031 - protein, 18 aa, Mycobacterium
LGELLERKELIVAPGVYD

SEQ ID NO: 833032 - protein, 25 aa, Mycobacterium
LGELPAGSLVGTSSPRRAAQLRALG

SEQ ID NO: 833033 - protein, 18 aa, Mycobacterium
LGELPAGSVIGTSSPRRA

SEQ ID NO: 833034 - protein, 18 aa, Mycobacterium
LGELPTGSVIGTSSPRRA

SEQ ID NO: 833035 - protein, 20 aa, Mycobacterium
LGELPVGSLVGTSSPRRAAQ

SEQ ID NO: 833036 - protein, 25 aa, Mycobacterium
LGELSQPQFPMTAWMFAAAAEEYMR

SEQ ID NO: 833037 - protein, 25 aa, Mycobacterium
LGEPRVVIGPLYETKTRTYCATEDP

SEQ ID NO: 833038 - protein, 26 aa, Mycobacterium
LGEPSRLRMVELLRTGPLSVGEIAEK

SEQ ID NO: 833039 - protein, 28 aa, Mycobacterium
LGEQSTLYLPVFAEGALFYVGDPHMAMG

SEQ ID NO: 833040 - protein, 23 aa, Mycobacterium
LGERFLLMIDKIRYPAGGASAET

SEQ ID NO: 833041 - protein, 21 aa, Mycobacterium
LGERLPAYMVPTAIVVLEALP

SEQ ID NO: 833042 - protein, 25 aa, Mycobacterium
LGERLPAYMVPVAVVVLDALPLTVN

SEQ ID NO: 833043 - protein, 23 aa, Mycobacterium
LGERWTILILREALLGTRRFADF

SEQ ID NO: 833044 - protein, 17 aa, Mycobacterium
LGERWTLLILRELVGGP

SEQ ID NO: 833045 - protein, 27 aa, Mycobacterium
LGESLSVELPLAKLALERLAAGLGVPH

SEQ ID NO: 833046 - protein, 27 aa, Mycobacterium
LGESQRLMNYVWYRNVPAGPELTEMLI

SEQ ID NO: 833047 - protein, 23 aa, Mycobacterium
LGETGLLTLPHPEQWGGGGQPYE

SEQ ID NO: 833048 - protein, 19 aa, Mycobacterium
LGETLYLHGSTGSGPLLAA

SEQ ID NO: 833049 - protein, 26 aa, Mycobacterium
LGEVADKLWYPLWDANIRLDHSVRTV

SEQ ID NO: 833050 - protein, 26 aa, Mycobacterium
LGEVEFAFFVILLAVAGNETTRNAMT

SEQ ID NO: 833051 - protein, 19 aa, Mycobacterium
LGEVPARAWEHGRFGAPYL

SEQ ID NO: 833052 - protein, 24 aa, Mycobacterium
LGEVTKFLVYNARKRQVGGDTADQ

SEQ ID NO: 833053 - protein, 26 aa, Mycobacterium
LGEYPGDFWVYARNKIMVAARIAGID

SEQ ID NO: 833054 - protein, 31 aa, Mycobacterium
LGEYQTFGFAGFFAVAIRFTGLLGGTPNDLC

SEQ ID NO: 833055 - protein, 21 aa, Mycobacterium
LGEYWGGLIDIDHADAPSSTA

SEQ ID NO: 833056 - protein, 28 aa, Mycobacterium
LGFDEVFARMWEFYLAYSEAGFRSGYLD

SEQ ID NO: 833057 - protein, 17 aa, Mycobacterium
LGFDRPSGFLDIWRDYT

SEQ ID NO: 833058 - protein, 24 aa, Mycobacterium
LGFDVDTPWRKLPAKARKAILEGA

SEQ ID NO: 833059 - protein, 24 aa, Mycobacterium
LGFDVDTPWRKLPAKARKAILEGC

SEQ ID NO: 833060 - protein, 24 aa, Mycobacterium
LGFDVDTPWRKLPAKARKAILEGS

SEQ ID NO: 833061 - protein, 22 aa, Mycobacterium
LGFERLLPVAPPPQEALPRWRR

SEQ ID NO: 833062 - protein, 25 aa, Mycobacterium
LGFGLLNKVVLRFDEPFWTEEFDAD

SEQ ID NO: 833063 - protein, 20 aa, Mycobacterium
LGFGQLALLLPTCPRDESLR

SEQ ID NO: 833064 - protein, 18 aa, Mycobacterium
LGFHYDTGLYLRFRATGP

SEQ ID NO: 833065 - protein, 24 aa, Mycobacterium
LGFKQPYIALMPQWDFLDFLAEKA

SEQ ID NO: 833066 - protein, 28 aa, Mycobacterium
LGFLHDGELYVCGRIKDLLILAGRNIYP

SEQ ID NO: 833067 - protein, 20 aa, Mycobacterium
LGFLLYRAAAVLRPEVSTAL

SEQ ID NO: 833068 - protein, 18 aa, Mycobacterium
LGFLPGVKRLLDRTPKHC

SEQ ID NO: 833069 - protein, 17 aa, Mycobacterium
LGFPHNMLELAPGIING

SEQ ID NO: 833070 - protein, 23 aa, Mycobacterium
LGFQPFTLEHAIAAHRAYLHYGK

SEQ ID NO: 833071 - protein, 23 aa, Mycobacterium
LGFRRVPVLAIKRKNAINEPLFS

SEQ ID NO: 833072 - protein, 21 aa, Mycobacterium
LGFRTPCIVISPYSRGPLMVH

SEQ ID NO: 833073 - protein, 18 aa, Mycobacterium
LGFSHFLRWERFAVVTDI

SEQ ID NO: 833074 - protein, 24 aa, Mycobacterium
LGFSTQAFYRWRKAPVSQRDWDDA

SEQ ID NO: 833075 - protein, 17 aa, Mycobacterium
LGFTERPPAKPLIAAVE

SEQ ID NO: 833076 - protein, 25 aa, Mycobacterium
LGFTQSYSYFTWRTAKWELTEFGND

SEQ ID NO: 833077 - protein, 25 aa, Mycobacterium
LGFTQSYTYFTWRTAKWELTEFGEE

SEQ ID NO: 833078 - protein, 32 aa, Mycobacterium
LGFTSIDYVVHYLACIRLGAVFVPLQTSSTAA

SEQ ID NO: 833079 - protein, 23 aa, Mycobacterium
LGGAALAGWAARGTIGGGRSSAT

SEQ ID NO: 833080 - protein, 31 aa, Mycobacterium
LGGAIDAALTVRLLLAPDIDVRFGLGWGAVT

SEQ ID NO: 833081 - protein, 27 aa, Mycobacterium
LGGAVSVDLPLARLAYEGLAAGLGVPH

SEQ ID NO: 833082 - protein, 25 aa, Mycobacterium
LGGDEFCVLLPDATLVAAQIFALDA

SEQ ID NO: 833083 - protein, 18 aa, Mycobacterium
LGGDIDGAWWPRADRITN

SEQ ID NO: 833084 - protein, 19 aa, Mycobacterium
LGGFASYTPALKAADAPKL

SEQ ID NO: 833085 - protein, 21 aa, Mycobacterium
LGGFAWQIALRLPGASVMRKP

SEQ ID NO: 833086 - protein, 17 aa, Mycobacterium
LGGFIRLLADLPEDVSD

SEQ ID NO: 833087 - protein, 19 aa, Mycobacterium
LGGFLPERPTKAKTLTLPG

SEQ ID NO: 833088 - protein, 23 aa, Mycobacterium
LGGFSTIWLARGAGPRGRVVTLE

SEQ ID NO: 833089 - protein, 25 aa, Mycobacterium
LGGGAYFIHFAWDSSDPDQLSETES

SEQ ID NO: 833090 - protein, 22 aa, Mycobacterium
LGGGCELAMMCDILIAADTAKF

SEQ ID NO: 833091 - protein, 30 aa, Mycobacterium
LGGGFELILACTFPVLSTKASMGLPESGLG

SEQ ID NO: 833092 - protein, 17 aa, Mycobacterium
LGGGGLGGAGGASTSAT

SEQ ID NO: 833093 - protein, 21 aa, Mycobacterium
LGGHRLMQKLIGAPPRDVSGD

SEQ ID NO: 833094 - protein, 18 aa, Mycobacterium
LGGINFAIANFNPLAAAQ

SEQ ID NO: 833095 - protein, 30 aa, Mycobacterium
LGGKHLLQSWIPLLALAAGYPDRDWLAVCI

SEQ ID NO: 833096 - protein, 26 aa, Mycobacterium
LGGKPIDGPGWFYPPTVVTDITKDMA

SEQ ID NO: 833097 - protein, 31 aa, Mycobacterium
LGGLAASVPAAIRLLGALRYDVVLLETVGVG

SEQ ID NO: 833098 - protein, 25 aa, Mycobacterium
LGGLAMKWRWRAKVGKGWEGRRPNL

SEQ ID NO: 833099 - protein, 25 aa, Mycobacterium
LGGLGYRGFFELGDARRPIAEFDVA

SEQ ID NO: 833100 - protein, 25 aa, Mycobacterium
LGGLIILATHLLASPDLWAAVVLVD

SEQ ID NO: 833101 - protein, 17 aa, Mycobacterium
LGGLLPPRGGTLQGTDA

SEQ ID NO: 833102 - protein, 24 aa, Mycobacterium
LGGLSIALLAYQLSLQGKRAPVID

SEQ ID NO: 833103 - protein, 24 aa, Mycobacterium
LGGLSIALLAYRLSLKGEPAPVID

SEQ ID NO: 833104 - protein, 17 aa, Mycobacterium
LGGLTAGIPGRGVTAVF

SEQ ID NO: 833105 - protein, 26 aa, Mycobacterium
LGGLTLPMLRSWLAAHAAAGTARSTL

SEQ ID NO: 833106 - protein, 18 aa, Mycobacterium
LGGMGIPGLGRKSATRKS

SEQ ID NO: 833107 - protein, 28 aa, Mycobacterium
LGGMPMPKALVWALHEHFLGANPAVWMY

SEQ ID NO: 833108 - protein, 28 aa, Mycobacterium
LGGMPMPRALVWALHEHLLGANPAVWMY

SEQ ID NO: 833109 - protein, 21 aa, Mycobacterium
LGGPAALRRTPLQAAAGTAVK

SEQ ID NO: 833110 - protein, 24 aa, Mycobacterium
LGGPALFGPIGMIVAAALRGDIDQ

SEQ ID NO: 833111 - protein, 25 aa, Mycobacterium
LGGPALFGPIGMIVAAALRGDIDTS

SEQ ID NO: 833112 - protein, 17 aa, Mycobacterium
LGGPEFLGGPAAGELLQ

SEQ ID NO: 833113 - protein, 20 aa, Mycobacterium
LGGPFPPLPFTPEGDDISAQ

SEQ ID NO: 833114 - protein, 25 aa, Mycobacterium
LGGPGRRTLFLLSSTDAYPKRLIGT

SEQ ID NO: 833115 - protein, 22 aa, Mycobacterium
LGGPILPASAYLMKSPPKQLAD

SEQ ID NO: 833116 - protein, 17 aa, Mycobacterium
LGGPRLKDVAGLSLTKL

SEQ ID NO: 833117 - protein, 22 aa, Mycobacterium
LGGPVLIVLEDVDLWCRDRRAG

SEQ ID NO: 833118 - protein, 28 aa, Mycobacterium
LGGQAARVVGKLRETLPGSPSLTQGVSV

SEQ ID NO: 833119 - protein, 25 aa, Mycobacterium
LGGQLRLVPPTRPEIARLLDFYEHQ

SEQ ID NO: 833120 - protein, 26 aa, Mycobacterium
LGGQVAAFHQQFLEGLRGASGAYAAA

SEQ ID NO: 833121 - protein, 24 aa, Mycobacterium
LGGRFRVLAPDLLGFGQSAKVVDF

SEQ ID NO: 833122 - protein, 24 aa, Mycobacterium
LGGRGIPLTQLFAFAAELADADPS

SEQ ID NO: 833123 - protein, 25 aa, Mycobacterium
LGGRILTGCDIRVPRFATVDLSGQR

SEQ ID NO: 833124 - protein, 18 aa, Mycobacterium
LGGRMDWARAFAAWSPHE

SEQ ID NO: 833125 - protein, 18 aa, Mycobacterium
LGGRMDWARAFASWSPHE

SEQ ID NO: 833126 - protein, 19 aa, Mycobacterium
LGGSAGMWGAGGAGGAAGT

SEQ ID NO: 833127 - protein, 21 aa, Mycobacterium
LGGSIFPAMQNFLLAARAQGL

SEQ ID NO: 833128 - protein, 25 aa, Mycobacterium
LGGSWLLPKIVGLQQAKRLALLADT

SEQ ID NO: 833129 - protein, 23 aa, Mycobacterium
LGGTCLHRGCIPTKALLHTAELA

SEQ ID NO: 833130 - protein, 22 aa, Mycobacterium
LGGTDHDKLFTRDGWMRMGDIC

SEQ ID NO: 833131 - protein, 26 aa, Mycobacterium
LGGVAPGLLTLLPEQLAEAIGASPVT

SEQ ID NO: 833132 - protein, 26 aa, Mycobacterium
LGGVSFWASLFPAVWSFCLALRSRGL

SEQ ID NO: 833133 - protein, 27 aa, Mycobacterium
LGGVSFWASLFPAVWSFCLALRSRGLG

SEQ ID NO: 833134 - protein, 18 aa, Mycobacterium
LGGVYPEIFLPLHGEHQA

SEQ ID NO: 833135 - protein, 17 aa, Mycobacterium
LGGVYTDIFLPLHGEHQ

SEQ ID NO: 833136 - protein, 18 aa, Mycobacterium
LGGWEISYLGPTTYLVNI

SEQ ID NO: 833137 - protein, 19 aa, Mycobacterium
LGGWFRLGLIANERKAWVH

SEQ ID NO: 833138 - protein, 30 aa, Mycobacterium
LGGYGIGLVTFFEFLMRLATVDPNVAHALR

SEQ ID NO: 833139 - protein, 32 aa, Mycobacterium
LGGYLHKDIGPAWAFLGWARPGSDWERRFSAA

SEQ ID NO: 833140 - protein, 31 aa, Mycobacterium
LGHDALLAPLTFISVFGYQAQWAMFAANNIG

SEQ ID NO: 833141 - protein, 19 aa, Mycobacterium
LGHDGLVASLTFPAVMALL

SEQ ID NO: 833142 - protein, 25 aa, Mycobacterium
LGHERAMLWLDYADMLHALTVESRP

SEQ ID NO: 833143 - protein, 26 aa, Mycobacterium
LGHERTLMWMAFANRLEQLLEDYRPA

SEQ ID NO: 833144 - protein, 26 aa, Mycobacterium
LGHERVMLWLGYANLLGELTIDFTPS

SEQ ID NO: 833145 - protein, 25 aa, Mycobacterium
LGHEWDFVVIAGLQDGLWPNTVPRG

SEQ ID NO: 833146 - protein, 28 aa, Mycobacterium
LGHEWDLVVIAGLQEGLWPNTIPRGGVL

SEQ ID NO: 833147 - protein, 25 aa, Mycobacterium
LGHEWDLVVIAGLQEGLWPNTVPRG

SEQ ID NO: 833148 - protein, 27 aa, Mycobacterium
LGHFALTGLLLDRLLPVRGSRVVTVSS

SEQ ID NO: 833149 - protein, 24 aa, Mycobacterium
LGHFALTGLLLENLTAVPDSRVVI

SEQ ID NO: 833150 - protein, 20 aa, Mycobacterium
LGHFALTNLLLPKISDRVVT

SEQ ID NO: 833151 - protein, 20 aa, Mycobacterium
LGHFALTNLLLPKLSDRVVT

SEQ ID NO: 833152 - protein, 19 aa, Mycobacterium
LGHFALTNLLLPRLTDRVV

SEQ ID NO: 833153 - protein, 17 aa, Mycobacterium
LGHFDKNGYFFVLDRTN

SEQ ID NO: 833154 - protein, 21 aa, Mycobacterium
LGHFLYHWHDPRPSQRVVKIA

SEQ ID NO: 833155 - protein, 23 aa, Mycobacterium
LGHFVLTDALLPSLLAADAPRVI

SEQ ID NO: 833156 - protein, 23 aa, Mycobacterium
LGHGYFVSSFLSPLFNRRGDEYG

SEQ ID NO: 833157 - protein, 19 aa, Mycobacterium
LGHLANRLAILARDMTVPP

SEQ ID NO: 833158 - protein, 19 aa, Mycobacterium
LGHLANRLAVLARDITVPP

SEQ ID NO: 833159 - protein, 17 aa, Mycobacterium
LGHLIEMLRGGPDYLMF

SEQ ID NO: 833160 - protein, 23 aa, Mycobacterium
LGHLPDFAALRRPHARKLDLPTY

SEQ ID NO: 833161 - protein, 17 aa, Mycobacterium
LGHLVRPKRRSALRLRE

SEQ ID NO: 833162 - protein, 21 aa, Mycobacterium
LGHNYLASSFLSPLINRRADE

SEQ ID NO: 833163 - protein, 18 aa, Mycobacterium
LGHPLLWCTSGIAEFWAL

SEQ ID NO: 833164 - protein, 25 aa, Mycobacterium
LGHRDIGLLTMRLGHDRRQGLVDAE

SEQ ID NO: 833165 - protein, 26 aa, Mycobacterium
LGHREIGLLTMRLGRDRRHGLVDAER

SEQ ID NO: 833166 - protein, 19 aa, Mycobacterium
LGHRSIYHDGWRAVCPWPG

SEQ ID NO: 833167 - protein, 19 aa, Mycobacterium
LGHSMGCAVIWSYLELFGT

SEQ ID NO: 833168 - protein, 17 aa, Mycobacterium
LGHSYYDDWEDQEMFVK

SEQ ID NO: 833169 - protein, 22 aa, Mycobacterium
LGHTQWAVAPYIEPPLAAMCPA

SEQ ID NO: 833170 - protein, 27 aa, Mycobacterium
LGHYALTGLLLERLLPVEGSRVVTVSS

SEQ ID NO: 833171 - protein, 22 aa, Mycobacterium
LGIAAMPLSAGQHRIWFAHGVT

SEQ ID NO: 833172 - protein, 19 aa, Mycobacterium
LGIAELPVIPRQRVLVIST

SEQ ID NO: 833173 - protein, 18 aa, Mycobacterium
LGIALFGLGNARRALVES

SEQ ID NO: 833174 - protein, 21 aa, Mycobacterium
LGIDFALMFPTLASLVEERMK

SEQ ID NO: 833175 - protein, 19 aa, Mycobacterium
LGIDYEIVPGVPAFAAAAA

SEQ ID NO: 833176 - protein, 20 aa, Mycobacterium
LGIELLTLDELLARADFISV

SEQ ID NO: 833177 - protein, 19 aa, Mycobacterium
LGIEPPVYVIGTEVPVPGG

SEQ ID NO: 833178 - protein, 24 aa, Mycobacterium
LGIGPPITDGFYYDFEVLEPFTPD

SEQ ID NO: 833179 - protein, 18 aa, Mycobacterium
LGIHPVTLSKWVKQDDID

SEQ ID NO: 833180 - protein, 27 aa, Mycobacterium
LGIIARRLRKDIYDLYGYNAVVHVLSA

SEQ ID NO: 833181 - protein, 19 aa, Mycobacterium
LGIIPLLQVDMWEHAFYLQ

SEQ ID NO: 833182 - protein, 17 aa, Mycobacterium
LGIIPRQGYLQIPQFIR

SEQ ID NO: 833183 - protein, 19 aa, Mycobacterium
LGILPHPEEVCFFDSRTGT

SEQ ID NO: 833184 - protein, 28 aa, Mycobacterium
LGIPTIATVPWTTDRLLNALLRETETAK

SEQ ID NO: 833185 - protein, 18 aa, Mycobacterium
LGIPTRRTLAREAVGVVG

SEQ ID NO: 833186 - protein, 26 aa, Mycobacterium
LGITGRVLPMCPIPLQIEADVSGLES

SEQ ID NO: 833187 - protein, 28 aa, Mycobacterium
LGITVPDFPNLFLIYGPGTHLAHGGSLI

SEQ ID NO: 833188 - protein, 25 aa, Mycobacterium
LGITVPMFPNLFLLYGPNTNVGSGS

SEQ ID NO: 833189 - protein, 22 aa, Mycobacterium
LGIVDLLPDKLYLQGSTGPLNA

SEQ ID NO: 833190 - protein, 18 aa, Mycobacterium
LGIWQWASTATGEPDVVL

SEQ ID NO: 833191 - protein, 29 aa, Mycobacterium
LGIWRGEPFPALDTPWINSLRSTLLGERL

SEQ ID NO: 833192 - protein, 25 aa, Mycobacterium
LGKHPPQSLLTWKLSGPTTVNAIIT

SEQ ID NO: 833193 - protein, 17 aa, Mycobacterium
LGKLLTKRARVIGTTLR

SEQ ID NO: 833194 - protein, 20 aa, Mycobacterium
LGKPAALLRAARASLGRKVR

SEQ ID NO: 833195 - protein, 26 aa, Mycobacterium
LGKPQWDLIGIKYYTGGENLKIDIEN

SEQ ID NO: 833196 - protein, 18 aa, Mycobacterium
LGKPVRQPTKLRRRRVAE

SEQ ID NO: 833197 - protein, 28 aa, Mycobacterium
LGKSEFDLANLFLPGGPISKAASKGRDL

SEQ ID NO: 833198 - protein, 24 aa, Mycobacterium
LGKTFYLLDTFAGLDPRFVSAGER

SEQ ID NO: 833199 - protein, 20 aa, Mycobacterium
LGKTRLFGQFSERISRRISA

SEQ ID NO: 833200 - protein, 23 aa, Mycobacterium
LGKVERLLPRVRATYARKVRYDK

SEQ ID NO: 833201 - protein, 18 aa, Mycobacterium
LGKWWRETRFQAYQGVSI

SEQ ID NO: 833202 - protein, 23 aa, Mycobacterium
LGKYDIGIAIGLDKHPRGAFTDD

SEQ ID NO: 833203 - protein, 17 aa, Mycobacterium
LGLAKRLEDAGVPIVGT

SEQ ID NO: 833204 - protein, 22 aa, Mycobacterium
LGLDCVPVVNLRRMDLGPGVAA

SEQ ID NO: 833205 - protein, 17 aa, Mycobacterium
LGLDLAWRIVVEKHNGD

SEQ ID NO: 833206 - protein, 28 aa, Mycobacterium
LGLDYVDLYLIHWPVSQQGKHVDSWGGL

SEQ ID NO: 833207 - protein, 29 aa, Mycobacterium
LGLEIRCWTGRLNSLFGNVFPITPIADGD

SEQ ID NO: 833208 - protein, 18 aa, Mycobacterium
LGLFTQRFRIWGSSDFRR

SEQ ID NO: 833209 - protein, 19 aa, Mycobacterium
LGLFVQRFRLWGSSDLRRW

SEQ ID NO: 833210 - protein, 19 aa, Mycobacterium
LGLGAAWYEREHTALGIPY

SEQ ID NO: 833211 - protein, 19 aa, Mycobacterium
LGLGERFARLPFSKLRRGT

SEQ ID NO: 833212 - protein, 18 aa, Mycobacterium
LGLGFSVLAALVGLSRVA

SEQ ID NO: 833213 - protein, 26 aa, Mycobacterium
LGLGHRQIGLLTMRLGRDRRQDLVDA

SEQ ID NO: 833214 - protein, 17 aa, Mycobacterium
LGLGLITADVLSPSQGI

SEQ ID NO: 833215 - protein, 28 aa, Mycobacterium
LGLGVDGFPNLFLISGPGAPAVLANMVL

SEQ ID NO: 833216 - protein, 26 aa, Mycobacterium
LGLGVDGFPNLFLVSGPGAPAVLANM

SEQ ID NO: 833217 - protein, 27 aa, Mycobacterium
LGLGVDGFPNLFLVSGPGAPAVLANMV

SEQ ID NO: 833218 - protein, 24 aa, Mycobacterium
LGLGVRTWVDGDDPYRLVSAALGG

SEQ ID NO: 833219 - protein, 17 aa, Mycobacterium
LGLHLGFASSRPDREEN

SEQ ID NO: 833220 - protein, 18 aa, Mycobacterium
LGLHMTFEDARFARFIMT

SEQ ID NO: 833221 - protein, 30 aa, Mycobacterium
LGLIDPDAWAFTWVVDAPLFEPADDATAAG

SEQ ID NO: 833222 - protein, 21 aa, Mycobacterium
LGLIGTMRRAGLIAPMRPDRY

SEQ ID NO: 833223 - protein, 22 aa, Mycobacterium
LGLIRAMEKFDYAKGFKFSTYA

SEQ ID NO: 833224 - protein, 21 aa, Mycobacterium
LGLITTLARSGLIAPMRPDRY

SEQ ID NO: 833225 - protein, 22 aa, Mycobacterium
LGLITTMGRAGLIAPMRPDRYL

SEQ ID NO: 833226 - protein, 26 aa, Mycobacterium
LGLKIPSVLLPLWDSELSTGLVSTLR

SEQ ID NO: 833227 - protein, 30 aa, Mycobacterium
LGLKRTMSLMRFISFIRKEIYPGGRLPMIS

SEQ ID NO: 833228 - protein, 29 aa, Mycobacterium
LGLLDGAGGLLLWPLLTSLSAAKEHLLLG

SEQ ID NO: 833229 - protein, 20 aa, Mycobacterium
LGLLELRGFEMPPHLRMAMV

SEQ ID NO: 833230 - protein, 21 aa, Mycobacterium
LGLLELRGFEMPPHLRMAMVQ

SEQ ID NO: 833231 - protein, 18 aa, Mycobacterium
LGLLPRLAELLDGRGDAV

SEQ ID NO: 833232 - protein, 20 aa, Mycobacterium
LGLLQVWQALTESVSRRPAN

SEQ ID NO: 833233 - protein, 22 aa, Mycobacterium
LGLMNAVNRFDPAKGPSFIGFA

SEQ ID NO: 833234 - protein, 29 aa, Mycobacterium
LGLPEEIVARQPFPGPGLGIRIIGEVTSD

SEQ ID NO: 833235 - protein, 29 aa, Mycobacterium
LGLPEEIVARQPFPGPGLGIRIVGEVTAA

SEQ ID NO: 833236 - protein, 29 aa, Mycobacterium
LGLPEEIVARQPFPGPGLGIRIVGEVTAQ

SEQ ID NO: 833237 - protein, 31 aa, Mycobacterium
LGLPEEIVGRQPFPGPGLAIRIVGEVTPDRL

SEQ ID NO: 833238 - protein, 33 aa, Mycobacterium
LGLPFTDVFLAEEWRHVVLARRIGTAAAYLSAK

SEQ ID NO: 833239 - protein, 24 aa, Mycobacterium
LGLPPSALRVIALRALDTTGRHSA

SEQ ID NO: 833240 - protein, 25 aa, Mycobacterium
LGLPRGALRVIALRAFVGADRDAAL

SEQ ID NO: 833241 - protein, 25 aa, Mycobacterium
LGLQDAMNLGWKLAAVLDGRVGPEL

SEQ ID NO: 833242 - protein, 19 aa, Mycobacterium
LGLRIVMRLAVEGPNAQLH

SEQ ID NO: 833243 - protein, 19 aa, Mycobacterium
LGLRPPPPQRFPLSEAQAA

SEQ ID NO: 833244 - protein, 23 aa, Mycobacterium
LGLRPTLAALKSGARLALANKES

SEQ ID NO: 833245 - protein, 18 aa, Mycobacterium
LGLRYTMNVIALNGAAVG

SEQ ID NO: 833246 - protein, 24 aa, Mycobacterium
LGLSTRGYTRLGAPLRHLTGRLLA

SEQ ID NO: 833247 - protein, 24 aa, Mycobacterium
LGLSTRGYTRLGAPLRHLTSRLLA

SEQ ID NO: 833248 - protein, 27 aa, Mycobacterium
LGLSVADYRLAMAELFAPFSKVAAKNP

SEQ ID NO: 833249 - protein, 28 aa, Mycobacterium
LGLSVDGFPNLFLISGPGAPAVLANMVL

SEQ ID NO: 833250 - protein, 20 aa, Mycobacterium
LGLSYLLPRAIGSSRAFEIM

SEQ ID NO: 833251 - protein, 21 aa, Mycobacterium
LGLSYLLPRAIGSSRAFEIML

SEQ ID NO: 833252 - protein, 17 aa, Mycobacterium
LGLTERVLTTLTAVGFG

SEQ ID NO: 833253 - protein, 17 aa, Mycobacterium
LGLTGKVVLVTGGVRGV

SEQ ID NO: 833254 - protein, 20 aa, Mycobacterium
LGLTKWLLHSANGLDLDRHL

SEQ ID NO: 833255 - protein, 17 aa, Mycobacterium
LGLTRRGRVSAGGATRL

SEQ ID NO: 833256 - protein, 18 aa, Mycobacterium
LGLTSYLEPGPTASGLSV

SEQ ID NO: 833257 - protein, 26 aa, Mycobacterium
LGLTTNVEFLRFLLADPDVAAGDLDT

SEQ ID NO: 833258 - protein, 20 aa, Mycobacterium
LGLVATLVPPALKSRNLDHA

SEQ ID NO: 833259 - protein, 23 aa, Mycobacterium
LGLVIYAGVYREDFMAEPAIAAL

SEQ ID NO: 833260 - protein, 22 aa, Mycobacterium
LGLVNIAIWADPARGLAAGVVS

SEQ ID NO: 833261 - protein, 17 aa, Mycobacterium
LGLVTRPEQRFVLLGGD

SEQ ID NO: 833262 - protein, 18 aa, Mycobacterium
LGLVVDLATRRSIFIPML

SEQ ID NO: 833263 - protein, 20 aa, Mycobacterium
LGLWQALSRRDWEAVKTFLS

SEQ ID NO: 833264 - protein, 33 aa, Mycobacterium
LGLWVTNPVPGLLRWLPRLWPSWRIEFWEDRYE

SEQ ID NO: 833265 - protein, 27 aa, Mycobacterium
LGMANLDWLVVRDLVMIESATFWKEAP

SEQ ID NO: 833266 - protein, 25 aa, Mycobacterium
LGMATVKWELEDLAFAILHPKKYEE

SEQ ID NO: 833267 - protein, 21 aa, Mycobacterium
LGMATVKWELEDLSFAILHPK

SEQ ID NO: 833268 - protein, 27 aa, Mycobacterium
LGMAVRILERFPSRLALPKAHVVGPVT

SEQ ID NO: 833269 - protein, 17 aa, Mycobacterium
LGMCPQGCISAGGATHL

SEQ ID NO: 833270 - protein, 19 aa, Mycobacterium
LGMDRFGIDLILPFEDRVS

SEQ ID NO: 833271 - protein, 19 aa, Mycobacterium
LGMDRFGLDVISPFEERVR

SEQ ID NO: 833272 - protein, 30 aa, Mycobacterium
LGMDSVLMPIGPRRALWARLGDSLRPRHLD

SEQ ID NO: 833273 - protein, 20 aa, Mycobacterium
LGMKTWPQIPRNIEWKHGIC

SEQ ID NO: 833274 - protein, 17 aa, Mycobacterium
LGMLNMVAVWYRTDGKS

SEQ ID NO: 833275 - protein, 30 aa, Mycobacterium
LGMLRHMWRFWYQVPMSLPVIGPRLIADPK

SEQ ID NO: 833276 - protein, 27 aa, Mycobacterium
LGMPAPPPPVLAPRRKTRQLMVGDVGV

SEQ ID NO: 833277 - protein, 23 aa, Mycobacterium
LGMQACAPLMKRSGNGSIINIGS

SEQ ID NO: 833278 - protein, 24 aa, Mycobacterium
LGMRPPAERFALAAAGPDPAVVDP

SEQ ID NO: 833279 - protein, 25 aa, Mycobacterium
LGMTAGNIFHDALRWPFVDDDEPLD

SEQ ID NO: 833280 - protein, 31 aa, Mycobacterium
LGMVRCVRAALPLLRKAQWARIVNFSAHSTQ

SEQ ID NO: 833281 - protein, 31 aa, Mycobacterium
LGMVRDIWRFWYQIPIMLPVIGPRVIADPKA

SEQ ID NO: 833282 - protein, 19 aa, Mycobacterium
LGNDLLLADAGRIALDAPQ

SEQ ID NO: 833283 - protein, 20 aa, Mycobacterium
LGNKLLIFQVYDHQSNFPLG

SEQ ID NO: 833284 - protein, 25 aa, Mycobacterium
LGNLGTVLRVLYLVFNEGYTGDVDL

SEQ ID NO: 833285 - protein, 17 aa, Mycobacterium
LGNQLDMLMGALGPMLS

SEQ ID NO: 833286 - protein, 18 aa, Mycobacterium
LGNRYGAAVLGPYGSKRQ

SEQ ID NO: 833287 - protein, 21 aa, Mycobacterium
LGNVRPLIPLQIDPPEHAKYR

SEQ ID NO: 833288 - protein, 25 aa, Mycobacterium
LGNVVRRALLPRVRFVPGLRDKISD

SEQ ID NO: 833289 - protein, 17 aa, Mycobacterium
LGNWTGIPVFKLTEEET

SEQ ID NO: 833290 - protein, 18 aa, Mycobacterium
LGPAGLPWGPTGSTGFTL

SEQ ID NO: 833291 - protein, 23 aa, Mycobacterium
LGPDFLVEVLEIRAALGPLIGRL

SEQ ID NO: 833292 - protein, 17 aa, Mycobacterium
LGPDFRSKMGLPVINVP

SEQ ID NO: 833293 - protein, 22 aa, Mycobacterium
LGPDGKHLAMLLLRLGRGRLGH

SEQ ID NO: 833294 - protein, 34 aa, Mycobacterium
LGPESLWRNEFAARLMLRFAFERPGRKAATLQMP

SEQ ID NO: 833295 - protein, 26 aa, Mycobacterium
LGPGSYHCGLTFQFAHGPYASSAAHS

SEQ ID NO: 833296 - protein, 40 aa, Mycobacterium
LGPHKIRLNMVVPTWMYGPPIQLYIGLVAQQRGITQEEVL

SEQ ID NO: 833297 - protein, 27 aa, Mycobacterium
LGPIAQLVKVRPGYEAALAAVLGAAAD

SEQ ID NO: 833298 - protein, 21 aa, Mycobacterium
LGPIRPPQRLAPHSYALGAEV

SEQ ID NO: 833299 - protein, 23 aa, Mycobacterium
LGPIRPPQRLAPHSYALGAEVKH

SEQ ID NO: 833300 - protein, 20 aa, Mycobacterium
LGPLARLANRLGGNFRWQHL

SEQ ID NO: 833301 - protein, 18 aa, Mycobacterium
LGPLILRKVIASILAVDP

SEQ ID NO: 833302 - protein, 18 aa, Mycobacterium
LGPLLTDAERRYLGCDAT

SEQ ID NO: 833303 - protein, 18 aa, Mycobacterium
LGPLPLAMDSDHARRVAD

SEQ ID NO: 833304 - protein, 17 aa, Mycobacterium
LGPLPPLRMEPDAEPIL

SEQ ID NO: 833305 - protein, 17 aa, Mycobacterium
LGPLRRCRALGTAVGTF

SEQ ID NO: 833306 - protein, 17 aa, Mycobacterium
LGPLRRCRALGTVVGNF

SEQ ID NO: 833307 - protein, 23 aa, Mycobacterium
LGPMIQHMLFMQLRHMMETEAVN

SEQ ID NO: 833308 - protein, 26 aa, Mycobacterium
LGPNKPWVFETWLADPNQWSMVVVGL

SEQ ID NO: 833309 - protein, 27 aa, Mycobacterium
LGPNRPIELRLLEIEPALKALEGVVME

SEQ ID NO: 833310 - protein, 24 aa, Mycobacterium
LGPQRNWWISGLAATPEIASRRGA

SEQ ID NO: 833311 - protein, 22 aa, Mycobacterium
LGPQTLIIDCGADFRLTDAAAW

SEQ ID NO: 833312 - protein, 20 aa, Mycobacterium
LGPRHGLTGEPLPPVLAATA

SEQ ID NO: 833313 - protein, 17 aa, Mycobacterium
LGPRLIATVRSLLSGDG

SEQ ID NO: 833314 - protein, 17 aa, Mycobacterium
LGPRRPGVSLAPGARDV

SEQ ID NO: 833315 - protein, 25 aa, Mycobacterium
LGPRVYQLLYGEPFPDGVQTAENLQ

SEQ ID NO: 833316 - protein, 34 aa, Mycobacterium
LGPSPFRHAPTIRLIRRRLIPAGTWSGQATFRAT

SEQ ID NO: 833317 - protein, 17 aa, Mycobacterium
LGPSWRMAHNPARIARG

SEQ ID NO: 833318 - protein, 23 aa, Mycobacterium
LGPSWVRVNSIRPGLIRTDLVAP

SEQ ID NO: 833319 - protein, 23 aa, Mycobacterium
LGPSWVRVNSIRPGLIRTELVAP

SEQ ID NO: 833320 - protein, 19 aa, Mycobacterium
LGPTGWLPFGGGSRRCLGA

SEQ ID NO: 833321 - protein, 33 aa, Mycobacterium
LGPTLQGRFLEYLPPPLAPTLFRAQSKRADHNR

SEQ ID NO: 833322 - protein, 18 aa, Mycobacterium
LGPTLWHRDFHDAVIVEC

SEQ ID NO: 833323 - protein, 17 aa, Mycobacterium
LGPVHILVTSAGLVDFA

SEQ ID NO: 833324 - protein, 18 aa, Mycobacterium
LGPVIKRWYRAEVRNLGN

SEQ ID NO: 833325 - protein, 17 aa, Mycobacterium
LGPVLADDLARQLNSDS

SEQ ID NO: 833326 - protein, 20 aa, Mycobacterium
LGPVLARRLLLTGDVIEAGA

SEQ ID NO: 833327 - protein, 17 aa, Mycobacterium
LGPVLWSPSGETPDWWD

SEQ ID NO: 833328 - protein, 23 aa, Mycobacterium
LGPYCVPVVNLDDHLEARNLNMV

SEQ ID NO: 833329 - protein, 26 aa, Mycobacterium
LGQALSAAELFASLYVGALTPDDELV

SEQ ID NO: 833330 - protein, 21 aa, Mycobacterium
LGQDRFWRRATRSALTIGPGH

SEQ ID NO: 833331 - protein, 22 aa, Mycobacterium
LGQEGHTLAMLLLRLGRGRLGH

SEQ ID NO: 833332 - protein, 24 aa, Mycobacterium
LGQGSIGLLFSYVAKAAGAAHVTG

SEQ ID NO: 833333 - protein, 17 aa, Mycobacterium
LGQGYRFGRPGALHTVP

SEQ ID NO: 833334 - protein, 21 aa, Mycobacterium
LGQIPQALTGLLSGAGGGSGS

SEQ ID NO: 833335 - protein, 33 aa, Mycobacterium; identical to SEQ ID NO: 690786

SEQ ID NO: 833336 - protein, 18 aa, Mycobacterium
LGQLLDPVINAPTGMLLH

SEQ ID NO: 833337 - protein, 19 aa, Mycobacterium
LGQLPRIYRADGSPIRVLL

SEQ ID NO: 833338 - protein, 18 aa, Mycobacterium
LGQLRLLAGYLAGRAVDV

SEQ ID NO: 833339 - protein, 27 aa, Mycobacterium
LGQPMSMLIPQVLGLKLTGELPAGTTA

SEQ ID NO: 833340 - protein, 27 aa, Mycobacterium
LGQRNPELVQQYAHGLVPFVDDMAGNN

SEQ ID NO: 833341 - protein, 25 aa, Mycobacterium
LGQSMPQRAAALTAPLLVVHGDKDR

SEQ ID NO: 833342 - protein, 18 aa, Mycobacterium
LGQSPPWARYDIDDVRVI

SEQ ID NO: 833343 - protein, 30 aa, Mycobacterium
LGQTSLTILHYIILSYEVDKVLARRLPWGD

SEQ ID NO: 833344 - protein, 21 aa, Mycobacterium
LGQWENTLFIYICGDNGASAE

SEQ ID NO: 833345 - protein, 18 aa, Mycobacterium
LGQYDPFAAAKEGCLLLV

SEQ ID NO: 833346 - protein, 23 aa, Mycobacterium
LGRAEIRAIFRSSKVGIIAGCMI

SEQ ID NO: 833347 - protein, 24 aa, Mycobacterium
LGRAEIRAIFRSSKVGIIAGCMIS

SEQ ID NO: 833348 - protein, 20 aa, Mycobacterium
LGRAPFEAWLADIASTAGEA

SEQ ID NO: 833349 - protein, 24 aa, Mycobacterium
LGRAPLVVRAPRPRARRQPGVGGQ

SEQ ID NO: 833350 - protein, 27 aa, Mycobacterium
LGRDAVPTFLLPANPVGALVVFEVMVR

SEQ ID NO: 833351 - protein, 27 aa, Mycobacterium
LGRDGVPTFLLPANPVSALVVFEVMVR

SEQ ID NO: 833352 - protein, 17 aa, Mycobacterium
LGRDIDGAWWPRSASVA

SEQ ID NO: 833353 - protein, 21 aa, Mycobacterium
LGREYALLLAARGAKVVVNDA

SEQ ID NO: 833354 - protein, 25 aa, Mycobacterium
LGRFSALTREWFTTAFAAPTPAQAD

SEQ ID NO: 833355 - protein, 27 aa, Mycobacterium
LGRGLVPSPLMGTLWAELALLEAGYEG

SEQ ID NO: 833356 - protein, 30 aa, Mycobacterium
LGRGTPLWGGWITGPTWLGPEEFARAGYDY

SEQ ID NO: 833357 - protein, 23 aa, Mycobacterium
LGRGYRLLQLFDGAGLELHDLER

SEQ ID NO: 833358 - protein, 35 aa, Mycobacterium
LGRHIFTAPTYYYKTGIAFLSWLNGLQPGFTMVGG

SEQ ID NO: 833359 - protein, 19 aa, Mycobacterium
LGRHLFGASYSRTGTVENS

SEQ ID NO: 833360 - protein, 25 aa, Mycobacterium
LGRHSDVLGINRLGAALIADFDRMR

SEQ ID NO: 833361 - protein, 28 aa, Mycobacterium
LGRHYAGSNFFWYFKDPANNFAEYHSDM

SEQ ID NO: 833362 - protein, 19 aa, Mycobacterium
LGRIIFMDEFYSLIERHQD

SEQ ID NO: 833363 - protein, 28 aa, Mycobacterium
LGRKDLGEYFLDRYLAHSGDVAPASLRD

SEQ ID NO: 833364 - protein, 30 aa, Mycobacterium
LGRKFLANPDLIDRLLLGAELNEANAATFY

SEQ ID NO: 833365 - protein, 37 aa, Mycobacterium
LGRKVVEILPIPPIALHLRTGIAMLSYARRFSFGITA

SEQ ID NO: 833366 - protein, 17 aa, Mycobacterium
LGRLAPGTPLRDGLERI

SEQ ID NO: 833367 - protein, 24 aa, Mycobacterium
LGRLGRPLRIAHAWSLSFDASWQP

SEQ ID NO: 833368 - protein, 17 aa, Mycobacterium
LGRLLRGRDTPAWQYVR

SEQ ID NO: 833369 - protein, 17 aa, Mycobacterium
LGRLMIYDALEMTYRTI

SEQ ID NO: 833370 - protein, 20 aa, Mycobacterium
LGRLSSLLRDKRVPLELCPS

SEQ ID NO: 833371 - protein, 19 aa, Mycobacterium
LGRLTLVQLELLHAPAATA

SEQ ID NO: 833372 - protein, 27 aa, Mycobacterium
LGRMYRRTVWPLRVAALRGLARDVVTP

SEQ ID NO: 833373 - protein, 24 aa, Mycobacterium
LGRNDEALQWFLRSAAADVEGVTD

SEQ ID NO: 833374 - protein, 17 aa, Mycobacterium
LGRPAFDGASAGRRHVA

SEQ ID NO: 833375 - protein, 24 aa, Mycobacterium
LGRPEEVAAAVLFLASGESSFMTG

SEQ ID NO: 833376 - protein, 25 aa, Mycobacterium
LGRPSSFIWYGPRWAQAATAPSRLH

SEQ ID NO: 833377 - protein, 17 aa, Mycobacterium
LGRPVEWVRVPWVDMIP

SEQ ID NO: 833378 - protein, 20 aa, Mycobacterium
LGRPVMARMFQKFLHNLRDY

SEQ ID NO: 833379 - protein, 27 aa, Mycobacterium
LGRQKFWPERMFSLLAGFVEAGESLEA

SEQ ID NO: 833380 - protein, 27 aa, Mycobacterium
LGRQLDLLLDGRTMLWRALCRVTTVVD

SEQ ID NO: 833381 - protein, 29 aa, Mycobacterium
LGRQRGLHRWVMAEVPSVVHWLPEYIGMG

SEQ ID NO: 833382 - protein, 24 aa, Mycobacterium
LGRQRRIDRQVGRPGLQHGKDGDD

SEQ ID NO: 833383 - protein, 23 aa, Mycobacterium
LGRQWWDMGFMSEALSLLLAGLP

SEQ ID NO: 833384 - protein, 24 aa, Mycobacterium
LGRRIVAWRAARGADWALAADYRA

SEQ ID NO: 833385 - protein, 26 aa, Mycobacterium
LGRRSVPVRIYRGGPSPAPVVVYCHS

SEQ ID NO: 833386 - protein, 24 aa, Mycobacterium
LGRRTTMYLTYWTAGETRNRGQAM

SEQ ID NO: 833387 - protein, 27 aa, Mycobacterium
LGRRTYEFFAARWPFRSGRWADRLNSL

SEQ ID NO: 833388 - protein, 18 aa, Mycobacterium
LGRRVFAMPMTGGGYAEY

SEQ ID NO: 833389 - protein, 24 aa, Mycobacterium
LGRRVTEIALVFKRAPHLPFDSTM

SEQ ID NO: 833390 - protein, 24 aa, Mycobacterium
LGRSHIAWTIVRPPKLTNKPLTGS

SEQ ID NO: 833391 - protein, 20 aa, Mycobacterium
LGRSYAHFLAGNGALVVVND

SEQ ID NO: 833392 - protein, 25 aa, Mycobacterium
LGRTFTSPAFICPVGVLGAVRDRGD

SEQ ID NO: 833393 - protein, 33 aa, Mycobacterium
LGRTGYTFACDYWDVVPDVFLLGKALGGGVVPL

SEQ ID NO: 833394 - protein, 22 aa, Mycobacterium
LGRTKVPWREGFRRMIAARHPE

SEQ ID NO: 833395 - protein, 26 aa, Mycobacterium
LGRTKVPWREGFRRMIAARHPEIALS

SEQ ID NO: 833396 - protein, 17 aa, Mycobacterium
LGRTTVTQPYRAGTTLL

SEQ ID NO: 833397 - protein, 17 aa, Mycobacterium
LGRVGMLARPEPLRDFV

SEQ ID NO: 833398 - protein, 33 aa, Mycobacterium
LGRVTYPIPQGTKRVWYWAAKSTGGDFSPNDEV

SEQ ID NO: 833399 - protein, 23 aa, Mycobacterium
LGRWLHNRPKLPRLINMYGITET

SEQ ID NO: 833400 - protein, 19 aa, Mycobacterium
LGRYGILELPGTELLDVFG

SEQ ID NO: 833401 - protein, 17 aa, Mycobacterium
LGSAGYLERDWRAEADG

SEQ ID NO: 833402 - protein, 23 aa, Mycobacterium
LGSAWRKGAWGSPEKYRRLVDAK

SEQ ID NO: 833403 - protein, 17 aa, Mycobacterium
LGSDPGLARFIDQVARR

SEQ ID NO: 833404 - protein, 33 aa, Mycobacterium
LGSEGQLNITLLFGFSPRFPFPDSYQEFCRAVS

SEQ ID NO: 833405 - protein, 28 aa, Mycobacterium
LGSETEPGLRWPDLSLAGGRVGYAALRD

SEQ ID NO: 833406 - protein, 19 aa, Mycobacterium
LGSFSHRTGRKDQRFSRMY

SEQ ID NO: 833407 - protein, 23 aa, Mycobacterium
LGSGVRWFRRHPWQFVRTSLSGE

SEQ ID NO: 833408 - protein, 18 aa, Mycobacterium
LGSGWRPAADALGPPTAV

SEQ ID NO: 833409 - protein, 24 aa, Mycobacterium
LGSKGIPRFLRISANLPVTGSNKV

SEQ ID NO: 833410 - protein, 18 aa, Mycobacterium
LGSKLTLTAIVQLAGLQP

SEQ ID NO: 833411 - protein, 26 aa, Mycobacterium
LGSKMNRFFLRGALVARLLSEASWKQ

SEQ ID NO: 833412 - protein, 24 aa, Mycobacterium
LGSKMQRFFARNALVARLVSEAAF

SEQ ID NO: 833413 - protein, 27 aa, Mycobacterium
LGSKMSRFFLRNALVARLLSEASWKAN

SEQ ID NO: 833414 - protein, 30 aa, Mycobacterium
LGSLHMFFHRLGPVLARRLLLTGDIIEAGA

SEQ ID NO: 833415 - protein, 30 aa, Mycobacterium
LGSLHMFFHRLGPVLARRLLLTGDIIEAGD

SEQ ID NO: 833416 - protein, 23 aa, Mycobacterium
LGSLTMMMYGAHAALAYMLDQGS

SEQ ID NO: 833417 - protein, 30 aa, Mycobacterium
LGSMATMSQLLYLRVPALNALFPDYRGSVL

SEQ ID NO: 833418 - protein, 20 aa, Mycobacterium
LGSMIYPPYTEKAFKLARKL

SEQ ID NO: 833419 - protein, 19 aa, Mycobacterium
LGSPAIGAAPTVPAAALPA

SEQ ID NO: 833420 - protein, 20 aa, Mycobacterium
LGSPLWASPSRKVPFTAVLL

SEQ ID NO: 833421 - protein, 28 aa, Mycobacterium
LGSPRRWAVLAYPRVLQRRGWSMWIAES

SEQ ID NO: 833422 - protein, 21 aa, Mycobacterium
LGSPTLLYLAAAGVGTIGIVE

SEQ ID NO: 833423 - protein, 23 aa, Mycobacterium
LGSQTLWFQRIQAEAFLNVGRKK

SEQ ID NO: 833424 - protein, 30 aa, Mycobacterium
LGSRFLDTGAMYRMVTLAVLRAGIDPADEQ

SEQ ID NO: 833425 - protein, 17 aa, Mycobacterium
LGSRIVVLTRRPGQIAL

SEQ ID NO: 833426 - protein, 22 aa, Mycobacterium
LGSRVIPLDEILASAPGPDPNG

SEQ ID NO: 833427 - protein, 24 aa, Mycobacterium
LGSRYFRLLPQRLVERIAPKPGTG

SEQ ID NO: 833428 - protein, 17 aa, Mycobacterium
LGSSGFLNDGALQSGVV

SEQ ID NO: 833429 - protein, 25 aa, Mycobacterium
LGSSVILLARSRLLSRMEPFVGDFV

SEQ ID NO: 833430 - protein, 21 aa, Mycobacterium
LGSVAQRPWRLYEAESQLVGL

SEQ ID NO: 833431 - protein, 22 aa, Mycobacterium
LGSVMAIVKVKLDGGDQVVTSS

SEQ ID NO: 833432 - protein, 26 aa, Mycobacterium
LGSVMGAMLGPLGGIVGGVVQAAGQA

SEQ ID NO: 833433 - protein, 18 aa, Mycobacterium
LGSVMRRGYKVGDVVVRH

SEQ ID NO: 833434 - protein, 24 aa, Mycobacterium
LGSVRAYRFGACGGVPLLLLTGRG

SEQ ID NO: 833435 - protein, 17 aa, Mycobacterium
LGSYHRPVQTPSAQAQV

SEQ ID NO: 833436 - protein, 20 aa, Mycobacterium
LGSYLWMIEATSAHLSRAIA

SEQ ID NO: 833437 - protein, 19 aa, Mycobacterium
LGSYNLGWGNLGGANQGFG

SEQ ID NO: 833438 - protein, 22 aa, Mycobacterium
LGSYVAKLKPNGRYILCGGVGG

SEQ ID NO: 833439 - protein, 17 aa, Mycobacterium
LGTAELIRIALTGKLKP

SEQ ID NO: 833440 - protein, 18 aa, Mycobacterium
LGTAELIRIALTTKLKPY

SEQ ID NO: 833441 - protein, 17 aa, Mycobacterium
LGTAELIRIALTTTIKP

SEQ ID NO: 833442 - protein, 29 aa, Mycobacterium
LGTARLLSFPIDYASVTRLLFSRSGQATV

SEQ ID NO: 833443 - protein, 26 aa, Mycobacterium
LGTDGAPGGWLIGNGGAGGSGAAGSA

SEQ ID NO: 833444 - protein, 28 aa, Mycobacterium
LGTDGRPLILPVWYRLTDDHLQFVTHLK

SEQ ID NO: 833445 - protein, 17 aa, Mycobacterium
LGTDRVFADDLQALRPH

SEQ ID NO: 833446 - protein, 28 aa, Mycobacterium
LGTDYVDLFLIHWPAPDYGQYVTAWQQI

SEQ ID NO: 833447 - protein, 22 aa, Mycobacterium
LGTEGFLALKTVWSYAHQRAID

SEQ ID NO: 833448 - protein, 24 aa, Mycobacterium
LGTEQLFGTTFYVLAHPCPMCLGS

SEQ ID NO: 833449 - protein, 23 aa, Mycobacterium
LGTFARILLFDKAGVGLSDPVPR

SEQ ID NO: 833450 - protein, 18 aa, Mycobacterium
LGTGHWIPDAPARPIALL

SEQ ID NO: 833451 - protein, 24 aa, Mycobacterium
LGTGLGTAFPLLRTDIRRGTVTDD

SEQ ID NO: 833452 - protein, 23 aa, Mycobacterium
LGTGSLLRFTRAVVAPAVVIHGR

SEQ ID NO: 833453 - protein, 24 aa, Mycobacterium
LGTIRPPQRLAPFSYALGAEIKHR

SEQ ID NO: 833454 - protein, 33 aa, Mycobacterium
LGTLEHICRSGQDYSWFILNARIIAKEFALSGQ

SEQ ID NO: 833455 - protein, 28 aa, Mycobacterium
LGTLLSAHLVDELCLTIAPTTIGGAGLR

SEQ ID NO: 833456 - protein, 17 aa, Mycobacterium
LGTLRIGVVGLSVGHAI

SEQ ID NO: 833457 - protein, 20 aa, Mycobacterium
LGTLRVTRALLPKLIASGDG

SEQ ID NO: 833458 - protein, 26 aa, Mycobacterium
LGTLRVTRALLPKLIDSGDGLIVTVT

SEQ ID NO: 833459 - protein, 24 aa, Mycobacterium
LGTLRVTRALLPKLIESGDGLIVT

SEQ ID NO: 833460 - protein, 30 aa, Mycobacterium
LGTNMVDGGPWRFARTWLANLRHPAMMLRS

SEQ ID NO: 833461 - protein, 18 aa, Mycobacterium
LGTPSHPIDPSLLPAYLG

SEQ ID NO: 833462 - protein, 20 aa, Mycobacterium
LGTRGIWHEGWFANTIHAAT

SEQ ID NO: 833463 - protein, 17 aa, Mycobacterium
LGTRGQVSFIIPPGTKG

SEQ ID NO: 833464 - protein, 20 aa, Mycobacterium
LGTSLFTRRPVSLTAAGAVF

SEQ ID NO: 833465 - protein, 22 aa, Mycobacterium
LGTTDLVLRLLYRHGLLRDDPE

SEQ ID NO: 833466 - protein, 26 aa, Mycobacterium
LGTTLPAALVWAYPTITDLAGALCER

SEQ ID NO: 833467 - protein, 25 aa, Mycobacterium
LGTVAVTPIMHWLRDVDGPIVEFNQ

SEQ ID NO: 833468 - protein, 37 aa, Mycobacterium
LGTVEPWVRDYLLLRGLLGTSILWFELDRDGNGDPLP

SEQ ID NO: 833469 - protein, 37 aa, Mycobacterium; identical to SEQ ID NO: 115814

SEQ ID NO: 833470 - protein, 24 aa, Mycobacterium
LGTVPMWRAFANSCNTTFAKLASE

SEQ ID NO: 833471 - protein, 21 aa, Mycobacterium
LGTYHRLLSLVVEGYRREGKR

SEQ ID NO: 833472 - protein, 27 aa, Mycobacterium
LGVADGRKLPWFGPPMAAGSMATARLM

SEQ ID NO: 833473 - protein, 26 aa, Mycobacterium
LGVALHRVRFQLGDSALPVAPAQTGS

SEQ ID NO: 833474 - protein, 18 aa, Mycobacterium
LGVALWLDAPLVELLTDA

SEQ ID NO: 833475 - protein, 23 aa, Mycobacterium
LGVAPFPAVTRPPVGWIAQDEGR

SEQ ID NO: 833476 - protein, 21 aa, Mycobacterium
LGVARISFGPFLQAALSGRAT

SEQ ID NO: 833477 - protein, 25 aa, Mycobacterium
LGVARISFGPFWQAALAERSKELLA

SEQ ID NO: 833478 - protein, 24 aa, Mycobacterium
LGVATAHLGLAPPAALIGDWFGSR

SEQ ID NO: 833479 - protein, 28 aa, Mycobacterium
LGVCAQILPWNYPLASAISKLAPALAMG

SEQ ID NO: 833480 - protein, 20 aa, Mycobacterium
LGVDSLLALDLRKKLKKTTG

SEQ ID NO: 833481 - protein, 21 aa, Mycobacterium
LGVDTVLVLIGERPGLSVADS

SEQ ID NO: 833482 - protein, 24 aa, Mycobacterium
LGVEHTWLGFVDSGLPKGDPPPPL

SEQ ID NO: 833483 - protein, 25 aa, Mycobacterium
LGVFAPIERLIGRPLFGNGSVAAAS

SEQ ID NO: 833484 - protein, 25 aa, Mycobacterium
LGVFIEETLRLEPPFRAHYRHVLGD

SEQ ID NO: 833485 - protein, 20 aa, Mycobacterium
LGVHGFTRLPDGGPLRVVVT

SEQ ID NO: 833486 - protein, 22 aa, Mycobacterium
LGVHQRIYIASKGYLGHHVPGM

SEQ ID NO: 833487 - protein, 20 aa, Mycobacterium
LGVHTLPLLYVGGTSVILPS

SEQ ID NO: 833488 - protein, 19 aa, Mycobacterium
LGVIHGIKAFVPLLLEQGD

SEQ ID NO: 833489 - protein, 29 aa, Mycobacterium
LGVIKVGTFTIPTLYLNGNNLTGTIGPIV

SEQ ID NO: 833490 - protein, 26 aa, Mycobacterium
LGVITALDLRLYPVPTHRATAVCGFA

SEQ ID NO: 833491 - protein, 24 aa, Mycobacterium
LGVITQLDLRLHPAPSHRVTAICG

SEQ ID NO: 833492 - protein, 18 aa, Mycobacterium
LGVKQLMGCLDWLDDFDD

SEQ ID NO: 833493 - protein, 17 aa, Mycobacterium
LGVLELYRSKAVLFEQS

SEQ ID NO: 833494 - protein, 25 aa, Mycobacterium
LGVLEQLARIHAKLEDIPAILESAR

SEQ ID NO: 833495 - protein, 20 aa, Mycobacterium
LGVLERAAIAEALLLANLAV

SEQ ID NO: 833496 - protein, 17 aa, Mycobacterium
LGVLERMGLLAAAQKRK

SEQ ID NO: 833497 - protein, 19 aa, Mycobacterium
LGVLGFLDLTSLDTAGRRF

SEQ ID NO: 833498 - protein, 23 aa, Mycobacterium
LGVLLTHHLDIRAPSRALRALVA

SEQ ID NO: 833499 - protein, 18 aa, Mycobacterium
LGVLPTERDMLLKWSDDL

SEQ ID NO: 833500 - protein, 26 aa, Mycobacterium
LGVLQHLRSLLRPGGELRYLEHIASA

SEQ ID NO: 833501 - protein, 20 aa, Mycobacterium
LGVLRLMMKYDPHFFAFLEI

SEQ ID NO: 833502 - protein, 32 aa, Mycobacterium
LGVMLAYSPLHALLFGLPGDPPGPAALVMTSA

SEQ ID NO: 833503 - protein, 24 aa, Mycobacterium
LGVNFKGTVYIVQAALQALTASGH

SEQ ID NO: 833504 - protein, 24 aa, Mycobacterium
LGVNWKIVCEPGVAAAPVPSAPEP

SEQ ID NO: 833505 - protein, 18 aa, Mycobacterium
LGVPAPLVKALAERGIAE

SEQ ID NO: 833506 - protein, 24 aa, Mycobacterium
LGVPLTFEMARFIRFIVTEIFPGG

SEQ ID NO: 833507 - protein, 24 aa, Mycobacterium
LGVPVHNIWGLRPALQPGTRDPLP

SEQ ID NO: 833508 - protein, 20 aa, Mycobacterium
LGVRFEVVYGGITTLQSRSF

SEQ ID NO: 833509 - protein, 17 aa, Mycobacterium
LGVRHRIDYEGQAAVEL

SEQ ID NO: 833510 - protein, 23 aa, Mycobacterium
LGVRHRWLGYVDSGLPQGDPLPP

SEQ ID NO: 833511 - protein, 25 aa, Mycobacterium
LGVRRDWRGRKLAQALLTHAMRAYR

SEQ ID NO: 833512 - protein, 22 aa, Mycobacterium
LGVSLFIPYRYTEDRIFRALQD

SEQ ID NO: 833513 - protein, 20 aa, Mycobacterium
LGVSLGVLRLLMGADYAPLA

SEQ ID NO: 833514 - protein, 32 aa, Mycobacterium
LGVSRSVKYFLNRIGLFPTYVRQILSESEFDS

SEQ ID NO: 833515 - protein, 24 aa, Mycobacterium
LGVSSPRVLSDLFWMGRYGERAEN

SEQ ID NO: 833516 - protein, 17 aa, Mycobacterium
LGVTALVEFPPAGTLTG

SEQ ID NO: 833517 - protein, 17 aa, Mycobacterium
LGVTAPEMTVLVGGLRA

SEQ ID NO: 833518 - protein, 18 aa, Mycobacterium
LGVTAPEMTVLVGGLRAL

SEQ ID NO: 833519 - protein, 19 aa, Mycobacterium
LGVTITTLPASPAAISAAI

SEQ ID NO: 833520 - protein, 29 aa, Mycobacterium
LGVTLRVLRLFLGAAYRPVAVHLPHPALG

SEQ ID NO: 833521 - protein, 24 aa, Mycobacterium
LGVVDLLTRWRPALAVAQNAKVVV

SEQ ID NO: 833522 - protein, 26 aa, Mycobacterium
LGVVLAYAPLHTLLFGFGGDEPAPQT

SEQ ID NO: 833523 - protein, 26 aa, Mycobacterium
LGVVLFKDFLALHFSPTRPPAEHGGD

SEQ ID NO: 833524 - protein, 26 aa, Mycobacterium
LGVVNAPTQALLGRPLIGNGANGTTV

SEQ ID NO: 833525 - protein, 24 aa, Mycobacterium
LGWDAALTMYRPLLSYDELNGILE

SEQ ID NO: 833526 - protein, 17 aa, Mycobacterium
LGWDLELIGRIGWTCRD

SEQ ID NO: 833527 - protein, 26 aa, Mycobacterium
LGWDPPRFCGTAFQNAWLNPVMWNAF

SEQ ID NO: 833528 - protein, 23 aa, Mycobacterium
LGWEHNIVALAARYRVLAPDLLG

SEQ ID NO: 833529 - protein, 22 aa, Mycobacterium
LGWERNISALAARYRVLAPDML

SEQ ID NO: 833530 - protein, 17 aa, Mycobacterium
LGWIALNGRRNAASNPL

SEQ ID NO: 833531 - protein, 17 aa, Mycobacterium
LGWKQRFDPELSASLRA

SEQ ID NO: 833532 - protein, 35 aa, Mycobacterium
LGWLRHGYPHGIPTTDYFPLLALLSRTLTEDEVVG

SEQ ID NO: 833533 - protein, 21 aa, Mycobacterium
LGWNTDAHVELLWALSRAPDA

SEQ ID NO: 833534 - protein, 21 aa, Mycobacterium
LGWRGLIAQSTDLGALAAEAQ

SEQ ID NO: 833535 - protein, 24 aa, Mycobacterium
LGWSLRRKPLPPTGQHWRLLSTVK

SEQ ID NO: 833536 - protein, 20 aa, Mycobacterium
LGWTGLALAEDVGGSGFGLA

SEQ ID NO: 833537 - protein, 20 aa, Mycobacterium
LGWTSLLIPEQLGGGSVSGN

SEQ ID NO: 833538 - protein, 28 aa, Mycobacterium
LGWTTEAHVPLLWSLSRSPDADAALLTL

SEQ ID NO: 833539 - protein, 18 aa, Mycobacterium
LGYADLAFMSATARLKCP

SEQ ID NO: 833540 - protein, 19 aa, Mycobacterium
LGYADLAFMSSTARLKCPF

SEQ ID NO: 833541 - protein, 20 aa, Mycobacterium
LGYAGVYSSFLRHAEAAAQR

SEQ ID NO: 833542 - protein, 20 aa, Mycobacterium
LGYAGVYSSFLRHAERAANE

SEQ ID NO: 833543 - protein, 19 aa, Mycobacterium
LGYIATDVYARYFRMTGRN

SEQ ID NO: 833544 - protein, 37 aa, Mycobacterium
LGYKCSIRTPWWRTPSLWIPDLFMLRQIHHAPRLTVN

SEQ ID NO: 833545 - protein, 17 aa, Mycobacterium
LGYNFKDWDLRTAFTWK

SEQ ID NO: 833546 - protein, 24 aa, Mycobacterium
LGYQLIDIPLKFHHPMWREHCEVD

SEQ ID NO: 833547 - protein, 30 aa, Mycobacterium
LGYTITAFVRLAYPSGNYKPLHSLLDVTPE

SEQ ID NO: 833548 - protein, 27 aa, Mycobacterium
LHAARPFDAVLDYLWGEPAEHVLGALA

SEQ ID NO: 833549 - protein, 17 aa, Mycobacterium
LHAERIGPYLTLLRGIA

SEQ ID NO: 833550 - protein, 21 aa, Mycobacterium
LHAGHLVPLLALRRFQRAGHR

SEQ ID NO: 833551 - protein, 27 aa, Mycobacterium
LHAIKIAARIRKVFGRRVRIRDVFDSQ

SEQ ID NO: 833552 - protein, 19 aa, Mycobacterium
LHALGPRWALVKGGHLRSS

SEQ ID NO: 833553 - protein, 29 aa, Mycobacterium
LHALRDGALPLQFLFSGTIFVKSERGFSV

SEQ ID NO: 833554 - protein, 33 aa, Mycobacterium
LHALRLAPELRGRLVWAWRADGANPAARVLGER

SEQ ID NO: 833555 - protein, 18 aa, Mycobacterium
LHAPPGIPVDIGPGATVA

SEQ ID NO: 833556 - protein, 20 aa, Mycobacterium
LHARTRVARLRFAGTSVVGV

SEQ ID NO: 833557 - protein, 22 aa, Mycobacterium
LHASPALEWALKAILESPSHTQ

SEQ ID NO: 833558 - protein, 19 aa, Mycobacterium
LHCCAPGVPWDLLQRSAFS

SEQ ID NO: 833559 - protein, 17 aa, Mycobacterium
LHCRLVGRPARTAALQR

SEQ ID NO: 833560 - protein, 25 aa, Mycobacterium
LHCVTAAQLVVTLTALRSAGRHPLD

SEQ ID NO: 833561 - protein, 28 aa, Mycobacterium
LHDADTYRWPMVPALALLAAMPALGSAE

SEQ ID NO: 833562 - protein, 18 aa, Mycobacterium
LHDAGFDASLPTAWLAEG

SEQ ID NO: 833563 - protein, 24 aa, Mycobacterium
LHDATLYYTVLGRSLDEEPDYEGA

SEQ ID NO: 833564 - protein, 24 aa, Mycobacterium
LHDAYGWHMRAAKWLTNRDIAAAR

SEQ ID NO: 833565 - protein, 25 aa, Mycobacterium
LHDAYTALKAWGLPVAEQTARVRGL

SEQ ID NO: 833566 - protein, 29 aa, Mycobacterium
LHDCFSANEFLLYEALGLCGEGEAGKLID

SEQ ID NO: 833567 - protein, 32 aa, Mycobacterium
LHDCFSANELLLYEALGLCGPGEAPKLIDNND

SEQ ID NO: 833568 - protein, 32 aa, Mycobacterium
LHDCFSANELLLYEALGLCGPGEAPRLIDDND

SEQ ID NO: 833569 - protein, 31 aa, Mycobacterium
LHDCFSANELLLYEALGLCGQGEAPKLIDNG

SEQ ID NO: 833570 - protein, 33 aa, Mycobacterium
LHDDAGRRWHADAVILAIPAPRLVRILDGVDGV

SEQ ID NO: 833571 - protein, 24 aa, Mycobacterium
LHDDLFDFFYDALPGYEKVGLRRT

SEQ ID NO: 833572 - protein, 17 aa, Mycobacterium
LHDFYDAFFPRLEEAIE

SEQ ID NO: 833573 - protein, 18 aa, Mycobacterium
LHDHLVDVVLDAAAMGRV

SEQ ID NO: 833574 - protein, 25 aa, Mycobacterium
LHDHVIQRLFAIGLALQGSVPRTRE

SEQ ID NO: 833575 - protein, 26 aa, Mycobacterium
LHDHVIQRLFAVGLSLQGSIARARSE

SEQ ID NO: 833576 - protein, 25 aa, Mycobacterium
LHDHVIQRLFLAGMDLQGTIARTKS

SEQ ID NO: 833577 - protein, 19 aa, Mycobacterium
LHDIDMSVDFFGASLRAPI

SEQ ID NO: 833578 - protein, 18 aa, Mycobacterium
LHDLAPDLVLWECDKTVY

SEQ ID NO: 833579 - protein, 18 aa, Mycobacterium
LHDLDPQAQLYFITGADA

SEQ ID NO: 833580 - protein, 21 aa, Mycobacterium
LHDLGWTIIRVSNKLLRYRQG

SEQ ID NO: 833581 - protein, 19 aa, Mycobacterium
LHDLLWAQDHRGFQGRLAR

SEQ ID NO: 833582 - protein, 23 aa, Mycobacterium
LHDLQSRKGPYERYLPYAVGDGS

SEQ ID NO: 833583 - protein, 19 aa, Mycobacterium
LHDLYLATCGLRRADMATA

SEQ ID NO: 833584 - protein, 18 aa, Mycobacterium
LHDRGVFDDLPLTEIIDA

SEQ ID NO: 833585 - protein, 26 aa, Mycobacterium
LHDRLPKIYLELLDAARGLERLAAEV

SEQ ID NO: 833586 - protein, 29 aa, Mycobacterium
LHDSLLPKFTGFSPVIWSLISGAGQTGLT

SEQ ID NO: 833587 - protein, 27 aa, Mycobacterium
LHDSLLPKFTGFSPVLWALISGESEFG

SEQ ID NO: 833588 - protein, 22 aa, Mycobacterium
LHDSTRWKLRHIGRYTLSGTKP

SEQ ID NO: 833589 - protein, 18 aa, Mycobacterium
LHDYLQAHHARCSAVTFM

SEQ ID NO: 833590 - protein, 20 aa, Mycobacterium
LHEAKLAIHDLGGRGWTLDG

SEQ ID NO: 833591 - protein, 23 aa, Mycobacterium
LHEAKLAMHDLAGRGWTLRGVTS

SEQ ID NO: 833592 - protein, 20 aa, Mycobacterium
LHEELGITGLIPTPLASASW

SEQ ID NO: 833593 - protein, 18 aa, Mycobacterium
LHEEWIGHRITDLEQATG

SEQ ID NO: 833594 - protein, 20 aa, Mycobacterium
LHEIIAGACFNTWLVWAQHA

SEQ ID NO: 833595 - protein, 18 aa, Mycobacterium
LHEILGTARLLSFPVDYA

SEQ ID NO: 833596 - protein, 24 aa, Mycobacterium
LHEKLTRWASTGATPPWVTQAWQP

SEQ ID NO: 833597 - protein, 18 aa, Mycobacterium
LHELAIPTIAKVTGIAVG

SEQ ID NO: 833598 - protein, 38 aa, Mycobacterium
LHEMAHMWFGDLVTMTWWDDLWLNESFATFASVLCQAE

SEQ ID NO: 833599 - protein, 38 aa, Mycobacterium
LHEMAHMWFGDLVTMTWWDDLWLNESFATFASVLCQSE

SEQ ID NO: 833600 - protein, 25 aa, Mycobacterium
LHEMRGMFDQYWSSVPQVLIEPGVR

SEQ ID NO: 833601 - protein, 24 aa, Mycobacterium
LHERDLIVLDPLLATGNSAIAAID

SEQ ID NO: 833602 - protein, 17 aa, Mycobacterium
LHERGLIASLAAAWLDT

SEQ ID NO: 833603 - protein, 27 aa, Mycobacterium
LHEVRIMLEQYWPSVPHVLIEPGVRTG

SEQ ID NO: 833604 - protein, 27 aa, Mycobacterium
LHEVRLMLDQYWPSVPHVLIEPGVRTG

SEQ ID NO: 833605 - protein, 22 aa, Mycobacterium
LHEWYGRYRYFSPDEVEPLQTH

SEQ ID NO: 833606 - protein, 26 aa, Mycobacterium
LHEYYAGPIFVPTAPHPLTGAQLPLT

SEQ ID NO: 833607 - protein, 26 aa, Mycobacterium
LHFGKPLVVLPLFWDQYENAQRIDEL

SEQ ID NO: 833608 - protein, 18 aa, Mycobacterium
LHFIVYSAMFEGQSQIAL

SEQ ID NO: 833609 - protein, 26 aa, Mycobacterium
LHFYRDVLGFFLRDSMKLPPQLVGRP

SEQ ID NO: 833610 - protein, 18 aa, Mycobacterium
LHGALAPGAIIAERGTDA

SEQ ID NO: 833611 - protein, 19 aa, Mycobacterium
LHGDPTFIISTALATRDFQ

SEQ ID NO: 833612 - protein, 25 aa, Mycobacterium
LHGEVNVRIWIRPEHRKKGYGTAAL

SEQ ID NO: 833613 - protein, 33 aa, Mycobacterium
LHGFALQNPGLARYMQLLFPRGEAGARLLSDEV

SEQ ID NO: 833614 - protein, 26 aa, Mycobacterium
LHGGGTVEWIMPPAGPALGLRADDWP

SEQ ID NO: 833615 - protein, 27 aa, Mycobacterium
LHGGYGFMREYPVARAYMDSRIQTIYG

SEQ ID NO: 833616 - protein, 25 aa, Mycobacterium
LHGLPDSWWQWHYALEGLGRRYHCL

SEQ ID NO: 833617 - protein, 21 aa, Mycobacterium
LHGNLHYRNALAADREPWLAI

SEQ ID NO: 833618 - protein, 18 aa, Mycobacterium
LHGPALTFDTACSSGLMA

SEQ ID NO: 833619 - protein, 27 aa, Mycobacterium
LHGPKRYNWAQLAGSVKYTLWRLQERV

SEQ ID NO: 833620 - protein, 26 aa, Mycobacterium
LHGPSWCDPVWLDQPGIAFPFPDEPF

SEQ ID NO: 833621 - protein, 17 aa, Mycobacterium
LHGQNDQLRLLRPDEQR

SEQ ID NO: 833622 - protein, 18 aa, Mycobacterium
LHGRARVVQFNEPEYPRL

SEQ ID NO: 833623 - protein, 24 aa, Mycobacterium
LHGRVERMHRACLILTFGGGTNEV

SEQ ID NO: 833624 - protein, 24 aa, Mycobacterium
LHGRYLLPHFLIRDIADVAADLRA

SEQ ID NO: 833625 - protein, 25 aa, Mycobacterium
LHGSDLIQTAWTLARALGTIEGTEL

SEQ ID NO: 833626 - protein, 24 aa, Mycobacterium
LHGSIPAPQLLLDAIRDILCSVPS

SEQ ID NO: 833627 - protein, 18 aa, Mycobacterium
LHGSTGSGPLLAARAAEA

SEQ ID NO: 833628 - protein, 20 aa, Mycobacterium
LHGVAFDRPLARLKETVEIV

SEQ ID NO: 833629 - protein, 19 aa, Mycobacterium
LHHEQFVCDLPPNSKINLY

SEQ ID NO: 833630 - protein, 35 aa, Mycobacterium
LHHGLPQRWIDFLHRWDPVHWLQPVSAAASGAGPQ

SEQ ID NO: 833631 - protein, 19 aa, Mycobacterium
LHHLAFAVLDSSLRPVPPG

SEQ ID NO: 833632 - protein, 18 aa, Mycobacterium
LHHLANVLGLVDGGAESP

SEQ ID NO: 833633 - protein, 17 aa, Mycobacterium
LHHPCCGDLVYGADPKL

SEQ ID NO: 833634 - protein, 18 aa, Mycobacterium
LHHPSIFSAAAVALPDPY

SEQ ID NO: 833635 - protein, 18 aa, Mycobacterium
LHHPSRIDAIRYALRAQI

SEQ ID NO: 833636 - protein, 17 aa, Mycobacterium
LHHQRQVQRLLFDAGWM

SEQ ID NO: 833637 - protein, 19 aa, Mycobacterium
LHHQSFPLVWPACRRRIEA

SEQ ID NO: 833638 - protein, 18 aa, Mycobacterium
LHHREPGPALALLRHRGV

SEQ ID NO: 833639 - protein, 20 aa, Mycobacterium
LHHTLFGGPPEGRRTWMADV

SEQ ID NO: 833640 - protein, 20 aa, Mycobacterium
LHHTLFGGPPEGRRTWMAEI

SEQ ID NO: 833641 - protein, 19 aa, Mycobacterium
LHHYATNRSLLLDGLRGIG

SEQ ID NO: 833642 - protein, 25 aa, Mycobacterium
LHHYLTFHSVVPPPRTILRGVKKVP

SEQ ID NO: 833643 - protein, 26 aa, Mycobacterium
LHIDDIRWFDFYSCFPSAVEAAIDAL

SEQ ID NO: 833644 - protein, 18 aa, Mycobacterium
LHIFPRACHGFDSLLPEW

SEQ ID NO: 833645 - protein, 30 aa, Mycobacterium
LHIGNLRTAVLAWLFARSTGRRFLMRVEDL

SEQ ID NO: 833646 - protein, 29 aa, Mycobacterium
LHIGNLRTAVLAWLFARSTGRRFLVRVED

SEQ ID NO: 833647 - protein, 27 aa, Mycobacterium
LHILEVQRLIRFMPKPVICLVNGWAAG

SEQ ID NO: 833648 - protein, 18 aa, Mycobacterium
LHIPLIPEFEGYDDFLAS

SEQ ID NO: 833649 - protein, 19 aa, Mycobacterium
LHISPIPVALAPRGYAEDP

SEQ ID NO: 833650 - protein, 19 aa, Mycobacterium
LHISRQRSPRPSTAAFLAA

SEQ ID NO: 833651 - protein, 33 aa, Mycobacterium
LHKDLYQEYSLRPPKGVLLYGPPGCGKTLIAKA

SEQ ID NO: 833652 - protein, 27 aa, Mycobacterium
LHKEAFRQWVLLRHTEWIKALEPERRR

SEQ ID NO: 833653 - protein, 17 aa, Mycobacterium
LHKFKDSGSLPNLSERL

SEQ ID NO: 833654 - protein, 25 aa, Mycobacterium
LHKKGNLPYLVYLRHPTTGGVFASW

SEQ ID NO: 833655 - protein, 20 aa, Mycobacterium
LHKTIVFVTHDFGEAVKLGD

SEQ ID NO: 833656 - protein, 21 aa, Mycobacterium
LHLAAYRALGLTDWTYERIEC

SEQ ID NO: 833657 - protein, 22 aa, Mycobacterium
LHLAAYRALGLTDWTYQRIECD

SEQ ID NO: 833658 - protein, 23 aa, Mycobacterium
LHLDAAWAAEQPGFRGERLVNSM

SEQ ID NO: 833659 - protein, 25 aa, Mycobacterium
LHLDDLHLRRHKWTRLGAYAQSKLA

SEQ ID NO: 833660 - protein, 26 aa, Mycobacterium
LHLDDLHLRRHKWTRLGAYAQSKLAV

SEQ ID NO: 833661 - protein, 25 aa, Mycobacterium
LHLDMDAFFASVEQLTRPTLRGRPV

SEQ ID NO: 833662 - protein, 18 aa, Mycobacterium
LHLFSIAARITRHARRAR

SEQ ID NO: 833663 - protein, 19 aa, Mycobacterium
LHLGFNFRLARIEFDGAEI

SEQ ID NO: 833664 - protein, 17 aa, Mycobacterium
LHLGFSCYLFDSSGRVL

SEQ ID NO: 833665 - protein, 19 aa, Mycobacterium
LHLGVFEKAATAEALLLDA

SEQ ID NO: 833666 - protein, 19 aa, Mycobacterium
LHLINHPVRERIPITIAAL

SEQ ID NO: 833667 - protein, 18 aa, Mycobacterium
LHLLIQLGNGPATLDELA

SEQ ID NO: 833668 - protein, 18 aa, Mycobacterium
LHLRFDAEARARLALRRF

SEQ ID NO: 833669 - protein, 24 aa, Mycobacterium
LHLVDFPVALGIRPNIPQDDLREI

SEQ ID NO: 833670 - protein, 19 aa, Mycobacterium
LHLVDFPVTLGIRPNIPQE

SEQ ID NO: 833671 - protein, 20 aa, Mycobacterium
LHLVPVAFTGGRRVLGAPAS

SEQ ID NO: 833672 - protein, 18 aa, Mycobacterium
LHLYAPLDEPVSSRGATV

SEQ ID NO: 833673 - protein, 18 aa, Mycobacterium
LHMHVVPRWGGDANFITI

SEQ ID NO: 833674 - protein, 18 aa, Mycobacterium
LHMLRHQQILAPKFELAL

SEQ ID NO: 833675 - protein, 18 aa, Mycobacterium
LHMMARLRTGQPLVPLDL

SEQ ID NO: 833676 - protein, 27 aa, Mycobacterium
LHMVPSLLGSVLLLPEARELRGLRHVP

SEQ ID NO: 833677 - protein, 18 aa, Mycobacterium
LHNDIVAPYLLALATEEQ

SEQ ID NO: 833678 - protein, 26 aa, Mycobacterium
LHNHTRWSAFLRGLRYLVVDECHYYR

SEQ ID NO: 833679 - protein, 17 aa, Mycobacterium
LHNLQQQVLTAINAPTQ

SEQ ID NO: 833680 - protein, 35 aa, Mycobacterium
LHNSQPWLWAAVDKTLHLFVDKQRILYSADHMGRE

SEQ ID NO: 833681 - protein, 25 aa, Mycobacterium
LHNSQPWQWVAGGGRVDLFLDASRA

SEQ ID NO: 833682 - protein, 23 aa, Mycobacterium
LHPADVPFFVTLCKKPGKPVNFV

SEQ ID NO: 833683 - protein, 21 aa, Mycobacterium
LHPAELLFTATLAGARALALE

SEQ ID NO: 833684 - protein, 19 aa, Mycobacterium
LHPAELLFTATLAGARALD

SEQ ID NO: 833685 - protein, 26 aa, Mycobacterium
LHPALKYYHPFDGDGMLHMVGFRDGK

SEQ ID NO: 833686 - protein, 20 aa, Mycobacterium
LHPAVIERLGLPKRTCALEL

SEQ ID NO: 833687 - protein, 18 aa, Mycobacterium
LHPDDIYWCTADPGWVTG

SEQ ID NO: 833688 - protein, 26 aa, Mycobacterium
LHPDEIHLPGIFVQRVVALTPEQAAH

SEQ ID NO: 833689 - protein, 29 aa, Mycobacterium
LHPEFRTVPMVWYIPPLSPVVDAVSRDGH

SEQ ID NO: 833690 - protein, 23 aa, Mycobacterium
LHPEPRLLVPRQETFWATRKVEF

SEQ ID NO: 833691 - protein, 22 aa, Mycobacterium
LHPEWDVFRNCYRPQWCRVIDY

SEQ ID NO: 833692 - protein, 17 aa, Mycobacterium
LHPFGRFDKTAMQMGAE

SEQ ID NO: 833693 - protein, 18 aa, Mycobacterium
LHPGLANALNPAPATPPA

SEQ ID NO: 833694 - protein, 17 aa, Mycobacterium
LHPLFAQLAERGLGLEN

SEQ ID NO: 833695 - protein, 17 aa, Mycobacterium
LHPLRPPSLLAVEPPDH

SEQ ID NO: 833696 - protein, 19 aa, Mycobacterium
LHPMQRGFIDHAGFQCGFC

SEQ ID NO: 833697 - protein, 20 aa, Mycobacterium
LHPNIRTFREWSPRIAGDKS

SEQ ID NO: 833698 - protein, 28 aa, Mycobacterium
LHPRTGPMLYPTPPFARLAGQSEWLLRP

SEQ ID NO: 833699 - protein, 38 aa, Mycobacterium
LHPTTPHPAVMDAWFKPYLGAGLHLASWGFGVETGTHA

SEQ ID NO: 833700 - protein, 17 aa, Mycobacterium
LHPYRVRHLLDRYGSLI

SEQ ID NO: 833701 - protein, 22 aa, Mycobacterium
LHPYRVRHLLDRYGSLIGEVLA

SEQ ID NO: 833702 - protein, 23 aa, Mycobacterium
LHPYRVRHLLDRYGSLIGEVLAC

SEQ ID NO: 833703 - protein, 25 aa, Mycobacterium
LHQHGLVELIDLSANAFHVLQPADD

SEQ ID NO: 833704 - protein, 23 aa, Mycobacterium
LHQKWFNLYDEATRVPFVIARSG

SEQ ID NO: 833705 - protein, 23 aa, Mycobacterium
LHQKWFNLYDEATRVPFVIARTG

SEQ ID NO: 833706 - protein, 22 aa, Mycobacterium
LHQKWFNLYDEATRVPFVIARV

SEQ ID NO: 833707 - protein, 18 aa, Mycobacterium
LHQLLAGSVWTSLFALPA

SEQ ID NO: 833708 - protein, 18 aa, Mycobacterium
LHQPPRSGLPVVELLATE

SEQ ID NO: 833709 - protein, 18 aa, Mycobacterium
LHQQLFADLLTAAGLDAT

SEQ ID NO: 833710 - protein, 18 aa, Mycobacterium
LHRAIAEHLDELLVWDRA

SEQ ID NO: 833711 - protein, 19 aa, Mycobacterium
LHRARTDLFAAARRELLPG

SEQ ID NO: 833712 - protein, 22 aa, Mycobacterium
LHRDAPLNQVMIASLYAAFVER

SEQ ID NO: 833713 - protein, 25 aa, Mycobacterium
LHRDRNWLGPAQQFGISAAILIGDV

SEQ ID NO: 833714 - protein, 18 aa, Mycobacterium
LHREPCFDQIIQGMGGLM

SEQ ID NO: 833715 - protein, 29 aa, Mycobacterium
LHRERNWLGPAHQFGISAAILLGDVAQAW

SEQ ID NO: 833716 - protein, 21 aa, Mycobacterium
LHRFDDWMTIFGGWRGEVPST

SEQ ID NO: 833717 - protein, 18 aa, Mycobacterium
LHRGRRQLRGLLADVAKE

SEQ ID NO: 833718 - protein, 22 aa, Mycobacterium
LHRIPLLPVGMFKQTGAHVLLT

SEQ ID NO: 833719 - protein, 17 aa, Mycobacterium
LHRIVVNACLDRLRQAR

SEQ ID NO: 833720 - protein, 17 aa, Mycobacterium
LHRIVVNACLDRLRRTK

SEQ ID NO: 833721 - protein, 18 aa, Mycobacterium
LHRIVVNACLDRLRRTKA

SEQ ID NO: 833722 - protein, 19 aa, Mycobacterium
LHRKAAELGLLGAGFPEDA

SEQ ID NO: 833723 - protein, 19 aa, Mycobacterium
LHRLGIQAFEPMLIEGKAI

SEQ ID NO: 833724 - protein, 17 aa, Mycobacterium
LHRLGIQAFEPQLVEGK

SEQ ID NO: 833725 - protein, 25 aa, Mycobacterium
LHRLGYRYHFTLYPIEDHVAMAVQG

SEQ ID NO: 833726 - protein, 18 aa, Mycobacterium
LHRLRREMPNLQEALQIA

SEQ ID NO: 833727 - protein, 18 aa, Mycobacterium
LHRLRREMPNLQEALQVA

SEQ ID NO: 833728 - protein, 17 aa, Mycobacterium
LHRNAVLPVVERALSAS

SEQ ID NO: 833729 - protein, 21 aa, Mycobacterium
LHRNWVCETLWPGSPPNRAVA

SEQ ID NO: 833730 - protein, 25 aa, Mycobacterium
LHRPDSGPVTWWSTQQMRTWANRPW

SEQ ID NO: 833731 - protein, 30 aa, Mycobacterium
LHRPKLGFPVPIRHWLRSGALLDWAHQTVS

SEQ ID NO: 833732 - protein, 29 aa, Mycobacterium
LHRPKLGFPVPIRHWLRTGELLEWAYELV

SEQ ID NO: 833733 - protein, 17 aa, Mycobacterium
LHRPNMTVLTGATVTRL

SEQ ID NO: 833734 - protein, 23 aa, Mycobacterium
LHRPTPCATLAAWLNTQTGILSE

SEQ ID NO: 833735 - protein, 28 aa, Mycobacterium
LHRQIAYVPGDVTLWPSLTGGEIIDLLA

SEQ ID NO: 833736 - protein, 18 aa, Mycobacterium
LHRRARAAVRIVQRVTGR

SEQ ID NO: 833737 - protein, 52 aa, Mycobacterium
LHRRARRIALPTYPFRQTRYWPRLRAAGGAPFLSPVRLASVVWTPLDAGTSA

SEQ ID NO: 833738 - protein, 27 aa, Mycobacterium
LHRRDALWAAALRTAIARRSGDSGAIQ

SEQ ID NO: 833739 - protein, 17 aa, Mycobacterium
LHRRHGCALQIGGSDQW

SEQ ID NO: 833740 - protein, 23 aa, Mycobacterium
LHRRNPRLVYCAMSGFGLDGPDS

SEQ ID NO: 833741 - protein, 17 aa, Mycobacterium
LHRTITDRGLYDPTIDV

SEQ ID NO: 833742 - protein, 24 aa, Mycobacterium
LHRVDALRFLTQNLGQAFDLALET

SEQ ID NO: 833743 - protein, 19 aa, Mycobacterium
LHRVLFEEAPRPPEFLAML

SEQ ID NO: 833744 - protein, 17 aa, Mycobacterium
LHRVLSRDGFDVGDATD

SEQ ID NO: 833745 - protein, 20 aa, Mycobacterium
LHRYFPATLRRRLGDRLTEH

SEQ ID NO: 833746 - protein, 17 aa, Mycobacterium
LHSDDWLFPTYRDSMAL

SEQ ID NO: 833747 - protein, 24 aa, Mycobacterium
LHSGTLARLEWIKARGYAITDTVD

SEQ ID NO: 833748 - protein, 26 aa, Mycobacterium
LHSIRAGYAGLLHQALTSLSADGFDP

SEQ ID NO: 833749 - protein, 24 aa, Mycobacterium
LHSLGVATVPQLIRLHHERLPGAR

SEQ ID NO: 833750 - protein, 25 aa, Mycobacterium
LHSQLLRVPPIRRTTEVPSIEPAKD

SEQ ID NO: 833751 - protein, 25 aa, Mycobacterium
LHSQLLRVPPVRRTLEVPSIEPAKD

SEQ ID NO: 833752 - protein, 17 aa, Mycobacterium
LHSRGFTAYFRHLHTSS

SEQ ID NO: 833753 - protein, 24 aa, Mycobacterium
LHSTPRWCIWIPDDDLPADVANSR

SEQ ID NO: 833754 - protein, 17 aa, Mycobacterium
LHSVDRGALRRTYDRFS

SEQ ID NO: 833755 - protein, 17 aa, Mycobacterium
LHTALRLPRDAALTVDG

SEQ ID NO: 833756 - protein, 19 aa, Mycobacterium
LHTASLRTVVIGLDPRLTP

SEQ ID NO: 833757 - protein, 17 aa, Mycobacterium
LHTLIATVPTAANAGYY

SEQ ID NO: 833758 - protein, 24 aa, Mycobacterium
LHTLLAVRCTPAPWWSYDTWDLRI

SEQ ID NO: 833759 - protein, 19 aa, Mycobacterium
LHTLWRMDLTRDERLKHLT

SEQ ID NO: 833760 - protein, 36 aa, Mycobacterium
LHTNPRAKMSGLRRGFVKIFCRPATGVVIGGVVVAA

SEQ ID NO: 833761 - protein, 18 aa, Mycobacterium
LHTPKRYSRRLRRVMYMS

SEQ ID NO: 833762 - protein, 20 aa, Mycobacterium
LHTQFGVEIPWDTIDMDFMN

SEQ ID NO: 833763 - protein, 18 aa, Mycobacterium
LHTSLLDRHRPLWELYVV

SEQ ID NO: 833764 - protein, 23 aa, Mycobacterium
LHTVGDLVRYFPRKYSDAMTVRG

SEQ ID NO: 833765 - protein, 20 aa, Mycobacterium
LHTVHRLLVSRAFTPRKLKA

SEQ ID NO: 833766 - protein, 19 aa, Mycobacterium
LHTVHRLLVSRAFTPRKMR

SEQ ID NO: 833767 - protein, 27 aa, Mycobacterium
LHVAAKAFWPSPLPFPVMHIDTGHNFD

SEQ ID NO: 833768 - protein, 24 aa, Mycobacterium
LHVEWYTTAPGVTWLPRWVSAHLN

SEQ ID NO: 833769 - protein, 20 aa, Mycobacterium
LHVIPGLWSPAHGYQRLVRH

SEQ ID NO: 833770 - protein, 18 aa, Mycobacterium
LHVLAQELCMLCQAGPPP

SEQ ID NO: 833771 - protein, 21 aa, Mycobacterium
LHVLRDTLAKPPPSGSPGLML

SEQ ID NO: 833772 - protein, 24 aa, Mycobacterium
LHVSTTLTPWPRGAGPRRAGVSSF

SEQ ID NO: 833773 - protein, 17 aa, Mycobacterium
LHVTGTRTDALRSVATT

SEQ ID NO: 833774 - protein, 17 aa, Mycobacterium
LHVTILYDEPRVVLLPS

SEQ ID NO: 833775 - protein, 18 aa, Mycobacterium
LHVTTLAWVALGPTPDGT

SEQ ID NO: 833776 - protein, 24 aa, Mycobacterium
LHVTYLIRDGLVLELLDYSQRSVA

SEQ ID NO: 833777 - protein, 21 aa, Mycobacterium
LHWPPDLEPVPPRDWRNEVRE

SEQ ID NO: 833778 - protein, 17 aa, Mycobacterium
LHYIDFEGRFFSVKGPS

SEQ ID NO: 833779 - protein, 22 aa, Mycobacterium
LHYIDFVGAHFSVKGPSITPRP

SEQ ID NO: 833780 - protein, 19 aa, Mycobacterium
LHYNRVWVKALGKLPDDPI

SEQ ID NO: 833781 - protein, 19 aa, Mycobacterium
LHYTIHPDGFLTYRVVGSQ

SEQ ID NO: 833782 - protein, 17 aa, Mycobacterium
LHYVDFTGKYFAVKGPS

SEQ ID NO: 833783 - protein, 17 aa, Mycobacterium
LIAAAERLVAERGYLAV

SEQ ID NO: 833784 - protein, 19 aa, Mycobacterium
LIAACRLRRALAEAKEAFY

SEQ ID NO: 833785 - protein, 25 aa, Mycobacterium
LIAAERITMLPGPPTLYHSLLAVKD

SEQ ID NO: 833786 - protein, 31 aa, Mycobacterium
LIAAGSKLADLVFPTLPAPIAATGSDPVSAA

SEQ ID NO: 833787 - protein, 22 aa, Mycobacterium
LIAAHLQGWTLDRLPAVDRAIL

SEQ ID NO: 833788 - protein, 23 aa, Mycobacterium
LIAALPAVLGFVPEKSLVLATIE

SEQ ID NO: 833789 - protein, 20 aa, Mycobacterium
LIAALTAALLGLPADNWPVL

SEQ ID NO: 833790 - protein, 27 aa, Mycobacterium
LIADDLPDFPLLSPPSAVRRMPLMNNE

SEQ ID NO: 833791 - protein, 20 aa, Mycobacterium
LIADEYFLRAYAGHAPDRTA

SEQ ID NO: 833792 - protein, 18 aa, Mycobacterium
LIADLWPDPNYSAVFRIK

SEQ ID NO: 833793 - protein, 25 aa, Mycobacterium
LIADPKARFFRMLTSWVGGGYRVPD

SEQ ID NO: 833794 - protein, 20 aa, Mycobacterium
LIADRLLPGGVFHAATDHPG

SEQ ID NO: 833795 - protein, 18 aa, Mycobacterium
LIADRLLPGGVLHVATDH

SEQ ID NO: 833796 - protein, 18 aa, Mycobacterium
LIADVMYQIGALSALAAA

SEQ ID NO: 833797 - protein, 24 aa, Mycobacterium
LIADYPQVSLGIYASPRQTAIAGP

SEQ ID NO: 833798 - protein, 20 aa, Mycobacterium
LIAEANSFASYKSSAAVSAI

SEQ ID NO: 833799 - protein, 23 aa, Mycobacterium
LIAELDAIFARRTLAEWTEVFAA

SEQ ID NO: 833800 - protein, 34 aa, Mycobacterium
LIAEQQADCFAGVYLRWVAAGNSPRFALSTGDGL

SEQ ID NO: 833801 - protein, 38 aa, Mycobacterium
LIAEYGISWILPRLAGWGAAMDLLLSGRTFFAEEAAQL

SEQ ID NO: 833802 - protein, 21 aa, Mycobacterium
LIAFALAWNEFLGAGGAPIGI

SEQ ID NO: 833803 - protein, 21 aa, Mycobacterium
LIAFGMAWTEFLGSKAAGAPI

SEQ ID NO: 833804 - protein, 19 aa, Mycobacterium
LIAFPEIRNLGYFTLVVQE

SEQ ID NO: 833805 - protein, 17 aa, Mycobacterium
LIAGGPLVLKAAKPGQI

SEQ ID NO: 833806 - protein, 24 aa, Mycobacterium
LIAGIGLRTFPLTSGSKGLHLYAP

SEQ ID NO: 833807 - protein, 18 aa, Mycobacterium
LIAGTTMLACRVGDDIFA

SEQ ID NO: 833808 - protein, 18 aa, Mycobacterium
LIALFRAEAGLPPKEFAR

SEQ ID NO: 833809 - protein, 25 aa, Mycobacterium
LIALGLRNYWGYNTFGYLAPHAGYA

SEQ ID NO: 833810 - protein, 18 aa, Mycobacterium
LIALYRNIAGEHPDWDEY

SEQ ID NO: 833811 - protein, 26 aa, Mycobacterium
LIANYHTMYFAYARRGQLRAGETVLV

SEQ ID NO: 833812 - protein, 23 aa, Mycobacterium
LIAPGDLVIIMSYLIVGEEERCG

SEQ ID NO: 833813 - protein, 24 aa, Mycobacterium
LIAQINSVVRWDLCAATIASAATA

SEQ ID NO: 833814 - protein, 23 aa, Mycobacterium
LIAQLDQIFATRSLAEWTEIFDA

SEQ ID NO: 833815 - protein, 21 aa, Mycobacterium
LIAQPQSWKLLRGNVTLPTHD

SEQ ID NO: 833816 - protein, 20 aa, Mycobacterium
LIARPPRSAFAPVLRARRHL

SEQ ID NO: 833817 - protein, 20 aa, Mycobacterium
LIARSFAAALGLKFTRVQFT

SEQ ID NO: 833818 - protein, 17 aa, Mycobacterium
LIASAAADLPPGTVLVV

SEQ ID NO: 833819 - protein, 17 aa, Mycobacterium
LIASPMRWKGPSGHSCW

SEQ ID NO: 833820 - protein, 30 aa, Mycobacterium
LIASQLIGLAMTRYVWQIEPIASMSDSEVL

SEQ ID NO: 833821 - protein, 27 aa, Mycobacterium
LIATERVTMLPGPPTLYHSLLGVPDKA

SEQ ID NO: 833822 - protein, 17 aa, Mycobacterium
LIATFNLNRLQAWHMSR

SEQ ID NO: 833823 - protein, 17 aa, Mycobacterium
LIAVPRDYAFDLMLFAQ

SEQ ID NO: 833824 - protein, 22 aa, Mycobacterium
LIAWTTQGFPPGAPYAGPTGKD

SEQ ID NO: 833825 - protein, 19 aa, Mycobacterium
LICAFERSVGLRAPLTEGR

SEQ ID NO: 833826 - protein, 18 aa, Mycobacterium
LICRYSRRAALLQIGLCA

SEQ ID NO: 833827 - protein, 17 aa, Mycobacterium
LICTPARHFSGRLFSRD

SEQ ID NO: 833828 - protein, 20 aa, Mycobacterium
LICVRWIINNEFRWSATRLG

SEQ ID NO: 833829 - protein, 18 aa, Mycobacterium
LIDALQIFEGAQVWMVGV

SEQ ID NO: 833830 - protein, 18 aa, Mycobacterium
LIDALRDGQVGFAALDVF

SEQ ID NO: 833831 - protein, 20 aa, Mycobacterium
LIDAYVWRTFAEPELAYVYY

SEQ ID NO: 833832 - protein, 17 aa, Mycobacterium
LIDDFEWERVLDAGGLF

SEQ ID NO: 833833 - protein, 17 aa, Mycobacterium
LIDDNWAHDFGIDSTSR

SEQ ID NO: 833834 - protein, 26 aa, Mycobacterium
LIDEKYLARPVFQPLFYDSNQRELSA

SEQ ID NO: 833835 - protein, 18 aa, Mycobacterium
LIDENLPVIVVMPSPKNA

SEQ ID NO: 833836 - protein, 19 aa, Mycobacterium
LIDEPKPLRLDDLSLHPAS

SEQ ID NO: 833837 - protein, 26 aa, Mycobacterium
LIDEQLDLFPALKELLTRRAGLLSGG

SEQ ID NO: 833838 - protein, 17 aa, Mycobacterium
LIDFHLDFALGEPDLIR

SEQ ID NO: 833839 - protein, 18 aa, Mycobacterium
LIDFHLDFALTEPDLIRI

SEQ ID NO: 833840 - protein, 30 aa, Mycobacterium
LIDFVLSNLVNARFLRICVLTQYKSHSLDR

SEQ ID NO: 833841 - protein, 31 aa, Mycobacterium
LIDFVLSNLVNARFLRICVLTQYKSHSLDRH

SEQ ID NO: 833842 - protein, 21 aa, Mycobacterium
LIDFVLSNLVNARYLRICVLT

SEQ ID NO: 833843 - protein, 24 aa, Mycobacterium
LIDGHEYLTNYHLAWFGAISHRSG

SEQ ID NO: 833844 - protein, 23 aa, Mycobacterium
LIDGQWVAFPTVEQLERAVFDMV

SEQ ID NO: 833845 - protein, 18 aa, Mycobacterium
LIDHITGLSLPPARGDAR

SEQ ID NO: 833846 - protein, 22 aa, Mycobacterium
LIDIRGLIKNFGVVRALDGLDL

SEQ ID NO: 833847 - protein, 27 aa, Mycobacterium
LIDIVGRPPERLLLEDVPDSSLVCVAD

SEQ ID NO: 833848 - protein, 19 aa, Mycobacterium
LIDKVFTHWGISHTPAALS

SEQ ID NO: 833849 - protein, 23 aa, Mycobacterium
LIDLGTPLWARPSERVAFTAVLL

SEQ ID NO: 833850 - protein, 30 aa, Mycobacterium
LIDPDPMFVPHLLGPLLLGQGIHLVKGFYR

SEQ ID NO: 833851 - protein, 21 aa, Mycobacterium
LIDPLARLLEQTLLGYDQLGL

SEQ ID NO: 833852 - protein, 17 aa, Mycobacterium
LIDPSVPLGLFAFDTGR

SEQ ID NO: 833853 - protein, 27 aa, Mycobacterium
LIDQAGNLEKFQWFVRAHLENAGGKLT

SEQ ID NO: 833854 - protein, 25 aa, Mycobacterium
LIDRAARELGFDPALLRARNLPATQ

SEQ ID NO: 833855 - protein, 18 aa, Mycobacterium
LIDRARMGIGRVITVLTD

SEQ ID NO: 833856 - protein, 18 aa, Mycobacterium
LIDTSVALAWIAQQAALE

SEQ ID NO: 833857 - protein, 17 aa, Mycobacterium
LIDVLAAALPPGPAYYP

SEQ ID NO: 833858 - protein, 19 aa, Mycobacterium
LIDVNLIDPLARLLEQTLL

SEQ ID NO: 833859 - protein, 18 aa, Mycobacterium
LIDVNVLGVFHTVRAALP

SEQ ID NO: 833860 - protein, 18 aa, Mycobacterium
LIDVRILETGKRFGRLRI

SEQ ID NO: 833861 - protein, 17 aa, Mycobacterium
LIDYNRAGVPLIEIVTK

SEQ ID NO: 833862 - protein, 21 aa, Mycobacterium
LIDYYVETFGFVLTARYGQGE

SEQ ID NO: 833863 - protein, 26 aa, Mycobacterium
LIEAIAPVLGFPPRESLVLVTVVGGS

SEQ ID NO: 833864 - protein, 26 aa, Mycobacterium
LIEALGGLPDMPWRLSIFGDGPDREA

SEQ ID NO: 833865 - protein, 25 aa, Mycobacterium
LIEAVKTALWLPGQVHVFIHGEAQA

SEQ ID NO: 833866 - protein, 19 aa, Mycobacterium
LIEAYMQAVSWVRDQAPDE

SEQ ID NO: 833867 - protein, 19 aa, Mycobacterium
LIEDDLPVIVIMPSPKGSA

SEQ ID NO: 833868 - protein, 20 aa, Mycobacterium
LIEDGIILRKYWFSVSGEEQ

SEQ ID NO: 833869 - protein, 18 aa, Mycobacterium
LIEDWSERLSKWEALEAL

SEQ ID NO: 833870 - protein, 19 aa, Mycobacterium
LIEELVAWGGGRLRRPLLG

SEQ ID NO: 833871 - protein, 20 aa, Mycobacterium
LIEEVELTRRGLYGGVLGYL

SEQ ID NO: 833872 - protein, 20 aa, Mycobacterium
LIEHERITMLPGPPTLYHSL

SEQ ID NO: 833873 - protein, 25 aa, Mycobacterium
LIEHPQQFRLLREHPELIPTAVEEF

SEQ ID NO: 833874 - protein, 19 aa, Mycobacterium
LIEHPTVKAAYRTVAETWL

SEQ ID NO: 833875 - protein, 27 aa, Mycobacterium
LIEHRNRFGPAPKRLSPVAQLVHADQL

SEQ ID NO: 833876 - protein, 18 aa, Mycobacterium
LIEIELDQCWDLLRQRRA

SEQ ID NO: 833877 - protein, 29 aa, Mycobacterium
LIEIPSVSTLLQPLLSTIPLQVFAASVAQ

SEQ ID NO: 833878 - protein, 29 aa, Mycobacterium
LIELDIHFRIEDDLYYPALKDATKLIAVA

SEQ ID NO: 833879 - protein, 32 aa, Mycobacterium
LIELDIHFRIEDDLYYPALRAATKLIAVAHAE

SEQ ID NO: 833880 - protein, 29 aa, Mycobacterium
LIELDIHFRIEDDLYYPALSAATKLIAVA

SEQ ID NO: 833881 - protein, 18 aa, Mycobacterium
LIEMYREAKARLGDPVLA

SEQ ID NO: 833882 - protein, 22 aa, Mycobacterium
LIENMGLKPRKAFGPIRVAATG

SEQ ID NO: 833883 - protein, 18 aa, Mycobacterium
LIEPGVRTGLPLLVDNPK

SEQ ID NO: 833884 - protein, 18 aa, Mycobacterium
LIEQDALPGTPLIAMVPV

SEQ ID NO: 833885 - protein, 20 aa, Mycobacterium
LIEQEHITMLPGPPTLYHSL

SEQ ID NO: 833886 - protein, 18 aa, Mycobacterium
LIEQLVDMLLAHGPAGSG

SEQ ID NO: 833887 - protein, 17 aa, Mycobacterium
LIEQVRFAPRAEFEFHH

SEQ ID NO: 833888 - protein, 17 aa, Mycobacterium
LIERDYLGPLRPQAADE

SEQ ID NO: 833889 - protein, 26 aa, Mycobacterium
LIERERITMLPGPPTLYHSLLSVGDK

SEQ ID NO: 833890 - protein, 20 aa, Mycobacterium
LIERERVTMLPGPPTLYHSL

SEQ ID NO: 833891 - protein, 26 aa, Mycobacterium
LIERTFLACEGASKVIVHFYNSTSIL

SEQ ID NO: 833892 - protein, 33 aa, Mycobacterium
LIERYGVTIYYTAPTLIRTFMKWGREIPDSHDL

SEQ ID NO: 833893 - protein, 18 aa, Mycobacterium
LIESGFFDLLRPTRYGGQ

SEQ ID NO: 833894 - protein, 17 aa, Mycobacterium
LIEVIGGQGIRLSSYLP

SEQ ID NO: 833895 - protein, 17 aa, Mycobacterium
LIEWEKGDFVTLPVGAH

SEQ ID NO: 833896 - protein, 25 aa, Mycobacterium
LIFEPPGVLGLIDWALETIAAQESW

SEQ ID NO: 833897 - protein, 17 aa, Mycobacterium
LIFHRGQFVGTATPEAY

SEQ ID NO: 833898 - protein, 21 aa, Mycobacterium
LIFNTLLDGIVANALTPSKWT

SEQ ID NO: 833899 - protein, 18 aa, Mycobacterium
LIGAKPRTKGMERADLLS

SEQ ID NO: 833900 - protein, 18 aa, Mycobacterium
LIGANRLATAVLPGMLER

SEQ ID NO: 833901 - protein, 25 aa, Mycobacterium
LIGASRATAMFLLGDTIDAPTAHTW

SEQ ID NO: 833902 - protein, 18 aa, Mycobacterium
LIGDRLPMDKVLAGVQEI

SEQ ID NO: 833903 - protein, 18 aa, Mycobacterium
LIGDRLPMDKVLAGVTEI

SEQ ID NO: 833904 - protein, 36 aa, Mycobacterium
LIGELGATWSRWGEPLLPIGVLYDPFVERALEPWSY

SEQ ID NO: 833905 - protein, 29 aa, Mycobacterium
LIGEYGITWILPRLAGWGAAADLLLSGRT

SEQ ID NO: 833906 - protein, 18 aa, Mycobacterium
LIGFAAKGTFLRGALDKA

SEQ ID NO: 833907 - protein, 17 aa, Mycobacterium
LIGGDPLRPAPPRSRSP

SEQ ID NO: 833908 - protein, 19 aa, Mycobacterium
LIGKRFGVPVPNLTPWRAS

SEQ ID NO: 833909 - protein, 20 aa, Mycobacterium
LIGKRFGVPVPNLTPWRASV

SEQ ID NO: 833910 - protein, 17 aa, Mycobacterium
LIGLAPTNAELLKTLVR

SEQ ID NO: 833911 - protein, 17 aa, Mycobacterium
LIGLLRGHGGRIAVWGR

SEQ ID NO: 833912 - protein, 19 aa, Mycobacterium
LIGLMKAKEYVLLGDRITP

SEQ ID NO: 833913 - protein, 19 aa, Mycobacterium
LIGMGVIPLQFPEGESASS

SEQ ID NO: 833914 - protein, 31 aa, Mycobacterium
LIGNRIDIPLFPLVAREFSYFGSFWGNYNDL

SEQ ID NO: 833915 - protein, 21 aa, Mycobacterium
LIGRGPGYRYLRARGNSIEGG

SEQ ID NO: 833916 - protein, 28 aa, Mycobacterium
LIGRLDRRGRMLWSLPKGHIELGETAEQ

SEQ ID NO: 833917 - protein, 18 aa, Mycobacterium
LIGSVRGRDIAYLELYWG

SEQ ID NO: 833918 - protein, 21 aa, Mycobacterium
LIGSVWVACPAPLDDAARRAL

SEQ ID NO: 833919 - protein, 24 aa, Mycobacterium
LIGTTARLLYVDPALVGGDILLVD

SEQ ID NO: 833920 - protein, 25 aa, Mycobacterium
LIGVAMARYIVKMEPFASLPAEQIV

SEQ ID NO: 833921 - protein, 18 aa, Mycobacterium
LIGVAWGEFLRTHADYLY

SEQ ID NO: 833922 - protein, 19 aa, Mycobacterium
LIGVWNTVEAAIPALIDGG

SEQ ID NO: 833923 - protein, 30 aa, Mycobacterium
LIHAPTGAVLLQLRWWCLEGRHDPVDELEQ

SEQ ID NO: 833924 - protein, 18 aa, Mycobacterium
LIHDDASWAVFQFVGRRG

SEQ ID NO: 833925 - protein, 26 aa, Mycobacterium
LIHDMQRYFLEPLPVSLRQALVRNVA

SEQ ID NO: 833926 - protein, 25 aa, Mycobacterium
LIHLDALTPARYRVLPFTGARKIDS

SEQ ID NO: 833927 - protein, 18 aa, Mycobacterium
LIHLPAPLITPKGDNWLT

SEQ ID NO: 833928 - protein, 17 aa, Mycobacterium
LIHMDDPLHRDIRKVGA

SEQ ID NO: 833929 - protein, 17 aa, Mycobacterium
LIHPTVVTDLPATARLC

SEQ ID NO: 833930 - protein, 17 aa, Mycobacterium
LIHSELFGALPAINPGV

SEQ ID NO: 833931 - protein, 26 aa, Mycobacterium
LIHTAQLLGLLAKLASLLASVVVDIV

SEQ ID NO: 833932 - protein, 19 aa, Mycobacterium
LIHVNRARLWTLPETVPDL

SEQ ID NO: 833933 - protein, 33 aa, Mycobacterium
LIIEGRRLLDRASRWFLLNRPQPLSIAAEAARF

SEQ ID NO: 833934 - protein, 17 aa, Mycobacterium
LIIIRGRNYYPEDIEAA

SEQ ID NO: 833935 - protein, 21 aa, Mycobacterium
LIILATHLLAPPDLWAAVVLV

SEQ ID NO: 833936 - protein, 21 aa, Mycobacterium
LIIPNDAYGGTFRLIDKVFSQ

SEQ ID NO: 833937 - protein, 22 aa, Mycobacterium
LIIRVTPGCFFPATERPWLVHF

SEQ ID NO: 833938 - protein, 20 aa, Mycobacterium
LIIRVTPGCYFPAADRPWLT

SEQ ID NO: 833939 - protein, 23 aa, Mycobacterium
LIKARDPQCVPIADALGLVLASD

SEQ ID NO: 833940 - protein, 17 aa, Mycobacterium
LIKLIPQAKNLFPEYRA

SEQ ID NO: 833941 - protein, 25 aa, Mycobacterium
LIKNPLLMQIYADVTGLPLSCVTST

SEQ ID NO: 833942 - protein, 17 aa, Mycobacterium
LIKSSKLTRLREDIVTP

SEQ ID NO: 833943 - protein, 19 aa, Mycobacterium
LIKWMSRLNTWMYRRNGGE

SEQ ID NO: 833944 - protein, 18 aa, Mycobacterium
LILAALERWMDENRYAGL

SEQ ID NO: 833945 - protein, 37 aa, Mycobacterium
LILAPQGLEYILAFLGSMQAGLIAVPLPLPHRGSGHD

SEQ ID NO: 833946 - protein, 40 aa, Mycobacterium
LILAPQSLEYILAFLGSMQAGLIAVPLPLPHRGSSLDRVS

SEQ ID NO: 833947 - protein, 18 aa, Mycobacterium
LILDHDEHMRPETTKEGL

SEQ ID NO: 833948 - protein, 17 aa, Mycobacterium
LILEWDYTRDSYDADAI

SEQ ID NO: 833949 - protein, 18 aa, Mycobacterium
LILIPREGYFQAGCFLPK

SEQ ID NO: 833950 - protein, 20 aa, Mycobacterium
LILKAIDQDGWHFAASSVSQ

SEQ ID NO: 833951 - protein, 19 aa, Mycobacterium
LILMRHAKSAYPPGVDDHQ

SEQ ID NO: 833952 - protein, 35 aa, Mycobacterium
LILTTVQMATYLQIPMDRWVFPYAGTDSHDTYAIG

SEQ ID NO: 833953 - protein, 17 aa, Mycobacterium
LILVARRAERLEALRRT

SEQ ID NO: 833954 - protein, 17 aa, Mycobacterium
LIMAIVNRTPDSFYDKG

SEQ ID NO: 833955 - protein, 29 aa, Mycobacterium
LIMTSYPIDQGVKKVYYWTARRIGGEFVP

SEQ ID NO: 833956 - protein, 28 aa, Mycobacterium
LINIHHSFLPAFIGAAPYRRAKERGVKL

SEQ ID NO: 833957 - protein, 20 aa, Mycobacterium
LINKPYLRDVFRGAPGEFDC

SEQ ID NO: 833958 - protein, 30 aa, Mycobacterium
LINMEFIQFHPTGMVWPPSVKGILVTEGVR

SEQ ID NO: 833959 - protein, 20 aa, Mycobacterium
LINMEFVQFHPTGMVWPPSV

SEQ ID NO: 833960 - protein, 17 aa, Mycobacterium
LINRRGDSVLGQPPLRS

SEQ ID NO: 833961 - protein, 34 aa, Mycobacterium
LINSAPRRWLQRVYEVPVLLRFGGRLVPDTQALE

SEQ ID NO: 833962 - protein, 17 aa, Mycobacterium
LINWWDPDGARRTLEEL

SEQ ID NO: 833963 - protein, 27 aa, Mycobacterium
LIPAVNKLGTMGLILNGSDELKKQVLP

SEQ ID NO: 833964 - protein, 27 aa, Mycobacterium
LIPDPHPYFDYLRSQSPVLRLPQYGVV

SEQ ID NO: 833965 - protein, 26 aa, Mycobacterium
LIPEAYRGRRLAWSDSWLTSPGGGNL

SEQ ID NO: 833966 - protein, 20 aa, Mycobacterium
LIPFAEPGACRLFLPDPVVR

SEQ ID NO: 833967 - protein, 27 aa, Mycobacterium
LIPGAFWASYQYRREDMLPFYEDEHSA

SEQ ID NO: 833968 - protein, 19 aa, Mycobacterium
LIPGFIEESLRMDSPVKSD

SEQ ID NO: 833969 - protein, 19 aa, Mycobacterium
LIPGLAYLDQSELAPNIQI

SEQ ID NO: 833970 - protein, 26 aa, Mycobacterium
LIPHIEESFYAVLGDLLRAAQQAGTV

SEQ ID NO: 833971 - protein, 17 aa, Mycobacterium
LIPKLMTAGVIEVAPLA

SEQ ID NO: 833972 - protein, 18 aa, Mycobacterium
LIPLRGGLIDLNAFADEA

SEQ ID NO: 833973 - protein, 20 aa, Mycobacterium
LIPNFAAGAVKAFIAAGLWS

SEQ ID NO: 833974 - protein, 23 aa, Mycobacterium
LIPQDWRRREPAPRPVRQAASNP

SEQ ID NO: 833975 - protein, 19 aa, Mycobacterium
LIPQSRFVALPSNNHLLTG

SEQ ID NO: 833976 - protein, 18 aa, Mycobacterium
LIPRGATLVSLAKGIELG

SEQ ID NO: 833977 - protein, 21 aa, Mycobacterium
LIPTRAPGLRLALNAAAPRSR

SEQ ID NO: 833978 - protein, 27 aa, Mycobacterium
LIPVRPDLPDVLLPQNYQPPKDLAPPP

SEQ ID NO: 833979 - protein, 33 aa, Mycobacterium
LIPVYDKPMVYYPLSTLMLAGIRDILVITTPHD

SEQ ID NO: 833980 - protein, 19 aa, Mycobacterium
LIQPVAMFSSFPTIITLDP

SEQ ID NO: 833981 - protein, 21 aa, Mycobacterium
LIQRIVDRLPQKAPLIELDVQ

SEQ ID NO: 833982 - protein, 31 aa, Mycobacterium
LIQSCRRIAIPELPLELFIESLRQLIAVDAE

SEQ ID NO: 833983 - protein, 32 aa, Mycobacterium
LIQSREGAWSPVALRLAEWLQKAEASLAVVDQ

SEQ ID NO: 833984 - protein, 18 aa, Mycobacterium
LIQVLLGWENFPGYDTNP

SEQ ID NO: 833985 - protein, 26 aa, Mycobacterium
LIQVMRDLLAAPEQYDWLATRLEIAR

SEQ ID NO: 833986 - protein, 21 aa, Mycobacterium
LIRAARLTRSYLDLALDGAVA

SEQ ID NO: 833987 - protein, 20 aa, Mycobacterium
LIRACAVRRAGGLPLLYYSG

SEQ ID NO: 833988 - protein, 17 aa, Mycobacterium
LIRAFLTAPPARSAAFM

SEQ ID NO: 833989 - protein, 18 aa, Mycobacterium
LIRAMEKFDYAKGFKFST

SEQ ID NO: 833990 - protein, 19 aa, Mycobacterium
LIRCWVVLERPAGKRLAPM

SEQ ID NO: 833991 - protein, 18 aa, Mycobacterium
LIRDARVLVAQRVRPPEL

SEQ ID NO: 833992 - protein, 18 aa, Mycobacterium
LIRDPYIETSAYARTLGI

SEQ ID NO: 833993 - protein, 18 aa, Mycobacterium
LIRDVGIPGYLRATTGLV

SEQ ID NO: 833994 - protein, 17 aa, Mycobacterium
LIREALHPYPENLALVS

SEQ ID NO: 833995 - protein, 18 aa, Mycobacterium
LIREAWEPVLKNWQEMSA

SEQ ID NO: 833996 - protein, 19 aa, Mycobacterium
LIRERLVRSWAGLKAMRSY

SEQ ID NO: 833997 - protein, 19 aa, Mycobacterium
LIRGDDLCWTLIKELEQLQ

SEQ ID NO: 833998 - protein, 17 aa, Mycobacterium
LIRGVFYAGWDPGGVPV

SEQ ID NO: 833999 - protein, 22 aa, Mycobacterium
LIRIHPRRIVVWGLDSESPALH

SEQ ID NO: 834000 - protein, 17 aa, Mycobacterium
LIRLALTTKMKPYAYVS

SEQ ID NO: 834001 - protein, 19 aa, Mycobacterium
LIRLALTTRLKPYTFVSTA

SEQ ID NO: 834002 - protein, 18 aa, Mycobacterium
LIRLVEDAMRFYMEAHYD

SEQ ID NO: 834003 - protein, 17 aa, Mycobacterium
LIRPLSAYVGPPQRPLT

SEQ ID NO: 834004 - protein, 25 aa, Mycobacterium
LIRPSVGIAEWILPTIISAGTEDLQ

SEQ ID NO: 834005 - protein, 23 aa, Mycobacterium
LIRPVIAELRRKLVVSAAETGMQ

SEQ ID NO: 834006 - protein, 18 aa, Mycobacterium
LIRRLWRRAVIVLPSGRD

SEQ ID NO: 834007 - protein, 18 aa, Mycobacterium
LIRSLDRPGRLTLVEGAG

SEQ ID NO: 834008 - protein, 40 aa, Mycobacterium
LIRTSQDWWPADYGNYAGLFVRMSWHAAGTYRIFDGRGGA

SEQ ID NO: 834009 - protein, 19 aa, Mycobacterium
LIRVIEDATRFYLEAYHDL

SEQ ID NO: 834010 - protein, 24 aa, Mycobacterium
LISADAHLLLPYHVAIDKVTERYM

SEQ ID NO: 834011 - protein, 25 aa, Mycobacterium
LISADAHLLLPYHVAIDKVTERYMG

SEQ ID NO: 834012 - protein, 24 aa, Mycobacterium
LISEAFSYPIEAFTDVAQRSAIVM

SEQ ID NO: 834013 - protein, 24 aa, Mycobacterium
LISFDEAFKLVKVNPLAAWTDQDM

SEQ ID NO: 834014 - protein, 18 aa, Mycobacterium
LISGGRFVFGVGAGWNIE

SEQ ID NO: 834015 - protein, 23 aa, Mycobacterium
LISIADLIEWRRKHEKHIARVAE

SEQ ID NO: 834016 - protein, 28 aa, Mycobacterium
LISLLRDDPRIRRFAETELRALLAHDAG

SEQ ID NO: 834017 - protein, 19 aa, Mycobacterium
LISLVGSSALLLAILHARD

SEQ ID NO: 834018 - protein, 18 aa, Mycobacterium
LISNGRFVFGVGAGWNLE

SEQ ID NO: 834019 - protein, 25 aa, Mycobacterium
LISPENKAYYFAAAFPSACGKTNLA

SEQ ID NO: 834020 - protein, 23 aa, Mycobacterium
LISPWGTWEWLGPAAVGATLPAR

SEQ ID NO: 834021 - protein, 26 aa, Mycobacterium
LISPWGTWEWLGPAVRAAVLPAGDTV

SEQ ID NO: 834022 - protein, 24 aa, Mycobacterium
LISRLSAILRCSVLLYNELGDVVA

SEQ ID NO: 834023 - protein, 18 aa, Mycobacterium
LISSCGAALNHCVIALAA

SEQ ID NO: 834024 - protein, 21 aa, Mycobacterium
LISSGRLRDVWKEWLPTLDYP

SEQ ID NO: 834025 - protein, 30 aa, Mycobacterium
LISSQMMGFALMRYVWKIEPVASMTDDEAI

SEQ ID NO: 834026 - protein, 17 aa, Mycobacterium
LISSRSPSDLPAFCAAI

SEQ ID NO: 834027 - protein, 19 aa, Mycobacterium
LISSWKAYAPAWAGKVAIE

SEQ ID NO: 834028 - protein, 21 aa, Mycobacterium
LISTKQVAALLFNPQTAGSVT

SEQ ID NO: 834029 - protein, 24 aa, Mycobacterium
LISWDNAFGLVKINPIAAWTDEDM

SEQ ID NO: 834030 - protein, 17 aa, Mycobacterium
LITAPRLDQAPYAAPPV

SEQ ID NO: 834031 - protein, 18 aa, Mycobacterium
LITDHRVTFLTTVPTIMQ

SEQ ID NO: 834032 - protein, 24 aa, Mycobacterium
LITEAIAAKPFEYWRRHLKTMKGQ

SEQ ID NO: 834033 - protein, 26 aa, Mycobacterium
LITELLHTSTRFRNLWSHHEVAHAPV

SEQ ID NO: 834034 - protein, 25 aa, Mycobacterium
LITGQKRFITNAPVADLFVVFARTR

SEQ ID NO: 834035 - protein, 17 aa, Mycobacterium
LITHGWPGSVVEFHKVI

SEQ ID NO: 834036 - protein, 20 aa, Mycobacterium
LITIKHYWQEWEDPRLIVAI

SEQ ID NO: 834037 - protein, 23 aa, Mycobacterium
LITLDVPGTWPSPAFTPARPDEF

SEQ ID NO: 834038 - protein, 18 aa, Mycobacterium
LITLGTPHRGALKALAVL

SEQ ID NO: 834039 - protein, 34 aa, Mycobacterium
LITLPNGRYSWRISLPAMVCYWSELARDAALPPP

SEQ ID NO: 834040 - protein, 19 aa, Mycobacterium
LITLVFMITDMFDGEALVQ

SEQ ID NO: 834041 - protein, 17 aa, Mycobacterium
LITNMRGYWNLEMMQFG

SEQ ID NO: 834042 - protein, 25 aa, Mycobacterium
LITNSDIATHFIVFAKTAPTEVSAF

SEQ ID NO: 834043 - protein, 22 aa, Mycobacterium
LITPSLTSPAFYPYAIEHMRRG

SEQ ID NO: 834044 - protein, 28 aa, Mycobacterium
LITRFENTALLPLKPLLSVSGLDSQIAV

SEQ ID NO: 834045 - protein, 19 aa, Mycobacterium
LITRYTIIHGLVDAPTQYG

SEQ ID NO: 834046 - protein, 17 aa, Mycobacterium
LITSITATLRMVRQRPA

SEQ ID NO: 834047 - protein, 26 aa, Mycobacterium
LIVADLSFISLASVLPALAGCASPTA

SEQ ID NO: 834048 - protein, 26 aa, Mycobacterium
LIVDFGLDLLWHPSLGLELGNNAQKV

SEQ ID NO: 834049 - protein, 26 aa, Mycobacterium
LIVDRYRVFLELGPHPVLLGNIRESF

SEQ ID NO: 834050 - protein, 17 aa, Mycobacterium
LIVNRALELAGAEQAIL

SEQ ID NO: 834051 - protein, 18 aa, Mycobacterium
LIVNYRLMPKHSIGMALD

SEQ ID NO: 834052 - protein, 19 aa, Mycobacterium
LIVQAYLFAADGYAVRIRV

SEQ ID NO: 834053 - protein, 18 aa, Mycobacterium
LIVQIRTIDRAGLLARLT

SEQ ID NO: 834054 - protein, 17 aa, Mycobacterium
LIVSAQLPDGGTGLFLV

SEQ ID NO: 834055 - protein, 19 aa, Mycobacterium
LIVTRVPNAFLTTLGSTGN

SEQ ID NO: 834056 - protein, 17 aa, Mycobacterium
LIVVLPGPPHELQRMWQ

SEQ ID NO: 834057 - protein, 18 aa, Mycobacterium
LIVWTTIPEARQVPGLWT

SEQ ID NO: 834058 - protein, 17 aa, Mycobacterium
LIYVDQYGNPLLNISVG

SEQ ID NO: 834059 - protein, 19 aa, Mycobacterium
LKAAAFPVPKTLESFDVAA

SEQ ID NO: 834060 - protein, 19 aa, Mycobacterium
LKAALQFPAFAGPVFDSLT

SEQ ID NO: 834061 - protein, 19 aa, Mycobacterium
LKAARVLSLAQDTADRLTA

SEQ ID NO: 834062 - protein, 19 aa, Mycobacterium
LKADDRLTLFRQRGGKFVV

SEQ ID NO: 834063 - protein, 17 aa, Mycobacterium
LKAHTALLSLRQFVQHN

SEQ ID NO: 834064 - protein, 21 aa, Mycobacterium
LKAILDRTPWRAEEPIVIVAP

SEQ ID NO: 834065 - protein, 19 aa, Mycobacterium
LKAILDRTPWRAEETVVVV

SEQ ID NO: 834066 - protein, 21 aa, Mycobacterium
LKAILDRTPWRAEQPIVIVAP

SEQ ID NO: 834067 - protein, 19 aa, Mycobacterium
LKALCRKHHLLKTFGQWTE

SEQ ID NO: 834068 - protein, 18 aa, Mycobacterium
LKALGIDLPAELLTIALT

SEQ ID NO: 834069 - protein, 19 aa, Mycobacterium
LKALGLGLEIRPLRGNLDT

SEQ ID NO: 834070 - protein, 25 aa, Mycobacterium
LKALHRRCADVRYLGSWPTGQAVGM

SEQ ID NO: 834071 - protein, 24 aa, Mycobacterium
LKALHRRCADVRYLGSWPTGSPAG

SEQ ID NO: 834072 - protein, 20 aa, Mycobacterium
LKAMGVYPGLDGAAPVIGGE

SEQ ID NO: 834073 - protein, 22 aa, Mycobacterium
LKAMGVYPGLDGAAPVIGGECV

SEQ ID NO: 834074 - protein, 20 aa, Mycobacterium
LKAQFAKWQLPDEYAYIVEV

SEQ ID NO: 834075 - protein, 18 aa, Mycobacterium
LKAQILAKDFAKPEIVAD

SEQ ID NO: 834076 - protein, 30 aa, Mycobacterium
LKAVADKLMSALTGLGLKPFGAEGEDFDPV

SEQ ID NO: 834077 - protein, 24 aa, Mycobacterium
LKAWAESLLQMHLMDGYGSTEAGM

SEQ ID NO: 834078 - protein, 20 aa, Mycobacterium
LKCAKGFRFYAENAEAMLAP

SEQ ID NO: 834079 - protein, 31 aa, Mycobacterium
LKCLCRTHHLVKTFWGWTEKQLADGTLILTS

SEQ ID NO: 834080 - protein, 26 aa, Mycobacterium
LKDAQTPTLLFPFAAPKVVGDLSEAG

SEQ ID NO: 834081 - protein, 27 aa, Mycobacterium
LKDAQTPTLLFPFAAPRVAGDMSEVGS

SEQ ID NO: 834082 - protein, 25 aa, Mycobacterium
LKDDFTALDALFAWYSTMGSVTGVS

SEQ ID NO: 834083 - protein, 20 aa, Mycobacterium
LKDFRFIPCLSQQAPDPVPN

SEQ ID NO: 834084 - protein, 33 aa, Mycobacterium
LKDGDALFFGHGLNIHFGLIKPPANVTVAMVAP

SEQ ID NO: 834085 - protein, 29 aa, Mycobacterium
LKDHRDVMFPFMTVKFLYDVFGTVNGTRA

SEQ ID NO: 834086 - protein, 17 aa, Mycobacterium
LKDIRRLEMLEGMGWLI

SEQ ID NO: 834087 - protein, 21 aa, Mycobacterium
LKDKQLYTLDLGSLVAGSRYR

SEQ ID NO: 834088 - protein, 20 aa, Mycobacterium
LKDRFGLSWQIVPDRLYELI

SEQ ID NO: 834089 - protein, 19 aa, Mycobacterium
LKDRPFVPATPPAFGERET

SEQ ID NO: 834090 - protein, 19 aa, Mycobacterium
LKDWFGFLAERGLDWRGVR

SEQ ID NO: 834091 - protein, 20 aa, Mycobacterium
LKEELLRIIEWDHLLRYGTA

SEQ ID NO: 834092 - protein, 24 aa, Mycobacterium
LKEGQAVIFPADRSDVLLAVASAH

SEQ ID NO: 834093 - protein, 18 aa, Mycobacterium
LKELAVRFAKPVLPGQDI

SEQ ID NO: 834094 - protein, 22 aa, Mycobacterium
LKERGFRLLALTPKGDARALPE

SEQ ID NO: 834095 - protein, 18 aa, Mycobacterium
LKEWRLRVSKEMKVPAYV

SEQ ID NO: 834096 - protein, 32 aa, Mycobacterium
LKFDAPQLLTFPDLFPNGLANKYTFGPIGELW

SEQ ID NO: 834097 - protein, 18 aa, Mycobacterium
LKFDVSLPLASIGGFARE

SEQ ID NO: 834098 - protein, 19 aa, Mycobacterium
LKFEKTLMAIWRAIQNIGT

SEQ ID NO: 834099 - protein, 19 aa, Mycobacterium
LKFEVLQALWRRGGEDREL

SEQ ID NO: 834100 - protein, 20 aa, Mycobacterium
LKFHLRDLAVTFRFGEEVTA

SEQ ID NO: 834101 - protein, 18 aa, Mycobacterium
LKFLGALRNAGVQHLALR

SEQ ID NO: 834102 - protein, 18 aa, Mycobacterium
LKGFKNRFRTEYQVVNVA

SEQ ID NO: 834103 - protein, 18 aa, Mycobacterium
LKGFKNRFRTEYQVVNVG

SEQ ID NO: 834104 - protein, 18 aa, Mycobacterium
LKGFRNRFRTEYGVVNVG

SEQ ID NO: 834105 - protein, 31 aa, Mycobacterium
LKGHFATMRHAASYWRGLSKAGKAVDARIIN

SEQ ID NO: 834106 - protein, 24 aa, Mycobacterium
LKGHPLFAHITLLRSERSPIAALV

SEQ ID NO: 834107 - protein, 22 aa, Mycobacterium
LKGLFDHLGLGRVPLVGNSLGG

SEQ ID NO: 834108 - protein, 18 aa, Mycobacterium
LKGLLDRGVVPHTQARAV

SEQ ID NO: 834109 - protein, 21 aa, Mycobacterium
LKGLRVVELAGIGPGPHAAMI

SEQ ID NO: 834110 - protein, 26 aa, Mycobacterium
LKGRIAKYWTLNPHPTLIPAIESGWV

SEQ ID NO: 834111 - protein, 17 aa, Mycobacterium
LKGTWNGTKAAAAIMRE

SEQ ID NO: 834112 - protein, 24 aa, Mycobacterium
LKGTWNGTRLAAAIMRENKRGAIV

SEQ ID NO: 834113 - protein, 24 aa, Mycobacterium
LKHALYPRLLTIARDWWAKLGRDS

SEQ ID NO: 834114 - protein, 37 aa, Mycobacterium
LKHHDFDYVFIDCPPSLGLLTINALVAAPEVLIPIQC

SEQ ID NO: 834115 - protein, 26 aa, Mycobacterium
LKHTPIRSVLSFKLFRGSQTAGTLNL

SEQ ID NO: 834116 - protein, 20 aa, Mycobacterium
LKIAREWSGERVQWGKPLAE

SEQ ID NO: 834117 - protein, 20 aa, Mycobacterium
LKIAREWSGERVQWGKPLGK

SEQ ID NO: 834118 - protein, 17 aa, Mycobacterium
LKIFPLVGWAERGGYGA

SEQ ID NO: 834119 - protein, 25 aa, Mycobacterium
LKILASPVRRYAAYTAAIRAEHPDL

SEQ ID NO: 834120 - protein, 18 aa, Mycobacterium
LKIVKRLLDTGISLHNIR

SEQ ID NO: 834121 - protein, 21 aa, Mycobacterium
LKIVMRVYFEKPRTTVGWKGL

SEQ ID NO: 834122 - protein, 25 aa, Mycobacterium
LKKEGPLYALFLNCTLKSAPEVSNT

SEQ ID NO: 834123 - protein, 24 aa, Mycobacterium
LKKHFRPEFLNRIDDIIVFEQLTQ

SEQ ID NO: 834124 - protein, 21 aa, Mycobacterium
LKKLIGKVPFASDAMDVLDSA

SEQ ID NO: 834125 - protein, 18 aa, Mycobacterium
LKKVLLGSVAGATLQRTF

SEQ ID NO: 834126 - protein, 23 aa, Mycobacterium
LKKVRVILEPGWHDATYDISFDL

SEQ ID NO: 834127 - protein, 36 aa, Mycobacterium
LKLAGIQPVWLREGLRFWMRTAITHQLFTWTTAVSR

SEQ ID NO: 834128 - protein, 25 aa, Mycobacterium
LKLEAEIYHKFASGIYQPLPVEVFD

SEQ ID NO: 834129 - protein, 18 aa, Mycobacterium
LKLFPLVGWAERGGYDAQ

SEQ ID NO: 834130 - protein, 24 aa, Mycobacterium
LKLGLGMLFQHHSAFKKIAVVTDK

SEQ ID NO: 834131 - protein, 20 aa, Mycobacterium
LKLHRQHYYAWLSCPVADAE

SEQ ID NO: 834132 - protein, 23 aa, Mycobacterium
LKLINHPLRERIPISIAALGPRN

SEQ ID NO: 834133 - protein, 17 aa, Mycobacterium
LKLLPTNEPKIELLLST

SEQ ID NO: 834134 - protein, 18 aa, Mycobacterium
LKLQLWVKERGEKICIIF

SEQ ID NO: 834135 - protein, 17 aa, Mycobacterium
LKLRPSLWRDAGEVTWL

SEQ ID NO: 834136 - protein, 24 aa, Mycobacterium
LKLTPADWDRLLSVNLMGVVHGCR

SEQ ID NO: 834137 - protein, 19 aa, Mycobacterium
LKMGGAPIRSQYAFSPTLG

SEQ ID NO: 834138 - protein, 31 aa, Mycobacterium
LKMSPEVLTKPRWFFSFAKTLRPPDLRVPNQ

SEQ ID NO: 834139 - protein, 19 aa, Mycobacterium
LKNLRFVGEPGQIALLRAH

SEQ ID NO: 834140 - protein, 20 aa, Mycobacterium
LKNVFAIASGMGYAIGIGEN

SEQ ID NO: 834141 - protein, 20 aa, Mycobacterium
LKNVFAIAVGMGYSLGIGEN

SEQ ID NO: 834142 - protein, 21 aa, Mycobacterium
LKNVWVEAIWRFSTGSFRHAN

SEQ ID NO: 834143 - protein, 20 aa, Mycobacterium
LKPDLVIMDVKMPRRDGIDA

SEQ ID NO: 834144 - protein, 33 aa, Mycobacterium
LKPEGKAIIQWRPLQWFAQRPPGRYQRSDGQML

SEQ ID NO: 834145 - protein, 17 aa, Mycobacterium
LKPEVCWQLPIRRTQEW

SEQ ID NO: 834146 - protein, 18 aa, Mycobacterium
LKPFWDTHPWERADLRRL

SEQ ID NO: 834147 - protein, 17 aa, Mycobacterium
LKPGRLFRSGELSGLDD

SEQ ID NO: 834148 - protein, 26 aa, Mycobacterium
LKPITHPLRADIPIMLGAEGPKNVAL

SEQ ID NO: 834149 - protein, 25 aa, Mycobacterium
LKPITHPLRADIPIMLGAEGPRNVA

SEQ ID NO: 834150 - protein, 19 aa, Mycobacterium
LKPITHPLRPDIPIMLGAE

SEQ ID NO: 834151 - protein, 26 aa, Mycobacterium
LKPQLVHYYFRTMDDLFLAVFRRRAE

SEQ ID NO: 834152 - protein, 23 aa, Mycobacterium
LKPQLVHYYFRTMDDLFLEVFRR

SEQ ID NO: 834153 - protein, 23 aa, Mycobacterium
LKPQLVHYYFRTMDELFLEVFRR

SEQ ID NO: 834154 - protein, 26 aa, Mycobacterium
LKPQLVHYYFRTMEDLFLAVFHRRAE

SEQ ID NO: 834155 - protein, 17 aa, Mycobacterium
LKPREWYDEKDIALRLG

SEQ ID NO: 834156 - protein, 21 aa, Mycobacterium
LKPSAIRRLGLTYEQLRRHNE

SEQ ID NO: 834157 - protein, 25 aa, Mycobacterium
LKPSFRQRFVTLAMHYLPPDREADV

SEQ ID NO: 834158 - protein, 23 aa, Mycobacterium
LKPSFRQRFVTLPMRYLPPEREA

SEQ ID NO: 834159 - protein, 23 aa, Mycobacterium
LKPSLIEAFTSDVPYLKSIGDFA

SEQ ID NO: 834160 - protein, 23 aa, Mycobacterium
LKPVPVVDAIMRKLGRHEDFVLV

SEQ ID NO: 834161 - protein, 24 aa, Mycobacterium
LKQDGMLALARLQRKMRLVESPYR

SEQ ID NO: 834162 - protein, 18 aa, Mycobacterium
LKQILTIGPVPEALNGVA

SEQ ID NO: 834163 - protein, 27 aa, Mycobacterium
LKQKADLRLIVIDYLQLMTSGKKVESR

SEQ ID NO: 834164 - protein, 21 aa, Mycobacterium
LKQLPEVDILINNLGIFGATP

SEQ ID NO: 834165 - protein, 19 aa, Mycobacterium
LKRALAKLADRFDVVIIDC

SEQ ID NO: 834166 - protein, 20 aa, Mycobacterium
LKRAWELMGMRVHWQSSNDL

SEQ ID NO: 834167 - protein, 31 aa, Mycobacterium
LKRHGEWMVPTRLALVRRLGSIELDLTKARF

SEQ ID NO: 834168 - protein, 26 aa, Mycobacterium
LKRIQRRTVPLPLSQKIFDSRWVPAQ

SEQ ID NO: 834169 - protein, 17 aa, Mycobacterium
LKRLGIGGGFFSFGIMH

SEQ ID NO: 834170 - protein, 17 aa, Mycobacterium
LKRLIDTGIIDFSDLPA

SEQ ID NO: 834171 - protein, 17 aa, Mycobacterium
LKRLLPTGRISGSTDSQ

SEQ ID NO: 834172 - protein, 26 aa, Mycobacterium
LKRLRGMFAFALWDTVTRELFCARDP

SEQ ID NO: 834173 - protein, 20 aa, Mycobacterium
LKRPFGIGVIDWVIRKEPEL

SEQ ID NO: 834174 - protein, 23 aa, Mycobacterium
LKRPSLPAVLAGRGPFVGREDEL

SEQ ID NO: 834175 - protein, 20 aa, Mycobacterium
LKRSLMLGTRWEQEGAQLVP

SEQ ID NO: 834176 - protein, 23 aa, Mycobacterium
LKRVGELIDRYPLRGIKGPMGTA

SEQ ID NO: 834177 - protein, 18 aa, Mycobacterium
LKSDFDIGFLCITDDLFI

SEQ ID NO: 834178 - protein, 19 aa, Mycobacterium
LKSETMFPGYYKRPETTAD

SEQ ID NO: 834179 - protein, 19 aa, Mycobacterium
LKSILDRTPWRAEQPVVIV

SEQ ID NO: 834180 - protein, 18 aa, Mycobacterium
LKSPAHLWQLDALLAEYP

SEQ ID NO: 834181 - protein, 28 aa, Mycobacterium
LKSQGVRPRVWFGEGWITSVLDLYHENI

SEQ ID NO: 834182 - protein, 18 aa, Mycobacterium
LKSRLMIAAVAAGATAAG

SEQ ID NO: 834183 - protein, 17 aa, Mycobacterium
LKSRMLLQVHDELLFEV

SEQ ID NO: 834184 - protein, 30 aa, Mycobacterium
LKSRPTRPHPLFSAFIRAAMEYKAAERLPL

SEQ ID NO: 834185 - protein, 34 aa, Mycobacterium
LKTFAYGASPMPLPLLRQALEAWPNTDFMQAYGL

SEQ ID NO: 834186 - protein, 18 aa, Mycobacterium
LKTFGGWRDKQLADGTVV

SEQ ID NO: 834187 - protein, 20 aa, Mycobacterium
LKTGELVTPVPMPAAAPAPT

SEQ ID NO: 834188 - protein, 19 aa, Mycobacterium
LKTGHYPQALALIQMTRGA

SEQ ID NO: 834189 - protein, 20 aa, Mycobacterium
LKTKPPLCIDTESADFYVDT

SEQ ID NO: 834190 - protein, 25 aa, Mycobacterium
LKTLMLDYAFINADLVWFHVAAANL

SEQ ID NO: 834191 - protein, 28 aa, Mycobacterium
LKTQGVRPRVWFGEQWITSILDLFKENA

SEQ ID NO: 834192 - protein, 28 aa, Mycobacterium
LKTQGVRPRVWFGEQWITSVLDLYRENI

SEQ ID NO: 834193 - protein, 19 aa, Mycobacterium
LKTQWAQAGARLGLSLDPK

SEQ ID NO: 834194 - protein, 22 aa, Mycobacterium
LKTRAMTFIRRSGVHDSGRPHA

SEQ ID NO: 834195 - protein, 19 aa, Mycobacterium
LKTYYLPSEDRRIKLRVST

SEQ ID NO: 834196 - protein, 19 aa, Mycobacterium
LKTYYLPSENRRIKLRVSA

SEQ ID NO: 834197 - protein, 20 aa, Mycobacterium
LKVATGIVNIWSAAAGPVAE

SEQ ID NO: 834198 - protein, 18 aa, Mycobacterium
LKVAVVCKSLFGKAHTVM

SEQ ID NO: 834199 - protein, 24 aa, Mycobacterium
LKVGDIFAGYTIVRLLGAGGMGEV

SEQ ID NO: 834200 - protein, 20 aa, Mycobacterium
LKVGYKWYDAENRTPLFPFG

SEQ ID NO: 834201 - protein, 20 aa, Mycobacterium
LKVIAAVHPGLWQPGVLAKL

SEQ ID NO: 834202 - protein, 32 aa, Mycobacterium
LKVIARLFGLPYFPVTPLFPAAGPVGLVPLPS

SEQ ID NO: 834203 - protein, 24 aa, Mycobacterium
LKVIDANLIGTFRLAKRASRNMIK

SEQ ID NO: 834204 - protein, 26 aa, Mycobacterium
LKVINPFDFFIEDWAETWPAQGLTYP

SEQ ID NO: 834205 - protein, 43 aa, Mycobacterium
LKVQGVRPRVWFGERWITSIFDLFEENVLYFPSLLPEISDEDP

SEQ ID NO: 834206 - protein, 24 aa, Mycobacterium
LKVRDRTSYEFAICSAAVALDIQG

SEQ ID NO: 834207 - protein, 18 aa, Mycobacterium
LKVRLAPAKAVAKITGQV

SEQ ID NO: 834208 - protein, 19 aa, Mycobacterium
LKVTHPAAIVWAAQMGTIT

SEQ ID NO: 834209 - protein, 18 aa, Mycobacterium
LKVTHPSAIVWAAQMGTI

SEQ ID NO: 834210 - protein, 22 aa, Mycobacterium
LKVVDEWLNGYRAMWTHNLDAF

SEQ ID NO: 834211 - protein, 21 aa, Mycobacterium
LKVVDLLTPYVRGGKIALFGG

SEQ ID NO: 834212 - protein, 17 aa, Mycobacterium
LKWGVAVPPDDYDHWAP

SEQ ID NO: 834213 - protein, 19 aa, Mycobacterium
LKWVPGIANYPDRVPLIFD

SEQ ID NO: 834214 - protein, 21 aa, Mycobacterium
LKYFTEHLPATFVYAGIEVER

SEQ ID NO: 834215 - protein, 17 aa, Mycobacterium
LKYRYLDLRREVPGNAI

SEQ ID NO: 834216 - protein, 21 aa, Mycobacterium
LKYVPNMLAVSFRTGRDAAIG

SEQ ID NO: 834217 - protein, 19 aa, Mycobacterium
LLAAAQMWFAPVNGYAEVV

SEQ ID NO: 834218 - protein, 30 aa, Mycobacterium
LLAACAALPRPPLFLMASSAAVYGSRNPYR

SEQ ID NO: 834219 - protein, 30 aa, Mycobacterium
LLAACATLPRPPLFLMASSAAVYGSRNPFR

SEQ ID NO: 834220 - protein, 21 aa, Mycobacterium
LLAADAGVPVLLAPATNVATA

SEQ ID NO: 834221 - protein, 26 aa, Mycobacterium
LLAAERARLRFLLVDDAQQLDPQAAR

SEQ ID NO: 834222 - protein, 18 aa, Mycobacterium
LLAAIKQAARVVPTNFLV

SEQ ID NO: 834223 - protein, 18 aa, Mycobacterium
LLAAKRLLSQTQSISLLA

SEQ ID NO: 834224 - protein, 25 aa, Mycobacterium
LLAALPGLARILLDEPRKVFGSLAN

SEQ ID NO: 834225 - protein, 20 aa, Mycobacterium
LLAALRLADRLIPHRAWILI

SEQ ID NO: 834226 - protein, 23 aa, Mycobacterium
LLAARLVAQIRAQFGIDLTVRAV

SEQ ID NO: 834227 - protein, 23 aa, Mycobacterium
LLAATFNSLIPPAPMPPSEGSLR

SEQ ID NO: 834228 - protein, 20 aa, Mycobacterium
LLAATRRPVALPRLAALAQW

SEQ ID NO: 834229 - protein, 17 aa, Mycobacterium
LLADAGATALLYHSAFA

SEQ ID NO: 834230 - protein, 18 aa, Mycobacterium
LLADAVGLALFVVLDTLP

SEQ ID NO: 834231 - protein, 18 aa, Mycobacterium
LLADIGLPEAVLGVILDE

SEQ ID NO: 834232 - protein, 18 aa, Mycobacterium
LLADLDCGCWRGADLEHV

SEQ ID NO: 834233 - protein, 19 aa, Mycobacterium
LLADLRKPEHQAALDKLGV

SEQ ID NO: 834234 - protein, 24 aa, Mycobacterium
LLADLRTILTPPYVARTREVAALM

SEQ ID NO: 834235 - protein, 25 aa, Mycobacterium
LLADPAVPVFALTTGPRWPDVSGNS

SEQ ID NO: 834236 - protein, 24 aa, Mycobacterium
LLADPKVPVFALTTGPRWPDVSGN

SEQ ID NO: 834237 - protein, 24 aa, Mycobacterium
LLADPSVPVYALTTGPRWPDVSGN

SEQ ID NO: 834238 - protein, 17 aa, Mycobacterium
LLADRLDLGIAFAGPHP

SEQ ID NO: 834239 - protein, 24 aa, Mycobacterium
LLAEADFAFIALPAGDEEDTAELV

SEQ ID NO: 834240 - protein, 17 aa, Mycobacterium
LLAEAYPRRPDGITFFP

SEQ ID NO: 834241 - protein, 31 aa, Mycobacterium
LLAEFVGYWERLLTEGGFTAGCPVVAAAIGC

SEQ ID NO: 834242 - protein, 18 aa, Mycobacterium
LLAEQLDWLLGNGGLEWA

SEQ ID NO: 834243 - protein, 17 aa, Mycobacterium
LLAETRFLTLQPGEKLV

SEQ ID NO: 834244 - protein, 17 aa, Mycobacterium
LLAFAHLEPGQRSPAAT

SEQ ID NO: 834245 - protein, 18 aa, Mycobacterium
LLAFLELVAKRRRRYPGM

SEQ ID NO: 834246 - protein, 18 aa, Mycobacterium
LLAGCAVVLKPAPESPLD

SEQ ID NO: 834247 - protein, 22 aa, Mycobacterium
LLAGFNLYAYLYAFNKILPGVL

SEQ ID NO: 834248 - protein, 18 aa, Mycobacterium
LLAGHYREDRFWTHQVLD

SEQ ID NO: 834249 - protein, 18 aa, Mycobacterium
LLAGRRVAVLTGAGISTD

SEQ ID NO: 834250 - protein, 17 aa, Mycobacterium
LLAGRRVAVLTGAGMST

SEQ ID NO: 834251 - protein, 23 aa, Mycobacterium
LLAGVAIVVVRILGGYRAWQGGI

SEQ ID NO: 834252 - protein, 20 aa, Mycobacterium
LLAHSAGYVELFYGRPRTQS

SEQ ID NO: 834253 - protein, 17 aa, Mycobacterium
LLAILKAGAAYVPIDAN

SEQ ID NO: 834254 - protein, 30 aa, Mycobacterium
LLAIRAAARPLLQLLADRGLLSGLLSQDEM

SEQ ID NO: 834255 - protein, 17 aa, Mycobacterium
LLALARLAGQPAVVLGQ

SEQ ID NO: 834256 - protein, 17 aa, Mycobacterium
LLALCPPGAKVVDTGPL

SEQ ID NO: 834257 - protein, 17 aa, Mycobacterium
LLALIADCERGVGRPER

SEQ ID NO: 834258 - protein, 19 aa, Mycobacterium
LLALLASILSDLGHGLAVL

SEQ ID NO: 834259 - protein, 19 aa, Mycobacterium
LLALRRFQRAGHRPIVLAG

SEQ ID NO: 834260 - protein, 19 aa, Mycobacterium
LLALSPPELAVLVGGLRVL

SEQ ID NO: 834261 - protein, 22 aa, Mycobacterium
LLAMPQAPVYGAAKAGLNNLTG

SEQ ID NO: 834262 - protein, 17 aa, Mycobacterium
LLANLATSLFEHGRIKT

SEQ ID NO: 834263 - protein, 33 aa, Mycobacterium
LLANLDRTGIPAPLISQFLPTQYERFRAGELDP

SEQ ID NO: 834264 - protein, 24 aa, Mycobacterium
LLANTNFFGLNFPAIAAAEGLYEE

SEQ ID NO: 834265 - protein, 17 aa, Mycobacterium
LLAPALGAATIGDGLPG

SEQ ID NO: 834266 - protein, 20 aa, Mycobacterium
LLAPAPQPEHLIAGYLAALD

SEQ ID NO: 834267 - protein, 28 aa, Mycobacterium
LLAPATEEFLRFFTPAPGDGRTFSEDVE

SEQ ID NO: 834268 - protein, 36 aa, Mycobacterium
LLAPDDVFLPVIPTPFGFGLWTSHTTPIYLGATAVL

SEQ ID NO: 834269 - protein, 17 aa, Mycobacterium
LLAPKWQMMSDPQLTGY

SEQ ID NO: 834270 - protein, 18 aa, Mycobacterium
LLAPKWQMMSDPQLTGYF

SEQ ID NO: 834271 - protein, 17 aa, Mycobacterium
LLAPLLPEMTAPPHPRA

SEQ ID NO: 834272 - protein, 23 aa, Mycobacterium
LLAPLPSLRLQIGAPSVLRKVDR

SEQ ID NO: 834273 - protein, 21 aa, Mycobacterium
LLAPRPSLTGPALPPQLAATA

SEQ ID NO: 834274 - protein, 23 aa, Mycobacterium
LLAPVLSQPSLPFGLSKKARYNI

SEQ ID NO: 834275 - protein, 30 aa, Mycobacterium
LLAQQGLLPDILFTSLLRRAINTAHLALDT

SEQ ID NO: 834276 - protein, 18 aa, Mycobacterium
LLAQWMLVGFIHGVMNTD

SEQ ID NO: 834277 - protein, 36 aa, Mycobacterium
LLARERIELLIDPDSPFLELCPLAAWGSDFTVGASL

SEQ ID NO: 834278 - protein, 24 aa, Mycobacterium
LLARFPNVLVVRTFSKAYGLAGLR

SEQ ID NO: 834279 - protein, 30 aa, Mycobacterium
LLARGPYGRAFPFSLVFAALYAARGYHVVL

SEQ ID NO: 834280 - protein, 21 aa, Mycobacterium
LLARLRLDHLADRSPYTLSGG

SEQ ID NO: 834281 - protein, 23 aa, Mycobacterium
LLARYREDYGRWPQSVGLSVWGT

SEQ ID NO: 834282 - protein, 19 aa, Mycobacterium
LLASAYYALPGDGPQTPTP

SEQ ID NO: 834283 - protein, 28 aa, Mycobacterium
LLASLPDGVLMRRAAYGLATAIAAELGT

SEQ ID NO: 834284 - protein, 24 aa, Mycobacterium
LLASLRPELMCLYQPLGGEYAGTR

SEQ ID NO: 834285 - protein, 19 aa, Mycobacterium
LLASYRRAIGDFTAGRRRK

SEQ ID NO: 834286 - protein, 19 aa, Mycobacterium
LLATAWGDTLSILRRPDGV

SEQ ID NO: 834287 - protein, 17 aa, Mycobacterium
LLATLVATNFFGQNTPA

SEQ ID NO: 834288 - protein, 17 aa, Mycobacterium
LLATYGQDRPPGRPLWL

SEQ ID NO: 834289 - protein, 17 aa, Mycobacterium
LLAVEICSLSWPTTRIT

SEQ ID NO: 834290 - protein, 17 aa, Mycobacterium
LLAVFGTYRTVAGPFLA

SEQ ID NO: 834291 - protein, 19 aa, Mycobacterium
LLAVINAPSQALTGRPLIG

SEQ ID NO: 834292 - protein, 18 aa, Mycobacterium
LLAWAEPYQEMMGPFAGV

SEQ ID NO: 834293 - protein, 17 aa, Mycobacterium
LLAWREMFSGFDTPTLV

SEQ ID NO: 834294 - protein, 17 aa, Mycobacterium
LLAYFADHRERVYRPAL

SEQ ID NO: 834295 - protein, 26 aa, Mycobacterium
LLAYLRPRAVIFHRSLGAKFADVLPR

SEQ ID NO: 834296 - protein, 17 aa, Mycobacterium
LLAYSKFDPVSGDQVLV

SEQ ID NO: 834297 - protein, 17 aa, Mycobacterium
LLAYSKFDPVTGDAVLV

SEQ ID NO: 834298 - protein, 17 aa, Mycobacterium
LLAYSKFDPVTGDTVLV

SEQ ID NO: 834299 - protein, 20 aa, Mycobacterium
LLCAGIIGYRSLLRAELPPG

SEQ ID NO: 834300 - protein, 19 aa, Mycobacterium
LLCDEPLLALDPANANLVA

SEQ ID NO: 834301 - protein, 18 aa, Mycobacterium
LLCDEPLLTLDPANAKLV

SEQ ID NO: 834302 - protein, 18 aa, Mycobacterium
LLCMTRMSTFAEDEVVTV

SEQ ID NO: 834303 - protein, 17 aa, Mycobacterium
LLCSSVSGLWGGHGHAA

SEQ ID NO: 834304 - protein, 17 aa, Mycobacterium
LLCWRDTGHPQGGGSET

SEQ ID NO: 834305 - protein, 24 aa, Mycobacterium
LLDAAPSVLPPMGPKLGLKAQHKL

SEQ ID NO: 834306 - protein, 30 aa, Mycobacterium
LLDAINAPVQTLLGRPLIGDGVHGSAPGQA

SEQ ID NO: 834307 - protein, 21 aa, Mycobacterium
LLDALARRRDAELERGVCLVG

SEQ ID NO: 834308 - protein, 20 aa, Mycobacterium
LLDAPGPFVSVYFDDSHDTH

SEQ ID NO: 834309 - protein, 33 aa, Mycobacterium
LLDAPSHIHLAYRPGVPLVAAVLRNGEIVWQTK

SEQ ID NO: 834310 - protein, 20 aa, Mycobacterium
LLDAPYPYYGLSIAWMDHVY

SEQ ID NO: 834311 - protein, 17 aa, Mycobacterium
LLDARLVLEPLAAALAA

SEQ ID NO: 834312 - protein, 17 aa, Mycobacterium
LLDATPTPDGFEVVLST

SEQ ID NO: 834313 - protein, 20 aa, Mycobacterium
LLDAVDALRAALWGQELLGQ

SEQ ID NO: 834314 - protein, 28 aa, Mycobacterium
LLDAVWRVRGYGDFWSYCLVAEGAVDIA

SEQ ID NO: 834315 - protein, 27 aa, Mycobacterium
LLDDADFAKYPFLVKGYIGPKALQDNG

SEQ ID NO: 834316 - protein, 25 aa, Mycobacterium
LLDDDFFDEIFRELGIPYEPVRWRT

SEQ ID NO: 834317 - protein, 17 aa, Mycobacterium
LLDDIRERFAIPVQSCV

SEQ ID NO: 834318 - protein, 28 aa, Mycobacterium
LLDDKDFRHLYVPPGFLHGFQALTAIAD

SEQ ID NO: 834319 - protein, 25 aa, Mycobacterium
LLDDRVRFIPGWFKDTLQDAPIESI

SEQ ID NO: 834320 - protein, 18 aa, Mycobacterium
LLDDWFESPQIKGALAVN

SEQ ID NO: 834321 - protein, 21 aa, Mycobacterium
LLDDYRRRPQWRRIGLIDCGE

SEQ ID NO: 834322 - protein, 17 aa, Mycobacterium
LLDEALQRRPAAVMLSF

SEQ ID NO: 834323 - protein, 23 aa, Mycobacterium
LLDEELTWVLPLNEVLSQHDRLD

SEQ ID NO: 834324 - protein, 19 aa, Mycobacterium
LLDEFPPYDEVFDPVNRVL

SEQ ID NO: 834325 - protein, 17 aa, Mycobacterium
LLDEGLDVLFGLWEGQP

SEQ ID NO: 834326 - protein, 18 aa, Mycobacterium
LLDEIDDVLEENAEDFVR

SEQ ID NO: 834327 - protein, 19 aa, Mycobacterium
LLDETLSLIIDIWGKRRDG

SEQ ID NO: 834328 - protein, 19 aa, Mycobacterium
LLDFLRAHLQPRGLTAGFG

SEQ ID NO: 834329 - protein, 17 aa, Mycobacterium
LLDFMPRYEVLFDECRR

SEQ ID NO: 834330 - protein, 22 aa, Mycobacterium
LLDFRDVLLRRNRKVLVGPVTW

SEQ ID NO: 834331 - protein, 18 aa, Mycobacterium
LLDFVFAEVWQRPALTRR

SEQ ID NO: 834332 - protein, 24 aa, Mycobacterium
LLDGLAAHLPPDSAVPAYLSRMLI

SEQ ID NO: 834333 - protein, 35 aa, Mycobacterium
LLDGLATHLPPDSPIPAYLSRLLIAGGRAGSALFD

SEQ ID NO: 834334 - protein, 18 aa, Mycobacterium
LLDGLRALGIDRLAPTDG

SEQ ID NO: 834335 - protein, 21 aa, Mycobacterium
LLDGPRRYGDLLSALSPIATD

SEQ ID NO: 834336 - protein, 18 aa, Mycobacterium
LLDHFQVAMAAAGWNAAV

SEQ ID NO: 834337 - protein, 17 aa, Mycobacterium
LLDHLLPHDWRVDMQEL

SEQ ID NO: 834338 - protein, 17 aa, Mycobacterium
LLDHLLPHDWRVDVQQL

SEQ ID NO: 834339 - protein, 27 aa, Mycobacterium
LLDIARLRWQFERLARGVPISAPWDAP

SEQ ID NO: 834340 - protein, 29 aa, Mycobacterium
LLDIDDEFFVILRPAPSGTRLLLSDATAA

SEQ ID NO: 834341 - protein, 18 aa, Mycobacterium
LLDLAWCLLGYDGEEPRA

SEQ ID NO: 834342 - protein, 18 aa, Mycobacterium
LLDLFDYRGSGPSGRDLL

SEQ ID NO: 834343 - protein, 17 aa, Mycobacterium
LLDLKLSAGSDFEGLSL

SEQ ID NO: 834344 - protein, 17 aa, Mycobacterium
LLDLQPYLDRKPKDLSG

SEQ ID NO: 834345 - protein, 24 aa, Mycobacterium
LLDLSSLWQIYDLDRPALKDPAFV

SEQ ID NO: 834346 - protein, 28 aa, Mycobacterium
LLDLSSLWQIYSLDRPALKDPAFVPATS

SEQ ID NO: 834347 - protein, 22 aa, Mycobacterium
LLDLVEPLATWTEALTAAVVDA

SEQ ID NO: 834348 - protein, 20 aa, Mycobacterium
LLDNIAKLFQLSISPQQFAD

SEQ ID NO: 834349 - protein, 17 aa, Mycobacterium
LLDPATEEFLRYFTPAP

SEQ ID NO: 834350 - protein, 21 aa, Mycobacterium
LLDPDALVLQFIHGRDRLEIG

SEQ ID NO: 834351 - protein, 17 aa, Mycobacterium
LLDPLPLPMETGYRRLD

SEQ ID NO: 834352 - protein, 18 aa, Mycobacterium
LLDQPTAWERHVLGAIPY

SEQ ID NO: 834353 - protein, 17 aa, Mycobacterium
LLDRGHPLWECYIIDGI

SEQ ID NO: 834354 - protein, 19 aa, Mycobacterium
LLDRHRPLWELYVVEGLND

SEQ ID NO: 834355 - protein, 17 aa, Mycobacterium
LLDRHRPLWETHIIEGL

SEQ ID NO: 834356 - protein, 28 aa, Mycobacterium
LLDRSGGFGTFLLLGHDWAPPAATFHSY

SEQ ID NO: 834357 - protein, 31 aa, Mycobacterium
LLDRYDAGAAYWWQNTRATVLFEPAMRRMLD

SEQ ID NO: 834358 - protein, 24 aa, Mycobacterium
LLDRYRADYGRWPESVGLSVWGTS

SEQ ID NO: 834359 - protein, 20 aa, Mycobacterium
LLDSHAPLVVFTAAGSLVAM

SEQ ID NO: 834360 - protein, 21 aa, Mycobacterium
LLDSLIRRDMLDELCLTVAPY

SEQ ID NO: 834361 - protein, 25 aa, Mycobacterium
LLDSNVPMFDLLVAAAARTVTRWRQ

SEQ ID NO: 834362 - protein, 26 aa, Mycobacterium
LLDSPDFIRLGLMLALERRPAEPRAR

SEQ ID NO: 834363 - protein, 18 aa, Mycobacterium
LLDSWPGTLIVVSHDRYL

SEQ ID NO: 834364 - protein, 17 aa, Mycobacterium
LLDTYHDVLRLPVDIVV

SEQ ID NO: 834365 - protein, 24 aa, Mycobacterium
LLDVAAHKFADLGALAFAADASAQ

SEQ ID NO: 834366 - protein, 17 aa, Mycobacterium
LLDVAARVRQAASEAAG

SEQ ID NO: 834367 - protein, 19 aa, Mycobacterium
LLDVAFDAVGLKVTFEQAL

SEQ ID NO: 834368 - protein, 17 aa, Mycobacterium
LLDVCRIAEDAGAEFVK

SEQ ID NO: 834369 - protein, 18 aa, Mycobacterium
LLDVFTLADRVLVLESGK

SEQ ID NO: 834370 - protein, 19 aa, Mycobacterium
LLDVHANTWRYNQLIAQQR

SEQ ID NO: 834371 - protein, 18 aa, Mycobacterium
LLDVIFDVDGPEAEETLR

SEQ ID NO: 834372 - protein, 27 aa, Mycobacterium
LLDVINAPARALLGRPLIGDGVDGGAG

SEQ ID NO: 834373 - protein, 19 aa, Mycobacterium
LLDVLAQRVVVGDGAMGTQ

SEQ ID NO: 834374 - protein, 21 aa, Mycobacterium
LLDVLRTEIWPLLHDRSPITK

SEQ ID NO: 834375 - protein, 18 aa, Mycobacterium
LLDVMRLGARIVKRSTET

SEQ ID NO: 834376 - protein, 32 aa, Mycobacterium
LLDVQIDSFEWLIGAPRWREAAAARGDGKPGV

SEQ ID NO: 834377 - protein, 30 aa, Mycobacterium
LLDVQIDSFEWLIGSPRWREAAAARGDVKP

SEQ ID NO: 834378 - protein, 17 aa, Mycobacterium
LLDWLRGAHRTASWTTS

SEQ ID NO: 834379 - protein, 22 aa, Mycobacterium
LLDWPGLAAREVACSAWPAGAG

SEQ ID NO: 834380 - protein, 20 aa, Mycobacterium
LLEAAGYRRAAEGTDADVVV

SEQ ID NO: 834381 - protein, 17 aa, Mycobacterium
LLEAAILQWHWKTDVFP

SEQ ID NO: 834382 - protein, 29 aa, Mycobacterium
LLEALPERERTVLILRFFESMTQTQIAER

SEQ ID NO: 834383 - protein, 21 aa, Mycobacterium
LLEAPAPFASVYFDDSHDTHD

SEQ ID NO: 834384 - protein, 19 aa, Mycobacterium
LLEAVVMDLMRVWELCQVC

SEQ ID NO: 834385 - protein, 21 aa, Mycobacterium
LLEEFGPIVVILDDVHKLSTP

SEQ ID NO: 834386 - protein, 17 aa, Mycobacterium
LLEEWLALWSEHYQLGE

SEQ ID NO: 834387 - protein, 17 aa, Mycobacterium
LLEEWLAMWSENYDLGE

SEQ ID NO: 834388 - protein, 17 aa, Mycobacterium
LLEFANELPPLPAHLEE

SEQ ID NO: 834389 - protein, 20 aa, Mycobacterium
LLEGLPLSRLTPFKQQLIDP

SEQ ID NO: 834390 - protein, 25 aa, Mycobacterium
LLEGPFLEHGIGAAGYLWSAGLTLF

SEQ ID NO: 834391 - protein, 19 aa, Mycobacterium
LLEGRPVILTVPRRAAPTA

SEQ ID NO: 834392 - protein, 20 aa, Mycobacterium
LLEGSGVRVGLKWPNDVLAG

SEQ ID NO: 834393 - protein, 35 aa, Mycobacterium
LLEHGCHHLQIIVTSWSRTGLPLSRLRLADELVEI

SEQ ID NO: 834394 - protein, 17 aa, Mycobacterium
LLEHKSSTRTRRLEGRT

SEQ ID NO: 834395 - protein, 27 aa, Mycobacterium
LLEIARFWAGLALFSRERGRYVIPGVI

SEQ ID NO: 834396 - protein, 17 aa, Mycobacterium
LLEIGAIRPILAGPSGA

SEQ ID NO: 834397 - protein, 20 aa, Mycobacterium
LLEIVKLSDFAKRKPAQLSG

SEQ ID NO: 834398 - protein, 27 aa, Mycobacterium
LLEKLSPLPRAHALTAPLLLVHGANDT

SEQ ID NO: 834399 - protein, 17 aa, Mycobacterium
LLEKVSALLAPYDADEW

SEQ ID NO: 834400 - protein, 19 aa, Mycobacterium
LLELGRYLGAFVQGELIGG

SEQ ID NO: 834401 - protein, 18 aa, Mycobacterium
LLELISDLRDHGITSIII

SEQ ID NO: 834402 - protein, 18 aa, Mycobacterium
LLELLLEHTTAGLPYEQC

SEQ ID NO: 834403 - protein, 18 aa, Mycobacterium
LLELLPRRGAVVVPVPPQ

SEQ ID NO: 834404 - protein, 17 aa, Mycobacterium
LLELLQRRITVPENTIR

SEQ ID NO: 834405 - protein, 17 aa, Mycobacterium
LLELMLTSDLDPANIRY

SEQ ID NO: 834406 - protein, 20 aa, Mycobacterium
LLELNRLFMAWTETEYHRRT

SEQ ID NO: 834407 - protein, 18 aa, Mycobacterium
LLEMPQLPGRGWIEYEPY

SEQ ID NO: 834408 - protein, 34 aa, Mycobacterium
LLEPGRAIQFNSLFLDPYLWKLQIGGKRLVQKAR

SEQ ID NO: 834409 - protein, 18 aa, Mycobacterium
LLEPSGHPAAKPFKDALV

SEQ ID NO: 834410 - protein, 27 aa, Mycobacterium
LLEQPLGGSLYELCQVRYGLQADSSTE

SEQ ID NO: 834411 - protein, 35 aa, Mycobacterium
LLERELDLLLDGRKLLWWAMSRFTTLGNLPYRYEE

SEQ ID NO: 834412 - protein, 26 aa, Mycobacterium
LLERERGAYWTFLVSTGNQVFIGATP

SEQ ID NO: 834413 - protein, 18 aa, Mycobacterium
LLERFRDLLVLQAVPDAV

SEQ ID NO: 834414 - protein, 22 aa, Mycobacterium
LLERIRAHTPLHLAAPTPPAPD

SEQ ID NO: 834415 - protein, 18 aa, Mycobacterium
LLERLGFAKGQLSARVSE

SEQ ID NO: 834416 - protein, 23 aa, Mycobacterium
LLERPGTLDVLRLIANAPNVFEE

SEQ ID NO: 834417 - protein, 36 aa, Mycobacterium
LLERQLDLLLQRRKLLWWTLSRFTTLSNLPFRYEED

SEQ ID NO: 834418 - protein, 20 aa, Mycobacterium
LLERYVARAAGLRRAAGSVR

SEQ ID NO: 834419 - protein, 21 aa, Mycobacterium
LLESLRASALFTGLRGRAPVD

SEQ ID NO: 834420 - protein, 28 aa, Mycobacterium
LLETADVSQRLRLLIDWTGDHLAEVEVN

SEQ ID NO: 834421 - protein, 24 aa, Mycobacterium
LLETEDVAARLRLLIAWTGEHLAE

SEQ ID NO: 834422 - protein, 18 aa, Mycobacterium
LLETLAHVPRWRDYYQSH

SEQ ID NO: 834423 - protein, 20 aa, Mycobacterium
LLETYTVPPLLQNQALAIGV

SEQ ID NO: 834424 - protein, 19 aa, Mycobacterium
LLEVDGVTGVWSALSRRVD

SEQ ID NO: 834425 - protein, 20 aa, Mycobacterium
LLEWADIHGGLHRSGTPAAP

SEQ ID NO: 834426 - protein, 19 aa, Mycobacterium
LLEWAEIHAGLHRSGTLAE

SEQ ID NO: 834427 - protein, 20 aa, Mycobacterium
LLEWAEIHGGLHRSGTPAAP

SEQ ID NO: 834428 - protein, 19 aa, Mycobacterium
LLEWAEIHGGLHRSGTPAQ

SEQ ID NO: 834429 - protein, 21 aa, Mycobacterium
LLEYATPRLAAIPGVTLVGTA

SEQ ID NO: 834430 - protein, 25 aa, Mycobacterium
LLEYVWALMGMPCGKYLVVMVGLWL

SEQ ID NO: 834431 - protein, 22 aa, Mycobacterium
LLFDGMFALVQHSLGRLYALGN

SEQ ID NO: 834432 - protein, 28 aa, Mycobacterium
LLFESAPGLFLVLDPDLRIVAVTDAYLQ

SEQ ID NO: 834433 - protein, 19 aa, Mycobacterium
LLFNDLTVYFALAVRGRLQ

SEQ ID NO: 834434 - protein, 26 aa, Mycobacterium
LLFNDLTVYFALRVRGRLQRGETVLV

SEQ ID NO: 834435 - protein, 32 aa, Mycobacterium
LLFNHSRRVFFFGALQGLRRGIHPNLELLYAA

SEQ ID NO: 834436 - protein, 17 aa, Mycobacterium
LLFRALSACNRLVCLLS

SEQ ID NO: 834437 - protein, 17 aa, Mycobacterium
LLFVIDDLCTAAGEEWS

SEQ ID NO: 834438 - protein, 18 aa, Mycobacterium
LLGAFAAVPRFASAAFAR

SEQ ID NO: 834439 - protein, 19 aa, Mycobacterium
LLGAFARLHQRWQREAPAL

SEQ ID NO: 834440 - protein, 26 aa, Mycobacterium
LLGAGAPWFESWLEHPDRDDPFWERL

SEQ ID NO: 834441 - protein, 18 aa, Mycobacterium
LLGAIAWLAEQKPGIYDG

SEQ ID NO: 834442 - protein, 19 aa, Mycobacterium
LLGALLRELHRIGVGNYRC

SEQ ID NO: 834443 - protein, 25 aa, Mycobacterium
LLGAMFGESLLHAVPLFGFTGCHGL

SEQ ID NO: 834444 - protein, 26 aa, Mycobacterium
LLGASRKRFLGSLLAGPDGATRPPAG

SEQ ID NO: 834445 - protein, 39 aa, Mycobacterium
LLGDALLAIPPYGWVNLHFSLLPAWRGAAPVQAAIAAGD

SEQ ID NO: 834446 - protein, 18 aa, Mycobacterium
LLGDANLRGLVFVESEQR

SEQ ID NO: 834447 - protein, 17 aa, Mycobacterium
LLGEGYTLVRREYMTAI

SEQ ID NO: 834448 - protein, 30 aa, Mycobacterium
LLGEQYPPGQVPLPFAWNGVRLPGRGASAL

SEQ ID NO: 834449 - protein, 24 aa, Mycobacterium
LLGERRFELALTHSPIGMAVVGLD

SEQ ID NO: 834450 - protein, 19 aa, Mycobacterium
LLGGLPVRRLWGIGPVAEE

SEQ ID NO: 834451 - protein, 17 aa, Mycobacterium
LLGGLVDELIVLDSGST

SEQ ID NO: 834452 - protein, 19 aa, Mycobacterium
LLGGPVYLHQSRINAMPAF

SEQ ID NO: 834453 - protein, 18 aa, Mycobacterium
LLGGRYIFAMTGSAPMSP

SEQ ID NO: 834454 - protein, 18 aa, Mycobacterium
LLGGYEFTMLWGGDEAPR

SEQ ID NO: 834455 - protein, 20 aa, Mycobacterium
LLGHGLLAWTAAALQDRALL

SEQ ID NO: 834456 - protein, 17 aa, Mycobacterium
LLGHHLVVQPKFDALEA

SEQ ID NO: 834457 - protein, 17 aa, Mycobacterium
LLGIHIFGSDATDLVHI

SEQ ID NO: 834458 - protein, 17 aa, Mycobacterium
LLGISFGGYFVARAAAH

SEQ ID NO: 834459 - protein, 18 aa, Mycobacterium
LLGIYRELIELRRTEPAL

SEQ ID NO: 834460 - protein, 25 aa, Mycobacterium
LLGKKTQWVRPIGAPLGAIDLREST

SEQ ID NO: 834461 - protein, 18 aa, Mycobacterium
LLGLAPELQAALRRGELA

SEQ ID NO: 834462 - protein, 18 aa, Mycobacterium
LLGLDLPERFGGAGGDFG

SEQ ID NO: 834463 - protein, 17 aa, Mycobacterium
LLGLPVGVLGEATEAPT

SEQ ID NO: 834464 - protein, 27 aa, Mycobacterium
LLGLVERVPWLSVIPAYFVGVGVRPEH

SEQ ID NO: 834465 - protein, 19 aa, Mycobacterium
LLGLYERHRIAAGVALRGI

SEQ ID NO: 834466 - protein, 18 aa, Mycobacterium
LLGLYQQDGQLASVGVIG

SEQ ID NO: 834467 - protein, 17 aa, Mycobacterium
LLGLYYADEGQFFEHRL

SEQ ID NO: 834468 - protein, 34 aa, Mycobacterium
LLGMDSVLMPIGPRRRLWSLLGDSLRPRRLDDLT

SEQ ID NO: 834469 - protein, 18 aa, Mycobacterium
LLGNLTPPELTPPAYGGQ

SEQ ID NO: 834470 - protein, 21 aa, Mycobacterium
LLGNTPFFGTVLAAAALSGIV

SEQ ID NO: 834471 - protein, 26 aa, Mycobacterium
LLGNYYTMYFALHRRGALQPGETVLV

SEQ ID NO: 834472 - protein, 20 aa, Mycobacterium
LLGPLLTCDGVHLVKGFYRR

SEQ ID NO: 834473 - protein, 21 aa, Mycobacterium
LLGPVELPLGARRPAGVPDSV

SEQ ID NO: 834474 - protein, 18 aa, Mycobacterium
LLGPVRVTFQRTLRIPET

SEQ ID NO: 834475 - protein, 17 aa, Mycobacterium
LLGQIDVVFSNAGIVVA

SEQ ID NO: 834476 - protein, 20 aa, Mycobacterium
LLGQIPDLELLFGPLDVCDC

SEQ ID NO: 834477 - protein, 18 aa, Mycobacterium
LLGQMALGSLTGGALGAV

SEQ ID NO: 834478 - protein, 18 aa, Mycobacterium
LLGREMLDQRFAGMKQAL

SEQ ID NO: 834479 - protein, 20 aa, Mycobacterium
LLGRFDALLLPTTTEHPSLA

SEQ ID NO: 834480 - protein, 34 aa, Mycobacterium
LLGRLDYLQWLGIDCIWLPPFYDSPLRDGGYDIR

SEQ ID NO: 834481 - protein, 24 aa, Mycobacterium
LLGRNLVGPLKFEPEFDLTTEAAT

SEQ ID NO: 834482 - protein, 18 aa, Mycobacterium
LLGSATWILATRPDIQRQ

SEQ ID NO: 834483 - protein, 24 aa, Mycobacterium
LLGSSMYSAHLAAAKGLPYVFAHH

SEQ ID NO: 834484 - protein, 28 aa, Mycobacterium
LLGSVPTYALLTQRWLHVTGTRTDALRS

SEQ ID NO: 834485 - protein, 20 aa, Mycobacterium
LLGTDGIFFDAAWDVRVTDT

SEQ ID NO: 834486 - protein, 26 aa, Mycobacterium
LLGTEGLDLLSRPYIRVGTRQAVEAA

SEQ ID NO: 834487 - protein, 18 aa, Mycobacterium
LLGTKIYLDLRVKVAKNW

SEQ ID NO: 834488 - protein, 25 aa, Mycobacterium
LLGTRYLPPFPYFVDTPNAFRVLPG

SEQ ID NO: 834489 - protein, 19 aa, Mycobacterium
LLGTTASWHLMRDCDTLLT

SEQ ID NO: 834490 - protein, 26 aa, Mycobacterium
LLGTYDVIQAFLPMLTRSGGSIVNNL

SEQ ID NO: 834491 - protein, 19 aa, Mycobacterium
LLGVKKWVRIPEVHFAPDS

SEQ ID NO: 834492 - protein, 18 aa, Mycobacterium
LLGVMGAGDLWPLRDERI

SEQ ID NO: 834493 - protein, 26 aa, Mycobacterium
LLGWEDIPGLRWPDVDMRGGRVSFDA

SEQ ID NO: 834494 - protein, 26 aa, Mycobacterium
LLGWQREMLALIEVPYRVIDVAAGDL

SEQ ID NO: 834495 - protein, 19 aa, Mycobacterium
LLGWQREMLARIEVPYRVI

SEQ ID NO: 834496 - protein, 28 aa, Mycobacterium
LLHAADDVLLFKYIIKNTAWQNGKTVTF

SEQ ID NO: 834497 - protein, 18 aa, Mycobacterium
LLHDFRRRHRSVEISLEL

SEQ ID NO: 834498 - protein, 18 aa, Mycobacterium
LLHELERTGGRYGLQTMC

SEQ ID NO: 834499 - protein, 20 aa, Mycobacterium
LLHEPDVLLMDEPFGALDAL

SEQ ID NO: 834500 - protein, 24 aa, Mycobacterium
LLHFDDAFYPIPRPRPALGAATIW

SEQ ID NO: 834501 - protein, 18 aa, Mycobacterium
LLHFGSDEQKRMLLPSIR

SEQ ID NO: 834502 - protein, 20 aa, Mycobacterium
LLHGAYRYRWHHAVAAYAEG

SEQ ID NO: 834503 - protein, 23 aa, Mycobacterium
LLHGDYRLDNLLFDPARTRVSVV

SEQ ID NO: 834504 - protein, 27 aa, Mycobacterium
LLHGDYRLDNLLFDPDLRRVAVVDWQT

SEQ ID NO: 834505 - protein, 29 aa, Mycobacterium
LLHGEPSWSFLYRKMIPILVAAGHRVICP

SEQ ID NO: 834506 - protein, 18 aa, Mycobacterium
LLHGIGGTLITLLGAQRV

SEQ ID NO: 834507 - protein, 29 aa, Mycobacterium
LLHGWPENWWMWHKVIPALAAAGYRVHAM

SEQ ID NO: 834508 - protein, 17 aa, Mycobacterium
LLHKKSEWIKPIGSPVG

SEQ ID NO: 834509 - protein, 18 aa, Mycobacterium
LLHLAQRFGTREGNSLRV

SEQ ID NO: 834510 - protein, 25 aa, Mycobacterium
LLHQRFSSKEQLWYAAVDWGFQAII

SEQ ID NO: 834511 - protein, 17 aa, Mycobacterium
LLHRRPDQRRLLTDNPE

SEQ ID NO: 834512 - protein, 18 aa, Mycobacterium
LLHSRLVSAIALISSPHP

SEQ ID NO: 834513 - protein, 17 aa, Mycobacterium
LLHSVKVIPSRGAWLEF

SEQ ID NO: 834514 - protein, 20 aa, Mycobacterium
LLHVDDLASACLYLLEHFDG

SEQ ID NO: 834515 - protein, 21 aa, Mycobacterium
LLHVDDLASACLYLLEHFDGP

SEQ ID NO: 834516 - protein, 20 aa, Mycobacterium
LLHVSQPDYLRRMTRFLRGF

SEQ ID NO: 834517 - protein, 19 aa, Mycobacterium
LLHVVQDLDTWLQANPIKP

SEQ ID NO: 834518 - protein, 19 aa, Mycobacterium
LLHWECLNPVPPATTDTLR

SEQ ID NO: 834519 - protein, 20 aa, Mycobacterium
LLHWLHHADAILLPSHYEPF

SEQ ID NO: 834520 - protein, 19 aa, Mycobacterium
LLHWQCVDPIPPATTEALR

SEQ ID NO: 834521 - protein, 22 aa, Mycobacterium
LLIAFGLAWNEFLGAAGSPIGI

SEQ ID NO: 834522 - protein, 27 aa, Mycobacterium
LLIAGKYQIRIPVPFTPGSELAGEVLT

SEQ ID NO: 834523 - protein, 18 aa, Mycobacterium
LLIAPRLDDRYPTYGVLA

SEQ ID NO: 834524 - protein, 20 aa, Mycobacterium
LLIAPRLEDRYPAYGVLASI

SEQ ID NO: 834525 - protein, 20 aa, Mycobacterium
LLIAPRLEDRYPSHGVIAKI

SEQ ID NO: 834526 - protein, 17 aa, Mycobacterium
LLIARPGFVIGRMSAGM

SEQ ID NO: 834527 - protein, 18 aa, Mycobacterium
LLIDFRNVSLRRNGRSLV

SEQ ID NO: 834528 - protein, 19 aa, Mycobacterium
LLIDVNRPIPVGQLVDRVW

SEQ ID NO: 834529 - protein, 27 aa, Mycobacterium
LLIERELLQPLPSLQLRIGAPSVIRKV

SEQ ID NO: 834530 - protein, 19 aa, Mycobacterium
LLIFADSLAYYGPAGGLPA

SEQ ID NO: 834531 - protein, 18 aa, Mycobacterium
LLIFADSLAYYGPTGGLP

SEQ ID NO: 834532 - protein, 18 aa, Mycobacterium
LLIGARLLDRAATGVPRQ

SEQ ID NO: 834533 - protein, 18 aa, Mycobacterium
LLIGERWAVGQDGLLLEV

SEQ ID NO: 834534 - protein, 28 aa, Mycobacterium
LLIGHSGELEKFQWFVRAHLENSGGQLS

SEQ ID NO: 834535 - protein, 19 aa, Mycobacterium
LLIGLLRGHGGQALVWGRD

SEQ ID NO: 834536 - protein, 18 aa, Mycobacterium
LLIGLLRGHGGRATVWGR

SEQ ID NO: 834537 - protein, 28 aa, Mycobacterium
LLIGQAGQLEKFQWFVRAHLESAGGQLA

SEQ ID NO: 834538 - protein, 18 aa, Mycobacterium
LLITINRPEARNAINSSV

SEQ ID NO: 834539 - protein, 17 aa, Mycobacterium
LLIVDRLSGRSRFSMLE

SEQ ID NO: 834540 - protein, 19 aa, Mycobacterium
LLIVHWHDLGRYLGAYGHT

SEQ ID NO: 834541 - protein, 22 aa, Mycobacterium
LLKAMRPGLTTPLRMAKHFLRH

SEQ ID NO: 834542 - protein, 17 aa, Mycobacterium
LLKEIDIPVYLGCDWDN

SEQ ID NO: 834543 - protein, 20 aa, Mycobacterium
LLKERLLLTVHIDPFTREQT

SEQ ID NO: 834544 - protein, 17 aa, Mycobacterium
LLKFGMNAHLRLLAGNR

SEQ ID NO: 834545 - protein, 17 aa, Mycobacterium
LLKHSISDFLSNRYALN

SEQ ID NO: 834546 - protein, 17 aa, Mycobacterium
LLKRGELPAKPLIAQIP

SEQ ID NO: 834547 - protein, 21 aa, Mycobacterium
LLKRHPPREALRRWMDRYASF

SEQ ID NO: 834548 - protein, 25 aa, Mycobacterium
LLLADFCPAVEWDGRSALLDSRHDG

SEQ ID NO: 834549 - protein, 24 aa, Mycobacterium
LLLADRIVLLSHRPATVADIITIE

SEQ ID NO: 834550 - protein, 20 aa, Mycobacterium
LLLAVLNRFLPSDDPRIRAT

SEQ ID NO: 834551 - protein, 17 aa, Mycobacterium
LLLDRDLRIRAASVAYE

SEQ ID NO: 834552 - protein, 17 aa, Mycobacterium
LLLDTGNLPTVLPSGYE

SEQ ID NO: 834553 - protein, 17 aa, Mycobacterium
LLLDVDLTRANTAAARA

SEQ ID NO: 834554 - protein, 25 aa, Mycobacterium
LLLECTSVHEVLAWTSALNADPIEG

SEQ ID NO: 834555 - protein, 19 aa, Mycobacterium
LLLELAYELEEARPWARIQ

SEQ ID NO: 834556 - protein, 33 aa, Mycobacterium
LLLGAEDAPGLRWPDLALQGGRLDWPAVRAALP

SEQ ID NO: 834557 - protein, 17 aa, Mycobacterium
LLLGARGRRVDPRQVRT

SEQ ID NO: 834558 - protein, 18 aa, Mycobacterium
LLLGGRPIREPVFHYGPF

SEQ ID NO: 834559 - protein, 17 aa, Mycobacterium
LLLGPSLGTTTATLWTG

SEQ ID NO: 834560 - protein, 17 aa, Mycobacterium
LLLGYQPCRVDEGMVIG

SEQ ID NO: 834561 - protein, 18 aa, Mycobacterium
LLLIATPGEQQPDHTLLT

SEQ ID NO: 834562 - protein, 17 aa, Mycobacterium
LLLLATTADAHLCVSPD

SEQ ID NO: 834563 - protein, 35 aa, Mycobacterium
LLLPNRPEFLEITWGCQLSGLYYTPVNTHLTFDEV

SEQ ID NO: 834564 - protein, 20 aa, Mycobacterium
LLLPNTVPPFFPTSPNITIS

SEQ ID NO: 834565 - protein, 26 aa, Mycobacterium
LLLQALGLGGWMFDGLDRLSVLGGSG

SEQ ID NO: 834566 - protein, 18 aa, Mycobacterium
LLLRHAKSDYPDGVVDHD

SEQ ID NO: 834567 - protein, 18 aa, Mycobacterium
LLLRRSMHILRDKQQWQR

SEQ ID NO: 834568 - protein, 26 aa, Mycobacterium
LLLSKGEYQLKLPPPFVPGLETAGVV

SEQ ID NO: 834569 - protein, 26 aa, Mycobacterium
LLLTKGEYQLKLPPPFVPGLETAGVV

SEQ ID NO: 834570 - protein, 18 aa, Mycobacterium
LLLVHRRSHQAGARLHLD

SEQ ID NO: 834571 - protein, 17 aa, Mycobacterium
LLMALMATNFLGQNTGA

SEQ ID NO: 834572 - protein, 20 aa, Mycobacterium
LLMAPTYAVPRLLARNGLTL

SEQ ID NO: 834573 - protein, 17 aa, Mycobacterium
LLMCAEMLKHLDLAGRG

SEQ ID NO: 834574 - protein, 19 aa, Mycobacterium
LLMLGHDWASPEATYHCYD

SEQ ID NO: 834575 - protein, 19 aa, Mycobacterium
LLMLGHDWASPEATYRCYD

SEQ ID NO: 834576 - protein, 31 aa, Mycobacterium
LLMPNCLEFIPIQQAIWAAGAVLVQMPTRAA

SEQ ID NO: 834577 - protein, 18 aa, Mycobacterium
LLMPRWVKCKRATFKYGL

SEQ ID NO: 834578 - protein, 18 aa, Mycobacterium
LLMRHHLVLMSRFDPERF

SEQ ID NO: 834579 - protein, 18 aa, Mycobacterium
LLMTWVEQSVGHAALKTV

SEQ ID NO: 834580 - protein, 22 aa, Mycobacterium
LLNGIAAALPHFQRQGHGHFVT

SEQ ID NO: 834581 - protein, 17 aa, Mycobacterium
LLNGLYDAKLDHTPVVA

SEQ ID NO: 834582 - protein, 18 aa, Mycobacterium
LLNGLYDAKLDHVPVVAI

SEQ ID NO: 834583 - protein, 26 aa, Mycobacterium
LLNGPRYWLMNAIEKAPQGPPVIKSF

SEQ ID NO: 834584 - protein, 25 aa, Mycobacterium
LLNGPRYWLMNSIEKEPQGLPETKS

SEQ ID NO: 834585 - protein, 20 aa, Mycobacterium
LLNHFIGTWLEAFGIDEKFV

SEQ ID NO: 834586 - protein, 17 aa, Mycobacterium
LLNPLRAVPILGNPLAD

SEQ ID NO: 834587 - protein, 31 aa, Mycobacterium
LLNPNHYLAVAIDYLYTHRPDWPQSTAVGKT

SEQ ID NO: 834588 - protein, 33 aa, Mycobacterium
LLNPNHYLAVAIDYLYTHRPSWPAGIAVGKTAV

SEQ ID NO: 834589 - protein, 32 aa, Mycobacterium
LLNPNHYLAVAIDYLYTHRPSWPDGIAVGKTA

SEQ ID NO: 834590 - protein, 29 aa, Mycobacterium
LLNRFGVLKVLFLLDEPFRGWTLGAAWAN

SEQ ID NO: 834591 - protein, 17 aa, Mycobacterium
LLNRRAGLLSGGQRQQL

SEQ ID NO: 834592 - protein, 26 aa, Mycobacterium
LLNRSGGFGTLLLLGHDWASPQATFH

SEQ ID NO: 834593 - protein, 19 aa, Mycobacterium
LLNRWPQWDIDYDSLQLAP

SEQ ID NO: 834594 - protein, 18 aa, Mycobacterium
LLNWLDSQTKRNLVITFG

SEQ ID NO: 834595 - protein, 25 aa, Mycobacterium
LLPAEDFIPPQLRRATQKLLDETMA

SEQ ID NO: 834596 - protein, 30 aa, Mycobacterium
LLPAHMIPRHVALVRRIPFTDAGKIDRRAV

SEQ ID NO: 834597 - protein, 17 aa, Mycobacterium
LLPALLEALVRNVSRGL

SEQ ID NO: 834598 - protein, 17 aa, Mycobacterium
LLPAPNFASYNGLLFIS

SEQ ID NO: 834599 - protein, 18 aa, Mycobacterium
LLPAPRLSEYTGCTVHLK

SEQ ID NO: 834600 - protein, 25 aa, Mycobacterium
LLPAYDLLSRLLGMNKIHRTLITQA

SEQ ID NO: 834601 - protein, 30 aa, Mycobacterium
LLPDMYYRHRGYAPFSLPSAFTDPGERARM

SEQ ID NO: 834602 - protein, 17 aa, Mycobacterium
LLPDNELRRIAALCAAF

SEQ ID NO: 834603 - protein, 20 aa, Mycobacterium
LLPDQPLTAHRARGLARALI

SEQ ID NO: 834604 - protein, 26 aa, Mycobacterium
LLPDVPHIAVFDTAFFHDMPPAAATY

SEQ ID NO: 834605 - protein, 18 aa, Mycobacterium
LLPEAFAVAREAAWRVLD

SEQ ID NO: 834606 - protein, 20 aa, Mycobacterium
LLPGGRAVFFVPGSPRHWGV

SEQ ID NO: 834607 - protein, 38 aa, Mycobacterium
LLPGIRTILDTLPPHPAHFLWLNWGPIPPRQDMAYSIE

SEQ ID NO: 834608 - protein, 19 aa, Mycobacterium
LLPGITFAAPDLIGHGRSS

SEQ ID NO: 834609 - protein, 24 aa, Mycobacterium
LLPGPWRLLRVVGHYYRPGFHPSQ

SEQ ID NO: 834610 - protein, 24 aa, Mycobacterium
LLPGYMIPARIELLEQMPLTSNGK

SEQ ID NO: 834611 - protein, 17 aa, Mycobacterium
LLPKLLAADALPAEIKA

SEQ ID NO: 834612 - protein, 18 aa, Mycobacterium
LLPMPDPIRMASHAHHYL

SEQ ID NO: 834613 - protein, 20 aa, Mycobacterium
LLPMSDLIRLASHANHYLAL

SEQ ID NO: 834614 - protein, 20 aa, Mycobacterium
LLPNAHWLYEFGDPRRLAST

SEQ ID NO: 834615 - protein, 17 aa, Mycobacterium
LLPPAKWPSRAAASLST

SEQ ID NO: 834616 - protein, 29 aa, Mycobacterium
LLPPEIQFPKMFFLPWNMRTAGSIIMFLN

SEQ ID NO: 834617 - protein, 25 aa, Mycobacterium
LLPPVEVSEYLGLRPTWVDATNVGG

SEQ ID NO: 834618 - protein, 19 aa, Mycobacterium
LLPRRHPGKRSPLWHQRQR

SEQ ID NO: 834619 - protein, 17 aa, Mycobacterium
LLPSRDPFYQPPVGFRT

SEQ ID NO: 834620 - protein, 25 aa, Mycobacterium
LLPSTPRQLALYAALIRIGVTDMTP

SEQ ID NO: 834621 - protein, 24 aa, Mycobacterium
LLPSTPRQLALYGALIRIGVAERV

SEQ ID NO: 834622 - protein, 17 aa, Mycobacterium
LLPTEDPFYLPPLGYEH

SEQ ID NO: 834623 - protein, 39 aa, Mycobacterium
LLPTNLMDWEDFERLLLDLGRHELGLRSLSYFGKRGQAQ

SEQ ID NO: 834624 - protein, 18 aa, Mycobacterium
LLPVAPPPQEAPPRWRRL

SEQ ID NO: 834625 - protein, 21 aa, Mycobacterium
LLPVFANPWLLSPAFQRPMLN

SEQ ID NO: 834626 - protein, 19 aa, Mycobacterium
LLPVGDAYRLNGEKFYSTG

SEQ ID NO: 834627 - protein, 21 aa, Mycobacterium
LLPVMDLTWGIMAQKTIITVG

SEQ ID NO: 834628 - protein, 28 aa, Mycobacterium
LLPVYDKPMIYYPLTTLMMAGIRDIQVI

SEQ ID NO: 834629 - protein, 26 aa, Mycobacterium
LLPYERSTCFWQRIAYLYSRFDSLVD

SEQ ID NO: 834630 - protein, 19 aa, Mycobacterium
LLQAPPADRTEILKGIFRL

SEQ ID NO: 834631 - protein, 17 aa, Mycobacterium
LLQAYQALDVKGRMSEV

SEQ ID NO: 834632 - protein, 19 aa, Mycobacterium
LLQDGAKLPFESLLEWVHA

SEQ ID NO: 834633 - protein, 26 aa, Mycobacterium
LLQGAFSRFSFIDRLPFRDGAGALAG

SEQ ID NO: 834634 - protein, 18 aa, Mycobacterium
LLQGRRIVALTGAGMSTD

SEQ ID NO: 834635 - protein, 24 aa, Mycobacterium
LLQGTPQELWWGREDFISELVNDH

SEQ ID NO: 834636 - protein, 17 aa, Mycobacterium
LLQLLDPATRADPYPIY

SEQ ID NO: 834637 - protein, 18 aa, Mycobacterium
LLQLRWLGLEGRHDPVDG

SEQ ID NO: 834638 - protein, 24 aa, Mycobacterium
LLQNRGVLPLTPAPGTRIAVIGGY

SEQ ID NO: 834639 - protein, 19 aa, Mycobacterium
LLQPMAPDLARIDPVTLTV

SEQ ID NO: 834640 - protein, 18 aa, Mycobacterium
LLQPMGLVHGGVYCSIIE

SEQ ID NO: 834641 - protein, 17 aa, Mycobacterium
LLQPWGIVHGGVYCAVI

SEQ ID NO: 834642 - protein, 27 aa, Mycobacterium
LLQRHHGPIFPLIEDLFGLSIIEVHQE

SEQ ID NO: 834643 - protein, 30 aa, Mycobacterium
LLQTSSLRVNFLRPFFAGNESRYEGTPLRV

SEQ ID NO: 834644 - protein, 22 aa, Mycobacterium
LLQWGPMIFALGYTAAEGGAPA

SEQ ID NO: 834645 - protein, 20 aa, Mycobacterium
LLQYHSIMTIVREGQWNALR

SEQ ID NO: 834646 - protein, 19 aa, Mycobacterium
LLRAEFMLTEALAGRHPRD

SEQ ID NO: 834647 - protein, 19 aa, Mycobacterium
LLRAEFMLTEALGGRHPRD

SEQ ID NO: 834648 - protein, 21 aa, Mycobacterium
LLRAGWLLRDPVRKTYHLGPA

SEQ ID NO: 834649 - protein, 27 aa, Mycobacterium
LLRAINPVLGFLLRTPLAGSLGNQLMV

SEQ ID NO: 834650 - protein, 27 aa, Mycobacterium
LLRAKHALFDRLVYGKLRAALGGNCHA

SEQ ID NO: 834651 - protein, 37 aa, Mycobacterium
LLRATRYRHPFKFLSKITPYPGTPLYQAYSAAGYLTD

SEQ ID NO: 834652 - protein, 28 aa, Mycobacterium
LLRAVNPVLGFLLGTPLAGPIRKQLMVL

SEQ ID NO: 834653 - protein, 29 aa, Mycobacterium
LLRAVRMDFPFIWEALSAHTAGGASAISD

SEQ ID NO: 834654 - protein, 24 aa, Mycobacterium
LLRAWDAAWPASRWYRYLQAQLEG

SEQ ID NO: 834655 - protein, 18 aa, Mycobacterium
LLRDARFLRIGEGPSEAL

SEQ ID NO: 834656 - protein, 21 aa, Mycobacterium
LLRDPYPIFARYRAQAGVFRG

SEQ ID NO: 834657 - protein, 22 aa, Mycobacterium
LLRDRGIIEIRPGRGGGLFVAD

SEQ ID NO: 834658 - protein, 29 aa, Mycobacterium
LLRDRIHQGWILTALWVIDTGITAATLEH

SEQ ID NO: 834659 - protein, 28 aa, Mycobacterium
LLRDSVLDAMRDLLLTRDWSAITLSDVA

SEQ ID NO: 834660 - protein, 28 aa, Mycobacterium
LLRDSVLDAMRELLLTRDWSAVTLSDVA

SEQ ID NO: 834661 - protein, 20 aa, Mycobacterium
LLREGVSVFGFHLCGLDMRQ

SEQ ID NO: 834662 - protein, 26 aa, Mycobacterium
LLREHGLLLPVEPDTRLLSETELWQL

SEQ ID NO: 834663 - protein, 18 aa, Mycobacterium
LLREPDLGELERLLDAGG

SEQ ID NO: 834664 - protein, 20 aa, Mycobacterium
LLRESVDFFAPYLAAAKLTG

SEQ ID NO: 834665 - protein, 23 aa, Mycobacterium
LLRGHDVVFLALPHGSSAKIAEE

SEQ ID NO: 834666 - protein, 19 aa, Mycobacterium
LLRGHRNWQQPWLPRSAEA

SEQ ID NO: 834667 - protein, 17 aa, Mycobacterium
LLRHWAASLGSPADVFD

SEQ ID NO: 834668 - protein, 25 aa, Mycobacterium
LLRHYGPLLDRWKAAGLLYPDVDFR

SEQ ID NO: 834669 - protein, 19 aa, Mycobacterium
LLRINDGSHRLLRYRDGHE

SEQ ID NO: 834670 - protein, 22 aa, Mycobacterium
LLRKELAWLRRGAPARTSKPKF

SEQ ID NO: 834671 - protein, 17 aa, Mycobacterium
LLRLSAEGWVRWSNTVS

SEQ ID NO: 834672 - protein, 17 aa, Mycobacterium
LLRLSFGRFGDHVAAST

SEQ ID NO: 834673 - protein, 25 aa, Mycobacterium
LLRNCAVRPLPLKVFDVRCAPAAYR

SEQ ID NO: 834674 - protein, 17 aa, Mycobacterium
LLRNELPEAYPLKMIGM

SEQ ID NO: 834675 - protein, 18 aa, Mycobacterium
LLRPGEEDLFWLGTAEAL

SEQ ID NO: 834676 - protein, 17 aa, Mycobacterium
LLRQLRLGEYDVLVGIN

SEQ ID NO: 834677 - protein, 18 aa, Mycobacterium
LLRQRRALRETGGDPREA

SEQ ID NO: 834678 - protein, 23 aa, Mycobacterium
LLRRAPHLVIVALSAYGLTGPYR

SEQ ID NO: 834679 - protein, 18 aa, Mycobacterium
LLRRDGFGALTVRRVAAE

SEQ ID NO: 834680 - protein, 33 aa, Mycobacterium
LLRREPLGVVSILTPWNFPHCLNVMKVNNALAA

SEQ ID NO: 834681 - protein, 17 aa, Mycobacterium
LLRRLVEAGTRVVQYGY

SEQ ID NO: 834682 - protein, 24 aa, Mycobacterium
LLRRRDVLVVVTPPASSLADWLRR

SEQ ID NO: 834683 - protein, 19 aa, Mycobacterium
LLRRVRVLNRETGRVRWYG

SEQ ID NO: 834684 - protein, 20 aa, Mycobacterium
LLRSCTGWPSGVWIDEPRRT

SEQ ID NO: 834685 - protein, 19 aa, Mycobacterium
LLRSKGFCWIASRPSVAAI

SEQ ID NO: 834686 - protein, 19 aa, Mycobacterium
LLRSLDFARDFAGEGNAIV

SEQ ID NO: 834687 - protein, 20 aa, Mycobacterium
LLRSMRSPIPITELQRHATG

SEQ ID NO: 834688 - protein, 25 aa, Mycobacterium
LLRSRGVPPTRLRLIYLADGQVLDY

SEQ ID NO: 834689 - protein, 23 aa, Mycobacterium
LLRTGAPLLIASGKFLGADKTAD

SEQ ID NO: 834690 - protein, 30 aa, Mycobacterium
LLRTGVVRITLPARLIPLTGGYRAVMPGPV

SEQ ID NO: 834691 - protein, 19 aa, Mycobacterium
LLRTLPLVVGGVSAGAAIL

SEQ ID NO: 834692 - protein, 25 aa, Mycobacterium
LLRTRGVPPTRLRLIYLADGQVLDY

SEQ ID NO: 834693 - protein, 18 aa, Mycobacterium
LLRVALGIIVFPTDRLDT

SEQ ID NO: 834694 - protein, 29 aa, Mycobacterium
LLRVHLPRSDPFWSYADRLTSPGLGGQSL

SEQ ID NO: 834695 - protein, 41 aa, Mycobacterium
LLRVTRDQRWKRFNLLNLVYNTMLMLLFEWGVGLQHVELGK

SEQ ID NO: 834696 - protein, 26 aa, Mycobacterium
LLRVVNPMLGFLLRTPLAGPARKQLM

SEQ ID NO: 834697 - protein, 22 aa, Mycobacterium
LLRWSVWRMATGARNITTTGQI

SEQ ID NO: 834698 - protein, 22 aa, Mycobacterium
LLRWSVWRMAVGNRNITTTGQI

SEQ ID NO: 834699 - protein, 37 aa, Mycobacterium
LLRYEPLGVVAAMTPWNFPHTLNVMKLGAALAAGNTL

SEQ ID NO: 834700 - protein, 22 aa, Mycobacterium
LLSAPAIKLLIRRSGARSADMA

SEQ ID NO: 834701 - protein, 17 aa, Mycobacterium
LLSCGRKDVLRWCGDPE

SEQ ID NO: 834702 - protein, 28 aa, Mycobacterium
LLSCQVVTYRFWAERLGIQVDSLSASAE

SEQ ID NO: 834703 - protein, 24 aa, Mycobacterium
LLSDDFTYWSIITRSAFEKDALRR

SEQ ID NO: 834704 - protein, 24 aa, Mycobacterium
LLSDDPLLDSLLFDDPALPDGEAP

SEQ ID NO: 834705 - protein, 19 aa, Mycobacterium
LLSDIRLDFKPVVQTRYEP

SEQ ID NO: 834706 - protein, 20 aa, Mycobacterium
LLSDVVLPAATWYEKADLSS

SEQ ID NO: 834707 - protein, 20 aa, Mycobacterium
LLSEFEALLGPKTKLVAATH

SEQ ID NO: 834708 - protein, 18 aa, Mycobacterium
LLSEFRFERSDPARFYGA

SEQ ID NO: 834709 - protein, 19 aa, Mycobacterium
LLSEFRYEQPDPARFYGAL

SEQ ID NO: 834710 - protein, 22 aa, Mycobacterium
LLSELPGVLEGLASPLASAVSA

SEQ ID NO: 834711 - protein, 33 aa, Mycobacterium
LLSGANGWLGRFLTLQWLERLAPVGGTLITIVR

SEQ ID NO: 834712 - protein, 24 aa, Mycobacterium
LLSGGIDLALLRPPVRQEAVLTHT

SEQ ID NO: 834713 - protein, 18 aa, Mycobacterium
LLSGHYRADRFWSPQVLE

SEQ ID NO: 834714 - protein, 17 aa, Mycobacterium
LLSGLLRAGRQVKDMVV

SEQ ID NO: 834715 - protein, 17 aa, Mycobacterium
LLSGMEPDLRWERFVTA

SEQ ID NO: 834716 - protein, 20 aa, Mycobacterium
LLSGRRTFVPWLSTVVNVAV

SEQ ID NO: 834717 - protein, 18 aa, Mycobacterium
LLSGWRAPDPAQDSLRHA

SEQ ID NO: 834718 - protein, 19 aa, Mycobacterium
LLSGYYHAVHELTLEYLGG

SEQ ID NO: 834719 - protein, 19 aa, Mycobacterium
LLSITGIMRRLLEGALRGA

SEQ ID NO: 834720 - protein, 18 aa, Mycobacterium
LLSKVFTRGIITWGIRDA

SEQ ID NO: 834721 - protein, 17 aa, Mycobacterium
LLSLVVEGYRREGKRYM

SEQ ID NO: 834722 - protein, 17 aa, Mycobacterium
LLSPFKVPTRWITVDSA

SEQ ID NO: 834723 - protein, 20 aa, Mycobacterium
LLSPRTVWALLRGRARMAAV

SEQ ID NO: 834724 - protein, 37 aa, Mycobacterium
LLSPSSPVYVPLTADPRLIGFLLRFARNSTASRWQKA

SEQ ID NO: 834725 - protein, 39 aa, Mycobacterium
LLSQRLLAVPRHGWINLHFSLLPAWRGAAPVQAAIAAGD

SEQ ID NO: 834726 - protein, 18 aa, Mycobacterium
LLSRMFTPRRIAALEPMI

SEQ ID NO: 834727 - protein, 25 aa, Mycobacterium
LLSSGLGWAVWTDGRIKFTTGGGLP

SEQ ID NO: 834728 - protein, 25 aa, Mycobacterium
LLSSRFSMWMAWGPELTFFCNSAYR

SEQ ID NO: 834729 - protein, 40 aa, Mycobacterium
LLSTGTDVFLPHAQLIFGGEPLRWPTVRRVRAARPGLTIW

SEQ ID NO: 834730 - protein, 19 aa, Mycobacterium
LLSTWDLRPFTDDSDFLVA

SEQ ID NO: 834731 - protein, 28 aa, Mycobacterium
LLSVGPPIRHFFRDSTWWPRVPQTTKDA

SEQ ID NO: 834732 - protein, 29 aa, Mycobacterium
LLSVLPEKQREILILRVVVGMSAEETAEA

SEQ ID NO: 834733 - protein, 28 aa, Mycobacterium
LLTAERTMLNLLCHLSGVATATAAWVDA

SEQ ID NO: 834734 - protein, 19 aa, Mycobacterium
LLTAFVTTTPELALEQAKA

SEQ ID NO: 834735 - protein, 19 aa, Mycobacterium
LLTALREGSLDTALIALPA

SEQ ID NO: 834736 - protein, 17 aa, Mycobacterium
LLTALRLDDAFTGDAVI

SEQ ID NO: 834737 - protein, 24 aa, Mycobacterium
LLTDLALSCAFWVGSGRALRVLDV

SEQ ID NO: 834738 - protein, 18 aa, Mycobacterium
LLTDLRKLRTAYLNINYR

SEQ ID NO: 834739 - protein, 19 aa, Mycobacterium
LLTDPDADPALILRELWDL

SEQ ID NO: 834740 - protein, 19 aa, Mycobacterium
LLTDPRLQTRMAVLQQPQA

SEQ ID NO: 834741 - protein, 27 aa, Mycobacterium
LLTESVLHLFHAGGKRFRPLFTVLAAQ

SEQ ID NO: 834742 - protein, 17 aa, Mycobacterium
LLTFAYGTKAPADNDLT

SEQ ID NO: 834743 - protein, 20 aa, Mycobacterium
LLTGFLAQLKTDLQRHSNAD

SEQ ID NO: 834744 - protein, 24 aa, Mycobacterium
LLTGGVVKPILWGPGKAAAVQRFA

SEQ ID NO: 834745 - protein, 25 aa, Mycobacterium
LLTGHYVMTALFLKTLGIGPEGEGE

SEQ ID NO: 834746 - protein, 27 aa, Mycobacterium
LLTGIRKLAWPKLKQHYGERLEQLYAE

SEQ ID NO: 834747 - protein, 27 aa, Mycobacterium
LLTGIRKLAWPKLRQHYGERLEQLYTE

SEQ ID NO: 834748 - protein, 17 aa, Mycobacterium
LLTGTRWLDVARGEGVD

SEQ ID NO: 834749 - protein, 18 aa, Mycobacterium
LLTHYMPAHYAGGWWMDS

SEQ ID NO: 834750 - protein, 18 aa, Mycobacterium
LLTHYMPAHYSAGWWMDT

SEQ ID NO: 834751 - protein, 19 aa, Mycobacterium
LLTILHDGGYHDTEIIRWL

SEQ ID NO: 834752 - protein, 19 aa, Mycobacterium
LLTILHDGGYRDTEIVRWL

SEQ ID NO: 834753 - protein, 27 aa, Mycobacterium
LLTLAEILRRSTFLADLIPADPLISHQ

SEQ ID NO: 834754 - protein, 17 aa, Mycobacterium
LLTLARTGDQLQGIKKG

SEQ ID NO: 834755 - protein, 18 aa, Mycobacterium
LLTLDPAPSPPPPGPPPP

SEQ ID NO: 834756 - protein, 20 aa, Mycobacterium
LLTLDQWNAIIDVNIRGVVH

SEQ ID NO: 834757 - protein, 19 aa, Mycobacterium
LLTLEFLNRMRHEHNVFCS

SEQ ID NO: 834758 - protein, 20 aa, Mycobacterium
LLTLHRRLGRWVQLGGHCDD

SEQ ID NO: 834759 - protein, 17 aa, Mycobacterium
LLTLNRPKAINSLTYDM

SEQ ID NO: 834760 - protein, 18 aa, Mycobacterium
LLTLQHPAVYTAGRRTEP

SEQ ID NO: 834761 - protein, 18 aa, Mycobacterium
LLTNVYIAAYRNPFLGAK

SEQ ID NO: 834762 - protein, 17 aa, Mycobacterium
LLTPLLPNGGAGAINPP

SEQ ID NO: 834763 - protein, 19 aa, Mycobacterium
LLTPLVNGIRVSGPFIADW

SEQ ID NO: 834764 - protein, 23 aa, Mycobacterium
LLTQVRTLPLAALFLGPDRAEKH

SEQ ID NO: 834765 - protein, 26 aa, Mycobacterium
LLTRAVVLPILTTVLRSVYTDLAEME

SEQ ID NO: 834766 - protein, 18 aa, Mycobacterium
LLTRDPRRYRSFFPRLEL

SEQ ID NO: 834767 - protein, 17 aa, Mycobacterium
LLTRLGITPLPNTAGCR

SEQ ID NO: 834768 - protein, 17 aa, Mycobacterium
LLTRVFPARTCSAGVFK

SEQ ID NO: 834769 - protein, 34 aa, Mycobacterium
LLTSFFGVSGWGRILVPINFRLAPAEIEYIVGHS

SEQ ID NO: 834770 - protein, 24 aa, Mycobacterium
LLTSGLGWAVWSDGRIKFTTGNGL

SEQ ID NO: 834771 - protein, 28 aa, Mycobacterium
LLTSMSLVTPWLMAVPDRFSLMHGDYRL

SEQ ID NO: 834772 - protein, 28 aa, Mycobacterium
LLTVGDRPLYLFGHSMGALVAFEVARRL

SEQ ID NO: 834773 - protein, 19 aa, Mycobacterium
LLTYLPLITTAVKAQFHPD

SEQ ID NO: 834774 - protein, 18 aa, Mycobacterium
LLVACDLQRPGAVNQLQV

SEQ ID NO: 834775 - protein, 20 aa, Mycobacterium
LLVAECLRRGLWAGLKPAEL

SEQ ID NO: 834776 - protein, 18 aa, Mycobacterium
LLVAPDLLRKVTVHTPAD

SEQ ID NO: 834777 - protein, 27 aa, Mycobacterium
LLVDGLRVLTFDHLVPQKAGFEPWIVS

SEQ ID NO: 834778 - protein, 26 aa, Mycobacterium
LLVDHYADDWTRLWWVRADGTATVHT

SEQ ID NO: 834779 - protein, 20 aa, Mycobacterium
LLVDVIGLPWEDVHAEACRW

SEQ ID NO: 834780 - protein, 20 aa, Mycobacterium
LLVDVIGLPWEEVHAEACRW

SEQ ID NO: 834781 - protein, 26 aa, Mycobacterium
LLVEKRPDLAPIFANAMPIVMAEAID

SEQ ID NO: 834782 - protein, 26 aa, Mycobacterium
LLVESGMAPLFPLVVIVYADVEVRLR

SEQ ID NO: 834783 - protein, 24 aa, Mycobacterium
LLVESGMAPLFPLVVVVHADMEVR

SEQ ID NO: 834784 - protein, 25 aa, Mycobacterium
LLVESGMAPLFPLVVVVHADVEVRV

SEQ ID NO: 834785 - protein, 24 aa, Mycobacterium
LLVESKMAPLFPLVVIVHADEEVR

SEQ ID NO: 834786 - protein, 23 aa, Mycobacterium
LLVEVVVPVPPAYMGFHLSNLWG

SEQ ID NO: 834787 - protein, 17 aa, Mycobacterium
LLVFDHSRAELVDLKNF

SEQ ID NO: 834788 - protein, 17 aa, Mycobacterium
LLVFFHGGGWVIGDLET

SEQ ID NO: 834789 - protein, 18 aa, Mycobacterium
LLVGHYMLTARLLETLEI

SEQ ID NO: 834790 - protein, 17 aa, Mycobacterium
LLVHEEFLRHVDGGYTL

SEQ ID NO: 834791 - protein, 21 aa, Mycobacterium
LLVIGAGQLLGTRRTALHPLG

SEQ ID NO: 834792 - protein, 19 aa, Mycobacterium
LLVLGEFPNVRTAKRAMLT

SEQ ID NO: 834793 - protein, 18 aa, Mycobacterium
LLVLLDAMTATITGHAPR

SEQ ID NO: 834794 - protein, 17 aa, Mycobacterium
LLVLTMHHIIVDGWSIG

SEQ ID NO: 834795 - protein, 19 aa, Mycobacterium
LLVMPVALPSQRLAWLPEP

SEQ ID NO: 834796 - protein, 26 aa, Mycobacterium
LLVNAAGFFIPKPFLEYGQLDYDAYM

SEQ ID NO: 834797 - protein, 17 aa, Mycobacterium
LLVNLKPSAIRRLGLTY

SEQ ID NO: 834798 - protein, 18 aa, Mycobacterium
LLVNLKPSAVRRLRLTYE

SEQ ID NO: 834799 - protein, 24 aa, Mycobacterium
LLVNMKPSVIRRLGLTYDALKEFN

SEQ ID NO: 834800 - protein, 17 aa, Mycobacterium
LLVPDFFDPSTDQWHIA

SEQ ID NO: 834801 - protein, 17 aa, Mycobacterium
LLVPRLMPHAFGATGNS

SEQ ID NO: 834802 - protein, 17 aa, Mycobacterium
LLVPTPDGGLNAPTLRP

SEQ ID NO: 834803 - protein, 21 aa, Mycobacterium
LLVQERADRLWTLPGGWCDVL

SEQ ID NO: 834804 - protein, 18 aa, Mycobacterium
LLVQQHFFMHVDVGMQTM

SEQ ID NO: 834805 - protein, 17 aa, Mycobacterium
LLVQQLAVHGSIKLIVT

SEQ ID NO: 834806 - protein, 18 aa, Mycobacterium
LLVRERIELMLDPDTAFL

SEQ ID NO: 834807 - protein, 19 aa, Mycobacterium
LLVRERIELMLDPDTAFLE

SEQ ID NO: 834808 - protein, 25 aa, Mycobacterium
LLVRSGHRLLPVTRGGPQENRLRAG

SEQ ID NO: 834809 - protein, 18 aa, Mycobacterium
LLVRTLSAALSLDFKRVQ

SEQ ID NO: 834810 - protein, 24 aa, Mycobacterium
LLVRVRDGIGLVGPLVIPGVTSCL

SEQ ID NO: 834811 - protein, 25 aa, Mycobacterium
LLVSADDRFVLTPRGRLLADAVVRT

SEQ ID NO: 834812 - protein, 18 aa, Mycobacterium
LLVSVFLDKDFSFVVSSE

SEQ ID NO: 834813 - protein, 19 aa, Mycobacterium
LLVSVFLDKDFSFVVSSEA

SEQ ID NO: 834814 - protein, 19 aa, Mycobacterium
LLVSVFLDKDFTFVVSSEA

SEQ ID NO: 834815 - protein, 26 aa, Mycobacterium
LLVTDLAGGWIPPHVRLPSHVTLLEP

SEQ ID NO: 834816 - protein, 24 aa, Mycobacterium
LLVTPAARGLFSRAIAQSSPATSV

SEQ ID NO: 834817 - protein, 18 aa, Mycobacterium
LLVVDFSRVLAGPYATMM

SEQ ID NO: 834818 - protein, 17 aa, Mycobacterium
LLVVHGDKDRLIPVAGS

SEQ ID NO: 834819 - protein, 26 aa, Mycobacterium
LLVVRELLLGPKRFTDLLAGLPGASP

SEQ ID NO: 834820 - protein, 17 aa, Mycobacterium
LLVWERRGESVRATVHF

SEQ ID NO: 834821 - protein, 18 aa, Mycobacterium
LLVYPNVIAVERQLRVVP

SEQ ID NO: 834822 - protein, 24 aa, Mycobacterium
LLWSAPIKEFPTLKIALSEGGTGW

SEQ ID NO: 834823 - protein, 17 aa, Mycobacterium
LLWSRPIKDYPDLKIGL

SEQ ID NO: 834824 - protein, 42 aa, Mycobacterium
LLYEARGAASCFPTLLRKGERLLVFLPLAHVLARSLSMSAFA

SEQ ID NO: 834825 - protein, 19 aa, Mycobacterium
LLYEYVVNGNGPRVISSGL

SEQ ID NO: 834826 - protein, 17 aa, Mycobacterium
LLYGLQITTVADPKAVL

SEQ ID NO: 834827 - protein, 17 aa, Mycobacterium
LLYIHRAGRGAYLDEVE

SEQ ID NO: 834828 - protein, 19 aa, Mycobacterium
LLYNSQPWRWAAEGSRLEP

SEQ ID NO: 834829 - protein, 19 aa, Mycobacterium
LLYRFRAIDRLPEAPSAPQ

SEQ ID NO: 834830 - protein, 17 aa, Mycobacterium
LLYRLRAIDRLPEPPSA

SEQ ID NO: 834831 - protein, 18 aa, Mycobacterium
LLYRTAGPVATITLNRPE

SEQ ID NO: 834832 - protein, 18 aa, Mycobacterium
LMAAMLSAGITPVVREYG

SEQ ID NO: 834833 - protein, 18 aa, Mycobacterium
LMAANTPMLLKAGLVEGN

SEQ ID NO: 834834 - protein, 18 aa, Mycobacterium
LMAAWTSLYDASKGQPDG

SEQ ID NO: 834835 - protein, 25 aa, Mycobacterium
LMACHAYTWKQVVGTALFAENELAL

SEQ ID NO: 834836 - protein, 17 aa, Mycobacterium
LMADWPEFPFAYGGVDD

SEQ ID NO: 834837 - protein, 28 aa, Mycobacterium
LMAEDFVWQLHVPLSPVVRGRDAARAEL

SEQ ID NO: 834838 - protein, 18 aa, Mycobacterium
LMAEQVDWMLGNGGLEWA

SEQ ID NO: 834839 - protein, 27 aa, Mycobacterium
LMAGLRPRLAAPDWLAGPFTVAQQLEF

SEQ ID NO: 834840 - protein, 18 aa, Mycobacterium
LMAMEDYLGYRIVARDPD

SEQ ID NO: 834841 - protein, 19 aa, Mycobacterium
LMAPTYAVPRLLARNNLTL

SEQ ID NO: 834842 - protein, 29 aa, Mycobacterium
LMARFERDAIPLLDQLYGGALRMTRNPAD

SEQ ID NO: 834843 - protein, 34 aa, Mycobacterium
LMARPKILLLDEPSMGLAPLLITKIFNIIEEINA

SEQ ID NO: 834844 - protein, 25 aa, Mycobacterium
LMARPKILLLDEPSMGLAPMVISQI

SEQ ID NO: 834845 - protein, 29 aa, Mycobacterium
LMATLGNPLVAAALYYAVMARGGYTSTSD

SEQ ID NO: 834846 - protein, 17 aa, Mycobacterium
LMAVDDWPLLRWRMREY

SEQ ID NO: 834847 - protein, 26 aa, Mycobacterium
LMAVDDWPLLRWRMRQYRHGRWGIHI

SEQ ID NO: 834848 - protein, 25 aa, Mycobacterium
LMAVDDWPLLRWRMRQYRHGRWGTE

SEQ ID NO: 834849 - protein, 26 aa, Mycobacterium
LMAVDDWPLLRWRMRQYRHGRWGTHI

SEQ ID NO: 834850 - protein, 26 aa, Mycobacterium
LMAVEDWPLLRWRMRQYRHGRWGTHI

SEQ ID NO: 834851 - protein, 31 aa, Mycobacterium; identical to SEQ ID NO: 128928

SEQ ID NO: 834852 - protein, 23 aa, Mycobacterium
LMCDQLYGRIVLASSIGGLYGNQ

SEQ ID NO: 834853 - protein, 19 aa, Mycobacterium
LMCVCRACYLLFTDSAAEL

SEQ ID NO: 834854 - protein, 30 aa, Mycobacterium
LMDATIFRDTLIMAYQWPADRQSLSWTLES

SEQ ID NO: 834855 - protein, 19 aa, Mycobacterium
LMDGMDLVVLGLGGRQVTS

SEQ ID NO: 834856 - protein, 21 aa, Mycobacterium
LMDGMDLVVLGLGGRTVPATR

SEQ ID NO: 834857 - protein, 18 aa, Mycobacterium
LMDIDPIYVWTHDSIGLG

SEQ ID NO: 834858 - protein, 23 aa, Mycobacterium
LMDPQHRILMETAWRAVEHSGIA

SEQ ID NO: 834859 - protein, 34 aa, Mycobacterium
LMDSRLGVPSPLDNPWLLLIELARDSDPTDDLAE

SEQ ID NO: 834860 - protein, 25 aa, Mycobacterium
LMDSVTVLLHRIGVAYTAIMNPGFR

SEQ ID NO: 834861 - protein, 24 aa, Mycobacterium
LMDSVTVLLHRLGVGYTAIMTPVF

SEQ ID NO: 834862 - protein, 26 aa, Mycobacterium
LMDSVTVLLHRLGVPYAAIMTPVFQV

SEQ ID NO: 834863 - protein, 26 aa, Mycobacterium
LMDSVTVLLHRLGVPYTAIMTPVFDV

SEQ ID NO: 834864 - protein, 22 aa, Mycobacterium
LMEAFHYRYHPLTLRAEDIIAS

SEQ ID NO: 834865 - protein, 38 aa, Mycobacterium
LMEIRTTLTLPPFGVKDGIIPLLLIAGLVSRSDEIALY

SEQ ID NO: 834866 - protein, 19 aa, Mycobacterium
LMEQTSRAVLILGAVLGAA

SEQ ID NO: 834867 - protein, 27 aa, Mycobacterium
LMETPQLPLLSEYWDLVLGDKLIEAMD

SEQ ID NO: 834868 - protein, 19 aa, Mycobacterium
LMEWVAMVGCPIIGINDSA

SEQ ID NO: 834869 - protein, 17 aa, Mycobacterium
LMFGHGLAVAAMRAQDG

SEQ ID NO: 834870 - protein, 17 aa, Mycobacterium
LMGCENLPGLRWPDLSL

SEQ ID NO: 834871 - protein, 18 aa, Mycobacterium
LMGDRINHFIPNVTFDPI

SEQ ID NO: 834872 - protein, 18 aa, Mycobacterium
LMGGYFAGLLNRSVLDTT

SEQ ID NO: 834873 - protein, 17 aa, Mycobacterium
LMGGYFAGLLNRSVLET

SEQ ID NO: 834874 - protein, 21 aa, Mycobacterium
LMGIATKLGLSPQAAVLGAFE

SEQ ID NO: 834875 - protein, 19 aa, Mycobacterium
LMGIMLTKYPEKFGALVCD

SEQ ID NO: 834876 - protein, 19 aa, Mycobacterium
LMGIMLTQYPEKFGALVCS

SEQ ID NO: 834877 - protein, 24 aa, Mycobacterium
LMGQRLVEALLDGGLPPSAVALVQ

SEQ ID NO: 834878 - protein, 33 aa, Mycobacterium
LMGRGTTWPRQLPWLIRHGRVYTYDAPWHRGRE

SEQ ID NO: 834879 - protein, 19 aa, Mycobacterium
LMGRNPAFQSALDPGTFES

SEQ ID NO: 834880 - protein, 30 aa, Mycobacterium
LMGRRVLEMLPIPPIALQLRTGVAMVSYAD

SEQ ID NO: 834881 - protein, 18 aa, Mycobacterium
LMGRTPELYIAMLGALRN

SEQ ID NO: 834882 - protein, 20 aa, Mycobacterium
LMGVMLTAYPELFGALVCQV

SEQ ID NO: 834883 - protein, 26 aa, Mycobacterium
LMHADDIRLWRMAVFDVLVNNADRKG

SEQ ID NO: 834884 - protein, 27 aa, Mycobacterium
LMHEVYEEWFSHKVPLKVWDQQMLDSP

SEQ ID NO: 834885 - protein, 19 aa, Mycobacterium
LMHGIGGTLIRLFGPEHVR

SEQ ID NO: 834886 - protein, 19 aa, Mycobacterium
LMHGVAPVVVGWPVGQLYT

SEQ ID NO: 834887 - protein, 18 aa, Mycobacterium
LMHRLRTTPPATLAGFPA

SEQ ID NO: 834888 - protein, 19 aa, Mycobacterium
LMHRSRLQVLMTVLARENP

SEQ ID NO: 834889 - protein, 17 aa, Mycobacterium
LMILASEDIGMADPTAL

SEQ ID NO: 834890 - protein, 19 aa, Mycobacterium
LMIRMRRLSDRFVKVKSSR

SEQ ID NO: 834891 - protein, 18 aa, Mycobacterium
LMIRMRRLSDRFVRVKNT

SEQ ID NO: 834892 - protein, 19 aa, Mycobacterium
LMISLRFDAQPTVAASGVA

SEQ ID NO: 834893 - protein, 26 aa, Mycobacterium
LMKEWPDVLATPRPTPAYWLHEGNML

SEQ ID NO: 834894 - protein, 22 aa, Mycobacterium
LMLAGSAKRSYWWAGTATLGVA

SEQ ID NO: 834895 - protein, 17 aa, Mycobacterium
LMLAPLAPHLAEELWLR

SEQ ID NO: 834896 - protein, 20 aa, Mycobacterium
LMLDKFIEPATLAAAPTLPG

SEQ ID NO: 834897 - protein, 18 aa, Mycobacterium
LMLLDHLTHGRVIGGMGP

SEQ ID NO: 834898 - protein, 19 aa, Mycobacterium
LMLPVEPDTRLLGETELWQ

SEQ ID NO: 834899 - protein, 18 aa, Mycobacterium
LMLRRLEHVPIATVVRLP

SEQ ID NO: 834900 - protein, 22 aa, Mycobacterium
LMLTASKRRSAWWAGTATLGVA

SEQ ID NO: 834901 - protein, 18 aa, Mycobacterium
LMMANRIEFYPFEIGAQH

SEQ ID NO: 834902 - protein, 18 aa, Mycobacterium
LMMASTVHPSLGALLSAH

SEQ ID NO: 834903 - protein, 17 aa, Mycobacterium
LMMLHPPSETTPSLPEC

SEQ ID NO: 834904 - protein, 19 aa, Mycobacterium
LMMPNLHMMARLRTGQPLG

SEQ ID NO: 834905 - protein, 19 aa, Mycobacterium
LMNIDPIYVWTHDSIGLGE

SEQ ID NO: 834906 - protein, 22 aa, Mycobacterium
LMNLVIALLSTRSFITADRIRE

SEQ ID NO: 834907 - protein, 22 aa, Mycobacterium
LMNLVIALLSTRTYLPAEKIRT

SEQ ID NO: 834908 - protein, 22 aa, Mycobacterium
LMNPNHYLAVAIDYLFSHRGGW

SEQ ID NO: 834909 - protein, 20 aa, Mycobacterium
LMPCFARLYEELGITKADIG

SEQ ID NO: 834910 - protein, 26 aa, Mycobacterium
LMPGQQSAWHTVRSAELWLYHSGGPL

SEQ ID NO: 834911 - protein, 26 aa, Mycobacterium
LMPPQMLHMILPRKDYEIVDDSWDVV

SEQ ID NO: 834912 - protein, 25 aa, Mycobacterium
LMPPQMLHMILPRKDYEIVEDSWNV

SEQ ID NO: 834913 - protein, 23 aa, Mycobacterium
LMPRYVRSITAWQLSRAQDPTGD

SEQ ID NO: 834914 - protein, 28 aa, Mycobacterium
LMQPNATALRFLGKTLTWGELRGRVAAL

SEQ ID NO: 834915 - protein, 17 aa, Mycobacterium
LMQTAGVDRLSALYSAI

SEQ ID NO: 834916 - protein, 17 aa, Mycobacterium
LMRASVASYARYWREAF

SEQ ID NO: 834917 - protein, 18 aa, Mycobacterium
LMRDVRFLRIGEGPSEAL

SEQ ID NO: 834918 - protein, 24 aa, Mycobacterium
LMREGIGHLPIALVGGVAGAIAGA

SEQ ID NO: 834919 - protein, 21 aa, Mycobacterium
LMRFPGRFSEHLLAEHLQKVS

SEQ ID NO: 834920 - protein, 18 aa, Mycobacterium
LMRLDHVVLWTKDVRAAM

SEQ ID NO: 834921 - protein, 19 aa, Mycobacterium
LMRLLIDEHHLAWDDAWDL

SEQ ID NO: 834922 - protein, 19 aa, Mycobacterium
LMRNLWAYVVIFCGHFPDG

SEQ ID NO: 834923 - protein, 26 aa, Mycobacterium
LMRRSGMIFIRRNIGDDPLYKYVLRE

SEQ ID NO: 834924 - protein, 17 aa, Mycobacterium
LMRTLNPAAYTGLDLNP

SEQ ID NO: 834925 - protein, 22 aa, Mycobacterium
LMRVRHRLSKLLLRQGRVYSGG

SEQ ID NO: 834926 - protein, 26 aa, Mycobacterium
LMSAAAGMRFPLFVKAVAGGGGRGMR

SEQ ID NO: 834927 - protein, 26 aa, Mycobacterium
LMSAGVIEVAPLAYMRGRTLNDAFII

SEQ ID NO: 834928 - protein, 26 aa, Mycobacterium
LMSAGVIEVAPLAYMRGRTLNSAFIV

SEQ ID NO: 834929 - protein, 25 aa, Mycobacterium
LMSFKPRYDNFIGGQWVAPTAGRYF

SEQ ID NO: 834930 - protein, 24 aa, Mycobacterium
LMSGYLGSIGFGFPAAMGAWAAAP

SEQ ID NO: 834931 - protein, 20 aa, Mycobacterium
LMSMFGLHRKLRGAAAGHFA

SEQ ID NO: 834932 - protein, 17 aa, Mycobacterium
LMSMMTGRRPAVRATDR

SEQ ID NO: 834933 - protein, 24 aa, Mycobacterium
LMSPGRGPHRYVCGGVMLTFDEMI

SEQ ID NO: 834934 - protein, 30 aa, Mycobacterium
LMSPTAFVRRPQRWIHALSAGSRTGRVVTA

SEQ ID NO: 834935 - protein, 18 aa, Mycobacterium
LMSRFDPERFLRLITDHR

SEQ ID NO: 834936 - protein, 20 aa, Mycobacterium
LMSVGPPWKVQVDEWLVDPA

SEQ ID NO: 834937 - protein, 18 aa, Mycobacterium
LMSYFADHRDRVYRPATA

SEQ ID NO: 834938 - protein, 20 aa, Mycobacterium
LMSYQREYGLYPDGICGPET

SEQ ID NO: 834939 - protein, 26 aa, Mycobacterium
LMTAGVIEVAPLAYMRGRTLNDAFIV

SEQ ID NO: 834940 - protein, 25 aa, Mycobacterium
LMTDYMTRLMRYVEFMKKVVPMHDD

SEQ ID NO: 834941 - protein, 17 aa, Mycobacterium
LMTFSLYLARRVPQRMG

SEQ ID NO: 834942 - protein, 18 aa, Mycobacterium
LMTFTRAVGAYSLDDGLR

SEQ ID NO: 834943 - protein, 19 aa, Mycobacterium
LMTGCPGVFAGGDMVPCER

SEQ ID NO: 834944 - protein, 18 aa, Mycobacterium
LMTLTTLDPPVIALVSVW

SEQ ID NO: 834945 - protein, 18 aa, Mycobacterium
LMTNYLPMAAHHGAQMFC

SEQ ID NO: 834946 - protein, 18 aa, Mycobacterium
LMTRFPKAARRLIRHLNT

SEQ ID NO: 834947 - protein, 19 aa, Mycobacterium
LMTTLLYHMRDKGIRYGLQ

SEQ ID NO: 834948 - protein, 19 aa, Mycobacterium
LMTTLLYHMRDNGIRYGLQ

SEQ ID NO: 834949 - protein, 17 aa, Mycobacterium
LMTYKGLMFSGVPNFAI

SEQ ID NO: 834950 - protein, 18 aa, Mycobacterium
LMTYKGLMFSGVPNFAIT

SEQ ID NO: 834951 - protein, 24 aa, Mycobacterium
LMVAAAVMPHVAWATTMAAQAEQT

SEQ ID NO: 834952 - protein, 24 aa, Mycobacterium
LMVDMAHFAGLVATGLHPSPVPHA

SEQ ID NO: 834953 - protein, 18 aa, Mycobacterium
LMVHGRDERLDWWAGPWP

SEQ ID NO: 834954 - protein, 18 aa, Mycobacterium
LMVHNLTGWPAAVVRCGT

SEQ ID NO: 834955 - protein, 21 aa, Mycobacterium
LMVPGPRGVVAVLTPWNDPVA

SEQ ID NO: 834956 - protein, 19 aa, Mycobacterium
LMVWIDKMTKRNLVITFGG

SEQ ID NO: 834957 - protein, 19 aa, Mycobacterium
LMVYREGNTSRFAGPAFLL

SEQ ID NO: 834958 - protein, 20 aa, Mycobacterium
LMYMGGDGFYWRHTFHPAYG

SEQ ID NO: 834959 - protein, 29 aa, Mycobacterium
LNAAHGRTFFLATRLLAPDQRPPVHALYG

SEQ ID NO: 834960 - protein, 27 aa, Mycobacterium
LNAAHSTLAYLGLRLGYRSIAEAVHDS

SEQ ID NO: 834961 - protein, 27 aa, Mycobacterium
LNADEFLTVMLRWLNAFVPKPGQTIPG

SEQ ID NO: 834962 - protein, 24 aa, Mycobacterium
LNAETFYFAHVTFFYHHLMVVTER

SEQ ID NO: 834963 - protein, 33 aa, Mycobacterium
LNAETFYFAHVTFFYYLLIRVVEQLHFDGSMPR

SEQ ID NO: 834964 - protein, 20 aa, Mycobacterium
LNAFEPIIARALLSSINHLA

SEQ ID NO: 834965 - protein, 17 aa, Mycobacterium
LNAFTSREHTCYYAHVL

SEQ ID NO: 834966 - protein, 17 aa, Mycobacterium
LNAHWSRLWSGQPEILD

SEQ ID NO: 834967 - protein, 18 aa, Mycobacterium
LNAKPFDLSLLGDWGERI

SEQ ID NO: 834968 - protein, 21 aa, Mycobacterium
LNARTPLPDWWADLDADAVTA

SEQ ID NO: 834969 - protein, 27 aa, Mycobacterium
LNASHQALCYFGYLAGYRLVHDAASDP

SEQ ID NO: 834970 - protein, 22 aa, Mycobacterium
LNASPISLWQLTANTTFRVEAV

SEQ ID NO: 834971 - protein, 24 aa, Mycobacterium
LNATNFFGINTVPIAFNEMDYFVR

SEQ ID NO: 834972 - protein, 19 aa, Mycobacterium
LNATTRAIPRADRRLFEFH

SEQ ID NO: 834973 - protein, 30 aa, Mycobacterium
LNAVNGPTEALLGRPLIGNGADGTAPGQAG

SEQ ID NO: 834974 - protein, 19 aa, Mycobacterium
LNAVRAIVGGPGLRRLRTA

SEQ ID NO: 834975 - protein, 27 aa, Mycobacterium
LNAVRVFLHDLLWAQDPRGLQIRLAQF

SEQ ID NO: 834976 - protein, 18 aa, Mycobacterium
LNCMSVRWGLWQGTTIAG

SEQ ID NO: 834977 - protein, 20 aa, Mycobacterium
LNCVPSMLDMILDLGGDRLG

SEQ ID NO: 834978 - protein, 20 aa, Mycobacterium
LNDDTRPRKLRPGDSLLVDT

SEQ ID NO: 834979 - protein, 25 aa, Mycobacterium
LNDEGLLVNLPISQALKYGNKPVEF

SEQ ID NO: 834980 - protein, 17 aa, Mycobacterium
LNDFFRIVVAAVHQQHG

SEQ ID NO: 834981 - protein, 24 aa, Mycobacterium
LNDGASIPQLGFGVYQISPEDTAD

SEQ ID NO: 834982 - protein, 17 aa, Mycobacterium
LNDGNFFELDWALQRHN

SEQ ID NO: 834983 - protein, 19 aa, Mycobacterium
LNDGVSIPQLGFGVFQIKP

SEQ ID NO: 834984 - protein, 26 aa, Mycobacterium
LNDIEKRWVLKNPSHLFALDALMEVY

SEQ ID NO: 834985 - protein, 31 aa, Mycobacterium
LNDIRLLGPVADLFPILALPGQDVQGFSNLL

SEQ ID NO: 834986 - protein, 25 aa, Mycobacterium
LNDLDALIVVSSPWWDGASAAGQTM

SEQ ID NO: 834987 - protein, 21 aa, Mycobacterium
LNDLRMRLAAARLPETETVYR

SEQ ID NO: 834988 - protein, 26 aa, Mycobacterium
LNDPVRQALIPPLQEIVKDRGLWATH

SEQ ID NO: 834989 - protein, 38 aa, Mycobacterium
LNDPVRQALIPPLQEIVKQRGLWATHLGPHLGGPGYGQ

SEQ ID NO: 834990 - protein, 25 aa, Mycobacterium
LNDQMARPRWQAKAALLHLKETEQV

SEQ ID NO: 834991 - protein, 26 aa, Mycobacterium
LNDREKRWVLKNPSHLFALDALFATY

SEQ ID NO: 834992 - protein, 25 aa, Mycobacterium
LNDTEKRWVLKNPSHLFALDALMAT

SEQ ID NO: 834993 - protein, 23 aa, Mycobacterium
LNDTRVYFVEPAKWVAALRHANG

SEQ ID NO: 834994 - protein, 24 aa, Mycobacterium
LNDVRSFLNPLPHVSFVHGAERVH

SEQ ID NO: 834995 - protein, 18 aa, Mycobacterium
LNEAFASVVLKFQKDLNI

SEQ ID NO: 834996 - protein, 23 aa, Mycobacterium
LNEAGLAANLLWLAESQYPANTG

SEQ ID NO: 834997 - protein, 23 aa, Mycobacterium
LNEAGLDWRQIQLVAGADTIRNG

SEQ ID NO: 834998 - protein, 38 aa, Mycobacterium
LNEAVTRMWTFLAPAYDLPFLQQWVYRPPHNEVIAQLR

SEQ ID NO: 834999 - protein, 26 aa, Mycobacterium
LNEDDLGRLNGYLLPILGADGRDGLT

SEQ ID NO: 835000 - protein, 32 aa, Mycobacterium
LNEDQLKDIALYLNFDMLGSPNPGYFTYDGDQ

SEQ ID NO: 835001 - protein, 18 aa, Mycobacterium
LNEEFPRLMVYRGPRRKG

SEQ ID NO: 835002 - protein, 20 aa, Mycobacterium
LNELAPWVRQWHNEIDPEYG

SEQ ID NO: 835003 - protein, 22 aa, Mycobacterium
LNELRTWFGFGVAGNFAGHLEQ

SEQ ID NO: 835004 - protein, 19 aa, Mycobacterium
LNENPFPPLPAVRAALIRS

SEQ ID NO: 835005 - protein, 19 aa, Mycobacterium
LNETLAHCHYVLPATTMYE

SEQ ID NO: 835006 - protein, 19 aa, Mycobacterium
LNETLDRYPGAREFFWVQE

SEQ ID NO: 835007 - protein, 24 aa, Mycobacterium
LNETRTGDLWLFRGRSRPDRAIQT

SEQ ID NO: 835008 - protein, 19 aa, Mycobacterium
LNEVCCIYPITPSSPMAEL

SEQ ID NO: 835009 - protein, 20 aa, Mycobacterium
LNEWMYEQWSFNYKDRIFAT

SEQ ID NO: 835010 - protein, 18 aa, Mycobacterium
LNFAVGPFASMLDRARDL

SEQ ID NO: 835011 - protein, 18 aa, Mycobacterium
LNFAVGPFASMLDRARDV

SEQ ID NO: 835012 - protein, 17 aa, Mycobacterium
LNFQTMVAELTGLDIAN

SEQ ID NO: 835013 - protein, 17 aa, Mycobacterium
LNFQTMVTDLTGLEIAN

SEQ ID NO: 835014 - protein, 18 aa, Mycobacterium
LNFRHLPPVPGTEDKGPV

SEQ ID NO: 835015 - protein, 23 aa, Mycobacterium
LNGFLAGILLGFDPARAPGLAAT

SEQ ID NO: 835016 - protein, 18 aa, Mycobacterium
LNGFTIPTITIDALSITD

SEQ ID NO: 835017 - protein, 29 aa, Mycobacterium
LNGGKRLRPAFAYWGWRAVATGEPDSEVL

SEQ ID NO: 835018 - protein, 19 aa, Mycobacterium
LNGGVIGAFAAWTPVHRTL

SEQ ID NO: 835019 - protein, 25 aa, Mycobacterium
LNGHRGCVIWFTGLSASGKSTIANL

SEQ ID NO: 835020 - protein, 25 aa, Mycobacterium
LNGHRGCVIWFTGLSGSGKSTVANL

SEQ ID NO: 835021 - protein, 19 aa, Mycobacterium
LNGKSLLGNKDRDWRRIRG

SEQ ID NO: 835022 - protein, 20 aa, Mycobacterium
LNGLKPNGLLVLRIPDRDSV

SEQ ID NO: 835023 - protein, 19 aa, Mycobacterium
LNGLLILSHLEVVNALGAM

SEQ ID NO: 835024 - protein, 18 aa, Mycobacterium
LNGLPVSVIIRTTLQDLE

SEQ ID NO: 835025 - protein, 17 aa, Mycobacterium
LNGPIMAVAWRAADFIL

SEQ ID NO: 835026 - protein, 17 aa, Mycobacterium
LNGPNLNLLGTRQPEVY

SEQ ID NO: 835027 - protein, 20 aa, Mycobacterium
LNGPWLADRLLELGVELSHI

SEQ ID NO: 835028 - protein, 24 aa, Mycobacterium
LNGSQIPLCLDTGHLLIGGTDPLE

SEQ ID NO: 835029 - protein, 23 aa, Mycobacterium
LNGTKAFLPYLIASGDGHVINIS

SEQ ID NO: 835030 - protein, 37 aa, Mycobacterium
LNGWDPLLQDGLPQPTLAWLDEIAPGGPLVIIHNSGH

SEQ ID NO: 835031 - protein, 26 aa, Mycobacterium
LNGWDPLLQTGLPEPTLAWLDGIAPE

SEQ ID NO: 835032 - protein, 22 aa, Mycobacterium
LNGYNWLTGIRIQDGLLKQLGS

SEQ ID NO: 835033 - protein, 23 aa, Mycobacterium
LNHAMDVPLLVKAALNGHGREVP

SEQ ID NO: 835034 - protein, 21 aa, Mycobacterium
LNHDVLLVAVGPLAAMALAVA

SEQ ID NO: 835035 - protein, 18 aa, Mycobacterium
LNHLGWMRRVLVDGVDVL

SEQ ID NO: 835036 - protein, 27 aa, Mycobacterium
LNHLRKYTTIWYVARLRGDLDIAALSA

SEQ ID NO: 835037 - protein, 25 aa, Mycobacterium
LNHVVSPRRWFASTSLPLPQAKATA

SEQ ID NO: 835038 - protein, 23 aa, Mycobacterium
LNIGTIEDYALSEWQRILDINVT

SEQ ID NO: 835039 - protein, 20 aa, Mycobacterium
LNIKPQVDLWTFGDSGKSII

SEQ ID NO: 835040 - protein, 19 aa, Mycobacterium
LNILAGAMRMKTHRPVLRV

SEQ ID NO: 835041 - protein, 17 aa, Mycobacterium
LNIWAPANTAPGAAKPV

SEQ ID NO: 835042 - protein, 22 aa, Mycobacterium
LNIYEPPRFFEAFLRGRAHTEP

SEQ ID NO: 835043 - protein, 27 aa, Mycobacterium
LNKLDPFCYQLIEVPLNFHHPMWRENC

SEQ ID NO: 835044 - protein, 19 aa, Mycobacterium
LNKLKLRIGAASTPWGLGI

SEQ ID NO: 835045 - protein, 19 aa, Mycobacterium
LNKQRPVSAFLRALARDLN

SEQ ID NO: 835046 - protein, 20 aa, Mycobacterium
LNKRYFYESFATLDDVATAV

SEQ ID NO: 835047 - protein, 22 aa, Mycobacterium
LNKRYFYESFTDLDAVAAGAIG

SEQ ID NO: 835048 - protein, 26 aa, Mycobacterium
LNKTARWPFLFRLTTIKKPETRARRI

SEQ ID NO: 835049 - protein, 25 aa, Mycobacterium
LNLARLLRLDEVVPVWIPSAAEEAA

SEQ ID NO: 835050 - protein, 19 aa, Mycobacterium
LNLEYKLEVWDSPNSAGII

SEQ ID NO: 835051 - protein, 18 aa, Mycobacterium
LNLEYKLEVWDSPNSAGV

SEQ ID NO: 835052 - protein, 27 aa, Mycobacterium
LNLGVQDAFNLGWKLAASINGWAPDGL

SEQ ID NO: 835053 - protein, 20 aa, Mycobacterium
LNLKLQPAKYRQLLQHILQH

SEQ ID NO: 835054 - protein, 18 aa, Mycobacterium
LNLNLLATGRHDHSWRSQ

SEQ ID NO: 835055 - protein, 25 aa, Mycobacterium
LNLPDGQFAAWFRRESLRSVDWGGD

SEQ ID NO: 835056 - protein, 24 aa, Mycobacterium
LNLSPLCGGLPPDIAWPYLQRVGE

SEQ ID NO: 835057 - protein, 27 aa, Mycobacterium
LNLTGPYRLTMGLYRSLKASTAVGGAS

SEQ ID NO: 835058 - protein, 21 aa, Mycobacterium
LNLVDVWVPEKNRLPLAVGLK

SEQ ID NO: 835059 - protein, 19 aa, Mycobacterium
LNMVPYFQANPRVTRAKAA

SEQ ID NO: 835060 - protein, 21 aa, Mycobacterium
LNNGFFYRGVGQGSLHFAITT

SEQ ID NO: 835061 - protein, 24 aa, Mycobacterium
LNNGPQFRLIAAASNRQFRVEGDD

SEQ ID NO: 835062 - protein, 17 aa, Mycobacterium
LNNIDVVGVGWGAWAGT

SEQ ID NO: 835063 - protein, 25 aa, Mycobacterium
LNNPRRSLYYLATPPSLFDPFVDQV

SEQ ID NO: 835064 - protein, 27 aa, Mycobacterium
LNPAWDHRFLEIIDGGWLSELDQWSNA

SEQ ID NO: 835065 - protein, 24 aa, Mycobacterium
LNPDLAALYERLRAGGGPGAGQLQ

SEQ ID NO: 835066 - protein, 27 aa, Mycobacterium
LNPDTFAELLREYIRDQGWQTYGEVVV

SEQ ID NO: 835067 - protein, 25 aa, Mycobacterium
LNPELIDELPLPRPKFEIFVYSPRV

SEQ ID NO: 835068 - protein, 22 aa, Mycobacterium
LNPKLEISGILLTRYDPRTVNS

SEQ ID NO: 835069 - protein, 22 aa, Mycobacterium
LNPLALLASQGVPLAFGSDAPV

SEQ ID NO: 835070 - protein, 23 aa, Mycobacterium
LNPLNWVTGIVRGALGAVSVVEH

SEQ ID NO: 835071 - protein, 32 aa, Mycobacterium
LNPNHFLAVAIEYLYTHRPSWPAGIAVGKTAV

SEQ ID NO: 835072 - protein, 23 aa, Mycobacterium
LNPPPVTFNLWPDPSGGPSRYPG

SEQ ID NO: 835073 - protein, 22 aa, Mycobacterium
LNPRLDISGILLTRYDPRTVNS

SEQ ID NO: 835074 - protein, 25 aa, Mycobacterium
LNPRNMDQLLFDGLPWVARAQDEHD

SEQ ID NO: 835075 - protein, 25 aa, Mycobacterium
LNPRNVDQLLFDGLPWVARAQDEHD

SEQ ID NO: 835076 - protein, 17 aa, Mycobacterium
LNPYLSPAAVKRWKPFI

SEQ ID NO: 835077 - protein, 17 aa, Mycobacterium
LNQAMITPLYAGFVDRY

SEQ ID NO: 835078 - protein, 27 aa, Mycobacterium
LNQHIYQWCMDFLGPEGLLYDGYGLGD

SEQ ID NO: 835079 - protein, 24 aa, Mycobacterium
LNQPRTLAERIPLGDGSTAAVIAS

SEQ ID NO: 835080 - protein, 26 aa, Mycobacterium
LNQREAWLTGDPKQQVRCVYVAIGQK

SEQ ID NO: 835081 - protein, 20 aa, Mycobacterium
LNQWMYETWQFDYQGRILST

SEQ ID NO: 835082 - protein, 24 aa, Mycobacterium
LNRAWHRLDPWPDSVAGLTRLKQR

SEQ ID NO: 835083 - protein, 20 aa, Mycobacterium
LNREAAIIPDIYLDGRIPHE

SEQ ID NO: 835084 - protein, 21 aa, Mycobacterium
LNREMNRFIDALRADIDLTVS

SEQ ID NO: 835085 - protein, 17 aa, Mycobacterium
LNRGLRYGVKTMFSTSG

SEQ ID NO: 835086 - protein, 18 aa, Mycobacterium
LNRIGFATTTQLLTVMTR

SEQ ID NO: 835087 - protein, 30 aa, Mycobacterium
LNRLLEFVVRQEPRLSWAIGDRADGTTVLV

SEQ ID NO: 835088 - protein, 32 aa, Mycobacterium
LNRNSLVQMVLSNWFGLNAPAIAQLEADYEAM

SEQ ID NO: 835089 - protein, 35 aa, Mycobacterium
LNRNTHGMSWLPLYHDMGLSMIGFPAVYGGHSTLM

SEQ ID NO: 835090 - protein, 32 aa, Mycobacterium
LNRNVKDPWLRRNLLPAYRAGSRRILFSDDFY

SEQ ID NO: 835091 - protein, 24 aa, Mycobacterium
LNRRNRLFWPTTCTVVEVIPEQKL

SEQ ID NO: 835092 - protein, 22 aa, Mycobacterium
LNRTAPVFPMLPGTPAQATHDY

SEQ ID NO: 835093 - protein, 41 aa, Mycobacterium
LNRVFDYLMVSLRSLPLVMVIGRPEVRIPVVTFALNGVPAE

SEQ ID NO: 835094 - protein, 33 aa, Mycobacterium
LNRVPGSVYLFSWGLNHLVSLGLRPPPPQRFPL

SEQ ID NO: 835095 - protein, 26 aa, Mycobacterium
LNRVPNAAALPFRYTINGYRGCSHAC

SEQ ID NO: 835096 - protein, 20 aa, Mycobacterium
LNRWPEWDIDYPTARLAPTS

SEQ ID NO: 835097 - protein, 29 aa, Mycobacterium
LNSAGAYLDWLFRYLVSALRTLPRVMVIG

SEQ ID NO: 835098 - protein, 18 aa, Mycobacterium
LNSAPMYRQFRPDLEAPS

SEQ ID NO: 835099 - protein, 33 aa, Mycobacterium
LNSDRYIEYLTAVPWLGAALNAVNIRWSLAEIG

SEQ ID NO: 835100 - protein, 18 aa, Mycobacterium
LNSFILPGGTTLSALLHV

SEQ ID NO: 835101 - protein, 27 aa, Mycobacterium
LNSGLENIGFFNSGAYDSGWDNSGNSG

SEQ ID NO: 835102 - protein, 17 aa, Mycobacterium
LNSLMAMAIRREAEMFV

SEQ ID NO: 835103 - protein, 18 aa, Mycobacterium
LNSLPEAALTALKALTLH

SEQ ID NO: 835104 - protein, 24 aa, Mycobacterium
LNSPFFDLHGPGILRTAPTSLTLR

SEQ ID NO: 835105 - protein, 22 aa, Mycobacterium
LNSPKLLQLSGIGPSDVLGAAG

SEQ ID NO: 835106 - protein, 17 aa, Mycobacterium
LNSPWVAFIIKWMAKGN

SEQ ID NO: 835107 - protein, 19 aa, Mycobacterium
LNSWVRRYPDVHVQTVAAG

SEQ ID NO: 835108 - protein, 17 aa, Mycobacterium
LNSWYRSTEQWIAAAAY

SEQ ID NO: 835109 - protein, 22 aa, Mycobacterium
LNTAQPHLFHLGALAPQTFDGG

SEQ ID NO: 835110 - protein, 17 aa, Mycobacterium
LNTFYRNTEPWIAAAAY

SEQ ID NO: 835111 - protein, 33 aa, Mycobacterium
LNTRFALDHHINLRPAKLYPGVTGPLAGNPAID

SEQ ID NO: 835112 - protein, 27 aa, Mycobacterium
LNTRQLLLVNMMTDALPAAALAVSKPS

SEQ ID NO: 835113 - protein, 20 aa, Mycobacterium
LNTRYFYESFADTDDLIGAV

SEQ ID NO: 835114 - protein, 21 aa, Mycobacterium
LNTRYFYESFGGTDDLLGAVY

SEQ ID NO: 835115 - protein, 18 aa, Mycobacterium
LNTSFLNQVGRPGLSLLS

SEQ ID NO: 835116 - protein, 24 aa, Mycobacterium
LNTTKPWFAIGGIDAQRLPDVLDA

SEQ ID NO: 835117 - protein, 22 aa, Mycobacterium
LNTTLVWGLHDSVAPLRVANHV

SEQ ID NO: 835118 - protein, 30 aa, Mycobacterium
LNTVNAPAQTLLGRPLIGNGANGAPGTGAN

SEQ ID NO: 835119 - protein, 24 aa, Mycobacterium
LNVDVPLNIPLRGTIGTLIDGEPI

SEQ ID NO: 835120 - protein, 18 aa, Mycobacterium
LNVGALQSGILNLGSTIS

SEQ ID NO: 835121 - protein, 17 aa, Mycobacterium
LNVIRKDGGTVDKVDIW

SEQ ID NO: 835122 - protein, 25 aa, Mycobacterium
LNVKRSAFVCALLARFPDVHVRQQR

SEQ ID NO: 835123 - protein, 22 aa, Mycobacterium
LNVLAAAWLQFETHDWFSHGTD

SEQ ID NO: 835124 - protein, 46 aa, Mycobacterium
LNVLGPADLNFLWLPLAHAFGKVMLSLPLLIGFPTAIDGRVDRIVD

SEQ ID NO: 835125 - protein, 17 aa, Mycobacterium
LNVLGVHDLVLAVLPGM

SEQ ID NO: 835126 - protein, 18 aa, Mycobacterium
LNVLQLIQSLAWAPAQAA

SEQ ID NO: 835127 - protein, 18 aa, Mycobacterium
LNVLWELAARHRVRLFGV

SEQ ID NO: 835128 - protein, 17 aa, Mycobacterium
LNVMANSILYFGGAVTT

SEQ ID NO: 835129 - protein, 20 aa, Mycobacterium
LNVNPANARWFYDNTRRGDI

SEQ ID NO: 835130 - protein, 29 aa, Mycobacterium
LNVPDAFTRLIFSLLVTGIAPSSFYEATD

SEQ ID NO: 835131 - protein, 29 aa, Mycobacterium
LNVPDAFTRLMFSLLTTGIAPTTFYRTDE

SEQ ID NO: 835132 - protein, 26 aa, Mycobacterium
LNVPDMFTRMILSLAATGIAPGSFYE

SEQ ID NO: 835133 - protein, 20 aa, Mycobacterium
LNVPVLQRELDRLQRGWLDG

SEQ ID NO: 835134 - protein, 19 aa, Mycobacterium
LNVRIRLALRRCGGGGEPR

SEQ ID NO: 835135 - protein, 27 aa, Mycobacterium
LNVTSGLAFMPSALTPTYCASKAALHS

SEQ ID NO: 835136 - protein, 30 aa, Mycobacterium
LNVVSVAAFQYVPMLSMYAAMKATLMSFTR

SEQ ID NO: 835137 - protein, 17 aa, Mycobacterium
LNVWAPSGCRPGDRRPV

SEQ ID NO: 835138 - protein, 17 aa, Mycobacterium
LNVWLRTHRREHPDSKV

SEQ ID NO: 835139 - protein, 18 aa, Mycobacterium
LNWEARSWRLDESGEYHS

SEQ ID NO: 835140 - protein, 31 aa, Mycobacterium
LNWERRRYSPWLAYSQSKLANLLFTSELQRR

SEQ ID NO: 835141 - protein, 18 aa, Mycobacterium
LNWYLDHLGMIVSDFQFF

SEQ ID NO: 835142 - protein, 18 aa, Mycobacterium
LNYASIFPLCRAAVHHGG

SEQ ID NO: 835143 - protein, 19 aa, Mycobacterium
LNYFKFRNWDITESWTGFS

SEQ ID NO: 835144 - protein, 31 aa, Mycobacterium
LNYQSRRYSPWLAYGQSKLANLLFTSELQRR

SEQ ID NO: 835145 - protein, 17 aa, Mycobacterium
LNYRVLLSVISCAEADI

SEQ ID NO: 835146 - protein, 31 aa, Mycobacterium
LPAADADFSLSIFGLQLVKTGTANATTTFGG

SEQ ID NO: 835147 - protein, 21 aa, Mycobacterium
LPAAELVPPLLVGTGLDVADG

SEQ ID NO: 835148 - protein, 29 aa, Mycobacterium
LPAAESGFPMMPMMVPPPTASAGTGWRKR

SEQ ID NO: 835149 - protein, 20 aa, Mycobacterium
LPAAGTLTVFSPPSGPGVRV

SEQ ID NO: 835150 - protein, 22 aa, Mycobacterium
LPAAGTLTVFSPPSGPGVRVDT

SEQ ID NO: 835151 - protein, 20 aa, Mycobacterium
LPAAPWRHRRHWISAKPTAA

SEQ ID NO: 835152 - protein, 17 aa, Mycobacterium
LPAATWYEKADLSSTDM

SEQ ID NO: 835153 - protein, 32 aa, Mycobacterium
LPADLLDKWGIRVVPLHILLDGTDLRDGVDDI

SEQ ID NO: 835154 - protein, 31 aa, Mycobacterium
LPADLLQKWAIRVVPLHILLDGADLRDGVDE

SEQ ID NO: 835155 - protein, 36 aa, Mycobacterium
LPADLVTSVRDGLVPTFLVVLRREPGQHLGGLRVGV

SEQ ID NO: 835156 - protein, 24 aa, Mycobacterium
LPADPAELVKLLDGYGLACVGGFV

SEQ ID NO: 835157 - protein, 24 aa, Mycobacterium
LPADPDAKPRPLAKARWAAAVDCV

SEQ ID NO: 835158 - protein, 24 aa, Mycobacterium
LPADPDAKPRPLGKARWAGGVDCV

SEQ ID NO: 835159 - protein, 23 aa, Mycobacterium
LPADPQWGGRLVSLPPGAGEVLA

SEQ ID NO: 835160 - protein, 21 aa, Mycobacterium
LPADPTLLFDGMFALVQHSLG

SEQ ID NO: 835161 - protein, 17 aa, Mycobacterium
LPADRLIEGLLSVGAVG

SEQ ID NO: 835162 - protein, 22 aa, Mycobacterium
LPAEFKLIDRANLLGLSAPEMT

SEQ ID NO: 835163 - protein, 20 aa, Mycobacterium
LPAEFVAAFVTAISRHRAWE

SEQ ID NO: 835164 - protein, 19 aa, Mycobacterium
LPAEIYPLTEARAAFRRMQ

SEQ ID NO: 835165 - protein, 21 aa, Mycobacterium
LPAELFDAPANIALLHQVVTA

SEQ ID NO: 835166 - protein, 18 aa, Mycobacterium
LPAELRGRWTRMLTHCRR

SEQ ID NO: 835167 - protein, 24 aa, Mycobacterium
LPAFAPALLRARFHLWESGSTAQM

SEQ ID NO: 835168 - protein, 25 aa, Mycobacterium
LPAFMMRAFCDLAERHPWQETRPGF

SEQ ID NO: 835169 - protein, 20 aa, Mycobacterium
LPAGDFVRWCRQVVDLLDQI

SEQ ID NO: 835170 - protein, 19 aa, Mycobacterium
LPAGLALAAGFDPALARAT

SEQ ID NO: 835171 - protein, 20 aa, Mycobacterium
LPAGLALAAGFDPALARSAG

SEQ ID NO: 835172 - protein, 21 aa, Mycobacterium
LPAGLALAASFNPALARSAGE

SEQ ID NO: 835173 - protein, 20 aa, Mycobacterium
LPAGLALAATFNPSLARAAG

SEQ ID NO: 835174 - protein, 28 aa, Mycobacterium
LPAGPNILRAFTFPLEKVRVLIVGQDPY

SEQ ID NO: 835175 - protein, 25 aa, Mycobacterium
LPAGQPVCYLAPGPAGNGDAAWANR

SEQ ID NO: 835176 - protein, 17 aa, Mycobacterium
LPAGSALLVVKRGPNAG

SEQ ID NO: 835177 - protein, 18 aa, Mycobacterium
LPAGSALLVVKRGPNAGS

SEQ ID NO: 835178 - protein, 23 aa, Mycobacterium
LPAHARIADFRRVDALPLTPSGK

SEQ ID NO: 835179 - protein, 26 aa, Mycobacterium
LPAHPAPVLIFVPGGAWVHGKAMGQG

SEQ ID NO: 835180 - protein, 19 aa, Mycobacterium
LPAHPYMKIDVQPLAQHYV

SEQ ID NO: 835181 - protein, 17 aa, Mycobacterium
LPALARTPVEAIAVDLV

SEQ ID NO: 835182 - protein, 19 aa, Mycobacterium
LPALLRRLVIMGGCYDGTA

SEQ ID NO: 835183 - protein, 22 aa, Mycobacterium
LPALVFAHGGGFVFCDLDSHDG

SEQ ID NO: 835184 - protein, 22 aa, Mycobacterium
LPAMRRNQPLPHGLRGLVADLH

SEQ ID NO: 835185 - protein, 22 aa, Mycobacterium
LPANLAIPLRVIASTVAICCQL

SEQ ID NO: 835186 - protein, 27 aa, Mycobacterium
LPAPEHSTIVRRWLDAGLVIFGKTNTP

SEQ ID NO: 835187 - protein, 17 aa, Mycobacterium
LPAPIGNTAADLGPLRW

SEQ ID NO: 835188 - protein, 18 aa, Mycobacterium
LPAPKYGTATTFAQARRI

SEQ ID NO: 835189 - protein, 26 aa, Mycobacterium
LPAPPSYRSYLMWLVAQDHAAAQAAW

SEQ ID NO: 835190 - protein, 33 aa, Mycobacterium
LPAPTGPLTVQNWPLVIGALLPENAIISDEANT

SEQ ID NO: 835191 - protein, 32 aa, Mycobacterium
LPAQLVVRAVGYRGLPTPGLPFDTNSATIPHS

SEQ ID NO: 835192 - protein, 17 aa, Mycobacterium
LPARGRFSAHTFWDDID

SEQ ID NO: 835193 - protein, 26 aa, Mycobacterium
LPARMPAYQVPLPPLPHGLLITHVNL

SEQ ID NO: 835194 - protein, 26 aa, Mycobacterium
LPASALARLFRTLQGRALFGGVAAHA

SEQ ID NO: 835195 - protein, 22 aa, Mycobacterium
LPASATFDQIADFKPDGVFLSN

SEQ ID NO: 835196 - protein, 17 aa, Mycobacterium
LPASGRFDPIPGAVVVS

SEQ ID NO: 835197 - protein, 19 aa, Mycobacterium
LPASIRFQQGAYRVHPALL

SEQ ID NO: 835198 - protein, 23 aa, Mycobacterium
LPASLASLSLLGSTAAPAAQATV

SEQ ID NO: 835199 - protein, 18 aa, Mycobacterium
LPASYFDGVTMAGGIAVL

SEQ ID NO: 835200 - protein, 18 aa, Mycobacterium
LPATSLAWGYWQTTSGMT

SEQ ID NO: 835201 - protein, 24 aa, Mycobacterium
LPAVDRAILRVAVWELLHAEDVPE

SEQ ID NO: 835202 - protein, 22 aa, Mycobacterium
LPAVDRAILRVSVWELLHADDV

SEQ ID NO: 835203 - protein, 25 aa, Mycobacterium
LPAVLTQYPFLAPDDWTLPTGKFPG

SEQ ID NO: 835204 - protein, 19 aa, Mycobacterium
LPAVLVLRADEWDSPLVPL

SEQ ID NO: 835205 - protein, 27 aa, Mycobacterium
LPAVQRRWPAVPALRVRPRRAATAAHY

SEQ ID NO: 835206 - protein, 19 aa, Mycobacterium
LPAWDVCCGLYAALAVVTA

SEQ ID NO: 835207 - protein, 17 aa, Mycobacterium
LPAWLTTAVTNLCLTRL

SEQ ID NO: 835208 - protein, 18 aa, Mycobacterium
LPAYGACAGMIMLASEIL

SEQ ID NO: 835209 - protein, 31 aa, Mycobacterium
LPAYVDPRWVRWLRVLPLDRGLAIPMVHADD

SEQ ID NO: 835210 - protein, 18 aa, Mycobacterium
LPCHAFSANTAWLEIILA

SEQ ID NO: 835211 - protein, 19 aa, Mycobacterium
LPCHAGDPDLWFAEAPADL

SEQ ID NO: 835212 - protein, 23 aa, Mycobacterium
LPCHDFQSNAAWLEIVLAAADLV

SEQ ID NO: 835213 - protein, 24 aa, Mycobacterium
LPCHRFRYCAPQPRKYTFVGLGKY

SEQ ID NO: 835214 - protein, 28 aa, Mycobacterium
LPCTPRGIVYLLRRYDVKLDGAHVVVIG

SEQ ID NO: 835215 - protein, 20 aa, Mycobacterium
LPDAARSLGKSMRIFKSELR

SEQ ID NO: 835216 - protein, 17 aa, Mycobacterium
LPDAQFRWLSVDLPPVV

SEQ ID NO: 835217 - protein, 23 aa, Mycobacterium
LPDARIRFMIADASPIVALTTAE

SEQ ID NO: 835218 - protein, 26 aa, Mycobacterium
LPDCTPVPVFLQRSPHFRPPEDPHTP

SEQ ID NO: 835219 - protein, 24 aa, Mycobacterium
LPDDARLLLTIRPGDLLDDEPDAA

SEQ ID NO: 835220 - protein, 27 aa, Mycobacterium
LPDDLKFKLVEPLRLLFKDEVRAVGRE

SEQ ID NO: 835221 - protein, 17 aa, Mycobacterium
LPDDPDYPRLWQIVNNN

SEQ ID NO: 835222 - protein, 25 aa, Mycobacterium
LPDEDLLAAHRVFAALTAAMVSFGA

SEQ ID NO: 835223 - protein, 24 aa, Mycobacterium
LPDERLIRLLELRPDLAQPPPGSI

SEQ ID NO: 835224 - protein, 30 aa, Mycobacterium
LPDFAGYAPKLWRYWAQHLDPDRALRDDPR

SEQ ID NO: 835225 - protein, 18 aa, Mycobacterium
LPDFFRPQTDHPAGSGTA

SEQ ID NO: 835226 - protein, 20 aa, Mycobacterium
LPDFPWGFTPAEVQSQLCAI

SEQ ID NO: 835227 - protein, 21 aa, Mycobacterium
LPDFTMLPDLALRPLGGAVIW

SEQ ID NO: 835228 - protein, 25 aa, Mycobacterium
LPDGGLIRRVPWPLAEATYDLLVPS

SEQ ID NO: 835229 - protein, 34 aa, Mycobacterium
LPDGGRGYLSKIFNDAWMSSYGFLRTRLDGSVEK

SEQ ID NO: 835230 - protein, 30 aa, Mycobacterium; identical to SEQ ID NO: 694023

SEQ ID NO: 835231 - protein, 27 aa, Mycobacterium
LPDGISRLRFRLRWRDFRVTIDVNHVD

SEQ ID NO: 835232 - protein, 17 aa, Mycobacterium
LPDGLAGAAALWGLAQK

SEQ ID NO: 835233 - protein, 21 aa, Mycobacterium
LPDGQYAVWFRREVLRSVDWG

SEQ ID NO: 835234 - protein, 25 aa, Mycobacterium
LPDGRRNRMFLQRLKDKLGNHANAS

SEQ ID NO: 835235 - protein, 17 aa, Mycobacterium
LPDGSLLRRHSRVRRDN

SEQ ID NO: 835236 - protein, 28 aa, Mycobacterium
LPDHIPPNALVCFPPPPASGSMTKASVA

SEQ ID NO: 835237 - protein, 30 aa, Mycobacterium
LPDHLEMYRRMWVLRLLDMALEEMRADGLM

SEQ ID NO: 835238 - protein, 24 aa, Mycobacterium
LPDISPRWPALTKPVIGAINGAAV

SEQ ID NO: 835239 - protein, 36 aa, Mycobacterium
LPDKFEQMWGYIYEQNIAPIYLGELGTRLSDPKDVV

SEQ ID NO: 835240 - protein, 23 aa, Mycobacterium
LPDKPLVAMCPVSIRAEGDQNAG

SEQ ID NO: 835241 - protein, 21 aa, Mycobacterium
LPDLAEAELFARYSDIGLSQR

SEQ ID NO: 835242 - protein, 20 aa, Mycobacterium
LPDLPGITEAWPWTNRQATE

SEQ ID NO: 835243 - protein, 18 aa, Mycobacterium
LPDLVKRLDMLLDESARR

SEQ ID NO: 835244 - protein, 22 aa, Mycobacterium
LPDPPRYLIAGRTHPKVLAAQG

SEQ ID NO: 835245 - protein, 34 aa, Mycobacterium
LPDPSPDLWQRYLGILFDGLRPEGAHPLPQPPPR

SEQ ID NO: 835246 - protein, 18 aa, Mycobacterium
LPDRAIVLHPGPMVRGME

SEQ ID NO: 835247 - protein, 24 aa, Mycobacterium
LPDTPLLGSPLTLTASVQLAGLAP

SEQ ID NO: 835248 - protein, 27 aa, Mycobacterium
LPDVGKLVELAFALGRLSSAGIGVGVS

SEQ ID NO: 835249 - protein, 27 aa, Mycobacterium
LPDVIAHGMLTMGLGAGFFSAWSGDPG

SEQ ID NO: 835250 - protein, 25 aa, Mycobacterium
LPDVIAHGMLTMGLGAGFVSAWSGD

SEQ ID NO: 835251 - protein, 25 aa, Mycobacterium
LPDVTVPVRWWHGDADPLVPLAAAR

SEQ ID NO: 835252 - protein, 27 aa, Mycobacterium
LPEALETWPLRIFGEALPRHLELIYEI

SEQ ID NO: 835253 - protein, 26 aa, Mycobacterium
LPEAQLDRFLMKLNVTLPARDSEIAI

SEQ ID NO: 835254 - protein, 23 aa, Mycobacterium
LPECPRWKVIDRNDLPHLVDRLR

SEQ ID NO: 835255 - protein, 24 aa, Mycobacterium
LPEDARLLLTIRPGDLLDEEPDAA

SEQ ID NO: 835256 - protein, 27 aa, Mycobacterium
LPEDLTFTLVEPLRLLFKDEVRAVGRE

SEQ ID NO: 835257 - protein, 18 aa, Mycobacterium
LPEEPLLSAPTVAELERA

SEQ ID NO: 835258 - protein, 20 aa, Mycobacterium
LPEFDPFWRDVEAAGLPIVL

SEQ ID NO: 835259 - protein, 20 aa, Mycobacterium
LPEFDPFWRDVESAGLPIVL

SEQ ID NO: 835260 - protein, 22 aa, Mycobacterium
LPEGFKKSMRALFDGGWDKVGL

SEQ ID NO: 835261 - protein, 17 aa, Mycobacterium
LPEGHGLLLLTDGLFEG

SEQ ID NO: 835262 - protein, 20 aa, Mycobacterium
LPEGLFQVLPGKGSVVGERF

SEQ ID NO: 835263 - protein, 17 aa, Mycobacterium
LPEGMGLVLLTDGLFEG

SEQ ID NO: 835264 - protein, 27 aa, Mycobacterium
LPEGRTVLYLYPLTGRPGLDIPEGWDA

SEQ ID NO: 835265 - protein, 24 aa, Mycobacterium
LPEHAVVLHPGPMLRGMEIASAVA

SEQ ID NO: 835266 - protein, 18 aa, Mycobacterium
LPEITHFVAGLGTAGTLM

SEQ ID NO: 835267 - protein, 26 aa, Mycobacterium
LPEKVADLRVYLDDLVVQLRAAGDVE

SEQ ID NO: 835268 - protein, 29 aa, Mycobacterium
LPELAADDLGLPDLLLLLATDMAAVDHHE

SEQ ID NO: 835269 - protein, 22 aa, Mycobacterium
LPELDRLCRHALDLLRTGIADP

SEQ ID NO: 835270 - protein, 18 aa, Mycobacterium
LPELGPEPSDLVLRRWHG

SEQ ID NO: 835271 - protein, 25 aa, Mycobacterium
LPELPFACQLGTRPLLTGDLVAASR

SEQ ID NO: 835272 - protein, 19 aa, Mycobacterium
LPELPLLRCRVAGAPLGLD

SEQ ID NO: 835273 - protein, 23 aa, Mycobacterium
LPELPQLRWKVTGAPLGLDRPWF

SEQ ID NO: 835274 - protein, 24 aa, Mycobacterium
LPELPQLRWRVTGAPFGLDRPWFV

SEQ ID NO: 835275 - protein, 18 aa, Mycobacterium
LPELTLAQKWDLTVNELA

SEQ ID NO: 835276 - protein, 18 aa, Mycobacterium
LPELVRRSIAVKAKVVAA

SEQ ID NO: 835277 - protein, 19 aa, Mycobacterium
LPEMGVVAKRLWRDSGLKP

SEQ ID NO: 835278 - protein, 27 aa, Mycobacterium
LPENATPAYLGFNLFGHAIARAVIHGT

SEQ ID NO: 835279 - protein, 20 aa, Mycobacterium
LPENDPRTAWLRGQVADLQA

SEQ ID NO: 835280 - protein, 19 aa, Mycobacterium
LPENMAYAMVRWKNVLRQA

SEQ ID NO: 835281 - protein, 17 aa, Mycobacterium
LPEPILHTAPERAELQR

SEQ ID NO: 835282 - protein, 20 aa, Mycobacterium
LPEPLRADARLVFTAHSIPL

SEQ ID NO: 835283 - protein, 17 aa, Mycobacterium
LPEPLVVVDGRYREMIG

SEQ ID NO: 835284 - protein, 19 aa, Mycobacterium
LPEPVWKPVTSELLTTFEC

SEQ ID NO: 835285 - protein, 22 aa, Mycobacterium
LPEQAWLTDRGLAPLRDLIHFE

SEQ ID NO: 835286 - protein, 31 aa, Mycobacterium
LPERDFPTLIDLYLQGRLPLDKFVSEQIGLG

SEQ ID NO: 835287 - protein, 30 aa, Mycobacterium
LPERDFPTLISLYLQGRFPLDKFVSERITL

SEQ ID NO: 835288 - protein, 31 aa, Mycobacterium
LPERDFPTLISLYLQGRLPLEKFVSERIGLD

SEQ ID NO: 835289 - protein, 24 aa, Mycobacterium
LPERERTVLVLRFFDSMTQTQIAE

SEQ ID NO: 835290 - protein, 25 aa, Mycobacterium
LPERERTVLVLRFFESMTQTQIAER

SEQ ID NO: 835291 - protein, 29 aa, Mycobacterium
LPERSARWILPLLWRRWSPGYRGADEDLR

SEQ ID NO: 835292 - protein, 17 aa, Mycobacterium
LPESDFPRMLRLTQELF

SEQ ID NO: 835293 - protein, 32 aa, Mycobacterium
LPESGSICFLIRSYMLPLADLAAFEPWRQRAA

SEQ ID NO: 835294 - protein, 21 aa, Mycobacterium
LPESLQSLPGGHLLVAPEAMR

SEQ ID NO: 835295 - protein, 17 aa, Mycobacterium
LPESRLPAPAPLADSPW

SEQ ID NO: 835296 - protein, 30 aa, Mycobacterium
LPETEHLEVARYLLPKLRAVNFVIQDILGK

SEQ ID NO: 835297 - protein, 17 aa, Mycobacterium
LPEVDAFVWHAYLPTIE

SEQ ID NO: 835298 - protein, 17 aa, Mycobacterium
LPEVDGFIWHAYIPNIE

SEQ ID NO: 835299 - protein, 19 aa, Mycobacterium
LPEVRDLRRMGSCALDLCA

SEQ ID NO: 835300 - protein, 24 aa, Mycobacterium
LPEVVAPLAAYVPAVRTGNLVYTA

SEQ ID NO: 835301 - protein, 18 aa, Mycobacterium
LPEWAIPPREEFDFGYPD

SEQ ID NO: 835302 - protein, 18 aa, Mycobacterium
LPFALKRFCGAEGIENVT

SEQ ID NO: 835303 - protein, 24 aa, Mycobacterium
LPFDTRLVSFFGQPVAVVIATTLE

SEQ ID NO: 835304 - protein, 17 aa, Mycobacterium
LPFEQWKPRRRTLQPVF

SEQ ID NO: 835305 - protein, 19 aa, Mycobacterium
LPFGTGQVFFFGQPIAVVV

SEQ ID NO: 835306 - protein, 18 aa, Mycobacterium
LPFIGDALGLLRLPMAMP

SEQ ID NO: 835307 - protein, 25 aa, Mycobacterium
LPFPQYVCMRVLSKNPGWSNADLAR

SEQ ID NO: 835308 - protein, 19 aa, Mycobacterium
LPFVASYHITPATALEAIE

SEQ ID NO: 835309 - protein, 26 aa, Mycobacterium
LPGAAEALIALATLPSTAAALISGRA

SEQ ID NO: 835310 - protein, 19 aa, Mycobacterium
LPGAAWQRCRTHYTTNLMA

SEQ ID NO: 835311 - protein, 22 aa, Mycobacterium
LPGAAYCEMALVAARTILGDAA

SEQ ID NO: 835312 - protein, 23 aa, Mycobacterium
LPGAIGWLKYTIDNELLMNQIAE

SEQ ID NO: 835313 - protein, 18 aa, Mycobacterium
LPGAPFVLAVQWHPEQSL

SEQ ID NO: 835314 - protein, 25 aa, Mycobacterium
LPGAPPPTLAPRRQTRQLMVGSVGV

SEQ ID NO: 835315 - protein, 25 aa, Mycobacterium
LPGAPTIFQMLLDHPARKNYDLTSL

SEQ ID NO: 835316 - protein, 24 aa, Mycobacterium
LPGARALLQRVAGLGLKVVLATSA

SEQ ID NO: 835317 - protein, 23 aa, Mycobacterium
LPGARALLRRVADLGLQVVLASS

SEQ ID NO: 835318 - protein, 18 aa, Mycobacterium
LPGARRKFGIDLEDIRAV

SEQ ID NO: 835319 - protein, 17 aa, Mycobacterium
LPGASRYTLRPGDFVCI

SEQ ID NO: 835320 - protein, 23 aa, Mycobacterium
LPGDDFIAPAWWGELYRGRPVVH

SEQ ID NO: 835321 - protein, 25 aa, Mycobacterium
LPGDRWCVVAVNWLRAHYDGCAAPV

SEQ ID NO: 835322 - protein, 17 aa, Mycobacterium
LPGDWNIAAGCVAGIDV

SEQ ID NO: 835323 - protein, 23 aa, Mycobacterium
LPGESPRLFVVTRNAASVTAGDA

SEQ ID NO: 835324 - protein, 29 aa, Mycobacterium
LPGETHGELLWRDKLVWAGRPNTHHVRDP

SEQ ID NO: 835325 - protein, 17 aa, Mycobacterium
LPGEWPYVRGGDALRDV

SEQ ID NO: 835326 - protein, 17 aa, Mycobacterium
LPGFIDPHSHYINALTV

SEQ ID NO: 835327 - protein, 19 aa, Mycobacterium
LPGGLNWPLDLTMGDDGRL

SEQ ID NO: 835328 - protein, 26 aa, Mycobacterium
LPGGMYRNQMWFPHPGSNVVLCLGMC

SEQ ID NO: 835329 - protein, 22 aa, Mycobacterium
LPGGTEVTLRFADGEVVTMHVI

SEQ ID NO: 835330 - protein, 23 aa, Mycobacterium
LPGGTEVTLRFPDGEVVTMHVIS

SEQ ID NO: 835331 - protein, 21 aa, Mycobacterium
LPGGYDWEYLDKGPEVWRIRI

SEQ ID NO: 835332 - protein, 21 aa, Mycobacterium
LPGHGPEFVALTRGAERADAE

SEQ ID NO: 835333 - protein, 27 aa, Mycobacterium
LPGHIDVVRDLLFDALSGEDVRALGDI

SEQ ID NO: 835334 - protein, 20 aa, Mycobacterium
LPGIAFGHDWLTSATRYSGL

SEQ ID NO: 835335 - protein, 17 aa, Mycobacterium
LPGITRDSLLQLALDAG

SEQ ID NO: 835336 - protein, 17 aa, Mycobacterium
LPGITRNSLLQLATDAG

SEQ ID NO: 835337 - protein, 20 aa, Mycobacterium
LPGLDEASAWLRNNRPTHYR

SEQ ID NO: 835338 - protein, 17 aa, Mycobacterium
LPGLHDWVDEQLAQDGK

SEQ ID NO: 835339 - protein, 17 aa, Mycobacterium
LPGLHSWVDERLAGREQ

SEQ ID NO: 835340 - protein, 26 aa, Mycobacterium
LPGLIDAHWHAMFTTIPAALAQVSEF

SEQ ID NO: 835341 - protein, 19 aa, Mycobacterium
LPGLLEHGGHIAFTASFAG

SEQ ID NO: 835342 - protein, 18 aa, Mycobacterium
LPGLQPFMPPYVPGGGSK

SEQ ID NO: 835343 - protein, 17 aa, Mycobacterium
LPGLRVLQKYAVRVGGG

SEQ ID NO: 835344 - protein, 21 aa, Mycobacterium
LPGMIVGEIALLRDIPRTATV

SEQ ID NO: 835345 - protein, 17 aa, Mycobacterium
LPGMLVLRILAGQLAEA

SEQ ID NO: 835346 - protein, 19 aa, Mycobacterium
LPGNAHFTFRGCEGDALLM

SEQ ID NO: 835347 - protein, 20 aa, Mycobacterium
LPGNAHFTFRGCEGDALLML

SEQ ID NO: 835348 - protein, 24 aa, Mycobacterium
LPGNGSMVAALRTATDADPVVAGK

SEQ ID NO: 835349 - protein, 55 aa, Mycobacterium
LPGPNQLGTFLYWMLWKRPGLDIYLLKSNLRLLPAFDGLWYGLAPVSLVNQISSK

SEQ ID NO: 835350 - protein, 18 aa, Mycobacterium
LPGQYLTVRIPGAGAPAP

SEQ ID NO: 835351 - protein, 17 aa, Mycobacterium
LPGRSLLFVRNVGHLMT

SEQ ID NO: 835352 - protein, 18 aa, Mycobacterium
LPGRSLLFVRNVGHLMTN

SEQ ID NO: 835353 - protein, 24 aa, Mycobacterium
LPGSAVVDVLLRRAPRTRSGSALP

SEQ ID NO: 835354 - protein, 30 aa, Mycobacterium
LPGTGGTIGIAGVPGSLPSGSTGGAGGDGG

SEQ ID NO: 835355 - protein, 18 aa, Mycobacterium
LPGTSLPPGIRATADAAE

SEQ ID NO: 835356 - protein, 17 aa, Mycobacterium
LPGTVLPAGVRATTDAA

SEQ ID NO: 835357 - protein, 28 aa, Mycobacterium
LPGTYLNGFYEIRPLPYAEAGFGYPEDG

SEQ ID NO: 835358 - protein, 23 aa, Mycobacterium
LPGVAMMVVLISRGGWATITVRY

SEQ ID NO: 835359 - protein, 23 aa, Mycobacterium
LPGVAMMVVLISRGGWCTITARY

SEQ ID NO: 835360 - protein, 21 aa, Mycobacterium
LPGVAMMVVLISRSGYCTIST

SEQ ID NO: 835361 - protein, 18 aa, Mycobacterium
LPGVLLTQVAAVRALARQ

SEQ ID NO: 835362 - protein, 17 aa, Mycobacterium
LPGVPRDGVVGHGLNSV

SEQ ID NO: 835363 - protein, 17 aa, Mycobacterium
LPGWFKDTLCDAPIDRI

SEQ ID NO: 835364 - protein, 18 aa, Mycobacterium
LPGWVEALSERTALGRLG

SEQ ID NO: 835365 - protein, 28 aa, Mycobacterium
LPGYAFDGDLLNLNFFATFIRAQDKLDC

SEQ ID NO: 835366 - protein, 22 aa, Mycobacterium
LPHAVATPFLRARGTLKVWRNM

SEQ ID NO: 835367 - protein, 23 aa, Mycobacterium
LPHDRRFYFHTSARQAIAPAATM

SEQ ID NO: 835368 - protein, 25 aa, Mycobacterium
LPHDRWLPRRRTLQPLFTKKHVPRF

SEQ ID NO: 835369 - protein, 20 aa, Mycobacterium
LPHGNGEVIRLARGASLSDF

SEQ ID NO: 835370 - protein, 18 aa, Mycobacterium
LPHGVEVIGYWGEAVTTA

SEQ ID NO: 835371 - protein, 22 aa, Mycobacterium
LPHGVINGVLLPHVVRFNAEAD

SEQ ID NO: 835372 - protein, 26 aa, Mycobacterium
LPHHDDGFYPIPRPRAPLAAATIWAI

SEQ ID NO: 835373 - protein, 31 aa, Mycobacterium
LPHKQAIAGFLNLMPRWYIGSVLRHVDFLTS

SEQ ID NO: 835374 - protein, 18 aa, Mycobacterium
LPHMRARGRGRILNIGSV

SEQ ID NO: 835375 - protein, 34 aa, Mycobacterium
LPHQLLRSWYIAYFQLPWLPERSAAWLPTLLWRR

SEQ ID NO: 835376 - protein, 32 aa, Mycobacterium
LPHQLLRSWYILYFQLPWLPERSASWVPRLLW

SEQ ID NO: 835377 - protein, 17 aa, Mycobacterium
LPHVAVFDTAFFHDLPA

SEQ ID NO: 835378 - protein, 21 aa, Mycobacterium
LPHVRAAVLDALRRAGRGLDD

SEQ ID NO: 835379 - protein, 23 aa, Mycobacterium
LPHYYLSALQRLAGEREVIFWDQ

SEQ ID NO: 835380 - protein, 17 aa, Mycobacterium
LPIDLATSPLRALATGA

SEQ ID NO: 835381 - protein, 17 aa, Mycobacterium
LPIEAYARAFRHAGFHD

SEQ ID NO: 835382 - protein, 19 aa, Mycobacterium
LPIESFRRRDEARKGLVAL

SEQ ID NO: 835383 - protein, 18 aa, Mycobacterium
LPIFLRAAGRNYIGATGT

SEQ ID NO: 835384 - protein, 26 aa, Mycobacterium
LPIGGGLWVPVYHPELRIAPPFTEWE

SEQ ID NO: 835385 - protein, 18 aa, Mycobacterium
LPIIRYRTRDLTKLLPGT

SEQ ID NO: 835386 - protein, 20 aa, Mycobacterium
LPIITPPYWVEGFDPAALTG

SEQ ID NO: 835387 - protein, 21 aa, Mycobacterium
LPILERAKFLAIFASNLDEFY

SEQ ID NO: 835388 - protein, 20 aa, Mycobacterium
LPIPEIQYLAYLHNAADQIR

SEQ ID NO: 835389 - protein, 21 aa, Mycobacterium
LPISFALLNNSMNPMRPRLRG

SEQ ID NO: 835390 - protein, 19 aa, Mycobacterium
LPITLRISGYERVAGGRPI

SEQ ID NO: 835391 - protein, 29 aa, Mycobacterium
LPIVPMFHANAWGLPYAALMAGADLVLPD

SEQ ID NO: 835392 - protein, 21 aa, Mycobacterium
LPIVVYAHGGGFVFCDLDSHD

SEQ ID NO: 835393 - protein, 29 aa, Mycobacterium
LPKDELLQYMYAFARFLDARWVADAPDVA

SEQ ID NO: 835394 - protein, 20 aa, Mycobacterium
LPKYRRLVEQLAQAGLLKVI

SEQ ID NO: 835395 - protein, 19 aa, Mycobacterium
LPLAGLLVAVKDNIDVAGL

SEQ ID NO: 835396 - protein, 17 aa, Mycobacterium
LPLAIELAAARMRAMSA

SEQ ID NO: 835397 - protein, 21 aa, Mycobacterium
LPLATMHYFPMRPNGQLSPGL

SEQ ID NO: 835398 - protein, 19 aa, Mycobacterium
LPLAVDHFRYFAGCIRAQE

SEQ ID NO: 835399 - protein, 28 aa, Mycobacterium
LPLDRIQRRGMADNYWSMGIPGPCGPCS

SEQ ID NO: 835400 - protein, 17 aa, Mycobacterium
LPLEQLTDVLAGADVVV

SEQ ID NO: 835401 - protein, 23 aa, Mycobacterium
LPLFASNYLLNQADIGMACALGT

SEQ ID NO: 835402 - protein, 17 aa, Mycobacterium
LPLFETFGDSFGSNGAI

SEQ ID NO: 835403 - protein, 17 aa, Mycobacterium
LPLHPLNADDLAALAHY

SEQ ID NO: 835404 - protein, 18 aa, Mycobacterium
LPLIEEWLEFVGEKLPTG

SEQ ID NO: 835405 - protein, 19 aa, Mycobacterium
LPLITQDNEFFWTSGADGT

SEQ ID NO: 835406 - protein, 21 aa, Mycobacterium
LPLLERAKFLAIFASNLDEFY

SEQ ID NO: 835407 - protein, 19 aa, Mycobacterium
LPLPLPRISYEEAMRRFGS

SEQ ID NO: 835408 - protein, 20 aa, Mycobacterium
LPLPRTPHCDSSQGDKPHIG

SEQ ID NO: 835409 - protein, 17 aa, Mycobacterium
LPLSGSLGAMFGVCGNE

SEQ ID NO: 835410 - protein, 24 aa, Mycobacterium
LPLSHDMGLIAYLISPMFAGNGAV

SEQ ID NO: 835411 - protein, 18 aa, Mycobacterium
LPLTGRLVKFALFQTRDE

SEQ ID NO: 835412 - protein, 19 aa, Mycobacterium
LPLTLSMLLFDSSGVNKDA

SEQ ID NO: 835413 - protein, 21 aa, Mycobacterium
LPLTRGQLDIWLSQETGFVGT

SEQ ID NO: 835414 - protein, 23 aa, Mycobacterium
LPLTTITAWETLFERFNLTADSR

SEQ ID NO: 835415 - protein, 17 aa, Mycobacterium
LPLVAETFTSGAAKWQG

SEQ ID NO: 835416 - protein, 23 aa, Mycobacterium
LPLVDLTVIQRLAAVLGAPLQEF

SEQ ID NO: 835417 - protein, 20 aa, Mycobacterium
LPLVTIFAREYGALGIGIEY

SEQ ID NO: 835418 - protein, 17 aa, Mycobacterium
LPLVVELVAQQSEWGLD

SEQ ID NO: 835419 - protein, 17 aa, Mycobacterium
LPLWQKLTVYTSESALH

SEQ ID NO: 835420 - protein, 20 aa, Mycobacterium
LPMALGGRLTGVTALSPVAP

SEQ ID NO: 835421 - protein, 24 aa, Mycobacterium
LPMATVWAVFPTCCALAGAGRFSE

SEQ ID NO: 835422 - protein, 18 aa, Mycobacterium
LPMERFELPNLRALNVVV

SEQ ID NO: 835423 - protein, 30 aa, Mycobacterium
LPMGSEAIALLRLPLVLPAVQVAGRVLGAA

SEQ ID NO: 835424 - protein, 31 aa, Mycobacterium
LPMGSEALALLRLPLVLPAVQLAGRIAGLAI

SEQ ID NO: 835425 - protein, 33 aa, Mycobacterium
LPMGSEALALLRLPLVLPSLQIAGKVAGTVFGS

SEQ ID NO: 835426 - protein, 35 aa, Mycobacterium
LPMGTEALALLRLPLLLPTLRLLGRVGGPLLGNTR

SEQ ID NO: 835427 - protein, 25 aa, Mycobacterium
LPMIDMPRYLDYLTTRLAAAGCEIE

SEQ ID NO: 835428 - protein, 18 aa, Mycobacterium
LPMLQLYMRGVHFHNGKG

SEQ ID NO: 835429 - protein, 19 aa, Mycobacterium
LPMMKLRIANPEYLVDIND

SEQ ID NO: 835430 - protein, 19 aa, Mycobacterium
LPMRDLIRMATHAHHYLAI

SEQ ID NO: 835431 - protein, 18 aa, Mycobacterium
LPMTAMQFAQGFGRLIRS

SEQ ID NO: 835432 - protein, 19 aa, Mycobacterium
LPNAKFGERVLAEVRRRGW

SEQ ID NO: 835433 - protein, 18 aa, Mycobacterium
LPNAKFTDRTLAEVRKRG

SEQ ID NO: 835434 - protein, 28 aa, Mycobacterium
LPNDQVALFLRHLWATDGSVRWDAKVGQ

SEQ ID NO: 835435 - protein, 17 aa, Mycobacterium
LPNEQWRPRKRALQPVF

SEQ ID NO: 835436 - protein, 19 aa, Mycobacterium
LPNFPAYYHMLGNVDVRLG

SEQ ID NO: 835437 - protein, 20 aa, Mycobacterium
LPNGLQLRQQRVPLGVVGIV

SEQ ID NO: 835438 - protein, 19 aa, Mycobacterium
LPNGLQLRQQRVPLGVVGM

SEQ ID NO: 835439 - protein, 26 aa, Mycobacterium
LPNHRAMDFLGQPPVAIGPAYQAKTI

SEQ ID NO: 835440 - protein, 25 aa, Mycobacterium
LPNHYLRLTGLENLQFFASLYEKQT

SEQ ID NO: 835441 - protein, 18 aa, Mycobacterium
LPNLPVACAVWEPEPSWS

SEQ ID NO: 835442 - protein, 25 aa, Mycobacterium
LPNMRTVLHCLPPKDWTEPGFMGLG

SEQ ID NO: 835443 - protein, 31 aa, Mycobacterium
LPNPNLRPLGKPPYYAFQIILGDLGTSGGLR

SEQ ID NO: 835444 - protein, 23 aa, Mycobacterium
LPNRAEFLEITWGAQLSGLYYTP

SEQ ID NO: 835445 - protein, 21 aa, Mycobacterium
LPNRLFNLLVTNVPGPQAPMY

SEQ ID NO: 835446 - protein, 28 aa, Mycobacterium
LPNRPEFLEITWACQLSGLYYTAVNTHF

SEQ ID NO: 835447 - protein, 21 aa, Mycobacterium
LPPAAGTLIRLFHAETVFVDV

SEQ ID NO: 835448 - protein, 28 aa, Mycobacterium
LPPEINSALMFAGPGAGPLLAAAGAWSG

SEQ ID NO: 835449 - protein, 20 aa, Mycobacterium
LPPGGGIGIAYWTGSRRLDP

SEQ ID NO: 835450 - protein, 19 aa, Mycobacterium
LPPLDLQAPPPAGSKQRLV

SEQ ID NO: 835451 - protein, 19 aa, Mycobacterium
LPPMAPPLHLRLDELPQTA

SEQ ID NO: 835452 - protein, 20 aa, Mycobacterium
LPPNAGTLIRLFHAETTELE

SEQ ID NO: 835453 - protein, 17 aa, Mycobacterium
LPPNFRAPKKAPSTAEI

SEQ ID NO: 835454 - protein, 29 aa, Mycobacterium
LPPNIIEHWYAGGPALAAWRGLPPVGERS

SEQ ID NO: 835455 - protein, 25 aa, Mycobacterium
LPPPAPNTPPSPTAPPPPPTEMPPP

SEQ ID NO: 835456 - protein, 19 aa, Mycobacterium
LPPPLPPTGATLPAQTGLT

SEQ ID NO: 835457 - protein, 18 aa, Mycobacterium
LPPPVTPPPAQPASSTAG

SEQ ID NO: 835458 - protein, 25 aa, Mycobacterium
LPPRLGGVPVITPALLRAMHASGRQ

SEQ ID NO: 835459 - protein, 24 aa, Mycobacterium
LPPRPEVRLLWKLIETAAAAEGAL

SEQ ID NO: 835460 - protein, 28 aa, Mycobacterium
LPPRRQPPRTVPPLRRPVGVPPARGGVI

SEQ ID NO: 835461 - protein, 27 aa, Mycobacterium
LPPSHHYLAAYHWLDAGFGAHAVVHLG

SEQ ID NO: 835462 - protein, 25 aa, Mycobacterium
LPPSHHYLAAYHWLDTGFGSDAVVH

SEQ ID NO: 835463 - protein, 26 aa, Mycobacterium
LPPSHHYLAAYRWLDTGFGAHAVVHL

SEQ ID NO: 835464 - protein, 26 aa, Mycobacterium
LPPSQSNFVWLPLGSRTMDFTEQAAE

SEQ ID NO: 835465 - protein, 17 aa, Mycobacterium
LPPTLHVDAPSPHIDWS

SEQ ID NO: 835466 - protein, 21 aa, Mycobacterium
LPPTVHLFMQATGVYIMNFLP

SEQ ID NO: 835467 - protein, 32 aa, Mycobacterium
LPPVGDAEFPERAAVVLSGLRKLQGSLAEAAS

SEQ ID NO: 835468 - protein, 17 aa, Mycobacterium
LPQAVLTYPMTAASQTV

SEQ ID NO: 835469 - protein, 19 aa, Mycobacterium
LPQFVGFAVIRPAQPGGDQ

SEQ ID NO: 835470 - protein, 17 aa, Mycobacterium
LPQHFVLAAHSAAGTLA

SEQ ID NO: 835471 - protein, 19 aa, Mycobacterium
LPQKLIHAAAPLALGKPKP

SEQ ID NO: 835472 - protein, 23 aa, Mycobacterium
LPQKYYRTLDPFVTLAAAAAVTT

SEQ ID NO: 835473 - protein, 31 aa, Mycobacterium
LPQRQIGVGWAALRTLPPPAATPSLTVDDVD

SEQ ID NO: 835474 - protein, 27 aa, Mycobacterium
LPQRWIDFLHRWDPARWPRANPRATSE

SEQ ID NO: 835475 - protein, 17 aa, Mycobacterium
LPQVLAIELPQPECFES

SEQ ID NO: 835476 - protein, 18 aa, Mycobacterium
LPQVLINVRVADKDTAAA

SEQ ID NO: 835477 - protein, 21 aa, Mycobacterium
LPRDALFQTLWDQAQRLQVVE

SEQ ID NO: 835478 - protein, 23 aa, Mycobacterium
LPRDDLDLFRRLSLDLISIPTDI

SEQ ID NO: 835479 - protein, 20 aa, Mycobacterium
LPRDGDALGWIAFQLRDALS

SEQ ID NO: 835480 - protein, 27 aa, Mycobacterium
LPRDKRMEIALTYIFGVGRTRSNEILA

SEQ ID NO: 835481 - protein, 27 aa, Mycobacterium
LPRDKRMEIALTYIFGVGRTRSNEILE

SEQ ID NO: 835482 - protein, 29 aa, Mycobacterium
LPRDKRMEIALTYIYGIGRTRSKEILAAT

SEQ ID NO: 835483 - protein, 29 aa, Mycobacterium
LPRDKRMEIALTYIYGIGRTRSNEILAAT

SEQ ID NO: 835484 - protein, 28 aa, Mycobacterium
LPRDKRMEIALTYIYGVGRTRSQEILEA

SEQ ID NO: 835485 - protein, 17 aa, Mycobacterium
LPRECLLIFGAEGPGIT

SEQ ID NO: 835486 - protein, 20 aa, Mycobacterium
LPRFVRRFPFNVLLADVDRR

SEQ ID NO: 835487 - protein, 22 aa, Mycobacterium
LPRGPLHAMLKERLELTGDLDV

SEQ ID NO: 835488 - protein, 17 aa, Mycobacterium
LPRHSWLDGYRDSWRYG

SEQ ID NO: 835489 - protein, 21 aa, Mycobacterium
LPRIAGPCGMVIFGVTGDLAR

SEQ ID NO: 835490 - protein, 22 aa, Mycobacterium
LPRIIRAGRHLARPKRYIPGFA

SEQ ID NO: 835491 - protein, 23 aa, Mycobacterium
LPRIIRAGRHLARPKRYLPGVPI

SEQ ID NO: 835492 - protein, 24 aa, Mycobacterium
LPRKDRWHSLARLAIRDDIYGALR

SEQ ID NO: 835493 - protein, 18 aa, Mycobacterium
LPRKVAMEMLLTGEPITA

SEQ ID NO: 835494 - protein, 22 aa, Mycobacterium
LPRKYYRTIAKMADTAWFVIRE

SEQ ID NO: 835495 - protein, 22 aa, Mycobacterium
LPRLVGMRRAQELMLTNRTLSA

SEQ ID NO: 835496 - protein, 17 aa, Mycobacterium
LPRNLHFQNPSPHIPWD

SEQ ID NO: 835497 - protein, 20 aa, Mycobacterium
LPRPITVDLFRGLAELEDTN

SEQ ID NO: 835498 - protein, 21 aa, Mycobacterium
LPRQPRFALLKGRRNYLCLNK

SEQ ID NO: 835499 - protein, 17 aa, Mycobacterium
LPRRIGMQKAKEMAFFG

SEQ ID NO: 835500 - protein, 17 aa, Mycobacterium
LPRRRSHLDTMPGRVGG

SEQ ID NO: 835501 - protein, 25 aa, Mycobacterium
LPRRSRVLLICRDEPTNEVWRRAVE

SEQ ID NO: 835502 - protein, 19 aa, Mycobacterium
LPRRTHVSVLTPTDPATAT

SEQ ID NO: 835503 - protein, 35 aa, Mycobacterium
LPRTQIMQRLPRVYQTLMELQLLDITTTPVEIAPT

SEQ ID NO: 835504 - protein, 19 aa, Mycobacterium
LPRTVTFKVLKRQLAAQGV

SEQ ID NO: 835505 - protein, 27 aa, Mycobacterium
LPRVHVDTWGGWLFINMDPDPEPLADY

SEQ ID NO: 835506 - protein, 22 aa, Mycobacterium
LPSAEFASLFQLLQARITKLEN

SEQ ID NO: 835507 - protein, 19 aa, Mycobacterium
LPSCAELIDSIVRDAIKHL

SEQ ID NO: 835508 - protein, 24 aa, Mycobacterium
LPSDDQVLELLAPEFSRSGVEIES

SEQ ID NO: 835509 - protein, 26 aa, Mycobacterium
LPSDRMLNLLIYIKSYLDGTLTFRRS

SEQ ID NO: 835510 - protein, 17 aa, Mycobacterium
LPSIRAGLLAGAPETRV

SEQ ID NO: 835511 - protein, 29 aa, Mycobacterium
LPSKRIPPTRGWRKVLYRGTFKLINPGQS

SEQ ID NO: 835512 - protein, 17 aa, Mycobacterium
LPSLERTIVTELSQMFD

SEQ ID NO: 835513 - protein, 17 aa, Mycobacterium
LPSMDHAELGRKLWVRD

SEQ ID NO: 835514 - protein, 20 aa, Mycobacterium
LPSPPRPVTPAPPPEWDDLD

SEQ ID NO: 835515 - protein, 20 aa, Mycobacterium
LPSRPVQVVGFTSVPGAGDN

SEQ ID NO: 835516 - protein, 19 aa, Mycobacterium
LPSSIAIIGAGPIGVEFAY

SEQ ID NO: 835517 - protein, 22 aa, Mycobacterium
LPSTGIMPVVCGDSHLGNFGFY

SEQ ID NO: 835518 - protein, 22 aa, Mycobacterium
LPSVLPTALRELIRYVRPPWLR

SEQ ID NO: 835519 - protein, 18 aa, Mycobacterium
LPTAQRRTPPAFHAWRAF

SEQ ID NO: 835520 - protein, 34 aa, Mycobacterium
LPTATLLIDRSAAWMFDYYPLRVRTEFPDGSCEA

SEQ ID NO: 835521 - protein, 19 aa, Mycobacterium
LPTELGFTLLGNPMNPNGG

SEQ ID NO: 835522 - protein, 17 aa, Mycobacterium
LPTFTRRGIATDLMRAQ

SEQ ID NO: 835523 - protein, 28 aa, Mycobacterium
LPTGITRLRFRLRWRGFRVTVEADHDTV

SEQ ID NO: 835524 - protein, 24 aa, Mycobacterium
LPTLADAVLPLRWTDGGMNRVRVL

SEQ ID NO: 835525 - protein, 25 aa, Mycobacterium
LPTLADAVLPMRWTDGGTSRVRIYR

SEQ ID NO: 835526 - protein, 25 aa, Mycobacterium
LPTLADTVLPLRWTDGGMSRVRVLR

SEQ ID NO: 835527 - protein, 21 aa, Mycobacterium
LPTLMPEHLATGWMSDSRRYA

SEQ ID NO: 835528 - protein, 17 aa, Mycobacterium
LPTLRTLAYGGSKVPLP

SEQ ID NO: 835529 - protein, 26 aa, Mycobacterium
LPTMLRGNLIQLLPRLPQRGLVTLAN

SEQ ID NO: 835530 - protein, 17 aa, Mycobacterium
LPTMPPWHVQENKWRAA

SEQ ID NO: 835531 - protein, 17 aa, Mycobacterium
LPTPPVTAPLTAPSHPP

SEQ ID NO: 835532 - protein, 27 aa, Mycobacterium
LPTQLPMMVSFLDFRKIPLVGMWAEMN

SEQ ID NO: 835533 - protein, 17 aa, Mycobacterium
LPTQPRLKRGSRPVILS

SEQ ID NO: 835534 - protein, 27 aa, Mycobacterium
LPTVTALNEYFWTAGRDGVLRIQECRS

SEQ ID NO: 835535 - protein, 20 aa, Mycobacterium
LPTVTGPFDLIFIDADKENN

SEQ ID NO: 835536 - protein, 17 aa, Mycobacterium
LPTVWDAWSARLAANAG

SEQ ID NO: 835537 - protein, 21 aa, Mycobacterium
LPTWKGLLDRFAEEAGFDKAT

SEQ ID NO: 835538 - protein, 38 aa, Mycobacterium
LPVAEAIAYILEILPALSYLHSIGLVYNDLKPENIMLT

SEQ ID NO: 835539 - protein, 38 aa, Mycobacterium
LPVAEAIAYLLEILPALSYLHSIGLVYNDLKPENIMLT

SEQ ID NO: 835540 - protein, 38 aa, Mycobacterium
LPVAEAIAYLLEILPALTYLHSIGLVYNDLKPENIMLT

SEQ ID NO: 835541 - protein, 33 aa, Mycobacterium
LPVAGQNWPWGDPHRYPFAPHPISGAAAKIWRG

SEQ ID NO: 835542 - protein, 18 aa, Mycobacterium
LPVAPIGVIPTRYYVNMN

SEQ ID NO: 835543 - protein, 23 aa, Mycobacterium
LPVDDMPIPIAPPTDRPSSIASP

SEQ ID NO: 835544 - protein, 24 aa, Mycobacterium
LPVDRLRYPVFSWQRITLQEMTHM

SEQ ID NO: 835545 - protein, 26 aa, Mycobacterium
LPVEELAWLRKAEPIHWVDIPNGSGG

SEQ ID NO: 835546 - protein, 25 aa, Mycobacterium
LPVEELIAAFLPVLFPGMEIVEHHA

SEQ ID NO: 835547 - protein, 18 aa, Mycobacterium
LPVEGQPGRFLLVTNFEY

SEQ ID NO: 835548 - protein, 20 aa, Mycobacterium
LPVEMIRSRQFVLPAMGRGV

SEQ ID NO: 835549 - protein, 20 aa, Mycobacterium
LPVFCIDYRLAPKHRFPTAA

SEQ ID NO: 835550 - protein, 18 aa, Mycobacterium
LPVFVLECAILADRVIVP

SEQ ID NO: 835551 - protein, 20 aa, Mycobacterium
LPVGPDAALWPTLREIATLG

SEQ ID NO: 835552 - protein, 35 aa, Mycobacterium; identical to SEQ ID NO: 129010

SEQ ID NO: 835553 - protein, 19 aa, Mycobacterium
LPVHDWPDRDLRITAIDTA

SEQ ID NO: 835554 - protein, 17 aa, Mycobacterium
LPVHECWDLMKSVTLGR

SEQ ID NO: 835555 - protein, 27 aa, Mycobacterium
LPVIGTKEFIAWLPTLLGLGSADAVVV

SEQ ID NO: 835556 - protein, 18 aa, Mycobacterium
LPVILVVNKTDRPDARIA

SEQ ID NO: 835557 - protein, 17 aa, Mycobacterium
LPVIVLRTSRFFPEQDD

SEQ ID NO: 835558 - protein, 26 aa, Mycobacterium
LPVKLCYAGPFFRYERPQAGRYRQLQ

SEQ ID NO: 835559 - protein, 18 aa, Mycobacterium
LPVKLYAAASRPPVVFWP

SEQ ID NO: 835560 - protein, 17 aa, Mycobacterium
LPVLGMTGSVFFEEAGR

SEQ ID NO: 835561 - protein, 17 aa, Mycobacterium
LPVLLLTAKDAVEDRIA

SEQ ID NO: 835562 - protein, 18 aa, Mycobacterium
LPVLLREVFAGYYGQRLP

SEQ ID NO: 835563 - protein, 17 aa, Mycobacterium
LPVLRPGEHVLLTDQLA

SEQ ID NO: 835564 - protein, 17 aa, Mycobacterium
LPVLTADASPAPQSDSS

SEQ ID NO: 835565 - protein, 17 aa, Mycobacterium
LPVMPPWHVQENKWRAA

SEQ ID NO: 835566 - protein, 17 aa, Mycobacterium
LPVMYDIPSRDDVAKVV

SEQ ID NO: 835567 - protein, 26 aa, Mycobacterium
LPVNDMRRLLVSLARRLRDADLPPVS

SEQ ID NO: 835568 - protein, 19 aa, Mycobacterium
LPVPPIALQVRTGIAMLSY

SEQ ID NO: 835569 - protein, 18 aa, Mycobacterium
LPVPPWAVVGLGSQAELL

SEQ ID NO: 835570 - protein, 18 aa, Mycobacterium
LPVQYADYAAWQSALLAD

SEQ ID NO: 835571 - protein, 24 aa, Mycobacterium
LPVQYVDYTLWQRAQFGELQDPHS

SEQ ID NO: 835572 - protein, 22 aa, Mycobacterium
LPVRSRLRRRWDVEGPLATVLD

SEQ ID NO: 835573 - protein, 17 aa, Mycobacterium
LPVRTPFAYQGVFGHLA

SEQ ID NO: 835574 - protein, 20 aa, Mycobacterium
LPVTGIEVLLSGLSGIRGVT

SEQ ID NO: 835575 - protein, 21 aa, Mycobacterium
LPVTRRVVHRFVPGETIDSAL

SEQ ID NO: 835576 - protein, 20 aa, Mycobacterium
LPVVPMVGLLARATLSPHLV

SEQ ID NO: 835577 - protein, 24 aa, Mycobacterium
LPVWTARQHLLGKKLWHDPRKRQC

SEQ ID NO: 835578 - protein, 24 aa, Mycobacterium
LPVWTLRLHLTGRRLWHDPRRRDC

SEQ ID NO: 835579 - protein, 24 aa, Mycobacterium
LPVWTLRLHLTGRRLWHDPRRREC

SEQ ID NO: 835580 - protein, 27 aa, Mycobacterium
LPVYDKPMIYYPLTTLMMAGIRDIQLI

SEQ ID NO: 835581 - protein, 25 aa, Mycobacterium
LPYARSTPLFYYNKAVWDRVGLPDR

SEQ ID NO: 835582 - protein, 20 aa, Mycobacterium
LPYAWPRKPVVAENVVCTSQ

SEQ ID NO: 835583 - protein, 19 aa, Mycobacterium
LPYFGRFLETNIRLYSIDD

SEQ ID NO: 835584 - protein, 21 aa, Mycobacterium
LPYHRPPLSKGYLAGKNGLDD

SEQ ID NO: 835585 - protein, 32 aa, Mycobacterium
LPYTQMIAGVLNLMPRWYIGSVLRHVDFLTSD

SEQ ID NO: 835586 - protein, 18 aa, Mycobacterium
LPYTTGSFLFQYAKTWRT

SEQ ID NO: 835587 - protein, 20 aa, Mycobacterium
LPYVAQKRLLRPVSDSARAT

SEQ ID NO: 835588 - protein, 21 aa, Mycobacterium
LQAAAAWDGLAAELSSAADSF

SEQ ID NO: 835589 - protein, 18 aa, Mycobacterium
LQAAFAQLLSWLTGQHDV

SEQ ID NO: 835590 - protein, 17 aa, Mycobacterium
LQAALDEGRIVLVAGFQ

SEQ ID NO: 835591 - protein, 30 aa, Mycobacterium
LQAAQPILLAHHLLAHAHPLLRDVDRLADF

SEQ ID NO: 835592 - protein, 26 aa, Mycobacterium
LQAAQPVLLAHHLLAHAQPLLRDVDR

SEQ ID NO: 835593 - protein, 20 aa, Mycobacterium
LQAATAWDGLSAELGSAASS

SEQ ID NO: 835594 - protein, 19 aa, Mycobacterium
LQADFRFLDVTDAEQWSRT

SEQ ID NO: 835595 - protein, 23 aa, Mycobacterium
LQADLGLTYLFISHDLAVIRQIS

SEQ ID NO: 835596 - protein, 18 aa, Mycobacterium
LQAFAQPLPVQVIGELLG

SEQ ID NO: 835597 - protein, 23 aa, Mycobacterium
LQAFFAPSKPITGALAPIADSLG

SEQ ID NO: 835598 - protein, 26 aa, Mycobacterium
LQAFGLLTDVPLTVLALGGEALGSAA

SEQ ID NO: 835599 - protein, 18 aa, Mycobacterium
LQAFPDIAGHYRRRFRHV

SEQ ID NO: 835600 - protein, 24 aa, Mycobacterium
LQAGQPLQISHLAEAFHAAGRCTA

SEQ ID NO: 835601 - protein, 24 aa, Mycobacterium
LQAGSPFQISRLAEAFHTAGRCTA

SEQ ID NO: 835602 - protein, 20 aa, Mycobacterium
LQAHYAGRPSPLYEAPRLSE

SEQ ID NO: 835603 - protein, 17 aa, Mycobacterium
LQAIGFAPRTTGYGLEH

SEQ ID NO: 835604 - protein, 25 aa, Mycobacterium
LQALALAIFIPRATSVESPFRFLVF

SEQ ID NO: 835605 - protein, 18 aa, Mycobacterium
LQALARWISTRTGAPVTI

SEQ ID NO: 835606 - protein, 21 aa, Mycobacterium
LQALGTPSWYARFAAQAMADP

SEQ ID NO: 835607 - protein, 26 aa, Mycobacterium
LQALLGIPMRVAVLGALRSTLASMLS

SEQ ID NO: 835608 - protein, 26 aa, Mycobacterium
LQALNRPIRALLAIPVTVRGADFGSL

SEQ ID NO: 835609 - protein, 21 aa, Mycobacterium
LQALQLRWFEHWLKDDARAAI

SEQ ID NO: 835610 - protein, 17 aa, Mycobacterium
LQALRLDAQILGSKYSE

SEQ ID NO: 835611 - protein, 27 aa, Mycobacterium
LQALSTLIRHHRSLPVLLVLVTDGHPL

SEQ ID NO: 835612 - protein, 17 aa, Mycobacterium
LQANWSWAPSALDHDRV

SEQ ID NO: 835613 - protein, 17 aa, Mycobacterium
LQANWTWARSALHDKQI

SEQ ID NO: 835614 - protein, 19 aa, Mycobacterium
LQARLIGRSAPVNEYLQRV

SEQ ID NO: 835615 - protein, 25 aa, Mycobacterium
LQARLVLGQALAWRGRGREAGQVLT

SEQ ID NO: 835616 - protein, 21 aa, Mycobacterium
LQARRLTAEVLLDRAARRLEA

SEQ ID NO: 835617 - protein, 18 aa, Mycobacterium
LQATIRGAYQRHLDATWL

SEQ ID NO: 835618 - protein, 33 aa, Mycobacterium
LQAVCDLEPYWEALRKVYAPFESGLPAPTGRVY

SEQ ID NO: 835619 - protein, 17 aa, Mycobacterium
LQAVIDDPDFRAGRVTT

SEQ ID NO: 835620 - protein, 17 aa, Mycobacterium
LQAVLDDPDFQAGRITT

SEQ ID NO: 835621 - protein, 17 aa, Mycobacterium
LQAWLDQRRTLAGGRAD

SEQ ID NO: 835622 - protein, 19 aa, Mycobacterium
LQAWLTTVVSRLGLDRLRS

SEQ ID NO: 835623 - protein, 17 aa, Mycobacterium
LQAYLKRTRADCAEFAA

SEQ ID NO: 835624 - protein, 18 aa, Mycobacterium
LQCPFHGWQWNQLGRNVC

SEQ ID NO: 835625 - protein, 18 aa, Mycobacterium
LQCPFHGWQWSQEGRNVC

SEQ ID NO: 835626 - protein, 17 aa, Mycobacterium
LQCPFHGWQWSTDGRNV

SEQ ID NO: 835627 - protein, 18 aa, Mycobacterium
LQCRWTEVALWGQGWPLG

SEQ ID NO: 835628 - protein, 27 aa, Mycobacterium
LQDDRDPPLLYLARYARATKPQVPSLS

SEQ ID NO: 835629 - protein, 25 aa, Mycobacterium
LQDDRWTYRFNLFDMARALDNQVFW

SEQ ID NO: 835630 - protein, 24 aa, Mycobacterium
LQDFATLWRHGGSPLLRGLIDAGA

SEQ ID NO: 835631 - protein, 19 aa, Mycobacterium
LQDHLQLRTIYRVRGARTV

SEQ ID NO: 835632 - protein, 24 aa, Mycobacterium
LQDLGLLRKYKGQLLLTKAGQAAQ

SEQ ID NO: 835633 - protein, 23 aa, Mycobacterium
LQDRDVMHRILLSSPDSLGTEAL

SEQ ID NO: 835634 - protein, 27 aa, Mycobacterium
LQDRNETLFYRVLLDHIPEALPIVYTP

SEQ ID NO: 835635 - protein, 23 aa, Mycobacterium
LQDTPTDILLLSPFSELAGHPLA

SEQ ID NO: 835636 - protein, 17 aa, Mycobacterium
LQDVGFFTLLQPEQWGG

SEQ ID NO: 835637 - protein, 18 aa, Mycobacterium
LQDVGFFTLLQPEQWGGL

SEQ ID NO: 835638 - protein, 19 aa, Mycobacterium
LQEEFGLSYLFVAHDLGVV

SEQ ID NO: 835639 - protein, 21 aa, Mycobacterium
LQEFLFGILVGVVGRHRVHLR

SEQ ID NO: 835640 - protein, 17 aa, Mycobacterium
LQEGIIPPTLNYETPDP

SEQ ID NO: 835641 - protein, 27 aa, Mycobacterium
LQEIDHVPFVAPLARFAATAQSAADAG

SEQ ID NO: 835642 - protein, 26 aa, Mycobacterium
LQEIDHVPFVAPLARFAATAQSADDA

SEQ ID NO: 835643 - protein, 27 aa, Mycobacterium
LQEIDHVPFVAPLARFAATAQSAEDAG

SEQ ID NO: 835644 - protein, 27 aa, Mycobacterium
LQEIDHVPFVAPLARFAATAQSAGDAG

SEQ ID NO: 835645 - protein, 27 aa, Mycobacterium
LQELARELRPWVPVVSLVKGLEQGTNL

SEQ ID NO: 835646 - protein, 18 aa, Mycobacterium
LQELATAYALTVGARGGH

SEQ ID NO: 835647 - protein, 19 aa, Mycobacterium
LQEQAFLNKGLTIKLTDER

SEQ ID NO: 835648 - protein, 24 aa, Mycobacterium
LQERFGPLVQILPSAVTSSFRLDY

SEQ ID NO: 835649 - protein, 30 aa, Mycobacterium
LQESFKRHVGLPPLTYLREVRLIRAHAELA

SEQ ID NO: 835650 - protein, 19 aa, Mycobacterium
LQETMVKAFAGFRSFRAGT

SEQ ID NO: 835651 - protein, 26 aa, Mycobacterium
LQETTLGAITSWLPWESELSDLAVGD

SEQ ID NO: 835652 - protein, 35 aa, Mycobacterium
LQFDPKFSRSPVLASPFTIVNAPFQLLTGQSIVNP

SEQ ID NO: 835653 - protein, 17 aa, Mycobacterium
LQFLRGGAQVAKPALML

SEQ ID NO: 835654 - protein, 18 aa, Mycobacterium
LQFLTGEAVLLESREPAK

SEQ ID NO: 835655 - protein, 17 aa, Mycobacterium
LQFPAFAGPVFDSLTTD

SEQ ID NO: 835656 - protein, 17 aa, Mycobacterium
LQFRQFGGRAEFAGPIS

SEQ ID NO: 835657 - protein, 26 aa, Mycobacterium
LQFRRFAGCPICNLHLRSISGRHDEI

SEQ ID NO: 835658 - protein, 17 aa, Mycobacterium
LQFRTIHGYKRAFRIAG

SEQ ID NO: 835659 - protein, 31 aa, Mycobacterium
LQFTESAGYLDFARFGPPSYAVLDATARLSE

SEQ ID NO: 835660 - protein, 18 aa, Mycobacterium
LQGAGWTAAAPQAAPGML

SEQ ID NO: 835661 - protein, 29 aa, Mycobacterium
LQGGSILGPHFSFTWFRGSPIGRERKTEE

SEQ ID NO: 835662 - protein, 18 aa, Mycobacterium
LQGPKIRLGRFADGPTVW

SEQ ID NO: 835663 - protein, 22 aa, Mycobacterium
LQGPKIRLGRFASGPTYWADGE

SEQ ID NO: 835664 - protein, 23 aa, Mycobacterium
LQGPKIRLGRFATGPTYWADGET

SEQ ID NO: 835665 - protein, 19 aa, Mycobacterium
LQGPWRDYVGWALNIEQVS

SEQ ID NO: 835666 - protein, 25 aa, Mycobacterium
LQGQFAKWQMPDAVLFVEALPRTSV

SEQ ID NO: 835667 - protein, 33 aa, Mycobacterium
LQGSRAIRLLATTNLSLYAMLMERHLSDGALPE

SEQ ID NO: 835668 - protein, 19 aa, Mycobacterium
LQHGVIPPNIHFSRLPDEM

SEQ ID NO: 835669 - protein, 26 aa, Mycobacterium
LQHGVIPRNLHFTCLPDDMARISTKL

SEQ ID NO: 835670 - protein, 25 aa, Mycobacterium
LQHISSGVFLLKASVRELRECVGRR

SEQ ID NO: 835671 - protein, 22 aa, Mycobacterium
LQHLEVALDQCWDLLRQRRALR

SEQ ID NO: 835672 - protein, 20 aa, Mycobacterium
LQHLYLKERSAAWTPGSFVE

SEQ ID NO: 835673 - protein, 24 aa, Mycobacterium
LQHQIAQLLLGAYVADVWQPFVES

SEQ ID NO: 835674 - protein, 24 aa, Mycobacterium
LQHQRFPVHRLGDGGALRGPRQAS

SEQ ID NO: 835675 - protein, 19 aa, Mycobacterium
LQHRRVMYVPYVAPRDFRG

SEQ ID NO: 835676 - protein, 23 aa, Mycobacterium
LQHSPHLLPFQPVSFRDFMLYEQ

SEQ ID NO: 835677 - protein, 21 aa, Mycobacterium
LQIDFYNWLPIKSQKTQTLVR

SEQ ID NO: 835678 - protein, 22 aa, Mycobacterium
LQIEAAWVWPEQHQWLKQFGET

SEQ ID NO: 835679 - protein, 17 aa, Mycobacterium
LQIELLKLQLWVKERGE

SEQ ID NO: 835680 - protein, 18 aa, Mycobacterium
LQIGDIEKFPFLDPPDRR

SEQ ID NO: 835681 - protein, 22 aa, Mycobacterium
LQIQGPTLFSGYHNLPEKTAEV

SEQ ID NO: 835682 - protein, 17 aa, Mycobacterium
LQIRLDWDRGFELIAPT

SEQ ID NO: 835683 - protein, 27 aa, Mycobacterium
LQIRSGAPLLLLHRLTHLEDGTPFDFE

SEQ ID NO: 835684 - protein, 17 aa, Mycobacterium
LQITPGTDLALLNGLLH

SEQ ID NO: 835685 - protein, 25 aa, Mycobacterium
LQIVDGFLRAGIIKAALIVASDANP

SEQ ID NO: 835686 - protein, 17 aa, Mycobacterium
LQIYAELTLDVAFTIVV

SEQ ID NO: 835687 - protein, 18 aa, Mycobacterium
LQLARRIAAALNAPGGGG

SEQ ID NO: 835688 - protein, 19 aa, Mycobacterium
LQLCSAALITWFNDHFDDL

SEQ ID NO: 835689 - protein, 21 aa, Mycobacterium
LQLDRLLRLKVFPLAISLPWG

SEQ ID NO: 835690 - protein, 33 aa, Mycobacterium
LQLDRLLRLKVFPLAISLPWGIAPAALPQLPLP

SEQ ID NO: 835691 - protein, 26 aa, Mycobacterium
LQLGPKPVVNNAVRFAFWTAEEDGLA

SEQ ID NO: 835692 - protein, 25 aa, Mycobacterium
LQLLDDVAAGQLLLAFAHQEPGHRT

SEQ ID NO: 835693 - protein, 19 aa, Mycobacterium
LQLNQYGARPVFAGVITTV

SEQ ID NO: 835694 - protein, 19 aa, Mycobacterium
LQLPPLGSPVSSPMAPSRL

SEQ ID NO: 835695 - protein, 21 aa, Mycobacterium
LQLQTLARPLADIETIWAAKE

SEQ ID NO: 835696 - protein, 49 aa, Mycobacterium
LQLVPKMLRMLRPDLTIGFFLHIPFPPVELFLQMPWRTEIIEGLLGADL

SEQ ID NO: 835697 - protein, 19 aa, Mycobacterium
LQMKWSDMAGMQRSLVERA

SEQ ID NO: 835698 - protein, 17 aa, Mycobacterium
LQNEGMYGVFRPDLKME

SEQ ID NO: 835699 - protein, 22 aa, Mycobacterium
LQNEIGFTRVLYDDHIGKVSLI

SEQ ID NO: 835700 - protein, 27 aa, Mycobacterium
LQNHPLAGIVYLAAQPLPVSDHRAEMM

SEQ ID NO: 835701 - protein, 22 aa, Mycobacterium
LQNITLIRKEGWRDFVVAAPRR

SEQ ID NO: 835702 - protein, 18 aa, Mycobacterium
LQNKARALQVLAARLQAM

SEQ ID NO: 835703 - protein, 24 aa, Mycobacterium
LQNKARALQVLAARLQSLAEEQAL

SEQ ID NO: 835704 - protein, 23 aa, Mycobacterium
LQNKLPCIYLVDSGGAFLPRQDE

SEQ ID NO: 835705 - protein, 18 aa, Mycobacterium
LQNKTRALQVLAARLQSM

SEQ ID NO: 835706 - protein, 24 aa, Mycobacterium
LQNLPPLPGVPEPLAGKLTVAVRY

SEQ ID NO: 835707 - protein, 25 aa, Mycobacterium
LQNNDFVLQLITFSGYPAPDEPERT

SEQ ID NO: 835708 - protein, 24 aa, Mycobacterium
LQNPSWVMLYQYGNPSNALAHYEG

SEQ ID NO: 835709 - protein, 23 aa, Mycobacterium
LQNRLPCIYLVDSGGAFLPKQDE

SEQ ID NO: 835710 - protein, 23 aa, Mycobacterium
LQNRLPCLYLVDSGGAFLPRQDE

SEQ ID NO: 835711 - protein, 23 aa, Mycobacterium
LQPAAMFALPICRRPGAKTVTAL

SEQ ID NO: 835712 - protein, 27 aa, Mycobacterium
LQPARWGTGFILGTDRWGPFGRHAPHA

SEQ ID NO: 835713 - protein, 25 aa, Mycobacterium
LQPARWGTGYILGTNRWGPFGRNAP

SEQ ID NO: 835714 - protein, 25 aa, Mycobacterium
LQPASPIYNFRYPNMLRLHYEKKRN

SEQ ID NO: 835715 - protein, 26 aa, Mycobacterium
LQPDRNLFMPMAFHLGYHSLPIGNVM

SEQ ID NO: 835716 - protein, 17 aa, Mycobacterium
LQPGDVLYLPRGQVHSA

SEQ ID NO: 835717 - protein, 24 aa, Mycobacterium
LQPGTAHRIMTGAPLPAGATAIVP

SEQ ID NO: 835718 - protein, 24 aa, Mycobacterium
LQPITKAPMYLKVEARYAVAAEGA

SEQ ID NO: 835719 - protein, 27 aa, Mycobacterium
LQPLSKMALIRRYAGLRPAGISTVEAA

SEQ ID NO: 835720 - protein, 19 aa, Mycobacterium
LQPPFECDMAVLVSGLLDG

SEQ ID NO: 835721 - protein, 22 aa, Mycobacterium
LQPQARYILPSFIEHSSFGVKE

SEQ ID NO: 835722 - protein, 27 aa, Mycobacterium
LQPQDAEMLGIRLVPLHVLTGEQDLRD

SEQ ID NO: 835723 - protein, 26 aa, Mycobacterium
LQPQQWGGLQCDPTLFFEATRRLASA

SEQ ID NO: 835724 - protein, 25 aa, Mycobacterium
LQPRARLSGPRRRPGRRRLDRRADH

SEQ ID NO: 835725 - protein, 19 aa, Mycobacterium
LQPRPYLVDYWTEVVRAVG

SEQ ID NO: 835726 - protein, 17 aa, Mycobacterium
LQPTMCVRGWFPDGQQL

SEQ ID NO: 835727 - protein, 22 aa, Mycobacterium
LQPVAVSASFLWAPDPGPVQLV

SEQ ID NO: 835728 - protein, 17 aa, Mycobacterium
LQPVFTPQNVRRFGGHM

SEQ ID NO: 835729 - protein, 18 aa, Mycobacterium
LQPVPAMAYPVILAEART

SEQ ID NO: 835730 - protein, 27 aa, Mycobacterium
LQPWDRDQIHRLFDDLEFRVLRDRLFE

SEQ ID NO: 835731 - protein, 25 aa, Mycobacterium
LQQAALCDGTLGAAPWLGAEAIDRM

SEQ ID NO: 835732 - protein, 25 aa, Mycobacterium
LQQALSGVLGLPASAAAAAAQNPAA

SEQ ID NO: 835733 - protein, 23 aa, Mycobacterium
LQQAQQLIRLQNGTFRSTINGHE

SEQ ID NO: 835734 - protein, 19 aa, Mycobacterium
LQQDWVWPELFSPQEDLER

SEQ ID NO: 835735 - protein, 42 aa, Mycobacterium
LQQLAPSLFRLRIPGGRAHLLNCYLWLAPDGVTLIDTGWPDS

SEQ ID NO: 835736 - protein, 30 aa, Mycobacterium
LQQLRLRTSMKWRAHPAAVLPLWVAEMDVR

SEQ ID NO: 835737 - protein, 27 aa, Mycobacterium
LQQLRPELISRERWMLSTATLSVIGSV

SEQ ID NO: 835738 - protein, 29 aa, Mycobacterium
LQQLVQSLPENDPRTAWLRGQVADLQAHM

SEQ ID NO: 835739 - protein, 26 aa, Mycobacterium
LQQNICFLYHQMNPWDVPIGGMGAVT

SEQ ID NO: 835740 - protein, 29 aa, Mycobacterium
LQQRLAPRTPLARVFWPRTRIVVSQDTVQ

SEQ ID NO: 835741 - protein, 27 aa, Mycobacterium
LQQTPVSRVLSIWPDWVRRWPTASATA

SEQ ID NO: 835742 - protein, 24 aa, Mycobacterium
LQQVGTPWMARQGGAVLAADANGL

SEQ ID NO: 835743 - protein, 29 aa, Mycobacterium
LQQYVHLQELARRRLYRSFNPQGVGIIAE

SEQ ID NO: 835744 - protein, 17 aa, Mycobacterium
LQRAEQLALLPFEPKAD

SEQ ID NO: 835745 - protein, 17 aa, Mycobacterium
LQRDASWAALVDGGVTA

SEQ ID NO: 835746 - protein, 24 aa, Mycobacterium
LQRDPPVLAGHRRLARPAQQGDAR

SEQ ID NO: 835747 - protein, 26 aa, Mycobacterium
LQREDLDYLLPPQLSGKMTQRVVKQM

SEQ ID NO: 835748 - protein, 17 aa, Mycobacterium
LQRELLASAIQLTRPGG

SEQ ID NO: 835749 - protein, 23 aa, Mycobacterium
LQRFEALSRMRGELDDFAGRLVP

SEQ ID NO: 835750 - protein, 19 aa, Mycobacterium
LQRGADLAALYLAAEQLGG

SEQ ID NO: 835751 - protein, 19 aa, Mycobacterium
LQRHLAKRRPPKSGQLVNE

SEQ ID NO: 835752 - protein, 17 aa, Mycobacterium
LQRHLALITQYWADGEN

SEQ ID NO: 835753 - protein, 17 aa, Mycobacterium
LQRLGVDAPIYLGGAGR

SEQ ID NO: 835754 - protein, 17 aa, Mycobacterium
LQRLSSHLGGAQIWAKR

SEQ ID NO: 835755 - protein, 19 aa, Mycobacterium
LQRRQIRLLDAVRHAVRTA

SEQ ID NO: 835756 - protein, 24 aa, Mycobacterium
LQRSPLYHELQVPEFSFTVVDGPT

SEQ ID NO: 835757 - protein, 23 aa, Mycobacterium
LQRSPLYHELQVPEFTFTAVDGP

SEQ ID NO: 835758 - protein, 19 aa, Mycobacterium
LQRTAPWVEQLGLEHLREV

SEQ ID NO: 835759 - protein, 18 aa, Mycobacterium
LQRTAPWVESLGLDHVRE

SEQ ID NO: 835760 - protein, 18 aa, Mycobacterium
LQRVARFASRLRAGKVMA

SEQ ID NO: 835761 - protein, 22 aa, Mycobacterium
LQRVCAHLPTPPQVVVVRGEPG

SEQ ID NO: 835762 - protein, 19 aa, Mycobacterium
LQRVGVPIADLLAGMYGAF

SEQ ID NO: 835763 - protein, 24 aa, Mycobacterium
LQRYPYGYTCHYVRPGWKLPRRAS

SEQ ID NO: 835764 - protein, 22 aa, Mycobacterium
LQSALGWLKYTIDTELRMNEIG

SEQ ID NO: 835765 - protein, 32 aa, Mycobacterium
LQSAQPILLAHHLLAHAHPLLRDVERIVDFDK

SEQ ID NO: 835766 - protein, 23 aa, Mycobacterium
LQSDRIFFAVWSVEKLGRAGRGA

SEQ ID NO: 835767 - protein, 21 aa, Mycobacterium
LQSEPMYRSFRPDLENPTRAD

SEQ ID NO: 835768 - protein, 22 aa, Mycobacterium
LQSHDPPLRALLGLPITVRGAD

SEQ ID NO: 835769 - protein, 17 aa, Mycobacterium
LQSIIQFFRFASVRSEQ

SEQ ID NO: 835770 - protein, 18 aa, Mycobacterium
LQSILDRDWLHPGSIVVA

SEQ ID NO: 835771 - protein, 25 aa, Mycobacterium
LQSKGCAMLLMGWDSLFWGDVEKAS

SEQ ID NO: 835772 - protein, 25 aa, Mycobacterium
LQSSRAIRLLAATNLSLYATLMERH

SEQ ID NO: 835773 - protein, 21 aa, Mycobacterium
LQSTQAAFILNFSCPIEQARD

SEQ ID NO: 835774 - protein, 29 aa, Mycobacterium
LQSVLENPTRWRLILTVPDSAPREYRAAV

SEQ ID NO: 835775 - protein, 17 aa, Mycobacterium
LQSWRQHIGPPRHLRAD

SEQ ID NO: 835776 - protein, 29 aa, Mycobacterium
LQTAERLGIFAPVERLIGRPLFGSSLEAS

SEQ ID NO: 835777 - protein, 17 aa, Mycobacterium
LQTARMAGLRAPSSCEI

SEQ ID NO: 835778 - protein, 17 aa, Mycobacterium
LQTFLTAGPKESRAWVI

SEQ ID NO: 835779 - protein, 24 aa, Mycobacterium
LQTHGRYAPFRWTFGARVGEQMIQ

SEQ ID NO: 835780 - protein, 38 aa, Mycobacterium
LQTLEQQLLGVINAPTNALLGRPLIGNGANGAPGADGQ

SEQ ID NO: 835781 - protein, 27 aa, Mycobacterium
LQTTTYLQTLNWYLDTLGMIVSDFLYY

SEQ ID NO: 835782 - protein, 23 aa, Mycobacterium
LQVAQRLTLMPKDFRLTLRRRRS

SEQ ID NO: 835783 - protein, 31 aa, Mycobacterium
LQVASLDHAMWFMRGFRADEWLLYDQSSPSA

SEQ ID NO: 835784 - protein, 25 aa, Mycobacterium
LQVGTFGIHPVLLDTALHALGVAGG

SEQ ID NO: 835785 - protein, 24 aa, Mycobacterium
LQVIFRPRIALDPYAIGVPGVYLC

SEQ ID NO: 835786 - protein, 19 aa, Mycobacterium
LQVIFRPRIAVDPYVIGVP

SEQ ID NO: 835787 - protein, 17 aa, Mycobacterium
LQVLGSYGDAWLIESHY

SEQ ID NO: 835788 - protein, 18 aa, Mycobacterium
LQVLRGRVRLTTGGDAWE

SEQ ID NO: 835789 - protein, 20 aa, Mycobacterium
LQVNELAFGALKYICEEGPD

SEQ ID NO: 835790 - protein, 17 aa, Mycobacterium
LQVPADYIDVLRFAIPE

SEQ ID NO: 835791 - protein, 19 aa, Mycobacterium
LQWETFDPRFDLAASPNEV

SEQ ID NO: 835792 - protein, 33 aa, Mycobacterium
LQWQRGRAWAFQQAMGLVWYYANSNPAMSRVGR

SEQ ID NO: 835793 - protein, 26 aa, Mycobacterium
LQYAKTWRTLAKLSLPNKYLRDNADD

SEQ ID NO: 835794 - protein, 32 aa, Mycobacterium
LQYDGFADFPRYPINFLADLNAFMGIQFVHTD

SEQ ID NO: 835795 - protein, 22 aa, Mycobacterium
LQYHRPRKRWALKGFHGFRLKE

SEQ ID NO: 835796 - protein, 21 aa, Mycobacterium
LQYRTGARRLVSVRITPLRLE

SEQ ID NO: 835797 - protein, 18 aa, Mycobacterium
LRAAAEHFGFHLDADDQR

SEQ ID NO: 835798 - protein, 21 aa, Mycobacterium
LRAAARLYALAPNAAIYYGLG

SEQ ID NO: 835799 - protein, 22 aa, Mycobacterium
LRAAASRWRAFGAAAKGVKGTL

SEQ ID NO: 835800 - protein, 30 aa, Mycobacterium
LRAAFADRILPALHAFSPELIIVSAGFDAH

SEQ ID NO: 835801 - protein, 18 aa, Mycobacterium
LRAAFAEVVACHEALRTV

SEQ ID NO: 835802 - protein, 22 aa, Mycobacterium
LRAAFTIKGITAPLPLSATITE

SEQ ID NO: 835803 - protein, 20 aa, Mycobacterium
LRAAISGSLSFMEGIVLHWM

SEQ ID NO: 835804 - protein, 19 aa, Mycobacterium
LRAALGGRCHAAISGGAPL

SEQ ID NO: 835805 - protein, 20 aa, Mycobacterium
LRAATWAAFPGVHGKAYRAL

SEQ ID NO: 835806 - protein, 24 aa, Mycobacterium
LRAAVAAVVLRHAALRTTVHAGAD

SEQ ID NO: 835807 - protein, 27 aa, Mycobacterium
LRADLDRFIFLLWQRRRTTLRTRIARS

SEQ ID NO: 835808 - protein, 36 aa, Mycobacterium
LRADMRITHPLISRAHLLLRFDQGRWLAIDNGSLNG

SEQ ID NO: 835809 - protein, 24 aa, Mycobacterium
LRAETFRLPAPLYADPATVVSMRE

SEQ ID NO: 835810 - protein, 25 aa, Mycobacterium
LRAFATCFGALVRTSWFQVSESGGH

SEQ ID NO: 835811 - protein, 17 aa, Mycobacterium
LRAFGAQIVLTPGADGM

SEQ ID NO: 835812 - protein, 18 aa, Mycobacterium
LRAFKKAGLNSQRARGAM

SEQ ID NO: 835813 - protein, 26 aa, Mycobacterium
LRAGEKMMLLFESANFDEAVFAEPER

SEQ ID NO: 835814 - protein, 30 aa, Mycobacterium
LRAGLDHLLTWGVLAAPLTLVPAPTRRTAA

SEQ ID NO: 835815 - protein, 27 aa, Mycobacterium
LRAGYGSLIQMIWIYDRAVDVEGLRRF

SEQ ID NO: 835816 - protein, 19 aa, Mycobacterium
LRAGYWRQVRTQLLVTPAM

SEQ ID NO: 835817 - protein, 19 aa, Mycobacterium
LRAHFRALSAWLTSALERG

SEQ ID NO: 835818 - protein, 21 aa, Mycobacterium
LRAIADFFGVPASYLIDRDTD

SEQ ID NO: 835819 - protein, 19 aa, Mycobacterium
LRAIFAELLGLPVENLIAG

SEQ ID NO: 835820 - protein, 21 aa, Mycobacterium
LRAIRMFMRWQRGIIQLLSGK

SEQ ID NO: 835821 - protein, 17 aa, Mycobacterium
LRAISRILPRGYGLHRG

SEQ ID NO: 835822 - protein, 24 aa, Mycobacterium
LRAKAGWLWTGRRGVVAGFSAAAL

SEQ ID NO: 835823 - protein, 26 aa, Mycobacterium
LRAKEFGPFDLVLANPPYVPGDRRVL

SEQ ID NO: 835824 - protein, 26 aa, Mycobacterium
LRAKHALFDRLVYHKLRAALGGECHA

SEQ ID NO: 835825 - protein, 18 aa, Mycobacterium
LRAKLLGALDYIEAAGDV

SEQ ID NO: 835826 - protein, 32 aa, Mycobacterium
LRAKTDLLDEAWWLPSVFIPNGGAAAASLGSG

SEQ ID NO: 835827 - protein, 22 aa, Mycobacterium
LRALAARSVLPVELRLGVPDRL

SEQ ID NO: 835828 - protein, 24 aa, Mycobacterium
LRALALVCSLKKSPAPSSSDLLAD

SEQ ID NO: 835829 - protein, 21 aa, Mycobacterium
LRALASVQALPTPGATVTGSG

SEQ ID NO: 835830 - protein, 26 aa, Mycobacterium
LRALFESFPDLRLTAPPQPRGLINLH

SEQ ID NO: 835831 - protein, 17 aa, Mycobacterium
LRALFINTTLKRSPDLS

SEQ ID NO: 835832 - protein, 17 aa, Mycobacterium
LRALGVGGPRYLGGAGR

SEQ ID NO: 835833 - protein, 17 aa, Mycobacterium
LRALGYETQITASPVVS

SEQ ID NO: 835834 - protein, 19 aa, Mycobacterium
LRALNPDSQLFFITGADAL

SEQ ID NO: 835835 - protein, 18 aa, Mycobacterium
LRALNYPKVVIGVSGGLD

SEQ ID NO: 835836 - protein, 26 aa, Mycobacterium
LRALPAPEILSFLYLEARLADEGRYS

SEQ ID NO: 835837 - protein, 20 aa, Mycobacterium
LRALPDTLTYGLLRYLNGDV

SEQ ID NO: 835838 - protein, 25 aa, Mycobacterium
LRALRATLELLATGPLAGLPPLSGG

SEQ ID NO: 835839 - protein, 21 aa, Mycobacterium
LRALVRAVIYWGQEALAFGMT

SEQ ID NO: 835840 - protein, 45 aa, Mycobacterium
LRAMRPDLTIGFFLHIPFPPVELFMQLPWRTEIIQGLLGADLVGF

SEQ ID NO: 835841 - protein, 18 aa, Mycobacterium
LRANLADPPPAGSIGLMI

SEQ ID NO: 835842 - protein, 40 aa, Mycobacterium
LRANNDWLVPLIRSIMDLAVPFTYFLGSLAPAYDRLNGLL

SEQ ID NO: 835843 - protein, 25 aa, Mycobacterium
LRAPDTPPLVLDFGGGVLGALQRYA

SEQ ID NO: 835844 - protein, 18 aa, Mycobacterium
LRAPILIGAMTGGAELSA

SEQ ID NO: 835845 - protein, 19 aa, Mycobacterium
LRAPLNRVIRYIFEGLRGR

SEQ ID NO: 835846 - protein, 17 aa, Mycobacterium
LRAPMSAGYRYLGGAPP

SEQ ID NO: 835847 - protein, 18 aa, Mycobacterium
LRAPQPDGTPAVLLQHRA

SEQ ID NO: 835848 - protein, 17 aa, Mycobacterium
LRAPRALPVLVIDGRDD

SEQ ID NO: 835849 - protein, 26 aa, Mycobacterium
LRAPVFNFIAPRLAGLPFSGALGAMY

SEQ ID NO: 835850 - protein, 22 aa, Mycobacterium
LRAPWTAIGMLQQGRRWIEKAL

SEQ ID NO: 835851 - protein, 26 aa, Mycobacterium
LRAQRRIMLIGWDLDYRTTFEPAGAT

SEQ ID NO: 835852 - protein, 18 aa, Mycobacterium
LRARGINLVINYVDQPGA

SEQ ID NO: 835853 - protein, 25 aa, Mycobacterium
LRARHALFDRLVYEKLRSALGGDCH

SEQ ID NO: 835854 - protein, 20 aa, Mycobacterium
LRARLDPQRPGHVGVLLGNT

SEQ ID NO: 835855 - protein, 26 aa, Mycobacterium
LRARLGLDSGYLSRLLRALEGAGLIE

SEQ ID NO: 835856 - protein, 20 aa, Mycobacterium
LRARLQLLSVGELEELLAYE

SEQ ID NO: 835857 - protein, 35 aa, Mycobacterium
LRARLQLMVDFMATRTAFFDEFFLGAADAGVRQVV

SEQ ID NO: 835858 - protein, 30 aa, Mycobacterium
LRARPIHVPSPLLGLLVAASWRARLQPLDR

SEQ ID NO: 835859 - protein, 24 aa, Mycobacterium
LRARPQLAVTFRNGWQWATVEGRA

SEQ ID NO: 835860 - protein, 27 aa, Mycobacterium
LRARPQLAVTFRNGWRWATVEGGAELA

SEQ ID NO: 835861 - protein, 22 aa, Mycobacterium
LRARRPAHGLTLLREALGGDSE

SEQ ID NO: 835862 - protein, 29 aa, Mycobacterium
LRARRRLAELRTLRYQLLRHRAAGPGLTR

SEQ ID NO: 835863 - protein, 32 aa, Mycobacterium
LRARRVRHLRGIEGLLRQAGRAAHRIGGGTAG

SEQ ID NO: 835864 - protein, 27 aa, Mycobacterium
LRARSRLREEYVGPWLPEPLLVAEDAS

SEQ ID NO: 835865 - protein, 21 aa, Mycobacterium
LRARVLKRWSVAPGTPPVTVV

SEQ ID NO: 835866 - protein, 32 aa, Mycobacterium
LRASDLDWTVLGPGRLTLEPATGRIALGEGKG

SEQ ID NO: 835867 - protein, 24 aa, Mycobacterium
LRASGLLGLVLPADVGGIAASPRE

SEQ ID NO: 835868 - protein, 31 aa, Mycobacterium
LRASIRASQNLIPRAFWLTYQNGRDDMLSFY

SEQ ID NO: 835869 - protein, 28 aa, Mycobacterium
LRASNRNAPLLWRFWPALSAGCDDLERR

SEQ ID NO: 835870 - protein, 25 aa, Mycobacterium
LRATGKPPFLLDSHRPRVSLADFRN

SEQ ID NO: 835871 - protein, 18 aa, Mycobacterium
LRATLACVLFAEPAPQLL

SEQ ID NO: 835872 - protein, 19 aa, Mycobacterium
LRATRVEERRWEKRAKENY

SEQ ID NO: 835873 - protein, 24 aa, Mycobacterium
LRATVNALAPDAWITVVGAGFTGI

SEQ ID NO: 835874 - protein, 18 aa, Mycobacterium
LRAVAALARAAKLIGEDH

SEQ ID NO: 835875 - protein, 17 aa, Mycobacterium
LRAVAVLDLADALDEEL

SEQ ID NO: 835876 - protein, 29 aa, Mycobacterium
LRAVRNIWRFWYQIPISLPVIGPRMISDL

SEQ ID NO: 835877 - protein, 20 aa, Mycobacterium
LRAVTLVPGYGAAKAGIICV

SEQ ID NO: 835878 - protein, 22 aa, Mycobacterium
LRAWLTTVVSRLGLDKLRSAAH

SEQ ID NO: 835879 - protein, 19 aa, Mycobacterium
LRAYAAGLAAWWNLLEETN

SEQ ID NO: 835880 - protein, 18 aa, Mycobacterium
LRAYLLDQNALPDAPLTA

SEQ ID NO: 835881 - protein, 21 aa, Mycobacterium
LRAYQFFRWAVTEDFLVAFGG

SEQ ID NO: 835882 - protein, 20 aa, Mycobacterium
LRCFREMVLDALHGQSNDLD

SEQ ID NO: 835883 - protein, 21 aa, Mycobacterium
LRCFVVLAEELHFGRAAQRLH

SEQ ID NO: 835884 - protein, 20 aa, Mycobacterium
LRCLAPTWPLGAHPEPLRPG

SEQ ID NO: 835885 - protein, 18 aa, Mycobacterium
LRCLKRQLARIVYRHLHT

SEQ ID NO: 835886 - protein, 17 aa, Mycobacterium
LRCPECGAILLRVKGFE

SEQ ID NO: 835887 - protein, 23 aa, Mycobacterium
LRCPYHSWTYALDGKLVAAPNIG

SEQ ID NO: 835888 - protein, 21 aa, Mycobacterium
LRCRPIRDLLVDYLRERQPSL

SEQ ID NO: 835889 - protein, 32 aa, Mycobacterium
LRDAARLAFRYLLDTLLERPMSRRLIEFPAAV

SEQ ID NO: 835890 - protein, 24 aa, Mycobacterium
LRDADIVVVRILGGYRAWEDGIDA

SEQ ID NO: 835891 - protein, 34 aa, Mycobacterium
LRDAGFTLPPSQANFIWLPLGARTTDFTEQAADA

SEQ ID NO: 835892 - protein, 17 aa, Mycobacterium
LRDAGHDVVVWDLSDAD

SEQ ID NO: 835893 - protein, 18 aa, Mycobacterium
LRDALAVHRAFDALGAAA

SEQ ID NO: 835894 - protein, 31 aa, Mycobacterium
LRDALSYLSPAAPKIPLVSTVAYAGSAPLYS

SEQ ID NO: 835895 - protein, 19 aa, Mycobacterium
LRDAPLSVMTTWQHRHREL

SEQ ID NO: 835896 - protein, 33 aa, Mycobacterium
LRDATVRPIVRYLFDRPMLPRVNAIRVQLAVPP

SEQ ID NO: 835897 - protein, 34 aa, Mycobacterium
LRDCVPWLRWTTPDGGLFVWCELADDLSGRWDGD

SEQ ID NO: 835898 - protein, 24 aa, Mycobacterium
LRDDLEGWQRLNVCAFLASGIAAA

SEQ ID NO: 835899 - protein, 26 aa, Mycobacterium
LRDDRTMFLFIFRAPREGTIAAPKDQ

SEQ ID NO: 835900 - protein, 27 aa, Mycobacterium
LRDEALDYALRLLWAGVAAELHVFSGT

SEQ ID NO: 835901 - protein, 28 aa, Mycobacterium
LRDEAPLYYNEKFDFWALSRFAEVDSAL

SEQ ID NO: 835902 - protein, 32 aa, Mycobacterium
LRDEAPVYFNGRFGFWALSRFADVEAALRDVD

SEQ ID NO: 835903 - protein, 26 aa, Mycobacterium
LRDEGLQYYRRLLRAGVPAVGRVVAG

SEQ ID NO: 835904 - protein, 23 aa, Mycobacterium
LRDESVGFAWGTWVAALGTQPEA

SEQ ID NO: 835905 - protein, 25 aa, Mycobacterium
LRDESVGFDWAGWATALGAGTEGLA

SEQ ID NO: 835906 - protein, 19 aa, Mycobacterium
LRDFFGPAAASDWYKPLDT

SEQ ID NO: 835907 - protein, 20 aa, Mycobacterium
LRDFLLTLQQKSAHGGPFEY

SEQ ID NO: 835908 - protein, 30 aa, Mycobacterium
LRDFTHPGLDRILQWDLRFGMDVVDALGPH

SEQ ID NO: 835909 - protein, 31 aa, Mycobacterium
LRDGDHYVINGRKWWITGAADPRCKILIVMG

SEQ ID NO: 835910 - protein, 17 aa, Mycobacterium
LRDGLARGRLRFSEDFG

SEQ ID NO: 835911 - protein, 20 aa, Mycobacterium
LRDGLQLETPIALADKLKLL

SEQ ID NO: 835912 - protein, 27 aa, Mycobacterium
LRDGMTLALEPWFARTTDRIRFDRDGW

SEQ ID NO: 835913 - protein, 25 aa, Mycobacterium
LRDGRFCAHPLLARLGAPGGALRAS

SEQ ID NO: 835914 - protein, 20 aa, Mycobacterium
LRDGRHIVTAPAAEFTEDSL

SEQ ID NO: 835915 - protein, 17 aa, Mycobacterium
LRDGVVPPTLNLKNQDP

SEQ ID NO: 835916 - protein, 23 aa, Mycobacterium
LRDGWRSVKRVPLAQALKSVRRY

SEQ ID NO: 835917 - protein, 17 aa, Mycobacterium
LRDHLEILIATSAARHR

SEQ ID NO: 835918 - protein, 23 aa, Mycobacterium
LRDHNMQWDFWSLSPESAHQVTW

SEQ ID NO: 835919 - protein, 24 aa, Mycobacterium
LRDHNMQWDFWTLSPESAHQVTWL

SEQ ID NO: 835920 - protein, 18 aa, Mycobacterium
LRDLAMVLDAPVLVVTTA

SEQ ID NO: 835921 - protein, 24 aa, Mycobacterium
LRDLARTWPKLRWQQTTDPQPHEA

SEQ ID NO: 835922 - protein, 26 aa, Mycobacterium
LRDLEHFMWDPPVVKVNYALGGPVPW

SEQ ID NO: 835923 - protein, 18 aa, Mycobacterium
LRDLGSAASPFNAFLVAQ

SEQ ID NO: 835924 - protein, 18 aa, Mycobacterium
LRDLGVALPAAVLVVVGA

SEQ ID NO: 835925 - protein, 19 aa, Mycobacterium
LRDLVLLTEAVMEAGGSSG

SEQ ID NO: 835926 - protein, 17 aa, Mycobacterium
LRDLWLAIAERFISAGA

SEQ ID NO: 835927 - protein, 17 aa, Mycobacterium
LRDNAFAALVTLAPAPA

SEQ ID NO: 835928 - protein, 17 aa, Mycobacterium
LRDNLAAGRLHFTTDYD

SEQ ID NO: 835929 - protein, 23 aa, Mycobacterium
LRDPERLERLLLDPDRPVQLIVA

SEQ ID NO: 835930 - protein, 19 aa, Mycobacterium
LRDPLRLGAYQLLRTRVEP

SEQ ID NO: 835931 - protein, 24 aa, Mycobacterium
LRDPRLQRVFTFQSLYAGVSPQRA

SEQ ID NO: 835932 - protein, 47 aa, Mycobacterium
LRDQFAGLMRLPLPTLLLPTALRPALFPLWLAIRPIAGRVIQVCSAT

SEQ ID NO: 835933 - protein, 25 aa, Mycobacterium
LRDQGTWAPYLIAPVGSLARKPPEI

SEQ ID NO: 835934 - protein, 18 aa, Mycobacterium
LRDQVVEALWPPVASADD

SEQ ID NO: 835935 - protein, 21 aa, Mycobacterium
LRDRAFYAPAQSRYRIFIIDE

SEQ ID NO: 835936 - protein, 20 aa, Mycobacterium
LRDRALPVVAPWIHRGLTSQ

SEQ ID NO: 835937 - protein, 20 aa, Mycobacterium
LRDRGALSAPTPAAAIAASD

SEQ ID NO: 835938 - protein, 25 aa, Mycobacterium
LRDRGITLLIIDHNIQFVFAVSDYV

SEQ ID NO: 835939 - protein, 25 aa, Mycobacterium
LRDRHPAWRLLRAGNASLVLSFLGE

SEQ ID NO: 835940 - protein, 18 aa, Mycobacterium
LRDRILTGALPAGTRIDL

SEQ ID NO: 835941 - protein, 18 aa, Mycobacterium
LRDRLGLDSGYVTRILTR

SEQ ID NO: 835942 - protein, 20 aa, Mycobacterium
LRDRLLFATLAETGMRLGEA

SEQ ID NO: 835943 - protein, 23 aa, Mycobacterium
LRDRLPKVGALFLQGLLSELLVR

SEQ ID NO: 835944 - protein, 17 aa, Mycobacterium
LRDRLPLVAAQFAEGAV

SEQ ID NO: 835945 - protein, 24 aa, Mycobacterium
LRDRLTQLWLRSEAQRLTAERSRA

SEQ ID NO: 835946 - protein, 27 aa, Mycobacterium
LRDRNPLLKAVPPLPESRLPAPAPLAD

SEQ ID NO: 835947 - protein, 23 aa, Mycobacterium
LRDRRRLSLDLLDRWGTDLLEAL

SEQ ID NO: 835948 - protein, 18 aa, Mycobacterium
LRDRTIGAWLWSGRRAVI

SEQ ID NO: 835949 - protein, 17 aa, Mycobacterium
LRDRVHWRGWSPGPGPA

SEQ ID NO: 835950 - protein, 25 aa, Mycobacterium
LRDSEGWPLYPIRPGQTYVNIGFWS

SEQ ID NO: 835951 - protein, 24 aa, Mycobacterium
LRDSPDLLVHRYKWLQRRERADLF

SEQ ID NO: 835952 - protein, 30 aa, Mycobacterium
LRDSRWDMPYLGMQVLIEGLALAAFGVLRD

SEQ ID NO: 835953 - protein, 26 aa, Mycobacterium
LRDSVLDAMRDLLLTRDWSAITLSDV

SEQ ID NO: 835954 - protein, 23 aa, Mycobacterium
LRDTLGLLPFGEPNPRFGPVGDH

SEQ ID NO: 835955 - protein, 25 aa, Mycobacterium
LRDVASEILVFTPGSWRSEPLPGVP

SEQ ID NO: 835956 - protein, 17 aa, Mycobacterium
LRDVASGLDWTNVHVFW

SEQ ID NO: 835957 - protein, 19 aa, Mycobacterium
LRDVQLLRALAIAQLTDSG

SEQ ID NO: 835958 - protein, 24 aa, Mycobacterium
LRDWAWSGLCLPAVRLGSFCHRET

SEQ ID NO: 835959 - protein, 21 aa, Mycobacterium
LRDWLINRAIECSVPPLGAQP

SEQ ID NO: 835960 - protein, 24 aa, Mycobacterium
LRDWLMNRAIECGVPPRGPVRPSP

SEQ ID NO: 835961 - protein, 24 aa, Mycobacterium
LRDWRQWWDWAPGACWHHPFGPRR

SEQ ID NO: 835962 - protein, 17 aa, Mycobacterium
LRDYGLLLPVEPDTSLL

SEQ ID NO: 835963 - protein, 24 aa, Mycobacterium
LRDYTAGLPFLIHAVSDGAHPPAQ

SEQ ID NO: 835964 - protein, 20 aa, Mycobacterium
LREAFRDRIIPAVDRFEPEL

SEQ ID NO: 835965 - protein, 21 aa, Mycobacterium
LREALERLPLGLPGRRHIRSI

SEQ ID NO: 835966 - protein, 17 aa, Mycobacterium
LREASYRLGARTLYHQF

SEQ ID NO: 835967 - protein, 22 aa, Mycobacterium
LRECHGLQCGFCTPGFVVSITA

SEQ ID NO: 835968 - protein, 35 aa, Mycobacterium
LRECRAMVFVSTARCPMTYVLVSPEIMASVAADVH

SEQ ID NO: 835969 - protein, 19 aa, Mycobacterium
LREDALLTRLLHDSIRANI

SEQ ID NO: 835970 - protein, 21 aa, Mycobacterium
LREDIVTPVISFYVSGRIRRA

SEQ ID NO: 835971 - protein, 18 aa, Mycobacterium
LREDLDRFGKARRAHLQE

SEQ ID NO: 835972 - protein, 24 aa, Mycobacterium
LREDRPVLRHADTGRPVTWGNPAV

SEQ ID NO: 835973 - protein, 18 aa, Mycobacterium
LREELVTALIKSLPKDLR

SEQ ID NO: 835974 - protein, 19 aa, Mycobacterium
LREELVTALIKSLPKDLRR

SEQ ID NO: 835975 - protein, 21 aa, Mycobacterium
LREENPQLPVLLLTAKDAVED

SEQ ID NO: 835976 - protein, 19 aa, Mycobacterium
LREERFGLFAAFEIANTRD

SEQ ID NO: 835977 - protein, 18 aa, Mycobacterium
LREFTLFYAPNINSYKRF

SEQ ID NO: 835978 - protein, 17 aa, Mycobacterium
LREFVKPHLALYIGGMG

SEQ ID NO: 835979 - protein, 19 aa, Mycobacterium
LREFVKPHLALYIGGMGAK

SEQ ID NO: 835980 - protein, 30 aa, Mycobacterium
LREGDRYLMVNPYFHTFGYKAGLIASFIRG

SEQ ID NO: 835981 - protein, 31 aa, Mycobacterium
LREGDRYLQINPYFHTFGLKAGLVTSFLRGA

SEQ ID NO: 835982 - protein, 23 aa, Mycobacterium
LREGLACAVLRRADHRPTFDVLF

SEQ ID NO: 835983 - protein, 25 aa, Mycobacterium
LREGQRLWLSWAMANRDPAVFTDPD

SEQ ID NO: 835984 - protein, 18 aa, Mycobacterium
LREGSLDTALIALPADYG

SEQ ID NO: 835985 - protein, 17 aa, Mycobacterium
LREHITYGYAITVHSAQ

SEQ ID NO: 835986 - protein, 17 aa, Mycobacterium
LREHPRIVHRRSLVGVC

SEQ ID NO: 835987 - protein, 17 aa, Mycobacterium
LREITIELSVFGSEGRQ

SEQ ID NO: 835988 - protein, 28 aa, Mycobacterium
LRELADVIYDPWIEQTPLRIYSAEQLAE

SEQ ID NO: 835989 - protein, 19 aa, Mycobacterium
LRELCEGLLRAARAADGWR

SEQ ID NO: 835990 - protein, 25 aa, Mycobacterium
LRELFSIAMRYFALTMLHIDVRLFE

SEQ ID NO: 835991 - protein, 19 aa, Mycobacterium
LRELGELVEFYLEHLPAHL

SEQ ID NO: 835992 - protein, 19 aa, Mycobacterium
LRELKVYEFSFVPVGANQD

SEQ ID NO: 835993 - protein, 17 aa, Mycobacterium
LRELLDVPFRSAAAFID

SEQ ID NO: 835994 - protein, 18 aa, Mycobacterium
LRELLPDLPLDGFQRDGS

SEQ ID NO: 835995 - protein, 20 aa, Mycobacterium
LRELLPLRRADQDDYLRWAV

SEQ ID NO: 835996 - protein, 20 aa, Mycobacterium
LRELLPLRRADQEDYLRWAV

SEQ ID NO: 835997 - protein, 26 aa, Mycobacterium
LRELQDNLGLTYLFISHDLSVVQQLS

SEQ ID NO: 835998 - protein, 46 aa, Mycobacterium
LRELRPDLTIGFFLHIPFPPVELFMQLPWRTEIIEGLLGADLVGFH

SEQ ID NO: 835999 - protein, 18 aa, Mycobacterium
LRELWAPITRYWNDTSKV

SEQ ID NO: 836000 - protein, 21 aa, Mycobacterium
LRELWRARRILAVTVAGHGVE

SEQ ID NO: 836001 - protein, 21 aa, Mycobacterium
LREMLDRCRRFLPSLREAHLD

SEQ ID NO: 836002 - protein, 33 aa, Mycobacterium
LREMRPDLTIGFFLHIPFPPVELFMQMPWRTEI

SEQ ID NO: 836003 - protein, 24 aa, Mycobacterium
LRENGRFPVVRPSLQVAGLRLLQW

SEQ ID NO: 836004 - protein, 20 aa, Mycobacterium
LREQFPLLDRGRDALRFLHD

SEQ ID NO: 836005 - protein, 17 aa, Mycobacterium
LREQIIPPTLNFSEPDD

SEQ ID NO: 836006 - protein, 18 aa, Mycobacterium
LREQLLTGMPALRRQRVH

SEQ ID NO: 836007 - protein, 19 aa, Mycobacterium
LREQLVFGCRRGERRFRRR

SEQ ID NO: 836008 - protein, 19 aa, Mycobacterium
LRERAHLAAHWLSHGQWTD

SEQ ID NO: 836009 - protein, 17 aa, Mycobacterium
LRERLGGAGPLLAADHP

SEQ ID NO: 836010 - protein, 23 aa, Mycobacterium
LRERLLRQLSRLTSRPYSRDELT

SEQ ID NO: 836011 - protein, 18 aa, Mycobacterium
LRERLQYVEDRMAILDCV

SEQ ID NO: 836012 - protein, 19 aa, Mycobacterium
LRERLRPFNLGKGPAIRLV

SEQ ID NO: 836013 - protein, 24 aa, Mycobacterium
LRERTGIMFGPHTFRHSYATELLR

SEQ ID NO: 836014 - protein, 18 aa, Mycobacterium
LRERTGLPVVPMVGLLAR

SEQ ID NO: 836015 - protein, 27 aa, Mycobacterium
LRESNGDRYLPIWIGQSEAAAIALEQQ

SEQ ID NO: 836016 - protein, 21 aa, Mycobacterium
LRETPLQWPCPPDGASNRSPI

SEQ ID NO: 836017 - protein, 25 aa, Mycobacterium
LREVPLQTSFFLITSGTAALFSSAA

SEQ ID NO: 836018 - protein, 26 aa, Mycobacterium
LREVQDVWTWVRPYFDDRATGTAKRF

SEQ ID NO: 836019 - protein, 24 aa, Mycobacterium
LREVSLVGADLRKAVLRRADLTGS

SEQ ID NO: 836020 - protein, 37 aa, Mycobacterium
LREYPYREAYLLRDAKLFRAELKMPLILLGGITNRET

SEQ ID NO: 836021 - protein, 21 aa, Mycobacterium
LRFAFADHHVPFLWNESNPAF

SEQ ID NO: 836022 - protein, 19 aa, Mycobacterium
LRFAFASAPVPFVWNQANP

SEQ ID NO: 836023 - protein, 19 aa, Mycobacterium
LRFAPRMLGAVRERFGFDV

SEQ ID NO: 836024 - protein, 27 aa, Mycobacterium
LRFAQDMYALIPLILAERKPVELADGQ

SEQ ID NO: 836025 - protein, 19 aa, Mycobacterium
LRFDGPVNIATWRYATADI

SEQ ID NO: 836026 - protein, 20 aa, Mycobacterium
LRFDQLLRIVDVAGRFSIID

SEQ ID NO: 836027 - protein, 18 aa, Mycobacterium
LRFLGKTVTWGDLRHRVA

SEQ ID NO: 836028 - protein, 17 aa, Mycobacterium
LRFNRAMTLLNQPGHRS

SEQ ID NO: 836029 - protein, 36 aa, Mycobacterium
LRFWSQRTYARALFADDLRPLPLDAPMVVLRTHRLQ

SEQ ID NO: 836030 - protein, 18 aa, Mycobacterium
LRFYGNPAHVQVADDPLG

SEQ ID NO: 836031 - protein, 18 aa, Mycobacterium
LRGAGLRLLVPEAHLDAA

SEQ ID NO: 836032 - protein, 17 aa, Mycobacterium
LRGAPMVHPYVASKWAV

SEQ ID NO: 836033 - protein, 21 aa, Mycobacterium
LRGATLLAHNYQLPAIQDVAD

SEQ ID NO: 836034 - protein, 27 aa, Mycobacterium
LRGDARVDWYMSRPGALVSPSSLVVER

SEQ ID NO: 836035 - protein, 20 aa, Mycobacterium
LRGDRTTFLFIFRADHDDTD

SEQ ID NO: 836036 - protein, 24 aa, Mycobacterium
LRGEFLWCQLFSEPGAGSDLASLR

SEQ ID NO: 836037 - protein, 21 aa, Mycobacterium
LRGEIPQLPVLLLTAKDAVED

SEQ ID NO: 836038 - protein, 24 aa, Mycobacterium
LRGELTVYPDLEPELRQGMFATPG

SEQ ID NO: 836039 - protein, 18 aa, Mycobacterium
LRGFDPDVVHLASPALLG

SEQ ID NO: 836040 - protein, 18 aa, Mycobacterium
LRGFEMPPHHQMAMVQAL

SEQ ID NO: 836041 - protein, 32 aa, Mycobacterium
LRGFERPVLLLWPRTLPFFPFAHAERWLRLLP

SEQ ID NO: 836042 - protein, 17 aa, Mycobacterium
LRGFTTVRDLGGPVFGI

SEQ ID NO: 836043 - protein, 19 aa, Mycobacterium
LRGFYMCPVTPLTDEFELD

SEQ ID NO: 836044 - protein, 23 aa, Mycobacterium
LRGGIMIPALWASYPPYHDRRYD

SEQ ID NO: 836045 - protein, 30 aa, Mycobacterium
LRGGKRVRPAFAYWGWRSVIEPADAVAGPD

SEQ ID NO: 836046 - protein, 26 aa, Mycobacterium
LRGGPDYLMFLYNTKGPVIYGDSPVL

SEQ ID NO: 836047 - protein, 25 aa, Mycobacterium
LRGGRTMFLFIFRAEHDSVGVTPKD

SEQ ID NO: 836048 - protein, 30 aa, Mycobacterium
LRGGTFHGIQLWVNLPRKKKFTPPRYQAIE

SEQ ID NO: 836049 - protein, 23 aa, Mycobacterium
LRGHARLLKASAPLPQSVFGRDQ

SEQ ID NO: 836050 - protein, 25 aa, Mycobacterium
LRGHLGHWLPDLVAEVRRVLGLDCD

SEQ ID NO: 836051 - protein, 23 aa, Mycobacterium
LRGIARVLTFEHPELKTTLVDIE

SEQ ID NO: 836052 - protein, 22 aa, Mycobacterium
LRGKPFFDYLASEPALTEIFNQ

SEQ ID NO: 836053 - protein, 24 aa, Mycobacterium
LRGLGPRMVLPGHGPDLADIRIVA

SEQ ID NO: 836054 - protein, 18 aa, Mycobacterium
LRGLHFAELPPSQAKYVT

SEQ ID NO: 836055 - protein, 21 aa, Mycobacterium
LRGLIRVVGMEHPRLRATQID

SEQ ID NO: 836056 - protein, 37 aa, Mycobacterium
LRGLMQRLDYLQWLGIDCIWLPPFYDSPLRDGGYDIR

SEQ ID NO: 836057 - protein, 17 aa, Mycobacterium
LRGLMSHMVYADQPANP

SEQ ID NO: 836058 - protein, 29 aa, Mycobacterium
LRGLPEVFRALLALILIVLRRDTGAAGQT

SEQ ID NO: 836059 - protein, 20 aa, Mycobacterium
LRGMPFFDYLDTDPEFATVF

SEQ ID NO: 836060 - protein, 23 aa, Mycobacterium
LRGPWRDYVGWALNFEQTSGMSA

SEQ ID NO: 836061 - protein, 18 aa, Mycobacterium
LRGQGHTPLLVACDLQRP

SEQ ID NO: 836062 - protein, 24 aa, Mycobacterium
LRGQQWRHIVVDPVLICKGQEPGA

SEQ ID NO: 836063 - protein, 29 aa, Mycobacterium
LRGRHVFAVYEWVFILDASGPRQTRLRSQ

SEQ ID NO: 836064 - protein, 23 aa, Mycobacterium
LRGRPQITIVTNSLTIAADCAVD

SEQ ID NO: 836065 - protein, 18 aa, Mycobacterium
LRGRTIITMFYENSTRTR

SEQ ID NO: 836066 - protein, 19 aa, Mycobacterium
LRGRTIITMFYENSTRTRV

SEQ ID NO: 836067 - protein, 22 aa, Mycobacterium
LRGRVERFHRSALILTFGGGTN

SEQ ID NO: 836068 - protein, 34 aa, Mycobacterium
LRGRWIRMLTHCRRARLLAYRVVALQSSGRIAPG

SEQ ID NO: 836069 - protein, 21 aa, Mycobacterium
LRGRWTRMLTHCRRARLMAYR

SEQ ID NO: 836070 - protein, 19 aa, Mycobacterium
LRGSGQFVEAFRTRLKSYI

SEQ ID NO: 836071 - protein, 21 aa, Mycobacterium
LRGSRVVLRVPRRGDKRALAE

SEQ ID NO: 836072 - protein, 28 aa, Mycobacterium
LRGVASMAFLPWPLRALAGPFNLFATTG

SEQ ID NO: 836073 - protein, 19 aa, Mycobacterium
LRGVLRVFTDFRYVREIGD

SEQ ID NO: 836074 - protein, 21 aa, Mycobacterium
LRGVPRRYPRMRVILSHGGGF

SEQ ID NO: 836075 - protein, 17 aa, Mycobacterium
LRGWSTLPVTLGPARAL

SEQ ID NO: 836076 - protein, 34 aa, Mycobacterium
LRGYEETVPLFVNALRPIEWRYTNDPAWVMRDKG

SEQ ID NO: 836077 - protein, 19 aa, Mycobacterium
LRGYRIAVTSSRRAEELCA

SEQ ID NO: 836078 - protein, 19 aa, Mycobacterium
LRGYTLPNGLQLRQQRVPL

SEQ ID NO: 836079 - protein, 24 aa, Mycobacterium
LRGYTLPNGLQLRQQRVPLGVVGM

SEQ ID NO: 836080 - protein, 20 aa, Mycobacterium
LRHAVLWAPAVTDAALRRAV

SEQ ID NO: 836081 - protein, 18 aa, Mycobacterium
LRHEDGAAVLWRASFRFI

SEQ ID NO: 836082 - protein, 36 aa, Mycobacterium
LRHEPLGVVSVLTPWNFPHCLNVMKLNHALAAGNTV

SEQ ID NO: 836083 - protein, 19 aa, Mycobacterium
LRHHSYLGALVALVAAIDD

SEQ ID NO: 836084 - protein, 22 aa, Mycobacterium
LRHIADRLVAELSAAPLSPESR

SEQ ID NO: 836085 - protein, 19 aa, Mycobacterium
LRHQRQLHRLARLTTRTAE

SEQ ID NO: 836086 - protein, 23 aa, Mycobacterium
LRHRIPPVAQHVPEFGRVGGSRN

SEQ ID NO: 836087 - protein, 21 aa, Mycobacterium
LRHRTILSALGLPVSYDADAL

SEQ ID NO: 836088 - protein, 24 aa, Mycobacterium
LRHSTVLDLIDRLLAKLRGTKPGL

SEQ ID NO: 836089 - protein, 19 aa, Mycobacterium
LRHWLRTYVEFYDRYSGCI

SEQ ID NO: 836090 - protein, 19 aa, Mycobacterium
LRIAQQVAAAAWLADAVVA

SEQ ID NO: 836091 - protein, 18 aa, Mycobacterium
LRICHPIVVAAELDEFST

SEQ ID NO: 836092 - protein, 22 aa, Mycobacterium
LRIDHTNRIIYRGDAPVAGKVG

SEQ ID NO: 836093 - protein, 21 aa, Mycobacterium
LRIDLDPMPGVEWRRILDVAQ

SEQ ID NO: 836094 - protein, 17 aa, Mycobacterium
LRIELEPVKPFVALRHI

SEQ ID NO: 836095 - protein, 17 aa, Mycobacterium
LRIELVDRPGSLGSLAV

SEQ ID NO: 836096 - protein, 18 aa, Mycobacterium
LRIELVDRPGSLGSLAVA

SEQ ID NO: 836097 - protein, 22 aa, Mycobacterium
LRIGRRIVARLNWRKQGPAPKP

SEQ ID NO: 836098 - protein, 18 aa, Mycobacterium
LRIITLIDNYVLGSALDL

SEQ ID NO: 836099 - protein, 17 aa, Mycobacterium
LRILLVTPQARGLGLGR

SEQ ID NO: 836100 - protein, 20 aa, Mycobacterium
LRILTVLQGGRRMSLGEIAS

SEQ ID NO: 836101 - protein, 19 aa, Mycobacterium
LRIQRRPDGSLQHPPVPAV

SEQ ID NO: 836102 - protein, 20 aa, Mycobacterium
LRIQRRPDGSLQHPPVPAVW

SEQ ID NO: 836103 - protein, 19 aa, Mycobacterium
LRIQRRPDGTLQHPPVPAV

SEQ ID NO: 836104 - protein, 17 aa, Mycobacterium
LRIRELLTRIGDRVDGV

SEQ ID NO: 836105 - protein, 19 aa, Mycobacterium
LRKGLAASGPFLKALRKLK

SEQ ID NO: 836106 - protein, 25 aa, Mycobacterium
LRKIEPSLLAWLVRTLPAAISEHTT

SEQ ID NO: 836107 - protein, 17 aa, Mycobacterium
LRKILHLDSDGPAALDE

SEQ ID NO: 836108 - protein, 18 aa, Mycobacterium
LRKKLTPEYGFGCKRPSV

SEQ ID NO: 836109 - protein, 20 aa, Mycobacterium
LRKKRFPFSLDANAMRATTL

SEQ ID NO: 836110 - protein, 17 aa, Mycobacterium
LRKKRQKFGTIRVVPGL

SEQ ID NO: 836111 - protein, 24 aa, Mycobacterium
LRKLDDIEICGFATLLGGAGAETV

SEQ ID NO: 836112 - protein, 32 aa, Mycobacterium
LRKLVVQEWVRFGWFFLVTRRDPRGLAEWIRL

SEQ ID NO: 836113 - protein, 31 aa, Mycobacterium
LRKNLRHKGGRWYWHWDPRFIDGTAPHPPME

SEQ ID NO: 836114 - protein, 24 aa, Mycobacterium
LRKQTTMLLTYWTGGDTRNRGVQM

SEQ ID NO: 836115 - protein, 25 aa, Mycobacterium
LRKSRSEMAWAFPAVPMVVRAPAAH

SEQ ID NO: 836116 - protein, 25 aa, Mycobacterium
LRKSRSEMAWAFPAVPMVVRAPAAN

SEQ ID NO: 836117 - protein, 25 aa, Mycobacterium
LRKSRSVMAAYFPAVPMVVRAPGVD

SEQ ID NO: 836118 - protein, 17 aa, Mycobacterium
LRKTLGVPLFQEQLMQL

SEQ ID NO: 836119 - protein, 30 aa, Mycobacterium
LRKVAPLGKALRGYSAWVTGLRRGETAARA

SEQ ID NO: 836120 - protein, 27 aa, Mycobacterium
LRKVIHGRLYKLDPFRYELVDIPFKFH

SEQ ID NO: 836121 - protein, 17 aa, Mycobacterium
LRKVYAPFESGLPGPTG

SEQ ID NO: 836122 - protein, 20 aa, Mycobacterium
LRKYGDYRLPVILLTALGEE

SEQ ID NO: 836123 - protein, 21 aa, Mycobacterium
LRKYYVKVFHNVHLRRGVELT

SEQ ID NO: 836124 - protein, 18 aa, Mycobacterium
LRLALKTPLGGLLSDFML

SEQ ID NO: 836125 - protein, 19 aa, Mycobacterium
LRLAMKERDIALWLDSPMA

SEQ ID NO: 836126 - protein, 23 aa, Mycobacterium
LRLAQELTPWPAVDGQRIGAVSA

SEQ ID NO: 836127 - protein, 21 aa, Mycobacterium
LRLAVCRRLLGQWWAQHSPSA

SEQ ID NO: 836128 - protein, 40 aa, Mycobacterium
LRLDHSMVMPLSFHLGYHGLPIPGLLPGFGHVGLGGSLGW

SEQ ID NO: 836129 - protein, 17 aa, Mycobacterium
LRLDNRLPGLDAAHRDE

SEQ ID NO: 836130 - protein, 18 aa, Mycobacterium
LRLDPDAPPPYVTGTMFR

SEQ ID NO: 836131 - protein, 20 aa, Mycobacterium
LRLGAYQLLRTRVEPHAALS

SEQ ID NO: 836132 - protein, 39 aa, Mycobacterium
LRLGEFTHLLPWEIPALPPAPTVIPIPFPVPAGITKGRK

SEQ ID NO: 836133 - protein, 30 aa, Mycobacterium
LRLGEFTHLLPWEIPALPPSPTAIPIPFPV

SEQ ID NO: 836134 - protein, 19 aa, Mycobacterium
LRLGPGLPVVLGGGLLVNQ

SEQ ID NO: 836135 - protein, 21 aa, Mycobacterium
LRLHKPVIRYDLPAGGRRLDQ

SEQ ID NO: 836136 - protein, 22 aa, Mycobacterium
LRLHKPVIRYDLPAGGRRLDQT

SEQ ID NO: 836137 - protein, 19 aa, Mycobacterium
LRLHPAAMAFDLPAGGNRI

SEQ ID NO: 836138 - protein, 17 aa, Mycobacterium
LRLHVRIDERTAGFLAV

SEQ ID NO: 836139 - protein, 26 aa, Mycobacterium
LRLIPNIVVLPYRNPFLVAKSGATLD

SEQ ID NO: 836140 - protein, 27 aa, Mycobacterium
LRLIPNIVVLPYRNPFVVAKSGATLDL

SEQ ID NO: 836141 - protein, 19 aa, Mycobacterium
LRLLATLEPDVVISSAFGG

SEQ ID NO: 836142 - protein, 17 aa, Mycobacterium
LRLLGSVALARASRGED

SEQ ID NO: 836143 - protein, 18 aa, Mycobacterium
LRLLLGHPAYTDGRLTIG

SEQ ID NO: 836144 - protein, 17 aa, Mycobacterium
LRLMVPDQHWTEVLRFV

SEQ ID NO: 836145 - protein, 19 aa, Mycobacterium
LRLNDRWVKATPAFNAELC

SEQ ID NO: 836146 - protein, 23 aa, Mycobacterium
LRLNKLVNTLLDFSRIEAGRTQA

SEQ ID NO: 836147 - protein, 17 aa, Mycobacterium
LRLPAAVKQILAGYADR

SEQ ID NO: 836148 - protein, 20 aa, Mycobacterium
LRLPAVVLEVEFALDASGRS

SEQ ID NO: 836149 - protein, 20 aa, Mycobacterium
LRLPFGRLWGYDVSVSDLGR

SEQ ID NO: 836150 - protein, 33 aa, Mycobacterium
LRLPREFGGFGVDLPTLFALLAEAGQADSNLPQ

SEQ ID NO: 836151 - protein, 18 aa, Mycobacterium
LRLQKRIPYQKALELALT

SEQ ID NO: 836152 - protein, 19 aa, Mycobacterium
LRLRGRWHRGIAHLLPEDD

SEQ ID NO: 836153 - protein, 17 aa, Mycobacterium
LRLRLDAAGLAGAASRL

SEQ ID NO: 836154 - protein, 26 aa, Mycobacterium
LRLRTSMKWRAHPADVLPLWVAEMDV

SEQ ID NO: 836155 - protein, 20 aa, Mycobacterium
LRLRVGFAFGRAISRSGDWY

SEQ ID NO: 836156 - protein, 18 aa, Mycobacterium
LRLTYHLLGATSLERAVL

SEQ ID NO: 836157 - protein, 19 aa, Mycobacterium
LRLVIGRRGGLADQESAGK

SEQ ID NO: 836158 - protein, 27 aa, Mycobacterium
LRLVPNIVVLPYRNPFVVAKSGATLDL

SEQ ID NO: 836159 - protein, 26 aa, Mycobacterium
LRLVSRAREMLWLNRFRWNRCTTGDT

SEQ ID NO: 836160 - protein, 26 aa, Mycobacterium
LRLVTRAREMLWANRLRWNRTTTGDT

SEQ ID NO: 836161 - protein, 28 aa, Mycobacterium
LRLVVVRELLQMRRPLTDLPPVPDTPGV

SEQ ID NO: 836162 - protein, 17 aa, Mycobacterium
LRLYERRGLLAPSRTDG

SEQ ID NO: 836163 - protein, 28 aa, Mycobacterium
LRMGDNDFRLLWQGGLHRWSPQGYTGVI

SEQ ID NO: 836164 - protein, 20 aa, Mycobacterium
LRMLRVGDRPLALLRAVRGI

SEQ ID NO: 836165 - protein, 17 aa, Mycobacterium
LRMLTLPATFGLYVERA

SEQ ID NO: 836166 - protein, 19 aa, Mycobacterium
LRMNGYNTALFGKAHFTPT

SEQ ID NO: 836167 - protein, 27 aa, Mycobacterium
LRMPEVWGIRLEGELPQWCSAKDVILE

SEQ ID NO: 836168 - protein, 17 aa, Mycobacterium
LRMQPWDRDQIHRLFDD

SEQ ID NO: 836169 - protein, 17 aa, Mycobacterium
LRMQPWNRDQIHRLFDD

SEQ ID NO: 836170 - protein, 28 aa, Mycobacterium
LRMRHAPFRIGFLERDAWLRCMHTAVAE

SEQ ID NO: 836171 - protein, 27 aa, Mycobacterium
LRMRHAPFRIGYLERDAWLRCMHTAVA

SEQ ID NO: 836172 - protein, 18 aa, Mycobacterium
LRMTTAPVQRTWPELIPL

SEQ ID NO: 836173 - protein, 32 aa, Mycobacterium
LRNAEIFYGRWGWWPMEGWLSSFADQGLIRRD

SEQ ID NO: 836174 - protein, 19 aa, Mycobacterium
LRNAELAHIFTKDAKAFGI

SEQ ID NO: 836175 - protein, 19 aa, Mycobacterium
LRNAELAHIFTKEAKTFGI

SEQ ID NO: 836176 - protein, 28 aa, Mycobacterium
LRNDGRIKFILFRHEQAAGFAAAAYGRL

SEQ ID NO: 836177 - protein, 35 aa, Mycobacterium
LRNEGITSMHFVPSLLGLFLSLPGVNEWRTLQRVP

SEQ ID NO: 836178 - protein, 20 aa, Mycobacterium
LRNFNLRIARGETVALLGPS

SEQ ID NO: 836179 - protein, 25 aa, Mycobacterium
LRNGALNPNAFRRKPMDEDAILNSP

SEQ ID NO: 836180 - protein, 19 aa, Mycobacterium
LRNGGVVLQLLTFAGYPAR

SEQ ID NO: 836181 - protein, 19 aa, Mycobacterium
LRNHARWAVFLRNLRYVVV

SEQ ID NO: 836182 - protein, 19 aa, Mycobacterium
LRNHGLHIEILIDPSSPVG

SEQ ID NO: 836183 - protein, 25 aa, Mycobacterium
LRNHSRWAVFLRNLRYIVVDECHYY

SEQ ID NO: 836184 - protein, 21 aa, Mycobacterium
LRNHYEGWLSQVALAVMAAEN

SEQ ID NO: 836185 - protein, 25 aa, Mycobacterium
LRNKMAYSHSGYPGGLRKRSIGELM

SEQ ID NO: 836186 - protein, 20 aa, Mycobacterium
LRNLCDLGMGLLSGASVSDG

SEQ ID NO: 836187 - protein, 17 aa, Mycobacterium
LRNLFKLSSLASFEGQL

SEQ ID NO: 836188 - protein, 23 aa, Mycobacterium
LRNLFKLSSLASFEGQLGKWARM

SEQ ID NO: 836189 - protein, 18 aa, Mycobacterium
LRNLHIPEYLHGTWTNHE

SEQ ID NO: 836190 - protein, 21 aa, Mycobacterium
LRNMLYADSPALRGLSYVVMD

SEQ ID NO: 836191 - protein, 18 aa, Mycobacterium
LRNPNPHIAFGGGGPHFC

SEQ ID NO: 836192 - protein, 24 aa, Mycobacterium
LRNRDQWDLLQRDPSLLPSAVEEM

SEQ ID NO: 836193 - protein, 27 aa, Mycobacterium
LRNRLKIISGLALPPTLIVDHPTPQLL

SEQ ID NO: 836194 - protein, 24 aa, Mycobacterium
LRNSHPLARALPVIRRLLVDHAAD

SEQ ID NO: 836195 - protein, 19 aa, Mycobacterium
LRNSPDAVLLMLAIVKCGA

SEQ ID NO: 836196 - protein, 21 aa, Mycobacterium
LRNSRGRLRRWGAAAGRLLRR

SEQ ID NO: 836197 - protein, 18 aa, Mycobacterium
LRNTLFLTTTQEGLLRAA

SEQ ID NO: 836198 - protein, 17 aa, Mycobacterium
LRNVRVLSRYSATPTSP

SEQ ID NO: 836199 - protein, 24 aa, Mycobacterium
LRNWVESLLQMHLMDGYGSTEAGM

SEQ ID NO: 836200 - protein, 19 aa, Mycobacterium
LRPADTVRRAGVCLGPAVG

SEQ ID NO: 836201 - protein, 30 aa, Mycobacterium
LRPASHYSLGWLPRWAKLGSAVPRLANRAA

SEQ ID NO: 836202 - protein, 25 aa, Mycobacterium
LRPDRNLFVPMAFHLGYHSFPIGNL

SEQ ID NO: 836203 - protein, 23 aa, Mycobacterium
LRPDVLLTRLVRRDGLLHFSTEV

SEQ ID NO: 836204 - protein, 23 aa, Mycobacterium
LRPEFRKFAQPLRWFGTSEDRVP

SEQ ID NO: 836205 - protein, 20 aa, Mycobacterium
LRPELLVTGHFDPIAGADRI

SEQ ID NO: 836206 - protein, 22 aa, Mycobacterium
LRPFEDGGWIWFDITTDTEVNL

SEQ ID NO: 836207 - protein, 17 aa, Mycobacterium
LRPFTDDSDFLVAILRP

SEQ ID NO: 836208 - protein, 20 aa, Mycobacterium
LRPGFTAFGQTRWPLDRQAQ

SEQ ID NO: 836209 - protein, 28 aa, Mycobacterium
LRPGQKLRIVKYLAYGWSSLRSRPALRD

SEQ ID NO: 836210 - protein, 18 aa, Mycobacterium
LRPGSLQALLPPEQRARP

SEQ ID NO: 836211 - protein, 18 aa, Mycobacterium
LRPGTPMRDIAVDTVFVG

SEQ ID NO: 836212 - protein, 25 aa, Mycobacterium
LRPHKPAPSAGWRKTVYRASFGTIN

SEQ ID NO: 836213 - protein, 23 aa, Mycobacterium
LRPHRPGFGNVERPAAGAVALDP

SEQ ID NO: 836214 - protein, 23 aa, Mycobacterium
LRPKLDAALLLHELTQDLDLSAF

SEQ ID NO: 836215 - protein, 25 aa, Mycobacterium
LRPLEPLLGTWVGRGAGEYPTIEPF

SEQ ID NO: 836216 - protein, 17 aa, Mycobacterium
LRPLGVFRAAAANEPGF

SEQ ID NO: 836217 - protein, 19 aa, Mycobacterium
LRPLRAKFGFVFQDPATAL

SEQ ID NO: 836218 - protein, 17 aa, Mycobacterium
LRPLRSAEISDGTLRFL

SEQ ID NO: 836219 - protein, 37 aa, Mycobacterium
LRPLTLSAPKPMLPTAGLPFLTHLLSRVAAAGIEHVI

SEQ ID NO: 836220 - protein, 19 aa, Mycobacterium
LRPLYTPEELYPLTGVKSL

SEQ ID NO: 836221 - protein, 30 aa, Mycobacterium
LRPMLTHTFGLARWRDAFWALADQGESGAV

SEQ ID NO: 836222 - protein, 22 aa, Mycobacterium
LRPNHAFRLPGGHVPIIMIGPG

SEQ ID NO: 836223 - protein, 19 aa, Mycobacterium
LRPPSLLAVEPPDHTRYRK

SEQ ID NO: 836224 - protein, 25 aa, Mycobacterium
LRPQDGGTQLWFTLSGFDPESPLNR

SEQ ID NO: 836225 - protein, 27 aa, Mycobacterium
LRPQGQALVFWDCYRPHDVQVKMFQVV

SEQ ID NO: 836226 - protein, 21 aa, Mycobacterium
LRPRALRRRRIDAVGHRARAA

SEQ ID NO: 836227 - protein, 25 aa, Mycobacterium
LRPRGLLGQVYAATVWPLRRRMLHR

SEQ ID NO: 836228 - protein, 25 aa, Mycobacterium
LRPRPPALLEPYDLARQFRILRALG

SEQ ID NO: 836229 - protein, 20 aa, Mycobacterium
LRPVAARLPLPCRLGATLIF

SEQ ID NO: 836230 - protein, 27 aa, Mycobacterium
LRPVRVDTWGGWLWINMDPDCEPLADY

SEQ ID NO: 836231 - protein, 28 aa, Mycobacterium
LRPVRVDTWGGWLWINMDPDCEPLADYL

SEQ ID NO: 836232 - protein, 19 aa, Mycobacterium
LRPWANWITPEAEPRRYDT

SEQ ID NO: 836233 - protein, 19 aa, Mycobacterium
LRQALSNFSAWVTGLRRVE

SEQ ID NO: 836234 - protein, 17 aa, Mycobacterium
LRQCLFIRKSVLRRLSL

SEQ ID NO: 836235 - protein, 25 aa, Mycobacterium
LRQGEKMILLFESANFDEKVFDDPE

SEQ ID NO: 836236 - protein, 18 aa, Mycobacterium
LRQKDPAVTARRRLRMIC

SEQ ID NO: 836237 - protein, 22 aa, Mycobacterium
LRQKNPAVTARRKLRMICHGIG

SEQ ID NO: 836238 - protein, 25 aa, Mycobacterium
LRQKNPAVTARRKLRMICHGIGYTE

SEQ ID NO: 836239 - protein, 32 aa, Mycobacterium
LRQKRLMDVIHLWLIHRFKAEIVYYVTPTEDN

SEQ ID NO: 836240 - protein, 18 aa, Mycobacterium
LRQMLGTANFRAGPALAF

SEQ ID NO: 836241 - protein, 17 aa, Mycobacterium
LRQQPVVMAPRTTFLPF

SEQ ID NO: 836242 - protein, 19 aa, Mycobacterium
LRQRAALIDHRRAKPASAG

SEQ ID NO: 836243 - protein, 20 aa, Mycobacterium
LRQRLDDLPVLYELAAEEDA

SEQ ID NO: 836244 - protein, 28 aa, Mycobacterium
LRQRSDGRWIWRWDPAFISSNFDVLQGN

SEQ ID NO: 836245 - protein, 18 aa, Mycobacterium
LRQSPIPIALGERLFSRW

SEQ ID NO: 836246 - protein, 26 aa, Mycobacterium
LRQVARALEPPLLDAGGHIVKRMGDG

SEQ ID NO: 836247 - protein, 20 aa, Mycobacterium
LRQVARAVEPPLLDAGGHIV

SEQ ID NO: 836248 - protein, 21 aa, Mycobacterium
LRQVGIKIWVDGSPWIGNIDL

SEQ ID NO: 836249 - protein, 23 aa, Mycobacterium
LRQVGIKIWVDGSPWIGNIDLSF

SEQ ID NO: 836250 - protein, 17 aa, Mycobacterium
LRQVGIKIWVDGSPWVG

SEQ ID NO: 836251 - protein, 17 aa, Mycobacterium
LRQVGIKIWVDGSPYVG

SEQ ID NO: 836252 - protein, 28 aa, Mycobacterium
LRQVGQTYRLLLLPPGSEMQIVRPIARP

SEQ ID NO: 836253 - protein, 20 aa, Mycobacterium
LRQYGIASNALWPRTTIDTA

SEQ ID NO: 836254 - protein, 18 aa, Mycobacterium
LRQYLLEQNALPDAPLVA

SEQ ID NO: 836255 - protein, 31 aa, Mycobacterium
LRRAARYGSGWWPFLTPPERIAERLDYLKSQ

SEQ ID NO: 836256 - protein, 20 aa, Mycobacterium
LRRAERLSQLLVARGVPRAT

SEQ ID NO: 836257 - protein, 18 aa, Mycobacterium
LRRAIPAELLGSRTFDAA

SEQ ID NO: 836258 - protein, 17 aa, Mycobacterium
LRRALEHRQRTCAVPGC

SEQ ID NO: 836259 - protein, 21 aa, Mycobacterium
LRRANEILKTASAFFAAAEVD

SEQ ID NO: 836260 - protein, 18 aa, Mycobacterium
LRRARPSRGWARQLRRSR

SEQ ID NO: 836261 - protein, 17 aa, Mycobacterium
LRRAVARLPLRLVYPDG

SEQ ID NO: 836262 - protein, 22 aa, Mycobacterium
LRRAVRLLAQLTRQVAVVQYPM

SEQ ID NO: 836263 - protein, 20 aa, Mycobacterium
LRRAVTFDAFLDGIDAVRRI

SEQ ID NO: 836264 - protein, 31 aa, Mycobacterium
LRRCSHRPLLERIWALRRTVTPYDAAYAALA

SEQ ID NO: 836265 - protein, 24 aa, Mycobacterium
LRRDELLLYLTVIATAGSETTTRA

SEQ ID NO: 836266 - protein, 18 aa, Mycobacterium
LRRDPRVSILLSPPDEPY

SEQ ID NO: 836267 - protein, 25 aa, Mycobacterium
LRREPGEWYVIHSYAGYENKVKANL

SEQ ID NO: 836268 - protein, 23 aa, Mycobacterium
LRRGQLAQFWMAGPNWLEALTRY

SEQ ID NO: 836269 - protein, 18 aa, Mycobacterium
LRRHGPVTVYGIDKFPRM

SEQ ID NO: 836270 - protein, 18 aa, Mycobacterium
LRRHGPVTVYGVDKFPRM

SEQ ID NO: 836271 - protein, 17 aa, Mycobacterium
LRRHYAGLEWPTPRAET

SEQ ID NO: 836272 - protein, 18 aa, Mycobacterium
LRRHYPVRFLRSTASSRP

SEQ ID NO: 836273 - protein, 18 aa, Mycobacterium
LRRIAVFDVLINNADRKG

SEQ ID NO: 836274 - protein, 19 aa, Mycobacterium
LRRIDMRGASLSPSHLRAA

SEQ ID NO: 836275 - protein, 26 aa, Mycobacterium
LRRIDPAKIVWFTQALPEAAAEYRRR

SEQ ID NO: 836276 - protein, 20 aa, Mycobacterium
LRRKRYDERLFLERYVRIRA

SEQ ID NO: 836277 - protein, 23 aa, Mycobacterium
LRRKWGDALYLKFGEPIPVTSLL

SEQ ID NO: 836278 - protein, 25 aa, Mycobacterium
LRRLAGIAWPHIDWSPHGRHPHLAV

SEQ ID NO: 836279 - protein, 18 aa, Mycobacterium
LRRLEGHFTLVFANADDP

SEQ ID NO: 836280 - protein, 24 aa, Mycobacterium
LRRLELTQPLFRPSTKRIRDIAAR

SEQ ID NO: 836281 - protein, 17 aa, Mycobacterium
LRRLISSAMIRTTRAQA

SEQ ID NO: 836282 - protein, 18 aa, Mycobacterium
LRRLLLKGDGPETAALAP

SEQ ID NO: 836283 - protein, 19 aa, Mycobacterium
LRRLLRLCARYSSAPTVIF

SEQ ID NO: 836284 - protein, 36 aa, Mycobacterium
LRRLLYCGEWIHSHVLHVYLLHAPDFLGCPDVIALA

SEQ ID NO: 836285 - protein, 17 aa, Mycobacterium
LRRLRADLDGRLLVTRG

SEQ ID NO: 836286 - protein, 19 aa, Mycobacterium
LRRLTTLVGEYEAVEVVIG

SEQ ID NO: 836287 - protein, 24 aa, Mycobacterium
LRRLWRARRVLAVTFPTRSEAADV

SEQ ID NO: 836288 - protein, 17 aa, Mycobacterium
LRRMGLEATVRPSFAFY

SEQ ID NO: 836289 - protein, 25 aa, Mycobacterium
LRRMGYLQKMSTILSRRVWENAGSP

SEQ ID NO: 836290 - protein, 24 aa, Mycobacterium
LRRNLDRLVAGFDPTEHWPRYCYS

SEQ ID NO: 836291 - protein, 35 aa, Mycobacterium
LRRNPHLFDASYTRWGPIQWVPPETFVTLGEHLRG

SEQ ID NO: 836292 - protein, 17 aa, Mycobacterium
LRRNSIDADWLLDYWTD

SEQ ID NO: 836293 - protein, 35 aa, Mycobacterium
LRRPDLLVSMLTYWQRHPALSYLFAGRFIGTTSQS

SEQ ID NO: 836294 - protein, 28 aa, Mycobacterium
LRRPGRFDRMIFVPLPDPDARAAIVRLH

SEQ ID NO: 836295 - protein, 17 aa, Mycobacterium
LRRPQFSFPARGILTSR

SEQ ID NO: 836296 - protein, 18 aa, Mycobacterium
LRRPVTVARLQALAHPAR

SEQ ID NO: 836297 - protein, 17 aa, Mycobacterium
LRRQIAVLSGKPAGKAV

SEQ ID NO: 836298 - protein, 17 aa, Mycobacterium
LRRQLACALGQLRDDTG

SEQ ID NO: 836299 - protein, 19 aa, Mycobacterium
LRRQPLPLSLLATHPIDLS

SEQ ID NO: 836300 - protein, 28 aa, Mycobacterium
LRRQVKDSWLRRQLTPHFRPGCKRMLMT

SEQ ID NO: 836301 - protein, 19 aa, Mycobacterium
LRRQVLAHDVDRWARAFLE

SEQ ID NO: 836302 - protein, 18 aa, Mycobacterium
LRRQVLAHDVDRWARSFL

SEQ ID NO: 836303 - protein, 17 aa, Mycobacterium
LRRRGAGACAVLLDPER

SEQ ID NO: 836304 - protein, 17 aa, Mycobacterium
LRRRHVVPEPPYGQGAA

SEQ ID NO: 836305 - protein, 21 aa, Mycobacterium
LRRRKLLTPPLHGTALGRYVP

SEQ ID NO: 836306 - protein, 18 aa, Mycobacterium
LRRRKLLVPPFHGRRMAG

SEQ ID NO: 836307 - protein, 23 aa, Mycobacterium
LRRRLARVGLGPKLLRARPDGDE

SEQ ID NO: 836308 - protein, 18 aa, Mycobacterium
LRRRLRASQTFEPAGLAG

SEQ ID NO: 836309 - protein, 17 aa, Mycobacterium
LRRRPGLLKSPTTSRLM

SEQ ID NO: 836310 - protein, 20 aa, Mycobacterium
LRRRRPEPGLDPKMLFLLAT

SEQ ID NO: 836311 - protein, 31 aa, Mycobacterium
LRRRRPEPGLDPKMLFLLATAKLNQAERFGV

SEQ ID NO: 836312 - protein, 17 aa, Mycobacterium
LRRRSTHEALRRAALKS

SEQ ID NO: 836313 - protein, 18 aa, Mycobacterium
LRRRTGGSDAGWHLKLPA

SEQ ID NO: 836314 - protein, 19 aa, Mycobacterium
LRRSLRRLFTRVGDEMLVL

SEQ ID NO: 836315 - protein, 19 aa, Mycobacterium
LRRSPCDLGFSVLGPTSHS

SEQ ID NO: 836316 - protein, 20 aa, Mycobacterium
LRRSYPFYGQAHQGGIDTPP

SEQ ID NO: 836317 - protein, 23 aa, Mycobacterium
LRRTAPIWWNEQPIGAGGFDDGG

SEQ ID NO: 836318 - protein, 18 aa, Mycobacterium
LRRTFWFCSIDDPHAFGA

SEQ ID NO: 836319 - protein, 17 aa, Mycobacterium
LRRVAEWGDGWYGFDLA

SEQ ID NO: 836320 - protein, 18 aa, Mycobacterium
LRRVAFIRMSQRLGIPLS

SEQ ID NO: 836321 - protein, 17 aa, Mycobacterium
LRRVAPHALSMLRGFNL

SEQ ID NO: 836322 - protein, 19 aa, Mycobacterium
LRRVARAVEPPLLDAGGHI

SEQ ID NO: 836323 - protein, 22 aa, Mycobacterium
LRRVDTRRIGFLRELLGAVCED

SEQ ID NO: 836324 - protein, 20 aa, Mycobacterium
LRRVFRPFIVKRILEIAAVV

SEQ ID NO: 836325 - protein, 25 aa, Mycobacterium
LRRVGWKHGAWHDVQWWQLDLVACE

SEQ ID NO: 836326 - protein, 18 aa, Mycobacterium
LRRVRRTRLSAEDIDLIA

SEQ ID NO: 836327 - protein, 19 aa, Mycobacterium
LRRVTRYTFLPTTGKTPSL

SEQ ID NO: 836328 - protein, 19 aa, Mycobacterium
LRRWEDSGAVWRVVGRTSS

SEQ ID NO: 836329 - protein, 18 aa, Mycobacterium
LRRWPRVQSWADIPLDEQ

SEQ ID NO: 836330 - protein, 21 aa, Mycobacterium
LRRWRSAARSAARQSRRAHIP

SEQ ID NO: 836331 - protein, 27 aa, Mycobacterium
LRRYDDLYEHELRWWTAPDRHDDGIPE

SEQ ID NO: 836332 - protein, 22 aa, Mycobacterium
LRRYDEFYHRELQWWTANVRHS

SEQ ID NO: 836333 - protein, 18 aa, Mycobacterium
LRRYLLEETYELFDAVRS

SEQ ID NO: 836334 - protein, 26 aa, Mycobacterium
LRSAAALRWAISPWAQSQVPLLEAAG

SEQ ID NO: 836335 - protein, 32 aa, Mycobacterium; identical to SEQ ID NO: 121214

SEQ ID NO: 836336 - protein, 25 aa, Mycobacterium
LRSAGRARLRVRPGLPRAAGDVAAG

SEQ ID NO: 836337 - protein, 32 aa, Mycobacterium
LRSAHPLAPVLPLIRRLLIDDAADSGVIVAVT

SEQ ID NO: 836338 - protein, 18 aa, Mycobacterium
LRSALDEGQIVLVAGFQG

SEQ ID NO: 836339 - protein, 26 aa, Mycobacterium
LRSAQPLWALWRFSTAPEATRLTMEF

SEQ ID NO: 836340 - protein, 26 aa, Mycobacterium
LRSDDFRVLVFGANLPGPLKWLERHT

SEQ ID NO: 836341 - protein, 19 aa, Mycobacterium
LRSDMLASLRRWTGGSIPD

SEQ ID NO: 836342 - protein, 26 aa, Mycobacterium
LRSEEVPVVVLLWSPRSDACVQLLDT

SEQ ID NO: 836343 - protein, 26 aa, Mycobacterium
LRSEEVPVVVLLWSPRSDACVQLVDI

SEQ ID NO: 836344 - protein, 25 aa, Mycobacterium
LRSELDIVPPGDLRMALAALASDSP

SEQ ID NO: 836345 - protein, 18 aa, Mycobacterium
LRSFQQASLLPGSARRRR

SEQ ID NO: 836346 - protein, 27 aa, Mycobacterium
LRSFVDYRKLLAIPELQNAPLGQPATD

SEQ ID NO: 836347 - protein, 23 aa, Mycobacterium
LRSGLAQLFSVPDGYEVILGNGG

SEQ ID NO: 836348 - protein, 19 aa, Mycobacterium
LRSGPDDLFWLGTNEALEQ

SEQ ID NO: 836349 - protein, 18 aa, Mycobacterium
LRSGQFYLALEGNAFHKI

SEQ ID NO: 836350 - protein, 30 aa, Mycobacterium
LRSHPNLTLPDLELIFAPAPFFDEGIGVAT

SEQ ID NO: 836351 - protein, 21 aa, Mycobacterium
LRSIEIGEDLLRMLTGIDVVR

SEQ ID NO: 836352 - protein, 18 aa, Mycobacterium
LRSLKVGIRATWGKVSGK

SEQ ID NO: 836353 - protein, 20 aa, Mycobacterium
LRSLLRDYQDSFGLPDEGWV

SEQ ID NO: 836354 - protein, 19 aa, Mycobacterium
LRSLRFEQRWLVVDVATDS

SEQ ID NO: 836355 - protein, 17 aa, Mycobacterium
LRSMRSPMPLPELQRRA

SEQ ID NO: 836356 - protein, 23 aa, Mycobacterium
LRSNFLIAPLSNGHVRLVVDLAR

SEQ ID NO: 836357 - protein, 31 aa, Mycobacterium; identical to SEQ ID NO: 129110

SEQ ID NO: 836358 - protein, 20 aa, Mycobacterium
LRSPLILVPVSLSTSNRGQS

SEQ ID NO: 836359 - protein, 23 aa, Mycobacterium
LRSRGTLALLGLGALTAELPVAL

SEQ ID NO: 836360 - protein, 22 aa, Mycobacterium
LRSRPGWYAVGLDTGNRRLAHL

SEQ ID NO: 836361 - protein, 17 aa, Mycobacterium
LRSSLDILIALTPKVLF

SEQ ID NO: 836362 - protein, 26 aa, Mycobacterium
LRSTGRPPFLLDSHRPRLALADYRDR

SEQ ID NO: 836363 - protein, 28 aa, Mycobacterium
LRSVATWLRTMFAIMPLPVGTRDQDLPD

SEQ ID NO: 836364 - protein, 24 aa, Mycobacterium
LRSYATKHPCHGFRRAWAALRYDE

SEQ ID NO: 836365 - protein, 26 aa, Mycobacterium
LRSYSRYLRQLPLPYGQGRIQQVLLD

SEQ ID NO: 836366 - protein, 21 aa, Mycobacterium
LRTAELYPRLGEMLTEMLCEM

SEQ ID NO: 836367 - protein, 26 aa, Mycobacterium
LRTASLRVNYLRQFFGGAHARYEGAA

SEQ ID NO: 836368 - protein, 20 aa, Mycobacterium
LRTATLRMVLAAIQTEEVSG

SEQ ID NO: 836369 - protein, 28 aa, Mycobacterium
LRTDIPCSFVLTMLRDPALPLLERVDEQ

SEQ ID NO: 836370 - protein, 27 aa, Mycobacterium
LRTDSRGLFFEWFTDAGFTEFAGHQFD

SEQ ID NO: 836371 - protein, 19 aa, Mycobacterium
LRTEHLRVLQSHPNAVGLS

SEQ ID NO: 836372 - protein, 19 aa, Mycobacterium
LRTFLREHGHFEVKMGCDA

SEQ ID NO: 836373 - protein, 17 aa, Mycobacterium
LRTGQPLGPVPLVEEAE

SEQ ID NO: 836374 - protein, 27 aa, Mycobacterium
LRTGRHHMLVGALPFDTSRPVALTAPV

SEQ ID NO: 836375 - protein, 19 aa, Mycobacterium
LRTILRELPAVRGVVHAAG

SEQ ID NO: 836376 - protein, 21 aa, Mycobacterium
LRTLEERLAYLRELDARREAV

SEQ ID NO: 836377 - protein, 19 aa, Mycobacterium
LRTLPTRFSTAWDVQAAEN

SEQ ID NO: 836378 - protein, 45 aa, Mycobacterium
LRTMRPDLTIGFFLHIPFPPVELFMQLPWRTEIIQGLLGADLVGF

SEQ ID NO: 836379 - protein, 19 aa, Mycobacterium
LRTNLAAVILQMAALGFGD

SEQ ID NO: 836380 - protein, 17 aa, Mycobacterium
LRTPLVLPASGSVAVQV

SEQ ID NO: 836381 - protein, 20 aa, Mycobacterium
LRTRARARLTPREQEILALL

SEQ ID NO: 836382 - protein, 30 aa, Mycobacterium
LRTRDRLDWTILRPGLLTDTAPTGSVTLSA

SEQ ID NO: 836383 - protein, 23 aa, Mycobacterium
LRTSGLEDLPAWQYERYTGVVAD

SEQ ID NO: 836384 - protein, 17 aa, Mycobacterium
LRTVLVTNQRWLSERAA

SEQ ID NO: 836385 - protein, 18 aa, Mycobacterium
LRTWGDPENPPLVFVHGG

SEQ ID NO: 836386 - protein, 18 aa, Mycobacterium
LRTYVRVPYRARVPMTRA

SEQ ID NO: 836387 - protein, 17 aa, Mycobacterium
LRVALAAAGWRARISRF

SEQ ID NO: 836388 - protein, 28 aa, Mycobacterium
LRVALAGAGPLDRMRLLRAAVVVALARD

SEQ ID NO: 836389 - protein, 27 aa, Mycobacterium
LRVANRAQQMLWLNRLRVNRTTTGNTR

SEQ ID NO: 836390 - protein, 17 aa, Mycobacterium
LRVARPNPVLLGGLQVQ

SEQ ID NO: 836391 - protein, 17 aa, Mycobacterium
LRVARRLRAGFIGLNGT

SEQ ID NO: 836392 - protein, 18 aa, Mycobacterium
LRVATAWEFDLYGGTVLL

SEQ ID NO: 836393 - protein, 18 aa, Mycobacterium
LRVATLLGGLRPPLTRSA

SEQ ID NO: 836394 - protein, 17 aa, Mycobacterium
LRVEALFHALWANTDSS

SEQ ID NO: 836395 - protein, 21 aa, Mycobacterium
LRVERLIARHVEFGKTAAAAR

SEQ ID NO: 836396 - protein, 18 aa, Mycobacterium
LRVFELHPLFNPTGYVVA

SEQ ID NO: 836397 - protein, 24 aa, Mycobacterium
LRVFHWSHPEWSKLNSILGTAEVD

SEQ ID NO: 836398 - protein, 33 aa, Mycobacterium
LRVFLDGAVAKWWIPERWAFIAEVPRTSVGKYD

SEQ ID NO: 836399 - protein, 23 aa, Mycobacterium
LRVGDWVLVHVGFAMAKIDEREA

SEQ ID NO: 836400 - protein, 29 aa, Mycobacterium
LRVGGMLFSAGYPGFLRGVAALGSGEFAV

SEQ ID NO: 836401 - protein, 23 aa, Mycobacterium
LRVGHLVLCDAFRHPAVLAKQAV

SEQ ID NO: 836402 - protein, 20 aa, Mycobacterium
LRVGMPVTAVFRPVDDTDPD

SEQ ID NO: 836403 - protein, 27 aa, Mycobacterium
LRVGTFVLNSAFYRPALLARDVAALND

SEQ ID NO: 836404 - protein, 17 aa, Mycobacterium
LRVGVVEDLPWMATQDR

SEQ ID NO: 836405 - protein, 19 aa, Mycobacterium
LRVHDDPDWLLDLVTRLTD

SEQ ID NO: 836406 - protein, 17 aa, Mycobacterium
LRVHRRARAAELLRSVM

SEQ ID NO: 836407 - protein, 20 aa, Mycobacterium
LRVIDLTAFWAGPAATHLLA

SEQ ID NO: 836408 - protein, 18 aa, Mycobacterium
LRVIMRLRERMGVTLQMR

SEQ ID NO: 836409 - protein, 24 aa, Mycobacterium
LRVIMRVRERMGVVLQMRDFVSAG

SEQ ID NO: 836410 - protein, 19 aa, Mycobacterium
LRVIRPLCPVSISGADFSQ

SEQ ID NO: 836411 - protein, 17 aa, Mycobacterium
LRVKRRRTERERLQAQP

SEQ ID NO: 836412 - protein, 25 aa, Mycobacterium
LRVLAPLGLIFDEDSAWLSVSACTG

SEQ ID NO: 836413 - protein, 18 aa, Mycobacterium
LRVLAPLGLVFDERSPWL

SEQ ID NO: 836414 - protein, 18 aa, Mycobacterium
LRVLAPMGLVFDENSPWL

SEQ ID NO: 836415 - protein, 19 aa, Mycobacterium
LRVLGKHGALTPALATLGF

SEQ ID NO: 836416 - protein, 22 aa, Mycobacterium
LRVLPLPYSLALRLRDAGVAPD

SEQ ID NO: 836417 - protein, 23 aa, Mycobacterium
LRVNVYRPPGSGPFPVILAAHPY

SEQ ID NO: 836418 - protein, 25 aa, Mycobacterium
LRVPPAHFVPRFDIGMGIVALDQPI

SEQ ID NO: 836419 - protein, 19 aa, Mycobacterium
LRVPTERWVYPQTGTEAHD

SEQ ID NO: 836420 - protein, 25 aa, Mycobacterium
LRVQGPLIHGFYNMAGLGGAPSEAM

SEQ ID NO: 836421 - protein, 20 aa, Mycobacterium
LRVQVLPRGTAWLDTGTFDQ

SEQ ID NO: 836422 - protein, 20 aa, Mycobacterium
LRVRLADRALVQTNPLLAVA

SEQ ID NO: 836423 - protein, 34 aa, Mycobacterium
LRVRLHPVPHLATGVLMFPWEQAADVMRRYDALA

SEQ ID NO: 836424 - protein, 17 aa, Mycobacterium
LRVRSVLRRTSGLTTPA

SEQ ID NO: 836425 - protein, 17 aa, Mycobacterium
LRVRWVPQRVLQGVSYD

SEQ ID NO: 836426 - protein, 25 aa, Mycobacterium
LRVSDLAHLLRLPGPYERDIVRGAY

SEQ ID NO: 836427 - protein, 17 aa, Mycobacterium
LRVSKEMKVPAYVVFTD

SEQ ID NO: 836428 - protein, 32 aa, Mycobacterium
LRVSNGRWQLSWRLPWIFTCQVHSCLLVDVCP

SEQ ID NO: 836429 - protein, 19 aa, Mycobacterium
LRVSTWPPGPTYDPNTWTT

SEQ ID NO: 836430 - protein, 18 aa, Mycobacterium
LRVTPKTRVLIAPFDHVI

SEQ ID NO: 836431 - protein, 37 aa, Mycobacterium
LRVTRDQKWKPHNLLNLVYNTMLCIFFEWGVGLQHLE

SEQ ID NO: 836432 - protein, 27 aa, Mycobacterium
LRVTRPGGLAILSYTVWLGPFGGHEMG

SEQ ID NO: 836433 - protein, 31 aa, Mycobacterium
LRVVAPDAFFQFPTSKYGLALDNWSIRRLAS

SEQ ID NO: 836434 - protein, 40 aa, Mycobacterium
LRVVAPDAYFQFPVAKYGIALDNWSIRRLTSLVGAGRARG

SEQ ID NO: 836435 - protein, 28 aa, Mycobacterium
LRVVAPEAFFQFPTSKYGLALDNWSIRR

SEQ ID NO: 836436 - protein, 30 aa, Mycobacterium
LRVVAPEAFFQFPTSKYGLALDNWSIRRLS

SEQ ID NO: 836437 - protein, 33 aa, Mycobacterium
LRVVAPEAFFQFPTSKYGLALDNWSIRRLSSLV

SEQ ID NO: 836438 - protein, 25 aa, Mycobacterium
LRVVQRARDMLWLNRSRWNRTTTGD

SEQ ID NO: 836439 - protein, 25 aa, Mycobacterium
LRVVSEVRALVRWLRPQATAIAVAG

SEQ ID NO: 836440 - protein, 31 aa, Mycobacterium
LRVVVPEAYFQFPVAKYGLALDNWSIRRLTS

SEQ ID NO: 836441 - protein, 21 aa, Mycobacterium
LRVYGALLAVLTELFSRPGVH

SEQ ID NO: 836442 - protein, 17 aa, Mycobacterium
LRVYQRDVPVDVLTAVI

SEQ ID NO: 836443 - protein, 20 aa, Mycobacterium
LRWAQLFGNPLTWSDLAWLR

SEQ ID NO: 836444 - protein, 19 aa, Mycobacterium
LRWDSLGEFLAIGASLDDM

SEQ ID NO: 836445 - protein, 19 aa, Mycobacterium
LRWDSLGEFLALGASFEDM

SEQ ID NO: 836446 - protein, 19 aa, Mycobacterium
LRWDSLGEFLALGASLEDM

SEQ ID NO: 836447 - protein, 21 aa, Mycobacterium
LRWDSLGEFLALGASLEDMGN

SEQ ID NO: 836448 - protein, 17 aa, Mycobacterium
LRWMVDNFAVAMDPAGN

SEQ ID NO: 836449 - protein, 19 aa, Mycobacterium
LRYFLLREVSFGQDGSYSE

SEQ ID NO: 836450 - protein, 21 aa, Mycobacterium
LRYLEQLEFGLVREALFEREL

SEQ ID NO: 836451 - protein, 21 aa, Mycobacterium
LRYLEQLEFGLVREALYEREL

SEQ ID NO: 836452 - protein, 33 aa, Mycobacterium
LRYLRAHLVHLPRGFRWLWGQTRCLALGGAYSI

SEQ ID NO: 836453 - protein, 17 aa, Mycobacterium
LRYLRDEVKLSGAQVHL

SEQ ID NO: 836454 - protein, 17 aa, Mycobacterium
LRYLVVDECHYYRGVFG

SEQ ID NO: 836455 - protein, 24 aa, Mycobacterium
LRYRGLRAPHKIKMGVSGCARECA

SEQ ID NO: 836456 - protein, 24 aa, Mycobacterium
LRYRGLRSPHKLKMGVSGCARECA

SEQ ID NO: 836457 - protein, 26 aa, Mycobacterium
LRYRPNLVIATPPDYPPYAENDWVGS

SEQ ID NO: 836458 - protein, 20 aa, Mycobacterium
LRYRRPTALERPLRAQARVG

SEQ ID NO: 836459 - protein, 26 aa, Mycobacterium
LRYRTGDWVYIPKATTWRQLPDTETT

SEQ ID NO: 836460 - protein, 17 aa, Mycobacterium
LRYTCGRCAYCLRGREN

SEQ ID NO: 836461 - protein, 29 aa, Mycobacterium
LRYTMPLGEIIFDFFDALKSRTRGYASLD

SEQ ID NO: 836462 - protein, 19 aa, Mycobacterium
LRYVAKLTINPARLFGIDH

SEQ ID NO: 836463 - protein, 17 aa, Mycobacterium
LRYVSEGATLLLDAGST

SEQ ID NO: 836464 - protein, 31 aa, Mycobacterium
LRYVVRLRRLRRLLKWIYHIESRKAQRDIGG

SEQ ID NO: 836465 - protein, 30 aa, Mycobacterium
LSAAGVLELAWTTGLIKWEDDPQPGWYDTE

SEQ ID NO: 836466 - protein, 17 aa, Mycobacterium
LSAALRIGLRDAGVPVK

SEQ ID NO: 836467 - protein, 25 aa, Mycobacterium
LSAALSKRLLWDTAINGYTPRQVAA

SEQ ID NO: 836468 - protein, 26 aa, Mycobacterium
LSAANWLAMPAQRYMHDFSLTREHLG

SEQ ID NO: 836469 - protein, 20 aa, Mycobacterium
LSAAPIVLAPMLVGGTTVLA

SEQ ID NO: 836470 - protein, 17 aa, Mycobacterium
LSAAPLSALASAPAAAG

SEQ ID NO: 836471 - protein, 21 aa, Mycobacterium
LSAAQFVACPFGAAGSRMYRT

SEQ ID NO: 836472 - protein, 20 aa, Mycobacterium
LSAAWKTLKPQRVYAFTAHA

SEQ ID NO: 836473 - protein, 17 aa, Mycobacterium
LSAAWSLGRLYWSDREG

SEQ ID NO: 836474 - protein, 17 aa, Mycobacterium
LSADCLICLTVRGKHRC

SEQ ID NO: 836475 - protein, 25 aa, Mycobacterium
LSADDIAHIWALLGLTVAGPDVPTL

SEQ ID NO: 836476 - protein, 24 aa, Mycobacterium
LSADKPWRTDLLPESARQGEQVTF

SEQ ID NO: 836477 - protein, 25 aa, Mycobacterium
LSADRGWVVLLARYQRPKAIRQTGI

SEQ ID NO: 836478 - protein, 25 aa, Mycobacterium
LSADVMWRSSRGNPLFLRHLVEGSM

SEQ ID NO: 836479 - protein, 27 aa, Mycobacterium
LSAEHGIAFVPFFPLGSGFVADNPVLK

SEQ ID NO: 836480 - protein, 17 aa, Mycobacterium
LSAFEAMTPLPGAAVAL

SEQ ID NO: 836481 - protein, 25 aa, Mycobacterium
LSAFGTHLIAYDPYVSPARAAQLGI

SEQ ID NO: 836482 - protein, 19 aa, Mycobacterium
LSAGDFVRWCRQVLDLLDQ

SEQ ID NO: 836483 - protein, 25 aa, Mycobacterium
LSAGDFVRWCRQVLDLLDQVRNAAP

SEQ ID NO: 836484 - protein, 27 aa, Mycobacterium
LSAGDFVRWCRQVLDLLDQVRNAAPTP

SEQ ID NO: 836485 - protein, 19 aa, Mycobacterium
LSAGFSPTELMRWVHPSLV

SEQ ID NO: 836486 - protein, 19 aa, Mycobacterium
LSAGFTPTELMRWVHPSQV

SEQ ID NO: 836487 - protein, 18 aa, Mycobacterium
LSAGIFNTGTHNAGLLNS

SEQ ID NO: 836488 - protein, 20 aa, Mycobacterium
LSAGLRAGLPPKAAPDKPDE

SEQ ID NO: 836489 - protein, 21 aa, Mycobacterium
LSAHPVALVHLTALASHRGIA

SEQ ID NO: 836490 - protein, 23 aa, Mycobacterium
LSAIDMIVAAPARQGFRTALGNR

SEQ ID NO: 836491 - protein, 17 aa, Mycobacterium
LSAIMRPGATELEIAKA

SEQ ID NO: 836492 - protein, 28 aa, Mycobacterium
LSAKYPDRLTIVHWLESLQGLPSVAALA

SEQ ID NO: 836493 - protein, 24 aa, Mycobacterium
LSALATRFYGDSAFYPLIAAVNGI

SEQ ID NO: 836494 - protein, 20 aa, Mycobacterium
LSALLAWPTDHLTEAAAHWD

SEQ ID NO: 836495 - protein, 20 aa, Mycobacterium
LSALLLDRLIHEAGVPEGVV

SEQ ID NO: 836496 - protein, 18 aa, Mycobacterium
LSALLVQQLAVHGSIKLI

SEQ ID NO: 836497 - protein, 17 aa, Mycobacterium
LSALMTNNRVRHVPVVV

SEQ ID NO: 836498 - protein, 19 aa, Mycobacterium
LSALRIGNLVPSSAGFYWM

SEQ ID NO: 836499 - protein, 17 aa, Mycobacterium
LSALRKFEVLGPDAEAL

SEQ ID NO: 836500 - protein, 19 aa, Mycobacterium
LSALRLTWAPTADDLWHSQ

SEQ ID NO: 836501 - protein, 17 aa, Mycobacterium
LSALVAHLVGAEALVLL

SEQ ID NO: 836502 - protein, 18 aa, Mycobacterium
LSALVPFASQVLYSASKA

SEQ ID NO: 836503 - protein, 20 aa, Mycobacterium
LSAPAVKLLVRKAGARSADM

SEQ ID NO: 836504 - protein, 39 aa, Mycobacterium
LSAPPKPVQFIGNLLPPAMKWKMFFSRQAANRNYLHDGD

SEQ ID NO: 836505 - protein, 23 aa, Mycobacterium
LSAPTMNLLARVSPKLHRPVRTV

SEQ ID NO: 836506 - protein, 29 aa, Mycobacterium
LSAQAAQFHQGFMQLLNSAGGAYAGAEAA

SEQ ID NO: 836507 - protein, 30 aa, Mycobacterium
LSAQAATFHEQFVQTLATASRAYASAEAVN

SEQ ID NO: 836508 - protein, 24 aa, Mycobacterium
LSARAQLFLAEGAIPGLLGTEGLD

SEQ ID NO: 836509 - protein, 19 aa, Mycobacterium
LSARDMTVCILDRPRHAQL

SEQ ID NO: 836510 - protein, 24 aa, Mycobacterium
LSARDVRSAWRLLPELQVGIVHLR

SEQ ID NO: 836511 - protein, 23 aa, Mycobacterium
LSARFDELLATMQTPKAKAGVAA

SEQ ID NO: 836512 - protein, 25 aa, Mycobacterium
LSARINIEALLWATGLTRGEDRKFL

SEQ ID NO: 836513 - protein, 18 aa, Mycobacterium
LSARSIYHPGAKLDWMTA

SEQ ID NO: 836514 - protein, 17 aa, Mycobacterium
LSARTPAALMAVADRYR

SEQ ID NO: 836515 - protein, 25 aa, Mycobacterium
LSARTPLLAGLLDKPTVAMGPAAVS

SEQ ID NO: 836516 - protein, 17 aa, Mycobacterium
LSARVRGLSPRSPLPGA

SEQ ID NO: 836517 - protein, 30 aa, Mycobacterium
LSASDIARPMYIARGWLSWEGPTSVLTPTE

SEQ ID NO: 836518 - protein, 25 aa, Mycobacterium
LSASFWGSLLPAVWSFMLALRSRGL

SEQ ID NO: 836519 - protein, 33 aa, Mycobacterium
LSASPGFRRAKLPPLTAPLAVILLGGLRELTAL

SEQ ID NO: 836520 - protein, 18 aa, Mycobacterium
LSATFTFDPNIRAALITD

SEQ ID NO: 836521 - protein, 21 aa, Mycobacterium
LSATRFVACPFGGSGARMYRT

SEQ ID NO: 836522 - protein, 19 aa, Mycobacterium
LSAVIGHDRLRLALVLCAV

SEQ ID NO: 836523 - protein, 30 aa, Mycobacterium
LSAVRQRVRWWSAIALLRCLASSPAAAEQT

SEQ ID NO: 836524 - protein, 28 aa, Mycobacterium
LSAVVRTFEWMFTKYRLGGGGLSVYVDG

SEQ ID NO: 836525 - protein, 22 aa, Mycobacterium
LSAVWTVVRQLGSLLPSGCVVV

SEQ ID NO: 836526 - protein, 29 aa, Mycobacterium
LSAYSIDLYTLLPVGELWVAAARLRTLDV

SEQ ID NO: 836527 - protein, 20 aa, Mycobacterium
LSCHVMVAPVLPYLTDSAEH

SEQ ID NO: 836528 - protein, 21 aa, Mycobacterium
LSCIYSVFTEGYWSTGGPSAI

SEQ ID NO: 836529 - protein, 19 aa, Mycobacterium
LSDAAIAWVIDAYTHGRVA

SEQ ID NO: 836530 - protein, 25 aa, Mycobacterium
LSDDEFGFFMVLLAVAGNETTRNSI

SEQ ID NO: 836531 - protein, 26 aa, Mycobacterium
LSDDEFGFFVMLLAVAGNETTRNSIT

SEQ ID NO: 836532 - protein, 27 aa, Mycobacterium
LSDDELLGFCLLLLIAGHETTSNLLAN

SEQ ID NO: 836533 - protein, 24 aa, Mycobacterium
LSDDFFDDIFRELGIPYEPVRWRI

SEQ ID NO: 836534 - protein, 20 aa, Mycobacterium
LSDDLWRLDPDAVSLTAAGG

SEQ ID NO: 836535 - protein, 25 aa, Mycobacterium
LSDDPFWPTRKPLRASFSLLTGWGR

SEQ ID NO: 836536 - protein, 28 aa, Mycobacterium
LSDEDAGRWYALALAATAADMVGAARGT

SEQ ID NO: 836537 - protein, 18 aa, Mycobacterium
LSDELLPLGDVDNIFFES

SEQ ID NO: 836538 - protein, 23 aa, Mycobacterium
LSDEQLLNIIWNLIAGGVDTTTS

SEQ ID NO: 836539 - protein, 25 aa, Mycobacterium
LSDERLIRLLELRPDLAQPPPGSIA

SEQ ID NO: 836540 - protein, 25 aa, Mycobacterium
LSDESRLLLLLIATGNGLLSEIDWA

SEQ ID NO: 836541 - protein, 18 aa, Mycobacterium
LSDFMLVSFTGRKSGKRY

SEQ ID NO: 836542 - protein, 24 aa, Mycobacterium
LSDFPVELFDRPGGAPRWPTFGIR

SEQ ID NO: 836543 - protein, 23 aa, Mycobacterium
LSDFPVQLFDRPDGQPRWPTFGI

SEQ ID NO: 836544 - protein, 26 aa, Mycobacterium
LSDGFRVPGLPMPSLPVIGGDAAAAC

SEQ ID NO: 836545 - protein, 24 aa, Mycobacterium
LSDGREFVLTDTVGFVRHLPTQLV

SEQ ID NO: 836546 - protein, 27 aa, Mycobacterium
LSDHDRYFRFFTLQLSPLHDLVGKLTE

SEQ ID NO: 836547 - protein, 24 aa, Mycobacterium
LSDHSDIMAPIECLAIDGAGELQV

SEQ ID NO: 836548 - protein, 23 aa, Mycobacterium
LSDIGFDVFDSFGTYFLTVDPRP

SEQ ID NO: 836549 - protein, 20 aa, Mycobacterium
LSDIRAFFHTNKVPLYFISP

SEQ ID NO: 836550 - protein, 34 aa, Mycobacterium
LSDKTDPLVLRPWTMPDPLLPIAVAPRAKTDEDK

SEQ ID NO: 836551 - protein, 24 aa, Mycobacterium
LSDLEVLLLDLGLGALDRAGDHLG

SEQ ID NO: 836552 - protein, 20 aa, Mycobacterium
LSDLPELRCLMLTSFTSDEA

SEQ ID NO: 836553 - protein, 21 aa, Mycobacterium
LSDLQVVLGTYPITPASDILH

SEQ ID NO: 836554 - protein, 22 aa, Mycobacterium
LSDLRRLLDVVPGILIVDEAYG

SEQ ID NO: 836555 - protein, 24 aa, Mycobacterium
LSDMFTRMVLSLVATGIAPRSFYQ

SEQ ID NO: 836556 - protein, 28 aa, Mycobacterium
LSDPAEKLYTLDYYLKLAEQIVEAGAHV

SEQ ID NO: 836557 - protein, 29 aa, Mycobacterium
LSDPAENLYTLDYYLKLAEQIVDAGAHVL

SEQ ID NO: 836558 - protein, 24 aa, Mycobacterium
LSDPEIGLLLPCNVVVRADTTHGN

SEQ ID NO: 836559 - protein, 26 aa, Mycobacterium
LSDPRLRRIFTFQSLYAGVAPRDALA

SEQ ID NO: 836560 - protein, 17 aa, Mycobacterium
LSDPTRIKVLWALSQGE

SEQ ID NO: 836561 - protein, 25 aa, Mycobacterium
LSDQDLLQFCLLLLVAGNETTRNLI

SEQ ID NO: 836562 - protein, 25 aa, Mycobacterium
LSDQGVAKFKWPERLEIRAELPLTN

SEQ ID NO: 836563 - protein, 26 aa, Mycobacterium
LSDRLKPWDVIARRLAAAAEADMVLA

SEQ ID NO: 836564 - protein, 24 aa, Mycobacterium
LSDRLKPWEVISARLEAAAAADLV

SEQ ID NO: 836565 - protein, 24 aa, Mycobacterium
LSDRLKPWKVIESRLRAAAAADLV

SEQ ID NO: 836566 - protein, 34 aa, Mycobacterium
LSDRRQAMLPGHAVVLHPGPMLRGMEIAFSVADS

SEQ ID NO: 836567 - protein, 23 aa, Mycobacterium
LSDTELLDFTALAKVFGYPTTTE

SEQ ID NO: 836568 - protein, 18 aa, Mycobacterium
LSDVVALITDGRLTVPIS

SEQ ID NO: 836569 - protein, 18 aa, Mycobacterium
LSDWIIPDCYVPDRIDCN

SEQ ID NO: 836570 - protein, 17 aa, Mycobacterium
LSDWQRRYPGVPVELVV

SEQ ID NO: 836571 - protein, 24 aa, Mycobacterium
LSEAAGLTLHGLCPRCQDAKPLKR

SEQ ID NO: 836572 - protein, 20 aa, Mycobacterium
LSEAALVPSLERILRALGLI

SEQ ID NO: 836573 - protein, 24 aa, Mycobacterium
LSEAEFLARREAVERVMVVRDRVR

SEQ ID NO: 836574 - protein, 20 aa, Mycobacterium
LSEAEPWLRRAGARAQARGW

SEQ ID NO: 836575 - protein, 18 aa, Mycobacterium
LSEALATQSWYLATLRDK

SEQ ID NO: 836576 - protein, 19 aa, Mycobacterium
LSEALRIELEPHRIGVTAI

SEQ ID NO: 836577 - protein, 17 aa, Mycobacterium
LSEARMLLIGAMFTNEY

SEQ ID NO: 836578 - protein, 29 aa, Mycobacterium
LSEARWNIQYFGRTTYLGSRAAFVGAALA

SEQ ID NO: 836579 - protein, 19 aa, Mycobacterium
LSEARYGIAWGAMGAARSA

SEQ ID NO: 836580 - protein, 26 aa, Mycobacterium
LSEDEFGFFVILLAVAGNETTRNSIT

SEQ ID NO: 836581 - protein, 26 aa, Mycobacterium
LSEDELLAWALPTAANQFWMLSEPER

SEQ ID NO: 836582 - protein, 25 aa, Mycobacterium
LSEDIHYLMPVRVTTALAAGYDTSP

SEQ ID NO: 836583 - protein, 20 aa, Mycobacterium
LSEFGGIDYLVNNAAIFGGM

SEQ ID NO: 836584 - protein, 18 aa, Mycobacterium
LSEGAPVLVLRRTSYTDG

SEQ ID NO: 836585 - protein, 20 aa, Mycobacterium
LSEGTAVFDFFHPSRIVIGA

SEQ ID NO: 836586 - protein, 20 aa, Mycobacterium
LSEIFVYAPQFEGLHLRFGL

SEQ ID NO: 836587 - protein, 19 aa, Mycobacterium
LSEIRERLPRLRLWNFYGQ

SEQ ID NO: 836588 - protein, 32 aa, Mycobacterium
LSEIRHWLQVFVERFYSFSQFKRSALPNGPKV

SEQ ID NO: 836589 - protein, 26 aa, Mycobacterium
LSEIRLELDPILQAPVRLAPEIDPNQ

SEQ ID NO: 836590 - protein, 28 aa, Mycobacterium
LSEKIDPYLRPLYDALHDMMDPELIPKL

SEQ ID NO: 836591 - protein, 18 aa, Mycobacterium
LSELDLLLRIVDAADVAF

SEQ ID NO: 836592 - protein, 17 aa, Mycobacterium
LSELIALRSQHAVEAPD

SEQ ID NO: 836593 - protein, 27 aa, Mycobacterium
LSELRAARRMGSKSPLLALIADCERGV

SEQ ID NO: 836594 - protein, 23 aa, Mycobacterium
LSEMDWRLLMRRCPRRSFTIVGD

SEQ ID NO: 836595 - protein, 18 aa, Mycobacterium
LSEMTPLQRMLVGALNGA

SEQ ID NO: 836596 - protein, 24 aa, Mycobacterium
LSEPVDIPIYIAASAPKILRMSGR

SEQ ID NO: 836597 - protein, 19 aa, Mycobacterium
LSEQLHALSARYSDGWQAH

SEQ ID NO: 836598 - protein, 20 aa, Mycobacterium
LSERAVAWGSLTKYSLEKAL

SEQ ID NO: 836599 - protein, 21 aa, Mycobacterium
LSERAVFVLDPMLATGGSMAH

SEQ ID NO: 836600 - protein, 27 aa, Mycobacterium
LSERSARWRPWRSYATQHLWTTLEHPV

SEQ ID NO: 836601 - protein, 26 aa, Mycobacterium
LSESAARYLRRWHRRRPLWVGVAIGG

SEQ ID NO: 836602 - protein, 18 aa, Mycobacterium
LSEWQRILDINVTGVFLG

SEQ ID NO: 836603 - protein, 24 aa, Mycobacterium
LSFADFLRREDLVLRADLLRPWAN

SEQ ID NO: 836604 - protein, 17 aa, Mycobacterium
LSFELPSLPVAIKVDIN

SEQ ID NO: 836605 - protein, 22 aa, Mycobacterium
LSFGFPFGFSAVIPPNLPLPTK

SEQ ID NO: 836606 - protein, 36 aa, Mycobacterium
LSFHDPLYVRQVLRLRPAPEFEAWLTGLGMADANGR

SEQ ID NO: 836607 - protein, 20 aa, Mycobacterium
LSFPVDYASITRLLFSRSGQ

SEQ ID NO: 836608 - protein, 25 aa, Mycobacterium
LSGAAFLGLLGEELWAMAALVRAEL

SEQ ID NO: 836609 - protein, 26 aa, Mycobacterium
LSGAESIPLPLIRRVIDPKRQVTVVG

SEQ ID NO: 836610 - protein, 24 aa, Mycobacterium
LSGAEWRSWRHAAKRLVIGTNVMR

SEQ ID NO: 836611 - protein, 31 aa, Mycobacterium
LSGAMRLIHPHEALWRPPVLTMSAVEGTGLT

SEQ ID NO: 836612 - protein, 37 aa, Mycobacterium
LSGDLSPIKLPFFVGRWPLKFIPPIAVGRGLRPERVH

SEQ ID NO: 836613 - protein, 38 aa, Mycobacterium
LSGEARRFDVSPAWFAALGAGLTLPWLASLDPVAVEAH

SEQ ID NO: 836614 - protein, 18 aa, Mycobacterium
LSGELPQRQIGVGWAALR

SEQ ID NO: 836615 - protein, 31 aa, Mycobacterium
LSGELRQRQIGVGWAALRSLPAAAGSPALTV

SEQ ID NO: 836616 - protein, 26 aa, Mycobacterium
LSGELRQRQIGVGWAALRSRPPPASH

SEQ ID NO: 836617 - protein, 28 aa, Mycobacterium
LSGEWDFVVLAGLQEGLWPNVSPRGGVL

SEQ ID NO: 836618 - protein, 32 aa, Mycobacterium
LSGFERFPAWMWRNVVVRDFVDWLRARNQRHR

SEQ ID NO: 836619 - protein, 18 aa, Mycobacterium
LSGFERLRRTLLVYLHYQ

SEQ ID NO: 836620 - protein, 17 aa, Mycobacterium
LSGFFHGGGMVNLGFAN

SEQ ID NO: 836621 - protein, 17 aa, Mycobacterium
LSGFIAEFGLSLVGGCC

SEQ ID NO: 836622 - protein, 25 aa, Mycobacterium
LSGGALEIFLDPQVPAPLVGVFGGS

SEQ ID NO: 836623 - protein, 33 aa, Mycobacterium
LSGGALEIFLTPQLPAPLIRVYGTTPIADALVQ

SEQ ID NO: 836624 - protein, 26 aa, Mycobacterium
LSGGQPIMLITEYFLRTVFQDVPHEE

SEQ ID NO: 836625 - protein, 30 aa, Mycobacterium
LSGGSLEIFLTPQLPPPMVRIYGATPIADA

SEQ ID NO: 836626 - protein, 27 aa, Mycobacterium
LSGGSLVVGYRIGCGIIGGPVEVLSSI

SEQ ID NO: 836627 - protein, 19 aa, Mycobacterium
LSGIALNLLPPTAIPHFGD

SEQ ID NO: 836628 - protein, 18 aa, Mycobacterium
LSGIRVLDLTTFWAGPSC

SEQ ID NO: 836629 - protein, 18 aa, Mycobacterium
LSGKRCFIGLKLNQIRAA

SEQ ID NO: 836630 - protein, 17 aa, Mycobacterium
LSGLALMRHPLAHPDIP

SEQ ID NO: 836631 - protein, 20 aa, Mycobacterium
LSGLLEIGVRYLSRQTGSLG

SEQ ID NO: 836632 - protein, 19 aa, Mycobacterium
LSGLLPIYPTADSALASAA

SEQ ID NO: 836633 - protein, 17 aa, Mycobacterium
LSGMAIGPKRVYLTLRG

SEQ ID NO: 836634 - protein, 26 aa, Mycobacterium
LSGQERPFPLDLVPRVIAAAEWSRLE

SEQ ID NO: 836635 - protein, 25 aa, Mycobacterium
LSGQERPFPLDLVPRVISAAEWARL

SEQ ID NO: 836636 - protein, 22 aa, Mycobacterium
LSGQPFLLTAGFFETHRPYPHE

SEQ ID NO: 836637 - protein, 24 aa, Mycobacterium
LSGRLLLSLDPPHHGRLRSIVAPT

SEQ ID NO: 836638 - protein, 17 aa, Mycobacterium
LSGRMRLVLGDRDFAIA

SEQ ID NO: 836639 - protein, 23 aa, Mycobacterium
LSGRPFLTTERAVYRLTAEVADW

SEQ ID NO: 836640 - protein, 24 aa, Mycobacterium
LSGRPGIVLSRRQLLEIIRDEPWV

SEQ ID NO: 836641 - protein, 25 aa, Mycobacterium
LSGRPGIVLSRRQLLEIVRDGPWVG

SEQ ID NO: 836642 - protein, 24 aa, Mycobacterium
LSGRPGRMLALRRFIEYALECGDV

SEQ ID NO: 836643 - protein, 29 aa, Mycobacterium
LSGRWARAYGFPLMPIDGILVGTAAMATK

SEQ ID NO: 836644 - protein, 17 aa, Mycobacterium
LSGRWSWATGVMHANWI

SEQ ID NO: 836645 - protein, 27 aa, Mycobacterium
LSGSGPAYFFLMVEALIDAGVAAGLSR

SEQ ID NO: 836646 - protein, 27 aa, Mycobacterium
LSGSGPAYFLLMVEALVDAGVAAGLSR

SEQ ID NO: 836647 - protein, 23 aa, Mycobacterium
LSGSRIPFQDWWTNPVIQDVDGT

SEQ ID NO: 836648 - protein, 26 aa, Mycobacterium
LSGTKTWISNARRSGLIALLCKTDPD

SEQ ID NO: 836649 - protein, 17 aa, Mycobacterium
LSGVRFGSITPGQEPID

SEQ ID NO: 836650 - protein, 28 aa, Mycobacterium
LSGVRVLEVAAWTFVPSAGAVLAEWGAE

SEQ ID NO: 836651 - protein, 27 aa, Mycobacterium
LSGVTALHGGWRYPEPLAPVAAAGRAG

SEQ ID NO: 836652 - protein, 18 aa, Mycobacterium
LSGVWHTVKVGVPHIIAG

SEQ ID NO: 836653 - protein, 24 aa, Mycobacterium
LSGWGQQWLKTTGLNKLRADFDVD

SEQ ID NO: 836654 - protein, 25 aa, Mycobacterium
LSGYPHLEEAYWFGEGVLPILERMG

SEQ ID NO: 836655 - protein, 26 aa, Mycobacterium
LSGYSGGLTYLYATYHAPVDFGNGIA

SEQ ID NO: 836656 - protein, 27 aa, Mycobacterium
LSHFELKMFFAVFLGAGFVTTTHLMGK

SEQ ID NO: 836657 - protein, 25 aa, Mycobacterium
LSHIESGVFVLKPSLRELRECTGKE

SEQ ID NO: 836658 - protein, 23 aa, Mycobacterium
LSHISAGVYLLKASVRELRECVG

SEQ ID NO: 836659 - protein, 20 aa, Mycobacterium
LSHLCELFVLVDRAGLLRDP

SEQ ID NO: 836660 - protein, 23 aa, Mycobacterium
LSHLWAAGIPWDADLPPVRACPE

SEQ ID NO: 836661 - protein, 25 aa, Mycobacterium
LSHMPNLRCLMLTSFTSDEAMLDAI

SEQ ID NO: 836662 - protein, 24 aa, Mycobacterium
LSHRNILNNGFFVTELIALGPDDR

SEQ ID NO: 836663 - protein, 20 aa, Mycobacterium
LSIDALLAAITRTGAQAVHP

SEQ ID NO: 836664 - protein, 30 aa, Mycobacterium
LSIFIGTRDILLPDALLLHFNACTVGTTSR

SEQ ID NO: 836665 - protein, 26 aa, Mycobacterium
LSIIANRLSYFLDLRGPSVAVDTACS

SEQ ID NO: 836666 - protein, 27 aa, Mycobacterium
LSIPTRMGQWWYYARSFEGKQYGVHCR

SEQ ID NO: 836667 - protein, 35 aa, Mycobacterium
LSIQRTPMPFAGPLFRFALFRTRADQFHLFACCHH

SEQ ID NO: 836668 - protein, 20 aa, Mycobacterium
LSIRDGWWDEWFDGENGWEI

SEQ ID NO: 836669 - protein, 24 aa, Mycobacterium
LSIRLGVPCFPDDPLRFTGSVTAK

SEQ ID NO: 836670 - protein, 26 aa, Mycobacterium
LSITHPRLIRELLTTVYQHTAEGVLP

SEQ ID NO: 836671 - protein, 18 aa, Mycobacterium
LSIWRAGDTAGLATVVRT

SEQ ID NO: 836672 - protein, 27 aa, Mycobacterium
LSIYFNEQVFPVLTPLAVDPAHPFPFV

SEQ ID NO: 836673 - protein, 24 aa, Mycobacterium
LSIYRPLLEPLGLTHPQYLVMLAL

SEQ ID NO: 836674 - protein, 26 aa, Mycobacterium
LSKARFEFRWEDQFNLSLDPDTAREF

SEQ ID NO: 836675 - protein, 19 aa, Mycobacterium
LSKEAVILYTMRSATALGG

SEQ ID NO: 836676 - protein, 17 aa, Mycobacterium
LSKELASLTLGDAGAAL

SEQ ID NO: 836677 - protein, 20 aa, Mycobacterium
LSKGLLTNQGWRGSAGFMAG

SEQ ID NO: 836678 - protein, 18 aa, Mycobacterium
LSKIARLVDLYAKRPQVQ

SEQ ID NO: 836679 - protein, 23 aa, Mycobacterium
LSKICNDLRLLSSGPRAGFGEIN

SEQ ID NO: 836680 - protein, 26 aa, Mycobacterium
LSKIVRYHLLLPNTATRRDLADPETI

SEQ ID NO: 836681 - protein, 22 aa, Mycobacterium
LSKLERKLFRTDIMPISIGFPF

SEQ ID NO: 836682 - protein, 25 aa, Mycobacterium
LSKLVRYHLLLPETATRRDLQDPKT

SEQ ID NO: 836683 - protein, 20 aa, Mycobacterium
LSKPFTFKRVEGLRPTIQQI

SEQ ID NO: 836684 - protein, 31 aa, Mycobacterium
LSKQSGSPVFLYMDGDFPQGLDKAADPAYAA

SEQ ID NO: 836685 - protein, 18 aa, Mycobacterium
LSKYETVLKFIMGGPALI

SEQ ID NO: 836686 - protein, 20 aa, Mycobacterium
LSLAPVAAALGEKLGRHVQL

SEQ ID NO: 836687 - protein, 19 aa, Mycobacterium
LSLCPQLRTAIENAVLEGA

SEQ ID NO: 836688 - protein, 19 aa, Mycobacterium
LSLDFFLSTSSIASVWGSF

SEQ ID NO: 836689 - protein, 24 aa, Mycobacterium
LSLGAPMDVLWFRMSRRPGDPEES

SEQ ID NO: 836690 - protein, 25 aa, Mycobacterium
LSLGQRWITMLVAKLDQAAYEGASA

SEQ ID NO: 836691 - protein, 20 aa, Mycobacterium
LSLHHLTRLAATPFELADAA

SEQ ID NO: 836692 - protein, 19 aa, Mycobacterium
LSLIGSDRGLGPRALRDIT

SEQ ID NO: 836693 - protein, 19 aa, Mycobacterium
LSLIQGTFVLALSTRDKHT

SEQ ID NO: 836694 - protein, 25 aa, Mycobacterium
LSLLVSELLALYRAAGNTSALPDAP

SEQ ID NO: 836695 - protein, 18 aa, Mycobacterium
LSLMRIGIALDYSGGFHQ

SEQ ID NO: 836696 - protein, 18 aa, Mycobacterium
LSLMVVPTDAAGLQKTLI

SEQ ID NO: 836697 - protein, 19 aa, Mycobacterium
LSLPALGLDFYGGTPSNTG

SEQ ID NO: 836698 - protein, 25 aa, Mycobacterium
LSLQDELMRRFNGAALETILTRMNV

SEQ ID NO: 836699 - protein, 22 aa, Mycobacterium
LSLQLILAEILTPSPGSWVMIS

SEQ ID NO: 836700 - protein, 19 aa, Mycobacterium
LSLQRDLYAYLHDQTLRLI

SEQ ID NO: 836701 - protein, 24 aa, Mycobacterium
LSLQRWVDVCATTPARMFGLYPRK

SEQ ID NO: 836702 - protein, 17 aa, Mycobacterium
LSLRGRHVFAVYEWVFI

SEQ ID NO: 836703 - protein, 19 aa, Mycobacterium
LSLRHQDFCIGAGGTPWID

SEQ ID NO: 836704 - protein, 20 aa, Mycobacterium
LSLRQGLMSLFRTIFEPWER

SEQ ID NO: 836705 - protein, 19 aa, Mycobacterium
LSLSDYRQYVLPHSARVFG

SEQ ID NO: 836706 - protein, 18 aa, Mycobacterium
LSLSPLGESLWQAAAEGF

SEQ ID NO: 836707 - protein, 17 aa, Mycobacterium
LSLTPLPPPADLPDAHT

SEQ ID NO: 836708 - protein, 21 aa, Mycobacterium
LSLVERRMLLPDALNQLLDWP

SEQ ID NO: 836709 - protein, 18 aa, Mycobacterium
LSLWARLPGFTVADLDAA

SEQ ID NO: 836710 - protein, 25 aa, Mycobacterium
LSMAAAAQPLVAWLTDTAESSALAA

SEQ ID NO: 836711 - protein, 24 aa, Mycobacterium
LSMALLGTGFGYSAGRRATQAALL

SEQ ID NO: 836712 - protein, 25 aa, Mycobacterium
LSMDPQQRMFLELSWEALERAGIEP

SEQ ID NO: 836713 - protein, 28 aa, Mycobacterium
LSMLETQILCLTYYPVSYFEVLGRPWRD

SEQ ID NO: 836714 - protein, 31 aa, Mycobacterium
LSMLETQILCLTYYPVTYFDMLGRPWRDARR

SEQ ID NO: 836715 - protein, 17 aa, Mycobacterium
LSMLQYRGFVRQDPISR

SEQ ID NO: 836716 - protein, 17 aa, Mycobacterium
LSMPLFHSNGVAAGWAV

SEQ ID NO: 836717 - protein, 17 aa, Mycobacterium
LSMPTGMQPLWGPDTRR

SEQ ID NO: 836718 - protein, 29 aa, Mycobacterium
LSNAKTIFWNGPMGVFEFPAYATGTRGIA

SEQ ID NO: 836719 - protein, 33 aa, Mycobacterium
LSNAKTVFWNGPMGVFEFPAFAAGTKGVAEAII

SEQ ID NO: 836720 - protein, 25 aa, Mycobacterium
LSNDFFLNLLDMRTEWKPSELSENV

SEQ ID NO: 836721 - protein, 25 aa, Mycobacterium
LSNIGLDLLGQARLLLARAAAADPA

SEQ ID NO: 836722 - protein, 19 aa, Mycobacterium
LSNLAYTLARRRGHRPVRT

SEQ ID NO: 836723 - protein, 28 aa, Mycobacterium
LSNREKLPYILRLFDIQGLSTRSAASLV

SEQ ID NO: 836724 - protein, 20 aa, Mycobacterium
LSNRLAYALNLMGPALTVDT

SEQ ID NO: 836725 - protein, 24 aa, Mycobacterium
LSNVTLTFINGLLVRFAHGDRIVD

SEQ ID NO: 836726 - protein, 26 aa, Mycobacterium
LSNWTELDIWRYIQLEDLELPSIYYA

SEQ ID NO: 836727 - protein, 17 aa, Mycobacterium
LSNYLGLAVHDGSGNVV

SEQ ID NO: 836728 - protein, 26 aa, Mycobacterium
LSNYWGYNTISFFAPDPKYSSAMLPG

SEQ ID NO: 836729 - protein, 24 aa, Mycobacterium
LSNYWGYNTISFFAPDPKYSSATS

SEQ ID NO: 836730 - protein, 18 aa, Mycobacterium
LSPAGMWQWVPRNGAGAG

SEQ ID NO: 836731 - protein, 22 aa, Mycobacterium
LSPALKTFFDLTPEFKVIIETV

SEQ ID NO: 836732 - protein, 23 aa, Mycobacterium
LSPARLALPTRLGARRAWGMAVQ

SEQ ID NO: 836733 - protein, 25 aa, Mycobacterium
LSPASPIRFTDLAKLPLVMPSGLTG

SEQ ID NO: 836734 - protein, 25 aa, Mycobacterium
LSPEHVVNLVRFLASPASEGVNGQL

SEQ ID NO: 836735 - protein, 25 aa, Mycobacterium
LSPEHVVSLVKFLSSPAAAEVNGQV

SEQ ID NO: 836736 - protein, 30 aa, Mycobacterium
LSPEQLDELALYLNFDMLGSTNTGYFTYDG

SEQ ID NO: 836737 - protein, 25 aa, Mycobacterium
LSPETWTRLGRWLDDRQRMDLMFTV

SEQ ID NO: 836738 - protein, 17 aa, Mycobacterium
LSPFQIFPVRASVKCSN

SEQ ID NO: 836739 - protein, 31 aa, Mycobacterium
LSPGLDTRAWRLPWLNDTVIFEVDRPRTLAF

SEQ ID NO: 836740 - protein, 25 aa, Mycobacterium
LSPILAAQTPAWRPGTRHGYHAITL

SEQ ID NO: 836741 - protein, 18 aa, Mycobacterium
LSPILLVRGDFAAGVPLQ

SEQ ID NO: 836742 - protein, 35 aa, Mycobacterium
LSPKAIRELFTIRLRLELLATEWALPRLDAETTVA

SEQ ID NO: 836743 - protein, 22 aa, Mycobacterium
LSPKAWPRYVRINDQLPATATN

SEQ ID NO: 836744 - protein, 18 aa, Mycobacterium
LSPLLGPVRPPKWVDRSL

SEQ ID NO: 836745 - protein, 19 aa, Mycobacterium
LSPMVLPDSAQLRLKRMYP

SEQ ID NO: 836746 - protein, 21 aa, Mycobacterium
LSPRQRAVLLLRDVLQWKSAE

SEQ ID NO: 836747 - protein, 20 aa, Mycobacterium
LSPSYRRSSPLRALRAGVAL

SEQ ID NO: 836748 - protein, 27 aa, Mycobacterium
LSPTEFTLLRYFMINAGTVLSKPKILD

SEQ ID NO: 836749 - protein, 18 aa, Mycobacterium
LSQANMAALAPISGVLPA

SEQ ID NO: 836750 - protein, 18 aa, Mycobacterium
LSQAWRSSGGIVLGLAPT

SEQ ID NO: 836751 - protein, 23 aa, Mycobacterium
LSQLAQPLWPAPHPITMVQAINR

SEQ ID NO: 836752 - protein, 20 aa, Mycobacterium
LSQLMSQITRYQPESVFPGI

SEQ ID NO: 836753 - protein, 17 aa, Mycobacterium
LSQPPARFGPISGMIET

SEQ ID NO: 836754 - protein, 25 aa, Mycobacterium
LSQVKDRLFLPYQVALEFQRNRLNV

SEQ ID NO: 836755 - protein, 17 aa, Mycobacterium
LSQVLPAYMVPAAFMVI

SEQ ID NO: 836756 - protein, 31 aa, Mycobacterium
LSRAGWLRWSDKLAPTPLKPGKGPIALRVHL

SEQ ID NO: 836757 - protein, 27 aa, Mycobacterium
LSRAVFSKGIFPAVDPLASSSTILDPA

SEQ ID NO: 836758 - protein, 22 aa, Mycobacterium
LSRDGRWTRSGACTAPPAATRC

SEQ ID NO: 836759 - protein, 17 aa, Mycobacterium
LSRDWFAAFAAQRGWEL

SEQ ID NO: 836760 - protein, 27 aa, Mycobacterium
LSREELLDICFLFLIAGLDTVTDSLDC

SEQ ID NO: 836761 - protein, 25 aa, Mycobacterium
LSREILQVRVFEVHPLFARAHTFVQ

SEQ ID NO: 836762 - protein, 17 aa, Mycobacterium
LSRELALAFQNLGGVVV

SEQ ID NO: 836763 - protein, 24 aa, Mycobacterium
LSREVGATEFMLLQAAVAVTLYKA

SEQ ID NO: 836764 - protein, 26 aa, Mycobacterium
LSRFRVLAFDLPWHGKSLPPDRWWRR

SEQ ID NO: 836765 - protein, 22 aa, Mycobacterium
LSRFVDAIVWRTFGQDRLQAMA

SEQ ID NO: 836766 - protein, 25 aa, Mycobacterium
LSRGAIFHHFKDKDTLFFELAREDA

SEQ ID NO: 836767 - protein, 26 aa, Mycobacterium
LSRGAIFHHFRDKDTLFFELAREDAE

SEQ ID NO: 836768 - protein, 18 aa, Mycobacterium
LSRGLLLCLERAKLVVEP

SEQ ID NO: 836769 - protein, 17 aa, Mycobacterium
LSRGLSSALPFMKILRG

SEQ ID NO: 836770 - protein, 29 aa, Mycobacterium
LSRGTWLAERLGLKRLLRSDILPLSFGFP

SEQ ID NO: 836771 - protein, 19 aa, Mycobacterium
LSRGVPLRLIYAVHPDDNG

SEQ ID NO: 836772 - protein, 30 aa, Mycobacterium
LSRHDIVIVRRAIRRLLLRGDSPETAALAP

SEQ ID NO: 836773 - protein, 26 aa, Mycobacterium
LSRHLHHLTLPRPGDWRQLCEQVSQL

SEQ ID NO: 836774 - protein, 20 aa, Mycobacterium
LSRIGDAFLALPEGFTAHPR

SEQ ID NO: 836775 - protein, 28 aa, Mycobacterium
LSRKAPGFVRWLLRRKAINSLPAGYDVD

SEQ ID NO: 836776 - protein, 18 aa, Mycobacterium
LSRKTDGYFWGDNAPRDP

SEQ ID NO: 836777 - protein, 19 aa, Mycobacterium
LSRLRRPGRRGGRPGDLGG

SEQ ID NO: 836778 - protein, 18 aa, Mycobacterium
LSRMPELRCLILTSYTSD

SEQ ID NO: 836779 - protein, 23 aa, Mycobacterium
LSRNDIEDIFWLQSTIAQELAAT

SEQ ID NO: 836780 - protein, 17 aa, Mycobacterium
LSRNHTFIRYDERGCGL

SEQ ID NO: 836781 - protein, 26 aa, Mycobacterium
LSRPAYAAMMRQGYGRFVFVSSSAGN

SEQ ID NO: 836782 - protein, 19 aa, Mycobacterium
LSRQHFVPLFDAELSMLRA

SEQ ID NO: 836783 - protein, 17 aa, Mycobacterium
LSRRGMVPLFVGNKPIT

SEQ ID NO: 836784 - protein, 30 aa, Mycobacterium
LSRRISLPPELIYLVRFPLGVRSAMSKLGA

SEQ ID NO: 836785 - protein, 18 aa, Mycobacterium
LSRRLEFLRGHHVVVLGL

SEQ ID NO: 836786 - protein, 23 aa, Mycobacterium
LSRRQCLDLLQRVRVGRLVFTED

SEQ ID NO: 836787 - protein, 24 aa, Mycobacterium
LSRRRIYHCFNPQGVGIIAASLLS

SEQ ID NO: 836788 - protein, 26 aa, Mycobacterium
LSRRRLFGIAMPVTGAIALSACTGSP

SEQ ID NO: 836789 - protein, 23 aa, Mycobacterium
LSRRRLVRIPWDLDSYGIDPDDF

SEQ ID NO: 836790 - protein, 23 aa, Mycobacterium
LSRRRLVRIPWDLDSYGLDPDEF

SEQ ID NO: 836791 - protein, 23 aa, Mycobacterium
LSRRRLVRIPWDLGSYGIDPDDF

SEQ ID NO: 836792 - protein, 24 aa, Mycobacterium
LSRRRLVRIPWDLSTYGIDPDDFS

SEQ ID NO: 836793 - protein, 23 aa, Mycobacterium
LSRRYRVPVLSVHAPCLLISQRV

SEQ ID NO: 836794 - protein, 24 aa, Mycobacterium
LSRSLDFYRLLGLDVPEPDGPHVE

SEQ ID NO: 836795 - protein, 20 aa, Mycobacterium
LSRTLLAEAGLTKPVAAAAH

SEQ ID NO: 836796 - protein, 20 aa, Mycobacterium
LSRTVGWFTAKYPVALNVGG

SEQ ID NO: 836797 - protein, 21 aa, Mycobacterium
LSRYLAGPGVPTMFGRDARLQ

SEQ ID NO: 836798 - protein, 22 aa, Mycobacterium
LSRYSYLVSLMPRQIIDDLGLD

SEQ ID NO: 836799 - protein, 23 aa, Mycobacterium
LSSAGYIPLPDKVKERLVAAIDA

SEQ ID NO: 836800 - protein, 23 aa, Mycobacterium
LSSEPKLYDLSAHYVWIGERTRQ

SEQ ID NO: 836801 - protein, 19 aa, Mycobacterium
LSSFIYPPYTARAFKMARR

SEQ ID NO: 836802 - protein, 20 aa, Mycobacterium
LSSGFTPTELMRWVHPGLVA

SEQ ID NO: 836803 - protein, 20 aa, Mycobacterium
LSSGFTPTELMRWVHPSQVA

SEQ ID NO: 836804 - protein, 26 aa, Mycobacterium
LSSLMELLGKIFTPKNPPALSYQPAN

SEQ ID NO: 836805 - protein, 26 aa, Mycobacterium
LSSMPRYLPTIRAWQLSRVSAPVGTC

SEQ ID NO: 836806 - protein, 24 aa, Mycobacterium
LSSRAEWLPAWQDGLQRAAVAIDS

SEQ ID NO: 836807 - protein, 17 aa, Mycobacterium
LSSRLFQEIREARGLAY

SEQ ID NO: 836808 - protein, 25 aa, Mycobacterium
LSSRPAVVFSRRQLLEAVWGDSWGG

SEQ ID NO: 836809 - protein, 35 aa, Mycobacterium
LSSSARARRLYASRGWLPWLGPTSVLAPTGPVRTP

SEQ ID NO: 836810 - protein, 19 aa, Mycobacterium
LSSYLPTRTFELAVHSLDI

SEQ ID NO: 836811 - protein, 18 aa, Mycobacterium
LSTAFILEEGTALDHLAR

SEQ ID NO: 836812 - protein, 27 aa, Mycobacterium
LSTAFRDFPLSWEWTDAAGFGETVMAA

SEQ ID NO: 836813 - protein, 25 aa, Mycobacterium
LSTAKPKVFLTTERFGRMSFQPDLC

SEQ ID NO: 836814 - protein, 21 aa, Mycobacterium
LSTALQRRYGLQHAYAVMTSP

SEQ ID NO: 836815 - protein, 25 aa, Mycobacterium
LSTARFEFRWNDQFALSLDPDTARE

SEQ ID NO: 836816 - protein, 32 aa, Mycobacterium
LSTARMYFAYGLGNSVWFPLATGGSAVINPLP

SEQ ID NO: 836817 - protein, 24 aa, Mycobacterium
LSTDHVVTLVQFLAAPASEGVNGQ

SEQ ID NO: 836818 - protein, 25 aa, Mycobacterium
LSTDIPLRAWLFRVADDEHVLVAVV

SEQ ID NO: 836819 - protein, 30 aa, Mycobacterium
LSTELFGLTLASPLFMAPIGVIGLCAQDGH

SEQ ID NO: 836820 - protein, 23 aa, Mycobacterium
LSTEMLIEHCAGFLGILGLYTLG

SEQ ID NO: 836821 - protein, 36 aa, Mycobacterium
LSTFALSSAPAIRRLPQTIAAFPPITSRDPAVVLRH

SEQ ID NO: 836822 - protein, 19 aa, Mycobacterium
LSTFFEDIALIRPSEVLFV

SEQ ID NO: 836823 - protein, 17 aa, Mycobacterium
LSTFPHPRYELIPQMIV

SEQ ID NO: 836824 - protein, 25 aa, Mycobacterium
LSTGQATWDAALLLFLERSGYREET

SEQ ID NO: 836825 - protein, 24 aa, Mycobacterium
LSTGTRFFKRRKAVPVSLLVAADS

SEQ ID NO: 836826 - protein, 22 aa, Mycobacterium
LSTIDSWVRLLTSVRPSLSATR

SEQ ID NO: 836827 - protein, 25 aa, Mycobacterium
LSTLDLYGRPKRRVSTGGGIPGETP

SEQ ID NO: 836828 - protein, 18 aa, Mycobacterium
LSTLPDALAVLKDERAKL

SEQ ID NO: 836829 - protein, 19 aa, Mycobacterium
LSTMGFALPGALGVKLARP

SEQ ID NO: 836830 - protein, 29 aa, Mycobacterium
LSTPADTRLPLTWIALLCGRIRASLAAST

SEQ ID NO: 836831 - protein, 21 aa, Mycobacterium
LSTPEVAGPLPLEGPPRVVVS

SEQ ID NO: 836832 - protein, 25 aa, Mycobacterium
LSTQVAAFHTQFVEAVTGAGNAYAA

SEQ ID NO: 836833 - protein, 23 aa, Mycobacterium
LSTRASFLRQLGWHTVARGWDGR

SEQ ID NO: 836834 - protein, 21 aa, Mycobacterium
LSTRFSVLASPTPGRPCQPTT

SEQ ID NO: 836835 - protein, 25 aa, Mycobacterium
LSTRLGELPVLRFVPDLLPRMDAEV

SEQ ID NO: 836836 - protein, 31 aa, Mycobacterium
LSTRPEHRIPIYLAALSPAMLRLTGRVADGW

SEQ ID NO: 836837 - protein, 31 aa, Mycobacterium
LSTRPQHPIPIYLATLSPAMLRLTGRVADGW

SEQ ID NO: 836838 - protein, 23 aa, Mycobacterium
LSTRTIWRYFRSKESCVEPLLAR

SEQ ID NO: 836839 - protein, 22 aa, Mycobacterium
LSTSVMIALGKAYGPRMVDVRP

SEQ ID NO: 836840 - protein, 35 aa, Mycobacterium
LSTVPVGFEAWIGWFLYRLSPGLMRGALGIAQMSL

SEQ ID NO: 836841 - protein, 19 aa, Mycobacterium
LSTVRRLWRTGELESVTIG

SEQ ID NO: 836842 - protein, 31 aa, Mycobacterium
LSTVRTQLEVILPYFLHYADTEQRQRWFPGL

SEQ ID NO: 836843 - protein, 31 aa, Mycobacterium
LSTVRTQLEVILPYFLHYANAEQRERWFPGL

SEQ ID NO: 836844 - protein, 19 aa, Mycobacterium
LSTVYPLRLGGTDPLAVGP

SEQ ID NO: 836845 - protein, 22 aa, Mycobacterium
LSTWGQQWLKTTGLNTLRPDFD

SEQ ID NO: 836846 - protein, 20 aa, Mycobacterium
LSTWLDPSINDFWTTYQTNQ

SEQ ID NO: 836847 - protein, 17 aa, Mycobacterium
LSTWNQIAASPYAVADR

SEQ ID NO: 836848 - protein, 18 aa, Mycobacterium
LSTWWADMGAECGRLAQE

SEQ ID NO: 836849 - protein, 24 aa, Mycobacterium
LSTYFHEQVFPVLTPLAVDPAHPF

SEQ ID NO: 836850 - protein, 27 aa, Mycobacterium
LSTYFHEQVFPVLTPLAVDPAHPFPFV

SEQ ID NO: 836851 - protein, 19 aa, Mycobacterium
LSTYLRPSRYAEADKFFGF

SEQ ID NO: 836852 - protein, 17 aa, Mycobacterium
LSTYNFATYCHGETVRA

SEQ ID NO: 836853 - protein, 19 aa, Mycobacterium
LSTYSGGMFRRVDVASALV

SEQ ID NO: 836854 - protein, 19 aa, Mycobacterium
LSVALALLPAMRAMTQRSG

SEQ ID NO: 836855 - protein, 20 aa, Mycobacterium
LSVAPVALAGGAPLLPRCIG

SEQ ID NO: 836856 - protein, 30 aa, Mycobacterium
LSVDEAMVLWPLLVLRTAVLNVSGAQQAAI

SEQ ID NO: 836857 - protein, 29 aa, Mycobacterium
LSVDLFGLQLPSPLFMAPIGVLGICGQDG

SEQ ID NO: 836858 - protein, 26 aa, Mycobacterium
LSVDVSSWRILFEDLNIAWAQHHHGQ

SEQ ID NO: 836859 - protein, 25 aa, Mycobacterium
LSVFQNGFNLAYQQGLQPLMQVMGM

SEQ ID NO: 836860 - protein, 27 aa, Mycobacterium
LSVGLDRKDGAAWLARNHGGAGVLGPI

SEQ ID NO: 836861 - protein, 18 aa, Mycobacterium
LSVHGTFAECVLLETLVL

SEQ ID NO: 836862 - protein, 26 aa, Mycobacterium
LSVISGRIAYTLGLAGPALTLDSSCA

SEQ ID NO: 836863 - protein, 17 aa, Mycobacterium
LSVITWPKQYGGRDAPL

SEQ ID NO: 836864 - protein, 18 aa, Mycobacterium
LSVITWPQKYGGRDAPLL

SEQ ID NO: 836865 - protein, 19 aa, Mycobacterium
LSVMTTWQHRHRELYEEKV

SEQ ID NO: 836866 - protein, 21 aa, Mycobacterium
LSVNQAIQWPLVELQTEAQMV

SEQ ID NO: 836867 - protein, 28 aa, Mycobacterium
LSVPIAHDFLLPDLFREWMEAAGIDQLA

SEQ ID NO: 836868 - protein, 26 aa, Mycobacterium
LSVPLSDIWIDIRFTLPAATVDGGAP

SEQ ID NO: 836869 - protein, 24 aa, Mycobacterium
LSVPNPFTVVPYLALGTVQGPQAA

SEQ ID NO: 836870 - protein, 18 aa, Mycobacterium
LSVPQAWITAIAASPVVS

SEQ ID NO: 836871 - protein, 25 aa, Mycobacterium
LSVPTRRGDWWYYGRSFQGKQYGVQ

SEQ ID NO: 836872 - protein, 18 aa, Mycobacterium
LSVPVGDHRVLVLAGRIH

SEQ ID NO: 836873 - protein, 25 aa, Mycobacterium
LSVRALTKWHRPRLEVLAAAGADVL

SEQ ID NO: 836874 - protein, 18 aa, Mycobacterium
LSVSLIFVLEMMVQQAES

SEQ ID NO: 836875 - protein, 17 aa, Mycobacterium
LSVSWYLVRAGIEHIVI

SEQ ID NO: 836876 - protein, 40 aa, Mycobacterium
LSVVGTNIRIQPLPLLDSAQLRLKRLHPAAQYRATTSVVQ

SEQ ID NO: 836877 - protein, 20 aa, Mycobacterium
LSVVLEFPADWTLGSDPVLV

SEQ ID NO: 836878 - protein, 28 aa, Mycobacterium
LSVVNPLVDATWRFMTLDHDGKIRMDCS

SEQ ID NO: 836879 - protein, 20 aa, Mycobacterium
LSVVTGLTDGPWLGGAALSM

SEQ ID NO: 836880 - protein, 19 aa, Mycobacterium
LSWATPFTEVLDWSDAPFA

SEQ ID NO: 836881 - protein, 19 aa, Mycobacterium
LSWATPFTEVLDWSQAPFA

SEQ ID NO: 836882 - protein, 19 aa, Mycobacterium
LSWKHIPGIGAYAAAKAAL

SEQ ID NO: 836883 - protein, 20 aa, Mycobacterium
LSWTANTYARLALGIGVHDI

SEQ ID NO: 836884 - protein, 30 aa, Mycobacterium
LSYAVAPRLDYADVVALFAVHLGGTAAERE

SEQ ID NO: 836885 - protein, 18 aa, Mycobacterium
LSYFPPAVDVASRAQRYL

SEQ ID NO: 836886 - protein, 17 aa, Mycobacterium
LSYFRLHEQRREAEVVS

SEQ ID NO: 836887 - protein, 19 aa, Mycobacterium
LSYGFFTPLTGFMGRQEVD

SEQ ID NO: 836888 - protein, 18 aa, Mycobacterium
LSYHAELDWWTSPFVLTD

SEQ ID NO: 836889 - protein, 17 aa, Mycobacterium
LSYLPSNNASEPPRYPG

SEQ ID NO: 836890 - protein, 22 aa, Mycobacterium
LSYLPTYPYTQEFIDRGIRGDY

SEQ ID NO: 836891 - protein, 24 aa, Mycobacterium
LSYTGVIAYVYFPGIMSGMLRPDD

SEQ ID NO: 836892 - protein, 30 aa, Mycobacterium
LTAAGDPWASFVTYGLLGGAPVLCVSNLAE

SEQ ID NO: 836893 - protein, 23 aa, Mycobacterium
LTAAPIERILLRLDAVNRVAVYP

SEQ ID NO: 836894 - protein, 19 aa, Mycobacterium
LTAARALGRYGVCANAICP

SEQ ID NO: 836895 - protein, 24 aa, Mycobacterium
LTAARALGRYGVCANAICPRARTA

SEQ ID NO: 836896 - protein, 30 aa, Mycobacterium
LTAARVIARDSLVKTALFGSDPNWGRVLAA

SEQ ID NO: 836897 - protein, 30 aa, Mycobacterium
LTAAVRTDFLVAWSALLRLAGEDDMAILAL

SEQ ID NO: 836898 - protein, 22 aa, Mycobacterium
LTAAYRLRRELGDDARISLYDP

SEQ ID NO: 836899 - protein, 33 aa, Mycobacterium
LTADDVFLPVIATPFGFGIWTSHTTPIHLGATV

SEQ ID NO: 836900 - protein, 17 aa, Mycobacterium
LTADLKGGLLGGPVGRL

SEQ ID NO: 836901 - protein, 19 aa, Mycobacterium
LTADRELLPDVWHLADELA

SEQ ID NO: 836902 - protein, 23 aa, Mycobacterium
LTAELPVALIMGKGLTVRGVVEG

SEQ ID NO: 836903 - protein, 22 aa, Mycobacterium
LTAEQLAWIGYKNHKHSVNNPY

SEQ ID NO: 836904 - protein, 25 aa, Mycobacterium
LTAERTMLNLICHLSGIATTTAHWV

SEQ ID NO: 836905 - protein, 24 aa, Mycobacterium
LTAERTMLNLVCHLSGIATATAAW

SEQ ID NO: 836906 - protein, 25 aa, Mycobacterium
LTAERTMLNLVCHLSGIATATAAWV

SEQ ID NO: 836907 - protein, 24 aa, Mycobacterium
LTAEVLLRGWLDSGAPEVFALAQG

SEQ ID NO: 836908 - protein, 19 aa, Mycobacterium
LTAFIMVTVTQRKLGEIGN

SEQ ID NO: 836909 - protein, 17 aa, Mycobacterium
LTAFLRTGGHRVILLVR

SEQ ID NO: 836910 - protein, 21 aa, Mycobacterium
LTAFVKAHHMPTKAVLQPVGE

SEQ ID NO: 836911 - protein, 39 aa, Mycobacterium
LTAGRLLAPLRRVLGDRLELRKPPPPALPLEVLPTRRTA

SEQ ID NO: 836912 - protein, 18 aa, Mycobacterium
LTAHRLVHALRQGGFRPE

SEQ ID NO: 836913 - protein, 20 aa, Mycobacterium
LTAHVIALTRPIVKRYFRSE

SEQ ID NO: 836914 - protein, 31 aa, Mycobacterium
LTAINAPTQALTGRPLIGNGTPGAAGTGAIG

SEQ ID NO: 836915 - protein, 21 aa, Mycobacterium
LTAIPHGCPFAPRCPLAIDEC

SEQ ID NO: 836916 - protein, 17 aa, Mycobacterium
LTAIPIYDEDFVLALPP

SEQ ID NO: 836917 - protein, 18 aa, Mycobacterium
LTALATQALIARAAADVG

SEQ ID NO: 836918 - protein, 19 aa, Mycobacterium
LTALDDDALRRTVEVNLVA

SEQ ID NO: 836919 - protein, 23 aa, Mycobacterium
LTALDIGLPLETVRPLIGNAFVD

SEQ ID NO: 836920 - protein, 24 aa, Mycobacterium
LTALEGAFVLCRTLRSVEPIIAAG

SEQ ID NO: 836921 - protein, 17 aa, Mycobacterium
LTALFDFVEQRTGERSL

SEQ ID NO: 836922 - protein, 19 aa, Mycobacterium
LTALGGRAAIAPLPVHSLS

SEQ ID NO: 836923 - protein, 19 aa, Mycobacterium
LTALLAARQLRMPAPRTCR

SEQ ID NO: 836924 - protein, 19 aa, Mycobacterium
LTALPPALTQLPAEPPPGV

SEQ ID NO: 836925 - protein, 19 aa, Mycobacterium
LTALRLAVTAPKLVPQLVM

SEQ ID NO: 836926 - protein, 19 aa, Mycobacterium
LTALRRTRVGDFGLDRART

SEQ ID NO: 836927 - protein, 18 aa, Mycobacterium
LTALYATTMALFHRERTG

SEQ ID NO: 836928 - protein, 18 aa, Mycobacterium
LTAMLKPDRLALRELITQ

SEQ ID NO: 836929 - protein, 27 aa, Mycobacterium
LTAMSVFFFDHLLRTAGVPNHLAGPPD

SEQ ID NO: 836930 - protein, 24 aa, Mycobacterium
LTANAYLGAWGIVDCLGDGADVVV

SEQ ID NO: 836931 - protein, 33 aa, Mycobacterium
LTANTPATPWLASTVRVAWRAKLMFSASVDARL

SEQ ID NO: 836932 - protein, 27 aa, Mycobacterium
LTAPEMARGQYWIHPALPEVVENALLD

SEQ ID NO: 836933 - protein, 25 aa, Mycobacterium
LTAPLMQWFFDHYADPDVRTDPRIA

SEQ ID NO: 836934 - protein, 17 aa, Mycobacterium
LTAPRSRFAARIAGVNL

SEQ ID NO: 836935 - protein, 25 aa, Mycobacterium
LTAQFLILATGYLCQPRKPDIPGIE

SEQ ID NO: 836936 - protein, 23 aa, Mycobacterium
LTAQSMMIILFSAGGESTASLIG

SEQ ID NO: 836937 - protein, 25 aa, Mycobacterium
LTARDRAIAAWLWSGKEAVVAGTSA

SEQ ID NO: 836938 - protein, 29 aa, Mycobacterium
LTARFERDAIPLLDQLYGGALRMTRNPAD

SEQ ID NO: 836939 - protein, 23 aa, Mycobacterium
LTARRLACVAALLRRRSGAERRD

SEQ ID NO: 836940 - protein, 21 aa, Mycobacterium
LTARSPLAQALAGRKPGDTVT

SEQ ID NO: 836941 - protein, 20 aa, Mycobacterium
LTASRFVACPFGAPGSRMYR

SEQ ID NO: 836942 - protein, 24 aa, Mycobacterium
LTATNLLFAAKLLRENPYAVNIAQ

SEQ ID NO: 836943 - protein, 26 aa, Mycobacterium
LTATPVGHFIGMVGAFLIPVLEGAPV

SEQ ID NO: 836944 - protein, 18 aa, Mycobacterium
LTATRFVANPYGGEPGSR

SEQ ID NO: 836945 - protein, 25 aa, Mycobacterium
LTATVAKVGVFRPLTRASGARDYLL

SEQ ID NO: 836946 - protein, 30 aa, Mycobacterium
LTAVNAPIQAATGRPLIGNGAPGATGSGAS

SEQ ID NO: 836947 - protein, 36 aa, Mycobacterium
LTAWLEDFALRGGKRLRPVFAYWGWHAVTTEEPGPE

SEQ ID NO: 836948 - protein, 20 aa, Mycobacterium
LTAYMGKLRRHAYRVLDGDI

SEQ ID NO: 836949 - protein, 20 aa, Mycobacterium
LTCALFVETLREAGFPAGVV

SEQ ID NO: 836950 - protein, 22 aa, Mycobacterium
LTCDATCEVWFELRGRVIGTGR

SEQ ID NO: 836951 - protein, 24 aa, Mycobacterium
LTCDPIAGLVQIPCIERNAISAGK

SEQ ID NO: 836952 - protein, 18 aa, Mycobacterium
LTCHVDLPLWVRLDELPS

SEQ ID NO: 836953 - protein, 20 aa, Mycobacterium
LTCPFHGWTFRNDGALLKVK

SEQ ID NO: 836954 - protein, 23 aa, Mycobacterium
LTCPFHGWTFRNDGTLLKVKDPD

SEQ ID NO: 836955 - protein, 17 aa, Mycobacterium
LTCPLFITTAEFLPQHR

SEQ ID NO: 836956 - protein, 27 aa, Mycobacterium
LTCRARQADPLLFVLAKSAGSQIEDRL

SEQ ID NO: 836957 - protein, 20 aa, Mycobacterium
LTCRLIDRPLRPSFVDGLRN

SEQ ID NO: 836958 - protein, 20 aa, Mycobacterium
LTCRLIDRPLRPSFVSGLRN

SEQ ID NO: 836959 - protein, 19 aa, Mycobacterium
LTCSFLFACTGYYNYDEGY

SEQ ID NO: 836960 - protein, 19 aa, Mycobacterium
LTCVFVDHGLLRAGEREQV

SEQ ID NO: 836961 - protein, 18 aa, Mycobacterium
LTDAQLRKAAGLLNLEDL

SEQ ID NO: 836962 - protein, 24 aa, Mycobacterium
LTDAYARLVAMRLVATRASDYMRS

SEQ ID NO: 836963 - protein, 28 aa, Mycobacterium
LTDDEIFAFLLLILPAGVETTYRASGNL

SEQ ID NO: 836964 - protein, 25 aa, Mycobacterium
LTDDEIIGFMFLMVIAGNETTTKLL

SEQ ID NO: 836965 - protein, 26 aa, Mycobacterium
LTDDEIMAFLFLMVVAGNETTTKLLA

SEQ ID NO: 836966 - protein, 27 aa, Mycobacterium
LTDEEIFSFLRLLLPAGVETTYRSLGN

SEQ ID NO: 836967 - protein, 25 aa, Mycobacterium
LTDEEILGFMFLMVIAGNETTTKLL

SEQ ID NO: 836968 - protein, 25 aa, Mycobacterium
LTDEEVLGFMFLMVIAGNETTTKLL

SEQ ID NO: 836969 - protein, 21 aa, Mycobacterium
LTDELLEIIAHRPDLGVPLAG

SEQ ID NO: 836970 - protein, 25 aa, Mycobacterium
LTDGFRVPGLPVPSLPVIGGDASAA

SEQ ID NO: 836971 - protein, 26 aa, Mycobacterium
LTDGRFIGFVVARRQRALLGVASEIF

SEQ ID NO: 836972 - protein, 23 aa, Mycobacterium
LTDGSLPLLAPMSEVAGRLSAQV

SEQ ID NO: 836973 - protein, 17 aa, Mycobacterium
LTDHLAALGNPTWYARF

SEQ ID NO: 836974 - protein, 19 aa, Mycobacterium
LTDILARASAINLARLATL

SEQ ID NO: 836975 - protein, 24 aa, Mycobacterium
LTDIPVRIYWPTVEPDRVLPVVVY

SEQ ID NO: 836976 - protein, 29 aa, Mycobacterium
LTDKPFGVNLTILPSINPPPYDEYRQVIV

SEQ ID NO: 836977 - protein, 18 aa, Mycobacterium
LTDKYVVIYDLPVTFDSA

SEQ ID NO: 836978 - protein, 23 aa, Mycobacterium
LTDKYVVIYDLPVTFDVSQVLPA

SEQ ID NO: 836979 - protein, 18 aa, Mycobacterium
LTDLADQLARLCGLTAAA

SEQ ID NO: 836980 - protein, 19 aa, Mycobacterium
LTDLEAWPRWGLTVAKAEM

SEQ ID NO: 836981 - protein, 18 aa, Mycobacterium
LTDLGWGARLRRLLSEPD

SEQ ID NO: 836982 - protein, 19 aa, Mycobacterium
LTDLPGLRLIGLDRDPNAL

SEQ ID NO: 836983 - protein, 21 aa, Mycobacterium
LTDLPLTLFSDPMAPGLACTP

SEQ ID NO: 836984 - protein, 45 aa, Mycobacterium
LTDLVRTVPLPYVPAQLALAPWDRDQIHRLFDDLEFRVLRDRLFE

SEQ ID NO: 836985 - protein, 19 aa, Mycobacterium
LTDLYLDGIVGRYSARQIE

SEQ ID NO: 836986 - protein, 31 aa, Mycobacterium
LTDNASLAHLLKFDSILGRLPHDVSLEGDDT

SEQ ID NO: 836987 - protein, 28 aa, Mycobacterium
LTDNATLAHLLKFDSILGRLPQDVSLEG

SEQ ID NO: 836988 - protein, 32 aa, Mycobacterium
LTDNATLAHLLKFDSILGRLPYDVSLEGDDTI

SEQ ID NO: 836989 - protein, 23 aa, Mycobacterium
LTDNLFLASMRPPVTDQLIQLRA

SEQ ID NO: 836990 - protein, 17 aa, Mycobacterium
LTDNQLRRMLADFGIDI

SEQ ID NO: 836991 - protein, 27 aa, Mycobacterium
LTDPAELAWLFYTSGTTGKSKGAMLSH

SEQ ID NO: 836992 - protein, 23 aa, Mycobacterium
LTDPQYLRVRAELRRLAGADGID

SEQ ID NO: 836993 - protein, 23 aa, Mycobacterium
LTDRFEIAHLSPDLLRFVAQRTL

SEQ ID NO: 836994 - protein, 17 aa, Mycobacterium
LTDRLEIAHISPALLRF

SEQ ID NO: 836995 - protein, 33 aa, Mycobacterium
LTDRPLVILLHGFGSFWWSWRHQLTGLSGARLV

SEQ ID NO: 836996 - protein, 19 aa, Mycobacterium
LTDRVVGLGAAVHPAAGFR

SEQ ID NO: 836997 - protein, 17 aa, Mycobacterium
LTDVKLLARLFGLPYFP

SEQ ID NO: 836998 - protein, 24 aa, Mycobacterium
LTDYAKPFSLLVIADLLGVPAEDH

SEQ ID NO: 836999 - protein, 18 aa, Mycobacterium
LTDYLESLHRLRGLGQRT

SEQ ID NO: 837000 - protein, 24 aa, Mycobacterium
LTEAAIPFEVRMQNWEGVAAEAAY

SEQ ID NO: 837001 - protein, 31 aa, Mycobacterium
LTEAAREKLFPLIRRYALAYHVVFIPPAEVD

SEQ ID NO: 837002 - protein, 26 aa, Mycobacterium
LTEADYCFLLDPWWNPATETQAVDRT

SEQ ID NO: 837003 - protein, 19 aa, Mycobacterium
LTEAEFLARREAVDRVMVV

SEQ ID NO: 837004 - protein, 20 aa, Mycobacterium
LTEAKLLLDESYRLGPEGGG

SEQ ID NO: 837005 - protein, 19 aa, Mycobacterium
LTEALAEYWHRRIREELRY

SEQ ID NO: 837006 - protein, 17 aa, Mycobacterium
LTEDALVRLPFGQSVRI

SEQ ID NO: 837007 - protein, 17 aa, Mycobacterium
LTEDDLLRTELFRTKAG

SEQ ID NO: 837008 - protein, 19 aa, Mycobacterium
LTEDPHLWARTLFDELEGL

SEQ ID NO: 837009 - protein, 23 aa, Mycobacterium
LTEDQLWAWCKQAVTPPASDVKA

SEQ ID NO: 837010 - protein, 25 aa, Mycobacterium
LTEFAGPEFRRFALSSGVEARHTAL

SEQ ID NO: 837011 - protein, 23 aa, Mycobacterium
LTEFRNQLLPRFANAYVRDTVAR

SEQ ID NO: 837012 - protein, 31 aa, Mycobacterium
LTEGAREKLFPLIRRYALAYHVVFIPPAEVD

SEQ ID NO: 837013 - protein, 20 aa, Mycobacterium
LTEGMRFDKGYISGYFVTDA

SEQ ID NO: 837014 - protein, 19 aa, Mycobacterium
LTEHLKQRWARGAGGLLLI

SEQ ID NO: 837015 - protein, 23 aa, Mycobacterium
LTEIVRILGRFREPLTTRAVKAF

SEQ ID NO: 837016 - protein, 27 aa, Mycobacterium
LTELARELRPWVPVVSLVKGLEQGTNM

SEQ ID NO: 837017 - protein, 26 aa, Mycobacterium
LTELCALSWMVYSLPGTPVLDHYELG

SEQ ID NO: 837018 - protein, 19 aa, Mycobacterium
LTELGFRVIPSDSNFVLFG

SEQ ID NO: 837019 - protein, 17 aa, Mycobacterium
LTELGWSLRRKPLPPTG

SEQ ID NO: 837020 - protein, 19 aa, Mycobacterium
LTELKSLGLKAFLMPISPG

SEQ ID NO: 837021 - protein, 17 aa, Mycobacterium
LTELPALYELGVGSMEK

SEQ ID NO: 837022 - protein, 23 aa, Mycobacterium
LTELRDELGDVLLQVLFHARIAE

SEQ ID NO: 837023 - protein, 26 aa, Mycobacterium
LTELRLHLAALLVERGRYAEALAHCS

SEQ ID NO: 837024 - protein, 20 aa, Mycobacterium
LTELRRVVRAPGRIGLLVFV

SEQ ID NO: 837025 - protein, 25 aa, Mycobacterium
LTEPRLLPLTIGVLGDWGSGKSSLM

SEQ ID NO: 837026 - protein, 19 aa, Mycobacterium
LTEQLEILTGLWTTPTGET

SEQ ID NO: 837027 - protein, 19 aa, Mycobacterium
LTEQLIGQLSADLMFLSCT

SEQ ID NO: 837028 - protein, 20 aa, Mycobacterium
LTERGRLPDFINQQSFFPTR

SEQ ID NO: 837029 - protein, 23 aa, Mycobacterium
LTERIRITAPRLLAAFTTREAVK

SEQ ID NO: 837030 - protein, 22 aa, Mycobacterium
LTERLVLMSRQYGIEPQQLVQY

SEQ ID NO: 837031 - protein, 36 aa, Mycobacterium
LTERLVMTSRQYGIEPQQLLGYLQENNQLPAMFADV

SEQ ID NO: 837032 - protein, 31 aa, Mycobacterium
LTERTDALIFGPLRLQFWVCGVFEVHNGRIT

SEQ ID NO: 837033 - protein, 21 aa, Mycobacterium
LTERVMGLLKPFLKGWHRAEV

SEQ ID NO: 837034 - protein, 26 aa, Mycobacterium
LTESGDSIYWAGLNKGKKSLAVDMRS

SEQ ID NO: 837035 - protein, 26 aa, Mycobacterium
LTESPWKCWRLLTLETRMQVCRRNSR

SEQ ID NO: 837036 - protein, 28 aa, Mycobacterium
LTETDTWWRIDWNTLIDPSVPLGLFAFD

SEQ ID NO: 837037 - protein, 19 aa, Mycobacterium
LTEVLWAALHGLVMLGRTG

SEQ ID NO: 837038 - protein, 19 aa, Mycobacterium
LTEVPSYNLNLFLDGIEQA

SEQ ID NO: 837039 - protein, 23 aa, Mycobacterium
LTEVRALWLDRASLRASMARDPA

SEQ ID NO: 837040 - protein, 18 aa, Mycobacterium
LTEVSPLARYGHLDLLAT

SEQ ID NO: 837041 - protein, 19 aa, Mycobacterium
LTEWLKLALDQPELLEKLG

SEQ ID NO: 837042 - protein, 18 aa, Mycobacterium
LTEYQWYPDGCQLTLLES

SEQ ID NO: 837043 - protein, 17 aa, Mycobacterium
LTFAAYPHFFELKRTRT

SEQ ID NO: 837044 - protein, 23 aa, Mycobacterium
LTFACGPHHKLLDKGWSPEKTAT

SEQ ID NO: 837045 - protein, 17 aa, Mycobacterium
LTFIRQARTLGLRLDDI

SEQ ID NO: 837046 - protein, 21 aa, Mycobacterium
LTFRNAIWPALTGRGTAAERL

SEQ ID NO: 837047 - protein, 18 aa, Mycobacterium
LTFTSAPGMQCNRRMFEE

SEQ ID NO: 837048 - protein, 18 aa, Mycobacterium
LTFVHWPVLPDSVAHMYP

SEQ ID NO: 837049 - protein, 38 aa, Mycobacterium
LTGAETPVWTFLGPRPASWWLRRWVHEVAVHRADAAIA

SEQ ID NO: 837050 - protein, 19 aa, Mycobacterium
LTGALLGGCPRLTVLATSR

SEQ ID NO: 837051 - protein, 18 aa, Mycobacterium
LTGAPRALVVVPTRELCL

SEQ ID NO: 837052 - protein, 24 aa, Mycobacterium
LTGATGFLGPFLVASLLGRTSYTV

SEQ ID NO: 837053 - protein, 18 aa, Mycobacterium
LTGATGFLGRYLVLEWLE

SEQ ID NO: 837054 - protein, 18 aa, Mycobacterium
LTGATGFLGRYLVLQWLR

SEQ ID NO: 837055 - protein, 23 aa, Mycobacterium
LTGATRPWQFGDTEPWNVTRTLT

SEQ ID NO: 837056 - protein, 25 aa, Mycobacterium
LTGDAGIFLDPLYSSGLDLVAIGNG

SEQ ID NO: 837057 - protein, 24 aa, Mycobacterium
LTGDFPIPSYPVLGGHEGAGIVTE

SEQ ID NO: 837058 - protein, 25 aa, Mycobacterium
LTGDGLGIIFRKGLPLEDMEFHQFH

SEQ ID NO: 837059 - protein, 24 aa, Mycobacterium
LTGDGMGIVFRRGLPLEDMEFHQF

SEQ ID NO: 837060 - protein, 24 aa, Mycobacterium
LTGDSFFHLAPLGSSGALAGLNMC

SEQ ID NO: 837061 - protein, 24 aa, Mycobacterium
LTGDSFFHLSGLGAPGALAGLNLC

SEQ ID NO: 837062 - protein, 24 aa, Mycobacterium
LTGDSFFHLSPLGSSGALAGLNMC

SEQ ID NO: 837063 - protein, 18 aa, Mycobacterium
LTGDTLALVIRQGRNWAV

SEQ ID NO: 837064 - protein, 28 aa, Mycobacterium
LTGEAPAALRRRVMLERAAWRLQHGEPV

SEQ ID NO: 837065 - protein, 26 aa, Mycobacterium
LTGELTRRQVYLPDPKHAAGAAAPPS

SEQ ID NO: 837066 - protein, 25 aa, Mycobacterium
LTGGGTGIGLLKRVRERSGEIDWSK

SEQ ID NO: 837067 - protein, 25 aa, Mycobacterium
LTGGKRSFILVPGIDVPFHSRVLRV

SEQ ID NO: 837068 - protein, 31 aa, Mycobacterium
LTGGTPQQMGWFRFYFADQHWEWSAEVQRMH

SEQ ID NO: 837069 - protein, 18 aa, Mycobacterium
LTGGYITLAATLCTARVA

SEQ ID NO: 837070 - protein, 27 aa, Mycobacterium
LTGHDHAWSFVFLASDRSRGITGETIH

SEQ ID NO: 837071 - protein, 17 aa, Mycobacterium
LTGHDVVFLALPHGHSA

SEQ ID NO: 837072 - protein, 23 aa, Mycobacterium
LTGHKWFTSAPMCDIFLVLAQAP

SEQ ID NO: 837073 - protein, 33 aa, Mycobacterium
LTGIDATLRPWAALRAQLLLAETLRAAGLQPDP

SEQ ID NO: 837074 - protein, 18 aa, Mycobacterium
LTGIDWSQAMLDIARRRA

SEQ ID NO: 837075 - protein, 17 aa, Mycobacterium
LTGISREDQDHWGVRSQ

SEQ ID NO: 837076 - protein, 17 aa, Mycobacterium
LTGKALDFFADAVTRTA

SEQ ID NO: 837077 - protein, 20 aa, Mycobacterium
LTGKKFFRSYPYHDAFLLED

SEQ ID NO: 837078 - protein, 27 aa, Mycobacterium
LTGKVRRPQLGIATWLVPSIVAYGTEE

SEQ ID NO: 837079 - protein, 18 aa, Mycobacterium
LTGLDRYVEVRVDGVTLR

SEQ ID NO: 837080 - protein, 18 aa, Mycobacterium
LTGLHATTLHRLLGPRPD

SEQ ID NO: 837081 - protein, 22 aa, Mycobacterium
LTGLLLDHLLPVRDSRVVTISS

SEQ ID NO: 837082 - protein, 19 aa, Mycobacterium
LTGLLNRRALIAHLDDRLA

SEQ ID NO: 837083 - protein, 23 aa, Mycobacterium
LTGLPVFCVNYRLAPRYRFPTAA

SEQ ID NO: 837084 - protein, 24 aa, Mycobacterium
LTGLQALVRIPFEQSRRDSADGQR

SEQ ID NO: 837085 - protein, 18 aa, Mycobacterium
LTGLQRRVDELQSAVVAA

SEQ ID NO: 837086 - protein, 34 aa, Mycobacterium
LTGNWGPFIRITNPGVLPLPPLPAGLTLEDFDAQ

SEQ ID NO: 837087 - protein, 17 aa, Mycobacterium
LTGPALPPQLAATAIAQ

SEQ ID NO: 837088 - protein, 21 aa, Mycobacterium
LTGPHRVGPAPWKPLLGMTGP

SEQ ID NO: 837089 - protein, 18 aa, Mycobacterium
LTGPLARYSLNSAHLPPI

SEQ ID NO: 837090 - protein, 22 aa, Mycobacterium
LTGPMRPKRWISGRAAQLGTSG

SEQ ID NO: 837091 - protein, 24 aa, Mycobacterium
LTGPRLILRPLRPTDADVVFFEVT

SEQ ID NO: 837092 - protein, 20 aa, Mycobacterium
LTGQAWQGAAAAAMSAAAAP

SEQ ID NO: 837093 - protein, 20 aa, Mycobacterium
LTGQAWQGAAAKAMAAVAAP

SEQ ID NO: 837094 - protein, 19 aa, Mycobacterium
LTGRLFRRRPQESEILLAN

SEQ ID NO: 837095 - protein, 32 aa, Mycobacterium
LTGRPFAASAPRIGAPRWDTAIIGLDCDTTIL

SEQ ID NO: 837096 - protein, 22 aa, Mycobacterium
LTGRQVLPPAWVADTLAGGPDS

SEQ ID NO: 837097 - protein, 20 aa, Mycobacterium
LTGSAPLGWYTGRDSPYTRE

SEQ ID NO: 837098 - protein, 21 aa, Mycobacterium
LTGSRFVACPFGRPGVRMYRT

SEQ ID NO: 837099 - protein, 23 aa, Mycobacterium
LTGSRLYVPTAAAPWPGPEGDRR

SEQ ID NO: 837100 - protein, 22 aa, Mycobacterium
LTGTDRGLLYLPGEPLDTDALG

SEQ ID NO: 837101 - protein, 23 aa, Mycobacterium
LTGTFLVVREALSALLANPRSAI

SEQ ID NO: 837102 - protein, 26 aa, Mycobacterium
LTGTITVRYRRLTPLGRLHSEARVTH

SEQ ID NO: 837103 - protein, 20 aa, Mycobacterium
LTGTPGGCGFQFDPPRYLRP

SEQ ID NO: 837104 - protein, 26 aa, Mycobacterium
LTGTSAIDWFALDRLPPLAPSVDEAQ

SEQ ID NO: 837105 - protein, 17 aa, Mycobacterium
LTGVDIHPGAVLGAGLF

SEQ ID NO: 837106 - protein, 25 aa, Mycobacterium
LTGVDQLRLVYPNGEKINSESLAVD

SEQ ID NO: 837107 - protein, 28 aa, Mycobacterium
LTGVETPVWTFLGPRPANWWIRRRLHEV

SEQ ID NO: 837108 - protein, 17 aa, Mycobacterium
LTGVEWLQTARDAGVDA

SEQ ID NO: 837109 - protein, 26 aa, Mycobacterium
LTGVLLGIPTVIYPLGAFEPGQLLDV

SEQ ID NO: 837110 - protein, 20 aa, Mycobacterium
LTGVMGYRWTKPVDAALSVA

SEQ ID NO: 837111 - protein, 21 aa, Mycobacterium
LTGVRFPTWTGKSGFAVREFS

SEQ ID NO: 837112 - protein, 21 aa, Mycobacterium
LTGVRVFFPDPWPKARHHKRR

SEQ ID NO: 837113 - protein, 22 aa, Mycobacterium
LTGVRVFFPDPWPKARHHKRRL

SEQ ID NO: 837114 - protein, 26 aa, Mycobacterium
LTGVTILNNWIRQGVVERGLVVSGEY

SEQ ID NO: 837115 - protein, 32 aa, Mycobacterium
LTGVTVDRYAEVSMLGFVLMTDALGGVNVCLN

SEQ ID NO: 837116 - protein, 17 aa, Mycobacterium
LTGVYHTIKAAIPTMVK

SEQ ID NO: 837117 - protein, 26 aa, Mycobacterium
LTGWLALLAPDIIYRAPVRTTRDHRT

SEQ ID NO: 837118 - protein, 18 aa, Mycobacterium
LTGYLARFKDDLRHRSNA

SEQ ID NO: 837119 - protein, 23 aa, Mycobacterium
LTHDQLLLRLAVPSRTAEISGLE

SEQ ID NO: 837120 - protein, 27 aa, Mycobacterium
LTHFRRLRSPEPWIERFERCWEVLDGC

SEQ ID NO: 837121 - protein, 31 aa, Mycobacterium
LTHHHMVFVIPPLVFPLRRSLEAGIGVRNFI

SEQ ID NO: 837122 - protein, 22 aa, Mycobacterium
LTHPGLLHRHSALHLAVAAAKD

SEQ ID NO: 837123 - protein, 25 aa, Mycobacterium
LTHPHGQIYGYPFLTPRTSVMLEQA

SEQ ID NO: 837124 - protein, 25 aa, Mycobacterium
LTHPHGQIYGYPYLTPRTAAMLDRA

SEQ ID NO: 837125 - protein, 21 aa, Mycobacterium
LTHPHGQIYGYPYLTPRTATM

SEQ ID NO: 837126 - protein, 25 aa, Mycobacterium
LTHPQYLVMLALWDHHKIRSAGVDP

SEQ ID NO: 837127 - protein, 25 aa, Mycobacterium
LTHPQYLVMLALWDNQRTSSGQGSA

SEQ ID NO: 837128 - protein, 22 aa, Mycobacterium
LTHRNIWINAVVFGLHATLRDD

SEQ ID NO: 837129 - protein, 18 aa, Mycobacterium
LTIAAELLSAAVKAKIIL

SEQ ID NO: 837130 - protein, 18 aa, Mycobacterium
LTIDPARRLAQSLGIEAL

SEQ ID NO: 837131 - protein, 35 aa, Mycobacterium
LTIEAIAAGNLKGIRKWVWERLGGTLYAQKAADAL

SEQ ID NO: 837132 - protein, 17 aa, Mycobacterium
LTIFEQLGTPLWAARAR

SEQ ID NO: 837133 - protein, 18 aa, Mycobacterium
LTILHDGGYRDTEIVRWL

SEQ ID NO: 837134 - protein, 18 aa, Mycobacterium
LTIPIPGELNRFVFAMPE

SEQ ID NO: 837135 - protein, 17 aa, Mycobacterium
LTIPIRHVYAALWRIGV

SEQ ID NO: 837136 - protein, 18 aa, Mycobacterium
LTIPLVPVVIACGAAVPQ

SEQ ID NO: 837137 - protein, 18 aa, Mycobacterium
LTIPQIRDVTFRGMFDEW

SEQ ID NO: 837138 - protein, 46 aa, Mycobacterium
LTIRTYNALLEAVLWFLARKLPGFIKWLLRRIAIKNLPAGYDVDTH

SEQ ID NO: 837139 - protein, 25 aa, Mycobacterium
LTISDLKFMKFIGEEIFPGGQLPAV

SEQ ID NO: 837140 - protein, 24 aa, Mycobacterium
LTITDTGSWKPPRPPRDSHRGRGL

SEQ ID NO: 837141 - protein, 20 aa, Mycobacterium
LTITHVLWAMFGVLPPNQVQ

SEQ ID NO: 837142 - protein, 22 aa, Mycobacterium
LTITTYDFPHLVPSKPARRALA

SEQ ID NO: 837143 - protein, 29 aa, Mycobacterium
LTIVGAERHAPYHRPPLSKKLLSGQVHRA

SEQ ID NO: 837144 - protein, 17 aa, Mycobacterium
LTIWLNESQITPSVAKS

SEQ ID NO: 837145 - protein, 29 aa, Mycobacterium
LTKAIEIHPIRRNIQHADLLVVRKGEKVT

SEQ ID NO: 837146 - protein, 17 aa, Mycobacterium
LTKGKLPTSLWIEIVST

SEQ ID NO: 837147 - protein, 17 aa, Mycobacterium
LTKGKLPTSMWIEIVTT

SEQ ID NO: 837148 - protein, 25 aa, Mycobacterium
LTKRRRFYALDLTPNSTVGTPFLGS

SEQ ID NO: 837149 - protein, 19 aa, Mycobacterium
LTKSYLSKIERGHSTPSIA

SEQ ID NO: 837150 - protein, 29 aa, Mycobacterium
LTKTIEIHPIRRNLVHADLLVVRKGEKVT

SEQ ID NO: 837151 - protein, 17 aa, Mycobacterium
LTKWSMPLLKREGRMLA

SEQ ID NO: 837152 - protein, 19 aa, Mycobacterium
LTKYLDRVNYRKNWKRLGF

SEQ ID NO: 837153 - protein, 19 aa, Mycobacterium
LTLADFLRDELQLTGTHLG

SEQ ID NO: 837154 - protein, 17 aa, Mycobacterium
LTLADYLREKCGLTGTH

SEQ ID NO: 837155 - protein, 17 aa, Mycobacterium
LTLAKLKDAPHGIDLGP

SEQ ID NO: 837156 - protein, 20 aa, Mycobacterium
LTLAVLPGMVERRAGGILIS

SEQ ID NO: 837157 - protein, 25 aa, Mycobacterium
LTLAWRRLRAWPDAVPGLTRLRSAY

SEQ ID NO: 837158 - protein, 21 aa, Mycobacterium
LTLEALAAHNVSCAGLVIGSW

SEQ ID NO: 837159 - protein, 21 aa, Mycobacterium
LTLEALAAQKVSCAGLVLGSW

SEQ ID NO: 837160 - protein, 18 aa, Mycobacterium
LTLEALAERTGLTKSYLS

SEQ ID NO: 837161 - protein, 26 aa, Mycobacterium
LTLEDFLEQMLTIRKMGPIGNLLGML

SEQ ID NO: 837162 - protein, 18 aa, Mycobacterium
LTLELPGRDPIPGVSFAF

SEQ ID NO: 837163 - protein, 18 aa, Mycobacterium
LTLHALRLRLGDTKFFAL

SEQ ID NO: 837164 - protein, 25 aa, Mycobacterium
LTLHLPGREPVGGVHFAFVSNSSPW

SEQ ID NO: 837165 - protein, 20 aa, Mycobacterium
LTLHLPGREPVSGVHFAFVS

SEQ ID NO: 837166 - protein, 20 aa, Mycobacterium
LTLHPRVGRWLQLGGHCEPT

SEQ ID NO: 837167 - protein, 17 aa, Mycobacterium
LTLLDFDDLLLHTAAAI

SEQ ID NO: 837168 - protein, 28 aa, Mycobacterium
LTLLDPVFTFVRIPLAPIAASVLMFAPG

SEQ ID NO: 837169 - protein, 27 aa, Mycobacterium
LTLLETITAALLTRGLNPEKLSWDAWR

SEQ ID NO: 837170 - protein, 17 aa, Mycobacterium
LTLLGALAAWTSRVRLL

SEQ ID NO: 837171 - protein, 17 aa, Mycobacterium
LTLLNRAMLSSDHTRFA

SEQ ID NO: 837172 - protein, 20 aa, Mycobacterium
LTLPADSHLLLMWGAANRDP

SEQ ID NO: 837173 - protein, 19 aa, Mycobacterium
LTLPGLAHPLLPPWMVTES

SEQ ID NO: 837174 - protein, 19 aa, Mycobacterium
LTLPGRSLLFVRNVGHLMT

SEQ ID NO: 837175 - protein, 33 aa, Mycobacterium
LTLPHGMKIRLSFLSGFVLDGLPGWRDTMHLPV

SEQ ID NO: 837176 - protein, 30 aa, Mycobacterium
LTLPHPYAHVRAFVLVPWSAVDASAASAVS

SEQ ID NO: 837177 - protein, 21 aa, Mycobacterium
LTLPSPIFLAPIGVIGLCAQD

SEQ ID NO: 837178 - protein, 21 aa, Mycobacterium
LTLQRALLPTMQPPPGFVVRY

SEQ ID NO: 837179 - protein, 24 aa, Mycobacterium
LTLQRAMLPPIQPPPGFTVRYEPA

SEQ ID NO: 837180 - protein, 24 aa, Mycobacterium
LTLQRAMLPPVKPPPGFAVRYEPA

SEQ ID NO: 837181 - protein, 31 aa, Mycobacterium
LTLRADGITAPVLAWLHAPGMDFGPALAADV

SEQ ID NO: 837182 - protein, 20 aa, Mycobacterium
LTLRIPRPRLCTDNGAMIAA

SEQ ID NO: 837183 - protein, 17 aa, Mycobacterium
LTLRRFQRAGHRPIVLA

SEQ ID NO: 837184 - protein, 17 aa, Mycobacterium
LTLRYLLPMAHEGLRRW

SEQ ID NO: 837185 - protein, 20 aa, Mycobacterium
LTLSCGAALNHCVIALAATG

SEQ ID NO: 837186 - protein, 26 aa, Mycobacterium
LTLTPETPLAAVTRYFAAYNLVCGPV

SEQ ID NO: 837187 - protein, 20 aa, Mycobacterium
LTLVPLSIYFTDGKVKVELA

SEQ ID NO: 837188 - protein, 25 aa, Mycobacterium
LTMDDLADRLLLQDPAILAEVRRTA

SEQ ID NO: 837189 - protein, 25 aa, Mycobacterium
LTMDDYLAARWINEPFRVLDCTSEV

SEQ ID NO: 837190 - protein, 20 aa, Mycobacterium
LTMEMAKFIRFIVTDIFPGG

SEQ ID NO: 837191 - protein, 20 aa, Mycobacterium
LTMFLVPIAHPGITLRRITM

SEQ ID NO: 837192 - protein, 19 aa, Mycobacterium
LTMFLVPISHPGITLRHIT

SEQ ID NO: 837193 - protein, 18 aa, Mycobacterium
LTMLAAALRDGTANRRTT

SEQ ID NO: 837194 - protein, 17 aa, Mycobacterium
LTMLSWNALKGIVEVGG

SEQ ID NO: 837195 - protein, 20 aa, Mycobacterium
LTMPGAVILVGERLATSPGA

SEQ ID NO: 837196 - protein, 30 aa, Mycobacterium
LTNAMPERLRLMVTLASWCALRFGETVELR

SEQ ID NO: 837197 - protein, 24 aa, Mycobacterium
LTNATAARRWLVAALGDEAVSKHF

SEQ ID NO: 837198 - protein, 26 aa, Mycobacterium
LTNATMPYVLKLADLGWQAACLSDSA

SEQ ID NO: 837199 - protein, 21 aa, Mycobacterium
LTNDQVRVIAAWRGNQKPSST

SEQ ID NO: 837200 - protein, 24 aa, Mycobacterium
LTNDTTLRWLAPGIRVVWGSPRAG

SEQ ID NO: 837201 - protein, 26 aa, Mycobacterium
LTNFEGPFDLLLQLISQHRLDVTEVA

SEQ ID NO: 837202 - protein, 27 aa, Mycobacterium
LTNLGYRGFWMGYFAARSAPLGQVPPE

SEQ ID NO: 837203 - protein, 25 aa, Mycobacterium
LTNLMHVPVNWLKIDRSFIADVLDN

SEQ ID NO: 837204 - protein, 22 aa, Mycobacterium
LTNPAFYIPLAQAAEAAGYSSM

SEQ ID NO: 837205 - protein, 18 aa, Mycobacterium
LTNPFYPELVEPLRNALG

SEQ ID NO: 837206 - protein, 19 aa, Mycobacterium
LTPAIVWQDRRAETLCAAL

SEQ ID NO: 837207 - protein, 29 aa, Mycobacterium
LTPAVLRRNILENPAWYTAYTPYQPEISQ

SEQ ID NO: 837208 - protein, 38 aa, Mycobacterium
LTPAYGHPFAILAPVLRFPLEPILGFVYRRLGDTQASL

SEQ ID NO: 837209 - protein, 21 aa, Mycobacterium
LTPCGPLCIGVHTVVRVDVGE

SEQ ID NO: 837210 - protein, 23 aa, Mycobacterium
LTPDEFAVLRRAGTERPFVGEYT

SEQ ID NO: 837211 - protein, 18 aa, Mycobacterium
LTPDGEGTVLRFTHRGLT

SEQ ID NO: 837212 - protein, 26 aa, Mycobacterium
LTPDHWLYDMFVHTRGLAEKDLTLAL

SEQ ID NO: 837213 - protein, 25 aa, Mycobacterium
LTPETPLVAVTRYLAAYNLVCGPVV

SEQ ID NO: 837214 - protein, 21 aa, Mycobacterium
LTPEYVAPVVAYLMTEELTDT

SEQ ID NO: 837215 - protein, 18 aa, Mycobacterium
LTPHVTWYTADTMRRYLT

SEQ ID NO: 837216 - protein, 24 aa, Mycobacterium
LTPKRSIANFAYYARTALAHHPET

SEQ ID NO: 837217 - protein, 22 aa, Mycobacterium
LTPLGTMYPGNFGLGPVAVLGS

SEQ ID NO: 837218 - protein, 30 aa, Mycobacterium
LTPLIRARAAWLWSRRRGIVAGLSAAAVHG

SEQ ID NO: 837219 - protein, 17 aa, Mycobacterium
LTPLMGQEFLDKYNLRD

SEQ ID NO: 837220 - protein, 17 aa, Mycobacterium
LTPLPRNVVRPDAPAPG

SEQ ID NO: 837221 - protein, 22 aa, Mycobacterium
LTPMQYLLEWRVAVAKDLMRSE

SEQ ID NO: 837222 - protein, 29 aa, Mycobacterium
LTPPVLRRNIIENPAWYTAYTPYQPEISQ

SEQ ID NO: 837223 - protein, 23 aa, Mycobacterium
LTPQAHTFFRIIDEISPYFHDDQ

SEQ ID NO: 837224 - protein, 20 aa, Mycobacterium
LTPQALIDLVASRSYCITSP

SEQ ID NO: 837225 - protein, 24 aa, Mycobacterium
LTPQALIDLVASRSYCITSPAEVR

SEQ ID NO: 837226 - protein, 21 aa, Mycobacterium
LTPQALIDLVASRSYCITSPE

SEQ ID NO: 837227 - protein, 23 aa, Mycobacterium
LTPQALIDLVASRSYCITSPTEV

SEQ ID NO: 837228 - protein, 24 aa, Mycobacterium
LTPQALIDLVASRTYCITSPAKVR

SEQ ID NO: 837229 - protein, 23 aa, Mycobacterium
LTPQEFAVLRRAGTERPFTGEYT

SEQ ID NO: 837230 - protein, 26 aa, Mycobacterium
LTPQELAKFFILLIGAGNETTRNALT

SEQ ID NO: 837231 - protein, 19 aa, Mycobacterium
LTPQFRPGCKRMLMTNDYY

SEQ ID NO: 837232 - protein, 23 aa, Mycobacterium
LTPQGVDYVAAFFAAIHAGNVAV

SEQ ID NO: 837233 - protein, 26 aa, Mycobacterium
LTPQQRAWLNLVQPLTIVEGFALLSV

SEQ ID NO: 837234 - protein, 27 aa, Mycobacterium
LTPQQRAWLNLVQPLTIVEGFALLSVP

SEQ ID NO: 837235 - protein, 26 aa, Mycobacterium
LTPQQRAWLTLVKPLTMAEGFALLSV

SEQ ID NO: 837236 - protein, 17 aa, Mycobacterium
LTPQRRGRYLQLPNKPA

SEQ ID NO: 837237 - protein, 21 aa, Mycobacterium
LTPSHQFPLGVPLHSDRRAAV

SEQ ID NO: 837238 - protein, 19 aa, Mycobacterium
LTPTIASLWVGTVTPIPPG

SEQ ID NO: 837239 - protein, 17 aa, Mycobacterium
LTPVLLQAGIDLLVIQG

SEQ ID NO: 837240 - protein, 20 aa, Mycobacterium
LTPVLSRFWDDPESWTLETY

SEQ ID NO: 837241 - protein, 19 aa, Mycobacterium
LTQALRAWVEKINACLAAP

SEQ ID NO: 837242 - protein, 23 aa, Mycobacterium
LTQDIAVLPGLQRGMHQPGFTHL

SEQ ID NO: 837243 - protein, 17 aa, Mycobacterium
LTQEAFDRLKAELDQLI

SEQ ID NO: 837244 - protein, 21 aa, Mycobacterium
LTQEMLWDRLCTALTPGNVVL

SEQ ID NO: 837245 - protein, 18 aa, Mycobacterium
LTQERLLRRDMGVGELLG

SEQ ID NO: 837246 - protein, 19 aa, Mycobacterium
LTQETFIRVFRSVQNYQPG

SEQ ID NO: 837247 - protein, 17 aa, Mycobacterium
LTQIRQRYDPSRLMYSG

SEQ ID NO: 837248 - protein, 23 aa, Mycobacterium
LTQLGTMYPGNFGLGPVAVLGDN

SEQ ID NO: 837249 - protein, 24 aa, Mycobacterium
LTQLRSRPVLADPLKALITRSDEI

SEQ ID NO: 837250 - protein, 26 aa, Mycobacterium
LTQMRDFYAFLLGEIPTLLERWRQEQ

SEQ ID NO: 837251 - protein, 46 aa, Mycobacterium
LTQNIGNWALVISGPLFTASGITPLMGGLYGLALPTAVAVAGDVSP

SEQ ID NO: 837252 - protein, 22 aa, Mycobacterium
LTQQALFPSYSGMALLGCTNRH

SEQ ID NO: 837253 - protein, 21 aa, Mycobacterium
LTQQLLAPVVMHTALRPAAEG

SEQ ID NO: 837254 - protein, 18 aa, Mycobacterium
LTQQRWYAGRNRELVSAT

SEQ ID NO: 837255 - protein, 25 aa, Mycobacterium
LTQVGSPYVWGGAAPGGFDCSGLVM

SEQ ID NO: 837256 - protein, 17 aa, Mycobacterium
LTQWHRLVPVQQSAAVG

SEQ ID NO: 837257 - protein, 17 aa, Mycobacterium
LTQWLTELGAPPSPVAS

SEQ ID NO: 837258 - protein, 24 aa, Mycobacterium
LTRATQRLGVLYRDALPQALAGLA

SEQ ID NO: 837259 - protein, 21 aa, Mycobacterium
LTRAVGLLAAAKRPVIMAGTN

SEQ ID NO: 837260 - protein, 21 aa, Mycobacterium
LTRDAGWGNAMRWLLTGDEFD

SEQ ID NO: 837261 - protein, 27 aa, Mycobacterium
LTRDELMAMCFLLITAGYETTVNLIGN

SEQ ID NO: 837262 - protein, 30 aa, Mycobacterium
LTRDGLRPLTFALWEMIVAARAARPEPVKT

SEQ ID NO: 837263 - protein, 29 aa, Mycobacterium
LTRDRVLALALHLLDLGYFRAGGEQYADD

SEQ ID NO: 837264 - protein, 18 aa, Mycobacterium
LTREAGLNNLARLAQYLP

SEQ ID NO: 837265 - protein, 20 aa, Mycobacterium
LTREFLASRTVPLATREHLD

SEQ ID NO: 837266 - protein, 30 aa, Mycobacterium
LTREFVRFVGVPPRRWLADEFRNIQDGGHS

SEQ ID NO: 837267 - protein, 26 aa, Mycobacterium
LTRESPKRHLAFGHGIHFCVGAALAR

SEQ ID NO: 837268 - protein, 17 aa, Mycobacterium
LTRGQLDIWLSQEAGFA

SEQ ID NO: 837269 - protein, 19 aa, Mycobacterium
LTRHALAAVAAWLARPDTA

SEQ ID NO: 837270 - protein, 24 aa, Mycobacterium
LTRHDDVFFASRHPEIFSSALGIT

SEQ ID NO: 837271 - protein, 24 aa, Mycobacterium
LTRHDDVFYASRHPELFSSASGIV

SEQ ID NO: 837272 - protein, 25 aa, Mycobacterium
LTRKDIPIHYLLADTFTVCDRYFSS

SEQ ID NO: 837273 - protein, 24 aa, Mycobacterium
LTRKWNTELDYRLIKELWAHDGNR

SEQ ID NO: 837274 - protein, 21 aa, Mycobacterium
LTRLGPLPPLRMDPQTGPILS

SEQ ID NO: 837275 - protein, 22 aa, Mycobacterium
LTRLGPLPPLRMQPDAPPILSH

SEQ ID NO: 837276 - protein, 21 aa, Mycobacterium
LTRLGPLPPLRMQPGAEPILS

SEQ ID NO: 837277 - protein, 26 aa, Mycobacterium
LTRLKMYRLLHELWARRHMAVLHVTH

SEQ ID NO: 837278 - protein, 18 aa, Mycobacterium
LTRLLPAARPVRAGSHAT

SEQ ID NO: 837279 - protein, 26 aa, Mycobacterium
LTRLPGIDDAWLRKVLHDNAAHVFGL

SEQ ID NO: 837280 - protein, 26 aa, Mycobacterium
LTRLRGMFAFALWDTVTRELFCARDP

SEQ ID NO: 837281 - protein, 19 aa, Mycobacterium
LTRLSMHRLLLNLWEQHGF

SEQ ID NO: 837282 - protein, 27 aa, Mycobacterium
LTRLSRPFFVWLTVGLYHPAVRERLGF

SEQ ID NO: 837283 - protein, 17 aa, Mycobacterium
LTRMHGKRLPDEDTFEL

SEQ ID NO: 837284 - protein, 18 aa, Mycobacterium
LTRMLIGIPVVYTSDYLV

SEQ ID NO: 837285 - protein, 25 aa, Mycobacterium
LTRPAINHYFASKQALYREVVVQTN

SEQ ID NO: 837286 - protein, 32 aa, Mycobacterium
LTRPAPSGLWRRIFPVLLLAQKAFRRRYLRSL

SEQ ID NO: 837287 - protein, 17 aa, Mycobacterium
LTRPEIAVLLAYSKNVV

SEQ ID NO: 837288 - protein, 26 aa, Mycobacterium
LTRPSLAHFIRTGQEFSWRAEELFDA

SEQ ID NO: 837289 - protein, 18 aa, Mycobacterium
LTRQAAVPQITYPDLPVT

SEQ ID NO: 837290 - protein, 28 aa, Mycobacterium
LTRQHNYWRWTGDPVLPPGLVELIESRI

SEQ ID NO: 837291 - protein, 17 aa, Mycobacterium
LTRREIEILRMLEAGRT

SEQ ID NO: 837292 - protein, 24 aa, Mycobacterium
LTRRLAPPRRIGPAPWKSLLGMTG

SEQ ID NO: 837293 - protein, 25 aa, Mycobacterium
LTRRQSLRLHYARTLDLWAEALQAH

SEQ ID NO: 837294 - protein, 22 aa, Mycobacterium
LTRSLAVEWAPKVRVNALAAGM

SEQ ID NO: 837295 - protein, 19 aa, Mycobacterium
LTRSNVVVLRTFSKAYGLA

SEQ ID NO: 837296 - protein, 19 aa, Mycobacterium
LTRSPLYHELKVPEFSFRS

SEQ ID NO: 837297 - protein, 24 aa, Mycobacterium
LTRSSFDAPWPGGPFDLLVLSEVA

SEQ ID NO: 837298 - protein, 26 aa, Mycobacterium
LTRTAAVWHLYTPITATLRERSTTAL

SEQ ID NO: 837299 - protein, 17 aa, Mycobacterium
LTRTAGFQWARHNICVN

SEQ ID NO: 837300 - protein, 25 aa, Mycobacterium
LTRTRELLRRPWVAAVSPMVCDDTA

SEQ ID NO: 837301 - protein, 27 aa, Mycobacterium
LTRVEGNLCFPLPKFSDIRYNYSLAGG

SEQ ID NO: 837302 - protein, 17 aa, Mycobacterium
LTRYDIEIFPTAALIAA

SEQ ID NO: 837303 - protein, 24 aa, Mycobacterium
LTSAIPIGGILTPLQPVDSTIVFR

SEQ ID NO: 837304 - protein, 18 aa, Mycobacterium
LTSALAHYDLTDAIPAAL

SEQ ID NO: 837305 - protein, 24 aa, Mycobacterium
LTSDDFPVLWPVGTRWADNDMFGH

SEQ ID NO: 837306 - protein, 20 aa, Mycobacterium
LTSEFDIRAGYRWPADVPER

SEQ ID NO: 837307 - protein, 23 aa, Mycobacterium
LTSGAFARYLADYIHEQGWQTYG

SEQ ID NO: 837308 - protein, 24 aa, Mycobacterium
LTSGDPPRPAWPRLRSPLGQAQLL

SEQ ID NO: 837309 - protein, 18 aa, Mycobacterium
LTSGKLYYELVARKAKDN

SEQ ID NO: 837310 - protein, 19 aa, Mycobacterium
LTSGLPLMIDRLRDRPRLA

SEQ ID NO: 837311 - protein, 22 aa, Mycobacterium
LTSGYILTPTLPAGLTPAPTAR

SEQ ID NO: 837312 - protein, 18 aa, Mycobacterium
LTSKPWVKTTMAPGSQVV

SEQ ID NO: 837313 - protein, 17 aa, Mycobacterium
LTSLPWSGPAAAAMLTA

SEQ ID NO: 837314 - protein, 33 aa, Mycobacterium
LTSLRAMLCGSAPAPIWLWHNVEDRLGISEIVT

SEQ ID NO: 837315 - protein, 26 aa, Mycobacterium
LTSPPNTHGFAMLRALRAIEERDVAD

SEQ ID NO: 837316 - protein, 20 aa, Mycobacterium
LTSRLHIVGWRTQHPEIAAA

SEQ ID NO: 837317 - protein, 25 aa, Mycobacterium
LTSSEFARYLADYIHEQGWQTYGDV

SEQ ID NO: 837318 - protein, 25 aa, Mycobacterium
LTSSSFARYLADYIHEQGWQTYGEV

SEQ ID NO: 837319 - protein, 23 aa, Mycobacterium
LTSTKWRDPYAGTPWHKHVPARI

SEQ ID NO: 837320 - protein, 18 aa, Mycobacterium
LTSVETALRLGISKDRWI

SEQ ID NO: 837321 - protein, 20 aa, Mycobacterium
LTSYSQLRLALAAAAARELA

SEQ ID NO: 837322 - protein, 28 aa, Mycobacterium
LTTALRLLHARIRLLRRYSLSAENRQPA

SEQ ID NO: 837323 - protein, 26 aa, Mycobacterium
LTTCYDIRFPGLYTDLARRGAQVITV

SEQ ID NO: 837324 - protein, 19 aa, Mycobacterium
LTTIFRTPVRLRAAGRTDA

SEQ ID NO: 837325 - protein, 20 aa, Mycobacterium
LTTKFFGMKANRYLHDHGIS

SEQ ID NO: 837326 - protein, 26 aa, Mycobacterium
LTTKTVGVALRFLPDSLKAVASRINS

SEQ ID NO: 837327 - protein, 17 aa, Mycobacterium
LTTLRQFGGLQSYPSRS

SEQ ID NO: 837328 - protein, 20 aa, Mycobacterium
LTTMDPPRHPRARALLGRLL

SEQ ID NO: 837329 - protein, 33 aa, Mycobacterium
LTTNLRRRGGRWYWHWDPQFISGTAAFPPFEVT

SEQ ID NO: 837330 - protein, 19 aa, Mycobacterium
LTTPAAVMLRRCETCAADI

SEQ ID NO: 837331 - protein, 18 aa, Mycobacterium
LTTPAAVMLRRCETCAGD

SEQ ID NO: 837332 - protein, 28 aa, Mycobacterium
LTTRDYHPAIGFYRRLFGWQTEQVGDTD

SEQ ID NO: 837333 - protein, 17 aa, Mycobacterium
LTTRRGHAMLKTLMAAS

SEQ ID NO: 837334 - protein, 29 aa, Mycobacterium
LTTRVIDLIMPIGKGQRALIVSPPKAGKT

SEQ ID NO: 837335 - protein, 30 aa, Mycobacterium
LTTRVIDLIMPIGKGQRALIVSPPKAGKTT

SEQ ID NO: 837336 - protein, 24 aa, Mycobacterium
LTTSRLRQLLRNAGRQRHVDRDAE

SEQ ID NO: 837337 - protein, 19 aa, Mycobacterium
LTTTFRPLAGPLQKQGVPK

SEQ ID NO: 837338 - protein, 19 aa, Mycobacterium
LTTTLAEPGTLLLGDDRRT

SEQ ID NO: 837339 - protein, 29 aa, Mycobacterium
LTTTVALLGRFLLPLDIARRRLAGNLVEV

SEQ ID NO: 837340 - protein, 24 aa, Mycobacterium
LTTYDSFRRLLRRATDPDPRRRFA

SEQ ID NO: 837341 - protein, 18 aa, Mycobacterium
LTTYRESIRWGKWHMPAL

SEQ ID NO: 837342 - protein, 26 aa, Mycobacterium
LTVAMDWYSRCVTGLRLTPVSTKSID

SEQ ID NO: 837343 - protein, 27 aa, Mycobacterium
LTVAMDWYTRCITALRLTPVSTKAVDV

SEQ ID NO: 837344 - protein, 26 aa, Mycobacterium
LTVARYRREWDDLPFVICVFGNGDLN

SEQ ID NO: 837345 - protein, 26 aa, Mycobacterium
LTVATDWAPPPPAGTLQRLLACSPPE

SEQ ID NO: 837346 - protein, 27 aa, Mycobacterium
LTVATILTKPWLTPPLAKGDYSEWAEQ

SEQ ID NO: 837347 - protein, 26 aa, Mycobacterium
LTVCYDIRFPALYTELARRGAELIVV

SEQ ID NO: 837348 - protein, 26 aa, Mycobacterium
LTVCYDIRFPELYTELARRGAQVIAV

SEQ ID NO: 837349 - protein, 26 aa, Mycobacterium
LTVCYDIRFPELYTELARRGASLIAV

SEQ ID NO: 837350 - protein, 26 aa, Mycobacterium
LTVDDYPTTPLPPPSPHDLAYLIYTS

SEQ ID NO: 837351 - protein, 18 aa, Mycobacterium
LTVDLPRPTALKPLEVHT

SEQ ID NO: 837352 - protein, 18 aa, Mycobacterium
LTVDPRPLGYDDSTSFCA

SEQ ID NO: 837353 - protein, 18 aa, Mycobacterium
LTVDSFVPIINDHLRQDL

SEQ ID NO: 837354 - protein, 18 aa, Mycobacterium
LTVFDLRAEAVAPLVEEG

SEQ ID NO: 837355 - protein, 20 aa, Mycobacterium
LTVFPDARLIWAHRDPYKAT

SEQ ID NO: 837356 - protein, 17 aa, Mycobacterium
LTVFRRGAAAYLERQQR

SEQ ID NO: 837357 - protein, 21 aa, Mycobacterium
LTVGILKYTRDLAFTAAGAYA

SEQ ID NO: 837358 - protein, 26 aa, Mycobacterium
LTVGNVVHGALRSAWIGYWVASSQTG

SEQ ID NO: 837359 - protein, 26 aa, Mycobacterium
LTVHLKGHFSVLRHAATYWKSQSKDG

SEQ ID NO: 837360 - protein, 24 aa, Mycobacterium
LTVKGHPYVFVIGDLMSVPGVPGM

SEQ ID NO: 837361 - protein, 17 aa, Mycobacterium
LTVLAPVSPPPVKIAVR

SEQ ID NO: 837362 - protein, 23 aa, Mycobacterium
LTVLRLGVPPTLARTLRSTNCIE

SEQ ID NO: 837363 - protein, 25 aa, Mycobacterium
LTVLVSEWLRTIPAFGLDAESVPPV

SEQ ID NO: 837364 - protein, 24 aa, Mycobacterium
LTVNRLLLRNVGVLGVAWGEYLNK

SEQ ID NO: 837365 - protein, 28 aa, Mycobacterium
LTVNYLGARLMLDGMLPLMNHGGSMVAV

SEQ ID NO: 837366 - protein, 17 aa, Mycobacterium
LTVPGAAGLRAAWLTMI

SEQ ID NO: 837367 - protein, 18 aa, Mycobacterium
LTVPGIRYVIDPGNARIS

SEQ ID NO: 837368 - protein, 19 aa, Mycobacterium
LTVPGIRYVIDPGTARISR

SEQ ID NO: 837369 - protein, 17 aa, Mycobacterium
LTVPGYGWRHHPAAAMW

SEQ ID NO: 837370 - protein, 27 aa, Mycobacterium
LTVPQPTEFWIPPGATLRIIGPGDKEV

SEQ ID NO: 837371 - protein, 17 aa, Mycobacterium
LTVPRRDGGERRLYLVE

SEQ ID NO: 837372 - protein, 19 aa, Mycobacterium
LTVQWALDRHTFGRPLASY

SEQ ID NO: 837373 - protein, 17 aa, Mycobacterium
LTVRAHLELAKRSGATL

SEQ ID NO: 837374 - protein, 24 aa, Mycobacterium
LTVRELELLVFLIEQHGRVASSEE

SEQ ID NO: 837375 - protein, 22 aa, Mycobacterium
LTVRLSFDWAQLKPGDKVLIHA

SEQ ID NO: 837376 - protein, 23 aa, Mycobacterium
LTVRLSFDWAQLKPGDKVLIHAA

SEQ ID NO: 837377 - protein, 21 aa, Mycobacterium
LTVRPLLRDEVFYVTADPARA

SEQ ID NO: 837378 - protein, 23 aa, Mycobacterium
LTVRSVAFRPLPGNGLSSVAPGE

SEQ ID NO: 837379 - protein, 21 aa, Mycobacterium
LTVRYALRRAGALRVWPQRAR

SEQ ID NO: 837380 - protein, 18 aa, Mycobacterium
LTVRYGPVLALDDASFTL

SEQ ID NO: 837381 - protein, 21 aa, Mycobacterium
LTVSAPLLLPTAGALQVQVVV

SEQ ID NO: 837382 - protein, 31 aa, Mycobacterium
LTVSMPMRLRLLEALDLFGIALGVAAVRRGA

SEQ ID NO: 837383 - protein, 20 aa, Mycobacterium
LTVVAPRRQQFTGDEAHERV

SEQ ID NO: 837384 - protein, 17 aa, Mycobacterium
LTVVHWLESVQGMPSVA

SEQ ID NO: 837385 - protein, 22 aa, Mycobacterium
LTVYVTLFEGALGQALAAAGHR

SEQ ID NO: 837386 - protein, 19 aa, Mycobacterium
LTWAGACRPGDGLGITGDE

SEQ ID NO: 837387 - protein, 20 aa, Mycobacterium
LTWDELPAPIATYLGARPKD

SEQ ID NO: 837388 - protein, 20 aa, Mycobacterium
LTWEGLFDVVAEQPHLLRSG

SEQ ID NO: 837389 - protein, 21 aa, Mycobacterium
LTWSMYFPPTESTMRGCWVDL

SEQ ID NO: 837390 - protein, 17 aa, Mycobacterium
LTWSRFRNHDFLARLRE

SEQ ID NO: 837391 - protein, 17 aa, Mycobacterium
LTWVTTYVDQHGEVLGR

SEQ ID NO: 837392 - protein, 17 aa, Mycobacterium
LTWVTTYVDQHSEVLGR

SEQ ID NO: 837393 - protein, 17 aa, Mycobacterium
LTYFPDVRFATSDRDLT

SEQ ID NO: 837394 - protein, 22 aa, Mycobacterium
LTYPAVFGFLRIVTNARILTEP

SEQ ID NO: 837395 - protein, 23 aa, Mycobacterium
LTYQMMYELRDFGFSTAIGIGGD

SEQ ID NO: 837396 - protein, 22 aa, Mycobacterium
LTYQMMYELRDLGFSTAIGIGG

SEQ ID NO: 837397 - protein, 26 aa, Mycobacterium
LTYRQGDWIYIPKACTWRQIPDPGPT

SEQ ID NO: 837398 - protein, 23 aa, Mycobacterium
LVAAAFVGLIPPPPMPPSTGSLR

SEQ ID NO: 837399 - protein, 29 aa, Mycobacterium
LVAAAWLHDIGYAPSLRRTGFHPLDGAEF

SEQ ID NO: 837400 - protein, 30 aa, Mycobacterium
LVAADAWQRFGVWLLHKHFDPEPGEVFVER

SEQ ID NO: 837401 - protein, 22 aa, Mycobacterium
LVAAHLQWHLERQLRTLPLVER

SEQ ID NO: 837402 - protein, 34 aa, Mycobacterium
LVAAHRLHRLPIWMRPLAWLPRPDLRRPGRRRSS

SEQ ID NO: 837403 - protein, 17 aa, Mycobacterium
LVAAMRKVARCVPGAQA

SEQ ID NO: 837404 - protein, 26 aa, Mycobacterium
LVAANRALFARLVANNLFGQNTSAIA

SEQ ID NO: 837405 - protein, 27 aa, Mycobacterium
LVAANRAQLLVLIATNFFGQNTSAIAA

SEQ ID NO: 837406 - protein, 35 aa, Mycobacterium
LVAAPPRVPPTPATWGWMLQLYGLRSSRSWGVGDL

SEQ ID NO: 837407 - protein, 26 aa, Mycobacterium
LVAATDALYFAMRRGRTSPAGTQAGM

SEQ ID NO: 837408 - protein, 20 aa, Mycobacterium
LVAAVWAWLGWHHLHSARAA

SEQ ID NO: 837409 - protein, 25 aa, Mycobacterium
LVADRLAPGARAWWQAGHRSTEPAH

SEQ ID NO: 837410 - protein, 25 aa, Mycobacterium
LVAEAIRRFSRLKAPLVLDLGGLDF

SEQ ID NO: 837411 - protein, 29 aa, Mycobacterium
LVAECRVWPSPLLPALPTMFDGLGDVHVL

SEQ ID NO: 837412 - protein, 18 aa, Mycobacterium
LVAEGLLMYLTEPEVRML

SEQ ID NO: 837413 - protein, 21 aa, Mycobacterium
LVAEGLPLRRAVRAAIVEALS

SEQ ID NO: 837414 - protein, 28 aa, Mycobacterium
LVAEQLAPGARQWWLAGHRSTEPAHSLA

SEQ ID NO: 837415 - protein, 26 aa, Mycobacterium
LVAEQPRLRWRLIDVGPDTELSQLIS

SEQ ID NO: 837416 - protein, 27 aa, Mycobacterium
LVAERLAPGARLWWQAGHRSTEPGHAL

SEQ ID NO: 837417 - protein, 28 aa, Mycobacterium
LVAERPVAVAALWSATLRRLACDHGHGM

SEQ ID NO: 837418 - protein, 17 aa, Mycobacterium
LVAFGRCPSFDGRLPEL

SEQ ID NO: 837419 - protein, 27 aa, Mycobacterium
LVAGEIARLALFLASPQARHITGQTLH

SEQ ID NO: 837420 - protein, 39 aa, Mycobacterium
LVAGERPPRVPLSFAQSRLWFLEQLQGPSAVYNIPVVLH

SEQ ID NO: 837421 - protein, 23 aa, Mycobacterium
LVAGLGQRLPIVETRFGTFETAS

SEQ ID NO: 837422 - protein, 17 aa, Mycobacterium
LVAGVRRALDFFVGDRK

SEQ ID NO: 837423 - protein, 17 aa, Mycobacterium
LVAGWRALHAVGPQPLV

SEQ ID NO: 837424 - protein, 19 aa, Mycobacterium
LVAHIGGLALAFDAAARKE

SEQ ID NO: 837425 - protein, 25 aa, Mycobacterium
LVAHPLVRRIGFIGSPGTGRHIQRL

SEQ ID NO: 837426 - protein, 25 aa, Mycobacterium
LVAHRPTGRRLLIQGSAGFVKGALA

SEQ ID NO: 837427 - protein, 17 aa, Mycobacterium
LVAIDTLLARMENDRDR

SEQ ID NO: 837428 - protein, 21 aa, Mycobacterium
LVAIENAIWPDLFIAGGGISR

SEQ ID NO: 837429 - protein, 22 aa, Mycobacterium
LVAIENAMWPDLFIAGGGISRK

SEQ ID NO: 837430 - protein, 32 aa, Mycobacterium
LVAINSPVQDLTGRPLIGNGTPAPAGSGADGT

SEQ ID NO: 837431 - protein, 19 aa, Mycobacterium
LVAKLALPVPSLVISQLLG

SEQ ID NO: 837432 - protein, 18 aa, Mycobacterium
LVALKRPPTPVHRDVREQ

SEQ ID NO: 837433 - protein, 18 aa, Mycobacterium
LVALLAVDAKARVFFCNS

SEQ ID NO: 837434 - protein, 17 aa, Mycobacterium
LVALLTELMEAAAEAGE

SEQ ID NO: 837435 - protein, 26 aa, Mycobacterium
LVALPAAHNFPLACPGLLGAMTVGAT

SEQ ID NO: 837436 - protein, 26 aa, Mycobacterium
LVALPAGHNFPLACPGLLGAISTGAT

SEQ ID NO: 837437 - protein, 30 aa, Mycobacterium
LVALPNGRYGWRISLPAMMAYWSELARDAV

SEQ ID NO: 837438 - protein, 26 aa, Mycobacterium
LVALRPDACCYNPLWPSIDELVRLLE

SEQ ID NO: 837439 - protein, 40 aa, Mycobacterium
LVALRRLLYCGEWINSHALHIYLLHAPDFLGYPDIVGMAR

SEQ ID NO: 837440 - protein, 18 aa, Mycobacterium
LVALSRFPDPDAAPAHGS

SEQ ID NO: 837441 - protein, 21 aa, Mycobacterium
LVAMGQLYEYFQKLIAARRVD

SEQ ID NO: 837442 - protein, 17 aa, Mycobacterium
LVAMPQLAEPYADSRDD

SEQ ID NO: 837443 - protein, 28 aa, Mycobacterium
LVANLARVPLLLIPCYQPYLPRIEGDES

SEQ ID NO: 837444 - protein, 18 aa, Mycobacterium
LVAPAYVETLKPLIEQLH

SEQ ID NO: 837445 - protein, 22 aa, Mycobacterium
LVAPDGVYDAALAWAGRFREHP

SEQ ID NO: 837446 - protein, 20 aa, Mycobacterium
LVAPEFTDEWLREPLLRACR

SEQ ID NO: 837447 - protein, 20 aa, Mycobacterium
LVAPIYTTRSAIPLLRAAGG

SEQ ID NO: 837448 - protein, 19 aa, Mycobacterium
LVAPLTFASTLALLVQQHF

SEQ ID NO: 837449 - protein, 29 aa, Mycobacterium
LVAPVAPLHGWGPDPYLTPGLTELSSQAG

SEQ ID NO: 837450 - protein, 19 aa, Mycobacterium
LVAQAWHWVDPARAIPEVA

SEQ ID NO: 837451 - protein, 19 aa, Mycobacterium
LVAQAWHWVDPERAIPEVA

SEQ ID NO: 837452 - protein, 20 aa, Mycobacterium
LVAQAWHWVDPTRAIPEVAR

SEQ ID NO: 837453 - protein, 19 aa, Mycobacterium
LVAQCRTVVSTWSQVTARS

SEQ ID NO: 837454 - protein, 27 aa, Mycobacterium
LVAQLDRGTWTPAPVFGMIAQRGRIER

SEQ ID NO: 837455 - protein, 26 aa, Mycobacterium
LVAQRVPYLQVWNLTGQPAAVVPWDF

SEQ ID NO: 837456 - protein, 28 aa, Mycobacterium
LVAQWQKYALIVSHTIPFENLGEALELA

SEQ ID NO: 837457 - protein, 24 aa, Mycobacterium
LVARALTVPLVRRGEPLATPGLDA

SEQ ID NO: 837458 - protein, 20 aa, Mycobacterium
LVARDGLVLGELPTGSVIGT

SEQ ID NO: 837459 - protein, 32 aa, Mycobacterium
LVARIGVLVDLGLGYLSLHRRTPTVSPGELQR

SEQ ID NO: 837460 - protein, 28 aa, Mycobacterium
LVARIGVLVDLGLGYLSLNRRTPSVSPG

SEQ ID NO: 837461 - protein, 22 aa, Mycobacterium
LVARLHALLRRAHHSDPTSDTM

SEQ ID NO: 837462 - protein, 24 aa, Mycobacterium
LVARLHAQRYLADRGALRGIDADS

SEQ ID NO: 837463 - protein, 19 aa, Mycobacterium
LVARLIQRGIPALGIDRSA

SEQ ID NO: 837464 - protein, 23 aa, Mycobacterium
LVARPLLAALRPELGCVLQPLGG

SEQ ID NO: 837465 - protein, 23 aa, Mycobacterium
LVARPLLAALRPELGCVLQPLSG

SEQ ID NO: 837466 - protein, 23 aa, Mycobacterium
LVARPLLASLRPELNCVLQPLGG

SEQ ID NO: 837467 - protein, 23 aa, Mycobacterium
LVARPMLAALRPELSCVVQPLGG

SEQ ID NO: 837468 - protein, 20 aa, Mycobacterium
LVARRRGITVLGDRPPMVSV

SEQ ID NO: 837469 - protein, 25 aa, Mycobacterium
LVARSKPLVAILWGRDASTLKPMLA

SEQ ID NO: 837470 - protein, 22 aa, Mycobacterium
LVARVRAMLRRPRVLQSATATA

SEQ ID NO: 837471 - protein, 18 aa, Mycobacterium
LVARWMLIGFIHGVMNTD

SEQ ID NO: 837472 - protein, 22 aa, Mycobacterium
LVASLLLVHGLHPHDLHRRVSD

SEQ ID NO: 837473 - protein, 18 aa, Mycobacterium
LVASLTTPISLIKHAAGA

SEQ ID NO: 837474 - protein, 27 aa, Mycobacterium
LVASQTIGFALMRYVWRIEPVASMRED

SEQ ID NO: 837475 - protein, 27 aa, Mycobacterium
LVASSRMMPVLRISGLTELVSVELAAP

SEQ ID NO: 837476 - protein, 26 aa, Mycobacterium
LVATEVGMLYQLRRAAPQVDFRAVND

SEQ ID NO: 837477 - protein, 18 aa, Mycobacterium
LVATGFPVLLGASRKRFL

SEQ ID NO: 837478 - protein, 38 aa, Mycobacterium
LVATLVRHPRLAKGFLRFNFHLLYGSSLPARLRELAVL

SEQ ID NO: 837479 - protein, 19 aa, Mycobacterium
LVAVEYYFKLPNDVAERDV

SEQ ID NO: 837480 - protein, 18 aa, Mycobacterium
LVAVHAWWSPGAFEMPGF

SEQ ID NO: 837481 - protein, 29 aa, Mycobacterium
LVAVHVWNNIPPGYVYAYTAWSAMDSAGE

SEQ ID NO: 837482 - protein, 23 aa, Mycobacterium
LVAVLNYPMYVVTTRAGGIAAGC

SEQ ID NO: 837483 - protein, 19 aa, Mycobacterium
LVAVLPAAFRDFKGIPVAI

SEQ ID NO: 837484 - protein, 26 aa, Mycobacterium
LVAVPRTEESRFRAMCEARGLPAARV

SEQ ID NO: 837485 - protein, 18 aa, Mycobacterium
LVAVRPGYWHPAHFASAA

SEQ ID NO: 837486 - protein, 18 aa, Mycobacterium
LVAWRPALAAADRAKVVV

SEQ ID NO: 837487 - protein, 23 aa, Mycobacterium
LVAWTTQGFPPGAPYIGPAGKDF

SEQ ID NO: 837488 - protein, 17 aa, Mycobacterium
LVAYPDRNKVLVEGVNR

SEQ ID NO: 837489 - protein, 17 aa, Mycobacterium
LVCDFWTELGRNTAARV

SEQ ID NO: 837490 - protein, 28 aa, Mycobacterium
LVCESGRVLFFELALPWLDRSKVARVDY

SEQ ID NO: 837491 - protein, 26 aa, Mycobacterium
LVCGDTVLWKPSELAPLTALACQALL

SEQ ID NO: 837492 - protein, 18 aa, Mycobacterium
LVCPALFDLGETSKVVVI

SEQ ID NO: 837493 - protein, 19 aa, Mycobacterium
LVCRGVLVDVPKLRGVDRL

SEQ ID NO: 837494 - protein, 31 aa, Mycobacterium
LVCSVPLLDMKRYHLLLAGASWMAEYGDPDN

SEQ ID NO: 837495 - protein, 31 aa, Mycobacterium; identical to SEQ ID NO: 121270

SEQ ID NO: 837496 - protein, 17 aa, Mycobacterium
LVCVAQCRPNTAPTVLQ

SEQ ID NO: 837497 - protein, 25 aa, Mycobacterium
LVDAGGFIFIARGSGLPYAAEGALK

SEQ ID NO: 837498 - protein, 31 aa, Mycobacterium
LVDAMGALVFWRLIALFRPVTSEYLDRVARA

SEQ ID NO: 837499 - protein, 21 aa, Mycobacterium
LVDAVAFPQPPSHRQRQRTVH

SEQ ID NO: 837500 - protein, 18 aa, Mycobacterium
LVDAVFVEAFRNPALESL

SEQ ID NO: 837501 - protein, 35 aa, Mycobacterium
LVDDDFAELFLPTPLRWLVGATRFAPVRRLMIRGS

SEQ ID NO: 837502 - protein, 31 aa, Mycobacterium
LVDDDLADLFLPRPLRWLVSATRPAGIRRLF

SEQ ID NO: 837503 - protein, 31 aa, Mycobacterium
LVDDDLAELFLPTPLRWLVAATRAAPLRRLM

SEQ ID NO: 837504 - protein, 27 aa, Mycobacterium
LVDDLRINWVWNPPWGPDKITEDGREQ

SEQ ID NO: 837505 - protein, 23 aa, Mycobacterium
LVDDPYPYFNALRDKCPVQSEDH

SEQ ID NO: 837506 - protein, 25 aa, Mycobacterium
LVDDQAIATLAFINGIMLTFVAGQP

SEQ ID NO: 837507 - protein, 24 aa, Mycobacterium
LVDELCVTVAPLLLGGGPGRIVTG

SEQ ID NO: 837508 - protein, 18 aa, Mycobacterium
LVDELGILTWRQIDQRAD

SEQ ID NO: 837509 - protein, 21 aa, Mycobacterium
LVDELPGIQGAFRSVINAWPA

SEQ ID NO: 837510 - protein, 29 aa, Mycobacterium
LVDFARTHRFPPPWCVALSGGPDSLALTA

SEQ ID NO: 837511 - protein, 17 aa, Mycobacterium
LVDFWAAYCRPCQAFAP

SEQ ID NO: 837512 - protein, 19 aa, Mycobacterium
LVDGDIIWAPAIDGAFVLT

SEQ ID NO: 837513 - protein, 24 aa, Mycobacterium
LVDGDLLRLGSLAFPIAAGTGTGT

SEQ ID NO: 837514 - protein, 31 aa, Mycobacterium
LVDGLAQKSLFGNILLIAKGRKADVLLRYNF

SEQ ID NO: 837515 - protein, 18 aa, Mycobacterium
LVDGPVVLGWQTLREIQE

SEQ ID NO: 837516 - protein, 25 aa, Mycobacterium
LVDGTARLAAMNLLLHGIGTADGES

SEQ ID NO: 837517 - protein, 19 aa, Mycobacterium
LVDGTMGWEYLLLTATKRT

SEQ ID NO: 837518 - protein, 17 aa, Mycobacterium
LVDIIGGVLGRPLRYQE

SEQ ID NO: 837519 - protein, 20 aa, Mycobacterium
LVDINLGIRILLGSSYYDDW

SEQ ID NO: 837520 - protein, 17 aa, Mycobacterium
LVDITRFWYEQGSLDNE

SEQ ID NO: 837521 - protein, 21 aa, Mycobacterium
LVDIYLRALWDTDLTGPVNAV

SEQ ID NO: 837522 - protein, 23 aa, Mycobacterium
LVDLALTAPTFQQLIARASDRPD

SEQ ID NO: 837523 - protein, 19 aa, Mycobacterium
LVDLIMTAAPPEFLQGIRA

SEQ ID NO: 837524 - protein, 18 aa, Mycobacterium
LVDLKVGDCLKLGGTPDR

SEQ ID NO: 837525 - protein, 19 aa, Mycobacterium
LVDLLPGQQWVACTASAAA

SEQ ID NO: 837526 - protein, 17 aa, Mycobacterium
LVDLLVAAGADVRAVTQ

SEQ ID NO: 837527 - protein, 17 aa, Mycobacterium
LVDLSPHWIATDPQGAA

SEQ ID NO: 837528 - protein, 18 aa, Mycobacterium
LVDLTPARTWGASTLIPF

SEQ ID NO: 837529 - protein, 18 aa, Mycobacterium
LVDLYPLVRKSIRVGTEN

SEQ ID NO: 837530 - protein, 17 aa, Mycobacterium
LVDPQRVWGIAADPRTS

SEQ ID NO: 837531 - protein, 31 aa, Mycobacterium
LVDRAFAADLPLLPVASIPVPGPVGVLDALA

SEQ ID NO: 837532 - protein, 18 aa, Mycobacterium
LVDRDHLPLLEGLDLNGI

SEQ ID NO: 837533 - protein, 18 aa, Mycobacterium
LVDRLREVLLKQELDRPL

SEQ ID NO: 837534 - protein, 18 aa, Mycobacterium
LVDRRVHQAFLRHQPLQQ

SEQ ID NO: 837535 - protein, 19 aa, Mycobacterium
LVDRVFPRASFDEGWQSIA

SEQ ID NO: 837536 - protein, 18 aa, Mycobacterium
LVDSAPKPLLEKVNKEAA

SEQ ID NO: 837537 - protein, 18 aa, Mycobacterium
LVDSAPKPLLEKVTKEAA

SEQ ID NO: 837538 - protein, 27 aa, Mycobacterium
LVDSNYLHVHAWRRAFDAEGIVVASWQ

SEQ ID NO: 837539 - protein, 17 aa, Mycobacterium
LVDSPLQVTMWTKRLRA

SEQ ID NO: 837540 - protein, 25 aa, Mycobacterium
LVDTIKARLPVWKHQFFADGTEEWV

SEQ ID NO: 837541 - protein, 26 aa, Mycobacterium
LVDTIKARLPVWKHQFFDDGTEEWVG

SEQ ID NO: 837542 - protein, 26 aa, Mycobacterium
LVDTIKARLPVWKHQFFGDGSEEWVG

SEQ ID NO: 837543 - protein, 23 aa, Mycobacterium
LVDTLQTLLPRDDRYRHAHGSRG

SEQ ID NO: 837544 - protein, 18 aa, Mycobacterium
LVDTYQLYIDGRWVEPEN

SEQ ID NO: 837545 - protein, 18 aa, Mycobacterium
LVDVPTPAGPFGRDEHPR

SEQ ID NO: 837546 - protein, 19 aa, Mycobacterium
LVDVPYLGPVLVDDLHRRV

SEQ ID NO: 837547 - protein, 18 aa, Mycobacterium
LVDVSFFVEARMAVPPWV

SEQ ID NO: 837548 - protein, 23 aa, Mycobacterium
LVDWHGWLFVDPSGQDADFATHV

SEQ ID NO: 837549 - protein, 17 aa, Mycobacterium
LVDWLDHAIELGASGIA

SEQ ID NO: 837550 - protein, 22 aa, Mycobacterium
LVDYLGDMAWYLDLITQKSKGG

SEQ ID NO: 837551 - protein, 19 aa, Mycobacterium
LVEALLAGFARRGRSVSVI

SEQ ID NO: 837552 - protein, 19 aa, Mycobacterium
LVEALWYSATLGSHRVASD

SEQ ID NO: 837553 - protein, 26 aa, Mycobacterium
LVEAPVLDADLLRRAKYSGLSDRQIS

SEQ ID NO: 837554 - protein, 19 aa, Mycobacterium
LVEASKFAEPLFTPATKAE

SEQ ID NO: 837555 - protein, 23 aa, Mycobacterium
LVEASKFGAPLFTPATKAALGDH

SEQ ID NO: 837556 - protein, 19 aa, Mycobacterium
LVEASKFSEPLFTPATKAA

SEQ ID NO: 837557 - protein, 23 aa, Mycobacterium
LVEAVRRRDGLPRIAQAIAAPAV

SEQ ID NO: 837558 - protein, 25 aa, Mycobacterium
LVEAVRRRDGLPRIAQAIAAPAVRR

SEQ ID NO: 837559 - protein, 25 aa, Mycobacterium
LVEAVRRRDGLPRIAQAVAAPAVRK

SEQ ID NO: 837560 - protein, 23 aa, Mycobacterium
LVEAWEYPWPPQRWRRYLQAQLD

SEQ ID NO: 837561 - protein, 19 aa, Mycobacterium
LVEAYLRGPMRGAVSPPNN

SEQ ID NO: 837562 - protein, 19 aa, Mycobacterium
LVEEETLLLGVAGVLVCER

SEQ ID NO: 837563 - protein, 18 aa, Mycobacterium
LVEEWVRLSQRSLTPPRV

SEQ ID NO: 837564 - protein, 24 aa, Mycobacterium
LVEFALRIMLSFFVSPNEATRSRD

SEQ ID NO: 837565 - protein, 25 aa, Mycobacterium
LVEFTLRIMLSFFVAPNEATRSREE

SEQ ID NO: 837566 - protein, 26 aa, Mycobacterium
LVEFVRSACRWTPRVAFVNGHGGNVD

SEQ ID NO: 837567 - protein, 23 aa, Mycobacterium
LVEGRRLAKFVGLPGADKGTQKR

SEQ ID NO: 837568 - protein, 24 aa, Mycobacterium
LVEGTWRPTFPAATYLFHHTELKY

SEQ ID NO: 837569 - protein, 28 aa, Mycobacterium
LVEHDLLPDVLYTSLLRRAITTAHLALD

SEQ ID NO: 837570 - protein, 28 aa, Mycobacterium
LVEHFALPIPSLVICELLGVPYADRDDF

SEQ ID NO: 837571 - protein, 18 aa, Mycobacterium
LVEKVFPASRRRGWRRPR

SEQ ID NO: 837572 - protein, 17 aa, Mycobacterium
LVELFAEQGRQVGVPLD

SEQ ID NO: 837573 - protein, 23 aa, Mycobacterium
LVELGLDIHLDWNRGIELISPIP

SEQ ID NO: 837574 - protein, 17 aa, Mycobacterium
LVELPTYAFDRRRFWLS

SEQ ID NO: 837575 - protein, 32 aa, Mycobacterium
LVELPTYAFQRQRFWLPPAPTGSVDPAGLGLG

SEQ ID NO: 837576 - protein, 21 aa, Mycobacterium
LVENFLRMTFGLPAEPYEVDP

SEQ ID NO: 837577 - protein, 26 aa, Mycobacterium
LVENGALGALMWTAGRLPAAAPRISK

SEQ ID NO: 837578 - protein, 29 aa, Mycobacterium
LVEPLAEYHRLWEPKIPLGRLGRPDELTG

SEQ ID NO: 837579 - protein, 18 aa, Mycobacterium
LVEPPRMPNLPVSRRRVL

SEQ ID NO: 837580 - protein, 17 aa, Mycobacterium
LVEPVLASCALPGVLPP

SEQ ID NO: 837581 - protein, 19 aa, Mycobacterium
LVEQFLTQFYGEQAELGSA

SEQ ID NO: 837582 - protein, 30 aa, Mycobacterium
LVEQHLPGVKYLWPQGTYLAWLDCRALGFD

SEQ ID NO: 837583 - protein, 18 aa, Mycobacterium
LVEQKLYERGVRSFLLDG

SEQ ID NO: 837584 - protein, 27 aa, Mycobacterium
LVEQPDVFPWFAKSIPFYRDYYRDEAD

SEQ ID NO: 837585 - protein, 19 aa, Mycobacterium
LVEQYRAEPKPPVDAPILA

SEQ ID NO: 837586 - protein, 19 aa, Mycobacterium
LVERADVVKISDEDLRWLD

SEQ ID NO: 837587 - protein, 31 aa, Mycobacterium
LVERAYLLDLTAPELTALIGGLRALGANHGG

SEQ ID NO: 837588 - protein, 18 aa, Mycobacterium
LVERRLSFIGLTGAEILA

SEQ ID NO: 837589 - protein, 20 aa, Mycobacterium
LVERSNALLRAIQLEAEATR

SEQ ID NO: 837590 - protein, 32 aa, Mycobacterium
LVESSPPYLELTPDPWLVAVFREEMESFGRTP

SEQ ID NO: 837591 - protein, 17 aa, Mycobacterium
LVETARLWLSLGHHDRH

SEQ ID NO: 837592 - protein, 17 aa, Mycobacterium
LVETFPARLARGRGIPP

SEQ ID NO: 837593 - protein, 19 aa, Mycobacterium
LVETLVPRLSAAGLSVAVI

SEQ ID NO: 837594 - protein, 17 aa, Mycobacterium
LVEVNPLVRDPKDQILA

SEQ ID NO: 837595 - protein, 20 aa, Mycobacterium
LVEVVLPRLEIPPLLVELVQ

SEQ ID NO: 837596 - protein, 17 aa, Mycobacterium
LVFEPLAASLAAEHIDE

SEQ ID NO: 837597 - protein, 19 aa, Mycobacterium
LVFETGLPTRYYIDPTDVA

SEQ ID NO: 837598 - protein, 27 aa, Mycobacterium
LVFGPSAPLRLLLVNGVPVVADDELRT

SEQ ID NO: 837599 - protein, 30 aa, Mycobacterium
LVFRHGLQLFGAMGFTWENDLQFALKRAKA

SEQ ID NO: 837600 - protein, 17 aa, Mycobacterium
LVFSGRFFDAEEALALG

SEQ ID NO: 837601 - protein, 31 aa, Mycobacterium
LVFSKIRTEILPRLATYPRIRIWIAGCATGE

SEQ ID NO: 837602 - protein, 17 aa, Mycobacterium
LVFSMPAGARELIRAFW

SEQ ID NO: 837603 - protein, 19 aa, Mycobacterium
LVFSVRTFSKIVAPGLRVG

SEQ ID NO: 837604 - protein, 20 aa, Mycobacterium
LVFVHPWQVLGSDRLTKYGL

SEQ ID NO: 837605 - protein, 18 aa, Mycobacterium
LVGAARALLTARPDLRRA

SEQ ID NO: 837606 - protein, 18 aa, Mycobacterium
LVGACDIVVAGRASTFAL

SEQ ID NO: 837607 - protein, 17 aa, Mycobacterium
LVGAFDQSMMVGADVVG

SEQ ID NO: 837608 - protein, 47 aa, Mycobacterium
LVGAHYEIFIPEFPVLNFDLNIPVDIPIYLDLGSLALNGFTIPTITI

SEQ ID NO: 837609 - protein, 17 aa, Mycobacterium
LVGALKRHKNKPVLFLG

SEQ ID NO: 837610 - protein, 18 aa, Mycobacterium
LVGFGQLPTPLTGQGSQD

SEQ ID NO: 837611 - protein, 18 aa, Mycobacterium
LVGFLDANSRYVVGVPGG

SEQ ID NO: 837612 - protein, 20 aa, Mycobacterium
LVGFPPEFGLRRLTDDAFRA

SEQ ID NO: 837613 - protein, 19 aa, Mycobacterium
LVGHDFFLFHDKESDRPCV

SEQ ID NO: 837614 - protein, 20 aa, Mycobacterium
LVGHDFFLFHDKHTERPCVV

SEQ ID NO: 837615 - protein, 24 aa, Mycobacterium
LVGHSQGGLLIKNFVAQDKSDSVA

SEQ ID NO: 837616 - protein, 27 aa, Mycobacterium
LVGIYFDVICDLQPVNRARLVLWAQAV

SEQ ID NO: 837617 - protein, 17 aa, Mycobacterium
LVGLGPDGGPGVADSWK

SEQ ID NO: 837618 - protein, 17 aa, Mycobacterium
LVGLRLSGKKVVVVGGG

SEQ ID NO: 837619 - protein, 17 aa, Mycobacterium
LVGLSWEAMRLGDLALG

SEQ ID NO: 837620 - protein, 32 aa, Mycobacterium
LVGMGRALIAPLRIGLQKAGVPVLLNTALTDL

SEQ ID NO: 837621 - protein, 27 aa, Mycobacterium
LVGMGRALIAPLRIGLREAGVPVLLNT

SEQ ID NO: 837622 - protein, 27 aa, Mycobacterium
LVGMGRALIGPLRIGLQRAGVPVVLNT

SEQ ID NO: 837623 - protein, 27 aa, Mycobacterium
LVGMGRALIGPLRIGLRQAGVPVLLNT

SEQ ID NO: 837624 - protein, 30 aa, Mycobacterium
LVGNAPVVFARFPEQWQKLLDDRSKIPAAV

SEQ ID NO: 837625 - protein, 24 aa, Mycobacterium
LVGNNFPVFFIQDGIKFPDFVHAV

SEQ ID NO: 837626 - protein, 25 aa, Mycobacterium
LVGNNLAVFFIRDAIKFPDVIHALK

SEQ ID NO: 837627 - protein, 24 aa, Mycobacterium
LVGNNMPVFFIQDGIKFPDVVHAA

SEQ ID NO: 837628 - protein, 17 aa, Mycobacterium
LVGNYRTADNRWLVLAM

SEQ ID NO: 837629 - protein, 27 aa, Mycobacterium
LVGPASARLFVASALARLGPLLVVTAT

SEQ ID NO: 837630 - protein, 22 aa, Mycobacterium
LVGPFRVRIPLTFSVPDGHELV

SEQ ID NO: 837631 - protein, 26 aa, Mycobacterium
LVGPHLLLALMSPYMSPGARTVLVGS

SEQ ID NO: 837632 - protein, 17 aa, Mycobacterium
LVGQLDMPFIADESVPT

SEQ ID NO: 837633 - protein, 22 aa, Mycobacterium
LVGQPFLLTAGFFETHRPYPQD

SEQ ID NO: 837634 - protein, 27 aa, Mycobacterium
LVGQSKSWRAVAHRVSRHIATREPILV

SEQ ID NO: 837635 - protein, 24 aa, Mycobacterium
LVGQVSMTAQWWLDAREPKKEVVA

SEQ ID NO: 837636 - protein, 26 aa, Mycobacterium
LVGRADLVLPMWQRLESAWGPARDVR

SEQ ID NO: 837637 - protein, 26 aa, Mycobacterium
LVGRADLVLPMWQRLESTWGPARDVR

SEQ ID NO: 837638 - protein, 18 aa, Mycobacterium
LVGRAYLYGLMAGGAAGV

SEQ ID NO: 837639 - protein, 17 aa, Mycobacterium
LVGRFLLKGGETVWVDG

SEQ ID NO: 837640 - protein, 20 aa, Mycobacterium
LVGRGPGYRYLRARGNSIEG

SEQ ID NO: 837641 - protein, 18 aa, Mycobacterium
LVGRLLREHPRIVHRRSL

SEQ ID NO: 837642 - protein, 20 aa, Mycobacterium
LVGRLMSYKLDRSKPLWELW

SEQ ID NO: 837643 - protein, 34 aa, Mycobacterium
LVGRLMSYPLERSRPLWEMWFIEGLEGGRAATLT

SEQ ID NO: 837644 - protein, 21 aa, Mycobacterium
LVGRRIAFLATDGVEKVELEQ

SEQ ID NO: 837645 - protein, 17 aa, Mycobacterium
LVGSPRWREVATARGEV

SEQ ID NO: 837646 - protein, 25 aa, Mycobacterium
LVGSVSMAAQWWLDVREPKKEVVAA

SEQ ID NO: 837647 - protein, 28 aa, Mycobacterium
LVGTGRWAAIVARTWFATAAPPAGTRTV

SEQ ID NO: 837648 - protein, 19 aa, Mycobacterium
LVGTLEYGALLPADAPAVT

SEQ ID NO: 837649 - protein, 21 aa, Mycobacterium
LVGTRFWACPEALVSPRAHQR

SEQ ID NO: 837650 - protein, 24 aa, Mycobacterium
LVGTSIIYPTRLTVPGAAGLRAAW

SEQ ID NO: 837651 - protein, 32 aa, Mycobacterium
LVGVAILSRGKPDLAWFPELARRLDGAARGDA

SEQ ID NO: 837652 - protein, 21 aa, Mycobacterium
LVHAALVHTLPPLPEARSGRS

SEQ ID NO: 837653 - protein, 18 aa, Mycobacterium
LVHALRQGGFRPEDAVYL

SEQ ID NO: 837654 - protein, 17 aa, Mycobacterium
LVHDAARALTPPALVVR

SEQ ID NO: 837655 - protein, 18 aa, Mycobacterium
LVHDAARALTPPALVVRL

SEQ ID NO: 837656 - protein, 17 aa, Mycobacterium
LVHDAARALTPPSLVAR

SEQ ID NO: 837657 - protein, 17 aa, Mycobacterium
LVHDIADTAYLIEQAYA

SEQ ID NO: 837658 - protein, 25 aa, Mycobacterium
LVHDIGWPIFSQQTLEGVLGALHRG

SEQ ID NO: 837659 - protein, 18 aa, Mycobacterium
LVHDMQHYFVKAYAPQDD

SEQ ID NO: 837660 - protein, 19 aa, Mycobacterium
LVHFLHREGFVTGVQPDRL

SEQ ID NO: 837661 - protein, 24 aa, Mycobacterium
LVHGDLYGTVLFAGAAAPGITDIT

SEQ ID NO: 837662 - protein, 18 aa, Mycobacterium
LVHGFWGGAAHWGNVIVE

SEQ ID NO: 837663 - protein, 17 aa, Mycobacterium
LVHGKGEKLRVVPLGDD

SEQ ID NO: 837664 - protein, 27 aa, Mycobacterium
LVHGTPYSSYLWRDIAPALAQHRSVYV

SEQ ID NO: 837665 - protein, 19 aa, Mycobacterium
LVHHGKLPAGVGRALIAVG

SEQ ID NO: 837666 - protein, 17 aa, Mycobacterium
LVHIGGVFRVLQCIAEA

SEQ ID NO: 837667 - protein, 19 aa, Mycobacterium
LVHLVRARCGVRARRRCVR

SEQ ID NO: 837668 - protein, 24 aa, Mycobacterium
LVHPGDLVILIAYGTMQDAEARAY

SEQ ID NO: 837669 - protein, 20 aa, Mycobacterium
LVHPLSWHRRTPGPPGLVLG

SEQ ID NO: 837670 - protein, 18 aa, Mycobacterium
LVHPPGPNATICADCAGV

SEQ ID NO: 837671 - protein, 17 aa, Mycobacterium
LVHQPRYSIFDRRIEQN

SEQ ID NO: 837672 - protein, 20 aa, Mycobacterium
LVHRLAGCPDDFLAPPLIGD

SEQ ID NO: 837673 - protein, 26 aa, Mycobacterium
LVHRREEFRASRIMLERARANDKITI

SEQ ID NO: 837674 - protein, 31 aa, Mycobacterium
LVHTLLGMLRRRLGLDTAWIASFRSGMQVFE

SEQ ID NO: 837675 - protein, 25 aa, Mycobacterium
LVHVGFGHGLWGFTDALRAAGWDPP

SEQ ID NO: 837676 - protein, 17 aa, Mycobacterium
LVHVLLARHGLLRGLRL

SEQ ID NO: 837677 - protein, 19 aa, Mycobacterium
LVIAGRWLCPRNPLTGQLP

SEQ ID NO: 837678 - protein, 19 aa, Mycobacterium
LVIATGLVPRRIPSIPDLE

SEQ ID NO: 837679 - protein, 18 aa, Mycobacterium
LVICGRKKELITVAGRNI

SEQ ID NO: 837680 - protein, 26 aa, Mycobacterium
LVIENYYLPIAAYEAALRQAGFHDFV

SEQ ID NO: 837681 - protein, 18 aa, Mycobacterium
LVIGMVRCRIPVIAAVNG

SEQ ID NO: 837682 - protein, 17 aa, Mycobacterium
LVIGWLLQQQAAVAVQA

SEQ ID NO: 837683 - protein, 18 aa, Mycobacterium
LVIIPTYNERENLPLIHR

SEQ ID NO: 837684 - protein, 26 aa, Mycobacterium
LVIKEALRLLAPVPLVMRKTVRDVAI

SEQ ID NO: 837685 - protein, 19 aa, Mycobacterium
LVIKSATIGRPDLRGLITS

SEQ ID NO: 837686 - protein, 18 aa, Mycobacterium
LVILTNHLPVPIPVNERE

SEQ ID NO: 837687 - protein, 18 aa, Mycobacterium
LVIQLPIGAENDFIGIID

SEQ ID NO: 837688 - protein, 19 aa, Mycobacterium
LVIRWHAPVIIDGADPKRV

SEQ ID NO: 837689 - protein, 17 aa, Mycobacterium
LVISSPRRRSLVTAELA

SEQ ID NO: 837690 - protein, 17 aa, Mycobacterium
LVITIPVSDAPYLGFQL

SEQ ID NO: 837691 - protein, 19 aa, Mycobacterium
LVIVCTRPERQWRIARLSG

SEQ ID NO: 837692 - protein, 23 aa, Mycobacterium
LVIVVGPGHKWAHRRKPVTLREL

SEQ ID NO: 837693 - protein, 22 aa, Mycobacterium
LVKALLFSVFEGGLRHGLFHGD

SEQ ID NO: 837694 - protein, 18 aa, Mycobacterium
LVKALVLSPPLPGVGDRV

SEQ ID NO: 837695 - protein, 20 aa, Mycobacterium
LVKAVPLQSLLLNRMMVDKV

SEQ ID NO: 837696 - protein, 21 aa, Mycobacterium
LVKCGPWHRGGWDPIPERPGC

SEQ ID NO: 837697 - protein, 24 aa, Mycobacterium
LVKDTHGATLRFAPPLVITEGEID

SEQ ID NO: 837698 - protein, 18 aa, Mycobacterium
LVKGFYRRPLKVSGAEDA

SEQ ID NO: 837699 - protein, 17 aa, Mycobacterium
LVKGFYRRPLMVSGKED

SEQ ID NO: 837700 - protein, 29 aa, Mycobacterium
LVKIDPGFPLVPAALLACAVPTGYGSAAR

SEQ ID NO: 837701 - protein, 30 aa, Mycobacterium
LVKIDQTFPLVPAALLACAIPTGYGSAARR

SEQ ID NO: 837702 - protein, 17 aa, Mycobacterium
LVKITPMDFMRDVLLWG

SEQ ID NO: 837703 - protein, 19 aa, Mycobacterium
LVKLGLTPLFFTVEGHLSD

SEQ ID NO: 837704 - protein, 18 aa, Mycobacterium
LVKLIPGPDWGCGASVIG

SEQ ID NO: 837705 - protein, 19 aa, Mycobacterium
LVKSFLLQVSAEVLRRFGF

SEQ ID NO: 837706 - protein, 24 aa, Mycobacterium
LVKTPMIAPSRRLNPVPPISAEHA

SEQ ID NO: 837707 - protein, 17 aa, Mycobacterium
LVLAALDDRIRAGLEST

SEQ ID NO: 837708 - protein, 18 aa, Mycobacterium
LVLAGRIHAYEGHDLRHV

SEQ ID NO: 837709 - protein, 17 aa, Mycobacterium
LVLASRGTPLWATATNG

SEQ ID NO: 837710 - protein, 18 aa, Mycobacterium
LVLAVNSLAVRHVTESLF

SEQ ID NO: 837711 - protein, 18 aa, Mycobacterium
LVLDALGRLLRKENLITD

SEQ ID NO: 837712 - protein, 18 aa, Mycobacterium
LVLDALKAGASGWCTAAP

SEQ ID NO: 837713 - protein, 19 aa, Mycobacterium
LVLDALKAGASGWCTAAPN

SEQ ID NO: 837714 - protein, 21 aa, Mycobacterium
LVLDALTMLGAIGFTWEHDVH

SEQ ID NO: 837715 - protein, 17 aa, Mycobacterium
LVLDDADLAGACSMAAF

SEQ ID NO: 837716 - protein, 17 aa, Mycobacterium
LVLDDADLTGACSMAAF

SEQ ID NO: 837717 - protein, 19 aa, Mycobacterium
LVLDGLRLAARIIGARHAH

SEQ ID NO: 837718 - protein, 19 aa, Mycobacterium
LVLDLQGLRFFGTDGLVAL

SEQ ID NO: 837719 - protein, 28 aa, Mycobacterium
LVLDTMSFYRPTQPGSYPIVLATYEIVC

SEQ ID NO: 837720 - protein, 22 aa, Mycobacterium
LVLEALTMLGAIGFTWEHDLHL

SEQ ID NO: 837721 - protein, 17 aa, Mycobacterium
LVLELRAHFRALSAWLT

SEQ ID NO: 837722 - protein, 18 aa, Mycobacterium
LVLEMSARHPGNIAALAE

SEQ ID NO: 837723 - protein, 31 aa, Mycobacterium
LVLEPGMAFSIEPGVYFPGQWGARIEDIVVI

SEQ ID NO: 837724 - protein, 17 aa, Mycobacterium
LVLGDWPAQEAVTGQLP

SEQ ID NO: 837725 - protein, 18 aa, Mycobacterium
LVLKGGAIAWAAMGDANA

SEQ ID NO: 837726 - protein, 17 aa, Mycobacterium
LVLLAAGPAAVATIEAL

SEQ ID NO: 837727 - protein, 18 aa, Mycobacterium
LVLLEAVAMSSPVIYCDP

SEQ ID NO: 837728 - protein, 17 aa, Mycobacterium
LVLLSRHPEGLSADHLA

SEQ ID NO: 837729 - protein, 18 aa, Mycobacterium
LVLMVAPLAPHLAEELWK

SEQ ID NO: 837730 - protein, 35 aa, Mycobacterium
LVLNTLCPHLARPVPFIYPLQTRFDRAYAGLGIGV

SEQ ID NO: 837731 - protein, 19 aa, Mycobacterium
LVLPALLRERGITGRDAAF

SEQ ID NO: 837732 - protein, 18 aa, Mycobacterium
LVLPDHHPVVLAKRLATL

SEQ ID NO: 837733 - protein, 19 aa, Mycobacterium
LVLPIFRGKRHAQRLVRAA

SEQ ID NO: 837734 - protein, 17 aa, Mycobacterium
LVLQYKRHTLDAHDVRS

SEQ ID NO: 837735 - protein, 18 aa, Mycobacterium
LVLRLRSNASFSAPVLAP

SEQ ID NO: 837736 - protein, 25 aa, Mycobacterium
LVLSAAERVFLQRGFHATTVAQIAA

SEQ ID NO: 837737 - protein, 19 aa, Mycobacterium
LVLSEDYTRFLRPGEAEVG

SEQ ID NO: 837738 - protein, 17 aa, Mycobacterium
LVLSEVAYYLRADALAA

SEQ ID NO: 837739 - protein, 17 aa, Mycobacterium
LVLSKLRERLGFGELRW

SEQ ID NO: 837740 - protein, 17 aa, Mycobacterium
LVLSQLRERLGFGELRW

SEQ ID NO: 837741 - protein, 18 aa, Mycobacterium
LVLTKIVEILNAFTLTRP

SEQ ID NO: 837742 - protein, 17 aa, Mycobacterium
LVMAAAVADFRPAHPAT

SEQ ID NO: 837743 - protein, 17 aa, Mycobacterium
LVMAAAVADFRPAQVST

SEQ ID NO: 837744 - protein, 25 aa, Mycobacterium
LVMAEPLTYFFSDPAARDFVTGVAQ

SEQ ID NO: 837745 - protein, 18 aa, Mycobacterium
LVMGPWHDLDRRSRTHRR

SEQ ID NO: 837746 - protein, 18 aa, Mycobacterium
LVMHGFLHAQPHYQAMAL

SEQ ID NO: 837747 - protein, 20 aa, Mycobacterium
LVMLHEVAHHLCRAEPPHGR

SEQ ID NO: 837748 - protein, 17 aa, Mycobacterium
LVMPERDWDRWLDPDAP

SEQ ID NO: 837749 - protein, 18 aa, Mycobacterium
LVMPRSQLPPLLDVKLEE

SEQ ID NO: 837750 - protein, 18 aa, Mycobacterium
LVMQYVREKGLPAVAMCI

SEQ ID NO: 837751 - protein, 20 aa, Mycobacterium
LVMTATPIPRTVALTIYGDL

SEQ ID NO: 837752 - protein, 19 aa, Mycobacterium
LVMTATPIPRTVALTVFGD

SEQ ID NO: 837753 - protein, 18 aa, Mycobacterium
LVMTATPIPRTVALTVYG

SEQ ID NO: 837754 - protein, 18 aa, Mycobacterium
LVMTGIGGAGLLSTPTNR

SEQ ID NO: 837755 - protein, 23 aa, Mycobacterium
LVNALCVGVLRKEDLKLAFASGA

SEQ ID NO: 837756 - protein, 17 aa, Mycobacterium
LVNASHFSRLFKAVHGS

SEQ ID NO: 837757 - protein, 17 aa, Mycobacterium
LVNEPLWRVVQAHPSAA

SEQ ID NO: 837758 - protein, 42 aa, Mycobacterium
LVNEQLLSPPPMTVVRLSDYPYLVPLIDREMLRPTYVFAAVD

SEQ ID NO: 837759 - protein, 19 aa, Mycobacterium
LVNGIRVSGPFIADWSSAA

SEQ ID NO: 837760 - protein, 21 aa, Mycobacterium
LVNGYLAMPATFTPGPRVLSG

SEQ ID NO: 837761 - protein, 20 aa, Mycobacterium
LVNHVLPYSQLFGPNVAGTA

SEQ ID NO: 837762 - protein, 20 aa, Mycobacterium
LVNHVLPYSQLFGPNVVGTA

SEQ ID NO: 837763 - protein, 18 aa, Mycobacterium
LVNLINAYGPYAVGITGE

SEQ ID NO: 837764 - protein, 26 aa, Mycobacterium
LVNLPNWLSLTFRVDGGPWFHIDDTE

SEQ ID NO: 837765 - protein, 24 aa, Mycobacterium
LVNNAAVTFLRPLDEFPERRVRLM

SEQ ID NO: 837766 - protein, 18 aa, Mycobacterium
LVNPLRFGSGIKLKVFEA

SEQ ID NO: 837767 - protein, 24 aa, Mycobacterium
LVNPLYADFTGFPRLYITVSDTES

SEQ ID NO: 837768 - protein, 25 aa, Mycobacterium
LVNRDSEWFPLRNAIFTLPAVKGNR

SEQ ID NO: 837769 - protein, 20 aa, Mycobacterium
LVNRGLGLTLLPRIVASVFA

SEQ ID NO: 837770 - protein, 20 aa, Mycobacterium
LVNRRLQRPLSALRPELDSR

SEQ ID NO: 837771 - protein, 22 aa, Mycobacterium
LVNTGLPFLPVSTEAAFFGDIP

SEQ ID NO: 837772 - protein, 24 aa, Mycobacterium
LVNVHSVFSWLGGTGAYGASKAAL

SEQ ID NO: 837773 - protein, 23 aa, Mycobacterium
LVNVRYLSGFTGSNGALLVFADD

SEQ ID NO: 837774 - protein, 17 aa, Mycobacterium
LVNWNALAALSGTIVLL

SEQ ID NO: 837775 - protein, 25 aa, Mycobacterium
LVNYNTMYFALARRAAMRPGETVLV

SEQ ID NO: 837776 - protein, 25 aa, Mycobacterium
LVNYNTMYFALARRAAMRPGNTVLV

SEQ ID NO: 837777 - protein, 21 aa, Mycobacterium
LVPADFIGFSQPIDDLPTVEG

SEQ ID NO: 837778 - protein, 17 aa, Mycobacterium
LVPAGVVGELYLGGAQL

SEQ ID NO: 837779 - protein, 24 aa, Mycobacterium
LVPDDEVGLLRQAWLTATRARNAL

SEQ ID NO: 837780 - protein, 18 aa, Mycobacterium
LVPDHHICVVRTDQIVDI

SEQ ID NO: 837781 - protein, 32 aa, Mycobacterium
LVPDIPLRIQHRSGALWILNSAALGSVGLAGH

SEQ ID NO: 837782 - protein, 17 aa, Mycobacterium
LVPDRSAITFKIPNLWG

SEQ ID NO: 837783 - protein, 26 aa, Mycobacterium
LVPELLLIGQLIDRSGMAWCISNFGR

SEQ ID NO: 837784 - protein, 25 aa, Mycobacterium
LVPGDVRLLQRKPADWSYAEAAGIS

SEQ ID NO: 837785 - protein, 17 aa, Mycobacterium
LVPGGVPADFSFTPGLH

SEQ ID NO: 837786 - protein, 25 aa, Mycobacterium
LVPGPTALLAPAWVPWEQRVRPGDL

SEQ ID NO: 837787 - protein, 18 aa, Mycobacterium
LVPIPDLIRMATHAFHYL

SEQ ID NO: 837788 - protein, 18 aa, Mycobacterium
LVPLLKFEVLQALWRRGG

SEQ ID NO: 837789 - protein, 24 aa, Mycobacterium
LVPLPSKWRIAFGEPIHTADYATT

SEQ ID NO: 837790 - protein, 24 aa, Mycobacterium
LVPLPSKWRIAFGEPIYTADYGSG

SEQ ID NO: 837791 - protein, 22 aa, Mycobacterium
LVPMLAMRLTHFENLIDISRIE

SEQ ID NO: 837792 - protein, 21 aa, Mycobacterium
LVPPCWRRESTLARNCFGLLP

SEQ ID NO: 837793 - protein, 25 aa, Mycobacterium
LVPRAPEPHPGLLVTPVALAVKLKR

SEQ ID NO: 837794 - protein, 24 aa, Mycobacterium
LVPRRIPAFPELEGIRVLRSFDEC

SEQ ID NO: 837795 - protein, 26 aa, Mycobacterium
LVPRRRFEQWLNTVVLERIWQGVYCL

SEQ ID NO: 837796 - protein, 32 aa, Mycobacterium
LVPSLERILRALGLIGWKWTPNGDGIVLSGAL

SEQ ID NO: 837797 - protein, 17 aa, Mycobacterium
LVPSPQLIETHAAPLRA

SEQ ID NO: 837798 - protein, 17 aa, Mycobacterium
LVPVIPVVVVHDAADAV

SEQ ID NO: 837799 - protein, 17 aa, Mycobacterium
LVPVITDAQQLTTRELA

SEQ ID NO: 837800 - protein, 19 aa, Mycobacterium
LVPVNTPRLLCASCALTAE

SEQ ID NO: 837801 - protein, 26 aa, Mycobacterium
LVPVRVTHRVVGYLRRLLSGEVIDFI

SEQ ID NO: 837802 - protein, 17 aa, Mycobacterium
LVPVYPTCHYVMGGIPT

SEQ ID NO: 837803 - protein, 18 aa, Mycobacterium
LVPVYPTCHYVMGGIPTT

SEQ ID NO: 837804 - protein, 26 aa, Mycobacterium
LVPWQELARRTGATLRWYGVTDDGRI

SEQ ID NO: 837805 - protein, 23 aa, Mycobacterium
LVQAVLHGFLHRPDREPLSPKSV

SEQ ID NO: 837806 - protein, 23 aa, Mycobacterium
LVQDALFATLEPTTRRGTFDDGR

SEQ ID NO: 837807 - protein, 17 aa, Mycobacterium
LVQDRHFRLDWSRPHDV

SEQ ID NO: 837808 - protein, 33 aa, Mycobacterium
LVQEEFGCQIALVDLFRYPTVSSLAVYLSSREF

SEQ ID NO: 837809 - protein, 18 aa, Mycobacterium
LVQETYLRGWKAYARFEG

SEQ ID NO: 837810 - protein, 25 aa, Mycobacterium
LVQGEILRVYNQNGGPTGSLGYPTS

SEQ ID NO: 837811 - protein, 17 aa, Mycobacterium
LVQGVVARIDWARFLPL

SEQ ID NO: 837812 - protein, 17 aa, Mycobacterium
LVQIADFDRFVPADSVA

SEQ ID NO: 837813 - protein, 18 aa, Mycobacterium
LVQKRAIQIARENAKPVI

SEQ ID NO: 837814 - protein, 23 aa, Mycobacterium
LVQLRRHHGMLSFAAPPMRRTGD

SEQ ID NO: 837815 - protein, 18 aa, Mycobacterium
LVQLSRARALLLGRDYVI

SEQ ID NO: 837816 - protein, 20 aa, Mycobacterium
LVQRLRRILGAMTAAPARRV

SEQ ID NO: 837817 - protein, 24 aa, Mycobacterium
LVQSFAHGLAPYIPNIAGEHNEFS

SEQ ID NO: 837818 - protein, 39 aa, Mycobacterium
LVQTRKVTRFPIILLGTEYWSGLLDWIRGTMLPAGKVGE

SEQ ID NO: 837819 - protein, 18 aa, Mycobacterium
LVQVYVSGLRRKLEAHGP

SEQ ID NO: 837820 - protein, 27 aa, Mycobacterium
LVRADPTLSAWFRPGEYFGGSLGLHSE

SEQ ID NO: 837821 - protein, 28 aa, Mycobacterium
LVRAEVALLKILALQFIMSDPRHQETQA

SEQ ID NO: 837822 - protein, 30 aa, Mycobacterium
LVRAEVAVLKILALQFIMSDPRHLEAQARQ

SEQ ID NO: 837823 - protein, 25 aa, Mycobacterium
LVRAEVAVLKMLALQFIMSDHQHLQ

SEQ ID NO: 837824 - protein, 21 aa, Mycobacterium
LVRAEVVLLKTLALEFIMSDH

SEQ ID NO: 837825 - protein, 26 aa, Mycobacterium
LVRAHAHAIWLVQCDLDLKASMVELL

SEQ ID NO: 837826 - protein, 19 aa, Mycobacterium
LVRALLESMLRVDQRHVAL

SEQ ID NO: 837827 - protein, 17 aa, Mycobacterium
LVRALQPASYTGLDLNP

SEQ ID NO: 837828 - protein, 17 aa, Mycobacterium
LVRAVGVRLARHQESRS

SEQ ID NO: 837829 - protein, 28 aa, Mycobacterium
LVRDEPVPVRVLYLGKGLAKAVKWGPAE

SEQ ID NO: 837830 - protein, 25 aa, Mycobacterium
LVRDFTFEFPTRVISRLLGLPEDDL

SEQ ID NO: 837831 - protein, 18 aa, Mycobacterium
LVRDGLVLELLDYSGRAV

SEQ ID NO: 837832 - protein, 21 aa, Mycobacterium
LVRDGMALTMLRLLDDRAHGD

SEQ ID NO: 837833 - protein, 18 aa, Mycobacterium
LVRDLDLLILDEPTNHLD

SEQ ID NO: 837834 - protein, 23 aa, Mycobacterium
LVRDYTFEFPTRVISKLLGLPEE

SEQ ID NO: 837835 - protein, 18 aa, Mycobacterium
LVREAGDWCLQVHGGMGY

SEQ ID NO: 837836 - protein, 30 aa, Mycobacterium
LVREGVTSFKFFMAYKGVFLSDDGQILRGM

SEQ ID NO: 837837 - protein, 17 aa, Mycobacterium
LVREPDLLLLDEPFGAL

SEQ ID NO: 837838 - protein, 19 aa, Mycobacterium
LVREPQAFLLDEPLSNLDA

SEQ ID NO: 837839 - protein, 17 aa, Mycobacterium
LVRFLLGVQYANATSLI

SEQ ID NO: 837840 - protein, 18 aa, Mycobacterium
LVRGIYPTAVTIGAEGAA

SEQ ID NO: 837841 - protein, 18 aa, Mycobacterium
LVRHFGLQQLSVRYPDQL

SEQ ID NO: 837842 - protein, 17 aa, Mycobacterium
LVRHFYDRLQSVIQEKG

SEQ ID NO: 837843 - protein, 21 aa, Mycobacterium
LVRKVQLLPVPHGLSPARVAA

SEQ ID NO: 837844 - protein, 17 aa, Mycobacterium
LVRLGFNMRKSAGGLAL

SEQ ID NO: 837845 - protein, 24 aa, Mycobacterium
LVRLKCDRVWIIDPLDGTREFSTR

SEQ ID NO: 837846 - protein, 18 aa, Mycobacterium
LVRLLGEVGLRVATAWEF

SEQ ID NO: 837847 - protein, 18 aa, Mycobacterium
LVRLRVPFTISRSAIDDV

SEQ ID NO: 837848 - protein, 17 aa, Mycobacterium
LVRLSDEGLLRRTSFRG

SEQ ID NO: 837849 - protein, 23 aa, Mycobacterium
LVRLYCDGRLDDRFLRGRTSLPH

SEQ ID NO: 837850 - protein, 23 aa, Mycobacterium
LVRMTDAWPLRPDARILLCSSVS

SEQ ID NO: 837851 - protein, 19 aa, Mycobacterium
LVRMTPAPVLLVKQPTTAA

SEQ ID NO: 837852 - protein, 27 aa, Mycobacterium
LVRNGSRGMLWLEPLIEVATPNGRVGY

SEQ ID NO: 837853 - protein, 18 aa, Mycobacterium
LVRPGEEDLFWLGTAEAI

SEQ ID NO: 837854 - protein, 17 aa, Mycobacterium
LVRPHDIRVGRTPEMAI

SEQ ID NO: 837855 - protein, 30 aa, Mycobacterium
LVRPTQLNFVPRIWDMLFQEYQSRLDNRRA

SEQ ID NO: 837856 - protein, 17 aa, Mycobacterium
LVRPVPGVRIRTYAGTA

SEQ ID NO: 837857 - protein, 23 aa, Mycobacterium
LVRQIVTVANLLRRDRLVMSVLH

SEQ ID NO: 837858 - protein, 18 aa, Mycobacterium
LVRRAVGIDFPGWDPTTS

SEQ ID NO: 837859 - protein, 18 aa, Mycobacterium
LVRRGPGWIGGADPRREG

SEQ ID NO: 837860 - protein, 20 aa, Mycobacterium
LVRRHFGRHLVRGRSPVAPR

SEQ ID NO: 837861 - protein, 25 aa, Mycobacterium
LVRRQSLQLHYARTLDLWAAALAAH

SEQ ID NO: 837862 - protein, 20 aa, Mycobacterium
LVRRRWAAPTQLLLVHCGRL

SEQ ID NO: 837863 - protein, 17 aa, Mycobacterium
LVRRRWTRLGQQVFRAV

SEQ ID NO: 837864 - protein, 18 aa, Mycobacterium
LVRRWHWTAETDPVKVEH

SEQ ID NO: 837865 - protein, 23 aa, Mycobacterium
LVRSFVSSLLAKPFAILTGLAGS

SEQ ID NO: 837866 - protein, 19 aa, Mycobacterium
LVRSFYTNWFSLDSSVRDL

SEQ ID NO: 837867 - protein, 18 aa, Mycobacterium
LVRTAVTPALVSLAAEWT

SEQ ID NO: 837868 - protein, 17 aa, Mycobacterium
LVRTGFLAGDALRMLAG

SEQ ID NO: 837869 - protein, 18 aa, Mycobacterium
LVRTGFLAGDALRMLAGT

SEQ ID NO: 837870 - protein, 26 aa, Mycobacterium
LVRTKLFRDPGLFPTLPDIAAEVGLH

SEQ ID NO: 837871 - protein, 20 aa, Mycobacterium
LVRTLQFDPVVVRLLAEHKP

SEQ ID NO: 837872 - protein, 17 aa, Mycobacterium
LVRVAAVLNLTPESFIK

SEQ ID NO: 837873 - protein, 19 aa, Mycobacterium
LVRVGFIAGDGLRKLAHTS

SEQ ID NO: 837874 - protein, 24 aa, Mycobacterium
LVRVGLGRLFAVQQGVGDLVDPVV

SEQ ID NO: 837875 - protein, 18 aa, Mycobacterium
LVRVLKVGGTLAISVPRW

SEQ ID NO: 837876 - protein, 23 aa, Mycobacterium
LVSCMVALPTQLFRSTGIPVCLW

SEQ ID NO: 837877 - protein, 38 aa, Mycobacterium
LVSDERARHMLKFLSSPLWRAYISTYVEGYQLLKGWLD

SEQ ID NO: 837878 - protein, 17 aa, Mycobacterium
LVSDLPESGRWSPECIG

SEQ ID NO: 837879 - protein, 20 aa, Mycobacterium
LVSEFVCRLLNYMDAKGFDF

SEQ ID NO: 837880 - protein, 20 aa, Mycobacterium
LVSEFVCRLLNYMDDNGFDF

SEQ ID NO: 837881 - protein, 20 aa, Mycobacterium
LVSEYVCRLLNYMDAHGYDT

SEQ ID NO: 837882 - protein, 20 aa, Mycobacterium
LVSGDWRSITVDKLCAAAGL

SEQ ID NO: 837883 - protein, 19 aa, Mycobacterium
LVSGHHWGATGIKPRGPSD

SEQ ID NO: 837884 - protein, 35 aa, Mycobacterium
LVSGVAVPIYVAGRLWGFIAIGSVTGPLPADVERC

SEQ ID NO: 837885 - protein, 21 aa, Mycobacterium
LVSGWLHTHIRPGMVITAAAP

SEQ ID NO: 837886 - protein, 19 aa, Mycobacterium
LVSIVAYLLGSAALTDQEA

SEQ ID NO: 837887 - protein, 23 aa, Mycobacterium
LVSKAFTPRRIAALTSAIEDLAD

SEQ ID NO: 837888 - protein, 19 aa, Mycobacterium
LVSLKLLARRPYREPGQRS

SEQ ID NO: 837889 - protein, 19 aa, Mycobacterium
LVSLPELARIRDIFSQERL

SEQ ID NO: 837890 - protein, 23 aa, Mycobacterium
LVSLREELWRVVGGKVDSTVSAE

SEQ ID NO: 837891 - protein, 24 aa, Mycobacterium
LVSPWTEGLLFALGGPIYAGTNEI

SEQ ID NO: 837892 - protein, 28 aa, Mycobacterium
LVSQIAPLLGPMIQEMLFMQLRHMMETE

SEQ ID NO: 837893 - protein, 18 aa, Mycobacterium
LVSRDDCLALIAAGVDDW

SEQ ID NO: 837894 - protein, 19 aa, Mycobacterium
LVSRDECLALIGAGVDDWG

SEQ ID NO: 837895 - protein, 18 aa, Mycobacterium
LVSRDECLALVAAGVDDW

SEQ ID NO: 837896 - protein, 19 aa, Mycobacterium
LVSRFDIVLLDEPTNDLDL

SEQ ID NO: 837897 - protein, 20 aa, Mycobacterium
LVSRSECLALIGAGVDDWGG

SEQ ID NO: 837898 - protein, 25 aa, Mycobacterium
LVSSTLHDLVIGSGLLFVDRGAHQL

SEQ ID NO: 837899 - protein, 27 aa, Mycobacterium
LVSSVHAMFGLPGRPAYAAAKAGLTGL

SEQ ID NO: 837900 - protein, 17 aa, Mycobacterium
LVSVFLDKDFSFVVSSE

SEQ ID NO: 837901 - protein, 24 aa, Mycobacterium
LVSVHPIFNLYNKRWPIRGGAENL

SEQ ID NO: 837902 - protein, 17 aa, Mycobacterium
LVSVPPLIPCRRCDFCA

SEQ ID NO: 837903 - protein, 37 aa, Mycobacterium
LVTAARPPWPPLSYSQLAMWFHYRMRGANDVFNMALA

SEQ ID NO: 837904 - protein, 18 aa, Mycobacterium
LVTAELDALLRQVARRDA

SEQ ID NO: 837905 - protein, 18 aa, Mycobacterium
LVTALALAAGHHVTLRDT

SEQ ID NO: 837906 - protein, 18 aa, Mycobacterium
LVTANDYGLRLYNGDTGV

SEQ ID NO: 837907 - protein, 20 aa, Mycobacterium
LVTAQLARLPLLDQEPVSTE

SEQ ID NO: 837908 - protein, 17 aa, Mycobacterium
LVTASPAELLAGVRALA

SEQ ID NO: 837909 - protein, 18 aa, Mycobacterium
LVTDLAHGWIPSGISLPA

SEQ ID NO: 837910 - protein, 32 aa, Mycobacterium
LVTDSGSFRWATPRGHRLAARLLDLGADGVNI

SEQ ID NO: 837911 - protein, 20 aa, Mycobacterium
LVTEIPGPLSLELSKRRAAA

SEQ ID NO: 837912 - protein, 29 aa, Mycobacterium
LVTFTKPTLIAWGLGDYFFPLKYGQRLAE

SEQ ID NO: 837913 - protein, 17 aa, Mycobacterium
LVTGGCDAVMKLAPALA

SEQ ID NO: 837914 - protein, 22 aa, Mycobacterium
LVTGVPFCGFSSELLTGALQGS

SEQ ID NO: 837915 - protein, 18 aa, Mycobacterium
LVTGWARLHGYPLGILAN

SEQ ID NO: 837916 - protein, 23 aa, Mycobacterium
LVTHDRWFLDEIATTTWEVHDGI

SEQ ID NO: 837917 - protein, 24 aa, Mycobacterium
LVTKAAIEPVWYLPGVAARFGCSE

SEQ ID NO: 837918 - protein, 17 aa, Mycobacterium
LVTNDFPPRRGGIQSYL

SEQ ID NO: 837919 - protein, 18 aa, Mycobacterium
LVTNGTAFAVTPTLREAY

SEQ ID NO: 837920 - protein, 26 aa, Mycobacterium
LVTPELVRRLCWDWAPVAAAEITSTI

SEQ ID NO: 837921 - protein, 18 aa, Mycobacterium
LVTPWRTGLLLGVDEFEA

SEQ ID NO: 837922 - protein, 19 aa, Mycobacterium
LVTPWRTGLLLGVNEFEAR

SEQ ID NO: 837923 - protein, 24 aa, Mycobacterium
LVTRAYHLYAIPRNANRWAVALGY

SEQ ID NO: 837924 - protein, 23 aa, Mycobacterium
LVTRHRVPALLVERIDGVPVLES

SEQ ID NO: 837925 - protein, 18 aa, Mycobacterium
LVTRLHVTWTGEGAAAHA

SEQ ID NO: 837926 - protein, 38 aa, Mycobacterium
LVTRSYHLYAIPRGVNRWAVSLAYLTDVLFNRSVVSIG

SEQ ID NO: 837927 - protein, 17 aa, Mycobacterium
LVTRWAQLELGMSAWDL

SEQ ID NO: 837928 - protein, 17 aa, Mycobacterium
LVTRWLATYGFHRRALA

SEQ ID NO: 837929 - protein, 31 aa, Mycobacterium
LVTTGRLGLIPLRWALACLLIDIGSVTFSTR

SEQ ID NO: 837930 - protein, 33 aa, Mycobacterium
LVTTRHPISVWWTEIFRVLRPGGSYFAQHIGPA

SEQ ID NO: 837931 - protein, 19 aa, Mycobacterium
LVTVIVYEPHRTGTKTVSP

SEQ ID NO: 837932 - protein, 19 aa, Mycobacterium
LVTVLVGHLSLAIGHVRQF

SEQ ID NO: 837933 - protein, 19 aa, Mycobacterium
LVVADLPFGSYEAGPAAAL

SEQ ID NO: 837934 - protein, 18 aa, Mycobacterium
LVVADWPRPSGITLDPVA

SEQ ID NO: 837935 - protein, 17 aa, Mycobacterium
LVVAHRIGWDDESWQVF

SEQ ID NO: 837936 - protein, 19 aa, Mycobacterium
LVVAKWLVDRGAGRVVLNG

SEQ ID NO: 837937 - protein, 21 aa, Mycobacterium
LVVALERLGRWCVPGPVTESI

SEQ ID NO: 837938 - protein, 18 aa, Mycobacterium
LVVAMGRARRRLLVTAVD

SEQ ID NO: 837939 - protein, 17 aa, Mycobacterium
LVVARMPAFGLDGPWRE

SEQ ID NO: 837940 - protein, 19 aa, Mycobacterium
LVVARTRSMPAIPILAGTT

SEQ ID NO: 837941 - protein, 23 aa, Mycobacterium
LVVDGIRADCFWMMGPPTPADQV

SEQ ID NO: 837942 - protein, 19 aa, Mycobacterium
LVVDTDLRWRVVTALARAG

SEQ ID NO: 837943 - protein, 24 aa, Mycobacterium
LVVGHPYVDIWQAVKPERVGLTAW

SEQ ID NO: 837944 - protein, 33 aa, Mycobacterium
LVVGHPYVDIWQAVKPHRLGLKAWPSVPRHIEW

SEQ ID NO: 837945 - protein, 38 aa, Mycobacterium
LVVGHPYVDIWQAVKPQRLGLAAWPDVPRQVDWKHGAC

SEQ ID NO: 837946 - protein, 20 aa, Mycobacterium
LVVGPTPAFLDHIGRVLPSL

SEQ ID NO: 837947 - protein, 22 aa, Mycobacterium
LVVGRDGALLLGLMLSSRERLD

SEQ ID NO: 837948 - protein, 26 aa, Mycobacterium
LVVHDWGSALGFYRALRYPEQIAGIA

SEQ ID NO: 837949 - protein, 20 aa, Mycobacterium
LVVHLGMSGQMLLGPIRDTR

SEQ ID NO: 837950 - protein, 17 aa, Mycobacterium
LVVKPVTGSLRDGQSVL

SEQ ID NO: 837951 - protein, 20 aa, Mycobacterium
LVVLIDGELTWFVERGGRSL

SEQ ID NO: 837952 - protein, 17 aa, Mycobacterium
LVVLRAYWEFDKVAGTA

SEQ ID NO: 837953 - protein, 17 aa, Mycobacterium
LVVLTRGAVALPGEDVT

SEQ ID NO: 837954 - protein, 28 aa, Mycobacterium
LVVLVDGLGWHLLPELAADGALLASVLA

SEQ ID NO: 837955 - protein, 17 aa, Mycobacterium
LVVMMHGGFGNGAQAER

SEQ ID NO: 837956 - protein, 18 aa, Mycobacterium
LVVNKTDLAPLVGADLKV

SEQ ID NO: 837957 - protein, 19 aa, Mycobacterium
LVVNLRPSSIRRLGLTYEA

SEQ ID NO: 837958 - protein, 26 aa, Mycobacterium
LVVPIQLGAQWLQRAIRWAEDNGVDR

SEQ ID NO: 837959 - protein, 23 aa, Mycobacterium
LVVPTVELLALHSEVHRLCAPYL

SEQ ID NO: 837960 - protein, 19 aa, Mycobacterium
LVVPVLNARFALNAANARW

SEQ ID NO: 837961 - protein, 26 aa, Mycobacterium
LVVQLTLPRGSFLRAGAVIAADDTAA

SEQ ID NO: 837962 - protein, 18 aa, Mycobacterium
LVVQRMLASRFTAHALLG

SEQ ID NO: 837963 - protein, 26 aa, Mycobacterium
LVVQRMLASRFVPRALLGTDRRLTEL

SEQ ID NO: 837964 - protein, 24 aa, Mycobacterium
LVVRAIRPVANPALFLYAAISPEG

SEQ ID NO: 837965 - protein, 23 aa, Mycobacterium
LVVRMIRPVANPALYLYAAISPE

SEQ ID NO: 837966 - protein, 17 aa, Mycobacterium
LVVRPGEILVLTGPSGC

SEQ ID NO: 837967 - protein, 18 aa, Mycobacterium
LVVRRRITFLAKSEYFTG

SEQ ID NO: 837968 - protein, 18 aa, Mycobacterium
LVVRRTGIDTPWTPDRDL

SEQ ID NO: 837969 - protein, 20 aa, Mycobacterium
LVVRYLGPRYPLVSDVRRVS

SEQ ID NO: 837970 - protein, 19 aa, Mycobacterium
LVVSFLQQRDSRWLGRLTA

SEQ ID NO: 837971 - protein, 28 aa, Mycobacterium
LVVSHVTPIKMLLRLALDVGSEVLYRLH

SEQ ID NO: 837972 - protein, 18 aa, Mycobacterium
LVVSLAKRYTGRGMPLLD

SEQ ID NO: 837973 - protein, 25 aa, Mycobacterium
LVVSPNASPVFLKSGRRPPVATRGT

SEQ ID NO: 837974 - protein, 17 aa, Mycobacterium
LVVSPPPLAPMPHPWFQ

SEQ ID NO: 837975 - protein, 18 aa, Mycobacterium
LVVSQFTLYANTKKGRRP

SEQ ID NO: 837976 - protein, 22 aa, Mycobacterium
LVVSYRREALPRLQVWDIDPGG

SEQ ID NO: 837977 - protein, 23 aa, Mycobacterium
LVVTILAPLLRGQHTVWAGPLGF

SEQ ID NO: 837978 - protein, 19 aa, Mycobacterium
LVVVATPPAAQTGPVVVFT

SEQ ID NO: 837979 - protein, 18 aa, Mycobacterium
LVVVTADCVPVLMADARA

SEQ ID NO: 837980 - protein, 18 aa, Mycobacterium
LVVWLPDERICLCGNTFG

SEQ ID NO: 837981 - protein, 20 aa, Mycobacterium
LVVWLPDERICLCGNTFGPV

SEQ ID NO: 837982 - protein, 17 aa, Mycobacterium
LVVWLPEERICLCGNTF

SEQ ID NO: 837983 - protein, 18 aa, Mycobacterium
LVWLDRDPRTVPPLELPA

SEQ ID NO: 837984 - protein, 18 aa, Mycobacterium
LVWNMLLAARCEGYGGTF

SEQ ID NO: 837985 - protein, 20 aa, Mycobacterium
LVYAVLNLYPYNPGHLMVVP

SEQ ID NO: 837986 - protein, 17 aa, Mycobacterium
LVYGLGTLITGLPGVLS

SEQ ID NO: 837987 - protein, 22 aa, Mycobacterium
LVYGNAVLWKPASTVPLLAMRL

SEQ ID NO: 837988 - protein, 17 aa, Mycobacterium
LVYLHYQEEHPFAPVTV

SEQ ID NO: 837989 - protein, 23 aa, Mycobacterium
LVYPPGLEMIAALYACARIGVIA

SEQ ID NO: 837990 - protein, 17 aa, Mycobacterium
LVYSVGWTQHTLGAQFI

SEQ ID NO: 837991 - protein, 27 aa, Mycobacterium
LVYTYVPAMIEYYLREKPLLANVETYR

SEQ ID NO: 837992 - protein, 23 aa, Mycobacterium
LVYVADGILGGAISFGGHVWDHA

SEQ ID NO: 837993 - protein, 18 aa, Mycobacterium
LWAATFVRRRGAAADAIL

SEQ ID NO: 837994 - protein, 24 aa, Mycobacterium
LWAELITKHRGSITAAPNFAYSLL

SEQ ID NO: 837995 - protein, 30 aa, Mycobacterium
LWAIRREAAKPGSYRWLKGGRRPAQAPAAV

SEQ ID NO: 837996 - protein, 19 aa, Mycobacterium
LWAKLIDAGILSSASATAV

SEQ ID NO: 837997 - protein, 24 aa, Mycobacterium
LWAKVLRRQPLPLSLLATHPIDVS

SEQ ID NO: 837998 - protein, 17 aa, Mycobacterium
LWALRGLVQAAHGQCGA

SEQ ID NO: 837999 - protein, 25 aa, Mycobacterium
LWDASVIFASYPHFWELKRTRTESP

SEQ ID NO: 838000 - protein, 25 aa, Mycobacterium
LWDASVIFASYPHFYELKRTRTEPP

SEQ ID NO: 838001 - protein, 19 aa, Mycobacterium
LWDPPNRWRETRLGELAMT

SEQ ID NO: 838002 - protein, 26 aa, Mycobacterium
LWDQGQFIRECARVLRPGGSLLISTP

SEQ ID NO: 838003 - protein, 25 aa, Mycobacterium
LWDTEQQLLYWLDSADGRIFRATAD

SEQ ID NO: 838004 - protein, 19 aa, Mycobacterium
LWEAADLLRLPTSGPYVVV

SEQ ID NO: 838005 - protein, 20 aa, Mycobacterium
LWEHWGKPEIVWYPGGHTGF

SEQ ID NO: 838006 - protein, 24 aa, Mycobacterium
LWEPLRRYLEARGVVFRLGTGAAR

SEQ ID NO: 838007 - protein, 18 aa, Mycobacterium
LWEWLHYEEGIPISRRAI

SEQ ID NO: 838008 - protein, 23 aa, Mycobacterium
LWGATGARSIAALVAWKLGTSAG

SEQ ID NO: 838009 - protein, 22 aa, Mycobacterium
LWGDEWPWGLNRTISPVQHVLS

SEQ ID NO: 838010 - protein, 18 aa, Mycobacterium
LWGELKNPGERPKQMFLR

SEQ ID NO: 838011 - protein, 18 aa, Mycobacterium
LWGFYPLAATLNSRWPRA

SEQ ID NO: 838012 - protein, 17 aa, Mycobacterium
LWGGYRNGLTKDPWRPD

SEQ ID NO: 838013 - protein, 17 aa, Mycobacterium
LWGITYVVDDIDATAAF

SEQ ID NO: 838014 - protein, 18 aa, Mycobacterium
LWHPWCHADIWRTDPETE

SEQ ID NO: 838015 - protein, 17 aa, Mycobacterium
LWHSITWQYLSADERDA

SEQ ID NO: 838016 - protein, 30 aa, Mycobacterium
LWLDPAMTTPYAWYQYFFNTADADVIRYLR

SEQ ID NO: 838017 - protein, 30 aa, Mycobacterium
LWLDPEMTSPYAWYQYFINTADADVVPYLR

SEQ ID NO: 838018 - protein, 21 aa, Mycobacterium
LWMFKEWNPHDYVPWSDGRNF

SEQ ID NO: 838019 - protein, 24 aa, Mycobacterium
LWNDGAARMFGFTAADALGQSLDL

SEQ ID NO: 838020 - protein, 20 aa, Mycobacterium
LWNVLVDYWFRMEIDGWENI

SEQ ID NO: 838021 - protein, 27 aa, Mycobacterium
LWPDPNYSAVFRIKAGYLLAARAEDGL

SEQ ID NO: 838022 - protein, 19 aa, Mycobacterium
LWPWQRDFVDRAVSTPAAF

SEQ ID NO: 838023 - protein, 17 aa, Mycobacterium
LWQEPYVIYSQILAATR

SEQ ID NO: 838024 - protein, 19 aa, Mycobacterium
LWQITEFQHVKPGKGPAFV

SEQ ID NO: 838025 - protein, 18 aa, Mycobacterium
LWQRFKAAQDTFFSARNA

SEQ ID NO: 838026 - protein, 19 aa, Mycobacterium
LWQRPDIALALAQRYSFAY

SEQ ID NO: 838027 - protein, 27 aa, Mycobacterium
LWRDGTAPPLLGRGLMFHITDILGLRA

SEQ ID NO: 838028 - protein, 25 aa, Mycobacterium
LWRDYFDLFDFLVKAPLRALPGILV

SEQ ID NO: 838029 - protein, 19 aa, Mycobacterium
LWRDYFDMFDMFKATLRGL

SEQ ID NO: 838030 - protein, 19 aa, Mycobacterium
LWRHPDDQSWRYKDLSYWT

SEQ ID NO: 838031 - protein, 30 aa, Mycobacterium
LWRRQEDIYNPLRFLRAGMKWCRKAQELGT

SEQ ID NO: 838032 - protein, 30 aa, Mycobacterium
LWRRRVGIIGTFAFIRRGDAVPLLSMAPLL

SEQ ID NO: 838033 - protein, 21 aa, Mycobacterium
LWRVATLLAAGVRVALSTDAP

SEQ ID NO: 838034 - protein, 17 aa, Mycobacterium
LWSAPHGAGRRFSRTKA

SEQ ID NO: 838035 - protein, 18 aa, Mycobacterium
LWSDVDEICRLLRGGKSV

SEQ ID NO: 838036 - protein, 25 aa, Mycobacterium
LWSGIPLRFPRLNITLAEGGLGWAA

SEQ ID NO: 838037 - protein, 19 aa, Mycobacterium
LWSIVEFQHVKPGKGPAFV

SEQ ID NO: 838038 - protein, 18 aa, Mycobacterium
LWSLAVDPAASLPGVGAA

SEQ ID NO: 838039 - protein, 18 aa, Mycobacterium
LWSPVLACAIGHGVLPRL

SEQ ID NO: 838040 - protein, 18 aa, Mycobacterium
LWSTFMQKWISYTAEVIE

SEQ ID NO: 838041 - protein, 17 aa, Mycobacterium
LWTQKRSIYARGEGGFG

SEQ ID NO: 838042 - protein, 18 aa, Mycobacterium
LWTSWAHHATRCIVLART

SEQ ID NO: 838043 - protein, 17 aa, Mycobacterium
LWVCLHEVTHRVQFRAN

SEQ ID NO: 838044 - protein, 26 aa, Mycobacterium
LWVHTDEQWRWLANTLTVEFLKELLP

SEQ ID NO: 838045 - protein, 18 aa, Mycobacterium
LWVRDAGRRRLDYPALAA

SEQ ID NO: 838046 - protein, 23 aa, Mycobacterium
LWVSAHPLWGFWGAGRITGRPAT

SEQ ID NO: 838047 - protein, 21 aa, Mycobacterium
LWVTDLTFVPTWAGVAYVCFI

SEQ ID NO: 838048 - protein, 25 aa, Mycobacterium
LWWDREHGYLIRDSPLRPGQVAIVS

SEQ ID NO: 838049 - protein, 18 aa, Mycobacterium
LYAASEWLHRETTRIGQT

SEQ ID NO: 838050 - protein, 17 aa, Mycobacterium
LYAGAMFHDIGLTDGYR

SEQ ID NO: 838051 - protein, 34 aa, Mycobacterium
LYALCTAKLAHFKAPKAFIFVSHIQRLGNGKPNY

SEQ ID NO: 838052 - protein, 18 aa, Mycobacterium
LYALRDITGTVESIPLIA

SEQ ID NO: 838053 - protein, 17 aa, Mycobacterium
LYALRDITGTVESLPLI

SEQ ID NO: 838054 - protein, 18 aa, Mycobacterium
LYAMGRGDLAGRLGAALA

SEQ ID NO: 838055 - protein, 18 aa, Mycobacterium
LYAPFSHQQLILAEAIGL

SEQ ID NO: 838056 - protein, 25 aa, Mycobacterium
LYAVSSLPRNGRWNALARLALREDL

SEQ ID NO: 838057 - protein, 19 aa, Mycobacterium
LYAVVWHGHRLAKRRSIGF

SEQ ID NO: 838058 - protein, 20 aa, Mycobacterium
LYAYLHDQTLRLINQGHTGI

SEQ ID NO: 838059 - protein, 22 aa, Mycobacterium
LYCCLPLYHNNALTVALSSVIT

SEQ ID NO: 838060 - protein, 17 aa, Mycobacterium
LYCCLPLYHNNALTVSV

SEQ ID NO: 838061 - protein, 19 aa, Mycobacterium
LYCDVWIDSIRKAHGTDII

SEQ ID NO: 838062 - protein, 29 aa, Mycobacterium
LYCERNWGAGFPRRWWWGQAHDFGDADVS

SEQ ID NO: 838063 - protein, 36 aa, Mycobacterium
LYCGEWIHSHVLHICLLHAPDFLGYPDAIAFARDER

SEQ ID NO: 838064 - protein, 17 aa, Mycobacterium
LYCVNYAHRAAVRIAAD

SEQ ID NO: 838065 - protein, 18 aa, Mycobacterium
LYDAAYHSELAWWTTPFA

SEQ ID NO: 838066 - protein, 17 aa, Mycobacterium
LYDADFGRYGWPETAGG

SEQ ID NO: 838067 - protein, 20 aa, Mycobacterium
LYDADWMRYGWPAEVGGLGG

SEQ ID NO: 838068 - protein, 22 aa, Mycobacterium
LYDAPEVVIPMLVPDGAHTYPD

SEQ ID NO: 838069 - protein, 24 aa, Mycobacterium
LYDDARLLVYAITQVWNLTDYRML

SEQ ID NO: 838070 - protein, 17 aa, Mycobacterium
LYDFITNEALPGTGVDA

SEQ ID NO: 838071 - protein, 26 aa, Mycobacterium
LYDGFSFNCLSWIEALGFCGIGEAKD

SEQ ID NO: 838072 - protein, 26 aa, Mycobacterium
LYDGFTFNCLSWLEALGFCGIGESKD

SEQ ID NO: 838073 - protein, 19 aa, Mycobacterium
LYDGMLRRETNRHTGERAE

SEQ ID NO: 838074 - protein, 25 aa, Mycobacterium
LYDIRTMFGVLFQDGALFGSMNLYD

SEQ ID NO: 838075 - protein, 17 aa, Mycobacterium
LYDKFPALTPDQAAGVI

SEQ ID NO: 838076 - protein, 18 aa, Mycobacterium
LYDKFPALTPEQAAGVIA

SEQ ID NO: 838077 - protein, 18 aa, Mycobacterium
LYDRVGFAAVGRFNEFDN

SEQ ID NO: 838078 - protein, 18 aa, Mycobacterium
LYDRVGFAAVGRFNEFNN

SEQ ID NO: 838079 - protein, 29 aa, Mycobacterium
LYDSDYHSELFWWTADFVATEGIPRSALV

SEQ ID NO: 838080 - protein, 18 aa, Mycobacterium
LYEAGAAAIFPPGTVIAD

SEQ ID NO: 838081 - protein, 41 aa, Mycobacterium
LYEARGAASCFPTLLRKGERLLVFLPLAHVLARSLSMSAFA

SEQ ID NO: 838082 - protein, 23 aa, Mycobacterium
LYECCASRIWAVRVAAGRPFRDE

SEQ ID NO: 838083 - protein, 18 aa, Mycobacterium
LYEDLALVRPTELNFVPR

SEQ ID NO: 838084 - protein, 24 aa, Mycobacterium
LYEERYVLLVPPDMVPAGASTVRW

SEQ ID NO: 838085 - protein, 18 aa, Mycobacterium
LYEGLNSLPLLIPDQRPD

SEQ ID NO: 838086 - protein, 17 aa, Mycobacterium
LYEHQVFTEGVIWGIDS

SEQ ID NO: 838087 - protein, 25 aa, Mycobacterium
LYEIRKLFGVMFQDGALFGSMNLYD

SEQ ID NO: 838088 - protein, 26 aa, Mycobacterium
LYEIRTLFGVLFQDGALFGSMNIYDN

SEQ ID NO: 838089 - protein, 26 aa, Mycobacterium
LYEIRTLFGVLFQDGALFGSMNLFDN

SEQ ID NO: 838090 - protein, 26 aa, Mycobacterium
LYEIRTLFGVLFQDGALFGSMNLYDN

SEQ ID NO: 838091 - protein, 26 aa, Mycobacterium
LYELGGNVLCYVLLDNTPADVTTTNG

SEQ ID NO: 838092 - protein, 18 aa, Mycobacterium
LYELPIPVIAAVNGVAVG

SEQ ID NO: 838093 - protein, 23 aa, Mycobacterium
LYEREVRFYAEVAPRLGGPIAPC

SEQ ID NO: 838094 - protein, 18 aa, Mycobacterium
LYERGVRSFLLDGDNVRY

SEQ ID NO: 838095 - protein, 25 aa, Mycobacterium
LYERIAPRPVSPWAQALRLALIDVA

SEQ ID NO: 838096 - protein, 24 aa, Mycobacterium
LYERYPHLVVTAITPFGLDGPWCD

SEQ ID NO: 838097 - protein, 25 aa, Mycobacterium
LYESLGFVTIGLRKRYYRASGADAY

SEQ ID NO: 838098 - protein, 25 aa, Mycobacterium
LYEVHDPFCYLLPDGVVDMGGVEVK

SEQ ID NO: 838099 - protein, 20 aa, Mycobacterium
LYEWAQSLALLGDPSHSGPR

SEQ ID NO: 838100 - protein, 25 aa, Mycobacterium
LYGAEYDVRLLSRVSDATPTLSRVV

SEQ ID NO: 838101 - protein, 33 aa, Mycobacterium
LYGGNNNWFAAYAYWYFKLYGHEKVKLLDGGRK

SEQ ID NO: 838102 - protein, 33 aa, Mycobacterium
LYGGNNNWFAAYAYWYFKLYGHQNVKLLDGGRK

SEQ ID NO: 838103 - protein, 33 aa, Mycobacterium
LYGGNNNWFAAYAYWYFKLYGHRDVKLLDGGRK

SEQ ID NO: 838104 - protein, 19 aa, Mycobacterium
LYGGVLGYLDFAGNADFAI

SEQ ID NO: 838105 - protein, 25 aa, Mycobacterium
LYGGYNVVRAAWPHFREQSYGRVVV

SEQ ID NO: 838106 - protein, 26 aa, Mycobacterium
LYGLYLSMLRRIGHYRWFAAIFKRVG

SEQ ID NO: 838107 - protein, 21 aa, Mycobacterium
LYGVPPKEFTAERARLTAAAR

SEQ ID NO: 838108 - protein, 17 aa, Mycobacterium
LYGYYDGAPQMTVCVWR

SEQ ID NO: 838109 - protein, 20 aa, Mycobacterium
LYHENIRYFPPLLPEVSDED

SEQ ID NO: 838110 - protein, 17 aa, Mycobacterium
LYHLNAWAEAPRKLITG

SEQ ID NO: 838111 - protein, 18 aa, Mycobacterium
LYHRYAFALNAAGIDVWA

SEQ ID NO: 838112 - protein, 17 aa, Mycobacterium
LYHYYALMTGKAVQQEK

SEQ ID NO: 838113 - protein, 20 aa, Mycobacterium
LYIADASVFPDIPRGTTALP

SEQ ID NO: 838114 - protein, 19 aa, Mycobacterium
LYIDGQWVAPAATGTIDVV

SEQ ID NO: 838115 - protein, 31 aa, Mycobacterium
LYKGTADLFLWPTLYLWEFPKPTISAIHGYC

SEQ ID NO: 838116 - protein, 31 aa, Mycobacterium
LYKGTADLFLWPTLYLWEFPKPTISQIHGYC

SEQ ID NO: 838117 - protein, 32 aa, Mycobacterium; identical to SEQ ID NO: 116138

SEQ ID NO: 838118 - protein, 26 aa, Mycobacterium
LYLLADSQLLFWKRDGRPLLETALDG

SEQ ID NO: 838119 - protein, 20 aa, Mycobacterium
LYLRRAHAIGRFLGGPERWQ

SEQ ID NO: 838120 - protein, 17 aa, Mycobacterium
LYLTDRSTFMIVSGGVN

SEQ ID NO: 838121 - protein, 18 aa, Mycobacterium
LYNEFQSRRGLARHYALR

SEQ ID NO: 838122 - protein, 18 aa, Mycobacterium
LYNPRLRRAYRIDDDIPV

SEQ ID NO: 838123 - protein, 17 aa, Mycobacterium
LYPELHDCFYNETFLNH

SEQ ID NO: 838124 - protein, 20 aa, Mycobacterium
LYPGPLVELTTINQPRREMA

SEQ ID NO: 838125 - protein, 32 aa, Mycobacterium
LYPLQRLKKNLGPWWDFLVTDVTLGTSGNAER

SEQ ID NO: 838126 - protein, 19 aa, Mycobacterium
LYPNLSFVHNWPKVADSDD

SEQ ID NO: 838127 - protein, 18 aa, Mycobacterium
LYPNVYVMDQFSTQIRHF

SEQ ID NO: 838128 - protein, 17 aa, Mycobacterium
LYPRLVCPVCHDGELAW

SEQ ID NO: 838129 - protein, 18 aa, Mycobacterium
LYPRLVMSVVRAVGDAAA

SEQ ID NO: 838130 - protein, 18 aa, Mycobacterium
LYQRIVAKKADIVRPLAK

SEQ ID NO: 838131 - protein, 19 aa, Mycobacterium
LYQRTAPWILPKWDSRYGV

SEQ ID NO: 838132 - protein, 20 aa, Mycobacterium
LYQRTAPWILPKWDSRYGVL

SEQ ID NO: 838133 - protein, 21 aa, Mycobacterium
LYQYFEKLIALRRNGALRDSD

SEQ ID NO: 838134 - protein, 19 aa, Mycobacterium
LYRAMKPQGRLFLYGFSDG

SEQ ID NO: 838135 - protein, 25 aa, Mycobacterium
LYRANLRHVLLCSQRVARKMVSEGL

SEQ ID NO: 838136 - protein, 25 aa, Mycobacterium
LYRANLRHVLLCTQRIARQLVSAGI

SEQ ID NO: 838137 - protein, 28 aa, Mycobacterium
LYRANMPAPFFVPVKQLPQTRVPVQVLV

SEQ ID NO: 838138 - protein, 18 aa, Mycobacterium
LYRIVVNACLDRLRRNKT

SEQ ID NO: 838139 - protein, 18 aa, Mycobacterium
LYRLATMGEWRSGSDVDL

SEQ ID NO: 838140 - protein, 20 aa, Mycobacterium
LYRPAEIAKVLRLADIALLV

SEQ ID NO: 838141 - protein, 28 aa, Mycobacterium
LYRPIRPEAWPNRRLVPAPADWVNDDDP

SEQ ID NO: 838142 - protein, 19 aa, Mycobacterium
LYRRFIAYREGLGFEVLPL

SEQ ID NO: 838143 - protein, 29 aa, Mycobacterium
LYRRNGIQFLPFNTVYQLAAERASGLLDL

SEQ ID NO: 838144 - protein, 20 aa, Mycobacterium
LYRSVGFEQVGLRRRYYRVS

SEQ ID NO: 838145 - protein, 18 aa, Mycobacterium
LYRSVRLLTRDVVTEAAV

SEQ ID NO: 838146 - protein, 17 aa, Mycobacterium
LYRVPDAYHSWMIANPR

SEQ ID NO: 838147 - protein, 25 aa, Mycobacterium
LYSDAGHGFLFQHLPDFAREVTEFL

SEQ ID NO: 838148 - protein, 18 aa, Mycobacterium
LYSDVQPIIFHRSGFHRL

SEQ ID NO: 838149 - protein, 27 aa, Mycobacterium
LYSGRYRGCYLLLYSDGTVKLSGYDRN

SEQ ID NO: 838150 - protein, 18 aa, Mycobacterium
LYSKIFRNNILASGVIPQ

SEQ ID NO: 838151 - protein, 22 aa, Mycobacterium
LYSLHHSGETFVFIEQWADEEA

SEQ ID NO: 838152 - protein, 18 aa, Mycobacterium
LYSLHQTGATFVFVEQWA

SEQ ID NO: 838153 - protein, 18 aa, Mycobacterium
LYSLSYKPNPRWSRRYAE

SEQ ID NO: 838154 - protein, 18 aa, Mycobacterium
LYSWCLIELIEAAVRCGE

SEQ ID NO: 838155 - protein, 18 aa, Mycobacterium
LYTHPQVNEFFSSLQGRS

SEQ ID NO: 838156 - protein, 26 aa, Mycobacterium
LYTLAHYGVFFTPFRAALGRLGVIHA

SEQ ID NO: 838157 - protein, 17 aa, Mycobacterium
LYVADYSGVLTAARIDS

SEQ ID NO: 838158 - protein, 25 aa, Mycobacterium
LYVDAHSWLRFDPAPRILTAHARHR

SEQ ID NO: 838159 - protein, 31 aa, Mycobacterium
LYVHGHDLDFRTLFPRRSKGLAGALDFANIP

SEQ ID NO: 838160 - protein, 18 aa, Mycobacterium
LYVLAGRAEGYVPFYPEY

SEQ ID NO: 838161 - protein, 18 aa, Mycobacterium
LYVPFQMLTLDGTELRFV

SEQ ID NO: 838162 - protein, 19 aa, Mycobacterium
LYVPVPHTVPVPPTVQAQT

SEQ ID NO: 838163 - protein, 23 aa, Mycobacterium
LYVTNAVKHFKFTRAAGGKRRIH

SEQ ID NO: 838164 - protein, 19 aa, Mycobacterium
LYWAIQPHQFVRFEGLIDH

SEQ ID NO: 838165 - protein, 21 aa, Mycobacterium
LYWAPLKDFTAQRTKLTAAAK

SEQ ID NO: 838166 - protein, 25 aa, Mycobacterium
LYYCSPKEVIFLITREAYEQYYLDD

SEQ ID NO: 838167 - protein, 17 aa, Mycobacterium
LYYLPDDFSQARNVAAE

SEQ ID NO: 838168 - protein, 24 aa, Mycobacterium
LYYPVLTHRHRVPLVADLFEGVRL

SEQ ID NO: 838169 - protein, 19 aa, Mycobacterium
MAAAAAAGVAWGLNQIAQA

SEQ ID NO: 838170 - protein, 23 aa, Mycobacterium
MAAAAAPYAAWLSAAAAQSAGAA

SEQ ID NO: 838171 - protein, 26 aa, Mycobacterium
MAAAAAPYAGWLNVAAARAAGAADQA

SEQ ID NO: 838172 - protein, 25 aa, Mycobacterium
MAAAAAPYLGWLQTAAAQAEQAAAQ

SEQ ID NO: 838173 - protein, 23 aa, Mycobacterium
MAAAAAPYVAWASATMTLAEQAA

SEQ ID NO: 838174 - protein, 27 aa, Mycobacterium
MAAAAAPYVVWLRATAELCEQSATQAT

SEQ ID NO: 838175 - protein, 20 aa, Mycobacterium
MAAALIGILEDDQLRAGYVA

SEQ ID NO: 838176 - protein, 21 aa, Mycobacterium
MAAAVAPYMGWMSITGVQAEQ

SEQ ID NO: 838177 - protein, 24 aa, Mycobacterium
MAAAVAPYVLWMTATAARAQQTAS

SEQ ID NO: 838178 - protein, 23 aa, Mycobacterium
MAAAVQPYVTWMQTTAAQAEEAA

SEQ ID NO: 838179 - protein, 28 aa, Mycobacterium
MAADLVVLGPGSWFTSVIPHVLVPELAA

SEQ ID NO: 838180 - protein, 36 aa, Mycobacterium
MAADLVVLGPGSWFTSVIPHVLVPELFAALQQTPAR

SEQ ID NO: 838181 - protein, 38 aa, Mycobacterium
MAADLVVLGPGSWFTSVIPHVLVPGLAAALRATTARRA

SEQ ID NO: 838182 - protein, 36 aa, Mycobacterium
MAADLVVLGPGSWFTSVIPHVLVPGLLTALQTTTAQ

SEQ ID NO: 838183 - protein, 28 aa, Mycobacterium
MAAENISPLVVWLGSAESRDVSGRVFEV

SEQ ID NO: 838184 - protein, 25 aa, Mycobacterium
MAAEVPDYLLQILARFARALRESSS

SEQ ID NO: 838185 - protein, 19 aa, Mycobacterium
MAAGALRRFGADTAVAITG

SEQ ID NO: 838186 - protein, 18 aa, Mycobacterium
MAAGLVDRVQVTLFPVIT

SEQ ID NO: 838187 - protein, 24 aa, Mycobacterium
MAAGRISYLFGLEGPAMALDTACS

SEQ ID NO: 838188 - protein, 20 aa, Mycobacterium
MAAIAHDSVVTRGGVGGAVT

SEQ ID NO: 838189 - protein, 26 aa, Mycobacterium
MAAIDEHFGHPAHLPRAGLPTEIGSV

SEQ ID NO: 838190 - protein, 36 aa, Mycobacterium
MAAILLGLLHHGDPVAGLTWLPFIDERYTAVTGGPL

SEQ ID NO: 838191 - protein, 27 aa, Mycobacterium
MAAKAAPYVWWLHSTAEQTQQTATQCR

SEQ ID NO: 838192 - protein, 18 aa, Mycobacterium
MAAKFFTGLPLDGPDPEC

SEQ ID NO: 838193 - protein, 26 aa, Mycobacterium
MAAKRTSDLIPLCHQLALTGVDVDFT

SEQ ID NO: 838194 - protein, 27 aa, Mycobacterium
MAAKRTSDLIPLCHQLALTGVDVEFTV

SEQ ID NO: 838195 - protein, 26 aa, Mycobacterium
MAAKRTSELIPLCHQIPLTGIEVDFA

SEQ ID NO: 838196 - protein, 25 aa, Mycobacterium
MAAKVAPYVSWLYTTATQTKQTAMQ

SEQ ID NO: 838197 - protein, 20 aa, Mycobacterium
MAALAPISGVLPAGADEVSF

SEQ ID NO: 838198 - protein, 29 aa, Mycobacterium
MAALDVTAAPPLRRLLREILREQRRTAII

SEQ ID NO: 838199 - protein, 28 aa, Mycobacterium
MAALQIIGMCNWVAWWFHKDDATSAEIV

SEQ ID NO: 838200 - protein, 18 aa, Mycobacterium
MAALRRAVPAAKGNTRRL

SEQ ID NO: 838201 - protein, 24 aa, Mycobacterium
MAALVLRAPLTYLGLAEFLSAQQD

SEQ ID NO: 838202 - protein, 22 aa, Mycobacterium
MAAQYRIRLGGTWKKPGTSDIE

SEQ ID NO: 838203 - protein, 23 aa, Mycobacterium
MAARAHLRRKFLTARVAISGANF

SEQ ID NO: 838204 - protein, 19 aa, Mycobacterium
MAARRWVTTLQAALPEQIT

SEQ ID NO: 838205 - protein, 17 aa, Mycobacterium
MAARVGSAAIAVCLFRL

SEQ ID NO: 838206 - protein, 26 aa, Mycobacterium
MAASAAPYVGWLYRTAEQTQQAAIQA

SEQ ID NO: 838207 - protein, 23 aa, Mycobacterium
MAASVALGYRRVWAASPVGADLR

SEQ ID NO: 838208 - protein, 25 aa, Mycobacterium
MAAVAAPYSSWLSAAAARAAGAAGQ

SEQ ID NO: 838209 - protein, 26 aa, Mycobacterium
MAAVATPHVRLLQGLAGQAEQAAAQA

SEQ ID NO: 838210 - protein, 18 aa, Mycobacterium
MAAVLAGLPDDLITPRAV

SEQ ID NO: 838211 - protein, 25 aa, Mycobacterium
MAAVSAVLRAWAPPGATVVVPADGY

SEQ ID NO: 838212 - protein, 20 aa, Mycobacterium
MAAVTWLTLPGQCGIGGDAF

SEQ ID NO: 838213 - protein, 23 aa, Mycobacterium
MACTYHGKIQWQPGSKMPAFSDD

SEQ ID NO: 838214 - protein, 17 aa, Mycobacterium
MADAEIDFLVYPTVQVP

SEQ ID NO: 838215 - protein, 25 aa, Mycobacterium
MADAPLFDELWREKFDGNPPPYLIV

SEQ ID NO: 838216 - protein, 24 aa, Mycobacterium
MADCHPILFLRMADRLKAGARLIV

SEQ ID NO: 838217 - protein, 22 aa, Mycobacterium
MADFHLRVRPGTDAWCLAALAA

SEQ ID NO: 838218 - protein, 21 aa, Mycobacterium
MADIHLRVRPGSDAWCLAALA

SEQ ID NO: 838219 - protein, 17 aa, Mycobacterium
MADLHMRWMDLPGPTDV

SEQ ID NO: 838220 - protein, 18 aa, Mycobacterium
MADLPFGFSPGEDPDKHG

SEQ ID NO: 838221 - protein, 17 aa, Mycobacterium
MADLQAQNLFFPGGHCK

SEQ ID NO: 838222 - protein, 23 aa, Mycobacterium
MADNVMTFRYVIKEIAIENGARA

SEQ ID NO: 838223 - protein, 23 aa, Mycobacterium
MADPGSVSYLFSRKGVVTLEKNS

SEQ ID NO: 838224 - protein, 17 aa, Mycobacterium
MADPRLRKISFTGSTGV

SEQ ID NO: 838225 - protein, 30 aa, Mycobacterium
MADQTNFKLVLLTHNFDFFRTLRSRGVVGY

SEQ ID NO: 838226 - protein, 25 aa, Mycobacterium
MADRAENLRRLAHVASLLADSGQIV

SEQ ID NO: 838227 - protein, 21 aa, Mycobacterium
MADWMCFMLSESADFLCGSVI

SEQ ID NO: 838228 - protein, 19 aa, Mycobacterium
MAEAIGFHLNRGVLASAPR

SEQ ID NO: 838229 - protein, 19 aa, Mycobacterium
MAEAIGFHLNRGVLASASR

SEQ ID NO: 838230 - protein, 26 aa, Mycobacterium
MAEEVMAPLGPILVAAAGIGPGVRVL

SEQ ID NO: 838231 - protein, 21 aa, Mycobacterium
MAEGFDFVAMARALLAEPDLV

SEQ ID NO: 838232 - protein, 21 aa, Mycobacterium
MAEGFQFVAMGRALLAEPDLI

SEQ ID NO: 838233 - protein, 18 aa, Mycobacterium
MAENCAVSWVLHPEPWYL

SEQ ID NO: 838234 - protein, 19 aa, Mycobacterium
MAENLAHIAPPDPDGKVLR

SEQ ID NO: 838235 - protein, 24 aa, Mycobacterium
MAERIRSLLQLRGPFVELAEAGHH

SEQ ID NO: 838236 - protein, 18 aa, Mycobacterium
MAEWMCFMLSDAADFLCG

SEQ ID NO: 838237 - protein, 21 aa, Mycobacterium
MAEWVALRVLAKQSEAMLAGL

SEQ ID NO: 838238 - protein, 18 aa, Mycobacterium
MAFAYDGAWAEYTVAQAA

SEQ ID NO: 838239 - protein, 22 aa, Mycobacterium
MAFDPMFRPLLANLHDHLTVRL

SEQ ID NO: 838240 - protein, 22 aa, Mycobacterium
MAFDVMVPLKEALETVTCDNSV

SEQ ID NO: 838241 - protein, 21 aa, Mycobacterium
MAFERVTLYGLPLVPRRRVGY

SEQ ID NO: 838242 - protein, 24 aa, Mycobacterium
MAFKKGKLLFNQPGALPAAALEDL

SEQ ID NO: 838243 - protein, 26 aa, Mycobacterium
MAFKKGKLLFNQPGALPPAALEDLVQ

SEQ ID NO: 838244 - protein, 27 aa, Mycobacterium
MAFKKGKLLFNQPGALPPAALEDLVQQ

SEQ ID NO: 838245 - protein, 25 aa, Mycobacterium
MAFVRFRIDGKDWPASPLPSLRMRT

SEQ ID NO: 838246 - protein, 22 aa, Mycobacterium
MAGAAAPYLAWVTDAGVQAEEA

SEQ ID NO: 838247 - protein, 25 aa, Mycobacterium
MAGAELLLGLRRFAARSLTSLYVYA

SEQ ID NO: 838248 - protein, 27 aa, Mycobacterium
MAGAELVLPHRWLQPGALVAIIEDTRP

SEQ ID NO: 838249 - protein, 20 aa, Mycobacterium
MAGAFHYLDPRGGYVNDHAW

SEQ ID NO: 838250 - protein, 23 aa, Mycobacterium
MAGAITPYVAWALTTAAQAEQIA

SEQ ID NO: 838251 - protein, 25 aa, Mycobacterium
MAGGGLLIRPDAMTGPPSAALAGTT

SEQ ID NO: 838252 - protein, 19 aa, Mycobacterium
MAGILTRTGAIRAGLYTPA

SEQ ID NO: 838253 - protein, 22 aa, Mycobacterium
MAGLLEDAGYIKADPGAPADLV

SEQ ID NO: 838254 - protein, 17 aa, Mycobacterium
MAGLTFADAFDADFFAA

SEQ ID NO: 838255 - protein, 24 aa, Mycobacterium
MAGNAPIYAILREANDRAKAAGAT

SEQ ID NO: 838256 - protein, 19 aa, Mycobacterium
MAGPFQYLDPKAGYANDPA

SEQ ID NO: 838257 - protein, 23 aa, Mycobacterium
MAGPPPVDPFAPPPPPEPAVVPV

SEQ ID NO: 838258 - protein, 18 aa, Mycobacterium
MAGQLFESPTFTPRMREV

SEQ ID NO: 838259 - protein, 24 aa, Mycobacterium
MAGSAFFDEAARRGLRTVAEAFAD

SEQ ID NO: 838260 - protein, 24 aa, Mycobacterium
MAGSGWWSIPPWRPRATFAAMERR

SEQ ID NO: 838261 - protein, 21 aa, Mycobacterium
MAGTPSFMWLEVDDVVRDCLA

SEQ ID NO: 838262 - protein, 25 aa, Mycobacterium
MAGVHQRFVQALTASGSSYAAAEAA

SEQ ID NO: 838263 - protein, 18 aa, Mycobacterium
MAGVSLTMVFLDDELERL

SEQ ID NO: 838264 - protein, 23 aa, Mycobacterium
MAGWQVRVLVPGGDDIRPLQILG

SEQ ID NO: 838265 - protein, 35 aa, Mycobacterium
MAHMWFGDLVTMKWWDDLWLNESFATFASVLCQSE

SEQ ID NO: 838266 - protein, 35 aa, Mycobacterium
MAHMWFGDLVTMQWWDDLWLNESFATFASVLCQAE

SEQ ID NO: 838267 - protein, 22 aa, Mycobacterium
MAHNRALQPTRFLLLARSEAEL

SEQ ID NO: 838268 - protein, 26 aa, Mycobacterium
MAIERANDLFLSAPRPLLVTAEADDL

SEQ ID NO: 838269 - protein, 21 aa, Mycobacterium
MAIGPKRVYLTLRGQPYLVSV

SEQ ID NO: 838270 - protein, 24 aa, Mycobacterium
MAILPPRLRRDLGPFSPWGRVARY

SEQ ID NO: 838271 - protein, 30 aa, Mycobacterium
MAINYFGAVRLVLALLPHWRERKFGHVVNV

SEQ ID NO: 838272 - protein, 31 aa, Mycobacterium
MAIRDFILPDGEWVLLMLAAAQRDPDVGPDL

SEQ ID NO: 838273 - protein, 28 aa, Mycobacterium
MAITPKASWPWVRTLLHSVFDQPDKESV

SEQ ID NO: 838274 - protein, 28 aa, Mycobacterium
MAITPKSSWPWVRTLLHSVFDQPDAGSV

SEQ ID NO: 838275 - protein, 20 aa, Mycobacterium
MAKLPFTEHGFHLRPVPDVI

SEQ ID NO: 838276 - protein, 26 aa, Mycobacterium
MAKVPYYRVLELAPWLSRPRPNFPVT

SEQ ID NO: 838277 - protein, 19 aa, Mycobacterium
MAKWDPAFTKALIGTVTPL

SEQ ID NO: 838278 - protein, 19 aa, Mycobacterium
MALALKLGENHTPPQRLEV

SEQ ID NO: 838279 - protein, 23 aa, Mycobacterium
MALARSFFTPLGAELQAALAGVP

SEQ ID NO: 838280 - protein, 29 aa, Mycobacterium
MALCRRLRQNGHYSVPVILLTALGEEDDR

SEQ ID NO: 838281 - protein, 18 aa, Mycobacterium
MALEAAKLRPLPFRIELD

SEQ ID NO: 838282 - protein, 23 aa, Mycobacterium
MALGAISWIGWGVAGITEFYVQV

SEQ ID NO: 838283 - protein, 21 aa, Mycobacterium
MALGEHWRGAGRRADFLLGMV

SEQ ID NO: 838284 - protein, 17 aa, Mycobacterium
MALGITGPILRSTGLPH

SEQ ID NO: 838285 - protein, 20 aa, Mycobacterium
MALGWSRWRALDGGRSLGLI

SEQ ID NO: 838286 - protein, 19 aa, Mycobacterium
MALLISDFAERFDVPAAVA

SEQ ID NO: 838287 - protein, 19 aa, Mycobacterium
MALLNWHDGSRFSPVDGSP

SEQ ID NO: 838288 - protein, 19 aa, Mycobacterium
MALLQPRRIIADEGLLGAL

SEQ ID NO: 838289 - protein, 21 aa, Mycobacterium
MALLQPRRLVSDEGLFGALRF

SEQ ID NO: 838290 - protein, 20 aa, Mycobacterium
MALMNLRLARPGVIVDIGRL

SEQ ID NO: 838291 - protein, 18 aa, Mycobacterium
MALPNARVLIHQPALGGV

SEQ ID NO: 838292 - protein, 18 aa, Mycobacterium
MALPNARVLIHQPALSGV

SEQ ID NO: 838293 - protein, 22 aa, Mycobacterium
MALQYWRSLGRGAKHRLMTWRG

SEQ ID NO: 838294 - protein, 17 aa, Mycobacterium
MALQYWRSRGRPGKHRL

SEQ ID NO: 838295 - protein, 18 aa, Mycobacterium
MALQYWRSRGRPGKHRLM

SEQ ID NO: 838296 - protein, 17 aa, Mycobacterium
MALRKWATQFYDVAPVG

SEQ ID NO: 838297 - protein, 31 aa, Mycobacterium
MALRLRPDDVLYSCLPLYHNNALTLAVSTTV

SEQ ID NO: 838298 - protein, 20 aa, Mycobacterium
MALRLRTAVAILSYGDDLVF

SEQ ID NO: 838299 - protein, 19 aa, Mycobacterium
MALRRKFSASQFLSDVRRY

SEQ ID NO: 838300 - protein, 21 aa, Mycobacterium
MALTPLQQGLFALAMFSESPV

SEQ ID NO: 838301 - protein, 27 aa, Mycobacterium
MALTPLQQGLFALAMFTKSAADDPYTI

SEQ ID NO: 838302 - protein, 19 aa, Mycobacterium
MALVARRVATIYSAMMAGK

SEQ ID NO: 838303 - protein, 19 aa, Mycobacterium
MAMGFFTHLAGDAAVAWSG

SEQ ID NO: 838304 - protein, 25 aa, Mycobacterium
MANAAKPYLVWMRASAAQAEQAATS

SEQ ID NO: 838305 - protein, 25 aa, Mycobacterium
MANDVELDLGWGRLIFGQTFADSAA

SEQ ID NO: 838306 - protein, 18 aa, Mycobacterium
MANHMRDNGIRYGLQTMC

SEQ ID NO: 838307 - protein, 28 aa, Mycobacterium
MANHTTGWVRMDFVVPSRGLIGWRTDFL

SEQ ID NO: 838308 - protein, 26 aa, Mycobacterium
MANPANRFHSWIYRARPDVQCIVHTH

SEQ ID NO: 838309 - protein, 20 aa, Mycobacterium
MANRFWQGNLNLAVALAKGQ

SEQ ID NO: 838310 - protein, 23 aa, Mycobacterium
MANRLPMMIVGRIIGVPDADIDK

SEQ ID NO: 838311 - protein, 20 aa, Mycobacterium
MANRRMALYALPRTPDDVPL

SEQ ID NO: 838312 - protein, 17 aa, Mycobacterium
MANSIEFIVAMLAVLKA

SEQ ID NO: 838313 - protein, 24 aa, Mycobacterium
MANSPALLHGYLGLAGSLDGGTLP

SEQ ID NO: 838314 - protein, 22 aa, Mycobacterium
MAPEIALLMRFAAAAPDFSDCG

SEQ ID NO: 838315 - protein, 28 aa, Mycobacterium
MAPENISPIVVWLGSAEARDVTGKMFEV

SEQ ID NO: 838316 - protein, 27 aa, Mycobacterium
MAPENVSPLVVWLGSPESREVTGKVFE

SEQ ID NO: 838317 - protein, 21 aa, Mycobacterium
MAPFRLTRELLMSIPGFSGKT

SEQ ID NO: 838318 - protein, 17 aa, Mycobacterium
MAPLLAEAKVPWVLMHW

SEQ ID NO: 838319 - protein, 18 aa, Mycobacterium
MAPLLIDDRRDLVQKAFG

SEQ ID NO: 838320 - protein, 19 aa, Mycobacterium
MAPLMADAGVPWVLMHWRS

SEQ ID NO: 838321 - protein, 18 aa, Mycobacterium
MAPLTLAGIPGFLSTVPP

SEQ ID NO: 838322 - protein, 23 aa, Mycobacterium
MAPMLMHLFVRPTSANLAFVGLP

SEQ ID NO: 838323 - protein, 30 aa, Mycobacterium
MAPNFNPGPNPFGPPPVLLGALGPVMTRTA

SEQ ID NO: 838324 - protein, 21 aa, Mycobacterium
MAPQLLARQFEAGACAVTAAT

SEQ ID NO: 838325 - protein, 24 aa, Mycobacterium
MAPRERFATLKQRLGDAFAVIEID

SEQ ID NO: 838326 - protein, 26 aa, Mycobacterium
MAPRQWRGLRRWLGEPEDFQDPKYDV

SEQ ID NO: 838327 - protein, 18 aa, Mycobacterium
MAPYNTRIVRRSNALLDW

SEQ ID NO: 838328 - protein, 26 aa, Mycobacterium
MAQALEPYLAWLRLTAQQCQQTAASV

SEQ ID NO: 838329 - protein, 20 aa, Mycobacterium
MAQALLPYFAPGFNQLRTAF

SEQ ID NO: 838330 - protein, 25 aa, Mycobacterium
MAQERTWQWLFDRITASSAATDHDR

SEQ ID NO: 838331 - protein, 23 aa, Mycobacterium
MAQLRNALRAQLFAGAAPAEAVR

SEQ ID NO: 838332 - protein, 18 aa, Mycobacterium
MAQMIPQMASGIGGALSG

SEQ ID NO: 838333 - protein, 23 aa, Mycobacterium
MAQMPMQMMSGIASAPQGLMQGA

SEQ ID NO: 838334 - protein, 18 aa, Mycobacterium
MAQPLRNTLAATPAPRLV

SEQ ID NO: 838335 - protein, 21 aa, Mycobacterium
MAQSRLMQRLDPGGMRLTELA

SEQ ID NO: 838336 - protein, 24 aa, Mycobacterium
MARAAAPYIAWLRTMAEQAEQASA

SEQ ID NO: 838337 - protein, 28 aa, Mycobacterium
MARARGYVLPYHKLMARADLDVLKAANG

SEQ ID NO: 838338 - protein, 27 aa, Mycobacterium
MARDEGRWAVRWVSTGLHPKLGEHQTF

SEQ ID NO: 838339 - protein, 19 aa, Mycobacterium
MARDYISTLPLLTGKQIAV

SEQ ID NO: 838340 - protein, 25 aa, Mycobacterium
MARECVAAGWLLSLSGTVTFRNARD

SEQ ID NO: 838341 - protein, 18 aa, Mycobacterium
MAREPRCPFAPPPDVMAL

SEQ ID NO: 838342 - protein, 24 aa, Mycobacterium
MARFPGWHIPILGVTFDGATRTDS

SEQ ID NO: 838343 - protein, 20 aa, Mycobacterium
MARFVDTFSRVLGDPALPHL

SEQ ID NO: 838344 - protein, 20 aa, Mycobacterium
MARFVETFARVLGDPALPHL

SEQ ID NO: 838345 - protein, 17 aa, Mycobacterium
MARHRDSTRLRYVEPYR

SEQ ID NO: 838346 - protein, 22 aa, Mycobacterium
MARLETQIALTALVRRLESPRL

SEQ ID NO: 838347 - protein, 21 aa, Mycobacterium
MARLNLARFPFPSTAEGRRAH

SEQ ID NO: 838348 - protein, 27 aa, Mycobacterium
MARLQRAMWIPPARYQDGFLARGHRAV

SEQ ID NO: 838349 - protein, 26 aa, Mycobacterium
MARNILESFTLLTNVSKLFAQRCIAG

SEQ ID NO: 838350 - protein, 32 aa, Mycobacterium
MARPLVILLHGFGSFWWSWRHQLRGLTSARVV

SEQ ID NO: 838351 - protein, 18 aa, Mycobacterium
MARPVRRSTFYRHTQGWL

SEQ ID NO: 838352 - protein, 21 aa, Mycobacterium
MARRLRLNSRMGLLPDGSPVV

SEQ ID NO: 838353 - protein, 41 aa, Mycobacterium
MARVPYYRVLELAPWLKWPEPNFPVSNFFHGGAAPLNAILA

SEQ ID NO: 838354 - protein, 24 aa, Mycobacterium
MASAAAPYASWLNAAAAGAQSASV

SEQ ID NO: 838355 - protein, 26 aa, Mycobacterium
MASAAQPYLVWLTTASVQAEQAASQV

SEQ ID NO: 838356 - protein, 24 aa, Mycobacterium
MASEFGLGITPWSPLKGGVLSGKY

SEQ ID NO: 838357 - protein, 19 aa, Mycobacterium
MASEYRALSGLPGVEKARI

SEQ ID NO: 838358 - protein, 22 aa, Mycobacterium
MASGLALEWSRYGIRTLCVAPG

SEQ ID NO: 838359 - protein, 27 aa, Mycobacterium
MASGVHAILIPEIPFSLDPVAAVIRDR

SEQ ID NO: 838360 - protein, 21 aa, Mycobacterium
MASMAAFTWLSTRGGGGVVGV

SEQ ID NO: 838361 - protein, 26 aa, Mycobacterium
MASPVLNYPLRQYMFCAPDEGAAAVI

SEQ ID NO: 838362 - protein, 20 aa, Mycobacterium
MASSMFRGCVSREFTVLATG

SEQ ID NO: 838363 - protein, 17 aa, Mycobacterium
MATALAAQFFDAGQPAG

SEQ ID NO: 838364 - protein, 27 aa, Mycobacterium
MATARYGSYLRDSLPPFWQTTNGTQVR

SEQ ID NO: 838365 - protein, 23 aa, Mycobacterium
MATATAPYLAWLNVTAGQAESTA

SEQ ID NO: 838366 - protein, 25 aa, Mycobacterium
MATATGPYLAWMTATADLARQSAVQ

SEQ ID NO: 838367 - protein, 23 aa, Mycobacterium
MATAWRGLGANVTLLARTDTLLP

SEQ ID NO: 838368 - protein, 18 aa, Mycobacterium
MATDAIFGVSHIWRRIRA

SEQ ID NO: 838369 - protein, 20 aa, Mycobacterium
MATGGRRLALALAPAGSGKT

SEQ ID NO: 838370 - protein, 18 aa, Mycobacterium
MATLPRLKPKCFYDLVVE

SEQ ID NO: 838371 - protein, 17 aa, Mycobacterium
MATMAWPPPGTPEDQHW

SEQ ID NO: 838372 - protein, 26 aa, Mycobacterium
MATVFKLPFGEIPGQVFIGMRTSDVL

SEQ ID NO: 838373 - protein, 47 aa, Mycobacterium
MATYKAEFLFHHYRRRIRPMAHYSMGWIPLWARLAAVAPNLLNTVTH

SEQ ID NO: 838374 - protein, 20 aa, Mycobacterium
MAVALRLAAFALLRADGSEP

SEQ ID NO: 838375 - protein, 17 aa, Mycobacterium
MAVAPIALALASHPTLE

SEQ ID NO: 838376 - protein, 19 aa, Mycobacterium
MAVAPLHRSGGQAQFIIRN

SEQ ID NO: 838377 - protein, 18 aa, Mycobacterium
MAVARDFFSPLSAHTHAA

SEQ ID NO: 838378 - protein, 19 aa, Mycobacterium
MAVASAYTDIALPANMVFI

SEQ ID NO: 838379 - protein, 24 aa, Mycobacterium
MAVCAAASAWIRIGQIQAAEVAAA

SEQ ID NO: 838380 - protein, 26 aa, Mycobacterium
MAVELGLTPLVRYLAGAVTGADPVLM

SEQ ID NO: 838381 - protein, 24 aa, Mycobacterium
MAVFLTHYLGFPLGSAFNGAVDTV

SEQ ID NO: 838382 - protein, 22 aa, Mycobacterium
MAVQRALMRLPLEQRAAVVAVD

SEQ ID NO: 838383 - protein, 17 aa, Mycobacterium
MAVQVGSLPIPLSALEK

SEQ ID NO: 838384 - protein, 18 aa, Mycobacterium
MAVTINAWNRINAAVRTP

SEQ ID NO: 838385 - protein, 17 aa, Mycobacterium
MAVWKVMPALAAGCTVV

SEQ ID NO: 838386 - protein, 18 aa, Mycobacterium
MAVYTYFGGMRELIAEVA

SEQ ID NO: 838387 - protein, 18 aa, Mycobacterium
MAWFCGPNHEVFAQSLTP

SEQ ID NO: 838388 - protein, 23 aa, Mycobacterium
MAWRMRSICDRIAGFPGPVIAAL

SEQ ID NO: 838389 - protein, 18 aa, Mycobacterium
MAWRRQYLPILEKDWSFG

SEQ ID NO: 838390 - protein, 20 aa, Mycobacterium
MAWSWLRHPVKSREFPAKHE

SEQ ID NO: 838391 - protein, 17 aa, Mycobacterium
MAWTLAMGHAMIRAGLS

SEQ ID NO: 838392 - protein, 28 aa, Mycobacterium
MAYEGKVDWAFGELLAFGTLVAEGKVVR

SEQ ID NO: 838393 - protein, 18 aa, Mycobacterium
MAYEGKVDWAFGELLALG

SEQ ID NO: 838394 - protein, 20 aa, Mycobacterium
MAYERVTLYGLPLVARRRIG

SEQ ID NO: 838395 - protein, 30 aa, Mycobacterium
MAYFEVLHELKLIVDLIYEGGIARMNYSVS

SEQ ID NO: 838396 - protein, 17 aa, Mycobacterium
MAYKGMLLTGMPNLAFT

SEQ ID NO: 838397 - protein, 26 aa, Mycobacterium
MAYYLSKQALVLYAKRLSGVAWREYG

SEQ ID NO: 838398 - protein, 20 aa, Mycobacterium
MCDFAAGWFSFSSRTDHTKN

SEQ ID NO: 838399 - protein, 22 aa, Mycobacterium
MCEDPRFSIARLSLLDRGMVFV

SEQ ID NO: 838400 - protein, 26 aa, Mycobacterium
MCEIPNNVILIDQFAKRFDGFSIGSN

SEQ ID NO: 838401 - protein, 17 aa, Mycobacterium
MCEIPNNVILLDEFAKR

SEQ ID NO: 838402 - protein, 26 aa, Mycobacterium
MCERGRYHFEPWIVPFVLDPVDGAPF

SEQ ID NO: 838403 - protein, 28 aa, Mycobacterium
MCGLEPNMRWRTFCAELLAIIEKLNVDT

SEQ ID NO: 838404 - protein, 18 aa, Mycobacterium
MCGPKFCSMRITQDVRDF

SEQ ID NO: 838405 - protein, 18 aa, Mycobacterium
MCGPKFCSMRITQDVRDY

SEQ ID NO: 838406 - protein, 27 aa, Mycobacterium
MCGRSYSPRFLFTWPNSRSAVMGPAQL

SEQ ID NO: 838407 - protein, 30 aa, Mycobacterium
MCIATALRYRLPQIAALYVQGRLSTRLISE

SEQ ID NO: 838408 - protein, 22 aa, Mycobacterium
MCKAVLVYRSLNGRSGYRFGHI

SEQ ID NO: 838409 - protein, 18 aa, Mycobacterium
MCLEIRPYTTGFAAMAGV

SEQ ID NO: 838410 - protein, 18 aa, Mycobacterium
MCLTLCPDVFSLTDDGYA

SEQ ID NO: 838411 - protein, 19 aa, Mycobacterium
MCLTLCPEVFQMTDDGWAV

SEQ ID NO: 838412 - protein, 18 aa, Mycobacterium
MCPFAYQTSLWIREVRQQ

SEQ ID NO: 838413 - protein, 25 aa, Mycobacterium
MCTGRLFAASLLPGAPERLVLTASQ

SEQ ID NO: 838414 - protein, 31 aa, Mycobacterium
MCTIGDPLLDLGWLLATWRQPDGSSVFSHAL

SEQ ID NO: 838415 - protein, 24 aa, Mycobacterium
MCVRDIVRLVALAGPAVLAVDQID

SEQ ID NO: 838416 - protein, 23 aa, Mycobacterium
MDAAHRHHLMSTRTYFEHVIRDG

SEQ ID NO: 838417 - protein, 19 aa, Mycobacterium
MDADLVLLAMGFTGPEREG

SEQ ID NO: 838418 - protein, 18 aa, Mycobacterium
MDAEQIGHLLLRDLPEGK

SEQ ID NO: 838419 - protein, 23 aa, Mycobacterium
MDAFALLCRTEGIIPAIESAHAI

SEQ ID NO: 838420 - protein, 18 aa, Mycobacterium
MDAGVIEVAPLAYMRGRT

SEQ ID NO: 838421 - protein, 26 aa, Mycobacterium
MDAHARLLVWELINALRRDGVTVLLT

SEQ ID NO: 838422 - protein, 28 aa, Mycobacterium
MDAPQHTRLRKIISRGFTPRAVGRLEDE

SEQ ID NO: 838423 - protein, 28 aa, Mycobacterium
MDAPRAIQFRYFWLEILGSEQAAPELDG

SEQ ID NO: 838424 - protein, 20 aa, Mycobacterium
MDAVFLGDSPALRGEIEEAP

SEQ ID NO: 838425 - protein, 23 aa, Mycobacterium
MDCHVLLTGHFHYASLRPHGRDQ

SEQ ID NO: 838426 - protein, 24 aa, Mycobacterium
MDDARLIEWCRWLGCVCVSVEYRL

SEQ ID NO: 838427 - protein, 32 aa, Mycobacterium
MDDARWDSVVAVNLLAPLRLTEGLVGNGSIGE

SEQ ID NO: 838428 - protein, 17 aa, Mycobacterium
MDDDPRWRLLDPGELVH

SEQ ID NO: 838429 - protein, 25 aa, Mycobacterium
MDDEHLPFLVKLISEPQRSPQRWTF

SEQ ID NO: 838430 - protein, 21 aa, Mycobacterium
MDDFLVLQRDWGADGGLRTVS

SEQ ID NO: 838431 - protein, 18 aa, Mycobacterium
MDDGLFVRLTDGALPTCF

SEQ ID NO: 838432 - protein, 17 aa, Mycobacterium
MDDLFHAALRELAVARP

SEQ ID NO: 838433 - protein, 26 aa, Mycobacterium
MDDLHRHLFTVLMDREWKHGVAAAVD

SEQ ID NO: 838434 - protein, 23 aa, Mycobacterium
MDDPTTWRAIPDEQLRVVLARRD

SEQ ID NO: 838435 - protein, 20 aa, Mycobacterium
MDDRAVVTALLQTARLLHGR

SEQ ID NO: 838436 - protein, 27 aa, Mycobacterium
MDEKRWDAVIAVNLLAPQRLTEGLVGN

SEQ ID NO: 838437 - protein, 31 aa, Mycobacterium
MDERKFADAFPKFMWMPSREVARAGVDALEH

SEQ ID NO: 838438 - protein, 27 aa, Mycobacterium
MDERTFASAFPKFLWIESREVAEKGID

SEQ ID NO: 838439 - protein, 31 aa, Mycobacterium
MDESRWDSVIAVNLLAPLRLAEELVGSGLIG

SEQ ID NO: 838440 - protein, 18 aa, Mycobacterium
MDFGMQMASAARLASTHP

SEQ ID NO: 838441 - protein, 27 aa, Mycobacterium
MDFRDKDGRPLMWWTDPESAFEAWKKC

SEQ ID NO: 838442 - protein, 28 aa, Mycobacterium
MDFVKRPVAPYFVPVPGLDDLPSGETAP

SEQ ID NO: 838443 - protein, 19 aa, Mycobacterium
MDGALAEYGLVVPAGTVST

SEQ ID NO: 838444 - protein, 24 aa, Mycobacterium
MDGGWAPPFDIDLAARRGLAFQLV

SEQ ID NO: 838445 - protein, 24 aa, Mycobacterium
MDGGWPAPFDTDLPARRGLALQLV

SEQ ID NO: 838446 - protein, 18 aa, Mycobacterium
MDGILTVSGWYGKQFDDV

SEQ ID NO: 838447 - protein, 23 aa, Mycobacterium
MDGKVHRHWGFGGGPHRCLGSHL

SEQ ID NO: 838448 - protein, 17 aa, Mycobacterium
MDGWAIAIFFSELLAVY

SEQ ID NO: 838449 - protein, 18 aa, Mycobacterium
MDHFYQLPMLGDPDQPML

SEQ ID NO: 838450 - protein, 26 aa, Mycobacterium
MDIERDNMLFTNWPRPVLATRQGDEL

SEQ ID NO: 838451 - protein, 27 aa, Mycobacterium
MDIERDNMLFTNWPRPVLTTAEGDEMQ

SEQ ID NO: 838452 - protein, 27 aa, Mycobacterium
MDIERENMLFTNWPRPVLTTAEGDEMQ

SEQ ID NO: 838453 - protein, 18 aa, Mycobacterium
MDIPRTAAPILRQLVDTL

SEQ ID NO: 838454 - protein, 21 aa, Mycobacterium
MDKFPIGAVMNRSLTIKTGQC

SEQ ID NO: 838455 - protein, 18 aa, Mycobacterium
MDKGFWIEPTVIAGLDNN

SEQ ID NO: 838456 - protein, 35 aa, Mycobacterium
MDKIDGPYYFFGVLARLAALPRFTPMALPDTGRTN

SEQ ID NO: 838457 - protein, 38 aa, Mycobacterium
MDKIDGPYYFFGVLARLAALPSLTPILLPDTGRTNIVP

SEQ ID NO: 838458 - protein, 26 aa, Mycobacterium
MDKVLPAPIDHFLLQADLTVIVPGPL

SEQ ID NO: 838459 - protein, 18 aa, Mycobacterium
MDLALGKLGLRPGMTLLD

SEQ ID NO: 838460 - protein, 18 aa, Mycobacterium
MDLLLANGELRRLTPDGD

SEQ ID NO: 838461 - protein, 21 aa, Mycobacterium
MDLPMRGNILTIPMAARKGAD

SEQ ID NO: 838462 - protein, 27 aa, Mycobacterium
MDLPPKLAIPMRVIASVAAILCQLDAH

SEQ ID NO: 838463 - protein, 27 aa, Mycobacterium
MDLPPKLAIPMRVIASVAAILCQLDAR

SEQ ID NO: 838464 - protein, 28 aa, Mycobacterium
MDLPPKLVIPMRVIMSVAAILCQLDAHV

SEQ ID NO: 838465 - protein, 19 aa, Mycobacterium
MDLYGISPVGHPQPRRLVR

SEQ ID NO: 838466 - protein, 17 aa, Mycobacterium
MDMLGYDALRAEQKERR

SEQ ID NO: 838467 - protein, 18 aa, Mycobacterium
MDMLLTAGERISNALVAM

SEQ ID NO: 838468 - protein, 22 aa, Mycobacterium
MDNLHRKGWLQRERVGKAFRYW

SEQ ID NO: 838469 - protein, 25 aa, Mycobacterium
MDPAAVFASLRALGGRPPYTVVVGC

SEQ ID NO: 838470 - protein, 26 aa, Mycobacterium
MDPAPPPMDYIRGSGGIFRDCAVHDF

SEQ ID NO: 838471 - protein, 17 aa, Mycobacterium
MDPFAPFGGVKASGYGR

SEQ ID NO: 838472 - protein, 18 aa, Mycobacterium
MDPLVFARRQLIAEGVDA

SEQ ID NO: 838473 - protein, 32 aa, Mycobacterium
MDPMLTGRENLVLFGRLRGLSRRRAKARADEL

SEQ ID NO: 838474 - protein, 24 aa, Mycobacterium
MDPNGLFDFYTEVLGFRSRGAFRV

SEQ ID NO: 838475 - protein, 24 aa, Mycobacterium
MDPQQRIALELTWEALENARIPAS

SEQ ID NO: 838476 - protein, 21 aa, Mycobacterium
MDPQQRLFLEVAWEALENAGI

SEQ ID NO: 838477 - protein, 22 aa, Mycobacterium
MDPQQRLLLEVAWEALEHAGIP

SEQ ID NO: 838478 - protein, 23 aa, Mycobacterium
MDPQQRVLLEVAWEALEHAGLPP

SEQ ID NO: 838479 - protein, 24 aa, Mycobacterium
MDPQQRVMLEISWEALERAGIDPL

SEQ ID NO: 838480 - protein, 23 aa, Mycobacterium
MDPQQRVVLRVSWRALENSGINP

SEQ ID NO: 838481 - protein, 31 aa, Mycobacterium
MDPRILTGALLYIPLLTRMLMNLNAMGLSEE

SEQ ID NO: 838482 - protein, 18 aa, Mycobacterium
MDPSGPTNYRLLASILTG

SEQ ID NO: 838483 - protein, 23 aa, Mycobacterium
MDPVTEGLLFALGGPIYAGTNEI

SEQ ID NO: 838484 - protein, 24 aa, Mycobacterium
MDPWHGGWFHPYSFTKLDVLSAPG

SEQ ID NO: 838485 - protein, 17 aa, Mycobacterium
MDQFAEVFRMSLAEPGV

SEQ ID NO: 838486 - protein, 26 aa, Mycobacterium
MDRDPAVVAALRRARRSLPGDPYFGD

SEQ ID NO: 838487 - protein, 30 aa, Mycobacterium
MDRGVWLRPFRNLVYAMPPYICSDGEIARI

SEQ ID NO: 838488 - protein, 20 aa, Mycobacterium
MDRPTLPLTPFIDGWETVAE

SEQ ID NO: 838489 - protein, 20 aa, Mycobacterium
MDRVDVVQPVLFAVMVSLAE

SEQ ID NO: 838490 - protein, 32 aa, Mycobacterium
MDSAHFVWLVGYHMIRCGWRRSAQPLIKPRAV

SEQ ID NO: 838491 - protein, 17 aa, Mycobacterium
MDSDKAKALGLRPRARI

SEQ ID NO: 838492 - protein, 22 aa, Mycobacterium
MDSLLSIVQMPAGVPVATVSIG

SEQ ID NO: 838493 - protein, 18 aa, Mycobacterium
MDSPRFAGITRLYTARQV

SEQ ID NO: 838494 - protein, 23 aa, Mycobacterium
MDSVTVLLHRLGVGYTTIMTPVF

SEQ ID NO: 838495 - protein, 17 aa, Mycobacterium
MDTATEGLRKRVLEVEK

SEQ ID NO: 838496 - protein, 17 aa, Mycobacterium
MDTLIAVGGFVEVITAW

SEQ ID NO: 838497 - protein, 26 aa, Mycobacterium
MDTVATARFLLAAWAGVLTMEAGSGD

SEQ ID NO: 838498 - protein, 18 aa, Mycobacterium
MDVLEYWNIIRPELPGLR

SEQ ID NO: 838499 - protein, 19 aa, Mycobacterium
MDVLTLFSYPVHPPGKPER

SEQ ID NO: 838500 - protein, 18 aa, Mycobacterium
MEAAFWRLQDRVAREPVT

SEQ ID NO: 838501 - protein, 17 aa, Mycobacterium
MEAAWGREYRRGRIMHK

SEQ ID NO: 838502 - protein, 21 aa, Mycobacterium
MEAGPMCRKAVMKSQPWILAY

SEQ ID NO: 838503 - protein, 22 aa, Mycobacterium
MEALAEPCAIRHVFSHPKIGEY

SEQ ID NO: 838504 - protein, 17 aa, Mycobacterium
MEALAGIEPRPSSTSFF

SEQ ID NO: 838505 - protein, 24 aa, Mycobacterium
MEAPAIGRVIALDAGLPVTVPGMQ

SEQ ID NO: 838506 - protein, 21 aa, Mycobacterium
MEARHLILIAMGRSKAEAVHH

SEQ ID NO: 838507 - protein, 27 aa, Mycobacterium
MEAYEEKPTIVLPGTGGSVSGTAVNDW

SEQ ID NO: 838508 - protein, 27 aa, Mycobacterium
MEDAWWGPTVPLEGAPWFALSERNSPG

SEQ ID NO: 838509 - protein, 37 aa, Mycobacterium
MEDLDNEFLAPLPLAAITPRWVARRLVGMAAGGPTLP

SEQ ID NO: 838510 - protein, 17 aa, Mycobacterium
MEDPLVTRPADAGPRDF

SEQ ID NO: 838511 - protein, 19 aa, Mycobacterium
MEDQIRILDPGRPFFEFLT

SEQ ID NO: 838512 - protein, 23 aa, Mycobacterium
MEEATFLTRFARSVTLIHRRDEF

SEQ ID NO: 838513 - protein, 24 aa, Mycobacterium
MEEATFLTRFARSVTLIHRRDEFR

SEQ ID NO: 838514 - protein, 24 aa, Mycobacterium
MEEATFLTRFARSVTLVHRREEFR

SEQ ID NO: 838515 - protein, 24 aa, Mycobacterium
MEEFQAMQSAWWKIAIDTAGYGRA

SEQ ID NO: 838516 - protein, 26 aa, Mycobacterium
MEETPMLLQPGVLSLAWGSVVRQLAA

SEQ ID NO: 838517 - protein, 21 aa, Mycobacterium
MEGLSQLKPVLEGGIHTAGTS

SEQ ID NO: 838518 - protein, 25 aa, Mycobacterium
MEGTSPRRALSELLRRGTKNMPGAD

SEQ ID NO: 838519 - protein, 18 aa, Mycobacterium
MEGWFWRLTDAASGRVVV

SEQ ID NO: 838520 - protein, 20 aa, Mycobacterium
MEGYGWVFEGYRDGLLEADD

SEQ ID NO: 838521 - protein, 19 aa, Mycobacterium
MEIHPALLDAALHAWVLAS

SEQ ID NO: 838522 - protein, 17 aa, Mycobacterium
MEILHEKNFLAAKAAYY

SEQ ID NO: 838523 - protein, 17 aa, Mycobacterium
MEKLYHQEWHYFFENTC

SEQ ID NO: 838524 - protein, 20 aa, Mycobacterium
MEKVTPLRRLGDPADIAAAA

SEQ ID NO: 838525 - protein, 17 aa, Mycobacterium
MELLGLTATPERGDGVD

SEQ ID NO: 838526 - protein, 35 aa, Mycobacterium
MELVPWLREGQWGAPLLFYLDAGIPPLSAMANSHV

SEQ ID NO: 838527 - protein, 22 aa, Mycobacterium
MEMRVIFDVLLDRVAGVTVTGP

SEQ ID NO: 838528 - protein, 31 aa, Mycobacterium
MEPFCGVAVRGFPNYFFITGPDAAAQGRYIA

SEQ ID NO: 838529 - protein, 18 aa, Mycobacterium
MEPHACIAQWNLGDSGKP

SEQ ID NO: 838530 - protein, 25 aa, Mycobacterium
MEPLIRSGLARKLSFTGSTKVGRML

SEQ ID NO: 838531 - protein, 25 aa, Mycobacterium
MEPSPYLPTSRRFVNPIYLRVEAIP

SEQ ID NO: 838532 - protein, 19 aa, Mycobacterium
MEQFRPGVAERLGLSYDAM

SEQ ID NO: 838533 - protein, 23 aa, Mycobacterium
MEQIAIDEWMLASPIYAKRIQQA

SEQ ID NO: 838534 - protein, 21 aa, Mycobacterium
MEQVAVIRYLIRHTGTIPVDR

SEQ ID NO: 838535 - protein, 18 aa, Mycobacterium
MERAGLEIPLLIGGATTS

SEQ ID NO: 838536 - protein, 23 aa, Mycobacterium
MERDPVPFLNVSTLTAYILELLG

SEQ ID NO: 838537 - protein, 18 aa, Mycobacterium
MEREGLEIPLLIGGATTS

SEQ ID NO: 838538 - protein, 17 aa, Mycobacterium
MERGVAIVVSYLEHQMA

SEQ ID NO: 838539 - protein, 23 aa, Mycobacterium
MERLAPLGPVYQAGTLSGNPVAM

SEQ ID NO: 838540 - protein, 22 aa, Mycobacterium
MERMRPMELFEIFADLELAWGP

SEQ ID NO: 838541 - protein, 18 aa, Mycobacterium
MESEARLVMLDRGLPLPE

SEQ ID NO: 838542 - protein, 26 aa, Mycobacterium
MESETFAPHGLWTRNYKEMMNEMAAL

SEQ ID NO: 838543 - protein, 23 aa, Mycobacterium
MESTYTMWERRLGVPVIRATYDI

SEQ ID NO: 838544 - protein, 28 aa, Mycobacterium
MESVLMAIGPRRQLWARLGDSLRPRHLA

SEQ ID NO: 838545 - protein, 23 aa, Mycobacterium
MESVRTPHFVNENLVFVITDATI

SEQ ID NO: 838546 - protein, 25 aa, Mycobacterium
METDASGFGVPPLEFFDPRATPHPR

SEQ ID NO: 838547 - protein, 29 aa, Mycobacterium
METIPATYGFPLPPIGYLEAVKDLCVRYD

SEQ ID NO: 838548 - protein, 22 aa, Mycobacterium
METIVCGSGLDWTIVRPSGLFD

SEQ ID NO: 838549 - protein, 32 aa, Mycobacterium
METLREHLGIDRWLLYGGSWASTLILAYAQRH

SEQ ID NO: 838550 - protein, 28 aa, Mycobacterium
METNPQLTHVLTPFLPDWVAEPDEIADT

SEQ ID NO: 838551 - protein, 24 aa, Mycobacterium
METPIVNPPPYWQVAAEQGLQGLH

SEQ ID NO: 838552 - protein, 39 aa, Mycobacterium
METWHPLGVVGVITAFNFPVAVWAWNIAVALVCGDTVVW

SEQ ID NO: 838553 - protein, 38 aa, Mycobacterium
METWHPLGVVGVITAFNFPVAVWAWNTAVALVCGDTVL

SEQ ID NO: 838554 - protein, 19 aa, Mycobacterium
METYPEWVPEYKKVEVLRA

SEQ ID NO: 838555 - protein, 27 aa, Mycobacterium
MEVGPDGLLYFPVMGANEIWRVDPDGG

SEQ ID NO: 838556 - protein, 25 aa, Mycobacterium
MEVLDEVILGLRRLHQPVIAAVNGP

SEQ ID NO: 838557 - protein, 17 aa, Mycobacterium
MEVLKPVLAFVDFGEYA

SEQ ID NO: 838558 - protein, 24 aa, Mycobacterium
MEVPAFALALMRRSLSGSNIGGIA

SEQ ID NO: 838559 - protein, 22 aa, Mycobacterium
MEVPQLMFREPVLATLEEEGST

SEQ ID NO: 838560 - protein, 17 aa, Mycobacterium
MEVPYWSSTTCLSASFD

SEQ ID NO: 838561 - protein, 25 aa, Mycobacterium
MEVVGRFLALLELYRSRAVAFDQSE

SEQ ID NO: 838562 - protein, 26 aa, Mycobacterium
MEVVGRFLALLELYRSRAVAFDQSEP

SEQ ID NO: 838563 - protein, 17 aa, Mycobacterium
MEVVKPATFLFAAGQET

SEQ ID NO: 838564 - protein, 17 aa, Mycobacterium
MEWCAMVGCPIVGIQDS

SEQ ID NO: 838565 - protein, 17 aa, Mycobacterium
MEYLNDRGWYHDLPFTD

SEQ ID NO: 838566 - protein, 17 aa, Mycobacterium
MEYLPWANRLQEGDDVL

SEQ ID NO: 838567 - protein, 30 aa, Mycobacterium
MFAAGWLSAQVVATLTWATHLVGDEQVLAI

SEQ ID NO: 838568 - protein, 18 aa, Mycobacterium
MFAFGHGLSYTKFDYRDL

SEQ ID NO: 838569 - protein, 24 aa, Mycobacterium
MFAFSGILTALYTRATTGAVRPVS

SEQ ID NO: 838570 - protein, 24 aa, Mycobacterium
MFAPATLCEYLGLALDFGERVDLG

SEQ ID NO: 838571 - protein, 18 aa, Mycobacterium
MFAPKLDAAALLHRLSLK

SEQ ID NO: 838572 - protein, 25 aa, Mycobacterium
MFAPSDYILDWASPVPFFGDVDQAQ

SEQ ID NO: 838573 - protein, 21 aa, Mycobacterium
MFAVGIDRWKPVPAPDMQAHN

SEQ ID NO: 838574 - protein, 19 aa, Mycobacterium
MFDLIHQMRSRIITSPSFG

SEQ ID NO: 838575 - protein, 19 aa, Mycobacterium
MFDRRAFVDLFSSAGLVDL

SEQ ID NO: 838576 - protein, 24 aa, Mycobacterium
MFDTLLVYENFPLDGLTAGTELTA

SEQ ID NO: 838577 - protein, 35 aa, Mycobacterium
MFDVMGFGKPLDHTPILFQPGVLSIAWGTSIRQLA

SEQ ID NO: 838578 - protein, 18 aa, Mycobacterium
MFDWAIGVGIKVSQARQA

SEQ ID NO: 838579 - protein, 17 aa, Mycobacterium
MFEPLGYDIRRRVKNFE

SEQ ID NO: 838580 - protein, 17 aa, Mycobacterium
MFERLPAPYGLVRAGVA

SEQ ID NO: 838581 - protein, 17 aa, Mycobacterium
MFEVLLGAFPTIELTGD

SEQ ID NO: 838582 - protein, 19 aa, Mycobacterium
MFEVNVFGLHRMTRAVLPH

SEQ ID NO: 838583 - protein, 24 aa, Mycobacterium
MFGPAGHLYVYQSHGIHMCANVVC

SEQ ID NO: 838584 - protein, 20 aa, Mycobacterium
MFGPPGRLYTYRSHGIHVCA

SEQ ID NO: 838585 - protein, 18 aa, Mycobacterium
MFGQGVSMYSAAKAALVS

SEQ ID NO: 838586 - protein, 25 aa, Mycobacterium
MFHGFGLGQLMLTLALGGTVLTQRH

SEQ ID NO: 838587 - protein, 17 aa, Mycobacterium
MFHGRSLEFDDLRPYIL

SEQ ID NO: 838588 - protein, 27 aa, Mycobacterium
MFHSVAFDFSVWELWGALLHGACVVVV

SEQ ID NO: 838589 - protein, 26 aa, Mycobacterium
MFKEWVGPSRLFITIFRDLEGLSHSM

SEQ ID NO: 838590 - protein, 18 aa, Mycobacterium
MFKNALTGLPIGGGKGGS

SEQ ID NO: 838591 - protein, 17 aa, Mycobacterium
MFLSAYSLETIAAQVGA

SEQ ID NO: 838592 - protein, 21 aa, Mycobacterium
MFMNEGTMKLFRPDLKNPGPE

SEQ ID NO: 838593 - protein, 25 aa, Mycobacterium
MFMVSHFHYDPVWWNTQGAYTSQWH

SEQ ID NO: 838594 - protein, 20 aa, Mycobacterium
MFQMPPALEQAWHTRGYYGS

SEQ ID NO: 838595 - protein, 17 aa, Mycobacterium
MFQPETFITMCKGRFLA

SEQ ID NO: 838596 - protein, 26 aa, Mycobacterium
MFQQLPTAGLPFHFQAWEQFEGFVDD

SEQ ID NO: 838597 - protein, 17 aa, Mycobacterium
MFQQLPTAGLPFQFQTW

SEQ ID NO: 838598 - protein, 19 aa, Mycobacterium
MFRLINPRQWSERTVIALV

SEQ ID NO: 838599 - protein, 21 aa, Mycobacterium
MFRMPPALERAWHTHGYYGSV

SEQ ID NO: 838600 - protein, 17 aa, Mycobacterium
MFRRVDLASALVVPPKV

SEQ ID NO: 838601 - protein, 26 aa, Mycobacterium
MFRTTELFLERLGLTSLSDLPDIAPL

SEQ ID NO: 838602 - protein, 33 aa, Mycobacterium
MFSEHLLLHPMSAPMTLRWLRDRFAGRPISAHI

SEQ ID NO: 838603 - protein, 17 aa, Mycobacterium
MFSGLEGFESLEEAADA

SEQ ID NO: 838604 - protein, 22 aa, Mycobacterium
MFTEMPLAEALARWARDILAQR

SEQ ID NO: 838605 - protein, 20 aa, Mycobacterium
MFTHQLLERASADRQRIVLP

SEQ ID NO: 838606 - protein, 19 aa, Mycobacterium
MFTLGFRFKPWTSEKAIAD

SEQ ID NO: 838607 - protein, 19 aa, Mycobacterium
MFTSFLFEPDFGVVDLAAN

SEQ ID NO: 838608 - protein, 19 aa, Mycobacterium
MFVLTRRSVAQREGYPVLA

SEQ ID NO: 838609 - protein, 18 aa, Mycobacterium
MFVPFHDGVISQFEGYEQ

SEQ ID NO: 838610 - protein, 17 aa, Mycobacterium
MFVPMPGLPLEAAITAR

SEQ ID NO: 838611 - protein, 20 aa, Mycobacterium
MFVSLFAQHLHDWFRRDDQG

SEQ ID NO: 838612 - protein, 19 aa, Mycobacterium
MGADGWLALGWPKEFGGQD

SEQ ID NO: 838613 - protein, 26 aa, Mycobacterium
MGAFWNSMDYLYRPVSHTPSRSAIDA

SEQ ID NO: 838614 - protein, 36 aa, Mycobacterium
MGAGICQWFHGDATYRAVLALLLLTGSMGRNGGGWA

SEQ ID NO: 838615 - protein, 19 aa, Mycobacterium
MGAGLYRHHPVFTTAIDEI

SEQ ID NO: 838616 - protein, 24 aa, Mycobacterium
MGAHSAPLGLSFTDGVLPEPYASG

SEQ ID NO: 838617 - protein, 22 aa, Mycobacterium
MGALDGFYSTWNKARETFGQGA

SEQ ID NO: 838618 - protein, 24 aa, Mycobacterium
MGALHAWCLAAQRPELVSALVLED

SEQ ID NO: 838619 - protein, 23 aa, Mycobacterium
MGALHSWCLAAERPGLVSALVVE

SEQ ID NO: 838620 - protein, 24 aa, Mycobacterium
MGALHSWCLAAQRPDLVSALVVED

SEQ ID NO: 838621 - protein, 24 aa, Mycobacterium
MGAPGTEVWTFTALNRGTTTISTG

SEQ ID NO: 838622 - protein, 23 aa, Mycobacterium
MGARLDFGCVWINTHIPLVAEMP

SEQ ID NO: 838623 - protein, 19 aa, Mycobacterium
MGASYLRYAMAMRDRLPLV

SEQ ID NO: 838624 - protein, 25 aa, Mycobacterium
MGAVLHTLNIRLFPEQIAYVANEAE

SEQ ID NO: 838625 - protein, 18 aa, Mycobacterium
MGAVPMVLGALAAADAEA

SEQ ID NO: 838626 - protein, 19 aa, Mycobacterium
MGCDDSCPYFPGKRYENWE

SEQ ID NO: 838627 - protein, 31 aa, Mycobacterium
MGCGDTCPYFPGVSYRDWKVPDPAGQPLPAV

SEQ ID NO: 838628 - protein, 30 aa, Mycobacterium
MGCGDTCPYFPGVTYRDWKLPDPAGQALEV

SEQ ID NO: 838629 - protein, 31 aa, Mycobacterium
MGCGDTCPYFPGVTYRDWKLPDPAGQPLDTV

SEQ ID NO: 838630 - protein, 28 aa, Mycobacterium
MGDALFGTTDSWLLWNLTGGTSGGVHVT

SEQ ID NO: 838631 - protein, 22 aa, Mycobacterium
MGDDLVPYRTLTGQAPVAVMVG

SEQ ID NO: 838632 - protein, 20 aa, Mycobacterium
MGDRFVLIRIDSTVGRQAAG

SEQ ID NO: 838633 - protein, 17 aa, Mycobacterium
MGEAPRLFVVTRGAQTV

SEQ ID NO: 838634 - protein, 22 aa, Mycobacterium
MGEAWWVPIVQIPNDTIDGKQR

SEQ ID NO: 838635 - protein, 19 aa, Mycobacterium
MGEAWWVPVVQIPGDTIDG

SEQ ID NO: 838636 - protein, 26 aa, Mycobacterium
MGEDLLPVLLSLLKWGDDYLQNGHKP

SEQ ID NO: 838637 - protein, 24 aa, Mycobacterium
MGEDPVIPRLFQAMGFLGDGAREI

SEQ ID NO: 838638 - protein, 30 aa, Mycobacterium
MGEGEAMLFGDYIRLMALVEYSADELKTVF

SEQ ID NO: 838639 - protein, 25 aa, Mycobacterium
MGEGEAMLFGEYIRLMALVEYSADE

SEQ ID NO: 838640 - protein, 24 aa, Mycobacterium
MGEIFGTLIMGARLVIPRPDGLRD

SEQ ID NO: 838641 - protein, 19 aa, Mycobacterium
MGELYEYFLGNFARAEGRR

SEQ ID NO: 838642 - protein, 31 aa, Mycobacterium
MGETHYLFGADRFPWSMKFARAMGSAGIDMN

SEQ ID NO: 838643 - protein, 22 aa, Mycobacterium
MGEVRRYFRDYSWGMRVPRRLR

SEQ ID NO: 838644 - protein, 25 aa, Mycobacterium
MGEVRVPAKALWRAQTQRAVENFPI

SEQ ID NO: 838645 - protein, 22 aa, Mycobacterium
MGEVRVPKDALWRAQTQRAVEN

SEQ ID NO: 838646 - protein, 25 aa, Mycobacterium
MGEVRVPKDALWRAQTQRAVENFPI

SEQ ID NO: 838647 - protein, 19 aa, Mycobacterium
MGFAKPMDEIPMLLQPGIL

SEQ ID NO: 838648 - protein, 17 aa, Mycobacterium
MGFAQHQFLVPPDAMDE

SEQ ID NO: 838649 - protein, 18 aa, Mycobacterium
MGFKTFGFGFGREDIWEP

SEQ ID NO: 838650 - protein, 17 aa, Mycobacterium
MGFSDAGAHLRNMAFYN

SEQ ID NO: 838651 - protein, 25 aa, Mycobacterium
MGFSRTAWGLVQPLVARRLRSVVYD

SEQ ID NO: 838652 - protein, 18 aa, Mycobacterium
MGFVLISELCRVSMGLVT

SEQ ID NO: 838653 - protein, 22 aa, Mycobacterium
MGFWRAAWYVGTSYSTYVVVRQ

SEQ ID NO: 838654 - protein, 22 aa, Mycobacterium
MGGAAGLFGGGGVGGVGGAGAA

SEQ ID NO: 838655 - protein, 27 aa, Mycobacterium
MGGAGGQAGWLSGAGGTGGAGGAGDNG

SEQ ID NO: 838656 - protein, 19 aa, Mycobacterium
MGGEWLPEAAVNHTGLLDV

SEQ ID NO: 838657 - protein, 24 aa, Mycobacterium
MGGFMMNGLWNRRFDEAVIIDCPD

SEQ ID NO: 838658 - protein, 35 aa, Mycobacterium
MGGGICHWFHADAIYRAVLALLMLTGSMGRNGGGW

SEQ ID NO: 838659 - protein, 25 aa, Mycobacterium
MGGHTVVSKLLLLFGTEEQKQKYLP

SEQ ID NO: 838660 - protein, 27 aa, Mycobacterium
MGGLGLANALWRFLPDRVRVLDFPTNF

SEQ ID NO: 838661 - protein, 24 aa, Mycobacterium
MGGLHSWCLAAQRPDLVSALVVED

SEQ ID NO: 838662 - protein, 27 aa, Mycobacterium
MGGNGGSGSWLIGGGGAGGAGGIGGTG

SEQ ID NO: 838663 - protein, 25 aa, Mycobacterium
MGGRPVVAVNLLGWPRDVLPFELAT

SEQ ID NO: 838664 - protein, 25 aa, Mycobacterium
MGGSGGLLYGLGGTGGLGGLGGNGG

SEQ ID NO: 838665 - protein, 24 aa, Mycobacterium
MGGTATLGFNGGMAGAGGNGGSAL

SEQ ID NO: 838666 - protein, 24 aa, Mycobacterium
MGGTGGTGGFFGNGGFGGDGGDGA

SEQ ID NO: 838667 - protein, 17 aa, Mycobacterium
MGGTYTGTGPGSSASGG

SEQ ID NO: 838668 - protein, 18 aa, Mycobacterium
MGHDLPEPVWKPVTSELL

SEQ ID NO: 838669 - protein, 30 aa, Mycobacterium
MGHDPNLLRLVRLHQLHLLQTLSPHTADLD

SEQ ID NO: 838670 - protein, 24 aa, Mycobacterium
MGHEGMLYSLPSRDLITDSIEYMV

SEQ ID NO: 838671 - protein, 24 aa, Mycobacterium
MGHRLTIAVQWRATVEWDGDRPVS

SEQ ID NO: 838672 - protein, 23 aa, Mycobacterium
MGIDSVFPLYLTLDSALSSLAGE

SEQ ID NO: 838673 - protein, 29 aa, Mycobacterium
MGIDVTYPLHRYFLWAKQIELSLGSAPQQ

SEQ ID NO: 838674 - protein, 18 aa, Mycobacterium
MGINPFFDAPYEDVSKGI

SEQ ID NO: 838675 - protein, 23 aa, Mycobacterium
MGINYGLNKVRFLSAVTAGSRIR

SEQ ID NO: 838676 - protein, 24 aa, Mycobacterium
MGIPARYVSGYLHPTRGAAVGDTI

SEQ ID NO: 838677 - protein, 17 aa, Mycobacterium
MGIPFATTTTPPPPRPA

SEQ ID NO: 838678 - protein, 20 aa, Mycobacterium
MGISLPAAIAAKLVHPDRKV

SEQ ID NO: 838679 - protein, 21 aa, Mycobacterium
MGISLPAAIAAKLVHPERKVV

SEQ ID NO: 838680 - protein, 19 aa, Mycobacterium
MGITGWVALTIAQAGTDEQ

SEQ ID NO: 838681 - protein, 21 aa, Mycobacterium
MGKGFFVTWVTTYRDQNGEVI

SEQ ID NO: 838682 - protein, 21 aa, Mycobacterium
MGKLRRLDFAWPECRVAVEYD

SEQ ID NO: 838683 - protein, 26 aa, Mycobacterium
MGLAERLIEFFGGIPILDGIGSTEVG

SEQ ID NO: 838684 - protein, 25 aa, Mycobacterium
MGLDARTIPFVKPAVFLHSQTTRCL

SEQ ID NO: 838685 - protein, 25 aa, Mycobacterium
MGLFGYAIPQEWGGLGLDLPQDVEL

SEQ ID NO: 838686 - protein, 25 aa, Mycobacterium
MGLFGYAIPQEWGGLGLNLAQDVEL

SEQ ID NO: 838687 - protein, 25 aa, Mycobacterium
MGLFGYAIPQQWGGLGLNLAQDVEL

SEQ ID NO: 838688 - protein, 29 aa, Mycobacterium
MGLGGRFFDKIPSGLLERVLPKPGTGPSE

SEQ ID NO: 838689 - protein, 30 aa, Mycobacterium
MGLKVNMTLLRFISFILKEIYPGGKLPQVD

SEQ ID NO: 838690 - protein, 19 aa, Mycobacterium
MGLLHGGVLAQRLTAWVGL

SEQ ID NO: 838691 - protein, 23 aa, Mycobacterium
MGLNVCQQLSWGAPPSQLEGLAL

SEQ ID NO: 838692 - protein, 21 aa, Mycobacterium
MGLPELTSTKWIVWGDGQIRP

SEQ ID NO: 838693 - protein, 21 aa, Mycobacterium
MGLPELTSTKWIVWGEGHTRP

SEQ ID NO: 838694 - protein, 30 aa, Mycobacterium
MGLQVNMTLLRFISFILKEIYPGGKLPQVD

SEQ ID NO: 838695 - protein, 17 aa, Mycobacterium
MGLRHHSYLGALVALVA

SEQ ID NO: 838696 - protein, 18 aa, Mycobacterium
MGLRLASRRVVLDHAVVG

SEQ ID NO: 838697 - protein, 22 aa, Mycobacterium
MGLRPLIERVPMSRLGVAASRR

SEQ ID NO: 838698 - protein, 20 aa, Mycobacterium
MGLVLDFHRQPALGGLDSFD

SEQ ID NO: 838699 - protein, 17 aa, Mycobacterium
MGLYYSGGYDWTFNPTV

SEQ ID NO: 838700 - protein, 17 aa, Mycobacterium
MGMFSMACRFDVMPVNP

SEQ ID NO: 838701 - protein, 25 aa, Mycobacterium
MGMGGSIPFIAEFAAAFPDATILVT

SEQ ID NO: 838702 - protein, 25 aa, Mycobacterium
MGMGGSIPFIAEFAAAFPQAKILVT

SEQ ID NO: 838703 - protein, 25 aa, Mycobacterium
MGMLALGVPYGEVMRWALLGSEERM

SEQ ID NO: 838704 - protein, 32 aa, Mycobacterium
MGMLGEFGLTWPWESLHLEALAWFDHWLKSRD

SEQ ID NO: 838705 - protein, 26 aa, Mycobacterium
MGMLYRRNLVMFGPREVLLTSDEPVI

SEQ ID NO: 838706 - protein, 18 aa, Mycobacterium
MGMMSSPTGELFFDNVRL

SEQ ID NO: 838707 - protein, 31 aa, Mycobacterium
MGMVRCVRAALPLLRAAEWARIVNFSAHSTQ

SEQ ID NO: 838708 - protein, 17 aa, Mycobacterium
MGNLIIGSPLVTAWTVG

SEQ ID NO: 838709 - protein, 26 aa, Mycobacterium
MGPAVTMYIPAFLRYDLREANGEWLI

SEQ ID NO: 838710 - protein, 28 aa, Mycobacterium
MGPDDPVPMMLLPTIPTMVWGGNVRMIG

SEQ ID NO: 838711 - protein, 19 aa, Mycobacterium
MGPELVSRWAAYMPPAPTQ

SEQ ID NO: 838712 - protein, 19 aa, Mycobacterium
MGPELVSRWAAYMPPGPTQ

SEQ ID NO: 838713 - protein, 19 aa, Mycobacterium
MGPHGLRHSAATHLLEGGA

SEQ ID NO: 838714 - protein, 18 aa, Mycobacterium
MGPIQRYLGPLVPTERMI

SEQ ID NO: 838715 - protein, 19 aa, Mycobacterium
MGPSPTTLLAAAVSAAGGL

SEQ ID NO: 838716 - protein, 21 aa, Mycobacterium
MGQEDLIRFAPIDCVDTLITD

SEQ ID NO: 838717 - protein, 37 aa, Mycobacterium
MGQHLVLMPRFEPAEFLRLVTSHRVTFLTTVPTIMQR

SEQ ID NO: 838718 - protein, 17 aa, Mycobacterium
MGQLPLSGGVPGGGAAG

SEQ ID NO: 838719 - protein, 23 aa, Mycobacterium
MGQSKIAVFRYLLGDEDKAQHAN

SEQ ID NO: 838720 - protein, 28 aa, Mycobacterium
MGRAALDLMLFHAWHLYSDLGLNVVLPV

SEQ ID NO: 838721 - protein, 24 aa, Mycobacterium
MGRAPRAYRAVVQPVAETPAAPVD

SEQ ID NO: 838722 - protein, 18 aa, Mycobacterium
MGREAVIGCGAMLDHFCV

SEQ ID NO: 838723 - protein, 24 aa, Mycobacterium
MGREMLDQRFAGMKQALENATDED

SEQ ID NO: 838724 - protein, 28 aa, Mycobacterium
MGREVVRMFPVPPMALRLRTAVAILSYG

SEQ ID NO: 838725 - protein, 27 aa, Mycobacterium
MGRGLCERFPVFGKAFDAAAEALDEHL

SEQ ID NO: 838726 - protein, 27 aa, Mycobacterium
MGRIDPRTRWLLRELVHALLVKKDHAA

SEQ ID NO: 838727 - protein, 27 aa, Mycobacterium
MGRIDPRTRWLLRELVYALLVKKDHAA

SEQ ID NO: 838728 - protein, 18 aa, Mycobacterium
MGRLAGRGFAAYGTAKAA

SEQ ID NO: 838729 - protein, 24 aa, Mycobacterium
MGRLAGRGFVAYGTAKAALAHYTR

SEQ ID NO: 838730 - protein, 18 aa, Mycobacterium
MGRLAPLGPVYQAGTLSG

SEQ ID NO: 838731 - protein, 27 aa, Mycobacterium
MGRPEELTGLYLYLASAASSYMTGSDI

SEQ ID NO: 838732 - protein, 20 aa, Mycobacterium
MGRRELADAIFPPFEVAVTV

SEQ ID NO: 838733 - protein, 17 aa, Mycobacterium
MGRRPGARWAADLVAAA

SEQ ID NO: 838734 - protein, 18 aa, Mycobacterium
MGRRPGARWAADLVAAAE

SEQ ID NO: 838735 - protein, 26 aa, Mycobacterium
MGRVYGWLLICDPPQQSLTALAAALS

SEQ ID NO: 838736 - protein, 19 aa, Mycobacterium
MGRYAGWIALNAGMASGVH

SEQ ID NO: 838737 - protein, 22 aa, Mycobacterium
MGRYPVLFLDPDFNEDIRLALV

SEQ ID NO: 838738 - protein, 24 aa, Mycobacterium
MGSEGYLLNQFLAPRTNKRTDSWG

SEQ ID NO: 838739 - protein, 35 aa, Mycobacterium
MGSLATAQLIRAGIDNLWVVNRSAERARRLAATAR

SEQ ID NO: 838740 - protein, 43 aa, Mycobacterium
MGSPYLANGLFLSLPWFYRAGYDVLLYTLPFHGLRAERFSPFS

SEQ ID NO: 838741 - protein, 29 aa, Mycobacterium
MGSYPDFPEKYWLPIPVDVTAEAIVHASI

SEQ ID NO: 838742 - protein, 26 aa, Mycobacterium
MGTEVSLRWIFVHMIAEYARHCGHAD

SEQ ID NO: 838743 - protein, 24 aa, Mycobacterium
MGTGIGLCLLRQGAKLRVIANKDR

SEQ ID NO: 838744 - protein, 27 aa, Mycobacterium
MGTPEDLVGMCLFLLGDQASWITGQIF

SEQ ID NO: 838745 - protein, 27 aa, Mycobacterium
MGTPEDLVGMCLFLLSDEASWITGQIF

SEQ ID NO: 838746 - protein, 27 aa, Mycobacterium
MGTPEDLVGMCLFLLSDQASWITGQIF

SEQ ID NO: 838747 - protein, 17 aa, Mycobacterium
MGTVYQAVISALTSQGW

SEQ ID NO: 838748 - protein, 24 aa, Mycobacterium
MGVDQGFIRKSGSWFTYEGEQLGQ

SEQ ID NO: 838749 - protein, 28 aa, Mycobacterium
MGVDSLLALDLRKRLRRATGRSVPLAAM

SEQ ID NO: 838750 - protein, 27 aa, Mycobacterium
MGVFFNSMDYLYRPVSYTPSRTKIDTD

SEQ ID NO: 838751 - protein, 24 aa, Mycobacterium
MGVNWVGPIIMRYGTEEQQRKHLP

SEQ ID NO: 838752 - protein, 26 aa, Mycobacterium
MGVQLALTQLWRSYGVHPDAVIGHSM

SEQ ID NO: 838753 - protein, 18 aa, Mycobacterium
MGVRHRDLPIHGVQFHPE

SEQ ID NO: 838754 - protein, 20 aa, Mycobacterium
MGVTWMLRPSAENVTIVEHG

SEQ ID NO: 838755 - protein, 17 aa, Mycobacterium
MGVWSENSLDRSVLVAV

SEQ ID NO: 838756 - protein, 19 aa, Mycobacterium
MGWSPFYPQFDRSSLDVAD

SEQ ID NO: 838757 - protein, 19 aa, Mycobacterium
MGWYERDWYLGAHRSEIFD

SEQ ID NO: 838758 - protein, 28 aa, Mycobacterium
MGYPSFHDEYWNPLWKALVDTDTVMNVH

SEQ ID NO: 838759 - protein, 28 aa, Mycobacterium
MGYPSFHDEYWNPLWKALVETDTVMNVH

SEQ ID NO: 838760 - protein, 24 aa, Mycobacterium
MGYPSFHNDYWNPLWKALCDTNTV

SEQ ID NO: 838761 - protein, 25 aa, Mycobacterium
MGYPSFHNEYWNPLWKALCDTNTVM

SEQ ID NO: 838762 - protein, 27 aa, Mycobacterium
MGYRQHLLRSILPLRESGLTADDGSRV

SEQ ID NO: 838763 - protein, 27 aa, Mycobacterium
MHAAGMWTAFSALCAGLPVVLYDDRNK

SEQ ID NO: 838764 - protein, 20 aa, Mycobacterium
MHANWFGLFGERVAEFLRRG

SEQ ID NO: 838765 - protein, 19 aa, Mycobacterium
MHAVLVATNFFGINTIPIA

SEQ ID NO: 838766 - protein, 21 aa, Mycobacterium
MHAVVAPVWPSNPWTAAYRQD

SEQ ID NO: 838767 - protein, 18 aa, Mycobacterium
MHDAIVYSLLHGGVDSPR

SEQ ID NO: 838768 - protein, 24 aa, Mycobacterium
MHDDLFDFFYDALPGYEKVGLRRT

SEQ ID NO: 838769 - protein, 25 aa, Mycobacterium
MHDDLFDFFYTALPGYEKVGLRRTL

SEQ ID NO: 838770 - protein, 28 aa, Mycobacterium
MHDELMRLWVEAEVLRLAGERLRQQATM

SEQ ID NO: 838771 - protein, 20 aa, Mycobacterium
MHDQLVQTLSASSASYAGAE

SEQ ID NO: 838772 - protein, 17 aa, Mycobacterium
MHEALLSYLGIERFHLL

SEQ ID NO: 838773 - protein, 29 aa, Mycobacterium
MHEELTSLLRFVLDLLSDYGLDDFYLELS

SEQ ID NO: 838774 - protein, 18 aa, Mycobacterium
MHEIVINPLLGGKLAREN

SEQ ID NO: 838775 - protein, 22 aa, Mycobacterium
MHEWDIVCRIATAMGYPMHYDH

SEQ ID NO: 838776 - protein, 25 aa, Mycobacterium
MHFFGYGSLFEPYVTYHRADADGEL

SEQ ID NO: 838777 - protein, 17 aa, Mycobacterium
MHHGAVMEGSWGASGER

SEQ ID NO: 838778 - protein, 17 aa, Mycobacterium
MHIAVTRLGITSVRFTG

SEQ ID NO: 838779 - protein, 18 aa, Mycobacterium
MHILRDKQQWQRLGRKHG

SEQ ID NO: 838780 - protein, 20 aa, Mycobacterium
MHKNWNPHDYIPWSDGKNYY

SEQ ID NO: 838781 - protein, 21 aa, Mycobacterium
MHKNWNPHDYIPWSDGKNYYA

SEQ ID NO: 838782 - protein, 19 aa, Mycobacterium
MHLHTRLTERFDAVIVPGV

SEQ ID NO: 838783 - protein, 18 aa, Mycobacterium
MHLLTQAASAGVPFLVIE

SEQ ID NO: 838784 - protein, 19 aa, Mycobacterium
MHLLYSMIMVSFPVECWKQ

SEQ ID NO: 838785 - protein, 20 aa, Mycobacterium
MHLLYSMIMVSFPVECWKQP

SEQ ID NO: 838786 - protein, 17 aa, Mycobacterium
MHLRTGVAMLSYADDLC

SEQ ID NO: 838787 - protein, 20 aa, Mycobacterium
MHLVGHPRPVNPRPGLATAA

SEQ ID NO: 838788 - protein, 19 aa, Mycobacterium
MHMLYSMIQASFPVECWKQ

SEQ ID NO: 838789 - protein, 18 aa, Mycobacterium
MHNAPLLMRGERSHHGLM

SEQ ID NO: 838790 - protein, 24 aa, Mycobacterium
MHNRIKWTIVRYQPPEGMTLNGDG

SEQ ID NO: 838791 - protein, 31 aa, Mycobacterium
MHPGHLVTRWLATFTFFRAALGVAAPRLQAY

SEQ ID NO: 838792 - protein, 22 aa, Mycobacterium
MHQAFRNIVIMLHEVRDGLIRD

SEQ ID NO: 838793 - protein, 33 aa, Mycobacterium
MHREPMPWNGPLFKFALFQVASEEFYLFVSIHH

SEQ ID NO: 838794 - protein, 22 aa, Mycobacterium
MHRLLLNLWEQHGFGVLLVTHD

SEQ ID NO: 838795 - protein, 18 aa, Mycobacterium
MHTALWDHDVALAGKRVA

SEQ ID NO: 838796 - protein, 17 aa, Mycobacterium
MHTLGGKVQGILVEDWR

SEQ ID NO: 838797 - protein, 23 aa, Mycobacterium
MHTSRSLMWNYVSTILAGDKSAD

SEQ ID NO: 838798 - protein, 18 aa, Mycobacterium
MHWMGSIGALNFFAGPAV

SEQ ID NO: 838799 - protein, 20 aa, Mycobacterium
MHWMSSIGALNFFAGPAVEQ

SEQ ID NO: 838800 - protein, 21 aa, Mycobacterium
MHYPVWRQSWTGVLPDSTIDV

SEQ ID NO: 838801 - protein, 38 aa, Mycobacterium
MIAATERGLLLTTLWYIREVDPTTLLLTGLTRDGVYLI

SEQ ID NO: 838802 - protein, 17 aa, Mycobacterium
MIAAVAAGATAAGAYSF

SEQ ID NO: 838803 - protein, 32 aa, Mycobacterium
MIADAKQVAPDKPFFLYFAPGATHSPHHVPKQ

SEQ ID NO: 838804 - protein, 40 aa, Mycobacterium
MIADLKLLARLLNLPYFPVTPFFPLAGPAGMIPLPSKWHI

SEQ ID NO: 838805 - protein, 18 aa, Mycobacterium
MIAEWMRRPHLAEAWEYV

SEQ ID NO: 838806 - protein, 24 aa, Mycobacterium
MIAHYCYGSFDLALRCVRLLEDRH

SEQ ID NO: 838807 - protein, 20 aa, Mycobacterium
MIAITANSPMLGGQFTGWCS

SEQ ID NO: 838808 - protein, 17 aa, Mycobacterium
MIAPESFVLNDIDGHAA

SEQ ID NO: 838809 - protein, 19 aa, Mycobacterium
MIAPMLGTDPTAYGLPAPN

SEQ ID NO: 838810 - protein, 17 aa, Mycobacterium
MIARRYMHEYGATSADF

SEQ ID NO: 838811 - protein, 22 aa, Mycobacterium
MIASFAAHLIAAGAAPSPLDAA

SEQ ID NO: 838812 - protein, 23 aa, Mycobacterium
MIASVLPYVGWLEATAVQAGHSA

SEQ ID NO: 838813 - protein, 26 aa, Mycobacterium
MIATVMERRLDRDRPLWECYLIEGLS

SEQ ID NO: 838814 - protein, 18 aa, Mycobacterium
MIAYFQQFQPVTAPGKIR

SEQ ID NO: 838815 - protein, 31 aa, Mycobacterium
MICTVGNYEYGFFWYFYNDASIEVEVKLSGV

SEQ ID NO: 838816 - protein, 31 aa, Mycobacterium
MICTVGNYEYGFFWYLYNDAGIEMEVKLTGV

SEQ ID NO: 838817 - protein, 18 aa, Mycobacterium
MIDALITALHRRTGRTTS

SEQ ID NO: 838818 - protein, 18 aa, Mycobacterium
MIDALLTALHRRTGRTTS

SEQ ID NO: 838819 - protein, 23 aa, Mycobacterium
MIDICDFAVGLSRQLYGRTIASE

SEQ ID NO: 838820 - protein, 18 aa, Mycobacterium
MIDICQFAVGLSRQLYGR

SEQ ID NO: 838821 - protein, 27 aa, Mycobacterium
MIDPDAWAFVWVVDPPLFEPADEATAA

SEQ ID NO: 838822 - protein, 27 aa, Mycobacterium
MIDTTPSMFAQLRAFGLLASVPLTVLA

SEQ ID NO: 838823 - protein, 21 aa, Mycobacterium
MIDVLRFWLGLGIDGFRLDAV

SEQ ID NO: 838824 - protein, 22 aa, Mycobacterium
MIDVLRFWLGLGIDGFRLDAVP

SEQ ID NO: 838825 - protein, 19 aa, Mycobacterium
MIDWWGPIVDEYYASSEAH

SEQ ID NO: 838826 - protein, 19 aa, Mycobacterium
MIDWWGPIVDEYYASSEAI

SEQ ID NO: 838827 - protein, 18 aa, Mycobacterium
MIDYAPPELAAQLVPRLL

SEQ ID NO: 838828 - protein, 25 aa, Mycobacterium
MIEAGPPYQKLLNGYLEFFDCPNTK

SEQ ID NO: 838829 - protein, 30 aa, Mycobacterium
MIEPWLMMNWHRTMDWLLLAPTLSAQQALD

SEQ ID NO: 838830 - protein, 19 aa, Mycobacterium
MIFDLAVATAIAWSKALDT

SEQ ID NO: 838831 - protein, 17 aa, Mycobacterium
MIFDLPPVMVKKFAPKG

SEQ ID NO: 838832 - protein, 17 aa, Mycobacterium
MIGALETLGLSVAASDS

SEQ ID NO: 838833 - protein, 19 aa, Mycobacterium
MIGLNFMPMSHIMGRGTLT

SEQ ID NO: 838834 - protein, 18 aa, Mycobacterium
MIGRAYLWGLAASGQAGV

SEQ ID NO: 838835 - protein, 25 aa, Mycobacterium
MIGSPLALALTTRAIARYCLGRPGW

SEQ ID NO: 838836 - protein, 25 aa, Mycobacterium
MIGTPGSRILYSGSPGLFEDVHPLL

SEQ ID NO: 838837 - protein, 25 aa, Mycobacterium
MIGVKVIPWIPTPAKRALFGGRSVT

SEQ ID NO: 838838 - protein, 18 aa, Mycobacterium
MIHLSILRNHARWAVLLR

SEQ ID NO: 838839 - protein, 17 aa, Mycobacterium
MIKAVLPGMRARGSGHI

SEQ ID NO: 838840 - protein, 20 aa, Mycobacterium
MILAPQGLDYITAFLGALQA

SEQ ID NO: 838841 - protein, 33 aa, Mycobacterium
MILARPKDISVVHPILLFSLMKGMRSMEGGLGS

SEQ ID NO: 838842 - protein, 17 aa, Mycobacterium
MILDHVLGATAHLPRRP

SEQ ID NO: 838843 - protein, 23 aa, Mycobacterium
MILDQIRSLIRDGHLKPGDRLPS

SEQ ID NO: 838844 - protein, 31 aa, Mycobacterium
MILSIARALVLNPRFLLFDEPSAGLSPKLVG

SEQ ID NO: 838845 - protein, 25 aa, Mycobacterium
MINGAKTWSTWAFAADYGLCLARTD

SEQ ID NO: 838846 - protein, 26 aa, Mycobacterium
MIPAFVMLRRVMLTAWIASHADADAA

SEQ ID NO: 838847 - protein, 31 aa, Mycobacterium
MIPDKGRILTAMSVFFFGLVDAPNHLAGPPD

SEQ ID NO: 838848 - protein, 18 aa, Mycobacterium
MIPEAIVAMLACARLGVM

SEQ ID NO: 838849 - protein, 26 aa, Mycobacterium
MIPPPRIVGRAMAHNLRLWLGERRRA

SEQ ID NO: 838850 - protein, 18 aa, Mycobacterium
MIPPPRIVGRTIAHNLRL

SEQ ID NO: 838851 - protein, 27 aa, Mycobacterium
MIPQRSGVVFFIAFSPRRGIPTFVHAT

SEQ ID NO: 838852 - protein, 17 aa, Mycobacterium
MIQAFFFDLQHINGGGS

SEQ ID NO: 838853 - protein, 18 aa, Mycobacterium
MIQAFFFDLQHINGGGSR

SEQ ID NO: 838854 - protein, 17 aa, Mycobacterium
MIRAVYPELLAMKAAGR

SEQ ID NO: 838855 - protein, 21 aa, Mycobacterium
MIRWVTPVKAFMRTAATDTVV

SEQ ID NO: 838856 - protein, 20 aa, Mycobacterium
MISAWLYRPAGADPARPVPM

SEQ ID NO: 838857 - protein, 21 aa, Mycobacterium
MISHHCYGSFDLAFRCVQLLQ

SEQ ID NO: 838858 - protein, 17 aa, Mycobacterium
MISLLSALDARVTVWCA

SEQ ID NO: 838859 - protein, 24 aa, Mycobacterium
MISPLSLTPLVPMAGRFIYAGVAD

SEQ ID NO: 838860 - protein, 20 aa, Mycobacterium
MISPTTLYDKFPALTPDQAA

SEQ ID NO: 838861 - protein, 19 aa, Mycobacterium
MISPTTLYDKFPALTPEQA

SEQ ID NO: 838862 - protein, 17 aa, Mycobacterium
MISQLLGSGGDGLLASA

SEQ ID NO: 838863 - protein, 25 aa, Mycobacterium
MISSFQYLFPRLKAGGVYVVEDVCA

SEQ ID NO: 838864 - protein, 19 aa, Mycobacterium
MISSPFGLYDCDVPCDGAI

SEQ ID NO: 838865 - protein, 27 aa, Mycobacterium
MITRNVWGGIWTRPGLDRRSRSLITLT

SEQ ID NO: 838866 - protein, 19 aa, Mycobacterium
MITTLIYELQRRGGGIGVA

SEQ ID NO: 838867 - protein, 18 aa, Mycobacterium
MITTVFERMGFDPELVPA

SEQ ID NO: 838868 - protein, 18 aa, Mycobacterium
MIVDPYPRLMVARDQVNQ

SEQ ID NO: 838869 - protein, 17 aa, Mycobacterium
MIVMPLQAATQWDALSH

SEQ ID NO: 838870 - protein, 18 aa, Mycobacterium
MIVRYLIDRRVSVEIPPV

SEQ ID NO: 838871 - protein, 19 aa, Mycobacterium
MIVTINAWNRINVTVKMPF

SEQ ID NO: 838872 - protein, 18 aa, Mycobacterium
MIVVLKPSTGEILAIAQN

SEQ ID NO: 838873 - protein, 17 aa, Mycobacterium
MIWPGRANPRYSIVYVY

SEQ ID NO: 838874 - protein, 18 aa, Mycobacterium
MIYWDVRPSQNFPTIEVR

SEQ ID NO: 838875 - protein, 34 aa, Mycobacterium
MKAAHFIELCDQRRIPLLFLQNISGFMVGRDYEA

SEQ ID NO: 838876 - protein, 18 aa, Mycobacterium
MKAARVLSLAQDTADRLT

SEQ ID NO: 838877 - protein, 17 aa, Mycobacterium
MKADHGLALPRRLQIEF

SEQ ID NO: 838878 - protein, 21 aa, Mycobacterium
MKADHGLVLPRRLQIEFSQVI

SEQ ID NO: 838879 - protein, 17 aa, Mycobacterium
MKAFYDAITPRAEEALS

SEQ ID NO: 838880 - protein, 24 aa, Mycobacterium
MKARRLAEKLWSLRILDDEKSASD

SEQ ID NO: 838881 - protein, 17 aa, Mycobacterium
MKASYIYALHSRLSQIL

SEQ ID NO: 838882 - protein, 26 aa, Mycobacterium
MKCCVQQLTPDGRLIPFCAYNSVGYR

SEQ ID NO: 838883 - protein, 17 aa, Mycobacterium
MKDMVGMMIAIARYFKR

SEQ ID NO: 838884 - protein, 23 aa, Mycobacterium
MKEIRAAAYWRWAKDNPEEAAAR

SEQ ID NO: 838885 - protein, 23 aa, Mycobacterium
MKGVTFALRLAFGLPVDADTEHI

SEQ ID NO: 838886 - protein, 26 aa, Mycobacterium
MKKEGPLYALFLNCTLKKGPEVSNTE

SEQ ID NO: 838887 - protein, 20 aa, Mycobacterium
MKLLAPKWQMMSDPQLTGYF

SEQ ID NO: 838888 - protein, 17 aa, Mycobacterium
MKLMFYIDEDADARQRV

SEQ ID NO: 838889 - protein, 22 aa, Mycobacterium
MKLTPDRFIHELLVEHLHVVEV

SEQ ID NO: 838890 - protein, 25 aa, Mycobacterium
MKPGPGFAMLRREGVRLLVNAPEGG

SEQ ID NO: 838891 - protein, 19 aa, Mycobacterium
MKPSAIRRLGLTYDSLKEF

SEQ ID NO: 838892 - protein, 19 aa, Mycobacterium
MKQWWPDEAEFARAPGATG

SEQ ID NO: 838893 - protein, 23 aa, Mycobacterium
MKRGVERLPIMGDGWKGVSGEAA

SEQ ID NO: 838894 - protein, 17 aa, Mycobacterium
MKRVWAGEKLTESVLPV

SEQ ID NO: 838895 - protein, 25 aa, Mycobacterium
MKSDHGLVLPRRLQIEFAQSIQRIT

SEQ ID NO: 838896 - protein, 27 aa, Mycobacterium
MKSKDKLRTATLRLLLAAIQTEEVSGK

SEQ ID NO: 838897 - protein, 28 aa, Mycobacterium
MKSTPGGMWFTVALAAIANRLGGDFRFQ

SEQ ID NO: 838898 - protein, 25 aa, Mycobacterium
MKSVHRILRNFKMPGFTVPEFRRKA

SEQ ID NO: 838899 - protein, 21 aa, Mycobacterium
MKYFDQEMVAWRAASGRLTVM

SEQ ID NO: 838900 - protein, 20 aa, Mycobacterium
MKYFGQEMVAWRAGSGQLTV

SEQ ID NO: 838901 - protein, 19 aa, Mycobacterium
MKYLTGCADFFRRGVTNVG

SEQ ID NO: 838902 - protein, 18 aa, Mycobacterium
MKYLTGCAKLFRQGYTDI

SEQ ID NO: 838903 - protein, 18 aa, Mycobacterium
MKYLTGCANAFRIGYIDV

SEQ ID NO: 838904 - protein, 24 aa, Mycobacterium
MLAAAAAWDGLADELSTAAAAFSS

SEQ ID NO: 838905 - protein, 29 aa, Mycobacterium
MLAAATAWDGLAAELFAAASAFGAVTSGL

SEQ ID NO: 838906 - protein, 26 aa, Mycobacterium
MLAADPALRSLPYWEAQEPLPPPGEE

SEQ ID NO: 838907 - protein, 18 aa, Mycobacterium
MLAAGQYLREFVADGVQW

SEQ ID NO: 838908 - protein, 20 aa, Mycobacterium
MLAAIRPYRPSLSAALPPSA

SEQ ID NO: 838909 - protein, 17 aa, Mycobacterium
MLAALHVLAALSEQERP

SEQ ID NO: 838910 - protein, 17 aa, Mycobacterium
MLAALRRAGRQDTPQRR

SEQ ID NO: 838911 - protein, 22 aa, Mycobacterium
MLAATGPFIDWLEITGALASET

SEQ ID NO: 838912 - protein, 18 aa, Mycobacterium
MLAAWQGLEGFEGRASLR

SEQ ID NO: 838913 - protein, 41 aa, Mycobacterium; identical to SEQ ID NO: 129412

SEQ ID NO: 838914 - protein, 19 aa, Mycobacterium
MLADPSQFDWLATRLEIAR

SEQ ID NO: 838915 - protein, 18 aa, Mycobacterium
MLAELEQIWRGRIARIDQ

SEQ ID NO: 838916 - protein, 18 aa, Mycobacterium
MLAGIMQSALQTPGLQGS

SEQ ID NO: 838917 - protein, 22 aa, Mycobacterium
MLAGLALKWRWRTKIGGTDGTG

SEQ ID NO: 838918 - protein, 18 aa, Mycobacterium
MLAGYWAANRVMGHLGWR

SEQ ID NO: 838919 - protein, 17 aa, Mycobacterium
MLALFGCAHYEAILAGY

SEQ ID NO: 838920 - protein, 17 aa, Mycobacterium
MLALFGCPFLGEVLEGY

SEQ ID NO: 838921 - protein, 17 aa, Mycobacterium
MLALMNRIEVRPGDGVL

SEQ ID NO: 838922 - protein, 18 aa, Mycobacterium
MLALTGYYAWHRICVDRG

SEQ ID NO: 838923 - protein, 24 aa, Mycobacterium
MLAPFPPVRPMLRLLTKLGTAEAL

SEQ ID NO: 838924 - protein, 18 aa, Mycobacterium
MLAPVVFTSALDLGELFA

SEQ ID NO: 838925 - protein, 25 aa, Mycobacterium
MLAQAYPDRFVLGLGAGYPSQAELV

SEQ ID NO: 838926 - protein, 25 aa, Mycobacterium
MLARCVIGLQWIPENILAEVGKRAA

SEQ ID NO: 838927 - protein, 19 aa, Mycobacterium
MLARCVVGLQWIPENILRD

SEQ ID NO: 838928 - protein, 18 aa, Mycobacterium
MLARERVELLLDPDTAFL

SEQ ID NO: 838929 - protein, 19 aa, Mycobacterium
MLARLKVVQRRLASRGLGL

SEQ ID NO: 838930 - protein, 22 aa, Mycobacterium
MLASAKIWRTATIGGNVCLSFP

SEQ ID NO: 838931 - protein, 18 aa, Mycobacterium
MLASPRIIDAVAATWRQL

SEQ ID NO: 838932 - protein, 25 aa, Mycobacterium
MLASRFHPHALLGTDRRLTELKDDL

SEQ ID NO: 838933 - protein, 18 aa, Mycobacterium
MLASSRIISAVAATWRRL

SEQ ID NO: 838934 - protein, 17 aa, Mycobacterium
MLATLVATNLFGQNTPA

SEQ ID NO: 838935 - protein, 28 aa, Mycobacterium
MLAVACGLARHVLCFRTLWEATHGELMK

SEQ ID NO: 838936 - protein, 19 aa, Mycobacterium
MLAVAKLGAVIMPTTGALG

SEQ ID NO: 838937 - protein, 19 aa, Mycobacterium
MLAVLKTGAAYLPIDPAHA

SEQ ID NO: 838938 - protein, 26 aa, Mycobacterium
MLAVNRRFPDVLLNRRYDGLERLMGW

SEQ ID NO: 838939 - protein, 17 aa, Mycobacterium
MLAYNCSPSFNWKQHLD

SEQ ID NO: 838940 - protein, 20 aa, Mycobacterium
MLCERPVKWIESRAECFLGG

SEQ ID NO: 838941 - protein, 18 aa, Mycobacterium
MLCYVTPKEHLGLPDRSD

SEQ ID NO: 838942 - protein, 18 aa, Mycobacterium
MLDCLEFDDLLRYVDGVD

SEQ ID NO: 838943 - protein, 28 aa, Mycobacterium
MLDDADFAKYPFLVKGYIGPKALRDNGV

SEQ ID NO: 838944 - protein, 19 aa, Mycobacterium
MLDDLRLEYGRLDQSIPVG

SEQ ID NO: 838945 - protein, 21 aa, Mycobacterium
MLDELAWWGAALRTAREHSPY

SEQ ID NO: 838946 - protein, 23 aa, Mycobacterium
MLDEPRRPLVWRSGADPTVAELV

SEQ ID NO: 838947 - protein, 26 aa, Mycobacterium
MLDGLKPGGLLLLRIPDRDAVYGWTT

SEQ ID NO: 838948 - protein, 18 aa, Mycobacterium
MLDGMRIGDPFPAEREIA

SEQ ID NO: 838949 - protein, 20 aa, Mycobacterium
MLDLLGGEPARLARLERRIA

SEQ ID NO: 838950 - protein, 25 aa, Mycobacterium
MLDPAAIALHGLWKTGLRAGHRVLV

SEQ ID NO: 838951 - protein, 20 aa, Mycobacterium
MLDPFRLQDMRCKWRKWLTF

SEQ ID NO: 838952 - protein, 17 aa, Mycobacterium
MLDRFDVDWVQYGYDDA

SEQ ID NO: 838953 - protein, 21 aa, Mycobacterium
MLDRYLGFMALDPPTARLYLV

SEQ ID NO: 838954 - protein, 23 aa, Mycobacterium
MLDTLIKEKWLTANGVIGFFCAN

SEQ ID NO: 838955 - protein, 17 aa, Mycobacterium
MLDTMIGRAFASAARRA

SEQ ID NO: 838956 - protein, 18 aa, Mycobacterium
MLDVHANTWRYNQLIAQQ

SEQ ID NO: 838957 - protein, 21 aa, Mycobacterium
MLDVRAFKLWAALSGVVPRIS

SEQ ID NO: 838958 - protein, 22 aa, Mycobacterium
MLEAIWQVMPTSRAAGVWTTHG

SEQ ID NO: 838959 - protein, 18 aa, Mycobacterium
MLELASKFAAEHPWLLGA

SEQ ID NO: 838960 - protein, 17 aa, Mycobacterium
MLELVMVKRAMKPVCHV

SEQ ID NO: 838961 - protein, 25 aa, Mycobacterium
MLENPDILVFAWGATVPMIAHAAGI

SEQ ID NO: 838962 - protein, 25 aa, Mycobacterium
MLEPGMLMYGWRRSSLRGNTFRGFV

SEQ ID NO: 838963 - protein, 26 aa, Mycobacterium
MLEPLRMYAHIPTLLSAYGRLEQAES

SEQ ID NO: 838964 - protein, 18 aa, Mycobacterium
MLESLQEQTWRAIAQSRK

SEQ ID NO: 838965 - protein, 25 aa, Mycobacterium
MLESQILGLTYYPVTYFEMLGRPWR

SEQ ID NO: 838966 - protein, 24 aa, Mycobacterium
MLETSVLGLTYYPVSYYEMLGRPW

SEQ ID NO: 838967 - protein, 34 aa, Mycobacterium
MLETVAIRGYRSLRDLVLPLRRLTVITGANGTGK

SEQ ID NO: 838968 - protein, 24 aa, Mycobacterium
MLEVLRASLPRTLALLGTAEEIPL

SEQ ID NO: 838969 - protein, 23 aa, Mycobacterium
MLEVRNELWFTDLALGDGPSLRV

SEQ ID NO: 838970 - protein, 19 aa, Mycobacterium
MLEVSGWAQPWDTHNLRDL

SEQ ID NO: 838971 - protein, 20 aa, Mycobacterium
MLEVTLALATLIRGVEIRSL

SEQ ID NO: 838972 - protein, 17 aa, Mycobacterium
MLFGFKSIHLDQARLLQ

SEQ ID NO: 838973 - protein, 17 aa, Mycobacterium
MLFPHLYGPLPVDAVMI

SEQ ID NO: 838974 - protein, 18 aa, Mycobacterium
MLFRKHLVMFGPREVLLT

SEQ ID NO: 838975 - protein, 19 aa, Mycobacterium
MLFRKHLVMFGPREVLLTS

SEQ ID NO: 838976 - protein, 18 aa, Mycobacterium
MLGDLITLTQSQLPVKMV

SEQ ID NO: 838977 - protein, 29 aa, Mycobacterium
MLGEHAVHPTMWIRMWFSDGDKSHQRGYT

SEQ ID NO: 838978 - protein, 21 aa, Mycobacterium
MLGIPLKKWNMYSEPVHAAVY

SEQ ID NO: 838979 - protein, 19 aa, Mycobacterium
MLGIPLKNWQMYSEPTHAA

SEQ ID NO: 838980 - protein, 17 aa, Mycobacterium
MLGLHFAPTRPVEDQLG

SEQ ID NO: 838981 - protein, 18 aa, Mycobacterium
MLGLLGQYSYAAANFAVQ

SEQ ID NO: 838982 - protein, 17 aa, Mycobacterium
MLGPGNEVLLQDLSRLP

SEQ ID NO: 838983 - protein, 21 aa, Mycobacterium
MLGPMIQHMLFMQLRHMMETE

SEQ ID NO: 838984 - protein, 19 aa, Mycobacterium
MLHDRFPATFPSGQGSDLA

SEQ ID NO: 838985 - protein, 27 aa, Mycobacterium
MLHGEPSWSYLYRKMIPILVADGHRVV

SEQ ID NO: 838986 - protein, 29 aa, Mycobacterium
MLHGEPSWSYLYRKMIPVLAAAGHRVICP

SEQ ID NO: 838987 - protein, 19 aa, Mycobacterium
MLHGEVLQLSLSLLADGRT

SEQ ID NO: 838988 - protein, 26 aa, Mycobacterium
MLHLGGTRLPAGRRLPFGLTVTMDGR

SEQ ID NO: 838989 - protein, 17 aa, Mycobacterium
MLHPLSAPMTLRWLTDR

SEQ ID NO: 838990 - protein, 19 aa, Mycobacterium
MLHRLFDFADGAPIFLEVR

SEQ ID NO: 838991 - protein, 19 aa, Mycobacterium
MLIDQLPDIVEKAALGLSG

SEQ ID NO: 838992 - protein, 28 aa, Mycobacterium
MLIGHAAELEKFQWFVRAHLENSGGELV

SEQ ID NO: 838993 - protein, 29 aa, Mycobacterium
MLKLLERRGIVSTWFWPGHSIETFPTQAK

SEQ ID NO: 838994 - protein, 17 aa, Mycobacterium
MLKPCTLELGGKSAAIL

SEQ ID NO: 838995 - protein, 17 aa, Mycobacterium
MLKPDRLALRELITQRD

SEQ ID NO: 838996 - protein, 27 aa, Mycobacterium
MLKRHPNLRARFLGRGLPHPVQVVPSE

SEQ ID NO: 838997 - protein, 27 aa, Mycobacterium
MLKTYVPDRWVYRTLTVNYRTPAEIMI

SEQ ID NO: 838998 - protein, 18 aa, Mycobacterium
MLLALHLGRIKDSVGLRP

SEQ ID NO: 838999 - protein, 17 aa, Mycobacterium
MLLARAGLRVLVVEAAR

SEQ ID NO: 839000 - protein, 25 aa, Mycobacterium
MLLDALRDRGSLRRFIPFDVDSSVL

SEQ ID NO: 839001 - protein, 18 aa, Mycobacterium
MLLDHLTHGRVIGGVGPG

SEQ ID NO: 839002 - protein, 17 aa, Mycobacterium
MLLDMPESDWQTMLDVN

SEQ ID NO: 839003 - protein, 29 aa, Mycobacterium
MLLGRPLMAWMFQRFLHNLRRYSDARYPS

SEQ ID NO: 839004 - protein, 19 aa, Mycobacterium
MLLLHLHHIAVDGISLNVL

SEQ ID NO: 839005 - protein, 17 aa, Mycobacterium
MLLVTLANFRDGTLDTV

SEQ ID NO: 839006 - protein, 17 aa, Mycobacterium
MLLWEERLLYERRFASA

SEQ ID NO: 839007 - protein, 18 aa, Mycobacterium
MLMADIRGFTRLSEILSP

SEQ ID NO: 839008 - protein, 22 aa, Mycobacterium
MLMCKYAIPRLISAGGGAIVNI

SEQ ID NO: 839009 - protein, 20 aa, Mycobacterium
MLMLVYGISEDAAFELLRWL

SEQ ID NO: 839010 - protein, 30 aa, Mycobacterium
MLMNHRFDILAWNPEMAWLLTDFGELPPVQ

SEQ ID NO: 839011 - protein, 17 aa, Mycobacterium
MLMSVSKNLSLLLAKDE

SEQ ID NO: 839012 - protein, 23 aa, Mycobacterium
MLNASLHGLAGWVDVKGPVVATA

SEQ ID NO: 839013 - protein, 23 aa, Mycobacterium
MLNLAMIATLNRPHELATHIRGA

SEQ ID NO: 839014 - protein, 17 aa, Mycobacterium
MLPATLWAEADAVMVNS

SEQ ID NO: 839015 - protein, 18 aa, Mycobacterium
MLPDGPGYERRLDMMLRV

SEQ ID NO: 839016 - protein, 18 aa, Mycobacterium
MLPDRPIAFVDAHGVPFI

SEQ ID NO: 839017 - protein, 25 aa, Mycobacterium
MLPKGAHVLAAYEDLLPAARPGTLF

SEQ ID NO: 839018 - protein, 17 aa, Mycobacterium
MLPLNTYGGQLSAGRMH

SEQ ID NO: 839019 - protein, 34 aa, Mycobacterium
MLPNTPAFAIAFYGIMYRGAVAVPMNPLLKAREV

SEQ ID NO: 839020 - protein, 17 aa, Mycobacterium
MLPTFRHTVEELFTAGL

SEQ ID NO: 839021 - protein, 22 aa, Mycobacterium
MLQAAAAWEGLAGELGSAADSF

SEQ ID NO: 839022 - protein, 19 aa, Mycobacterium
MLQAFIGRMGGVPPSVWGG

SEQ ID NO: 839023 - protein, 18 aa, Mycobacterium
MLQASAAWNGLAEELGAA

SEQ ID NO: 839024 - protein, 23 aa, Mycobacterium
MLQDRDMLIFAWGATVPMIAHAA

SEQ ID NO: 839025 - protein, 29 aa, Mycobacterium
MLQQTPVARVLPIWSDWVRRWPTPSATAA

SEQ ID NO: 839026 - protein, 28 aa, Mycobacterium
MLQQTPVSRVLSIWPDWVRRWPTASATA

SEQ ID NO: 839027 - protein, 22 aa, Mycobacterium
MLRAALIATRLADRLGLCADER

SEQ ID NO: 839028 - protein, 18 aa, Mycobacterium
MLRLHYEKKRNLPRALLA

SEQ ID NO: 839029 - protein, 20 aa, Mycobacterium
MLRLVETFGYGWSDLQRFTI

SEQ ID NO: 839030 - protein, 34 aa, Mycobacterium
MLRMLRPDVTIGFFLHIPFPPVELFMQMPWRTEI

SEQ ID NO: 839031 - protein, 19 aa, Mycobacterium
MLRPLRAAELSDGTLRFLL

SEQ ID NO: 839032 - protein, 18 aa, Mycobacterium
MLRPLRSAELSDGTIRFL

SEQ ID NO: 839033 - protein, 19 aa, Mycobacterium
MLRQGVLTEGWRLNPGSDP

SEQ ID NO: 839034 - protein, 19 aa, Mycobacterium
MLRRRRATGGPAEQTFATL

SEQ ID NO: 839035 - protein, 17 aa, Mycobacterium
MLRTLVRGLARRAEPTG

SEQ ID NO: 839036 - protein, 19 aa, Mycobacterium
MLRYNFPGAGLSDDALRTL

SEQ ID NO: 839037 - protein, 24 aa, Mycobacterium
MLSARVRSIRWDEDTWRWVCQVDR

SEQ ID NO: 839038 - protein, 19 aa, Mycobacterium
MLSELEQLWRGRIARIDEL

SEQ ID NO: 839039 - protein, 18 aa, Mycobacterium
MLSHGPIVAREIGIPCVC

SEQ ID NO: 839040 - protein, 17 aa, Mycobacterium
MLSIGRALMARPKILLL

SEQ ID NO: 839041 - protein, 22 aa, Mycobacterium
MLSLADYRQYALPHSARVFATL

SEQ ID NO: 839042 - protein, 17 aa, Mycobacterium
MLSLRGPTPTGLARSLA

SEQ ID NO: 839043 - protein, 17 aa, Mycobacterium
MLSPMESTDSDDVLNDD

SEQ ID NO: 839044 - protein, 24 aa, Mycobacterium
MLSQTWFSWIGGHRPGDVFYYRVQ

SEQ ID NO: 839045 - protein, 18 aa, Mycobacterium
MLSQWRAPDPAQDSLRHA

SEQ ID NO: 839046 - protein, 19 aa, Mycobacterium
MLSRFDIVLLDEPTNDLDL

SEQ ID NO: 839047 - protein, 28 aa, Mycobacterium
MLSWIAEGPPPIYFGFGSTPVSSPPETV

SEQ ID NO: 839048 - protein, 18 aa, Mycobacterium
MLSWVRVIRTGPGALADD

SEQ ID NO: 839049 - protein, 25 aa, Mycobacterium
MLTAGEDPRFVARRLMILASEDVGM

SEQ ID NO: 839050 - protein, 26 aa, Mycobacterium
MLTALEGAFVLCRTLRSVEPMLIAGH

SEQ ID NO: 839051 - protein, 39 aa, Mycobacterium
MLTDVKLLARLFGLPYFPITPLFPLAGPAGLVPLPSKWR

SEQ ID NO: 839052 - protein, 40 aa, Mycobacterium
MLTDVKLLARLFGLPYFPVTPLFPLAGPAGLVPLPSKWRI

SEQ ID NO: 839053 - protein, 30 aa, Mycobacterium
MLTEAPELAIPLYFRLLGETGSHASILVDV

SEQ ID NO: 839054 - protein, 23 aa, Mycobacterium
MLTELVAVLRYFGELIIDDATAE

SEQ ID NO: 839055 - protein, 37 aa, Mycobacterium
MLTFTYRQEWPLSDTFRFMVNYLRLFATDPAERVPRP

SEQ ID NO: 839056 - protein, 30 aa, Mycobacterium
MLTGVTILNNWIRQGVVERGLVVSGEYISQ

SEQ ID NO: 839057 - protein, 24 aa, Mycobacterium
MLTNRPEFHIADMATLLAGATPFS

SEQ ID NO: 839058 - protein, 37 aa, Mycobacterium
MLTPQDVVLPVIPMPFGFGIWTSHTTPIYLGASAVIL

SEQ ID NO: 839059 - protein, 24 aa, Mycobacterium
MLTRYWHAFAAKDVPAALACFTDD

SEQ ID NO: 839060 - protein, 24 aa, Mycobacterium
MLVAELLDAWDKPLGLDVAHCLYA

SEQ ID NO: 839061 - protein, 26 aa, Mycobacterium
MLVAGEDPRFIARRLMILASEDIGMA

SEQ ID NO: 839062 - protein, 25 aa, Mycobacterium
MLVAGEDPRFVARRLMILASEDIGL

SEQ ID NO: 839063 - protein, 17 aa, Mycobacterium
MLVEHFDERLGRSVLGP

SEQ ID NO: 839064 - protein, 19 aa, Mycobacterium
MLVEQKLLEKGSLAYVLDG

SEQ ID NO: 839065 - protein, 26 aa, Mycobacterium
MLVGGLCRLLVRKGLSVAPFKAQNMS

SEQ ID NO: 839066 - protein, 17 aa, Mycobacterium
MLVLAAALSIPDPRERP

SEQ ID NO: 839067 - protein, 18 aa, Mycobacterium
MLVLKRLPDAVRDGDRVL

SEQ ID NO: 839068 - protein, 25 aa, Mycobacterium
MLVLPNLLRRPVARVVNFYQHPLRY

SEQ ID NO: 839069 - protein, 28 aa, Mycobacterium
MLVRREFVAKLLARKTPPKGAAIFVGRV

SEQ ID NO: 839070 - protein, 23 aa, Mycobacterium
MLVVGIRHRNPVGKLLLGSVAQK

SEQ ID NO: 839071 - protein, 17 aa, Mycobacterium
MLVVKRGPNVGSHFVLN

SEQ ID NO: 839072 - protein, 17 aa, Mycobacterium
MLWLSDITEHYTGDGKL

SEQ ID NO: 839073 - protein, 18 aa, Mycobacterium
MLWTPASFRRRGIYLDRY

SEQ ID NO: 839074 - protein, 27 aa, Mycobacterium
MLYVQSLLDDWAFPAKDPAIRARWERR

SEQ ID NO: 839075 - protein, 27 aa, Mycobacterium
MLYVQSLLDDWTFPATDPSVRARWEQR

SEQ ID NO: 839076 - protein, 27 aa, Mycobacterium
MLYVQSLLDNWSFPATDPAVRARWEEC

SEQ ID NO: 839077 - protein, 18 aa, Mycobacterium
MMAFTQFPEQWELYKKER

SEQ ID NO: 839078 - protein, 22 aa, Mycobacterium
MMAHGSPAWVWNLSSIGGVAAV

SEQ ID NO: 839079 - protein, 18 aa, Mycobacterium
MMAILRPLQQQVKDQGLW

SEQ ID NO: 839080 - protein, 19 aa, Mycobacterium
MMAKVQITVTVGVAEALIA

SEQ ID NO: 839081 - protein, 37 aa, Mycobacterium
MMAMLVEFWMHPDAVYLSPAPLYHTAPSVWSMQVQAG

SEQ ID NO: 839082 - protein, 40 aa, Mycobacterium
MMDGMGFARPLDFEPLLKTPGFIEMAWKAPIALMADALGV

SEQ ID NO: 839083 - protein, 29 aa, Mycobacterium
MMDINIRGTFLLTKAALPHLRQARAGAHV

SEQ ID NO: 839084 - protein, 24 aa, Mycobacterium
MMDRYIRHVLVEHDGALVGIVSAR

SEQ ID NO: 839085 - protein, 18 aa, Mycobacterium
MMDWWGPIIDEYYASSEA

SEQ ID NO: 839086 - protein, 27 aa, Mycobacterium
MMEHYIRHVLVEHDGIPAGIVSARDLL

SEQ ID NO: 839087 - protein, 24 aa, Mycobacterium
MMEQGAQLWRWLNEGAHLYVCGDA

SEQ ID NO: 839088 - protein, 25 aa, Mycobacterium
MMFQQLPTAGLPFHFQEWREWERFV

SEQ ID NO: 839089 - protein, 25 aa, Mycobacterium
MMFQQLPTAGLPFQFQTWHEFEGFV

SEQ ID NO: 839090 - protein, 23 aa, Mycobacterium
MMFQQLPTAGLPFQFQTWSEFEG

SEQ ID NO: 839091 - protein, 24 aa, Mycobacterium
MMGAAMTFGLIPPLIDHQHGRTRT

SEQ ID NO: 839092 - protein, 18 aa, Mycobacterium
MMGEVRRHFRDHGWSLHV

SEQ ID NO: 839093 - protein, 20 aa, Mycobacterium
MMHDSVVFSLLHGGLDSPRP

SEQ ID NO: 839094 - protein, 18 aa, Mycobacterium
MMIGFRGHHAFGHRPTYR

SEQ ID NO: 839095 - protein, 24 aa, Mycobacterium
MMKYDPHFFAFLEIPEVLNVVDRV

SEQ ID NO: 839096 - protein, 17 aa, Mycobacterium
MMLLLAAAHRDPAEFDR

SEQ ID NO: 839097 - protein, 25 aa, Mycobacterium
MMPARGRVLLDLSNLNRIIDVDVES

SEQ ID NO: 839098 - protein, 17 aa, Mycobacterium
MMPFPPADRARLYDLGE

SEQ ID NO: 839099 - protein, 21 aa, Mycobacterium
MMQESLEAILALFRAGPTERI

SEQ ID NO: 839100 - protein, 17 aa, Mycobacterium
MMRAISGLLPLTSGSVW

SEQ ID NO: 839101 - protein, 30 aa, Mycobacterium
MMRDADFPLPWATMHKVKAPTLLTWGRDDR

SEQ ID NO: 839102 - protein, 23 aa, Mycobacterium
MMRGAFDFQLTPLDLEDLRVTIS

SEQ ID NO: 839103 - protein, 25 aa, Mycobacterium
MMRLWVEAEVLRLTGERLRQQAATG

SEQ ID NO: 839104 - protein, 31 aa, Mycobacterium
MMRNADFPLPWSIMHKVKAPTLLTWGRDDRV

SEQ ID NO: 839105 - protein, 18 aa, Mycobacterium
MMRVGIAPTLIGTRGSRP

SEQ ID NO: 839106 - protein, 23 aa, Mycobacterium
MMSALVGFWMTPDSVYLSPAPLY

SEQ ID NO: 839107 - protein, 37 aa, Mycobacterium
MMSALVSFWMNPDSIYLSPAPLYHTAPSVWSMSAQAG

SEQ ID NO: 839108 - protein, 26 aa, Mycobacterium
MMSGLDIHYDLGPGHPLLGRRMPDLE

SEQ ID NO: 839109 - protein, 18 aa, Mycobacterium
MMSGLDIHYMLGDGHQLL

SEQ ID NO: 839110 - protein, 26 aa, Mycobacterium
MMSGLDIRYHLGGGHPLLGRRMPDLD

SEQ ID NO: 839111 - protein, 17 aa, Mycobacterium
MMSGMMDGGMMGPGMGH

SEQ ID NO: 839112 - protein, 18 aa, Mycobacterium
MMSRFVRGFASLMHCDKP

SEQ ID NO: 839113 - protein, 17 aa, Mycobacterium
MMVLGPFGETFGRVRDV

SEQ ID NO: 839114 - protein, 25 aa, Mycobacterium
MMVNIDSFREMFSKYIFGGILDRHP

SEQ ID NO: 839115 - protein, 25 aa, Mycobacterium
MMYIQALLDDWAFPATDPQVRARWE

SEQ ID NO: 839116 - protein, 24 aa, Mycobacterium
MNADWDMDLAMKAVPLWSSRGCMP

SEQ ID NO: 839117 - protein, 24 aa, Mycobacterium
MNAGWDMDLAMKAVPLWASRGCMP

SEQ ID NO: 839118 - protein, 24 aa, Mycobacterium
MNAHLRLLAGNRPLLARLVREVGE

SEQ ID NO: 839119 - protein, 21 aa, Mycobacterium
MNAHRPALVARCAALLVILCD

SEQ ID NO: 839120 - protein, 17 aa, Mycobacterium
MNAMMWVRGFAADYDDW

SEQ ID NO: 839121 - protein, 20 aa, Mycobacterium
MNAVSRWLFRRVLTKFVGAK

SEQ ID NO: 839122 - protein, 20 aa, Mycobacterium
MNCIEWVDAFYGIMKARAVP

SEQ ID NO: 839123 - protein, 18 aa, Mycobacterium
MNCLSWIEALGFCGIGEA

SEQ ID NO: 839124 - protein, 17 aa, Mycobacterium
MNCPMHHLIFRSRGRSY

SEQ ID NO: 839125 - protein, 23 aa, Mycobacterium
MNDNTFRLFRPDLENPGPDDFAP

SEQ ID NO: 839126 - protein, 17 aa, Mycobacterium
MNEGHAGFLGAERIREL

SEQ ID NO: 839127 - protein, 25 aa, Mycobacterium
MNERFPFAVPRYQRSYAWGDEAVGF

SEQ ID NO: 839128 - protein, 18 aa, Mycobacterium
MNESLRMVTPLPFNMRMA

SEQ ID NO: 839129 - protein, 18 aa, Mycobacterium
MNFPGKFSEQLLVEHLQK

SEQ ID NO: 839130 - protein, 21 aa, Mycobacterium
MNGGFFPSVREYSVRYGLSDR

SEQ ID NO: 839131 - protein, 27 aa, Mycobacterium
MNGMGFGHPLEFQPMLATPGFIEMAWQ

SEQ ID NO: 839132 - protein, 22 aa, Mycobacterium
MNGSFFPSAREYSVRYGLSEKR

SEQ ID NO: 839133 - protein, 23 aa, Mycobacterium
MNHRPKFNLIDRGPQFSDEVYPL

SEQ ID NO: 839134 - protein, 30 aa, Mycobacterium
MNILLNHEVPMSPAIRLFRSRPATWAAKAI

SEQ ID NO: 839135 - protein, 17 aa, Mycobacterium
MNKADLLVVFGASFSNH

SEQ ID NO: 839136 - protein, 17 aa, Mycobacterium
MNLLDLRRRARQYAVEM

SEQ ID NO: 839137 - protein, 18 aa, Mycobacterium
MNMLLIGLDSRKDQDGND

SEQ ID NO: 839138 - protein, 22 aa, Mycobacterium
MNNLFTPPGGPFGPRPGFGFGP

SEQ ID NO: 839139 - protein, 27 aa, Mycobacterium
MNNVFYRGRGFLDGKYDDLRAGLRMNI

SEQ ID NO: 839140 - protein, 27 aa, Mycobacterium
MNNVFYRGRGFLDGKYDDLRAGLRMNL

SEQ ID NO: 839141 - protein, 29 aa, Mycobacterium
MNQLLPTARPYSVVILKQGPKFGDEAAPA

SEQ ID NO: 839142 - protein, 32 aa, Mycobacterium
MNRGFHAFFRQYYNLRALLARIDPRLRMLTPV

SEQ ID NO: 839143 - protein, 31 aa, Mycobacterium
MNRGFHAFFRQYYNLRALLGRIDPHLRMLTP

SEQ ID NO: 839144 - protein, 27 aa, Mycobacterium
MNRLGFHLWSDPRELALRQALFRDVLG

SEQ ID NO: 839145 - protein, 19 aa, Mycobacterium
MNRRLGILEIPMPPLRDAA

SEQ ID NO: 839146 - protein, 23 aa, Mycobacterium
MNRRPALLKGIELLGRAYIKSQI

SEQ ID NO: 839147 - protein, 19 aa, Mycobacterium
MNRVYVRCGMVPAGVDVIW

SEQ ID NO: 839148 - protein, 32 aa, Mycobacterium; identical to SEQ ID NO: 220698

SEQ ID NO: 839149 - protein, 26 aa, Mycobacterium
MNVIGSRPDGWWRDRRGAMARLVAQL

SEQ ID NO: 839150 - protein, 19 aa, Mycobacterium
MNVLYSLQHLGYTIPPQAD

SEQ ID NO: 839151 - protein, 17 aa, Mycobacterium
MNVTLRTLLREFEFIPT

SEQ ID NO: 839152 - protein, 26 aa, Mycobacterium
MNYGGLSVYSGEWWHFDGPGAGVDRP

SEQ ID NO: 839153 - protein, 24 aa, Mycobacterium
MPAAEVIAKYHDLWHVEKSFRMSK

SEQ ID NO: 839154 - protein, 18 aa, Mycobacterium
MPAALLRSQFDALEPLGA

SEQ ID NO: 839155 - protein, 20 aa, Mycobacterium
MPAARRYFAQLQAGENPWNS

SEQ ID NO: 839156 - protein, 28 aa, Mycobacterium
MPADLATDTLLYQPLRIAVVQSHPLAAQ

SEQ ID NO: 839157 - protein, 26 aa, Mycobacterium
MPADTVSFWLKPVGFFDRNPSLDVAP

SEQ ID NO: 839158 - protein, 21 aa, Mycobacterium
MPAEWFHDLLAPDGRPFRDPE

SEQ ID NO: 839159 - protein, 18 aa, Mycobacterium
MPAFLPNLPVNMPAQMTL

SEQ ID NO: 839160 - protein, 23 aa, Mycobacterium
MPAHELCNTLGWEKSRLSHQVRR

SEQ ID NO: 839161 - protein, 22 aa, Mycobacterium
MPAHYSAGWWMDSSSSLAEAAA

SEQ ID NO: 839162 - protein, 18 aa, Mycobacterium
MPAHYSAGWWMDTSASLA

SEQ ID NO: 839163 - protein, 20 aa, Mycobacterium
MPALNLDQLLATLPAERISL

SEQ ID NO: 839164 - protein, 18 aa, Mycobacterium
MPALPGLAELWGDSVFHC

SEQ ID NO: 839165 - protein, 18 aa, Mycobacterium
MPALSRVLITGGAGFVGA

SEQ ID NO: 839166 - protein, 24 aa, Mycobacterium
MPAPAPLVWAVNEMIYCANPSASF

SEQ ID NO: 839167 - protein, 18 aa, Mycobacterium
MPATRFLGPALGSLHMFF

SEQ ID NO: 839168 - protein, 17 aa, Mycobacterium
MPDAAIPLVFRLLGETG

SEQ ID NO: 839169 - protein, 18 aa, Mycobacterium
MPDDWFEQLRGFDAIFFG

SEQ ID NO: 839170 - protein, 24 aa, Mycobacterium
MPDGRAYMWVARTVERRAARYGQP

SEQ ID NO: 839171 - protein, 25 aa, Mycobacterium
MPDGRNYLWVARTVERRASRYGQPG

SEQ ID NO: 839172 - protein, 23 aa, Mycobacterium
MPEAITVFLAPPSWQDLEARLVG

SEQ ID NO: 839173 - protein, 23 aa, Mycobacterium
MPEALTVFLAPPSWEDLEARLVG

SEQ ID NO: 839174 - protein, 19 aa, Mycobacterium
MPEATAYHMDYLRNSPEKF

SEQ ID NO: 839175 - protein, 34 aa, Mycobacterium
MPEGRGLFFKTLYPALWRFPPIKPFRGAYVLLEF

SEQ ID NO: 839176 - protein, 18 aa, Mycobacterium
MPEKYRGRRLGWSDTWVR

SEQ ID NO: 839177 - protein, 17 aa, Mycobacterium
MPELMSELLWSRIGARY

SEQ ID NO: 839178 - protein, 22 aa, Mycobacterium
MPEPDDWVLVHVGFAMAKIDET

SEQ ID NO: 839179 - protein, 17 aa, Mycobacterium
MPEVVTVFLAPPSWQDL

SEQ ID NO: 839180 - protein, 17 aa, Mycobacterium
MPEWLNYREATLERLRQ

SEQ ID NO: 839181 - protein, 17 aa, Mycobacterium
MPFFVRHVDGDLLSFVH

SEQ ID NO: 839182 - protein, 21 aa, Mycobacterium
MPFTPVIFEGLCVLPYVDRSS

SEQ ID NO: 839183 - protein, 22 aa, Mycobacterium
MPGFARLWRGFARVSLEQLSNE

SEQ ID NO: 839184 - protein, 25 aa, Mycobacterium
MPGFTTISMYPRMWAAGGIDYPTLL

SEQ ID NO: 839185 - protein, 27 aa, Mycobacterium
MPGGNGGPAGLFGIGGTGGFGANIAGS

SEQ ID NO: 839186 - protein, 24 aa, Mycobacterium
MPGLMALRREYAEVLPLKGARISG

SEQ ID NO: 839187 - protein, 19 aa, Mycobacterium
MPGQRWGSMAMGASLRRSY

SEQ ID NO: 839188 - protein, 20 aa, Mycobacterium
MPGVEYYAHPWEFGPRKAKE

SEQ ID NO: 839189 - protein, 21 aa, Mycobacterium
MPGVEYYAHPWEFGPRKAKEL

SEQ ID NO: 839190 - protein, 40 aa, Mycobacterium
MPGVTPRMWDWWFGWHGTDTRRYKLWHPRAHASARWADGG

SEQ ID NO: 839191 - protein, 22 aa, Mycobacterium
MPHHTFIWEGIDGTGVFTHFPP

SEQ ID NO: 839192 - protein, 17 aa, Mycobacterium
MPIAALAAMRRSEPEAP

SEQ ID NO: 839193 - protein, 25 aa, Mycobacterium
MPIAPGMFAISWLDQSRLPVRIDSV

SEQ ID NO: 839194 - protein, 22 aa, Mycobacterium
MPKGVLWRQHDIFMTSFGGRDL

SEQ ID NO: 839195 - protein, 22 aa, Mycobacterium
MPKGVLWRQHDIFMTSFGGRNL

SEQ ID NO: 839196 - protein, 17 aa, Mycobacterium
MPLLRRAIQDRGLSPDD

SEQ ID NO: 839197 - protein, 28 aa, Mycobacterium
MPLSASQLRSWFAYRLDGPSPVNNIPFA

SEQ ID NO: 839198 - protein, 20 aa, Mycobacterium
MPMAFVTALMVRHSREVGRA

SEQ ID NO: 839199 - protein, 19 aa, Mycobacterium
MPMVPSSWDGLQEGVPKGG

SEQ ID NO: 839200 - protein, 23 aa, Mycobacterium
MPNAAVWLVNPPISDPRHGSGIL

SEQ ID NO: 839201 - protein, 18 aa, Mycobacterium
MPNDVPMLSWAGRGVAMG

SEQ ID NO: 839202 - protein, 25 aa, Mycobacterium
MPNQHSAWHRVTSAELWFFHRGSPL

SEQ ID NO: 839203 - protein, 24 aa, Mycobacterium
MPNRIKWTVVRYKPPEGMTLNGDG

SEQ ID NO: 839204 - protein, 23 aa, Mycobacterium
MPPAPTQAFFRWASGRDGDNKIL

SEQ ID NO: 839205 - protein, 25 aa, Mycobacterium
MPPSELVNFVLFGDGAGAAVLALDD

SEQ ID NO: 839206 - protein, 24 aa, Mycobacterium
MPPSLMHTWFELLSPEQIVSAYGM

SEQ ID NO: 839207 - protein, 33 aa, Mycobacterium
MPQWARDWQRLLFDNGWLLPAQPPEFGGRNASV

SEQ ID NO: 839208 - protein, 18 aa, Mycobacterium
MPQWDFLDFIAKEAQRFS

SEQ ID NO: 839209 - protein, 21 aa, Mycobacterium
MPRLFREAPLMGIWEGSGNVS

SEQ ID NO: 839210 - protein, 25 aa, Mycobacterium
MPRPQPPLDIWLGGSAPAAFRRIGA

SEQ ID NO: 839211 - protein, 33 aa, Mycobacterium
MPRWARDWQRLLFDNGWLLPGQPPEFGGRNATV

SEQ ID NO: 839212 - protein, 21 aa, Mycobacterium
MPSMPVMFWNDPDGTRLRAAY

SEQ ID NO: 839213 - protein, 21 aa, Mycobacterium
MPSQPTFYRLVKRLAEGRHTF

SEQ ID NO: 839214 - protein, 27 aa, Mycobacterium
MPSQRGWRHWLYVTTRINLGLSPDEVY

SEQ ID NO: 839215 - protein, 31 aa, Mycobacterium
MPSQTPPSPPTLLWPIGVPFSDGLNSLAVFK

SEQ ID NO: 839216 - protein, 24 aa, Mycobacterium
MPSSTPITCKTLFTLTATTAEQTE

SEQ ID NO: 839217 - protein, 26 aa, Mycobacterium
MPSTPSNYFHLLRRHALDGIQRPLIV

SEQ ID NO: 839218 - protein, 17 aa, Mycobacterium
MPTFLPNVAPTGRAVML

SEQ ID NO: 839219 - protein, 17 aa, Mycobacterium
MPTLNLDALIAALGAER

SEQ ID NO: 839220 - protein, 27 aa, Mycobacterium
MPTYCLRDYFRILAWKRGSTPGLTPED

SEQ ID NO: 839221 - protein, 17 aa, Mycobacterium
MPVAVVRGLSFSDDGST

SEQ ID NO: 839222 - protein, 22 aa, Mycobacterium
MPVAVVYGWHDVLPFCAGSPFP

SEQ ID NO: 839223 - protein, 18 aa, Mycobacterium
MPVLKVLHDAAGLTRLIV

SEQ ID NO: 839224 - protein, 20 aa, Mycobacterium
MPVLRKWRIFEREDFTGDAA

SEQ ID NO: 839225 - protein, 18 aa, Mycobacterium
MPVPVLVGSWHTISGLVY

SEQ ID NO: 839226 - protein, 17 aa, Mycobacterium
MPVRATYIDFPAGDSGP

SEQ ID NO: 839227 - protein, 20 aa, Mycobacterium
MPVTVILELKFKPDAVPQAR

SEQ ID NO: 839228 - protein, 24 aa, Mycobacterium
MPYAQVHYPFENRGWFDGVDCADP

SEQ ID NO: 839229 - protein, 29 aa, Mycobacterium
MQAARYLARKLIRQGWRKTADHSLPYCPH

SEQ ID NO: 839230 - protein, 18 aa, Mycobacterium
MQALPRLMSAPIADRITL

SEQ ID NO: 839231 - protein, 21 aa, Mycobacterium
MQARKKSLLQRLPFVDAPNDG

SEQ ID NO: 839232 - protein, 27 aa, Mycobacterium
MQATENALWYYRQAWQTNLGLNVELAK

SEQ ID NO: 839233 - protein, 22 aa, Mycobacterium
MQAVPTTFGLKASGWRQLILEA

SEQ ID NO: 839234 - protein, 21 aa, Mycobacterium
MQCGPFQVVSLMSSGSVAALG

SEQ ID NO: 839235 - protein, 22 aa, Mycobacterium
MQDRLERYCVFPNLGAEPQDAF

SEQ ID NO: 839236 - protein, 20 aa, Mycobacterium
MQESLEAILALFRAGPSERI

SEQ ID NO: 839237 - protein, 25 aa, Mycobacterium
MQGLLRSKGFCWIASRDDIAAIWSQ

SEQ ID NO: 839238 - protein, 25 aa, Mycobacterium
MQHDVQAPLRWFRDLYPDLDVDRAT

SEQ ID NO: 839239 - protein, 23 aa, Mycobacterium
MQHFTIPISFFDEAVFEEGLAFD

SEQ ID NO: 839240 - protein, 18 aa, Mycobacterium
MQHFTIPISFFDESVFED

SEQ ID NO: 839241 - protein, 18 aa, Mycobacterium
MQHFTIPVSFFDESVFED

SEQ ID NO: 839242 - protein, 24 aa, Mycobacterium
MQHRSRLYELLRYADYNQFDSDIY

SEQ ID NO: 839243 - protein, 20 aa, Mycobacterium
MQIKAIFSVLLREYEFEMAQ

SEQ ID NO: 839244 - protein, 23 aa, Mycobacterium
MQIKAIFSVLLREYEFEMAQPAD

SEQ ID NO: 839245 - protein, 18 aa, Mycobacterium
MQIRDFDCWMHELDVRDS

SEQ ID NO: 839246 - protein, 20 aa, Mycobacterium
MQKFLRGWSDALWDTGIEFG

SEQ ID NO: 839247 - protein, 25 aa, Mycobacterium
MQKKKFLPAILAGEVHFAIGYTEPE

SEQ ID NO: 839248 - protein, 30 aa, Mycobacterium
MQLQALIRDVWQPLYLLDPAPRPRIDLEVG

SEQ ID NO: 839249 - protein, 20 aa, Mycobacterium
MQLQVPYIKRILAEHPNVEY

SEQ ID NO: 839250 - protein, 29 aa, Mycobacterium
MQMASQLPQMLGQLPQMLGQVPQQLAQPL

SEQ ID NO: 839251 - protein, 32 aa, Mycobacterium
MQMNGLAELLTIRRYAHLWADPRMVICVFHNN

SEQ ID NO: 839252 - protein, 23 aa, Mycobacterium
MQMPEMPLIKFLDGYETIEELEK

SEQ ID NO: 839253 - protein, 22 aa, Mycobacterium
MQMRLTFVRALINDPELLFLDE

SEQ ID NO: 839254 - protein, 25 aa, Mycobacterium
MQNALPIQILMPEDIAGAVAWLVSD

SEQ ID NO: 839255 - protein, 18 aa, Mycobacterium
MQPPDQLRRWIDSLLNAV

SEQ ID NO: 839256 - protein, 25 aa, Mycobacterium
MQPPPLDDASIWLARLREGQPDEGR

SEQ ID NO: 839257 - protein, 17 aa, Mycobacterium
MQPPPPAGCTGRAPPGV

SEQ ID NO: 839258 - protein, 27 aa, Mycobacterium
MQPWDRDQIHRLFDDLEFRVLRDRLFE

SEQ ID NO: 839259 - protein, 27 aa, Mycobacterium
MQPWNRDQIHRLFDDLEFRVLRDRLFE

SEQ ID NO: 839260 - protein, 21 aa, Mycobacterium
MQQFISDLIVLFGGGQLAQGV

SEQ ID NO: 839261 - protein, 21 aa, Mycobacterium
MQQGELAVSFLLIGSGRAEVT

SEQ ID NO: 839262 - protein, 22 aa, Mycobacterium
MQQVPFAIRRAAGSTGLVVTRA

SEQ ID NO: 839263 - protein, 25 aa, Mycobacterium
MQRFAPLNSWPDNASLDKARRLLWP

SEQ ID NO: 839264 - protein, 21 aa, Mycobacterium
MQRFVQSLPENDPRTAWLRGQ

SEQ ID NO: 839265 - protein, 35 aa, Mycobacterium
MQRHIEALAGVFDFAFPPAPWMFGAAGREHMQKYG

SEQ ID NO: 839266 - protein, 21 aa, Mycobacterium
MQRHRELIAPKFALVAEILED

SEQ ID NO: 839267 - protein, 18 aa, Mycobacterium
MQRLGLYPPPPGVSEIPG

SEQ ID NO: 839268 - protein, 17 aa, Mycobacterium
MQRLLIDTWRSHPTTVV

SEQ ID NO: 839269 - protein, 22 aa, Mycobacterium
MQRLLIDTWRTHPTTIVFVTHD

SEQ ID NO: 839270 - protein, 17 aa, Mycobacterium
MQRLLPVYRADPDAYDL

SEQ ID NO: 839271 - protein, 17 aa, Mycobacterium
MQSLLRGLVTRVPTLEL

SEQ ID NO: 839272 - protein, 17 aa, Mycobacterium
MQSMFIQAVYYPGENQI

SEQ ID NO: 839273 - protein, 19 aa, Mycobacterium
MQTLGWRGYVERNRVAALM

SEQ ID NO: 839274 - protein, 29 aa, Mycobacterium
MQTRLTQPALFTVGYALSQLLGAWGVQPV

SEQ ID NO: 839275 - protein, 18 aa, Mycobacterium
MQTVFSDFFHRVANDPLA

SEQ ID NO: 839276 - protein, 18 aa, Mycobacterium
MQTVLGALRLRWLGTELN

SEQ ID NO: 839277 - protein, 23 aa, Mycobacterium
MQTVPHLIRLHHSRFPQARFELH

SEQ ID NO: 839278 - protein, 23 aa, Mycobacterium
MQYFTQAFVLRDKNPKMYDLFMD

SEQ ID NO: 839279 - protein, 28 aa, Mycobacterium
MQYGVLAGYPLVNLKVTLLDGAFHEVDS

SEQ ID NO: 839280 - protein, 19 aa, Mycobacterium
MRAALPDDITFRLGLSATP

SEQ ID NO: 839281 - protein, 19 aa, Mycobacterium
MRAAVIRCLYPVNRGGQGL

SEQ ID NO: 839282 - protein, 24 aa, Mycobacterium
MRADASALTYLRLAGDIRGVGEGP

SEQ ID NO: 839283 - protein, 26 aa, Mycobacterium
MRADRGFFCFPEVDIRIPFTDGMAAL

SEQ ID NO: 839284 - protein, 24 aa, Mycobacterium
MRAEGINLIVHYVDQPGALGKIGT

SEQ ID NO: 839285 - protein, 17 aa, Mycobacterium
MRAGKLAGTGKLGAEVT

SEQ ID NO: 839286 - protein, 17 aa, Mycobacterium
MRAGLPPALAVAGSYLD

SEQ ID NO: 839287 - protein, 20 aa, Mycobacterium
MRAITGAGEHLTIIPSMDGT

SEQ ID NO: 839288 - protein, 19 aa, Mycobacterium
MRALRAPTIVAALQHMIDI

SEQ ID NO: 839289 - protein, 19 aa, Mycobacterium
MRALRTLARQRHGVKVIVV

SEQ ID NO: 839290 - protein, 17 aa, Mycobacterium
MRALTARSWRAGLRQRA

SEQ ID NO: 839291 - protein, 19 aa, Mycobacterium
MRAPRPHAAGLNSAIALLE

SEQ ID NO: 839292 - protein, 18 aa, Mycobacterium
MRARNVWTPVLMLTAKDG

SEQ ID NO: 839293 - protein, 23 aa, Mycobacterium
MRARVETVFVRRADAALSPAMAQ

SEQ ID NO: 839294 - protein, 18 aa, Mycobacterium
MRCLDAMSALGALGTAAA

SEQ ID NO: 839295 - protein, 18 aa, Mycobacterium
MRCMGGAIHGKLAPRDDE

SEQ ID NO: 839296 - protein, 26 aa, Mycobacterium
MRDAQPNYFLPLDKAGIDPFTTAYPV

SEQ ID NO: 839297 - protein, 26 aa, Mycobacterium
MRDAQPNYFLPLDKAGIDPFVTAYPL

SEQ ID NO: 839298 - protein, 26 aa, Mycobacterium
MRDDRGYFCFPEVDIRIPFNAGMAAL

SEQ ID NO: 839299 - protein, 27 aa, Mycobacterium
MRDIHRGLLTRLSAFKVPHRLAVVERL

SEQ ID NO: 839300 - protein, 30 aa, Mycobacterium
MRDIRKHIGWYLHGFPAGSELRRALAMVKT

SEQ ID NO: 839301 - protein, 31 aa, Mycobacterium
MRDIRKHVAWYLHGFPAGADLRRALALVKTR

SEQ ID NO: 839302 - protein, 31 aa, Mycobacterium
MRDIRKHVAWYLHGFPAGSDLRRALALVKTL

SEQ ID NO: 839303 - protein, 17 aa, Mycobacterium
MRDLLLQHREPGTPVVV

SEQ ID NO: 839304 - protein, 18 aa, Mycobacterium
MRDQFLKRYGSLHRLECN

SEQ ID NO: 839305 - protein, 19 aa, Mycobacterium
MRDWVACLVCPLTEHLEAL

SEQ ID NO: 839306 - protein, 24 aa, Mycobacterium
MREDTLFRLASVTKPIVTVAVLRL

SEQ ID NO: 839307 - protein, 18 aa, Mycobacterium
MREFVAALHAIWSAWRDG

SEQ ID NO: 839308 - protein, 18 aa, Mycobacterium
MREFVAALHAIWSVWKDG

SEQ ID NO: 839309 - protein, 23 aa, Mycobacterium
MREGQTLFTYLHLAASKPCTDAL

SEQ ID NO: 839310 - protein, 20 aa, Mycobacterium
MREYPDLAAFEWVIRAEGAA

SEQ ID NO: 839311 - protein, 19 aa, Mycobacterium
MRFMLKAEMQEVPVMSFLI

SEQ ID NO: 839312 - protein, 27 aa, Mycobacterium
MRFPSSSFSFFHYVDMLGLTAKPFPNP

SEQ ID NO: 839313 - protein, 17 aa, Mycobacterium
MRFQELMPDVLHWLGIR

SEQ ID NO: 839314 - protein, 20 aa, Mycobacterium
MRFTHQLRMTLRELGSRRVT

SEQ ID NO: 839315 - protein, 26 aa, Mycobacterium
MRGAREKISFQGLPARICWLGYGERD

SEQ ID NO: 839316 - protein, 18 aa, Mycobacterium
MRGHTAFLISARKLAPGA

SEQ ID NO: 839317 - protein, 18 aa, Mycobacterium
MRGLPEKVDLARPRREHA

SEQ ID NO: 839318 - protein, 27 aa, Mycobacterium
MRGPGWVAHVPMDGFHLADAQLRRLGL

SEQ ID NO: 839319 - protein, 19 aa, Mycobacterium
MRGRTLATVDHWAVDMLSS

SEQ ID NO: 839320 - protein, 19 aa, Mycobacterium
MRGRTLYVVPFCMGPLDAE

SEQ ID NO: 839321 - protein, 41 aa, Mycobacterium
MRGTYTFHRRVLQLLQWHCPPTLWHLKTPVHMFALDALVEA

SEQ ID NO: 839322 - protein, 25 aa, Mycobacterium
MRHMPFRITPIHRDAWLRCMHTAVA

SEQ ID NO: 839323 - protein, 24 aa, Mycobacterium
MRHVPFRITPIERDAWLRCMHTAV

SEQ ID NO: 839324 - protein, 22 aa, Mycobacterium
MRHVPGFISANIHLSADGTRVA

SEQ ID NO: 839325 - protein, 17 aa, Mycobacterium
MRIAPRTLLCGNGVRAH

SEQ ID NO: 839326 - protein, 28 aa, Mycobacterium
MRIAPRTMLCGIAFRIHIDVAGARFEEL

SEQ ID NO: 839327 - protein, 19 aa, Mycobacterium
MRIPELPEHLVIVGSGFVA

SEQ ID NO: 839328 - protein, 18 aa, Mycobacterium
MRIPGGKVLQRLLSQAFV

SEQ ID NO: 839329 - protein, 26 aa, Mycobacterium
MRIPKPKFVLMPTGIWDQLFRPLVAG

SEQ ID NO: 839330 - protein, 20 aa, Mycobacterium
MRISDLPEHLVIVGGGFVAA

SEQ ID NO: 839331 - protein, 24 aa, Mycobacterium
MRKKLNLEIFRPHYTPNTVIARAK

SEQ ID NO: 839332 - protein, 32 aa, Mycobacterium
MRKKRLMDLIHLWLIHRFKAEIVYYVTPTEDN

SEQ ID NO: 839333 - protein, 23 aa, Mycobacterium
MRKSAHDGLNPRLGWAEWCAEWG

SEQ ID NO: 839334 - protein, 17 aa, Mycobacterium
MRLADRLPSYMMPSRLV

SEQ ID NO: 839335 - protein, 21 aa, Mycobacterium
MRLRKIVSRGFTPRILSELRG

SEQ ID NO: 839336 - protein, 18 aa, Mycobacterium
MRMRTAVAILSYADHLAF

SEQ ID NO: 839337 - protein, 21 aa, Mycobacterium
MRNQILAIYAVLQQTSDEELA

SEQ ID NO: 839338 - protein, 22 aa, Mycobacterium
MRNQVYVMGRFDLAPDEAFVVD

SEQ ID NO: 839339 - protein, 18 aa, Mycobacterium
MRPARMFGLRAEVEPTPL

SEQ ID NO: 839340 - protein, 18 aa, Mycobacterium
MRQGADSMKRMFLELGGK

SEQ ID NO: 839341 - protein, 22 aa, Mycobacterium
MRQGYQLGEHVLRNALVAVVET

SEQ ID NO: 839342 - protein, 18 aa, Mycobacterium
MRQPRLVRRYSRTVLTED

SEQ ID NO: 839343 - protein, 20 aa, Mycobacterium
MRQREPADWFLLVGSGSGEV

SEQ ID NO: 839344 - protein, 23 aa, Mycobacterium
MRQRLLIAMAVALNPTVLIADEP

SEQ ID NO: 839345 - protein, 24 aa, Mycobacterium
MRQRVLIAIAFGLNPKLLVADEPT

SEQ ID NO: 839346 - protein, 17 aa, Mycobacterium
MRRAGYMYGSYLPRGPR

SEQ ID NO: 839347 - protein, 29 aa, Mycobacterium
MRRDLKALTIARFARYKLLQAAPADADSE

SEQ ID NO: 839348 - protein, 18 aa, Mycobacterium
MRRELGLPGYDPVTELDD

SEQ ID NO: 839349 - protein, 28 aa, Mycobacterium
MRREQPMPWGLRPVVIDLYSAGAAVDFG

SEQ ID NO: 839350 - protein, 17 aa, Mycobacterium
MRRGYSLGDLPIVEAYL

SEQ ID NO: 839351 - protein, 19 aa, Mycobacterium
MRRKYLLLEAPQLPGRGWV

SEQ ID NO: 839352 - protein, 17 aa, Mycobacterium
MRRLLRDVAEGRELGDT

SEQ ID NO: 839353 - protein, 18 aa, Mycobacterium
MRRLLRDVAEGRELGDTS

SEQ ID NO: 839354 - protein, 23 aa, Mycobacterium
MRRLRGRFYDGMRALHGAPDEVI

SEQ ID NO: 839355 - protein, 17 aa, Mycobacterium
MRRLRSRFYDGMRERHG

SEQ ID NO: 839356 - protein, 25 aa, Mycobacterium
MRRLWDDQIPGACDSTLLIAERVQP

SEQ ID NO: 839357 - protein, 20 aa, Mycobacterium
MRRMSYVQRLAKLLSTQLWE

SEQ ID NO: 839358 - protein, 25 aa, Mycobacterium
MRRNAGQPPPFPNAGRFPFLTVDGP

SEQ ID NO: 839359 - protein, 22 aa, Mycobacterium
MRRPVKLVLTRRQMYSAIGYRP

SEQ ID NO: 839360 - protein, 18 aa, Mycobacterium
MRRVRLRRAHLELIAASA

SEQ ID NO: 839361 - protein, 20 aa, Mycobacterium
MRSALSIATLLIGSSVRAVE

SEQ ID NO: 839362 - protein, 24 aa, Mycobacterium
MRSALYAPDLALARAWTLAAARDL

SEQ ID NO: 839363 - protein, 18 aa, Mycobacterium
MRSFFAVPHIRSTAELTI

SEQ ID NO: 839364 - protein, 17 aa, Mycobacterium
MRSFFVDFGTKFPTEAT

SEQ ID NO: 839365 - protein, 26 aa, Mycobacterium
MRSLHKVLLNFKMPGYTIPDFRRRAV

SEQ ID NO: 839366 - protein, 17 aa, Mycobacterium
MRSPLQVGVGIGAGGGV

SEQ ID NO: 839367 - protein, 36 aa, Mycobacterium
MRTAGSIIMFLNLARQFFPLLSIPTNIFNPGAWLGV

SEQ ID NO: 839368 - protein, 24 aa, Mycobacterium
MRTAINLLLDRLPNLRLDPDADDP

SEQ ID NO: 839369 - protein, 22 aa, Mycobacterium
MRTDRIRAWSKHLCARSSVVFA

SEQ ID NO: 839370 - protein, 25 aa, Mycobacterium
MRTFDRPVLVIWAREDRMMPLEHAD

SEQ ID NO: 839371 - protein, 20 aa, Mycobacterium
MRTFLGVPVRVHDMSLGTLY

SEQ ID NO: 839372 - protein, 21 aa, Mycobacterium
MRTGRLFAVSLLPGTPERVVL

SEQ ID NO: 839373 - protein, 20 aa, Mycobacterium
MRTIFEPWESHPLMLRSYFQ

SEQ ID NO: 839374 - protein, 18 aa, Mycobacterium
MRTLDPWVSLGTAAAVTS

SEQ ID NO: 839375 - protein, 17 aa, Mycobacterium
MRTLWRDDLASFTGEFV

SEQ ID NO: 839376 - protein, 23 aa, Mycobacterium
MRTPTQMVFLQPRAHNPTGIAMT

SEQ ID NO: 839377 - protein, 29 aa, Mycobacterium
MRTVVRLLSPILRPALRAVLMVQRRLEGR

SEQ ID NO: 839378 - protein, 18 aa, Mycobacterium
MRTYRPHGRRWGSVLGPQ

SEQ ID NO: 839379 - protein, 18 aa, Mycobacterium
MRVARREALLDLGVTDRR

SEQ ID NO: 839380 - protein, 21 aa, Mycobacterium
MRVDWTPTCGNILAGVGPFAI

SEQ ID NO: 839381 - protein, 25 aa, Mycobacterium
MRVIQHPHWFRTGDLGRLDAEGNLA

SEQ ID NO: 839382 - protein, 17 aa, Mycobacterium
MRVNFWSHYNSYQVLAP

SEQ ID NO: 839383 - protein, 17 aa, Mycobacterium
MRVTTRKLRSLLRDYQD

SEQ ID NO: 839384 - protein, 18 aa, Mycobacterium
MRVTTRKLRSLLRDYQEA

SEQ ID NO: 839385 - protein, 20 aa, Mycobacterium
MRVVNAIPYVVTAPAGLLSS

SEQ ID NO: 839386 - protein, 28 aa, Mycobacterium
MRWIRDPELMTWLRTARLNAARDLFPVF

SEQ ID NO: 839387 - protein, 17 aa, Mycobacterium
MRYAALAAVIRPAATEL

SEQ ID NO: 839388 - protein, 17 aa, Mycobacterium
MRYDLSAGFPLITTKKV

SEQ ID NO: 839389 - protein, 30 aa, Mycobacterium
MRYGSAQVRFPLRPFMGMMGVAFTQDREIT

SEQ ID NO: 839390 - protein, 28 aa, Mycobacterium
MRYVGDRFPLMPIPSWMDNPIDPISIRD

SEQ ID NO: 839391 - protein, 27 aa, Mycobacterium
MSAAAAPYVSWLNAAAVRAGEAALQAK

SEQ ID NO: 839392 - protein, 24 aa, Mycobacterium
MSAALSKRLLWDTAINGYAPQQVG

SEQ ID NO: 839393 - protein, 26 aa, Mycobacterium
MSAAQLRQWFQYRIEGPGPVNNVPFA

SEQ ID NO: 839394 - protein, 28 aa, Mycobacterium
MSADLVVLGPGSWFTSVIPHVLVPELAA

SEQ ID NO: 839395 - protein, 25 aa, Mycobacterium
MSAGFWGSLLPAVWSFMLALRSRGL

SEQ ID NO: 839396 - protein, 25 aa, Mycobacterium
MSAGVIEVAPLAYMRGRSLNDAFII

SEQ ID NO: 839397 - protein, 25 aa, Mycobacterium
MSAGVIEVAPLAYMRGRTLNSAFIV

SEQ ID NO: 839398 - protein, 19 aa, Mycobacterium
MSAINRARLPIAARSWIDN

SEQ ID NO: 839399 - protein, 21 aa, Mycobacterium
MSALAGAHLLAVPTAQMTPFE

SEQ ID NO: 839400 - protein, 21 aa, Mycobacterium
MSAMFYGFREREEILRVFESI

SEQ ID NO: 839401 - protein, 26 aa, Mycobacterium
MSAPSRWMRLLPGQTPLDAAKVLARA

SEQ ID NO: 839402 - protein, 20 aa, Mycobacterium
MSARHPGNIAALAAIAPPSV

SEQ ID NO: 839403 - protein, 24 aa, Mycobacterium
MSARLVKVTPALAALADACHEPAR

SEQ ID NO: 839404 - protein, 20 aa, Mycobacterium
MSAVTLRQLVETALLEGVQG

SEQ ID NO: 839405 - protein, 18 aa, Mycobacterium
MSAWELLIEIARNELDSR

SEQ ID NO: 839406 - protein, 18 aa, Mycobacterium
MSAYGWLTPVSEIQAFSV

SEQ ID NO: 839407 - protein, 20 aa, Mycobacterium
MSCEWFFCASGYYRYDEGYT

SEQ ID NO: 839408 - protein, 21 aa, Mycobacterium
MSCGVLLDHLRVALAAAGWDT

SEQ ID NO: 839409 - protein, 26 aa, Mycobacterium
MSDAAGGFFGLWQPAGHDGFQVFNEP

SEQ ID NO: 839410 - protein, 27 aa, Mycobacterium
MSDADTLFFIGTSFPYAEWLPKEGQCR

SEQ ID NO: 839411 - protein, 25 aa, Mycobacterium
MSDEYEWVPLRLPPEVTRVSASTRL

SEQ ID NO: 839412 - protein, 21 aa, Mycobacterium
MSDFHLRVRPGTDAWCLAALA

SEQ ID NO: 839413 - protein, 22 aa, Mycobacterium
MSDFHLRVRPGTDAWCLAALAA

SEQ ID NO: 839414 - protein, 22 aa, Mycobacterium
MSDGVYRLGPLDIDVVAGVARV

SEQ ID NO: 839415 - protein, 23 aa, Mycobacterium
MSDRDFLRLANRIIDEARDGDSS

SEQ ID NO: 839416 - protein, 25 aa, Mycobacterium
MSDRHTLLLMRHAKSQYPPGVADHE

SEQ ID NO: 839417 - protein, 24 aa, Mycobacterium
MSDVRFMRFIGQEIFPGGQLPAQE

SEQ ID NO: 839418 - protein, 28 aa, Mycobacterium
MSDYAELYGWNTYYPEALLKQNSFSSDG

SEQ ID NO: 839419 - protein, 18 aa, Mycobacterium
MSEFYIPVTPDAGRLLYA

SEQ ID NO: 839420 - protein, 24 aa, Mycobacterium
MSEGEMFIIGRIKDLLIVDGRNHY

SEQ ID NO: 839421 - protein, 20 aa, Mycobacterium
MSEIKPRYVVLAAAKVGGIL

SEQ ID NO: 839422 - protein, 17 aa, Mycobacterium
MSELPDALQAPGLTAHR

SEQ ID NO: 839423 - protein, 19 aa, Mycobacterium
MSFAYHYLATHPAERDRLI

SEQ ID NO: 839424 - protein, 17 aa, Mycobacterium
MSFDFGALPPEINSLRM

SEQ ID NO: 839425 - protein, 23 aa, Mycobacterium
MSFENWDAVLKVHLYGGYNVIRA

SEQ ID NO: 839426 - protein, 19 aa, Mycobacterium
MSFIAVCGQCRWCASGMEY

SEQ ID NO: 839427 - protein, 23 aa, Mycobacterium
MSFVFAVPEFLTTAAQDAAAIGT

SEQ ID NO: 839428 - protein, 26 aa, Mycobacterium
MSGALKHFFDTVYYPVLDHVAGRPYG

SEQ ID NO: 839429 - protein, 24 aa, Mycobacterium
MSGARITLHLAQELKRRGGGIGVA

SEQ ID NO: 839430 - protein, 24 aa, Mycobacterium
MSGARITLHVALELARRGSGYGVA

SEQ ID NO: 839431 - protein, 26 aa, Mycobacterium
MSGCQAEVIRIPWADGSLVALPGQPD

SEQ ID NO: 839432 - protein, 25 aa, Mycobacterium
MSGDMLMPLMLLTRKGGRACLTSVA

SEQ ID NO: 839433 - protein, 37 aa, Mycobacterium
MSGFERRGRWNVPGKLTSFALWGGGVLDLRYADFTSN

SEQ ID NO: 839434 - protein, 22 aa, Mycobacterium
MSGGIAFVLGLDPRRVNTAMVE

SEQ ID NO: 839435 - protein, 27 aa, Mycobacterium
MSGIEFLERAMDLYPAARRVLLTAYAD

SEQ ID NO: 839436 - protein, 18 aa, Mycobacterium
MSGLQQGFVKMFCRKSTG

SEQ ID NO: 839437 - protein, 24 aa, Mycobacterium
MSGWAGYVAGVIWALRCAGHPVPG

SEQ ID NO: 839438 - protein, 28 aa, Mycobacterium
MSGWDGVPLAPYFTSLTDAPVVIDNDAN

SEQ ID NO: 839439 - protein, 17 aa, Mycobacterium
MSGWMGVDLARYGLDEP

SEQ ID NO: 839440 - protein, 17 aa, Mycobacterium
MSGWWRSNVLLISTDNV

SEQ ID NO: 839441 - protein, 24 aa, Mycobacterium
MSGYAHGELADRLNLAISALREEA

SEQ ID NO: 839442 - protein, 24 aa, Mycobacterium
MSHANEFIMLIDENHWRVAEEPVE

SEQ ID NO: 839443 - protein, 26 aa, Mycobacterium
MSHANEFIMLITENHWRVVEQPVEVL

SEQ ID NO: 839444 - protein, 25 aa, Mycobacterium
MSHATEFIMLIAENHWRVAEEPVEV

SEQ ID NO: 839445 - protein, 25 aa, Mycobacterium
MSHATEFVMLIAENHWRVAEEPVEV

SEQ ID NO: 839446 - protein, 18 aa, Mycobacterium
MSILLGEVFTRYGNGSLA

SEQ ID NO: 839447 - protein, 17 aa, Mycobacterium
MSILTRSATLPYATTER

SEQ ID NO: 839448 - protein, 25 aa, Mycobacterium
MSIPSDLVFLARINLNISALSATLN

SEQ ID NO: 839449 - protein, 26 aa, Mycobacterium
MSISVAFHEPARWSGWLLYTHESTQV

SEQ ID NO: 839450 - protein, 26 aa, Mycobacterium
MSISVAFHEPVRWDGWLLYTHESTQV

SEQ ID NO: 839451 - protein, 17 aa, Mycobacterium
MSIWRAGDTAGLGTVVR

SEQ ID NO: 839452 - protein, 17 aa, Mycobacterium
MSKHFPYSPVGSALLCR

SEQ ID NO: 839453 - protein, 18 aa, Mycobacterium
MSKLVWKITELEPGTSWT

SEQ ID NO: 839454 - protein, 39 aa, Mycobacterium
MSLPVTFDVPVLGPLNIPVVIHLPFQGLLVPPHPITATV

SEQ ID NO: 839455 - protein, 36 aa, Mycobacterium
MSLTKNLRVFIRPHPLVGIITPWNGPLATPIVDGMP

SEQ ID NO: 839456 - protein, 19 aa, Mycobacterium
MSMLRTLLRRNQIGDIVHV

SEQ ID NO: 839457 - protein, 17 aa, Mycobacterium
MSMLRTLVRRDAIGAPG

SEQ ID NO: 839458 - protein, 18 aa, Mycobacterium
MSMLRTLVRRDQITDIVH

SEQ ID NO: 839459 - protein, 22 aa, Mycobacterium
MSMRFFKSREALLDKAKRAEDA

SEQ ID NO: 839460 - protein, 25 aa, Mycobacterium
MSNDTWMVLSALDRALLNAPDTPPD

SEQ ID NO: 839461 - protein, 17 aa, Mycobacterium
MSNYDPMMVIGQGASFD

SEQ ID NO: 839462 - protein, 25 aa, Mycobacterium
MSPEEARFILDRLTPGMSQIFGMAE

SEQ ID NO: 839463 - protein, 26 aa, Mycobacterium
MSPIGRRLMQLPLGLTVQACEAAIAD

SEQ ID NO: 839464 - protein, 20 aa, Mycobacterium
MSPKGFGASAPFYGAPLPRH

SEQ ID NO: 839465 - protein, 26 aa, Mycobacterium
MSPPNLIRAILQAPVDLLFNGGIGTY

SEQ ID NO: 839466 - protein, 23 aa, Mycobacterium
MSPSSVYLSPAPLYHAAGVNYTM

SEQ ID NO: 839467 - protein, 25 aa, Mycobacterium
MSQNTPICPVLIPSVARVVFASSLL

SEQ ID NO: 839468 - protein, 18 aa, Mycobacterium
MSQRKLRPLRAKFGFVFQ

SEQ ID NO: 839469 - protein, 23 aa, Mycobacterium
MSQRLGIPLARIREALATLPSDR

SEQ ID NO: 839470 - protein, 19 aa, Mycobacterium
MSRAPGCPFAPPPKVLELN

SEQ ID NO: 839471 - protein, 21 aa, Mycobacterium
MSRELFDTEPLFAETLRECAA

SEQ ID NO: 839472 - protein, 25 aa, Mycobacterium
MSRGAIFHHFRDKDALFFALAHEDA

SEQ ID NO: 839473 - protein, 18 aa, Mycobacterium
MSRHARSLAGPLRRLARL

SEQ ID NO: 839474 - protein, 26 aa, Mycobacterium
MSRHWYRYHHLFGELLRAELHRCEPE

SEQ ID NO: 839475 - protein, 17 aa, Mycobacterium
MSRLAPLGPVYQAGTLS

SEQ ID NO: 839476 - protein, 17 aa, Mycobacterium
MSRLRGVVERPDPLSGL

SEQ ID NO: 839477 - protein, 19 aa, Mycobacterium
MSRLRKQFAGILATQPYRF

SEQ ID NO: 839478 - protein, 21 aa, Mycobacterium
MSRMTWRSMISDGLAMRHGKE

SEQ ID NO: 839479 - protein, 24 aa, Mycobacterium
MSRNGCWGTFVIADARHAVTLPAG

SEQ ID NO: 839480 - protein, 22 aa, Mycobacterium
MSRRELIRHTAWFGAAVALTVT

SEQ ID NO: 839481 - protein, 24 aa, Mycobacterium
MSRSAGCPFAPPPGVMALAAAKPL

SEQ ID NO: 839482 - protein, 19 aa, Mycobacterium
MSRWRATVNWAGSRPVSAE

SEQ ID NO: 839483 - protein, 26 aa, Mycobacterium
MSSEPLIDAIPLWKRPQDGAIITGWD

SEQ ID NO: 839484 - protein, 26 aa, Mycobacterium
MSSEPLIDAIPLWKRPQDGAVITGWD

SEQ ID NO: 839485 - protein, 21 aa, Mycobacterium
MSSESVRRLGLEPGVVAVAVV

SEQ ID NO: 839486 - protein, 17 aa, Mycobacterium
MSSLDVARRPDFLRLLR

SEQ ID NO: 839487 - protein, 34 aa, Mycobacterium
MSSNNQPFLPPPGPRQLMALLKPPPEGASREQII

SEQ ID NO: 839488 - protein, 33 aa, Mycobacterium
MSSNRPEFVIALRAIWRLGAAAVLISPAWKTTE

SEQ ID NO: 839489 - protein, 35 aa, Mycobacterium
MSSNRPEFVVALRAIWRLGAAAVLLSPAWKQTEVG

SEQ ID NO: 839490 - protein, 25 aa, Mycobacterium
MSTIQLDFNFPERFELDYTAADGTR

SEQ ID NO: 839491 - protein, 25 aa, Mycobacterium
MSTLEVHLLSWRPGLTYRQLATELT

SEQ ID NO: 839492 - protein, 17 aa, Mycobacterium
MSTSVEFIVAMLGVLKS

SEQ ID NO: 839493 - protein, 28 aa, Mycobacterium
MSTTFKLPFGELPGQVFVGIRTSDVLTH

SEQ ID NO: 839494 - protein, 28 aa, Mycobacterium
MSTVEVPLLWRKRLLRKAIDFADPLRCA

SEQ ID NO: 839495 - protein, 24 aa, Mycobacterium
MSTVSYGVINWFDDERGFGFVHPA

SEQ ID NO: 839496 - protein, 25 aa, Mycobacterium
MSVALSKRLLWDTLINGYTPRQVAE

SEQ ID NO: 839497 - protein, 27 aa, Mycobacterium
MSVDDELRWMWLTSQAALHLWDDAHWD

SEQ ID NO: 839498 - protein, 25 aa, Mycobacterium
MSVDIRVPARYRLGPPGGGFGMMME

SEQ ID NO: 839499 - protein, 23 aa, Mycobacterium
MSVHREWLLIELRTDWSPKAGAD

SEQ ID NO: 839500 - protein, 23 aa, Mycobacterium
MSVLTGRIFAGHLRSIIGSMTVE

SEQ ID NO: 839501 - protein, 28 aa, Mycobacterium
MSVRNPDPLLLLFDPLPNTGVVVIQGNP

SEQ ID NO: 839502 - protein, 23 aa, Mycobacterium
MSVVPYQLIPRVVHGEQFFKFHR

SEQ ID NO: 839503 - protein, 18 aa, Mycobacterium
MSWDFLARSTAGLWEWAQ

SEQ ID NO: 839504 - protein, 18 aa, Mycobacterium
MSYHLPRIVGTSVAADWM

SEQ ID NO: 839505 - protein, 19 aa, Mycobacterium
MSYRTLMADLATLYRGHHL

SEQ ID NO: 839506 - protein, 22 aa, Mycobacterium
MTAAPIERILIRLPAISMAAVY

SEQ ID NO: 839507 - protein, 25 aa, Mycobacterium
MTAAPNFAYALLAKRLRRNAKPGDF

SEQ ID NO: 839508 - protein, 31 aa, Mycobacterium
MTAATEHAEFIRWRVEQLVATDALIGQQLQA

SEQ ID NO: 839509 - protein, 19 aa, Mycobacterium
MTAGLKALAWMSRQNPEGS

SEQ ID NO: 839510 - protein, 18 aa, Mycobacterium
MTAGRHPASDIYLDDITV

SEQ ID NO: 839511 - protein, 19 aa, Mycobacterium
MTAIVKGLRTGTDFEYELQ

SEQ ID NO: 839512 - protein, 24 aa, Mycobacterium
MTAPGDPIAIVQSLPRDVRLSDVP

SEQ ID NO: 839513 - protein, 21 aa, Mycobacterium
MTAVMRAIVSAPLPVIAAIDG

SEQ ID NO: 839514 - protein, 27 aa, Mycobacterium
MTAYEDRPTLVLPGSGKTITGTAVGDW

SEQ ID NO: 839515 - protein, 26 aa, Mycobacterium
MTAYEDRPTLVLPGSGKTITGTAVND

SEQ ID NO: 839516 - protein, 21 aa, Mycobacterium
MTDGFRYPITSFTDQGRRPAI

SEQ ID NO: 839517 - protein, 19 aa, Mycobacterium
MTDIDYCQGWYFIDPADGK

SEQ ID NO: 839518 - protein, 31 aa, Mycobacterium
MTDRVQTYVPERALRPMFAYRHRQLADDLAA

SEQ ID NO: 839519 - protein, 22 aa, Mycobacterium
MTDWYLQLLDGKVAFANPMIAF

SEQ ID NO: 839520 - protein, 23 aa, Mycobacterium
MTDYMTRLMRYVEFMKKVVPLHD

SEQ ID NO: 839521 - protein, 34 aa, Mycobacterium
MTEAERMRLIAIPLWHSYMFAIRKDWGYMTSQAT

SEQ ID NO: 839522 - protein, 26 aa, Mycobacterium
MTEFLPGHYDFLQRLFAGINPRHRQQ

SEQ ID NO: 839523 - protein, 27 aa, Mycobacterium
MTEFLPGHYDFLQRLFAGINPRHRQQL

SEQ ID NO: 839524 - protein, 19 aa, Mycobacterium
MTELIAALRAIFAAWNCGD

SEQ ID NO: 839525 - protein, 21 aa, Mycobacterium
MTELPLIVIDVQRGGPSTGLP

SEQ ID NO: 839526 - protein, 23 aa, Mycobacterium
MTELPLLVIDVQRGGPSTGLPTK

SEQ ID NO: 839527 - protein, 26 aa, Mycobacterium
MTELTWLIPAAIAAKFWNAPPGSGEI

SEQ ID NO: 839528 - protein, 26 aa, Mycobacterium
MTERSKLYWDFWEQFRSRVVSEYPGW

SEQ ID NO: 839529 - protein, 37 aa, Mycobacterium
MTESLTHLFKAGGKRFRPLFTVLSAQLGPNPDAADVT

SEQ ID NO: 839530 - protein, 17 aa, Mycobacterium
MTESMLELLLRELDVAP

SEQ ID NO: 839531 - protein, 17 aa, Mycobacterium
MTESMLELLLRELDVNP

SEQ ID NO: 839532 - protein, 19 aa, Mycobacterium
MTFEYRCGGERMALSEGDI

SEQ ID NO: 839533 - protein, 17 aa, Mycobacterium
MTFIRRSGVHDSGRPHA

SEQ ID NO: 839534 - protein, 17 aa, Mycobacterium
MTFVSILAKLVQSDFFR

SEQ ID NO: 839535 - protein, 18 aa, Mycobacterium
MTGFGFAEPVTTPTWGVL

SEQ ID NO: 839536 - protein, 17 aa, Mycobacterium
MTGIGFEPPATNPAWGV

SEQ ID NO: 839537 - protein, 24 aa, Mycobacterium
MTGKFEWLDNNVVQWVPSHYWPAH

SEQ ID NO: 839538 - protein, 23 aa, Mycobacterium
MTGMDWKVRHAVTSWPSICSGLR

SEQ ID NO: 839539 - protein, 19 aa, Mycobacterium
MTGMPMMPPGAMGAGGEGG

SEQ ID NO: 839540 - protein, 25 aa, Mycobacterium
MTGRAATPISLTPGLLAEALVDLGA

SEQ ID NO: 839541 - protein, 25 aa, Mycobacterium
MTGRKLAHLPLPNSRLCNLASITSF

SEQ ID NO: 839542 - protein, 35 aa, Mycobacterium
MTGRYQWLDNNVVQWVPDQFWPAHSTVALSVGGVS

SEQ ID NO: 839543 - protein, 19 aa, Mycobacterium
MTGSVFFQQATDLGLRTVA

SEQ ID NO: 839544 - protein, 24 aa, Mycobacterium
MTGTPWAYQQLGVKPDVVAFGKKT

SEQ ID NO: 839545 - protein, 18 aa, Mycobacterium
MTGYRRFGSRLQGHPTPV

SEQ ID NO: 839546 - protein, 26 aa, Mycobacterium
MTHDDWRWVIDIDLWGSIHTVEAFLP

SEQ ID NO: 839547 - protein, 40 aa, Mycobacterium
MTHHLDRAFAVLAHLGDPIAWSAPLRWAGVHAAILTNSPE

SEQ ID NO: 839548 - protein, 29 aa, Mycobacterium
MTHLGSGLFAVALPFLNLLDYRLDVEYGG

SEQ ID NO: 839549 - protein, 25 aa, Mycobacterium
MTHLNAMRWYSFDPFSRIPREQATV

SEQ ID NO: 839550 - protein, 19 aa, Mycobacterium
MTHNDFVFGTMRPDLEKPT

SEQ ID NO: 839551 - protein, 18 aa, Mycobacterium
MTIALKYLRWREISYLAA

SEQ ID NO: 839552 - protein, 27 aa, Mycobacterium
MTIDEFAPQISFFFYTHGDFFEEIAKY

SEQ ID NO: 839553 - protein, 30 aa, Mycobacterium
MTIPRLVILARWRHTIVGELLRDVAQAGAI

SEQ ID NO: 839554 - protein, 28 aa, Mycobacterium
MTIPYAAMEVLKLRLTPSAYQQAAGLAK

SEQ ID NO: 839555 - protein, 28 aa, Mycobacterium
MTIRQNVGLVPGLLGWDRKRIGDRVDEL

SEQ ID NO: 839556 - protein, 26 aa, Mycobacterium
MTISVAFHEPVRWDGWLLYTHESTQV

SEQ ID NO: 839557 - protein, 20 aa, Mycobacterium
MTKALLRGLAALVIPQLRTT

SEQ ID NO: 839558 - protein, 27 aa, Mycobacterium
MTKPIPPLDLSWLLLESPAGTTHVGAM

SEQ ID NO: 839559 - protein, 22 aa, Mycobacterium
MTLAGKTLGLLGLGRVGRRMAE

SEQ ID NO: 839560 - protein, 20 aa, Mycobacterium
MTLERVLVSPPIWFDDRSNT

SEQ ID NO: 839561 - protein, 18 aa, Mycobacterium
MTLMLKLMRLTQTDSAWS

SEQ ID NO: 839562 - protein, 25 aa, Mycobacterium
MTLMSPLSFVRRPGRWIRELAAASH

SEQ ID NO: 839563 - protein, 20 aa, Mycobacterium
MTLRIPRPRLCTDNGAMIAS

SEQ ID NO: 839564 - protein, 30 aa, Mycobacterium
MTLSGFYSHPWAWNEIGFGGPAYPRGFMRL

SEQ ID NO: 839565 - protein, 26 aa, Mycobacterium
MTMEAWNDPTLLKFLATPALAREYLF

SEQ ID NO: 839566 - protein, 29 aa, Mycobacterium
MTMEMAKFVKFILTEIFPGGQLPSSEMVH

SEQ ID NO: 839567 - protein, 25 aa, Mycobacterium
MTMGHPVVMGRLTWESLPASVRPLP

SEQ ID NO: 839568 - protein, 27 aa, Mycobacterium
MTMRAGQVAAWLLGLSQYRDSALSVAA

SEQ ID NO: 839569 - protein, 20 aa, Mycobacterium
MTMVLAPHRGAKTRAKAAEQ

SEQ ID NO: 839570 - protein, 20 aa, Mycobacterium
MTMVLAPHRGAKTRAKAAQQ

SEQ ID NO: 839571 - protein, 18 aa, Mycobacterium
MTNAGINGTISFGGQAGT

SEQ ID NO: 839572 - protein, 19 aa, Mycobacterium
MTNLLLCSAVDHGTLSRGL

SEQ ID NO: 839573 - protein, 24 aa, Mycobacterium
MTNPDWLPTIRRAAALVTDTGGMT

SEQ ID NO: 839574 - protein, 23 aa, Mycobacterium
MTNPNIALIQDPLLPVGPAQQIG

SEQ ID NO: 839575 - protein, 30 aa, Mycobacterium
MTNRALHDLPYYRALAQWRAAALLQAELGR

SEQ ID NO: 839576 - protein, 20 aa, Mycobacterium
MTNVFYRGRGFLDGAYDDLR

SEQ ID NO: 839577 - protein, 17 aa, Mycobacterium
MTPFERKIVHDAVAAID

SEQ ID NO: 839578 - protein, 17 aa, Mycobacterium
MTPFERKIVHDAVAAVD

SEQ ID NO: 839579 - protein, 20 aa, Mycobacterium
MTPKVPYYSATLFDPRERPL

SEQ ID NO: 839580 - protein, 19 aa, Mycobacterium
MTPLTNWRIPGPELKFEER

SEQ ID NO: 839581 - protein, 26 aa, Mycobacterium
MTPPNLIRAILQAPVDLLFNGGIGTY

SEQ ID NO: 839582 - protein, 30 aa, Mycobacterium
MTPPQLVRAILLAPVDLFFNGGIGTYVKAE

SEQ ID NO: 839583 - protein, 19 aa, Mycobacterium
MTPTFSPGPSPYGPPPIYV

SEQ ID NO: 839584 - protein, 24 aa, Mycobacterium
MTPWVWPKMHLNPPNWIEPITEAC

SEQ ID NO: 839585 - protein, 17 aa, Mycobacterium
MTRAALPHLLKTGSGRI

SEQ ID NO: 839586 - protein, 28 aa, Mycobacterium
MTRALSILTTYPFPNETLEKWLRGDYGN

SEQ ID NO: 839587 - protein, 18 aa, Mycobacterium
MTRAPGCPFAPPPKVLEL

SEQ ID NO: 839588 - protein, 22 aa, Mycobacterium
MTRDELIDYLTMLSWNALKGIV

SEQ ID NO: 839589 - protein, 19 aa, Mycobacterium
MTRFDNSVLSWFGLPRSLA

SEQ ID NO: 839590 - protein, 27 aa, Mycobacterium
MTRHLIGPPFIIARFMKYLELEEIPLT

SEQ ID NO: 839591 - protein, 35 aa, Mycobacterium
MTRLAPIWSRLAVGGVLMTINWWSASRTMTQDDLI

SEQ ID NO: 839592 - protein, 17 aa, Mycobacterium
MTRLDLPHTLFPPIVEA

SEQ ID NO: 839593 - protein, 18 aa, Mycobacterium
MTRLDPETPARLFYERSF

SEQ ID NO: 839594 - protein, 24 aa, Mycobacterium
MTRLHQYNVFPNMTLLANADHLTV

SEQ ID NO: 839595 - protein, 21 aa, Mycobacterium
MTRPRDTVIRYPVVGSTTLAV

SEQ ID NO: 839596 - protein, 24 aa, Mycobacterium
MTRRQFGHTLFEHQALRLRMADLQ

SEQ ID NO: 839597 - protein, 25 aa, Mycobacterium
MTRRQLLRHTAWFGAAVGLTVAGGE

SEQ ID NO: 839598 - protein, 30 aa, Mycobacterium
MTRSDGVMLVLFSTPWRLEGFQRDNPDIKL

SEQ ID NO: 839599 - protein, 18 aa, Mycobacterium
MTRWTDYLSGASGPLMVA

SEQ ID NO: 839600 - protein, 18 aa, Mycobacterium
MTRYSWQSYLIATGGFAE

SEQ ID NO: 839601 - protein, 31 aa, Mycobacterium
MTSDELIDYLTMLSWYALCGIVEVGGSLEKF

SEQ ID NO: 839602 - protein, 20 aa, Mycobacterium
MTSFYDWYADLPVAAPQVFG

SEQ ID NO: 839603 - protein, 20 aa, Mycobacterium
MTSGPWRGPASTSMASAAAP

SEQ ID NO: 839604 - protein, 25 aa, Mycobacterium
MTSGSLYHYFPNKSELLNATATEIE

SEQ ID NO: 839605 - protein, 25 aa, Mycobacterium
MTSGSLYHYFPNKSELLNATGEEIE

SEQ ID NO: 839606 - protein, 17 aa, Mycobacterium
MTSRGFPNQFFMGFIQG

SEQ ID NO: 839607 - protein, 22 aa, Mycobacterium
MTSRRLSTALAGFAIITGAAAG

SEQ ID NO: 839608 - protein, 24 aa, Mycobacterium
MTSSLTSMLLSCLLTLGGVRPESA

SEQ ID NO: 839609 - protein, 24 aa, Mycobacterium
MTSVLLRHYPTLEPVLRNVKNPFA

SEQ ID NO: 839610 - protein, 17 aa, Mycobacterium
MTSVVINPFFQWGSDRA

SEQ ID NO: 839611 - protein, 28 aa, Mycobacterium
MTTESAQLDWPLAEALRYPAGLIDDFEW

SEQ ID NO: 839612 - protein, 18 aa, Mycobacterium
MTTLVSVLEQGGGRYGLQ

SEQ ID NO: 839613 - protein, 24 aa, Mycobacterium
MTTRLNWQLWNYPVAGNDTEDIRL

SEQ ID NO: 839614 - protein, 25 aa, Mycobacterium
MTTSDLFVRYLRPVRQGSAFAVPKV

SEQ ID NO: 839615 - protein, 25 aa, Mycobacterium
MTTSEIATVLAWHDALNAGDVETLV

SEQ ID NO: 839616 - protein, 18 aa, Mycobacterium
MTTSEWLDRLAPKATAIV

SEQ ID NO: 839617 - protein, 27 aa, Mycobacterium
MTTYHMIPTENLPLLEPLRGVPFIGNT

SEQ ID NO: 839618 - protein, 18 aa, Mycobacterium
MTVALLLASTRHLLTADA

SEQ ID NO: 839619 - protein, 27 aa, Mycobacterium
MTVFEHLGRLLIIDCGVLFPTHDEPGV

SEQ ID NO: 839620 - protein, 27 aa, Mycobacterium
MTVFELRGRLLIIDCGVLFPGHNEPGV

SEQ ID NO: 839621 - protein, 18 aa, Mycobacterium
MTVHPALVAANRAQLAVL

SEQ ID NO: 839622 - protein, 17 aa, Mycobacterium
MTVPPAEIAANRTLLMA

SEQ ID NO: 839623 - protein, 19 aa, Mycobacterium
MTVPPIVVAANRALLAALI

SEQ ID NO: 839624 - protein, 18 aa, Mycobacterium
MTVPPPLVAANRAQLLVL

SEQ ID NO: 839625 - protein, 19 aa, Mycobacterium
MTVPPPVVAANRSLLLTLI

SEQ ID NO: 839626 - protein, 21 aa, Mycobacterium
MTVPYGHIVGFLGPNGAGKST

SEQ ID NO: 839627 - protein, 21 aa, Mycobacterium
MTVQLGMGMLLALHLGRIKDS

SEQ ID NO: 839628 - protein, 24 aa, Mycobacterium
MTVRQNIAFPLTLAKVPKAEIAAK

SEQ ID NO: 839629 - protein, 17 aa, Mycobacterium
MTVVHVIGSLKGALKAA

SEQ ID NO: 839630 - protein, 23 aa, Mycobacterium
MTWRDDEYIIWNLNNYLGLADHP

SEQ ID NO: 839631 - protein, 23 aa, Mycobacterium
MTYDNWDAVLKVHLYGGYNVIRA

SEQ ID NO: 839632 - protein, 23 aa, Mycobacterium
MTYKGMMLSGVPNMAFTFGYTNA

SEQ ID NO: 839633 - protein, 18 aa, Mycobacterium
MTYVICEVLAWRGIWLSE

SEQ ID NO: 839634 - protein, 25 aa, Mycobacterium
MVAAATPYLQWLISAAGQAEIAAAQ

SEQ ID NO: 839635 - protein, 19 aa, Mycobacterium
MVAACLKWEGGYVWACKNY

SEQ ID NO: 839636 - protein, 17 aa, Mycobacterium
MVAAMRWAGDFVTGLMA

SEQ ID NO: 839637 - protein, 40 aa, Mycobacterium
MVAATERGLLLTTLWYIREVDPAVLLLTGLTRDGVYLIED

SEQ ID NO: 839638 - protein, 17 aa, Mycobacterium
MVADFITTARAAGLTIP

SEQ ID NO: 839639 - protein, 26 aa, Mycobacterium
MVADGRVRPIIGARLPIQQAGDAHQR

SEQ ID NO: 839640 - protein, 18 aa, Mycobacterium
MVADLLAARLGAKFKVHK

SEQ ID NO: 839641 - protein, 27 aa, Mycobacterium
MVAEGRSRRFAYPPNLFVVDGGAPQVN

SEQ ID NO: 839642 - protein, 27 aa, Mycobacterium
MVAEISKLRLLPFRLSFDGDEISTQLT

SEQ ID NO: 839643 - protein, 20 aa, Mycobacterium
MVAFADFPDQWQKLQKDRSK

SEQ ID NO: 839644 - protein, 31 aa, Mycobacterium
MVAGALELRRLGLVRQPWLVVPNAITEQVGR

SEQ ID NO: 839645 - protein, 25 aa, Mycobacterium
MVAGELPLVGLGPDGGPGVAESWKA

SEQ ID NO: 839646 - protein, 18 aa, Mycobacterium
MVAHHIPALISLTGSVRA

SEQ ID NO: 839647 - protein, 23 aa, Mycobacterium
MVAKTLLAGVPLVAVPGGGDQWE

SEQ ID NO: 839648 - protein, 18 aa, Mycobacterium
MVAPPPAMAAGMPGMPFS

SEQ ID NO: 839649 - protein, 24 aa, Mycobacterium
MVAQPLDDPPWRNTVQRFFVEYAR

SEQ ID NO: 839650 - protein, 23 aa, Mycobacterium
MVAQWAMRFRTEAQERVSAAIRH

SEQ ID NO: 839651 - protein, 22 aa, Mycobacterium
MVARGCPFSGLLYAGLAITANG

SEQ ID NO: 839652 - protein, 24 aa, Mycobacterium
MVASVLPYVGWLEATAVQAGHSAM

SEQ ID NO: 839653 - protein, 18 aa, Mycobacterium
MVAVLFAMQSPPPVDLDF

SEQ ID NO: 839654 - protein, 39 aa, Mycobacterium
MVCADTWDLPYPRSVAAFPAPWLVTDKYWPPVRRIDGVH

SEQ ID NO: 839655 - protein, 19 aa, Mycobacterium
MVCVGAVGLRHFQPGRVGS

SEQ ID NO: 839656 - protein, 19 aa, Mycobacterium
MVDAGYQCALLAPTEVLAT

SEQ ID NO: 839657 - protein, 18 aa, Mycobacterium
MVDAIAWAGDFLTGVMGD

SEQ ID NO: 839658 - protein, 17 aa, Mycobacterium
MVDALITALHQRTGRTT

SEQ ID NO: 839659 - protein, 19 aa, Mycobacterium
MVDALYPGLHYANLAIRGK

SEQ ID NO: 839660 - protein, 22 aa, Mycobacterium
MVDDGFLNRLDLAFSRDQRQRI

SEQ ID NO: 839661 - protein, 25 aa, Mycobacterium
MVDEFNFFVVPKVVGGGLRALPDDV

SEQ ID NO: 839662 - protein, 29 aa, Mycobacterium
MVDEGWLPQSYLPDTYPYVASLSPGLNVY

SEQ ID NO: 839663 - protein, 25 aa, Mycobacterium
MVDELERRGLKRALITLCVGGGMGV

SEQ ID NO: 839664 - protein, 23 aa, Mycobacterium
MVDGTVFGYFLLGQNPAVGSAHG

SEQ ID NO: 839665 - protein, 19 aa, Mycobacterium
MVDLVLLGRYRLRTALPAR

SEQ ID NO: 839666 - protein, 18 aa, Mycobacterium
MVDPALPVLGMAGSAFFD

SEQ ID NO: 839667 - protein, 18 aa, Mycobacterium
MVDPALPVLGMTGSVFFE

SEQ ID NO: 839668 - protein, 21 aa, Mycobacterium
MVDQLWGACYHRLLVPDQPLT

SEQ ID NO: 839669 - protein, 26 aa, Mycobacterium
MVDTLREFLRRFDFLVTPVTTAQAFG

SEQ ID NO: 839670 - protein, 45 aa, Mycobacterium
MVEAMLHSDYPLQALLYAVVLHRYLGWRLSGYDPATHLGGVLYLF

SEQ ID NO: 839671 - protein, 42 aa, Mycobacterium
MVEAMLHSDYPLQALLYSVVLHRFLSWRLPGYRPEEHLGGAV

SEQ ID NO: 839672 - protein, 24 aa, Mycobacterium
MVEGMLALTGYFGWHKICVERGIL

SEQ ID NO: 839673 - protein, 19 aa, Mycobacterium
MVEGSLSRWLREAEPVRTR

SEQ ID NO: 839674 - protein, 27 aa, Mycobacterium
MVEHFELLLNNLLTDPAALLTNLPMVL

SEQ ID NO: 839675 - protein, 24 aa, Mycobacterium
MVEHPILIERPFVVTTKGTRLARP

SEQ ID NO: 839676 - protein, 25 aa, Mycobacterium
MVELGIPEHPMPVPAFALALMRRSL

SEQ ID NO: 839677 - protein, 17 aa, Mycobacterium
MVELPAQQVLSELASRG

SEQ ID NO: 839678 - protein, 18 aa, Mycobacterium
MVENGTNMWETHGVISAL

SEQ ID NO: 839679 - protein, 18 aa, Mycobacterium
MVEYVIMGQVLTAGAGQM

SEQ ID NO: 839680 - protein, 18 aa, Mycobacterium
MVFDSVHLQRYGFLGVEP

SEQ ID NO: 839681 - protein, 20 aa, Mycobacterium
MVFGEIGAGWRQVTSELGFE

SEQ ID NO: 839682 - protein, 23 aa, Mycobacterium
MVGAFLIPVLEGAPVDLCDVWDP

SEQ ID NO: 839683 - protein, 25 aa, Mycobacterium
MVGELMFEAPRRGMPPRHLADLDAA

SEQ ID NO: 839684 - protein, 17 aa, Mycobacterium
MVGFFAYDLVRRLERLP

SEQ ID NO: 839685 - protein, 18 aa, Mycobacterium
MVGKRLFDLFERSSSTLV

SEQ ID NO: 839686 - protein, 20 aa, Mycobacterium
MVGLFINTVPLRIRLDPAGS

SEQ ID NO: 839687 - protein, 18 aa, Mycobacterium
MVGLFINTVPLRVRLDPA

SEQ ID NO: 839688 - protein, 18 aa, Mycobacterium
MVGLFINTVPLRVRLDPQ

SEQ ID NO: 839689 - protein, 19 aa, Mycobacterium
MVGLLINTVPVRATIDAET

SEQ ID NO: 839690 - protein, 22 aa, Mycobacterium
MVGLLINTVPVRATLTAATTVA

SEQ ID NO: 839691 - protein, 20 aa, Mycobacterium
MVGLLINTVPVRATLTPTTT

SEQ ID NO: 839692 - protein, 18 aa, Mycobacterium
MVGLNRPVVSTPAAPFGG

SEQ ID NO: 839693 - protein, 21 aa, Mycobacterium
MVGNAWLWSSCGRCEYCRTGW

SEQ ID NO: 839694 - protein, 30 aa, Mycobacterium
MVGNNTPIFFIRDPLKFQHFIRSQKRRAAN

SEQ ID NO: 839695 - protein, 29 aa, Mycobacterium
MVGNNTPVFFIRDPMKFQNFIRSQKRMAA

SEQ ID NO: 839696 - protein, 20 aa, Mycobacterium
MVGNTPVLWISGSAGPVGSA

SEQ ID NO: 839697 - protein, 18 aa, Mycobacterium
MVGPILQRRAAAAGVIYA

SEQ ID NO: 839698 - protein, 23 aa, Mycobacterium
MVGQTPVLRIGAPFTAAEHGFWA

SEQ ID NO: 839699 - protein, 21 aa, Mycobacterium
MVGVMRPFLKAYFRSEVHGLG

SEQ ID NO: 839700 - protein, 21 aa, Mycobacterium
MVGYAAIVFASNDPIMRACNL

SEQ ID NO: 839701 - protein, 17 aa, Mycobacterium
MVGYGHHPYFFEVPDDE

SEQ ID NO: 839702 - protein, 24 aa, Mycobacterium
MVHGYVDFALVVPAAAEAAGRGLA

SEQ ID NO: 839703 - protein, 20 aa, Mycobacterium
MVHIPGITPRLLRTARQRLA

SEQ ID NO: 839704 - protein, 25 aa, Mycobacterium
MVHPLMITLISYAVGGPIRMVDARA

SEQ ID NO: 839705 - protein, 20 aa, Mycobacterium
MVIDLLLKRAASLGVQIRYE

SEQ ID NO: 839706 - protein, 18 aa, Mycobacterium
MVIGMYSEMVDAAWHAFI

SEQ ID NO: 839707 - protein, 18 aa, Mycobacterium
MVIQTALAVLLAKLSGSS

SEQ ID NO: 839708 - protein, 19 aa, Mycobacterium
MVKAMAQLYVHGHALDPRT

SEQ ID NO: 839709 - protein, 17 aa, Mycobacterium
MVLAATAEDRRIGYGGL

SEQ ID NO: 839710 - protein, 19 aa, Mycobacterium
MVLAMRHATLPATLHVDEP

SEQ ID NO: 839711 - protein, 18 aa, Mycobacterium
MVLAMSTGALRNLLLRYD

SEQ ID NO: 839712 - protein, 18 aa, Mycobacterium
MVLAPHRGAKTRAKAAHD

SEQ ID NO: 839713 - protein, 18 aa, Mycobacterium
MVLARIGLGPLRRARPDV

SEQ ID NO: 839714 - protein, 24 aa, Mycobacterium
MVLEQLEALGLPPLESLPADQARA

SEQ ID NO: 839715 - protein, 17 aa, Mycobacterium
MVLGLLLARAGIEVTVF

SEQ ID NO: 839716 - protein, 18 aa, Mycobacterium
MVLLPLVAAHVDVPIVAA

SEQ ID NO: 839717 - protein, 19 aa, Mycobacterium
MVLLSPWLDLGMTNPNIAF

SEQ ID NO: 839718 - protein, 17 aa, Mycobacterium
MVLNERTFRRLRPDLEN

SEQ ID NO: 839719 - protein, 22 aa, Mycobacterium
MVLNYYGPLRLIRGLAPGMLER

SEQ ID NO: 839720 - protein, 19 aa, Mycobacterium
MVLPEPPAHRMERSDLTAA

SEQ ID NO: 839721 - protein, 22 aa, Mycobacterium
MVLPFISIRQWQPISESETEVC

SEQ ID NO: 839722 - protein, 18 aa, Mycobacterium
MVLYLFGSKAELFRESMR

SEQ ID NO: 839723 - protein, 17 aa, Mycobacterium
MVMRLLAFGLRAHRLSD

SEQ ID NO: 839724 - protein, 25 aa, Mycobacterium
MVNAARHAHWLNPEPKHLWGSGDSA

SEQ ID NO: 839725 - protein, 30 aa, Mycobacterium
MVNHFFVCSTHDWILFFTTQGRVYRAKAYE

SEQ ID NO: 839726 - protein, 25 aa, Mycobacterium
MVNQAVPMWPEMPMMTSMSAWQEED

SEQ ID NO: 839727 - protein, 30 aa, Mycobacterium; identical to SEQ ID NO: 129502

SEQ ID NO: 839728 - protein, 31 aa, Mycobacterium
MVPADRVLAALHGWLAPLPPEGASAIVFRDV

SEQ ID NO: 839729 - protein, 19 aa, Mycobacterium
MVPAMWSALTQVPDFDSYD

SEQ ID NO: 839730 - protein, 33 aa, Mycobacterium
MVPAPMYHTNGFATFFFLLAGDHLVILEKFDAA

SEQ ID NO: 839731 - protein, 33 aa, Mycobacterium
MVPAPMYHTNGFATFLMLLAGDHLVILEKFDAA

SEQ ID NO: 839732 - protein, 30 aa, Mycobacterium
MVPAPMYHTNGFATFLMLLGGDHLVVLERF

SEQ ID NO: 839733 - protein, 26 aa, Mycobacterium
MVPARLRPIGMVFQHYALFPNMTVAE

SEQ ID NO: 839734 - protein, 18 aa, Mycobacterium
MVPEAIIAMLACARLGAM

SEQ ID NO: 839735 - protein, 17 aa, Mycobacterium
MVPHLPGEPIGPKALGE

SEQ ID NO: 839736 - protein, 18 aa, Mycobacterium
MVPPSFGPLLGEQRSDLI

SEQ ID NO: 839737 - protein, 24 aa, Mycobacterium
MVPQLPDILGTPDKKIRLAPQYLL

SEQ ID NO: 839738 - protein, 24 aa, Mycobacterium
MVPQLPHILGTPDKKIRLAPQYLL

SEQ ID NO: 839739 - protein, 17 aa, Mycobacterium
MVPTAIVVLEALPLTVN

SEQ ID NO: 839740 - protein, 24 aa, Mycobacterium
MVPTALIPRGSGPVAALPAGPAPV

SEQ ID NO: 839741 - protein, 28 aa, Mycobacterium
MVPTRTVFFERFPLTANGKLDRRAVTAL

SEQ ID NO: 839742 - protein, 17 aa, Mycobacterium
MVQAINRALRDAMAADE

SEQ ID NO: 839743 - protein, 17 aa, Mycobacterium
MVQALNRALHDAMTVDE

SEQ ID NO: 839744 - protein, 24 aa, Mycobacterium
MVQPGLLNWRGVARVMSENPARIV

SEQ ID NO: 839745 - protein, 17 aa, Mycobacterium
MVQRGLLNRYSQFALAG

SEQ ID NO: 839746 - protein, 19 aa, Mycobacterium
MVQRLIQTGRPRPANLRTV

SEQ ID NO: 839747 - protein, 21 aa, Mycobacterium
MVQRPFVLIGQQYLADPSRSA

SEQ ID NO: 839748 - protein, 17 aa, Mycobacterium
MVRALLHGAYRYRWHHA

SEQ ID NO: 839749 - protein, 27 aa, Mycobacterium
MVRDDDLWVIPLRGPRSGGLLLKQRNP

SEQ ID NO: 839750 - protein, 26 aa, Mycobacterium
MVRDLEFIYCPWHQWGFELATGTTAV

SEQ ID NO: 839751 - protein, 26 aa, Mycobacterium
MVRDMEYIYCPWHQWGFELATGTTAV

SEQ ID NO: 839752 - protein, 26 aa, Mycobacterium
MVRDQEYIFCPWHQWGFELATGTTAV

SEQ ID NO: 839753 - protein, 18 aa, Mycobacterium
MVRHHLLLPITATRSDLN

SEQ ID NO: 839754 - protein, 29 aa, Mycobacterium
MVRISIEPLWARFYDFGAGRLPAFLVNLV

SEQ ID NO: 839755 - protein, 17 aa, Mycobacterium
MVRLLVYYAADQLDRNH

SEQ ID NO: 839756 - protein, 22 aa, Mycobacterium
MVRLMHSMVRYNALKRSDKWDT

SEQ ID NO: 839757 - protein, 25 aa, Mycobacterium
MVRPGLLTWRDIARVMSERPAQIVG

SEQ ID NO: 839758 - protein, 18 aa, Mycobacterium
MVRQRPALAAWFASTRPP

SEQ ID NO: 839759 - protein, 26 aa, Mycobacterium
MVRRHRLLETFLVNELGYAWDEVHDE

SEQ ID NO: 839760 - protein, 26 aa, Mycobacterium
MVRRHRLLETYLVNELGYGWDEVHDE

SEQ ID NO: 839761 - protein, 24 aa, Mycobacterium
MVRRLATMEIPLDALNRAAKGIGV

SEQ ID NO: 839762 - protein, 20 aa, Mycobacterium
MVRRNLHRTATDQRFLLGAN

SEQ ID NO: 839763 - protein, 22 aa, Mycobacterium
MVRSLVTAYAPPDVRDYVLGKL

SEQ ID NO: 839764 - protein, 27 aa, Mycobacterium
MVRTPMVNHWWQVTLYVSPRGLTTGAI

SEQ ID NO: 839765 - protein, 25 aa, Mycobacterium
MVRVRVMPTWLRLDARFGSVYRRRG

SEQ ID NO: 839766 - protein, 30 aa, Mycobacterium
MVRVVADAGVPWILMHWRSVDGDNPHEVPA

SEQ ID NO: 839767 - protein, 19 aa, Mycobacterium
MVSLAELWKSVGVSPDAVI

SEQ ID NO: 839768 - protein, 19 aa, Mycobacterium
MVSLDYFGLSLEKWSDYAT

SEQ ID NO: 839769 - protein, 25 aa, Mycobacterium
MVSPMAPLGPLLPAAADIGLHVIVT

SEQ ID NO: 839770 - protein, 25 aa, Mycobacterium
MVTASRHAHWLNPEPRHLWGSGDSA

SEQ ID NO: 839771 - protein, 23 aa, Mycobacterium
MVTAYACNGVDDEAWFFGNQADG

SEQ ID NO: 839772 - protein, 21 aa, Mycobacterium
MVTFAKFPDQWQKLLDDRSKV

SEQ ID NO: 839773 - protein, 27 aa, Mycobacterium
MVTGDPHLRFYAGMPIRTAEGHALGTI

SEQ ID NO: 839774 - protein, 19 aa, Mycobacterium
MVTILPLHNPIIAAKQIAT

SEQ ID NO: 839775 - protein, 17 aa, Mycobacterium
MVTPLPFNMRMAVRDTE

SEQ ID NO: 839776 - protein, 25 aa, Mycobacterium
MVTVLYEPYPIWGVPEYVPAQVASI

SEQ ID NO: 839777 - protein, 17 aa, Mycobacterium
MVVALTKRHFRDLVEVT

SEQ ID NO: 839778 - protein, 20 aa, Mycobacterium
MVVASQRYLLRLPDLAGASD

SEQ ID NO: 839779 - protein, 20 aa, Mycobacterium
MVVDRWILLDHITRGRVIFG

SEQ ID NO: 839780 - protein, 17 aa, Mycobacterium
MVVGLLAILKAGAAYVP

SEQ ID NO: 839781 - protein, 17 aa, Mycobacterium
MVVGTVNDGWRLARTTL

SEQ ID NO: 839782 - protein, 18 aa, Mycobacterium
MVVNPILPSLRDHDLRFI

SEQ ID NO: 839783 - protein, 18 aa, Mycobacterium
MVVQAVLAVLLAKLSASS

SEQ ID NO: 839784 - protein, 17 aa, Mycobacterium
MVVRLLAFGLRAHRLDD

SEQ ID NO: 839785 - protein, 18 aa, Mycobacterium
MVVSANPYYHYLLSDIYS

SEQ ID NO: 839786 - protein, 25 aa, Mycobacterium
MVVSQKFWPRRIAEGLNRMLGGDHV

SEQ ID NO: 839787 - protein, 27 aa, Mycobacterium
MVVVGPLLNLALRRYLRNLRSYTDSLA

SEQ ID NO: 839788 - protein, 19 aa, Mycobacterium
MVWTVTKLQPMRTFTWVAT

SEQ ID NO: 839789 - protein, 17 aa, Mycobacterium
MVYDALDMTYRTIKIRK

SEQ ID NO: 839790 - protein, 30 aa, Mycobacterium
MVYQYRHAFGRRLWELPAGLLDVADEPPQQ

SEQ ID NO: 839791 - protein, 27 aa, Mycobacterium
MWAAKRSGLYYTLLNTHLSPSEIAYIV

SEQ ID NO: 839792 - protein, 25 aa, Mycobacterium
MWAARRAGLYYVPINTHLTAAEVAY

SEQ ID NO: 839793 - protein, 25 aa, Mycobacterium
MWAARRSGLYYALINTHLTAAEAAY

SEQ ID NO: 839794 - protein, 26 aa, Mycobacterium
MWAARRSGLYYVPINTHLAPAEAAYI

SEQ ID NO: 839795 - protein, 19 aa, Mycobacterium
MWAQDVAAMFGYHSGASSA

SEQ ID NO: 839796 - protein, 19 aa, Mycobacterium
MWAQDVVAMLGYHADTSAA

SEQ ID NO: 839797 - protein, 19 aa, Mycobacterium
MWAQQLPFGMAGTGLLAVA

SEQ ID NO: 839798 - protein, 17 aa, Mycobacterium
MWARPRGVAPDALFALM

SEQ ID NO: 839799 - protein, 21 aa, Mycobacterium
MWATAIQHRLGGSGGLAGHPI

SEQ ID NO: 839800 - protein, 29 aa, Mycobacterium
MWAVSVDRQIRWFGLDGVENTSSTGVLVD

SEQ ID NO: 839801 - protein, 20 aa, Mycobacterium
MWDLSMLNIVPGIRVAAPRD

SEQ ID NO: 839802 - protein, 18 aa, Mycobacterium
MWDPLLSLMMAAQATTKL

SEQ ID NO: 839803 - protein, 19 aa, Mycobacterium
MWGEWPLEASPLRQAPHTA

SEQ ID NO: 839804 - protein, 19 aa, Mycobacterium
MWHDPKHEPAFSEYLELDL

SEQ ID NO: 839805 - protein, 17 aa, Mycobacterium
MWKPSPGSVYPTLQLLV

SEQ ID NO: 839806 - protein, 18 aa, Mycobacterium
MWLDALRRDSDVTVPTVI

SEQ ID NO: 839807 - protein, 19 aa, Mycobacterium
MWPDLFIAGGGISRKADKW

SEQ ID NO: 839808 - protein, 19 aa, Mycobacterium
MWRASPQFESWQAVMAQVY

SEQ ID NO: 839809 - protein, 29 aa, Mycobacterium
MWRWSVESVPQFWRALWEFFEVPGRGLRD

SEQ ID NO: 839810 - protein, 18 aa, Mycobacterium
MWSMFANPALLAGAPEIE

SEQ ID NO: 839811 - protein, 24 aa, Mycobacterium
MWTSLIEYADYIWLAVRTNTEVKK

SEQ ID NO: 839812 - protein, 35 aa, Mycobacterium
MYADLFDEWKLPVPALFGQMVLPPAASTLLGELAE

SEQ ID NO: 839813 - protein, 33 aa, Mycobacterium
MYARRLGPKRARLLNPLALLASQGVPLAFGSDA

SEQ ID NO: 839814 - protein, 17 aa, Mycobacterium
MYASYHGAPGLTAIARR

SEQ ID NO: 839815 - protein, 24 aa, Mycobacterium
MYDQWRPRPWPDLTRRRLFVRPDA

SEQ ID NO: 839816 - protein, 24 aa, Mycobacterium
MYESEIYRRLSLSVLVRLPAGIDR

SEQ ID NO: 839817 - protein, 17 aa, Mycobacterium
MYGFIPVDRAPGLWGGY

SEQ ID NO: 839818 - protein, 22 aa, Mycobacterium
MYGSTMFLVQVIDAYHSDPVLW

SEQ ID NO: 839819 - protein, 18 aa, Mycobacterium
MYGVFRPDLKMEGKTPTR

SEQ ID NO: 839820 - protein, 20 aa, Mycobacterium
MYGVLHHIATQNLPIRAGWV

SEQ ID NO: 839821 - protein, 20 aa, Mycobacterium
MYHTTAFPGSFVPRTASERG

SEQ ID NO: 839822 - protein, 24 aa, Mycobacterium
MYMVSHFHYDPVWWNTQAGYTSQW

SEQ ID NO: 839823 - protein, 25 aa, Mycobacterium
MYNDLPEYKYFWSTEGMLGWKRSFQ

SEQ ID NO: 839824 - protein, 24 aa, Mycobacterium
MYNRVKWTLQKYDPPTGLFLDGQG

SEQ ID NO: 839825 - protein, 25 aa, Mycobacterium
MYPASMMMSPMMQLLNSANSAGLAG

SEQ ID NO: 839826 - protein, 23 aa, Mycobacterium
MYPDFDRRDLWAACLEYAQRDRR

SEQ ID NO: 839827 - protein, 17 aa, Mycobacterium
MYPGHPNLLPAYLDDPH

SEQ ID NO: 839828 - protein, 18 aa, Mycobacterium
MYQQDRGLAPWDGGWHLT

SEQ ID NO: 839829 - protein, 20 aa, Mycobacterium
MYRLVETFGYGWSDIQRFTI

SEQ ID NO: 839830 - protein, 27 aa, Mycobacterium
MYRTERFHVSVLFWLSATVSIHEHGFE

SEQ ID NO: 839831 - protein, 25 aa, Mycobacterium
MYRTGDLACWGADGQLRYLGRADEQ

SEQ ID NO: 839832 - protein, 26 aa, Mycobacterium
MYTDGACQLAFWRDDGYLVCEARDTG

SEQ ID NO: 839833 - protein, 26 aa, Mycobacterium
MYTEAMVARLWTMSFITGDPTPVINV

SEQ ID NO: 839834 - protein, 23 aa, Mycobacterium
MYTLGFRFSPWNDSRTLADGPSI

SEQ ID NO: 839835 - protein, 19 aa, Mycobacterium
MYTVKGIKLAINYGLNKVR

SEQ ID NO: 839836 - protein, 25 aa, Mycobacterium
MYVGSLMILGRPRAGLSYETLLATV

SEQ ID NO: 839837 - protein, 22 aa, Mycobacterium
MYVGSLQILRRPRSGLSYETLL

SEQ ID NO: 839838 - protein, 26 aa, Mycobacterium
MYVVGPLLNLGLRRFLRNLRSYTDAR

SEQ ID NO: 839839 - protein, 18 aa, Mycobacterium
NAAAADVIRLAPPLVITD

SEQ ID NO: 839840 - protein, 24 aa, Mycobacterium
NAAAELLKPVVRPTPVVASRILSD

SEQ ID NO: 839841 - protein, 28 aa, Mycobacterium
NAAAHPTVTLLWPPREPGGYTLIVDGGA

SEQ ID NO: 839842 - protein, 23 aa, Mycobacterium
NAAAPDVIRLAPPLIITEAQLDG

SEQ ID NO: 839843 - protein, 18 aa, Mycobacterium
NAAAPEVVRLAPPLIITE

SEQ ID NO: 839844 - protein, 27 aa, Mycobacterium
NAADLDDYLVLQRDWGVDGGLRSVDPT

SEQ ID NO: 839845 - protein, 26 aa, Mycobacterium
NAAERPHYMPLFVAPQPLDSDDDSDT

SEQ ID NO: 839846 - protein, 25 aa, Mycobacterium
NAAFHDYLFTLTGNEHLLQAYQALD

SEQ ID NO: 839847 - protein, 17 aa, Mycobacterium
NAAFLPSKDLTEGISAI

SEQ ID NO: 839848 - protein, 31 aa, Mycobacterium
NAAGDVPTLFAWRILDYWNWTNRPDRNHYEF

SEQ ID NO: 839849 - protein, 25 aa, Mycobacterium
NAAGLTYPAQFWPLTLNLGNLTINE

SEQ ID NO: 839850 - protein, 22 aa, Mycobacterium
NAAGTLHHQGRKYSFCSAGCIA

SEQ ID NO: 839851 - protein, 23 aa, Mycobacterium
NAAHAFLRLGIAPGDRVLLQLPN

SEQ ID NO: 839852 - protein, 28 aa, Mycobacterium
NAAHGRTFFLATRLLAPDQRPAVHALYG

SEQ ID NO: 839853 - protein, 17 aa, Mycobacterium
NAAIFEYIDWMSQQVVA

SEQ ID NO: 839854 - protein, 25 aa, Mycobacterium
NAALAPLITAVVPPAADPVSLEAAI

SEQ ID NO: 839855 - protein, 20 aa, Mycobacterium
NAALLEHKVIFFRGQHDLDD

SEQ ID NO: 839856 - protein, 26 aa, Mycobacterium
NAALTAKLRAHWARRLPPTIVGRTGE

SEQ ID NO: 839857 - protein, 20 aa, Mycobacterium
NAAPVFEPPGADLSGEELSV

SEQ ID NO: 839858 - protein, 26 aa, Mycobacterium
NAAQGTRLVPIPGAPPSLAGLDPGCP

SEQ ID NO: 839859 - protein, 32 aa, Mycobacterium
NAAQSILLDPLNGISQVLTGRPLIGNGVNGAP

SEQ ID NO: 839860 - protein, 22 aa, Mycobacterium
NAARDLFPVFPPGKERVRDKAM

SEQ ID NO: 839861 - protein, 20 aa, Mycobacterium
NAARWAVPEAASRGIPLRLV

SEQ ID NO: 839862 - protein, 33 aa, Mycobacterium
NAATHRFLAHLPGYQGWQWAAVVASYVGADRVT

SEQ ID NO: 839863 - protein, 26 aa, Mycobacterium
NAATHRFLAHLPGYQGWQWAVVVAAH

SEQ ID NO: 839864 - protein, 23 aa, Mycobacterium
NAATIAAILDLTPAAYRAAYERA

SEQ ID NO: 839865 - protein, 27 aa, Mycobacterium
NAATSGLRLTPPGWRRLATQLRRPAHE

SEQ ID NO: 839866 - protein, 24 aa, Mycobacterium
NAAVTMRIPAYLRYALQDTETDTE

SEQ ID NO: 839867 - protein, 28 aa, Mycobacterium
NAAYLRWWACLERVVLEAGLRGVLIAHH

SEQ ID NO: 839868 - protein, 26 aa, Mycobacterium
NAAYTGIDPYFDDLFLMAAEKRFLSV

SEQ ID NO: 839869 - protein, 21 aa, Mycobacterium
NACCSVFLPTEIFDFDIRPGG

SEQ ID NO: 839870 - protein, 31 aa, Mycobacterium
NACVRMGLLGKFGLTWPWESLHVEALAWYDH

SEQ ID NO: 839871 - protein, 21 aa, Mycobacterium
NADAPGPLLRREFRPSRAVME

SEQ ID NO: 839872 - protein, 26 aa, Mycobacterium
NADAWRPVFTGLAELGLFGVAVPEDH

SEQ ID NO: 839873 - protein, 24 aa, Mycobacterium
NADFVYLQAWIDGASTYRIAGDRG

SEQ ID NO: 839874 - protein, 29 aa, Mycobacterium
NADGRVIGVLTLLWPTPRQFDASELEMFT

SEQ ID NO: 839875 - protein, 23 aa, Mycobacterium
NADIPVYSTLSPLGRAITGARLG

SEQ ID NO: 839876 - protein, 22 aa, Mycobacterium
NADLLVPDFFDPDTDQWHIAIQ

SEQ ID NO: 839877 - protein, 37 aa, Mycobacterium
NADLVVLGPGSWFTSVIPHVLVPQLAAALQATTARRA

SEQ ID NO: 839878 - protein, 28 aa, Mycobacterium
NADPVNPMRIFWELTKRMPPNAIITADS

SEQ ID NO: 839879 - protein, 46 aa, Mycobacterium
NADQLLIVVALADPPPRTGFVERALIAAYAGGLKPVLCLTKSDLAA

SEQ ID NO: 839880 - protein, 26 aa, Mycobacterium
NADQLLIVVALADPPPRTGLVDRTLI

SEQ ID NO: 839881 - protein, 45 aa, Mycobacterium
NADQLLIVVALADPPPRTGLVERALIAAYAGGLVPILCLTKTDLA

SEQ ID NO: 839882 - protein, 25 aa, Mycobacterium
NADRQIGLLLPCNVAVRADTSGDGD

SEQ ID NO: 839883 - protein, 25 aa, Mycobacterium
NADRVVHLYNYLLAGAYTALRDDGE

SEQ ID NO: 839884 - protein, 24 aa, Mycobacterium
NADTWADPWDMYTALRDHDPVHHV

SEQ ID NO: 839885 - protein, 23 aa, Mycobacterium
NADVMLRYNFPGAGLTDDALRTL

SEQ ID NO: 839886 - protein, 19 aa, Mycobacterium
NADVTGHRLLRGALRPGAV

SEQ ID NO: 839887 - protein, 32 aa, Mycobacterium
NADWVVMSGSLPPGIPASWYADITARLSGQGC

SEQ ID NO: 839888 - protein, 23 aa, Mycobacterium
NAEAQRLPLPRNLFVVGTVNVDE

SEQ ID NO: 839889 - protein, 22 aa, Mycobacterium
NAEAVVLAPVTDGRWSCVHWGD

SEQ ID NO: 839890 - protein, 29 aa, Mycobacterium
NAECRSYEMPLILNVPTFTICAATILDMG

SEQ ID NO: 839891 - protein, 29 aa, Mycobacterium
NAEEGRLFTRFLPLLPTNEPMIEKLFADA

SEQ ID NO: 839892 - protein, 25 aa, Mycobacterium
NAEEGVRWLYSFLSADKRKTYCLYE

SEQ ID NO: 839893 - protein, 18 aa, Mycobacterium
NAEELKAVRPSSGPSALN

SEQ ID NO: 839894 - protein, 25 aa, Mycobacterium
NAEGRSMLYLEIRCILVAKGAGVQG

SEQ ID NO: 839895 - protein, 20 aa, Mycobacterium
NAELDLPYGSALTSSGRISA

SEQ ID NO: 839896 - protein, 27 aa, Mycobacterium
NAELELERNFLLRQLLSEGSRDPQLHR

SEQ ID NO: 839897 - protein, 28 aa, Mycobacterium
NAELTALNLLFAAKLLRANPYTINIAEH

SEQ ID NO: 839898 - protein, 20 aa, Mycobacterium
NAERLQWLRSAGAQTVIRLG

SEQ ID NO: 839899 - protein, 24 aa, Mycobacterium
NAEVELAWQILDPVLDNWAADGKP

SEQ ID NO: 839900 - protein, 17 aa, Mycobacterium
NAEWRMLQVLTVEGDRV

SEQ ID NO: 839901 - protein, 17 aa, Mycobacterium
NAFARWGRHLLANRDRK

SEQ ID NO: 839902 - protein, 25 aa, Mycobacterium
NAFDEGWVVPLPPTKLTGKTVAVVG

SEQ ID NO: 839903 - protein, 23 aa, Mycobacterium
NAFHAWVQRFYGAESLFDLADLP

SEQ ID NO: 839904 - protein, 18 aa, Mycobacterium
NAFHSWVQKFYGAECLFD

SEQ ID NO: 839905 - protein, 26 aa, Mycobacterium
NAFHSWVQRFYGAELLFDLGDLPGAA

SEQ ID NO: 839906 - protein, 27 aa, Mycobacterium
NAFHTWVQQFYGAELLFDLGDLPGAAD

SEQ ID NO: 839907 - protein, 23 aa, Mycobacterium
NAFLDALAWRLRGQGIFAVSVNF

SEQ ID NO: 839908 - protein, 17 aa, Mycobacterium
NAFLLKPSERDPSVPVR

SEQ ID NO: 839909 - protein, 34 aa, Mycobacterium
NAFRVVVAIFVADFLPRVWAGCDALGLGRPGWSA

SEQ ID NO: 839910 - protein, 19 aa, Mycobacterium
NAGALIKFEKGRSWPRRST

SEQ ID NO: 839911 - protein, 30 aa, Mycobacterium
NAGAPAFPPTAKPMFLVPAIPSAEGGHSDV

SEQ ID NO: 839912 - protein, 24 aa, Mycobacterium
NAGCVWINDHIPIISEMPHGGVGA

SEQ ID NO: 839913 - protein, 23 aa, Mycobacterium
NAGDACVLWCTAIRHTVLTGEID

SEQ ID NO: 839914 - protein, 23 aa, Mycobacterium
NAGERLWRPEPCWDPTAADWWSY

SEQ ID NO: 839915 - protein, 20 aa, Mycobacterium
NAGFLNYGNYNSGFRNTVYP

SEQ ID NO: 839916 - protein, 17 aa, Mycobacterium
NAGFPWLSHELLAARRS

SEQ ID NO: 839917 - protein, 23 aa, Mycobacterium
NAGGLFLAWVDRVVAPGNPAAAD

SEQ ID NO: 839918 - protein, 22 aa, Mycobacterium
NAGGLFLSWVDRLIGPADRDGE

SEQ ID NO: 839919 - protein, 23 aa, Mycobacterium
NAGGLGFIAAGYLTADALAERIK

SEQ ID NO: 839920 - protein, 29 aa, Mycobacterium
NAGGMALPDGYLRQIYAAIRAGGGLAISD

SEQ ID NO: 839921 - protein, 25 aa, Mycobacterium
NAGHQGLCYFAYLAGYRLVHEAAQD

SEQ ID NO: 839922 - protein, 24 aa, Mycobacterium
NAGHQGLCYFGYLAGYRLVHEAAQ

SEQ ID NO: 839923 - protein, 25 aa, Mycobacterium
NAGHQGLCYFGYLAGYRLVHEAAQD

SEQ ID NO: 839924 - protein, 26 aa, Mycobacterium
NAGIEQFGYLWDTPVANWQRVMDVNV

SEQ ID NO: 839925 - protein, 26 aa, Mycobacterium
NAGISSPLRRLLDDDLADFHRVMGVN

SEQ ID NO: 839926 - protein, 23 aa, Mycobacterium
NAGKLAIVGLTYHLADGKVDLRD

SEQ ID NO: 839927 - protein, 25 aa, Mycobacterium
NAGKLIVVVLPDFGERYLSTVLFAD

SEQ ID NO: 839928 - protein, 25 aa, Mycobacterium
NAGKLVVVVLPDFGERYLSTALFAD

SEQ ID NO: 839929 - protein, 25 aa, Mycobacterium
NAGKLVVVVLPSFGERYLSTPLFAD

SEQ ID NO: 839930 - protein, 17 aa, Mycobacterium
NAGLIFRHIGNKEALVA

SEQ ID NO: 839931 - protein, 20 aa, Mycobacterium
NAGLLAARILGVADTALRDK

SEQ ID NO: 839932 - protein, 20 aa, Mycobacterium
NAGLLFISYQKDPQDFIRLQ

SEQ ID NO: 839933 - protein, 22 aa, Mycobacterium
NAGLLFISYQNDPQDFIRLQNR

SEQ ID NO: 839934 - protein, 18 aa, Mycobacterium
NAGLLGCGGAGGAGGLGI

SEQ ID NO: 839935 - protein, 25 aa, Mycobacterium
NAGLSADAFLIRMTEERFEKVIDAN

SEQ ID NO: 839936 - protein, 23 aa, Mycobacterium
NAGLTFVHVPYPAPSDWTRRTLT

SEQ ID NO: 839937 - protein, 18 aa, Mycobacterium
NAGLVGNGGNGGAGADSE

SEQ ID NO: 839938 - protein, 45 aa, Mycobacterium
NAGPSLTRSLSFFTVFPWVKEPLTNWLRGDYANLTLIVDLTLSRI

SEQ ID NO: 839939 - protein, 20 aa, Mycobacterium
NAGQFGEPGTGGSGGNGGKG

SEQ ID NO: 839940 - protein, 24 aa, Mycobacterium
NAGQPIFWVVRALELLEDFEQFGY

SEQ ID NO: 839941 - protein, 23 aa, Mycobacterium
NAGSRFLLDQPITSAGRHPDSDI

SEQ ID NO: 839942 - protein, 26 aa, Mycobacterium
NAGVEQFGYLWDTPVANWNRIMDINV

SEQ ID NO: 839943 - protein, 19 aa, Mycobacterium
NAGVFPDAPLATMTPEQLN

SEQ ID NO: 839944 - protein, 33 aa, Mycobacterium
NAGVLLITHYTRILRYIQPQFVHVFYDGRIIES

SEQ ID NO: 839945 - protein, 25 aa, Mycobacterium
NAGVLWLGPIENTPLKRWQLCLDVN

SEQ ID NO: 839946 - protein, 26 aa, Mycobacterium
NAGVLWLGPIESTPLKRWQLCLDVNT

SEQ ID NO: 839947 - protein, 25 aa, Mycobacterium
NAGVYAFDIAALRSALNRLSSNNAQ

SEQ ID NO: 839948 - protein, 24 aa, Mycobacterium
NAGVYAFDVAALRSALSRLSSNNA

SEQ ID NO: 839949 - protein, 25 aa, Mycobacterium
NAGVYAFEITALQSALSRLSSDNAQ

SEQ ID NO: 839950 - protein, 23 aa, Mycobacterium
NAGVYDGLAWSDLAPRQWQSIYE

SEQ ID NO: 839951 - protein, 22 aa, Mycobacterium
NAHALFARPMVTSPDAAIAIEI

SEQ ID NO: 839952 - protein, 22 aa, Mycobacterium
NAHILPVPMMNIINGGAHADTG

SEQ ID NO: 839953 - protein, 22 aa, Mycobacterium
NAHILPVPMMNILNGGAHADTA

SEQ ID NO: 839954 - protein, 22 aa, Mycobacterium
NAHILPVPMMNILNGGAHADTG

SEQ ID NO: 839955 - protein, 23 aa, Mycobacterium
NAHILPVPMMNILNGGAHADTGV

SEQ ID NO: 839956 - protein, 22 aa, Mycobacterium
NAHIMPVPMMNILNGGAHADTS

SEQ ID NO: 839957 - protein, 26 aa, Mycobacterium
NAHSHAFHRALRGRTHRGGGSFWTWR

SEQ ID NO: 839958 - protein, 25 aa, Mycobacterium
NAHTWDTVILGLGAPALALDLPGHG

SEQ ID NO: 839959 - protein, 26 aa, Mycobacterium
NAHYLAYFDVALTEYWEALTGARNAD

SEQ ID NO: 839960 - protein, 23 aa, Mycobacterium
NAIAPDITLTEGLELLAGGAEMA

SEQ ID NO: 839961 - protein, 29 aa, Mycobacterium
NAIAPVARTRLTLATPGMGAIFAAPVEEG

SEQ ID NO: 839962 - protein, 20 aa, Mycobacterium
NAIGIFHAFIDDPGVRLIGF

SEQ ID NO: 839963 - protein, 18 aa, Mycobacterium
NAIGVPLGPMHRCRALGA

SEQ ID NO: 839964 - protein, 17 aa, Mycobacterium
NAIIATFERHADLTGPV

SEQ ID NO: 839965 - protein, 17 aa, Mycobacterium
NAILGQRLLYTVPDARG

SEQ ID NO: 839966 - protein, 20 aa, Mycobacterium
NAILPIIESPVADSLPVVNS

SEQ ID NO: 839967 - protein, 25 aa, Mycobacterium
NAINAPTQAFLGRPLIGNGANGGPG

SEQ ID NO: 839968 - protein, 17 aa, Mycobacterium
NAINAPVQNLTGRPLIG

SEQ ID NO: 839969 - protein, 19 aa, Mycobacterium
NAISLFTPAESYWITGIKT

SEQ ID NO: 839970 - protein, 23 aa, Mycobacterium
NAITALVPGLTWSMDMDTWTGCG

SEQ ID NO: 839971 - protein, 21 aa, Mycobacterium
NAIVAAFDFDRARPVLETFGY

SEQ ID NO: 839972 - protein, 18 aa, Mycobacterium
NAIVKGLRTGTDFEYELQ

SEQ ID NO: 839973 - protein, 20 aa, Mycobacterium
NAIVKGLRTGTDFEYELQMA

SEQ ID NO: 839974 - protein, 27 aa, Mycobacterium
NAIVRKPVPPLSWWRGIRARKTLEDYF

SEQ ID NO: 839975 - protein, 22 aa, Mycobacterium
NAIYPALALVPADDIRIVDVWQ

SEQ ID NO: 839976 - protein, 22 aa, Mycobacterium
NAKFFTDVLPGRAQPLGSPGGA

SEQ ID NO: 839977 - protein, 29 aa, Mycobacterium
NAKRWGVLHVIWRQKIYPGIGAPSWTADY

SEQ ID NO: 839978 - protein, 17 aa, Mycobacterium
NAKTIFWNGPMGVFEFP

SEQ ID NO: 839979 - protein, 18 aa, Mycobacterium
NALALPSTSEILAAGTDE

SEQ ID NO: 839980 - protein, 27 aa, Mycobacterium
NALALQFGWRLFAPILRTATGLDELTD

SEQ ID NO: 839981 - protein, 20 aa, Mycobacterium
NALFHQLLVTASHNRTLGEI

SEQ ID NO: 839982 - protein, 24 aa, Mycobacterium
NALIAERYVGIRPAPGYPSCPEHT

SEQ ID NO: 839983 - protein, 18 aa, Mycobacterium
NALKAVPAERLWVNPDCG

SEQ ID NO: 839984 - protein, 19 aa, Mycobacterium
NALLKSILSTPGEGAVLVV

SEQ ID NO: 839985 - protein, 26 aa, Mycobacterium
NALLRGVPIGPFGRRTAAAGYSHKYG

SEQ ID NO: 839986 - protein, 24 aa, Mycobacterium
NALNAIAGRVAFALGLEGPAVAVD

SEQ ID NO: 839987 - protein, 25 aa, Mycobacterium
NALNMPAEGLLGRPLIGDGADGAPG

SEQ ID NO: 839988 - protein, 18 aa, Mycobacterium
NALPKRVFDEWLAVIAER

SEQ ID NO: 839989 - protein, 24 aa, Mycobacterium
NALPRRGFAALRRPVRRPLDEGVI

SEQ ID NO: 839990 - protein, 23 aa, Mycobacterium
NALQERWGGQLYWYDGSHVGHIF

SEQ ID NO: 839991 - protein, 33 aa, Mycobacterium
NALRAQAHAGILPPLFSGLIRMPAKRARAAATL

SEQ ID NO: 839992 - protein, 21 aa, Mycobacterium
NALRPGDLAVWDGHVAMIVGP

SEQ ID NO: 839993 - protein, 19 aa, Mycobacterium
NALRQFGLQPHVVEMMPRL

SEQ ID NO: 839994 - protein, 17 aa, Mycobacterium
NALRQFGLQTHVIEMMP

SEQ ID NO: 839995 - protein, 30 aa, Mycobacterium
NALRSIGVTRGLGLTALSTGTASSAGPTIS

SEQ ID NO: 839996 - protein, 25 aa, Mycobacterium
NALSPSKPILTPGLAYYAREFDETA

SEQ ID NO: 839997 - protein, 24 aa, Mycobacterium
NALSPSKPILTPGLSYYARNFDDT

SEQ ID NO: 839998 - protein, 21 aa, Mycobacterium
NALTEVERLLPRVLADVQRVA

SEQ ID NO: 839999 - protein, 24 aa, Mycobacterium
NALTKLFVAGLFATANAALGGVET

SEQ ID NO: 840000 - protein, 24 aa, Mycobacterium
NALTPAMYFGIRYAVGRVNEDPDL

SEQ ID NO: 840001 - protein, 28 aa, Mycobacterium
NALYTPQHWKYLTSGLLGLQHGTDAGDL

SEQ ID NO: 840002 - protein, 17 aa, Mycobacterium
NAMALTVAGLWEPARAA

SEQ ID NO: 840003 - protein, 29 aa, Mycobacterium
NAMEVGPDGLLYYPLMTANEIWRIDPSGG

SEQ ID NO: 840004 - protein, 22 aa, Mycobacterium
NAMREEAAQSPGWEAGHEKNRQ

SEQ ID NO: 840005 - protein, 29 aa, Mycobacterium
NAMVQYVAYHLFRAAPRLGRWVIRKATIS

SEQ ID NO: 840006 - protein, 25 aa, Mycobacterium
NANINLAMLTLLQKNLQGTIFGGGN

SEQ ID NO: 840007 - protein, 23 aa, Mycobacterium
NANLGLWARDDPGYAWARDYLSV

SEQ ID NO: 840008 - protein, 24 aa, Mycobacterium
NANREWWPTQLNLQILKKNPPAAN

SEQ ID NO: 840009 - protein, 24 aa, Mycobacterium
NANRGMEMVVVRPADVYGPGSVWI

SEQ ID NO: 840010 - protein, 17 aa, Mycobacterium
NANRWAVALGYLTNVLF

SEQ ID NO: 840011 - protein, 21 aa, Mycobacterium
NANTGLFNPGSYNTGLANIGN

SEQ ID NO: 840012 - protein, 23 aa, Mycobacterium
NANYAWIQHILSKLAPGGKAGVV

SEQ ID NO: 840013 - protein, 32 aa, Mycobacterium
NAPAIALAEAQYEQMWAADVAAMVGYHGGASA

SEQ ID NO: 840014 - protein, 24 aa, Mycobacterium
NAPAKSFWRIDVAPASRTVLHCRG

SEQ ID NO: 840015 - protein, 25 aa, Mycobacterium
NAPAQTLLGHPLIPTGGPSALGQGV

SEQ ID NO: 840016 - protein, 20 aa, Mycobacterium
NAPCVLFFDELDALGHRRSQ

SEQ ID NO: 840017 - protein, 33 aa, Mycobacterium
NAPGVPMVFPPWFERFQIKYFNPAVKPIARFLP

SEQ ID NO: 840018 - protein, 34 aa, Mycobacterium
NAPGVPMVFPPWFERFQIKYINPALKPIARYLPG

SEQ ID NO: 840019 - protein, 24 aa, Mycobacterium
NAPHEELLTFLVKLSPGGAMSDYL

SEQ ID NO: 840020 - protein, 32 aa, Mycobacterium
NAPHLVHAMPQLVPLLPSMDHLKRALVRTGFL

SEQ ID NO: 840021 - protein, 34 aa, Mycobacterium
NAPHLVHAMPQLVPLLPSMGHVKRALVRTGFLAG

SEQ ID NO: 840022 - protein, 21 aa, Mycobacterium
NAPKHNGITYFLLDMKSEGVQ

SEQ ID NO: 840023 - protein, 21 aa, Mycobacterium
NAPKHNGITYFLLDMKSQGVQ

SEQ ID NO: 840024 - protein, 20 aa, Mycobacterium
NAPLAFALHDADRAGRLRLH

SEQ ID NO: 840025 - protein, 23 aa, Mycobacterium
NAPRAFVLQFAAMRAGVVMVPLN

SEQ ID NO: 840026 - protein, 22 aa, Mycobacterium
NAPTLALLGRPLIGNGAAGTPG

SEQ ID NO: 840027 - protein, 22 aa, Mycobacterium
NAPTWLCSVMGKSGLFNDYLVK

SEQ ID NO: 840028 - protein, 18 aa, Mycobacterium
NAPTWLCSVMGKSGLFSD

SEQ ID NO: 840029 - protein, 33 aa, Mycobacterium
NAPVSWVDVPPYRPFWAITRYADIMAIERANDL

SEQ ID NO: 840030 - protein, 31 aa, Mycobacterium
NAPVSWVEVPNYRPFWAITKHADIMDIEREN

SEQ ID NO: 840031 - protein, 26 aa, Mycobacterium
NAQAADMLAGALLFETADEDSAGGMA

SEQ ID NO: 840032 - protein, 18 aa, Mycobacterium
NAQDWRWLVITDADKRAA

SEQ ID NO: 840033 - protein, 24 aa, Mycobacterium
NAQELYFPACFELAVARGMPAHDA

SEQ ID NO: 840034 - protein, 25 aa, Mycobacterium
NAQELYFPVCFELAITKGPPTADDR

SEQ ID NO: 840035 - protein, 25 aa, Mycobacterium
NAQELYFPVCFELAVTKGPPAPQDR

SEQ ID NO: 840036 - protein, 19 aa, Mycobacterium
NAQGLNAFYSPKAITGTLA

SEQ ID NO: 840037 - protein, 17 aa, Mycobacterium
NAQLPVLYCSPTMELGV

SEQ ID NO: 840038 - protein, 24 aa, Mycobacterium
NAQNAKYVFLLTNTDPQGPKHKNL

SEQ ID NO: 840039 - protein, 19 aa, Mycobacterium
NAQNFRILTRLEPKVLDAD

SEQ ID NO: 840040 - protein, 18 aa, Mycobacterium
NAQNFRILTRLEPKVLDE

SEQ ID NO: 840041 - protein, 26 aa, Mycobacterium
NAQQELYLTDVIAILRGDGLAIHARH

SEQ ID NO: 840042 - protein, 20 aa, Mycobacterium
NAQSWRWLVIADPALRAKIA

SEQ ID NO: 840043 - protein, 23 aa, Mycobacterium
NAQTWQPRHTLNAKPQALLATGD

SEQ ID NO: 840044 - protein, 23 aa, Mycobacterium
NAQVALLRRRLTAAGLGGIRVGT

SEQ ID NO: 840045 - protein, 25 aa, Mycobacterium
NAQVQRPLSVSLPTRQCTFDKVSAL

SEQ ID NO: 840046 - protein, 20 aa, Mycobacterium
NAQWFYDNFGSGDPVVVKNS

SEQ ID NO: 840047 - protein, 22 aa, Mycobacterium
NAQWFYDNFGSGDPVVVKNSVG

SEQ ID NO: 840048 - protein, 26 aa, Mycobacterium
NARDPRLPDLIVCRPELAEQVLAVTR

SEQ ID NO: 840049 - protein, 25 aa, Mycobacterium
NARIRLEPPLTLLKHYFPDSATGRI

SEQ ID NO: 840050 - protein, 23 aa, Mycobacterium
NARMLRAAFATLPTQLVLVTHDL

SEQ ID NO: 840051 - protein, 24 aa, Mycobacterium
NARNPRFRSIRIDQSWRGIILAPE

SEQ ID NO: 840052 - protein, 21 aa, Mycobacterium
NARPLTIAEWSRLLAEHGLVV

SEQ ID NO: 840053 - protein, 24 aa, Mycobacterium
NARQAILDSLNRFWKPADLDTAPS

SEQ ID NO: 840054 - protein, 24 aa, Mycobacterium
NARQRLIFSIPELKAALYDEYYRT

SEQ ID NO: 840055 - protein, 17 aa, Mycobacterium
NARRFMGLPIANPDPEA

SEQ ID NO: 840056 - protein, 20 aa, Mycobacterium
NARRIAGQLIAPAAPGTATP

SEQ ID NO: 840057 - protein, 26 aa, Mycobacterium
NARRLPIFRVLRYPIVNSTYFTDFDH

SEQ ID NO: 840058 - protein, 27 aa, Mycobacterium
NARRRAIWELTGMPSPLFLERKGYNSA

SEQ ID NO: 840059 - protein, 20 aa, Mycobacterium
NARRRWCTPSHRTAGGSRGG

SEQ ID NO: 840060 - protein, 25 aa, Mycobacterium
NARTRFVLVGLPGRPPARTGADRTS

SEQ ID NO: 840061 - protein, 32 aa, Mycobacterium
NARWLDYEIDIAKLLDFPLMTDMRDPLTIAFH

SEQ ID NO: 840062 - protein, 32 aa, Mycobacterium
NARYRGQLVGRAVDLVQLFPAAAYGKNGADIR

SEQ ID NO: 840063 - protein, 17 aa, Mycobacterium
NARYRMEQGFTFELNLA

SEQ ID NO: 840064 - protein, 28 aa, Mycobacterium
NASAAAPTTALLSALGADEVSAAVTAMF

SEQ ID NO: 840065 - protein, 23 aa, Mycobacterium
NASAAKMLLDPRSMGKGVQLFLP

SEQ ID NO: 840066 - protein, 24 aa, Mycobacterium
NASAKLAPALAAGGSLLVKPAEET

SEQ ID NO: 840067 - protein, 22 aa, Mycobacterium
NASFALAERLAAAIAGAAAVHV

SEQ ID NO: 840068 - protein, 18 aa, Mycobacterium
NASFYRWPKDSTFKGWRD

SEQ ID NO: 840069 - protein, 26 aa, Mycobacterium
NASGGAAFLLCRRASRLTSHAAQWAL

SEQ ID NO: 840070 - protein, 25 aa, Mycobacterium
NASGRTITFAGFLKAYVESLDEQAG

SEQ ID NO: 840071 - protein, 25 aa, Mycobacterium
NASGRTITFPGFLKAYVESIDELAG

SEQ ID NO: 840072 - protein, 29 aa, Mycobacterium
NASIPTPQPVLPRPMFGAAPATAAATSVH

SEQ ID NO: 840073 - protein, 24 aa, Mycobacterium
NASLTGEALRRWPDRVRLTTRGRP

SEQ ID NO: 840074 - protein, 38 aa, Mycobacterium
NASPLQAVLDVVNAPAQALLGRPLIGNGDDGVAGTGQS

SEQ ID NO: 840075 - protein, 24 aa, Mycobacterium
NASRQKMALADRWEGSGAQSALEE

SEQ ID NO: 840076 - protein, 24 aa, Mycobacterium
NASVYLWHDVEGRAPFFDAPDVFA

SEQ ID NO: 840077 - protein, 19 aa, Mycobacterium
NASYYRWPRDTAFANWRSQ

SEQ ID NO: 840078 - protein, 17 aa, Mycobacterium
NATFLRDALDKAGIEAQ

SEQ ID NO: 840079 - protein, 19 aa, Mycobacterium
NATIRYLMFSVFSVRPGEL

SEQ ID NO: 840080 - protein, 19 aa, Mycobacterium
NATLLKRFTKKFAVKRGAM

SEQ ID NO: 840081 - protein, 26 aa, Mycobacterium
NATLWPLYHDVIVKPIYHREWWERYV

SEQ ID NO: 840082 - protein, 22 aa, Mycobacterium
NATLWPLYHDVIVKPLYDREWW

SEQ ID NO: 840083 - protein, 27 aa, Mycobacterium
NATLWPLYHDVIVKPLYHREWWDRYVV

SEQ ID NO: 840084 - protein, 22 aa, Mycobacterium
NATQMHWLWDRAHTRGLDLDHT

SEQ ID NO: 840085 - protein, 17 aa, Mycobacterium
NATQRCIAVLYAAMYGD

SEQ ID NO: 840086 - protein, 35 aa, Mycobacterium
NATRIPMTWFEVDQVPLWAKVPIVLVVHAPAGGDY

SEQ ID NO: 840087 - protein, 19 aa, Mycobacterium
NATTTFGGLAIASGANSSA

SEQ ID NO: 840088 - protein, 21 aa, Mycobacterium
NATVLVCYMGVNGRDGTVFDS

SEQ ID NO: 840089 - protein, 25 aa, Mycobacterium
NAVAPGPILTDWARPVLTSAGIATD

SEQ ID NO: 840090 - protein, 24 aa, Mycobacterium
NAVEKGLVSKPWVKTTMAPGSQVV

SEQ ID NO: 840091 - protein, 21 aa, Mycobacterium
NAVFHYVPLHDSPAGRRYGRT

SEQ ID NO: 840092 - protein, 22 aa, Mycobacterium
NAVGPKLPELWGGSADLAGSNN

SEQ ID NO: 840093 - protein, 26 aa, Mycobacterium
NAVHELMRYYPIVFGTIRETVEDVEL

SEQ ID NO: 840094 - protein, 35 aa, Mycobacterium
NAVHLRHPLLDPLPGTLPEPEIWARLVRALGFVTD

SEQ ID NO: 840095 - protein, 17 aa, Mycobacterium
NAVIAALPLARMATRED

SEQ ID NO: 840096 - protein, 35 aa, Mycobacterium
NAVKLSQLISTVPPLLKWFATRPLIAGVVTVEEGM

SEQ ID NO: 840097 - protein, 27 aa, Mycobacterium
NAVLAGAPLAALWGPNPGAPCGRAVPG

SEQ ID NO: 840098 - protein, 18 aa, Mycobacterium
NAVLALFHYPDKKLRELA

SEQ ID NO: 840099 - protein, 28 aa, Mycobacterium
NAVNAPTQALLGRPLIGNGTNGLPNTGQ

SEQ ID NO: 840100 - protein, 19 aa, Mycobacterium
NAVQRCVAVLFAALHGDTN

SEQ ID NO: 840101 - protein, 27 aa, Mycobacterium
NAVRDWIDMFTMWPQKPTPGIRTHLSI

SEQ ID NO: 840102 - protein, 21 aa, Mycobacterium
NAVRVFLHDLLWAQDHRGFQG

SEQ ID NO: 840103 - protein, 25 aa, Mycobacterium
NAVVLRQRLRLRAIPAEIVEITLSD

SEQ ID NO: 840104 - protein, 19 aa, Mycobacterium
NAVVQLIGNQPRIGPRRAE

SEQ ID NO: 840105 - protein, 26 aa, Mycobacterium
NAVYGFTAMLINLLRDEQPTHIAAAF

SEQ ID NO: 840106 - protein, 32 aa, Mycobacterium
NAWFIAEMVGAGTFPWVLAITTPYSDEAQRSA

SEQ ID NO: 840107 - protein, 21 aa, Mycobacterium
NAWQGDTGLTYQGWQAQWNQS

SEQ ID NO: 840108 - protein, 23 aa, Mycobacterium
NAYASATFPWYQLGRQVHVRGAV

SEQ ID NO: 840109 - protein, 17 aa, Mycobacterium
NAYGATELWYSALSPRL

SEQ ID NO: 840110 - protein, 34 aa, Mycobacterium
NAYVGRTFIQPSQTIRQLGIRLKLNPLKEVIRGK

SEQ ID NO: 840111 - protein, 19 aa, Mycobacterium
NCAAFKRWGLYPRMGIAPE

SEQ ID NO: 840112 - protein, 23 aa, Mycobacterium
NCAALGGLITFSALAAKLCNDVA

SEQ ID NO: 840113 - protein, 17 aa, Mycobacterium
NCAEFGVRLYPMGNLEQ

SEQ ID NO: 840114 - protein, 31 aa, Mycobacterium
NCAPPEVAALRYFWPRLTPGAFVLLDDYANR

SEQ ID NO: 840115 - protein, 33 aa, Mycobacterium
NCATAMLYRHPNLRARFIYGDLPHPVQVVPSDV

SEQ ID NO: 840116 - protein, 31 aa, Mycobacterium
NCDAFETFPPFPFPAVFTLLRGPRSIKPLFA

SEQ ID NO: 840117 - protein, 31 aa, Mycobacterium
NCDKITPGMLMAALRLNIPAVFVSGGPMEGG

SEQ ID NO: 840118 - protein, 22 aa, Mycobacterium
NCDPELCRYDRILFASDADPDG

SEQ ID NO: 840119 - protein, 23 aa, Mycobacterium
NCEAFDRWGLMPRMFVGAAERDL

SEQ ID NO: 840120 - protein, 17 aa, Mycobacterium
NCEQTYHRYLQPGELVS

SEQ ID NO: 840121 - protein, 17 aa, Mycobacterium
NCFGLHEWAMVYRTDHV

SEQ ID NO: 840122 - protein, 23 aa, Mycobacterium
NCGPRFTIIASLPYDRASTTMAG

SEQ ID NO: 840123 - protein, 19 aa, Mycobacterium
NCGPRFTIIRDLPYDRPGT

SEQ ID NO: 840124 - protein, 23 aa, Mycobacterium
NCGPRFTLIASLPYDRASTTMAE

SEQ ID NO: 840125 - protein, 18 aa, Mycobacterium
NCGPRLTVIRTLPYDRPG

SEQ ID NO: 840126 - protein, 21 aa, Mycobacterium
NCGQAGPLGWTLPAALGVVAA

SEQ ID NO: 840127 - protein, 23 aa, Mycobacterium
NCKLVSWPIATLAPNGIRTADGI

SEQ ID NO: 840128 - protein, 17 aa, Mycobacterium
NCLDYVVGFLACAYARR

SEQ ID NO: 840129 - protein, 23 aa, Mycobacterium
NCLGGSLMDYLIPTAMEVPHFET

SEQ ID NO: 840130 - protein, 23 aa, Mycobacterium
NCLGGSLMDYLIPTAVEVPHLET

SEQ ID NO: 840131 - protein, 17 aa, Mycobacterium
NCLSWIEALGFCGIGEA

SEQ ID NO: 840132 - protein, 23 aa, Mycobacterium
NCPGFVFSTGLPGPLAAAALRAV

SEQ ID NO: 840133 - protein, 19 aa, Mycobacterium
NCSILLTELPLLQRPEAAR

SEQ ID NO: 840134 - protein, 18 aa, Mycobacterium
NCYRPQWCRVIDYPFTAG

SEQ ID NO: 840135 - protein, 24 aa, Mycobacterium
NDADKRWVLKNPSHLFALDALMAT

SEQ ID NO: 840136 - protein, 25 aa, Mycobacterium
NDAEKRWVLKNPSHLFALDALFATY

SEQ ID NO: 840137 - protein, 27 aa, Mycobacterium
NDAEVLIDLIRRYAPKIALIVTSHQHF

SEQ ID NO: 840138 - protein, 34 aa, Mycobacterium
NDAFKPLSRFFDRVWRPEQLPAALLGAMRVLTDP

SEQ ID NO: 840139 - protein, 27 aa, Mycobacterium
NDAGYVPMLFAAGLPRLLRAVPVLGGR

SEQ ID NO: 840140 - protein, 22 aa, Mycobacterium
NDAILIGCPGTDLARSAADFHL

SEQ ID NO: 840141 - protein, 25 aa, Mycobacterium
NDALSQPLKDAFNAYIDAARAVANA

SEQ ID NO: 840142 - protein, 17 aa, Mycobacterium
NDAMVARYAPRIAGRPA

SEQ ID NO: 840143 - protein, 29 aa, Mycobacterium
NDAPLHVTTLAWLSLGPTGSNNEADDRHT

SEQ ID NO: 840144 - protein, 22 aa, Mycobacterium
NDAPVQRFWRDAHAGRVHAAND

SEQ ID NO: 840145 - protein, 26 aa, Mycobacterium
NDAQKQEWLPLLASGKALGAFGLTEA

SEQ ID NO: 840146 - protein, 27 aa, Mycobacterium
NDARAVLIRITPAGVSALRQARADRGA

SEQ ID NO: 840147 - protein, 25 aa, Mycobacterium
NDATAFIYIGEVCRYLLNQPAKPTD

SEQ ID NO: 840148 - protein, 36 aa, Mycobacterium
NDAVTRLWSFLAPAYDLPFLQQWVYRPPHDEVIAQL

SEQ ID NO: 840149 - protein, 20 aa, Mycobacterium
NDCPVVIDFIVGADAQVWPM

SEQ ID NO: 840150 - protein, 17 aa, Mycobacterium
NDDFAQYWSEICAIPLS

SEQ ID NO: 840151 - protein, 21 aa, Mycobacterium
NDDKVWLTIVTGTGRAFCTGA

SEQ ID NO: 840152 - protein, 24 aa, Mycobacterium
NDDRILRAAGRLLQRSVADLTILG

SEQ ID NO: 840153 - protein, 17 aa, Mycobacterium
NDDVAPIVFHRSSFRKL

SEQ ID NO: 840154 - protein, 28 aa, Mycobacterium
NDDVAVADWIAMFSMWPVKSTPGTRCQL

SEQ ID NO: 840155 - protein, 24 aa, Mycobacterium
NDDVTLLAAQRRIPAPPLCMTTDA

SEQ ID NO: 840156 - protein, 22 aa, Mycobacterium
NDELRAPMEKATPMRRLGDPVD

SEQ ID NO: 840157 - protein, 17 aa, Mycobacterium
NDELRAPMEQATPLRRL

SEQ ID NO: 840158 - protein, 26 aa, Mycobacterium
NDEQLGRLRVLLGAALDGKKLSAASV

SEQ ID NO: 840159 - protein, 20 aa, Mycobacterium
NDETALARVWHPLADKLDVH

SEQ ID NO: 840160 - protein, 23 aa, Mycobacterium
NDEWVLFGYDPLFQAFRDDRIFS

SEQ ID NO: 840161 - protein, 20 aa, Mycobacterium
NDEYLPMFNRPNVTLVDVSD

SEQ ID NO: 840162 - protein, 22 aa, Mycobacterium
NDFFVNLLDVNIEWTPRADTAD

SEQ ID NO: 840163 - protein, 17 aa, Mycobacterium
NDFGRFSGVQWDVPESL

SEQ ID NO: 840164 - protein, 27 aa, Mycobacterium
NDFPTGPYHHFFMDRFTEAFRSELAGF

SEQ ID NO: 840165 - protein, 21 aa, Mycobacterium
NDFVRLLQRSADWHTVPKADD

SEQ ID NO: 840166 - protein, 32 aa, Mycobacterium
NDFVSKFIGLGRGYRLLQLIDGAGLPLHDITC

SEQ ID NO: 840167 - protein, 19 aa, Mycobacterium
NDFVVGGLGIRCVDDRPWV

SEQ ID NO: 840168 - protein, 27 aa, Mycobacterium
NDGDLPLRSWLFTVARNIVIDGSRSAR

SEQ ID NO: 840169 - protein, 24 aa, Mycobacterium
NDGIELWRYIEINHLLRSDGKTLM

SEQ ID NO: 840170 - protein, 17 aa, Mycobacterium
NDGKLEVYSPNSPLGGA

SEQ ID NO: 840171 - protein, 23 aa, Mycobacterium
NDGLACVWVGIPAARFEASRPED

SEQ ID NO: 840172 - protein, 24 aa, Mycobacterium
NDGLFITLPGIRKLPHHATLDTVR

SEQ ID NO: 840173 - protein, 26 aa, Mycobacterium
NDGSDLIVSGPIRWATNVFPDALMVL

SEQ ID NO: 840174 - protein, 17 aa, Mycobacterium
NDGWRLARTTLANERIA

SEQ ID NO: 840175 - protein, 22 aa, Mycobacterium
NDGYLLKNFVAAGIPCLGIEPT

SEQ ID NO: 840176 - protein, 24 aa, Mycobacterium
NDHAWIVFDSAHLQRYGFLGIEPG

SEQ ID NO: 840177 - protein, 32 aa, Mycobacterium
NDHIETLQWRYYLAWWLWNGHEFDPAAARTRK

SEQ ID NO: 840178 - protein, 17 aa, Mycobacterium
NDHLLGWCQGRQITFTR

SEQ ID NO: 840179 - protein, 28 aa, Mycobacterium
NDILRGHLAQFRYPVIEPHHAHVPIELN

SEQ ID NO: 840180 - protein, 18 aa, Mycobacterium
NDIPMTFHFRGPGTALDG

SEQ ID NO: 840181 - protein, 22 aa, Mycobacterium
NDIRALTKIPAKANLPAGVSVF

SEQ ID NO: 840182 - protein, 21 aa, Mycobacterium
NDIRTAIRELSVRAQLARKEE

SEQ ID NO: 840183 - protein, 22 aa, Mycobacterium
NDKHWAAFVDAVRPPWAGSCYA

SEQ ID NO: 840184 - protein, 25 aa, Mycobacterium
NDKHWAAFVDAVRPPWASEQYATLE

SEQ ID NO: 840185 - protein, 25 aa, Mycobacterium
NDKHWNAFMNAVRPPWASELYATLE

SEQ ID NO: 840186 - protein, 23 aa, Mycobacterium
NDKNAMGLQFYDLSHPWGLGTPC

SEQ ID NO: 840187 - protein, 24 aa, Mycobacterium
NDKQFRLLVQALEMPRLARDDRFA

SEQ ID NO: 840188 - protein, 28 aa, Mycobacterium
NDLARKLMSAFALGLRLPADYFVDTIDR

SEQ ID NO: 840189 - protein, 24 aa, Mycobacterium
NDLDKLIWAEGFSLPLTQSPGDVA

SEQ ID NO: 840190 - protein, 21 aa, Mycobacterium
NDLHLWRQLEFPGTNAQVSAL

SEQ ID NO: 840191 - protein, 25 aa, Mycobacterium
NDLHRELFAQLIGPHWQHGPLVAAD

SEQ ID NO: 840192 - protein, 22 aa, Mycobacterium
NDLLVLQRVAPQIGLAGMVMTV

SEQ ID NO: 840193 - protein, 17 aa, Mycobacterium
NDLNFPPEWRLSRSGRA

SEQ ID NO: 840194 - protein, 26 aa, Mycobacterium
NDLQPAALSLDPALRRTLRAGLDAGA

SEQ ID NO: 840195 - protein, 24 aa, Mycobacterium
NDLRHHYRRLFPGVYVRGEPTLRD

SEQ ID NO: 840196 - protein, 22 aa, Mycobacterium
NDLRTRAMGTINQVATVWTQHG

SEQ ID NO: 840197 - protein, 23 aa, Mycobacterium
NDLVPPVLFGPAMRAMTAVAASE

SEQ ID NO: 840198 - protein, 23 aa, Mycobacterium
NDLVQYYDMLLSGTGGLPPERAN

SEQ ID NO: 840199 - protein, 29 aa, Mycobacterium
NDLYQLYLRVMRRVGHYRWFALFMKHAGS

SEQ ID NO: 840200 - protein, 20 aa, Mycobacterium
NDMEAGFGRWVKALDYLDTD

SEQ ID NO: 840201 - protein, 17 aa, Mycobacterium
NDMPSYLPPVGIGEVMR

SEQ ID NO: 840202 - protein, 18 aa, Mycobacterium
NDMPSYLPPVGIGEVMRA

SEQ ID NO: 840203 - protein, 30 aa, Mycobacterium
NDMVLVDFWASWCGPCRAFAPTFQASSEAH

SEQ ID NO: 840204 - protein, 24 aa, Mycobacterium
NDMVRGLRVITPVGTLDLGRAPES

SEQ ID NO: 840205 - protein, 19 aa, Mycobacterium
NDNGPPPPFTSWQPPGVPP

SEQ ID NO: 840206 - protein, 28 aa, Mycobacterium
NDNSLYTMLMPQPRLVRLLEQRASALGV

SEQ ID NO: 840207 - protein, 22 aa, Mycobacterium
NDPARLAGWWAEQFGGATRELL

SEQ ID NO: 840208 - protein, 24 aa, Mycobacterium
NDPAWIVFDSLHLKHYGFLGVDPD

SEQ ID NO: 840209 - protein, 23 aa, Mycobacterium
NDPELAGVWNLVPDRSAITFKIP

SEQ ID NO: 840210 - protein, 19 aa, Mycobacterium
NDPGWLVWTHGCPGGESVA

SEQ ID NO: 840211 - protein, 20 aa, Mycobacterium
NDPLAHSYLSSAATLRGLVD

SEQ ID NO: 840212 - protein, 22 aa, Mycobacterium
NDPLAVKAALDDALRRARDGGG

SEQ ID NO: 840213 - protein, 33 aa, Mycobacterium
NDPLTPRFTGTLTIRYLRATPLGDLRAEGWITR

SEQ ID NO: 840214 - protein, 29 aa, Mycobacterium
NDPMDRFIATLVLMIRRIALSSTELDEPE

SEQ ID NO: 840215 - protein, 17 aa, Mycobacterium
NDPRAWIAQPVMQLSTV

SEQ ID NO: 840216 - protein, 23 aa, Mycobacterium
NDPRELAAPLWALVHGVASLAIG

SEQ ID NO: 840217 - protein, 21 aa, Mycobacterium
NDPRNEWLFTDAWGVDVAVST

SEQ ID NO: 840218 - protein, 23 aa, Mycobacterium
NDPRNEWLFTDAWGVDVAVSTPR

SEQ ID NO: 840219 - protein, 24 aa, Mycobacterium
NDPVTVGTLRRWIREEQPGSGLRP

SEQ ID NO: 840220 - protein, 22 aa, Mycobacterium
NDPWTLTFGGYLPEDERLREAL

SEQ ID NO: 840221 - protein, 25 aa, Mycobacterium
NDQAVWDFVLPLVRSDVRAMHSGAT

SEQ ID NO: 840222 - protein, 22 aa, Mycobacterium
NDQMYPLVDFLTRSAGKIAAMR

SEQ ID NO: 840223 - protein, 27 aa, Mycobacterium
NDQRPITVPVLLALTERFGLPTRYFAP

SEQ ID NO: 840224 - protein, 27 aa, Mycobacterium
NDQVATLFRLWLRDAVRRVADGVLEVV

SEQ ID NO: 840225 - protein, 26 aa, Mycobacterium
NDQVATLFRMWLRDAAGRISEGVLDV

SEQ ID NO: 840226 - protein, 18 aa, Mycobacterium
NDREWQRLAREIIDRPDL

SEQ ID NO: 840227 - protein, 18 aa, Mycobacterium
NDRGWYHDLPFTDIVTEL

SEQ ID NO: 840228 - protein, 31 aa, Mycobacterium
NDRLTIHDYLWRWDTDWFWCSRAFGAQNPGI

SEQ ID NO: 840229 - protein, 23 aa, Mycobacterium
NDRTVRRFALRKVLRNIDLAIEL

SEQ ID NO: 840230 - protein, 22 aa, Mycobacterium
NDRWQALARLAIRDDIYASLRA

SEQ ID NO: 840231 - protein, 24 aa, Mycobacterium
NDSALLAALIFDRGLDALGQTIVA

SEQ ID NO: 840232 - protein, 23 aa, Mycobacterium
NDSEITRLLLSTGLIALGKTQMS

SEQ ID NO: 840233 - protein, 22 aa, Mycobacterium
NDSEMGHHLAKNAGLPSRADVE

SEQ ID NO: 840234 - protein, 25 aa, Mycobacterium
NDSGKPGVPLSLTKPLGIGVLNSRH

SEQ ID NO: 840235 - protein, 22 aa, Mycobacterium
NDSLALLIYTSGSTGAPKGAMY

SEQ ID NO: 840236 - protein, 22 aa, Mycobacterium
NDSRGFFTSRVIGTFVNEAVAM

SEQ ID NO: 840237 - protein, 17 aa, Mycobacterium
NDTLISWTFQGPNWTFG

SEQ ID NO: 840238 - protein, 18 aa, Mycobacterium
NDTLLFDGLPWVARAQQE

SEQ ID NO: 840239 - protein, 28 aa, Mycobacterium
NDTPELMPLPIALAHRLSRRLTEVRKNG

SEQ ID NO: 840240 - protein, 25 aa, Mycobacterium
NDTPLARLYSWHRAMRIFDGPDEVH

SEQ ID NO: 840241 - protein, 31 aa, Mycobacterium
NDTQGRWQLHWRLGWSFACLTHRCLLAHTCP

SEQ ID NO: 840242 - protein, 22 aa, Mycobacterium
NDTRVYYVEPAKWVAALRHANG

SEQ ID NO: 840243 - protein, 22 aa, Mycobacterium
NDTRVYYVEPAKWVAALRHANT

SEQ ID NO: 840244 - protein, 22 aa, Mycobacterium
NDTRVYYVEPAKWVAALRHLNA

SEQ ID NO: 840245 - protein, 22 aa, Mycobacterium
NDTRVYYVEPAKWVAALRHTKT

SEQ ID NO: 840246 - protein, 27 aa, Mycobacterium
NDTTRAKMMTKVFGLPAGADAGSTLAY

SEQ ID NO: 840247 - protein, 23 aa, Mycobacterium
NDTWMVLAGVERAVALRSDPPQS

SEQ ID NO: 840248 - protein, 25 aa, Mycobacterium
NDVALSYGFWLGDAFASGGSVGYDH

SEQ ID NO: 840249 - protein, 23 aa, Mycobacterium
NDVAPKLPELWGGSADLAGSNNT

SEQ ID NO: 840250 - protein, 17 aa, Mycobacterium
NDVFIPDEMLLGGPTDG

SEQ ID NO: 840251 - protein, 22 aa, Mycobacterium
NDVRLLDLLAKSPTGSARMGDV

SEQ ID NO: 840252 - protein, 19 aa, Mycobacterium
NDVSFIRPIFADNELIGFA

SEQ ID NO: 840253 - protein, 26 aa, Mycobacterium
NDVVPLLFQHSVYKSYPAALLVRSRF

SEQ ID NO: 840254 - protein, 20 aa, Mycobacterium
NDVYVSMNLVRKNGLRRGDA

SEQ ID NO: 840255 - protein, 31 aa, Mycobacterium
NDWHIDEWCGAYPARFIPMAIPVIWDAEACA

SEQ ID NO: 840256 - protein, 32 aa, Mycobacterium
NDWHIDEWCGAYPARFIPMAIPVIWDAEACAA

SEQ ID NO: 840257 - protein, 21 aa, Mycobacterium
NDWPMARLTLALSPATLPKMG

SEQ ID NO: 840258 - protein, 26 aa, Mycobacterium
NDWSQTSLWLTFSYKGECIESNLIDA

SEQ ID NO: 840259 - protein, 26 aa, Mycobacterium
NDYEPLLIDWRAPAAQAFYIATSAHP

SEQ ID NO: 840260 - protein, 29 aa, Mycobacterium
NDYGRMVVGVWISKLFPQKMFKKVNQLRG

SEQ ID NO: 840261 - protein, 25 aa, Mycobacterium
NDYRCFTIIRCGLSHRYPSSKRCGP

SEQ ID NO: 840262 - protein, 18 aa, Mycobacterium
NDYVELHRRHGCALQIGG

SEQ ID NO: 840263 - protein, 32 aa, Mycobacterium
NDYYDKAGLWPYLEKLGFYLVGYGCTTCIGNS

SEQ ID NO: 840264 - protein, 26 aa, Mycobacterium
NEAAALAWSRSPLRRDCFRVLLELPG

SEQ ID NO: 840265 - protein, 24 aa, Mycobacterium
NEAAFLYQLLVRSFGTNNLPDCSN

SEQ ID NO: 840266 - protein, 21 aa, Mycobacterium
NEAAFLYQLLVRSYGTNNLPD

SEQ ID NO: 840267 - protein, 28 aa, Mycobacterium
NEAAPYLAAHGWRLNSASIRDLFAANGL

SEQ ID NO: 840268 - protein, 30 aa, Mycobacterium
NEAEAGAWPWRPPHLVTTLGARGARYAGAD

SEQ ID NO: 840269 - protein, 35 aa, Mycobacterium
NEAIGMLDSAYLGHVIVLWSWALKQPAVGNAESVR

SEQ ID NO: 840270 - protein, 18 aa, Mycobacterium
NEALGLPPYTLEETPLAN

SEQ ID NO: 840271 - protein, 26 aa, Mycobacterium
NEAQRKQWLEPLLAGEIRSAFAMTEP

SEQ ID NO: 840272 - protein, 30 aa, Mycobacterium
NEARRQMLKQPLWFQRAQAAALMVADSVRA

SEQ ID NO: 840273 - protein, 24 aa, Mycobacterium
NEATHYRDAFDRIGYAFAGIEEQS

SEQ ID NO: 840274 - protein, 19 aa, Mycobacterium
NEAWNGLQALRLDAQILGS

SEQ ID NO: 840275 - protein, 17 aa, Mycobacterium
NEDFMWRLADRQLDTFI

SEQ ID NO: 840276 - protein, 18 aa, Mycobacterium
NEDLLGRRHRFGYTVGAY

SEQ ID NO: 840277 - protein, 24 aa, Mycobacterium
NEDRIYAWPKPRLALNVVGSGRGG

SEQ ID NO: 840278 - protein, 26 aa, Mycobacterium
NEEGAICIKLPLPPGTLPTVWGDDQR

SEQ ID NO: 840279 - protein, 25 aa, Mycobacterium
NEEIKGLWVLARYDDGRPSQLRLDT

SEQ ID NO: 840280 - protein, 20 aa, Mycobacterium
NEEKLFFSPGDLGYPVFHTR

SEQ ID NO: 840281 - protein, 24 aa, Mycobacterium
NEELIGQFGIGFYASFMVADRVEL

SEQ ID NO: 840282 - protein, 32 aa, Mycobacterium
NEEQKSKWLPDLLAGRALAGFGLTEPGAGSDA

SEQ ID NO: 840283 - protein, 25 aa, Mycobacterium
NEEQRARWMPGIISGDLVLAIAMTE

SEQ ID NO: 840284 - protein, 23 aa, Mycobacterium
NEEVELAWQILDPVLDNWAAGGK

SEQ ID NO: 840285 - protein, 25 aa, Mycobacterium
NEEVKGLWVLARYDDGRPSQLRLDT

SEQ ID NO: 840286 - protein, 18 aa, Mycobacterium
NEEWNCDKGRWAFTYATA

SEQ ID NO: 840287 - protein, 19 aa, Mycobacterium
NEEWNCDKGRWAFTYATRP

SEQ ID NO: 840288 - protein, 32 aa, Mycobacterium
NEEWQAELPLIEEWFQFIGDKLPTGVKDEFEA

SEQ ID NO: 840289 - protein, 20 aa, Mycobacterium
NEFCLHMLPGAFATVIAARV

SEQ ID NO: 840290 - protein, 18 aa, Mycobacterium
NEFFALFQDPSRTYSCAY

SEQ ID NO: 840291 - protein, 21 aa, Mycobacterium
NEFLARLCKTAMWIDHGEIKL

SEQ ID NO: 840292 - protein, 26 aa, Mycobacterium
NEFLHYLRIREWQDLVGQLRSIARDL

SEQ ID NO: 840293 - protein, 20 aa, Mycobacterium
NEFVQLVMSNLFGQNAPAIA

SEQ ID NO: 840294 - protein, 28 aa, Mycobacterium
NEGMGFYQLMRNLPQERLALAVGAVAAA

SEQ ID NO: 840295 - protein, 18 aa, Mycobacterium
NEHLLQAYQALDVKGRMS

SEQ ID NO: 840296 - protein, 19 aa, Mycobacterium
NEHLPALNSFVLPGGSPLS

SEQ ID NO: 840297 - protein, 22 aa, Mycobacterium
NEHMMLHPLSAPMTLRWLTDRF

SEQ ID NO: 840298 - protein, 23 aa, Mycobacterium
NEHMVLHPLSAPMTLRWLTDRFA

SEQ ID NO: 840299 - protein, 19 aa, Mycobacterium
NEIDHIVRSLRPDHPGAVA

SEQ ID NO: 840300 - protein, 26 aa, Mycobacterium
NEIIQHHDWLPTFLAAAGEPDIIEKL

SEQ ID NO: 840301 - protein, 24 aa, Mycobacterium
NEILQQIFRAFAGPGGTVLGLEPS

SEQ ID NO: 840302 - protein, 23 aa, Mycobacterium
NEILVYEALGFCEPGAAGKLIDN

SEQ ID NO: 840303 - protein, 31 aa, Mycobacterium
NEIPARVFEFLPRRILLPLIRNQHPALRRSR

SEQ ID NO: 840304 - protein, 21 aa, Mycobacterium
NEKLHWALANVWRQLAADKDA

SEQ ID NO: 840305 - protein, 34 aa, Mycobacterium
NEKWTKYFLDPAAIRLLRALKGSGALLPLGSVAE

SEQ ID NO: 840306 - protein, 27 aa, Mycobacterium
NEKWTQYFLDPAAIRLLRSLKASTAMT

SEQ ID NO: 840307 - protein, 17 aa, Mycobacterium
NELDRRLRAGPPDSDSS

SEQ ID NO: 840308 - protein, 17 aa, Mycobacterium
NELLADPAQMYATATVP

SEQ ID NO: 840309 - protein, 17 aa, Mycobacterium
NELLALHGQNDQLRLMR

SEQ ID NO: 840310 - protein, 17 aa, Mycobacterium
NELLRQFRHAITYISAE

SEQ ID NO: 840311 - protein, 18 aa, Mycobacterium
NELLTLHGQNDQLRLMRP

SEQ ID NO: 840312 - protein, 18 aa, Mycobacterium
NELVRYLHNYLTSVTSLI

SEQ ID NO: 840313 - protein, 17 aa, Mycobacterium
NELVWPYRDEAIPAPRG

SEQ ID NO: 840314 - protein, 23 aa, Mycobacterium
NEMDYFVRMWNQAAGAMDVYHAE

SEQ ID NO: 840315 - protein, 19 aa, Mycobacterium
NEMNWRIMKFRPGAKKAAD

SEQ ID NO: 840316 - protein, 20 aa, Mycobacterium
NENLGYGLLGRRIERSPLPF

SEQ ID NO: 840317 - protein, 24 aa, Mycobacterium
NENRIRAAMDRLLRGEIPPGGNCD

SEQ ID NO: 840318 - protein, 23 aa, Mycobacterium
NENRIRAAMDRLLRGEISPGGNC

SEQ ID NO: 840319 - protein, 25 aa, Mycobacterium
NENWRNLSVLYVCPLRALLNNLEPR

SEQ ID NO: 840320 - protein, 24 aa, Mycobacterium
NENYDGFWYLSSYEAVSHTARDGD

SEQ ID NO: 840321 - protein, 19 aa, Mycobacterium
NEPICPPCGTFIRSNGADI

SEQ ID NO: 840322 - protein, 20 aa, Mycobacterium
NEPLPALNSFILPGGTTLSA

SEQ ID NO: 840323 - protein, 30 aa, Mycobacterium
NERHDAIVLGPLRLQFWVCGVFEVSDEGTI

SEQ ID NO: 840324 - protein, 29 aa, Mycobacterium
NERIGLRPTPLTWPVGIAGDFKGVLDRRT

SEQ ID NO: 840325 - protein, 24 aa, Mycobacterium
NERQKQVLLDIYTSFCQQNEAALA

SEQ ID NO: 840326 - protein, 19 aa, Mycobacterium
NERVYSWGAHGFRGRWLVN

SEQ ID NO: 840327 - protein, 20 aa, Mycobacterium
NERWRDVPFYLRTGKAMGDN

SEQ ID NO: 840328 - protein, 29 aa, Mycobacterium
NESERERLFPLIRRYAVAFHVVFIPSVEV

SEQ ID NO: 840329 - protein, 21 aa, Mycobacterium
NESKSWLHRYGDQEISQFRGS

SEQ ID NO: 840330 - protein, 26 aa, Mycobacterium
NESQKQEWLPLLASGKALGAFGLTEA

SEQ ID NO: 840331 - protein, 24 aa, Mycobacterium
NESVRIVREFLVRGVAAAIGRGEV

SEQ ID NO: 840332 - protein, 25 aa, Mycobacterium
NESYCYIPLLEELDFMPSKKFADGA

SEQ ID NO: 840333 - protein, 26 aa, Mycobacterium
NESYCYVPLLEELNYIPSKKFADGTE

SEQ ID NO: 840334 - protein, 25 aa, Mycobacterium
NETEARSWLYPSRHLVTTLGDEGSR

SEQ ID NO: 840335 - protein, 27 aa, Mycobacterium
NETETALLDAYLKQSRRYPGGVLAIGG

SEQ ID NO: 840336 - protein, 18 aa, Mycobacterium
NETLDILKLAFSGERFSY

SEQ ID NO: 840337 - protein, 24 aa, Mycobacterium
NETRTGDLWLFRGRSRPDRAIQTL

SEQ ID NO: 840338 - protein, 27 aa, Mycobacterium
NETSKYAHVFLPGASFLEKDGTFTNAE

SEQ ID NO: 840339 - protein, 25 aa, Mycobacterium
NETVVQWAIAWLQDNNIQAWIIDPL

SEQ ID NO: 840340 - protein, 18 aa, Mycobacterium
NEVDLSVLGLPLTLLATN

SEQ ID NO: 840341 - protein, 17 aa, Mycobacterium
NEVFRRYLGDRLARLEP

SEQ ID NO: 840342 - protein, 28 aa, Mycobacterium
NEVGGLFGLFRMGLPTNFGLSGYSGGLT

SEQ ID NO: 840343 - protein, 39 aa, Mycobacterium
NEVLERSLVHLGLKHYFLVDFPQEPGALRRFLDEVLGPG

SEQ ID NO: 840344 - protein, 21 aa, Mycobacterium
NEVLPHIYFAVKDVLNTAQST

SEQ ID NO: 840345 - protein, 24 aa, Mycobacterium
NEVTHFWALLKYEDIRFVSANPAR

SEQ ID NO: 840346 - protein, 21 aa, Mycobacterium
NEVTLFRRYGNKATLINSALT

SEQ ID NO: 840347 - protein, 29 aa, Mycobacterium
NEVVIAVPMWLTLPPAGKWPREIVCVDPK

SEQ ID NO: 840348 - protein, 28 aa, Mycobacterium
NEVVMPVLKKWRIFEREDFTGEAAWMRD

SEQ ID NO: 840349 - protein, 17 aa, Mycobacterium
NEVWVSHGVISGASNTS

SEQ ID NO: 840350 - protein, 25 aa, Mycobacterium
NFAAGRLSYFLGVRGPAVVSDTACS

SEQ ID NO: 840351 - protein, 22 aa, Mycobacterium
NFADVLIAFGRYPAFDDLSPQF

SEQ ID NO: 840352 - protein, 19 aa, Mycobacterium
NFADVLIAFGRYPSLEGRL

SEQ ID NO: 840353 - protein, 18 aa, Mycobacterium
NFAFGHGLTYTSFGYRDL

SEQ ID NO: 840354 - protein, 18 aa, Mycobacterium
NFATLLIAQLRGLQFDLL

SEQ ID NO: 840355 - protein, 26 aa, Mycobacterium
NFAVADPPLKLVLLESPGAGGTLNHL

SEQ ID NO: 840356 - protein, 18 aa, Mycobacterium
NFDALRTLTLPFGIGIET

SEQ ID NO: 840357 - protein, 23 aa, Mycobacterium
NFDAQAARRFGCGFAPSGWDSLT

SEQ ID NO: 840358 - protein, 17 aa, Mycobacterium
NFDAQEWIRLINAESVT

SEQ ID NO: 840359 - protein, 32 aa, Mycobacterium
NFDEHLHPARPRSLRFRPRVRTPFTRRSLSRD

SEQ ID NO: 840360 - protein, 32 aa, Mycobacterium
NFDLTMMSPMSFIQRPALWFEVMDRVRATVTV

SEQ ID NO: 840361 - protein, 26 aa, Mycobacterium
NFDRGYRSAWWPSTLPTLIVSGSADR

SEQ ID NO: 840362 - protein, 27 aa, Mycobacterium
NFDRSGPVFLYRVPPQDFTDRAAWQGW

SEQ ID NO: 840363 - protein, 24 aa, Mycobacterium
NFDSPLSLLTPQLAQLAAIGGFGK

SEQ ID NO: 840364 - protein, 24 aa, Mycobacterium
NFDSPLSLLTPRLAQLTAIGGFRR

SEQ ID NO: 840365 - protein, 17 aa, Mycobacterium
NFEAKPITRPYADSLRA

SEQ ID NO: 840366 - protein, 37 aa, Mycobacterium
NFEGRIHPECKMNFLASPLLVVAYALAGTLHTNLLRD

SEQ ID NO: 840367 - protein, 19 aa, Mycobacterium
NFELAMAAHLAYLRYGRGR

SEQ ID NO: 840368 - protein, 25 aa, Mycobacterium
NFELVEAPRYLFIAGGIGITPILAM

SEQ ID NO: 840369 - protein, 18 aa, Mycobacterium
NFEYGLDCILDHAGRLID

SEQ ID NO: 840370 - protein, 23 aa, Mycobacterium
NFEYGLGCILDHASWLIEEGKRS

SEQ ID NO: 840371 - protein, 18 aa, Mycobacterium
NFFELDWALQRHNEFVAS

SEQ ID NO: 840372 - protein, 17 aa, Mycobacterium
NFGAVRALDGLDLTVRP

SEQ ID NO: 840373 - protein, 24 aa, Mycobacterium
NFGFGNLGDFNLGFGNTGVGNIGF

SEQ ID NO: 840374 - protein, 17 aa, Mycobacterium
NFGQANYGAAKLGLVGL

SEQ ID NO: 840375 - protein, 27 aa, Mycobacterium
NFGSRAIYRDGWWACARLDRAPWDLSP

SEQ ID NO: 840376 - protein, 26 aa, Mycobacterium
NFGVATAFTFRLHPVPTVICGPTAWP

SEQ ID NO: 840377 - protein, 18 aa, Mycobacterium
NFGVAYDRSLLFGYALDE

SEQ ID NO: 840378 - protein, 24 aa, Mycobacterium
NFHDLGRLGGWAILAAVAPQGSAA

SEQ ID NO: 840379 - protein, 17 aa, Mycobacterium
NFKPFLAGPIEDAEAMV

SEQ ID NO: 840380 - protein, 17 aa, Mycobacterium
NFKPTMEKMLQGGEVRI

SEQ ID NO: 840381 - protein, 29 aa, Mycobacterium
NFKQAMLGLIHLYFGFSEVIRSAIGLKRA

SEQ ID NO: 840382 - protein, 18 aa, Mycobacterium
NFKWIARSADGWITTPRD

SEQ ID NO: 840383 - protein, 22 aa, Mycobacterium
NFLATDVYLGATSIILPRPEPD

SEQ ID NO: 840384 - protein, 23 aa, Mycobacterium
NFLATLPQFVEFVRDGQFDQVAQ

SEQ ID NO: 840385 - protein, 17 aa, Mycobacterium
NFLGMWGTQLQAGDVVR

SEQ ID NO: 840386 - protein, 18 aa, Mycobacterium
NFLPELGLRRENIAFVSG

SEQ ID NO: 840387 - protein, 27 aa, Mycobacterium
NFMTQGWFTGLIPITVPIAATSFNDAA

SEQ ID NO: 840388 - protein, 29 aa, Mycobacterium
NFMTQGWFTGLVPITIPIAAVSFSDAAWA

SEQ ID NO: 840389 - protein, 20 aa, Mycobacterium
NFMVGDLVVVALPGTTLPGG

SEQ ID NO: 840390 - protein, 17 aa, Mycobacterium
NFPDYPPERVRAGAGLL

SEQ ID NO: 840391 - protein, 25 aa, Mycobacterium
NFPILRGLSIKRLVINPGAMRTPHW

SEQ ID NO: 840392 - protein, 28 aa, Mycobacterium
NFPLGIIPLLLLDMWEHAFYLQYKNVKV

SEQ ID NO: 840393 - protein, 28 aa, Mycobacterium
NFPLGIVPLLLLDMWEHAFYLQYKNVKV

SEQ ID NO: 840394 - protein, 20 aa, Mycobacterium
NFPQAFSHIGLVNAAWAIAQ

SEQ ID NO: 840395 - protein, 20 aa, Mycobacterium
NFPVWQTQIAVQRRDARSPQ

SEQ ID NO: 840396 - protein, 18 aa, Mycobacterium
NFPVWQTQMAVQRRDARA

SEQ ID NO: 840397 - protein, 28 aa, Mycobacterium
NFQVVSIPTMILFKDGQPVKRIVGAKGK

SEQ ID NO: 840398 - protein, 20 aa, Mycobacterium
NFRDIYLRNGSYTAPLPHIP

SEQ ID NO: 840399 - protein, 25 aa, Mycobacterium
NFRDVLMALGMYPGAQPVLGGEGSG

SEQ ID NO: 840400 - protein, 25 aa, Mycobacterium
NFRDVLVALGMYPGAAQLGAEGAGI

SEQ ID NO: 840401 - protein, 25 aa, Mycobacterium
NFRDVLVALGMYPGAAQLGAEGAGL

SEQ ID NO: 840402 - protein, 21 aa, Mycobacterium
NFRDVMITLGMFTHEALLGGE

SEQ ID NO: 840403 - protein, 20 aa, Mycobacterium
NFRNGVINPNAFRRKEISVE

SEQ ID NO: 840404 - protein, 20 aa, Mycobacterium
NFRPVLPRVSAFTVRDGRVL

SEQ ID NO: 840405 - protein, 20 aa, Mycobacterium
NFRSFVLPKDDPTGARYFAA

SEQ ID NO: 840406 - protein, 19 aa, Mycobacterium
NFRSIHVRILESEGAQIYV

SEQ ID NO: 840407 - protein, 21 aa, Mycobacterium
NFRVDSLPRAGLAAGPCLLKD

SEQ ID NO: 840408 - protein, 17 aa, Mycobacterium
NFRWVVLTDPESNLFCV

SEQ ID NO: 840409 - protein, 24 aa, Mycobacterium
NFSAAPLEWVPVPEGRLVLQTLRS

SEQ ID NO: 840410 - protein, 23 aa, Mycobacterium
NFSDLIDFLTIQLAPDDLHADPA

SEQ ID NO: 840411 - protein, 34 aa, Mycobacterium
NFSFGDYFKKGAIELAWSLLTNPVSEGGYGFDPE

SEQ ID NO: 840412 - protein, 17 aa, Mycobacterium
NFSRNIPVLAQRFHVLA

SEQ ID NO: 840413 - protein, 18 aa, Mycobacterium
NFTAIAANLPTAPALMGN

SEQ ID NO: 840414 - protein, 21 aa, Mycobacterium
NFTAYKLLIADVVGGDLKVVP

SEQ ID NO: 840415 - protein, 27 aa, Mycobacterium
NFTSSDGVFFMLVALTGRHFRDLTEVT

SEQ ID NO: 840416 - protein, 28 aa, Mycobacterium
NFVAGAPDRLWVADFTYCRTRAGWAYTA

SEQ ID NO: 840417 - protein, 39 aa, Mycobacterium
NFVKALMDRAYAKKFRFPTFLGAFKYYTSYTLKTFDGKR

SEQ ID NO: 840418 - protein, 20 aa, Mycobacterium
NFVLKRNLLVQLHDYSIDTA

SEQ ID NO: 840419 - protein, 27 aa, Mycobacterium
NFVPRIWETLFGEFQRQVARRLSEGGD

SEQ ID NO: 840420 - protein, 27 aa, Mycobacterium
NFVRGVPVWSTLIALLVDGVPVVGVVS

SEQ ID NO: 840421 - protein, 17 aa, Mycobacterium
NFVSGLEKMPVAFTPSA

SEQ ID NO: 840422 - protein, 25 aa, Mycobacterium
NFVVRIPDSLPLDKAAPLLCAGITL

SEQ ID NO: 840423 - protein, 17 aa, Mycobacterium
NFVYGIPAYAVSVGVQV

SEQ ID NO: 840424 - protein, 17 aa, Mycobacterium
NFYRSPLKYAVYFEDWI

SEQ ID NO: 840425 - protein, 17 aa, Mycobacterium
NFYVMRNPRKLAALATA

SEQ ID NO: 840426 - protein, 29 aa, Mycobacterium
NGAAAHLVHPGDLVIIIAYGVMTDEEARA

SEQ ID NO: 840427 - protein, 19 aa, Mycobacterium
NGAAAHLVHPGDLVILIAY

SEQ ID NO: 840428 - protein, 27 aa, Mycobacterium
NGAAFLVLRPLLVDYIMSMPRGPQVIY

SEQ ID NO: 840429 - protein, 30 aa, Mycobacterium
NGAAGIIPAVLHYYWRFVPEADEDGVVEFL

SEQ ID NO: 840430 - protein, 29 aa, Mycobacterium
NGAAILQAMLDLPLYRALVTARGGCQEVM

SEQ ID NO: 840431 - protein, 28 aa, Mycobacterium
NGAAYLVLRPLLIDYVMSMPRGPQVIYP

SEQ ID NO: 840432 - protein, 25 aa, Mycobacterium
NGADGGIGGQFFGNGGDGGAGGIGT

SEQ ID NO: 840433 - protein, 25 aa, Mycobacterium
NGADRSLRWFIEDVLGLFDIDPNSH

SEQ ID NO: 840434 - protein, 23 aa, Mycobacterium
NGADWVPTLFRGLKGVYKKMPQA

SEQ ID NO: 840435 - protein, 25 aa, Mycobacterium
NGAFPSVLVNYYAKLIRSWTAEEVR

SEQ ID NO: 840436 - protein, 26 aa, Mycobacterium
NGAGKSTLLRILARDLEPLEGTVSVA

SEQ ID NO: 840437 - protein, 32 aa, Mycobacterium
NGAGKTTLLNAFTWVLYGQFTKDFEKPKSLGN

SEQ ID NO: 840438 - protein, 17 aa, Mycobacterium
NGAIFGLPSWNLTLEIV

SEQ ID NO: 840439 - protein, 23 aa, Mycobacterium
NGAKALITTIAPGTVWPGEDHHR

SEQ ID NO: 840440 - protein, 25 aa, Mycobacterium
NGAKTWISNARRSGLIALLCKTDPN

SEQ ID NO: 840441 - protein, 25 aa, Mycobacterium
NGALDDWCYELAWPARPAPDTETSN

SEQ ID NO: 840442 - protein, 22 aa, Mycobacterium
NGALNPNAFRRKPISEDDILNS

SEQ ID NO: 840443 - protein, 17 aa, Mycobacterium
NGALRERLGLPAAINRY

SEQ ID NO: 840444 - protein, 27 aa, Mycobacterium
NGAMFDPPLGPALYPRTVARNRRPYQT

SEQ ID NO: 840445 - protein, 18 aa, Mycobacterium
NGAMFDPPLGPAVYPRTV

SEQ ID NO: 840446 - protein, 24 aa, Mycobacterium
NGAMMALRLGCQTDIFAAIAPVAG

SEQ ID NO: 840447 - protein, 27 aa, Mycobacterium
NGAPFLVLRPLLVDYVMSMPRGPQVIY

SEQ ID NO: 840448 - protein, 26 aa, Mycobacterium
NGAPLEPAAILGMVRLIISAGHETTV

SEQ ID NO: 840449 - protein, 17 aa, Mycobacterium
NGAPREGFPAGTPFADI

SEQ ID NO: 840450 - protein, 24 aa, Mycobacterium
NGAPYLRYFNHKMKRDALVPIAPD

SEQ ID NO: 840451 - protein, 20 aa, Mycobacterium
NGAQFNKDIARYIKAAKKAK

SEQ ID NO: 840452 - protein, 27 aa, Mycobacterium
NGARPKALLLPLGPLAEHNIRTTFASN

SEQ ID NO: 840453 - protein, 18 aa, Mycobacterium
NGASAPLLVFYHGGGWSI

SEQ ID NO: 840454 - protein, 26 aa, Mycobacterium
NGATILHAMLELPIYRALVAARGETQ

SEQ ID NO: 840455 - protein, 26 aa, Mycobacterium
NGATPRRFVALANPGLRRLLDQRLGE

SEQ ID NO: 840456 - protein, 18 aa, Mycobacterium
NGAWLRRGVADTQGTVVA

SEQ ID NO: 840457 - protein, 25 aa, Mycobacterium
NGDCVAFFWFAEAPDRVPGISSPEA

SEQ ID NO: 840458 - protein, 24 aa, Mycobacterium
NGDHSHFMFVATLSKPSTETVTVR

SEQ ID NO: 840459 - protein, 25 aa, Mycobacterium
NGDNAKWFYDFAVPGDVVEVRNSGG

SEQ ID NO: 840460 - protein, 17 aa, Mycobacterium
NGDPELLLGGPTPKRGP

SEQ ID NO: 840461 - protein, 25 aa, Mycobacterium
NGDRKFLWLLNHSKGKAVLHLDGPG

SEQ ID NO: 840462 - protein, 35 aa, Mycobacterium
NGDSAPPGWGWVAPYIGMIWPNGDSGKLRAAAAAW

SEQ ID NO: 840463 - protein, 25 aa, Mycobacterium
NGEDPAIRWWPVAVSVGRDDGALSV

SEQ ID NO: 840464 - protein, 31 aa, Mycobacterium
NGEGRLLAVLGYFAALLYNGAGRYEEAYAAI

SEQ ID NO: 840465 - protein, 18 aa, Mycobacterium
NGEKWFSSFASMASFIIV

SEQ ID NO: 840466 - protein, 19 aa, Mycobacterium
NGELIPRLPGPMVRTGMSV

SEQ ID NO: 840467 - protein, 24 aa, Mycobacterium
NGERLEIASPRLGFRIQLDPLELE

SEQ ID NO: 840468 - protein, 23 aa, Mycobacterium
NGERSMAIAYWMAERVSAAIEGR

SEQ ID NO: 840469 - protein, 21 aa, Mycobacterium
NGFAFHFPGWSIQRVLQPWIV

SEQ ID NO: 840470 - protein, 17 aa, Mycobacterium
NGFATCPITQGSLVRFL

SEQ ID NO: 840471 - protein, 22 aa, Mycobacterium
NGFFYRLMPPFCIGTAAAGVGD

SEQ ID NO: 840472 - protein, 24 aa, Mycobacterium
NGFGTEWWAGDLEMLAGTSVGGVM

SEQ ID NO: 840473 - protein, 24 aa, Mycobacterium
NGFGYDPIFVPRGGLRTAAELTPE

SEQ ID NO: 840474 - protein, 39 aa, Mycobacterium
NGFLNGEVTLPLLLPLGLGLVVLDIPFDGILAPPHAMTG

SEQ ID NO: 840475 - protein, 21 aa, Mycobacterium
NGFMKKLNWFGKTFVSASEAK

SEQ ID NO: 840476 - protein, 21 aa, Mycobacterium
NGFRIDGIGPDPRFGEIACKL

SEQ ID NO: 840477 - protein, 17 aa, Mycobacterium
NGFTVAIPSLFGEPGRA

SEQ ID NO: 840478 - protein, 19 aa, Mycobacterium
NGFVIADGAAFLVLERRSH

SEQ ID NO: 840479 - protein, 20 aa, Mycobacterium
NGFWRRPVLQSPDDVHQGLR

SEQ ID NO: 840480 - protein, 21 aa, Mycobacterium
NGGAGGWLFGNGGNGGTGGDA

SEQ ID NO: 840481 - protein, 21 aa, Mycobacterium
NGGAGGWLFGNGGTGGTGGDA

SEQ ID NO: 840482 - protein, 17 aa, Mycobacterium
NGGAPYLLWPAPRRIRA

SEQ ID NO: 840483 - protein, 22 aa, Mycobacterium
NGGDAGLLFSAGGAGGFGGFGS

SEQ ID NO: 840484 - protein, 27 aa, Mycobacterium
NGGDALWALTFLRRRGVSASAVLLNPE

SEQ ID NO: 840485 - protein, 18 aa, Mycobacterium
NGGFFPSVREYSSRFGLS

SEQ ID NO: 840486 - protein, 20 aa, Mycobacterium
NGGFGALNLAGDGGAGAGGG

SEQ ID NO: 840487 - protein, 33 aa, Mycobacterium
NGGFLERFHGLYIPILDLPFFGATPANAYPTTD

SEQ ID NO: 840488 - protein, 21 aa, Mycobacterium
NGGFNGYQGVGGNGGAGGKLF

SEQ ID NO: 840489 - protein, 27 aa, Mycobacterium
NGGHKPWLPHFYLGHGIGTYPAEAPMI

SEQ ID NO: 840490 - protein, 25 aa, Mycobacterium
NGGIGGAGGFLYGLGGNGGIGGHGG

SEQ ID NO: 840491 - protein, 31 aa, Mycobacterium
NGGILSRFPGVHLPIADFTFFPATPSNVYPT

SEQ ID NO: 840492 - protein, 26 aa, Mycobacterium
NGGLDGYLHALRRRHPTRWTWAATPT

SEQ ID NO: 840493 - protein, 18 aa, Mycobacterium
NGGLFRSGGCRVGGHGSQ

SEQ ID NO: 840494 - protein, 26 aa, Mycobacterium
NGGLGIAYSPLVTGIGIGGAGGDGGA

SEQ ID NO: 840495 - protein, 19 aa, Mycobacterium
NGGLLFGNGGTGGAAGDLA

SEQ ID NO: 840496 - protein, 24 aa, Mycobacterium
NGGLLMGIMLTRYPERFGALVCSV

SEQ ID NO: 840497 - protein, 25 aa, Mycobacterium
NGGMLARFPDLSLPSLGLTFYGATP

SEQ ID NO: 840498 - protein, 25 aa, Mycobacterium
NGGNAGSIPAGFMAPAENGIGGNGG

SEQ ID NO: 840499 - protein, 17 aa, Mycobacterium
NGGNFNLGFGNGGAANV

SEQ ID NO: 840500 - protein, 26 aa, Mycobacterium
NGGNGGAGGLFMNGGDGGAGGQGGDG

SEQ ID NO: 840501 - protein, 24 aa, Mycobacterium
NGGNGGLAGIAGDGGDGATGTYDS

SEQ ID NO: 840502 - protein, 23 aa, Mycobacterium
NGGNGGRLLGLGGAGGDAGNGGV

SEQ ID NO: 840503 - protein, 24 aa, Mycobacterium
NGGNGGWLFSNGGVGGAGGAGAPA

SEQ ID NO: 840504 - protein, 22 aa, Mycobacterium
NGGNGGWLIGSGGAGGVSGTGG

SEQ ID NO: 840505 - protein, 24 aa, Mycobacterium
NGGNGSQPPFGSTPAGSGGDGGNG

SEQ ID NO: 840506 - protein, 19 aa, Mycobacterium
NGGPGIPGGPGPAGGNGGN

SEQ ID NO: 840507 - protein, 25 aa, Mycobacterium
NGGPPIALQVLHYAPLDLVTPTRDK

SEQ ID NO: 840508 - protein, 29 aa, Mycobacterium
NGGQTCMAWTRMLVPLSRYSEALDLVAAA

SEQ ID NO: 840509 - protein, 24 aa, Mycobacterium
NGGRAALLIGFGGNGGNGGVGTAT

SEQ ID NO: 840510 - protein, 25 aa, Mycobacterium
NGGRGAYGSGLIPPARGGDGGNGGD

SEQ ID NO: 840511 - protein, 36 aa, Mycobacterium
NGGRGGDGGAFDDGFFLIFGDPGIDGDPGGPPDGGA

SEQ ID NO: 840512 - protein, 22 aa, Mycobacterium
NGGRGGMFIGNGGAGGAGGTGG

SEQ ID NO: 840513 - protein, 23 aa, Mycobacterium
NGGRGLLLMRALSSAVDLDPAPT

SEQ ID NO: 840514 - protein, 27 aa, Mycobacterium
NGGRKPWLPHFYLGHGIGTYPAEAPMI

SEQ ID NO: 840515 - protein, 26 aa, Mycobacterium
NGGSKPWLPHFYLGHGIGVNAAEMPM

SEQ ID NO: 840516 - protein, 28 aa, Mycobacterium
NGGSKWDKLFRFLALDRLQSRLHRWRFN

SEQ ID NO: 840517 - protein, 21 aa, Mycobacterium
NGGVGGLLYGNGGRGGAGGDG

SEQ ID NO: 840518 - protein, 33 aa, Mycobacterium
NGGVLGRFPALTIPILGITFHGATPTAGVDGAY

SEQ ID NO: 840519 - protein, 29 aa, Mycobacterium
NGGVLQRFTGLYVPVLDVLFNGATPPDSP

SEQ ID NO: 840520 - protein, 25 aa, Mycobacterium
NGGVPTFEAVREKIESRYATAMGAA

SEQ ID NO: 840521 - protein, 28 aa, Mycobacterium
NGGVVLLMWAGILAYLDRYGYDYVTGCV

SEQ ID NO: 840522 - protein, 30 aa, Mycobacterium
NGGWAALAHVPALRALPEYDLRAVATSRPE

SEQ ID NO: 840523 - protein, 17 aa, Mycobacterium
NGGWLWGYGGHGGAGGA

SEQ ID NO: 840524 - protein, 36 aa, Mycobacterium
NGGYFCRGLPRDFDRLALPGWAWPDVLDSFRAIETD

SEQ ID NO: 840525 - protein, 25 aa, Mycobacterium
NGHFYGVGLINWWDPKGTRSTLEEL

SEQ ID NO: 840526 - protein, 24 aa, Mycobacterium
NGHQGCVIWFTGLSGSGKSTVANI

SEQ ID NO: 840527 - protein, 28 aa, Mycobacterium
NGHRPAINALFRSVALTFGPRAIGVLLS

SEQ ID NO: 840528 - protein, 24 aa, Mycobacterium
NGHTTFLELAPNPVALMQVGLTTA

SEQ ID NO: 840529 - protein, 20 aa, Mycobacterium
NGIDAARWPFAERRPRTGPA

SEQ ID NO: 840530 - protein, 25 aa, Mycobacterium
NGIDAQLWPFARRCPRTGPPRLLYV

SEQ ID NO: 840531 - protein, 20 aa, Mycobacterium
NGIDFKIADLSLADFGRKEL

SEQ ID NO: 840532 - protein, 24 aa, Mycobacterium
NGIEPEIVLYLKTPPTRAELETMI

SEQ ID NO: 840533 - protein, 18 aa, Mycobacterium
NGIGLLRSLVDRPIEWSK

SEQ ID NO: 840534 - protein, 30 aa, Mycobacterium
NGIGVLAPLAALGCITLAIHPAMTFAGTDE

SEQ ID NO: 840535 - protein, 35 aa, Mycobacterium
NGIKPNLDFPTGPAYYLMGFDIGAFTPIFVMSRIT

SEQ ID NO: 840536 - protein, 18 aa, Mycobacterium
NGINPLVLGALTPRIVSL

SEQ ID NO: 840537 - protein, 23 aa, Mycobacterium
NGIPLWAGAAFKHASAGPAADII

SEQ ID NO: 840538 - protein, 21 aa, Mycobacterium
NGKIWLDGQLQPQSALPTGDF

SEQ ID NO: 840539 - protein, 23 aa, Mycobacterium
NGKRFCVLVDADRNRHLFTYRAD

SEQ ID NO: 840540 - protein, 21 aa, Mycobacterium
NGKTVFVFPGQGGQYPAMAAE

SEQ ID NO: 840541 - protein, 24 aa, Mycobacterium
NGLAFFESLGWRVTESESLFAAAN

SEQ ID NO: 840542 - protein, 31 aa, Mycobacterium
NGLAHEYGLSELWFVTRLMRTAPVSREMVLN

SEQ ID NO: 840543 - protein, 23 aa, Mycobacterium
NGLDLDWLMSHGDRTDWYVGRVH

SEQ ID NO: 840544 - protein, 23 aa, Mycobacterium
NGLDPEGIHWIRTLMQSLAAQGR

SEQ ID NO: 840545 - protein, 24 aa, Mycobacterium
NGLDPEGIHWVRTLMRELAGEGRT

SEQ ID NO: 840546 - protein, 24 aa, Mycobacterium
NGLDPEGIHWVRTLMRTLAAEGRT

SEQ ID NO: 840547 - protein, 28 aa, Mycobacterium
NGLDVPGIVWLRELLHRLAGRGCTVVVA

SEQ ID NO: 840548 - protein, 18 aa, Mycobacterium
NGLFWQDDYQGLIDGSPG

SEQ ID NO: 840549 - protein, 17 aa, Mycobacterium
NGLGVHILLGRGEANTG

SEQ ID NO: 840550 - protein, 25 aa, Mycobacterium
NGLHLRQQRVPLGVVGMIYEGRPNV

SEQ ID NO: 840551 - protein, 17 aa, Mycobacterium
NGLLSGVGKLLRPSLKA

SEQ ID NO: 840552 - protein, 17 aa, Mycobacterium
NGLLTHGIAESAMFAPA

SEQ ID NO: 840553 - protein, 20 aa, Mycobacterium
NGLPQLLLVAGAELSATSAS

SEQ ID NO: 840554 - protein, 19 aa, Mycobacterium
NGLRLPGAHSFFVGNPQIG

SEQ ID NO: 840555 - protein, 31 aa, Mycobacterium
NGLSFNAVLAAAILLAEWRLRETPHVPIPYC

SEQ ID NO: 840556 - protein, 22 aa, Mycobacterium
NGLTAAAILQRAGLRTLCLEAN

SEQ ID NO: 840557 - protein, 23 aa, Mycobacterium
NGLTAAAILQRAGLRTVCLEANT

SEQ ID NO: 840558 - protein, 22 aa, Mycobacterium
NGLTAAAVLQRAGLRTLCMEAN

SEQ ID NO: 840559 - protein, 26 aa, Mycobacterium
NGLTQQTRRHAFITSLLGVEHVVLCI

SEQ ID NO: 840560 - protein, 23 aa, Mycobacterium
NGLTVFHVVPTLAAALKAVDAGV

SEQ ID NO: 840561 - protein, 20 aa, Mycobacterium
NGLVAAAYLAKAGLDVLVVE

SEQ ID NO: 840562 - protein, 20 aa, Mycobacterium
NGLVLFLHGGGFVLGSRTAY

SEQ ID NO: 840563 - protein, 28 aa, Mycobacterium
NGMNELITIARYWRQWADPRLVVVVLHN

SEQ ID NO: 840564 - protein, 27 aa, Mycobacterium
NGMSRKWQRFFRYLSLDGMQTRLHRWR

SEQ ID NO: 840565 - protein, 31 aa, Mycobacterium
NGMVFTAFDPIGAPVLRRVYYSVGGGFVVDE

SEQ ID NO: 840566 - protein, 22 aa, Mycobacterium
NGMWDLSMLGIVPGIRVAAPRD

SEQ ID NO: 840567 - protein, 27 aa, Mycobacterium
NGNELVGPLPKVSPAVIGVWNEEHVEY

SEQ ID NO: 840568 - protein, 29 aa, Mycobacterium
NGNTQYYMFMTRNLPLLEPLRAIPFIGRP

SEQ ID NO: 840569 - protein, 39 aa, Mycobacterium
NGNTSYYIIRTHHLPLLTPLRFIPVLGNPLADLVEPNLT

SEQ ID NO: 840570 - protein, 33 aa, Mycobacterium
NGNWTWRYDAIRKFPDFDVLWDDVDRLSAPITL

SEQ ID NO: 840571 - protein, 26 aa, Mycobacterium
NGPDATTFSFGIANPGFWNVGSANIG

SEQ ID NO: 840572 - protein, 28 aa, Mycobacterium
NGPIPRPVDWRWPWGEVLDVLDDVGTDV

SEQ ID NO: 840573 - protein, 17 aa, Mycobacterium
NGPLAVQAILRTIRETE

SEQ ID NO: 840574 - protein, 18 aa, Mycobacterium
NGPLLVVAATGREADELT

SEQ ID NO: 840575 - protein, 17 aa, Mycobacterium
NGPMMAMAWRAADLILQ

SEQ ID NO: 840576 - protein, 21 aa, Mycobacterium
NGPPYSPEFLSRYRAAQAARN

SEQ ID NO: 840577 - protein, 18 aa, Mycobacterium
NGPPYTADFLARYRSAQV

SEQ ID NO: 840578 - protein, 21 aa, Mycobacterium
NGPQVFFDWMNHGKLSYVADF

SEQ ID NO: 840579 - protein, 23 aa, Mycobacterium
NGPRDMIELCNLAAIAAAGERIT

SEQ ID NO: 840580 - protein, 17 aa, Mycobacterium
NGPSLVIDTACSSSLVA

SEQ ID NO: 840581 - protein, 18 aa, Mycobacterium
NGPWIADRLLELGVELAH

SEQ ID NO: 840582 - protein, 28 aa, Mycobacterium
NGQAAARAWWLLRAAGVSNVRILDGGWA

SEQ ID NO: 840583 - protein, 26 aa, Mycobacterium
NGQAYQFPMGLGLVSQFFGRYFSPDE

SEQ ID NO: 840584 - protein, 25 aa, Mycobacterium
NGQEALGLINQLWEGGARNVDVAAD

SEQ ID NO: 840585 - protein, 17 aa, Mycobacterium
NGQFVTTKFFGMKANHY

SEQ ID NO: 840586 - protein, 28 aa, Mycobacterium
NGQHAFYQLLHQGTWLVPADFIGFSQPI

SEQ ID NO: 840587 - protein, 25 aa, Mycobacterium
NGQKIWTSLGHVARFGLLLARTDPD

SEQ ID NO: 840588 - protein, 29 aa, Mycobacterium
NGQKMWTSLIAYADWVWLAVRTNPDAKKH

SEQ ID NO: 840589 - protein, 30 aa, Mycobacterium
NGQKMWTSLIAYADWVWLAVRTNPEAKKHR

SEQ ID NO: 840590 - protein, 27 aa, Mycobacterium
NGQKMWTSLIAYADYVWLAVRTNPEAK

SEQ ID NO: 840591 - protein, 34 aa, Mycobacterium
NGQKTWTTLGQYADWIFCLVRTDPNAPKKQAGIS

SEQ ID NO: 840592 - protein, 30 aa, Mycobacterium
NGQKVWTSLAHRARWGLLLARTNPDVPKHK

SEQ ID NO: 840593 - protein, 17 aa, Mycobacterium
NGQKVWTSLALQSQWCF

SEQ ID NO: 840594 - protein, 26 aa, Mycobacterium
NGQMFKFVLFQTGHEEFYLFGCCHHI

SEQ ID NO: 840595 - protein, 17 aa, Mycobacterium
NGQTLFEICARLTTKHG

SEQ ID NO: 840596 - protein, 22 aa, Mycobacterium
NGQTLFEICARLTTKHGICSTR

SEQ ID NO: 840597 - protein, 27 aa, Mycobacterium
NGQTYTTRPGSRLLFPALCAPTSEWPT

SEQ ID NO: 840598 - protein, 33 aa, Mycobacterium
NGRALIERAATLGPWTLVLDECHHLLATWGALV

SEQ ID NO: 840599 - protein, 26 aa, Mycobacterium
NGRDGLLMAPTYAVPRLLARNGLSLQ

SEQ ID NO: 840600 - protein, 24 aa, Mycobacterium
NGRGLQLTYPFTPGSDLAGTVVAL

SEQ ID NO: 840601 - protein, 41 aa, Mycobacterium
NGRIGRLLIVLQFMIDDLLQEPLLSVSPWFESRRNEYEDEL

SEQ ID NO: 840602 - protein, 18 aa, Mycobacterium
NGRIPFETALLSEALAEA

SEQ ID NO: 840603 - protein, 19 aa, Mycobacterium
NGRIPFETALLSEVLAERG

SEQ ID NO: 840604 - protein, 24 aa, Mycobacterium
NGRITIMFCSFTRNSRILRLYGTG

SEQ ID NO: 840605 - protein, 29 aa, Mycobacterium
NGRITLWRDYFDFFDMLKATARGLAALVV

SEQ ID NO: 840606 - protein, 26 aa, Mycobacterium
NGRMPVMRPLLEVAGLRLLQWQAAPR

SEQ ID NO: 840607 - protein, 23 aa, Mycobacterium
NGRNPIAIIVPCHRVIGASGKLT

SEQ ID NO: 840608 - protein, 19 aa, Mycobacterium
NGRPLAFAPLPDFAGVLDD

SEQ ID NO: 840609 - protein, 25 aa, Mycobacterium
NGRPNYLFAPALPGPDLYPSLINDP

SEQ ID NO: 840610 - protein, 25 aa, Mycobacterium
NGRQRWCVRLFQGGGFGGPLLDGFD

SEQ ID NO: 840611 - protein, 25 aa, Mycobacterium
NGRSEFCYGSFIRTVPLPAGVTEDG

SEQ ID NO: 840612 - protein, 23 aa, Mycobacterium
NGRSWSRWSFIGAGAPSALTVRD

SEQ ID NO: 840613 - protein, 23 aa, Mycobacterium
NGRSWSRWSFIGAGSPSALTVRD

SEQ ID NO: 840614 - protein, 24 aa, Mycobacterium
NGSEPWRIPDVSTLPRITHAFAKP

SEQ ID NO: 840615 - protein, 22 aa, Mycobacterium
NGSIRFGIIPTVAPYVLPTVLA

SEQ ID NO: 840616 - protein, 28 aa, Mycobacterium
NGSKTWISNARRSGLIALLCKTDPNTKP

SEQ ID NO: 840617 - protein, 19 aa, Mycobacterium
NGSLMVIPGSHQTFYPCVG

SEQ ID NO: 840618 - protein, 22 aa, Mycobacterium
NGSNPLVFDTANPGAAGQDVTT

SEQ ID NO: 840619 - protein, 19 aa, Mycobacterium
NGSPAVYLLDGLRAQDDYN

SEQ ID NO: 840620 - protein, 17 aa, Mycobacterium
NGSPLRWGHAEPSPANP

SEQ ID NO: 840621 - protein, 18 aa, Mycobacterium
NGSVREWVRSRQSVAIAA

SEQ ID NO: 840622 - protein, 24 aa, Mycobacterium
NGTAAILLAFYVAAAEKKGIPRAK

SEQ ID NO: 840623 - protein, 24 aa, Mycobacterium
NGTAAILLAFYVAAAEKKGIPRSK

SEQ ID NO: 840624 - protein, 25 aa, Mycobacterium
NGTGRLLLVITGRPGDWLPRQWPVE

SEQ ID NO: 840625 - protein, 17 aa, Mycobacterium
NGTLRSVGRGRHQLRTA

SEQ ID NO: 840626 - protein, 17 aa, Mycobacterium
NGTLRSVGRGRHQLRTT

SEQ ID NO: 840627 - protein, 17 aa, Mycobacterium
NGTMYVLKHAAREMVRG

SEQ ID NO: 840628 - protein, 20 aa, Mycobacterium
NGTPAQMWPVGANAAPESGE

SEQ ID NO: 840629 - protein, 23 aa, Mycobacterium
NGTPLLEWLRQRGIDDVDVAGIA

SEQ ID NO: 840630 - protein, 35 aa, Mycobacterium
NGTPPPAPFWAARHRLLLGWVKMLDGQLTAAGADV

SEQ ID NO: 840631 - protein, 19 aa, Mycobacterium
NGTTPWLVTGHEAARTLFA

SEQ ID NO: 840632 - protein, 25 aa, Mycobacterium
NGTVQFFEKALPTTAFARVVALADN

SEQ ID NO: 840633 - protein, 20 aa, Mycobacterium
NGTYNLTRLVAAAVAAAEPR

SEQ ID NO: 840634 - protein, 24 aa, Mycobacterium
NGVCLTVAELLPGGLFTADVMGET

SEQ ID NO: 840635 - protein, 44 aa, Mycobacterium
NGVDLHEMWGSRPYAYLGITVPQFPNFFIVYGPGTHLAHGGSLI

SEQ ID NO: 840636 - protein, 23 aa, Mycobacterium
NGVERMAGLIPAEYQDFAAPVFE

SEQ ID NO: 840637 - protein, 24 aa, Mycobacterium
NGVEYVPLPNLLSQADVISLHAPL

SEQ ID NO: 840638 - protein, 25 aa, Mycobacterium
NGVFHCVQAVLPDMIEAGWGRIVNI

SEQ ID NO: 840639 - protein, 29 aa, Mycobacterium
NGVGILAPLTRDGCIPLAIHPAMTFTGPD

SEQ ID NO: 840640 - protein, 28 aa, Mycobacterium
NGVGILAPLTRQGCIPLAIHPAMTFTGS

SEQ ID NO: 840641 - protein, 26 aa, Mycobacterium
NGVHGFDLMFAAPKSVSLLRSLTDDV

SEQ ID NO: 840642 - protein, 20 aa, Mycobacterium
NGVHPLPAWNRHDPESVRFW

SEQ ID NO: 840643 - protein, 34 aa, Mycobacterium
NGVIYLQHGFGAIGWFYQPLAMQLAQQTNSIVVV

SEQ ID NO: 840644 - protein, 17 aa, Mycobacterium
NGVLLLQALGLGGWMFD

SEQ ID NO: 840645 - protein, 18 aa, Mycobacterium
NGVLNPVNIRWTPAEIAY

SEQ ID NO: 840646 - protein, 21 aa, Mycobacterium
NGVLRLRIPVAEKAKPRKIVV

SEQ ID NO: 840647 - protein, 24 aa, Mycobacterium
NGVLVFPDLHLAPEAQVAFSRRLG

SEQ ID NO: 840648 - protein, 20 aa, Mycobacterium
NGVPRLLCMTRMSTFAEDEV

SEQ ID NO: 840649 - protein, 28 aa, Mycobacterium
NGVRRDYRWAEADRHLWIADERGTWQIR

SEQ ID NO: 840650 - protein, 18 aa, Mycobacterium
NGVRVFAHYLRSVGLEHR

SEQ ID NO: 840651 - protein, 28 aa, Mycobacterium
NGVSNSRIVVGGLWGNGGHGGTGGTGSA

SEQ ID NO: 840652 - protein, 24 aa, Mycobacterium
NGVTPRRFLALANPGLRELLDDAI

SEQ ID NO: 840653 - protein, 25 aa, Mycobacterium
NGVTPRRFLALANPGLRELLDRTVG

SEQ ID NO: 840654 - protein, 24 aa, Mycobacterium
NGVTPRRFVALANPGLRKLLDETL

SEQ ID NO: 840655 - protein, 20 aa, Mycobacterium
NGVYGDLQRVLARLSAEEAV

SEQ ID NO: 840656 - protein, 26 aa, Mycobacterium
NGWDPLLQNGLPEPTLNWLDGIAPDT

SEQ ID NO: 840657 - protein, 19 aa, Mycobacterium
NGWHQVTSELSFERSGPER

SEQ ID NO: 840658 - protein, 19 aa, Mycobacterium
NGWRNADLIPGTRINRNAM

SEQ ID NO: 840659 - protein, 18 aa, Mycobacterium
NGWTMVSWDGIPVAPATL

SEQ ID NO: 840660 - protein, 17 aa, Mycobacterium
NGWVQSYGSRCVRPPIL

SEQ ID NO: 840661 - protein, 20 aa, Mycobacterium
NGYAAWVTGLRRVESPTRAD

SEQ ID NO: 840662 - protein, 26 aa, Mycobacterium
NGYLGRFLALEWLERLDKTDGKLIAI

SEQ ID NO: 840663 - protein, 19 aa, Mycobacterium
NGYNWLTGIRIQDGLLKQL

SEQ ID NO: 840664 - protein, 24 aa, Mycobacterium
NGYPGQLAVLYYAPTAADNAYAGE

SEQ ID NO: 840665 - protein, 18 aa, Mycobacterium
NGYPKLMCMTRMSTFAED

SEQ ID NO: 840666 - protein, 17 aa, Mycobacterium
NGYYGGLQFNLGTWRSH

SEQ ID NO: 840667 - protein, 21 aa, Mycobacterium
NHAALLLAQGAGRLLRRVTDR

SEQ ID NO: 840668 - protein, 18 aa, Mycobacterium
NHAFIYLRGEVVPVLRRL

SEQ ID NO: 840669 - protein, 20 aa, Mycobacterium
NHARLLRQLGVEDARLRMLR

SEQ ID NO: 840670 - protein, 39 aa, Mycobacterium
NHARLMRKTFMGNPILCDLILIRAALSPKAARLGAEEME

SEQ ID NO: 840671 - protein, 35 aa, Mycobacterium
NHARLMRKTFMGNPILCDLILIRAALSPKAARMGA

SEQ ID NO: 840672 - protein, 37 aa, Mycobacterium
NHARLMRKTFMGNPILCDLILIRSALSPKAARLGAQE

SEQ ID NO: 840673 - protein, 35 aa, Mycobacterium
NHARLMRKTFMGNPILCDLILIRSALSPRAARLGA

SEQ ID NO: 840674 - protein, 25 aa, Mycobacterium
NHDEDLKYAARLKGLIDVGTYNASN

SEQ ID NO: 840675 - protein, 19 aa, Mycobacterium
NHDGRLRLGARVRPGWFAQ

SEQ ID NO: 840676 - protein, 22 aa, Mycobacterium
NHDSVVRRQIAFGYTEEELRVL

SEQ ID NO: 840677 - protein, 25 aa, Mycobacterium
NHDVAAVGDWMLLAAIEAVIEGHEY

SEQ ID NO: 840678 - protein, 28 aa, Mycobacterium
NHDVGFYGPTGIFIKVGYRGNLVVSGYT

SEQ ID NO: 840679 - protein, 23 aa, Mycobacterium
NHEFGLPIRLFEIGASAGLNLRA

SEQ ID NO: 840680 - protein, 19 aa, Mycobacterium
NHEISPSDLAYTLARRRSH

SEQ ID NO: 840681 - protein, 20 aa, Mycobacterium
NHEPFVTLGLHIGARTTSIV

SEQ ID NO: 840682 - protein, 27 aa, Mycobacterium
NHFVPNLTLGLPVVESLLAATTIPMDC

SEQ ID NO: 840683 - protein, 21 aa, Mycobacterium
NHFVPNLTLGLPVVESLLKVT

SEQ ID NO: 840684 - protein, 26 aa, Mycobacterium
NHGAADPGGFWDANGNPIDGGPMGAD

SEQ ID NO: 840685 - protein, 28 aa, Mycobacterium
NHGALERRYLLVPGLRSSATYVLDTKPD

SEQ ID NO: 840686 - protein, 18 aa, Mycobacterium
NHGPIPAIAPAQWRLTVS

SEQ ID NO: 840687 - protein, 27 aa, Mycobacterium
NHGPMGHFGLFFIGASDQLVLSSSGDG

SEQ ID NO: 840688 - protein, 33 aa, Mycobacterium
NHGTRFHNYLYDKLGLDFLYKAFSTTDIAAAIG

SEQ ID NO: 840689 - protein, 21 aa, Mycobacterium
NHHPDLCPHGCYPCAAGSWIS

SEQ ID NO: 840690 - protein, 19 aa, Mycobacterium
NHHPSICPYGLFDTADGAV

SEQ ID NO: 840691 - protein, 19 aa, Mycobacterium
NHIGELSMWELPRDTTGTL

SEQ ID NO: 840692 - protein, 18 aa, Mycobacterium
NHKITPERRFATATLALA

SEQ ID NO: 840693 - protein, 27 aa, Mycobacterium
NHLDADSIGWLRDFLKNHTGGLVMISH

SEQ ID NO: 840694 - protein, 22 aa, Mycobacterium
NHLDISLNRPGALIAALPAVLG

SEQ ID NO: 840695 - protein, 26 aa, Mycobacterium
NHLDVEVIGWLAGHLTARPARALVVV

SEQ ID NO: 840696 - protein, 21 aa, Mycobacterium
NHLEWQNWSLRVGFNYREGMT

SEQ ID NO: 840697 - protein, 30 aa, Mycobacterium
NHLGHFALTGHLLPLLRAAGNARVVSLSSL

SEQ ID NO: 840698 - protein, 27 aa, Mycobacterium
NHLGHFALTGLLFDNILDIPGSRIVTV

SEQ ID NO: 840699 - protein, 30 aa, Mycobacterium
NHLGHFALTGLLLDHLLPVPGSRVITVSSL

SEQ ID NO: 840700 - protein, 30 aa, Mycobacterium
NHLGHFALVAHLLPLLRAGGARVTSQVSVA

SEQ ID NO: 840701 - protein, 28 aa, Mycobacterium
NHLGPSGNYLPKFAPYLSAGSNPWGASI

SEQ ID NO: 840702 - protein, 28 aa, Mycobacterium
NHLHQGIALQVPPYHYAHPDDLLAAAMD

SEQ ID NO: 840703 - protein, 26 aa, Mycobacterium
NHLHQGIALQVPPYNYAHPDDLVEAA

SEQ ID NO: 840704 - protein, 26 aa, Mycobacterium
NHLIAEVYLDLVRKVPFFTDVNVAMR

SEQ ID NO: 840705 - protein, 28 aa, Mycobacterium
NHLMGDGYWVWLIRLASGATSVGIVADP

SEQ ID NO: 840706 - protein, 21 aa, Mycobacterium
NHLPNINWDPMLDYQMMSRFT

SEQ ID NO: 840707 - protein, 19 aa, Mycobacterium
NHLQTLRLYAEWCDLADLR

SEQ ID NO: 840708 - protein, 18 aa, Mycobacterium
NHLRMLHQLGVDEERVRM

SEQ ID NO: 840709 - protein, 20 aa, Mycobacterium
NHLSCLRGCGLVIAAYEGRQ

SEQ ID NO: 840710 - protein, 19 aa, Mycobacterium
NHLTPRVLDIDDLYARMTG

SEQ ID NO: 840711 - protein, 17 aa, Mycobacterium
NHLVPFGGYKQSGYGRE

SEQ ID NO: 840712 - protein, 18 aa, Mycobacterium
NHLYLDRTGPWREALRLM

SEQ ID NO: 840713 - protein, 26 aa, Mycobacterium
NHMTRLELRRMAYVQRMALHVGRQVW

SEQ ID NO: 840714 - protein, 22 aa, Mycobacterium
NHMYSTPHQLIFGAPKSGKTTI

SEQ ID NO: 840715 - protein, 20 aa, Mycobacterium
NHPGSLLAFPVADLAEHLIA

SEQ ID NO: 840716 - protein, 17 aa, Mycobacterium
NHPKIMGPAKPLGPIEQ

SEQ ID NO: 840717 - protein, 21 aa, Mycobacterium
NHPVQFCSVLLEPPVKHRFQA

SEQ ID NO: 840718 - protein, 24 aa, Mycobacterium
NHPVRLFIGSGMPTGLWGRVVDAF

SEQ ID NO: 840719 - protein, 24 aa, Mycobacterium
NHPVRLFIGSGMPTGLWGRVVEAF

SEQ ID NO: 840720 - protein, 33 aa, Mycobacterium
NHQWHQLARAFLMYTTQRWPDVLLTAAEELPPQ

SEQ ID NO: 840721 - protein, 18 aa, Mycobacterium
NHRHPVVAAVTITTSTTN

SEQ ID NO: 840722 - protein, 18 aa, Mycobacterium
NHRLAALTGLFTFRELRD

SEQ ID NO: 840723 - protein, 29 aa, Mycobacterium
NHRLGFPLRSGFEFFLRKGLQLGLGDRRL

SEQ ID NO: 840724 - protein, 24 aa, Mycobacterium
NHRQGFLTHGFIAAPADPRRAVSY

SEQ ID NO: 840725 - protein, 19 aa, Mycobacterium
NHRVFDVHGIYHQDTYDFI

SEQ ID NO: 840726 - protein, 17 aa, Mycobacterium
NHRVPAPVIAASLFARF

SEQ ID NO: 840727 - protein, 26 aa, Mycobacterium
NHSGLAAGLAYWRKTFDWAAEGEPNP

SEQ ID NO: 840728 - protein, 18 aa, Mycobacterium
NHSIWWKNLSPNGGDKPT

SEQ ID NO: 840729 - protein, 31 aa, Mycobacterium
NHSPGAVALVRRARRLLPGDPEFGDPLSTAG

SEQ ID NO: 840730 - protein, 25 aa, Mycobacterium
NHSPGVVAFIRRARRLLPGDPEFGD

SEQ ID NO: 840731 - protein, 18 aa, Mycobacterium
NHSPGVVAFVRRARRLLP

SEQ ID NO: 840732 - protein, 23 aa, Mycobacterium
NHSSNNFGFGNWGPMNMGSGNHG

SEQ ID NO: 840733 - protein, 24 aa, Mycobacterium
NHSVRSYLFGELLAAHDGMRHGVD

SEQ ID NO: 840734 - protein, 29 aa, Mycobacterium
NHTEELRVLRLHLLHLLQTVSYNSEELDV

SEQ ID NO: 840735 - protein, 17 aa, Mycobacterium
NHTIWWKNLSPNGGDKP

SEQ ID NO: 840736 - protein, 31 aa, Mycobacterium
NHTLSSTLPPLFSTLIKRPLRRLVDNDTPSS

SEQ ID NO: 840737 - protein, 24 aa, Mycobacterium
NHTNQRVPFMLLAGDRDVAAGAVS

SEQ ID NO: 840738 - protein, 19 aa, Mycobacterium
NHTSSQHPWFQAALAAGPG

SEQ ID NO: 840739 - protein, 24 aa, Mycobacterium
NHTSYFDFTFAGLPAYRQHLGRKV

SEQ ID NO: 840740 - protein, 26 aa, Mycobacterium
NHTTRELPKRRPVPLRLLDWKEVYED

SEQ ID NO: 840741 - protein, 18 aa, Mycobacterium
NHVAMHCLVPSLPFGGVG

SEQ ID NO: 840742 - protein, 19 aa, Mycobacterium
NHVIHCEEQLRGSLAGLST

SEQ ID NO: 840743 - protein, 20 aa, Mycobacterium
NHVRSMDLLLANGELRRLTP

SEQ ID NO: 840744 - protein, 25 aa, Mycobacterium
NHVRYLQILWPDGAGRFPGNPELDP

SEQ ID NO: 840745 - protein, 19 aa, Mycobacterium
NHVVALCGEVFPVTRSAKP

SEQ ID NO: 840746 - protein, 17 aa, Mycobacterium
NHVVNYPPMRLARDGRD

SEQ ID NO: 840747 - protein, 18 aa, Mycobacterium
NHVVSPQRRFASATLSLA

SEQ ID NO: 840748 - protein, 27 aa, Mycobacterium
NHYAGDALYAVWDLKALPQANELAIDF

SEQ ID NO: 840749 - protein, 18 aa, Mycobacterium
NHYFASKGVLWAEVVEQT

SEQ ID NO: 840750 - protein, 18 aa, Mycobacterium
NHYLAVFDRATGSALDLF

SEQ ID NO: 840751 - protein, 23 aa, Mycobacterium
NHYSQARMFWMSMTRVEAEHIVA

SEQ ID NO: 840752 - protein, 18 aa, Mycobacterium
NHYVDLVCSWGPMILGHA

SEQ ID NO: 840753 - protein, 18 aa, Mycobacterium
NIAAFRYGRLAVAEPETF

SEQ ID NO: 840754 - protein, 17 aa, Mycobacterium
NIAAGCVAGIDVRWTGR

SEQ ID NO: 840755 - protein, 22 aa, Mycobacterium
NIACSRWGMLAPDGLCKTFDAD

SEQ ID NO: 840756 - protein, 18 aa, Mycobacterium
NIAFPLTLAKMKKAAIAQ

SEQ ID NO: 840757 - protein, 28 aa, Mycobacterium
NIAIELDGLRLITWRGAARAEQGLPFAR

SEQ ID NO: 840758 - protein, 28 aa, Mycobacterium
NIAIELDGLRLITWRGAARAEQGLPFVR

SEQ ID NO: 840759 - protein, 20 aa, Mycobacterium
NIALMHQVVTAQLAAKRQGT

SEQ ID NO: 840760 - protein, 17 aa, Mycobacterium
NIAPPMYSAIPADGVYA

SEQ ID NO: 840761 - protein, 19 aa, Mycobacterium
NIARFDLPGLFGNAGKPDD

SEQ ID NO: 840762 - protein, 18 aa, Mycobacterium
NIARLLGAARAAGVAVVH

SEQ ID NO: 840763 - protein, 24 aa, Mycobacterium
NIARVAARLAAAGWPLAGITHPPE

SEQ ID NO: 840764 - protein, 20 aa, Mycobacterium
NIASTLWRSVVDHDARRYYF

SEQ ID NO: 840765 - protein, 25 aa, Mycobacterium
NIATEDLVYLLADSGFEVHIDLPAA

SEQ ID NO: 840766 - protein, 26 aa, Mycobacterium
NIAVEDLVYLLRDSGIHTEVDLDAAI

SEQ ID NO: 840767 - protein, 23 aa, Mycobacterium
NICSLSGRRPSPGTGAYGAAKAG

SEQ ID NO: 840768 - protein, 27 aa, Mycobacterium
NIDETFRKFKEWLADSAIGTFFSQTLP

SEQ ID NO: 840769 - protein, 18 aa, Mycobacterium
NIDGQLWQIVEFQHVKPG

SEQ ID NO: 840770 - protein, 25 aa, Mycobacterium
NIDGSPLFHIISGNLGYQVEHHLYP

SEQ ID NO: 840771 - protein, 26 aa, Mycobacterium
NIDLQEFILMNKTLAGTIFGSCNPRA

SEQ ID NO: 840772 - protein, 23 aa, Mycobacterium
NIEFNVPPRRLPGRAALDLEAEV

SEQ ID NO: 840773 - protein, 27 aa, Mycobacterium
NIEGKPRNFMLWAGGFDTYIDMCDGVA

SEQ ID NO: 840774 - protein, 19 aa, Mycobacterium
NIEGWVQRKRPGSAAAEAA

SEQ ID NO: 840775 - protein, 22 aa, Mycobacterium
NIELHRIWRETGTTVVLVTHSV

SEQ ID NO: 840776 - protein, 27 aa, Mycobacterium
NIENTILAACPMVGVLIAIGDGRPYNT

SEQ ID NO: 840777 - protein, 20 aa, Mycobacterium
NIFHGALSWPFAEDDEPLDT

SEQ ID NO: 840778 - protein, 24 aa, Mycobacterium
NIGDLFGGLFGRGPQQRPSRPRRG

SEQ ID NO: 840779 - protein, 24 aa, Mycobacterium
NIGHLGARLATLGPAATLARGYAV

SEQ ID NO: 840780 - protein, 21 aa, Mycobacterium
NIGHMSAFMAQAGRLVVRGNA

SEQ ID NO: 840781 - protein, 24 aa, Mycobacterium
NIGLANLGHYSIGFGNAGDFNVGF

SEQ ID NO: 840782 - protein, 28 aa, Mycobacterium
NIGLLGKFMPNFLFAPNDALPSIGRRDD

SEQ ID NO: 840783 - protein, 19 aa, Mycobacterium
NIGLWARDDAGYAWVREHL

SEQ ID NO: 840784 - protein, 35 aa, Mycobacterium
NIGPADTFFWYTSPSWMMWNFQVAGLLVGATIVCY

SEQ ID NO: 840785 - protein, 18 aa, Mycobacterium
NIGQFNIGLGNFGSGNIG

SEQ ID NO: 840786 - protein, 25 aa, Mycobacterium
NIGQILETHLGWVAKAGWNIDVAAG

SEQ ID NO: 840787 - protein, 25 aa, Mycobacterium
NIGQILETHLGWVAKAGWNIRLASD

SEQ ID NO: 840788 - protein, 18 aa, Mycobacterium
NIGQILETHLGWVAKSGW

SEQ ID NO: 840789 - protein, 22 aa, Mycobacterium
NIGQLSMWQLPRDQTGDIGVSN

SEQ ID NO: 840790 - protein, 20 aa, Mycobacterium
NIGRLPMAWIDPGTADLRSV

SEQ ID NO: 840791 - protein, 20 aa, Mycobacterium
NIGSHNFGFANTGPALSDAI

SEQ ID NO: 840792 - protein, 19 aa, Mycobacterium
NIGSWRGFPLRDRVAAMVP

SEQ ID NO: 840793 - protein, 25 aa, Mycobacterium
NIGTDLMMKTLRSSSLEMAVLVGVD

SEQ ID NO: 840794 - protein, 32 aa, Mycobacterium
NIGWDRELAMKAYPLWLARGCMPGKLMPVEDL

SEQ ID NO: 840795 - protein, 18 aa, Mycobacterium
NIHPMLEREIRANLMDLT

SEQ ID NO: 840796 - protein, 23 aa, Mycobacterium
NIHRNLLSRMFTPRKVLALEPQI

SEQ ID NO: 840797 - protein, 24 aa, Mycobacterium
NIKGWRGFPLRERVAAAVPGVPVR

SEQ ID NO: 840798 - protein, 20 aa, Mycobacterium
NIKKQWWRSVITSRDDVVGL

SEQ ID NO: 840799 - protein, 20 aa, Mycobacterium
NIKRQWWRAVVSGRDDVVGL

SEQ ID NO: 840800 - protein, 21 aa, Mycobacterium
NIKRQWWRSVVTGRDDVVGLD

SEQ ID NO: 840801 - protein, 18 aa, Mycobacterium
NILALRFANQLFDPIWNA

SEQ ID NO: 840802 - protein, 19 aa, Mycobacterium
NILALRFANQLFDPIWNAH

SEQ ID NO: 840803 - protein, 22 aa, Mycobacterium
NIMVDRMFAGEAPRLLLLGSAM

SEQ ID NO: 840804 - protein, 18 aa, Mycobacterium
NIPFVPLDELTTQYARVA

SEQ ID NO: 840805 - protein, 22 aa, Mycobacterium
NIPIRAHLLDEGLVRRGTGRWP

SEQ ID NO: 840806 - protein, 26 aa, Mycobacterium
NIPMNTGLLPFALGPVYISNSPSGVG

SEQ ID NO: 840807 - protein, 19 aa, Mycobacterium
NIPMVYQYRHAFGRRLLEL

SEQ ID NO: 840808 - protein, 28 aa, Mycobacterium
NIPPHNLRELADAVFWALDNYDADEETT

SEQ ID NO: 840809 - protein, 28 aa, Mycobacterium
NIPSYKACFLALLRRFYELGVKELNGHL

SEQ ID NO: 840810 - protein, 19 aa, Mycobacterium
NIPVRFPVLPAADDRGWHI

SEQ ID NO: 840811 - protein, 19 aa, Mycobacterium
NIPVVLHLHGPWTPKHSEP

SEQ ID NO: 840812 - protein, 23 aa, Mycobacterium
NIQRGMVPRIFGRSYAIEGRLHI

SEQ ID NO: 840813 - protein, 17 aa, Mycobacterium
NIRAFFDGKPLRAYRPP

SEQ ID NO: 840814 - protein, 17 aa, Mycobacterium
NIRKLPSGRYQVRFTDP

SEQ ID NO: 840815 - protein, 18 aa, Mycobacterium
NIRLAVDGSLRRLETDYI

SEQ ID NO: 840816 - protein, 23 aa, Mycobacterium
NIRLVIEWIDRYAEALPLTVIGA

SEQ ID NO: 840817 - protein, 23 aa, Mycobacterium
NIRPQVDLWTFPDTGKSIIVLSE

SEQ ID NO: 840818 - protein, 22 aa, Mycobacterium
NIRPRVVFMEASDDMLVRRYEQ

SEQ ID NO: 840819 - protein, 19 aa, Mycobacterium
NIRQWIYPSAPELYQLLAK

SEQ ID NO: 840820 - protein, 18 aa, Mycobacterium
NIRWDPLDSVYFAGYAMW

SEQ ID NO: 840821 - protein, 28 aa, Mycobacterium
NISGQRFAGMLVAGVFLREFVADGVSWA

SEQ ID NO: 840822 - protein, 31 aa, Mycobacterium
NISTDLLYKLLRSDWLEPRWMVGIDPESEGL

SEQ ID NO: 840823 - protein, 24 aa, Mycobacterium
NITDVDAYYFAPQKNFAGDGGLWL

SEQ ID NO: 840824 - protein, 18 aa, Mycobacterium
NITGARYRRDFTPIDAEC

SEQ ID NO: 840825 - protein, 22 aa, Mycobacterium
NITMAINYGYNKVRFITPVRVG

SEQ ID NO: 840826 - protein, 21 aa, Mycobacterium
NITPMDIPYPVLWRNLTEAVA

SEQ ID NO: 840827 - protein, 17 aa, Mycobacterium
NITSVLELLIKDGALAP

SEQ ID NO: 840828 - protein, 24 aa, Mycobacterium
NIVCPWHGWRWRGDGTNALIPYSK

SEQ ID NO: 840829 - protein, 22 aa, Mycobacterium
NIVDIQPPLFSLLVAALRGLFS

SEQ ID NO: 840830 - protein, 19 aa, Mycobacterium
NIVIGYDLSTGIPVEKVRY

SEQ ID NO: 840831 - protein, 24 aa, Mycobacterium
NIVIPWVFDGLGFDAPLGKKQDSM

SEQ ID NO: 840832 - protein, 18 aa, Mycobacterium
NIVITTPPDYPAYSENDW

SEQ ID NO: 840833 - protein, 24 aa, Mycobacterium
NIVMPWVFDGLGFDAPLDKKQDSM

SEQ ID NO: 840834 - protein, 28 aa, Mycobacterium
NIVRDRGELLDYLPIPHLHPGDGGPYVN

SEQ ID NO: 840835 - protein, 18 aa, Mycobacterium
NIWANLGLARQMNSRKPR

SEQ ID NO: 840836 - protein, 25 aa, Mycobacterium
NIWNTIFSSGFYMPSNTLAPFLGFL

SEQ ID NO: 840837 - protein, 17 aa, Mycobacterium
NIWRPSPGSVYPTLQLL

SEQ ID NO: 840838 - protein, 20 aa, Mycobacterium
NIWRTDLQAALDKLASLLGS

SEQ ID NO: 840839 - protein, 26 aa, Mycobacterium
NIWRTDLQAALSRLATLLGSAASIAV

SEQ ID NO: 840840 - protein, 21 aa, Mycobacterium
NIYEPPRFFEAFLRGRAHTEP

SEQ ID NO: 840841 - protein, 21 aa, Mycobacterium
NIYLPLSNLTAFQTALLDAAT

SEQ ID NO: 840842 - protein, 18 aa, Mycobacterium
NIYSDFLRDSGPGLHHIC

SEQ ID NO: 840843 - protein, 20 aa, Mycobacterium
NIYYGSFHAVAEVTLTVLPR

SEQ ID NO: 840844 - protein, 25 aa, Mycobacterium
NKAAALRTLFPRPAAVDGVNARVGR

SEQ ID NO: 840845 - protein, 30 aa, Mycobacterium; identical to SEQ ID NO: 116306

SEQ ID NO: 840846 - protein, 26 aa, Mycobacterium
NKALPKPLDHFLLQADLTVVVPGPLE

SEQ ID NO: 840847 - protein, 24 aa, Mycobacterium
NKASLAPFAIEQWADLSAAALEDA

SEQ ID NO: 840848 - protein, 23 aa, Mycobacterium
NKATVYHYFASKALILYEIYFKA

SEQ ID NO: 840849 - protein, 26 aa, Mycobacterium
NKATVYHYYASKALILFDIYRQAAEG

SEQ ID NO: 840850 - protein, 24 aa, Mycobacterium
NKDTEPFWIAAKERRLVAPQCGDC

SEQ ID NO: 840851 - protein, 22 aa, Mycobacterium
NKEALFLRALDRYYERYMDFIP

SEQ ID NO: 840852 - protein, 27 aa, Mycobacterium
NKELGKGEASLWLEEFRGEVTATMVYD

SEQ ID NO: 840853 - protein, 25 aa, Mycobacterium
NKESLLVELLVGISSRLLAGARQVT

SEQ ID NO: 840854 - protein, 21 aa, Mycobacterium
NKESLVAGGPLVLRAARPGQI

SEQ ID NO: 840855 - protein, 25 aa, Mycobacterium
NKFGYDAWVLVYDIETVRTINEAYP

SEQ ID NO: 840856 - protein, 18 aa, Mycobacterium
NKGDFLLHTLRLSRATMI

SEQ ID NO: 840857 - protein, 22 aa, Mycobacterium
NKGEFLLHTLRLSCAKVILTDA

SEQ ID NO: 840858 - protein, 26 aa, Mycobacterium
NKGLELIETHLLFGLPYDRIEVVVHP

SEQ ID NO: 840859 - protein, 21 aa, Mycobacterium
NKGRAPELLALLDAATEAGAD

SEQ ID NO: 840860 - protein, 24 aa, Mycobacterium
NKGRQYAAMFGWPEPLADGADKRE

SEQ ID NO: 840861 - protein, 36 aa, Mycobacterium
NKGVRAWRLPMGFTAWPPWRPGVLFAGDSLGAGKPA

SEQ ID NO: 840862 - protein, 27 aa, Mycobacterium
NKGWGWDDILPIFKRFEDNEFGPSATR

SEQ ID NO: 840863 - protein, 29 aa, Mycobacterium
NKHEAALFRLMRSRLMPITPHAITSMFDQ

SEQ ID NO: 840864 - protein, 27 aa, Mycobacterium
NKHEASLFRWMKSPLMPITPEAIRAMF

SEQ ID NO: 840865 - protein, 20 aa, Mycobacterium
NKHFHGMLTFGFASLAQFLE

SEQ ID NO: 840866 - protein, 22 aa, Mycobacterium
NKHLTPFEYIDRGIALILVAAD

SEQ ID NO: 840867 - protein, 19 aa, Mycobacterium
NKISWADLITYAGNVALES

SEQ ID NO: 840868 - protein, 28 aa, Mycobacterium
NKITFDKIDQHLSVLGLNNTITYKDGDP

SEQ ID NO: 840869 - protein, 26 aa, Mycobacterium
NKKLAVRYHLLNFLDDRSHSRTYSTR

SEQ ID NO: 840870 - protein, 25 aa, Mycobacterium
NKKLRDILGLLRDAYCRHIGVEYTH

SEQ ID NO: 840871 - protein, 25 aa, Mycobacterium
NKLLGSFELTGIPPAPRGVPQIEVT

SEQ ID NO: 840872 - protein, 30 aa, Mycobacterium
NKPMPLDQPLYRYAIYQTRTDEFYLYAGFH

SEQ ID NO: 840873 - protein, 17 aa, Mycobacterium
NKPTTPAFKVTYDAQVR

SEQ ID NO: 840874 - protein, 20 aa, Mycobacterium
NKPVLFLGDTTLTGGQMAER

SEQ ID NO: 840875 - protein, 21 aa, Mycobacterium
NKQLYQERKLKVVAPPNSEPV

SEQ ID NO: 840876 - protein, 25 aa, Mycobacterium
NKRLAWTACRTFLAINGQWISAPED

SEQ ID NO: 840877 - protein, 25 aa, Mycobacterium
NKRLGWAACRTFLAINAQWISAPED

SEQ ID NO: 840878 - protein, 26 aa, Mycobacterium
NKRTAWASAWTFLYINGIELVAGFDV

SEQ ID NO: 840879 - protein, 22 aa, Mycobacterium
NKTIMLVMIYPMTTGRNFDEVL

SEQ ID NO: 840880 - protein, 27 aa, Mycobacterium
NKTQAYVVWGLIRDKWNELGGSQGKLG

SEQ ID NO: 840881 - protein, 24 aa, Mycobacterium
NKTRKLEYLIPDALAQGADTLVSI

SEQ ID NO: 840882 - protein, 24 aa, Mycobacterium
NKVAAMRVLQAKLLERKRIEERAE

SEQ ID NO: 840883 - protein, 24 aa, Mycobacterium
NKVAAMRVLQAKLLERKRLEERAE

SEQ ID NO: 840884 - protein, 24 aa, Mycobacterium
NKVEAPLLPPVLGGGMPGAPGPVP

SEQ ID NO: 840885 - protein, 28 aa, Mycobacterium
NKVKAAPVLWTQQVLTTGALRAVILNSG

SEQ ID NO: 840886 - protein, 23 aa, Mycobacterium
NKVLALLHRFGIAAPASADRSRA

SEQ ID NO: 840887 - protein, 33 aa, Mycobacterium
NKVMPIISALLNYYPHLLALSASSPWWGGEDTG

SEQ ID NO: 840888 - protein, 33 aa, Mycobacterium; identical to SEQ ID NO: 121431

SEQ ID NO: 840889 - protein, 25 aa, Mycobacterium
NKVMRRLVGMLARRGYHQSMALDVV

SEQ ID NO: 840890 - protein, 19 aa, Mycobacterium
NKVPAASALPFRFTVNGYR

SEQ ID NO: 840891 - protein, 19 aa, Mycobacterium
NKVPGASALPFRYTVNGYR

SEQ ID NO: 840892 - protein, 24 aa, Mycobacterium
NKVPNAAALPFRYTVNGYRGCTHA

SEQ ID NO: 840893 - protein, 26 aa, Mycobacterium
NKVPTVSMLPFRFTVNAFRGCAHACR

SEQ ID NO: 840894 - protein, 24 aa, Mycobacterium
NKVSAMRVLQAKLLERKRLEERAE

SEQ ID NO: 840895 - protein, 20 aa, Mycobacterium
NKVVLPHRTMLMITITEEVG

SEQ ID NO: 840896 - protein, 23 aa, Mycobacterium
NKYRLVFEKLRLKPGDRLLDVGC

SEQ ID NO: 840897 - protein, 24 aa, Mycobacterium
NKYRLVFEKLRLKPGDRLLDVGCG

SEQ ID NO: 840898 - protein, 28 aa, Mycobacterium
NLAAAMQGLVALPLLASYDIHASDPRSA

SEQ ID NO: 840899 - protein, 27 aa, Mycobacterium
NLAAAMQGLVAVPLLVGYDLDDPNGET

SEQ ID NO: 840900 - protein, 21 aa, Mycobacterium
NLAAHVLLHFGSDEQKRMLLP

SEQ ID NO: 840901 - protein, 19 aa, Mycobacterium
NLAALLAARGVGPGALVGL

SEQ ID NO: 840902 - protein, 20 aa, Mycobacterium
NLAALLAKNGAGPGALVGLS

SEQ ID NO: 840903 - protein, 24 aa, Mycobacterium
NLAALLIEPIQGEGGFIVPAEGFL

SEQ ID NO: 840904 - protein, 21 aa, Mycobacterium
NLAAMVQRLLGLQLTKGHGAA

SEQ ID NO: 840905 - protein, 20 aa, Mycobacterium
NLAAPLVLPATGSVAVQVVV

SEQ ID NO: 840906 - protein, 24 aa, Mycobacterium
NLADMSPLERLHLVPPPGMSPEMV

SEQ ID NO: 840907 - protein, 18 aa, Mycobacterium
NLADPPPAGSIGLMIAMG

SEQ ID NO: 840908 - protein, 18 aa, Mycobacterium
NLAFTLLGNPMAPNGGLL

SEQ ID NO: 840909 - protein, 26 aa, Mycobacterium
NLAHWPGMLVLYYTALQPLHDNGSLL

SEQ ID NO: 840910 - protein, 21 aa, Mycobacterium
NLAIELPSWAFGNSGTRFKVF

SEQ ID NO: 840911 - protein, 20 aa, Mycobacterium
NLALPALLRDRRITGRDAAF

SEQ ID NO: 840912 - protein, 17 aa, Mycobacterium
NLALPALLRERQISGRD

SEQ ID NO: 840913 - protein, 18 aa, Mycobacterium
NLALVPMSLYFSEGKVKV

SEQ ID NO: 840914 - protein, 19 aa, Mycobacterium
NLALVTRTMRLVQALDLPV

SEQ ID NO: 840915 - protein, 25 aa, Mycobacterium
NLANLHAFLSDTLLMTGFGFAEPVT

SEQ ID NO: 840916 - protein, 18 aa, Mycobacterium
NLAPTPPVSDLFGKAGRH

SEQ ID NO: 840917 - protein, 19 aa, Mycobacterium
NLAQLRRSLGESATYAVAK

SEQ ID NO: 840918 - protein, 18 aa, Mycobacterium
NLARKELAWLRRGPPART

SEQ ID NO: 840919 - protein, 19 aa, Mycobacterium
NLARMTIDLMFNAIADGIP

SEQ ID NO: 840920 - protein, 19 aa, Mycobacterium
NLARMTIDLMFNAIADVMP

SEQ ID NO: 840921 - protein, 19 aa, Mycobacterium
NLARMTISLIFNAVADHMP

SEQ ID NO: 840922 - protein, 20 aa, Mycobacterium
NLARVAQFIPLLAEVEQKIV

SEQ ID NO: 840923 - protein, 20 aa, Mycobacterium
NLARWRYVIDRATPAPLRGI

SEQ ID NO: 840924 - protein, 22 aa, Mycobacterium
NLASYLIPPLTAVSLPTERLGA

SEQ ID NO: 840925 - protein, 20 aa, Mycobacterium
NLAVKGIYWARRGADARRRR

SEQ ID NO: 840926 - protein, 26 aa, Mycobacterium
NLAVLVDFLQFFRAGAEWDVLAAIPA

SEQ ID NO: 840927 - protein, 26 aa, Mycobacterium
NLAVVLRATWALARVLAEQPGPRSPT

SEQ ID NO: 840928 - protein, 20 aa, Mycobacterium
NLAYVEWAVRLARPGAVVVV

SEQ ID NO: 840929 - protein, 21 aa, Mycobacterium
NLCTIGFIDPVARVAFTAGHC

SEQ ID NO: 840930 - protein, 35 aa, Mycobacterium
NLDAPHFRFFTNADAVLFMFDPLRVQVIRDQLHDL

SEQ ID NO: 840931 - protein, 17 aa, Mycobacterium
NLDITWLRDESLDDADH

SEQ ID NO: 840932 - protein, 19 aa, Mycobacterium
NLDKRIVRLPKSHIKAVGT

SEQ ID NO: 840933 - protein, 22 aa, Mycobacterium
NLDLHLDPLIAEGLPVVPVAAD

SEQ ID NO: 840934 - protein, 17 aa, Mycobacterium
NLDLKAGQTLVLRGATS

SEQ ID NO: 840935 - protein, 17 aa, Mycobacterium
NLDLLRQVADRTAAPVI

SEQ ID NO: 840936 - protein, 24 aa, Mycobacterium
NLDLSDYLKLLKLDGTLVELGMPE

SEQ ID NO: 840937 - protein, 25 aa, Mycobacterium
NLDPKRKVRFLPYGIAVSVLDDDSE

SEQ ID NO: 840938 - protein, 24 aa, Mycobacterium
NLDPVAITSLFPLSAAAREAVAMA

SEQ ID NO: 840939 - protein, 22 aa, Mycobacterium
NLDPVLVGERLIGPLYAHGAQG

SEQ ID NO: 840940 - protein, 27 aa, Mycobacterium
NLDQLMKAALPLGLWVPVLPGTRQVTI

SEQ ID NO: 840941 - protein, 20 aa, Mycobacterium
NLDSHYRSWFDRYARSFAAT

SEQ ID NO: 840942 - protein, 20 aa, Mycobacterium
NLEAFLRVMVYDQKLITDEL

SEQ ID NO: 840943 - protein, 41 aa, Mycobacterium
NLEFPHNTFQLRRPLLEPLPGTLPEPEIWARLVRALGVVDD

SEQ ID NO: 840944 - protein, 17 aa, Mycobacterium
NLEHTVLGIFRDVSRPT

SEQ ID NO: 840945 - protein, 17 aa, Mycobacterium
NLEHTVLGIFRNINRPT

SEQ ID NO: 840946 - protein, 23 aa, Mycobacterium
NLEHTVLGIFRSISRPAYDDAAR

SEQ ID NO: 840947 - protein, 27 aa, Mycobacterium
NLELRYRGLRAPHKIKMGVSGCARECA

SEQ ID NO: 840948 - protein, 71 aa, Mycobacterium
NLEMANAAAALPTTGLLAAGADEVSAAIAALFDEHALGYQTISAQASAFHARFMSALNTGAGAYAAAEAAN

SEQ ID NO: 840949 - protein, 18 aa, Mycobacterium
NLEPVIVEYLKTPPSREQ

SEQ ID NO: 840950 - protein, 24 aa, Mycobacterium
NLERRKEICGRAYRILTEKVGFPA

SEQ ID NO: 840951 - protein, 23 aa, Mycobacterium
NLERRKEICGRAYRILTEQVGFP

SEQ ID NO: 840952 - protein, 24 aa, Mycobacterium
NLESKFRVTFPRSNVLSALADELG

SEQ ID NO: 840953 - protein, 17 aa, Mycobacterium
NLEYKLEVWDSPNSAGI

SEQ ID NO: 840954 - protein, 19 aa, Mycobacterium
NLFRDPVEAASYVADPEAA

SEQ ID NO: 840955 - protein, 21 aa, Mycobacterium
NLFVEAVLPGSILRGLTPAEH

SEQ ID NO: 840956 - protein, 27 aa, Mycobacterium
NLFVEMSAHPALLFSLGQSAGDALTVG

SEQ ID NO: 840957 - protein, 18 aa, Mycobacterium
NLGAALAEYGRRVLLVDM

SEQ ID NO: 840958 - protein, 18 aa, Mycobacterium
NLGAALAGYGRRVLLVDL

SEQ ID NO: 840959 - protein, 26 aa, Mycobacterium
NLGALEPLFAKTLKWASTTPLDDGMV

SEQ ID NO: 840960 - protein, 19 aa, Mycobacterium
NLGDYNVGFGNAGSLNQGF

SEQ ID NO: 840961 - protein, 20 aa, Mycobacterium
NLGFANLGDENLGLGNSGFN

SEQ ID NO: 840962 - protein, 23 aa, Mycobacterium
NLGKWWRETRFQAYQGVSVPYFP

SEQ ID NO: 840963 - protein, 21 aa, Mycobacterium
NLGLIRAMEKFDYTKGFKFST

SEQ ID NO: 840964 - protein, 20 aa, Mycobacterium
NLGLIRAVEKFDYTKGYKFS

SEQ ID NO: 840965 - protein, 24 aa, Mycobacterium
NLGLRDVIFALQWVRDNIAAFGGD

SEQ ID NO: 840966 - protein, 25 aa, Mycobacterium
NLGPKVRRLHYLSVPPKAAREVISV

SEQ ID NO: 840967 - protein, 27 aa, Mycobacterium
NLGQGWTSWLLQRVLRELLLDPRVTAQ

SEQ ID NO: 840968 - protein, 17 aa, Mycobacterium
NLGQLFRHVGRGDRWAA

SEQ ID NO: 840969 - protein, 24 aa, Mycobacterium
NLGSGNFGTLNLFGGNNGDLGLGS

SEQ ID NO: 840970 - protein, 23 aa, Mycobacterium
NLGWDLQSYSRGRFILGLGTQIQ

SEQ ID NO: 840971 - protein, 26 aa, Mycobacterium
NLGWHPKAEDLLWRPDLQQPKRSQNG

SEQ ID NO: 840972 - protein, 18 aa, Mycobacterium
NLGWSSWATQWLSTLPGE

SEQ ID NO: 840973 - protein, 21 aa, Mycobacterium
NLHFMEALRKDGRIKFVLFRH

SEQ ID NO: 840974 - protein, 20 aa, Mycobacterium
NLHFQNPSPHIPWDSLPVRV

SEQ ID NO: 840975 - protein, 17 aa, Mycobacterium
NLHGQFVTTLNSSAFSY

SEQ ID NO: 840976 - protein, 26 aa, Mycobacterium
NLHGRYLLPHFIIHDIAQVAADLRAH

SEQ ID NO: 840977 - protein, 25 aa, Mycobacterium
NLHGRYLLPHFLIHDIADVAADLRA

SEQ ID NO: 840978 - protein, 19 aa, Mycobacterium
NLHHALALASRHLRRHPNA

SEQ ID NO: 840979 - protein, 22 aa, Mycobacterium
NLHMVFYRNLMLAALDIEPDAA

SEQ ID NO: 840980 - protein, 21 aa, Mycobacterium
NLHPRWLADLRARAYRRSRHG

SEQ ID NO: 840981 - protein, 18 aa, Mycobacterium
NLHRASTGQPLDWFCLFS

SEQ ID NO: 840982 - protein, 19 aa, Mycobacterium
NLHRPFIDELTRPNPDDPT

SEQ ID NO: 840983 - protein, 18 aa, Mycobacterium
NLHRPFIDQLTRPNPDDP

SEQ ID NO: 840984 - protein, 29 aa, Mycobacterium
NLHRPRRFNRRLLRPCYLAALSSLKNSPA

SEQ ID NO: 840985 - protein, 25 aa, Mycobacterium
NLHVGLAQLWPRLSDDRTARAAVLT

SEQ ID NO: 840986 - protein, 26 aa, Mycobacterium
NLHVVLATRSDPLLPLARLRANGELV

SEQ ID NO: 840987 - protein, 27 aa, Mycobacterium
NLIAPLTGTWYNVTGLPYFGIGITNSL

SEQ ID NO: 840988 - protein, 17 aa, Mycobacterium
NLIATAMRVVNAVPAVV

SEQ ID NO: 840989 - protein, 24 aa, Mycobacterium
NLIATPQNLLLRKALDAVAPRGRS

SEQ ID NO: 840990 - protein, 24 aa, Mycobacterium
NLIDARFPIQYVIRPQGGAAAPGA

SEQ ID NO: 840991 - protein, 29 aa, Mycobacterium
NLIDPSAWEFVWVVDPPLFEPAEDATASG

SEQ ID NO: 840992 - protein, 18 aa, Mycobacterium
NLIFNAVADHMPDLTPIA

SEQ ID NO: 840993 - protein, 19 aa, Mycobacterium
NLIGMGVIPLQFPEGESAA

SEQ ID NO: 840994 - protein, 20 aa, Mycobacterium
NLIGMGVIPLQFPEGKSAKE

SEQ ID NO: 840995 - protein, 23 aa, Mycobacterium
NLIGMGVVPLQFPAGESAASLKL

SEQ ID NO: 840996 - protein, 24 aa, Mycobacterium
NLIHDVMKLRQQGYRPSNSNATAL

SEQ ID NO: 840997 - protein, 20 aa, Mycobacterium
NLIHFAVAILRDPGGPVPAN

SEQ ID NO: 840998 - protein, 22 aa, Mycobacterium
NLIHGFILAAQHLVPGGTAPGQ

SEQ ID NO: 840999 - protein, 26 aa, Mycobacterium
NLINAPTNALLGRPLIGNGTNGAPGT

SEQ ID NO: 841000 - protein, 21 aa, Mycobacterium
NLIPISVFLRRNPNLMAIQSA

SEQ ID NO: 841001 - protein, 20 aa, Mycobacterium
NLIPVVSESLSVGAATGGLD

SEQ ID NO: 841002 - protein, 17 aa, Mycobacterium
NLISAAGAYLNSDQGLA

SEQ ID NO: 841003 - protein, 27 aa, Mycobacterium
NLITPEVVRRLCWDWQPVADVASTVEE

SEQ ID NO: 841004 - protein, 20 aa, Mycobacterium
NLKAAYRLSIDELDWMTPQT

SEQ ID NO: 841005 - protein, 19 aa, Mycobacterium
NLKGPFRLSALVGERMVAA

SEQ ID NO: 841006 - protein, 20 aa, Mycobacterium
NLKGPFRLSALVGERMVAAG

SEQ ID NO: 841007 - protein, 22 aa, Mycobacterium
NLKGPFRLSASIATKMAAGAGG

SEQ ID NO: 841008 - protein, 21 aa, Mycobacterium
NLKGVWHTMLATVPSIVRKGV

SEQ ID NO: 841009 - protein, 20 aa, Mycobacterium
NLKKVMLELGGKSPVLIFDD

SEQ ID NO: 841010 - protein, 23 aa, Mycobacterium
NLKLLTAHFPAHSPLGVRRSGAA

SEQ ID NO: 841011 - protein, 26 aa, Mycobacterium
NLKPALFVIPTDTPGLHWTKIEMELI

SEQ ID NO: 841012 - protein, 18 aa, Mycobacterium
NLLAAQDYFSVIRKSPEL

SEQ ID NO: 841013 - protein, 19 aa, Mycobacterium
NLLAMFTAQRDLLAGKTAF

SEQ ID NO: 841014 - protein, 18 aa, Mycobacterium
NLLDHRSVEILAEQRRPV

SEQ ID NO: 841015 - protein, 22 aa, Mycobacterium
NLLFFTGDAMARPLLDALLAHQ

SEQ ID NO: 841016 - protein, 20 aa, Mycobacterium
NLLFFTGDAMARPLLDSLLA

SEQ ID NO: 841017 - protein, 20 aa, Mycobacterium
NLLFKMKDKGLLPKLSQRLG

SEQ ID NO: 841018 - protein, 31 aa, Mycobacterium
NLLFVNAGMVQFVPYFLGQRTPPWDRATSVQ

SEQ ID NO: 841019 - protein, 33 aa, Mycobacterium
NLLFVNAGMVQFVPYFLGQRTPPYPTATSIQKC

SEQ ID NO: 841020 - protein, 20 aa, Mycobacterium
NLLGTFLVSREAAKLMRKGK

SEQ ID NO: 841021 - protein, 17 aa, Mycobacterium
NLLIDCVSAPRATLFVT

SEQ ID NO: 841022 - protein, 17 aa, Mycobacterium
NLLPPTAIPHFGDAPAS

SEQ ID NO: 841023 - protein, 21 aa, Mycobacterium
NLLVQFWRFARINLKMMRIIF

SEQ ID NO: 841024 - protein, 17 aa, Mycobacterium
NLLVQLSETELAAGVVC

SEQ ID NO: 841025 - protein, 32 aa, Mycobacterium
NLMAVWVIVRTLEALERLPLSYRLALLETVGV

SEQ ID NO: 841026 - protein, 19 aa, Mycobacterium
NLMIQGWKRDPSIVDVLAA

SEQ ID NO: 841027 - protein, 17 aa, Mycobacterium
NLNDLFDAASRSGGTNI

SEQ ID NO: 841028 - protein, 26 aa, Mycobacterium
NLNGVFHCTQAVLPDMIEAGWGRIVN

SEQ ID NO: 841029 - protein, 17 aa, Mycobacterium
NLNLKGPFRLSALVGER

SEQ ID NO: 841030 - protein, 17 aa, Mycobacterium
NLNMATPWIAAERGYID

SEQ ID NO: 841031 - protein, 25 aa, Mycobacterium
NLNRRKRMFWPTTCTVVDIVPDRKL

SEQ ID NO: 841032 - protein, 24 aa, Mycobacterium
NLNVPTPMRAPLEGPGMWALESAM

SEQ ID NO: 841033 - protein, 22 aa, Mycobacterium
NLNYRTTAEILGWSLGLLRGER

SEQ ID NO: 841034 - protein, 22 aa, Mycobacterium
NLPADALTDIFLRRPPRTRSGN

SEQ ID NO: 841035 - protein, 25 aa, Mycobacterium
NLPAGPALSAIPRAIASRLDELDDP

SEQ ID NO: 841036 - protein, 19 aa, Mycobacterium
NLPAQRLLAGFLTGGHLAD

SEQ ID NO: 841037 - protein, 24 aa, Mycobacterium
NLPHDTWLPRRRTLQPIFTKQRVA

SEQ ID NO: 841038 - protein, 23 aa, Mycobacterium
NLPNEQYFVDGWFRTGDAARRDA

SEQ ID NO: 841039 - protein, 20 aa, Mycobacterium
NLPNVHVLAYDQLNTYDVLK

SEQ ID NO: 841040 - protein, 22 aa, Mycobacterium
NLPPEHIFSRRADFYTFGVLGQ

SEQ ID NO: 841041 - protein, 19 aa, Mycobacterium
NLPPPCTTGFLPAQQRRPP

SEQ ID NO: 841042 - protein, 23 aa, Mycobacterium
NLPQAFVHALLFEAAHGLTDGYG

SEQ ID NO: 841043 - protein, 17 aa, Mycobacterium
NLPSSFAAAAYLPDEGF

SEQ ID NO: 841044 - protein, 21 aa, Mycobacterium
NLPVDFHRPPEWCETLQFDVR

SEQ ID NO: 841045 - protein, 17 aa, Mycobacterium
NLPVGGVALDVGSGPGN

SEQ ID NO: 841046 - protein, 18 aa, Mycobacterium
NLPVVLGGNMMQYNWTIN

SEQ ID NO: 841047 - protein, 26 aa, Mycobacterium
NLPYDEPWGWMQPTRHAYGALLLEQG

SEQ ID NO: 841048 - protein, 29 aa, Mycobacterium
NLQAEVSGLIWLPIGPPIDVAAYVEEKHA

SEQ ID NO: 841049 - protein, 24 aa, Mycobacterium
NLQFELDRYLGWPGQAPSYAIGQR

SEQ ID NO: 841050 - protein, 26 aa, Mycobacterium
NLQHGSPPMALLLKAIEELPEPRENL

SEQ ID NO: 841051 - protein, 20 aa, Mycobacterium
NLQLRPYQDGDLDGAWYAIA

SEQ ID NO: 841052 - protein, 30 aa, Mycobacterium
NLQLTVVNPLVDATWRFMTLDTDGKIRMDC

SEQ ID NO: 841053 - protein, 19 aa, Mycobacterium
NLQLWVAACLYKGGVDVLR

SEQ ID NO: 841054 - protein, 24 aa, Mycobacterium
NLQNFGPLRWRDGSAVTVVLAAEN

SEQ ID NO: 841055 - protein, 26 aa, Mycobacterium
NLRARPQLAITFRNGWQWATVEGRAE

SEQ ID NO: 841056 - protein, 25 aa, Mycobacterium
NLRDHHMQWDFWTLSPESAHQVTWL

SEQ ID NO: 841057 - protein, 20 aa, Mycobacterium
NLRDILITLGYDIDKPWRKL

SEQ ID NO: 841058 - protein, 32 aa, Mycobacterium
NLRDILITLGYDIDKPWRKLPKRQREWILFTE

SEQ ID NO: 841059 - protein, 20 aa, Mycobacterium
NLRDPLNRGLRYGVKTMFST

SEQ ID NO: 841060 - protein, 24 aa, Mycobacterium
NLRDPWTAIGMLQQGRRWIEKALD

SEQ ID NO: 841061 - protein, 18 aa, Mycobacterium
NLREAALPHMHDLFEATR

SEQ ID NO: 841062 - protein, 20 aa, Mycobacterium
NLRESLLIGLLAGGHVLIES

SEQ ID NO: 841063 - protein, 17 aa, Mycobacterium
NLRLMAADRVLEHLGLR

SEQ ID NO: 841064 - protein, 27 aa, Mycobacterium
NLRLRDGRWYWHWDPAMMTAPGDDPEL

SEQ ID NO: 841065 - protein, 29 aa, Mycobacterium
NLRLRDGRWYWHWDPAMMTAPLDDPDLRT

SEQ ID NO: 841066 - protein, 22 aa, Mycobacterium
NLRPLVNGPFYAVKVVLSDLGT

SEQ ID NO: 841067 - protein, 29 aa, Mycobacterium
NLRRQVKDTWLRRQLTPQFRPGCKRMLMT

SEQ ID NO: 841068 - protein, 18 aa, Mycobacterium
NLRRRPEQGPGSKAEIIA

SEQ ID NO: 841069 - protein, 30 aa, Mycobacterium
NLSELEFNLLMLVAPVLRKLAYADAAAGTL

SEQ ID NO: 841070 - protein, 19 aa, Mycobacterium
NLSGGRFLLGLGASGPQVI

SEQ ID NO: 841071 - protein, 18 aa, Mycobacterium
NLSGTWRTLRAAVPAMIE

SEQ ID NO: 841072 - protein, 18 aa, Mycobacterium
NLSGVWKSVKAAVPHLLA

SEQ ID NO: 841073 - protein, 19 aa, Mycobacterium
NLSGVWKTVKAAVPHLIAG

SEQ ID NO: 841074 - protein, 23 aa, Mycobacterium
NLSMGARQRLAIASALLGDPQVL

SEQ ID NO: 841075 - protein, 22 aa, Mycobacterium
NLSRINQLLFDSARGRLPGMVN

SEQ ID NO: 841076 - protein, 23 aa, Mycobacterium
NLSVRDMTVCILDRPRHAQLIHD

SEQ ID NO: 841077 - protein, 24 aa, Mycobacterium
NLTFKLHPPILKALGRKKKISMGP

SEQ ID NO: 841078 - protein, 26 aa, Mycobacterium
NLTGRPAISLPLYQTPKGLPLGVQFV

SEQ ID NO: 841079 - protein, 25 aa, Mycobacterium
NLTGRPAISVPLHWTDEGLPLGVQF

SEQ ID NO: 841080 - protein, 30 aa, Mycobacterium
NLTGRPAISVPLHWTPAGLPLGVQFVGGLG

SEQ ID NO: 841081 - protein, 30 aa, Mycobacterium
NLTGRPAISVPLHWTQNGLPLGVQFVGKLG

SEQ ID NO: 841082 - protein, 25 aa, Mycobacterium
NLTGTFLVVREALPALLANPRSAIV

SEQ ID NO: 841083 - protein, 24 aa, Mycobacterium
NLTGTFLVVREALPALLANQRSTI

SEQ ID NO: 841084 - protein, 24 aa, Mycobacterium
NLTGTFLVVREALPALLDNQRSTV

SEQ ID NO: 841085 - protein, 35 aa, Mycobacterium
NLTHTPHGFGISALLPYVMRYNLPTRVPEFAEIGR

SEQ ID NO: 841086 - protein, 24 aa, Mycobacterium
NLTQFYHPLDMFGEWNRAYGAAGF

SEQ ID NO: 841087 - protein, 24 aa, Mycobacterium
NLTQFYHPLDMFGEWNRAYGPAGF

SEQ ID NO: 841088 - protein, 24 aa, Mycobacterium
NLTQFYHPLDMFGEWNRAYGSAGF

SEQ ID NO: 841089 - protein, 22 aa, Mycobacterium
NLTVEIDGRRFTRCYSPANAEG

SEQ ID NO: 841090 - protein, 23 aa, Mycobacterium
NLTYPYGAYFCVVDIDPGTAVVK

SEQ ID NO: 841091 - protein, 22 aa, Mycobacterium
NLTYPYGAYFCVVDVDPGTAVV

SEQ ID NO: 841092 - protein, 22 aa, Mycobacterium
NLTYPYGAYFCVVDVDPGTGVV

SEQ ID NO: 841093 - protein, 23 aa, Mycobacterium
NLTYPYGAYFCVVDVDPGTGVVK

SEQ ID NO: 841094 - protein, 25 aa, Mycobacterium
NLVAQACAFINYAMGRYGVAVDASN

SEQ ID NO: 841095 - protein, 17 aa, Mycobacterium
NLVAQACAFINYAQGRY

SEQ ID NO: 841096 - protein, 18 aa, Mycobacterium
NLVARRYLSKDGQPELWA

SEQ ID NO: 841097 - protein, 24 aa, Mycobacterium
NLVDGDHIMVVLALAMHEAGELSS

SEQ ID NO: 841098 - protein, 18 aa, Mycobacterium
NLVDWFRDGVAETSDALA

SEQ ID NO: 841099 - protein, 19 aa, Mycobacterium
NLVEITLPDDTPWGGKPVR

SEQ ID NO: 841100 - protein, 18 aa, Mycobacterium
NLVEVFFSIITRQEIRRG

SEQ ID NO: 841101 - protein, 22 aa, Mycobacterium
NLVGTALFRYVMKVGPLTELAT

SEQ ID NO: 841102 - protein, 22 aa, Mycobacterium
NLVGTFDCIRIAATAMSRNEPT

SEQ ID NO: 841103 - protein, 17 aa, Mycobacterium
NLVIADCGAGLFDPVTR

SEQ ID NO: 841104 - protein, 21 aa, Mycobacterium
NLVLFGRLYGLSKSAARRRSQ

SEQ ID NO: 841105 - protein, 21 aa, Mycobacterium
NLVLLCPYHHRAHHRGLITIT

SEQ ID NO: 841106 - protein, 20 aa, Mycobacterium
NLVLLCPYHHRSHHRGIITI

SEQ ID NO: 841107 - protein, 20 aa, Mycobacterium
NLVLSNVPGPSFPLYMAGAR

SEQ ID NO: 841108 - protein, 20 aa, Mycobacterium
NLVNARYLRICVLTQYKSHS

SEQ ID NO: 841109 - protein, 24 aa, Mycobacterium
NLVNARYLRICVLTQYKSHSLDRH

SEQ ID NO: 841110 - protein, 19 aa, Mycobacterium
NLVNRILLTSGKIYYEMVA

SEQ ID NO: 841111 - protein, 24 aa, Mycobacterium
NLVPITTFLRRSPYLAAVRTAIAE

SEQ ID NO: 841112 - protein, 25 aa, Mycobacterium
NLVQVVPRRGILVPPISVEAQFKLL

SEQ ID NO: 841113 - protein, 19 aa, Mycobacterium
NLVRGALAHFGKLDILVNN

SEQ ID NO: 841114 - protein, 37 aa, Mycobacterium
NLVSPPSLTIPSIPGLPVPLPNTVPVPSDLLCVGTDW

SEQ ID NO: 841115 - protein, 20 aa, Mycobacterium
NLVSRQECLALIGAGVDDWG

SEQ ID NO: 841116 - protein, 20 aa, Mycobacterium
NLVYTPAISPLVRLVDTDAD

SEQ ID NO: 841117 - protein, 17 aa, Mycobacterium
NLWALPRGVARTGQAGP

SEQ ID NO: 841118 - protein, 17 aa, Mycobacterium
NLWELPVPKWHGEDGGR

SEQ ID NO: 841119 - protein, 26 aa, Mycobacterium
NLYAGRAIVYLRRFDPHEWVRLVRDE

SEQ ID NO: 841120 - protein, 20 aa, Mycobacterium
NLYARALADLTWKATVQAMK

SEQ ID NO: 841121 - protein, 23 aa, Mycobacterium
NLYLRDLVSALRWVRENIAAFGG

SEQ ID NO: 841122 - protein, 24 aa, Mycobacterium
NLYPLGDPPYYAFRIVLGDLGTSG

SEQ ID NO: 841123 - protein, 30 aa, Mycobacterium
NLYTLRCYLDDRPIFLGRNGRISVFSSERA

SEQ ID NO: 841124 - protein, 37 aa, Mycobacterium; identical to SEQ ID NO: 116322

SEQ ID NO: 841125 - protein, 42 aa, Mycobacterium
NMAKVPYYRVLELAPSLRWPQPNFPVSNFFHGGAAPLNAVLA

SEQ ID NO: 841126 - protein, 42 aa, Mycobacterium
NMAKVPYYRVLELAPWLGWPRPNFPVSNFFHGGAAPLNAILA

SEQ ID NO: 841127 - protein, 25 aa, Mycobacterium
NMARLGSFFSDRWMESLRAAEGAVV

SEQ ID NO: 841128 - protein, 20 aa, Mycobacterium
NMAYGVRPPHLGEWIVNLGE

SEQ ID NO: 841129 - protein, 30 aa, Mycobacterium
NMDAPQHTRLRKIISRGFTPRAIGRLEDEL

SEQ ID NO: 841130 - protein, 34 aa, Mycobacterium
NMDDARWDSVIAVNLLAPLRLTEGLVGNGSIGAG

SEQ ID NO: 841131 - protein, 33 aa, Mycobacterium
NMDDARWDSVIAVNLLAPQRLTEGLIGNGTIGE

SEQ ID NO: 841132 - protein, 19 aa, Mycobacterium
NMDDGLPGSIWIDEALRTA

SEQ ID NO: 841133 - protein, 23 aa, Mycobacterium
NMFGPMRLTMRCHDLLKSSQAPG

SEQ ID NO: 841134 - protein, 22 aa, Mycobacterium
NMFVNPWGLWWQEVSASDICVV

SEQ ID NO: 841135 - protein, 25 aa, Mycobacterium
NMGDIYLVGRLPLPAITPDEIDRLL

SEQ ID NO: 841136 - protein, 24 aa, Mycobacterium
NMGEAWWVPIVQIPGDTFEGRPRS

SEQ ID NO: 841137 - protein, 23 aa, Mycobacterium
NMGEAWWVPIVQIPGDTIEGKPR

SEQ ID NO: 841138 - protein, 24 aa, Mycobacterium
NMGEAWWVPIVQIPGDTIGARQRS

SEQ ID NO: 841139 - protein, 19 aa, Mycobacterium
NMGFRADAYWSVGGFRGLK

SEQ ID NO: 841140 - protein, 20 aa, Mycobacterium
NMGFRAESYWRVGGFRALKS

SEQ ID NO: 841141 - protein, 18 aa, Mycobacterium
NMGVVPPKPGYNAALRSI

SEQ ID NO: 841142 - protein, 21 aa, Mycobacterium
NMIGRLMALKSLAEIIPESLV

SEQ ID NO: 841143 - protein, 22 aa, Mycobacterium
NMIQAFFLDMQTINGGGSRPDG

SEQ ID NO: 841144 - protein, 26 aa, Mycobacterium
NMKDVVPTVMLFIPSVDGVSHAENEF

SEQ ID NO: 841145 - protein, 24 aa, Mycobacterium
NMKEIVPSVMLFVPSVEGISHAEA

SEQ ID NO: 841146 - protein, 17 aa, Mycobacterium
NMLPLRPANFVSGLESM

SEQ ID NO: 841147 - protein, 19 aa, Mycobacterium
NMLWFFETAAASHDRLRPG

SEQ ID NO: 841148 - protein, 20 aa, Mycobacterium
NMMENFPVGDPWTPGIMQGP

SEQ ID NO: 841149 - protein, 17 aa, Mycobacterium
NMMLINGFLGEVVGLPG

SEQ ID NO: 841150 - protein, 18 aa, Mycobacterium
NMPLALRFEGPLDSVALA

SEQ ID NO: 841151 - protein, 18 aa, Mycobacterium
NMPLMGAVPMVLGALAAA

SEQ ID NO: 841152 - protein, 24 aa, Mycobacterium
NMPPHNLRELAEAVYWALDNHEAD

SEQ ID NO: 841153 - protein, 17 aa, Mycobacterium
NMPSGWLTFNQFFGREL

SEQ ID NO: 841154 - protein, 28 aa, Mycobacterium
NMQLPDGTLWSIPIVFDLSAADIDSYGL

SEQ ID NO: 841155 - protein, 24 aa, Mycobacterium
NMQRNPLLTEAMTRALVFADASAA

SEQ ID NO: 841156 - protein, 30 aa, Mycobacterium
NMRLPKVTRSLLLYRYRRLPEARRAAAEAG

SEQ ID NO: 841157 - protein, 19 aa, Mycobacterium
NMRRVVHPLARMLASRLAA

SEQ ID NO: 841158 - protein, 35 aa, Mycobacterium
NMRSTYRVVPLDVGLPWFMRGPGAVTGAFALECAM

SEQ ID NO: 841159 - protein, 17 aa, Mycobacterium
NMRWRTFCAELVAIADK

SEQ ID NO: 841160 - protein, 30 aa, Mycobacterium
NMSESALAEEIFVIADLARQKARAAQHTFM

SEQ ID NO: 841161 - protein, 17 aa, Mycobacterium
NMSMYSLRVSESGMREP

SEQ ID NO: 841162 - protein, 35 aa, Mycobacterium
NMSSTYRVVPLDINLPWFMRGPGAVTGTFALESTM

SEQ ID NO: 841163 - protein, 25 aa, Mycobacterium
NMSTTWPRLKVAPMLGISVLGETHD

SEQ ID NO: 841164 - protein, 25 aa, Mycobacterium
NMTDDRLCKLIPGPDWGSGASVVGT

SEQ ID NO: 841165 - protein, 24 aa, Mycobacterium
NMTGYPEAILARELELCYAAIALV

SEQ ID NO: 841166 - protein, 24 aa, Mycobacterium
NMTGYPEAVLARELEICYAAIALV

SEQ ID NO: 841167 - protein, 18 aa, Mycobacterium
NMTGYPEAVLARELELCY

SEQ ID NO: 841168 - protein, 17 aa, Mycobacterium
NMTGYPEAVLARELEMC

SEQ ID NO: 841169 - protein, 20 aa, Mycobacterium
NMVARRLLGNRYGAAVLGPY

SEQ ID NO: 841170 - protein, 21 aa, Mycobacterium
NMVDTFVLLTLARAGDQLQGI

SEQ ID NO: 841171 - protein, 21 aa, Mycobacterium
NMVDTFVLLTLARGGDQLQGI

SEQ ID NO: 841172 - protein, 22 aa, Mycobacterium
NMVDTFVLLTLARTGDQLQGIK

SEQ ID NO: 841173 - protein, 26 aa, Mycobacterium
NMVRRKPIPFPPEPLASVGIQATRWS

SEQ ID NO: 841174 - protein, 25 aa, Mycobacterium
NNAAALLLTALTLAAPGKEIVLSRG

SEQ ID NO: 841175 - protein, 17 aa, Mycobacterium
NNAAIYGGMKLDLLLTV

SEQ ID NO: 841176 - protein, 31 aa, Mycobacterium
NNAALLPPPAPRALLALLKGPPPNSPREVIV

SEQ ID NO: 841177 - protein, 19 aa, Mycobacterium
NNAFRVPSMKPLAGTSFQH

SEQ ID NO: 841178 - protein, 17 aa, Mycobacterium
NNAGFLRDRMLANMSEE

SEQ ID NO: 841179 - protein, 28 aa, Mycobacterium
NNAIALPRVWEYNLPARYERYAQLATAM

SEQ ID NO: 841180 - protein, 23 aa, Mycobacterium
NNAPVTEWQLADGDIIRLGHSEI

SEQ ID NO: 841181 - protein, 24 aa, Mycobacterium
NNAVEYFVSYYDYYQPEAYIAQTD

SEQ ID NO: 841182 - protein, 33 aa, Mycobacterium
NNDEAAATLLYDRWFRLLAPHLDPARNVGFVGV

SEQ ID NO: 841183 - protein, 24 aa, Mycobacterium
NNDGSFPAFPLPLGDTSRLTAGEV

SEQ ID NO: 841184 - protein, 23 aa, Mycobacterium
NNEHFHAVMWAARRAGLYYVPIN

SEQ ID NO: 841185 - protein, 23 aa, Mycobacterium
NNELGHPWTVLRATESTKFLVLE

SEQ ID NO: 841186 - protein, 23 aa, Mycobacterium
NNELGHPWTVLRATRDTDFLVLE

SEQ ID NO: 841187 - protein, 26 aa, Mycobacterium
NNELGHPWTVLRATRRTDYLVLEMSA

SEQ ID NO: 841188 - protein, 22 aa, Mycobacterium
NNELRIVGAYYTLDTGIVTWLN

SEQ ID NO: 841189 - protein, 18 aa, Mycobacterium
NNFSWINNYYDDMAWLAL

SEQ ID NO: 841190 - protein, 20 aa, Mycobacterium
NNFTRLLDHVAPLGYPEVNQ

SEQ ID NO: 841191 - protein, 22 aa, Mycobacterium
NNFVICNFVPRKVDYHPLSVPV

SEQ ID NO: 841192 - protein, 30 aa, Mycobacterium
NNGASTWLEPLIWRGFENLNIPLLDVHMSG

SEQ ID NO: 841193 - protein, 21 aa, Mycobacterium
NNGGFPEFPLPLGNPKKSTSS

SEQ ID NO: 841194 - protein, 18 aa, Mycobacterium
NNGGFPEFPLPLGNPQES

SEQ ID NO: 841195 - protein, 30 aa, Mycobacterium
NNGLENYYMITYPGLPILEPLRAIPVIGNP

SEQ ID NO: 841196 - protein, 22 aa, Mycobacterium
NNGWVVAAFQAAWSAITTTASR

SEQ ID NO: 841197 - protein, 18 aa, Mycobacterium
NNHLVRKYGFYYRYDTDE

SEQ ID NO: 841198 - protein, 24 aa, Mycobacterium
NNIAILAGDYLFATASRLTSRLGP

SEQ ID NO: 841199 - protein, 20 aa, Mycobacterium
NNIAILAGDYLFATASRLVS

SEQ ID NO: 841200 - protein, 21 aa, Mycobacterium
NNIGLGLLGSNLVGVGGAYYD

SEQ ID NO: 841201 - protein, 25 aa, Mycobacterium
NNISRTAWLTVGLPDHVGATTIDCQ

SEQ ID NO: 841202 - protein, 17 aa, Mycobacterium
NNITGHWLAARGGLGIA

SEQ ID NO: 841203 - protein, 23 aa, Mycobacterium
NNLEISVVQLLRIGAALADPATL

SEQ ID NO: 841204 - protein, 18 aa, Mycobacterium
NNLLYGRGLHVCPGAPLA

SEQ ID NO: 841205 - protein, 20 aa, Mycobacterium
NNMRRMVRFATAVQAALEDG

SEQ ID NO: 841206 - protein, 25 aa, Mycobacterium
NNMVLAVQQIAIGEAFLLAEKLGLS

SEQ ID NO: 841207 - protein, 20 aa, Mycobacterium
NNMVLAVQQIAIGEAFVLAE

SEQ ID NO: 841208 - protein, 24 aa, Mycobacterium
NNNGSLPEFPLPLGNPLEPTRSDM

SEQ ID NO: 841209 - protein, 24 aa, Mycobacterium
NNNGTFPEFPLPLGNPAEATNSTM

SEQ ID NO: 841210 - protein, 23 aa, Mycobacterium
NNPGYLDWALRLTEPGAVIVVDN

SEQ ID NO: 841211 - protein, 22 aa, Mycobacterium
NNPMLTTLTQALSGQLNPNVNL

SEQ ID NO: 841212 - protein, 22 aa, Mycobacterium
NNPPIVVLAHGFAAFRELRLDA

SEQ ID NO: 841213 - protein, 26 aa, Mycobacterium
NNRRRARVHGFRLRMRTRAGRAIVSG

SEQ ID NO: 841214 - protein, 21 aa, Mycobacterium
NNRSYAILQMELQRVGTAATG

SEQ ID NO: 841215 - protein, 19 aa, Mycobacterium
NNRYRADWCRVIDFPLTEP

SEQ ID NO: 841216 - protein, 22 aa, Mycobacterium
NNSGFFNVSFIDGNSGLRNYGN

SEQ ID NO: 841217 - protein, 21 aa, Mycobacterium
NNTMFAAQIGLVAEGVRLGAR

SEQ ID NO: 841218 - protein, 25 aa, Mycobacterium
NNTPVFFIRDGLKFQHFIRSQKRRA

SEQ ID NO: 841219 - protein, 26 aa, Mycobacterium
NNTPVFFMRDPLKFQHFIRSQKRMQA

SEQ ID NO: 841220 - protein, 18 aa, Mycobacterium
NNVFYRGRGFLDGQYDDL

SEQ ID NO: 841221 - protein, 25 aa, Mycobacterium
NNVGGVFWSPLLQTSEKGWDALYRS

SEQ ID NO: 841222 - protein, 22 aa, Mycobacterium
NNVGLLLMLEYGSDEQKAAWVE

SEQ ID NO: 841223 - protein, 27 aa, Mycobacterium
NNVLTNAGSLWWRTVQAVAAEYPEVEV

SEQ ID NO: 841224 - protein, 23 aa, Mycobacterium
NNVVKVVKVVGFVASAPGFTGQP

SEQ ID NO: 841225 - protein, 19 aa, Mycobacterium
NNWLGLTPTIYDTILKRTT

SEQ ID NO: 841226 - protein, 18 aa, Mycobacterium
NNWWGFQPNDYKIIFHDL

SEQ ID NO: 841227 - protein, 24 aa, Mycobacterium
NNYIQPLFSGAIPQALFTPEQFWP

SEQ ID NO: 841228 - protein, 18 aa, Mycobacterium
NPAALVQALFNLGEMVTA

SEQ ID NO: 841229 - protein, 26 aa, Mycobacterium
NPAFDALTFEVWTPLLTGGTCVVFGG

SEQ ID NO: 841230 - protein, 21 aa, Mycobacterium
NPAFRRRYWARNHVGWRHMDD

SEQ ID NO: 841231 - protein, 20 aa, Mycobacterium
NPAIDGAVLPILHLNGYKIA

SEQ ID NO: 841232 - protein, 21 aa, Mycobacterium
NPAIDGAVLPILHLNGYKIAN

SEQ ID NO: 841233 - protein, 25 aa, Mycobacterium
NPALAHRALNAYRQIGQLLPCNVVV

SEQ ID NO: 841234 - protein, 23 aa, Mycobacterium
NPALFDAMFTRATTLPFAAAETP

SEQ ID NO: 841235 - protein, 24 aa, Mycobacterium
NPALGVRGIRISFANPGLLDRQLE

SEQ ID NO: 841236 - protein, 25 aa, Mycobacterium
NPALYDAMFIRATTLRFADADTPPE

SEQ ID NO: 841237 - protein, 23 aa, Mycobacterium
NPANRFHSWIYRARPDVQCIVHT

SEQ ID NO: 841238 - protein, 23 aa, Mycobacterium
NPAPFLHQLIANQMGYAQTAATA

SEQ ID NO: 841239 - protein, 21 aa, Mycobacterium
NPAQLALTRLKLHLLETVGSP

SEQ ID NO: 841240 - protein, 29 aa, Mycobacterium
NPAQLFETIVMLALQFVIHRTLVLINLLL

SEQ ID NO: 841241 - protein, 24 aa, Mycobacterium
NPAQRAAWLVSQLGSLPGSGIVYT

SEQ ID NO: 841242 - protein, 27 aa, Mycobacterium
NPATGRPWTADILPELSAPPAAEIEKL

SEQ ID NO: 841243 - protein, 21 aa, Mycobacterium
NPAVSQMLLPGVPLVEARDVT

SEQ ID NO: 841244 - protein, 20 aa, Mycobacterium
NPAVTARRRLRMICHGLGHV

SEQ ID NO: 841245 - protein, 20 aa, Mycobacterium
NPDAAWYYPDPSPAASDIKN

SEQ ID NO: 841246 - protein, 25 aa, Mycobacterium
NPDAELVLPFSWQGVSLHAAGAASV

SEQ ID NO: 841247 - protein, 20 aa, Mycobacterium
NPDAWFYQKPITLEQHQQSR

SEQ ID NO: 841248 - protein, 30 aa, Mycobacterium
NPDGENLDPLFDVLLEHIPPPQGDPDAPLQ

SEQ ID NO: 841249 - protein, 25 aa, Mycobacterium
NPDGFTETLTWWQIYRRAKIVAEEL

SEQ ID NO: 841250 - protein, 18 aa, Mycobacterium
NPDHLATLRFHPMQAVTA

SEQ ID NO: 841251 - protein, 19 aa, Mycobacterium
NPDHVAPAVGYLVSEENQE

SEQ ID NO: 841252 - protein, 19 aa, Mycobacterium
NPDLAFKTSFLPNDGVGLA

SEQ ID NO: 841253 - protein, 33 aa, Mycobacterium
NPDLFDESYTRWGPIQWMAPETLLTLGAHLADR

SEQ ID NO: 841254 - protein, 20 aa, Mycobacterium
NPDLKLLGALPTLYDSRTTH

SEQ ID NO: 841255 - protein, 23 aa, Mycobacterium
NPDLKMLGALPTLYDSRTTHSRD

SEQ ID NO: 841256 - protein, 21 aa, Mycobacterium
NPDLRLLGALPTLYDSRTTHT

SEQ ID NO: 841257 - protein, 23 aa, Mycobacterium
NPDNLTLLGALAAWTDRVRLLTT

SEQ ID NO: 841258 - protein, 23 aa, Mycobacterium
NPDRTRLPLPDRKFGGVMGRTMG

SEQ ID NO: 841259 - protein, 22 aa, Mycobacterium
NPDSLTLLGALAAWTDRVRLVT

SEQ ID NO: 841260 - protein, 25 aa, Mycobacterium
NPDSTYVRKPPYFDGMPAEPEPVAD

SEQ ID NO: 841261 - protein, 21 aa, Mycobacterium
NPDVFYWAHATFFMGTIIVAE

SEQ ID NO: 841262 - protein, 24 aa, Mycobacterium
NPDVFYWAHSTFFMGTILVAERFG

SEQ ID NO: 841263 - protein, 23 aa, Mycobacterium
NPEALRLQLLDALAGKMRTRSLR

SEQ ID NO: 841264 - protein, 22 aa, Mycobacterium
NPEARLFIDGRLRDSSTGKTVD

SEQ ID NO: 841265 - protein, 20 aa, Mycobacterium
NPEAVYYRRGPFAPDDITAS

SEQ ID NO: 841266 - protein, 22 aa, Mycobacterium
NPEAWRWYRKVIGADSLPIVDT

SEQ ID NO: 841267 - protein, 31 aa, Mycobacterium
NPEHLIAADLTWLLSHWSCVFGTPACQGTVA

SEQ ID NO: 841268 - protein, 31 aa, Mycobacterium
NPEHLIAADLTWLLSHWTCVFGTPACQGTVA

SEQ ID NO: 841269 - protein, 32 aa, Mycobacterium
NPEHLIAADLTWLLSRWTCVFGTPACHGTVAG

SEQ ID NO: 841270 - protein, 31 aa, Mycobacterium
NPEHLIAADLTWLLSRWTCVFGTPACQGTVE

SEQ ID NO: 841271 - protein, 26 aa, Mycobacterium
NPEIRPAHLLVALLGQTDGIAAPLLQ

SEQ ID NO: 841272 - protein, 19 aa, Mycobacterium
NPELFYWAHASFVDQVIYN

SEQ ID NO: 841273 - protein, 20 aa, Mycobacterium
NPELFYWAHATFVDQVLYTA

SEQ ID NO: 841274 - protein, 21 aa, Mycobacterium
NPELRLLGALPTLYDSRTTHT

SEQ ID NO: 841275 - protein, 17 aa, Mycobacterium
NPELYLADAIGARGLPV

SEQ ID NO: 841276 - protein, 27 aa, Mycobacterium
NPEMPLPTTLFDASVLWRAAACCRFNS

SEQ ID NO: 841277 - protein, 24 aa, Mycobacterium
NPENIYFYITVYNEPYVQPAEPEN

SEQ ID NO: 841278 - protein, 23 aa, Mycobacterium
NPENVFFYITVYNEPYVQPPEPE

SEQ ID NO: 841279 - protein, 25 aa, Mycobacterium
NPENVYFYMTIYNEPYVQPAEPEGI

SEQ ID NO: 841280 - protein, 27 aa, Mycobacterium
NPERRTLFLLRNTPWPRGAKTAAMVDE

SEQ ID NO: 841281 - protein, 23 aa, Mycobacterium
NPESRFLREIPQELIDWRRIEAP

SEQ ID NO: 841282 - protein, 33 aa, Mycobacterium
NPESRFLREIPQELIDWRRTAPAPSFSAPVSGV

SEQ ID NO: 841283 - protein, 31 aa, Mycobacterium; identical to SEQ ID NO: 220927

SEQ ID NO: 841284 - protein, 22 aa, Mycobacterium
NPESRFLREIPQELIDWRRTEA

SEQ ID NO: 841285 - protein, 41 aa, Mycobacterium
NPESRFLREIPQELIEWRRTAPAPSFSAPVSGAGRFGAPRA

SEQ ID NO: 841286 - protein, 25 aa, Mycobacterium
NPESRLLTIILMRCGLRVGDATKIA

SEQ ID NO: 841287 - protein, 22 aa, Mycobacterium
NPFDPTRWQPVPGFEDLTDITY

SEQ ID NO: 841288 - protein, 19 aa, Mycobacterium
NPFIGSHPGMPWDPPDHLG

SEQ ID NO: 841289 - protein, 22 aa, Mycobacterium
NPFKLVLNIIKMLRSVTSFLDL

SEQ ID NO: 841290 - protein, 18 aa, Mycobacterium
NPFLTISMFAERTAELMR

SEQ ID NO: 841291 - protein, 22 aa, Mycobacterium
NPFPAMPSLADLFCRPNGVPKL

SEQ ID NO: 841292 - protein, 27 aa, Mycobacterium
NPFRFNDDLIIMPLQAASQWDALSHVY

SEQ ID NO: 841293 - protein, 17 aa, Mycobacterium
NPFRPRKLTSRGVEATI

SEQ ID NO: 841294 - protein, 20 aa, Mycobacterium
NPFTLLAVTAARWPNRAAVI

SEQ ID NO: 841295 - protein, 32 aa, Mycobacterium
NPGAFSYSHVLWLLLLSMGFGSRLHLFTAGSQ

SEQ ID NO: 841296 - protein, 17 aa, Mycobacterium
NPGAPPRRALYDAVLRA

SEQ ID NO: 841297 - protein, 32 aa, Mycobacterium
NPGDALFFGHGLNIHFDLIKPPADVTVAMVAP

SEQ ID NO: 841298 - protein, 26 aa, Mycobacterium
NPGKAGLMGWGLTLSIWCSEWVPFES

SEQ ID NO: 841299 - protein, 27 aa, Mycobacterium
NPGLGKVLPFVLYETLGPTLPEGLSGA

SEQ ID NO: 841300 - protein, 24 aa, Mycobacterium
NPGLSLLRHMIANRLPFGVVEVKS

SEQ ID NO: 841301 - protein, 24 aa, Mycobacterium
NPGMFNRIHIDYYGASTPITQLSS

SEQ ID NO: 841302 - protein, 18 aa, Mycobacterium
NPGQYYLHLFDTEQPDLN

SEQ ID NO: 841303 - protein, 24 aa, Mycobacterium
NPGRPIWGHGWDESAWPERSAPNT

SEQ ID NO: 841304 - protein, 24 aa, Mycobacterium
NPGSILPSGLIQPATTTANPTVAK

SEQ ID NO: 841305 - protein, 24 aa, Mycobacterium
NPGSLLPSGLVPTATTLSAANTTA

SEQ ID NO: 841306 - protein, 23 aa, Mycobacterium
NPGTSAWITLSYAAAVKPGDHVL

SEQ ID NO: 841307 - protein, 21 aa, Mycobacterium
NPGWLYATRLRQMKTLLSEGI

SEQ ID NO: 841308 - protein, 25 aa, Mycobacterium
NPHHDIPQLLSMYKAGKLNLDDMVT

SEQ ID NO: 841309 - protein, 25 aa, Mycobacterium
NPHHDIPQLLSMYKAGRLNLDDMVT

SEQ ID NO: 841310 - protein, 25 aa, Mycobacterium
NPHTLQLIMDSLRYWVTEMHVDGFR

SEQ ID NO: 841311 - protein, 17 aa, Mycobacterium
NPHVLRPHLLCAATELP

SEQ ID NO: 841312 - protein, 17 aa, Mycobacterium
NPIAALDRWSDPKMGVA

SEQ ID NO: 841313 - protein, 24 aa, Mycobacterium
NPIASIFAWTRGLAHRGKLDDTPE

SEQ ID NO: 841314 - protein, 19 aa, Mycobacterium
NPINFNKFMIGNEDSPLTV

SEQ ID NO: 841315 - protein, 28 aa, Mycobacterium
NPIQSLQQIFVVQGKPAIYARTAVALVK

SEQ ID NO: 841316 - protein, 25 aa, Mycobacterium
NPIVPYVDRILYLVDGRFQIGTVDE

SEQ ID NO: 841317 - protein, 19 aa, Mycobacterium
NPIWDVRLTDTSLRDGSHH

SEQ ID NO: 841318 - protein, 19 aa, Mycobacterium
NPKAFFYGKPITIEDHQNS

SEQ ID NO: 841319 - protein, 21 aa, Mycobacterium
NPKARLRFEITMEQALNAPTV

SEQ ID NO: 841320 - protein, 31 aa, Mycobacterium
NPKEIWDVFAEEYLAPITPLERIRQKVTASE

SEQ ID NO: 841321 - protein, 19 aa, Mycobacterium
NPKFPALQQAGVRYRWDGE

SEQ ID NO: 841322 - protein, 27 aa, Mycobacterium
NPKIYPALHDYLRASGVPLLAVWGDKD

SEQ ID NO: 841323 - protein, 18 aa, Mycobacterium
NPKLPLRGEAIRDPRLGM

SEQ ID NO: 841324 - protein, 22 aa, Mycobacterium
NPKPLGMPLQYMVSGMAVAATH

SEQ ID NO: 841325 - protein, 22 aa, Mycobacterium
NPKPLGMPLQYMVSGMAVRATN

SEQ ID NO: 841326 - protein, 23 aa, Mycobacterium
NPKPLGMPLQYMVSGMAVRATNK

SEQ ID NO: 841327 - protein, 26 aa, Mycobacterium
NPKSDIALLATLYESGRLLLDEMITK

SEQ ID NO: 841328 - protein, 18 aa, Mycobacterium
NPLFDPVLAVLGPPATST

SEQ ID NO: 841329 - protein, 31 aa, Mycobacterium
NPLGWCDIRIQDLRLLPLLDGPGQTDAGVPE

SEQ ID NO: 841330 - protein, 25 aa, Mycobacterium
NPLHSDPWFAKELAGFPKPILHGLC

SEQ ID NO: 841331 - protein, 28 aa, Mycobacterium
NPLHSDPWFAQLAGFRRPILHGLCTYGV

SEQ ID NO: 841332 - protein, 26 aa, Mycobacterium
NPLIRVLEDAMRFYFEFHHDQGEGYL

SEQ ID NO: 841333 - protein, 17 aa, Mycobacterium
NPLLSIADIAAISALGA

SEQ ID NO: 841334 - protein, 17 aa, Mycobacterium
NPLRDKLDKRLPRIAGS

SEQ ID NO: 841335 - protein, 20 aa, Mycobacterium
NPLRFASAAMKWCRKAAELG

SEQ ID NO: 841336 - protein, 20 aa, Mycobacterium
NPLTLYWCYDANGVLRCVVA

SEQ ID NO: 841337 - protein, 20 aa, Mycobacterium
NPLVGLYTTSDERYISFVMM

SEQ ID NO: 841338 - protein, 17 aa, Mycobacterium
NPLVLDALKAGASGWCT

SEQ ID NO: 841339 - protein, 18 aa, Mycobacterium
NPMIGFRGASRYAHPAYA

SEQ ID NO: 841340 - protein, 26 aa, Mycobacterium
NPMIGYRGCYRYIKEPDLFALELSAL

SEQ ID NO: 841341 - protein, 18 aa, Mycobacterium
NPMLGFRGASRYAHPAYA

SEQ ID NO: 841342 - protein, 20 aa, Mycobacterium
NPMLHRVSRLLALVTNRVLN

SEQ ID NO: 841343 - protein, 19 aa, Mycobacterium
NPNHIVICSGFHHGLQLIA

SEQ ID NO: 841344 - protein, 28 aa, Mycobacterium
NPNIDFIVCFFHHCAYSTTLSHASDGGV

SEQ ID NO: 841345 - protein, 21 aa, Mycobacterium
NPNLRLLGALPTLYDSRTTHT

SEQ ID NO: 841346 - protein, 25 aa, Mycobacterium
NPNLRPLVKGPFYAVKMVLSDLGTC

SEQ ID NO: 841347 - protein, 24 aa, Mycobacterium
NPPDDVIILPWNIAHEVRTQLADL

SEQ ID NO: 841348 - protein, 18 aa, Mycobacterium
NPPDPIPAVFFGGSSAAA

SEQ ID NO: 841349 - protein, 27 aa, Mycobacterium
NPPGTVTVFPDGRIRSIALSPGVVRMS

SEQ ID NO: 841350 - protein, 25 aa, Mycobacterium
NPPNPFAWIPFGGGMMRCIGASFAT

SEQ ID NO: 841351 - protein, 27 aa, Mycobacterium
NPPTPPMLGVFRPKRWPMKTTPQEPVP

SEQ ID NO: 841352 - protein, 25 aa, Mycobacterium
NPQAACDGPRFRWVQGLKVSCEKGF

SEQ ID NO: 841353 - protein, 21 aa, Mycobacterium
NPQDLGLPMRRAIRRTQGLRR

SEQ ID NO: 841354 - protein, 24 aa, Mycobacterium
NPQNRVRRYVCLKGPDHGGCGRLT

SEQ ID NO: 841355 - protein, 29 aa, Mycobacterium
NPQRVLGLHFFNPVPVLPLVELVCTLVTD

SEQ ID NO: 841356 - protein, 29 aa, Mycobacterium
NPQRVLGLHFFNPVPVLPLVELVSTLVTD

SEQ ID NO: 841357 - protein, 30 aa, Mycobacterium
NPQRVLGLHFFNPVPVLPLVELVTTLVTDE

SEQ ID NO: 841358 - protein, 20 aa, Mycobacterium
NPQSWKLLRGKVALPSHAAL

SEQ ID NO: 841359 - protein, 25 aa, Mycobacterium
NPQYDIVRLLRLYDAGQLKLDELIT

SEQ ID NO: 841360 - protein, 17 aa, Mycobacterium
NPRDALASAGKTLVELF

SEQ ID NO: 841361 - protein, 26 aa, Mycobacterium
NPREGTVSMRWTLLAMIQEFARHAGH

SEQ ID NO: 841362 - protein, 25 aa, Mycobacterium
NPRELAGWLAEALAASDGIAAADVA

SEQ ID NO: 841363 - protein, 26 aa, Mycobacterium
NPRELAGWLATALTAADGIAVAEVAG

SEQ ID NO: 841364 - protein, 20 aa, Mycobacterium
NPRGRLAVMAAEQGWPVLRL

SEQ ID NO: 841365 - protein, 28 aa, Mycobacterium
NPRHDIPRMLDLYRAGRLKLDELVTREY

SEQ ID NO: 841366 - protein, 21 aa, Mycobacterium
NPRLAADFWHGLFGHSVTWED

SEQ ID NO: 841367 - protein, 26 aa, Mycobacterium
NPRNDIPKMLKLWDSGQINLDGLVTK

SEQ ID NO: 841368 - protein, 20 aa, Mycobacterium
NPRPEFVERIRLHQLAVGNH

SEQ ID NO: 841369 - protein, 20 aa, Mycobacterium
NPRPYRDYISWLAQQDTGAA

SEQ ID NO: 841370 - protein, 17 aa, Mycobacterium
NPRSYARTWRYLLDMDL

SEQ ID NO: 841371 - protein, 26 aa, Mycobacterium
NPRTSVPMLLSLYQAGELKLDELVTR

SEQ ID NO: 841372 - protein, 21 aa, Mycobacterium
NPRVLEMIRNALESKRLVIEQ

SEQ ID NO: 841373 - protein, 24 aa, Mycobacterium
NPSANFFCLGPLMAQALYVEGNEE

SEQ ID NO: 841374 - protein, 22 aa, Mycobacterium
NPSATWRFRLTPRDGGTVLTYR

SEQ ID NO: 841375 - protein, 18 aa, Mycobacterium
NPSGPYLQAASGTDGLSG

SEQ ID NO: 841376 - protein, 17 aa, Mycobacterium
NPSHLFALDALFATYPD

SEQ ID NO: 841377 - protein, 26 aa, Mycobacterium
NPSKTLIRPIEVFNLARAVPGVRETI

SEQ ID NO: 841378 - protein, 21 aa, Mycobacterium
NPSPHIPWDSLPVRVVDTAMP

SEQ ID NO: 841379 - protein, 22 aa, Mycobacterium
NPSQLMQLANWMHSYRPEELFD

SEQ ID NO: 841380 - protein, 29 aa, Mycobacterium
NPTALAAETPLPVLVAALGPVMLQIAGEL

SEQ ID NO: 841381 - protein, 28 aa, Mycobacterium
NPTLSKVLPFVLYETLGPALPDGMAGAA

SEQ ID NO: 841382 - protein, 23 aa, Mycobacterium
NPTLSLVRRYAKAVGAVFTVDVR

SEQ ID NO: 841383 - protein, 27 aa, Mycobacterium
NPTPKGCIFEYVYLARPDSTLAGRSVH

SEQ ID NO: 841384 - protein, 24 aa, Mycobacterium
NPTRRQIHQFLAWAVHRGYAHDVA

SEQ ID NO: 841385 - protein, 22 aa, Mycobacterium
NPTSSYLWRNIIPHVSDRARCI

SEQ ID NO: 841386 - protein, 29 aa, Mycobacterium
NPTVAKLLPFVLYETLGPTLPDGLRGAAA

SEQ ID NO: 841387 - protein, 21 aa, Mycobacterium
NPVAKLMWRICRIDGPPSRYR

SEQ ID NO: 841388 - protein, 21 aa, Mycobacterium
NPVALGQLWWNKEFCRIVVID

SEQ ID NO: 841389 - protein, 22 aa, Mycobacterium
NPVCTAAALAVLRTLATEDLVR

SEQ ID NO: 841390 - protein, 17 aa, Mycobacterium
NPVFRNALRRLRNVNLL

SEQ ID NO: 841391 - protein, 27 aa, Mycobacterium
NPVHPLALTLLHPQQVIMLGRPTLHRQ

SEQ ID NO: 841392 - protein, 23 aa, Mycobacterium
NPVKLRLGIGYVIQNAGLMPHQR

SEQ ID NO: 841393 - protein, 34 aa, Mycobacterium
NPVLAEWFLRRFSLLDSLYMIPPPRIVGRTIAHN

SEQ ID NO: 841394 - protein, 28 aa, Mycobacterium
NPVLAEWFLRRISLLDSLYTVPSAPIIG

SEQ ID NO: 841395 - protein, 20 aa, Mycobacterium
NPVLEPLVAVHREIYPKADL

SEQ ID NO: 841396 - protein, 19 aa, Mycobacterium
NPVLEPLVAVHREIYPKAN

SEQ ID NO: 841397 - protein, 20 aa, Mycobacterium
NPVLEPLVAVHREIYPKANL

SEQ ID NO: 841398 - protein, 21 aa, Mycobacterium
NPVLHPYMTVLADSALDEARQ

SEQ ID NO: 841399 - protein, 17 aa, Mycobacterium
NPVLLKPGSDHRSHVVL

SEQ ID NO: 841400 - protein, 22 aa, Mycobacterium
NPVNWPRVLTVWRANLIGSSGK

SEQ ID NO: 841401 - protein, 33 aa, Mycobacterium
NPVPKNFIDDFVLYWSFLAFALVRGGRRTFGAS

SEQ ID NO: 841402 - protein, 19 aa, Mycobacterium
NPVPPLYFGGSSAAAGPVA

SEQ ID NO: 841403 - protein, 24 aa, Mycobacterium
NPVPSLRVVILSGARLDPSLARRF

SEQ ID NO: 841404 - protein, 24 aa, Mycobacterium
NPVQRLWAGWAPSFAIIEHKGRKS

SEQ ID NO: 841405 - protein, 22 aa, Mycobacterium
NPVQRLWAGWLPPFAIVEHVGR

SEQ ID NO: 841406 - protein, 27 aa, Mycobacterium
NPVREAIHAVFLYHAIKAGLDMGIVNA

SEQ ID NO: 841407 - protein, 20 aa, Mycobacterium
NPVRLAEAIRRFGPIFAQYY

SEQ ID NO: 841408 - protein, 23 aa, Mycobacterium
NPVRLRAERVWIVDPLDGTREFS

SEQ ID NO: 841409 - protein, 27 aa, Mycobacterium
NPVTARAQMIGGIIWGWGKATLEASTQ

SEQ ID NO: 841410 - protein, 22 aa, Mycobacterium
NPVTLVRSLRRFSRTPMFTADA

SEQ ID NO: 841411 - protein, 26 aa, Mycobacterium
NPVWDQRFLEIIDGGWLAELDQWSNS

SEQ ID NO: 841412 - protein, 26 aa, Mycobacterium
NPVYRLITVILMRCGLRITDALRLRG

SEQ ID NO: 841413 - protein, 21 aa, Mycobacterium
NPYARVIADEALRRGIFVEVL

SEQ ID NO: 841414 - protein, 18 aa, Mycobacterium
NPYLLRAAKFHGKQSSVM

SEQ ID NO: 841415 - protein, 21 aa, Mycobacterium
NPYLSQIERGLRRPSAEVLNQ

SEQ ID NO: 841416 - protein, 26 aa, Mycobacterium
NPYTTAPGSTFRWYRGRQLGGRLHTW

SEQ ID NO: 841417 - protein, 18 aa, Mycobacterium
NPYYHYLLSDIYSSEWLG

SEQ ID NO: 841418 - protein, 18 aa, Mycobacterium
NQAALPPPGPRQLAAILQ

SEQ ID NO: 841419 - protein, 26 aa, Mycobacterium
NQAEYILKFDWLSISGLTARIYIGHI

SEQ ID NO: 841420 - protein, 17 aa, Mycobacterium
NQAIHWLYECCASRIWA

SEQ ID NO: 841421 - protein, 27 aa, Mycobacterium
NQAMKSLHLILHNFKMPGFQVPEFRRK

SEQ ID NO: 841422 - protein, 35 aa, Mycobacterium
NQAMKSLHLILRHFKMPGFLVPEFRRKAVIIAVGG

SEQ ID NO: 841423 - protein, 26 aa, Mycobacterium
NQAPLSFPIPGWNICVDFPIKAGLNE

SEQ ID NO: 841424 - protein, 18 aa, Mycobacterium
NQDDLDAIIAQWAAQRLP

SEQ ID NO: 841425 - protein, 17 aa, Mycobacterium
NQDELDNIIGCWAAERQ

SEQ ID NO: 841426 - protein, 25 aa, Mycobacterium
NQDLSAVGDWMLMAAIDALIDGHEY

SEQ ID NO: 841427 - protein, 21 aa, Mycobacterium
NQDMFTAALGGLIDRFNLRGE

SEQ ID NO: 841428 - protein, 17 aa, Mycobacterium
NQDTPWVDPLIAAAAMG

SEQ ID NO: 841429 - protein, 23 aa, Mycobacterium
NQEAYLMRYFAKHAPDPAGFNSG

SEQ ID NO: 841430 - protein, 28 aa, Mycobacterium
NQEFGHRTLYEILRFCAFFAATGDTDGD

SEQ ID NO: 841431 - protein, 21 aa, Mycobacterium
NQELYLATATALRDAADDPEV

SEQ ID NO: 841432 - protein, 20 aa, Mycobacterium
NQEMLWNRLCEALTPGNVVL

SEQ ID NO: 841433 - protein, 24 aa, Mycobacterium
NQENVMNPATWSGDAVAASHATAI

SEQ ID NO: 841434 - protein, 18 aa, Mycobacterium
NQFGSCQAIWRLDDGYVA

SEQ ID NO: 841435 - protein, 18 aa, Mycobacterium
NQFGSCQAIWRLDGGYFA

SEQ ID NO: 841436 - protein, 20 aa, Mycobacterium
NQFHYYRLTADNRIVWGGYD

SEQ ID NO: 841437 - protein, 26 aa, Mycobacterium
NQFKYIANEFPLTVLLIGIGLHERNA

SEQ ID NO: 841438 - protein, 18 aa, Mycobacterium
NQFNYKTPQRILIDNRTG

SEQ ID NO: 841439 - protein, 25 aa, Mycobacterium
NQGLELWLAEFPQPRPPRETWSQNP

SEQ ID NO: 841440 - protein, 35 aa, Mycobacterium
NQGVIWQTLYPFDWLARLPIPVNRRFRSAITDVRD

SEQ ID NO: 841441 - protein, 31 aa, Mycobacterium
NQGVLINMPRGLLEFGPNSLPPIVQLNGAPG

SEQ ID NO: 841442 - protein, 17 aa, Mycobacterium
NQGWRGSAGFMAGFRRA

SEQ ID NO: 841443 - protein, 20 aa, Mycobacterium
NQGYTMDPFAPFGGVKASGY

SEQ ID NO: 841444 - protein, 24 aa, Mycobacterium
NQHGPHSILFYTKTKTVTSRWPSG

SEQ ID NO: 841445 - protein, 39 aa, Mycobacterium
NQHTVVALLYLDFDLFEPTLAAIRTFLPRMPKGAVLAFD

SEQ ID NO: 841446 - protein, 24 aa, Mycobacterium
NQIGVPLRLFVYDCAETRGGGTRH

SEQ ID NO: 841447 - protein, 20 aa, Mycobacterium
NQILGRALGLSTYKMVFGHR

SEQ ID NO: 841448 - protein, 19 aa, Mycobacterium
NQILRFYDANRRLLAEMAP

SEQ ID NO: 841449 - protein, 23 aa, Mycobacterium
NQKHRFMVLPVRPDGTQGWTEEQ

SEQ ID NO: 841450 - protein, 21 aa, Mycobacterium
NQKLRTLALGDFRTLAYAMLT

SEQ ID NO: 841451 - protein, 18 aa, Mycobacterium
NQKWLRRDFGNKLPSEVF

SEQ ID NO: 841452 - protein, 19 aa, Mycobacterium
NQLAAPDLLAWAHEGRRGC

SEQ ID NO: 841453 - protein, 25 aa, Mycobacterium
NQLAGVVGPLFRSALRSAEVRRRVS

SEQ ID NO: 841454 - protein, 21 aa, Mycobacterium
NQLAPPDLLAWAHEGRRGCDP

SEQ ID NO: 841455 - protein, 29 aa, Mycobacterium
NQLDPYLPDFVMCRPELAPVLLDAIRQVW

SEQ ID NO: 841456 - protein, 30 aa, Mycobacterium
NQLDRWITARRLRTMGWRHDGALVKARVNE

SEQ ID NO: 841457 - protein, 21 aa, Mycobacterium
NQLIQLLDDYQRRGTWRRIGL

SEQ ID NO: 841458 - protein, 21 aa, Mycobacterium
NQLMKLTEVWQGAGSLAASGE

SEQ ID NO: 841459 - protein, 24 aa, Mycobacterium
NQLPAMFADVRRGLTIAAVVHAAT

SEQ ID NO: 841460 - protein, 24 aa, Mycobacterium
NQLPAMFADVRRGLTVAAVVYAAT

SEQ ID NO: 841461 - protein, 21 aa, Mycobacterium
NQLRRMLADFGIDIDRYGLDD

SEQ ID NO: 841462 - protein, 19 aa, Mycobacterium
NQLSVLSPLIVNKAQETKV

SEQ ID NO: 841463 - protein, 17 aa, Mycobacterium
NQLVDRFFEARKMMSQM

SEQ ID NO: 841464 - protein, 24 aa, Mycobacterium
NQPGFLGFQLLRPIKGENRYFVVT

SEQ ID NO: 841465 - protein, 27 aa, Mycobacterium
NQQKVLLARWLITEPDLFILDEPTRGI

SEQ ID NO: 841466 - protein, 26 aa, Mycobacterium
NQQKVVLARWLTGKVNVLLLDEPTRG

SEQ ID NO: 841467 - protein, 24 aa, Mycobacterium
NQQKVVLSKWLFTDPDVLILDEPT

SEQ ID NO: 841468 - protein, 23 aa, Mycobacterium
NQQPWKFVVLKSSSLRDVVTAAA

SEQ ID NO: 841469 - protein, 23 aa, Mycobacterium
NQQRTVLEGRLEQLRTFEREYRT

SEQ ID NO: 841470 - protein, 26 aa, Mycobacterium
NQQSTALLGRPLIGNGADGAAPGQSG

SEQ ID NO: 841471 - protein, 20 aa, Mycobacterium
NQRTILIDGHRLRDHSWGPR

SEQ ID NO: 841472 - protein, 25 aa, Mycobacterium
NQSPYPPGGPIPRKYYRTLDPFVAL

SEQ ID NO: 841473 - protein, 28 aa, Mycobacterium
NQSSGRIKLAWFLLNAARYMPAQLYASD

SEQ ID NO: 841474 - protein, 21 aa, Mycobacterium
NQTIYSFTGASPRFLLEFSRS

SEQ ID NO: 841475 - protein, 29 aa, Mycobacterium
NQTRLLVLHAAWLLDTVGIMGALSAVSEI

SEQ ID NO: 841476 - protein, 22 aa, Mycobacterium
NQVASSLLRLGVRKGDRVAILL

SEQ ID NO: 841477 - protein, 17 aa, Mycobacterium
NQVELEIMPAWGGAERL

SEQ ID NO: 841478 - protein, 28 aa, Mycobacterium
NQVNFYDRFCHLVLLSVPVDVAIARVSA

SEQ ID NO: 841479 - protein, 23 aa, Mycobacterium
NQYDQYIALALAITKAQSTDGAA

SEQ ID NO: 841480 - protein, 26 aa, Mycobacterium
NRAALNYELTLFLLRSPEARDRLAAQ

SEQ ID NO: 841481 - protein, 24 aa, Mycobacterium
NRAANRWDLVYRFDYQSSTAEQTS

SEQ ID NO: 841482 - protein, 18 aa, Mycobacterium
NRAARLRSLATGGQILCS

SEQ ID NO: 841483 - protein, 29 aa, Mycobacterium
NRACEALYHFAWDEFCDWYLELAKVQLGQ

SEQ ID NO: 841484 - protein, 25 aa, Mycobacterium
NRACEALYHFAWDEFCDWYVELAKV

SEQ ID NO: 841485 - protein, 24 aa, Mycobacterium
NRADLLQAAGKYPPPPGASEIIGL

SEQ ID NO: 841486 - protein, 24 aa, Mycobacterium
NRADLLQAAGKYPPPPGASEIIGM

SEQ ID NO: 841487 - protein, 22 aa, Mycobacterium
NRAELLALIATNFFGQNTAAIA

SEQ ID NO: 841488 - protein, 22 aa, Mycobacterium
NRAELLMLIATNVLGQNSPAIA

SEQ ID NO: 841489 - protein, 25 aa, Mycobacterium
NRAGSARAWWVLRAAGIEDVRILDG

SEQ ID NO: 841490 - protein, 25 aa, Mycobacterium
NRAGSARAWWVLTAAGLDNVRILDG

SEQ ID NO: 841491 - protein, 17 aa, Mycobacterium
NRAIIVRRLLGLEGVLS

SEQ ID NO: 841492 - protein, 24 aa, Mycobacterium
NRAIIVRRLLGLEPVLSIGFCGPT

SEQ ID NO: 841493 - protein, 17 aa, Mycobacterium
NRAIIVRRLLGLESVLS

SEQ ID NO: 841494 - protein, 18 aa, Mycobacterium
NRALAHRSVMALCLFDAE

SEQ ID NO: 841495 - protein, 24 aa, Mycobacterium
NRANTPLLFLHNTTGYMVGKDYEE

SEQ ID NO: 841496 - protein, 29 aa, Mycobacterium
NRARDELLTAIRRLPLLGPPGAQVSYSSP

SEQ ID NO: 841497 - protein, 19 aa, Mycobacterium
NRASAWIAEGLFGYLAPGA

SEQ ID NO: 841498 - protein, 24 aa, Mycobacterium
NRAVLARSWVPVSIPGLFAAQATR

SEQ ID NO: 841499 - protein, 22 aa, Mycobacterium
NRAVLARSWVPVSIPGLFAAQV

SEQ ID NO: 841500 - protein, 25 aa, Mycobacterium
NRAVLAVYRPLLAPLGITHPQYLVM

SEQ ID NO: 841501 - protein, 24 aa, Mycobacterium
NRDALARLAPMRAVLSAGAAQLSV

SEQ ID NO: 841502 - protein, 30 aa, Mycobacterium
NRDEATFANPWLFDLARTPNPHFGFGGGGA

SEQ ID NO: 841503 - protein, 23 aa, Mycobacterium
NRDEFFSMTARLLGKVVPGAVAE

SEQ ID NO: 841504 - protein, 20 aa, Mycobacterium
NRDFNALVYVLSGRGSVGPV

SEQ ID NO: 841505 - protein, 24 aa, Mycobacterium
NRDHGPPYSPEFLVRYRAAQVARN

SEQ ID NO: 841506 - protein, 26 aa, Mycobacterium
NRDKRSLVFPVKRLADLGFKILATEG

SEQ ID NO: 841507 - protein, 26 aa, Mycobacterium
NRDKRSLVFPVKRLADLGFTVLATEG

SEQ ID NO: 841508 - protein, 18 aa, Mycobacterium
NRDKVYFPKLGKQGTKGR

SEQ ID NO: 841509 - protein, 17 aa, Mycobacterium
NRDLDWLVQLRDSKVRE

SEQ ID NO: 841510 - protein, 20 aa, Mycobacterium
NRDLMRLALPVIKADYRAFD

SEQ ID NO: 841511 - protein, 23 aa, Mycobacterium
NRDSYALPPIGLTADEAAAVAVA

SEQ ID NO: 841512 - protein, 20 aa, Mycobacterium
NRDWEVVGVRDGLNGLLLPD

SEQ ID NO: 841513 - protein, 23 aa, Mycobacterium
NREAFDRWGLMPRMFVGAAERDL

SEQ ID NO: 841514 - protein, 23 aa, Mycobacterium
NREFNALVYVLSGRGTVGALGHP

SEQ ID NO: 841515 - protein, 26 aa, Mycobacterium
NREKLTEIPVLWAYARDLYQTPGFGD

SEQ ID NO: 841516 - protein, 17 aa, Mycobacterium
NRELTAELALALGSAAA

SEQ ID NO: 841517 - protein, 23 aa, Mycobacterium
NREQLLLLIATNFFGQNTSAIAA

SEQ ID NO: 841518 - protein, 25 aa, Mycobacterium
NREYALLLRHPQPRPWLVCIHGTEM

SEQ ID NO: 841519 - protein, 18 aa, Mycobacterium
NRFFSATWSAIARREPQE

SEQ ID NO: 841520 - protein, 18 aa, Mycobacterium
NRFGGLDILVNNAGILNI

SEQ ID NO: 841521 - protein, 20 aa, Mycobacterium
NRFHSWIYRERPDVQCIVHT

SEQ ID NO: 841522 - protein, 24 aa, Mycobacterium
NRFPPQLEMRLLFEEPMVFVCRPD

SEQ ID NO: 841523 - protein, 26 aa, Mycobacterium
NRFRRAVPPVPAPTARRASRRPSAQR

SEQ ID NO: 841524 - protein, 25 aa, Mycobacterium
NRFRRRVFVYARDWPGESPLQASYD

SEQ ID NO: 841525 - protein, 20 aa, Mycobacterium
NRFRTEYEIVNVGDIARLFP

SEQ ID NO: 841526 - protein, 18 aa, Mycobacterium
NRFRTEYEIVNVGDIGRL

SEQ ID NO: 841527 - protein, 22 aa, Mycobacterium
NRFSFDWWHSLKQLGATHCLLV

SEQ ID NO: 841528 - protein, 18 aa, Mycobacterium
NRFWLGKVNLTMAMAKGT

SEQ ID NO: 841529 - protein, 19 aa, Mycobacterium
NRFYSSPQNLLFPGVARVM

SEQ ID NO: 841530 - protein, 37 aa, Mycobacterium
NRGAPRPVLRVAPLSVAGLLRQRVFSRSTVVLTSATL

SEQ ID NO: 841531 - protein, 27 aa, Mycobacterium
NRGDGPARVLLLGGAPFTEELVMWWNF

SEQ ID NO: 841532 - protein, 26 aa, Mycobacterium
NRGEIARRVFATCRKLGLGTVAVYSD

SEQ ID NO: 841533 - protein, 28 aa, Mycobacterium
NRGKLEALLRVLEPFGIREIAQSGMVSL

SEQ ID NO: 841534 - protein, 20 aa, Mycobacterium
NRGMIFLHEDPDRAWAELGD

SEQ ID NO: 841535 - protein, 20 aa, Mycobacterium
NRGWDVVGIRDGLNGLLLPE

SEQ ID NO: 841536 - protein, 20 aa, Mycobacterium
NRGWIINWRSTGDPVGFCTW

SEQ ID NO: 841537 - protein, 17 aa, Mycobacterium
NRHLWGHFARHGDGITP

SEQ ID NO: 841538 - protein, 26 aa, Mycobacterium
NRHQLRTRFRTLYPNVYVPKTSEPTL

SEQ ID NO: 841539 - protein, 23 aa, Mycobacterium
NRHSGWTLATFPPGYSGPTDVFK

SEQ ID NO: 841540 - protein, 25 aa, Mycobacterium
NRHYYAYAPGFYKDAGEWFVERKVK

SEQ ID NO: 841541 - protein, 19 aa, Mycobacterium
NRIAFLDHVAFLRLRATGV

SEQ ID NO: 841542 - protein, 20 aa, Mycobacterium
NRIDLLIGHGRFVDPHTIEV

SEQ ID NO: 841543 - protein, 19 aa, Mycobacterium
NRIDLLLGHGRFVDPHTIE

SEQ ID NO: 841544 - protein, 19 aa, Mycobacterium
NRIDPVGWLAKRGLSPGSY

SEQ ID NO: 841545 - protein, 23 aa, Mycobacterium
NRIDRRLVIDPRARDLAAGILAV

SEQ ID NO: 841546 - protein, 19 aa, Mycobacterium
NRIEIVIAMLGIVKAGAIL

SEQ ID NO: 841547 - protein, 24 aa, Mycobacterium
NRIGADVLLLNTSFSGPALAEVVS

SEQ ID NO: 841548 - protein, 21 aa, Mycobacterium
NRIIIAYSPLAQGLLGGKYGV

SEQ ID NO: 841549 - protein, 24 aa, Mycobacterium
NRIPFPLTAWAVRLLTQLPQRGVT

SEQ ID NO: 841550 - protein, 17 aa, Mycobacterium
NRITLARIALPVAEADP

SEQ ID NO: 841551 - protein, 19 aa, Mycobacterium
NRIVGADLLEPLSAYAQID

SEQ ID NO: 841552 - protein, 20 aa, Mycobacterium
NRKYRLLGPLSEFGVWITRR

SEQ ID NO: 841553 - protein, 23 aa, Mycobacterium
NRLAHLLAERGAGPGTFVALLFS

SEQ ID NO: 841554 - protein, 18 aa, Mycobacterium
NRLAHWQPLANLAIEPET

SEQ ID NO: 841555 - protein, 19 aa, Mycobacterium
NRLAKKALSSPDRPVRRLM

SEQ ID NO: 841556 - protein, 23 aa, Mycobacterium
NRLATAQLTRRLTRWTRLYPDVR

SEQ ID NO: 841557 - protein, 26 aa, Mycobacterium
NRLATQRIQMPLPSAQARLLATIEAQ

SEQ ID NO: 841558 - protein, 20 aa, Mycobacterium
NRLCAQILLLAAEDASKDIN

SEQ ID NO: 841559 - protein, 19 aa, Mycobacterium
NRLGAYSARLWLPLLRAER

SEQ ID NO: 841560 - protein, 18 aa, Mycobacterium
NRLGFGAMRLTAKGVWGP

SEQ ID NO: 841561 - protein, 20 aa, Mycobacterium
NRLLFEALTGICAHVRHGGG

SEQ ID NO: 841562 - protein, 17 aa, Mycobacterium
NRLMVYREGNTSRFAGP

SEQ ID NO: 841563 - protein, 36 aa, Mycobacterium
NRLMVYRRTLSRRWAGPAFLLNQMLVWGFTGQVISA

SEQ ID NO: 841564 - protein, 17 aa, Mycobacterium
NRLNLALTLKEGGNLIL

SEQ ID NO: 841565 - protein, 19 aa, Mycobacterium
NRLPAYRSIATPVLVIGFS

SEQ ID NO: 841566 - protein, 17 aa, Mycobacterium
NRLPQVAALFAEGTISA

SEQ ID NO: 841567 - protein, 24 aa, Mycobacterium
NRLREQPIASVPLLAEGIASALPA

SEQ ID NO: 841568 - protein, 23 aa, Mycobacterium
NRLSQLWFEALAGICAHVRAGGG

SEQ ID NO: 841569 - protein, 19 aa, Mycobacterium
NRLVIAYSPLAQGLLGGKY

SEQ ID NO: 841570 - protein, 23 aa, Mycobacterium
NRLVVAALHWDGDVKGLIASHFK

SEQ ID NO: 841571 - protein, 24 aa, Mycobacterium
NRLVVAALHWDGPVSGLIASHLKA

SEQ ID NO: 841572 - protein, 27 aa, Mycobacterium
NRLVVPVRVFWVPGGLPTRLKVVALMS

SEQ ID NO: 841573 - protein, 21 aa, Mycobacterium
NRLYLELMIAHHAGAIKMART

SEQ ID NO: 841574 - protein, 27 aa, Mycobacterium
NRMDAVVRQWLDYGLTFRDSYLTCWQG

SEQ ID NO: 841575 - protein, 19 aa, Mycobacterium
NRMGLLLEVLAAAELIAVG

SEQ ID NO: 841576 - protein, 18 aa, Mycobacterium
NRMICDPYPRLLVARDQV

SEQ ID NO: 841577 - protein, 29 aa, Mycobacterium
NRMPFPLTAWAVRLLTRLPQRGITTLATN

SEQ ID NO: 841578 - protein, 31 aa, Mycobacterium
NRMREDLGALLQFRRDLWPLIAREVECVYYE

SEQ ID NO: 841579 - protein, 42 aa, Mycobacterium
NRMRWPHGRMRYYIAMLAELSQLRTLPFRLVLDGAREIETDL

SEQ ID NO: 841580 - protein, 43 aa, Mycobacterium
NRMSWPHGRLRYYLAMLAELSQLRLLPFRLVLDGTREIDADIT

SEQ ID NO: 841581 - protein, 19 aa, Mycobacterium
NRNAWDAAAAKLPPMAPPL

SEQ ID NO: 841582 - protein, 26 aa, Mycobacterium
NRNNGYFWRADDRGQFGFDFGITMPG

SEQ ID NO: 841583 - protein, 32 aa, Mycobacterium
NRNTHGVSWLPLYHDMGLSMIGFPAVYGGHST

SEQ ID NO: 841584 - protein, 34 aa, Mycobacterium
NRNTHGVSWLPLYHDMGLSMIGFPAVYGGHSTLM

SEQ ID NO: 841585 - protein, 18 aa, Mycobacterium
NRPAGWFSPPLPAPAVYI

SEQ ID NO: 841586 - protein, 22 aa, Mycobacterium
NRPALEVLLLGGKPIREPVFHY

SEQ ID NO: 841587 - protein, 20 aa, Mycobacterium
NRPDLVILRGRTYRPNQLGH

SEQ ID NO: 841588 - protein, 29 aa, Mycobacterium
NRPEFVAALQAIWRLGAAAVLISPAWKRD

SEQ ID NO: 841589 - protein, 26 aa, Mycobacterium
NRPGGTWFHPGFAYQLETFGEFLPVT

SEQ ID NO: 841590 - protein, 32 aa, Mycobacterium
NRPGLVMRPLPESWAELGFLIAVRPDRRRNAT

SEQ ID NO: 841591 - protein, 28 aa, Mycobacterium
NRPGPRGFIGQPIPIAGLYLGSAGCHGG

SEQ ID NO: 841592 - protein, 28 aa, Mycobacterium
NRPLIPRHLRLHSLFPRDALAHTDVVTG

SEQ ID NO: 841593 - protein, 22 aa, Mycobacterium
NRPLTWEEFAERIGQTVYLSAT

SEQ ID NO: 841594 - protein, 22 aa, Mycobacterium
NRPPVLYELPHGLRFTELLALH

SEQ ID NO: 841595 - protein, 24 aa, Mycobacterium
NRPRRAFRRITGAALEALLPQADT

SEQ ID NO: 841596 - protein, 23 aa, Mycobacterium
NRPRRAFRRITGAQLETLLQKAT

SEQ ID NO: 841597 - protein, 19 aa, Mycobacterium
NRQAAQVCRWLLTSRLEFI

SEQ ID NO: 841598 - protein, 27 aa, Mycobacterium
NRQEWHYYFENTKRWRNLRKITVAQVH

SEQ ID NO: 841599 - protein, 21 aa, Mycobacterium
NRQPWDFVIVTDRAQLQELST

SEQ ID NO: 841600 - protein, 19 aa, Mycobacterium
NRQVLLRRRPSGLVRPDDT

SEQ ID NO: 841601 - protein, 17 aa, Mycobacterium
NRRAGLLSGGQRQQLAI

SEQ ID NO: 841602 - protein, 31 aa, Mycobacterium
NRRDFHTFNLAYRPPLYRVRTHDGLALCGMM

SEQ ID NO: 841603 - protein, 18 aa, Mycobacterium
NRRELVELVAAWTRKRTP

SEQ ID NO: 841604 - protein, 34 aa, Mycobacterium
NRRIKRLLGGAWELWWLKTPLPGVVWCNTPHMTG

SEQ ID NO: 841605 - protein, 27 aa, Mycobacterium
NRRLHVLVFGAFRPLGLATTLRGATGT

SEQ ID NO: 841606 - protein, 21 aa, Mycobacterium
NRRLIETLTRLRGLGNTLIVV

SEQ ID NO: 841607 - protein, 17 aa, Mycobacterium
NRRLLGLGLETRGVFWL

SEQ ID NO: 841608 - protein, 21 aa, Mycobacterium
NRRLYLWPGGGGLAEALAGSG

SEQ ID NO: 841609 - protein, 24 aa, Mycobacterium
NRRRAKVHGFRLRMRTRAGRAIVT

SEQ ID NO: 841610 - protein, 24 aa, Mycobacterium
NRRRARVHGFRLRMRTRAGRAIVA

SEQ ID NO: 841611 - protein, 24 aa, Mycobacterium
NRRRARVHGFRLRMRTRAGRAIVS

SEQ ID NO: 841612 - protein, 20 aa, Mycobacterium
NRRRKLISNAFNPRAIAKLE

SEQ ID NO: 841613 - protein, 19 aa, Mycobacterium
NRRRLIEFCLLATQYDALA

SEQ ID NO: 841614 - protein, 25 aa, Mycobacterium
NRRRRVLRVLLVWDAPNLDMGLGAI

SEQ ID NO: 841615 - protein, 34 aa, Mycobacterium
NRRTSHRLAALDVPVPFWMRAPGECPGTYAAEVA

SEQ ID NO: 841616 - protein, 17 aa, Mycobacterium
NRRYTFDTFVIGASNRF

SEQ ID NO: 841617 - protein, 24 aa, Mycobacterium
NRSAAEAFLPAPSGWRNLASGYQQ

SEQ ID NO: 841618 - protein, 22 aa, Mycobacterium
NRSGVLRFVVLDGLAKPGRLEG

SEQ ID NO: 841619 - protein, 25 aa, Mycobacterium
NRSKLSEMPALWAYARDLFQTPGFG

SEQ ID NO: 841620 - protein, 25 aa, Mycobacterium
NRSKLSEMPVLWAYARDLFQTPGFG

SEQ ID NO: 841621 - protein, 26 aa, Mycobacterium
NRSKLSEMPVLWAYARDLFQTPGFGD

SEQ ID NO: 841622 - protein, 20 aa, Mycobacterium
NRSLALPGHTFTVVALDGNP

SEQ ID NO: 841623 - protein, 23 aa, Mycobacterium
NRSTLLDGLRRIGIDRLAPTDGA

SEQ ID NO: 841624 - protein, 25 aa, Mycobacterium
NRTAFALHKPLLVGNGSLASVLGTS

SEQ ID NO: 841625 - protein, 35 aa, Mycobacterium
NRTANIALLHYLDGEKRYIIAPQGLKQGAIVESGA

SEQ ID NO: 841626 - protein, 35 aa, Mycobacterium
NRTANIALLHYLDGEKRYIIAPQGLKQGDVIESGA

SEQ ID NO: 841627 - protein, 35 aa, Mycobacterium
NRTANIALLHYLDGEKRYIIAPYGLSQGDVVESGA

SEQ ID NO: 841628 - protein, 26 aa, Mycobacterium
NRTEDSPLLLARRKAQYFSSLLKDAI

SEQ ID NO: 841629 - protein, 18 aa, Mycobacterium
NRTIIVRRLLGLEDVLPI

SEQ ID NO: 841630 - protein, 25 aa, Mycobacterium
NRTKLSEMPVLWAYARDLFQTPGFG

SEQ ID NO: 841631 - protein, 32 aa, Mycobacterium
NRTLGEIMAPILYRVQWLVRQIPDPHAVSDDH

SEQ ID NO: 841632 - protein, 21 aa, Mycobacterium
NRTLWSGFTFEYWSQTRKVDP

SEQ ID NO: 841633 - protein, 17 aa, Mycobacterium
NRTMLSWLVATNALGQN

SEQ ID NO: 841634 - protein, 17 aa, Mycobacterium
NRTNPRMPLVSEITALL

SEQ ID NO: 841635 - protein, 26 aa, Mycobacterium
NRTPIDWDGYTPPLPAQGLGVREFHD

SEQ ID NO: 841636 - protein, 20 aa, Mycobacterium
NRVAALMRDVRFLRIGEGPS

SEQ ID NO: 841637 - protein, 26 aa, Mycobacterium
NRVALAALALLPRMVANTDFLDPLGL

SEQ ID NO: 841638 - protein, 23 aa, Mycobacterium
NRVALDRLRPVRAALPAGAGSMG

SEQ ID NO: 841639 - protein, 18 aa, Mycobacterium
NRVAPLRLFGHSMGAVVA

SEQ ID NO: 841640 - protein, 26 aa, Mycobacterium
NRVDASLIHLIGFAPDGRIASLRQLT

SEQ ID NO: 841641 - protein, 18 aa, Mycobacterium
NRVDLLVGHGRFIDPHTI

SEQ ID NO: 841642 - protein, 25 aa, Mycobacterium
NRVHAGLLSLPWEGLGLSHGDPAIA

SEQ ID NO: 841643 - protein, 18 aa, Mycobacterium
NRVIPDLAIREALEKLWS

SEQ ID NO: 841644 - protein, 25 aa, Mycobacterium
NRVKRDRLPALERLHGALLAGKPDP

SEQ ID NO: 841645 - protein, 40 aa, Mycobacterium
NRVRATRIEFWAFDLLFLDGRSLLRARYRDRRKLLETLGS

SEQ ID NO: 841646 - protein, 36 aa, Mycobacterium
NRVRATRIEFWAFDLLYLDGRSLLRAKYQDRRKLLE

SEQ ID NO: 841647 - protein, 23 aa, Mycobacterium
NRVTLRRRTGGLDAGWHLKLPAG

SEQ ID NO: 841648 - protein, 19 aa, Mycobacterium
NRVYSTPVLTLGLVDEARR

SEQ ID NO: 841649 - protein, 18 aa, Mycobacterium
NRVYVRCGMVPAGVDVIW

SEQ ID NO: 841650 - protein, 19 aa, Mycobacterium
NRWISSPYTKLMNSNNMVE

SEQ ID NO: 841651 - protein, 19 aa, Mycobacterium
NRYARGWHCLGVAKDFMDG

SEQ ID NO: 841652 - protein, 26 aa, Mycobacterium
NRYDAMPYRRVGTSGLLLPAISLGLW

SEQ ID NO: 841653 - protein, 24 aa, Mycobacterium
NRYDLTSFRALFYAASAIPQALLE

SEQ ID NO: 841654 - protein, 40 aa, Mycobacterium
NRYLVYTSVDIRALYLFKRTLWWPYSVAMRVANYAFTNAL

SEQ ID NO: 841655 - protein, 17 aa, Mycobacterium
NRYLYPRVEVEVGFILN

SEQ ID NO: 841656 - protein, 17 aa, Mycobacterium
NRYPGIQCDNESYCYIP

SEQ ID NO: 841657 - protein, 18 aa, Mycobacterium
NRYRDELTAVAIVAVVPT

SEQ ID NO: 841658 - protein, 23 aa, Mycobacterium
NRYWGTPIPVWKSDDPAYPRIDV

SEQ ID NO: 841659 - protein, 25 aa, Mycobacterium
NSAALSYEKLITALSSEEWMGPASA

SEQ ID NO: 841660 - protein, 26 aa, Mycobacterium
NSAENPFPVRAVAIRVAGWIDKLGTV

SEQ ID NO: 841661 - protein, 33 aa, Mycobacterium
NSAIDAIWADIAHRPTFLGADLSALHLPQADVR

SEQ ID NO: 841662 - protein, 24 aa, Mycobacterium
NSALMYFGPGSRSMLAAAAAWDAV

SEQ ID NO: 841663 - protein, 23 aa, Mycobacterium
NSANLNIGFWNSTGAGNVGVMNT

SEQ ID NO: 841664 - protein, 22 aa, Mycobacterium
NSARLRLLRNRLVEGVLAEIDG

SEQ ID NO: 841665 - protein, 17 aa, Mycobacterium
NSARMYSGAGSGPLLAA

SEQ ID NO: 841666 - protein, 21 aa, Mycobacterium
NSARYLVHFTQSGLGLPDESY

SEQ ID NO: 841667 - protein, 19 aa, Mycobacterium
NSAVLNYPLTQYMFCAPDE

SEQ ID NO: 841668 - protein, 22 aa, Mycobacterium
NSAWILCAAIAHNLLRAAGVLA

SEQ ID NO: 841669 - protein, 23 aa, Mycobacterium
NSAWILCAAIAHNLLRAAGVLAG

SEQ ID NO: 841670 - protein, 25 aa, Mycobacterium
NSDAALRRVAAWADGWYGFNLDGVG

SEQ ID NO: 841671 - protein, 26 aa, Mycobacterium
NSDDDRFMFGYIPPVFKGQYAETAEE

SEQ ID NO: 841672 - protein, 26 aa, Mycobacterium
NSDDKRFMFDYIPPVFKGQYAETEQE

SEQ ID NO: 841673 - protein, 21 aa, Mycobacterium
NSDEKLAPIPSLLAVAGVHHH

SEQ ID NO: 841674 - protein, 23 aa, Mycobacterium
NSDGFPEFPLPLGNPKDSTRSVM

SEQ ID NO: 841675 - protein, 27 aa, Mycobacterium
NSDGKRFMFDYIPPVFKGQYAETEQEA

SEQ ID NO: 841676 - protein, 23 aa, Mycobacterium
NSDGRLLKLTLHPGVMTGYSHGE

SEQ ID NO: 841677 - protein, 17 aa, Mycobacterium
NSDLAAHPVVRSRYPML

SEQ ID NO: 841678 - protein, 21 aa, Mycobacterium
NSDLMRRRAFGPAVHGFLDTI

SEQ ID NO: 841679 - protein, 24 aa, Mycobacterium
NSDNLSYDGIIGNGGTGGNGGVGG

SEQ ID NO: 841680 - protein, 25 aa, Mycobacterium
NSDPYGEGWLVDLRVEAGTLDEALG

SEQ ID NO: 841681 - protein, 28 aa, Mycobacterium
NSDPYGEGWLVELQADSASLDAALAELF

SEQ ID NO: 841682 - protein, 19 aa, Mycobacterium
NSDQLLFDGLPWVSRAQEE

SEQ ID NO: 841683 - protein, 34 aa, Mycobacterium
NSDRYHEYLLAVPWADAVLNPINIRWSPPEIAYA

SEQ ID NO: 841684 - protein, 28 aa, Mycobacterium
NSDRYHEYLLAVPWANGVLNPVNIRWTP

SEQ ID NO: 841685 - protein, 26 aa, Mycobacterium
NSDVGFIGVPFFHIAGIGNLLTGVLL

SEQ ID NO: 841686 - protein, 24 aa, Mycobacterium
NSDVGFIGVPFFHIAGIGNMLSGM

SEQ ID NO: 841687 - protein, 24 aa, Mycobacterium
NSDVGFIGVPFFHIAGIGNMLTGM

SEQ ID NO: 841688 - protein, 23 aa, Mycobacterium
NSDVGFIGVPLFHIAGIGNMLTG

SEQ ID NO: 841689 - protein, 18 aa, Mycobacterium
NSELTSLAPVPALVDLST

SEQ ID NO: 841690 - protein, 27 aa, Mycobacterium
NSENSRFMFDYIPPVFKGQYAESEQEA

SEQ ID NO: 841691 - protein, 25 aa, Mycobacterium
NSENVYFYITLYNEPYVQPAEPENV

SEQ ID NO: 841692 - protein, 18 aa, Mycobacterium
NSERSFLLAVVVPTPEAL

SEQ ID NO: 841693 - protein, 23 aa, Mycobacterium
NSERSFLLAVVVPTPEVLERYAD

SEQ ID NO: 841694 - protein, 20 aa, Mycobacterium
NSFLDALAAHRHARGLPGLS

SEQ ID NO: 841695 - protein, 25 aa, Mycobacterium
NSFLDGLAVHRQAHGLPAISLGWGL

SEQ ID NO: 841696 - protein, 19 aa, Mycobacterium
NSFLDGLAVHRRARGLPAI

SEQ ID NO: 841697 - protein, 28 aa, Mycobacterium
NSFVDGLVAYRRSLGLPAVGINWGPWAE

SEQ ID NO: 841698 - protein, 19 aa, Mycobacterium
NSFVYNLVDPILNDPSFSN

SEQ ID NO: 841699 - protein, 22 aa, Mycobacterium
NSGDLNTGFWDSGSFNTGSGNS

SEQ ID NO: 841700 - protein, 32 aa, Mycobacterium
NSGDNGFVYVAPLFTISFTSGVFSSGAFTSGF

SEQ ID NO: 841701 - protein, 29 aa, Mycobacterium
NSGGGLNRGLFNNGFLNIGIANSGDNGFV

SEQ ID NO: 841702 - protein, 24 aa, Mycobacterium
NSGGVNSGFWNSGGLNTGFGNAGA

SEQ ID NO: 841703 - protein, 34 aa, Mycobacterium
NSGIEWELYYEPTAPMWELLPMKVRGKNGELLAD

SEQ ID NO: 841704 - protein, 25 aa, Mycobacterium
NSGIRDAFNLGWKLAAVVRGQAGDA

SEQ ID NO: 841705 - protein, 22 aa, Mycobacterium
NSGKLHRFVNIYVNDEDVRFSG

SEQ ID NO: 841706 - protein, 25 aa, Mycobacterium
NSGKLTFGIVYTYVRPQTWQSNAAT

SEQ ID NO: 841707 - protein, 18 aa, Mycobacterium
NSGLLNTGLFNSGELNTG

SEQ ID NO: 841708 - protein, 24 aa, Mycobacterium
NSGPDRLFELIWSAQPTSTVQPVS

SEQ ID NO: 841709 - protein, 22 aa, Mycobacterium
NSGPQLPFAIAGITLHATGASR

SEQ ID NO: 841710 - protein, 23 aa, Mycobacterium
NSGPQLPFAIAGITLHATGASRM

SEQ ID NO: 841711 - protein, 25 aa, Mycobacterium
NSGQYTVFAPTNAAFDKLPAATIDQ

SEQ ID NO: 841712 - protein, 25 aa, Mycobacterium
NSGRPVAVICHGPWTLIEAGVAKGR

SEQ ID NO: 841713 - protein, 23 aa, Mycobacterium
NSGSTNWGLWNPGTGNTGIANAG

SEQ ID NO: 841714 - protein, 22 aa, Mycobacterium
NSGTFYTLRCYLNDEPIFLGRN

SEQ ID NO: 841715 - protein, 22 aa, Mycobacterium
NSGYLVERLTPAGQRLYGLMAG

SEQ ID NO: 841716 - protein, 25 aa, Mycobacterium
NSHEASMFAWTKPPMLPTTRESIDG

SEQ ID NO: 841717 - protein, 17 aa, Mycobacterium
NSIHPGFIRTPMTEHFP

SEQ ID NO: 841718 - protein, 22 aa, Mycobacterium
NSIHQLIGPNAWRLPFEREWRE

SEQ ID NO: 841719 - protein, 21 aa, Mycobacterium
NSIRLLIAEPDGARLRDVHRE

SEQ ID NO: 841720 - protein, 23 aa, Mycobacterium
NSKTRLRELAALTLKDFGLAGVI

SEQ ID NO: 841721 - protein, 20 aa, Mycobacterium
NSKVRDLLPPIIEKVRATGH

SEQ ID NO: 841722 - protein, 33 aa, Mycobacterium
NSLAAPAALPTLTPLELLDLLADLSGLFIDPEI

SEQ ID NO: 841723 - protein, 17 aa, Mycobacterium
NSLARAIRFGHKVIEAA

SEQ ID NO: 841724 - protein, 37 aa, Mycobacterium
NSLEIAVTGALKWASRPLKFAKLLPATIGVIPAWLER

SEQ ID NO: 841725 - protein, 30 aa, Mycobacterium
NSLGELWVMQTYLRPDLLEHAGVADLGDWG

SEQ ID NO: 841726 - protein, 20 aa, Mycobacterium
NSLIEWYRPSRTLSADEVAD

SEQ ID NO: 841727 - protein, 19 aa, Mycobacterium
NSLLDINVFGRRAGIAAAN

SEQ ID NO: 841728 - protein, 19 aa, Mycobacterium
NSLPRIMWKPAAQVAQAGI

SEQ ID NO: 841729 - protein, 21 aa, Mycobacterium
NSLPRRGLAALRRPVRRPLDE

SEQ ID NO: 841730 - protein, 17 aa, Mycobacterium
NSLTRLGPLPPLRMQPD

SEQ ID NO: 841731 - protein, 22 aa, Mycobacterium
NSMAGAFHYLDPRGGYVNDRGW

SEQ ID NO: 841732 - protein, 26 aa, Mycobacterium
NSMAGPFHFLDPKLGYANDPAWIVFD

SEQ ID NO: 841733 - protein, 24 aa, Mycobacterium
NSMAGPFHYLDPRDGYVNDRGWIV

SEQ ID NO: 841734 - protein, 23 aa, Mycobacterium
NSMPLLERAKFLAIFASNLDEFY

SEQ ID NO: 841735 - protein, 21 aa, Mycobacterium
NSNWLIFVEGVADHQGHSYWW

SEQ ID NO: 841736 - protein, 33 aa, Mycobacterium
NSPADYLPDLDPPLPPLPAPISNNIPKPIKPLL

SEQ ID NO: 841737 - protein, 25 aa, Mycobacterium
NSPDTLLNPTYLAGRARLISGDTTM

SEQ ID NO: 841738 - protein, 21 aa, Mycobacterium
NSPEIMQVILREGLLDTAMTK

SEQ ID NO: 841739 - protein, 20 aa, Mycobacterium
NSPFFFSHQLWAETRIELFT

SEQ ID NO: 841740 - protein, 25 aa, Mycobacterium
NSPHTLTVWLPFTDATPLNGCMYVL

SEQ ID NO: 841741 - protein, 23 aa, Mycobacterium
NSPLVRQIFVYANGARAYPLAVV

SEQ ID NO: 841742 - protein, 17 aa, Mycobacterium
NSPMLWDPIRFLESCPS

SEQ ID NO: 841743 - protein, 24 aa, Mycobacterium
NSPPPLLNLLLGQTVQYTTYQGMS

SEQ ID NO: 841744 - protein, 17 aa, Mycobacterium
NSPTAIRTTKKALWHSL

SEQ ID NO: 841745 - protein, 22 aa, Mycobacterium
NSPTAPGLKKSLAASARLVPYV

SEQ ID NO: 841746 - protein, 23 aa, Mycobacterium
NSQAVSVLLFSEGRALANLEFDS

SEQ ID NO: 841747 - protein, 35 aa, Mycobacterium
NSQDWWPADYGTYGGLFIRMSWHSAGTYRIHDGRG

SEQ ID NO: 841748 - protein, 34 aa, Mycobacterium
NSQILPIRLPRRIVEPMWAVAEWGYWQILKSAED

SEQ ID NO: 841749 - protein, 30 aa, Mycobacterium
NSQLLDVLLHDLLSITLPVWRRMEDRFTEA

SEQ ID NO: 841750 - protein, 17 aa, Mycobacterium
NSQPWRWVAEADTLQLW

SEQ ID NO: 841751 - protein, 23 aa, Mycobacterium
NSRDPQLLSFFESLVATDIGVTR

SEQ ID NO: 841752 - protein, 18 aa, Mycobacterium
NSRLLLPEAIHDEVVDRL

SEQ ID NO: 841753 - protein, 25 aa, Mycobacterium
NSRPIALLLKYFARLHIWVYRRTNG

SEQ ID NO: 841754 - protein, 22 aa, Mycobacterium
NSRPVFVERIRLHQLAAGSGTA

SEQ ID NO: 841755 - protein, 17 aa, Mycobacterium
NSRQRVALFADIQLIAL

SEQ ID NO: 841756 - protein, 23 aa, Mycobacterium
NSRRWYSLALAPRRRHRAPRWRV

SEQ ID NO: 841757 - protein, 25 aa, Mycobacterium
NSRSPGHVWAWQTRSWSRGQVFPGA

SEQ ID NO: 841758 - protein, 21 aa, Mycobacterium
NSRVWLADMTLLDPHAAQVAC

SEQ ID NO: 841759 - protein, 23 aa, Mycobacterium
NSSPLALAVPPWATEPVGELGKD

SEQ ID NO: 841760 - protein, 24 aa, Mycobacterium
NSTEFIQVLLGCAKIGALAVPLNV

SEQ ID NO: 841761 - protein, 18 aa, Mycobacterium
NSTLCLDVDWVVGGCMSV

SEQ ID NO: 841762 - protein, 24 aa, Mycobacterium
NSTLGLDFLRSCSIKHRQASIIFS

SEQ ID NO: 841763 - protein, 24 aa, Mycobacterium
NSTVQPFAYVHPQPPRPGGASSPS

SEQ ID NO: 841764 - protein, 23 aa, Mycobacterium
NSTYRIPLFAFRGTPTGIDARKV

SEQ ID NO: 841765 - protein, 30 aa, Mycobacterium
NSVAHYDWLVGCGVVFKPEFFDEPGWEPMG

SEQ ID NO: 841766 - protein, 24 aa, Mycobacterium
NSVAPGPIWTPLIPSTMPPDSVES

SEQ ID NO: 841767 - protein, 17 aa, Mycobacterium
NSVEFLEVLLGCAKIGA

SEQ ID NO: 841768 - protein, 21 aa, Mycobacterium
NSVGLIPDGLGLIAQNQAAFS

SEQ ID NO: 841769 - protein, 27 aa, Mycobacterium
NSVHLILTVLGCWKIGAVPVPMHWDLP

SEQ ID NO: 841770 - protein, 23 aa, Mycobacterium
NSVIFAGALRELAAKYPDRLTVV

SEQ ID NO: 841771 - protein, 17 aa, Mycobacterium
NSVLGRVAAFYPGPAGA

SEQ ID NO: 841772 - protein, 19 aa, Mycobacterium
NSVLLALAQRLVQEEFGCQ

SEQ ID NO: 841773 - protein, 43 aa, Mycobacterium
NSVNINGWKPVKDVIYSAASALAWPSLSQQTVGSRFLDRLNTL

SEQ ID NO: 841774 - protein, 26 aa, Mycobacterium
NSVPLMAMYGLGPLAGLDGGGFMADL

SEQ ID NO: 841775 - protein, 22 aa, Mycobacterium
NSVRGVLTCRSLSEQLGLHFLT

SEQ ID NO: 841776 - protein, 31 aa, Mycobacterium
NSVTVQRWRHIWLHEGFACYAEWLWSEHCGE

SEQ ID NO: 841777 - protein, 17 aa, Mycobacterium
NSVVPGYMWGENLKGYF

SEQ ID NO: 841778 - protein, 22 aa, Mycobacterium
NSVVTEYLLLGLRFDRIESGYV

SEQ ID NO: 841779 - protein, 22 aa, Mycobacterium
NSWVDAFAHWRRAQGLPVCAIA

SEQ ID NO: 841780 - protein, 23 aa, Mycobacterium
NSYSLLAGFGARLGERMNRANAR

SEQ ID NO: 841781 - protein, 23 aa, Mycobacterium
NTAAWFVMAAIPNSVFLGHTLNA

SEQ ID NO: 841782 - protein, 30 aa, Mycobacterium
NTADADVIRYLRWFTFLVAEELTELEQATA

SEQ ID NO: 841783 - protein, 31 aa, Mycobacterium
NTADADVLGYLRWFTFLTPDELAELADATEN

SEQ ID NO: 841784 - protein, 29 aa, Mycobacterium
NTADADVVPYLRWFTFLTAEELAELELAT

SEQ ID NO: 841785 - protein, 23 aa, Mycobacterium
NTADINVFGLENVATVATAIGDN

SEQ ID NO: 841786 - protein, 23 aa, Mycobacterium
NTAGVSTWLVYAPGIREHIDAAR

SEQ ID NO: 841787 - protein, 23 aa, Mycobacterium
NTAHLRIFTPAAELPFAGHPTVG

SEQ ID NO: 841788 - protein, 23 aa, Mycobacterium
NTAIDLGPLRALVNSAGIGWAQR

SEQ ID NO: 841789 - protein, 21 aa, Mycobacterium
NTALHRIAVTQIRLAGLGQAY

SEQ ID NO: 841790 - protein, 25 aa, Mycobacterium
NTAPAMLLTVGFPPTAAAAALTALE

SEQ ID NO: 841791 - protein, 20 aa, Mycobacterium
NTAPLRAIVDRWLTPRSQEE

SEQ ID NO: 841792 - protein, 25 aa, Mycobacterium
NTCGFWSHLPGQRIPLSFGRWPTRD

SEQ ID NO: 841793 - protein, 29 aa, Mycobacterium
NTCSMYVDIRFPPNVFPIDVQRDFTSRVT

SEQ ID NO: 841794 - protein, 24 aa, Mycobacterium
NTDAKAWELLAPYGVGPGNARLER

SEQ ID NO: 841795 - protein, 31 aa, Mycobacterium
NTDASLTTQLPLKPSLAHKPTPQTKPSLTTH

SEQ ID NO: 841796 - protein, 25 aa, Mycobacterium
NTDPKRKVRFLPYGIAVSVLDDPAD

SEQ ID NO: 841797 - protein, 25 aa, Mycobacterium
NTDPYGAGWLLDVQVEGSDVAALES

SEQ ID NO: 841798 - protein, 25 aa, Mycobacterium
NTDRILDFSTAITGGLFFTPTVDFL

SEQ ID NO: 841799 - protein, 25 aa, Mycobacterium
NTDRILDFSTAVTGGLFFSPTMDFL

SEQ ID NO: 841800 - protein, 23 aa, Mycobacterium
NTDTIILVRIPNNGTSATAISIP

SEQ ID NO: 841801 - protein, 23 aa, Mycobacterium
NTECGALLMHRTRSSALMMAAAM

SEQ ID NO: 841802 - protein, 27 aa, Mycobacterium
NTEPILLLHPFLLSQSVWKYVAPQLAD

SEQ ID NO: 841803 - protein, 22 aa, Mycobacterium
NTETFPGLAGLGDLIVTCTSQR

SEQ ID NO: 841804 - protein, 33 aa, Mycobacterium
NTEYFLGLTQKLPLTSLIRPIPYVGTPLAELVQ

SEQ ID NO: 841805 - protein, 30 aa, Mycobacterium
NTEYPLLLNEPYVRLYPRQVVKQADLVLAM

SEQ ID NO: 841806 - protein, 21 aa, Mycobacterium
NTEYTLGWKPRVGLARGIRHT

SEQ ID NO: 841807 - protein, 18 aa, Mycobacterium
NTFCAPPTVWRMLIQSDL

SEQ ID NO: 841808 - protein, 21 aa, Mycobacterium
NTFMVFGPFAWSGSSWHVMVE

SEQ ID NO: 841809 - protein, 20 aa, Mycobacterium
NTFRRLNGTLLAGLPAMVVA

SEQ ID NO: 841810 - protein, 22 aa, Mycobacterium
NTFYEWVLGPSMTYTCACYPDA

SEQ ID NO: 841811 - protein, 23 aa, Mycobacterium
NTFYEWVLGPSMTYTCACYPTED

SEQ ID NO: 841812 - protein, 24 aa, Mycobacterium
NTFYSWVLGPSMTYTCACYPHPDA

SEQ ID NO: 841813 - protein, 25 aa, Mycobacterium
NTGGMGAYTPLPWLPAETVSEIVDT

SEQ ID NO: 841814 - protein, 21 aa, Mycobacterium
NTGIALAMVCAARGYRCVLTM

SEQ ID NO: 841815 - protein, 23 aa, Mycobacterium
NTGKEFWPLQLLATNKDGTPTGG

SEQ ID NO: 841816 - protein, 18 aa, Mycobacterium
NTGLFNIGVFNTGIANPG

SEQ ID NO: 841817 - protein, 25 aa, Mycobacterium
NTGVYAFDITALRSALSRLSSDNAQ

SEQ ID NO: 841818 - protein, 17 aa, Mycobacterium
NTGYLNRGDYNTGVANF

SEQ ID NO: 841819 - protein, 18 aa, Mycobacterium
NTHPLIVFDPADEAMTAR

SEQ ID NO: 841820 - protein, 25 aa, Mycobacterium
NTHRGALWALGLLAAGAATAHTVPG

SEQ ID NO: 841821 - protein, 17 aa, Mycobacterium
NTHVKFHWNGNAVELIG

SEQ ID NO: 841822 - protein, 24 aa, Mycobacterium
NTIATPYLIQPIAHGADIVVHSAT

SEQ ID NO: 841823 - protein, 33 aa, Mycobacterium
NTIELAQHAERWGYRRFWVAEHHFVAVASASPA

SEQ ID NO: 841824 - protein, 25 aa, Mycobacterium
NTIEYRGLPYDASARRLYGVPVVVS

SEQ ID NO: 841825 - protein, 29 aa, Mycobacterium
NTIIAVQRFHRPWPMEPFAHRAVGEMWLG

SEQ ID NO: 841826 - protein, 18 aa, Mycobacterium
NTIRNFLPELGLRRENIV

SEQ ID NO: 841827 - protein, 17 aa, Mycobacterium
NTIRWNWERGDVAIWDN

SEQ ID NO: 841828 - protein, 20 aa, Mycobacterium
NTITVTGLGPGGPGAPTTVT

SEQ ID NO: 841829 - protein, 23 aa, Mycobacterium
NTKFSLFERSKLPQLIGREGGVP

SEQ ID NO: 841830 - protein, 18 aa, Mycobacterium
NTKQPPMWLVGSSNSQGG

SEQ ID NO: 841831 - protein, 20 aa, Mycobacterium
NTKRLASLGPLLNDLEARVV

SEQ ID NO: 841832 - protein, 17 aa, Mycobacterium
NTKRVTRLFDRVARHRR

SEQ ID NO: 841833 - protein, 27 aa, Mycobacterium
NTKRYMHHYNFPPYSTGETGRVGSPKR

SEQ ID NO: 841834 - protein, 23 aa, Mycobacterium
NTLAAVQILLAPLNIRALYSDVP

SEQ ID NO: 841835 - protein, 34 aa, Mycobacterium
NTLESARRMAPAAKLLVIGPPWPTADVPEVVTQL

SEQ ID NO: 841836 - protein, 25 aa, Mycobacterium
NTLIRVAIDLLLKREAELAGTTEAE

SEQ ID NO: 841837 - protein, 25 aa, Mycobacterium
NTLLGAPVPTNFTSSLLLGSSAQVF

SEQ ID NO: 841838 - protein, 18 aa, Mycobacterium
NTLLKNYLYLAESGGAQV

SEQ ID NO: 841839 - protein, 17 aa, Mycobacterium
NTLLPGFIDPHSHYINA

SEQ ID NO: 841840 - protein, 19 aa, Mycobacterium
NTLNLKKLGHLGNDQLEFI

SEQ ID NO: 841841 - protein, 24 aa, Mycobacterium
NTLNLRKLGHLGVDQLEFVKKDVA

SEQ ID NO: 841842 - protein, 17 aa, Mycobacterium
NTLTPREREVLGLMAEG

SEQ ID NO: 841843 - protein, 27 aa, Mycobacterium
NTLVCPVCLGLPGALPVLNEAAVESAI

SEQ ID NO: 841844 - protein, 17 aa, Mycobacterium
NTLVGNTPVLWVSEPFS

SEQ ID NO: 841845 - protein, 31 aa, Mycobacterium
NTLVNTWGLAYFGAGIFQLGTLFAQQLLPDA

SEQ ID NO: 841846 - protein, 17 aa, Mycobacterium
NTLVRTPAGWRADNTDI

SEQ ID NO: 841847 - protein, 25 aa, Mycobacterium
NTLYVPPEPFFNDPQWRDITDWRAE

SEQ ID NO: 841848 - protein, 17 aa, Mycobacterium
NTMPIGTKWRAGSAGES

SEQ ID NO: 841849 - protein, 23 aa, Mycobacterium
NTNGLLRDYFPKGVTLIDHSPEH

SEQ ID NO: 841850 - protein, 24 aa, Mycobacterium
NTNGLLRQYFPKGTDLSRWSAEDL

SEQ ID NO: 841851 - protein, 24 aa, Mycobacterium
NTNKMAYLEAIQFDFDDSSPGVLA

SEQ ID NO: 841852 - protein, 24 aa, Mycobacterium
NTNPAMLGGIFGLSSNGANIGNIG

SEQ ID NO: 841853 - protein, 17 aa, Mycobacterium
NTPETLLYKKSSVLFGI

SEQ ID NO: 841854 - protein, 21 aa, Mycobacterium
NTPLGVIPPNLIPTGAVVPTQ

SEQ ID NO: 841855 - protein, 29 aa, Mycobacterium
NTPNSAGRYRPFYLRNLLDAVQGRTLEEA

SEQ ID NO: 841856 - protein, 31 aa, Mycobacterium
NTPQYLVEVLGRRIWRGVSDAALIVGAESGA

SEQ ID NO: 841857 - protein, 19 aa, Mycobacterium
NTPVLWVSEPFSGPGTGFW

SEQ ID NO: 841858 - protein, 19 aa, Mycobacterium
NTQDWRWLVITDPDKRAAI

SEQ ID NO: 841859 - protein, 18 aa, Mycobacterium
NTQNWTAYTELMCVAMRA

SEQ ID NO: 841860 - protein, 20 aa, Mycobacterium
NTRFLLVNNNWRGLVLDSSR

SEQ ID NO: 841861 - protein, 29 aa, Mycobacterium
NTRIVRRSNALLDWAYGRQFRYTESMSLG

SEQ ID NO: 841862 - protein, 29 aa, Mycobacterium
NTRMNEIRLWLPYDEVLPRRQPPSVSVAP

SEQ ID NO: 841863 - protein, 20 aa, Mycobacterium
NTRRLATLGPLLQDLEARII

SEQ ID NO: 841864 - protein, 31 aa, Mycobacterium
NTSGGNGGFGGMALFIGSGGNGGAGGNAVSI

SEQ ID NO: 841865 - protein, 24 aa, Mycobacterium
NTSLWAYNVLPPTRPRSYHSILEL

SEQ ID NO: 841866 - protein, 31 aa, Mycobacterium
NTSQAMPLASVFKLYVLLAAGTAINAGTLRW

SEQ ID NO: 841867 - protein, 22 aa, Mycobacterium
NTTGVFLVTKAVIPHVRARGGG

SEQ ID NO: 841868 - protein, 38 aa, Mycobacterium
NTTQLRPLIGVALQEVALDLWMSPVEQIRMSLAMAGWP

SEQ ID NO: 841869 - protein, 25 aa, Mycobacterium
NTTYPLLLHEAYVRLYPAQVIKQAD

SEQ ID NO: 841870 - protein, 26 aa, Mycobacterium
NTTYPLLLHEAYVRLYPAQVIKQADL

SEQ ID NO: 841871 - protein, 24 aa, Mycobacterium
NTVANLYRAFAHDQLLGTAAAPTF

SEQ ID NO: 841872 - protein, 33 aa, Mycobacterium
NTVDLARHAERWGYRRFWVAEHHFVAVASTAPA

SEQ ID NO: 841873 - protein, 17 aa, Mycobacterium
NTVFIDDVFVPDELVLG

SEQ ID NO: 841874 - protein, 20 aa, Mycobacterium
NTVLLPVDLAPDAQLRAQLQ

SEQ ID NO: 841875 - protein, 23 aa, Mycobacterium
NTVLWGGYTWEYWRATRSVRPAE

SEQ ID NO: 841876 - protein, 21 aa, Mycobacterium
NTVPLTYPFALTFPSVMSLVT

SEQ ID NO: 841877 - protein, 20 aa, Mycobacterium
NTVPPFFPQASLAAPPPETA

SEQ ID NO: 841878 - protein, 29 aa, Mycobacterium
NTVRAWAFTPNLHWPFEYVDGLAGFMPRI

SEQ ID NO: 841879 - protein, 24 aa, Mycobacterium
NTVRYRLRRIADFTGRDPAVPRDA

SEQ ID NO: 841880 - protein, 24 aa, Mycobacterium
NTVRYRLRRLKQLTGRDVARPRDI

SEQ ID NO: 841881 - protein, 23 aa, Mycobacterium
NTVRYRLRRMAEVTNLELTDPRK

SEQ ID NO: 841882 - protein, 24 aa, Mycobacterium
NTVTAIHLLHYMPDPVRLETAMRN

SEQ ID NO: 841883 - protein, 17 aa, Mycobacterium
NTVVLKPAPDTPWCAAV

SEQ ID NO: 841884 - protein, 22 aa, Mycobacterium
NTVVVRLRPGPRQTFRELLAQT

SEQ ID NO: 841885 - protein, 20 aa, Mycobacterium
NTVWKPTVPLGYGRTYTLTV

SEQ ID NO: 841886 - protein, 25 aa, Mycobacterium
NTVYPLLMNEPYVRLYPAQVLKQAD

SEQ ID NO: 841887 - protein, 17 aa, Mycobacterium
NTWERNGGLRYAQRADL

SEQ ID NO: 841888 - protein, 19 aa, Mycobacterium
NTWKQNWPQHNPSAYIQAG

SEQ ID NO: 841889 - protein, 35 aa, Mycobacterium
NTYAPHFRFFADADAVFFMFDPLRVKGVRDQLQDL

SEQ ID NO: 841890 - protein, 32 aa, Mycobacterium
NTYHYDIGPRIFGPYEIPIVNFSGTGFGNSTT

SEQ ID NO: 841891 - protein, 21 aa, Mycobacterium
NTYRALLKVAAACAEHFAATT

SEQ ID NO: 841892 - protein, 22 aa, Mycobacterium
NTYSRFLLGVGIHDITAGYRAY

SEQ ID NO: 841893 - protein, 19 aa, Mycobacterium
NTYVLCEVLGWRGIWLSEE

SEQ ID NO: 841894 - protein, 26 aa, Mycobacterium
NVAEGDFLIYPKPKPIPHKTVLSLEF

SEQ ID NO: 841895 - protein, 18 aa, Mycobacterium
NVAESYGWQRIQGQARFA

SEQ ID NO: 841896 - protein, 27 aa, Mycobacterium
NVAIGTLYRYFPTKRHLFVSALVRESE

SEQ ID NO: 841897 - protein, 18 aa, Mycobacterium
NVAILAGDYLFATASRLV

SEQ ID NO: 841898 - protein, 19 aa, Mycobacterium
NVALLTGISREDQDHWGVR

SEQ ID NO: 841899 - protein, 17 aa, Mycobacterium
NVALRDLAKDLGEATVL

SEQ ID NO: 841900 - protein, 22 aa, Mycobacterium
NVAMAINYGYNKVRFITPVRVG

SEQ ID NO: 841901 - protein, 22 aa, Mycobacterium
NVANCLVALAILDAVGVSPEQA

SEQ ID NO: 841902 - protein, 18 aa, Mycobacterium
NVAPPLNMDPRWVGAHVG

SEQ ID NO: 841903 - protein, 17 aa, Mycobacterium
NVAPPMYAAIPADGVYA

SEQ ID NO: 841904 - protein, 17 aa, Mycobacterium
NVAPPMYSAIPADGVYA

SEQ ID NO: 841905 - protein, 20 aa, Mycobacterium
NVARPRVDPAVWPVTTHLDE

SEQ ID NO: 841906 - protein, 21 aa, Mycobacterium
NVARWIGRFVGHAVSPEKVAD

SEQ ID NO: 841907 - protein, 22 aa, Mycobacterium
NVASGYLGWLASTGVQAGQAAS

SEQ ID NO: 841908 - protein, 23 aa, Mycobacterium
NVATFWRKRTWFEGGYEPSITLN

SEQ ID NO: 841909 - protein, 23 aa, Mycobacterium
NVAYGLYPAWRGRGLATRAVDLV

SEQ ID NO: 841910 - protein, 22 aa, Mycobacterium
NVCGPTAWDGYAAAAVCAAGVE

SEQ ID NO: 841911 - protein, 22 aa, Mycobacterium
NVCGQLSHRFAVAYGLVSLAVD

SEQ ID NO: 841912 - protein, 24 aa, Mycobacterium
NVDAFLAVCRKWEVLATVIGEVTD

SEQ ID NO: 841913 - protein, 26 aa, Mycobacterium
NVDAVFLFDVLLHQVSPDWDAILEMY

SEQ ID NO: 841914 - protein, 32 aa, Mycobacterium
NVDDLDASILFYSKLFGVDPAKRKPGYANFAV

SEQ ID NO: 841915 - protein, 24 aa, Mycobacterium
NVDDLDEAITFYSKLFGVAPAKVK

SEQ ID NO: 841916 - protein, 31 aa, Mycobacterium
NVDDLDPRVWPYVIERLLAAGAYDAWLTPII

SEQ ID NO: 841917 - protein, 23 aa, Mycobacterium
NVDGGDFVIIINADKISLSGDKL

SEQ ID NO: 841918 - protein, 19 aa, Mycobacterium
NVDLQPGGAVIGAFLGSRR

SEQ ID NO: 841919 - protein, 32 aa, Mycobacterium
NVDLVILARYMQILSPAFLDAIGCPLINIHHS

SEQ ID NO: 841920 - protein, 21 aa, Mycobacterium
NVDNAWFWRDGDLLRCGLMDW

SEQ ID NO: 841921 - protein, 26 aa, Mycobacterium
NVDNPDPLLLLTHPLPNTGVVEVQGS

SEQ ID NO: 841922 - protein, 23 aa, Mycobacterium
NVDPALLLNCMLLAATESGVTGD

SEQ ID NO: 841923 - protein, 24 aa, Mycobacterium
NVDPMRKVRFLPYGIAVSVLDNDS

SEQ ID NO: 841924 - protein, 26 aa, Mycobacterium
NVDRFWEKFYFKPGNLGYPIFDTAVG

SEQ ID NO: 841925 - protein, 24 aa, Mycobacterium
NVDTNFLAAALLSEPDGLAARIVA

SEQ ID NO: 841926 - protein, 23 aa, Mycobacterium
NVEAFKHWGLMPRMLMAATERDL

SEQ ID NO: 841927 - protein, 17 aa, Mycobacterium
NVEIDVLPYPVYKRLRD

SEQ ID NO: 841928 - protein, 26 aa, Mycobacterium
NVEIPDHFRIFVNDKLTRLERYDKTL

SEQ ID NO: 841929 - protein, 23 aa, Mycobacterium
NVEKSLYSLLDPGVDPGPTHVHG

SEQ ID NO: 841930 - protein, 25 aa, Mycobacterium
NVEQVVIRRRLTLGVLVCCPADVAD

SEQ ID NO: 841931 - protein, 22 aa, Mycobacterium
NVERLRLVGTLPASLGIQIPVN

SEQ ID NO: 841932 - protein, 25 aa, Mycobacterium
NVETLMACPLRWMLERHGGTDLTDP

SEQ ID NO: 841933 - protein, 24 aa, Mycobacterium
NVETVPRIFKRIRPAFTYQRSLDV

SEQ ID NO: 841934 - protein, 26 aa, Mycobacterium
NVFAETCPQYLYLSLEEHLGAPGFEG

SEQ ID NO: 841935 - protein, 24 aa, Mycobacterium
NVFANLPGVIHTAARRGLFRSNPE

SEQ ID NO: 841936 - protein, 33 aa, Mycobacterium
NVFDIELLARRLVDVTIWLGRERDTAALPVGYF

SEQ ID NO: 841937 - protein, 26 aa, Mycobacterium
NVFDIGLLARRLVDVTGWLAAQPDTT

SEQ ID NO: 841938 - protein, 25 aa, Mycobacterium
NVFDIGLLARRLVDVTGWLAGQPDT

SEQ ID NO: 841939 - protein, 23 aa, Mycobacterium
NVFGPLFGHIPNLVTMRGDRYRD

SEQ ID NO: 841940 - protein, 29 aa, Mycobacterium
NVFPAVERFAYQPHFYQIAMLAVLTGITK

SEQ ID NO: 841941 - protein, 17 aa, Mycobacterium
NVFPIYPATKNLESWDI

SEQ ID NO: 841942 - protein, 23 aa, Mycobacterium
NVFRVAMIGFPPLPELPPGQIAQ

SEQ ID NO: 841943 - protein, 26 aa, Mycobacterium
NVFTKPIGVTYPWTPPLAERVHGRTV

SEQ ID NO: 841944 - protein, 19 aa, Mycobacterium
NVFVQLVMSNLFGQNAPAI

SEQ ID NO: 841945 - protein, 17 aa, Mycobacterium
NVFYRGRGFLEGQYDDL

SEQ ID NO: 841946 - protein, 26 aa, Mycobacterium
NVGAQLPFWILINPYGSGQIHYSSGS

SEQ ID NO: 841947 - protein, 25 aa, Mycobacterium
NVGAVYDAVLRRARLALAGGHTVIL

SEQ ID NO: 841948 - protein, 17 aa, Mycobacterium
NVGFFNSGVGNFGIFNN

SEQ ID NO: 841949 - protein, 31 aa, Mycobacterium
NVGGLPGDLKFKLVEPLRLLFKDEVRAVGRE

SEQ ID NO: 841950 - protein, 31 aa, Mycobacterium
NVGGLPGDLTFKLVEPLRLLFKDEVRAVGRE

SEQ ID NO: 841951 - protein, 17 aa, Mycobacterium
NVGKWMKRRYRLLEMSQ

SEQ ID NO: 841952 - protein, 18 aa, Mycobacterium
NVGLPWSTQFTAFGAQVF

SEQ ID NO: 841953 - protein, 20 aa, Mycobacterium
NVGLYIPSFCERESKNFPGG

SEQ ID NO: 841954 - protein, 25 aa, Mycobacterium
NVGNLVCPALFDLGEYQKVVVISVT

SEQ ID NO: 841955 - protein, 25 aa, Mycobacterium
NVGPISVPILHIPAAPGVGNSTINP

SEQ ID NO: 841956 - protein, 28 aa, Mycobacterium
NVGQALTGMKYLATRKGPLAAPSFDVVG

SEQ ID NO: 841957 - protein, 18 aa, Mycobacterium
NVGRLALAGLLTNSRHEL

SEQ ID NO: 841958 - protein, 19 aa, Mycobacterium
NVGSWLDLLVARLQALAQS

SEQ ID NO: 841959 - protein, 29 aa, Mycobacterium
NVGWDRDLAMKAYPLWLSGGCMPGKLMPV

SEQ ID NO: 841960 - protein, 18 aa, Mycobacterium
NVGWVYRTLFARVGNRTD

SEQ ID NO: 841961 - protein, 26 aa, Mycobacterium
NVHIGPSDYVAWLDDRKWAYVRLEGR

SEQ ID NO: 841962 - protein, 17 aa, Mycobacterium
NVHIRVAGWPNQQFALL

SEQ ID NO: 841963 - protein, 19 aa, Mycobacterium
NVIAVRYLPDERVSPIPDD

SEQ ID NO: 841964 - protein, 17 aa, Mycobacterium
NVIAWASSGHVGFKGSR

SEQ ID NO: 841965 - protein, 18 aa, Mycobacterium
NVIAWASSGHVGFKGSRK

SEQ ID NO: 841966 - protein, 19 aa, Mycobacterium
NVIAWASSGHVGFKGSRKS

SEQ ID NO: 841967 - protein, 18 aa, Mycobacterium
NVIEAVWPADPLAVRREE

SEQ ID NO: 841968 - protein, 24 aa, Mycobacterium
NVIGVSLPLVQRLISRTGLSISEF

SEQ ID NO: 841969 - protein, 17 aa, Mycobacterium
NVIGVSLPVLRALFERL

SEQ ID NO: 841970 - protein, 22 aa, Mycobacterium
NVIIGERNAIAPPLTMHHRDDG

SEQ ID NO: 841971 - protein, 21 aa, Mycobacterium
NVIIQVTWLYSHAIDLDALQR

SEQ ID NO: 841972 - protein, 19 aa, Mycobacterium
NVITGIFQIGVPMAGWKES

SEQ ID NO: 841973 - protein, 22 aa, Mycobacterium
NVKGRRVGGLSIGYRINHSTKT

SEQ ID NO: 841974 - protein, 20 aa, Mycobacterium
NVKLRLLAEQLIRDYNELVY

SEQ ID NO: 841975 - protein, 21 aa, Mycobacterium
NVKLRPLARQIVREFLALSRR

SEQ ID NO: 841976 - protein, 19 aa, Mycobacterium
NVKPKFAIDALVATAGQAL

SEQ ID NO: 841977 - protein, 24 aa, Mycobacterium
NVKPQVDLWTFPDTGRSIIVLSEG

SEQ ID NO: 841978 - protein, 28 aa, Mycobacterium
NVLAAVNAPTQAVLGRPLIGDGANGSPN

SEQ ID NO: 841979 - protein, 17 aa, Mycobacterium
NVLADFGALSTWADGID

SEQ ID NO: 841980 - protein, 41 aa, Mycobacterium
NVLGPDDLNFLWLPLAHAFGKVMLALPLSIGFTTAIDGRVE

SEQ ID NO: 841981 - protein, 18 aa, Mycobacterium
NVLGQALLAQRMGKKRVI

SEQ ID NO: 841982 - protein, 24 aa, Mycobacterium
NVLHIITAYHRLKLNPNLEIAPRA

SEQ ID NO: 841983 - protein, 23 aa, Mycobacterium
NVLIGNFALFGASGGRLFVQGQA

SEQ ID NO: 841984 - protein, 26 aa, Mycobacterium
NVLITPTVPIPAFPLGADVPPNSGMR

SEQ ID NO: 841985 - protein, 26 aa, Mycobacterium
NVLKETLRLHPPLIILMRVAKGEFEV

SEQ ID NO: 841986 - protein, 27 aa, Mycobacterium
NVLKETLRLHPPLIILMRVAKGEFQVE

SEQ ID NO: 841987 - protein, 29 aa, Mycobacterium
NVLKIRPPLVFSMADVDWFCTEFAGALAH

SEQ ID NO: 841988 - protein, 41 aa, Mycobacterium
NVLKVVLKPFGGLLAFTSLKIPFFTDGVPPFFLTPGLDVER

SEQ ID NO: 841989 - protein, 17 aa, Mycobacterium
NVLLPVPGDVRGLAPGT

SEQ ID NO: 841990 - protein, 18 aa, Mycobacterium
NVLLSPVTVIAASRARML

SEQ ID NO: 841991 - protein, 27 aa, Mycobacterium
NVLMTQNRVRHIPVLDDGRLAGIVSIG

SEQ ID NO: 841992 - protein, 19 aa, Mycobacterium
NVLPLLAIPANLAQGSATL

SEQ ID NO: 841993 - protein, 25 aa, Mycobacterium
NVLSARHFDAWWRKQRLKTPDLLTF

SEQ ID NO: 841994 - protein, 26 aa, Mycobacterium
NVLTAKYLNRLSDLLFILSRVANNGK

SEQ ID NO: 841995 - protein, 19 aa, Mycobacterium
NVLTSLRTLGYGPGDVRAI

SEQ ID NO: 841996 - protein, 18 aa, Mycobacterium
NVLYVVWDDIGIATWDCF

SEQ ID NO: 841997 - protein, 34 aa, Mycobacterium
NVMAAWVILRAIDALLLMPLPNRLDLYEKLALTE

SEQ ID NO: 841998 - protein, 19 aa, Mycobacterium
NVMELWSLLSITAPGLFPN

SEQ ID NO: 841999 - protein, 18 aa, Mycobacterium
NVMLYWVTASAASSARLY

SEQ ID NO: 842000 - protein, 25 aa, Mycobacterium
NVMPVHGTWRMLRANAKLAASAGVA

SEQ ID NO: 842001 - protein, 18 aa, Mycobacterium
NVMTFRYVIKEVAIENGA

SEQ ID NO: 842002 - protein, 18 aa, Mycobacterium
NVMTFRYVIKEVALEEGV

SEQ ID NO: 842003 - protein, 19 aa, Mycobacterium
NVNIRLAIDWLDRWADDMP

SEQ ID NO: 842004 - protein, 24 aa, Mycobacterium
NVNTPLFMNEGTMKLFRPDLENPG

SEQ ID NO: 842005 - protein, 30 aa, Mycobacterium
NVNTVFQHYALFPHMTVWDNVAYGPRSAKK

SEQ ID NO: 842006 - protein, 30 aa, Mycobacterium
NVNTVFQHYALFPHMTVWDNVAYGPRSKKL

SEQ ID NO: 842007 - protein, 18 aa, Mycobacterium
NVNVPLMIIGIGTAAQVS

SEQ ID NO: 842008 - protein, 18 aa, Mycobacterium
NVNYRQLLNIKTVSRRRT

SEQ ID NO: 842009 - protein, 17 aa, Mycobacterium
NVPAPRWEAKDPRTYTL

SEQ ID NO: 842010 - protein, 23 aa, Mycobacterium
NVPAQFLAPIPDGIGAVEAATIP

SEQ ID NO: 842011 - protein, 23 aa, Mycobacterium
NVPAQFLAPIPDGISGVEAATIP

SEQ ID NO: 842012 - protein, 24 aa, Mycobacterium
NVPASLVEYVIMGQVLTAGAGQMP

SEQ ID NO: 842013 - protein, 24 aa, Mycobacterium
NVPEARLVVIKPYEANQLHAIETA

SEQ ID NO: 842014 - protein, 25 aa, Mycobacterium
NVPEARLVVIKPYEASQLGAIENAI

SEQ ID NO: 842015 - protein, 25 aa, Mycobacterium
NVPEARLVVIKPYEASQLRAIEDAI

SEQ ID NO: 842016 - protein, 23 aa, Mycobacterium
NVPEARLVVIKPYEASQVGAIET

SEQ ID NO: 842017 - protein, 24 aa, Mycobacterium
NVPEARMVVIKPYEANQLHAIETA

SEQ ID NO: 842018 - protein, 24 aa, Mycobacterium
NVPEARMVVIKPYEANQLRPIEDA

SEQ ID NO: 842019 - protein, 24 aa, Mycobacterium
NVPEARMVVIKPYESNQLKAIEDA

SEQ ID NO: 842020 - protein, 27 aa, Mycobacterium
NVPGLRALVRLVIYWGQEALAFGMTKR

SEQ ID NO: 842021 - protein, 24 aa, Mycobacterium
NVPGPPMPVYLAGSKVAGIVGWAP

SEQ ID NO: 842022 - protein, 27 aa, Mycobacterium
NVPGPQVPLYFLGAEVKAMYPLGPIFH

SEQ ID NO: 842023 - protein, 17 aa, Mycobacterium
NVPKYTPDWVRTVPIWA

SEQ ID NO: 842024 - protein, 19 aa, Mycobacterium
NVPLFINTGDKLKVDSRDG

SEQ ID NO: 842025 - protein, 18 aa, Mycobacterium
NVPLNRNAWDAAAAKLPP

SEQ ID NO: 842026 - protein, 24 aa, Mycobacterium
NVPNDFVRGLLGPGTLGGTVLGLV

SEQ ID NO: 842027 - protein, 24 aa, Mycobacterium
NVPQAFVHALLFETAHRLKDVGGP

SEQ ID NO: 842028 - protein, 23 aa, Mycobacterium
NVPQSALYLADVIARGGFPDGCF

SEQ ID NO: 842029 - protein, 25 aa, Mycobacterium
NVPQTVLSIPMWANGIKAPLGLGQA

SEQ ID NO: 842030 - protein, 17 aa, Mycobacterium
NVPTPFGLFPDVSLQVV

SEQ ID NO: 842031 - protein, 22 aa, Mycobacterium
NVPYYIQHLVAAARKSWQDTGV

SEQ ID NO: 842032 - protein, 21 aa, Mycobacterium
NVQFHWLKIEDIPEVWRRLDT

SEQ ID NO: 842033 - protein, 19 aa, Mycobacterium
NVQLISTWLAESTVLNLAS

SEQ ID NO: 842034 - protein, 25 aa, Mycobacterium
NVQNNDIPLWLSYRADTSGVAVPKQ

SEQ ID NO: 842035 - protein, 17 aa, Mycobacterium
NVQPWHMVFVSGPARDR

SEQ ID NO: 842036 - protein, 20 aa, Mycobacterium
NVQRLKLLGTLPANLGVEIP

SEQ ID NO: 842037 - protein, 19 aa, Mycobacterium
NVQTVVILGALLADTPHTR

SEQ ID NO: 842038 - protein, 17 aa, Mycobacterium
NVQWRKQQLLQLQRLME

SEQ ID NO: 842039 - protein, 26 aa, Mycobacterium
NVRAKYGWTDVARFAALGIPAVNFGP

SEQ ID NO: 842040 - protein, 23 aa, Mycobacterium
NVRAVPIMTFVARQLDLRRYFAE

SEQ ID NO: 842041 - protein, 25 aa, Mycobacterium
NVRFDGLMTFTLAETLWLADHGFDN

SEQ ID NO: 842042 - protein, 26 aa, Mycobacterium
NVRGVYLMCRQFLPAMTTRGRGDIIN

SEQ ID NO: 842043 - protein, 17 aa, Mycobacterium
NVRILDGGLAAWRSAEE

SEQ ID NO: 842044 - protein, 18 aa, Mycobacterium
NVRIPKENLLGNPEIEVG

SEQ ID NO: 842045 - protein, 18 aa, Mycobacterium
NVRQLCVPTLRGLADELG

SEQ ID NO: 842046 - protein, 25 aa, Mycobacterium
NVRRDPMAMLPFLGYNVGDYFQHWI

SEQ ID NO: 842047 - protein, 24 aa, Mycobacterium
NVRRDPMAMLPFMGYNVGDYVQHW

SEQ ID NO: 842048 - protein, 30 aa, Mycobacterium
NVRRHSLEWIWMQSPLFRQFRGDDWMPDPC

SEQ ID NO: 842049 - protein, 27 aa, Mycobacterium
NVSGQRFAGMLVAGVFLREFVADAVDW

SEQ ID NO: 842050 - protein, 17 aa, Mycobacterium
NVSIKTNMLNPCPMLTL

SEQ ID NO: 842051 - protein, 21 aa, Mycobacterium
NVSIPWHRHGRKIWDVIAVEG

SEQ ID NO: 842052 - protein, 24 aa, Mycobacterium
NVSKLLWANWHRDLGELAMEIIGT

SEQ ID NO: 842053 - protein, 38 aa, Mycobacterium; identical to SEQ ID NO: 121495

SEQ ID NO: 842054 - protein, 18 aa, Mycobacterium
NVSLRQARDWLSRFDLGP

SEQ ID NO: 842055 - protein, 23 aa, Mycobacterium
NVSPKLFLPGLSGLTQGPGFPNL

SEQ ID NO: 842056 - protein, 24 aa, Mycobacterium
NVSPLDQLFVVWTAVNRVSRSGEV

SEQ ID NO: 842057 - protein, 17 aa, Mycobacterium
NVSRLFAERCIVGLVAN

SEQ ID NO: 842058 - protein, 25 aa, Mycobacterium
NVTFPDALDVWPAYALKIAPTPTLA

SEQ ID NO: 842059 - protein, 19 aa, Mycobacterium
NVTKLPGLGGWRRPQEELD

SEQ ID NO: 842060 - protein, 17 aa, Mycobacterium
NVTLAPMKVRRFAKDKA

SEQ ID NO: 842061 - protein, 27 aa, Mycobacterium
NVTLGRKYPWALGRPASEVWAEIWDDI

SEQ ID NO: 842062 - protein, 24 aa, Mycobacterium
NVTLNLAMLTLMQKNLQGTIFGGG

SEQ ID NO: 842063 - protein, 31 aa, Mycobacterium
NVTLTSVLRATRAALRYFREAPHGGVIVNNA

SEQ ID NO: 842064 - protein, 24 aa, Mycobacterium
NVTPCAVIPLGWPIGKYGPTTRRP

SEQ ID NO: 842065 - protein, 23 aa, Mycobacterium
NVTQLFEALAGDGLLSAGQVWSQ

SEQ ID NO: 842066 - protein, 17 aa, Mycobacterium
NVTQVLPGIHPVIGVEA

SEQ ID NO: 842067 - protein, 19 aa, Mycobacterium
NVTRYNALYAAYVELHDWF

SEQ ID NO: 842068 - protein, 19 aa, Mycobacterium
NVVDAYRYWTREAIIADID

SEQ ID NO: 842069 - protein, 20 aa, Mycobacterium
NVVDAYRYWTREAIIADIDR

SEQ ID NO: 842070 - protein, 19 aa, Mycobacterium
NVVDAYRYWTREAIVADID

SEQ ID NO: 842071 - protein, 27 aa, Mycobacterium
NVVDMAHFFYVHGAVPTYFKNIFEGHI

SEQ ID NO: 842072 - protein, 21 aa, Mycobacterium
NVVLVYQYRHPLGRRLWELPA

SEQ ID NO: 842073 - protein, 18 aa, Mycobacterium
NVVMPVRPHWSAGQARFA

SEQ ID NO: 842074 - protein, 25 aa, Mycobacterium
NVVNAPTQALLGRPLVGDGVNGASG

SEQ ID NO: 842075 - protein, 23 aa, Mycobacterium
NVVNPGIFTLISRATCVDFDGSK

SEQ ID NO: 842076 - protein, 19 aa, Mycobacterium
NVVPAVLTLALMGIPLQNW

SEQ ID NO: 842077 - protein, 19 aa, Mycobacterium
NVVRLAPPLVITEPQLEGF

SEQ ID NO: 842078 - protein, 24 aa, Mycobacterium
NVVSALLFGGMWNAPIPDLDRTDH

SEQ ID NO: 842079 - protein, 26 aa, Mycobacterium
NVVSRKCGVPYLYRFELMGTADDVAA

SEQ ID NO: 842080 - protein, 17 aa, Mycobacterium
NVVTPVGWFYPSEKEAA

SEQ ID NO: 842081 - protein, 28 aa, Mycobacterium
NVVVLGLARGGIPVAWEVAAALGAPLDA

SEQ ID NO: 842082 - protein, 18 aa, Mycobacterium
NVVVLRTFSKAYGLAGLR

SEQ ID NO: 842083 - protein, 19 aa, Mycobacterium
NVVVLRTFSKAYGLAGLRV

SEQ ID NO: 842084 - protein, 21 aa, Mycobacterium
NVVVPSLFIAGAADPVLGFTD

SEQ ID NO: 842085 - protein, 25 aa, Mycobacterium
NVVVRGRGWCRLTDVFAAGGLDQPV

SEQ ID NO: 842086 - protein, 18 aa, Mycobacterium
NVVWAIDFQFDSTIDGKA

SEQ ID NO: 842087 - protein, 17 aa, Mycobacterium
NVVWTNFGPCAVEGFET

SEQ ID NO: 842088 - protein, 18 aa, Mycobacterium
NVVWTNRGPCAIEGFEAV

SEQ ID NO: 842089 - protein, 20 aa, Mycobacterium
NVVYTPAVGPLVRMVDTDAA

SEQ ID NO: 842090 - protein, 19 aa, Mycobacterium
NVWLAIALHTTPGITEFLS

SEQ ID NO: 842091 - protein, 25 aa, Mycobacterium
NVWWGHAEAALLRLAEERRIPVLMN

SEQ ID NO: 842092 - protein, 19 aa, Mycobacterium
NVYCNELCFVFGRLPTAPV

SEQ ID NO: 842093 - protein, 21 aa, Mycobacterium
NVYELPDWLAETIAAHGRTYA

SEQ ID NO: 842094 - protein, 21 aa, Mycobacterium
NWADLYLPAGPQQVDSIPLVV

SEQ ID NO: 842095 - protein, 21 aa, Mycobacterium
NWDEVVALSLRAGLGGLECLS

SEQ ID NO: 842096 - protein, 20 aa, Mycobacterium
NWDMAGVWLVQNYGPFTTVA

SEQ ID NO: 842097 - protein, 30 aa, Mycobacterium
NWDVPKHDGLTMFLVPLRHPGITINRVEQV

SEQ ID NO: 842098 - protein, 17 aa, Mycobacterium
NWEDMFSMAKFVGVSRP

SEQ ID NO: 842099 - protein, 19 aa, Mycobacterium
NWEGRLRPFRTTLETSDAL

SEQ ID NO: 842100 - protein, 23 aa, Mycobacterium
NWETFHIAQLLPWVEANFRTYAE

SEQ ID NO: 842101 - protein, 24 aa, Mycobacterium
NWGAGFPERWWWGQAHDFPAADVS

SEQ ID NO: 842102 - protein, 17 aa, Mycobacterium
NWGQQWLKTTGLNTLRP

SEQ ID NO: 842103 - protein, 23 aa, Mycobacterium
NWHEAAIVYLASTLAGMVINPIL

SEQ ID NO: 842104 - protein, 21 aa, Mycobacterium
NWHEAAVIYLAATLAGMVVNP

SEQ ID NO: 842105 - protein, 23 aa, Mycobacterium
NWHEAAVIYLASTLAAMVANPVL

SEQ ID NO: 842106 - protein, 18 aa, Mycobacterium
NWHVRKAMWAPALGCYGP

SEQ ID NO: 842107 - protein, 31 aa, Mycobacterium
NWISRAGMGLQYLLLRSGPLTMPPSTLGAFA

SEQ ID NO: 842108 - protein, 31 aa, Mycobacterium
NWITRAGMGIQYLLLRSGPLTMPPSTLGAFA

SEQ ID NO: 842109 - protein, 29 aa, Mycobacterium
NWITRAGMGIQYLLLRSGPMTMPPSTLGA

SEQ ID NO: 842110 - protein, 26 aa, Mycobacterium
NWLAEYWEHYAYLIDRRSLLYSTGYT

SEQ ID NO: 842111 - protein, 32 aa, Mycobacterium
NWLGNLLEQIGMALLPFAPELTPFFLEAGELI

SEQ ID NO: 842112 - protein, 17 aa, Mycobacterium
NWLIQDPGNPAVAAEQE

SEQ ID NO: 842113 - protein, 21 aa, Mycobacterium
NWLRACLVSCWLASDESARSL

SEQ ID NO: 842114 - protein, 22 aa, Mycobacterium
NWLWWEDRRRELYFLKAGRERG

SEQ ID NO: 842115 - protein, 27 aa, Mycobacterium
NWQGAYDPALIEFFGSRRQADGTLLPD

SEQ ID NO: 842116 - protein, 24 aa, Mycobacterium
NWQSRPYSAWLAYGQSKLANLLFT

SEQ ID NO: 842117 - protein, 23 aa, Mycobacterium
NWRFHQAIHRAAHSPRLLAAIKQ

SEQ ID NO: 842118 - protein, 17 aa, Mycobacterium
NWRYHLNLRKSGDGMDF

SEQ ID NO: 842119 - protein, 20 aa, Mycobacterium
NWSVLTPPEPDARMARPMSV

SEQ ID NO: 842120 - protein, 17 aa, Mycobacterium
NWTLWRDDNERLIPYRA

SEQ ID NO: 842121 - protein, 19 aa, Mycobacterium
NWVAGWVDFAGPTVDVGSL

SEQ ID NO: 842122 - protein, 25 aa, Mycobacterium
NWVATRKPPLFGTHPDARVTTLAAE

SEQ ID NO: 842123 - protein, 26 aa, Mycobacterium
NWVEYPEFLFGINELGAIYAGIPVAY

SEQ ID NO: 842124 - protein, 18 aa, Mycobacterium
NWVWAGAAVLRPDFQRAL

SEQ ID NO: 842125 - protein, 22 aa, Mycobacterium
NYAFFTDVPGLIHAGFPLAEVH

SEQ ID NO: 842126 - protein, 19 aa, Mycobacterium
NYAFFTEIADLSHAGFPLA

SEQ ID NO: 842127 - protein, 18 aa, Mycobacterium
NYAGDVMNFNLAVDQLRS

SEQ ID NO: 842128 - protein, 21 aa, Mycobacterium
NYAHYIASKGAVWALTHALAT

SEQ ID NO: 842129 - protein, 18 aa, Mycobacterium
NYAILNRGKRAYAVDFKD

SEQ ID NO: 842130 - protein, 24 aa, Mycobacterium
NYAKALRMFAVLPTVVAADMRRRR

SEQ ID NO: 842131 - protein, 18 aa, Mycobacterium
NYAKSLRMFAVLPTIVAS

SEQ ID NO: 842132 - protein, 18 aa, Mycobacterium
NYALRMEAAWGREYRRGR

SEQ ID NO: 842133 - protein, 25 aa, Mycobacterium
NYAPRPVLDLPWDIADSPPGRAVAT

SEQ ID NO: 842134 - protein, 22 aa, Mycobacterium
NYARVPLIVLSANRPYELLGTG

SEQ ID NO: 842135 - protein, 25 aa, Mycobacterium
NYARVPLIVLSANRPYEMLGTGANQ

SEQ ID NO: 842136 - protein, 28 aa, Mycobacterium
NYAVHGGVLPMLFDSLFGMCIHAAGRPI

SEQ ID NO: 842137 - protein, 21 aa, Mycobacterium
NYAWIQHILSKLAPGGRAGVV

SEQ ID NO: 842138 - protein, 23 aa, Mycobacterium
NYDAEWIVVLDDWTDGVGKSPQQ

SEQ ID NO: 842139 - protein, 24 aa, Mycobacterium
NYDATLPAMRRIVEALFSDPAYAD

SEQ ID NO: 842140 - protein, 25 aa, Mycobacterium
NYDKDATLWVIDGKTHTVTATVAVG

SEQ ID NO: 842141 - protein, 17 aa, Mycobacterium
NYDLLLPTMEKAGFIQQ

SEQ ID NO: 842142 - protein, 18 aa, Mycobacterium
NYDLLLPTMEKVGFIQKG

SEQ ID NO: 842143 - protein, 17 aa, Mycobacterium
NYDLPWNPMRIEQRIGR

SEQ ID NO: 842144 - protein, 23 aa, Mycobacterium
NYDYRYCWIRDQCYAGQAVAAAG

SEQ ID NO: 842145 - protein, 33 aa, Mycobacterium
NYFEVNVLSAVRLIRAYLPAMIGAGWGRIIQIA

SEQ ID NO: 842146 - protein, 19 aa, Mycobacterium
NYFSPRAYFALAEGLPANR

SEQ ID NO: 842147 - protein, 27 aa, Mycobacterium
NYGAAKLGLVGLLNTLAIEGAKYGITA

SEQ ID NO: 842148 - protein, 25 aa, Mycobacterium
NYGPMFIRMAWHAAGTYRVGDGRGG

SEQ ID NO: 842149 - protein, 20 aa, Mycobacterium
NYHTPVMILSDGAIANGSEP

SEQ ID NO: 842150 - protein, 18 aa, Mycobacterium
NYIFPEGFDPETNEWMEG

SEQ ID NO: 842151 - protein, 24 aa, Mycobacterium
NYKDPLKVLGILTERELGKTYFKL

SEQ ID NO: 842152 - protein, 25 aa, Mycobacterium
NYKVPRSFEFVDELPLSGAGKILKR

SEQ ID NO: 842153 - protein, 19 aa, Mycobacterium
NYLAEWYLADLAEATVDDI

SEQ ID NO: 842154 - protein, 18 aa, Mycobacterium
NYLFDMRTIRRGKVADEG

SEQ ID NO: 842155 - protein, 19 aa, Mycobacterium
NYLIVRAGEFSRISDVLLP

SEQ ID NO: 842156 - protein, 17 aa, Mycobacterium
NYLKQYLVLYTNGGSND

SEQ ID NO: 842157 - protein, 25 aa, Mycobacterium
NYLLLAEIVRLVSGKSLPDFLSIEI

SEQ ID NO: 842158 - protein, 19 aa, Mycobacterium
NYLPFAVNAWTVRVLTRLP

SEQ ID NO: 842159 - protein, 27 aa, Mycobacterium
NYLTPQALIDLVASRSYCIASPTEVRT

SEQ ID NO: 842160 - protein, 23 aa, Mycobacterium
NYMNWNRMHLAHAQWAVAELLEA

SEQ ID NO: 842161 - protein, 19 aa, Mycobacterium
NYPDTQLLRSMLASVTHHL

SEQ ID NO: 842162 - protein, 26 aa, Mycobacterium
NYPQPRLRDRIIERIPIINRFHEPKP

SEQ ID NO: 842163 - protein, 25 aa, Mycobacterium
NYRSLRQLVVPLHQLNVVTGANGSG

SEQ ID NO: 842164 - protein, 24 aa, Mycobacterium
NYRSLRQLVVPLRQLNVVTGANGT

SEQ ID NO: 842165 - protein, 17 aa, Mycobacterium
NYRVGCKRILNSSTYYG

SEQ ID NO: 842166 - protein, 26 aa, Mycobacterium
NYSEAVALARLGWASLAVGTGQAVLD

SEQ ID NO: 842167 - protein, 26 aa, Mycobacterium
NYSGPQRYWWMPGVTQVVPNWNDPNY

SEQ ID NO: 842168 - protein, 24 aa, Mycobacterium
NYSRAYIRHLFKAKEMLSATLCTI

SEQ ID NO: 842169 - protein, 26 aa, Mycobacterium
NYTRAYLHHLFKAKELLAATLCTIHN

SEQ ID NO: 842170 - protein, 19 aa, Mycobacterium
NYWGYNTIGFFAPDSKYSS

SEQ ID NO: 842171 - protein, 18 aa, Mycobacterium
NYWGYNTIGFLAPDSKYS

SEQ ID NO: 842172 - protein, 17 aa, Mycobacterium
NYYTLIGATKANAAGIE

SEQ ID NO: 842173 - protein, 24 aa, Mycobacterium
NYYVEAFTLSILKFRGHRVLHRMI

SEQ ID NO: 842174 - protein, 25 aa, Mycobacterium
PAAADAVSILTAARFSQHGQLFQEI

SEQ ID NO: 842175 - protein, 24 aa, Mycobacterium
PAAAFALPVVRKPAPGLATVLGGG

SEQ ID NO: 842176 - protein, 21 aa, Mycobacterium
PAAALAFLRRLHDETRRIDGF

SEQ ID NO: 842177 - protein, 26 aa, Mycobacterium
PAAALAQLPLLLLDEGHCLRDQALDV

SEQ ID NO: 842178 - protein, 25 aa, Mycobacterium
PAAALDTALRRAAARTFDRLDIDGS

SEQ ID NO: 842179 - protein, 21 aa, Mycobacterium
PAAALTFHWPEVVRQVRVVGA

SEQ ID NO: 842180 - protein, 25 aa, Mycobacterium
PAAAPPAPRKLSYTGAATTLAAGVV

SEQ ID NO: 842181 - protein, 36 aa, Mycobacterium
PAAATHRFLAHLPGYQGWQWAVVVAAHPGADHATVS

SEQ ID NO: 842182 - protein, 39 aa, Mycobacterium
PAACGFPEHHPPMRAFLAVPITIRGTVFGSLYLTHVDPG

SEQ ID NO: 842183 - protein, 33 aa, Mycobacterium
PAADEAMLPSFVFLRRLLLLAWMGSHTHSRESA

SEQ ID NO: 842184 - protein, 24 aa, Mycobacterium
PAADIIEGMWAGCREALAGAADRL

SEQ ID NO: 842185 - protein, 23 aa, Mycobacterium
PAADLLRQQFVLALDGDLDVIGS

SEQ ID NO: 842186 - protein, 25 aa, Mycobacterium
PAADRYVRAGRWPVDGMFPLTRDVS

SEQ ID NO: 842187 - protein, 23 aa, Mycobacterium
PAAEFFTGLWETALASDEILTAV

SEQ ID NO: 842188 - protein, 24 aa, Mycobacterium
PAAELSMVLLDTAAMADLHMRWMD

SEQ ID NO: 842189 - protein, 20 aa, Mycobacterium
PAAELWTHIARRLRGQPRAE

SEQ ID NO: 842190 - protein, 19 aa, Mycobacterium
PAAEMFFAALATGDIAAAA

SEQ ID NO: 842191 - protein, 26 aa, Mycobacterium
PAAEQPWTKKLWVYDLRTNQHFTLKQ

SEQ ID NO: 842192 - protein, 28 aa, Mycobacterium
PAAETPLTMLLLGQVFADAGLPAGVLSI

SEQ ID NO: 842193 - protein, 25 aa, Mycobacterium
PAAEVSRRVGFLKDYLRASSTKGFV

SEQ ID NO: 842194 - protein, 20 aa, Mycobacterium
PAAEYAAVALALDATIEATS

SEQ ID NO: 842195 - protein, 24 aa, Mycobacterium
PAAFRYVMMVLRHVPRPIFRKLPI

SEQ ID NO: 842196 - protein, 17 aa, Mycobacterium
PAAFVRRPQRWIKALSA

SEQ ID NO: 842197 - protein, 21 aa, Mycobacterium
PAAFWQLLRDGVDAVTETPPD

SEQ ID NO: 842198 - protein, 17 aa, Mycobacterium
PAAFYRHFESMEALGLV

SEQ ID NO: 842199 - protein, 28 aa, Mycobacterium
PAAGEAILTGWRMLLDAGRLQDGEPHLS

SEQ ID NO: 842200 - protein, 20 aa, Mycobacterium
PAAGGRLLAPIKPTKLIHTA

SEQ ID NO: 842201 - protein, 36 aa, Mycobacterium
PAAGHDALLPLYDLLTRLFGFTRVYEKLIAQADIGD

SEQ ID NO: 842202 - protein, 18 aa, Mycobacterium
PAAGLLGAPVAQALAAPA

SEQ ID NO: 842203 - protein, 19 aa, Mycobacterium
PAAGPVGLVPLPSKWHIEF

SEQ ID NO: 842204 - protein, 29 aa, Mycobacterium
PAAGVMLSALWVAPTGQLVLIVHHLAVDG

SEQ ID NO: 842205 - protein, 18 aa, Mycobacterium
PAAHWRLGDACELTLLES

SEQ ID NO: 842206 - protein, 25 aa, Mycobacterium
PAAIEGWMPFGRVFETLSWGRRHVV

SEQ ID NO: 842207 - protein, 17 aa, Mycobacterium
PAAIFLVATIDAGGEQT

SEQ ID NO: 842208 - protein, 17 aa, Mycobacterium
PAAILFNFMMNPLVEQF

SEQ ID NO: 842209 - protein, 23 aa, Mycobacterium
PAAIQTLQYLAVQDPLPLADVTA

SEQ ID NO: 842210 - protein, 18 aa, Mycobacterium
PAAIVWAAQMGTITLHPW

SEQ ID NO: 842211 - protein, 34 aa, Mycobacterium
PAAKAVAPRLFWRRKYRLLQRLGKSSPDARLAAS

SEQ ID NO: 842212 - protein, 28 aa, Mycobacterium
PAAKRQYGYYVWPFLLDGQLVGRVDLKA

SEQ ID NO: 842213 - protein, 29 aa, Mycobacterium
PAAKRQYGYYVWPLLMDGRLVARVDLKAD

SEQ ID NO: 842214 - protein, 23 aa, Mycobacterium
PAAKWLALQKMTFEVAWRILQST

SEQ ID NO: 842215 - protein, 20 aa, Mycobacterium
PAALAAFLMTVLHGMAVQAK

SEQ ID NO: 842216 - protein, 25 aa, Mycobacterium
PAALDWLVDRLELTPGESLLDSGAG

SEQ ID NO: 842217 - protein, 17 aa, Mycobacterium
PAALFENLVGYPTFRGL

SEQ ID NO: 842218 - protein, 17 aa, Mycobacterium
PAALLDRWAPGRIMLNA

SEQ ID NO: 842219 - protein, 18 aa, Mycobacterium
PAALPLDVIITNANIYLP

SEQ ID NO: 842220 - protein, 20 aa, Mycobacterium
PAALQDLEGLFARLAAGSTP

SEQ ID NO: 842221 - protein, 19 aa, Mycobacterium
PAALRRLGLDFAAVSDRNP

SEQ ID NO: 842222 - protein, 18 aa, Mycobacterium
PAALRRTPVQAAVGLAVR

SEQ ID NO: 842223 - protein, 18 aa, Mycobacterium
PAALTGEWFGALAVIAPS

SEQ ID NO: 842224 - protein, 21 aa, Mycobacterium
PAAMMLPPPGMGAPAAPVAAG

SEQ ID NO: 842225 - protein, 30 aa, Mycobacterium
PAAPDEFLPKVWRPPTPRCSTMASWWGWCI

SEQ ID NO: 842226 - protein, 31 aa, Mycobacterium
PAAPPPLPEPLPVGPTRRAPLGLIAGARSGD

SEQ ID NO: 842227 - protein, 18 aa, Mycobacterium
PAAPSGYFAWEAAGLRWL

SEQ ID NO: 842228 - protein, 26 aa, Mycobacterium
PAAPSYRSFVTWLTNQDRAAAQAAWA

SEQ ID NO: 842229 - protein, 21 aa, Mycobacterium
PAAPVLTVALPDGWPSTPGTG

SEQ ID NO: 842230 - protein, 24 aa, Mycobacterium
PAAQLTRDVLLPAAASGLDAWGVD

SEQ ID NO: 842231 - protein, 26 aa, Mycobacterium
PAAQRLRAIPPLLGGIRLGLARGVAL

SEQ ID NO: 842232 - protein, 20 aa, Mycobacterium
PAARALRVDKLTLAALEATL

SEQ ID NO: 842233 - protein, 20 aa, Mycobacterium
PAARALRVDKLTLAALEATV

SEQ ID NO: 842234 - protein, 35 aa, Mycobacterium
PAARIVAFVGRIQPLKAPDVLLRAAALLPDVHVVI

SEQ ID NO: 842235 - protein, 27 aa, Mycobacterium
PAARKPHLVVLGGDRPRWVTTDSVGHL

SEQ ID NO: 842236 - protein, 25 aa, Mycobacterium
PAARLLWARVLPTHLTVVRSLLEGA

SEQ ID NO: 842237 - protein, 27 aa, Mycobacterium
PAARPRIRLAYRLTPTRVLGEQRVSGL

SEQ ID NO: 842238 - protein, 20 aa, Mycobacterium
PAARRRLAAILAHHGLAVVT

SEQ ID NO: 842239 - protein, 25 aa, Mycobacterium
PAARTALTFGMQKINLRPIAATQDE

SEQ ID NO: 842240 - protein, 24 aa, Mycobacterium
PAASLMIRMGRLSDRFARMRAQRP

SEQ ID NO: 842241 - protein, 20 aa, Mycobacterium
PAASWQSLSLLLVEDDRADA

SEQ ID NO: 842242 - protein, 18 aa, Mycobacterium
PAATAVVELPPSGALSGI

SEQ ID NO: 842243 - protein, 24 aa, Mycobacterium
PAATGWRMLSGDETGWLLGDYILS

SEQ ID NO: 842244 - protein, 25 aa, Mycobacterium
PAATSWRKLDPWLRHTFSDARQQLP

SEQ ID NO: 842245 - protein, 18 aa, Mycobacterium
PAATVRPLPGGRFCLSGP

SEQ ID NO: 842246 - protein, 26 aa, Mycobacterium
PAAVDLLRRVIDARLAFLISGGTGAG

SEQ ID NO: 842247 - protein, 17 aa, Mycobacterium
PAAVDSFRIAREAFAEA

SEQ ID NO: 842248 - protein, 25 aa, Mycobacterium
PAAVFAPGFGPPRSWQGLLVAARKG

SEQ ID NO: 842249 - protein, 22 aa, Mycobacterium
PAAVLDWRLPAPIGNTAADLGP

SEQ ID NO: 842250 - protein, 32 aa, Mycobacterium
PAAVTLNSLIPLKLRWGISLGALIMHLRQSAL

SEQ ID NO: 842251 - protein, 22 aa, Mycobacterium
PAAVWRFRLVPRDGGTNLTYRT

SEQ ID NO: 842252 - protein, 17 aa, Mycobacterium
PAAWIEMRIDQWNGPTP

SEQ ID NO: 842253 - protein, 24 aa, Mycobacterium
PAAWTHLVGIKPQRGRISTSPLPE

SEQ ID NO: 842254 - protein, 24 aa, Mycobacterium
PAAWTHLVGIKPQRGRISTWPWPE

SEQ ID NO: 842255 - protein, 25 aa, Mycobacterium
PAAYQAAMRLLLNFSPKTLNNDAAI

SEQ ID NO: 842256 - protein, 25 aa, Mycobacterium
PACGAGRAALTPGAPSADVSARSAG

SEQ ID NO: 842257 - protein, 21 aa, Mycobacterium
PACLGYVFYAPPRAVPRAHRF

SEQ ID NO: 842258 - protein, 23 aa, Mycobacterium
PACRFWNLVVWNQFMAVPGVEDA

SEQ ID NO: 842259 - protein, 32 aa, Mycobacterium
PADAADALALAICHCWRAPMIARIARAEALAA

SEQ ID NO: 842260 - protein, 35 aa, Mycobacterium
PADAGPRDFMVDRKYVMFSTEGNGRMIEMIGDIKP

SEQ ID NO: 842261 - protein, 24 aa, Mycobacterium
PADAKPFDFVFHGGSGSLKSEIED

SEQ ID NO: 842262 - protein, 24 aa, Mycobacterium
PADFESARALGCTIKLLSICERIT

SEQ ID NO: 842263 - protein, 24 aa, Mycobacterium
PADFETAHALGCTIKLLSICERIT

SEQ ID NO: 842264 - protein, 17 aa, Mycobacterium
PADFRLWVCLHEVTHRV

SEQ ID NO: 842265 - protein, 21 aa, Mycobacterium
PADFYALLRQTGQHHGPAFAA

SEQ ID NO: 842266 - protein, 39 aa, Mycobacterium
PADGENWWRVVDLWQRIKAPLLDAMLAPFPPVRPMLRLL

SEQ ID NO: 842267 - protein, 26 aa, Mycobacterium
PADGENWWRVVKLWERIKAPLLDAML

SEQ ID NO: 842268 - protein, 23 aa, Mycobacterium
PADGFLPALQRWCRDNDVVFIAD

SEQ ID NO: 842269 - protein, 26 aa, Mycobacterium
PADGFLPTLLDWCRKNDVVFIADEVQ

SEQ ID NO: 842270 - protein, 26 aa, Mycobacterium
PADGRRLFVFLGSTIGNLTPGPRADF

SEQ ID NO: 842271 - protein, 19 aa, Mycobacterium
PADGVGALLRYPASDRLAS

SEQ ID NO: 842272 - protein, 26 aa, Mycobacterium
PADGVYAAWFTLLGHGPTMGTVVPGE

SEQ ID NO: 842273 - protein, 25 aa, Mycobacterium
PADGVYAAWFTVLGHGPVTGTVIPG

SEQ ID NO: 842274 - protein, 26 aa, Mycobacterium
PADGVYAAWFTVLGHGPVVGTVTPGE

SEQ ID NO: 842275 - protein, 28 aa, Mycobacterium
PADIAEIVAFLAGPARWVNGQVIYANGG

SEQ ID NO: 842276 - protein, 17 aa, Mycobacterium
PADIARVVVRLIHTCGQ

SEQ ID NO: 842277 - protein, 26 aa, Mycobacterium
PADIDIALLYDAFASNPAMILEEAGF

SEQ ID NO: 842278 - protein, 23 aa, Mycobacterium
PADIFGELAVFDPAPRACTATAL

SEQ ID NO: 842279 - protein, 17 aa, Mycobacterium
PADIGWAAAFLASDLAS

SEQ ID NO: 842280 - protein, 28 aa, Mycobacterium
PADIRERWAIREVPLHILLDGVDLRDGV

SEQ ID NO: 842281 - protein, 18 aa, Mycobacterium
PADIVSLLPRAIAAARIG

SEQ ID NO: 842282 - protein, 24 aa, Mycobacterium
PADKLMRPGGVVDLLTAPGGLLDR

SEQ ID NO: 842283 - protein, 23 aa, Mycobacterium
PADLGVLSLLGPALAGDAVLSAL

SEQ ID NO: 842284 - protein, 17 aa, Mycobacterium
PADLKWVPGIANYPDRV

SEQ ID NO: 842285 - protein, 22 aa, Mycobacterium
PADLPTFLAAHTPFQGSTAEEL

SEQ ID NO: 842286 - protein, 31 aa, Mycobacterium
PADLRDTWAIREVPLHILLDGADLRDGVDEI

SEQ ID NO: 842287 - protein, 32 aa, Mycobacterium; identical to SEQ ID NO: 121509

SEQ ID NO: 842288 - protein, 22 aa, Mycobacterium
PADLYALLRQAGQNHGPAFAAL

SEQ ID NO: 842289 - protein, 28 aa, Mycobacterium
PADPATLTDLVFAWRACRAVKSNAIVIA

SEQ ID NO: 842290 - protein, 27 aa, Mycobacterium
PADPATLTDLVFAWRSCRAVKSNAIVI

SEQ ID NO: 842291 - protein, 25 aa, Mycobacterium
PADPAVLLIMGIGAQMVFWRPEFCQ

SEQ ID NO: 842292 - protein, 22 aa, Mycobacterium
PADPDAKPRPLATARWAAAVDC

SEQ ID NO: 842293 - protein, 24 aa, Mycobacterium
PADPLDKVVLARALLLTAQGRLDA

SEQ ID NO: 842294 - protein, 32 aa, Mycobacterium
PADPPPLPEPLPDGLLRRAPLGRIAGARSGDK

SEQ ID NO: 842295 - protein, 30 aa, Mycobacterium
PADPVILSAMPFFWIGGLLAAMGALHESIT

SEQ ID NO: 842296 - protein, 25 aa, Mycobacterium
PADQLRWWAEHILLWHRDGHRVVVY

SEQ ID NO: 842297 - protein, 35 aa, Mycobacterium
PADREMTVVSWLPFYHDLGLMMGICQSVLTGFPAV

SEQ ID NO: 842298 - protein, 18 aa, Mycobacterium
PADRLAFILGDADAKLVL

SEQ ID NO: 842299 - protein, 27 aa, Mycobacterium
PADRLSPLMLAFRRAAVERGFSAADDI

SEQ ID NO: 842300 - protein, 22 aa, Mycobacterium
PADRRMVLPPSNAPVIRAAREN

SEQ ID NO: 842301 - protein, 25 aa, Mycobacterium
PADRTEILKGIFRLHELGLVREQAQ

SEQ ID NO: 842302 - protein, 24 aa, Mycobacterium
PADSAWVTVRSQRLSAFDLQARTI

SEQ ID NO: 842303 - protein, 32 aa, Mycobacterium
PADSLRRLALGHWLRRWWPASLREGVGPLDRA

SEQ ID NO: 842304 - protein, 24 aa, Mycobacterium
PADSRLLTRELFYTAVTRAARKVR

SEQ ID NO: 842305 - protein, 25 aa, Mycobacterium
PADTATTAVARRADSTRSAGTAVAK

SEQ ID NO: 842306 - protein, 26 aa, Mycobacterium
PADTELTERPDLFPAWDSLSDTQKKL

SEQ ID NO: 842307 - protein, 25 aa, Mycobacterium
PADTLARWIVRINFSLIAEPADPDD

SEQ ID NO: 842308 - protein, 30 aa, Mycobacterium
PADTLLKESTRWTWWQQRRLQTMIDYATSE

SEQ ID NO: 842309 - protein, 20 aa, Mycobacterium
PADTPPEPAPLLSVAHGPET

SEQ ID NO: 842310 - protein, 19 aa, Mycobacterium
PADVLGCLPRRSLAFDMPA

SEQ ID NO: 842311 - protein, 20 aa, Mycobacterium
PADVYGPGSVWIREPIAMAK

SEQ ID NO: 842312 - protein, 25 aa, Mycobacterium
PADWEPGRKVGWRTALDAWFDVIKA

SEQ ID NO: 842313 - protein, 21 aa, Mycobacterium
PADWHMLQPQWLADLSDARRA

SEQ ID NO: 842314 - protein, 19 aa, Mycobacterium
PADYELVRFANRSARRGRA

SEQ ID NO: 842315 - protein, 27 aa, Mycobacterium
PADYQQWYPTFAESGLVVPTWAREHGG

SEQ ID NO: 842316 - protein, 24 aa, Mycobacterium
PAEAIRIYMTLGRYVLGFANQIGA

SEQ ID NO: 842317 - protein, 19 aa, Mycobacterium
PAEALLMAMAARPCALAEL

SEQ ID NO: 842318 - protein, 24 aa, Mycobacterium
PAEAMLPNAIGLRAPLACLSEARY

SEQ ID NO: 842319 - protein, 24 aa, Mycobacterium
PAEAPLLASRPRRGQGLPLEGIRV

SEQ ID NO: 842320 - protein, 24 aa, Mycobacterium
PAEAPLPVMVFIHGGGYILGSSAT

SEQ ID NO: 842321 - protein, 25 aa, Mycobacterium
PAEAQQPPGIATIAAPEAAVTAGAA

SEQ ID NO: 842322 - protein, 18 aa, Mycobacterium
PAEAVWPPHGVPRSVLVE

SEQ ID NO: 842323 - protein, 21 aa, Mycobacterium
PAECPGDMRLIPLVANGQPAA

SEQ ID NO: 842324 - protein, 26 aa, Mycobacterium
PAEDALAFFRDEPFFRCVRLVELANG

SEQ ID NO: 842325 - protein, 25 aa, Mycobacterium
PAEDEWIWGRATVLAAGYLTGLAAA

SEQ ID NO: 842326 - protein, 27 aa, Mycobacterium
PAEDRAFGLGLWLVDWRFPNRLNRNRW

SEQ ID NO: 842327 - protein, 25 aa, Mycobacterium
PAEFMTTGWFVGHIPFTVAVASSFD

SEQ ID NO: 842328 - protein, 19 aa, Mycobacterium
PAEGEPLLEPLRALFEPIM

SEQ ID NO: 842329 - protein, 24 aa, Mycobacterium
PAEGFLPALLDWCRKNDVVFIADE

SEQ ID NO: 842330 - protein, 25 aa, Mycobacterium
PAEGFLPTLLDWCRANDVVFIADEV

SEQ ID NO: 842331 - protein, 19 aa, Mycobacterium
PAEIAANRTLLMALVATNI

SEQ ID NO: 842332 - protein, 25 aa, Mycobacterium
PAEIEGWMPFGRVFETLSWGRRHVV

SEQ ID NO: 842333 - protein, 33 aa, Mycobacterium
PAEIQKLWSINVDGVLWGIQAAVAQFTTLHNKE

SEQ ID NO: 842334 - protein, 30 aa, Mycobacterium
PAEIRGILSKRLPPYMVPAAVVVLETLPLT

SEQ ID NO: 842335 - protein, 19 aa, Mycobacterium
PAEIRMLRVLGADLVGMST

SEQ ID NO: 842336 - protein, 23 aa, Mycobacterium
PAEKRRSWAVLGEMAELGEDAIA

SEQ ID NO: 842337 - protein, 23 aa, Mycobacterium
PAELADVVLAIVRDRPLQPVARI

SEQ ID NO: 842338 - protein, 19 aa, Mycobacterium
PAELAGLWELPGGKVTPGE

SEQ ID NO: 842339 - protein, 24 aa, Mycobacterium
PAELDWVEPLLAATTTLQVATGIV

SEQ ID NO: 842340 - protein, 19 aa, Mycobacterium
PAELGYFLDCSYRMHPAVC

SEQ ID NO: 842341 - protein, 29 aa, Mycobacterium
PAELHFLGAVLWRRGLHRVLREFVDRGDW

SEQ ID NO: 842342 - protein, 27 aa, Mycobacterium
PAELHYLGAALWRRGIHRVLHGFVQSG

SEQ ID NO: 842343 - protein, 20 aa, Mycobacterium
PAELLARYFEQVNGRYVFHK

SEQ ID NO: 842344 - protein, 18 aa, Mycobacterium
PAELLGSIQRSVIARAGL

SEQ ID NO: 842345 - protein, 17 aa, Mycobacterium
PAELLLFSVGRAAQVEF

SEQ ID NO: 842346 - protein, 17 aa, Mycobacterium
PAELLRRIVKIRSSIIK

SEQ ID NO: 842347 - protein, 18 aa, Mycobacterium
PAELMGPPPPDALLGADL

SEQ ID NO: 842348 - protein, 29 aa, Mycobacterium
PAELRAALAKRLPPYMVPAALVRLEALPL

SEQ ID NO: 842349 - protein, 21 aa, Mycobacterium
PAELRAAWKDIPEVVGAATVT

SEQ ID NO: 842350 - protein, 25 aa, Mycobacterium
PAELRLRNLLKPEQFPYTTKTGWVY

SEQ ID NO: 842351 - protein, 24 aa, Mycobacterium
PAELRPALERAFASGLPAVVNVLT

SEQ ID NO: 842352 - protein, 24 aa, Mycobacterium
PAELRPALQRAFASGLPSVVNVLT

SEQ ID NO: 842353 - protein, 25 aa, Mycobacterium
PAELRQAWLDLHESWLIAKAAQIGI

SEQ ID NO: 842354 - protein, 24 aa, Mycobacterium
PAELRRFVESVPPHILIAIDEAYV

SEQ ID NO: 842355 - protein, 27 aa, Mycobacterium
PAELRTLLADRLPAYMVPAAVVVLDRL

SEQ ID NO: 842356 - protein, 24 aa, Mycobacterium
PAELSELRAGDAARWHALALAATS

SEQ ID NO: 842357 - protein, 19 aa, Mycobacterium
PAELSWVEPLLEATTTLQV

SEQ ID NO: 842358 - protein, 23 aa, Mycobacterium
PAENVRVISPFVGGAFGNAGQVW

SEQ ID NO: 842359 - protein, 19 aa, Mycobacterium
PAEPAAREPVLLWGDARVG

SEQ ID NO: 842360 - protein, 23 aa, Mycobacterium
PAEPAPAAPPPAPPAPRTYTVVS

SEQ ID NO: 842361 - protein, 22 aa, Mycobacterium
PAEPFIAAYRTAADREVLLEEF

SEQ ID NO: 842362 - protein, 17 aa, Mycobacterium
PAEPLELIELPTPEPKA

SEQ ID NO: 842363 - protein, 28 aa, Mycobacterium
PAEQTPASILYLMSLIGDLLPAGVVNVV

SEQ ID NO: 842364 - protein, 26 aa, Mycobacterium
PAEQTPASVLYLMSLIADLVPAGVVN

SEQ ID NO: 842365 - protein, 30 aa, Mycobacterium
PAEQTPLSMLALLGILREAGVPDGVVSVIT

SEQ ID NO: 842366 - protein, 27 aa, Mycobacterium
PAEQTPVSVLYLFSLIGDLLPAGVVNI

SEQ ID NO: 842367 - protein, 28 aa, Mycobacterium
PAEQTPVSVLYLMSLIGDLLPAGVVNVV

SEQ ID NO: 842368 - protein, 29 aa, Mycobacterium
PAEQTPVSVLYLMSLIGDLLPPGVINVVS

SEQ ID NO: 842369 - protein, 25 aa, Mycobacterium
PAERATCAPWLAAEWRLVGPSVAVI

SEQ ID NO: 842370 - protein, 25 aa, Mycobacterium
PAERDTCWPWLQAEWQLVADHVRVV

SEQ ID NO: 842371 - protein, 20 aa, Mycobacterium
PAERITLIPLGGEPVPRADP

SEQ ID NO: 842372 - protein, 20 aa, Mycobacterium
PAERLRMLRSFDPRSGAHVL

SEQ ID NO: 842373 - protein, 26 aa, Mycobacterium
PAERNLLWAVFTDPFVRDLLDDWPVT

SEQ ID NO: 842374 - protein, 20 aa, Mycobacterium
PAERSAVLAKLAKLADEHAE

SEQ ID NO: 842375 - protein, 25 aa, Mycobacterium
PAERYRRWLAVLRGQATVVIGTRAA

SEQ ID NO: 842376 - protein, 24 aa, Mycobacterium
PAERYRRWLSVLRGQARVVIGTRS

SEQ ID NO: 842377 - protein, 27 aa, Mycobacterium
PAESLWAVLARALPEPWRVEALVLLGF

SEQ ID NO: 842378 - protein, 28 aa, Mycobacterium
PAETGTMTHAWLITGPPGSGRSIAALCF

SEQ ID NO: 842379 - protein, 25 aa, Mycobacterium
PAEVRLRNLLKPEQFPYTTKTGWVY

SEQ ID NO: 842380 - protein, 29 aa, Mycobacterium
PAEVRLRNLLKPNQFPYTTKTGWTYDSGD

SEQ ID NO: 842381 - protein, 22 aa, Mycobacterium
PAEWERVLGVNLTGTWLTIRAA

SEQ ID NO: 842382 - protein, 24 aa, Mycobacterium
PAEWKVFLGVLRERFEQDKTKWTK

SEQ ID NO: 842383 - protein, 22 aa, Mycobacterium
PAEWNRVLGVNLTGTWLTIRAG

SEQ ID NO: 842384 - protein, 24 aa, Mycobacterium
PAEWVPGPLKEYHWNTLLRARAIE

SEQ ID NO: 842385 - protein, 30 aa, Mycobacterium
PAEYELLRRNQILFTYLHLAASRACTEALL

SEQ ID NO: 842386 - protein, 20 aa, Mycobacterium
PAEYKLIDRANLLALSPPEL

SEQ ID NO: 842387 - protein, 31 aa, Mycobacterium
PAFAAQPGIFTFGWGPVLHQLAAGLGVKIDN

SEQ ID NO: 842388 - protein, 17 aa, Mycobacterium
PAFADAGLGLVFLGADP

SEQ ID NO: 842389 - protein, 24 aa, Mycobacterium
PAFAEVPAGWRVVFGEAARAACLD

SEQ ID NO: 842390 - protein, 17 aa, Mycobacterium
PAFAFEIAYIIESGLQR

SEQ ID NO: 842391 - protein, 18 aa, Mycobacterium
PAFAIDVEWTLLASMGRL

SEQ ID NO: 842392 - protein, 27 aa, Mycobacterium
PAFAQLEIERMWPKVWQLACMLDHVAA

SEQ ID NO: 842393 - protein, 21 aa, Mycobacterium
PAFEAIIPRLLRDLRGRVFVA

SEQ ID NO: 842394 - protein, 25 aa, Mycobacterium
PAFEKAYAWVVNLQSRSFVGTESRL

SEQ ID NO: 842395 - protein, 18 aa, Mycobacterium
PAFELPPRAVFVAVDFPP

SEQ ID NO: 842396 - protein, 19 aa, Mycobacterium
PAFGGTPPPYPGWPADYGV

SEQ ID NO: 842397 - protein, 26 aa, Mycobacterium
PAFGVELQFWVFDETVIRCPVENSLT

SEQ ID NO: 842398 - protein, 17 aa, Mycobacterium
PAFHAFPASRWRRYDKL

SEQ ID NO: 842399 - protein, 22 aa, Mycobacterium
PAFHAFPASRWRRYDKLERFPG

SEQ ID NO: 842400 - protein, 26 aa, Mycobacterium
PAFIHANVPVIPPLPAGSPIEFPPHQ

SEQ ID NO: 842401 - protein, 23 aa, Mycobacterium
PAFKAPFEPLTPGGFRAPNTNFY

SEQ ID NO: 842402 - protein, 19 aa, Mycobacterium
PAFKAPFEPLTPGGVRIPN

SEQ ID NO: 842403 - protein, 18 aa, Mycobacterium
PAFKLTRSSAAYWRGDQR

SEQ ID NO: 842404 - protein, 24 aa, Mycobacterium
PAFQGTIKSAVAFGALLSKGIGDT

SEQ ID NO: 842405 - protein, 24 aa, Mycobacterium
PAFQGTIKSAVAFGALLSSGIGDT

SEQ ID NO: 842406 - protein, 24 aa, Mycobacterium
PAFRAKQLAHHYFGRLIADPRQMS

SEQ ID NO: 842407 - protein, 19 aa, Mycobacterium
PAFRFSKTPVARPGPAPQL

SEQ ID NO: 842408 - protein, 18 aa, Mycobacterium
PAFRQVFAAQFLPDGTRA

SEQ ID NO: 842409 - protein, 17 aa, Mycobacterium
PAFRQVFAAQFLPEGSR

SEQ ID NO: 842410 - protein, 17 aa, Mycobacterium
PAFSLDYRLAPEHPFPA

SEQ ID NO: 842411 - protein, 17 aa, Mycobacterium
PAGAMISLLSALDARVT

SEQ ID NO: 842412 - protein, 23 aa, Mycobacterium
PAGAPVAWFYDPPWTVPCLRRNE

SEQ ID NO: 842413 - protein, 26 aa, Mycobacterium
PAGARALPYRSNIPKLAMFSFTQVDE

SEQ ID NO: 842414 - protein, 26 aa, Mycobacterium
PAGARELIRAFWPGALSLVVVQAPSL

SEQ ID NO: 842415 - protein, 17 aa, Mycobacterium
PAGAVIGFWQPGTHVGF

SEQ ID NO: 842416 - protein, 20 aa, Mycobacterium
PAGAYFPRGIKPVSVWLSHE

SEQ ID NO: 842417 - protein, 17 aa, Mycobacterium
PAGCVAGVYISWQGIVG

SEQ ID NO: 842418 - protein, 29 aa, Mycobacterium
PAGDSGFPMLPPLMPPPISAGSGWRKRKQ

SEQ ID NO: 842419 - protein, 23 aa, Mycobacterium
PAGEYRYLLIASPAGAYFSQGIK

SEQ ID NO: 842420 - protein, 18 aa, Mycobacterium
PAGFTRIAAFRGGVAGNM

SEQ ID NO: 842421 - protein, 24 aa, Mycobacterium
PAGGLFGRSRPLFSLGLGARLGNG

SEQ ID NO: 842422 - protein, 25 aa, Mycobacterium
PAGGLLLAHHPLLLRGVDRVAASTP

SEQ ID NO: 842423 - protein, 26 aa, Mycobacterium
PAGGRRLFVFLGSTIGNLTPGPRAEF

SEQ ID NO: 842424 - protein, 23 aa, Mycobacterium
PAGHGLHLFATLLAAAEHASGAG

SEQ ID NO: 842425 - protein, 26 aa, Mycobacterium
PAGIRRLFIRWSEWSGSGLWVNLTCR

SEQ ID NO: 842426 - protein, 18 aa, Mycobacterium
PAGKTVFVFPGQGSQWLG

SEQ ID NO: 842427 - protein, 17 aa, Mycobacterium
PAGLELMPVKPGSATVP

SEQ ID NO: 842428 - protein, 21 aa, Mycobacterium
PAGLFGYSHMLGGFAGGQAEY

SEQ ID NO: 842429 - protein, 21 aa, Mycobacterium
PAGLFLVAALHEEPVGCAGLK

SEQ ID NO: 842430 - protein, 29 aa, Mycobacterium
PAGLKGLHDFFKPVLRNLGASARVVVVGT

SEQ ID NO: 842431 - protein, 24 aa, Mycobacterium
PAGLPIHGVLAAYPGWRLTAESAN

SEQ ID NO: 842432 - protein, 22 aa, Mycobacterium
PAGLPPLVFCTDATAFPTMRTP

SEQ ID NO: 842433 - protein, 18 aa, Mycobacterium
PAGLREWIRLRRLGRRER

SEQ ID NO: 842434 - protein, 21 aa, Mycobacterium
PAGLSALAEADLRSLRALLEK

SEQ ID NO: 842435 - protein, 22 aa, Mycobacterium
PAGLSIPQLFTASVNRSPDAVA

SEQ ID NO: 842436 - protein, 33 aa, Mycobacterium
PAGLVFMAWAPDDGVRRWLLRATPVITDELWDG

SEQ ID NO: 842437 - protein, 19 aa, Mycobacterium
PAGLVHDVIVLPYADNRAL

SEQ ID NO: 842438 - protein, 23 aa, Mycobacterium
PAGLWAFEALRVAATRPRLTLDT

SEQ ID NO: 842439 - protein, 20 aa, Mycobacterium
PAGLWCEDAWLTTAMLVGTT

SEQ ID NO: 842440 - protein, 23 aa, Mycobacterium
PAGNLRRYAAAFEALRDRSDAFL

SEQ ID NO: 842441 - protein, 34 aa, Mycobacterium
PAGPARLGMMLFGPLLNLGLRRFLRKLRSYTDAR

SEQ ID NO: 842442 - protein, 23 aa, Mycobacterium
PAGPIVGQAWQFLKELRLERGPL

SEQ ID NO: 842443 - protein, 29 aa, Mycobacterium
PAGPLDFVPLDMPGVFDTGGWLQPNGIAV

SEQ ID NO: 842444 - protein, 20 aa, Mycobacterium
PAGPLPAYGADLRPTAAAPP

SEQ ID NO: 842445 - protein, 17 aa, Mycobacterium
PAGPLPPFNSDIAPRQV

SEQ ID NO: 842446 - protein, 18 aa, Mycobacterium
PAGQVGVDWAPDALEAVI

SEQ ID NO: 842447 - protein, 32 aa, Mycobacterium
PAGRCEFLTAYAKPFSLLVIADMLGVPEADHE

SEQ ID NO: 842448 - protein, 28 aa, Mycobacterium
PAGRGRFLRWALPVAYRLPGLGRLRAPV

SEQ ID NO: 842449 - protein, 24 aa, Mycobacterium
PAGRIELPLLTRTPYFCSGCPHNR

SEQ ID NO: 842450 - protein, 17 aa, Mycobacterium
PAGRQWCAVWSDVHYRV

SEQ ID NO: 842451 - protein, 23 aa, Mycobacterium
PAGRRAMLHHRRAARREFRDQMR

SEQ ID NO: 842452 - protein, 18 aa, Mycobacterium
PAGRRELLSLRLSSAKIA

SEQ ID NO: 842453 - protein, 20 aa, Mycobacterium
PAGRVLLVWDAPNLDMGLGS

SEQ ID NO: 842454 - protein, 21 aa, Mycobacterium
PAGSHLTLLWGAANRDPAIFE

SEQ ID NO: 842455 - protein, 17 aa, Mycobacterium
PAGSLTAPMPGSVIRLP

SEQ ID NO: 842456 - protein, 26 aa, Mycobacterium
PAGSNNPIELPFIGLRHPLGTAVDDA

SEQ ID NO: 842457 - protein, 22 aa, Mycobacterium
PAGSVLVLPGLFPVVGSTEAEA

SEQ ID NO: 842458 - protein, 25 aa, Mycobacterium
PAGTAFAAVTALAARATCRTRGPDL

SEQ ID NO: 842459 - protein, 23 aa, Mycobacterium
PAGTALWFDCNIMHGSGSNITPY

SEQ ID NO: 842460 - protein, 25 aa, Mycobacterium
PAGTLLVRGPYGRGLPFATMFASFY

SEQ ID NO: 842461 - protein, 17 aa, Mycobacterium
PAGTPAATAPSAWSPPV

SEQ ID NO: 842462 - protein, 19 aa, Mycobacterium
PAGTPVIRAMPNAAALVGA

SEQ ID NO: 842463 - protein, 28 aa, Mycobacterium
PAGTSIRILFIFDPRRQAILLLGGDKAG

SEQ ID NO: 842464 - protein, 21 aa, Mycobacterium
PAGVDVHLLPFPDLADDQAGT

SEQ ID NO: 842465 - protein, 21 aa, Mycobacterium
PAGWTDLAARCAVGMDALLGA

SEQ ID NO: 842466 - protein, 31 aa, Mycobacterium
PAGWTPEYFGGEAVPLFGWNSVTVPGAVSAW

SEQ ID NO: 842467 - protein, 19 aa, Mycobacterium
PAHADLLDPIPGNGVFVVG

SEQ ID NO: 842468 - protein, 26 aa, Mycobacterium
PAHALHRKFLVRHLAAKRIRAIEQFA

SEQ ID NO: 842469 - protein, 20 aa, Mycobacterium
PAHCEALLTALVRQASRQGD

SEQ ID NO: 842470 - protein, 27 aa, Mycobacterium
PAHDPLFGVAHFPTLLRTGRFDGGSVL

SEQ ID NO: 842471 - protein, 19 aa, Mycobacterium
PAHDWLTLTGGAIGYGIPA

SEQ ID NO: 842472 - protein, 32 aa, Mycobacterium
PAHGFEPEHPWLLRFFDRISWYPVSAEELLDL

SEQ ID NO: 842473 - protein, 18 aa, Mycobacterium
PAHKELFDRAWKSPDVIE

SEQ ID NO: 842474 - protein, 24 aa, Mycobacterium
PAHLDVALDRFGPPAGDPAWVVKD

SEQ ID NO: 842475 - protein, 24 aa, Mycobacterium
PAHLMAAARLDLPAIVVIGGYQRG

SEQ ID NO: 842476 - protein, 21 aa, Mycobacterium
PAHLQLVLHKLHDAGATVTQS

SEQ ID NO: 842477 - protein, 26 aa, Mycobacterium
PAHLRLRKLVSRPFTPRAIARLGDRV

SEQ ID NO: 842478 - protein, 19 aa, Mycobacterium
PAHPLPAPEALTGVLYRLA

SEQ ID NO: 842479 - protein, 20 aa, Mycobacterium
PAHPPTDPGPRGLAAPAAPG

SEQ ID NO: 842480 - protein, 26 aa, Mycobacterium
PAHQGLHLWLAEFPQPRPPRETWDSN

SEQ ID NO: 842481 - protein, 22 aa, Mycobacterium
PAHQPQPGYLPVLRAYDYAGDE

SEQ ID NO: 842482 - protein, 30 aa, Mycobacterium
PAHQTAYLTELVFRAIIDSGLLPEGSVQLL

SEQ ID NO: 842483 - protein, 19 aa, Mycobacterium
PAHRRRVGLMPQEGALFPH

SEQ ID NO: 842484 - protein, 22 aa, Mycobacterium
PAHRRVIAWIQRHCPNTKVLAA

SEQ ID NO: 842485 - protein, 24 aa, Mycobacterium
PAHRVLVVLGFPDIASAGDATPAI

SEQ ID NO: 842486 - protein, 20 aa, Mycobacterium
PAHRVPVGCGLVAAGGATTT

SEQ ID NO: 842487 - protein, 26 aa, Mycobacterium
PAHTGARPAVTLPPGAHWANDLVEAP

SEQ ID NO: 842488 - protein, 22 aa, Mycobacterium
PAHTVFGQLPLRPTVAFECVGV

SEQ ID NO: 842489 - protein, 31 aa, Mycobacterium
PAHVIAAFDTELFGHWWYEGPTWLERVLRAL

SEQ ID NO: 842490 - protein, 21 aa, Mycobacterium
PAHVRAWGRDAWLRDLMQPLR

SEQ ID NO: 842491 - protein, 20 aa, Mycobacterium
PAHVRAWGRNTRLAELMRPV

SEQ ID NO: 842492 - protein, 26 aa, Mycobacterium
PAIAANRLLLMTLIATNFFGQNTPAI

SEQ ID NO: 842493 - protein, 31 aa, Mycobacterium
PAIAKLVDGLGLKLPIIATPYGTFETASRVA

SEQ ID NO: 842494 - protein, 17 aa, Mycobacterium
PAIALADLHNVTYIARI

SEQ ID NO: 842495 - protein, 20 aa, Mycobacterium
PAIALAQFYDVPMVSTIHAT

SEQ ID NO: 842496 - protein, 19 aa, Mycobacterium
PAIALAVRDALDGTLVEMG

SEQ ID NO: 842497 - protein, 22 aa, Mycobacterium
PAIAMGSFLLLSGDHRVGSPRS

SEQ ID NO: 842498 - protein, 21 aa, Mycobacterium
PAIARLRTQLSATLRAAVLAE

SEQ ID NO: 842499 - protein, 26 aa, Mycobacterium
PAIATLVLLAEQLDWLLGNGGLDWAV

SEQ ID NO: 842500 - protein, 29 aa, Mycobacterium
PAIDLLGALADFFRVPLSALTDPERTYSL

SEQ ID NO: 842501 - protein, 30 aa, Mycobacterium
PAIDMLRGGFELAYRLLSFPKPVVMACTGH

SEQ ID NO: 842502 - protein, 28 aa, Mycobacterium
PAIDMLRGGFELAYRLLSHPKPVVMACT

SEQ ID NO: 842503 - protein, 30 aa, Mycobacterium; identical to SEQ ID NO: 221045

SEQ ID NO: 842504 - protein, 31 aa, Mycobacterium
PAIDMLRGGFELSYRLLSYPKPVVIACTGHA

SEQ ID NO: 842505 - protein, 23 aa, Mycobacterium
PAIDPIMQKVLDAVPFRLSTEDG

SEQ ID NO: 842506 - protein, 20 aa, Mycobacterium
PAIEGALIFPLSATSADGLR

SEQ ID NO: 842507 - protein, 18 aa, Mycobacterium
PAIELIDTRITNWQIKLC

SEQ ID NO: 842508 - protein, 30 aa, Mycobacterium
PAIIAEYLGLPQLTHLRKLSLEGGKVTGER

SEQ ID NO: 842509 - protein, 26 aa, Mycobacterium
PAIIAEYLGLPQLTHLRKLSVEGGKV

SEQ ID NO: 842510 - protein, 20 aa, Mycobacterium
PAIITAFARVDGRPVGVIAN

SEQ ID NO: 842511 - protein, 23 aa, Mycobacterium
PAIKGMWTVPVFGNPTGITYSWE

SEQ ID NO: 842512 - protein, 25 aa, Mycobacterium
PAILDVIYHPWPTTLAAAAQRRGAV

SEQ ID NO: 842513 - protein, 19 aa, Mycobacterium
PAILELYKLGQLNLDDMVT

SEQ ID NO: 842514 - protein, 22 aa, Mycobacterium
PAILNFMRLVPEFTELDAPEFR

SEQ ID NO: 842515 - protein, 17 aa, Mycobacterium
PAIPPREDYRDALVARD

SEQ ID NO: 842516 - protein, 23 aa, Mycobacterium
PAIQFERRWVTWGQIAESARHVS

SEQ ID NO: 842517 - protein, 17 aa, Mycobacterium
PAIRQQIWTLIRAAKMD

SEQ ID NO: 842518 - protein, 24 aa, Mycobacterium
PAISAFNAWVLLKGLETLAVRVDY

SEQ ID NO: 842519 - protein, 20 aa, Mycobacterium
PAITAVVPPAVDPVSLQTAM

SEQ ID NO: 842520 - protein, 28 aa, Mycobacterium
PAITNPGLRRYWPWTAVGRRMAETDALL

SEQ ID NO: 842521 - protein, 22 aa, Mycobacterium
PAIVAGWHDRPWAHHVPVMRET

SEQ ID NO: 842522 - protein, 19 aa, Mycobacterium
PAIVDQMWASGLMSAFNPA

SEQ ID NO: 842523 - protein, 18 aa, Mycobacterium
PAIVVIGGYQRGGTWSGC

SEQ ID NO: 842524 - protein, 22 aa, Mycobacterium
PAIVVLTLGARGAVAFCAAGDA

SEQ ID NO: 842525 - protein, 19 aa, Mycobacterium
PAIVVTPERSLAEGALAGV

SEQ ID NO: 842526 - protein, 28 aa, Mycobacterium
PAIYHDLRIIDNVRYFAALYGYNRQAAD

SEQ ID NO: 842527 - protein, 28 aa, Mycobacterium
PAKCLPLEGIRILDLTRALSGPFCTTLL

SEQ ID NO: 842528 - protein, 18 aa, Mycobacterium
PAKLAKFRDAEALTFPLL

SEQ ID NO: 842529 - protein, 26 aa, Mycobacterium
PAKLEKYTCVFADSVLMMADCFDLAL

SEQ ID NO: 842530 - protein, 17 aa, Mycobacterium
PAKLLEARVGRAAVLEQ

SEQ ID NO: 842531 - protein, 25 aa, Mycobacterium
PAKPEQLPWVQLVAEWRADARGLKV

SEQ ID NO: 842532 - protein, 25 aa, Mycobacterium
PAKPKALHEAKLAIHDLRGRGWTLN

SEQ ID NO: 842533 - protein, 31 aa, Mycobacterium
PAKPTLAARWKPLLEPLLAELAAQDLIVDLR

SEQ ID NO: 842534 - protein, 24 aa, Mycobacterium
PAKQAPFEPLPGYVTHVPYGDIDA

SEQ ID NO: 842535 - protein, 24 aa, Mycobacterium
PAKQAPFQPLPGYVTHVRYGDVDA

SEQ ID NO: 842536 - protein, 18 aa, Mycobacterium
PAKRLAQALGIKDLGNTP

SEQ ID NO: 842537 - protein, 20 aa, Mycobacterium
PAKVLPFNEVLDAAGFRCNF

SEQ ID NO: 842538 - protein, 25 aa, Mycobacterium
PAKVQVPALMRGYLRLGAKVLGEPA

SEQ ID NO: 842539 - protein, 27 aa, Mycobacterium
PALAALCDIFYPRVYLRRGAIVPAGTI

SEQ ID NO: 842540 - protein, 20 aa, Mycobacterium
PALAAWFAATRPPIGGELAG

SEQ ID NO: 842541 - protein, 25 aa, Mycobacterium
PALANRDWPQRVRMGRPLSPDLPAD

SEQ ID NO: 842542 - protein, 18 aa, Mycobacterium
PALARLASAFRKAGRPIV

SEQ ID NO: 842543 - protein, 18 aa, Mycobacterium
PALASLVFVVRPPTATPT

SEQ ID NO: 842544 - protein, 18 aa, Mycobacterium
PALATTSAGLAFALGRRD

SEQ ID NO: 842545 - protein, 26 aa, Mycobacterium
PALCRFEFEYLLNPAPPQAQAVELSL

SEQ ID NO: 842546 - protein, 22 aa, Mycobacterium
PALDAWHRHGLGGTVPFGKGEM

SEQ ID NO: 842547 - protein, 24 aa, Mycobacterium
PALDLDALIGGFHPLFEALDPAQV

SEQ ID NO: 842548 - protein, 20 aa, Mycobacterium
PALERIPALDADLAHWAPSV

SEQ ID NO: 842549 - protein, 21 aa, Mycobacterium
PALEVLHDALASKAREWHTVV

SEQ ID NO: 842550 - protein, 30 aa, Mycobacterium
PALFAVEMGLARLWQSWAIEPDVVLGHSVG

SEQ ID NO: 842551 - protein, 29 aa, Mycobacterium
PALFAVEMGLARLWQSWGIEPDVVLGHSV

SEQ ID NO: 842552 - protein, 23 aa, Mycobacterium
PALFTARLHDAGITVFHVVGTLA

SEQ ID NO: 842553 - protein, 25 aa, Mycobacterium
PALGELWDFLMADWYEIHERRYALD

SEQ ID NO: 842554 - protein, 17 aa, Mycobacterium
PALGPPFGQGEHQVHAG

SEQ ID NO: 842555 - protein, 18 aa, Mycobacterium
PALHLSKGLLTNQGWRGS

SEQ ID NO: 842556 - protein, 28 aa, Mycobacterium
PALHTTVMPFILRGVALLGMDSVLMPIG

SEQ ID NO: 842557 - protein, 17 aa, Mycobacterium
PALIADDAALVALDTDS

SEQ ID NO: 842558 - protein, 18 aa, Mycobacterium
PALIRARLAELGAAARRV

SEQ ID NO: 842559 - protein, 25 aa, Mycobacterium
PALKKTLGVPLFQEQLMQLAVDCAG

SEQ ID NO: 842560 - protein, 18 aa, Mycobacterium
PALKLYLGDSFEGVITIE

SEQ ID NO: 842561 - protein, 20 aa, Mycobacterium
PALLAQLHLTADQLYPGLTR

SEQ ID NO: 842562 - protein, 17 aa, Mycobacterium
PALLEKPVAVTAAEAAH

SEQ ID NO: 842563 - protein, 19 aa, Mycobacterium
PALLLRTCRTAAQRGVAIG

SEQ ID NO: 842564 - protein, 20 aa, Mycobacterium
PALLRALIAVFDLNGVTPAV

SEQ ID NO: 842565 - protein, 20 aa, Mycobacterium
PALLTPGMWVQFQAADASSD

SEQ ID NO: 842566 - protein, 17 aa, Mycobacterium
PALLYTRTPEYVRGAKG

SEQ ID NO: 842567 - protein, 23 aa, Mycobacterium
PALNLEAFFETWFGLANDGKVDP

SEQ ID NO: 842568 - protein, 19 aa, Mycobacterium
PALNLIYAHLNRIIRERDA

SEQ ID NO: 842569 - protein, 18 aa, Mycobacterium
PALRAEFGDRLPVVLLDG

SEQ ID NO: 842570 - protein, 18 aa, Mycobacterium
PALRCAADPLPLTPREWE

SEQ ID NO: 842571 - protein, 23 aa, Mycobacterium
PALREELVTALIRSLPKDLRRNF

SEQ ID NO: 842572 - protein, 24 aa, Mycobacterium
PALRRNHRCARRTRPLLPHHPQHR

SEQ ID NO: 842573 - protein, 20 aa, Mycobacterium
PALSALYERQRAGGGPGAGP

SEQ ID NO: 842574 - protein, 24 aa, Mycobacterium
PALSPFNAWTLVKGLETLDLRVRH

SEQ ID NO: 842575 - protein, 23 aa, Mycobacterium
PALSPIRFFNPLGMKFARRASAS

SEQ ID NO: 842576 - protein, 25 aa, Mycobacterium
PALSRTFRILLPDQPGFGGSYRPTG

SEQ ID NO: 842577 - protein, 22 aa, Mycobacterium
PALTARLPDGSLAARQPLRVVV

SEQ ID NO: 842578 - protein, 25 aa, Mycobacterium
PALTATRFVANPYALQPGSRLYRSG

SEQ ID NO: 842579 - protein, 24 aa, Mycobacterium
PALTINKMCLSGIDAIALADQLIR

SEQ ID NO: 842580 - protein, 24 aa, Mycobacterium
PALTINKMCLSGIDSIALADQLIR

SEQ ID NO: 842581 - protein, 20 aa, Mycobacterium
PALVLPLRATDTVAGVLVAV

SEQ ID NO: 842582 - protein, 19 aa, Mycobacterium
PALVRSHLLEHFARLGVTA

SEQ ID NO: 842583 - protein, 37 aa, Mycobacterium
PALVTPSLAPGWLAWSVDPRPLFGLPALATDSTDADL

SEQ ID NO: 842584 - protein, 19 aa, Mycobacterium
PALYSRLAAIQRRLGVDLD

SEQ ID NO: 842585 - protein, 31 aa, Mycobacterium
PAMAQRTLWAPYWQLLMNALDTKWGAITGRN

SEQ ID NO: 842586 - protein, 22 aa, Mycobacterium
PAMFTLDQYALLAKMVIEDAGV

SEQ ID NO: 842587 - protein, 23 aa, Mycobacterium
PAMIDVVFSWFETGTLQREREVA

SEQ ID NO: 842588 - protein, 19 aa, Mycobacterium
PAMLLADKIERVLVIGSGE

SEQ ID NO: 842589 - protein, 18 aa, Mycobacterium
PAMMAYWSELARDAVLPP

SEQ ID NO: 842590 - protein, 20 aa, Mycobacterium
PAMMLVAGRKYWYASVIEHM

SEQ ID NO: 842591 - protein, 18 aa, Mycobacterium
PAMMSYWSELARDAVLPP

SEQ ID NO: 842592 - protein, 25 aa, Mycobacterium
PAMPAECLLDRNALIMGYSGVYSSF

SEQ ID NO: 842593 - protein, 17 aa, Mycobacterium
PAMPSQPTFYRLVKRLA

SEQ ID NO: 842594 - protein, 24 aa, Mycobacterium
PAMSKFEVLTAMAFAAFADAPVDV

SEQ ID NO: 842595 - protein, 25 aa, Mycobacterium
PAMTFGYLAALHIAGAAPAATSSSG

SEQ ID NO: 842596 - protein, 17 aa, Mycobacterium
PANGWTMVSWDGIPVAP

SEQ ID NO: 842597 - protein, 17 aa, Mycobacterium
PANHPPMRTFLGVPVQV

SEQ ID NO: 842598 - protein, 23 aa, Mycobacterium
PANHVPAPPRLLWADGSNPGELI

SEQ ID NO: 842599 - protein, 20 aa, Mycobacterium
PANILLLTAHHLAVDVVSWH

SEQ ID NO: 842600 - protein, 17 aa, Mycobacterium
PANPYGAALPWPTSDDD

SEQ ID NO: 842601 - protein, 26 aa, Mycobacterium
PANVPTPFGLFPPVSPLTVAEHLAAG

SEQ ID NO: 842602 - protein, 20 aa, Mycobacterium
PANWAGLLDAATSAASTVFD

SEQ ID NO: 842603 - protein, 23 aa, Mycobacterium
PAPAEPVIFLKPNTAIIGPNVPI

SEQ ID NO: 842604 - protein, 18 aa, Mycobacterium
PAPAFFDSATTREAMWQE

SEQ ID NO: 842605 - protein, 26 aa, Mycobacterium
PAPALLSGAAAFKVLYRLRALMQTGE

SEQ ID NO: 842606 - protein, 18 aa, Mycobacterium
PAPAPPGPWDVSGTSLVE

SEQ ID NO: 842607 - protein, 18 aa, Mycobacterium
PAPAPRFSRTRPQPPTAP

SEQ ID NO: 842608 - protein, 25 aa, Mycobacterium
PAPARWAMRIPGGKALQRLLSQAYV

SEQ ID NO: 842609 - protein, 21 aa, Mycobacterium
PAPARWAMRIPGGKVLQRLLS

SEQ ID NO: 842610 - protein, 25 aa, Mycobacterium
PAPDHLRLVTLPWSRDLAAAIERLG

SEQ ID NO: 842611 - protein, 20 aa, Mycobacterium
PAPDPYLRAAALLGVEPRDC

SEQ ID NO: 842612 - protein, 28 aa, Mycobacterium
PAPDTMTYLTALLPVKQGVAVYAALKRT

SEQ ID NO: 842613 - protein, 19 aa, Mycobacterium
PAPEFEAWLSGLGMVGADG

SEQ ID NO: 842614 - protein, 17 aa, Mycobacterium
PAPELNNPTFPLPEFHP

SEQ ID NO: 842615 - protein, 18 aa, Mycobacterium
PAPEPVVYPLERAAEAIA

SEQ ID NO: 842616 - protein, 22 aa, Mycobacterium
PAPFFAQRKIFITGANGFIGAN

SEQ ID NO: 842617 - protein, 29 aa, Mycobacterium
PAPGATWFKNWHYWWQAHLQDCLIDAQLR

SEQ ID NO: 842618 - protein, 27 aa, Mycobacterium
PAPGDPWYSMYTRDPLQAPITPIPAEV

SEQ ID NO: 842619 - protein, 39 aa, Mycobacterium
PAPGNPLHPLALPLLRPKQVIMLGRPTLHRPVSALLADP

SEQ ID NO: 842620 - protein, 19 aa, Mycobacterium
PAPGQWWGVWAAESGDEVV

SEQ ID NO: 842621 - protein, 28 aa, Mycobacterium
PAPHHTRPVRFVWLQHPGTRARLLDRMK

SEQ ID NO: 842622 - protein, 28 aa, Mycobacterium
PAPHHTRPVRFVWLQTPAVRARLLDRMK

SEQ ID NO: 842623 - protein, 27 aa, Mycobacterium
PAPHHTRPVRFVWLQTRDIRLRLLDRM

SEQ ID NO: 842624 - protein, 18 aa, Mycobacterium
PAPKTYVAPIAFNVVPLA

SEQ ID NO: 842625 - protein, 26 aa, Mycobacterium
PAPLDMLSPIAWITDKLRRSDLSADP

SEQ ID NO: 842626 - protein, 27 aa, Mycobacterium
PAPLLEPLAVERLYLDNFFSIAKASRD

SEQ ID NO: 842627 - protein, 26 aa, Mycobacterium
PAPLLEPLAVERLYLDNYFSIAKARR

SEQ ID NO: 842628 - protein, 18 aa, Mycobacterium
PAPLPALVFAHGGGFVFC

SEQ ID NO: 842629 - protein, 19 aa, Mycobacterium
PAPLPSWPTRLGWAVRDWP

SEQ ID NO: 842630 - protein, 18 aa, Mycobacterium
PAPLRWLERRTRDNQLHP

SEQ ID NO: 842631 - protein, 21 aa, Mycobacterium
PAPMVQTLVSALYAGARPAVL

SEQ ID NO: 842632 - protein, 22 aa, Mycobacterium
PAPNCMVYVTVLLPVAQGVGMY

SEQ ID NO: 842633 - protein, 27 aa, Mycobacterium
PAPNGMVYFTVLLPLAQGIGMYAALKH

SEQ ID NO: 842634 - protein, 24 aa, Mycobacterium
PAPNKYVAPIAFNVVPLAGSLVDD

SEQ ID NO: 842635 - protein, 24 aa, Mycobacterium
PAPPAPTLAPRRKTRQLNVGGVGI

SEQ ID NO: 842636 - protein, 25 aa, Mycobacterium
PAPPKAPLPGQRPAPTPGKPAAPQA

SEQ ID NO: 842637 - protein, 30 aa, Mycobacterium
PAPPMEPSPYLPTSRRFVNPLYLRVEAIPE

SEQ ID NO: 842638 - protein, 18 aa, Mycobacterium
PAPPPVIGTGMPAPTMPG

SEQ ID NO: 842639 - protein, 25 aa, Mycobacterium
PAPPSMDYIKGSGGIFRDCAVHDFD

SEQ ID NO: 842640 - protein, 21 aa, Mycobacterium
PAPRMFRLPADRALLNRMGFN

SEQ ID NO: 842641 - protein, 24 aa, Mycobacterium
PAPRRWRSPAPLWGDASFDSVAPA

SEQ ID NO: 842642 - protein, 28 aa, Mycobacterium
PAPSHSALLGRWVALRAAAERVGDDVVA

SEQ ID NO: 842643 - protein, 17 aa, Mycobacterium
PAPSTLLLALMSGFERR

SEQ ID NO: 842644 - protein, 22 aa, Mycobacterium
PAPSYFVYDAILNRKDRELLDQ

SEQ ID NO: 842645 - protein, 26 aa, Mycobacterium
PAPTKKIPLVLSYAMAALGSAKSRLK

SEQ ID NO: 842646 - protein, 33 aa, Mycobacterium
PAPVPLILTHGWPDSFWRYAKVLALLTDPASHG

SEQ ID NO: 842647 - protein, 25 aa, Mycobacterium
PAPVRAFPFNALLKDLDWRIRTGRS

SEQ ID NO: 842648 - protein, 27 aa, Mycobacterium
PAPVRDLDLSTYLRPSRYAEADKFFGF

SEQ ID NO: 842649 - protein, 21 aa, Mycobacterium
PAPVTFVDIAGIVKGASEGAG

SEQ ID NO: 842650 - protein, 17 aa, Mycobacterium
PAPWKAISGITGPTTLP

SEQ ID NO: 842651 - protein, 21 aa, Mycobacterium
PAPWKPLLGMTGPTTLSIEFT

SEQ ID NO: 842652 - protein, 17 aa, Mycobacterium
PAPWVAQLIASGAKVKE

SEQ ID NO: 842653 - protein, 24 aa, Mycobacterium
PAQADPVIFLKPNTAIIGPNVPIR

SEQ ID NO: 842654 - protein, 21 aa, Mycobacterium
PAQAIAQVCELTWQLKGQATG

SEQ ID NO: 842655 - protein, 21 aa, Mycobacterium
PAQAIAQVCELTWQLRGQAGD

SEQ ID NO: 842656 - protein, 22 aa, Mycobacterium
PAQAIAQVCELTWQLRGRATGR

SEQ ID NO: 842657 - protein, 28 aa, Mycobacterium
PAQDMARGQYWIHPALPEVVENALLSLC

SEQ ID NO: 842658 - protein, 25 aa, Mycobacterium
PAQDPPLRAFLGIPITVRAANFGNL

SEQ ID NO: 842659 - protein, 18 aa, Mycobacterium
PAQKRKPLRRSEIDDSLR

SEQ ID NO: 842660 - protein, 23 aa, Mycobacterium
PAQLRAVLNPLLIDSVVALSQAR

SEQ ID NO: 842661 - protein, 24 aa, Mycobacterium
PAQLRPALERAFASGLPAVVNVLT

SEQ ID NO: 842662 - protein, 18 aa, Mycobacterium
PAQNFVDRYARLAHRHAR

SEQ ID NO: 842663 - protein, 27 aa, Mycobacterium
PAQPTAWLAEGLLPYLPADAQDRLFEL

SEQ ID NO: 842664 - protein, 24 aa, Mycobacterium
PAQPTPFTADRWASDTPPSGIPQQ

SEQ ID NO: 842665 - protein, 17 aa, Mycobacterium
PAQPVHVALVLAGAREP

SEQ ID NO: 842666 - protein, 36 aa, Mycobacterium
PAQQRYPAWPASFDASLRLPWRQLQPVDPATLGPNP

SEQ ID NO: 842667 - protein, 27 aa, Mycobacterium
PAQRITLPTYAFQRRRFWLDGTSRAGD

SEQ ID NO: 842668 - protein, 22 aa, Mycobacterium
PAQRRLPSFGIPYWTGRGFGLG

SEQ ID NO: 842669 - protein, 17 aa, Mycobacterium
PAQRRPTGPPLFTLDQY

SEQ ID NO: 842670 - protein, 21 aa, Mycobacterium
PAQTATLIWYYALLLWGVNAP

SEQ ID NO: 842671 - protein, 17 aa, Mycobacterium
PAQTFVTGDRFASILDP

SEQ ID NO: 842672 - protein, 21 aa, Mycobacterium
PAQTWSRLDAPLPAPREVVAQ

SEQ ID NO: 842673 - protein, 29 aa, Mycobacterium
PAQVALAWTLSVAPNVLLIPGTSSVRHLE

SEQ ID NO: 842674 - protein, 18 aa, Mycobacterium
PAQVVLRWHIQRGDIVFP

SEQ ID NO: 842675 - protein, 19 aa, Mycobacterium
PAQVVLRWHIQRGDIVFPK

SEQ ID NO: 842676 - protein, 31 aa, Mycobacterium
PAQWADLGMYLQTVMLLLRAEGLHSCPQMAW

SEQ ID NO: 842677 - protein, 18 aa, Mycobacterium
PAQYRDRYPRELSGGQQQ

SEQ ID NO: 842678 - protein, 26 aa, Mycobacterium
PAQYRIAGWGAALMAIAPAPDLVLDT

SEQ ID NO: 842679 - protein, 24 aa, Mycobacterium
PARAAYLAGIWGAVASLSPELFLR

SEQ ID NO: 842680 - protein, 22 aa, Mycobacterium
PARAAYLAGPWGAVASLSPELF

SEQ ID NO: 842681 - protein, 18 aa, Mycobacterium
PARADAYGPVLRGLLDNA

SEQ ID NO: 842682 - protein, 19 aa, Mycobacterium
PARALLGHPLIPTDGSATA

SEQ ID NO: 842683 - protein, 19 aa, Mycobacterium
PARALRMAKRLLQESRTGV

SEQ ID NO: 842684 - protein, 17 aa, Mycobacterium
PARAPWSTVVAAGDVLT

SEQ ID NO: 842685 - protein, 25 aa, Mycobacterium
PARARMQRRWSIVMVDEFQDTDPVQ

SEQ ID NO: 842686 - protein, 32 aa, Mycobacterium; identical to SEQ ID NO: 116419

SEQ ID NO: 842687 - protein, 21 aa, Mycobacterium
PARFDRGFWVDPTLFTDVDNS

SEQ ID NO: 842688 - protein, 20 aa, Mycobacterium
PARFPDWTSLAEYRDFAAQV

SEQ ID NO: 842689 - protein, 17 aa, Mycobacterium
PARGFLPTGGRALRVFE

SEQ ID NO: 842690 - protein, 17 aa, Mycobacterium
PARGFLPTGGRVLRVIE

SEQ ID NO: 842691 - protein, 24 aa, Mycobacterium
PARGIQLFIELWKAQLAETEMQAG

SEQ ID NO: 842692 - protein, 24 aa, Mycobacterium
PARGLKGFRRSYLEATYAHRVASL

SEQ ID NO: 842693 - protein, 26 aa, Mycobacterium
PARGYHLELITPVPLPRKPSGDLARL

SEQ ID NO: 842694 - protein, 18 aa, Mycobacterium
PARIGVMPREGGNRDVRW

SEQ ID NO: 842695 - protein, 37 aa, Mycobacterium
PARIQAMLGALLELFQARALHPLPIKTWDVRCTPAAY

SEQ ID NO: 842696 - protein, 18 aa, Mycobacterium
PARIVGLPDQGRPLEVGE

SEQ ID NO: 842697 - protein, 27 aa, Mycobacterium
PARKLDLPTYPFERRQYWFSDKRDGDN

SEQ ID NO: 842698 - protein, 33 aa, Mycobacterium
PARLIAAGSKLAELVFPAPPAPIAATGGDPVSA

SEQ ID NO: 842699 - protein, 21 aa, Mycobacterium
PARLLKTKWTDAWDAPEAPEP

SEQ ID NO: 842700 - protein, 34 aa, Mycobacterium
PARLTSRGRDDRLRWWAGPWPVDERWWDDRPEAG

SEQ ID NO: 842701 - protein, 27 aa, Mycobacterium
PARLTVDLLRPVALQPLQMHSSVVRDG

SEQ ID NO: 842702 - protein, 21 aa, Mycobacterium
PARLYGLAKLGFTQSYTYFTW

SEQ ID NO: 842703 - protein, 25 aa, Mycobacterium
PARLYGLARLGFTQSYTYFTWRTGK

SEQ ID NO: 842704 - protein, 23 aa, Mycobacterium
PARMPVARPTSWRVPDTDSLPAL

SEQ ID NO: 842705 - protein, 29 aa, Mycobacterium
PARNVGFVGVRWPSTLWRDEPIPDFPATP

SEQ ID NO: 842706 - protein, 32 aa, Mycobacterium
PARNVVPKPLQKPHPPVWVACTRPASVQMAAQ

SEQ ID NO: 842707 - protein, 30 aa, Mycobacterium
PARPKAASNPDWFAALGSFSYQTSGVAMPN

SEQ ID NO: 842708 - protein, 19 aa, Mycobacterium
PARPLTVTGGLTFAGGPWN

SEQ ID NO: 842709 - protein, 20 aa, Mycobacterium
PARPLTVTGGLTFAGGPWSN

SEQ ID NO: 842710 - protein, 24 aa, Mycobacterium
PARPRAGLIGCAFADLAEIMAGVF

SEQ ID NO: 842711 - protein, 23 aa, Mycobacterium
PARPVFFDMCPPNRMIGGPNPEG

SEQ ID NO: 842712 - protein, 24 aa, Mycobacterium
PARQAADLAYFRVLIHGTRNRALG

SEQ ID NO: 842713 - protein, 26 aa, Mycobacterium
PARQLRWVAAPVFHRRGEVLGALGVA

SEQ ID NO: 842714 - protein, 17 aa, Mycobacterium
PARRRRRRRAGSRGVRG

SEQ ID NO: 842715 - protein, 17 aa, Mycobacterium
PARSFLAQVPRSVLEPT

SEQ ID NO: 842716 - protein, 25 aa, Mycobacterium
PARSLRNVFAAYTLYDLTARLVLGD

SEQ ID NO: 842717 - protein, 27 aa, Mycobacterium
PARSVYEPAPRSPALGVGVPAPIPQFE

SEQ ID NO: 842718 - protein, 20 aa, Mycobacterium
PARTVTLPLHTNPRAKMSGL

SEQ ID NO: 842719 - protein, 27 aa, Mycobacterium
PARVELPGYPFERQRYWIAPSDGIQPI

SEQ ID NO: 842720 - protein, 26 aa, Mycobacterium
PARVGWFRYYFADDRWEWSDEVAMLH

SEQ ID NO: 842721 - protein, 21 aa, Mycobacterium
PARVKLMSLLFSSPANEENSG

SEQ ID NO: 842722 - protein, 27 aa, Mycobacterium
PARVPFDHPLWVLFSSGTTGLPKGIVH

SEQ ID NO: 842723 - protein, 22 aa, Mycobacterium
PARVRMHQRWPIVMVDEFQDTD

SEQ ID NO: 842724 - protein, 23 aa, Mycobacterium
PARVTPTLQPLRPLRGGPAARPV

SEQ ID NO: 842725 - protein, 20 aa, Mycobacterium
PARVWSLVSDIKLMPTLSNE

SEQ ID NO: 842726 - protein, 17 aa, Mycobacterium
PARWFLDHARVALSSGH

SEQ ID NO: 842727 - protein, 17 aa, Mycobacterium
PARWKYVHLGNHTLHGT

SEQ ID NO: 842728 - protein, 19 aa, Mycobacterium
PARWMRTLAEHPHTWSSAP

SEQ ID NO: 842729 - protein, 21 aa, Mycobacterium
PASAIALLRAMGERGYRVGEL

SEQ ID NO: 842730 - protein, 24 aa, Mycobacterium
PASASKTWVAAVTTVAALATADNG

SEQ ID NO: 842731 - protein, 24 aa, Mycobacterium
PASASPIHALQQQALTAINGPIQT

SEQ ID NO: 842732 - protein, 21 aa, Mycobacterium
PASAWEPLILARRIRDYSPQM

SEQ ID NO: 842733 - protein, 31 aa, Mycobacterium
PASAYQRYFGCPPFFCEPVGGFTLRATDMQK

SEQ ID NO: 842734 - protein, 24 aa, Mycobacterium
PASEELTLWASTQTPHELRAFCAR

SEQ ID NO: 842735 - protein, 20 aa, Mycobacterium
PASELPLPILPIESDPPETQ

SEQ ID NO: 842736 - protein, 24 aa, Mycobacterium
PASEPAVALAFDEASRRGVGLVAV

SEQ ID NO: 842737 - protein, 25 aa, Mycobacterium
PASEQPWTTKLWVYDLRTNQHFTLK

SEQ ID NO: 842738 - protein, 19 aa, Mycobacterium
PASFIAFDLLALGDDDYTT

SEQ ID NO: 842739 - protein, 19 aa, Mycobacterium
PASFQGVLTNLGWSVDDDI

SEQ ID NO: 842740 - protein, 21 aa, Mycobacterium
PASGIYRYFSGKADILAAGFR

SEQ ID NO: 842741 - protein, 30 aa, Mycobacterium
PASGVLALIKVLLAFQHRMYPPAANFTAPN

SEQ ID NO: 842742 - protein, 17 aa, Mycobacterium
PASGYLLTAPDAPPLVI

SEQ ID NO: 842743 - protein, 22 aa, Mycobacterium
PASHLDIWLGGSSRAGYRRIGE

SEQ ID NO: 842744 - protein, 28 aa, Mycobacterium
PASIEYGGLLRLWYDVRIGRDEFGFPLN

SEQ ID NO: 842745 - protein, 22 aa, Mycobacterium
PASILYLMEVIGDLLPAGVVNV

SEQ ID NO: 842746 - protein, 27 aa, Mycobacterium
PASLEEARPLFPHHLDTIVNVPAPTWE

SEQ ID NO: 842747 - protein, 23 aa, Mycobacterium
PASLKWHDTARRSWLRELGRIPR

SEQ ID NO: 842748 - protein, 18 aa, Mycobacterium
PASLLSAWLDRQADPEGA

SEQ ID NO: 842749 - protein, 23 aa, Mycobacterium
PASMLFPHLYGTLPVAAVTRVTP

SEQ ID NO: 842750 - protein, 27 aa, Mycobacterium
PASMRKFFNAFAPYGLPETAVKPSYGL

SEQ ID NO: 842751 - protein, 25 aa, Mycobacterium
PASMRKFYEAFAPYGLRETAVKPSY

SEQ ID NO: 842752 - protein, 26 aa, Mycobacterium
PASMTPFPTMHELFNIGWGIPDVRQQ

SEQ ID NO: 842753 - protein, 24 aa, Mycobacterium
PASMVTDVLWQWPPSVSDCHDNQT

SEQ ID NO: 842754 - protein, 22 aa, Mycobacterium
PASNMHVLAPLAKPFHFNEVRV

SEQ ID NO: 842755 - protein, 20 aa, Mycobacterium
PASPVRWPEQLRPALSTVGF

SEQ ID NO: 842756 - protein, 17 aa, Mycobacterium
PASRPRELTLDDAVVWR

SEQ ID NO: 842757 - protein, 17 aa, Mycobacterium
PASTIYRYFSGKSAVLS

SEQ ID NO: 842758 - protein, 19 aa, Mycobacterium
PASTSATWPLIRSTGKLAV

SEQ ID NO: 842759 - protein, 18 aa, Mycobacterium
PASTWWSWRGHDVHILRA

SEQ ID NO: 842760 - protein, 23 aa, Mycobacterium
PASVFAVLPRLEGHFTLVFAHAD

SEQ ID NO: 842761 - protein, 19 aa, Mycobacterium
PASVLATVGLDRPATQRFT

SEQ ID NO: 842762 - protein, 19 aa, Mycobacterium
PASVLSVLRRLEGHFTLVF

SEQ ID NO: 842763 - protein, 21 aa, Mycobacterium
PASWTSVIPTLNGGAISGLPN

SEQ ID NO: 842764 - protein, 26 aa, Mycobacterium
PATAIKFLEQLWNRDLSDHDPDGPLP

SEQ ID NO: 842765 - protein, 26 aa, Mycobacterium
PATALADLPLLLLDEGHCLRDQALDV

SEQ ID NO: 842766 - protein, 18 aa, Mycobacterium
PATALAWREGFLDGQHLR

SEQ ID NO: 842767 - protein, 27 aa, Mycobacterium
PATAPAWAKPVLAANRPLAAEIAVFRA

SEQ ID NO: 842768 - protein, 25 aa, Mycobacterium
PATARRLIGWLHRIIDAFATDADTT

SEQ ID NO: 842769 - protein, 25 aa, Mycobacterium
PATARVLFCHPNTVRYRLRRLKQLT

SEQ ID NO: 842770 - protein, 25 aa, Mycobacterium
PATDIGPVVAFLIGSDATYITGQTI

SEQ ID NO: 842771 - protein, 25 aa, Mycobacterium
PATEEFLRFFTPAPGDGRTFAEDAE

SEQ ID NO: 842772 - protein, 25 aa, Mycobacterium
PATEEFLRFFTPAPGDGRTIADEIE

SEQ ID NO: 842773 - protein, 25 aa, Mycobacterium
PATEEFLRYFTPAPGDGRTFAEDTE

SEQ ID NO: 842774 - protein, 25 aa, Mycobacterium
PATEEFLRYFTPAPGDGRTFSDDVE

SEQ ID NO: 842775 - protein, 17 aa, Mycobacterium
PATEHGYLDAAYYAKVG

SEQ ID NO: 842776 - protein, 28 aa, Mycobacterium
PATELLCRVVAELPRRLAQEPDDLVVCH

SEQ ID NO: 842777 - protein, 24 aa, Mycobacterium
PATEMNALAIPWIESIDVTNAVLF

SEQ ID NO: 842778 - protein, 19 aa, Mycobacterium
PATGEPLLEPLRALFEPIM

SEQ ID NO: 842779 - protein, 27 aa, Mycobacterium
PATGGFVLFYHLLWELTHVCFEHPGLL

SEQ ID NO: 842780 - protein, 25 aa, Mycobacterium
PATGQFLWQNIFGVWPVSGEVTAEL

SEQ ID NO: 842781 - protein, 25 aa, Mycobacterium
PATGQFLWQNIFGVWPVSGQVTREL

SEQ ID NO: 842782 - protein, 28 aa, Mycobacterium
PATGQPVILLHGWPYDIHSYADVSALLA

SEQ ID NO: 842783 - protein, 22 aa, Mycobacterium
PATGVNFGPWARGGMASSEAAA

SEQ ID NO: 842784 - protein, 25 aa, Mycobacterium
PATHLGGVLYLFVRGMCGAGTPVVD

SEQ ID NO: 842785 - protein, 23 aa, Mycobacterium
PATHRLVKKWIQQGRFDVLHLHE

SEQ ID NO: 842786 - protein, 26 aa, Mycobacterium
PATIATDPYGAGWLYSVQPTAVGELL

SEQ ID NO: 842787 - protein, 19 aa, Mycobacterium
PATIGVIPAWLERSKRGEA

SEQ ID NO: 842788 - protein, 24 aa, Mycobacterium
PATILPVVAAFHAIRPLSGDEIEA

SEQ ID NO: 842789 - protein, 25 aa, Mycobacterium
PATIVPMFVLYDYTFLPEGANSKAE

SEQ ID NO: 842790 - protein, 37 aa, Mycobacterium
PATLDLSLSYDVSPIQLQLLYIPPTTGLGNTSSSPSS

SEQ ID NO: 842791 - protein, 23 aa, Mycobacterium
PATLFPIPNPFVIGTDLVIGAVH

SEQ ID NO: 842792 - protein, 17 aa, Mycobacterium
PATLLRAGQKTGEFCYF

SEQ ID NO: 842793 - protein, 23 aa, Mycobacterium
PATLSMPFSAFPTPADYARLPTV

SEQ ID NO: 842794 - protein, 18 aa, Mycobacterium
PATMFPNMSFSAGFPRTI

SEQ ID NO: 842795 - protein, 17 aa, Mycobacterium
PATMMARWFRTEQARAL

SEQ ID NO: 842796 - protein, 23 aa, Mycobacterium
PATPALAAILPSFPSNLKKQLKG

SEQ ID NO: 842797 - protein, 18 aa, Mycobacterium
PATPEPVAALILGELRTA

SEQ ID NO: 842798 - protein, 18 aa, Mycobacterium
PATPWQHSRFWVTDRSAM

SEQ ID NO: 842799 - protein, 24 aa, Mycobacterium
PATRASGVLPRYGVRLTVMAHPPA

SEQ ID NO: 842800 - protein, 19 aa, Mycobacterium
PATRKKLLTDIFALAMELG

SEQ ID NO: 842801 - protein, 25 aa, Mycobacterium
PATRRMRWLRWPTAWASRVGCSTRS

SEQ ID NO: 842802 - protein, 30 aa, Mycobacterium
PATRRPIHLTGLDKTFALYPTLDEALTGVR

SEQ ID NO: 842803 - protein, 33 aa, Mycobacterium
PATRRPIHLTGLDKTFPLYPALDDALTGVRDGK

SEQ ID NO: 842804 - protein, 33 aa, Mycobacterium
PATRRPIHLTGLDKTFPLYPTLDDALTAVRDDN

SEQ ID NO: 842805 - protein, 33 aa, Mycobacterium; identical to SEQ ID NO: 116427

SEQ ID NO: 842806 - protein, 25 aa, Mycobacterium
PATRSWWVQAFCVPAFAVDRPFAAK

SEQ ID NO: 842807 - protein, 24 aa, Mycobacterium
PATSRPLKLVGIADIVALYSNLDE

SEQ ID NO: 842808 - protein, 20 aa, Mycobacterium
PATSVNFGPWAQGGMAASEA

SEQ ID NO: 842809 - protein, 18 aa, Mycobacterium
PATTGLHRVLTTPLVRSG

SEQ ID NO: 842810 - protein, 20 aa, Mycobacterium
PATTLRLPGLILTAPGEPQS

SEQ ID NO: 842811 - protein, 23 aa, Mycobacterium
PATTLTWVLRRGISSDTFGGGTA

SEQ ID NO: 842812 - protein, 24 aa, Mycobacterium
PATTQSVRIRNVGGFSGMYSQGGD

SEQ ID NO: 842813 - protein, 17 aa, Mycobacterium
PATTWRSPSPPAAPQPS

SEQ ID NO: 842814 - protein, 25 aa, Mycobacterium
PATVAMWRHWLAGRAAPDGAVPARA

SEQ ID NO: 842815 - protein, 19 aa, Mycobacterium
PATVAVQPVPWPAANSMLD

SEQ ID NO: 842816 - protein, 23 aa, Mycobacterium
PATVFVANFIGQANLWPGRQTER

SEQ ID NO: 842817 - protein, 18 aa, Mycobacterium
PATYFSGGKIQWILDNVP

SEQ ID NO: 842818 - protein, 20 aa, Mycobacterium
PAVAADDICLLLYTSGTASA

SEQ ID NO: 842819 - protein, 21 aa, Mycobacterium
PAVAATLLRTRRVRRHRAVVR

SEQ ID NO: 842820 - protein, 24 aa, Mycobacterium
PAVADWLYWRYVAGLLANALADAS

SEQ ID NO: 842821 - protein, 21 aa, Mycobacterium
PAVARFLARWVCEAGPRILEP

SEQ ID NO: 842822 - protein, 31 aa, Mycobacterium
PAVARRVARWMVVFLQRPGGQAQFSVWAESA

SEQ ID NO: 842823 - protein, 23 aa, Mycobacterium
PAVDAWLCGWDEKFTTALAARGW

SEQ ID NO: 842824 - protein, 24 aa, Mycobacterium
PAVDRAILRVAVWELLHAQDVPEV

SEQ ID NO: 842825 - protein, 26 aa, Mycobacterium
PAVDRVRPLLGCYGDPVLHVGPAGAG

SEQ ID NO: 842826 - protein, 24 aa, Mycobacterium
PAVDYPAMLDLLASGALQPERLVT

SEQ ID NO: 842827 - protein, 18 aa, Mycobacterium
PAVEELLRWATPVMHFRR

SEQ ID NO: 842828 - protein, 19 aa, Mycobacterium
PAVFAWEQQAIFSGWTCVG

SEQ ID NO: 842829 - protein, 19 aa, Mycobacterium
PAVFIFNHRNQVDPVIAGA

SEQ ID NO: 842830 - protein, 17 aa, Mycobacterium
PAVFRRPPAGPIAEGAN

SEQ ID NO: 842831 - protein, 24 aa, Mycobacterium
PAVGALLSLLAKLSGGKAVAEVGT

SEQ ID NO: 842832 - protein, 24 aa, Mycobacterium
PAVGALLSLLTKLSGGKAVAEVGT

SEQ ID NO: 842833 - protein, 24 aa, Mycobacterium
PAVGALLSMLAKLSGGKAVAEVGT

SEQ ID NO: 842834 - protein, 19 aa, Mycobacterium
PAVGHRLLARLQAEGTPQQ

SEQ ID NO: 842835 - protein, 18 aa, Mycobacterium
PAVGHRLLARLQVETSAR

SEQ ID NO: 842836 - protein, 27 aa, Mycobacterium
PAVHAFTDRGWRWGGEWTAPLDYQHFE

SEQ ID NO: 842837 - protein, 26 aa, Mycobacterium
PAVIAEYLGLPQLTHVRKLNVENGKV

SEQ ID NO: 842838 - protein, 18 aa, Mycobacterium
PAVIAHHPAPPGAPTVLL

SEQ ID NO: 842839 - protein, 18 aa, Mycobacterium
PAVIARHPAPPGAPTVLL

SEQ ID NO: 842840 - protein, 20 aa, Mycobacterium
PAVIARYPAPPGAPTVLLYA

SEQ ID NO: 842841 - protein, 28 aa, Mycobacterium
PAVIKNAIDWLSRPFGDGALKDKPLAVI

SEQ ID NO: 842842 - protein, 28 aa, Mycobacterium
PAVIKNAIDWLSRPFGDGALKGKPLAVI

SEQ ID NO: 842843 - protein, 25 aa, Mycobacterium
PAVKQAWIDLLGPQVVWELYGGTEL

SEQ ID NO: 842844 - protein, 20 aa, Mycobacterium
PAVKRALDLALRLTSTFLVN

SEQ ID NO: 842845 - protein, 25 aa, Mycobacterium
PAVKRAWIDIVGPDALWELYGGTEL

SEQ ID NO: 842846 - protein, 18 aa, Mycobacterium
PAVLAAIPAGYRALVVDN

SEQ ID NO: 842847 - protein, 17 aa, Mycobacterium
PAVLDFGVEQDWAWLRT

SEQ ID NO: 842848 - protein, 19 aa, Mycobacterium
PAVLEPFSGPWGTDTLLDL

SEQ ID NO: 842849 - protein, 30 aa, Mycobacterium
PAVLGPIGSITLLPLYFELDGSFPNHEANP

SEQ ID NO: 842850 - protein, 26 aa, Mycobacterium
PAVLKPYVDRWFWQVKGHVGGLTPQS

SEQ ID NO: 842851 - protein, 17 aa, Mycobacterium
PAVLLIPKDVQQARLAV

SEQ ID NO: 842852 - protein, 18 aa, Mycobacterium
PAVLLLPKDIQQAHLDAG

SEQ ID NO: 842853 - protein, 18 aa, Mycobacterium
PAVLLLPKDIQQGCVEIE

SEQ ID NO: 842854 - protein, 18 aa, Mycobacterium
PAVLLQHRAFWSHQGGTW

SEQ ID NO: 842855 - protein, 17 aa, Mycobacterium
PAVLLYLGDQLEGVITV

SEQ ID NO: 842856 - protein, 24 aa, Mycobacterium
PAVLQQMTLARFEYVGITLGRKPH

SEQ ID NO: 842857 - protein, 18 aa, Mycobacterium
PAVLRYGVRALLSPSSPV

SEQ ID NO: 842858 - protein, 25 aa, Mycobacterium
PAVLSRALTFLAEYQDRLPFDRLAA

SEQ ID NO: 842859 - protein, 35 aa, Mycobacterium
PAVLVARPVKAAPDPPWGLRAPPATAAPADSAATA

SEQ ID NO: 842860 - protein, 22 aa, Mycobacterium
PAVMARWLAGVLPGNAAPEVTV

SEQ ID NO: 842861 - protein, 17 aa, Mycobacterium
PAVMPMDAWREEGQFIV

SEQ ID NO: 842862 - protein, 36 aa, Mycobacterium
PAVMSAKIIWDVAFYWGFIGLLYMNNRYARVADDPE

SEQ ID NO: 842863 - protein, 26 aa, Mycobacterium
PAVNKLGTMGLILRGSDDLKKQVLPS

SEQ ID NO: 842864 - protein, 36 aa, Mycobacterium
PAVPGKFYWMSTTQLRWRPIDFWPADTTVSIDASGT

SEQ ID NO: 842865 - protein, 24 aa, Mycobacterium
PAVPNLLVELGFPGTRWVNFRAPR

SEQ ID NO: 842866 - protein, 40 aa, Mycobacterium
PAVPPNIAYFLDRGLRDTGRWRVPLILRLDPKVGSEDVRA

SEQ ID NO: 842867 - protein, 41 aa, Mycobacterium
PAVPPNIAYFLDRGLRDTGRWRVPLILRLDPQVGPEDIRAV

SEQ ID NO: 842868 - protein, 18 aa, Mycobacterium
PAVPRDAGALRLLLAVDA

SEQ ID NO: 842869 - protein, 18 aa, Mycobacterium
PAVPWDRAYSVPSPSWAM

SEQ ID NO: 842870 - protein, 24 aa, Mycobacterium
PAVPWPPWPPLPPVPPTPPSPELP

SEQ ID NO: 842871 - protein, 18 aa, Mycobacterium
PAVRAAFLLVNDLAVLTL

SEQ ID NO: 842872 - protein, 20 aa, Mycobacterium
PAVRLRIGGQWRSGTAHLLP

SEQ ID NO: 842873 - protein, 19 aa, Mycobacterium
PAVRRAVAATRNGRIGVIG

SEQ ID NO: 842874 - protein, 23 aa, Mycobacterium
PAVRSWFARLPSARLFNHYGPTE

SEQ ID NO: 842875 - protein, 17 aa, Mycobacterium
PAVSASLPEFPWDTLAD

SEQ ID NO: 842876 - protein, 22 aa, Mycobacterium
PAVSQMLLPDVPLVEAQDVTEA

SEQ ID NO: 842877 - protein, 20 aa, Mycobacterium
PAVSTVLYPGLPEHPGHDIA

SEQ ID NO: 842878 - protein, 17 aa, Mycobacterium
PAVTAGATVPAVVAARA

SEQ ID NO: 842879 - protein, 23 aa, Mycobacterium
PAVTALAWLTPPAEGFTPSASVE

SEQ ID NO: 842880 - protein, 18 aa, Mycobacterium
PAVTARRRLRMICHGLGH

SEQ ID NO: 842881 - protein, 18 aa, Mycobacterium
PAVTPGYWNLPNEQYFVD

SEQ ID NO: 842882 - protein, 19 aa, Mycobacterium
PAVVDAMWSSGLMSAFNPS

SEQ ID NO: 842883 - protein, 32 aa, Mycobacterium
PAVVPLSFAQSRLWFLDQLQGPSPVYNMAAAM

SEQ ID NO: 842884 - protein, 20 aa, Mycobacterium
PAVWRVVALVFNPLAAFLTT

SEQ ID NO: 842885 - protein, 23 aa, Mycobacterium
PAVYDQLMIAAQTLERLAADVQD

SEQ ID NO: 842886 - protein, 17 aa, Mycobacterium
PAVYLKRVTRTGFEDGL

SEQ ID NO: 842887 - protein, 18 aa, Mycobacterium
PAVYRYVCDALGVAPADC

SEQ ID NO: 842888 - protein, 20 aa, Mycobacterium
PAWALRGGVLRRGAPVPTPC

SEQ ID NO: 842889 - protein, 21 aa, Mycobacterium
PAWAPLRVQYADYAAWQGAFL

SEQ ID NO: 842890 - protein, 24 aa, Mycobacterium
PAWAYSVIALRWAAKYYAAEREFA

SEQ ID NO: 842891 - protein, 22 aa, Mycobacterium
PAWGYEPVLKLYRQIEDWQGTG

SEQ ID NO: 842892 - protein, 17 aa, Mycobacterium
PAWLMDTLGLTDSARTT

SEQ ID NO: 842893 - protein, 22 aa, Mycobacterium
PAWMGRLTNRWTLRPAGVGTEV

SEQ ID NO: 842894 - protein, 20 aa, Mycobacterium
PAWVTLLRSAGAHDTYLRTY

SEQ ID NO: 842895 - protein, 18 aa, Mycobacterium
PAYAELRPDAWLSETVRA

SEQ ID NO: 842896 - protein, 23 aa, Mycobacterium
PAYGARPGWLYDLTRRHPDASVG

SEQ ID NO: 842897 - protein, 20 aa, Mycobacterium
PAYGLAFRLLSSAHENVITG

SEQ ID NO: 842898 - protein, 20 aa, Mycobacterium
PAYGTLPEHTTWRNFAPRGS

SEQ ID NO: 842899 - protein, 22 aa, Mycobacterium
PAYGYLHRMLQFLQWQKRQRGQ

SEQ ID NO: 842900 - protein, 17 aa, Mycobacterium
PAYIAGDLAYYLDKRER

SEQ ID NO: 842901 - protein, 20 aa, Mycobacterium
PAYLAHLHCPPALPSLAAEV

SEQ ID NO: 842902 - protein, 27 aa, Mycobacterium
PAYMVPAAVVVLDRLPLTPAGKLDVRA

SEQ ID NO: 842903 - protein, 25 aa, Mycobacterium
PAYNLTLFLSQLAQGDLRAAIELPL

SEQ ID NO: 842904 - protein, 21 aa, Mycobacterium
PAYQPALAAAFGQWQSLLADG

SEQ ID NO: 842905 - protein, 21 aa, Mycobacterium
PAYREIFFDRLPDALGMLAAD

SEQ ID NO: 842906 - protein, 24 aa, Mycobacterium
PAYRRQLEYFGLEDVGLALSEMAH

SEQ ID NO: 842907 - protein, 17 aa, Mycobacterium
PAYRYHRMFLQHLQSGV

SEQ ID NO: 842908 - protein, 27 aa, Mycobacterium
PAYSGVLGRLWLARGGTYVLANIRGGG

SEQ ID NO: 842909 - protein, 19 aa, Mycobacterium
PAYTLSKYGMTLLSLGWAA

SEQ ID NO: 842910 - protein, 30 aa, Mycobacterium
PAYVDPRWVRWLPLLPLDRSLSVSIVHADD

SEQ ID NO: 842911 - protein, 17 aa, Mycobacterium
PAYYLPREAFAEGSLRA

SEQ ID NO: 842912 - protein, 18 aa, Mycobacterium
PCDIGYTMLGFHVTDFDA

SEQ ID NO: 842913 - protein, 17 aa, Mycobacterium
PCDSSVMNLMTLFMGHL

SEQ ID NO: 842914 - protein, 18 aa, Mycobacterium
PCDYLWDHHLPIAHGTGL

SEQ ID NO: 842915 - protein, 19 aa, Mycobacterium
PCEPFRPDLVFAEAASLGL

SEQ ID NO: 842916 - protein, 26 aa, Mycobacterium
PCEQIDFWRFNVAFAQQILAQQPISG

SEQ ID NO: 842917 - protein, 29 aa, Mycobacterium
PCEQIDFWRFNVAFARQILAQQPISGPGE

SEQ ID NO: 842918 - protein, 30 aa, Mycobacterium
PCFHDMGMTGYLTVPMYFGAELVKITPMDF

SEQ ID NO: 842919 - protein, 18 aa, Mycobacterium
PCFPNQPGCLQIYATPQP

SEQ ID NO: 842920 - protein, 20 aa, Mycobacterium
PCGKPQPGYLPVLRAYDYSG

SEQ ID NO: 842921 - protein, 30 aa, Mycobacterium
PCGKYLVVMVGLWLPLLAESGDLDRPFATE

SEQ ID NO: 842922 - protein, 19 aa, Mycobacterium
PCGWLKDKYGLAWQVTPSE

SEQ ID NO: 842923 - protein, 17 aa, Mycobacterium
PCHAFSANAAWQEIILA

SEQ ID NO: 842924 - protein, 27 aa, Mycobacterium
PCHVHAHYATYPALAAWVCHRLAGTSY

SEQ ID NO: 842925 - protein, 24 aa, Mycobacterium
PCIYNKHMIFPKPGVDLSNPDNFA

SEQ ID NO: 842926 - protein, 25 aa, Mycobacterium
PCIYNKHMIFPKPGVDLSNPDSFAS

SEQ ID NO: 842927 - protein, 17 aa, Mycobacterium
PCLAPQPCLDLYEAVRA

SEQ ID NO: 842928 - protein, 19 aa, Mycobacterium
PCLLITQRVWGANPITKLA

SEQ ID NO: 842929 - protein, 17 aa, Mycobacterium
PCLSIHAAIVFTSPNPR

SEQ ID NO: 842930 - protein, 25 aa, Mycobacterium
PCLVYLQQMLDLKILLNVAFDGEKL

SEQ ID NO: 842931 - protein, 23 aa, Mycobacterium
PCLVYLQQMLDLKILLSHVFDGE

SEQ ID NO: 842932 - protein, 22 aa, Mycobacterium
PCLVYLQQMLDLKVLLNHVFDG

SEQ ID NO: 842933 - protein, 24 aa, Mycobacterium
PCPLTVIEFFQGRSLPFQEGFGMT

SEQ ID NO: 842934 - protein, 23 aa, Mycobacterium
PCPNGLLCWAKPAGSVPFGAPGS

SEQ ID NO: 842935 - protein, 24 aa, Mycobacterium
PCREGTYWLVRILQRLESGEGKAE

SEQ ID NO: 842936 - protein, 17 aa, Mycobacterium
PCRHRSTALRIAGTAAA

SEQ ID NO: 842937 - protein, 26 aa, Mycobacterium
PCTPRGIVHLLRRFDVPIAGAHVVVI

SEQ ID NO: 842938 - protein, 22 aa, Mycobacterium
PCTTFDKWQLIPVLDDDGIVVD

SEQ ID NO: 842939 - protein, 18 aa, Mycobacterium
PCVFLVQNNQWAISTPVH

SEQ ID NO: 842940 - protein, 24 aa, Mycobacterium
PCVYNKHMIFPKPGVDLSDPDSFA

SEQ ID NO: 842941 - protein, 24 aa, Mycobacterium
PCVYNKHMIFPKPGVDLSNPDNFA

SEQ ID NO: 842942 - protein, 25 aa, Mycobacterium
PCVYSKHMVIPKPGTDFTDPAAFAS

SEQ ID NO: 842943 - protein, 18 aa, Mycobacterium
PCWKVHLDTGLASDDTPA

SEQ ID NO: 842944 - protein, 17 aa, Mycobacterium
PCYIFHVANAYETTSAD

SEQ ID NO: 842945 - protein, 18 aa, Mycobacterium
PCYRGPEDLAAIESIPLS

SEQ ID NO: 842946 - protein, 25 aa, Mycobacterium
PDAAAVTVNFRFAPDRSVPDALQHV

SEQ ID NO: 842947 - protein, 25 aa, Mycobacterium
PDAAAVTVNFRFAPDRSVTAALQHV

SEQ ID NO: 842948 - protein, 24 aa, Mycobacterium
PDAAEGFILDGYPRSVEQAGALKD

SEQ ID NO: 842949 - protein, 24 aa, Mycobacterium
PDAANGFILDGYPRSVEQAKALHE

SEQ ID NO: 842950 - protein, 25 aa, Mycobacterium
PDAANLVTAWRLLQSADPRLRTHRI

SEQ ID NO: 842951 - protein, 19 aa, Mycobacterium
PDAAPPWLRPLLDNVGHVP

SEQ ID NO: 842952 - protein, 28 aa, Mycobacterium
PDAAQWIVRVVLSLAYWPLASSRVERNV

SEQ ID NO: 842953 - protein, 17 aa, Mycobacterium
PDAARSLGKSMRIFKSE

SEQ ID NO: 842954 - protein, 20 aa, Mycobacterium
PDAASVTVNFRFAPDRDVDQ

SEQ ID NO: 842955 - protein, 18 aa, Mycobacterium
PDAASVTVNFRFAPDRTI

SEQ ID NO: 842956 - protein, 25 aa, Mycobacterium
PDAATLWLELARKFLPEALPRRFGN

SEQ ID NO: 842957 - protein, 25 aa, Mycobacterium
PDAAYWVENLCAPVLFPAAIGRLFD

SEQ ID NO: 842958 - protein, 33 aa, Mycobacterium
PDADARDLAVFFLTGLYALLATGAHHSPTADAV

SEQ ID NO: 842959 - protein, 18 aa, Mycobacterium
PDADIYRSLPGLGVVLGA

SEQ ID NO: 842960 - protein, 22 aa, Mycobacterium
PDADLVFFFDRRELPLVVSGDD

SEQ ID NO: 842961 - protein, 30 aa, Mycobacterium
PDAEPPFEAALTALLPQLSPPRPGMRVPVL

SEQ ID NO: 842962 - protein, 28 aa, Mycobacterium
PDAEPVQPLYARYWLHNRGPAPLGGLPA

SEQ ID NO: 842963 - protein, 18 aa, Mycobacterium
PDAFARAAAILAALPQPF

SEQ ID NO: 842964 - protein, 20 aa, Mycobacterium
PDAFPLIITHGWPGSIVEFQ

SEQ ID NO: 842965 - protein, 20 aa, Mycobacterium
PDAHGEVFPFVFTAARLTEH

SEQ ID NO: 842966 - protein, 19 aa, Mycobacterium
PDAIIQLGTNLRFGALAPR

SEQ ID NO: 842967 - protein, 21 aa, Mycobacterium
PDAILAYYRNSGSVYEVFAEL

SEQ ID NO: 842968 - protein, 24 aa, Mycobacterium
PDALAHWTLPRLVGTAVAAELLLT

SEQ ID NO: 842969 - protein, 30 aa, Mycobacterium
PDALPEVRLTAPILLLDGASMWFRSYFGVP

SEQ ID NO: 842970 - protein, 17 aa, Mycobacterium
PDALPLDAAAPLLCAGI

SEQ ID NO: 842971 - protein, 17 aa, Mycobacterium
PDALVLWEAQFGDFVNG

SEQ ID NO: 842972 - protein, 20 aa, Mycobacterium
PDALVRFVDACHAKGLGVLI

SEQ ID NO: 842973 - protein, 18 aa, Mycobacterium
PDALYLRMDERCARIIVT

SEQ ID NO: 842974 - protein, 23 aa, Mycobacterium
PDAMAWPLLAVIDSSLDEPWCRT

SEQ ID NO: 842975 - protein, 17 aa, Mycobacterium
PDAMEEWLMDPVGFRPE

SEQ ID NO: 842976 - protein, 27 aa, Mycobacterium
PDAMTKLTVLLPLKQGVAVYAALHQAA

SEQ ID NO: 842977 - protein, 21 aa, Mycobacterium
PDAMVWPLLGVIDESLDEPWC

SEQ ID NO: 842978 - protein, 26 aa, Mycobacterium
PDAPADFWTPQLFVDEFHAVCTALGI

SEQ ID NO: 842979 - protein, 27 aa, Mycobacterium
PDAPATLRDFLLTLRKKSDHGGPFEYR

SEQ ID NO: 842980 - protein, 23 aa, Mycobacterium
PDAPKHQGITYFLLDMKSPGVEV

SEQ ID NO: 842981 - protein, 30 aa, Mycobacterium
PDAPKPKRLTLFLLPMDRPGFTVRPIPSML

SEQ ID NO: 842982 - protein, 21 aa, Mycobacterium
PDAPLWNHHCGDRLNREALDR

SEQ ID NO: 842983 - protein, 20 aa, Mycobacterium
PDAPPLDRLIAFGRERICFV

SEQ ID NO: 842984 - protein, 25 aa, Mycobacterium
PDAPRVVLLGIPTRGVILAERLAGN

SEQ ID NO: 842985 - protein, 25 aa, Mycobacterium
PDAPRVVLLGIPTRGVILAERLATH

SEQ ID NO: 842986 - protein, 26 aa, Mycobacterium
PDAPTLSGFWHWAVANLPADVTELPA

SEQ ID NO: 842987 - protein, 25 aa, Mycobacterium
PDAQGPWHLVADRSTITFKIKNMWG

SEQ ID NO: 842988 - protein, 26 aa, Mycobacterium
PDAQQDWLRAFGAPNPRFLQRMTLVL

SEQ ID NO: 842989 - protein, 24 aa, Mycobacterium
PDARDWTYLPVGPFPTAQSYRAWA

SEQ ID NO: 842990 - protein, 20 aa, Mycobacterium
PDARILLCSSVSGLWGGHGH

SEQ ID NO: 842991 - protein, 24 aa, Mycobacterium
PDARLLAVGFLGDAPVVTAEAFRR

SEQ ID NO: 842992 - protein, 22 aa, Mycobacterium
PDARLRAALLSAVLMVVASQRY

SEQ ID NO: 842993 - protein, 26 aa, Mycobacterium
PDARPTVWLGVPRVWHKIKVGIETKL

SEQ ID NO: 842994 - protein, 22 aa, Mycobacterium
PDASMLLLSNRILPAAGMHHMS

SEQ ID NO: 842995 - protein, 28 aa, Mycobacterium
PDASYFVLVFAVGAFPPGIGPNAVTEDE

SEQ ID NO: 842996 - protein, 27 aa, Mycobacterium
PDATRDAYLPGLWFKTGDRADVDENGW

SEQ ID NO: 842997 - protein, 36 aa, Mycobacterium
PDAVAMLDTAYLGHVIVLWSWALKQPNPDTAESTAV

SEQ ID NO: 842998 - protein, 25 aa, Mycobacterium
PDAVELPGWYRPNPGLARDLAFIAF

SEQ ID NO: 842999 - protein, 27 aa, Mycobacterium
PDAVELPGWYRPNPGLARDLAFIAFSS

SEQ ID NO: 843000 - protein, 23 aa, Mycobacterium
PDAVRVFLSLEAARQFATRSTRV

SEQ ID NO: 843001 - protein, 25 aa, Mycobacterium
PDAVTAAMLPVLIKASAGGGGRGMR

SEQ ID NO: 843002 - protein, 17 aa, Mycobacterium
PDAWFVGELIHGDYAAV

SEQ ID NO: 843003 - protein, 24 aa, Mycobacterium
PDAYPGYLGLMPQGTQVPNEVAAR

SEQ ID NO: 843004 - protein, 19 aa, Mycobacterium
PDAYQVLARQGIYGDFFSF

SEQ ID NO: 843005 - protein, 23 aa, Mycobacterium
PDAYVVRTAWVYRGGDGSDFVAT

SEQ ID NO: 843006 - protein, 26 aa, Mycobacterium
PDCEPLADYLFPAAKILDPFGCENMR

SEQ ID NO: 843007 - protein, 48 aa, Mycobacterium
PDCEPLADYLFPAAKILDPFGLENMRFKWRKWLDFDCNWKVALEAFNE

SEQ ID NO: 843008 - protein, 28 aa, Mycobacterium
PDCEPLADYLFPASKILEPFGLENMRYK

SEQ ID NO: 843009 - protein, 18 aa, Mycobacterium
PDCGIALATAEPGHHHDK

SEQ ID NO: 843010 - protein, 17 aa, Mycobacterium
PDCHIRWHDVWDHPLQT

SEQ ID NO: 843011 - protein, 18 aa, Mycobacterium
PDCPKPRTGIILAAKEFL

SEQ ID NO: 843012 - protein, 20 aa, Mycobacterium
PDCQQAVRFGLFHVLQASAR

SEQ ID NO: 843013 - protein, 24 aa, Mycobacterium
PDCQQAVRFGLFHVLQASARAERR

SEQ ID NO: 843014 - protein, 25 aa, Mycobacterium
PDCRRQFLLAYFGDHLPRPCGNCDR

SEQ ID NO: 843015 - protein, 19 aa, Mycobacterium
PDCVVYNPMWIDVDELARI

SEQ ID NO: 843016 - protein, 24 aa, Mycobacterium
PDDAEWPHWQFQAFASVDTKRMPN

SEQ ID NO: 843017 - protein, 23 aa, Mycobacterium
PDDDALWRLELTELAALIRTRQV

SEQ ID NO: 843018 - protein, 27 aa, Mycobacterium
PDDDSPMMFLPGVIVSMWGGQVRSLAD

SEQ ID NO: 843019 - protein, 26 aa, Mycobacterium
PDDDYDYYPLRLPPEITRITASLRLS

SEQ ID NO: 843020 - protein, 26 aa, Mycobacterium
PDDERHMFWFDLMKPMTSNATGREVA

SEQ ID NO: 843021 - protein, 26 aa, Mycobacterium
PDDERHMLWFELMKPMTSSATGREVA

SEQ ID NO: 843022 - protein, 25 aa, Mycobacterium
PDDFSTPLRLLARRIEFTDPRSGVR

SEQ ID NO: 843023 - protein, 17 aa, Mycobacterium
PDDFTAWILAHLRADVV

SEQ ID NO: 843024 - protein, 22 aa, Mycobacterium
PDDFTMYRLRTRRPVRGHEDDH

SEQ ID NO: 843025 - protein, 28 aa, Mycobacterium
PDDFTRPLQLLARTLAFRDPLNGKDVRY

SEQ ID NO: 843026 - protein, 25 aa, Mycobacterium
PDDGRMLLHTILTYTQKQFHEMGVK

SEQ ID NO: 843027 - protein, 32 aa, Mycobacterium
PDDHIRQILPERLHSFFFFNGERIEHLVQASA

SEQ ID NO: 843028 - protein, 24 aa, Mycobacterium
PDDHKAYYPGATPISIRITGDATT

SEQ ID NO: 843029 - protein, 27 aa, Mycobacterium
PDDIKALAHRILRHRLILGFEAVAENV

SEQ ID NO: 843030 - protein, 30 aa, Mycobacterium
PDDLDELSLVLWGIPRISIAFWSMGENERA

SEQ ID NO: 843031 - protein, 26 aa, Mycobacterium
PDDLKFKLVEPLRLLFKDEVRAVGRE

SEQ ID NO: 843032 - protein, 24 aa, Mycobacterium
PDDLLNAVINFLASIRNGVVPILE

SEQ ID NO: 843033 - protein, 30 aa, Mycobacterium
PDDMAPICQMFHTLPIPWVEAEDISNAVLF

SEQ ID NO: 843034 - protein, 22 aa, Mycobacterium
PDDPCLILFTSGTTSGAKAAVH

SEQ ID NO: 843035 - protein, 26 aa, Mycobacterium
PDDPEFRAPWSLAKKKRRSSPLSPLS

SEQ ID NO: 843036 - protein, 18 aa, Mycobacterium
PDDPLLSARQRAVAARGG

SEQ ID NO: 843037 - protein, 18 aa, Mycobacterium
PDDPLLTARQRAITAHGG

SEQ ID NO: 843038 - protein, 29 aa, Mycobacterium
PDDPNLLGYFLVDVPFWGRHPTGAGYPPG

SEQ ID NO: 843039 - protein, 23 aa, Mycobacterium
PDDQLFMPTLAQDVAFGPANFGV

SEQ ID NO: 843040 - protein, 35 aa, Mycobacterium
PDDRLIPLVAGLSELLPWVDLWHGEPDALYGGSSP

SEQ ID NO: 843041 - protein, 23 aa, Mycobacterium
PDDRRRIRWLRDRAGADRARGGG

SEQ ID NO: 843042 - protein, 26 aa, Mycobacterium
PDDRYMRTLDPWVSLGAACAVTSKIR

SEQ ID NO: 843043 - protein, 24 aa, Mycobacterium
PDDRYMRTLDPWVSLGTAAAVTSR

SEQ ID NO: 843044 - protein, 25 aa, Mycobacterium
PDDTAHYLWAWTDRNAGSLRARMFA

SEQ ID NO: 843045 - protein, 25 aa, Mycobacterium
PDDTLVFDRVLRFAGQRVAAVVADT

SEQ ID NO: 843046 - protein, 25 aa, Mycobacterium
PDDVALLLYRQPGPLEIDLPARASQ

SEQ ID NO: 843047 - protein, 23 aa, Mycobacterium
PDDVLTDRWLAGNGAPLPELLPS

SEQ ID NO: 843048 - protein, 23 aa, Mycobacterium
PDEAAVTVNFRFAPDRSPEQALV

SEQ ID NO: 843049 - protein, 25 aa, Mycobacterium
PDEADPLTLLIYTSGSTGTPKGAMY

SEQ ID NO: 843050 - protein, 22 aa, Mycobacterium
PDEALIFEFADDGEFWMLTNMG

SEQ ID NO: 843051 - protein, 19 aa, Mycobacterium
PDEALIFHRGQFVGTATPE

SEQ ID NO: 843052 - protein, 25 aa, Mycobacterium
PDECERLGLPVFVKPARGGSSIGVT

SEQ ID NO: 843053 - protein, 31 aa, Mycobacterium
PDEDSRSPMDPKLYLLWAQANATAGYRYSVE

SEQ ID NO: 843054 - protein, 25 aa, Mycobacterium
PDEFAIVHKLRRVLSGLDAHQAIDL

SEQ ID NO: 843055 - protein, 24 aa, Mycobacterium
PDEFGIVHKLRRVLSGLDSHQAID

SEQ ID NO: 843056 - protein, 24 aa, Mycobacterium
PDEGFVTAVYRWATTGDLASALAA

SEQ ID NO: 843057 - protein, 22 aa, Mycobacterium
PDEGMYAFEQMLRHARTYTGYI

SEQ ID NO: 843058 - protein, 26 aa, Mycobacterium
PDEIAPSYVFFAASQMSSYYSGEVLA

SEQ ID NO: 843059 - protein, 18 aa, Mycobacterium
PDEIGQLVFVTSTGFIAP

SEQ ID NO: 843060 - protein, 26 aa, Mycobacterium
PDELAALGNFLDPATLDYLAGYRFSG

SEQ ID NO: 843061 - protein, 24 aa, Mycobacterium
PDELQLETVCLPRDAFFGRVETVP

SEQ ID NO: 843062 - protein, 24 aa, Mycobacterium
PDELRGFTAIRAWAKQFYPNGLGG

SEQ ID NO: 843063 - protein, 23 aa, Mycobacterium
PDELRTLFLFEALTEAQLAVLCA

SEQ ID NO: 843064 - protein, 17 aa, Mycobacterium
PDELSGLLYSLADPGVS

SEQ ID NO: 843065 - protein, 24 aa, Mycobacterium
PDENADLFWGLRGGKATLGIVTSA

SEQ ID NO: 843066 - protein, 25 aa, Mycobacterium
PDEQAALLVFLGSAAASYVTGQVIW

SEQ ID NO: 843067 - protein, 32 aa, Mycobacterium
PDEQSLVERLIPDFLWIDTEYTAKVSLDGLDR

SEQ ID NO: 843068 - protein, 28 aa, Mycobacterium
PDERGTPPWWPMRQLVRALGADADEVLE

SEQ ID NO: 843069 - protein, 22 aa, Mycobacterium
PDERICLCGNTFGPLFGHIPNL

SEQ ID NO: 843070 - protein, 27 aa, Mycobacterium
PDERPIPIMIELNLGFQPTAQAARDRV

SEQ ID NO: 843071 - protein, 28 aa, Mycobacterium
PDEVAGVILFLLSDLSSYITGQTLLVDG

SEQ ID NO: 843072 - protein, 20 aa, Mycobacterium
PDEVAKVALFLASDLSSYMT

SEQ ID NO: 843073 - protein, 24 aa, Mycobacterium
PDEVPLNFLNPRPGTPFGDLEVLP

SEQ ID NO: 843074 - protein, 17 aa, Mycobacterium
PDEVVAFLKAQHNLIED

SEQ ID NO: 843075 - protein, 22 aa, Mycobacterium
PDEYARLLTYRVELLAHHAATI

SEQ ID NO: 843076 - protein, 19 aa, Mycobacterium
PDFETLLYATAGPVATITL

SEQ ID NO: 843077 - protein, 25 aa, Mycobacterium
PDFFEGVMMPELFMADAIGATGKPM

SEQ ID NO: 843078 - protein, 23 aa, Mycobacterium
PDFFEGVMMPELFMADAMGATGK

SEQ ID NO: 843079 - protein, 22 aa, Mycobacterium
PDFFEGVMMPELFMADATGATG

SEQ ID NO: 843080 - protein, 23 aa, Mycobacterium
PDFFEGVMMPELFMADAVGATGK

SEQ ID NO: 843081 - protein, 27 aa, Mycobacterium
PDFGVITAIPQPLRAVVRSRGLRLAHF

SEQ ID NO: 843082 - protein, 24 aa, Mycobacterium
PDFIEGITAFFEKRPPSFPPLSTQ

SEQ ID NO: 843083 - protein, 21 aa, Mycobacterium
PDFLAELLEIRAALGPLIGRL

SEQ ID NO: 843084 - protein, 36 aa, Mycobacterium
PDFNPLARMASGVYLTFFGSFVFGTPGFPLADVPLS

SEQ ID NO: 843085 - protein, 24 aa, Mycobacterium
PDFRARYPTVPQGISADLIATLEG

SEQ ID NO: 843086 - protein, 18 aa, Mycobacterium
PDFRHNFGVAYDRSLLFG

SEQ ID NO: 843087 - protein, 26 aa, Mycobacterium
PDFSTLRRIPWLPGTAMVMADLSWLD

SEQ ID NO: 843088 - protein, 26 aa, Mycobacterium
PDFTALDFIGPYEVLRFIPDTEVRFV

SEQ ID NO: 843089 - protein, 26 aa, Mycobacterium
PDFVTAAWRKLLTNALAGFMALAGRR

SEQ ID NO: 843090 - protein, 24 aa, Mycobacterium
PDGAKPFDFVFHGGSGSLKSEIEE

SEQ ID NO: 843091 - protein, 26 aa, Mycobacterium
PDGARDLIRAFWPGALSLVVTQAPSL

SEQ ID NO: 843092 - protein, 35 aa, Mycobacterium
PDGARLRVLQDLYARWPFFRTVLSNMAQVLAKADM

SEQ ID NO: 843093 - protein, 24 aa, Mycobacterium
PDGDLLQFLQTTYAAAADLGRWDR

SEQ ID NO: 843094 - protein, 27 aa, Mycobacterium
PDGDPQDLLLLYDLLGIADPQVELPKI

SEQ ID NO: 843095 - protein, 23 aa, Mycobacterium
PDGEDLSWLWDVRFEHFAEAFKT

SEQ ID NO: 843096 - protein, 25 aa, Mycobacterium
PDGEDLSWLWDVRFEHFEKAQVVAA

SEQ ID NO: 843097 - protein, 25 aa, Mycobacterium
PDGEMAWWLLEDSARSTRLALTLER

SEQ ID NO: 843098 - protein, 26 aa, Mycobacterium
PDGGASALLPLLIGRARTARMAMTAE

SEQ ID NO: 843099 - protein, 20 aa, Mycobacterium
PDGGAWLYAETVRYIKDLNP

SEQ ID NO: 843100 - protein, 20 aa, Mycobacterium
PDGGLLPSWTPGGHIDVLLP

SEQ ID NO: 843101 - protein, 33 aa, Mycobacterium
PDGGRGYLSKIFNDGWMSSYGFLRTRLDGSVQE

SEQ ID NO: 843102 - protein, 26 aa, Mycobacterium
PDGGRRLFVFLGSTIGNLTPGPRAEF

SEQ ID NO: 843103 - protein, 28 aa, Mycobacterium
PDGHTDMLVNPWGLWWQELTASDICVVD

SEQ ID NO: 843104 - protein, 28 aa, Mycobacterium
PDGHTEMLVNPWGLWWQEITASDICVVD

SEQ ID NO: 843105 - protein, 25 aa, Mycobacterium
PDGKVRWFLGIPYAAPPVGDLRWRP

SEQ ID NO: 843106 - protein, 27 aa, Mycobacterium
PDGLDPLIPRLWALQRSAMYRDMSTIG

SEQ ID NO: 843107 - protein, 26 aa, Mycobacterium
PDGLDRGWYVTPTLFASADNAMRIAR

SEQ ID NO: 843108 - protein, 23 aa, Mycobacterium
PDGLTYTFKIKQGVKFHDGTPLD

SEQ ID NO: 843109 - protein, 18 aa, Mycobacterium
PDGNHHPDLCPHGCYPCA

SEQ ID NO: 843110 - protein, 21 aa, Mycobacterium
PDGPELLKRLKALPGFGEQKA

SEQ ID NO: 843111 - protein, 27 aa, Mycobacterium
PDGQTDMLVNPWGLWWQELTASDICTV

SEQ ID NO: 843112 - protein, 27 aa, Mycobacterium
PDGRHRLELASPDRWWAQVQAIPEADI

SEQ ID NO: 843113 - protein, 23 aa, Mycobacterium
PDGRLVLCLHGFPDSAWGWRKFA

SEQ ID NO: 843114 - protein, 25 aa, Mycobacterium
PDGRMGVIDFGAVAPLPGGFPTSLG

SEQ ID NO: 843115 - protein, 22 aa, Mycobacterium
PDGRNYMWVARTVERRAARYGQ

SEQ ID NO: 843116 - protein, 27 aa, Mycobacterium
PDGRPFFCGTYYPKANFLQLLTAVAET

SEQ ID NO: 843117 - protein, 32 aa, Mycobacterium
PDGRPFFCGTYYPKVSFLQLLAAVSETWRTRR

SEQ ID NO: 843118 - protein, 23 aa, Mycobacterium
PDGRPHRFQVTASRFGRSVNVAA

SEQ ID NO: 843119 - protein, 20 aa, Mycobacterium
PDGRVMAAMPRLLGAHYAAV

SEQ ID NO: 843120 - protein, 23 aa, Mycobacterium
PDGRYLYIAGYSGVVTVAPITAG

SEQ ID NO: 843121 - protein, 25 aa, Mycobacterium
PDGSEVRLLLVNLGQRMSAYRNECA

SEQ ID NO: 843122 - protein, 23 aa, Mycobacterium
PDGSFEWRFRPTDPGQLVIREVY

SEQ ID NO: 843123 - protein, 31 aa, Mycobacterium
PDGSPYQVFTPFLRQWHKVGWRAPATSGAAS

SEQ ID NO: 843124 - protein, 28 aa, Mycobacterium
PDGTATARFLIARILFHDWEHEMSPDLH

SEQ ID NO: 843125 - protein, 34 aa, Mycobacterium
PDGTFKKTIRYFKLEKWMAWQRYLLRGGDMDIDT

SEQ ID NO: 843126 - protein, 23 aa, Mycobacterium
PDGTGWRWQTWHLYPTGSGGSVV

SEQ ID NO: 843127 - protein, 25 aa, Mycobacterium
PDGTKGVTVLLFTQGRALAELEFDG

SEQ ID NO: 843128 - protein, 18 aa, Mycobacterium
PDGTLYYMGIFQFDDELV

SEQ ID NO: 843129 - protein, 24 aa, Mycobacterium
PDGVAAWLVLCCRALTAGAQEALS

SEQ ID NO: 843130 - protein, 23 aa, Mycobacterium
PDGVPVWISGPQYAAHYRDKHTQ

SEQ ID NO: 843131 - protein, 25 aa, Mycobacterium
PDGVRFLVGTLLPDGAAPVAQAYAG

SEQ ID NO: 843132 - protein, 27 aa, Mycobacterium
PDGVRVVRQPWWAPVVDIPDGPAVLIT

SEQ ID NO: 843133 - protein, 20 aa, Mycobacterium
PDGVVWLPMNSPGSAVHQRL

SEQ ID NO: 843134 - protein, 18 aa, Mycobacterium
PDGYADYPIAPAAAHFSA

SEQ ID NO: 843135 - protein, 25 aa, Mycobacterium
PDGYRLPVDYAVRITSRGLYVHSAP

SEQ ID NO: 843136 - protein, 25 aa, Mycobacterium
PDGYRLTVDYAVRITGRGLYVHSAP

SEQ ID NO: 843137 - protein, 24 aa, Mycobacterium
PDHASRLLLRVLGIEPPDHELDLW

SEQ ID NO: 843138 - protein, 19 aa, Mycobacterium
PDHDVTIGLVFRARMSEPE

SEQ ID NO: 843139 - protein, 20 aa, Mycobacterium
PDHFLHDMFVHTRGLAEKDL

SEQ ID NO: 843140 - protein, 18 aa, Mycobacterium
PDHIANPGAFLASRLRRL

SEQ ID NO: 843141 - protein, 31 aa, Mycobacterium
PDHIANPGAFLASRLRRLSWTSPDTAPTKAG

SEQ ID NO: 843142 - protein, 22 aa, Mycobacterium
PDHIDPLDALALAIRRIRATNI

SEQ ID NO: 843143 - protein, 30 aa, Mycobacterium
PDHLAKGERILVFLPLAHVLARAITIGAFA

SEQ ID NO: 843144 - protein, 20 aa, Mycobacterium
PDHPLGCKRLVFATDYLKTL

SEQ ID NO: 843145 - protein, 24 aa, Mycobacterium
PDHPMGCKRLVFSSDYLPALTRPN

SEQ ID NO: 843146 - protein, 22 aa, Mycobacterium
PDHPPVGLVVFAGGASSGLDDG

SEQ ID NO: 843147 - protein, 17 aa, Mycobacterium
PDHPWRTMPHEAMTPHV

SEQ ID NO: 843148 - protein, 27 aa, Mycobacterium
PDHTAVAIALLFENFTSVLVGTSGSSG

SEQ ID NO: 843149 - protein, 26 aa, Mycobacterium
PDHVAELFKFFTKCPDWVTYAEQCRL

SEQ ID NO: 843150 - protein, 20 aa, Mycobacterium
PDHVLPGAPVMPVPDKIVEV

SEQ ID NO: 843151 - protein, 26 aa, Mycobacterium
PDHVTELFKFFTKCPDWVTYAEQCRL

SEQ ID NO: 843152 - protein, 24 aa, Mycobacterium
PDHVVGRIVAVLALAALIHRHRTG

SEQ ID NO: 843153 - protein, 19 aa, Mycobacterium
PDIADLLRLRLDAAGLAGA

SEQ ID NO: 843154 - protein, 20 aa, Mycobacterium
PDIAQYYRRRFRHVLVDEYQ

SEQ ID NO: 843155 - protein, 20 aa, Mycobacterium
PDIDIRWRTVTFALVTHSEG

SEQ ID NO: 843156 - protein, 22 aa, Mycobacterium
PDIDIRWRTVTFGLVTHSAGGI

SEQ ID NO: 843157 - protein, 29 aa, Mycobacterium
PDIDLRRTVGWFTTYYPVPLVCGNGSGIQ

SEQ ID NO: 843158 - protein, 20 aa, Mycobacterium
PDIEFSALVASPNGAKRALA

SEQ ID NO: 843159 - protein, 19 aa, Mycobacterium
PDIEFSALVASPNGAKRAV

SEQ ID NO: 843160 - protein, 20 aa, Mycobacterium
PDIEFSALVASPNGARRAIA

SEQ ID NO: 843161 - protein, 19 aa, Mycobacterium
PDIEFSALVASPNGARRAV

SEQ ID NO: 843162 - protein, 24 aa, Mycobacterium
PDIGKYFWSPMPLGDKATSGEDAL

SEQ ID NO: 843163 - protein, 18 aa, Mycobacterium
PDIHVTLIEPLLRRSEFL

SEQ ID NO: 843164 - protein, 30 aa, Mycobacterium
PDIIKVRYYRPRFFGKPFFQLAQALLRGPS

SEQ ID NO: 843165 - protein, 17 aa, Mycobacterium
PDILINNAGLSTLGPVA

SEQ ID NO: 843166 - protein, 22 aa, Mycobacterium
PDIRRLYEELSSYPVPKGGDRG

SEQ ID NO: 843167 - protein, 19 aa, Mycobacterium
PDIRVAAELALPHRRRRDP

SEQ ID NO: 843168 - protein, 21 aa, Mycobacterium
PDISGLVRAIGFRDPAKRLSA

SEQ ID NO: 843169 - protein, 25 aa, Mycobacterium
PDIVHAHDWLVAHPAIALADYYDVP

SEQ ID NO: 843170 - protein, 23 aa, Mycobacterium
PDKIPGVTRLDTGYYGEFGKHPN

SEQ ID NO: 843171 - protein, 18 aa, Mycobacterium
PDKLIIDPGLGFAKTGQH

SEQ ID NO: 843172 - protein, 19 aa, Mycobacterium
PDKLILDPGLGFAKTAHHN

SEQ ID NO: 843173 - protein, 17 aa, Mycobacterium
PDKLSRFVSFVNAPDAA

SEQ ID NO: 843174 - protein, 25 aa, Mycobacterium
PDKRDAVVTPLLLASAYHARRDIPG

SEQ ID NO: 843175 - protein, 30 aa, Mycobacterium
PDKVLRLPSGRWFGAPATGYEIHHGRITRG

SEQ ID NO: 843176 - protein, 23 aa, Mycobacterium
PDKVVRFMLGLANRYGPAFYTSY

SEQ ID NO: 843177 - protein, 17 aa, Mycobacterium
PDLAAFEWAIRAGNIVS

SEQ ID NO: 843178 - protein, 24 aa, Mycobacterium
PDLAEAALAIRSGALWVAANVDPT

SEQ ID NO: 843179 - protein, 22 aa, Mycobacterium
PDLAGAFYLPTLLADVGEQSQA

SEQ ID NO: 843180 - protein, 24 aa, Mycobacterium
PDLAGPFLPRVHAPTLLIVGGNDE

SEQ ID NO: 843181 - protein, 19 aa, Mycobacterium
PDLALVFNEGPDYAAAGVF

SEQ ID NO: 843182 - protein, 25 aa, Mycobacterium
PDLAPPQRIPRPVQVLLVSGRSDAA

SEQ ID NO: 843183 - protein, 25 aa, Mycobacterium
PDLARLYEPMLARQTNRHYGTPTPI

SEQ ID NO: 843184 - protein, 19 aa, Mycobacterium
PDLATFKVQVRKLKNLGLT

SEQ ID NO: 843185 - protein, 24 aa, Mycobacterium
PDLDADWLGHGWLALVRKWIDDAE

SEQ ID NO: 843186 - protein, 33 aa, Mycobacterium
PDLDEAWLADGWLALFRTWLADAQRAGLVEPNA

SEQ ID NO: 843187 - protein, 21 aa, Mycobacterium
PDLDVVYVFRPVERNGMSVGD

SEQ ID NO: 843188 - protein, 32 aa, Mycobacterium
PDLELAMPILPQQALLYRLCGDRNPLHSDPEF

SEQ ID NO: 843189 - protein, 18 aa, Mycobacterium
PDLELLYAGAMFHDIGLT

SEQ ID NO: 843190 - protein, 20 aa, Mycobacterium
PDLERRILLSRVPELPEHIA

SEQ ID NO: 843191 - protein, 28 aa, Mycobacterium
PDLETFAVLPWDTSFARVFCRLYEPDHL

SEQ ID NO: 843192 - protein, 23 aa, Mycobacterium
PDLFDAIRAAGYTRVSLGMQSVA

SEQ ID NO: 843193 - protein, 23 aa, Mycobacterium
PDLGQFGVWLPTRSIEPELAAGI

SEQ ID NO: 843194 - protein, 19 aa, Mycobacterium
PDLGRFGSFGWGVTPQQAK
